United States Patent 7,341,835 (METHODS OF ANALYSIS OF ALTERNATIVE SPLICING IN MOUSE) - sequence listing, part 10

SEQ ID NO: 358961 - DNA, 25 bp, Mus musculus
tccacagtggagatccagacaggcg

SEQ ID NO: 358962 - DNA, 25 bp, Mus musculus
tccacagtgtaaagctctatgtcag

SEQ ID NO: 358963 - DNA, 25 bp, Mus musculus
tccacataaaaggaaattgtgggaa

SEQ ID NO: 358964 - DNA, 25 bp, Mus musculus
tccacatacaagggacagtggcaca

SEQ ID NO: 358965 - DNA, 25 bp, Mus musculus
tccacatcaactacgggtatttggc

SEQ ID NO: 358966 - DNA, 25 bp, Mus musculus
tccacatcctctgatcggttaagca

SEQ ID NO: 358967 - DNA, 25 bp, Mus musculus
tccacatgcaggcttcccgaggagg

SEQ ID NO: 358968 - DNA, 25 bp, Mus musculus
tccacatgcaggtgtggtacatcca

SEQ ID NO: 358969 - DNA, 25 bp, Mus musculus
tccacattccccagcctctgcagac

SEQ ID NO: 358970 - DNA, 25 bp, Mus musculus
tccacattccccaggctctgcagac

SEQ ID NO: 358971 - DNA, 25 bp, Mus musculus
tccacattcgagatggtggagtata

SEQ ID NO: 358972 - DNA, 25 bp, Mus musculus
tccacattcgagatgttcctcctgc

SEQ ID NO: 358973 - DNA, 25 bp, Mus musculus
tccacattgagagcaccaagaccgg

SEQ ID NO: 358974 - DNA, 25 bp, Mus musculus
tccacatttgagaacggccggtttg

SEQ ID NO: 358975 - DNA, 25 bp, Mus musculus
tccacatttgagtgtgaagtgaggg

SEQ ID NO: 358976 - DNA, 25 bp, Mus musculus
tccacatttggagcccttacagagg

SEQ ID NO: 358977 - DNA, 25 bp, Mus musculus
tccaccaactcaagaggcccaggag

SEQ ID NO: 358978 - DNA, 25 bp, Mus musculus
tccaccacagataactctcttcact

SEQ ID NO: 358979 - DNA, 25 bp, Mus musculus
tccaccacagatgaagaagaagatg

SEQ ID NO: 358980 - DNA, 25 bp, Mus musculus
tccaccacaggaggaaaaagaaatg

SEQ ID NO: 358981 - DNA, 25 bp, Mus musculus
tccaccaccaggtattccaataact

SEQ ID NO: 358982 - DNA, 25 bp, Mus musculus
tccaccacctggatcgagaactcgc

SEQ ID NO: 358983 - DNA, 25 bp, Mus musculus
tccaccacggatacttgtaagcggt

SEQ ID NO: 358984 - DNA, 25 bp, Mus musculus
tccaccactcaggtgttttctctgg

SEQ ID NO: 358985 - DNA, 25 bp, Mus musculus
tccaccactgagtttgaagagcccc

SEQ ID NO: 358986 - DNA, 25 bp, Mus musculus
tccaccagatgctgagcaactacat

SEQ ID NO: 358987 - DNA, 25 bp, Mus musculus
tccaccagcaggttcagcagctcca

SEQ ID NO: 358988 - DNA, 25 bp, Mus musculus
tccaccagctcagttaatggaaccc

SEQ ID NO: 358989 - DNA, 25 bp, Mus musculus
tccaccaggcagcatctgaggacct

SEQ ID NO: 358990 - DNA, 25 bp, Mus musculus
tccaccaggccaaagattatttgta

SEQ ID NO: 358991 - DNA, 25 bp, Mus musculus
tccaccagtacttggggccttttgc

SEQ ID NO: 358992 - DNA, 25 bp, Mus musculus
tccaccagtacttgggtctgacaag

SEQ ID NO: 358993 - DNA, 25 bp, Mus musculus
tccaccagtcggtgttgactttaag

SEQ ID NO: 358994 - DNA, 25 bp, Mus musculus
tccaccatattcttttgaatatgta

SEQ ID NO: 358995 - DNA, 25 bp, Mus musculus
tccaccatcaagaaccatgagttta

SEQ ID NO: 358996 - DNA, 25 bp, Mus musculus
tccaccatcaagagcaccccatctg

SEQ ID NO: 358997 - DNA, 25 bp, Mus musculus
tccaccatcatctggctatgtataa

SEQ ID NO: 358998 - DNA, 25 bp, Mus musculus
tccaccatctggtgagtgaaccccc

SEQ ID NO: 358999 - DNA, 25 bp, Mus musculus
tccaccattactctacggctggccc

SEQ ID NO: 359000 - DNA, 25 bp, Mus musculus
tccaccattggctggattgctgctg

SEQ ID NO: 359001 - DNA, 25 bp, Mus musculus
tccaccatttcagagtcagcttgcg

SEQ ID NO: 359002 - DNA, 25 bp, Mus musculus
tccacccaagggtacagcatgtttg

SEQ ID NO: 359003 - DNA, 25 bp, Mus musculus
tccacccacctctcactccccatgg

SEQ ID NO: 359004 - DNA, 25 bp, Mus musculus
tccacccagagaagatgtgagccca

SEQ ID NO: 359005 - DNA, 25 bp, Mus musculus
tccacccagcaagaaaaagccacaa

SEQ ID NO: 359006 - DNA, 25 bp, Mus musculus
tccacccatgagaagctgcccatgg

SEQ ID NO: 359007 - DNA, 25 bp, Mus musculus
tccaccccaaacagtgtcaccccgc

SEQ ID NO: 359008 - DNA, 25 bp, Mus musculus
tccaccccaagaaaaagctccctgt

SEQ ID NO: 359009 - DNA, 25 bp, Mus musculus
tccaccccaagtaagaagactagca

SEQ ID NO: 359010 - DNA, 25 bp, Mus musculus
tccaccccaagtaagataccaaggt

SEQ ID NO: 359011 - DNA, 25 bp, Mus musculus
tccaccccacaggtatatacggtgc

SEQ ID NO: 359012 - DNA, 25 bp, Mus musculus
tccaccccagactctgcagaggacg

SEQ ID NO: 359013 - DNA, 25 bp, Mus musculus
tccacccccagaaacgtgtgccgtc

SEQ ID NO: 359014 - DNA, 25 bp, Mus musculus
tccacccccgcctcccagacagaca

SEQ ID NO: 359015 - DNA, 25 bp, Mus musculus
tccacccgagaagacagcatgaaga

SEQ ID NO: 359016 - DNA, 25 bp, Mus musculus
tccacccgagcactgtctatggagg

SEQ ID NO: 359017 - DNA, 25 bp, Mus musculus
tccacccgagtggcccatcctcagg

SEQ ID NO: 359018 - DNA, 25 bp, Mus musculus
tccacccgcgagggtggcccgaggc

SEQ ID NO: 359019 - DNA, 25 bp, Mus musculus
tccacccgcgggggccctagctgct

SEQ ID NO: 359020 - DNA, 25 bp, Mus musculus
tccaccctaaaggagcggttccagt

SEQ ID NO: 359021 - DNA, 25 bp, Mus musculus
tccaccctgacaggatgcaagctgt

SEQ ID NO: 359022 - DNA, 25 bp, Mus musculus
tccaccctgacaggcaggtaccacc

SEQ ID NO: 359023 - DNA, 25 bp, Mus musculus
tccaccctgacaggggcataaggac

SEQ ID NO: 359024 - DNA, 25 bp, Mus musculus
tccaccctgcacctggtccttcgcc

SEQ ID NO: 359025 - DNA, 25 bp, Mus musculus
tccacccttgagtcaagtccatcat

SEQ ID NO: 359026 - DNA, 25 bp, Mus musculus
tccaccgaccagtggccacagttaa

SEQ ID NO: 359027 - DNA, 25 bp, Mus musculus
tccaccgacctgatcaagggatcaa

SEQ ID NO: 359028 - DNA, 25 bp, Mus musculus
tccaccgcagctgagatcgattata

SEQ ID NO: 359029 - DNA, 25 bp, Mus musculus
tccaccgcagtgtgaagaaaaaggg

SEQ ID NO: 359030 - DNA, 25 bp, Mus musculus
tccaccgcggagatggatggccttt

SEQ ID NO: 359031 - DNA, 25 bp, Mus musculus
tccaccgcgggaccttctgtctccc

SEQ ID NO: 359032 - DNA, 25 bp, Mus musculus
tccaccgctcaacaggtttgatggc

SEQ ID NO: 359033 - DNA, 25 bp, Mus musculus
tccaccgctcaacagttcccttctt

SEQ ID NO: 359034 - DNA, 25 bp, Mus musculus
tccaccgtgaaccacccattcctct

SEQ ID NO: 359035 - DNA, 25 bp, Mus musculus
tccaccgtgggaggttctccagtgg

SEQ ID NO: 359036 - DNA, 25 bp, Mus musculus
tccaccgtgggagtggattttgctc

SEQ ID NO: 359037 - DNA, 25 bp, Mus musculus
tccaccgttgtggccagaaccccgt

SEQ ID NO: 359038 - DNA, 25 bp, Mus musculus
tccacctaaaagtgctggacgagcc

SEQ ID NO: 359039 - DNA, 25 bp, Mus musculus
tccacctaaagagccactggacatg

SEQ ID NO: 359040 - DNA, 25 bp, Mus musculus
tccacctaaagtactgaccaagtgc

SEQ ID NO: 359041 - DNA, 25 bp, Mus musculus
tccacctaccaggagaactatgagc

SEQ ID NO: 359042 - DNA, 25 bp, Mus musculus
tccacctaccagtgaaatcaactct

SEQ ID NO: 359043 - DNA, 25 bp, Mus musculus
tccacctagggactgccgcttcgct

SEQ ID NO: 359044 - DNA, 25 bp, Mus musculus
tccacctcaaagagttgaaaagagc

SEQ ID NO: 359045 - DNA, 25 bp, Mus musculus
tccacctcaaaggtctgtgttggaa

SEQ ID NO: 359046 - DNA, 25 bp, Mus musculus
tccacctcacagaatagcattcctt

SEQ ID NO: 359047 - DNA, 25 bp, Mus musculus
tccacctcacagaggagcagggaca

SEQ ID NO: 359048 - DNA, 25 bp, Mus musculus
tccacctcacagattcccggtcggg

SEQ ID NO: 359049 - DNA, 25 bp, Mus musculus
tccacctccacagcacaagagcaag

SEQ ID NO: 359050 - DNA, 25 bp, Mus musculus
tccacctcctccacggagcaggagc

SEQ ID NO: 359051 - DNA, 25 bp, Mus musculus
tccacctcctccacggagcgagagg

SEQ ID NO: 359052 - DNA, 25 bp, Mus musculus
tccacctcctgagaaattagaagga

SEQ ID NO: 359053 - DNA, 25 bp, Mus musculus
tccacctcctgagaccatggtatct

SEQ ID NO: 359054 - DNA, 25 bp, Mus musculus
tccacctcctgagtctagccgccgg

SEQ ID NO: 359055 - DNA, 25 bp, Mus musculus
tccacctccttaaaaatataactgt

SEQ ID NO: 359056 - DNA, 25 bp, Mus musculus
tccacctcttccgaggacccacact

SEQ ID NO: 359057 - DNA, 25 bp, Mus musculus
tccacctgcttgcagacctgatgca

SEQ ID NO: 359058 - DNA, 25 bp, Mus musculus
tccacctgcttgcaggcgatcctaa

SEQ ID NO: 359059 - DNA, 25 bp, Mus musculus
tccacctgcttgcaggtggctttgc

SEQ ID NO: 359060 - DNA, 25 bp, Mus musculus
tccacctgtcagacccgccaggagt

SEQ ID NO: 359061 - DNA, 25 bp, Mus musculus
tccacctgtgaggtttcaagtgccc

SEQ ID NO: 359062 - DNA, 25 bp, Mus musculus
tccacctgtgggtccttgctgccaa

SEQ ID NO: 359063 - DNA, 25 bp, Mus musculus
tccaccttcaagcttcagaacatgg

SEQ ID NO: 359064 - DNA, 25 bp, Mus musculus
tccaccttcaatttggaaggcctct

SEQ ID NO: 359065 - DNA, 25 bp, Mus musculus
tccaccttcagacccaggcctgctc

SEQ ID NO: 359066 - DNA, 25 bp, Mus musculus
tccaccttcagcaacaacacttgat

SEQ ID NO: 359067 - DNA, 25 bp, Mus musculus
tccaccttctctctcttcctcctgg

SEQ ID NO: 359068 - DNA, 25 bp, Mus musculus
tccacgacagctccctcttgatgtg

SEQ ID NO: 359069 - DNA, 25 bp, Mus musculus
tccacgagagtgagttccaggacag

SEQ ID NO: 359070 - DNA, 25 bp, Mus musculus
tccacgagcgctcaggagaaatatg

SEQ ID NO: 359071 - DNA, 25 bp, Mus musculus
tccacgatgctccagattctgtccc

SEQ ID NO: 359072 - DNA, 25 bp, Mus musculus
tccacgatgctccaggaggagcctg

SEQ ID NO: 359073 - DNA, 25 bp, Mus musculus
tccacgcagcgctcgaaagaataga

SEQ ID NO: 359074 - DNA, 25 bp, Mus musculus
tccacgccacttgtcggcagctctg

SEQ ID NO: 359075 - DNA, 25 bp, Mus musculus
tccacgccatggatgcagtgaccta

SEQ ID NO: 359076 - DNA, 25 bp, Mus musculus
tccacgccccatggtgtggacattg

SEQ ID NO: 359077 - DNA, 25 bp, Mus musculus
tccacgcctctcgtcagaagaaaga

SEQ ID NO: 359078 - DNA, 25 bp, Mus musculus
tccacgcctgattctggcaggtgat

SEQ ID NO: 359079 - DNA, 25 bp, Mus musculus
tccacgcgccagggaatggacctgt

SEQ ID NO: 359080 - DNA, 25 bp, Mus musculus
tccacgcgggccatcctggccctca

SEQ ID NO: 359081 - DNA, 25 bp, Mus musculus
tccacgctcaagcagcccacacacc

SEQ ID NO: 359082 - DNA, 25 bp, Mus musculus
tccacgctcaaggtgaccctgccct

SEQ ID NO: 359083 - DNA, 25 bp, Mus musculus
tccacgcttcaaggcgcaacctggt

SEQ ID NO: 359084 - DNA, 25 bp, Mus musculus
tccacggaagagtaaagacatttcc

SEQ ID NO: 359085 - DNA, 25 bp, Mus musculus
tccacggagtcagaactgggctctt

SEQ ID NO: 359086 - DNA, 25 bp, Mus musculus
tccacggagtcaggacggggctctt

SEQ ID NO: 359087 - DNA, 25 bp, Mus musculus
tccacggcggtgcaagttgctcccc

SEQ ID NO: 359088 - DNA, 25 bp, Mus musculus
tccacggcggtgcctggagagcatg

SEQ ID NO: 359089 - DNA, 25 bp, Mus musculus
tccacgggaggatgctccagtgctt

SEQ ID NO: 359090 - DNA, 25 bp, Mus musculus
tccacggtattgagttggtcacaat

SEQ ID NO: 359091 - DNA, 25 bp, Mus musculus
tccacggtccaggaagaatgtttct

SEQ ID NO: 359092 - DNA, 25 bp, Mus musculus
tccacggtgagagtctgggatgtga

SEQ ID NO: 359093 - DNA, 25 bp, Mus musculus
tccacggtgggggacccctgtgcag

SEQ ID NO: 359094 - DNA, 25 bp, Mus musculus
tccacggtgggggattgctgctgga

SEQ ID NO: 359095 - DNA, 25 bp, Mus musculus
tccacgtgagacatggcacaagaac

SEQ ID NO: 359096 - DNA, 25 bp, Mus musculus
tccacgtgagatccttcttaccagc

SEQ ID NO: 359097 - DNA, 25 bp, Mus musculus
tccacgtgcgtgcttcttgccacct

SEQ ID NO: 359098 - DNA, 25 bp, Mus musculus
tccacgtgtgagattccctgctcca

SEQ ID NO: 359099 - DNA, 25 bp, Mus musculus
tccacgttccctgacctcctgtacc

SEQ ID NO: 359100 - DNA, 25 bp, Mus musculus
tccacgttctagattggccgtttga

SEQ ID NO: 359101 - DNA, 25 bp, Mus musculus
tccacgttctaggctcctgtgctag

SEQ ID NO: 359102 - DNA, 25 bp, Mus musculus
tccactaaagactgacacgtttagg

SEQ ID NO: 359103 - DNA, 25 bp, Mus musculus
tccactaaagattcagagtcaccaa

SEQ ID NO: 359104 - DNA, 25 bp, Mus musculus
tccactaacagctctatttcagtgc

SEQ ID NO: 359105 - DNA, 25 bp, Mus musculus
tccactaacagtgcttctctcctcc

SEQ ID NO: 359106 - DNA, 25 bp, Mus musculus
tccactacaagatgaggtctcaata

SEQ ID NO: 359107 - DNA, 25 bp, Mus musculus
tccactacgggcagtgatgatgact

SEQ ID NO: 359108 - DNA, 25 bp, Mus musculus
tccactatagtgagttctctggtga

SEQ ID NO: 359109 - DNA, 25 bp, Mus musculus
tccactatgatatcctcttgtttgc

SEQ ID NO: 359110 - DNA, 25 bp, Mus musculus
tccactattaaaagagggtgcctca

SEQ ID NO: 359111 - DNA, 25 bp, Mus musculus
tccactattggctgggcaatgaatg

SEQ ID NO: 359112 - DNA, 25 bp, Mus musculus
tccactcatcctccttgtgagcagc

SEQ ID NO: 359113 - DNA, 25 bp, Mus musculus
tccactccagatcatgtcatcaggc

SEQ ID NO: 359114 - DNA, 25 bp, Mus musculus
tccactccagctggtggctggcatc

SEQ ID NO: 359115 - DNA, 25 bp, Mus musculus
tccactccagggctctctaagtacc

SEQ ID NO: 359116 - DNA, 25 bp, Mus musculus
tccactccagggtctagagattgtg

SEQ ID NO: 359117 - DNA, 25 bp, Mus musculus
tccactccgacaagatgaaagaaac

SEQ ID NO: 359118 - DNA, 25 bp, Mus musculus
tccactcctagctccaccccccggg

SEQ ID NO: 359119 - DNA, 25 bp, Mus musculus
tccactccttccaggatcccctgcc

SEQ ID NO: 359120 - DNA, 25 bp, Mus musculus
tccactcgcacaccgagagaacaac

SEQ ID NO: 359121 - DNA, 25 bp, Mus musculus
tccactctgaacttaacatctctga

SEQ ID NO: 359122 - DNA, 25 bp, Mus musculus
tccactctgtcaaggcccgagacca

SEQ ID NO: 359123 - DNA, 25 bp, Mus musculus
tccactcttaccgatcagcaccagt

SEQ ID NO: 359124 - DNA, 25 bp, Mus musculus
tccactcttccctcctatcccctgc

SEQ ID NO: 359125 - DNA, 25 bp, Mus musculus
tccactcttgaaagaaaaatgactc

SEQ ID NO: 359126 - DNA, 25 bp, Mus musculus
tccactcttgaagatgccgagatgt

SEQ ID NO: 359127 - DNA, 25 bp, Mus musculus
tccactcttgaaggatgcccaccac

SEQ ID NO: 359128 - DNA, 25 bp, Mus musculus
tccactctttcctcccttggagttc

SEQ ID NO: 359129 - DNA, 25 bp, Mus musculus
tccactgaaacattttaacagtgat

SEQ ID NO: 359130 - DNA, 25 bp, Mus musculus
tccactgaaaccaaggctggtctgc

SEQ ID NO: 359131 - DNA, 25 bp, Mus musculus
tccactgagagcaggagatctggaa

SEQ ID NO: 359132 - DNA, 25 bp, Mus musculus
tccactgagagcattccagtgtcag

SEQ ID NO: 359133 - DNA, 25 bp, Mus musculus
tccactgagcccatggttccaggat

SEQ ID NO: 359134 - DNA, 25 bp, Mus musculus
tccactgcattgaacagcgtctgtt

SEQ ID NO: 359135 - DNA, 25 bp, Mus musculus
tccactgctcaggttgaaggtttga

SEQ ID NO: 359136 - DNA, 25 bp, Mus musculus
tccactgctctggctcgacttcgga

SEQ ID NO: 359137 - DNA, 25 bp, Mus musculus
tccactggcctctcggacctcaggc

SEQ ID NO: 359138 - DNA, 25 bp, Mus musculus
tccactggtgaagaagcaggccagc

SEQ ID NO: 359139 - DNA, 25 bp, Mus musculus
tccactgtaaatggagatcgctctg

SEQ ID NO: 359140 - DNA, 25 bp, Mus musculus
tccactgtcctcactatgcccgacc

SEQ ID NO: 359141 - DNA, 25 bp, Mus musculus
tccactgtgaaaccgagaccaacta

SEQ ID NO: 359142 - DNA, 25 bp, Mus musculus
tccactgtgaaaccggttgttctac

SEQ ID NO: 359143 - DNA, 25 bp, Mus musculus
tccactgtgccactcctgcctggaa

SEQ ID NO: 359144 - DNA, 25 bp, Mus musculus
tccactgtgccagcaccagacccta

SEQ ID NO: 359145 - DNA, 25 bp, Mus musculus
tccactgtgttgccagaaaaagatc

SEQ ID NO: 359146 - DNA, 25 bp, Mus musculus
tccactgttccatgtctccaggaaa

SEQ ID NO: 359147 - DNA, 25 bp, Mus musculus
tccacttactgaactgatggctgcc

SEQ ID NO: 359148 - DNA, 25 bp, Mus musculus
tccacttcaaatggacccataactg

SEQ ID NO: 359149 - DNA, 25 bp, Mus musculus
tccacttcaaatgggaagaagatgg

SEQ ID NO: 359150 - DNA, 25 bp, Mus musculus
tccacttcaaatggggagggtagac

SEQ ID NO: 359151 - DNA, 25 bp, Mus musculus
tccacttcaggtactaaacagaccc

SEQ ID NO: 359152 - DNA, 25 bp, Mus musculus
tccacttcctaaaaggtaaagcacc

SEQ ID NO: 359153 - DNA, 25 bp, Mus musculus
tccacttcctccagaagaagactcc

SEQ ID NO: 359154 - DNA, 25 bp, Mus musculus
tccacttcctgttgtcggtgcctgc

SEQ ID NO: 359155 - DNA, 25 bp, Mus musculus
tccacttctaaacagaattctgatt

SEQ ID NO: 359156 - DNA, 25 bp, Mus musculus
tccacttctaaacagatggatttac

SEQ ID NO: 359157 - DNA, 25 bp, Mus musculus
tccacttctaaggcggcgacagcag

SEQ ID NO: 359158 - DNA, 25 bp, Mus musculus
tccacttgactgggacgtggaacac

SEQ ID NO: 359159 - DNA, 25 bp, Mus musculus
tccacttgcaaaagaggccatgacg

SEQ ID NO: 359160 - DNA, 25 bp, Mus musculus
tccacttggggaagcctgagatggg

SEQ ID NO: 359161 - DNA, 25 bp, Mus musculus
tccacttgtttggttgtggcctacg

SEQ ID NO: 359162 - DNA, 25 bp, Mus musculus
tccactttcaggaccatggtatcta

SEQ ID NO: 359163 - DNA, 25 bp, Mus musculus
tccactttcttgggtctttggggct

SEQ ID NO: 359164 - DNA, 25 bp, Mus musculus
tccactttggacagagttgcaatgt

SEQ ID NO: 359165 - DNA, 25 bp, Mus musculus
tccactttggacagtgttgcaatgt

SEQ ID NO: 359166 - DNA, 25 bp, Mus musculus
tccagaaaaacctccagcgtctcct

SEQ ID NO: 359167 - DNA, 25 bp, Mus musculus
tccagaaaaatgaaactgtgaagtt

SEQ ID NO: 359168 - DNA, 25 bp, Mus musculus
tccagaaaaatgcatcaaagagatg

SEQ ID NO: 359169 - DNA, 25 bp, Mus musculus
tccagaaaacggtttcaggcaccag

SEQ ID NO: 359170 - DNA, 25 bp, Mus musculus
tccagaaaagcccagtggctttggg

SEQ ID NO: 359171 - DNA, 25 bp, Mus musculus
tccagaaaagctctccgtaaattct

SEQ ID NO: 359172 - DNA, 25 bp, Mus musculus
tccagaaaagctgtcttcagacaca

SEQ ID NO: 359173 - DNA, 25 bp, Mus musculus
tccagaaaatccttgccagagatcc

SEQ ID NO: 359174 - DNA, 25 bp, Mus musculus
tccagaaaatccttgctagagaaaa

SEQ ID NO: 359175 - DNA, 25 bp, Mus musculus
tccagaaaatctcagcctccttccc

SEQ ID NO: 359176 - DNA, 25 bp, Mus musculus
tccagaaacgagaagaagcagacca

SEQ ID NO: 359177 - DNA, 25 bp, Mus musculus
tccagaaagaccttgattcagatgg

SEQ ID NO: 359178 - DNA, 25 bp, Mus musculus
tccagaaagaggcgccctgtgcttt

SEQ ID NO: 359179 - DNA, 25 bp, Mus musculus
tccagaaagaggtgggtcttctcag

SEQ ID NO: 359180 - DNA, 25 bp, Mus musculus
tccagaaagatctggccaacatagc

SEQ ID NO: 359181 - DNA, 25 bp, Mus musculus
tccagaaagcagaatgctggcagaa

SEQ ID NO: 359182 - DNA, 25 bp, Mus musculus
tccagaaagccaaagcggaggaaga

SEQ ID NO: 359183 - DNA, 25 bp, Mus musculus
tccagaaagccaagaacagagagta

SEQ ID NO: 359184 - DNA, 25 bp, Mus musculus
tccagaaagtatgcagccctgctgg

SEQ ID NO: 359185 - DNA, 25 bp, Mus musculus
tccagaaagtatgcagccctttgat

SEQ ID NO: 359186 - DNA, 25 bp, Mus musculus
tccagaaagtgatcacagaatacct

SEQ ID NO: 359187 - DNA, 25 bp, Mus musculus
tccagaaagtgctttgcatgggttc

SEQ ID NO: 359188 - DNA, 25 bp, Mus musculus
tccagaaagtggtatcccataaata

SEQ ID NO: 359189 - DNA, 25 bp, Mus musculus
tccagaaatccaagaaaatgtacag

SEQ ID NO: 359190 - DNA, 25 bp, Mus musculus
tccagaaatctgttggtgttctggc

SEQ ID NO: 359191 - DNA, 25 bp, Mus musculus
tccagaaattccaggatgtctgtgt

SEQ ID NO: 359192 - DNA, 25 bp, Mus musculus
tccagaaattccaggattgctgtgt

SEQ ID NO: 359193 - DNA, 25 bp, Mus musculus
tccagaacaaagtctgttcaagatc

SEQ ID NO: 359194 - DNA, 25 bp, Mus musculus
tccagaacaagattcttttcgtcct

SEQ ID NO: 359195 - DNA, 25 bp, Mus musculus
tccagaacaagtttccatagaaccc

SEQ ID NO: 359196 - DNA, 25 bp, Mus musculus
tccagaacacaggctgggaagatgc

SEQ ID NO: 359197 - DNA, 25 bp, Mus musculus
tccagaacagcctgcacttcgctgc

SEQ ID NO: 359198 - DNA, 25 bp, Mus musculus
tccagaacagctatggatttgccag

SEQ ID NO: 359199 - DNA, 25 bp, Mus musculus
tccagaacagctggaggtggctgat

SEQ ID NO: 359200 - DNA, 25 bp, Mus musculus
tccagaacagctgttcctaaggctt

SEQ ID NO: 359201 - DNA, 25 bp, Mus musculus
tccagaacagggaaaggcaggagca

SEQ ID NO: 359202 - DNA, 25 bp, Mus musculus
tccagaacagggcgtgcctaggaca

SEQ ID NO: 359203 - DNA, 25 bp, Mus musculus
tccagaacaggtgaccttggagtgc

SEQ ID NO: 359204 - DNA, 25 bp, Mus musculus
tccagaacagtgtccccgatgaaga

SEQ ID NO: 359205 - DNA, 25 bp, Mus musculus
tccagaaccagaaccggagtgtttt

SEQ ID NO: 359206 - DNA, 25 bp, Mus musculus
tccagaaccagataattagcaccat

SEQ ID NO: 359207 - DNA, 25 bp, Mus musculus
tccagaaccagtgtctgacagttcc

SEQ ID NO: 359208 - DNA, 25 bp, Mus musculus
tccagaacctggagaatgtggttga

SEQ ID NO: 359209 - DNA, 25 bp, Mus musculus
tccagaacgacgtaggtcacccctt

SEQ ID NO: 359210 - DNA, 25 bp, Mus musculus
tccagaactatcccgtggtctccat

SEQ ID NO: 359211 - DNA, 25 bp, Mus musculus
tccagaacttgccatcaatgccttc

SEQ ID NO: 359212 - DNA, 25 bp, Mus musculus
tccagaagaagaaataaagtggagc

SEQ ID NO: 359213 - DNA, 25 bp, Mus musculus
tccagaagacaggactcagctgaga

SEQ ID NO: 359214 - DNA, 25 bp, Mus musculus
tccagaagaccgaatttatctctga

SEQ ID NO: 359215 - DNA, 25 bp, Mus musculus
tccagaagagcaagaacctgggagc

SEQ ID NO: 359216 - DNA, 25 bp, Mus musculus
tccagaagagcaagttaagtttgaa

SEQ ID NO: 359217 - DNA, 25 bp, Mus musculus
tccagaagcagaggacgttcgtaag

SEQ ID NO: 359218 - DNA, 25 bp, Mus musculus
tccagaagcaggtgtccccagaact

SEQ ID NO: 359219 - DNA, 25 bp, Mus musculus
tccagaagccatgggactcgtgggg

SEQ ID NO: 359220 - DNA, 25 bp, Mus musculus
tccagaaggctgaaggcttaactcc

SEQ ID NO: 359221 - DNA, 25 bp, Mus musculus
tccagaagttcctgggtttgatgaa

SEQ ID NO: 359222 - DNA, 25 bp, Mus musculus
tccagaagtttggggacctggaagt

SEQ ID NO: 359223 - DNA, 25 bp, Mus musculus
tccagaataagctgaactcccacct

SEQ ID NO: 359224 - DNA, 25 bp, Mus musculus
tccagaatcagacaggaatctgctt

SEQ ID NO: 359225 - DNA, 25 bp, Mus musculus
tccagaatcagacaggtgatttgaa

SEQ ID NO: 359226 - DNA, 25 bp, Mus musculus
tccagaatggtggccacttggatgc

SEQ ID NO: 359227 - DNA, 25 bp, Mus musculus
tccagaatgtggatcggtcatggga

SEQ ID NO: 359228 - DNA, 25 bp, Mus musculus
tccagaattgattacaacaaccctg

SEQ ID NO: 359229 - DNA, 25 bp, Mus musculus
tccagacaaccaggtcagaaaaccc

SEQ ID NO: 359230 - DNA, 25 bp, Mus musculus
tccagacaacggccccacctgtcaa

SEQ ID NO: 359231 - DNA, 25 bp, Mus musculus
tccagacacagatggaggtagtgag

SEQ ID NO: 359232 - DNA, 25 bp, Mus musculus
tccagacacaggcaactggcccgat

SEQ ID NO: 359233 - DNA, 25 bp, Mus musculus
tccagacaccatgccagcccactca

SEQ ID NO: 359234 - DNA, 25 bp, Mus musculus
tccagacacgcagttacagaccacg

SEQ ID NO: 359235 - DNA, 25 bp, Mus musculus
tccagacacgcattcctgggagatg

SEQ ID NO: 359236 - DNA, 25 bp, Mus musculus
tccagacatctcagagcctgggacc

SEQ ID NO: 359237 - DNA, 25 bp, Mus musculus
tccagacatctcatgggtttgtgga

SEQ ID NO: 359238 - DNA, 25 bp, Mus musculus
tccagacatggagacaacagcttcc

SEQ ID NO: 359239 - DNA, 25 bp, Mus musculus
tccagacattcagagccacaggcac

SEQ ID NO: 359240 - DNA, 25 bp, Mus musculus
tccagaccaaagaagagagggaact

SEQ ID NO: 359241 - DNA, 25 bp, Mus musculus
tccagaccacagggatcacccatca

SEQ ID NO: 359242 - DNA, 25 bp, Mus musculus
tccagaccacaggtccctgtggaaa

SEQ ID NO: 359243 - DNA, 25 bp, Mus musculus
tccagaccagggacggaaactttct

SEQ ID NO: 359244 - DNA, 25 bp, Mus musculus
tccagacccacagacttccaaattg

SEQ ID NO: 359245 - DNA, 25 bp, Mus musculus
tccagacccacagaggctcccaaac

SEQ ID NO: 359246 - DNA, 25 bp, Mus musculus
tccagaccccatttgggttccagtg

SEQ ID NO: 359247 - DNA, 25 bp, Mus musculus
tccagaccccttccaaggtgatcct

SEQ ID NO: 359248 - DNA, 25 bp, Mus musculus
tccagacctcaggtttaacacacaa

SEQ ID NO: 359249 - DNA, 25 bp, Mus musculus
tccagacctggctgcccagacccct

SEQ ID NO: 359250 - DNA, 25 bp, Mus musculus
tccagaccttcacgcatcatgactg

SEQ ID NO: 359251 - DNA, 25 bp, Mus musculus
tccagacgtctgaggacacagactc

SEQ ID NO: 359252 - DNA, 25 bp, Mus musculus
tccagacgtctgaggcagcgggagc

SEQ ID NO: 359253 - DNA, 25 bp, Mus musculus
tccagacgtctgaggtggcttggtt

SEQ ID NO: 359254 - DNA, 25 bp, Mus musculus
tccagactacctgacctcatctttg

SEQ ID NO: 359255 - DNA, 25 bp, Mus musculus
tccagactcgctttgaattcatgag

SEQ ID NO: 359256 - DNA, 25 bp, Mus musculus
tccagactcggggccctgttctccg

SEQ ID NO: 359257 - DNA, 25 bp, Mus musculus
tccagactcggggttctctggaaac

SEQ ID NO: 359258 - DNA, 25 bp, Mus musculus
tccagactgcatggaactacatgaa

SEQ ID NO: 359259 - DNA, 25 bp, Mus musculus
tccagagaaagaggatggaggcctc

SEQ ID NO: 359260 - DNA, 25 bp, Mus musculus
tccagagaacaaggtccttccatag

SEQ ID NO: 359261 - DNA, 25 bp, Mus musculus
tccagagaagatacggactctgacg

SEQ ID NO: 359262 - DNA, 25 bp, Mus musculus
tccagagaaggtgatcatctgtctg

SEQ ID NO: 359263 - DNA, 25 bp, Mus musculus
tccagagaatcttataggatttaaa

SEQ ID NO: 359264 - DNA, 25 bp, Mus musculus
tccagagacaggcagtcatttgaag

SEQ ID NO: 359265 - DNA, 25 bp, Mus musculus
tccagagagagaaccttcacacctg

SEQ ID NO: 359266 - DNA, 25 bp, Mus musculus
tccagagaggcagagacagggcagg

SEQ ID NO: 359267 - DNA, 25 bp, Mus musculus
tccagagaggtgtggagaggatgcc

SEQ ID NO: 359268 - DNA, 25 bp, Mus musculus
tccagagatgaagaccacatagccc

SEQ ID NO: 359269 - DNA, 25 bp, Mus musculus
tccagagatgagatcacatagcatt

SEQ ID NO: 359270 - DNA, 25 bp, Mus musculus
tccagagcaaggttgctcttctggt

SEQ ID NO: 359271 - DNA, 25 bp, Mus musculus
tccagagcaatgagtccagatccga

SEQ ID NO: 359272 - DNA, 25 bp, Mus musculus
tccagagcaatggcacggaatgctg

SEQ ID NO: 359273 - DNA, 25 bp, Mus musculus
tccagagcacagaaaggagcttgaa

SEQ ID NO: 359274 - DNA, 25 bp, Mus musculus
tccagagcacagatacctgactgtc

SEQ ID NO: 359275 - DNA, 25 bp, Mus musculus
tccagagcacccaggcttccactgc

SEQ ID NO: 359276 - DNA, 25 bp, Mus musculus
tccagagcaccctgctgctgaataa

SEQ ID NO: 359277 - DNA, 25 bp, Mus musculus
tccagagcaccgcctcctggctgct

SEQ ID NO: 359278 - DNA, 25 bp, Mus musculus
tccagagcagagtgccagctggacc

SEQ ID NO: 359279 - DNA, 25 bp, Mus musculus
tccagagcatcacgaaatagatatg

SEQ ID NO: 359280 - DNA, 25 bp, Mus musculus
tccagagcatcacgccagtagaaat

SEQ ID NO: 359281 - DNA, 25 bp, Mus musculus
tccagagccagggaagggcaatgcg

SEQ ID NO: 359282 - DNA, 25 bp, Mus musculus
tccagagccggggaatggtctagca

SEQ ID NO: 359283 - DNA, 25 bp, Mus musculus
tccagagccggtttagtctccactg

SEQ ID NO: 359284 - DNA, 25 bp, Mus musculus
tccagagcctctaggccctaggacc

SEQ ID NO: 359285 - DNA, 25 bp, Mus musculus
tccagagcctgtgcttgaggcgagc

SEQ ID NO: 359286 - DNA, 25 bp, Mus musculus
tccagaggaagtagacaatcctcct

SEQ ID NO: 359287 - DNA, 25 bp, Mus musculus
tccagaggaagttgtcctggtcagt

SEQ ID NO: 359288 - DNA, 25 bp, Mus musculus
tccagaggagaggtggtgaaggcat

SEQ ID NO: 359289 - DNA, 25 bp, Mus musculus
tccagaggagaggtgtgaaggcatt

SEQ ID NO: 359290 - DNA, 25 bp, Mus musculus
tccagaggaggtactacaagcctgg

SEQ ID NO: 359291 - DNA, 25 bp, Mus musculus
tccagaggcaagctgagtcaaagca

SEQ ID NO: 359292 - DNA, 25 bp, Mus musculus
tccagaggcagcaagaaaagcagag

SEQ ID NO: 359293 - DNA, 25 bp, Mus musculus
tccagaggcagctgcgagcttccat

SEQ ID NO: 359294 - DNA, 25 bp, Mus musculus
tccagaggcagttagccttacaaga

SEQ ID NO: 359295 - DNA, 25 bp, Mus musculus
tccagaggcggccagcaggtggcca

SEQ ID NO: 359296 - DNA, 25 bp, Mus musculus
tccagagggattcagcacccggagc

SEQ ID NO: 359297 - DNA, 25 bp, Mus musculus
tccagagggattcaggggttccagt

SEQ ID NO: 359298 - DNA, 25 bp, Mus musculus
tccagagggcattgacctagagact

SEQ ID NO: 359299 - DNA, 25 bp, Mus musculus
tccagagggctagatgtggaagatg

SEQ ID NO: 359300 - DNA, 25 bp, Mus musculus
tccagaggtaaaagcgccattccag

SEQ ID NO: 359301 - DNA, 25 bp, Mus musculus
tccagaggtgccgagtaacttgtcg

SEQ ID NO: 359302 - DNA, 25 bp, Mus musculus
tccagaggtgccgcaccatggccag

SEQ ID NO: 359303 - DNA, 25 bp, Mus musculus
tccagaggttaaagataacagtgga

SEQ ID NO: 359304 - DNA, 25 bp, Mus musculus
tccagagtgataatgtgtacaagtc

SEQ ID NO: 359305 - DNA, 25 bp, Mus musculus
tccagagtgggtcatatcggatgta

SEQ ID NO: 359306 - DNA, 25 bp, Mus musculus
tccagatagagctcgccgcctgcag

SEQ ID NO: 359307 - DNA, 25 bp, Mus musculus
tccagatagagtcccaggtaaagat

SEQ ID NO: 359308 - DNA, 25 bp, Mus musculus
tccagatatcctgagcagaggggca

SEQ ID NO: 359309 - DNA, 25 bp, Mus musculus
tccagatatgcaaaccatgtttcct

SEQ ID NO: 359310 - DNA, 25 bp, Mus musculus
tccagatcacagaatacagatatgg

SEQ ID NO: 359311 - DNA, 25 bp, Mus musculus
tccagatcacagcctctgcagaatg

SEQ ID NO: 359312 - DNA, 25 bp, Mus musculus
tccagatcacggaccaggagggaaa

SEQ ID NO: 359313 - DNA, 25 bp, Mus musculus
tccagatcagaaagcctaggacctg

SEQ ID NO: 359314 - DNA, 25 bp, Mus musculus
tccagatcagaaaggcagtttgtgc

SEQ ID NO: 359315 - DNA, 25 bp, Mus musculus
tccagatcagaaagggtgtgtggga

SEQ ID NO: 359316 - DNA, 25 bp, Mus musculus
tccagatcaggatgactctttagaa

SEQ ID NO: 359317 - DNA, 25 bp, Mus musculus
tccagatcagtaggtgcaaactcag

SEQ ID NO: 359318 - DNA, 25 bp, Mus musculus
tccagatcatggttgcccccaaggt

SEQ ID NO: 359319 - DNA, 25 bp, Mus musculus
tccagatcctgaagactgctggagt

SEQ ID NO: 359320 - DNA, 25 bp, Mus musculus
tccagatcctgaagcattcgggaat

SEQ ID NO: 359321 - DNA, 25 bp, Mus musculus
tccagatcctgccggcgagtgagga

SEQ ID NO: 359322 - DNA, 25 bp, Mus musculus
tccagatcctgccggcgctctgaaa

SEQ ID NO: 359323 - DNA, 25 bp, Mus musculus
tccagatctctatggtcccttttgg

SEQ ID NO: 359324 - DNA, 25 bp, Mus musculus
tccagatctgatgaacacaatgatg

SEQ ID NO: 359325 - DNA, 25 bp, Mus musculus
tccagatctgccggatcatgcgtcc

SEQ ID NO: 359326 - DNA, 25 bp, Mus musculus
tccagatctgccgggctgcctctag

SEQ ID NO: 359327 - DNA, 25 bp, Mus musculus
tccagatctggggttggtgtcattt

SEQ ID NO: 359328 - DNA, 25 bp, Mus musculus
tccagatgaagatccaggaggatcc

SEQ ID NO: 359329 - DNA, 25 bp, Mus musculus
tccagatgaagtcaggaggcaagag

SEQ ID NO: 359330 - DNA, 25 bp, Mus musculus
tccagatgagagggaagagtggatg

SEQ ID NO: 359331 - DNA, 25 bp, Mus musculus
tccagatgagagggaagagtgtatt

SEQ ID NO: 359332 - DNA, 25 bp, Mus musculus
tccagatgccttacaagaggagtgg

SEQ ID NO: 359333 - DNA, 25 bp, Mus musculus
tccagatggatccctctatgctgtg

SEQ ID NO: 359334 - DNA, 25 bp, Mus musculus
tccagatggcagcacacgccaaaga

SEQ ID NO: 359335 - DNA, 25 bp, Mus musculus
tccagatggcttcacctgggagaag

SEQ ID NO: 359336 - DNA, 25 bp, Mus musculus
tccagatgtaagtgccctggaactt

SEQ ID NO: 359337 - DNA, 25 bp, Mus musculus
tccagatgtccagatctgctggaac

SEQ ID NO: 359338 - DNA, 25 bp, Mus musculus
tccagatgtccaggtgtggtgcaca

SEQ ID NO: 359339 - DNA, 25 bp, Mus musculus
tccagatgtgaccaggcctgaaggg

SEQ ID NO: 359340 - DNA, 25 bp, Mus musculus
tccagatgtgcagcgccgagtacaa

SEQ ID NO: 359341 - DNA, 25 bp, Mus musculus
tccagatgttccagaagaagctggt

SEQ ID NO: 359342 - DNA, 25 bp, Mus musculus
tccagatgttccaggagggagtatg

SEQ ID NO: 359343 - DNA, 25 bp, Mus musculus
tccagattcaggcgacaactggcca

SEQ ID NO: 359344 - DNA, 25 bp, Mus musculus
tccagattcttggataaggaattgg

SEQ ID NO: 359345 - DNA, 25 bp, Mus musculus
tccagattgctttggcctggagaga

SEQ ID NO: 359346 - DNA, 25 bp, Mus musculus
tccagattgggggcagcaactctta

SEQ ID NO: 359347 - DNA, 25 bp, Mus musculus
tccagatttgcaagacagttcggca

SEQ ID NO: 359348 - DNA, 25 bp, Mus musculus
tccagatttgcaagggagttgattt

SEQ ID NO: 359349 - DNA, 25 bp, Mus musculus
tccagcaaacagatactctgtcaaa

SEQ ID NO: 359350 - DNA, 25 bp, Mus musculus
tccagcaaacagccaaagttgttac

SEQ ID NO: 359351 - DNA, 25 bp, Mus musculus
tccagcaaaccagaagagcccttgg

SEQ ID NO: 359352 - DNA, 25 bp, Mus musculus
tccagcaaagaattgggatatgacc

SEQ ID NO: 359353 - DNA, 25 bp, Mus musculus
tccagcaaaggtttagaccctctgt

SEQ ID NO: 359354 - DNA, 25 bp, Mus musculus
tccagcaaccagaatttcagcttcc

SEQ ID NO: 359355 - DNA, 25 bp, Mus musculus
tccagcaaccagcacccggcagtgc

SEQ ID NO: 359356 - DNA, 25 bp, Mus musculus
tccagcaacttgaggctcctgagca

SEQ ID NO: 359357 - DNA, 25 bp, Mus musculus
tccagcaagcttcggaggggaaaat

SEQ ID NO: 359358 - DNA, 25 bp, Mus musculus
tccagcaaggagattcttccaagaa

SEQ ID NO: 359359 - DNA, 25 bp, Mus musculus
tccagcacacccagcagcccgagca

SEQ ID NO: 359360 - DNA, 25 bp, Mus musculus
tccagcacacttgtatggggatcct

SEQ ID NO: 359361 - DNA, 25 bp, Mus musculus
tccagcacacttgtccaacaaagtt

SEQ ID NO: 359362 - DNA, 25 bp, Mus musculus
tccagcacagaatcgtccttggaaa

SEQ ID NO: 359363 - DNA, 25 bp, Mus musculus
tccagcacagatggatacagtgagt

SEQ ID NO: 359364 - DNA, 25 bp, Mus musculus
tccagcacagccagccatatggaac

SEQ ID NO: 359365 - DNA, 25 bp, Mus musculus
tccagcacaggatgcgggctcctgg

SEQ ID NO: 359366 - DNA, 25 bp, Mus musculus
tccagcacagggacctgaggtgcag

SEQ ID NO: 359367 - DNA, 25 bp, Mus musculus
tccagcacagtcggagccagggaga

SEQ ID NO: 359368 - DNA, 25 bp, Mus musculus
tccagcaccagctcttttgatatag

SEQ ID NO: 359369 - DNA, 25 bp, Mus musculus
tccagcaccagcttgctttctctta

SEQ ID NO: 359370 - DNA, 25 bp, Mus musculus
tccagcaccagtacctcatgcctga

SEQ ID NO: 359371 - DNA, 25 bp, Mus musculus
tccagcacctacgtttgttgaagga

SEQ ID NO: 359372 - DNA, 25 bp, Mus musculus
tccagcacctcagggatttgcaaat

SEQ ID NO: 359373 - DNA, 25 bp, Mus musculus
tccagcacctcagggccaataataa

SEQ ID NO: 359374 - DNA, 25 bp, Mus musculus
tccagcacctcagtgccttcccaga

SEQ ID NO: 359375 - DNA, 25 bp, Mus musculus
tccagcacctgtgaataaaagctgt

SEQ ID NO: 359376 - DNA, 25 bp, Mus musculus
tccagcaccttcagctatctaactt

SEQ ID NO: 359377 - DNA, 25 bp, Mus musculus
tccagcacgcagctttacatggtga

SEQ ID NO: 359378 - DNA, 25 bp, Mus musculus
tccagcacgtacaagagagaaatgt

SEQ ID NO: 359379 - DNA, 25 bp, Mus musculus
tccagcacgtgaggacaagttttta

SEQ ID NO: 359380 - DNA, 25 bp, Mus musculus
tccagcactagggctccttctccta

SEQ ID NO: 359381 - DNA, 25 bp, Mus musculus
tccagcagaactaaagaacgcttct

SEQ ID NO: 359382 - DNA, 25 bp, Mus musculus
tccagcagaagtacgatggaatcat

SEQ ID NO: 359383 - DNA, 25 bp, Mus musculus
tccagcagaattctgagatcttgag

SEQ ID NO: 359384 - DNA, 25 bp, Mus musculus
tccagcagaattctggttttggtaa

SEQ ID NO: 359385 - DNA, 25 bp, Mus musculus
tccagcagacgtcccccgccacagg

SEQ ID NO: 359386 - DNA, 25 bp, Mus musculus
tccagcagaggaaaggagagtgttg

SEQ ID NO: 359387 - DNA, 25 bp, Mus musculus
tccagcagaggtgcagttaaaaact

SEQ ID NO: 359388 - DNA, 25 bp, Mus musculus
tccagcagcacttctcctctctgac

SEQ ID NO: 359389 - DNA, 25 bp, Mus musculus
tccagcagcaggaccagtgtgtggc

SEQ ID NO: 359390 - DNA, 25 bp, Mus musculus
tccagcagcagtttgtgcagtggga

SEQ ID NO: 359391 - DNA, 25 bp, Mus musculus
tccagcagccacagagggagggagc

SEQ ID NO: 359392 - DNA, 25 bp, Mus musculus
tccagcagccacagcgggcagctca

SEQ ID NO: 359393 - DNA, 25 bp, Mus musculus
tccagcagccgagagtacaaacagg

SEQ ID NO: 359394 - DNA, 25 bp, Mus musculus
tccagcagctcagggactcagcgat

SEQ ID NO: 359395 - DNA, 25 bp, Mus musculus
tccagcaggcatccagggcagaagt

SEQ ID NO: 359396 - DNA, 25 bp, Mus musculus
tccagcagggagagcagagacggta

SEQ ID NO: 359397 - DNA, 25 bp, Mus musculus
tccagcaggtcccagttgtactgca

SEQ ID NO: 359398 - DNA, 25 bp, Mus musculus
tccagcaggtgagaggccacgattg

SEQ ID NO: 359399 - DNA, 25 bp, Mus musculus
tccagcagtagggagtgccgcgtct

SEQ ID NO: 359400 - DNA, 25 bp, Mus musculus
tccagcagtaggggaacaaagatga

SEQ ID NO: 359401 - DNA, 25 bp, Mus musculus
tccagcagtcaggctgggacaacgc

SEQ ID NO: 359402 - DNA, 25 bp, Mus musculus
tccagcagtctaaggtgtctgaaca

SEQ ID NO: 359403 - DNA, 25 bp, Mus musculus
tccagcagttacacctggagcactc

SEQ ID NO: 359404 - DNA, 25 bp, Mus musculus
tccagcataaagaaggaatcaccca

SEQ ID NO: 359405 - DNA, 25 bp, Mus musculus
tccagcatagccccacggcctgcta

SEQ ID NO: 359406 - DNA, 25 bp, Mus musculus
tccagcatcgatttgactttattga

SEQ ID NO: 359407 - DNA, 25 bp, Mus musculus
tccagcatcgtggccaagatggaca

SEQ ID NO: 359408 - DNA, 25 bp, Mus musculus
tccagcattgctgaagtgcagagtg

SEQ ID NO: 359409 - DNA, 25 bp, Mus musculus
tccagccaaaggactgcaggctaca

SEQ ID NO: 359410 - DNA, 25 bp, Mus musculus
tccagccaaggctgtcttcatgctg

SEQ ID NO: 359411 - DNA, 25 bp, Mus musculus
tccagccaatgagaaagagaaaact

SEQ ID NO: 359412 - DNA, 25 bp, Mus musculus
tccagccaccagcccctgcccggat

SEQ ID NO: 359413 - DNA, 25 bp, Mus musculus
tccagccagcccaggtgcatacaca

SEQ ID NO: 359414 - DNA, 25 bp, Mus musculus
tccagccagcccaggttttacttgg

SEQ ID NO: 359415 - DNA, 25 bp, Mus musculus
tccagccaggtacctgatgtgatgg

SEQ ID NO: 359416 - DNA, 25 bp, Mus musculus
tccagcccagaattaaccctgaatc

SEQ ID NO: 359417 - DNA, 25 bp, Mus musculus
tccagcccagatggaggatgaggac

SEQ ID NO: 359418 - DNA, 25 bp, Mus musculus
tccagcccagcagacaggaggatca

SEQ ID NO: 359419 - DNA, 25 bp, Mus musculus
tccagcccagctggagatggaggat

SEQ ID NO: 359420 - DNA, 25 bp, Mus musculus
tccagcccaggccctccttgtcaac

SEQ ID NO: 359421 - DNA, 25 bp, Mus musculus
tccagcccaggtgaacaccatgtcc

SEQ ID NO: 359422 - DNA, 25 bp, Mus musculus
tccagcccaggtgctggggcccgcc

SEQ ID NO: 359423 - DNA, 25 bp, Mus musculus
tccagcccagtccaaggcgacctcc

SEQ ID NO: 359424 - DNA, 25 bp, Mus musculus
tccagccccagaacaaggaattgaa

SEQ ID NO: 359425 - DNA, 25 bp, Mus musculus
tccagccccatgatgatactgagga

SEQ ID NO: 359426 - DNA, 25 bp, Mus musculus
tccagccccatgatgatcgcaaaag

SEQ ID NO: 359427 - DNA, 25 bp, Mus musculus
tccagccccatgatggcttcttttc

SEQ ID NO: 359428 - DNA, 25 bp, Mus musculus
tccagcccccagatctccttgtcag

SEQ ID NO: 359429 - DNA, 25 bp, Mus musculus
tccagcccctaaaggtctcagaggt

SEQ ID NO: 359430 - DNA, 25 bp, Mus musculus
tccagccccttcagaacctgtctgt

SEQ ID NO: 359431 - DNA, 25 bp, Mus musculus
tccagccccttcagctgtgcagaac

SEQ ID NO: 359432 - DNA, 25 bp, Mus musculus
tccagcccgcctttggctcccatcc

SEQ ID NO: 359433 - DNA, 25 bp, Mus musculus
tccagcccggatgaggtggctctgg

SEQ ID NO: 359434 - DNA, 25 bp, Mus musculus
tccagcccggttttgaggaaaagga

SEQ ID NO: 359435 - DNA, 25 bp, Mus musculus
tccagccctgaagccgaacaaaaaa

SEQ ID NO: 359436 - DNA, 25 bp, Mus musculus
tccagccgggatgctgtccaggccc

SEQ ID NO: 359437 - DNA, 25 bp, Mus musculus
tccagccgtcctcaaagcctatgaa

SEQ ID NO: 359438 - DNA, 25 bp, Mus musculus
tccagcctcagaggccagaaaggac

SEQ ID NO: 359439 - DNA, 25 bp, Mus musculus
tccagcctcagaggccagaagaagg

SEQ ID NO: 359440 - DNA, 25 bp, Mus musculus
tccagcctcctccatgaagcttcgt

SEQ ID NO: 359441 - DNA, 25 bp, Mus musculus
tccagcctctcaacgattcccacgc

SEQ ID NO: 359442 - DNA, 25 bp, Mus musculus
tccagcctgagagcttcggtgcaac

SEQ ID NO: 359443 - DNA, 25 bp, Mus musculus
tccagcctggagaaggtcccacctg

SEQ ID NO: 359444 - DNA, 25 bp, Mus musculus
tccagcctgggagggcctaggaact

SEQ ID NO: 359445 - DNA, 25 bp, Mus musculus
tccagccttcaccgtatggtgtgga

SEQ ID NO: 359446 - DNA, 25 bp, Mus musculus
tccagccttggatccaattatagta

SEQ ID NO: 359447 - DNA, 25 bp, Mus musculus
tccagcgacatcgctgacttcaggg

SEQ ID NO: 359448 - DNA, 25 bp, Mus musculus
tccagcgatcgcaggattgaaattc

SEQ ID NO: 359449 - DNA, 25 bp, Mus musculus
tccagcgccggggactctgatgggg

SEQ ID NO: 359450 - DNA, 25 bp, Mus musculus
tccagcgctgagcttcacctggttc

SEQ ID NO: 359451 - DNA, 25 bp, Mus musculus
tccagcggcagccagcaccagctgc

SEQ ID NO: 359452 - DNA, 25 bp, Mus musculus
tccagcgggacaggtggtgtccctc

SEQ ID NO: 359453 - DNA, 25 bp, Mus musculus
tccagcgggacagtgacgttgcccg

SEQ ID NO: 359454 - DNA, 25 bp, Mus musculus
tccagcgggcagaggcggatcttag

SEQ ID NO: 359455 - DNA, 25 bp, Mus musculus
tccagcgggcaggtcatgttagcgg

SEQ ID NO: 359456 - DNA, 25 bp, Mus musculus
tccagcgtcgccaccatgaccaccg

SEQ ID NO: 359457 - DNA, 25 bp, Mus musculus
tccagcgtctaaggttcctgtgtcc

SEQ ID NO: 359458 - DNA, 25 bp, Mus musculus
tccagctaagcaggtctgaagaaag

SEQ ID NO: 359459 - DNA, 25 bp, Mus musculus
tccagctaccagtgtccaaatgatg

SEQ ID NO: 359460 - DNA, 25 bp, Mus musculus
tccagctagggaatgaaggtgaaga

SEQ ID NO: 359461 - DNA, 25 bp, Mus musculus
tccagctatgagaagcaacaggcca

SEQ ID NO: 359462 - DNA, 25 bp, Mus musculus
tccagctatgagcctggagtactcg

SEQ ID NO: 359463 - DNA, 25 bp, Mus musculus
tccagctcaaagctgctgagagcct

SEQ ID NO: 359464 - DNA, 25 bp, Mus musculus
tccagctcactactgtaacagaaga

SEQ ID NO: 359465 - DNA, 25 bp, Mus musculus
tccagctcagttctgcgctcggggc

SEQ ID NO: 359466 - DNA, 25 bp, Mus musculus
tccagctccaagaaaagcaccttca

SEQ ID NO: 359467 - DNA, 25 bp, Mus musculus
tccagctccaagttatctccagagt

SEQ ID NO: 359468 - DNA, 25 bp, Mus musculus
tccagctccaccccctactccccga

SEQ ID NO: 359469 - DNA, 25 bp, Mus musculus
tccagctccaggtacttcgagtttt

SEQ ID NO: 359470 - DNA, 25 bp, Mus musculus
tccagctccctgacagaggatggtt

SEQ ID NO: 359471 - DNA, 25 bp, Mus musculus
tccagctccctgacagctatattgt

SEQ ID NO: 359472 - DNA, 25 bp, Mus musculus
tccagctcctgggatacgtattatc

SEQ ID NO: 359473 - DNA, 25 bp, Mus musculus
tccagctcgagcaggacttccaata

SEQ ID NO: 359474 - DNA, 25 bp, Mus musculus
tccagctcgagcaggttaggagaag

SEQ ID NO: 359475 - DNA, 25 bp, Mus musculus
tccagctctccagatcatggctcct

SEQ ID NO: 359476 - DNA, 25 bp, Mus musculus
tccagctcttggcagaagactttaa

SEQ ID NO: 359477 - DNA, 25 bp, Mus musculus
tccagctgactcagcaaatggaact

SEQ ID NO: 359478 - DNA, 25 bp, Mus musculus
tccagctgatcaagaggcctgccaa

SEQ ID NO: 359479 - DNA, 25 bp, Mus musculus
tccagctgatcaagccagccatctc

SEQ ID NO: 359480 - DNA, 25 bp, Mus musculus
tccagctgatcgagaaaacataaag

SEQ ID NO: 359481 - DNA, 25 bp, Mus musculus
tccagctgcaatggggactctggcg

SEQ ID NO: 359482 - DNA, 25 bp, Mus musculus
tccagctgcagaaaggtcagacggg

SEQ ID NO: 359483 - DNA, 25 bp, Mus musculus
tccagctgcagcagttctatgctgc

SEQ ID NO: 359484 - DNA, 25 bp, Mus musculus
tccagctgcaggatgaagtggccca

SEQ ID NO: 359485 - DNA, 25 bp, Mus musculus
tccagctgccaaacgtcaaactccg

SEQ ID NO: 359486 - DNA, 25 bp, Mus musculus
tccagctgcctttttcaacatggat

SEQ ID NO: 359487 - DNA, 25 bp, Mus musculus
tccagctgctgacccaggtcctgag

SEQ ID NO: 359488 - DNA, 25 bp, Mus musculus
tccagctggagggagagcgtgagcg

SEQ ID NO: 359489 - DNA, 25 bp, Mus musculus
tccagctgtaccccgggagggacat

SEQ ID NO: 359490 - DNA, 25 bp, Mus musculus
tccagcttacggacatgctcccaaa

SEQ ID NO: 359491 - DNA, 25 bp, Mus musculus
tccagcttcagcagcatctacaggg

SEQ ID NO: 359492 - DNA, 25 bp, Mus musculus
tccagcttcagcagctctagccaag

SEQ ID NO: 359493 - DNA, 25 bp, Mus musculus
tccagcttccagatacctcagtcca

SEQ ID NO: 359494 - DNA, 25 bp, Mus musculus
tccagcttccagccctacgttcttc

SEQ ID NO: 359495 - DNA, 25 bp, Mus musculus
tccagcttcctgaatgttttggctg

SEQ ID NO: 359496 - DNA, 25 bp, Mus musculus
tccagcttctagagatcatgagggc

SEQ ID NO: 359497 - DNA, 25 bp, Mus musculus
tccagcttctagagcctgtttctct

SEQ ID NO: 359498 - DNA, 25 bp, Mus musculus
tccagcttgaaggtactaaagaaat

SEQ ID NO: 359499 - DNA, 25 bp, Mus musculus
tccagcttgtattgcagttttagtt

SEQ ID NO: 359500 - DNA, 25 bp, Mus musculus
tccagcttgtgaggttcttgtttcc

SEQ ID NO: 359501 - DNA, 25 bp, Mus musculus
tccagcttgtgtctgaaggtgcttc

SEQ ID NO: 359502 - DNA, 25 bp, Mus musculus
tccagctttgagatggctatgaacg

SEQ ID NO: 359503 - DNA, 25 bp, Mus musculus
tccaggaaacaagaacgtatctcct

SEQ ID NO: 359504 - DNA, 25 bp, Mus musculus
tccaggaaacagaaagctggtccaa

SEQ ID NO: 359505 - DNA, 25 bp, Mus musculus
tccaggaaacaggaaggagtcttca

SEQ ID NO: 359506 - DNA, 25 bp, Mus musculus
tccaggaaacatggaaataagcagc

SEQ ID NO: 359507 - DNA, 25 bp, Mus musculus
tccaggaacagctcaaggccgtgca

SEQ ID NO: 359508 - DNA, 25 bp, Mus musculus
tccaggaacccaagaatttattgcc

SEQ ID NO: 359509 - DNA, 25 bp, Mus musculus
tccaggaaccgcaggctgttgccgc

SEQ ID NO: 359510 - DNA, 25 bp, Mus musculus
tccaggaacctctcctcctggctgt

SEQ ID NO: 359511 - DNA, 25 bp, Mus musculus
tccaggaagaaaggtcaggatcgca

SEQ ID NO: 359512 - DNA, 25 bp, Mus musculus
tccaggaagaaattccaaattacag

SEQ ID NO: 359513 - DNA, 25 bp, Mus musculus
tccaggaagaggcggtgacagaggc

SEQ ID NO: 359514 - DNA, 25 bp, Mus musculus
tccaggaagatccactcctatgtgt

SEQ ID NO: 359515 - DNA, 25 bp, Mus musculus
tccaggaagccaggtctttggccag

SEQ ID NO: 359516 - DNA, 25 bp, Mus musculus
tccaggaagctactgggccgcgttg

SEQ ID NO: 359517 - DNA, 25 bp, Mus musculus
tccaggaagggactatattgatcag

SEQ ID NO: 359518 - DNA, 25 bp, Mus musculus
tccaggacaagatgcgagctacacc

SEQ ID NO: 359519 - DNA, 25 bp, Mus musculus
tccaggacaaggaagaaaccgttgg

SEQ ID NO: 359520 - DNA, 25 bp, Mus musculus
tccaggacacgtttctgtgttgtgg

SEQ ID NO: 359521 - DNA, 25 bp, Mus musculus
tccaggacagatggcgctgccagtg

SEQ ID NO: 359522 - DNA, 25 bp, Mus musculus
tccaggacagccagggtctctggaa

SEQ ID NO: 359523 - DNA, 25 bp, Mus musculus
tccaggacagccagggtgagtccag

SEQ ID NO: 359524 - DNA, 25 bp, Mus musculus
tccaggacaggaaggtacttctcca

SEQ ID NO: 359525 - DNA, 25 bp, Mus musculus
tccaggacagttgtccacgtacaga

SEQ ID NO: 359526 - DNA, 25 bp, Mus musculus
tccaggacatagagaccatagaatc

SEQ ID NO: 359527 - DNA, 25 bp, Mus musculus
tccaggaccacgatgtccctggtag

SEQ ID NO: 359528 - DNA, 25 bp, Mus musculus
tccaggaccatgcaaaagcaaaaga

SEQ ID NO: 359529 - DNA, 25 bp, Mus musculus
tccaggacccagtggaacaattgga

SEQ ID NO: 359530 - DNA, 25 bp, Mus musculus
tccaggacctcaaggacggtattta

SEQ ID NO: 359531 - DNA, 25 bp, Mus musculus
tccaggacctgcagctcttatgctc

SEQ ID NO: 359532 - DNA, 25 bp, Mus musculus
tccaggacctgcaggccccccagga

SEQ ID NO: 359533 - DNA, 25 bp, Mus musculus
tccaggacgaagggtcctgtgcgca

SEQ ID NO: 359534 - DNA, 25 bp, Mus musculus
tccaggactgaatctacccaaacga

SEQ ID NO: 359535 - DNA, 25 bp, Mus musculus
tccaggagaatgccaggaggtcata

SEQ ID NO: 359536 - DNA, 25 bp, Mus musculus
tccaggagacaaattgagacctaca

SEQ ID NO: 359537 - DNA, 25 bp, Mus musculus
tccaggagacaagcatctaatgatg

SEQ ID NO: 359538 - DNA, 25 bp, Mus musculus
tccaggagaccagggagagaaatac

SEQ ID NO: 359539 - DNA, 25 bp, Mus musculus
tccaggagagggaaaagatgccgtt

SEQ ID NO: 359540 - DNA, 25 bp, Mus musculus
tccaggagcagacacggatcatcct

SEQ ID NO: 359541 - DNA, 25 bp, Mus musculus
tccaggagcaggggggactccccac

SEQ ID NO: 359542 - DNA, 25 bp, Mus musculus
tccaggagccaggtggtgtccctca

SEQ ID NO: 359543 - DNA, 25 bp, Mus musculus
tccaggagccggaaagaagagacgc

SEQ ID NO: 359544 - DNA, 25 bp, Mus musculus
tccaggagccgggcattcaactcgg

SEQ ID NO: 359545 - DNA, 25 bp, Mus musculus
tccaggagctcacacgagagaagga

SEQ ID NO: 359546 - DNA, 25 bp, Mus musculus
tccaggagctcacaggagagaagga

SEQ ID NO: 359547 - DNA, 25 bp, Mus musculus
tccaggaggaagaagactcagaaag

SEQ ID NO: 359548 - DNA, 25 bp, Mus musculus
tccaggaggaagaggaagtccaaga

SEQ ID NO: 359549 - DNA, 25 bp, Mus musculus
tccaggaggaagatgctgtcgccga

SEQ ID NO: 359550 - DNA, 25 bp, Mus musculus
tccaggaggacagcgagacggtcat

SEQ ID NO: 359551 - DNA, 25 bp, Mus musculus
tccaggaggcagagagtgctacaat

SEQ ID NO: 359552 - DNA, 25 bp, Mus musculus
tccaggaggcagaggtaagaaagtg

SEQ ID NO: 359553 - DNA, 25 bp, Mus musculus
tccaggaggcagaggtccctggctg

SEQ ID NO: 359554 - DNA, 25 bp, Mus musculus
tccaggagggaagatatgaatctga

SEQ ID NO: 359555 - DNA, 25 bp, Mus musculus
tccaggaggtcaagattcgggaaga

SEQ ID NO: 359556 - DNA, 25 bp, Mus musculus
tccaggaggttatcggcagcggagc

SEQ ID NO: 359557 - DNA, 25 bp, Mus musculus
tccaggaggttatcggtaaggcgag

SEQ ID NO: 359558 - DNA, 25 bp, Mus musculus
tccaggagtcaaaggtccacgaacc

SEQ ID NO: 359559 - DNA, 25 bp, Mus musculus
tccaggagtcccagtgtcttgctgc

SEQ ID NO: 359560 - DNA, 25 bp, Mus musculus
tccaggagtgcccaggcgaccacct

SEQ ID NO: 359561 - DNA, 25 bp, Mus musculus
tccaggataccaaggctcctgtgat

SEQ ID NO: 359562 - DNA, 25 bp, Mus musculus
tccaggatccaggcgccaggcagca

SEQ ID NO: 359563 - DNA, 25 bp, Mus musculus
tccaggatccaggttttatccagag

SEQ ID NO: 359564 - DNA, 25 bp, Mus musculus
tccaggatcctcatccgagagtccg

SEQ ID NO: 359565 - DNA, 25 bp, Mus musculus
tccaggatgcaggagcctccagaca

SEQ ID NO: 359566 - DNA, 25 bp, Mus musculus
tccaggatggaaccgggcgcagcgc

SEQ ID NO: 359567 - DNA, 25 bp, Mus musculus
tccaggatgggccgaaagaattcag

SEQ ID NO: 359568 - DNA, 25 bp, Mus musculus
tccaggattggaaaggttccaggat

SEQ ID NO: 359569 - DNA, 25 bp, Mus musculus
tccaggatttaaccctgagatacca

SEQ ID NO: 359570 - DNA, 25 bp, Mus musculus
tccaggatttgggagccaaagactc

SEQ ID NO: 359571 - DNA, 25 bp, Mus musculus
tccaggatttggggtggtatcacgg

SEQ ID NO: 359572 - DNA, 25 bp, Mus musculus
tccaggcaaagatacagagtcaggg

SEQ ID NO: 359573 - DNA, 25 bp, Mus musculus
tccaggcaactaggaggctggattg

SEQ ID NO: 359574 - DNA, 25 bp, Mus musculus
tccaggcaactagggtttcaactct

SEQ ID NO: 359575 - DNA, 25 bp, Mus musculus
tccaggcaagatcagctctgaatgg

SEQ ID NO: 359576 - DNA, 25 bp, Mus musculus
tccaggcagagctggcaccagaaac

SEQ ID NO: 359577 - DNA, 25 bp, Mus musculus
tccaggcagaggacagctcctctgt

SEQ ID NO: 359578 - DNA, 25 bp, Mus musculus
tccaggcagatacaacagcacaacc

SEQ ID NO: 359579 - DNA, 25 bp, Mus musculus
tccaggcagctgggtaccgggtgct

SEQ ID NO: 359580 - DNA, 25 bp, Mus musculus
tccaggcagtgctgaaaaccaagcc

SEQ ID NO: 359581 - DNA, 25 bp, Mus musculus
tccaggcattgtggactctagaaaa

SEQ ID NO: 359582 - DNA, 25 bp, Mus musculus
tccaggcattgtggattatcagact

SEQ ID NO: 359583 - DNA, 25 bp, Mus musculus
tccaggccacaatcggctatccatc

SEQ ID NO: 359584 - DNA, 25 bp, Mus musculus
tccaggccagcagacacacaacctt

SEQ ID NO: 359585 - DNA, 25 bp, Mus musculus
tccaggccagcagccctgtctccag

SEQ ID NO: 359586 - DNA, 25 bp, Mus musculus
tccaggccaggctgggcagcatcgc

SEQ ID NO: 359587 - DNA, 25 bp, Mus musculus
tccaggccaggtacatctatgggaa

SEQ ID NO: 359588 - DNA, 25 bp, Mus musculus
tccaggccatcactgacaaaagaaa

SEQ ID NO: 359589 - DNA, 25 bp, Mus musculus
tccaggccattgtggaaagcccccc

SEQ ID NO: 359590 - DNA, 25 bp, Mus musculus
tccaggccccagctttggtggcccc

SEQ ID NO: 359591 - DNA, 25 bp, Mus musculus
tccaggccctccggaggacctggcg

SEQ ID NO: 359592 - DNA, 25 bp, Mus musculus
tccaggccctgctggagctccagga

SEQ ID NO: 359593 - DNA, 25 bp, Mus musculus
tccaggccgaaccagtggctgcagc

SEQ ID NO: 359594 - DNA, 25 bp, Mus musculus
tccaggcctgttaagaccactgttc

SEQ ID NO: 359595 - DNA, 25 bp, Mus musculus
tccaggcggagagagcaacttcttc

SEQ ID NO: 359596 - DNA, 25 bp, Mus musculus
tccaggcggggtacatggcttcttc

SEQ ID NO: 359597 - DNA, 25 bp, Mus musculus
tccaggcggggttaaactcactttc

SEQ ID NO: 359598 - DNA, 25 bp, Mus musculus
tccaggctacaggagatcgctctgg

SEQ ID NO: 359599 - DNA, 25 bp, Mus musculus
tccaggctcctccagatgtcaactt

SEQ ID NO: 359600 - DNA, 25 bp, Mus musculus
tccaggctcgccaggctggaacgct

SEQ ID NO: 359601 - DNA, 25 bp, Mus musculus
tccaggctcgccagggaagtctact

SEQ ID NO: 359602 - DNA, 25 bp, Mus musculus
tccaggctcgccagggtggctgtct

SEQ ID NO: 359603 - DNA, 25 bp, Mus musculus
tccaggctctacttctgttcatatg

SEQ ID NO: 359604 - DNA, 25 bp, Mus musculus
tccaggctctgggaccctgaaagcc

SEQ ID NO: 359605 - DNA, 25 bp, Mus musculus
tccaggctgacaaggcccttttagc

SEQ ID NO: 359606 - DNA, 25 bp, Mus musculus
tccaggcttgccctctgttttctgt

SEQ ID NO: 359607 - DNA, 25 bp, Mus musculus
tccagggaatgtgagatacctttat

SEQ ID NO: 359608 - DNA, 25 bp, Mus musculus
tccagggacctgagggtacagtcct

SEQ ID NO: 359609 - DNA, 25 bp, Mus musculus
tccagggactgtgggctgggattct

SEQ ID NO: 359610 - DNA, 25 bp, Mus musculus
tccagggagacgaaggaggcgttct

SEQ ID NO: 359611 - DNA, 25 bp, Mus musculus
tccagggagagaaggtgtcttacca

SEQ ID NO: 359612 - DNA, 25 bp, Mus musculus
tccagggagtgaagccaagaagaag

SEQ ID NO: 359613 - DNA, 25 bp, Mus musculus
tccagggatcagtgggcgagcttca

SEQ ID NO: 359614 - DNA, 25 bp, Mus musculus
tccagggatcagtggtaccgggctt

SEQ ID NO: 359615 - DNA, 25 bp, Mus musculus
tccagggattcatgctgtattttca

SEQ ID NO: 359616 - DNA, 25 bp, Mus musculus
tccagggcaagaaagtatccacgga

SEQ ID NO: 359617 - DNA, 25 bp, Mus musculus
tccagggcaagccccaggactggac

SEQ ID NO: 359618 - DNA, 25 bp, Mus musculus
tccagggcaaggtatgtcctctggt

SEQ ID NO: 359619 - DNA, 25 bp, Mus musculus
tccagggcatggacaagtccagttc

SEQ ID NO: 359620 - DNA, 25 bp, Mus musculus
tccagggccagtttcttctgggacc

SEQ ID NO: 359621 - DNA, 25 bp, Mus musculus
tccagggcccctgggcccacctggc

SEQ ID NO: 359622 - DNA, 25 bp, Mus musculus
tccagggccctccgggcagagcgcc

SEQ ID NO: 359623 - DNA, 25 bp, Mus musculus
tccagggcttccaaggcccttgtcc

SEQ ID NO: 359624 - DNA, 25 bp, Mus musculus
tccaggggaggccagtggtgagaaa

SEQ ID NO: 359625 - DNA, 25 bp, Mus musculus
tccaggggatccaggaccagatgta

SEQ ID NO: 359626 - DNA, 25 bp, Mus musculus
tccaggggtggtcgggctcagaaag

SEQ ID NO: 359627 - DNA, 25 bp, Mus musculus
tccaggggtggtcggtggatggctt

SEQ ID NO: 359628 - DNA, 25 bp, Mus musculus
tccagggtcagcttccaagcaaccg

SEQ ID NO: 359629 - DNA, 25 bp, Mus musculus
tccagggtcaggtgaaccaccaaaa

SEQ ID NO: 359630 - DNA, 25 bp, Mus musculus
tccagggttcaccagataaatttaa

SEQ ID NO: 359631 - DNA, 25 bp, Mus musculus
tccagggtttgctgagagtggacag

SEQ ID NO: 359632 - DNA, 25 bp, Mus musculus
tccaggtaagtgctggccattcagg

SEQ ID NO: 359633 - DNA, 25 bp, Mus musculus
tccaggtacaagacgaactggagaa

SEQ ID NO: 359634 - DNA, 25 bp, Mus musculus
tccaggtatcttgatgtcagcccat

SEQ ID NO: 359635 - DNA, 25 bp, Mus musculus
tccaggtatggtatgaaaccaaagc

SEQ ID NO: 359636 - DNA, 25 bp, Mus musculus
tccaggtcaaagtgattgtgtgtcg

SEQ ID NO: 359637 - DNA, 25 bp, Mus musculus
tccaggtcactaggggcttcagaag

SEQ ID NO: 359638 - DNA, 25 bp, Mus musculus
tccaggtcagtgcttcgcaagatgg

SEQ ID NO: 359639 - DNA, 25 bp, Mus musculus
tccaggtccaggtcccgttcaagaa

SEQ ID NO: 359640 - DNA, 25 bp, Mus musculus
tccaggtctgagagcccaacatgca

SEQ ID NO: 359641 - DNA, 25 bp, Mus musculus
tccaggtgacaaagcaggtaaacac

SEQ ID NO: 359642 - DNA, 25 bp, Mus musculus
tccaggtgatgacagaggacaaagg

SEQ ID NO: 359643 - DNA, 25 bp, Mus musculus
tccaggtgatgacagtcacctctcc

SEQ ID NO: 359644 - DNA, 25 bp, Mus musculus
tccaggtgcagagggcagctgagac

SEQ ID NO: 359645 - DNA, 25 bp, Mus musculus
tccaggtgcagctggtgatcaagga

SEQ ID NO: 359646 - DNA, 25 bp, Mus musculus
tccaggtggacattgaggcactgca

SEQ ID NO: 359647 - DNA, 25 bp, Mus musculus
tccaggtggccgagaagctgtttga

SEQ ID NO: 359648 - DNA, 25 bp, Mus musculus
tccaggtggctgagctcccgccagt

SEQ ID NO: 359649 - DNA, 25 bp, Mus musculus
tccaggtggctgccccagtgcgggt

SEQ ID NO: 359650 - DNA, 25 bp, Mus musculus
tccaggttcaggtgttggcagccga

SEQ ID NO: 359651 - DNA, 25 bp, Mus musculus
tccaggttcccagtttagccaggcc

SEQ ID NO: 359652 - DNA, 25 bp, Mus musculus
tccaggttgtagcaaatgacaagat

SEQ ID NO: 359653 - DNA, 25 bp, Mus musculus
tccaggtttgtcaaaaataaggcca

SEQ ID NO: 359654 - DNA, 25 bp, Mus musculus
tccagtaaacccagtgatcaggtgt

SEQ ID NO: 359655 - DNA, 25 bp, Mus musculus
tccagtaaagactccttgttgcaat

SEQ ID NO: 359656 - DNA, 25 bp, Mus musculus
tccagtaaagccaacaaattactcc

SEQ ID NO: 359657 - DNA, 25 bp, Mus musculus
tccagtaaagtccaggtacataggg

SEQ ID NO: 359658 - DNA, 25 bp, Mus musculus
tccagtaacagttacagaaaccccg

SEQ ID NO: 359659 - DNA, 25 bp, Mus musculus
tccagtaacgtgtgctgccatgctt

SEQ ID NO: 359660 - DNA, 25 bp, Mus musculus
tccagtaagcagataaggatgaatg

SEQ ID NO: 359661 - DNA, 25 bp, Mus musculus
tccagtaagtatgataggctgggct

SEQ ID NO: 359662 - DNA, 25 bp, Mus musculus
tccagtacagccaggtgaccgagct

SEQ ID NO: 359663 - DNA, 25 bp, Mus musculus
tccagtacaggaaattaaaatgcat

SEQ ID NO: 359664 - DNA, 25 bp, Mus musculus
tccagtacaggtcagaggaacgccc

SEQ ID NO: 359665 - DNA, 25 bp, Mus musculus
tccagtacaggtgaatatactgtaa

SEQ ID NO: 359666 - DNA, 25 bp, Mus musculus
tccagtacattacgatgagactgag

SEQ ID NO: 359667 - DNA, 25 bp, Mus musculus
tccagtacattacggctgagcggga

SEQ ID NO: 359668 - DNA, 25 bp, Mus musculus
tccagtaccaagacaaagcctattt

SEQ ID NO: 359669 - DNA, 25 bp, Mus musculus
tccagtaccattgcaagtactccac

SEQ ID NO: 359670 - DNA, 25 bp, Mus musculus
tccagtactttgtgacaggtgtgtg

SEQ ID NO: 359671 - DNA, 25 bp, Mus musculus
tccagtagagaaataccggtatcag

SEQ ID NO: 359672 - DNA, 25 bp, Mus musculus
tccagtagagaagctgaagggaacg

SEQ ID NO: 359673 - DNA, 25 bp, Mus musculus
tccagtatagggagaagctgggcac

SEQ ID NO: 359674 - DNA, 25 bp, Mus musculus
tccagtatcggtaactgtgaatgct

SEQ ID NO: 359675 - DNA, 25 bp, Mus musculus
tccagtatcggtaagtgttattgta

SEQ ID NO: 359676 - DNA, 25 bp, Mus musculus
tccagtatcggtactaatgtctgcg

SEQ ID NO: 359677 - DNA, 25 bp, Mus musculus
tccagtatcggtactcctccaaagt

SEQ ID NO: 359678 - DNA, 25 bp, Mus musculus
tccagtatcttcagtcaagaccttt

SEQ ID NO: 359679 - DNA, 25 bp, Mus musculus
tccagtatgagcaagatccagtatg

SEQ ID NO: 359680 - DNA, 25 bp, Mus musculus
tccagtattcagatggaaaactaca

SEQ ID NO: 359681 - DNA, 25 bp, Mus musculus
tccagtattcctgggggttcggcag

SEQ ID NO: 359682 - DNA, 25 bp, Mus musculus
tccagtcaaggaggaggatgactat

SEQ ID NO: 359683 - DNA, 25 bp, Mus musculus
tccagtcaaggatgactatgacgtc

SEQ ID NO: 359684 - DNA, 25 bp, Mus musculus
tccagtcacactgcgagttacactt

SEQ ID NO: 359685 - DNA, 25 bp, Mus musculus
tccagtcacactgcgggagaaagca

SEQ ID NO: 359686 - DNA, 25 bp, Mus musculus
tccagtccacagccattcctgcgcc

SEQ ID NO: 359687 - DNA, 25 bp, Mus musculus
tccagtccagcaatcccaggatcca

SEQ ID NO: 359688 - DNA, 25 bp, Mus musculus
tccagtcctttgagattgagcgtca

SEQ ID NO: 359689 - DNA, 25 bp, Mus musculus
tccagtctccaggtgattggatgtg

SEQ ID NO: 359690 - DNA, 25 bp, Mus musculus
tccagtctctgccaaacacaccaga

SEQ ID NO: 359691 - DNA, 25 bp, Mus musculus
tccagtctctgccaacattgtcctc

SEQ ID NO: 359692 - DNA, 25 bp, Mus musculus
tccagtctgagccgaatccaccttg

SEQ ID NO: 359693 - DNA, 25 bp, Mus musculus
tccagtctgcagcaagccccgccca

SEQ ID NO: 359694 - DNA, 25 bp, Mus musculus
tccagtcttggcagagttttgcctg

SEQ ID NO: 359695 - DNA, 25 bp, Mus musculus
tccagtgaattcttggacctgagtt

SEQ ID NO: 359696 - DNA, 25 bp, Mus musculus
tccagtgactccatcaaagagagga

SEQ ID NO: 359697 - DNA, 25 bp, Mus musculus
tccagtgaggagaaggacctcacca

SEQ ID NO: 359698 - DNA, 25 bp, Mus musculus
tccagtgaggctgtcatctgggagg

SEQ ID NO: 359699 - DNA, 25 bp, Mus musculus
tccagtgaggggtgcactctcagaa

SEQ ID NO: 359700 - DNA, 25 bp, Mus musculus
tccagtgatttgctgtcagaagcta

SEQ ID NO: 359701 - DNA, 25 bp, Mus musculus
tccagtgcaagcagcccagccatga

SEQ ID NO: 359702 - DNA, 25 bp, Mus musculus
tccagtgcaccagcagaacagtttg

SEQ ID NO: 359703 - DNA, 25 bp, Mus musculus
tccagtgcagaagctgtagctatct

SEQ ID NO: 359704 - DNA, 25 bp, Mus musculus
tccagtgcaggcctaaccctgtccc

SEQ ID NO: 359705 - DNA, 25 bp, Mus musculus
tccagtgcagggaaaagctgtgttc

SEQ ID NO: 359706 - DNA, 25 bp, Mus musculus
tccagtgccagcccaggcctccagc

SEQ ID NO: 359707 - DNA, 25 bp, Mus musculus
tccagtgccagtttcctagattgga

SEQ ID NO: 359708 - DNA, 25 bp, Mus musculus
tccagtgcggctgctcctggcacaa

SEQ ID NO: 359709 - DNA, 25 bp, Mus musculus
tccagtgcgggctgatgcatgggct

SEQ ID NO: 359710 - DNA, 25 bp, Mus musculus
tccagtgctgcgccattttggctgc

SEQ ID NO: 359711 - DNA, 25 bp, Mus musculus
tccagtgctgtaaccctccactgag

SEQ ID NO: 359712 - DNA, 25 bp, Mus musculus
tccagtggaacagattgttgtggtg

SEQ ID NO: 359713 - DNA, 25 bp, Mus musculus
tccagtggaacgtgggatctcatca

SEQ ID NO: 359714 - DNA, 25 bp, Mus musculus
tccagtggatcggaaaaggcctact

SEQ ID NO: 359715 - DNA, 25 bp, Mus musculus
tccagtgtagagggccaagtccact

SEQ ID NO: 359716 - DNA, 25 bp, Mus musculus
tccagtgtagatttatttttataag

SEQ ID NO: 359717 - DNA, 25 bp, Mus musculus
tccagtgtaggctctcagacactgc

SEQ ID NO: 359718 - DNA, 25 bp, Mus musculus
tccagtgtaggtgttggaactgtag

SEQ ID NO: 359719 - DNA, 25 bp, Mus musculus
tccagtgtcctggcagcccaaacga

SEQ ID NO: 359720 - DNA, 25 bp, Mus musculus
tccagtgtgactggtttcatatgtc

SEQ ID NO: 359721 - DNA, 25 bp, Mus musculus
tccagttaaaaaatcttgcccagtc

SEQ ID NO: 359722 - DNA, 25 bp, Mus musculus
tccagttaaacctgctgatcttaag

SEQ ID NO: 359723 - DNA, 25 bp, Mus musculus
tccagttactctacatcccctcctc

SEQ ID NO: 359724 - DNA, 25 bp, Mus musculus
tccagttactctacttcatctactc

SEQ ID NO: 359725 - DNA, 25 bp, Mus musculus
tccagttattcagtggttctgggaa

SEQ ID NO: 359726 - DNA, 25 bp, Mus musculus
tccagttattcagttcgttactggc

SEQ ID NO: 359727 - DNA, 25 bp, Mus musculus
tccagttcagcagcctgcagcaggg

SEQ ID NO: 359728 - DNA, 25 bp, Mus musculus
tccagttcagcagggcacctacgcc

SEQ ID NO: 359729 - DNA, 25 bp, Mus musculus
tccagttcaggatgagatgctggcc

SEQ ID NO: 359730 - DNA, 25 bp, Mus musculus
tccagttccaagaggtgggatgcta

SEQ ID NO: 359731 - DNA, 25 bp, Mus musculus
tccagttccaggaagtcgttcttct

SEQ ID NO: 359732 - DNA, 25 bp, Mus musculus
tccagttccagtaagtgcaataaaa

SEQ ID NO: 359733 - DNA, 25 bp, Mus musculus
tccagttcccttcaaggcatgagag

SEQ ID NO: 359734 - DNA, 25 bp, Mus musculus
tccagttcggagaggctctgtctgc

SEQ ID NO: 359735 - DNA, 25 bp, Mus musculus
tccagttcggagaggtggttctgga

SEQ ID NO: 359736 - DNA, 25 bp, Mus musculus
tccagttctaattgtaatcgtgttc

SEQ ID NO: 359737 - DNA, 25 bp, Mus musculus
tccagttgcagattgaacttcatga

SEQ ID NO: 359738 - DNA, 25 bp, Mus musculus
tccagttgcagcaggtactctgaag

SEQ ID NO: 359739 - DNA, 25 bp, Mus musculus
tccagttgcaggtacaacataagag

SEQ ID NO: 359740 - DNA, 25 bp, Mus musculus
tccagttggaaatgaaatgttcctt

SEQ ID NO: 359741 - DNA, 25 bp, Mus musculus
tccagttggctggagggaaggtggc

SEQ ID NO: 359742 - DNA, 25 bp, Mus musculus
tccagttgtgagatgtggtgatcta

SEQ ID NO: 359743 - DNA, 25 bp, Mus musculus
tccagtttaacaagacagtggagca

SEQ ID NO: 359744 - DNA, 25 bp, Mus musculus
tccagtttcccttgtgggtatgaaa

SEQ ID NO: 359745 - DNA, 25 bp, Mus musculus
tccagtttgaataataggaatatcc

SEQ ID NO: 359746 - DNA, 25 bp, Mus musculus
tccagtttgaataatatttccctca

SEQ ID NO: 359747 - DNA, 25 bp, Mus musculus
tccagtttgctaagaactttgttgc

SEQ ID NO: 359748 - DNA, 25 bp, Mus musculus
tccagtttggagagtgtgacttgct

SEQ ID NO: 359749 - DNA, 25 bp, Mus musculus
tccagtttggagggtttctctgtgt

SEQ ID NO: 359750 - DNA, 25 bp, Mus musculus
tccagtttgggaagaaaggtggcag

SEQ ID NO: 359751 - DNA, 25 bp, Mus musculus
tccagtttgggtgtctggagacatg

SEQ ID NO: 359752 - DNA, 25 bp, Mus musculus
tccagttttacaggaatctgggcaa

SEQ ID NO: 359753 - DNA, 25 bp, Mus musculus
tccagttttccagagccccttccaa

SEQ ID NO: 359754 - DNA, 25 bp, Mus musculus
tccagttttccattgggtcaggatc

SEQ ID NO: 359755 - DNA, 25 bp, Mus musculus
tccataaacacggcttttttcacag

SEQ ID NO: 359756 - DNA, 25 bp, Mus musculus
tccataaacagcaagcctgtcattc

SEQ ID NO: 359757 - DNA, 25 bp, Mus musculus
tccataaacagcaaggggagatgtt

SEQ ID NO: 359758 - DNA, 25 bp, Mus musculus
tccataaacatgctcagcaaagaag

SEQ ID NO: 359759 - DNA, 25 bp, Mus musculus
tccataaacatggaataccaaattg

SEQ ID NO: 359760 - DNA, 25 bp, Mus musculus
tccataaacatggacttgaatttta

SEQ ID NO: 359761 - DNA, 25 bp, Mus musculus
tccataaagaggatggagatattct

SEQ ID NO: 359762 - DNA, 25 bp, Mus musculus
tccataaagggcaagaaaaagtcat

SEQ ID NO: 359763 - DNA, 25 bp, Mus musculus
tccataaaggggcagtaaatggctt

SEQ ID NO: 359764 - DNA, 25 bp, Mus musculus
tccataacaacaaagaagggattca

SEQ ID NO: 359765 - DNA, 25 bp, Mus musculus
tccataacctacaagctaccacatt

SEQ ID NO: 359766 - DNA, 25 bp, Mus musculus
tccataacctacaagttgttatccg

SEQ ID NO: 359767 - DNA, 25 bp, Mus musculus
tccataagaacgggagaggctccat

SEQ ID NO: 359768 - DNA, 25 bp, Mus musculus
tccataagttcaaacctctaggact

SEQ ID NO: 359769 - DNA, 25 bp, Mus musculus
tccataagttcaaacggcaacaggt

SEQ ID NO: 359770 - DNA, 25 bp, Mus musculus
tccataagttcaaagctctaggact

SEQ ID NO: 359771 - DNA, 25 bp, Mus musculus
tccataagttcaaagggcaacaggt

SEQ ID NO: 359772 - DNA, 25 bp, Mus musculus
tccataagtttggatgatttacctt

SEQ ID NO: 359773 - DNA, 25 bp, Mus musculus
tccataatgcagggcacaccaagag

SEQ ID NO: 359774 - DNA, 25 bp, Mus musculus
tccataatggagatggttctgccga

SEQ ID NO: 359775 - DNA, 25 bp, Mus musculus
tccataattgtgtggattctttaag

SEQ ID NO: 359776 - DNA, 25 bp, Mus musculus
tccatacacaggctcatcagcagga

SEQ ID NO: 359777 - DNA, 25 bp, Mus musculus
tccatacacatatggaggggctttt

SEQ ID NO: 359778 - DNA, 25 bp, Mus musculus
tccatacagaaagagtatgaaaaga

SEQ ID NO: 359779 - DNA, 25 bp, Mus musculus
tccatacatcagccctcgtggtagc

SEQ ID NO: 359780 - DNA, 25 bp, Mus musculus
tccatacatcagttttgcaggtgac

SEQ ID NO: 359781 - DNA, 25 bp, Mus musculus
tccatacccaaaggtatcacagcca

SEQ ID NO: 359782 - DNA, 25 bp, Mus musculus
tccatacggctggctcggatggcgt

SEQ ID NO: 359783 - DNA, 25 bp, Mus musculus
tccatagaacagaactcatgggaag

SEQ ID NO: 359784 - DNA, 25 bp, Mus musculus
tccatagaacaggccaaagtagaag

SEQ ID NO: 359785 - DNA, 25 bp, Mus musculus
tccatagacctcatcttcagtccct

SEQ ID NO: 359786 - DNA, 25 bp, Mus musculus
tccatagacctcatggcctctacaa

SEQ ID NO: 359787 - DNA, 25 bp, Mus musculus
tccatagacctcattgggcaagagc

SEQ ID NO: 359788 - DNA, 25 bp, Mus musculus
tccatagtcacaggacgtccagcag

SEQ ID NO: 359789 - DNA, 25 bp, Mus musculus
tccatatatcaaatctggaggtgaa

SEQ ID NO: 359790 - DNA, 25 bp, Mus musculus
tccatatcagctggaaggacgggct

SEQ ID NO: 359791 - DNA, 25 bp, Mus musculus
tccatatcctcagattcagaaaaac

SEQ ID NO: 359792 - DNA, 25 bp, Mus musculus
tccatatcctcagcctctccagctt

SEQ ID NO: 359793 - DNA, 25 bp, Mus musculus
tccatatgaatatcaagatggatgc

SEQ ID NO: 359794 - DNA, 25 bp, Mus musculus
tccatatgaccaaaggctactatat

SEQ ID NO: 359795 - DNA, 25 bp, Mus musculus
tccatattaccctagattggtgctg

SEQ ID NO: 359796 - DNA, 25 bp, Mus musculus
tccatattattataaatgaggagtg

SEQ ID NO: 359797 - DNA, 25 bp, Mus musculus
tccatattcccagcttctccagttg

SEQ ID NO: 359798 - DNA, 25 bp, Mus musculus
tccatcaaagaaattagccaggaaa

SEQ ID NO: 359799 - DNA, 25 bp, Mus musculus
tccatcaaagccccagaagaccctc

SEQ ID NO: 359800 - DNA, 25 bp, Mus musculus
tccatcaaagccctgtgcccacgag

SEQ ID NO: 359801 - DNA, 25 bp, Mus musculus
tccatcaaagctgacttctctaccc

SEQ ID NO: 359802 - DNA, 25 bp, Mus musculus
tccatcaaaggacctgatagatgag

SEQ ID NO: 359803 - DNA, 25 bp, Mus musculus
tccatcaaagggtcgtcttctgccg

SEQ ID NO: 359804 - DNA, 25 bp, Mus musculus
tccatcaacaggatcattcggacaa

SEQ ID NO: 359805 - DNA, 25 bp, Mus musculus
tccatcaacatcctaatcctggagg

SEQ ID NO: 359806 - DNA, 25 bp, Mus musculus
tccatcaactaaccaatactggagt

SEQ ID NO: 359807 - DNA, 25 bp, Mus musculus
tccatcaaggtgctctcgtcagttc

SEQ ID NO: 359808 - DNA, 25 bp, Mus musculus
tccatcaagtgggttcatgtactgg

SEQ ID NO: 359809 - DNA, 25 bp, Mus musculus
tccatcacattaaagtttcactaga

SEQ ID NO: 359810 - DNA, 25 bp, Mus musculus
tccatcaccaagaacaagaaaacag

SEQ ID NO: 359811 - DNA, 25 bp, Mus musculus
tccatcaccagcatccatgtcttac

SEQ ID NO: 359812 - DNA, 25 bp, Mus musculus
tccatcaccaggtgcgtgatgacat

SEQ ID NO: 359813 - DNA, 25 bp, Mus musculus
tccatcacccagggcaccccactca

SEQ ID NO: 359814 - DNA, 25 bp, Mus musculus
tccatcaccccagaggtgtggccaa

SEQ ID NO: 359815 - DNA, 25 bp, Mus musculus
tccatcaccttcattcacaacgaca

SEQ ID NO: 359816 - DNA, 25 bp, Mus musculus
tccatcacgattcaggctctttcta

SEQ ID NO: 359817 - DNA, 25 bp, Mus musculus
tccatcacgcaaggcatcccgaggt

SEQ ID NO: 359818 - DNA, 25 bp, Mus musculus
tccatcactcagctggagcaattca

SEQ ID NO: 359819 - DNA, 25 bp, Mus musculus
tccatcactcagggcgttcccttgg

SEQ ID NO: 359820 - DNA, 25 bp, Mus musculus
tccatcagacggctggaagaggccc

SEQ ID NO: 359821 - DNA, 25 bp, Mus musculus
tccatcagtacagggagcagatcaa

SEQ ID NO: 359822 - DNA, 25 bp, Mus musculus
tccatcagtacagtcatgcctgcag

SEQ ID NO: 359823 - DNA, 25 bp, Mus musculus
tccatcagttctgtgctcaaagatc

SEQ ID NO: 359824 - DNA, 25 bp, Mus musculus
tccatcatagccaagttcctgtacg

SEQ ID NO: 359825 - DNA, 25 bp, Mus musculus
tccatcatccacaagactgcgggaa

SEQ ID NO: 359826 - DNA, 25 bp, Mus musculus
tccatcatctctcattactcgggtt

SEQ ID NO: 359827 - DNA, 25 bp, Mus musculus
tccatcatgaggaaatttgccccgc

SEQ ID NO: 359828 - DNA, 25 bp, Mus musculus
tccatcccaaagaaccatggatcgg

SEQ ID NO: 359829 - DNA, 25 bp, Mus musculus
tccatcccaagcgcctgtgtctggc

SEQ ID NO: 359830 - DNA, 25 bp, Mus musculus
tccatccccaggtgctgctttcctg

SEQ ID NO: 359831 - DNA, 25 bp, Mus musculus
tccatccccatcaggccaaccagag

SEQ ID NO: 359832 - DNA, 25 bp, Mus musculus
tccatccctggcctatctccctgga

SEQ ID NO: 359833 - DNA, 25 bp, Mus musculus
tccatccgagattgagcttgaagct

SEQ ID NO: 359834 - DNA, 25 bp, Mus musculus
tccatccgagcctgacctgatggag

SEQ ID NO: 359835 - DNA, 25 bp, Mus musculus
tccatccgagtggcagcaagttggc

SEQ ID NO: 359836 - DNA, 25 bp, Mus musculus
tccatccggatagacaagcgtgaga

SEQ ID NO: 359837 - DNA, 25 bp, Mus musculus
tccatcctaccagttcgcagaccag

SEQ ID NO: 359838 - DNA, 25 bp, Mus musculus
tccatcctaccatatctgtctcgga

SEQ ID NO: 359839 - DNA, 25 bp, Mus musculus
tccatcctatatagtctacatgggc

SEQ ID NO: 359840 - DNA, 25 bp, Mus musculus
tccatcctcatcaccggagaatccg

SEQ ID NO: 359841 - DNA, 25 bp, Mus musculus
tccatcctgaagtccctgctatgtg

SEQ ID NO: 359842 - DNA, 25 bp, Mus musculus
tccatcctgagcggctctctgtgga

SEQ ID NO: 359843 - DNA, 25 bp, Mus musculus
tccatcctgcagaagcaccctagga

SEQ ID NO: 359844 - DNA, 25 bp, Mus musculus
tccatcctgcagaccttatgtgagc

SEQ ID NO: 359845 - DNA, 25 bp, Mus musculus
tccatcctgcaggggctggcgagat

SEQ ID NO: 359846 - DNA, 25 bp, Mus musculus
tccatcctggcctcccttttttttg

SEQ ID NO: 359847 - DNA, 25 bp, Mus musculus
tccatcctgggttggctgatgttag

SEQ ID NO: 359848 - DNA, 25 bp, Mus musculus
tccatcctgtctatggagaaaataa

SEQ ID NO: 359849 - DNA, 25 bp, Mus musculus
tccatccttagtcagacgcgcacgg

SEQ ID NO: 359850 - DNA, 25 bp, Mus musculus
tccatcctttgcatgtgtctaagga

SEQ ID NO: 359851 - DNA, 25 bp, Mus musculus
tccatcgcaagtccacttgatccca

SEQ ID NO: 359852 - DNA, 25 bp, Mus musculus
tccatcgctacagatactttatgca

SEQ ID NO: 359853 - DNA, 25 bp, Mus musculus
tccatcggacttttgatcctcactt

SEQ ID NO: 359854 - DNA, 25 bp, Mus musculus
tccatcggacttttggacagtttct

SEQ ID NO: 359855 - DNA, 25 bp, Mus musculus
tccatcggagccggggggacctcgg

SEQ ID NO: 359856 - DNA, 25 bp, Mus musculus
tccatcggcaccggcttttcctaga

SEQ ID NO: 359857 - DNA, 25 bp, Mus musculus
tccatcggcgggctcctggccttgt

SEQ ID NO: 359858 - DNA, 25 bp, Mus musculus
tccatcggcggggaagtttggtgag

SEQ ID NO: 359859 - DNA, 25 bp, Mus musculus
tccatcggcttcagatatttatcaa

SEQ ID NO: 359860 - DNA, 25 bp, Mus musculus
tccatcggcttggtttggttccagt

SEQ ID NO: 359861 - DNA, 25 bp, Mus musculus
tccatcgtgagacataggaggcggt

SEQ ID NO: 359862 - DNA, 25 bp, Mus musculus
tccatcgtgaggaactatgaatggg

SEQ ID NO: 359863 - DNA, 25 bp, Mus musculus
tccatcgtgaggtagttgaaatgta

SEQ ID NO: 359864 - DNA, 25 bp, Mus musculus
tccatcgtgatcggcaagaagccag

SEQ ID NO: 359865 - DNA, 25 bp, Mus musculus
tccatcgtgatcggtgagaaggacc

SEQ ID NO: 359866 - DNA, 25 bp, Mus musculus
tccatctacactggaattacactat

SEQ ID NO: 359867 - DNA, 25 bp, Mus musculus
tccatctacaggcctgtccactggg

SEQ ID NO: 359868 - DNA, 25 bp, Mus musculus
tccatctactatatctctgctcatg

SEQ ID NO: 359869 - DNA, 25 bp, Mus musculus
tccatctatagatcttaccaatata

SEQ ID NO: 359870 - DNA, 25 bp, Mus musculus
tccatctataggattcatgaataaa

SEQ ID NO: 359871 - DNA, 25 bp, Mus musculus
tccatctcagggttctggctgcttt

SEQ ID NO: 359872 - DNA, 25 bp, Mus musculus
tccatctccaagcaggggtattttg

SEQ ID NO: 359873 - DNA, 25 bp, Mus musculus
tccatctccaagcagtatgtctgga

SEQ ID NO: 359874 - DNA, 25 bp, Mus musculus
tccatctccacagctgcggtgctct

SEQ ID NO: 359875 - DNA, 25 bp, Mus musculus
tccatctccgagctgatccacaccg

SEQ ID NO: 359876 - DNA, 25 bp, Mus musculus
tccatctctcatcagcatccgccac

SEQ ID NO: 359877 - DNA, 25 bp, Mus musculus
tccatctgaagaaatcaaaggctct

SEQ ID NO: 359878 - DNA, 25 bp, Mus musculus
tccatctgcagggttatcaagatgt

SEQ ID NO: 359879 - DNA, 25 bp, Mus musculus
tccatctgctcccagaattacctca

SEQ ID NO: 359880 - DNA, 25 bp, Mus musculus
tccatctgtggataagctatatcca

SEQ ID NO: 359881 - DNA, 25 bp, Mus musculus
tccatcttaattaagaacattactt

SEQ ID NO: 359882 - DNA, 25 bp, Mus musculus
tccatcttagaacatcctttactgt

SEQ ID NO: 359883 - DNA, 25 bp, Mus musculus
tccatcttcaagccttctgtggatg

SEQ ID NO: 359884 - DNA, 25 bp, Mus musculus
tccatcttccaggagaaccacaatg

SEQ ID NO: 359885 - DNA, 25 bp, Mus musculus
tccatcttgactcggaggaagacga

SEQ ID NO: 359886 - DNA, 25 bp, Mus musculus
tccatcttgactcggtggacaccat

SEQ ID NO: 359887 - DNA, 25 bp, Mus musculus
tccatcttggccaaatgtaccgtct

SEQ ID NO: 359888 - DNA, 25 bp, Mus musculus
tccatctttattaagcatgtgaagt

SEQ ID NO: 359889 - DNA, 25 bp, Mus musculus
tccatctttattaagtacaaatcga

SEQ ID NO: 359890 - DNA, 25 bp, Mus musculus
tccatctttggtctggctcccatgg

SEQ ID NO: 359891 - DNA, 25 bp, Mus musculus
tccatgaaaagcaagatgggcatat

SEQ ID NO: 359892 - DNA, 25 bp, Mus musculus
tccatgaaagagacaggtgttgacc

SEQ ID NO: 359893 - DNA, 25 bp, Mus musculus
tccatgaaagtgagatgagcatcag

SEQ ID NO: 359894 - DNA, 25 bp, Mus musculus
tccatgaaatgagtttctctaatag

SEQ ID NO: 359895 - DNA, 25 bp, Mus musculus
tccatgaaattcaaggatccagtga

SEQ ID NO: 359896 - DNA, 25 bp, Mus musculus
tccatgaacaagaagtcctacccta

SEQ ID NO: 359897 - DNA, 25 bp, Mus musculus
tccatgaacatatcccgtactcttc

SEQ ID NO: 359898 - DNA, 25 bp, Mus musculus
tccatgaacatgggtccaggagtgc

SEQ ID NO: 359899 - DNA, 25 bp, Mus musculus
tccatgacaaggagtatgtcagggc

SEQ ID NO: 359900 - DNA, 25 bp, Mus musculus
tccatgaccggaatccatgcccaga

SEQ ID NO: 359901 - DNA, 25 bp, Mus musculus
tccatgacctcgaaaacgggctgta

SEQ ID NO: 359902 - DNA, 25 bp, Mus musculus
tccatgactgaagggcatccgtctc

SEQ ID NO: 359903 - DNA, 25 bp, Mus musculus
tccatgagaagaggaagcttcttga

SEQ ID NO: 359904 - DNA, 25 bp, Mus musculus
tccatgagaaggtactgaatgaggc

SEQ ID NO: 359905 - DNA, 25 bp, Mus musculus
tccatgagaccctggacatgaacaa

SEQ ID NO: 359906 - DNA, 25 bp, Mus musculus
tccatgagaccctgtacatgggctg

SEQ ID NO: 359907 - DNA, 25 bp, Mus musculus
tccatgagatggattctgacgttgg

SEQ ID NO: 359908 - DNA, 25 bp, Mus musculus
tccatgagccgggtgaacctgaatt

SEQ ID NO: 359909 - DNA, 25 bp, Mus musculus
tccatgaggatttgggatttagaat

SEQ ID NO: 359910 - DNA, 25 bp, Mus musculus
tccatgagtactacagcatgggcgc

SEQ ID NO: 359911 - DNA, 25 bp, Mus musculus
tccatgagtagcgaaagcaaatcag

SEQ ID NO: 359912 - DNA, 25 bp, Mus musculus
tccatgagttcatcgatggctaaag

SEQ ID NO: 359913 - DNA, 25 bp, Mus musculus
tccatgagttcatcgatgtctactt

SEQ ID NO: 359914 - DNA, 25 bp, Mus musculus
tccatgatgtacgcaccagttgaat

SEQ ID NO: 359915 - DNA, 25 bp, Mus musculus
tccatgatgtacgccagtgaattca

SEQ ID NO: 359916 - DNA, 25 bp, Mus musculus
tccatgattgacaatgagacgctgc

SEQ ID NO: 359917 - DNA, 25 bp, Mus musculus
tccatgcaaacggtgttcaatatga

SEQ ID NO: 359918 - DNA, 25 bp, Mus musculus
tccatgcaagtgccaaatttacgga

SEQ ID NO: 359919 - DNA, 25 bp, Mus musculus
tccatgcaggaatatttaaggctgc

SEQ ID NO: 359920 - DNA, 25 bp, Mus musculus
tccatgcagtatgctgcctggctga

SEQ ID NO: 359921 - DNA, 25 bp, Mus musculus
tccatgcagtcccccagcctgcaga

SEQ ID NO: 359922 - DNA, 25 bp, Mus musculus
tccatgccataaggaaatcctacct

SEQ ID NO: 359923 - DNA, 25 bp, Mus musculus
tccatgccctctttagcagatatat

SEQ ID NO: 359924 - DNA, 25 bp, Mus musculus
tccatgccgggttgcttcctagaaa

SEQ ID NO: 359925 - DNA, 25 bp, Mus musculus
tccatgctgtcagccgttgactact

SEQ ID NO: 359926 - DNA, 25 bp, Mus musculus
tccatgctgtggagattcatgactt

SEQ ID NO: 359927 - DNA, 25 bp, Mus musculus
tccatggaagacagcagtgacagtg

SEQ ID NO: 359928 - DNA, 25 bp, Mus musculus
tccatggacaagatgcaatcactgt

SEQ ID NO: 359929 - DNA, 25 bp, Mus musculus
tccatggacatgatgttgacggcat

SEQ ID NO: 359930 - DNA, 25 bp, Mus musculus
tccatggacatgcacaatatcgcca

SEQ ID NO: 359931 - DNA, 25 bp, Mus musculus
tccatggaccctggacttcgggtga

SEQ ID NO: 359932 - DNA, 25 bp, Mus musculus
tccatggagaacaggtgcttttaca

SEQ ID NO: 359933 - DNA, 25 bp, Mus musculus
tccatggagacgatctatgacatgc

SEQ ID NO: 359934 - DNA, 25 bp, Mus musculus
tccatggagagattgatcctgttac

SEQ ID NO: 359935 - DNA, 25 bp, Mus musculus
tccatggcaccaggattttaattcc

SEQ ID NO: 359936 - DNA, 25 bp, Mus musculus
tccatggcatcagaacggggctctt

SEQ ID NO: 359937 - DNA, 25 bp, Mus musculus
tccatggcatcaggacgggcctctt

SEQ ID NO: 359938 - DNA, 25 bp, Mus musculus
tccatggcgacctggtgactccata

SEQ ID NO: 359939 - DNA, 25 bp, Mus musculus
tccatggctcagcaagcttccctgc

SEQ ID NO: 359940 - DNA, 25 bp, Mus musculus
tccatggctcagcaagcttccctgg

SEQ ID NO: 359941 - DNA, 25 bp, Mus musculus
tccatggctggcaatgtccacagac

SEQ ID NO: 359942 - DNA, 25 bp, Mus musculus
tccatggggtgcgccccgggatgcc

SEQ ID NO: 359943 - DNA, 25 bp, Mus musculus
tccatggtaacaggcctgatggaat

SEQ ID NO: 359944 - DNA, 25 bp, Mus musculus
tccatggtaacagtcaacaaatgca

SEQ ID NO: 359945 - DNA, 25 bp, Mus musculus
tccatggtgaaggaagatgaggctc

SEQ ID NO: 359946 - DNA, 25 bp, Mus musculus
tccatggtgactgatggtggaatgt

SEQ ID NO: 359947 - DNA, 25 bp, Mus musculus
tccatgtagagcaaggaaagaccgt

SEQ ID NO: 359948 - DNA, 25 bp, Mus musculus
tccatgtcaacagcgtgagcaccac

SEQ ID NO: 359949 - DNA, 25 bp, Mus musculus
tccatgtcatcatatgatttttggt

SEQ ID NO: 359950 - DNA, 25 bp, Mus musculus
tccatgtcatcattatcacttatgc

SEQ ID NO: 359951 - DNA, 25 bp, Mus musculus
tccatgtccactgaggaaacctcac

SEQ ID NO: 359952 - DNA, 25 bp, Mus musculus
tccatgtccactgagggtgtgctga

SEQ ID NO: 359953 - DNA, 25 bp, Mus musculus
tccatgtccagcaccaaagaaggca

SEQ ID NO: 359954 - DNA, 25 bp, Mus musculus
tccatgtccaggttttcccatcata

SEQ ID NO: 359955 - DNA, 25 bp, Mus musculus
tccatgtcccacaattctcgactat

SEQ ID NO: 359956 - DNA, 25 bp, Mus musculus
tccatgtcccacagtaacccctcta

SEQ ID NO: 359957 - DNA, 25 bp, Mus musculus
tccatgtcgggtgtgaagattgctc

SEQ ID NO: 359958 - DNA, 25 bp, Mus musculus
tccatgtctttaagaattctgtctt

SEQ ID NO: 359959 - DNA, 25 bp, Mus musculus
tccatgtctttaaggtgtttgtggc

SEQ ID NO: 359960 - DNA, 25 bp, Mus musculus
tccatgtgccagggaaaccgtgacg

SEQ ID NO: 359961 - DNA, 25 bp, Mus musculus
tccatgtggatgctgcctggggtgg

SEQ ID NO: 359962 - DNA, 25 bp, Mus musculus
tccatgtggatggctgactctgtgg

SEQ ID NO: 359963 - DNA, 25 bp, Mus musculus
tccatgtgggagattgtgaccttgg

SEQ ID NO: 359964 - DNA, 25 bp, Mus musculus
tccatgttcagaaaggagctcttac

SEQ ID NO: 359965 - DNA, 25 bp, Mus musculus
tccatgttcgacaccacgccccact

SEQ ID NO: 359966 - DNA, 25 bp, Mus musculus
tccatgttcgagtgctaaggatacc

SEQ ID NO: 359967 - DNA, 25 bp, Mus musculus
tccatgttggagtttggattcgagt

SEQ ID NO: 359968 - DNA, 25 bp, Mus musculus
tccatgtttgccaagggaaagaagg

SEQ ID NO: 359969 - DNA, 25 bp, Mus musculus
tccattaaaaagagcaacagtgtga

SEQ ID NO: 359970 - DNA, 25 bp, Mus musculus
tccattaaaacaaagatgtctcatt

SEQ ID NO: 359971 - DNA, 25 bp, Mus musculus
tccattaaaacaaaggggaagcgtg

SEQ ID NO: 359972 - DNA, 25 bp, Mus musculus
tccattaatcaacagattcaaggcc

SEQ ID NO: 359973 - DNA, 25 bp, Mus musculus
tccattacaagaccgaccagggcat

SEQ ID NO: 359974 - DNA, 25 bp, Mus musculus
tccattatgaaattgaagaccaaat

SEQ ID NO: 359975 - DNA, 25 bp, Mus musculus
tccattatgaagaaacagggaagct

SEQ ID NO: 359976 - DNA, 25 bp, Mus musculus
tccattcaaaggcattggccaggag

SEQ ID NO: 359977 - DNA, 25 bp, Mus musculus
tccattcacaaggattcagggaata

SEQ ID NO: 359978 - DNA, 25 bp, Mus musculus
tccattcacctacgattaccacacc

SEQ ID NO: 359979 - DNA, 25 bp, Mus musculus
tccattcacctacggcaagagatgt

SEQ ID NO: 359980 - DNA, 25 bp, Mus musculus
tccattcatcaactggccttgacag

SEQ ID NO: 359981 - DNA, 25 bp, Mus musculus
tccattcatcaggaagcaggtgtgc

SEQ ID NO: 359982 - DNA, 25 bp, Mus musculus
tccattcatgaaagctccttgtgaa

SEQ ID NO: 359983 - DNA, 25 bp, Mus musculus
tccattcatgaaaggaagaacaatt

SEQ ID NO: 359984 - DNA, 25 bp, Mus musculus
tccattcattcattcccactatggg

SEQ ID NO: 359985 - DNA, 25 bp, Mus musculus
tccattcatttcagttgcctctctg

SEQ ID NO: 359986 - DNA, 25 bp, Mus musculus
tccattccagaggcattaaaagctg

SEQ ID NO: 359987 - DNA, 25 bp, Mus musculus
tccattccggcgcccatggcgaatt

SEQ ID NO: 359988 - DNA, 25 bp, Mus musculus
tccattcctaagaagacccagcact

SEQ ID NO: 359989 - DNA, 25 bp, Mus musculus
tccattcctaagaaggccacagacc

SEQ ID NO: 359990 - DNA, 25 bp, Mus musculus
tccattctacacagctcacatgagc

SEQ ID NO: 359991 - DNA, 25 bp, Mus musculus
tccattctcacatccatgaagaaag

SEQ ID NO: 359992 - DNA, 25 bp, Mus musculus
tccattctcagcgctgtgtagttct

SEQ ID NO: 359993 - DNA, 25 bp, Mus musculus
tccattctcgaggtggctgttatct

SEQ ID NO: 359994 - DNA, 25 bp, Mus musculus
tccattctctccagctctgggcccc

SEQ ID NO: 359995 - DNA, 25 bp, Mus musculus
tccattctctggaagattaggtcag

SEQ ID NO: 359996 - DNA, 25 bp, Mus musculus
tccattctctggaagtcctagtcac

SEQ ID NO: 359997 - DNA, 25 bp, Mus musculus
tccattctgttgcaccaagtataga

SEQ ID NO: 359998 - DNA, 25 bp, Mus musculus
tccattcttagaaaacgcctccttg

SEQ ID NO: 359999 - DNA, 25 bp, Mus musculus
tccattcttgactgggctgctggac

SEQ ID NO: 360000 - DNA, 25 bp, Mus musculus
tccattctttgtggtcgctacactg

SEQ ID NO: 360001 - DNA, 25 bp, Mus musculus
tccattcttttgttggggatggaac

SEQ ID NO: 360002 - DNA, 25 bp, Mus musculus
tccattgaaagaggcttcatcactg

SEQ ID NO: 360003 - DNA, 25 bp, Mus musculus
tccattgcaaaggctgggatcatct

SEQ ID NO: 360004 - DNA, 25 bp, Mus musculus
tccattgcataaccccaaatctcag

SEQ ID NO: 360005 - DNA, 25 bp, Mus musculus
tccattgcgaggctcctgacagtgc

SEQ ID NO: 360006 - DNA, 25 bp, Mus musculus
tccattgcgctacaggggcgggaca

SEQ ID NO: 360007 - DNA, 25 bp, Mus musculus
tccattgctaactgaaatggcaaag

SEQ ID NO: 360008 - DNA, 25 bp, Mus musculus
tccattgctggggggaaaggctcaa

SEQ ID NO: 360009 - DNA, 25 bp, Mus musculus
tccattggaacaaaattctcagatc

SEQ ID NO: 360010 - DNA, 25 bp, Mus musculus
tccattggtttacagtccctggatg

SEQ ID NO: 360011 - DNA, 25 bp, Mus musculus
tccattgtagggatgtttcttgcgg

SEQ ID NO: 360012 - DNA, 25 bp, Mus musculus
tccattgtgaagtctcttattggtg

SEQ ID NO: 360013 - DNA, 25 bp, Mus musculus
tccatttaattgtaaatgaagagtg

SEQ ID NO: 360014 - DNA, 25 bp, Mus musculus
tccatttagcatggctgttggaaag

SEQ ID NO: 360015 - DNA, 25 bp, Mus musculus
tccatttatctgtaacagcgtggaa

SEQ ID NO: 360016 - DNA, 25 bp, Mus musculus
tccatttcaaggtctcaaaagattc

SEQ ID NO: 360017 - DNA, 25 bp, Mus musculus
tccatttcactccgcagatgaccct

SEQ ID NO: 360018 - DNA, 25 bp, Mus musculus
tccatttccactctgcttccctgtg

SEQ ID NO: 360019 - DNA, 25 bp, Mus musculus
tccatttcccagggcacaccaataa

SEQ ID NO: 360020 - DNA, 25 bp, Mus musculus
tccatttctgaaagattagaacacc

SEQ ID NO: 360021 - DNA, 25 bp, Mus musculus
tccatttctgaaaggccagtgaatg

SEQ ID NO: 360022 - DNA, 25 bp, Mus musculus
tccatttgaaaatgatgccagaatt

SEQ ID NO: 360023 - DNA, 25 bp, Mus musculus
tccatttggccgtaggtttagtctc

SEQ ID NO: 360024 - DNA, 25 bp, Mus musculus
tccatttgtgaagatatcgatgagt

SEQ ID NO: 360025 - DNA, 25 bp, Mus musculus
tccatttgtgaagatgaagatgaat

SEQ ID NO: 360026 - DNA, 25 bp, Mus musculus
tccattttagatctgcctcactagt

SEQ ID NO: 360027 - DNA, 25 bp, Mus musculus
tccattttcacgtggagcctgacag

SEQ ID NO: 360028 - DNA, 25 bp, Mus musculus
tccattttcacgtgggcgggccagg

SEQ ID NO: 360029 - DNA, 25 bp, Mus musculus
tccattttcagtgatataccgatac

SEQ ID NO: 360030 - DNA, 25 bp, Mus musculus
tccattttcagtgtttgtgaggaaa

SEQ ID NO: 360031 - DNA, 25 bp, Mus musculus
tccatttttcagagctgcgttcagt

SEQ ID NO: 360032 - DNA, 25 bp, Mus musculus
tcccaaaacagaataaatggagagg

SEQ ID NO: 360033 - DNA, 25 bp, Mus musculus
tcccaaaacagtatctttcagaata

SEQ ID NO: 360034 - DNA, 25 bp, Mus musculus
tcccaaaagaccatgtgacccatca

SEQ ID NO: 360035 - DNA, 25 bp, Mus musculus
tcccaaaatcacagaataccacctc

SEQ ID NO: 360036 - DNA, 25 bp, Mus musculus
tcccaaaatcacagagaagcagaac

SEQ ID NO: 360037 - DNA, 25 bp, Mus musculus
tcccaaaatggacacgctccccaga

SEQ ID NO: 360038 - DNA, 25 bp, Mus musculus
tcccaaaattgctgtgatcgcctgc

SEQ ID NO: 360039 - DNA, 25 bp, Mus musculus
tcccaaacacaaggcgaaggagatg

SEQ ID NO: 360040 - DNA, 25 bp, Mus musculus
tcccaaacaggtgcagttaaaaact

SEQ ID NO: 360041 - DNA, 25 bp, Mus musculus
tcccaaaccaaaagttgatgtagga

SEQ ID NO: 360042 - DNA, 25 bp, Mus musculus
tcccaaactatgtcggacggccaaa

SEQ ID NO: 360043 - DNA, 25 bp, Mus musculus
tcccaaactgagatttgcaacagca

SEQ ID NO: 360044 - DNA, 25 bp, Mus musculus
tcccaaagaacagaaaatcaatctt

SEQ ID NO: 360045 - DNA, 25 bp, Mus musculus
tcccaaagaacaggtcctcagaatg

SEQ ID NO: 360046 - DNA, 25 bp, Mus musculus
tcccaaagaaccatggatcggttct

SEQ ID NO: 360047 - DNA, 25 bp, Mus musculus
tcccaaagacgcaggaaaaggaaga

SEQ ID NO: 360048 - DNA, 25 bp, Mus musculus
tcccaaagagatgcacgggaataag

SEQ ID NO: 360049 - DNA, 25 bp, Mus musculus
tcccaaagatactggcattgcccga

SEQ ID NO: 360050 - DNA, 25 bp, Mus musculus
tcccaaagcctgaaaccaaaattct

SEQ ID NO: 360051 - DNA, 25 bp, Mus musculus
tcccaaagcctgatgaggatgatgc

SEQ ID NO: 360052 - DNA, 25 bp, Mus musculus
tcccaaagctaacagggacagttaa

SEQ ID NO: 360053 - DNA, 25 bp, Mus musculus
tcccaaatcagatcgacatcaggat

SEQ ID NO: 360054 - DNA, 25 bp, Mus musculus
tcccaaatgctggaccctcccaggc

SEQ ID NO: 360055 - DNA, 25 bp, Mus musculus
tcccaaatggattttctctatatga

SEQ ID NO: 360056 - DNA, 25 bp, Mus musculus
tcccaacaagacgatgatgatgacg

SEQ ID NO: 360057 - DNA, 25 bp, Mus musculus
tcccaacacccagcaagaagtctat

SEQ ID NO: 360058 - DNA, 25 bp, Mus musculus
tcccaacagaaggcgacatcccagg

SEQ ID NO: 360059 - DNA, 25 bp, Mus musculus
tcccaacagagcaagtgacaaatga

SEQ ID NO: 360060 - DNA, 25 bp, Mus musculus
tcccaacagagcaatctctggcaaa

SEQ ID NO: 360061 - DNA, 25 bp, Mus musculus
tcccaaccaagctgctggaagctct

SEQ ID NO: 360062 - DNA, 25 bp, Mus musculus
tcccaaccaaggaatcactgagatt

SEQ ID NO: 360063 - DNA, 25 bp, Mus musculus
tcccaaccacagatgactacagctg

SEQ ID NO: 360064 - DNA, 25 bp, Mus musculus
tcccaacccaaatcttccaccacct

SEQ ID NO: 360065 - DNA, 25 bp, Mus musculus
tcccaacccaagtgacgttttgaat

SEQ ID NO: 360066 - DNA, 25 bp, Mus musculus
tcccaaccgagatcctatgattgac

SEQ ID NO: 360067 - DNA, 25 bp, Mus musculus
tcccaacctcagacgacaatttcca

SEQ ID NO: 360068 - DNA, 25 bp, Mus musculus
tcccaacgaaaattgaacagatcga

SEQ ID NO: 360069 - DNA, 25 bp, Mus musculus
tcccaacggggttaagcctgatcac

SEQ ID NO: 360070 - DNA, 25 bp, Mus musculus
tcccaacgtacagagccattgtcac

SEQ ID NO: 360071 - DNA, 25 bp, Mus musculus
tcccaactacagaaaagcagtcagc

SEQ ID NO: 360072 - DNA, 25 bp, Mus musculus
tcccaactcaaggtctgatccggat

SEQ ID NO: 360073 - DNA, 25 bp, Mus musculus
tcccaactcaaggtgctgtcccaca

SEQ ID NO: 360074 - DNA, 25 bp, Mus musculus
tcccaactcagcgggtggataccct

SEQ ID NO: 360075 - DNA, 25 bp, Mus musculus
tcccaactcagcgggttcttccagt

SEQ ID NO: 360076 - DNA, 25 bp, Mus musculus
tcccaactccttcagcgcatcatga

SEQ ID NO: 360077 - DNA, 25 bp, Mus musculus
tcccaactccttcaggtccatctct

SEQ ID NO: 360078 - DNA, 25 bp, Mus musculus
tcccaactctcttccatgcgccaat

SEQ ID NO: 360079 - DNA, 25 bp, Mus musculus
tcccaactgtagtgctggacccaaa

SEQ ID NO: 360080 - DNA, 25 bp, Mus musculus
tcccaacttataaagatgattatag

SEQ ID NO: 360081 - DNA, 25 bp, Mus musculus
tcccaacttcgccaggtcctagagt

SEQ ID NO: 360082 - DNA, 25 bp, Mus musculus
tcccaagaaacatgcactgataaag

SEQ ID NO: 360083 - DNA, 25 bp, Mus musculus
tcccaagaaacatgggattactgct

SEQ ID NO: 360084 - DNA, 25 bp, Mus musculus
tcccaagacaagtgtcagcggaaac

SEQ ID NO: 360085 - DNA, 25 bp, Mus musculus
tcccaagagaaggatgggtagaaca

SEQ ID NO: 360086 - DNA, 25 bp, Mus musculus
tcccaagagccagatggtccagcgc

SEQ ID NO: 360087 - DNA, 25 bp, Mus musculus
tcccaagagggggaatacctccacg

SEQ ID NO: 360088 - DNA, 25 bp, Mus musculus
tcccaagagggtgtagcccggatcc

SEQ ID NO: 360089 - DNA, 25 bp, Mus musculus
tcccaagcaaggttgaaaggaaatg

SEQ ID NO: 360090 - DNA, 25 bp, Mus musculus
tcccaagcagacagaccgtgcgagt

SEQ ID NO: 360091 - DNA, 25 bp, Mus musculus
tcccaagcagcagcaggctgtggct

SEQ ID NO: 360092 - DNA, 25 bp, Mus musculus
tcccaagccaggctttcttgatcat

SEQ ID NO: 360093 - DNA, 25 bp, Mus musculus
tcccaagcttcctgatgctccattg

SEQ ID NO: 360094 - DNA, 25 bp, Mus musculus
tcccaagcttctgaggagctagaag

SEQ ID NO: 360095 - DNA, 25 bp, Mus musculus
tcccaaggaaggagtctatgaactg

SEQ ID NO: 360096 - DNA, 25 bp, Mus musculus
tcccaaggaagttcatgttctgtgg

SEQ ID NO: 360097 - DNA, 25 bp, Mus musculus
tcccaaggaccattctggatgcaga

SEQ ID NO: 360098 - DNA, 25 bp, Mus musculus
tcccaagggaagggaggaagagaca

SEQ ID NO: 360099 - DNA, 25 bp, Mus musculus
tcccaagggaaggggagaggcctgt

SEQ ID NO: 360100 - DNA, 25 bp, Mus musculus
tcccaaggtgcagcaacctcacttt

SEQ ID NO: 360101 - DNA, 25 bp, Mus musculus
tcccaaggtgcaggctttggttaga

SEQ ID NO: 360102 - DNA, 25 bp, Mus musculus
tcccaagtagcatgctacaaatgaa

SEQ ID NO: 360103 - DNA, 25 bp, Mus musculus
tcccaagtatgagcccaattttgcc

SEQ ID NO: 360104 - DNA, 25 bp, Mus musculus
tcccaagtcggatgtggaaatggaa

SEQ ID NO: 360105 - DNA, 25 bp, Mus musculus
tcccaagtcggttaacagtgatgtc

SEQ ID NO: 360106 - DNA, 25 bp, Mus musculus
tcccaagttcaagggaatcaaagac

SEQ ID NO: 360107 - DNA, 25 bp, Mus musculus
tcccaataaaagataattggttaag

SEQ ID NO: 360108 - DNA, 25 bp, Mus musculus
tcccaataaaaggctcccgtccacc

SEQ ID NO: 360109 - DNA, 25 bp, Mus musculus
tcccaatcctcaaccagttctgtat

SEQ ID NO: 360110 - DNA, 25 bp, Mus musculus
tcccaatcctcgagccctgacatac

SEQ ID NO: 360111 - DNA, 25 bp, Mus musculus
tcccaatctggggaactctgataag

SEQ ID NO: 360112 - DNA, 25 bp, Mus musculus
tcccaatgacggtcaagatgctgaa

SEQ ID NO: 360113 - DNA, 25 bp, Mus musculus
tcccaatgatctgattggctgtgtg

SEQ ID NO: 360114 - DNA, 25 bp, Mus musculus
tcccaatgatggcagcaagatcagc

SEQ ID NO: 360115 - DNA, 25 bp, Mus musculus
tcccaatgctcggtccgcggagggg

SEQ ID NO: 360116 - DNA, 25 bp, Mus musculus
tcccaatggtgatgatggtgaatgt

SEQ ID NO: 360117 - DNA, 25 bp, Mus musculus
tcccaatgtggaagaagctcagaaa

SEQ ID NO: 360118 - DNA, 25 bp, Mus musculus
tcccaatgttgtacggctgatggat

SEQ ID NO: 360119 - DNA, 25 bp, Mus musculus
tcccaatgttgtacggtggttacgc

SEQ ID NO: 360120 - DNA, 25 bp, Mus musculus
tcccaattcaggaagcacagaccaa

SEQ ID NO: 360121 - DNA, 25 bp, Mus musculus
tcccaattgcccaagaacaaacctg

SEQ ID NO: 360122 - DNA, 25 bp, Mus musculus
tcccaattgcccaagagttaaccag

SEQ ID NO: 360123 - DNA, 25 bp, Mus musculus
tcccaattgcccaaggtaataatct

SEQ ID NO: 360124 - DNA, 25 bp, Mus musculus
tcccaatttcaggctcacccatgac

SEQ ID NO: 360125 - DNA, 25 bp, Mus musculus
tcccacaacgttcacccggccacac

SEQ ID NO: 360126 - DNA, 25 bp, Mus musculus
tcccacacagccttggacaaattac

SEQ ID NO: 360127 - DNA, 25 bp, Mus musculus
tcccacacaggcgctctgaaatcac

SEQ ID NO: 360128 - DNA, 25 bp, Mus musculus
tcccacacaggtgagaagccctacg

SEQ ID NO: 360129 - DNA, 25 bp, Mus musculus
tcccacagaaatgctgcacaatgtc

SEQ ID NO: 360130 - DNA, 25 bp, Mus musculus
tcccacagaacacggaatgacaagg

SEQ ID NO: 360131 - DNA, 25 bp, Mus musculus
tcccacagaacacgtgaaagcagag

SEQ ID NO: 360132 - DNA, 25 bp, Mus musculus
tcccacagaaggacccagaaatcta

SEQ ID NO: 360133 - DNA, 25 bp, Mus musculus
tcccacagaggttgaaatgggcatg

SEQ ID NO: 360134 - DNA, 25 bp, Mus musculus
tcccacagatgaagtgtcctataca

SEQ ID NO: 360135 - DNA, 25 bp, Mus musculus
tcccacagatggaacagattctggt

SEQ ID NO: 360136 - DNA, 25 bp, Mus musculus
tcccacagcacccaccatcccctgc

SEQ ID NO: 360137 - DNA, 25 bp, Mus musculus
tcccacagcacccagcatgaggagc

SEQ ID NO: 360138 - DNA, 25 bp, Mus musculus
tcccacagcatccgaacttttgtga

SEQ ID NO: 360139 - DNA, 25 bp, Mus musculus
tcccacagctggtggagatgattgc

SEQ ID NO: 360140 - DNA, 25 bp, Mus musculus
tcccacagctggtggagttgttggg

SEQ ID NO: 360141 - DNA, 25 bp, Mus musculus
tcccacatactatatatgccgttcc

SEQ ID NO: 360142 - DNA, 25 bp, Mus musculus
tcccacatcaaggtggtggtcggcg

SEQ ID NO: 360143 - DNA, 25 bp, Mus musculus
tcccacattcaggtccaacaaagtt

SEQ ID NO: 360144 - DNA, 25 bp, Mus musculus
tcccacattggcaagacattgcttt

SEQ ID NO: 360145 - DNA, 25 bp, Mus musculus
tcccaccaacaaggcctgtttcgat

SEQ ID NO: 360146 - DNA, 25 bp, Mus musculus
tcccaccaagcccacaaggcccgac

SEQ ID NO: 360147 - DNA, 25 bp, Mus musculus
tcccaccaagctctctgctggaaaa

SEQ ID NO: 360148 - DNA, 25 bp, Mus musculus
tcccaccaaggtgaaggcccacggt

SEQ ID NO: 360149 - DNA, 25 bp, Mus musculus
tcccaccaattcccacagagaacca

SEQ ID NO: 360150 - DNA, 25 bp, Mus musculus
tcccaccaccgggtgtgatgaatca

SEQ ID NO: 360151 - DNA, 25 bp, Mus musculus
tcccaccagatgcagcatccctgga

SEQ ID NO: 360152 - DNA, 25 bp, Mus musculus
tcccaccagatgcaggagagaagat

SEQ ID NO: 360153 - DNA, 25 bp, Mus musculus
tcccaccagatgcagtgttgtggtc

SEQ ID NO: 360154 - DNA, 25 bp, Mus musculus
tcccaccatgatgggaagaaaggaa

SEQ ID NO: 360155 - DNA, 25 bp, Mus musculus
tcccacccagacaggcttcaggaca

SEQ ID NO: 360156 - DNA, 25 bp, Mus musculus
tcccacccaggaatccaaacgcttt

SEQ ID NO: 360157 - DNA, 25 bp, Mus musculus
tcccacccagtgatgactacgatga

SEQ ID NO: 360158 - DNA, 25 bp, Mus musculus
tcccaccccagggttcctgctggac

SEQ ID NO: 360159 - DNA, 25 bp, Mus musculus
tcccaccccagtacggcctctactc

SEQ ID NO: 360160 - DNA, 25 bp, Mus musculus
tcccacccctcaagcatgaccagtg

SEQ ID NO: 360161 - DNA, 25 bp, Mus musculus
tcccacccctcaagttcacagctcc

SEQ ID NO: 360162 - DNA, 25 bp, Mus musculus
tcccaccgagcaggtgacattccca

SEQ ID NO: 360163 - DNA, 25 bp, Mus musculus
tcccaccgcagcccagggagaaagt

SEQ ID NO: 360164 - DNA, 25 bp, Mus musculus
tcccaccgcaggtatcatccggata

SEQ ID NO: 360165 - DNA, 25 bp, Mus musculus
tcccacctacgggtggcggctgaca

SEQ ID NO: 360166 - DNA, 25 bp, Mus musculus
tcccacctgagctggatgtaccctc

SEQ ID NO: 360167 - DNA, 25 bp, Mus musculus
tcccacctgccagacgcacagccga

SEQ ID NO: 360168 - DNA, 25 bp, Mus musculus
tcccaccttgaggcctttcttccag

SEQ ID NO: 360169 - DNA, 25 bp, Mus musculus
tcccaccttgagggaagtaaccagg

SEQ ID NO: 360170 - DNA, 25 bp, Mus musculus
tcccaccttgagggtcctgagtccc

SEQ ID NO: 360171 - DNA, 25 bp, Mus musculus
tcccaccttgccaggttctgcctta

SEQ ID NO: 360172 - DNA, 25 bp, Mus musculus
tcccacgcagagggtctggagacat

SEQ ID NO: 360173 - DNA, 25 bp, Mus musculus
tcccacgcgtcagaggtccctctgt

SEQ ID NO: 360174 - DNA, 25 bp, Mus musculus
tcccacgctaagatgcccctagacc

SEQ ID NO: 360175 - DNA, 25 bp, Mus musculus
tcccacgctccaggagaggcgggag

SEQ ID NO: 360176 - DNA, 25 bp, Mus musculus
tcccacggcatcacaaggccatcgc

SEQ ID NO: 360177 - DNA, 25 bp, Mus musculus
tcccacggcatcacactatggagtg

SEQ ID NO: 360178 - DNA, 25 bp, Mus musculus
tcccacggctccaaggatgccaaca

SEQ ID NO: 360179 - DNA, 25 bp, Mus musculus
tcccacggctgctgacctcctgcag

SEQ ID NO: 360180 - DNA, 25 bp, Mus musculus
tcccactagacgaaggaaacagcaa

SEQ ID NO: 360181 - DNA, 25 bp, Mus musculus
tcccactattggctttggaccttga

SEQ ID NO: 360182 - DNA, 25 bp, Mus musculus
tcccactcatgttactgggcctggt

SEQ ID NO: 360183 - DNA, 25 bp, Mus musculus
tcccactccccagagcctcaagtca

SEQ ID NO: 360184 - DNA, 25 bp, Mus musculus
tcccactctcctgaacttccaggtc

SEQ ID NO: 360185 - DNA, 25 bp, Mus musculus
tcccactctcctgggctgcaactgg

SEQ ID NO: 360186 - DNA, 25 bp, Mus musculus
tcccactctcctggtcctgagtcag

SEQ ID NO: 360187 - DNA, 25 bp, Mus musculus
tcccactctgaggagaagaattgag

SEQ ID NO: 360188 - DNA, 25 bp, Mus musculus
tcccactctgaggtccagagttcaa

SEQ ID NO: 360189 - DNA, 25 bp, Mus musculus
tcccactgacagaaacaaataaaac

SEQ ID NO: 360190 - DNA, 25 bp, Mus musculus
tcccactgacagaaaccgtaatcct

SEQ ID NO: 360191 - DNA, 25 bp, Mus musculus
tcccactgaggccaatgtgctttgt

SEQ ID NO: 360192 - DNA, 25 bp, Mus musculus
tcccactgatgacactttcatggtg

SEQ ID NO: 360193 - DNA, 25 bp, Mus musculus
tcccactgcaatttgaagagcttgt

SEQ ID NO: 360194 - DNA, 25 bp, Mus musculus
tcccactggagcagctaaatgagat

SEQ ID NO: 360195 - DNA, 25 bp, Mus musculus
tcccactgggcctgaagtggaggtg

SEQ ID NO: 360196 - DNA, 25 bp, Mus musculus
tcccactggggctgaagtggaggtg

SEQ ID NO: 360197 - DNA, 25 bp, Mus musculus
tcccactgtacaacatcagccatgc

SEQ ID NO: 360198 - DNA, 25 bp, Mus musculus
tcccactgtacaacttgactggtct

SEQ ID NO: 360199 - DNA, 25 bp, Mus musculus
tcccactgtgcaaactctggcctgt

SEQ ID NO: 360200 - DNA, 25 bp, Mus musculus
tcccactgtgttgagcacatcgagt

SEQ ID NO: 360201 - DNA, 25 bp, Mus musculus
tcccactgtgttgaggtcctgagtt

SEQ ID NO: 360202 - DNA, 25 bp, Mus musculus
tcccacttgctcagccttcctgatc

SEQ ID NO: 360203 - DNA, 25 bp, Mus musculus
tcccactttcataagattcggctcc

SEQ ID NO: 360204 - DNA, 25 bp, Mus musculus
tcccagaaagccccgcagccctaca

SEQ ID NO: 360205 - DNA, 25 bp, Mus musculus
tcccagaaaggatgaggccatcctc

SEQ ID NO: 360206 - DNA, 25 bp, Mus musculus
tcccagaacaagactgagaatcaga

SEQ ID NO: 360207 - DNA, 25 bp, Mus musculus
tcccagaacaagattactactcaac

SEQ ID NO: 360208 - DNA, 25 bp, Mus musculus
tcccagaacaatattgctgccttcc

SEQ ID NO: 360209 - DNA, 25 bp, Mus musculus
tcccagaacacgagcccaagatgat

SEQ ID NO: 360210 - DNA, 25 bp, Mus musculus
tcccagaacagatcgggaagctgca

SEQ ID NO: 360211 - DNA, 25 bp, Mus musculus
tcccagaacgatgtggaacagggaa

SEQ ID NO: 360212 - DNA, 25 bp, Mus musculus
tcccagaagaatatggtggcctggg

SEQ ID NO: 360213 - DNA, 25 bp, Mus musculus
tcccagaagaatctgatgccaacgc

SEQ ID NO: 360214 - DNA, 25 bp, Mus musculus
tcccagaagaggacactacatgaag

SEQ ID NO: 360215 - DNA, 25 bp, Mus musculus
tcccagaatactgaacttcgtgtat

SEQ ID NO: 360216 - DNA, 25 bp, Mus musculus
tcccagaatactgacaaaaaaagcc

SEQ ID NO: 360217 - DNA, 25 bp, Mus musculus
tcccagaatatgaccccagcagcga

SEQ ID NO: 360218 - DNA, 25 bp, Mus musculus
tcccagaatatgatggaccccagag

SEQ ID NO: 360219 - DNA, 25 bp, Mus musculus
tcccagaatatgcgatgatccctcc

SEQ ID NO: 360220 - DNA, 25 bp, Mus musculus
tcccagaatggatgtaaccattact

SEQ ID NO: 360221 - DNA, 25 bp, Mus musculus
tcccagaatgttatggctgcagctt

SEQ ID NO: 360222 - DNA, 25 bp, Mus musculus
tcccagacagacggtggcgcctcat

SEQ ID NO: 360223 - DNA, 25 bp, Mus musculus
tcccagacagagatgctgcctggga

SEQ ID NO: 360224 - DNA, 25 bp, Mus musculus
tcccagacagcagctgcagtatctc

SEQ ID NO: 360225 - DNA, 25 bp, Mus musculus
tcccagacagcttgcttgccttttg

SEQ ID NO: 360226 - DNA, 25 bp, Mus musculus
tcccagagaaaaggtggagcttttg

SEQ ID NO: 360227 - DNA, 25 bp, Mus musculus
tcccagagaaaggatgcaagctgtt

SEQ ID NO: 360228 - DNA, 25 bp, Mus musculus
tcccagagaaggaagacaccaaatc

SEQ ID NO: 360229 - DNA, 25 bp, Mus musculus
tcccagagaaggaaggaatgtcact

SEQ ID NO: 360230 - DNA, 25 bp, Mus musculus
tcccagagaaggaaggtatttccaa

SEQ ID NO: 360231 - DNA, 25 bp, Mus musculus
tcccagagaagggggaactgattac

SEQ ID NO: 360232 - DNA, 25 bp, Mus musculus
tcccagagagctgatggccaggagg

SEQ ID NO: 360233 - DNA, 25 bp, Mus musculus
tcccagagccaaaaaccaaagatga

SEQ ID NO: 360234 - DNA, 25 bp, Mus musculus
tcccagagccaaaacttccacggaa

SEQ ID NO: 360235 - DNA, 25 bp, Mus musculus
tcccagagccagatgaagagctaga

SEQ ID NO: 360236 - DNA, 25 bp, Mus musculus
tcccagagccaggctccccagcaca

SEQ ID NO: 360237 - DNA, 25 bp, Mus musculus
tcccagagccgacagagcaagtgtt

SEQ ID NO: 360238 - DNA, 25 bp, Mus musculus
tcccagagccgacagagcttcgtcc

SEQ ID NO: 360239 - DNA, 25 bp, Mus musculus
tcccagagcctccagagcttcgtcc

SEQ ID NO: 360240 - DNA, 25 bp, Mus musculus
tcccagagctcaaggagcgaatctg

SEQ ID NO: 360241 - DNA, 25 bp, Mus musculus
tcccagagctcaaggctaacccttt

SEQ ID NO: 360242 - DNA, 25 bp, Mus musculus
tcccagagctcccagacttcttcga

SEQ ID NO: 360243 - DNA, 25 bp, Mus musculus
tcccagaggaactctgtgcctgttc

SEQ ID NO: 360244 - DNA, 25 bp, Mus musculus
tcccagaggaggacgatgtcatgat

SEQ ID NO: 360245 - DNA, 25 bp, Mus musculus
tcccagaggagttggatattctaaa

SEQ ID NO: 360246 - DNA, 25 bp, Mus musculus
tcccagaggctcctgaggaagaagc

SEQ ID NO: 360247 - DNA, 25 bp, Mus musculus
tcccagagggcattcaaagggatgg

SEQ ID NO: 360248 - DNA, 25 bp, Mus musculus
tcccagatacaccagttgtgacaca

SEQ ID NO: 360249 - DNA, 25 bp, Mus musculus
tcccagatacccagaaatggaactg

SEQ ID NO: 360250 - DNA, 25 bp, Mus musculus
tcccagatctctctggcttttggga

SEQ ID NO: 360251 - DNA, 25 bp, Mus musculus
tcccagatgccaaatagaccttctg

SEQ ID NO: 360252 - DNA, 25 bp, Mus musculus
tcccagatgccaaattggatgaata

SEQ ID NO: 360253 - DNA, 25 bp, Mus musculus
tcccagatgctggcttggagatgaa

SEQ ID NO: 360254 - DNA, 25 bp, Mus musculus
tcccagattactaaggacaacatag

SEQ ID NO: 360255 - DNA, 25 bp, Mus musculus
tcccagattataagtttccagaact

SEQ ID NO: 360256 - DNA, 25 bp, Mus musculus
tcccagattatgcacaggacctcag

SEQ ID NO: 360257 - DNA, 25 bp, Mus musculus
tcccagattgtaaagcgtgaagaca

SEQ ID NO: 360258 - DNA, 25 bp, Mus musculus
tcccagattgtaaagtgatggttca

SEQ ID NO: 360259 - DNA, 25 bp, Mus musculus
tcccagcaatgccagtgccttcgtg

SEQ ID NO: 360260 - DNA, 25 bp, Mus musculus
tcccagcaatgccagttttcccatg

SEQ ID NO: 360261 - DNA, 25 bp, Mus musculus
tcccagcacacagacctatgcttgg

SEQ ID NO: 360262 - DNA, 25 bp, Mus musculus
tcccagcacctgtccctcactctcc

SEQ ID NO: 360263 - DNA, 25 bp, Mus musculus
tcccagcacgccgctttttagaact

SEQ ID NO: 360264 - DNA, 25 bp, Mus musculus
tcccagcagaaggagtgtcctctcc

SEQ ID NO: 360265 - DNA, 25 bp, Mus musculus
tcccagcagaaggcagcaagcgccc

SEQ ID NO: 360266 - DNA, 25 bp, Mus musculus
tcccagcagcaagaaggtgacgggc

SEQ ID NO: 360267 - DNA, 25 bp, Mus musculus
tcccagcagcaagtgggcagaagtt

SEQ ID NO: 360268 - DNA, 25 bp, Mus musculus
tcccagcagcattctgcagacctcc

SEQ ID NO: 360269 - DNA, 25 bp, Mus musculus
tcccagccaccaaaggggaggcgcg

SEQ ID NO: 360270 - DNA, 25 bp, Mus musculus
tcccagcccaagttccaaagaacat

SEQ ID NO: 360271 - DNA, 25 bp, Mus musculus
tcccagccctcacctcctgtctcac

SEQ ID NO: 360272 - DNA, 25 bp, Mus musculus
tcccagccgctcatgtgggatatga

SEQ ID NO: 360273 - DNA, 25 bp, Mus musculus
tcccagccggagtgttcttttgttc

SEQ ID NO: 360274 - DNA, 25 bp, Mus musculus
tcccagcctaggcgaaacctgacca

SEQ ID NO: 360275 - DNA, 25 bp, Mus musculus
tcccagcgaaaagcccattggaata

SEQ ID NO: 360276 - DNA, 25 bp, Mus musculus
tcccagcgagatggagttgctatgc

SEQ ID NO: 360277 - DNA, 25 bp, Mus musculus
tcccagcgagcagccctgcaactcc

SEQ ID NO: 360278 - DNA, 25 bp, Mus musculus
tcccagcgaggagagagtgtatatg

SEQ ID NO: 360279 - DNA, 25 bp, Mus musculus
tcccagcgcaagagcctgttattct

SEQ ID NO: 360280 - DNA, 25 bp, Mus musculus
tcccagcgcagggacagtcacgagg

SEQ ID NO: 360281 - DNA, 25 bp, Mus musculus
tcccagcgcagggttaatttctaat

SEQ ID NO: 360282 - DNA, 25 bp, Mus musculus
tcccagcgctttggagctgtgtgga

SEQ ID NO: 360283 - DNA, 25 bp, Mus musculus
tcccagcgctttggagctgtgtgtg

SEQ ID NO: 360284 - DNA, 25 bp, Mus musculus
tcccagcggcagagatagctgttgt

SEQ ID NO: 360285 - DNA, 25 bp, Mus musculus
tcccagcggcagctgagcagaataa

SEQ ID NO: 360286 - DNA, 25 bp, Mus musculus
tcccagctcacttcttccccgtccc

SEQ ID NO: 360287 - DNA, 25 bp, Mus musculus
tcccagctcagcatgaaagcatccc

SEQ ID NO: 360288 - DNA, 25 bp, Mus musculus
tcccagctcaggaggaaaactccct

SEQ ID NO: 360289 - DNA, 25 bp, Mus musculus
tcccagctcgtaaagctcaatgtcg

SEQ ID NO: 360290 - DNA, 25 bp, Mus musculus
tcccagctgagactggctggtggac

SEQ ID NO: 360291 - DNA, 25 bp, Mus musculus
tcccagctggggtcggagcttccac

SEQ ID NO: 360292 - DNA, 25 bp, Mus musculus
tcccagcttccctcgcaacctcctg

SEQ ID NO: 360293 - DNA, 25 bp, Mus musculus
tcccagcttccctcgcggggctgcg

SEQ ID NO: 360294 - DNA, 25 bp, Mus musculus
tcccagcttcgcaggacccaacctc

SEQ ID NO: 360295 - DNA, 25 bp, Mus musculus
tcccaggaaaggtgattgatgagat

SEQ ID NO: 360296 - DNA, 25 bp, Mus musculus
tcccaggaacaggtatacaagagac

SEQ ID NO: 360297 - DNA, 25 bp, Mus musculus
tcccaggaagcctcaaggagaagct

SEQ ID NO: 360298 - DNA, 25 bp, Mus musculus
tcccaggaagcgtgcccaactaatt

SEQ ID NO: 360299 - DNA, 25 bp, Mus musculus
tcccaggaagctggagaaggggtgg

SEQ ID NO: 360300 - DNA, 25 bp, Mus musculus
tcccaggaagctggtccagctcagc

SEQ ID NO: 360301 - DNA, 25 bp, Mus musculus
tcccaggaagtgcaaagaggagatt

SEQ ID NO: 360302 - DNA, 25 bp, Mus musculus
tcccaggacgatagccagccctgga

SEQ ID NO: 360303 - DNA, 25 bp, Mus musculus
tcccaggacggctactggcaggagc

SEQ ID NO: 360304 - DNA, 25 bp, Mus musculus
tcccaggactggtcaatgtggctac

SEQ ID NO: 360305 - DNA, 25 bp, Mus musculus
tcccaggagaggaatgctgtggccc

SEQ ID NO: 360306 - DNA, 25 bp, Mus musculus
tcccaggagagtcccggagagtgga

SEQ ID NO: 360307 - DNA, 25 bp, Mus musculus
tcccaggagtgcaagaacctgatcc

SEQ ID NO: 360308 - DNA, 25 bp, Mus musculus
tcccaggagtgcaagggctccagca

SEQ ID NO: 360309 - DNA, 25 bp, Mus musculus
tcccaggattcaagggagccccggg

SEQ ID NO: 360310 - DNA, 25 bp, Mus musculus
tcccaggcaagcctggaagagttgt

SEQ ID NO: 360311 - DNA, 25 bp, Mus musculus
tcccaggcaagggcagtgtatgggg

SEQ ID NO: 360312 - DNA, 25 bp, Mus musculus
tcccaggccacctcgggcaaggtgg

SEQ ID NO: 360313 - DNA, 25 bp, Mus musculus
tcccaggccctgaatgaagaagagt

SEQ ID NO: 360314 - DNA, 25 bp, Mus musculus
tcccaggccttgggaaaagctgtgt

SEQ ID NO: 360315 - DNA, 25 bp, Mus musculus
tcccaggctgatagagacatcggcg

SEQ ID NO: 360316 - DNA, 25 bp, Mus musculus
tcccaggctggacagagatttcctc

SEQ ID NO: 360317 - DNA, 25 bp, Mus musculus
tcccaggctggagaaagctgtggca

SEQ ID NO: 360318 - DNA, 25 bp, Mus musculus
tcccaggctttggaggaagtggcca

SEQ ID NO: 360319 - DNA, 25 bp, Mus musculus
tcccaggctttggagtaggccagac

SEQ ID NO: 360320 - DNA, 25 bp, Mus musculus
tcccagggacgaaaggagtctgagg

SEQ ID NO: 360321 - DNA, 25 bp, Mus musculus
tcccagggaggtcagcacctcggca

SEQ ID NO: 360322 - DNA, 25 bp, Mus musculus
tcccagggcagcagagaatcagctg

SEQ ID NO: 360323 - DNA, 25 bp, Mus musculus
tcccagggcagcccagcaagacgca

SEQ ID NO: 360324 - DNA, 25 bp, Mus musculus
tcccagggccaacaggtgaccgagg

SEQ ID NO: 360325 - DNA, 25 bp, Mus musculus
tcccagggccacaaggtgaccgagg

SEQ ID NO: 360326 - DNA, 25 bp, Mus musculus
tcccaggggaaggctactacatggg

SEQ ID NO: 360327 - DNA, 25 bp, Mus musculus
tcccagggttacagacagggtttct

SEQ ID NO: 360328 - DNA, 25 bp, Mus musculus
tcccagggttacagatgctctctga

SEQ ID NO: 360329 - DNA, 25 bp, Mus musculus
tcccaggtacagatcatattgatca

SEQ ID NO: 360330 - DNA, 25 bp, Mus musculus
tcccaggtcgctcaggacatcagca

SEQ ID NO: 360331 - DNA, 25 bp, Mus musculus
tcccaggtcgctcaggcttgcagat

SEQ ID NO: 360332 - DNA, 25 bp, Mus musculus
tcccaggtcgggaccctggtgactg

SEQ ID NO: 360333 - DNA, 25 bp, Mus musculus
tcccaggtcggtgttttatctgctg

SEQ ID NO: 360334 - DNA, 25 bp, Mus musculus
tcccaggtgacaccgcttggctcct

SEQ ID NO: 360335 - DNA, 25 bp, Mus musculus
tcccaggtgcaaccagagctgcctg

SEQ ID NO: 360336 - DNA, 25 bp, Mus musculus
tcccaggtgcagcctctaggtcgcc

SEQ ID NO: 360337 - DNA, 25 bp, Mus musculus
tcccagtaacaagaggcttcccgag

SEQ ID NO: 360338 - DNA, 25 bp, Mus musculus
tcccagtaaggaaactctcggtgcc

SEQ ID NO: 360339 - DNA, 25 bp, Mus musculus
tcccagtagcaagatggactgtaac

SEQ ID NO: 360340 - DNA, 25 bp, Mus musculus
tcccagtcagacactgcatatgcga

SEQ ID NO: 360341 - DNA, 25 bp, Mus musculus
tcccagtcagagctctgaacatgtc

SEQ ID NO: 360342 - DNA, 25 bp, Mus musculus
tcccagtccaccatgctgatgggga

SEQ ID NO: 360343 - DNA, 25 bp, Mus musculus
tcccagtccattgaggcgcccttga

SEQ ID NO: 360344 - DNA, 25 bp, Mus musculus
tcccagtccccacgggcactatgaa

SEQ ID NO: 360345 - DNA, 25 bp, Mus musculus
tcccagtgaagagacatcatgtgac

SEQ ID NO: 360346 - DNA, 25 bp, Mus musculus
tcccagtgaaggtcgcaggcatcct

SEQ ID NO: 360347 - DNA, 25 bp, Mus musculus
tcccagtgcaggatttactaggtca

SEQ ID NO: 360348 - DNA, 25 bp, Mus musculus
tcccagtgcagggataacaacaccc

SEQ ID NO: 360349 - DNA, 25 bp, Mus musculus
tcccagtgctgcacatgatggcatc

SEQ ID NO: 360350 - DNA, 25 bp, Mus musculus
tcccagtgctgggtctcttttaaaa

SEQ ID NO: 360351 - DNA, 25 bp, Mus musculus
tcccagtggcacagatgccctaggt

SEQ ID NO: 360352 - DNA, 25 bp, Mus musculus
tcccagtggcacaggtctccaccgc

SEQ ID NO: 360353 - DNA, 25 bp, Mus musculus
tcccagtggggctcaagagtgtcat

SEQ ID NO: 360354 - DNA, 25 bp, Mus musculus
tcccagtggggtacatgtacccctc

SEQ ID NO: 360355 - DNA, 25 bp, Mus musculus
tcccagtgtgctccaactgctggag

SEQ ID NO: 360356 - DNA, 25 bp, Mus musculus
tcccagttctcagagccccgtattc

SEQ ID NO: 360357 - DNA, 25 bp, Mus musculus
tcccataaagcccaaactcccacaa

SEQ ID NO: 360358 - DNA, 25 bp, Mus musculus
tcccataaagcccaagtggaacggc

SEQ ID NO: 360359 - DNA, 25 bp, Mus musculus
tcccataccagcgaggggtcccgta

SEQ ID NO: 360360 - DNA, 25 bp, Mus musculus
tcccataccgcaagagacagataaa

SEQ ID NO: 360361 - DNA, 25 bp, Mus musculus
tcccataccgcaagatcgtctactt

SEQ ID NO: 360362 - DNA, 25 bp, Mus musculus
tcccatacctgctgagggacccagg

SEQ ID NO: 360363 - DNA, 25 bp, Mus musculus
tcccatacctgctgctccagcacgg

SEQ ID NO: 360364 - DNA, 25 bp, Mus musculus
tcccatactcggtccctgaatggca

SEQ ID NO: 360365 - DNA, 25 bp, Mus musculus
tcccatatatgtggggccgagcaat

SEQ ID NO: 360366 - DNA, 25 bp, Mus musculus
tcccatatgtgaaggaagaagaaat

SEQ ID NO: 360367 - DNA, 25 bp, Mus musculus
tcccatcactcagggaaaccttagc

SEQ ID NO: 360368 - DNA, 25 bp, Mus musculus
tcccatcactcaggtcgctgttatt

SEQ ID NO: 360369 - DNA, 25 bp, Mus musculus
tcccatcagcaagccaccaccacga

SEQ ID NO: 360370 - DNA, 25 bp, Mus musculus
tcccatcagccgagatgaacctcta

SEQ ID NO: 360371 - DNA, 25 bp, Mus musculus
tcccatcaggaggaggagatagaag

SEQ ID NO: 360372 - DNA, 25 bp, Mus musculus
tcccatcatgaacggacccaagtgt

SEQ ID NO: 360373 - DNA, 25 bp, Mus musculus
tcccatcatttgaggctctttcaca

SEQ ID NO: 360374 - DNA, 25 bp, Mus musculus
tcccatccagctggtgaagacacac

SEQ ID NO: 360375 - DNA, 25 bp, Mus musculus
tcccatccgacagcccgccggagtc

SEQ ID NO: 360376 - DNA, 25 bp, Mus musculus
tcccatcctcacaaaagcacttgca

SEQ ID NO: 360377 - DNA, 25 bp, Mus musculus
tcccatcctgaagtttatcccgatg

SEQ ID NO: 360378 - DNA, 25 bp, Mus musculus
tcccatctccgatggtggaaccagg

SEQ ID NO: 360379 - DNA, 25 bp, Mus musculus
tcccatctcttttaggatggacgac

SEQ ID NO: 360380 - DNA, 25 bp, Mus musculus
tcccatctttaaaagatgttcctcc

SEQ ID NO: 360381 - DNA, 25 bp, Mus musculus
tcccatgaagaaaaaagatgttgga

SEQ ID NO: 360382 - DNA, 25 bp, Mus musculus
tcccatgaccaaaggactctgatca

SEQ ID NO: 360383 - DNA, 25 bp, Mus musculus
tcccatgacttttgtacaaacaaat

SEQ ID NO: 360384 - DNA, 25 bp, Mus musculus
tcccatgatgaccctatcaaggaga

SEQ ID NO: 360385 - DNA, 25 bp, Mus musculus
tcccatgattaatgaattagtagaa

SEQ ID NO: 360386 - DNA, 25 bp, Mus musculus
tcccatgcagctcggggtctggttc

SEQ ID NO: 360387 - DNA, 25 bp, Mus musculus
tcccatgcccctgtttcactggctg

SEQ ID NO: 360388 - DNA, 25 bp, Mus musculus
tcccatgcccgtggctgttcgacga

SEQ ID NO: 360389 - DNA, 25 bp, Mus musculus
tcccatgcgagctgatggctttgtg

SEQ ID NO: 360390 - DNA, 25 bp, Mus musculus
tcccatgcgagctggtccctgagtt

SEQ ID NO: 360391 - DNA, 25 bp, Mus musculus
tcccatgcgtcaggaaatgtgtttt

SEQ ID NO: 360392 - DNA, 25 bp, Mus musculus
tcccatggaacaccccatgcttacc

SEQ ID NO: 360393 - DNA, 25 bp, Mus musculus
tcccatggtcaagacgtccgtcctc

SEQ ID NO: 360394 - DNA, 25 bp, Mus musculus
tcccatgtgtgcagcttccattgaa

SEQ ID NO: 360395 - DNA, 25 bp, Mus musculus
tcccatgtgtgcaggttgtacttgt

SEQ ID NO: 360396 - DNA, 25 bp, Mus musculus
tcccatgttgttgctggttgttgga

SEQ ID NO: 360397 - DNA, 25 bp, Mus musculus
tcccattagcaaaggtggattgcac

SEQ ID NO: 360398 - DNA, 25 bp, Mus musculus
tcccattcttcaggtgttgggaaac

SEQ ID NO: 360399 - DNA, 25 bp, Mus musculus
tcccattcttctgggtcggatgctc

SEQ ID NO: 360400 - DNA, 25 bp, Mus musculus
tcccattgagtagatttgaaagaag

SEQ ID NO: 360401 - DNA, 25 bp, Mus musculus
tcccattgcaagataaataggattt

SEQ ID NO: 360402 - DNA, 25 bp, Mus musculus
tcccattggaaagatggtggaacca

SEQ ID NO: 360403 - DNA, 25 bp, Mus musculus
tcccattgtgggagagccaggctac

SEQ ID NO: 360404 - DNA, 25 bp, Mus musculus
tcccatttcaggtgctggtggcaac

SEQ ID NO: 360405 - DNA, 25 bp, Mus musculus
tcccatttgattgagaaatgtgatg

SEQ ID NO: 360406 - DNA, 25 bp, Mus musculus
tccccaaaacctgacgtccacgtct

SEQ ID NO: 360407 - DNA, 25 bp, Mus musculus
tccccaaaacgcagctgcagcactg

SEQ ID NO: 360408 - DNA, 25 bp, Mus musculus
tccccaaaacgcaggaccatcagaa

SEQ ID NO: 360409 - DNA, 25 bp, Mus musculus
tccccaaacccagacttacagctct

SEQ ID NO: 360410 - DNA, 25 bp, Mus musculus
tccccaaacccagatcagtggacca

SEQ ID NO: 360411 - DNA, 25 bp, Mus musculus
tccccaaacccaggtctggaggtga

SEQ ID NO: 360412 - DNA, 25 bp, Mus musculus
tccccaaagaaaggtcaaatggtta

SEQ ID NO: 360413 - DNA, 25 bp, Mus musculus
tccccaaaggatggctccatctcca

SEQ ID NO: 360414 - DNA, 25 bp, Mus musculus
tccccaaataatgacctagccctca

SEQ ID NO: 360415 - DNA, 25 bp, Mus musculus
tccccaaataatgatgtctatactc

SEQ ID NO: 360416 - DNA, 25 bp, Mus musculus
tccccaacacggtcggaaactccgt

SEQ ID NO: 360417 - DNA, 25 bp, Mus musculus
tccccaacagcgggaacttcattgc

SEQ ID NO: 360418 - DNA, 25 bp, Mus musculus
tccccaacagggagttggcacggga

SEQ ID NO: 360419 - DNA, 25 bp, Mus musculus
tccccaacaggtaattggcacggga

SEQ ID NO: 360420 - DNA, 25 bp, Mus musculus
tccccaacaggtggtgaagcagtat

SEQ ID NO: 360421 - DNA, 25 bp, Mus musculus
tccccaacctcagctttctgacctg

SEQ ID NO: 360422 - DNA, 25 bp, Mus musculus
tccccaacggctctgcctgcagtgg

SEQ ID NO: 360423 - DNA, 25 bp, Mus musculus
tccccaacggctctgcgttgctgct

SEQ ID NO: 360424 - DNA, 25 bp, Mus musculus
tccccaactccaagggctgggtctt

SEQ ID NO: 360425 - DNA, 25 bp, Mus musculus
tccccaactccaaggttacagagtc

SEQ ID NO: 360426 - DNA, 25 bp, Mus musculus
tccccaacttcaagggtgctgctca

SEQ ID NO: 360427 - DNA, 25 bp, Mus musculus
tccccaagaaccagacccgagtcag

SEQ ID NO: 360428 - DNA, 25 bp, Mus musculus
tccccaagaggtacttttctcactt

SEQ ID NO: 360429 - DNA, 25 bp, Mus musculus
tccccaagccagccccgcagcccta

SEQ ID NO: 360430 - DNA, 25 bp, Mus musculus
tccccaagtacccgcctacagtttc

SEQ ID NO: 360431 - DNA, 25 bp, Mus musculus
tccccaagttcaggaagaagcacac

SEQ ID NO: 360432 - DNA, 25 bp, Mus musculus
tccccaagttcaggagctctgcaca

SEQ ID NO: 360433 - DNA, 25 bp, Mus musculus
tccccaatacctgtcctagcctgtc

SEQ ID NO: 360434 - DNA, 25 bp, Mus musculus
tccccaatcagagtgcggagatcca

SEQ ID NO: 360435 - DNA, 25 bp, Mus musculus
tccccaatcccactgattttaggtg

SEQ ID NO: 360436 - DNA, 25 bp, Mus musculus
tccccaatgtctttgcaccctgtga

SEQ ID NO: 360437 - DNA, 25 bp, Mus musculus
tccccacagaggtggaagcacttca

SEQ ID NO: 360438 - DNA, 25 bp, Mus musculus
tccccacagcacgccactggcagat

SEQ ID NO: 360439 - DNA, 25 bp, Mus musculus
tccccacagcagtcctgtggatcat

SEQ ID NO: 360440 - DNA, 25 bp, Mus musculus
tccccacaggggcaggtgctgagtg

SEQ ID NO: 360441 - DNA, 25 bp, Mus musculus
tccccaccacagatctgcgatggcg

SEQ ID NO: 360442 - DNA, 25 bp, Mus musculus
tccccaccagcacctcctaccggca

SEQ ID NO: 360443 - DNA, 25 bp, Mus musculus
tccccaccaggacctgcaagcacag

SEQ ID NO: 360444 - DNA, 25 bp, Mus musculus
tccccacccaggcctggataccaca

SEQ ID NO: 360445 - DNA, 25 bp, Mus musculus
tccccaccgccatgcctgtctcctc

SEQ ID NO: 360446 - DNA, 25 bp, Mus musculus
tccccaccgtctttgacaactattc

SEQ ID NO: 360447 - DNA, 25 bp, Mus musculus
tccccaccgtgacgtgttcttaatt

SEQ ID NO: 360448 - DNA, 25 bp, Mus musculus
tccccacctactgggaccagcggga

SEQ ID NO: 360449 - DNA, 25 bp, Mus musculus
tccccacctccagggtgaagttgat

SEQ ID NO: 360450 - DNA, 25 bp, Mus musculus
tccccacctgggaaaagatgccgtt

SEQ ID NO: 360451 - DNA, 25 bp, Mus musculus
tccccacgtatgcaggctctgcctg

SEQ ID NO: 360452 - DNA, 25 bp, Mus musculus
tccccactaatgtcgaaagagatga

SEQ ID NO: 360453 - DNA, 25 bp, Mus musculus
tccccactaatgtcggcacaccatt

SEQ ID NO: 360454 - DNA, 25 bp, Mus musculus
tccccactgtggaaggaagtttggc

SEQ ID NO: 360455 - DNA, 25 bp, Mus musculus
tccccagaagacccagccagcagca

SEQ ID NO: 360456 - DNA, 25 bp, Mus musculus
tccccagacacagaaagccatcacc

SEQ ID NO: 360457 - DNA, 25 bp, Mus musculus
tccccagacagttacacgtctgctc

SEQ ID NO: 360458 - DNA, 25 bp, Mus musculus
tccccagaccagatcatccagcccc

SEQ ID NO: 360459 - DNA, 25 bp, Mus musculus
tccccagaccaggatgaggaggagg

SEQ ID NO: 360460 - DNA, 25 bp, Mus musculus
tccccagacgcttgtcggagctcca

SEQ ID NO: 360461 - DNA, 25 bp, Mus musculus
tccccagagagaaccttcttccact

SEQ ID NO: 360462 - DNA, 25 bp, Mus musculus
tccccagagagatgaggaaagtgag

SEQ ID NO: 360463 - DNA, 25 bp, Mus musculus
tccccagagagcatttctggctgct

SEQ ID NO: 360464 - DNA, 25 bp, Mus musculus
tccccagagataagctgacgctggg

SEQ ID NO: 360465 - DNA, 25 bp, Mus musculus
tccccagagcaggagactctgagtt

SEQ ID NO: 360466 - DNA, 25 bp, Mus musculus
tccccagagcagtgctaccatctca

SEQ ID NO: 360467 - DNA, 25 bp, Mus musculus
tccccagagcttcaggaggaatttg

SEQ ID NO: 360468 - DNA, 25 bp, Mus musculus
tccccagatgtctgatacatatctg

SEQ ID NO: 360469 - DNA, 25 bp, Mus musculus
tccccagatgtctggagtggatgac

SEQ ID NO: 360470 - DNA, 25 bp, Mus musculus
tccccagcaacaattgaaatggcga

SEQ ID NO: 360471 - DNA, 25 bp, Mus musculus
tccccagcaacactgcaatggctgc

SEQ ID NO: 360472 - DNA, 25 bp, Mus musculus
tccccagcacagcaatcttccctgg

SEQ ID NO: 360473 - DNA, 25 bp, Mus musculus
tccccagcagtcagggcatctgtta

SEQ ID NO: 360474 - DNA, 25 bp, Mus musculus
tccccagccctattcaggttattga

SEQ ID NO: 360475 - DNA, 25 bp, Mus musculus
tccccagccctcaacttaatgagct

SEQ ID NO: 360476 - DNA, 25 bp, Mus musculus
tccccagcctgacgggaggaaaact

SEQ ID NO: 360477 - DNA, 25 bp, Mus musculus
tccccagcctgacgtttctcttcag

SEQ ID NO: 360478 - DNA, 25 bp, Mus musculus
tccccagcgaggggacaaaggcgtt

SEQ ID NO: 360479 - DNA, 25 bp, Mus musculus
tccccagctacaggtacattactgg

SEQ ID NO: 360480 - DNA, 25 bp, Mus musculus
tccccagctggagaagctccatttc

SEQ ID NO: 360481 - DNA, 25 bp, Mus musculus
tccccaggaggcccccaaggtggtc

SEQ ID NO: 360482 - DNA, 25 bp, Mus musculus
tccccagggaacaaggtcagtgaca

SEQ ID NO: 360483 - DNA, 25 bp, Mus musculus
tccccaggtcagcaggcgctttgcc

SEQ ID NO: 360484 - DNA, 25 bp, Mus musculus
tccccagtacaaagcccagcacctc

SEQ ID NO: 360485 - DNA, 25 bp, Mus musculus
tccccagtacaaagctgtcttgata

SEQ ID NO: 360486 - DNA, 25 bp, Mus musculus
tccccagtacaaaggacaaagccaa

SEQ ID NO: 360487 - DNA, 25 bp, Mus musculus
tccccagtacaaagggaagtgtggt

SEQ ID NO: 360488 - DNA, 25 bp, Mus musculus
tccccagtacaaaggggaccatgga

SEQ ID NO: 360489 - DNA, 25 bp, Mus musculus
tccccagtacaaaggtgtctcttgc

SEQ ID NO: 360490 - DNA, 25 bp, Mus musculus
tccccagtacaaaggtgtggtatca

SEQ ID NO: 360491 - DNA, 25 bp, Mus musculus
tccccagtcaggtagcctttccagt

SEQ ID NO: 360492 - DNA, 25 bp, Mus musculus
tccccagtcctcaggttctaagcgc

SEQ ID NO: 360493 - DNA, 25 bp, Mus musculus
tccccagtgaactaggtggccttag

SEQ ID NO: 360494 - DNA, 25 bp, Mus musculus
tccccagttcccaggtctttcatag

SEQ ID NO: 360495 - DNA, 25 bp, Mus musculus
tccccagttcctggaccctgtattg

SEQ ID NO: 360496 - DNA, 25 bp, Mus musculus
tccccagttcttagaccctgtattg

SEQ ID NO: 360497 - DNA, 25 bp, Mus musculus
tccccagttgtccccaaggtcagca

SEQ ID NO: 360498 - DNA, 25 bp, Mus musculus
tccccagttttgctgagaatggaat

SEQ ID NO: 360499 - DNA, 25 bp, Mus musculus
tccccatacctaaggtggagattct

SEQ ID NO: 360500 - DNA, 25 bp, Mus musculus
tccccatagcagacaacaacagttc

SEQ ID NO: 360501 - DNA, 25 bp, Mus musculus
tccccatagcaggggaagaagaggt

SEQ ID NO: 360502 - DNA, 25 bp, Mus musculus
tccccatagcaggtattccagcatc

SEQ ID NO: 360503 - DNA, 25 bp, Mus musculus
tccccatatgagcataaatcaaaag

SEQ ID NO: 360504 - DNA, 25 bp, Mus musculus
tccccatatgatgggaaataagttc

SEQ ID NO: 360505 - DNA, 25 bp, Mus musculus
tccccatcaagaaatctgaccctgt

SEQ ID NO: 360506 - DNA, 25 bp, Mus musculus
tccccatcaagatcccacgcaatga

SEQ ID NO: 360507 - DNA, 25 bp, Mus musculus
tccccatcagctgtttctccaaacc

SEQ ID NO: 360508 - DNA, 25 bp, Mus musculus
tccccatcaggccaaccagaggagc

SEQ ID NO: 360509 - DNA, 25 bp, Mus musculus
tccccatcaggtttggacatatgca

SEQ ID NO: 360510 - DNA, 25 bp, Mus musculus
tccccatcattgcaggctcaaacat

SEQ ID NO: 360511 - DNA, 25 bp, Mus musculus
tccccatcgacctggctgctgcaag

SEQ ID NO: 360512 - DNA, 25 bp, Mus musculus
tccccatcgataggcccagcagctg

SEQ ID NO: 360513 - DNA, 25 bp, Mus musculus
tccccatcgataggctcaggtatta

SEQ ID NO: 360514 - DNA, 25 bp, Mus musculus
tccccatcgatagtgtgtgcccttg

SEQ ID NO: 360515 - DNA, 25 bp, Mus musculus
tccccatctcagagctctcttccgg

SEQ ID NO: 360516 - DNA, 25 bp, Mus musculus
tccccatctcagccagcagaggcct

SEQ ID NO: 360517 - DNA, 25 bp, Mus musculus
tccccatctcagctccggaaaggcc

SEQ ID NO: 360518 - DNA, 25 bp, Mus musculus
tccccatctggcatgcccacgtgcc

SEQ ID NO: 360519 - DNA, 25 bp, Mus musculus
tccccatgaagagtctttgcagttt

SEQ ID NO: 360520 - DNA, 25 bp, Mus musculus
tccccatgagaaattgccagtagtt

SEQ ID NO: 360521 - DNA, 25 bp, Mus musculus
tccccatgagaggtagctaagtggg

SEQ ID NO: 360522 - DNA, 25 bp, Mus musculus
tccccatgccaaagtctttgaaacc

SEQ ID NO: 360523 - DNA, 25 bp, Mus musculus
tccccatgcccatccgttcaattcc

SEQ ID NO: 360524 - DNA, 25 bp, Mus musculus
tccccatggaagtctgctcgactga

SEQ ID NO: 360525 - DNA, 25 bp, Mus musculus
tccccatggttgcaggtctgcaata

SEQ ID NO: 360526 - DNA, 25 bp, Mus musculus
tccccatgtacagactcatcccacc

SEQ ID NO: 360527 - DNA, 25 bp, Mus musculus
tccccatgtacagctcacaaactca

SEQ ID NO: 360528 - DNA, 25 bp, Mus musculus
tccccattagaaacaagccacggaa

SEQ ID NO: 360529 - DNA, 25 bp, Mus musculus
tccccattagaaaccacctaccctc

SEQ ID NO: 360530 - DNA, 25 bp, Mus musculus
tccccattgccgagctcggcttcat

SEQ ID NO: 360531 - DNA, 25 bp, Mus musculus
tcccccaaactgaagaagtagctaa

SEQ ID NO: 360532 - DNA, 25 bp, Mus musculus
tcccccaacttaaagactgaagtgt

SEQ ID NO: 360533 - DNA, 25 bp, Mus musculus
tcccccaaggaggcggacgctcagc

SEQ ID NO: 360534 - DNA, 25 bp, Mus musculus
tcccccaaggaggtaagcctggact

SEQ ID NO: 360535 - DNA, 25 bp, Mus musculus
tcccccaaggaggtctctgagtgtg

SEQ ID NO: 360536 - DNA, 25 bp, Mus musculus
tcccccaccagaaggaccctgctct

SEQ ID NO: 360537 - DNA, 25 bp, Mus musculus
tcccccaccagaaggtggtagccaa

SEQ ID NO: 360538 - DNA, 25 bp, Mus musculus
tcccccaccatgaatttgtggccct

SEQ ID NO: 360539 - DNA, 25 bp, Mus musculus
tcccccaccccccaggacatgacag

SEQ ID NO: 360540 - DNA, 25 bp, Mus musculus
tcccccactggagagaccactgcta

SEQ ID NO: 360541 - DNA, 25 bp, Mus musculus
tcccccagagaggccaggctgggac

SEQ ID NO: 360542 - DNA, 25 bp, Mus musculus
tcccccagagagtcatggaccaaca

SEQ ID NO: 360543 - DNA, 25 bp, Mus musculus
tcccccagaggttgagaacaaaaag

SEQ ID NO: 360544 - DNA, 25 bp, Mus musculus
tcccccagccccagcagcctggtag

SEQ ID NO: 360545 - DNA, 25 bp, Mus musculus
tcccccagccccagtccttcaggct

SEQ ID NO: 360546 - DNA, 25 bp, Mus musculus
tcccccagctgtggtagtcaggagt

SEQ ID NO: 360547 - DNA, 25 bp, Mus musculus
tcccccagctgtggtattcaggctg

SEQ ID NO: 360548 - DNA, 25 bp, Mus musculus
tcccccaggaggcatcacagcagaa

SEQ ID NO: 360549 - DNA, 25 bp, Mus musculus
tcccccaggctggagagaatgaaga

SEQ ID NO: 360550 - DNA, 25 bp, Mus musculus
tcccccagtagaaatcgcagcctgc

SEQ ID NO: 360551 - DNA, 25 bp, Mus musculus
tcccccagtgccctgggcaaggcca

SEQ ID NO: 360552 - DNA, 25 bp, Mus musculus
tcccccatgcgcagctccagacctc

SEQ ID NO: 360553 - DNA, 25 bp, Mus musculus
tcccccattaggaagatcaaaggca

SEQ ID NO: 360554 - DNA, 25 bp, Mus musculus
tcccccattggagaggaacctgctt

SEQ ID NO: 360555 - DNA, 25 bp, Mus musculus
tcccccattggagccaaggctgttg

SEQ ID NO: 360556 - DNA, 25 bp, Mus musculus
tccccccagccaggatgatgtctac

SEQ ID NO: 360557 - DNA, 25 bp, Mus musculus
tcccccccagctacccgtacagtga

SEQ ID NO: 360558 - DNA, 25 bp, Mus musculus
tccccccggcagatgagacaccaat

SEQ ID NO: 360559 - DNA, 25 bp, Mus musculus
tccccccggcaggtaattctgactc

SEQ ID NO: 360560 - DNA, 25 bp, Mus musculus
tccccccgggtctgtctgccaaaat

SEQ ID NO: 360561 - DNA, 25 bp, Mus musculus
tcccccgaaataggctgctggcacc

SEQ ID NO: 360562 - DNA, 25 bp, Mus musculus
tcccccgaagttcagagtaaagaca

SEQ ID NO: 360563 - DNA, 25 bp, Mus musculus
tcccccgacgacgatcttggatcta

SEQ ID NO: 360564 - DNA, 25 bp, Mus musculus
tcccccgacgccttgccaccccgct

SEQ ID NO: 360565 - DNA, 25 bp, Mus musculus
tcccccgacgccttggtcactggca

SEQ ID NO: 360566 - DNA, 25 bp, Mus musculus
tcccccgcaagcctcctggaggacc

SEQ ID NO: 360567 - DNA, 25 bp, Mus musculus
tcccccgcacttctagacagctgtc

SEQ ID NO: 360568 - DNA, 25 bp, Mus musculus
tcccccgcagccgacatgcgctacg

SEQ ID NO: 360569 - DNA, 25 bp, Mus musculus
tcccccgcagcgtttggaaaacgaa

SEQ ID NO: 360570 - DNA, 25 bp, Mus musculus
tcccccgcccaggacagtcggccca

SEQ ID NO: 360571 - DNA, 25 bp, Mus musculus
tcccccgctcctgggccgcaaacag

SEQ ID NO: 360572 - DNA, 25 bp, Mus musculus
tcccccgctgcacaacacccccgcc

SEQ ID NO: 360573 - DNA, 25 bp, Mus musculus
tcccccggaatggtgaagtgtgtcc

SEQ ID NO: 360574 - DNA, 25 bp, Mus musculus
tccccctagaagtggccctgccgcc

SEQ ID NO: 360575 - DNA, 25 bp, Mus musculus
tccccctcacagtaattcttcagtc

SEQ ID NO: 360576 - DNA, 25 bp, Mus musculus
tccccctcagatccaacactccttg

SEQ ID NO: 360577 - DNA, 25 bp, Mus musculus
tccccctcagggatccgtgaaccac

SEQ ID NO: 360578 - DNA, 25 bp, Mus musculus
tccccctcattcaagatgttcacac

SEQ ID NO: 360579 - DNA, 25 bp, Mus musculus
tccccctcattcaaggagtagaccc

SEQ ID NO: 360580 - DNA, 25 bp, Mus musculus
tccccctgaggaggctgcggggcca

SEQ ID NO: 360581 - DNA, 25 bp, Mus musculus
tccccctggaccgggagcagaatgg

SEQ ID NO: 360582 - DNA, 25 bp, Mus musculus
tccccctggagtcctttcactgcac

SEQ ID NO: 360583 - DNA, 25 bp, Mus musculus
tccccctggcaacagtgatccggag

SEQ ID NO: 360584 - DNA, 25 bp, Mus musculus
tccccctggggtctggagggagagc

SEQ ID NO: 360585 - DNA, 25 bp, Mus musculus
tccccctggtcaggagtgctgcaaa

SEQ ID NO: 360586 - DNA, 25 bp, Mus musculus
tccccctggtcaggcactcggacat

SEQ ID NO: 360587 - DNA, 25 bp, Mus musculus
tccccctggtcctgctggcttccct

SEQ ID NO: 360588 - DNA, 25 bp, Mus musculus
tccccctgtgtgcatcagcatcatc

SEQ ID NO: 360589 - DNA, 25 bp, Mus musculus
tcccccttagacactactttgctct

SEQ ID NO: 360590 - DNA, 25 bp, Mus musculus
tcccccttctacttcagagccacca

SEQ ID NO: 360591 - DNA, 25 bp, Mus musculus
tcccccttggttgcctctctgcatt

SEQ ID NO: 360592 - DNA, 25 bp, Mus musculus
tccccgaaactcagttccagagcct

SEQ ID NO: 360593 - DNA, 25 bp, Mus musculus
tccccgaactttagaccatgccgtc

SEQ ID NO: 360594 - DNA, 25 bp, Mus musculus
tccccgaagccgggctgatgtgatg

SEQ ID NO: 360595 - DNA, 25 bp, Mus musculus
tccccgacgcaggtcctacggcctg

SEQ ID NO: 360596 - DNA, 25 bp, Mus musculus
tccccgacgcaggtgttctttgaca

SEQ ID NO: 360597 - DNA, 25 bp, Mus musculus
tccccgagcccggaagagaaaagag

SEQ ID NO: 360598 - DNA, 25 bp, Mus musculus
tccccgagccgcagggccagttcct

SEQ ID NO: 360599 - DNA, 25 bp, Mus musculus
tccccgagctcacagctatccctct

SEQ ID NO: 360600 - DNA, 25 bp, Mus musculus
tccccgaggagatctcccctctggt

SEQ ID NO: 360601 - DNA, 25 bp, Mus musculus
tccccgaggagctacagttttatta

SEQ ID NO: 360602 - DNA, 25 bp, Mus musculus
tccccgagggcggggcagcctgatg

SEQ ID NO: 360603 - DNA, 25 bp, Mus musculus
tccccgagtgttgggagcgggatga

SEQ ID NO: 360604 - DNA, 25 bp, Mus musculus
tccccgatgacaagcttgctcgcct

SEQ ID NO: 360605 - DNA, 25 bp, Mus musculus
tccccgcccgcaggtccattcagaa

SEQ ID NO: 360606 - DNA, 25 bp, Mus musculus
tccccgcgaggtgtcgcggaagatg

SEQ ID NO: 360607 - DNA, 25 bp, Mus musculus
tccccgcgccacggacaagtgacgc

SEQ ID NO: 360608 - DNA, 25 bp, Mus musculus
tccccgcgcggctaactcaacaaaa

SEQ ID NO: 360609 - DNA, 25 bp, Mus musculus
tccccgcggacggcactgagagtat

SEQ ID NO: 360610 - DNA, 25 bp, Mus musculus
tccccgctagacatccgttacaaac

SEQ ID NO: 360611 - DNA, 25 bp, Mus musculus
tccccgctagacatgaaggatggct

SEQ ID NO: 360612 - DNA, 25 bp, Mus musculus
tccccgctctgctgccctgaatctg

SEQ ID NO: 360613 - DNA, 25 bp, Mus musculus
tccccgctgcagatttgcaacagca

SEQ ID NO: 360614 - DNA, 25 bp, Mus musculus
tccccgctggaagtttgtgtgagtg

SEQ ID NO: 360615 - DNA, 25 bp, Mus musculus
tccccgctgtacttgtccagctctt

SEQ ID NO: 360616 - DNA, 25 bp, Mus musculus
tccccgcttccgctctcgggaccgg

SEQ ID NO: 360617 - DNA, 25 bp, Mus musculus
tccccggaaacttagggaatgacaa

SEQ ID NO: 360618 - DNA, 25 bp, Mus musculus
tccccggaagacgaagagccggaat

SEQ ID NO: 360619 - DNA, 25 bp, Mus musculus
tccccggaagcactctgacaccata

SEQ ID NO: 360620 - DNA, 25 bp, Mus musculus
tccccggacggagctgaagaagaag

SEQ ID NO: 360621 - DNA, 25 bp, Mus musculus
tccccggataacgagcgaccgcctt

SEQ ID NO: 360622 - DNA, 25 bp, Mus musculus
tccccggataacgtggaccatgtgt

SEQ ID NO: 360623 - DNA, 25 bp, Mus musculus
tccccggccagacagcaattcctca

SEQ ID NO: 360624 - DNA, 25 bp, Mus musculus
tccccggccagatgaggacaagcct

SEQ ID NO: 360625 - DNA, 25 bp, Mus musculus
tccccggccagtggctcttgaccgc

SEQ ID NO: 360626 - DNA, 25 bp, Mus musculus
tccccggcccacgaagcatgtaatg

SEQ ID NO: 360627 - DNA, 25 bp, Mus musculus
tccccggcggagatgaggaaactga

SEQ ID NO: 360628 - DNA, 25 bp, Mus musculus
tccccggcggaggtgtgaccccaca

SEQ ID NO: 360629 - DNA, 25 bp, Mus musculus
tccccggctacacagatttgacata

SEQ ID NO: 360630 - DNA, 25 bp, Mus musculus
tccccggctacagaactttgtacct

SEQ ID NO: 360631 - DNA, 25 bp, Mus musculus
tccccggctccaggactactacgtg

SEQ ID NO: 360632 - DNA, 25 bp, Mus musculus
tccccggctgagagtctccagagcc

SEQ ID NO: 360633 - DNA, 25 bp, Mus musculus
tccccgggacgaggcaaagatgctg

SEQ ID NO: 360634 - DNA, 25 bp, Mus musculus
tccccgggaggtttcatgggatcat

SEQ ID NO: 360635 - DNA, 25 bp, Mus musculus
tccccgggatggagatgaggtgcca

SEQ ID NO: 360636 - DNA, 25 bp, Mus musculus
tccccggggatgagtcctcaaatgc

SEQ ID NO: 360637 - DNA, 25 bp, Mus musculus
tccccggtgaggcatatgctatgat

SEQ ID NO: 360638 - DNA, 25 bp, Mus musculus
tccccggtgaggtataaagaggaag

SEQ ID NO: 360639 - DNA, 25 bp, Mus musculus
tccccggtgcgcggaaagatcaacg

SEQ ID NO: 360640 - DNA, 25 bp, Mus musculus
tccccggttgtcatgtatcacggtg

SEQ ID NO: 360641 - DNA, 25 bp, Mus musculus
tccccgtaatgctggtgagattggg

SEQ ID NO: 360642 - DNA, 25 bp, Mus musculus
tccccgtaattacgctggggaggag

SEQ ID NO: 360643 - DNA, 25 bp, Mus musculus
tccccgtcagcccggttagctttat

SEQ ID NO: 360644 - DNA, 25 bp, Mus musculus
tccccgtgaaggacagtcatggcaa

SEQ ID NO: 360645 - DNA, 25 bp, Mus musculus
tccccgtgcccagtcgagaagcccc

SEQ ID NO: 360646 - DNA, 25 bp, Mus musculus
tccccgtggacaagtccctgctcca

SEQ ID NO: 360647 - DNA, 25 bp, Mus musculus
tccccgtggcttaagagaagagcca

SEQ ID NO: 360648 - DNA, 25 bp, Mus musculus
tccccgtggtacaggccctgttgca

SEQ ID NO: 360649 - DNA, 25 bp, Mus musculus
tccccgttaggccagcaggtggcca

SEQ ID NO: 360650 - DNA, 25 bp, Mus musculus
tcccctaagtacaggtcaccatcat

SEQ ID NO: 360651 - DNA, 25 bp, Mus musculus
tcccctacacccgggtcaatgcagg

SEQ ID NO: 360652 - DNA, 25 bp, Mus musculus
tcccctacagttggagtaaaaatgg

SEQ ID NO: 360653 - DNA, 25 bp, Mus musculus
tcccctacagttggcgtaggagtgt

SEQ ID NO: 360654 - DNA, 25 bp, Mus musculus
tcccctacatctggacattggcacc

SEQ ID NO: 360655 - DNA, 25 bp, Mus musculus
tcccctacatctggcattcaggaca

SEQ ID NO: 360656 - DNA, 25 bp, Mus musculus
tcccctacatctgggctggttacca

SEQ ID NO: 360657 - DNA, 25 bp, Mus musculus
tcccctagaaggaagagtcactcca

SEQ ID NO: 360658 - DNA, 25 bp, Mus musculus
tcccctagcacagcagagtcaattc

SEQ ID NO: 360659 - DNA, 25 bp, Mus musculus
tcccctatatcagtgacacaggaac

SEQ ID NO: 360660 - DNA, 25 bp, Mus musculus
tcccctcaagtctgagtttgtgatc

SEQ ID NO: 360661 - DNA, 25 bp, Mus musculus
tcccctcagctaacaatgaagagga

SEQ ID NO: 360662 - DNA, 25 bp, Mus musculus
tcccctcagtgaatgtggctctctt

SEQ ID NO: 360663 - DNA, 25 bp, Mus musculus
tcccctcatgaaggaagtggagacc

SEQ ID NO: 360664 - DNA, 25 bp, Mus musculus
tcccctcatgaagggtacggattgc

SEQ ID NO: 360665 - DNA, 25 bp, Mus musculus
tcccctccaagagcaaagctgcagc

SEQ ID NO: 360666 - DNA, 25 bp, Mus musculus
tcccctccactcagcttcccatgct

SEQ ID NO: 360667 - DNA, 25 bp, Mus musculus
tcccctcccaagtttcagattacga

SEQ ID NO: 360668 - DNA, 25 bp, Mus musculus
tcccctcccaccggtgcctgctgtc

SEQ ID NO: 360669 - DNA, 25 bp, Mus musculus
tcccctccctcccagctgatggttc

SEQ ID NO: 360670 - DNA, 25 bp, Mus musculus
tcccctccgaaaatgccatcccgcc

SEQ ID NO: 360671 - DNA, 25 bp, Mus musculus
tcccctccgaaactgtctgcccagt

SEQ ID NO: 360672 - DNA, 25 bp, Mus musculus
tcccctcctgaagctgattggcgtc

SEQ ID NO: 360673 - DNA, 25 bp, Mus musculus
tcccctcgaagcagcaccgggactc

SEQ ID NO: 360674 - DNA, 25 bp, Mus musculus
tcccctcgccccaggcactgggctc

SEQ ID NO: 360675 - DNA, 25 bp, Mus musculus
tcccctctactcagttcctcatttg

SEQ ID NO: 360676 - DNA, 25 bp, Mus musculus
tcccctctgcagtgtatgtggctca

SEQ ID NO: 360677 - DNA, 25 bp, Mus musculus
tcccctctggccagacagtctgcta

SEQ ID NO: 360678 - DNA, 25 bp, Mus musculus
tcccctctggccaggcagttattca

SEQ ID NO: 360679 - DNA, 25 bp, Mus musculus
tcccctgaagcattgaaaaaggcaa

SEQ ID NO: 360680 - DNA, 25 bp, Mus musculus
tcccctgaagccaatcatctgggga

SEQ ID NO: 360681 - DNA, 25 bp, Mus musculus
tcccctgagatctaaacctactgac

SEQ ID NO: 360682 - DNA, 25 bp, Mus musculus
tcccctgcaaaaatctggaagagaa

SEQ ID NO: 360683 - DNA, 25 bp, Mus musculus
tcccctgcaatactgccgaaaccca

SEQ ID NO: 360684 - DNA, 25 bp, Mus musculus
tcccctgcccaagctgtgctggatg

SEQ ID NO: 360685 - DNA, 25 bp, Mus musculus
tcccctgccccaggacttctctgtg

SEQ ID NO: 360686 - DNA, 25 bp, Mus musculus
tcccctgcccgagcgtttctagagc

SEQ ID NO: 360687 - DNA, 25 bp, Mus musculus
tcccctgcccggaattctgatcaag

SEQ ID NO: 360688 - DNA, 25 bp, Mus musculus
tcccctgcctccccactaccctcca

SEQ ID NO: 360689 - DNA, 25 bp, Mus musculus
tcccctgcgagggtggctgctgcta

SEQ ID NO: 360690 - DNA, 25 bp, Mus musculus
tcccctgctcccatgcttatcattg

SEQ ID NO: 360691 - DNA, 25 bp, Mus musculus
tcccctgctttagtttcctgacagg

SEQ ID NO: 360692 - DNA, 25 bp, Mus musculus
tcccctggacgcttgcctttgtctg

SEQ ID NO: 360693 - DNA, 25 bp, Mus musculus
tcccctggacgcttgtcaccagatt

SEQ ID NO: 360694 - DNA, 25 bp, Mus musculus
tcccctggcgacggttaccacagtg

SEQ ID NO: 360695 - DNA, 25 bp, Mus musculus
tcccctgggagtgcttacttttctg

SEQ ID NO: 360696 - DNA, 25 bp, Mus musculus
tcccctgggagtgggaggagtgaag

SEQ ID NO: 360697 - DNA, 25 bp, Mus musculus
tcccctgtcgtatagagtctgaagg

SEQ ID NO: 360698 - DNA, 25 bp, Mus musculus
tcccctgtgaccctagtctctcttc

SEQ ID NO: 360699 - DNA, 25 bp, Mus musculus
tcccctgtgagggctgaactgaaaa

SEQ ID NO: 360700 - DNA, 25 bp, Mus musculus
tccccttaaaggatcctctgaagct

SEQ ID NO: 360701 - DNA, 25 bp, Mus musculus
tccccttagcagctcaagcccaccc

SEQ ID NO: 360702 - DNA, 25 bp, Mus musculus
tccccttatcagagcctgccccagt

SEQ ID NO: 360703 - DNA, 25 bp, Mus musculus
tccccttatgatcaggaaccagctc

SEQ ID NO: 360704 - DNA, 25 bp, Mus musculus
tccccttatgatcaggcggcttgga

SEQ ID NO: 360705 - DNA, 25 bp, Mus musculus
tccccttcacggcatatggatcagg

SEQ ID NO: 360706 - DNA, 25 bp, Mus musculus
tccccttcacggttgcagcttcata

SEQ ID NO: 360707 - DNA, 25 bp, Mus musculus
tccccttcagccggattacacagga

SEQ ID NO: 360708 - DNA, 25 bp, Mus musculus
tccccttcagctcttggggtgaagc

SEQ ID NO: 360709 - DNA, 25 bp, Mus musculus
tccccttcaggagtcgctttccttg

SEQ ID NO: 360710 - DNA, 25 bp, Mus musculus
tccccttcaggccagaaggtttgga

SEQ ID NO: 360711 - DNA, 25 bp, Mus musculus
tccccttcaggcctgcctttttcct

SEQ ID NO: 360712 - DNA, 25 bp, Mus musculus
tccccttccccaggatgacagagga

SEQ ID NO: 360713 - DNA, 25 bp, Mus musculus
tccccttcgcctgtggaggcgcagc

SEQ ID NO: 360714 - DNA, 25 bp, Mus musculus
tccccttcgcctgtggtgaagaagt

SEQ ID NO: 360715 - DNA, 25 bp, Mus musculus
tccccttggaaagcttttatgaaac

SEQ ID NO: 360716 - DNA, 25 bp, Mus musculus
tccccttggggccttctagccctcc

SEQ ID NO: 360717 - DNA, 25 bp, Mus musculus
tccccttgtgctttgatgaccacga

SEQ ID NO: 360718 - DNA, 25 bp, Mus musculus
tccccttgtgctttggtctccttct

SEQ ID NO: 360719 - DNA, 25 bp, Mus musculus
tcccctttaaggctccaggatgact

SEQ ID NO: 360720 - DNA, 25 bp, Mus musculus
tcccctttcgagagggagaatcccg

SEQ ID NO: 360721 - DNA, 25 bp, Mus musculus
tccccttttctgggtaacacaaggc

SEQ ID NO: 360722 - DNA, 25 bp, Mus musculus
tcccgaaaccaagtggagctgattg

SEQ ID NO: 360723 - DNA, 25 bp, Mus musculus
tcccgaaactccagtgacacgtgcc

SEQ ID NO: 360724 - DNA, 25 bp, Mus musculus
tcccgaaactgaccactgcggcaca

SEQ ID NO: 360725 - DNA, 25 bp, Mus musculus
tcccgaaatggggttggtgtcattt

SEQ ID NO: 360726 - DNA, 25 bp, Mus musculus
tcccgaaattcctgggcagagctga

SEQ ID NO: 360727 - DNA, 25 bp, Mus musculus
tcccgaagccgcagccagagccaca

SEQ ID NO: 360728 - DNA, 25 bp, Mus musculus
tcccgaagtatcatgtaccggagct

SEQ ID NO: 360729 - DNA, 25 bp, Mus musculus
tcccgaattctgcagacccatgcag

SEQ ID NO: 360730 - DNA, 25 bp, Mus musculus
tcccgaattctgcaggtatccaacg

SEQ ID NO: 360731 - DNA, 25 bp, Mus musculus
tcccgaccattgggtttaatgtgga

SEQ ID NO: 360732 - DNA, 25 bp, Mus musculus
tcccgacgccttggtctgtgtgtgg

SEQ ID NO: 360733 - DNA, 25 bp, Mus musculus
tcccgactgtaccgggctgtcaggg

SEQ ID NO: 360734 - DNA, 25 bp, Mus musculus
tcccgactgtgatctgtgagtctcg

SEQ ID NO: 360735 - DNA, 25 bp, Mus musculus
tcccgagaaggccgagcctgctagg

SEQ ID NO: 360736 - DNA, 25 bp, Mus musculus
tcccgagaatacgcagaccaaactg

SEQ ID NO: 360737 - DNA, 25 bp, Mus musculus
tcccgagacaagagattcagatgcc

SEQ ID NO: 360738 - DNA, 25 bp, Mus musculus
tcccgagacaagagtttccttctag

SEQ ID NO: 360739 - DNA, 25 bp, Mus musculus
tcccgagagagggaaacaacagtat

SEQ ID NO: 360740 - DNA, 25 bp, Mus musculus
tcccgagagagggtcagcctctcag

SEQ ID NO: 360741 - DNA, 25 bp, Mus musculus
tcccgagagctgaagaatggctttg

SEQ ID NO: 360742 - DNA, 25 bp, Mus musculus
tcccgagaggcacgcccccattggt

SEQ ID NO: 360743 - DNA, 25 bp, Mus musculus
tcccgagaggcacgggcaatgaggt

SEQ ID NO: 360744 - DNA, 25 bp, Mus musculus
tcccgagcaggcagcaaacagaaag

SEQ ID NO: 360745 - DNA, 25 bp, Mus musculus
tcccgagccagaggagtacttttga

SEQ ID NO: 360746 - DNA, 25 bp, Mus musculus
tcccgagccaggatcttgtgctgaa

SEQ ID NO: 360747 - DNA, 25 bp, Mus musculus
tcccgagctcctcgagcctaaccca

SEQ ID NO: 360748 - DNA, 25 bp, Mus musculus
tcccgagctcctcgctgtgatcact

SEQ ID NO: 360749 - DNA, 25 bp, Mus musculus
tcccgagggaccggacactggccaa

SEQ ID NO: 360750 - DNA, 25 bp, Mus musculus
tcccgaggtcgatacttcccaagaa

SEQ ID NO: 360751 - DNA, 25 bp, Mus musculus
tcccgagtcaaaagagctttggcac

SEQ ID NO: 360752 - DNA, 25 bp, Mus musculus
tcccgagtccagattgaacacatat

SEQ ID NO: 360753 - DNA, 25 bp, Mus musculus
tcccgagtccaggccgacgtggaaa

SEQ ID NO: 360754 - DNA, 25 bp, Mus musculus
tcccgagtgcctgtgctggtggagt

SEQ ID NO: 360755 - DNA, 25 bp, Mus musculus
tcccgagtgccttagtcctgggcta

SEQ ID NO: 360756 - DNA, 25 bp, Mus musculus
tcccgatcaagatcaacaacccctc

SEQ ID NO: 360757 - DNA, 25 bp, Mus musculus
tcccgatcaagatcatactctccta

SEQ ID NO: 360758 - DNA, 25 bp, Mus musculus
tcccgatccaggtctctgagtgtga

SEQ ID NO: 360759 - DNA, 25 bp, Mus musculus
tcccgatgaagaactaagtggaaaa

SEQ ID NO: 360760 - DNA, 25 bp, Mus musculus
tcccgatgaagaatggataacgacc

SEQ ID NO: 360761 - DNA, 25 bp, Mus musculus
tcccgattctgtggacaggccaaaa

SEQ ID NO: 360762 - DNA, 25 bp, Mus musculus
tcccgattgcagcgtgcccttgaag

SEQ ID NO: 360763 - DNA, 25 bp, Mus musculus
tcccgcaaagacaggtggtgtccgg

SEQ ID NO: 360764 - DNA, 25 bp, Mus musculus
tcccgcaacaggtgacccaatgaca

SEQ ID NO: 360765 - DNA, 25 bp, Mus musculus
tcccgcactatgccaaaaataaagc

SEQ ID NO: 360766 - DNA, 25 bp, Mus musculus
tcccgcagaatatggagggccccat

SEQ ID NO: 360767 - DNA, 25 bp, Mus musculus
tcccgcagcgtgagccagtgggtgt

SEQ ID NO: 360768 - DNA, 25 bp, Mus musculus
tcccgcagcgtgaggtcctggtatt

SEQ ID NO: 360769 - DNA, 25 bp, Mus musculus
tcccgccaaacgccatgagaatttc

SEQ ID NO: 360770 - DNA, 25 bp, Mus musculus
tcccgccaggtttctttcagcctcc

SEQ ID NO: 360771 - DNA, 25 bp, Mus musculus
tcccgccatccatgccagtttgcct

SEQ ID NO: 360772 - DNA, 25 bp, Mus musculus
tcccgcccccagcgcctgctctggc

SEQ ID NO: 360773 - DNA, 25 bp, Mus musculus
tcccgccccgggcggcttggctgcc

SEQ ID NO: 360774 - DNA, 25 bp, Mus musculus
tcccgccccgggcgggagtcaggcc

SEQ ID NO: 360775 - DNA, 25 bp, Mus musculus
tcccgcccctggtgtgctaccaccc

SEQ ID NO: 360776 - DNA, 25 bp, Mus musculus
tcccgcccgctgaaaaaattgtgca

SEQ ID NO: 360777 - DNA, 25 bp, Mus musculus
tcccgccctggatgccttttacaac

SEQ ID NO: 360778 - DNA, 25 bp, Mus musculus
tcccgccgcccgcagagctgtttgg

SEQ ID NO: 360779 - DNA, 25 bp, Mus musculus
tcccgccgcggaggagaatggcgct

SEQ ID NO: 360780 - DNA, 25 bp, Mus musculus
tcccgcctcctcgcggcattggagg

SEQ ID NO: 360781 - DNA, 25 bp, Mus musculus
tcccgcctcgggttgctgttctggc

SEQ ID NO: 360782 - DNA, 25 bp, Mus musculus
tcccgcgcctctcagtgctcaggag

SEQ ID NO: 360783 - DNA, 25 bp, Mus musculus
tcccgctacgcgcggtatgtggcct

SEQ ID NO: 360784 - DNA, 25 bp, Mus musculus
tcccgctagaccggtggaacctagg

SEQ ID NO: 360785 - DNA, 25 bp, Mus musculus
tcccgctctccgtagtgaagctgtg

SEQ ID NO: 360786 - DNA, 25 bp, Mus musculus
tcccgctgagacgtaggcaattttc

SEQ ID NO: 360787 - DNA, 25 bp, Mus musculus
tcccgctgagctcccgccatcctat

SEQ ID NO: 360788 - DNA, 25 bp, Mus musculus
tcccgctgaggtcccgccatcctat

SEQ ID NO: 360789 - DNA, 25 bp, Mus musculus
tcccgctgagtcgtaggcaattttc

SEQ ID NO: 360790 - DNA, 25 bp, Mus musculus
tcccgctgcccgccgccaatatgcc

SEQ ID NO: 360791 - DNA, 25 bp, Mus musculus
tcccgctgctcctgggtgctggcca

SEQ ID NO: 360792 - DNA, 25 bp, Mus musculus
tcccgctggagcagggccacgtggc

SEQ ID NO: 360793 - DNA, 25 bp, Mus musculus
tcccgctggatcaggtattcctttt

SEQ ID NO: 360794 - DNA, 25 bp, Mus musculus
tcccgctggatcaggttaactttgt

SEQ ID NO: 360795 - DNA, 25 bp, Mus musculus
tcccgctggatcagtttaggattta

SEQ ID NO: 360796 - DNA, 25 bp, Mus musculus
tcccgcttggcaggccggcagagga

SEQ ID NO: 360797 - DNA, 25 bp, Mus musculus
tcccggaaggaaggtcggcagctct

SEQ ID NO: 360798 - DNA, 25 bp, Mus musculus
tcccggacacccggaaaccctgatg

SEQ ID NO: 360799 - DNA, 25 bp, Mus musculus
tcccggactctgagacgccacaggg

SEQ ID NO: 360800 - DNA, 25 bp, Mus musculus
tcccggagaaagcaggccacccctt

SEQ ID NO: 360801 - DNA, 25 bp, Mus musculus
tcccggagaagaggcaatcaagccc

SEQ ID NO: 360802 - DNA, 25 bp, Mus musculus
tcccggagacaactagctgtgttac

SEQ ID NO: 360803 - DNA, 25 bp, Mus musculus
tcccggagaggtgtcgcggaagatg

SEQ ID NO: 360804 - DNA, 25 bp, Mus musculus
tcccggagccaagatcccattctca

SEQ ID NO: 360805 - DNA, 25 bp, Mus musculus
tcccggagccaagtggttgatcggt

SEQ ID NO: 360806 - DNA, 25 bp, Mus musculus
tcccggaggaagcctcaagcacagc

SEQ ID NO: 360807 - DNA, 25 bp, Mus musculus
tcccggaggaaggtgttcctggtgg

SEQ ID NO: 360808 - DNA, 25 bp, Mus musculus
tcccggatatctgaggttcccaatc

SEQ ID NO: 360809 - DNA, 25 bp, Mus musculus
tcccggatggagtgtcgagggggaa

SEQ ID NO: 360810 - DNA, 25 bp, Mus musculus
tcccggattgagcggtcctcgtctt

SEQ ID NO: 360811 - DNA, 25 bp, Mus musculus
tcccggatttctgcaccccctggac

SEQ ID NO: 360812 - DNA, 25 bp, Mus musculus
tcccggatttttgttgaagtactca

SEQ ID NO: 360813 - DNA, 25 bp, Mus musculus
tcccggcagaggagcctggaggagg

SEQ ID NO: 360814 - DNA, 25 bp, Mus musculus
tcccggcagcagaggtggtttgtgc

SEQ ID NO: 360815 - DNA, 25 bp, Mus musculus
tcccggccaggccatgccatgggtt

SEQ ID NO: 360816 - DNA, 25 bp, Mus musculus
tcccggcccatcgggtgagcccggc

SEQ ID NO: 360817 - DNA, 25 bp, Mus musculus
tcccggccgagagtgactcatgaaa

SEQ ID NO: 360818 - DNA, 25 bp, Mus musculus
tcccggctagagaacatgaatggct

SEQ ID NO: 360819 - DNA, 25 bp, Mus musculus
tcccggctagagatcggaatgtgcg

SEQ ID NO: 360820 - DNA, 25 bp, Mus musculus
tcccggctcacctggttccggaagc

SEQ ID NO: 360821 - DNA, 25 bp, Mus musculus
tcccggctctgtggtgccttagctg

SEQ ID NO: 360822 - DNA, 25 bp, Mus musculus
tcccggctgaagcaggctattgaag

SEQ ID NO: 360823 - DNA, 25 bp, Mus musculus
tcccggctgaagcaggtaaaaaaca

SEQ ID NO: 360824 - DNA, 25 bp, Mus musculus
tcccggctgcagggtctgtcaccgc

SEQ ID NO: 360825 - DNA, 25 bp, Mus musculus
tcccgggagcagagaagaaagcgag

SEQ ID NO: 360826 - DNA, 25 bp, Mus musculus
tcccgggagcagtgatgaaaagact

SEQ ID NO: 360827 - DNA, 25 bp, Mus musculus
tcccgggagcccctgatgaccccta

SEQ ID NO: 360828 - DNA, 25 bp, Mus musculus
tcccgggagcgagagctttgtaaat

SEQ ID NO: 360829 - DNA, 25 bp, Mus musculus
tcccgggagcggggcagccacagaa

SEQ ID NO: 360830 - DNA, 25 bp, Mus musculus
tcccgggagcggtcgagctagagga

SEQ ID NO: 360831 - DNA, 25 bp, Mus musculus
tcccgggataggcttctgtgtcagt

SEQ ID NO: 360832 - DNA, 25 bp, Mus musculus
tcccgggcagcatccagcatgtgta

SEQ ID NO: 360833 - DNA, 25 bp, Mus musculus
tcccgggcaggcagtatgggcttat

SEQ ID NO: 360834 - DNA, 25 bp, Mus musculus
tcccgggccaaggctagccaacgac

SEQ ID NO: 360835 - DNA, 25 bp, Mus musculus
tcccggggcatagccaccccgctgg

SEQ ID NO: 360836 - DNA, 25 bp, Mus musculus
tcccggggcggagtttgatggtgac

SEQ ID NO: 360837 - DNA, 25 bp, Mus musculus
tcccggggcggcctcttgggagacc

SEQ ID NO: 360838 - DNA, 25 bp, Mus musculus
tcccggggcggtgatgtggccgtgg

SEQ ID NO: 360839 - DNA, 25 bp, Mus musculus
tcccgggggacaaggacccagcatg

SEQ ID NO: 360840 - DNA, 25 bp, Mus musculus
tcccgggggacaagggtgccagtga

SEQ ID NO: 360841 - DNA, 25 bp, Mus musculus
tcccggggtgctatggggaagagac

SEQ ID NO: 360842 - DNA, 25 bp, Mus musculus
tcccgggttctgctgcagagacagc

SEQ ID NO: 360843 - DNA, 25 bp, Mus musculus
tcccgggttctgctgggccactgcc

SEQ ID NO: 360844 - DNA, 25 bp, Mus musculus
tcccgggttctgctgtctcagtgcc

SEQ ID NO: 360845 - DNA, 25 bp, Mus musculus
tcccggtgatcaagaaatgcattga

SEQ ID NO: 360846 - DNA, 25 bp, Mus musculus
tcccgtatccttgaattacatccaa

SEQ ID NO: 360847 - DNA, 25 bp, Mus musculus
tcccgtatccttgtgttatccaaga

SEQ ID NO: 360848 - DNA, 25 bp, Mus musculus
tcccgtattaggagacacagaagga

SEQ ID NO: 360849 - DNA, 25 bp, Mus musculus
tcccgtcccccagaggttgagaaca

SEQ ID NO: 360850 - DNA, 25 bp, Mus musculus
tcccgtccgaggtacccagactcat

SEQ ID NO: 360851 - DNA, 25 bp, Mus musculus
tcccgtccgaggtgtgaatgacaga

SEQ ID NO: 360852 - DNA, 25 bp, Mus musculus
tcccgtcctacgtgggctcgccata

SEQ ID NO: 360853 - DNA, 25 bp, Mus musculus
tcccgtctgtaactgggatcatggc

SEQ ID NO: 360854 - DNA, 25 bp, Mus musculus
tcccgtctgtaactgtcatcagaga

SEQ ID NO: 360855 - DNA, 25 bp, Mus musculus
tcccgtgaaggtgattcagacaagt

SEQ ID NO: 360856 - DNA, 25 bp, Mus musculus
tcccgtgcacccagaaaacgaagag

SEQ ID NO: 360857 - DNA, 25 bp, Mus musculus
tcccgtggcaatcctggttctcgtg

SEQ ID NO: 360858 - DNA, 25 bp, Mus musculus
tcccgtggccaggaaggacaggagt

SEQ ID NO: 360859 - DNA, 25 bp, Mus musculus
tcccgtgggggcagtaaatgatgct

SEQ ID NO: 360860 - DNA, 25 bp, Mus musculus
tcccgtggtcccctggagcaccaag

SEQ ID NO: 360861 - DNA, 25 bp, Mus musculus
tcccgtggtgcgaaagaaaaagtca

SEQ ID NO: 360862 - DNA, 25 bp, Mus musculus
tcccgtgtcatgggtctcagcctgg

SEQ ID NO: 360863 - DNA, 25 bp, Mus musculus
tcccgttcatatcagatgttttcca

SEQ ID NO: 360864 - DNA, 25 bp, Mus musculus
tcccgttcatatcagtggaacacat

SEQ ID NO: 360865 - DNA, 25 bp, Mus musculus
tccctaaagaaagagtttgacctgg

SEQ ID NO: 360866 - DNA, 25 bp, Mus musculus
tccctaaagcaagggagccgagtac

SEQ ID NO: 360867 - DNA, 25 bp, Mus musculus
tccctaagcttcctggtgcaaatag

SEQ ID NO: 360868 - DNA, 25 bp, Mus musculus
tccctaatggtccatctctacaaca

SEQ ID NO: 360869 - DNA, 25 bp, Mus musculus
tccctaatggtccattacccaggca

SEQ ID NO: 360870 - DNA, 25 bp, Mus musculus
tccctacagagatgggagaccgtta

SEQ ID NO: 360871 - DNA, 25 bp, Mus musculus
tccctacagaggagaatttagagct

SEQ ID NO: 360872 - DNA, 25 bp, Mus musculus
tccctacagaggtgtgtcagagctc

SEQ ID NO: 360873 - DNA, 25 bp, Mus musculus
tccctacatgtaaaggtcaagtagc

SEQ ID NO: 360874 - DNA, 25 bp, Mus musculus
tccctaccaggaggaagcagtggcc

SEQ ID NO: 360875 - DNA, 25 bp, Mus musculus
tccctaccatccccaaggaacctga

SEQ ID NO: 360876 - DNA, 25 bp, Mus musculus
tccctaccattctgtccggtcggga

SEQ ID NO: 360877 - DNA, 25 bp, Mus musculus
tccctaccctcgagtctgtagctcg

SEQ ID NO: 360878 - DNA, 25 bp, Mus musculus
tccctaccctctgggtctggagaca

SEQ ID NO: 360879 - DNA, 25 bp, Mus musculus
tccctaccttcaacaggactgggag

SEQ ID NO: 360880 - DNA, 25 bp, Mus musculus
tccctacgcctggactaacggttat

SEQ ID NO: 360881 - DNA, 25 bp, Mus musculus
tccctacggcatagtgccgtccagc

SEQ ID NO: 360882 - DNA, 25 bp, Mus musculus
tccctacggcatgaaacagaagagc

SEQ ID NO: 360883 - DNA, 25 bp, Mus musculus
tccctactccaaggtgaagcagaaa

SEQ ID NO: 360884 - DNA, 25 bp, Mus musculus
tccctactgagtggccaccctttgt

SEQ ID NO: 360885 - DNA, 25 bp, Mus musculus
tccctagaaagcggcctgacctgct

SEQ ID NO: 360886 - DNA, 25 bp, Mus musculus
tccctagaaagcgggactttgccag

SEQ ID NO: 360887 - DNA, 25 bp, Mus musculus
tccctagaagatggattcatgggtg

SEQ ID NO: 360888 - DNA, 25 bp, Mus musculus
tccctagaagggcaacaacccggat

SEQ ID NO: 360889 - DNA, 25 bp, Mus musculus
tccctagcaaaactcttccaagtgt

SEQ ID NO: 360890 - DNA, 25 bp, Mus musculus
tccctagcgccacaggcatggggag

SEQ ID NO: 360891 - DNA, 25 bp, Mus musculus
tccctagctggaaggactgggcaaa

SEQ ID NO: 360892 - DNA, 25 bp, Mus musculus
tccctaggcaatgacaccctgtact

SEQ ID NO: 360893 - DNA, 25 bp, Mus musculus
tccctaggcaatgcactactctccg

SEQ ID NO: 360894 - DNA, 25 bp, Mus musculus
tccctagtagatccactgtgggtgc

SEQ ID NO: 360895 - DNA, 25 bp, Mus musculus
tccctagttcaagaggaagaaatgc

SEQ ID NO: 360896 - DNA, 25 bp, Mus musculus
tccctagttcaagaggacacaatgt

SEQ ID NO: 360897 - DNA, 25 bp, Mus musculus
tccctataaccgatgagaaccacag

SEQ ID NO: 360898 - DNA, 25 bp, Mus musculus
tccctataagtaaggaatgaattcg

SEQ ID NO: 360899 - DNA, 25 bp, Mus musculus
tccctataagtaaggctgtagaaaa

SEQ ID NO: 360900 - DNA, 25 bp, Mus musculus
tccctatctacttggaccagaagtg

SEQ ID NO: 360901 - DNA, 25 bp, Mus musculus
tccctatgaatacaggagtggaggc

SEQ ID NO: 360902 - DNA, 25 bp, Mus musculus
tccctatggagcagcccaggcctcc

SEQ ID NO: 360903 - DNA, 25 bp, Mus musculus
tccctatggcactggtatctcattc

SEQ ID NO: 360904 - DNA, 25 bp, Mus musculus
tccctatgtcccatcttgtcaagtt

SEQ ID NO: 360905 - DNA, 25 bp, Mus musculus
tccctatgttacagaacccaagagt

SEQ ID NO: 360906 - DNA, 25 bp, Mus musculus
tccctattgcagagatggagactca

SEQ ID NO: 360907 - DNA, 25 bp, Mus musculus
tccctattgcagagggcaagtttat

SEQ ID NO: 360908 - DNA, 25 bp, Mus musculus
tccctcaaaccccggcttcttcact

SEQ ID NO: 360909 - DNA, 25 bp, Mus musculus
tccctcaaagatgaacgagaccgtg

SEQ ID NO: 360910 - DNA, 25 bp, Mus musculus
tccctcaagagtttacaaacctgaa

SEQ ID NO: 360911 - DNA, 25 bp, Mus musculus
tccctcaagtgaccacacactggct

SEQ ID NO: 360912 - DNA, 25 bp, Mus musculus
tccctcaatgcaaaaaggccagata

SEQ ID NO: 360913 - DNA, 25 bp, Mus musculus
tccctcacaaccttgccagaaaacc

SEQ ID NO: 360914 - DNA, 25 bp, Mus musculus
tccctcacaaccttggtaccttcac

SEQ ID NO: 360915 - DNA, 25 bp, Mus musculus
tccctcacacacctgcacgttctct

SEQ ID NO: 360916 - DNA, 25 bp, Mus musculus
tccctcacagaccaagtctgaaact

SEQ ID NO: 360917 - DNA, 25 bp, Mus musculus
tccctcacatccgtcctgcctctgc

SEQ ID NO: 360918 - DNA, 25 bp, Mus musculus
tccctcaccaagcttagcaaggagt

SEQ ID NO: 360919 - DNA, 25 bp, Mus musculus
tccctcacccccaggagttcaacta

SEQ ID NO: 360920 - DNA, 25 bp, Mus musculus
tccctcacctcaggattctgggtag

SEQ ID NO: 360921 - DNA, 25 bp, Mus musculus
tccctcacctcagggaagagggatt

SEQ ID NO: 360922 - DNA, 25 bp, Mus musculus
tccctcacctcccagtggcaccacc

SEQ ID NO: 360923 - DNA, 25 bp, Mus musculus
tccctcacctgaagaaaaaagcagt

SEQ ID NO: 360924 - DNA, 25 bp, Mus musculus
tccctcacctgaagggatgtctgaa

SEQ ID NO: 360925 - DNA, 25 bp, Mus musculus
tccctcaccttggcagccatcatgg

SEQ ID NO: 360926 - DNA, 25 bp, Mus musculus
tccctcaccttgggaatcccaatgc

SEQ ID NO: 360927 - DNA, 25 bp, Mus musculus
tccctcaccttgttttctgctcata

SEQ ID NO: 360928 - DNA, 25 bp, Mus musculus
tccctcactgcactaacctttgagg

SEQ ID NO: 360929 - DNA, 25 bp, Mus musculus
tccctcactggtgagaatgtccggg

SEQ ID NO: 360930 - DNA, 25 bp, Mus musculus
tccctcagaagcatctccatcgcct

SEQ ID NO: 360931 - DNA, 25 bp, Mus musculus
tccctcagactcggggtcgcatccc

SEQ ID NO: 360932 - DNA, 25 bp, Mus musculus
tccctcagactcggtacctcggaat

SEQ ID NO: 360933 - DNA, 25 bp, Mus musculus
tccctcagactcggtcccccagagg

SEQ ID NO: 360934 - DNA, 25 bp, Mus musculus
tccctcagcagcaggtcctgggagc

SEQ ID NO: 360935 - DNA, 25 bp, Mus musculus
tccctcagctgctcctggacttcta

SEQ ID NO: 360936 - DNA, 25 bp, Mus musculus
tccctcaggccgcaggcctctctgt

SEQ ID NO: 360937 - DNA, 25 bp, Mus musculus
tccctcaggcgaaaatatttcttgg

SEQ ID NO: 360938 - DNA, 25 bp, Mus musculus
tccctcaggcgacccaactctactg

SEQ ID NO: 360939 - DNA, 25 bp, Mus musculus
tccctcagggtggcaaaggtgatgt

SEQ ID NO: 360940 - DNA, 25 bp, Mus musculus
tccctcatactacaggtgagcgtcc

SEQ ID NO: 360941 - DNA, 25 bp, Mus musculus
tccctcatcaatggtgaacaaccca

SEQ ID NO: 360942 - DNA, 25 bp, Mus musculus
tccctcatccacgaaggttttgcag

SEQ ID NO: 360943 - DNA, 25 bp, Mus musculus
tccctcatccacggtttgtggaatc

SEQ ID NO: 360944 - DNA, 25 bp, Mus musculus
tccctcatcggcagccagctggagg

SEQ ID NO: 360945 - DNA, 25 bp, Mus musculus
tccctccaaagcaagagtgaagtgt

SEQ ID NO: 360946 - DNA, 25 bp, Mus musculus
tccctccaaatttgggcagacatta

SEQ ID NO: 360947 - DNA, 25 bp, Mus musculus
tccctccaaggctgggcgcgggctg

SEQ ID NO: 360948 - DNA, 25 bp, Mus musculus
tccctccactggttggaagaggctg

SEQ ID NO: 360949 - DNA, 25 bp, Mus musculus
tccctcccaacccaaatcttccacc

SEQ ID NO: 360950 - DNA, 25 bp, Mus musculus
tccctcccaacccaagtgacgtttt

SEQ ID NO: 360951 - DNA, 25 bp, Mus musculus
tccctcccagctgatggttcctggg

SEQ ID NO: 360952 - DNA, 25 bp, Mus musculus
tccctcccatgcagccacctggaca

SEQ ID NO: 360953 - DNA, 25 bp, Mus musculus
tccctccccagcaatctactctcct

SEQ ID NO: 360954 - DNA, 25 bp, Mus musculus
tccctccccaggaacattgaccatg

SEQ ID NO: 360955 - DNA, 25 bp, Mus musculus
tccctccccggccagacagcaattc

SEQ ID NO: 360956 - DNA, 25 bp, Mus musculus
tccctccccggccagatgaggacaa

SEQ ID NO: 360957 - DNA, 25 bp, Mus musculus
tccctccccggccagtggctcttga

SEQ ID NO: 360958 - DNA, 25 bp, Mus musculus
tccctcccgcccaagcctaatagac

SEQ ID NO: 360959 - DNA, 25 bp, Mus musculus
tccctcccgcccccagcgcctgctc

SEQ ID NO: 360960 - DNA, 25 bp, Mus musculus
tccctccctggcagggggaggagga

SEQ ID NO: 360961 - DNA, 25 bp, Mus musculus
tccctccgcggaaatctaccagaga

SEQ ID NO: 360962 - DNA, 25 bp, Mus musculus
tccctccgggctgtgagcacctcct

SEQ ID NO: 360963 - DNA, 25 bp, Mus musculus
tccctcctaagactgtatcactttc

SEQ ID NO: 360964 - DNA, 25 bp, Mus musculus
tccctcctcaggtggggctcccaga

SEQ ID NO: 360965 - DNA, 25 bp, Mus musculus
tccctcctgcaagcgttctgtcaac

SEQ ID NO: 360966 - DNA, 25 bp, Mus musculus
tccctcctggccttcccagaggcca

SEQ ID NO: 360967 - DNA, 25 bp, Mus musculus
tccctcctggtaccagactctcatg

SEQ ID NO: 360968 - DNA, 25 bp, Mus musculus
tccctccttggacagatgaaaaaga

SEQ ID NO: 360969 - DNA, 25 bp, Mus musculus
tccctccttggacagtaattttatg

SEQ ID NO: 360970 - DNA, 25 bp, Mus musculus
tccctcgacctggaggatgtttctt

SEQ ID NO: 360971 - DNA, 25 bp, Mus musculus
tccctcgcagttcttgaacacttcc

SEQ ID NO: 360972 - DNA, 25 bp, Mus musculus
tccctcggagaaaggccagccatgt

SEQ ID NO: 360973 - DNA, 25 bp, Mus musculus
tccctcggaggcacgcgcctacctc

SEQ ID NO: 360974 - DNA, 25 bp, Mus musculus
tccctcggagtacaacacagaagag

SEQ ID NO: 360975 - DNA, 25 bp, Mus musculus
tccctcggatcggagaaacgcttcg

SEQ ID NO: 360976 - DNA, 25 bp, Mus musculus
tccctcgggagcaggtttcaacact

SEQ ID NO: 360977 - DNA, 25 bp, Mus musculus
tccctctaaaagaagcgtgcaatca

SEQ ID NO: 360978 - DNA, 25 bp, Mus musculus
tccctctaaaagcttcctgcagtag

SEQ ID NO: 360979 - DNA, 25 bp, Mus musculus
tccctctactcctaagtccccaggt

SEQ ID NO: 360980 - DNA, 25 bp, Mus musculus
tccctctactcctaatgtgaaaaac

SEQ ID NO: 360981 - DNA, 25 bp, Mus musculus
tccctctataaggagggtcactcca

SEQ ID NO: 360982 - DNA, 25 bp, Mus musculus
tccctctatgccaaaaggccagata

SEQ ID NO: 360983 - DNA, 25 bp, Mus musculus
tccctctcaaccctggctgcactgc

SEQ ID NO: 360984 - DNA, 25 bp, Mus musculus
tccctctcagccccctggtgctccc

SEQ ID NO: 360985 - DNA, 25 bp, Mus musculus
tccctctcagggtgcgggtagcggc

SEQ ID NO: 360986 - DNA, 25 bp, Mus musculus
tccctctcaggtttacagccccaac

SEQ ID NO: 360987 - DNA, 25 bp, Mus musculus
tccctctcctgaaagcgctgagaag

SEQ ID NO: 360988 - DNA, 25 bp, Mus musculus
tccctctctgctgcggtcatgtagg

SEQ ID NO: 360989 - DNA, 25 bp, Mus musculus
tccctctctttgccaaggtgaacgt

SEQ ID NO: 360990 - DNA, 25 bp, Mus musculus
tccctctgatttagatcttgaacca

SEQ ID NO: 360991 - DNA, 25 bp, Mus musculus
tccctctgcatgccccagagtggcc

SEQ ID NO: 360992 - DNA, 25 bp, Mus musculus
tccctctgcatgccgcagagtggcc

SEQ ID NO: 360993 - DNA, 25 bp, Mus musculus
tccctctggaagcagcagccgcagc

SEQ ID NO: 360994 - DNA, 25 bp, Mus musculus
tccctctggaagtgccgaattcgag

SEQ ID NO: 360995 - DNA, 25 bp, Mus musculus
tccctctgtcaagggggtgtcgttt

SEQ ID NO: 360996 - DNA, 25 bp, Mus musculus
tccctctgtcaagttaacactcacg

SEQ ID NO: 360997 - DNA, 25 bp, Mus musculus
tccctctgtccccagggaacagact

SEQ ID NO: 360998 - DNA, 25 bp, Mus musculus
tccctctgtgccgaacatctcatca

SEQ ID NO: 360999 - DNA, 25 bp, Mus musculus
tccctctgtgccgcccccagaggaa

SEQ ID NO: 361000 - DNA, 25 bp, Mus musculus
tccctcttagccatgaaacactctc

SEQ ID NO: 361001 - DNA, 25 bp, Mus musculus
tccctcttcacctcgctgaggtgaa

SEQ ID NO: 361002 - DNA, 25 bp, Mus musculus
tccctcttcatgacacccctggatg

SEQ ID NO: 361003 - DNA, 25 bp, Mus musculus
tccctcttgcagctcaaatgtcccc

SEQ ID NO: 361004 - DNA, 25 bp, Mus musculus
tccctcttggctgatggtgaggcca

SEQ ID NO: 361005 - DNA, 25 bp, Mus musculus
tccctgaaacagatgctgaccttaa

SEQ ID NO: 361006 - DNA, 25 bp, Mus musculus
tccctgaaacccaaatatgccaagt

SEQ ID NO: 361007 - DNA, 25 bp, Mus musculus
tccctgaaaggaagtcagagaagct

SEQ ID NO: 361008 - DNA, 25 bp, Mus musculus
tccctgaactgcacacgccaaagat

SEQ ID NO: 361009 - DNA, 25 bp, Mus musculus
tccctgaagcagaagactctcttct

SEQ ID NO: 361010 - DNA, 25 bp, Mus musculus
tccctgaagtcaagggcaggcactg

SEQ ID NO: 361011 - DNA, 25 bp, Mus musculus
tccctgaagtcaaggtcggttaggc

SEQ ID NO: 361012 - DNA, 25 bp, Mus musculus
tccctgaattgacccagcccgggga

SEQ ID NO: 361013 - DNA, 25 bp, Mus musculus
tccctgacaaagctgactctcgggc

SEQ ID NO: 361014 - DNA, 25 bp, Mus musculus
tccctgacaaaggtgactctcgggc

SEQ ID NO: 361015 - DNA, 25 bp, Mus musculus
tccctgacagcaggggcttcagtgt

SEQ ID NO: 361016 - DNA, 25 bp, Mus musculus
tccctgacagcagttcccacagctg

SEQ ID NO: 361017 - DNA, 25 bp, Mus musculus
tccctgacaggcccgagcctacgtg

SEQ ID NO: 361018 - DNA, 25 bp, Mus musculus
tccctgacaggggagagcacccctg

SEQ ID NO: 361019 - DNA, 25 bp, Mus musculus
tccctgactatttggttcctgctgc

SEQ ID NO: 361020 - DNA, 25 bp, Mus musculus
tccctgactcatggtggcccgaggc

SEQ ID NO: 361021 - DNA, 25 bp, Mus musculus
tccctgactcgatggcaccgcatgc

SEQ ID NO: 361022 - DNA, 25 bp, Mus musculus
tccctgagcagattgaacgggctgc

SEQ ID NO: 361023 - DNA, 25 bp, Mus musculus
tccctgagccggaggttccaggatg

SEQ ID NO: 361024 - DNA, 25 bp, Mus musculus
tccctgagctgtgaggcgcagcaag

SEQ ID NO: 361025 - DNA, 25 bp, Mus musculus
tccctgaggaacagaaaatgttaac

SEQ ID NO: 361026 - DNA, 25 bp, Mus musculus
tccctgaggaacagatcctggagag

SEQ ID NO: 361027 - DNA, 25 bp, Mus musculus
tccctgaggagcagggcattttccg

SEQ ID NO: 361028 - DNA, 25 bp, Mus musculus
tccctgaggggtacctcggaatcgg

SEQ ID NO: 361029 - DNA, 25 bp, Mus musculus
tccctgagtggctatggagttactt

SEQ ID NO: 361030 - DNA, 25 bp, Mus musculus
tccctgagtttcaggagcggctgca

SEQ ID NO: 361031 - DNA, 25 bp, Mus musculus
tccctgagtttgacgactctgacta

SEQ ID NO: 361032 - DNA, 25 bp, Mus musculus
tccctgatacagagcgcctagatga

SEQ ID NO: 361033 - DNA, 25 bp, Mus musculus
tccctgatagagttgcaacatctcg

SEQ ID NO: 361034 - DNA, 25 bp, Mus musculus
tccctgatatcaagtcgcgcattgc

SEQ ID NO: 361035 - DNA, 25 bp, Mus musculus
tccctgatcaagatggactgtaaca

SEQ ID NO: 361036 - DNA, 25 bp, Mus musculus
tccctgatcacaaagcagacccagg

SEQ ID NO: 361037 - DNA, 25 bp, Mus musculus
tccctgatgcgagagaacaagagat

SEQ ID NO: 361038 - DNA, 25 bp, Mus musculus
tccctgcaagatatggttgcaggag

SEQ ID NO: 361039 - DNA, 25 bp, Mus musculus
tccctgcaaggaaagagtgccaccc

SEQ ID NO: 361040 - DNA, 25 bp, Mus musculus
tccctgcaaggagtgttacggcttg

SEQ ID NO: 361041 - DNA, 25 bp, Mus musculus
tccctgcacaggggtgacagtccaa

SEQ ID NO: 361042 - DNA, 25 bp, Mus musculus
tccctgcacggctggccaggccaag

SEQ ID NO: 361043 - DNA, 25 bp, Mus musculus
tccctgcacttgtggatggagacca

SEQ ID NO: 361044 - DNA, 25 bp, Mus musculus
tccctgcagctaaggcagaaaagat

SEQ ID NO: 361045 - DNA, 25 bp, Mus musculus
tccctgcagctacaggagtcatggc

SEQ ID NO: 361046 - DNA, 25 bp, Mus musculus
tccctgcaggacaggtggcctctga

SEQ ID NO: 361047 - DNA, 25 bp, Mus musculus
tccctgcagggtcccacaaaacagc

SEQ ID NO: 361048 - DNA, 25 bp, Mus musculus
tccctgcatagaggtagttcctaat

SEQ ID NO: 361049 - DNA, 25 bp, Mus musculus
tccctgcatagaggtgtgaaattga

SEQ ID NO: 361050 - DNA, 25 bp, Mus musculus
tccctgcatgtcaccctgccgtgga

SEQ ID NO: 361051 - DNA, 25 bp, Mus musculus
tccctgcatgtcaccctggactggt

SEQ ID NO: 361052 - DNA, 25 bp, Mus musculus
tccctgcatgtcaccctgtgctgaa

SEQ ID NO: 361053 - DNA, 25 bp, Mus musculus
tccctgccaaatttccaagcaagaa

SEQ ID NO: 361054 - DNA, 25 bp, Mus musculus
tccctgccaacaagaacctgaagat

SEQ ID NO: 361055 - DNA, 25 bp, Mus musculus
tccctgccagaggttgagacagatc

SEQ ID NO: 361056 - DNA, 25 bp, Mus musculus
tccctgccagatgaggatcatgcgg

SEQ ID NO: 361057 - DNA, 25 bp, Mus musculus
tccctgcccagagtgaacctgtgag

SEQ ID NO: 361058 - DNA, 25 bp, Mus musculus
tccctgcccgaagggacagtttggt

SEQ ID NO: 361059 - DNA, 25 bp, Mus musculus
tccctgcccgcctgtaagttccagg

SEQ ID NO: 361060 - DNA, 25 bp, Mus musculus
tccctgcccgcctgtcgccttgaag

SEQ ID NO: 361061 - DNA, 25 bp, Mus musculus
tccctgccctcaaggtaatggatga

SEQ ID NO: 361062 - DNA, 25 bp, Mus musculus
tccctgccctcaaggtggtgaagaa

SEQ ID NO: 361063 - DNA, 25 bp, Mus musculus
tccctgccgggctgtgcctctcctt

SEQ ID NO: 361064 - DNA, 25 bp, Mus musculus
tccctgcctgaggagctgcagaagt

SEQ ID NO: 361065 - DNA, 25 bp, Mus musculus
tccctgcgcagctcggcatttcagt

SEQ ID NO: 361066 - DNA, 25 bp, Mus musculus
tccctgctacagcaacttctcctgg

SEQ ID NO: 361067 - DNA, 25 bp, Mus musculus
tccctgctagagacggtcgctcgca

SEQ ID NO: 361068 - DNA, 25 bp, Mus musculus
tccctgctatgacactggctggagg

SEQ ID NO: 361069 - DNA, 25 bp, Mus musculus
tccctgctatgggcatattgtatta

SEQ ID NO: 361070 - DNA, 25 bp, Mus musculus
tccctgctatgggcatattgtattt

SEQ ID NO: 361071 - DNA, 25 bp, Mus musculus
tccctgctcagctgcgcatcctgcc

SEQ ID NO: 361072 - DNA, 25 bp, Mus musculus
tccctgctcagctgcgtcggcaccc

SEQ ID NO: 361073 - DNA, 25 bp, Mus musculus
tccctgctcattattcccccagaac

SEQ ID NO: 361074 - DNA, 25 bp, Mus musculus
tccctgctccacaggtgttctacac

SEQ ID NO: 361075 - DNA, 25 bp, Mus musculus
tccctgctccggcaagacattgctt

SEQ ID NO: 361076 - DNA, 25 bp, Mus musculus
tccctgctctgttgtgtatccaggt

SEQ ID NO: 361077 - DNA, 25 bp, Mus musculus
tccctgctgacgcagatcattaagt

SEQ ID NO: 361078 - DNA, 25 bp, Mus musculus
tccctgctgacgcaggatcctaccc

SEQ ID NO: 361079 - DNA, 25 bp, Mus musculus
tccctgctggagaatgagagagaaa

SEQ ID NO: 361080 - DNA, 25 bp, Mus musculus
tccctgctggaggagctgatgcact

SEQ ID NO: 361081 - DNA, 25 bp, Mus musculus
tccctgctgtcaacggggtctcatt

SEQ ID NO: 361082 - DNA, 25 bp, Mus musculus
tccctgctgttcctgattatctatt

SEQ ID NO: 361083 - DNA, 25 bp, Mus musculus
tccctgcttcagcaagcttccctgt

SEQ ID NO: 361084 - DNA, 25 bp, Mus musculus
tccctgcttccagcccctatgttac

SEQ ID NO: 361085 - DNA, 25 bp, Mus musculus
tccctgctttttggagaggacgacc

SEQ ID NO: 361086 - DNA, 25 bp, Mus musculus
tccctggaaaagcctgaaaatcagg

SEQ ID NO: 361087 - DNA, 25 bp, Mus musculus
tccctggaacgggtgaagttgattc

SEQ ID NO: 361088 - DNA, 25 bp, Mus musculus
tccctggaagctgaggacctacctg

SEQ ID NO: 361089 - DNA, 25 bp, Mus musculus
tccctggaaggggagccccgcaagg

SEQ ID NO: 361090 - DNA, 25 bp, Mus musculus
tccctggaaggtggaacctagggtc

SEQ ID NO: 361091 - DNA, 25 bp, Mus musculus
tccctggacaagctgtggccagcgt

SEQ ID NO: 361092 - DNA, 25 bp, Mus musculus
tccctggaccaaggtgcttcacctg

SEQ ID NO: 361093 - DNA, 25 bp, Mus musculus
tccctggaccacctctgccctccca

SEQ ID NO: 361094 - DNA, 25 bp, Mus musculus
tccctggaccaggtgaaaaaagccc

SEQ ID NO: 361095 - DNA, 25 bp, Mus musculus
tccctggaccattttagactacatc

SEQ ID NO: 361096 - DNA, 25 bp, Mus musculus
tccctggacccaggctgccctgccc

SEQ ID NO: 361097 - DNA, 25 bp, Mus musculus
tccctggactggaaggaaatctaca

SEQ ID NO: 361098 - DNA, 25 bp, Mus musculus
tccctggacttcagaaccagcagct

SEQ ID NO: 361099 - DNA, 25 bp, Mus musculus
tccctggagaaggatatgaatcaga

SEQ ID NO: 361100 - DNA, 25 bp, Mus musculus
tccctggagaaggcgtgggtgactg

SEQ ID NO: 361101 - DNA, 25 bp, Mus musculus
tccctggagaagtcaaacaggtgac

SEQ ID NO: 361102 - DNA, 25 bp, Mus musculus
tccctggagacctggccaaccgctg

SEQ ID NO: 361103 - DNA, 25 bp, Mus musculus
tccctggaggagcagaattttctac

SEQ ID NO: 361104 - DNA, 25 bp, Mus musculus
tccctggatcaccaggtgttgatgc

SEQ ID NO: 361105 - DNA, 25 bp, Mus musculus
tccctggatccaggcttacaattac

SEQ ID NO: 361106 - DNA, 25 bp, Mus musculus
tccctggatgagcaagaaggagtta

SEQ ID NO: 361107 - DNA, 25 bp, Mus musculus
tccctggattcagtcatttgaagac

SEQ ID NO: 361108 - DNA, 25 bp, Mus musculus
tccctggcaaaaggtgcccgaggtg

SEQ ID NO: 361109 - DNA, 25 bp, Mus musculus
tccctggcacagaaacatcatccaa

SEQ ID NO: 361110 - DNA, 25 bp, Mus musculus
tccctggcacagcaagcttccctgg

SEQ ID NO: 361111 - DNA, 25 bp, Mus musculus
tccctggcaccgggcactgactgtc

SEQ ID NO: 361112 - DNA, 25 bp, Mus musculus
tccctggcactgcaagtttccccag

SEQ ID NO: 361113 - DNA, 25 bp, Mus musculus
tccctggcattagggcaggctggat

SEQ ID NO: 361114 - DNA, 25 bp, Mus musculus
tccctggcattagtacactgtagct

SEQ ID NO: 361115 - DNA, 25 bp, Mus musculus
tccctggccctcacaagtggccaat

SEQ ID NO: 361116 - DNA, 25 bp, Mus musculus
tccctggcctatctccctggagttt

SEQ ID NO: 361117 - DNA, 25 bp, Mus musculus
tccctggcctccctgggccccaagg

SEQ ID NO: 361118 - DNA, 25 bp, Mus musculus
tccctggcggttcacaagagcaaga

SEQ ID NO: 361119 - DNA, 25 bp, Mus musculus
tccctggctaagcaagcttccctgt

SEQ ID NO: 361120 - DNA, 25 bp, Mus musculus
tccctggctccctcatcagcgaaaa

SEQ ID NO: 361121 - DNA, 25 bp, Mus musculus
tccctggctgagtatgagcccagag

SEQ ID NO: 361122 - DNA, 25 bp, Mus musculus
tccctgggaaaaggacgctattaca

SEQ ID NO: 361123 - DNA, 25 bp, Mus musculus
tccctgggcagaaaggtgatcgagg

SEQ ID NO: 361124 - DNA, 25 bp, Mus musculus
tccctgggctgtggtggtgagaagc

SEQ ID NO: 361125 - DNA, 25 bp, Mus musculus
tccctggggaaagctactgggatgg

SEQ ID NO: 361126 - DNA, 25 bp, Mus musculus
tccctggggatccgagagactcggg

SEQ ID NO: 361127 - DNA, 25 bp, Mus musculus
tccctgggtgtcactggtgcagact

SEQ ID NO: 361128 - DNA, 25 bp, Mus musculus
tccctgggtttaaagacagtatttg

SEQ ID NO: 361129 - DNA, 25 bp, Mus musculus
tccctggtacagcaaccttccatgg

SEQ ID NO: 361130 - DNA, 25 bp, Mus musculus
tccctggtacagcaagcttccctgc

SEQ ID NO: 361131 - DNA, 25 bp, Mus musculus
tccctggtacagcaagcttccctgg

SEQ ID NO: 361132 - DNA, 25 bp, Mus musculus
tccctggtacagcaagcttccctgt

SEQ ID NO: 361133 - DNA, 25 bp, Mus musculus
tccctggtacagcaagctttcctgg

SEQ ID NO: 361134 - DNA, 25 bp, Mus musculus
tccctggtccaggtgaaatcgccct

SEQ ID NO: 361135 - DNA, 25 bp, Mus musculus
tccctggtcctgtgggtctccctgg

SEQ ID NO: 361136 - DNA, 25 bp, Mus musculus
tccctggtcctgtgggtgaaccagg

SEQ ID NO: 361137 - DNA, 25 bp, Mus musculus
tccctggtcctgtgggtgagcaagg

SEQ ID NO: 361138 - DNA, 25 bp, Mus musculus
tccctggtcgtaatggagatagggc

SEQ ID NO: 361139 - DNA, 25 bp, Mus musculus
tccctggtgcccagagagaggcagg

SEQ ID NO: 361140 - DNA, 25 bp, Mus musculus
tccctgtaacaagcttaaatccagt

SEQ ID NO: 361141 - DNA, 25 bp, Mus musculus
tccctgtaacagccaaacaccatgt

SEQ ID NO: 361142 - DNA, 25 bp, Mus musculus
tccctgtaacaggaatgggctgctt

SEQ ID NO: 361143 - DNA, 25 bp, Mus musculus
tccctgtacgacgatgacgtggcgc

SEQ ID NO: 361144 - DNA, 25 bp, Mus musculus
tccctgtcaagattgagattcccct

SEQ ID NO: 361145 - DNA, 25 bp, Mus musculus
tccctgtcacagattgaaatggatg

SEQ ID NO: 361146 - DNA, 25 bp, Mus musculus
tccctgtcagaatgatcatgcgtcc

SEQ ID NO: 361147 - DNA, 25 bp, Mus musculus
tccctgtcatcagattgatcttttc

SEQ ID NO: 361148 - DNA, 25 bp, Mus musculus
tccctgtccgtcaagtttggaaatg

SEQ ID NO: 361149 - DNA, 25 bp, Mus musculus
tccctgtcctaggtagcagaggcag

SEQ ID NO: 361150 - DNA, 25 bp, Mus musculus
tccctgtcctgaggccatgcttgtg

SEQ ID NO: 361151 - DNA, 25 bp, Mus musculus
tccctgtcggtgagatgggtgcaag

SEQ ID NO: 361152 - DNA, 25 bp, Mus musculus
tccctgtctctcagaactgaggggg

SEQ ID NO: 361153 - DNA, 25 bp, Mus musculus
tccctgtctctttggtcaagacagc

SEQ ID NO: 361154 - DNA, 25 bp, Mus musculus
tccctgtctgaaggatctcacataa

SEQ ID NO: 361155 - DNA, 25 bp, Mus musculus
tccctgtctgaaggcacttctggat

SEQ ID NO: 361156 - DNA, 25 bp, Mus musculus
tccctgtctgtacctacagccgggt

SEQ ID NO: 361157 - DNA, 25 bp, Mus musculus
tccctgtctgtggccaggagggccg

SEQ ID NO: 361158 - DNA, 25 bp, Mus musculus
tccctgtgcgggccatcaattaccc

SEQ ID NO: 361159 - DNA, 25 bp, Mus musculus
tccctgtgcgggttgccgatgctgc

SEQ ID NO: 361160 - DNA, 25 bp, Mus musculus
tccctgtggaacagccgtgtaggtt

SEQ ID NO: 361161 - DNA, 25 bp, Mus musculus
tccctgtggcaggtgaccttggaca

SEQ ID NO: 361162 - DNA, 25 bp, Mus musculus
tccctgtggcagtggaggtgaagcc

SEQ ID NO: 361163 - DNA, 25 bp, Mus musculus
tccctgtggctgatcgcgtggctga

SEQ ID NO: 361164 - DNA, 25 bp, Mus musculus
tccctgtggctgatctcttcattgg

SEQ ID NO: 361165 - DNA, 25 bp, Mus musculus
tccctgtggctgatgtatgtgtaag

SEQ ID NO: 361166 - DNA, 25 bp, Mus musculus
tccctgtgggaagcccccggcagca

SEQ ID NO: 361167 - DNA, 25 bp, Mus musculus
tccctgtggtagcagacccaacagt

SEQ ID NO: 361168 - DNA, 25 bp, Mus musculus
tccctgttaagcatcaacatttctg

SEQ ID NO: 361169 - DNA, 25 bp, Mus musculus
tccctgttcactcaacagacctgac

SEQ ID NO: 361170 - DNA, 25 bp, Mus musculus
tccctgttcagagggagagccgaga

SEQ ID NO: 361171 - DNA, 25 bp, Mus musculus
tccctgttcagaggtcctgatagct

SEQ ID NO: 361172 - DNA, 25 bp, Mus musculus
tccctgttctccaccctcccctgat

SEQ ID NO: 361173 - DNA, 25 bp, Mus musculus
tccctgttgacaatatctttaatgc

SEQ ID NO: 361174 - DNA, 25 bp, Mus musculus
tccctgttgacgaacctaaaactaa

SEQ ID NO: 361175 - DNA, 25 bp, Mus musculus
tccctgtttcagcaaccttccatgg

SEQ ID NO: 361176 - DNA, 25 bp, Mus musculus
tccctgtttcagcaaccttccctgc

SEQ ID NO: 361177 - DNA, 25 bp, Mus musculus
tccctgtttcagcaaccttccctgg

SEQ ID NO: 361178 - DNA, 25 bp, Mus musculus
tccctgtttcagcaagcttccctgc

SEQ ID NO: 361179 - DNA, 25 bp, Mus musculus
tccctgtttcagcaagcttccctgt

SEQ ID NO: 361180 - DNA, 25 bp, Mus musculus
tccctgtttcagcaagtttccccag

SEQ ID NO: 361181 - DNA, 25 bp, Mus musculus
tccctgtttcagcaatcttccctgg

SEQ ID NO: 361182 - DNA, 25 bp, Mus musculus
tccctgtttcagcttccctgtttca

SEQ ID NO: 361183 - DNA, 25 bp, Mus musculus
tccctgtttcaggattatttttctt

SEQ ID NO: 361184 - DNA, 25 bp, Mus musculus
tccctgtttgcccagatgggttttg

SEQ ID NO: 361185 - DNA, 25 bp, Mus musculus
tccctgtttgcccagctctctgtgc

SEQ ID NO: 361186 - DNA, 25 bp, Mus musculus
tcccttaactgatgtgccggtgaat

SEQ ID NO: 361187 - DNA, 25 bp, Mus musculus
tcccttaagaccattcaaatccctg

SEQ ID NO: 361188 - DNA, 25 bp, Mus musculus
tcccttaagttcaggtcagaggaac

SEQ ID NO: 361189 - DNA, 25 bp, Mus musculus
tcccttacatgaagtcgatggcaat

SEQ ID NO: 361190 - DNA, 25 bp, Mus musculus
tcccttaccgcgtcgagcagaacag

SEQ ID NO: 361191 - DNA, 25 bp, Mus musculus
tcccttaggtttgatcagacctact

SEQ ID NO: 361192 - DNA, 25 bp, Mus musculus
tcccttcactggctcccactactgg

SEQ ID NO: 361193 - DNA, 25 bp, Mus musculus
tcccttcagagggacagaccaccgg

SEQ ID NO: 361194 - DNA, 25 bp, Mus musculus
tcccttcagagggaggggcgacatc

SEQ ID NO: 361195 - DNA, 25 bp, Mus musculus
tcccttcagccgagaaacatcccaa

SEQ ID NO: 361196 - DNA, 25 bp, Mus musculus
tcccttcagccgagaagaactttga

SEQ ID NO: 361197 - DNA, 25 bp, Mus musculus
tcccttcagcctggggctgacatgg

SEQ ID NO: 361198 - DNA, 25 bp, Mus musculus
tcccttcaggacttgctgatgtgga

SEQ ID NO: 361199 - DNA, 25 bp, Mus musculus
tcccttcatttctcatctcccagca

SEQ ID NO: 361200 - DNA, 25 bp, Mus musculus
tcccttccagaagtcttgtgtgatg

SEQ ID NO: 361201 - DNA, 25 bp, Mus musculus
tcccttccagaatgtcaagtgcccc

SEQ ID NO: 361202 - DNA, 25 bp, Mus musculus
tcccttccccctgaggaggctgcgg

SEQ ID NO: 361203 - DNA, 25 bp, Mus musculus
tcccttcccctcagagttgtctgct

SEQ ID NO: 361204 - DNA, 25 bp, Mus musculus
tcccttcccctcaggagtggagtca

SEQ ID NO: 361205 - DNA, 25 bp, Mus musculus
tcccttcccctcaggggtgatccat

SEQ ID NO: 361206 - DNA, 25 bp, Mus musculus
tcccttcccgagggcgctgtgaggt

SEQ ID NO: 361207 - DNA, 25 bp, Mus musculus
tcccttccggcacaattgccaaaat

SEQ ID NO: 361208 - DNA, 25 bp, Mus musculus
tcccttccggctggccacccccatc

SEQ ID NO: 361209 - DNA, 25 bp, Mus musculus
tcccttccgggctgtggaaggatcc

SEQ ID NO: 361210 - DNA, 25 bp, Mus musculus
tcccttctggccttcccagaggcca

SEQ ID NO: 361211 - DNA, 25 bp, Mus musculus
tcccttctggtcagtgttcacaccg

SEQ ID NO: 361212 - DNA, 25 bp, Mus musculus
tcccttgactcactgattcatctga

SEQ ID NO: 361213 - DNA, 25 bp, Mus musculus
tcccttgatggcaagtatgtctata

SEQ ID NO: 361214 - DNA, 25 bp, Mus musculus
tcccttgcagccactgcaagaaaaa

SEQ ID NO: 361215 - DNA, 25 bp, Mus musculus
tcccttgcagccagacgttagggga

SEQ ID NO: 361216 - DNA, 25 bp, Mus musculus
tcccttgcagccatgcagtggtgcc

SEQ ID NO: 361217 - DNA, 25 bp, Mus musculus
tcccttgtattaaagatccaaaagg

SEQ ID NO: 361218 - DNA, 25 bp, Mus musculus
tcccttgtattaaagggtatgatgt

SEQ ID NO: 361219 - DNA, 25 bp, Mus musculus
tccctttaaggcatcaatacttgtg

SEQ ID NO: 361220 - DNA, 25 bp, Mus musculus
tccctttaggagagaagatagagga

SEQ ID NO: 361221 - DNA, 25 bp, Mus musculus
tccctttcacttaaggtccttcaga

SEQ ID NO: 361222 - DNA, 25 bp, Mus musculus
tccctttctcaggtccaggtggagt

SEQ ID NO: 361223 - DNA, 25 bp, Mus musculus
tccctttgcgcacaggttacatcgg

SEQ ID NO: 361224 - DNA, 25 bp, Mus musculus
tccctttgcgcagaggttacatcgg

SEQ ID NO: 361225 - DNA, 25 bp, Mus musculus
tccctttgggttctcaggccgcctg

SEQ ID NO: 361226 - DNA, 25 bp, Mus musculus
tcccttttacttggcaagtccttgg

SEQ ID NO: 361227 - DNA, 25 bp, Mus musculus
tcccttttctgagtggtccaagccg

SEQ ID NO: 361228 - DNA, 25 bp, Mus musculus
tcccttttgcatggtaagaccagct

SEQ ID NO: 361229 - DNA, 25 bp, Mus musculus
tccgaaacactcagccctggcacca

SEQ ID NO: 361230 - DNA, 25 bp, Mus musculus
tccgaaagaactggaataagtgggc

SEQ ID NO: 361231 - DNA, 25 bp, Mus musculus
tccgaaagaagtggaataagtgggc

SEQ ID NO: 361232 - DNA, 25 bp, Mus musculus
tccgaaatcaggcagaagaggagct

SEQ ID NO: 361233 - DNA, 25 bp, Mus musculus
tccgaaatctgcttcttgcaggagc

SEQ ID NO: 361234 - DNA, 25 bp, Mus musculus
tccgaaatgagctggaattttggag

SEQ ID NO: 361235 - DNA, 25 bp, Mus musculus
tccgaacaacaaagaatctgaagca

SEQ ID NO: 361236 - DNA, 25 bp, Mus musculus
tccgaagaccaagcgctggaaggta

SEQ ID NO: 361237 - DNA, 25 bp, Mus musculus
tccgaagaccaagcggatctctttc

SEQ ID NO: 361238 - DNA, 25 bp, Mus musculus
tccgaagactgaaactgttatggtt

SEQ ID NO: 361239 - DNA, 25 bp, Mus musculus
tccgaagactgtcgctcctgtgcgg

SEQ ID NO: 361240 - DNA, 25 bp, Mus musculus
tccgaagatggaggagctggagtca

SEQ ID NO: 361241 - DNA, 25 bp, Mus musculus
tccgaagcaggctcctggagtccat

SEQ ID NO: 361242 - DNA, 25 bp, Mus musculus
tccgaagcccaagaaataaatcata

SEQ ID NO: 361243 - DNA, 25 bp, Mus musculus
tccgaagcgcctccctcttgatgtg

SEQ ID NO: 361244 - DNA, 25 bp, Mus musculus
tccgaagcgcggtcaacatggctgg

SEQ ID NO: 361245 - DNA, 25 bp, Mus musculus
tccgaagctcagccacgggggccgt

SEQ ID NO: 361246 - DNA, 25 bp, Mus musculus
tccgaaggagcaggttgatatgtca

SEQ ID NO: 361247 - DNA, 25 bp, Mus musculus
tccgaagggtccagggtctcaggtc

SEQ ID NO: 361248 - DNA, 25 bp, Mus musculus
tccgaagtcaagcctttcatcacct

SEQ ID NO: 361249 - DNA, 25 bp, Mus musculus
tccgaagtgaggggcttgcagatgg

SEQ ID NO: 361250 - DNA, 25 bp, Mus musculus
tccgaatagcagcttcttcggctgt

SEQ ID NO: 361251 - DNA, 25 bp, Mus musculus
tccgaatcctatacccacctgtctc

SEQ ID NO: 361252 - DNA, 25 bp, Mus musculus
tccgaatctttgagtgtgagaaact

SEQ ID NO: 361253 - DNA, 25 bp, Mus musculus
tccgaatttatgttgaaaaacattt

SEQ ID NO: 361254 - DNA, 25 bp, Mus musculus
tccgaatttcaagcccatctctcac

SEQ ID NO: 361255 - DNA, 25 bp, Mus musculus
tccgaatttcaaggggacgatttgg

SEQ ID NO: 361256 - DNA, 25 bp, Mus musculus
tccgaatttcaaggtctttaagtgg

SEQ ID NO: 361257 - DNA, 25 bp, Mus musculus
tccgacaaatgcaggaatgtgctaa

SEQ ID NO: 361258 - DNA, 25 bp, Mus musculus
tccgacaactggaggaagagcagtc

SEQ ID NO: 361259 - DNA, 25 bp, Mus musculus
tccgacaagagcctgaaacctgctt

SEQ ID NO: 361260 - DNA, 25 bp, Mus musculus
tccgacaagaggactactgcctttg

SEQ ID NO: 361261 - DNA, 25 bp, Mus musculus
tccgacaatgatagaccaaactgca

SEQ ID NO: 361262 - DNA, 25 bp, Mus musculus
tccgacaatgatagattcaaacacc

SEQ ID NO: 361263 - DNA, 25 bp, Mus musculus
tccgacatcgatcctgcagtagtaa

SEQ ID NO: 361264 - DNA, 25 bp, Mus musculus
tccgacatcggcagacagacacaaa

SEQ ID NO: 361265 - DNA, 25 bp, Mus musculus
tccgacatcgtgatccgggccaaag

SEQ ID NO: 361266 - DNA, 25 bp, Mus musculus
tccgacatggaggatgacttgaaag

SEQ ID NO: 361267 - DNA, 25 bp, Mus musculus
tccgacattccaacacttcaaactc

SEQ ID NO: 361268 - DNA, 25 bp, Mus musculus
tccgacattccaacgtgtccgatcc

SEQ ID NO: 361269 - DNA, 25 bp, Mus musculus
tccgaccattagccaagtccaggtg

SEQ ID NO: 361270 - DNA, 25 bp, Mus musculus
tccgacccacagatccctctagctg

SEQ ID NO: 361271 - DNA, 25 bp, Mus musculus
tccgacccaccacgggagccaggta

SEQ ID NO: 361272 - DNA, 25 bp, Mus musculus
tccgacccgggcaggagctgggagg

SEQ ID NO: 361273 - DNA, 25 bp, Mus musculus
tccgacccgttgatgtgacccggtt

SEQ ID NO: 361274 - DNA, 25 bp, Mus musculus
tccgaccggcctctctggaggaaat

SEQ ID NO: 361275 - DNA, 25 bp, Mus musculus
tccgacctgcacaagcaaaacctgg

SEQ ID NO: 361276 - DNA, 25 bp, Mus musculus
tccgacgcgcctttccctctggagc

SEQ ID NO: 361277 - DNA, 25 bp, Mus musculus
tccgacgcgcctttcctctctggag

SEQ ID NO: 361278 - DNA, 25 bp, Mus musculus
tccgacgcgcctttctccaccccag

SEQ ID NO: 361279 - DNA, 25 bp, Mus musculus
tccgacgctgacatggactgggctg

SEQ ID NO: 361280 - DNA, 25 bp, Mus musculus
tccgactaaatagctggaccacgtt

SEQ ID NO: 361281 - DNA, 25 bp, Mus musculus
tccgactacgggtggactatagtgg

SEQ ID NO: 361282 - DNA, 25 bp, Mus musculus
tccgactcagatcagctcgaacggg

SEQ ID NO: 361283 - DNA, 25 bp, Mus musculus
tccgactcagattctttatacaatt

SEQ ID NO: 361284 - DNA, 25 bp, Mus musculus
tccgactcttgaagaacatatcccc

SEQ ID NO: 361285 - DNA, 25 bp, Mus musculus
tccgactcttgaaggacatagatgc

SEQ ID NO: 361286 - DNA, 25 bp, Mus musculus
tccgacttctaggcgtgtgtataga

SEQ ID NO: 361287 - DNA, 25 bp, Mus musculus
tccgactttccactgcttaggctcg

SEQ ID NO: 361288 - DNA, 25 bp, Mus musculus
tccgagaaccagagggcacatctgc

SEQ ID NO: 361289 - DNA, 25 bp, Mus musculus
tccgagaaccagttgataaaattac

SEQ ID NO: 361290 - DNA, 25 bp, Mus musculus
tccgagaactgagtgaggccttgtt

SEQ ID NO: 361291 - DNA, 25 bp, Mus musculus
tccgagaagccagctggagattcac

SEQ ID NO: 361292 - DNA, 25 bp, Mus musculus
tccgagacagagacaaaatcacaaa

SEQ ID NO: 361293 - DNA, 25 bp, Mus musculus
tccgagacagattacttcgcaacct

SEQ ID NO: 361294 - DNA, 25 bp, Mus musculus
tccgagacatgatagaagcgatgga

SEQ ID NO: 361295 - DNA, 25 bp, Mus musculus
tccgagacatggagatcgagggcgc

SEQ ID NO: 361296 - DNA, 25 bp, Mus musculus
tccgagaccagacccctgagcagct

SEQ ID NO: 361297 - DNA, 25 bp, Mus musculus
tccgagacccaactgtcgacgcata

SEQ ID NO: 361298 - DNA, 25 bp, Mus musculus
tccgagaccccagtggtctctctgg

SEQ ID NO: 361299 - DNA, 25 bp, Mus musculus
tccgagagaagacacagctggtatg

SEQ ID NO: 361300 - DNA, 25 bp, Mus musculus
tccgagagaagaccaccaaggcctt

SEQ ID NO: 361301 - DNA, 25 bp, Mus musculus
tccgagagaaggtgggtgacatcac

SEQ ID NO: 361302 - DNA, 25 bp, Mus musculus
tccgagagacagaagattgtcacaa

SEQ ID NO: 361303 - DNA, 25 bp, Mus musculus
tccgagagagatacgctccttgctc

SEQ ID NO: 361304 - DNA, 25 bp, Mus musculus
tccgagagagcaagaaggagcagag

SEQ ID NO: 361305 - DNA, 25 bp, Mus musculus
tccgagagaggtgccgttctctgag

SEQ ID NO: 361306 - DNA, 25 bp, Mus musculus
tccgagagcaggtctgcctgggctt

SEQ ID NO: 361307 - DNA, 25 bp, Mus musculus
tccgagagcagtggccacagttaag

SEQ ID NO: 361308 - DNA, 25 bp, Mus musculus
tccgagaggtccaagagaacagaaa

SEQ ID NO: 361309 - DNA, 25 bp, Mus musculus
tccgagagtgctcccagaggttcct

SEQ ID NO: 361310 - DNA, 25 bp, Mus musculus
tccgagatctgctgcccaccaattc

SEQ ID NO: 361311 - DNA, 25 bp, Mus musculus
tccgagattctggacctgtgtttgg

SEQ ID NO: 361312 - DNA, 25 bp, Mus musculus
tccgagcagaagcaagccatacagg

SEQ ID NO: 361313 - DNA, 25 bp, Mus musculus
tccgagccaggacgagggatctgat

SEQ ID NO: 361314 - DNA, 25 bp, Mus musculus
tccgagccaggattgaaattccaag

SEQ ID NO: 361315 - DNA, 25 bp, Mus musculus
tccgagcctcatggttcggagcgac

SEQ ID NO: 361316 - DNA, 25 bp, Mus musculus
tccgagcgtacctgtgcccacatct

SEQ ID NO: 361317 - DNA, 25 bp, Mus musculus
tccgagctgaaacagggaccgcgtg

SEQ ID NO: 361318 - DNA, 25 bp, Mus musculus
tccgagctgatgtgtggagcctggc

SEQ ID NO: 361319 - DNA, 25 bp, Mus musculus
tccgaggacaatcgggtgatccagg

SEQ ID NO: 361320 - DNA, 25 bp, Mus musculus
tccgaggacagagccaccagccatg

SEQ ID NO: 361321 - DNA, 25 bp, Mus musculus
tccgaggacgactccttctatgaaa

SEQ ID NO: 361322 - DNA, 25 bp, Mus musculus
tccgaggactatgagaccaccatca

SEQ ID NO: 361323 - DNA, 25 bp, Mus musculus
tccgaggacttcaccatccacgaaa

SEQ ID NO: 361324 - DNA, 25 bp, Mus musculus
tccgaggagctaatcagtgagatga

SEQ ID NO: 361325 - DNA, 25 bp, Mus musculus
tccgaggagctaattctgaagtccc

SEQ ID NO: 361326 - DNA, 25 bp, Mus musculus
tccgaggcctacctcccttttgcta

SEQ ID NO: 361327 - DNA, 25 bp, Mus musculus
tccgaggcctatgttgatctaacca

SEQ ID NO: 361328 - DNA, 25 bp, Mus musculus
tccgaggccttcagaatctgaggaa

SEQ ID NO: 361329 - DNA, 25 bp, Mus musculus
tccgaggccttcaggtggttgagca

SEQ ID NO: 361330 - DNA, 25 bp, Mus musculus
tccgaggctgacaggtgagatctcc

SEQ ID NO: 361331 - DNA, 25 bp, Mus musculus
tccgagggcagctactgcaagacaa

SEQ ID NO: 361332 - DNA, 25 bp, Mus musculus
tccgagggcgggcggcgacagcagc

SEQ ID NO: 361333 - DNA, 25 bp, Mus musculus
tccgagggcggtggaggaacagacc

SEQ ID NO: 361334 - DNA, 25 bp, Mus musculus
tccgaggggcggagctacagagact

SEQ ID NO: 361335 - DNA, 25 bp, Mus musculus
tccgaggggcggatacagagactgc

SEQ ID NO: 361336 - DNA, 25 bp, Mus musculus
tccgaggtgcacagaggcataatca

SEQ ID NO: 361337 - DNA, 25 bp, Mus musculus
tccgaggttctgccgcaggagatgc

SEQ ID NO: 361338 - DNA, 25 bp, Mus musculus
tccgagtaatcctgtgtcttggttt

SEQ ID NO: 361339 - DNA, 25 bp, Mus musculus
tccgagtagtgtgtgacggaatgga

SEQ ID NO: 361340 - DNA, 25 bp, Mus musculus
tccgagtcagctacttcctgtgctg

SEQ ID NO: 361341 - DNA, 25 bp, Mus musculus
tccgagtcatcaagacttcataagg

SEQ ID NO: 361342 - DNA, 25 bp, Mus musculus
tccgagtcatcaaggtaaaccgaga

SEQ ID NO: 361343 - DNA, 25 bp, Mus musculus
tccgagtccccaagaacacagccaa

SEQ ID NO: 361344 - DNA, 25 bp, Mus musculus
tccgagtccccaagcacggctggag

SEQ ID NO: 361345 - DNA, 25 bp, Mus musculus
tccgagtcgctgatgagcgggaccg

SEQ ID NO: 361346 - DNA, 25 bp, Mus musculus
tccgagtctggatcatctctggaca

SEQ ID NO: 361347 - DNA, 25 bp, Mus musculus
tccgagttcaaggtcgcttctccga

SEQ ID NO: 361348 - DNA, 25 bp, Mus musculus
tccgatacaaaacaactgataaaag

SEQ ID NO: 361349 - DNA, 25 bp, Mus musculus
tccgataggcagagcagctccatca

SEQ ID NO: 361350 - DNA, 25 bp, Mus musculus
tccgataggcagaggtcagtaccat

SEQ ID NO: 361351 - DNA, 25 bp, Mus musculus
tccgatccaacagaccctcaggact

SEQ ID NO: 361352 - DNA, 25 bp, Mus musculus
tccgatccttaccagtgaggctgct

SEQ ID NO: 361353 - DNA, 25 bp, Mus musculus
tccgatgatgcgggagggaccttgt

SEQ ID NO: 361354 - DNA, 25 bp, Mus musculus
tccgatgatgcggggggcctggatc

SEQ ID NO: 361355 - DNA, 25 bp, Mus musculus
tccgatgatgcgggtttctccggct

SEQ ID NO: 361356 - DNA, 25 bp, Mus musculus
tccgatgccacctaggtttgaagac

SEQ ID NO: 361357 - DNA, 25 bp, Mus musculus
tccgatggcagaaacttgattgaac

SEQ ID NO: 361358 - DNA, 25 bp, Mus musculus
tccgatgtgacctctgccatgccat

SEQ ID NO: 361359 - DNA, 25 bp, Mus musculus
tccgatgtgtctgagctgtccagct

SEQ ID NO: 361360 - DNA, 25 bp, Mus musculus
tccgattagcagaagctcacgctcg

SEQ ID NO: 361361 - DNA, 25 bp, Mus musculus
tccgattcctaggggtgttattggg

SEQ ID NO: 361362 - DNA, 25 bp, Mus musculus
tccgatttgggacgaggacctatta

SEQ ID NO: 361363 - DNA, 25 bp, Mus musculus
tccgcaaaaggttcgaaccttcttc

SEQ ID NO: 361364 - DNA, 25 bp, Mus musculus
tccgcaaaaggttggaagcaatcgt

SEQ ID NO: 361365 - DNA, 25 bp, Mus musculus
tccgcaaacaaaaaatgcagagaga

SEQ ID NO: 361366 - DNA, 25 bp, Mus musculus
tccgcaacactgaccgaggcaatga

SEQ ID NO: 361367 - DNA, 25 bp, Mus musculus
tccgcaaccgatcacttgtggaaga

SEQ ID NO: 361368 - DNA, 25 bp, Mus musculus
tccgcaagctgccccccaagtgtcc

SEQ ID NO: 361369 - DNA, 25 bp, Mus musculus
tccgcaagctgtctgatcagtgcac

SEQ ID NO: 361370 - DNA, 25 bp, Mus musculus
tccgcaaggaaaggctcctagaagg

SEQ ID NO: 361371 - DNA, 25 bp, Mus musculus
tccgcaagggcaaggtgctggctca

SEQ ID NO: 361372 - DNA, 25 bp, Mus musculus
tccgcacagtcaaggagctgggcaa

SEQ ID NO: 361373 - DNA, 25 bp, Mus musculus
tccgcaccaacgttttgaggacttc

SEQ ID NO: 361374 - DNA, 25 bp, Mus musculus
tccgcaccacaggcaaatcctcctc

SEQ ID NO: 361375 - DNA, 25 bp, Mus musculus
tccgcaccagaggaacttctgcagg

SEQ ID NO: 361376 - DNA, 25 bp, Mus musculus
tccgcacccacactcgactgcagaa

SEQ ID NO: 361377 - DNA, 25 bp, Mus musculus
tccgcacccacactcgtgagaagcc

SEQ ID NO: 361378 - DNA, 25 bp, Mus musculus
tccgcacccacactggactgcagaa

SEQ ID NO: 361379 - DNA, 25 bp, Mus musculus
tccgcacccacactggtgagaagcc

SEQ ID NO: 361380 - DNA, 25 bp, Mus musculus
tccgcacctacctggcaggccatgg

SEQ ID NO: 361381 - DNA, 25 bp, Mus musculus
tccgcactgccaaggagtgtggggc

SEQ ID NO: 361382 - DNA, 25 bp, Mus musculus
tccgcactgccaaggtttcctgcct

SEQ ID NO: 361383 - DNA, 25 bp, Mus musculus
tccgcactgtgagaaggaggggatc

SEQ ID NO: 361384 - DNA, 25 bp, Mus musculus
tccgcagacaagatgccttggatga

SEQ ID NO: 361385 - DNA, 25 bp, Mus musculus
tccgcagacacccgctgtgagcgct

SEQ ID NO: 361386 - DNA, 25 bp, Mus musculus
tccgcagacaccttccgccaagaga

SEQ ID NO: 361387 - DNA, 25 bp, Mus musculus
tccgcagacccacaggaaacaccag

SEQ ID NO: 361388 - DNA, 25 bp, Mus musculus
tccgcagagacgagaacagagctga

SEQ ID NO: 361389 - DNA, 25 bp, Mus musculus
tccgcagagacgagctgacatccga

SEQ ID NO: 361390 - DNA, 25 bp, Mus musculus
tccgcagagcgacaggctccgtgaa

SEQ ID NO: 361391 - DNA, 25 bp, Mus musculus
tccgcagaggtcgcagcgtgagcat

SEQ ID NO: 361392 - DNA, 25 bp, Mus musculus
tccgcagcaagatcgaggagctgga

SEQ ID NO: 361393 - DNA, 25 bp, Mus musculus
tccgcagcaggatgagccggcaggt

SEQ ID NO: 361394 - DNA, 25 bp, Mus musculus
tccgcagcagtttacaatctgtatc

SEQ ID NO: 361395 - DNA, 25 bp, Mus musculus
tccgcagccagaggagtatctgatt

SEQ ID NO: 361396 - DNA, 25 bp, Mus musculus
tccgcagccagaggggctcggtctc

SEQ ID NO: 361397 - DNA, 25 bp, Mus musculus
tccgcagcccgaatcctattctatt

SEQ ID NO: 361398 - DNA, 25 bp, Mus musculus
tccgcagccgaggctcgcgctgtat

SEQ ID NO: 361399 - DNA, 25 bp, Mus musculus
tccgcagctctgcagccccatgtgc

SEQ ID NO: 361400 - DNA, 25 bp, Mus musculus
tccgcaggattgtagcctctatcac

SEQ ID NO: 361401 - DNA, 25 bp, Mus musculus
tccgcaggcggctcaaagacttgga

SEQ ID NO: 361402 - DNA, 25 bp, Mus musculus
tccgcagtacccaggacactgtggt

SEQ ID NO: 361403 - DNA, 25 bp, Mus musculus
tccgcagtgcccagacctgtgttac

SEQ ID NO: 361404 - DNA, 25 bp, Mus musculus
tccgcataacttcctgagaaggact

SEQ ID NO: 361405 - DNA, 25 bp, Mus musculus
tccgcatatgcgctggtggacgcag

SEQ ID NO: 361406 - DNA, 25 bp, Mus musculus
tccgcatatgcgctggttccagatg

SEQ ID NO: 361407 - DNA, 25 bp, Mus musculus
tccgcatcagacatggattgcagtg

SEQ ID NO: 361408 - DNA, 25 bp, Mus musculus
tccgcatcagaggaaggagatgact

SEQ ID NO: 361409 - DNA, 25 bp, Mus musculus
tccgcatccagaggatgctgcccag

SEQ ID NO: 361410 - DNA, 25 bp, Mus musculus
tccgcattgcagatgaacgagaccg

SEQ ID NO: 361411 - DNA, 25 bp, Mus musculus
tccgccaaatggactggaacttcct

SEQ ID NO: 361412 - DNA, 25 bp, Mus musculus
tccgccaagtggtttgctggtgctt

SEQ ID NO: 361413 - DNA, 25 bp, Mus musculus
tccgccaccaggccaaccatattct

SEQ ID NO: 361414 - DNA, 25 bp, Mus musculus
tccgccaccagggccagagcttgag

SEQ ID NO: 361415 - DNA, 25 bp, Mus musculus
tccgccacctgacaggtcacaacca

SEQ ID NO: 361416 - DNA, 25 bp, Mus musculus
tccgccagaagcctgcatccttagt

SEQ ID NO: 361417 - DNA, 25 bp, Mus musculus
tccgccagaggatccgtgaagaggt

SEQ ID NO: 361418 - DNA, 25 bp, Mus musculus
tccgccagagggacagtcggcccaa

SEQ ID NO: 361419 - DNA, 25 bp, Mus musculus
tccgccagagggtgcactattccaa

SEQ ID NO: 361420 - DNA, 25 bp, Mus musculus
tccgccagctcccggttgcttccta

SEQ ID NO: 361421 - DNA, 25 bp, Mus musculus
tccgccaggtctcagttgtggccga

SEQ ID NO: 361422 - DNA, 25 bp, Mus musculus
tccgccagtcaacaggagaagtttg

SEQ ID NO: 361423 - DNA, 25 bp, Mus musculus
tccgccatccacccggctgccaata

SEQ ID NO: 361424 - DNA, 25 bp, Mus musculus
tccgccatcgtaggtgccgatcccc

SEQ ID NO: 361425 - DNA, 25 bp, Mus musculus
tccgccatgacagatcagacctact

SEQ ID NO: 361426 - DNA, 25 bp, Mus musculus
tccgccatgctctgcgttgctgctc

SEQ ID NO: 361427 - DNA, 25 bp, Mus musculus
tccgcccaacaggcgctgtgaggtt

SEQ ID NO: 361428 - DNA, 25 bp, Mus musculus
tccgcccaacatgccaccttacacc

SEQ ID NO: 361429 - DNA, 25 bp, Mus musculus
tccgcccaagagctcaaagcccaag

SEQ ID NO: 361430 - DNA, 25 bp, Mus musculus
tccgcccaagttggtcacaatggca

SEQ ID NO: 361431 - DNA, 25 bp, Mus musculus
tccgcccacagagatgagccgccag

SEQ ID NO: 361432 - DNA, 25 bp, Mus musculus
tccgcccaggcaactgcgcagttcc

SEQ ID NO: 361433 - DNA, 25 bp, Mus musculus
tccgccccagaaaaaggagaagaaa

SEQ ID NO: 361434 - DNA, 25 bp, Mus musculus
tccgccccagaccctgttagaccag

SEQ ID NO: 361435 - DNA, 25 bp, Mus musculus
tccgccccgcacagtatcagaaatt

SEQ ID NO: 361436 - DNA, 25 bp, Mus musculus
tccgcccgaagccctattctgaaaa

SEQ ID NO: 361437 - DNA, 25 bp, Mus musculus
tccgcccgaagcttggtgaggtctg

SEQ ID NO: 361438 - DNA, 25 bp, Mus musculus
tccgcccgaaggttaacaagcctgc

SEQ ID NO: 361439 - DNA, 25 bp, Mus musculus
tccgcccgagatcatcagaaactag

SEQ ID NO: 361440 - DNA, 25 bp, Mus musculus
tccgccctgagaaatccagtaaacc

SEQ ID NO: 361441 - DNA, 25 bp, Mus musculus
tccgccctgagaggtcccgtaaacc

SEQ ID NO: 361442 - DNA, 25 bp, Mus musculus
tccgccgaccccgggatggcacacc

SEQ ID NO: 361443 - DNA, 25 bp, Mus musculus
tccgccgaccccgtgggctgttcat

SEQ ID NO: 361444 - DNA, 25 bp, Mus musculus
tccgccgccagctgggtggctttga

SEQ ID NO: 361445 - DNA, 25 bp, Mus musculus
tccgccgccgcaaccatcagcctga

SEQ ID NO: 361446 - DNA, 25 bp, Mus musculus
tccgccgcggcccagaattgtaaaa

SEQ ID NO: 361447 - DNA, 25 bp, Mus musculus
tccgccgcggcccaggttaaatgga

SEQ ID NO: 361448 - DNA, 25 bp, Mus musculus
tccgccgggagggttgatttcttca

SEQ ID NO: 361449 - DNA, 25 bp, Mus musculus
tccgccgggaggtcatggctgcagc

SEQ ID NO: 361450 - DNA, 25 bp, Mus musculus
tccgccggggcaaggtctgttcact

SEQ ID NO: 361451 - DNA, 25 bp, Mus musculus
tccgccgtgcccgtggtgtgccccc

SEQ ID NO: 361452 - DNA, 25 bp, Mus musculus
tccgcctacgtggcctataacattc

SEQ ID NO: 361453 - DNA, 25 bp, Mus musculus
tccgcctcacaggaacaaaaagttt

SEQ ID NO: 361454 - DNA, 25 bp, Mus musculus
tccgcctcagatggcagtcaaaact

SEQ ID NO: 361455 - DNA, 25 bp, Mus musculus
tccgcctcagtaccaaacgtctatg

SEQ ID NO: 361456 - DNA, 25 bp, Mus musculus
tccgcctccccgatcccgcccggag

SEQ ID NO: 361457 - DNA, 25 bp, Mus musculus
tccgcctgctggacagcgtgctgga

SEQ ID NO: 361458 - DNA, 25 bp, Mus musculus
tccgcctggggtgactgtcccagcc

SEQ ID NO: 361459 - DNA, 25 bp, Mus musculus
tccgccttcgccagttctcaggccg

SEQ ID NO: 361460 - DNA, 25 bp, Mus musculus
tccgcctttggcaactgcgagtgct

SEQ ID NO: 361461 - DNA, 25 bp, Mus musculus
tccgcctttggcactgtagctatct

SEQ ID NO: 361462 - DNA, 25 bp, Mus musculus
tccgcctttggcagtcagaccaagc

SEQ ID NO: 361463 - DNA, 25 bp, Mus musculus
tccgcgaatcggtgttgagaaactc

SEQ ID NO: 361464 - DNA, 25 bp, Mus musculus
tccgcgacagagactaggcctgaca

SEQ ID NO: 361465 - DNA, 25 bp, Mus musculus
tccgcgacaggcaggagactgaaca

SEQ ID NO: 361466 - DNA, 25 bp, Mus musculus
tccgcgacaggggtccctccaatct

SEQ ID NO: 361467 - DNA, 25 bp, Mus musculus
tccgcgacaggtcagggtatttctg

SEQ ID NO: 361468 - DNA, 25 bp, Mus musculus
tccgcgacctccgcaatttcaccga

SEQ ID NO: 361469 - DNA, 25 bp, Mus musculus
tccgcgacctccgcagctaggtaat

SEQ ID NO: 361470 - DNA, 25 bp, Mus musculus
tccgcgacgccggtgccttcgccgg

SEQ ID NO: 361471 - DNA, 25 bp, Mus musculus
tccgcgagccgcgaagccaaaaacg

SEQ ID NO: 361472 - DNA, 25 bp, Mus musculus
tccgcgagccgctggtgcacggcag

SEQ ID NO: 361473 - DNA, 25 bp, Mus musculus
tccgcgatggagaaaactttagaaa

SEQ ID NO: 361474 - DNA, 25 bp, Mus musculus
tccgcgatggagagagaaaaggaac

SEQ ID NO: 361475 - DNA, 25 bp, Mus musculus
tccgcgcacagcattagcagagaca

SEQ ID NO: 361476 - DNA, 25 bp, Mus musculus
tccgcgccaagaacatttaaaagat

SEQ ID NO: 361477 - DNA, 25 bp, Mus musculus
tccgcgccaggttcatcatttggaa

SEQ ID NO: 361478 - DNA, 25 bp, Mus musculus
tccgcgccgagaatcaagaacttaa

SEQ ID NO: 361479 - DNA, 25 bp, Mus musculus
tccgcgccgagattaaaagaaagtt

SEQ ID NO: 361480 - DNA, 25 bp, Mus musculus
tccgcgcctcgcagggctcaacata

SEQ ID NO: 361481 - DNA, 25 bp, Mus musculus
tccgcgctcgtgcaagttccctggc

SEQ ID NO: 361482 - DNA, 25 bp, Mus musculus
tccgcggagcaggctgccgactaca

SEQ ID NO: 361483 - DNA, 25 bp, Mus musculus
tccgcggagcagggtaaaggccggc

SEQ ID NO: 361484 - DNA, 25 bp, Mus musculus
tccgcggagcaggtctacaggctta

SEQ ID NO: 361485 - DNA, 25 bp, Mus musculus
tccgcggatcacgagtgaccgtctt

SEQ ID NO: 361486 - DNA, 25 bp, Mus musculus
tccgcggccgcaggcagcaggtgcc

SEQ ID NO: 361487 - DNA, 25 bp, Mus musculus
tccgcgggacggatttgatctactg

SEQ ID NO: 361488 - DNA, 25 bp, Mus musculus
tccgcgggacggggagaaagagaga

SEQ ID NO: 361489 - DNA, 25 bp, Mus musculus
tccgcgggctgaggaaatataagaa

SEQ ID NO: 361490 - DNA, 25 bp, Mus musculus
tccgcgggctggccctccaagacca

SEQ ID NO: 361491 - DNA, 25 bp, Mus musculus
tccgcggggactggacacctgggct

SEQ ID NO: 361492 - DNA, 25 bp, Mus musculus
tccgcggtgtgcatgttgaccccaa

SEQ ID NO: 361493 - DNA, 25 bp, Mus musculus
tccgcgtcccgcaggtcctgcatgt

SEQ ID NO: 361494 - DNA, 25 bp, Mus musculus
tccgcgtcgagatttggtgactgag

SEQ ID NO: 361495 - DNA, 25 bp, Mus musculus
tccgcgtgcggtttctagagcatct

SEQ ID NO: 361496 - DNA, 25 bp, Mus musculus
tccgcgtgggtgtcccagaaatttc

SEQ ID NO: 361497 - DNA, 25 bp, Mus musculus
tccgctacacccaagaatgtggcaa

SEQ ID NO: 361498 - DNA, 25 bp, Mus musculus
tccgctacacccaagcgagcctgtc

SEQ ID NO: 361499 - DNA, 25 bp, Mus musculus
tccgctcacgaaaggcaagctgaga

SEQ ID NO: 361500 - DNA, 25 bp, Mus musculus
tccgctcacgtgctacctgtcctcg

SEQ ID NO: 361501 - DNA, 25 bp, Mus musculus
tccgctccagtgcgactttactgga

SEQ ID NO: 361502 - DNA, 25 bp, Mus musculus
tccgctcccactgcttcacacaggc

SEQ ID NO: 361503 - DNA, 25 bp, Mus musculus
tccgctcccactggcatgctagtcc

SEQ ID NO: 361504 - DNA, 25 bp, Mus musculus
tccgctcccagaatggatgtaacca

SEQ ID NO: 361505 - DNA, 25 bp, Mus musculus
tccgctcccagaatgttatggctgc

SEQ ID NO: 361506 - DNA, 25 bp, Mus musculus
tccgctcctttgcagagcctgacca

SEQ ID NO: 361507 - DNA, 25 bp, Mus musculus
tccgctctccgaatcaagctataga

SEQ ID NO: 361508 - DNA, 25 bp, Mus musculus
tccgctgagaatatgtacttttctc

SEQ ID NO: 361509 - DNA, 25 bp, Mus musculus
tccgctgctgccatccctcaggccg

SEQ ID NO: 361510 - DNA, 25 bp, Mus musculus
tccgctggagaattccttctctgaa

SEQ ID NO: 361511 - DNA, 25 bp, Mus musculus
tccgctggagcccgagtggcaccag

SEQ ID NO: 361512 - DNA, 25 bp, Mus musculus
tccgctggagcccgatggttttcgg

SEQ ID NO: 361513 - DNA, 25 bp, Mus musculus
tccgcttaaaggactggacagacta

SEQ ID NO: 361514 - DNA, 25 bp, Mus musculus
tccgcttccgtgatgtgctaacgaa

SEQ ID NO: 361515 - DNA, 25 bp, Mus musculus
tccgcttcgggcagctgctgattca

SEQ ID NO: 361516 - DNA, 25 bp, Mus musculus
tccggaaaagtttgtcaaagacata

SEQ ID NO: 361517 - DNA, 25 bp, Mus musculus
tccggaaagggctctatcacggact

SEQ ID NO: 361518 - DNA, 25 bp, Mus musculus
tccggaaatggcactgtttttaggt

SEQ ID NO: 361519 - DNA, 25 bp, Mus musculus
tccggaaatgtgagcgggagaatgg

SEQ ID NO: 361520 - DNA, 25 bp, Mus musculus
tccggaacagcgcaggacccagaag

SEQ ID NO: 361521 - DNA, 25 bp, Mus musculus
tccggaaccagcctctgacctccag

SEQ ID NO: 361522 - DNA, 25 bp, Mus musculus
tccggaaccaggtgtcaccctgagg

SEQ ID NO: 361523 - DNA, 25 bp, Mus musculus
tccggaacctcaaagtcagtggcta

SEQ ID NO: 361524 - DNA, 25 bp, Mus musculus
tccggaactatcctgtggtctccat

SEQ ID NO: 361525 - DNA, 25 bp, Mus musculus
tccggaactcagatttcaactattg

SEQ ID NO: 361526 - DNA, 25 bp, Mus musculus
tccggaaggtgctgctggaggcccg

SEQ ID NO: 361527 - DNA, 25 bp, Mus musculus
tccggaagtaaggacaagaccagtg

SEQ ID NO: 361528 - DNA, 25 bp, Mus musculus
tccggaagttccagggatccttgtg

SEQ ID NO: 361529 - DNA, 25 bp, Mus musculus
tccggaagttccaggtctggaggct

SEQ ID NO: 361530 - DNA, 25 bp, Mus musculus
tccggaatacctaagctttctccag

SEQ ID NO: 361531 - DNA, 25 bp, Mus musculus
tccggaatacctaagtagtgttgga

SEQ ID NO: 361532 - DNA, 25 bp, Mus musculus
tccggaatttggaactcagggcggt

SEQ ID NO: 361533 - DNA, 25 bp, Mus musculus
tccggaatttgggctctggacctga

SEQ ID NO: 361534 - DNA, 25 bp, Mus musculus
tccggacacagaatatccagttatg

SEQ ID NO: 361535 - DNA, 25 bp, Mus musculus
tccggacagccagcccaggctatcc

SEQ ID NO: 361536 - DNA, 25 bp, Mus musculus
tccggacagccaggcctctggggac

SEQ ID NO: 361537 - DNA, 25 bp, Mus musculus
tccggaccagcaaagaaaaaatggc

SEQ ID NO: 361538 - DNA, 25 bp, Mus musculus
tccggaccatcacccttcagagtca

SEQ ID NO: 361539 - DNA, 25 bp, Mus musculus
tccggacctatgagtgtgatccaga

SEQ ID NO: 361540 - DNA, 25 bp, Mus musculus
tccggacggctcagaaaagggggat

SEQ ID NO: 361541 - DNA, 25 bp, Mus musculus
tccggacttggacaaacacagccag

SEQ ID NO: 361542 - DNA, 25 bp, Mus musculus
tccggacttggactgacctgaaaag

SEQ ID NO: 361543 - DNA, 25 bp, Mus musculus
tccggagaagacaaggttctttaac

SEQ ID NO: 361544 - DNA, 25 bp, Mus musculus
tccggagatcacagctgcacgagtt

SEQ ID NO: 361545 - DNA, 25 bp, Mus musculus
tccggagatcattataggtaaaagc

SEQ ID NO: 361546 - DNA, 25 bp, Mus musculus
tccggagcaccccagtgcccgaggc

SEQ ID NO: 361547 - DNA, 25 bp, Mus musculus
tccggagccagaatgacagccaaga

SEQ ID NO: 361548 - DNA, 25 bp, Mus musculus
tccggagccaggacaaagccaactt

SEQ ID NO: 361549 - DNA, 25 bp, Mus musculus
tccggagccagggctcagattcttt

SEQ ID NO: 361550 - DNA, 25 bp, Mus musculus
tccggagccaggtcatccacgcctg

SEQ ID NO: 361551 - DNA, 25 bp, Mus musculus
tccggagctgctctggttgaaggtt

SEQ ID NO: 361552 - DNA, 25 bp, Mus musculus
tccggagctggactgaacttttgaa

SEQ ID NO: 361553 - DNA, 25 bp, Mus musculus
tccggagctgtgaggaatgagttcc

SEQ ID NO: 361554 - DNA, 25 bp, Mus musculus
tccggagctgtgaggacagaaaata

SEQ ID NO: 361555 - DNA, 25 bp, Mus musculus
tccggaggaaagccatcatgttaag

SEQ ID NO: 361556 - DNA, 25 bp, Mus musculus
tccggaggaaaggatttctccatat

SEQ ID NO: 361557 - DNA, 25 bp, Mus musculus
tccggaggatcaagacgaaactgca

SEQ ID NO: 361558 - DNA, 25 bp, Mus musculus
tccggaggatcaagagttgaaagcg

SEQ ID NO: 361559 - DNA, 25 bp, Mus musculus
tccggagtcccaagtctccaggtgg

SEQ ID NO: 361560 - DNA, 25 bp, Mus musculus
tccggagtgaactgaagttgaaaag

SEQ ID NO: 361561 - DNA, 25 bp, Mus musculus
tccggagtgcggagggcgggggcag

SEQ ID NO: 361562 - DNA, 25 bp, Mus musculus
tccggagtgcggagggggcccccca

SEQ ID NO: 361563 - DNA, 25 bp, Mus musculus
tccggagttcgtgcctccggagcca

SEQ ID NO: 361564 - DNA, 25 bp, Mus musculus
tccggatccctccagcggaactggc

SEQ ID NO: 361565 - DNA, 25 bp, Mus musculus
tccggatccctccaggaggagcagg

SEQ ID NO: 361566 - DNA, 25 bp, Mus musculus
tccggatctgatcgtctgccgtagt

SEQ ID NO: 361567 - DNA, 25 bp, Mus musculus
tccggatcttccggccccggaagct

SEQ ID NO: 361568 - DNA, 25 bp, Mus musculus
tccggatgtggacgcctctgcccat

SEQ ID NO: 361569 - DNA, 25 bp, Mus musculus
tccggatgtggacgcttctgccaga

SEQ ID NO: 361570 - DNA, 25 bp, Mus musculus
tccggatgtggacggccgagctctg

SEQ ID NO: 361571 - DNA, 25 bp, Mus musculus
tccggattcagaaggacattaacga

SEQ ID NO: 361572 - DNA, 25 bp, Mus musculus
tccggcaaattaggtctgactttgt

SEQ ID NO: 361573 - DNA, 25 bp, Mus musculus
tccggcaccgccacacagacagatg

SEQ ID NO: 361574 - DNA, 25 bp, Mus musculus
tccggcaccggactttttcctaggg

SEQ ID NO: 361575 - DNA, 25 bp, Mus musculus
tccggcaccgggccatggcggactc

SEQ ID NO: 361576 - DNA, 25 bp, Mus musculus
tccggcacgccgttcggggtctaat

SEQ ID NO: 361577 - DNA, 25 bp, Mus musculus
tccggcagaacctgggccgcatgta

SEQ ID NO: 361578 - DNA, 25 bp, Mus musculus
tccggcagaagcgcctgtctcacgt

SEQ ID NO: 361579 - DNA, 25 bp, Mus musculus
tccggcagacagacagctggtggca

SEQ ID NO: 361580 - DNA, 25 bp, Mus musculus
tccggcagacagtgaagccagtctc

SEQ ID NO: 361581 - DNA, 25 bp, Mus musculus
tccggcagaggtatcgcatcctgaa

SEQ ID NO: 361582 - DNA, 25 bp, Mus musculus
tccggcaggctcagctgcaggctgt

SEQ ID NO: 361583 - DNA, 25 bp, Mus musculus
tccggcatccagtcctctctctggc

SEQ ID NO: 361584 - DNA, 25 bp, Mus musculus
tccggccaccggcaggggactttgt

SEQ ID NO: 361585 - DNA, 25 bp, Mus musculus
tccggccagacccggcatcaggaag

SEQ ID NO: 361586 - DNA, 25 bp, Mus musculus
tccggccaggacctagggaagggag

SEQ ID NO: 361587 - DNA, 25 bp, Mus musculus
tccggccatctcagctgtggtcctc

SEQ ID NO: 361588 - DNA, 25 bp, Mus musculus
tccggccatctcaggtgttcctgta

SEQ ID NO: 361589 - DNA, 25 bp, Mus musculus
tccggccatctcaggttgtactttc

SEQ ID NO: 361590 - DNA, 25 bp, Mus musculus
tccggccccgaaacgccagcgatgg

SEQ ID NO: 361591 - DNA, 25 bp, Mus musculus
tccggccctacgcagctcccacaga

SEQ ID NO: 361592 - DNA, 25 bp, Mus musculus
tccggccctacgcaggtcctgtcca

SEQ ID NO: 361593 - DNA, 25 bp, Mus musculus
tccggccgccaaggttcgcttatct

SEQ ID NO: 361594 - DNA, 25 bp, Mus musculus
tccggccggtcaagacagggtctta

SEQ ID NO: 361595 - DNA, 25 bp, Mus musculus
tccggccggtcaagagttataccct

SEQ ID NO: 361596 - DNA, 25 bp, Mus musculus
tccggccggtcaaggtgtaaactct

SEQ ID NO: 361597 - DNA, 25 bp, Mus musculus
tccggccggtcaagtgcacaaccct

SEQ ID NO: 361598 - DNA, 25 bp, Mus musculus
tccggcctcagggggctactccgtc

SEQ ID NO: 361599 - DNA, 25 bp, Mus musculus
tccggcctctttggaggctcatcca

SEQ ID NO: 361600 - DNA, 25 bp, Mus musculus
tccggcctctttggctgctgggaac

SEQ ID NO: 361601 - DNA, 25 bp, Mus musculus
tccggccttaatgggcaacgtggtt

SEQ ID NO: 361602 - DNA, 25 bp, Mus musculus
tccggcgagaaacagcaacattact

SEQ ID NO: 361603 - DNA, 25 bp, Mus musculus
tccggcgagaaacagcgtcatagca

SEQ ID NO: 361604 - DNA, 25 bp, Mus musculus
tccggcgagggctgtaaaaaatggt

SEQ ID NO: 361605 - DNA, 25 bp, Mus musculus
tccggcgcgcacagccgttgactac

SEQ ID NO: 361606 - DNA, 25 bp, Mus musculus
tccggcggaagcagtatccagcatg

SEQ ID NO: 361607 - DNA, 25 bp, Mus musculus
tccggcggaaggtcatgttagcggc

SEQ ID NO: 361608 - DNA, 25 bp, Mus musculus
tccggcggcagatgtgatggcacca

SEQ ID NO: 361609 - DNA, 25 bp, Mus musculus
tccggcggccgctacaaggtggggt

SEQ ID NO: 361610 - DNA, 25 bp, Mus musculus
tccggcggctggtcacctttgtatg

SEQ ID NO: 361611 - DNA, 25 bp, Mus musculus
tccggcgggcggcctcattgctccg

SEQ ID NO: 361612 - DNA, 25 bp, Mus musculus
tccggcgggcggtggtacaggatct

SEQ ID NO: 361613 - DNA, 25 bp, Mus musculus
tccggctcccgccagagctcaggcc

SEQ ID NO: 361614 - DNA, 25 bp, Mus musculus
tccggctcccgccagctcaaggtga

SEQ ID NO: 361615 - DNA, 25 bp, Mus musculus
tccggctcccgccaggagaatggtg

SEQ ID NO: 361616 - DNA, 25 bp, Mus musculus
tccggctctaaggccaaagatctca

SEQ ID NO: 361617 - DNA, 25 bp, Mus musculus
tccggctctggttggtcatgctgcc

SEQ ID NO: 361618 - DNA, 25 bp, Mus musculus
tccggctctgtgaagccgaggaagt

SEQ ID NO: 361619 - DNA, 25 bp, Mus musculus
tccggctcttcaagtacggggtaca

SEQ ID NO: 361620 - DNA, 25 bp, Mus musculus
tccggctgacgggctcctccccgac

SEQ ID NO: 361621 - DNA, 25 bp, Mus musculus
tccggctgcaagatgagcctggggc

SEQ ID NO: 361622 - DNA, 25 bp, Mus musculus
tccggctgcaagggttgttaaacat

SEQ ID NO: 361623 - DNA, 25 bp, Mus musculus
tccggctgtgggaggtgctgtggac

SEQ ID NO: 361624 - DNA, 25 bp, Mus musculus
tccggcttcgccatggtagcgatgg

SEQ ID NO: 361625 - DNA, 25 bp, Mus musculus
tccggcttgatagtgagattggcag

SEQ ID NO: 361626 - DNA, 25 bp, Mus musculus
tccgggaaaacaatatggctcctta

SEQ ID NO: 361627 - DNA, 25 bp, Mus musculus
tccgggaaaggattcagatattaaa

SEQ ID NO: 361628 - DNA, 25 bp, Mus musculus
tccgggaaagggctctcttgtgctt

SEQ ID NO: 361629 - DNA, 25 bp, Mus musculus
tccgggacaacgaggagaacatttg

SEQ ID NO: 361630 - DNA, 25 bp, Mus musculus
tccgggacactggacatcatcacca

SEQ ID NO: 361631 - DNA, 25 bp, Mus musculus
tccgggacactgggatcttccttga

SEQ ID NO: 361632 - DNA, 25 bp, Mus musculus
tccgggacagaggaccaggaggatg

SEQ ID NO: 361633 - DNA, 25 bp, Mus musculus
tccgggacagcaagaagttcctgtg

SEQ ID NO: 361634 - DNA, 25 bp, Mus musculus
tccgggaccgcctgatccggacact

SEQ ID NO: 361635 - DNA, 25 bp, Mus musculus
tccgggaccgcctggaggaggacat

SEQ ID NO: 361636 - DNA, 25 bp, Mus musculus
tccgggagaaggatcagtggtgaac

SEQ ID NO: 361637 - DNA, 25 bp, Mus musculus
tccgggagaaggtcctgggcaagtt

SEQ ID NO: 361638 - DNA, 25 bp, Mus musculus
tccgggagacaggcctctctttctg

SEQ ID NO: 361639 - DNA, 25 bp, Mus musculus
tccgggagatacttgatccttctta

SEQ ID NO: 361640 - DNA, 25 bp, Mus musculus
tccgggagatccccactccttcctc

SEQ ID NO: 361641 - DNA, 25 bp, Mus musculus
tccgggagcaggaggagccaagcaa

SEQ ID NO: 361642 - DNA, 25 bp, Mus musculus
tccgggagcaggaggagccaggagc

SEQ ID NO: 361643 - DNA, 25 bp, Mus musculus
tccgggagctggagtcctttggaac

SEQ ID NO: 361644 - DNA, 25 bp, Mus musculus
tccgggaggaactgcacgggcgcag

SEQ ID NO: 361645 - DNA, 25 bp, Mus musculus
tccgggatgcctgatcgtaccgaga

SEQ ID NO: 361646 - DNA, 25 bp, Mus musculus
tccgggattgtgctttgagcgctgc

SEQ ID NO: 361647 - DNA, 25 bp, Mus musculus
tccgggcagaccatggtgagcccat

SEQ ID NO: 361648 - DNA, 25 bp, Mus musculus
tccgggcagagcaggccaaggagat

SEQ ID NO: 361649 - DNA, 25 bp, Mus musculus
tccgggcagggatttcagccatggc

SEQ ID NO: 361650 - DNA, 25 bp, Mus musculus
tccgggccagagcctgagcctttgc

SEQ ID NO: 361651 - DNA, 25 bp, Mus musculus
tccgggccctgcaggaggacctggc

SEQ ID NO: 361652 - DNA, 25 bp, Mus musculus
tccgggccggaccgagaaagggcta

SEQ ID NO: 361653 - DNA, 25 bp, Mus musculus
tccgggccggaccgcacagagaatg

SEQ ID NO: 361654 - DNA, 25 bp, Mus musculus
tccgggctcacggagggaccaacat

SEQ ID NO: 361655 - DNA, 25 bp, Mus musculus
tccgggctcctgaggcatggagggg

SEQ ID NO: 361656 - DNA, 25 bp, Mus musculus
tccgggctcggaggtccctgaccct

SEQ ID NO: 361657 - DNA, 25 bp, Mus musculus
tccgggctgaggagccaacatgttg

SEQ ID NO: 361658 - DNA, 25 bp, Mus musculus
tccgggctgagtcaagtccatcatc

SEQ ID NO: 361659 - DNA, 25 bp, Mus musculus
tccggggaccaggagcttttccaga

SEQ ID NO: 361660 - DNA, 25 bp, Mus musculus
tccggggaccgaaagtctcctgctt

SEQ ID NO: 361661 - DNA, 25 bp, Mus musculus
tccggggacgagatgatttttgatc

SEQ ID NO: 361662 - DNA, 25 bp, Mus musculus
tccggggagagctaggtcacttgtc

SEQ ID NO: 361663 - DNA, 25 bp, Mus musculus
tccggggagagctagttgctgcttc

SEQ ID NO: 361664 - DNA, 25 bp, Mus musculus
tccggggccagtagagtatagaaat

SEQ ID NO: 361665 - DNA, 25 bp, Mus musculus
tccggggccagtaggtccaatcagc

SEQ ID NO: 361666 - DNA, 25 bp, Mus musculus
tccggggcttgcagaggcctacgtg

SEQ ID NO: 361667 - DNA, 25 bp, Mus musculus
tccgggggagccgagcactccgcca

SEQ ID NO: 361668 - DNA, 25 bp, Mus musculus
tccggggtctggacagcattcttct

SEQ ID NO: 361669 - DNA, 25 bp, Mus musculus
tccggggtctggtggtacttgactg

SEQ ID NO: 361670 - DNA, 25 bp, Mus musculus
tccggggttcatttgcatccctggc

SEQ ID NO: 361671 - DNA, 25 bp, Mus musculus
tccgggtaaagaggtgtatgcagtt

SEQ ID NO: 361672 - DNA, 25 bp, Mus musculus
tccgggtaactccaggccatccgaa

SEQ ID NO: 361673 - DNA, 25 bp, Mus musculus
tccgggtcatcaagggtcacgtgat

SEQ ID NO: 361674 - DNA, 25 bp, Mus musculus
tccgggtccaggcactttctaggta

SEQ ID NO: 361675 - DNA, 25 bp, Mus musculus
tccgggtgagtttgccaggcagtac

SEQ ID NO: 361676 - DNA, 25 bp, Mus musculus
tccgggtgtgaagggtgagagtggt

SEQ ID NO: 361677 - DNA, 25 bp, Mus musculus
tccggtaaagtgacaaaacataaag

SEQ ID NO: 361678 - DNA, 25 bp, Mus musculus
tccggtcactatgagtgaaacatct

SEQ ID NO: 361679 - DNA, 25 bp, Mus musculus
tccggtcactatggtgataaagtta

SEQ ID NO: 361680 - DNA, 25 bp, Mus musculus
tccggtcatgggagttagggagact

SEQ ID NO: 361681 - DNA, 25 bp, Mus musculus
tccggtcattaggttcaaccagatg

SEQ ID NO: 361682 - DNA, 25 bp, Mus musculus
tccggtccttttcatggttaatttc

SEQ ID NO: 361683 - DNA, 25 bp, Mus musculus
tccggtcgagatgaccggttcgaac

SEQ ID NO: 361684 - DNA, 25 bp, Mus musculus
tccggtctgaaccggctgattatga

SEQ ID NO: 361685 - DNA, 25 bp, Mus musculus
tccggtgaagaatgctatcagaagg

SEQ ID NO: 361686 - DNA, 25 bp, Mus musculus
tccggtgcaggctgactttttgggg

SEQ ID NO: 361687 - DNA, 25 bp, Mus musculus
tccggtgcaggctggttaccatggc

SEQ ID NO: 361688 - DNA, 25 bp, Mus musculus
tccggtgcccaggtctgggaacgta

SEQ ID NO: 361689 - DNA, 25 bp, Mus musculus
tccggtgccttgaaggaggggtcat

SEQ ID NO: 361690 - DNA, 25 bp, Mus musculus
tccggttatggtacaaattctgagc

SEQ ID NO: 361691 - DNA, 25 bp, Mus musculus
tccggttctcatcaagatcaatgaa

SEQ ID NO: 361692 - DNA, 25 bp, Mus musculus
tccggttctcatgctcctgtggctg

SEQ ID NO: 361693 - DNA, 25 bp, Mus musculus
tccggttgttgccgaatacaccaag

SEQ ID NO: 361694 - DNA, 25 bp, Mus musculus
tccggtttgcaagagtctttttggt

SEQ ID NO: 361695 - DNA, 25 bp, Mus musculus
tccggtttgcaagggcaaatggaaa

SEQ ID NO: 361696 - DNA, 25 bp, Mus musculus
tccggtttgcaggagagagggagct

SEQ ID NO: 361697 - DNA, 25 bp, Mus musculus
tccgtaaagttcgaggtcacgttca

SEQ ID NO: 361698 - DNA, 25 bp, Mus musculus
tccgtaggaagaagtccctctcgtg

SEQ ID NO: 361699 - DNA, 25 bp, Mus musculus
tccgtagtggtgctgacctggacag

SEQ ID NO: 361700 - DNA, 25 bp, Mus musculus
tccgtagtggtggtcttatgctgac

SEQ ID NO: 361701 - DNA, 25 bp, Mus musculus
tccgtatagaggaagcccagccctg

SEQ ID NO: 361702 - DNA, 25 bp, Mus musculus
tccgtatataagaagaccctatcta

SEQ ID NO: 361703 - DNA, 25 bp, Mus musculus
tccgtatataagaaggcactaaccc

SEQ ID NO: 361704 - DNA, 25 bp, Mus musculus
tccgtatccaggattccctggagat

SEQ ID NO: 361705 - DNA, 25 bp, Mus musculus
tccgtatgtggagaacgttgacaaa

SEQ ID NO: 361706 - DNA, 25 bp, Mus musculus
tccgtattataaccacagtggaaga

SEQ ID NO: 361707 - DNA, 25 bp, Mus musculus
tccgtattataacctcatcgtgttg

SEQ ID NO: 361708 - DNA, 25 bp, Mus musculus
tccgtattgtgcaggcatccagggt

SEQ ID NO: 361709 - DNA, 25 bp, Mus musculus
tccgtcagagaatgctgactttgca

SEQ ID NO: 361710 - DNA, 25 bp, Mus musculus
tccgtcagatgagccctaggaccat

SEQ ID NO: 361711 - DNA, 25 bp, Mus musculus
tccgtcataacgggcctgtgtgata

SEQ ID NO: 361712 - DNA, 25 bp, Mus musculus
tccgtcatgacgcaacttcggcaca

SEQ ID NO: 361713 - DNA, 25 bp, Mus musculus
tccgtccagaagaaaacacacgtga

SEQ ID NO: 361714 - DNA, 25 bp, Mus musculus
tccgtccagaagcccacagtcacca

SEQ ID NO: 361715 - DNA, 25 bp, Mus musculus
tccgtccagaagggtgaacctaagg

SEQ ID NO: 361716 - DNA, 25 bp, Mus musculus
tccgtccagagcctgtgcttgaggc

SEQ ID NO: 361717 - DNA, 25 bp, Mus musculus
tccgtccccagaacccgagccagaa

SEQ ID NO: 361718 - DNA, 25 bp, Mus musculus
tccgtcccccacacacctgctctca

SEQ ID NO: 361719 - DNA, 25 bp, Mus musculus
tccgtcccttcactggctcccacta

SEQ ID NO: 361720 - DNA, 25 bp, Mus musculus
tccgtcctacaaacctcatccagct

SEQ ID NO: 361721 - DNA, 25 bp, Mus musculus
tccgtcctgccgggagctcttacca

SEQ ID NO: 361722 - DNA, 25 bp, Mus musculus
tccgtcctggatactccatgtttcc

SEQ ID NO: 361723 - DNA, 25 bp, Mus musculus
tccgtcctttaggaaaggtatgctg

SEQ ID NO: 361724 - DNA, 25 bp, Mus musculus
tccgtcgaatgaaaacaagatgagc

SEQ ID NO: 361725 - DNA, 25 bp, Mus musculus
tccgtcgaatgaaactatccagcaa

SEQ ID NO: 361726 - DNA, 25 bp, Mus musculus
tccgtcgccatggctccagcacccg

SEQ ID NO: 361727 - DNA, 25 bp, Mus musculus
tccgtcgcttaccggtggaagcttg

SEQ ID NO: 361728 - DNA, 25 bp, Mus musculus
tccgtcgcttaccgttaccgcaggt

SEQ ID NO: 361729 - DNA, 25 bp, Mus musculus
tccgtcggaaccatggcttcccttt

SEQ ID NO: 361730 - DNA, 25 bp, Mus musculus
tccgtcgtgtacagtgacaccatct

SEQ ID NO: 361731 - DNA, 25 bp, Mus musculus
tccgtctatagccaagcagaagcaa

SEQ ID NO: 361732 - DNA, 25 bp, Mus musculus
tccgtctataggcggaacatgttcc

SEQ ID NO: 361733 - DNA, 25 bp, Mus musculus
tccgtctgtaagaatgacatacggc

SEQ ID NO: 361734 - DNA, 25 bp, Mus musculus
tccgtctttgcagtatggtggaacc

SEQ ID NO: 361735 - DNA, 25 bp, Mus musculus
tccgtgaaaaccaggcgactatctc

SEQ ID NO: 361736 - DNA, 25 bp, Mus musculus
tccgtgaaaactatggattccaaaa

SEQ ID NO: 361737 - DNA, 25 bp, Mus musculus
tccgtgaaaactatggtgacctgct

SEQ ID NO: 361738 - DNA, 25 bp, Mus musculus
tccgtgaaggaagaggctgtggccc

SEQ ID NO: 361739 - DNA, 25 bp, Mus musculus
tccgtgacagactcaaactagaaac

SEQ ID NO: 361740 - DNA, 25 bp, Mus musculus
tccgtgacaggccctttgaacggac

SEQ ID NO: 361741 - DNA, 25 bp, Mus musculus
tccgtgagaagtttatgcagcaccc

SEQ ID NO: 361742 - DNA, 25 bp, Mus musculus
tccgtgagtcagatgttccagccca

SEQ ID NO: 361743 - DNA, 25 bp, Mus musculus
tccgtgagtttttggagttagaaca

SEQ ID NO: 361744 - DNA, 25 bp, Mus musculus
tccgtgatcagaattgcatttgtaa

SEQ ID NO: 361745 - DNA, 25 bp, Mus musculus
tccgtgatcagttccgtatctactt

SEQ ID NO: 361746 - DNA, 25 bp, Mus musculus
tccgtgcagacacagatgacgctcc

SEQ ID NO: 361747 - DNA, 25 bp, Mus musculus
tccgtgccagacctcgcagtaactc

SEQ ID NO: 361748 - DNA, 25 bp, Mus musculus
tccgtgccagtaaccctgacctcag

SEQ ID NO: 361749 - DNA, 25 bp, Mus musculus
tccgtgccatcatggacatcgataa

SEQ ID NO: 361750 - DNA, 25 bp, Mus musculus
tccgtgcccacagcccaggctatat

SEQ ID NO: 361751 - DNA, 25 bp, Mus musculus
tccgtgcccgagtttcaggtgccat

SEQ ID NO: 361752 - DNA, 25 bp, Mus musculus
tccgtgcccgtatagattacatctc

SEQ ID NO: 361753 - DNA, 25 bp, Mus musculus
tccgtgcccgtataggcacgtcagc

SEQ ID NO: 361754 - DNA, 25 bp, Mus musculus
tccgtgccggcggcctcagcactct

SEQ ID NO: 361755 - DNA, 25 bp, Mus musculus
tccgtgcctctgagatcccgtttca

SEQ ID NO: 361756 - DNA, 25 bp, Mus musculus
tccgtgctcaaatgagaaaagttga

SEQ ID NO: 361757 - DNA, 25 bp, Mus musculus
tccgtgctcaagatcaaagaagaac

SEQ ID NO: 361758 - DNA, 25 bp, Mus musculus
tccgtgctgggggcagaatcctttc

SEQ ID NO: 361759 - DNA, 25 bp, Mus musculus
tccgtggacaacctggacagcttac

SEQ ID NO: 361760 - DNA, 25 bp, Mus musculus
tccgtggagatggagacattgatgg

SEQ ID NO: 361761 - DNA, 25 bp, Mus musculus
tccgtggagcgactatcctgggtgc

SEQ ID NO: 361762 - DNA, 25 bp, Mus musculus
tccgtggagggtacactagctcaga

SEQ ID NO: 361763 - DNA, 25 bp, Mus musculus
tccgtggcacggcaggattcacaga

SEQ ID NO: 361764 - DNA, 25 bp, Mus musculus
tccgtggccattgaggtgaggcaca

SEQ ID NO: 361765 - DNA, 25 bp, Mus musculus
tccgtggctgaggaggcagctgacc

SEQ ID NO: 361766 - DNA, 25 bp, Mus musculus
tccgtgggactctctgcgccctttg

SEQ ID NO: 361767 - DNA, 25 bp, Mus musculus
tccgtggggccaggcctcttaggta

SEQ ID NO: 361768 - DNA, 25 bp, Mus musculus
tccgtgggtgtgtgaaatgcactta

SEQ ID NO: 361769 - DNA, 25 bp, Mus musculus
tccgtgggtgtgtggactgtgcagc

SEQ ID NO: 361770 - DNA, 25 bp, Mus musculus
tccgtgtagaggagcaggcgagcag

SEQ ID NO: 361771 - DNA, 25 bp, Mus musculus
tccgtgtcctctgatgctgaggaat

SEQ ID NO: 361772 - DNA, 25 bp, Mus musculus
tccgtgtcctctgcctgttccagtt

SEQ ID NO: 361773 - DNA, 25 bp, Mus musculus
tccgtgtctttatctgcatcccctg

SEQ ID NO: 361774 - DNA, 25 bp, Mus musculus
tccgtgtgaaagatacttggtaacg

SEQ ID NO: 361775 - DNA, 25 bp, Mus musculus
tccgtgtttctcagctcagaggctg

SEQ ID NO: 361776 - DNA, 25 bp, Mus musculus
tccgtgtttgccgggtgtaatggat

SEQ ID NO: 361777 - DNA, 25 bp, Mus musculus
tccgttaaaggtcacacaactggcc

SEQ ID NO: 361778 - DNA, 25 bp, Mus musculus
tccgttatcatgaacacggctctag

SEQ ID NO: 361779 - DNA, 25 bp, Mus musculus
tccgttatcatgtttgatttgacag

SEQ ID NO: 361780 - DNA, 25 bp, Mus musculus
tccgttcaaaggtctcaacatggtt

SEQ ID NO: 361781 - DNA, 25 bp, Mus musculus
tccgttctctgggttaccacagtgg

SEQ ID NO: 361782 - DNA, 25 bp, Mus musculus
tccgttggcagaagccatcccgatg

SEQ ID NO: 361783 - DNA, 25 bp, Mus musculus
tccgttgttcaagtcagaaaccaaa

SEQ ID NO: 361784 - DNA, 25 bp, Mus musculus
tccgtttacaggtgctgggcgttac

SEQ ID NO: 361785 - DNA, 25 bp, Mus musculus
tccgtttacaggtggtggtcgctat

SEQ ID NO: 361786 - DNA, 25 bp, Mus musculus
tccgtttagatcagctgaagcttgc

SEQ ID NO: 361787 - DNA, 25 bp, Mus musculus
tccgtttccgaggctcagtactatg

SEQ ID NO: 361788 - DNA, 25 bp, Mus musculus
tccgtttggggcggcaacctttggc

SEQ ID NO: 361789 - DNA, 25 bp, Mus musculus
tccgtttggggctacgccttctacg

SEQ ID NO: 361790 - DNA, 25 bp, Mus musculus
tcctaaaaaaagactgggctatatg

SEQ ID NO: 361791 - DNA, 25 bp, Mus musculus
tcctaaaaaaagtgccgtgatgccg

SEQ ID NO: 361792 - DNA, 25 bp, Mus musculus
tcctaaaaaagagaacgcaccagga

SEQ ID NO: 361793 - DNA, 25 bp, Mus musculus
tcctaaaagaagtcgttccccatca

SEQ ID NO: 361794 - DNA, 25 bp, Mus musculus
tcctaaaatcccttgctaacagaga

SEQ ID NO: 361795 - DNA, 25 bp, Mus musculus
tcctaaacatctgtggatggatgga

SEQ ID NO: 361796 - DNA, 25 bp, Mus musculus
tcctaaacccagctggtgccagctt

SEQ ID NO: 361797 - DNA, 25 bp, Mus musculus
tcctaaactttccacatctacatcc

SEQ ID NO: 361798 - DNA, 25 bp, Mus musculus
tcctaaagagactaagccccagtct

SEQ ID NO: 361799 - DNA, 25 bp, Mus musculus
tcctaaaggatatgttcgcacaact

SEQ ID NO: 361800 - DNA, 25 bp, Mus musculus
tcctaaatcagctgctgaaatcgtc

SEQ ID NO: 361801 - DNA, 25 bp, Mus musculus
tcctaaatcaggtcatggtttttac

SEQ ID NO: 361802 - DNA, 25 bp, Mus musculus
tcctaaatgtgttgcaacagaccaa

SEQ ID NO: 361803 - DNA, 25 bp, Mus musculus
tcctaaatttaagtatgcagtactg

SEQ ID NO: 361804 - DNA, 25 bp, Mus musculus
tcctaacccagaacatgtttgggat

SEQ ID NO: 361805 - DNA, 25 bp, Mus musculus
tcctaacccagttccgcagaggacg

SEQ ID NO: 361806 - DNA, 25 bp, Mus musculus
tcctaaccgcgttggctctcccagc

SEQ ID NO: 361807 - DNA, 25 bp, Mus musculus
tcctaaccgtacctggtctgacaga

SEQ ID NO: 361808 - DNA, 25 bp, Mus musculus
tcctaacgagaatgtcatacccagg

SEQ ID NO: 361809 - DNA, 25 bp, Mus musculus
tcctaactcaggtgaggcacagagt

SEQ ID NO: 361810 - DNA, 25 bp, Mus musculus
tcctaacttgtccatggaggtcttc

SEQ ID NO: 361811 - DNA, 25 bp, Mus musculus
tcctaacttgtccattttgttgcat

SEQ ID NO: 361812 - DNA, 25 bp, Mus musculus
tcctaacttttagtcacagaaaaga

SEQ ID NO: 361813 - DNA, 25 bp, Mus musculus
tcctaagaaaccatcaagaagcgtc

SEQ ID NO: 361814 - DNA, 25 bp, Mus musculus
tcctaagaaacgcaggctccagctg

SEQ ID NO: 361815 - DNA, 25 bp, Mus musculus
tcctaagaagacccagcactacttc

SEQ ID NO: 361816 - DNA, 25 bp, Mus musculus
tcctaagaaggccacagacccagca

SEQ ID NO: 361817 - DNA, 25 bp, Mus musculus
tcctaagcaaaaggctgaggagctg

SEQ ID NO: 361818 - DNA, 25 bp, Mus musculus
tcctaagccaacatgccatatgaac

SEQ ID NO: 361819 - DNA, 25 bp, Mus musculus
tcctaaggaagcacctcccttacag

SEQ ID NO: 361820 - DNA, 25 bp, Mus musculus
tcctaaggaaggctcagagaaataa

SEQ ID NO: 361821 - DNA, 25 bp, Mus musculus
tcctaaggaagggtacctggaatgg

SEQ ID NO: 361822 - DNA, 25 bp, Mus musculus
tcctaaggaatgggtattggcttgc

SEQ ID NO: 361823 - DNA, 25 bp, Mus musculus
tcctaagtcgaaagagttataccct

SEQ ID NO: 361824 - DNA, 25 bp, Mus musculus
tcctaagtgcaaagaatggctacat

SEQ ID NO: 361825 - DNA, 25 bp, Mus musculus
tcctaagtgcaaagagagacaggaa

SEQ ID NO: 361826 - DNA, 25 bp, Mus musculus
tcctaatatcacagaacagcacttc

SEQ ID NO: 361827 - DNA, 25 bp, Mus musculus
tcctaatccgggagctttctccaga

SEQ ID NO: 361828 - DNA, 25 bp, Mus musculus
tcctaatctttgaggcctgcagcat

SEQ ID NO: 361829 - DNA, 25 bp, Mus musculus
tcctaatctttgagggaaccaatga

SEQ ID NO: 361830 - DNA, 25 bp, Mus musculus
tcctaatggagccatctttaaatcc

SEQ ID NO: 361831 - DNA, 25 bp, Mus musculus
tcctaatggaggtaattttgggagg

SEQ ID NO: 361832 - DNA, 25 bp, Mus musculus
tcctaatttcttggggcgctttcat

SEQ ID NO: 361833 - DNA, 25 bp, Mus musculus
tcctaatttcttggtgaatgaactc

SEQ ID NO: 361834 - DNA, 25 bp, Mus musculus
tcctacaaaaggtgtggcgtggcac

SEQ ID NO: 361835 - DNA, 25 bp, Mus musculus
tcctacaagttggtcagtgaaatgg

SEQ ID NO: 361836 - DNA, 25 bp, Mus musculus
tcctacaatgatgatgtgctgacta

SEQ ID NO: 361837 - DNA, 25 bp, Mus musculus
tcctacacaaaaagctgttcagcag

SEQ ID NO: 361838 - DNA, 25 bp, Mus musculus
tcctacacgtcaaagaagtcttcta

SEQ ID NO: 361839 - DNA, 25 bp, Mus musculus
tcctacacgtcaaagacctaactac

SEQ ID NO: 361840 - DNA, 25 bp, Mus musculus
tcctacactgggctcctccaccaca

SEQ ID NO: 361841 - DNA, 25 bp, Mus musculus
tcctacactggtgacaagacgagct

SEQ ID NO: 361842 - DNA, 25 bp, Mus musculus
tcctacagagtctcagcctactgag

SEQ ID NO: 361843 - DNA, 25 bp, Mus musculus
tcctacagagtctcaggtggtccac

SEQ ID NO: 361844 - DNA, 25 bp, Mus musculus
tcctacaggacaagaatgccctgga

SEQ ID NO: 361845 - DNA, 25 bp, Mus musculus
tcctacaggacaagctaagcattga

SEQ ID NO: 361846 - DNA, 25 bp, Mus musculus
tcctacagttgcaggcatcccacaa

SEQ ID NO: 361847 - DNA, 25 bp, Mus musculus
tcctacattgtcttgctgagtatcc

SEQ ID NO: 361848 - DNA, 25 bp, Mus musculus
tcctaccaaagtcttgtgatttgaa

SEQ ID NO: 361849 - DNA, 25 bp, Mus musculus
tcctaccacagggtctgtaccaaaa

SEQ ID NO: 361850 - DNA, 25 bp, Mus musculus
tcctaccacggctcgccagaggcct

SEQ ID NO: 361851 - DNA, 25 bp, Mus musculus
tcctaccacggctctacttccccac

SEQ ID NO: 361852 - DNA, 25 bp, Mus musculus
tcctaccactgacaaagtctcccct

SEQ ID NO: 361853 - DNA, 25 bp, Mus musculus
tcctaccagcctgtggaatagtcac

SEQ ID NO: 361854 - DNA, 25 bp, Mus musculus
tcctaccagcctgtgggtccgaagc

SEQ ID NO: 361855 - DNA, 25 bp, Mus musculus
tcctaccagcggagcatgcacgcct

SEQ ID NO: 361856 - DNA, 25 bp, Mus musculus
tcctaccagcggagggtttctctgt

SEQ ID NO: 361857 - DNA, 25 bp, Mus musculus
tcctacccatgttcctgaatgtgtt

SEQ ID NO: 361858 - DNA, 25 bp, Mus musculus
tcctacccgcagacagacgtgttct

SEQ ID NO: 361859 - DNA, 25 bp, Mus musculus
tcctacccgcagacagttggagaca

SEQ ID NO: 361860 - DNA, 25 bp, Mus musculus
tcctaccctcctatgtgctcccaag

SEQ ID NO: 361861 - DNA, 25 bp, Mus musculus
tcctacctacggtgactctggcacc

SEQ ID NO: 361862 - DNA, 25 bp, Mus musculus
tcctacctccagactttggttctga

SEQ ID NO: 361863 - DNA, 25 bp, Mus musculus
tcctacctccagaggttggcgattt

SEQ ID NO: 361864 - DNA, 25 bp, Mus musculus
tcctacctccagatttaggtcgctc

SEQ ID NO: 361865 - DNA, 25 bp, Mus musculus
tcctacctccaggcacttagcgcta

SEQ ID NO: 361866 - DNA, 25 bp, Mus musculus
tcctacctccagtacctcactgtgg

SEQ ID NO: 361867 - DNA, 25 bp, Mus musculus
tcctacctgaagagcaccaagctgt

SEQ ID NO: 361868 - DNA, 25 bp, Mus musculus
tcctacctgtgaaaagatcatctgt

SEQ ID NO: 361869 - DNA, 25 bp, Mus musculus
tcctacctgtgaaaatggctctgga

SEQ ID NO: 361870 - DNA, 25 bp, Mus musculus
tcctaccttgacgtcccacacttgc

SEQ ID NO: 361871 - DNA, 25 bp, Mus musculus
tcctacgaagattatacagacacgc

SEQ ID NO: 361872 - DNA, 25 bp, Mus musculus
tcctacgagcagcgggtgctgacgg

SEQ ID NO: 361873 - DNA, 25 bp, Mus musculus
tcctacgagcagggctgtgcgatag

SEQ ID NO: 361874 - DNA, 25 bp, Mus musculus
tcctacgagtccgaaaggcaagagc

SEQ ID NO: 361875 - DNA, 25 bp, Mus musculus
tcctacgtcctgcagagcgacgttt

SEQ ID NO: 361876 - DNA, 25 bp, Mus musculus
tcctactactgctcccagggctgtg

SEQ ID NO: 361877 - DNA, 25 bp, Mus musculus
tcctactagaaacagaaaattcatt

SEQ ID NO: 361878 - DNA, 25 bp, Mus musculus
tcctactagggagagactctacagg

SEQ ID NO: 361879 - DNA, 25 bp, Mus musculus
tcctactcttgtatgtcttcgtgga

SEQ ID NO: 361880 - DNA, 25 bp, Mus musculus
tcctactggaaggtacccagggcat

SEQ ID NO: 361881 - DNA, 25 bp, Mus musculus
tcctacttaccatggcattgatatg

SEQ ID NO: 361882 - DNA, 25 bp, Mus musculus
tcctacttaccatgggaaggtgtct

SEQ ID NO: 361883 - DNA, 25 bp, Mus musculus
tcctacttaccatgggcttcactgt

SEQ ID NO: 361884 - DNA, 25 bp, Mus musculus
tcctacttcaagggccaacggcaga

SEQ ID NO: 361885 - DNA, 25 bp, Mus musculus
tcctacttccagaacatttaaaaga

SEQ ID NO: 361886 - DNA, 25 bp, Mus musculus
tcctacttcttcagctgcagtgttg

SEQ ID NO: 361887 - DNA, 25 bp, Mus musculus
tcctacttcttcagttaccctgcag

SEQ ID NO: 361888 - DNA, 25 bp, Mus musculus
tcctacttggttcggtacatgggct

SEQ ID NO: 361889 - DNA, 25 bp, Mus musculus
tcctagaaatatagctcccgttact

SEQ ID NO: 361890 - DNA, 25 bp, Mus musculus
tcctagaaatgacttctgaataagt

SEQ ID NO: 361891 - DNA, 25 bp, Mus musculus
tcctagaaatgcagaccaggaatcc

SEQ ID NO: 361892 - DNA, 25 bp, Mus musculus
tcctagaaatgccttctccctagca

SEQ ID NO: 361893 - DNA, 25 bp, Mus musculus
tcctagaacaggccttcgatatgaa

SEQ ID NO: 361894 - DNA, 25 bp, Mus musculus
tcctagaagcctggcaaaatgaagg

SEQ ID NO: 361895 - DNA, 25 bp, Mus musculus
tcctagaagggaggtggtgtggtct

SEQ ID NO: 361896 - DNA, 25 bp, Mus musculus
tcctagacacacagcccatcctcag

SEQ ID NO: 361897 - DNA, 25 bp, Mus musculus
tcctagacagacaaagtttctctgt

SEQ ID NO: 361898 - DNA, 25 bp, Mus musculus
tcctagacagtgttcctaggatccc

SEQ ID NO: 361899 - DNA, 25 bp, Mus musculus
tcctagctgactatgctcactcttt

SEQ ID NO: 361900 - DNA, 25 bp, Mus musculus
tcctagctgggctatggagttactg

SEQ ID NO: 361901 - DNA, 25 bp, Mus musculus
tcctagctggggatttgtatacatc

SEQ ID NO: 361902 - DNA, 25 bp, Mus musculus
tcctaggaagaggatgtacatgctg

SEQ ID NO: 361903 - DNA, 25 bp, Mus musculus
tcctaggaagccagtgacgccaaga

SEQ ID NO: 361904 - DNA, 25 bp, Mus musculus
tcctaggacagggcttcgcctctat

SEQ ID NO: 361905 - DNA, 25 bp, Mus musculus
tcctaggagctgggcttgcaggcaa

SEQ ID NO: 361906 - DNA, 25 bp, Mus musculus
tcctaggagggagcctccctgtgaa

SEQ ID NO: 361907 - DNA, 25 bp, Mus musculus
tcctaggatctacaggtgaaagagc

SEQ ID NO: 361908 - DNA, 25 bp, Mus musculus
tcctaggatggtggcccagatgatg

SEQ ID NO: 361909 - DNA, 25 bp, Mus musculus
tcctaggcaaggtgctgatagtctg

SEQ ID NO: 361910 - DNA, 25 bp, Mus musculus
tcctaggccagtctccctatgagcg

SEQ ID NO: 361911 - DNA, 25 bp, Mus musculus
tcctagggacaagtcactgttctgg

SEQ ID NO: 361912 - DNA, 25 bp, Mus musculus
tcctaggggtggcgaccgtgctgtg

SEQ ID NO: 361913 - DNA, 25 bp, Mus musculus
tcctaggggtggtgacgtgctgtgt

SEQ ID NO: 361914 - DNA, 25 bp, Mus musculus
tcctaggtgcaggcagtctaaagtc

SEQ ID NO: 361915 - DNA, 25 bp, Mus musculus
tcctaggtgccagattgacgtgttg

SEQ ID NO: 361916 - DNA, 25 bp, Mus musculus
tcctaggtgccaggttggctgatgt

SEQ ID NO: 361917 - DNA, 25 bp, Mus musculus
tcctagtccaattcaggttattgaa

SEQ ID NO: 361918 - DNA, 25 bp, Mus musculus
tcctagtgagcttgtccaggtgact

SEQ ID NO: 361919 - DNA, 25 bp, Mus musculus
tcctagtgtctgccagatctgtggc

SEQ ID NO: 361920 - DNA, 25 bp, Mus musculus
tcctagtgtctgccattgcaggatc

SEQ ID NO: 361921 - DNA, 25 bp, Mus musculus
tcctataacaggataacataaatgt

SEQ ID NO: 361922 - DNA, 25 bp, Mus musculus
tcctataatgttgtgatgacgacct

SEQ ID NO: 361923 - DNA, 25 bp, Mus musculus
tcctatacacaaccagtttccgttc

SEQ ID NO: 361924 - DNA, 25 bp, Mus musculus
tcctatagcagggtctacctgctgt

SEQ ID NO: 361925 - DNA, 25 bp, Mus musculus
tcctataggcaaaggttctgcctca

SEQ ID NO: 361926 - DNA, 25 bp, Mus musculus
tcctatagtggactcgggagggcag

SEQ ID NO: 361927 - DNA, 25 bp, Mus musculus
tcctatataagtaactttgaaacag

SEQ ID NO: 361928 - DNA, 25 bp, Mus musculus
tcctatataagtggtaagccaaaag

SEQ ID NO: 361929 - DNA, 25 bp, Mus musculus
tcctatataggtgacagtggaagat

SEQ ID NO: 361930 - DNA, 25 bp, Mus musculus
tcctatatcatagcaagaggaggca

SEQ ID NO: 361931 - DNA, 25 bp, Mus musculus
tcctatcaagaggcaggaagcgatc

SEQ ID NO: 361932 - DNA, 25 bp, Mus musculus
tcctatcaaggctcatcagcaggac

SEQ ID NO: 361933 - DNA, 25 bp, Mus musculus
tcctatcattaagcaaagcactatt

SEQ ID NO: 361934 - DNA, 25 bp, Mus musculus
tcctatcctatgaaggtggtatgtc

SEQ ID NO: 361935 - DNA, 25 bp, Mus musculus
tcctatcctggtgctactaaaattt

SEQ ID NO: 361936 - DNA, 25 bp, Mus musculus
tcctatctaatgatgctttcagact

SEQ ID NO: 361937 - DNA, 25 bp, Mus musculus
tcctatctaatgatggaacatgtct

SEQ ID NO: 361938 - DNA, 25 bp, Mus musculus
tcctatctatatggcaccagaggtc

SEQ ID NO: 361939 - DNA, 25 bp, Mus musculus
tcctatgaagagaagagccttgttg

SEQ ID NO: 361940 - DNA, 25 bp, Mus musculus
tcctatgaagcccacattcagtgtc

SEQ ID NO: 361941 - DNA, 25 bp, Mus musculus
tcctatgaaggaagagcagcatgcc

SEQ ID NO: 361942 - DNA, 25 bp, Mus musculus
tcctatgaaggtggtatgtccgtgt

SEQ ID NO: 361943 - DNA, 25 bp, Mus musculus
tcctatgaatctgttgatgacatta

SEQ ID NO: 361944 - DNA, 25 bp, Mus musculus
tcctatgagactatggcaggggcag

SEQ ID NO: 361945 - DNA, 25 bp, Mus musculus
tcctatgatcgtcatcttcttcctg

SEQ ID NO: 361946 - DNA, 25 bp, Mus musculus
tcctatgcagaagaagtactacaag

SEQ ID NO: 361947 - DNA, 25 bp, Mus musculus
tcctatgcgaagcagatttatggtc

SEQ ID NO: 361948 - DNA, 25 bp, Mus musculus
tcctatgcgaagcagggtgtgcaga

SEQ ID NO: 361949 - DNA, 25 bp, Mus musculus
tcctatgctccttggctgaaccttc

SEQ ID NO: 361950 - DNA, 25 bp, Mus musculus
tcctatgctctcttcattctcatac

SEQ ID NO: 361951 - DNA, 25 bp, Mus musculus
tcctatggaccaaggtgttggggcc

SEQ ID NO: 361952 - DNA, 25 bp, Mus musculus
tcctatggaccagggatttaaaatc

SEQ ID NO: 361953 - DNA, 25 bp, Mus musculus
tcctatggctggaggaatctgcgaa

SEQ ID NO: 361954 - DNA, 25 bp, Mus musculus
tcctatgtagctcagaatgtgaagc

SEQ ID NO: 361955 - DNA, 25 bp, Mus musculus
tcctatgtagctcaggttcccctcc

SEQ ID NO: 361956 - DNA, 25 bp, Mus musculus
tcctatgtcaaaacctgggcaagat

SEQ ID NO: 361957 - DNA, 25 bp, Mus musculus
tcctattacaccgggtgaacctgaa

SEQ ID NO: 361958 - DNA, 25 bp, Mus musculus
tcctattacttgaagctggctaaga

SEQ ID NO: 361959 - DNA, 25 bp, Mus musculus
tcctattacttgtcccaaaggaagc

SEQ ID NO: 361960 - DNA, 25 bp, Mus musculus
tcctattcagaccctcagtgctcac

SEQ ID NO: 361961 - DNA, 25 bp, Mus musculus
tcctattcaggccatgtggctgggc

SEQ ID NO: 361962 - DNA, 25 bp, Mus musculus
tcctattccagtatcattttgcctg

SEQ ID NO: 361963 - DNA, 25 bp, Mus musculus
tcctatttgtgggattgttcatcac

SEQ ID NO: 361964 - DNA, 25 bp, Mus musculus
tcctcaaacaagaaaaagagaaaag

SEQ ID NO: 361965 - DNA, 25 bp, Mus musculus
tcctcaaacaagaagaatcctgttg

SEQ ID NO: 361966 - DNA, 25 bp, Mus musculus
tcctcaaacaaggcaccaaggagag

SEQ ID NO: 361967 - DNA, 25 bp, Mus musculus
tcctcaaacccctcatctccccggc

SEQ ID NO: 361968 - DNA, 25 bp, Mus musculus
tcctcaaactcaactctcgatccac

SEQ ID NO: 361969 - DNA, 25 bp, Mus musculus
tcctcaaagaaggtcagctggccgc

SEQ ID NO: 361970 - DNA, 25 bp, Mus musculus
tcctcaaatcggggaaaaactctca

SEQ ID NO: 361971 - DNA, 25 bp, Mus musculus
tcctcaacaaggacctgatgcaaca

SEQ ID NO: 361972 - DNA, 25 bp, Mus musculus
tcctcaacagcttgtgaccttgttt

SEQ ID NO: 361973 - DNA, 25 bp, Mus musculus
tcctcaacagtgtctacattgggcc

SEQ ID NO: 361974 - DNA, 25 bp, Mus musculus
tcctcaaccacagtgtggacaagaa

SEQ ID NO: 361975 - DNA, 25 bp, Mus musculus
tcctcaacctggtcacccatccctg

SEQ ID NO: 361976 - DNA, 25 bp, Mus musculus
tcctcaacctggtctatgaaacaac

SEQ ID NO: 361977 - DNA, 25 bp, Mus musculus
tcctcaaccttgctggcaccatcgg

SEQ ID NO: 361978 - DNA, 25 bp, Mus musculus
tcctcaacgagcaggatgaggtgtt

SEQ ID NO: 361979 - DNA, 25 bp, Mus musculus
tcctcaacggagagtatgagagttc

SEQ ID NO: 361980 - DNA, 25 bp, Mus musculus
tcctcaacgtgtattttgttaaatt

SEQ ID NO: 361981 - DNA, 25 bp, Mus musculus
tcctcaactaggagcttcgatatga

SEQ ID NO: 361982 - DNA, 25 bp, Mus musculus
tcctcaactagggaacatattcaaa

SEQ ID NO: 361983 - DNA, 25 bp, Mus musculus
tcctcaactccaccccagcctgctg

SEQ ID NO: 361984 - DNA, 25 bp, Mus musculus
tcctcaactccaccctgaagagctt

SEQ ID NO: 361985 - DNA, 25 bp, Mus musculus
tcctcaagaggaaggcagtagagtc

SEQ ID NO: 361986 - DNA, 25 bp, Mus musculus
tcctcaagaggaaggccgaggatga

SEQ ID NO: 361987 - DNA, 25 bp, Mus musculus
tcctcaagatggagagacgttagca

SEQ ID NO: 361988 - DNA, 25 bp, Mus musculus
tcctcaagcgcggtttccgtgagag

SEQ ID NO: 361989 - DNA, 25 bp, Mus musculus
tcctcaatagttgaactttctagat

SEQ ID NO: 361990 - DNA, 25 bp, Mus musculus
tcctcaatatgccctacacagtcct

SEQ ID NO: 361991 - DNA, 25 bp, Mus musculus
tcctcaatatggaaagtacctaacc

SEQ ID NO: 361992 - DNA, 25 bp, Mus musculus
tcctcaatcacctctcccagtacag

SEQ ID NO: 361993 - DNA, 25 bp, Mus musculus
tcctcaatcacttatcacagttcag

SEQ ID NO: 361994 - DNA, 25 bp, Mus musculus
tcctcaatgtgttgcaacagaccaa

SEQ ID NO: 361995 - DNA, 25 bp, Mus musculus
tcctcacaagcagaaacacctggtg

SEQ ID NO: 361996 - DNA, 25 bp, Mus musculus
tcctcacaagcagtctttcacagaa

SEQ ID NO: 361997 - DNA, 25 bp, Mus musculus
tcctcacacagatgccccactgaaa

SEQ ID NO: 361998 - DNA, 25 bp, Mus musculus
tcctcacacagtgtccaacctgtca

SEQ ID NO: 361999 - DNA, 25 bp, Mus musculus
tcctcacactcagagccttccaagg

SEQ ID NO: 362000 - DNA, 25 bp, Mus musculus
tcctcacatactggctacccaggcg

SEQ ID NO: 362001 - DNA, 25 bp, Mus musculus
tcctcacatgaaggggcctctgctg

SEQ ID NO: 362002 - DNA, 25 bp, Mus musculus
tcctcacatgcaggatccaaaccaa

SEQ ID NO: 362003 - DNA, 25 bp, Mus musculus
tcctcacatgctaggtggagagagc

SEQ ID NO: 362004 - DNA, 25 bp, Mus musculus
tcctcaccaagatcctccaattctg

SEQ ID NO: 362005 - DNA, 25 bp, Mus musculus
tcctcaccaaggtttctctggactc

SEQ ID NO: 362006 - DNA, 25 bp, Mus musculus
tcctcaccacagcttccactcagaa

SEQ ID NO: 362007 - DNA, 25 bp, Mus musculus
tcctcaccacttgagctcctggcca

SEQ ID NO: 362008 - DNA, 25 bp, Mus musculus
tcctcaccacttggtgaacagtgag

SEQ ID NO: 362009 - DNA, 25 bp, Mus musculus
tcctcaccccccatggcttttcaag

SEQ ID NO: 362010 - DNA, 25 bp, Mus musculus
tcctcacctagcaccatcggtttgt

SEQ ID NO: 362011 - DNA, 25 bp, Mus musculus
tcctcacctgccacgctccagtggc

SEQ ID NO: 362012 - DNA, 25 bp, Mus musculus
tcctcacctgcctgcagcaacaagc

SEQ ID NO: 362013 - DNA, 25 bp, Mus musculus
tcctcacctgttaggaaagaatctt

SEQ ID NO: 362014 - DNA, 25 bp, Mus musculus
tcctcacctttacagattggagctg

SEQ ID NO: 362015 - DNA, 25 bp, Mus musculus
tcctcacgcagacagtgtccattct

SEQ ID NO: 362016 - DNA, 25 bp, Mus musculus
tcctcactacaggcttccagccagc

SEQ ID NO: 362017 - DNA, 25 bp, Mus musculus
tcctcactccagatgtgtttgggct

SEQ ID NO: 362018 - DNA, 25 bp, Mus musculus
tcctcactccagccggatgtatgga

SEQ ID NO: 362019 - DNA, 25 bp, Mus musculus
tcctcactgacctggcctctgggga

SEQ ID NO: 362020 - DNA, 25 bp, Mus musculus
tcctcactggttatgctttccatga

SEQ ID NO: 362021 - DNA, 25 bp, Mus musculus
tcctcactggttatggatccatctg

SEQ ID NO: 362022 - DNA, 25 bp, Mus musculus
tcctcagaaatgacacacttttgtg

SEQ ID NO: 362023 - DNA, 25 bp, Mus musculus
tcctcagaagagcatggcagaagac

SEQ ID NO: 362024 - DNA, 25 bp, Mus musculus
tcctcagaagcaaatggagaccatc

SEQ ID NO: 362025 - DNA, 25 bp, Mus musculus
tcctcagaagcatggtgtgctcctg

SEQ ID NO: 362026 - DNA, 25 bp, Mus musculus
tcctcagaagttgtggagtttgaca

SEQ ID NO: 362027 - DNA, 25 bp, Mus musculus
tcctcagacaagaggtaaagaagaa

SEQ ID NO: 362028 - DNA, 25 bp, Mus musculus
tcctcagacaggcttccatacacag

SEQ ID NO: 362029 - DNA, 25 bp, Mus musculus
tcctcagacagtgaaaacaaagaac

SEQ ID NO: 362030 - DNA, 25 bp, Mus musculus
tcctcagacgctgactcatcccagg

SEQ ID NO: 362031 - DNA, 25 bp, Mus musculus
tcctcagagaagaagtgtttgaaag

SEQ ID NO: 362032 - DNA, 25 bp, Mus musculus
tcctcagaggccaggaccatccttg

SEQ ID NO: 362033 - DNA, 25 bp, Mus musculus
tcctcagagtctgatgccaagccat

SEQ ID NO: 362034 - DNA, 25 bp, Mus musculus
tcctcagagtctgcaagaaactaca

SEQ ID NO: 362035 - DNA, 25 bp, Mus musculus
tcctcagagtttgtcatccgtcctt

SEQ ID NO: 362036 - DNA, 25 bp, Mus musculus
tcctcagattccagagacactgtac

SEQ ID NO: 362037 - DNA, 25 bp, Mus musculus
tcctcagcagaccaaaatcacccag

SEQ ID NO: 362038 - DNA, 25 bp, Mus musculus
tcctcagcagagttacgtcaatatg

SEQ ID NO: 362039 - DNA, 25 bp, Mus musculus
tcctcagcaggtatttgtcaagtgt

SEQ ID NO: 362040 - DNA, 25 bp, Mus musculus
tcctcagcatggctggaccgcttcg

SEQ ID NO: 362041 - DNA, 25 bp, Mus musculus
tcctcagccagcaaacaggccctgg

SEQ ID NO: 362042 - DNA, 25 bp, Mus musculus
tcctcagccatgagaaaacaagaaa

SEQ ID NO: 362043 - DNA, 25 bp, Mus musculus
tcctcagccccagtttgacggatga

SEQ ID NO: 362044 - DNA, 25 bp, Mus musculus
tcctcagccccctcccgccttcctc

SEQ ID NO: 362045 - DNA, 25 bp, Mus musculus
tcctcagcccctcctcctccctccc

SEQ ID NO: 362046 - DNA, 25 bp, Mus musculus
tcctcagccctgaggttatttcgtc

SEQ ID NO: 362047 - DNA, 25 bp, Mus musculus
tcctcaggaagagggttcactgatc

SEQ ID NO: 362048 - DNA, 25 bp, Mus musculus
tcctcagggagtgcctgcacttctg

SEQ ID NO: 362049 - DNA, 25 bp, Mus musculus
tcctcaggttctgccgcctcctgat

SEQ ID NO: 362050 - DNA, 25 bp, Mus musculus
tcctcaggttctgccggggacccct

SEQ ID NO: 362051 - DNA, 25 bp, Mus musculus
tcctcagtaatgaccaattctccag

SEQ ID NO: 362052 - DNA, 25 bp, Mus musculus
tcctcagtcaggaggtctccccaga

SEQ ID NO: 362053 - DNA, 25 bp, Mus musculus
tcctcagtcagtgctggggactgat

SEQ ID NO: 362054 - DNA, 25 bp, Mus musculus
tcctcagtcgtttggacttcaaatc

SEQ ID NO: 362055 - DNA, 25 bp, Mus musculus
tcctcagtgccaacctttttgccca

SEQ ID NO: 362056 - DNA, 25 bp, Mus musculus
tcctcagtggcaggcggtgtggcta

SEQ ID NO: 362057 - DNA, 25 bp, Mus musculus
tcctcagtggcagttgctgcgattg

SEQ ID NO: 362058 - DNA, 25 bp, Mus musculus
tcctcataaattccacatgagatat

SEQ ID NO: 362059 - DNA, 25 bp, Mus musculus
tcctcataaggtcacgttcatgaat

SEQ ID NO: 362060 - DNA, 25 bp, Mus musculus
tcctcatacacagcgtgcagggtcg

SEQ ID NO: 362061 - DNA, 25 bp, Mus musculus
tcctcatagcagaatctggtcaacc

SEQ ID NO: 362062 - DNA, 25 bp, Mus musculus
tcctcatcaccggagaatccggagc

SEQ ID NO: 362063 - DNA, 25 bp, Mus musculus
tcctcatcagatgttttaaggattt

SEQ ID NO: 362064 - DNA, 25 bp, Mus musculus
tcctcatcagtgccaactgtaaagc

SEQ ID NO: 362065 - DNA, 25 bp, Mus musculus
tcctcatcagtggccaccaatgaag

SEQ ID NO: 362066 - DNA, 25 bp, Mus musculus
tcctcatcccatgcttccaaactat

SEQ ID NO: 362067 - DNA, 25 bp, Mus musculus
tcctcatccccaaggccgcagatca

SEQ ID NO: 362068 - DNA, 25 bp, Mus musculus
tcctcatccccaaggggtcaatcct

SEQ ID NO: 362069 - DNA, 25 bp, Mus musculus
tcctcatccctcctgaggggatccc

SEQ ID NO: 362070 - DNA, 25 bp, Mus musculus
tcctcatccctcctgaggggatgct

SEQ ID NO: 362071 - DNA, 25 bp, Mus musculus
tcctcatctatgagggctacgaggg

SEQ ID NO: 362072 - DNA, 25 bp, Mus musculus
tcctcatctgtgctggctgcaacca

SEQ ID NO: 362073 - DNA, 25 bp, Mus musculus
tcctcatcttcaaagggattaacat

SEQ ID NO: 362074 - DNA, 25 bp, Mus musculus
tcctcatgaggaaacggctgctctt

SEQ ID NO: 362075 - DNA, 25 bp, Mus musculus
tcctcatgcctggataagagtaaag

SEQ ID NO: 362076 - DNA, 25 bp, Mus musculus
tcctcatgtttctgggctttcagga

SEQ ID NO: 362077 - DNA, 25 bp, Mus musculus
tcctcattgagacccccgatggcat

SEQ ID NO: 362078 - DNA, 25 bp, Mus musculus
tcctcatttacgagcacgagtgctt

SEQ ID NO: 362079 - DNA, 25 bp, Mus musculus
tcctcatttatgatcccataaaaac

SEQ ID NO: 362080 - DNA, 25 bp, Mus musculus
tcctcatttcaaaggtattttaacc

SEQ ID NO: 362081 - DNA, 25 bp, Mus musculus
tcctccaaaacctcaggctggctac

SEQ ID NO: 362082 - DNA, 25 bp, Mus musculus
tcctccaaagacacgagcaccgggg

SEQ ID NO: 362083 - DNA, 25 bp, Mus musculus
tcctccaaagatccattactaatgc

SEQ ID NO: 362084 - DNA, 25 bp, Mus musculus
tcctccaaagattgccatggtggtg

SEQ ID NO: 362085 - DNA, 25 bp, Mus musculus
tcctccaaagcatggaaataaatgc

SEQ ID NO: 362086 - DNA, 25 bp, Mus musculus
tcctccaaagcatggcaatgcttgg

SEQ ID NO: 362087 - DNA, 25 bp, Mus musculus
tcctccaaaggagctctcaagtgga

SEQ ID NO: 362088 - DNA, 25 bp, Mus musculus
tcctccaacaaatgcagaaccccga

SEQ ID NO: 362089 - DNA, 25 bp, Mus musculus
tcctccaacaatcctccatgtgaat

SEQ ID NO: 362090 - DNA, 25 bp, Mus musculus
tcctccaacccgggaagcacaggct

SEQ ID NO: 362091 - DNA, 25 bp, Mus musculus
tcctccaagagaaggtggacctggc

SEQ ID NO: 362092 - DNA, 25 bp, Mus musculus
tcctccaagaggcggagtcgccggc

SEQ ID NO: 362093 - DNA, 25 bp, Mus musculus
tcctccacaaaggtcagaagagggt

SEQ ID NO: 362094 - DNA, 25 bp, Mus musculus
tcctccacaagagcctgagttttct

SEQ ID NO: 362095 - DNA, 25 bp, Mus musculus
tcctccacaggctctggtcagggtg

SEQ ID NO: 362096 - DNA, 25 bp, Mus musculus
tcctccacagtaaaggacagtctca

SEQ ID NO: 362097 - DNA, 25 bp, Mus musculus
tcctccacagtaaaggttacagata

SEQ ID NO: 362098 - DNA, 25 bp, Mus musculus
tcctccacatcctctgatcggttaa

SEQ ID NO: 362099 - DNA, 25 bp, Mus musculus
tcctccaccaggtagctgagaccta

SEQ ID NO: 362100 - DNA, 25 bp, Mus musculus
tcctccacccaggtgtcaacacatg

SEQ ID NO: 362101 - DNA, 25 bp, Mus musculus
tcctccacctaccaggagaactatg

SEQ ID NO: 362102 - DNA, 25 bp, Mus musculus
tcctccacctaccagtgaaatcaac

SEQ ID NO: 362103 - DNA, 25 bp, Mus musculus
tcctccactccagatcatgtcatca

SEQ ID NO: 362104 - DNA, 25 bp, Mus musculus
tcctccagcaggcttgtgacatcac

SEQ ID NO: 362105 - DNA, 25 bp, Mus musculus
tcctccagcagtgggtttttcttcc

SEQ ID NO: 362106 - DNA, 25 bp, Mus musculus
tcctccagccaccagcccctgcccg

SEQ ID NO: 362107 - DNA, 25 bp, Mus musculus
tcctccagccaggaatggcaagatg

SEQ ID NO: 362108 - DNA, 25 bp, Mus musculus
tcctccagccaggtgatgttctgat

SEQ ID NO: 362109 - DNA, 25 bp, Mus musculus
tcctccagctctacccgatcaagtc

SEQ ID NO: 362110 - DNA, 25 bp, Mus musculus
tcctccaggaccatgcaaaagcaaa

SEQ ID NO: 362111 - DNA, 25 bp, Mus musculus
tcctccaggatcctcatccgagagt

SEQ ID NO: 362112 - DNA, 25 bp, Mus musculus
tcctccagggccagtttcttctggg

SEQ ID NO: 362113 - DNA, 25 bp, Mus musculus
tcctccagggtcagcttccaagcaa

SEQ ID NO: 362114 - DNA, 25 bp, Mus musculus
tcctccagggtcaggtgaaccacca

SEQ ID NO: 362115 - DNA, 25 bp, Mus musculus
tcctccagtgactccatcaaagaga

SEQ ID NO: 362116 - DNA, 25 bp, Mus musculus
tcctccagtggatcggaaaaggcct

SEQ ID NO: 362117 - DNA, 25 bp, Mus musculus
tcctccagttttccagagccccttc

SEQ ID NO: 362118 - DNA, 25 bp, Mus musculus
tcctccatcaccttcattcacaacg

SEQ ID NO: 362119 - DNA, 25 bp, Mus musculus
tcctccatctccgagctgatccaca

SEQ ID NO: 362120 - DNA, 25 bp, Mus musculus
tcctccatcttggcatgtgctccac

SEQ ID NO: 362121 - DNA, 25 bp, Mus musculus
tcctccatgacgcctgacctgctga

SEQ ID NO: 362122 - DNA, 25 bp, Mus musculus
tcctccatgagtgaacccacagctt

SEQ ID NO: 362123 - DNA, 25 bp, Mus musculus
tcctccatgccctctttagcagata

SEQ ID NO: 362124 - DNA, 25 bp, Mus musculus
tcctccatgggcatggacatatctg

SEQ ID NO: 362125 - DNA, 25 bp, Mus musculus
tcctccattctcgaggtggctgtta

SEQ ID NO: 362126 - DNA, 25 bp, Mus musculus
tcctcccaaactgagatttgcaaca

SEQ ID NO: 362127 - DNA, 25 bp, Mus musculus
tcctcccaaagatactggcattgcc

SEQ ID NO: 362128 - DNA, 25 bp, Mus musculus
tcctcccaaagggtatgtgtatttg

SEQ ID NO: 362129 - DNA, 25 bp, Mus musculus
tcctcccaacagatgcagcgaagcc

SEQ ID NO: 362130 - DNA, 25 bp, Mus musculus
tcctcccaagattcccgtggggctg

SEQ ID NO: 362131 - DNA, 25 bp, Mus musculus
tcctcccaagcaaggttgaaaggaa

SEQ ID NO: 362132 - DNA, 25 bp, Mus musculus
tcctcccagcgcagggttaatttct

SEQ ID NO: 362133 - DNA, 25 bp, Mus musculus
tcctccccagaaatagatgaagacc

SEQ ID NO: 362134 - DNA, 25 bp, Mus musculus
tcctccccagaagacccagccagca

SEQ ID NO: 362135 - DNA, 25 bp, Mus musculus
tcctccccagatcagcaccgacacg

SEQ ID NO: 362136 - DNA, 25 bp, Mus musculus
tcctcccccaggctggagagaatga

SEQ ID NO: 362137 - DNA, 25 bp, Mus musculus
tcctcccccaggcttcagcaccgtg

SEQ ID NO: 362138 - DNA, 25 bp, Mus musculus
tcctcccctgctacaaaaaattgcc

SEQ ID NO: 362139 - DNA, 25 bp, Mus musculus
tcctcccctggctagagcatggaaa

SEQ ID NO: 362140 - DNA, 25 bp, Mus musculus
tcctccccttggggccttctagccc

SEQ ID NO: 362141 - DNA, 25 bp, Mus musculus
tcctcccgctttgggaaattcatca

SEQ ID NO: 362142 - DNA, 25 bp, Mus musculus
tcctcccggaggaagcctcaagcac

SEQ ID NO: 362143 - DNA, 25 bp, Mus musculus
tcctcccggaggaaggtgttcctgg

SEQ ID NO: 362144 - DNA, 25 bp, Mus musculus
tcctccctcactgcactaacctttg

SEQ ID NO: 362145 - DNA, 25 bp, Mus musculus
tcctccctcactggtgagaatgtcc

SEQ ID NO: 362146 - DNA, 25 bp, Mus musculus
tcctccctcccatgcagccacctgg

SEQ ID NO: 362147 - DNA, 25 bp, Mus musculus
tcctccctgagcagattgaacgggc

SEQ ID NO: 362148 - DNA, 25 bp, Mus musculus
tcctccctttcggcttcgtgagctt

SEQ ID NO: 362149 - DNA, 25 bp, Mus musculus
tcctccgaatttatgttgaaaaaca

SEQ ID NO: 362150 - DNA, 25 bp, Mus musculus
tcctccgagaaccagagggcacatc

SEQ ID NO: 362151 - DNA, 25 bp, Mus musculus
tcctccgagaaccagttgataaaat

SEQ ID NO: 362152 - DNA, 25 bp, Mus musculus
tcctccgagaagccccggcagccca

SEQ ID NO: 362153 - DNA, 25 bp, Mus musculus
tcctccgagaattatatcagaattc

SEQ ID NO: 362154 - DNA, 25 bp, Mus musculus
tcctccgagagaggtgccgttctct

SEQ ID NO: 362155 - DNA, 25 bp, Mus musculus
tcctccgagtacatcaccaagcttt

SEQ ID NO: 362156 - DNA, 25 bp, Mus musculus
tcctccgcagaggccaagtgagact

SEQ ID NO: 362157 - DNA, 25 bp, Mus musculus
tcctccgcagcctctactcaatagt

SEQ ID NO: 362158 - DNA, 25 bp, Mus musculus
tcctccgcaggttcgtggtacgaac

SEQ ID NO: 362159 - DNA, 25 bp, Mus musculus
tcctccgccgggagggttgatttct

SEQ ID NO: 362160 - DNA, 25 bp, Mus musculus
tcctccgccgggaggtcatggctgc

SEQ ID NO: 362161 - DNA, 25 bp, Mus musculus
tcctccggcggaagcagtatccagc

SEQ ID NO: 362162 - DNA, 25 bp, Mus musculus
tcctccggcggaaggtcatgttagc

SEQ ID NO: 362163 - DNA, 25 bp, Mus musculus
tcctccggcttgttggaggtgagct

SEQ ID NO: 362164 - DNA, 25 bp, Mus musculus
tcctccgggaaggtagactgcctga

SEQ ID NO: 362165 - DNA, 25 bp, Mus musculus
tcctccggggcaacattttgatggc

SEQ ID NO: 362166 - DNA, 25 bp, Mus musculus
tcctccggggcatccagggaaatga

SEQ ID NO: 362167 - DNA, 25 bp, Mus musculus
tcctccggtgcccaggtctgggaac

SEQ ID NO: 362168 - DNA, 25 bp, Mus musculus
tcctcctaaagaacagagcctggga

SEQ ID NO: 362169 - DNA, 25 bp, Mus musculus
tcctcctaaagccgagcgccagcgc

SEQ ID NO: 362170 - DNA, 25 bp, Mus musculus
tcctcctaaggcgcctgtgtctggc

SEQ ID NO: 362171 - DNA, 25 bp, Mus musculus
tcctcctaaggtgatcttagtggag

SEQ ID NO: 362172 - DNA, 25 bp, Mus musculus
tcctcctaagtggagggcagcaagc

SEQ ID NO: 362173 - DNA, 25 bp, Mus musculus
tcctcctacaacacggtagaggact

SEQ ID NO: 362174 - DNA, 25 bp, Mus musculus
tcctcctacattgagcagacacggt

SEQ ID NO: 362175 - DNA, 25 bp, Mus musculus
tcctcctcacctagcaccatcggtt

SEQ ID NO: 362176 - DNA, 25 bp, Mus musculus
tcctcctccacctaaggtggtaaat

SEQ ID NO: 362177 - DNA, 25 bp, Mus musculus
tcctcctcctggcaatcccctggtt

SEQ ID NO: 362178 - DNA, 25 bp, Mus musculus
tcctcctcctggcagtaagatccta

SEQ ID NO: 362179 - DNA, 25 bp, Mus musculus
tcctcctccttgggcccattgactc

SEQ ID NO: 362180 - DNA, 25 bp, Mus musculus
tcctcctcgaatgataatctggagg

SEQ ID NO: 362181 - DNA, 25 bp, Mus musculus
tcctcctctcggtacttctccatac

SEQ ID NO: 362182 - DNA, 25 bp, Mus musculus
tcctcctgacccagaaacaacttga

SEQ ID NO: 362183 - DNA, 25 bp, Mus musculus
tcctcctgacccagccaaggcagga

SEQ ID NO: 362184 - DNA, 25 bp, Mus musculus
tcctcctgccagacttggcagcctg

SEQ ID NO: 362185 - DNA, 25 bp, Mus musculus
tcctcctgccaggccaaaagcacct

SEQ ID NO: 362186 - DNA, 25 bp, Mus musculus
tcctcctgccaggttttttccttga

SEQ ID NO: 362187 - DNA, 25 bp, Mus musculus
tcctcctgcctcagtaaaggccaaa

SEQ ID NO: 362188 - DNA, 25 bp, Mus musculus
tcctcctgctgatgctttcattggc

SEQ ID NO: 362189 - DNA, 25 bp, Mus musculus
tcctcctggaggagttctcagagta

SEQ ID NO: 362190 - DNA, 25 bp, Mus musculus
tcctcctggcaatcccctggttgaa

SEQ ID NO: 362191 - DNA, 25 bp, Mus musculus
tcctcctggcagtaagatcctacag

SEQ ID NO: 362192 - DNA, 25 bp, Mus musculus
tcctcctggtttaggagatcccagc

SEQ ID NO: 362193 - DNA, 25 bp, Mus musculus
tcctcctgtccagcaaatctcccag

SEQ ID NO: 362194 - DNA, 25 bp, Mus musculus
tcctcctgttggtggtcatcaactc

SEQ ID NO: 362195 - DNA, 25 bp, Mus musculus
tcctccttaaagcctgcggagccca

SEQ ID NO: 362196 - DNA, 25 bp, Mus musculus
tcctccttagcaaggtcaacaacag

SEQ ID NO: 362197 - DNA, 25 bp, Mus musculus
tcctccttcagctgataatactaga

SEQ ID NO: 362198 - DNA, 25 bp, Mus musculus
tcctccttggctggcagcacagact

SEQ ID NO: 362199 - DNA, 25 bp, Mus musculus
tcctccttggctgggaaaatgaccc

SEQ ID NO: 362200 - DNA, 25 bp, Mus musculus
tcctccttggctgggggaagaacag

SEQ ID NO: 362201 - DNA, 25 bp, Mus musculus
tcctcctttggtggccgtgcctgca

SEQ ID NO: 362202 - DNA, 25 bp, Mus musculus
tcctcgaaacagggtcacgtctctg

SEQ ID NO: 362203 - DNA, 25 bp, Mus musculus
tcctcgaaagatgttccggcacaca

SEQ ID NO: 362204 - DNA, 25 bp, Mus musculus
tcctcgaaatctgacagatttcatc

SEQ ID NO: 362205 - DNA, 25 bp, Mus musculus
tcctcgaaatctgactcagagcaac

SEQ ID NO: 362206 - DNA, 25 bp, Mus musculus
tcctcgaacacctatgtgcccttcc

SEQ ID NO: 362207 - DNA, 25 bp, Mus musculus
tcctcgaacacctgagccagcccgc

SEQ ID NO: 362208 - DNA, 25 bp, Mus musculus
tcctcgaagctagggtcccaaaggc

SEQ ID NO: 362209 - DNA, 25 bp, Mus musculus
tcctcgaaggtcctggccacaccca

SEQ ID NO: 362210 - DNA, 25 bp, Mus musculus
tcctcgaatgataatctggaggctg

SEQ ID NO: 362211 - DNA, 25 bp, Mus musculus
tcctcgaccagagagaagcaaccat

SEQ ID NO: 362212 - DNA, 25 bp, Mus musculus
tcctcgaccagctgcttaaaggata

SEQ ID NO: 362213 - DNA, 25 bp, Mus musculus
tcctcgacgcagcaggtcttctatc

SEQ ID NO: 362214 - DNA, 25 bp, Mus musculus
tcctcgacgggtcctgcatggtgga

SEQ ID NO: 362215 - DNA, 25 bp, Mus musculus
tcctcgactccgcatatttcagact

SEQ ID NO: 362216 - DNA, 25 bp, Mus musculus
tcctcgactccgcattggaactgga

SEQ ID NO: 362217 - DNA, 25 bp, Mus musculus
tcctcgcagcaggaagaagtagcta

SEQ ID NO: 362218 - DNA, 25 bp, Mus musculus
tcctcgcattccggatgattgtaaa

SEQ ID NO: 362219 - DNA, 25 bp, Mus musculus
tcctcgcccaaggagagctctctga

SEQ ID NO: 362220 - DNA, 25 bp, Mus musculus
tcctcgccgagcagaacatgccggg

SEQ ID NO: 362221 - DNA, 25 bp, Mus musculus
tcctcgccgagcagcctgtagtgaa

SEQ ID NO: 362222 - DNA, 25 bp, Mus musculus
tcctcgcctgtgaactcatcagcac

SEQ ID NO: 362223 - DNA, 25 bp, Mus musculus
tcctcgcctttggtaccacgtacac

SEQ ID NO: 362224 - DNA, 25 bp, Mus musculus
tcctcgcttttgagcttggcaaatg

SEQ ID NO: 362225 - DNA, 25 bp, Mus musculus
tcctcgcttttgagtgacagccctg

SEQ ID NO: 362226 - DNA, 25 bp, Mus musculus
tcctcggaaaccatcgagcgtttgg

SEQ ID NO: 362227 - DNA, 25 bp, Mus musculus
tcctcggaagaggagaaggggacca

SEQ ID NO: 362228 - DNA, 25 bp, Mus musculus
tcctcggaagcactgctacaggagc

SEQ ID NO: 362229 - DNA, 25 bp, Mus musculus
tcctcggaagcagagatggctatga

SEQ ID NO: 362230 - DNA, 25 bp, Mus musculus
tcctcggaagcatctcctctggcct

SEQ ID NO: 362231 - DNA, 25 bp, Mus musculus
tcctcggagagacctccattgctga

SEQ ID NO: 362232 - DNA, 25 bp, Mus musculus
tcctcggagtttgatccatttttta

SEQ ID NO: 362233 - DNA, 25 bp, Mus musculus
tcctcggcaacaagacgctgccgtc

SEQ ID NO: 362234 - DNA, 25 bp, Mus musculus
tcctcggcaatcagtttggagattc

SEQ ID NO: 362235 - DNA, 25 bp, Mus musculus
tcctcggcatcatgatgacccggag

SEQ ID NO: 362236 - DNA, 25 bp, Mus musculus
tcctcggccagaagccaccccagtg

SEQ ID NO: 362237 - DNA, 25 bp, Mus musculus
tcctcggccagaagctgaaccttat

SEQ ID NO: 362238 - DNA, 25 bp, Mus musculus
tcctcggccagaagttgcaagttgt

SEQ ID NO: 362239 - DNA, 25 bp, Mus musculus
tcctcggcctcacgtttgaagctgg

SEQ ID NO: 362240 - DNA, 25 bp, Mus musculus
tcctcggcctcaggtttgaagctgg

SEQ ID NO: 362241 - DNA, 25 bp, Mus musculus
tcctcggcctggtcaccgaagtgaa

SEQ ID NO: 362242 - DNA, 25 bp, Mus musculus
tcctcggctgcccgggcctgactac

SEQ ID NO: 362243 - DNA, 25 bp, Mus musculus
tcctcgggctccactctcgctcaca

SEQ ID NO: 362244 - DNA, 25 bp, Mus musculus
tcctcggggcagaaaatatctgcag

SEQ ID NO: 362245 - DNA, 25 bp, Mus musculus
tcctcggggcagatcgtaatgtaaa

SEQ ID NO: 362246 - DNA, 25 bp, Mus musculus
tcctcgggggactggcaatgtttgc

SEQ ID NO: 362247 - DNA, 25 bp, Mus musculus
tcctcgggggactggccatgtttgc

SEQ ID NO: 362248 - DNA, 25 bp, Mus musculus
tcctcgggtctgaggaacagtctga

SEQ ID NO: 362249 - DNA, 25 bp, Mus musculus
tcctcgtaggaatcagagaagctgg

SEQ ID NO: 362250 - DNA, 25 bp, Mus musculus
tcctcgtccagcagcaaagccgacc

SEQ ID NO: 362251 - DNA, 25 bp, Mus musculus
tcctcgtcctagccatctgcatcat

SEQ ID NO: 362252 - DNA, 25 bp, Mus musculus
tcctcgtcctaggtattctcatggg

SEQ ID NO: 362253 - DNA, 25 bp, Mus musculus
tcctcgtcctcctcttcttctaatg

SEQ ID NO: 362254 - DNA, 25 bp, Mus musculus
tcctcgtccttgagagatgccaaag

SEQ ID NO: 362255 - DNA, 25 bp, Mus musculus
tcctcgtgtataactaagaatgtct

SEQ ID NO: 362256 - DNA, 25 bp, Mus musculus
tcctcgtgtgcggattcctttgttt

SEQ ID NO: 362257 - DNA, 25 bp, Mus musculus
tcctcgtgtgcggtgcacgatctga

SEQ ID NO: 362258 - DNA, 25 bp, Mus musculus
tcctcgttggagtgacatcgtcttt

SEQ ID NO: 362259 - DNA, 25 bp, Mus musculus
tcctctaaaaggcaacaactctaca

SEQ ID NO: 362260 - DNA, 25 bp, Mus musculus
tcctctaaaagggccgcgcctgcgc

SEQ ID NO: 362261 - DNA, 25 bp, Mus musculus
tcctctaaacaagacgggccgcatt

SEQ ID NO: 362262 - DNA, 25 bp, Mus musculus
tcctctaaagaccggaaagcactgc

SEQ ID NO: 362263 - DNA, 25 bp, Mus musculus
tcctctaagcaggtaaacgagttgt

SEQ ID NO: 362264 - DNA, 25 bp, Mus musculus
tcctctaagcaggtttctaccccag

SEQ ID NO: 362265 - DNA, 25 bp, Mus musculus
tcctctaattaagctgtctcctaag

SEQ ID NO: 362266 - DNA, 25 bp, Mus musculus
tcctctacaagacaatgttctattg

SEQ ID NO: 362267 - DNA, 25 bp, Mus musculus
tcctctacaagactgtgtacagtgc

SEQ ID NO: 362268 - DNA, 25 bp, Mus musculus
tcctctacaatgggcacctgggtta

SEQ ID NO: 362269 - DNA, 25 bp, Mus musculus
tcctctacagacagaccctgctctt

SEQ ID NO: 362270 - DNA, 25 bp, Mus musculus
tcctctacagcaatgggatacggac

SEQ ID NO: 362271 - DNA, 25 bp, Mus musculus
tcctctacaggggacctggctgaca

SEQ ID NO: 362272 - DNA, 25 bp, Mus musculus
tcctctacatgggtaaaaagcaaga

SEQ ID NO: 362273 - DNA, 25 bp, Mus musculus
tcctctaccctcaaccagcaagcct

SEQ ID NO: 362274 - DNA, 25 bp, Mus musculus
tcctctactgtcccggtgtgccagc

SEQ ID NO: 362275 - DNA, 25 bp, Mus musculus
tcctctagaacagatgcaaaatcgt

SEQ ID NO: 362276 - DNA, 25 bp, Mus musculus
tcctctagaacaggagagcctgaca

SEQ ID NO: 362277 - DNA, 25 bp, Mus musculus
tcctctagacacctttctctccctt

SEQ ID NO: 362278 - DNA, 25 bp, Mus musculus
tcctctagaggctgtggggtgggcg

SEQ ID NO: 362279 - DNA, 25 bp, Mus musculus
tcctctagcaacaaggaatcaaaaa

SEQ ID NO: 362280 - DNA, 25 bp, Mus musculus
tcctctaggagaacttaggcttctt

SEQ ID NO: 362281 - DNA, 25 bp, Mus musculus
tcctctataattagcacagagaatg

SEQ ID NO: 362282 - DNA, 25 bp, Mus musculus
tcctctcaaagggacagccagcccc

SEQ ID NO: 362283 - DNA, 25 bp, Mus musculus
tcctctcaaaggtttattttattta

SEQ ID NO: 362284 - DNA, 25 bp, Mus musculus
tcctctcaacctctcttcaggccca

SEQ ID NO: 362285 - DNA, 25 bp, Mus musculus
tcctctcaaggctcaaactcagaaa

SEQ ID NO: 362286 - DNA, 25 bp, Mus musculus
tcctctcaatgaattcctggaggag

SEQ ID NO: 362287 - DNA, 25 bp, Mus musculus
tcctctcaggccgcctctagacgtc

SEQ ID NO: 362288 - DNA, 25 bp, Mus musculus
tcctctcaggccgggttcgagtgag

SEQ ID NO: 362289 - DNA, 25 bp, Mus musculus
tcctctcaggccggtgacgctgact

SEQ ID NO: 362290 - DNA, 25 bp, Mus musculus
tcctctcagtgcaagacagtattgg

SEQ ID NO: 362291 - DNA, 25 bp, Mus musculus
tcctctcagtgcaagtcatggggac

SEQ ID NO: 362292 - DNA, 25 bp, Mus musculus
tcctctcagtggccccagggcccgg

SEQ ID NO: 362293 - DNA, 25 bp, Mus musculus
tcctctccaaccaaggcatcctcgg

SEQ ID NO: 362294 - DNA, 25 bp, Mus musculus
tcctctccaaccaaggtatcatgtt

SEQ ID NO: 362295 - DNA, 25 bp, Mus musculus
tcctctccaggacccaagtttcttc

SEQ ID NO: 362296 - DNA, 25 bp, Mus musculus
tcctctccaggatgttctgaggagg

SEQ ID NO: 362297 - DNA, 25 bp, Mus musculus
tcctctccattgtagggatgtttct

SEQ ID NO: 362298 - DNA, 25 bp, Mus musculus
tcctctcccggagaggtgtcgcgga

SEQ ID NO: 362299 - DNA, 25 bp, Mus musculus
tcctctccgacatcacccatgctgg

SEQ ID NO: 362300 - DNA, 25 bp, Mus musculus
tcctctcctggtggagagagccagc

SEQ ID NO: 362301 - DNA, 25 bp, Mus musculus
tcctctcctgtcctgagctttcccg

SEQ ID NO: 362302 - DNA, 25 bp, Mus musculus
tcctctctctggaccctactttcag

SEQ ID NO: 362303 - DNA, 25 bp, Mus musculus
tcctctctgcttgaggaagaagctc

SEQ ID NO: 362304 - DNA, 25 bp, Mus musculus
tcctctctgtgcagcacgatggcct

SEQ ID NO: 362305 - DNA, 25 bp, Mus musculus
tcctctcttagactatcccccgaat

SEQ ID NO: 362306 - DNA, 25 bp, Mus musculus
tcctctcttggtcaaactacaactc

SEQ ID NO: 362307 - DNA, 25 bp, Mus musculus
tcctctgaacctgccgaattcgagg

SEQ ID NO: 362308 - DNA, 25 bp, Mus musculus
tcctctgaactcagactactcgctg

SEQ ID NO: 362309 - DNA, 25 bp, Mus musculus
tcctctgaactggatgccagtaaag

SEQ ID NO: 362310 - DNA, 25 bp, Mus musculus
tcctctgaactgtataaaatggttt

SEQ ID NO: 362311 - DNA, 25 bp, Mus musculus
tcctctgaaggctagccctgctcct

SEQ ID NO: 362312 - DNA, 25 bp, Mus musculus
tcctctgacagtctcatctttggac

SEQ ID NO: 362313 - DNA, 25 bp, Mus musculus
tcctctgacagtgaagaaaatgctg

SEQ ID NO: 362314 - DNA, 25 bp, Mus musculus
tcctctgacagtggtgggtgtgtgc

SEQ ID NO: 362315 - DNA, 25 bp, Mus musculus
tcctctgacccactcttggaactga

SEQ ID NO: 362316 - DNA, 25 bp, Mus musculus
tcctctgagcccctccccccgccat

SEQ ID NO: 362317 - DNA, 25 bp, Mus musculus
tcctctgaggaggcccactgagtgt

SEQ ID NO: 362318 - DNA, 25 bp, Mus musculus
tcctctgatcttggggagtgggagg

SEQ ID NO: 362319 - DNA, 25 bp, Mus musculus
tcctctgatgaccacggctccttca

SEQ ID NO: 362320 - DNA, 25 bp, Mus musculus
tcctctgcactgctctcaggagaag

SEQ ID NO: 362321 - DNA, 25 bp, Mus musculus
tcctctgcagttgttgacctcctgt

SEQ ID NO: 362322 - DNA, 25 bp, Mus musculus
tcctctgcctgctccggctcctgct

SEQ ID NO: 362323 - DNA, 25 bp, Mus musculus
tcctctgctacaaggctttcttctg

SEQ ID NO: 362324 - DNA, 25 bp, Mus musculus
tcctctgctacaagtgactacttcc

SEQ ID NO: 362325 - DNA, 25 bp, Mus musculus
tcctctgctcagcagccactctcta

SEQ ID NO: 362326 - DNA, 25 bp, Mus musculus
tcctctgctcagcagggataactct

SEQ ID NO: 362327 - DNA, 25 bp, Mus musculus
tcctctggaaagacccccctttgtg

SEQ ID NO: 362328 - DNA, 25 bp, Mus musculus
tcctctggaaagccccggcagccca

SEQ ID NO: 362329 - DNA, 25 bp, Mus musculus
tcctctggaagggagagacgacatg

SEQ ID NO: 362330 - DNA, 25 bp, Mus musculus
tcctctggagacaggttttctctgg

SEQ ID NO: 362331 - DNA, 25 bp, Mus musculus
tcctctggagggtctggaatccctg

SEQ ID NO: 362332 - DNA, 25 bp, Mus musculus
tcctctggagtcgagctcctggggc

SEQ ID NO: 362333 - DNA, 25 bp, Mus musculus
tcctctggagtcgatgaggatccag

SEQ ID NO: 362334 - DNA, 25 bp, Mus musculus
tcctctggatcaggctgctccacta

SEQ ID NO: 362335 - DNA, 25 bp, Mus musculus
tcctctggatcagggtttgaggagt

SEQ ID NO: 362336 - DNA, 25 bp, Mus musculus
tcctctggcatgaacctctcaggag

SEQ ID NO: 362337 - DNA, 25 bp, Mus musculus
tcctctggcccagaccgaagccagg

SEQ ID NO: 362338 - DNA, 25 bp, Mus musculus
tcctctggccctggggatgtgacaa

SEQ ID NO: 362339 - DNA, 25 bp, Mus musculus
tcctctggctctgaatttctcttct

SEQ ID NO: 362340 - DNA, 25 bp, Mus musculus
tcctctggctctgacagcgacgaac

SEQ ID NO: 362341 - DNA, 25 bp, Mus musculus
tcctctgggaaaagggtcaatgcta

SEQ ID NO: 362342 - DNA, 25 bp, Mus musculus
tcctctggggcttagtccttggctc

SEQ ID NO: 362343 - DNA, 25 bp, Mus musculus
tcctctgtaccagttgctgtgattg

SEQ ID NO: 362344 - DNA, 25 bp, Mus musculus
tcctctgtcagatgatgatcatttt

SEQ ID NO: 362345 - DNA, 25 bp, Mus musculus
tcctctgtgaagctgtttgttcagg

SEQ ID NO: 362346 - DNA, 25 bp, Mus musculus
tcctctgtgaaggtcacagtaatga

SEQ ID NO: 362347 - DNA, 25 bp, Mus musculus
tcctctgtgaccttggtctgccttg

SEQ ID NO: 362348 - DNA, 25 bp, Mus musculus
tcctctgtggaaagcagatgagaaa

SEQ ID NO: 362349 - DNA, 25 bp, Mus musculus
tcctctgtttctgtgaggaccttga

SEQ ID NO: 362350 - DNA, 25 bp, Mus musculus
tcctctgtttcttggaggatctgga

SEQ ID NO: 362351 - DNA, 25 bp, Mus musculus
tcctcttacttaaggaactcagaga

SEQ ID NO: 362352 - DNA, 25 bp, Mus musculus
tcctcttatgacagctggaacgctt

SEQ ID NO: 362353 - DNA, 25 bp, Mus musculus
tcctcttatgacaggtggctgtctg

SEQ ID NO: 362354 - DNA, 25 bp, Mus musculus
tcctcttcagaaaggccggagcctc

SEQ ID NO: 362355 - DNA, 25 bp, Mus musculus
tcctcttcagctgctctgtccgggc

SEQ ID NO: 362356 - DNA, 25 bp, Mus musculus
tcctcttcatcaggatgctgcacaa

SEQ ID NO: 362357 - DNA, 25 bp, Mus musculus
tcctcttccactggggtgtgtctgc

SEQ ID NO: 362358 - DNA, 25 bp, Mus musculus
tcctcttcgccgccattgctcctgt

SEQ ID NO: 362359 - DNA, 25 bp, Mus musculus
tcctcttctctggggcctggaatga

SEQ ID NO: 362360 - DNA, 25 bp, Mus musculus
tcctcttctgcagaactgggagtcc

SEQ ID NO: 362361 - DNA, 25 bp, Mus musculus
tcctcttctgcagtctacctgtgcc

SEQ ID NO: 362362 - DNA, 25 bp, Mus musculus
tcctcttctggaaggactaccacct

SEQ ID NO: 362363 - DNA, 25 bp, Mus musculus
tcctcttctggaaggactcgggaca

SEQ ID NO: 362364 - DNA, 25 bp, Mus musculus
tcctcttgagaatattctccttctt

SEQ ID NO: 362365 - DNA, 25 bp, Mus musculus
tcctcttgagcattgcgccagccct

SEQ ID NO: 362366 - DNA, 25 bp, Mus musculus
tcctcttgcaaggagtcagcattgg

SEQ ID NO: 362367 - DNA, 25 bp, Mus musculus
tcctcttgcagatactggagtgtgg

SEQ ID NO: 362368 - DNA, 25 bp, Mus musculus
tcctcttgcctcagtgacatcaggc

SEQ ID NO: 362369 - DNA, 25 bp, Mus musculus
tcctcttggctcagctgaaggatga

SEQ ID NO: 362370 - DNA, 25 bp, Mus musculus
tcctcttgtggaagtgcggcttctt

SEQ ID NO: 362371 - DNA, 25 bp, Mus musculus
tcctcttgtggaagtgtgacttctt

SEQ ID NO: 362372 - DNA, 25 bp, Mus musculus
tcctctttaaaggattggtgaccag

SEQ ID NO: 362373 - DNA, 25 bp, Mus musculus
tcctctttaagaagtttgatgaagg

SEQ ID NO: 362374 - DNA, 25 bp, Mus musculus
tcctctttacagcaaatgcaacaaa

SEQ ID NO: 362375 - DNA, 25 bp, Mus musculus
tcctctttacagcaagccttttctg

SEQ ID NO: 362376 - DNA, 25 bp, Mus musculus
tcctctttaccagtaaccaggtgac

SEQ ID NO: 362377 - DNA, 25 bp, Mus musculus
tcctctttagaacctgggtgtggtc

SEQ ID NO: 362378 - DNA, 25 bp, Mus musculus
tcctctttcatacgcggaaccctct

SEQ ID NO: 362379 - DNA, 25 bp, Mus musculus
tcctctttcatacggattttgataa

SEQ ID NO: 362380 - DNA, 25 bp, Mus musculus
tcctctttcataggcggaaccctct

SEQ ID NO: 362381 - DNA, 25 bp, Mus musculus
tcctctttcatagggattttgataa

SEQ ID NO: 362382 - DNA, 25 bp, Mus musculus
tcctctttgaagacctttgcacaga

SEQ ID NO: 362383 - DNA, 25 bp, Mus musculus
tcctctttgacactctcgtgggcgc

SEQ ID NO: 362384 - DNA, 25 bp, Mus musculus
tcctctttgacacttttctcaacag

SEQ ID NO: 362385 - DNA, 25 bp, Mus musculus
tcctctttggacagagccagtatac

SEQ ID NO: 362386 - DNA, 25 bp, Mus musculus
tcctcttttctggacaagatggcaa

SEQ ID NO: 362387 - DNA, 25 bp, Mus musculus
tcctctttttccagcagttggaatt

SEQ ID NO: 362388 - DNA, 25 bp, Mus musculus
tcctgaaacagagaagcccgtgctt

SEQ ID NO: 362389 - DNA, 25 bp, Mus musculus
tcctgaaacaggtactacttgtcct

SEQ ID NO: 362390 - DNA, 25 bp, Mus musculus
tcctgaaactcaggttatgaggtga

SEQ ID NO: 362391 - DNA, 25 bp, Mus musculus
tcctgaaactgtaccagttcaaccc

SEQ ID NO: 362392 - DNA, 25 bp, Mus musculus
tcctgaaagcccaagtggccgcacg

SEQ ID NO: 362393 - DNA, 25 bp, Mus musculus
tcctgaaatgcctaacatacatggt

SEQ ID NO: 362394 - DNA, 25 bp, Mus musculus
tcctgaaattagatggcttcccttt

SEQ ID NO: 362395 - DNA, 25 bp, Mus musculus
tcctgaacaaggtccaggacatctt

SEQ ID NO: 362396 - DNA, 25 bp, Mus musculus
tcctgaacacagtaaggtagattac

SEQ ID NO: 362397 - DNA, 25 bp, Mus musculus
tcctgaacacgacccgagcaacgtc

SEQ ID NO: 362398 - DNA, 25 bp, Mus musculus
tcctgaacaggatgctgccagccct

SEQ ID NO: 362399 - DNA, 25 bp, Mus musculus
tcctgaacatcaacggttctcccat

SEQ ID NO: 362400 - DNA, 25 bp, Mus musculus
tcctgaacatgccaggcacgagcca

SEQ ID NO: 362401 - DNA, 25 bp, Mus musculus
tcctgaaccagctggtccctgagaa

SEQ ID NO: 362402 - DNA, 25 bp, Mus musculus
tcctgaaccctggcggaggctgctg

SEQ ID NO: 362403 - DNA, 25 bp, Mus musculus
tcctgaacttggatcctttctctat

SEQ ID NO: 362404 - DNA, 25 bp, Mus musculus
tcctgaagaaaggaactgtcgtcca

SEQ ID NO: 362405 - DNA, 25 bp, Mus musculus
tcctgaagaaagtggtatcccgcca

SEQ ID NO: 362406 - DNA, 25 bp, Mus musculus
tcctgaagaacggtatcactgagga

SEQ ID NO: 362407 - DNA, 25 bp, Mus musculus
tcctgaagaagattaacttgagtat

SEQ ID NO: 362408 - DNA, 25 bp, Mus musculus
tcctgaagaagcacgcccactggaa

SEQ ID NO: 362409 - DNA, 25 bp, Mus musculus
tcctgaagacagcccaggacccagg

SEQ ID NO: 362410 - DNA, 25 bp, Mus musculus
tcctgaagacgcatttagtaaagaa

SEQ ID NO: 362411 - DNA, 25 bp, Mus musculus
tcctgaagatcaaagacgccttagc

SEQ ID NO: 362412 - DNA, 25 bp, Mus musculus
tcctgaagatctagtgcgccgtcat

SEQ ID NO: 362413 - DNA, 25 bp, Mus musculus
tcctgaagccccagtcttattaatc

SEQ ID NO: 362414 - DNA, 25 bp, Mus musculus
tcctgaagctgcgacaagggtctga

SEQ ID NO: 362415 - DNA, 25 bp, Mus musculus
tcctgaaggagaacagcaaacctct

SEQ ID NO: 362416 - DNA, 25 bp, Mus musculus
tcctgaaggaggtactgtctgagcc

SEQ ID NO: 362417 - DNA, 25 bp, Mus musculus
tcctgaaggagtgtggcatgttcat

SEQ ID NO: 362418 - DNA, 25 bp, Mus musculus
tcctgaagtaggtgtaattattgag

SEQ ID NO: 362419 - DNA, 25 bp, Mus musculus
tcctgaagtgattttcctcgcatct

SEQ ID NO: 362420 - DNA, 25 bp, Mus musculus
tcctgaatacacaggccccagtgcc

SEQ ID NO: 362421 - DNA, 25 bp, Mus musculus
tcctgaatgacaagctccccgaggc

SEQ ID NO: 362422 - DNA, 25 bp, Mus musculus
tcctgaatgacaaggtggaggagcg

SEQ ID NO: 362423 - DNA, 25 bp, Mus musculus
tcctgaatgcagttggaatgccaag

SEQ ID NO: 362424 - DNA, 25 bp, Mus musculus
tcctgaatgtgagaagattacagta

SEQ ID NO: 362425 - DNA, 25 bp, Mus musculus
tcctgaatttatcaggaaacaaaag

SEQ ID NO: 362426 - DNA, 25 bp, Mus musculus
tcctgacagaaacacataaacctca

SEQ ID NO: 362427 - DNA, 25 bp, Mus musculus
tcctgacagaagatgattctgagga

SEQ ID NO: 362428 - DNA, 25 bp, Mus musculus
tcctgacagccagatgaatagagaa

SEQ ID NO: 362429 - DNA, 25 bp, Mus musculus
tcctgacagctgggatctccatctt

SEQ ID NO: 362430 - DNA, 25 bp, Mus musculus
tcctgacaggtagccaggcttggca

SEQ ID NO: 362431 - DNA, 25 bp, Mus musculus
tcctgaccaagagtggcaacagcat

SEQ ID NO: 362432 - DNA, 25 bp, Mus musculus
tcctgaccaccacacccagtgttgg

SEQ ID NO: 362433 - DNA, 25 bp, Mus musculus
tcctgaccagagagcttctgtgtgg

SEQ ID NO: 362434 - DNA, 25 bp, Mus musculus
tcctgacccagaaacaacttgagcc

SEQ ID NO: 362435 - DNA, 25 bp, Mus musculus
tcctgacccagccaaggcaggagca

SEQ ID NO: 362436 - DNA, 25 bp, Mus musculus
tcctgacctatctcgacgtcggatg

SEQ ID NO: 362437 - DNA, 25 bp, Mus musculus
tcctgacctctagttgggatgaatg

SEQ ID NO: 362438 - DNA, 25 bp, Mus musculus
tcctgaccttgcacgggctgcagga

SEQ ID NO: 362439 - DNA, 25 bp, Mus musculus
tcctgactacagaggatgcgtccga

SEQ ID NO: 362440 - DNA, 25 bp, Mus musculus
tcctgactacaggtacaatagagga

SEQ ID NO: 362441 - DNA, 25 bp, Mus musculus
tcctgactatatgatggggctgtgt

SEQ ID NO: 362442 - DNA, 25 bp, Mus musculus
tcctgactcagaagaaccaatcact

SEQ ID NO: 362443 - DNA, 25 bp, Mus musculus
tcctgactcagaaggtgtacagact

SEQ ID NO: 362444 - DNA, 25 bp, Mus musculus
tcctgactccgttcaacacacagaa

SEQ ID NO: 362445 - DNA, 25 bp, Mus musculus
tcctgactgcagcaggcaccagagt

SEQ ID NO: 362446 - DNA, 25 bp, Mus musculus
tcctgactggctggtttttcaacga

SEQ ID NO: 362447 - DNA, 25 bp, Mus musculus
tcctgactgtctacagtgtctagct

SEQ ID NO: 362448 - DNA, 25 bp, Mus musculus
tcctgacttgagaggcccaggatgg

SEQ ID NO: 362449 - DNA, 25 bp, Mus musculus
tcctgacttgagggagtgcccagct

SEQ ID NO: 362450 - DNA, 25 bp, Mus musculus
tcctgacttgagggtcctgagggag

SEQ ID NO: 362451 - DNA, 25 bp, Mus musculus
tcctgactttgggtaatgttctcct

SEQ ID NO: 362452 - DNA, 25 bp, Mus musculus
tcctgagaaaagggcagtcatggaa

SEQ ID NO: 362453 - DNA, 25 bp, Mus musculus
tcctgagaaacagtcatggaagtgc

SEQ ID NO: 362454 - DNA, 25 bp, Mus musculus
tcctgagaaaggtataaatgggtcg

SEQ ID NO: 362455 - DNA, 25 bp, Mus musculus
tcctgagaagtctggagaaatctgg

SEQ ID NO: 362456 - DNA, 25 bp, Mus musculus
tcctgagaatgaatgaacaaaacca

SEQ ID NO: 362457 - DNA, 25 bp, Mus musculus
tcctgagaatggtctctctgggatc

SEQ ID NO: 362458 - DNA, 25 bp, Mus musculus
tcctgagacaggctccgtccatgcc

SEQ ID NO: 362459 - DNA, 25 bp, Mus musculus
tcctgagacagggttgtgagccccg

SEQ ID NO: 362460 - DNA, 25 bp, Mus musculus
tcctgagatacaaggaaagaaagga

SEQ ID NO: 362461 - DNA, 25 bp, Mus musculus
tcctgagattaaagcattggatacc

SEQ ID NO: 362462 - DNA, 25 bp, Mus musculus
tcctgagattaaaggacaaccctcc

SEQ ID NO: 362463 - DNA, 25 bp, Mus musculus
tcctgagcaaaggctacaacaaggc

SEQ ID NO: 362464 - DNA, 25 bp, Mus musculus
tcctgagcagggacctgaggtgcag

SEQ ID NO: 362465 - DNA, 25 bp, Mus musculus
tcctgagcaggtcttgggacccatg

SEQ ID NO: 362466 - DNA, 25 bp, Mus musculus
tcctgagcaggttgtggatgtggct

SEQ ID NO: 362467 - DNA, 25 bp, Mus musculus
tcctgagccaggttgatgtaggagt

SEQ ID NO: 362468 - DNA, 25 bp, Mus musculus
tcctgagcccggctgtgctggatgc

SEQ ID NO: 362469 - DNA, 25 bp, Mus musculus
tcctgagccctgaagattttctgca

SEQ ID NO: 362470 - DNA, 25 bp, Mus musculus
tcctgagctctgcaggggactcctt

SEQ ID NO: 362471 - DNA, 25 bp, Mus musculus
tcctgagctggaagatttcatcctg

SEQ ID NO: 362472 - DNA, 25 bp, Mus musculus
tcctgaggaacagcgcatcgccatg

SEQ ID NO: 362473 - DNA, 25 bp, Mus musculus
tcctgaggacagagaaagagctaaa

SEQ ID NO: 362474 - DNA, 25 bp, Mus musculus
tcctgaggaccgtgttcgtaagcag

SEQ ID NO: 362475 - DNA, 25 bp, Mus musculus
tcctgaggactcaaggtaagaaatc

SEQ ID NO: 362476 - DNA, 25 bp, Mus musculus
tcctgaggactcaagtttcagagtg

SEQ ID NO: 362477 - DNA, 25 bp, Mus musculus
tcctgaggcgagcagctggtggccc

SEQ ID NO: 362478 - DNA, 25 bp, Mus musculus
tcctgaggcgagcagctgtggcccc

SEQ ID NO: 362479 - DNA, 25 bp, Mus musculus
tcctgaggctgtaagcaatggcttc

SEQ ID NO: 362480 - DNA, 25 bp, Mus musculus
tcctgaggtggatgtgtgggtgcag

SEQ ID NO: 362481 - DNA, 25 bp, Mus musculus
tcctgagtctcaagagccaaggaca

SEQ ID NO: 362482 - DNA, 25 bp, Mus musculus
tcctgagtgagcagaaaatgcgacc

SEQ ID NO: 362483 - DNA, 25 bp, Mus musculus
tcctgagtgccatggattggcgtct

SEQ ID NO: 362484 - DNA, 25 bp, Mus musculus
tcctgataaacttcccacgacagca

SEQ ID NO: 362485 - DNA, 25 bp, Mus musculus
tcctgatacaggagttccactccag

SEQ ID NO: 362486 - DNA, 25 bp, Mus musculus
tcctgataggcaggagatgagccgc

SEQ ID NO: 362487 - DNA, 25 bp, Mus musculus
tcctgatatctaatagcattccttt

SEQ ID NO: 362488 - DNA, 25 bp, Mus musculus
tcctgatcacaggacagctccctct

SEQ ID NO: 362489 - DNA, 25 bp, Mus musculus
tcctgatcagggctccagtggtcca

SEQ ID NO: 362490 - DNA, 25 bp, Mus musculus
tcctgatcaggtaatgtatgtggaa

SEQ ID NO: 362491 - DNA, 25 bp, Mus musculus
tcctgatctccgcatctcttcgccg

SEQ ID NO: 362492 - DNA, 25 bp, Mus musculus
tcctgatctgtgtgggcgggtgcat

SEQ ID NO: 362493 - DNA, 25 bp, Mus musculus
tcctgatgaaatgctttgaaccctg

SEQ ID NO: 362494 - DNA, 25 bp, Mus musculus
tcctgatgaaatggaaaaactctga

SEQ ID NO: 362495 - DNA, 25 bp, Mus musculus
tcctgatgaaatggtcttcttcccg

SEQ ID NO: 362496 - DNA, 25 bp, Mus musculus
tcctgatgaacaaaacagggatttg

SEQ ID NO: 362497 - DNA, 25 bp, Mus musculus
tcctgatgaagaccctcttgtgagg

SEQ ID NO: 362498 - DNA, 25 bp, Mus musculus
tcctgatgaaggactatgtgctggc

SEQ ID NO: 362499 - DNA, 25 bp, Mus musculus
tcctgatgaagttatagtgcctcgc

SEQ ID NO: 362500 - DNA, 25 bp, Mus musculus
tcctgatgaatgtcattggtctcag

SEQ ID NO: 362501 - DNA, 25 bp, Mus musculus
tcctgatgaggtttatcagcttatg

SEQ ID NO: 362502 - DNA, 25 bp, Mus musculus
tcctgatgcgggagcacagtcggac

SEQ ID NO: 362503 - DNA, 25 bp, Mus musculus
tcctgatgctgacggtcacagagct

SEQ ID NO: 362504 - DNA, 25 bp, Mus musculus
tcctgatggaaagaacagacaaggt

SEQ ID NO: 362505 - DNA, 25 bp, Mus musculus
tcctgatggaggtgcttgtcctggc

SEQ ID NO: 362506 - DNA, 25 bp, Mus musculus
tcctgatgggcaaggctgggtgggt

SEQ ID NO: 362507 - DNA, 25 bp, Mus musculus
tcctgattccgggactgcaggctac

SEQ ID NO: 362508 - DNA, 25 bp, Mus musculus
tcctgattgagggccgcaaacagga

SEQ ID NO: 362509 - DNA, 25 bp, Mus musculus
tcctgattgataatcctgctaccag

SEQ ID NO: 362510 - DNA, 25 bp, Mus musculus
tcctgcaaaaggctctgagtttctg

SEQ ID NO: 362511 - DNA, 25 bp, Mus musculus
tcctgcacaaggttctgaaccagct

SEQ ID NO: 362512 - DNA, 25 bp, Mus musculus
tcctgcacagattgcgctggctcca

SEQ ID NO: 362513 - DNA, 25 bp, Mus musculus
tcctgcacagcgggctgacggctga

SEQ ID NO: 362514 - DNA, 25 bp, Mus musculus
tcctgcaccaggaagagttgggctg

SEQ ID NO: 362515 - DNA, 25 bp, Mus musculus
tcctgcacccagaggcatcagaaaa

SEQ ID NO: 362516 - DNA, 25 bp, Mus musculus
tcctgcaccgcggaggctctgcaga

SEQ ID NO: 362517 - DNA, 25 bp, Mus musculus
tcctgcacctaccaaactggcatta

SEQ ID NO: 362518 - DNA, 25 bp, Mus musculus
tcctgcacgtgacagtgggctccct

SEQ ID NO: 362519 - DNA, 25 bp, Mus musculus
tcctgcactcaggtagtgacatggt

SEQ ID NO: 362520 - DNA, 25 bp, Mus musculus
tcctgcactttgaggaggaagagat

SEQ ID NO: 362521 - DNA, 25 bp, Mus musculus
tcctgcagaaagaggtacataatgc

SEQ ID NO: 362522 - DNA, 25 bp, Mus musculus
tcctgcagaaagaggtgaaaaaact

SEQ ID NO: 362523 - DNA, 25 bp, Mus musculus
tcctgcagaagcaccctaggataca

SEQ ID NO: 362524 - DNA, 25 bp, Mus musculus
tcctgcagagccacggtcaagatgc

SEQ ID NO: 362525 - DNA, 25 bp, Mus musculus
tcctgcagcaaagccaccatgccaa

SEQ ID NO: 362526 - DNA, 25 bp, Mus musculus
tcctgcagcaaaggccgatacaaag

SEQ ID NO: 362527 - DNA, 25 bp, Mus musculus
tcctgcagccagaagaatatccagt

SEQ ID NO: 362528 - DNA, 25 bp, Mus musculus
tcctgcagcgagcttcaagcgtgtt

SEQ ID NO: 362529 - DNA, 25 bp, Mus musculus
tcctgcagcgatatcgatgagtgcg

SEQ ID NO: 362530 - DNA, 25 bp, Mus musculus
tcctgcaggaccaggtgtcatttgg

SEQ ID NO: 362531 - DNA, 25 bp, Mus musculus
tcctgcaggaccaggtgtctgatct

SEQ ID NO: 362532 - DNA, 25 bp, Mus musculus
tcctgcaggaggcagcgggccgtga

SEQ ID NO: 362533 - DNA, 25 bp, Mus musculus
tcctgcatctgaagaggtggccatg

SEQ ID NO: 362534 - DNA, 25 bp, Mus musculus
tcctgcatcttccttcctaggcatc

SEQ ID NO: 362535 - DNA, 25 bp, Mus musculus
tcctgcatgcagtcagacttctcca

SEQ ID NO: 362536 - DNA, 25 bp, Mus musculus
tcctgcatgcagtcagtgcagccct

SEQ ID NO: 362537 - DNA, 25 bp, Mus musculus
tcctgcatgctgggtccttcaggac

SEQ ID NO: 362538 - DNA, 25 bp, Mus musculus
tcctgcatttggggttcctgctgga

SEQ ID NO: 362539 - DNA, 25 bp, Mus musculus
tcctgccacactggggtagcctttg

SEQ ID NO: 362540 - DNA, 25 bp, Mus musculus
tcctgccacagacagggccactgcc

SEQ ID NO: 362541 - DNA, 25 bp, Mus musculus
tcctgccacaggtactactgggcct

SEQ ID NO: 362542 - DNA, 25 bp, Mus musculus
tcctgccaccagcagccaggccaaa

SEQ ID NO: 362543 - DNA, 25 bp, Mus musculus
tcctgccacctggagatggtgtttc

SEQ ID NO: 362544 - DNA, 25 bp, Mus musculus
tcctgccagaaccacctgtagctct

SEQ ID NO: 362545 - DNA, 25 bp, Mus musculus
tcctgccagaggccctgcccgcctg

SEQ ID NO: 362546 - DNA, 25 bp, Mus musculus
tcctgccatccttgctcggcgtcct

SEQ ID NO: 362547 - DNA, 25 bp, Mus musculus
tcctgccatccttggtgaggctttc

SEQ ID NO: 362548 - DNA, 25 bp, Mus musculus
tcctgcccacctggtacttcctgtg

SEQ ID NO: 362549 - DNA, 25 bp, Mus musculus
tcctgcccacctggttcccagagct

SEQ ID NO: 362550 - DNA, 25 bp, Mus musculus
tcctgcccagctcaatggtggctct

SEQ ID NO: 362551 - DNA, 25 bp, Mus musculus
tcctgcccaggatggcagtacctgg

SEQ ID NO: 362552 - DNA, 25 bp, Mus musculus
tcctgcccaggtttgcacaccctta

SEQ ID NO: 362553 - DNA, 25 bp, Mus musculus
tcctgcccagtgggcagctgatcac

SEQ ID NO: 362554 - DNA, 25 bp, Mus musculus
tcctgcccagtgttgaagaaattgt

SEQ ID NO: 362555 - DNA, 25 bp, Mus musculus
tcctgccccacgggcttcagcagcg

SEQ ID NO: 362556 - DNA, 25 bp, Mus musculus
tcctgccccagaaaacatcggacca

SEQ ID NO: 362557 - DNA, 25 bp, Mus musculus
tcctgcccccagaacctggaccctt

SEQ ID NO: 362558 - DNA, 25 bp, Mus musculus
tcctgccccgtgaactgtgacaaac

SEQ ID NO: 362559 - DNA, 25 bp, Mus musculus
tcctgccccgtgaggagactgctca

SEQ ID NO: 362560 - DNA, 25 bp, Mus musculus
tcctgccctcactcggccgccgcgt

SEQ ID NO: 362561 - DNA, 25 bp, Mus musculus
tcctgccctcgctagttctgacggt

SEQ ID NO: 362562 - DNA, 25 bp, Mus musculus
tcctgccctgcagccagacagtgac

SEQ ID NO: 362563 - DNA, 25 bp, Mus musculus
tcctgccctgtgcaagtgccctctg

SEQ ID NO: 362564 - DNA, 25 bp, Mus musculus
tcctgccgcgacgagaaccccagac

SEQ ID NO: 362565 - DNA, 25 bp, Mus musculus
tcctgccgcgacgagccctgctggt

SEQ ID NO: 362566 - DNA, 25 bp, Mus musculus
tcctgccgcgacgagctgaggaggg

SEQ ID NO: 362567 - DNA, 25 bp, Mus musculus
tcctgccgctgctgggtggctgcgt

SEQ ID NO: 362568 - DNA, 25 bp, Mus musculus
tcctgcctaacaggtcgctgttatt

SEQ ID NO: 362569 - DNA, 25 bp, Mus musculus
tcctgcctacaggttaggccggggc

SEQ ID NO: 362570 - DNA, 25 bp, Mus musculus
tcctgcctagctttgtatagtccag

SEQ ID NO: 362571 - DNA, 25 bp, Mus musculus
tcctgcctattcaagatctgcacgt

SEQ ID NO: 362572 - DNA, 25 bp, Mus musculus
tcctgcctcagtaaaggccaaaaat

SEQ ID NO: 362573 - DNA, 25 bp, Mus musculus
tcctgcctcccaaggttgttaaaca

SEQ ID NO: 362574 - DNA, 25 bp, Mus musculus
tcctgcctcggttcctgtaaagctg

SEQ ID NO: 362575 - DNA, 25 bp, Mus musculus
tcctgcctctgggcggaaaaactga

SEQ ID NO: 362576 - DNA, 25 bp, Mus musculus
tcctgcctctgggttaacaatcaag

SEQ ID NO: 362577 - DNA, 25 bp, Mus musculus
tcctgcctgacctggagctgcagtt

SEQ ID NO: 362578 - DNA, 25 bp, Mus musculus
tcctgcctggtcagtgtcagctggt

SEQ ID NO: 362579 - DNA, 25 bp, Mus musculus
tcctgcctgtgccggcctttaatgt

SEQ ID NO: 362580 - DNA, 25 bp, Mus musculus
tcctgccttcctttctttgatgttg

SEQ ID NO: 362581 - DNA, 25 bp, Mus musculus
tcctgccttgacactagttgctggt

SEQ ID NO: 362582 - DNA, 25 bp, Mus musculus
tcctgccttgagagcttacccctca

SEQ ID NO: 362583 - DNA, 25 bp, Mus musculus
tcctgccttgaggatgacaagatcc

SEQ ID NO: 362584 - DNA, 25 bp, Mus musculus
tcctgccttgaggttcctagacaac

SEQ ID NO: 362585 - DNA, 25 bp, Mus musculus
tcctgccttgatgacagggtccctt

SEQ ID NO: 362586 - DNA, 25 bp, Mus musculus
tcctgccttgattggccctcctttt

SEQ ID NO: 362587 - DNA, 25 bp, Mus musculus
tcctgcctttgaggatgacatgcac

SEQ ID NO: 362588 - DNA, 25 bp, Mus musculus
tcctgcgattcaaccctcctgggat

SEQ ID NO: 362589 - DNA, 25 bp, Mus musculus
tcctgcgcgcgcccggcctggccat

SEQ ID NO: 362590 - DNA, 25 bp, Mus musculus
tcctgcggcaaggggacatgcttcg

SEQ ID NO: 362591 - DNA, 25 bp, Mus musculus
tcctgcggcgctagctaggcggccg

SEQ ID NO: 362592 - DNA, 25 bp, Mus musculus
tcctgcgggttttgctggaccgcag

SEQ ID NO: 362593 - DNA, 25 bp, Mus musculus
tcctgcgtgcagtgatcgtttcagc

SEQ ID NO: 362594 - DNA, 25 bp, Mus musculus
tcctgctaaggctagagcgcagaag

SEQ ID NO: 362595 - DNA, 25 bp, Mus musculus
tcctgctaagtgttcttgagtggaa

SEQ ID NO: 362596 - DNA, 25 bp, Mus musculus
tcctgctaccataggagactacacg

SEQ ID NO: 362597 - DNA, 25 bp, Mus musculus
tcctgctaccataggctccacttac

SEQ ID NO: 362598 - DNA, 25 bp, Mus musculus
tcctgctactccaggtttcttgaac

SEQ ID NO: 362599 - DNA, 25 bp, Mus musculus
tcctgctactcgcggttcccagagc

SEQ ID NO: 362600 - DNA, 25 bp, Mus musculus
tcctgctagagcgcatcccagcctt

SEQ ID NO: 362601 - DNA, 25 bp, Mus musculus
tcctgctaggagcagagatcaagtt

SEQ ID NO: 362602 - DNA, 25 bp, Mus musculus
tcctgctatcctaagtgatgtgcca

SEQ ID NO: 362603 - DNA, 25 bp, Mus musculus
tcctgctattcaaaacagcgtggaa

SEQ ID NO: 362604 - DNA, 25 bp, Mus musculus
tcctgctcaagttcgattggatccg

SEQ ID NO: 362605 - DNA, 25 bp, Mus musculus
tcctgctcaagttcttctctgtgtt

SEQ ID NO: 362606 - DNA, 25 bp, Mus musculus
tcctgctcagctcaggtactagaag

SEQ ID NO: 362607 - DNA, 25 bp, Mus musculus
tcctgctcaggagactgcttctaaa

SEQ ID NO: 362608 - DNA, 25 bp, Mus musculus
tcctgctcaggtgactcagaagaag

SEQ ID NO: 362609 - DNA, 25 bp, Mus musculus
tcctgctccaaggctacagctcccc

SEQ ID NO: 362610 - DNA, 25 bp, Mus musculus
tcctgctccaaggctacagctctca

SEQ ID NO: 362611 - DNA, 25 bp, Mus musculus
tcctgctcccaagcccttggacatc

SEQ ID NO: 362612 - DNA, 25 bp, Mus musculus
tcctgctcgaaacagatcagccagc

SEQ ID NO: 362613 - DNA, 25 bp, Mus musculus
tcctgctcgaaacagtagtttagta

SEQ ID NO: 362614 - DNA, 25 bp, Mus musculus
tcctgctctgaaagcttactgataa

SEQ ID NO: 362615 - DNA, 25 bp, Mus musculus
tcctgctctgctctgcctcggcaac

SEQ ID NO: 362616 - DNA, 25 bp, Mus musculus
tcctgctctggtggctccttgtgac

SEQ ID NO: 362617 - DNA, 25 bp, Mus musculus
tcctgctgaacgagggttcagccga

SEQ ID NO: 362618 - DNA, 25 bp, Mus musculus
tcctgctgacaagccgatacacctc

SEQ ID NO: 362619 - DNA, 25 bp, Mus musculus
tcctgctgaggcgagtaacaagaaa

SEQ ID NO: 362620 - DNA, 25 bp, Mus musculus
tcctgctgcagaacgagtttgttgt

SEQ ID NO: 362621 - DNA, 25 bp, Mus musculus
tcctgctgcaggctctggtccaaga

SEQ ID NO: 362622 - DNA, 25 bp, Mus musculus
tcctgctgcaggctgccaacagcta

SEQ ID NO: 362623 - DNA, 25 bp, Mus musculus
tcctgctgccctggaatcttccgac

SEQ ID NO: 362624 - DNA, 25 bp, Mus musculus
tcctgctgccctggagcctcaaacc

SEQ ID NO: 362625 - DNA, 25 bp, Mus musculus
tcctgctgcgctctgtgccaacgcg

SEQ ID NO: 362626 - DNA, 25 bp, Mus musculus
tcctgctgctaaagcttattgagcg

SEQ ID NO: 362627 - DNA, 25 bp, Mus musculus
tcctgctgctaaagggttatcacac

SEQ ID NO: 362628 - DNA, 25 bp, Mus musculus
tcctgctgctgaagaacttttccag

SEQ ID NO: 362629 - DNA, 25 bp, Mus musculus
tcctgctggagtgaggcctgccacc

SEQ ID NO: 362630 - DNA, 25 bp, Mus musculus
tcctgctggccagatagacaggaaa

SEQ ID NO: 362631 - DNA, 25 bp, Mus musculus
tcctgctggccggcattgaatgtcc

SEQ ID NO: 362632 - DNA, 25 bp, Mus musculus
tcctgctggtgtcagtgtctgaaag

SEQ ID NO: 362633 - DNA, 25 bp, Mus musculus
tcctgctgtaaaggctggctactgt

SEQ ID NO: 362634 - DNA, 25 bp, Mus musculus
tcctgctgtcccaggtgctcctggt

SEQ ID NO: 362635 - DNA, 25 bp, Mus musculus
tcctgctgtgaaatcttctattcca

SEQ ID NO: 362636 - DNA, 25 bp, Mus musculus
tcctgcttccggtgttccgaatgcc

SEQ ID NO: 362637 - DNA, 25 bp, Mus musculus
tcctgcttcctgccacagcacccac

SEQ ID NO: 362638 - DNA, 25 bp, Mus musculus
tcctgcttctgtgctaacctcagga

SEQ ID NO: 362639 - DNA, 25 bp, Mus musculus
tcctgcttggggtttgcccagatgg

SEQ ID NO: 362640 - DNA, 25 bp, Mus musculus
tcctgctttatgaccctctggagat

SEQ ID NO: 362641 - DNA, 25 bp, Mus musculus
tcctggaaaactgggcccattgact

SEQ ID NO: 362642 - DNA, 25 bp, Mus musculus
tcctggaaacgactacatcgaccag

SEQ ID NO: 362643 - DNA, 25 bp, Mus musculus
tcctggaaacgacttgtaccagggg

SEQ ID NO: 362644 - DNA, 25 bp, Mus musculus
tcctggaaaggtgatgtacaaagcc

SEQ ID NO: 362645 - DNA, 25 bp, Mus musculus
tcctggaaatccactgcagctcatg

SEQ ID NO: 362646 - DNA, 25 bp, Mus musculus
tcctggaaatgcacggggagatgtt

SEQ ID NO: 362647 - DNA, 25 bp, Mus musculus
tcctggaacaacagaaaatcaatct

SEQ ID NO: 362648 - DNA, 25 bp, Mus musculus
tcctggaacaacaggtcctcagaat

SEQ ID NO: 362649 - DNA, 25 bp, Mus musculus
tcctggaacagactaaggctggacc

SEQ ID NO: 362650 - DNA, 25 bp, Mus musculus
tcctggaacaggaacgttggcgggt

SEQ ID NO: 362651 - DNA, 25 bp, Mus musculus
tcctggaacaggtgacatgtatgaa

SEQ ID NO: 362652 - DNA, 25 bp, Mus musculus
tcctggaaccaaggtgatgaatctt

SEQ ID NO: 362653 - DNA, 25 bp, Mus musculus
tcctggaacggcagatcacagagca

SEQ ID NO: 362654 - DNA, 25 bp, Mus musculus
tcctggaacggcagcgtgttgagga

SEQ ID NO: 362655 - DNA, 25 bp, Mus musculus
tcctggaacggcaggtagagatgac

SEQ ID NO: 362656 - DNA, 25 bp, Mus musculus
tcctggaactatgtcttcagtacct

SEQ ID NO: 362657 - DNA, 25 bp, Mus musculus
tcctggaactcaagttggtgggaac

SEQ ID NO: 362658 - DNA, 25 bp, Mus musculus
tcctggaactcaagtttggacgtca

SEQ ID NO: 362659 - DNA, 25 bp, Mus musculus
tcctggaactgaataaaagctgtgg

SEQ ID NO: 362660 - DNA, 25 bp, Mus musculus
tcctggaactgtgttacatcctgaa

SEQ ID NO: 362661 - DNA, 25 bp, Mus musculus
tcctggaatcagcagccagtgagga

SEQ ID NO: 362662 - DNA, 25 bp, Mus musculus
tcctggaatgaagggagaagcaggt

SEQ ID NO: 362663 - DNA, 25 bp, Mus musculus
tcctggaatgccgccatgactaccc

SEQ ID NO: 362664 - DNA, 25 bp, Mus musculus
tcctggaatgtcatggccttatcac

SEQ ID NO: 362665 - DNA, 25 bp, Mus musculus
tcctggacaagaggggaagtccctg

SEQ ID NO: 362666 - DNA, 25 bp, Mus musculus
tcctggacaaggtagagcctcaggc

SEQ ID NO: 362667 - DNA, 25 bp, Mus musculus
tcctggacaccacagagctccttgg

SEQ ID NO: 362668 - DNA, 25 bp, Mus musculus
tcctggacaccacaggaaagaatgt

SEQ ID NO: 362669 - DNA, 25 bp, Mus musculus
tcctggacaggccaaccaggatctc

SEQ ID NO: 362670 - DNA, 25 bp, Mus musculus
tcctggacagtctgcacctgtctgg

SEQ ID NO: 362671 - DNA, 25 bp, Mus musculus
tcctggacattactggccagttcac

SEQ ID NO: 362672 - DNA, 25 bp, Mus musculus
tcctggaccccgagagccccaagga

SEQ ID NO: 362673 - DNA, 25 bp, Mus musculus
tcctggacctcctggtccaaatggt

SEQ ID NO: 362674 - DNA, 25 bp, Mus musculus
tcctggacctcggagaacttccagg

SEQ ID NO: 362675 - DNA, 25 bp, Mus musculus
tcctggacctcggagccacagagat

SEQ ID NO: 362676 - DNA, 25 bp, Mus musculus
tcctggacctcggagctgcccagac

SEQ ID NO: 362677 - DNA, 25 bp, Mus musculus
tcctggacctcggagggatgactcg

SEQ ID NO: 362678 - DNA, 25 bp, Mus musculus
tcctggacgccattcccccactttg

SEQ ID NO: 362679 - DNA, 25 bp, Mus musculus
tcctggacttcgggtcagtgaatgc

SEQ ID NO: 362680 - DNA, 25 bp, Mus musculus
tcctggacttcggtatatccaaagc

SEQ ID NO: 362681 - DNA, 25 bp, Mus musculus
tcctggagaagacaagtccatctac

SEQ ID NO: 362682 - DNA, 25 bp, Mus musculus
tcctggagacaagtagtcttttaca

SEQ ID NO: 362683 - DNA, 25 bp, Mus musculus
tcctggagagaaagacggtcgctga

SEQ ID NO: 362684 - DNA, 25 bp, Mus musculus
tcctggagaggagggtctagagaca

SEQ ID NO: 362685 - DNA, 25 bp, Mus musculus
tcctggagataggacgagtgaccaa

SEQ ID NO: 362686 - DNA, 25 bp, Mus musculus
tcctggagatgagaaataaagattt

SEQ ID NO: 362687 - DNA, 25 bp, Mus musculus
tcctggagatgagtcacagcccagc

SEQ ID NO: 362688 - DNA, 25 bp, Mus musculus
tcctggagcagacaggattatggaa

SEQ ID NO: 362689 - DNA, 25 bp, Mus musculus
tcctggagcagcctgactctgactc

SEQ ID NO: 362690 - DNA, 25 bp, Mus musculus
tcctggagccaggggtcttaccggt

SEQ ID NO: 362691 - DNA, 25 bp, Mus musculus
tcctggagcgttcactgtgagcctt

SEQ ID NO: 362692 - DNA, 25 bp, Mus musculus
tcctggagctagcatctagtgcttt

SEQ ID NO: 362693 - DNA, 25 bp, Mus musculus
tcctggagctaggtcattttacctg

SEQ ID NO: 362694 - DNA, 25 bp, Mus musculus
tcctggagctcagcttttccagacc

SEQ ID NO: 362695 - DNA, 25 bp, Mus musculus
tcctggagctgaacaaggagcaagc

SEQ ID NO: 362696 - DNA, 25 bp, Mus musculus
tcctggagctgtgcatccttttata

SEQ ID NO: 362697 - DNA, 25 bp, Mus musculus
tcctggagctgtggttcgttctccc

SEQ ID NO: 362698 - DNA, 25 bp, Mus musculus
tcctggaggagttctcagagtacat

SEQ ID NO: 362699 - DNA, 25 bp, Mus musculus
tcctggaggatcagttggcaaagct

SEQ ID NO: 362700 - DNA, 25 bp, Mus musculus
tcctggaggccagcatattcaggag

SEQ ID NO: 362701 - DNA, 25 bp, Mus musculus
tcctggagggcatatcctttttact

SEQ ID NO: 362702 - DNA, 25 bp, Mus musculus
tcctggagtagcctctccaggcaga

SEQ ID NO: 362703 - DNA, 25 bp, Mus musculus
tcctggagtagtcccaggcactctg

SEQ ID NO: 362704 - DNA, 25 bp, Mus musculus
tcctggagtcaagctggaaccacct

SEQ ID NO: 362705 - DNA, 25 bp, Mus musculus
tcctggagtcattagagtgttcagt

SEQ ID NO: 362706 - DNA, 25 bp, Mus musculus
tcctggagtcattaggggccctggg

SEQ ID NO: 362707 - DNA, 25 bp, Mus musculus
tcctggatcacactggatgcagcct

SEQ ID NO: 362708 - DNA, 25 bp, Mus musculus
tcctggatctgagggaaatctgctc

SEQ ID NO: 362709 - DNA, 25 bp, Mus musculus
tcctggatgaaaggtcgagatttca

SEQ ID NO: 362710 - DNA, 25 bp, Mus musculus
tcctggatgccaggcgcaagcggcg

SEQ ID NO: 362711 - DNA, 25 bp, Mus musculus
tcctggatgcgttaagatctccatg

SEQ ID NO: 362712 - DNA, 25 bp, Mus musculus
tcctggatgctcagacatggtgcct

SEQ ID NO: 362713 - DNA, 25 bp, Mus musculus
tcctggatgctcagagacaatgtct

SEQ ID NO: 362714 - DNA, 25 bp, Mus musculus
tcctggattgggtttatgcagaact

SEQ ID NO: 362715 - DNA, 25 bp, Mus musculus
tcctggattgggtttgaactcggag

SEQ ID NO: 362716 - DNA, 25 bp, Mus musculus
tcctggatttggggaatacacatgc

SEQ ID NO: 362717 - DNA, 25 bp, Mus musculus
tcctggatttgggggtcctgttaca

SEQ ID NO: 362718 - DNA, 25 bp, Mus musculus
tcctggcaagaggagcactcacccc

SEQ ID NO: 362719 - DNA, 25 bp, Mus musculus
tcctggcacagaaacatcatccaag

SEQ ID NO: 362720 - DNA, 25 bp, Mus musculus
tcctggcacagagaacctgtgctca

SEQ ID NO: 362721 - DNA, 25 bp, Mus musculus
tcctggcacagcaagcttccctggc

SEQ ID NO: 362722 - DNA, 25 bp, Mus musculus
tcctggcacaggtacaaagtgaaat

SEQ ID NO: 362723 - DNA, 25 bp, Mus musculus
tcctggcacccagaaggacctctta

SEQ ID NO: 362724 - DNA, 25 bp, Mus musculus
tcctggcactgcagagcaaaaaaac

SEQ ID NO: 362725 - DNA, 25 bp, Mus musculus
tcctggcactgcagtggagaaagca

SEQ ID NO: 362726 - DNA, 25 bp, Mus musculus
tcctggcagagacggagggcatgct

SEQ ID NO: 362727 - DNA, 25 bp, Mus musculus
tcctggcagcagacttttcacagat

SEQ ID NO: 362728 - DNA, 25 bp, Mus musculus
tcctggcaggagacctagaacttca

SEQ ID NO: 362729 - DNA, 25 bp, Mus musculus
tcctggcataaggatgctttcattg

SEQ ID NO: 362730 - DNA, 25 bp, Mus musculus
tcctggcataagggagctggtaagc

SEQ ID NO: 362731 - DNA, 25 bp, Mus musculus
tcctggcatgcggcctcctcctcca

SEQ ID NO: 362732 - DNA, 25 bp, Mus musculus
tcctggcatggtacttttctcactt

SEQ ID NO: 362733 - DNA, 25 bp, Mus musculus
tcctggccacgaaacactctctgga

SEQ ID NO: 362734 - DNA, 25 bp, Mus musculus
tcctggccatctcaggtgagttgga

SEQ ID NO: 362735 - DNA, 25 bp, Mus musculus
tcctggcccagcaaccttccctggc

SEQ ID NO: 362736 - DNA, 25 bp, Mus musculus
tcctggcccagcaatcttccctggt

SEQ ID NO: 362737 - DNA, 25 bp, Mus musculus
tcctggcccagcgggtacaccagga

SEQ ID NO: 362738 - DNA, 25 bp, Mus musculus
tcctggccccaaggtggccattgaa

SEQ ID NO: 362739 - DNA, 25 bp, Mus musculus
tcctggcccccaaggccatgaagaa

SEQ ID NO: 362740 - DNA, 25 bp, Mus musculus
tcctggccccccgcggacttccaat

SEQ ID NO: 362741 - DNA, 25 bp, Mus musculus
tcctggccctcagggacctgcaggt

SEQ ID NO: 362742 - DNA, 25 bp, Mus musculus
tcctggccgatgaggtaatcactgt

SEQ ID NO: 362743 - DNA, 25 bp, Mus musculus
tcctggccgatgagtaatatgcaga

SEQ ID NO: 362744 - DNA, 25 bp, Mus musculus
tcctggccgctcagaaaagatgtct

SEQ ID NO: 362745 - DNA, 25 bp, Mus musculus
tcctggccgctcagtgtcttaaaac

SEQ ID NO: 362746 - DNA, 25 bp, Mus musculus
tcctggcctatctcgacgtcggatg

SEQ ID NO: 362747 - DNA, 25 bp, Mus musculus
tcctggcctcagacctcacagtgga

SEQ ID NO: 362748 - DNA, 25 bp, Mus musculus
tcctggcctggtgtgcatcggccac

SEQ ID NO: 362749 - DNA, 25 bp, Mus musculus
tcctggccttgtcgggtgtgatcat

SEQ ID NO: 362750 - DNA, 25 bp, Mus musculus
tcctggcgagcggatctacgaagta

SEQ ID NO: 362751 - DNA, 25 bp, Mus musculus
tcctggcgttggagggtgctgagta

SEQ ID NO: 362752 - DNA, 25 bp, Mus musculus
tcctggctacactgggcgccctgtg

SEQ ID NO: 362753 - DNA, 25 bp, Mus musculus
tcctggctcaaggctttggctccct

SEQ ID NO: 362754 - DNA, 25 bp, Mus musculus
tcctggctccagatgacctcatccc

SEQ ID NO: 362755 - DNA, 25 bp, Mus musculus
tcctggctccagcggacgcccgtgg

SEQ ID NO: 362756 - DNA, 25 bp, Mus musculus
tcctggctctatccaggcttacaat

SEQ ID NO: 362757 - DNA, 25 bp, Mus musculus
tcctggctctctacctggccaatga

SEQ ID NO: 362758 - DNA, 25 bp, Mus musculus
tcctggctgaggtactttctgaacc

SEQ ID NO: 362759 - DNA, 25 bp, Mus musculus
tcctggcttgcacaccggggccctg

SEQ ID NO: 362760 - DNA, 25 bp, Mus musculus
tcctggcttgcagtgtgcctgcagt

SEQ ID NO: 362761 - DNA, 25 bp, Mus musculus
tcctggcttgccgggccctccaggt

SEQ ID NO: 362762 - DNA, 25 bp, Mus musculus
tcctgggaaagcaggggagaagtca

SEQ ID NO: 362763 - DNA, 25 bp, Mus musculus
tcctgggaaaggtgtggtatctctt

SEQ ID NO: 362764 - DNA, 25 bp, Mus musculus
tcctgggaactgcaggtaaggaact

SEQ ID NO: 362765 - DNA, 25 bp, Mus musculus
tcctgggaactgcagtttccctgca

SEQ ID NO: 362766 - DNA, 25 bp, Mus musculus
tcctgggacacacaggagagtacta

SEQ ID NO: 362767 - DNA, 25 bp, Mus musculus
tcctgggacacagagtcttcaagca

SEQ ID NO: 362768 - DNA, 25 bp, Mus musculus
tcctgggaccaactcagtacctgtg

SEQ ID NO: 362769 - DNA, 25 bp, Mus musculus
tcctgggacctggtcactcctgtcc

SEQ ID NO: 362770 - DNA, 25 bp, Mus musculus
tcctgggactcagatggaccacaca

SEQ ID NO: 362771 - DNA, 25 bp, Mus musculus
tcctgggagtccttttgtcctctgc

SEQ ID NO: 362772 - DNA, 25 bp, Mus musculus
tcctgggatcctataaatttgaaaa

SEQ ID NO: 362773 - DNA, 25 bp, Mus musculus
tcctgggatcctgggagaatttaga

SEQ ID NO: 362774 - DNA, 25 bp, Mus musculus
tcctgggatctgaacttcactggac

SEQ ID NO: 362775 - DNA, 25 bp, Mus musculus
tcctgggatctgctgtgtcccagga

SEQ ID NO: 362776 - DNA, 25 bp, Mus musculus
tcctgggatgtgccgacggtggttc

SEQ ID NO: 362777 - DNA, 25 bp, Mus musculus
tcctgggatgtgccggaatgcaggc

SEQ ID NO: 362778 - DNA, 25 bp, Mus musculus
tcctgggatgttgggtagcggaaag

SEQ ID NO: 362779 - DNA, 25 bp, Mus musculus
tcctgggattctgtctcaaaccatg

SEQ ID NO: 362780 - DNA, 25 bp, Mus musculus
tcctgggcacagaccgcgggacagt

SEQ ID NO: 362781 - DNA, 25 bp, Mus musculus
tcctgggcacctgactcagcgtgaa

SEQ ID NO: 362782 - DNA, 25 bp, Mus musculus
tcctgggcagactcagccatggtcc

SEQ ID NO: 362783 - DNA, 25 bp, Mus musculus
tcctgggcccaagaggcctcaaaga

SEQ ID NO: 362784 - DNA, 25 bp, Mus musculus
tcctgggcccaagaggcctcgtgga

SEQ ID NO: 362785 - DNA, 25 bp, Mus musculus
tcctgggcctaagttatgaggagtc

SEQ ID NO: 362786 - DNA, 25 bp, Mus musculus
tcctgggccttccagccatgctgca

SEQ ID NO: 362787 - DNA, 25 bp, Mus musculus
tcctgggcgcgctcggagacattcc

SEQ ID NO: 362788 - DNA, 25 bp, Mus musculus
tcctgggcgggagagatggatgcga

SEQ ID NO: 362789 - DNA, 25 bp, Mus musculus
tcctgggctgcatgcattgtggctg

SEQ ID NO: 362790 - DNA, 25 bp, Mus musculus
tcctgggctgggacgaagtagctca

SEQ ID NO: 362791 - DNA, 25 bp, Mus musculus
tcctgggcttggggaagtcccagat

SEQ ID NO: 362792 - DNA, 25 bp, Mus musculus
tcctggggagtgaggacagaacttt

SEQ ID NO: 362793 - DNA, 25 bp, Mus musculus
tcctggggatgcaggttctccgcca

SEQ ID NO: 362794 - DNA, 25 bp, Mus musculus
tcctggggatgggagtgagtgctgc

SEQ ID NO: 362795 - DNA, 25 bp, Mus musculus
tcctggggcagggcgggagagtatt

SEQ ID NO: 362796 - DNA, 25 bp, Mus musculus
tcctggggctgcgccggagcgcaga

SEQ ID NO: 362797 - DNA, 25 bp, Mus musculus
tcctgggggcagcagcaccatggcc

SEQ ID NO: 362798 - DNA, 25 bp, Mus musculus
tcctgggggcagcagcttcctggcc

SEQ ID NO: 362799 - DNA, 25 bp, Mus musculus
tcctgggggcagcaggatcccagtg

SEQ ID NO: 362800 - DNA, 25 bp, Mus musculus
tcctggggtacagattcccgtgggg

SEQ ID NO: 362801 - DNA, 25 bp, Mus musculus
tcctgggtacaggcaaccaagaacg

SEQ ID NO: 362802 - DNA, 25 bp, Mus musculus
tcctgggtacaggtcggccagtgag

SEQ ID NO: 362803 - DNA, 25 bp, Mus musculus
tcctgggtctcagattatacagaca

SEQ ID NO: 362804 - DNA, 25 bp, Mus musculus
tcctgggtctttcgaatccttcgaa

SEQ ID NO: 362805 - DNA, 25 bp, Mus musculus
tcctgggtgatgttttcagctttgt

SEQ ID NO: 362806 - DNA, 25 bp, Mus musculus
tcctgggtgcccgggatgaaagtgg

SEQ ID NO: 362807 - DNA, 25 bp, Mus musculus
tcctgggtggctctcccagggtggg

SEQ ID NO: 362808 - DNA, 25 bp, Mus musculus
tcctgggtgtggtcaacagctgagc

SEQ ID NO: 362809 - DNA, 25 bp, Mus musculus
tcctgggttaaggagagcacacagc

SEQ ID NO: 362810 - DNA, 25 bp, Mus musculus
tcctgggttcaggcatcagaaacac

SEQ ID NO: 362811 - DNA, 25 bp, Mus musculus
tcctgggttcaggtgtttccaggac

SEQ ID NO: 362812 - DNA, 25 bp, Mus musculus
tcctgggttccagaccagccacgat

SEQ ID NO: 362813 - DNA, 25 bp, Mus musculus
tcctgggttgcagcccagaggactt

SEQ ID NO: 362814 - DNA, 25 bp, Mus musculus
tcctgggttgcagttataataaaga

SEQ ID NO: 362815 - DNA, 25 bp, Mus musculus
tcctggtacagaccatattaaccag

SEQ ID NO: 362816 - DNA, 25 bp, Mus musculus
tcctggtacagaccatattgatcag

SEQ ID NO: 362817 - DNA, 25 bp, Mus musculus
tcctggtacagaggtatctacacaa

SEQ ID NO: 362818 - DNA, 25 bp, Mus musculus
tcctggtacagtgacagctcttact

SEQ ID NO: 362819 - DNA, 25 bp, Mus musculus
tcctggtaccagactctcatggaca

SEQ ID NO: 362820 - DNA, 25 bp, Mus musculus
tcctggtagtagatgtcccatatta

SEQ ID NO: 362821 - DNA, 25 bp, Mus musculus
tcctggtataactatggtatcgctg

SEQ ID NO: 362822 - DNA, 25 bp, Mus musculus
tcctggtatgatcccaggctccggc

SEQ ID NO: 362823 - DNA, 25 bp, Mus musculus
tcctggtcacaaggctccgacatga

SEQ ID NO: 362824 - DNA, 25 bp, Mus musculus
tcctggtcacaagtgcgaatctgtc

SEQ ID NO: 362825 - DNA, 25 bp, Mus musculus
tcctggtcatgagaggagaaagagt

SEQ ID NO: 362826 - DNA, 25 bp, Mus musculus
tcctggtcatgagaggagggcaggt

SEQ ID NO: 362827 - DNA, 25 bp, Mus musculus
tcctggtcccagcgcaggagcctgt

SEQ ID NO: 362828 - DNA, 25 bp, Mus musculus
tcctggtctatcctggccgcctggg

SEQ ID NO: 362829 - DNA, 25 bp, Mus musculus
tcctggtctatcctggggacctaaa

SEQ ID NO: 362830 - DNA, 25 bp, Mus musculus
tcctggtctatcctggtgatccact

SEQ ID NO: 362831 - DNA, 25 bp, Mus musculus
tcctggtctcaggaatctatgaata

SEQ ID NO: 362832 - DNA, 25 bp, Mus musculus
tcctggtctcaggtaatctccaaaa

SEQ ID NO: 362833 - DNA, 25 bp, Mus musculus
tcctggtctgagaggtcttcctgga

SEQ ID NO: 362834 - DNA, 25 bp, Mus musculus
tcctggtgccaagggcgaagctggt

SEQ ID NO: 362835 - DNA, 25 bp, Mus musculus
tcctggtgcctagatgctgaatgct

SEQ ID NO: 362836 - DNA, 25 bp, Mus musculus
tcctggtgcgagacaccccccaggc

SEQ ID NO: 362837 - DNA, 25 bp, Mus musculus
tcctggtgcgagagtcacccagcac

SEQ ID NO: 362838 - DNA, 25 bp, Mus musculus
tcctggtgctaatacaacctgtggg

SEQ ID NO: 362839 - DNA, 25 bp, Mus musculus
tcctggtgctaatcacagaactgtt

SEQ ID NO: 362840 - DNA, 25 bp, Mus musculus
tcctggtgctaatgtctgtgcgtcc

SEQ ID NO: 362841 - DNA, 25 bp, Mus musculus
tcctggtgctacctttttttgatcc

SEQ ID NO: 362842 - DNA, 25 bp, Mus musculus
tcctggtgctagcacaggttagtgt

SEQ ID NO: 362843 - DNA, 25 bp, Mus musculus
tcctggtgctagctggtgaagacac

SEQ ID NO: 362844 - DNA, 25 bp, Mus musculus
tcctggtgctaggagtggcctgcag

SEQ ID NO: 362845 - DNA, 25 bp, Mus musculus
tcctggtgctggagagcaaaaaaac

SEQ ID NO: 362846 - DNA, 25 bp, Mus musculus
tcctggtgctggagtggagaaagca

SEQ ID NO: 362847 - DNA, 25 bp, Mus musculus
tcctggtggcgggagcctttttctg

SEQ ID NO: 362848 - DNA, 25 bp, Mus musculus
tcctggtggcggggaaggcagatga

SEQ ID NO: 362849 - DNA, 25 bp, Mus musculus
tcctggtggctcagtttctacagtt

SEQ ID NO: 362850 - DNA, 25 bp, Mus musculus
tcctggtggtgaccgcagggaggcc

SEQ ID NO: 362851 - DNA, 25 bp, Mus musculus
tcctggtggtgcgtcttctgggacc

SEQ ID NO: 362852 - DNA, 25 bp, Mus musculus
tcctggtgtaaagggagatcgaggc

SEQ ID NO: 362853 - DNA, 25 bp, Mus musculus
tcctggtgtaaaggtagatcgaggc

SEQ ID NO: 362854 - DNA, 25 bp, Mus musculus
tcctggtgtcaaaggagaccaaggt

SEQ ID NO: 362855 - DNA, 25 bp, Mus musculus
tcctggtgttggagcccctgggaac

SEQ ID NO: 362856 - DNA, 25 bp, Mus musculus
tcctggtgttggagctctgtgatac

SEQ ID NO: 362857 - DNA, 25 bp, Mus musculus
tcctggtgttggaggaagtaaagct

SEQ ID NO: 362858 - DNA, 25 bp, Mus musculus
tcctggttacggtcatttggtgtct

SEQ ID NO: 362859 - DNA, 25 bp, Mus musculus
tcctggttcgcctgggtggcggctg

SEQ ID NO: 362860 - DNA, 25 bp, Mus musculus
tcctggttcggggccgtcgtgaccc

SEQ ID NO: 362861 - DNA, 25 bp, Mus musculus
tcctggtttaggagatcccagccat

SEQ ID NO: 362862 - DNA, 25 bp, Mus musculus
tcctggtttcacaggtcaactttgt

SEQ ID NO: 362863 - DNA, 25 bp, Mus musculus
tcctggtttgaagatcccaatactt

SEQ ID NO: 362864 - DNA, 25 bp, Mus musculus
tcctggtttgaaggtttggagtcga

SEQ ID NO: 362865 - DNA, 25 bp, Mus musculus
tcctggtttgggtccgtgttcacct

SEQ ID NO: 362866 - DNA, 25 bp, Mus musculus
tcctgtaaggacttaaatattttat

SEQ ID NO: 362867 - DNA, 25 bp, Mus musculus
tcctgtaaggagacgttcatttgaa

SEQ ID NO: 362868 - DNA, 25 bp, Mus musculus
tcctgtacaggttggcggacctcat

SEQ ID NO: 362869 - DNA, 25 bp, Mus musculus
tcctgtacccttgtggaccagcaga

SEQ ID NO: 362870 - DNA, 25 bp, Mus musculus
tcctgtactgcgtggtgacatctcc

SEQ ID NO: 362871 - DNA, 25 bp, Mus musculus
tcctgtacttgcgaaagcagttgac

SEQ ID NO: 362872 - DNA, 25 bp, Mus musculus
tcctgtacttggttcgtcaatgcat

SEQ ID NO: 362873 - DNA, 25 bp, Mus musculus
tcctgtagagagccatatacagaag

SEQ ID NO: 362874 - DNA, 25 bp, Mus musculus
tcctgtagaggtgaggcatgaaatt

SEQ ID NO: 362875 - DNA, 25 bp, Mus musculus
tcctgtagccaagaccacatccttc

SEQ ID NO: 362876 - DNA, 25 bp, Mus musculus
tcctgtagccaaggtcagattacct

SEQ ID NO: 362877 - DNA, 25 bp, Mus musculus
tcctgtagcgatgaagaaagaggaa

SEQ ID NO: 362878 - DNA, 25 bp, Mus musculus
tcctgtagttctgtgcatctgggtg

SEQ ID NO: 362879 - DNA, 25 bp, Mus musculus
tcctgtatcagggtgcgcaggcttg

SEQ ID NO: 362880 - DNA, 25 bp, Mus musculus
tcctgtatttaagaatgcaccaaac

SEQ ID NO: 362881 - DNA, 25 bp, Mus musculus
tcctgtatttaaggcccatctccga

SEQ ID NO: 362882 - DNA, 25 bp, Mus musculus
tcctgtatttaaggttcttggactt

SEQ ID NO: 362883 - DNA, 25 bp, Mus musculus
tcctgtcaatgcagcccagatggag

SEQ ID NO: 362884 - DNA, 25 bp, Mus musculus
tcctgtcaatgcagcttgttttagc

SEQ ID NO: 362885 - DNA, 25 bp, Mus musculus
tcctgtcaatgcaggcgacctggca

SEQ ID NO: 362886 - DNA, 25 bp, Mus musculus
tcctgtcagccggggcctcccccag

SEQ ID NO: 362887 - DNA, 25 bp, Mus musculus
tcctgtcagccggtaacctccgtgc

SEQ ID NO: 362888 - DNA, 25 bp, Mus musculus
tcctgtcaggccagatttggaccag

SEQ ID NO: 362889 - DNA, 25 bp, Mus musculus
tcctgtcaggtgctgatttcaacgt

SEQ ID NO: 362890 - DNA, 25 bp, Mus musculus
tcctgtccacacaggtttatgaagc

SEQ ID NO: 362891 - DNA, 25 bp, Mus musculus
tcctgtccaccctgttggcagaagc

SEQ ID NO: 362892 - DNA, 25 bp, Mus musculus
tcctgtccacgcggttctatggtac

SEQ ID NO: 362893 - DNA, 25 bp, Mus musculus
tcctgtccacgcgtgcagtctgcat

SEQ ID NO: 362894 - DNA, 25 bp, Mus musculus
tcctgtccagagagaacattataag

SEQ ID NO: 362895 - DNA, 25 bp, Mus musculus
tcctgtccagcaaatctcccagctg

SEQ ID NO: 362896 - DNA, 25 bp, Mus musculus
tcctgtccaggagagaacacaagct

SEQ ID NO: 362897 - DNA, 25 bp, Mus musculus
tcctgtcccgaaacaagccttcacc

SEQ ID NO: 362898 - DNA, 25 bp, Mus musculus
tcctgtccgaggatggatgccctga

SEQ ID NO: 362899 - DNA, 25 bp, Mus musculus
tcctgtcctcagaggtgtgctcctg

SEQ ID NO: 362900 - DNA, 25 bp, Mus musculus
tcctgtcctcagggaccgcagcagc

SEQ ID NO: 362901 - DNA, 25 bp, Mus musculus
tcctgtcctcagggccttcagggac

SEQ ID NO: 362902 - DNA, 25 bp, Mus musculus
tcctgtcctctcaaggctcaaactc

SEQ ID NO: 362903 - DNA, 25 bp, Mus musculus
tcctgtcgcagcctcggcctggcag

SEQ ID NO: 362904 - DNA, 25 bp, Mus musculus
tcctgtcgcctgtagttgcagcccc

SEQ ID NO: 362905 - DNA, 25 bp, Mus musculus
tcctgtcgctgtggctacgtgttct

SEQ ID NO: 362906 - DNA, 25 bp, Mus musculus
tcctgtcggcatggcagcccaccca

SEQ ID NO: 362907 - DNA, 25 bp, Mus musculus
tcctgtctacaaccgctcccaccaa

SEQ ID NO: 362908 - DNA, 25 bp, Mus musculus
tcctgtctacaaccggtggcaggat

SEQ ID NO: 362909 - DNA, 25 bp, Mus musculus
tcctgtctatggagaaaataagtcc

SEQ ID NO: 362910 - DNA, 25 bp, Mus musculus
tcctgtctgaccaggaaaagaaaga

SEQ ID NO: 362911 - DNA, 25 bp, Mus musculus
tcctgtctgagcgggaggaagcact

SEQ ID NO: 362912 - DNA, 25 bp, Mus musculus
tcctgtctgagctctttcctgtaat

SEQ ID NO: 362913 - DNA, 25 bp, Mus musculus
tcctgtctgagtggacgagcgaagg

SEQ ID NO: 362914 - DNA, 25 bp, Mus musculus
tcctgtctgcaagagaccgggctca

SEQ ID NO: 362915 - DNA, 25 bp, Mus musculus
tcctgtctttgggcagctcaaagag

SEQ ID NO: 362916 - DNA, 25 bp, Mus musculus
tcctgtcttttttgaaattggcacc

SEQ ID NO: 362917 - DNA, 25 bp, Mus musculus
tcctgtcttttttgctgagaaagtg

SEQ ID NO: 362918 - DNA, 25 bp, Mus musculus
tcctgtgaacactgagcctacacag

SEQ ID NO: 362919 - DNA, 25 bp, Mus musculus
tcctgtgaacactgcgaaattgccc

SEQ ID NO: 362920 - DNA, 25 bp, Mus musculus
tcctgtgaacaggttgatcgtgtcc

SEQ ID NO: 362921 - DNA, 25 bp, Mus musculus
tcctgtgaaccgatttaaaggaatt

SEQ ID NO: 362922 - DNA, 25 bp, Mus musculus
tcctgtgaagacagggccagtgcgg

SEQ ID NO: 362923 - DNA, 25 bp, Mus musculus
tcctgtgaagacatcaacgaatgca

SEQ ID NO: 362924 - DNA, 25 bp, Mus musculus
tcctgtgaagacatcaatgagtgtg

SEQ ID NO: 362925 - DNA, 25 bp, Mus musculus
tcctgtgaagaccaagacgagtgtt

SEQ ID NO: 362926 - DNA, 25 bp, Mus musculus
tcctgtgaagatattgacgaatgcg

SEQ ID NO: 362927 - DNA, 25 bp, Mus musculus
tcctgtgaagatgtggatgagtgct

SEQ ID NO: 362928 - DNA, 25 bp, Mus musculus
tcctgtgacgcgggtctgcaccggt

SEQ ID NO: 362929 - DNA, 25 bp, Mus musculus
tcctgtgagcaagaggaagcttttc

SEQ ID NO: 362930 - DNA, 25 bp, Mus musculus
tcctgtgagttagagttccagttac

SEQ ID NO: 362931 - DNA, 25 bp, Mus musculus
tcctgtgcaatgaccggggtcgctg

SEQ ID NO: 362932 - DNA, 25 bp, Mus musculus
tcctgtgcagaagattgataagtat

SEQ ID NO: 362933 - DNA, 25 bp, Mus musculus
tcctgtgcagcccagagaagagttt

SEQ ID NO: 362934 - DNA, 25 bp, Mus musculus
tcctgtgccaggaaagcactgccac

SEQ ID NO: 362935 - DNA, 25 bp, Mus musculus
tcctgtgccaggcaaggtgacccat

SEQ ID NO: 362936 - DNA, 25 bp, Mus musculus
tcctgtgcccacaagcctcccctcg

SEQ ID NO: 362937 - DNA, 25 bp, Mus musculus
tcctgtgcctatgcttataccatca

SEQ ID NO: 362938 - DNA, 25 bp, Mus musculus
tcctgtgcctcctagatgccctttg

SEQ ID NO: 362939 - DNA, 25 bp, Mus musculus
tcctgtgctacaaaaaactgagacg

SEQ ID NO: 362940 - DNA, 25 bp, Mus musculus
tcctgtgctacaagtccacacacgt

SEQ ID NO: 362941 - DNA, 25 bp, Mus musculus
tcctgtgctagtttcgcatttggct

SEQ ID NO: 362942 - DNA, 25 bp, Mus musculus
tcctgtggagagcctccaacgtgtt

SEQ ID NO: 362943 - DNA, 25 bp, Mus musculus
tcctgtggaggaaattgtgtcagag

SEQ ID NO: 362944 - DNA, 25 bp, Mus musculus
tcctgtggagtgtggattttatgga

SEQ ID NO: 362945 - DNA, 25 bp, Mus musculus
tcctgtggcaagggagtcatccagg

SEQ ID NO: 362946 - DNA, 25 bp, Mus musculus
tcctgtggctaagtaagaaatccag

SEQ ID NO: 362947 - DNA, 25 bp, Mus musculus
tcctgtggctaagtgactaataaac

SEQ ID NO: 362948 - DNA, 25 bp, Mus musculus
tcctgtggctaatcctgtctgtaga

SEQ ID NO: 362949 - DNA, 25 bp, Mus musculus
tcctgtggctaatttcagagtgata

SEQ ID NO: 362950 - DNA, 25 bp, Mus musculus
tcctgtggtgatcaggatctgcacc

SEQ ID NO: 362951 - DNA, 25 bp, Mus musculus
tcctgtgtccctcatacaactagac

SEQ ID NO: 362952 - DNA, 25 bp, Mus musculus
tcctgtgtccttgaggcccatctga

SEQ ID NO: 362953 - DNA, 25 bp, Mus musculus
tcctgtgtctccaatcgtggatgat

SEQ ID NO: 362954 - DNA, 25 bp, Mus musculus
tcctgtgtgaggtccctccagctat

SEQ ID NO: 362955 - DNA, 25 bp, Mus musculus
tcctgtgtgatctcagtaagttcta

SEQ ID NO: 362956 - DNA, 25 bp, Mus musculus
tcctgtgtgtataaagtacaacctg

SEQ ID NO: 362957 - DNA, 25 bp, Mus musculus
tcctgtgttacaagctaatggcact

SEQ ID NO: 362958 - DNA, 25 bp, Mus musculus
tcctgtgttacaagggactgagtgg

SEQ ID NO: 362959 - DNA, 25 bp, Mus musculus
tcctgtgtttgctagagggcaatgc

SEQ ID NO: 362960 - DNA, 25 bp, Mus musculus
tcctgttagctgaggtgccgacaat

SEQ ID NO: 362961 - DNA, 25 bp, Mus musculus
tcctgttatctccagaagtgacaga

SEQ ID NO: 362962 - DNA, 25 bp, Mus musculus
tcctgttatgacaagcccgtctcga

SEQ ID NO: 362963 - DNA, 25 bp, Mus musculus
tcctgttcaaccctgactctaaggg

SEQ ID NO: 362964 - DNA, 25 bp, Mus musculus
tcctgttcagcaccaacaccacctt

SEQ ID NO: 362965 - DNA, 25 bp, Mus musculus
tcctgttcagcaccatcagcaccag

SEQ ID NO: 362966 - DNA, 25 bp, Mus musculus
tcctgttcagggagaggcggtgaga

SEQ ID NO: 362967 - DNA, 25 bp, Mus musculus
tcctgttcaggtccgcgaatacctg

SEQ ID NO: 362968 - DNA, 25 bp, Mus musculus
tcctgttccaccatagccatcatag

SEQ ID NO: 362969 - DNA, 25 bp, Mus musculus
tcctgttccaggatggaggtaaagg

SEQ ID NO: 362970 - DNA, 25 bp, Mus musculus
tcctgttctgcagaccatcctgtca

SEQ ID NO: 362971 - DNA, 25 bp, Mus musculus
tcctgttctgcagacgaagacatgg

SEQ ID NO: 362972 - DNA, 25 bp, Mus musculus
tcctgttctgcatctcaccagcccc

SEQ ID NO: 362973 - DNA, 25 bp, Mus musculus
tcctgttcttatgcctgaaaaagac

SEQ ID NO: 362974 - DNA, 25 bp, Mus musculus
tcctgttgaaactttagccacttac

SEQ ID NO: 362975 - DNA, 25 bp, Mus musculus
tcctgttgaatgaccctcttccatt

SEQ ID NO: 362976 - DNA, 25 bp, Mus musculus
tcctgttgaggatattttctttcct

SEQ ID NO: 362977 - DNA, 25 bp, Mus musculus
tcctgttgaggcctggaatgtccta

SEQ ID NO: 362978 - DNA, 25 bp, Mus musculus
tcctgttgcagggccacaataccca

SEQ ID NO: 362979 - DNA, 25 bp, Mus musculus
tcctgttgcgcagcgtctcctgtaa

SEQ ID NO: 362980 - DNA, 25 bp, Mus musculus
tcctgttggagcgggcggcaggaaa

SEQ ID NO: 362981 - DNA, 25 bp, Mus musculus
tcctgttggataaaggataaggtag

SEQ ID NO: 362982 - DNA, 25 bp, Mus musculus
tcctgttggtggtcatcaactccag

SEQ ID NO: 362983 - DNA, 25 bp, Mus musculus
tcctgttgtgaataggatggagaca

SEQ ID NO: 362984 - DNA, 25 bp, Mus musculus
tcctgtttaaccatcagcagtgtta

SEQ ID NO: 362985 - DNA, 25 bp, Mus musculus
tcctgtttaagagttcagatgcctg

SEQ ID NO: 362986 - DNA, 25 bp, Mus musculus
tcctgtttcatttgggagaaccatg

SEQ ID NO: 362987 - DNA, 25 bp, Mus musculus
tcctgtttgcagtatgatctggaca

SEQ ID NO: 362988 - DNA, 25 bp, Mus musculus
tcctgtttggtcaggtggtacgtgg

SEQ ID NO: 362989 - DNA, 25 bp, Mus musculus
tcctgttttagaaccaaccgatgtt

SEQ ID NO: 362990 - DNA, 25 bp, Mus musculus
tcctgttttatggctggcctggtct

SEQ ID NO: 362991 - DNA, 25 bp, Mus musculus
tcctgttttccccttctgttgtact

SEQ ID NO: 362992 - DNA, 25 bp, Mus musculus
tccttaaaaggttatggctttcaga

SEQ ID NO: 362993 - DNA, 25 bp, Mus musculus
tccttaaacaagatccatgcataca

SEQ ID NO: 362994 - DNA, 25 bp, Mus musculus
tccttaaagggattggagctggagg

SEQ ID NO: 362995 - DNA, 25 bp, Mus musculus
tccttaaaggggcgacctggcattc

SEQ ID NO: 362996 - DNA, 25 bp, Mus musculus
tccttaaattgggaagatgctggtg

SEQ ID NO: 362997 - DNA, 25 bp, Mus musculus
tccttaacctgggatcgcttacact

SEQ ID NO: 362998 - DNA, 25 bp, Mus musculus
tccttaatccaggaagcatttgtca

SEQ ID NO: 362999 - DNA, 25 bp, Mus musculus
tccttaatgagatcctcacattagc

SEQ ID NO: 363000 - DNA, 25 bp, Mus musculus
tccttacacatacagagttcgttat

SEQ ID NO: 363001 - DNA, 25 bp, Mus musculus
tccttacagcaggtggccccttctg

SEQ ID NO: 363002 - DNA, 25 bp, Mus musculus
tccttacagcccaagcagccaccta

SEQ ID NO: 363003 - DNA, 25 bp, Mus musculus
tccttacaggagccaggccacagag

SEQ ID NO: 363004 - DNA, 25 bp, Mus musculus
tccttacaggtaaacagggattcga

SEQ ID NO: 363005 - DNA, 25 bp, Mus musculus
tccttacatgcgctgtaagatgaac

SEQ ID NO: 363006 - DNA, 25 bp, Mus musculus
tccttacatgctcctgaccacttga

SEQ ID NO: 363007 - DNA, 25 bp, Mus musculus
tccttaccacagaatccagattctc

SEQ ID NO: 363008 - DNA, 25 bp, Mus musculus
tccttaccacaggctccaagatttt

SEQ ID NO: 363009 - DNA, 25 bp, Mus musculus
tccttaccacaggtgctacttttcc

SEQ ID NO: 363010 - DNA, 25 bp, Mus musculus
tccttaccaggagatcgagactcat

SEQ ID NO: 363011 - DNA, 25 bp, Mus musculus
tccttaccagtgaggctgtgtctac

SEQ ID NO: 363012 - DNA, 25 bp, Mus musculus
tccttacctgcctggaaagccaaca

SEQ ID NO: 363013 - DNA, 25 bp, Mus musculus
tccttacctgcctgggtctgggatc

SEQ ID NO: 363014 - DNA, 25 bp, Mus musculus
tccttacggcaaagtctcatacatc

SEQ ID NO: 363015 - DNA, 25 bp, Mus musculus
tccttactgtcccgagaaggtgtag

SEQ ID NO: 363016 - DNA, 25 bp, Mus musculus
tccttacttcagaggagctggctct

SEQ ID NO: 363017 - DNA, 25 bp, Mus musculus
tccttacttcagtacaggtcaagtt

SEQ ID NO: 363018 - DNA, 25 bp, Mus musculus
tccttagagcagaacatctggccct

SEQ ID NO: 363019 - DNA, 25 bp, Mus musculus
tccttagcaaccttccatggctcag

SEQ ID NO: 363020 - DNA, 25 bp, Mus musculus
tccttagcaagcataaacagattcc

SEQ ID NO: 363021 - DNA, 25 bp, Mus musculus
tccttagcaaggtcaacaacagtcc

SEQ ID NO: 363022 - DNA, 25 bp, Mus musculus
tccttaggaggaatgccctgctgga

SEQ ID NO: 363023 - DNA, 25 bp, Mus musculus
tccttaggaggaatggcctactgaa

SEQ ID NO: 363024 - DNA, 25 bp, Mus musculus
tccttaggtttgcagatgatacgta

SEQ ID NO: 363025 - DNA, 25 bp, Mus musculus
tccttaggtttgcatgggacacagc

SEQ ID NO: 363026 - DNA, 25 bp, Mus musculus
tccttagtaaaacttacctcactgt

SEQ ID NO: 363027 - DNA, 25 bp, Mus musculus
tccttagtcaccagtgccagcggat

SEQ ID NO: 363028 - DNA, 25 bp, Mus musculus
tccttagtcagacgcgcacggacca

SEQ ID NO: 363029 - DNA, 25 bp, Mus musculus
tccttatagtctgattcctttctcc

SEQ ID NO: 363030 - DNA, 25 bp, Mus musculus
tccttatattaaaaggtgtccagtg

SEQ ID NO: 363031 - DNA, 25 bp, Mus musculus
tccttatcagacgaaagagcctgtg

SEQ ID NO: 363032 - DNA, 25 bp, Mus musculus
tccttatcagaggtcgactcatgga

SEQ ID NO: 363033 - DNA, 25 bp, Mus musculus
tccttatcaggaactcaataaacat

SEQ ID NO: 363034 - DNA, 25 bp, Mus musculus
tccttatcaggacgcacatgcaaaa

SEQ ID NO: 363035 - DNA, 25 bp, Mus musculus
tccttatcagtcaggattctgaatc

SEQ ID NO: 363036 - DNA, 25 bp, Mus musculus
tccttatcagtgtagcccagtgaat

SEQ ID NO: 363037 - DNA, 25 bp, Mus musculus
tccttatcatccttagcaagagatg

SEQ ID NO: 363038 - DNA, 25 bp, Mus musculus
tccttatcccactctgcccgacctc

SEQ ID NO: 363039 - DNA, 25 bp, Mus musculus
tccttatctaacagtgtcattcaga

SEQ ID NO: 363040 - DNA, 25 bp, Mus musculus
tccttatctacgagaccctcctctg

SEQ ID NO: 363041 - DNA, 25 bp, Mus musculus
tccttatctatttttcatcatcggg

SEQ ID NO: 363042 - DNA, 25 bp, Mus musculus
tccttatgacaggttctgtccattc

SEQ ID NO: 363043 - DNA, 25 bp, Mus musculus
tccttatggcaggtgctgacctgag

SEQ ID NO: 363044 - DNA, 25 bp, Mus musculus
tccttatggccaatgaggtcactcg

SEQ ID NO: 363045 - DNA, 25 bp, Mus musculus
tccttatggccaatggtcagttggt

SEQ ID NO: 363046 - DNA, 25 bp, Mus musculus
tccttattaccacagcgtttatgtt

SEQ ID NO: 363047 - DNA, 25 bp, Mus musculus
tccttattaccacaggaactgcatg

SEQ ID NO: 363048 - DNA, 25 bp, Mus musculus
tccttatttctgtgacagctatatt

SEQ ID NO: 363049 - DNA, 25 bp, Mus musculus
tccttcaaagcagaagcctcctgcc

SEQ ID NO: 363050 - DNA, 25 bp, Mus musculus
tccttcaattaccagggtgaaagaa

SEQ ID NO: 363051 - DNA, 25 bp, Mus musculus
tccttcacaacagcgaggtgtacca

SEQ ID NO: 363052 - DNA, 25 bp, Mus musculus
tccttcacaggagagatagacccag

SEQ ID NO: 363053 - DNA, 25 bp, Mus musculus
tccttcaccaatttatcaaaagttt

SEQ ID NO: 363054 - DNA, 25 bp, Mus musculus
tccttcacccgggaggaagctgatg

SEQ ID NO: 363055 - DNA, 25 bp, Mus musculus
tccttcacgaaagaacttatttgtc

SEQ ID NO: 363056 - DNA, 25 bp, Mus musculus
tccttcacgtggttggaaattgatg

SEQ ID NO: 363057 - DNA, 25 bp, Mus musculus
tccttcacgtggttggaatgtggtg

SEQ ID NO: 363058 - DNA, 25 bp, Mus musculus
tccttcacgttgggttcgccaagca

SEQ ID NO: 363059 - DNA, 25 bp, Mus musculus
tccttcactctagcccatccagtcc

SEQ ID NO: 363060 - DNA, 25 bp, Mus musculus
tccttcagacctctcctgagatggg

SEQ ID NO: 363061 - DNA, 25 bp, Mus musculus
tccttcagagaaacagcagcaccat

SEQ ID NO: 363062 - DNA, 25 bp, Mus musculus
tccttcagctacgaaccaaaaacca

SEQ ID NO: 363063 - DNA, 25 bp, Mus musculus
tccttcaggaaccatatcctaggca

SEQ ID NO: 363064 - DNA, 25 bp, Mus musculus
tccttcaggaaccatatgactgctt

SEQ ID NO: 363065 - DNA, 25 bp, Mus musculus
tccttcaggaaccatattctgtttt

SEQ ID NO: 363066 - DNA, 25 bp, Mus musculus
tccttcaggaaggtggtcagcgcgc

SEQ ID NO: 363067 - DNA, 25 bp, Mus musculus
tccttcaggacaaggttttcaaaat

SEQ ID NO: 363068 - DNA, 25 bp, Mus musculus
tccttcaggaccccaaggtcatgat

SEQ ID NO: 363069 - DNA, 25 bp, Mus musculus
tccttcaggtgtactcctccctttc

SEQ ID NO: 363070 - DNA, 25 bp, Mus musculus
tccttcaggtgtactcctctctttt

SEQ ID NO: 363071 - DNA, 25 bp, Mus musculus
tccttcagtgaggaggcttacatcc

SEQ ID NO: 363072 - DNA, 25 bp, Mus musculus
tccttcagtggctcggatgttcagc

SEQ ID NO: 363073 - DNA, 25 bp, Mus musculus
tccttcatagaagatcaagatgtag

SEQ ID NO: 363074 - DNA, 25 bp, Mus musculus
tccttcatagaaggtacttcaagag

SEQ ID NO: 363075 - DNA, 25 bp, Mus musculus
tccttcatagaaggttctcattgtg

SEQ ID NO: 363076 - DNA, 25 bp, Mus musculus
tccttcatccgctctgctttccggg

SEQ ID NO: 363077 - DNA, 25 bp, Mus musculus
tccttcatgacagaggacatttgac

SEQ ID NO: 363078 - DNA, 25 bp, Mus musculus
tccttcatgacagatttctcaggaa

SEQ ID NO: 363079 - DNA, 25 bp, Mus musculus
tccttccaaaaggcccacagcagca

SEQ ID NO: 363080 - DNA, 25 bp, Mus musculus
tccttccaaagaggatttgttggta

SEQ ID NO: 363081 - DNA, 25 bp, Mus musculus
tccttccaaagggtgatgtcttccc

SEQ ID NO: 363082 - DNA, 25 bp, Mus musculus
tccttccaactcaggctgcttctga

SEQ ID NO: 363083 - DNA, 25 bp, Mus musculus
tccttccaagactcagattagcccc

SEQ ID NO: 363084 - DNA, 25 bp, Mus musculus
tccttccacaagaagaacgagacga

SEQ ID NO: 363085 - DNA, 25 bp, Mus musculus
tccttccacaagtttcctcttactc

SEQ ID NO: 363086 - DNA, 25 bp, Mus musculus
tccttccacaatcggtattaccaga

SEQ ID NO: 363087 - DNA, 25 bp, Mus musculus
tccttccacagacttcccaagaaag

SEQ ID NO: 363088 - DNA, 25 bp, Mus musculus
tccttccacagctgctccgaaagac

SEQ ID NO: 363089 - DNA, 25 bp, Mus musculus
tccttccagtgagcttgcttcccag

SEQ ID NO: 363090 - DNA, 25 bp, Mus musculus
tccttccagtgggatgatctggccc

SEQ ID NO: 363091 - DNA, 25 bp, Mus musculus
tccttccatggctgtgacccaatta

SEQ ID NO: 363092 - DNA, 25 bp, Mus musculus
tccttccattatgtatagcagtgtt

SEQ ID NO: 363093 - DNA, 25 bp, Mus musculus
tccttcccaggagtacacggtcatt

SEQ ID NO: 363094 - DNA, 25 bp, Mus musculus
tccttcccagtggggctcaagagtg

SEQ ID NO: 363095 - DNA, 25 bp, Mus musculus
tccttcccagtggggtacatgtacc

SEQ ID NO: 363096 - DNA, 25 bp, Mus musculus
tccttcccatttgattgagaaatgt

SEQ ID NO: 363097 - DNA, 25 bp, Mus musculus
tccttccctgagcatagtaacattc

SEQ ID NO: 363098 - DNA, 25 bp, Mus musculus
tccttccctgcacctccgcacctgt

SEQ ID NO: 363099 - DNA, 25 bp, Mus musculus
tccttccgacccctacttcagcacc

SEQ ID NO: 363100 - DNA, 25 bp, Mus musculus
tccttccgtctatagccaagcagaa

SEQ ID NO: 363101 - DNA, 25 bp, Mus musculus
tccttccgtctataggcggaacatg

SEQ ID NO: 363102 - DNA, 25 bp, Mus musculus
tccttccgttcagcggacgccgcgg

SEQ ID NO: 363103 - DNA, 25 bp, Mus musculus
tccttcctatgggctggtggaatat

SEQ ID NO: 363104 - DNA, 25 bp, Mus musculus
tccttcctcagctactgtgactact

SEQ ID NO: 363105 - DNA, 25 bp, Mus musculus
tccttcctccaggagccggccaccc

SEQ ID NO: 363106 - DNA, 25 bp, Mus musculus
tccttcctgccccttccatcaagat

SEQ ID NO: 363107 - DNA, 25 bp, Mus musculus
tccttcctgtcagggattgtgccat

SEQ ID NO: 363108 - DNA, 25 bp, Mus musculus
tccttcctgtgccccacagattacc

SEQ ID NO: 363109 - DNA, 25 bp, Mus musculus
tccttcctgttggcaaccgtgtctt

SEQ ID NO: 363110 - DNA, 25 bp, Mus musculus
tccttcctgttgggcatctcctatg

SEQ ID NO: 363111 - DNA, 25 bp, Mus musculus
tccttccttcagaagagttcgctcc

SEQ ID NO: 363112 - DNA, 25 bp, Mus musculus
tccttccttttgggcagcaaggcga

SEQ ID NO: 363113 - DNA, 25 bp, Mus musculus
tccttccttttgtgagatttttttg

SEQ ID NO: 363114 - DNA, 25 bp, Mus musculus
tccttccttttgttttcagctttgt

SEQ ID NO: 363115 - DNA, 25 bp, Mus musculus
tccttcgccacagaaatggcctcca

SEQ ID NO: 363116 - DNA, 25 bp, Mus musculus
tccttcgcctcagaggtcgagccca

SEQ ID NO: 363117 - DNA, 25 bp, Mus musculus
tccttcgcctcagaggtggcatgca

SEQ ID NO: 363118 - DNA, 25 bp, Mus musculus
tccttcggaggagccagttcttgcc

SEQ ID NO: 363119 - DNA, 25 bp, Mus musculus
tccttcgttgccaggagatggcctg

SEQ ID NO: 363120 - DNA, 25 bp, Mus musculus
tccttctaagattggtgtccctttt

SEQ ID NO: 363121 - DNA, 25 bp, Mus musculus
tccttctaatcccaagcacggtaga

SEQ ID NO: 363122 - DNA, 25 bp, Mus musculus
tccttctacagagccttggggattc

SEQ ID NO: 363123 - DNA, 25 bp, Mus musculus
tccttctacagtgctcctttgtcct

SEQ ID NO: 363124 - DNA, 25 bp, Mus musculus
tccttctagcaggcctgcctacttt

SEQ ID NO: 363125 - DNA, 25 bp, Mus musculus
tccttctagccagctgcagacggag

SEQ ID NO: 363126 - DNA, 25 bp, Mus musculus
tccttctccactacctcctccacct

SEQ ID NO: 363127 - DNA, 25 bp, Mus musculus
tccttctccagattatctgcaatgc

SEQ ID NO: 363128 - DNA, 25 bp, Mus musculus
tccttctccagcagcaagagccaga

SEQ ID NO: 363129 - DNA, 25 bp, Mus musculus
tccttctccagcaggacccaacctc

SEQ ID NO: 363130 - DNA, 25 bp, Mus musculus
tccttctcccaggaagtgatcccaa

SEQ ID NO: 363131 - DNA, 25 bp, Mus musculus
tccttctgagagctgtccagctcgc

SEQ ID NO: 363132 - DNA, 25 bp, Mus musculus
tccttctgagccaatagtaaccagc

SEQ ID NO: 363133 - DNA, 25 bp, Mus musculus
tccttctgcggaatggggtgagtga

SEQ ID NO: 363134 - DNA, 25 bp, Mus musculus
tccttctgcggagaacgttttagag

SEQ ID NO: 363135 - DNA, 25 bp, Mus musculus
tccttctggcttctggctccaggcc

SEQ ID NO: 363136 - DNA, 25 bp, Mus musculus
tccttctgggataaaaagaagcaag

SEQ ID NO: 363137 - DNA, 25 bp, Mus musculus
tccttctggtgccagctctaggaat

SEQ ID NO: 363138 - DNA, 25 bp, Mus musculus
tccttctggttctggctgatctctt

SEQ ID NO: 363139 - DNA, 25 bp, Mus musculus
tccttctgtaggtgtgctgatgatg

SEQ ID NO: 363140 - DNA, 25 bp, Mus musculus
tccttctgtccctcccctttctccc

SEQ ID NO: 363141 - DNA, 25 bp, Mus musculus
tccttctgtggagcggatgtgggtg

SEQ ID NO: 363142 - DNA, 25 bp, Mus musculus
tccttcttcttcaggcaacagactt

SEQ ID NO: 363143 - DNA, 25 bp, Mus musculus
tccttcttcttcaggttgccagtca

SEQ ID NO: 363144 - DNA, 25 bp, Mus musculus
tccttcttgtggccctattgtgtgc

SEQ ID NO: 363145 - DNA, 25 bp, Mus musculus
tccttctttgaaagacactacgcac

SEQ ID NO: 363146 - DNA, 25 bp, Mus musculus
tccttgaaagacctgcctggagttg

SEQ ID NO: 363147 - DNA, 25 bp, Mus musculus
tccttgaagaggagcagacagatct

SEQ ID NO: 363148 - DNA, 25 bp, Mus musculus
tccttgaagaggttgcccacggacc

SEQ ID NO: 363149 - DNA, 25 bp, Mus musculus
tccttgaatacctctgcaggtgtca

SEQ ID NO: 363150 - DNA, 25 bp, Mus musculus
tccttgacaccagggtggacccagt

SEQ ID NO: 363151 - DNA, 25 bp, Mus musculus
tccttgacgtctaagattcctgctc

SEQ ID NO: 363152 - DNA, 25 bp, Mus musculus
tccttgactctcggtgtcctccacc

SEQ ID NO: 363153 - DNA, 25 bp, Mus musculus
tccttgactttgaaggttgtcttga

SEQ ID NO: 363154 - DNA, 25 bp, Mus musculus
tccttgagcatgatgttgccatccc

SEQ ID NO: 363155 - DNA, 25 bp, Mus musculus
tccttgagcatgcaccagccacaac

SEQ ID NO: 363156 - DNA, 25 bp, Mus musculus
tccttgaggcagctggaagctggcc

SEQ ID NO: 363157 - DNA, 25 bp, Mus musculus
tccttgagtcgatgtgcctgagacg

SEQ ID NO: 363158 - DNA, 25 bp, Mus musculus
tccttgagtggggactgtcagggca

SEQ ID NO: 363159 - DNA, 25 bp, Mus musculus
tccttgataagctcgttggcgagtt

SEQ ID NO: 363160 - DNA, 25 bp, Mus musculus
tccttgatacgtttggaaagctggt

SEQ ID NO: 363161 - DNA, 25 bp, Mus musculus
tccttgatacgtttggaaatgttcc

SEQ ID NO: 363162 - DNA, 25 bp, Mus musculus
tccttgatctcagatctgcagactc

SEQ ID NO: 363163 - DNA, 25 bp, Mus musculus
tccttgatctcaggtgattactgac

SEQ ID NO: 363164 - DNA, 25 bp, Mus musculus
tccttgatgtcggtggcgcccaggg

SEQ ID NO: 363165 - DNA, 25 bp, Mus musculus
tccttgcaacactctgggttatgac

SEQ ID NO: 363166 - DNA, 25 bp, Mus musculus
tccttgcaggaaaagagttcctggt

SEQ ID NO: 363167 - DNA, 25 bp, Mus musculus
tccttgcatccagggatgcaggcag

SEQ ID NO: 363168 - DNA, 25 bp, Mus musculus
tccttgcatccagggatgttaattt

SEQ ID NO: 363169 - DNA, 25 bp, Mus musculus
tccttgcatgagacacacaaccttt

SEQ ID NO: 363170 - DNA, 25 bp, Mus musculus
tccttgcatgatatggcataagata

SEQ ID NO: 363171 - DNA, 25 bp, Mus musculus
tccttgcgacaacagatggagaagt

SEQ ID NO: 363172 - DNA, 25 bp, Mus musculus
tccttgcgccacagactcttccaag

SEQ ID NO: 363173 - DNA, 25 bp, Mus musculus
tccttgctatgaacacccctggcta

SEQ ID NO: 363174 - DNA, 25 bp, Mus musculus
tccttgctattgctcctgggcctgc

SEQ ID NO: 363175 - DNA, 25 bp, Mus musculus
tccttgctgctcctggtaacttcaa

SEQ ID NO: 363176 - DNA, 25 bp, Mus musculus
tccttgcttaatagacttggtcccc

SEQ ID NO: 363177 - DNA, 25 bp, Mus musculus
tccttgcttaataggtgtgtcctct

SEQ ID NO: 363178 - DNA, 25 bp, Mus musculus
tccttggaatcgcagttactgtggg

SEQ ID NO: 363179 - DNA, 25 bp, Mus musculus
tccttggacagatgaaaaagagaaa

SEQ ID NO: 363180 - DNA, 25 bp, Mus musculus
tccttggacagtaattttatgaata

SEQ ID NO: 363181 - DNA, 25 bp, Mus musculus
tccttggagaatggttataagtaca

SEQ ID NO: 363182 - DNA, 25 bp, Mus musculus
tccttggagagacagaacaaggatt

SEQ ID NO: 363183 - DNA, 25 bp, Mus musculus
tccttggatggcagctgtccggcag

SEQ ID NO: 363184 - DNA, 25 bp, Mus musculus
tccttggcagaagctctgcagatcc

SEQ ID NO: 363185 - DNA, 25 bp, Mus musculus
tccttggcagaaggtagcacggctt

SEQ ID NO: 363186 - DNA, 25 bp, Mus musculus
tccttggcagcaggaggagccatct

SEQ ID NO: 363187 - DNA, 25 bp, Mus musculus
tccttggccttcagagctccagata

SEQ ID NO: 363188 - DNA, 25 bp, Mus musculus
tccttggctcatcagcagttattca

SEQ ID NO: 363189 - DNA, 25 bp, Mus musculus
tccttggctgaccacgatattttca

SEQ ID NO: 363190 - DNA, 25 bp, Mus musculus
tccttggctgaccaggatattttca

SEQ ID NO: 363191 - DNA, 25 bp, Mus musculus
tccttggctggcagcacagactctg

SEQ ID NO: 363192 - DNA, 25 bp, Mus musculus
tccttggctggcgtatgaggagtgg

SEQ ID NO: 363193 - DNA, 25 bp, Mus musculus
tccttggctggcgtgaggccaaagc

SEQ ID NO: 363194 - DNA, 25 bp, Mus musculus
tccttggctgggaaaatgacccagc

SEQ ID NO: 363195 - DNA, 25 bp, Mus musculus
tccttggctgggggaagaacagttc

SEQ ID NO: 363196 - DNA, 25 bp, Mus musculus
tccttggcttgcagataaaaatata

SEQ ID NO: 363197 - DNA, 25 bp, Mus musculus
tccttgggaggttctggctgcccat

SEQ ID NO: 363198 - DNA, 25 bp, Mus musculus
tccttgggccaacacctgaatctcc

SEQ ID NO: 363199 - DNA, 25 bp, Mus musculus
tccttgggcttgacgacaatggagg

SEQ ID NO: 363200 - DNA, 25 bp, Mus musculus
tccttgggcttgacgtgtccaacct

SEQ ID NO: 363201 - DNA, 25 bp, Mus musculus
tccttggggcgcagacatgtctttt

SEQ ID NO: 363202 - DNA, 25 bp, Mus musculus
tccttggggcgcaggacccaagttt

SEQ ID NO: 363203 - DNA, 25 bp, Mus musculus
tccttggtcccagctgtgcagtgcc

SEQ ID NO: 363204 - DNA, 25 bp, Mus musculus
tccttgtaacaagcttaaatccagt

SEQ ID NO: 363205 - DNA, 25 bp, Mus musculus
tccttgtacagcaggcaggcaacct

SEQ ID NO: 363206 - DNA, 25 bp, Mus musculus
tccttgtcaaacccaacagttccca

SEQ ID NO: 363207 - DNA, 25 bp, Mus musculus
tccttgtcaaagatcgactgtgccg

SEQ ID NO: 363208 - DNA, 25 bp, Mus musculus
tccttgtcaaagtctacaaaatacc

SEQ ID NO: 363209 - DNA, 25 bp, Mus musculus
tccttgtcaacaatcaagatgacgg

SEQ ID NO: 363210 - DNA, 25 bp, Mus musculus
tccttgtcaagtggtgtgggcatat

SEQ ID NO: 363211 - DNA, 25 bp, Mus musculus
tccttgtcacaggggcgggacagga

SEQ ID NO: 363212 - DNA, 25 bp, Mus musculus
tccttgtcacagggggtgagaaccc

SEQ ID NO: 363213 - DNA, 25 bp, Mus musculus
tccttgtcacagggggtggaaagct

SEQ ID NO: 363214 - DNA, 25 bp, Mus musculus
tccttgtccaagatcgagcggtcca

SEQ ID NO: 363215 - DNA, 25 bp, Mus musculus
tccttgtccagattatgaagtatgc

SEQ ID NO: 363216 - DNA, 25 bp, Mus musculus
tccttgtccagtggttttaggtgat

SEQ ID NO: 363217 - DNA, 25 bp, Mus musculus
tccttgtcctctgcgagtggcagtg

SEQ ID NO: 363218 - DNA, 25 bp, Mus musculus
tccttgtctgtcttcatctcggagc

SEQ ID NO: 363219 - DNA, 25 bp, Mus musculus
tccttgtctgttgcggggccacagc

SEQ ID NO: 363220 - DNA, 25 bp, Mus musculus
tccttgtgcttaggacgggttcccg

SEQ ID NO: 363221 - DNA, 25 bp, Mus musculus
tccttgtggaaaagaaccagcgggt

SEQ ID NO: 363222 - DNA, 25 bp, Mus musculus
tccttgtggaggtcttccaagttgc

SEQ ID NO: 363223 - DNA, 25 bp, Mus musculus
tccttgtgtattggcattggaggtg

SEQ ID NO: 363224 - DNA, 25 bp, Mus musculus
tccttgttaggtgccgcattgcacc

SEQ ID NO: 363225 - DNA, 25 bp, Mus musculus
tccttgttcatagggcggcggggcc

SEQ ID NO: 363226 - DNA, 25 bp, Mus musculus
tccttgttcatccgaacaaaaaagg

SEQ ID NO: 363227 - DNA, 25 bp, Mus musculus
tccttgttttaaaaggtgtccagtg

SEQ ID NO: 363228 - DNA, 25 bp, Mus musculus
tcctttaaaagatcagcatggagac

SEQ ID NO: 363229 - DNA, 25 bp, Mus musculus
tcctttacagcaaggtgaataaatc

SEQ ID NO: 363230 - DNA, 25 bp, Mus musculus
tcctttacaggcgagatgatttttg

SEQ ID NO: 363231 - DNA, 25 bp, Mus musculus
tcctttacgcagaagatgttggaca

SEQ ID NO: 363232 - DNA, 25 bp, Mus musculus
tcctttacgcaggcccagatgacac

SEQ ID NO: 363233 - DNA, 25 bp, Mus musculus
tcctttacgcagttcacacagaaga

SEQ ID NO: 363234 - DNA, 25 bp, Mus musculus
tcctttactgacagcttttgcctac

SEQ ID NO: 363235 - DNA, 25 bp, Mus musculus
tcctttatagaggacaaggaatatg

SEQ ID NO: 363236 - DNA, 25 bp, Mus musculus
tcctttcaagaattacaggcccggc

SEQ ID NO: 363237 - DNA, 25 bp, Mus musculus
tcctttcacagaaggagacattctg

SEQ ID NO: 363238 - DNA, 25 bp, Mus musculus
tcctttcacaggtgctgggcgttac

SEQ ID NO: 363239 - DNA, 25 bp, Mus musculus
tcctttcaccgccgctttgacctcg

SEQ ID NO: 363240 - DNA, 25 bp, Mus musculus
tcctttcatgtaaatttacatatgt

SEQ ID NO: 363241 - DNA, 25 bp, Mus musculus
tcctttcccagaaaaatatgcccaa

SEQ ID NO: 363242 - DNA, 25 bp, Mus musculus
tcctttccgtagccagcccaggctt

SEQ ID NO: 363243 - DNA, 25 bp, Mus musculus
tcctttcctaacgctgctgcatttt

SEQ ID NO: 363244 - DNA, 25 bp, Mus musculus
tcctttcctaagaaccaagacaact

SEQ ID NO: 363245 - DNA, 25 bp, Mus musculus
tcctttctgccagggacatgaaatg

SEQ ID NO: 363246 - DNA, 25 bp, Mus musculus
tcctttctggaaagaatatccagtt

SEQ ID NO: 363247 - DNA, 25 bp, Mus musculus
tcctttcttaccctcagctggatag

SEQ ID NO: 363248 - DNA, 25 bp, Mus musculus
tcctttgaagagcagatggcccagt

SEQ ID NO: 363249 - DNA, 25 bp, Mus musculus
tcctttgaagagcaggttgcttcca

SEQ ID NO: 363250 - DNA, 25 bp, Mus musculus
tcctttgactgtggcagccacagca

SEQ ID NO: 363251 - DNA, 25 bp, Mus musculus
tcctttgagtccatcagcagtgtta

SEQ ID NO: 363252 - DNA, 25 bp, Mus musculus
tcctttgagtgacgggtttagcttt

SEQ ID NO: 363253 - DNA, 25 bp, Mus musculus
tcctttgatgtgcatgtgtgggcat

SEQ ID NO: 363254 - DNA, 25 bp, Mus musculus
tcctttgcaaagtgcattgaggtca

SEQ ID NO: 363255 - DNA, 25 bp, Mus musculus
tcctttgcacaggtgacgccatctg

SEQ ID NO: 363256 - DNA, 25 bp, Mus musculus
tcctttgcagactttgatcctcacc

SEQ ID NO: 363257 - DNA, 25 bp, Mus musculus
tcctttgcagagcctgaccagacag

SEQ ID NO: 363258 - DNA, 25 bp, Mus musculus
tcctttgcagccacagacagtaagg

SEQ ID NO: 363259 - DNA, 25 bp, Mus musculus
tcctttgcatgtgtctaaggatgac

SEQ ID NO: 363260 - DNA, 25 bp, Mus musculus
tcctttgcttggccacagacaagcg

SEQ ID NO: 363261 - DNA, 25 bp, Mus musculus
tcctttggaaaagttgctgtggttc

SEQ ID NO: 363262 - DNA, 25 bp, Mus musculus
tcctttggagaattgcagtactgtt

SEQ ID NO: 363263 - DNA, 25 bp, Mus musculus
tcctttggccaaatggcaccgctcc

SEQ ID NO: 363264 - DNA, 25 bp, Mus musculus
tcctttggcttccctcatcagcgaa

SEQ ID NO: 363265 - DNA, 25 bp, Mus musculus
tcctttggtagactctggctggagg

SEQ ID NO: 363266 - DNA, 25 bp, Mus musculus
tcctttggtgccacaagccccgccc

SEQ ID NO: 363267 - DNA, 25 bp, Mus musculus
tcctttggttcctcaagccccgccc

SEQ ID NO: 363268 - DNA, 25 bp, Mus musculus
tcctttgtatctctcctggaaagaa

SEQ ID NO: 363269 - DNA, 25 bp, Mus musculus
tcctttgtatctgtcctggaaagaa

SEQ ID NO: 363270 - DNA, 25 bp, Mus musculus
tcctttgtcaaagaggtacagcagg

SEQ ID NO: 363271 - DNA, 25 bp, Mus musculus
tcctttgtgtggttcttcttgcttt

SEQ ID NO: 363272 - DNA, 25 bp, Mus musculus
tcctttgttcctggggcctgtgttt

SEQ ID NO: 363273 - DNA, 25 bp, Mus musculus
tcctttgttgatggtattgcgcgag

SEQ ID NO: 363274 - DNA, 25 bp, Mus musculus
tccttttaaaactatcacttgtgga

SEQ ID NO: 363275 - DNA, 25 bp, Mus musculus
tccttttaaagatcagccagatgct

SEQ ID NO: 363276 - DNA, 25 bp, Mus musculus
tccttttacctattcatcgctccac

SEQ ID NO: 363277 - DNA, 25 bp, Mus musculus
tccttttagaagcaattctacagaa

SEQ ID NO: 363278 - DNA, 25 bp, Mus musculus
tccttttcatggttaatttctaatg

SEQ ID NO: 363279 - DNA, 25 bp, Mus musculus
tccttttccagacagtccaggatgg

SEQ ID NO: 363280 - DNA, 25 bp, Mus musculus
tccttttctctgcagtcaatcgcag

SEQ ID NO: 363281 - DNA, 25 bp, Mus musculus
tccttttctgaaggtgtagaagcca

SEQ ID NO: 363282 - DNA, 25 bp, Mus musculus
tccttttgcagatggagggaagact

SEQ ID NO: 363283 - DNA, 25 bp, Mus musculus
tccttttgcagatggtagaaggaca

SEQ ID NO: 363284 - DNA, 25 bp, Mus musculus
tccttttgtctacaggcttcctgaa

SEQ ID NO: 363285 - DNA, 25 bp, Mus musculus
tcctttttataatcatgctgcttac

SEQ ID NO: 363286 - DNA, 25 bp, Mus musculus
tcctttttcaacttggagaagaaca

SEQ ID NO: 363287 - DNA, 25 bp, Mus musculus
tcctttttcctaactcttggcaagt

SEQ ID NO: 363288 - DNA, 25 bp, Mus musculus
tcctttttcctccctatctgagctc

SEQ ID NO: 363289 - DNA, 25 bp, Mus musculus
tcctttttgcctcaggtgacactgg

SEQ ID NO: 363290 - DNA, 25 bp, Mus musculus
tcctttttgctgttcactttggaaa

SEQ ID NO: 363291 - DNA, 25 bp, Mus musculus
tccttttttgaaggagcacatggat

SEQ ID NO: 363292 - DNA, 25 bp, Mus musculus
tccttttttgaaggattcactagca

SEQ ID NO: 363293 - DNA, 25 bp, Mus musculus
tcgaaaaaacatgcagagatctctt

SEQ ID NO: 363294 - DNA, 25 bp, Mus musculus
tcgaaaaacaaggacactgctggcc

SEQ ID NO: 363295 - DNA, 25 bp, Mus musculus
tcgaaaacatcactgtcgtcactgc

SEQ ID NO: 363296 - DNA, 25 bp, Mus musculus
tcgaaaactccaggatgtgtttgaa

SEQ ID NO: 363297 - DNA, 25 bp, Mus musculus
tcgaaaagagagtgtatctgtcaga

SEQ ID NO: 363298 - DNA, 25 bp, Mus musculus
tcgaaaaggctgtaatttggcctca

SEQ ID NO: 363299 - DNA, 25 bp, Mus musculus
tcgaaaatctatgaaagccctggtt

SEQ ID NO: 363300 - DNA, 25 bp, Mus musculus
tcgaaaatctatgaaatcagcaacc

SEQ ID NO: 363301 - DNA, 25 bp, Mus musculus
tcgaaaatggggtccaagggtagcc

SEQ ID NO: 363302 - DNA, 25 bp, Mus musculus
tcgaaacagggtcacgtctctggga

SEQ ID NO: 363303 - DNA, 25 bp, Mus musculus
tcgaaacattctattcactggcaat

SEQ ID NO: 363304 - DNA, 25 bp, Mus musculus
tcgaaacgagaaaggtgagatctca

SEQ ID NO: 363305 - DNA, 25 bp, Mus musculus
tcgaaactgcatgttgcgggatgac

SEQ ID NO: 363306 - DNA, 25 bp, Mus musculus
tcgaaactggagggctctctgggat

SEQ ID NO: 363307 - DNA, 25 bp, Mus musculus
tcgaaactggaggtgacccctgtaa

SEQ ID NO: 363308 - DNA, 25 bp, Mus musculus
tcgaaactggagttacctcgctgag

SEQ ID NO: 363309 - DNA, 25 bp, Mus musculus
tcgaaagaaagatcttcctcagaac

SEQ ID NO: 363310 - DNA, 25 bp, Mus musculus
tcgaaagaaagctgattcaagcatc

SEQ ID NO: 363311 - DNA, 25 bp, Mus musculus
tcgaaagaggcacagatcttagatg

SEQ ID NO: 363312 - DNA, 25 bp, Mus musculus
tcgaaagcaagtctcgttacatcag

SEQ ID NO: 363313 - DNA, 25 bp, Mus musculus
tcgaaagcacagaatactattacaa

SEQ ID NO: 363314 - DNA, 25 bp, Mus musculus
tcgaaagcacaggttttgcactgat

SEQ ID NO: 363315 - DNA, 25 bp, Mus musculus
tcgaaagcacgaggatggatgcgag

SEQ ID NO: 363316 - DNA, 25 bp, Mus musculus
tcgaaagcattgcattggtctctgc

SEQ ID NO: 363317 - DNA, 25 bp, Mus musculus
tcgaaagtcaggaaactgaagctca

SEQ ID NO: 363318 - DNA, 25 bp, Mus musculus
tcgaaagtccaaggtgccccgagcc

SEQ ID NO: 363319 - DNA, 25 bp, Mus musculus
tcgaaagtgaagatatggagtctgg

SEQ ID NO: 363320 - DNA, 25 bp, Mus musculus
tcgaaataaaaaaggggcctgctga

SEQ ID NO: 363321 - DNA, 25 bp, Mus musculus
tcgaaataaattgaaaaacatgtgg

SEQ ID NO: 363322 - DNA, 25 bp, Mus musculus
tcgaaatctgacagatttcatcata

SEQ ID NO: 363323 - DNA, 25 bp, Mus musculus
tcgaaatctgactcagagcaaccca

SEQ ID NO: 363324 - DNA, 25 bp, Mus musculus
tcgaaatgaaagatccagcaatgac

SEQ ID NO: 363325 - DNA, 25 bp, Mus musculus
tcgaaatgaaagttccagcaatgac

SEQ ID NO: 363326 - DNA, 25 bp, Mus musculus
tcgaaattacaggaagctctcgtag

SEQ ID NO: 363327 - DNA, 25 bp, Mus musculus
tcgaaatttacaatctttaagaaat

SEQ ID NO: 363328 - DNA, 25 bp, Mus musculus
tcgaacaaagtcagctttctctggt

SEQ ID NO: 363329 - DNA, 25 bp, Mus musculus
tcgaacacctatgtgcccttcccat

SEQ ID NO: 363330 - DNA, 25 bp, Mus musculus
tcgaacacctgagccagcccgcatc

SEQ ID NO: 363331 - DNA, 25 bp, Mus musculus
tcgaacagacaagcctttgaggacc

SEQ ID NO: 363332 - DNA, 25 bp, Mus musculus
tcgaacagacaagggtgtgtctgca

SEQ ID NO: 363333 - DNA, 25 bp, Mus musculus
tcgaaccagtggcaacactggcagc

SEQ ID NO: 363334 - DNA, 25 bp, Mus musculus
tcgaacccaggctccaccaaacgtg

SEQ ID NO: 363335 - DNA, 25 bp, Mus musculus
tcgaacccaggctcccactggcctc

SEQ ID NO: 363336 - DNA, 25 bp, Mus musculus
tcgaacccctggaattgtggaggca

SEQ ID NO: 363337 - DNA, 25 bp, Mus musculus
tcgaacctggaacaaggcctgagta

SEQ ID NO: 363338 - DNA, 25 bp, Mus musculus
tcgaacggccaggtgtcgtgattaa

SEQ ID NO: 363339 - DNA, 25 bp, Mus musculus
tcgaacgtgccacggtcagggaaac

SEQ ID NO: 363340 - DNA, 25 bp, Mus musculus
tcgaactacttaaagaaagatcaca

SEQ ID NO: 363341 - DNA, 25 bp, Mus musculus
tcgaactagaaaccagtgctgttgc

SEQ ID NO: 363342 - DNA, 25 bp, Mus musculus
tcgaactagaacaccagcagtgctt

SEQ ID NO: 363343 - DNA, 25 bp, Mus musculus
tcgaacttcgaggaatgtttaaatg

SEQ ID NO: 363344 - DNA, 25 bp, Mus musculus
tcgaagaaacatggatgtaaacaga

SEQ ID NO: 363345 - DNA, 25 bp, Mus musculus
tcgaagaaagaagatggacgacatg

SEQ ID NO: 363346 - DNA, 25 bp, Mus musculus
tcgaagacacagtgaagcatgactg

SEQ ID NO: 363347 - DNA, 25 bp, Mus musculus
tcgaagacggggacattacacttag

SEQ ID NO: 363348 - DNA, 25 bp, Mus musculus
tcgaagactaagtggactaaagagg

SEQ ID NO: 363349 - DNA, 25 bp, Mus musculus
tcgaagagcaccagaattcatccta

SEQ ID NO: 363350 - DNA, 25 bp, Mus musculus
tcgaagagctggaccgtgctggaat

SEQ ID NO: 363351 - DNA, 25 bp, Mus musculus
tcgaagagtgggaagaacttccatt

SEQ ID NO: 363352 - DNA, 25 bp, Mus musculus
tcgaagccaaggcccaggccttgtc

SEQ ID NO: 363353 - DNA, 25 bp, Mus musculus
tcgaagcccttggtccagaatagcg

SEQ ID NO: 363354 - DNA, 25 bp, Mus musculus
tcgaagcgtttgatgactccggaaa

SEQ ID NO: 363355 - DNA, 25 bp, Mus musculus
tcgaagcgtttgcaatcccggaagg

SEQ ID NO: 363356 - DNA, 25 bp, Mus musculus
tcgaagcgtttggctccttccgctc

SEQ ID NO: 363357 - DNA, 25 bp, Mus musculus
tcgaagctaacggggaataaaagct

SEQ ID NO: 363358 - DNA, 25 bp, Mus musculus
tcgaagctagggtcccaaaggccgc

SEQ ID NO: 363359 - DNA, 25 bp, Mus musculus
tcgaaggagacgaagagatgagacc

SEQ ID NO: 363360 - DNA, 25 bp, Mus musculus
tcgaaggagcggacgtgacgtatga

SEQ ID NO: 363361 - DNA, 25 bp, Mus musculus
tcgaaggcctgcaagacgacaagga

SEQ ID NO: 363362 - DNA, 25 bp, Mus musculus
tcgaaggcctggtcattcaatatta

SEQ ID NO: 363363 - DNA, 25 bp, Mus musculus
tcgaaggctggacagatctgctcat

SEQ ID NO: 363364 - DNA, 25 bp, Mus musculus
tcgaaggctggacagattcagataa

SEQ ID NO: 363365 - DNA, 25 bp, Mus musculus
tcgaagtaaggagagatgcctctgg

SEQ ID NO: 363366 - DNA, 25 bp, Mus musculus
tcgaagtaaggagagttttagatgc

SEQ ID NO: 363367 - DNA, 25 bp, Mus musculus
tcgaagtcagtgaaggcaggagctg

SEQ ID NO: 363368 - DNA, 25 bp, Mus musculus
tcgaagtcgctgacatcaatgcaag

SEQ ID NO: 363369 - DNA, 25 bp, Mus musculus
tcgaagtgagattgaccttgttcag

SEQ ID NO: 363370 - DNA, 25 bp, Mus musculus
tcgaagttcaatatgctcccaagct

SEQ ID NO: 363371 - DNA, 25 bp, Mus musculus
tcgaagtttccagactcaaactgtc

SEQ ID NO: 363372 - DNA, 25 bp, Mus musculus
tcgaagtttccagcctcctctggta

SEQ ID NO: 363373 - DNA, 25 bp, Mus musculus
tcgaataaagtcagagatccagaaa

SEQ ID NO: 363374 - DNA, 25 bp, Mus musculus
tcgaataaagtcaggtatcttttgg

SEQ ID NO: 363375 - DNA, 25 bp, Mus musculus
tcgaataaagtcaggttttgatatt

SEQ ID NO: 363376 - DNA, 25 bp, Mus musculus
tcgaatacccgactcagccctagac

SEQ ID NO: 363377 - DNA, 25 bp, Mus musculus
tcgaatacccgagttggattgtcca

SEQ ID NO: 363378 - DNA, 25 bp, Mus musculus
tcgaataccctgcagcatagcatct

SEQ ID NO: 363379 - DNA, 25 bp, Mus musculus
tcgaataccctgcaggtgatctgtc

SEQ ID NO: 363380 - DNA, 25 bp, Mus musculus
tcgaataccggcatgtcatgttgcc

SEQ ID NO: 363381 - DNA, 25 bp, Mus musculus
tcgaatcaagccaaatctgaagtgg

SEQ ID NO: 363382 - DNA, 25 bp, Mus musculus
tcgaatcaagccaatccataggaat

SEQ ID NO: 363383 - DNA, 25 bp, Mus musculus
tcgaatcacgtggagtgaactcagt

SEQ ID NO: 363384 - DNA, 25 bp, Mus musculus
tcgaatcacgtggatggaatgaaac

SEQ ID NO: 363385 - DNA, 25 bp, Mus musculus
tcgaatctacagggatgaatggatc

SEQ ID NO: 363386 - DNA, 25 bp, Mus musculus
tcgaatctacaggttatacaatggt

SEQ ID NO: 363387 - DNA, 25 bp, Mus musculus
tcgaatgaaaacaagatgagcgata

SEQ ID NO: 363388 - DNA, 25 bp, Mus musculus
tcgaatgaaactatccagcaagaga

SEQ ID NO: 363389 - DNA, 25 bp, Mus musculus
tcgaatgacacccatgaaccgcaca

SEQ ID NO: 363390 - DNA, 25 bp, Mus musculus
tcgaatgcctggtgcagccggatgt

SEQ ID NO: 363391 - DNA, 25 bp, Mus musculus
tcgaatttaagcgtctagccagctc

SEQ ID NO: 363392 - DNA, 25 bp, Mus musculus
tcgacaaagtcaaggtgtatgagat

SEQ ID NO: 363393 - DNA, 25 bp, Mus musculus
tcgacaacacagagtttcaaggcaa

SEQ ID NO: 363394 - DNA, 25 bp, Mus musculus
tcgacaacagcacaggcgtggtgac

SEQ ID NO: 363395 - DNA, 25 bp, Mus musculus
tcgacaacatgaatgaatctgagct

SEQ ID NO: 363396 - DNA, 25 bp, Mus musculus
tcgacaaggagatggacagtacaga

SEQ ID NO: 363397 - DNA, 25 bp, Mus musculus
tcgacaagtaaagaatctgctggat

SEQ ID NO: 363398 - DNA, 25 bp, Mus musculus
tcgacacaatacaaaagaaagaaaa

SEQ ID NO: 363399 - DNA, 25 bp, Mus musculus
tcgacaccttggggcaacctatcca

SEQ ID NO: 363400 - DNA, 25 bp, Mus musculus
tcgacacgccagataacacaactgg

SEQ ID NO: 363401 - DNA, 25 bp, Mus musculus
tcgacacgccggagtctgagggtgg

SEQ ID NO: 363402 - DNA, 25 bp, Mus musculus
tcgacacgttttttgccattggtgt

SEQ ID NO: 363403 - DNA, 25 bp, Mus musculus
tcgacactgtagccacgcgagttgt

SEQ ID NO: 363404 - DNA, 25 bp, Mus musculus
tcgacagagcccaggagcacctcaa

SEQ ID NO: 363405 - DNA, 25 bp, Mus musculus
tcgacagagcccaggtctgctgcct

SEQ ID NO: 363406 - DNA, 25 bp, Mus musculus
tcgacagagtgtgtggaggagtgat

SEQ ID NO: 363407 - DNA, 25 bp, Mus musculus
tcgacagcctgatgggggatgagtc

SEQ ID NO: 363408 - DNA, 25 bp, Mus musculus
tcgacagcctgattggagatagcaa

SEQ ID NO: 363409 - DNA, 25 bp, Mus musculus
tcgacagcgcggagacgcgtggcgg

SEQ ID NO: 363410 - DNA, 25 bp, Mus musculus
tcgacaggcctaagtgtccaccatc

SEQ ID NO: 363411 - DNA, 25 bp, Mus musculus
tcgacagtcctgcagatcgtcctgc

SEQ ID NO: 363412 - DNA, 25 bp, Mus musculus
tcgacagtgcgaaaattttgccaaa

SEQ ID NO: 363413 - DNA, 25 bp, Mus musculus
tcgacagtggtgaagggacacgcct

SEQ ID NO: 363414 - DNA, 25 bp, Mus musculus
tcgacagttcacagggaaccccaat

SEQ ID NO: 363415 - DNA, 25 bp, Mus musculus
tcgacagttcatcagaggagaaatg

SEQ ID NO: 363416 - DNA, 25 bp, Mus musculus
tcgacatagaaaggccaccttaggg

SEQ ID NO: 363417 - DNA, 25 bp, Mus musculus
tcgacatagaaagggagccacccag

SEQ ID NO: 363418 - DNA, 25 bp, Mus musculus
tcgacatcgatttcgggacctaccc

SEQ ID NO: 363419 - DNA, 25 bp, Mus musculus
tcgacatgagcaaggtctttgaagt

SEQ ID NO: 363420 - DNA, 25 bp, Mus musculus
tcgacatggagatgagtgtgaatgt

SEQ ID NO: 363421 - DNA, 25 bp, Mus musculus
tcgacatggaggaccctctgtcatt

SEQ ID NO: 363422 - DNA, 25 bp, Mus musculus
tcgacattacctcagagctgtggaa

SEQ ID NO: 363423 - DNA, 25 bp, Mus musculus
tcgaccacacagcggggagaaggtt

SEQ ID NO: 363424 - DNA, 25 bp, Mus musculus
tcgaccacacagcggtcgctatgca

SEQ ID NO: 363425 - DNA, 25 bp, Mus musculus
tcgaccacaggaagaagagctggag

SEQ ID NO: 363426 - DNA, 25 bp, Mus musculus
tcgaccagctgcttaaaggatagca

SEQ ID NO: 363427 - DNA, 25 bp, Mus musculus
tcgaccaggatgttgacctaaagat

SEQ ID NO: 363428 - DNA, 25 bp, Mus musculus
tcgaccaggatgttgagaaagcaac

SEQ ID NO: 363429 - DNA, 25 bp, Mus musculus
tcgaccagtggggagtggagctggg

SEQ ID NO: 363430 - DNA, 25 bp, Mus musculus
tcgaccagtggggctggggaagcag

SEQ ID NO: 363431 - DNA, 25 bp, Mus musculus
tcgacccgaagagtacagtcgtttt

SEQ ID NO: 363432 - DNA, 25 bp, Mus musculus
tcgacccgaaggtcgttttgaagct

SEQ ID NO: 363433 - DNA, 25 bp, Mus musculus
tcgaccctgagactggtatgggccc

SEQ ID NO: 363434 - DNA, 25 bp, Mus musculus
tcgaccctgagcttgcaagatacct

SEQ ID NO: 363435 - DNA, 25 bp, Mus musculus
tcgaccgcaaggtcaactcctggag

SEQ ID NO: 363436 - DNA, 25 bp, Mus musculus
tcgaccggttccaggatccagccgc

SEQ ID NO: 363437 - DNA, 25 bp, Mus musculus
tcgacctacaggacagctatacagc

SEQ ID NO: 363438 - DNA, 25 bp, Mus musculus
tcgacctacaggaggggcccggcct

SEQ ID NO: 363439 - DNA, 25 bp, Mus musculus
tcgacctcacaaggtgactggacag

SEQ ID NO: 363440 - DNA, 25 bp, Mus musculus
tcgacctcacaagtgcacgatctga

SEQ ID NO: 363441 - DNA, 25 bp, Mus musculus
tcgacctcagagcaggtcactttga

SEQ ID NO: 363442 - DNA, 25 bp, Mus musculus
tcgacctgagccccgagcctttgac

SEQ ID NO: 363443 - DNA, 25 bp, Mus musculus
tcgacctgcagctttcctgcctgtg

SEQ ID NO: 363444 - DNA, 25 bp, Mus musculus
tcgacctgcagggattgctgatgga

SEQ ID NO: 363445 - DNA, 25 bp, Mus musculus
tcgacctggaggatgtttcttgcgg

SEQ ID NO: 363446 - DNA, 25 bp, Mus musculus
tcgacctggtgacccacaaccgcac

SEQ ID NO: 363447 - DNA, 25 bp, Mus musculus
tcgaccttactatgaggtctacacc

SEQ ID NO: 363448 - DNA, 25 bp, Mus musculus
tcgaccttactatggagaaggaagc

SEQ ID NO: 363449 - DNA, 25 bp, Mus musculus
tcgaccttccaggagatcctgaaca

SEQ ID NO: 363450 - DNA, 25 bp, Mus musculus
tcgaccttccaggttttgggaactc

SEQ ID NO: 363451 - DNA, 25 bp, Mus musculus
tcgacctttgtaaaagaatgataga

SEQ ID NO: 363452 - DNA, 25 bp, Mus musculus
tcgacgaactccaggatgtgtttgt

SEQ ID NO: 363453 - DNA, 25 bp, Mus musculus
tcgacgacagggaacgaatggagct

SEQ ID NO: 363454 - DNA, 25 bp, Mus musculus
tcgacgacctccacaaggttctgaa

SEQ ID NO: 363455 - DNA, 25 bp, Mus musculus
tcgacgagtccagattgctgaagct

SEQ ID NO: 363456 - DNA, 25 bp, Mus musculus
tcgacgcagcaggtcttctatcaga

SEQ ID NO: 363457 - DNA, 25 bp, Mus musculus
tcgacggcccaagcctactcgccca

SEQ ID NO: 363458 - DNA, 25 bp, Mus musculus
tcgacggcctggtagtattaaagga

SEQ ID NO: 363459 - DNA, 25 bp, Mus musculus
tcgacgtgctggtaggcccacagaa

SEQ ID NO: 363460 - DNA, 25 bp, Mus musculus
tcgactcattaaagagtggccgagc

SEQ ID NO: 363461 - DNA, 25 bp, Mus musculus
tcgactccagctatgacagggactc

SEQ ID NO: 363462 - DNA, 25 bp, Mus musculus
tcgactccagctatgctcctacttt

SEQ ID NO: 363463 - DNA, 25 bp, Mus musculus
tcgactccgcatatttcagacttca

SEQ ID NO: 363464 - DNA, 25 bp, Mus musculus
tcgactccgcattggaactggaaca

SEQ ID NO: 363465 - DNA, 25 bp, Mus musculus
tcgactctataaattggagctggcc

SEQ ID NO: 363466 - DNA, 25 bp, Mus musculus
tcgactctgttggttcactttaatt

SEQ ID NO: 363467 - DNA, 25 bp, Mus musculus
tcgactgaccttggcatgcttgctc

SEQ ID NO: 363468 - DNA, 25 bp, Mus musculus
tcgactgagagatcctgagcaagca

SEQ ID NO: 363469 - DNA, 25 bp, Mus musculus
tcgactgcgtcaagacccggatgca

SEQ ID NO: 363470 - DNA, 25 bp, Mus musculus
tcgactgcgtcaaggtgcagccgga

SEQ ID NO: 363471 - DNA, 25 bp, Mus musculus
tcgactggaaaaaggacaggtgcag

SEQ ID NO: 363472 - DNA, 25 bp, Mus musculus
tcgactggaaaaaggataggtgcgg

SEQ ID NO: 363473 - DNA, 25 bp, Mus musculus
tcgactggaacatggtgcagcccgg

SEQ ID NO: 363474 - DNA, 25 bp, Mus musculus
tcgactgtccctcaagttgcctgca

SEQ ID NO: 363475 - DNA, 25 bp, Mus musculus
tcgactgtccctcaatggcacgctc

SEQ ID NO: 363476 - DNA, 25 bp, Mus musculus
tcgactgtccctcaatttcgaggac

SEQ ID NO: 363477 - DNA, 25 bp, Mus musculus
tcgactgtgcccggaatcccagtca

SEQ ID NO: 363478 - DNA, 25 bp, Mus musculus
tcgacttagtgcggctgtgtggaga

SEQ ID NO: 363479 - DNA, 25 bp, Mus musculus
tcgacttatcaaaggtgtggcccac

SEQ ID NO: 363480 - DNA, 25 bp, Mus musculus
tcgacttcaaggacacagcaggcca

SEQ ID NO: 363481 - DNA, 25 bp, Mus musculus
tcgacttcaggctgatctcttcgtt

SEQ ID NO: 363482 - DNA, 25 bp, Mus musculus
tcgacttcaggtacaggtcccagaa

SEQ ID NO: 363483 - DNA, 25 bp, Mus musculus
tcgacttcaggtctgtggccatgag

SEQ ID NO: 363484 - DNA, 25 bp, Mus musculus
tcgacttcaggtggtaagagaagct

SEQ ID NO: 363485 - DNA, 25 bp, Mus musculus
tcgacttcggactaggggctctgag

SEQ ID NO: 363486 - DNA, 25 bp, Mus musculus
tcgacttctgcagctaatgggaatg

SEQ ID NO: 363487 - DNA, 25 bp, Mus musculus
tcgactttacttctgtggagtcaat

SEQ ID NO: 363488 - DNA, 25 bp, Mus musculus
tcgactttgaaggacaaattgcaca

SEQ ID NO: 363489 - DNA, 25 bp, Mus musculus
tcgactttgaaggtccttgctgcca

SEQ ID NO: 363490 - DNA, 25 bp, Mus musculus
tcgactttgccagaaagtgagccac

SEQ ID NO: 363491 - DNA, 25 bp, Mus musculus
tcgactttggaggtctcccagtgga

SEQ ID NO: 363492 - DNA, 25 bp, Mus musculus
tcgagaaaaccctggcgtttagaga

SEQ ID NO: 363493 - DNA, 25 bp, Mus musculus
tcgagaaaagatgagagtcacggaa

SEQ ID NO: 363494 - DNA, 25 bp, Mus musculus
tcgagaaaaggaaaatgagaagtgc

SEQ ID NO: 363495 - DNA, 25 bp, Mus musculus
tcgagaaagaagcctcaggtacagt

SEQ ID NO: 363496 - DNA, 25 bp, Mus musculus
tcgagaaatagaagggaacaagtca

SEQ ID NO: 363497 - DNA, 25 bp, Mus musculus
tcgagaaatcgagaacactgttatg

SEQ ID NO: 363498 - DNA, 25 bp, Mus musculus
tcgagaaatcgagaacttgattctg

SEQ ID NO: 363499 - DNA, 25 bp, Mus musculus
tcgagaaatgagtcctctctgggag

SEQ ID NO: 363500 - DNA, 25 bp, Mus musculus
tcgagaaattcgggccaatggtggc

SEQ ID NO: 363501 - DNA, 25 bp, Mus musculus
tcgagaacattccagatacacttca

SEQ ID NO: 363502 - DNA, 25 bp, Mus musculus
tcgagaagaaagaagtgttgccggg

SEQ ID NO: 363503 - DNA, 25 bp, Mus musculus
tcgagaagaacgaggccatccaggc

SEQ ID NO: 363504 - DNA, 25 bp, Mus musculus
tcgagaagaacgaggcggcccatga

SEQ ID NO: 363505 - DNA, 25 bp, Mus musculus
tcgagaagcagagattttattccct

SEQ ID NO: 363506 - DNA, 25 bp, Mus musculus
tcgagaagccaggagaaactacaac

SEQ ID NO: 363507 - DNA, 25 bp, Mus musculus
tcgagaagccaggtggtgaccatag

SEQ ID NO: 363508 - DNA, 25 bp, Mus musculus
tcgagaagtcaaccatccaaaactc

SEQ ID NO: 363509 - DNA, 25 bp, Mus musculus
tcgagaatgacatgggatacaaact

SEQ ID NO: 363510 - DNA, 25 bp, Mus musculus
tcgagaatgagatgagctgcccgac

SEQ ID NO: 363511 - DNA, 25 bp, Mus musculus
tcgagaattaatagctaaaaggaca

SEQ ID NO: 363512 - DNA, 25 bp, Mus musculus
tcgagacactacaggagagcacaca

SEQ ID NO: 363513 - DNA, 25 bp, Mus musculus
tcgagaccagcaaaaaatgctatca

SEQ ID NO: 363514 - DNA, 25 bp, Mus musculus
tcgagacctaagaagagatccagag

SEQ ID NO: 363515 - DNA, 25 bp, Mus musculus
tcgagacgggccattgctcctgtgc

SEQ ID NO: 363516 - DNA, 25 bp, Mus musculus
tcgagactcaaggtcaacatggcca

SEQ ID NO: 363517 - DNA, 25 bp, Mus musculus
tcgagactcaagtttagctgttaac

SEQ ID NO: 363518 - DNA, 25 bp, Mus musculus
tcgagactcagggtgaaatggtcaa

SEQ ID NO: 363519 - DNA, 25 bp, Mus musculus
tcgagagagaaaaaatcaaccactc

SEQ ID NO: 363520 - DNA, 25 bp, Mus musculus
tcgagagagaaaaaatcaatccagg

SEQ ID NO: 363521 - DNA, 25 bp, Mus musculus
tcgagaggcgcgaggccgcaaaacg

SEQ ID NO: 363522 - DNA, 25 bp, Mus musculus
tcgagagtcaacaaggtgatcattg

SEQ ID NO: 363523 - DNA, 25 bp, Mus musculus
tcgagatgatgcagaacatgttgga

SEQ ID NO: 363524 - DNA, 25 bp, Mus musculus
tcgagatgcacaaccaggcggaaat

SEQ ID NO: 363525 - DNA, 25 bp, Mus musculus
tcgagcaagatgtggaaaaagccaa

SEQ ID NO: 363526 - DNA, 25 bp, Mus musculus
tcgagcaagatgtggaaaaagccac

SEQ ID NO: 363527 - DNA, 25 bp, Mus musculus
tcgagcaagatgtggcaatccccag

SEQ ID NO: 363528 - DNA, 25 bp, Mus musculus
tcgagcaatggctaggagaccatct

SEQ ID NO: 363529 - DNA, 25 bp, Mus musculus
tcgagcacatgcccttaggcccagg

SEQ ID NO: 363530 - DNA, 25 bp, Mus musculus
tcgagcacatgggagtgttgtgaag

SEQ ID NO: 363531 - DNA, 25 bp, Mus musculus
tcgagcacatgtaatagcgctcatc

SEQ ID NO: 363532 - DNA, 25 bp, Mus musculus
tcgagcacatgtttaggtaatagcg

SEQ ID NO: 363533 - DNA, 25 bp, Mus musculus
tcgagcacctccgggacctgtttca

SEQ ID NO: 363534 - DNA, 25 bp, Mus musculus
tcgagcacttccggtggacactgca

SEQ ID NO: 363535 - DNA, 25 bp, Mus musculus
tcgagcacttccgtgtctgtctctc

SEQ ID NO: 363536 - DNA, 25 bp, Mus musculus
tcgagcagctggagaatcctgggga

SEQ ID NO: 363537 - DNA, 25 bp, Mus musculus
tcgagcaggccctttccgatctcat

SEQ ID NO: 363538 - DNA, 25 bp, Mus musculus
tcgagcagtgagcgagatgcagcac

SEQ ID NO: 363539 - DNA, 25 bp, Mus musculus
tcgagcagtggatggaagacagcga

SEQ ID NO: 363540 - DNA, 25 bp, Mus musculus
tcgagcatctacttacggctggccc

SEQ ID NO: 363541 - DNA, 25 bp, Mus musculus
tcgagcatctacttcagctgcgtgc

SEQ ID NO: 363542 - DNA, 25 bp, Mus musculus
tcgagccagcataggtgcaacaagc

SEQ ID NO: 363543 - DNA, 25 bp, Mus musculus
tcgagccaggctgtgctggccagct

SEQ ID NO: 363544 - DNA, 25 bp, Mus musculus
tcgagcccaggaggaagaaggcatt

SEQ ID NO: 363545 - DNA, 25 bp, Mus musculus
tcgagcccgggcaggtaaatttaac

SEQ ID NO: 363546 - DNA, 25 bp, Mus musculus
tcgagcctaaagaacatcaaactga

SEQ ID NO: 363547 - DNA, 25 bp, Mus musculus
tcgagcggactcagacggtcagcgt

SEQ ID NO: 363548 - DNA, 25 bp, Mus musculus
tcgagctattttggattactataag

SEQ ID NO: 363549 - DNA, 25 bp, Mus musculus
tcgagctcatgaacacttcagttat

SEQ ID NO: 363550 - DNA, 25 bp, Mus musculus
tcgagctcatgatcagtaatggaac

SEQ ID NO: 363551 - DNA, 25 bp, Mus musculus
tcgagctcatgtgttctgtgccaag

SEQ ID NO: 363552 - DNA, 25 bp, Mus musculus
tcgagctcatgttaccgaagtgcat

SEQ ID NO: 363553 - DNA, 25 bp, Mus musculus
tcgagctgaagggaagtgaccaagc

SEQ ID NO: 363554 - DNA, 25 bp, Mus musculus
tcgagctgaagggctctcctgctgc

SEQ ID NO: 363555 - DNA, 25 bp, Mus musculus
tcgagctggggcccgagttctctgg

SEQ ID NO: 363556 - DNA, 25 bp, Mus musculus
tcgagcttctgcaaggttctgtccc

SEQ ID NO: 363557 - DNA, 25 bp, Mus musculus
tcgaggaactatccgcaaagaagat

SEQ ID NO: 363558 - DNA, 25 bp, Mus musculus
tcgaggacaagatgctcatgagcag

SEQ ID NO: 363559 - DNA, 25 bp, Mus musculus
tcgaggacagacaagaaattgcaaa

SEQ ID NO: 363560 - DNA, 25 bp, Mus musculus
tcgaggacccgcgagatgctgagga

SEQ ID NO: 363561 - DNA, 25 bp, Mus musculus
tcgaggacgtcccgcacgtagaaga

SEQ ID NO: 363562 - DNA, 25 bp, Mus musculus
tcgaggagaaattggtccttaccct

SEQ ID NO: 363563 - DNA, 25 bp, Mus musculus
tcgaggagactcctgaggcttttga

SEQ ID NO: 363564 - DNA, 25 bp, Mus musculus
tcgaggagatcgagggcctgatctc

SEQ ID NO: 363565 - DNA, 25 bp, Mus musculus
tcgaggagggcatgggcaacaggac

SEQ ID NO: 363566 - DNA, 25 bp, Mus musculus
tcgaggagggcatgggcgttaagat

SEQ ID NO: 363567 - DNA, 25 bp, Mus musculus
tcgaggaggtggaggacctcatgga

SEQ ID NO: 363568 - DNA, 25 bp, Mus musculus
tcgaggaggtgtaccacagcagcct

SEQ ID NO: 363569 - DNA, 25 bp, Mus musculus
tcgaggatattggagctccagccac

SEQ ID NO: 363570 - DNA, 25 bp, Mus musculus
tcgaggatcctcaggaggaagaacc

SEQ ID NO: 363571 - DNA, 25 bp, Mus musculus
tcgaggatgaagaaagaagcatcgg

SEQ ID NO: 363572 - DNA, 25 bp, Mus musculus
tcgaggatgatcggggaatcatcac

SEQ ID NO: 363573 - DNA, 25 bp, Mus musculus
tcgaggatttagctggtccaaagcc

SEQ ID NO: 363574 - DNA, 25 bp, Mus musculus
tcgaggcaataaattggagagaggt

SEQ ID NO: 363575 - DNA, 25 bp, Mus musculus
tcgaggcatggccagtaatgttaaa

SEQ ID NO: 363576 - DNA, 25 bp, Mus musculus
tcgaggcatgggtgaacggcctttc

SEQ ID NO: 363577 - DNA, 25 bp, Mus musculus
tcgaggccagccggctacacagaga

SEQ ID NO: 363578 - DNA, 25 bp, Mus musculus
tcgaggcgctttcaggtaaaatgga

SEQ ID NO: 363579 - DNA, 25 bp, Mus musculus
tcgaggctaactgaggggttggcaa

SEQ ID NO: 363580 - DNA, 25 bp, Mus musculus
tcgaggctaatgaggaagcattagg

SEQ ID NO: 363581 - DNA, 25 bp, Mus musculus
tcgaggctaatgaggtttctggctc

SEQ ID NO: 363582 - DNA, 25 bp, Mus musculus
tcgagggaaagtgtccacagacaaa

SEQ ID NO: 363583 - DNA, 25 bp, Mus musculus
tcgagggaagctaaagaagtaaaca

SEQ ID NO: 363584 - DNA, 25 bp, Mus musculus
tcgagggatacagatgtatgagtct

SEQ ID NO: 363585 - DNA, 25 bp, Mus musculus
tcgagggatacaggatggtgttgct

SEQ ID NO: 363586 - DNA, 25 bp, Mus musculus
tcgagggcacaggcggacctatgtg

SEQ ID NO: 363587 - DNA, 25 bp, Mus musculus
tcgagggcagagagtctcgctctca

SEQ ID NO: 363588 - DNA, 25 bp, Mus musculus
tcgagggcagagttaatgttcgtga

SEQ ID NO: 363589 - DNA, 25 bp, Mus musculus
tcgagggccttcaggaagatgctac

SEQ ID NO: 363590 - DNA, 25 bp, Mus musculus
tcgaggggagaagtgatgccttatt

SEQ ID NO: 363591 - DNA, 25 bp, Mus musculus
tcgagggttccctgatctatgagga

SEQ ID NO: 363592 - DNA, 25 bp, Mus musculus
tcgaggtatttccaatcccgctcaa

SEQ ID NO: 363593 - DNA, 25 bp, Mus musculus
tcgaggtgccccgggtgaacgcgga

SEQ ID NO: 363594 - DNA, 25 bp, Mus musculus
tcgaggtggcaggccccactgaaac

SEQ ID NO: 363595 - DNA, 25 bp, Mus musculus
tcgagtaaaatcgataaacaaccca

SEQ ID NO: 363596 - DNA, 25 bp, Mus musculus
tcgagtacaggagttattcctgatg

SEQ ID NO: 363597 - DNA, 25 bp, Mus musculus
tcgagtaccagaaagctcagcccag

SEQ ID NO: 363598 - DNA, 25 bp, Mus musculus
tcgagtaccaggttggagtgggtgg

SEQ ID NO: 363599 - DNA, 25 bp, Mus musculus
tcgagtatctcagtggaggagaact

SEQ ID NO: 363600 - DNA, 25 bp, Mus musculus
tcgagtcacaggcctgagggccagc

SEQ ID NO: 363601 - DNA, 25 bp, Mus musculus
tcgagtcacagggggtgacatggca

SEQ ID NO: 363602 - DNA, 25 bp, Mus musculus
tcgagtcaccgtttgccatctctgg

SEQ ID NO: 363603 - DNA, 25 bp, Mus musculus
tcgagtgaccagtggagtgaagcca

SEQ ID NO: 363604 - DNA, 25 bp, Mus musculus
tcgagtgatcatgtgcctctccttt

SEQ ID NO: 363605 - DNA, 25 bp, Mus musculus
tcgagtgcggacgggaatctggtcg

SEQ ID NO: 363606 - DNA, 25 bp, Mus musculus
tcgagtggcaggagaaacccaagcc

SEQ ID NO: 363607 - DNA, 25 bp, Mus musculus
tcgagtggcaggaggtccggagttc

SEQ ID NO: 363608 - DNA, 25 bp, Mus musculus
tcgagtggtgaaggacctcagtgca

SEQ ID NO: 363609 - DNA, 25 bp, Mus musculus
tcgagtgtcaagactgtgatttacc

SEQ ID NO: 363610 - DNA, 25 bp, Mus musculus
tcgagttctgggagaacaaagtatt

SEQ ID NO: 363611 - DNA, 25 bp, Mus musculus
tcgagttgctccttcctctccacta

SEQ ID NO: 363612 - DNA, 25 bp, Mus musculus
tcgagtttgaaattcctatcacata

SEQ ID NO: 363613 - DNA, 25 bp, Mus musculus
tcgataaccagagccaacctttggg

SEQ ID NO: 363614 - DNA, 25 bp, Mus musculus
tcgataaccaggtgagaaaggcaga

SEQ ID NO: 363615 - DNA, 25 bp, Mus musculus
tcgataataagatcagcaccagtga

SEQ ID NO: 363616 - DNA, 25 bp, Mus musculus
tcgataatttcaatgtccttggctc

SEQ ID NO: 363617 - DNA, 25 bp, Mus musculus
tcgatacctgaggacacgagaggac

SEQ ID NO: 363618 - DNA, 25 bp, Mus musculus
tcgatactgtggagactatgacagt

SEQ ID NO: 363619 - DNA, 25 bp, Mus musculus
tcgatactgtggagggctccacctg

SEQ ID NO: 363620 - DNA, 25 bp, Mus musculus
tcgatagcaacgggggcatctgcaa

SEQ ID NO: 363621 - DNA, 25 bp, Mus musculus
tcgataggaatacaagagaggacta

SEQ ID NO: 363622 - DNA, 25 bp, Mus musculus
tcgataggaatacaagttgactgca

SEQ ID NO: 363623 - DNA, 25 bp, Mus musculus
tcgatataaagactcggtaccccat

SEQ ID NO: 363624 - DNA, 25 bp, Mus musculus
tcgatataaagattgccctgaccgc

SEQ ID NO: 363625 - DNA, 25 bp, Mus musculus
tcgatatcaggtgtcctggagcctg

SEQ ID NO: 363626 - DNA, 25 bp, Mus musculus
tcgatatcaggttgatccccaaaga

SEQ ID NO: 363627 - DNA, 25 bp, Mus musculus
tcgatatcgtcccagttttcgcata

SEQ ID NO: 363628 - DNA, 25 bp, Mus musculus
tcgatatctaatttttaagacaatt

SEQ ID NO: 363629 - DNA, 25 bp, Mus musculus
tcgatatgtccctggatgatattat

SEQ ID NO: 363630 - DNA, 25 bp, Mus musculus
tcgatcaactcaataaagccgttgt

SEQ ID NO: 363631 - DNA, 25 bp, Mus musculus
tcgatcaactcagccggctcaacat

SEQ ID NO: 363632 - DNA, 25 bp, Mus musculus
tcgatcagctgctgagcagctgcag

SEQ ID NO: 363633 - DNA, 25 bp, Mus musculus
tcgatcagtgagctcctgctgttct

SEQ ID NO: 363634 - DNA, 25 bp, Mus musculus
tcgatccaagtgagttacaagactt

SEQ ID NO: 363635 - DNA, 25 bp, Mus musculus
tcgatcccagatgtagaactctcaa

SEQ ID NO: 363636 - DNA, 25 bp, Mus musculus
tcgatcccaggtgcacctccgctct

SEQ ID NO: 363637 - DNA, 25 bp, Mus musculus
tcgatcccaggtgcttgtcctggcc

SEQ ID NO: 363638 - DNA, 25 bp, Mus musculus
tcgatccgcccaagagctcaaagcc

SEQ ID NO: 363639 - DNA, 25 bp, Mus musculus
tcgatcgatcgagtcagtccgaccg

SEQ ID NO: 363640 - DNA, 25 bp, Mus musculus
tcgatgacgtgaaaagacaccgaag

SEQ ID NO: 363641 - DNA, 25 bp, Mus musculus
tcgatgagacaagaagactgctgga

SEQ ID NO: 363642 - DNA, 25 bp, Mus musculus
tcgatgagacaagatcttcaagcaa

SEQ ID NO: 363643 - DNA, 25 bp, Mus musculus
tcgatgagcgcattttaaagcccaa

SEQ ID NO: 363644 - DNA, 25 bp, Mus musculus
tcgatgccagaaagaagagctgaac

SEQ ID NO: 363645 - DNA, 25 bp, Mus musculus
tcgatgccagattttgcctcagtac

SEQ ID NO: 363646 - DNA, 25 bp, Mus musculus
tcgatgccaggtttcactttttcat

SEQ ID NO: 363647 - DNA, 25 bp, Mus musculus
tcgatgccatggacgtgactgcacc

SEQ ID NO: 363648 - DNA, 25 bp, Mus musculus
tcgatgccctggtcgtgtgcccctc

SEQ ID NO: 363649 - DNA, 25 bp, Mus musculus
tcgatggcactgcagctgctcctgg

SEQ ID NO: 363650 - DNA, 25 bp, Mus musculus
tcgatggcatcaagttcatgggcgg

SEQ ID NO: 363651 - DNA, 25 bp, Mus musculus
tcgatggcatgtggctcctacccag

SEQ ID NO: 363652 - DNA, 25 bp, Mus musculus
tcgatggcgtgacctcctcttgctt

SEQ ID NO: 363653 - DNA, 25 bp, Mus musculus
tcgatggtagccgctgccgtgactt

SEQ ID NO: 363654 - DNA, 25 bp, Mus musculus
tcgatggtagccggaagctgtgctg

SEQ ID NO: 363655 - DNA, 25 bp, Mus musculus
tcgatgtcgccagcgcccctccagc

SEQ ID NO: 363656 - DNA, 25 bp, Mus musculus
tcgatgtcgttgaacggtcaccaca

SEQ ID NO: 363657 - DNA, 25 bp, Mus musculus
tcgatgtgcacatgctggtagctga

SEQ ID NO: 363658 - DNA, 25 bp, Mus musculus
tcgatgtgcgagattgtgaagggaa

SEQ ID NO: 363659 - DNA, 25 bp, Mus musculus
tcgatgtgcgagggaaggttgtgaa

SEQ ID NO: 363660 - DNA, 25 bp, Mus musculus
tcgatgtgggaacaggtgtcacagc

SEQ ID NO: 363661 - DNA, 25 bp, Mus musculus
tcgatgtgttttcagtggataatga

SEQ ID NO: 363662 - DNA, 25 bp, Mus musculus
tcgatgttcaggagcaggatattga

SEQ ID NO: 363663 - DNA, 25 bp, Mus musculus
tcgatgttcagggcaaccgtcctgt

SEQ ID NO: 363664 - DNA, 25 bp, Mus musculus
tcgatgttccactcgctctttgcca

SEQ ID NO: 363665 - DNA, 25 bp, Mus musculus
tcgatgttccactcggatcaagttt

SEQ ID NO: 363666 - DNA, 25 bp, Mus musculus
tcgattaaagcaaaaagtcaaagct

SEQ ID NO: 363667 - DNA, 25 bp, Mus musculus
tcgattacccccaagtgctgcagga

SEQ ID NO: 363668 - DNA, 25 bp, Mus musculus
tcgattattcagaagcagaacagag

SEQ ID NO: 363669 - DNA, 25 bp, Mus musculus
tcgattcaaccacaatgacggattc

SEQ ID NO: 363670 - DNA, 25 bp, Mus musculus
tcgattcaaggatcgcattgtatca

SEQ ID NO: 363671 - DNA, 25 bp, Mus musculus
tcgattcaccgtatggctccatggt

SEQ ID NO: 363672 - DNA, 25 bp, Mus musculus
tcgattccagcgtctcaaagggtaa

SEQ ID NO: 363673 - DNA, 25 bp, Mus musculus
tcgattccagcgtttcatgaaccat

SEQ ID NO: 363674 - DNA, 25 bp, Mus musculus
tcgattccgaatctgcctcagcctt

SEQ ID NO: 363675 - DNA, 25 bp, Mus musculus
tcgattccgatttgtgctagtgaac

SEQ ID NO: 363676 - DNA, 25 bp, Mus musculus
tcgatttttaatagatggagagcat

SEQ ID NO: 363677 - DNA, 25 bp, Mus musculus
tcgcaaaaggcagagggacagttaa

SEQ ID NO: 363678 - DNA, 25 bp, Mus musculus
tcgcaaaccagctccttaattgatg

SEQ ID NO: 363679 - DNA, 25 bp, Mus musculus
tcgcaaacgtccagcgtttggagca

SEQ ID NO: 363680 - DNA, 25 bp, Mus musculus
tcgcaaacgtccaggagcaggcctc

SEQ ID NO: 363681 - DNA, 25 bp, Mus musculus
tcgcaaagacggaaggactggaaat

SEQ ID NO: 363682 - DNA, 25 bp, Mus musculus
tcgcaaagactctcacccaggtgac

SEQ ID NO: 363683 - DNA, 25 bp, Mus musculus
tcgcaaagagctcaccgagctcttt

SEQ ID NO: 363684 - DNA, 25 bp, Mus musculus
tcgcaaagagggtttctctgtgtag

SEQ ID NO: 363685 - DNA, 25 bp, Mus musculus
tcgcaaagagtgtggggagacctgt

SEQ ID NO: 363686 - DNA, 25 bp, Mus musculus
tcgcaaattacgtccacagcaaagg

SEQ ID NO: 363687 - DNA, 25 bp, Mus musculus
tcgcaacgaggagactccagaaccc

SEQ ID NO: 363688 - DNA, 25 bp, Mus musculus
tcgcaactatcagcccttgtttctt

SEQ ID NO: 363689 - DNA, 25 bp, Mus musculus
tcgcaactatcaggctcggaacttc

SEQ ID NO: 363690 - DNA, 25 bp, Mus musculus
tcgcaactcaaggtaggtgtacatg

SEQ ID NO: 363691 - DNA, 25 bp, Mus musculus
tcgcaactcaaggtcctttcccata

SEQ ID NO: 363692 - DNA, 25 bp, Mus musculus
tcgcaagaaaaagtctgatgccaac

SEQ ID NO: 363693 - DNA, 25 bp, Mus musculus
tcgcaagaaatgggaaccccaacag

SEQ ID NO: 363694 - DNA, 25 bp, Mus musculus
tcgcaagcccaagtatgatcaggga

SEQ ID NO: 363695 - DNA, 25 bp, Mus musculus
tcgcaagctgcaggctgcactgagg

SEQ ID NO: 363696 - DNA, 25 bp, Mus musculus
tcgcaagctgcgggtgcagcaggct

SEQ ID NO: 363697 - DNA, 25 bp, Mus musculus
tcgcaaggccaagagcacggacgag

SEQ ID NO: 363698 - DNA, 25 bp, Mus musculus
tcgcaaggccaagctattacaagcc

SEQ ID NO: 363699 - DNA, 25 bp, Mus musculus
tcgcaaggttgcagcacgcagcaga

SEQ ID NO: 363700 - DNA, 25 bp, Mus musculus
tcgcacaagagaatcagctgatgtt

SEQ ID NO: 363701 - DNA, 25 bp, Mus musculus
tcgcacaagagaatgagctgatgtt

SEQ ID NO: 363702 - DNA, 25 bp, Mus musculus
tcgcacaaggccccgaaatgggacc

SEQ ID NO: 363703 - DNA, 25 bp, Mus musculus
tcgcacaccgagatatgaggatcaa

SEQ ID NO: 363704 - DNA, 25 bp, Mus musculus
tcgcacacggcctctgtgctcgaaa

SEQ ID NO: 363705 - DNA, 25 bp, Mus musculus
tcgcacacggcctggaggtgtgact

SEQ ID NO: 363706 - DNA, 25 bp, Mus musculus
tcgcacacgggggacgcccccttcc

SEQ ID NO: 363707 - DNA, 25 bp, Mus musculus
tcgcacagacgattcctcagatgtt

SEQ ID NO: 363708 - DNA, 25 bp, Mus musculus
tcgcacagaggaagccgtgaaggca

SEQ ID NO: 363709 - DNA, 25 bp, Mus musculus
tcgcacagcaactaggcatgaagca

SEQ ID NO: 363710 - DNA, 25 bp, Mus musculus
tcgcacagcatgatcaacaggcccc

SEQ ID NO: 363711 - DNA, 25 bp, Mus musculus
tcgcacagctctatggtatcgctgg

SEQ ID NO: 363712 - DNA, 25 bp, Mus musculus
tcgcacaggaagggactgagactat

SEQ ID NO: 363713 - DNA, 25 bp, Mus musculus
tcgcacaggctaggtatgacggaga

SEQ ID NO: 363714 - DNA, 25 bp, Mus musculus
tcgcacagtgatgatgtgctgacta

SEQ ID NO: 363715 - DNA, 25 bp, Mus musculus
tcgcacagtgcccctgcttgttctc

SEQ ID NO: 363716 - DNA, 25 bp, Mus musculus
tcgcacagtgggctgttggtgctga

SEQ ID NO: 363717 - DNA, 25 bp, Mus musculus
tcgcacagtggggtcggttacggag

SEQ ID NO: 363718 - DNA, 25 bp, Mus musculus
tcgcacagtggtttcaagtgcccca

SEQ ID NO: 363719 - DNA, 25 bp, Mus musculus
tcgcacagtgtgtgttttgtgcctg

SEQ ID NO: 363720 - DNA, 25 bp, Mus musculus
tcgcacattacaaggacatgggcaa

SEQ ID NO: 363721 - DNA, 25 bp, Mus musculus
tcgcacccaaatagcgctggcgtgg

SEQ ID NO: 363722 - DNA, 25 bp, Mus musculus
tcgcacctggggcagggaagaggtg

SEQ ID NO: 363723 - DNA, 25 bp, Mus musculus
tcgcacgcgtgagcatgcgctacgt

SEQ ID NO: 363724 - DNA, 25 bp, Mus musculus
tcgcactagatatcaaaatcgggtc

SEQ ID NO: 363725 - DNA, 25 bp, Mus musculus
tcgcactagatatcaatctgtggtt

SEQ ID NO: 363726 - DNA, 25 bp, Mus musculus
tcgcactgcagacaattgcctatag

SEQ ID NO: 363727 - DNA, 25 bp, Mus musculus
tcgcactgttaacaggcagcaaaca

SEQ ID NO: 363728 - DNA, 25 bp, Mus musculus
tcgcacttttcgcggattctttggg

SEQ ID NO: 363729 - DNA, 25 bp, Mus musculus
tcgcagaaagtgggtttcccgtctt

SEQ ID NO: 363730 - DNA, 25 bp, Mus musculus
tcgcagaccattgcccagactcggc

SEQ ID NO: 363731 - DNA, 25 bp, Mus musculus
tcgcagacggttcccagcagtggca

SEQ ID NO: 363732 - DNA, 25 bp, Mus musculus
tcgcagagacagaggaggccatgtc

SEQ ID NO: 363733 - DNA, 25 bp, Mus musculus
tcgcagagctcagaggagaattctg

SEQ ID NO: 363734 - DNA, 25 bp, Mus musculus
tcgcagagctcagagggtgctctgt

SEQ ID NO: 363735 - DNA, 25 bp, Mus musculus
tcgcagagctgtcagtgacccaccc

SEQ ID NO: 363736 - DNA, 25 bp, Mus musculus
tcgcagaggggacaatgccaagttc

SEQ ID NO: 363737 - DNA, 25 bp, Mus musculus
tcgcagagtgacatggaagctatgg

SEQ ID NO: 363738 - DNA, 25 bp, Mus musculus
tcgcagagtgacatggccgcagcca

SEQ ID NO: 363739 - DNA, 25 bp, Mus musculus
tcgcagagtgacatgtgcgaccaag

SEQ ID NO: 363740 - DNA, 25 bp, Mus musculus
tcgcagcaaacgatcatcccagcag

SEQ ID NO: 363741 - DNA, 25 bp, Mus musculus
tcgcagcccaagaagaaccaagagc

SEQ ID NO: 363742 - DNA, 25 bp, Mus musculus
tcgcagcccaagaagacgcaaatcc

SEQ ID NO: 363743 - DNA, 25 bp, Mus musculus
tcgcagcctggacctggggattccg

SEQ ID NO: 363744 - DNA, 25 bp, Mus musculus
tcgcagcctgttcagaattggggca

SEQ ID NO: 363745 - DNA, 25 bp, Mus musculus
tcgcagctagcaggtgccttccaac

SEQ ID NO: 363746 - DNA, 25 bp, Mus musculus
tcgcaggacacgaaaactgtccttg

SEQ ID NO: 363747 - DNA, 25 bp, Mus musculus
tcgcaggacccggaactgaaagcaa

SEQ ID NO: 363748 - DNA, 25 bp, Mus musculus
tcgcaggagggcgaagagaaagaca

SEQ ID NO: 363749 - DNA, 25 bp, Mus musculus
tcgcaggcaaaggttcagaacttag

SEQ ID NO: 363750 - DNA, 25 bp, Mus musculus
tcgcaggggacaagatcacctttgt

SEQ ID NO: 363751 - DNA, 25 bp, Mus musculus
tcgcaggggtgccctgtggtaagcg

SEQ ID NO: 363752 - DNA, 25 bp, Mus musculus
tcgcagtcaggcctcagctgcacca

SEQ ID NO: 363753 - DNA, 25 bp, Mus musculus
tcgcagtcagtactgttacataaaa

SEQ ID NO: 363754 - DNA, 25 bp, Mus musculus
tcgcagtgcacagagcatatgaaac

SEQ ID NO: 363755 - DNA, 25 bp, Mus musculus
tcgcagtgctcagtgtggctgagga

SEQ ID NO: 363756 - DNA, 25 bp, Mus musculus
tcgcagtgcttagagaacgatgtgg

SEQ ID NO: 363757 - DNA, 25 bp, Mus musculus
tcgcagtgcttagctcttctgtcgg

SEQ ID NO: 363758 - DNA, 25 bp, Mus musculus
tcgcagtggtgcaggcagtgcaggc

SEQ ID NO: 363759 - DNA, 25 bp, Mus musculus
tcgcagttcaaggagatgccagacc

SEQ ID NO: 363760 - DNA, 25 bp, Mus musculus
tcgcagttgcctcagcaccaaggag

SEQ ID NO: 363761 - DNA, 25 bp, Mus musculus
tcgcataccggatggaaatgcagga

SEQ ID NO: 363762 - DNA, 25 bp, Mus musculus
tcgcataggagagcgggctgagcgg

SEQ ID NO: 363763 - DNA, 25 bp, Mus musculus
tcgcataggcagttctcccagatgg

SEQ ID NO: 363764 - DNA, 25 bp, Mus musculus
tcgcatatactaggtcctgtgggaa

SEQ ID NO: 363765 - DNA, 25 bp, Mus musculus
tcgcatcaactgcagccaggctatg

SEQ ID NO: 363766 - DNA, 25 bp, Mus musculus
tcgcatccatgtcattgaccacagt

SEQ ID NO: 363767 - DNA, 25 bp, Mus musculus
tcgcatgaaggagatcttggacaag

SEQ ID NO: 363768 - DNA, 25 bp, Mus musculus
tcgcattccggatgattgtaaagtc

SEQ ID NO: 363769 - DNA, 25 bp, Mus musculus
tcgcattgcctgctccccacactcc

SEQ ID NO: 363770 - DNA, 25 bp, Mus musculus
tcgcatttgctgtccgctacagagc

SEQ ID NO: 363771 - DNA, 25 bp, Mus musculus
tcgcatttttcaataatgtatattt

SEQ ID NO: 363772 - DNA, 25 bp, Mus musculus
tcgccaaagcaaggacgtccacgtc

SEQ ID NO: 363773 - DNA, 25 bp, Mus musculus
tcgccaaagcccatgaaatgattga

SEQ ID NO: 363774 - DNA, 25 bp, Mus musculus
tcgccaaataagaacaactaggctg

SEQ ID NO: 363775 - DNA, 25 bp, Mus musculus
tcgccaaataagacagtgaaatcgg

SEQ ID NO: 363776 - DNA, 25 bp, Mus musculus
tcgccaacaccctgggaaacaaggg

SEQ ID NO: 363777 - DNA, 25 bp, Mus musculus
tcgccaagagctcagctttgggatt

SEQ ID NO: 363778 - DNA, 25 bp, Mus musculus
tcgccaagatttggattcaagtcaa

SEQ ID NO: 363779 - DNA, 25 bp, Mus musculus
tcgccaagcaggtagggccttcctg

SEQ ID NO: 363780 - DNA, 25 bp, Mus musculus
tcgccaagcggacccagccacctcc

SEQ ID NO: 363781 - DNA, 25 bp, Mus musculus
tcgccaagtacagacttctggagga

SEQ ID NO: 363782 - DNA, 25 bp, Mus musculus
tcgccaagtgctcaagtatgatgac

SEQ ID NO: 363783 - DNA, 25 bp, Mus musculus
tcgccaatggccaaatcaaagaaat

SEQ ID NO: 363784 - DNA, 25 bp, Mus musculus
tcgccaccagtcaactcctagtacc

SEQ ID NO: 363785 - DNA, 25 bp, Mus musculus
tcgccaccagtgctgaggatcaaac

SEQ ID NO: 363786 - DNA, 25 bp, Mus musculus
tcgccaccagttaaaaagtatggag

SEQ ID NO: 363787 - DNA, 25 bp, Mus musculus
tcgccacccaagttggagtcattcg

SEQ ID NO: 363788 - DNA, 25 bp, Mus musculus
tcgccacgcgagcaagctctcacgc

SEQ ID NO: 363789 - DNA, 25 bp, Mus musculus
tcgccacgtacctagaacaccacgc

SEQ ID NO: 363790 - DNA, 25 bp, Mus musculus
tcgccactgcacagattgcatctgg

SEQ ID NO: 363791 - DNA, 25 bp, Mus musculus
tcgccagcaacatctccagcacctg

SEQ ID NO: 363792 - DNA, 25 bp, Mus musculus
tcgccagcccgtcccaggtaaatca

SEQ ID NO: 363793 - DNA, 25 bp, Mus musculus
tcgccagctcaggcaccttaaggat

SEQ ID NO: 363794 - DNA, 25 bp, Mus musculus
tcgccagtgatttccggtacaaaga

SEQ ID NO: 363795 - DNA, 25 bp, Mus musculus
tcgccataggtaacattgccaagac

SEQ ID NO: 363796 - DNA, 25 bp, Mus musculus
tcgccatagtgggacaatatcccag

SEQ ID NO: 363797 - DNA, 25 bp, Mus musculus
tcgccatcccagggaacaggaagaa

SEQ ID NO: 363798 - DNA, 25 bp, Mus musculus
tcgccatcctggcgatcattacagg

SEQ ID NO: 363799 - DNA, 25 bp, Mus musculus
tcgccatcctggcggggaattctac

SEQ ID NO: 363800 - DNA, 25 bp, Mus musculus
tcgccatccttgaaattttctgaat

SEQ ID NO: 363801 - DNA, 25 bp, Mus musculus
tcgccatccttgaatgtccagtttc

SEQ ID NO: 363802 - DNA, 25 bp, Mus musculus
tcgccatcgagcaggtattcccaag

SEQ ID NO: 363803 - DNA, 25 bp, Mus musculus
tcgccatcgagcaggtgtcaccgga

SEQ ID NO: 363804 - DNA, 25 bp, Mus musculus
tcgccatctacgaggttcccaaaga

SEQ ID NO: 363805 - DNA, 25 bp, Mus musculus
tcgccatgaagaagcccattggaat

SEQ ID NO: 363806 - DNA, 25 bp, Mus musculus
tcgccatgggctcccggccccgtgg

SEQ ID NO: 363807 - DNA, 25 bp, Mus musculus
tcgccatgtactattttacctatga

SEQ ID NO: 363808 - DNA, 25 bp, Mus musculus
tcgcccaaaagacctagtggtttat

SEQ ID NO: 363809 - DNA, 25 bp, Mus musculus
tcgcccaagaaggtggagtttgtcc

SEQ ID NO: 363810 - DNA, 25 bp, Mus musculus
tcgcccacagcagagtctgtgcgcc

SEQ ID NO: 363811 - DNA, 25 bp, Mus musculus
tcgcccacgactgcactgggccctg

SEQ ID NO: 363812 - DNA, 25 bp, Mus musculus
tcgcccaggagcaggtgtagctact

SEQ ID NO: 363813 - DNA, 25 bp, Mus musculus
tcgcccaggataaagcgattgtcca

SEQ ID NO: 363814 - DNA, 25 bp, Mus musculus
tcgcccatcaagggaaaactcgatg

SEQ ID NO: 363815 - DNA, 25 bp, Mus musculus
tcgcccatgtcagtatttcctaaat

SEQ ID NO: 363816 - DNA, 25 bp, Mus musculus
tcgccccagaggtcacccggcctgc

SEQ ID NO: 363817 - DNA, 25 bp, Mus musculus
tcgccccagaggtgacccttaccct

SEQ ID NO: 363818 - DNA, 25 bp, Mus musculus
tcgcccccagagattaatgtggctg

SEQ ID NO: 363819 - DNA, 25 bp, Mus musculus
tcgcccccagaggtgtcgtggaggt

SEQ ID NO: 363820 - DNA, 25 bp, Mus musculus
tcgcccccgaccagagcagagggct

SEQ ID NO: 363821 - DNA, 25 bp, Mus musculus
tcgccccctggcaggtgatgctttt

SEQ ID NO: 363822 - DNA, 25 bp, Mus musculus
tcgccccctggtgtggacattgcaa

SEQ ID NO: 363823 - DNA, 25 bp, Mus musculus
tcgccccgagagaagtcaatgaaag

SEQ ID NO: 363824 - DNA, 25 bp, Mus musculus
tcgccccgagagactgaattccctc

SEQ ID NO: 363825 - DNA, 25 bp, Mus musculus
tcgcccctaagccttcaagatggtc

SEQ ID NO: 363826 - DNA, 25 bp, Mus musculus
tcgcccctaaggtaagttctcgtcc

SEQ ID NO: 363827 - DNA, 25 bp, Mus musculus
tcgcccctgaagatggagagaagag

SEQ ID NO: 363828 - DNA, 25 bp, Mus musculus
tcgcccctgagaaaaatgttttaca

SEQ ID NO: 363829 - DNA, 25 bp, Mus musculus
tcgcccgactatctctcacctatct

SEQ ID NO: 363830 - DNA, 25 bp, Mus musculus
tcgcccggcaggcctatgagaagca

SEQ ID NO: 363831 - DNA, 25 bp, Mus musculus
tcgcccgggacccttatgacctgat

SEQ ID NO: 363832 - DNA, 25 bp, Mus musculus
tcgcccgggacccttctgccactgc

SEQ ID NO: 363833 - DNA, 25 bp, Mus musculus
tcgcccgggaggcgctggcggtggt

SEQ ID NO: 363834 - DNA, 25 bp, Mus musculus
tcgccctagagttgaggccggcgct

SEQ ID NO: 363835 - DNA, 25 bp, Mus musculus
tcgccctcggctatcccctctgcca

SEQ ID NO: 363836 - DNA, 25 bp, Mus musculus
tcgccctcgggttccagcagaagac

SEQ ID NO: 363837 - DNA, 25 bp, Mus musculus
tcgccctctcaagctcagccttttc

SEQ ID NO: 363838 - DNA, 25 bp, Mus musculus
tcgccctgccgggagccctgcaggc

SEQ ID NO: 363839 - DNA, 25 bp, Mus musculus
tcgccctggtgaatggggtcagtgg

SEQ ID NO: 363840 - DNA, 25 bp, Mus musculus
tcgccctggtggggttggtggctgt

SEQ ID NO: 363841 - DNA, 25 bp, Mus musculus
tcgccctggtgggtccaagtacagc

SEQ ID NO: 363842 - DNA, 25 bp, Mus musculus
tcgccctgtccaaagatctcaccac

SEQ ID NO: 363843 - DNA, 25 bp, Mus musculus
tcgccctgtccaaaggaccatgacc

SEQ ID NO: 363844 - DNA, 25 bp, Mus musculus
tcgccctgtccaaaggaggagacct

SEQ ID NO: 363845 - DNA, 25 bp, Mus musculus
tcgccctgtccaaaggcctcaatct

SEQ ID NO: 363846 - DNA, 25 bp, Mus musculus
tcgccctttgaacttatattggatt

SEQ ID NO: 363847 - DNA, 25 bp, Mus musculus
tcgccgaaaagaaatggaagatagt

SEQ ID NO: 363848 - DNA, 25 bp, Mus musculus
tcgccgaagttacagacccactgtc

SEQ ID NO: 363849 - DNA, 25 bp, Mus musculus
tcgccgacaggagctacgagaggtt

SEQ ID NO: 363850 - DNA, 25 bp, Mus musculus
tcgccgacaggaggcgacccagtgg

SEQ ID NO: 363851 - DNA, 25 bp, Mus musculus
tcgccgagaggaaccaagatgaccc

SEQ ID NO: 363852 - DNA, 25 bp, Mus musculus
tcgccgagcactagcgctggggacc

SEQ ID NO: 363853 - DNA, 25 bp, Mus musculus
tcgccgagcagaacatgccggggtg

SEQ ID NO: 363854 - DNA, 25 bp, Mus musculus
tcgccgagcagcctgtagtgaaagt

SEQ ID NO: 363855 - DNA, 25 bp, Mus musculus
tcgccgagccgagatactactcgtc

SEQ ID NO: 363856 - DNA, 25 bp, Mus musculus
tcgccgatgatcttggttttgagtt

SEQ ID NO: 363857 - DNA, 25 bp, Mus musculus
tcgccgccacagagttctgtccttg

SEQ ID NO: 363858 - DNA, 25 bp, Mus musculus
tcgccgccatggagtcctccacctt

SEQ ID NO: 363859 - DNA, 25 bp, Mus musculus
tcgccgccctccccactgcgtctct

SEQ ID NO: 363860 - DNA, 25 bp, Mus musculus
tcgccgccgagctggagaactacga

SEQ ID NO: 363861 - DNA, 25 bp, Mus musculus
tcgccgccgagctggaggtggggcc

SEQ ID NO: 363862 - DNA, 25 bp, Mus musculus
tcgccgccgggtcagacgcctcttc

SEQ ID NO: 363863 - DNA, 25 bp, Mus musculus
tcgccgcctcgatgagcagctctca

SEQ ID NO: 363864 - DNA, 25 bp, Mus musculus
tcgccgcgcagactgggaagagtgt

SEQ ID NO: 363865 - DNA, 25 bp, Mus musculus
tcgccgcgcaggatctaccaaggcc

SEQ ID NO: 363866 - DNA, 25 bp, Mus musculus
tcgccgcgcttcagggcaactattg

SEQ ID NO: 363867 - DNA, 25 bp, Mus musculus
tcgccgcgtctggtgacttctgtga

SEQ ID NO: 363868 - DNA, 25 bp, Mus musculus
tcgccggaaagagacacagcagtcc

SEQ ID NO: 363869 - DNA, 25 bp, Mus musculus
tcgccggcagctcttcctcccctcc

SEQ ID NO: 363870 - DNA, 25 bp, Mus musculus
tcgccggcagggttgggatcacacc

SEQ ID NO: 363871 - DNA, 25 bp, Mus musculus
tcgccggcttccaggtaccaatggg

SEQ ID NO: 363872 - DNA, 25 bp, Mus musculus
tcgccgggggaagagtacacacgaa

SEQ ID NO: 363873 - DNA, 25 bp, Mus musculus
tcgccgtcagtctcggcgtggaaag

SEQ ID NO: 363874 - DNA, 25 bp, Mus musculus
tcgccgtctggggcctcatttcaga

SEQ ID NO: 363875 - DNA, 25 bp, Mus musculus
tcgccgtgccgcgggagaggaaaag

SEQ ID NO: 363876 - DNA, 25 bp, Mus musculus
tcgccgtgccgcgggtgtgccagga

SEQ ID NO: 363877 - DNA, 25 bp, Mus musculus
tcgccgtggggctgcagcagcctca

SEQ ID NO: 363878 - DNA, 25 bp, Mus musculus
tcgcctacaggcatataccagcgtg

SEQ ID NO: 363879 - DNA, 25 bp, Mus musculus
tcgcctaccctgggagtttttcgta

SEQ ID NO: 363880 - DNA, 25 bp, Mus musculus
tcgcctacgccgcctatgtattgta

SEQ ID NO: 363881 - DNA, 25 bp, Mus musculus
tcgcctacgccgcctctgtttgggg

SEQ ID NO: 363882 - DNA, 25 bp, Mus musculus
tcgcctactgcagtcagctggccgc

SEQ ID NO: 363883 - DNA, 25 bp, Mus musculus
tcgcctattgtggcaagtggtttgt

SEQ ID NO: 363884 - DNA, 25 bp, Mus musculus
tcgcctatttcaagataaacaagct

SEQ ID NO: 363885 - DNA, 25 bp, Mus musculus
tcgcctcaaggagtatgtctccaaa

SEQ ID NO: 363886 - DNA, 25 bp, Mus musculus
tcgcctcagagaacttctgcagccg

SEQ ID NO: 363887 - DNA, 25 bp, Mus musculus
tcgcctcagagatactacggaggag

SEQ ID NO: 363888 - DNA, 25 bp, Mus musculus
tcgcctcagaggtcgagcccagtga

SEQ ID NO: 363889 - DNA, 25 bp, Mus musculus
tcgcctcagaggtggcatgcagatc

SEQ ID NO: 363890 - DNA, 25 bp, Mus musculus
tcgcctcagagtgtgttcagttccc

SEQ ID NO: 363891 - DNA, 25 bp, Mus musculus
tcgcctcagagttccctggcagctc

SEQ ID NO: 363892 - DNA, 25 bp, Mus musculus
tcgcctccagcctatttaagagtgg

SEQ ID NO: 363893 - DNA, 25 bp, Mus musculus
tcgcctccaggccagcagcaacatg

SEQ ID NO: 363894 - DNA, 25 bp, Mus musculus
tcgcctcgagaaccctgcacctgct

SEQ ID NO: 363895 - DNA, 25 bp, Mus musculus
tcgcctcgaggaagaaggcattgtg

SEQ ID NO: 363896 - DNA, 25 bp, Mus musculus
tcgcctcgccaccagtcaactccta

SEQ ID NO: 363897 - DNA, 25 bp, Mus musculus
tcgcctcgccaccagtgctgaggat

SEQ ID NO: 363898 - DNA, 25 bp, Mus musculus
tcgcctcgccaccagttaaaaagta

SEQ ID NO: 363899 - DNA, 25 bp, Mus musculus
tcgcctctacctaacaccccaattc

SEQ ID NO: 363900 - DNA, 25 bp, Mus musculus
tcgcctctacctctttctagtaaca

SEQ ID NO: 363901 - DNA, 25 bp, Mus musculus
tcgcctctgacggggcatatctgct

SEQ ID NO: 363902 - DNA, 25 bp, Mus musculus
tcgcctctggaccaacggtcccatt

SEQ ID NO: 363903 - DNA, 25 bp, Mus musculus
tcgcctcttggattctgtgtcttta

SEQ ID NO: 363904 - DNA, 25 bp, Mus musculus
tcgcctgaagctaagctcccttcga

SEQ ID NO: 363905 - DNA, 25 bp, Mus musculus
tcgcctgaccatcaagctgacccct

SEQ ID NO: 363906 - DNA, 25 bp, Mus musculus
tcgcctgcaaggttcctgctgctgt

SEQ ID NO: 363907 - DNA, 25 bp, Mus musculus
tcgcctgcaagtgtctcactttaca

SEQ ID NO: 363908 - DNA, 25 bp, Mus musculus
tcgcctgcagagaggaagacgactg

SEQ ID NO: 363909 - DNA, 25 bp, Mus musculus
tcgcctgcaggatactttggaacaa

SEQ ID NO: 363910 - DNA, 25 bp, Mus musculus
tcgcctgcagggcatggaacaagat

SEQ ID NO: 363911 - DNA, 25 bp, Mus musculus
tcgcctgcagggtgagttggtgaaa

SEQ ID NO: 363912 - DNA, 25 bp, Mus musculus
tcgcctgcaggtgattttcgatata

SEQ ID NO: 363913 - DNA, 25 bp, Mus musculus
tcgcctgcaggtgtctaagcactgg

SEQ ID NO: 363914 - DNA, 25 bp, Mus musculus
tcgcctgcatcgagggagtagaact

SEQ ID NO: 363915 - DNA, 25 bp, Mus musculus
tcgcctgcgtgacgtgtcacgatgt

SEQ ID NO: 363916 - DNA, 25 bp, Mus musculus
tcgcctggagccgaaatcatgtcca

SEQ ID NO: 363917 - DNA, 25 bp, Mus musculus
tcgcctgggagagagggttgaaaac

SEQ ID NO: 363918 - DNA, 25 bp, Mus musculus
tcgcctgtggttggtgacaaacagc

SEQ ID NO: 363919 - DNA, 25 bp, Mus musculus
tcgccttcaccagggatgactctgt

SEQ ID NO: 363920 - DNA, 25 bp, Mus musculus
tcgccttccaagagttttcttggag

SEQ ID NO: 363921 - DNA, 25 bp, Mus musculus
tcgccttgccttctctcaaactcct

SEQ ID NO: 363922 - DNA, 25 bp, Mus musculus
tcgcctttgaaaagctttctccaga

SEQ ID NO: 363923 - DNA, 25 bp, Mus musculus
tcgcctttgaccaggaacttagccc

SEQ ID NO: 363924 - DNA, 25 bp, Mus musculus
tcgcctttgaccaggtaaccggtgt

SEQ ID NO: 363925 - DNA, 25 bp, Mus musculus
tcgcctttgtctggaagcggcctct

SEQ ID NO: 363926 - DNA, 25 bp, Mus musculus
tcgcctttgtctggtcccccttcct

SEQ ID NO: 363927 - DNA, 25 bp, Mus musculus
tcgcgaaccttgcccatggcgaatt

SEQ ID NO: 363928 - DNA, 25 bp, Mus musculus
tcgcgaaccttgggaattcgacacc

SEQ ID NO: 363929 - DNA, 25 bp, Mus musculus
tcgcgacatgaatggaatgacctat

SEQ ID NO: 363930 - DNA, 25 bp, Mus musculus
tcgcgacatgatctacttctccaac

SEQ ID NO: 363931 - DNA, 25 bp, Mus musculus
tcgcgagaacagttcaagggcagac

SEQ ID NO: 363932 - DNA, 25 bp, Mus musculus
tcgcgagactaagaccatggccaaa

SEQ ID NO: 363933 - DNA, 25 bp, Mus musculus
tcgcgagactaagagccccactgct

SEQ ID NO: 363934 - DNA, 25 bp, Mus musculus
tcgcgagctttcctttgaagcacct

SEQ ID NO: 363935 - DNA, 25 bp, Mus musculus
tcgcgaggacgatccactgcaacac

SEQ ID NO: 363936 - DNA, 25 bp, Mus musculus
tcgcgagtcccaagccccacccaca

SEQ ID NO: 363937 - DNA, 25 bp, Mus musculus
tcgcgatccgcagaagacctaaccg

SEQ ID NO: 363938 - DNA, 25 bp, Mus musculus
tcgcgatccgcagagcagcttaaga

SEQ ID NO: 363939 - DNA, 25 bp, Mus musculus
tcgcgattatcagaatccctctgcg

SEQ ID NO: 363940 - DNA, 25 bp, Mus musculus
tcgcgattatcagagtccagtagag

SEQ ID NO: 363941 - DNA, 25 bp, Mus musculus
tcgcgcaattcccaccaaatatacg

SEQ ID NO: 363942 - DNA, 25 bp, Mus musculus
tcgcgcacaggattacatcttctac

SEQ ID NO: 363943 - DNA, 25 bp, Mus musculus
tcgcgcacaggccctaccgtggacc

SEQ ID NO: 363944 - DNA, 25 bp, Mus musculus
tcgcgcactctgtgggtcatttctc

SEQ ID NO: 363945 - DNA, 25 bp, Mus musculus
tcgcgcagcatgaaagatgtattcc

SEQ ID NO: 363946 - DNA, 25 bp, Mus musculus
tcgcgcagcatgtcaaagaaaagag

SEQ ID NO: 363947 - DNA, 25 bp, Mus musculus
tcgcgcagcgacaatggaggtgaat

SEQ ID NO: 363948 - DNA, 25 bp, Mus musculus
tcgcgcagcgacattgtgtgttcca

SEQ ID NO: 363949 - DNA, 25 bp, Mus musculus
tcgcgcatccaggtcatccttcggg

SEQ ID NO: 363950 - DNA, 25 bp, Mus musculus
tcgcgccagaggaaggtgggagtca

SEQ ID NO: 363951 - DNA, 25 bp, Mus musculus
tcgcgccagagtttgtgatcctgtg

SEQ ID NO: 363952 - DNA, 25 bp, Mus musculus
tcgcgccctaagcaggtgagcccta

SEQ ID NO: 363953 - DNA, 25 bp, Mus musculus
tcgcgccgacgaaatggctaccaag

SEQ ID NO: 363954 - DNA, 25 bp, Mus musculus
tcgcgcctccagtgaccaaagactt

SEQ ID NO: 363955 - DNA, 25 bp, Mus musculus
tcgcgcctccagtttttggctttca

SEQ ID NO: 363956 - DNA, 25 bp, Mus musculus
tcgcgcctggagtctcactgttaga

SEQ ID NO: 363957 - DNA, 25 bp, Mus musculus
tcgcgcgcagtggtaactcataaat

SEQ ID NO: 363958 - DNA, 25 bp, Mus musculus
tcgcgcgcgaggcggaggccaggct

SEQ ID NO: 363959 - DNA, 25 bp, Mus musculus
tcgcgcgcgggggtgttccctcacc

SEQ ID NO: 363960 - DNA, 25 bp, Mus musculus
tcgcgcggcttggagctccttcctg

SEQ ID NO: 363961 - DNA, 25 bp, Mus musculus
tcgcgctgcgctcggtgagtgcagg

SEQ ID NO: 363962 - DNA, 25 bp, Mus musculus
tcgcgctgtccttctcctccgcctc

SEQ ID NO: 363963 - DNA, 25 bp, Mus musculus
tcgcggagagcggtcccgtaggcct

SEQ ID NO: 363964 - DNA, 25 bp, Mus musculus
tcgcggagccgagtaaagacatttc

SEQ ID NO: 363965 - DNA, 25 bp, Mus musculus
tcgcggagtcagaaggtagcaggtg

SEQ ID NO: 363966 - DNA, 25 bp, Mus musculus
tcgcggagtcaggctcttgtctggg

SEQ ID NO: 363967 - DNA, 25 bp, Mus musculus
tcgcggcagagccaggctagtgaac

SEQ ID NO: 363968 - DNA, 25 bp, Mus musculus
tcgcggccatgaagcatgtctgctg

SEQ ID NO: 363969 - DNA, 25 bp, Mus musculus
tcgcggccatgaaggcgggtgctac

SEQ ID NO: 363970 - DNA, 25 bp, Mus musculus
tcgcggccgagggtacttgtggaag

SEQ ID NO: 363971 - DNA, 25 bp, Mus musculus
tcgcggcctaaactccagtctttcc

SEQ ID NO: 363972 - DNA, 25 bp, Mus musculus
tcgcggcctgcagatcttgaaccag

SEQ ID NO: 363973 - DNA, 25 bp, Mus musculus
tcgcggcctgcagcacatcttcatt

SEQ ID NO: 363974 - DNA, 25 bp, Mus musculus
tcgcggcgagggtggtcctggactt

SEQ ID NO: 363975 - DNA, 25 bp, Mus musculus
tcgcggcgaggtaattgaagataga

SEQ ID NO: 363976 - DNA, 25 bp, Mus musculus
tcgcggcgctggagcctggaatgct

SEQ ID NO: 363977 - DNA, 25 bp, Mus musculus
tcgcggcggggtggcggtgggatcc

SEQ ID NO: 363978 - DNA, 25 bp, Mus musculus
tcgcggcgtccggacactgcagaag

SEQ ID NO: 363979 - DNA, 25 bp, Mus musculus
tcgcggcgtcctcagatatagccat

SEQ ID NO: 363980 - DNA, 25 bp, Mus musculus
tcgcggctcccgatggaaatcctat

SEQ ID NO: 363981 - DNA, 25 bp, Mus musculus
tcgcggcttgactaaaatgtcaaaa

SEQ ID NO: 363982 - DNA, 25 bp, Mus musculus
tcgcgggcccgtgaggtggtgatgc

SEQ ID NO: 363983 - DNA, 25 bp, Mus musculus
tcgcgggcccgtgagttcatattct

SEQ ID NO: 363984 - DNA, 25 bp, Mus musculus
tcgcgggcttcaggtagaagccact

SEQ ID NO: 363985 - DNA, 25 bp, Mus musculus
tcgcgggcttcaggtgaggatccca

SEQ ID NO: 363986 - DNA, 25 bp, Mus musculus
tcgcgggcttcagtgctggaggagg

SEQ ID NO: 363987 - DNA, 25 bp, Mus musculus
tcgcggggcaggtgcccatgttgga

SEQ ID NO: 363988 - DNA, 25 bp, Mus musculus
tcgcggggcaggtgtccatgttgga

SEQ ID NO: 363989 - DNA, 25 bp, Mus musculus
tcgcggtcaatgggtgggtgaggtg

SEQ ID NO: 363990 - DNA, 25 bp, Mus musculus
tcgcggtcaatggtcagcaagatcc

SEQ ID NO: 363991 - DNA, 25 bp, Mus musculus
tcgcggtgctcagggaggttacagc

SEQ ID NO: 363992 - DNA, 25 bp, Mus musculus
tcgcggtgctcagtgtctggagaca

SEQ ID NO: 363993 - DNA, 25 bp, Mus musculus
tcgcggtttgctggaaaggaagcag

SEQ ID NO: 363994 - DNA, 25 bp, Mus musculus
tcgcggtttgctggtacacactggt

SEQ ID NO: 363995 - DNA, 25 bp, Mus musculus
tcgcgtcacggtcttgttgcagcat

SEQ ID NO: 363996 - DNA, 25 bp, Mus musculus
tcgcgtcccggcccagggccttgct

SEQ ID NO: 363997 - DNA, 25 bp, Mus musculus
tcgcgtcgctccgaaatcatgtcca

SEQ ID NO: 363998 - DNA, 25 bp, Mus musculus
tcgcgtctagggagtagaacagagg

SEQ ID NO: 363999 - DNA, 25 bp, Mus musculus
tcgcgtggatcggaactccagcgac

SEQ ID NO: 364000 - DNA, 25 bp, Mus musculus
tcgcgtggatcggttcgccttgcgc

SEQ ID NO: 364001 - DNA, 25 bp, Mus musculus
tcgctaagcagccagatttagatca

SEQ ID NO: 364002 - DNA, 25 bp, Mus musculus
tcgctaagctgccgggcatgtctag

SEQ ID NO: 364003 - DNA, 25 bp, Mus musculus
tcgctacgaggtgtgggctcaccgc

SEQ ID NO: 364004 - DNA, 25 bp, Mus musculus
tcgctacgataggaaacagatggga

SEQ ID NO: 364005 - DNA, 25 bp, Mus musculus
tcgctacgataggaacacatcaaga

SEQ ID NO: 364006 - DNA, 25 bp, Mus musculus
tcgctacgatagtggttccatgtca

SEQ ID NO: 364007 - DNA, 25 bp, Mus musculus
tcgctactacaagaaacatggcatc

SEQ ID NO: 364008 - DNA, 25 bp, Mus musculus
tcgctacttttaagatttttgaaga

SEQ ID NO: 364009 - DNA, 25 bp, Mus musculus
tcgctattcagattcttctggaata

SEQ ID NO: 364010 - DNA, 25 bp, Mus musculus
tcgctcaaaggagaaaggatcctgg

SEQ ID NO: 364011 - DNA, 25 bp, Mus musculus
tcgctcaaaggtcgatccttcggga

SEQ ID NO: 364012 - DNA, 25 bp, Mus musculus
tcgctcaacaagagagaaggctttg

SEQ ID NO: 364013 - DNA, 25 bp, Mus musculus
tcgctccaaagaacctaaggaaggt

SEQ ID NO: 364014 - DNA, 25 bp, Mus musculus
tcgctccaaagagaaaacggccccg

SEQ ID NO: 364015 - DNA, 25 bp, Mus musculus
tcgctccaaagatcctgtctctaca

SEQ ID NO: 364016 - DNA, 25 bp, Mus musculus
tcgctccaaaggctgcctgcttctg

SEQ ID NO: 364017 - DNA, 25 bp, Mus musculus
tcgctcccgcctcgggttgctgttc

SEQ ID NO: 364018 - DNA, 25 bp, Mus musculus
tcgctcctatggcatgtgggcacat

SEQ ID NO: 364019 - DNA, 25 bp, Mus musculus
tcgctcctccctcgagaggagctgt

SEQ ID NO: 364020 - DNA, 25 bp, Mus musculus
tcgctcggagatcgcttttgtggct

SEQ ID NO: 364021 - DNA, 25 bp, Mus musculus
tcgctcggagatcgtatacttgaag

SEQ ID NO: 364022 - DNA, 25 bp, Mus musculus
tcgctcggctgcagggtaagaccag

SEQ ID NO: 364023 - DNA, 25 bp, Mus musculus
tcgctcgtgccaagtctcacacagg

SEQ ID NO: 364024 - DNA, 25 bp, Mus musculus
tcgctctatttgatgttcatgcaga

SEQ ID NO: 364025 - DNA, 25 bp, Mus musculus
tcgctctccttgccgaatgcctaaa

SEQ ID NO: 364026 - DNA, 25 bp, Mus musculus
tcgctctgagggttccaattggttc

SEQ ID NO: 364027 - DNA, 25 bp, Mus musculus
tcgctcttgtcacaggtggtgagat

SEQ ID NO: 364028 - DNA, 25 bp, Mus musculus
tcgctgaaccgagcctgttcctgcg

SEQ ID NO: 364029 - DNA, 25 bp, Mus musculus
tcgctgaagagcatccgtgcagccc

SEQ ID NO: 364030 - DNA, 25 bp, Mus musculus
tcgctgaagccagagagtcatggat

SEQ ID NO: 364031 - DNA, 25 bp, Mus musculus
tcgctgaatttacggtcaccattct

SEQ ID NO: 364032 - DNA, 25 bp, Mus musculus
tcgctgaatttacggtggctctccc

SEQ ID NO: 364033 - DNA, 25 bp, Mus musculus
tcgctgaccatactggacacccttt

SEQ ID NO: 364034 - DNA, 25 bp, Mus musculus
tcgctgacccagcggcgaggacgag

SEQ ID NO: 364035 - DNA, 25 bp, Mus musculus
tcgctgacgtagaggaaatgctgtc

SEQ ID NO: 364036 - DNA, 25 bp, Mus musculus
tcgctgagttctggaatacagtgag

SEQ ID NO: 364037 - DNA, 25 bp, Mus musculus
tcgctgcacagtgatgactcttcca

SEQ ID NO: 364038 - DNA, 25 bp, Mus musculus
tcgctgccaccatgaaaggagaagc

SEQ ID NO: 364039 - DNA, 25 bp, Mus musculus
tcgctgcccaggtccgcacgctcac

SEQ ID NO: 364040 - DNA, 25 bp, Mus musculus
tcgctgcctactgggcaaggtggtt

SEQ ID NO: 364041 - DNA, 25 bp, Mus musculus
tcgctgcctactggggaaggagaag

SEQ ID NO: 364042 - DNA, 25 bp, Mus musculus
tcgctgcggagacaggttgcagaat

SEQ ID NO: 364043 - DNA, 25 bp, Mus musculus
tcgctgctataggcatgaaagaagt

SEQ ID NO: 364044 - DNA, 25 bp, Mus musculus
tcgctgctataggctactattggaa

SEQ ID NO: 364045 - DNA, 25 bp, Mus musculus
tcgctgctattctccactccagagg

SEQ ID NO: 364046 - DNA, 25 bp, Mus musculus
tcgctgctcggtgtcgcaacatccc

SEQ ID NO: 364047 - DNA, 25 bp, Mus musculus
tcgctgctgaggtcgtacaccctgg

SEQ ID NO: 364048 - DNA, 25 bp, Mus musculus
tcgctggccagtatgtggcctttgc

SEQ ID NO: 364049 - DNA, 25 bp, Mus musculus
tcgctggccctcctggtgctgatgg

SEQ ID NO: 364050 - DNA, 25 bp, Mus musculus
tcgctggcttccaaatggaactctg

SEQ ID NO: 364051 - DNA, 25 bp, Mus musculus
tcgctgggatcgctttagaatgtga

SEQ ID NO: 364052 - DNA, 25 bp, Mus musculus
tcgctgggatcggtttttgtgaatt

SEQ ID NO: 364053 - DNA, 25 bp, Mus musculus
tcgctgggatcgtttgtttatatgg

SEQ ID NO: 364054 - DNA, 25 bp, Mus musculus
tcgctgggcagatcttccttggggg

SEQ ID NO: 364055 - DNA, 25 bp, Mus musculus
tcgctggtgtctggtggcactgaca

SEQ ID NO: 364056 - DNA, 25 bp, Mus musculus
tcgctggttctgagaatctgcctgt

SEQ ID NO: 364057 - DNA, 25 bp, Mus musculus
tcgctggttctgagttctcatctcc

SEQ ID NO: 364058 - DNA, 25 bp, Mus musculus
tcgctggtttgcgctccctccaaca

SEQ ID NO: 364059 - DNA, 25 bp, Mus musculus
tcgctgtccagctcgtagtgcatgt

SEQ ID NO: 364060 - DNA, 25 bp, Mus musculus
tcgctgtccaggagctggagaagct

SEQ ID NO: 364061 - DNA, 25 bp, Mus musculus
tcgctgtctccaagccaagaggacc

SEQ ID NO: 364062 - DNA, 25 bp, Mus musculus
tcgctgtgcgggtgtctccacgacc

SEQ ID NO: 364063 - DNA, 25 bp, Mus musculus
tcgctgtgcgggtgtgggcacatct

SEQ ID NO: 364064 - DNA, 25 bp, Mus musculus
tcgctgtgtctatcgtgcgggccct

SEQ ID NO: 364065 - DNA, 25 bp, Mus musculus
tcgctgtgtctatgtgaagccatcc

SEQ ID NO: 364066 - DNA, 25 bp, Mus musculus
tcgctgtgttggacttccttgtgga

SEQ ID NO: 364067 - DNA, 25 bp, Mus musculus
tcgctgttacggaggcgaagaggat

SEQ ID NO: 364068 - DNA, 25 bp, Mus musculus
tcgctgttacgggctgtgacaatct

SEQ ID NO: 364069 - DNA, 25 bp, Mus musculus
tcgctgttttgaaacatgtccacct

SEQ ID NO: 364070 - DNA, 25 bp, Mus musculus
tcgcttaccggtggaagcttggaga

SEQ ID NO: 364071 - DNA, 25 bp, Mus musculus
tcgcttaccgttaccgcaggtggaa

SEQ ID NO: 364072 - DNA, 25 bp, Mus musculus
tcgcttacttaaaggaagtggaaca

SEQ ID NO: 364073 - DNA, 25 bp, Mus musculus
tcgcttagcagacgcttaaaggatg

SEQ ID NO: 364074 - DNA, 25 bp, Mus musculus
tcgcttcaatgcaccgggtgctcaa

SEQ ID NO: 364075 - DNA, 25 bp, Mus musculus
tcgcttcaggtgaggcctttaccct

SEQ ID NO: 364076 - DNA, 25 bp, Mus musculus
tcgcttcctcaagctgagtcctgag

SEQ ID NO: 364077 - DNA, 25 bp, Mus musculus
tcgcttcgggactacctccccggga

SEQ ID NO: 364078 - DNA, 25 bp, Mus musculus
tcgcttcgggactagctccccggga

SEQ ID NO: 364079 - DNA, 25 bp, Mus musculus
tcgcttctaaggtggtggcctacca

SEQ ID NO: 364080 - DNA, 25 bp, Mus musculus
tcgcttctttgaggactccagattc

SEQ ID NO: 364081 - DNA, 25 bp, Mus musculus
tcgcttgcaaggttcctgtcccacc

SEQ ID NO: 364082 - DNA, 25 bp, Mus musculus
tcgcttgcaagtgtgacttggaagg

SEQ ID NO: 364083 - DNA, 25 bp, Mus musculus
tcgcttgcaggcctacagggtggac

SEQ ID NO: 364084 - DNA, 25 bp, Mus musculus
tcgcttgtagaaatgccaaagccct

SEQ ID NO: 364085 - DNA, 25 bp, Mus musculus
tcgcttgtaggaatgccaaagccct

SEQ ID NO: 364086 - DNA, 25 bp, Mus musculus
tcgcttgtggggaatgtttttgagc

SEQ ID NO: 364087 - DNA, 25 bp, Mus musculus
tcgctttcaactgtatggtcttggg

SEQ ID NO: 364088 - DNA, 25 bp, Mus musculus
tcgctttcatttactgatgggagtc

SEQ ID NO: 364089 - DNA, 25 bp, Mus musculus
tcgctttcatttactttgtggcctt

SEQ ID NO: 364090 - DNA, 25 bp, Mus musculus
tcgctttctgaatggtttggctacc

SEQ ID NO: 364091 - DNA, 25 bp, Mus musculus
tcgcttttgaacttgatcgtactcg

SEQ ID NO: 364092 - DNA, 25 bp, Mus musculus
tcgcttttgaacttggatgtccaga

SEQ ID NO: 364093 - DNA, 25 bp, Mus musculus
tcgcttttgagcttggcaaatggtc

SEQ ID NO: 364094 - DNA, 25 bp, Mus musculus
tcgcttttgagtgacagccctgctg

SEQ ID NO: 364095 - DNA, 25 bp, Mus musculus
tcgcttttttatcaggtcgcatcaa

SEQ ID NO: 364096 - DNA, 25 bp, Mus musculus
tcggaaaaaggaaggtcatcgtgga

SEQ ID NO: 364097 - DNA, 25 bp, Mus musculus
tcggaaaacaaaggcatccttactt

SEQ ID NO: 364098 - DNA, 25 bp, Mus musculus
tcggaaaatgccgagctgccacagg

SEQ ID NO: 364099 - DNA, 25 bp, Mus musculus
tcggaaactcagatgaatgaagaaa

SEQ ID NO: 364100 - DNA, 25 bp, Mus musculus
tcggaaagttggggccctggagtcc

SEQ ID NO: 364101 - DNA, 25 bp, Mus musculus
tcggaacaccacaagagcatcgcaa

SEQ ID NO: 364102 - DNA, 25 bp, Mus musculus
tcggaacagccgtgaagcacctaaa

SEQ ID NO: 364103 - DNA, 25 bp, Mus musculus
tcggaaccagttccctcagccaatg

SEQ ID NO: 364104 - DNA, 25 bp, Mus musculus
tcggaaccatggctagcctctgccg

SEQ ID NO: 364105 - DNA, 25 bp, Mus musculus
tcggaaccatggcttccctttccct

SEQ ID NO: 364106 - DNA, 25 bp, Mus musculus
tcggaaccatgtgaaaccttccacc

SEQ ID NO: 364107 - DNA, 25 bp, Mus musculus
tcggaactgagccatctcttggcgt

SEQ ID NO: 364108 - DNA, 25 bp, Mus musculus
tcggaactggacaagaaggagaaga

SEQ ID NO: 364109 - DNA, 25 bp, Mus musculus
tcggaactggacaagtgtcttcttg

SEQ ID NO: 364110 - DNA, 25 bp, Mus musculus
tcggaagaggagggagaatcccgta

SEQ ID NO: 364111 - DNA, 25 bp, Mus musculus
tcggaagcaaggtctggtccatcga

SEQ ID NO: 364112 - DNA, 25 bp, Mus musculus
tcggaagcactaacgtttgatcccc

SEQ ID NO: 364113 - DNA, 25 bp, Mus musculus
tcggaagcactaactccagaacttt

SEQ ID NO: 364114 - DNA, 25 bp, Mus musculus
tcggaagcagagatggctatgaacg

SEQ ID NO: 364115 - DNA, 25 bp, Mus musculus
tcggaagcctctgagtcgcttcaaa

SEQ ID NO: 364116 - DNA, 25 bp, Mus musculus
tcggaagcctctggaattggaaatg

SEQ ID NO: 364117 - DNA, 25 bp, Mus musculus
tcggaaggagctgactggccaatca

SEQ ID NO: 364118 - DNA, 25 bp, Mus musculus
tcggaaggaggagagatactgttat

SEQ ID NO: 364119 - DNA, 25 bp, Mus musculus
tcggaaggaggagagcaataaactg

SEQ ID NO: 364120 - DNA, 25 bp, Mus musculus
tcggaaggaggagagcaccaatgga

SEQ ID NO: 364121 - DNA, 25 bp, Mus musculus
tcggaaggaggagaggctgtgacct

SEQ ID NO: 364122 - DNA, 25 bp, Mus musculus
tcggaaggaggagagttgctcttct

SEQ ID NO: 364123 - DNA, 25 bp, Mus musculus
tcggaaggagggcagaatctagatc

SEQ ID NO: 364124 - DNA, 25 bp, Mus musculus
tcggaagtgaactcaaagacagatc

SEQ ID NO: 364125 - DNA, 25 bp, Mus musculus
tcggaatctaggagcccaccttggg

SEQ ID NO: 364126 - DNA, 25 bp, Mus musculus
tcggaatgagaaaaaggagaagaaa

SEQ ID NO: 364127 - DNA, 25 bp, Mus musculus
tcggaatgatgagagccagctctcc

SEQ ID NO: 364128 - DNA, 25 bp, Mus musculus
tcggaatgatgagctctcccctgcc

SEQ ID NO: 364129 - DNA, 25 bp, Mus musculus
tcggacaagcggcagattgtagacc

SEQ ID NO: 364130 - DNA, 25 bp, Mus musculus
tcggacacagagaagcagggtcccg

SEQ ID NO: 364131 - DNA, 25 bp, Mus musculus
tcggacacagatgcctccagctcag

SEQ ID NO: 364132 - DNA, 25 bp, Mus musculus
tcggacacccccaagttcaatctca

SEQ ID NO: 364133 - DNA, 25 bp, Mus musculus
tcggacactcagagactgtctctgg

SEQ ID NO: 364134 - DNA, 25 bp, Mus musculus
tcggacactcagaggatttccctag

SEQ ID NO: 364135 - DNA, 25 bp, Mus musculus
tcggacaggagagtgaagtgtgtca

SEQ ID NO: 364136 - DNA, 25 bp, Mus musculus
tcggacatcctgaagaattacctgg

SEQ ID NO: 364137 - DNA, 25 bp, Mus musculus
tcggacatcctgaagtgtcttatct

SEQ ID NO: 364138 - DNA, 25 bp, Mus musculus
tcggacatctgtggttcggcagact

SEQ ID NO: 364139 - DNA, 25 bp, Mus musculus
tcggacatgcagtggaaagttcgaa

SEQ ID NO: 364140 - DNA, 25 bp, Mus musculus
tcggacatgtgtgagggctgccggt

SEQ ID NO: 364141 - DNA, 25 bp, Mus musculus
tcggaccactcggagatgtggtcag

SEQ ID NO: 364142 - DNA, 25 bp, Mus musculus
tcggaccactcggcctctgcagaga

SEQ ID NO: 364143 - DNA, 25 bp, Mus musculus
tcggaccatcagccttggggagttc

SEQ ID NO: 364144 - DNA, 25 bp, Mus musculus
tcggacccacatggtggacctgctg

SEQ ID NO: 364145 - DNA, 25 bp, Mus musculus
tcggacccagtcgacctgataaaaa

SEQ ID NO: 364146 - DNA, 25 bp, Mus musculus
tcggaccccgaggagccaacatgtt

SEQ ID NO: 364147 - DNA, 25 bp, Mus musculus
tcggaccggaacggatgtatacatc

SEQ ID NO: 364148 - DNA, 25 bp, Mus musculus
tcggacctggagcagaagtattggg

SEQ ID NO: 364149 - DNA, 25 bp, Mus musculus
tcggacctggagtgggaccctgaag

SEQ ID NO: 364150 - DNA, 25 bp, Mus musculus
tcggacctggatgctaaaaggattc

SEQ ID NO: 364151 - DNA, 25 bp, Mus musculus
tcggacctggtcataagggctaaat

SEQ ID NO: 364152 - DNA, 25 bp, Mus musculus
tcggacgcaggctcagcttctttgt

SEQ ID NO: 364153 - DNA, 25 bp, Mus musculus
tcggacgcagggaaggtagtgtgtg

SEQ ID NO: 364154 - DNA, 25 bp, Mus musculus
tcggacggctgccgggttgtgagcc

SEQ ID NO: 364155 - DNA, 25 bp, Mus musculus
tcggacgtagaaggcctctttgaca

SEQ ID NO: 364156 - DNA, 25 bp, Mus musculus
tcggactatacaaggtggggatgcg

SEQ ID NO: 364157 - DNA, 25 bp, Mus musculus
tcggactcaggaggatatttccacc

SEQ ID NO: 364158 - DNA, 25 bp, Mus musculus
tcggactcgagaggtcactggatgt

SEQ ID NO: 364159 - DNA, 25 bp, Mus musculus
tcggactcgagagttacaggtcact

SEQ ID NO: 364160 - DNA, 25 bp, Mus musculus
tcggactcgctgagctccagttata

SEQ ID NO: 364161 - DNA, 25 bp, Mus musculus
tcggactttgagaaccctgactgaa

SEQ ID NO: 364162 - DNA, 25 bp, Mus musculus
tcggacttttgatcctcacttcctg

SEQ ID NO: 364163 - DNA, 25 bp, Mus musculus
tcggacttttggacagtttcttgaa

SEQ ID NO: 364164 - DNA, 25 bp, Mus musculus
tcggagaaaagggagaacctggtga

SEQ ID NO: 364165 - DNA, 25 bp, Mus musculus
tcggagaaaggccagccatgtgagt

SEQ ID NO: 364166 - DNA, 25 bp, Mus musculus
tcggagaaccctcgatggtttcaag

SEQ ID NO: 364167 - DNA, 25 bp, Mus musculus
tcggagaagtcccgttgtatcagag

SEQ ID NO: 364168 - DNA, 25 bp, Mus musculus
tcggagaatgggcaggtggcactga

SEQ ID NO: 364169 - DNA, 25 bp, Mus musculus
tcggagaatgggcagttgttacagg

SEQ ID NO: 364170 - DNA, 25 bp, Mus musculus
tcggagacccggatttcccagcctg

SEQ ID NO: 364171 - DNA, 25 bp, Mus musculus
tcggagacgcggctcctgtgcggca

SEQ ID NO: 364172 - DNA, 25 bp, Mus musculus
tcggagagaatgggttcaatgtatc

SEQ ID NO: 364173 - DNA, 25 bp, Mus musculus
tcggagagaccaggtaggcgacgct

SEQ ID NO: 364174 - DNA, 25 bp, Mus musculus
tcggagagcagaggtgtggagaaga

SEQ ID NO: 364175 - DNA, 25 bp, Mus musculus
tcggagaggaagagatcaagcactt

SEQ ID NO: 364176 - DNA, 25 bp, Mus musculus
tcggagatccccaaggcgagttctg

SEQ ID NO: 364177 - DNA, 25 bp, Mus musculus
tcggagatgaagattcaatgagagg

SEQ ID NO: 364178 - DNA, 25 bp, Mus musculus
tcggagatgcccagatcatgagcca

SEQ ID NO: 364179 - DNA, 25 bp, Mus musculus
tcggagatggaggctcagctgtctc

SEQ ID NO: 364180 - DNA, 25 bp, Mus musculus
tcggagatttgcagtccaacgtcgt

SEQ ID NO: 364181 - DNA, 25 bp, Mus musculus
tcggagccatgcctcttcgacttga

SEQ ID NO: 364182 - DNA, 25 bp, Mus musculus
tcggagccatggagcatttcactgt

SEQ ID NO: 364183 - DNA, 25 bp, Mus musculus
tcggagcccgaccagaaccgggtgg

SEQ ID NO: 364184 - DNA, 25 bp, Mus musculus
tcggagcccgcgattctcattgaaa

SEQ ID NO: 364185 - DNA, 25 bp, Mus musculus
tcggagcccgcgggtcttactgttt

SEQ ID NO: 364186 - DNA, 25 bp, Mus musculus
tcggagccgcagcagttgccccaga

SEQ ID NO: 364187 - DNA, 25 bp, Mus musculus
tcggagccgccaagtgcctgaagac

SEQ ID NO: 364188 - DNA, 25 bp, Mus musculus
tcggagcgaccgggtcatgtaggaa

SEQ ID NO: 364189 - DNA, 25 bp, Mus musculus
tcggagctgatgaggatcctcagct

SEQ ID NO: 364190 - DNA, 25 bp, Mus musculus
tcggagctgctgctggctttgaaca

SEQ ID NO: 364191 - DNA, 25 bp, Mus musculus
tcggaggaagcaccactgccgaaac

SEQ ID NO: 364192 - DNA, 25 bp, Mus musculus
tcggaggacagcataagcagtacgc

SEQ ID NO: 364193 - DNA, 25 bp, Mus musculus
tcggaggagtggtgtggaaggcagt

SEQ ID NO: 364194 - DNA, 25 bp, Mus musculus
tcggaggatcagacatggtctcacc

SEQ ID NO: 364195 - DNA, 25 bp, Mus musculus
tcggaggccagcggggctggcgctg

SEQ ID NO: 364196 - DNA, 25 bp, Mus musculus
tcggaggccagcgggggctggctta

SEQ ID NO: 364197 - DNA, 25 bp, Mus musculus
tcggaggccagttctggtccgcata

SEQ ID NO: 364198 - DNA, 25 bp, Mus musculus
tcggaggccttgaaggatttagttg

SEQ ID NO: 364199 - DNA, 25 bp, Mus musculus
tcggaggccttgaagtgctttagga

SEQ ID NO: 364200 - DNA, 25 bp, Mus musculus
tcggaggctccgtggaacactcggg

SEQ ID NO: 364201 - DNA, 25 bp, Mus musculus
tcggaggggcagaggtagccattgc

SEQ ID NO: 364202 - DNA, 25 bp, Mus musculus
tcggagtccgtgctgagacgtcatc

SEQ ID NO: 364203 - DNA, 25 bp, Mus musculus
tcggagtcctcacagtgagtgatag

SEQ ID NO: 364204 - DNA, 25 bp, Mus musculus
tcggagtgcaagcagagagagaaga

SEQ ID NO: 364205 - DNA, 25 bp, Mus musculus
tcggagtgcaagcagttgcacgttt

SEQ ID NO: 364206 - DNA, 25 bp, Mus musculus
tcggagtgccaagacacaagcatct

SEQ ID NO: 364207 - DNA, 25 bp, Mus musculus
tcggagtgccaattattctgttttt

SEQ ID NO: 364208 - DNA, 25 bp, Mus musculus
tcggagttgctgggagacattgggg

SEQ ID NO: 364209 - DNA, 25 bp, Mus musculus
tcggagtttgatccattttttagtc

SEQ ID NO: 364210 - DNA, 25 bp, Mus musculus
tcggataaccagtggcatcctttga

SEQ ID NO: 364211 - DNA, 25 bp, Mus musculus
tcggataagacagatatgaaccgac

SEQ ID NO: 364212 - DNA, 25 bp, Mus musculus
tcggataagctctgacttcagaaca

SEQ ID NO: 364213 - DNA, 25 bp, Mus musculus
tcggataagctctggggatgaagag

SEQ ID NO: 364214 - DNA, 25 bp, Mus musculus
tcggataggagatgtttgagacaga

SEQ ID NO: 364215 - DNA, 25 bp, Mus musculus
tcggatcaatggctctgcctggtac

SEQ ID NO: 364216 - DNA, 25 bp, Mus musculus
tcggatcagcagctgtggctaactt

SEQ ID NO: 364217 - DNA, 25 bp, Mus musculus
tcggatccaggacctgctgtccttt

SEQ ID NO: 364218 - DNA, 25 bp, Mus musculus
tcggatccctgaattgacccagccc

SEQ ID NO: 364219 - DNA, 25 bp, Mus musculus
tcggatcgcctgcagagaggaagac

SEQ ID NO: 364220 - DNA, 25 bp, Mus musculus
tcggatcgcctgcagggtgagttgg

SEQ ID NO: 364221 - DNA, 25 bp, Mus musculus
tcggatcggagaaacgcttcgttaa

SEQ ID NO: 364222 - DNA, 25 bp, Mus musculus
tcggatctaacccaggtgatgaagt

SEQ ID NO: 364223 - DNA, 25 bp, Mus musculus
tcggatgactgaaatctacttaaaa

SEQ ID NO: 364224 - DNA, 25 bp, Mus musculus
tcggatgagcagagaccactgctat

SEQ ID NO: 364225 - DNA, 25 bp, Mus musculus
tcggatgccagatgttgcatgtggc

SEQ ID NO: 364226 - DNA, 25 bp, Mus musculus
tcggatgctgtgctgggtcactttt

SEQ ID NO: 364227 - DNA, 25 bp, Mus musculus
tcggatggaaaagcacctggatgct

SEQ ID NO: 364228 - DNA, 25 bp, Mus musculus
tcggatgtggataaaaatatccagc

SEQ ID NO: 364229 - DNA, 25 bp, Mus musculus
tcggatgtggatgcaaatgaaaaga

SEQ ID NO: 364230 - DNA, 25 bp, Mus musculus
tcggatgtttccaggaaatgcccat

SEQ ID NO: 364231 - DNA, 25 bp, Mus musculus
tcggatgtttccagggctgcacaga

SEQ ID NO: 364232 - DNA, 25 bp, Mus musculus
tcggattcacaaataaagtggtgac

SEQ ID NO: 364233 - DNA, 25 bp, Mus musculus
tcggattcaggcttgtgtgtgaggg

SEQ ID NO: 364234 - DNA, 25 bp, Mus musculus
tcggattcaggtaatcgccacgtgt

SEQ ID NO: 364235 - DNA, 25 bp, Mus musculus
tcggatttggagatataaccaagaa

SEQ ID NO: 364236 - DNA, 25 bp, Mus musculus
tcggcaacaagacgctgccgtccag

SEQ ID NO: 364237 - DNA, 25 bp, Mus musculus
tcggcaagcaaggcttataccccta

SEQ ID NO: 364238 - DNA, 25 bp, Mus musculus
tcggcaaggggagactggccaatca

SEQ ID NO: 364239 - DNA, 25 bp, Mus musculus
tcggcaatcagtttggagattctca

SEQ ID NO: 364240 - DNA, 25 bp, Mus musculus
tcggcaatggctatgacattgcctt

SEQ ID NO: 364241 - DNA, 25 bp, Mus musculus
tcggcacaactcctggtcatctagt

SEQ ID NO: 364242 - DNA, 25 bp, Mus musculus
tcggcacaatcagagccttggctgt

SEQ ID NO: 364243 - DNA, 25 bp, Mus musculus
tcggcacccatcagaagcaagacga

SEQ ID NO: 364244 - DNA, 25 bp, Mus musculus
tcggcaccggcttttcctagatgac

SEQ ID NO: 364245 - DNA, 25 bp, Mus musculus
tcggcacctgcagactctgcagagg

SEQ ID NO: 364246 - DNA, 25 bp, Mus musculus
tcggcacctgcagcctgctccccag

SEQ ID NO: 364247 - DNA, 25 bp, Mus musculus
tcggcagaaagctaaaaagatctga

SEQ ID NO: 364248 - DNA, 25 bp, Mus musculus
tcggcagacctgctggggtgacagt

SEQ ID NO: 364249 - DNA, 25 bp, Mus musculus
tcggcagatcagagattgttattga

SEQ ID NO: 364250 - DNA, 25 bp, Mus musculus
tcggcagatcagaggttgagcttgt

SEQ ID NO: 364251 - DNA, 25 bp, Mus musculus
tcggcagcgtcaggggacagaccac

SEQ ID NO: 364252 - DNA, 25 bp, Mus musculus
tcggcagctagagacagtccgagaa

SEQ ID NO: 364253 - DNA, 25 bp, Mus musculus
tcggcaggcagaatgggaaacagca

SEQ ID NO: 364254 - DNA, 25 bp, Mus musculus
tcggcaggcagaggcagatatcaag

SEQ ID NO: 364255 - DNA, 25 bp, Mus musculus
tcggcaggtcccaggtatgaatacc

SEQ ID NO: 364256 - DNA, 25 bp, Mus musculus
tcggcagtggcgcaggatggcgcag

SEQ ID NO: 364257 - DNA, 25 bp, Mus musculus
tcggcagtggcgcagttttactttc

SEQ ID NO: 364258 - DNA, 25 bp, Mus musculus
tcggcatcagaacggccggtttgtg

SEQ ID NO: 364259 - DNA, 25 bp, Mus musculus
tcggcatcatgatgacccggagaag

SEQ ID NO: 364260 - DNA, 25 bp, Mus musculus
tcggcatcgcggaggatcggtcatg

SEQ ID NO: 364261 - DNA, 25 bp, Mus musculus
tcggcatcttactacctgaaccagc

SEQ ID NO: 364262 - DNA, 25 bp, Mus musculus
tcggcatgaaccacaagacctgcta

SEQ ID NO: 364263 - DNA, 25 bp, Mus musculus
tcggcatgttcgtgtggacaaatgt

SEQ ID NO: 364264 - DNA, 25 bp, Mus musculus
tcggcatgttctctgaattcctgtc

SEQ ID NO: 364265 - DNA, 25 bp, Mus musculus
tcggcattgcccgcccatgtgcctc

SEQ ID NO: 364266 - DNA, 25 bp, Mus musculus
tcggccacctccggggccaagatgg

SEQ ID NO: 364267 - DNA, 25 bp, Mus musculus
tcggccacctttgaagactcggtgt

SEQ ID NO: 364268 - DNA, 25 bp, Mus musculus
tcggccagaagccaccccagtgatg

SEQ ID NO: 364269 - DNA, 25 bp, Mus musculus
tcggccagaagctgaaccttattca

SEQ ID NO: 364270 - DNA, 25 bp, Mus musculus
tcggccagaagttgcaagttgttca

SEQ ID NO: 364271 - DNA, 25 bp, Mus musculus
tcggccagagaggccggggcccgcc

SEQ ID NO: 364272 - DNA, 25 bp, Mus musculus
tcggccagcggcaagatgtcattga

SEQ ID NO: 364273 - DNA, 25 bp, Mus musculus
tcggccagcggcaaggtgcgccgtc

SEQ ID NO: 364274 - DNA, 25 bp, Mus musculus
tcggccagtgagcccatcatcttcg

SEQ ID NO: 364275 - DNA, 25 bp, Mus musculus
tcggccagtgccaaggcctggccac

SEQ ID NO: 364276 - DNA, 25 bp, Mus musculus
tcggcccaaagagatgaagttggcg

SEQ ID NO: 364277 - DNA, 25 bp, Mus musculus
tcggcccacgaggatcgtctgaagg

SEQ ID NO: 364278 - DNA, 25 bp, Mus musculus
tcggcccagagatgggcacctccgt

SEQ ID NO: 364279 - DNA, 25 bp, Mus musculus
tcggcccaggataagtacggtttct

SEQ ID NO: 364280 - DNA, 25 bp, Mus musculus
tcggcccctcccatggagggtgctc

SEQ ID NO: 364281 - DNA, 25 bp, Mus musculus
tcggccctacagtgcctgagcaatg

SEQ ID NO: 364282 - DNA, 25 bp, Mus musculus
tcggccggacgctagcagaatctta

SEQ ID NO: 364283 - DNA, 25 bp, Mus musculus
tcggccggacgggaagcttagatat

SEQ ID NO: 364284 - DNA, 25 bp, Mus musculus
tcggccggctccattcagaacaacc

SEQ ID NO: 364285 - DNA, 25 bp, Mus musculus
tcggccgtggtaagggaacaattaa

SEQ ID NO: 364286 - DNA, 25 bp, Mus musculus
tcggccgtttccacggaagatgcta

SEQ ID NO: 364287 - DNA, 25 bp, Mus musculus
tcggcctcagctttgaagctggctc

SEQ ID NO: 364288 - DNA, 25 bp, Mus musculus
tcggcctcaggaaattccttcacaa

SEQ ID NO: 364289 - DNA, 25 bp, Mus musculus
tcggcctcaggtttgaagctggctc

SEQ ID NO: 364290 - DNA, 25 bp, Mus musculus
tcggcctcagtagagtgatgcctgc

SEQ ID NO: 364291 - DNA, 25 bp, Mus musculus
tcggcctcatcctggtgacatctcc

SEQ ID NO: 364292 - DNA, 25 bp, Mus musculus
tcggcctccaacgtatcccaccaaa

SEQ ID NO: 364293 - DNA, 25 bp, Mus musculus
tcggcctgcaggcctgtcgaggggc

SEQ ID NO: 364294 - DNA, 25 bp, Mus musculus
tcggcctgcaggtgcggacctatgg

SEQ ID NO: 364295 - DNA, 25 bp, Mus musculus
tcggcctgcagtttcaggcctgtcg

SEQ ID NO: 364296 - DNA, 25 bp, Mus musculus
tcggcctgcggaggataagacctct

SEQ ID NO: 364297 - DNA, 25 bp, Mus musculus
tcggcctggcacatgccctggtgga

SEQ ID NO: 364298 - DNA, 25 bp, Mus musculus
tcggccttccagttttacctgctgc

SEQ ID NO: 364299 - DNA, 25 bp, Mus musculus
tcggccttgccaggaaaatactaaa

SEQ ID NO: 364300 - DNA, 25 bp, Mus musculus
tcggccttgtggtaccaatggggat

SEQ ID NO: 364301 - DNA, 25 bp, Mus musculus
tcggcgagcccagggaatattttta

SEQ ID NO: 364302 - DNA, 25 bp, Mus musculus
tcggcgagcccagtacgctccagaa

SEQ ID NO: 364303 - DNA, 25 bp, Mus musculus
tcggcgccaaagctgatggtgaggc

SEQ ID NO: 364304 - DNA, 25 bp, Mus musculus
tcggcgccagggagtccttgccatc

SEQ ID NO: 364305 - DNA, 25 bp, Mus musculus
tcggcgccaggggcagcttgactcg

SEQ ID NO: 364306 - DNA, 25 bp, Mus musculus
tcggcgccctggaagaccagagccc

SEQ ID NO: 364307 - DNA, 25 bp, Mus musculus
tcggcgccgatcaggttaaagatcg

SEQ ID NO: 364308 - DNA, 25 bp, Mus musculus
tcggcgctgctcggagcctggtgga

SEQ ID NO: 364309 - DNA, 25 bp, Mus musculus
tcggcggaacaggtaattgctggct

SEQ ID NO: 364310 - DNA, 25 bp, Mus musculus
tcggcggagggaagtgttgacgctg

SEQ ID NO: 364311 - DNA, 25 bp, Mus musculus
tcggcggcagcaggcaaggagatga

SEQ ID NO: 364312 - DNA, 25 bp, Mus musculus
tcggcggcagcaggcattaaaaaaa

SEQ ID NO: 364313 - DNA, 25 bp, Mus musculus
tcggcggccacctaggcctgcagct

SEQ ID NO: 364314 - DNA, 25 bp, Mus musculus
tcggcggccacctaggcttcagtgg

SEQ ID NO: 364315 - DNA, 25 bp, Mus musculus
tcggcggccagcagatcgtgtccag

SEQ ID NO: 364316 - DNA, 25 bp, Mus musculus
tcggcggccagcaggtactcctgag

SEQ ID NO: 364317 - DNA, 25 bp, Mus musculus
tcggcggcgtccgcgcgccgctgtg

SEQ ID NO: 364318 - DNA, 25 bp, Mus musculus
tcggcggggacagatctcaagacca

SEQ ID NO: 364319 - DNA, 25 bp, Mus musculus
tcggcgggtctcagaaagaagaaac

SEQ ID NO: 364320 - DNA, 25 bp, Mus musculus
tcggcgggtctcaggacaagccaat

SEQ ID NO: 364321 - DNA, 25 bp, Mus musculus
tcggcgtacaggagaatgactcagg

SEQ ID NO: 364322 - DNA, 25 bp, Mus musculus
tcggcgtcgccggcagctgcagcag

SEQ ID NO: 364323 - DNA, 25 bp, Mus musculus
tcggctaaagcagaggtgcagtgag

SEQ ID NO: 364324 - DNA, 25 bp, Mus musculus
tcggctacacagaagttcagttccg

SEQ ID NO: 364325 - DNA, 25 bp, Mus musculus
tcggctacacagatgttcactgaag

SEQ ID NO: 364326 - DNA, 25 bp, Mus musculus
tcggctacacagtctgggtgtttgg

SEQ ID NO: 364327 - DNA, 25 bp, Mus musculus
tcggctacaggagatccagtcactg

SEQ ID NO: 364328 - DNA, 25 bp, Mus musculus
tcggctacatggtcctctctctggc

SEQ ID NO: 364329 - DNA, 25 bp, Mus musculus
tcggctactacacgtgggctgtctt

SEQ ID NO: 364330 - DNA, 25 bp, Mus musculus
tcggctagtaagcagtctgcaaaca

SEQ ID NO: 364331 - DNA, 25 bp, Mus musculus
tcggctcacaaaaaacttcatcaaa

SEQ ID NO: 364332 - DNA, 25 bp, Mus musculus
tcggctcacagatggctgccagcaa

SEQ ID NO: 364333 - DNA, 25 bp, Mus musculus
tcggctcacaggcagaagactttaa

SEQ ID NO: 364334 - DNA, 25 bp, Mus musculus
tcggctcactgaggctggaccacgt

SEQ ID NO: 364335 - DNA, 25 bp, Mus musculus
tcggctcagggtcttggaggaggaa

SEQ ID NO: 364336 - DNA, 25 bp, Mus musculus
tcggctcattgaggtgaatgggcag

SEQ ID NO: 364337 - DNA, 25 bp, Mus musculus
tcggctccaaagtcggtttctgtat

SEQ ID NO: 364338 - DNA, 25 bp, Mus musculus
tcggctccacacgggacaagctctg

SEQ ID NO: 364339 - DNA, 25 bp, Mus musculus
tcggctccacacggttacaggccca

SEQ ID NO: 364340 - DNA, 25 bp, Mus musculus
tcggctccagaccaaagattcaagt

SEQ ID NO: 364341 - DNA, 25 bp, Mus musculus
tcggctccaggccaactggaataga

SEQ ID NO: 364342 - DNA, 25 bp, Mus musculus
tcggctcccacagagctgatttatc

SEQ ID NO: 364343 - DNA, 25 bp, Mus musculus
tcggctccctcccgatgagaagaag

SEQ ID NO: 364344 - DNA, 25 bp, Mus musculus
tcggctccctcccgggatatttgct

SEQ ID NO: 364345 - DNA, 25 bp, Mus musculus
tcggctccgagggagcagaaggcca

SEQ ID NO: 364346 - DNA, 25 bp, Mus musculus
tcggctccgaggtgggaaactacct

SEQ ID NO: 364347 - DNA, 25 bp, Mus musculus
tcggctccgcgggctgaggaaatat

SEQ ID NO: 364348 - DNA, 25 bp, Mus musculus
tcggctcggcccagggctcccagtt

SEQ ID NO: 364349 - DNA, 25 bp, Mus musculus
tcggctctccgggtgtaaagatctt

SEQ ID NO: 364350 - DNA, 25 bp, Mus musculus
tcggctctgcggggcgcctctgaag

SEQ ID NO: 364351 - DNA, 25 bp, Mus musculus
tcggctgaacaaaccttatatctac

SEQ ID NO: 364352 - DNA, 25 bp, Mus musculus
tcggctgaacaagttggtgacacat

SEQ ID NO: 364353 - DNA, 25 bp, Mus musculus
tcggctgacagacccgtggattccc

SEQ ID NO: 364354 - DNA, 25 bp, Mus musculus
tcggctgacagggcaagagttcaaa

SEQ ID NO: 364355 - DNA, 25 bp, Mus musculus
tcggctgacaggtagaaaaccagtt

SEQ ID NO: 364356 - DNA, 25 bp, Mus musculus
tcggctgagaggcaggctgcaaggc

SEQ ID NO: 364357 - DNA, 25 bp, Mus musculus
tcggctgagaggcaggctgtcaatg

SEQ ID NO: 364358 - DNA, 25 bp, Mus musculus
tcggctgaggaggccaccatggcag

SEQ ID NO: 364359 - DNA, 25 bp, Mus musculus
tcggctgcagacttgacatcgtctt

SEQ ID NO: 364360 - DNA, 25 bp, Mus musculus
tcggctgcagatcgcaacgagcgac

SEQ ID NO: 364361 - DNA, 25 bp, Mus musculus
tcggctgcagggtaagaccagctgt

SEQ ID NO: 364362 - DNA, 25 bp, Mus musculus
tcggctgcagttcgcaacgagcgac

SEQ ID NO: 364363 - DNA, 25 bp, Mus musculus
tcggctgcccgggcctgactaccag

SEQ ID NO: 364364 - DNA, 25 bp, Mus musculus
tcggctgccgactgcgaatcgccag

SEQ ID NO: 364365 - DNA, 25 bp, Mus musculus
tcggctgcctctcaaatgaacctct

SEQ ID NO: 364366 - DNA, 25 bp, Mus musculus
tcggctgcgcagctgcccctgtcga

SEQ ID NO: 364367 - DNA, 25 bp, Mus musculus
tcggctgcgcaggaaagtgcccatc

SEQ ID NO: 364368 - DNA, 25 bp, Mus musculus
tcggctgctcatggaaacgtgtgcc

SEQ ID NO: 364369 - DNA, 25 bp, Mus musculus
tcggctggggtcattctcagagctt

SEQ ID NO: 364370 - DNA, 25 bp, Mus musculus
tcggctgtcagagactatgaaatcc

SEQ ID NO: 364371 - DNA, 25 bp, Mus musculus
tcggcttcagagcactaaagcgaaa

SEQ ID NO: 364372 - DNA, 25 bp, Mus musculus
tcggcttcagatatttatcaacaac

SEQ ID NO: 364373 - DNA, 25 bp, Mus musculus
tcggcttcagctggaaaggcatctg

SEQ ID NO: 364374 - DNA, 25 bp, Mus musculus
tcggcttcaggtgaagctgaggaca

SEQ ID NO: 364375 - DNA, 25 bp, Mus musculus
tcggcttccaaggttcctacttgaa

SEQ ID NO: 364376 - DNA, 25 bp, Mus musculus
tcggcttccaagtctgttcttcagg

SEQ ID NO: 364377 - DNA, 25 bp, Mus musculus
tcggcttcctgagatgaagaaactg

SEQ ID NO: 364378 - DNA, 25 bp, Mus musculus
tcggcttccttaagacagatgggag

SEQ ID NO: 364379 - DNA, 25 bp, Mus musculus
tcggcttcttgccggccccgccccc

SEQ ID NO: 364380 - DNA, 25 bp, Mus musculus
tcggcttcttgccgggatctgaccc

SEQ ID NO: 364381 - DNA, 25 bp, Mus musculus
tcggcttgagagagagagccagctg

SEQ ID NO: 364382 - DNA, 25 bp, Mus musculus
tcggctttgacagctgcaggtcctg

SEQ ID NO: 364383 - DNA, 25 bp, Mus musculus
tcggctttgcaaaagtacgatcaga

SEQ ID NO: 364384 - DNA, 25 bp, Mus musculus
tcggctttgcaaagtgattcgtaag

SEQ ID NO: 364385 - DNA, 25 bp, Mus musculus
tcggctttgcaaatgctcagcagag

SEQ ID NO: 364386 - DNA, 25 bp, Mus musculus
tcgggaaacaggacccagccacctc

SEQ ID NO: 364387 - DNA, 25 bp, Mus musculus
tcgggaaacatacccagagaaattc

SEQ ID NO: 364388 - DNA, 25 bp, Mus musculus
tcgggaaacatcacagaagtaccca

SEQ ID NO: 364389 - DNA, 25 bp, Mus musculus
tcgggaaacgcgaagatgtgacagc

SEQ ID NO: 364390 - DNA, 25 bp, Mus musculus
tcgggaaagccatgtggagattggc

SEQ ID NO: 364391 - DNA, 25 bp, Mus musculus
tcgggaacatggagcacatggctgc

SEQ ID NO: 364392 - DNA, 25 bp, Mus musculus
tcgggaagctgaggaaaccaatgtt

SEQ ID NO: 364393 - DNA, 25 bp, Mus musculus
tcgggaagctgaggtctaatctctt

SEQ ID NO: 364394 - DNA, 25 bp, Mus musculus
tcgggaatctgggtggtactggggt

SEQ ID NO: 364395 - DNA, 25 bp, Mus musculus
tcgggacagataagcagcgtgcttc

SEQ ID NO: 364396 - DNA, 25 bp, Mus musculus
tcgggacaggagccgtccagagatc

SEQ ID NO: 364397 - DNA, 25 bp, Mus musculus
tcgggacaggaggcgtccagagatc

SEQ ID NO: 364398 - DNA, 25 bp, Mus musculus
tcgggaccaggatgaggctgtagag

SEQ ID NO: 364399 - DNA, 25 bp, Mus musculus
tcgggaccaggtctcctgttctccc

SEQ ID NO: 364400 - DNA, 25 bp, Mus musculus
tcgggaccgtgaagtggatgggagc

SEQ ID NO: 364401 - DNA, 25 bp, Mus musculus
tcgggacctaaagcctgagaatttg

SEQ ID NO: 364402 - DNA, 25 bp, Mus musculus
tcgggactacaggcgagcggcgtgc

SEQ ID NO: 364403 - DNA, 25 bp, Mus musculus
tcgggactacagggtcaacgtggtg

SEQ ID NO: 364404 - DNA, 25 bp, Mus musculus
tcgggactagctccccgggatgcgg

SEQ ID NO: 364405 - DNA, 25 bp, Mus musculus
tcgggactaggtccccgggatgcgg

SEQ ID NO: 364406 - DNA, 25 bp, Mus musculus
tcgggagactagcgtggcgactcca

SEQ ID NO: 364407 - DNA, 25 bp, Mus musculus
tcgggagactaggtcacgagcctgg

SEQ ID NO: 364408 - DNA, 25 bp, Mus musculus
tcgggagaggaacagtatccagatc

SEQ ID NO: 364409 - DNA, 25 bp, Mus musculus
tcgggagaggaggtttgggatgctc

SEQ ID NO: 364410 - DNA, 25 bp, Mus musculus
tcgggagaggcattcagtggctctg

SEQ ID NO: 364411 - DNA, 25 bp, Mus musculus
tcgggagatattggcaaaatatcca

SEQ ID NO: 364412 - DNA, 25 bp, Mus musculus
tcgggagatgagaatcagctgttct

SEQ ID NO: 364413 - DNA, 25 bp, Mus musculus
tcgggagatgagcattcgcagccgc

SEQ ID NO: 364414 - DNA, 25 bp, Mus musculus
tcgggagatggatccttaaatttag

SEQ ID NO: 364415 - DNA, 25 bp, Mus musculus
tcgggagcaggtttcaacactaaac

SEQ ID NO: 364416 - DNA, 25 bp, Mus musculus
tcgggagcctgcccaagtcttcaac

SEQ ID NO: 364417 - DNA, 25 bp, Mus musculus
tcgggagcctgtggcctaaatgtag

SEQ ID NO: 364418 - DNA, 25 bp, Mus musculus
tcgggagtcagaaagagcccagtga

SEQ ID NO: 364419 - DNA, 25 bp, Mus musculus
tcgggatcagcgtgggagctccgct

SEQ ID NO: 364420 - DNA, 25 bp, Mus musculus
tcgggatcctacagcttcacatgga

SEQ ID NO: 364421 - DNA, 25 bp, Mus musculus
tcgggatggcagcataggtggcagg

SEQ ID NO: 364422 - DNA, 25 bp, Mus musculus
tcgggatggcaggatccaagtgaac

SEQ ID NO: 364423 - DNA, 25 bp, Mus musculus
tcgggcaccgtcaggctcaagtcca

SEQ ID NO: 364424 - DNA, 25 bp, Mus musculus
tcgggcactgagcaccagttttgtg

SEQ ID NO: 364425 - DNA, 25 bp, Mus musculus
tcgggcagaagctgcgagacgcttt

SEQ ID NO: 364426 - DNA, 25 bp, Mus musculus
tcgggcagagatgggtggcctaacg

SEQ ID NO: 364427 - DNA, 25 bp, Mus musculus
tcgggcagctccccctctacctgga

SEQ ID NO: 364428 - DNA, 25 bp, Mus musculus
tcgggcagctgtgtgcctgctttgg

SEQ ID NO: 364429 - DNA, 25 bp, Mus musculus
tcgggcatctctgagctcatgaccc

SEQ ID NO: 364430 - DNA, 25 bp, Mus musculus
tcgggcatctctgaggtccgatctg

SEQ ID NO: 364431 - DNA, 25 bp, Mus musculus
tcgggcatctgtgggcatgtattta

SEQ ID NO: 364432 - DNA, 25 bp, Mus musculus
tcgggcatgagccaaagcctgcgcg

SEQ ID NO: 364433 - DNA, 25 bp, Mus musculus
tcgggcccagctctccagtctaacg

SEQ ID NO: 364434 - DNA, 25 bp, Mus musculus
tcgggccctcagccctaccagcagt

SEQ ID NO: 364435 - DNA, 25 bp, Mus musculus
tcgggccctcagtgagttgcagaca

SEQ ID NO: 364436 - DNA, 25 bp, Mus musculus
tcgggccgccagatagaaggacaag

SEQ ID NO: 364437 - DNA, 25 bp, Mus musculus
tcgggccgtagggctgttgacctat

SEQ ID NO: 364438 - DNA, 25 bp, Mus musculus
tcgggcctaccaggataaggaagcc

SEQ ID NO: 364439 - DNA, 25 bp, Mus musculus
tcgggcctgaagccggtcgacaatg

SEQ ID NO: 364440 - DNA, 25 bp, Mus musculus
tcgggcgagctgtaaaagctggcag

SEQ ID NO: 364441 - DNA, 25 bp, Mus musculus
tcgggcggcggagagttgtctgctg

SEQ ID NO: 364442 - DNA, 25 bp, Mus musculus
tcgggctcagtggatgagacccttt

SEQ ID NO: 364443 - DNA, 25 bp, Mus musculus
tcgggctcagtggttgttgacctcc

SEQ ID NO: 364444 - DNA, 25 bp, Mus musculus
tcgggctctggaggtacccactgat

SEQ ID NO: 364445 - DNA, 25 bp, Mus musculus
tcgggctctgtaggttgtgaaccat

SEQ ID NO: 364446 - DNA, 25 bp, Mus musculus
tcgggctgatcgaaaaggactctaa

SEQ ID NO: 364447 - DNA, 25 bp, Mus musculus
tcgggctgatcgtgaccatctttcc

SEQ ID NO: 364448 - DNA, 25 bp, Mus musculus
tcgggctgattgtagacaccggtac

SEQ ID NO: 364449 - DNA, 25 bp, Mus musculus
tcgggctgcagatgggcaccaacaa

SEQ ID NO: 364450 - DNA, 25 bp, Mus musculus
tcgggctgcagatttattgccaagc

SEQ ID NO: 364451 - DNA, 25 bp, Mus musculus
tcgggctgcctggcgtggccgagaa

SEQ ID NO: 364452 - DNA, 25 bp, Mus musculus
tcgggctgcctgtctccctccagag

SEQ ID NO: 364453 - DNA, 25 bp, Mus musculus
tcgggctgctccaagcagtgcctgg

SEQ ID NO: 364454 - DNA, 25 bp, Mus musculus
tcgggctggtgctgcatgggctccc

SEQ ID NO: 364455 - DNA, 25 bp, Mus musculus
tcgggcttcagggggctgaggcgat

SEQ ID NO: 364456 - DNA, 25 bp, Mus musculus
tcgggcttcgccatgcagtggcccc

SEQ ID NO: 364457 - DNA, 25 bp, Mus musculus
tcgggcttcgccatggtggccatgg

SEQ ID NO: 364458 - DNA, 25 bp, Mus musculus
tcgggcttgggcccagagtatgttc

SEQ ID NO: 364459 - DNA, 25 bp, Mus musculus
tcggggaaccagtgggaggtgggac

SEQ ID NO: 364460 - DNA, 25 bp, Mus musculus
tcggggaaccagtggtgactgccct

SEQ ID NO: 364461 - DNA, 25 bp, Mus musculus
tcggggacaacaccagcgactgctg

SEQ ID NO: 364462 - DNA, 25 bp, Mus musculus
tcggggacaagggtgacaagggaga

SEQ ID NO: 364463 - DNA, 25 bp, Mus musculus
tcggggacagagtctcggccaccat

SEQ ID NO: 364464 - DNA, 25 bp, Mus musculus
tcggggacattcaggttggctcctg

SEQ ID NO: 364465 - DNA, 25 bp, Mus musculus
tcggggacgcggcgatctgccagga

SEQ ID NO: 364466 - DNA, 25 bp, Mus musculus
tcggggacgcggcgcacacagggcc

SEQ ID NO: 364467 - DNA, 25 bp, Mus musculus
tcggggactaacaggactccaagcc

SEQ ID NO: 364468 - DNA, 25 bp, Mus musculus
tcggggactggaaagatggagccag

SEQ ID NO: 364469 - DNA, 25 bp, Mus musculus
tcggggactggacagatggagccag

SEQ ID NO: 364470 - DNA, 25 bp, Mus musculus
tcggggattatcgggctcagcgttg

SEQ ID NO: 364471 - DNA, 25 bp, Mus musculus
tcggggattatcggggaagcgtttc

SEQ ID NO: 364472 - DNA, 25 bp, Mus musculus
tcggggcagaagagattgtggatgg

SEQ ID NO: 364473 - DNA, 25 bp, Mus musculus
tcggggcaggatggcagccacagag

SEQ ID NO: 364474 - DNA, 25 bp, Mus musculus
tcggggcgcgcggtgtgaagaaaaa

SEQ ID NO: 364475 - DNA, 25 bp, Mus musculus
tcggggctccccgcctccgctgaag

SEQ ID NO: 364476 - DNA, 25 bp, Mus musculus
tcggggctgacagatcaacttatga

SEQ ID NO: 364477 - DNA, 25 bp, Mus musculus
tcggggcttttgcggctaagtaaga

SEQ ID NO: 364478 - DNA, 25 bp, Mus musculus
tcgggggactggcaatgtttgcccg

SEQ ID NO: 364479 - DNA, 25 bp, Mus musculus
tcgggggactggccatgtttgccag

SEQ ID NO: 364480 - DNA, 25 bp, Mus musculus
tcgggggccagccgccgccatgatc

SEQ ID NO: 364481 - DNA, 25 bp, Mus musculus
tcgggggcccagaaggctgagaccg

SEQ ID NO: 364482 - DNA, 25 bp, Mus musculus
tcgggggctgtcagattggtgaccc

SEQ ID NO: 364483 - DNA, 25 bp, Mus musculus
tcgggggctgtcaggcacagaggat

SEQ ID NO: 364484 - DNA, 25 bp, Mus musculus
tcggggggccgttgggcgtcgcggc

SEQ ID NO: 364485 - DNA, 25 bp, Mus musculus
tcggggtaaacatgctcatgaacta

SEQ ID NO: 364486 - DNA, 25 bp, Mus musculus
tcggggtagccaagctgcttttaga

SEQ ID NO: 364487 - DNA, 25 bp, Mus musculus
tcggggtgcagcaggatgctgggca

SEQ ID NO: 364488 - DNA, 25 bp, Mus musculus
tcggggtgcagcaggatgcttcatc

SEQ ID NO: 364489 - DNA, 25 bp, Mus musculus
tcggggttgtcaggtatgagcatgc

SEQ ID NO: 364490 - DNA, 25 bp, Mus musculus
tcggggtttgcctgaagagaaggag

SEQ ID NO: 364491 - DNA, 25 bp, Mus musculus
tcgggtagccggagtatgccgcctg

SEQ ID NO: 364492 - DNA, 25 bp, Mus musculus
tcgggtcagccggatgtggagaaag

SEQ ID NO: 364493 - DNA, 25 bp, Mus musculus
tcgggtcataccaggtaatatcctt

SEQ ID NO: 364494 - DNA, 25 bp, Mus musculus
tcgggtcatctaagaatgaagccaa

SEQ ID NO: 364495 - DNA, 25 bp, Mus musculus
tcgggtcatggaaatatgggcttag

SEQ ID NO: 364496 - DNA, 25 bp, Mus musculus
tcgggtccccgcgaggtgtcgcgga

SEQ ID NO: 364497 - DNA, 25 bp, Mus musculus
tcgggtcgcaggaactggtgctcct

SEQ ID NO: 364498 - DNA, 25 bp, Mus musculus
tcgggtcgtaggtctcaaaagattc

SEQ ID NO: 364499 - DNA, 25 bp, Mus musculus
tcgggtctccagacacagtttctct

SEQ ID NO: 364500 - DNA, 25 bp, Mus musculus
tcgggtctccaggacacagcccagt

SEQ ID NO: 364501 - DNA, 25 bp, Mus musculus
tcgggtctccaggtgtcctatctga

SEQ ID NO: 364502 - DNA, 25 bp, Mus musculus
tcgggtctctctcagcatacgaagg

SEQ ID NO: 364503 - DNA, 25 bp, Mus musculus
tcgggtctctctcaggcgtggagga

SEQ ID NO: 364504 - DNA, 25 bp, Mus musculus
tcgggtctgaggaacagtctgagat

SEQ ID NO: 364505 - DNA, 25 bp, Mus musculus
tcgggtctgtggatgatgaccacaa

SEQ ID NO: 364506 - DNA, 25 bp, Mus musculus
tcgggtgacagggccctggatgtca

SEQ ID NO: 364507 - DNA, 25 bp, Mus musculus
tcgggtgactgctcccttccctggt

SEQ ID NO: 364508 - DNA, 25 bp, Mus musculus
tcgggtggacggacgggcgcctctg

SEQ ID NO: 364509 - DNA, 25 bp, Mus musculus
tcgggtggtggaggacaaccataac

SEQ ID NO: 364510 - DNA, 25 bp, Mus musculus
tcgggtggtggctctgtctctgtcc

SEQ ID NO: 364511 - DNA, 25 bp, Mus musculus
tcgggtgtccctcagctgcttccgg

SEQ ID NO: 364512 - DNA, 25 bp, Mus musculus
tcgggtgtccctcaggtggcccctt

SEQ ID NO: 364513 - DNA, 25 bp, Mus musculus
tcgggtgtccctcagtcgagccccg

SEQ ID NO: 364514 - DNA, 25 bp, Mus musculus
tcgggtgttatatggttatatattt

SEQ ID NO: 364515 - DNA, 25 bp, Mus musculus
tcgggttaaggttgaggagccctca

SEQ ID NO: 364516 - DNA, 25 bp, Mus musculus
tcggtaaacctggagatgggtatcg

SEQ ID NO: 364517 - DNA, 25 bp, Mus musculus
tcggtaagagggggcccgtaagctg

SEQ ID NO: 364518 - DNA, 25 bp, Mus musculus
tcggtacatgcaggtgcatattttc

SEQ ID NO: 364519 - DNA, 25 bp, Mus musculus
tcggtactccaaagtctttggaagc

SEQ ID NO: 364520 - DNA, 25 bp, Mus musculus
tcggtattttcaggaaatcagcctc

SEQ ID NO: 364521 - DNA, 25 bp, Mus musculus
tcggtcagtcaacacagtgttcaag

SEQ ID NO: 364522 - DNA, 25 bp, Mus musculus
tcggtccaagaggtcctccaggacc

SEQ ID NO: 364523 - DNA, 25 bp, Mus musculus
tcggtccactaacagctctatttca

SEQ ID NO: 364524 - DNA, 25 bp, Mus musculus
tcggtccactaacagtgcttctctc

SEQ ID NO: 364525 - DNA, 25 bp, Mus musculus
tcggtccagtgaggctgtcatctgg

SEQ ID NO: 364526 - DNA, 25 bp, Mus musculus
tcggtccagtgaggggtgcactctc

SEQ ID NO: 364527 - DNA, 25 bp, Mus musculus
tcggtcctccatgggcatggacata

SEQ ID NO: 364528 - DNA, 25 bp, Mus musculus
tcggtcgactgagagatcctgagca

SEQ ID NO: 364529 - DNA, 25 bp, Mus musculus
tcggtctccagattcgcctctaatc

SEQ ID NO: 364530 - DNA, 25 bp, Mus musculus
tcggtctctcagaaaacatctcggg

SEQ ID NO: 364531 - DNA, 25 bp, Mus musculus
tcggtcttcaccacttccctgatga

SEQ ID NO: 364532 - DNA, 25 bp, Mus musculus
tcggtcttcttgagctcggcttcat

SEQ ID NO: 364533 - DNA, 25 bp, Mus musculus
tcggtcttcttgaggtgagcgggat

SEQ ID NO: 364534 - DNA, 25 bp, Mus musculus
tcggtgaaagggattgaaattccaa

SEQ ID NO: 364535 - DNA, 25 bp, Mus musculus
tcggtgaacatcgaagacgccataa

SEQ ID NO: 364536 - DNA, 25 bp, Mus musculus
tcggtgaacatcggaaggaagagag

SEQ ID NO: 364537 - DNA, 25 bp, Mus musculus
tcggtgacagaacaaatcagttgac

SEQ ID NO: 364538 - DNA, 25 bp, Mus musculus
tcggtgacagggcggctactaagag

SEQ ID NO: 364539 - DNA, 25 bp, Mus musculus
tcggtgacaggtttggggccttaga

SEQ ID NO: 364540 - DNA, 25 bp, Mus musculus
tcggtgacatgaccaatgaggaatt

SEQ ID NO: 364541 - DNA, 25 bp, Mus musculus
tcggtgagagctcaaggcttctagc

SEQ ID NO: 364542 - DNA, 25 bp, Mus musculus
tcggtgagcacgatgaaacggacag

SEQ ID NO: 364543 - DNA, 25 bp, Mus musculus
tcggtgaggattcgaaagaatagac

SEQ ID NO: 364544 - DNA, 25 bp, Mus musculus
tcggtgaggattcggacttctagat

SEQ ID NO: 364545 - DNA, 25 bp, Mus musculus
tcggtgcagagccaccatgccaatc

SEQ ID NO: 364546 - DNA, 25 bp, Mus musculus
tcggtgcccctgaccccatgactca

SEQ ID NO: 364547 - DNA, 25 bp, Mus musculus
tcggtgcctggagactcctccaccc

SEQ ID NO: 364548 - DNA, 25 bp, Mus musculus
tcggtgcctggagggtctcattatg

SEQ ID NO: 364549 - DNA, 25 bp, Mus musculus
tcggtgcgcttccggtacggtggca

SEQ ID NO: 364550 - DNA, 25 bp, Mus musculus
tcggtgctatgagtgctctggggat

SEQ ID NO: 364551 - DNA, 25 bp, Mus musculus
tcggtgctatggcctgtgctgcttt

SEQ ID NO: 364552 - DNA, 25 bp, Mus musculus
tcggtgctggcgccggagtactgga

SEQ ID NO: 364553 - DNA, 25 bp, Mus musculus
tcggtggaagagggtcagggctgca

SEQ ID NO: 364554 - DNA, 25 bp, Mus musculus
tcggtggatcgaagtctgcttccct

SEQ ID NO: 364555 - DNA, 25 bp, Mus musculus
tcggtggccgacagagtgcttggga

SEQ ID NO: 364556 - DNA, 25 bp, Mus musculus
tcggtggcggaagctggaatgcctt

SEQ ID NO: 364557 - DNA, 25 bp, Mus musculus
tcggtgggacagaaactcatcatgg

SEQ ID NO: 364558 - DNA, 25 bp, Mus musculus
tcggtgggacagctgggaacactcc

SEQ ID NO: 364559 - DNA, 25 bp, Mus musculus
tcggtgggttctcgggcaatgatgg

SEQ ID NO: 364560 - DNA, 25 bp, Mus musculus
tcggtgtcaggaggacatgtctagg

SEQ ID NO: 364561 - DNA, 25 bp, Mus musculus
tcggtgtcaggggacactcttaagg

SEQ ID NO: 364562 - DNA, 25 bp, Mus musculus
tcggtgtcggatcagctgcctgctg

SEQ ID NO: 364563 - DNA, 25 bp, Mus musculus
tcggtgtgctcatgcccgacatcgt

SEQ ID NO: 364564 - DNA, 25 bp, Mus musculus
tcggtgtgctcatgttcgagatgct

SEQ ID NO: 364565 - DNA, 25 bp, Mus musculus
tcggtgtggaagagatgaaccggac

SEQ ID NO: 364566 - DNA, 25 bp, Mus musculus
tcggtgtgtatgattccctgtcgtg

SEQ ID NO: 364567 - DNA, 25 bp, Mus musculus
tcggtgttcctcagcaacttgattt

SEQ ID NO: 364568 - DNA, 25 bp, Mus musculus
tcggttaaaatacctgagcatctgt

SEQ ID NO: 364569 - DNA, 25 bp, Mus musculus
tcggttagagcagatggaagattca

SEQ ID NO: 364570 - DNA, 25 bp, Mus musculus
tcggttcccttctctgggtccttac

SEQ ID NO: 364571 - DNA, 25 bp, Mus musculus
tcggttctggcgctccggcactcag

SEQ ID NO: 364572 - DNA, 25 bp, Mus musculus
tcggttctggcgggattcctctgcg

SEQ ID NO: 364573 - DNA, 25 bp, Mus musculus
tcggtttaaagcggggatctgatga

SEQ ID NO: 364574 - DNA, 25 bp, Mus musculus
tcggtttatcatgacaccaagctgg

SEQ ID NO: 364575 - DNA, 25 bp, Mus musculus
tcggtttatgcctgagcgcttctta

SEQ ID NO: 364576 - DNA, 25 bp, Mus musculus
tcggtttatgcctgatccaacagga

SEQ ID NO: 364577 - DNA, 25 bp, Mus musculus
tcggtttcccctttggagtcccatg

SEQ ID NO: 364578 - DNA, 25 bp, Mus musculus
tcggtttcttcaaggacgtagagtc

SEQ ID NO: 364579 - DNA, 25 bp, Mus musculus
tcggtttggccccagaagtcggtga

SEQ ID NO: 364580 - DNA, 25 bp, Mus musculus
tcggtttggccccagggcctgagcc

SEQ ID NO: 364581 - DNA, 25 bp, Mus musculus
tcggttttccctcagaatgggtcag

SEQ ID NO: 364582 - DNA, 25 bp, Mus musculus
tcgtaaaaatgagcatctgtaacac

SEQ ID NO: 364583 - DNA, 25 bp, Mus musculus
tcgtaaaaattgaaatctctcagag

SEQ ID NO: 364584 - DNA, 25 bp, Mus musculus
tcgtaaagaatgaaggaataacagc

SEQ ID NO: 364585 - DNA, 25 bp, Mus musculus
tcgtaaccatagctcaccgtgtctc

SEQ ID NO: 364586 - DNA, 25 bp, Mus musculus
tcgtaaccatagctcatcgggttca

SEQ ID NO: 364587 - DNA, 25 bp, Mus musculus
tcgtaagattcccacctgttgccca

SEQ ID NO: 364588 - DNA, 25 bp, Mus musculus
tcgtaagcatcagggaaacctcacc

SEQ ID NO: 364589 - DNA, 25 bp, Mus musculus
tcgtaaggaggtgcctgcaggccct

SEQ ID NO: 364590 - DNA, 25 bp, Mus musculus
tcgtacacaaatgaagagagacttc

SEQ ID NO: 364591 - DNA, 25 bp, Mus musculus
tcgtacctgcatgattgccacaatc

SEQ ID NO: 364592 - DNA, 25 bp, Mus musculus
tcgtacctgcatgggtgaaagaatt

SEQ ID NO: 364593 - DNA, 25 bp, Mus musculus
tcgtactcagaaacgaaagctgcag

SEQ ID NO: 364594 - DNA, 25 bp, Mus musculus
tcgtactcttcagaggaatgatatt

SEQ ID NO: 364595 - DNA, 25 bp, Mus musculus
tcgtactggagaagttatttccgag

SEQ ID NO: 364596 - DNA, 25 bp, Mus musculus
tcgtactggagacaccaacaggtgg

SEQ ID NO: 364597 - DNA, 25 bp, Mus musculus
tcgtacttcctctggactctgtgaa

SEQ ID NO: 364598 - DNA, 25 bp, Mus musculus
tcgtacttcctctgtggaaggactc

SEQ ID NO: 364599 - DNA, 25 bp, Mus musculus
tcgtacttctacagttacccagctg

SEQ ID NO: 364600 - DNA, 25 bp, Mus musculus
tcgtagaagtggtgattgaaggtga

SEQ ID NO: 364601 - DNA, 25 bp, Mus musculus
tcgtagaggaggagctggagcgctc

SEQ ID NO: 364602 - DNA, 25 bp, Mus musculus
tcgtagaggcggatcacattccagc

SEQ ID NO: 364603 - DNA, 25 bp, Mus musculus
tcgtagaggcggggctctgccacgt

SEQ ID NO: 364604 - DNA, 25 bp, Mus musculus
tcgtaggacagaaaggaagcagagg

SEQ ID NO: 364605 - DNA, 25 bp, Mus musculus
tcgtaggggcgaggcacccaagcag

SEQ ID NO: 364606 - DNA, 25 bp, Mus musculus
tcgtagtcaaggcacatcccagccc

SEQ ID NO: 364607 - DNA, 25 bp, Mus musculus
tcgtagtcagcattttcttgagata

SEQ ID NO: 364608 - DNA, 25 bp, Mus musculus
tcgtatacaaggaattttctcgatt

SEQ ID NO: 364609 - DNA, 25 bp, Mus musculus
tcgtatacaagttccctctaggaat

SEQ ID NO: 364610 - DNA, 25 bp, Mus musculus
tcgtatcctagagaggtgctcggtc

SEQ ID NO: 364611 - DNA, 25 bp, Mus musculus
tcgtattactgaagcttaaaaagca

SEQ ID NO: 364612 - DNA, 25 bp, Mus musculus
tcgtcaaagaaggggaggaagtttg

SEQ ID NO: 364613 - DNA, 25 bp, Mus musculus
tcgtcaacagccctggaaatgtgga

SEQ ID NO: 364614 - DNA, 25 bp, Mus musculus
tcgtcaacagccctggcactgaaga

SEQ ID NO: 364615 - DNA, 25 bp, Mus musculus
tcgtcaactctccatcctacctcac

SEQ ID NO: 364616 - DNA, 25 bp, Mus musculus
tcgtcaagtactggttgggtggtcc

SEQ ID NO: 364617 - DNA, 25 bp, Mus musculus
tcgtcaagtactggtttacaggaac

SEQ ID NO: 364618 - DNA, 25 bp, Mus musculus
tcgtcacatgatcatggatatacca

SEQ ID NO: 364619 - DNA, 25 bp, Mus musculus
tcgtcacccacagcaatgagaggta

SEQ ID NO: 364620 - DNA, 25 bp, Mus musculus
tcgtcacctgtaaggtagaaattta

SEQ ID NO: 364621 - DNA, 25 bp, Mus musculus
tcgtcacctgtaaggtctctagcat

SEQ ID NO: 364622 - DNA, 25 bp, Mus musculus
tcgtcacggattccacactacgccg

SEQ ID NO: 364623 - DNA, 25 bp, Mus musculus
tcgtcagaagagaagacgccagcaa

SEQ ID NO: 364624 - DNA, 25 bp, Mus musculus
tcgtcagaagaggagtccaaaatcg

SEQ ID NO: 364625 - DNA, 25 bp, Mus musculus
tcgtcagacagcacatcgtcagcga

SEQ ID NO: 364626 - DNA, 25 bp, Mus musculus
tcgtcagacagctacagcacatcgt

SEQ ID NO: 364627 - DNA, 25 bp, Mus musculus
tcgtcagactacatggaatatgctc

SEQ ID NO: 364628 - DNA, 25 bp, Mus musculus
tcgtcagcaagctgtgggccacatt

SEQ ID NO: 364629 - DNA, 25 bp, Mus musculus
tcgtcagcaggaagcgcatccagta

SEQ ID NO: 364630 - DNA, 25 bp, Mus musculus
tcgtcagcaggaagtatggaagctt

SEQ ID NO: 364631 - DNA, 25 bp, Mus musculus
tcgtcagctttgacgttaccaccag

SEQ ID NO: 364632 - DNA, 25 bp, Mus musculus
tcgtcagctttgagtcggtctatgt

SEQ ID NO: 364633 - DNA, 25 bp, Mus musculus
tcgtcagtgtggaagagctcccgcc

SEQ ID NO: 364634 - DNA, 25 bp, Mus musculus
tcgtcagtgtggtgatttacaaaaa

SEQ ID NO: 364635 - DNA, 25 bp, Mus musculus
tcgtcatactctgagtgacagcttc

SEQ ID NO: 364636 - DNA, 25 bp, Mus musculus
tcgtcatatcaggtaacgggcaacc

SEQ ID NO: 364637 - DNA, 25 bp, Mus musculus
tcgtcatgagatcaaggacaccttc

SEQ ID NO: 364638 - DNA, 25 bp, Mus musculus
tcgtcatggcaacagactccaagcc

SEQ ID NO: 364639 - DNA, 25 bp, Mus musculus
tcgtccaatatcatggggggatatc

SEQ ID NO: 364640 - DNA, 25 bp, Mus musculus
tcgtccagcagcaaagccgacccgg

SEQ ID NO: 364641 - DNA, 25 bp, Mus musculus
tcgtccagctcctgggatacgtatt

SEQ ID NO: 364642 - DNA, 25 bp, Mus musculus
tcgtccagtatagggagaagctggg

SEQ ID NO: 364643 - DNA, 25 bp, Mus musculus
tcgtccatgtcgggtgtgaagattg

SEQ ID NO: 364644 - DNA, 25 bp, Mus musculus
tcgtcccaacgaaaattgaacagat

SEQ ID NO: 364645 - DNA, 25 bp, Mus musculus
tcgtcccagcggctgaccaaggcct

SEQ ID NO: 364646 - DNA, 25 bp, Mus musculus
tcgtcccagcgtcagcccaggccag

SEQ ID NO: 364647 - DNA, 25 bp, Mus musculus
tcgtcccatggtccttcagaggact

SEQ ID NO: 364648 - DNA, 25 bp, Mus musculus
tcgtccccggacggagctgaagaag

SEQ ID NO: 364649 - DNA, 25 bp, Mus musculus
tcgtcccctcaggatcgccacgact

SEQ ID NO: 364650 - DNA, 25 bp, Mus musculus
tcgtccgagtctccaggaacacagc

SEQ ID NO: 364651 - DNA, 25 bp, Mus musculus
tcgtccgccagactcagtccgctag

SEQ ID NO: 364652 - DNA, 25 bp, Mus musculus
tcgtccgccagagtacagttgacca

SEQ ID NO: 364653 - DNA, 25 bp, Mus musculus
tcgtccgtggaggttgtcagagaat

SEQ ID NO: 364654 - DNA, 25 bp, Mus musculus
tcgtcctaacccagaacatgtttgg

SEQ ID NO: 364655 - DNA, 25 bp, Mus musculus
tcgtcctacgaagattatacagaca

SEQ ID NO: 364656 - DNA, 25 bp, Mus musculus
tcgtcctaggctaggcggccgtcac

SEQ ID NO: 364657 - DNA, 25 bp, Mus musculus
tcgtcctagggggagcttctggagg

SEQ ID NO: 364658 - DNA, 25 bp, Mus musculus
tcgtcctcatttatgatcccataaa

SEQ ID NO: 364659 - DNA, 25 bp, Mus musculus
tcgtcctcgtcctcctcttcttcta

SEQ ID NO: 364660 - DNA, 25 bp, Mus musculus
tcgtcctgcgctctttgagcgctgc

SEQ ID NO: 364661 - DNA, 25 bp, Mus musculus
tcgtcctgggtggctctcccagggt

SEQ ID NO: 364662 - DNA, 25 bp, Mus musculus
tcgtcctgtgaacaggttgatcgtg

SEQ ID NO: 364663 - DNA, 25 bp, Mus musculus
tcgtcctgtgagagagattccccct

SEQ ID NO: 364664 - DNA, 25 bp, Mus musculus
tcgtcctgtgagatctatgtaagag

SEQ ID NO: 364665 - DNA, 25 bp, Mus musculus
tcgtcctgtgcctatgcttatacca

SEQ ID NO: 364666 - DNA, 25 bp, Mus musculus
tcgtccttgaaagccctctgggcgt

SEQ ID NO: 364667 - DNA, 25 bp, Mus musculus
tcgtcgccgagaagacctccttccc

SEQ ID NO: 364668 - DNA, 25 bp, Mus musculus
tcgtcgcctgcaggatactttggaa

SEQ ID NO: 364669 - DNA, 25 bp, Mus musculus
tcgtcgcctgcaggtgattttcgat

SEQ ID NO: 364670 - DNA, 25 bp, Mus musculus
tcgtcgcctgcaggtgtctaagcac

SEQ ID NO: 364671 - DNA, 25 bp, Mus musculus
tcgtcgctgagttctggaatacagt

SEQ ID NO: 364672 - DNA, 25 bp, Mus musculus
tcgtcggcatcagaacggccggttt

SEQ ID NO: 364673 - DNA, 25 bp, Mus musculus
tcgtcggtattttcaggaaatcagc

SEQ ID NO: 364674 - DNA, 25 bp, Mus musculus
tcgtcgtcagcttgacaaaagtaag

SEQ ID NO: 364675 - DNA, 25 bp, Mus musculus
tcgtcgtcatgatggagaggagaag

SEQ ID NO: 364676 - DNA, 25 bp, Mus musculus
tcgtcgtccgctccagaaatcttga

SEQ ID NO: 364677 - DNA, 25 bp, Mus musculus
tcgtcgtcgtccgctccagaaatct

SEQ ID NO: 364678 - DNA, 25 bp, Mus musculus
tcgtcgttgttacagtttgccaggc

SEQ ID NO: 364679 - DNA, 25 bp, Mus musculus
tcgtctaccaagctgttccacgcac

SEQ ID NO: 364680 - DNA, 25 bp, Mus musculus
tcgtctaccaaggagaggaacgtcc

SEQ ID NO: 364681 - DNA, 25 bp, Mus musculus
tcgtctatcagtcttgtctgtattc

SEQ ID NO: 364682 - DNA, 25 bp, Mus musculus
tcgtctccaagaatggtcctggcac

SEQ ID NO: 364683 - DNA, 25 bp, Mus musculus
tcgtctccggcaatctctgagtttg

SEQ ID NO: 364684 - DNA, 25 bp, Mus musculus
tcgtctccggcaggaatttaatgaa

SEQ ID NO: 364685 - DNA, 25 bp, Mus musculus
tcgtctccgggctggtttgataacc

SEQ ID NO: 364686 - DNA, 25 bp, Mus musculus
tcgtctcctggccagagttccaaac

SEQ ID NO: 364687 - DNA, 25 bp, Mus musculus
tcgtctcctgggacagaagatgcac

SEQ ID NO: 364688 - DNA, 25 bp, Mus musculus
tcgtctctcaggtgccgcaccagtt

SEQ ID NO: 364689 - DNA, 25 bp, Mus musculus
tcgtctctccaaagtacttgggaga

SEQ ID NO: 364690 - DNA, 25 bp, Mus musculus
tcgtctctgagccacctgcgcaaca

SEQ ID NO: 364691 - DNA, 25 bp, Mus musculus
tcgtctctttcaaattaattgtggt

SEQ ID NO: 364692 - DNA, 25 bp, Mus musculus
tcgtctgaagacaaacctgagacaa

SEQ ID NO: 364693 - DNA, 25 bp, Mus musculus
tcgtctgaagatgggtcagagatgg

SEQ ID NO: 364694 - DNA, 25 bp, Mus musculus
tcgtctgagtggagaacttcacctc

SEQ ID NO: 364695 - DNA, 25 bp, Mus musculus
tcgtctgatgtcatggctccgaacc

SEQ ID NO: 364696 - DNA, 25 bp, Mus musculus
tcgtctgatgttcacctcacctcgc

SEQ ID NO: 364697 - DNA, 25 bp, Mus musculus
tcgtctgcctctgtccagttgtccc

SEQ ID NO: 364698 - DNA, 25 bp, Mus musculus
tcgtctgcggagcggggttgaaaga

SEQ ID NO: 364699 - DNA, 25 bp, Mus musculus
tcgtctgcggagcgggtttatggtc

SEQ ID NO: 364700 - DNA, 25 bp, Mus musculus
tcgtctggagatgaagctataaaag

SEQ ID NO: 364701 - DNA, 25 bp, Mus musculus
tcgtcttaaacaagcaataccttct

SEQ ID NO: 364702 - DNA, 25 bp, Mus musculus
tcgtcttcagattggagattttatt

SEQ ID NO: 364703 - DNA, 25 bp, Mus musculus
tcgtcttcagattggttctgtaagc

SEQ ID NO: 364704 - DNA, 25 bp, Mus musculus
tcgtcttcatcgcgcccttgctgac

SEQ ID NO: 364705 - DNA, 25 bp, Mus musculus
tcgtcttcatcgtggacctgctgca

SEQ ID NO: 364706 - DNA, 25 bp, Mus musculus
tcgtcttcctgaaggttgagaacaa

SEQ ID NO: 364707 - DNA, 25 bp, Mus musculus
tcgtcttctggctggctggaggcgt

SEQ ID NO: 364708 - DNA, 25 bp, Mus musculus
tcgtctttcagctacagcggaacat

SEQ ID NO: 364709 - DNA, 25 bp, Mus musculus
tcgtctttcaggctgatgccccaaa

SEQ ID NO: 364710 - DNA, 25 bp, Mus musculus
tcgtcttttcaaggtatttcctggt

SEQ ID NO: 364711 - DNA, 25 bp, Mus musculus
tcgtgaaacaccattgctggggttc

SEQ ID NO: 364712 - DNA, 25 bp, Mus musculus
tcgtgaaactagaaatgatggaaga

SEQ ID NO: 364713 - DNA, 25 bp, Mus musculus
tcgtgaaatcttcagctgctgacct

SEQ ID NO: 364714 - DNA, 25 bp, Mus musculus
tcgtgaacctgcagtggaccccgaa

SEQ ID NO: 364715 - DNA, 25 bp, Mus musculus
tcgtgaactggttaccaggcctgaa

SEQ ID NO: 364716 - DNA, 25 bp, Mus musculus
tcgtgaagcgactccggccctcgac

SEQ ID NO: 364717 - DNA, 25 bp, Mus musculus
tcgtgaagctaggtactgggtttgg

SEQ ID NO: 364718 - DNA, 25 bp, Mus musculus
tcgtgaatcctcttggttcagacaa

SEQ ID NO: 364719 - DNA, 25 bp, Mus musculus
tcgtgacacctaaggtgaaggcgat

SEQ ID NO: 364720 - DNA, 25 bp, Mus musculus
tcgtgacagagatggtcaagagatt

SEQ ID NO: 364721 - DNA, 25 bp, Mus musculus
tcgtgacagaggaacagaaattctt

SEQ ID NO: 364722 - DNA, 25 bp, Mus musculus
tcgtgacagaggcgttctctgcggc

SEQ ID NO: 364723 - DNA, 25 bp, Mus musculus
tcgtgacagagtggaatctggtgtg

SEQ ID NO: 364724 - DNA, 25 bp, Mus musculus
tcgtgacagagtgggacctggtgtg

SEQ ID NO: 364725 - DNA, 25 bp, Mus musculus
tcgtgaccgtgagcccattctgcac

SEQ ID NO: 364726 - DNA, 25 bp, Mus musculus
tcgtgactgagtggaaccttgtgtg

SEQ ID NO: 364727 - DNA, 25 bp, Mus musculus
tcgtgactggacaggttttatacgt

SEQ ID NO: 364728 - DNA, 25 bp, Mus musculus
tcgtgagaagcatggtgaagaaaca

SEQ ID NO: 364729 - DNA, 25 bp, Mus musculus
tcgtgagaaggtatagcagtgtttt

SEQ ID NO: 364730 - DNA, 25 bp, Mus musculus
tcgtgaggagagacgtggagaaatg

SEQ ID NO: 364731 - DNA, 25 bp, Mus musculus
tcgtgagtaaacaagaattcctcag

SEQ ID NO: 364732 - DNA, 25 bp, Mus musculus
tcgtgagtaaacaagatctcgccct

SEQ ID NO: 364733 - DNA, 25 bp, Mus musculus
tcgtgagtggaagaatcctcggctc

SEQ ID NO: 364734 - DNA, 25 bp, Mus musculus
tcgtgagtggaaggcgagaactcca

SEQ ID NO: 364735 - DNA, 25 bp, Mus musculus
tcgtgagtggaaggggattttacag

SEQ ID NO: 364736 - DNA, 25 bp, Mus musculus
tcgtgagtggtcctgtccaagaaca

SEQ ID NO: 364737 - DNA, 25 bp, Mus musculus
tcgtgagttcagcgacattaaggcc

SEQ ID NO: 364738 - DNA, 25 bp, Mus musculus
tcgtgatcaggaagaaaagcaacta

SEQ ID NO: 364739 - DNA, 25 bp, Mus musculus
tcgtgatcaggaggaatctgagagt

SEQ ID NO: 364740 - DNA, 25 bp, Mus musculus
tcgtgatcagtagcaagattgacag

SEQ ID NO: 364741 - DNA, 25 bp, Mus musculus
tcgtgatttccagtccctgcagggc

SEQ ID NO: 364742 - DNA, 25 bp, Mus musculus
tcgtgcaccgcctgacccccagcct

SEQ ID NO: 364743 - DNA, 25 bp, Mus musculus
tcgtgcaccgggatttaaagttgga

SEQ ID NO: 364744 - DNA, 25 bp, Mus musculus
tcgtgcactagcgggacttggtgag

SEQ ID NO: 364745 - DNA, 25 bp, Mus musculus
tcgtgcactagcggtctcaaaagat

SEQ ID NO: 364746 - DNA, 25 bp, Mus musculus
tcgtgccaagtctcacacaggtccc

SEQ ID NO: 364747 - DNA, 25 bp, Mus musculus
tcgtgcccaaggttgtccagagcta

SEQ ID NO: 364748 - DNA, 25 bp, Mus musculus
tcgtgcctgagaactccgtgcaaga

SEQ ID NO: 364749 - DNA, 25 bp, Mus musculus
tcgtgcgcaaactgactgatgatgc

SEQ ID NO: 364750 - DNA, 25 bp, Mus musculus
tcgtgcgcaaactggcgccccttgt

SEQ ID NO: 364751 - DNA, 25 bp, Mus musculus
tcgtgcgttgcaggtctccgggact

SEQ ID NO: 364752 - DNA, 25 bp, Mus musculus
tcgtgctccagtgtggcgctgactc

SEQ ID NO: 364753 - DNA, 25 bp, Mus musculus
tcgtgctccttgcagatttctaacg

SEQ ID NO: 364754 - DNA, 25 bp, Mus musculus
tcgtgctggccacagagttcctgga

SEQ ID NO: 364755 - DNA, 25 bp, Mus musculus
tcgtgctggccacaggcctgcccaa

SEQ ID NO: 364756 - DNA, 25 bp, Mus musculus
tcgtgctgttcccgatccgtacttc

SEQ ID NO: 364757 - DNA, 25 bp, Mus musculus
tcgtggaagaggtaaagagagatcc

SEQ ID NO: 364758 - DNA, 25 bp, Mus musculus
tcgtggaccccgtggatggtgtggt

SEQ ID NO: 364759 - DNA, 25 bp, Mus musculus
tcgtggaccccgtggtctacgtgac

SEQ ID NO: 364760 - DNA, 25 bp, Mus musculus
tcgtggacctccactccaggcagca

SEQ ID NO: 364761 - DNA, 25 bp, Mus musculus
tcgtggagcacatatcgacttggag

SEQ ID NO: 364762 - DNA, 25 bp, Mus musculus
tcgtggagcgagcggatttgataat

SEQ ID NO: 364763 - DNA, 25 bp, Mus musculus
tcgtggaggaaatcaatcgcaagca

SEQ ID NO: 364764 - DNA, 25 bp, Mus musculus
tcgtggaggtcctggacctttaatg

SEQ ID NO: 364765 - DNA, 25 bp, Mus musculus
tcgtggatttccaggcagtagaggc

SEQ ID NO: 364766 - DNA, 25 bp, Mus musculus
tcgtggatttccaggccgtggtatt

SEQ ID NO: 364767 - DNA, 25 bp, Mus musculus
tcgtggcaaaaagtcagtccgaccg

SEQ ID NO: 364768 - DNA, 25 bp, Mus musculus
tcgtggcaggggtactacaagaagt

SEQ ID NO: 364769 - DNA, 25 bp, Mus musculus
tcgtggccatcataggtacccagga

SEQ ID NO: 364770 - DNA, 25 bp, Mus musculus
tcgtggcctggagcttaccagccct

SEQ ID NO: 364771 - DNA, 25 bp, Mus musculus
tcgtggcctggagtgttgaagatga

SEQ ID NO: 364772 - DNA, 25 bp, Mus musculus
tcgtggcctttgatgccgtcctgct

SEQ ID NO: 364773 - DNA, 25 bp, Mus musculus
tcgtggcgactgcagcctattccaa

SEQ ID NO: 364774 - DNA, 25 bp, Mus musculus
tcgtggcgactgcaggtaacgggca

SEQ ID NO: 364775 - DNA, 25 bp, Mus musculus
tcgtggctcatacacactttggagg

SEQ ID NO: 364776 - DNA, 25 bp, Mus musculus
tcgtggctcatagtatgatatttgc

SEQ ID NO: 364777 - DNA, 25 bp, Mus musculus
tcgtggctgaagaggtcccaggtaa

SEQ ID NO: 364778 - DNA, 25 bp, Mus musculus
tcgtggctggatccggtggacacac

SEQ ID NO: 364779 - DNA, 25 bp, Mus musculus
tcgtggctggatccgtaccccaagt

SEQ ID NO: 364780 - DNA, 25 bp, Mus musculus
tcgtggctggatccgtattcttgtt

SEQ ID NO: 364781 - DNA, 25 bp, Mus musculus
tcgtgggaagatagacccagtgaca

SEQ ID NO: 364782 - DNA, 25 bp, Mus musculus
tcgtgggacataagttctacggccc

SEQ ID NO: 364783 - DNA, 25 bp, Mus musculus
tcgtgggcgcccggcgcagcaagca

SEQ ID NO: 364784 - DNA, 25 bp, Mus musculus
tcgtgggctgtgccggcattggcat

SEQ ID NO: 364785 - DNA, 25 bp, Mus musculus
tcgtgggtggagctgaagaaagcaa

SEQ ID NO: 364786 - DNA, 25 bp, Mus musculus
tcgtgggtggagctgaagaaagcca

SEQ ID NO: 364787 - DNA, 25 bp, Mus musculus
tcgtggtacgttcaggaggccccat

SEQ ID NO: 364788 - DNA, 25 bp, Mus musculus
tcgtggtacgttcaggggttgtgct

SEQ ID NO: 364789 - DNA, 25 bp, Mus musculus
tcgtggtcagaatttcaaaggccat

SEQ ID NO: 364790 - DNA, 25 bp, Mus musculus
tcgtggtccagaaccctctgattgc

SEQ ID NO: 364791 - DNA, 25 bp, Mus musculus
tcgtggtgacaagggcaacagcagg

SEQ ID NO: 364792 - DNA, 25 bp, Mus musculus
tcgtggtgagttcaggtggttgtgg

SEQ ID NO: 364793 - DNA, 25 bp, Mus musculus
tcgtggtgccgatctctgagaagag

SEQ ID NO: 364794 - DNA, 25 bp, Mus musculus
tcgtggtggattctgggaaggtgaa

SEQ ID NO: 364795 - DNA, 25 bp, Mus musculus
tcgtggtggcccgagctgtgggaac

SEQ ID NO: 364796 - DNA, 25 bp, Mus musculus
tcgtggttacagagccgagcagttg

SEQ ID NO: 364797 - DNA, 25 bp, Mus musculus
tcgtggttacaggaaataatgaaga

SEQ ID NO: 364798 - DNA, 25 bp, Mus musculus
tcgtggttcatccatacatccagaa

SEQ ID NO: 364799 - DNA, 25 bp, Mus musculus
tcgtgtacagggtgaagttgattcc

SEQ ID NO: 364800 - DNA, 25 bp, Mus musculus
tcgtgtacagtgacaccatctgtga

SEQ ID NO: 364801 - DNA, 25 bp, Mus musculus
tcgtgtataactaagaatgtcttcc

SEQ ID NO: 364802 - DNA, 25 bp, Mus musculus
tcgtgtattcagggggagatgactg

SEQ ID NO: 364803 - DNA, 25 bp, Mus musculus
tcgtgtcactttcggctggggaact

SEQ ID NO: 364804 - DNA, 25 bp, Mus musculus
tcgtgtccctcgtttagctttttct

SEQ ID NO: 364805 - DNA, 25 bp, Mus musculus
tcgtgtccgacttcagaggatgaat

SEQ ID NO: 364806 - DNA, 25 bp, Mus musculus
tcgtgtccgatttattaaccttgca

SEQ ID NO: 364807 - DNA, 25 bp, Mus musculus
tcgtgtcctgcttagtcttgctgtt

SEQ ID NO: 364808 - DNA, 25 bp, Mus musculus
tcgtgtcctgcttttttcacttccc

SEQ ID NO: 364809 - DNA, 25 bp, Mus musculus
tcgtgtcgctgctcggtgtcgcaac

SEQ ID NO: 364810 - DNA, 25 bp, Mus musculus
tcgtgtctagaccttaaactacaca

SEQ ID NO: 364811 - DNA, 25 bp, Mus musculus
tcgtgtctagagccttgcacattat

SEQ ID NO: 364812 - DNA, 25 bp, Mus musculus
tcgtgtctatcggccgctcacccca

SEQ ID NO: 364813 - DNA, 25 bp, Mus musculus
tcgtgtcttgggtcttctccatcgt

SEQ ID NO: 364814 - DNA, 25 bp, Mus musculus
tcgtgtctttgcgggcgtgctggtc

SEQ ID NO: 364815 - DNA, 25 bp, Mus musculus
tcgtgtctttgcgggtgcctggctg

SEQ ID NO: 364816 - DNA, 25 bp, Mus musculus
tcgtgtctttggctaattctggctt

SEQ ID NO: 364817 - DNA, 25 bp, Mus musculus
tcgtgtctttgtaaagtcgggcaaa

SEQ ID NO: 364818 - DNA, 25 bp, Mus musculus
tcgtgtgcagccagtcaggggagac

SEQ ID NO: 364819 - DNA, 25 bp, Mus musculus
tcgtgtgcaggcagtcaggggagac

SEQ ID NO: 364820 - DNA, 25 bp, Mus musculus
tcgtgtgcctgagcggaggactggc

SEQ ID NO: 364821 - DNA, 25 bp, Mus musculus
tcgtgtgcctgagcgggctagctgt

SEQ ID NO: 364822 - DNA, 25 bp, Mus musculus
tcgtgtgcggattcctttgtttctt

SEQ ID NO: 364823 - DNA, 25 bp, Mus musculus
tcgtgtgcgggcatttcagggaaga

SEQ ID NO: 364824 - DNA, 25 bp, Mus musculus
tcgtgtgcgggtgagatctgatttt

SEQ ID NO: 364825 - DNA, 25 bp, Mus musculus
tcgtgtgcggtgcacgatctgattt

SEQ ID NO: 364826 - DNA, 25 bp, Mus musculus
tcgtgtgctccaacggcttcctgct

SEQ ID NO: 364827 - DNA, 25 bp, Mus musculus
tcgtgtggagagattgctctctcac

SEQ ID NO: 364828 - DNA, 25 bp, Mus musculus
tcgtgttcactttagaacacccggg

SEQ ID NO: 364829 - DNA, 25 bp, Mus musculus
tcgtgttggaaggtggcattgaccc

SEQ ID NO: 364830 - DNA, 25 bp, Mus musculus
tcgtgtttcaaaagctctcttctcc

SEQ ID NO: 364831 - DNA, 25 bp, Mus musculus
tcgtgtttcaaaaggcattgcgctc

SEQ ID NO: 364832 - DNA, 25 bp, Mus musculus
tcgtgtttcaggtattctgcgttgg

SEQ ID NO: 364833 - DNA, 25 bp, Mus musculus
tcgtgtttcttaccatctatggagt

SEQ ID NO: 364834 - DNA, 25 bp, Mus musculus
tcgtgtttgaccttgttaccggagg

SEQ ID NO: 364835 - DNA, 25 bp, Mus musculus
tcgtgtttggaaaggcgaccgtgct

SEQ ID NO: 364836 - DNA, 25 bp, Mus musculus
tcgtgtttggaaaggctggcaagtt

SEQ ID NO: 364837 - DNA, 25 bp, Mus musculus
tcgttaacagataggttctgcctca

SEQ ID NO: 364838 - DNA, 25 bp, Mus musculus
tcgttaagagaggagaactttgact

SEQ ID NO: 364839 - DNA, 25 bp, Mus musculus
tcgttagaagcaaaatctacatcac

SEQ ID NO: 364840 - DNA, 25 bp, Mus musculus
tcgttagaagctgaaggaagaggaa

SEQ ID NO: 364841 - DNA, 25 bp, Mus musculus
tcgttaggatcgcaccagagtatat

SEQ ID NO: 364842 - DNA, 25 bp, Mus musculus
tcgttatgttgattcacaatgacat

SEQ ID NO: 364843 - DNA, 25 bp, Mus musculus
tcgttcaaacaaagtctggtttttg

SEQ ID NO: 364844 - DNA, 25 bp, Mus musculus
tcgttcaaccgggagaggtctgctc

SEQ ID NO: 364845 - DNA, 25 bp, Mus musculus
tcgttcaaccgggagcaggaggaca

SEQ ID NO: 364846 - DNA, 25 bp, Mus musculus
tcgttcaaccgggagcattctcaga

SEQ ID NO: 364847 - DNA, 25 bp, Mus musculus
tcgttcactccaatgatggcactca

SEQ ID NO: 364848 - DNA, 25 bp, Mus musculus
tcgttcagccaggttgcattgaagg

SEQ ID NO: 364849 - DNA, 25 bp, Mus musculus
tcgttcatgataagtgcacaaagaa

SEQ ID NO: 364850 - DNA, 25 bp, Mus musculus
tcgttcctcaagatggccgactctg

SEQ ID NO: 364851 - DNA, 25 bp, Mus musculus
tcgttctcgggcaaggacttagcat

SEQ ID NO: 364852 - DNA, 25 bp, Mus musculus
tcgttctctagcgaaatccctctct

SEQ ID NO: 364853 - DNA, 25 bp, Mus musculus
tcgttctctagcgtgatttttcttc

SEQ ID NO: 364854 - DNA, 25 bp, Mus musculus
tcgttctgattgaagcctgctgcaa

SEQ ID NO: 364855 - DNA, 25 bp, Mus musculus
tcgttctgtgatgccagcagagggg

SEQ ID NO: 364856 - DNA, 25 bp, Mus musculus
tcgttcttagaatcctattctaaga

SEQ ID NO: 364857 - DNA, 25 bp, Mus musculus
tcgttcttagatgagcccaggtcgt

SEQ ID NO: 364858 - DNA, 25 bp, Mus musculus
tcgttcttaggtaaggtggtcagcg

SEQ ID NO: 364859 - DNA, 25 bp, Mus musculus
tcgttcttccagccaaggacccctg

SEQ ID NO: 364860 - DNA, 25 bp, Mus musculus
tcgttcttccaggcaaggacccctg

SEQ ID NO: 364861 - DNA, 25 bp, Mus musculus
tcgttcttgctggtgcactgcctgt

SEQ ID NO: 364862 - DNA, 25 bp, Mus musculus
tcgttcttgtcaataaggtaatgtt

SEQ ID NO: 364863 - DNA, 25 bp, Mus musculus
tcgttgacaggaaagagtaggaaac

SEQ ID NO: 364864 - DNA, 25 bp, Mus musculus
tcgttgactctggtagagcagatcc

SEQ ID NO: 364865 - DNA, 25 bp, Mus musculus
tcgttgccaagagagtacacggtca

SEQ ID NO: 364866 - DNA, 25 bp, Mus musculus
tcgttgccaagaggaaaatagcttc

SEQ ID NO: 364867 - DNA, 25 bp, Mus musculus
tcgttgccaggagatggcctgactg

SEQ ID NO: 364868 - DNA, 25 bp, Mus musculus
tcgttgcccagatcctgtgggccga

SEQ ID NO: 364869 - DNA, 25 bp, Mus musculus
tcgttgctgtccagaaccccgtctg

SEQ ID NO: 364870 - DNA, 25 bp, Mus musculus
tcgttgctgtccagggtgaagcctg

SEQ ID NO: 364871 - DNA, 25 bp, Mus musculus
tcgttggagctcaggtgcccctggg

SEQ ID NO: 364872 - DNA, 25 bp, Mus musculus
tcgttggaggcagacgatttacatg

SEQ ID NO: 364873 - DNA, 25 bp, Mus musculus
tcgttggatcctcctctgtagagct

SEQ ID NO: 364874 - DNA, 25 bp, Mus musculus
tcgttggatcctgcgggttgaggcg

SEQ ID NO: 364875 - DNA, 25 bp, Mus musculus
tcgttgtccgcataggcttcagttg

SEQ ID NO: 364876 - DNA, 25 bp, Mus musculus
tcgttgttacagtttgccaggcagt

SEQ ID NO: 364877 - DNA, 25 bp, Mus musculus
tcgtttaattttagctgaaccaata

SEQ ID NO: 364878 - DNA, 25 bp, Mus musculus
tcgtttatagagacttaaaacctga

SEQ ID NO: 364879 - DNA, 25 bp, Mus musculus
tcgtttcaagagaacggcaggctgt

SEQ ID NO: 364880 - DNA, 25 bp, Mus musculus
tcgtttccctggattatgccatctc

SEQ ID NO: 364881 - DNA, 25 bp, Mus musculus
tcgtttccctgggtatttctctgag

SEQ ID NO: 364882 - DNA, 25 bp, Mus musculus
tcgtttctattgaaatctcacaggc

SEQ ID NO: 364883 - DNA, 25 bp, Mus musculus
tcgtttctattgaatacaggctagt

SEQ ID NO: 364884 - DNA, 25 bp, Mus musculus
tcgtttctgagtgagatcccatttc

SEQ ID NO: 364885 - DNA, 25 bp, Mus musculus
tcgtttcttcccaggtgaagtggaa

SEQ ID NO: 364886 - DNA, 25 bp, Mus musculus
tcgtttgaaaaagtcctaatcctgg

SEQ ID NO: 364887 - DNA, 25 bp, Mus musculus
tcgtttgtcagattttccactcacg

SEQ ID NO: 364888 - DNA, 25 bp, Mus musculus
tcgtttgtgagtttgatgcagccta

SEQ ID NO: 364889 - DNA, 25 bp, Mus musculus
tcgtttgtgagtttgtctttggagg

SEQ ID NO: 364890 - DNA, 25 bp, Mus musculus
tcgtttgtgttacagctgccctatc

SEQ ID NO: 364891 - DNA, 25 bp, Mus musculus
tcgttttcacaggggccgatcaaca

SEQ ID NO: 364892 - DNA, 25 bp, Mus musculus
tcgttttccctctagtggaaacaag

SEQ ID NO: 364893 - DNA, 25 bp, Mus musculus
tcgttttccctctagttgtgagcgg

SEQ ID NO: 364894 - DNA, 25 bp, Mus musculus
tcgttttcctgggagactccagaac

SEQ ID NO: 364895 - DNA, 25 bp, Mus musculus
tcgttttctctagatccatttgggc

SEQ ID NO: 364896 - DNA, 25 bp, Mus musculus
tcgttttgacttatatgatgttgat

SEQ ID NO: 364897 - DNA, 25 bp, Mus musculus
tctaaaaaaccagatcatcacctcc

SEQ ID NO: 364898 - DNA, 25 bp, Mus musculus
tctaaaaaccagtcggcagaccaca

SEQ ID NO: 364899 - DNA, 25 bp, Mus musculus
tctaaaaactcaagatgtggagtac

SEQ ID NO: 364900 - DNA, 25 bp, Mus musculus
tctaaaaactgctttgcacgtgaca

SEQ ID NO: 364901 - DNA, 25 bp, Mus musculus
tctaaaaagaggttgtggatgtggc

SEQ ID NO: 364902 - DNA, 25 bp, Mus musculus
tctaaaacaagagatttgaagttca

SEQ ID NO: 364903 - DNA, 25 bp, Mus musculus
tctaaaacaagaggagattaggttg

SEQ ID NO: 364904 - DNA, 25 bp, Mus musculus
tctaaaagatttgtccataagaact

SEQ ID NO: 364905 - DNA, 25 bp, Mus musculus
tctaaaatagagctggagtaactga

SEQ ID NO: 364906 - DNA, 25 bp, Mus musculus
tctaaacaagacgggccgcattgac

SEQ ID NO: 364907 - DNA, 25 bp, Mus musculus
tctaaacaatcagcccaggagttaa

SEQ ID NO: 364908 - DNA, 25 bp, Mus musculus
tctaaacacaagagaattcatacag

SEQ ID NO: 364909 - DNA, 25 bp, Mus musculus
tctaaacagaaaggtgtcaactctg

SEQ ID NO: 364910 - DNA, 25 bp, Mus musculus
tctaaacgtttcactgcgcaaacca

SEQ ID NO: 364911 - DNA, 25 bp, Mus musculus
tctaaactacatgagcgatgtcgaa

SEQ ID NO: 364912 - DNA, 25 bp, Mus musculus
tctaaagaaaggtattgaggctctg

SEQ ID NO: 364913 - DNA, 25 bp, Mus musculus
tctaaagaaggatgtggactgtgcc

SEQ ID NO: 364914 - DNA, 25 bp, Mus musculus
tctaaagaccggaaagcactgccac

SEQ ID NO: 364915 - DNA, 25 bp, Mus musculus
tctaaagagtgaaggcttcagatgc

SEQ ID NO: 364916 - DNA, 25 bp, Mus musculus
tctaaagatgctgaaggcatcacaa

SEQ ID NO: 364917 - DNA, 25 bp, Mus musculus
tctaaagcagatactaaaatggatc

SEQ ID NO: 364918 - DNA, 25 bp, Mus musculus
tctaaagcaggtactaaaatggatc

SEQ ID NO: 364919 - DNA, 25 bp, Mus musculus
tctaaagtcggagaggtacagattc

SEQ ID NO: 364920 - DNA, 25 bp, Mus musculus
tctaaagtcggagaggttgacgtcg

SEQ ID NO: 364921 - DNA, 25 bp, Mus musculus
tctaaagtgaacaggccatggcgca

SEQ ID NO: 364922 - DNA, 25 bp, Mus musculus
tctaaagtgaacaggtgccttcttc

SEQ ID NO: 364923 - DNA, 25 bp, Mus musculus
tctaaagttcaagagctgtttgaca

SEQ ID NO: 364924 - DNA, 25 bp, Mus musculus
tctaaataaagaaactactcactgg

SEQ ID NO: 364925 - DNA, 25 bp, Mus musculus
tctaaatgaacttcagtaacttgtg

SEQ ID NO: 364926 - DNA, 25 bp, Mus musculus
tctaaatgataagaatggcacacga

SEQ ID NO: 364927 - DNA, 25 bp, Mus musculus
tctaaatgataaggaacatgacatt

SEQ ID NO: 364928 - DNA, 25 bp, Mus musculus
tctaaatgggatatccttctcgtct

SEQ ID NO: 364929 - DNA, 25 bp, Mus musculus
tctaaattaaagactgagtgtggat

SEQ ID NO: 364930 - DNA, 25 bp, Mus musculus
tctaaattcaagtgacaatgcctta

SEQ ID NO: 364931 - DNA, 25 bp, Mus musculus
tctaaattccaagccatcttctctt

SEQ ID NO: 364932 - DNA, 25 bp, Mus musculus
tctaaattctaagatgggatgtgac

SEQ ID NO: 364933 - DNA, 25 bp, Mus musculus
tctaacaattttcagcagtacccct

SEQ ID NO: 364934 - DNA, 25 bp, Mus musculus
tctaacaccctgatgcttcctttgc

SEQ ID NO: 364935 - DNA, 25 bp, Mus musculus
tctaacaccgcaagccccgcccaac

SEQ ID NO: 364936 - DNA, 25 bp, Mus musculus
tctaacacgaagaggtatatgtggt

SEQ ID NO: 364937 - DNA, 25 bp, Mus musculus
tctaacactgctgcgaccattgcca

SEQ ID NO: 364938 - DNA, 25 bp, Mus musculus
tctaacagaaaccagattcatccag

SEQ ID NO: 364939 - DNA, 25 bp, Mus musculus
tctaacagatttcacgtgtcaccat

SEQ ID NO: 364940 - DNA, 25 bp, Mus musculus
tctaacagcagcaggaaaatgggaa

SEQ ID NO: 364941 - DNA, 25 bp, Mus musculus
tctaacagctcaagatggtgaggaa

SEQ ID NO: 364942 - DNA, 25 bp, Mus musculus
tctaacataagctgcttcctgcttg

SEQ ID NO: 364943 - DNA, 25 bp, Mus musculus
tctaacataagtcttcttttttgtt

SEQ ID NO: 364944 - DNA, 25 bp, Mus musculus
tctaacatattaaaggaggtcctgg

SEQ ID NO: 364945 - DNA, 25 bp, Mus musculus
tctaacatatttgaggcggaggcag

SEQ ID NO: 364946 - DNA, 25 bp, Mus musculus
tctaacatcacagattgctgaaaga

SEQ ID NO: 364947 - DNA, 25 bp, Mus musculus
tctaacatcttcacgctaatgaacc

SEQ ID NO: 364948 - DNA, 25 bp, Mus musculus
tctaacatcttcacgtctcgaaaag

SEQ ID NO: 364949 - DNA, 25 bp, Mus musculus
tctaaccactcacaatcagcggagt

SEQ ID NO: 364950 - DNA, 25 bp, Mus musculus
tctaaccagaggcaccaggatcatc

SEQ ID NO: 364951 - DNA, 25 bp, Mus musculus
tctaaccagatggactatccatcgc

SEQ ID NO: 364952 - DNA, 25 bp, Mus musculus
tctaaccagcagatagtctacatgg

SEQ ID NO: 364953 - DNA, 25 bp, Mus musculus
tctaaccagctccacttgagcagcg

SEQ ID NO: 364954 - DNA, 25 bp, Mus musculus
tctaaccagctcgacttgagcagcg

SEQ ID NO: 364955 - DNA, 25 bp, Mus musculus
tctaaccatataccagaggaggagt

SEQ ID NO: 364956 - DNA, 25 bp, Mus musculus
tctaacccaggtgatgaagtctcga

SEQ ID NO: 364957 - DNA, 25 bp, Mus musculus
tctaacctgcatcccagcctatgac

SEQ ID NO: 364958 - DNA, 25 bp, Mus musculus
tctaacctgcctgtgatggtatgga

SEQ ID NO: 364959 - DNA, 25 bp, Mus musculus
tctaacctggagaatgccctggact

SEQ ID NO: 364960 - DNA, 25 bp, Mus musculus
tctaacctggccctctgctgttttc

SEQ ID NO: 364961 - DNA, 25 bp, Mus musculus
tctaacctggttggtttgggatgct

SEQ ID NO: 364962 - DNA, 25 bp, Mus musculus
tctaactcactcagaagagaagagc

SEQ ID NO: 364963 - DNA, 25 bp, Mus musculus
tctaactcactcagtgtcaacaggg

SEQ ID NO: 364964 - DNA, 25 bp, Mus musculus
tctaactcaggaaggcgaagtgcac

SEQ ID NO: 364965 - DNA, 25 bp, Mus musculus
tctaacttcagccagaggctccagc

SEQ ID NO: 364966 - DNA, 25 bp, Mus musculus
tctaagaaacattccctgtgtggtc

SEQ ID NO: 364967 - DNA, 25 bp, Mus musculus
tctaagaaagccagagaaggtgtga

SEQ ID NO: 364968 - DNA, 25 bp, Mus musculus
tctaagaaagccagcagcattagat

SEQ ID NO: 364969 - DNA, 25 bp, Mus musculus
tctaagaaggctacaaggtggggtc

SEQ ID NO: 364970 - DNA, 25 bp, Mus musculus
tctaagaatgctgttttgaatcagc

SEQ ID NO: 364971 - DNA, 25 bp, Mus musculus
tctaagactcaggtaacagttcagt

SEQ ID NO: 364972 - DNA, 25 bp, Mus musculus
tctaagactgcagatgcccccgaaa

SEQ ID NO: 364973 - DNA, 25 bp, Mus musculus
tctaagagcaagatatgaaatcgtg

SEQ ID NO: 364974 - DNA, 25 bp, Mus musculus
tctaagatggtgcagtgaaccacca

SEQ ID NO: 364975 - DNA, 25 bp, Mus musculus
tctaagattctccttccacgaccca

SEQ ID NO: 364976 - DNA, 25 bp, Mus musculus
tctaagattgaagatcgagcgtttg

SEQ ID NO: 364977 - DNA, 25 bp, Mus musculus
tctaagattggtgtcccttttccca

SEQ ID NO: 364978 - DNA, 25 bp, Mus musculus
tctaagcagaagcaccgagtggatt

SEQ ID NO: 364979 - DNA, 25 bp, Mus musculus
tctaagccaggttgccatgaagtgt

SEQ ID NO: 364980 - DNA, 25 bp, Mus musculus
tctaagcctgaacctggctgctttt

SEQ ID NO: 364981 - DNA, 25 bp, Mus musculus
tctaagcgtagaagccgaactcccg

SEQ ID NO: 364982 - DNA, 25 bp, Mus musculus
tctaagcttacaggagtgccaggag

SEQ ID NO: 364983 - DNA, 25 bp, Mus musculus
tctaaggaaggaaaaccataagggt

SEQ ID NO: 364984 - DNA, 25 bp, Mus musculus
tctaaggaggagaacatttcagagt

SEQ ID NO: 364985 - DNA, 25 bp, Mus musculus
tctaaggaggagtacatttcagagt

SEQ ID NO: 364986 - DNA, 25 bp, Mus musculus
tctaaggatgatgggccagatcatc

SEQ ID NO: 364987 - DNA, 25 bp, Mus musculus
tctaaggatggtcctgcccccgctc

SEQ ID NO: 364988 - DNA, 25 bp, Mus musculus
tctaaggattcaggctaaaaccgac

SEQ ID NO: 364989 - DNA, 25 bp, Mus musculus
tctaagggaaggaaccaagtggttg

SEQ ID NO: 364990 - DNA, 25 bp, Mus musculus
tctaaggtcggacaagctctactcc

SEQ ID NO: 364991 - DNA, 25 bp, Mus musculus
tctaaggtcggacaaggaaacacag

SEQ ID NO: 364992 - DNA, 25 bp, Mus musculus
tctaagtagtgagtctattgagaac

SEQ ID NO: 364993 - DNA, 25 bp, Mus musculus
tctaagtcctgacaagccgcccctc

SEQ ID NO: 364994 - DNA, 25 bp, Mus musculus
tctaagtcctgacacaagcgaccgg

SEQ ID NO: 364995 - DNA, 25 bp, Mus musculus
tctaagtcgcaggtagaatggatga

SEQ ID NO: 364996 - DNA, 25 bp, Mus musculus
tctaagtctacccggcagttgggtt

SEQ ID NO: 364997 - DNA, 25 bp, Mus musculus
tctaagtctacccggtttattatat

SEQ ID NO: 364998 - DNA, 25 bp, Mus musculus
tctaagtgaaggacagagggtaccc

SEQ ID NO: 364999 - DNA, 25 bp, Mus musculus
tctaagtgacaagaaaatgacaaga

SEQ ID NO: 365000 - DNA, 25 bp, Mus musculus
tctaagtgacaagaatatagaacga

SEQ ID NO: 365001 - DNA, 25 bp, Mus musculus
tctaagttggatcagtgatgatgag

SEQ ID NO: 365002 - DNA, 25 bp, Mus musculus
tctaagtttgcagcttggatgctca

SEQ ID NO: 365003 - DNA, 25 bp, Mus musculus
tctaataaagcaaggagtaaataat

SEQ ID NO: 365004 - DNA, 25 bp, Mus musculus
tctaataaaggatatggtggtgatc

SEQ ID NO: 365005 - DNA, 25 bp, Mus musculus
tctaataacctcaagtgactgtggt

SEQ ID NO: 365006 - DNA, 25 bp, Mus musculus
tctaatacagactcagccatggtcc

SEQ ID NO: 365007 - DNA, 25 bp, Mus musculus
tctaatacagtggcttctttctcct

SEQ ID NO: 365008 - DNA, 25 bp, Mus musculus
tctaatagtgtccatgtcaatatac

SEQ ID NO: 365009 - DNA, 25 bp, Mus musculus
tctaatatcagcgctcatgctccgg

SEQ ID NO: 365010 - DNA, 25 bp, Mus musculus
tctaatatcatccagttgctgcttc

SEQ ID NO: 365011 - DNA, 25 bp, Mus musculus
tctaatatgaaggaagtacttaagc

SEQ ID NO: 365012 - DNA, 25 bp, Mus musculus
tctaatcattcttgtgaatctcttg

SEQ ID NO: 365013 - DNA, 25 bp, Mus musculus
tctaatcattctttctgagcagaag

SEQ ID NO: 365014 - DNA, 25 bp, Mus musculus
tctaatccaggatgctgggcagttt

SEQ ID NO: 365015 - DNA, 25 bp, Mus musculus
tctaatccagggtctgccgtcatcc

SEQ ID NO: 365016 - DNA, 25 bp, Mus musculus
tctaatcccaagcacggtagatgga

SEQ ID NO: 365017 - DNA, 25 bp, Mus musculus
tctaatcctaaatctccacagttga

SEQ ID NO: 365018 - DNA, 25 bp, Mus musculus
tctaatgatgctttcagacttggtc

SEQ ID NO: 365019 - DNA, 25 bp, Mus musculus
tctaatgatggaacatgtctcagga

SEQ ID NO: 365020 - DNA, 25 bp, Mus musculus
tctaatgggggtcctgctccagaag

SEQ ID NO: 365021 - DNA, 25 bp, Mus musculus
tctaatgtaaacctgaactatgaca

SEQ ID NO: 365022 - DNA, 25 bp, Mus musculus
tctaatgtaaacctgttgccaagaa

SEQ ID NO: 365023 - DNA, 25 bp, Mus musculus
tctaattaagctgtctcctaagaag

SEQ ID NO: 365024 - DNA, 25 bp, Mus musculus
tctaattcagatcatgattctggaa

SEQ ID NO: 365025 - DNA, 25 bp, Mus musculus
tctaattctttaagttcaagtttgg

SEQ ID NO: 365026 - DNA, 25 bp, Mus musculus
tctaattgtgggagtctgcagtgat

SEQ ID NO: 365027 - DNA, 25 bp, Mus musculus
tctaatttttcaggtgccgacttat

SEQ ID NO: 365028 - DNA, 25 bp, Mus musculus
tctacaaaaagattgaagacctgat

SEQ ID NO: 365029 - DNA, 25 bp, Mus musculus
tctacaaaagattgatgtatcctct

SEQ ID NO: 365030 - DNA, 25 bp, Mus musculus
tctacaaaagctcttcagagaagta

SEQ ID NO: 365031 - DNA, 25 bp, Mus musculus
tctacaaaaggtacacaataaaagg

SEQ ID NO: 365032 - DNA, 25 bp, Mus musculus
tctacaaaaggtgaagtatttgact

SEQ ID NO: 365033 - DNA, 25 bp, Mus musculus
tctacaaacagcatgatgcagctgc

SEQ ID NO: 365034 - DNA, 25 bp, Mus musculus
tctacaaacagcatggaactgaccc

SEQ ID NO: 365035 - DNA, 25 bp, Mus musculus
tctacaaagtcagatactccatatc

SEQ ID NO: 365036 - DNA, 25 bp, Mus musculus
tctacaaatgataaaactattaaat

SEQ ID NO: 365037 - DNA, 25 bp, Mus musculus
tctacaacaagaaggtagaggcagt

SEQ ID NO: 365038 - DNA, 25 bp, Mus musculus
tctacaacaggccattctttgcccc

SEQ ID NO: 365039 - DNA, 25 bp, Mus musculus
tctacaacagggcatccgtccctgc

SEQ ID NO: 365040 - DNA, 25 bp, Mus musculus
tctacaaccaagaaggtttgatgag

SEQ ID NO: 365041 - DNA, 25 bp, Mus musculus
tctacaaccaaggagaatagcaaaa

SEQ ID NO: 365042 - DNA, 25 bp, Mus musculus
tctacaaccgctcccaccaacagtg

SEQ ID NO: 365043 - DNA, 25 bp, Mus musculus
tctacaaccggtggcaggatccaat

SEQ ID NO: 365044 - DNA, 25 bp, Mus musculus
tctacaagaatgaggaaggcacttg

SEQ ID NO: 365045 - DNA, 25 bp, Mus musculus
tctacaagaatgcggaaggcacttg

SEQ ID NO: 365046 - DNA, 25 bp, Mus musculus
tctacaagacgcagctcggtgagga

SEQ ID NO: 365047 - DNA, 25 bp, Mus musculus
tctacaagcaagacccaagagttac

SEQ ID NO: 365048 - DNA, 25 bp, Mus musculus
tctacaagcaaggagttacaccctg

SEQ ID NO: 365049 - DNA, 25 bp, Mus musculus
tctacaagccaggagccatgcgagg

SEQ ID NO: 365050 - DNA, 25 bp, Mus musculus
tctacaatgggcacctgggttaggg

SEQ ID NO: 365051 - DNA, 25 bp, Mus musculus
tctacacaatttgggagtgagctac

SEQ ID NO: 365052 - DNA, 25 bp, Mus musculus
tctacacaccccctacctatggagt

SEQ ID NO: 365053 - DNA, 25 bp, Mus musculus
tctacacactgtgggcatcctctac

SEQ ID NO: 365054 - DNA, 25 bp, Mus musculus
tctacacactgtgggccatccacga

SEQ ID NO: 365055 - DNA, 25 bp, Mus musculus
tctacacactgtggggtgcccaatt

SEQ ID NO: 365056 - DNA, 25 bp, Mus musculus
tctacacagaaccagagcatgacca

SEQ ID NO: 365057 - DNA, 25 bp, Mus musculus
tctacacatccttgctgaggatcaa

SEQ ID NO: 365058 - DNA, 25 bp, Mus musculus
tctacacatcctttaaaaagtatgg

SEQ ID NO: 365059 - DNA, 25 bp, Mus musculus
tctacaccacgactggtggaaaaat

SEQ ID NO: 365060 - DNA, 25 bp, Mus musculus
tctacacccaggtgattcgagtcat

SEQ ID NO: 365061 - DNA, 25 bp, Mus musculus
tctacacccatgagcacttgctggc

SEQ ID NO: 365062 - DNA, 25 bp, Mus musculus
tctacaccctggtggtgtctgtgag

SEQ ID NO: 365063 - DNA, 25 bp, Mus musculus
tctacacctgcaaggaatattgaag

SEQ ID NO: 365064 - DNA, 25 bp, Mus musculus
tctacactgaattttagaaaggaaa

SEQ ID NO: 365065 - DNA, 25 bp, Mus musculus
tctacactgagtccaaacatcacac

SEQ ID NO: 365066 - DNA, 25 bp, Mus musculus
tctacactgagtgccagtcattata

SEQ ID NO: 365067 - DNA, 25 bp, Mus musculus
tctacactgagtggttcctcagacc

SEQ ID NO: 365068 - DNA, 25 bp, Mus musculus
tctacactgcactgggtgggctgaa

SEQ ID NO: 365069 - DNA, 25 bp, Mus musculus
tctacactgccaaccagaactgcgt

SEQ ID NO: 365070 - DNA, 25 bp, Mus musculus
tctacactgttgttggccgccccat

SEQ ID NO: 365071 - DNA, 25 bp, Mus musculus
tctacacttcccaaaaagaagatta

SEQ ID NO: 365072 - DNA, 25 bp, Mus musculus
tctacacttgcaaggccataccttc

SEQ ID NO: 365073 - DNA, 25 bp, Mus musculus
tctacacttttcatgcagatcctgt

SEQ ID NO: 365074 - DNA, 25 bp, Mus musculus
tctacagaacaggtgggcactctgg

SEQ ID NO: 365075 - DNA, 25 bp, Mus musculus
tctacagaacagtctatacaaccat

SEQ ID NO: 365076 - DNA, 25 bp, Mus musculus
tctacagaacctgacaggtatgtca

SEQ ID NO: 365077 - DNA, 25 bp, Mus musculus
tctacagaagagagacatctcctgt

SEQ ID NO: 365078 - DNA, 25 bp, Mus musculus
tctacagaagagggtgattaaagtt

SEQ ID NO: 365079 - DNA, 25 bp, Mus musculus
tctacagagaatccccggcagccca

SEQ ID NO: 365080 - DNA, 25 bp, Mus musculus
tctacagaggacaggctcacaactc

SEQ ID NO: 365081 - DNA, 25 bp, Mus musculus
tctacagataacccccggcagccca

SEQ ID NO: 365082 - DNA, 25 bp, Mus musculus
tctacagcaagttcgatccttcatg

SEQ ID NO: 365083 - DNA, 25 bp, Mus musculus
tctacagcaatgggatacggacaga

SEQ ID NO: 365084 - DNA, 25 bp, Mus musculus
tctacagcatagccctcagggattc

SEQ ID NO: 365085 - DNA, 25 bp, Mus musculus
tctacagcatagggaagcagctgcc

SEQ ID NO: 365086 - DNA, 25 bp, Mus musculus
tctacagccatgggcttctgcttct

SEQ ID NO: 365087 - DNA, 25 bp, Mus musculus
tctacagcccagggtctggtgagaa

SEQ ID NO: 365088 - DNA, 25 bp, Mus musculus
tctacagcccaggtttggtcatctc

SEQ ID NO: 365089 - DNA, 25 bp, Mus musculus
tctacagcctgggctgcgccttccc

SEQ ID NO: 365090 - DNA, 25 bp, Mus musculus
tctacagctcagatgtttttacccc

SEQ ID NO: 365091 - DNA, 25 bp, Mus musculus
tctacagctgctggaaattagagcg

SEQ ID NO: 365092 - DNA, 25 bp, Mus musculus
tctacagctgctggctgagggtggg

SEQ ID NO: 365093 - DNA, 25 bp, Mus musculus
tctacaggaaaacaggtttcaagtg

SEQ ID NO: 365094 - DNA, 25 bp, Mus musculus
tctacaggaacagcgctcatccact

SEQ ID NO: 365095 - DNA, 25 bp, Mus musculus
tctacaggaacagcggaaaatacag

SEQ ID NO: 365096 - DNA, 25 bp, Mus musculus
tctacaggaacccgtcattgccttt

SEQ ID NO: 365097 - DNA, 25 bp, Mus musculus
tctacaggagaagtggtgcatggat

SEQ ID NO: 365098 - DNA, 25 bp, Mus musculus
tctacaggagaagtggtggcctgct

SEQ ID NO: 365099 - DNA, 25 bp, Mus musculus
tctacaggccaactgccaatttgtg

SEQ ID NO: 365100 - DNA, 25 bp, Mus musculus
tctacaggctccagtctttcacccc

SEQ ID NO: 365101 - DNA, 25 bp, Mus musculus
tctacagggatgagactttgaagag

SEQ ID NO: 365102 - DNA, 25 bp, Mus musculus
tctacagggatgagctagttaaagg

SEQ ID NO: 365103 - DNA, 25 bp, Mus musculus
tctacaggtagggacccgaaagtgc

SEQ ID NO: 365104 - DNA, 25 bp, Mus musculus
tctacagtaagaaggtggaggagcc

SEQ ID NO: 365105 - DNA, 25 bp, Mus musculus
tctacagtaagaaggtggagtacct

SEQ ID NO: 365106 - DNA, 25 bp, Mus musculus
tctacatagaagttgaccagatata

SEQ ID NO: 365107 - DNA, 25 bp, Mus musculus
tctacatatcaactcaacaaggaca

SEQ ID NO: 365108 - DNA, 25 bp, Mus musculus
tctacatatttgcaggtgtcctcca

SEQ ID NO: 365109 - DNA, 25 bp, Mus musculus
tctacatcctggtgtttgtggtagc

SEQ ID NO: 365110 - DNA, 25 bp, Mus musculus
tctacatctttggtattgttgggtg

SEQ ID NO: 365111 - DNA, 25 bp, Mus musculus
tctacattaggcaaatcaacaatgt

SEQ ID NO: 365112 - DNA, 25 bp, Mus musculus
tctacattagtgggaagcagctata

SEQ ID NO: 365113 - DNA, 25 bp, Mus musculus
tctacattagtgggtagcagctata

SEQ ID NO: 365114 - DNA, 25 bp, Mus musculus
tctacattccagaggtgatggtggc

SEQ ID NO: 365115 - DNA, 25 bp, Mus musculus
tctacatttcagacatcccgcttac

SEQ ID NO: 365116 - DNA, 25 bp, Mus musculus
tctacatttcagatcctcctaccac

SEQ ID NO: 365117 - DNA, 25 bp, Mus musculus
tctaccaaaacaaccctggcctatg

SEQ ID NO: 365118 - DNA, 25 bp, Mus musculus
tctaccaaagtctcactttatctct

SEQ ID NO: 365119 - DNA, 25 bp, Mus musculus
tctaccaaatactatctgaatgact

SEQ ID NO: 365120 - DNA, 25 bp, Mus musculus
tctaccaaatattgcatttagccat

SEQ ID NO: 365121 - DNA, 25 bp, Mus musculus
tctaccaacgataaaacaataaaat

SEQ ID NO: 365122 - DNA, 25 bp, Mus musculus
tctaccaacggtaagacaataaaat

SEQ ID NO: 365123 - DNA, 25 bp, Mus musculus
tctaccaagaaaaagacgctgggct

SEQ ID NO: 365124 - DNA, 25 bp, Mus musculus
tctaccaagaaaaagacttcaagga

SEQ ID NO: 365125 - DNA, 25 bp, Mus musculus
tctaccacaaatattatcactacct

SEQ ID NO: 365126 - DNA, 25 bp, Mus musculus
tctaccacaacctgaagaacatggt

SEQ ID NO: 365127 - DNA, 25 bp, Mus musculus
tctaccacaagaaggttgtggatca

SEQ ID NO: 365128 - DNA, 25 bp, Mus musculus
tctaccacaagatgctggtggttgg

SEQ ID NO: 365129 - DNA, 25 bp, Mus musculus
tctaccacagtgactcatgttcatc

SEQ ID NO: 365130 - DNA, 25 bp, Mus musculus
tctaccaccaacgagagccatcctt

SEQ ID NO: 365131 - DNA, 25 bp, Mus musculus
tctaccaccgcgtaggatctttctc

SEQ ID NO: 365132 - DNA, 25 bp, Mus musculus
tctaccactacacccagctgccctc

SEQ ID NO: 365133 - DNA, 25 bp, Mus musculus
tctaccagaattatatatgttgggt

SEQ ID NO: 365134 - DNA, 25 bp, Mus musculus
tctaccagaggctgtgtacagcgcg

SEQ ID NO: 365135 - DNA, 25 bp, Mus musculus
tctaccagcaaggttggcccctagg

SEQ ID NO: 365136 - DNA, 25 bp, Mus musculus
tctaccagcaatgtgtgtccgtcct

SEQ ID NO: 365137 - DNA, 25 bp, Mus musculus
tctaccagcagaacagcacagcccc

SEQ ID NO: 365138 - DNA, 25 bp, Mus musculus
tctaccagcagacccaatggaactg

SEQ ID NO: 365139 - DNA, 25 bp, Mus musculus
tctaccagcaggcttccccaccaga

SEQ ID NO: 365140 - DNA, 25 bp, Mus musculus
tctaccaggaaataatccttgctaa

SEQ ID NO: 365141 - DNA, 25 bp, Mus musculus
tctaccaggtacagcaatgacattt

SEQ ID NO: 365142 - DNA, 25 bp, Mus musculus
tctaccatacggacatatagattct

SEQ ID NO: 365143 - DNA, 25 bp, Mus musculus
tctaccatcctcagtggtacactta

SEQ ID NO: 365144 - DNA, 25 bp, Mus musculus
tctaccatggccagggctctgacag

SEQ ID NO: 365145 - DNA, 25 bp, Mus musculus
tctaccatggccagtgaggtgttcg

SEQ ID NO: 365146 - DNA, 25 bp, Mus musculus
tctaccatggtgaagggaatgtacg

SEQ ID NO: 365147 - DNA, 25 bp, Mus musculus
tctaccatttatggaagccctgcag

SEQ ID NO: 365148 - DNA, 25 bp, Mus musculus
tctacccaaagtgatcaacttttgt

SEQ ID NO: 365149 - DNA, 25 bp, Mus musculus
tctacccaatggaggttctgaagac

SEQ ID NO: 365150 - DNA, 25 bp, Mus musculus
tctacccagaagaaggaccaggtga

SEQ ID NO: 365151 - DNA, 25 bp, Mus musculus
tctacccagaggaagaatttgagca

SEQ ID NO: 365152 - DNA, 25 bp, Mus musculus
tctacccagcatagccccttcacag

SEQ ID NO: 365153 - DNA, 25 bp, Mus musculus
tctacccatttctcccaagtgctgg

SEQ ID NO: 365154 - DNA, 25 bp, Mus musculus
tctaccccacataatatttcttgga

SEQ ID NO: 365155 - DNA, 25 bp, Mus musculus
tctaccccacttaatatttcttgga

SEQ ID NO: 365156 - DNA, 25 bp, Mus musculus
tctaccccagacaagaataaggtga

SEQ ID NO: 365157 - DNA, 25 bp, Mus musculus
tctaccccaggtggcagccttggct

SEQ ID NO: 365158 - DNA, 25 bp, Mus musculus
tctaccccagttcccaaagtggctg

SEQ ID NO: 365159 - DNA, 25 bp, Mus musculus
tctaccccatttggtgacttcatgg

SEQ ID NO: 365160 - DNA, 25 bp, Mus musculus
tctaccccatttggtgatctgaatg

SEQ ID NO: 365161 - DNA, 25 bp, Mus musculus
tctacccctccacatggcttcttct

SEQ ID NO: 365162 - DNA, 25 bp, Mus musculus
tctacccctccacatgtctctggat

SEQ ID NO: 365163 - DNA, 25 bp, Mus musculus
tctacccctttcagattgtaagctc

SEQ ID NO: 365164 - DNA, 25 bp, Mus musculus
tctacccctttcaggactccttcta

SEQ ID NO: 365165 - DNA, 25 bp, Mus musculus
tctacccgacagacatacttcctgc

SEQ ID NO: 365166 - DNA, 25 bp, Mus musculus
tctacccgacagggtgtgaacaaag

SEQ ID NO: 365167 - DNA, 25 bp, Mus musculus
tctaccctcaaccagcaagcctgcc

SEQ ID NO: 365168 - DNA, 25 bp, Mus musculus
tctaccctgtccaagcccacaggac

SEQ ID NO: 365169 - DNA, 25 bp, Mus musculus
tctaccctttcactggggatcacaa

SEQ ID NO: 365170 - DNA, 25 bp, Mus musculus
tctaccgcaacgtggtctccattga

SEQ ID NO: 365171 - DNA, 25 bp, Mus musculus
tctaccggcttgatctcagtgaaaa

SEQ ID NO: 365172 - DNA, 25 bp, Mus musculus
tctaccggtttcagacaccctattt

SEQ ID NO: 365173 - DNA, 25 bp, Mus musculus
tctaccgtagcccagaaaaatatga

SEQ ID NO: 365174 - DNA, 25 bp, Mus musculus
tctaccgtagcccagagcaagtccc

SEQ ID NO: 365175 - DNA, 25 bp, Mus musculus
tctacctacaagagaactctgaagg

SEQ ID NO: 365176 - DNA, 25 bp, Mus musculus
tctacctacaagaggagagtcaaac

SEQ ID NO: 365177 - DNA, 25 bp, Mus musculus
tctacctacaagaggtagaaagtcc

SEQ ID NO: 365178 - DNA, 25 bp, Mus musculus
tctacctaccagccctgggtcctga

SEQ ID NO: 365179 - DNA, 25 bp, Mus musculus
tctacctaccaggatggtccacctc

SEQ ID NO: 365180 - DNA, 25 bp, Mus musculus
tctacctacgaccaggttcagaaca

SEQ ID NO: 365181 - DNA, 25 bp, Mus musculus
tctacctagaaaagatttcacacac

SEQ ID NO: 365182 - DNA, 25 bp, Mus musculus
tctacctcagggccccgccgtcacc

SEQ ID NO: 365183 - DNA, 25 bp, Mus musculus
tctacctctgtggaagctcggattc

SEQ ID NO: 365184 - DNA, 25 bp, Mus musculus
tctacctctttgaggaactttgatg

SEQ ID NO: 365185 - DNA, 25 bp, Mus musculus
tctacctctttgagggaagaagcca

SEQ ID NO: 365186 - DNA, 25 bp, Mus musculus
tctacctgaacagggacccagaagg

SEQ ID NO: 365187 - DNA, 25 bp, Mus musculus
tctacctgaaggatctgaaaacatc

SEQ ID NO: 365188 - DNA, 25 bp, Mus musculus
tctacctgatgccgaatgatcaccg

SEQ ID NO: 365189 - DNA, 25 bp, Mus musculus
tctacctgatgcctggcctggtctg

SEQ ID NO: 365190 - DNA, 25 bp, Mus musculus
tctacctgatgcgcctggagctgtg

SEQ ID NO: 365191 - DNA, 25 bp, Mus musculus
tctacctgcagagctttgtggcgtg

SEQ ID NO: 365192 - DNA, 25 bp, Mus musculus
tctacctgcagcatcgaatcctgga

SEQ ID NO: 365193 - DNA, 25 bp, Mus musculus
tctacctgcaggagaccccatgttt

SEQ ID NO: 365194 - DNA, 25 bp, Mus musculus
tctacctgcaggcagcctgatctct

SEQ ID NO: 365195 - DNA, 25 bp, Mus musculus
tctacctgcaggtcacccacgtgtt

SEQ ID NO: 365196 - DNA, 25 bp, Mus musculus
tctacctggcagagatggacatgct

SEQ ID NO: 365197 - DNA, 25 bp, Mus musculus
tctacctggcagagccgctgatgga

SEQ ID NO: 365198 - DNA, 25 bp, Mus musculus
tctacctggcagaggtgatatgtaa

SEQ ID NO: 365199 - DNA, 25 bp, Mus musculus
tctacctgtacagggctggtacttc

SEQ ID NO: 365200 - DNA, 25 bp, Mus musculus
tctacctgtacagttttgtggcggc

SEQ ID NO: 365201 - DNA, 25 bp, Mus musculus
tctaccttgaaggcccacaatgtcc

SEQ ID NO: 365202 - DNA, 25 bp, Mus musculus
tctaccttgcttgtgggattcacag

SEQ ID NO: 365203 - DNA, 25 bp, Mus musculus
tctacgaacacggccaaagtgaaag

SEQ ID NO: 365204 - DNA, 25 bp, Mus musculus
tctacgacacgaacctgccagatgt

SEQ ID NO: 365205 - DNA, 25 bp, Mus musculus
tctacgacaggctcatcagcggctc

SEQ ID NO: 365206 - DNA, 25 bp, Mus musculus
tctacgagagctttaattttgccaa

SEQ ID NO: 365207 - DNA, 25 bp, Mus musculus
tctacgagagctttggtctctttgc

SEQ ID NO: 365208 - DNA, 25 bp, Mus musculus
tctacgagcagggcacaactgtgcg

SEQ ID NO: 365209 - DNA, 25 bp, Mus musculus
tctacgaggtagatgcacgggaata

SEQ ID NO: 365210 - DNA, 25 bp, Mus musculus
tctacgatgagtgtaaacgaagatt

SEQ ID NO: 365211 - DNA, 25 bp, Mus musculus
tctacgccaagcatcatcagctggt

SEQ ID NO: 365212 - DNA, 25 bp, Mus musculus
tctacgccatgggctggcgccaccc

SEQ ID NO: 365213 - DNA, 25 bp, Mus musculus
tctacgccttcccgaactacgctgc

SEQ ID NO: 365214 - DNA, 25 bp, Mus musculus
tctacggatggaggaatcacttgga

SEQ ID NO: 365215 - DNA, 25 bp, Mus musculus
tctacggcagaaaggggagtgtgtt

SEQ ID NO: 365216 - DNA, 25 bp, Mus musculus
tctacggcagtacatttttatacct

SEQ ID NO: 365217 - DNA, 25 bp, Mus musculus
tctacggccctgcaacattggttct

SEQ ID NO: 365218 - DNA, 25 bp, Mus musculus
tctacggccctgcagtggaagactt

SEQ ID NO: 365219 - DNA, 25 bp, Mus musculus
tctacggcggagtggaacactcggg

SEQ ID NO: 365220 - DNA, 25 bp, Mus musculus
tctacgggcaggctcccggacctct

SEQ ID NO: 365221 - DNA, 25 bp, Mus musculus
tctacgggtactggggcctggatat

SEQ ID NO: 365222 - DNA, 25 bp, Mus musculus
tctacggtgccaggctgtactgcct

SEQ ID NO: 365223 - DNA, 25 bp, Mus musculus
tctacgtggcagatggcagcctgca

SEQ ID NO: 365224 - DNA, 25 bp, Mus musculus
tctacgttaaggtcacctccaaggt

SEQ ID NO: 365225 - DNA, 25 bp, Mus musculus
tctacgttaagttccggcgggagga

SEQ ID NO: 365226 - DNA, 25 bp, Mus musculus
tctactaagaaatgtcataaaggaa

SEQ ID NO: 365227 - DNA, 25 bp, Mus musculus
tctactacaaggtttgaagagtggc

SEQ ID NO: 365228 - DNA, 25 bp, Mus musculus
tctactacgtacaagatgaacatct

SEQ ID NO: 365229 - DNA, 25 bp, Mus musculus
tctactacgtacaaggaatcaaaga

SEQ ID NO: 365230 - DNA, 25 bp, Mus musculus
tctactactgaataccccaagtacc

SEQ ID NO: 365231 - DNA, 25 bp, Mus musculus
tctactactgggactcgtactgggt

SEQ ID NO: 365232 - DNA, 25 bp, Mus musculus
tctactagagttatctgggaatgtg

SEQ ID NO: 365233 - DNA, 25 bp, Mus musculus
tctactatatctctgctcatgtcta

SEQ ID NO: 365234 - DNA, 25 bp, Mus musculus
tctactatggagatgtcatctgggt

SEQ ID NO: 365235 - DNA, 25 bp, Mus musculus
tctactatggaggggctccacgggc

SEQ ID NO: 365236 - DNA, 25 bp, Mus musculus
tctactcaaattctggaatatcctg

SEQ ID NO: 365237 - DNA, 25 bp, Mus musculus
tctactcaataagctgagagtgcta

SEQ ID NO: 365238 - DNA, 25 bp, Mus musculus
tctactcaatagtcaaggaggttct

SEQ ID NO: 365239 - DNA, 25 bp, Mus musculus
tctactcacagagagaaaaaaccat

SEQ ID NO: 365240 - DNA, 25 bp, Mus musculus
tctactcacagagccccgtggcttc

SEQ ID NO: 365241 - DNA, 25 bp, Mus musculus
tctactcacaggagaaaatgctgga

SEQ ID NO: 365242 - DNA, 25 bp, Mus musculus
tctactccaggatggaggcctcctg

SEQ ID NO: 365243 - DNA, 25 bp, Mus musculus
tctactccagtaaatcctgtcataa

SEQ ID NO: 365244 - DNA, 25 bp, Mus musculus
tctactccgccattttcctgctgtc

SEQ ID NO: 365245 - DNA, 25 bp, Mus musculus
tctactcctaagtccccaggtgcat

SEQ ID NO: 365246 - DNA, 25 bp, Mus musculus
tctactcctaatgtgaaaaactcaa

SEQ ID NO: 365247 - DNA, 25 bp, Mus musculus
tctactcctcagctggaattttgga

SEQ ID NO: 365248 - DNA, 25 bp, Mus musculus
tctactcctcgctgagcacctcccc

SEQ ID NO: 365249 - DNA, 25 bp, Mus musculus
tctactcgtcctcttccacttcctg

SEQ ID NO: 365250 - DNA, 25 bp, Mus musculus
tctactctgtctgaagaagagctgg

SEQ ID NO: 365251 - DNA, 25 bp, Mus musculus
tctactcttggttcttcattgagtc

SEQ ID NO: 365252 - DNA, 25 bp, Mus musculus
tctactgaaggcttccaaaggaatt

SEQ ID NO: 365253 - DNA, 25 bp, Mus musculus
tctactgacagttgtccgtgtaatt

SEQ ID NO: 365254 - DNA, 25 bp, Mus musculus
tctactgacatgtaccataatgtca

SEQ ID NO: 365255 - DNA, 25 bp, Mus musculus
tctactgagcccaggaaactacaac

SEQ ID NO: 365256 - DNA, 25 bp, Mus musculus
tctactgccacagtggttccggaag

SEQ ID NO: 365257 - DNA, 25 bp, Mus musculus
tctactgccagactactggacttgg

SEQ ID NO: 365258 - DNA, 25 bp, Mus musculus
tctactgccagtgtctgttgtagac

SEQ ID NO: 365259 - DNA, 25 bp, Mus musculus
tctactgcggctggtgtcagtcgag

SEQ ID NO: 365260 - DNA, 25 bp, Mus musculus
tctactgcgggatggccatcgtccc

SEQ ID NO: 365261 - DNA, 25 bp, Mus musculus
tctactgcgggcatggtgaagcctt

SEQ ID NO: 365262 - DNA, 25 bp, Mus musculus
tctactgctaaagggagaaaagaca

SEQ ID NO: 365263 - DNA, 25 bp, Mus musculus
tctactgctgctttggctaccgctg

SEQ ID NO: 365264 - DNA, 25 bp, Mus musculus
tctactggaatagctacctcaggct

SEQ ID NO: 365265 - DNA, 25 bp, Mus musculus
tctactggcaaggtggtctacttca

SEQ ID NO: 365266 - DNA, 25 bp, Mus musculus
tctactggcaaggtggtctatttca

SEQ ID NO: 365267 - DNA, 25 bp, Mus musculus
tctactggccagaaggccagcaaca

SEQ ID NO: 365268 - DNA, 25 bp, Mus musculus
tctactgtcccggtgtgccagcctt

SEQ ID NO: 365269 - DNA, 25 bp, Mus musculus
tctactgtgaaggtgtggtccggtg

SEQ ID NO: 365270 - DNA, 25 bp, Mus musculus
tctacttacgaaggaagtggttcca

SEQ ID NO: 365271 - DNA, 25 bp, Mus musculus
tctacttattcaaagactcctggaa

SEQ ID NO: 365272 - DNA, 25 bp, Mus musculus
tctacttattcaaagttgtccgtgt

SEQ ID NO: 365273 - DNA, 25 bp, Mus musculus
tctacttcattgaccataacacaaa

SEQ ID NO: 365274 - DNA, 25 bp, Mus musculus
tctacttcattgatcataatacgaa

SEQ ID NO: 365275 - DNA, 25 bp, Mus musculus
tctacttcctcgaggcctacaattc

SEQ ID NO: 365276 - DNA, 25 bp, Mus musculus
tctacttctccaaagccaagcccga

SEQ ID NO: 365277 - DNA, 25 bp, Mus musculus
tctacttctccaaaggtctgtcaaa

SEQ ID NO: 365278 - DNA, 25 bp, Mus musculus
tctacttgtcagattgctgcccggg

SEQ ID NO: 365279 - DNA, 25 bp, Mus musculus
tctactttaaaggcaaatggaagat

SEQ ID NO: 365280 - DNA, 25 bp, Mus musculus
tctactttaatggtgagtacgcagg

SEQ ID NO: 365281 - DNA, 25 bp, Mus musculus
tctactttcattctctttacaggga

SEQ ID NO: 365282 - DNA, 25 bp, Mus musculus
tctactttcattctttagtaacaaa

SEQ ID NO: 365283 - DNA, 25 bp, Mus musculus
tctactttctgctttcatctccgta

SEQ ID NO: 365284 - DNA, 25 bp, Mus musculus
tctagaaaacaactcccagacctac

SEQ ID NO: 365285 - DNA, 25 bp, Mus musculus
tctagaaaacaatattgatgggcag

SEQ ID NO: 365286 - DNA, 25 bp, Mus musculus
tctagaaaacataggagacagcttg

SEQ ID NO: 365287 - DNA, 25 bp, Mus musculus
tctagaaaacgctaatctttctgca

SEQ ID NO: 365288 - DNA, 25 bp, Mus musculus
tctagaaaagttgaaatactggaca

SEQ ID NO: 365289 - DNA, 25 bp, Mus musculus
tctagaacagatgcaaaatcgtatg

SEQ ID NO: 365290 - DNA, 25 bp, Mus musculus
tctagaacaggagagcctgacaagg

SEQ ID NO: 365291 - DNA, 25 bp, Mus musculus
tctagaacagttcttaggaagcaag

SEQ ID NO: 365292 - DNA, 25 bp, Mus musculus
tctagaagaagaagctgaagtcatt

SEQ ID NO: 365293 - DNA, 25 bp, Mus musculus
tctagaagagcagtcgggtgctctt

SEQ ID NO: 365294 - DNA, 25 bp, Mus musculus
tctagaagaggcaatattgataata

SEQ ID NO: 365295 - DNA, 25 bp, Mus musculus
tctagaagcgaaggaatacacagac

SEQ ID NO: 365296 - DNA, 25 bp, Mus musculus
tctagaagtaagcggactggaaaca

SEQ ID NO: 365297 - DNA, 25 bp, Mus musculus
tctagaagttggtagtttacaaatg

SEQ ID NO: 365298 - DNA, 25 bp, Mus musculus
tctagaatacgcgtctgatggctat

SEQ ID NO: 365299 - DNA, 25 bp, Mus musculus
tctagacaaggcaggttcaccggac

SEQ ID NO: 365300 - DNA, 25 bp, Mus musculus
tctagacacagggcccatcatggct

SEQ ID NO: 365301 - DNA, 25 bp, Mus musculus
tctagacccaggagttttgctctgc

SEQ ID NO: 365302 - DNA, 25 bp, Mus musculus
tctagacttcggatccagcaatgcc

SEQ ID NO: 365303 - DNA, 25 bp, Mus musculus
tctagactttgaggaggaagaagtg

SEQ ID NO: 365304 - DNA, 25 bp, Mus musculus
tctagagaaatatgtgcatgagctc

SEQ ID NO: 365305 - DNA, 25 bp, Mus musculus
tctagagaaggagctagaagcgatc

SEQ ID NO: 365306 - DNA, 25 bp, Mus musculus
tctagagacacggaagcctgtgctg

SEQ ID NO: 365307 - DNA, 25 bp, Mus musculus
tctagagaccattgacaaagccaac

SEQ ID NO: 365308 - DNA, 25 bp, Mus musculus
tctagagccgtcaagctgatttatc

SEQ ID NO: 365309 - DNA, 25 bp, Mus musculus
tctagagctagcgggttatgcctcc

SEQ ID NO: 365310 - DNA, 25 bp, Mus musculus
tctagaggaggcctctaggtcgcca

SEQ ID NO: 365311 - DNA, 25 bp, Mus musculus
tctagatcagccaccatgcggcgta

SEQ ID NO: 365312 - DNA, 25 bp, Mus musculus
tctagatcctgaagatgttgctgtg

SEQ ID NO: 365313 - DNA, 25 bp, Mus musculus
tctagatcctgaatgttgctgtgca

SEQ ID NO: 365314 - DNA, 25 bp, Mus musculus
tctagatgagatatgtgaatcctcg

SEQ ID NO: 365315 - DNA, 25 bp, Mus musculus
tctagatgatatggagagcaccact

SEQ ID NO: 365316 - DNA, 25 bp, Mus musculus
tctagatgatatggcccactatgac

SEQ ID NO: 365317 - DNA, 25 bp, Mus musculus
tctagatggaacaagtaaggataga

SEQ ID NO: 365318 - DNA, 25 bp, Mus musculus
tctagatttaaagtgttcctaggat

SEQ ID NO: 365319 - DNA, 25 bp, Mus musculus
tctagcaacaaggaatcaaaaatga

SEQ ID NO: 365320 - DNA, 25 bp, Mus musculus
tctagcaagcagctatggccggtga

SEQ ID NO: 365321 - DNA, 25 bp, Mus musculus
tctagcaagcaggcatgacttgcca

SEQ ID NO: 365322 - DNA, 25 bp, Mus musculus
tctagcacaggttggtctggggtgg

SEQ ID NO: 365323 - DNA, 25 bp, Mus musculus
tctagcaccaagaaattcattcctg

SEQ ID NO: 365324 - DNA, 25 bp, Mus musculus
tctagcacccaggttactcggcggc

SEQ ID NO: 365325 - DNA, 25 bp, Mus musculus
tctagcacttgtgcttccaatagtc

SEQ ID NO: 365326 - DNA, 25 bp, Mus musculus
tctagcagcagaaagagccgtctct

SEQ ID NO: 365327 - DNA, 25 bp, Mus musculus
tctagcagtgcaaggtgtccgcaaa

SEQ ID NO: 365328 - DNA, 25 bp, Mus musculus
tctagcatcaaagatcttcaggatt

SEQ ID NO: 365329 - DNA, 25 bp, Mus musculus
tctagcatcaaaggccagaaacatc

SEQ ID NO: 365330 - DNA, 25 bp, Mus musculus
tctagcattacaaggaggtgcccct

SEQ ID NO: 365331 - DNA, 25 bp, Mus musculus
tctagcattgaggcctttgctgtgt

SEQ ID NO: 365332 - DNA, 25 bp, Mus musculus
tctagccccaggctcaatttgagaa

SEQ ID NO: 365333 - DNA, 25 bp, Mus musculus
tctagccctgagacagactcacacc

SEQ ID NO: 365334 - DNA, 25 bp, Mus musculus
tctagccgagatgtggtgaccaagc

SEQ ID NO: 365335 - DNA, 25 bp, Mus musculus
tctagccgaggccatgtggagcagc

SEQ ID NO: 365336 - DNA, 25 bp, Mus musculus
tctagcctaagttctgagaagtcag

SEQ ID NO: 365337 - DNA, 25 bp, Mus musculus
tctagcctaccagggatggctctga

SEQ ID NO: 365338 - DNA, 25 bp, Mus musculus
tctagcctcccaggtggaatgaacc

SEQ ID NO: 365339 - DNA, 25 bp, Mus musculus
tctagcctgaatctcctggagaaag

SEQ ID NO: 365340 - DNA, 25 bp, Mus musculus
tctagcggccgccagtctccacaga

SEQ ID NO: 365341 - DNA, 25 bp, Mus musculus
tctagctaatggggtagctgggagt

SEQ ID NO: 365342 - DNA, 25 bp, Mus musculus
tctagctcaggatgatatcctccag

SEQ ID NO: 365343 - DNA, 25 bp, Mus musculus
tctagctcaggtagcaacaattgca

SEQ ID NO: 365344 - DNA, 25 bp, Mus musculus
tctagctcaggtttctgtagctgga

SEQ ID NO: 365345 - DNA, 25 bp, Mus musculus
tctagctcgagaagggcagttatac

SEQ ID NO: 365346 - DNA, 25 bp, Mus musculus
tctagctcgagaagtctgatcagcg

SEQ ID NO: 365347 - DNA, 25 bp, Mus musculus
tctagctgaagtgagcaaaccaaca

SEQ ID NO: 365348 - DNA, 25 bp, Mus musculus
tctagctgggcgaggacccgtggag

SEQ ID NO: 365349 - DNA, 25 bp, Mus musculus
tctagctgtcgggacacagattggg

SEQ ID NO: 365350 - DNA, 25 bp, Mus musculus
tctaggaagcagaagatgccatact

SEQ ID NO: 365351 - DNA, 25 bp, Mus musculus
tctaggacatacccggttacatagg

SEQ ID NO: 365352 - DNA, 25 bp, Mus musculus
tctaggacctcgagtataactgcaa

SEQ ID NO: 365353 - DNA, 25 bp, Mus musculus
tctaggagaacttaggcttctttgg

SEQ ID NO: 365354 - DNA, 25 bp, Mus musculus
tctaggagggctgaggtacagtcat

SEQ ID NO: 365355 - DNA, 25 bp, Mus musculus
tctaggatcttctagtgaacagcgt

SEQ ID NO: 365356 - DNA, 25 bp, Mus musculus
tctaggatgcgatacaaatctcaaa

SEQ ID NO: 365357 - DNA, 25 bp, Mus musculus
tctaggatgcgatgccctgtggaat

SEQ ID NO: 365358 - DNA, 25 bp, Mus musculus
tctaggatgctggacgctggatcgc

SEQ ID NO: 365359 - DNA, 25 bp, Mus musculus
tctaggatttgttgtggctttttaa

SEQ ID NO: 365360 - DNA, 25 bp, Mus musculus
tctaggcaccagtctgcgttaagca

SEQ ID NO: 365361 - DNA, 25 bp, Mus musculus
tctaggccagcctggtctccgttat

SEQ ID NO: 365362 - DNA, 25 bp, Mus musculus
tctaggccctcagatcaatgatgat

SEQ ID NO: 365363 - DNA, 25 bp, Mus musculus
tctagggacagctggttccgtggct

SEQ ID NO: 365364 - DNA, 25 bp, Mus musculus
tctagggctctgcaggaagcctgct

SEQ ID NO: 365365 - DNA, 25 bp, Mus musculus
tctaggggcccaggtggacaacatc

SEQ ID NO: 365366 - DNA, 25 bp, Mus musculus
tctaggtaccacaggtaatctagct

SEQ ID NO: 365367 - DNA, 25 bp, Mus musculus
tctaggtatggtctgccggaagcct

SEQ ID NO: 365368 - DNA, 25 bp, Mus musculus
tctaggtcagcgaggtattgaagcc

SEQ ID NO: 365369 - DNA, 25 bp, Mus musculus
tctagtaaaagtgtcctagatgatg

SEQ ID NO: 365370 - DNA, 25 bp, Mus musculus
tctagtaacctttaggtcttgctag

SEQ ID NO: 365371 - DNA, 25 bp, Mus musculus
tctagtaatgacaagccctcatcac

SEQ ID NO: 365372 - DNA, 25 bp, Mus musculus
tctagtagcttgtcttctcacaggt

SEQ ID NO: 365373 - DNA, 25 bp, Mus musculus
tctagtcctcagaactgtggacctc

SEQ ID NO: 365374 - DNA, 25 bp, Mus musculus
tctagtgaatagtggaggagtgtac

SEQ ID NO: 365375 - DNA, 25 bp, Mus musculus
tctagtgactggggaattgatgtcc

SEQ ID NO: 365376 - DNA, 25 bp, Mus musculus
tctagtgcaggtgagtgcaggatcc

SEQ ID NO: 365377 - DNA, 25 bp, Mus musculus
tctagtgccaggaaaatactaaagt

SEQ ID NO: 365378 - DNA, 25 bp, Mus musculus
tctagtgctacaggcactcttcaac

SEQ ID NO: 365379 - DNA, 25 bp, Mus musculus
tctagtgctacaggttctcacgcgg

SEQ ID NO: 365380 - DNA, 25 bp, Mus musculus
tctagtgctacaggttctgctgact

SEQ ID NO: 365381 - DNA, 25 bp, Mus musculus
tctagtgctcttcagaatgtgaaga

SEQ ID NO: 365382 - DNA, 25 bp, Mus musculus
tctagtggaccagaggatatctggg

SEQ ID NO: 365383 - DNA, 25 bp, Mus musculus
tctagttaagaggtttggacatttc

SEQ ID NO: 365384 - DNA, 25 bp, Mus musculus
tctagttcaggccagctgctgctca

SEQ ID NO: 365385 - DNA, 25 bp, Mus musculus
tctagttccgagtcccgctcacgct

SEQ ID NO: 365386 - DNA, 25 bp, Mus musculus
tctagttgttggaggaactgctgaa

SEQ ID NO: 365387 - DNA, 25 bp, Mus musculus
tctataaaaagaaaaatattacaag

SEQ ID NO: 365388 - DNA, 25 bp, Mus musculus
tctataaaacatatttccagggtag

SEQ ID NO: 365389 - DNA, 25 bp, Mus musculus
tctataaaagagcatgggtacacaa

SEQ ID NO: 365390 - DNA, 25 bp, Mus musculus
tctataaaagaggtatatattatga

SEQ ID NO: 365391 - DNA, 25 bp, Mus musculus
tctataaaattgatgcatctctgac

SEQ ID NO: 365392 - DNA, 25 bp, Mus musculus
tctataaacaggcggcagcagctct

SEQ ID NO: 365393 - DNA, 25 bp, Mus musculus
tctataaacaggtcttagagccttc

SEQ ID NO: 365394 - DNA, 25 bp, Mus musculus
tctataaaggactgattgtgaattc

SEQ ID NO: 365395 - DNA, 25 bp, Mus musculus
tctataaatttgcaagagccagagg

SEQ ID NO: 365396 - DNA, 25 bp, Mus musculus
tctataacaataaagctgcagtgtt

SEQ ID NO: 365397 - DNA, 25 bp, Mus musculus
tctataacccgataatcccctatgt

SEQ ID NO: 365398 - DNA, 25 bp, Mus musculus
tctataacccgattccaggttgact

SEQ ID NO: 365399 - DNA, 25 bp, Mus musculus
tctataacggctgggcacgtggaga

SEQ ID NO: 365400 - DNA, 25 bp, Mus musculus
tctataacttcaaaaagcagccttc

SEQ ID NO: 365401 - DNA, 25 bp, Mus musculus
tctataacttcaatgtctttaacat

SEQ ID NO: 365402 - DNA, 25 bp, Mus musculus
tctataagaactgctccgctcggct

SEQ ID NO: 365403 - DNA, 25 bp, Mus musculus
tctataagaactggcacaagtctaa

SEQ ID NO: 365404 - DNA, 25 bp, Mus musculus
tctataagcagcctgctgtggaggt

SEQ ID NO: 365405 - DNA, 25 bp, Mus musculus
tctataagcagtgtgctgtgagaac

SEQ ID NO: 365406 - DNA, 25 bp, Mus musculus
tctataaggagggtcactccaaagg

SEQ ID NO: 365407 - DNA, 25 bp, Mus musculus
tctataagtgtgagatcgagtgctt

SEQ ID NO: 365408 - DNA, 25 bp, Mus musculus
tctataatcctgtggctgaccatat

SEQ ID NO: 365409 - DNA, 25 bp, Mus musculus
tctataatgccgtggctgctccagt

SEQ ID NO: 365410 - DNA, 25 bp, Mus musculus
tctataatgccgtggtgtggcttga

SEQ ID NO: 365411 - DNA, 25 bp, Mus musculus
tctataattagcacagagaatgaac

SEQ ID NO: 365412 - DNA, 25 bp, Mus musculus
tctatacacaggtgattttcgatat

SEQ ID NO: 365413 - DNA, 25 bp, Mus musculus
tctatacacatagttacttgggatt

SEQ ID NO: 365414 - DNA, 25 bp, Mus musculus
tctatacagaggctctccctacgga

SEQ ID NO: 365415 - DNA, 25 bp, Mus musculus
tctatacatcagagacttcagtact

SEQ ID NO: 365416 - DNA, 25 bp, Mus musculus
tctataccaagaagtgtcgagagct

SEQ ID NO: 365417 - DNA, 25 bp, Mus musculus
tctataccagactttgtacctattg

SEQ ID NO: 365418 - DNA, 25 bp, Mus musculus
tctataccagataaaaactacagtg

SEQ ID NO: 365419 - DNA, 25 bp, Mus musculus
tctataccattgacactggccaaaa

SEQ ID NO: 365420 - DNA, 25 bp, Mus musculus
tctataccttacggtccctttcctt

SEQ ID NO: 365421 - DNA, 25 bp, Mus musculus
tctatactgccaaaggtcttttccg

SEQ ID NO: 365422 - DNA, 25 bp, Mus musculus
tctatagcacgaccccttatccctc

SEQ ID NO: 365423 - DNA, 25 bp, Mus musculus
tctatagcacggtaacacaagtagc

SEQ ID NO: 365424 - DNA, 25 bp, Mus musculus
tctatagccaaggacattaaggacg

SEQ ID NO: 365425 - DNA, 25 bp, Mus musculus
tctatagcctggctcggttctctcc

SEQ ID NO: 365426 - DNA, 25 bp, Mus musculus
tctataggagctgagacccttcctg

SEQ ID NO: 365427 - DNA, 25 bp, Mus musculus
tctatagtccaggacagccagggct

SEQ ID NO: 365428 - DNA, 25 bp, Mus musculus
tctatagttcaggcatctactatga

SEQ ID NO: 365429 - DNA, 25 bp, Mus musculus
tctatataaagacactccgtggtgc

SEQ ID NO: 365430 - DNA, 25 bp, Mus musculus
tctatataggcaaaggtgatttatc

SEQ ID NO: 365431 - DNA, 25 bp, Mus musculus
tctatataggcaattcaacttgatt

SEQ ID NO: 365432 - DNA, 25 bp, Mus musculus
tctatataggcaattgggtccccat

SEQ ID NO: 365433 - DNA, 25 bp, Mus musculus
tctatatcaccaaagctgaaagggg

SEQ ID NO: 365434 - DNA, 25 bp, Mus musculus
tctatatcaccaaagtcctgaaggg

SEQ ID NO: 365435 - DNA, 25 bp, Mus musculus
tctatatcccttgcattccatattg

SEQ ID NO: 365436 - DNA, 25 bp, Mus musculus
tctatatcgtccaggtatttgataa

SEQ ID NO: 365437 - DNA, 25 bp, Mus musculus
tctatatgacagactccattagcag

SEQ ID NO: 365438 - DNA, 25 bp, Mus musculus
tctatatgacagggcttctggtgta

SEQ ID NO: 365439 - DNA, 25 bp, Mus musculus
tctatattactcaacaacatccccg

SEQ ID NO: 365440 - DNA, 25 bp, Mus musculus
tctatattggaaggtcctcagaatg

SEQ ID NO: 365441 - DNA, 25 bp, Mus musculus
tctatcaaaggtgatttcaatctca

SEQ ID NO: 365442 - DNA, 25 bp, Mus musculus
tctatcaaaggttgccgaggctggt

SEQ ID NO: 365443 - DNA, 25 bp, Mus musculus
tctatcaatcaatctatctacctat

SEQ ID NO: 365444 - DNA, 25 bp, Mus musculus
tctatcacaaaagctgcatagactc

SEQ ID NO: 365445 - DNA, 25 bp, Mus musculus
tctatcacagagctgtttggatttg

SEQ ID NO: 365446 - DNA, 25 bp, Mus musculus
tctatcacaggccaaaacaacttca

SEQ ID NO: 365447 - DNA, 25 bp, Mus musculus
tctatcacatagatgagaattctcc

SEQ ID NO: 365448 - DNA, 25 bp, Mus musculus
tctatcacatatacgcagtactccg

SEQ ID NO: 365449 - DNA, 25 bp, Mus musculus
tctatcagaaactccaggaccagga

SEQ ID NO: 365450 - DNA, 25 bp, Mus musculus
tctatccaagcaggctgtcgcttac

SEQ ID NO: 365451 - DNA, 25 bp, Mus musculus
tctatccaagggaaggaaaatacaa

SEQ ID NO: 365452 - DNA, 25 bp, Mus musculus
tctatccagaacagggcgtgcctag

SEQ ID NO: 365453 - DNA, 25 bp, Mus musculus
tctatccagaacaggtgaccttgga

SEQ ID NO: 365454 - DNA, 25 bp, Mus musculus
tctatcccacagatggtatggtgta

SEQ ID NO: 365455 - DNA, 25 bp, Mus musculus
tctatcccagaaaggatgaggccat

SEQ ID NO: 365456 - DNA, 25 bp, Mus musculus
tctatccccaaacaggagacttaat

SEQ ID NO: 365457 - DNA, 25 bp, Mus musculus
tctatccctcttggaggaaccacaa

SEQ ID NO: 365458 - DNA, 25 bp, Mus musculus
tctatccgccccagaccctgttaga

SEQ ID NO: 365459 - DNA, 25 bp, Mus musculus
tctatcctgaagtgattttcctcgc

SEQ ID NO: 365460 - DNA, 25 bp, Mus musculus
tctatcgaaaatgagcaactggtgg

SEQ ID NO: 365461 - DNA, 25 bp, Mus musculus
tctatcgagtacgaagtgggctaaa

SEQ ID NO: 365462 - DNA, 25 bp, Mus musculus
tctatcggcatggtttgctaggtat

SEQ ID NO: 365463 - DNA, 25 bp, Mus musculus
tctatctatcatctatctacctatc

SEQ ID NO: 365464 - DNA, 25 bp, Mus musculus
tctatctatctatcatctatctacc

SEQ ID NO: 365465 - DNA, 25 bp, Mus musculus
tctatctatgaatttggaaatactg

SEQ ID NO: 365466 - DNA, 25 bp, Mus musculus
tctatctcaaagcaagccccgccca

SEQ ID NO: 365467 - DNA, 25 bp, Mus musculus
tctatctcaccagttgtgtgaatta

SEQ ID NO: 365468 - DNA, 25 bp, Mus musculus
tctatctcctccagcggcagtacat

SEQ ID NO: 365469 - DNA, 25 bp, Mus musculus
tctatctcgcagaggagttagcgac

SEQ ID NO: 365470 - DNA, 25 bp, Mus musculus
tctatctgaaggccctgtccacgga

SEQ ID NO: 365471 - DNA, 25 bp, Mus musculus
tctatctgagaaaacaggtcttaat

SEQ ID NO: 365472 - DNA, 25 bp, Mus musculus
tctatctgagatgccttattggagg

SEQ ID NO: 365473 - DNA, 25 bp, Mus musculus
tctatctgccagcagaatggcattg

SEQ ID NO: 365474 - DNA, 25 bp, Mus musculus
tctatctgtgcatgggccagcgtga

SEQ ID NO: 365475 - DNA, 25 bp, Mus musculus
tctatcttctccaagttgctgcaat

SEQ ID NO: 365476 - DNA, 25 bp, Mus musculus
tctatctttttgagttgtgtaaaaa

SEQ ID NO: 365477 - DNA, 25 bp, Mus musculus
tctatgaaaaactgatgagccctga

SEQ ID NO: 365478 - DNA, 25 bp, Mus musculus
tctatgaaaagtctgtcagtttgtc

SEQ ID NO: 365479 - DNA, 25 bp, Mus musculus
tctatgaacaccagaagcctaagag

SEQ ID NO: 365480 - DNA, 25 bp, Mus musculus
tctatgaacaccaggtttggacgtc

SEQ ID NO: 365481 - DNA, 25 bp, Mus musculus
tctatgaatgcactgacactgaaga

SEQ ID NO: 365482 - DNA, 25 bp, Mus musculus
tctatgaccctcagaaaaaagtggt

SEQ ID NO: 365483 - DNA, 25 bp, Mus musculus
tctatgaccgcctggtctacgtgat

SEQ ID NO: 365484 - DNA, 25 bp, Mus musculus
tctatgacgtgaccctggaagacat

SEQ ID NO: 365485 - DNA, 25 bp, Mus musculus
tctatgagaaagtccctccaggagg

SEQ ID NO: 365486 - DNA, 25 bp, Mus musculus
tctatgagaatagagcacagtcaga

SEQ ID NO: 365487 - DNA, 25 bp, Mus musculus
tctatgagagaatatcaaagaatat

SEQ ID NO: 365488 - DNA, 25 bp, Mus musculus
tctatgagatcaaccgtgaccattt

SEQ ID NO: 365489 - DNA, 25 bp, Mus musculus
tctatgagatcaacggtgaccattt

SEQ ID NO: 365490 - DNA, 25 bp, Mus musculus
tctatgaggaatgagtggccttgtg

SEQ ID NO: 365491 - DNA, 25 bp, Mus musculus
tctatgaggactgtgagtgttccca

SEQ ID NO: 365492 - DNA, 25 bp, Mus musculus
tctatgagggaaattgacttctata

SEQ ID NO: 365493 - DNA, 25 bp, Mus musculus
tctatgagtagtgggatgagagtca

SEQ ID NO: 365494 - DNA, 25 bp, Mus musculus
tctatgataaggtacaaaatgaagc

SEQ ID NO: 365495 - DNA, 25 bp, Mus musculus
tctatgatcccagagctggtttggc

SEQ ID NO: 365496 - DNA, 25 bp, Mus musculus
tctatgcaaaacgtataaatcctcg

SEQ ID NO: 365497 - DNA, 25 bp, Mus musculus
tctatgcaaaactgcttcaccgata

SEQ ID NO: 365498 - DNA, 25 bp, Mus musculus
tctatgcatccaagaaggatcctgt

SEQ ID NO: 365499 - DNA, 25 bp, Mus musculus
tctatgcatccaaggctgtcggcga

SEQ ID NO: 365500 - DNA, 25 bp, Mus musculus
tctatgccagacttggaggtaacat

SEQ ID NO: 365501 - DNA, 25 bp, Mus musculus
tctatgccatgaagcagaagggact

SEQ ID NO: 365502 - DNA, 25 bp, Mus musculus
tctatgccgtggacaacaattacga

SEQ ID NO: 365503 - DNA, 25 bp, Mus musculus
tctatgccgtggatgaacggggtaa

SEQ ID NO: 365504 - DNA, 25 bp, Mus musculus
tctatgctaataacatgtacctgaa

SEQ ID NO: 365505 - DNA, 25 bp, Mus musculus
tctatgctaccctaggaaggagtat

SEQ ID NO: 365506 - DNA, 25 bp, Mus musculus
tctatgctaggtattctctgaaaag

SEQ ID NO: 365507 - DNA, 25 bp, Mus musculus
tctatgctccctggtgcagcatgtg

SEQ ID NO: 365508 - DNA, 25 bp, Mus musculus
tctatgctccctttcccaggtggta

SEQ ID NO: 365509 - DNA, 25 bp, Mus musculus
tctatgctccggggagaaaaatgta

SEQ ID NO: 365510 - DNA, 25 bp, Mus musculus
tctatgctgggacggccttctctga

SEQ ID NO: 365511 - DNA, 25 bp, Mus musculus
tctatgctgtggtttgccactagct

SEQ ID NO: 365512 - DNA, 25 bp, Mus musculus
tctatgcttcagatggagtggatgg

SEQ ID NO: 365513 - DNA, 25 bp, Mus musculus
tctatgcttcagcccctggtcataa

SEQ ID NO: 365514 - DNA, 25 bp, Mus musculus
tctatgcttccggcatcgtgttgga

SEQ ID NO: 365515 - DNA, 25 bp, Mus musculus
tctatggaagaaggatattacaaat

SEQ ID NO: 365516 - DNA, 25 bp, Mus musculus
tctatggaagaggaatcttcaaagt

SEQ ID NO: 365517 - DNA, 25 bp, Mus musculus
tctatggaccgccaggcactgggaa

SEQ ID NO: 365518 - DNA, 25 bp, Mus musculus
tctatggagagagtgctgaggctgt

SEQ ID NO: 365519 - DNA, 25 bp, Mus musculus
tctatggaggaagaagacagcatga

SEQ ID NO: 365520 - DNA, 25 bp, Mus musculus
tctatggcagtcctgacttcctggg

SEQ ID NO: 365521 - DNA, 25 bp, Mus musculus
tctatggcatatcagccatggacgg

SEQ ID NO: 365522 - DNA, 25 bp, Mus musculus
tctatggccctaaaggggttggtgc

SEQ ID NO: 365523 - DNA, 25 bp, Mus musculus
tctatggcggaacctaaggaaggta

SEQ ID NO: 365524 - DNA, 25 bp, Mus musculus
tctatggcggatcctgtctctacag

SEQ ID NO: 365525 - DNA, 25 bp, Mus musculus
tctatggctcccttcttctcatggg

SEQ ID NO: 365526 - DNA, 25 bp, Mus musculus
tctatgggcatgctagcaaaaaagt

SEQ ID NO: 365527 - DNA, 25 bp, Mus musculus
tctatgggcatggcatcgtcttcag

SEQ ID NO: 365528 - DNA, 25 bp, Mus musculus
tctatgggctagagcaagccccgcc

SEQ ID NO: 365529 - DNA, 25 bp, Mus musculus
tctatggggagacaccagaggcatg

SEQ ID NO: 365530 - DNA, 25 bp, Mus musculus
tctatgggtcgcgggtctactctgt

SEQ ID NO: 365531 - DNA, 25 bp, Mus musculus
tctatgggtcggttccgggagcgca

SEQ ID NO: 365532 - DNA, 25 bp, Mus musculus
tctatgtactacaatggcattggag

SEQ ID NO: 365533 - DNA, 25 bp, Mus musculus
tctatgtactcaggatatgctgtca

SEQ ID NO: 365534 - DNA, 25 bp, Mus musculus
tctatgtactcagggggaaaatgct

SEQ ID NO: 365535 - DNA, 25 bp, Mus musculus
tctatgtcagacagggaacaacact

SEQ ID NO: 365536 - DNA, 25 bp, Mus musculus
tctatgtcagtgaggttcctgctgc

SEQ ID NO: 365537 - DNA, 25 bp, Mus musculus
tctatgtcatggtggggttttttgg

SEQ ID NO: 365538 - DNA, 25 bp, Mus musculus
tctatgtgagcaactgggacaaata

SEQ ID NO: 365539 - DNA, 25 bp, Mus musculus
tctatgtgaggaaaaacgggatctg

SEQ ID NO: 365540 - DNA, 25 bp, Mus musculus
tctatgtgccagctgcaacggaaga

SEQ ID NO: 365541 - DNA, 25 bp, Mus musculus
tctatgtgccaggctgcccgcccac

SEQ ID NO: 365542 - DNA, 25 bp, Mus musculus
tctatgtggaaaggaaaatagaaat

SEQ ID NO: 365543 - DNA, 25 bp, Mus musculus
tctatgtggcttagcagatcatcag

SEQ ID NO: 365544 - DNA, 25 bp, Mus musculus
tctattaaaagatgacttacagggt

SEQ ID NO: 365545 - DNA, 25 bp, Mus musculus
tctattaaaagccccagaccctccc

SEQ ID NO: 365546 - DNA, 25 bp, Mus musculus
tctattaaaagctcttttggaagaa

SEQ ID NO: 365547 - DNA, 25 bp, Mus musculus
tctattaaaaggtcaccaccatagc

SEQ ID NO: 365548 - DNA, 25 bp, Mus musculus
tctattaacacagatgctgctcaga

SEQ ID NO: 365549 - DNA, 25 bp, Mus musculus
tctattaacacagcacggtgcaaca

SEQ ID NO: 365550 - DNA, 25 bp, Mus musculus
tctattaacacaggatcacactatg

SEQ ID NO: 365551 - DNA, 25 bp, Mus musculus
tctattaacagcttcgaccttgcct

SEQ ID NO: 365552 - DNA, 25 bp, Mus musculus
tctattacaggtgaatacattgtta

SEQ ID NO: 365553 - DNA, 25 bp, Mus musculus
tctattacccaggggaccccagctc

SEQ ID NO: 365554 - DNA, 25 bp, Mus musculus
tctattatgtagatgtgcagaaatt

SEQ ID NO: 365555 - DNA, 25 bp, Mus musculus
tctattattggtactggcggaggac

SEQ ID NO: 365556 - DNA, 25 bp, Mus musculus
tctattcctgaataaacactgaatt

SEQ ID NO: 365557 - DNA, 25 bp, Mus musculus
tctattcgtaatgatttcattatga

SEQ ID NO: 365558 - DNA, 25 bp, Mus musculus
tctattctgaagtagcttgccacaa

SEQ ID NO: 365559 - DNA, 25 bp, Mus musculus
tctattctgactggagccctttcag

SEQ ID NO: 365560 - DNA, 25 bp, Mus musculus
tctattcttgacggacttaaaagga

SEQ ID NO: 365561 - DNA, 25 bp, Mus musculus
tctattgagataaaagccagagtta

SEQ ID NO: 365562 - DNA, 25 bp, Mus musculus
tctattgataaggctgcctttgata

SEQ ID NO: 365563 - DNA, 25 bp, Mus musculus
tctattgataaggtaacaagccgat

SEQ ID NO: 365564 - DNA, 25 bp, Mus musculus
tctattgattagtacaaacaggcca

SEQ ID NO: 365565 - DNA, 25 bp, Mus musculus
tctattgcagagttacccctggact

SEQ ID NO: 365566 - DNA, 25 bp, Mus musculus
tctattgcagcagtgtcagacacaa

SEQ ID NO: 365567 - DNA, 25 bp, Mus musculus
tctattgggtaatgggccaattcaa

SEQ ID NO: 365568 - DNA, 25 bp, Mus musculus
tctatttaagaagagaaggtggctg

SEQ ID NO: 365569 - DNA, 25 bp, Mus musculus
tctatttaagaagatgaaaccagat

SEQ ID NO: 365570 - DNA, 25 bp, Mus musculus
tctatttcaggactcagtggctttt

SEQ ID NO: 365571 - DNA, 25 bp, Mus musculus
tctatttcctagagctgtttgacaa

SEQ ID NO: 365572 - DNA, 25 bp, Mus musculus
tctatttctgggttctgccagaatc

SEQ ID NO: 365573 - DNA, 25 bp, Mus musculus
tctatttgatgcactagctgaaaaa

SEQ ID NO: 365574 - DNA, 25 bp, Mus musculus
tctatttgatgttcatgcagaagaa

SEQ ID NO: 365575 - DNA, 25 bp, Mus musculus
tctattttcaggatgtcagtggggg

SEQ ID NO: 365576 - DNA, 25 bp, Mus musculus
tctattttcaggggtttcgtgttga

SEQ ID NO: 365577 - DNA, 25 bp, Mus musculus
tctattttgagagactgcctttagc

SEQ ID NO: 365578 - DNA, 25 bp, Mus musculus
tctattttgaggttgagcacatcac

SEQ ID NO: 365579 - DNA, 25 bp, Mus musculus
tctcaaaaaacacagctgcctgcct

SEQ ID NO: 365580 - DNA, 25 bp, Mus musculus
tctcaaaacagatctgtctgattta

SEQ ID NO: 365581 - DNA, 25 bp, Mus musculus
tctcaaaaccagggatactgggaac

SEQ ID NO: 365582 - DNA, 25 bp, Mus musculus
tctcaaaacccaaaggaagagccca

SEQ ID NO: 365583 - DNA, 25 bp, Mus musculus
tctcaaaacccagagggccagtaag

SEQ ID NO: 365584 - DNA, 25 bp, Mus musculus
tctcaaaacctgacaagacatttca

SEQ ID NO: 365585 - DNA, 25 bp, Mus musculus
tctcaaaactggcttggagtcaaaa

SEQ ID NO: 365586 - DNA, 25 bp, Mus musculus
tctcaaaactgggattattggccca

SEQ ID NO: 365587 - DNA, 25 bp, Mus musculus
tctcaaaatgagccccggcagccca

SEQ ID NO: 365588 - DNA, 25 bp, Mus musculus
tctcaaaattcaattgctgatagcc

SEQ ID NO: 365589 - DNA, 25 bp, Mus musculus
tctcaaaattcaatttctgttgccc

SEQ ID NO: 365590 - DNA, 25 bp, Mus musculus
tctcaaacaaagcatcgctgataga

SEQ ID NO: 365591 - DNA, 25 bp, Mus musculus
tctcaaacaaagcatctatccagcc

SEQ ID NO: 365592 - DNA, 25 bp, Mus musculus
tctcaaacaataggtgaccagtgtg

SEQ ID NO: 365593 - DNA, 25 bp, Mus musculus
tctcaaacacaaagtgctgcagtcg

SEQ ID NO: 365594 - DNA, 25 bp, Mus musculus
tctcaaaccaacagtatcacatctg

SEQ ID NO: 365595 - DNA, 25 bp, Mus musculus
tctcaaaccaacagttccctgccgc

SEQ ID NO: 365596 - DNA, 25 bp, Mus musculus
tctcaaaccaacattcagcaggact

SEQ ID NO: 365597 - DNA, 25 bp, Mus musculus
tctcaaaccacgcggagtgtccttt

SEQ ID NO: 365598 - DNA, 25 bp, Mus musculus
tctcaaaccacgtgacctcttggtt

SEQ ID NO: 365599 - DNA, 25 bp, Mus musculus
tctcaaactcctgccctgcataagg

SEQ ID NO: 365600 - DNA, 25 bp, Mus musculus
tctcaaagcagcaggagcagacccc

SEQ ID NO: 365601 - DNA, 25 bp, Mus musculus
tctcaaagccaaactgcagatgaca

SEQ ID NO: 365602 - DNA, 25 bp, Mus musculus
tctcaaagcccaggagaagcgcccc

SEQ ID NO: 365603 - DNA, 25 bp, Mus musculus
tctcaaagcccaggtcaaactctgg

SEQ ID NO: 365604 - DNA, 25 bp, Mus musculus
tctcaaagcgcaaatttcccagctg

SEQ ID NO: 365605 - DNA, 25 bp, Mus musculus
tctcaaagtcaagctgaacagggcc

SEQ ID NO: 365606 - DNA, 25 bp, Mus musculus
tctcaaattaaatccaagttaatcc

SEQ ID NO: 365607 - DNA, 25 bp, Mus musculus
tctcaacaaaagggctctactacat

SEQ ID NO: 365608 - DNA, 25 bp, Mus musculus
tctcaacaacctgagattcatattt

SEQ ID NO: 365609 - DNA, 25 bp, Mus musculus
tctcaacaaggcacggcagctcttt

SEQ ID NO: 365610 - DNA, 25 bp, Mus musculus
tctcaacagaacaggatttgtgcag

SEQ ID NO: 365611 - DNA, 25 bp, Mus musculus
tctcaacagaacagtgctcttggct

SEQ ID NO: 365612 - DNA, 25 bp, Mus musculus
tctcaacagccatctgcaatggctg

SEQ ID NO: 365613 - DNA, 25 bp, Mus musculus
tctcaacatggaaaagtataacttc

SEQ ID NO: 365614 - DNA, 25 bp, Mus musculus
tctcaaccacaagcaacgatgccta

SEQ ID NO: 365615 - DNA, 25 bp, Mus musculus
tctcaaccaggatgcgtacactgca

SEQ ID NO: 365616 - DNA, 25 bp, Mus musculus
tctcaaccctcgtctcttctgtcgg

SEQ ID NO: 365617 - DNA, 25 bp, Mus musculus
tctcaacctagcagaagcgctcctg

SEQ ID NO: 365618 - DNA, 25 bp, Mus musculus
tctcaacctctcttcaggcccagag

SEQ ID NO: 365619 - DNA, 25 bp, Mus musculus
tctcaacctgccagatgcagagaag

SEQ ID NO: 365620 - DNA, 25 bp, Mus musculus
tctcaacctgccaggatatgctctc

SEQ ID NO: 365621 - DNA, 25 bp, Mus musculus
tctcaactcagtttgacccattgat

SEQ ID NO: 365622 - DNA, 25 bp, Mus musculus
tctcaactccatggtcagcaacatc

SEQ ID NO: 365623 - DNA, 25 bp, Mus musculus
tctcaactctttcgatatgtcttgt

SEQ ID NO: 365624 - DNA, 25 bp, Mus musculus
tctcaactctttcgtctccttttac

SEQ ID NO: 365625 - DNA, 25 bp, Mus musculus
tctcaactgcaagatggccactgag

SEQ ID NO: 365626 - DNA, 25 bp, Mus musculus
tctcaactgcaagattgcccagctg

SEQ ID NO: 365627 - DNA, 25 bp, Mus musculus
tctcaactggctatggctcctgggc

SEQ ID NO: 365628 - DNA, 25 bp, Mus musculus
tctcaactggctgatgcttgacttc

SEQ ID NO: 365629 - DNA, 25 bp, Mus musculus
tctcaacttgaggccatccgctgca

SEQ ID NO: 365630 - DNA, 25 bp, Mus musculus
tctcaacttgagtcagaagaggcag

SEQ ID NO: 365631 - DNA, 25 bp, Mus musculus
tctcaagaaagatgcgccaggagga

SEQ ID NO: 365632 - DNA, 25 bp, Mus musculus
tctcaagaaaggacagatcgttacg

SEQ ID NO: 365633 - DNA, 25 bp, Mus musculus
tctcaagaaaggatggatgatccat

SEQ ID NO: 365634 - DNA, 25 bp, Mus musculus
tctcaagaatatgttgttgatcaca

SEQ ID NO: 365635 - DNA, 25 bp, Mus musculus
tctcaagaattaggtaagtggagaa

SEQ ID NO: 365636 - DNA, 25 bp, Mus musculus
tctcaagcaagttgataatgaagag

SEQ ID NO: 365637 - DNA, 25 bp, Mus musculus
tctcaagcagatttcggaggcactg

SEQ ID NO: 365638 - DNA, 25 bp, Mus musculus
tctcaagcagggtactggtctcttt

SEQ ID NO: 365639 - DNA, 25 bp, Mus musculus
tctcaagcaggtggcccacgcgctg

SEQ ID NO: 365640 - DNA, 25 bp, Mus musculus
tctcaagcatgacttaacctgtgtg

SEQ ID NO: 365641 - DNA, 25 bp, Mus musculus
tctcaagcctgcggacttgactgcg

SEQ ID NO: 365642 - DNA, 25 bp, Mus musculus
tctcaagcctgcggggacttgactg

SEQ ID NO: 365643 - DNA, 25 bp, Mus musculus
tctcaaggagtcagagcaacccagt

SEQ ID NO: 365644 - DNA, 25 bp, Mus musculus
tctcaaggcaggttgtaaaagttaa

SEQ ID NO: 365645 - DNA, 25 bp, Mus musculus
tctcaaggcggggacgatccggagc

SEQ ID NO: 365646 - DNA, 25 bp, Mus musculus
tctcaagtaccggcagtcctttact

SEQ ID NO: 365647 - DNA, 25 bp, Mus musculus
tctcaagtcaaagaaatggcctcca

SEQ ID NO: 365648 - DNA, 25 bp, Mus musculus
tctcaatacccaaagatctttataa

SEQ ID NO: 365649 - DNA, 25 bp, Mus musculus
tctcaatccactttgtcaagtggat

SEQ ID NO: 365650 - DNA, 25 bp, Mus musculus
tctcaatgcctcagcttcggtagcc

SEQ ID NO: 365651 - DNA, 25 bp, Mus musculus
tctcaattagttgacattaaaaagc

SEQ ID NO: 365652 - DNA, 25 bp, Mus musculus
tctcaatttcaagtcagaagacatg

SEQ ID NO: 365653 - DNA, 25 bp, Mus musculus
tctcacaatgccatcaggtttgggc

SEQ ID NO: 365654 - DNA, 25 bp, Mus musculus
tctcacaatgctctgtcagaaacga

SEQ ID NO: 365655 - DNA, 25 bp, Mus musculus
tctcacaatggagatcagaaccagg

SEQ ID NO: 365656 - DNA, 25 bp, Mus musculus
tctcacaatggaggaagaacgagcc

SEQ ID NO: 365657 - DNA, 25 bp, Mus musculus
tctcacaatgtgtcctactgaaacc

SEQ ID NO: 365658 - DNA, 25 bp, Mus musculus
tctcacaattttacgcagatagagc

SEQ ID NO: 365659 - DNA, 25 bp, Mus musculus
tctcacaattttctggactgaaggg

SEQ ID NO: 365660 - DNA, 25 bp, Mus musculus
tctcacacacagctttcttctgcag

SEQ ID NO: 365661 - DNA, 25 bp, Mus musculus
tctcacacacaggacacagaagacc

SEQ ID NO: 365662 - DNA, 25 bp, Mus musculus
tctcacactcaggggacaattcaag

SEQ ID NO: 365663 - DNA, 25 bp, Mus musculus
tctcacagagatgaggcttgagcct

SEQ ID NO: 365664 - DNA, 25 bp, Mus musculus
tctcacagagtgttctccatggccc

SEQ ID NO: 365665 - DNA, 25 bp, Mus musculus
tctcacagtgatagaatgcctgaat

SEQ ID NO: 365666 - DNA, 25 bp, Mus musculus
tctcacagtgatgagaattttaaat

SEQ ID NO: 365667 - DNA, 25 bp, Mus musculus
tctcacagtggagatgaatctggct

SEQ ID NO: 365668 - DNA, 25 bp, Mus musculus
tctcacataaaggctgaaggtgaag

SEQ ID NO: 365669 - DNA, 25 bp, Mus musculus
tctcacatccagggtaaagccccaa

SEQ ID NO: 365670 - DNA, 25 bp, Mus musculus
tctcacatccaggtaaccgagaagg

SEQ ID NO: 365671 - DNA, 25 bp, Mus musculus
tctcacatggagaaactgctgtcat

SEQ ID NO: 365672 - DNA, 25 bp, Mus musculus
tctcaccaagcggacagagaagttc

SEQ ID NO: 365673 - DNA, 25 bp, Mus musculus
tctcaccaaggattacacagtgcgt

SEQ ID NO: 365674 - DNA, 25 bp, Mus musculus
tctcaccaaggctctggcctatgtg

SEQ ID NO: 365675 - DNA, 25 bp, Mus musculus
tctcaccaataaagcccacagaagc

SEQ ID NO: 365676 - DNA, 25 bp, Mus musculus
tctcaccaataaaggcaaatcctcc

SEQ ID NO: 365677 - DNA, 25 bp, Mus musculus
tctcaccaccaaggaaaagttgtat

SEQ ID NO: 365678 - DNA, 25 bp, Mus musculus
tctcaccaccaagggaacttaatac

SEQ ID NO: 365679 - DNA, 25 bp, Mus musculus
tctcaccagaaactatggtggccct

SEQ ID NO: 365680 - DNA, 25 bp, Mus musculus
tctcaccagagcaagatatggcgtg

SEQ ID NO: 365681 - DNA, 25 bp, Mus musculus
tctcaccattgttataataaagacc

SEQ ID NO: 365682 - DNA, 25 bp, Mus musculus
tctcacccaccgacctttgcacaga

SEQ ID NO: 365683 - DNA, 25 bp, Mus musculus
tctcacccagacaggcttctaaagt

SEQ ID NO: 365684 - DNA, 25 bp, Mus musculus
tctcacccagccatgcctatggagg

SEQ ID NO: 365685 - DNA, 25 bp, Mus musculus
tctcacccagccatgctatcccaat

SEQ ID NO: 365686 - DNA, 25 bp, Mus musculus
tctcacccaggagatcttcagaaca

SEQ ID NO: 365687 - DNA, 25 bp, Mus musculus
tctcacccaggagatggagttccag

SEQ ID NO: 365688 - DNA, 25 bp, Mus musculus
tctcacccaggatgagtttcatcct

SEQ ID NO: 365689 - DNA, 25 bp, Mus musculus
tctcaccccaagatgctttgtgacg

SEQ ID NO: 365690 - DNA, 25 bp, Mus musculus
tctcacccccagcccagccaagcgg

SEQ ID NO: 365691 - DNA, 25 bp, Mus musculus
tctcacccccagctccaaccctctt

SEQ ID NO: 365692 - DNA, 25 bp, Mus musculus
tctcacccgggtgctggggacattg

SEQ ID NO: 365693 - DNA, 25 bp, Mus musculus
tctcaccgacatcactcagcactca

SEQ ID NO: 365694 - DNA, 25 bp, Mus musculus
tctcaccgctcgaggtggccaggca

SEQ ID NO: 365695 - DNA, 25 bp, Mus musculus
tctcaccgctcggctctgggtgctc

SEQ ID NO: 365696 - DNA, 25 bp, Mus musculus
tctcaccgctcgggcctgtgctctc

SEQ ID NO: 365697 - DNA, 25 bp, Mus musculus
tctcaccggcaaggtgatgcttctt

SEQ ID NO: 365698 - DNA, 25 bp, Mus musculus
tctcaccggcagaggctgaaggcgg

SEQ ID NO: 365699 - DNA, 25 bp, Mus musculus
tctcacctacacccaaaaacacaga

SEQ ID NO: 365700 - DNA, 25 bp, Mus musculus
tctcacctacacccaatacaagcag

SEQ ID NO: 365701 - DNA, 25 bp, Mus musculus
tctcacctcaatgaggacaataata

SEQ ID NO: 365702 - DNA, 25 bp, Mus musculus
tctcaccttctacagaaaaccgtca

SEQ ID NO: 365703 - DNA, 25 bp, Mus musculus
tctcacgaaaagatcctgagcaagc

SEQ ID NO: 365704 - DNA, 25 bp, Mus musculus
tctcacgacaggtgatttccgattt

SEQ ID NO: 365705 - DNA, 25 bp, Mus musculus
tctcacgcaagaccctgactgcacc

SEQ ID NO: 365706 - DNA, 25 bp, Mus musculus
tctcactacggaggtgcatcctgag

SEQ ID NO: 365707 - DNA, 25 bp, Mus musculus
tctcactcaaggtggcgtgattgaa

SEQ ID NO: 365708 - DNA, 25 bp, Mus musculus
tctcactcacatagctaacccaagg

SEQ ID NO: 365709 - DNA, 25 bp, Mus musculus
tctcactcacatgtgctggagagtc

SEQ ID NO: 365710 - DNA, 25 bp, Mus musculus
tctcactcaggctcccatgtgtgaa

SEQ ID NO: 365711 - DNA, 25 bp, Mus musculus
tctcactgaaagatttgtatacatc

SEQ ID NO: 365712 - DNA, 25 bp, Mus musculus
tctcactgaccctctccccttaaaa

SEQ ID NO: 365713 - DNA, 25 bp, Mus musculus
tctcactgcagacactccactctcc

SEQ ID NO: 365714 - DNA, 25 bp, Mus musculus
tctcactgcctccaggtctggagag

SEQ ID NO: 365715 - DNA, 25 bp, Mus musculus
tctcactgtcaggaagttggtgtcc

SEQ ID NO: 365716 - DNA, 25 bp, Mus musculus
tctcacttctaggtcgtttcagctc

SEQ ID NO: 365717 - DNA, 25 bp, Mus musculus
tctcagaaaatggctcctcggtggc

SEQ ID NO: 365718 - DNA, 25 bp, Mus musculus
tctcagaagagaaatatattgagcg

SEQ ID NO: 365719 - DNA, 25 bp, Mus musculus
tctcagaagagaaattttgaaatgc

SEQ ID NO: 365720 - DNA, 25 bp, Mus musculus
tctcagaaggcaaatgtgccgagct

SEQ ID NO: 365721 - DNA, 25 bp, Mus musculus
tctcagaaggccaagttcgacagct

SEQ ID NO: 365722 - DNA, 25 bp, Mus musculus
tctcagaagtcagcggctgcgtagt

SEQ ID NO: 365723 - DNA, 25 bp, Mus musculus
tctcagaattgctagattagtggag

SEQ ID NO: 365724 - DNA, 25 bp, Mus musculus
tctcagacaaatgtcagtgagatcg

SEQ ID NO: 365725 - DNA, 25 bp, Mus musculus
tctcagacacaaaccaaatgaacac

SEQ ID NO: 365726 - DNA, 25 bp, Mus musculus
tctcagacagcaagacaaacgaggg

SEQ ID NO: 365727 - DNA, 25 bp, Mus musculus
tctcagacaggaacagaaattcttt

SEQ ID NO: 365728 - DNA, 25 bp, Mus musculus
tctcagacaggtttggtcgcaagaa

SEQ ID NO: 365729 - DNA, 25 bp, Mus musculus
tctcagagctgtggcagctcagcag

SEQ ID NO: 365730 - DNA, 25 bp, Mus musculus
tctcagaggatcacaagctgaagat

SEQ ID NO: 365731 - DNA, 25 bp, Mus musculus
tctcagaggcagaagaacctgtgct

SEQ ID NO: 365732 - DNA, 25 bp, Mus musculus
tctcagaggcagatgacctggatgg

SEQ ID NO: 365733 - DNA, 25 bp, Mus musculus
tctcagaggctgagaaaataatgtt

SEQ ID NO: 365734 - DNA, 25 bp, Mus musculus
tctcagaggctgaggacaaatgaga

SEQ ID NO: 365735 - DNA, 25 bp, Mus musculus
tctcagaggggcaggagctccgggt

SEQ ID NO: 365736 - DNA, 25 bp, Mus musculus
tctcagatctcctgagccacagcct

SEQ ID NO: 365737 - DNA, 25 bp, Mus musculus
tctcagatcttggaggactccctgc

SEQ ID NO: 365738 - DNA, 25 bp, Mus musculus
tctcagatggatgaggaagacatgg

SEQ ID NO: 365739 - DNA, 25 bp, Mus musculus
tctcagattggctatgtagtcagtg

SEQ ID NO: 365740 - DNA, 25 bp, Mus musculus
tctcagcaaaaagcctaagaaagtt

SEQ ID NO: 365741 - DNA, 25 bp, Mus musculus
tctcagcaacctcatacattaaagt

SEQ ID NO: 365742 - DNA, 25 bp, Mus musculus
tctcagcaacctcatccctggcagc

SEQ ID NO: 365743 - DNA, 25 bp, Mus musculus
tctcagcaacctcatttccctgact

SEQ ID NO: 365744 - DNA, 25 bp, Mus musculus
tctcagcaactgcaggacagtctcc

SEQ ID NO: 365745 - DNA, 25 bp, Mus musculus
tctcagcaactgcaggtggaagagc

SEQ ID NO: 365746 - DNA, 25 bp, Mus musculus
tctcagcaagatggagcgggtagtc

SEQ ID NO: 365747 - DNA, 25 bp, Mus musculus
tctcagcaaggtgatctggggaacc

SEQ ID NO: 365748 - DNA, 25 bp, Mus musculus
tctcagcacaccagaactatgccga

SEQ ID NO: 365749 - DNA, 25 bp, Mus musculus
tctcagcacacctggagcctgttat

SEQ ID NO: 365750 - DNA, 25 bp, Mus musculus
tctcagcactgtgtgtcaccgtgcc

SEQ ID NO: 365751 - DNA, 25 bp, Mus musculus
tctcagcagaggtggaaagtacgca

SEQ ID NO: 365752 - DNA, 25 bp, Mus musculus
tctcagcagatgatcctctaggcac

SEQ ID NO: 365753 - DNA, 25 bp, Mus musculus
tctcagcagatggtacctggaccct

SEQ ID NO: 365754 - DNA, 25 bp, Mus musculus
tctcagcatagaaagtcctcgcgtg

SEQ ID NO: 365755 - DNA, 25 bp, Mus musculus
tctcagcatagaagtttaccgacaa

SEQ ID NO: 365756 - DNA, 25 bp, Mus musculus
tctcagcatccctggctgagagctt

SEQ ID NO: 365757 - DNA, 25 bp, Mus musculus
tctcagcatgcaaaattctaaagat

SEQ ID NO: 365758 - DNA, 25 bp, Mus musculus
tctcagcatgcaagagactctgcag

SEQ ID NO: 365759 - DNA, 25 bp, Mus musculus
tctcagcatttgccctggttcccaa

SEQ ID NO: 365760 - DNA, 25 bp, Mus musculus
tctcagccatgatggtaacaaaaga

SEQ ID NO: 365761 - DNA, 25 bp, Mus musculus
tctcagccccagctcgtgccccctt

SEQ ID NO: 365762 - DNA, 25 bp, Mus musculus
tctcagccccagctggtgccccctt

SEQ ID NO: 365763 - DNA, 25 bp, Mus musculus
tctcagcctcgaatgggtgaagacc

SEQ ID NO: 365764 - DNA, 25 bp, Mus musculus
tctcagcgcggattaccttatgctg

SEQ ID NO: 365765 - DNA, 25 bp, Mus musculus
tctcagcgctgacaggtacagagct

SEQ ID NO: 365766 - DNA, 25 bp, Mus musculus
tctcagctcagcggaacctgcctct

SEQ ID NO: 365767 - DNA, 25 bp, Mus musculus
tctcagctcagcggtcacacagcaa

SEQ ID NO: 365768 - DNA, 25 bp, Mus musculus
tctcagctgcctttggcaacctcct

SEQ ID NO: 365769 - DNA, 25 bp, Mus musculus
tctcagctggacaaaccatctttct

SEQ ID NO: 365770 - DNA, 25 bp, Mus musculus
tctcagctgggtactctcaagttca

SEQ ID NO: 365771 - DNA, 25 bp, Mus musculus
tctcagcttctcatgctcatctttc

SEQ ID NO: 365772 - DNA, 25 bp, Mus musculus
tctcagcttctcatgtgcaggctga

SEQ ID NO: 365773 - DNA, 25 bp, Mus musculus
tctcagctttatcaggtccacagag

SEQ ID NO: 365774 - DNA, 25 bp, Mus musculus
tctcaggaaaggtaaacctagcctt

SEQ ID NO: 365775 - DNA, 25 bp, Mus musculus
tctcaggaagtgcttctgtttcctg

SEQ ID NO: 365776 - DNA, 25 bp, Mus musculus
tctcaggacagcatcccagccttta

SEQ ID NO: 365777 - DNA, 25 bp, Mus musculus
tctcaggaccaggtagattccataa

SEQ ID NO: 365778 - DNA, 25 bp, Mus musculus
tctcaggacggagatgaacatctgc

SEQ ID NO: 365779 - DNA, 25 bp, Mus musculus
tctcaggagagaggtacaaagaaga

SEQ ID NO: 365780 - DNA, 25 bp, Mus musculus
tctcaggatcaccaggtgctcgagg

SEQ ID NO: 365781 - DNA, 25 bp, Mus musculus
tctcaggattggaagatcgaagcct

SEQ ID NO: 365782 - DNA, 25 bp, Mus musculus
tctcaggcaccaggttcctccaaca

SEQ ID NO: 365783 - DNA, 25 bp, Mus musculus
tctcaggccgcctctagacgtcctc

SEQ ID NO: 365784 - DNA, 25 bp, Mus musculus
tctcaggccgggttcgagtgagcca

SEQ ID NO: 365785 - DNA, 25 bp, Mus musculus
tctcaggccggtgacgctgactgcg

SEQ ID NO: 365786 - DNA, 25 bp, Mus musculus
tctcaggctctgggagttggaaccc

SEQ ID NO: 365787 - DNA, 25 bp, Mus musculus
tctcaggctgtcagaaaaagatgca

SEQ ID NO: 365788 - DNA, 25 bp, Mus musculus
tctcaggctgtcagtctagtctcct

SEQ ID NO: 365789 - DNA, 25 bp, Mus musculus
tctcaggctgtgagatatctgtttc

SEQ ID NO: 365790 - DNA, 25 bp, Mus musculus
tctcaggcttcaggaagtgtgccat

SEQ ID NO: 365791 - DNA, 25 bp, Mus musculus
tctcagggaaaagcacagagctgat

SEQ ID NO: 365792 - DNA, 25 bp, Mus musculus
tctcagggaaaaggaacaccatgga

SEQ ID NO: 365793 - DNA, 25 bp, Mus musculus
tctcagggtcttcctggtgcagtgg

SEQ ID NO: 365794 - DNA, 25 bp, Mus musculus
tctcaggtcccagagaccagagggt

SEQ ID NO: 365795 - DNA, 25 bp, Mus musculus
tctcaggtcccaggctgtgtcccac

SEQ ID NO: 365796 - DNA, 25 bp, Mus musculus
tctcaggttgttcctcaatgtctgc

SEQ ID NO: 365797 - DNA, 25 bp, Mus musculus
tctcaggttttggctaccggctctc

SEQ ID NO: 365798 - DNA, 25 bp, Mus musculus
tctcagtcaggagagaattcagagc

SEQ ID NO: 365799 - DNA, 25 bp, Mus musculus
tctcagtcagggtgacaagggagat

SEQ ID NO: 365800 - DNA, 25 bp, Mus musculus
tctcagtcaggtaccaagcgccttg

SEQ ID NO: 365801 - DNA, 25 bp, Mus musculus
tctcagtcaggtcgcagacatttta

SEQ ID NO: 365802 - DNA, 25 bp, Mus musculus
tctcagtcaggtttggacgtcatga

SEQ ID NO: 365803 - DNA, 25 bp, Mus musculus
tctcagtcatgagaacacaaattga

SEQ ID NO: 365804 - DNA, 25 bp, Mus musculus
tctcagtccattaggctcttctgcg

SEQ ID NO: 365805 - DNA, 25 bp, Mus musculus
tctcagtcgaaaggcaagaagcgaa

SEQ ID NO: 365806 - DNA, 25 bp, Mus musculus
tctcagtctgaaaggctccagatac

SEQ ID NO: 365807 - DNA, 25 bp, Mus musculus
tctcagtgaaaggtaaaccagatgt

SEQ ID NO: 365808 - DNA, 25 bp, Mus musculus
tctcagtgaagagtcacatactcac

SEQ ID NO: 365809 - DNA, 25 bp, Mus musculus
tctcagtgcaagacagtattggaga

SEQ ID NO: 365810 - DNA, 25 bp, Mus musculus
tctcagtgcaagtcatggggaccct

SEQ ID NO: 365811 - DNA, 25 bp, Mus musculus
tctcagtgcaatggatcagttggag

SEQ ID NO: 365812 - DNA, 25 bp, Mus musculus
tctcagtgcaatggcttccatacga

SEQ ID NO: 365813 - DNA, 25 bp, Mus musculus
tctcagtgctgatgcagatgcgctt

SEQ ID NO: 365814 - DNA, 25 bp, Mus musculus
tctcagtgctgatgcgcttcgacgg

SEQ ID NO: 365815 - DNA, 25 bp, Mus musculus
tctcagtgctgggttttcagagcac

SEQ ID NO: 365816 - DNA, 25 bp, Mus musculus
tctcagtggccccagggcccggagt

SEQ ID NO: 365817 - DNA, 25 bp, Mus musculus
tctcagtgtaacccagtgtggtgaa

SEQ ID NO: 365818 - DNA, 25 bp, Mus musculus
tctcagttaaaaaacaaggtgagac

SEQ ID NO: 365819 - DNA, 25 bp, Mus musculus
tctcagttcagcgtcgccaacagga

SEQ ID NO: 365820 - DNA, 25 bp, Mus musculus
tctcagtttctcagaatcccctggt

SEQ ID NO: 365821 - DNA, 25 bp, Mus musculus
tctcagttttcgcatcaaggtgtaa

SEQ ID NO: 365822 - DNA, 25 bp, Mus musculus
tctcataaaaatggatgagacatca

SEQ ID NO: 365823 - DNA, 25 bp, Mus musculus
tctcataaaattcccatggctcttt

SEQ ID NO: 365824 - DNA, 25 bp, Mus musculus
tctcataaagccctttctgacatgg

SEQ ID NO: 365825 - DNA, 25 bp, Mus musculus
tctcataaataaggtgcgagaagat

SEQ ID NO: 365826 - DNA, 25 bp, Mus musculus
tctcataaataaggttgtgcatttt

SEQ ID NO: 365827 - DNA, 25 bp, Mus musculus
tctcataagtaaaggagaggagcca

SEQ ID NO: 365828 - DNA, 25 bp, Mus musculus
tctcatacaggtgagaaaccttttg

SEQ ID NO: 365829 - DNA, 25 bp, Mus musculus
tctcatactgcaggcagagaggtgg

SEQ ID NO: 365830 - DNA, 25 bp, Mus musculus
tctcatactgcagtctggacagagg

SEQ ID NO: 365831 - DNA, 25 bp, Mus musculus
tctcatagccagggttcagccgact

SEQ ID NO: 365832 - DNA, 25 bp, Mus musculus
tctcatagctgtctggtttgtggac

SEQ ID NO: 365833 - DNA, 25 bp, Mus musculus
tctcatcaagaccctgaagacagct

SEQ ID NO: 365834 - DNA, 25 bp, Mus musculus
tctcatcaaggcacataccatgtta

SEQ ID NO: 365835 - DNA, 25 bp, Mus musculus
tctcatcaataaggactgcatcgac

SEQ ID NO: 365836 - DNA, 25 bp, Mus musculus
tctcatcaatgcaggaaaggaaaca

SEQ ID NO: 365837 - DNA, 25 bp, Mus musculus
tctcatcaatgccaaccgtcctggg

SEQ ID NO: 365838 - DNA, 25 bp, Mus musculus
tctcatcaatgccagtcccatccca

SEQ ID NO: 365839 - DNA, 25 bp, Mus musculus
tctcatcacagccaggaagtcacct

SEQ ID NO: 365840 - DNA, 25 bp, Mus musculus
tctcatcacaggagcatctcaatgg

SEQ ID NO: 365841 - DNA, 25 bp, Mus musculus
tctcatcacctctggaacttagccc

SEQ ID NO: 365842 - DNA, 25 bp, Mus musculus
tctcatcatagatatcacaaccacc

SEQ ID NO: 365843 - DNA, 25 bp, Mus musculus
tctcatcatagatgacttccatagt

SEQ ID NO: 365844 - DNA, 25 bp, Mus musculus
tctcatccaaagcctttatccatca

SEQ ID NO: 365845 - DNA, 25 bp, Mus musculus
tctcatccctagcagaacatcatga

SEQ ID NO: 365846 - DNA, 25 bp, Mus musculus
tctcatccctgctcctgtctccaat

SEQ ID NO: 365847 - DNA, 25 bp, Mus musculus
tctcatccgctgagacccatgcgga

SEQ ID NO: 365848 - DNA, 25 bp, Mus musculus
tctcatccgctgagatgctggtgga

SEQ ID NO: 365849 - DNA, 25 bp, Mus musculus
tctcatccttgcatgatatggcata

SEQ ID NO: 365850 - DNA, 25 bp, Mus musculus
tctcatctacttccccctttcccac

SEQ ID NO: 365851 - DNA, 25 bp, Mus musculus
tctcatctccgacttcttcgccaag

SEQ ID NO: 365852 - DNA, 25 bp, Mus musculus
tctcatcttgagaacccagcagtga

SEQ ID NO: 365853 - DNA, 25 bp, Mus musculus
tctcatgaagccattgatcttatca

SEQ ID NO: 365854 - DNA, 25 bp, Mus musculus
tctcatgagtctggcgaacactctg

SEQ ID NO: 365855 - DNA, 25 bp, Mus musculus
tctcatgatgacaggtttctactgc

SEQ ID NO: 365856 - DNA, 25 bp, Mus musculus
tctcatgcagatcccagtcaagtat

SEQ ID NO: 365857 - DNA, 25 bp, Mus musculus
tctcatgcagttcccagtcaagtat

SEQ ID NO: 365858 - DNA, 25 bp, Mus musculus
tctcatgcctgtggggctgcgaggc

SEQ ID NO: 365859 - DNA, 25 bp, Mus musculus
tctcatgcgagccaagatggacaac

SEQ ID NO: 365860 - DNA, 25 bp, Mus musculus
tctcatgctagttcagcaatcagca

SEQ ID NO: 365861 - DNA, 25 bp, Mus musculus
tctcatggagagtaaaagttggcat

SEQ ID NO: 365862 - DNA, 25 bp, Mus musculus
tctcatggctatactgatcatttca

SEQ ID NO: 365863 - DNA, 25 bp, Mus musculus
tctcatgtgcatgtccatgctgtgg

SEQ ID NO: 365864 - DNA, 25 bp, Mus musculus
tctcatgtgcatgttcatgacttgc

SEQ ID NO: 365865 - DNA, 25 bp, Mus musculus
tctcatgttgagtgacaaaagaact

SEQ ID NO: 365866 - DNA, 25 bp, Mus musculus
tctcatgttgccagagaggcagatg

SEQ ID NO: 365867 - DNA, 25 bp, Mus musculus
tctcatgtttaattgttcctgctgc

SEQ ID NO: 365868 - DNA, 25 bp, Mus musculus
tctcattaaggtaaatgaccgtcgg

SEQ ID NO: 365869 - DNA, 25 bp, Mus musculus
tctcattcagaacccattccaagct

SEQ ID NO: 365870 - DNA, 25 bp, Mus musculus
tctcattcctccagctacactcctc

SEQ ID NO: 365871 - DNA, 25 bp, Mus musculus
tctcattctctgcatcgggttcaca

SEQ ID NO: 365872 - DNA, 25 bp, Mus musculus
tctcattgacccaggtgctctcacc

SEQ ID NO: 365873 - DNA, 25 bp, Mus musculus
tctcattgaggcttatgtaaacatg

SEQ ID NO: 365874 - DNA, 25 bp, Mus musculus
tctcattgcacaaacaggagagcaa

SEQ ID NO: 365875 - DNA, 25 bp, Mus musculus
tctcattgcacacagaggaaagaaa

SEQ ID NO: 365876 - DNA, 25 bp, Mus musculus
tctcattgcacacagttttggtttc

SEQ ID NO: 365877 - DNA, 25 bp, Mus musculus
tctcattgctcgagtttgtgacaag

SEQ ID NO: 365878 - DNA, 25 bp, Mus musculus
tctcattgtgcaggcggctctccta

SEQ ID NO: 365879 - DNA, 25 bp, Mus musculus
tctcattgtgcagttctgtgccaat

SEQ ID NO: 365880 - DNA, 25 bp, Mus musculus
tctcattgtgtggaatcacaggcct

SEQ ID NO: 365881 - DNA, 25 bp, Mus musculus
tctcatttagtcaattggatccagt

SEQ ID NO: 365882 - DNA, 25 bp, Mus musculus
tctcatttggatggcaccacccctg

SEQ ID NO: 365883 - DNA, 25 bp, Mus musculus
tctcattttaaggccctgtggttct

SEQ ID NO: 365884 - DNA, 25 bp, Mus musculus
tctcatttttcgctcccagacctac

SEQ ID NO: 365885 - DNA, 25 bp, Mus musculus
tctccaaaaccaaaggcagaccgaa

SEQ ID NO: 365886 - DNA, 25 bp, Mus musculus
tctccaaaataaaggtgagttcctc

SEQ ID NO: 365887 - DNA, 25 bp, Mus musculus
tctccaaacagacgatccagaacca

SEQ ID NO: 365888 - DNA, 25 bp, Mus musculus
tctccaaaccccattcaacctctac

SEQ ID NO: 365889 - DNA, 25 bp, Mus musculus
tctccaaacccctgagggagagcag

SEQ ID NO: 365890 - DNA, 25 bp, Mus musculus
tctccaaaccggagtcctgttgaag

SEQ ID NO: 365891 - DNA, 25 bp, Mus musculus
tctccaaagagaaggaaaagtgata

SEQ ID NO: 365892 - DNA, 25 bp, Mus musculus
tctccaaagagaaggcaggtacacc

SEQ ID NO: 365893 - DNA, 25 bp, Mus musculus
tctccaaattatgtgccaccaaaag

SEQ ID NO: 365894 - DNA, 25 bp, Mus musculus
tctccaacaacaaagaagcctgatg

SEQ ID NO: 365895 - DNA, 25 bp, Mus musculus
tctccaacaccaaaagtgcccatgg

SEQ ID NO: 365896 - DNA, 25 bp, Mus musculus
tctccaacaccaaaatctgtagatt

SEQ ID NO: 365897 - DNA, 25 bp, Mus musculus
tctccaaccaaggcatcctcggaga

SEQ ID NO: 365898 - DNA, 25 bp, Mus musculus
tctccaaccaaggtatcatgtttgt

SEQ ID NO: 365899 - DNA, 25 bp, Mus musculus
tctccaaccagccaatagttacagt

SEQ ID NO: 365900 - DNA, 25 bp, Mus musculus
tctccaaccagttacagttagtgca

SEQ ID NO: 365901 - DNA, 25 bp, Mus musculus
tctccaacctccagtctcaccagcg

SEQ ID NO: 365902 - DNA, 25 bp, Mus musculus
tctccaacgtggaagcagcctgtga

SEQ ID NO: 365903 - DNA, 25 bp, Mus musculus
tctccaacgtggaagccctctgctc

SEQ ID NO: 365904 - DNA, 25 bp, Mus musculus
tctccaactggctttaagggaattc

SEQ ID NO: 365905 - DNA, 25 bp, Mus musculus
tctccaagaatggtcctggcactgt

SEQ ID NO: 365906 - DNA, 25 bp, Mus musculus
tctccaagcaggggtattttgccta

SEQ ID NO: 365907 - DNA, 25 bp, Mus musculus
tctccaagcagtatgtctggatttg

SEQ ID NO: 365908 - DNA, 25 bp, Mus musculus
tctccaagcatgagttatttgctgg

SEQ ID NO: 365909 - DNA, 25 bp, Mus musculus
tctccaaggtggcctagactgctct

SEQ ID NO: 365910 - DNA, 25 bp, Mus musculus
tctccaaggtggctggacccgacta

SEQ ID NO: 365911 - DNA, 25 bp, Mus musculus
tctccaaggtgtcatagacatgaaa

SEQ ID NO: 365912 - DNA, 25 bp, Mus musculus
tctccaagtaagagtcaaagcagtc

SEQ ID NO: 365913 - DNA, 25 bp, Mus musculus
tctccaagtatgaaggaggagtaga

SEQ ID NO: 365914 - DNA, 25 bp, Mus musculus
tctccaagtatgtaggaggagtaaa

SEQ ID NO: 365915 - DNA, 25 bp, Mus musculus
tctccaataattctatactttctgg

SEQ ID NO: 365916 - DNA, 25 bp, Mus musculus
tctccaataattcttatttgtagag

SEQ ID NO: 365917 - DNA, 25 bp, Mus musculus
tctccaatgcaggaggcccacctgc

SEQ ID NO: 365918 - DNA, 25 bp, Mus musculus
tctccacaaaggtgtattccctgga

SEQ ID NO: 365919 - DNA, 25 bp, Mus musculus
tctccacagctgcggtgctcttagc

SEQ ID NO: 365920 - DNA, 25 bp, Mus musculus
tctccacaggatgggtcccagcctg

SEQ ID NO: 365921 - DNA, 25 bp, Mus musculus
tctccacagtaaaagctgaaaataa

SEQ ID NO: 365922 - DNA, 25 bp, Mus musculus
tctccacagtcactggagagtcagg

SEQ ID NO: 365923 - DNA, 25 bp, Mus musculus
tctccacagtcgctggagagtcagg

SEQ ID NO: 365924 - DNA, 25 bp, Mus musculus
tctccacattcgagatggtggagta

SEQ ID NO: 365925 - DNA, 25 bp, Mus musculus
tctccacattcgagatgttcctcct

SEQ ID NO: 365926 - DNA, 25 bp, Mus musculus
tctccaccactcaggtgttttctct

SEQ ID NO: 365927 - DNA, 25 bp, Mus musculus
tctccaccaggacatggatttgatt

SEQ ID NO: 365928 - DNA, 25 bp, Mus musculus
tctccaccagtcggtgttgacttta

SEQ ID NO: 365929 - DNA, 25 bp, Mus musculus
tctccacccgcgggggccctagctg

SEQ ID NO: 365930 - DNA, 25 bp, Mus musculus
tctccacccggacagagtccttggc

SEQ ID NO: 365931 - DNA, 25 bp, Mus musculus
tctccacccttgagtcaagtccatc

SEQ ID NO: 365932 - DNA, 25 bp, Mus musculus
tctccaccgggaaaatctgaacaag

SEQ ID NO: 365933 - DNA, 25 bp, Mus musculus
tctccaccgtgaaccacccattcct

SEQ ID NO: 365934 - DNA, 25 bp, Mus musculus
tctccacctcaaagagttgaaaaga

SEQ ID NO: 365935 - DNA, 25 bp, Mus musculus
tctccacctcaaaggtctgtgttgg

SEQ ID NO: 365936 - DNA, 25 bp, Mus musculus
tctccacgccatggatgcagtgacc

SEQ ID NO: 365937 - DNA, 25 bp, Mus musculus
tctccacgcctctcgtcagaagaaa

SEQ ID NO: 365938 - DNA, 25 bp, Mus musculus
tctccactacaagatgaggtctcaa

SEQ ID NO: 365939 - DNA, 25 bp, Mus musculus
tctccactcttaccgatcagcacca

SEQ ID NO: 365940 - DNA, 25 bp, Mus musculus
tctccactcttgaaagaaaaatgac

SEQ ID NO: 365941 - DNA, 25 bp, Mus musculus
tctccactctttcctcccttggagt

SEQ ID NO: 365942 - DNA, 25 bp, Mus musculus
tctccactggcctctcggacctcag

SEQ ID NO: 365943 - DNA, 25 bp, Mus musculus
tctccactggtgaagaagcaggcca

SEQ ID NO: 365944 - DNA, 25 bp, Mus musculus
tctccacttcaggtactaaacagac

SEQ ID NO: 365945 - DNA, 25 bp, Mus musculus
tctccacttctaaggcggcgacagc

SEQ ID NO: 365946 - DNA, 25 bp, Mus musculus
tctccacttgggtgaaagacaagga

SEQ ID NO: 365947 - DNA, 25 bp, Mus musculus
tctccagaaagaggcgccctgtgct

SEQ ID NO: 365948 - DNA, 25 bp, Mus musculus
tctccagaaagaggtgggtcttctc

SEQ ID NO: 365949 - DNA, 25 bp, Mus musculus
tctccagaaagtgctttgcatgggt

SEQ ID NO: 365950 - DNA, 25 bp, Mus musculus
tctccagaaagtggtatcccataaa

SEQ ID NO: 365951 - DNA, 25 bp, Mus musculus
tctccagaacaaagtctgttcaaga

SEQ ID NO: 365952 - DNA, 25 bp, Mus musculus
tctccagaacagctatggatttgcc

SEQ ID NO: 365953 - DNA, 25 bp, Mus musculus
tctccagaacagctgttcctaaggc

SEQ ID NO: 365954 - DNA, 25 bp, Mus musculus
tctccagaaggtcgcttataccaag

SEQ ID NO: 365955 - DNA, 25 bp, Mus musculus
tctccagacagataccagaagctct

SEQ ID NO: 365956 - DNA, 25 bp, Mus musculus
tctccagacatggagacaacagctt

SEQ ID NO: 365957 - DNA, 25 bp, Mus musculus
tctccagacctggctgcccagaccc

SEQ ID NO: 365958 - DNA, 25 bp, Mus musculus
tctccagaccttcacgcatcatgac

SEQ ID NO: 365959 - DNA, 25 bp, Mus musculus
tctccagagaggtgcccttctccaa

SEQ ID NO: 365960 - DNA, 25 bp, Mus musculus
tctccagagcaccgcctcctggctg

SEQ ID NO: 365961 - DNA, 25 bp, Mus musculus
tctccagagtgataatgtgtacaag

SEQ ID NO: 365962 - DNA, 25 bp, Mus musculus
tctccagatagagctcgccgcctgc

SEQ ID NO: 365963 - DNA, 25 bp, Mus musculus
tctccagatagagtcccaggtaaag

SEQ ID NO: 365964 - DNA, 25 bp, Mus musculus
tctccagatgacttcttgggtcgta

SEQ ID NO: 365965 - DNA, 25 bp, Mus musculus
tctccagatgagagggaagagtgga

SEQ ID NO: 365966 - DNA, 25 bp, Mus musculus
tctccagatgagagggaagagtgta

SEQ ID NO: 365967 - DNA, 25 bp, Mus musculus
tctccagcaaggcatgatcaccatc

SEQ ID NO: 365968 - DNA, 25 bp, Mus musculus
tctccagcaagttacagtccctgtt

SEQ ID NO: 365969 - DNA, 25 bp, Mus musculus
tctccagcacacttgtatggggatc

SEQ ID NO: 365970 - DNA, 25 bp, Mus musculus
tctccagcacacttgtccaacaaag

SEQ ID NO: 365971 - DNA, 25 bp, Mus musculus
tctccagcacctgtgaataaaagct

SEQ ID NO: 365972 - DNA, 25 bp, Mus musculus
tctccagcagaactaaagaacgctt

SEQ ID NO: 365973 - DNA, 25 bp, Mus musculus
tctccagcagcaagagccagaggga

SEQ ID NO: 365974 - DNA, 25 bp, Mus musculus
tctccagcaggacccaacctcctgc

SEQ ID NO: 365975 - DNA, 25 bp, Mus musculus
tctccagcaggttacagtaccttta

SEQ ID NO: 365976 - DNA, 25 bp, Mus musculus
tctccagccaatgctgactaccagg

SEQ ID NO: 365977 - DNA, 25 bp, Mus musculus
tctccagccaggatgtgatggtggt

SEQ ID NO: 365978 - DNA, 25 bp, Mus musculus
tctccagccaggctgcttctgatgc

SEQ ID NO: 365979 - DNA, 25 bp, Mus musculus
tctccagccagtgaggatcccattt

SEQ ID NO: 365980 - DNA, 25 bp, Mus musculus
tctccagccatatctggcaccaatt

SEQ ID NO: 365981 - DNA, 25 bp, Mus musculus
tctccagcccaggtgaacaccatgt

SEQ ID NO: 365982 - DNA, 25 bp, Mus musculus
tctccagccccagaacaaggaattg

SEQ ID NO: 365983 - DNA, 25 bp, Mus musculus
tctccagcccccagatctccttgtc

SEQ ID NO: 365984 - DNA, 25 bp, Mus musculus
tctccagcccggttttgaggaaaag

SEQ ID NO: 365985 - DNA, 25 bp, Mus musculus
tctccagcgggcagaggcggatctt

SEQ ID NO: 365986 - DNA, 25 bp, Mus musculus
tctccagcgggcaggtcatgttagc

SEQ ID NO: 365987 - DNA, 25 bp, Mus musculus
tctccagctatgagaagcaacaggc

SEQ ID NO: 365988 - DNA, 25 bp, Mus musculus
tctccagctatgagcctggagtact

SEQ ID NO: 365989 - DNA, 25 bp, Mus musculus
tctccagctcaaagctgctgagagc

SEQ ID NO: 365990 - DNA, 25 bp, Mus musculus
tctccaggaagccaggtctttggcc

SEQ ID NO: 365991 - DNA, 25 bp, Mus musculus
tctccaggatgttctgaggaggact

SEQ ID NO: 365992 - DNA, 25 bp, Mus musculus
tctccaggctctacttctgttcata

SEQ ID NO: 365993 - DNA, 25 bp, Mus musculus
tctccaggctctgggaccctgaaag

SEQ ID NO: 365994 - DNA, 25 bp, Mus musculus
tctccagggagacgaaggaggcgtt

SEQ ID NO: 365995 - DNA, 25 bp, Mus musculus
tctccaggtacaagacgaactggag

SEQ ID NO: 365996 - DNA, 25 bp, Mus musculus
tctccagtaaacccagtgatcaggt

SEQ ID NO: 365997 - DNA, 25 bp, Mus musculus
tctccagtaccattgcaagtactcc

SEQ ID NO: 365998 - DNA, 25 bp, Mus musculus
tctccagtctccaggtgattggatg

SEQ ID NO: 365999 - DNA, 25 bp, Mus musculus
tctccagtgcaagcagcccagccat

SEQ ID NO: 366000 - DNA, 25 bp, Mus musculus
tctccagttccaggaagtcgttctt

SEQ ID NO: 366001 - DNA, 25 bp, Mus musculus
tctccagttccagtaagtgcaataa

SEQ ID NO: 366002 - DNA, 25 bp, Mus musculus
tctccataaggtggcccacgcgctg

SEQ ID NO: 366003 - DNA, 25 bp, Mus musculus
tctccatcaaaccccggcagcccaa

SEQ ID NO: 366004 - DNA, 25 bp, Mus musculus
tctccatcaaagaaattagccagga

SEQ ID NO: 366005 - DNA, 25 bp, Mus musculus
tctccatcaaaggacctgatagatg

SEQ ID NO: 366006 - DNA, 25 bp, Mus musculus
tctccatcagaatccaagagaaaag

SEQ ID NO: 366007 - DNA, 25 bp, Mus musculus
tctccatcaggtttctttcttgttc

SEQ ID NO: 366008 - DNA, 25 bp, Mus musculus
tctccatcagtatccaagagaaaag

SEQ ID NO: 366009 - DNA, 25 bp, Mus musculus
tctccatcctaccagttcgcagacc

SEQ ID NO: 366010 - DNA, 25 bp, Mus musculus
tctccatcctaccatatctgtctcg

SEQ ID NO: 366011 - DNA, 25 bp, Mus musculus
tctccatcctgaagtccctgctatg

SEQ ID NO: 366012 - DNA, 25 bp, Mus musculus
tctccatcctgggttggctgatgtt

SEQ ID NO: 366013 - DNA, 25 bp, Mus musculus
tctccatctatagatcttaccaata

SEQ ID NO: 366014 - DNA, 25 bp, Mus musculus
tctccatctataggattcatgaata

SEQ ID NO: 366015 - DNA, 25 bp, Mus musculus
tctccatggacacactacagatgct

SEQ ID NO: 366016 - DNA, 25 bp, Mus musculus
tctccatggacagactacagatgct

SEQ ID NO: 366017 - DNA, 25 bp, Mus musculus
tctccatggagcttggagctgcctg

SEQ ID NO: 366018 - DNA, 25 bp, Mus musculus
tctccatggaggcaagatgaatatg

SEQ ID NO: 366019 - DNA, 25 bp, Mus musculus
tctccattcaggagacattccaaat

SEQ ID NO: 366020 - DNA, 25 bp, Mus musculus
tctccattcaggcacagatgcttct

SEQ ID NO: 366021 - DNA, 25 bp, Mus musculus
tctccattcagggttcccgggcccc

SEQ ID NO: 366022 - DNA, 25 bp, Mus musculus
tctccattcaggtagtgactgcagc

SEQ ID NO: 366023 - DNA, 25 bp, Mus musculus
tctccattccatttctgggcttcaa

SEQ ID NO: 366024 - DNA, 25 bp, Mus musculus
tctccattctgttgcaccaagtata

SEQ ID NO: 366025 - DNA, 25 bp, Mus musculus
tctccattgcgaggctcctgacagt

SEQ ID NO: 366026 - DNA, 25 bp, Mus musculus
tctccattgtagggatgtttcttgc

SEQ ID NO: 366027 - DNA, 25 bp, Mus musculus
tctccatttttcagagctgcgttca

SEQ ID NO: 366028 - DNA, 25 bp, Mus musculus
tctcccaagagccagatggtccagc

SEQ ID NO: 366029 - DNA, 25 bp, Mus musculus
tctcccaaggtgcagcaacctcact

SEQ ID NO: 366030 - DNA, 25 bp, Mus musculus
tctcccaaggtgcaggctttggtta

SEQ ID NO: 366031 - DNA, 25 bp, Mus musculus
tctcccaatcctgtgatagtcctca

SEQ ID NO: 366032 - DNA, 25 bp, Mus musculus
tctcccacagaaatgctgcacaatg

SEQ ID NO: 366033 - DNA, 25 bp, Mus musculus
tctcccaccagaggctgatccccgg

SEQ ID NO: 366034 - DNA, 25 bp, Mus musculus
tctcccaccagatacccataatatc

SEQ ID NO: 366035 - DNA, 25 bp, Mus musculus
tctcccaccaggctcaatattgtgc

SEQ ID NO: 366036 - DNA, 25 bp, Mus musculus
tctcccaccatcccaaatttattcc

SEQ ID NO: 366037 - DNA, 25 bp, Mus musculus
tctcccaccatgaaacaaaaggagg

SEQ ID NO: 366038 - DNA, 25 bp, Mus musculus
tctcccacctacgggtggcggctga

SEQ ID NO: 366039 - DNA, 25 bp, Mus musculus
tctcccaccttgaggcctttcttcc

SEQ ID NO: 366040 - DNA, 25 bp, Mus musculus
tctcccaccttgagggaagtaacca

SEQ ID NO: 366041 - DNA, 25 bp, Mus musculus
tctcccaccttgagggtcctgagtc

SEQ ID NO: 366042 - DNA, 25 bp, Mus musculus
tctcccacgctaagatgcccctaga

SEQ ID NO: 366043 - DNA, 25 bp, Mus musculus
tctcccactctcctgggctgcaact

SEQ ID NO: 366044 - DNA, 25 bp, Mus musculus
tctcccagagcctggcacccccaga

SEQ ID NO: 366045 - DNA, 25 bp, Mus musculus
tctcccagaggaactctgtgcctgt

SEQ ID NO: 366046 - DNA, 25 bp, Mus musculus
tctcccagaggaggacgatgtcatg

SEQ ID NO: 366047 - DNA, 25 bp, Mus musculus
tctcccagaggagttggatattcta

SEQ ID NO: 366048 - DNA, 25 bp, Mus musculus
tctcccagaggcaaaatctcatcag

SEQ ID NO: 366049 - DNA, 25 bp, Mus musculus
tctcccagagtggcttcatcactgt

SEQ ID NO: 366050 - DNA, 25 bp, Mus musculus
tctcccagattataagtttccagaa

SEQ ID NO: 366051 - DNA, 25 bp, Mus musculus
tctcccagattatgcacaggacctc

SEQ ID NO: 366052 - DNA, 25 bp, Mus musculus
tctcccagctccttcactcactcgt

SEQ ID NO: 366053 - DNA, 25 bp, Mus musculus
tctcccagcttcgcaggacccaacc

SEQ ID NO: 366054 - DNA, 25 bp, Mus musculus
tctcccaggaagcctcaaggagaag

SEQ ID NO: 366055 - DNA, 25 bp, Mus musculus
tctcccaggaagcgtgcccaactaa

SEQ ID NO: 366056 - DNA, 25 bp, Mus musculus
tctcccaggaagtgcaaagaggaga

SEQ ID NO: 366057 - DNA, 25 bp, Mus musculus
tctcccaggagattggagaccgaaa

SEQ ID NO: 366058 - DNA, 25 bp, Mus musculus
tctcccagggatgaacaggccgatc

SEQ ID NO: 366059 - DNA, 25 bp, Mus musculus
tctcccatcaggaggaggagataga

SEQ ID NO: 366060 - DNA, 25 bp, Mus musculus
tctcccatgaagaaaaaagatgttg

SEQ ID NO: 366061 - DNA, 25 bp, Mus musculus
tctcccatgattaatgaattagtag

SEQ ID NO: 366062 - DNA, 25 bp, Mus musculus
tctcccctatatcagtgacacagga

SEQ ID NO: 366063 - DNA, 25 bp, Mus musculus
tctcccgagtgccttagtcctgggc

SEQ ID NO: 366064 - DNA, 25 bp, Mus musculus
tctcccggagaggtgtcgcggaaga

SEQ ID NO: 366065 - DNA, 25 bp, Mus musculus
tctcccggagccaagatcccattct

SEQ ID NO: 366066 - DNA, 25 bp, Mus musculus
tctcccggagccaagtggttgatcg

SEQ ID NO: 366067 - DNA, 25 bp, Mus musculus
tctcccggctctgtggtgccttagc

SEQ ID NO: 366068 - DNA, 25 bp, Mus musculus
tctcccgtggtgcgaaagaaaaagt

SEQ ID NO: 366069 - DNA, 25 bp, Mus musculus
tctccctacagagatgggagaccgt

SEQ ID NO: 366070 - DNA, 25 bp, Mus musculus
tctccctacagaggagaatttagag

SEQ ID NO: 366071 - DNA, 25 bp, Mus musculus
tctccctacagaggtgtgtcagagc

SEQ ID NO: 366072 - DNA, 25 bp, Mus musculus
tctccctacggcatagtgccgtcca

SEQ ID NO: 366073 - DNA, 25 bp, Mus musculus
tctccctacggcatgaaacagaaga

SEQ ID NO: 366074 - DNA, 25 bp, Mus musculus
tctccctagcaaaactcttccaagt

SEQ ID NO: 366075 - DNA, 25 bp, Mus musculus
tctccctagtagatccactgtgggt

SEQ ID NO: 366076 - DNA, 25 bp, Mus musculus
tctccctcaagacatctccgacccc

SEQ ID NO: 366077 - DNA, 25 bp, Mus musculus
tctccctcaagtgctgcattgacct

SEQ ID NO: 366078 - DNA, 25 bp, Mus musculus
tctccctcaccttgttttctgctca

SEQ ID NO: 366079 - DNA, 25 bp, Mus musculus
tctccctccaaatttgggcagacat

SEQ ID NO: 366080 - DNA, 25 bp, Mus musculus
tctccctccggaaagaacaagttag

SEQ ID NO: 366081 - DNA, 25 bp, Mus musculus
tctccctcgcagttcttgaacactt

SEQ ID NO: 366082 - DNA, 25 bp, Mus musculus
tctccctcttcacctcgctgaggtg

SEQ ID NO: 366083 - DNA, 25 bp, Mus musculus
tctccctggaaggggagccccgcaa

SEQ ID NO: 366084 - DNA, 25 bp, Mus musculus
tctccctggaaggtggaacctaggg

SEQ ID NO: 366085 - DNA, 25 bp, Mus musculus
tctccctggattcagtcatttgaag

SEQ ID NO: 366086 - DNA, 25 bp, Mus musculus
tctccctggcattagggcaggctgg

SEQ ID NO: 366087 - DNA, 25 bp, Mus musculus
tctccctggcattagtacactgtag

SEQ ID NO: 366088 - DNA, 25 bp, Mus musculus
tctccctggcgagtgactcagaccc

SEQ ID NO: 366089 - DNA, 25 bp, Mus musculus
tctccctgggctgtggtggtgagaa

SEQ ID NO: 366090 - DNA, 25 bp, Mus musculus
tctccctggtcgtaatggagatagg

SEQ ID NO: 366091 - DNA, 25 bp, Mus musculus
tctccgaagatacttgaaccagttc

SEQ ID NO: 366092 - DNA, 25 bp, Mus musculus
tctccgacatcacccatgctggacg

SEQ ID NO: 366093 - DNA, 25 bp, Mus musculus
tctccgacccgggcaggagctggga

SEQ ID NO: 366094 - DNA, 25 bp, Mus musculus
tctccgagacagagacaaaatcaca

SEQ ID NO: 366095 - DNA, 25 bp, Mus musculus
tctccgagattctggacctgtgttt

SEQ ID NO: 366096 - DNA, 25 bp, Mus musculus
tctccgaggagctaatcagtgagat

SEQ ID NO: 366097 - DNA, 25 bp, Mus musculus
tctccgaggagctaattctgaagtc

SEQ ID NO: 366098 - DNA, 25 bp, Mus musculus
tctccgagggcgggcggcgacagca

SEQ ID NO: 366099 - DNA, 25 bp, Mus musculus
tctccgatccaacagaccctcagga

SEQ ID NO: 366100 - DNA, 25 bp, Mus musculus
tctccgcaaaggcaccaccttccat

SEQ ID NO: 366101 - DNA, 25 bp, Mus musculus
tctccgcaaagggtacacgcagctc

SEQ ID NO: 366102 - DNA, 25 bp, Mus musculus
tctccgcaccagaggaacttctgca

SEQ ID NO: 366103 - DNA, 25 bp, Mus musculus
tctccgcagcaggatgagccggcag

SEQ ID NO: 366104 - DNA, 25 bp, Mus musculus
tctccgcagcagtttacaatctgta

SEQ ID NO: 366105 - DNA, 25 bp, Mus musculus
tctccgccagaagcctgcatcctta

SEQ ID NO: 366106 - DNA, 25 bp, Mus musculus
tctccgccagaggatccgtgaagag

SEQ ID NO: 366107 - DNA, 25 bp, Mus musculus
tctccgccagagggtgcactattcc

SEQ ID NO: 366108 - DNA, 25 bp, Mus musculus
tctccgccagtcaacaggagaagtt

SEQ ID NO: 366109 - DNA, 25 bp, Mus musculus
tctccgcccacagagatgagccgcc

SEQ ID NO: 366110 - DNA, 25 bp, Mus musculus
tctccgccgagccggaccgggctgg

SEQ ID NO: 366111 - DNA, 25 bp, Mus musculus
tctccgccgagcgcctcggtcctga

SEQ ID NO: 366112 - DNA, 25 bp, Mus musculus
tctccgcgcacagcattagcagaga

SEQ ID NO: 366113 - DNA, 25 bp, Mus musculus
tctccgcggaggaccctaggaaaat

SEQ ID NO: 366114 - DNA, 25 bp, Mus musculus
tctccgcggaggtattacttggact

SEQ ID NO: 366115 - DNA, 25 bp, Mus musculus
tctccgctggcgagcctccctgtga

SEQ ID NO: 366116 - DNA, 25 bp, Mus musculus
tctccggaactcagatttcaactat

SEQ ID NO: 366117 - DNA, 25 bp, Mus musculus
tctccggatctgatcgtctgccgta

SEQ ID NO: 366118 - DNA, 25 bp, Mus musculus
tctccggatcttccggccccggaag

SEQ ID NO: 366119 - DNA, 25 bp, Mus musculus
tctccggcaccggactttttcctag

SEQ ID NO: 366120 - DNA, 25 bp, Mus musculus
tctccggcaccgggccatggcggac

SEQ ID NO: 366121 - DNA, 25 bp, Mus musculus
tctccggcagacagacagctggtgg

SEQ ID NO: 366122 - DNA, 25 bp, Mus musculus
tctccggcagacagtgaagccagtc

SEQ ID NO: 366123 - DNA, 25 bp, Mus musculus
tctccggctctaaggccaaagatct

SEQ ID NO: 366124 - DNA, 25 bp, Mus musculus
tctccggctggatgagcctgcccgc

SEQ ID NO: 366125 - DNA, 25 bp, Mus musculus
tctccggctggcccaccttgggaca

SEQ ID NO: 366126 - DNA, 25 bp, Mus musculus
tctccgggattgtgctttgagcgct

SEQ ID NO: 366127 - DNA, 25 bp, Mus musculus
tctccgggctgaggagccaacatgt

SEQ ID NO: 366128 - DNA, 25 bp, Mus musculus
tctccgggtgagtttgccaggcagt

SEQ ID NO: 366129 - DNA, 25 bp, Mus musculus
tctccggtctgaaccggctgattat

SEQ ID NO: 366130 - DNA, 25 bp, Mus musculus
tctccgtacagatcttcgtccctcc

SEQ ID NO: 366131 - DNA, 25 bp, Mus musculus
tctccgtacagcgccatggctactt

SEQ ID NO: 366132 - DNA, 25 bp, Mus musculus
tctccgtccccagaacccgagccag

SEQ ID NO: 366133 - DNA, 25 bp, Mus musculus
tctccgtcctttaggaaaggtatgc

SEQ ID NO: 366134 - DNA, 25 bp, Mus musculus
tctccgtgccggcggcctcagcact

SEQ ID NO: 366135 - DNA, 25 bp, Mus musculus
tctccgtggagatggagacattgat

SEQ ID NO: 366136 - DNA, 25 bp, Mus musculus
tctccgtgtgaaagatacttggtaa

SEQ ID NO: 366137 - DNA, 25 bp, Mus musculus
tctccgttatcatgaacacggctct

SEQ ID NO: 366138 - DNA, 25 bp, Mus musculus
tctccgttatcatgtttgatttgac

SEQ ID NO: 366139 - DNA, 25 bp, Mus musculus
tctcctaaaagaagtcgttccccat

SEQ ID NO: 366140 - DNA, 25 bp, Mus musculus
tctcctaaaaggattgcaaaagttt

SEQ ID NO: 366141 - DNA, 25 bp, Mus musculus
tctcctaacagatgaacagtgtttt

SEQ ID NO: 366142 - DNA, 25 bp, Mus musculus
tctcctaacagctatgaaaggacag

SEQ ID NO: 366143 - DNA, 25 bp, Mus musculus
tctcctaactcaggtgaggcacaga

SEQ ID NO: 366144 - DNA, 25 bp, Mus musculus
tctcctaactggtcagtaccatgaa

SEQ ID NO: 366145 - DNA, 25 bp, Mus musculus
tctcctacaaattgctaataatcac

SEQ ID NO: 366146 - DNA, 25 bp, Mus musculus
tctcctacactgggctcctccacca

SEQ ID NO: 366147 - DNA, 25 bp, Mus musculus
tctcctacactggtgacaagacgag

SEQ ID NO: 366148 - DNA, 25 bp, Mus musculus
tctcctacgagcagcgggtgctgac

SEQ ID NO: 366149 - DNA, 25 bp, Mus musculus
tctcctacgagcagggctgtgcgat

SEQ ID NO: 366150 - DNA, 25 bp, Mus musculus
tctcctacgagtccgaaaggcaaga

SEQ ID NO: 366151 - DNA, 25 bp, Mus musculus
tctcctacttcaagggccaacggca

SEQ ID NO: 366152 - DNA, 25 bp, Mus musculus
tctcctagtgagcttgtccaggtga

SEQ ID NO: 366153 - DNA, 25 bp, Mus musculus
tctcctatagcagggtctacctgct

SEQ ID NO: 366154 - DNA, 25 bp, Mus musculus
tctcctatggctgtcttcagacact

SEQ ID NO: 366155 - DNA, 25 bp, Mus musculus
tctcctatgggtatggccgaataga

SEQ ID NO: 366156 - DNA, 25 bp, Mus musculus
tctcctcaaggcaccttgttgtgac

SEQ ID NO: 366157 - DNA, 25 bp, Mus musculus
tctcctcaatatgccctacacagtc

SEQ ID NO: 366158 - DNA, 25 bp, Mus musculus
tctcctcaatatggaaagtacctaa

SEQ ID NO: 366159 - DNA, 25 bp, Mus musculus
tctcctcagaggcagcatcctgttc

SEQ ID NO: 366160 - DNA, 25 bp, Mus musculus
tctcctcagagtctgatgccaagcc

SEQ ID NO: 366161 - DNA, 25 bp, Mus musculus
tctcctcagagtctgcaagaaacta

SEQ ID NO: 366162 - DNA, 25 bp, Mus musculus
tctcctcagagtttgtcatccgtcc

SEQ ID NO: 366163 - DNA, 25 bp, Mus musculus
tctcctcagcccttcagggtggtaa

SEQ ID NO: 366164 - DNA, 25 bp, Mus musculus
tctcctccaaaacctcaggctggct

SEQ ID NO: 366165 - DNA, 25 bp, Mus musculus
tctcctccagcggcagtacatccct

SEQ ID NO: 366166 - DNA, 25 bp, Mus musculus
tctcctcccagtgccctggggggca

SEQ ID NO: 366167 - DNA, 25 bp, Mus musculus
tctcctccccagaagacccagccag

SEQ ID NO: 366168 - DNA, 25 bp, Mus musculus
tctcctccccagatcagcaccgaca

SEQ ID NO: 366169 - DNA, 25 bp, Mus musculus
tctcctccccttggggccttctagc

SEQ ID NO: 366170 - DNA, 25 bp, Mus musculus
tctcctccgagagaggtgccgttct

SEQ ID NO: 366171 - DNA, 25 bp, Mus musculus
tctcctccgaggtccagtttggcca

SEQ ID NO: 366172 - DNA, 25 bp, Mus musculus
tctcctccgcagaggccaagtgaga

SEQ ID NO: 366173 - DNA, 25 bp, Mus musculus
tctcctccggcttgttggaggtgag

SEQ ID NO: 366174 - DNA, 25 bp, Mus musculus
tctcctcctgtccagcaaatctccc

SEQ ID NO: 366175 - DNA, 25 bp, Mus musculus
tctcctccttaaagcctgcggagcc

SEQ ID NO: 366176 - DNA, 25 bp, Mus musculus
tctcctccttggctggcagcacaga

SEQ ID NO: 366177 - DNA, 25 bp, Mus musculus
tctcctccttggctgggaaaatgac

SEQ ID NO: 366178 - DNA, 25 bp, Mus musculus
tctcctccttggctgggggaagaac

SEQ ID NO: 366179 - DNA, 25 bp, Mus musculus
tctcctcgacgggtcctgcatggtg

SEQ ID NO: 366180 - DNA, 25 bp, Mus musculus
tctcctctaaaaggcaacaactcta

SEQ ID NO: 366181 - DNA, 25 bp, Mus musculus
tctcctctaaaagggccgcgcctgc

SEQ ID NO: 366182 - DNA, 25 bp, Mus musculus
tctcctctatgctcctttcctggct

SEQ ID NO: 366183 - DNA, 25 bp, Mus musculus
tctcctctatggctcagcactgcat

SEQ ID NO: 366184 - DNA, 25 bp, Mus musculus
tctcctctcaactccacgtcagcac

SEQ ID NO: 366185 - DNA, 25 bp, Mus musculus
tctcctctcaagcaagctatagtca

SEQ ID NO: 366186 - DNA, 25 bp, Mus musculus
tctcctctcagaggctctggagacg

SEQ ID NO: 366187 - DNA, 25 bp, Mus musculus
tctcctctcagcaaagctgttgctg

SEQ ID NO: 366188 - DNA, 25 bp, Mus musculus
tctcctctccgacatcacccatgct

SEQ ID NO: 366189 - DNA, 25 bp, Mus musculus
tctcctctcctgaaaatgactccct

SEQ ID NO: 366190 - DNA, 25 bp, Mus musculus
tctcctctgaaggctagccctgctc

SEQ ID NO: 366191 - DNA, 25 bp, Mus musculus
tctcctgaaagcgctgagaagcaga

SEQ ID NO: 366192 - DNA, 25 bp, Mus musculus
tctcctgaaatgcctaacatacatg

SEQ ID NO: 366193 - DNA, 25 bp, Mus musculus
tctcctgaagtaggtgtaattattg

SEQ ID NO: 366194 - DNA, 25 bp, Mus musculus
tctcctgacttgagggagtgcccag

SEQ ID NO: 366195 - DNA, 25 bp, Mus musculus
tctcctgacttgagggtcctgaggg

SEQ ID NO: 366196 - DNA, 25 bp, Mus musculus
tctcctgactttgggtaatgttctc

SEQ ID NO: 366197 - DNA, 25 bp, Mus musculus
tctcctgagagagaacttgccgacg

SEQ ID NO: 366198 - DNA, 25 bp, Mus musculus
tctcctgagagagaggtgcaggcag

SEQ ID NO: 366199 - DNA, 25 bp, Mus musculus
tctcctgatatctaatagcattcct

SEQ ID NO: 366200 - DNA, 25 bp, Mus musculus
tctcctgatggaggtgcttgtcctg

SEQ ID NO: 366201 - DNA, 25 bp, Mus musculus
tctcctgcaaaggctgaggagctgt

SEQ ID NO: 366202 - DNA, 25 bp, Mus musculus
tctcctgcaaatgtccaaacggatt

SEQ ID NO: 366203 - DNA, 25 bp, Mus musculus
tctcctgcaagtgtcctgtgggata

SEQ ID NO: 366204 - DNA, 25 bp, Mus musculus
tctcctgcacgtgaggagcatgtcc

SEQ ID NO: 366205 - DNA, 25 bp, Mus musculus
tctcctgcagcgagcttcaagcgtg

SEQ ID NO: 366206 - DNA, 25 bp, Mus musculus
tctcctgcagcgatatcgatgagtg

SEQ ID NO: 366207 - DNA, 25 bp, Mus musculus
tctcctgcaggaagtggacattgtg

SEQ ID NO: 366208 - DNA, 25 bp, Mus musculus
tctcctgccaggaatgaagaaagaa

SEQ ID NO: 366209 - DNA, 25 bp, Mus musculus
tctcctgccccgtgaactgtgacaa

SEQ ID NO: 366210 - DNA, 25 bp, Mus musculus
tctcctgccctgtgcaagtgccctc

SEQ ID NO: 366211 - DNA, 25 bp, Mus musculus
tctcctgccttcctttctttgatgt

SEQ ID NO: 366212 - DNA, 25 bp, Mus musculus
tctcctgctgggacacccctcacag

SEQ ID NO: 366213 - DNA, 25 bp, Mus musculus
tctcctgctgggtctgtgatggtga

SEQ ID NO: 366214 - DNA, 25 bp, Mus musculus
tctcctgcttggctcctgtagtttc

SEQ ID NO: 366215 - DNA, 25 bp, Mus musculus
tctcctggaaaactgggcccattga

SEQ ID NO: 366216 - DNA, 25 bp, Mus musculus
tctcctggagctcagcttttccaga

SEQ ID NO: 366217 - DNA, 25 bp, Mus musculus
tctcctggaggttccaactatggga

SEQ ID NO: 366218 - DNA, 25 bp, Mus musculus
tctcctggcagccaaccaatggaat

SEQ ID NO: 366219 - DNA, 25 bp, Mus musculus
tctcctggccacgaaacactctctg

SEQ ID NO: 366220 - DNA, 25 bp, Mus musculus
tctcctggcccagcaaccttccctg

SEQ ID NO: 366221 - DNA, 25 bp, Mus musculus
tctcctggcccagcaatcttccctg

SEQ ID NO: 366222 - DNA, 25 bp, Mus musculus
tctcctgggccctcaccagagcagc

SEQ ID NO: 366223 - DNA, 25 bp, Mus musculus
tctcctggtcccagcgcaggagcct

SEQ ID NO: 366224 - DNA, 25 bp, Mus musculus
tctcctggttacggtcatttggtgt

SEQ ID NO: 366225 - DNA, 25 bp, Mus musculus
tctcctgtcagatgggattgatgag

SEQ ID NO: 366226 - DNA, 25 bp, Mus musculus
tctcctgtcaggccagatttggacc

SEQ ID NO: 366227 - DNA, 25 bp, Mus musculus
tctcctgtcctgagctttcccgaga

SEQ ID NO: 366228 - DNA, 25 bp, Mus musculus
tctcctgtcgcagcctcggcctggc

SEQ ID NO: 366229 - DNA, 25 bp, Mus musculus
tctcctgttaggcgtctcttttctc

SEQ ID NO: 366230 - DNA, 25 bp, Mus musculus
tctccttatcaggacgcacatgcaa

SEQ ID NO: 366231 - DNA, 25 bp, Mus musculus
tctccttcaggctccatgttggctc

SEQ ID NO: 366232 - DNA, 25 bp, Mus musculus
tctccttcagtaaattcaagatgga

SEQ ID NO: 366233 - DNA, 25 bp, Mus musculus
tctccttcagttaaagctagtcctc

SEQ ID NO: 366234 - DNA, 25 bp, Mus musculus
tctccttccaaagaggatttgttgg

SEQ ID NO: 366235 - DNA, 25 bp, Mus musculus
tctccttccacaagaagaacgagac

SEQ ID NO: 366236 - DNA, 25 bp, Mus musculus
tctccttccacaagtttcctcttac

SEQ ID NO: 366237 - DNA, 25 bp, Mus musculus
tctccttccacagacttcccaagaa

SEQ ID NO: 366238 - DNA, 25 bp, Mus musculus
tctccttccacagctgctccgaaag

SEQ ID NO: 366239 - DNA, 25 bp, Mus musculus
tctccttccatggctgtgacccaat

SEQ ID NO: 366240 - DNA, 25 bp, Mus musculus
tctccttccattatgtatagcagtg

SEQ ID NO: 366241 - DNA, 25 bp, Mus musculus
tctccttccgttcagcggacgccgc

SEQ ID NO: 366242 - DNA, 25 bp, Mus musculus
tctccttcctcagctactgtgacta

SEQ ID NO: 366243 - DNA, 25 bp, Mus musculus
tctccttcctgtgccccacagatta

SEQ ID NO: 366244 - DNA, 25 bp, Mus musculus
tctccttccttttgggcagcaaggc

SEQ ID NO: 366245 - DNA, 25 bp, Mus musculus
tctccttccttttgtgagatttttt

SEQ ID NO: 366246 - DNA, 25 bp, Mus musculus
tctccttccttttgttttcagcttt

SEQ ID NO: 366247 - DNA, 25 bp, Mus musculus
tctccttctgggataaaaagaagca

SEQ ID NO: 366248 - DNA, 25 bp, Mus musculus
tctccttctttgaaagacactacgc

SEQ ID NO: 366249 - DNA, 25 bp, Mus musculus
tctccttgcagagcaggcaaggaga

SEQ ID NO: 366250 - DNA, 25 bp, Mus musculus
tctccttgccgaatgcctaaatcaa

SEQ ID NO: 366251 - DNA, 25 bp, Mus musculus
tctccttggtcccagctgtgcagtg

SEQ ID NO: 366252 - DNA, 25 bp, Mus musculus
tctccttgtccaagatcgagcggtc

SEQ ID NO: 366253 - DNA, 25 bp, Mus musculus
tctcctttcaagaattacaggcccg

SEQ ID NO: 366254 - DNA, 25 bp, Mus musculus
tctccttttaaagatcagccagatg

SEQ ID NO: 366255 - DNA, 25 bp, Mus musculus
tctccttttacctattcatcgctcc

SEQ ID NO: 366256 - DNA, 25 bp, Mus musculus
tctcctttttgctgttcactttgga

SEQ ID NO: 366257 - DNA, 25 bp, Mus musculus
tctcgaaccagtggcaacactggca

SEQ ID NO: 366258 - DNA, 25 bp, Mus musculus
tctcgaacctggaacaaggcctgag

SEQ ID NO: 366259 - DNA, 25 bp, Mus musculus
tctcgaacgtgccacggtcagggaa

SEQ ID NO: 366260 - DNA, 25 bp, Mus musculus
tctcgaagattccccccagctggtg

SEQ ID NO: 366261 - DNA, 25 bp, Mus musculus
tctcgacacaatacaaaagaaagaa

SEQ ID NO: 366262 - DNA, 25 bp, Mus musculus
tctcgacagcgcggagacgcgtggc

SEQ ID NO: 366263 - DNA, 25 bp, Mus musculus
tctcgacatagatatcccaatgtct

SEQ ID NO: 366264 - DNA, 25 bp, Mus musculus
tctcgacataggtgcactgcatcag

SEQ ID NO: 366265 - DNA, 25 bp, Mus musculus
tctcgacctttgaatgatagagaca

SEQ ID NO: 366266 - DNA, 25 bp, Mus musculus
tctcgactcattaaagagtggccga

SEQ ID NO: 366267 - DNA, 25 bp, Mus musculus
tctcgactgagggtccaaaccttgt

SEQ ID NO: 366268 - DNA, 25 bp, Mus musculus
tctcgagggaaagtgtccacagaca

SEQ ID NO: 366269 - DNA, 25 bp, Mus musculus
tctcgataataagatcagcaccagt

SEQ ID NO: 366270 - DNA, 25 bp, Mus musculus
tctcgcacagcatgatcaacaggcc

SEQ ID NO: 366271 - DNA, 25 bp, Mus musculus
tctcgcacaggacctaaagattgtc

SEQ ID NO: 366272 - DNA, 25 bp, Mus musculus
tctcgcagaaagtgggtttcccgtc

SEQ ID NO: 366273 - DNA, 25 bp, Mus musculus
tctcgcagaggagttagcgacgccg

SEQ ID NO: 366274 - DNA, 25 bp, Mus musculus
tctcgcatgaaggagatcttggaca

SEQ ID NO: 366275 - DNA, 25 bp, Mus musculus
tctcgccggcagctcttcctcccct

SEQ ID NO: 366276 - DNA, 25 bp, Mus musculus
tctcgccggcagggttgggatcaca

SEQ ID NO: 366277 - DNA, 25 bp, Mus musculus
tctcgcctgtggttggtgacaaaca

SEQ ID NO: 366278 - DNA, 25 bp, Mus musculus
tctcgcgccagaggaaggtgggagt

SEQ ID NO: 366279 - DNA, 25 bp, Mus musculus
tctcgcgccagagtttgtgatcctg

SEQ ID NO: 366280 - DNA, 25 bp, Mus musculus
tctcgcggcctgcagatcttgaacc

SEQ ID NO: 366281 - DNA, 25 bp, Mus musculus
tctcgcggcctgcagcacatcttca

SEQ ID NO: 366282 - DNA, 25 bp, Mus musculus
tctcgctattcagattcttctggaa

SEQ ID NO: 366283 - DNA, 25 bp, Mus musculus
tctcgctgctataggcatgaaagaa

SEQ ID NO: 366284 - DNA, 25 bp, Mus musculus
tctcgctgctataggctactattgg

SEQ ID NO: 366285 - DNA, 25 bp, Mus musculus
tctcgctgggaaatctacaaaatgg

SEQ ID NO: 366286 - DNA, 25 bp, Mus musculus
tctcgctggtttgcgctccctccaa

SEQ ID NO: 366287 - DNA, 25 bp, Mus musculus
tctcggaagtgaactcaaagacaga

SEQ ID NO: 366288 - DNA, 25 bp, Mus musculus
tctcggacaggagagtgaagtgtgt

SEQ ID NO: 366289 - DNA, 25 bp, Mus musculus
tctcggacgcaggctcagcttcttt

SEQ ID NO: 366290 - DNA, 25 bp, Mus musculus
tctcggacgcagggaaggtagtgtg

SEQ ID NO: 366291 - DNA, 25 bp, Mus musculus
tctcggacgtagaaggcctctttga

SEQ ID NO: 366292 - DNA, 25 bp, Mus musculus
tctcggaggaagcaccactgccgaa

SEQ ID NO: 366293 - DNA, 25 bp, Mus musculus
tctcggataggagatgtttgagaca

SEQ ID NO: 366294 - DNA, 25 bp, Mus musculus
tctcggcaggccgtttagggacgcg

SEQ ID NO: 366295 - DNA, 25 bp, Mus musculus
tctcggcccacgaggatcgtctgaa

SEQ ID NO: 366296 - DNA, 25 bp, Mus musculus
tctcggcctcatcctggtgacatct

SEQ ID NO: 366297 - DNA, 25 bp, Mus musculus
tctcggccttgccaggaaaatacta

SEQ ID NO: 366298 - DNA, 25 bp, Mus musculus
tctcggcgccagggagtccttgcca

SEQ ID NO: 366299 - DNA, 25 bp, Mus musculus
tctcggcgccaggggcagcttgact

SEQ ID NO: 366300 - DNA, 25 bp, Mus musculus
tctcggctcactgaggctggaccac

SEQ ID NO: 366301 - DNA, 25 bp, Mus musculus
tctcggctccgctagttctgacggt

SEQ ID NO: 366302 - DNA, 25 bp, Mus musculus
tctcggctccgctgccctgggccct

SEQ ID NO: 366303 - DNA, 25 bp, Mus musculus
tctcggcttccaaggttcctacttg

SEQ ID NO: 366304 - DNA, 25 bp, Mus musculus
tctcggcttccaagtctgttcttca

SEQ ID NO: 366305 - DNA, 25 bp, Mus musculus
tctcgggacggagatactactcgtc

SEQ ID NO: 366306 - DNA, 25 bp, Mus musculus
tctcgggacgggccctggtggtggc

SEQ ID NO: 366307 - DNA, 25 bp, Mus musculus
tctcgggacggttcaatgtatctat

SEQ ID NO: 366308 - DNA, 25 bp, Mus musculus
tctcgggcaaggacttagcattcag

SEQ ID NO: 366309 - DNA, 25 bp, Mus musculus
tctcgggtcgcaggaactggtgctc

SEQ ID NO: 366310 - DNA, 25 bp, Mus musculus
tctcggtaagagggggcccgtaagc

SEQ ID NO: 366311 - DNA, 25 bp, Mus musculus
tctcggtgaaagggattgaaattcc

SEQ ID NO: 366312 - DNA, 25 bp, Mus musculus
tctcggtgagcacgatgaaacggac

SEQ ID NO: 366313 - DNA, 25 bp, Mus musculus
tctcggtgcctggagactcctccac

SEQ ID NO: 366314 - DNA, 25 bp, Mus musculus
tctcggtgcctggagggtctcatta

SEQ ID NO: 366315 - DNA, 25 bp, Mus musculus
tctcggtggatcgaagtctgcttcc

SEQ ID NO: 366316 - DNA, 25 bp, Mus musculus
tctcgtacctgcatgattgccacaa

SEQ ID NO: 366317 - DNA, 25 bp, Mus musculus
tctcgtacctgcatgggtgaaagaa

SEQ ID NO: 366318 - DNA, 25 bp, Mus musculus
tctcgtcaagtgagccccaggccat

SEQ ID NO: 366319 - DNA, 25 bp, Mus musculus
tctcgtcacagataacatctggttg

SEQ ID NO: 366320 - DNA, 25 bp, Mus musculus
tctcgtcacaggaatggcggcccta

SEQ ID NO: 366321 - DNA, 25 bp, Mus musculus
tctcgtcctaggctaggcggccgtc

SEQ ID NO: 366322 - DNA, 25 bp, Mus musculus
tctcgtcctagggggagcttctgga

SEQ ID NO: 366323 - DNA, 25 bp, Mus musculus
tctcgtgaactggttaccaggcctg

SEQ ID NO: 366324 - DNA, 25 bp, Mus musculus
tctcgtggaggctgctctgacagtt

SEQ ID NO: 366325 - DNA, 25 bp, Mus musculus
tctcgtggatttccaggcagtagag

SEQ ID NO: 366326 - DNA, 25 bp, Mus musculus
tctcgtggatttccaggccgtggta

SEQ ID NO: 366327 - DNA, 25 bp, Mus musculus
tctcgtgggctgtgccggcattggc

SEQ ID NO: 366328 - DNA, 25 bp, Mus musculus
tctcgtggtggcccgagctgtggga

SEQ ID NO: 366329 - DNA, 25 bp, Mus musculus
tctcgtgtaaggatcttctgcctat

SEQ ID NO: 366330 - DNA, 25 bp, Mus musculus
tctcgttcagaatgtcatacccagg

SEQ ID NO: 366331 - DNA, 25 bp, Mus musculus
tctcgttcaggttagccagtacacc

SEQ ID NO: 366332 - DNA, 25 bp, Mus musculus
tctctaaaacaagagatttgaagtt

SEQ ID NO: 366333 - DNA, 25 bp, Mus musculus
tctctaaaactgaagcaccttcagg

SEQ ID NO: 366334 - DNA, 25 bp, Mus musculus
tctctaaaacttctatcatcctgaa

SEQ ID NO: 366335 - DNA, 25 bp, Mus musculus
tctctaaaagatttgtccataagaa

SEQ ID NO: 366336 - DNA, 25 bp, Mus musculus
tctctaaattccaagccatcttctc

SEQ ID NO: 366337 - DNA, 25 bp, Mus musculus
tctctaacacccttatttagaagtc

SEQ ID NO: 366338 - DNA, 25 bp, Mus musculus
tctctaaccagctccacttgagcag

SEQ ID NO: 366339 - DNA, 25 bp, Mus musculus
tctctaaccagctcgacttgagcag

SEQ ID NO: 366340 - DNA, 25 bp, Mus musculus
tctctaacctggccctctgctgttt

SEQ ID NO: 366341 - DNA, 25 bp, Mus musculus
tctctaaggatggtcctgcccccgc

SEQ ID NO: 366342 - DNA, 25 bp, Mus musculus
tctctaataaagcaaggagtaaata

SEQ ID NO: 366343 - DNA, 25 bp, Mus musculus
tctctaataaaggatatggtggtga

SEQ ID NO: 366344 - DNA, 25 bp, Mus musculus
tctctaatttttcaggtgccgactt

SEQ ID NO: 366345 - DNA, 25 bp, Mus musculus
tctctacaaaaagattgaagacctg

SEQ ID NO: 366346 - DNA, 25 bp, Mus musculus
tctctacaaatgataaaactattaa

SEQ ID NO: 366347 - DNA, 25 bp, Mus musculus
tctctacacaggaaatccaccttcc

SEQ ID NO: 366348 - DNA, 25 bp, Mus musculus
tctctacacaggctgacaagaaaac

SEQ ID NO: 366349 - DNA, 25 bp, Mus musculus
tctctacacatccttgctgaggatc

SEQ ID NO: 366350 - DNA, 25 bp, Mus musculus
tctctacacatcctttaaaaagtat

SEQ ID NO: 366351 - DNA, 25 bp, Mus musculus
tctctacagattcctgcggaacatc

SEQ ID NO: 366352 - DNA, 25 bp, Mus musculus
tctctacagccctcagccaaacagg

SEQ ID NO: 366353 - DNA, 25 bp, Mus musculus
tctctacagctcagatgtttttacc

SEQ ID NO: 366354 - DNA, 25 bp, Mus musculus
tctctacaggtagggacccgaaagt

SEQ ID NO: 366355 - DNA, 25 bp, Mus musculus
tctctaccaggtctgtcacctaaag

SEQ ID NO: 366356 - DNA, 25 bp, Mus musculus
tctctaccccatttggtgacttcat

SEQ ID NO: 366357 - DNA, 25 bp, Mus musculus
tctctaccccatttggtgatctgaa

SEQ ID NO: 366358 - DNA, 25 bp, Mus musculus
tctctacctgcaggcagcctgatct

SEQ ID NO: 366359 - DNA, 25 bp, Mus musculus
tctctacggatggaggaatcacttg

SEQ ID NO: 366360 - DNA, 25 bp, Mus musculus
tctctactgcctacaagaagactca

SEQ ID NO: 366361 - DNA, 25 bp, Mus musculus
tctctactgcctatgtgaaaacgtc

SEQ ID NO: 366362 - DNA, 25 bp, Mus musculus
tctctagaaaagttgaaatactgga

SEQ ID NO: 366363 - DNA, 25 bp, Mus musculus
tctctagaactgaactcattataca

SEQ ID NO: 366364 - DNA, 25 bp, Mus musculus
tctctagatagggtgagcgtggaca

SEQ ID NO: 366365 - DNA, 25 bp, Mus musculus
tctctagcacaggttggtctggggt

SEQ ID NO: 366366 - DNA, 25 bp, Mus musculus
tctctagcagccctacgttcttcca

SEQ ID NO: 366367 - DNA, 25 bp, Mus musculus
tctctagcctaagttctgagaagtc

SEQ ID NO: 366368 - DNA, 25 bp, Mus musculus
tctctagcctcccaggtggaatgaa

SEQ ID NO: 366369 - DNA, 25 bp, Mus musculus
tctctagctgaagtgagcaaaccaa

SEQ ID NO: 366370 - DNA, 25 bp, Mus musculus
tctctataaaaagaaaaatattaca

SEQ ID NO: 366371 - DNA, 25 bp, Mus musculus
tctctatagtccaggacagccaggg

SEQ ID NO: 366372 - DNA, 25 bp, Mus musculus
tctctatataaagacactccgtggt

SEQ ID NO: 366373 - DNA, 25 bp, Mus musculus
tctctatcaaaggttgccgaggctg

SEQ ID NO: 366374 - DNA, 25 bp, Mus musculus
tctctatgagaatagagcacagtca

SEQ ID NO: 366375 - DNA, 25 bp, Mus musculus
tctctatgagggaaattgacttcta

SEQ ID NO: 366376 - DNA, 25 bp, Mus musculus
tctctatgctgtggtttgccactag

SEQ ID NO: 366377 - DNA, 25 bp, Mus musculus
tctctatggaagaggaatcttcaaa

SEQ ID NO: 366378 - DNA, 25 bp, Mus musculus
tctctatgtactcaggatatgctgt

SEQ ID NO: 366379 - DNA, 25 bp, Mus musculus
tctctatgtactcagggggaaaatg

SEQ ID NO: 366380 - DNA, 25 bp, Mus musculus
tctctattaaaagatgacttacagg

SEQ ID NO: 366381 - DNA, 25 bp, Mus musculus
tctctattaaaagctcttttggaag

SEQ ID NO: 366382 - DNA, 25 bp, Mus musculus
tctctcaaaggatcctgctggccgt

SEQ ID NO: 366383 - DNA, 25 bp, Mus musculus
tctctcaaaggatgacatttgcacc

SEQ ID NO: 366384 - DNA, 25 bp, Mus musculus
tctctcaaagtcaagctgaacaggg

SEQ ID NO: 366385 - DNA, 25 bp, Mus musculus
tctctcaagacctcttctagaaaac

SEQ ID NO: 366386 - DNA, 25 bp, Mus musculus
tctctcaatgctgtatgcccagctg

SEQ ID NO: 366387 - DNA, 25 bp, Mus musculus
tctctcaatggtgtatgcccagctg

SEQ ID NO: 366388 - DNA, 25 bp, Mus musculus
tctctcacactcaggggacaattca

SEQ ID NO: 366389 - DNA, 25 bp, Mus musculus
tctctcacatggagaaactgctgtc

SEQ ID NO: 366390 - DNA, 25 bp, Mus musculus
tctctcaccggcagaggctgaaggc

SEQ ID NO: 366391 - DNA, 25 bp, Mus musculus
tctctcacctcaatgaggacaataa

SEQ ID NO: 366392 - DNA, 25 bp, Mus musculus
tctctcactgtcaggaagttggtgt

SEQ ID NO: 366393 - DNA, 25 bp, Mus musculus
tctctcagcagattccaaaggctgg

SEQ ID NO: 366394 - DNA, 25 bp, Mus musculus
tctctcagcaggccttgagcctccc

SEQ ID NO: 366395 - DNA, 25 bp, Mus musculus
tctctcagcgcatctcctccctcac

SEQ ID NO: 366396 - DNA, 25 bp, Mus musculus
tctctcaggaccaggtagattccat

SEQ ID NO: 366397 - DNA, 25 bp, Mus musculus
tctctcaggcaccaggttcctccaa

SEQ ID NO: 366398 - DNA, 25 bp, Mus musculus
tctctcaggtcccagagaccagagg

SEQ ID NO: 366399 - DNA, 25 bp, Mus musculus
tctctcaggtcccaggctgtgtccc

SEQ ID NO: 366400 - DNA, 25 bp, Mus musculus
tctctcataaagccctttctgacat

SEQ ID NO: 366401 - DNA, 25 bp, Mus musculus
tctctcatagccagggttcagccga

SEQ ID NO: 366402 - DNA, 25 bp, Mus musculus
tctctcatagggaactttcaagttg

SEQ ID NO: 366403 - DNA, 25 bp, Mus musculus
tctctcatcagcatccgccaccacg

SEQ ID NO: 366404 - DNA, 25 bp, Mus musculus
tctctcatgagtctggcgaacactc

SEQ ID NO: 366405 - DNA, 25 bp, Mus musculus
tctctcatgctagttcagcaatcag

SEQ ID NO: 366406 - DNA, 25 bp, Mus musculus
tctctcattgctcgagtttgtgaca

SEQ ID NO: 366407 - DNA, 25 bp, Mus musculus
tctctcatttttcgctcccagacct

SEQ ID NO: 366408 - DNA, 25 bp, Mus musculus
tctctccaaagtacttgggagacag

SEQ ID NO: 366409 - DNA, 25 bp, Mus musculus
tctctccagcagaactaaagaacgc

SEQ ID NO: 366410 - DNA, 25 bp, Mus musculus
tctctccagccaggatgtgatggtg

SEQ ID NO: 366411 - DNA, 25 bp, Mus musculus
tctctccagccaggctgcttctgat

SEQ ID NO: 366412 - DNA, 25 bp, Mus musculus
tctctccagccagtgaggatcccat

SEQ ID NO: 366413 - DNA, 25 bp, Mus musculus
tctctccagccatatctggcaccaa

SEQ ID NO: 366414 - DNA, 25 bp, Mus musculus
tctctccagccccagaacaaggaat

SEQ ID NO: 366415 - DNA, 25 bp, Mus musculus
tctctccaggctctacttctgttca

SEQ ID NO: 366416 - DNA, 25 bp, Mus musculus
tctctccaggctctgggaccctgaa

SEQ ID NO: 366417 - DNA, 25 bp, Mus musculus
tctctccagtggtggatgtgaagaa

SEQ ID NO: 366418 - DNA, 25 bp, Mus musculus
tctctccataaggtggcccacgcgc

SEQ ID NO: 366419 - DNA, 25 bp, Mus musculus
tctctccatcaggtttctttcttgt

SEQ ID NO: 366420 - DNA, 25 bp, Mus musculus
tctctccattcaggcacagatgctt

SEQ ID NO: 366421 - DNA, 25 bp, Mus musculus
tctctccattcaggtagtgactgca

SEQ ID NO: 366422 - DNA, 25 bp, Mus musculus
tctctccccatgactgacttggaca

SEQ ID NO: 366423 - DNA, 25 bp, Mus musculus
tctctccctcgcagttcttgaacac

SEQ ID NO: 366424 - DNA, 25 bp, Mus musculus
tctctccgacccgggcaggagctgg

SEQ ID NO: 366425 - DNA, 25 bp, Mus musculus
tctctcctaaaaggattgcaaaagt

SEQ ID NO: 366426 - DNA, 25 bp, Mus musculus
tctctcctaactcaggtgaggcaca

SEQ ID NO: 366427 - DNA, 25 bp, Mus musculus
tctctcctaactggtcagtaccatg

SEQ ID NO: 366428 - DNA, 25 bp, Mus musculus
tctctcctctgaaggctagccctgc

SEQ ID NO: 366429 - DNA, 25 bp, Mus musculus
tctctcctgagagagaacttgccga

SEQ ID NO: 366430 - DNA, 25 bp, Mus musculus
tctctcctgagagagaggtgcaggc

SEQ ID NO: 366431 - DNA, 25 bp, Mus musculus
tctctcctggccacgaaacactctc

SEQ ID NO: 366432 - DNA, 25 bp, Mus musculus
tctctccttggtcacgcccgggtct

SEQ ID NO: 366433 - DNA, 25 bp, Mus musculus
tctctcgaaaggttctgtacctcac

SEQ ID NO: 366434 - DNA, 25 bp, Mus musculus
tctctcgaagattccccccagctgg

SEQ ID NO: 366435 - DNA, 25 bp, Mus musculus
tctctcgccggcagctcttcctccc

SEQ ID NO: 366436 - DNA, 25 bp, Mus musculus
tctctcgccggcagggttgggatca

SEQ ID NO: 366437 - DNA, 25 bp, Mus musculus
tctctcggaagtgaactcaaagaca

SEQ ID NO: 366438 - DNA, 25 bp, Mus musculus
tctctcggcagagtcattcccgagc

SEQ ID NO: 366439 - DNA, 25 bp, Mus musculus
tctctcggcaggcctggctgagagg

SEQ ID NO: 366440 - DNA, 25 bp, Mus musculus
tctctcggcgccagggagtccttgc

SEQ ID NO: 366441 - DNA, 25 bp, Mus musculus
tctctcggcgccaggggcagcttga

SEQ ID NO: 366442 - DNA, 25 bp, Mus musculus
tctctcggctccgctagttctgacg

SEQ ID NO: 366443 - DNA, 25 bp, Mus musculus
tctctcggctccgctgccctgggcc

SEQ ID NO: 366444 - DNA, 25 bp, Mus musculus
tctctcgtcaagtgagccccaggcc

SEQ ID NO: 366445 - DNA, 25 bp, Mus musculus
tctctctacagccctcagccaaaca

SEQ ID NO: 366446 - DNA, 25 bp, Mus musculus
tctctctaccctcctgctgactggg

SEQ ID NO: 366447 - DNA, 25 bp, Mus musculus
tctctctagaaaagttgaaatactg

SEQ ID NO: 366448 - DNA, 25 bp, Mus musculus
tctctctagcctaagttctgagaag

SEQ ID NO: 366449 - DNA, 25 bp, Mus musculus
tctctctatgagggaaattgacttc

SEQ ID NO: 366450 - DNA, 25 bp, Mus musculus
tctctctcagcatacgaaggacaac

SEQ ID NO: 366451 - DNA, 25 bp, Mus musculus
tctctctcaggcacttgtggaatgg

SEQ ID NO: 366452 - DNA, 25 bp, Mus musculus
tctctctcaggcgtggaggaggtgc

SEQ ID NO: 366453 - DNA, 25 bp, Mus musculus
tctctctccagataatctggaggct

SEQ ID NO: 366454 - DNA, 25 bp, Mus musculus
tctctctccagcgcctgtattatgt

SEQ ID NO: 366455 - DNA, 25 bp, Mus musculus
tctctctccagggagtgttcctgta

SEQ ID NO: 366456 - DNA, 25 bp, Mus musculus
tctctctccagtacccccacttcct

SEQ ID NO: 366457 - DNA, 25 bp, Mus musculus
tctctctccataaggtggcccacgc

SEQ ID NO: 366458 - DNA, 25 bp, Mus musculus
tctctctcctgagagagaacttgcc

SEQ ID NO: 366459 - DNA, 25 bp, Mus musculus
tctctctcctgagagagaggtgcag

SEQ ID NO: 366460 - DNA, 25 bp, Mus musculus
tctctctctccagataatctggagg

SEQ ID NO: 366461 - DNA, 25 bp, Mus musculus
tctctctctctccagataatctgga

SEQ ID NO: 366462 - DNA, 25 bp, Mus musculus
tctctctctctttgatgggggaacc

SEQ ID NO: 366463 - DNA, 25 bp, Mus musculus
tctctctctgtgagagccaaagact

SEQ ID NO: 366464 - DNA, 25 bp, Mus musculus
tctctctctgtggaggtgaagccgg

SEQ ID NO: 366465 - DNA, 25 bp, Mus musculus
tctctctcttacagatcaagatctt

SEQ ID NO: 366466 - DNA, 25 bp, Mus musculus
tctctctcttacaggcactacagac

SEQ ID NO: 366467 - DNA, 25 bp, Mus musculus
tctctctctttgatgggggaaccag

SEQ ID NO: 366468 - DNA, 25 bp, Mus musculus
tctctctgaaaccaggttccacagc

SEQ ID NO: 366469 - DNA, 25 bp, Mus musculus
tctctctgacaccagtggcagtgaa

SEQ ID NO: 366470 - DNA, 25 bp, Mus musculus
tctctctgcaagatcatgctgggag

SEQ ID NO: 366471 - DNA, 25 bp, Mus musculus
tctctctgcaggtcaggaatctacc

SEQ ID NO: 366472 - DNA, 25 bp, Mus musculus
tctctctgcaggttaatatccgaca

SEQ ID NO: 366473 - DNA, 25 bp, Mus musculus
tctctctggaccctactttcaggct

SEQ ID NO: 366474 - DNA, 25 bp, Mus musculus
tctctctggcagggatggaagactg

SEQ ID NO: 366475 - DNA, 25 bp, Mus musculus
tctctctggctgagtgactgggtga

SEQ ID NO: 366476 - DNA, 25 bp, Mus musculus
tctctctgtctggtatctatcctgt

SEQ ID NO: 366477 - DNA, 25 bp, Mus musculus
tctctctgtgagagccaaagactct

SEQ ID NO: 366478 - DNA, 25 bp, Mus musculus
tctctcttacagatcaagatcttag

SEQ ID NO: 366479 - DNA, 25 bp, Mus musculus
tctctcttacaggcactacagactc

SEQ ID NO: 366480 - DNA, 25 bp, Mus musculus
tctctcttccatgtctcccatcagc

SEQ ID NO: 366481 - DNA, 25 bp, Mus musculus
tctctctttgtagggactacaagaa

SEQ ID NO: 366482 - DNA, 25 bp, Mus musculus
tctctgaaaccaggttccacagcac

SEQ ID NO: 366483 - DNA, 25 bp, Mus musculus
tctctgaaactgatgcagtgaccta

SEQ ID NO: 366484 - DNA, 25 bp, Mus musculus
tctctgaaagttctcctgtctatct

SEQ ID NO: 366485 - DNA, 25 bp, Mus musculus
tctctgaaccaggttatgaaaatga

SEQ ID NO: 366486 - DNA, 25 bp, Mus musculus
tctctgaacctgttccagctacggt

SEQ ID NO: 366487 - DNA, 25 bp, Mus musculus
tctctgaactgtttgatcacattcc

SEQ ID NO: 366488 - DNA, 25 bp, Mus musculus
tctctgaagaagtcttagggaaagt

SEQ ID NO: 366489 - DNA, 25 bp, Mus musculus
tctctgaagaatgcaccaccaaaaa

SEQ ID NO: 366490 - DNA, 25 bp, Mus musculus
tctctgaagcaggacctggagttgc

SEQ ID NO: 366491 - DNA, 25 bp, Mus musculus
tctctgacaaatcgccagtacctac

SEQ ID NO: 366492 - DNA, 25 bp, Mus musculus
tctctgacaaattctctccagaggc

SEQ ID NO: 366493 - DNA, 25 bp, Mus musculus
tctctgacaagaaggaaatgttgtc

SEQ ID NO: 366494 - DNA, 25 bp, Mus musculus
tctctgacaccagtggcagtgaacc

SEQ ID NO: 366495 - DNA, 25 bp, Mus musculus
tctctgacaggtgtccccagaactg

SEQ ID NO: 366496 - DNA, 25 bp, Mus musculus
tctctgacatggaggatatgctgtc

SEQ ID NO: 366497 - DNA, 25 bp, Mus musculus
tctctgaccctgaatcgtccttgga

SEQ ID NO: 366498 - DNA, 25 bp, Mus musculus
tctctgaccgggactttgaatatgt

SEQ ID NO: 366499 - DNA, 25 bp, Mus musculus
tctctgactcagattccaccataga

SEQ ID NO: 366500 - DNA, 25 bp, Mus musculus
tctctgacttaccagctgggaaggg

SEQ ID NO: 366501 - DNA, 25 bp, Mus musculus
tctctgacttagagaagagtgggaa

SEQ ID NO: 366502 - DNA, 25 bp, Mus musculus
tctctgacttagaggaaatgctgtc

SEQ ID NO: 366503 - DNA, 25 bp, Mus musculus
tctctgagaaactgatctctcacct

SEQ ID NO: 366504 - DNA, 25 bp, Mus musculus
tctctgagagaaggtggagcagccc

SEQ ID NO: 366505 - DNA, 25 bp, Mus musculus
tctctgagatcacaggggacctcag

SEQ ID NO: 366506 - DNA, 25 bp, Mus musculus
tctctgagatctcagtccaagaaag

SEQ ID NO: 366507 - DNA, 25 bp, Mus musculus
tctctgagatctcagtgctgatctg

SEQ ID NO: 366508 - DNA, 25 bp, Mus musculus
tctctgagcagtggtagtgtgaagc

SEQ ID NO: 366509 - DNA, 25 bp, Mus musculus
tctctgagcgtgccttcatcaagta

SEQ ID NO: 366510 - DNA, 25 bp, Mus musculus
tctctgaggaagagacactccagca

SEQ ID NO: 366511 - DNA, 25 bp, Mus musculus
tctctgaggaagaggacttttgggg

SEQ ID NO: 366512 - DNA, 25 bp, Mus musculus
tctctgaggggagcttttcccagtc

SEQ ID NO: 366513 - DNA, 25 bp, Mus musculus
tctctgatattagggaggtgcccct

SEQ ID NO: 366514 - DNA, 25 bp, Mus musculus
tctctgattcatcagacacctgctg

SEQ ID NO: 366515 - DNA, 25 bp, Mus musculus
tctctgattcatgagccatcaaaga

SEQ ID NO: 366516 - DNA, 25 bp, Mus musculus
tctctgattgctgtggacagacgcc

SEQ ID NO: 366517 - DNA, 25 bp, Mus musculus
tctctgcaagaaaaggcaagagctg

SEQ ID NO: 366518 - DNA, 25 bp, Mus musculus
tctctgcaagaggtgttgtcggaat

SEQ ID NO: 366519 - DNA, 25 bp, Mus musculus
tctctgcaagatcaagacagctgca

SEQ ID NO: 366520 - DNA, 25 bp, Mus musculus
tctctgcaagatcatgctgggagat

SEQ ID NO: 366521 - DNA, 25 bp, Mus musculus
tctctgcaagtggccctgccgcctg

SEQ ID NO: 366522 - DNA, 25 bp, Mus musculus
tctctgcaatataaggcacaatgga

SEQ ID NO: 366523 - DNA, 25 bp, Mus musculus
tctctgcagaagtttgatggtgaca

SEQ ID NO: 366524 - DNA, 25 bp, Mus musculus
tctctgcaggggaggacatagtcga

SEQ ID NO: 366525 - DNA, 25 bp, Mus musculus
tctctgcaggggaggctttgctaca

SEQ ID NO: 366526 - DNA, 25 bp, Mus musculus
tctctgcagtgctatggggcatgga

SEQ ID NO: 366527 - DNA, 25 bp, Mus musculus
tctctgcattctgggagcctagggc

SEQ ID NO: 366528 - DNA, 25 bp, Mus musculus
tctctgccaaacacaccagaaggga

SEQ ID NO: 366529 - DNA, 25 bp, Mus musculus
tctctgccaacattgtcctcgtaaa

SEQ ID NO: 366530 - DNA, 25 bp, Mus musculus
tctctgccagctttgtttactagcg

SEQ ID NO: 366531 - DNA, 25 bp, Mus musculus
tctctgccagtggaccctcatgacc

SEQ ID NO: 366532 - DNA, 25 bp, Mus musculus
tctctgccagtggacgactctcagg

SEQ ID NO: 366533 - DNA, 25 bp, Mus musculus
tctctgcccactcagccagttgtca

SEQ ID NO: 366534 - DNA, 25 bp, Mus musculus
tctctgcccatgtgatcatgattct

SEQ ID NO: 366535 - DNA, 25 bp, Mus musculus
tctctgcctgaaggtttgacttcat

SEQ ID NO: 366536 - DNA, 25 bp, Mus musculus
tctctgcctggcccgatttcccgcc

SEQ ID NO: 366537 - DNA, 25 bp, Mus musculus
tctctgcctgtaacggagactctgg

SEQ ID NO: 366538 - DNA, 25 bp, Mus musculus
tctctgcctgtcaggaccgaataaa

SEQ ID NO: 366539 - DNA, 25 bp, Mus musculus
tctctgcctgtcagtgaagctggct

SEQ ID NO: 366540 - DNA, 25 bp, Mus musculus
tctctgcctgtttttgagccacgtg

SEQ ID NO: 366541 - DNA, 25 bp, Mus musculus
tctctgccttctctgggttccctgg

SEQ ID NO: 366542 - DNA, 25 bp, Mus musculus
tctctgcgaaaaagggatgactgag

SEQ ID NO: 366543 - DNA, 25 bp, Mus musculus
tctctgcgcagatgttgatgagtgt

SEQ ID NO: 366544 - DNA, 25 bp, Mus musculus
tctctgcgcggttgactcttcacca

SEQ ID NO: 366545 - DNA, 25 bp, Mus musculus
tctctgctacacagcctcttgccag

SEQ ID NO: 366546 - DNA, 25 bp, Mus musculus
tctctgctacctgaattttgtgcca

SEQ ID NO: 366547 - DNA, 25 bp, Mus musculus
tctctgctattgcagaggtggcttt

SEQ ID NO: 366548 - DNA, 25 bp, Mus musculus
tctctgctattgcaggtttcctggc

SEQ ID NO: 366549 - DNA, 25 bp, Mus musculus
tctctgctcaggaagaacgttggtg

SEQ ID NO: 366550 - DNA, 25 bp, Mus musculus
tctctgctgacctgggcacacatga

SEQ ID NO: 366551 - DNA, 25 bp, Mus musculus
tctctgctgcaggatgctgccaagg

SEQ ID NO: 366552 - DNA, 25 bp, Mus musculus
tctctgctgcggtcatgtaggaaat

SEQ ID NO: 366553 - DNA, 25 bp, Mus musculus
tctctgcttgaggaagaagctcact

SEQ ID NO: 366554 - DNA, 25 bp, Mus musculus
tctctgctttcctgggaaggtgtga

SEQ ID NO: 366555 - DNA, 25 bp, Mus musculus
tctctggaaaccaggaagtgagtgc

SEQ ID NO: 366556 - DNA, 25 bp, Mus musculus
tctctggaaaccaggagaacagtac

SEQ ID NO: 366557 - DNA, 25 bp, Mus musculus
tctctggaagattaggtcagagacc

SEQ ID NO: 366558 - DNA, 25 bp, Mus musculus
tctctggaagggtttctctgtatag

SEQ ID NO: 366559 - DNA, 25 bp, Mus musculus
tctctggaaggtgagcctcagggac

SEQ ID NO: 366560 - DNA, 25 bp, Mus musculus
tctctggaagtcctagtcactcgag

SEQ ID NO: 366561 - DNA, 25 bp, Mus musculus
tctctggaccctactttcaggctga

SEQ ID NO: 366562 - DNA, 25 bp, Mus musculus
tctctggagattgtcctgctttaag

SEQ ID NO: 366563 - DNA, 25 bp, Mus musculus
tctctggagggagagacgtgaaaaa

SEQ ID NO: 366564 - DNA, 25 bp, Mus musculus
tctctggcagaatccatgcgacgat

SEQ ID NO: 366565 - DNA, 25 bp, Mus musculus
tctctggcagcgaaattggaacagc

SEQ ID NO: 366566 - DNA, 25 bp, Mus musculus
tctctggcagggatggaagactgtg

SEQ ID NO: 366567 - DNA, 25 bp, Mus musculus
tctctggccacaggaaatcgagagg

SEQ ID NO: 366568 - DNA, 25 bp, Mus musculus
tctctggccacgggaaatcgagagg

SEQ ID NO: 366569 - DNA, 25 bp, Mus musculus
tctctggcgttattgctgtctcccc

SEQ ID NO: 366570 - DNA, 25 bp, Mus musculus
tctctggcttcctcccgaggccgag

SEQ ID NO: 366571 - DNA, 25 bp, Mus musculus
tctctgggacgcttggtaaagcgtt

SEQ ID NO: 366572 - DNA, 25 bp, Mus musculus
tctctgggattaacctggatcctga

SEQ ID NO: 366573 - DNA, 25 bp, Mus musculus
tctctggggtctggccaaagatctc

SEQ ID NO: 366574 - DNA, 25 bp, Mus musculus
tctctggggtctggtcagaaagaca

SEQ ID NO: 366575 - DNA, 25 bp, Mus musculus
tctctgggtctggaggtttgaggct

SEQ ID NO: 366576 - DNA, 25 bp, Mus musculus
tctctggtaacagaagaaaagatgt

SEQ ID NO: 366577 - DNA, 25 bp, Mus musculus
tctctggtttgcctcctgaataaaa

SEQ ID NO: 366578 - DNA, 25 bp, Mus musculus
tctctgtaaaagggtgtctttaaga

SEQ ID NO: 366579 - DNA, 25 bp, Mus musculus
tctctgtaagttctccctgttcact

SEQ ID NO: 366580 - DNA, 25 bp, Mus musculus
tctctgtacgcatgtgacaccagac

SEQ ID NO: 366581 - DNA, 25 bp, Mus musculus
tctctgtatatcatgcatccatttt

SEQ ID NO: 366582 - DNA, 25 bp, Mus musculus
tctctgtatcctcagttcatgttcc

SEQ ID NO: 366583 - DNA, 25 bp, Mus musculus
tctctgtatgtgactgtcctagagg

SEQ ID NO: 366584 - DNA, 25 bp, Mus musculus
tctctgtcaaggcggcccagaccag

SEQ ID NO: 366585 - DNA, 25 bp, Mus musculus
tctctgtccttgtcttatctcctct

SEQ ID NO: 366586 - DNA, 25 bp, Mus musculus
tctctgtccttttgcctttatcatg

SEQ ID NO: 366587 - DNA, 25 bp, Mus musculus
tctctgtcgggtaagcagctgctcc

SEQ ID NO: 366588 - DNA, 25 bp, Mus musculus
tctctgtctagggctgacggttgct

SEQ ID NO: 366589 - DNA, 25 bp, Mus musculus
tctctgtctccaggacacccaacac

SEQ ID NO: 366590 - DNA, 25 bp, Mus musculus
tctctgtctcggggaaaggttggaa

SEQ ID NO: 366591 - DNA, 25 bp, Mus musculus
tctctgtctcggggtgacaatagct

SEQ ID NO: 366592 - DNA, 25 bp, Mus musculus
tctctgtctggtatctatcctgttg

SEQ ID NO: 366593 - DNA, 25 bp, Mus musculus
tctctgtgagagccaaagactctgt

SEQ ID NO: 366594 - DNA, 25 bp, Mus musculus
tctctgtgagagggtatgtctcctg

SEQ ID NO: 366595 - DNA, 25 bp, Mus musculus
tctctgtgcagcacgatggcctggt

SEQ ID NO: 366596 - DNA, 25 bp, Mus musculus
tctctgtgcgcggcaatacagagtg

SEQ ID NO: 366597 - DNA, 25 bp, Mus musculus
tctctgtgctccaggctctcacagc

SEQ ID NO: 366598 - DNA, 25 bp, Mus musculus
tctctgtgctctcaggggactcctc

SEQ ID NO: 366599 - DNA, 25 bp, Mus musculus
tctctgtggaagagacctctgctaa

SEQ ID NO: 366600 - DNA, 25 bp, Mus musculus
tctctgtggcccaggttgctacagg

SEQ ID NO: 366601 - DNA, 25 bp, Mus musculus
tctctgtggcccagtcactggccgg

SEQ ID NO: 366602 - DNA, 25 bp, Mus musculus
tctctgtggttgagtacgtgaaggg

SEQ ID NO: 366603 - DNA, 25 bp, Mus musculus
tctctgtgtgatcaggagttcctct

SEQ ID NO: 366604 - DNA, 25 bp, Mus musculus
tctctgttattcagctaccactacc

SEQ ID NO: 366605 - DNA, 25 bp, Mus musculus
tctctgttattcaggctttcaccac

SEQ ID NO: 366606 - DNA, 25 bp, Mus musculus
tctctgttcagcccttcccacaaat

SEQ ID NO: 366607 - DNA, 25 bp, Mus musculus
tctctgttcaggatatgcagtacct

SEQ ID NO: 366608 - DNA, 25 bp, Mus musculus
tctctgttccgaggagaagcctaca

SEQ ID NO: 366609 - DNA, 25 bp, Mus musculus
tctctgttccgtcacagtcacgcca

SEQ ID NO: 366610 - DNA, 25 bp, Mus musculus
tctctgttggggcttcacacctacc

SEQ ID NO: 366611 - DNA, 25 bp, Mus musculus
tctctgtttgagtgatgagccggca

SEQ ID NO: 366612 - DNA, 25 bp, Mus musculus
tctctgttttctgttgagcggctgc

SEQ ID NO: 366613 - DNA, 25 bp, Mus musculus
tctcttaaaggagagcttgaacttg

SEQ ID NO: 366614 - DNA, 25 bp, Mus musculus
tctcttacaagaagagtaccagcct

SEQ ID NO: 366615 - DNA, 25 bp, Mus musculus
tctcttacagatcaagatcttagaa

SEQ ID NO: 366616 - DNA, 25 bp, Mus musculus
tctcttacaggcactacagactcga

SEQ ID NO: 366617 - DNA, 25 bp, Mus musculus
tctcttaccagtctccactcagcct

SEQ ID NO: 366618 - DNA, 25 bp, Mus musculus
tctcttagccccaggtgctgcagtc

SEQ ID NO: 366619 - DNA, 25 bp, Mus musculus
tctcttagtgagaagccagtggatg

SEQ ID NO: 366620 - DNA, 25 bp, Mus musculus
tctcttagtgataacaaagatactg

SEQ ID NO: 366621 - DNA, 25 bp, Mus musculus
tctcttcaagtgatagttctcagta

SEQ ID NO: 366622 - DNA, 25 bp, Mus musculus
tctcttcacaaccattcctggtctg

SEQ ID NO: 366623 - DNA, 25 bp, Mus musculus
tctcttcagcctgggctcagccatc

SEQ ID NO: 366624 - DNA, 25 bp, Mus musculus
tctcttcagctacctcagctttatg

SEQ ID NO: 366625 - DNA, 25 bp, Mus musculus
tctcttcaggagcggaggtacactg

SEQ ID NO: 366626 - DNA, 25 bp, Mus musculus
tctcttcaggagggggaacagacat

SEQ ID NO: 366627 - DNA, 25 bp, Mus musculus
tctcttcattgatgggcagacacgc

SEQ ID NO: 366628 - DNA, 25 bp, Mus musculus
tctcttccaagaggcaacaactgta

SEQ ID NO: 366629 - DNA, 25 bp, Mus musculus
tctcttccaccgcgccctgtctcac

SEQ ID NO: 366630 - DNA, 25 bp, Mus musculus
tctcttccagctaccactatgccgc

SEQ ID NO: 366631 - DNA, 25 bp, Mus musculus
tctcttccaggaatgtctcgaggca

SEQ ID NO: 366632 - DNA, 25 bp, Mus musculus
tctcttccatatgaggaaactgagg

SEQ ID NO: 366633 - DNA, 25 bp, Mus musculus
tctcttccatgtctcccatcagcag

SEQ ID NO: 366634 - DNA, 25 bp, Mus musculus
tctcttcccccagatgcctgtcggt

SEQ ID NO: 366635 - DNA, 25 bp, Mus musculus
tctcttcccgatttgcccatgaagc

SEQ ID NO: 366636 - DNA, 25 bp, Mus musculus
tctcttccctgtcctgaggccatgc

SEQ ID NO: 366637 - DNA, 25 bp, Mus musculus
tctcttccttacacatgatgaagat

SEQ ID NO: 366638 - DNA, 25 bp, Mus musculus
tctcttctagatcagccaccatgcg

SEQ ID NO: 366639 - DNA, 25 bp, Mus musculus
tctcttctcagggtctcagaatggc

SEQ ID NO: 366640 - DNA, 25 bp, Mus musculus
tctcttctgcccagccaccccgctg

SEQ ID NO: 366641 - DNA, 25 bp, Mus musculus
tctcttgatcagcaagccccgccca

SEQ ID NO: 366642 - DNA, 25 bp, Mus musculus
tctcttgcacaagttgatgggcagt

SEQ ID NO: 366643 - DNA, 25 bp, Mus musculus
tctcttggaggctgcaaaagacatt

SEQ ID NO: 366644 - DNA, 25 bp, Mus musculus
tctcttggctcagaaatcctacgaa

SEQ ID NO: 366645 - DNA, 25 bp, Mus musculus
tctcttggtgcagggtttgtggtag

SEQ ID NO: 366646 - DNA, 25 bp, Mus musculus
tctcttgtggatggcttcaagccag

SEQ ID NO: 366647 - DNA, 25 bp, Mus musculus
tctcttgttaggttcacctggagaa

SEQ ID NO: 366648 - DNA, 25 bp, Mus musculus
tctcttgttttacagatggctcatt

SEQ ID NO: 366649 - DNA, 25 bp, Mus musculus
tctcttgttttacaggtgtgtgtgg

SEQ ID NO: 366650 - DNA, 25 bp, Mus musculus
tctctttagtcccgatcatccaggt

SEQ ID NO: 366651 - DNA, 25 bp, Mus musculus
tctctttcaaattaattgtggtgag

SEQ ID NO: 366652 - DNA, 25 bp, Mus musculus
tctctttcagggagacatagcctct

SEQ ID NO: 366653 - DNA, 25 bp, Mus musculus
tctctttcaggtagagcttgagatg

SEQ ID NO: 366654 - DNA, 25 bp, Mus musculus
tctctttcagtatcctgtgcgtcct

SEQ ID NO: 366655 - DNA, 25 bp, Mus musculus
tctctttcatctcagatgtggtgaa

SEQ ID NO: 366656 - DNA, 25 bp, Mus musculus
tctctttccgggtgaacagagagat

SEQ ID NO: 366657 - DNA, 25 bp, Mus musculus
tctctttcctcgttgtttttgtttt

SEQ ID NO: 366658 - DNA, 25 bp, Mus musculus
tctctttgactccagctattcacgg

SEQ ID NO: 366659 - DNA, 25 bp, Mus musculus
tctctttgccaaggtgaacgtgaga

SEQ ID NO: 366660 - DNA, 25 bp, Mus musculus
tctctttgctgcgattatttgattc

SEQ ID NO: 366661 - DNA, 25 bp, Mus musculus
tctctttgctgcggcttcatagagc

SEQ ID NO: 366662 - DNA, 25 bp, Mus musculus
tctctttgcttgaatgggcctgtgt

SEQ ID NO: 366663 - DNA, 25 bp, Mus musculus
tctctttgtagggactacaagaaat

SEQ ID NO: 366664 - DNA, 25 bp, Mus musculus
tctcttttagaaagggggagctggt

SEQ ID NO: 366665 - DNA, 25 bp, Mus musculus
tctcttttaggatggacgacagagg

SEQ ID NO: 366666 - DNA, 25 bp, Mus musculus
tctcttttggactgggttttgccag

SEQ ID NO: 366667 - DNA, 25 bp, Mus musculus
tctctttttagtctctggaagactg

SEQ ID NO: 366668 - DNA, 25 bp, Mus musculus
tctctttttctcgaaagaaggattt

SEQ ID NO: 366669 - DNA, 25 bp, Mus musculus
tctcttttttgagattgagctcctt

SEQ ID NO: 366670 - DNA, 25 bp, Mus musculus
tctgaaaaagtcaccttaattttcc

SEQ ID NO: 366671 - DNA, 25 bp, Mus musculus
tctgaaaaatagtcacaaagcactt

SEQ ID NO: 366672 - DNA, 25 bp, Mus musculus
tctgaaaaatcaagaaatgtgcctg

SEQ ID NO: 366673 - DNA, 25 bp, Mus musculus
tctgaaaaatcaagttgtcactcag

SEQ ID NO: 366674 - DNA, 25 bp, Mus musculus
tctgaaaacgatgatggagctggtg

SEQ ID NO: 366675 - DNA, 25 bp, Mus musculus
tctgaaaataaaggtgcctcgtctc

SEQ ID NO: 366676 - DNA, 25 bp, Mus musculus
tctgaaaatttggaggcagcaccgg

SEQ ID NO: 366677 - DNA, 25 bp, Mus musculus
tctgaaacaccaggaacgggagcga

SEQ ID NO: 366678 - DNA, 25 bp, Mus musculus
tctgaaacaccaggagttggagagg

SEQ ID NO: 366679 - DNA, 25 bp, Mus musculus
tctgaaacagagatggctcccaagt

SEQ ID NO: 366680 - DNA, 25 bp, Mus musculus
tctgaaacagcctcaaggagaagct

SEQ ID NO: 366681 - DNA, 25 bp, Mus musculus
tctgaaacaggaaatccggctcatt

SEQ ID NO: 366682 - DNA, 25 bp, Mus musculus
tctgaaacaggtcctgcctaatcat

SEQ ID NO: 366683 - DNA, 25 bp, Mus musculus
tctgaaacataatcacagaactgtg

SEQ ID NO: 366684 - DNA, 25 bp, Mus musculus
tctgaaacatggtggtaagagaagc

SEQ ID NO: 366685 - DNA, 25 bp, Mus musculus
tctgaaaccacagaggaagcattct

SEQ ID NO: 366686 - DNA, 25 bp, Mus musculus
tctgaaaccacagcattctcatctt

SEQ ID NO: 366687 - DNA, 25 bp, Mus musculus
tctgaaaccacagctctagccaaga

SEQ ID NO: 366688 - DNA, 25 bp, Mus musculus
tctgaaaccagagtccagcttggta

SEQ ID NO: 366689 - DNA, 25 bp, Mus musculus
tctgaaaccaggagattggccggta

SEQ ID NO: 366690 - DNA, 25 bp, Mus musculus
tctgaaaccaggttccacagcactg

SEQ ID NO: 366691 - DNA, 25 bp, Mus musculus
tctgaaacccacagcatggtgagac

SEQ ID NO: 366692 - DNA, 25 bp, Mus musculus
tctgaaacccgctgtacgctggatt

SEQ ID NO: 366693 - DNA, 25 bp, Mus musculus
tctgaaacccggtagtgcaacttca

SEQ ID NO: 366694 - DNA, 25 bp, Mus musculus
tctgaaactgtagcttctttgttac

SEQ ID NO: 366695 - DNA, 25 bp, Mus musculus
tctgaaagaggatatcaagttcatt

SEQ ID NO: 366696 - DNA, 25 bp, Mus musculus
tctgaaagatagtaacaggagactg

SEQ ID NO: 366697 - DNA, 25 bp, Mus musculus
tctgaaagatattaccaggagactg

SEQ ID NO: 366698 - DNA, 25 bp, Mus musculus
tctgaaagtcaaaaggtctccagat

SEQ ID NO: 366699 - DNA, 25 bp, Mus musculus
tctgaaatacgattcagatggttac

SEQ ID NO: 366700 - DNA, 25 bp, Mus musculus
tctgaacactgaggggttcctggac

SEQ ID NO: 366701 - DNA, 25 bp, Mus musculus
tctgaacagcagctcccgttacttc

SEQ ID NO: 366702 - DNA, 25 bp, Mus musculus
tctgaacagcaggtcccaggattta

SEQ ID NO: 366703 - DNA, 25 bp, Mus musculus
tctgaaccagcctccagtccctggc

SEQ ID NO: 366704 - DNA, 25 bp, Mus musculus
tctgaaccaggttatgaaaatgact

SEQ ID NO: 366705 - DNA, 25 bp, Mus musculus
tctgaacctagtctctgtccagatt

SEQ ID NO: 366706 - DNA, 25 bp, Mus musculus
tctgaacctggctctggtagccgag

SEQ ID NO: 366707 - DNA, 25 bp, Mus musculus
tctgaactcagactactcgctgctg

SEQ ID NO: 366708 - DNA, 25 bp, Mus musculus
tctgaactgtttgatcacattccag

SEQ ID NO: 366709 - DNA, 25 bp, Mus musculus
tctgaagaacgggtatggctttgtg

SEQ ID NO: 366710 - DNA, 25 bp, Mus musculus
tctgaagaacggtctgttatgttct

SEQ ID NO: 366711 - DNA, 25 bp, Mus musculus
tctgaagaaggatgtggactgtgcc

SEQ ID NO: 366712 - DNA, 25 bp, Mus musculus
tctgaagaaggctccttcccctgag

SEQ ID NO: 366713 - DNA, 25 bp, Mus musculus
tctgaagaagtcttagggaaagttc

SEQ ID NO: 366714 - DNA, 25 bp, Mus musculus
tctgaagaatgcaccaccaaaaaag

SEQ ID NO: 366715 - DNA, 25 bp, Mus musculus
tctgaagaccccactcagagatgct

SEQ ID NO: 366716 - DNA, 25 bp, Mus musculus
tctgaagaccccactgactcatccc

SEQ ID NO: 366717 - DNA, 25 bp, Mus musculus
tctgaagaggaggtgctgggcccca

SEQ ID NO: 366718 - DNA, 25 bp, Mus musculus
tctgaagcagattcgctgcctgatg

SEQ ID NO: 366719 - DNA, 25 bp, Mus musculus
tctgaagcaggaagcaggaagcctg

SEQ ID NO: 366720 - DNA, 25 bp, Mus musculus
tctgaagcaggaaggaacagctcgg

SEQ ID NO: 366721 - DNA, 25 bp, Mus musculus
tctgaagcaggacctggagttgctg

SEQ ID NO: 366722 - DNA, 25 bp, Mus musculus
tctgaagcaggatctgaagaagaag

SEQ ID NO: 366723 - DNA, 25 bp, Mus musculus
tctgaagccagaggtacttgatgtg

SEQ ID NO: 366724 - DNA, 25 bp, Mus musculus
tctgaagcctggttccctcaacccc

SEQ ID NO: 366725 - DNA, 25 bp, Mus musculus
tctgaagcgagaccaccgtgggaaa

SEQ ID NO: 366726 - DNA, 25 bp, Mus musculus
tctgaagctcagaactttgccaatt

SEQ ID NO: 366727 - DNA, 25 bp, Mus musculus
tctgaaggagacccagcatgtgcag

SEQ ID NO: 366728 - DNA, 25 bp, Mus musculus
tctgaaggagatggcaattccggtc

SEQ ID NO: 366729 - DNA, 25 bp, Mus musculus
tctgaaggagccggcatgaccaaga

SEQ ID NO: 366730 - DNA, 25 bp, Mus musculus
tctgaaggcaagaagacagtaacca

SEQ ID NO: 366731 - DNA, 25 bp, Mus musculus
tctgaaggcactggcactacaagat

SEQ ID NO: 366732 - DNA, 25 bp, Mus musculus
tctgaaggcctggttctgcataagc

SEQ ID NO: 366733 - DNA, 25 bp, Mus musculus
tctgaagggcaaggaactaccgtgg

SEQ ID NO: 366734 - DNA, 25 bp, Mus musculus
tctgaagggcaaggtgctcatctgc

SEQ ID NO: 366735 - DNA, 25 bp, Mus musculus
tctgaagggcagagggatacagtac

SEQ ID NO: 366736 - DNA, 25 bp, Mus musculus
tctgaagggtataggcatcgcctcc

SEQ ID NO: 366737 - DNA, 25 bp, Mus musculus
tctgaagggtttgagagaatcgcac

SEQ ID NO: 366738 - DNA, 25 bp, Mus musculus
tctgaagtagcttgccacaagcttc

SEQ ID NO: 366739 - DNA, 25 bp, Mus musculus
tctgaagtcaccctgccagcaagaa

SEQ ID NO: 366740 - DNA, 25 bp, Mus musculus
tctgaagtgaaaaagtgccactgag

SEQ ID NO: 366741 - DNA, 25 bp, Mus musculus
tctgaagtgcaggaactctgcaaac

SEQ ID NO: 366742 - DNA, 25 bp, Mus musculus
tctgaagtgcaggtatcagggtggc

SEQ ID NO: 366743 - DNA, 25 bp, Mus musculus
tctgaagtggttctgaacacggtac

SEQ ID NO: 366744 - DNA, 25 bp, Mus musculus
tctgaatatccccaggtactgtgca

SEQ ID NO: 366745 - DNA, 25 bp, Mus musculus
tctgaatcacggagtcaaagtggac

SEQ ID NO: 366746 - DNA, 25 bp, Mus musculus
tctgaatcacgtgtcgagtgtccct

SEQ ID NO: 366747 - DNA, 25 bp, Mus musculus
tctgaatcactaagagggaccagtc

SEQ ID NO: 366748 - DNA, 25 bp, Mus musculus
tctgaatcagatcaggtggatgtgt

SEQ ID NO: 366749 - DNA, 25 bp, Mus musculus
tctgaatctcccaggaaacctcatc

SEQ ID NO: 366750 - DNA, 25 bp, Mus musculus
tctgaatctcccaggtagtcaatac

SEQ ID NO: 366751 - DNA, 25 bp, Mus musculus
tctgaatggtgggtgcaagtcccag

SEQ ID NO: 366752 - DNA, 25 bp, Mus musculus
tctgaattcaagggaaacaactgga

SEQ ID NO: 366753 - DNA, 25 bp, Mus musculus
tctgaattcagaggaggtggctgaa

SEQ ID NO: 366754 - DNA, 25 bp, Mus musculus
tctgaattcttgcagacacctttgt

SEQ ID NO: 366755 - DNA, 25 bp, Mus musculus
tctgaattcttgcagatccgtctac

SEQ ID NO: 366756 - DNA, 25 bp, Mus musculus
tctgaattgaggattaagcttgcaa

SEQ ID NO: 366757 - DNA, 25 bp, Mus musculus
tctgacaaaagaaagaatatgtact

SEQ ID NO: 366758 - DNA, 25 bp, Mus musculus
tctgacaacagccaagagaaacatc

SEQ ID NO: 366759 - DNA, 25 bp, Mus musculus
tctgacaacaggtcaccttcgtctc

SEQ ID NO: 366760 - DNA, 25 bp, Mus musculus
tctgacaagaaggaaatgttgtcct

SEQ ID NO: 366761 - DNA, 25 bp, Mus musculus
tctgacaagcaaatgatcaaacttc

SEQ ID NO: 366762 - DNA, 25 bp, Mus musculus
tctgacaatgagctgtgtgtccgag

SEQ ID NO: 366763 - DNA, 25 bp, Mus musculus
tctgacaatgcaatcccgcctatga

SEQ ID NO: 366764 - DNA, 25 bp, Mus musculus
tctgacaatggaatcccgcctatga

SEQ ID NO: 366765 - DNA, 25 bp, Mus musculus
tctgacacacagggagaaaatcccc

SEQ ID NO: 366766 - DNA, 25 bp, Mus musculus
tctgacaccagtggcagtgaacctg

SEQ ID NO: 366767 - DNA, 25 bp, Mus musculus
tctgacacggaacaggaaggcaaat

SEQ ID NO: 366768 - DNA, 25 bp, Mus musculus
tctgacacggagcaggaaggcaaat

SEQ ID NO: 366769 - DNA, 25 bp, Mus musculus
tctgacagatatagactcttcaaga

SEQ ID NO: 366770 - DNA, 25 bp, Mus musculus
tctgacagccctgtgtggggctgcc

SEQ ID NO: 366771 - DNA, 25 bp, Mus musculus
tctgacagtccagagcgcctcccca

SEQ ID NO: 366772 - DNA, 25 bp, Mus musculus
tctgacagtgaagaaaatgctgagc

SEQ ID NO: 366773 - DNA, 25 bp, Mus musculus
tctgacagtggtgggtgtgtgcaca

SEQ ID NO: 366774 - DNA, 25 bp, Mus musculus
tctgacatggaggaaatgctgtcat

SEQ ID NO: 366775 - DNA, 25 bp, Mus musculus
tctgacatggaggatatgctgtcat

SEQ ID NO: 366776 - DNA, 25 bp, Mus musculus
tctgacatggtctagagctttatgg

SEQ ID NO: 366777 - DNA, 25 bp, Mus musculus
tctgaccaaagaatacattccacca

SEQ ID NO: 366778 - DNA, 25 bp, Mus musculus
tctgaccaacagaacatacaacatc

SEQ ID NO: 366779 - DNA, 25 bp, Mus musculus
tctgaccaaggtttggcctcacaag

SEQ ID NO: 366780 - DNA, 25 bp, Mus musculus
tctgaccacagttttcctgacttct

SEQ ID NO: 366781 - DNA, 25 bp, Mus musculus
tctgaccacatgcagaatcacagcg

SEQ ID NO: 366782 - DNA, 25 bp, Mus musculus
tctgaccacatgcaggagagatttt

SEQ ID NO: 366783 - DNA, 25 bp, Mus musculus
tctgaccaccacggcatcacggctg

SEQ ID NO: 366784 - DNA, 25 bp, Mus musculus
tctgaccaggaaaagaaagatgtga

SEQ ID NO: 366785 - DNA, 25 bp, Mus musculus
tctgaccatacaggctgggccggta

SEQ ID NO: 366786 - DNA, 25 bp, Mus musculus
tctgacccaagagattgctatggag

SEQ ID NO: 366787 - DNA, 25 bp, Mus musculus
tctgacccaagcttatgatggagca

SEQ ID NO: 366788 - DNA, 25 bp, Mus musculus
tctgacccaggtgtccccatgactt

SEQ ID NO: 366789 - DNA, 25 bp, Mus musculus
tctgaccgagtcagcaggaccaagg

SEQ ID NO: 366790 - DNA, 25 bp, Mus musculus
tctgaccgccctgctgctcatgatc

SEQ ID NO: 366791 - DNA, 25 bp, Mus musculus
tctgacctaccagggtacgagccgc

SEQ ID NO: 366792 - DNA, 25 bp, Mus musculus
tctgacctccagaaaggtgctggat

SEQ ID NO: 366793 - DNA, 25 bp, Mus musculus
tctgacctgggagagtttgtgagaa

SEQ ID NO: 366794 - DNA, 25 bp, Mus musculus
tctgacgaaaaaagatgattctttt

SEQ ID NO: 366795 - DNA, 25 bp, Mus musculus
tctgacgaaaaaaggaatgtcctcc

SEQ ID NO: 366796 - DNA, 25 bp, Mus musculus
tctgacgagaccgaggcttacttct

SEQ ID NO: 366797 - DNA, 25 bp, Mus musculus
tctgacgagaccgaggtctttgaca

SEQ ID NO: 366798 - DNA, 25 bp, Mus musculus
tctgacgagaccgagttacttgccg

SEQ ID NO: 366799 - DNA, 25 bp, Mus musculus
tctgacgcaagagcaggaatccagc

SEQ ID NO: 366800 - DNA, 25 bp, Mus musculus
tctgacgctgagctccaacagtgtc

SEQ ID NO: 366801 - DNA, 25 bp, Mus musculus
tctgacgctggcagacaccactaac

SEQ ID NO: 366802 - DNA, 25 bp, Mus musculus
tctgacggtgctgggaggatctggc

SEQ ID NO: 366803 - DNA, 25 bp, Mus musculus
tctgacgtccattacagaagactgt

SEQ ID NO: 366804 - DNA, 25 bp, Mus musculus
tctgactacccgtgatacttaaata

SEQ ID NO: 366805 - DNA, 25 bp, Mus musculus
tctgactatgcatcatctatactct

SEQ ID NO: 366806 - DNA, 25 bp, Mus musculus
tctgactcaagggaagtaagcaatg

SEQ ID NO: 366807 - DNA, 25 bp, Mus musculus
tctgactcagattccaccatagacc

SEQ ID NO: 366808 - DNA, 25 bp, Mus musculus
tctgactccacgtcgtggtcctgcc

SEQ ID NO: 366809 - DNA, 25 bp, Mus musculus
tctgactgaaccttatcaagcactg

SEQ ID NO: 366810 - DNA, 25 bp, Mus musculus
tctgactgcgacatttacattgttg

SEQ ID NO: 366811 - DNA, 25 bp, Mus musculus
tctgactgcggttgaaatgggcatg

SEQ ID NO: 366812 - DNA, 25 bp, Mus musculus
tctgactgctgcagcagagagccag

SEQ ID NO: 366813 - DNA, 25 bp, Mus musculus
tctgactgtggaagaaggtggtgat

SEQ ID NO: 366814 - DNA, 25 bp, Mus musculus
tctgacttaccagctgggaagggct

SEQ ID NO: 366815 - DNA, 25 bp, Mus musculus
tctgacttagagaagagtgggaatg

SEQ ID NO: 366816 - DNA, 25 bp, Mus musculus
tctgacttagaggaaatgctgtcat

SEQ ID NO: 366817 - DNA, 25 bp, Mus musculus
tctgacttcccttagaatgtgattt

SEQ ID NO: 366818 - DNA, 25 bp, Mus musculus
tctgacttcggtcagccatgtcatc

SEQ ID NO: 366819 - DNA, 25 bp, Mus musculus
tctgacttctgtttctcttcagcaa

SEQ ID NO: 366820 - DNA, 25 bp, Mus musculus
tctgacttggggaagaaagtgaatc

SEQ ID NO: 366821 - DNA, 25 bp, Mus musculus
tctgacttttagaaccagctcagct

SEQ ID NO: 366822 - DNA, 25 bp, Mus musculus
tctgagaaacctgagatttctgttt

SEQ ID NO: 366823 - DNA, 25 bp, Mus musculus
tctgagaaacctgaggagttaggat

SEQ ID NO: 366824 - DNA, 25 bp, Mus musculus
tctgagaaactgatctctcacctat

SEQ ID NO: 366825 - DNA, 25 bp, Mus musculus
tctgagaaactggagaccttcttcg

SEQ ID NO: 366826 - DNA, 25 bp, Mus musculus
tctgagaaacttgaggccagaagtc

SEQ ID NO: 366827 - DNA, 25 bp, Mus musculus
tctgagaaacttgagtatgaaagca

SEQ ID NO: 366828 - DNA, 25 bp, Mus musculus
tctgagaaagacaactgaggataag

SEQ ID NO: 366829 - DNA, 25 bp, Mus musculus
tctgagaaagattgtctaaagccac

SEQ ID NO: 366830 - DNA, 25 bp, Mus musculus
tctgagaaatcaggtcttaatttgc

SEQ ID NO: 366831 - DNA, 25 bp, Mus musculus
tctgagaaatgcaggaatctccggt

SEQ ID NO: 366832 - DNA, 25 bp, Mus musculus
tctgagaacaggaagcccagccctg

SEQ ID NO: 366833 - DNA, 25 bp, Mus musculus
tctgagaacaggaatggccttgatg

SEQ ID NO: 366834 - DNA, 25 bp, Mus musculus
tctgagaacggtgatgctagcgagg

SEQ ID NO: 366835 - DNA, 25 bp, Mus musculus
tctgagaatgaagacactcagccgg

SEQ ID NO: 366836 - DNA, 25 bp, Mus musculus
tctgagaatgaaggctctggaatgg

SEQ ID NO: 366837 - DNA, 25 bp, Mus musculus
tctgagacagactgcatgtatggga

SEQ ID NO: 366838 - DNA, 25 bp, Mus musculus
tctgagaccaccctcccttggaacg

SEQ ID NO: 366839 - DNA, 25 bp, Mus musculus
tctgagaccagacgtctccaccagc

SEQ ID NO: 366840 - DNA, 25 bp, Mus musculus
tctgagagaaactgcaagaaaaatg

SEQ ID NO: 366841 - DNA, 25 bp, Mus musculus
tctgagagaaagtgatgtatcgcct

SEQ ID NO: 366842 - DNA, 25 bp, Mus musculus
tctgagagaacatgaacaaaaagtt

SEQ ID NO: 366843 - DNA, 25 bp, Mus musculus
tctgagagaagacccatgcttgtac

SEQ ID NO: 366844 - DNA, 25 bp, Mus musculus
tctgagagaaggtggagcagccctg

SEQ ID NO: 366845 - DNA, 25 bp, Mus musculus
tctgagagacaggacggggcgctgt

SEQ ID NO: 366846 - DNA, 25 bp, Mus musculus
tctgagagacaggccttctgtatac

SEQ ID NO: 366847 - DNA, 25 bp, Mus musculus
tctgagagacttaaaatgaaatgga

SEQ ID NO: 366848 - DNA, 25 bp, Mus musculus
tctgagagaggtgaaccaccaaaat

SEQ ID NO: 366849 - DNA, 25 bp, Mus musculus
tctgagagataaggcacctccaagt

SEQ ID NO: 366850 - DNA, 25 bp, Mus musculus
tctgagagcaaaaagaacatgtttg

SEQ ID NO: 366851 - DNA, 25 bp, Mus musculus
tctgagaggaaccattctctgagga

SEQ ID NO: 366852 - DNA, 25 bp, Mus musculus
tctgagaggaacccttctctgagga

SEQ ID NO: 366853 - DNA, 25 bp, Mus musculus
tctgagaggaagttttatctgtgca

SEQ ID NO: 366854 - DNA, 25 bp, Mus musculus
tctgagaggacagccctgactcccc

SEQ ID NO: 366855 - DNA, 25 bp, Mus musculus
tctgagaggacaggcattgttatcg

SEQ ID NO: 366856 - DNA, 25 bp, Mus musculus
tctgagatagcaagcagattggggc

SEQ ID NO: 366857 - DNA, 25 bp, Mus musculus
tctgagataggtgtcttccacctgg

SEQ ID NO: 366858 - DNA, 25 bp, Mus musculus
tctgagatcacaggggacctcagcc

SEQ ID NO: 366859 - DNA, 25 bp, Mus musculus
tctgagatcgacaggaagcccgcaa

SEQ ID NO: 366860 - DNA, 25 bp, Mus musculus
tctgagatctcagtccaagaaagct

SEQ ID NO: 366861 - DNA, 25 bp, Mus musculus
tctgagatctcagtgctgatctggg

SEQ ID NO: 366862 - DNA, 25 bp, Mus musculus
tctgagatcttaaaggttgccagga

SEQ ID NO: 366863 - DNA, 25 bp, Mus musculus
tctgagatgacagcagaagtccata

SEQ ID NO: 366864 - DNA, 25 bp, Mus musculus
tctgagatgacagcagccttcaagg

SEQ ID NO: 366865 - DNA, 25 bp, Mus musculus
tctgagatggtgcaggacatggggg

SEQ ID NO: 366866 - DNA, 25 bp, Mus musculus
tctgagcaactagggttacagggaa

SEQ ID NO: 366867 - DNA, 25 bp, Mus musculus
tctgagcaactagtctaaatgttca

SEQ ID NO: 366868 - DNA, 25 bp, Mus musculus
tctgagcaggactcggaacccactt

SEQ ID NO: 366869 - DNA, 25 bp, Mus musculus
tctgagcaggagaatctggagaagc

SEQ ID NO: 366870 - DNA, 25 bp, Mus musculus
tctgagcaggaggatgagtctgagg

SEQ ID NO: 366871 - DNA, 25 bp, Mus musculus
tctgagcagggcgaaggagcagggc

SEQ ID NO: 366872 - DNA, 25 bp, Mus musculus
tctgagccaggtatcatacagactg

SEQ ID NO: 366873 - DNA, 25 bp, Mus musculus
tctgagccatctgggaaagatgtgg

SEQ ID NO: 366874 - DNA, 25 bp, Mus musculus
tctgagccatctgggaagatgtctg

SEQ ID NO: 366875 - DNA, 25 bp, Mus musculus
tctgagcccagcagcgtaaacgacc

SEQ ID NO: 366876 - DNA, 25 bp, Mus musculus
tctgagcctcactggtgggtgtgca

SEQ ID NO: 366877 - DNA, 25 bp, Mus musculus
tctgagccttgcgtgccctcccagt

SEQ ID NO: 366878 - DNA, 25 bp, Mus musculus
tctgagcgtgccttcatcaagtagt

SEQ ID NO: 366879 - DNA, 25 bp, Mus musculus
tctgagctcttccaacacttcgaca

SEQ ID NO: 366880 - DNA, 25 bp, Mus musculus
tctgagctgagaggcaaacccgtgg

SEQ ID NO: 366881 - DNA, 25 bp, Mus musculus
tctgagctgcaagataagcagacag

SEQ ID NO: 366882 - DNA, 25 bp, Mus musculus
tctgagctgcaaggaactcattata

SEQ ID NO: 366883 - DNA, 25 bp, Mus musculus
tctgagctggcttgctgcccattct

SEQ ID NO: 366884 - DNA, 25 bp, Mus musculus
tctgaggaagagacactccagcaac

SEQ ID NO: 366885 - DNA, 25 bp, Mus musculus
tctgaggaagaggacttttggggaa

SEQ ID NO: 366886 - DNA, 25 bp, Mus musculus
tctgaggaagcactggattgccaac

SEQ ID NO: 366887 - DNA, 25 bp, Mus musculus
tctgaggaaggtattcggcaccaac

SEQ ID NO: 366888 - DNA, 25 bp, Mus musculus
tctgaggacagaacttatttgtcca

SEQ ID NO: 366889 - DNA, 25 bp, Mus musculus
tctgaggaggcccactgagtgtttc

SEQ ID NO: 366890 - DNA, 25 bp, Mus musculus
tctgaggagggtgtaaaagaagaga

SEQ ID NO: 366891 - DNA, 25 bp, Mus musculus
tctgaggatacagcaacttctaagg

SEQ ID NO: 366892 - DNA, 25 bp, Mus musculus
tctgaggcaggtacccacccggaag

SEQ ID NO: 366893 - DNA, 25 bp, Mus musculus
tctgaggccatgagttccgactctg

SEQ ID NO: 366894 - DNA, 25 bp, Mus musculus
tctgaggcgcggcccagcactatgg

SEQ ID NO: 366895 - DNA, 25 bp, Mus musculus
tctgaggctgcaggtgccctacgtt

SEQ ID NO: 366896 - DNA, 25 bp, Mus musculus
tctgaggctggtcttcttctacatc

SEQ ID NO: 366897 - DNA, 25 bp, Mus musculus
tctgaggggaagagatgcaattcga

SEQ ID NO: 366898 - DNA, 25 bp, Mus musculus
tctgaggggagcttttcccagtcat

SEQ ID NO: 366899 - DNA, 25 bp, Mus musculus
tctgagggttccaattggttccaag

SEQ ID NO: 366900 - DNA, 25 bp, Mus musculus
tctgaggtgagctttgacgccgcca

SEQ ID NO: 366901 - DNA, 25 bp, Mus musculus
tctgaggtgcacggctgtgtttgga

SEQ ID NO: 366902 - DNA, 25 bp, Mus musculus
tctgaggtgcacgggtgacccagat

SEQ ID NO: 366903 - DNA, 25 bp, Mus musculus
tctgagtaaaggtgaacatcagtga

SEQ ID NO: 366904 - DNA, 25 bp, Mus musculus
tctgagtaaaggtgaacgacgactg

SEQ ID NO: 366905 - DNA, 25 bp, Mus musculus
tctgagtaaggagagtccttcttgt

SEQ ID NO: 366906 - DNA, 25 bp, Mus musculus
tctgagtacaaagtgaaggaggagg

SEQ ID NO: 366907 - DNA, 25 bp, Mus musculus
tctgagtcaagagcttggattctga

SEQ ID NO: 366908 - DNA, 25 bp, Mus musculus
tctgagtcacgtgctgtaattacag

SEQ ID NO: 366909 - DNA, 25 bp, Mus musculus
tctgagtcaggatgcgtacactgca

SEQ ID NO: 366910 - DNA, 25 bp, Mus musculus
tctgagtctgaagaagacaaaggca

SEQ ID NO: 366911 - DNA, 25 bp, Mus musculus
tctgagtctgttcagactgtactcc

SEQ ID NO: 366912 - DNA, 25 bp, Mus musculus
tctgagtctttaaggagaaagcatc

SEQ ID NO: 366913 - DNA, 25 bp, Mus musculus
tctgagtctttaagtggttctgtgt

SEQ ID NO: 366914 - DNA, 25 bp, Mus musculus
tctgagtctttcctggttttctatt

SEQ ID NO: 366915 - DNA, 25 bp, Mus musculus
tctgagtgaagattatttgtcttta

SEQ ID NO: 366916 - DNA, 25 bp, Mus musculus
tctgagtggagagggcgaggccccc

SEQ ID NO: 366917 - DNA, 25 bp, Mus musculus
tctgagtgtcaggatggtggtgcgg

SEQ ID NO: 366918 - DNA, 25 bp, Mus musculus
tctgagtgtcaggctgtgagtcctg

SEQ ID NO: 366919 - DNA, 25 bp, Mus musculus
tctgagttccactgggctcccatcc

SEQ ID NO: 366920 - DNA, 25 bp, Mus musculus
tctgagttggcaggaagaaaatgcc

SEQ ID NO: 366921 - DNA, 25 bp, Mus musculus
tctgagttggcagtcacaaactcgc

SEQ ID NO: 366922 - DNA, 25 bp, Mus musculus
tctgagttttatgagaggaacctgt

SEQ ID NO: 366923 - DNA, 25 bp, Mus musculus
tctgagttttcgcgagaactttcaa

SEQ ID NO: 366924 - DNA, 25 bp, Mus musculus
tctgataaaaccaggtttgcttatg

SEQ ID NO: 366925 - DNA, 25 bp, Mus musculus
tctgataaaggcaactgttggattg

SEQ ID NO: 366926 - DNA, 25 bp, Mus musculus
tctgataaataagagggcaatgcga

SEQ ID NO: 366927 - DNA, 25 bp, Mus musculus
tctgataatagccagaacaaatata

SEQ ID NO: 366928 - DNA, 25 bp, Mus musculus
tctgataatagtgttatccaagata

SEQ ID NO: 366929 - DNA, 25 bp, Mus musculus
tctgatagaagaagtgagctgaaga

SEQ ID NO: 366930 - DNA, 25 bp, Mus musculus
tctgatagaggtgccctgggacaac

SEQ ID NO: 366931 - DNA, 25 bp, Mus musculus
tctgatagcatcaggcgcgagcttc

SEQ ID NO: 366932 - DNA, 25 bp, Mus musculus
tctgatagcctgggtttgtcactct

SEQ ID NO: 366933 - DNA, 25 bp, Mus musculus
tctgataggcttggtgaatcacaga

SEQ ID NO: 366934 - DNA, 25 bp, Mus musculus
tctgatatgaggacccatcctctgt

SEQ ID NO: 366935 - DNA, 25 bp, Mus musculus
tctgatattagggaggtgcccctga

SEQ ID NO: 366936 - DNA, 25 bp, Mus musculus
tctgatcaaaaagtttcagttcgtt

SEQ ID NO: 366937 - DNA, 25 bp, Mus musculus
tctgatcaacaggtctccattttga

SEQ ID NO: 366938 - DNA, 25 bp, Mus musculus
tctgatcagcagaggtgctgttacc

SEQ ID NO: 366939 - DNA, 25 bp, Mus musculus
tctgatcagcagagtgaaatggtta

SEQ ID NO: 366940 - DNA, 25 bp, Mus musculus
tctgatccaaaaaggatacatgagg

SEQ ID NO: 366941 - DNA, 25 bp, Mus musculus
tctgatccaggggcaggtgaggtgt

SEQ ID NO: 366942 - DNA, 25 bp, Mus musculus
tctgatccagtcaaggaggaggatg

SEQ ID NO: 366943 - DNA, 25 bp, Mus musculus
tctgatccagtcaaggatgactatg

SEQ ID NO: 366944 - DNA, 25 bp, Mus musculus
tctgatccagtctgcctggagattc

SEQ ID NO: 366945 - DNA, 25 bp, Mus musculus
tctgatcctagtgtcaaaggtcccc

SEQ ID NO: 366946 - DNA, 25 bp, Mus musculus
tctgatccttcatggcagtgaagaa

SEQ ID NO: 366947 - DNA, 25 bp, Mus musculus
tctgatcgtgtacagggtgaagttg

SEQ ID NO: 366948 - DNA, 25 bp, Mus musculus
tctgatctccatgatggtggccagt

SEQ ID NO: 366949 - DNA, 25 bp, Mus musculus
tctgatctgagaggcctctcctgca

SEQ ID NO: 366950 - DNA, 25 bp, Mus musculus
tctgatcttgaacggggtgccacgg

SEQ ID NO: 366951 - DNA, 25 bp, Mus musculus
tctgatcttggggagtgggaggtgc

SEQ ID NO: 366952 - DNA, 25 bp, Mus musculus
tctgatgaaagggaggctacagaca

SEQ ID NO: 366953 - DNA, 25 bp, Mus musculus
tctgatgaaaggggagggcactgac

SEQ ID NO: 366954 - DNA, 25 bp, Mus musculus
tctgatgaactcagctctgatgtct

SEQ ID NO: 366955 - DNA, 25 bp, Mus musculus
tctgatgaactgaatccaaatccag

SEQ ID NO: 366956 - DNA, 25 bp, Mus musculus
tctgatgacactggctgcggctgga

SEQ ID NO: 366957 - DNA, 25 bp, Mus musculus
tctgatgatgattcatgaaaaactt

SEQ ID NO: 366958 - DNA, 25 bp, Mus musculus
tctgatgatggtcgggtgagagcca

SEQ ID NO: 366959 - DNA, 25 bp, Mus musculus
tctgatgatgttgctttcccctgtg

SEQ ID NO: 366960 - DNA, 25 bp, Mus musculus
tctgatgattcacagtggtaagatt

SEQ ID NO: 366961 - DNA, 25 bp, Mus musculus
tctgatgctgccaggagacgctctg

SEQ ID NO: 366962 - DNA, 25 bp, Mus musculus
tctgatgctggctggggacatcttc

SEQ ID NO: 366963 - DNA, 25 bp, Mus musculus
tctgatggaggaatcaaaaatgaat

SEQ ID NO: 366964 - DNA, 25 bp, Mus musculus
tctgatggaggagtcttctatgagt

SEQ ID NO: 366965 - DNA, 25 bp, Mus musculus
tctgatggaggtaaaagtaactcga

SEQ ID NO: 366966 - DNA, 25 bp, Mus musculus
tctgatgggagagcaagccctcatg

SEQ ID NO: 366967 - DNA, 25 bp, Mus musculus
tctgatgggagaggctttgaagact

SEQ ID NO: 366968 - DNA, 25 bp, Mus musculus
tctgatgggctgcagggacctcccg

SEQ ID NO: 366969 - DNA, 25 bp, Mus musculus
tctgatgtatggatcggaacgtcaa

SEQ ID NO: 366970 - DNA, 25 bp, Mus musculus
tctgatgtggaaaggaaaatagaaa

SEQ ID NO: 366971 - DNA, 25 bp, Mus musculus
tctgatgtgtaagcttatcacagtt

SEQ ID NO: 366972 - DNA, 25 bp, Mus musculus
tctgatgttgaaatggaatacacta

SEQ ID NO: 366973 - DNA, 25 bp, Mus musculus
tctgattaaaggtggagcagccctg

SEQ ID NO: 366974 - DNA, 25 bp, Mus musculus
tctgattaaagtaacgacattctgc

SEQ ID NO: 366975 - DNA, 25 bp, Mus musculus
tctgattatagggtcctgctgatgg

SEQ ID NO: 366976 - DNA, 25 bp, Mus musculus
tctgattcaggtacacaactggagc

SEQ ID NO: 366977 - DNA, 25 bp, Mus musculus
tctgattcatcagacacctgctgtc

SEQ ID NO: 366978 - DNA, 25 bp, Mus musculus
tctgattcatgagccatcaaagaga

SEQ ID NO: 366979 - DNA, 25 bp, Mus musculus
tctgattccaagcctggaagggcgt

SEQ ID NO: 366980 - DNA, 25 bp, Mus musculus
tctgattccagctgaccagggtgga

SEQ ID NO: 366981 - DNA, 25 bp, Mus musculus
tctgattcccagctgtttggggcaa

SEQ ID NO: 366982 - DNA, 25 bp, Mus musculus
tctgattcctcagggcatcgtgaag

SEQ ID NO: 366983 - DNA, 25 bp, Mus musculus
tctgattctgaggtgtggcttgacg

SEQ ID NO: 366984 - DNA, 25 bp, Mus musculus
tctgattcttgaatgcaccttatag

SEQ ID NO: 366985 - DNA, 25 bp, Mus musculus
tctgattgaagcctgctgcaaaaat

SEQ ID NO: 366986 - DNA, 25 bp, Mus musculus
tctgattgcagttccaactacctca

SEQ ID NO: 366987 - DNA, 25 bp, Mus musculus
tctgattgctgtggacagacgcctg

SEQ ID NO: 366988 - DNA, 25 bp, Mus musculus
tctgattggaggtcggtgagctggt

SEQ ID NO: 366989 - DNA, 25 bp, Mus musculus
tctgattgggactggaaaaggaggc

SEQ ID NO: 366990 - DNA, 25 bp, Mus musculus
tctgattggggagggttttgaatcc

SEQ ID NO: 366991 - DNA, 25 bp, Mus musculus
tctgattgtgagcggaaaagtgtac

SEQ ID NO: 366992 - DNA, 25 bp, Mus musculus
tctgatttaaagctcatccactgga

SEQ ID NO: 366993 - DNA, 25 bp, Mus musculus
tctgatttaaaggtcatccactgga

SEQ ID NO: 366994 - DNA, 25 bp, Mus musculus
tctgatttagatcttgaaccagatg

SEQ ID NO: 366995 - DNA, 25 bp, Mus musculus
tctgatttcgaggggacccagccgt

SEQ ID NO: 366996 - DNA, 25 bp, Mus musculus
tctgatttcttggaatagaaaccct

SEQ ID NO: 366997 - DNA, 25 bp, Mus musculus
tctgatttcttgggtgaagaaaatc

SEQ ID NO: 366998 - DNA, 25 bp, Mus musculus
tctgattttgagaattcagagccaa

SEQ ID NO: 366999 - DNA, 25 bp, Mus musculus
tctgattttgagtttgaaaatgaaa

SEQ ID NO: 367000 - DNA, 25 bp, Mus musculus
tctgcaaaaacagatgtggaaagag

SEQ ID NO: 367001 - DNA, 25 bp, Mus musculus
tctgcaaaaagaaatacgaagaaaa

SEQ ID NO: 367002 - DNA, 25 bp, Mus musculus
tctgcaaaaaggggatggaattcga

SEQ ID NO: 367003 - DNA, 25 bp, Mus musculus
tctgcaaaagaaatacaaagagtat

SEQ ID NO: 367004 - DNA, 25 bp, Mus musculus
tctgcaaaagagctgcagggatgga

SEQ ID NO: 367005 - DNA, 25 bp, Mus musculus
tctgcaaaagattcacagtctccgt

SEQ ID NO: 367006 - DNA, 25 bp, Mus musculus
tctgcaaaagcaatgtcttcaatga

SEQ ID NO: 367007 - DNA, 25 bp, Mus musculus
tctgcaaacagtgccaccaaaagcc

SEQ ID NO: 367008 - DNA, 25 bp, Mus musculus
tctgcaaaccatgatctcaagacca

SEQ ID NO: 367009 - DNA, 25 bp, Mus musculus
tctgcaaaccatgcctcaatctagg

SEQ ID NO: 367010 - DNA, 25 bp, Mus musculus
tctgcaaagagccgtctagacaagg

SEQ ID NO: 367011 - DNA, 25 bp, Mus musculus
tctgcaaagcgccatcaaaggattt

SEQ ID NO: 367012 - DNA, 25 bp, Mus musculus
tctgcaaagcgctactgttgaggct

SEQ ID NO: 367013 - DNA, 25 bp, Mus musculus
tctgcaaaggaaacgatggatctgg

SEQ ID NO: 367014 - DNA, 25 bp, Mus musculus
tctgcaaaggaaacggtgcctcctc

SEQ ID NO: 367015 - DNA, 25 bp, Mus musculus
tctgcaaagggagcttggcatggat

SEQ ID NO: 367016 - DNA, 25 bp, Mus musculus
tctgcaaatggcgaaagtcctaggt

SEQ ID NO: 367017 - DNA, 25 bp, Mus musculus
tctgcaaattagatgttctttgttt

SEQ ID NO: 367018 - DNA, 25 bp, Mus musculus
tctgcaacaaaggcttcaccacagc

SEQ ID NO: 367019 - DNA, 25 bp, Mus musculus
tctgcaacaaaggtactggtgaggt

SEQ ID NO: 367020 - DNA, 25 bp, Mus musculus
tctgcaacagttgtttaatgaactt

SEQ ID NO: 367021 - DNA, 25 bp, Mus musculus
tctgcaaccaaggcctttgtagatt

SEQ ID NO: 367022 - DNA, 25 bp, Mus musculus
tctgcaagaaaaggaaggaactcaa

SEQ ID NO: 367023 - DNA, 25 bp, Mus musculus
tctgcaagaaaaggactggacagac

SEQ ID NO: 367024 - DNA, 25 bp, Mus musculus
tctgcaagaaaaggctcatgtgttt

SEQ ID NO: 367025 - DNA, 25 bp, Mus musculus
tctgcaagaaatttgccgaggcctt

SEQ ID NO: 367026 - DNA, 25 bp, Mus musculus
tctgcaagaaatttggtgtccaggg

SEQ ID NO: 367027 - DNA, 25 bp, Mus musculus
tctgcaagaacacatacagtgtctt

SEQ ID NO: 367028 - DNA, 25 bp, Mus musculus
tctgcaagaacactgtcttcaagat

SEQ ID NO: 367029 - DNA, 25 bp, Mus musculus
tctgcaagaaggagatctggaacac

SEQ ID NO: 367030 - DNA, 25 bp, Mus musculus
tctgcaagagcaataaaattgctac

SEQ ID NO: 367031 - DNA, 25 bp, Mus musculus
tctgcaagatcaagacagctgcatc

SEQ ID NO: 367032 - DNA, 25 bp, Mus musculus
tctgcaagccaagcagtctctggtc

SEQ ID NO: 367033 - DNA, 25 bp, Mus musculus
tctgcaaggaaggttggcagcgtgg

SEQ ID NO: 367034 - DNA, 25 bp, Mus musculus
tctgcaaggatgctacggaagagtc

SEQ ID NO: 367035 - DNA, 25 bp, Mus musculus
tctgcaaggatggagaatacattga

SEQ ID NO: 367036 - DNA, 25 bp, Mus musculus
tctgcaaggcaaatctcatataaaa

SEQ ID NO: 367037 - DNA, 25 bp, Mus musculus
tctgcaaggcaggtcttccatgttt

SEQ ID NO: 367038 - DNA, 25 bp, Mus musculus
tctgcaaggctgtgtatacagtttt

SEQ ID NO: 367039 - DNA, 25 bp, Mus musculus
tctgcaagtggcaggattctgaatc

SEQ ID NO: 367040 - DNA, 25 bp, Mus musculus
tctgcaagtgggtgggaccatcatc

SEQ ID NO: 367041 - DNA, 25 bp, Mus musculus
tctgcaagttaaaaggaacttctgc

SEQ ID NO: 367042 - DNA, 25 bp, Mus musculus
tctgcaatacctggcgccagagctt

SEQ ID NO: 367043 - DNA, 25 bp, Mus musculus
tctgcaatataaggcacaatggaag

SEQ ID NO: 367044 - DNA, 25 bp, Mus musculus
tctgcaatcgaggtcatgcttctgg

SEQ ID NO: 367045 - DNA, 25 bp, Mus musculus
tctgcaatggcaggcctagccagca

SEQ ID NO: 367046 - DNA, 25 bp, Mus musculus
tctgcaatggcagtctgttccggta

SEQ ID NO: 367047 - DNA, 25 bp, Mus musculus
tctgcaattctccccaggaaaatac

SEQ ID NO: 367048 - DNA, 25 bp, Mus musculus
tctgcacacatacacgcccgaatgg

SEQ ID NO: 367049 - DNA, 25 bp, Mus musculus
tctgcacagaaaacccagccagtgg

SEQ ID NO: 367050 - DNA, 25 bp, Mus musculus
tctgcacagacaggagcatgcaaaa

SEQ ID NO: 367051 - DNA, 25 bp, Mus musculus
tctgcacagacaggagcatgcattc

SEQ ID NO: 367052 - DNA, 25 bp, Mus musculus
tctgcacagatatctttccatctgt

SEQ ID NO: 367053 - DNA, 25 bp, Mus musculus
tctgcaccagagattgtgcacgagg

SEQ ID NO: 367054 - DNA, 25 bp, Mus musculus
tctgcaccagcaggaagtgatgtca

SEQ ID NO: 367055 - DNA, 25 bp, Mus musculus
tctgcaccaggcatagcaggaagtg

SEQ ID NO: 367056 - DNA, 25 bp, Mus musculus
tctgcaccaggtctacctgggtttc

SEQ ID NO: 367057 - DNA, 25 bp, Mus musculus
tctgcacccagccaaggtagccacg

SEQ ID NO: 367058 - DNA, 25 bp, Mus musculus
tctgcaccctctgatactccagatc

SEQ ID NO: 367059 - DNA, 25 bp, Mus musculus
tctgcaccctctgattgctaaagaa

SEQ ID NO: 367060 - DNA, 25 bp, Mus musculus
tctgcacgaagatctgttagcaaga

SEQ ID NO: 367061 - DNA, 25 bp, Mus musculus
tctgcacgcctacagcttcctggtg

SEQ ID NO: 367062 - DNA, 25 bp, Mus musculus
tctgcacgcggaaagagaactagat

SEQ ID NO: 367063 - DNA, 25 bp, Mus musculus
tctgcacggcgggtaacttcatgga

SEQ ID NO: 367064 - DNA, 25 bp, Mus musculus
tctgcacgtgcagcgcccacaggcc

SEQ ID NO: 367065 - DNA, 25 bp, Mus musculus
tctgcacgtgcagggtccccgacaa

SEQ ID NO: 367066 - DNA, 25 bp, Mus musculus
tctgcactacacaggacaccaagga

SEQ ID NO: 367067 - DNA, 25 bp, Mus musculus
tctgcactacgcgggtgacttcacc

SEQ ID NO: 367068 - DNA, 25 bp, Mus musculus
tctgcactagagtatcaagagagcc

SEQ ID NO: 367069 - DNA, 25 bp, Mus musculus
tctgcactaggctccgcaggaggct

SEQ ID NO: 367070 - DNA, 25 bp, Mus musculus
tctgcactatcggtctgtgcactgt

SEQ ID NO: 367071 - DNA, 25 bp, Mus musculus
tctgcactatcggtttggaggtacc

SEQ ID NO: 367072 - DNA, 25 bp, Mus musculus
tctgcactctcagctccagctagaa

SEQ ID NO: 367073 - DNA, 25 bp, Mus musculus
tctgcactgaacagtcaaattctcc

SEQ ID NO: 367074 - DNA, 25 bp, Mus musculus
tctgcactgcagggttttggcgacc

SEQ ID NO: 367075 - DNA, 25 bp, Mus musculus
tctgcactggacttgctgaaacctg

SEQ ID NO: 367076 - DNA, 25 bp, Mus musculus
tctgcacttaacaggacaagctctg

SEQ ID NO: 367077 - DNA, 25 bp, Mus musculus
tctgcacttcgtggggagcaggtcc

SEQ ID NO: 367078 - DNA, 25 bp, Mus musculus
tctgcagaaaaatatcgtttgcctc

SEQ ID NO: 367079 - DNA, 25 bp, Mus musculus
tctgcagaaagtggaagaaaatggc

SEQ ID NO: 367080 - DNA, 25 bp, Mus musculus
tctgcagaagataccgggacacagg

SEQ ID NO: 367081 - DNA, 25 bp, Mus musculus
tctgcagaagcaacctcttacctcc

SEQ ID NO: 367082 - DNA, 25 bp, Mus musculus
tctgcagaagctggaagatgaagaa

SEQ ID NO: 367083 - DNA, 25 bp, Mus musculus
tctgcagaaggccaagatggacaac

SEQ ID NO: 367084 - DNA, 25 bp, Mus musculus
tctgcagaagggggactatgtatgg

SEQ ID NO: 367085 - DNA, 25 bp, Mus musculus
tctgcagaaggtttcaacactaaac

SEQ ID NO: 367086 - DNA, 25 bp, Mus musculus
tctgcagaagtttgatggtgacagt

SEQ ID NO: 367087 - DNA, 25 bp, Mus musculus
tctgcagacacagggctctgctctg

SEQ ID NO: 367088 - DNA, 25 bp, Mus musculus
tctgcagactcggtcaccactcaag

SEQ ID NO: 367089 - DNA, 25 bp, Mus musculus
tctgcagagacaggagctgctgctg

SEQ ID NO: 367090 - DNA, 25 bp, Mus musculus
tctgcagagacaggtactgagttca

SEQ ID NO: 367091 - DNA, 25 bp, Mus musculus
tctgcagagtgcagtattgtggaat

SEQ ID NO: 367092 - DNA, 25 bp, Mus musculus
tctgcagatacaggatcacttctgt

SEQ ID NO: 367093 - DNA, 25 bp, Mus musculus
tctgcagcaagatcttggccaactt

SEQ ID NO: 367094 - DNA, 25 bp, Mus musculus
tctgcagcaagcacatgcatcccct

SEQ ID NO: 367095 - DNA, 25 bp, Mus musculus
tctgcagcagatcgtgaaccttata

SEQ ID NO: 367096 - DNA, 25 bp, Mus musculus
tctgcagcatcacaggaggcacctc

SEQ ID NO: 367097 - DNA, 25 bp, Mus musculus
tctgcagcctcagcaaagaagagtc

SEQ ID NO: 367098 - DNA, 25 bp, Mus musculus
tctgcagcgagcctatagtttggcc

SEQ ID NO: 367099 - DNA, 25 bp, Mus musculus
tctgcagcgagtgcccttcgcattg

SEQ ID NO: 367100 - DNA, 25 bp, Mus musculus
tctgcagcgagtttggccaaggagc

SEQ ID NO: 367101 - DNA, 25 bp, Mus musculus
tctgcagcgggccagctacgaatac

SEQ ID NO: 367102 - DNA, 25 bp, Mus musculus
tctgcagcgggccaggaatgagatc

SEQ ID NO: 367103 - DNA, 25 bp, Mus musculus
tctgcagcgttcgaggagcgacaca

SEQ ID NO: 367104 - DNA, 25 bp, Mus musculus
tctgcagcgttcgaggtcgtgagtc

SEQ ID NO: 367105 - DNA, 25 bp, Mus musculus
tctgcagctggcactggggctgctg

SEQ ID NO: 367106 - DNA, 25 bp, Mus musculus
tctgcagctggtcacagctctggaa

SEQ ID NO: 367107 - DNA, 25 bp, Mus musculus
tctgcagctgtatgttgtatgggca

SEQ ID NO: 367108 - DNA, 25 bp, Mus musculus
tctgcaggaagggtccccctgtggg

SEQ ID NO: 367109 - DNA, 25 bp, Mus musculus
tctgcaggaaggtgtggggcggagt

SEQ ID NO: 367110 - DNA, 25 bp, Mus musculus
tctgcaggacatgaagctacagtcg

SEQ ID NO: 367111 - DNA, 25 bp, Mus musculus
tctgcaggagaaaagaataaatgaa

SEQ ID NO: 367112 - DNA, 25 bp, Mus musculus
tctgcaggagcaggccaacgagggc

SEQ ID NO: 367113 - DNA, 25 bp, Mus musculus
tctgcaggccgagatcaagatgctg

SEQ ID NO: 367114 - DNA, 25 bp, Mus musculus
tctgcaggccgagcaggtccttgaa

SEQ ID NO: 367115 - DNA, 25 bp, Mus musculus
tctgcaggctcagcaaatgacaaga

SEQ ID NO: 367116 - DNA, 25 bp, Mus musculus
tctgcagggcccaggaattgcattg

SEQ ID NO: 367117 - DNA, 25 bp, Mus musculus
tctgcaggggaggacatagtcgaca

SEQ ID NO: 367118 - DNA, 25 bp, Mus musculus
tctgcaggggaggctttgctacaga

SEQ ID NO: 367119 - DNA, 25 bp, Mus musculus
tctgcaggtccattgggcatcatga

SEQ ID NO: 367120 - DNA, 25 bp, Mus musculus
tctgcaggtgagtacggctccacag

SEQ ID NO: 367121 - DNA, 25 bp, Mus musculus
tctgcagtaggggctgctgaataat

SEQ ID NO: 367122 - DNA, 25 bp, Mus musculus
tctgcagtcctcgaggagatcccag

SEQ ID NO: 367123 - DNA, 25 bp, Mus musculus
tctgcagtggaaggcaaagagaaac

SEQ ID NO: 367124 - DNA, 25 bp, Mus musculus
tctgcataaggctgcggagaagggt

SEQ ID NO: 367125 - DNA, 25 bp, Mus musculus
tctgcatacggtagtcttttacaga

SEQ ID NO: 367126 - DNA, 25 bp, Mus musculus
tctgcatagcagagctacccagctg

SEQ ID NO: 367127 - DNA, 25 bp, Mus musculus
tctgcatcaccctgacaaaggagac

SEQ ID NO: 367128 - DNA, 25 bp, Mus musculus
tctgcatcagactccgtgcttctga

SEQ ID NO: 367129 - DNA, 25 bp, Mus musculus
tctgcatcccgttcacgcaaagaat

SEQ ID NO: 367130 - DNA, 25 bp, Mus musculus
tctgcatccgaccagacagatggat

SEQ ID NO: 367131 - DNA, 25 bp, Mus musculus
tctgcatccgaccagcttttttaaa

SEQ ID NO: 367132 - DNA, 25 bp, Mus musculus
tctgcatccgaccaggatggcttcc

SEQ ID NO: 367133 - DNA, 25 bp, Mus musculus
tctgcatccggggacagagtccttg

SEQ ID NO: 367134 - DNA, 25 bp, Mus musculus
tctgcatcgaggtggacaacatcag

SEQ ID NO: 367135 - DNA, 25 bp, Mus musculus
tctgcatcgcggggtggcgggacgg

SEQ ID NO: 367136 - DNA, 25 bp, Mus musculus
tctgcatctatacaggtgacctctt

SEQ ID NO: 367137 - DNA, 25 bp, Mus musculus
tctgcatctatgaggagaaccatgg

SEQ ID NO: 367138 - DNA, 25 bp, Mus musculus
tctgcatgaacttctgcacagcagc

SEQ ID NO: 367139 - DNA, 25 bp, Mus musculus
tctgcatgaatttcagttcgttgtg

SEQ ID NO: 367140 - DNA, 25 bp, Mus musculus
tctgcatgagcagtaccccctggcc

SEQ ID NO: 367141 - DNA, 25 bp, Mus musculus
tctgcatgagcagtcgatggctgtg

SEQ ID NO: 367142 - DNA, 25 bp, Mus musculus
tctgcatgaggcttggatctagcaa

SEQ ID NO: 367143 - DNA, 25 bp, Mus musculus
tctgcatgcagatggagatgcagcc

SEQ ID NO: 367144 - DNA, 25 bp, Mus musculus
tctgcatgcagatgggggcagagat

SEQ ID NO: 367145 - DNA, 25 bp, Mus musculus
tctgcatgctcatggtgggcagcaa

SEQ ID NO: 367146 - DNA, 25 bp, Mus musculus
tctgcatggctgatccttccttgtt

SEQ ID NO: 367147 - DNA, 25 bp, Mus musculus
tctgcatgttgagacacaaagatcg

SEQ ID NO: 367148 - DNA, 25 bp, Mus musculus
tctgcattcacacaaatagcatgtg

SEQ ID NO: 367149 - DNA, 25 bp, Mus musculus
tctgcattcacacaattaccagaac

SEQ ID NO: 367150 - DNA, 25 bp, Mus musculus
tctgcattcgtgccgaggagttgtc

SEQ ID NO: 367151 - DNA, 25 bp, Mus musculus
tctgcattcgtggtgtttgtctttg

SEQ ID NO: 367152 - DNA, 25 bp, Mus musculus
tctgcattctgggagcctagggctt

SEQ ID NO: 367153 - DNA, 25 bp, Mus musculus
tctgcattggaccagttttcagagc

SEQ ID NO: 367154 - DNA, 25 bp, Mus musculus
tctgcatttactgagaaacatggtg

SEQ ID NO: 367155 - DNA, 25 bp, Mus musculus
tctgcatttggcataattccaagaa

SEQ ID NO: 367156 - DNA, 25 bp, Mus musculus
tctgcattttaaggaagatccttgg

SEQ ID NO: 367157 - DNA, 25 bp, Mus musculus
tctgcattttaaggagcataaacat

SEQ ID NO: 367158 - DNA, 25 bp, Mus musculus
tctgccaacagacccagtgttgagt

SEQ ID NO: 367159 - DNA, 25 bp, Mus musculus
tctgccaacaggaatgggtaggaga

SEQ ID NO: 367160 - DNA, 25 bp, Mus musculus
tctgccaaggacctccctgcaccca

SEQ ID NO: 367161 - DNA, 25 bp, Mus musculus
tctgccacacttaggcatcctacat

SEQ ID NO: 367162 - DNA, 25 bp, Mus musculus
tctgccacatagaaggctctcagca

SEQ ID NO: 367163 - DNA, 25 bp, Mus musculus
tctgccaccaagcagaaacagcacc

SEQ ID NO: 367164 - DNA, 25 bp, Mus musculus
tctgccaccaagcaggagattacct

SEQ ID NO: 367165 - DNA, 25 bp, Mus musculus
tctgccaccatttggcttcattaaa

SEQ ID NO: 367166 - DNA, 25 bp, Mus musculus
tctgccacctactggacccttttgt

SEQ ID NO: 367167 - DNA, 25 bp, Mus musculus
tctgccacctccaagtcagcctcca

SEQ ID NO: 367168 - DNA, 25 bp, Mus musculus
tctgccacgagagagctgcaagacc

SEQ ID NO: 367169 - DNA, 25 bp, Mus musculus
tctgccactgcgcgccggagcctgg

SEQ ID NO: 367170 - DNA, 25 bp, Mus musculus
tctgccactgcgcgcgcccggcatg

SEQ ID NO: 367171 - DNA, 25 bp, Mus musculus
tctgccagaaagtgacagcatcctc

SEQ ID NO: 367172 - DNA, 25 bp, Mus musculus
tctgccagatgaagatgactgtcag

SEQ ID NO: 367173 - DNA, 25 bp, Mus musculus
tctgccagcaaggtgtagctacttc

SEQ ID NO: 367174 - DNA, 25 bp, Mus musculus
tctgccagctgcaggtggtggctga

SEQ ID NO: 367175 - DNA, 25 bp, Mus musculus
tctgccagctggagacctccacaca

SEQ ID NO: 367176 - DNA, 25 bp, Mus musculus
tctgccaggaatgtaataacatgct

SEQ ID NO: 367177 - DNA, 25 bp, Mus musculus
tctgccagtgcaagaatggccattt

SEQ ID NO: 367178 - DNA, 25 bp, Mus musculus
tctgccagtgcaagatgaagcactg

SEQ ID NO: 367179 - DNA, 25 bp, Mus musculus
tctgccagtggaccctcatgaccta

SEQ ID NO: 367180 - DNA, 25 bp, Mus musculus
tctgccagtggacgactctcaggca

SEQ ID NO: 367181 - DNA, 25 bp, Mus musculus
tctgccagtgtgattttgacattgc

SEQ ID NO: 367182 - DNA, 25 bp, Mus musculus
tctgccatctagcactaagagcggc

SEQ ID NO: 367183 - DNA, 25 bp, Mus musculus
tctgccattctcaggaaaactactc

SEQ ID NO: 367184 - DNA, 25 bp, Mus musculus
tctgccattttctaggaaacctcgt

SEQ ID NO: 367185 - DNA, 25 bp, Mus musculus
tctgcccaacaaggcacctcccacg

SEQ ID NO: 367186 - DNA, 25 bp, Mus musculus
tctgcccaataaggcacctcccacc

SEQ ID NO: 367187 - DNA, 25 bp, Mus musculus
tctgcccaattgttatggctttgag

SEQ ID NO: 367188 - DNA, 25 bp, Mus musculus
tctgcccacacagggtgtgtcccca

SEQ ID NO: 367189 - DNA, 25 bp, Mus musculus
tctgcccacacaggttctgcagtac

SEQ ID NO: 367190 - DNA, 25 bp, Mus musculus
tctgcccacagagagcccagacgct

SEQ ID NO: 367191 - DNA, 25 bp, Mus musculus
tctgcccaccaggcttggaagggag

SEQ ID NO: 367192 - DNA, 25 bp, Mus musculus
tctgcccatgtgatcatgattctgg

SEQ ID NO: 367193 - DNA, 25 bp, Mus musculus
tctgccccaaaggcattcgatgggt

SEQ ID NO: 367194 - DNA, 25 bp, Mus musculus
tctgccccaaagttccccagctcgg

SEQ ID NO: 367195 - DNA, 25 bp, Mus musculus
tctgccccacaccccgtgacccgca

SEQ ID NO: 367196 - DNA, 25 bp, Mus musculus
tctgccccaggagaggactcttccc

SEQ ID NO: 367197 - DNA, 25 bp, Mus musculus
tctgccccaggcgggatccgggaga

SEQ ID NO: 367198 - DNA, 25 bp, Mus musculus
tctgccccaggtgtaaagaagagca

SEQ ID NO: 367199 - DNA, 25 bp, Mus musculus
tctgccccccaattattaagaaatt

SEQ ID NO: 367200 - DNA, 25 bp, Mus musculus
tctgcccctcgcgagagctggctcg

SEQ ID NO: 367201 - DNA, 25 bp, Mus musculus
tctgcccctgcctaagcctgaaaat

SEQ ID NO: 367202 - DNA, 25 bp, Mus musculus
tctgccctcacacagagaggtctga

SEQ ID NO: 367203 - DNA, 25 bp, Mus musculus
tctgccctcacacaggtttccctct

SEQ ID NO: 367204 - DNA, 25 bp, Mus musculus
tctgccctgaaggctggataatcag

SEQ ID NO: 367205 - DNA, 25 bp, Mus musculus
tctgccctgaccccggtgtgtgata

SEQ ID NO: 367206 - DNA, 25 bp, Mus musculus
tctgccctgggagcctctgacctcc

SEQ ID NO: 367207 - DNA, 25 bp, Mus musculus
tctgccctgtgagtttcaggtgcca

SEQ ID NO: 367208 - DNA, 25 bp, Mus musculus
tctgccctttttggctgcagagata

SEQ ID NO: 367209 - DNA, 25 bp, Mus musculus
tctgccctttttgtgccgtggtgag

SEQ ID NO: 367210 - DNA, 25 bp, Mus musculus
tctgccgaagcaaggtgagatctcc

SEQ ID NO: 367211 - DNA, 25 bp, Mus musculus
tctgccgagaggggtcccacagagg

SEQ ID NO: 367212 - DNA, 25 bp, Mus musculus
tctgccgcaggacagcaccacgccc

SEQ ID NO: 367213 - DNA, 25 bp, Mus musculus
tctgccgccagcattgacctcttta

SEQ ID NO: 367214 - DNA, 25 bp, Mus musculus
tctgccgcccgagcagttgccccag

SEQ ID NO: 367215 - DNA, 25 bp, Mus musculus
tctgccgcctcctcagtatcaggca

SEQ ID NO: 367216 - DNA, 25 bp, Mus musculus
tctgccggctgccgttccgagccct

SEQ ID NO: 367217 - DNA, 25 bp, Mus musculus
tctgccgtcaaagtcgtgaccccag

SEQ ID NO: 367218 - DNA, 25 bp, Mus musculus
tctgccgtgtgtctgcccatcgtgt

SEQ ID NO: 367219 - DNA, 25 bp, Mus musculus
tctgcctacatctggtagtttacaa

SEQ ID NO: 367220 - DNA, 25 bp, Mus musculus
tctgcctaccaggtgcagagcccct

SEQ ID NO: 367221 - DNA, 25 bp, Mus musculus
tctgcctaccaggtggcaaaggaaa

SEQ ID NO: 367222 - DNA, 25 bp, Mus musculus
tctgcctaccctgaggaagctggaa

SEQ ID NO: 367223 - DNA, 25 bp, Mus musculus
tctgcctcaaagctcattggctaag

SEQ ID NO: 367224 - DNA, 25 bp, Mus musculus
tctgcctcaagaaatttgtcaagcc

SEQ ID NO: 367225 - DNA, 25 bp, Mus musculus
tctgcctcagagaacatgagctgtg

SEQ ID NO: 367226 - DNA, 25 bp, Mus musculus
tctgcctcagagcacctacgcttgg

SEQ ID NO: 367227 - DNA, 25 bp, Mus musculus
tctgcctcagcagccaatggaaacg

SEQ ID NO: 367228 - DNA, 25 bp, Mus musculus
tctgcctcagcagggctgccctttg

SEQ ID NO: 367229 - DNA, 25 bp, Mus musculus
tctgcctcaggacctcttcctgatg

SEQ ID NO: 367230 - DNA, 25 bp, Mus musculus
tctgcctcaggtcttcggatcagtg

SEQ ID NO: 367231 - DNA, 25 bp, Mus musculus
tctgcctcattgtacaagtctccag

SEQ ID NO: 367232 - DNA, 25 bp, Mus musculus
tctgcctccaggagaaggtcctttt

SEQ ID NO: 367233 - DNA, 25 bp, Mus musculus
tctgcctccttaagggtcttgagac

SEQ ID NO: 367234 - DNA, 25 bp, Mus musculus
tctgcctcgaatacgaaaatggatc

SEQ ID NO: 367235 - DNA, 25 bp, Mus musculus
tctgcctctgttaccgtaaagcctt

SEQ ID NO: 367236 - DNA, 25 bp, Mus musculus
tctgcctgaaggtttgacttcatgc

SEQ ID NO: 367237 - DNA, 25 bp, Mus musculus
tctgcctgacaaattgacatcagca

SEQ ID NO: 367238 - DNA, 25 bp, Mus musculus
tctgcctgacaattggcagcttcag

SEQ ID NO: 367239 - DNA, 25 bp, Mus musculus
tctgcctgactcagaacaggtgaga

SEQ ID NO: 367240 - DNA, 25 bp, Mus musculus
tctgcctgaggaggattcagaattt

SEQ ID NO: 367241 - DNA, 25 bp, Mus musculus
tctgcctgccattgctgctctgaca

SEQ ID NO: 367242 - DNA, 25 bp, Mus musculus
tctgcctgccattgctgctgacaag

SEQ ID NO: 367243 - DNA, 25 bp, Mus musculus
tctgcctggcacaaggtgatagagg

SEQ ID NO: 367244 - DNA, 25 bp, Mus musculus
tctgcctgggatgcgccgcagcacc

SEQ ID NO: 367245 - DNA, 25 bp, Mus musculus
tctgcctgggattttcctggtctgg

SEQ ID NO: 367246 - DNA, 25 bp, Mus musculus
tctgcctggtggaggcggacctatg

SEQ ID NO: 367247 - DNA, 25 bp, Mus musculus
tctgcctgtaacggagactctggtg

SEQ ID NO: 367248 - DNA, 25 bp, Mus musculus
tctgcctgtattggccttctgtata

SEQ ID NO: 367249 - DNA, 25 bp, Mus musculus
tctgcctgtcaggaccgaataaacc

SEQ ID NO: 367250 - DNA, 25 bp, Mus musculus
tctgcctgtcagtgaagctggctat

SEQ ID NO: 367251 - DNA, 25 bp, Mus musculus
tctgcctgtccagacatcttcttct

SEQ ID NO: 367252 - DNA, 25 bp, Mus musculus
tctgcctgtccagggatttggacat

SEQ ID NO: 367253 - DNA, 25 bp, Mus musculus
tctgcctgtttttgagccacgtggt

SEQ ID NO: 367254 - DNA, 25 bp, Mus musculus
tctgccttaaaaaagaatccatgcc

SEQ ID NO: 367255 - DNA, 25 bp, Mus musculus
tctgccttaaaaaaggatgctcatg

SEQ ID NO: 367256 - DNA, 25 bp, Mus musculus
tctgccttcagaaaaaatgctgttt

SEQ ID NO: 367257 - DNA, 25 bp, Mus musculus
tctgccttcctggattcaccggcgc

SEQ ID NO: 367258 - DNA, 25 bp, Mus musculus
tctgccttctctgggttccctggac

SEQ ID NO: 367259 - DNA, 25 bp, Mus musculus
tctgccttgcttaccctagaagccg

SEQ ID NO: 367260 - DNA, 25 bp, Mus musculus
tctgcctttgaaacagacataatga

SEQ ID NO: 367261 - DNA, 25 bp, Mus musculus
tctgcctttgaacatgattctgtta

SEQ ID NO: 367262 - DNA, 25 bp, Mus musculus
tctgcctttggaaaggagcaccgac

SEQ ID NO: 367263 - DNA, 25 bp, Mus musculus
tctgcctttgggctgtaccttggcc

SEQ ID NO: 367264 - DNA, 25 bp, Mus musculus
tctgcctttggggatgtcgtcaccg

SEQ ID NO: 367265 - DNA, 25 bp, Mus musculus
tctgccttttacaatgctcatgacc

SEQ ID NO: 367266 - DNA, 25 bp, Mus musculus
tctgcgaaaaagggatgactgagtg

SEQ ID NO: 367267 - DNA, 25 bp, Mus musculus
tctgcgaaccaaacacactgggttc

SEQ ID NO: 367268 - DNA, 25 bp, Mus musculus
tctgcgaaccaactgccaggggaca

SEQ ID NO: 367269 - DNA, 25 bp, Mus musculus
tctgcgaaggtcaagcacccctatt

SEQ ID NO: 367270 - DNA, 25 bp, Mus musculus
tctgcgaaggtcaaggccacaggcc

SEQ ID NO: 367271 - DNA, 25 bp, Mus musculus
tctgcgaatggaaggagagtccaga

SEQ ID NO: 367272 - DNA, 25 bp, Mus musculus
tctgcgactctgagagcagaggggc

SEQ ID NO: 367273 - DNA, 25 bp, Mus musculus
tctgcgagactaaagaaacgtgttc

SEQ ID NO: 367274 - DNA, 25 bp, Mus musculus
tctgcgagcagccaccactggtcca

SEQ ID NO: 367275 - DNA, 25 bp, Mus musculus
tctgcgagccgcagtggttttatga

SEQ ID NO: 367276 - DNA, 25 bp, Mus musculus
tctgcgagctacaagtattctgagg

SEQ ID NO: 367277 - DNA, 25 bp, Mus musculus
tctgcgattcccaaggccttccccc

SEQ ID NO: 367278 - DNA, 25 bp, Mus musculus
tctgcgatttagctgctgtgtggat

SEQ ID NO: 367279 - DNA, 25 bp, Mus musculus
tctgcgcagacaggtgtcagctgac

SEQ ID NO: 367280 - DNA, 25 bp, Mus musculus
tctgcgcagagaggtccaggatgcc

SEQ ID NO: 367281 - DNA, 25 bp, Mus musculus
tctgcgcagagaggtccaggatgct

SEQ ID NO: 367282 - DNA, 25 bp, Mus musculus
tctgcgcagtgctagctcttctgtc

SEQ ID NO: 367283 - DNA, 25 bp, Mus musculus
tctgcgccagccaagaagaagatga

SEQ ID NO: 367284 - DNA, 25 bp, Mus musculus
tctgcgccagccaaggtggggctgc

SEQ ID NO: 367285 - DNA, 25 bp, Mus musculus
tctgcgcccccagccactggcccct

SEQ ID NO: 367286 - DNA, 25 bp, Mus musculus
tctgcgccccgggctccagcatacc

SEQ ID NO: 367287 - DNA, 25 bp, Mus musculus
tctgcgccctcaggatgactgagtg

SEQ ID NO: 367288 - DNA, 25 bp, Mus musculus
tctgcgcctaggggaggatcatgcg

SEQ ID NO: 367289 - DNA, 25 bp, Mus musculus
tctgcgcgggagagtcctttcaagt

SEQ ID NO: 367290 - DNA, 25 bp, Mus musculus
tctgcgcgtccagggtttcctctcc

SEQ ID NO: 367291 - DNA, 25 bp, Mus musculus
tctgcgcgtccaggttaaatgaata

SEQ ID NO: 367292 - DNA, 25 bp, Mus musculus
tctgcgctggcaggtcccagggatt

SEQ ID NO: 367293 - DNA, 25 bp, Mus musculus
tctgcgctggcaggttgtagatacc

SEQ ID NO: 367294 - DNA, 25 bp, Mus musculus
tctgcggaaagtacacaaacaagtt

SEQ ID NO: 367295 - DNA, 25 bp, Mus musculus
tctgcggaagggaaacaacctgatc

SEQ ID NO: 367296 - DNA, 25 bp, Mus musculus
tctgcggaatggggtgagtgaggag

SEQ ID NO: 367297 - DNA, 25 bp, Mus musculus
tctgcggaccgagaacctctccata

SEQ ID NO: 367298 - DNA, 25 bp, Mus musculus
tctgcggaccgagaagaaccgatcg

SEQ ID NO: 367299 - DNA, 25 bp, Mus musculus
tctgcggagcctaagtctgtaccaa

SEQ ID NO: 367300 - DNA, 25 bp, Mus musculus
tctgcggagcggggttgaaagacac

SEQ ID NO: 367301 - DNA, 25 bp, Mus musculus
tctgcggagcgggtttatggtcggc

SEQ ID NO: 367302 - DNA, 25 bp, Mus musculus
tctgcggcccggctagttcattgaa

SEQ ID NO: 367303 - DNA, 25 bp, Mus musculus
tctgcggccgcaggcctgaagctca

SEQ ID NO: 367304 - DNA, 25 bp, Mus musculus
tctgcggctggccacgtgtggttga

SEQ ID NO: 367305 - DNA, 25 bp, Mus musculus
tctgcgggccagaatcaccgccgcc

SEQ ID NO: 367306 - DNA, 25 bp, Mus musculus
tctgcgggctttgcttaaatccagt

SEQ ID NO: 367307 - DNA, 25 bp, Mus musculus
tctgcggggcggttgccgctggtgg

SEQ ID NO: 367308 - DNA, 25 bp, Mus musculus
tctgcgggtgcttctgtttccggtg

SEQ ID NO: 367309 - DNA, 25 bp, Mus musculus
tctgcggtttccagatgaagctctc

SEQ ID NO: 367310 - DNA, 25 bp, Mus musculus
tctgcgtacagatgtggagattggc

SEQ ID NO: 367311 - DNA, 25 bp, Mus musculus
tctgcgtaccccagaccgattttgc

SEQ ID NO: 367312 - DNA, 25 bp, Mus musculus
tctgcgtcattcagagaggaatgcg

SEQ ID NO: 367313 - DNA, 25 bp, Mus musculus
tctgcgtccgtgcccgttctgtact

SEQ ID NO: 367314 - DNA, 25 bp, Mus musculus
tctgcgtctaaaggcttcgagtacc

SEQ ID NO: 367315 - DNA, 25 bp, Mus musculus
tctgcgtctcgagacaagaccataa

SEQ ID NO: 367316 - DNA, 25 bp, Mus musculus
tctgcgtctcgagacaagaccatca

SEQ ID NO: 367317 - DNA, 25 bp, Mus musculus
tctgcgtgcccagggtcctgtgggc

SEQ ID NO: 367318 - DNA, 25 bp, Mus musculus
tctgcgtgcctatcaatcccaggct

SEQ ID NO: 367319 - DNA, 25 bp, Mus musculus
tctgcgtggcttccggagacagaaa

SEQ ID NO: 367320 - DNA, 25 bp, Mus musculus
tctgcgtggcttccggatcctttgt

SEQ ID NO: 367321 - DNA, 25 bp, Mus musculus
tctgcgtgtgagcgtggcacaagac

SEQ ID NO: 367322 - DNA, 25 bp, Mus musculus
tctgcgttaattgaacactgttaat

SEQ ID NO: 367323 - DNA, 25 bp, Mus musculus
tctgctaaaagatttctgcatgaac

SEQ ID NO: 367324 - DNA, 25 bp, Mus musculus
tctgctaaaccattgctggcctcga

SEQ ID NO: 367325 - DNA, 25 bp, Mus musculus
tctgctaaaggactggaaaggagac

SEQ ID NO: 367326 - DNA, 25 bp, Mus musculus
tctgctaagaaggattcatggttgg

SEQ ID NO: 367327 - DNA, 25 bp, Mus musculus
tctgctaagaagggtgctcacttcg

SEQ ID NO: 367328 - DNA, 25 bp, Mus musculus
tctgctaatagttcctgcacgacca

SEQ ID NO: 367329 - DNA, 25 bp, Mus musculus
tctgctaatatggatgcaaagacca

SEQ ID NO: 367330 - DNA, 25 bp, Mus musculus
tctgctacaagcttcctgacagtgt

SEQ ID NO: 367331 - DNA, 25 bp, Mus musculus
tctgctacaaggaggatctcagtaa

SEQ ID NO: 367332 - DNA, 25 bp, Mus musculus
tctgctacaaggctttcttctgtgg

SEQ ID NO: 367333 - DNA, 25 bp, Mus musculus
tctgctacaagtgactacttccggg

SEQ ID NO: 367334 - DNA, 25 bp, Mus musculus
tctgctacacagcctcttgccagcc

SEQ ID NO: 367335 - DNA, 25 bp, Mus musculus
tctgctacagcggctgtacagcatg

SEQ ID NO: 367336 - DNA, 25 bp, Mus musculus
tctgctacaggagtcagcagcccca

SEQ ID NO: 367337 - DNA, 25 bp, Mus musculus
tctgctaccacagccgctagtcaga

SEQ ID NO: 367338 - DNA, 25 bp, Mus musculus
tctgctaccacaggagccgaaagcg

SEQ ID NO: 367339 - DNA, 25 bp, Mus musculus
tctgctacctgaattttgtgccatc

SEQ ID NO: 367340 - DNA, 25 bp, Mus musculus
tctgctaccttcaagatgctgtccc

SEQ ID NO: 367341 - DNA, 25 bp, Mus musculus
tctgctagagaagggcaagtctgaa

SEQ ID NO: 367342 - DNA, 25 bp, Mus musculus
tctgctagagactggctctccaagc

SEQ ID NO: 367343 - DNA, 25 bp, Mus musculus
tctgctagagctctggtgttctatt

SEQ ID NO: 367344 - DNA, 25 bp, Mus musculus
tctgctagaggttcacaacaaagag

SEQ ID NO: 367345 - DNA, 25 bp, Mus musculus
tctgctagagtaggtgcttcccgga

SEQ ID NO: 367346 - DNA, 25 bp, Mus musculus
tctgctagcatagatattttgagac

SEQ ID NO: 367347 - DNA, 25 bp, Mus musculus
tctgctagcatcagggcccatttgg

SEQ ID NO: 367348 - DNA, 25 bp, Mus musculus
tctgctagccaagatatcaacctga

SEQ ID NO: 367349 - DNA, 25 bp, Mus musculus
tctgctagccaaggtgctggattaa

SEQ ID NO: 367350 - DNA, 25 bp, Mus musculus
tctgctatagaaggtaattacactc

SEQ ID NO: 367351 - DNA, 25 bp, Mus musculus
tctgctatcaaggtgcagagcccct

SEQ ID NO: 367352 - DNA, 25 bp, Mus musculus
tctgctattaagatcgagttctcta

SEQ ID NO: 367353 - DNA, 25 bp, Mus musculus
tctgctattgcagaggtggcttttg

SEQ ID NO: 367354 - DNA, 25 bp, Mus musculus
tctgctattgcaggtttcctggcag

SEQ ID NO: 367355 - DNA, 25 bp, Mus musculus
tctgctcaagagtgaagacaagatc

SEQ ID NO: 367356 - DNA, 25 bp, Mus musculus
tctgctcacagcctccctcttaacc

SEQ ID NO: 367357 - DNA, 25 bp, Mus musculus
tctgctcacccacagagtgctgacc

SEQ ID NO: 367358 - DNA, 25 bp, Mus musculus
tctgctcacccagagcttgtcaatg

SEQ ID NO: 367359 - DNA, 25 bp, Mus musculus
tctgctcactgggggaatgcggggc

SEQ ID NO: 367360 - DNA, 25 bp, Mus musculus
tctgctcagagtggcctctcaaagg

SEQ ID NO: 367361 - DNA, 25 bp, Mus musculus
tctgctcagatggtttagacacgtg

SEQ ID NO: 367362 - DNA, 25 bp, Mus musculus
tctgctcagcagccactctctacaa

SEQ ID NO: 367363 - DNA, 25 bp, Mus musculus
tctgctcagcagggataactctctg

SEQ ID NO: 367364 - DNA, 25 bp, Mus musculus
tctgctcaggatcccagccagccct

SEQ ID NO: 367365 - DNA, 25 bp, Mus musculus
tctgctcagggcggcttcatttgga

SEQ ID NO: 367366 - DNA, 25 bp, Mus musculus
tctgctcatccgctcccatctccag

SEQ ID NO: 367367 - DNA, 25 bp, Mus musculus
tctgctccagcaaggtgcagagctt

SEQ ID NO: 367368 - DNA, 25 bp, Mus musculus
tctgctcccccaggccggtagtggt

SEQ ID NO: 367369 - DNA, 25 bp, Mus musculus
tctgctccgaggtctccaaaaatgc

SEQ ID NO: 367370 - DNA, 25 bp, Mus musculus
tctgctcctcagccatgagaaaaca

SEQ ID NO: 367371 - DNA, 25 bp, Mus musculus
tctgctcctgccaatgggaagctcc

SEQ ID NO: 367372 - DNA, 25 bp, Mus musculus
tctgctcctggccttcccagaggcc

SEQ ID NO: 367373 - DNA, 25 bp, Mus musculus
tctgctccttgaatacctctgcagg

SEQ ID NO: 367374 - DNA, 25 bp, Mus musculus
tctgctcggcagcacatcatgcaac

SEQ ID NO: 367375 - DNA, 25 bp, Mus musculus
tctgctcggctcacggatgatgact

SEQ ID NO: 367376 - DNA, 25 bp, Mus musculus
tctgctcggtctggtttatctccgg

SEQ ID NO: 367377 - DNA, 25 bp, Mus musculus
tctgctctccaccgggaaaatctga

SEQ ID NO: 367378 - DNA, 25 bp, Mus musculus
tctgctctctagcagccctacgttc

SEQ ID NO: 367379 - DNA, 25 bp, Mus musculus
tctgctctgcagtgcctgagcaaca

SEQ ID NO: 367380 - DNA, 25 bp, Mus musculus
tctgctctgggatgctgcaggacca

SEQ ID NO: 367381 - DNA, 25 bp, Mus musculus
tctgctcttaccaatcttgaacttt

SEQ ID NO: 367382 - DNA, 25 bp, Mus musculus
tctgctcttccaggtgacagtcaca

SEQ ID NO: 367383 - DNA, 25 bp, Mus musculus
tctgctcttccagtgggaaacattc

SEQ ID NO: 367384 - DNA, 25 bp, Mus musculus
tctgctcttgccatgcttccaccac

SEQ ID NO: 367385 - DNA, 25 bp, Mus musculus
tctgctgaaggtgtccatcatacct

SEQ ID NO: 367386 - DNA, 25 bp, Mus musculus
tctgctgacaattgcttctacttct

SEQ ID NO: 367387 - DNA, 25 bp, Mus musculus
tctgctgacagacactgtcctgttg

SEQ ID NO: 367388 - DNA, 25 bp, Mus musculus
tctgctgaccaagcccactccccac

SEQ ID NO: 367389 - DNA, 25 bp, Mus musculus
tctgctgacctgggcacacatgaga

SEQ ID NO: 367390 - DNA, 25 bp, Mus musculus
tctgctgacgcttcgctgcggggtc

SEQ ID NO: 367391 - DNA, 25 bp, Mus musculus
tctgctgacggatagcggcggcttc

SEQ ID NO: 367392 - DNA, 25 bp, Mus musculus
tctgctgagcaaagatgaagcggca

SEQ ID NO: 367393 - DNA, 25 bp, Mus musculus
tctgctgagtcctgcagcaggtgca

SEQ ID NO: 367394 - DNA, 25 bp, Mus musculus
tctgctgataccggtgacagtggta

SEQ ID NO: 367395 - DNA, 25 bp, Mus musculus
tctgctgatggacggctctcagaca

SEQ ID NO: 367396 - DNA, 25 bp, Mus musculus
tctgctgcaacagcaaggtggccac

SEQ ID NO: 367397 - DNA, 25 bp, Mus musculus
tctgctgcaacagcgaggcagaggc

SEQ ID NO: 367398 - DNA, 25 bp, Mus musculus
tctgctgcacagtgatcatcaagga

SEQ ID NO: 367399 - DNA, 25 bp, Mus musculus
tctgctgcaggatgctgccaaggtc

SEQ ID NO: 367400 - DNA, 25 bp, Mus musculus
tctgctgcatcagaacctcttacat

SEQ ID NO: 367401 - DNA, 25 bp, Mus musculus
tctgctgcatcagcccagcactatg

SEQ ID NO: 367402 - DNA, 25 bp, Mus musculus
tctgctgcatcaggtaccaccagct

SEQ ID NO: 367403 - DNA, 25 bp, Mus musculus
tctgctgccatggtagtgatggaca

SEQ ID NO: 367404 - DNA, 25 bp, Mus musculus
tctgctgcccctcctgggccctggc

SEQ ID NO: 367405 - DNA, 25 bp, Mus musculus
tctgctgccggcttttctcctgaac

SEQ ID NO: 367406 - DNA, 25 bp, Mus musculus
tctgctgccgggtcagcacctcggc

SEQ ID NO: 367407 - DNA, 25 bp, Mus musculus
tctgctgctgctggaacgggttcca

SEQ ID NO: 367408 - DNA, 25 bp, Mus musculus
tctgctgcttctgccaagattacag

SEQ ID NO: 367409 - DNA, 25 bp, Mus musculus
tctgctggactccacgtggaactta

SEQ ID NO: 367410 - DNA, 25 bp, Mus musculus
tctgctggagaaagagtacttctta

SEQ ID NO: 367411 - DNA, 25 bp, Mus musculus
tctgctggatcatgcacctccagag

SEQ ID NO: 367412 - DNA, 25 bp, Mus musculus
tctgctggatggctctgccttattc

SEQ ID NO: 367413 - DNA, 25 bp, Mus musculus
tctgctggcaagaacttgacctcat

SEQ ID NO: 367414 - DNA, 25 bp, Mus musculus
tctgctgggaagatgagccagatag

SEQ ID NO: 367415 - DNA, 25 bp, Mus musculus
tctgctgtacgcgtcttgttggaga

SEQ ID NO: 367416 - DNA, 25 bp, Mus musculus
tctgctgtacgcgtgccggaattgc

SEQ ID NO: 367417 - DNA, 25 bp, Mus musculus
tctgctgtatgggtggtctatcaca

SEQ ID NO: 367418 - DNA, 25 bp, Mus musculus
tctgctgtatggtgcccagcacggc

SEQ ID NO: 367419 - DNA, 25 bp, Mus musculus
tctgctgtatttcccacaggttttt

SEQ ID NO: 367420 - DNA, 25 bp, Mus musculus
tctgctgtatttctcacagatcttt

SEQ ID NO: 367421 - DNA, 25 bp, Mus musculus
tctgctgtcaggtacaggtcaagtt

SEQ ID NO: 367422 - DNA, 25 bp, Mus musculus
tctgctgtcatggaggtttatcacc

SEQ ID NO: 367423 - DNA, 25 bp, Mus musculus
tctgctgtctgtgaacaaatctacc

SEQ ID NO: 367424 - DNA, 25 bp, Mus musculus
tctgctgtctgtgcagtactccagg

SEQ ID NO: 367425 - DNA, 25 bp, Mus musculus
tctgctgtgcttgaggtgattgaag

SEQ ID NO: 367426 - DNA, 25 bp, Mus musculus
tctgctgtggacaagaaaggtgaca

SEQ ID NO: 367427 - DNA, 25 bp, Mus musculus
tctgctgtgggaacttatttagaag

SEQ ID NO: 367428 - DNA, 25 bp, Mus musculus
tctgctgttcagccagggacagtgg

SEQ ID NO: 367429 - DNA, 25 bp, Mus musculus
tctgctgttttgaagattaaaggtt

SEQ ID NO: 367430 - DNA, 25 bp, Mus musculus
tctgcttaaaatcaggaaattttgc

SEQ ID NO: 367431 - DNA, 25 bp, Mus musculus
tctgcttaaaatcaggcagggagaa

SEQ ID NO: 367432 - DNA, 25 bp, Mus musculus
tctgcttacccgccgcagctccgga

SEQ ID NO: 367433 - DNA, 25 bp, Mus musculus
tctgcttacccggtacctggcagca

SEQ ID NO: 367434 - DNA, 25 bp, Mus musculus
tctgcttataagactgaagagggaa

SEQ ID NO: 367435 - DNA, 25 bp, Mus musculus
tctgcttataaggacccatagatga

SEQ ID NO: 367436 - DNA, 25 bp, Mus musculus
tctgcttatggcgtgcgcagggacc

SEQ ID NO: 367437 - DNA, 25 bp, Mus musculus
tctgcttatgtgcttctgggtcctg

SEQ ID NO: 367438 - DNA, 25 bp, Mus musculus
tctgcttcaagcagcatgattgggc

SEQ ID NO: 367439 - DNA, 25 bp, Mus musculus
tctgcttcaagcagcgttccacgcc

SEQ ID NO: 367440 - DNA, 25 bp, Mus musculus
tctgcttcaagcagtgtggcattgt

SEQ ID NO: 367441 - DNA, 25 bp, Mus musculus
tctgcttccacctgtcacagcaaac

SEQ ID NO: 367442 - DNA, 25 bp, Mus musculus
tctgcttcccaggctaaggagaagg

SEQ ID NO: 367443 - DNA, 25 bp, Mus musculus
tctgcttctatgaggttgactgtgg

SEQ ID NO: 367444 - DNA, 25 bp, Mus musculus
tctgcttgaggaagaagctcactat

SEQ ID NO: 367445 - DNA, 25 bp, Mus musculus
tctgcttgatgtcctagaagaccct

SEQ ID NO: 367446 - DNA, 25 bp, Mus musculus
tctgcttggataagattaatgtcct

SEQ ID NO: 367447 - DNA, 25 bp, Mus musculus
tctgcttgtaaggcatctcagaagg

SEQ ID NO: 367448 - DNA, 25 bp, Mus musculus
tctgcttgtgggccaccccttccac

SEQ ID NO: 367449 - DNA, 25 bp, Mus musculus
tctgctttcaagaaaggcgacaggg

SEQ ID NO: 367450 - DNA, 25 bp, Mus musculus
tctgctttcaggttctcagaagcac

SEQ ID NO: 367451 - DNA, 25 bp, Mus musculus
tctgctttcaggttctgcagcattc

SEQ ID NO: 367452 - DNA, 25 bp, Mus musculus
tctgctttcaggttgggagaaacac

SEQ ID NO: 367453 - DNA, 25 bp, Mus musculus
tctgctttccagcaagccccgccca

SEQ ID NO: 367454 - DNA, 25 bp, Mus musculus
tctgctttcctgggaaggtgtgaac

SEQ ID NO: 367455 - DNA, 25 bp, Mus musculus
tctgcttttcctcagattgtctaaa

SEQ ID NO: 367456 - DNA, 25 bp, Mus musculus
tctgcttttggcaactcgttggtag

SEQ ID NO: 367457 - DNA, 25 bp, Mus musculus
tctgcttttgtctgctgcccatcat

SEQ ID NO: 367458 - DNA, 25 bp, Mus musculus
tctgctttttctcaggtgccttcag

SEQ ID NO: 367459 - DNA, 25 bp, Mus musculus
tctggaaaacagatttattcttcat

SEQ ID NO: 367460 - DNA, 25 bp, Mus musculus
tctggaaaacaggcccacagaacat

SEQ ID NO: 367461 - DNA, 25 bp, Mus musculus
tctggaaaagaactactgccgaaac

SEQ ID NO: 367462 - DNA, 25 bp, Mus musculus
tctggaaaatgccactccgtgtatc

SEQ ID NO: 367463 - DNA, 25 bp, Mus musculus
tctggaaacagaaaggacttcatct

SEQ ID NO: 367464 - DNA, 25 bp, Mus musculus
tctggaaaccaggaagtgagtgcct

SEQ ID NO: 367465 - DNA, 25 bp, Mus musculus
tctggaaaccaggagaacagtacgg

SEQ ID NO: 367466 - DNA, 25 bp, Mus musculus
tctggaaagagaaaacatcgctctc

SEQ ID NO: 367467 - DNA, 25 bp, Mus musculus
tctggaaagagatggctgtctcaaa

SEQ ID NO: 367468 - DNA, 25 bp, Mus musculus
tctggaaaggaacaggtatgtcact

SEQ ID NO: 367469 - DNA, 25 bp, Mus musculus
tctggaaaggagtatgtttgtcctg

SEQ ID NO: 367470 - DNA, 25 bp, Mus musculus
tctggaaaggagtattgcaagaaga

SEQ ID NO: 367471 - DNA, 25 bp, Mus musculus
tctggaaagtgagttacatgaacat

SEQ ID NO: 367472 - DNA, 25 bp, Mus musculus
tctggaaataaggccgttgactact

SEQ ID NO: 367473 - DNA, 25 bp, Mus musculus
tctggaaatacccggccccagcctg

SEQ ID NO: 367474 - DNA, 25 bp, Mus musculus
tctggaacagacacagcccttgacg

SEQ ID NO: 367475 - DNA, 25 bp, Mus musculus
tctggaacagctgtgtcactacttc

SEQ ID NO: 367476 - DNA, 25 bp, Mus musculus
tctggaacagggaacaagcttattg

SEQ ID NO: 367477 - DNA, 25 bp, Mus musculus
tctggaactctgacagtgtccattc

SEQ ID NO: 367478 - DNA, 25 bp, Mus musculus
tctggaactctgccaaaaatggatt

SEQ ID NO: 367479 - DNA, 25 bp, Mus musculus
tctggaacttcacgattcctgtgtt

SEQ ID NO: 367480 - DNA, 25 bp, Mus musculus
tctggaagagaacctgtggacaaag

SEQ ID NO: 367481 - DNA, 25 bp, Mus musculus
tctggaagattcgggcttcagttgt

SEQ ID NO: 367482 - DNA, 25 bp, Mus musculus
tctggaagcagcagccgcagcctac

SEQ ID NO: 367483 - DNA, 25 bp, Mus musculus
tctggaagccaactgggtggtgatg

SEQ ID NO: 367484 - DNA, 25 bp, Mus musculus
tctggaagccaagaaagccctctct

SEQ ID NO: 367485 - DNA, 25 bp, Mus musculus
tctggaagctaaaaatctggccgcc

SEQ ID NO: 367486 - DNA, 25 bp, Mus musculus
tctggaagtgagagttcattgtttc

SEQ ID NO: 367487 - DNA, 25 bp, Mus musculus
tctggaatacactgcatctatattg

SEQ ID NO: 367488 - DNA, 25 bp, Mus musculus
tctggaatatcctggaccatgctgc

SEQ ID NO: 367489 - DNA, 25 bp, Mus musculus
tctggaatcacaggccaactactgt

SEQ ID NO: 367490 - DNA, 25 bp, Mus musculus
tctggaatccctgagatcaaaacca

SEQ ID NO: 367491 - DNA, 25 bp, Mus musculus
tctggaatgacagatcagctcgaac

SEQ ID NO: 367492 - DNA, 25 bp, Mus musculus
tctggaatgtggaacagccccaaca

SEQ ID NO: 367493 - DNA, 25 bp, Mus musculus
tctggaatgtggtagcgagatggga

SEQ ID NO: 367494 - DNA, 25 bp, Mus musculus
tctggaattaaacaggcatgatgca

SEQ ID NO: 367495 - DNA, 25 bp, Mus musculus
tctggaattacagggatcgcttaca

SEQ ID NO: 367496 - DNA, 25 bp, Mus musculus
tctggaattgtgcatggcagaagag

SEQ ID NO: 367497 - DNA, 25 bp, Mus musculus
tctggaattgtgcatgttcccccta

SEQ ID NO: 367498 - DNA, 25 bp, Mus musculus
tctggacaaggtcagtcctcccggg

SEQ ID NO: 367499 - DNA, 25 bp, Mus musculus
tctggacaatgccaacagtatacat

SEQ ID NO: 367500 - DNA, 25 bp, Mus musculus
tctggacaattacggtgcccgaggg

SEQ ID NO: 367501 - DNA, 25 bp, Mus musculus
tctggacacccatggctttgagcac

SEQ ID NO: 367502 - DNA, 25 bp, Mus musculus
tctggacaccgatgactttgtgaaa

SEQ ID NO: 367503 - DNA, 25 bp, Mus musculus
tctggacaccgccacagtacatgtg

SEQ ID NO: 367504 - DNA, 25 bp, Mus musculus
tctggacactcaagaaaattacaac

SEQ ID NO: 367505 - DNA, 25 bp, Mus musculus
tctggacactcaagagagggactcc

SEQ ID NO: 367506 - DNA, 25 bp, Mus musculus
tctggacactcaaggcatttcccca

SEQ ID NO: 367507 - DNA, 25 bp, Mus musculus
tctggacactggcagtttccaggca

SEQ ID NO: 367508 - DNA, 25 bp, Mus musculus
tctggacagagcgaggtgtggacag

SEQ ID NO: 367509 - DNA, 25 bp, Mus musculus
tctggacagagtttgatgagtggtg

SEQ ID NO: 367510 - DNA, 25 bp, Mus musculus
tctggacagccaggtgtggagggct

SEQ ID NO: 367511 - DNA, 25 bp, Mus musculus
tctggacagccagtttgtaggtgtg

SEQ ID NO: 367512 - DNA, 25 bp, Mus musculus
tctggacccaaatcaatactacaag

SEQ ID NO: 367513 - DNA, 25 bp, Mus musculus
tctggaccctgcatggtttattgaa

SEQ ID NO: 367514 - DNA, 25 bp, Mus musculus
tctggacctcacctccttatagctc

SEQ ID NO: 367515 - DNA, 25 bp, Mus musculus
tctggacctgcagacccaagaatct

SEQ ID NO: 367516 - DNA, 25 bp, Mus musculus
tctggacctgcagcacgtgggataa

SEQ ID NO: 367517 - DNA, 25 bp, Mus musculus
tctggacctggctgcaggtcctggt

SEQ ID NO: 367518 - DNA, 25 bp, Mus musculus
tctggacggcctgtatgccctgatg

SEQ ID NO: 367519 - DNA, 25 bp, Mus musculus
tctggactatggctggcagagggag

SEQ ID NO: 367520 - DNA, 25 bp, Mus musculus
tctggactctcaggttgtgaggact

SEQ ID NO: 367521 - DNA, 25 bp, Mus musculus
tctggactgacgcagatgaagagct

SEQ ID NO: 367522 - DNA, 25 bp, Mus musculus
tctggactgcagcctcttttatgaa

SEQ ID NO: 367523 - DNA, 25 bp, Mus musculus
tctggactgtgcaaggaagatctgg

SEQ ID NO: 367524 - DNA, 25 bp, Mus musculus
tctggacttacaggtactatgggtt

SEQ ID NO: 367525 - DNA, 25 bp, Mus musculus
tctggacttgggcggacgtatgtga

SEQ ID NO: 367526 - DNA, 25 bp, Mus musculus
tctggacttggggggacgtatgtga

SEQ ID NO: 367527 - DNA, 25 bp, Mus musculus
tctggactttcaagatgacgggacg

SEQ ID NO: 367528 - DNA, 25 bp, Mus musculus
tctggactttcaagcctatgtgttt

SEQ ID NO: 367529 - DNA, 25 bp, Mus musculus
tctggagaaagagtttgagaggacc

SEQ ID NO: 367530 - DNA, 25 bp, Mus musculus
tctggagaagattgaagaaatgctt

SEQ ID NO: 367531 - DNA, 25 bp, Mus musculus
tctggagaagctccagcacccgagc

SEQ ID NO: 367532 - DNA, 25 bp, Mus musculus
tctggagaaggccaacagcaggctg

SEQ ID NO: 367533 - DNA, 25 bp, Mus musculus
tctggagaaggccagacccccatcc

SEQ ID NO: 367534 - DNA, 25 bp, Mus musculus
tctggagaaggccagggtagacagc

SEQ ID NO: 367535 - DNA, 25 bp, Mus musculus
tctggagaaggtggactatagtgga

SEQ ID NO: 367536 - DNA, 25 bp, Mus musculus
tctggagacacagcatcttgcagcc

SEQ ID NO: 367537 - DNA, 25 bp, Mus musculus
tctggagacactagacctgaactat

SEQ ID NO: 367538 - DNA, 25 bp, Mus musculus
tctggagaccaggttctctgccaac

SEQ ID NO: 367539 - DNA, 25 bp, Mus musculus
tctggagaccccagcaccacatctg

SEQ ID NO: 367540 - DNA, 25 bp, Mus musculus
tctggagacccggatgggagccagg

SEQ ID NO: 367541 - DNA, 25 bp, Mus musculus
tctggagaccggtggaggatctgga

SEQ ID NO: 367542 - DNA, 25 bp, Mus musculus
tctggagacctggaggatccccagg

SEQ ID NO: 367543 - DNA, 25 bp, Mus musculus
tctggagacctggtacggagcagag

SEQ ID NO: 367544 - DNA, 25 bp, Mus musculus
tctggagatccaggcttccgtgggg

SEQ ID NO: 367545 - DNA, 25 bp, Mus musculus
tctggagatgaagctataaaagcaa

SEQ ID NO: 367546 - DNA, 25 bp, Mus musculus
tctggagatggcagttccctccagg

SEQ ID NO: 367547 - DNA, 25 bp, Mus musculus
tctggagatggtcaagcaagaagcg

SEQ ID NO: 367548 - DNA, 25 bp, Mus musculus
tctggagattaaagtaattggcaac

SEQ ID NO: 367549 - DNA, 25 bp, Mus musculus
tctggagattgtcctgctttaaggc

SEQ ID NO: 367550 - DNA, 25 bp, Mus musculus
tctggagcaacaaggggaaagcgag

SEQ ID NO: 367551 - DNA, 25 bp, Mus musculus
tctggagcaacaagtccgtgcactg

SEQ ID NO: 367552 - DNA, 25 bp, Mus musculus
tctggagcagaagacaaaagaaatt

SEQ ID NO: 367553 - DNA, 25 bp, Mus musculus
tctggagcagaaggttatgttcttg

SEQ ID NO: 367554 - DNA, 25 bp, Mus musculus
tctggagcagcagcctcagggctgg

SEQ ID NO: 367555 - DNA, 25 bp, Mus musculus
tctggagcaggtgtgccacagatca

SEQ ID NO: 367556 - DNA, 25 bp, Mus musculus
tctggagcagtgccaataacttcgc

SEQ ID NO: 367557 - DNA, 25 bp, Mus musculus
tctggagccaggagaaggctgctat

SEQ ID NO: 367558 - DNA, 25 bp, Mus musculus
tctggagccgattcaaaaggtgatg

SEQ ID NO: 367559 - DNA, 25 bp, Mus musculus
tctggagccggtgagcctggaggcc

SEQ ID NO: 367560 - DNA, 25 bp, Mus musculus
tctggagctgccatcaacaccccct

SEQ ID NO: 367561 - DNA, 25 bp, Mus musculus
tctggaggaactgagaagacatttt

SEQ ID NO: 367562 - DNA, 25 bp, Mus musculus
tctggaggagattggcatccagaac

SEQ ID NO: 367563 - DNA, 25 bp, Mus musculus
tctggaggagctggaccagatctgc

SEQ ID NO: 367564 - DNA, 25 bp, Mus musculus
tctggaggaggttcttcgtgatctc

SEQ ID NO: 367565 - DNA, 25 bp, Mus musculus
tctggaggcaaggatggccaggcta

SEQ ID NO: 367566 - DNA, 25 bp, Mus musculus
tctggaggcaaggctatgctgtggg

SEQ ID NO: 367567 - DNA, 25 bp, Mus musculus
tctggaggcgagaaccatgtgtgct

SEQ ID NO: 367568 - DNA, 25 bp, Mus musculus
tctggaggcgagtatttcctaaatg

SEQ ID NO: 367569 - DNA, 25 bp, Mus musculus
tctggagggagagacgtgaaaaatg

SEQ ID NO: 367570 - DNA, 25 bp, Mus musculus
tctggaggggtgagtgtggatctgc

SEQ ID NO: 367571 - DNA, 25 bp, Mus musculus
tctggagtcgagctcctggggccct

SEQ ID NO: 367572 - DNA, 25 bp, Mus musculus
tctggagtcgatgaggatccagact

SEQ ID NO: 367573 - DNA, 25 bp, Mus musculus
tctggagtgtgggccagacccatgg

SEQ ID NO: 367574 - DNA, 25 bp, Mus musculus
tctggagttacggtgaaactagatt

SEQ ID NO: 367575 - DNA, 25 bp, Mus musculus
tctggagttagccagaatggagaat

SEQ ID NO: 367576 - DNA, 25 bp, Mus musculus
tctggagttatttagacaagatcct

SEQ ID NO: 367577 - DNA, 25 bp, Mus musculus
tctggagttgctttttgcaatgttt

SEQ ID NO: 367578 - DNA, 25 bp, Mus musculus
tctggagttggctgcaacaggtgac

SEQ ID NO: 367579 - DNA, 25 bp, Mus musculus
tctggataaaaaggtagcaacaatt

SEQ ID NO: 367580 - DNA, 25 bp, Mus musculus
tctggataaagagttcaggaaggag

SEQ ID NO: 367581 - DNA, 25 bp, Mus musculus
tctggataagagtgcctcgggccca

SEQ ID NO: 367582 - DNA, 25 bp, Mus musculus
tctggataagcccacctggaagcag

SEQ ID NO: 367583 - DNA, 25 bp, Mus musculus
tctggataaggtgcttctgtgtggt

SEQ ID NO: 367584 - DNA, 25 bp, Mus musculus
tctggatacagacaggatctttcta

SEQ ID NO: 367585 - DNA, 25 bp, Mus musculus
tctggatacagccaaggtctccaag

SEQ ID NO: 367586 - DNA, 25 bp, Mus musculus
tctggatacaggtggaaacgtcctc

SEQ ID NO: 367587 - DNA, 25 bp, Mus musculus
tctggatacccagtttgcagatggc

SEQ ID NO: 367588 - DNA, 25 bp, Mus musculus
tctggatatgcaagctcttgaagac

SEQ ID NO: 367589 - DNA, 25 bp, Mus musculus
tctggatatgcaagttttgattatg

SEQ ID NO: 367590 - DNA, 25 bp, Mus musculus
tctggatcagaattaaaatgctctg

SEQ ID NO: 367591 - DNA, 25 bp, Mus musculus
tctggatcagaccttgtgaccgtgt

SEQ ID NO: 367592 - DNA, 25 bp, Mus musculus
tctggatcagatctccatgatcaga

SEQ ID NO: 367593 - DNA, 25 bp, Mus musculus
tctggatcagattgattatgtgtaa

SEQ ID NO: 367594 - DNA, 25 bp, Mus musculus
tctggatcaggctgctccactactc

SEQ ID NO: 367595 - DNA, 25 bp, Mus musculus
tctggatcagggtttgaggagtatt

SEQ ID NO: 367596 - DNA, 25 bp, Mus musculus
tctggatccaggtggtacccgggag

SEQ ID NO: 367597 - DNA, 25 bp, Mus musculus
tctggatcgagacaaagtgcaacag

SEQ ID NO: 367598 - DNA, 25 bp, Mus musculus
tctggatcgagacggtctgtcctgt

SEQ ID NO: 367599 - DNA, 25 bp, Mus musculus
tctggatcgagagaaagtgcaacag

SEQ ID NO: 367600 - DNA, 25 bp, Mus musculus
tctggatcgagagggtctgtcctgt

SEQ ID NO: 367601 - DNA, 25 bp, Mus musculus
tctggatctaacaaggagcgagatt

SEQ ID NO: 367602 - DNA, 25 bp, Mus musculus
tctggatctaacaaggttcatttaa

SEQ ID NO: 367603 - DNA, 25 bp, Mus musculus
tctggatctggtgaagcaggaaggc

SEQ ID NO: 367604 - DNA, 25 bp, Mus musculus
tctggatgaacaacactttcatggt

SEQ ID NO: 367605 - DNA, 25 bp, Mus musculus
tctggatgaagctgtagcaatggag

SEQ ID NO: 367606 - DNA, 25 bp, Mus musculus
tctggatgacaagccaagcccgatc

SEQ ID NO: 367607 - DNA, 25 bp, Mus musculus
tctggatgacagctctgaccaggct

SEQ ID NO: 367608 - DNA, 25 bp, Mus musculus
tctggatgactctgctcactggagg

SEQ ID NO: 367609 - DNA, 25 bp, Mus musculus
tctggatgagaattggcaaggttgg

SEQ ID NO: 367610 - DNA, 25 bp, Mus musculus
tctggatgagagggagatgagacag

SEQ ID NO: 367611 - DNA, 25 bp, Mus musculus
tctggatgagtggatctccacttgg

SEQ ID NO: 367612 - DNA, 25 bp, Mus musculus
tctggatgccccaggaactggatgc

SEQ ID NO: 367613 - DNA, 25 bp, Mus musculus
tctggatgccccagttttataggca

SEQ ID NO: 367614 - DNA, 25 bp, Mus musculus
tctggatgctatgtcaggatcgcag

SEQ ID NO: 367615 - DNA, 25 bp, Mus musculus
tctggatggaacctgttcgatttct

SEQ ID NO: 367616 - DNA, 25 bp, Mus musculus
tctggatggagagggccctggatgt

SEQ ID NO: 367617 - DNA, 25 bp, Mus musculus
tctggatgtactggacaaacaaaca

SEQ ID NO: 367618 - DNA, 25 bp, Mus musculus
tctggcaaaagatgcttgcattggg

SEQ ID NO: 367619 - DNA, 25 bp, Mus musculus
tctggcaaaatgcgtgcccacactt

SEQ ID NO: 367620 - DNA, 25 bp, Mus musculus
tctggcaaaggccaaggaagtagca

SEQ ID NO: 367621 - DNA, 25 bp, Mus musculus
tctggcaaagggtatacctggcctt

SEQ ID NO: 367622 - DNA, 25 bp, Mus musculus
tctggcaagcacgatctgcccatgg

SEQ ID NO: 367623 - DNA, 25 bp, Mus musculus
tctggcacaagggtgactgtggccc

SEQ ID NO: 367624 - DNA, 25 bp, Mus musculus
tctggcacagaagctgattggcgtc

SEQ ID NO: 367625 - DNA, 25 bp, Mus musculus
tctggcacagccggagagaagcccg

SEQ ID NO: 367626 - DNA, 25 bp, Mus musculus
tctggcacagctgctgaaccaggtg

SEQ ID NO: 367627 - DNA, 25 bp, Mus musculus
tctggcacaggcttctgccctcaca

SEQ ID NO: 367628 - DNA, 25 bp, Mus musculus
tctggcacaggtgctttgccagata

SEQ ID NO: 367629 - DNA, 25 bp, Mus musculus
tctggcactaacagaacctttagaa

SEQ ID NO: 367630 - DNA, 25 bp, Mus musculus
tctggcactactggcctgcccaagg

SEQ ID NO: 367631 - DNA, 25 bp, Mus musculus
tctggcagaaggttctctctcttgc

SEQ ID NO: 367632 - DNA, 25 bp, Mus musculus
tctggcagagaacgaatcttggaga

SEQ ID NO: 367633 - DNA, 25 bp, Mus musculus
tctggcagagacttggcagtgtaag

SEQ ID NO: 367634 - DNA, 25 bp, Mus musculus
tctggcagaggcattgaagacaaga

SEQ ID NO: 367635 - DNA, 25 bp, Mus musculus
tctggcagaggcctgcctcaaaatg

SEQ ID NO: 367636 - DNA, 25 bp, Mus musculus
tctggcagccatggtcacgtctctg

SEQ ID NO: 367637 - DNA, 25 bp, Mus musculus
tctggcaggctctgtcccaggtaaa

SEQ ID NO: 367638 - DNA, 25 bp, Mus musculus
tctggcagttttttgcatgttacat

SEQ ID NO: 367639 - DNA, 25 bp, Mus musculus
tctggcatccaggtgcgctacctga

SEQ ID NO: 367640 - DNA, 25 bp, Mus musculus
tctggcatggacgagatggcagttg

SEQ ID NO: 367641 - DNA, 25 bp, Mus musculus
tctggcatgggatggagagtctgta

SEQ ID NO: 367642 - DNA, 25 bp, Mus musculus
tctggcatgggatgggggacagctg

SEQ ID NO: 367643 - DNA, 25 bp, Mus musculus
tctggcattgatggtttgtcttctg

SEQ ID NO: 367644 - DNA, 25 bp, Mus musculus
tctggcattggatctactgctgagc

SEQ ID NO: 367645 - DNA, 25 bp, Mus musculus
tctggccaaacgaaagctgggctct

SEQ ID NO: 367646 - DNA, 25 bp, Mus musculus
tctggccacaggaaatcgagaggaa

SEQ ID NO: 367647 - DNA, 25 bp, Mus musculus
tctggccacaggggcattgttgtga

SEQ ID NO: 367648 - DNA, 25 bp, Mus musculus
tctggccagagaaggtgcttgacat

SEQ ID NO: 367649 - DNA, 25 bp, Mus musculus
tctggccagagaagtctttctgtct

SEQ ID NO: 367650 - DNA, 25 bp, Mus musculus
tctggccaggttccgggagaccctc

SEQ ID NO: 367651 - DNA, 25 bp, Mus musculus
tctggcccacaagacccgccctagt

SEQ ID NO: 367652 - DNA, 25 bp, Mus musculus
tctggcccacaagcccccactgtga

SEQ ID NO: 367653 - DNA, 25 bp, Mus musculus
tctggcccacggacgaccatgacac

SEQ ID NO: 367654 - DNA, 25 bp, Mus musculus
tctggcccagaccgaagccaggaca

SEQ ID NO: 367655 - DNA, 25 bp, Mus musculus
tctggcccagaggccaagtgagact

SEQ ID NO: 367656 - DNA, 25 bp, Mus musculus
tctggcccagcagctggagcaattc

SEQ ID NO: 367657 - DNA, 25 bp, Mus musculus
tctggcccataaatgctgttggctg

SEQ ID NO: 367658 - DNA, 25 bp, Mus musculus
tctggcccgaacaggtcttatttta

SEQ ID NO: 367659 - DNA, 25 bp, Mus musculus
tctggccctagaggtccacctggcc

SEQ ID NO: 367660 - DNA, 25 bp, Mus musculus
tctggccctggggatgtgacaagca

SEQ ID NO: 367661 - DNA, 25 bp, Mus musculus
tctggccgccacggatgggtgctac

SEQ ID NO: 367662 - DNA, 25 bp, Mus musculus
tctggccgcttcttcactgactatg

SEQ ID NO: 367663 - DNA, 25 bp, Mus musculus
tctggccgtcgcggctggactgtac

SEQ ID NO: 367664 - DNA, 25 bp, Mus musculus
tctggcctatgatgatcctcatggg

SEQ ID NO: 367665 - DNA, 25 bp, Mus musculus
tctggcctatgatggatctgatgaa

SEQ ID NO: 367666 - DNA, 25 bp, Mus musculus
tctggcctcagatgccctgctgtga

SEQ ID NO: 367667 - DNA, 25 bp, Mus musculus
tctggcctcaggtaaccatggagaa

SEQ ID NO: 367668 - DNA, 25 bp, Mus musculus
tctggcctccgatggtgacattata

SEQ ID NO: 367669 - DNA, 25 bp, Mus musculus
tctggcctcgccaagagttcctcca

SEQ ID NO: 367670 - DNA, 25 bp, Mus musculus
tctggcctcgccaaggtatgtggac

SEQ ID NO: 367671 - DNA, 25 bp, Mus musculus
tctggcctggcgcttaatgaaaaac

SEQ ID NO: 367672 - DNA, 25 bp, Mus musculus
tctggccttctctctgaaggtgttc

SEQ ID NO: 367673 - DNA, 25 bp, Mus musculus
tctggcgaatgggaaagggccaaat

SEQ ID NO: 367674 - DNA, 25 bp, Mus musculus
tctggcgacatgatatttgaaggaa

SEQ ID NO: 367675 - DNA, 25 bp, Mus musculus
tctggcgaccgcagcaacccttctg

SEQ ID NO: 367676 - DNA, 25 bp, Mus musculus
tctggcgagtctgtgaaggccccaa

SEQ ID NO: 367677 - DNA, 25 bp, Mus musculus
tctggcgggcaatggtgaatgagaa

SEQ ID NO: 367678 - DNA, 25 bp, Mus musculus
tctggcggtgaggagaggtttcata

SEQ ID NO: 367679 - DNA, 25 bp, Mus musculus
tctggcgtctcccaggtgttcttga

SEQ ID NO: 367680 - DNA, 25 bp, Mus musculus
tctggcgtcttatgggttggaggat

SEQ ID NO: 367681 - DNA, 25 bp, Mus musculus
tctggctacaaaaggtgcttccact

SEQ ID NO: 367682 - DNA, 25 bp, Mus musculus
tctggctatcatactgctgataaag

SEQ ID NO: 367683 - DNA, 25 bp, Mus musculus
tctggctcaaaaaaaaaaagcctct

SEQ ID NO: 367684 - DNA, 25 bp, Mus musculus
tctggctcacagagaaggacttgat

SEQ ID NO: 367685 - DNA, 25 bp, Mus musculus
tctggctcagatgcgattcatgcta

SEQ ID NO: 367686 - DNA, 25 bp, Mus musculus
tctggctccaactggcgtccctaca

SEQ ID NO: 367687 - DNA, 25 bp, Mus musculus
tctggctccaactgggtctgagtgc

SEQ ID NO: 367688 - DNA, 25 bp, Mus musculus
tctggctccagaaggatctgttcca

SEQ ID NO: 367689 - DNA, 25 bp, Mus musculus
tctggctccagagaaatcttctagg

SEQ ID NO: 367690 - DNA, 25 bp, Mus musculus
tctggctccatgcagctgaggtcta

SEQ ID NO: 367691 - DNA, 25 bp, Mus musculus
tctggctctctgaggtggaggctct

SEQ ID NO: 367692 - DNA, 25 bp, Mus musculus
tctggctctgaatttctcttcttta

SEQ ID NO: 367693 - DNA, 25 bp, Mus musculus
tctggctctgacagcgacgaaccgt

SEQ ID NO: 367694 - DNA, 25 bp, Mus musculus
tctggctgcagggaattgatgtccg

SEQ ID NO: 367695 - DNA, 25 bp, Mus musculus
tctggctgctgcaggtcctgtggga

SEQ ID NO: 367696 - DNA, 25 bp, Mus musculus
tctggctgctgcagtgctggggatc

SEQ ID NO: 367697 - DNA, 25 bp, Mus musculus
tctggctggcagcactgaaaactga

SEQ ID NO: 367698 - DNA, 25 bp, Mus musculus
tctggctggcaggaggcacagtggt

SEQ ID NO: 367699 - DNA, 25 bp, Mus musculus
tctggctggcgaaggatgatgccct

SEQ ID NO: 367700 - DNA, 25 bp, Mus musculus
tctggctgtagcagctgcaccacat

SEQ ID NO: 367701 - DNA, 25 bp, Mus musculus
tctggctgtttctgggtgtggccat

SEQ ID NO: 367702 - DNA, 25 bp, Mus musculus
tctggctgtttgccgagattgctct

SEQ ID NO: 367703 - DNA, 25 bp, Mus musculus
tctggcttccacaggattttcacct

SEQ ID NO: 367704 - DNA, 25 bp, Mus musculus
tctggcttccagggctggcgctgca

SEQ ID NO: 367705 - DNA, 25 bp, Mus musculus
tctggcttcctcccgaggccgagct

SEQ ID NO: 367706 - DNA, 25 bp, Mus musculus
tctggcttcctggatgtccagaagg

SEQ ID NO: 367707 - DNA, 25 bp, Mus musculus
tctggcttctcaccgcttagaatta

SEQ ID NO: 367708 - DNA, 25 bp, Mus musculus
tctggcttctcaccgggcgagcctt

SEQ ID NO: 367709 - DNA, 25 bp, Mus musculus
tctggcttctcaccggtgcacgcct

SEQ ID NO: 367710 - DNA, 25 bp, Mus musculus
tctggcttctcaccgttatcctagg

SEQ ID NO: 367711 - DNA, 25 bp, Mus musculus
tctggcttctcagatgggagctcag

SEQ ID NO: 367712 - DNA, 25 bp, Mus musculus
tctggcttctcagttccagagcctc

SEQ ID NO: 367713 - DNA, 25 bp, Mus musculus
tctggcttctggctccaggccgggc

SEQ ID NO: 367714 - DNA, 25 bp, Mus musculus
tctggctttcaagggaacaaagaat

SEQ ID NO: 367715 - DNA, 25 bp, Mus musculus
tctggctttcaagttgtggagctcc

SEQ ID NO: 367716 - DNA, 25 bp, Mus musculus
tctgggaaaagggtcaatgctaggt

SEQ ID NO: 367717 - DNA, 25 bp, Mus musculus
tctgggaaagagtgtgaggagatca

SEQ ID NO: 367718 - DNA, 25 bp, Mus musculus
tctgggaaaggtattctctaagaag

SEQ ID NO: 367719 - DNA, 25 bp, Mus musculus
tctgggaagctgtgctcagtagtcc

SEQ ID NO: 367720 - DNA, 25 bp, Mus musculus
tctgggaaggtggaggtgtggtaca

SEQ ID NO: 367721 - DNA, 25 bp, Mus musculus
tctgggaatagattccaagagcaga

SEQ ID NO: 367722 - DNA, 25 bp, Mus musculus
tctgggacccgaacaatttcgaaga

SEQ ID NO: 367723 - DNA, 25 bp, Mus musculus
tctgggaccctggtacctcatcaac

SEQ ID NO: 367724 - DNA, 25 bp, Mus musculus
tctgggaccggattcccgaagccca

SEQ ID NO: 367725 - DNA, 25 bp, Mus musculus
tctgggacgcttggtaaagcgttcg

SEQ ID NO: 367726 - DNA, 25 bp, Mus musculus
tctgggacgtgaaggacttcaagac

SEQ ID NO: 367727 - DNA, 25 bp, Mus musculus
tctgggagaagatgctcagaccagt

SEQ ID NO: 367728 - DNA, 25 bp, Mus musculus
tctgggagaatcaggcatcgcctcc

SEQ ID NO: 367729 - DNA, 25 bp, Mus musculus
tctgggagaggacgcgtgagcatgc

SEQ ID NO: 367730 - DNA, 25 bp, Mus musculus
tctgggaggagccacccgcggtcag

SEQ ID NO: 367731 - DNA, 25 bp, Mus musculus
tctgggagtttgaggaattagaaag

SEQ ID NO: 367732 - DNA, 25 bp, Mus musculus
tctgggatcattcacagatcattct

SEQ ID NO: 367733 - DNA, 25 bp, Mus musculus
tctgggatctaagtaaaattggaga

SEQ ID NO: 367734 - DNA, 25 bp, Mus musculus
tctgggattaaaggaaacaaatgtc

SEQ ID NO: 367735 - DNA, 25 bp, Mus musculus
tctgggattaacctggatcctgacc

SEQ ID NO: 367736 - DNA, 25 bp, Mus musculus
tctgggattcagtcattaggattgg

SEQ ID NO: 367737 - DNA, 25 bp, Mus musculus
tctgggatttaagtctgtgcgaggg

SEQ ID NO: 367738 - DNA, 25 bp, Mus musculus
tctgggcaacaagggaaatactggg

SEQ ID NO: 367739 - DNA, 25 bp, Mus musculus
tctgggcaacaaggtggaccccctt

SEQ ID NO: 367740 - DNA, 25 bp, Mus musculus
tctgggcaaggagcacttcaattac

SEQ ID NO: 367741 - DNA, 25 bp, Mus musculus
tctgggcacgctaataattttcaag

SEQ ID NO: 367742 - DNA, 25 bp, Mus musculus
tctgggcatgtggccattatgtttg

SEQ ID NO: 367743 - DNA, 25 bp, Mus musculus
tctgggcatgtggggtgatcctgta

SEQ ID NO: 367744 - DNA, 25 bp, Mus musculus
tctgggccagagcttcgagtgtgtc

SEQ ID NO: 367745 - DNA, 25 bp, Mus musculus
tctgggccagcagactggaagctcc

SEQ ID NO: 367746 - DNA, 25 bp, Mus musculus
tctgggccagcaggtggcccgaggc

SEQ ID NO: 367747 - DNA, 25 bp, Mus musculus
tctgggccaggagtctccaaaacct

SEQ ID NO: 367748 - DNA, 25 bp, Mus musculus
tctgggccaggtgcgtgctattatg

SEQ ID NO: 367749 - DNA, 25 bp, Mus musculus
tctgggccatttcaagtccgaggtc

SEQ ID NO: 367750 - DNA, 25 bp, Mus musculus
tctgggcgaggaaaaagtaaaggta

SEQ ID NO: 367751 - DNA, 25 bp, Mus musculus
tctgggcgaggagagaacacatttt

SEQ ID NO: 367752 - DNA, 25 bp, Mus musculus
tctgggcgatggggcactggctcca

SEQ ID NO: 367753 - DNA, 25 bp, Mus musculus
tctgggcgctgcagggtaattcaga

SEQ ID NO: 367754 - DNA, 25 bp, Mus musculus
tctgggcgggaaccaggtgctacag

SEQ ID NO: 367755 - DNA, 25 bp, Mus musculus
tctgggctaagacctccagtcagac

SEQ ID NO: 367756 - DNA, 25 bp, Mus musculus
tctgggctatgtgggtgagcctgtg

SEQ ID NO: 367757 - DNA, 25 bp, Mus musculus
tctgggctccacaagcaaaaccttg

SEQ ID NO: 367758 - DNA, 25 bp, Mus musculus
tctgggctctgcagattctcattgc

SEQ ID NO: 367759 - DNA, 25 bp, Mus musculus
tctgggctgccccaggatccacctg

SEQ ID NO: 367760 - DNA, 25 bp, Mus musculus
tctgggcttaaaaggcatccaagga

SEQ ID NO: 367761 - DNA, 25 bp, Mus musculus
tctgggcttcccgatacgacatttc

SEQ ID NO: 367762 - DNA, 25 bp, Mus musculus
tctgggcttcccgattctgtttagg

SEQ ID NO: 367763 - DNA, 25 bp, Mus musculus
tctgggcttcccggagccgaggacc

SEQ ID NO: 367764 - DNA, 25 bp, Mus musculus
tctggggaagccttggccacgaggg

SEQ ID NO: 367765 - DNA, 25 bp, Mus musculus
tctggggaagctgctgcccagacca

SEQ ID NO: 367766 - DNA, 25 bp, Mus musculus
tctggggaaggtgcagctggatcta

SEQ ID NO: 367767 - DNA, 25 bp, Mus musculus
tctggggaatattcctacctccact

SEQ ID NO: 367768 - DNA, 25 bp, Mus musculus
tctggggaccaaacggtgatggaaa

SEQ ID NO: 367769 - DNA, 25 bp, Mus musculus
tctggggagaaaacaccagctacat

SEQ ID NO: 367770 - DNA, 25 bp, Mus musculus
tctggggaggcagtaaattacagag

SEQ ID NO: 367771 - DNA, 25 bp, Mus musculus
tctggggaggcagtgttcagggagg

SEQ ID NO: 367772 - DNA, 25 bp, Mus musculus
tctggggatcatgtcggtcacacag

SEQ ID NO: 367773 - DNA, 25 bp, Mus musculus
tctggggatggcagattcctgtcca

SEQ ID NO: 367774 - DNA, 25 bp, Mus musculus
tctggggattctacagcacagggga

SEQ ID NO: 367775 - DNA, 25 bp, Mus musculus
tctggggcagaagattgctttggcc

SEQ ID NO: 367776 - DNA, 25 bp, Mus musculus
tctggggcagaagcgcattaaagag

SEQ ID NO: 367777 - DNA, 25 bp, Mus musculus
tctggggcagatcctccttatccca

SEQ ID NO: 367778 - DNA, 25 bp, Mus musculus
tctggggctacaggtggccttgcac

SEQ ID NO: 367779 - DNA, 25 bp, Mus musculus
tctgggggaggaaagaccacagttg

SEQ ID NO: 367780 - DNA, 25 bp, Mus musculus
tctgggggcaccgaggtctccagca

SEQ ID NO: 367781 - DNA, 25 bp, Mus musculus
tctgggggcaccgagtcaaataatt

SEQ ID NO: 367782 - DNA, 25 bp, Mus musculus
tctggggtcctgctcctgcaaaaaa

SEQ ID NO: 367783 - DNA, 25 bp, Mus musculus
tctggggtctggccaaagatctcat

SEQ ID NO: 367784 - DNA, 25 bp, Mus musculus
tctggggtctggtcagaaagacagc

SEQ ID NO: 367785 - DNA, 25 bp, Mus musculus
tctggggttgcctaggtgaggcatg

SEQ ID NO: 367786 - DNA, 25 bp, Mus musculus
tctgggtaaactgaggctcctagaa

SEQ ID NO: 367787 - DNA, 25 bp, Mus musculus
tctgggtacccgctttcttgatcat

SEQ ID NO: 367788 - DNA, 25 bp, Mus musculus
tctgggtcaaagcactccactcatc

SEQ ID NO: 367789 - DNA, 25 bp, Mus musculus
tctgggtcaaagcattcctcaacca

SEQ ID NO: 367790 - DNA, 25 bp, Mus musculus
tctgggtcagggggattgatgtgag

SEQ ID NO: 367791 - DNA, 25 bp, Mus musculus
tctgggtcctggatggagcctgcag

SEQ ID NO: 367792 - DNA, 25 bp, Mus musculus
tctgggtcctgggagccacgctggt

SEQ ID NO: 367793 - DNA, 25 bp, Mus musculus
tctgggtctggaggtttgaggctct

SEQ ID NO: 367794 - DNA, 25 bp, Mus musculus
tctgggtgaaggagagtttgggtct

SEQ ID NO: 367795 - DNA, 25 bp, Mus musculus
tctgggtgagaggctgcccctggag

SEQ ID NO: 367796 - DNA, 25 bp, Mus musculus
tctgggtgaggaggttgtggcagca

SEQ ID NO: 367797 - DNA, 25 bp, Mus musculus
tctgggtgtccagacgctgcggcca

SEQ ID NO: 367798 - DNA, 25 bp, Mus musculus
tctgggttaaatggtttgtcttctg

SEQ ID NO: 367799 - DNA, 25 bp, Mus musculus
tctgggttagagatgagacctgctc

SEQ ID NO: 367800 - DNA, 25 bp, Mus musculus
tctgggttgagtaaattcacagata

SEQ ID NO: 367801 - DNA, 25 bp, Mus musculus
tctggtaacagaagaaaagatgtgg

SEQ ID NO: 367802 - DNA, 25 bp, Mus musculus
tctggtaccacagaatgagagccac

SEQ ID NO: 367803 - DNA, 25 bp, Mus musculus
tctggtaccacagagcatttctgaa

SEQ ID NO: 367804 - DNA, 25 bp, Mus musculus
tctggtacctgcagcccatacctgg

SEQ ID NO: 367805 - DNA, 25 bp, Mus musculus
tctggtacctgcagtgcctgagacg

SEQ ID NO: 367806 - DNA, 25 bp, Mus musculus
tctggtagcagttggaacaagagga

SEQ ID NO: 367807 - DNA, 25 bp, Mus musculus
tctggtatatcgaactcgcacttgc

SEQ ID NO: 367808 - DNA, 25 bp, Mus musculus
tctggtatatcgttgtgcagactac

SEQ ID NO: 367809 - DNA, 25 bp, Mus musculus
tctggtccaaacagactgaaagtgt

SEQ ID NO: 367810 - DNA, 25 bp, Mus musculus
tctggtccagcagatgcgtcgagcc

SEQ ID NO: 367811 - DNA, 25 bp, Mus musculus
tctggtcgaggaagatgggctcctg

SEQ ID NO: 367812 - DNA, 25 bp, Mus musculus
tctggtctacatagtgtgagtcatt

SEQ ID NO: 367813 - DNA, 25 bp, Mus musculus
tctggtcttaggttcttgattgtct

SEQ ID NO: 367814 - DNA, 25 bp, Mus musculus
tctggtgaagattatgggacagtcg

SEQ ID NO: 367815 - DNA, 25 bp, Mus musculus
tctggtgaggctagaaagaaggatt

SEQ ID NO: 367816 - DNA, 25 bp, Mus musculus
tctggtgagtatgcagctgataaag

SEQ ID NO: 367817 - DNA, 25 bp, Mus musculus
tctggtgatggccataaaatcaggt

SEQ ID NO: 367818 - DNA, 25 bp, Mus musculus
tctggtgccagcaactggccatgcc

SEQ ID NO: 367819 - DNA, 25 bp, Mus musculus
tctggtgccagctctaggaatgatt

SEQ ID NO: 367820 - DNA, 25 bp, Mus musculus
tctggtgccagggtttctctgtgtg

SEQ ID NO: 367821 - DNA, 25 bp, Mus musculus
tctggtgctgaaacccttcactgaa

SEQ ID NO: 367822 - DNA, 25 bp, Mus musculus
tctggtggagcaaggtggccctgtc

SEQ ID NO: 367823 - DNA, 25 bp, Mus musculus
tctggtgtgcttggattacacagtg

SEQ ID NO: 367824 - DNA, 25 bp, Mus musculus
tctggtgtgcttgtgctcgccgtgg

SEQ ID NO: 367825 - DNA, 25 bp, Mus musculus
tctggtgtggcagtagaaacagata

SEQ ID NO: 367826 - DNA, 25 bp, Mus musculus
tctggtgtggcattttttggaccat

SEQ ID NO: 367827 - DNA, 25 bp, Mus musculus
tctggtgttcggtagagctggtgag

SEQ ID NO: 367828 - DNA, 25 bp, Mus musculus
tctggtgttcggtgaagatggttct

SEQ ID NO: 367829 - DNA, 25 bp, Mus musculus
tctggttagaggtgaagaatattga

SEQ ID NO: 367830 - DNA, 25 bp, Mus musculus
tctggttcaggctggcctgccttcc

SEQ ID NO: 367831 - DNA, 25 bp, Mus musculus
tctggttctggaatgatctcaactt

SEQ ID NO: 367832 - DNA, 25 bp, Mus musculus
tctggttctggctgatctcttcgtt

SEQ ID NO: 367833 - DNA, 25 bp, Mus musculus
tctggttgagcaacaaaatcttgct

SEQ ID NO: 367834 - DNA, 25 bp, Mus musculus
tctggttgagcatcaaaatcttgct

SEQ ID NO: 367835 - DNA, 25 bp, Mus musculus
tctggttgcccaggtgctgggcttg

SEQ ID NO: 367836 - DNA, 25 bp, Mus musculus
tctggttggacttggtgtgagtcat

SEQ ID NO: 367837 - DNA, 25 bp, Mus musculus
tctggtttcaaggtgacagatcagt

SEQ ID NO: 367838 - DNA, 25 bp, Mus musculus
tctggtttctctagatctcacactc

SEQ ID NO: 367839 - DNA, 25 bp, Mus musculus
tctggtttctctaggtgtgagcatc

SEQ ID NO: 367840 - DNA, 25 bp, Mus musculus
tctggtttctcttgtccatctcagt

SEQ ID NO: 367841 - DNA, 25 bp, Mus musculus
tctggtttgcctcctgaataaaaag

SEQ ID NO: 367842 - DNA, 25 bp, Mus musculus
tctggtttgggaagggctgtcatgg

SEQ ID NO: 367843 - DNA, 25 bp, Mus musculus
tctggtttgtgtggggttcactgat

SEQ ID NO: 367844 - DNA, 25 bp, Mus musculus
tctggttttaggtccagcgagcaca

SEQ ID NO: 367845 - DNA, 25 bp, Mus musculus
tctgtaaaaaagcaacacgttttaa

SEQ ID NO: 367846 - DNA, 25 bp, Mus musculus
tctgtaaaagggtgtctttaagaag

SEQ ID NO: 367847 - DNA, 25 bp, Mus musculus
tctgtaaacagataggtaccctact

SEQ ID NO: 367848 - DNA, 25 bp, Mus musculus
tctgtaaagtgatggctgcagcaac

SEQ ID NO: 367849 - DNA, 25 bp, Mus musculus
tctgtaacaacaggaggcccagcct

SEQ ID NO: 367850 - DNA, 25 bp, Mus musculus
tctgtaacatcttctcacatcatgg

SEQ ID NO: 367851 - DNA, 25 bp, Mus musculus
tctgtaacattgccattatcctcaa

SEQ ID NO: 367852 - DNA, 25 bp, Mus musculus
tctgtaaccagaatggattgaatgc

SEQ ID NO: 367853 - DNA, 25 bp, Mus musculus
tctgtaacgtatgatggatcgaata

SEQ ID NO: 367854 - DNA, 25 bp, Mus musculus
tctgtaacgtatgatggattcaata

SEQ ID NO: 367855 - DNA, 25 bp, Mus musculus
tctgtaactgaggctttaacagaaa

SEQ ID NO: 367856 - DNA, 25 bp, Mus musculus
tctgtaactgggatcatggcaggat

SEQ ID NO: 367857 - DNA, 25 bp, Mus musculus
tctgtaactgtcatcagagatcacc

SEQ ID NO: 367858 - DNA, 25 bp, Mus musculus
tctgtaagaaggtcccaggtaaatc

SEQ ID NO: 367859 - DNA, 25 bp, Mus musculus
tctgtaagcagcctaggatgtcagg

SEQ ID NO: 367860 - DNA, 25 bp, Mus musculus
tctgtaagcatggtcccctgtgtag

SEQ ID NO: 367861 - DNA, 25 bp, Mus musculus
tctgtaatagcaggatgctggtcct

SEQ ID NO: 367862 - DNA, 25 bp, Mus musculus
tctgtaataggtgtgtgctgaagat

SEQ ID NO: 367863 - DNA, 25 bp, Mus musculus
tctgtaatggcagtttgagatggta

SEQ ID NO: 367864 - DNA, 25 bp, Mus musculus
tctgtacaagggtgaaaaaggagac

SEQ ID NO: 367865 - DNA, 25 bp, Mus musculus
tctgtacaaggttttgaatcctgta

SEQ ID NO: 367866 - DNA, 25 bp, Mus musculus
tctgtacagaacagctaggactcag

SEQ ID NO: 367867 - DNA, 25 bp, Mus musculus
tctgtacagaacaggcaaagacaag

SEQ ID NO: 367868 - DNA, 25 bp, Mus musculus
tctgtacagaattggacaaaatccc

SEQ ID NO: 367869 - DNA, 25 bp, Mus musculus
tctgtaccagccgtgactgtcccat

SEQ ID NO: 367870 - DNA, 25 bp, Mus musculus
tctgtaccagggtgtacattggtga

SEQ ID NO: 367871 - DNA, 25 bp, Mus musculus
tctgtaccaggtgcgcaaggacctg

SEQ ID NO: 367872 - DNA, 25 bp, Mus musculus
tctgtaccagttgctgtgattggct

SEQ ID NO: 367873 - DNA, 25 bp, Mus musculus
tctgtaccccgaaagagctcctggg

SEQ ID NO: 367874 - DNA, 25 bp, Mus musculus
tctgtacctgcaactcaatcgttta

SEQ ID NO: 367875 - DNA, 25 bp, Mus musculus
tctgtacctgcaagaagaaagtcct

SEQ ID NO: 367876 - DNA, 25 bp, Mus musculus
tctgtaccttggacaaagtggggca

SEQ ID NO: 367877 - DNA, 25 bp, Mus musculus
tctgtactagggaatattggcagct

SEQ ID NO: 367878 - DNA, 25 bp, Mus musculus
tctgtactctcgggaggtgttcctg

SEQ ID NO: 367879 - DNA, 25 bp, Mus musculus
tctgtagaaaggaacatgtctcagg

SEQ ID NO: 367880 - DNA, 25 bp, Mus musculus
tctgtagacgctcttttcagaccca

SEQ ID NO: 367881 - DNA, 25 bp, Mus musculus
tctgtagcaacagaggaacatgtgt

SEQ ID NO: 367882 - DNA, 25 bp, Mus musculus
tctgtagcacccagttcttgcaggt

SEQ ID NO: 367883 - DNA, 25 bp, Mus musculus
tctgtagcaccccaggtgttgactg

SEQ ID NO: 367884 - DNA, 25 bp, Mus musculus
tctgtagcaccccagttcttgcagg

SEQ ID NO: 367885 - DNA, 25 bp, Mus musculus
tctgtagcaggtctagtgacaggat

SEQ ID NO: 367886 - DNA, 25 bp, Mus musculus
tctgtagccctagatcctttacaag

SEQ ID NO: 367887 - DNA, 25 bp, Mus musculus
tctgtagcctggaaggagctttggt

SEQ ID NO: 367888 - DNA, 25 bp, Mus musculus
tctgtagcctggaagggcatacttt

SEQ ID NO: 367889 - DNA, 25 bp, Mus musculus
tctgtagggctgcctctctggatgg

SEQ ID NO: 367890 - DNA, 25 bp, Mus musculus
tctgtagggctgttgccaaggcacc

SEQ ID NO: 367891 - DNA, 25 bp, Mus musculus
tctgtagtgatgctgcatgccatga

SEQ ID NO: 367892 - DNA, 25 bp, Mus musculus
tctgtataccagcacctgaggagag

SEQ ID NO: 367893 - DNA, 25 bp, Mus musculus
tctgtatatcatgcatccatttttg

SEQ ID NO: 367894 - DNA, 25 bp, Mus musculus
tctgtatcacagctgcctcatatac

SEQ ID NO: 367895 - DNA, 25 bp, Mus musculus
tctgtatcacttgggtgagaatgcc

SEQ ID NO: 367896 - DNA, 25 bp, Mus musculus
tctgtatccagcgagacggtcatct

SEQ ID NO: 367897 - DNA, 25 bp, Mus musculus
tctgtatccctgttgctgagctggt

SEQ ID NO: 367898 - DNA, 25 bp, Mus musculus
tctgtatcctcagttcatgttccat

SEQ ID NO: 367899 - DNA, 25 bp, Mus musculus
tctgtatgagaacaaagccagtcaa

SEQ ID NO: 367900 - DNA, 25 bp, Mus musculus
tctgtatgagtggcctcgaactcag

SEQ ID NO: 367901 - DNA, 25 bp, Mus musculus
tctgtatgagtggctgagagggttg

SEQ ID NO: 367902 - DNA, 25 bp, Mus musculus
tctgtattagaaaaggaaactgcat

SEQ ID NO: 367903 - DNA, 25 bp, Mus musculus
tctgtattagaaaagtctctccaga

SEQ ID NO: 367904 - DNA, 25 bp, Mus musculus
tctgtattatcgttatgagtattgg

SEQ ID NO: 367905 - DNA, 25 bp, Mus musculus
tctgtattgagaaacctgaaaaatg

SEQ ID NO: 367906 - DNA, 25 bp, Mus musculus
tctgtattttctcaggtgtgcatgt

SEQ ID NO: 367907 - DNA, 25 bp, Mus musculus
tctgtcaaaacttggctcttgaccg

SEQ ID NO: 367908 - DNA, 25 bp, Mus musculus
tctgtcaagccaaacatccagaacc

SEQ ID NO: 367909 - DNA, 25 bp, Mus musculus
tctgtcaagcctggaatgaagtatt

SEQ ID NO: 367910 - DNA, 25 bp, Mus musculus
tctgtcaaggcggcccagaccagtg

SEQ ID NO: 367911 - DNA, 25 bp, Mus musculus
tctgtcacagaaagaaagactgcgt

SEQ ID NO: 367912 - DNA, 25 bp, Mus musculus
tctgtcacatgggaccatctgggcc

SEQ ID NO: 367913 - DNA, 25 bp, Mus musculus
tctgtcaccgagaggcttcattaac

SEQ ID NO: 367914 - DNA, 25 bp, Mus musculus
tctgtcactgagaaggtgtccttgg

SEQ ID NO: 367915 - DNA, 25 bp, Mus musculus
tctgtcacttgggagtttgcccaat

SEQ ID NO: 367916 - DNA, 25 bp, Mus musculus
tctgtcagaagccacattgaatttg

SEQ ID NO: 367917 - DNA, 25 bp, Mus musculus
tctgtcagtcctatggcagtaccag

SEQ ID NO: 367918 - DNA, 25 bp, Mus musculus
tctgtcatagcaaccaccgctcttg

SEQ ID NO: 367919 - DNA, 25 bp, Mus musculus
tctgtcatagcactggaccacgggt

SEQ ID NO: 367920 - DNA, 25 bp, Mus musculus
tctgtcatcacagacaccctctctc

SEQ ID NO: 367921 - DNA, 25 bp, Mus musculus
tctgtcatcacagattctttaagat

SEQ ID NO: 367922 - DNA, 25 bp, Mus musculus
tctgtcatccgaaaactccagggat

SEQ ID NO: 367923 - DNA, 25 bp, Mus musculus
tctgtcatccgccctagcacaaaac

SEQ ID NO: 367924 - DNA, 25 bp, Mus musculus
tctgtcatgggtcctctacagcctg

SEQ ID NO: 367925 - DNA, 25 bp, Mus musculus
tctgtcattcacgagcaccctgaaa

SEQ ID NO: 367926 - DNA, 25 bp, Mus musculus
tctgtcattcacggtgaaggcagct

SEQ ID NO: 367927 - DNA, 25 bp, Mus musculus
tctgtccacatgcccctgtgatgcc

SEQ ID NO: 367928 - DNA, 25 bp, Mus musculus
tctgtccacatgcgtttgatatcgt

SEQ ID NO: 367929 - DNA, 25 bp, Mus musculus
tctgtccagaaggacaaggtggaac

SEQ ID NO: 367930 - DNA, 25 bp, Mus musculus
tctgtccattcatcaactggccttg

SEQ ID NO: 367931 - DNA, 25 bp, Mus musculus
tctgtccccaggcgtatgggcaagt

SEQ ID NO: 367932 - DNA, 25 bp, Mus musculus
tctgtccccagggaacagactgctt

SEQ ID NO: 367933 - DNA, 25 bp, Mus musculus
tctgtccccagggactgaaaggagg

SEQ ID NO: 367934 - DNA, 25 bp, Mus musculus
tctgtccccagtgcatgggtacaga

SEQ ID NO: 367935 - DNA, 25 bp, Mus musculus
tctgtcccccaggtttcacggggct

SEQ ID NO: 367936 - DNA, 25 bp, Mus musculus
tctgtccccgaggctgcttatgatc

SEQ ID NO: 367937 - DNA, 25 bp, Mus musculus
tctgtcccctagaaggaagagtcac

SEQ ID NO: 367938 - DNA, 25 bp, Mus musculus
tctgtcccgtcatctcccccagatc

SEQ ID NO: 367939 - DNA, 25 bp, Mus musculus
tctgtccctcccctttctcccttgc

SEQ ID NO: 367940 - DNA, 25 bp, Mus musculus
tctgtccgaggtcgctcatccgatc

SEQ ID NO: 367941 - DNA, 25 bp, Mus musculus
tctgtccgctcagggatggtctgta

SEQ ID NO: 367942 - DNA, 25 bp, Mus musculus
tctgtccgctcagggcttctgaccc

SEQ ID NO: 367943 - DNA, 25 bp, Mus musculus
tctgtcctcaagtgagccccaggcc

SEQ ID NO: 367944 - DNA, 25 bp, Mus musculus
tctgtcctcataccagaatctggtc

SEQ ID NO: 367945 - DNA, 25 bp, Mus musculus
tctgtcctcgtaggaatcagagaag

SEQ ID NO: 367946 - DNA, 25 bp, Mus musculus
tctgtcctgaaagccagagacccgc

SEQ ID NO: 367947 - DNA, 25 bp, Mus musculus
tctgtcctgaaagtaggcttctttg

SEQ ID NO: 367948 - DNA, 25 bp, Mus musculus
tctgtcctgaaagtctcagaggagc

SEQ ID NO: 367949 - DNA, 25 bp, Mus musculus
tctgtcctgaggagtgtgcagccac

SEQ ID NO: 367950 - DNA, 25 bp, Mus musculus
tctgtcgcagattggaagaattgtt

SEQ ID NO: 367951 - DNA, 25 bp, Mus musculus
tctgtcggacggggctgaaaagctg

SEQ ID NO: 367952 - DNA, 25 bp, Mus musculus
tctgtcggacttagaagaattgaat

SEQ ID NO: 367953 - DNA, 25 bp, Mus musculus
tctgtcggctgagaggcaggctgca

SEQ ID NO: 367954 - DNA, 25 bp, Mus musculus
tctgtcggctgagaggcaggctgtc

SEQ ID NO: 367955 - DNA, 25 bp, Mus musculus
tctgtcgggaccgtgaagtggatgg

SEQ ID NO: 367956 - DNA, 25 bp, Mus musculus
tctgtcgggagatgagaatcagctg

SEQ ID NO: 367957 - DNA, 25 bp, Mus musculus
tctgtcgggagatgagcattcgcag

SEQ ID NO: 367958 - DNA, 25 bp, Mus musculus
tctgtcgggagatggatccttaaat

SEQ ID NO: 367959 - DNA, 25 bp, Mus musculus
tctgtcgtagagacactctgcacaa

SEQ ID NO: 367960 - DNA, 25 bp, Mus musculus
tctgtcgtcgccgagaagacctcct

SEQ ID NO: 367961 - DNA, 25 bp, Mus musculus
tctgtctaagaatctcctgtaaaaa

SEQ ID NO: 367962 - DNA, 25 bp, Mus musculus
tctgtctacccttatgagctaccgg

SEQ ID NO: 367963 - DNA, 25 bp, Mus musculus
tctgtctatgaaaatgacactgtga

SEQ ID NO: 367964 - DNA, 25 bp, Mus musculus
tctgtctatggtatcatcagagatt

SEQ ID NO: 367965 - DNA, 25 bp, Mus musculus
tctgtctcacccaggatgagtttca

SEQ ID NO: 367966 - DNA, 25 bp, Mus musculus
tctgtctcagcgcggattaccttat

SEQ ID NO: 367967 - DNA, 25 bp, Mus musculus
tctgtctcaggaaaggtaaacctag

SEQ ID NO: 367968 - DNA, 25 bp, Mus musculus
tctgtctccacgaccctgctttttg

SEQ ID NO: 367969 - DNA, 25 bp, Mus musculus
tctgtctccaggacacccaacacac

SEQ ID NO: 367970 - DNA, 25 bp, Mus musculus
tctgtctcgagagctgaagacacca

SEQ ID NO: 367971 - DNA, 25 bp, Mus musculus
tctgtctcggggaaaggttggaaga

SEQ ID NO: 367972 - DNA, 25 bp, Mus musculus
tctgtctcggggtgacaatagcttt

SEQ ID NO: 367973 - DNA, 25 bp, Mus musculus
tctgtctctttgacaggagaaggaa

SEQ ID NO: 367974 - DNA, 25 bp, Mus musculus
tctgtctgaaaacgatgatggagct

SEQ ID NO: 367975 - DNA, 25 bp, Mus musculus
tctgtctgaaatactgatccagaac

SEQ ID NO: 367976 - DNA, 25 bp, Mus musculus
tctgtctgaaatgagcatctgtaac

SEQ ID NO: 367977 - DNA, 25 bp, Mus musculus
tctgtctgagatcgtcagtggcata

SEQ ID NO: 367978 - DNA, 25 bp, Mus musculus
tctgtctgatggaggtaaaagtaac

SEQ ID NO: 367979 - DNA, 25 bp, Mus musculus
tctgtctgcaaggatccagcaatgc

SEQ ID NO: 367980 - DNA, 25 bp, Mus musculus
tctgtctgcaggtgttatttccaat

SEQ ID NO: 367981 - DNA, 25 bp, Mus musculus
tctgtctggagaagattgaagaaat

SEQ ID NO: 367982 - DNA, 25 bp, Mus musculus
tctgtctggagaaggtggactatag

SEQ ID NO: 367983 - DNA, 25 bp, Mus musculus
tctgtctgtggcggcacagtggttg

SEQ ID NO: 367984 - DNA, 25 bp, Mus musculus
tctgtctgtggcggtcattgtcatg

SEQ ID NO: 367985 - DNA, 25 bp, Mus musculus
tctgtcttaaaggccgttgatgctc

SEQ ID NO: 367986 - DNA, 25 bp, Mus musculus
tctgtcttaaaggtatctcattcag

SEQ ID NO: 367987 - DNA, 25 bp, Mus musculus
tctgtcttaatcagtggatggagac

SEQ ID NO: 367988 - DNA, 25 bp, Mus musculus
tctgtctttcagggtggtaggaatg

SEQ ID NO: 367989 - DNA, 25 bp, Mus musculus
tctgtgaaaaaccaggtggaggatc

SEQ ID NO: 367990 - DNA, 25 bp, Mus musculus
tctgtgaaaggtaaccccaggtgac

SEQ ID NO: 367991 - DNA, 25 bp, Mus musculus
tctgtgaaatcaaggttacagaatg

SEQ ID NO: 367992 - DNA, 25 bp, Mus musculus
tctgtgacaagggagcagaaagaaa

SEQ ID NO: 367993 - DNA, 25 bp, Mus musculus
tctgtgacaaggtcatagtccgcca

SEQ ID NO: 367994 - DNA, 25 bp, Mus musculus
tctgtgacagaaaggcgatctcttt

SEQ ID NO: 367995 - DNA, 25 bp, Mus musculus
tctgtgacagaaagggaacgcatca

SEQ ID NO: 367996 - DNA, 25 bp, Mus musculus
tctgtgacaggtgacacggctcaga

SEQ ID NO: 367997 - DNA, 25 bp, Mus musculus
tctgtgacagtggagatctcagact

SEQ ID NO: 367998 - DNA, 25 bp, Mus musculus
tctgtgaccacagaatcagacacaa

SEQ ID NO: 367999 - DNA, 25 bp, Mus musculus
tctgtgaccacagatcttaccttct

SEQ ID NO: 368000 - DNA, 25 bp, Mus musculus
tctgtgacctcctcctctactgctg

SEQ ID NO: 368001 - DNA, 25 bp, Mus musculus
tctgtgacctgtataatggttacac

SEQ ID NO: 368002 - DNA, 25 bp, Mus musculus
tctgtgaccttagaatcagctgccc

SEQ ID NO: 368003 - DNA, 25 bp, Mus musculus
tctgtgaccttggtctgccttgacc

SEQ ID NO: 368004 - DNA, 25 bp, Mus musculus
tctgtgacgggtttcgtgctaccat

SEQ ID NO: 368005 - DNA, 25 bp, Mus musculus
tctgtgactggattggccgcagacc

SEQ ID NO: 368006 - DNA, 25 bp, Mus musculus
tctgtgacttgctgctgcgatacta

SEQ ID NO: 368007 - DNA, 25 bp, Mus musculus
tctgtgagagggtatgtctcctgtg

SEQ ID NO: 368008 - DNA, 25 bp, Mus musculus
tctgtgagcacaggacataataaga

SEQ ID NO: 368009 - DNA, 25 bp, Mus musculus
tctgtgagcagcgcggatgtcgaag

SEQ ID NO: 368010 - DNA, 25 bp, Mus musculus
tctgtgagcaggaatcccttcgcca

SEQ ID NO: 368011 - DNA, 25 bp, Mus musculus
tctgtgagcagtggcagtggcacgc

SEQ ID NO: 368012 - DNA, 25 bp, Mus musculus
tctgtgagctagagaagatccagat

SEQ ID NO: 368013 - DNA, 25 bp, Mus musculus
tctgtgagctaggaaccggagtggc

SEQ ID NO: 368014 - DNA, 25 bp, Mus musculus
tctgtgaggagttcaaggatgtggc

SEQ ID NO: 368015 - DNA, 25 bp, Mus musculus
tctgtgagtcagaaccatctggtga

SEQ ID NO: 368016 - DNA, 25 bp, Mus musculus
tctgtgataccagaccctgaagaag

SEQ ID NO: 368017 - DNA, 25 bp, Mus musculus
tctgtgatgacaactacgaaagagc

SEQ ID NO: 368018 - DNA, 25 bp, Mus musculus
tctgtgattatcaggactagcggac

SEQ ID NO: 368019 - DNA, 25 bp, Mus musculus
tctgtgattatgtctgtcagaatct

SEQ ID NO: 368020 - DNA, 25 bp, Mus musculus
tctgtgatttacaggtggaaagctt

SEQ ID NO: 368021 - DNA, 25 bp, Mus musculus
tctgtgatttcctggattctcagga

SEQ ID NO: 368022 - DNA, 25 bp, Mus musculus
tctgtgcaagccagccccaggtatg

SEQ ID NO: 368023 - DNA, 25 bp, Mus musculus
tctgtgcacacatgtctgagagcaa

SEQ ID NO: 368024 - DNA, 25 bp, Mus musculus
tctgtgcacagactgactttgcacg

SEQ ID NO: 368025 - DNA, 25 bp, Mus musculus
tctgtgcactgctgaagaaggaccc

SEQ ID NO: 368026 - DNA, 25 bp, Mus musculus
tctgtgcactggaggttccaatacc

SEQ ID NO: 368027 - DNA, 25 bp, Mus musculus
tctgtgcacttagtagaaaatgaga

SEQ ID NO: 368028 - DNA, 25 bp, Mus musculus
tctgtgcagagatattcacaacgtt

SEQ ID NO: 368029 - DNA, 25 bp, Mus musculus
tctgtgcatgggccagcgtgacggc

SEQ ID NO: 368030 - DNA, 25 bp, Mus musculus
tctgtgccaacatggccatcctgga

SEQ ID NO: 368031 - DNA, 25 bp, Mus musculus
tctgtgccacacagatgctggagag

SEQ ID NO: 368032 - DNA, 25 bp, Mus musculus
tctgtgccacgccccctgattgaac

SEQ ID NO: 368033 - DNA, 25 bp, Mus musculus
tctgtgccagacatcctgcagttca

SEQ ID NO: 368034 - DNA, 25 bp, Mus musculus
tctgtgccagccatgaatgtcctgg

SEQ ID NO: 368035 - DNA, 25 bp, Mus musculus
tctgtgccaggctgtttgattatcg

SEQ ID NO: 368036 - DNA, 25 bp, Mus musculus
tctgtgccatgccaggtggttctga

SEQ ID NO: 368037 - DNA, 25 bp, Mus musculus
tctgtgcccaagattgggtgtgatc

SEQ ID NO: 368038 - DNA, 25 bp, Mus musculus
tctgtgcccataggttacaaccatc

SEQ ID NO: 368039 - DNA, 25 bp, Mus musculus
tctgtgcctatccagaccctcctcc

SEQ ID NO: 368040 - DNA, 25 bp, Mus musculus
tctgtgcctcgatggcactgccttt

SEQ ID NO: 368041 - DNA, 25 bp, Mus musculus
tctgtgcctctctgtgagcaaagaa

SEQ ID NO: 368042 - DNA, 25 bp, Mus musculus
tctgtgcgcggcaatacagagtgct

SEQ ID NO: 368043 - DNA, 25 bp, Mus musculus
tctgtgcgggaccagctgatccgag

SEQ ID NO: 368044 - DNA, 25 bp, Mus musculus
tctgtgcgggaccaggcctttaaga

SEQ ID NO: 368045 - DNA, 25 bp, Mus musculus
tctgtgctacagatgtcacagccat

SEQ ID NO: 368046 - DNA, 25 bp, Mus musculus
tctgtgctacagattacacctttgc

SEQ ID NO: 368047 - DNA, 25 bp, Mus musculus
tctgtgctagacaagtgctacgttg

SEQ ID NO: 368048 - DNA, 25 bp, Mus musculus
tctgtgctatgaaggtgaagcttcc

SEQ ID NO: 368049 - DNA, 25 bp, Mus musculus
tctgtgctccaggctctcacagcag

SEQ ID NO: 368050 - DNA, 25 bp, Mus musculus
tctgtgctctcaggggactcctctc

SEQ ID NO: 368051 - DNA, 25 bp, Mus musculus
tctgtgctgagctgggtgaagatga

SEQ ID NO: 368052 - DNA, 25 bp, Mus musculus
tctgtgctgcccagatcttggtgac

SEQ ID NO: 368053 - DNA, 25 bp, Mus musculus
tctgtgctgctgccttccctcctct

SEQ ID NO: 368054 - DNA, 25 bp, Mus musculus
tctgtgctgctgcgcggtgaccaca

SEQ ID NO: 368055 - DNA, 25 bp, Mus musculus
tctgtgctgtttggaagtgaaatgg

SEQ ID NO: 368056 - DNA, 25 bp, Mus musculus
tctgtggaaaactgatgagaaatga

SEQ ID NO: 368057 - DNA, 25 bp, Mus musculus
tctgtggaaagcagatgagaaatga

SEQ ID NO: 368058 - DNA, 25 bp, Mus musculus
tctgtggaaatccaggctgttcatc

SEQ ID NO: 368059 - DNA, 25 bp, Mus musculus
tctgtggaaatccagggcagagatg

SEQ ID NO: 368060 - DNA, 25 bp, Mus musculus
tctgtggaagagacctctgctaagg

SEQ ID NO: 368061 - DNA, 25 bp, Mus musculus
tctgtggaatcaccctgccccacga

SEQ ID NO: 368062 - DNA, 25 bp, Mus musculus
tctgtggacgaagaaaatattcccg

SEQ ID NO: 368063 - DNA, 25 bp, Mus musculus
tctgtggacggaatcttggagagac

SEQ ID NO: 368064 - DNA, 25 bp, Mus musculus
tctgtggaggatctggaaagagaac

SEQ ID NO: 368065 - DNA, 25 bp, Mus musculus
tctgtggataagctatatccacctt

SEQ ID NO: 368066 - DNA, 25 bp, Mus musculus
tctgtggatgaggtcactacttcag

SEQ ID NO: 368067 - DNA, 25 bp, Mus musculus
tctgtggatgatgaccacaagccga

SEQ ID NO: 368068 - DNA, 25 bp, Mus musculus
tctgtggcaaagtaggagttggcat

SEQ ID NO: 368069 - DNA, 25 bp, Mus musculus
tctgtggcaaagttagagaacgtgg

SEQ ID NO: 368070 - DNA, 25 bp, Mus musculus
tctgtggcatgcagctccatgactg

SEQ ID NO: 368071 - DNA, 25 bp, Mus musculus
tctgtggcatgcaggtgtaccagct

SEQ ID NO: 368072 - DNA, 25 bp, Mus musculus
tctgtggccatttctggcagctcta

SEQ ID NO: 368073 - DNA, 25 bp, Mus musculus
tctgtggcccaggttgctacaggca

SEQ ID NO: 368074 - DNA, 25 bp, Mus musculus
tctgtggcccagtcactggccgggg

SEQ ID NO: 368075 - DNA, 25 bp, Mus musculus
tctgtggcgaggagaaagcggtgga

SEQ ID NO: 368076 - DNA, 25 bp, Mus musculus
tctgtggctcagctatcttccagat

SEQ ID NO: 368077 - DNA, 25 bp, Mus musculus
tctgtggctgctgactctgctctcc

SEQ ID NO: 368078 - DNA, 25 bp, Mus musculus
tctgtggctgtcctccaggaggact

SEQ ID NO: 368079 - DNA, 25 bp, Mus musculus
tctgtggctttaataaaccacgttt

SEQ ID NO: 368080 - DNA, 25 bp, Mus musculus
tctgtggctttaatatgggcggcaa

SEQ ID NO: 368081 - DNA, 25 bp, Mus musculus
tctgtgggaagacaaagccattggc

SEQ ID NO: 368082 - DNA, 25 bp, Mus musculus
tctgtgggagtatgtcatggccacc

SEQ ID NO: 368083 - DNA, 25 bp, Mus musculus
tctgtgggctgcttgctctctaact

SEQ ID NO: 368084 - DNA, 25 bp, Mus musculus
tctgtgggctgcttggcttacttct

SEQ ID NO: 368085 - DNA, 25 bp, Mus musculus
tctgtggggaagaattcttgaagtc

SEQ ID NO: 368086 - DNA, 25 bp, Mus musculus
tctgtggggaagctcctgactatga

SEQ ID NO: 368087 - DNA, 25 bp, Mus musculus
tctgtggggctccacagaattgtgg

SEQ ID NO: 368088 - DNA, 25 bp, Mus musculus
tctgtggggctccctccatgtgctg

SEQ ID NO: 368089 - DNA, 25 bp, Mus musculus
tctgtgggtaccttgatgccatccc

SEQ ID NO: 368090 - DNA, 25 bp, Mus musculus
tctgtgggttagcgctaactgtcct

SEQ ID NO: 368091 - DNA, 25 bp, Mus musculus
tctgtggtcctagggttctccacat

SEQ ID NO: 368092 - DNA, 25 bp, Mus musculus
tctgtggtcctgaatccttcacacc

SEQ ID NO: 368093 - DNA, 25 bp, Mus musculus
tctgtggtggttctttcagctacaa

SEQ ID NO: 368094 - DNA, 25 bp, Mus musculus
tctgtggttgagctagaaaattatg

SEQ ID NO: 368095 - DNA, 25 bp, Mus musculus
tctgtggttgagtacgtgaagggct

SEQ ID NO: 368096 - DNA, 25 bp, Mus musculus
tctgtgtacagggttcggcagactc

SEQ ID NO: 368097 - DNA, 25 bp, Mus musculus
tctgtgtacctcagctggattcatc

SEQ ID NO: 368098 - DNA, 25 bp, Mus musculus
tctgtgtatagagttcgaaatttga

SEQ ID NO: 368099 - DNA, 25 bp, Mus musculus
tctgtgtatagatgatgaggaatct

SEQ ID NO: 368100 - DNA, 25 bp, Mus musculus
tctgtgtcaacgaggaaatgttgtc

SEQ ID NO: 368101 - DNA, 25 bp, Mus musculus
tctgtgtcaacgaggtccccggacc

SEQ ID NO: 368102 - DNA, 25 bp, Mus musculus
tctgtgtcaagcccaacaagcttcg

SEQ ID NO: 368103 - DNA, 25 bp, Mus musculus
tctgtgtccaggcttcagaagagcg

SEQ ID NO: 368104 - DNA, 25 bp, Mus musculus
tctgtgtctcactaatgctcatact

SEQ ID NO: 368105 - DNA, 25 bp, Mus musculus
tctgtgtctcgtttaaaaagcttgt

SEQ ID NO: 368106 - DNA, 25 bp, Mus musculus
tctgtgtctggaggaggtaaatgaa

SEQ ID NO: 368107 - DNA, 25 bp, Mus musculus
tctgtgtgacaccaacgacctgcag

SEQ ID NO: 368108 - DNA, 25 bp, Mus musculus
tctgtgtgacaccattcattgatgc

SEQ ID NO: 368109 - DNA, 25 bp, Mus musculus
tctgtgtgagagttgacggcgtcca

SEQ ID NO: 368110 - DNA, 25 bp, Mus musculus
tctgtgtgagagttgagtcctacct

SEQ ID NO: 368111 - DNA, 25 bp, Mus musculus
tctgtgtgatcaggagttcctctgt

SEQ ID NO: 368112 - DNA, 25 bp, Mus musculus
tctgtgtgattactggataagaaaa

SEQ ID NO: 368113 - DNA, 25 bp, Mus musculus
tctgtgtgcgggagaaaccactggt

SEQ ID NO: 368114 - DNA, 25 bp, Mus musculus
tctgtgtgcggggatctgaagttgg

SEQ ID NO: 368115 - DNA, 25 bp, Mus musculus
tctgtgtgcgtgtattctagtcaag

SEQ ID NO: 368116 - DNA, 25 bp, Mus musculus
tctgtgtgcgtgttaaaagagccaa

SEQ ID NO: 368117 - DNA, 25 bp, Mus musculus
tctgtgtggagaaatctgacgtttg

SEQ ID NO: 368118 - DNA, 25 bp, Mus musculus
tctgtgtggaggtacattcgctcag

SEQ ID NO: 368119 - DNA, 25 bp, Mus musculus
tctgtgtggaggtactacaagcctg

SEQ ID NO: 368120 - DNA, 25 bp, Mus musculus
tctgtgtgtgcagggaaatctgctc

SEQ ID NO: 368121 - DNA, 25 bp, Mus musculus
tctgtgttagcggggtgccacggct

SEQ ID NO: 368122 - DNA, 25 bp, Mus musculus
tctgtgtttactcactttcaaaact

SEQ ID NO: 368123 - DNA, 25 bp, Mus musculus
tctgtgtttactcactttgaaaaag

SEQ ID NO: 368124 - DNA, 25 bp, Mus musculus
tctgtgtttattcaggtgcactgca

SEQ ID NO: 368125 - DNA, 25 bp, Mus musculus
tctgtgtttccctacatccagaacc

SEQ ID NO: 368126 - DNA, 25 bp, Mus musculus
tctgttaagaaagaaacgctgcatc

SEQ ID NO: 368127 - DNA, 25 bp, Mus musculus
tctgttaagaaagattaaagatgaa

SEQ ID NO: 368128 - DNA, 25 bp, Mus musculus
tctgttaagaaaggacaaagatgtt

SEQ ID NO: 368129 - DNA, 25 bp, Mus musculus
tctgttacagcaaggtggctcagga

SEQ ID NO: 368130 - DNA, 25 bp, Mus musculus
tctgttactgccaggcatctggaga

SEQ ID NO: 368131 - DNA, 25 bp, Mus musculus
tctgttactgcccatgaaacccctg

SEQ ID NO: 368132 - DNA, 25 bp, Mus musculus
tctgttagacagaatggcaatccca

SEQ ID NO: 368133 - DNA, 25 bp, Mus musculus
tctgttagcgagttccagaatacct

SEQ ID NO: 368134 - DNA, 25 bp, Mus musculus
tctgttattcagctaccactacccc

SEQ ID NO: 368135 - DNA, 25 bp, Mus musculus
tctgttattcaggctttcaccactg

SEQ ID NO: 368136 - DNA, 25 bp, Mus musculus
tctgttcaacagcactgttgccaag

SEQ ID NO: 368137 - DNA, 25 bp, Mus musculus
tctgttcaacagggaccaaatgacg

SEQ ID NO: 368138 - DNA, 25 bp, Mus musculus
tctgttcagtgaacctaacactgag

SEQ ID NO: 368139 - DNA, 25 bp, Mus musculus
tctgttcccatgagaacccctgagc

SEQ ID NO: 368140 - DNA, 25 bp, Mus musculus
tctgttcccatggaatcattggtct

SEQ ID NO: 368141 - DNA, 25 bp, Mus musculus
tctgttccttccgaaccctgtgtat

SEQ ID NO: 368142 - DNA, 25 bp, Mus musculus
tctgttcgttcttagaatcctattc

SEQ ID NO: 368143 - DNA, 25 bp, Mus musculus
tctgttctaaagatgctgaaggcat

SEQ ID NO: 368144 - DNA, 25 bp, Mus musculus
tctgttctctgatttggggatattc

SEQ ID NO: 368145 - DNA, 25 bp, Mus musculus
tctgttctctggcgtaatagcttgg

SEQ ID NO: 368146 - DNA, 25 bp, Mus musculus
tctgttctctggtgaagaaatcttg

SEQ ID NO: 368147 - DNA, 25 bp, Mus musculus
tctgttctgactgctgcagctggct

SEQ ID NO: 368148 - DNA, 25 bp, Mus musculus
tctgttctggcggatgaaatgtggc

SEQ ID NO: 368149 - DNA, 25 bp, Mus musculus
tctgttcttggaggagggcaatgcg

SEQ ID NO: 368150 - DNA, 25 bp, Mus musculus
tctgttgaagagcaagttgctcccc

SEQ ID NO: 368151 - DNA, 25 bp, Mus musculus
tctgttgacctggaggagatggtgg

SEQ ID NO: 368152 - DNA, 25 bp, Mus musculus
tctgttgacctggaggagctgttgg

SEQ ID NO: 368153 - DNA, 25 bp, Mus musculus
tctgttgcaagcctacttctcccta

SEQ ID NO: 368154 - DNA, 25 bp, Mus musculus
tctgttgcaaggtgatctctgcacg

SEQ ID NO: 368155 - DNA, 25 bp, Mus musculus
tctgttggagataccttcctatccc

SEQ ID NO: 368156 - DNA, 25 bp, Mus musculus
tctgttggcctggtacaggaccctg

SEQ ID NO: 368157 - DNA, 25 bp, Mus musculus
tctgttgtcatggagagaatgcctc

SEQ ID NO: 368158 - DNA, 25 bp, Mus musculus
tctgttgtcatggaggactgtcacc

SEQ ID NO: 368159 - DNA, 25 bp, Mus musculus
tctgttgtgtagatgaacgagaccg

SEQ ID NO: 368160 - DNA, 25 bp, Mus musculus
tctgtttaatgaagactttgtatca

SEQ ID NO: 368161 - DNA, 25 bp, Mus musculus
tctgtttaatgaagtgtcacgagca

SEQ ID NO: 368162 - DNA, 25 bp, Mus musculus
tctgtttatctgaaggatcctaccc

SEQ ID NO: 368163 - DNA, 25 bp, Mus musculus
tctgtttcaaatcccagaaaccggc

SEQ ID NO: 368164 - DNA, 25 bp, Mus musculus
tctgtttcaagaagatctgcctcag

SEQ ID NO: 368165 - DNA, 25 bp, Mus musculus
tctgtttcagtggaaacaagttgag

SEQ ID NO: 368166 - DNA, 25 bp, Mus musculus
tctgtttcccagaccaggtcgacct

SEQ ID NO: 368167 - DNA, 25 bp, Mus musculus
tctgtttcccagggtcccaaaggcc

SEQ ID NO: 368168 - DNA, 25 bp, Mus musculus
tctgtttccgggtgccatgcagaag

SEQ ID NO: 368169 - DNA, 25 bp, Mus musculus
tctgtttctactctggtgaccatag

SEQ ID NO: 368170 - DNA, 25 bp, Mus musculus
tctgtttctcgctggaaggctctac

SEQ ID NO: 368171 - DNA, 25 bp, Mus musculus
tctgtttgaaaacagctcgaggctg

SEQ ID NO: 368172 - DNA, 25 bp, Mus musculus
tctgtttgaaatggctcggttttac

SEQ ID NO: 368173 - DNA, 25 bp, Mus musculus
tctgtttgaggttcctgggtggagc

SEQ ID NO: 368174 - DNA, 25 bp, Mus musculus
tctgtttgagtgatgagccggcagg

SEQ ID NO: 368175 - DNA, 25 bp, Mus musculus
tctgtttgctcagggtgcagtgagc

SEQ ID NO: 368176 - DNA, 25 bp, Mus musculus
tctgttttacaaaaggtcacaacca

SEQ ID NO: 368177 - DNA, 25 bp, Mus musculus
tctgttttagcaatcccacagggac

SEQ ID NO: 368178 - DNA, 25 bp, Mus musculus
tctgttttatcctggtctctaataa

SEQ ID NO: 368179 - DNA, 25 bp, Mus musculus
tctgttttatgagatgtccagctcg

SEQ ID NO: 368180 - DNA, 25 bp, Mus musculus
tctgttttctgttgagcggctgcaa

SEQ ID NO: 368181 - DNA, 25 bp, Mus musculus
tctgttttgtgaaggacaaggctac

SEQ ID NO: 368182 - DNA, 25 bp, Mus musculus
tctgttttttagcacaatggaaggt

SEQ ID NO: 368183 - DNA, 25 bp, Mus musculus
tcttaaaaagtgcttctctctgaat

SEQ ID NO: 368184 - DNA, 25 bp, Mus musculus
tcttaaaaatgcaccaacaattctc

SEQ ID NO: 368185 - DNA, 25 bp, Mus musculus
tcttaaaacaagtgcctccaaaacc

SEQ ID NO: 368186 - DNA, 25 bp, Mus musculus
tcttaaaacaagtgttttgtcaagt

SEQ ID NO: 368187 - DNA, 25 bp, Mus musculus
tcttaaaagaggtctggaagactcc

SEQ ID NO: 368188 - DNA, 25 bp, Mus musculus
tcttaaacaagcaataccttctgac

SEQ ID NO: 368189 - DNA, 25 bp, Mus musculus
tcttaaactcggtgtgtatgaagcc

SEQ ID NO: 368190 - DNA, 25 bp, Mus musculus
tcttaaagatgaggtcctgtaataa

SEQ ID NO: 368191 - DNA, 25 bp, Mus musculus
tcttaaagatggaggcgccgaggag

SEQ ID NO: 368192 - DNA, 25 bp, Mus musculus
tcttaaagatggcttgtccatgcga

SEQ ID NO: 368193 - DNA, 25 bp, Mus musculus
tcttaaagatgggggctgaggcgat

SEQ ID NO: 368194 - DNA, 25 bp, Mus musculus
tcttaaagctggcgagcttctgcag

SEQ ID NO: 368195 - DNA, 25 bp, Mus musculus
tcttaaagctggcggtccccaacca

SEQ ID NO: 368196 - DNA, 25 bp, Mus musculus
tcttaaaggagagcttgaacttgga

SEQ ID NO: 368197 - DNA, 25 bp, Mus musculus
tcttaaataaaggtatggcctcaca

SEQ ID NO: 368198 - DNA, 25 bp, Mus musculus
tcttaaatctggggaaggaagccag

SEQ ID NO: 368199 - DNA, 25 bp, Mus musculus
tcttaaatctggttaactatttgta

SEQ ID NO: 368200 - DNA, 25 bp, Mus musculus
tcttaaatctgttcacacagaagat

SEQ ID NO: 368201 - DNA, 25 bp, Mus musculus
tcttaacaagcacaatgggtgtgtt

SEQ ID NO: 368202 - DNA, 25 bp, Mus musculus
tcttaacaaggcacctaattacaac

SEQ ID NO: 368203 - DNA, 25 bp, Mus musculus
tcttaacaagggataactctctgcc

SEQ ID NO: 368204 - DNA, 25 bp, Mus musculus
tcttaacaaggtgcagatcactgga

SEQ ID NO: 368205 - DNA, 25 bp, Mus musculus
tcttaaccctgcaactgatgagatg

SEQ ID NO: 368206 - DNA, 25 bp, Mus musculus
tcttaactatatgagcgatgtcgaa

SEQ ID NO: 368207 - DNA, 25 bp, Mus musculus
tcttaactggagttggtcgaattat

SEQ ID NO: 368208 - DNA, 25 bp, Mus musculus
tcttaactttcatagatcctgaagg

SEQ ID NO: 368209 - DNA, 25 bp, Mus musculus
tcttaagaaagaggaagcagaaatc

SEQ ID NO: 368210 - DNA, 25 bp, Mus musculus
tcttaagaaatgctgcggcaccatt

SEQ ID NO: 368211 - DNA, 25 bp, Mus musculus
tcttaagaagaaagcagcacacaca

SEQ ID NO: 368212 - DNA, 25 bp, Mus musculus
tcttaagaagaaaggactgacagac

SEQ ID NO: 368213 - DNA, 25 bp, Mus musculus
tcttaagaagattgaaaagcaaata

SEQ ID NO: 368214 - DNA, 25 bp, Mus musculus
tcttaagaaggtcttgctgtgcagc

SEQ ID NO: 368215 - DNA, 25 bp, Mus musculus
tcttaagactggcctgctgcaaaaa

SEQ ID NO: 368216 - DNA, 25 bp, Mus musculus
tcttaagaggaggtccttgttcacc

SEQ ID NO: 368217 - DNA, 25 bp, Mus musculus
tcttaaggagctaagggaacaatta

SEQ ID NO: 368218 - DNA, 25 bp, Mus musculus
tcttaagggagatcgccacgactcg

SEQ ID NO: 368219 - DNA, 25 bp, Mus musculus
tcttaagtacatggcgcagcagcag

SEQ ID NO: 368220 - DNA, 25 bp, Mus musculus
tcttaagtatttgatgctggagaag

SEQ ID NO: 368221 - DNA, 25 bp, Mus musculus
tcttaagtatttggctcagtgttta

SEQ ID NO: 368222 - DNA, 25 bp, Mus musculus
tcttaatataacttgcaccgattag

SEQ ID NO: 368223 - DNA, 25 bp, Mus musculus
tcttaatcaggtatgtgtacatccc

SEQ ID NO: 368224 - DNA, 25 bp, Mus musculus
tcttaatcaggtcttctcgtcccag

SEQ ID NO: 368225 - DNA, 25 bp, Mus musculus
tcttaatcagtggatggagaccaag

SEQ ID NO: 368226 - DNA, 25 bp, Mus musculus
tcttaatcttccttcctactagacg

SEQ ID NO: 368227 - DNA, 25 bp, Mus musculus
tcttaattaagaacattacttcata

SEQ ID NO: 368228 - DNA, 25 bp, Mus musculus
tcttaattctggcagttaaaccaga

SEQ ID NO: 368229 - DNA, 25 bp, Mus musculus
tcttacaagaagagtaccagcctca

SEQ ID NO: 368230 - DNA, 25 bp, Mus musculus
tcttacagaagtaccctcctccact

SEQ ID NO: 368231 - DNA, 25 bp, Mus musculus
tcttacagaagttactggacagtga

SEQ ID NO: 368232 - DNA, 25 bp, Mus musculus
tcttacagctcacagaaggacatgg

SEQ ID NO: 368233 - DNA, 25 bp, Mus musculus
tcttacatggaaggaggcatggaga

SEQ ID NO: 368234 - DNA, 25 bp, Mus musculus
tcttacatggaagggcgtggagctg

SEQ ID NO: 368235 - DNA, 25 bp, Mus musculus
tcttaccaagaagtttgttcgcact

SEQ ID NO: 368236 - DNA, 25 bp, Mus musculus
tcttaccaagattctaaggtgaaga

SEQ ID NO: 368237 - DNA, 25 bp, Mus musculus
tcttaccaatcttgaactttccacc

SEQ ID NO: 368238 - DNA, 25 bp, Mus musculus
tcttaccacctgtggtggactggtg

SEQ ID NO: 368239 - DNA, 25 bp, Mus musculus
tcttacccaaagcccacctggaagc

SEQ ID NO: 368240 - DNA, 25 bp, Mus musculus
tcttacccagaccaacagcaaccac

SEQ ID NO: 368241 - DNA, 25 bp, Mus musculus
tcttacccagcatatatttggtttc

SEQ ID NO: 368242 - DNA, 25 bp, Mus musculus
tcttacccaggtttttgtgcgtctg

SEQ ID NO: 368243 - DNA, 25 bp, Mus musculus
tcttacctctggaaggcatcagttt

SEQ ID NO: 368244 - DNA, 25 bp, Mus musculus
tcttacctctgtcccaattcacagg

SEQ ID NO: 368245 - DNA, 25 bp, Mus musculus
tcttacctgcaaagtaacagcctcc

SEQ ID NO: 368246 - DNA, 25 bp, Mus musculus
tcttacctgcctgtgccgtgtgacg

SEQ ID NO: 368247 - DNA, 25 bp, Mus musculus
tcttacggagggctggatcgtgact

SEQ ID NO: 368248 - DNA, 25 bp, Mus musculus
tcttactacaggaatgagtgccact

SEQ ID NO: 368249 - DNA, 25 bp, Mus musculus
tcttactatgaaaagggatggatct

SEQ ID NO: 368250 - DNA, 25 bp, Mus musculus
tcttactatgaaaaggtgacgtgca

SEQ ID NO: 368251 - DNA, 25 bp, Mus musculus
tcttactcagaaaaatttcctatct

SEQ ID NO: 368252 - DNA, 25 bp, Mus musculus
tcttactcagggcattacacaagca

SEQ ID NO: 368253 - DNA, 25 bp, Mus musculus
tcttactccgtggcgaatctcatta

SEQ ID NO: 368254 - DNA, 25 bp, Mus musculus
tcttactctcccagcatgctggact

SEQ ID NO: 368255 - DNA, 25 bp, Mus musculus
tcttactgacagcttttttattaag

SEQ ID NO: 368256 - DNA, 25 bp, Mus musculus
tcttactgacagtgtacactctttt

SEQ ID NO: 368257 - DNA, 25 bp, Mus musculus
tcttactgacagttgaacaccagtg

SEQ ID NO: 368258 - DNA, 25 bp, Mus musculus
tcttactgcagcagcttcaaactgt

SEQ ID NO: 368259 - DNA, 25 bp, Mus musculus
tcttactgcagcaggagtgtgataa

SEQ ID NO: 368260 - DNA, 25 bp, Mus musculus
tcttactgccaagatatagatgagt

SEQ ID NO: 368261 - DNA, 25 bp, Mus musculus
tcttactgctttgactgtactccct

SEQ ID NO: 368262 - DNA, 25 bp, Mus musculus
tcttactggaagattatcctgtcct

SEQ ID NO: 368263 - DNA, 25 bp, Mus musculus
tcttacttaaggaactcagagaaag

SEQ ID NO: 368264 - DNA, 25 bp, Mus musculus
tcttacttctgcccgggctgagcgc

SEQ ID NO: 368265 - DNA, 25 bp, Mus musculus
tcttacttctgcccggtgctggcca

SEQ ID NO: 368266 - DNA, 25 bp, Mus musculus
tcttagaagcagaatggaatgacct

SEQ ID NO: 368267 - DNA, 25 bp, Mus musculus
tcttagacctcaagaattaaaacag

SEQ ID NO: 368268 - DNA, 25 bp, Mus musculus
tcttagacctcaagggagaaggtga

SEQ ID NO: 368269 - DNA, 25 bp, Mus musculus
tcttagacctggaatcagatgaaga

SEQ ID NO: 368270 - DNA, 25 bp, Mus musculus
tcttagagaacatgctggatagtag

SEQ ID NO: 368271 - DNA, 25 bp, Mus musculus
tcttagagaagatccatctgacacc

SEQ ID NO: 368272 - DNA, 25 bp, Mus musculus
tcttagagagagtgcagttctccgt

SEQ ID NO: 368273 - DNA, 25 bp, Mus musculus
tcttagagagcttcctgccagcact

SEQ ID NO: 368274 - DNA, 25 bp, Mus musculus
tcttagagataaggttcatcatttg

SEQ ID NO: 368275 - DNA, 25 bp, Mus musculus
tcttagagcagaaagccaatgctct

SEQ ID NO: 368276 - DNA, 25 bp, Mus musculus
tcttagagtaccagcgcgggatgcg

SEQ ID NO: 368277 - DNA, 25 bp, Mus musculus
tcttagatcagaaaagattcggcag

SEQ ID NO: 368278 - DNA, 25 bp, Mus musculus
tcttagatcagaggcggcagacccc

SEQ ID NO: 368279 - DNA, 25 bp, Mus musculus
tcttagcaagggtctgtcaccgctg

SEQ ID NO: 368280 - DNA, 25 bp, Mus musculus
tcttagcagaaatctagatcttgag

SEQ ID NO: 368281 - DNA, 25 bp, Mus musculus
tcttagcagaacaggtgtttggatt

SEQ ID NO: 368282 - DNA, 25 bp, Mus musculus
tcttagcatcggcaggacagcagcg

SEQ ID NO: 368283 - DNA, 25 bp, Mus musculus
tcttagccatgaaacactctctgga

SEQ ID NO: 368284 - DNA, 25 bp, Mus musculus
tcttagccccaggtgctgcagtcgc

SEQ ID NO: 368285 - DNA, 25 bp, Mus musculus
tcttagcccgcgaggaacagtctga

SEQ ID NO: 368286 - DNA, 25 bp, Mus musculus
tcttagccggaggatactcagctct

SEQ ID NO: 368287 - DNA, 25 bp, Mus musculus
tcttagcggcggactggtgcagtca

SEQ ID NO: 368288 - DNA, 25 bp, Mus musculus
tcttagcggcgggagtctatcctga

SEQ ID NO: 368289 - DNA, 25 bp, Mus musculus
tcttagcggcgggtactataccaac

SEQ ID NO: 368290 - DNA, 25 bp, Mus musculus
tcttagctgagatagaagctttgga

SEQ ID NO: 368291 - DNA, 25 bp, Mus musculus
tcttagctggcggtgtggcacccac

SEQ ID NO: 368292 - DNA, 25 bp, Mus musculus
tcttaggtaaggtggtcagcgcgct

SEQ ID NO: 368293 - DNA, 25 bp, Mus musculus
tcttagtaaatgaaggctggagcca

SEQ ID NO: 368294 - DNA, 25 bp, Mus musculus
tcttagtcaagggtctcatgtactc

SEQ ID NO: 368295 - DNA, 25 bp, Mus musculus
tcttagtcaaggttggcttcctgaa

SEQ ID NO: 368296 - DNA, 25 bp, Mus musculus
tcttagtcccagtggaagcaccagc

SEQ ID NO: 368297 - DNA, 25 bp, Mus musculus
tcttagtccgcagacccccaggaaa

SEQ ID NO: 368298 - DNA, 25 bp, Mus musculus
tcttagtgcaggccaaaagtcacat

SEQ ID NO: 368299 - DNA, 25 bp, Mus musculus
tcttagtgcaggctttggcagctca

SEQ ID NO: 368300 - DNA, 25 bp, Mus musculus
tcttagttcgttgtgatgacgacct

SEQ ID NO: 368301 - DNA, 25 bp, Mus musculus
tcttataaatgtttatgtctgggaa

SEQ ID NO: 368302 - DNA, 25 bp, Mus musculus
tcttatatgggagagtcagtcgttg

SEQ ID NO: 368303 - DNA, 25 bp, Mus musculus
tcttatcaccagggagctaagaaga

SEQ ID NO: 368304 - DNA, 25 bp, Mus musculus
tcttatcagacaaagtaaatcagat

SEQ ID NO: 368305 - DNA, 25 bp, Mus musculus
tcttatcagggtcaaagaaggcaaa

SEQ ID NO: 368306 - DNA, 25 bp, Mus musculus
tcttatcatatgataatattaagaa

SEQ ID NO: 368307 - DNA, 25 bp, Mus musculus
tcttatcatatgatagtctgatatg

SEQ ID NO: 368308 - DNA, 25 bp, Mus musculus
tcttatccaggtaccattactatgg

SEQ ID NO: 368309 - DNA, 25 bp, Mus musculus
tcttatctccatctcttcccactgg

SEQ ID NO: 368310 - DNA, 25 bp, Mus musculus
tcttatctcgagttgggaaccaaaa

SEQ ID NO: 368311 - DNA, 25 bp, Mus musculus
tcttatctcgatgaggtctcaatat

SEQ ID NO: 368312 - DNA, 25 bp, Mus musculus
tcttatctcggttacacctgtaatc

SEQ ID NO: 368313 - DNA, 25 bp, Mus musculus
tcttatctctgtgtgtgccgacaac

SEQ ID NO: 368314 - DNA, 25 bp, Mus musculus
tcttatgaaggtctacggcttgaag

SEQ ID NO: 368315 - DNA, 25 bp, Mus musculus
tcttatgacagctggaacgctttag

SEQ ID NO: 368316 - DNA, 25 bp, Mus musculus
tcttatgacaggtggctgtctgccc

SEQ ID NO: 368317 - DNA, 25 bp, Mus musculus
tcttatgactctgctgggattcctg

SEQ ID NO: 368318 - DNA, 25 bp, Mus musculus
tcttatgactgcaccattcctgccc

SEQ ID NO: 368319 - DNA, 25 bp, Mus musculus
tcttatgctagaaaaggttgcacga

SEQ ID NO: 368320 - DNA, 25 bp, Mus musculus
tcttatgtcaaggcaccgagatgga

SEQ ID NO: 368321 - DNA, 25 bp, Mus musculus
tcttattccagtcccactcacttac

SEQ ID NO: 368322 - DNA, 25 bp, Mus musculus
tcttattccatagtagtgggcagca

SEQ ID NO: 368323 - DNA, 25 bp, Mus musculus
tcttattcctcctatgaggcgtctg

SEQ ID NO: 368324 - DNA, 25 bp, Mus musculus
tcttattcgcagtggctgtgacgtg

SEQ ID NO: 368325 - DNA, 25 bp, Mus musculus
tcttattgaaacatccatttcagtc

SEQ ID NO: 368326 - DNA, 25 bp, Mus musculus
tcttattgaatatccagaagatgtg

SEQ ID NO: 368327 - DNA, 25 bp, Mus musculus
tcttattggacaagtgcaactgtag

SEQ ID NO: 368328 - DNA, 25 bp, Mus musculus
tcttattgtcgctctattctctcct

SEQ ID NO: 368329 - DNA, 25 bp, Mus musculus
tcttattgtcggttggtgatgagaa

SEQ ID NO: 368330 - DNA, 25 bp, Mus musculus
tcttatttaaagctgagtgcaatat

SEQ ID NO: 368331 - DNA, 25 bp, Mus musculus
tcttatttaagacttcattgaacca

SEQ ID NO: 368332 - DNA, 25 bp, Mus musculus
tcttatttattggcacagacacagg

SEQ ID NO: 368333 - DNA, 25 bp, Mus musculus
tcttcaaaagagtgttgaagtccta

SEQ ID NO: 368334 - DNA, 25 bp, Mus musculus
tcttcaaaagtgaggaagaaaaact

SEQ ID NO: 368335 - DNA, 25 bp, Mus musculus
tcttcaaacgtggggttctatggcc

SEQ ID NO: 368336 - DNA, 25 bp, Mus musculus
tcttcaaagaatgattctgttggct

SEQ ID NO: 368337 - DNA, 25 bp, Mus musculus
tcttcaaagacaagctcaaacatgt

SEQ ID NO: 368338 - DNA, 25 bp, Mus musculus
tcttcaaagacaaggtgagggtggt

SEQ ID NO: 368339 - DNA, 25 bp, Mus musculus
tcttcaaagtagaaggttacatcca

SEQ ID NO: 368340 - DNA, 25 bp, Mus musculus
tcttcaaataaaaaggtgcttgagc

SEQ ID NO: 368341 - DNA, 25 bp, Mus musculus
tcttcaacaggttctactcagttcc

SEQ ID NO: 368342 - DNA, 25 bp, Mus musculus
tcttcaacattgaggatcataaaga

SEQ ID NO: 368343 - DNA, 25 bp, Mus musculus
tcttcaaccaacaggagctctttgg

SEQ ID NO: 368344 - DNA, 25 bp, Mus musculus
tcttcaaccatcaggggctggtgtc

SEQ ID NO: 368345 - DNA, 25 bp, Mus musculus
tcttcaaccatcaggtctaggtggc

SEQ ID NO: 368346 - DNA, 25 bp, Mus musculus
tcttcaaccgcatctccctgactgg

SEQ ID NO: 368347 - DNA, 25 bp, Mus musculus
tcttcaaccggatctccctgactgg

SEQ ID NO: 368348 - DNA, 25 bp, Mus musculus
tcttcaactccccagagcacccctt

SEQ ID NO: 368349 - DNA, 25 bp, Mus musculus
tcttcaactccccaggaagctacag

SEQ ID NO: 368350 - DNA, 25 bp, Mus musculus
tcttcaactctgtagtgaatgtggg

SEQ ID NO: 368351 - DNA, 25 bp, Mus musculus
tcttcaagaacattgcgacgctcca

SEQ ID NO: 368352 - DNA, 25 bp, Mus musculus
tcttcaagaaggagaacagagaaag

SEQ ID NO: 368353 - DNA, 25 bp, Mus musculus
tcttcaagaaggagtatggctgtaa

SEQ ID NO: 368354 - DNA, 25 bp, Mus musculus
tcttcaagaatgacattgtcaactg

SEQ ID NO: 368355 - DNA, 25 bp, Mus musculus
tcttcaagaggaccctggcccagtc

SEQ ID NO: 368356 - DNA, 25 bp, Mus musculus
tcttcaagaggacgtccttcatttc

SEQ ID NO: 368357 - DNA, 25 bp, Mus musculus
tcttcaagatgagagcgatgacaga

SEQ ID NO: 368358 - DNA, 25 bp, Mus musculus
tcttcaagatgaggcgagtggcagt

SEQ ID NO: 368359 - DNA, 25 bp, Mus musculus
tcttcaagcagagaaagaacgaacg

SEQ ID NO: 368360 - DNA, 25 bp, Mus musculus
tcttcaagcagcctgaaaggcaagg

SEQ ID NO: 368361 - DNA, 25 bp, Mus musculus
tcttcaagctcttatgtgagacgtg

SEQ ID NO: 368362 - DNA, 25 bp, Mus musculus
tcttcaagtgatagttctcagtatg

SEQ ID NO: 368363 - DNA, 25 bp, Mus musculus
tcttcaatacagtagtctggacaga

SEQ ID NO: 368364 - DNA, 25 bp, Mus musculus
tcttcaatatcttgggagccgaaga

SEQ ID NO: 368365 - DNA, 25 bp, Mus musculus
tcttcaatatcttggtacagggagc

SEQ ID NO: 368366 - DNA, 25 bp, Mus musculus
tcttcaatccccaagaccctgaaga

SEQ ID NO: 368367 - DNA, 25 bp, Mus musculus
tcttcaatccccaaggttcattctg

SEQ ID NO: 368368 - DNA, 25 bp, Mus musculus
tcttcaatcgcagaggagaactgcg

SEQ ID NO: 368369 - DNA, 25 bp, Mus musculus
tcttcaatgagcagggttggttttt

SEQ ID NO: 368370 - DNA, 25 bp, Mus musculus
tcttcaatgagcaggtttcagcgga

SEQ ID NO: 368371 - DNA, 25 bp, Mus musculus
tcttcaatgaggggaagcgcttggc

SEQ ID NO: 368372 - DNA, 25 bp, Mus musculus
tcttcaatgtggctcactttagtgc

SEQ ID NO: 368373 - DNA, 25 bp, Mus musculus
tcttcacaaccattcctggtctgac

SEQ ID NO: 368374 - DNA, 25 bp, Mus musculus
tcttcacactgctttggtgcggcaa

SEQ ID NO: 368375 - DNA, 25 bp, Mus musculus
tcttcacagaacaagcagacttcca

SEQ ID NO: 368376 - DNA, 25 bp, Mus musculus
tcttcacaggagagagactgagaac

SEQ ID NO: 368377 - DNA, 25 bp, Mus musculus
tcttcacagggacctgtgggatcca

SEQ ID NO: 368378 - DNA, 25 bp, Mus musculus
tcttcacatcatgaagtgtgatctg

SEQ ID NO: 368379 - DNA, 25 bp, Mus musculus
tcttcaccactgaccggggggtgtg

SEQ ID NO: 368380 - DNA, 25 bp, Mus musculus
tcttcaccacttccctgatgatctt

SEQ ID NO: 368381 - DNA, 25 bp, Mus musculus
tcttcaccaggtccagctagctggg

SEQ ID NO: 368382 - DNA, 25 bp, Mus musculus
tcttcaccagtctaaatccagtgaa

SEQ ID NO: 368383 - DNA, 25 bp, Mus musculus
tcttcaccattggggctgtgcattt

SEQ ID NO: 368384 - DNA, 25 bp, Mus musculus
tcttcaccattgggttcacaggctg

SEQ ID NO: 368385 - DNA, 25 bp, Mus musculus
tcttcaccccacaggtgcgactgga

SEQ ID NO: 368386 - DNA, 25 bp, Mus musculus
tcttcacccggaggtttcagaaagt

SEQ ID NO: 368387 - DNA, 25 bp, Mus musculus
tcttcaccgcacagacaccaagtgg

SEQ ID NO: 368388 - DNA, 25 bp, Mus musculus
tcttcacctactacagacaagtaga

SEQ ID NO: 368389 - DNA, 25 bp, Mus musculus
tcttcacctagtacagacaagtaga

SEQ ID NO: 368390 - DNA, 25 bp, Mus musculus
tcttcacctccattgggcacatgac

SEQ ID NO: 368391 - DNA, 25 bp, Mus musculus
tcttcacctgcctctgcctcctgag

SEQ ID NO: 368392 - DNA, 25 bp, Mus musculus
tcttcacctgcttcctggcagtgga

SEQ ID NO: 368393 - DNA, 25 bp, Mus musculus
tcttcacctgggtgctacagaagac

SEQ ID NO: 368394 - DNA, 25 bp, Mus musculus
tcttcacctttggtgtcctgtgcat

SEQ ID NO: 368395 - DNA, 25 bp, Mus musculus
tcttcacgataggcaaggggaagtc

SEQ ID NO: 368396 - DNA, 25 bp, Mus musculus
tcttcacgcctctgggaaacctaaa

SEQ ID NO: 368397 - DNA, 25 bp, Mus musculus
tcttcacgctggatgttgaatgcgg

SEQ ID NO: 368398 - DNA, 25 bp, Mus musculus
tcttcacgctggggtttctctgtat

SEQ ID NO: 368399 - DNA, 25 bp, Mus musculus
tcttcacggaactcgatggagcaaa

SEQ ID NO: 368400 - DNA, 25 bp, Mus musculus
tcttcacggcactggttctaaggct

SEQ ID NO: 368401 - DNA, 25 bp, Mus musculus
tcttcactgaagaagtggactctcg

SEQ ID NO: 368402 - DNA, 25 bp, Mus musculus
tcttcactgacacatgccctgagcc

SEQ ID NO: 368403 - DNA, 25 bp, Mus musculus
tcttcactgactagtctccagaggc

SEQ ID NO: 368404 - DNA, 25 bp, Mus musculus
tcttcactgactattttaacagcgt

SEQ ID NO: 368405 - DNA, 25 bp, Mus musculus
tcttcactgcaggtcccaaattggt

SEQ ID NO: 368406 - DNA, 25 bp, Mus musculus
tcttcactgcaggttcacctggaga

SEQ ID NO: 368407 - DNA, 25 bp, Mus musculus
tcttcactgtaaaggtgcgagaaga

SEQ ID NO: 368408 - DNA, 25 bp, Mus musculus
tcttcactttcacgaggagaacatt

SEQ ID NO: 368409 - DNA, 25 bp, Mus musculus
tcttcagaaacaggtctggatgctt

SEQ ID NO: 368410 - DNA, 25 bp, Mus musculus
tcttcagaaacaggtctggcaggat

SEQ ID NO: 368411 - DNA, 25 bp, Mus musculus
tcttcagaaaggccggagcctcaac

SEQ ID NO: 368412 - DNA, 25 bp, Mus musculus
tcttcagaaggtcgtgaaaatacat

SEQ ID NO: 368413 - DNA, 25 bp, Mus musculus
tcttcagacagacccttagagggcc

SEQ ID NO: 368414 - DNA, 25 bp, Mus musculus
tcttcagacagagggccacagctac

SEQ ID NO: 368415 - DNA, 25 bp, Mus musculus
tcttcagacaggcccagtgctcgcc

SEQ ID NO: 368416 - DNA, 25 bp, Mus musculus
tcttcagacggtttctctagaggac

SEQ ID NO: 368417 - DNA, 25 bp, Mus musculus
tcttcagacttgctggtacaagtat

SEQ ID NO: 368418 - DNA, 25 bp, Mus musculus
tcttcagagagaggtaccgaccctt

SEQ ID NO: 368419 - DNA, 25 bp, Mus musculus
tcttcagagagagtctttctgcagg

SEQ ID NO: 368420 - DNA, 25 bp, Mus musculus
tcttcagagccagatagacctcttg

SEQ ID NO: 368421 - DNA, 25 bp, Mus musculus
tcttcagatgcacatatggatgcat

SEQ ID NO: 368422 - DNA, 25 bp, Mus musculus
tcttcagatgcacatcctcttctag

SEQ ID NO: 368423 - DNA, 25 bp, Mus musculus
tcttcagattctgagagtctgctag

SEQ ID NO: 368424 - DNA, 25 bp, Mus musculus
tcttcagattctgagtctgatatcc

SEQ ID NO: 368425 - DNA, 25 bp, Mus musculus
tcttcagattctgagtggggacctc

SEQ ID NO: 368426 - DNA, 25 bp, Mus musculus
tcttcagattggagattttatttct

SEQ ID NO: 368427 - DNA, 25 bp, Mus musculus
tcttcagattggttctgtaagcgga

SEQ ID NO: 368428 - DNA, 25 bp, Mus musculus
tcttcagcaagacagaggagctgaa

SEQ ID NO: 368429 - DNA, 25 bp, Mus musculus
tcttcagcagatgatgcccgccagc

SEQ ID NO: 368430 - DNA, 25 bp, Mus musculus
tcttcagccaaagaaccccaaatct

SEQ ID NO: 368431 - DNA, 25 bp, Mus musculus
tcttcagccaaagcctattggtgta

SEQ ID NO: 368432 - DNA, 25 bp, Mus musculus
tcttcagccaaaggagccagtcaca

SEQ ID NO: 368433 - DNA, 25 bp, Mus musculus
tcttcagccaaaggattgggacatg

SEQ ID NO: 368434 - DNA, 25 bp, Mus musculus
tcttcagcctggcagaaaacttctt

SEQ ID NO: 368435 - DNA, 25 bp, Mus musculus
tcttcagcctgggctcagccatcgc

SEQ ID NO: 368436 - DNA, 25 bp, Mus musculus
tcttcagctacattttcagctttgt

SEQ ID NO: 368437 - DNA, 25 bp, Mus musculus
tcttcagctacctcagctttatgag

SEQ ID NO: 368438 - DNA, 25 bp, Mus musculus
tcttcagctgctctgtccgggcctt

SEQ ID NO: 368439 - DNA, 25 bp, Mus musculus
tcttcagctggcaacacccaaggcc

SEQ ID NO: 368440 - DNA, 25 bp, Mus musculus
tcttcagctggcaagaccggggttc

SEQ ID NO: 368441 - DNA, 25 bp, Mus musculus
tcttcagcttcaaatcagtaccaca

SEQ ID NO: 368442 - DNA, 25 bp, Mus musculus
tcttcagcttcaaggtttggattca

SEQ ID NO: 368443 - DNA, 25 bp, Mus musculus
tcttcaggaaagagcaaataagttg

SEQ ID NO: 368444 - DNA, 25 bp, Mus musculus
tcttcaggagcggaggtacactgta

SEQ ID NO: 368445 - DNA, 25 bp, Mus musculus
tcttcaggagggggaacagacatcc

SEQ ID NO: 368446 - DNA, 25 bp, Mus musculus
tcttcaggcaacatgaaattgatgg

SEQ ID NO: 368447 - DNA, 25 bp, Mus musculus
tcttcaggcttaaagggtatgtccc

SEQ ID NO: 368448 - DNA, 25 bp, Mus musculus
tcttcagggggtgattagtgttaag

SEQ ID NO: 368449 - DNA, 25 bp, Mus musculus
tcttcaggggtcaggaggcgggagc

SEQ ID NO: 368450 - DNA, 25 bp, Mus musculus
tcttcagtattcctgtcttgacttc

SEQ ID NO: 368451 - DNA, 25 bp, Mus musculus
tcttcagtcctacaggtttgttaag

SEQ ID NO: 368452 - DNA, 25 bp, Mus musculus
tcttcagtctgagattggccaggtg

SEQ ID NO: 368453 - DNA, 25 bp, Mus musculus
tcttcagtgcaaggatggaaggacc

SEQ ID NO: 368454 - DNA, 25 bp, Mus musculus
tcttcagtgcaaggttatcctgctc

SEQ ID NO: 368455 - DNA, 25 bp, Mus musculus
tcttcagtggaaggtaaacagaatc

SEQ ID NO: 368456 - DNA, 25 bp, Mus musculus
tcttcagttttagatcaagaatgac

SEQ ID NO: 368457 - DNA, 25 bp, Mus musculus
tcttcataacaaggatatagtgcac

SEQ ID NO: 368458 - DNA, 25 bp, Mus musculus
tcttcatactgcatgacatcaacag

SEQ ID NO: 368459 - DNA, 25 bp, Mus musculus
tcttcatagagacacaccagaggag

SEQ ID NO: 368460 - DNA, 25 bp, Mus musculus
tcttcatagagatctccttgtcagc

SEQ ID NO: 368461 - DNA, 25 bp, Mus musculus
tcttcatatttggccacagccttcg

SEQ ID NO: 368462 - DNA, 25 bp, Mus musculus
tcttcatcaagtcacagtaatgaaa

SEQ ID NO: 368463 - DNA, 25 bp, Mus musculus
tcttcatcaccacgtatcacgtatg

SEQ ID NO: 368464 - DNA, 25 bp, Mus musculus
tcttcatcaccaggtatcacgtatg

SEQ ID NO: 368465 - DNA, 25 bp, Mus musculus
tcttcatcaggatgctgcacaacaa

SEQ ID NO: 368466 - DNA, 25 bp, Mus musculus
tcttcatccagcagatccgaatcca

SEQ ID NO: 368467 - DNA, 25 bp, Mus musculus
tcttcatccagcattccatgatcta

SEQ ID NO: 368468 - DNA, 25 bp, Mus musculus
tcttcatcccaggagatcttcccac

SEQ ID NO: 368469 - DNA, 25 bp, Mus musculus
tcttcatctcaaggatccttgacac

SEQ ID NO: 368470 - DNA, 25 bp, Mus musculus
tcttcatctccaaggttggtgacac

SEQ ID NO: 368471 - DNA, 25 bp, Mus musculus
tcttcatctgactctggctcctctt

SEQ ID NO: 368472 - DNA, 25 bp, Mus musculus
tcttcatctgctgggaccagagtga

SEQ ID NO: 368473 - DNA, 25 bp, Mus musculus
tcttcatgcccacctggtaacatct

SEQ ID NO: 368474 - DNA, 25 bp, Mus musculus
tcttcatgctggatgatactatcgt

SEQ ID NO: 368475 - DNA, 25 bp, Mus musculus
tcttcatggcgaagaagaagacacc

SEQ ID NO: 368476 - DNA, 25 bp, Mus musculus
tcttcatgttcgtgattgtgctgtc

SEQ ID NO: 368477 - DNA, 25 bp, Mus musculus
tcttcatgtttccagttggcctcta

SEQ ID NO: 368478 - DNA, 25 bp, Mus musculus
tcttcattaaacccaacaaacctgt

SEQ ID NO: 368479 - DNA, 25 bp, Mus musculus
tcttcattaagatggatgtaggtca

SEQ ID NO: 368480 - DNA, 25 bp, Mus musculus
tcttcattaggtgctgacctctcgg

SEQ ID NO: 368481 - DNA, 25 bp, Mus musculus
tcttcattgagactggacaatctgt

SEQ ID NO: 368482 - DNA, 25 bp, Mus musculus
tcttcattgatgggcagacacgcac

SEQ ID NO: 368483 - DNA, 25 bp, Mus musculus
tcttcattgccagcaaccgtgtctt

SEQ ID NO: 368484 - DNA, 25 bp, Mus musculus
tcttcattgctcagacggccagagc

SEQ ID NO: 368485 - DNA, 25 bp, Mus musculus
tcttcattgctcagcatgagaatga

SEQ ID NO: 368486 - DNA, 25 bp, Mus musculus
tcttcattgctggctttgcggtggg

SEQ ID NO: 368487 - DNA, 25 bp, Mus musculus
tcttcattgtaatcgattggtatca

SEQ ID NO: 368488 - DNA, 25 bp, Mus musculus
tcttcattgtcaggttcctggaaag

SEQ ID NO: 368489 - DNA, 25 bp, Mus musculus
tcttcatttagggacaagaagacct

SEQ ID NO: 368490 - DNA, 25 bp, Mus musculus
tcttcatttcaggccatcagctcca

SEQ ID NO: 368491 - DNA, 25 bp, Mus musculus
tcttcatttgagggggtcaggacaa

SEQ ID NO: 368492 - DNA, 25 bp, Mus musculus
tcttcatttgtgtaattttgtgcca

SEQ ID NO: 368493 - DNA, 25 bp, Mus musculus
tcttccaagagaggaggctgtgaaa

SEQ ID NO: 368494 - DNA, 25 bp, Mus musculus
tcttccaagaggcaacaactgtatg

SEQ ID NO: 368495 - DNA, 25 bp, Mus musculus
tcttccaatcccttgctgatctgaa

SEQ ID NO: 368496 - DNA, 25 bp, Mus musculus
tcttccacacacgccaccccacctt

SEQ ID NO: 368497 - DNA, 25 bp, Mus musculus
tcttccacacacggaggaggttggc

SEQ ID NO: 368498 - DNA, 25 bp, Mus musculus
tcttccacaggtctgttggtgcccg

SEQ ID NO: 368499 - DNA, 25 bp, Mus musculus
tcttccacagtgcctccggagccag

SEQ ID NO: 368500 - DNA, 25 bp, Mus musculus
tcttccaccaaggaggaatttcaac

SEQ ID NO: 368501 - DNA, 25 bp, Mus musculus
tcttccaccgcgccctgtctcactg

SEQ ID NO: 368502 - DNA, 25 bp, Mus musculus
tcttccactggggtgtgtctgcagc

SEQ ID NO: 368503 - DNA, 25 bp, Mus musculus
tcttccagaccagggacggaaactt

SEQ ID NO: 368504 - DNA, 25 bp, Mus musculus
tcttccagatgagaaaatgatgtag

SEQ ID NO: 368505 - DNA, 25 bp, Mus musculus
tcttccagatggggacttcagacgc

SEQ ID NO: 368506 - DNA, 25 bp, Mus musculus
tcttccagccctgagatgctcacgt

SEQ ID NO: 368507 - DNA, 25 bp, Mus musculus
tcttccagctaccactatgccgctt

SEQ ID NO: 368508 - DNA, 25 bp, Mus musculus
tcttccaggaagaggcggtgacaga

SEQ ID NO: 368509 - DNA, 25 bp, Mus musculus
tcttccagtaccaagacaaagccta

SEQ ID NO: 368510 - DNA, 25 bp, Mus musculus
tcttccagtgcaggcctaaccctgt

SEQ ID NO: 368511 - DNA, 25 bp, Mus musculus
tcttccagtgcagggaaaagctgtg

SEQ ID NO: 368512 - DNA, 25 bp, Mus musculus
tcttccataaagggcaagaaaaagt

SEQ ID NO: 368513 - DNA, 25 bp, Mus musculus
tcttccataaaggggcagtaaatgg

SEQ ID NO: 368514 - DNA, 25 bp, Mus musculus
tcttccataagaacgggagaggctc

SEQ ID NO: 368515 - DNA, 25 bp, Mus musculus
tcttccatacagatgatattgaaaa

SEQ ID NO: 368516 - DNA, 25 bp, Mus musculus
tcttccatcactcagctggagcaat

SEQ ID NO: 368517 - DNA, 25 bp, Mus musculus
tcttccatcactcagggcgttccct

SEQ ID NO: 368518 - DNA, 25 bp, Mus musculus
tcttccatcctgagcggctctctgt

SEQ ID NO: 368519 - DNA, 25 bp, Mus musculus
tcttccatctggtcctgcatgtcca

SEQ ID NO: 368520 - DNA, 25 bp, Mus musculus
tcttccatgtgctccccacactcct

SEQ ID NO: 368521 - DNA, 25 bp, Mus musculus
tcttcccaaaacagaataaatggag

SEQ ID NO: 368522 - DNA, 25 bp, Mus musculus
tcttcccaaaacagtatctttcaga

SEQ ID NO: 368523 - DNA, 25 bp, Mus musculus
tcttcccaacaagacgatgatgatg

SEQ ID NO: 368524 - DNA, 25 bp, Mus musculus
tcttcccaagctaaagcccattatc

SEQ ID NO: 368525 - DNA, 25 bp, Mus musculus
tcttcccacaatattctggataaca

SEQ ID NO: 368526 - DNA, 25 bp, Mus musculus
tcttcccacactcaccgagctcttt

SEQ ID NO: 368527 - DNA, 25 bp, Mus musculus
tcttcccacccaggaatccaaacgc

SEQ ID NO: 368528 - DNA, 25 bp, Mus musculus
tcttcccacccagtgatgactacga

SEQ ID NO: 368529 - DNA, 25 bp, Mus musculus
tcttcccacgaacaagatgccattt

SEQ ID NO: 368530 - DNA, 25 bp, Mus musculus
tcttcccacggatgtgatcttcgtg

SEQ ID NO: 368531 - DNA, 25 bp, Mus musculus
tcttcccactcatgttactgggcct

SEQ ID NO: 368532 - DNA, 25 bp, Mus musculus
tcttcccagagtttccagagtctga

SEQ ID NO: 368533 - DNA, 25 bp, Mus musculus
tcttcccaggatgagtctgactatc

SEQ ID NO: 368534 - DNA, 25 bp, Mus musculus
tcttcccatcagcccaggccacagc

SEQ ID NO: 368535 - DNA, 25 bp, Mus musculus
tcttccccaggttctccaagccagc

SEQ ID NO: 368536 - DNA, 25 bp, Mus musculus
tcttcccccacagtcccagacgagg

SEQ ID NO: 368537 - DNA, 25 bp, Mus musculus
tcttcccccagatgcctgtcggtgc

SEQ ID NO: 368538 - DNA, 25 bp, Mus musculus
tcttccccccaggattcttcctact

SEQ ID NO: 368539 - DNA, 25 bp, Mus musculus
tcttccccccaggcttaagatactc

SEQ ID NO: 368540 - DNA, 25 bp, Mus musculus
tcttccccgtgaaggacagtcatgg

SEQ ID NO: 368541 - DNA, 25 bp, Mus musculus
tcttcccgatttgcccatgaagctg

SEQ ID NO: 368542 - DNA, 25 bp, Mus musculus
tcttccctaagacctaggacctagg

SEQ ID NO: 368543 - DNA, 25 bp, Mus musculus
tcttccctaaggtgaaaggactgag

SEQ ID NO: 368544 - DNA, 25 bp, Mus musculus
tcttccctagagatggctttcctga

SEQ ID NO: 368545 - DNA, 25 bp, Mus musculus
tcttccctatctacttggaccagaa

SEQ ID NO: 368546 - DNA, 25 bp, Mus musculus
tcttccctcccgcccaagcctaata

SEQ ID NO: 368547 - DNA, 25 bp, Mus musculus
tcttccctgccagaggttgagacag

SEQ ID NO: 368548 - DNA, 25 bp, Mus musculus
tcttccctggcacagaaacatcatc

SEQ ID NO: 368549 - DNA, 25 bp, Mus musculus
tcttccctggcaccgggcactgact

SEQ ID NO: 368550 - DNA, 25 bp, Mus musculus
tcttccctggtacagcaagcttccc

SEQ ID NO: 368551 - DNA, 25 bp, Mus musculus
tcttccctggtacagcaagctttcc

SEQ ID NO: 368552 - DNA, 25 bp, Mus musculus
tcttccctgtcctgaggccatgctt

SEQ ID NO: 368553 - DNA, 25 bp, Mus musculus
tcttcccttagaccgtcacgacggc

SEQ ID NO: 368554 - DNA, 25 bp, Mus musculus
tcttccctttctcaggtccaggtgg

SEQ ID NO: 368555 - DNA, 25 bp, Mus musculus
tcttccgacatggaggatgacttga

SEQ ID NO: 368556 - DNA, 25 bp, Mus musculus
tcttccgagtcagctacttcctgtg

SEQ ID NO: 368557 - DNA, 25 bp, Mus musculus
tcttccgatggcagaaacttgattg

SEQ ID NO: 368558 - DNA, 25 bp, Mus musculus
tcttccgggaaagggctctcttgtg

SEQ ID NO: 368559 - DNA, 25 bp, Mus musculus
tcttccgggagatccccactccttc

SEQ ID NO: 368560 - DNA, 25 bp, Mus musculus
tcttccggggtctggacagcattct

SEQ ID NO: 368561 - DNA, 25 bp, Mus musculus
tcttccggggtctggtggtacttga

SEQ ID NO: 368562 - DNA, 25 bp, Mus musculus
tcttccgtcataacgggcctgtgtg

SEQ ID NO: 368563 - DNA, 25 bp, Mus musculus
tcttccgtgcaggcgcctaaaagaa

SEQ ID NO: 368564 - DNA, 25 bp, Mus musculus
tcttcctacaaaaggtgtggcgtgg

SEQ ID NO: 368565 - DNA, 25 bp, Mus musculus
tcttcctacagttggtcccgcagat

SEQ ID NO: 368566 - DNA, 25 bp, Mus musculus
tcttcctatcagagagtgactcaga

SEQ ID NO: 368567 - DNA, 25 bp, Mus musculus
tcttcctatcagggctcagttctga

SEQ ID NO: 368568 - DNA, 25 bp, Mus musculus
tcttcctcaaccccctagaatccat

SEQ ID NO: 368569 - DNA, 25 bp, Mus musculus
tcttcctcagaattatctgggaatg

SEQ ID NO: 368570 - DNA, 25 bp, Mus musculus
tcttcctcatcagtgccaactgtaa

SEQ ID NO: 368571 - DNA, 25 bp, Mus musculus
tcttcctcatcagtggccaccaatg

SEQ ID NO: 368572 - DNA, 25 bp, Mus musculus
tcttcctccaccaggtagctgagac

SEQ ID NO: 368573 - DNA, 25 bp, Mus musculus
tcttcctcctttggtggccgtgcct

SEQ ID NO: 368574 - DNA, 25 bp, Mus musculus
tcttcctcgcgtttcatgcaggctc

SEQ ID NO: 368575 - DNA, 25 bp, Mus musculus
tcttcctcgggctccactctcgctc

SEQ ID NO: 368576 - DNA, 25 bp, Mus musculus
tcttcctctgacagtctcatctttg

SEQ ID NO: 368577 - DNA, 25 bp, Mus musculus
tcttcctctggaatcaacataaagt

SEQ ID NO: 368578 - DNA, 25 bp, Mus musculus
tcttcctgaagaacggtatcactga

SEQ ID NO: 368579 - DNA, 25 bp, Mus musculus
tcttcctgaaggttgagaacaaaaa

SEQ ID NO: 368580 - DNA, 25 bp, Mus musculus
tcttcctgacagggagccaggcttg

SEQ ID NO: 368581 - DNA, 25 bp, Mus musculus
tcttcctgcaagaactgagcctgga

SEQ ID NO: 368582 - DNA, 25 bp, Mus musculus
tcttcctgcaagcagccttcagatg

SEQ ID NO: 368583 - DNA, 25 bp, Mus musculus
tcttcctgcaagggtggccatgggt

SEQ ID NO: 368584 - DNA, 25 bp, Mus musculus
tcttcctgcactttgaggaggaaga

SEQ ID NO: 368585 - DNA, 25 bp, Mus musculus
tcttcctgcccagtgggcagctgat

SEQ ID NO: 368586 - DNA, 25 bp, Mus musculus
tcttcctgcccccagaacctggacc

SEQ ID NO: 368587 - DNA, 25 bp, Mus musculus
tcttcctgccctcgctagttctgac

SEQ ID NO: 368588 - DNA, 25 bp, Mus musculus
tcttcctgctcaggagactgcttct

SEQ ID NO: 368589 - DNA, 25 bp, Mus musculus
tcttcctggagttccctgaggatcc

SEQ ID NO: 368590 - DNA, 25 bp, Mus musculus
tcttcctggctctatccaggcttac

SEQ ID NO: 368591 - DNA, 25 bp, Mus musculus
tcttcctggctctctacctggccaa

SEQ ID NO: 368592 - DNA, 25 bp, Mus musculus
tcttcctgggatctgaacttcactg

SEQ ID NO: 368593 - DNA, 25 bp, Mus musculus
tcttcctgggatctgctgtgtccca

SEQ ID NO: 368594 - DNA, 25 bp, Mus musculus
tcttcctgtaaggacttaaatattt

SEQ ID NO: 368595 - DNA, 25 bp, Mus musculus
tcttcctgtccaccctgttggcaga

SEQ ID NO: 368596 - DNA, 25 bp, Mus musculus
tcttccttaaagggattggagctgg

SEQ ID NO: 368597 - DNA, 25 bp, Mus musculus
tcttccttaaaggggcgacctggca

SEQ ID NO: 368598 - DNA, 25 bp, Mus musculus
tcttccttagcaaccttccatggct

SEQ ID NO: 368599 - DNA, 25 bp, Mus musculus
tcttccttcaggtccttcatttctt

SEQ ID NO: 368600 - DNA, 25 bp, Mus musculus
tcttcctttcctaagaaccaagaca

SEQ ID NO: 368601 - DNA, 25 bp, Mus musculus
tcttcctttgcacaggtgacgccat

SEQ ID NO: 368602 - DNA, 25 bp, Mus musculus
tcttcgaaagcacagaatactatta

SEQ ID NO: 368603 - DNA, 25 bp, Mus musculus
tcttcgaaagcacaggttttgcact

SEQ ID NO: 368604 - DNA, 25 bp, Mus musculus
tcttcgaacggcacccaccaggtga

SEQ ID NO: 368605 - DNA, 25 bp, Mus musculus
tcttcgaagccaaggcccaggcctt

SEQ ID NO: 368606 - DNA, 25 bp, Mus musculus
tcttcgaataaggactgcatcaaat

SEQ ID NO: 368607 - DNA, 25 bp, Mus musculus
tcttcgaataagtaataaaagagca

SEQ ID NO: 368608 - DNA, 25 bp, Mus musculus
tcttcgagataagacagtgatgata

SEQ ID NO: 368609 - DNA, 25 bp, Mus musculus
tcttcgagcacttccggtggacact

SEQ ID NO: 368610 - DNA, 25 bp, Mus musculus
tcttcgagcacttccgtgtctgtct

SEQ ID NO: 368611 - DNA, 25 bp, Mus musculus
tcttcgccataggtagcattgccaa

SEQ ID NO: 368612 - DNA, 25 bp, Mus musculus
tcttcgccccctggtgtggacattg

SEQ ID NO: 368613 - DNA, 25 bp, Mus musculus
tcttcgccgcgtctggtgacttctg

SEQ ID NO: 368614 - DNA, 25 bp, Mus musculus
tcttcgcggaagatatatgttgggt

SEQ ID NO: 368615 - DNA, 25 bp, Mus musculus
tcttcgcggcggggtggcggtggga

SEQ ID NO: 368616 - DNA, 25 bp, Mus musculus
tcttcgcttggggtgcacacagtga

SEQ ID NO: 368617 - DNA, 25 bp, Mus musculus
tcttcggctacatggtcctctctct

SEQ ID NO: 368618 - DNA, 25 bp, Mus musculus
tcttcgggagaggaacagtatccag

SEQ ID NO: 368619 - DNA, 25 bp, Mus musculus
tcttcgggagaggaggtttgggatg

SEQ ID NO: 368620 - DNA, 25 bp, Mus musculus
tcttcgtactagaggctgctgtccg

SEQ ID NO: 368621 - DNA, 25 bp, Mus musculus
tcttcgtactagctcacttcatgac

SEQ ID NO: 368622 - DNA, 25 bp, Mus musculus
tcttcgtactagctcctggacttct

SEQ ID NO: 368623 - DNA, 25 bp, Mus musculus
tcttcgtcaaggaaacctgcagatc

SEQ ID NO: 368624 - DNA, 25 bp, Mus musculus
tcttcgtcaaggccggaagtgatgg

SEQ ID NO: 368625 - DNA, 25 bp, Mus musculus
tcttcgtcaaggctggttatgacgg

SEQ ID NO: 368626 - DNA, 25 bp, Mus musculus
tcttcgtcctgtgagagagattccc

SEQ ID NO: 368627 - DNA, 25 bp, Mus musculus
tcttcgtcctgtgagatctatgtaa

SEQ ID NO: 368628 - DNA, 25 bp, Mus musculus
tcttcgtctcctgccgtggatgctg

SEQ ID NO: 368629 - DNA, 25 bp, Mus musculus
tcttcgtctgaagacaaacctgaga

SEQ ID NO: 368630 - DNA, 25 bp, Mus musculus
tcttcgtctgaagatgggtcagaga

SEQ ID NO: 368631 - DNA, 25 bp, Mus musculus
tcttcgtcttcatcgcgcccttgct

SEQ ID NO: 368632 - DNA, 25 bp, Mus musculus
tcttcgtcttcatcgtggacctgct

SEQ ID NO: 368633 - DNA, 25 bp, Mus musculus
tcttcgtgacgataagtgggcagag

SEQ ID NO: 368634 - DNA, 25 bp, Mus musculus
tcttcgtgacgttattagaagccca

SEQ ID NO: 368635 - DNA, 25 bp, Mus musculus
tcttcgtgtttcaggtattctgcgt

SEQ ID NO: 368636 - DNA, 25 bp, Mus musculus
tcttcgttgggggcactcagaaaga

SEQ ID NO: 368637 - DNA, 25 bp, Mus musculus
tcttcgttttgacttatatgatgtt

SEQ ID NO: 368638 - DNA, 25 bp, Mus musculus
tcttctaaagacctcaaaggaagac

SEQ ID NO: 368639 - DNA, 25 bp, Mus musculus
tcttctaaagttgattgaatcaaca

SEQ ID NO: 368640 - DNA, 25 bp, Mus musculus
tcttctaaccagaggcaccaggatc

SEQ ID NO: 368641 - DNA, 25 bp, Mus musculus
tcttctaagtgaaggacagagggta

SEQ ID NO: 368642 - DNA, 25 bp, Mus musculus
tcttctacagcatagccctcaggga

SEQ ID NO: 368643 - DNA, 25 bp, Mus musculus
tcttctacagcatagggaagcagct

SEQ ID NO: 368644 - DNA, 25 bp, Mus musculus
tcttctacatctttggtattgttgg

SEQ ID NO: 368645 - DNA, 25 bp, Mus musculus
tcttctacatggtgccatcagcaac

SEQ ID NO: 368646 - DNA, 25 bp, Mus musculus
tcttctaccactgaggggtttcacc

SEQ ID NO: 368647 - DNA, 25 bp, Mus musculus
tcttctaccccacataatatttctt

SEQ ID NO: 368648 - DNA, 25 bp, Mus musculus
tcttctaccccagataatatttctt

SEQ ID NO: 368649 - DNA, 25 bp, Mus musculus
tcttctactagagttatctgggaat

SEQ ID NO: 368650 - DNA, 25 bp, Mus musculus
tcttctactgacatgtaccataatg

SEQ ID NO: 368651 - DNA, 25 bp, Mus musculus
tcttctactgcggctggtgtcagtc

SEQ ID NO: 368652 - DNA, 25 bp, Mus musculus
tcttctactgcgggatggccatcgt

SEQ ID NO: 368653 - DNA, 25 bp, Mus musculus
tcttctactgcgggcatggtgaagc

SEQ ID NO: 368654 - DNA, 25 bp, Mus musculus
tcttctagatcagccaccatgcggc

SEQ ID NO: 368655 - DNA, 25 bp, Mus musculus
tcttctagtagcttgtcttctcaca

SEQ ID NO: 368656 - DNA, 25 bp, Mus musculus
tcttctagttaagaggtttggacat

SEQ ID NO: 368657 - DNA, 25 bp, Mus musculus
tcttctataacggctgggcacgtgg

SEQ ID NO: 368658 - DNA, 25 bp, Mus musculus
tcttctatccagggatgaactccat

SEQ ID NO: 368659 - DNA, 25 bp, Mus musculus
tcttctatccagggcccattgtgga

SEQ ID NO: 368660 - DNA, 25 bp, Mus musculus
tcttctatctttggtatagttggaa

SEQ ID NO: 368661 - DNA, 25 bp, Mus musculus
tcttctatctttttgagttgtgtaa

SEQ ID NO: 368662 - DNA, 25 bp, Mus musculus
tcttctatggagagaaacaacccga

SEQ ID NO: 368663 - DNA, 25 bp, Mus musculus
tcttctatttcctagagctgtttga

SEQ ID NO: 368664 - DNA, 25 bp, Mus musculus
tcttctatttctgggttctgccaga

SEQ ID NO: 368665 - DNA, 25 bp, Mus musculus
tcttctattttgagagactgccttt

SEQ ID NO: 368666 - DNA, 25 bp, Mus musculus
tcttctattttgaggttgagcacat

SEQ ID NO: 368667 - DNA, 25 bp, Mus musculus
tcttctcaagcagatttcggaggca

SEQ ID NO: 368668 - DNA, 25 bp, Mus musculus
tcttctcaagcagggtactggtctc

SEQ ID NO: 368669 - DNA, 25 bp, Mus musculus
tcttctcaagcaggtggcccacgcg

SEQ ID NO: 368670 - DNA, 25 bp, Mus musculus
tcttctcaatgtaaatttaacacaa

SEQ ID NO: 368671 - DNA, 25 bp, Mus musculus
tcttctcagagaagaaaagcgagtc

SEQ ID NO: 368672 - DNA, 25 bp, Mus musculus
tcttctcagcatccctggctgagag

SEQ ID NO: 368673 - DNA, 25 bp, Mus musculus
tcttctcagcatttgccctggttcc

SEQ ID NO: 368674 - DNA, 25 bp, Mus musculus
tcttctcagggtctcagaatggcct

SEQ ID NO: 368675 - DNA, 25 bp, Mus musculus
tcttctcagtcaggtaccaagcgcc

SEQ ID NO: 368676 - DNA, 25 bp, Mus musculus
tcttctcagtcaggtcgcagacatt

SEQ ID NO: 368677 - DNA, 25 bp, Mus musculus
tcttctccaagttgctgcaatagta

SEQ ID NO: 368678 - DNA, 25 bp, Mus musculus
tcttctccaccaagtcaaagtaaac

SEQ ID NO: 368679 - DNA, 25 bp, Mus musculus
tcttctccacggtactacttgtcct

SEQ ID NO: 368680 - DNA, 25 bp, Mus musculus
tcttctccacgttctaccacgcctg

SEQ ID NO: 368681 - DNA, 25 bp, Mus musculus
tcttctccatagcagactagagaga

SEQ ID NO: 368682 - DNA, 25 bp, Mus musculus
tcttctccatatacctggtgatgga

SEQ ID NO: 368683 - DNA, 25 bp, Mus musculus
tcttctccatcacaatccaagagaa

SEQ ID NO: 368684 - DNA, 25 bp, Mus musculus
tcttctccatcagaatccaagagaa

SEQ ID NO: 368685 - DNA, 25 bp, Mus musculus
tcttctcccagatgaccaagatgtt

SEQ ID NO: 368686 - DNA, 25 bp, Mus musculus
tcttctcccctgacagacccggagt

SEQ ID NO: 368687 - DNA, 25 bp, Mus musculus
tcttctcccctggtttctgtatgca

SEQ ID NO: 368688 - DNA, 25 bp, Mus musculus
tcttctcgatctttgggaccatctg

SEQ ID NO: 368689 - DNA, 25 bp, Mus musculus
tcttctctaaaaaagattgatagcg

SEQ ID NO: 368690 - DNA, 25 bp, Mus musculus
tcttctctgcagaccggcccaacgt

SEQ ID NO: 368691 - DNA, 25 bp, Mus musculus
tcttctctggggtctatgtttcttc

SEQ ID NO: 368692 - DNA, 25 bp, Mus musculus
tcttctctgtaaaagggtgtcttta

SEQ ID NO: 368693 - DNA, 25 bp, Mus musculus
tcttctgaaagctctgtacaactca

SEQ ID NO: 368694 - DNA, 25 bp, Mus musculus
tcttctgaccaaagaatacattcca

SEQ ID NO: 368695 - DNA, 25 bp, Mus musculus
tcttctgagaacaggaatggccttg

SEQ ID NO: 368696 - DNA, 25 bp, Mus musculus
tcttctgagccttgcgtgccctccc

SEQ ID NO: 368697 - DNA, 25 bp, Mus musculus
tcttctgatagaggtgccctgggac

SEQ ID NO: 368698 - DNA, 25 bp, Mus musculus
tcttctgatatgaggacccatcctc

SEQ ID NO: 368699 - DNA, 25 bp, Mus musculus
tcttctgatcagcagagtgaaatgg

SEQ ID NO: 368700 - DNA, 25 bp, Mus musculus
tcttctgatgagctgggaagtcatc

SEQ ID NO: 368701 - DNA, 25 bp, Mus musculus
tcttctgcaagcactgcagagagcg

SEQ ID NO: 368702 - DNA, 25 bp, Mus musculus
tcttctgcactagagtatcaagaga

SEQ ID NO: 368703 - DNA, 25 bp, Mus musculus
tcttctgcagaactgggagtcctcc

SEQ ID NO: 368704 - DNA, 25 bp, Mus musculus
tcttctgcagtctacctgtgcccca

SEQ ID NO: 368705 - DNA, 25 bp, Mus musculus
tcttctgcatgaacttctgcacagc

SEQ ID NO: 368706 - DNA, 25 bp, Mus musculus
tcttctgcatgaatttcagttcgtt

SEQ ID NO: 368707 - DNA, 25 bp, Mus musculus
tcttctgcattcgtgccgaggagtt

SEQ ID NO: 368708 - DNA, 25 bp, Mus musculus
tcttctgcattcgtggtgtttgtct

SEQ ID NO: 368709 - DNA, 25 bp, Mus musculus
tcttctgccatacccgcaaaacagc

SEQ ID NO: 368710 - DNA, 25 bp, Mus musculus
tcttctgcccagccaccccgctggg

SEQ ID NO: 368711 - DNA, 25 bp, Mus musculus
tcttctgccgccagcattgacctct

SEQ ID NO: 368712 - DNA, 25 bp, Mus musculus
tcttctgctgtggaacgacatcgcc

SEQ ID NO: 368713 - DNA, 25 bp, Mus musculus
tcttctggaaagagatggctgtctc

SEQ ID NO: 368714 - DNA, 25 bp, Mus musculus
tcttctggaaagctaggtagaagcc

SEQ ID NO: 368715 - DNA, 25 bp, Mus musculus
tcttctggaaaggcctagactggtt

SEQ ID NO: 368716 - DNA, 25 bp, Mus musculus
tcttctggaactctgacagtgtcca

SEQ ID NO: 368717 - DNA, 25 bp, Mus musculus
tcttctggaactctgccaaaaatgg

SEQ ID NO: 368718 - DNA, 25 bp, Mus musculus
tcttctggaagccgctctctctccc

SEQ ID NO: 368719 - DNA, 25 bp, Mus musculus
tcttctggaaggactaccaccttgc

SEQ ID NO: 368720 - DNA, 25 bp, Mus musculus
tcttctggaaggactcgggacaccc

SEQ ID NO: 368721 - DNA, 25 bp, Mus musculus
tcttctggaaggatccgccgcgatg

SEQ ID NO: 368722 - DNA, 25 bp, Mus musculus
tcttctggaatgtggaacagcccca

SEQ ID NO: 368723 - DNA, 25 bp, Mus musculus
tcttctggaatgtggtagcgagatg

SEQ ID NO: 368724 - DNA, 25 bp, Mus musculus
tcttctggaccctgcatggtttatt

SEQ ID NO: 368725 - DNA, 25 bp, Mus musculus
tcttctggagagaagtgtgctggtg

SEQ ID NO: 368726 - DNA, 25 bp, Mus musculus
tcttctggagagggcatcatggctc

SEQ ID NO: 368727 - DNA, 25 bp, Mus musculus
tcttctggatgctatgtcaggatcg

SEQ ID NO: 368728 - DNA, 25 bp, Mus musculus
tcttctggcctccgatggtgacatt

SEQ ID NO: 368729 - DNA, 25 bp, Mus musculus
tcttctgggagaagatgctcagacc

SEQ ID NO: 368730 - DNA, 25 bp, Mus musculus
tcttctgggcggaacgaagagctct

SEQ ID NO: 368731 - DNA, 25 bp, Mus musculus
tcttctgggtcctggatggagcctg

SEQ ID NO: 368732 - DNA, 25 bp, Mus musculus
tcttctgggtcctgggagccacgct

SEQ ID NO: 368733 - DNA, 25 bp, Mus musculus
tcttctgtctcccctgaggcctttg

SEQ ID NO: 368734 - DNA, 25 bp, Mus musculus
tcttctgtgacaagggagcagaaag

SEQ ID NO: 368735 - DNA, 25 bp, Mus musculus
tcttctgtgacaaggtcatagtccg

SEQ ID NO: 368736 - DNA, 25 bp, Mus musculus
tcttctgtgatggactgcagtaatg

SEQ ID NO: 368737 - DNA, 25 bp, Mus musculus
tcttctgtgatggccaaagatctca

SEQ ID NO: 368738 - DNA, 25 bp, Mus musculus
tcttctgtggccatttctggcagct

SEQ ID NO: 368739 - DNA, 25 bp, Mus musculus
tcttcttaaggagagcgattcaatg

SEQ ID NO: 368740 - DNA, 25 bp, Mus musculus
tcttcttaattctggcagttaaacc

SEQ ID NO: 368741 - DNA, 25 bp, Mus musculus
tcttcttacagaagtaccctcctcc

SEQ ID NO: 368742 - DNA, 25 bp, Mus musculus
tcttcttacagaagttactggacag

SEQ ID NO: 368743 - DNA, 25 bp, Mus musculus
tcttcttatagcaggttcttgtctg

SEQ ID NO: 368744 - DNA, 25 bp, Mus musculus
tcttcttatcagggtcaaagaaggc

SEQ ID NO: 368745 - DNA, 25 bp, Mus musculus
tcttcttatctgagttgaactcttt

SEQ ID NO: 368746 - DNA, 25 bp, Mus musculus
tcttcttatctgtgttgaactcttt

SEQ ID NO: 368747 - DNA, 25 bp, Mus musculus
tcttcttcacaggaagtcctcgggt

SEQ ID NO: 368748 - DNA, 25 bp, Mus musculus
tcttcttcacggtgccttggagcac

SEQ ID NO: 368749 - DNA, 25 bp, Mus musculus
tcttcttcactgacacatgccctga

SEQ ID NO: 368750 - DNA, 25 bp, Mus musculus
tcttcttcagaaacaaacatatcat

SEQ ID NO: 368751 - DNA, 25 bp, Mus musculus
tcttcttcagatacatgtctcagag

SEQ ID NO: 368752 - DNA, 25 bp, Mus musculus
tcttcttcaggcaacagactttatc

SEQ ID NO: 368753 - DNA, 25 bp, Mus musculus
tcttcttcaggttgccagtcacagt

SEQ ID NO: 368754 - DNA, 25 bp, Mus musculus
tcttcttccaccaaggaggaatttc

SEQ ID NO: 368755 - DNA, 25 bp, Mus musculus
tcttcttccagtgcaggtcctaatc

SEQ ID NO: 368756 - DNA, 25 bp, Mus musculus
tcttcttctttgtactaggcggcct

SEQ ID NO: 368757 - DNA, 25 bp, Mus musculus
tcttcttctttttagggacaggggc

SEQ ID NO: 368758 - DNA, 25 bp, Mus musculus
tcttcttctttttaggtcccgcctg

SEQ ID NO: 368759 - DNA, 25 bp, Mus musculus
tcttcttctttttaggtgaggagtt

SEQ ID NO: 368760 - DNA, 25 bp, Mus musculus
tcttcttgaaatctacccagaatgg

SEQ ID NO: 368761 - DNA, 25 bp, Mus musculus
tcttcttgagctcggcttcatgacg

SEQ ID NO: 368762 - DNA, 25 bp, Mus musculus
tcttcttgaggtgagcgggatggcg

SEQ ID NO: 368763 - DNA, 25 bp, Mus musculus
tcttctttcctgactgatggcgctt

SEQ ID NO: 368764 - DNA, 25 bp, Mus musculus
tcttctttgatccagatgccaaggg

SEQ ID NO: 368765 - DNA, 25 bp, Mus musculus
tcttctttgatgagaagtcccgtgt

SEQ ID NO: 368766 - DNA, 25 bp, Mus musculus
tcttctttgtcagtttgtccctgct

SEQ ID NO: 368767 - DNA, 25 bp, Mus musculus
tcttcttttgccaggctgagctgga

SEQ ID NO: 368768 - DNA, 25 bp, Mus musculus
tcttctttttagggacaggggcaga

SEQ ID NO: 368769 - DNA, 25 bp, Mus musculus
tcttctttttaggtcccgcctggca

SEQ ID NO: 368770 - DNA, 25 bp, Mus musculus
tcttctttttaggtgaggagttcta

SEQ ID NO: 368771 - DNA, 25 bp, Mus musculus
tcttgaaaatgtggagtgtgacaat

SEQ ID NO: 368772 - DNA, 25 bp, Mus musculus
tcttgaaagtccgctacgtgaaaaa

SEQ ID NO: 368773 - DNA, 25 bp, Mus musculus
tcttgaaagtgcaggaaaggaagtt

SEQ ID NO: 368774 - DNA, 25 bp, Mus musculus
tcttgaaccaccaggcctcagctgc

SEQ ID NO: 368775 - DNA, 25 bp, Mus musculus
tcttgaaccagcagggtggcccacg

SEQ ID NO: 368776 - DNA, 25 bp, Mus musculus
tcttgaactctccagagtgctacaa

SEQ ID NO: 368777 - DNA, 25 bp, Mus musculus
tcttgaacttgaagctggttcatgt

SEQ ID NO: 368778 - DNA, 25 bp, Mus musculus
tcttgaacttgaggacccaagtttc

SEQ ID NO: 368779 - DNA, 25 bp, Mus musculus
tcttgaactttaagaaaagatgtgg

SEQ ID NO: 368780 - DNA, 25 bp, Mus musculus
tcttgaactttgcaaattgaagaat

SEQ ID NO: 368781 - DNA, 25 bp, Mus musculus
tcttgaagaagtaaccctcctcccc

SEQ ID NO: 368782 - DNA, 25 bp, Mus musculus
tcttgaagaagtttcctgtggccaa

SEQ ID NO: 368783 - DNA, 25 bp, Mus musculus
tcttgaagcaggtggactcccctaa

SEQ ID NO: 368784 - DNA, 25 bp, Mus musculus
tcttgaaggagatggattctgatgc

SEQ ID NO: 368785 - DNA, 25 bp, Mus musculus
tcttgaaggcaacagaatgaaggga

SEQ ID NO: 368786 - DNA, 25 bp, Mus musculus
tcttgaaggcaacagtgaagggacc

SEQ ID NO: 368787 - DNA, 25 bp, Mus musculus
tcttgaataggtattgataaatgga

SEQ ID NO: 368788 - DNA, 25 bp, Mus musculus
tcttgacaagacagaggagggcgcg

SEQ ID NO: 368789 - DNA, 25 bp, Mus musculus
tcttgacaccaggaacctatgggct

SEQ ID NO: 368790 - DNA, 25 bp, Mus musculus
tcttgacaccaggctgaccttcttc

SEQ ID NO: 368791 - DNA, 25 bp, Mus musculus
tcttgacataagtgaacctagtaac

SEQ ID NO: 368792 - DNA, 25 bp, Mus musculus
tcttgaccaagttccaggaagacag

SEQ ID NO: 368793 - DNA, 25 bp, Mus musculus
tcttgaccggatccgctccctgccg

SEQ ID NO: 368794 - DNA, 25 bp, Mus musculus
tcttgaccgggcttctcagagtggc

SEQ ID NO: 368795 - DNA, 25 bp, Mus musculus
tcttgacctgactggcaccctcagg

SEQ ID NO: 368796 - DNA, 25 bp, Mus musculus
tcttgacctgactggtcacagtaat

SEQ ID NO: 368797 - DNA, 25 bp, Mus musculus
tcttgacctgactggtcttaagttt

SEQ ID NO: 368798 - DNA, 25 bp, Mus musculus
tcttgacctggaagggaacatgccg

SEQ ID NO: 368799 - DNA, 25 bp, Mus musculus
tcttgactcgagaagtcgtcacatt

SEQ ID NO: 368800 - DNA, 25 bp, Mus musculus
tcttgactcggaggaagacgatgat

SEQ ID NO: 368801 - DNA, 25 bp, Mus musculus
tcttgactcggtggacaccatgatt

SEQ ID NO: 368802 - DNA, 25 bp, Mus musculus
tcttgacttacaaatcaggagtata

SEQ ID NO: 368803 - DNA, 25 bp, Mus musculus
tcttgactttcacacaatcagggca

SEQ ID NO: 368804 - DNA, 25 bp, Mus musculus
tcttgagaacaccaaattccggggt

SEQ ID NO: 368805 - DNA, 25 bp, Mus musculus
tcttgagaccagcaggtttctggac

SEQ ID NO: 368806 - DNA, 25 bp, Mus musculus
tcttgagatgaatagcccagccaag

SEQ ID NO: 368807 - DNA, 25 bp, Mus musculus
tcttgagattactggagtgctgaca

SEQ ID NO: 368808 - DNA, 25 bp, Mus musculus
tcttgagattggcgtttcagtgaac

SEQ ID NO: 368809 - DNA, 25 bp, Mus musculus
tcttgagccagcccatacccagcca

SEQ ID NO: 368810 - DNA, 25 bp, Mus musculus
tcttgagggaggccttaaccatggc

SEQ ID NO: 368811 - DNA, 25 bp, Mus musculus
tcttgagtatatgggaagtactgga

SEQ ID NO: 368812 - DNA, 25 bp, Mus musculus
tcttgagtatatggggcagagcccg

SEQ ID NO: 368813 - DNA, 25 bp, Mus musculus
tcttgagtcaagagaatcggctatc

SEQ ID NO: 368814 - DNA, 25 bp, Mus musculus
tcttgagtcaagagatcaggacttc

SEQ ID NO: 368815 - DNA, 25 bp, Mus musculus
tcttgagtcaagagatgaagccacc

SEQ ID NO: 368816 - DNA, 25 bp, Mus musculus
tcttgagtgagccctgaatctgtgg

SEQ ID NO: 368817 - DNA, 25 bp, Mus musculus
tcttgagtgagggtatcctgtcttg

SEQ ID NO: 368818 - DNA, 25 bp, Mus musculus
tcttgagtttgacagtgtcattcag

SEQ ID NO: 368819 - DNA, 25 bp, Mus musculus
tcttgataaaagtgaatttcctact

SEQ ID NO: 368820 - DNA, 25 bp, Mus musculus
tcttgataggatctgcttaaatggc

SEQ ID NO: 368821 - DNA, 25 bp, Mus musculus
tcttgatagtgatctttccagaaca

SEQ ID NO: 368822 - DNA, 25 bp, Mus musculus
tcttgatcagcaagccccgcccaac

SEQ ID NO: 368823 - DNA, 25 bp, Mus musculus
tcttgatcatcccagcctatgggaa

SEQ ID NO: 368824 - DNA, 25 bp, Mus musculus
tcttgatctaggccttcctatagat

SEQ ID NO: 368825 - DNA, 25 bp, Mus musculus
tcttgatgagacctctttgacaata

SEQ ID NO: 368826 - DNA, 25 bp, Mus musculus
tcttgatgagggtccaccaaaatac

SEQ ID NO: 368827 - DNA, 25 bp, Mus musculus
tcttgattgttgaagatataattga

SEQ ID NO: 368828 - DNA, 25 bp, Mus musculus
tcttgatttggggttcccagcagtg

SEQ ID NO: 368829 - DNA, 25 bp, Mus musculus
tcttgcaaaaagacacacctgcaaa

SEQ ID NO: 368830 - DNA, 25 bp, Mus musculus
tcttgcaaaaagaggtctccaaggt

SEQ ID NO: 368831 - DNA, 25 bp, Mus musculus
tcttgcaaagatcactggagattgc

SEQ ID NO: 368832 - DNA, 25 bp, Mus musculus
tcttgcaaaggtgacccttaccctg

SEQ ID NO: 368833 - DNA, 25 bp, Mus musculus
tcttgcaaatttgatgcattcttca

SEQ ID NO: 368834 - DNA, 25 bp, Mus musculus
tcttgcaactccatctcggaagaaa

SEQ ID NO: 368835 - DNA, 25 bp, Mus musculus
tcttgcaactgaatctgcctgtaaa

SEQ ID NO: 368836 - DNA, 25 bp, Mus musculus
tcttgcaagaattgagagacatctc

SEQ ID NO: 368837 - DNA, 25 bp, Mus musculus
tcttgcacttccagatctctgacat

SEQ ID NO: 368838 - DNA, 25 bp, Mus musculus
tcttgcagaagaacatgtttgggat

SEQ ID NO: 368839 - DNA, 25 bp, Mus musculus
tcttgcagaagagtcaggagctgct

SEQ ID NO: 368840 - DNA, 25 bp, Mus musculus
tcttgcagcaggtctgctttgcctt

SEQ ID NO: 368841 - DNA, 25 bp, Mus musculus
tcttgcagccactgggttgccaaga

SEQ ID NO: 368842 - DNA, 25 bp, Mus musculus
tcttgcagctcaaatgtccccagca

SEQ ID NO: 368843 - DNA, 25 bp, Mus musculus
tcttgcagctgtctagcccatgcca

SEQ ID NO: 368844 - DNA, 25 bp, Mus musculus
tcttgcagcttcatgagtttaaatt

SEQ ID NO: 368845 - DNA, 25 bp, Mus musculus
tcttgcaggcctggagataaagttc

SEQ ID NO: 368846 - DNA, 25 bp, Mus musculus
tcttgcagttctcaggaggggtcat

SEQ ID NO: 368847 - DNA, 25 bp, Mus musculus
tcttgcatggggatgatgactcttc

SEQ ID NO: 368848 - DNA, 25 bp, Mus musculus
tcttgccaaggtgattcctcctaag

SEQ ID NO: 368849 - DNA, 25 bp, Mus musculus
tcttgccatgcttccaccactgccg

SEQ ID NO: 368850 - DNA, 25 bp, Mus musculus
tcttgcccgctggacagttgctgtg

SEQ ID NO: 368851 - DNA, 25 bp, Mus musculus
tcttgcctcagtgacatcaggctgt

SEQ ID NO: 368852 - DNA, 25 bp, Mus musculus
tcttgcctgcaggaagcaccatggc

SEQ ID NO: 368853 - DNA, 25 bp, Mus musculus
tcttgcctgcagttccgtttccccc

SEQ ID NO: 368854 - DNA, 25 bp, Mus musculus
tcttgcctggacctcctcccatctc

SEQ ID NO: 368855 - DNA, 25 bp, Mus musculus
tcttgcctggtggaaagacagctgg

SEQ ID NO: 368856 - DNA, 25 bp, Mus musculus
tcttgcctggtggaagctccatggt

SEQ ID NO: 368857 - DNA, 25 bp, Mus musculus
tcttgcgcgcagctggggtcatgat

SEQ ID NO: 368858 - DNA, 25 bp, Mus musculus
tcttgcgtttcagagggcccatagc

SEQ ID NO: 368859 - DNA, 25 bp, Mus musculus
tcttgctaacaacaacacctcgtcc

SEQ ID NO: 368860 - DNA, 25 bp, Mus musculus
tcttgctaatgaagcaagtgtggag

SEQ ID NO: 368861 - DNA, 25 bp, Mus musculus
tcttgctacctcagtctcacggatg

SEQ ID NO: 368862 - DNA, 25 bp, Mus musculus
tcttgctacctgcagggctgaccag

SEQ ID NO: 368863 - DNA, 25 bp, Mus musculus
tcttgctactgcaggggagccctat

SEQ ID NO: 368864 - DNA, 25 bp, Mus musculus
tcttgctagcagcaatcatctgggg

SEQ ID NO: 368865 - DNA, 25 bp, Mus musculus
tcttgctcagccacagaacatccag

SEQ ID NO: 368866 - DNA, 25 bp, Mus musculus
tcttgctcagggtcctcttaaaagc

SEQ ID NO: 368867 - DNA, 25 bp, Mus musculus
tcttgctcctgcactggtgcaggac

SEQ ID NO: 368868 - DNA, 25 bp, Mus musculus
tcttgctgactacatttcctcggcc

SEQ ID NO: 368869 - DNA, 25 bp, Mus musculus
tcttgctgaggaacatggttggtgc

SEQ ID NO: 368870 - DNA, 25 bp, Mus musculus
tcttgctggacgaggtgccagtcat

SEQ ID NO: 368871 - DNA, 25 bp, Mus musculus
tcttgctggtggaaggaggcaggat

SEQ ID NO: 368872 - DNA, 25 bp, Mus musculus
tcttgctgttactataaagctctga

SEQ ID NO: 368873 - DNA, 25 bp, Mus musculus
tcttgctgttactattgacaccgat

SEQ ID NO: 368874 - DNA, 25 bp, Mus musculus
tcttgcttagatggcaggttcagcg

SEQ ID NO: 368875 - DNA, 25 bp, Mus musculus
tcttgcttagcctcaaagagttgct

SEQ ID NO: 368876 - DNA, 25 bp, Mus musculus
tcttgcttcgaagccagacacacct

SEQ ID NO: 368877 - DNA, 25 bp, Mus musculus
tcttgcttctgaaacctcaggtgga

SEQ ID NO: 368878 - DNA, 25 bp, Mus musculus
tcttgctttgacacgagatgacata

SEQ ID NO: 368879 - DNA, 25 bp, Mus musculus
tcttgctttggtgggcagtcctggc

SEQ ID NO: 368880 - DNA, 25 bp, Mus musculus
tcttggaaccctaagctgggctctc

SEQ ID NO: 368881 - DNA, 25 bp, Mus musculus
tcttggaagaatggcatctagtgct

SEQ ID NO: 368882 - DNA, 25 bp, Mus musculus
tcttggaagaggccctgggcttctc

SEQ ID NO: 368883 - DNA, 25 bp, Mus musculus
tcttggaatacagtgccgtgatgtg

SEQ ID NO: 368884 - DNA, 25 bp, Mus musculus
tcttggaatttatggtacaggaaaa

SEQ ID NO: 368885 - DNA, 25 bp, Mus musculus
tcttggacagcaagggccatgtgaa

SEQ ID NO: 368886 - DNA, 25 bp, Mus musculus
tcttggacagtgagcctcgaggtct

SEQ ID NO: 368887 - DNA, 25 bp, Mus musculus
tcttggaccacgctatggttttgga

SEQ ID NO: 368888 - DNA, 25 bp, Mus musculus
tcttggacctcagagatgaggagtt

SEQ ID NO: 368889 - DNA, 25 bp, Mus musculus
tcttggacggacagaatacaccatc

SEQ ID NO: 368890 - DNA, 25 bp, Mus musculus
tcttggacggcttgactaaaataca

SEQ ID NO: 368891 - DNA, 25 bp, Mus musculus
tcttggacggcttgatgaggtctcc

SEQ ID NO: 368892 - DNA, 25 bp, Mus musculus
tcttggacggcttgatgagtaagaa

SEQ ID NO: 368893 - DNA, 25 bp, Mus musculus
tcttggacggcttggggatccagca

SEQ ID NO: 368894 - DNA, 25 bp, Mus musculus
tcttggactgccagggtcacgtggt

SEQ ID NO: 368895 - DNA, 25 bp, Mus musculus
tcttggactgccagtacttggctcc

SEQ ID NO: 368896 - DNA, 25 bp, Mus musculus
tcttggacttcagccctagtctgaa

SEQ ID NO: 368897 - DNA, 25 bp, Mus musculus
tcttggagaaaatcttggaccttcc

SEQ ID NO: 368898 - DNA, 25 bp, Mus musculus
tcttggagaggtaaccccaggtgac

SEQ ID NO: 368899 - DNA, 25 bp, Mus musculus
tcttggagctgtcaaggccctgtgg

SEQ ID NO: 368900 - DNA, 25 bp, Mus musculus
tcttggaggctgcaaaagacatttg

SEQ ID NO: 368901 - DNA, 25 bp, Mus musculus
tcttggagtcaggggaaatgagcat

SEQ ID NO: 368902 - DNA, 25 bp, Mus musculus
tcttggagtcaggggtcactaggat

SEQ ID NO: 368903 - DNA, 25 bp, Mus musculus
tcttggataatagaatgacagcagc

SEQ ID NO: 368904 - DNA, 25 bp, Mus musculus
tcttggatcggatgaagaagataag

SEQ ID NO: 368905 - DNA, 25 bp, Mus musculus
tcttggattcagtttctttagaatg

SEQ ID NO: 368906 - DNA, 25 bp, Mus musculus
tcttggattcgctggttggtgggga

SEQ ID NO: 368907 - DNA, 25 bp, Mus musculus
tcttggcacctgaggacaaagtctg

SEQ ID NO: 368908 - DNA, 25 bp, Mus musculus
tcttggcattataaaccgtgtcagc

SEQ ID NO: 368909 - DNA, 25 bp, Mus musculus
tcttggcattatgtgccctccgttt

SEQ ID NO: 368910 - DNA, 25 bp, Mus musculus
tcttggccaaatgtaccgtctaacc

SEQ ID NO: 368911 - DNA, 25 bp, Mus musculus
tcttggccaacaagagtcctcgttg

SEQ ID NO: 368912 - DNA, 25 bp, Mus musculus
tcttggccaacaagagtgatctgtc

SEQ ID NO: 368913 - DNA, 25 bp, Mus musculus
tcttggccactgatagtgcctttga

SEQ ID NO: 368914 - DNA, 25 bp, Mus musculus
tcttggccctggtggatcagaacaa

SEQ ID NO: 368915 - DNA, 25 bp, Mus musculus
tcttggcgcgatgaggaaactgagg

SEQ ID NO: 368916 - DNA, 25 bp, Mus musculus
tcttggcgttatgggtgtgataggt

SEQ ID NO: 368917 - DNA, 25 bp, Mus musculus
tcttggcgttatgtttgagatggta

SEQ ID NO: 368918 - DNA, 25 bp, Mus musculus
tcttggctataaaaaatgccaggca

SEQ ID NO: 368919 - DNA, 25 bp, Mus musculus
tcttggctcagaaatcctacgaaca

SEQ ID NO: 368920 - DNA, 25 bp, Mus musculus
tcttggctctgaagattgccctcta

SEQ ID NO: 368921 - DNA, 25 bp, Mus musculus
tcttggctggtggctaccaaggact

SEQ ID NO: 368922 - DNA, 25 bp, Mus musculus
tcttgggaaaagactgtaatgaaac

SEQ ID NO: 368923 - DNA, 25 bp, Mus musculus
tcttgggaacttcagacccagccac

SEQ ID NO: 368924 - DNA, 25 bp, Mus musculus
tcttgggaagaaagacgatgctcaa

SEQ ID NO: 368925 - DNA, 25 bp, Mus musculus
tcttgggaagagacaaagacatctt

SEQ ID NO: 368926 - DNA, 25 bp, Mus musculus
tcttgggaataggccctttggagac

SEQ ID NO: 368927 - DNA, 25 bp, Mus musculus
tcttgggacaaaacgcaccctacct

SEQ ID NO: 368928 - DNA, 25 bp, Mus musculus
tcttgggagaagtatgcttccactg

SEQ ID NO: 368929 - DNA, 25 bp, Mus musculus
tcttgggagaagtttcttctagtat

SEQ ID NO: 368930 - DNA, 25 bp, Mus musculus
tcttgggagagcgcattaaagagga

SEQ ID NO: 368931 - DNA, 25 bp, Mus musculus
tcttgggagaggaagaagaaaggac

SEQ ID NO: 368932 - DNA, 25 bp, Mus musculus
tcttgggaggaggcttgaagatgca

SEQ ID NO: 368933 - DNA, 25 bp, Mus musculus
tcttgggccagagagctgggtttga

SEQ ID NO: 368934 - DNA, 25 bp, Mus musculus
tcttgggcctgggcccatacccact

SEQ ID NO: 368935 - DNA, 25 bp, Mus musculus
tcttgggcctttgttcaagcacaca

SEQ ID NO: 368936 - DNA, 25 bp, Mus musculus
tcttgggctatggagctggtgctgt

SEQ ID NO: 368937 - DNA, 25 bp, Mus musculus
tcttgggctatggagtcccaacagg

SEQ ID NO: 368938 - DNA, 25 bp, Mus musculus
tcttgggcttttcaggtcacctagc

SEQ ID NO: 368939 - DNA, 25 bp, Mus musculus
tcttggggatatggtgaacttgacc

SEQ ID NO: 368940 - DNA, 25 bp, Mus musculus
tcttggggatatggttgcctgtaat

SEQ ID NO: 368941 - DNA, 25 bp, Mus musculus
tcttgggttcaagatcttggcaacc

SEQ ID NO: 368942 - DNA, 25 bp, Mus musculus
tcttggtactgcatagtgggacacc

SEQ ID NO: 368943 - DNA, 25 bp, Mus musculus
tcttggtactggtgaacaccatgtc

SEQ ID NO: 368944 - DNA, 25 bp, Mus musculus
tcttggtcaagaactgtactcttga

SEQ ID NO: 368945 - DNA, 25 bp, Mus musculus
tcttggtcaaggtacaactgtaact

SEQ ID NO: 368946 - DNA, 25 bp, Mus musculus
tcttggtcacacagggctcgcttgc

SEQ ID NO: 368947 - DNA, 25 bp, Mus musculus
tcttggtcagaagaagcgcacgttg

SEQ ID NO: 368948 - DNA, 25 bp, Mus musculus
tcttggtccaggatctttctcaagt

SEQ ID NO: 368949 - DNA, 25 bp, Mus musculus
tcttggtccaggtcatcccagtggt

SEQ ID NO: 368950 - DNA, 25 bp, Mus musculus
tcttggtccttgaggatttcaaaca

SEQ ID NO: 368951 - DNA, 25 bp, Mus musculus
tcttggtccttgttccaccctccaa

SEQ ID NO: 368952 - DNA, 25 bp, Mus musculus
tcttggtctccgaggagtatgtctc

SEQ ID NO: 368953 - DNA, 25 bp, Mus musculus
tcttggtgaataagtacaacaaagc

SEQ ID NO: 368954 - DNA, 25 bp, Mus musculus
tcttggtgacaaggtgaattccctt

SEQ ID NO: 368955 - DNA, 25 bp, Mus musculus
tcttggtgcagggtttgtggtagtg

SEQ ID NO: 368956 - DNA, 25 bp, Mus musculus
tcttggtggtgtgtcggagctccaa

SEQ ID NO: 368957 - DNA, 25 bp, Mus musculus
tcttggtgtggacacttcccgagtg

SEQ ID NO: 368958 - DNA, 25 bp, Mus musculus
tcttggtgtggatggtgcctgcagg

SEQ ID NO: 368959 - DNA, 25 bp, Mus musculus
tcttggtgtgggacgcccctaaagg

SEQ ID NO: 368960 - DNA, 25 bp, Mus musculus
tcttggttgttcaagttataggtaa

SEQ ID NO: 368961 - DNA, 25 bp, Mus musculus
tcttgtaaaatcagaggtccggacc

SEQ ID NO: 368962 - DNA, 25 bp, Mus musculus
tcttgtaattcaggtgagcacctcc

SEQ ID NO: 368963 - DNA, 25 bp, Mus musculus
tcttgtaccagagaactgaaaagct

SEQ ID NO: 368964 - DNA, 25 bp, Mus musculus
tcttgtactcagccagaagcacccc

SEQ ID NO: 368965 - DNA, 25 bp, Mus musculus
tcttgtatacttagacaaaagtcct

SEQ ID NO: 368966 - DNA, 25 bp, Mus musculus
tcttgtatgctagttcactttaatt

SEQ ID NO: 368967 - DNA, 25 bp, Mus musculus
tcttgtcaataaggtaatgttagca

SEQ ID NO: 368968 - DNA, 25 bp, Mus musculus
tcttgtcacaggtggtgagattgcc

SEQ ID NO: 368969 - DNA, 25 bp, Mus musculus
tcttgtcataaaaatatgacagata

SEQ ID NO: 368970 - DNA, 25 bp, Mus musculus
tcttgtcccccacgtgccccgagcc

SEQ ID NO: 368971 - DNA, 25 bp, Mus musculus
tcttgtcctgtaaggtggtctgtga

SEQ ID NO: 368972 - DNA, 25 bp, Mus musculus
tcttgtcgtgacctctaaatgtggt

SEQ ID NO: 368973 - DNA, 25 bp, Mus musculus
tcttgtcgtggtcagaatttcaaag

SEQ ID NO: 368974 - DNA, 25 bp, Mus musculus
tcttgtctgaagcgaaggtgtccga

SEQ ID NO: 368975 - DNA, 25 bp, Mus musculus
tcttgtctggggcttcaatgggggc

SEQ ID NO: 368976 - DNA, 25 bp, Mus musculus
tcttgtgagagggtctgcatttgct

SEQ ID NO: 368977 - DNA, 25 bp, Mus musculus
tcttgtgcaaactgggatggatcta

SEQ ID NO: 368978 - DNA, 25 bp, Mus musculus
tcttgtggaaacagcactcatgaac

SEQ ID NO: 368979 - DNA, 25 bp, Mus musculus
tcttgtggaagtgcggcttcttcaa

SEQ ID NO: 368980 - DNA, 25 bp, Mus musculus
tcttgtggaagtgtgacttctttaa

SEQ ID NO: 368981 - DNA, 25 bp, Mus musculus
tcttgtggatggcttcaagccaggt

SEQ ID NO: 368982 - DNA, 25 bp, Mus musculus
tcttgtggccctattgtgtgcccag

SEQ ID NO: 368983 - DNA, 25 bp, Mus musculus
tcttgtggggatctacttcaccggc

SEQ ID NO: 368984 - DNA, 25 bp, Mus musculus
tcttgtgggggtcttctgggtagga

SEQ ID NO: 368985 - DNA, 25 bp, Mus musculus
tcttgtggtgctagacctgaactat

SEQ ID NO: 368986 - DNA, 25 bp, Mus musculus
tcttgtggtgctgcatctacataac

SEQ ID NO: 368987 - DNA, 25 bp, Mus musculus
tcttgtgtatatgctgtagaaaacc

SEQ ID NO: 368988 - DNA, 25 bp, Mus musculus
tcttgttacacaggttacaaccctg

SEQ ID NO: 368989 - DNA, 25 bp, Mus musculus
tcttgttacaggaagaacccccagc

SEQ ID NO: 368990 - DNA, 25 bp, Mus musculus
tcttgttcaaaggaaatgccaccat

SEQ ID NO: 368991 - DNA, 25 bp, Mus musculus
tcttgttcaaagggaagtggctgac

SEQ ID NO: 368992 - DNA, 25 bp, Mus musculus
tcttgttgatgcaaatgtgctagtt

SEQ ID NO: 368993 - DNA, 25 bp, Mus musculus
tcttgttgcccagctggcatttttc

SEQ ID NO: 368994 - DNA, 25 bp, Mus musculus
tcttgttgttcaggtttatcatggc

SEQ ID NO: 368995 - DNA, 25 bp, Mus musculus
tcttgtttcaggaaatggctgcagt

SEQ ID NO: 368996 - DNA, 25 bp, Mus musculus
tcttgtttcaggacttcctccatca

SEQ ID NO: 368997 - DNA, 25 bp, Mus musculus
tcttgtttctgactctaaaacaaca

SEQ ID NO: 368998 - DNA, 25 bp, Mus musculus
tcttgtttctggatccttgacactg

SEQ ID NO: 368999 - DNA, 25 bp, Mus musculus
tcttgtttgccagaatggaggatag

SEQ ID NO: 369000 - DNA, 25 bp, Mus musculus
tcttgttttaaatggggctctctaa

SEQ ID NO: 369001 - DNA, 25 bp, Mus musculus
tcttgttttacagatggctcattgc

SEQ ID NO: 369002 - DNA, 25 bp, Mus musculus
tcttgttttacaggtgtgtgtggtt

SEQ ID NO: 369003 - DNA, 25 bp, Mus musculus
tctttaaaaaagccgagctggaatt

SEQ ID NO: 369004 - DNA, 25 bp, Mus musculus
tctttaaaagatgttcctcctgcgg

SEQ ID NO: 369005 - DNA, 25 bp, Mus musculus
tctttaaaaggtgaggcatgaaatt

SEQ ID NO: 369006 - DNA, 25 bp, Mus musculus
tctttaaatatatttactggctcca

SEQ ID NO: 369007 - DNA, 25 bp, Mus musculus
tctttaaatgacaacaattgacata

SEQ ID NO: 369008 - DNA, 25 bp, Mus musculus
tctttaaatgtacagtctaaatcca

SEQ ID NO: 369009 - DNA, 25 bp, Mus musculus
tctttaacaaggtaaataagctgaa

SEQ ID NO: 369010 - DNA, 25 bp, Mus musculus
tctttaactaccaagcatctatatt

SEQ ID NO: 369011 - DNA, 25 bp, Mus musculus
tctttaagaaaagcagccactggag

SEQ ID NO: 369012 - DNA, 25 bp, Mus musculus
tctttaagaaagctggacctgggct

SEQ ID NO: 369013 - DNA, 25 bp, Mus musculus
tctttaagaacaaggacaacatcca

SEQ ID NO: 369014 - DNA, 25 bp, Mus musculus
tctttaagaacaagtactgaaagtg

SEQ ID NO: 369015 - DNA, 25 bp, Mus musculus
tctttaagaagacagagcacactcc

SEQ ID NO: 369016 - DNA, 25 bp, Mus musculus
tctttaagaagggctctgctaaggc

SEQ ID NO: 369017 - DNA, 25 bp, Mus musculus
tctttaagaagtttgatgaaggccg

SEQ ID NO: 369018 - DNA, 25 bp, Mus musculus
tctttaagctgggaggaagagacag

SEQ ID NO: 369019 - DNA, 25 bp, Mus musculus
tctttaatgatccggaccttcgaga

SEQ ID NO: 369020 - DNA, 25 bp, Mus musculus
tctttaattgctacctcaggctctg

SEQ ID NO: 369021 - DNA, 25 bp, Mus musculus
tctttacaaggattttcaccttgta

SEQ ID NO: 369022 - DNA, 25 bp, Mus musculus
tctttacagcaaatgcaacaaatga

SEQ ID NO: 369023 - DNA, 25 bp, Mus musculus
tctttacagcaagccttttctgatt

SEQ ID NO: 369024 - DNA, 25 bp, Mus musculus
tctttaccaaggagctggagaaggt

SEQ ID NO: 369025 - DNA, 25 bp, Mus musculus
tctttaccaggtatgactacgagga

SEQ ID NO: 369026 - DNA, 25 bp, Mus musculus
tctttaccagtaaccaggtgactga

SEQ ID NO: 369027 - DNA, 25 bp, Mus musculus
tctttacccacgtttttgcagcttc

SEQ ID NO: 369028 - DNA, 25 bp, Mus musculus
tctttacccagcctccatagactcg

SEQ ID NO: 369029 - DNA, 25 bp, Mus musculus
tctttacctacaactgctgcttgta

SEQ ID NO: 369030 - DNA, 25 bp, Mus musculus
tctttacgttactggttgcttctat

SEQ ID NO: 369031 - DNA, 25 bp, Mus musculus
tctttactatgcggagcaactgaag

SEQ ID NO: 369032 - DNA, 25 bp, Mus musculus
tctttactatgctgagcagattaag

SEQ ID NO: 369033 - DNA, 25 bp, Mus musculus
tctttactctcagatagcctttcat

SEQ ID NO: 369034 - DNA, 25 bp, Mus musculus
tctttactgaatataagtaccatat

SEQ ID NO: 369035 - DNA, 25 bp, Mus musculus
tctttagaaagaagcatgtctgctg

SEQ ID NO: 369036 - DNA, 25 bp, Mus musculus
tctttagaagaagtgctctggatgt

SEQ ID NO: 369037 - DNA, 25 bp, Mus musculus
tctttagagatggtgaagaatttaa

SEQ ID NO: 369038 - DNA, 25 bp, Mus musculus
tctttagagcaggtttaaacgcatc

SEQ ID NO: 369039 - DNA, 25 bp, Mus musculus
tctttagagttttggtcccagcaac

SEQ ID NO: 369040 - DNA, 25 bp, Mus musculus
tctttagattgtcccagttgtgaca

SEQ ID NO: 369041 - DNA, 25 bp, Mus musculus
tctttagcaactggagcactaaagc

SEQ ID NO: 369042 - DNA, 25 bp, Mus musculus
tctttagcaagagcagtatataaag

SEQ ID NO: 369043 - DNA, 25 bp, Mus musculus
tctttaggcacaaggatactgagaa

SEQ ID NO: 369044 - DNA, 25 bp, Mus musculus
tctttagtcccgatcatccaggttt

SEQ ID NO: 369045 - DNA, 25 bp, Mus musculus
tctttataaaaatctgctgtatctt

SEQ ID NO: 369046 - DNA, 25 bp, Mus musculus
tctttatatcttaaaagatgtgatg

SEQ ID NO: 369047 - DNA, 25 bp, Mus musculus
tctttatcacccaaggttcagacaa

SEQ ID NO: 369048 - DNA, 25 bp, Mus musculus
tctttatcagcaatgctggtggtga

SEQ ID NO: 369049 - DNA, 25 bp, Mus musculus
tctttatcctctctggcctctctct

SEQ ID NO: 369050 - DNA, 25 bp, Mus musculus
tctttatctcaaattctggaattga

SEQ ID NO: 369051 - DNA, 25 bp, Mus musculus
tctttatctcacacgccggtggaca

SEQ ID NO: 369052 - DNA, 25 bp, Mus musculus
tctttatgggaagaattgcggcgag

SEQ ID NO: 369053 - DNA, 25 bp, Mus musculus
tctttatgtctgagggtttggaaat

SEQ ID NO: 369054 - DNA, 25 bp, Mus musculus
tctttatgtctgaggtatctcattt

SEQ ID NO: 369055 - DNA, 25 bp, Mus musculus
tctttattaagcatgtgaagtacaa

SEQ ID NO: 369056 - DNA, 25 bp, Mus musculus
tctttattaagtacaaatcgaagtc

SEQ ID NO: 369057 - DNA, 25 bp, Mus musculus
tctttattaccaagatgaaccccca

SEQ ID NO: 369058 - DNA, 25 bp, Mus musculus
tctttattaccaagcataccacaaa

SEQ ID NO: 369059 - DNA, 25 bp, Mus musculus
tctttattaccaaggtgctatatct

SEQ ID NO: 369060 - DNA, 25 bp, Mus musculus
tctttattagatgatgcagtccctc

SEQ ID NO: 369061 - DNA, 25 bp, Mus musculus
tctttattcagaagtaccgggcttt

SEQ ID NO: 369062 - DNA, 25 bp, Mus musculus
tctttattctgtcaaccacagaagc

SEQ ID NO: 369063 - DNA, 25 bp, Mus musculus
tctttatttgagtgcagcagctgcc

SEQ ID NO: 369064 - DNA, 25 bp, Mus musculus
tctttcaacgccaaccactctgaag

SEQ ID NO: 369065 - DNA, 25 bp, Mus musculus
tctttcaacttcagagctgtgcctg

SEQ ID NO: 369066 - DNA, 25 bp, Mus musculus
tctttcaacttcaggagcctttgga

SEQ ID NO: 369067 - DNA, 25 bp, Mus musculus
tctttcaagccgtaattgctggctt

SEQ ID NO: 369068 - DNA, 25 bp, Mus musculus
tctttcacaagaggctccataggaa

SEQ ID NO: 369069 - DNA, 25 bp, Mus musculus
tctttcaccaccatcatttttgatg

SEQ ID NO: 369070 - DNA, 25 bp, Mus musculus
tctttcagaagttctatgcaagaat

SEQ ID NO: 369071 - DNA, 25 bp, Mus musculus
tctttcagagtgcttctacttctca

SEQ ID NO: 369072 - DNA, 25 bp, Mus musculus
tctttcagatgagggaaagcactgc

SEQ ID NO: 369073 - DNA, 25 bp, Mus musculus
tctttcagatggtgatatacatggg

SEQ ID NO: 369074 - DNA, 25 bp, Mus musculus
tctttcagcatagtctccattcaga

SEQ ID NO: 369075 - DNA, 25 bp, Mus musculus
tctttcagcttggtgctgttaaagg

SEQ ID NO: 369076 - DNA, 25 bp, Mus musculus
tctttcaggtattcatgtgatggaa

SEQ ID NO: 369077 - DNA, 25 bp, Mus musculus
tctttcatagatgaagcccgaggca

SEQ ID NO: 369078 - DNA, 25 bp, Mus musculus
tctttcatagccggaaccctctgca

SEQ ID NO: 369079 - DNA, 25 bp, Mus musculus
tctttcatagcgattttgataaagt

SEQ ID NO: 369080 - DNA, 25 bp, Mus musculus
tctttcataggcggaaccctctgca

SEQ ID NO: 369081 - DNA, 25 bp, Mus musculus
tctttcatagggattttgataaagt

SEQ ID NO: 369082 - DNA, 25 bp, Mus musculus
tctttcatctcagatgtggtgaacg

SEQ ID NO: 369083 - DNA, 25 bp, Mus musculus
tctttccaaaagcaactgctttgct

SEQ ID NO: 369084 - DNA, 25 bp, Mus musculus
tctttccaaaagctcctgggacctg

SEQ ID NO: 369085 - DNA, 25 bp, Mus musculus
tctttccaaatggacctgaggtgca

SEQ ID NO: 369086 - DNA, 25 bp, Mus musculus
tctttccaacaaagcctacacaggt

SEQ ID NO: 369087 - DNA, 25 bp, Mus musculus
tctttccaacaacctgcatcataag

SEQ ID NO: 369088 - DNA, 25 bp, Mus musculus
tctttccaacagagcttaccaaatg

SEQ ID NO: 369089 - DNA, 25 bp, Mus musculus
tctttccattgagttcctccgcaac

SEQ ID NO: 369090 - DNA, 25 bp, Mus musculus
tctttcccaggacgatagccagccc

SEQ ID NO: 369091 - DNA, 25 bp, Mus musculus
tctttcccaggacggctactggcag

SEQ ID NO: 369092 - DNA, 25 bp, Mus musculus
tctttcccgagggagcacgggtctg

SEQ ID NO: 369093 - DNA, 25 bp, Mus musculus
tctttcccgaggtgttcacctacaa

SEQ ID NO: 369094 - DNA, 25 bp, Mus musculus
tctttccctcagagccagcccaggc

SEQ ID NO: 369095 - DNA, 25 bp, Mus musculus
tctttccgaagtctggggctatgga

SEQ ID NO: 369096 - DNA, 25 bp, Mus musculus
tctttcctaaattctctgcccttct

SEQ ID NO: 369097 - DNA, 25 bp, Mus musculus
tctttcctatggatttggccatgga

SEQ ID NO: 369098 - DNA, 25 bp, Mus musculus
tctttcctcgttgtttttgttttgt

SEQ ID NO: 369099 - DNA, 25 bp, Mus musculus
tctttcctctctgacttcctctttg

SEQ ID NO: 369100 - DNA, 25 bp, Mus musculus
tctttcctggaacaggtgacatgta

SEQ ID NO: 369101 - DNA, 25 bp, Mus musculus
tctttcctggagtaggtgacatgta

SEQ ID NO: 369102 - DNA, 25 bp, Mus musculus
tctttccttcggacgctgaacccaa

SEQ ID NO: 369103 - DNA, 25 bp, Mus musculus
tctttcgaaagaaagatcttcctca

SEQ ID NO: 369104 - DNA, 25 bp, Mus musculus
tctttcgaaagaaagctgattcaag

SEQ ID NO: 369105 - DNA, 25 bp, Mus musculus
tctttcgacacgccggagtctgagg

SEQ ID NO: 369106 - DNA, 25 bp, Mus musculus
tctttcgatttgcgatcttctgcct

SEQ ID NO: 369107 - DNA, 25 bp, Mus musculus
tctttcgatttgctttgtccatacg

SEQ ID NO: 369108 - DNA, 25 bp, Mus musculus
tctttcgcttgcaggcctacagggt

SEQ ID NO: 369109 - DNA, 25 bp, Mus musculus
tctttcggctaagaaccaaaaatca

SEQ ID NO: 369110 - DNA, 25 bp, Mus musculus
tctttctaacagagaagaatatcaa

SEQ ID NO: 369111 - DNA, 25 bp, Mus musculus
tctttctatccccaaacaggagact

SEQ ID NO: 369112 - DNA, 25 bp, Mus musculus
tctttctcagattccttgtaatgga

SEQ ID NO: 369113 - DNA, 25 bp, Mus musculus
tctttctcgacctttgaatgataga

SEQ ID NO: 369114 - DNA, 25 bp, Mus musculus
tctttctctagcttttcctatgatg

SEQ ID NO: 369115 - DNA, 25 bp, Mus musculus
tctttctctcagccaaagccttcta

SEQ ID NO: 369116 - DNA, 25 bp, Mus musculus
tctttctctggccctgtatccctgg

SEQ ID NO: 369117 - DNA, 25 bp, Mus musculus
tctttctgagacaccccctgtttgg

SEQ ID NO: 369118 - DNA, 25 bp, Mus musculus
tctttctgagagaaactgcaagaaa

SEQ ID NO: 369119 - DNA, 25 bp, Mus musculus
tctttctgccagcgggtccggagtg

SEQ ID NO: 369120 - DNA, 25 bp, Mus musculus
tctttctgccctgtttcacctttat

SEQ ID NO: 369121 - DNA, 25 bp, Mus musculus
tctttctgcccttgcagaactgggc

SEQ ID NO: 369122 - DNA, 25 bp, Mus musculus
tctttctggacctggctgcaggtcc

SEQ ID NO: 369123 - DNA, 25 bp, Mus musculus
tctttctggtaatccccggcagccc

SEQ ID NO: 369124 - DNA, 25 bp, Mus musculus
tctttctgtgttgatgagaggctgt

SEQ ID NO: 369125 - DNA, 25 bp, Mus musculus
tctttctgtgttgcggttccctcat

SEQ ID NO: 369126 - DNA, 25 bp, Mus musculus
tctttcttattgaatatccagaaga

SEQ ID NO: 369127 - DNA, 25 bp, Mus musculus
tctttcttctggaaccagctattgc

SEQ ID NO: 369128 - DNA, 25 bp, Mus musculus
tctttcttgaccggatccgctccct

SEQ ID NO: 369129 - DNA, 25 bp, Mus musculus
tctttcttgaccgggcttctcagag

SEQ ID NO: 369130 - DNA, 25 bp, Mus musculus
tctttctttgaaggtgacgggccgc

SEQ ID NO: 369131 - DNA, 25 bp, Mus musculus
tctttctttgcagcacacagcacac

SEQ ID NO: 369132 - DNA, 25 bp, Mus musculus
tctttcttttgggagcctcaatggt

SEQ ID NO: 369133 - DNA, 25 bp, Mus musculus
tctttcttttgggagtgagtgtgta

SEQ ID NO: 369134 - DNA, 25 bp, Mus musculus
tctttgaaaaccaggaaaataggtg

SEQ ID NO: 369135 - DNA, 25 bp, Mus musculus
tctttgaaactgaagaaactcggaa

SEQ ID NO: 369136 - DNA, 25 bp, Mus musculus
tctttgaaagaagcagttccgaggc

SEQ ID NO: 369137 - DNA, 25 bp, Mus musculus
tctttgaaatacaagctggcatttt

SEQ ID NO: 369138 - DNA, 25 bp, Mus musculus
tctttgaaatacaaggagcaactgt

SEQ ID NO: 369139 - DNA, 25 bp, Mus musculus
tctttgaaccagaagactttgaaag

SEQ ID NO: 369140 - DNA, 25 bp, Mus musculus
tctttgaaccagaagggctgtcagg

SEQ ID NO: 369141 - DNA, 25 bp, Mus musculus
tctttgaacctttggtcagaaagca

SEQ ID NO: 369142 - DNA, 25 bp, Mus musculus
tctttgaagatgttccctcagccaa

SEQ ID NO: 369143 - DNA, 25 bp, Mus musculus
tctttgacaagcactataagactga

SEQ ID NO: 369144 - DNA, 25 bp, Mus musculus
tctttgacatcactgatgagagtag

SEQ ID NO: 369145 - DNA, 25 bp, Mus musculus
tctttgacatcagtgatgagagtag

SEQ ID NO: 369146 - DNA, 25 bp, Mus musculus
tctttgaccgagaaggagaagagtt

SEQ ID NO: 369147 - DNA, 25 bp, Mus musculus
tctttgaccttgggtgccttccaac

SEQ ID NO: 369148 - DNA, 25 bp, Mus musculus
tctttgactccagctattcacggaa

SEQ ID NO: 369149 - DNA, 25 bp, Mus musculus
tctttgacttgctgaacattgttcc

SEQ ID NO: 369150 - DNA, 25 bp, Mus musculus
tctttgagaatccccggcagcccaa

SEQ ID NO: 369151 - DNA, 25 bp, Mus musculus
tctttgagaggtatatctttgcaaa

SEQ ID NO: 369152 - DNA, 25 bp, Mus musculus
tctttgagcataggtcctgatcact

SEQ ID NO: 369153 - DNA, 25 bp, Mus musculus
tctttgaggacctttactctttgat

SEQ ID NO: 369154 - DNA, 25 bp, Mus musculus
tctttgaggagagaagagaactatg

SEQ ID NO: 369155 - DNA, 25 bp, Mus musculus
tctttgatccagatgccaaggggct

SEQ ID NO: 369156 - DNA, 25 bp, Mus musculus
tctttgatcgggtgctgacagagct

SEQ ID NO: 369157 - DNA, 25 bp, Mus musculus
tctttgatcggtccctctccagggt

SEQ ID NO: 369158 - DNA, 25 bp, Mus musculus
tctttgatgagaagtcccgtgttgc

SEQ ID NO: 369159 - DNA, 25 bp, Mus musculus
tctttgatgagtgcttcctttgcag

SEQ ID NO: 369160 - DNA, 25 bp, Mus musculus
tctttgatgctagagaggaggtggc

SEQ ID NO: 369161 - DNA, 25 bp, Mus musculus
tctttgatgctagagcctcagtctg

SEQ ID NO: 369162 - DNA, 25 bp, Mus musculus
tctttgattccagctactcccgaaa

SEQ ID NO: 369163 - DNA, 25 bp, Mus musculus
tctttgcaaataccggtcaactatt

SEQ ID NO: 369164 - DNA, 25 bp, Mus musculus
tctttgcaaggtattgtcgccttcg

SEQ ID NO: 369165 - DNA, 25 bp, Mus musculus
tctttgcacaagacccacaccatct

SEQ ID NO: 369166 - DNA, 25 bp, Mus musculus
tctttgcacaagggtttctctgtag

SEQ ID NO: 369167 - DNA, 25 bp, Mus musculus
tctttgcactgagcgggaactgagc

SEQ ID NO: 369168 - DNA, 25 bp, Mus musculus
tctttgcatatcagatctgatgttt

SEQ ID NO: 369169 - DNA, 25 bp, Mus musculus
tctttgccagcaagagaatccgggc

SEQ ID NO: 369170 - DNA, 25 bp, Mus musculus
tctttgccatcctcggtttctactt

SEQ ID NO: 369171 - DNA, 25 bp, Mus musculus
tctttgcccattgatttaggtcgct

SEQ ID NO: 369172 - DNA, 25 bp, Mus musculus
tctttgcccggaacacacgccgggc

SEQ ID NO: 369173 - DNA, 25 bp, Mus musculus
tctttgccctcaggcaccgaataaa

SEQ ID NO: 369174 - DNA, 25 bp, Mus musculus
tctttgcctaggttgagaacaaaaa

SEQ ID NO: 369175 - DNA, 25 bp, Mus musculus
tctttgcctgcactggcacacaggc

SEQ ID NO: 369176 - DNA, 25 bp, Mus musculus
tctttgccttccgagatgagacggc

SEQ ID NO: 369177 - DNA, 25 bp, Mus musculus
tctttgccttccgagggcagtactg

SEQ ID NO: 369178 - DNA, 25 bp, Mus musculus
tctttgctgaaatgcacctagtgtg

SEQ ID NO: 369179 - DNA, 25 bp, Mus musculus
tctttgctgaaatggtgacccgcag

SEQ ID NO: 369180 - DNA, 25 bp, Mus musculus
tctttgctgcgattatttgattctg

SEQ ID NO: 369181 - DNA, 25 bp, Mus musculus
tctttgctgcggcttcatagagccc

SEQ ID NO: 369182 - DNA, 25 bp, Mus musculus
tctttgcttgaatgggcctgtgttt

SEQ ID NO: 369183 - DNA, 25 bp, Mus musculus
tctttggaaaaaagctctcttaaga

SEQ ID NO: 369184 - DNA, 25 bp, Mus musculus
tctttggaaaaaagttctaggcaag

SEQ ID NO: 369185 - DNA, 25 bp, Mus musculus
tctttggaaagggacatcatcgaag

SEQ ID NO: 369186 - DNA, 25 bp, Mus musculus
tctttggaacatagacaacatagaa

SEQ ID NO: 369187 - DNA, 25 bp, Mus musculus
tctttggacagagccagtatacagc

SEQ ID NO: 369188 - DNA, 25 bp, Mus musculus
tctttggacctccctccaactcttc

SEQ ID NO: 369189 - DNA, 25 bp, Mus musculus
tctttggagaaaaatgtggaattgg

SEQ ID NO: 369190 - DNA, 25 bp, Mus musculus
tctttggagaaatatgtggaattgg

SEQ ID NO: 369191 - DNA, 25 bp, Mus musculus
tctttggagagctcaaagagaagca

SEQ ID NO: 369192 - DNA, 25 bp, Mus musculus
tctttggagcagtggccgtgcctgc

SEQ ID NO: 369193 - DNA, 25 bp, Mus musculus
tctttggagtcaagttctccaagga

SEQ ID NO: 369194 - DNA, 25 bp, Mus musculus
tctttggattcataggggcttcttc

SEQ ID NO: 369195 - DNA, 25 bp, Mus musculus
tctttggcaacaacgctctggtgca

SEQ ID NO: 369196 - DNA, 25 bp, Mus musculus
tctttggcaagtttgggcctgcctt

SEQ ID NO: 369197 - DNA, 25 bp, Mus musculus
tctttggcagatcagtaatggaacg

SEQ ID NO: 369198 - DNA, 25 bp, Mus musculus
tctttggctatgaagaatgcccata

SEQ ID NO: 369199 - DNA, 25 bp, Mus musculus
tctttggctatgaagccacattggg

SEQ ID NO: 369200 - DNA, 25 bp, Mus musculus
tctttggctccgcagcagaatgcca

SEQ ID NO: 369201 - DNA, 25 bp, Mus musculus
tctttggctgggcagattggccacc

SEQ ID NO: 369202 - DNA, 25 bp, Mus musculus
tctttgggaatgccctctacgccct

SEQ ID NO: 369203 - DNA, 25 bp, Mus musculus
tctttgggcacaggaaagccatcac

SEQ ID NO: 369204 - DNA, 25 bp, Mus musculus
tctttgggcagctgctcgccctgcc

SEQ ID NO: 369205 - DNA, 25 bp, Mus musculus
tctttgggccaaaccaatatattgt

SEQ ID NO: 369206 - DNA, 25 bp, Mus musculus
tctttggggatgcccctgcctccct

SEQ ID NO: 369207 - DNA, 25 bp, Mus musculus
tctttggtcagagaggtgctggtaa

SEQ ID NO: 369208 - DNA, 25 bp, Mus musculus
tctttgtaatcttgagaaaatgaaa

SEQ ID NO: 369209 - DNA, 25 bp, Mus musculus
tctttgtacacaatgccaaagaagc

SEQ ID NO: 369210 - DNA, 25 bp, Mus musculus
tctttgtacacagcccacttttagg

SEQ ID NO: 369211 - DNA, 25 bp, Mus musculus
tctttgtaccaggatcttgaaacag

SEQ ID NO: 369212 - DNA, 25 bp, Mus musculus
tctttgtaccagggggctggtggca

SEQ ID NO: 369213 - DNA, 25 bp, Mus musculus
tctttgtagccggggacgatccgga

SEQ ID NO: 369214 - DNA, 25 bp, Mus musculus
tctttgtcactgagaaacgtctcag

SEQ ID NO: 369215 - DNA, 25 bp, Mus musculus
tctttgtcactgagctcctgcttcc

SEQ ID NO: 369216 - DNA, 25 bp, Mus musculus
tctttgtcaggtaagaatgattgat

SEQ ID NO: 369217 - DNA, 25 bp, Mus musculus
tctttgtcagtttgtccctgctggg

SEQ ID NO: 369218 - DNA, 25 bp, Mus musculus
tctttgtcctaagattagcctcaca

SEQ ID NO: 369219 - DNA, 25 bp, Mus musculus
tctttgtctgccagactgtcattga

SEQ ID NO: 369220 - DNA, 25 bp, Mus musculus
tctttgtctgctccctggtggttct

SEQ ID NO: 369221 - DNA, 25 bp, Mus musculus
tctttgtcttcttgtctggggaggt

SEQ ID NO: 369222 - DNA, 25 bp, Mus musculus
tctttgtgaaggaaggactccaccg

SEQ ID NO: 369223 - DNA, 25 bp, Mus musculus
tctttgtggaacacgaagccctgca

SEQ ID NO: 369224 - DNA, 25 bp, Mus musculus
tctttgtggaacacgctgtcttcag

SEQ ID NO: 369225 - DNA, 25 bp, Mus musculus
tctttgttcaggagtttaatctgat

SEQ ID NO: 369226 - DNA, 25 bp, Mus musculus
tctttgttcgaataaatgctgctca

SEQ ID NO: 369227 - DNA, 25 bp, Mus musculus
tctttgttctccaatgttgtatgtg

SEQ ID NO: 369228 - DNA, 25 bp, Mus musculus
tcttttacaataagagaccagcacc

SEQ ID NO: 369229 - DNA, 25 bp, Mus musculus
tcttttactatagccccagcgggaa

SEQ ID NO: 369230 - DNA, 25 bp, Mus musculus
tcttttagaaagggggagctggtga

SEQ ID NO: 369231 - DNA, 25 bp, Mus musculus
tcttttataaaagatctgcagtggg

SEQ ID NO: 369232 - DNA, 25 bp, Mus musculus
tcttttatctcaggtgacataaatc

SEQ ID NO: 369233 - DNA, 25 bp, Mus musculus
tcttttatgagtttgaaggaaggaa

SEQ ID NO: 369234 - DNA, 25 bp, Mus musculus
tcttttcaacaacaggcatgttaca

SEQ ID NO: 369235 - DNA, 25 bp, Mus musculus
tcttttcaaggtatttcctggtgga

SEQ ID NO: 369236 - DNA, 25 bp, Mus musculus
tcttttcacaatgctcatgatctca

SEQ ID NO: 369237 - DNA, 25 bp, Mus musculus
tcttttcagaccaatacccacaggt

SEQ ID NO: 369238 - DNA, 25 bp, Mus musculus
tcttttccaaacatcaacatggctg

SEQ ID NO: 369239 - DNA, 25 bp, Mus musculus
tcttttccaggcatggtttattgaa

SEQ ID NO: 369240 - DNA, 25 bp, Mus musculus
tcttttccaggtgcagagtggtggc

SEQ ID NO: 369241 - DNA, 25 bp, Mus musculus
tcttttccaggtggttttcctgggg

SEQ ID NO: 369242 - DNA, 25 bp, Mus musculus
tcttttcctgaaagctttggataga

SEQ ID NO: 369243 - DNA, 25 bp, Mus musculus
tcttttcctgaaagttaaatcggag

SEQ ID NO: 369244 - DNA, 25 bp, Mus musculus
tcttttcctgccccacctccagata

SEQ ID NO: 369245 - DNA, 25 bp, Mus musculus
tcttttcctgggtgaaagacaagga

SEQ ID NO: 369246 - DNA, 25 bp, Mus musculus
tcttttcgcagaagccacagaagag

SEQ ID NO: 369247 - DNA, 25 bp, Mus musculus
tcttttctcagagcaacacgtttta

SEQ ID NO: 369248 - DNA, 25 bp, Mus musculus
tcttttctgcggttgatccaaaaga

SEQ ID NO: 369249 - DNA, 25 bp, Mus musculus
tcttttgaatatccagggttctctg

SEQ ID NO: 369250 - DNA, 25 bp, Mus musculus
tcttttgagcaaaggagaagcgcta

SEQ ID NO: 369251 - DNA, 25 bp, Mus musculus
tcttttgagtagcagtgagcgtcct

SEQ ID NO: 369252 - DNA, 25 bp, Mus musculus
tcttttgcaatcaaagttctatttt

SEQ ID NO: 369253 - DNA, 25 bp, Mus musculus
tcttttgcaattagaagatggaggt

SEQ ID NO: 369254 - DNA, 25 bp, Mus musculus
tcttttgcagcagtcctatgcacca

SEQ ID NO: 369255 - DNA, 25 bp, Mus musculus
tcttttgctatgctcagcacattgc

SEQ ID NO: 369256 - DNA, 25 bp, Mus musculus
tcttttggaaaggtttttcttgata

SEQ ID NO: 369257 - DNA, 25 bp, Mus musculus
tcttttggactgggttttgccaggt

SEQ ID NO: 369258 - DNA, 25 bp, Mus musculus
tcttttgggagacagagatcctgag

SEQ ID NO: 369259 - DNA, 25 bp, Mus musculus
tcttttggtctgtgagcatccctca

SEQ ID NO: 369260 - DNA, 25 bp, Mus musculus
tcttttggtttttggtgaatgaata

SEQ ID NO: 369261 - DNA, 25 bp, Mus musculus
tcttttgtcaaggactgtgaattgg

SEQ ID NO: 369262 - DNA, 25 bp, Mus musculus
tcttttgtcaaggatggtgaggaag

SEQ ID NO: 369263 - DNA, 25 bp, Mus musculus
tctttttaaaaagtgtgttcaaagc

SEQ ID NO: 369264 - DNA, 25 bp, Mus musculus
tctttttaaggtacagcaagggaga

SEQ ID NO: 369265 - DNA, 25 bp, Mus musculus
tctttttaatttctctttcctctct

SEQ ID NO: 369266 - DNA, 25 bp, Mus musculus
tctttttcatggaagtgtgtgatga

SEQ ID NO: 369267 - DNA, 25 bp, Mus musculus
tctttttccagcagttggaattgat

SEQ ID NO: 369268 - DNA, 25 bp, Mus musculus
tctttttctcgaaagaaggatttcg

SEQ ID NO: 369269 - DNA, 25 bp, Mus musculus
tctttttgaagaagcagaaaagtat

SEQ ID NO: 369270 - DNA, 25 bp, Mus musculus
tctttttgagagtagtataagaaag

SEQ ID NO: 369271 - DNA, 25 bp, Mus musculus
tctttttgagagtattattggcatt

SEQ ID NO: 369272 - DNA, 25 bp, Mus musculus
tctttttgctttgatgaaaaaacaa

SEQ ID NO: 369273 - DNA, 25 bp, Mus musculus
tcttttttgaaacaggtgttctggc

SEQ ID NO: 369274 - DNA, 25 bp, Mus musculus
tcttttttgagattgagctccttga

SEQ ID NO: 369275 - DNA, 25 bp, Mus musculus
tcttttttgctggatagagagagtg

SEQ ID NO: 369276 - DNA, 25 bp, Mus musculus
tctttttttcctactcactgtgtgc

SEQ ID NO: 369277 - DNA, 25 bp, Mus musculus
tcttttttttattgagtctcatgta

SEQ ID NO: 369278 - DNA, 25 bp, Mus musculus
tgaaaaaaagctcaggagaaatcaa

SEQ ID NO: 369279 - DNA, 25 bp, Mus musculus
tgaaaaaactaaggagttttggagc

SEQ ID NO: 369280 - DNA, 25 bp, Mus musculus
tgaaaaaacttttgcactccttccc

SEQ ID NO: 369281 - DNA, 25 bp, Mus musculus
tgaaaaaataggttttcctgcagcc

SEQ ID NO: 369282 - DNA, 25 bp, Mus musculus
tgaaaaacaagtggagagattttgg

SEQ ID NO: 369283 - DNA, 25 bp, Mus musculus
tgaaaaacagggaagctgcccggga

SEQ ID NO: 369284 - DNA, 25 bp, Mus musculus
tgaaaaacagggaagctgctaaaga

SEQ ID NO: 369285 - DNA, 25 bp, Mus musculus
tgaaaaaccaggtggaggatcttct

SEQ ID NO: 369286 - DNA, 25 bp, Mus musculus
tgaaaaaccgcacggccttcaacac

SEQ ID NO: 369287 - DNA, 25 bp, Mus musculus
tgaaaaactacaaaatccacaggta

SEQ ID NO: 369288 - DNA, 25 bp, Mus musculus
tgaaaaactacagaagttaaatgaa

SEQ ID NO: 369289 - DNA, 25 bp, Mus musculus
tgaaaaactcagtcgtgcggggtcc

SEQ ID NO: 369290 - DNA, 25 bp, Mus musculus
tgaaaaacttaagtaaatttgatcc

SEQ ID NO: 369291 - DNA, 25 bp, Mus musculus
tgaaaaagacaagatctccctaggc

SEQ ID NO: 369292 - DNA, 25 bp, Mus musculus
tgaaaaagaccacaaattgatccag

SEQ ID NO: 369293 - DNA, 25 bp, Mus musculus
tgaaaaagagctgcatgagaaattt

SEQ ID NO: 369294 - DNA, 25 bp, Mus musculus
tgaaaaagctggaggcaagaaagga

SEQ ID NO: 369295 - DNA, 25 bp, Mus musculus
tgaaaaaggccaagatatttatcaa

SEQ ID NO: 369296 - DNA, 25 bp, Mus musculus
tgaaaaataagattggccaggtgaa

SEQ ID NO: 369297 - DNA, 25 bp, Mus musculus
tgaaaaataaggtagagcaactgaa

SEQ ID NO: 369298 - DNA, 25 bp, Mus musculus
tgaaaaatcaagaaatgtgcctgtg

SEQ ID NO: 369299 - DNA, 25 bp, Mus musculus
tgaaaaatcaagttgtcactcagcc

SEQ ID NO: 369300 - DNA, 25 bp, Mus musculus
tgaaaaatcagggggcctgtggcag

SEQ ID NO: 369301 - DNA, 25 bp, Mus musculus
tgaaaaatcgggttctgcctgtgcc

SEQ ID NO: 369302 - DNA, 25 bp, Mus musculus
tgaaaaatgactggcatggaggtgc

SEQ ID NO: 369303 - DNA, 25 bp, Mus musculus
tgaaaaatgactgggaaggatttaa

SEQ ID NO: 369304 - DNA, 25 bp, Mus musculus
tgaaaaatgagttcattgagaagcg

SEQ ID NO: 369305 - DNA, 25 bp, Mus musculus
tgaaaaatgagtttggcaaaggtgt

SEQ ID NO: 369306 - DNA, 25 bp, Mus musculus
tgaaaaatgggagattatgtttaat

SEQ ID NO: 369307 - DNA, 25 bp, Mus musculus
tgaaaaatgggatgggttggagcag

SEQ ID NO: 369308 - DNA, 25 bp, Mus musculus
tgaaaaatgtgaaggggctctttcc

SEQ ID NO: 369309 - DNA, 25 bp, Mus musculus
tgaaaaatgtgaaggttggtacaga

SEQ ID NO: 369310 - DNA, 25 bp, Mus musculus
tgaaaacaaaacagaccagaaccag

SEQ ID NO: 369311 - DNA, 25 bp, Mus musculus
tgaaaacaaaacgaaccagctgcga

SEQ ID NO: 369312 - DNA, 25 bp, Mus musculus
tgaaaacaaacgatacaaggaggca

SEQ ID NO: 369313 - DNA, 25 bp, Mus musculus
tgaaaacaaacggtcctgctgtctc

SEQ ID NO: 369314 - DNA, 25 bp, Mus musculus
tgaaaacaaccaggtattgaccaag

SEQ ID NO: 369315 - DNA, 25 bp, Mus musculus
tgaaaacaccaggcagtggtggatg

SEQ ID NO: 369316 - DNA, 25 bp, Mus musculus
tgaaaacatacatgttgccaggatg

SEQ ID NO: 369317 - DNA, 25 bp, Mus musculus
tgaaaacatcaaaataaaccaggcg

SEQ ID NO: 369318 - DNA, 25 bp, Mus musculus
tgaaaacatccaatgtctcttcaga

SEQ ID NO: 369319 - DNA, 25 bp, Mus musculus
tgaaaacatgggtacaggaccctgg

SEQ ID NO: 369320 - DNA, 25 bp, Mus musculus
tgaaaacattatgaactgctgagtg

SEQ ID NO: 369321 - DNA, 25 bp, Mus musculus
tgaaaacattcaaggtgtcaactct

SEQ ID NO: 369322 - DNA, 25 bp, Mus musculus
tgaaaaccaagaatccacctcattg

SEQ ID NO: 369323 - DNA, 25 bp, Mus musculus
tgaaaaccagatacaatggagaggt

SEQ ID NO: 369324 - DNA, 25 bp, Mus musculus
tgaaaaccaggaaaataggtgagct

SEQ ID NO: 369325 - DNA, 25 bp, Mus musculus
tgaaaacccagtgagatgagtcaga

SEQ ID NO: 369326 - DNA, 25 bp, Mus musculus
tgaaaacccctcttatcctactagt

SEQ ID NO: 369327 - DNA, 25 bp, Mus musculus
tgaaaaccgacctatgtcaccttcg

SEQ ID NO: 369328 - DNA, 25 bp, Mus musculus
tgaaaaccgacttccagattaccag

SEQ ID NO: 369329 - DNA, 25 bp, Mus musculus
tgaaaaccgcagacctgtgttgcgt

SEQ ID NO: 369330 - DNA, 25 bp, Mus musculus
tgaaaaccgcaggtatggcatttca

SEQ ID NO: 369331 - DNA, 25 bp, Mus musculus
tgaaaaccgcaggtgagaagacaaa

SEQ ID NO: 369332 - DNA, 25 bp, Mus musculus
tgaaaacctcggctctctgctcccc

SEQ ID NO: 369333 - DNA, 25 bp, Mus musculus
tgaaaacctggatctgatggaacaa

SEQ ID NO: 369334 - DNA, 25 bp, Mus musculus
tgaaaacctgtattttgaggaatta

SEQ ID NO: 369335 - DNA, 25 bp, Mus musculus
tgaaaactatgctgaacttggtgtt

SEQ ID NO: 369336 - DNA, 25 bp, Mus musculus
tgaaaactatggattccaaaatgcg

SEQ ID NO: 369337 - DNA, 25 bp, Mus musculus
tgaaaactatggtgacctgctggaa

SEQ ID NO: 369338 - DNA, 25 bp, Mus musculus
tgaaaactatgtgcttgacagaaga

SEQ ID NO: 369339 - DNA, 25 bp, Mus musculus
tgaaaactggtcagtacttggctct

SEQ ID NO: 369340 - DNA, 25 bp, Mus musculus
tgaaaactggtctgtacttggctct

SEQ ID NO: 369341 - DNA, 25 bp, Mus musculus
tgaaaagaacgaaagtcagcgtggg

SEQ ID NO: 369342 - DNA, 25 bp, Mus musculus
tgaaaagaagaccttgtcctggccc

SEQ ID NO: 369343 - DNA, 25 bp, Mus musculus
tgaaaagaagatccagccgcagcca

SEQ ID NO: 369344 - DNA, 25 bp, Mus musculus
tgaaaagcaagaaggacctagaccg

SEQ ID NO: 369345 - DNA, 25 bp, Mus musculus
tgaaaagcaagaagggtcttgttgc

SEQ ID NO: 369346 - DNA, 25 bp, Mus musculus
tgaaaagccggctttctccttccaa

SEQ ID NO: 369347 - DNA, 25 bp, Mus musculus
tgaaaagccgggtactggaaattgg

SEQ ID NO: 369348 - DNA, 25 bp, Mus musculus
tgaaaagcctgacagaagtcgagga

SEQ ID NO: 369349 - DNA, 25 bp, Mus musculus
tgaaaagcctgctccaggtctggtt

SEQ ID NO: 369350 - DNA, 25 bp, Mus musculus
tgaaaaggaaaggagtgactggtca

SEQ ID NO: 369351 - DNA, 25 bp, Mus musculus
tgaaaaggaaggtacaagaggacac

SEQ ID NO: 369352 - DNA, 25 bp, Mus musculus
tgaaaaggaaggtgtcttctcgtcc

SEQ ID NO: 369353 - DNA, 25 bp, Mus musculus
tgaaaaggagctgggagactccctg

SEQ ID NO: 369354 - DNA, 25 bp, Mus musculus
tgaaaaggagtgttaagcaaaagga

SEQ ID NO: 369355 - DNA, 25 bp, Mus musculus
tgaaaaggcacaaagtaagcgcaaa

SEQ ID NO: 369356 - DNA, 25 bp, Mus musculus
tgaaaaggcagaagatgcatattga

SEQ ID NO: 369357 - DNA, 25 bp, Mus musculus
tgaaaaggcagaagcagaaatgcta

SEQ ID NO: 369358 - DNA, 25 bp, Mus musculus
tgaaaaggggacacattttagtttc

SEQ ID NO: 369359 - DNA, 25 bp, Mus musculus
tgaaaagtgcggggaagcgcttggc

SEQ ID NO: 369360 - DNA, 25 bp, Mus musculus
tgaaaagttaaccagagtttgagtg

SEQ ID NO: 369361 - DNA, 25 bp, Mus musculus
tgaaaagtttgataacttacagtcc

SEQ ID NO: 369362 - DNA, 25 bp, Mus musculus
tgaaaataaaggtgcctcgtctcca

SEQ ID NO: 369363 - DNA, 25 bp, Mus musculus
tgaaaataattgatgctgtgaaggc

SEQ ID NO: 369364 - DNA, 25 bp, Mus musculus
tgaaaatagattagcattcttgaag

SEQ ID NO: 369365 - DNA, 25 bp, Mus musculus
tgaaaatcaccagatggtctcagca

SEQ ID NO: 369366 - DNA, 25 bp, Mus musculus
tgaaaatccaaaaggacacatgtat

SEQ ID NO: 369367 - DNA, 25 bp, Mus musculus
tgaaaatccaaaaggatctggagac

SEQ ID NO: 369368 - DNA, 25 bp, Mus musculus
tgaaaatctcaagacaaaaagatat

SEQ ID NO: 369369 - DNA, 25 bp, Mus musculus
tgaaaatctcaaggtctatcctaaa

SEQ ID NO: 369370 - DNA, 25 bp, Mus musculus
tgaaaatcttagattttgtccagac

SEQ ID NO: 369371 - DNA, 25 bp, Mus musculus
tgaaaatcttagcaaagagatgtct

SEQ ID NO: 369372 - DNA, 25 bp, Mus musculus
tgaaaatgaagagataggcgctcac

SEQ ID NO: 369373 - DNA, 25 bp, Mus musculus
tgaaaatgcaaaggcaggaaggagc

SEQ ID NO: 369374 - DNA, 25 bp, Mus musculus
tgaaaatgcaaaggtttcatcactt

SEQ ID NO: 369375 - DNA, 25 bp, Mus musculus
tgaaaatgctgacgtcctacaacca

SEQ ID NO: 369376 - DNA, 25 bp, Mus musculus
tgaaaatgcttcgagaacagaaaga

SEQ ID NO: 369377 - DNA, 25 bp, Mus musculus
tgaaaatgcttgggtcaccagtgga

SEQ ID NO: 369378 - DNA, 25 bp, Mus musculus
tgaaaatggaacaaggacctctgct

SEQ ID NO: 369379 - DNA, 25 bp, Mus musculus
tgaaaatggaacaagtacaaccctc

SEQ ID NO: 369380 - DNA, 25 bp, Mus musculus
tgaaaatggaactagtaacaaggac

SEQ ID NO: 369381 - DNA, 25 bp, Mus musculus
tgaaaattattggattgcagtgctc

SEQ ID NO: 369382 - DNA, 25 bp, Mus musculus
tgaaaatttaaagtaggaggagcca

SEQ ID NO: 369383 - DNA, 25 bp, Mus musculus
tgaaaatttggaggcagcaccggct

SEQ ID NO: 369384 - DNA, 25 bp, Mus musculus
tgaaacaaagatgcccttagaccac

SEQ ID NO: 369385 - DNA, 25 bp, Mus musculus
tgaaacaatcctgaggtactgtact

SEQ ID NO: 369386 - DNA, 25 bp, Mus musculus
tgaaacacaggacttccatagtttg

SEQ ID NO: 369387 - DNA, 25 bp, Mus musculus
tgaaacacatcccaggcaccccaca

SEQ ID NO: 369388 - DNA, 25 bp, Mus musculus
tgaaacaccaggaacgggagcgaag

SEQ ID NO: 369389 - DNA, 25 bp, Mus musculus
tgaaacaccaggagttggagaggca

SEQ ID NO: 369390 - DNA, 25 bp, Mus musculus
tgaaacaccattgctggggttcgaa

SEQ ID NO: 369391 - DNA, 25 bp, Mus musculus
tgaaacactatggatcgcagctcca

SEQ ID NO: 369392 - DNA, 25 bp, Mus musculus
tgaaacagaaaaaaattgaggagac

SEQ ID NO: 369393 - DNA, 25 bp, Mus musculus
tgaaacagatgctgaccttaagaga

SEQ ID NO: 369394 - DNA, 25 bp, Mus musculus
tgaaacagcaggatgtcgatcagat

SEQ ID NO: 369395 - DNA, 25 bp, Mus musculus
tgaaacaggctgttgtgcagactac

SEQ ID NO: 369396 - DNA, 25 bp, Mus musculus
tgaaacaggtggaaggtacagttaa

SEQ ID NO: 369397 - DNA, 25 bp, Mus musculus
tgaaacatctggaaggtatctcaga

SEQ ID NO: 369398 - DNA, 25 bp, Mus musculus
tgaaacatgaccaggccatgtgaaa

SEQ ID NO: 369399 - DNA, 25 bp, Mus musculus
tgaaacatgactttctgggacaagt

SEQ ID NO: 369400 - DNA, 25 bp, Mus musculus
tgaaaccaaggctggtctgctcagg

SEQ ID NO: 369401 - DNA, 25 bp, Mus musculus
tgaaaccacagaggaagcattctca

SEQ ID NO: 369402 - DNA, 25 bp, Mus musculus
tgaaaccacagcattctcatcttct

SEQ ID NO: 369403 - DNA, 25 bp, Mus musculus
tgaaaccacagctctagccaagagt

SEQ ID NO: 369404 - DNA, 25 bp, Mus musculus
tgaaaccacatccgtggttttttgg

SEQ ID NO: 369405 - DNA, 25 bp, Mus musculus
tgaaaccacatccgtttggaaatga

SEQ ID NO: 369406 - DNA, 25 bp, Mus musculus
tgaaaccaggagattggccggtaca

SEQ ID NO: 369407 - DNA, 25 bp, Mus musculus
tgaaaccatcgatagtgtccggatg

SEQ ID NO: 369408 - DNA, 25 bp, Mus musculus
tgaaaccattaagttcgagaagctg

SEQ ID NO: 369409 - DNA, 25 bp, Mus musculus
tgaaacccacagcatggtgagacac

SEQ ID NO: 369410 - DNA, 25 bp, Mus musculus
tgaaacccagatccttactgactgg

SEQ ID NO: 369411 - DNA, 25 bp, Mus musculus
tgaaacccagcagccatccttgcag

SEQ ID NO: 369412 - DNA, 25 bp, Mus musculus
tgaaacccagcagtatgaatattct

SEQ ID NO: 369413 - DNA, 25 bp, Mus musculus
tgaaaccgatcccagctctaccgcc

SEQ ID NO: 369414 - DNA, 25 bp, Mus musculus
tgaaacctgggactttactggaaag

SEQ ID NO: 369415 - DNA, 25 bp, Mus musculus
tgaaaccttggctgggggatgggct

SEQ ID NO: 369416 - DNA, 25 bp, Mus musculus
tgaaacgcaacgtcatccccgctgg

SEQ ID NO: 369417 - DNA, 25 bp, Mus musculus
tgaaacggctccaggctgctggcaa

SEQ ID NO: 369418 - DNA, 25 bp, Mus musculus
tgaaactaagcagaacaagccatcc

SEQ ID NO: 369419 - DNA, 25 bp, Mus musculus
tgaaactaagcaggaagcagaacaa

SEQ ID NO: 369420 - DNA, 25 bp, Mus musculus
tgaaactaagccgcccagccaccat

SEQ ID NO: 369421 - DNA, 25 bp, Mus musculus
tgaaactagctgggatactaacaaa

SEQ ID NO: 369422 - DNA, 25 bp, Mus musculus
tgaaactcaaagagcgtcaggaagc

SEQ ID NO: 369423 - DNA, 25 bp, Mus musculus
tgaaactcaaattttaatccaggtg

SEQ ID NO: 369424 - DNA, 25 bp, Mus musculus
tgaaactcaggtggtgctgatcaat

SEQ ID NO: 369425 - DNA, 25 bp, Mus musculus
tgaaactcaggttatgaggtgacgg

SEQ ID NO: 369426 - DNA, 25 bp, Mus musculus
tgaaactctacaagcacttgcagaa

SEQ ID NO: 369427 - DNA, 25 bp, Mus musculus
tgaaactgaagaaactcggaaaatt

SEQ ID NO: 369428 - DNA, 25 bp, Mus musculus
tgaaactgaagaagctattgcctgt

SEQ ID NO: 369429 - DNA, 25 bp, Mus musculus
tgaaactgaagaagctcataattat

SEQ ID NO: 369430 - DNA, 25 bp, Mus musculus
tgaaactgaaggctggcaacatggc

SEQ ID NO: 369431 - DNA, 25 bp, Mus musculus
tgaaactgaggagagatcaggaatc

SEQ ID NO: 369432 - DNA, 25 bp, Mus musculus
tgaaactgcagatccaggtggatga

SEQ ID NO: 369433 - DNA, 25 bp, Mus musculus
tgaaactgcaggtcacggaagcgta

SEQ ID NO: 369434 - DNA, 25 bp, Mus musculus
tgaaactgcagtgctggcagaagac

SEQ ID NO: 369435 - DNA, 25 bp, Mus musculus
tgaaactgcagtggactgagtttag

SEQ ID NO: 369436 - DNA, 25 bp, Mus musculus
tgaaactgtagcttctttgttacag

SEQ ID NO: 369437 - DNA, 25 bp, Mus musculus
tgaaacttacaggccttacttctct

SEQ ID NO: 369438 - DNA, 25 bp, Mus musculus
tgaaacttacaggtgcttttgggtc

SEQ ID NO: 369439 - DNA, 25 bp, Mus musculus
tgaaactttagtgccatggcagaac

SEQ ID NO: 369440 - DNA, 25 bp, Mus musculus
tgaaagaaaaagtggcccatcctca

SEQ ID NO: 369441 - DNA, 25 bp, Mus musculus
tgaaagaaaagcgggtgccctccaa

SEQ ID NO: 369442 - DNA, 25 bp, Mus musculus
tgaaagaaacagaggtcaacagtct

SEQ ID NO: 369443 - DNA, 25 bp, Mus musculus
tgaaagaaacagcttttaaagacag

SEQ ID NO: 369444 - DNA, 25 bp, Mus musculus
tgaaagaaatataaggactgaggat

SEQ ID NO: 369445 - DNA, 25 bp, Mus musculus
tgaaagaagaaatctctgtcataga

SEQ ID NO: 369446 - DNA, 25 bp, Mus musculus
tgaaagaagaaatctgtgtacttta

SEQ ID NO: 369447 - DNA, 25 bp, Mus musculus
tgaaagaagagcaggaaccccagaa

SEQ ID NO: 369448 - DNA, 25 bp, Mus musculus
tgaaagaaggcagaggtatgatgat

SEQ ID NO: 369449 - DNA, 25 bp, Mus musculus
tgaaagaattgcagagggtaatttt

SEQ ID NO: 369450 - DNA, 25 bp, Mus musculus
tgaaagaattgcagttgcctctttt

SEQ ID NO: 369451 - DNA, 25 bp, Mus musculus
tgaaagacagaaacaaactgttccc

SEQ ID NO: 369452 - DNA, 25 bp, Mus musculus
tgaaagacagggacatgaaacctga

SEQ ID NO: 369453 - DNA, 25 bp, Mus musculus
tgaaagagaaaggtgttgacctgaa

SEQ ID NO: 369454 - DNA, 25 bp, Mus musculus
tgaaagagaagcagtgaacttattt

SEQ ID NO: 369455 - DNA, 25 bp, Mus musculus
tgaaagagaataaatggcttgttgg

SEQ ID NO: 369456 - DNA, 25 bp, Mus musculus
tgaaagagaggaagcatcaacaccc

SEQ ID NO: 369457 - DNA, 25 bp, Mus musculus
tgaaagagaggaagtaaaactcaaa

SEQ ID NO: 369458 - DNA, 25 bp, Mus musculus
tgaaagagaggaggcgcaggcaggg

SEQ ID NO: 369459 - DNA, 25 bp, Mus musculus
tgaaagagaggtcttacttgttcct

SEQ ID NO: 369460 - DNA, 25 bp, Mus musculus
tgaaagagatgaaggactcgctggc

SEQ ID NO: 369461 - DNA, 25 bp, Mus musculus
tgaaagaggaaatggagcctgtgac

SEQ ID NO: 369462 - DNA, 25 bp, Mus musculus
tgaaagagggtgaagaaactgaagg

SEQ ID NO: 369463 - DNA, 25 bp, Mus musculus
tgaaagagtagtttcaagaacatgg

SEQ ID NO: 369464 - DNA, 25 bp, Mus musculus
tgaaagagtcacatcagtttcacct

SEQ ID NO: 369465 - DNA, 25 bp, Mus musculus
tgaaagagtggcggaacatgaagtt

SEQ ID NO: 369466 - DNA, 25 bp, Mus musculus
tgaaagagtggcggtcctggagttt

SEQ ID NO: 369467 - DNA, 25 bp, Mus musculus
tgaaagatagtaacaggagactgaa

SEQ ID NO: 369468 - DNA, 25 bp, Mus musculus
tgaaagatcaatgggcagcagcaat

SEQ ID NO: 369469 - DNA, 25 bp, Mus musculus
tgaaagatcagtttggctttattaa

SEQ ID NO: 369470 - DNA, 25 bp, Mus musculus
tgaaagatgagaatgcacctgtctg

SEQ ID NO: 369471 - DNA, 25 bp, Mus musculus
tgaaagcaactgtggaagaatttga

SEQ ID NO: 369472 - DNA, 25 bp, Mus musculus
tgaaagcaaggccagaagtcaatgt

SEQ ID NO: 369473 - DNA, 25 bp, Mus musculus
tgaaagcaagtcagatgaatggaaa

SEQ ID NO: 369474 - DNA, 25 bp, Mus musculus
tgaaagcaggtctgggtattggatg

SEQ ID NO: 369475 - DNA, 25 bp, Mus musculus
tgaaagcatccagtttgtgctcgat

SEQ ID NO: 369476 - DNA, 25 bp, Mus musculus
tgaaagccatgcattggaatttgaa

SEQ ID NO: 369477 - DNA, 25 bp, Mus musculus
tgaaagcccaagtggccgcacgagg

SEQ ID NO: 369478 - DNA, 25 bp, Mus musculus
tgaaagcccagaaagaactagaaga

SEQ ID NO: 369479 - DNA, 25 bp, Mus musculus
tgaaagcccagaaaggatgtataat

SEQ ID NO: 369480 - DNA, 25 bp, Mus musculus
tgaaagcccattcaaccatggatgt

SEQ ID NO: 369481 - DNA, 25 bp, Mus musculus
tgaaagcctcctaggcacccgaggg

SEQ ID NO: 369482 - DNA, 25 bp, Mus musculus
tgaaagcgacagctctacaacagaa

SEQ ID NO: 369483 - DNA, 25 bp, Mus musculus
tgaaagcgttttcagaaaagatgtc

SEQ ID NO: 369484 - DNA, 25 bp, Mus musculus
tgaaagctcaggactctcggctctc

SEQ ID NO: 369485 - DNA, 25 bp, Mus musculus
tgaaagcttatttggtatgctaaca

SEQ ID NO: 369486 - DNA, 25 bp, Mus musculus
tgaaaggaagtcagagaagcttcaa

SEQ ID NO: 369487 - DNA, 25 bp, Mus musculus
tgaaaggaattcaagatggtcaaat

SEQ ID NO: 369488 - DNA, 25 bp, Mus musculus
tgaaaggaattccagatggtcaaat

SEQ ID NO: 369489 - DNA, 25 bp, Mus musculus
tgaaaggagagaaaacggtgtattg

SEQ ID NO: 369490 - DNA, 25 bp, Mus musculus
tgaaaggagagaaaagcatctgtcc

SEQ ID NO: 369491 - DNA, 25 bp, Mus musculus
tgaaaggagagaaagatcagccaca

SEQ ID NO: 369492 - DNA, 25 bp, Mus musculus
tgaaaggagatgagtccccggcatg

SEQ ID NO: 369493 - DNA, 25 bp, Mus musculus
tgaaaggcaaagccatgtcatatcc

SEQ ID NO: 369494 - DNA, 25 bp, Mus musculus
tgaaaggcaaaggtcagtgtcctgg

SEQ ID NO: 369495 - DNA, 25 bp, Mus musculus
tgaaaggcacatacttggtacattt

SEQ ID NO: 369496 - DNA, 25 bp, Mus musculus
tgaaagggcccatgatctccatctt

SEQ ID NO: 369497 - DNA, 25 bp, Mus musculus
tgaaagggccgaggcgaagcccgac

SEQ ID NO: 369498 - DNA, 25 bp, Mus musculus
tgaaagggtcacggacctcttcact

SEQ ID NO: 369499 - DNA, 25 bp, Mus musculus
tgaaagggtcacggttgcatctgat

SEQ ID NO: 369500 - DNA, 25 bp, Mus musculus
tgaaaggtcacagaggacacaaagg

SEQ ID NO: 369501 - DNA, 25 bp, Mus musculus
tgaaaggtgtgctggtgcgatgcat

SEQ ID NO: 369502 - DNA, 25 bp, Mus musculus
tgaaagtaaaaactggcattgcttc

SEQ ID NO: 369503 - DNA, 25 bp, Mus musculus
tgaaagtaacactgagtaccagtga

SEQ ID NO: 369504 - DNA, 25 bp, Mus musculus
tgaaagtaagcgtttcaagggtact

SEQ ID NO: 369505 - DNA, 25 bp, Mus musculus
tgaaagtacagggttgtttcaaaga

SEQ ID NO: 369506 - DNA, 25 bp, Mus musculus
tgaaagtacaggtagagatctgcct

SEQ ID NO: 369507 - DNA, 25 bp, Mus musculus
tgaaagtacttgaaaactggtggtc

SEQ ID NO: 369508 - DNA, 25 bp, Mus musculus
tgaaagtagttaccgtggtcaagaa

SEQ ID NO: 369509 - DNA, 25 bp, Mus musculus
tgaaagtcaaaaggtctccagatga

SEQ ID NO: 369510 - DNA, 25 bp, Mus musculus
tgaaagtccgctacgtgaaaaatga

SEQ ID NO: 369511 - DNA, 25 bp, Mus musculus
tgaaagtctctgcaggtgcccaaaa

SEQ ID NO: 369512 - DNA, 25 bp, Mus musculus
tgaaagtctgtctagagtttcaaga

SEQ ID NO: 369513 - DNA, 25 bp, Mus musculus
tgaaagtgaaacactagaccagctc

SEQ ID NO: 369514 - DNA, 25 bp, Mus musculus
tgaaagtgaaaccagaggaggagtc

SEQ ID NO: 369515 - DNA, 25 bp, Mus musculus
tgaaagtgacagagaaagtgatctt

SEQ ID NO: 369516 - DNA, 25 bp, Mus musculus
tgaaagtgacagagagtcagtgggc

SEQ ID NO: 369517 - DNA, 25 bp, Mus musculus
tgaaagtgcaggaaaggaagttcct

SEQ ID NO: 369518 - DNA, 25 bp, Mus musculus
tgaaagtgtgtggtgcaacagaatg

SEQ ID NO: 369519 - DNA, 25 bp, Mus musculus
tgaaagttagaaatttcaacgttga

SEQ ID NO: 369520 - DNA, 25 bp, Mus musculus
tgaaagttggacaagatgcaagttc

SEQ ID NO: 369521 - DNA, 25 bp, Mus musculus
tgaaatacaagctggcatttttcag

SEQ ID NO: 369522 - DNA, 25 bp, Mus musculus
tgaaatacaaggagcaactgtgcca

SEQ ID NO: 369523 - DNA, 25 bp, Mus musculus
tgaaatacgattcagatggttacgg

SEQ ID NO: 369524 - DNA, 25 bp, Mus musculus
tgaaatacgttccaggagttacagc

SEQ ID NO: 369525 - DNA, 25 bp, Mus musculus
tgaaatactaggttgcaggaatcct

SEQ ID NO: 369526 - DNA, 25 bp, Mus musculus
tgaaatagaagaggactccatataa

SEQ ID NO: 369527 - DNA, 25 bp, Mus musculus
tgaaatagaagaggccttctttcta

SEQ ID NO: 369528 - DNA, 25 bp, Mus musculus
tgaaatatgcaggaggggaagcaga

SEQ ID NO: 369529 - DNA, 25 bp, Mus musculus
tgaaatatgcagtgagcatgttttt

SEQ ID NO: 369530 - DNA, 25 bp, Mus musculus
tgaaatatgcccagcgagccagagc

SEQ ID NO: 369531 - DNA, 25 bp, Mus musculus
tgaaatatgcccaggtgaagcctga

SEQ ID NO: 369532 - DNA, 25 bp, Mus musculus
tgaaatattccaagttcagtggtca

SEQ ID NO: 369533 - DNA, 25 bp, Mus musculus
tgaaatcaaccaagctgctcttctc

SEQ ID NO: 369534 - DNA, 25 bp, Mus musculus
tgaaatcaagagaagcgagccagag

SEQ ID NO: 369535 - DNA, 25 bp, Mus musculus
tgaaatcaaggaacaagcaatggca

SEQ ID NO: 369536 - DNA, 25 bp, Mus musculus
tgaaatcaaggaagactcttcaatc

SEQ ID NO: 369537 - DNA, 25 bp, Mus musculus
tgaaatcaaggtaactatggatgca

SEQ ID NO: 369538 - DNA, 25 bp, Mus musculus
tgaaatcaaggttacagaatgtctg

SEQ ID NO: 369539 - DNA, 25 bp, Mus musculus
tgaaatcaaggttccgtgttgccag

SEQ ID NO: 369540 - DNA, 25 bp, Mus musculus
tgaaatcaagtatgcaacccagctg

SEQ ID NO: 369541 - DNA, 25 bp, Mus musculus
tgaaatcacacaatatgtagctggc

SEQ ID NO: 369542 - DNA, 25 bp, Mus musculus
tgaaatcacacagttttcagatatg

SEQ ID NO: 369543 - DNA, 25 bp, Mus musculus
tgaaatcacagaactagacaccctg

SEQ ID NO: 369544 - DNA, 25 bp, Mus musculus
tgaaatcacagagaacacccagatc

SEQ ID NO: 369545 - DNA, 25 bp, Mus musculus
tgaaatcacaggtcctgctgtctct

SEQ ID NO: 369546 - DNA, 25 bp, Mus musculus
tgaaatcagccacaccttcaactcc

SEQ ID NO: 369547 - DNA, 25 bp, Mus musculus
tgaaatccaagccaagtgccctcca

SEQ ID NO: 369548 - DNA, 25 bp, Mus musculus
tgaaatcccaggtgatgacacacct

SEQ ID NO: 369549 - DNA, 25 bp, Mus musculus
tgaaatccttcctggaaggccggat

SEQ ID NO: 369550 - DNA, 25 bp, Mus musculus
tgaaatctaccagaacaatctggaa

SEQ ID NO: 369551 - DNA, 25 bp, Mus musculus
tgaaatctaccagttgagaaatgtg

SEQ ID NO: 369552 - DNA, 25 bp, Mus musculus
tgaaatctgtaacggaaggtgcatc

SEQ ID NO: 369553 - DNA, 25 bp, Mus musculus
tgaaatcttcagctgctgacctcac

SEQ ID NO: 369554 - DNA, 25 bp, Mus musculus
tgaaatgaaaaaggcccaagaggat

SEQ ID NO: 369555 - DNA, 25 bp, Mus musculus
tgaaatgaaaaaggttaaggagctg

SEQ ID NO: 369556 - DNA, 25 bp, Mus musculus
tgaaatgatccaggtactgcagggt

SEQ ID NO: 369557 - DNA, 25 bp, Mus musculus
tgaaatgattgactctggtgtgaga

SEQ ID NO: 369558 - DNA, 25 bp, Mus musculus
tgaaatgcacgatgaggaaactgag

SEQ ID NO: 369559 - DNA, 25 bp, Mus musculus
tgaaatggacgtatgttccatcaag

SEQ ID NO: 369560 - DNA, 25 bp, Mus musculus
tgaaatggcaaagtacccaggcaag

SEQ ID NO: 369561 - DNA, 25 bp, Mus musculus
tgaaatgggccaaggaaaatgatga

SEQ ID NO: 369562 - DNA, 25 bp, Mus musculus
tgaaatggtttacagactgttttcc

SEQ ID NO: 369563 - DNA, 25 bp, Mus musculus
tgaaatggtttacaggtttactgct

SEQ ID NO: 369564 - DNA, 25 bp, Mus musculus
tgaaatgtcagaaaatcaagagaag

SEQ ID NO: 369565 - DNA, 25 bp, Mus musculus
tgaaatgtcagactcattgaaagaa

SEQ ID NO: 369566 - DNA, 25 bp, Mus musculus
tgaaatgtcaggatgccccaggtga

SEQ ID NO: 369567 - DNA, 25 bp, Mus musculus
tgaaatgtgagctcactctgcagag

SEQ ID NO: 369568 - DNA, 25 bp, Mus musculus
tgaaatgtgcagattgtgggttgaa

SEQ ID NO: 369569 - DNA, 25 bp, Mus musculus
tgaaatgtttgccagaaatgtgcaa

SEQ ID NO: 369570 - DNA, 25 bp, Mus musculus
tgaaatgtttgccagacacgcgaaa

SEQ ID NO: 369571 - DNA, 25 bp, Mus musculus
tgaaattacggccgagatccagtcc

SEQ ID NO: 369572 - DNA, 25 bp, Mus musculus
tgaaattagatggcttccctttccc

SEQ ID NO: 369573 - DNA, 25 bp, Mus musculus
tgaaattataagcaaattctacggt

SEQ ID NO: 369574 - DNA, 25 bp, Mus musculus
tgaaattcaaggatccagtgaaaga

SEQ ID NO: 369575 - DNA, 25 bp, Mus musculus
tgaaattcacaaaagggaaggatct

SEQ ID NO: 369576 - DNA, 25 bp, Mus musculus
tgaaattccacaagctgatcaacgt

SEQ ID NO: 369577 - DNA, 25 bp, Mus musculus
tgaaattcccaatgagttgccatat

SEQ ID NO: 369578 - DNA, 25 bp, Mus musculus
tgaaattcctcaaggagtcacctgg

SEQ ID NO: 369579 - DNA, 25 bp, Mus musculus
tgaaattcctcaaggcacttaggca

SEQ ID NO: 369580 - DNA, 25 bp, Mus musculus
tgaaattcctcaagggggaggataa

SEQ ID NO: 369581 - DNA, 25 bp, Mus musculus
tgaaattggacaggattggcccctg

SEQ ID NO: 369582 - DNA, 25 bp, Mus musculus
tgaaattggacaggtccttcatttt

SEQ ID NO: 369583 - DNA, 25 bp, Mus musculus
tgaaattggcttccctgagatcctg

SEQ ID NO: 369584 - DNA, 25 bp, Mus musculus
tgaaattgtgaaagaggtcctgtaa

SEQ ID NO: 369585 - DNA, 25 bp, Mus musculus
tgaaatttatgattccatattaata

SEQ ID NO: 369586 - DNA, 25 bp, Mus musculus
tgaaatttcaggtcacgttcatgaa

SEQ ID NO: 369587 - DNA, 25 bp, Mus musculus
tgaaatttggaagctacgcttacac

SEQ ID NO: 369588 - DNA, 25 bp, Mus musculus
tgaaatttgggagttatgcatatcc

SEQ ID NO: 369589 - DNA, 25 bp, Mus musculus
tgaacaaaacagattgcctgcagtt

SEQ ID NO: 369590 - DNA, 25 bp, Mus musculus
tgaacaaagaccggcaactatccat

SEQ ID NO: 369591 - DNA, 25 bp, Mus musculus
tgaacaaatcccaggagcaagtgtc

SEQ ID NO: 369592 - DNA, 25 bp, Mus musculus
tgaacaaatcccagttgtaggccat

SEQ ID NO: 369593 - DNA, 25 bp, Mus musculus
tgaacaacatgggacgaaacttagc

SEQ ID NO: 369594 - DNA, 25 bp, Mus musculus
tgaacaaccaactgggcagcaactt

SEQ ID NO: 369595 - DNA, 25 bp, Mus musculus
tgaacaaccaggagccctacacagg

SEQ ID NO: 369596 - DNA, 25 bp, Mus musculus
tgaacaacgcaggactaaattcgga

SEQ ID NO: 369597 - DNA, 25 bp, Mus musculus
tgaacaagaagatctaccgcattgg

SEQ ID NO: 369598 - DNA, 25 bp, Mus musculus
tgaacaagaagtcctaccctaggca

SEQ ID NO: 369599 - DNA, 25 bp, Mus musculus
tgaacaagaggcagatgggcatatc

SEQ ID NO: 369600 - DNA, 25 bp, Mus musculus
tgaacaagataaggggatggtaata

SEQ ID NO: 369601 - DNA, 25 bp, Mus musculus
tgaacaagatgacggtcagcgtcaa

SEQ ID NO: 369602 - DNA, 25 bp, Mus musculus
tgaacaagattaatgaaccaccaaa

SEQ ID NO: 369603 - DNA, 25 bp, Mus musculus
tgaacaagttgaggaacaatacgaa

SEQ ID NO: 369604 - DNA, 25 bp, Mus musculus
tgaacaagttgaggaggaggcccaa

SEQ ID NO: 369605 - DNA, 25 bp, Mus musculus
tgaacaatgcaagaaaacgaagtcc

SEQ ID NO: 369606 - DNA, 25 bp, Mus musculus
tgaacaatttccaggtcatgagcat

SEQ ID NO: 369607 - DNA, 25 bp, Mus musculus
tgaacacaacatgtgggatcacatg

SEQ ID NO: 369608 - DNA, 25 bp, Mus musculus
tgaacacaagggtcatccaaacgca

SEQ ID NO: 369609 - DNA, 25 bp, Mus musculus
tgaacacaataaggctcatgcacaa

SEQ ID NO: 369610 - DNA, 25 bp, Mus musculus
tgaacacaatcaagcccccactgtg

SEQ ID NO: 369611 - DNA, 25 bp, Mus musculus
tgaacacaatcaaggcacttcggag

SEQ ID NO: 369612 - DNA, 25 bp, Mus musculus
tgaacacaatcaaggtccacaggat

SEQ ID NO: 369613 - DNA, 25 bp, Mus musculus
tgaacacagccaaagatcggaaccg

SEQ ID NO: 369614 - DNA, 25 bp, Mus musculus
tgaacacattgaagcaataccttct

SEQ ID NO: 369615 - DNA, 25 bp, Mus musculus
tgaacaccagaagcctaagagttcc

SEQ ID NO: 369616 - DNA, 25 bp, Mus musculus
tgaacaccaggtttggacgtcatga

SEQ ID NO: 369617 - DNA, 25 bp, Mus musculus
tgaacaccccctcagtggccacagt

SEQ ID NO: 369618 - DNA, 25 bp, Mus musculus
tgaacaccccgggcttgcccaggtg

SEQ ID NO: 369619 - DNA, 25 bp, Mus musculus
tgaacaccttgcagaacattccagg

SEQ ID NO: 369620 - DNA, 25 bp, Mus musculus
tgaacaccttgcatcccacgagtcc

SEQ ID NO: 369621 - DNA, 25 bp, Mus musculus
tgaacacgctcagaaatgacctgca

SEQ ID NO: 369622 - DNA, 25 bp, Mus musculus
tgaacactgacgcttttgtcaatct

SEQ ID NO: 369623 - DNA, 25 bp, Mus musculus
tgaacactgaggggttcctggactg

SEQ ID NO: 369624 - DNA, 25 bp, Mus musculus
tgaacactgatatagaaaatcttgt

SEQ ID NO: 369625 - DNA, 25 bp, Mus musculus
tgaacactgatcaagaaaatcttgt

SEQ ID NO: 369626 - DNA, 25 bp, Mus musculus
tgaacactgtccaacactggccagt

SEQ ID NO: 369627 - DNA, 25 bp, Mus musculus
tgaacagaaaggtcaaatcattaag

SEQ ID NO: 369628 - DNA, 25 bp, Mus musculus
tgaacagaatgagatcatcgatgac

SEQ ID NO: 369629 - DNA, 25 bp, Mus musculus
tgaacagacagctgaaattacccca

SEQ ID NO: 369630 - DNA, 25 bp, Mus musculus
tgaacagagagcagatcttgagtgc

SEQ ID NO: 369631 - DNA, 25 bp, Mus musculus
tgaacagatttgccagggagatgta

SEQ ID NO: 369632 - DNA, 25 bp, Mus musculus
tgaacagcaaaggtcaatatccaac

SEQ ID NO: 369633 - DNA, 25 bp, Mus musculus
tgaacagcagctcccgttacttcca

SEQ ID NO: 369634 - DNA, 25 bp, Mus musculus
tgaacagcaggtcccaggatttatg

SEQ ID NO: 369635 - DNA, 25 bp, Mus musculus
tgaacagcataaggcttgctcttca

SEQ ID NO: 369636 - DNA, 25 bp, Mus musculus
tgaacagctggccgactgcttttcc

SEQ ID NO: 369637 - DNA, 25 bp, Mus musculus
tgaacaggaacatagcggcggagcc

SEQ ID NO: 369638 - DNA, 25 bp, Mus musculus
tgaacagtaggtgagcttagcctac

SEQ ID NO: 369639 - DNA, 25 bp, Mus musculus
tgaacagtgaagcaggcagggcatt

SEQ ID NO: 369640 - DNA, 25 bp, Mus musculus
tgaacagtgccatatgagaacatgc

SEQ ID NO: 369641 - DNA, 25 bp, Mus musculus
tgaacagtgccgcaacataacatgt

SEQ ID NO: 369642 - DNA, 25 bp, Mus musculus
tgaacagttagaggaaagaacaggc

SEQ ID NO: 369643 - DNA, 25 bp, Mus musculus
tgaacagttagaggttcgagaaatg

SEQ ID NO: 369644 - DNA, 25 bp, Mus musculus
tgaacatatttattgcatccgatat

SEQ ID NO: 369645 - DNA, 25 bp, Mus musculus
tgaacatatttattggatgactagg

SEQ ID NO: 369646 - DNA, 25 bp, Mus musculus
tgaacatatttattggtgaagccga

SEQ ID NO: 369647 - DNA, 25 bp, Mus musculus
tgaacatcaacggttctcccatggc

SEQ ID NO: 369648 - DNA, 25 bp, Mus musculus
tgaacatcactcacgagctctttga

SEQ ID NO: 369649 - DNA, 25 bp, Mus musculus
tgaacatcatgcatgctaagtggca

SEQ ID NO: 369650 - DNA, 25 bp, Mus musculus
tgaacatccaaaagtttgcagtcct

SEQ ID NO: 369651 - DNA, 25 bp, Mus musculus
tgaacatccaaagacacacaggacc

SEQ ID NO: 369652 - DNA, 25 bp, Mus musculus
tgaacatccagagccgtctgggtac

SEQ ID NO: 369653 - DNA, 25 bp, Mus musculus
tgaacatccagatcatccacacgga

SEQ ID NO: 369654 - DNA, 25 bp, Mus musculus
tgaacatcctcaaagcgacccctga

SEQ ID NO: 369655 - DNA, 25 bp, Mus musculus
tgaacatcctcaaaggatacaactt

SEQ ID NO: 369656 - DNA, 25 bp, Mus musculus
tgaacatgaacatccagtaataata

SEQ ID NO: 369657 - DNA, 25 bp, Mus musculus
tgaacatgatgaagaatagaattgc

SEQ ID NO: 369658 - DNA, 25 bp, Mus musculus
tgaacatgatgatgaacttgttcct

SEQ ID NO: 369659 - DNA, 25 bp, Mus musculus
tgaacatggaaaagaaaatagatat

SEQ ID NO: 369660 - DNA, 25 bp, Mus musculus
tgaacatggaaaagatatcaccagt

SEQ ID NO: 369661 - DNA, 25 bp, Mus musculus
tgaacatggatgtggacgccactat

SEQ ID NO: 369662 - DNA, 25 bp, Mus musculus
tgaacatgtgaagatttctgctcct

SEQ ID NO: 369663 - DNA, 25 bp, Mus musculus
tgaacattacaagaagacgctgcag

SEQ ID NO: 369664 - DNA, 25 bp, Mus musculus
tgaacattacaaggtgggagagggc

SEQ ID NO: 369665 - DNA, 25 bp, Mus musculus
tgaacattataagattcccccccta

SEQ ID NO: 369666 - DNA, 25 bp, Mus musculus
tgaacattccaccatgccagcagca

SEQ ID NO: 369667 - DNA, 25 bp, Mus musculus
tgaacatttaagagtgaatgccatc

SEQ ID NO: 369668 - DNA, 25 bp, Mus musculus
tgaacatttaaggcaattctgcctt

SEQ ID NO: 369669 - DNA, 25 bp, Mus musculus
tgaacatttctgtattactatgaat

SEQ ID NO: 369670 - DNA, 25 bp, Mus musculus
tgaacattttcaagacatttgagaa

SEQ ID NO: 369671 - DNA, 25 bp, Mus musculus
tgaaccaaagaagatgccgctccaa

SEQ ID NO: 369672 - DNA, 25 bp, Mus musculus
tgaaccaaagaagtacggcgagctc

SEQ ID NO: 369673 - DNA, 25 bp, Mus musculus
tgaaccaagatgaatgagcgccaac

SEQ ID NO: 369674 - DNA, 25 bp, Mus musculus
tgaaccaagatgctgtgcagaatga

SEQ ID NO: 369675 - DNA, 25 bp, Mus musculus
tgaaccaagcacttgtttctagttt

SEQ ID NO: 369676 - DNA, 25 bp, Mus musculus
tgaaccaaggaattcatcctacaaa

SEQ ID NO: 369677 - DNA, 25 bp, Mus musculus
tgaaccacaggaattcaaacccatt

SEQ ID NO: 369678 - DNA, 25 bp, Mus musculus
tgaaccacaggatgtgaactacttt

SEQ ID NO: 369679 - DNA, 25 bp, Mus musculus
tgaaccactcatatgatacagattt

SEQ ID NO: 369680 - DNA, 25 bp, Mus musculus
tgaaccactcatatgatttcaacca

SEQ ID NO: 369681 - DNA, 25 bp, Mus musculus
tgaaccactgcaggatttctggcac

SEQ ID NO: 369682 - DNA, 25 bp, Mus musculus
tgaaccagaagactttgaaagcatt

SEQ ID NO: 369683 - DNA, 25 bp, Mus musculus
tgaaccagaagggctgtcagggggt

SEQ ID NO: 369684 - DNA, 25 bp, Mus musculus
tgaaccagacagctgtgccaccgca

SEQ ID NO: 369685 - DNA, 25 bp, Mus musculus
tgaaccagacaggcacctgtgctca

SEQ ID NO: 369686 - DNA, 25 bp, Mus musculus
tgaaccagcagggtggcccacgcgc

SEQ ID NO: 369687 - DNA, 25 bp, Mus musculus
tgaaccagcggagttcaatgcgagc

SEQ ID NO: 369688 - DNA, 25 bp, Mus musculus
tgaaccagcggagtttcagtctgga

SEQ ID NO: 369689 - DNA, 25 bp, Mus musculus
tgaaccagctcaaaggcaaatcaaa

SEQ ID NO: 369690 - DNA, 25 bp, Mus musculus
tgaaccagctcgaaaaaacaatggc

SEQ ID NO: 369691 - DNA, 25 bp, Mus musculus
tgaaccaggccgcgttgtctgtctt

SEQ ID NO: 369692 - DNA, 25 bp, Mus musculus
tgaaccatcccccatgcggctgggt

SEQ ID NO: 369693 - DNA, 25 bp, Mus musculus
tgaacccaagagacttctctaccca

SEQ ID NO: 369694 - DNA, 25 bp, Mus musculus
tgaacccagcatgagtccgcagagt

SEQ ID NO: 369695 - DNA, 25 bp, Mus musculus
tgaacccatcaggaaggatcatcga

SEQ ID NO: 369696 - DNA, 25 bp, Mus musculus
tgaacccatcaggctgacatcaaag

SEQ ID NO: 369697 - DNA, 25 bp, Mus musculus
tgaacccattggtcagtgacatcaa

SEQ ID NO: 369698 - DNA, 25 bp, Mus musculus
tgaaccctaggttctgctgccttaa

SEQ ID NO: 369699 - DNA, 25 bp, Mus musculus
tgaaccctatcgaagaagaaccgat

SEQ ID NO: 369700 - DNA, 25 bp, Mus musculus
tgaaccctgagcgcccccgtggaat

SEQ ID NO: 369701 - DNA, 25 bp, Mus musculus
tgaaccctggcggaggctgctgaac

SEQ ID NO: 369702 - DNA, 25 bp, Mus musculus
tgaaccgaggcatcaaggcctgcaa

SEQ ID NO: 369703 - DNA, 25 bp, Mus musculus
tgaaccgcacttgctagtgtgccca

SEQ ID NO: 369704 - DNA, 25 bp, Mus musculus
tgaaccgcatccaggtcttggataa

SEQ ID NO: 369705 - DNA, 25 bp, Mus musculus
tgaaccgcatccaggttaaacgctc

SEQ ID NO: 369706 - DNA, 25 bp, Mus musculus
tgaaccgctggttgggtgaacagtt

SEQ ID NO: 369707 - DNA, 25 bp, Mus musculus
tgaaccggcagtttcgaaactgcat

SEQ ID NO: 369708 - DNA, 25 bp, Mus musculus
tgaaccggtcaacaatgcatattcc

SEQ ID NO: 369709 - DNA, 25 bp, Mus musculus
tgaaccgtgaggggaactggtatct

SEQ ID NO: 369710 - DNA, 25 bp, Mus musculus
tgaacctaaggctgctgactttccg

SEQ ID NO: 369711 - DNA, 25 bp, Mus musculus
tgaacctattttggaagagcagtca

SEQ ID NO: 369712 - DNA, 25 bp, Mus musculus
tgaacctattttggttgataatccc

SEQ ID NO: 369713 - DNA, 25 bp, Mus musculus
tgaacctcaacaccaagatgatacc

SEQ ID NO: 369714 - DNA, 25 bp, Mus musculus
tgaacctcaccagcatgtccaaaat

SEQ ID NO: 369715 - DNA, 25 bp, Mus musculus
tgaacctcagaaacagaacttacac

SEQ ID NO: 369716 - DNA, 25 bp, Mus musculus
tgaacctcagaaacatcattcaaga

SEQ ID NO: 369717 - DNA, 25 bp, Mus musculus
tgaacctcagcattgtgatgaccac

SEQ ID NO: 369718 - DNA, 25 bp, Mus musculus
tgaacctccgaacctgattcacaga

SEQ ID NO: 369719 - DNA, 25 bp, Mus musculus
tgaacctctcaacctgtctgcaaac

SEQ ID NO: 369720 - DNA, 25 bp, Mus musculus
tgaacctctgaaactgaactttcta

SEQ ID NO: 369721 - DNA, 25 bp, Mus musculus
tgaacctctgaacctagtgctacaa

SEQ ID NO: 369722 - DNA, 25 bp, Mus musculus
tgaacctctgaacctatactttggc

SEQ ID NO: 369723 - DNA, 25 bp, Mus musculus
tgaacctctgaacctcatagttttg

SEQ ID NO: 369724 - DNA, 25 bp, Mus musculus
tgaacctctgaacctccaccactgg

SEQ ID NO: 369725 - DNA, 25 bp, Mus musculus
tgaacctctgaacctctccttcttc

SEQ ID NO: 369726 - DNA, 25 bp, Mus musculus
tgaacctctgaacctgacagagatt

SEQ ID NO: 369727 - DNA, 25 bp, Mus musculus
tgaacctctgaacctgacccagaag

SEQ ID NO: 369728 - DNA, 25 bp, Mus musculus
tgaacctctgaacctgctccgcccc

SEQ ID NO: 369729 - DNA, 25 bp, Mus musculus
tgaacctctgaacctgtggatattg

SEQ ID NO: 369730 - DNA, 25 bp, Mus musculus
tgaacctctgaacttgtggcagggc

SEQ ID NO: 369731 - DNA, 25 bp, Mus musculus
tgaacctgaaaacattattatgtta

SEQ ID NO: 369732 - DNA, 25 bp, Mus musculus
tgaacctgcaggtactaacaccaca

SEQ ID NO: 369733 - DNA, 25 bp, Mus musculus
tgaacctgcaggtcttttcatgtgt

SEQ ID NO: 369734 - DNA, 25 bp, Mus musculus
tgaacctgcagtggaccccgaagga

SEQ ID NO: 369735 - DNA, 25 bp, Mus musculus
tgaacctgctgctagcccgggcccc

SEQ ID NO: 369736 - DNA, 25 bp, Mus musculus
tgaacctgctgctagccctgctctt

SEQ ID NO: 369737 - DNA, 25 bp, Mus musculus
tgaacctggaaaacactggccaaaa

SEQ ID NO: 369738 - DNA, 25 bp, Mus musculus
tgaacctggaaggccaaatccttgt

SEQ ID NO: 369739 - DNA, 25 bp, Mus musculus
tgaaccttgagaggcttatacccct

SEQ ID NO: 369740 - DNA, 25 bp, Mus musculus
tgaaccttggcatgaataggttgaa

SEQ ID NO: 369741 - DNA, 25 bp, Mus musculus
tgaaccttgggtggcttgtcccttg

SEQ ID NO: 369742 - DNA, 25 bp, Mus musculus
tgaacgacatcgaagacatgctcca

SEQ ID NO: 369743 - DNA, 25 bp, Mus musculus
tgaacgaggaggctgtgtctgcttc

SEQ ID NO: 369744 - DNA, 25 bp, Mus musculus
tgaacgatttctgatcgtctgccgt

SEQ ID NO: 369745 - DNA, 25 bp, Mus musculus
tgaacgcaaagaggtaaatgatctg

SEQ ID NO: 369746 - DNA, 25 bp, Mus musculus
tgaacgcaaagagtaacttgtttga

SEQ ID NO: 369747 - DNA, 25 bp, Mus musculus
tgaacgccatagaaaagtttcactt

SEQ ID NO: 369748 - DNA, 25 bp, Mus musculus
tgaacgccatagaagtttcactcac

SEQ ID NO: 369749 - DNA, 25 bp, Mus musculus
tgaacgccatagcatcaaaagacgt

SEQ ID NO: 369750 - DNA, 25 bp, Mus musculus
tgaacgccatagtggcattgaacca

SEQ ID NO: 369751 - DNA, 25 bp, Mus musculus
tgaacgcccgggcctggaagcgctg

SEQ ID NO: 369752 - DNA, 25 bp, Mus musculus
tgaacggacaagaagtattttatct

SEQ ID NO: 369753 - DNA, 25 bp, Mus musculus
tgaacggacaagttgtgtgcgctgt

SEQ ID NO: 369754 - DNA, 25 bp, Mus musculus
tgaacggcatcaggcgcagatagat

SEQ ID NO: 369755 - DNA, 25 bp, Mus musculus
tgaacgggagacaggtacttgtgga

SEQ ID NO: 369756 - DNA, 25 bp, Mus musculus
tgaacgggtgtgactctcttttggc

SEQ ID NO: 369757 - DNA, 25 bp, Mus musculus
tgaacgtcacaggcatatatcgagc

SEQ ID NO: 369758 - DNA, 25 bp, Mus musculus
tgaacgtggattccctccatccata

SEQ ID NO: 369759 - DNA, 25 bp, Mus musculus
tgaacgtgttagactcccatttcca

SEQ ID NO: 369760 - DNA, 25 bp, Mus musculus
tgaactaaagcttgacaaaaaaggg

SEQ ID NO: 369761 - DNA, 25 bp, Mus musculus
tgaactaaaggagtcaaggagtatc

SEQ ID NO: 369762 - DNA, 25 bp, Mus musculus
tgaactaatcaaggacactgacatc

SEQ ID NO: 369763 - DNA, 25 bp, Mus musculus
tgaactacagtgaagatcgttacca

SEQ ID NO: 369764 - DNA, 25 bp, Mus musculus
tgaactaccagtccggcttcagcct

SEQ ID NO: 369765 - DNA, 25 bp, Mus musculus
tgaactactatgaagacatccgttc

SEQ ID NO: 369766 - DNA, 25 bp, Mus musculus
tgaactacttaaactccgactgatt

SEQ ID NO: 369767 - DNA, 25 bp, Mus musculus
tgaactacttaaagctctggattac

SEQ ID NO: 369768 - DNA, 25 bp, Mus musculus
tgaactagagcttctggaatttctg

SEQ ID NO: 369769 - DNA, 25 bp, Mus musculus
tgaactagcctggcatcccagcctt

SEQ ID NO: 369770 - DNA, 25 bp, Mus musculus
tgaactattcaagagcccccaattt

SEQ ID NO: 369771 - DNA, 25 bp, Mus musculus
tgaactatttccagcactggccagt

SEQ ID NO: 369772 - DNA, 25 bp, Mus musculus
tgaactcacagaaagcctcatatag

SEQ ID NO: 369773 - DNA, 25 bp, Mus musculus
tgaactcactgtgaatgggaacaca

SEQ ID NO: 369774 - DNA, 25 bp, Mus musculus
tgaactcagtgagagttgtagtgca

SEQ ID NO: 369775 - DNA, 25 bp, Mus musculus
tgaactcatcaagatgtttgacaag

SEQ ID NO: 369776 - DNA, 25 bp, Mus musculus
tgaactcatcaagtgctcggcgctc

SEQ ID NO: 369777 - DNA, 25 bp, Mus musculus
tgaactccagggaggttagaaggat

SEQ ID NO: 369778 - DNA, 25 bp, Mus musculus
tgaactccctgcagcttgacgtggc

SEQ ID NO: 369779 - DNA, 25 bp, Mus musculus
tgaactcctgaaagaaattcaagcc

SEQ ID NO: 369780 - DNA, 25 bp, Mus musculus
tgaactcctgagatatgaatctgaa

SEQ ID NO: 369781 - DNA, 25 bp, Mus musculus
tgaactcgcaggcaccttttgtgtc

SEQ ID NO: 369782 - DNA, 25 bp, Mus musculus
tgaactcgcaggttctggctggact

SEQ ID NO: 369783 - DNA, 25 bp, Mus musculus
tgaactctatcatattgcagcaccc

SEQ ID NO: 369784 - DNA, 25 bp, Mus musculus
tgaactctattcagctcccattttc

SEQ ID NO: 369785 - DNA, 25 bp, Mus musculus
tgaactctcagacacatgcctggac

SEQ ID NO: 369786 - DNA, 25 bp, Mus musculus
tgaactctcaggaaacccaaggaaa

SEQ ID NO: 369787 - DNA, 25 bp, Mus musculus
tgaactctcatcaggtgaaaacatg

SEQ ID NO: 369788 - DNA, 25 bp, Mus musculus
tgaactctcatcagttcttacccaa

SEQ ID NO: 369789 - DNA, 25 bp, Mus musculus
tgaactctccagagtgctacaataa

SEQ ID NO: 369790 - DNA, 25 bp, Mus musculus
tgaactctgaaaaagtcctaatcaa

SEQ ID NO: 369791 - DNA, 25 bp, Mus musculus
tgaactctggaaggaaaaaaatctg

SEQ ID NO: 369792 - DNA, 25 bp, Mus musculus
tgaactctggaaggctgtcaagaaa

SEQ ID NO: 369793 - DNA, 25 bp, Mus musculus
tgaactcttcaagagagatcctggc

SEQ ID NO: 369794 - DNA, 25 bp, Mus musculus
tgaactcttcaagatcctaaatttg

SEQ ID NO: 369795 - DNA, 25 bp, Mus musculus
tgaactgaatgtgtttcctttgcca

SEQ ID NO: 369796 - DNA, 25 bp, Mus musculus
tgaactgaggagacttcttcgaggg

SEQ ID NO: 369797 - DNA, 25 bp, Mus musculus
tgaactgaggagggtggccaaacag

SEQ ID NO: 369798 - DNA, 25 bp, Mus musculus
tgaactgatgaccaaacgggctgta

SEQ ID NO: 369799 - DNA, 25 bp, Mus musculus
tgaactgatgaccgcccagctctca

SEQ ID NO: 369800 - DNA, 25 bp, Mus musculus
tgaactgcacagaggggctctttag

SEQ ID NO: 369801 - DNA, 25 bp, Mus musculus
tgaactgcattcaggacaggggtcc

SEQ ID NO: 369802 - DNA, 25 bp, Mus musculus
tgaactgcctgacttgtgacacctg

SEQ ID NO: 369803 - DNA, 25 bp, Mus musculus
tgaactgcgcaggttacatccaggc

SEQ ID NO: 369804 - DNA, 25 bp, Mus musculus
tgaactgcgggacatctatgacctg

SEQ ID NO: 369805 - DNA, 25 bp, Mus musculus
tgaactgcgggagtctttgtctgaa

SEQ ID NO: 369806 - DNA, 25 bp, Mus musculus
tgaactgcttccctgtgctggtcca

SEQ ID NO: 369807 - DNA, 25 bp, Mus musculus
tgaactgcttccctgtggtattatt

SEQ ID NO: 369808 - DNA, 25 bp, Mus musculus
tgaactggacaggtacctctaagtc

SEQ ID NO: 369809 - DNA, 25 bp, Mus musculus
tgaactggcagaacagctgatttta

SEQ ID NO: 369810 - DNA, 25 bp, Mus musculus
tgaactggctacctttctgaaggac

SEQ ID NO: 369811 - DNA, 25 bp, Mus musculus
tgaactggctgactgccttgtgtgg

SEQ ID NO: 369812 - DNA, 25 bp, Mus musculus
tgaactggctgactgctgatctgcc

SEQ ID NO: 369813 - DNA, 25 bp, Mus musculus
tgaactggctgactgctgtagtgga

SEQ ID NO: 369814 - DNA, 25 bp, Mus musculus
tgaactgggccgctctctgcctctc

SEQ ID NO: 369815 - DNA, 25 bp, Mus musculus
tgaactgttcaagaatgccatgaga

SEQ ID NO: 369816 - DNA, 25 bp, Mus musculus
tgaactgttcagacgcctccttggc

SEQ ID NO: 369817 - DNA, 25 bp, Mus musculus
tgaactgttgaataagttcgtgtgt

SEQ ID NO: 369818 - DNA, 25 bp, Mus musculus
tgaactgttggcccttgattgtgat

SEQ ID NO: 369819 - DNA, 25 bp, Mus musculus
tgaactgtttgatcacattccagct

SEQ ID NO: 369820 - DNA, 25 bp, Mus musculus
tgaacttattcagagatttcctctg

SEQ ID NO: 369821 - DNA, 25 bp, Mus musculus
tgaacttcaagctcttttggaagaa

SEQ ID NO: 369822 - DNA, 25 bp, Mus musculus
tgaacttcagcagagactccaagaa

SEQ ID NO: 369823 - DNA, 25 bp, Mus musculus
tgaacttctgcctagcatcaacgat

SEQ ID NO: 369824 - DNA, 25 bp, Mus musculus
tgaacttctgcctaggtatgtctat

SEQ ID NO: 369825 - DNA, 25 bp, Mus musculus
tgaacttctgcctaggtcctcaact

SEQ ID NO: 369826 - DNA, 25 bp, Mus musculus
tgaacttgaagctggttcatgtctt

SEQ ID NO: 369827 - DNA, 25 bp, Mus musculus
tgaacttgaggacccaagtttcttc

SEQ ID NO: 369828 - DNA, 25 bp, Mus musculus
tgaacttgggaatgtacctgaactt

SEQ ID NO: 369829 - DNA, 25 bp, Mus musculus
tgaacttgggttttatgattccctt

SEQ ID NO: 369830 - DNA, 25 bp, Mus musculus
tgaacttggtccaggcaaacaggga

SEQ ID NO: 369831 - DNA, 25 bp, Mus musculus
tgaacttgttggatttgaacttttt

SEQ ID NO: 369832 - DNA, 25 bp, Mus musculus
tgaactttctccaagatggcctaga

SEQ ID NO: 369833 - DNA, 25 bp, Mus musculus
tgaactttgaatgctcacactgcct

SEQ ID NO: 369834 - DNA, 25 bp, Mus musculus
tgaacttttttgctctctggagcca

SEQ ID NO: 369835 - DNA, 25 bp, Mus musculus
tgaagaaaactgtggcaacataaca

SEQ ID NO: 369836 - DNA, 25 bp, Mus musculus
tgaagaaaagcccctttcctcgatg

SEQ ID NO: 369837 - DNA, 25 bp, Mus musculus
tgaagaaaagcgcagaagagcagtg

SEQ ID NO: 369838 - DNA, 25 bp, Mus musculus
tgaagaaaaggaaatgttattccca

SEQ ID NO: 369839 - DNA, 25 bp, Mus musculus
tgaagaaaaggaagatgaggagctc

SEQ ID NO: 369840 - DNA, 25 bp, Mus musculus
tgaagaaaaggccttggcaattaaa

SEQ ID NO: 369841 - DNA, 25 bp, Mus musculus
tgaagaaaagtactctcaaaaagaa

SEQ ID NO: 369842 - DNA, 25 bp, Mus musculus
tgaagaaaattattgatattttcat

SEQ ID NO: 369843 - DNA, 25 bp, Mus musculus
tgaagaaactcttttttctcctctt

SEQ ID NO: 369844 - DNA, 25 bp, Mus musculus
tgaagaaagaacatgcataccaggt

SEQ ID NO: 369845 - DNA, 25 bp, Mus musculus
tgaagaaagagcgagatggacagag

SEQ ID NO: 369846 - DNA, 25 bp, Mus musculus
tgaagaaagagcgatacttggtaac

SEQ ID NO: 369847 - DNA, 25 bp, Mus musculus
tgaagaaatcgagcgccaggctccg

SEQ ID NO: 369848 - DNA, 25 bp, Mus musculus
tgaagaaatgcaaacccagccatac

SEQ ID NO: 369849 - DNA, 25 bp, Mus musculus
tgaagaaatgttgttatccgatgca

SEQ ID NO: 369850 - DNA, 25 bp, Mus musculus
tgaagaacaaggcagctgcaggaaa

SEQ ID NO: 369851 - DNA, 25 bp, Mus musculus
tgaagaacagagcatttagctcctc

SEQ ID NO: 369852 - DNA, 25 bp, Mus musculus
tgaagaacagggagtgcttggtgcc

SEQ ID NO: 369853 - DNA, 25 bp, Mus musculus
tgaagaacatcgagaagccaggtct

SEQ ID NO: 369854 - DNA, 25 bp, Mus musculus
tgaagaacatgatgcaaggagacgt

SEQ ID NO: 369855 - DNA, 25 bp, Mus musculus
tgaagaacatggactggaaagttaa

SEQ ID NO: 369856 - DNA, 25 bp, Mus musculus
tgaagaaccaagcaatgtcttcaat

SEQ ID NO: 369857 - DNA, 25 bp, Mus musculus
tgaagaaccagggccagtgcgggtc

SEQ ID NO: 369858 - DNA, 25 bp, Mus musculus
tgaagaacctaaggcccgtgtcttt

SEQ ID NO: 369859 - DNA, 25 bp, Mus musculus
tgaagaacctaatatcaggacaagc

SEQ ID NO: 369860 - DNA, 25 bp, Mus musculus
tgaagaacctgcaactggacaataa

SEQ ID NO: 369861 - DNA, 25 bp, Mus musculus
tgaagaacgaaaagggaactgtgaa

SEQ ID NO: 369862 - DNA, 25 bp, Mus musculus
tgaagaacgggtatggctttgtgga

SEQ ID NO: 369863 - DNA, 25 bp, Mus musculus
tgaagaacggtctgttatgttctga

SEQ ID NO: 369864 - DNA, 25 bp, Mus musculus
tgaagaactaaatgaatgccatgag

SEQ ID NO: 369865 - DNA, 25 bp, Mus musculus
tgaagaactaaatgcgaaatcacca

SEQ ID NO: 369866 - DNA, 25 bp, Mus musculus
tgaagaactggagaaaccatggaat

SEQ ID NO: 369867 - DNA, 25 bp, Mus musculus
tgaagaactggagtattttaaccac

SEQ ID NO: 369868 - DNA, 25 bp, Mus musculus
tgaagaagaaaaagggtgatcctga

SEQ ID NO: 369869 - DNA, 25 bp, Mus musculus
tgaagaagaagcagcaacagttgga

SEQ ID NO: 369870 - DNA, 25 bp, Mus musculus
tgaagaagagagggactcaaagctg

SEQ ID NO: 369871 - DNA, 25 bp, Mus musculus
tgaagaagagcagtttccggaggtg

SEQ ID NO: 369872 - DNA, 25 bp, Mus musculus
tgaagaagaggtcacgaaagaagga

SEQ ID NO: 369873 - DNA, 25 bp, Mus musculus
tgaagaagatgactttgaaaaagca

SEQ ID NO: 369874 - DNA, 25 bp, Mus musculus
tgaagaagatggatgcagattcctg

SEQ ID NO: 369875 - DNA, 25 bp, Mus musculus
tgaagaagatggattatgacaatga

SEQ ID NO: 369876 - DNA, 25 bp, Mus musculus
tgaagaagatgggcctgacggagga

SEQ ID NO: 369877 - DNA, 25 bp, Mus musculus
tgaagaagattattgatattttcat

SEQ ID NO: 369878 - DNA, 25 bp, Mus musculus
tgaagaagcaatatggtattcatgc

SEQ ID NO: 369879 - DNA, 25 bp, Mus musculus
tgaagaagcaatgaactcccaggct

SEQ ID NO: 369880 - DNA, 25 bp, Mus musculus
tgaagaagcactcagcacggcagct

SEQ ID NO: 369881 - DNA, 25 bp, Mus musculus
tgaagaagcacttttagatggctaa

SEQ ID NO: 369882 - DNA, 25 bp, Mus musculus
tgaagaagcttctggaggctctttc

SEQ ID NO: 369883 - DNA, 25 bp, Mus musculus
tgaagaaggcaaagagagacacacc

SEQ ID NO: 369884 - DNA, 25 bp, Mus musculus
tgaagaagtaaccctcctcccctgc

SEQ ID NO: 369885 - DNA, 25 bp, Mus musculus
tgaagaagtcaagccaggtgcccag

SEQ ID NO: 369886 - DNA, 25 bp, Mus musculus
tgaagaagtcaagggaaaagtatgt

SEQ ID NO: 369887 - DNA, 25 bp, Mus musculus
tgaagaagtggggtgccgccatgct

SEQ ID NO: 369888 - DNA, 25 bp, Mus musculus
tgaagaagtttgcagctaggagccc

SEQ ID NO: 369889 - DNA, 25 bp, Mus musculus
tgaagaagtttgcagtgtgtgacat

SEQ ID NO: 369890 - DNA, 25 bp, Mus musculus
tgaagaatcaagaaactgatctcag

SEQ ID NO: 369891 - DNA, 25 bp, Mus musculus
tgaagaatctagagctgatcataag

SEQ ID NO: 369892 - DNA, 25 bp, Mus musculus
tgaagaatctgaaggtccagcctga

SEQ ID NO: 369893 - DNA, 25 bp, Mus musculus
tgaagaatgtggcttcccagacacc

SEQ ID NO: 369894 - DNA, 25 bp, Mus musculus
tgaagaattcagtgaacagagtatc

SEQ ID NO: 369895 - DNA, 25 bp, Mus musculus
tgaagaattccaaatagcatagctt

SEQ ID NO: 369896 - DNA, 25 bp, Mus musculus
tgaagaattccaaatgcttactttt

SEQ ID NO: 369897 - DNA, 25 bp, Mus musculus
tgaagaattccatcaatggaaaaaa

SEQ ID NO: 369898 - DNA, 25 bp, Mus musculus
tgaagaatttcaagactgcgagtgc

SEQ ID NO: 369899 - DNA, 25 bp, Mus musculus
tgaagaatttgtggaagaggagaca

SEQ ID NO: 369900 - DNA, 25 bp, Mus musculus
tgaagacaaggtgctggtctcctac

SEQ ID NO: 369901 - DNA, 25 bp, Mus musculus
tgaagacaagtgcagatgaaatcat

SEQ ID NO: 369902 - DNA, 25 bp, Mus musculus
tgaagacacaggattatgtactgaa

SEQ ID NO: 369903 - DNA, 25 bp, Mus musculus
tgaagacacaggggctccttattgg

SEQ ID NO: 369904 - DNA, 25 bp, Mus musculus
tgaagacacgggtgatgtcccgcac

SEQ ID NO: 369905 - DNA, 25 bp, Mus musculus
tgaagacaggagtcttttattcaaa

SEQ ID NO: 369906 - DNA, 25 bp, Mus musculus
tgaagacatagggaatctgtccttg

SEQ ID NO: 369907 - DNA, 25 bp, Mus musculus
tgaagacatgaggactttcagtcag

SEQ ID NO: 369908 - DNA, 25 bp, Mus musculus
tgaagaccaaaacgccagccacctg

SEQ ID NO: 369909 - DNA, 25 bp, Mus musculus
tgaagaccaaaacgggggagcagtg

SEQ ID NO: 369910 - DNA, 25 bp, Mus musculus
tgaagaccaacagaacttgacgaga

SEQ ID NO: 369911 - DNA, 25 bp, Mus musculus
tgaagaccatcttgcagtgcgccct

SEQ ID NO: 369912 - DNA, 25 bp, Mus musculus
tgaagaccatgaagggctgccaaca

SEQ ID NO: 369913 - DNA, 25 bp, Mus musculus
tgaagaccatgaagttggacaactt

SEQ ID NO: 369914 - DNA, 25 bp, Mus musculus
tgaagacccagaggacacaaagatc

SEQ ID NO: 369915 - DNA, 25 bp, Mus musculus
tgaagacccagaggaggaagagttt

SEQ ID NO: 369916 - DNA, 25 bp, Mus musculus
tgaagaccccactcagagatgctga

SEQ ID NO: 369917 - DNA, 25 bp, Mus musculus
tgaagaccccactgactcatcccag

SEQ ID NO: 369918 - DNA, 25 bp, Mus musculus
tgaagaccccgggtcttgttgcagc

SEQ ID NO: 369919 - DNA, 25 bp, Mus musculus
tgaagaccctcacctccacgcccta

SEQ ID NO: 369920 - DNA, 25 bp, Mus musculus
tgaagaccctgacagcaagaccatc

SEQ ID NO: 369921 - DNA, 25 bp, Mus musculus
tgaagaccgggcatctggagatttt

SEQ ID NO: 369922 - DNA, 25 bp, Mus musculus
tgaagacctcccataacacgacaag

SEQ ID NO: 369923 - DNA, 25 bp, Mus musculus
tgaagacctgctgccgacaacctca

SEQ ID NO: 369924 - DNA, 25 bp, Mus musculus
tgaagacctggcacagtcaggtttt

SEQ ID NO: 369925 - DNA, 25 bp, Mus musculus
tgaagacctggcacattcctcttca

SEQ ID NO: 369926 - DNA, 25 bp, Mus musculus
tgaagacgaagaaaggccacggaac

SEQ ID NO: 369927 - DNA, 25 bp, Mus musculus
tgaagacgaagaaaggctacttcgt

SEQ ID NO: 369928 - DNA, 25 bp, Mus musculus
tgaagacgagttggtgtcagaattc

SEQ ID NO: 369929 - DNA, 25 bp, Mus musculus
tgaagacgagttttcgtttctctgt

SEQ ID NO: 369930 - DNA, 25 bp, Mus musculus
tgaagacggacaccatgatatcttt

SEQ ID NO: 369931 - DNA, 25 bp, Mus musculus
tgaagacggacagtgttacgaagcg

SEQ ID NO: 369932 - DNA, 25 bp, Mus musculus
tgaagacggtgcttggcctgttctt

SEQ ID NO: 369933 - DNA, 25 bp, Mus musculus
tgaagacgtgagcaagatggggctc

SEQ ID NO: 369934 - DNA, 25 bp, Mus musculus
tgaagacgtggaggcatccaggctg

SEQ ID NO: 369935 - DNA, 25 bp, Mus musculus
tgaagacgtgggcgatggttgtgga

SEQ ID NO: 369936 - DNA, 25 bp, Mus musculus
tgaagacgtgggcggctgttttgag

SEQ ID NO: 369937 - DNA, 25 bp, Mus musculus
tgaagactatcaccttaaccaacct

SEQ ID NO: 369938 - DNA, 25 bp, Mus musculus
tgaagactcctctgattcagatgcc

SEQ ID NO: 369939 - DNA, 25 bp, Mus musculus
tgaagactctggtaggaacaacctt

SEQ ID NO: 369940 - DNA, 25 bp, Mus musculus
tgaagactctgtgcctggaatcaaa

SEQ ID NO: 369941 - DNA, 25 bp, Mus musculus
tgaagactgacaagcactgccccaa

SEQ ID NO: 369942 - DNA, 25 bp, Mus musculus
tgaagactgtggaaacaccaggcaa

SEQ ID NO: 369943 - DNA, 25 bp, Mus musculus
tgaagactgtggtcttgccgtcact

SEQ ID NO: 369944 - DNA, 25 bp, Mus musculus
tgaagacttggagcactttgaggaa

SEQ ID NO: 369945 - DNA, 25 bp, Mus musculus
tgaagactttagtcctgcactagaa

SEQ ID NO: 369946 - DNA, 25 bp, Mus musculus
tgaagacttttgggctctatacaac

SEQ ID NO: 369947 - DNA, 25 bp, Mus musculus
tgaagagaaaatgaaagcagaccgc

SEQ ID NO: 369948 - DNA, 25 bp, Mus musculus
tgaagagaaagtacacactgcgctg

SEQ ID NO: 369949 - DNA, 25 bp, Mus musculus
tgaagagaaatggttcccataacaa

SEQ ID NO: 369950 - DNA, 25 bp, Mus musculus
tgaagagaatatgaccacctatcta

SEQ ID NO: 369951 - DNA, 25 bp, Mus musculus
tgaagagaatatgagatcctgcaac

SEQ ID NO: 369952 - DNA, 25 bp, Mus musculus
tgaagagaatatgagttccagcagc

SEQ ID NO: 369953 - DNA, 25 bp, Mus musculus
tgaagagacaaggcatagtgcagtc

SEQ ID NO: 369954 - DNA, 25 bp, Mus musculus
tgaagagacacaagggtaaggaatc

SEQ ID NO: 369955 - DNA, 25 bp, Mus musculus
tgaagagacacaagggtgctgatgg

SEQ ID NO: 369956 - DNA, 25 bp, Mus musculus
tgaagagacttggttgaaaggccac

SEQ ID NO: 369957 - DNA, 25 bp, Mus musculus
tgaagagatggaagatcaccgcctc

SEQ ID NO: 369958 - DNA, 25 bp, Mus musculus
tgaagagattcaaagcagaatacca

SEQ ID NO: 369959 - DNA, 25 bp, Mus musculus
tgaagagcaaatttgacgccgagtt

SEQ ID NO: 369960 - DNA, 25 bp, Mus musculus
tgaagagcaagatcctggcagccac

SEQ ID NO: 369961 - DNA, 25 bp, Mus musculus
tgaagagcacggatgttctttggca

SEQ ID NO: 369962 - DNA, 25 bp, Mus musculus
tgaagagcagacttggaggtaacat

SEQ ID NO: 369963 - DNA, 25 bp, Mus musculus
tgaagagcagatggcccagtgagcc

SEQ ID NO: 369964 - DNA, 25 bp, Mus musculus
tgaagagcaggtatctcagacgagg

SEQ ID NO: 369965 - DNA, 25 bp, Mus musculus
tgaagagcaggttgcttccataaga

SEQ ID NO: 369966 - DNA, 25 bp, Mus musculus
tgaagagcctagaggagaaagtctc

SEQ ID NO: 369967 - DNA, 25 bp, Mus musculus
tgaagagcgaggagacgagcaaaaa

SEQ ID NO: 369968 - DNA, 25 bp, Mus musculus
tgaagagcgaggaggtggaagatat

SEQ ID NO: 369969 - DNA, 25 bp, Mus musculus
tgaagagcgtgggtgtggtggctta

SEQ ID NO: 369970 - DNA, 25 bp, Mus musculus
tgaagagctagagatatgtgtcaca

SEQ ID NO: 369971 - DNA, 25 bp, Mus musculus
tgaagagctcaggtgtaccagctgg

SEQ ID NO: 369972 - DNA, 25 bp, Mus musculus
tgaagagctgctatatccagagcct

SEQ ID NO: 369973 - DNA, 25 bp, Mus musculus
tgaagagctgctggagcaggcacaa

SEQ ID NO: 369974 - DNA, 25 bp, Mus musculus
tgaagagctggtatatccagagcct

SEQ ID NO: 369975 - DNA, 25 bp, Mus musculus
tgaagagctggtggaaggatcatcg

SEQ ID NO: 369976 - DNA, 25 bp, Mus musculus
tgaagagcttgctacaatgggtgac

SEQ ID NO: 369977 - DNA, 25 bp, Mus musculus
tgaagaggaacatgcagaggcacgg

SEQ ID NO: 369978 - DNA, 25 bp, Mus musculus
tgaagaggaacatgggatgtgaagt

SEQ ID NO: 369979 - DNA, 25 bp, Mus musculus
tgaagaggacatcgatccctttgac

SEQ ID NO: 369980 - DNA, 25 bp, Mus musculus
tgaagaggacattcgccaatggcag

SEQ ID NO: 369981 - DNA, 25 bp, Mus musculus
tgaagaggacattcgtctgtattca

SEQ ID NO: 369982 - DNA, 25 bp, Mus musculus
tgaagaggagagtgatgctgttgtg

SEQ ID NO: 369983 - DNA, 25 bp, Mus musculus
tgaagaggaggcgggccccggggac

SEQ ID NO: 369984 - DNA, 25 bp, Mus musculus
tgaagaggaggtcccccagaggtgc

SEQ ID NO: 369985 - DNA, 25 bp, Mus musculus
tgaagaggctgaatgggagccatcg

SEQ ID NO: 369986 - DNA, 25 bp, Mus musculus
tgaagaggcttcctctctttggcac

SEQ ID NO: 369987 - DNA, 25 bp, Mus musculus
tgaagaggcttcctgtctttggcac

SEQ ID NO: 369988 - DNA, 25 bp, Mus musculus
tgaagagggcaaatatggttatgtc

SEQ ID NO: 369989 - DNA, 25 bp, Mus musculus
tgaagagtctccgacgggcactatg

SEQ ID NO: 369990 - DNA, 25 bp, Mus musculus
tgaagagttgtgttagggttttact

SEQ ID NO: 369991 - DNA, 25 bp, Mus musculus
tgaagagtttcctagattgcttcct

SEQ ID NO: 369992 - DNA, 25 bp, Mus musculus
tgaagataacctaagtaccagcagt

SEQ ID NO: 369993 - DNA, 25 bp, Mus musculus
tgaagatacttacagattggccagg

SEQ ID NO: 369994 - DNA, 25 bp, Mus musculus
tgaagatacttacagtcacatgtgg

SEQ ID NO: 369995 - DNA, 25 bp, Mus musculus
tgaagatatttcacggacgtcaggg

SEQ ID NO: 369996 - DNA, 25 bp, Mus musculus
tgaagatcaagatcattgctcctcc

SEQ ID NO: 369997 - DNA, 25 bp, Mus musculus
tgaagatcaagcagatgtggatcag

SEQ ID NO: 369998 - DNA, 25 bp, Mus musculus
tgaagatcatgtgagcatcgtggaa

SEQ ID NO: 369999 - DNA, 25 bp, Mus musculus
tgaagatcctgggggcagtgtatgg

SEQ ID NO: 370000 - DNA, 25 bp, Mus musculus
tgaagatcgatgagctttcactcta

SEQ ID NO: 370001 - DNA, 25 bp, Mus musculus
tgaagatcgcctgtagcaaagtccg

SEQ ID NO: 370002 - DNA, 25 bp, Mus musculus
tgaagatcgtgcccgatgaacgaga

SEQ ID NO: 370003 - DNA, 25 bp, Mus musculus
tgaagatctagtgcgccgtcatgag

SEQ ID NO: 370004 - DNA, 25 bp, Mus musculus
tgaagatctctacagaggaaggcat

SEQ ID NO: 370005 - DNA, 25 bp, Mus musculus
tgaagatctgctttcccaggctaaa

SEQ ID NO: 370006 - DNA, 25 bp, Mus musculus
tgaagatcttgaagccatgatcaaa

SEQ ID NO: 370007 - DNA, 25 bp, Mus musculus
tgaagatcttgaaggataccagaat

SEQ ID NO: 370008 - DNA, 25 bp, Mus musculus
tgaagatgaacagagcctcccaaaa

SEQ ID NO: 370009 - DNA, 25 bp, Mus musculus
tgaagatgaaccggaagtatgaaga

SEQ ID NO: 370010 - DNA, 25 bp, Mus musculus
tgaagatgacacagaccattcttta

SEQ ID NO: 370011 - DNA, 25 bp, Mus musculus
tgaagatgagaaaggtcatttacta

SEQ ID NO: 370012 - DNA, 25 bp, Mus musculus
tgaagatgaggatttcttatctgct

SEQ ID NO: 370013 - DNA, 25 bp, Mus musculus
tgaagatgatgaaagccctctctat

SEQ ID NO: 370014 - DNA, 25 bp, Mus musculus
tgaagatgattttggaagttgcttt

SEQ ID NO: 370015 - DNA, 25 bp, Mus musculus
tgaagatgcagaagacggacaagac

SEQ ID NO: 370016 - DNA, 25 bp, Mus musculus
tgaagatgcagaagtgtatgagaga

SEQ ID NO: 370017 - DNA, 25 bp, Mus musculus
tgaagatgcgcatgggaggctttgt

SEQ ID NO: 370018 - DNA, 25 bp, Mus musculus
tgaagatgctgcaggcaccagaaag

SEQ ID NO: 370019 - DNA, 25 bp, Mus musculus
tgaagatgctgcaggtctgggaagg

SEQ ID NO: 370020 - DNA, 25 bp, Mus musculus
tgaagatggagagcttccctatggc

SEQ ID NO: 370021 - DNA, 25 bp, Mus musculus
tgaagatggcgaaattgggaaagaa

SEQ ID NO: 370022 - DNA, 25 bp, Mus musculus
tgaagatggcgaatcaccgcctccg

SEQ ID NO: 370023 - DNA, 25 bp, Mus musculus
tgaagatgggattgatgatgattct

SEQ ID NO: 370024 - DNA, 25 bp, Mus musculus
tgaagatgtgaagatgatcagtgca

SEQ ID NO: 370025 - DNA, 25 bp, Mus musculus
tgaagatgttgaaagatgatgccac

SEQ ID NO: 370026 - DNA, 25 bp, Mus musculus
tgaagattcaggcttgttccccctg

SEQ ID NO: 370027 - DNA, 25 bp, Mus musculus
tgaagattctcagagttctgaactt

SEQ ID NO: 370028 - DNA, 25 bp, Mus musculus
tgaagattgagagccagcgggccat

SEQ ID NO: 370029 - DNA, 25 bp, Mus musculus
tgaagattgaggagaagaaggtggc

SEQ ID NO: 370030 - DNA, 25 bp, Mus musculus
tgaagattgtcaagatgaaatgtcc

SEQ ID NO: 370031 - DNA, 25 bp, Mus musculus
tgaagatttagagagttccagtgag

SEQ ID NO: 370032 - DNA, 25 bp, Mus musculus
tgaagcaacccgaagcagaagcagg

SEQ ID NO: 370033 - DNA, 25 bp, Mus musculus
tgaagcaacctccagctctcttccg

SEQ ID NO: 370034 - DNA, 25 bp, Mus musculus
tgaagcaactaagattcctctcgtg

SEQ ID NO: 370035 - DNA, 25 bp, Mus musculus
tgaagcaactaaggttcagagaaac

SEQ ID NO: 370036 - DNA, 25 bp, Mus musculus
tgaagcaagtgtctgaacgagaaga

SEQ ID NO: 370037 - DNA, 25 bp, Mus musculus
tgaagcacacaggggtagtgttgcc

SEQ ID NO: 370038 - DNA, 25 bp, Mus musculus
tgaagcaccagcatcggtgtgtggc

SEQ ID NO: 370039 - DNA, 25 bp, Mus musculus
tgaagcaccaggtgaatgggattgc

SEQ ID NO: 370040 - DNA, 25 bp, Mus musculus
tgaagcaccaggtttggaaacagaa

SEQ ID NO: 370041 - DNA, 25 bp, Mus musculus
tgaagcactgagccctccagagctg

SEQ ID NO: 370042 - DNA, 25 bp, Mus musculus
tgaagcactgagccctccccacttg

SEQ ID NO: 370043 - DNA, 25 bp, Mus musculus
tgaagcagaagactctcttctgcag

SEQ ID NO: 370044 - DNA, 25 bp, Mus musculus
tgaagcagaagaggagagtgataat

SEQ ID NO: 370045 - DNA, 25 bp, Mus musculus
tgaagcagaagaggatcctgggcat

SEQ ID NO: 370046 - DNA, 25 bp, Mus musculus
tgaagcagaaggagctaggtggcga

SEQ ID NO: 370047 - DNA, 25 bp, Mus musculus
tgaagcagaagtacctggactatgc

SEQ ID NO: 370048 - DNA, 25 bp, Mus musculus
tgaagcaggaagcaggaagcctgtg

SEQ ID NO: 370049 - DNA, 25 bp, Mus musculus
tgaagcaggaatagcctgcacaggt

SEQ ID NO: 370050 - DNA, 25 bp, Mus musculus
tgaagcagggaacccagggggcaag

SEQ ID NO: 370051 - DNA, 25 bp, Mus musculus
tgaagcagggaagcctggaccccca

SEQ ID NO: 370052 - DNA, 25 bp, Mus musculus
tgaagcagggagggcaagctcccca

SEQ ID NO: 370053 - DNA, 25 bp, Mus musculus
tgaagcagggagtaatgcatgaaat

SEQ ID NO: 370054 - DNA, 25 bp, Mus musculus
tgaagcaggtgaagatgacgatggc

SEQ ID NO: 370055 - DNA, 25 bp, Mus musculus
tgaagcatgcggatccccggatcca

SEQ ID NO: 370056 - DNA, 25 bp, Mus musculus
tgaagcatgcggtttctgatgtctg

SEQ ID NO: 370057 - DNA, 25 bp, Mus musculus
tgaagcatggcaatgaaatctacat

SEQ ID NO: 370058 - DNA, 25 bp, Mus musculus
tgaagcatggccagaagacatgttt

SEQ ID NO: 370059 - DNA, 25 bp, Mus musculus
tgaagcatttaatgcctcctgcctg

SEQ ID NO: 370060 - DNA, 25 bp, Mus musculus
tgaagccaagattgtaagggccaag

SEQ ID NO: 370061 - DNA, 25 bp, Mus musculus
tgaagccaagccctcccaggacgca

SEQ ID NO: 370062 - DNA, 25 bp, Mus musculus
tgaagccaagggcccagtgtgcatc

SEQ ID NO: 370063 - DNA, 25 bp, Mus musculus
tgaagccacgcttgcctctccacct

SEQ ID NO: 370064 - DNA, 25 bp, Mus musculus
tgaagccacgttgtgggacctaaga

SEQ ID NO: 370065 - DNA, 25 bp, Mus musculus
tgaagccagacagccccaggatcct

SEQ ID NO: 370066 - DNA, 25 bp, Mus musculus
tgaagccagacagggttgccatacc

SEQ ID NO: 370067 - DNA, 25 bp, Mus musculus
tgaagccagaccgagatgccttgga

SEQ ID NO: 370068 - DNA, 25 bp, Mus musculus
tgaagccagaccgaggatcaaccat

SEQ ID NO: 370069 - DNA, 25 bp, Mus musculus
tgaagccagagatttaaggcaagaa

SEQ ID NO: 370070 - DNA, 25 bp, Mus musculus
tgaagccagagggaggcttcagttg

SEQ ID NO: 370071 - DNA, 25 bp, Mus musculus
tgaagccagaggtacttgatgtgtg

SEQ ID NO: 370072 - DNA, 25 bp, Mus musculus
tgaagccagctaaaggtatgctaac

SEQ ID NO: 370073 - DNA, 25 bp, Mus musculus
tgaagccagtaaacaaggccagggc

SEQ ID NO: 370074 - DNA, 25 bp, Mus musculus
tgaagccatgaaaggaacagagtgg

SEQ ID NO: 370075 - DNA, 25 bp, Mus musculus
tgaagccatgtgcacagccctgagt

SEQ ID NO: 370076 - DNA, 25 bp, Mus musculus
tgaagcccagaagccctacccatgt

SEQ ID NO: 370077 - DNA, 25 bp, Mus musculus
tgaagcccagaagctgtgattggac

SEQ ID NO: 370078 - DNA, 25 bp, Mus musculus
tgaagcccagcagatttggcctggc

SEQ ID NO: 370079 - DNA, 25 bp, Mus musculus
tgaagcccagcaggccagtgtgctt

SEQ ID NO: 370080 - DNA, 25 bp, Mus musculus
tgaagcccgcaaaagctccctccaa

SEQ ID NO: 370081 - DNA, 25 bp, Mus musculus
tgaagcccggagggatccttttgtg

SEQ ID NO: 370082 - DNA, 25 bp, Mus musculus
tgaagccctggctgggggatgggct

SEQ ID NO: 370083 - DNA, 25 bp, Mus musculus
tgaagcccttcaagagcttctgcag

SEQ ID NO: 370084 - DNA, 25 bp, Mus musculus
tgaagcccttcaaggatatggacta

SEQ ID NO: 370085 - DNA, 25 bp, Mus musculus
tgaagcccttcacagctgacattat

SEQ ID NO: 370086 - DNA, 25 bp, Mus musculus
tgaagccctttatctgacttgttgg

SEQ ID NO: 370087 - DNA, 25 bp, Mus musculus
tgaagccctttatctgtgaggtctg

SEQ ID NO: 370088 - DNA, 25 bp, Mus musculus
tgaagccgactcagatccgtgatga

SEQ ID NO: 370089 - DNA, 25 bp, Mus musculus
tgaagcctaagaaggcaccgacagc

SEQ ID NO: 370090 - DNA, 25 bp, Mus musculus
tgaagcctcatcggaaatttgtatg

SEQ ID NO: 370091 - DNA, 25 bp, Mus musculus
tgaagcctcgcaaactatttcaatg

SEQ ID NO: 370092 - DNA, 25 bp, Mus musculus
tgaagcctctccaaggtggcccagc

SEQ ID NO: 370093 - DNA, 25 bp, Mus musculus
tgaagcctgaaggtctccaccagct

SEQ ID NO: 370094 - DNA, 25 bp, Mus musculus
tgaagcctgctggtcctacagtgga

SEQ ID NO: 370095 - DNA, 25 bp, Mus musculus
tgaagcctggggatggtgtgacccc

SEQ ID NO: 370096 - DNA, 25 bp, Mus musculus
tgaagccttagaggacgtagagatt

SEQ ID NO: 370097 - DNA, 25 bp, Mus musculus
tgaagccttcaaggcgccccccaca

SEQ ID NO: 370098 - DNA, 25 bp, Mus musculus
tgaagccttcaaggtgaagtacatg

SEQ ID NO: 370099 - DNA, 25 bp, Mus musculus
tgaagccttctcaggccagatttta

SEQ ID NO: 370100 - DNA, 25 bp, Mus musculus
tgaagccttgataggaccttcgaga

SEQ ID NO: 370101 - DNA, 25 bp, Mus musculus
tgaagccttgataggagctgtttac

SEQ ID NO: 370102 - DNA, 25 bp, Mus musculus
tgaagcctttcaggatgaagacctt

SEQ ID NO: 370103 - DNA, 25 bp, Mus musculus
tgaagcctttcaggtgcctctccca

SEQ ID NO: 370104 - DNA, 25 bp, Mus musculus
tgaagcgaagaataggtgtgatgaa

SEQ ID NO: 370105 - DNA, 25 bp, Mus musculus
tgaagcgaaggacggatcttgtaaa

SEQ ID NO: 370106 - DNA, 25 bp, Mus musculus
tgaagcggctacaggcggcaggaaa

SEQ ID NO: 370107 - DNA, 25 bp, Mus musculus
tgaagcgggatctgttctctcagag

SEQ ID NO: 370108 - DNA, 25 bp, Mus musculus
tgaagcggtcttaagaatcaacata

SEQ ID NO: 370109 - DNA, 25 bp, Mus musculus
tgaagcggtgctcactcctggccct

SEQ ID NO: 370110 - DNA, 25 bp, Mus musculus
tgaagctaagccccaagcattctgc

SEQ ID NO: 370111 - DNA, 25 bp, Mus musculus
tgaagctacagggttgaaaaataca

SEQ ID NO: 370112 - DNA, 25 bp, Mus musculus
tgaagctaccaaacgcaagcaccag

SEQ ID NO: 370113 - DNA, 25 bp, Mus musculus
tgaagctacgccaatcaaaaccccc

SEQ ID NO: 370114 - DNA, 25 bp, Mus musculus
tgaagctacgtcgacgcataattaa

SEQ ID NO: 370115 - DNA, 25 bp, Mus musculus
tgaagctatggtaaaagtttcattt

SEQ ID NO: 370116 - DNA, 25 bp, Mus musculus
tgaagctcaagatggagaaatggat

SEQ ID NO: 370117 - DNA, 25 bp, Mus musculus
tgaagctcaaggttgattctttcag

SEQ ID NO: 370118 - DNA, 25 bp, Mus musculus
tgaagctcagaaacttgattgaacc

SEQ ID NO: 370119 - DNA, 25 bp, Mus musculus
tgaagctcagaactttgccaattct

SEQ ID NO: 370120 - DNA, 25 bp, Mus musculus
tgaagctccaggaggcactgaagaa

SEQ ID NO: 370121 - DNA, 25 bp, Mus musculus
tgaagctccaggaggttatttccat

SEQ ID NO: 370122 - DNA, 25 bp, Mus musculus
tgaagctcctgaagacccagggggc

SEQ ID NO: 370123 - DNA, 25 bp, Mus musculus
tgaagctcctgaaggaagaagaact

SEQ ID NO: 370124 - DNA, 25 bp, Mus musculus
tgaagctcgcaaaggctggcaaaac

SEQ ID NO: 370125 - DNA, 25 bp, Mus musculus
tgaagctctgatgcgctctgaggag

SEQ ID NO: 370126 - DNA, 25 bp, Mus musculus
tgaagctgaaggcatcatagacacg

SEQ ID NO: 370127 - DNA, 25 bp, Mus musculus
tgaagctgagagcactctgtggagg

SEQ ID NO: 370128 - DNA, 25 bp, Mus musculus
tgaagctgatcaggctctaagggat

SEQ ID NO: 370129 - DNA, 25 bp, Mus musculus
tgaagctgatgccagtcattgcatt

SEQ ID NO: 370130 - DNA, 25 bp, Mus musculus
tgaagctgatgccagtcattgtata

SEQ ID NO: 370131 - DNA, 25 bp, Mus musculus
tgaagctgctgatgaaccacgcctt

SEQ ID NO: 370132 - DNA, 25 bp, Mus musculus
tgaagctgctgatggtcgacacccg

SEQ ID NO: 370133 - DNA, 25 bp, Mus musculus
tgaagctgctgcagccctgccagtt

SEQ ID NO: 370134 - DNA, 25 bp, Mus musculus
tgaagctgggatcaagcacttcctg

SEQ ID NO: 370135 - DNA, 25 bp, Mus musculus
tgaagctgtagtgcagttgaacact

SEQ ID NO: 370136 - DNA, 25 bp, Mus musculus
tgaagctgtagtgccaactactcaa

SEQ ID NO: 370137 - DNA, 25 bp, Mus musculus
tgaagctttcaaagccattggcaca

SEQ ID NO: 370138 - DNA, 25 bp, Mus musculus
tgaaggaaaaccaggcacgcatcga

SEQ ID NO: 370139 - DNA, 25 bp, Mus musculus
tgaaggaaaagtatgatacagactt

SEQ ID NO: 370140 - DNA, 25 bp, Mus musculus
tgaaggaaagactcaggcagctgga

SEQ ID NO: 370141 - DNA, 25 bp, Mus musculus
tgaaggaaagttacccagcatgcca

SEQ ID NO: 370142 - DNA, 25 bp, Mus musculus
tgaaggaaataaaatggttatgtcc

SEQ ID NO: 370143 - DNA, 25 bp, Mus musculus
tgaaggaagaggggatatgtggtac

SEQ ID NO: 370144 - DNA, 25 bp, Mus musculus
tgaaggaagataaagccatcccgat

SEQ ID NO: 370145 - DNA, 25 bp, Mus musculus
tgaaggaagatacatgttgtcaggt

SEQ ID NO: 370146 - DNA, 25 bp, Mus musculus
tgaaggaagtggaggtggaggaatg

SEQ ID NO: 370147 - DNA, 25 bp, Mus musculus
tgaaggaatacgtgctgcccagttt

SEQ ID NO: 370148 - DNA, 25 bp, Mus musculus
tgaaggaatgggagaatgaaggggg

SEQ ID NO: 370149 - DNA, 25 bp, Mus musculus
tgaaggaatgggagacgtacgcagc

SEQ ID NO: 370150 - DNA, 25 bp, Mus musculus
tgaaggaatggtcacgatctagatc

SEQ ID NO: 370151 - DNA, 25 bp, Mus musculus
tgaaggacaccttaggtattggaaa

SEQ ID NO: 370152 - DNA, 25 bp, Mus musculus
tgaaggacagtaaaggaggcagccc

SEQ ID NO: 370153 - DNA, 25 bp, Mus musculus
tgaaggacatagtttcaggcaccag

SEQ ID NO: 370154 - DNA, 25 bp, Mus musculus
tgaaggacgatgatgtttgtgatcc

SEQ ID NO: 370155 - DNA, 25 bp, Mus musculus
tgaaggacgggcagtaccaggcggc

SEQ ID NO: 370156 - DNA, 25 bp, Mus musculus
tgaaggacgggctctccctacggac

SEQ ID NO: 370157 - DNA, 25 bp, Mus musculus
tgaaggacgggggatggtggacaga

SEQ ID NO: 370158 - DNA, 25 bp, Mus musculus
tgaaggacttgaggaacttcctgta

SEQ ID NO: 370159 - DNA, 25 bp, Mus musculus
tgaaggagaaaggcgccctggctct

SEQ ID NO: 370160 - DNA, 25 bp, Mus musculus
tgaaggagaaaggcgctgacttcct

SEQ ID NO: 370161 - DNA, 25 bp, Mus musculus
tgaaggagaacagcaaacctctgaa

SEQ ID NO: 370162 - DNA, 25 bp, Mus musculus
tgaaggagaacgggaggctgccggc

SEQ ID NO: 370163 - DNA, 25 bp, Mus musculus
tgaaggagaccagaaggactccatg

SEQ ID NO: 370164 - DNA, 25 bp, Mus musculus
tgaaggagactgaaggccttcggat

SEQ ID NO: 370165 - DNA, 25 bp, Mus musculus
tgaaggagactgaaggtgctggggg

SEQ ID NO: 370166 - DNA, 25 bp, Mus musculus
tgaaggagataaaaggacggactgt

SEQ ID NO: 370167 - DNA, 25 bp, Mus musculus
tgaaggagataacaggacggactgt

SEQ ID NO: 370168 - DNA, 25 bp, Mus musculus
tgaaggagatggattctgatgcaat

SEQ ID NO: 370169 - DNA, 25 bp, Mus musculus
tgaaggagatggcaattccggtctt

SEQ ID NO: 370170 - DNA, 25 bp, Mus musculus
tgaaggagcatcagaatttcagatg

SEQ ID NO: 370171 - DNA, 25 bp, Mus musculus
tgaaggagcatcagattccagaatt

SEQ ID NO: 370172 - DNA, 25 bp, Mus musculus
tgaaggagccgctggcttacagggt

SEQ ID NO: 370173 - DNA, 25 bp, Mus musculus
tgaaggagctcagaaggagtgaaaa

SEQ ID NO: 370174 - DNA, 25 bp, Mus musculus
tgaaggagctgaggtgggctggtat

SEQ ID NO: 370175 - DNA, 25 bp, Mus musculus
tgaaggagctggtacagacttacgt

SEQ ID NO: 370176 - DNA, 25 bp, Mus musculus
tgaaggaggaggttggaagtcggat

SEQ ID NO: 370177 - DNA, 25 bp, Mus musculus
tgaaggaggcagtgttttgtcaagt

SEQ ID NO: 370178 - DNA, 25 bp, Mus musculus
tgaaggagtaggccctgtattggaa

SEQ ID NO: 370179 - DNA, 25 bp, Mus musculus
tgaaggagtattcatggctgctcgc

SEQ ID NO: 370180 - DNA, 25 bp, Mus musculus
tgaaggagtgtggcatgttcatcac

SEQ ID NO: 370181 - DNA, 25 bp, Mus musculus
tgaaggagtttctggtgtgatccct

SEQ ID NO: 370182 - DNA, 25 bp, Mus musculus
tgaaggatactccagatgccaacgc

SEQ ID NO: 370183 - DNA, 25 bp, Mus musculus
tgaaggatcaaggcagagatgcttt

SEQ ID NO: 370184 - DNA, 25 bp, Mus musculus
tgaaggatcaggatgacgatgctga

SEQ ID NO: 370185 - DNA, 25 bp, Mus musculus
tgaaggatcaggcccttaaggatga

SEQ ID NO: 370186 - DNA, 25 bp, Mus musculus
tgaaggatgaagagctaaggcgcat

SEQ ID NO: 370187 - DNA, 25 bp, Mus musculus
tgaaggatgaagagggccccgtggg

SEQ ID NO: 370188 - DNA, 25 bp, Mus musculus
tgaaggatgacttggagattttgca

SEQ ID NO: 370189 - DNA, 25 bp, Mus musculus
tgaaggatgccagcccaaaccaggt

SEQ ID NO: 370190 - DNA, 25 bp, Mus musculus
tgaaggatgccagccctccagggcc

SEQ ID NO: 370191 - DNA, 25 bp, Mus musculus
tgaaggcaaaaaggccaaagcctca

SEQ ID NO: 370192 - DNA, 25 bp, Mus musculus
tgaaggcaacagaatgaagggacct

SEQ ID NO: 370193 - DNA, 25 bp, Mus musculus
tgaaggcaacagtgaagggacctgc

SEQ ID NO: 370194 - DNA, 25 bp, Mus musculus
tgaaggcaacatcgctgtgggcaaa

SEQ ID NO: 370195 - DNA, 25 bp, Mus musculus
tgaaggcaacatcggatggcacttc

SEQ ID NO: 370196 - DNA, 25 bp, Mus musculus
tgaaggcaagaagacagtaaccagt

SEQ ID NO: 370197 - DNA, 25 bp, Mus musculus
tgaaggcaccaatttcgttgtggac

SEQ ID NO: 370198 - DNA, 25 bp, Mus musculus
tgaaggcactggcactacaagatgt

SEQ ID NO: 370199 - DNA, 25 bp, Mus musculus
tgaaggcagagttctttgcagatgt

SEQ ID NO: 370200 - DNA, 25 bp, Mus musculus
tgaaggcatccacggaagaagtgcc

SEQ ID NO: 370201 - DNA, 25 bp, Mus musculus
tgaaggcatccacggccatgggttc

SEQ ID NO: 370202 - DNA, 25 bp, Mus musculus
tgaaggcatgatatggttccttgtt

SEQ ID NO: 370203 - DNA, 25 bp, Mus musculus
tgaaggcatgggtcttcggatcagt

SEQ ID NO: 370204 - DNA, 25 bp, Mus musculus
tgaaggccaaggaaggcaccagacc

SEQ ID NO: 370205 - DNA, 25 bp, Mus musculus
tgaaggccagagcagatgaagtgag

SEQ ID NO: 370206 - DNA, 25 bp, Mus musculus
tgaaggccagagcaggctccttagg

SEQ ID NO: 370207 - DNA, 25 bp, Mus musculus
tgaaggccctgaggtatcaccacag

SEQ ID NO: 370208 - DNA, 25 bp, Mus musculus
tgaaggccgctacggatacaggttc

SEQ ID NO: 370209 - DNA, 25 bp, Mus musculus
tgaaggccggaggatggaaccaaat

SEQ ID NO: 370210 - DNA, 25 bp, Mus musculus
tgaaggccggagttccctcacaaca

SEQ ID NO: 370211 - DNA, 25 bp, Mus musculus
tgaaggcctggttctgcataagcag

SEQ ID NO: 370212 - DNA, 25 bp, Mus musculus
tgaaggcgctcgagtatgcctgtgg

SEQ ID NO: 370213 - DNA, 25 bp, Mus musculus
tgaaggcgggtttgccacaatctgc

SEQ ID NO: 370214 - DNA, 25 bp, Mus musculus
tgaaggcggtaaatgggcttcttgg

SEQ ID NO: 370215 - DNA, 25 bp, Mus musculus
tgaaggcgtccgcaggtttgatgag

SEQ ID NO: 370216 - DNA, 25 bp, Mus musculus
tgaaggcgtgaatatgacatctgca

SEQ ID NO: 370217 - DNA, 25 bp, Mus musculus
tgaaggcgtggcaacatacgcagct

SEQ ID NO: 370218 - DNA, 25 bp, Mus musculus
tgaaggcgtgggtatgcaatataaa

SEQ ID NO: 370219 - DNA, 25 bp, Mus musculus
tgaaggctacaaggtgctggtggca

SEQ ID NO: 370220 - DNA, 25 bp, Mus musculus
tgaaggctcgcaacaccaagaagga

SEQ ID NO: 370221 - DNA, 25 bp, Mus musculus
tgaaggctgacaaggaatttcggca

SEQ ID NO: 370222 - DNA, 25 bp, Mus musculus
tgaaggctggcgtagatcgactgtg

SEQ ID NO: 370223 - DNA, 25 bp, Mus musculus
tgaaggctggctgcctttgcggggc

SEQ ID NO: 370224 - DNA, 25 bp, Mus musculus
tgaaggcttcaggaaatcaggacct

SEQ ID NO: 370225 - DNA, 25 bp, Mus musculus
tgaaggcttgggaggaactgagtgg

SEQ ID NO: 370226 - DNA, 25 bp, Mus musculus
tgaaggcttgggagggtgacacttc

SEQ ID NO: 370227 - DNA, 25 bp, Mus musculus
tgaaggctttgtgtactgctctgct

SEQ ID NO: 370228 - DNA, 25 bp, Mus musculus
tgaagggaaaaaggtgatgtctatc

SEQ ID NO: 370229 - DNA, 25 bp, Mus musculus
tgaagggaaagaaagccgctctgca

SEQ ID NO: 370230 - DNA, 25 bp, Mus musculus
tgaagggaaagaaagtcacagacaa

SEQ ID NO: 370231 - DNA, 25 bp, Mus musculus
tgaagggaatactaagatgcttagt

SEQ ID NO: 370232 - DNA, 25 bp, Mus musculus
tgaagggaatcctggcctcccagta

SEQ ID NO: 370233 - DNA, 25 bp, Mus musculus
tgaagggaatcctggggacacttaa

SEQ ID NO: 370234 - DNA, 25 bp, Mus musculus
tgaagggagagttcgtgtcgatggg

SEQ ID NO: 370235 - DNA, 25 bp, Mus musculus
tgaagggaggggatcaaactcttca

SEQ ID NO: 370236 - DNA, 25 bp, Mus musculus
tgaagggcaaggaactaccgtgggg

SEQ ID NO: 370237 - DNA, 25 bp, Mus musculus
tgaagggcaaggtgctcatctgcag

SEQ ID NO: 370238 - DNA, 25 bp, Mus musculus
tgaagggcagacaagatgaacctcc

SEQ ID NO: 370239 - DNA, 25 bp, Mus musculus
tgaagggcagagggaaggctcctgc

SEQ ID NO: 370240 - DNA, 25 bp, Mus musculus
tgaagggcagagggatacagtacag

SEQ ID NO: 370241 - DNA, 25 bp, Mus musculus
tgaagggcaggctccggcttcgtca

SEQ ID NO: 370242 - DNA, 25 bp, Mus musculus
tgaagggcagggacattagtcatga

SEQ ID NO: 370243 - DNA, 25 bp, Mus musculus
tgaagggcaggtttggcatagaaat

SEQ ID NO: 370244 - DNA, 25 bp, Mus musculus
tgaaggggaagaggaatattgaaga

SEQ ID NO: 370245 - DNA, 25 bp, Mus musculus
tgaaggggcagtctgtccatcagtt

SEQ ID NO: 370246 - DNA, 25 bp, Mus musculus
tgaaggggctgaagtatatccatgc

SEQ ID NO: 370247 - DNA, 25 bp, Mus musculus
tgaagggtataggcatcgcctccat

SEQ ID NO: 370248 - DNA, 25 bp, Mus musculus
tgaagggtcagatttctcagctgat

SEQ ID NO: 370249 - DNA, 25 bp, Mus musculus
tgaagggtgcaaaaggtaccagcaa

SEQ ID NO: 370250 - DNA, 25 bp, Mus musculus
tgaagggtttgagagaatcgcacgt

SEQ ID NO: 370251 - DNA, 25 bp, Mus musculus
tgaaggtacaggagttaaagaccag

SEQ ID NO: 370252 - DNA, 25 bp, Mus musculus
tgaaggtcaacaccatcaccacccg

SEQ ID NO: 370253 - DNA, 25 bp, Mus musculus
tgaaggtcactgagggcggtgagcc

SEQ ID NO: 370254 - DNA, 25 bp, Mus musculus
tgaaggtcgatgtgggcccagaccc

SEQ ID NO: 370255 - DNA, 25 bp, Mus musculus
tgaaggtcgtgccagaaggaatgag

SEQ ID NO: 370256 - DNA, 25 bp, Mus musculus
tgaaggtgaaagagactcggatgac

SEQ ID NO: 370257 - DNA, 25 bp, Mus musculus
tgaaggtgacaggtctattttccgg

SEQ ID NO: 370258 - DNA, 25 bp, Mus musculus
tgaaggtgaggctggtggagttcat

SEQ ID NO: 370259 - DNA, 25 bp, Mus musculus
tgaaggtgccggttttggcacgtga

SEQ ID NO: 370260 - DNA, 25 bp, Mus musculus
tgaaggtgctgaggcaccatcacag

SEQ ID NO: 370261 - DNA, 25 bp, Mus musculus
tgaaggtgctgagttcatgcaaaga

SEQ ID NO: 370262 - DNA, 25 bp, Mus musculus
tgaaggtggcagaggtgctggctgg

SEQ ID NO: 370263 - DNA, 25 bp, Mus musculus
tgaaggttatagcacacatccagaa

SEQ ID NO: 370264 - DNA, 25 bp, Mus musculus
tgaaggttcatctctcccttctcag

SEQ ID NO: 370265 - DNA, 25 bp, Mus musculus
tgaagtaaaacaagatactcattta

SEQ ID NO: 370266 - DNA, 25 bp, Mus musculus
tgaagtaaaaggcaaccagataaac

SEQ ID NO: 370267 - DNA, 25 bp, Mus musculus
tgaagtaaccccaggttctgcctta

SEQ ID NO: 370268 - DNA, 25 bp, Mus musculus
tgaagtacaagaatcttatggcaag

SEQ ID NO: 370269 - DNA, 25 bp, Mus musculus
tgaagtacaggctggacattgtgca

SEQ ID NO: 370270 - DNA, 25 bp, Mus musculus
tgaagtaccgaaagctggacgatgg

SEQ ID NO: 370271 - DNA, 25 bp, Mus musculus
tgaagtacctgaacgtgctggccaa

SEQ ID NO: 370272 - DNA, 25 bp, Mus musculus
tgaagtacctggttaactttgtggc

SEQ ID NO: 370273 - DNA, 25 bp, Mus musculus
tgaagtacttaaggctcaggccgtg

SEQ ID NO: 370274 - DNA, 25 bp, Mus musculus
tgaagtacttaagtcaggaggaggc

SEQ ID NO: 370275 - DNA, 25 bp, Mus musculus
tgaagtagacagcctgatgtgtgaa

SEQ ID NO: 370276 - DNA, 25 bp, Mus musculus
tgaagtagacaggcattggactact

SEQ ID NO: 370277 - DNA, 25 bp, Mus musculus
tgaagtagagaccatccatgtggcc

SEQ ID NO: 370278 - DNA, 25 bp, Mus musculus
tgaagtagagaggcattttcttgag

SEQ ID NO: 370279 - DNA, 25 bp, Mus musculus
tgaagtagagccagcaagtccacat

SEQ ID NO: 370280 - DNA, 25 bp, Mus musculus
tgaagtagagccaggcttgccatct

SEQ ID NO: 370281 - DNA, 25 bp, Mus musculus
tgaagtagaggcaccagactccccc

SEQ ID NO: 370282 - DNA, 25 bp, Mus musculus
tgaagtagagtccatccatgtggcc

SEQ ID NO: 370283 - DNA, 25 bp, Mus musculus
tgaagtattagaaaaagatgttggt

SEQ ID NO: 370284 - DNA, 25 bp, Mus musculus
tgaagtattagaataaatgaaggat

SEQ ID NO: 370285 - DNA, 25 bp, Mus musculus
tgaagtcaagggcaggcactgatga

SEQ ID NO: 370286 - DNA, 25 bp, Mus musculus
tgaagtcaaggtcggttaggccccg

SEQ ID NO: 370287 - DNA, 25 bp, Mus musculus
tgaagtcaccctgccagcaagaagc

SEQ ID NO: 370288 - DNA, 25 bp, Mus musculus
tgaagtcactcggtgtgggctttgc

SEQ ID NO: 370289 - DNA, 25 bp, Mus musculus
tgaagtcagaaaccccaggtttccc

SEQ ID NO: 370290 - DNA, 25 bp, Mus musculus
tgaagtcagagggtgctggtgacag

SEQ ID NO: 370291 - DNA, 25 bp, Mus musculus
tgaagtcatgaactccaatgtggag

SEQ ID NO: 370292 - DNA, 25 bp, Mus musculus
tgaagtcattcaattctggaacaag

SEQ ID NO: 370293 - DNA, 25 bp, Mus musculus
tgaagtcattgggagagtccttatc

SEQ ID NO: 370294 - DNA, 25 bp, Mus musculus
tgaagtcatttcagccgtgtttgac

SEQ ID NO: 370295 - DNA, 25 bp, Mus musculus
tgaagtccaagctggaggcattcca

SEQ ID NO: 370296 - DNA, 25 bp, Mus musculus
tgaagtcccagtggccagtgaagag

SEQ ID NO: 370297 - DNA, 25 bp, Mus musculus
tgaagtcccgaggccaaccgcgtag

SEQ ID NO: 370298 - DNA, 25 bp, Mus musculus
tgaagtcccgaggttgagccccaca

SEQ ID NO: 370299 - DNA, 25 bp, Mus musculus
tgaagtcctccggaccatgctgcct

SEQ ID NO: 370300 - DNA, 25 bp, Mus musculus
tgaagtcctccggtctgaaactctt

SEQ ID NO: 370301 - DNA, 25 bp, Mus musculus
tgaagtcctggcctgcagctgagcc

SEQ ID NO: 370302 - DNA, 25 bp, Mus musculus
tgaagtcgcagagaaagataagggc

SEQ ID NO: 370303 - DNA, 25 bp, Mus musculus
tgaagtctcgacaacatgcattcat

SEQ ID NO: 370304 - DNA, 25 bp, Mus musculus
tgaagtctggctgtacatcattgac

SEQ ID NO: 370305 - DNA, 25 bp, Mus musculus
tgaagtcttttgcagcagtcctatg

SEQ ID NO: 370306 - DNA, 25 bp, Mus musculus
tgaagtgaaaaagtgccactgaggt

SEQ ID NO: 370307 - DNA, 25 bp, Mus musculus
tgaagtgaaagctgctcctgacatc

SEQ ID NO: 370308 - DNA, 25 bp, Mus musculus
tgaagtgaaaggagatttctaatag

SEQ ID NO: 370309 - DNA, 25 bp, Mus musculus
tgaagtgaatccaggtggcacaaga

SEQ ID NO: 370310 - DNA, 25 bp, Mus musculus
tgaagtgactgagagtggaatgcag

SEQ ID NO: 370311 - DNA, 25 bp, Mus musculus
tgaagtgcaggaactctgcaaacaa

SEQ ID NO: 370312 - DNA, 25 bp, Mus musculus
tgaagtgcaggtatcagggtggcca

SEQ ID NO: 370313 - DNA, 25 bp, Mus musculus
tgaagtgctctggtcctccttgtcc

SEQ ID NO: 370314 - DNA, 25 bp, Mus musculus
tgaagtggaacactgactgtcacag

SEQ ID NO: 370315 - DNA, 25 bp, Mus musculus
tgaagtggaggaggacttggtgaaa

SEQ ID NO: 370316 - DNA, 25 bp, Mus musculus
tgaagtggtgtgctcggaggacact

SEQ ID NO: 370317 - DNA, 25 bp, Mus musculus
tgaagtggttctgaacacggtacaa

SEQ ID NO: 370318 - DNA, 25 bp, Mus musculus
tgaagtgtatccctgggaagatgcc

SEQ ID NO: 370319 - DNA, 25 bp, Mus musculus
tgaagtgtcagcttgatactcatgg

SEQ ID NO: 370320 - DNA, 25 bp, Mus musculus
tgaagtgtcaggcgtttgcacatgg

SEQ ID NO: 370321 - DNA, 25 bp, Mus musculus
tgaagtgtctactaatttcccagca

SEQ ID NO: 370322 - DNA, 25 bp, Mus musculus
tgaagtgtggcttggtacctggaat

SEQ ID NO: 370323 - DNA, 25 bp, Mus musculus
tgaagtgttccaggacatgctaccc

SEQ ID NO: 370324 - DNA, 25 bp, Mus musculus
tgaagtgttgcttgctgtgcctcag

SEQ ID NO: 370325 - DNA, 25 bp, Mus musculus
tgaagtgttgcttgttttgctggta

SEQ ID NO: 370326 - DNA, 25 bp, Mus musculus
tgaagtgtttggattcacaacactt

SEQ ID NO: 370327 - DNA, 25 bp, Mus musculus
tgaagttaaaaagtggaatgcagtg

SEQ ID NO: 370328 - DNA, 25 bp, Mus musculus
tgaagttacagtcaccggaagaaga

SEQ ID NO: 370329 - DNA, 25 bp, Mus musculus
tgaagttatgagagagattcagaaa

SEQ ID NO: 370330 - DNA, 25 bp, Mus musculus
tgaagttatgcagggatggcaagag

SEQ ID NO: 370331 - DNA, 25 bp, Mus musculus
tgaagttattcagaagagagccaac

SEQ ID NO: 370332 - DNA, 25 bp, Mus musculus
tgaagttattcatgctcgatttatt

SEQ ID NO: 370333 - DNA, 25 bp, Mus musculus
tgaagttcactctagagtcttttat

SEQ ID NO: 370334 - DNA, 25 bp, Mus musculus
tgaagttccttcgggcctctgaaga

SEQ ID NO: 370335 - DNA, 25 bp, Mus musculus
tgaagttccttcggtgtgtcctggt

SEQ ID NO: 370336 - DNA, 25 bp, Mus musculus
tgaagttcggttcctgtgtgacgag

SEQ ID NO: 370337 - DNA, 25 bp, Mus musculus
tgaagttctcacagcacatgaaggc

SEQ ID NO: 370338 - DNA, 25 bp, Mus musculus
tgaagttctcacaggacatgaaggc

SEQ ID NO: 370339 - DNA, 25 bp, Mus musculus
tgaagttgccagaaggagaagcaga

SEQ ID NO: 370340 - DNA, 25 bp, Mus musculus
tgaagtttcctgcagctatccttcg

SEQ ID NO: 370341 - DNA, 25 bp, Mus musculus
tgaagtttgatgcccaggcaactta

SEQ ID NO: 370342 - DNA, 25 bp, Mus musculus
tgaataaaacaacagttaatttaga

SEQ ID NO: 370343 - DNA, 25 bp, Mus musculus
tgaataaaacttcagttgttgacct

SEQ ID NO: 370344 - DNA, 25 bp, Mus musculus
tgaataaagaaaaggctggaagttc

SEQ ID NO: 370345 - DNA, 25 bp, Mus musculus
tgaataaagcgaatgaacttttcta

SEQ ID NO: 370346 - DNA, 25 bp, Mus musculus
tgaataaagtatcagaaatccactt

SEQ ID NO: 370347 - DNA, 25 bp, Mus musculus
tgaataaagtatcagatgtctttat

SEQ ID NO: 370348 - DNA, 25 bp, Mus musculus
tgaataaagtatcagggctggcagt

SEQ ID NO: 370349 - DNA, 25 bp, Mus musculus
tgaataaatgtctcattaagaaccc

SEQ ID NO: 370350 - DNA, 25 bp, Mus musculus
tgaataagcagttccgggcttgcat

SEQ ID NO: 370351 - DNA, 25 bp, Mus musculus
tgaataataccaggtggtgccacag

SEQ ID NO: 370352 - DNA, 25 bp, Mus musculus
tgaatacacaggccccagtgccttc

SEQ ID NO: 370353 - DNA, 25 bp, Mus musculus
tgaatacactgagctcatgaccagg

SEQ ID NO: 370354 - DNA, 25 bp, Mus musculus
tgaatacatacacaaaggcattagc

SEQ ID NO: 370355 - DNA, 25 bp, Mus musculus
tgaatacccctctataaaactggtg

SEQ ID NO: 370356 - DNA, 25 bp, Mus musculus
tgaatacccctctctggtggtggag

SEQ ID NO: 370357 - DNA, 25 bp, Mus musculus
tgaatacgaagctgttgccgcacat

SEQ ID NO: 370358 - DNA, 25 bp, Mus musculus
tgaatacgtcagacatctggcagga

SEQ ID NO: 370359 - DNA, 25 bp, Mus musculus
tgaatactcagcaatgtgggctggc

SEQ ID NO: 370360 - DNA, 25 bp, Mus musculus
tgaatactcaggatactgggaacct

SEQ ID NO: 370361 - DNA, 25 bp, Mus musculus
tgaatagactaccaggttgggataa

SEQ ID NO: 370362 - DNA, 25 bp, Mus musculus
tgaatagcaaaggatgcagtcatgc

SEQ ID NO: 370363 - DNA, 25 bp, Mus musculus
tgaatagcgtgcctcaggagccgta

SEQ ID NO: 370364 - DNA, 25 bp, Mus musculus
tgaatagtccccaaggactttctga

SEQ ID NO: 370365 - DNA, 25 bp, Mus musculus
tgaatataacatcagatattcagtg

SEQ ID NO: 370366 - DNA, 25 bp, Mus musculus
tgaatatacagcgtttgacttttgc

SEQ ID NO: 370367 - DNA, 25 bp, Mus musculus
tgaatatactgttgaatcaagggat

SEQ ID NO: 370368 - DNA, 25 bp, Mus musculus
tgaatatagcaacttggttctcacg

SEQ ID NO: 370369 - DNA, 25 bp, Mus musculus
tgaatatcaagaaacccccatagaa

SEQ ID NO: 370370 - DNA, 25 bp, Mus musculus
tgaatatcaatacagggtctgtgat

SEQ ID NO: 370371 - DNA, 25 bp, Mus musculus
tgaatatcagacatgtacatggagg

SEQ ID NO: 370372 - DNA, 25 bp, Mus musculus
tgaatatcaggacaatgggctggaa

SEQ ID NO: 370373 - DNA, 25 bp, Mus musculus
tgaatatccagagactaagtctggc

SEQ ID NO: 370374 - DNA, 25 bp, Mus musculus
tgaatatccagggttctctgacctg

SEQ ID NO: 370375 - DNA, 25 bp, Mus musculus
tgaatatccccaggtactgtgcagg

SEQ ID NO: 370376 - DNA, 25 bp, Mus musculus
tgaatatccgtcgaaaagcggcatc

SEQ ID NO: 370377 - DNA, 25 bp, Mus musculus
tgaatatgaactctcatccttattc

SEQ ID NO: 370378 - DNA, 25 bp, Mus musculus
tgaatatgagatgtgcataatgcgt

SEQ ID NO: 370379 - DNA, 25 bp, Mus musculus
tgaatatgaggtgtcagctgtgcct

SEQ ID NO: 370380 - DNA, 25 bp, Mus musculus
tgaatatgtggtgctgctgtttttt

SEQ ID NO: 370381 - DNA, 25 bp, Mus musculus
tgaatattccaggaacattagaatg

SEQ ID NO: 370382 - DNA, 25 bp, Mus musculus
tgaatattgtcaagatcgtaccgag

SEQ ID NO: 370383 - DNA, 25 bp, Mus musculus
tgaatcaacaagaagttaattatac

SEQ ID NO: 370384 - DNA, 25 bp, Mus musculus
tgaatcaacagagtatgtcaatagg

SEQ ID NO: 370385 - DNA, 25 bp, Mus musculus
tgaatcacaggacctggagttgctg

SEQ ID NO: 370386 - DNA, 25 bp, Mus musculus
tgaatcaccggcgaggagtctgcag

SEQ ID NO: 370387 - DNA, 25 bp, Mus musculus
tgaatcactaagagggaccagtctt

SEQ ID NO: 370388 - DNA, 25 bp, Mus musculus
tgaatcagaaaaatttgctcaggaa

SEQ ID NO: 370389 - DNA, 25 bp, Mus musculus
tgaatcagatcaggtggatgtgtgt

SEQ ID NO: 370390 - DNA, 25 bp, Mus musculus
tgaatcagcacaacctcatattcag

SEQ ID NO: 370391 - DNA, 25 bp, Mus musculus
tgaatcagcacatcctcatattcag

SEQ ID NO: 370392 - DNA, 25 bp, Mus musculus
tgaatcaggagcttacagatgtcct

SEQ ID NO: 370393 - DNA, 25 bp, Mus musculus
tgaatcaggatgatctcaaagccat

SEQ ID NO: 370394 - DNA, 25 bp, Mus musculus
tgaatcaggatgtgtctctctccag

SEQ ID NO: 370395 - DNA, 25 bp, Mus musculus
tgaatccagaagacattgatcagct

SEQ ID NO: 370396 - DNA, 25 bp, Mus musculus
tgaatccagaggttggaatgaaata

SEQ ID NO: 370397 - DNA, 25 bp, Mus musculus
tgaatccagcctgaaactgttattg

SEQ ID NO: 370398 - DNA, 25 bp, Mus musculus
tgaatccagcctggctgacgttggg

SEQ ID NO: 370399 - DNA, 25 bp, Mus musculus
tgaatccgttcaggctgacggctga

SEQ ID NO: 370400 - DNA, 25 bp, Mus musculus
tgaatcctaaagagactaagcccca

SEQ ID NO: 370401 - DNA, 25 bp, Mus musculus
tgaatcctatcagggtgaaggaggt

SEQ ID NO: 370402 - DNA, 25 bp, Mus musculus
tgaatcctcttggttcagacaatga

SEQ ID NO: 370403 - DNA, 25 bp, Mus musculus
tgaatcctgagcaatggaagagtta

SEQ ID NO: 370404 - DNA, 25 bp, Mus musculus
tgaatcctgaggtgcagcgtggcgt

SEQ ID NO: 370405 - DNA, 25 bp, Mus musculus
tgaatcctgatggaaagaacagaca

SEQ ID NO: 370406 - DNA, 25 bp, Mus musculus
tgaatccttgcagtcagaaaatggg

SEQ ID NO: 370407 - DNA, 25 bp, Mus musculus
tgaatcgaaaggctcaggtcacagg

SEQ ID NO: 370408 - DNA, 25 bp, Mus musculus
tgaatcgccacagagcctacagagt

SEQ ID NO: 370409 - DNA, 25 bp, Mus musculus
tgaatctattgcagagttacccctg

SEQ ID NO: 370410 - DNA, 25 bp, Mus musculus
tgaatctattgcagcagtgtcagac

SEQ ID NO: 370411 - DNA, 25 bp, Mus musculus
tgaatctcaagcaagttgataatga

SEQ ID NO: 370412 - DNA, 25 bp, Mus musculus
tgaatctcaggactccagaggacct

SEQ ID NO: 370413 - DNA, 25 bp, Mus musculus
tgaatctcatgttgagtgacaaaag

SEQ ID NO: 370414 - DNA, 25 bp, Mus musculus
tgaatctcccaggaaacctcatcgt

SEQ ID NO: 370415 - DNA, 25 bp, Mus musculus
tgaatctcccaggtagtcaataccc

SEQ ID NO: 370416 - DNA, 25 bp, Mus musculus
tgaatctctgaacctgttccagcta

SEQ ID NO: 370417 - DNA, 25 bp, Mus musculus
tgaatctgactccacgtcgtggtcc

SEQ ID NO: 370418 - DNA, 25 bp, Mus musculus
tgaatctgatcctggcctgtgttgg

SEQ ID NO: 370419 - DNA, 25 bp, Mus musculus
tgaatctgtcagacgtgttgatgcc

SEQ ID NO: 370420 - DNA, 25 bp, Mus musculus
tgaatcttaacaagggataactctc

SEQ ID NO: 370421 - DNA, 25 bp, Mus musculus
tgaatcttcaggggctggctgtggg

SEQ ID NO: 370422 - DNA, 25 bp, Mus musculus
tgaatcttcattgagcatgtttttg

SEQ ID NO: 370423 - DNA, 25 bp, Mus musculus
tgaatcttccatctggtcctgcatg

SEQ ID NO: 370424 - DNA, 25 bp, Mus musculus
tgaatctttctgggtcagaaacgta

SEQ ID NO: 370425 - DNA, 25 bp, Mus musculus
tgaatgaaagggagaagaaggaact

SEQ ID NO: 370426 - DNA, 25 bp, Mus musculus
tgaatgaacagcttctacctaagca

SEQ ID NO: 370427 - DNA, 25 bp, Mus musculus
tgaatgaacttgggggactgcaggc

SEQ ID NO: 370428 - DNA, 25 bp, Mus musculus
tgaatgacaagctccccgaggctca

SEQ ID NO: 370429 - DNA, 25 bp, Mus musculus
tgaatgacaaggtggaggagcggcg

SEQ ID NO: 370430 - DNA, 25 bp, Mus musculus
tgaatgacgagccccacaggatcgc

SEQ ID NO: 370431 - DNA, 25 bp, Mus musculus
tgaatgacgagtgtggagagcaaag

SEQ ID NO: 370432 - DNA, 25 bp, Mus musculus
tgaatgagaaagaccttgtcctggc

SEQ ID NO: 370433 - DNA, 25 bp, Mus musculus
tgaatgagccaaggaccagagtgag

SEQ ID NO: 370434 - DNA, 25 bp, Mus musculus
tgaatgagtttgaggcgggatccac

SEQ ID NO: 370435 - DNA, 25 bp, Mus musculus
tgaatgatctggagtgccccgagcc

SEQ ID NO: 370436 - DNA, 25 bp, Mus musculus
tgaatgatgcagagtcctccccgtc

SEQ ID NO: 370437 - DNA, 25 bp, Mus musculus
tgaatgattacaacatttcagaagg

SEQ ID NO: 370438 - DNA, 25 bp, Mus musculus
tgaatgcacagacgtggacgaatgt

SEQ ID NO: 370439 - DNA, 25 bp, Mus musculus
tgaatgcaggactgtctccttagtg

SEQ ID NO: 370440 - DNA, 25 bp, Mus musculus
tgaatgcagtagaagccatgctggc

SEQ ID NO: 370441 - DNA, 25 bp, Mus musculus
tgaatgctctggtgtccgccgatgc

SEQ ID NO: 370442 - DNA, 25 bp, Mus musculus
tgaatgcttataagggtccgtcgta

SEQ ID NO: 370443 - DNA, 25 bp, Mus musculus
tgaatggcaaaaaggtggtggagaa

SEQ ID NO: 370444 - DNA, 25 bp, Mus musculus
tgaatggcaaggtgctggatggttc

SEQ ID NO: 370445 - DNA, 25 bp, Mus musculus
tgaatggcaggaaatctcaccacat

SEQ ID NO: 370446 - DNA, 25 bp, Mus musculus
tgaatggcctgagaattcttttcgt

SEQ ID NO: 370447 - DNA, 25 bp, Mus musculus
tgaatggcttctgagaaactggtca

SEQ ID NO: 370448 - DNA, 25 bp, Mus musculus
tgaatgggcacaaggcgacccaagc

SEQ ID NO: 370449 - DNA, 25 bp, Mus musculus
tgaatgggcacaagggtgtggactg

SEQ ID NO: 370450 - DNA, 25 bp, Mus musculus
tgaatgggctgaagagaatgcaaag

SEQ ID NO: 370451 - DNA, 25 bp, Mus musculus
tgaatggtgtggagtttgcagattc

SEQ ID NO: 370452 - DNA, 25 bp, Mus musculus
tgaatgtactgaaggatttctggta

SEQ ID NO: 370453 - DNA, 25 bp, Mus musculus
tgaatgtcaaagattgtaacataaa

SEQ ID NO: 370454 - DNA, 25 bp, Mus musculus
tgaatgtcaagggaagttgagaagc

SEQ ID NO: 370455 - DNA, 25 bp, Mus musculus
tgaatgtcacagatgccatctcatc

SEQ ID NO: 370456 - DNA, 25 bp, Mus musculus
tgaatgtcagcccaggtgctgtgag

SEQ ID NO: 370457 - DNA, 25 bp, Mus musculus
tgaatgtcatgtatttcaacaatcc

SEQ ID NO: 370458 - DNA, 25 bp, Mus musculus
tgaatgtccaggaccccctggcccc

SEQ ID NO: 370459 - DNA, 25 bp, Mus musculus
tgaatgtgacaagatcgtgaacctt

SEQ ID NO: 370460 - DNA, 25 bp, Mus musculus
tgaatgtgacaaggcatatctagat

SEQ ID NO: 370461 - DNA, 25 bp, Mus musculus
tgaatgtgagaagattacagtagca

SEQ ID NO: 370462 - DNA, 25 bp, Mus musculus
tgaatgtgagagacctctcagtagc

SEQ ID NO: 370463 - DNA, 25 bp, Mus musculus
tgaatgtgaggcctcagtgagcttt

SEQ ID NO: 370464 - DNA, 25 bp, Mus musculus
tgaatgttccaagtaccccagcaag

SEQ ID NO: 370465 - DNA, 25 bp, Mus musculus
tgaatgttccccattgtaacataaa

SEQ ID NO: 370466 - DNA, 25 bp, Mus musculus
tgaatgttccccgtaacaaatcaca

SEQ ID NO: 370467 - DNA, 25 bp, Mus musculus
tgaatgttccccgtcagaaacgtac

SEQ ID NO: 370468 - DNA, 25 bp, Mus musculus
tgaattacaggaaatgcttgatgaa

SEQ ID NO: 370469 - DNA, 25 bp, Mus musculus
tgaattagatataatgtttaatttg

SEQ ID NO: 370470 - DNA, 25 bp, Mus musculus
tgaattatcacaatgaggttgacat

SEQ ID NO: 370471 - DNA, 25 bp, Mus musculus
tgaattattttcagagaagcagaag

SEQ ID NO: 370472 - DNA, 25 bp, Mus musculus
tgaattcaaaagatagtgttttggg

SEQ ID NO: 370473 - DNA, 25 bp, Mus musculus
tgaattcaaaagctgccgttcggct

SEQ ID NO: 370474 - DNA, 25 bp, Mus musculus
tgaattcaaaggaggttcatgagtt

SEQ ID NO: 370475 - DNA, 25 bp, Mus musculus
tgaattcaagggaaacaactggaag

SEQ ID NO: 370476 - DNA, 25 bp, Mus musculus
tgaattcaaggtggacattcgcttc

SEQ ID NO: 370477 - DNA, 25 bp, Mus musculus
tgaattcaagtgttggactggaact

SEQ ID NO: 370478 - DNA, 25 bp, Mus musculus
tgaattcaagtgttggcagcagtgg

SEQ ID NO: 370479 - DNA, 25 bp, Mus musculus
tgaattcctaaaagcagccaacaag

SEQ ID NO: 370480 - DNA, 25 bp, Mus musculus
tgaattcgatccaggctccccggct

SEQ ID NO: 370481 - DNA, 25 bp, Mus musculus
tgaattcgatccaggtgctaccaag

SEQ ID NO: 370482 - DNA, 25 bp, Mus musculus
tgaattcgcacagtggggtcggtta

SEQ ID NO: 370483 - DNA, 25 bp, Mus musculus
tgaattcgcacagtgtgtgttttgt

SEQ ID NO: 370484 - DNA, 25 bp, Mus musculus
tgaattctactactgggactcgtac

SEQ ID NO: 370485 - DNA, 25 bp, Mus musculus
tgaattctcagatgccagcatgtct

SEQ ID NO: 370486 - DNA, 25 bp, Mus musculus
tgaattctcagttaaatttaaaaag

SEQ ID NO: 370487 - DNA, 25 bp, Mus musculus
tgaattctgagggactaactacgac

SEQ ID NO: 370488 - DNA, 25 bp, Mus musculus
tgaattctgccagataaaacacgga

SEQ ID NO: 370489 - DNA, 25 bp, Mus musculus
tgaattctgccagatactggattta

SEQ ID NO: 370490 - DNA, 25 bp, Mus musculus
tgaattctgcctcaggacctcttcc

SEQ ID NO: 370491 - DNA, 25 bp, Mus musculus
tgaattcttcaaggactggggatct

SEQ ID NO: 370492 - DNA, 25 bp, Mus musculus
tgaattcttcaaggtggtacctcat

SEQ ID NO: 370493 - DNA, 25 bp, Mus musculus
tgaattcttctatacagaaactgca

SEQ ID NO: 370494 - DNA, 25 bp, Mus musculus
tgaattcttgcagacacctttgtcc

SEQ ID NO: 370495 - DNA, 25 bp, Mus musculus
tgaattcttgcagatccgtctacct

SEQ ID NO: 370496 - DNA, 25 bp, Mus musculus
tgaattgtaatgtggagctgcccga

SEQ ID NO: 370497 - DNA, 25 bp, Mus musculus
tgaattgtacagatccgctgtactc

SEQ ID NO: 370498 - DNA, 25 bp, Mus musculus
tgaattgtagcaccatcccgattgc

SEQ ID NO: 370499 - DNA, 25 bp, Mus musculus
tgaatttaaggagattaatagagac

SEQ ID NO: 370500 - DNA, 25 bp, Mus musculus
tgaatttaaggagttcatcagcctc

SEQ ID NO: 370501 - DNA, 25 bp, Mus musculus
tgaatttacggtcaccattcttgtc

SEQ ID NO: 370502 - DNA, 25 bp, Mus musculus
tgaatttacggtggctctcccaaaa

SEQ ID NO: 370503 - DNA, 25 bp, Mus musculus
tgaatttatcaggaaacaaaaggag

SEQ ID NO: 370504 - DNA, 25 bp, Mus musculus
tgaatttatcgtcagatacagagtt

SEQ ID NO: 370505 - DNA, 25 bp, Mus musculus
tgaatttcaaggggctgaggcgatg

SEQ ID NO: 370506 - DNA, 25 bp, Mus musculus
tgaatttcacaatactacctgtctg

SEQ ID NO: 370507 - DNA, 25 bp, Mus musculus
tgaatttcagactctgaattcggtc

SEQ ID NO: 370508 - DNA, 25 bp, Mus musculus
tgaatttcagagggccttcagcggc

SEQ ID NO: 370509 - DNA, 25 bp, Mus musculus
tgaatttcaggaatataccatgctg

SEQ ID NO: 370510 - DNA, 25 bp, Mus musculus
tgaatttcattaagacctggtccca

SEQ ID NO: 370511 - DNA, 25 bp, Mus musculus
tgaatttcattaagatcgggaagct

SEQ ID NO: 370512 - DNA, 25 bp, Mus musculus
tgaatttccaaaagagaacggacac

SEQ ID NO: 370513 - DNA, 25 bp, Mus musculus
tgaatttccaaaagcctgaaacatt

SEQ ID NO: 370514 - DNA, 25 bp, Mus musculus
tgaatttccagatgcaggtgtcccc

SEQ ID NO: 370515 - DNA, 25 bp, Mus musculus
tgaatttctggtaatctatgccagc

SEQ ID NO: 370516 - DNA, 25 bp, Mus musculus
tgaatttctggtttgcggtgtagga

SEQ ID NO: 370517 - DNA, 25 bp, Mus musculus
tgaatttgaacagggcctgtctgag

SEQ ID NO: 370518 - DNA, 25 bp, Mus musculus
tgaatttgaacaggtcatgcagttg

SEQ ID NO: 370519 - DNA, 25 bp, Mus musculus
tgaatttgacttcttagcacttaac

SEQ ID NO: 370520 - DNA, 25 bp, Mus musculus
tgaatttgcaagtggattgtcttgc

SEQ ID NO: 370521 - DNA, 25 bp, Mus musculus
tgaatttgggaggtcataagtggtg

SEQ ID NO: 370522 - DNA, 25 bp, Mus musculus
tgaatttgggcacctccgcacctgt

SEQ ID NO: 370523 - DNA, 25 bp, Mus musculus
tgaattttagaatgattgaagatag

SEQ ID NO: 370524 - DNA, 25 bp, Mus musculus
tgaattttagagaacgagttagtac

SEQ ID NO: 370525 - DNA, 25 bp, Mus musculus
tgaattttagagaatggctctgaag

SEQ ID NO: 370526 - DNA, 25 bp, Mus musculus
tgaattttagctggattcatcgctg

SEQ ID NO: 370527 - DNA, 25 bp, Mus musculus
tgaattttccaagctgatcatatga

SEQ ID NO: 370528 - DNA, 25 bp, Mus musculus
tgaattttccaggtctctttaaggt

SEQ ID NO: 370529 - DNA, 25 bp, Mus musculus
tgaattttccagttcaaaaggacat

SEQ ID NO: 370530 - DNA, 25 bp, Mus musculus
tgaattttgaggtggcccgggagag

SEQ ID NO: 370531 - DNA, 25 bp, Mus musculus
tgaattttgagtctttccttctgac

SEQ ID NO: 370532 - DNA, 25 bp, Mus musculus
tgaatttttcaaatttctgctggac

SEQ ID NO: 370533 - DNA, 25 bp, Mus musculus
tgacaaaaaagagctctcttacagg

SEQ ID NO: 370534 - DNA, 25 bp, Mus musculus
tgacaaaaacagcttatagagcaca

SEQ ID NO: 370535 - DNA, 25 bp, Mus musculus
tgacaaaaaggtttgcacctgacag

SEQ ID NO: 370536 - DNA, 25 bp, Mus musculus
tgacaaaaatgggaggcttactcaa

SEQ ID NO: 370537 - DNA, 25 bp, Mus musculus
tgacaaaaatgggagtgggtgaact

SEQ ID NO: 370538 - DNA, 25 bp, Mus musculus
tgacaaaaatttcaagtactcagac

SEQ ID NO: 370539 - DNA, 25 bp, Mus musculus
tgacaaacaagctgctaactcagga

SEQ ID NO: 370540 - DNA, 25 bp, Mus musculus
tgacaaacaagctttgaaaagtact

SEQ ID NO: 370541 - DNA, 25 bp, Mus musculus
tgacaaagaaggctggattctcata

SEQ ID NO: 370542 - DNA, 25 bp, Mus musculus
tgacaaagactctaggatcaagtga

SEQ ID NO: 370543 - DNA, 25 bp, Mus musculus
tgacaaagactctagtctttcaggt

SEQ ID NO: 370544 - DNA, 25 bp, Mus musculus
tgacaaagagcctgactctgattcc

SEQ ID NO: 370545 - DNA, 25 bp, Mus musculus
tgacaaagccagctaccgagtctat

SEQ ID NO: 370546 - DNA, 25 bp, Mus musculus
tgacaaaggagaccctggcttcaaa

SEQ ID NO: 370547 - DNA, 25 bp, Mus musculus
tgacaaaggcacagcgccctcaggc

SEQ ID NO: 370548 - DNA, 25 bp, Mus musculus
tgacaaaggtttcaagaattggagg

SEQ ID NO: 370549 - DNA, 25 bp, Mus musculus
tgacaaagttggcatcctgactttg

SEQ ID NO: 370550 - DNA, 25 bp, Mus musculus
tgacaaataccggggtgaacctgga

SEQ ID NO: 370551 - DNA, 25 bp, Mus musculus
tgacaaatactttgctgccttctga

SEQ ID NO: 370552 - DNA, 25 bp, Mus musculus
tgacaaatactttgttgaaccaaga

SEQ ID NO: 370553 - DNA, 25 bp, Mus musculus
tgacaaatagctcctaggttgggag

SEQ ID NO: 370554 - DNA, 25 bp, Mus musculus
tgacaaatagctcctatacctgact

SEQ ID NO: 370555 - DNA, 25 bp, Mus musculus
tgacaaatgacacccagtcttctgg

SEQ ID NO: 370556 - DNA, 25 bp, Mus musculus
tgacaacaaatggaccccttctttc

SEQ ID NO: 370557 - DNA, 25 bp, Mus musculus
tgacaacaaatgtcactagtgccaa

SEQ ID NO: 370558 - DNA, 25 bp, Mus musculus
tgacaacaagagcctggccatccct

SEQ ID NO: 370559 - DNA, 25 bp, Mus musculus
tgacaacagtttgggggacatcctg

SEQ ID NO: 370560 - DNA, 25 bp, Mus musculus
tgacaaccagggtggtgcccccaac

SEQ ID NO: 370561 - DNA, 25 bp, Mus musculus
tgacaacccgatagaggagcataga

SEQ ID NO: 370562 - DNA, 25 bp, Mus musculus
tgacaacctagaggccttgtctcac

SEQ ID NO: 370563 - DNA, 25 bp, Mus musculus
tgacaacctgttggagagaagacac

SEQ ID NO: 370564 - DNA, 25 bp, Mus musculus
tgacaaccttgcaggccctgtggtt

SEQ ID NO: 370565 - DNA, 25 bp, Mus musculus
tgacaacgtcaaccctccacgccat

SEQ ID NO: 370566 - DNA, 25 bp, Mus musculus
tgacaacgtcaggtatggcatttca

SEQ ID NO: 370567 - DNA, 25 bp, Mus musculus
tgacaactatctcagcatcaagatg

SEQ ID NO: 370568 - DNA, 25 bp, Mus musculus
tgacaactttgaactctgcactttg

SEQ ID NO: 370569 - DNA, 25 bp, Mus musculus
tgacaagaaaaatatcgctgtagtg

SEQ ID NO: 370570 - DNA, 25 bp, Mus musculus
tgacaagaaagctgttcttcctacc

SEQ ID NO: 370571 - DNA, 25 bp, Mus musculus
tgacaagaaagcttgatccggagca

SEQ ID NO: 370572 - DNA, 25 bp, Mus musculus
tgacaagaagatggccctctctttc

SEQ ID NO: 370573 - DNA, 25 bp, Mus musculus
tgacaagaagatggccgtggcaacc

SEQ ID NO: 370574 - DNA, 25 bp, Mus musculus
tgacaagaaggaaatgttgtccttc

SEQ ID NO: 370575 - DNA, 25 bp, Mus musculus
tgacaagacagttcccttcagcatt

SEQ ID NO: 370576 - DNA, 25 bp, Mus musculus
tgacaagaccattggagaaggagag

SEQ ID NO: 370577 - DNA, 25 bp, Mus musculus
tgacaagagaaagcgccaagggaag

SEQ ID NO: 370578 - DNA, 25 bp, Mus musculus
tgacaagagctgaagtgggagaaaa

SEQ ID NO: 370579 - DNA, 25 bp, Mus musculus
tgacaagcaaatgatcaaacttcaa

SEQ ID NO: 370580 - DNA, 25 bp, Mus musculus
tgacaagcacccaatgtcagaatac

SEQ ID NO: 370581 - DNA, 25 bp, Mus musculus
tgacaagcagcctgacaaaagacat

SEQ ID NO: 370582 - DNA, 25 bp, Mus musculus
tgacaagcaggctgagtaatttagg

SEQ ID NO: 370583 - DNA, 25 bp, Mus musculus
tgacaagcaggtttgctgaggagca

SEQ ID NO: 370584 - DNA, 25 bp, Mus musculus
tgacaagccccagcttatcaagtac

SEQ ID NO: 370585 - DNA, 25 bp, Mus musculus
tgacaagccccagggcagtccttta

SEQ ID NO: 370586 - DNA, 25 bp, Mus musculus
tgacaagccccagggtgccacctcc

SEQ ID NO: 370587 - DNA, 25 bp, Mus musculus
tgacaagctaaggatttggagtttc

SEQ ID NO: 370588 - DNA, 25 bp, Mus musculus
tgacaaggaaagctggtgaagcaca

SEQ ID NO: 370589 - DNA, 25 bp, Mus musculus
tgacaaggaaagctgtctgcaatcc

SEQ ID NO: 370590 - DNA, 25 bp, Mus musculus
tgacaaggaagcggcctttgacgac

SEQ ID NO: 370591 - DNA, 25 bp, Mus musculus
tgacaaggaaggcctgaagggaaag

SEQ ID NO: 370592 - DNA, 25 bp, Mus musculus
tgacaaggagaatacacctctcatt

SEQ ID NO: 370593 - DNA, 25 bp, Mus musculus
tgacaaggagaatgtcccttcagag

SEQ ID NO: 370594 - DNA, 25 bp, Mus musculus
tgacaaggccaggtgtggaggcatc

SEQ ID NO: 370595 - DNA, 25 bp, Mus musculus
tgacaagggagaattcggtggcttt

SEQ ID NO: 370596 - DNA, 25 bp, Mus musculus
tgacaagggagggaaaattgaatgt

SEQ ID NO: 370597 - DNA, 25 bp, Mus musculus
tgacaagggcaggctgctgtcacca

SEQ ID NO: 370598 - DNA, 25 bp, Mus musculus
tgacaagtacaggagctttgtcatc

SEQ ID NO: 370599 - DNA, 25 bp, Mus musculus
tgacaagtacaggaggccgagtggg

SEQ ID NO: 370600 - DNA, 25 bp, Mus musculus
tgacaagtccagtagaggaagccag

SEQ ID NO: 370601 - DNA, 25 bp, Mus musculus
tgacaagtgcgagaacatgtttggg

SEQ ID NO: 370602 - DNA, 25 bp, Mus musculus
tgacaagtgcgagatcaaagaactg

SEQ ID NO: 370603 - DNA, 25 bp, Mus musculus
tgacaagtggagaaatgattagcag

SEQ ID NO: 370604 - DNA, 25 bp, Mus musculus
tgacaagtggagtcattttataaga

SEQ ID NO: 370605 - DNA, 25 bp, Mus musculus
tgacaagttcatcagcgggcccctc

SEQ ID NO: 370606 - DNA, 25 bp, Mus musculus
tgacaagttcatcaggtatttgtac

SEQ ID NO: 370607 - DNA, 25 bp, Mus musculus
tgacaagttctcgcacacaagaagc

SEQ ID NO: 370608 - DNA, 25 bp, Mus musculus
tgacaagttctcggcctatggctgg

SEQ ID NO: 370609 - DNA, 25 bp, Mus musculus
tgacaataaaacgggtaaaatgatc

SEQ ID NO: 370610 - DNA, 25 bp, Mus musculus
tgacaataaggacgggccaaggtgg

SEQ ID NO: 370611 - DNA, 25 bp, Mus musculus
tgacaatatctatctgcatgtccag

SEQ ID NO: 370612 - DNA, 25 bp, Mus musculus
tgacaatatctggcaaaaaggataa

SEQ ID NO: 370613 - DNA, 25 bp, Mus musculus
tgacaatgaagaaaggaagtggaag

SEQ ID NO: 370614 - DNA, 25 bp, Mus musculus
tgacaatgagctgtgtgtccgagcc

SEQ ID NO: 370615 - DNA, 25 bp, Mus musculus
tgacaatgcaagtgcaccttccagc

SEQ ID NO: 370616 - DNA, 25 bp, Mus musculus
tgacaatgctcaagagtatagtcat

SEQ ID NO: 370617 - DNA, 25 bp, Mus musculus
tgacaatgggggtgaagcttctagg

SEQ ID NO: 370618 - DNA, 25 bp, Mus musculus
tgacaattaccagtgatatgctgtg

SEQ ID NO: 370619 - DNA, 25 bp, Mus musculus
tgacaattatgagggttcagctcct

SEQ ID NO: 370620 - DNA, 25 bp, Mus musculus
tgacaattcagcctggagatgccca

SEQ ID NO: 370621 - DNA, 25 bp, Mus musculus
tgacacacaccaggggtgacagtcc

SEQ ID NO: 370622 - DNA, 25 bp, Mus musculus
tgacacacagggagaaaatccccca

SEQ ID NO: 370623 - DNA, 25 bp, Mus musculus
tgacacacccctgtctgcaggcatt

SEQ ID NO: 370624 - DNA, 25 bp, Mus musculus
tgacacactgcagcgtgctctgcta

SEQ ID NO: 370625 - DNA, 25 bp, Mus musculus
tgacacactggagggagactgtgac

SEQ ID NO: 370626 - DNA, 25 bp, Mus musculus
tgacacagaagatctggaacttcct

SEQ ID NO: 370627 - DNA, 25 bp, Mus musculus
tgacacagaaggaaggaattcagga

SEQ ID NO: 370628 - DNA, 25 bp, Mus musculus
tgacacagaggggctggctgtgggc

SEQ ID NO: 370629 - DNA, 25 bp, Mus musculus
tgacacagaggtggaggagagcatg

SEQ ID NO: 370630 - DNA, 25 bp, Mus musculus
tgacacagaggtggcggagaacaat

SEQ ID NO: 370631 - DNA, 25 bp, Mus musculus
tgacacagcaaacggctgtccctcc

SEQ ID NO: 370632 - DNA, 25 bp, Mus musculus
tgacacagctaacttcacagccatg

SEQ ID NO: 370633 - DNA, 25 bp, Mus musculus
tgacacagctaagttcacagccatg

SEQ ID NO: 370634 - DNA, 25 bp, Mus musculus
tgacacaggaggacctccaccatgg

SEQ ID NO: 370635 - DNA, 25 bp, Mus musculus
tgacacatacggacctcaaacctga

SEQ ID NO: 370636 - DNA, 25 bp, Mus musculus
tgacacatgatgctatcatgaacat

SEQ ID NO: 370637 - DNA, 25 bp, Mus musculus
tgacacatgatggctatttgaaact

SEQ ID NO: 370638 - DNA, 25 bp, Mus musculus
tgacacatgctcaggacccatagat

SEQ ID NO: 370639 - DNA, 25 bp, Mus musculus
tgacacattggcggctttcttgatc

SEQ ID NO: 370640 - DNA, 25 bp, Mus musculus
tgacaccacaaccagctaaagaacg

SEQ ID NO: 370641 - DNA, 25 bp, Mus musculus
tgacaccaccaagatcccatggttt

SEQ ID NO: 370642 - DNA, 25 bp, Mus musculus
tgacaccagagaccttaaccgaagg

SEQ ID NO: 370643 - DNA, 25 bp, Mus musculus
tgacaccagcagacatagactgcca

SEQ ID NO: 370644 - DNA, 25 bp, Mus musculus
tgacaccagcagtcatagactgcca

SEQ ID NO: 370645 - DNA, 25 bp, Mus musculus
tgacaccagctgcaaggtgtgaggt

SEQ ID NO: 370646 - DNA, 25 bp, Mus musculus
tgacaccatcaagcacccaggaggt

SEQ ID NO: 370647 - DNA, 25 bp, Mus musculus
tgacaccatgcctgctgacaaggac

SEQ ID NO: 370648 - DNA, 25 bp, Mus musculus
tgacacccagggtcctcactgcagt

SEQ ID NO: 370649 - DNA, 25 bp, Mus musculus
tgacacccatcccagaaccaggcag

SEQ ID NO: 370650 - DNA, 25 bp, Mus musculus
tgacacccattgagaatcctataag

SEQ ID NO: 370651 - DNA, 25 bp, Mus musculus
tgacacccattgaggcccaaacacg

SEQ ID NO: 370652 - DNA, 25 bp, Mus musculus
tgacaccgcgcggcgaagtcaatga

SEQ ID NO: 370653 - DNA, 25 bp, Mus musculus
tgacaccgtacgaggcagctgtggc

SEQ ID NO: 370654 - DNA, 25 bp, Mus musculus
tgacacctaaggtgaaggcgataaa

SEQ ID NO: 370655 - DNA, 25 bp, Mus musculus
tgacacctcagggcacacttgccga

SEQ ID NO: 370656 - DNA, 25 bp, Mus musculus
tgacacctcaggtaaaccccttgac

SEQ ID NO: 370657 - DNA, 25 bp, Mus musculus
tgacacctcaggtggaccccttgac

SEQ ID NO: 370658 - DNA, 25 bp, Mus musculus
tgacacctccatgtatcccaagggt

SEQ ID NO: 370659 - DNA, 25 bp, Mus musculus
tgacacctggaaggcagccagagta

SEQ ID NO: 370660 - DNA, 25 bp, Mus musculus
tgacacctgtgtacaggaaaactcc

SEQ ID NO: 370661 - DNA, 25 bp, Mus musculus
tgacacctgttgcaggcatgatggg

SEQ ID NO: 370662 - DNA, 25 bp, Mus musculus
tgacacgctgagaaatacgaagaaa

SEQ ID NO: 370663 - DNA, 25 bp, Mus musculus
tgacacgctgagaatatatcagagc

SEQ ID NO: 370664 - DNA, 25 bp, Mus musculus
tgacacggagagaagattaaggaca

SEQ ID NO: 370665 - DNA, 25 bp, Mus musculus
tgacacggagcaggaaggcaaatac

SEQ ID NO: 370666 - DNA, 25 bp, Mus musculus
tgacactactgatttcagctctgat

SEQ ID NO: 370667 - DNA, 25 bp, Mus musculus
tgacactcagatcaaattgcttatt

SEQ ID NO: 370668 - DNA, 25 bp, Mus musculus
tgacactccacacttggatgctcaa

SEQ ID NO: 370669 - DNA, 25 bp, Mus musculus
tgacactccacagaagtgtacagtc

SEQ ID NO: 370670 - DNA, 25 bp, Mus musculus
tgacactcgaggatgtgaagcagga

SEQ ID NO: 370671 - DNA, 25 bp, Mus musculus
tgacactgaagttggtgagtctagc

SEQ ID NO: 370672 - DNA, 25 bp, Mus musculus
tgacactgaggtcgcatcaaatatc

SEQ ID NO: 370673 - DNA, 25 bp, Mus musculus
tgacactgctgacagtgccacggcc

SEQ ID NO: 370674 - DNA, 25 bp, Mus musculus
tgacactgctgatgccgagtgctga

SEQ ID NO: 370675 - DNA, 25 bp, Mus musculus
tgacactgcttttctccttccgcaa

SEQ ID NO: 370676 - DNA, 25 bp, Mus musculus
tgacactggcctctgagagctgtcg

SEQ ID NO: 370677 - DNA, 25 bp, Mus musculus
tgacactgtcagagtatttttctat

SEQ ID NO: 370678 - DNA, 25 bp, Mus musculus
tgacacttaagggctacttgattag

SEQ ID NO: 370679 - DNA, 25 bp, Mus musculus
tgacacttccgtgttaggcacgggc

SEQ ID NO: 370680 - DNA, 25 bp, Mus musculus
tgacacttgggaggccatggaggac

SEQ ID NO: 370681 - DNA, 25 bp, Mus musculus
tgacagaaagcagatttcaacaaga

SEQ ID NO: 370682 - DNA, 25 bp, Mus musculus
tgacagaaaggaaacatggagctcg

SEQ ID NO: 370683 - DNA, 25 bp, Mus musculus
tgacagaaaggcgatctctttccaa

SEQ ID NO: 370684 - DNA, 25 bp, Mus musculus
tgacagaaagggaacgcatcatcaa

SEQ ID NO: 370685 - DNA, 25 bp, Mus musculus
tgacagaacaggtcctgctgcaggc

SEQ ID NO: 370686 - DNA, 25 bp, Mus musculus
tgacagaacagtttttggcctttga

SEQ ID NO: 370687 - DNA, 25 bp, Mus musculus
tgacagaacccgaaaagggccctgt

SEQ ID NO: 370688 - DNA, 25 bp, Mus musculus
tgacagaacccgagctgcctgccga

SEQ ID NO: 370689 - DNA, 25 bp, Mus musculus
tgacagacaagatttgaaagaagcg

SEQ ID NO: 370690 - DNA, 25 bp, Mus musculus
tgacagacagaacagtctaagagtg

SEQ ID NO: 370691 - DNA, 25 bp, Mus musculus
tgacagacagaatgtactttcctta

SEQ ID NO: 370692 - DNA, 25 bp, Mus musculus
tgacagacagactgggaaaacatcg

SEQ ID NO: 370693 - DNA, 25 bp, Mus musculus
tgacagacagtatctgaacacagtc

SEQ ID NO: 370694 - DNA, 25 bp, Mus musculus
tgacagacagtttcgcatttggctc

SEQ ID NO: 370695 - DNA, 25 bp, Mus musculus
tgacagaccaagtctgctgaagaca

SEQ ID NO: 370696 - DNA, 25 bp, Mus musculus
tgacagacgaggtaaacagcccaga

SEQ ID NO: 370697 - DNA, 25 bp, Mus musculus
tgacagactccccagtttctcaagg

SEQ ID NO: 370698 - DNA, 25 bp, Mus musculus
tgacagactgagccccttaggtgag

SEQ ID NO: 370699 - DNA, 25 bp, Mus musculus
tgacagagaaacgtctgtctgcagg

SEQ ID NO: 370700 - DNA, 25 bp, Mus musculus
tgacagagaaagatgccaagctggg

SEQ ID NO: 370701 - DNA, 25 bp, Mus musculus
tgacagagaggaggagacacggtct

SEQ ID NO: 370702 - DNA, 25 bp, Mus musculus
tgacagagctgaagagccagatgaa

SEQ ID NO: 370703 - DNA, 25 bp, Mus musculus
tgacagagggggaggaagaaattgt

SEQ ID NO: 370704 - DNA, 25 bp, Mus musculus
tgacagagtgactgtatacgacatt

SEQ ID NO: 370705 - DNA, 25 bp, Mus musculus
tgacagataagaactgagtcaaaca

SEQ ID NO: 370706 - DNA, 25 bp, Mus musculus
tgacagataagtgtccagctgctcc

SEQ ID NO: 370707 - DNA, 25 bp, Mus musculus
tgacagataagttcggaataaattg

SEQ ID NO: 370708 - DNA, 25 bp, Mus musculus
tgacagatacttctgtgagtgcaaa

SEQ ID NO: 370709 - DNA, 25 bp, Mus musculus
tgacagatatagactcttcaagaaa

SEQ ID NO: 370710 - DNA, 25 bp, Mus musculus
tgacagatgatatgctggacaaatt

SEQ ID NO: 370711 - DNA, 25 bp, Mus musculus
tgacagatgatcaggagttagtgag

SEQ ID NO: 370712 - DNA, 25 bp, Mus musculus
tgacagatgtcatgctgtgtgcagg

SEQ ID NO: 370713 - DNA, 25 bp, Mus musculus
tgacagatgttctgcgccccactca

SEQ ID NO: 370714 - DNA, 25 bp, Mus musculus
tgacagatgttctggccaacctctc

SEQ ID NO: 370715 - DNA, 25 bp, Mus musculus
tgacagatttaagagtttgtttcta

SEQ ID NO: 370716 - DNA, 25 bp, Mus musculus
tgacagatttaagcttccttccact

SEQ ID NO: 370717 - DNA, 25 bp, Mus musculus
tgacagcaaacgaggcctaagtcac

SEQ ID NO: 370718 - DNA, 25 bp, Mus musculus
tgacagcaaaggcacccggattctg

SEQ ID NO: 370719 - DNA, 25 bp, Mus musculus
tgacagcaacagttagagatggtga

SEQ ID NO: 370720 - DNA, 25 bp, Mus musculus
tgacagcagcgcccggacgtcctcc

SEQ ID NO: 370721 - DNA, 25 bp, Mus musculus
tgacagcataggtccctcactctcc

SEQ ID NO: 370722 - DNA, 25 bp, Mus musculus
tgacagcattaacaggagaagggaa

SEQ ID NO: 370723 - DNA, 25 bp, Mus musculus
tgacagccagaagaattggctggac

SEQ ID NO: 370724 - DNA, 25 bp, Mus musculus
tgacagccagaaggtagcccctgga

SEQ ID NO: 370725 - DNA, 25 bp, Mus musculus
tgacagccagatgaatagagaagaa

SEQ ID NO: 370726 - DNA, 25 bp, Mus musculus
tgacagccctgtgtggggctgcctt

SEQ ID NO: 370727 - DNA, 25 bp, Mus musculus
tgacagcctctctggtacatggctt

SEQ ID NO: 370728 - DNA, 25 bp, Mus musculus
tgacagccttaccctgattaacctg

SEQ ID NO: 370729 - DNA, 25 bp, Mus musculus
tgacagctatgtccccagtgacctg

SEQ ID NO: 370730 - DNA, 25 bp, Mus musculus
tgacagctctgcaagagaagctgat

SEQ ID NO: 370731 - DNA, 25 bp, Mus musculus
tgacagctctgcaagtacggttaga

SEQ ID NO: 370732 - DNA, 25 bp, Mus musculus
tgacagctctgcctatttgatcaag

SEQ ID NO: 370733 - DNA, 25 bp, Mus musculus
tgacagctgggatctccatctttcc

SEQ ID NO: 370734 - DNA, 25 bp, Mus musculus
tgacaggactaagagggtgtttctt

SEQ ID NO: 370735 - DNA, 25 bp, Mus musculus
tgacaggactaaggggaagactgtc

SEQ ID NO: 370736 - DNA, 25 bp, Mus musculus
tgacaggagttcgggactctgctga

SEQ ID NO: 370737 - DNA, 25 bp, Mus musculus
tgacaggatggctgggcacagagta

SEQ ID NO: 370738 - DNA, 25 bp, Mus musculus
tgacaggatgttggtgttggtacta

SEQ ID NO: 370739 - DNA, 25 bp, Mus musculus
tgacaggcacgagctgcaggtcctg

SEQ ID NO: 370740 - DNA, 25 bp, Mus musculus
tgacaggcagaggcacggtagatgg

SEQ ID NO: 370741 - DNA, 25 bp, Mus musculus
tgacaggcaggccaggagtgtgcct

SEQ ID NO: 370742 - DNA, 25 bp, Mus musculus
tgacaggcatcctggtcatttgaag

SEQ ID NO: 370743 - DNA, 25 bp, Mus musculus
tgacaggcatgagtaaagacatttc

SEQ ID NO: 370744 - DNA, 25 bp, Mus musculus
tgacaggccttccagggctgaccag

SEQ ID NO: 370745 - DNA, 25 bp, Mus musculus
tgacagggatgagtgggatgtacca

SEQ ID NO: 370746 - DNA, 25 bp, Mus musculus
tgacaggggcacaaggcattgccac

SEQ ID NO: 370747 - DNA, 25 bp, Mus musculus
tgacaggtagccaggcttggcacgt

SEQ ID NO: 370748 - DNA, 25 bp, Mus musculus
tgacaggtattgagatgttccacaa

SEQ ID NO: 370749 - DNA, 25 bp, Mus musculus
tgacaggtctaaaaggcttggtggc

SEQ ID NO: 370750 - DNA, 25 bp, Mus musculus
tgacaggtctatgctgaggggtggt

SEQ ID NO: 370751 - DNA, 25 bp, Mus musculus
tgacagtaagggtgatgcccggtac

SEQ ID NO: 370752 - DNA, 25 bp, Mus musculus
tgacagtatcgaggagaaagaaaag

SEQ ID NO: 370753 - DNA, 25 bp, Mus musculus
tgacagtatggaagggcctagtcaa

SEQ ID NO: 370754 - DNA, 25 bp, Mus musculus
tgacagtcaaagaacactggtgaag

SEQ ID NO: 370755 - DNA, 25 bp, Mus musculus
tgacagtcaatcagaatcagatagt

SEQ ID NO: 370756 - DNA, 25 bp, Mus musculus
tgacagtcaatcaggtacatccaaa

SEQ ID NO: 370757 - DNA, 25 bp, Mus musculus
tgacagtccagagcgcctccccatc

SEQ ID NO: 370758 - DNA, 25 bp, Mus musculus
tgacagtcggaccagatggtgactt

SEQ ID NO: 370759 - DNA, 25 bp, Mus musculus
tgacagtgaagatccagccataaaa

SEQ ID NO: 370760 - DNA, 25 bp, Mus musculus
tgacagtgaaggtatgctgcaagac

SEQ ID NO: 370761 - DNA, 25 bp, Mus musculus
tgacagtgaagtgtaacaactaaat

SEQ ID NO: 370762 - DNA, 25 bp, Mus musculus
tgacagtgacccggctaagcatggg

SEQ ID NO: 370763 - DNA, 25 bp, Mus musculus
tgacagtgacccggtgaagactttt

SEQ ID NO: 370764 - DNA, 25 bp, Mus musculus
tgacagtgacctggctgaagaattt

SEQ ID NO: 370765 - DNA, 25 bp, Mus musculus
tgacagtgagaacacaaacctccaa

SEQ ID NO: 370766 - DNA, 25 bp, Mus musculus
tgacagtgaggatccaaaggaggcc

SEQ ID NO: 370767 - DNA, 25 bp, Mus musculus
tgacagtgatactagtcgacaatta

SEQ ID NO: 370768 - DNA, 25 bp, Mus musculus
tgacagtgatactagtttaaaagcc

SEQ ID NO: 370769 - DNA, 25 bp, Mus musculus
tgacagtgcagggtcaccatcatga

SEQ ID NO: 370770 - DNA, 25 bp, Mus musculus
tgacagtgccaacctggagaaggcg

SEQ ID NO: 370771 - DNA, 25 bp, Mus musculus
tgacagtggaaaggttgagttattt

SEQ ID NO: 370772 - DNA, 25 bp, Mus musculus
tgacagtgtcaagttctgtggatct

SEQ ID NO: 370773 - DNA, 25 bp, Mus musculus
tgacagtgtctcggttattcccaat

SEQ ID NO: 370774 - DNA, 25 bp, Mus musculus
tgacagtgtggctcagactcctgag

SEQ ID NO: 370775 - DNA, 25 bp, Mus musculus
tgacagttctgccagcgcctgtgag

SEQ ID NO: 370776 - DNA, 25 bp, Mus musculus
tgacagttgcttataggctcttgaa

SEQ ID NO: 370777 - DNA, 25 bp, Mus musculus
tgacataagtgaacctagtaacaaa

SEQ ID NO: 370778 - DNA, 25 bp, Mus musculus
tgacatactggggtgagcatgccaa

SEQ ID NO: 370779 - DNA, 25 bp, Mus musculus
tgacatagagtgtgctgctctggtt

SEQ ID NO: 370780 - DNA, 25 bp, Mus musculus
tgacatagcctgctgggtccaccat

SEQ ID NO: 370781 - DNA, 25 bp, Mus musculus
tgacatcaacaaggtgtttgagttt

SEQ ID NO: 370782 - DNA, 25 bp, Mus musculus
tgacatcaagaaggcgtaccgaaag

SEQ ID NO: 370783 - DNA, 25 bp, Mus musculus
tgacatcaagaagggagaagaaatg

SEQ ID NO: 370784 - DNA, 25 bp, Mus musculus
tgacatcaagctggaaaaccttatg

SEQ ID NO: 370785 - DNA, 25 bp, Mus musculus
tgacatcacagatgagctccagtgt

SEQ ID NO: 370786 - DNA, 25 bp, Mus musculus
tgacatcacagctggtgaatgagca

SEQ ID NO: 370787 - DNA, 25 bp, Mus musculus
tgacatcaccagccgagaaacctgc

SEQ ID NO: 370788 - DNA, 25 bp, Mus musculus
tgacatcaccaggcgagaaacctgc

SEQ ID NO: 370789 - DNA, 25 bp, Mus musculus
tgacatcaccctgacctgcaactcc

SEQ ID NO: 370790 - DNA, 25 bp, Mus musculus
tgacatcagaaaattagaccgattc

SEQ ID NO: 370791 - DNA, 25 bp, Mus musculus
tgacatcagaggagagcccagaggc

SEQ ID NO: 370792 - DNA, 25 bp, Mus musculus
tgacatcagccctggttcaggcagc

SEQ ID NO: 370793 - DNA, 25 bp, Mus musculus
tgacatcagctctgagtggtgggac

SEQ ID NO: 370794 - DNA, 25 bp, Mus musculus
tgacatcagctctgggcgtcagtgt

SEQ ID NO: 370795 - DNA, 25 bp, Mus musculus
tgacatcatcgagaccctgaggaag

SEQ ID NO: 370796 - DNA, 25 bp, Mus musculus
tgacatcatcgaggcgctgcacaag

SEQ ID NO: 370797 - DNA, 25 bp, Mus musculus
tgacatcattcagaatctgtccgtg

SEQ ID NO: 370798 - DNA, 25 bp, Mus musculus
tgacatccaggacctcatgtggcag

SEQ ID NO: 370799 - DNA, 25 bp, Mus musculus
tgacatccagtcaccagatttcgtg

SEQ ID NO: 370800 - DNA, 25 bp, Mus musculus
tgacatccccctggttggttttatc

SEQ ID NO: 370801 - DNA, 25 bp, Mus musculus
tgacatccgacttcgccctcagctt

SEQ ID NO: 370802 - DNA, 25 bp, Mus musculus
tgacatccggacagccagcgatggg

SEQ ID NO: 370803 - DNA, 25 bp, Mus musculus
tgacatccggacaggctgacgatgc

SEQ ID NO: 370804 - DNA, 25 bp, Mus musculus
tgacatccggatgctgaccttcatc

SEQ ID NO: 370805 - DNA, 25 bp, Mus musculus
tgacatccgggtcaaggctggttct

SEQ ID NO: 370806 - DNA, 25 bp, Mus musculus
tgacatcctagacaacaacgggacc

SEQ ID NO: 370807 - DNA, 25 bp, Mus musculus
tgacatcctgttgtacgtggtgatc

SEQ ID NO: 370808 - DNA, 25 bp, Mus musculus
tgacatccttggcagcactgcaggt

SEQ ID NO: 370809 - DNA, 25 bp, Mus musculus
tgacatctacagctataacccagat

SEQ ID NO: 370810 - DNA, 25 bp, Mus musculus
tgacatctatgtgattggttaccag

SEQ ID NO: 370811 - DNA, 25 bp, Mus musculus
tgacatcttcaacccgatctccctg

SEQ ID NO: 370812 - DNA, 25 bp, Mus musculus
tgacatcttcaaccggatctccctg

SEQ ID NO: 370813 - DNA, 25 bp, Mus musculus
tgacatcttctgggtattcggcacc

SEQ ID NO: 370814 - DNA, 25 bp, Mus musculus
tgacatgacctctatagcgtctcta

SEQ ID NO: 370815 - DNA, 25 bp, Mus musculus
tgacatgacctctatataaactgaa

SEQ ID NO: 370816 - DNA, 25 bp, Mus musculus
tgacatgagtttaaggttaaatgag

SEQ ID NO: 370817 - DNA, 25 bp, Mus musculus
tgacatgccagcccactggaagccg

SEQ ID NO: 370818 - DNA, 25 bp, Mus musculus
tgacatggaggaaatgctgtcattc

SEQ ID NO: 370819 - DNA, 25 bp, Mus musculus
tgacatggaggatatgctgtcattc

SEQ ID NO: 370820 - DNA, 25 bp, Mus musculus
tgacatggagtggaagacatgaacc

SEQ ID NO: 370821 - DNA, 25 bp, Mus musculus
tgacatggcaacagaagttggtttc

SEQ ID NO: 370822 - DNA, 25 bp, Mus musculus
tgacatggcctcaggtggcccggca

SEQ ID NO: 370823 - DNA, 25 bp, Mus musculus
tgacatggtaaagggaatgcagtgg

SEQ ID NO: 370824 - DNA, 25 bp, Mus musculus
tgacatggtctagagctttatggat

SEQ ID NO: 370825 - DNA, 25 bp, Mus musculus
tgacatgtacaacagaatgaccagt

SEQ ID NO: 370826 - DNA, 25 bp, Mus musculus
tgacatgtcaaggtcctgggtgagc

SEQ ID NO: 370827 - DNA, 25 bp, Mus musculus
tgacattaaaaacctgcaactggat

SEQ ID NO: 370828 - DNA, 25 bp, Mus musculus
tgacattaaaaaccttaggttgttc

SEQ ID NO: 370829 - DNA, 25 bp, Mus musculus
tgacattacaggaccaggtggacac

SEQ ID NO: 370830 - DNA, 25 bp, Mus musculus
tgacattactggcatgcctgtggtc

SEQ ID NO: 370831 - DNA, 25 bp, Mus musculus
tgacattcaacagagctgccttccg

SEQ ID NO: 370832 - DNA, 25 bp, Mus musculus
tgacattcacctgctgtcttccctg

SEQ ID NO: 370833 - DNA, 25 bp, Mus musculus
tgacattcagagttgaaactgtggg

SEQ ID NO: 370834 - DNA, 25 bp, Mus musculus
tgacattcaggtgcagtctttgtca

SEQ ID NO: 370835 - DNA, 25 bp, Mus musculus
tgacattccccaggattgggtttcc

SEQ ID NO: 370836 - DNA, 25 bp, Mus musculus
tgacattccttcattagtgaaaaga

SEQ ID NO: 370837 - DNA, 25 bp, Mus musculus
tgacattcgcgcctagtattttgtt

SEQ ID NO: 370838 - DNA, 25 bp, Mus musculus
tgacattgaaagagcccattctgca

SEQ ID NO: 370839 - DNA, 25 bp, Mus musculus
tgacattgagagggaatgaggtctt

SEQ ID NO: 370840 - DNA, 25 bp, Mus musculus
tgacattgagagggagagtgtggag

SEQ ID NO: 370841 - DNA, 25 bp, Mus musculus
tgacattgccctcccctttttttgt

SEQ ID NO: 370842 - DNA, 25 bp, Mus musculus
tgacattgtagaaaaaatcgatgcc

SEQ ID NO: 370843 - DNA, 25 bp, Mus musculus
tgacatttaaaacagttgccatcca

SEQ ID NO: 370844 - DNA, 25 bp, Mus musculus
tgacatttaccatatgacttttcca

SEQ ID NO: 370845 - DNA, 25 bp, Mus musculus
tgacatttctgttggaggcctccct

SEQ ID NO: 370846 - DNA, 25 bp, Mus musculus
tgaccaaaaataaggtacaagttca

SEQ ID NO: 370847 - DNA, 25 bp, Mus musculus
tgaccaaaagggcaacatccccgat

SEQ ID NO: 370848 - DNA, 25 bp, Mus musculus
tgaccaaacaggccatcgtgtatga

SEQ ID NO: 370849 - DNA, 25 bp, Mus musculus
tgaccaaacaggcgctgctaagttt

SEQ ID NO: 370850 - DNA, 25 bp, Mus musculus
tgaccaaacgcagaagcttgcagga

SEQ ID NO: 370851 - DNA, 25 bp, Mus musculus
tgaccaaacgttagaaaagtcctgg

SEQ ID NO: 370852 - DNA, 25 bp, Mus musculus
tgaccaaagaatacattccaccact

SEQ ID NO: 370853 - DNA, 25 bp, Mus musculus
tgaccaaatggagatataatcatgt

SEQ ID NO: 370854 - DNA, 25 bp, Mus musculus
tgaccaacaacactgacaggggcat

SEQ ID NO: 370855 - DNA, 25 bp, Mus musculus
tgaccaacaagtagcaggattgtct

SEQ ID NO: 370856 - DNA, 25 bp, Mus musculus
tgaccaacagaacatacaacatcag

SEQ ID NO: 370857 - DNA, 25 bp, Mus musculus
tgaccaacagcaacatggccaatgc

SEQ ID NO: 370858 - DNA, 25 bp, Mus musculus
tgaccaacagtttgaaggaaggaag

SEQ ID NO: 370859 - DNA, 25 bp, Mus musculus
tgaccaacattcagggtctactgaa

SEQ ID NO: 370860 - DNA, 25 bp, Mus musculus
tgaccaaccagattgagagccaccc

SEQ ID NO: 370861 - DNA, 25 bp, Mus musculus
tgaccaaccaggtcgagtgtcaccc

SEQ ID NO: 370862 - DNA, 25 bp, Mus musculus
tgaccaagacccgggcctggttctc

SEQ ID NO: 370863 - DNA, 25 bp, Mus musculus
tgaccaagaggtcgctcgcattcgg

SEQ ID NO: 370864 - DNA, 25 bp, Mus musculus
tgaccaagctgtagatcaagtctcc

SEQ ID NO: 370865 - DNA, 25 bp, Mus musculus
tgaccaagctgtagcatagttttgg

SEQ ID NO: 370866 - DNA, 25 bp, Mus musculus
tgaccaagttacaggaggcagtgac

SEQ ID NO: 370867 - DNA, 25 bp, Mus musculus
tgaccaagttacaggtctcctgttt

SEQ ID NO: 370868 - DNA, 25 bp, Mus musculus
tgaccaatatgagaaagtttggtga

SEQ ID NO: 370869 - DNA, 25 bp, Mus musculus
tgaccaatcaggatgtgatcaaggc

SEQ ID NO: 370870 - DNA, 25 bp, Mus musculus
tgaccaatcagttcatgcagaagaa

SEQ ID NO: 370871 - DNA, 25 bp, Mus musculus
tgaccaatttagtattcgcctggga

SEQ ID NO: 370872 - DNA, 25 bp, Mus musculus
tgaccacaccctgttcttgcttcag

SEQ ID NO: 370873 - DNA, 25 bp, Mus musculus
tgaccacacggatatggaagaggga

SEQ ID NO: 370874 - DNA, 25 bp, Mus musculus
tgaccacagacaaggccaacatcaa

SEQ ID NO: 370875 - DNA, 25 bp, Mus musculus
tgaccacagagagttctccagattt

SEQ ID NO: 370876 - DNA, 25 bp, Mus musculus
tgaccacagccaactttccagatgt

SEQ ID NO: 370877 - DNA, 25 bp, Mus musculus
tgaccacaggacaggattatggaaa

SEQ ID NO: 370878 - DNA, 25 bp, Mus musculus
tgaccacatctgtcaaattatcaca

SEQ ID NO: 370879 - DNA, 25 bp, Mus musculus
tgaccacatgcagaatcacagcgag

SEQ ID NO: 370880 - DNA, 25 bp, Mus musculus
tgaccacatgcaggagagattttgg

SEQ ID NO: 370881 - DNA, 25 bp, Mus musculus
tgaccaccacacaggccagacccat

SEQ ID NO: 370882 - DNA, 25 bp, Mus musculus
tgaccaccacacccagtgttgggca

SEQ ID NO: 370883 - DNA, 25 bp, Mus musculus
tgaccaccacggcatcacggctgcg

SEQ ID NO: 370884 - DNA, 25 bp, Mus musculus
tgaccaccactaccatcacggagaa

SEQ ID NO: 370885 - DNA, 25 bp, Mus musculus
tgaccacccagatgttgccgcacta

SEQ ID NO: 370886 - DNA, 25 bp, Mus musculus
tgaccaccgacatggtaaagaactt

SEQ ID NO: 370887 - DNA, 25 bp, Mus musculus
tgaccaccttctacaattcccagcg

SEQ ID NO: 370888 - DNA, 25 bp, Mus musculus
tgaccactacgcaggaggattacaa

SEQ ID NO: 370889 - DNA, 25 bp, Mus musculus
tgaccactacgcagttaccgtgacg

SEQ ID NO: 370890 - DNA, 25 bp, Mus musculus
tgaccactcaagcccatcgtttctg

SEQ ID NO: 370891 - DNA, 25 bp, Mus musculus
tgaccactcaaggcaccacaatggg

SEQ ID NO: 370892 - DNA, 25 bp, Mus musculus
tgaccactcagctgctgcgctgccc

SEQ ID NO: 370893 - DNA, 25 bp, Mus musculus
tgaccactcgaccaggttctgggct

SEQ ID NO: 370894 - DNA, 25 bp, Mus musculus
tgaccactgcaaggtgctgagacgt

SEQ ID NO: 370895 - DNA, 25 bp, Mus musculus
tgaccactgcagtctctctctccag

SEQ ID NO: 370896 - DNA, 25 bp, Mus musculus
tgaccagaagcagctggtgaatgag

SEQ ID NO: 370897 - DNA, 25 bp, Mus musculus
tgaccagaagcagggaaaaggctct

SEQ ID NO: 370898 - DNA, 25 bp, Mus musculus
tgaccagacctacgataaccacttc

SEQ ID NO: 370899 - DNA, 25 bp, Mus musculus
tgaccagatagagctggagctggcc

SEQ ID NO: 370900 - DNA, 25 bp, Mus musculus
tgaccagatcagaagaacagtctat

SEQ ID NO: 370901 - DNA, 25 bp, Mus musculus
tgaccagatcagaagaccaggaacc

SEQ ID NO: 370902 - DNA, 25 bp, Mus musculus
tgaccagatcagaagagctctgcag

SEQ ID NO: 370903 - DNA, 25 bp, Mus musculus
tgaccagattgccgacttcaaggag

SEQ ID NO: 370904 - DNA, 25 bp, Mus musculus
tgaccagattgccgatcgagttctc

SEQ ID NO: 370905 - DNA, 25 bp, Mus musculus
tgaccagcaaatctcactggaagct

SEQ ID NO: 370906 - DNA, 25 bp, Mus musculus
tgaccagctggcaaggttatgaaaa

SEQ ID NO: 370907 - DNA, 25 bp, Mus musculus
tgaccaggaacacgggggcttcttc

SEQ ID NO: 370908 - DNA, 25 bp, Mus musculus
tgaccaggcagttctagatgagcgc

SEQ ID NO: 370909 - DNA, 25 bp, Mus musculus
tgaccagggcgacttcgagaagccc

SEQ ID NO: 370910 - DNA, 25 bp, Mus musculus
tgaccaggtttgggttccccaggat

SEQ ID NO: 370911 - DNA, 25 bp, Mus musculus
tgaccagtctatatatattggggcc

SEQ ID NO: 370912 - DNA, 25 bp, Mus musculus
tgaccagtctccaagatggcggtaa

SEQ ID NO: 370913 - DNA, 25 bp, Mus musculus
tgaccagtgactccaatatgcctga

SEQ ID NO: 370914 - DNA, 25 bp, Mus musculus
tgaccatacagatcatgtcatcagg

SEQ ID NO: 370915 - DNA, 25 bp, Mus musculus
tgaccatacaggctgggccggtaat

SEQ ID NO: 370916 - DNA, 25 bp, Mus musculus
tgaccatacaggtatgtcatcaggc

SEQ ID NO: 370917 - DNA, 25 bp, Mus musculus
tgaccatactcccgagatgttagat

SEQ ID NO: 370918 - DNA, 25 bp, Mus musculus
tgaccatactggacaccctttcagc

SEQ ID NO: 370919 - DNA, 25 bp, Mus musculus
tgaccatagacgagttggagtggaa

SEQ ID NO: 370920 - DNA, 25 bp, Mus musculus
tgaccatagacgtggaaactgtctg

SEQ ID NO: 370921 - DNA, 25 bp, Mus musculus
tgaccatcaagctgacccctgccca

SEQ ID NO: 370922 - DNA, 25 bp, Mus musculus
tgaccatcacagggtttgtggatgc

SEQ ID NO: 370923 - DNA, 25 bp, Mus musculus
tgaccatcacaggtctattctggat

SEQ ID NO: 370924 - DNA, 25 bp, Mus musculus
tgaccatcacagtccgcaccaagaa

SEQ ID NO: 370925 - DNA, 25 bp, Mus musculus
tgaccatcagacaagctgcaaccct

SEQ ID NO: 370926 - DNA, 25 bp, Mus musculus
tgaccatcaggactcttccccccac

SEQ ID NO: 370927 - DNA, 25 bp, Mus musculus
tgaccatcaggtactgcagggttgc

SEQ ID NO: 370928 - DNA, 25 bp, Mus musculus
tgaccatccagaaaaaacactgaat

SEQ ID NO: 370929 - DNA, 25 bp, Mus musculus
tgaccatgaccaggaataactcaac

SEQ ID NO: 370930 - DNA, 25 bp, Mus musculus
tgaccatgaccaggcgctggctcag

SEQ ID NO: 370931 - DNA, 25 bp, Mus musculus
tgaccatgcggatccttccattttc

SEQ ID NO: 370932 - DNA, 25 bp, Mus musculus
tgaccatgctccgagccgctggttt

SEQ ID NO: 370933 - DNA, 25 bp, Mus musculus
tgaccatgctccgagggtctgacta

SEQ ID NO: 370934 - DNA, 25 bp, Mus musculus
tgaccatggacgatctgtttcccct

SEQ ID NO: 370935 - DNA, 25 bp, Mus musculus
tgaccatggccaagatggagttcca

SEQ ID NO: 370936 - DNA, 25 bp, Mus musculus
tgaccatgggcaatgacacgtcccc

SEQ ID NO: 370937 - DNA, 25 bp, Mus musculus
tgaccattactgggggatgcagaga

SEQ ID NO: 370938 - DNA, 25 bp, Mus musculus
tgaccattagtatagcaagaagcca

SEQ ID NO: 370939 - DNA, 25 bp, Mus musculus
tgaccattgaagatgatgactattc

SEQ ID NO: 370940 - DNA, 25 bp, Mus musculus
tgaccattgagcaagaactatgtca

SEQ ID NO: 370941 - DNA, 25 bp, Mus musculus
tgaccattgaggttatctggctgtt

SEQ ID NO: 370942 - DNA, 25 bp, Mus musculus
tgacccaaagatcttggcatataca

SEQ ID NO: 370943 - DNA, 25 bp, Mus musculus
tgacccaaggaatgattcccgttgc

SEQ ID NO: 370944 - DNA, 25 bp, Mus musculus
tgacccacagaacgagagcgccatc

SEQ ID NO: 370945 - DNA, 25 bp, Mus musculus
tgacccacagttcagaaactgtgaa

SEQ ID NO: 370946 - DNA, 25 bp, Mus musculus
tgacccaccaggtgccagcctcaca

SEQ ID NO: 370947 - DNA, 25 bp, Mus musculus
tgacccaccaggtgtgccaggggag

SEQ ID NO: 370948 - DNA, 25 bp, Mus musculus
tgacccagaattaggtatcgaagtg

SEQ ID NO: 370949 - DNA, 25 bp, Mus musculus
tgacccagacatgctgctcatcggg

SEQ ID NO: 370950 - DNA, 25 bp, Mus musculus
tgacccagaggtctttgacccactg

SEQ ID NO: 370951 - DNA, 25 bp, Mus musculus
tgacccagttgatggtcacccttcc

SEQ ID NO: 370952 - DNA, 25 bp, Mus musculus
tgacccagttgatggttggcagaac

SEQ ID NO: 370953 - DNA, 25 bp, Mus musculus
tgacccattctgtgctgcctgccag

SEQ ID NO: 370954 - DNA, 25 bp, Mus musculus
tgacccattctgtggctttcacttt

SEQ ID NO: 370955 - DNA, 25 bp, Mus musculus
tgacccattgaccagcaggaatcca

SEQ ID NO: 370956 - DNA, 25 bp, Mus musculus
tgaccccagcaagacattcaccccc

SEQ ID NO: 370957 - DNA, 25 bp, Mus musculus
tgaccccatgcagaccagactctga

SEQ ID NO: 370958 - DNA, 25 bp, Mus musculus
tgaccccatgcaggaatctgatgct

SEQ ID NO: 370959 - DNA, 25 bp, Mus musculus
tgaccccatgcaggtttatggtgtg

SEQ ID NO: 370960 - DNA, 25 bp, Mus musculus
tgaccccatgtggccacagtacacg

SEQ ID NO: 370961 - DNA, 25 bp, Mus musculus
tgacccccaagaggccattaactgt

SEQ ID NO: 370962 - DNA, 25 bp, Mus musculus
tgacccccaaggccatcgcccacta

SEQ ID NO: 370963 - DNA, 25 bp, Mus musculus
tgacccccacgtgattccttagaaa

SEQ ID NO: 370964 - DNA, 25 bp, Mus musculus
tgacccccacgtggaagaaaggtca

SEQ ID NO: 370965 - DNA, 25 bp, Mus musculus
tgacccccagcagtctaaggtggta

SEQ ID NO: 370966 - DNA, 25 bp, Mus musculus
tgaccccctagactggcttaagata

SEQ ID NO: 370967 - DNA, 25 bp, Mus musculus
tgaccccctggcaggacactactgg

SEQ ID NO: 370968 - DNA, 25 bp, Mus musculus
tgaccccgaagcttgatggtgtgaa

SEQ ID NO: 370969 - DNA, 25 bp, Mus musculus
tgaccccgaagttgatgaaacatat

SEQ ID NO: 370970 - DNA, 25 bp, Mus musculus
tgaccccgaattcctcctccaccgt

SEQ ID NO: 370971 - DNA, 25 bp, Mus musculus
tgaccccgcgggtccttcacacacc

SEQ ID NO: 370972 - DNA, 25 bp, Mus musculus
tgacccctgcgaggcggtgctggtg

SEQ ID NO: 370973 - DNA, 25 bp, Mus musculus
tgacccctggaggaaactctgatgc

SEQ ID NO: 370974 - DNA, 25 bp, Mus musculus
tgacccctggaggtggagacagaaa

SEQ ID NO: 370975 - DNA, 25 bp, Mus musculus
tgaccccttcaaaggtgatcctttc

SEQ ID NO: 370976 - DNA, 25 bp, Mus musculus
tgaccccttcttcgcagaatacaaa

SEQ ID NO: 370977 - DNA, 25 bp, Mus musculus
tgaccccttcttcgctgattctttt

SEQ ID NO: 370978 - DNA, 25 bp, Mus musculus
tgacccgaagggtcacagacgaacc

SEQ ID NO: 370979 - DNA, 25 bp, Mus musculus
tgacccgccaggacaatggattttc

SEQ ID NO: 370980 - DNA, 25 bp, Mus musculus
tgacccgctgttcattccttggaag

SEQ ID NO: 370981 - DNA, 25 bp, Mus musculus
tgacccggaggagagtccaccactg

SEQ ID NO: 370982 - DNA, 25 bp, Mus musculus
tgacccggccatcctacctgcctat

SEQ ID NO: 370983 - DNA, 25 bp, Mus musculus
tgacccggccatcgttgtggagctg

SEQ ID NO: 370984 - DNA, 25 bp, Mus musculus
tgacccggttcccgggctttgatga

SEQ ID NO: 370985 - DNA, 25 bp, Mus musculus
tgacccgtaagaccaagcgcccagc

SEQ ID NO: 370986 - DNA, 25 bp, Mus musculus
tgaccctagcttaagtatacctggc

SEQ ID NO: 370987 - DNA, 25 bp, Mus musculus
tgaccctatgtcagggttcggagcg

SEQ ID NO: 370988 - DNA, 25 bp, Mus musculus
tgaccctcagaaaaaagtggttatt

SEQ ID NO: 370989 - DNA, 25 bp, Mus musculus
tgaccctcagatagtgtttctagaa

SEQ ID NO: 370990 - DNA, 25 bp, Mus musculus
tgaccctcgtgagagctgcttcagc

SEQ ID NO: 370991 - DNA, 25 bp, Mus musculus
tgaccctcgtgagagggtttctctg

SEQ ID NO: 370992 - DNA, 25 bp, Mus musculus
tgaccctctgaaactgtgccgatcc

SEQ ID NO: 370993 - DNA, 25 bp, Mus musculus
tgaccctcttcggctacagcaagtg

SEQ ID NO: 370994 - DNA, 25 bp, Mus musculus
tgaccctgacccagcttctcgtgta

SEQ ID NO: 370995 - DNA, 25 bp, Mus musculus
tgaccctgacccaggaacacagtgt

SEQ ID NO: 370996 - DNA, 25 bp, Mus musculus
tgaccctgacccaggtcaacagctg

SEQ ID NO: 370997 - DNA, 25 bp, Mus musculus
tgaccctgagacgatccagaaccac

SEQ ID NO: 370998 - DNA, 25 bp, Mus musculus
tgaccctgcctccagcactgggaag

SEQ ID NO: 370999 - DNA, 25 bp, Mus musculus
tgaccctggaggtgagaaagtctgg

SEQ ID NO: 371000 - DNA, 25 bp, Mus musculus
tgaccctgtgtctcaggggcctacc

SEQ ID NO: 371001 - DNA, 25 bp, Mus musculus
tgacccttcctgaaggagcagagag

SEQ ID NO: 371002 - DNA, 25 bp, Mus musculus
tgacccttggcagacagggtccctt

SEQ ID NO: 371003 - DNA, 25 bp, Mus musculus
tgaccctttgcctggctccaagatg

SEQ ID NO: 371004 - DNA, 25 bp, Mus musculus
tgaccgaaagcacagccatcttgat

SEQ ID NO: 371005 - DNA, 25 bp, Mus musculus
tgaccgaatgagaaaggtttaactg

SEQ ID NO: 371006 - DNA, 25 bp, Mus musculus
tgaccgaatgagagactctacagga

SEQ ID NO: 371007 - DNA, 25 bp, Mus musculus
tgaccgaatgagctgccgagtgttt

SEQ ID NO: 371008 - DNA, 25 bp, Mus musculus
tgaccgagaaggagaagagttagaa

SEQ ID NO: 371009 - DNA, 25 bp, Mus musculus
tgaccgcaagaaaagtatcaaggag

SEQ ID NO: 371010 - DNA, 25 bp, Mus musculus
tgaccgcacaggtactgagacagag

SEQ ID NO: 371011 - DNA, 25 bp, Mus musculus
tgaccgcctggtctacgtgatcatt

SEQ ID NO: 371012 - DNA, 25 bp, Mus musculus
tgaccgcggagacccttccaatctg

SEQ ID NO: 371013 - DNA, 25 bp, Mus musculus
tgaccggaagtcactggtgacgctg

SEQ ID NO: 371014 - DNA, 25 bp, Mus musculus
tgaccggagagaaggtctaatgcgc

SEQ ID NO: 371015 - DNA, 25 bp, Mus musculus
tgaccggagctgagcatttcagatc

SEQ ID NO: 371016 - DNA, 25 bp, Mus musculus
tgaccggcagggtgatgctgagttc

SEQ ID NO: 371017 - DNA, 25 bp, Mus musculus
tgaccggctgacctgcaaatctggt

SEQ ID NO: 371018 - DNA, 25 bp, Mus musculus
tgaccggctgacctggccctctgtc

SEQ ID NO: 371019 - DNA, 25 bp, Mus musculus
tgaccggctgacctgttgaacactc

SEQ ID NO: 371020 - DNA, 25 bp, Mus musculus
tgaccggggcaggaagtggtccttc

SEQ ID NO: 371021 - DNA, 25 bp, Mus musculus
tgaccggttagccagggattacgca

SEQ ID NO: 371022 - DNA, 25 bp, Mus musculus
tgaccgtaaagtgttcgtgggtaga

SEQ ID NO: 371023 - DNA, 25 bp, Mus musculus
tgaccgtaccaagggatagcccacc

SEQ ID NO: 371024 - DNA, 25 bp, Mus musculus
tgaccgtatcaccattgaaatacct

SEQ ID NO: 371025 - DNA, 25 bp, Mus musculus
tgaccgtgacccagcccgtccgcct

SEQ ID NO: 371026 - DNA, 25 bp, Mus musculus
tgaccgtgagcccattctgcactcc

SEQ ID NO: 371027 - DNA, 25 bp, Mus musculus
tgaccgtgccgaacgtgctggccaa

SEQ ID NO: 371028 - DNA, 25 bp, Mus musculus
tgaccgtgctgaaaggaagcaggtc

SEQ ID NO: 371029 - DNA, 25 bp, Mus musculus
tgaccgttctggaagccctggaaga

SEQ ID NO: 371030 - DNA, 25 bp, Mus musculus
tgacctaacaaatgtcgagtggctg

SEQ ID NO: 371031 - DNA, 25 bp, Mus musculus
tgacctaacaggtgtgaaagatgtt

SEQ ID NO: 371032 - DNA, 25 bp, Mus musculus
tgacctaatgcagtcatccttccta

SEQ ID NO: 371033 - DNA, 25 bp, Mus musculus
tgacctaccagggtacgagccgccc

SEQ ID NO: 371034 - DNA, 25 bp, Mus musculus
tgacctaccggttcttcagcgaacc

SEQ ID NO: 371035 - DNA, 25 bp, Mus musculus
tgacctactaggtcactgcccagcc

SEQ ID NO: 371036 - DNA, 25 bp, Mus musculus
tgacctagctgagccctacaaaggc

SEQ ID NO: 371037 - DNA, 25 bp, Mus musculus
tgacctaggaaggcccagcccccgc

SEQ ID NO: 371038 - DNA, 25 bp, Mus musculus
tgacctatcagggtacttttgatgc

SEQ ID NO: 371039 - DNA, 25 bp, Mus musculus
tgacctatctcgacgtcggatgcgc

SEQ ID NO: 371040 - DNA, 25 bp, Mus musculus
tgacctcaaggagctgtaggtggcg

SEQ ID NO: 371041 - DNA, 25 bp, Mus musculus
tgacctcaagggctctctagtgtcc

SEQ ID NO: 371042 - DNA, 25 bp, Mus musculus
tgacctcaagggtggttttgactgg

SEQ ID NO: 371043 - DNA, 25 bp, Mus musculus
tgacctcaaggtcctaaatgctcag

SEQ ID NO: 371044 - DNA, 25 bp, Mus musculus
tgacctcaaggtttccctggagaat

SEQ ID NO: 371045 - DNA, 25 bp, Mus musculus
tgacctcaccgactctgcaaagcac

SEQ ID NO: 371046 - DNA, 25 bp, Mus musculus
tgacctcaccgtgatcaacttttgt

SEQ ID NO: 371047 - DNA, 25 bp, Mus musculus
tgacctcactcagagccatgatgct

SEQ ID NO: 371048 - DNA, 25 bp, Mus musculus
tgacctcagactcagggttgagctc

SEQ ID NO: 371049 - DNA, 25 bp, Mus musculus
tgacctcagagccaggttggttcct

SEQ ID NO: 371050 - DNA, 25 bp, Mus musculus
tgacctcagcagcggggttctctgg

SEQ ID NO: 371051 - DNA, 25 bp, Mus musculus
tgacctcatgctttcgaaatgaata

SEQ ID NO: 371052 - DNA, 25 bp, Mus musculus
tgacctcatggtgttcgtgaccaac

SEQ ID NO: 371053 - DNA, 25 bp, Mus musculus
tgacctcattacagtgtgactgcac

SEQ ID NO: 371054 - DNA, 25 bp, Mus musculus
tgacctccaagggcccaatgtaaag

SEQ ID NO: 371055 - DNA, 25 bp, Mus musculus
tgacctccagaaaggtgctggatca

SEQ ID NO: 371056 - DNA, 25 bp, Mus musculus
tgacctcctcagtgggaacacaggc

SEQ ID NO: 371057 - DNA, 25 bp, Mus musculus
tgacctcgaggaagtggacattgtg

SEQ ID NO: 371058 - DNA, 25 bp, Mus musculus
tgacctcgcgagtttcctgacaggc

SEQ ID NO: 371059 - DNA, 25 bp, Mus musculus
tgacctcgggaaacatacccagaga

SEQ ID NO: 371060 - DNA, 25 bp, Mus musculus
tgacctcgggaaacatcacagaagt

SEQ ID NO: 371061 - DNA, 25 bp, Mus musculus
tgacctctagttgggatgaatgggt

SEQ ID NO: 371062 - DNA, 25 bp, Mus musculus
tgacctctatagcgtctctacagcc

SEQ ID NO: 371063 - DNA, 25 bp, Mus musculus
tgacctctatataaactgaagtgca

SEQ ID NO: 371064 - DNA, 25 bp, Mus musculus
tgacctctatgtaactgtcaccgtt

SEQ ID NO: 371065 - DNA, 25 bp, Mus musculus
tgacctcttcatgcgcatggacttg

SEQ ID NO: 371066 - DNA, 25 bp, Mus musculus
tgacctgaaaaggaaacctgcagat

SEQ ID NO: 371067 - DNA, 25 bp, Mus musculus
tgacctgactgacccattgaagaag

SEQ ID NO: 371068 - DNA, 25 bp, Mus musculus
tgacctgactggcaccctcaggaag

SEQ ID NO: 371069 - DNA, 25 bp, Mus musculus
tgacctgactggtcacagtaatgaa

SEQ ID NO: 371070 - DNA, 25 bp, Mus musculus
tgacctgactggtcttaagttttga

SEQ ID NO: 371071 - DNA, 25 bp, Mus musculus
tgacctgagataccatggccaaagt

SEQ ID NO: 371072 - DNA, 25 bp, Mus musculus
tgacctgatagcagctgtgagtacc

SEQ ID NO: 371073 - DNA, 25 bp, Mus musculus
tgacctgcagcaggtgatagaggga

SEQ ID NO: 371074 - DNA, 25 bp, Mus musculus
tgacctgccaatcccatctctcccg

SEQ ID NO: 371075 - DNA, 25 bp, Mus musculus
tgacctgcgccgagagatcccgatg

SEQ ID NO: 371076 - DNA, 25 bp, Mus musculus
tgacctgcgtgcatcagagtcttca

SEQ ID NO: 371077 - DNA, 25 bp, Mus musculus
tgacctgcttggttcaactggagag

SEQ ID NO: 371078 - DNA, 25 bp, Mus musculus
tgacctggaaagtgtctttgccatg

SEQ ID NO: 371079 - DNA, 25 bp, Mus musculus
tgacctggaagacgagctctatgcc

SEQ ID NO: 371080 - DNA, 25 bp, Mus musculus
tgacctggaagataaactgaagtgc

SEQ ID NO: 371081 - DNA, 25 bp, Mus musculus
tgacctggacaagatcatagaactc

SEQ ID NO: 371082 - DNA, 25 bp, Mus musculus
tgacctggagaagctgacctctctc

SEQ ID NO: 371083 - DNA, 25 bp, Mus musculus
tgacctggaggagatggtggaattc

SEQ ID NO: 371084 - DNA, 25 bp, Mus musculus
tgacctggaggagctgttgggccgt

SEQ ID NO: 371085 - DNA, 25 bp, Mus musculus
tgacctgggagagtttgtgagaagc

SEQ ID NO: 371086 - DNA, 25 bp, Mus musculus
tgacctgggctgaagctaggcggcc

SEQ ID NO: 371087 - DNA, 25 bp, Mus musculus
tgacctgggctgaaggagacagagg

SEQ ID NO: 371088 - DNA, 25 bp, Mus musculus
tgacctgggctgaaggggagcttct

SEQ ID NO: 371089 - DNA, 25 bp, Mus musculus
tgacctggtggccaattggagcatc

SEQ ID NO: 371090 - DNA, 25 bp, Mus musculus
tgacctggtggccagcaaccttcct

SEQ ID NO: 371091 - DNA, 25 bp, Mus musculus
tgacctgtatcagacacctctgcac

SEQ ID NO: 371092 - DNA, 25 bp, Mus musculus
tgacctgtcccacaggcggaatgtg

SEQ ID NO: 371093 - DNA, 25 bp, Mus musculus
tgacctgtcctgaggttgctacagg

SEQ ID NO: 371094 - DNA, 25 bp, Mus musculus
tgacctgtcttcaaggtgccgccat

SEQ ID NO: 371095 - DNA, 25 bp, Mus musculus
tgaccttactgtcccttttgctcga

SEQ ID NO: 371096 - DNA, 25 bp, Mus musculus
tgaccttcacaccctcagaacagca

SEQ ID NO: 371097 - DNA, 25 bp, Mus musculus
tgaccttcacttttggttccacacc

SEQ ID NO: 371098 - DNA, 25 bp, Mus musculus
tgaccttcagctcacgaggcgcata

SEQ ID NO: 371099 - DNA, 25 bp, Mus musculus
tgaccttcatgcaaggctgggcccc

SEQ ID NO: 371100 - DNA, 25 bp, Mus musculus
tgaccttctagctcaccctagcatt

SEQ ID NO: 371101 - DNA, 25 bp, Mus musculus
tgaccttgaagaggatcccagtcct

SEQ ID NO: 371102 - DNA, 25 bp, Mus musculus
tgaccttgaaggggactcagaagaa

SEQ ID NO: 371103 - DNA, 25 bp, Mus musculus
tgaccttgaccagctcttcattggg

SEQ ID NO: 371104 - DNA, 25 bp, Mus musculus
tgaccttgaggacagacaaggaact

SEQ ID NO: 371105 - DNA, 25 bp, Mus musculus
tgaccttgcacgggctgcaggatga

SEQ ID NO: 371106 - DNA, 25 bp, Mus musculus
tgaccttgctggactcgccagtgat

SEQ ID NO: 371107 - DNA, 25 bp, Mus musculus
tgaccttggaagggcctggttctca

SEQ ID NO: 371108 - DNA, 25 bp, Mus musculus
tgaccttggacaagatagccaagga

SEQ ID NO: 371109 - DNA, 25 bp, Mus musculus
tgaccttggacaaggagcagatagc

SEQ ID NO: 371110 - DNA, 25 bp, Mus musculus
tgaccttggaggatttgaggcgcct

SEQ ID NO: 371111 - DNA, 25 bp, Mus musculus
tgaccttggtgcagacaacatcgct

SEQ ID NO: 371112 - DNA, 25 bp, Mus musculus
tgaccttgtaacaaggctgtgtctg

SEQ ID NO: 371113 - DNA, 25 bp, Mus musculus
tgaccttgtaacaaggtacactttt

SEQ ID NO: 371114 - DNA, 25 bp, Mus musculus
tgacctttaagaggtgtgctgatgt

SEQ ID NO: 371115 - DNA, 25 bp, Mus musculus
tgacctttatctcaggcttcctgct

SEQ ID NO: 371116 - DNA, 25 bp, Mus musculus
tgacctttctgagggagacttcctg

SEQ ID NO: 371117 - DNA, 25 bp, Mus musculus
tgacctttgctttagggatcagtct

SEQ ID NO: 371118 - DNA, 25 bp, Mus musculus
tgacctttgctttgattctttcagc

SEQ ID NO: 371119 - DNA, 25 bp, Mus musculus
tgaccttttcggggtcatcttggca

SEQ ID NO: 371120 - DNA, 25 bp, Mus musculus
tgaccttttgggaccagctggaaga

SEQ ID NO: 371121 - DNA, 25 bp, Mus musculus
tgacgaaaaaagatgattcttttat

SEQ ID NO: 371122 - DNA, 25 bp, Mus musculus
tgacgaaaaaaggaatgtcctccaa

SEQ ID NO: 371123 - DNA, 25 bp, Mus musculus
tgacgaaaacgacagaagataccaa

SEQ ID NO: 371124 - DNA, 25 bp, Mus musculus
tgacgaaaacgagctgttgcgcagc

SEQ ID NO: 371125 - DNA, 25 bp, Mus musculus
tgacgaatgcaaggcaccaacagag

SEQ ID NO: 371126 - DNA, 25 bp, Mus musculus
tgacgaatgcaaggtgagagcacag

SEQ ID NO: 371127 - DNA, 25 bp, Mus musculus
tgacgacaagactggccaggtcatc

SEQ ID NO: 371128 - DNA, 25 bp, Mus musculus
tgacgacaagatttgaaagaagcgg

SEQ ID NO: 371129 - DNA, 25 bp, Mus musculus
tgacgacaatgcagctataaaacca

SEQ ID NO: 371130 - DNA, 25 bp, Mus musculus
tgacgacaccaaaagggctcaggat

SEQ ID NO: 371131 - DNA, 25 bp, Mus musculus
tgacgacagcagagaaacatggctt

SEQ ID NO: 371132 - DNA, 25 bp, Mus musculus
tgacgacagcccatctgctgctcct

SEQ ID NO: 371133 - DNA, 25 bp, Mus musculus
tgacgaccctctaaggatatgctgt

SEQ ID NO: 371134 - DNA, 25 bp, Mus musculus
tgacgacgatgactcccctgcaact

SEQ ID NO: 371135 - DNA, 25 bp, Mus musculus
tgacgagaacagaaaatactcttgc

SEQ ID NO: 371136 - DNA, 25 bp, Mus musculus
tgacgagaagcacatcaaggtgaac

SEQ ID NO: 371137 - DNA, 25 bp, Mus musculus
tgacgagaccgaggcttacttcttt

SEQ ID NO: 371138 - DNA, 25 bp, Mus musculus
tgacgagaccgaggtctttgacaga

SEQ ID NO: 371139 - DNA, 25 bp, Mus musculus
tgacgagaccgagttacttgccggt

SEQ ID NO: 371140 - DNA, 25 bp, Mus musculus
tgacgagaccggcggcaagtacatt

SEQ ID NO: 371141 - DNA, 25 bp, Mus musculus
tgacgagcatgagaggaggagcttg

SEQ ID NO: 371142 - DNA, 25 bp, Mus musculus
tgacgagcatgagcttagcagcctg

SEQ ID NO: 371143 - DNA, 25 bp, Mus musculus
tgacgagcatgagtggggtccggcc

SEQ ID NO: 371144 - DNA, 25 bp, Mus musculus
tgacgaggcgtgagcacctccgcac

SEQ ID NO: 371145 - DNA, 25 bp, Mus musculus
tgacgagtcctatggtgaaggctgc

SEQ ID NO: 371146 - DNA, 25 bp, Mus musculus
tgacgagtttgttgtcacaatgctt

SEQ ID NO: 371147 - DNA, 25 bp, Mus musculus
tgacgatacagaaagagtctttctc

SEQ ID NO: 371148 - DNA, 25 bp, Mus musculus
tgacgatagctgagagtcgacaatt

SEQ ID NO: 371149 - DNA, 25 bp, Mus musculus
tgacgattactttgaataccctgga

SEQ ID NO: 371150 - DNA, 25 bp, Mus musculus
tgacgattactttggccgttgtgcc

SEQ ID NO: 371151 - DNA, 25 bp, Mus musculus
tgacgcaaacacaggtgaaaatctg

SEQ ID NO: 371152 - DNA, 25 bp, Mus musculus
tgacgcaagagcaggaatccagcca

SEQ ID NO: 371153 - DNA, 25 bp, Mus musculus
tgacgcacccttcagtacaagccca

SEQ ID NO: 371154 - DNA, 25 bp, Mus musculus
tgacgcagagctgctcagggtgccg

SEQ ID NO: 371155 - DNA, 25 bp, Mus musculus
tgacgcagagctggctcccgcgtat

SEQ ID NO: 371156 - DNA, 25 bp, Mus musculus
tgacgcaggatgatgtctggcagga

SEQ ID NO: 371157 - DNA, 25 bp, Mus musculus
tgacgccagcaccttctgcttcccg

SEQ ID NO: 371158 - DNA, 25 bp, Mus musculus
tgacgccaggatcccattttcaggt

SEQ ID NO: 371159 - DNA, 25 bp, Mus musculus
tgacgcctcaagcacttgtctctgc

SEQ ID NO: 371160 - DNA, 25 bp, Mus musculus
tgacgcctcaagggttgagacatcc

SEQ ID NO: 371161 - DNA, 25 bp, Mus musculus
tgacgcctccacggggtttgacttc

SEQ ID NO: 371162 - DNA, 25 bp, Mus musculus
tgacgcgacagaaaccgcccagaat

SEQ ID NO: 371163 - DNA, 25 bp, Mus musculus
tgacgcgacagcacaccacatgtat

SEQ ID NO: 371164 - DNA, 25 bp, Mus musculus
tgacgcgcggggaagagtcttgcgc

SEQ ID NO: 371165 - DNA, 25 bp, Mus musculus
tgacgcggagagtagattggatcca

SEQ ID NO: 371166 - DNA, 25 bp, Mus musculus
tgacgcgggtctgcaccggtgagtc

SEQ ID NO: 371167 - DNA, 25 bp, Mus musculus
tgacgcgggtgggtcatcgtggaga

SEQ ID NO: 371168 - DNA, 25 bp, Mus musculus
tgacgctagtcagggacaagaagac

SEQ ID NO: 371169 - DNA, 25 bp, Mus musculus
tgacgctcagagagggggaggcatg

SEQ ID NO: 371170 - DNA, 25 bp, Mus musculus
tgacgctcagaggttttctcttttt

SEQ ID NO: 371171 - DNA, 25 bp, Mus musculus
tgacgctctacacgatgcggccgaa

SEQ ID NO: 371172 - DNA, 25 bp, Mus musculus
tgacgctctacacgtatgaagtaca

SEQ ID NO: 371173 - DNA, 25 bp, Mus musculus
tgacgctgagctccaacagtgtctg

SEQ ID NO: 371174 - DNA, 25 bp, Mus musculus
tgacgctgaggtggtatataaccgt

SEQ ID NO: 371175 - DNA, 25 bp, Mus musculus
tgacgctgaggttttatataaccgt

SEQ ID NO: 371176 - DNA, 25 bp, Mus musculus
tgacgctggcagacaccactaactg

SEQ ID NO: 371177 - DNA, 25 bp, Mus musculus
tgacgcttttgccagacaagcagtg

SEQ ID NO: 371178 - DNA, 25 bp, Mus musculus
tgacgcttttgccaggtgatggaaa

SEQ ID NO: 371179 - DNA, 25 bp, Mus musculus
tgacggaagaatcgggcagctcagt

SEQ ID NO: 371180 - DNA, 25 bp, Mus musculus
tgacggacagatcttcttggaaaca

SEQ ID NO: 371181 - DNA, 25 bp, Mus musculus
tgacggaccccggcaggaggactgt

SEQ ID NO: 371182 - DNA, 25 bp, Mus musculus
tgacggacccctgtttgtaagcggt

SEQ ID NO: 371183 - DNA, 25 bp, Mus musculus
tgacggacttattgccaaggaaatc

SEQ ID NO: 371184 - DNA, 25 bp, Mus musculus
tgacggagacagggagttctcagat

SEQ ID NO: 371185 - DNA, 25 bp, Mus musculus
tgacggagactccagatgaggacga

SEQ ID NO: 371186 - DNA, 25 bp, Mus musculus
tgacggagactccaggccacaatgg

SEQ ID NO: 371187 - DNA, 25 bp, Mus musculus
tgacggagcaggcctgtctcgtcat

SEQ ID NO: 371188 - DNA, 25 bp, Mus musculus
tgacggagcgaaatacttaaggaag

SEQ ID NO: 371189 - DNA, 25 bp, Mus musculus
tgacggaggctgagatcactggaga

SEQ ID NO: 371190 - DNA, 25 bp, Mus musculus
tgacggatgcggatgccatgaagta

SEQ ID NO: 371191 - DNA, 25 bp, Mus musculus
tgacggatgctggagctctcttgag

SEQ ID NO: 371192 - DNA, 25 bp, Mus musculus
tgacggcaaaaaatgtaacatttca

SEQ ID NO: 371193 - DNA, 25 bp, Mus musculus
tgacggcaaaaaatgttggtttgcc

SEQ ID NO: 371194 - DNA, 25 bp, Mus musculus
tgacggcaccatggcgtttatgttt

SEQ ID NO: 371195 - DNA, 25 bp, Mus musculus
tgacggcaggagagcctgtgtcctg

SEQ ID NO: 371196 - DNA, 25 bp, Mus musculus
tgacggcaggagagggctgtagcag

SEQ ID NO: 371197 - DNA, 25 bp, Mus musculus
tgacggcagtactggcaccttctcc

SEQ ID NO: 371198 - DNA, 25 bp, Mus musculus
tgacggcagtactggtcctaaccgt

SEQ ID NO: 371199 - DNA, 25 bp, Mus musculus
tgacggccacattgattttcctcgc

SEQ ID NO: 371200 - DNA, 25 bp, Mus musculus
tgacggccacattgccctgtcagcc

SEQ ID NO: 371201 - DNA, 25 bp, Mus musculus
tgacgggaagcttatcaagtacggg

SEQ ID NO: 371202 - DNA, 25 bp, Mus musculus
tgacgggaaggtgtgtgagtctcct

SEQ ID NO: 371203 - DNA, 25 bp, Mus musculus
tgacgggagcatcaaaaccctactg

SEQ ID NO: 371204 - DNA, 25 bp, Mus musculus
tgacgggagcatcaagaagtcatgc

SEQ ID NO: 371205 - DNA, 25 bp, Mus musculus
tgacggtctggtcaaagctgttcct

SEQ ID NO: 371206 - DNA, 25 bp, Mus musculus
tgacgtaactctgagataaagtgca

SEQ ID NO: 371207 - DNA, 25 bp, Mus musculus
tgacgtaactctgagtcacaggaat

SEQ ID NO: 371208 - DNA, 25 bp, Mus musculus
tgacgtagaggaaatgctgtcattc

SEQ ID NO: 371209 - DNA, 25 bp, Mus musculus
tgacgtagcagaagcagatataatt

SEQ ID NO: 371210 - DNA, 25 bp, Mus musculus
tgacgtagcagaagggttcactgca

SEQ ID NO: 371211 - DNA, 25 bp, Mus musculus
tgacgtcagtccaggaccacttggt

SEQ ID NO: 371212 - DNA, 25 bp, Mus musculus
tgacgtcatagtacaggattcatcc

SEQ ID NO: 371213 - DNA, 25 bp, Mus musculus
tgacgtccaccagtgaaaatgtgct

SEQ ID NO: 371214 - DNA, 25 bp, Mus musculus
tgacgtcgggaactgaagagccgag

SEQ ID NO: 371215 - DNA, 25 bp, Mus musculus
tgacgtcgggaagttccgtgtacca

SEQ ID NO: 371216 - DNA, 25 bp, Mus musculus
tgacgtcgtgaagttaagcaaaact

SEQ ID NO: 371217 - DNA, 25 bp, Mus musculus
tgacgtctaagattcctgctctggc

SEQ ID NO: 371218 - DNA, 25 bp, Mus musculus
tgacgtctccacagccagagaacct

SEQ ID NO: 371219 - DNA, 25 bp, Mus musculus
tgacgtctctaagtaacatacaaga

SEQ ID NO: 371220 - DNA, 25 bp, Mus musculus
tgacgtcttggctcatgctgcctga

SEQ ID NO: 371221 - DNA, 25 bp, Mus musculus
tgacgtgaccctggaagacatccca

SEQ ID NO: 371222 - DNA, 25 bp, Mus musculus
tgacgtgattgtgaatacccttttc

SEQ ID NO: 371223 - DNA, 25 bp, Mus musculus
tgacgtgcagaacagagcctacttc

SEQ ID NO: 371224 - DNA, 25 bp, Mus musculus
tgacgtggatgagtacgctccagaa

SEQ ID NO: 371225 - DNA, 25 bp, Mus musculus
tgacgtggatgcaggccctgcttct

SEQ ID NO: 371226 - DNA, 25 bp, Mus musculus
tgacgtggatgcagggagcccccgg

SEQ ID NO: 371227 - DNA, 25 bp, Mus musculus
tgacgtggccagcttcatcttccgt

SEQ ID NO: 371228 - DNA, 25 bp, Mus musculus
tgacgtggccagtgcttttacagtg

SEQ ID NO: 371229 - DNA, 25 bp, Mus musculus
tgacgtggtaaaagactacgcgttt

SEQ ID NO: 371230 - DNA, 25 bp, Mus musculus
tgacgtggtgggaagaggtgccagc

SEQ ID NO: 371231 - DNA, 25 bp, Mus musculus
tgacgtgtgttgaggagcccaccgc

SEQ ID NO: 371232 - DNA, 25 bp, Mus musculus
tgacgtgttcgagaaccgttacgac

SEQ ID NO: 371233 - DNA, 25 bp, Mus musculus
tgactaaaagtagtagaaggaggag

SEQ ID NO: 371234 - DNA, 25 bp, Mus musculus
tgactaaagaagaaaaatgatacct

SEQ ID NO: 371235 - DNA, 25 bp, Mus musculus
tgactaacagggagtacacctttag

SEQ ID NO: 371236 - DNA, 25 bp, Mus musculus
tgactaagcacaagagtcacctgta

SEQ ID NO: 371237 - DNA, 25 bp, Mus musculus
tgactacaacagcgtccatgccatt

SEQ ID NO: 371238 - DNA, 25 bp, Mus musculus
tgactacaggcactggcagatccca

SEQ ID NO: 371239 - DNA, 25 bp, Mus musculus
tgactacatgaagtgccctccgttt

SEQ ID NO: 371240 - DNA, 25 bp, Mus musculus
tgactacctgaggctggcccagcct

SEQ ID NO: 371241 - DNA, 25 bp, Mus musculus
tgactacctgagggtgaacaacatg

SEQ ID NO: 371242 - DNA, 25 bp, Mus musculus
tgactacctgggaattaccaggagg

SEQ ID NO: 371243 - DNA, 25 bp, Mus musculus
tgactacctgggacattcctggagg

SEQ ID NO: 371244 - DNA, 25 bp, Mus musculus
tgactacgagacggtggtgaaagtg

SEQ ID NO: 371245 - DNA, 25 bp, Mus musculus
tgactacgagctaaggaggctcgca

SEQ ID NO: 371246 - DNA, 25 bp, Mus musculus
tgactacgagcttaagtacccacca

SEQ ID NO: 371247 - DNA, 25 bp, Mus musculus
tgactacgtgaagcaacatcctttg

SEQ ID NO: 371248 - DNA, 25 bp, Mus musculus
tgactactatcggcgacgcctgggc

SEQ ID NO: 371249 - DNA, 25 bp, Mus musculus
tgactactatcggcgtcttcccaaa

SEQ ID NO: 371250 - DNA, 25 bp, Mus musculus
tgactactccagtcactgtggggct

SEQ ID NO: 371251 - DNA, 25 bp, Mus musculus
tgactactccatgcggctctgcaga

SEQ ID NO: 371252 - DNA, 25 bp, Mus musculus
tgactacttggcaccggtgcagcct

SEQ ID NO: 371253 - DNA, 25 bp, Mus musculus
tgactactttaagggactgatggac

SEQ ID NO: 371254 - DNA, 25 bp, Mus musculus
tgactactttagggccatgttcact

SEQ ID NO: 371255 - DNA, 25 bp, Mus musculus
tgactactttagtgctgaggtgaca

SEQ ID NO: 371256 - DNA, 25 bp, Mus musculus
tgactagaacaaaaggaagccagat

SEQ ID NO: 371257 - DNA, 25 bp, Mus musculus
tgactagagttagaatcccttcgcc

SEQ ID NO: 371258 - DNA, 25 bp, Mus musculus
tgactagtattaagtgcgtaatagc

SEQ ID NO: 371259 - DNA, 25 bp, Mus musculus
tgactatcagaaaggagatgaatat

SEQ ID NO: 371260 - DNA, 25 bp, Mus musculus
tgactatcagaaagggatgaatatg

SEQ ID NO: 371261 - DNA, 25 bp, Mus musculus
tgactatcagcatggggctgctttt

SEQ ID NO: 371262 - DNA, 25 bp, Mus musculus
tgactatcaggacctccaggacctc

SEQ ID NO: 371263 - DNA, 25 bp, Mus musculus
tgactatcgatgatgtgatgagttt

SEQ ID NO: 371264 - DNA, 25 bp, Mus musculus
tgactatgaacaaataggagacagc

SEQ ID NO: 371265 - DNA, 25 bp, Mus musculus
tgactatgcatcatctatactcttc

SEQ ID NO: 371266 - DNA, 25 bp, Mus musculus
tgactattgacctagccccatccct

SEQ ID NO: 371267 - DNA, 25 bp, Mus musculus
tgactatttggttcctgctgctctt

SEQ ID NO: 371268 - DNA, 25 bp, Mus musculus
tgactcaacgggggggcagtgccca

SEQ ID NO: 371269 - DNA, 25 bp, Mus musculus
tgactcacacaaagtttgctaggta

SEQ ID NO: 371270 - DNA, 25 bp, Mus musculus
tgactcacagctgaaggtggagatc

SEQ ID NO: 371271 - DNA, 25 bp, Mus musculus
tgactcacagggaacaacccctttc

SEQ ID NO: 371272 - DNA, 25 bp, Mus musculus
tgactcactgattcatctgaaaact

SEQ ID NO: 371273 - DNA, 25 bp, Mus musculus
tgactcagaagaaaaaaagtattca

SEQ ID NO: 371274 - DNA, 25 bp, Mus musculus
tgactcagaagaaccaatcactgaa

SEQ ID NO: 371275 - DNA, 25 bp, Mus musculus
tgactcagaagctcttgtcctgaac

SEQ ID NO: 371276 - DNA, 25 bp, Mus musculus
tgactcagaaggtgtacagactcca

SEQ ID NO: 371277 - DNA, 25 bp, Mus musculus
tgactcagactgggcccagtcttct

SEQ ID NO: 371278 - DNA, 25 bp, Mus musculus
tgactcagactggttgatccccaaa

SEQ ID NO: 371279 - DNA, 25 bp, Mus musculus
tgactcaggctaagaatggttttag

SEQ ID NO: 371280 - DNA, 25 bp, Mus musculus
tgactcaggtaggcctgtcaaccca

SEQ ID NO: 371281 - DNA, 25 bp, Mus musculus
tgactcagtgtctgaaaccaaggaa

SEQ ID NO: 371282 - DNA, 25 bp, Mus musculus
tgactcagtgtctggacatttattc

SEQ ID NO: 371283 - DNA, 25 bp, Mus musculus
tgactcagtgtctggtgcagagtgg

SEQ ID NO: 371284 - DNA, 25 bp, Mus musculus
tgactcatatgagtccaacactgga

SEQ ID NO: 371285 - DNA, 25 bp, Mus musculus
tgactcatatgccctggtgtggggc

SEQ ID NO: 371286 - DNA, 25 bp, Mus musculus
tgactcatgagaaaagagaagcagc

SEQ ID NO: 371287 - DNA, 25 bp, Mus musculus
tgactcatgaggctcatccagagct

SEQ ID NO: 371288 - DNA, 25 bp, Mus musculus
tgactcatgccagggttgtcgccct

SEQ ID NO: 371289 - DNA, 25 bp, Mus musculus
tgactccaaaaccagcaccgtcttc

SEQ ID NO: 371290 - DNA, 25 bp, Mus musculus
tgactccaaaaccagtgtcgtcacc

SEQ ID NO: 371291 - DNA, 25 bp, Mus musculus
tgactccaaggacaagaccagtgct

SEQ ID NO: 371292 - DNA, 25 bp, Mus musculus
tgactccaggaggagcgacagtttt

SEQ ID NO: 371293 - DNA, 25 bp, Mus musculus
tgactccaggaggcttccagcttgt

SEQ ID NO: 371294 - DNA, 25 bp, Mus musculus
tgactcccaaagcctacaaggatgg

SEQ ID NO: 371295 - DNA, 25 bp, Mus musculus
tgactcccagacattgggcctgtac

SEQ ID NO: 371296 - DNA, 25 bp, Mus musculus
tgactcccagaccatctcctacatc

SEQ ID NO: 371297 - DNA, 25 bp, Mus musculus
tgactcccaggatgccctgatggac

SEQ ID NO: 371298 - DNA, 25 bp, Mus musculus
tgactccctcaagaacaaagtcaca

SEQ ID NO: 371299 - DNA, 25 bp, Mus musculus
tgactccctcaagattcaaacagac

SEQ ID NO: 371300 - DNA, 25 bp, Mus musculus
tgactcctccatgctggacagtgct

SEQ ID NO: 371301 - DNA, 25 bp, Mus musculus
tgactcctgacggtgaccctaaaac

SEQ ID NO: 371302 - DNA, 25 bp, Mus musculus
tgactcctgagatcatgaaggaagt

SEQ ID NO: 371303 - DNA, 25 bp, Mus musculus
tgactcctgtgaagacagggccagt

SEQ ID NO: 371304 - DNA, 25 bp, Mus musculus
tgactcctttcccaacactatgact

SEQ ID NO: 371305 - DNA, 25 bp, Mus musculus
tgactcgaaggaacctaagtcatca

SEQ ID NO: 371306 - DNA, 25 bp, Mus musculus
tgactcgatggcaccgcatgcgtgg

SEQ ID NO: 371307 - DNA, 25 bp, Mus musculus
tgactcgcaacgagtctgtagctcg

SEQ ID NO: 371308 - DNA, 25 bp, Mus musculus
tgactcggaaaagtcatgttgcaaa

SEQ ID NO: 371309 - DNA, 25 bp, Mus musculus
tgactcggaaagttccattttgggg

SEQ ID NO: 371310 - DNA, 25 bp, Mus musculus
tgactcggcatcttactacctgaac

SEQ ID NO: 371311 - DNA, 25 bp, Mus musculus
tgactctacagccactacgaaggtt

SEQ ID NO: 371312 - DNA, 25 bp, Mus musculus
tgactctacaggcattgggcatgga

SEQ ID NO: 371313 - DNA, 25 bp, Mus musculus
tgactctaccaaatactatctgaat

SEQ ID NO: 371314 - DNA, 25 bp, Mus musculus
tgactctaccaaatattgcatttag

SEQ ID NO: 371315 - DNA, 25 bp, Mus musculus
tgactctatttcaggactcagtggc

SEQ ID NO: 371316 - DNA, 25 bp, Mus musculus
tgactctcacaggggagaagcgagc

SEQ ID NO: 371317 - DNA, 25 bp, Mus musculus
tgactctcaggcaaggccagctgaa

SEQ ID NO: 371318 - DNA, 25 bp, Mus musculus
tgactctcctcagaagactggtccc

SEQ ID NO: 371319 - DNA, 25 bp, Mus musculus
tgactctcctcaggtcatgtttact

SEQ ID NO: 371320 - DNA, 25 bp, Mus musculus
tgactctctgtggacgcaagcgccg

SEQ ID NO: 371321 - DNA, 25 bp, Mus musculus
tgactctgagatggtagagatggct

SEQ ID NO: 371322 - DNA, 25 bp, Mus musculus
tgactctgaggtgctgtaggagccc

SEQ ID NO: 371323 - DNA, 25 bp, Mus musculus
tgactctgcaaacagtgccaccaaa

SEQ ID NO: 371324 - DNA, 25 bp, Mus musculus
tgactctggacaaactgtcctgtgt

SEQ ID NO: 371325 - DNA, 25 bp, Mus musculus
tgactctggacaatgccaacagtat

SEQ ID NO: 371326 - DNA, 25 bp, Mus musculus
tgactctggagaaggccaacagcag

SEQ ID NO: 371327 - DNA, 25 bp, Mus musculus
tgactctggggctgacaaaaagttc

SEQ ID NO: 371328 - DNA, 25 bp, Mus musculus
tgactctggttcaggctggcctgcc

SEQ ID NO: 371329 - DNA, 25 bp, Mus musculus
tgactcttacctgcctgtgccgtgt

SEQ ID NO: 371330 - DNA, 25 bp, Mus musculus
tgactgaaaaagttccaccaggtga

SEQ ID NO: 371331 - DNA, 25 bp, Mus musculus
tgactgaaatctacttaaaattctg

SEQ ID NO: 371332 - DNA, 25 bp, Mus musculus
tgactgaaatctcgagatctttgca

SEQ ID NO: 371333 - DNA, 25 bp, Mus musculus
tgactgaaccttatcaagcactgaa

SEQ ID NO: 371334 - DNA, 25 bp, Mus musculus
tgactgaactctcagacacatgcct

SEQ ID NO: 371335 - DNA, 25 bp, Mus musculus
tgactgaactctcaggaaacccaag

SEQ ID NO: 371336 - DNA, 25 bp, Mus musculus
tgactgacaaagaaggctggattct

SEQ ID NO: 371337 - DNA, 25 bp, Mus musculus
tgactgacagaagttaccaaatggg

SEQ ID NO: 371338 - DNA, 25 bp, Mus musculus
tgactgaccgggagagggataaagt

SEQ ID NO: 371339 - DNA, 25 bp, Mus musculus
tgactgagagcgagctgaccaatga

SEQ ID NO: 371340 - DNA, 25 bp, Mus musculus
tgactgagagtgagaaagcgctgca

SEQ ID NO: 371341 - DNA, 25 bp, Mus musculus
tgactgagagtggaatgcagtggcc

SEQ ID NO: 371342 - DNA, 25 bp, Mus musculus
tgactgagatagaaagaaaggccca

SEQ ID NO: 371343 - DNA, 25 bp, Mus musculus
tgactgagcacactctgcagaggac

SEQ ID NO: 371344 - DNA, 25 bp, Mus musculus
tgactgagcacgcggtggagggaga

SEQ ID NO: 371345 - DNA, 25 bp, Mus musculus
tgactgagccaagtggtggcgggaa

SEQ ID NO: 371346 - DNA, 25 bp, Mus musculus
tgactgagctgagctggcaactatt

SEQ ID NO: 371347 - DNA, 25 bp, Mus musculus
tgactgaggtgtggtctcggattgg

SEQ ID NO: 371348 - DNA, 25 bp, Mus musculus
tgactgagtcagaggaggggtgagg

SEQ ID NO: 371349 - DNA, 25 bp, Mus musculus
tgactgagtcagaggatccacactg

SEQ ID NO: 371350 - DNA, 25 bp, Mus musculus
tgactgatagacagcccctgttgca

SEQ ID NO: 371351 - DNA, 25 bp, Mus musculus
tgactgatagacagctgctgctcca

SEQ ID NO: 371352 - DNA, 25 bp, Mus musculus
tgactgatatccagtatggaagggt

SEQ ID NO: 371353 - DNA, 25 bp, Mus musculus
tgactgatcgaaaggtggcctcctc

SEQ ID NO: 371354 - DNA, 25 bp, Mus musculus
tgactgcaagattatttatgtggca

SEQ ID NO: 371355 - DNA, 25 bp, Mus musculus
tgactgcacgcagaaagatgacagg

SEQ ID NO: 371356 - DNA, 25 bp, Mus musculus
tgactgcagagaggctggcctccac

SEQ ID NO: 371357 - DNA, 25 bp, Mus musculus
tgactgcagcaggcaccagagtttt

SEQ ID NO: 371358 - DNA, 25 bp, Mus musculus
tgactgccaagattcatgaataaaa

SEQ ID NO: 371359 - DNA, 25 bp, Mus musculus
tgactgccattgaagctgaagaaga

SEQ ID NO: 371360 - DNA, 25 bp, Mus musculus
tgactgccgccccaacccgtgtcac

SEQ ID NO: 371361 - DNA, 25 bp, Mus musculus
tgactgccgtatcaacattgatgag

SEQ ID NO: 371362 - DNA, 25 bp, Mus musculus
tgactgccttgggctggtgagatgg

SEQ ID NO: 371363 - DNA, 25 bp, Mus musculus
tgactgcggattcggagcattcttg

SEQ ID NO: 371364 - DNA, 25 bp, Mus musculus
tgactgcggattcggatggattcca

SEQ ID NO: 371365 - DNA, 25 bp, Mus musculus
tgactgcggcgcaaccatgaaggtg

SEQ ID NO: 371366 - DNA, 25 bp, Mus musculus
tgactgctccagcggctgtgacagc

SEQ ID NO: 371367 - DNA, 25 bp, Mus musculus
tgactgctccgaggcatgtccccca

SEQ ID NO: 371368 - DNA, 25 bp, Mus musculus
tgactgctcttgtctgaaaacagtc

SEQ ID NO: 371369 - DNA, 25 bp, Mus musculus
tgactgctgcagcagagagccagcc

SEQ ID NO: 371370 - DNA, 25 bp, Mus musculus
tgactgctgcggacaagtttttact

SEQ ID NO: 371371 - DNA, 25 bp, Mus musculus
tgactgcttctgtatcaagatatta

SEQ ID NO: 371372 - DNA, 25 bp, Mus musculus
tgactgctttctatccctgtgcaca

SEQ ID NO: 371373 - DNA, 25 bp, Mus musculus
tgactggaaagcactctccagcccc

SEQ ID NO: 371374 - DNA, 25 bp, Mus musculus
tgactggaacaggaaggttcatatg

SEQ ID NO: 371375 - DNA, 25 bp, Mus musculus
tgactggaaggatctgcgatggcgt

SEQ ID NO: 371376 - DNA, 25 bp, Mus musculus
tgactggaatggtatttccaaacta

SEQ ID NO: 371377 - DNA, 25 bp, Mus musculus
tgactggacaggttttatacgttcc

SEQ ID NO: 371378 - DNA, 25 bp, Mus musculus
tgactggacatgattttgggcatca

SEQ ID NO: 371379 - DNA, 25 bp, Mus musculus
tgactggacatggggatcctgtggg

SEQ ID NO: 371380 - DNA, 25 bp, Mus musculus
tgactggacccatgtccttcaggac

SEQ ID NO: 371381 - DNA, 25 bp, Mus musculus
tgactggatctgggagcatcaaggt

SEQ ID NO: 371382 - DNA, 25 bp, Mus musculus
tgactggcaacccagaactgatagt

SEQ ID NO: 371383 - DNA, 25 bp, Mus musculus
tgactggcaacccagattgacttga

SEQ ID NO: 371384 - DNA, 25 bp, Mus musculus
tgactggctggtgtgcaggattttt

SEQ ID NO: 371385 - DNA, 25 bp, Mus musculus
tgactggctggtttttcaacgacga

SEQ ID NO: 371386 - DNA, 25 bp, Mus musculus
tgactgggaaactactatagaaaac

SEQ ID NO: 371387 - DNA, 25 bp, Mus musculus
tgactgggagacttgtggcaatatg

SEQ ID NO: 371388 - DNA, 25 bp, Mus musculus
tgactgggagaggatttgaattaat

SEQ ID NO: 371389 - DNA, 25 bp, Mus musculus
tgactgggataaaggattccagcag

SEQ ID NO: 371390 - DNA, 25 bp, Mus musculus
tgactgggtggaggctaatctcgac

SEQ ID NO: 371391 - DNA, 25 bp, Mus musculus
tgactggtcaagaggaaattgatga

SEQ ID NO: 371392 - DNA, 25 bp, Mus musculus
tgactggtgtcaagcctgagggatc

SEQ ID NO: 371393 - DNA, 25 bp, Mus musculus
tgactggtgtcaagctcccagactc

SEQ ID NO: 371394 - DNA, 25 bp, Mus musculus
tgactggttaggaaacctgccatat

SEQ ID NO: 371395 - DNA, 25 bp, Mus musculus
tgactggttgcaatcaggattcaga

SEQ ID NO: 371396 - DNA, 25 bp, Mus musculus
tgactggttgttaaatgaagcttcc

SEQ ID NO: 371397 - DNA, 25 bp, Mus musculus
tgactgtaaagaagctggctgtgaa

SEQ ID NO: 371398 - DNA, 25 bp, Mus musculus
tgactgtaagttgtctgacatctct

SEQ ID NO: 371399 - DNA, 25 bp, Mus musculus
tgactgtacagtatgtgcagagcat

SEQ ID NO: 371400 - DNA, 25 bp, Mus musculus
tgactgtacagtgaaacagatgtgc

SEQ ID NO: 371401 - DNA, 25 bp, Mus musculus
tgactgtagcccggacatcaccttg

SEQ ID NO: 371402 - DNA, 25 bp, Mus musculus
tgactgtcaggaacatgacattgaa

SEQ ID NO: 371403 - DNA, 25 bp, Mus musculus
tgactgtctatacaactaaaattat

SEQ ID NO: 371404 - DNA, 25 bp, Mus musculus
tgactgtctatagacctgcaatgac

SEQ ID NO: 371405 - DNA, 25 bp, Mus musculus
tgactgtcttgagtgtctagctgcc

SEQ ID NO: 371406 - DNA, 25 bp, Mus musculus
tgactgtgaacagttcaaattccat

SEQ ID NO: 371407 - DNA, 25 bp, Mus musculus
tgactgtgaacagtttaaagcatgc

SEQ ID NO: 371408 - DNA, 25 bp, Mus musculus
tgactgtgaagaaccgacgcagacc

SEQ ID NO: 371409 - DNA, 25 bp, Mus musculus
tgactgtgaagtgtgccttacatcc

SEQ ID NO: 371410 - DNA, 25 bp, Mus musculus
tgactgtgaatgggtgaatttggaa

SEQ ID NO: 371411 - DNA, 25 bp, Mus musculus
tgactgtgaatgggttctaacgttc

SEQ ID NO: 371412 - DNA, 25 bp, Mus musculus
tgactgtgcactcagccatagattg

SEQ ID NO: 371413 - DNA, 25 bp, Mus musculus
tgactgtggaagaaggtggtgatct

SEQ ID NO: 371414 - DNA, 25 bp, Mus musculus
tgactgtgtctaaagggcttctctg

SEQ ID NO: 371415 - DNA, 25 bp, Mus musculus
tgactgtgtctaaaggtaaaacaga

SEQ ID NO: 371416 - DNA, 25 bp, Mus musculus
tgactgtgtggtgtcgattgatgag

SEQ ID NO: 371417 - DNA, 25 bp, Mus musculus
tgactgtgtggttgcagaagctgga

SEQ ID NO: 371418 - DNA, 25 bp, Mus musculus
tgactgtgtgtttgatcctgagttg

SEQ ID NO: 371419 - DNA, 25 bp, Mus musculus
tgactgtgttagatgctcctgaagt

SEQ ID NO: 371420 - DNA, 25 bp, Mus musculus
tgactgtgttagttgaacccacagt

SEQ ID NO: 371421 - DNA, 25 bp, Mus musculus
tgactgtgttctagactcaagaatg

SEQ ID NO: 371422 - DNA, 25 bp, Mus musculus
tgactgtgtttatggactacaaaga

SEQ ID NO: 371423 - DNA, 25 bp, Mus musculus
tgactgttaatagcccacaggtcct

SEQ ID NO: 371424 - DNA, 25 bp, Mus musculus
tgactgttaataggtcctgcctccc

SEQ ID NO: 371425 - DNA, 25 bp, Mus musculus
tgactgttaccaatgcaccttccag

SEQ ID NO: 371426 - DNA, 25 bp, Mus musculus
tgactgttatatgcagcagaagatg

SEQ ID NO: 371427 - DNA, 25 bp, Mus musculus
tgactgtttggtgctgcagagcttc

SEQ ID NO: 371428 - DNA, 25 bp, Mus musculus
tgacttaaaggaactagaggctgcc

SEQ ID NO: 371429 - DNA, 25 bp, Mus musculus
tgacttaagcacagaaggtgggact

SEQ ID NO: 371430 - DNA, 25 bp, Mus musculus
tgacttacaaatcaggagtatacaa

SEQ ID NO: 371431 - DNA, 25 bp, Mus musculus
tgacttacacacaggctgagggtat

SEQ ID NO: 371432 - DNA, 25 bp, Mus musculus
tgacttacagtaaggggctccacgg

SEQ ID NO: 371433 - DNA, 25 bp, Mus musculus
tgacttaccagctgggaagggctac

SEQ ID NO: 371434 - DNA, 25 bp, Mus musculus
tgacttaccgattctgttcccagtt

SEQ ID NO: 371435 - DNA, 25 bp, Mus musculus
tgacttagaagacgagctgtatgct

SEQ ID NO: 371436 - DNA, 25 bp, Mus musculus
tgacttagaagagaaagtggcccat

SEQ ID NO: 371437 - DNA, 25 bp, Mus musculus
tgacttagaagataagtttctttgc

SEQ ID NO: 371438 - DNA, 25 bp, Mus musculus
tgacttagaagatcaactctaccat

SEQ ID NO: 371439 - DNA, 25 bp, Mus musculus
tgacttagagaagagtgggaatgcc

SEQ ID NO: 371440 - DNA, 25 bp, Mus musculus
tgacttagaggaaatgctgtcattc

SEQ ID NO: 371441 - DNA, 25 bp, Mus musculus
tgacttagaggactagcccactgtg

SEQ ID NO: 371442 - DNA, 25 bp, Mus musculus
tgacttagaggactgtcagaaaacc

SEQ ID NO: 371443 - DNA, 25 bp, Mus musculus
tgacttagccgagttcaatctcatc

SEQ ID NO: 371444 - DNA, 25 bp, Mus musculus
tgacttatgggatatcttcagaaaa

SEQ ID NO: 371445 - DNA, 25 bp, Mus musculus
tgacttcaacaccctcttcaagtcc

SEQ ID NO: 371446 - DNA, 25 bp, Mus musculus
tgacttcaaggctgacatctggtcc

SEQ ID NO: 371447 - DNA, 25 bp, Mus musculus
tgacttcaataatgatttccagggt

SEQ ID NO: 371448 - DNA, 25 bp, Mus musculus
tgacttcaataatgtggtgaaaaca

SEQ ID NO: 371449 - DNA, 25 bp, Mus musculus
tgacttcacagtggaaggacattcc

SEQ ID NO: 371450 - DNA, 25 bp, Mus musculus
tgacttcactaaagcaaaaatcgtg

SEQ ID NO: 371451 - DNA, 25 bp, Mus musculus
tgacttcactaaggcaaaaatcgtg

SEQ ID NO: 371452 - DNA, 25 bp, Mus musculus
tgacttcagaatgaagtatgagaat

SEQ ID NO: 371453 - DNA, 25 bp, Mus musculus
tgacttcagactcaagtacgaaaac

SEQ ID NO: 371454 - DNA, 25 bp, Mus musculus
tgacttcaggaccaagtatgagtca

SEQ ID NO: 371455 - DNA, 25 bp, Mus musculus
tgacttcagtggggcgtctccgctg

SEQ ID NO: 371456 - DNA, 25 bp, Mus musculus
tgacttcatggtggcttgcatgcaa

SEQ ID NO: 371457 - DNA, 25 bp, Mus musculus
tgacttccacaggacctataagaac

SEQ ID NO: 371458 - DNA, 25 bp, Mus musculus
tgacttccacatcctgactccgttc

SEQ ID NO: 371459 - DNA, 25 bp, Mus musculus
tgacttccagaaggatctgaaagcc

SEQ ID NO: 371460 - DNA, 25 bp, Mus musculus
tgacttccagatgatgttgatcctg

SEQ ID NO: 371461 - DNA, 25 bp, Mus musculus
tgacttccatataagtttctttgct

SEQ ID NO: 371462 - DNA, 25 bp, Mus musculus
tgacttcccagatggcgaatactgg

SEQ ID NO: 371463 - DNA, 25 bp, Mus musculus
tgacttcccaggagctgatgcactg

SEQ ID NO: 371464 - DNA, 25 bp, Mus musculus
tgacttccccacctgggaaaagatg

SEQ ID NO: 371465 - DNA, 25 bp, Mus musculus
tgacttccctctagatttgatcaaa

SEQ ID NO: 371466 - DNA, 25 bp, Mus musculus
tgacttcccttagaatgtgattttt

SEQ ID NO: 371467 - DNA, 25 bp, Mus musculus
tgacttccgaggtcctggaggccac

SEQ ID NO: 371468 - DNA, 25 bp, Mus musculus
tgacttccgtggtgggattttcctg

SEQ ID NO: 371469 - DNA, 25 bp, Mus musculus
tgacttccttatctaacagtgtcat

SEQ ID NO: 371470 - DNA, 25 bp, Mus musculus
tgacttccttatctatttttcatca

SEQ ID NO: 371471 - DNA, 25 bp, Mus musculus
tgacttctcaaggagcgatgagcaa

SEQ ID NO: 371472 - DNA, 25 bp, Mus musculus
tgacttctcaaggcgaccctttgac

SEQ ID NO: 371473 - DNA, 25 bp, Mus musculus
tgacttctctaaggcttgccctctg

SEQ ID NO: 371474 - DNA, 25 bp, Mus musculus
tgacttctgctacaagcttcctgac

SEQ ID NO: 371475 - DNA, 25 bp, Mus musculus
tgacttctggatggacagtctgagg

SEQ ID NO: 371476 - DNA, 25 bp, Mus musculus
tgacttctgtagagtccaattggta

SEQ ID NO: 371477 - DNA, 25 bp, Mus musculus
tgacttctgtaggcataaactggga

SEQ ID NO: 371478 - DNA, 25 bp, Mus musculus
tgacttctttggtcttctaggggac

SEQ ID NO: 371479 - DNA, 25 bp, Mus musculus
tgacttgacctcagatcttggtaat

SEQ ID NO: 371480 - DNA, 25 bp, Mus musculus
tgacttgagaggcccaggatgggtg

SEQ ID NO: 371481 - DNA, 25 bp, Mus musculus
tgacttgagggagtgcccagctgct

SEQ ID NO: 371482 - DNA, 25 bp, Mus musculus
tgacttgagggtcctgagggaggca

SEQ ID NO: 371483 - DNA, 25 bp, Mus musculus
tgacttgatagcatagaaaattgga

SEQ ID NO: 371484 - DNA, 25 bp, Mus musculus
tgacttgatgtgtcttaccactgag

SEQ ID NO: 371485 - DNA, 25 bp, Mus musculus
tgacttgcaggttgatatgtcagac

SEQ ID NO: 371486 - DNA, 25 bp, Mus musculus
tgacttgctgctgcgatactatgat

SEQ ID NO: 371487 - DNA, 25 bp, Mus musculus
tgacttggccatgagatgagatgga

SEQ ID NO: 371488 - DNA, 25 bp, Mus musculus
tgacttggcggccatcgagtaaaat

SEQ ID NO: 371489 - DNA, 25 bp, Mus musculus
tgacttgggaggagactgacaaaac

SEQ ID NO: 371490 - DNA, 25 bp, Mus musculus
tgacttgtcctacctgctgattttc

SEQ ID NO: 371491 - DNA, 25 bp, Mus musculus
tgacttgttggcccgtgggattgac

SEQ ID NO: 371492 - DNA, 25 bp, Mus musculus
tgactttaaactagcagggggagga

SEQ ID NO: 371493 - DNA, 25 bp, Mus musculus
tgactttaactttgagaagaaccaa

SEQ ID NO: 371494 - DNA, 25 bp, Mus musculus
tgactttaagcaggtgctgctggtg

SEQ ID NO: 371495 - DNA, 25 bp, Mus musculus
tgactttaaggacagttatctgctg

SEQ ID NO: 371496 - DNA, 25 bp, Mus musculus
tgactttaaggaggccacgcagtgc

SEQ ID NO: 371497 - DNA, 25 bp, Mus musculus
tgactttaatcaaagcaatggaagt

SEQ ID NO: 371498 - DNA, 25 bp, Mus musculus
tgactttacaggaaaaccaccaaag

SEQ ID NO: 371499 - DNA, 25 bp, Mus musculus
tgactttaggaatgtgaagctcttg

SEQ ID NO: 371500 - DNA, 25 bp, Mus musculus
tgactttagggtcttctcagttact

SEQ ID NO: 371501 - DNA, 25 bp, Mus musculus
tgactttcacacaatcagggcatgg

SEQ ID NO: 371502 - DNA, 25 bp, Mus musculus
tgactttcatgatgcccccaccata

SEQ ID NO: 371503 - DNA, 25 bp, Mus musculus
tgactttcattggtgctgtccccgg

SEQ ID NO: 371504 - DNA, 25 bp, Mus musculus
tgactttctctgtaccgtcagaagg

SEQ ID NO: 371505 - DNA, 25 bp, Mus musculus
tgactttctgaagcttcttcacatt

SEQ ID NO: 371506 - DNA, 25 bp, Mus musculus
tgactttcttcagttgtttcctctc

SEQ ID NO: 371507 - DNA, 25 bp, Mus musculus
tgactttgaagatgaccgcaacccg

SEQ ID NO: 371508 - DNA, 25 bp, Mus musculus
tgactttgaaggttgtcttgacacc

SEQ ID NO: 371509 - DNA, 25 bp, Mus musculus
tgactttgagacctataatggtcag

SEQ ID NO: 371510 - DNA, 25 bp, Mus musculus
tgactttgagcggaggctgctgaac

SEQ ID NO: 371511 - DNA, 25 bp, Mus musculus
tgactttgatgaggtacagtatcag

SEQ ID NO: 371512 - DNA, 25 bp, Mus musculus
tgactttgcagtttcaccaaacctc

SEQ ID NO: 371513 - DNA, 25 bp, Mus musculus
tgactttgccttcaatctcacagag

SEQ ID NO: 371514 - DNA, 25 bp, Mus musculus
tgactttggatggaagacttcgagt

SEQ ID NO: 371515 - DNA, 25 bp, Mus musculus
tgactttgtaagaaactggtcaaaa

SEQ ID NO: 371516 - DNA, 25 bp, Mus musculus
tgactttgtaaggtatctactttat

SEQ ID NO: 371517 - DNA, 25 bp, Mus musculus
tgacttttagaaccagctcagctag

SEQ ID NO: 371518 - DNA, 25 bp, Mus musculus
tgacttttgttacagactagcttcc

SEQ ID NO: 371519 - DNA, 25 bp, Mus musculus
tgactttttcgctgccttggggtgc

SEQ ID NO: 371520 - DNA, 25 bp, Mus musculus
tgactttttcggtgcctcctgagaa

SEQ ID NO: 371521 - DNA, 25 bp, Mus musculus
tgactttttgaaccgctcccatttt

SEQ ID NO: 371522 - DNA, 25 bp, Mus musculus
tgagaaaaaccaatggctccccctg

SEQ ID NO: 371523 - DNA, 25 bp, Mus musculus
tgagaaaaaggattcagaatttcct

SEQ ID NO: 371524 - DNA, 25 bp, Mus musculus
tgagaaaaaggtcctggagtgggct

SEQ ID NO: 371525 - DNA, 25 bp, Mus musculus
tgagaaaaatttagaatatgacatc

SEQ ID NO: 371526 - DNA, 25 bp, Mus musculus
tgagaaaacagaagattctagtgtt

SEQ ID NO: 371527 - DNA, 25 bp, Mus musculus
tgagaaaacaggatctgactttgtg

SEQ ID NO: 371528 - DNA, 25 bp, Mus musculus
tgagaaaactggggtaattgaacat

SEQ ID NO: 371529 - DNA, 25 bp, Mus musculus
tgagaaaaggtcaaaactctaacac

SEQ ID NO: 371530 - DNA, 25 bp, Mus musculus
tgagaaaaggtgcagatcctggggc

SEQ ID NO: 371531 - DNA, 25 bp, Mus musculus
tgagaaaaggtgcagcaactgcttt

SEQ ID NO: 371532 - DNA, 25 bp, Mus musculus
tgagaaacagcacacagggccagag

SEQ ID NO: 371533 - DNA, 25 bp, Mus musculus
tgagaaacaggtggaagagctgttg

SEQ ID NO: 371534 - DNA, 25 bp, Mus musculus
tgagaaacatgctggtggctgggac

SEQ ID NO: 371535 - DNA, 25 bp, Mus musculus
tgagaaacatgctggtggtgtcaca

SEQ ID NO: 371536 - DNA, 25 bp, Mus musculus
tgagaaacattcaagggtatccaga

SEQ ID NO: 371537 - DNA, 25 bp, Mus musculus
tgagaaacctgagatttctgttttt

SEQ ID NO: 371538 - DNA, 25 bp, Mus musculus
tgagaaacctgaggagttaggatct

SEQ ID NO: 371539 - DNA, 25 bp, Mus musculus
tgagaaacgctgccgccaagttgaa

SEQ ID NO: 371540 - DNA, 25 bp, Mus musculus
tgagaaactgatctctcacctatct

SEQ ID NO: 371541 - DNA, 25 bp, Mus musculus
tgagaaactggagaccttcttcggg

SEQ ID NO: 371542 - DNA, 25 bp, Mus musculus
tgagaaacttgaggccagaagtcaa

SEQ ID NO: 371543 - DNA, 25 bp, Mus musculus
tgagaaacttgagtatgaaagcaag

SEQ ID NO: 371544 - DNA, 25 bp, Mus musculus
tgagaaagaagctgctccagctgct

SEQ ID NO: 371545 - DNA, 25 bp, Mus musculus
tgagaaagataggttgcagctgtct

SEQ ID NO: 371546 - DNA, 25 bp, Mus musculus
tgagaaagatgacaagttgacccca

SEQ ID NO: 371547 - DNA, 25 bp, Mus musculus
tgagaaagatgtgccagaaacagaa

SEQ ID NO: 371548 - DNA, 25 bp, Mus musculus
tgagaaagcataagaatgttttgag

SEQ ID NO: 371549 - DNA, 25 bp, Mus musculus
tgagaaagcataaggtgactcatat

SEQ ID NO: 371550 - DNA, 25 bp, Mus musculus
tgagaaagcatgctctctgttggga

SEQ ID NO: 371551 - DNA, 25 bp, Mus musculus
tgagaaataaagacaaaaggcttga

SEQ ID NO: 371552 - DNA, 25 bp, Mus musculus
tgagaaataagaggtacccagactc

SEQ ID NO: 371553 - DNA, 25 bp, Mus musculus
tgagaaataccagtccctggcctac

SEQ ID NO: 371554 - DNA, 25 bp, Mus musculus
tgagaaatacggtgaggccctggga

SEQ ID NO: 371555 - DNA, 25 bp, Mus musculus
tgagaaatcaggtcttaatttgcag

SEQ ID NO: 371556 - DNA, 25 bp, Mus musculus
tgagaaatgcaggaatctccggttc

SEQ ID NO: 371557 - DNA, 25 bp, Mus musculus
tgagaaatggcatttatctgggagt

SEQ ID NO: 371558 - DNA, 25 bp, Mus musculus
tgagaaattgcaggtctcacccaaa

SEQ ID NO: 371559 - DNA, 25 bp, Mus musculus
tgagaacaaagtggcctatgagcgg

SEQ ID NO: 371560 - DNA, 25 bp, Mus musculus
tgagaacaacaggaacctgaggaga

SEQ ID NO: 371561 - DNA, 25 bp, Mus musculus
tgagaacaacaggactccgggagaa

SEQ ID NO: 371562 - DNA, 25 bp, Mus musculus
tgagaacaagaaagcatctaaagac

SEQ ID NO: 371563 - DNA, 25 bp, Mus musculus
tgagaacaccaaattccggggtgca

SEQ ID NO: 371564 - DNA, 25 bp, Mus musculus
tgagaacagagagatggatgatcct

SEQ ID NO: 371565 - DNA, 25 bp, Mus musculus
tgagaacaggatggacagtctctcc

SEQ ID NO: 371566 - DNA, 25 bp, Mus musculus
tgagaacagggtaggtgagctccag

SEQ ID NO: 371567 - DNA, 25 bp, Mus musculus
tgagaacatcaagacaaaccaggtg

SEQ ID NO: 371568 - DNA, 25 bp, Mus musculus
tgagaacatcaagactggagtacct

SEQ ID NO: 371569 - DNA, 25 bp, Mus musculus
tgagaaccagagcatcgtgctggag

SEQ ID NO: 371570 - DNA, 25 bp, Mus musculus
tgagaaccagagggacagcatcgtg

SEQ ID NO: 371571 - DNA, 25 bp, Mus musculus
tgagaaccccagggtccattcacac

SEQ ID NO: 371572 - DNA, 25 bp, Mus musculus
tgagaaccgagaaatggcaaaatgt

SEQ ID NO: 371573 - DNA, 25 bp, Mus musculus
tgagaaccgagttcctgttcctctc

SEQ ID NO: 371574 - DNA, 25 bp, Mus musculus
tgagaaccggaagaaagccgaagcc

SEQ ID NO: 371575 - DNA, 25 bp, Mus musculus
tgagaacctgccctgcagttaaacg

SEQ ID NO: 371576 - DNA, 25 bp, Mus musculus
tgagaacctgtctccttaaagaatc

SEQ ID NO: 371577 - DNA, 25 bp, Mus musculus
tgagaacggatgggatatttccacc

SEQ ID NO: 371578 - DNA, 25 bp, Mus musculus
tgagaactacatcaggaactggttt

SEQ ID NO: 371579 - DNA, 25 bp, Mus musculus
tgagaactaggtgctcctgccatgc

SEQ ID NO: 371580 - DNA, 25 bp, Mus musculus
tgagaactatgcaggtattgcagct

SEQ ID NO: 371581 - DNA, 25 bp, Mus musculus
tgagaacttcaggctcctgggcaat

SEQ ID NO: 371582 - DNA, 25 bp, Mus musculus
tgagaacttcaggtctgctgtaaca

SEQ ID NO: 371583 - DNA, 25 bp, Mus musculus
tgagaacttcaggtttgctgtctta

SEQ ID NO: 371584 - DNA, 25 bp, Mus musculus
tgagaagaaggtgtttctcctggcc

SEQ ID NO: 371585 - DNA, 25 bp, Mus musculus
tgagaagaccaagactgtatccctt

SEQ ID NO: 371586 - DNA, 25 bp, Mus musculus
tgagaagaccaaggctttgatccag

SEQ ID NO: 371587 - DNA, 25 bp, Mus musculus
tgagaagacccagaaatttgtatgc

SEQ ID NO: 371588 - DNA, 25 bp, Mus musculus
tgagaagacgggatatcgctcgagg

SEQ ID NO: 371589 - DNA, 25 bp, Mus musculus
tgagaagactgtgaacaggtatgag

SEQ ID NO: 371590 - DNA, 25 bp, Mus musculus
tgagaagagaagacactaccactga

SEQ ID NO: 371591 - DNA, 25 bp, Mus musculus
tgagaagagagagaagctcggacct

SEQ ID NO: 371592 - DNA, 25 bp, Mus musculus
tgagaagatcttctgattcctgccg

SEQ ID NO: 371593 - DNA, 25 bp, Mus musculus
tgagaagatcttctggcacagcttg

SEQ ID NO: 371594 - DNA, 25 bp, Mus musculus
tgagaagatgagctcagcagtcagc

SEQ ID NO: 371595 - DNA, 25 bp, Mus musculus
tgagaagatgagtcgggatataagc

SEQ ID NO: 371596 - DNA, 25 bp, Mus musculus
tgagaagatgggtaatgccatcgag

SEQ ID NO: 371597 - DNA, 25 bp, Mus musculus
tgagaagattacgacgggcagaacc

SEQ ID NO: 371598 - DNA, 25 bp, Mus musculus
tgagaagcaggctgtgcagctatcg

SEQ ID NO: 371599 - DNA, 25 bp, Mus musculus
tgagaagcaggtctgttctcctggc

SEQ ID NO: 371600 - DNA, 25 bp, Mus musculus
tgagaagcccaagctgcagacggag

SEQ ID NO: 371601 - DNA, 25 bp, Mus musculus
tgagaagctgggcttcaacaaatcc

SEQ ID NO: 371602 - DNA, 25 bp, Mus musculus
tgagaagctgggtatcagtaccatt

SEQ ID NO: 371603 - DNA, 25 bp, Mus musculus
tgagaaggaacaaggtctgcaaaca

SEQ ID NO: 371604 - DNA, 25 bp, Mus musculus
tgagaaggaagagggtaaactggtg

SEQ ID NO: 371605 - DNA, 25 bp, Mus musculus
tgagaaggaaggtctgtctgcaggt

SEQ ID NO: 371606 - DNA, 25 bp, Mus musculus
tgagaaggacaaattggagcctgcc

SEQ ID NO: 371607 - DNA, 25 bp, Mus musculus
tgagaaggacaaggttaactgctct

SEQ ID NO: 371608 - DNA, 25 bp, Mus musculus
tgagaaggagacaatcccagacatt

SEQ ID NO: 371609 - DNA, 25 bp, Mus musculus
tgagaaggagcttcctgtcacggaa

SEQ ID NO: 371610 - DNA, 25 bp, Mus musculus
tgagaaggagggggagctcaactaa

SEQ ID NO: 371611 - DNA, 25 bp, Mus musculus
tgagaaggaggggttccccatcaca

SEQ ID NO: 371612 - DNA, 25 bp, Mus musculus
tgagaaggaggtcactcttatccac

SEQ ID NO: 371613 - DNA, 25 bp, Mus musculus
tgagaaggatgcccactgagcagga

SEQ ID NO: 371614 - DNA, 25 bp, Mus musculus
tgagaagggcaaagacgatgcggtc

SEQ ID NO: 371615 - DNA, 25 bp, Mus musculus
tgagaagggcaaaggctggagcaaa

SEQ ID NO: 371616 - DNA, 25 bp, Mus musculus
tgagaaggtgggaggctggaatatc

SEQ ID NO: 371617 - DNA, 25 bp, Mus musculus
tgagaagtcgggtacaaagtaagaa

SEQ ID NO: 371618 - DNA, 25 bp, Mus musculus
tgagaagtctggagaaatctgggct

SEQ ID NO: 371619 - DNA, 25 bp, Mus musculus
tgagaataaatccaagtttggggcc

SEQ ID NO: 371620 - DNA, 25 bp, Mus musculus
tgagaataaatccttggagctggtg

SEQ ID NO: 371621 - DNA, 25 bp, Mus musculus
tgagaataaatgcctttaatgtgat

SEQ ID NO: 371622 - DNA, 25 bp, Mus musculus
tgagaataagttcaaggtgcttatg

SEQ ID NO: 371623 - DNA, 25 bp, Mus musculus
tgagaataatctttgtgcgctctgt

SEQ ID NO: 371624 - DNA, 25 bp, Mus musculus
tgagaataatgtttgctttgagtgt

SEQ ID NO: 371625 - DNA, 25 bp, Mus musculus
tgagaataccattgagtcagacgtt

SEQ ID NO: 371626 - DNA, 25 bp, Mus musculus
tgagaatagctaagagctttgaccc

SEQ ID NO: 371627 - DNA, 25 bp, Mus musculus
tgagaatccagaaatggcctccacc

SEQ ID NO: 371628 - DNA, 25 bp, Mus musculus
tgagaatccagatccagggttcctg

SEQ ID NO: 371629 - DNA, 25 bp, Mus musculus
tgagaatccaggtctcccggactta

SEQ ID NO: 371630 - DNA, 25 bp, Mus musculus
tgagaatcttgtcaggaacctcagc

SEQ ID NO: 371631 - DNA, 25 bp, Mus musculus
tgagaatcttgtcaggtgtgatgaa

SEQ ID NO: 371632 - DNA, 25 bp, Mus musculus
tgagaatgaagacactcagccggag

SEQ ID NO: 371633 - DNA, 25 bp, Mus musculus
tgagaatgaaggctctggaatggca

SEQ ID NO: 371634 - DNA, 25 bp, Mus musculus
tgagaatgacaggagccatccgcaa

SEQ ID NO: 371635 - DNA, 25 bp, Mus musculus
tgagaatgagacgtccagcgtgctt

SEQ ID NO: 371636 - DNA, 25 bp, Mus musculus
tgagaatgaggaaggcaagcgcagt

SEQ ID NO: 371637 - DNA, 25 bp, Mus musculus
tgagaatgatccagctacatcaaaa

SEQ ID NO: 371638 - DNA, 25 bp, Mus musculus
tgagaatgggctaggcaaaagatgt

SEQ ID NO: 371639 - DNA, 25 bp, Mus musculus
tgagaatgggctagtcacagttgca

SEQ ID NO: 371640 - DNA, 25 bp, Mus musculus
tgagaatggggacagtgtcttacac

SEQ ID NO: 371641 - DNA, 25 bp, Mus musculus
tgagaatgtccactgttccccattt

SEQ ID NO: 371642 - DNA, 25 bp, Mus musculus
tgagaatgtctaataaaactggatg

SEQ ID NO: 371643 - DNA, 25 bp, Mus musculus
tgagaattcaagtctgtcacctaaa

SEQ ID NO: 371644 - DNA, 25 bp, Mus musculus
tgagaattgactctgtttcccacag

SEQ ID NO: 371645 - DNA, 25 bp, Mus musculus
tgagaattgtggaagaataagaatg

SEQ ID NO: 371646 - DNA, 25 bp, Mus musculus
tgagaattttacagaatcctgaaat

SEQ ID NO: 371647 - DNA, 25 bp, Mus musculus
tgagacaaagggagctgaaggttgg

SEQ ID NO: 371648 - DNA, 25 bp, Mus musculus
tgagacaagagatgtgcttgtgtgg

SEQ ID NO: 371649 - DNA, 25 bp, Mus musculus
tgagacaagcaaggaggtgagtgct

SEQ ID NO: 371650 - DNA, 25 bp, Mus musculus
tgagacaagcaagggctctgtaaaa

SEQ ID NO: 371651 - DNA, 25 bp, Mus musculus
tgagacaattccagcacaaggaatt

SEQ ID NO: 371652 - DNA, 25 bp, Mus musculus
tgagacaattgaggaaccaacacaa

SEQ ID NO: 371653 - DNA, 25 bp, Mus musculus
tgagacacacgcgcttgttctctac

SEQ ID NO: 371654 - DNA, 25 bp, Mus musculus
tgagacaccgagagtgtgggttcgc

SEQ ID NO: 371655 - DNA, 25 bp, Mus musculus
tgagacacggagcggtactgctcac

SEQ ID NO: 371656 - DNA, 25 bp, Mus musculus
tgagacagatggaccctcctcatcc

SEQ ID NO: 371657 - DNA, 25 bp, Mus musculus
tgagacagcaaagcgcaggctatga

SEQ ID NO: 371658 - DNA, 25 bp, Mus musculus
tgagacaggaccagcaatggcaagc

SEQ ID NO: 371659 - DNA, 25 bp, Mus musculus
tgagacatcctaagatcaaacaaat

SEQ ID NO: 371660 - DNA, 25 bp, Mus musculus
tgagacatcctaaggtcctcggccc

SEQ ID NO: 371661 - DNA, 25 bp, Mus musculus
tgagacatttcaagaagacagcatc

SEQ ID NO: 371662 - DNA, 25 bp, Mus musculus
tgagacatttcaagctcttagcccc

SEQ ID NO: 371663 - DNA, 25 bp, Mus musculus
tgagaccaacaaatagctgtatgaa

SEQ ID NO: 371664 - DNA, 25 bp, Mus musculus
tgagaccaacaaatgacaccgtaca

SEQ ID NO: 371665 - DNA, 25 bp, Mus musculus
tgagaccacagatgccaattcatca

SEQ ID NO: 371666 - DNA, 25 bp, Mus musculus
tgagaccaccctcccttggaacgcc

SEQ ID NO: 371667 - DNA, 25 bp, Mus musculus
tgagaccacgcagaggaaagatggt

SEQ ID NO: 371668 - DNA, 25 bp, Mus musculus
tgagaccacgcagagggaaggtgtg

SEQ ID NO: 371669 - DNA, 25 bp, Mus musculus
tgagaccagacgtctccaccagctg

SEQ ID NO: 371670 - DNA, 25 bp, Mus musculus
tgagaccatcctagtcatgggagac

SEQ ID NO: 371671 - DNA, 25 bp, Mus musculus
tgagaccattacagaagctgaaccg

SEQ ID NO: 371672 - DNA, 25 bp, Mus musculus
tgagacccaacagaaaaatggctac

SEQ ID NO: 371673 - DNA, 25 bp, Mus musculus
tgagacccaagggcctgatttgttc

SEQ ID NO: 371674 - DNA, 25 bp, Mus musculus
tgagacccacatggaatggacctgt

SEQ ID NO: 371675 - DNA, 25 bp, Mus musculus
tgagacccagctttccctgctgctt

SEQ ID NO: 371676 - DNA, 25 bp, Mus musculus
tgagacccaggtggtactgataaat

SEQ ID NO: 371677 - DNA, 25 bp, Mus musculus
tgagacccaggttcaactggagagc

SEQ ID NO: 371678 - DNA, 25 bp, Mus musculus
tgagaccccaagagaagggagtgga

SEQ ID NO: 371679 - DNA, 25 bp, Mus musculus
tgagaccccaagagagacaacaatc

SEQ ID NO: 371680 - DNA, 25 bp, Mus musculus
tgagaccccgagtggaaagctgagc

SEQ ID NO: 371681 - DNA, 25 bp, Mus musculus
tgagaccccgctcaggccccgcgat

SEQ ID NO: 371682 - DNA, 25 bp, Mus musculus
tgagaccccgctcaggtttccaggc

SEQ ID NO: 371683 - DNA, 25 bp, Mus musculus
tgagaccccgggcaggtttagacac

SEQ ID NO: 371684 - DNA, 25 bp, Mus musculus
tgagaccctacatggcttccttccc

SEQ ID NO: 371685 - DNA, 25 bp, Mus musculus
tgagaccctacatgtacccctcaat

SEQ ID NO: 371686 - DNA, 25 bp, Mus musculus
tgagaccctggacatgaacaagctg

SEQ ID NO: 371687 - DNA, 25 bp, Mus musculus
tgagaccctgtacatgggctgtgtg

SEQ ID NO: 371688 - DNA, 25 bp, Mus musculus
tgagaccggaccagctccccatata

SEQ ID NO: 371689 - DNA, 25 bp, Mus musculus
tgagaccggatcagctccccatata

SEQ ID NO: 371690 - DNA, 25 bp, Mus musculus
tgagacctctgagagatggatttat

SEQ ID NO: 371691 - DNA, 25 bp, Mus musculus
tgagacctctgagagctcccaggag

SEQ ID NO: 371692 - DNA, 25 bp, Mus musculus
tgagacctgcgacaacaacgggacc

SEQ ID NO: 371693 - DNA, 25 bp, Mus musculus
tgagaccttcaccttccagagaagg

SEQ ID NO: 371694 - DNA, 25 bp, Mus musculus
tgagaccttccaggaacttccatta

SEQ ID NO: 371695 - DNA, 25 bp, Mus musculus
tgagaccttccaggtggaggatttt

SEQ ID NO: 371696 - DNA, 25 bp, Mus musculus
tgagacctttacgacagtgtgaact

SEQ ID NO: 371697 - DNA, 25 bp, Mus musculus
tgagacgaccctcaagtgccctgtg

SEQ ID NO: 371698 - DNA, 25 bp, Mus musculus
tgagacggcacccagtaatctttgg

SEQ ID NO: 371699 - DNA, 25 bp, Mus musculus
tgagacgggaagctgtacagagagg

SEQ ID NO: 371700 - DNA, 25 bp, Mus musculus
tgagacgtgaaagataaagctttta

SEQ ID NO: 371701 - DNA, 25 bp, Mus musculus
tgagacgtgggactccagtgatttt

SEQ ID NO: 371702 - DNA, 25 bp, Mus musculus
tgagactaaagtctttaagaaatag

SEQ ID NO: 371703 - DNA, 25 bp, Mus musculus
tgagactaatagtgcagaggagaac

SEQ ID NO: 371704 - DNA, 25 bp, Mus musculus
tgagactaatccagctgaacatacc

SEQ ID NO: 371705 - DNA, 25 bp, Mus musculus
tgagactctctgtgcaaagacccac

SEQ ID NO: 371706 - DNA, 25 bp, Mus musculus
tgagactctctgtggaccccgttca

SEQ ID NO: 371707 - DNA, 25 bp, Mus musculus
tgagactgaccaaggctccagaaat

SEQ ID NO: 371708 - DNA, 25 bp, Mus musculus
tgagactgaccaaggggctgacggg

SEQ ID NO: 371709 - DNA, 25 bp, Mus musculus
tgagactgagagaggaccatgctcc

SEQ ID NO: 371710 - DNA, 25 bp, Mus musculus
tgagactgagatagacaccatcttg

SEQ ID NO: 371711 - DNA, 25 bp, Mus musculus
tgagactgagatagatttcaaatat

SEQ ID NO: 371712 - DNA, 25 bp, Mus musculus
tgagactgctcctggtgcatggagg

SEQ ID NO: 371713 - DNA, 25 bp, Mus musculus
tgagactggagagacgagagaatat

SEQ ID NO: 371714 - DNA, 25 bp, Mus musculus
tgagactggagcttggtgtctgtct

SEQ ID NO: 371715 - DNA, 25 bp, Mus musculus
tgagactggatctctttcctttgca

SEQ ID NO: 371716 - DNA, 25 bp, Mus musculus
tgagactggctcttggcgacaactg

SEQ ID NO: 371717 - DNA, 25 bp, Mus musculus
tgagactgggcagttggtcatcatg

SEQ ID NO: 371718 - DNA, 25 bp, Mus musculus
tgagactgtgggatagtgtgctggc

SEQ ID NO: 371719 - DNA, 25 bp, Mus musculus
tgagactgtggtgtgtctgcaggat

SEQ ID NO: 371720 - DNA, 25 bp, Mus musculus
tgagacttacagattgccaaaatgc

SEQ ID NO: 371721 - DNA, 25 bp, Mus musculus
tgagacttagaatccttctgaaggt

SEQ ID NO: 371722 - DNA, 25 bp, Mus musculus
tgagacttagtagctagaagaatgc

SEQ ID NO: 371723 - DNA, 25 bp, Mus musculus
tgagacttgacaaggtggtgacagt

SEQ ID NO: 371724 - DNA, 25 bp, Mus musculus
tgagacttgtattccctgtgagtgt

SEQ ID NO: 371725 - DNA, 25 bp, Mus musculus
tgagactttccaagaaagtcactgt

SEQ ID NO: 371726 - DNA, 25 bp, Mus musculus
tgagactttccaaggtggaacttgc

SEQ ID NO: 371727 - DNA, 25 bp, Mus musculus
tgagagaaaacttttatccatgacc

SEQ ID NO: 371728 - DNA, 25 bp, Mus musculus
tgagagaaaaggcctgctggtgacc

SEQ ID NO: 371729 - DNA, 25 bp, Mus musculus
tgagagaaagaatcccaagaggttt

SEQ ID NO: 371730 - DNA, 25 bp, Mus musculus
tgagagaaagaatgcccagatgtct

SEQ ID NO: 371731 - DNA, 25 bp, Mus musculus
tgagagaaagtgatgtatcgcctga

SEQ ID NO: 371732 - DNA, 25 bp, Mus musculus
tgagagaacatgaacaaaaagtttc

SEQ ID NO: 371733 - DNA, 25 bp, Mus musculus
tgagagaatggctgataatgcctgc

SEQ ID NO: 371734 - DNA, 25 bp, Mus musculus
tgagagaattaaggcaccaaggaga

SEQ ID NO: 371735 - DNA, 25 bp, Mus musculus
tgagagaattggaaaatgactccct

SEQ ID NO: 371736 - DNA, 25 bp, Mus musculus
tgagagacaggacggggcgctgttg

SEQ ID NO: 371737 - DNA, 25 bp, Mus musculus
tgagagacaggccttctgtatactg

SEQ ID NO: 371738 - DNA, 25 bp, Mus musculus
tgagagacccaaaagcagaatacag

SEQ ID NO: 371739 - DNA, 25 bp, Mus musculus
tgagagacccaaaagtttgaggata

SEQ ID NO: 371740 - DNA, 25 bp, Mus musculus
tgagagacttaaaatgaaatggaag

SEQ ID NO: 371741 - DNA, 25 bp, Mus musculus
tgagagagagaaggagagggaaaga

SEQ ID NO: 371742 - DNA, 25 bp, Mus musculus
tgagagagaggatgagaccggggcc

SEQ ID NO: 371743 - DNA, 25 bp, Mus musculus
tgagagagcgagagttactacctgg

SEQ ID NO: 371744 - DNA, 25 bp, Mus musculus
tgagagagcgaggttgcacataggc

SEQ ID NO: 371745 - DNA, 25 bp, Mus musculus
tgagagagctgcaagcaggggtaga

SEQ ID NO: 371746 - DNA, 25 bp, Mus musculus
tgagagagttggaaggaaggcttgc

SEQ ID NO: 371747 - DNA, 25 bp, Mus musculus
tgagagagttggaagggagctagct

SEQ ID NO: 371748 - DNA, 25 bp, Mus musculus
tgagagataaggcacctccaagtgg

SEQ ID NO: 371749 - DNA, 25 bp, Mus musculus
tgagagatcccaagttctttcagat

SEQ ID NO: 371750 - DNA, 25 bp, Mus musculus
tgagagatcctttcggctgtcggcg

SEQ ID NO: 371751 - DNA, 25 bp, Mus musculus
tgagagatctgaagcagataaagaa

SEQ ID NO: 371752 - DNA, 25 bp, Mus musculus
tgagagatgcaagctgataggagca

SEQ ID NO: 371753 - DNA, 25 bp, Mus musculus
tgagagattagaagaaaaccacgag

SEQ ID NO: 371754 - DNA, 25 bp, Mus musculus
tgagagattcttcaggtctatggaa

SEQ ID NO: 371755 - DNA, 25 bp, Mus musculus
tgagagcaaaaagaacatgtttggg

SEQ ID NO: 371756 - DNA, 25 bp, Mus musculus
tgagagcaaggatttatatgaatac

SEQ ID NO: 371757 - DNA, 25 bp, Mus musculus
tgagagcaccccgatcccagagagc

SEQ ID NO: 371758 - DNA, 25 bp, Mus musculus
tgagagcacggactagaagtgagaa

SEQ ID NO: 371759 - DNA, 25 bp, Mus musculus
tgagagcattaagcatccagcatgt

SEQ ID NO: 371760 - DNA, 25 bp, Mus musculus
tgagagccagagctgttctgccaag

SEQ ID NO: 371761 - DNA, 25 bp, Mus musculus
tgagagccagaggcactgagagtat

SEQ ID NO: 371762 - DNA, 25 bp, Mus musculus
tgagagccagatatccattgaatac

SEQ ID NO: 371763 - DNA, 25 bp, Mus musculus
tgagagccagtcgtttcagctctgc

SEQ ID NO: 371764 - DNA, 25 bp, Mus musculus
tgagagcctcctgacatgatgtagc

SEQ ID NO: 371765 - DNA, 25 bp, Mus musculus
tgagagcctcctggagctggtggag

SEQ ID NO: 371766 - DNA, 25 bp, Mus musculus
tgagagcgatccagtttgacgccga

SEQ ID NO: 371767 - DNA, 25 bp, Mus musculus
tgagagctagcagacatctctgtga

SEQ ID NO: 371768 - DNA, 25 bp, Mus musculus
tgagagctagcagttccagtgcaga

SEQ ID NO: 371769 - DNA, 25 bp, Mus musculus
tgagagctcagccctagtcgaggga

SEQ ID NO: 371770 - DNA, 25 bp, Mus musculus
tgagagctggctcccttccccagga

SEQ ID NO: 371771 - DNA, 25 bp, Mus musculus
tgagagctgtaatagttccgaggat

SEQ ID NO: 371772 - DNA, 25 bp, Mus musculus
tgagaggaaaagcagacttgtgtcc

SEQ ID NO: 371773 - DNA, 25 bp, Mus musculus
tgagaggaaaagcagcagatatacc

SEQ ID NO: 371774 - DNA, 25 bp, Mus musculus
tgagaggaacgagtgtggccagacg

SEQ ID NO: 371775 - DNA, 25 bp, Mus musculus
tgagaggaagactctgcagcttcaa

SEQ ID NO: 371776 - DNA, 25 bp, Mus musculus
tgagaggaatcagaatcagactgga

SEQ ID NO: 371777 - DNA, 25 bp, Mus musculus
tgagaggaatcagttcacagcgctg

SEQ ID NO: 371778 - DNA, 25 bp, Mus musculus
tgagaggaatccaacctcagtgcag

SEQ ID NO: 371779 - DNA, 25 bp, Mus musculus
tgagaggacagccctgactccccca

SEQ ID NO: 371780 - DNA, 25 bp, Mus musculus
tgagaggacaggcattgttatcggc

SEQ ID NO: 371781 - DNA, 25 bp, Mus musculus
tgagaggagcacaggaccatcagaa

SEQ ID NO: 371782 - DNA, 25 bp, Mus musculus
tgagaggatgctgagagtccatgcc

SEQ ID NO: 371783 - DNA, 25 bp, Mus musculus
tgagaggcagggcttgtcaatgagg

SEQ ID NO: 371784 - DNA, 25 bp, Mus musculus
tgagaggcatcaagagtcattcccg

SEQ ID NO: 371785 - DNA, 25 bp, Mus musculus
tgagaggccagatcctaaatttgac

SEQ ID NO: 371786 - DNA, 25 bp, Mus musculus
tgagaggccagccatagctcttgga

SEQ ID NO: 371787 - DNA, 25 bp, Mus musculus
tgagaggctcagcaggaaacaagga

SEQ ID NO: 371788 - DNA, 25 bp, Mus musculus
tgagaggctcagcagggtgctacag

SEQ ID NO: 371789 - DNA, 25 bp, Mus musculus
tgagaggctcaggcagaagatcctg

SEQ ID NO: 371790 - DNA, 25 bp, Mus musculus
tgagagggagcttcgttacgacgat

SEQ ID NO: 371791 - DNA, 25 bp, Mus musculus
tgagagggaggtctgggacatgttt

SEQ ID NO: 371792 - DNA, 25 bp, Mus musculus
tgagaggggcaggtggcagctcagc

SEQ ID NO: 371793 - DNA, 25 bp, Mus musculus
tgagaggtaagcttgtctcctctct

SEQ ID NO: 371794 - DNA, 25 bp, Mus musculus
tgagaggttccacaacttagaaggc

SEQ ID NO: 371795 - DNA, 25 bp, Mus musculus
tgagagtaagatttatgacattcaa

SEQ ID NO: 371796 - DNA, 25 bp, Mus musculus
tgagagtatgcagtccttcagctca

SEQ ID NO: 371797 - DNA, 25 bp, Mus musculus
tgagagtcgggccctgtctccaaca

SEQ ID NO: 371798 - DNA, 25 bp, Mus musculus
tgagagtcgggggcctggtgtacac

SEQ ID NO: 371799 - DNA, 25 bp, Mus musculus
tgagagtctatcaccactactttaa

SEQ ID NO: 371800 - DNA, 25 bp, Mus musculus
tgagagtctcaaggctacatgtgag

SEQ ID NO: 371801 - DNA, 25 bp, Mus musculus
tgagagtgagaacaggtcctatgag

SEQ ID NO: 371802 - DNA, 25 bp, Mus musculus
tgagagtgagaagcatttcttcact

SEQ ID NO: 371803 - DNA, 25 bp, Mus musculus
tgagagtgagagaggcatgaaagtc

SEQ ID NO: 371804 - DNA, 25 bp, Mus musculus
tgagagtgagagcaagagatacttc

SEQ ID NO: 371805 - DNA, 25 bp, Mus musculus
tgagagtggcaggaagaagtcccag

SEQ ID NO: 371806 - DNA, 25 bp, Mus musculus
tgagagttaagggcacagagaactg

SEQ ID NO: 371807 - DNA, 25 bp, Mus musculus
tgagagttataccaaattcttctgg

SEQ ID NO: 371808 - DNA, 25 bp, Mus musculus
tgagagttataccaaattgaaaaga

SEQ ID NO: 371809 - DNA, 25 bp, Mus musculus
tgagagttgtgaggagatcccccaa

SEQ ID NO: 371810 - DNA, 25 bp, Mus musculus
tgagataatccaccatgactggtgg

SEQ ID NO: 371811 - DNA, 25 bp, Mus musculus
tgagatacaagcgggctttgctgct

SEQ ID NO: 371812 - DNA, 25 bp, Mus musculus
tgagatacaaggaaagaaaggagag

SEQ ID NO: 371813 - DNA, 25 bp, Mus musculus
tgagatacaagggtcaatatagacc

SEQ ID NO: 371814 - DNA, 25 bp, Mus musculus
tgagatacaaggtgtagtggctggc

SEQ ID NO: 371815 - DNA, 25 bp, Mus musculus
tgagatacagattgctaataatcac

SEQ ID NO: 371816 - DNA, 25 bp, Mus musculus
tgagatagaaagaaaggcccaggct

SEQ ID NO: 371817 - DNA, 25 bp, Mus musculus
tgagatatttaaagctgcaggcaca

SEQ ID NO: 371818 - DNA, 25 bp, Mus musculus
tgagatatttagaaggttctactta

SEQ ID NO: 371819 - DNA, 25 bp, Mus musculus
tgagatatttgtggtagtgtgaagc

SEQ ID NO: 371820 - DNA, 25 bp, Mus musculus
tgagatcaacccctagtggtgacca

SEQ ID NO: 371821 - DNA, 25 bp, Mus musculus
tgagatcaacctgccactgtccatg

SEQ ID NO: 371822 - DNA, 25 bp, Mus musculus
tgagatcacaggggacctcagcccg

SEQ ID NO: 371823 - DNA, 25 bp, Mus musculus
tgagatcagctaattaagaacctag

SEQ ID NO: 371824 - DNA, 25 bp, Mus musculus
tgagatcatggagatgctccaagct

SEQ ID NO: 371825 - DNA, 25 bp, Mus musculus
tgagatcattaggaaacaggtctca

SEQ ID NO: 371826 - DNA, 25 bp, Mus musculus
tgagatcattaggtctcagccacta

SEQ ID NO: 371827 - DNA, 25 bp, Mus musculus
tgagatccagctgtaggagactttg

SEQ ID NO: 371828 - DNA, 25 bp, Mus musculus
tgagatcccagcccccgaaactctg

SEQ ID NO: 371829 - DNA, 25 bp, Mus musculus
tgagatcccagctgagaaagcgctg

SEQ ID NO: 371830 - DNA, 25 bp, Mus musculus
tgagatccggaggatccaaggactg

SEQ ID NO: 371831 - DNA, 25 bp, Mus musculus
tgagatcgacaggaagcccgcaatg

SEQ ID NO: 371832 - DNA, 25 bp, Mus musculus
tgagatctcagtccaagaaagctgt

SEQ ID NO: 371833 - DNA, 25 bp, Mus musculus
tgagatctcagtgctgatctgggac

SEQ ID NO: 371834 - DNA, 25 bp, Mus musculus
tgagatctcccaggctgtgacctct

SEQ ID NO: 371835 - DNA, 25 bp, Mus musculus
tgagatctgtgaggaaggtctacga

SEQ ID NO: 371836 - DNA, 25 bp, Mus musculus
tgagatcttaaaggttgccaggatg

SEQ ID NO: 371837 - DNA, 25 bp, Mus musculus
tgagatcttaccaagattctaaggt

SEQ ID NO: 371838 - DNA, 25 bp, Mus musculus
tgagatcttcgatttcaacagcttt

SEQ ID NO: 371839 - DNA, 25 bp, Mus musculus
tgagatcttggaaatagcagacacc

SEQ ID NO: 371840 - DNA, 25 bp, Mus musculus
tgagatgaatagcccagccaagcgg

SEQ ID NO: 371841 - DNA, 25 bp, Mus musculus
tgagatgacagcagaagtccataac

SEQ ID NO: 371842 - DNA, 25 bp, Mus musculus
tgagatgacagcagccttcaagggt

SEQ ID NO: 371843 - DNA, 25 bp, Mus musculus
tgagatgacttcagatggaggctgg

SEQ ID NO: 371844 - DNA, 25 bp, Mus musculus
tgagatggaaaagcaaaaggtggcg

SEQ ID NO: 371845 - DNA, 25 bp, Mus musculus
tgagatggaaaaggtggcgcgttac

SEQ ID NO: 371846 - DNA, 25 bp, Mus musculus
tgagatggaagctgccactgactgt

SEQ ID NO: 371847 - DNA, 25 bp, Mus musculus
tgagatggacaggcagcgggcaggc

SEQ ID NO: 371848 - DNA, 25 bp, Mus musculus
tgagatggagaggtgaggctgctgg

SEQ ID NO: 371849 - DNA, 25 bp, Mus musculus
tgagatggagtctctagccaagagt

SEQ ID NO: 371850 - DNA, 25 bp, Mus musculus
tgagatgggaaggaaaaagtgtgag

SEQ ID NO: 371851 - DNA, 25 bp, Mus musculus
tgagatgggaagggaaaatgaacaa

SEQ ID NO: 371852 - DNA, 25 bp, Mus musculus
tgagatggtgcaggacatgggggcc

SEQ ID NO: 371853 - DNA, 25 bp, Mus musculus
tgagatgtgtatagcgagatctttg

SEQ ID NO: 371854 - DNA, 25 bp, Mus musculus
tgagatgtttgttggattcagtcct

SEQ ID NO: 371855 - DNA, 25 bp, Mus musculus
tgagattaaagacagctgcagcacg

SEQ ID NO: 371856 - DNA, 25 bp, Mus musculus
tgagattaaagcattggataccctg

SEQ ID NO: 371857 - DNA, 25 bp, Mus musculus
tgagattaaaggacaaccctccata

SEQ ID NO: 371858 - DNA, 25 bp, Mus musculus
tgagattaaaggcctctggggacct

SEQ ID NO: 371859 - DNA, 25 bp, Mus musculus
tgagattaagaaatgtgaccttcat

SEQ ID NO: 371860 - DNA, 25 bp, Mus musculus
tgagattaaggaagcctgctgcgtg

SEQ ID NO: 371861 - DNA, 25 bp, Mus musculus
tgagattacagaatcgtatggaagc

SEQ ID NO: 371862 - DNA, 25 bp, Mus musculus
tgagattacagagaaaacagaggcc

SEQ ID NO: 371863 - DNA, 25 bp, Mus musculus
tgagattacagaggcctcattcaca

SEQ ID NO: 371864 - DNA, 25 bp, Mus musculus
tgagattacaggaatggaagaaagc

SEQ ID NO: 371865 - DNA, 25 bp, Mus musculus
tgagattacagggacagtgatcatt

SEQ ID NO: 371866 - DNA, 25 bp, Mus musculus
tgagattacaggtgtggttgaatct

SEQ ID NO: 371867 - DNA, 25 bp, Mus musculus
tgagattacgccaggtggtgccaca

SEQ ID NO: 371868 - DNA, 25 bp, Mus musculus
tgagattactggagtgctgacagag

SEQ ID NO: 371869 - DNA, 25 bp, Mus musculus
tgagattcagaaactgtacggacat

SEQ ID NO: 371870 - DNA, 25 bp, Mus musculus
tgagattccaggtggcagacatgga

SEQ ID NO: 371871 - DNA, 25 bp, Mus musculus
tgagattcctgagatgaccacaggg

SEQ ID NO: 371872 - DNA, 25 bp, Mus musculus
tgagattctgaccaagtgttgtaca

SEQ ID NO: 371873 - DNA, 25 bp, Mus musculus
tgagattctgacccatgcttctctg

SEQ ID NO: 371874 - DNA, 25 bp, Mus musculus
tgagattctggtcattcgaaagggg

SEQ ID NO: 371875 - DNA, 25 bp, Mus musculus
tgagattgaagaaaccgggctccat

SEQ ID NO: 371876 - DNA, 25 bp, Mus musculus
tgagattgatgatgaatatgaagga

SEQ ID NO: 371877 - DNA, 25 bp, Mus musculus
tgagattgccaggcccgacgactct

SEQ ID NO: 371878 - DNA, 25 bp, Mus musculus
tgagattggcgtttcagtgaacaac

SEQ ID NO: 371879 - DNA, 25 bp, Mus musculus
tgagattgggaaggtggccttagta

SEQ ID NO: 371880 - DNA, 25 bp, Mus musculus
tgagatttttgtggacagcacatgg

SEQ ID NO: 371881 - DNA, 25 bp, Mus musculus
tgagcaaaagctggtgcaacacgtg

SEQ ID NO: 371882 - DNA, 25 bp, Mus musculus
tgagcaaacagctgcccgggaggag

SEQ ID NO: 371883 - DNA, 25 bp, Mus musculus
tgagcaaagaggtgcaagatctctt

SEQ ID NO: 371884 - DNA, 25 bp, Mus musculus
tgagcaaattcagatataaaaagat

SEQ ID NO: 371885 - DNA, 25 bp, Mus musculus
tgagcaaattcagctaataattttc

SEQ ID NO: 371886 - DNA, 25 bp, Mus musculus
tgagcaactagggttacagggaaac

SEQ ID NO: 371887 - DNA, 25 bp, Mus musculus
tgagcaactagtctaaatgttcaga

SEQ ID NO: 371888 - DNA, 25 bp, Mus musculus
tgagcaacttgtcttcactctgcct

SEQ ID NO: 371889 - DNA, 25 bp, Mus musculus
tgagcaagaccatgactggccaaaa

SEQ ID NO: 371890 - DNA, 25 bp, Mus musculus
tgagcaagaggaagcttttcttcta

SEQ ID NO: 371891 - DNA, 25 bp, Mus musculus
tgagcaagcggcccttgattgtgat

SEQ ID NO: 371892 - DNA, 25 bp, Mus musculus
tgagcaagcggcttgttatgctgcc

SEQ ID NO: 371893 - DNA, 25 bp, Mus musculus
tgagcaaggaggacttcgtggagat

SEQ ID NO: 371894 - DNA, 25 bp, Mus musculus
tgagcaaggagtggctccgcgggcc

SEQ ID NO: 371895 - DNA, 25 bp, Mus musculus
tgagcaaggcgaacaactcgatcgt

SEQ ID NO: 371896 - DNA, 25 bp, Mus musculus
tgagcaaggcgaacaactggaacgc

SEQ ID NO: 371897 - DNA, 25 bp, Mus musculus
tgagcaaggtaagctctgaggatga

SEQ ID NO: 371898 - DNA, 25 bp, Mus musculus
tgagcaataagagcggtctcacccc

SEQ ID NO: 371899 - DNA, 25 bp, Mus musculus
tgagcaatctgtaaagaaaacgtgc

SEQ ID NO: 371900 - DNA, 25 bp, Mus musculus
tgagcaattgcgagctctgcaggag

SEQ ID NO: 371901 - DNA, 25 bp, Mus musculus
tgagcacaagactgacctaggtggc

SEQ ID NO: 371902 - DNA, 25 bp, Mus musculus
tgagcacaagagctgcgaggagaag

SEQ ID NO: 371903 - DNA, 25 bp, Mus musculus
tgagcacaatcaagtctaaactaga

SEQ ID NO: 371904 - DNA, 25 bp, Mus musculus
tgagcacaatcagagctattctcaa

SEQ ID NO: 371905 - DNA, 25 bp, Mus musculus
tgagcacaatcaggtggaaacttca

SEQ ID NO: 371906 - DNA, 25 bp, Mus musculus
tgagcacaatcaggtggccaatagg

SEQ ID NO: 371907 - DNA, 25 bp, Mus musculus
tgagcacaatcaggtgggagaaaaa

SEQ ID NO: 371908 - DNA, 25 bp, Mus musculus
tgagcacactggccatgaacgtcct

SEQ ID NO: 371909 - DNA, 25 bp, Mus musculus
tgagcacagccatcttgcttcctca

SEQ ID NO: 371910 - DNA, 25 bp, Mus musculus
tgagcacatccgtctcaggtgaaaa

SEQ ID NO: 371911 - DNA, 25 bp, Mus musculus
tgagcaccaagcagccttctctccg

SEQ ID NO: 371912 - DNA, 25 bp, Mus musculus
tgagcaccagggcttccagctggcc

SEQ ID NO: 371913 - DNA, 25 bp, Mus musculus
tgagcaccccacgatggtacctcac

SEQ ID NO: 371914 - DNA, 25 bp, Mus musculus
tgagcaccccacggacagacagctg

SEQ ID NO: 371915 - DNA, 25 bp, Mus musculus
tgagcacggtgcctgtggcctaagg

SEQ ID NO: 371916 - DNA, 25 bp, Mus musculus
tgagcacggtgttcctgtagttgct

SEQ ID NO: 371917 - DNA, 25 bp, Mus musculus
tgagcactccttctggagatccttt

SEQ ID NO: 371918 - DNA, 25 bp, Mus musculus
tgagcactctagttctgacagtatc

SEQ ID NO: 371919 - DNA, 25 bp, Mus musculus
tgagcactcttgtccctttaaaaaa

SEQ ID NO: 371920 - DNA, 25 bp, Mus musculus
tgagcactggaggagttgtaatggc

SEQ ID NO: 371921 - DNA, 25 bp, Mus musculus
tgagcactggccctctctggggggt

SEQ ID NO: 371922 - DNA, 25 bp, Mus musculus
tgagcacttcacaagaaattaccat

SEQ ID NO: 371923 - DNA, 25 bp, Mus musculus
tgagcacttccacagatctgcagac

SEQ ID NO: 371924 - DNA, 25 bp, Mus musculus
tgagcagaaagatcagtatgcattc

SEQ ID NO: 371925 - DNA, 25 bp, Mus musculus
tgagcagaaaggacaaagcccagtt

SEQ ID NO: 371926 - DNA, 25 bp, Mus musculus
tgagcagaacctcaggttctccctg

SEQ ID NO: 371927 - DNA, 25 bp, Mus musculus
tgagcagaagaaaccttgttccccc

SEQ ID NO: 371928 - DNA, 25 bp, Mus musculus
tgagcagaagggccttcttgaagta

SEQ ID NO: 371929 - DNA, 25 bp, Mus musculus
tgagcagaagtcagaaattacactt

SEQ ID NO: 371930 - DNA, 25 bp, Mus musculus
tgagcagaagtggttcccagtggga

SEQ ID NO: 371931 - DNA, 25 bp, Mus musculus
tgagcagagctgaagaaggttatga

SEQ ID NO: 371932 - DNA, 25 bp, Mus musculus
tgagcagcaatggtaaatatgtgtg

SEQ ID NO: 371933 - DNA, 25 bp, Mus musculus
tgagcagcacagattctaactcaga

SEQ ID NO: 371934 - DNA, 25 bp, Mus musculus
tgagcagcactgcggagagccagct

SEQ ID NO: 371935 - DNA, 25 bp, Mus musculus
tgagcagcactgcggagttgagagc

SEQ ID NO: 371936 - DNA, 25 bp, Mus musculus
tgagcagcagcaaaaagatggaacc

SEQ ID NO: 371937 - DNA, 25 bp, Mus musculus
tgagcagccgggcaggtttgccaag

SEQ ID NO: 371938 - DNA, 25 bp, Mus musculus
tgagcagctcctgacaaacgtcctg

SEQ ID NO: 371939 - DNA, 25 bp, Mus musculus
tgagcagctctgcagtatgctgacc

SEQ ID NO: 371940 - DNA, 25 bp, Mus musculus
tgagcagctctgtgctgtattttca

SEQ ID NO: 371941 - DNA, 25 bp, Mus musculus
tgagcagctctgtggtttgggctca

SEQ ID NO: 371942 - DNA, 25 bp, Mus musculus
tgagcaggaattccgggtcagctgc

SEQ ID NO: 371943 - DNA, 25 bp, Mus musculus
tgagcaggaccaagctggcaagcgc

SEQ ID NO: 371944 - DNA, 25 bp, Mus musculus
tgagcaggaccaaggatcagacaag

SEQ ID NO: 371945 - DNA, 25 bp, Mus musculus
tgagcaggagaagagtatcgatgat

SEQ ID NO: 371946 - DNA, 25 bp, Mus musculus
tgagcaggagaatctggagaagcag

SEQ ID NO: 371947 - DNA, 25 bp, Mus musculus
tgagcaggaggagctgagcaagcgt

SEQ ID NO: 371948 - DNA, 25 bp, Mus musculus
tgagcaggaggatgagtctgaggat

SEQ ID NO: 371949 - DNA, 25 bp, Mus musculus
tgagcagggagatggcggtaaatga

SEQ ID NO: 371950 - DNA, 25 bp, Mus musculus
tgagcagggcaatgttctgtcttcc

SEQ ID NO: 371951 - DNA, 25 bp, Mus musculus
tgagcagggcgaaggagcagggcgc

SEQ ID NO: 371952 - DNA, 25 bp, Mus musculus
tgagcagggctgtggcctggagatg

SEQ ID NO: 371953 - DNA, 25 bp, Mus musculus
tgagcagtccgcaggtctttggcca

SEQ ID NO: 371954 - DNA, 25 bp, Mus musculus
tgagcagttggtaagtggagaaaga

SEQ ID NO: 371955 - DNA, 25 bp, Mus musculus
tgagcatcagcgggcaaatcattta

SEQ ID NO: 371956 - DNA, 25 bp, Mus musculus
tgagcatccagggtgagtgtccatg

SEQ ID NO: 371957 - DNA, 25 bp, Mus musculus
tgagcatccagtgtatccagagtgt

SEQ ID NO: 371958 - DNA, 25 bp, Mus musculus
tgagcatcccgactttaagctcgac

SEQ ID NO: 371959 - DNA, 25 bp, Mus musculus
tgagcatcctctaccacacccgtga

SEQ ID NO: 371960 - DNA, 25 bp, Mus musculus
tgagcatccttgcagctggccagct

SEQ ID NO: 371961 - DNA, 25 bp, Mus musculus
tgagcatgagcttttatgggagccc

SEQ ID NO: 371962 - DNA, 25 bp, Mus musculus
tgagcatgaggtctcagacagccca

SEQ ID NO: 371963 - DNA, 25 bp, Mus musculus
tgagcatgaggttgtctattacact

SEQ ID NO: 371964 - DNA, 25 bp, Mus musculus
tgagcatgagttggatatacaaccg

SEQ ID NO: 371965 - DNA, 25 bp, Mus musculus
tgagcatgcacaggaaaagttattg

SEQ ID NO: 371966 - DNA, 25 bp, Mus musculus
tgagcatgcaggctctgctctgacc

SEQ ID NO: 371967 - DNA, 25 bp, Mus musculus
tgagcatgctttcatgagcatgttt

SEQ ID NO: 371968 - DNA, 25 bp, Mus musculus
tgagcatgtaagctctggcttctcc

SEQ ID NO: 371969 - DNA, 25 bp, Mus musculus
tgagcattacctggttcataagcca

SEQ ID NO: 371970 - DNA, 25 bp, Mus musculus
tgagcattgctgagcagatgggccg

SEQ ID NO: 371971 - DNA, 25 bp, Mus musculus
tgagcattgctgcggtgacagaggc

SEQ ID NO: 371972 - DNA, 25 bp, Mus musculus
tgagcattgctgtctctgaaaaatg

SEQ ID NO: 371973 - DNA, 25 bp, Mus musculus
tgagcattggcgtcccccatccacc

SEQ ID NO: 371974 - DNA, 25 bp, Mus musculus
tgagcatttcaatacgcgctaccct

SEQ ID NO: 371975 - DNA, 25 bp, Mus musculus
tgagcatttcacagctattgtccag

SEQ ID NO: 371976 - DNA, 25 bp, Mus musculus
tgagccaacatggtcgtgaaaatac

SEQ ID NO: 371977 - DNA, 25 bp, Mus musculus
tgagccaaggacaggctgagggtat

SEQ ID NO: 371978 - DNA, 25 bp, Mus musculus
tgagccaccagagagctgtgcctga

SEQ ID NO: 371979 - DNA, 25 bp, Mus musculus
tgagccaccaggagaggaaacgagg

SEQ ID NO: 371980 - DNA, 25 bp, Mus musculus
tgagccaccgacaaggtacaaccac

SEQ ID NO: 371981 - DNA, 25 bp, Mus musculus
tgagccacctaaggtgacaaaagaa

SEQ ID NO: 371982 - DNA, 25 bp, Mus musculus
tgagccaccttgtgtgtggaatgtc

SEQ ID NO: 371983 - DNA, 25 bp, Mus musculus
tgagccactgccagcgttccatgtt

SEQ ID NO: 371984 - DNA, 25 bp, Mus musculus
tgagccaggacgacctggcgagaat

SEQ ID NO: 371985 - DNA, 25 bp, Mus musculus
tgagccaggagaatggtccgtctcc

SEQ ID NO: 371986 - DNA, 25 bp, Mus musculus
tgagccaggcatctatgttctgcgg

SEQ ID NO: 371987 - DNA, 25 bp, Mus musculus
tgagccagtccccctactgtgacag

SEQ ID NO: 371988 - DNA, 25 bp, Mus musculus
tgagccagtcccgcatccttcagaa

SEQ ID NO: 371989 - DNA, 25 bp, Mus musculus
tgagccatctgggaaagatgtggac

SEQ ID NO: 371990 - DNA, 25 bp, Mus musculus
tgagccatctgggaagatgtctgca

SEQ ID NO: 371991 - DNA, 25 bp, Mus musculus
tgagccatttagaaggtgtgccgat

SEQ ID NO: 371992 - DNA, 25 bp, Mus musculus
tgagcccaaagcacccatgctggac

SEQ ID NO: 371993 - DNA, 25 bp, Mus musculus
tgagcccacagcaacctcaagccca

SEQ ID NO: 371994 - DNA, 25 bp, Mus musculus
tgagcccacagccttctcatcattc

SEQ ID NO: 371995 - DNA, 25 bp, Mus musculus
tgagcccagaggcagactcacctca

SEQ ID NO: 371996 - DNA, 25 bp, Mus musculus
tgagcccagcaccgatcggtcagca

SEQ ID NO: 371997 - DNA, 25 bp, Mus musculus
tgagcccagcagcgtaaacgacccc

SEQ ID NO: 371998 - DNA, 25 bp, Mus musculus
tgagcccatgagtggaaacaagttg

SEQ ID NO: 371999 - DNA, 25 bp, Mus musculus
tgagcccatggttccaggatggctt

SEQ ID NO: 372000 - DNA, 25 bp, Mus musculus
tgagccccagaccacctcatcctcc

SEQ ID NO: 372001 - DNA, 25 bp, Mus musculus
tgagccccaggtctgtctccgtgcc

SEQ ID NO: 372002 - DNA, 25 bp, Mus musculus
tgagcccccgcaggataaggaagcc

SEQ ID NO: 372003 - DNA, 25 bp, Mus musculus
tgagcccccgcaggtgcgcttgaga

SEQ ID NO: 372004 - DNA, 25 bp, Mus musculus
tgagccccgatcttggtcattgcct

SEQ ID NO: 372005 - DNA, 25 bp, Mus musculus
tgagccccgggaaggaaaagcgcaa

SEQ ID NO: 372006 - DNA, 25 bp, Mus musculus
tgagcccgagaggagccacagaccc

SEQ ID NO: 372007 - DNA, 25 bp, Mus musculus
tgagcccgagaggcccatctgaaca

SEQ ID NO: 372008 - DNA, 25 bp, Mus musculus
tgagcccgagagtttccaaggagtc

SEQ ID NO: 372009 - DNA, 25 bp, Mus musculus
tgagccctgaagattttctgcattt

SEQ ID NO: 372010 - DNA, 25 bp, Mus musculus
tgagccctgcgccaaaacgacaccc

SEQ ID NO: 372011 - DNA, 25 bp, Mus musculus
tgagccctttcttgcatttagtaaa

SEQ ID NO: 372012 - DNA, 25 bp, Mus musculus
tgagccgaaaccatgcatgggcgcc

SEQ ID NO: 372013 - DNA, 25 bp, Mus musculus
tgagccgacccaggtctgtgcagac

SEQ ID NO: 372014 - DNA, 25 bp, Mus musculus
tgagccgagagaagagccctgggga

SEQ ID NO: 372015 - DNA, 25 bp, Mus musculus
tgagccgagctcagccaaccccacc

SEQ ID NO: 372016 - DNA, 25 bp, Mus musculus
tgagccgcagaagtatgaggcttgg

SEQ ID NO: 372017 - DNA, 25 bp, Mus musculus
tgagccgcattaaggacagccttct

SEQ ID NO: 372018 - DNA, 25 bp, Mus musculus
tgagccgcggaggacgtggcctggg

SEQ ID NO: 372019 - DNA, 25 bp, Mus musculus
tgagccggaggttccaggatggctt

SEQ ID NO: 372020 - DNA, 25 bp, Mus musculus
tgagccggggaaaggtgctctccca

SEQ ID NO: 372021 - DNA, 25 bp, Mus musculus
tgagccggggaaaggtgtctaagga

SEQ ID NO: 372022 - DNA, 25 bp, Mus musculus
tgagcctagtactgccaaccccacg

SEQ ID NO: 372023 - DNA, 25 bp, Mus musculus
tgagcctagtactggaggagagtta

SEQ ID NO: 372024 - DNA, 25 bp, Mus musculus
tgagcctcactggtgggtgtgcaaa

SEQ ID NO: 372025 - DNA, 25 bp, Mus musculus
tgagcctcaggactcagagaggctg

SEQ ID NO: 372026 - DNA, 25 bp, Mus musculus
tgagcctcagggccccttaggccaa

SEQ ID NO: 372027 - DNA, 25 bp, Mus musculus
tgagcctcagtacctggtactggtc

SEQ ID NO: 372028 - DNA, 25 bp, Mus musculus
tgagcctccagtgttgagtggagac

SEQ ID NO: 372029 - DNA, 25 bp, Mus musculus
tgagcctcccgagcaccatcaatca

SEQ ID NO: 372030 - DNA, 25 bp, Mus musculus
tgagcctccggccaggcgagcagac

SEQ ID NO: 372031 - DNA, 25 bp, Mus musculus
tgagcctcttaaggtcattttcttg

SEQ ID NO: 372032 - DNA, 25 bp, Mus musculus
tgagcctgaagaaaaagttaaactg

SEQ ID NO: 372033 - DNA, 25 bp, Mus musculus
tgagcctgaagtggtgttcaacatt

SEQ ID NO: 372034 - DNA, 25 bp, Mus musculus
tgagcctggccagggagaggagatc

SEQ ID NO: 372035 - DNA, 25 bp, Mus musculus
tgagcctgggccaagatgaaagctt

SEQ ID NO: 372036 - DNA, 25 bp, Mus musculus
tgagcctggggaacaaaaactgcac

SEQ ID NO: 372037 - DNA, 25 bp, Mus musculus
tgagcctgggtcactgttctgggag

SEQ ID NO: 372038 - DNA, 25 bp, Mus musculus
tgagcctggtcaggcagtccctcga

SEQ ID NO: 372039 - DNA, 25 bp, Mus musculus
tgagcctggtcaggtgaaagcagcc

SEQ ID NO: 372040 - DNA, 25 bp, Mus musculus
tgagccttccaaacagaacctttcc

SEQ ID NO: 372041 - DNA, 25 bp, Mus musculus
tgagccttccaaacagtttcaaaga

SEQ ID NO: 372042 - DNA, 25 bp, Mus musculus
tgagccttcgcgaggtggtggctga

SEQ ID NO: 372043 - DNA, 25 bp, Mus musculus
tgagccttgagatggcgttgacgtt

SEQ ID NO: 372044 - DNA, 25 bp, Mus musculus
tgagccttgcgtgccctcccagtcc

SEQ ID NO: 372045 - DNA, 25 bp, Mus musculus
tgagccttgctcaggagtatcccgg

SEQ ID NO: 372046 - DNA, 25 bp, Mus musculus
tgagccttgctcaggtttcccttcc

SEQ ID NO: 372047 - DNA, 25 bp, Mus musculus
tgagcctttttcaagaccaacagca

SEQ ID NO: 372048 - DNA, 25 bp, Mus musculus
tgagcgaaagactttactggaaaga

SEQ ID NO: 372049 - DNA, 25 bp, Mus musculus
tgagcgaccagagatgtggctttgg

SEQ ID NO: 372050 - DNA, 25 bp, Mus musculus
tgagcgaccaggacaggattccatg

SEQ ID NO: 372051 - DNA, 25 bp, Mus musculus
tgagcgacgtggaggaggtattcac

SEQ ID NO: 372052 - DNA, 25 bp, Mus musculus
tgagcgactgaggcaattaaaaacc

SEQ ID NO: 372053 - DNA, 25 bp, Mus musculus
tgagcgactgaggtctgccgacggg

SEQ ID NO: 372054 - DNA, 25 bp, Mus musculus
tgagcgactgcatcgtcaacgtgtg

SEQ ID NO: 372055 - DNA, 25 bp, Mus musculus
tgagcgactggtctgtgagtttcac

SEQ ID NO: 372056 - DNA, 25 bp, Mus musculus
tgagcgagagagggaactggaggag

SEQ ID NO: 372057 - DNA, 25 bp, Mus musculus
tgagcgaggcgagcgtgcacagtgc

SEQ ID NO: 372058 - DNA, 25 bp, Mus musculus
tgagcgaggcgaggcaccatgacaa

SEQ ID NO: 372059 - DNA, 25 bp, Mus musculus
tgagcgaggtgtgactgcaaagtgg

SEQ ID NO: 372060 - DNA, 25 bp, Mus musculus
tgagcgagttcaagaacctggacat

SEQ ID NO: 372061 - DNA, 25 bp, Mus musculus
tgagcgagttcaagctgatcatggc

SEQ ID NO: 372062 - DNA, 25 bp, Mus musculus
tgagcgagttcaagggcagagaaca

SEQ ID NO: 372063 - DNA, 25 bp, Mus musculus
tgagcgcaaggtaatagaacttcct

SEQ ID NO: 372064 - DNA, 25 bp, Mus musculus
tgagcgcaggctgtactacgagggc

SEQ ID NO: 372065 - DNA, 25 bp, Mus musculus
tgagcgcagtgggagatttgaaaaa

SEQ ID NO: 372066 - DNA, 25 bp, Mus musculus
tgagcgcattgaggaaagcgggact

SEQ ID NO: 372067 - DNA, 25 bp, Mus musculus
tgagcgccagagtacagtcgctttg

SEQ ID NO: 372068 - DNA, 25 bp, Mus musculus
tgagcgctctgcgaccagctcccaa

SEQ ID NO: 372069 - DNA, 25 bp, Mus musculus
tgagcggactggcttttatgaaaca

SEQ ID NO: 372070 - DNA, 25 bp, Mus musculus
tgagcggagttgagattcccaccct

SEQ ID NO: 372071 - DNA, 25 bp, Mus musculus
tgagcggatatgaccaagttttaca

SEQ ID NO: 372072 - DNA, 25 bp, Mus musculus
tgagcggatatggtagccaaggagc

SEQ ID NO: 372073 - DNA, 25 bp, Mus musculus
tgagcggcaggttgggtcggaactg

SEQ ID NO: 372074 - DNA, 25 bp, Mus musculus
tgagcggccggaagatggcagactt

SEQ ID NO: 372075 - DNA, 25 bp, Mus musculus
tgagcggccggaaggagtggaatgt

SEQ ID NO: 372076 - DNA, 25 bp, Mus musculus
tgagcggccggaagtgttactgtga

SEQ ID NO: 372077 - DNA, 25 bp, Mus musculus
tgagcggcctgagatccagagacaa

SEQ ID NO: 372078 - DNA, 25 bp, Mus musculus
tgagcggcggaagggttaccctcga

SEQ ID NO: 372079 - DNA, 25 bp, Mus musculus
tgagcgggagaaggctctgtccaac

SEQ ID NO: 372080 - DNA, 25 bp, Mus musculus
tgagcggggctcacgagaatcatca

SEQ ID NO: 372081 - DNA, 25 bp, Mus musculus
tgagcggggctcacgtttcagatga

SEQ ID NO: 372082 - DNA, 25 bp, Mus musculus
tgagcggggctgtggatctttccag

SEQ ID NO: 372083 - DNA, 25 bp, Mus musculus
tgagcgggggtgagttgtcagtggg

SEQ ID NO: 372084 - DNA, 25 bp, Mus musculus
tgagcggtaggagggaactgagccg

SEQ ID NO: 372085 - DNA, 25 bp, Mus musculus
tgagcggtgaagcggagccctgcag

SEQ ID NO: 372086 - DNA, 25 bp, Mus musculus
tgagcggtgaagcgggtcgccctcc

SEQ ID NO: 372087 - DNA, 25 bp, Mus musculus
tgagcggtgagcgacatgtccttcc

SEQ ID NO: 372088 - DNA, 25 bp, Mus musculus
tgagcggtgagcgacgggccgcatt

SEQ ID NO: 372089 - DNA, 25 bp, Mus musculus
tgagcgtaaaaatgagtgaaaaaga

SEQ ID NO: 372090 - DNA, 25 bp, Mus musculus
tgagcgtaaaaatggaaatgcttga

SEQ ID NO: 372091 - DNA, 25 bp, Mus musculus
tgagcgtcctctcgagacatgaaaa

SEQ ID NO: 372092 - DNA, 25 bp, Mus musculus
tgagcgtcctctcggaggtaacagc

SEQ ID NO: 372093 - DNA, 25 bp, Mus musculus
tgagcgtctgcaaagataaaagctt

SEQ ID NO: 372094 - DNA, 25 bp, Mus musculus
tgagcgtggagaaaaagcagcgatg

SEQ ID NO: 372095 - DNA, 25 bp, Mus musculus
tgagcgtggcggacctcatccgcat

SEQ ID NO: 372096 - DNA, 25 bp, Mus musculus
tgagcgtgttggggacaaagagaaa

SEQ ID NO: 372097 - DNA, 25 bp, Mus musculus
tgagcgttactgccgatgcaatgcc

SEQ ID NO: 372098 - DNA, 25 bp, Mus musculus
tgagctaatacgagggagaagacac

SEQ ID NO: 372099 - DNA, 25 bp, Mus musculus
tgagctacaggaatggagagtggca

SEQ ID NO: 372100 - DNA, 25 bp, Mus musculus
tgagctaccgggacaagagtgaagc

SEQ ID NO: 372101 - DNA, 25 bp, Mus musculus
tgagctactcaggcctgcctacttt

SEQ ID NO: 372102 - DNA, 25 bp, Mus musculus
tgagctactcaggtcaaggctttga

SEQ ID NO: 372103 - DNA, 25 bp, Mus musculus
tgagctacttcccacccctgcctgc

SEQ ID NO: 372104 - DNA, 25 bp, Mus musculus
tgagctacttgaaaagtaaagaaca

SEQ ID NO: 372105 - DNA, 25 bp, Mus musculus
tgagctatcttgcagttcatggcat

SEQ ID NO: 372106 - DNA, 25 bp, Mus musculus
tgagctatgctgcaggaaatgacct

SEQ ID NO: 372107 - DNA, 25 bp, Mus musculus
tgagctcaagaaaccacagtgcaaa

SEQ ID NO: 372108 - DNA, 25 bp, Mus musculus
tgagctcaagactgaagtgtcctgg

SEQ ID NO: 372109 - DNA, 25 bp, Mus musculus
tgagctcaagcccccggaagcctct

SEQ ID NO: 372110 - DNA, 25 bp, Mus musculus
tgagctcaagcgtttagcctggttc

SEQ ID NO: 372111 - DNA, 25 bp, Mus musculus
tgagctcaagggtttagcctggttc

SEQ ID NO: 372112 - DNA, 25 bp, Mus musculus
tgagctcaagtctgaagtgtcctgg

SEQ ID NO: 372113 - DNA, 25 bp, Mus musculus
tgagctcaatatggatcaaaattag

SEQ ID NO: 372114 - DNA, 25 bp, Mus musculus
tgagctcacatgaaaccaaagatga

SEQ ID NO: 372115 - DNA, 25 bp, Mus musculus
tgagctcaccaagctactccattcc

SEQ ID NO: 372116 - DNA, 25 bp, Mus musculus
tgagctcagaccagatggccaagct

SEQ ID NO: 372117 - DNA, 25 bp, Mus musculus
tgagctcagccacaggggcattagg

SEQ ID NO: 372118 - DNA, 25 bp, Mus musculus
tgagctcagtcctagtactgatgtc

SEQ ID NO: 372119 - DNA, 25 bp, Mus musculus
tgagctcagtcctagtaggagagat

SEQ ID NO: 372120 - DNA, 25 bp, Mus musculus
tgagctcatacagagtccaggctgt

SEQ ID NO: 372121 - DNA, 25 bp, Mus musculus
tgagctcatacagtctcaacagatc

SEQ ID NO: 372122 - DNA, 25 bp, Mus musculus
tgagctcatccaaggaggcgagtac

SEQ ID NO: 372123 - DNA, 25 bp, Mus musculus
tgagctcatccaagtcctaccagga

SEQ ID NO: 372124 - DNA, 25 bp, Mus musculus
tgagctcatcctagcaggtatgcca

SEQ ID NO: 372125 - DNA, 25 bp, Mus musculus
tgagctcatggagagagcagtagag

SEQ ID NO: 372126 - DNA, 25 bp, Mus musculus
tgagctcatggagcttgagatcttc

SEQ ID NO: 372127 - DNA, 25 bp, Mus musculus
tgagctccaagaatggcgggcatat

SEQ ID NO: 372128 - DNA, 25 bp, Mus musculus
tgagctccaagagctgttagctgat

SEQ ID NO: 372129 - DNA, 25 bp, Mus musculus
tgagctccaaggatgctctggagga

SEQ ID NO: 372130 - DNA, 25 bp, Mus musculus
tgagctccagcacgatggagaatag

SEQ ID NO: 372131 - DNA, 25 bp, Mus musculus
tgagctccaggtaagtgctggccat

SEQ ID NO: 372132 - DNA, 25 bp, Mus musculus
tgagctcccaaggtggatgaagact

SEQ ID NO: 372133 - DNA, 25 bp, Mus musculus
tgagctctcagaaggcaaatgtgcc

SEQ ID NO: 372134 - DNA, 25 bp, Mus musculus
tgagctctcagaaggccaagttcga

SEQ ID NO: 372135 - DNA, 25 bp, Mus musculus
tgagctctgcaggggactccttttc

SEQ ID NO: 372136 - DNA, 25 bp, Mus musculus
tgagctctgggatcagtttgacaac

SEQ ID NO: 372137 - DNA, 25 bp, Mus musculus
tgagctctgtgaaaggtaaccccag

SEQ ID NO: 372138 - DNA, 25 bp, Mus musculus
tgagctcttccaacacttcgacaaa

SEQ ID NO: 372139 - DNA, 25 bp, Mus musculus
tgagctgaactgagctgagctgggt

SEQ ID NO: 372140 - DNA, 25 bp, Mus musculus
tgagctgaagatcctagactttggc

SEQ ID NO: 372141 - DNA, 25 bp, Mus musculus
tgagctgaaggacgagggccttggg

SEQ ID NO: 372142 - DNA, 25 bp, Mus musculus
tgagctgagaggcaaacccgtggca

SEQ ID NO: 372143 - DNA, 25 bp, Mus musculus
tgagctgagctggagagtcagtcct

SEQ ID NO: 372144 - DNA, 25 bp, Mus musculus
tgagctgagctggcaactattgatg

SEQ ID NO: 372145 - DNA, 25 bp, Mus musculus
tgagctgagctgggagagtcagtcc

SEQ ID NO: 372146 - DNA, 25 bp, Mus musculus
tgagctgcaagataagcagacagct

SEQ ID NO: 372147 - DNA, 25 bp, Mus musculus
tgagctgcaaggaactcattataca

SEQ ID NO: 372148 - DNA, 25 bp, Mus musculus
tgagctgcagaatgctggccttgca

SEQ ID NO: 372149 - DNA, 25 bp, Mus musculus
tgagctgcagaatggtaatacacag

SEQ ID NO: 372150 - DNA, 25 bp, Mus musculus
tgagctgccgactagaagttatttt

SEQ ID NO: 372151 - DNA, 25 bp, Mus musculus
tgagctgccgactatactgaagcag

SEQ ID NO: 372152 - DNA, 25 bp, Mus musculus
tgagctgccgactcctgatagagga

SEQ ID NO: 372153 - DNA, 25 bp, Mus musculus
tgagctgccgacttaaccgtgtgga

SEQ ID NO: 372154 - DNA, 25 bp, Mus musculus
tgagctgcctgagcttcatgccctc

SEQ ID NO: 372155 - DNA, 25 bp, Mus musculus
tgagctgccttttgacatcccagag

SEQ ID NO: 372156 - DNA, 25 bp, Mus musculus
tgagctgcgaggggtcctgagaagc

SEQ ID NO: 372157 - DNA, 25 bp, Mus musculus
tgagctgctatacgaaggggctcct

SEQ ID NO: 372158 - DNA, 25 bp, Mus musculus
tgagctgctccaggagcctgaagct

SEQ ID NO: 372159 - DNA, 25 bp, Mus musculus
tgagctggaagatttcatcctgatg

SEQ ID NO: 372160 - DNA, 25 bp, Mus musculus
tgagctggacgagaactacaatatg

SEQ ID NO: 372161 - DNA, 25 bp, Mus musculus
tgagctggacgggacctcattcctc

SEQ ID NO: 372162 - DNA, 25 bp, Mus musculus
tgagctggaggcccctggcgaaggg

SEQ ID NO: 372163 - DNA, 25 bp, Mus musculus
tgagctggcaccagctgaggatggt

SEQ ID NO: 372164 - DNA, 25 bp, Mus musculus
tgagctggcagagtcccgttgccga

SEQ ID NO: 372165 - DNA, 25 bp, Mus musculus
tgagctggcagagtctaagtgttct

SEQ ID NO: 372166 - DNA, 25 bp, Mus musculus
tgagctggccactgtggtcaaagca

SEQ ID NO: 372167 - DNA, 25 bp, Mus musculus
tgagctggccactgtgtttacttat

SEQ ID NO: 372168 - DNA, 25 bp, Mus musculus
tgagctggctgggtttgactctgct

SEQ ID NO: 372169 - DNA, 25 bp, Mus musculus
tgagctggctggtgctggcatgaac

SEQ ID NO: 372170 - DNA, 25 bp, Mus musculus
tgagctggtgtcactgcagatgaga

SEQ ID NO: 372171 - DNA, 25 bp, Mus musculus
tgagctgtgaggcgcagcaagcaca

SEQ ID NO: 372172 - DNA, 25 bp, Mus musculus
tgagctgttacaggtactgcgaatg

SEQ ID NO: 372173 - DNA, 25 bp, Mus musculus
tgagctgttacagtttttcagctgc

SEQ ID NO: 372174 - DNA, 25 bp, Mus musculus
tgagctgttcagaatgaattagcct

SEQ ID NO: 372175 - DNA, 25 bp, Mus musculus
tgagctgttcagacggtgcgcagtg

SEQ ID NO: 372176 - DNA, 25 bp, Mus musculus
tgagctgttcagagacagatggggc

SEQ ID NO: 372177 - DNA, 25 bp, Mus musculus
tgagcttaatgctttaatgactgat

SEQ ID NO: 372178 - DNA, 25 bp, Mus musculus
tgagcttaatgtttgttaacgcgcc

SEQ ID NO: 372179 - DNA, 25 bp, Mus musculus
tgagcttactggccgcagcaagaac

SEQ ID NO: 372180 - DNA, 25 bp, Mus musculus
tgagcttactggcctttcaggcagc

SEQ ID NO: 372181 - DNA, 25 bp, Mus musculus
tgagcttcaggaaaaacataaacaa

SEQ ID NO: 372182 - DNA, 25 bp, Mus musculus
tgagcttcaggttcatggacactta

SEQ ID NO: 372183 - DNA, 25 bp, Mus musculus
tgagcttccgagcaggggaagagtt

SEQ ID NO: 372184 - DNA, 25 bp, Mus musculus
tgagcttcctcttcagcagccgctc

SEQ ID NO: 372185 - DNA, 25 bp, Mus musculus
tgagcttcctcttcgttattttaac

SEQ ID NO: 372186 - DNA, 25 bp, Mus musculus
tgagcttctgtgaagtcaccttaat

SEQ ID NO: 372187 - DNA, 25 bp, Mus musculus
tgagcttgagcagcatcagaaaagt

SEQ ID NO: 372188 - DNA, 25 bp, Mus musculus
tgagcttgagcagctgagtcccttc

SEQ ID NO: 372189 - DNA, 25 bp, Mus musculus
tgagcttgcaggcatctagtcttgc

SEQ ID NO: 372190 - DNA, 25 bp, Mus musculus
tgagcttgccctggtcaggcagcag

SEQ ID NO: 372191 - DNA, 25 bp, Mus musculus
tgagcttgctaagctacaagaagac

SEQ ID NO: 372192 - DNA, 25 bp, Mus musculus
tgagcttgctaaggtggaagaagaa

SEQ ID NO: 372193 - DNA, 25 bp, Mus musculus
tgagcttggagcagctgggaacact

SEQ ID NO: 372194 - DNA, 25 bp, Mus musculus
tgagcttggcagactgtataacaaa

SEQ ID NO: 372195 - DNA, 25 bp, Mus musculus
tgagctttcccgagacagcctgcca

SEQ ID NO: 372196 - DNA, 25 bp, Mus musculus
tgagctttcggagcattttctgcag

SEQ ID NO: 372197 - DNA, 25 bp, Mus musculus
tgagctttggagctgttggttttga

SEQ ID NO: 372198 - DNA, 25 bp, Mus musculus
tgagctttgtcaagaacctacatgg

SEQ ID NO: 372199 - DNA, 25 bp, Mus musculus
tgagctttgtcaagggctggggagc

SEQ ID NO: 372200 - DNA, 25 bp, Mus musculus
tgaggaaacaggccgaggaagatgc

SEQ ID NO: 372201 - DNA, 25 bp, Mus musculus
tgaggaaacaggggaacacctctac

SEQ ID NO: 372202 - DNA, 25 bp, Mus musculus
tgaggaaacccagtcgcatagggca

SEQ ID NO: 372203 - DNA, 25 bp, Mus musculus
tgaggaaagacatgatactgtcagc

SEQ ID NO: 372204 - DNA, 25 bp, Mus musculus
tgaggaaagaggaagaagtcgtcac

SEQ ID NO: 372205 - DNA, 25 bp, Mus musculus
tgaggaaagcacagagaccagctat

SEQ ID NO: 372206 - DNA, 25 bp, Mus musculus
tgaggaaagcacagggaagctggga

SEQ ID NO: 372207 - DNA, 25 bp, Mus musculus
tgaggaaagcgaatctccccgaggt

SEQ ID NO: 372208 - DNA, 25 bp, Mus musculus
tgaggaacaaactggttattaaata

SEQ ID NO: 372209 - DNA, 25 bp, Mus musculus
tgaggaacaagattcgagagcaaaa

SEQ ID NO: 372210 - DNA, 25 bp, Mus musculus
tgaggaacagaaaatgttaacaagc

SEQ ID NO: 372211 - DNA, 25 bp, Mus musculus
tgaggaacagatcctggagagaaac

SEQ ID NO: 372212 - DNA, 25 bp, Mus musculus
tgaggaacatgccggagttctctgg

SEQ ID NO: 372213 - DNA, 25 bp, Mus musculus
tgaggaacatgtaacaggtccactg

SEQ ID NO: 372214 - DNA, 25 bp, Mus musculus
tgaggaaccactgaactggcattat

SEQ ID NO: 372215 - DNA, 25 bp, Mus musculus
tgaggaaccccggaagcacaaatac

SEQ ID NO: 372216 - DNA, 25 bp, Mus musculus
tgaggaactgattgacccttcccat

SEQ ID NO: 372217 - DNA, 25 bp, Mus musculus
tgaggaactgcctaaggagcctcaa

SEQ ID NO: 372218 - DNA, 25 bp, Mus musculus
tgaggaactgggaaagggagccttc

SEQ ID NO: 372219 - DNA, 25 bp, Mus musculus
tgaggaagactgaaccagctctcca

SEQ ID NO: 372220 - DNA, 25 bp, Mus musculus
tgaggaagagacactccagcaactg

SEQ ID NO: 372221 - DNA, 25 bp, Mus musculus
tgaggaagagcaatgtggactttgt

SEQ ID NO: 372222 - DNA, 25 bp, Mus musculus
tgaggaagagccggaatcggtggga

SEQ ID NO: 372223 - DNA, 25 bp, Mus musculus
tgaggaagaggaacacgcagcactg

SEQ ID NO: 372224 - DNA, 25 bp, Mus musculus
tgaggaagaggacttttggggaaca

SEQ ID NO: 372225 - DNA, 25 bp, Mus musculus
tgaggaagatctaagtacaccaaat

SEQ ID NO: 372226 - DNA, 25 bp, Mus musculus
tgaggaagcagatataaagacttga

SEQ ID NO: 372227 - DNA, 25 bp, Mus musculus
tgaggaagccgccactggagaatgc

SEQ ID NO: 372228 - DNA, 25 bp, Mus musculus
tgaggaagcctaaggatgatgctgt

SEQ ID NO: 372229 - DNA, 25 bp, Mus musculus
tgaggaagcttcagcgacagcagtc

SEQ ID NO: 372230 - DNA, 25 bp, Mus musculus
tgaggaaggcgaagatgagcgttcg

SEQ ID NO: 372231 - DNA, 25 bp, Mus musculus
tgaggaagtctgcactggaaccacc

SEQ ID NO: 372232 - DNA, 25 bp, Mus musculus
tgaggaagtctgcagtgccggtgcc

SEQ ID NO: 372233 - DNA, 25 bp, Mus musculus
tgaggaagttcgtggaagggtggct

SEQ ID NO: 372234 - DNA, 25 bp, Mus musculus
tgaggaatagacttttcactgagtt

SEQ ID NO: 372235 - DNA, 25 bp, Mus musculus
tgaggaatagccctggctttcctgg

SEQ ID NO: 372236 - DNA, 25 bp, Mus musculus
tgaggaatagcttctggaatttctg

SEQ ID NO: 372237 - DNA, 25 bp, Mus musculus
tgaggaataggtacctggcagcatg

SEQ ID NO: 372238 - DNA, 25 bp, Mus musculus
tgaggaatcagcttaccaacaaaac

SEQ ID NO: 372239 - DNA, 25 bp, Mus musculus
tgaggaatcagtattcgcctgggaa

SEQ ID NO: 372240 - DNA, 25 bp, Mus musculus
tgaggaatgctcgccaaaacaactt

SEQ ID NO: 372241 - DNA, 25 bp, Mus musculus
tgaggaatgctctctttggggtgtt

SEQ ID NO: 372242 - DNA, 25 bp, Mus musculus
tgaggaatgggaaaagtacgagatg

SEQ ID NO: 372243 - DNA, 25 bp, Mus musculus
tgaggaatgtgatggttctccagga

SEQ ID NO: 372244 - DNA, 25 bp, Mus musculus
tgaggaatgtgcccctgtcccttcc

SEQ ID NO: 372245 - DNA, 25 bp, Mus musculus
tgaggacaaaacaggaatggaagcc

SEQ ID NO: 372246 - DNA, 25 bp, Mus musculus
tgaggacaaaacagtgaccaagaag

SEQ ID NO: 372247 - DNA, 25 bp, Mus musculus
tgaggacaagagtgtggaaaatgct

SEQ ID NO: 372248 - DNA, 25 bp, Mus musculus
tgaggacacagagaagctcattgct

SEQ ID NO: 372249 - DNA, 25 bp, Mus musculus
tgaggacacgagttgcattgtagtg

SEQ ID NO: 372250 - DNA, 25 bp, Mus musculus
tgaggacagaagatacaatggagag

SEQ ID NO: 372251 - DNA, 25 bp, Mus musculus
tgaggacagcttgtcccaggtaaat

SEQ ID NO: 372252 - DNA, 25 bp, Mus musculus
tgaggacattaagagtggaaagctg

SEQ ID NO: 372253 - DNA, 25 bp, Mus musculus
tgaggacattaaggccacccgagac

SEQ ID NO: 372254 - DNA, 25 bp, Mus musculus
tgaggaccaaggtgagcctgtgact

SEQ ID NO: 372255 - DNA, 25 bp, Mus musculus
tgaggaccaggtggtagttaataaa

SEQ ID NO: 372256 - DNA, 25 bp, Mus musculus
tgaggaccccaaagtggttgatcgg

SEQ ID NO: 372257 - DNA, 25 bp, Mus musculus
tgaggacccggagctagaagcgatc

SEQ ID NO: 372258 - DNA, 25 bp, Mus musculus
tgaggaccgcgaagaggatgaacct

SEQ ID NO: 372259 - DNA, 25 bp, Mus musculus
tgaggaccgcgaaggtcatctaact

SEQ ID NO: 372260 - DNA, 25 bp, Mus musculus
tgaggaccgtgttcgtaagcagact

SEQ ID NO: 372261 - DNA, 25 bp, Mus musculus
tgaggaccttgcacgacctagtggt

SEQ ID NO: 372262 - DNA, 25 bp, Mus musculus
tgaggacgacccaggaagagaaaga

SEQ ID NO: 372263 - DNA, 25 bp, Mus musculus
tgaggacgacccaggcaaagggaat

SEQ ID NO: 372264 - DNA, 25 bp, Mus musculus
tgaggactatggcaggttcaccgga

SEQ ID NO: 372265 - DNA, 25 bp, Mus musculus
tgaggactcaaggtaagaaatccag

SEQ ID NO: 372266 - DNA, 25 bp, Mus musculus
tgaggactcaagtttcagagtgata

SEQ ID NO: 372267 - DNA, 25 bp, Mus musculus
tgaggactgatgggatggctctgag

SEQ ID NO: 372268 - DNA, 25 bp, Mus musculus
tgaggactgcgggccttcatcaagt

SEQ ID NO: 372269 - DNA, 25 bp, Mus musculus
tgaggactgggttgactgtgggttc

SEQ ID NO: 372270 - DNA, 25 bp, Mus musculus
tgaggactgtgagtgttcccaggag

SEQ ID NO: 372271 - DNA, 25 bp, Mus musculus
tgaggacttccacaagaaatttgcc

SEQ ID NO: 372272 - DNA, 25 bp, Mus musculus
tgaggacttctcagagtctgtccca

SEQ ID NO: 372273 - DNA, 25 bp, Mus musculus
tgaggactttgaggacaatggtgac

SEQ ID NO: 372274 - DNA, 25 bp, Mus musculus
tgaggactttgcaactgctgctgag

SEQ ID NO: 372275 - DNA, 25 bp, Mus musculus
tgaggagaaacaggcaagtgctctc

SEQ ID NO: 372276 - DNA, 25 bp, Mus musculus
tgaggagaagcaaaccaagagtttt

SEQ ID NO: 372277 - DNA, 25 bp, Mus musculus
tgaggagaagcctatgggaaggtgt

SEQ ID NO: 372278 - DNA, 25 bp, Mus musculus
tgaggagaagtgtgagaaactttac

SEQ ID NO: 372279 - DNA, 25 bp, Mus musculus
tgaggagaatgtcccagaaatcctg

SEQ ID NO: 372280 - DNA, 25 bp, Mus musculus
tgaggagagaagagaactatgagca

SEQ ID NO: 372281 - DNA, 25 bp, Mus musculus
tgaggagagacgtggagaaatgggg

SEQ ID NO: 372282 - DNA, 25 bp, Mus musculus
tgaggagagagaacctggtccacgt

SEQ ID NO: 372283 - DNA, 25 bp, Mus musculus
tgaggagagagtgttccagaaggaa

SEQ ID NO: 372284 - DNA, 25 bp, Mus musculus
tgaggagagatcagtgttgaagatg

SEQ ID NO: 372285 - DNA, 25 bp, Mus musculus
tgaggagagggaactagttccctag

SEQ ID NO: 372286 - DNA, 25 bp, Mus musculus
tgaggagagtgaggaagaagacgat

SEQ ID NO: 372287 - DNA, 25 bp, Mus musculus
tgaggagatcaagaggatagatagg

SEQ ID NO: 372288 - DNA, 25 bp, Mus musculus
tgaggagatcaaggacttgcaccag

SEQ ID NO: 372289 - DNA, 25 bp, Mus musculus
tgaggagcaacacagggactattcc

SEQ ID NO: 372290 - DNA, 25 bp, Mus musculus
tgaggagcagttcctgaatgccacg

SEQ ID NO: 372291 - DNA, 25 bp, Mus musculus
tgaggagccggtccagattatctct

SEQ ID NO: 372292 - DNA, 25 bp, Mus musculus
tgaggagctgaggagagaacattga

SEQ ID NO: 372293 - DNA, 25 bp, Mus musculus
tgaggagctgagtgataacattcag

SEQ ID NO: 372294 - DNA, 25 bp, Mus musculus
tgaggagctgagtgattttgaggaa

SEQ ID NO: 372295 - DNA, 25 bp, Mus musculus
tgaggagctgccagaaaagcctttg

SEQ ID NO: 372296 - DNA, 25 bp, Mus musculus
tgaggagctggaggttgcgagaaca

SEQ ID NO: 372297 - DNA, 25 bp, Mus musculus
tgaggaggaagaaatggtccttctc

SEQ ID NO: 372298 - DNA, 25 bp, Mus musculus
tgaggaggaagagttaacactcacg

SEQ ID NO: 372299 - DNA, 25 bp, Mus musculus
tgaggaggaagtttacagtagcatg

SEQ ID NO: 372300 - DNA, 25 bp, Mus musculus
tgaggaggatgaggatggtgggcat

SEQ ID NO: 372301 - DNA, 25 bp, Mus musculus
tgaggaggatgaggattttgattgg

SEQ ID NO: 372302 - DNA, 25 bp, Mus musculus
tgaggaggatttgagttttaagcta

SEQ ID NO: 372303 - DNA, 25 bp, Mus musculus
tgaggaggcagtaggacttagaaga

SEQ ID NO: 372304 - DNA, 25 bp, Mus musculus
tgaggaggcctcagattttacatgt

SEQ ID NO: 372305 - DNA, 25 bp, Mus musculus
tgaggaggcctcagttcctggcccc

SEQ ID NO: 372306 - DNA, 25 bp, Mus musculus
tgaggagggagctgaggttttatct

SEQ ID NO: 372307 - DNA, 25 bp, Mus musculus
tgaggagtaccaggagaccctgagc

SEQ ID NO: 372308 - DNA, 25 bp, Mus musculus
tgaggagtaccaggaggagctggag

SEQ ID NO: 372309 - DNA, 25 bp, Mus musculus
tgaggagtcccggcgtggagcgtta

SEQ ID NO: 372310 - DNA, 25 bp, Mus musculus
tgaggagtcccggctcatcactctt

SEQ ID NO: 372311 - DNA, 25 bp, Mus musculus
tgaggagtcggagatggcagccaca

SEQ ID NO: 372312 - DNA, 25 bp, Mus musculus
tgaggataaagaatgacagcccata

SEQ ID NO: 372313 - DNA, 25 bp, Mus musculus
tgaggatacagcaacttctaaggac

SEQ ID NO: 372314 - DNA, 25 bp, Mus musculus
tgaggatacggttcggtcaccactc

SEQ ID NO: 372315 - DNA, 25 bp, Mus musculus
tgaggatagccaggtcaaagcccag

SEQ ID NO: 372316 - DNA, 25 bp, Mus musculus
tgaggatagggttgtcgatgagtta

SEQ ID NO: 372317 - DNA, 25 bp, Mus musculus
tgaggatcaggttggtacacgatgt

SEQ ID NO: 372318 - DNA, 25 bp, Mus musculus
tgaggatcccgagggcatcagatcc

SEQ ID NO: 372319 - DNA, 25 bp, Mus musculus
tgaggatcccgggcgtgattgagtt

SEQ ID NO: 372320 - DNA, 25 bp, Mus musculus
tgaggatctggaagctcaagtgaca

SEQ ID NO: 372321 - DNA, 25 bp, Mus musculus
tgaggatcttcgggtatttggctcc

SEQ ID NO: 372322 - DNA, 25 bp, Mus musculus
tgaggatgaagatgatgaggaagag

SEQ ID NO: 372323 - DNA, 25 bp, Mus musculus
tgaggatgaaggacggtggcgcctc

SEQ ID NO: 372324 - DNA, 25 bp, Mus musculus
tgaggatgaaggactttacctcgct

SEQ ID NO: 372325 - DNA, 25 bp, Mus musculus
tgaggatgacactggaccccccttt

SEQ ID NO: 372326 - DNA, 25 bp, Mus musculus
tgaggatgacatccgtggacagctg

SEQ ID NO: 372327 - DNA, 25 bp, Mus musculus
tgaggatgactacagcattacaccc

SEQ ID NO: 372328 - DNA, 25 bp, Mus musculus
tgaggatgccagagcacagggcact

SEQ ID NO: 372329 - DNA, 25 bp, Mus musculus
tgaggatgccaggagctccggccca

SEQ ID NO: 372330 - DNA, 25 bp, Mus musculus
tgaggatggcagggtatttatgagc

SEQ ID NO: 372331 - DNA, 25 bp, Mus musculus
tgaggatggccagtggaagaaacac

SEQ ID NO: 372332 - DNA, 25 bp, Mus musculus
tgaggatggggacgaaagcatccac

SEQ ID NO: 372333 - DNA, 25 bp, Mus musculus
tgaggattattccagtacttccagg

SEQ ID NO: 372334 - DNA, 25 bp, Mus musculus
tgaggattcgaaagaatagactttt

SEQ ID NO: 372335 - DNA, 25 bp, Mus musculus
tgaggattcggacttctagatctgt

SEQ ID NO: 372336 - DNA, 25 bp, Mus musculus
tgaggattctgacatcctgcagagc

SEQ ID NO: 372337 - DNA, 25 bp, Mus musculus
tgaggattctgacattgatggcgag

SEQ ID NO: 372338 - DNA, 25 bp, Mus musculus
tgaggatttgggatttagaattccc

SEQ ID NO: 372339 - DNA, 25 bp, Mus musculus
tgaggattttaaagtggacatccca

SEQ ID NO: 372340 - DNA, 25 bp, Mus musculus
tgaggattttccatctttaaatcct

SEQ ID NO: 372341 - DNA, 25 bp, Mus musculus
tgaggcaaaagcagaaccgggatgg

SEQ ID NO: 372342 - DNA, 25 bp, Mus musculus
tgaggcaaactcttcctaagaaacc

SEQ ID NO: 372343 - DNA, 25 bp, Mus musculus
tgaggcaaagaacctagccagctat

SEQ ID NO: 372344 - DNA, 25 bp, Mus musculus
tgaggcaaagctagacaagttggat

SEQ ID NO: 372345 - DNA, 25 bp, Mus musculus
tgaggcacaaggagcaagacccaaa

SEQ ID NO: 372346 - DNA, 25 bp, Mus musculus
tgaggcacgagcaagagtactgttt

SEQ ID NO: 372347 - DNA, 25 bp, Mus musculus
tgaggcagaagctccaagatgaaac

SEQ ID NO: 372348 - DNA, 25 bp, Mus musculus
tgaggcagaagtgctgtgtggtctc

SEQ ID NO: 372349 - DNA, 25 bp, Mus musculus
tgaggcagaagttgacccaccttcc

SEQ ID NO: 372350 - DNA, 25 bp, Mus musculus
tgaggcagaatgctatcaaaagccc

SEQ ID NO: 372351 - DNA, 25 bp, Mus musculus
tgaggcagaggtcccgtcaggaagc

SEQ ID NO: 372352 - DNA, 25 bp, Mus musculus
tgaggcagcgggagctggaacagca

SEQ ID NO: 372353 - DNA, 25 bp, Mus musculus
tgaggcagcgggagggagctgaatc

SEQ ID NO: 372354 - DNA, 25 bp, Mus musculus
tgaggcaggaaggttcgttctccca

SEQ ID NO: 372355 - DNA, 25 bp, Mus musculus
tgaggcaggacggattctgatgcaa

SEQ ID NO: 372356 - DNA, 25 bp, Mus musculus
tgaggcaggacggctgctgtgaagg

SEQ ID NO: 372357 - DNA, 25 bp, Mus musculus
tgaggcaggtgcaagctggccattc

SEQ ID NO: 372358 - DNA, 25 bp, Mus musculus
tgaggcatcaaaacaaatggcctcc

SEQ ID NO: 372359 - DNA, 25 bp, Mus musculus
tgaggcatcagatgcttataccatc

SEQ ID NO: 372360 - DNA, 25 bp, Mus musculus
tgaggccaaacagctcaggcctgca

SEQ ID NO: 372361 - DNA, 25 bp, Mus musculus
tgaggccaagcacgataaatacatg

SEQ ID NO: 372362 - DNA, 25 bp, Mus musculus
tgaggccaagcacgtggacgagaaa

SEQ ID NO: 372363 - DNA, 25 bp, Mus musculus
tgaggccacagtgtgtcagaaatca

SEQ ID NO: 372364 - DNA, 25 bp, Mus musculus
tgaggccatgagagtcctcgttgaa

SEQ ID NO: 372365 - DNA, 25 bp, Mus musculus
tgaggccccagggcaactgggtgag

SEQ ID NO: 372366 - DNA, 25 bp, Mus musculus
tgaggccccccagccaggatgatgt

SEQ ID NO: 372367 - DNA, 25 bp, Mus musculus
tgaggcccgagaaactgaaggagcc

SEQ ID NO: 372368 - DNA, 25 bp, Mus musculus
tgaggcccgccaggaattgtggagg

SEQ ID NO: 372369 - DNA, 25 bp, Mus musculus
tgaggcccgccaggatatgaattgg

SEQ ID NO: 372370 - DNA, 25 bp, Mus musculus
tgaggccctaatgacattatgccct

SEQ ID NO: 372371 - DNA, 25 bp, Mus musculus
tgaggccctcaagtctcacatcatg

SEQ ID NO: 372372 - DNA, 25 bp, Mus musculus
tgaggccctgggcaggctgctggtt

SEQ ID NO: 372373 - DNA, 25 bp, Mus musculus
tgaggccgcagggttgcagaaactg

SEQ ID NO: 372374 - DNA, 25 bp, Mus musculus
tgaggccgccatgggtattaagagc

SEQ ID NO: 372375 - DNA, 25 bp, Mus musculus
tgaggccggcccgaggcccggtcgg

SEQ ID NO: 372376 - DNA, 25 bp, Mus musculus
tgaggccggcgtcctccgccccctt

SEQ ID NO: 372377 - DNA, 25 bp, Mus musculus
tgaggccgtgaagagtgagccggtg

SEQ ID NO: 372378 - DNA, 25 bp, Mus musculus
tgaggcctggcaggtcctgaaacac

SEQ ID NO: 372379 - DNA, 25 bp, Mus musculus
tgaggcctggcaggtgcccttctcc

SEQ ID NO: 372380 - DNA, 25 bp, Mus musculus
tgaggccttgcaagcaaggtgcaga

SEQ ID NO: 372381 - DNA, 25 bp, Mus musculus
tgaggccttgcaagctatgtctgag

SEQ ID NO: 372382 - DNA, 25 bp, Mus musculus
tgaggccttgcaaggggagagttag

SEQ ID NO: 372383 - DNA, 25 bp, Mus musculus
tgaggcgaaagagagccgggtcaaa

SEQ ID NO: 372384 - DNA, 25 bp, Mus musculus
tgaggcgaaggaaagctcacaacag

SEQ ID NO: 372385 - DNA, 25 bp, Mus musculus
tgaggcgagaggtgaaagagctggt

SEQ ID NO: 372386 - DNA, 25 bp, Mus musculus
tgaggcgagcagctggtggcccccg

SEQ ID NO: 372387 - DNA, 25 bp, Mus musculus
tgaggcgagcagctgtggcccctca

SEQ ID NO: 372388 - DNA, 25 bp, Mus musculus
tgaggcgcacagcggggactcgagg

SEQ ID NO: 372389 - DNA, 25 bp, Mus musculus
tgaggcgcacagcggtaaaatgtcg

SEQ ID NO: 372390 - DNA, 25 bp, Mus musculus
tgaggcgcccaaagtctcaggggcc

SEQ ID NO: 372391 - DNA, 25 bp, Mus musculus
tgaggcgcggcccagcactatggtg

SEQ ID NO: 372392 - DNA, 25 bp, Mus musculus
tgaggcgcttggagaatggcagcag

SEQ ID NO: 372393 - DNA, 25 bp, Mus musculus
tgaggcggacgcagaattcggcccc

SEQ ID NO: 372394 - DNA, 25 bp, Mus musculus
tgaggcggacgcaggtccgctacag

SEQ ID NO: 372395 - DNA, 25 bp, Mus musculus
tgaggcggagaccagaaccccagct

SEQ ID NO: 372396 - DNA, 25 bp, Mus musculus
tgaggcggcagctgcagcagcctca

SEQ ID NO: 372397 - DNA, 25 bp, Mus musculus
tgaggcggctctagggcgtcccggg

SEQ ID NO: 372398 - DNA, 25 bp, Mus musculus
tgaggcggctctagggggccagagt

SEQ ID NO: 372399 - DNA, 25 bp, Mus musculus
tgaggctagattgagatgagcagct

SEQ ID NO: 372400 - DNA, 25 bp, Mus musculus
tgaggctcagaaaggatgtcaaagt

SEQ ID NO: 372401 - DNA, 25 bp, Mus musculus
tgaggctcaggagaccaccatcagc

SEQ ID NO: 372402 - DNA, 25 bp, Mus musculus
tgaggctcagtggagaccagaggag

SEQ ID NO: 372403 - DNA, 25 bp, Mus musculus
tgaggctccagtcctgccaacccat

SEQ ID NO: 372404 - DNA, 25 bp, Mus musculus
tgaggctgaaaaagcaatacgagga

SEQ ID NO: 372405 - DNA, 25 bp, Mus musculus
tgaggctgaagaggaagaagagctg

SEQ ID NO: 372406 - DNA, 25 bp, Mus musculus
tgaggctgacagacaagattgtaag

SEQ ID NO: 372407 - DNA, 25 bp, Mus musculus
tgaggctgatgaagccatcaaagga

SEQ ID NO: 372408 - DNA, 25 bp, Mus musculus
tgaggctgcaggtgccctacgttgg

SEQ ID NO: 372409 - DNA, 25 bp, Mus musculus
tgaggctgcgtgcagattaccttat

SEQ ID NO: 372410 - DNA, 25 bp, Mus musculus
tgaggctgctgcaggttgctgagaa

SEQ ID NO: 372411 - DNA, 25 bp, Mus musculus
tgaggctgctggaggtctctcctgg

SEQ ID NO: 372412 - DNA, 25 bp, Mus musculus
tgaggctgcttctttttaaagatga

SEQ ID NO: 372413 - DNA, 25 bp, Mus musculus
tgaggctgcttgggaaccaacagag

SEQ ID NO: 372414 - DNA, 25 bp, Mus musculus
tgaggctgggaggagtgggaggtgc

SEQ ID NO: 372415 - DNA, 25 bp, Mus musculus
tgaggctggtcttcttctacatctc

SEQ ID NO: 372416 - DNA, 25 bp, Mus musculus
tgaggcttacagatttgtgaaagaa

SEQ ID NO: 372417 - DNA, 25 bp, Mus musculus
tgaggcttacaggcggcagaagcct

SEQ ID NO: 372418 - DNA, 25 bp, Mus musculus
tgaggcttatcggaagaaatggaag

SEQ ID NO: 372419 - DNA, 25 bp, Mus musculus
tgaggcttccagatggtcggcagtg

SEQ ID NO: 372420 - DNA, 25 bp, Mus musculus
tgaggctttcaagctaactgatgat

SEQ ID NO: 372421 - DNA, 25 bp, Mus musculus
tgaggctttcgaggagaaaattcta

SEQ ID NO: 372422 - DNA, 25 bp, Mus musculus
tgaggctttggttttgttgagtttg

SEQ ID NO: 372423 - DNA, 25 bp, Mus musculus
tgagggaaagaaaaataccttgaga

SEQ ID NO: 372424 - DNA, 25 bp, Mus musculus
tgagggaaagagttcacatgagact

SEQ ID NO: 372425 - DNA, 25 bp, Mus musculus
tgagggaaagattgacggcggggct

SEQ ID NO: 372426 - DNA, 25 bp, Mus musculus
tgagggaagacaaggtgatgatgag

SEQ ID NO: 372427 - DNA, 25 bp, Mus musculus
tgagggaaggtccccaccctgcatg

SEQ ID NO: 372428 - DNA, 25 bp, Mus musculus
tgagggaccagacaaaaagtcccaa

SEQ ID NO: 372429 - DNA, 25 bp, Mus musculus
tgagggactacagtggacaaggcgt

SEQ ID NO: 372430 - DNA, 25 bp, Mus musculus
tgagggactgctaggaagggacaaa

SEQ ID NO: 372431 - DNA, 25 bp, Mus musculus
tgagggactgctaggcaaagaacgt

SEQ ID NO: 372432 - DNA, 25 bp, Mus musculus
tgagggagacagaggcattcaaggt

SEQ ID NO: 372433 - DNA, 25 bp, Mus musculus
tgagggagaggagggtctggtcagc

SEQ ID NO: 372434 - DNA, 25 bp, Mus musculus
tgagggaggagctttcatggatcgc

SEQ ID NO: 372435 - DNA, 25 bp, Mus musculus
tgagggaggagtgtgtgctgtcaga

SEQ ID NO: 372436 - DNA, 25 bp, Mus musculus
tgagggagggaccagtgacacagga

SEQ ID NO: 372437 - DNA, 25 bp, Mus musculus
tgagggatgctgactgtgcaccata

SEQ ID NO: 372438 - DNA, 25 bp, Mus musculus
tgagggatggcaggctcaaagactt

SEQ ID NO: 372439 - DNA, 25 bp, Mus musculus
tgagggcaagaaggctgcgaaaaga

SEQ ID NO: 372440 - DNA, 25 bp, Mus musculus
tgagggcaccaagcactgaaaactg

SEQ ID NO: 372441 - DNA, 25 bp, Mus musculus
tgagggcctcgagaatggctctgaa

SEQ ID NO: 372442 - DNA, 25 bp, Mus musculus
tgagggcggcagcgtgcctgaagac

SEQ ID NO: 372443 - DNA, 25 bp, Mus musculus
tgagggctcaagtcgcaatgtgtct

SEQ ID NO: 372444 - DNA, 25 bp, Mus musculus
tgagggctctagcttggacagcccc

SEQ ID NO: 372445 - DNA, 25 bp, Mus musculus
tgagggctctagtgtcactgctcag

SEQ ID NO: 372446 - DNA, 25 bp, Mus musculus
tgagggctgtggagacaaatgaatt

SEQ ID NO: 372447 - DNA, 25 bp, Mus musculus
tgagggctgtggaggaacgggattt

SEQ ID NO: 372448 - DNA, 25 bp, Mus musculus
tgagggctttccctgagaagcagct

SEQ ID NO: 372449 - DNA, 25 bp, Mus musculus
tgaggggaagagatgcaattcgaag

SEQ ID NO: 372450 - DNA, 25 bp, Mus musculus
tgaggggagacgtggtactcagttc

SEQ ID NO: 372451 - DNA, 25 bp, Mus musculus
tgaggggagcactggactccttcag

SEQ ID NO: 372452 - DNA, 25 bp, Mus musculus
tgaggggagcactggccctgctccc

SEQ ID NO: 372453 - DNA, 25 bp, Mus musculus
tgaggggagccagattatcacaaag

SEQ ID NO: 372454 - DNA, 25 bp, Mus musculus
tgaggggcggccaggtccagcacca

SEQ ID NO: 372455 - DNA, 25 bp, Mus musculus
tgaggggctgtcctgctaaggaaga

SEQ ID NO: 372456 - DNA, 25 bp, Mus musculus
tgagggggaggtccaacacaatcca

SEQ ID NO: 372457 - DNA, 25 bp, Mus musculus
tgagggggctctgaggttgaactgg

SEQ ID NO: 372458 - DNA, 25 bp, Mus musculus
tgagggggtccggatcaaaagcccc

SEQ ID NO: 372459 - DNA, 25 bp, Mus musculus
tgaggggtgcaagaactgccccatt

SEQ ID NO: 372460 - DNA, 25 bp, Mus musculus
tgaggggtgcaagggcttcttccgc

SEQ ID NO: 372461 - DNA, 25 bp, Mus musculus
tgagggtaagtatcagatggagatg

SEQ ID NO: 372462 - DNA, 25 bp, Mus musculus
tgagggtagcaggagctgcaaagtt

SEQ ID NO: 372463 - DNA, 25 bp, Mus musculus
tgagggtcatgacactgaacctgca

SEQ ID NO: 372464 - DNA, 25 bp, Mus musculus
tgagggtctctgagtggaggtgaag

SEQ ID NO: 372465 - DNA, 25 bp, Mus musculus
tgagggtgagtttgaaaccaggaaa

SEQ ID NO: 372466 - DNA, 25 bp, Mus musculus
tgagggtggaagggccagggaccag

SEQ ID NO: 372467 - DNA, 25 bp, Mus musculus
tgagggtgggattattagatttaga

SEQ ID NO: 372468 - DNA, 25 bp, Mus musculus
tgaggtacaaggtgaactgtggact

SEQ ID NO: 372469 - DNA, 25 bp, Mus musculus
tgaggtacacaggcgcaggtctgag

SEQ ID NO: 372470 - DNA, 25 bp, Mus musculus
tgaggtacaggtgtcggctctgtcc

SEQ ID NO: 372471 - DNA, 25 bp, Mus musculus
tgaggtactctcttggacctatatc

SEQ ID NO: 372472 - DNA, 25 bp, Mus musculus
tgaggtcaacggctggacctgttta

SEQ ID NO: 372473 - DNA, 25 bp, Mus musculus
tgaggtcaagagtgggccatgaact

SEQ ID NO: 372474 - DNA, 25 bp, Mus musculus
tgaggtcacgtaaacagagagtggc

SEQ ID NO: 372475 - DNA, 25 bp, Mus musculus
tgaggtccaagctcggacctcaggc

SEQ ID NO: 372476 - DNA, 25 bp, Mus musculus
tgaggtccagatgggctcctcagct

SEQ ID NO: 372477 - DNA, 25 bp, Mus musculus
tgaggtccaggaactgttaagacaa

SEQ ID NO: 372478 - DNA, 25 bp, Mus musculus
tgaggtccaggagatacttcaagcg

SEQ ID NO: 372479 - DNA, 25 bp, Mus musculus
tgaggtccaggtgacaataaatttg

SEQ ID NO: 372480 - DNA, 25 bp, Mus musculus
tgaggtcctcttggctcagctgaag

SEQ ID NO: 372481 - DNA, 25 bp, Mus musculus
tgaggtcctgggctcttctctcacg

SEQ ID NO: 372482 - DNA, 25 bp, Mus musculus
tgaggtcgtaaaaatgagcatctgt

SEQ ID NO: 372483 - DNA, 25 bp, Mus musculus
tgaggtcgtaaaaattgaaatctct

SEQ ID NO: 372484 - DNA, 25 bp, Mus musculus
tgaggtctcactgctaataaagaca

SEQ ID NO: 372485 - DNA, 25 bp, Mus musculus
tgaggtctcactggttggcgcatcc

SEQ ID NO: 372486 - DNA, 25 bp, Mus musculus
tgaggtcttgacagaggatctccct

SEQ ID NO: 372487 - DNA, 25 bp, Mus musculus
tgaggtgagctttgacgccgccacc

SEQ ID NO: 372488 - DNA, 25 bp, Mus musculus
tgaggtgcacggctgtgtttggatg

SEQ ID NO: 372489 - DNA, 25 bp, Mus musculus
tgaggtgcacgggtgacccagatat

SEQ ID NO: 372490 - DNA, 25 bp, Mus musculus
tgaggtgccagacgacctggaggaa

SEQ ID NO: 372491 - DNA, 25 bp, Mus musculus
tgaggtgccaggatgaacagcagta

SEQ ID NO: 372492 - DNA, 25 bp, Mus musculus
tgaggtgccaggctggacccatgag

SEQ ID NO: 372493 - DNA, 25 bp, Mus musculus
tgaggtgcgacaggtaaatttaaca

SEQ ID NO: 372494 - DNA, 25 bp, Mus musculus
tgaggtggagaaggccaaggggaat

SEQ ID NO: 372495 - DNA, 25 bp, Mus musculus
tgaggtggagaaggccgagtacaac

SEQ ID NO: 372496 - DNA, 25 bp, Mus musculus
tgaggtggagcagccctgttccctt

SEQ ID NO: 372497 - DNA, 25 bp, Mus musculus
tgaggtggagcaggtgaggggtcgg

SEQ ID NO: 372498 - DNA, 25 bp, Mus musculus
tgaggtggaggagatcctggtgctg

SEQ ID NO: 372499 - DNA, 25 bp, Mus musculus
tgaggtggaggagatgctgaccaac

SEQ ID NO: 372500 - DNA, 25 bp, Mus musculus
tgaggtggaggaggtggagtttgat

SEQ ID NO: 372501 - DNA, 25 bp, Mus musculus
tgaggtggatgtgtgggtgcaggtg

SEQ ID NO: 372502 - DNA, 25 bp, Mus musculus
tgaggtgggccaggtccacctccac

SEQ ID NO: 372503 - DNA, 25 bp, Mus musculus
tgaggtggtgcaggagatcccccaa

SEQ ID NO: 372504 - DNA, 25 bp, Mus musculus
tgaggtgtggtctcggattgggaaa

SEQ ID NO: 372505 - DNA, 25 bp, Mus musculus
tgaggtgtgttgaggtcattgcaaa

SEQ ID NO: 372506 - DNA, 25 bp, Mus musculus
tgaggttacaatccggaaccagcta

SEQ ID NO: 372507 - DNA, 25 bp, Mus musculus
tgaggttacaatccggtggcgtccc

SEQ ID NO: 372508 - DNA, 25 bp, Mus musculus
tgaggttcaaaaggatccagaagca

SEQ ID NO: 372509 - DNA, 25 bp, Mus musculus
tgaggttcaaaaggcacagtgacct

SEQ ID NO: 372510 - DNA, 25 bp, Mus musculus
tgaggttcagggcagctctcagggc

SEQ ID NO: 372511 - DNA, 25 bp, Mus musculus
tgaggttcctgatgatgatgaacca

SEQ ID NO: 372512 - DNA, 25 bp, Mus musculus
tgaggttcctgatggaaaaccaact

SEQ ID NO: 372513 - DNA, 25 bp, Mus musculus
tgaggttcctgatggtgttctccaa

SEQ ID NO: 372514 - DNA, 25 bp, Mus musculus
tgaggttgacatgagtaacatacaa

SEQ ID NO: 372515 - DNA, 25 bp, Mus musculus
tgaggttgagcaacattttgatggc

SEQ ID NO: 372516 - DNA, 25 bp, Mus musculus
tgaggttgagggaatagccagagcc

SEQ ID NO: 372517 - DNA, 25 bp, Mus musculus
tgaggttgaggtgtcctcaacaatg

SEQ ID NO: 372518 - DNA, 25 bp, Mus musculus
tgaggttggacccaggagccgggtg

SEQ ID NO: 372519 - DNA, 25 bp, Mus musculus
tgaggttggcaggccccctgcgcat

SEQ ID NO: 372520 - DNA, 25 bp, Mus musculus
tgaggtttcttctgatgaaagagaa

SEQ ID NO: 372521 - DNA, 25 bp, Mus musculus
tgaggttttgacaggactggaggac

SEQ ID NO: 372522 - DNA, 25 bp, Mus musculus
tgagtaaacaagaattcctcagaga

SEQ ID NO: 372523 - DNA, 25 bp, Mus musculus
tgagtaaacaagatctcgccctcct

SEQ ID NO: 372524 - DNA, 25 bp, Mus musculus
tgagtaaaggtgaacatcagtgaaa

SEQ ID NO: 372525 - DNA, 25 bp, Mus musculus
tgagtaaatatttgggcccagcaac

SEQ ID NO: 372526 - DNA, 25 bp, Mus musculus
tgagtaaatatttggtgctggtaac

SEQ ID NO: 372527 - DNA, 25 bp, Mus musculus
tgagtaaatgttagtgacagctaga

SEQ ID NO: 372528 - DNA, 25 bp, Mus musculus
tgagtaaattgtcagatactgctca

SEQ ID NO: 372529 - DNA, 25 bp, Mus musculus
tgagtaagccgagttctctagcctc

SEQ ID NO: 372530 - DNA, 25 bp, Mus musculus
tgagtaatgtcatggaattggggaa

SEQ ID NO: 372531 - DNA, 25 bp, Mus musculus
tgagtacaaagcatacgaggaaact

SEQ ID NO: 372532 - DNA, 25 bp, Mus musculus
tgagtacaaagtgaaggaggagggc

SEQ ID NO: 372533 - DNA, 25 bp, Mus musculus
tgagtacaaggttggaagtcggatt

SEQ ID NO: 372534 - DNA, 25 bp, Mus musculus
tgagtacaccacggacaaggagccc

SEQ ID NO: 372535 - DNA, 25 bp, Mus musculus
tgagtacaggtctgtaccacaacac

SEQ ID NO: 372536 - DNA, 25 bp, Mus musculus
tgagtaccacgcggacatctatgac

SEQ ID NO: 372537 - DNA, 25 bp, Mus musculus
tgagtaccacgcgggggaagggctc

SEQ ID NO: 372538 - DNA, 25 bp, Mus musculus
tgagtacctcagcaaatctgtcatc

SEQ ID NO: 372539 - DNA, 25 bp, Mus musculus
tgagtacctcagcttcaggaaaagc

SEQ ID NO: 372540 - DNA, 25 bp, Mus musculus
tgagtacctcaggaaatctgtcatc

SEQ ID NO: 372541 - DNA, 25 bp, Mus musculus
tgagtacctcaggttcaggaaaagc

SEQ ID NO: 372542 - DNA, 25 bp, Mus musculus
tgagtacgaggaggaaatctccaag

SEQ ID NO: 372543 - DNA, 25 bp, Mus musculus
tgagtacgccaggagtgagagagag

SEQ ID NO: 372544 - DNA, 25 bp, Mus musculus
tgagtactccacgttgcaggatctg

SEQ ID NO: 372545 - DNA, 25 bp, Mus musculus
tgagtactgcaagattggcaaagag

SEQ ID NO: 372546 - DNA, 25 bp, Mus musculus
tgagtagagagggtcctgagtgatg

SEQ ID NO: 372547 - DNA, 25 bp, Mus musculus
tgagtagcaacaaaacgctgccgtc

SEQ ID NO: 372548 - DNA, 25 bp, Mus musculus
tgagtagcaacaaagagcagcggtc

SEQ ID NO: 372549 - DNA, 25 bp, Mus musculus
tgagtagcaccaatgggcataggtg

SEQ ID NO: 372550 - DNA, 25 bp, Mus musculus
tgagtagcagtgagcgtcctgggag

SEQ ID NO: 372551 - DNA, 25 bp, Mus musculus
tgagtagcgaaagcaaatcagaaga

SEQ ID NO: 372552 - DNA, 25 bp, Mus musculus
tgagtagcttcataatcctcagccc

SEQ ID NO: 372553 - DNA, 25 bp, Mus musculus
tgagtagcttcatgctctctatctc

SEQ ID NO: 372554 - DNA, 25 bp, Mus musculus
tgagtaggcaaggaccccatgactc

SEQ ID NO: 372555 - DNA, 25 bp, Mus musculus
tgagtagtgggatgagagtcattca

SEQ ID NO: 372556 - DNA, 25 bp, Mus musculus
tgagtatagaggtgctccagaccag

SEQ ID NO: 372557 - DNA, 25 bp, Mus musculus
tgagtatatgggaagtactggagaa

SEQ ID NO: 372558 - DNA, 25 bp, Mus musculus
tgagtatatggggcagagcccgggc

SEQ ID NO: 372559 - DNA, 25 bp, Mus musculus
tgagtatccggacaattccatcaag

SEQ ID NO: 372560 - DNA, 25 bp, Mus musculus
tgagtatcttgagttgaactacagg

SEQ ID NO: 372561 - DNA, 25 bp, Mus musculus
tgagtatctttccaagagctggaga

SEQ ID NO: 372562 - DNA, 25 bp, Mus musculus
tgagtatgcaggtcctgatgaagtt

SEQ ID NO: 372563 - DNA, 25 bp, Mus musculus
tgagtatgtgctggaggatctggaa

SEQ ID NO: 372564 - DNA, 25 bp, Mus musculus
tgagtattgggaatattacagccaa

SEQ ID NO: 372565 - DNA, 25 bp, Mus musculus
tgagtatttgtggtgataatgagtc

SEQ ID NO: 372566 - DNA, 25 bp, Mus musculus
tgagtattttgatgttgccttcatc

SEQ ID NO: 372567 - DNA, 25 bp, Mus musculus
tgagtattttggtataggcagagtg

SEQ ID NO: 372568 - DNA, 25 bp, Mus musculus
tgagtcaaacgagtctcccattaga

SEQ ID NO: 372569 - DNA, 25 bp, Mus musculus
tgagtcaaacgccacatctacatcc

SEQ ID NO: 372570 - DNA, 25 bp, Mus musculus
tgagtcaaaggtcacatgctgctgc

SEQ ID NO: 372571 - DNA, 25 bp, Mus musculus
tgagtcaagagaatcggctatccat

SEQ ID NO: 372572 - DNA, 25 bp, Mus musculus
tgagtcaagagatcaggacttccca

SEQ ID NO: 372573 - DNA, 25 bp, Mus musculus
tgagtcaagagatgaagccacccca

SEQ ID NO: 372574 - DNA, 25 bp, Mus musculus
tgagtcactcaagagcctcatcccc

SEQ ID NO: 372575 - DNA, 25 bp, Mus musculus
tgagtcactcaaggaggctgttgtg

SEQ ID NO: 372576 - DNA, 25 bp, Mus musculus
tgagtcagaagcccatctcggtcac

SEQ ID NO: 372577 - DNA, 25 bp, Mus musculus
tgagtcagaaggtgttgcagcccat

SEQ ID NO: 372578 - DNA, 25 bp, Mus musculus
tgagtcagaggaggggtgaggggat

SEQ ID NO: 372579 - DNA, 25 bp, Mus musculus
tgagtcagaggatccacactggcct

SEQ ID NO: 372580 - DNA, 25 bp, Mus musculus
tgagtcagccccagcctggtaggga

SEQ ID NO: 372581 - DNA, 25 bp, Mus musculus
tgagtcatacagaggtaccttcctt

SEQ ID NO: 372582 - DNA, 25 bp, Mus musculus
tgagtcatacagaggttaaattaaa

SEQ ID NO: 372583 - DNA, 25 bp, Mus musculus
tgagtcatctaggctaaaggacaca

SEQ ID NO: 372584 - DNA, 25 bp, Mus musculus
tgagtcatggacggtttgaagatca

SEQ ID NO: 372585 - DNA, 25 bp, Mus musculus
tgagtcatggacgttcggggatgag

SEQ ID NO: 372586 - DNA, 25 bp, Mus musculus
tgagtccaaaggatcagactgaaca

SEQ ID NO: 372587 - DNA, 25 bp, Mus musculus
tgagtccaaagtttccattgggaag

SEQ ID NO: 372588 - DNA, 25 bp, Mus musculus
tgagtccaagaaatggcctccacct

SEQ ID NO: 372589 - DNA, 25 bp, Mus musculus
tgagtccaagtcagtttctgatgac

SEQ ID NO: 372590 - DNA, 25 bp, Mus musculus
tgagtccagaaagtcaacgcctcaa

SEQ ID NO: 372591 - DNA, 25 bp, Mus musculus
tgagtccaggtgcagctgctggacc

SEQ ID NO: 372592 - DNA, 25 bp, Mus musculus
tgagtccaggtgttttggttcatct

SEQ ID NO: 372593 - DNA, 25 bp, Mus musculus
tgagtcccaaaagaccatgtgaccc

SEQ ID NO: 372594 - DNA, 25 bp, Mus musculus
tgagtcccaaaggatgcatgctgtt

SEQ ID NO: 372595 - DNA, 25 bp, Mus musculus
tgagtcccaaagggtcttcagatta

SEQ ID NO: 372596 - DNA, 25 bp, Mus musculus
tgagtcccaaaggtgtcctgcaggt

SEQ ID NO: 372597 - DNA, 25 bp, Mus musculus
tgagtcccagaagaggacactacat

SEQ ID NO: 372598 - DNA, 25 bp, Mus musculus
tgagtcccaggtgtattccctggac

SEQ ID NO: 372599 - DNA, 25 bp, Mus musculus
tgagtccccagtcaggtagcctttc

SEQ ID NO: 372600 - DNA, 25 bp, Mus musculus
tgagtcccgaaatggggttggtgtc

SEQ ID NO: 372601 - DNA, 25 bp, Mus musculus
tgagtccctagaagcaagacgaccg

SEQ ID NO: 372602 - DNA, 25 bp, Mus musculus
tgagtcctcaaactcactctgcaga

SEQ ID NO: 372603 - DNA, 25 bp, Mus musculus
tgagtcctcaaagacaatgtgtcta

SEQ ID NO: 372604 - DNA, 25 bp, Mus musculus
tgagtcctccccttcaaagctgtgt

SEQ ID NO: 372605 - DNA, 25 bp, Mus musculus
tgagtcctgtgagacagtgtttctt

SEQ ID NO: 372606 - DNA, 25 bp, Mus musculus
tgagtcctgtgagagatggatgtcc

SEQ ID NO: 372607 - DNA, 25 bp, Mus musculus
tgagtccttaaaggtttatgggact

SEQ ID NO: 372608 - DNA, 25 bp, Mus musculus
tgagtcctttggcttcaccgctgat

SEQ ID NO: 372609 - DNA, 25 bp, Mus musculus
tgagtcgaaacattgtggatttcaa

SEQ ID NO: 372610 - DNA, 25 bp, Mus musculus
tgagtcgatgtgcctgagacgtaaa

SEQ ID NO: 372611 - DNA, 25 bp, Mus musculus
tgagtcgcctcagaaaatgtatctc

SEQ ID NO: 372612 - DNA, 25 bp, Mus musculus
tgagtcgcctcgagaaccctgcacc

SEQ ID NO: 372613 - DNA, 25 bp, Mus musculus
tgagtcgcctcgaggaagaaggcat

SEQ ID NO: 372614 - DNA, 25 bp, Mus musculus
tgagtcggcagggctctgagtcaga

SEQ ID NO: 372615 - DNA, 25 bp, Mus musculus
tgagtcggcagttgaaagtgggggt

SEQ ID NO: 372616 - DNA, 25 bp, Mus musculus
tgagtcgttgaagagagttgtggtt

SEQ ID NO: 372617 - DNA, 25 bp, Mus musculus
tgagtcgttgaaggtactagcaaga

SEQ ID NO: 372618 - DNA, 25 bp, Mus musculus
tgagtctaaagggaagcgattatag

SEQ ID NO: 372619 - DNA, 25 bp, Mus musculus
tgagtctacaggtttgtacagcgca

SEQ ID NO: 372620 - DNA, 25 bp, Mus musculus
tgagtctacccaaagtgatcaactt

SEQ ID NO: 372621 - DNA, 25 bp, Mus musculus
tgagtctcaagagccaaggacatga

SEQ ID NO: 372622 - DNA, 25 bp, Mus musculus
tgagtctcaggaacctgacagaact

SEQ ID NO: 372623 - DNA, 25 bp, Mus musculus
tgagtctcaggttccacgagtaccc

SEQ ID NO: 372624 - DNA, 25 bp, Mus musculus
tgagtctccacagattgacggcggg

SEQ ID NO: 372625 - DNA, 25 bp, Mus musculus
tgagtctcccagctccttcactcac

SEQ ID NO: 372626 - DNA, 25 bp, Mus musculus
tgagtctcccaggaagatctgctat

SEQ ID NO: 372627 - DNA, 25 bp, Mus musculus
tgagtctctcaagcgtcaagaactg

SEQ ID NO: 372628 - DNA, 25 bp, Mus musculus
tgagtctctgagtgaggagacccag

SEQ ID NO: 372629 - DNA, 25 bp, Mus musculus
tgagtctctgggcacggaggtgcca

SEQ ID NO: 372630 - DNA, 25 bp, Mus musculus
tgagtctgaagcaggaaggaacagc

SEQ ID NO: 372631 - DNA, 25 bp, Mus musculus
tgagtctgaagcaggatctgaagaa

SEQ ID NO: 372632 - DNA, 25 bp, Mus musculus
tgagtctgaagggattggagatagc

SEQ ID NO: 372633 - DNA, 25 bp, Mus musculus
tgagtctgccaaaattatggaccct

SEQ ID NO: 372634 - DNA, 25 bp, Mus musculus
tgagtctggacaggtcacgctggag

SEQ ID NO: 372635 - DNA, 25 bp, Mus musculus
tgagtctgttcagactgtactccct

SEQ ID NO: 372636 - DNA, 25 bp, Mus musculus
tgagtcttatctatgttcaaaggat

SEQ ID NO: 372637 - DNA, 25 bp, Mus musculus
tgagtcttatgtatgttcaaaggat

SEQ ID NO: 372638 - DNA, 25 bp, Mus musculus
tgagtctttaaggagaaagcatcca

SEQ ID NO: 372639 - DNA, 25 bp, Mus musculus
tgagtctttaagtggttctgtgtat

SEQ ID NO: 372640 - DNA, 25 bp, Mus musculus
tgagtctttcctggttttctatttt

SEQ ID NO: 372641 - DNA, 25 bp, Mus musculus
tgagtgaactgcgggacatctatga

SEQ ID NO: 372642 - DNA, 25 bp, Mus musculus
tgagtgaactgcgggagtctttgtc

SEQ ID NO: 372643 - DNA, 25 bp, Mus musculus
tgagtgaagagctctgcagttttga

SEQ ID NO: 372644 - DNA, 25 bp, Mus musculus
tgagtgaagatagtttaggtcaacc

SEQ ID NO: 372645 - DNA, 25 bp, Mus musculus
tgagtgaagatgatcgtaatacttt

SEQ ID NO: 372646 - DNA, 25 bp, Mus musculus
tgagtgacagagcctccaggtgagg

SEQ ID NO: 372647 - DNA, 25 bp, Mus musculus
tgagtgacaggggacccatgagctt

SEQ ID NO: 372648 - DNA, 25 bp, Mus musculus
tgagtgacatcgcatcggctcttag

SEQ ID NO: 372649 - DNA, 25 bp, Mus musculus
tgagtgacatcggcgccagagcttc

SEQ ID NO: 372650 - DNA, 25 bp, Mus musculus
tgagtgacgggtttagctttttctc

SEQ ID NO: 372651 - DNA, 25 bp, Mus musculus
tgagtgactccaggctgtccttgtt

SEQ ID NO: 372652 - DNA, 25 bp, Mus musculus
tgagtgactctgccgaccccttcct

SEQ ID NO: 372653 - DNA, 25 bp, Mus musculus
tgagtgactctgctcttctagatta

SEQ ID NO: 372654 - DNA, 25 bp, Mus musculus
tgagtgagaaaaggatgattgagat

SEQ ID NO: 372655 - DNA, 25 bp, Mus musculus
tgagtgagaaaaggccctcaacttc

SEQ ID NO: 372656 - DNA, 25 bp, Mus musculus
tgagtgagaaaggagacatggagta

SEQ ID NO: 372657 - DNA, 25 bp, Mus musculus
tgagtgagaaaggggacagtcaaaa

SEQ ID NO: 372658 - DNA, 25 bp, Mus musculus
tgagtgagagccagtcgtttcagct

SEQ ID NO: 372659 - DNA, 25 bp, Mus musculus
tgagtgagatcgcagccttccctgt

SEQ ID NO: 372660 - DNA, 25 bp, Mus musculus
tgagtgagatcgtttcctcctcaga

SEQ ID NO: 372661 - DNA, 25 bp, Mus musculus
tgagtgagattccctgttctgcagg

SEQ ID NO: 372662 - DNA, 25 bp, Mus musculus
tgagtgagcacggatgaaaattttt

SEQ ID NO: 372663 - DNA, 25 bp, Mus musculus
tgagtgagcaggctcctgcaaaaaa

SEQ ID NO: 372664 - DNA, 25 bp, Mus musculus
tgagtgatcagggcaccctcagatc

SEQ ID NO: 372665 - DNA, 25 bp, Mus musculus
tgagtgatggaggacttctgtgtgt

SEQ ID NO: 372666 - DNA, 25 bp, Mus musculus
tgagtgattacagagaattgtattt

SEQ ID NO: 372667 - DNA, 25 bp, Mus musculus
tgagtgattacagaggctttggtat

SEQ ID NO: 372668 - DNA, 25 bp, Mus musculus
tgagtgattacagaggttgccatga

SEQ ID NO: 372669 - DNA, 25 bp, Mus musculus
tgagtgcaagaggcaagtgcaggtg

SEQ ID NO: 372670 - DNA, 25 bp, Mus musculus
tgagtgcaaggcaccccggctggaa

SEQ ID NO: 372671 - DNA, 25 bp, Mus musculus
tgagtgccaaatggcccagcaagga

SEQ ID NO: 372672 - DNA, 25 bp, Mus musculus
tgagtgccaaggttcatatgggaag

SEQ ID NO: 372673 - DNA, 25 bp, Mus musculus
tgagtgccagcgaatggctattcaa

SEQ ID NO: 372674 - DNA, 25 bp, Mus musculus
tgagtgccaggtgatacttaaatac

SEQ ID NO: 372675 - DNA, 25 bp, Mus musculus
tgagtgccagtaaagcatatgggtg

SEQ ID NO: 372676 - DNA, 25 bp, Mus musculus
tgagtgccatggattggcgtctcta

SEQ ID NO: 372677 - DNA, 25 bp, Mus musculus
tgagtgcctgagaggcgtccccatt

SEQ ID NO: 372678 - DNA, 25 bp, Mus musculus
tgagtgccttaaaagaaaccatgga

SEQ ID NO: 372679 - DNA, 25 bp, Mus musculus
tgagtgctacaccccctcacgcctc

SEQ ID NO: 372680 - DNA, 25 bp, Mus musculus
tgagtgctgaagaggaagagcagaa

SEQ ID NO: 372681 - DNA, 25 bp, Mus musculus
tgagtggaacgcaaccttcctgctt

SEQ ID NO: 372682 - DNA, 25 bp, Mus musculus
tgagtggaagaatcctcggctcctc

SEQ ID NO: 372683 - DNA, 25 bp, Mus musculus
tgagtggaaggcgagaactccactg

SEQ ID NO: 372684 - DNA, 25 bp, Mus musculus
tgagtggaaggggattttacagtta

SEQ ID NO: 372685 - DNA, 25 bp, Mus musculus
tgagtggaaggtggcccagatgatg

SEQ ID NO: 372686 - DNA, 25 bp, Mus musculus
tgagtggaaggtgggattggtttcc

SEQ ID NO: 372687 - DNA, 25 bp, Mus musculus
tgagtggaatgcgctcttcgtggtg

SEQ ID NO: 372688 - DNA, 25 bp, Mus musculus
tgagtggacaggctgaatttgacaa

SEQ ID NO: 372689 - DNA, 25 bp, Mus musculus
tgagtggagctggtctgggactgtg

SEQ ID NO: 372690 - DNA, 25 bp, Mus musculus
tgagtggaggagcagtgccctcagc

SEQ ID NO: 372691 - DNA, 25 bp, Mus musculus
tgagtggaggcgccactgcccacac

SEQ ID NO: 372692 - DNA, 25 bp, Mus musculus
tgagtggagtggggacggcagcggc

SEQ ID NO: 372693 - DNA, 25 bp, Mus musculus
tgagtggctggattcctatctactc

SEQ ID NO: 372694 - DNA, 25 bp, Mus musculus
tgagtgggaagatgatcttcccaaa

SEQ ID NO: 372695 - DNA, 25 bp, Mus musculus
tgagtgggagttgtgacacaggatt

SEQ ID NO: 372696 - DNA, 25 bp, Mus musculus
tgagtgggggtaagggtggaatgta

SEQ ID NO: 372697 - DNA, 25 bp, Mus musculus
tgagtggtacatatgacaatggatg

SEQ ID NO: 372698 - DNA, 25 bp, Mus musculus
tgagtggtacgacatgacaatggat

SEQ ID NO: 372699 - DNA, 25 bp, Mus musculus
tgagtggtccatgtctctttctcca

SEQ ID NO: 372700 - DNA, 25 bp, Mus musculus
tgagtggtctcagaagtgccttcaa

SEQ ID NO: 372701 - DNA, 25 bp, Mus musculus
tgagtgtagaattctcactggccgg

SEQ ID NO: 372702 - DNA, 25 bp, Mus musculus
tgagtgtcaggatggtggtgcggag

SEQ ID NO: 372703 - DNA, 25 bp, Mus musculus
tgagtgtcaggctgtgagtcctgat

SEQ ID NO: 372704 - DNA, 25 bp, Mus musculus
tgagtgtcctaggtcttgagagagc

SEQ ID NO: 372705 - DNA, 25 bp, Mus musculus
tgagtgtctctgatcaagagcacct

SEQ ID NO: 372706 - DNA, 25 bp, Mus musculus
tgagtgtgcgagcaggtagtcaata

SEQ ID NO: 372707 - DNA, 25 bp, Mus musculus
tgagtgtggcagtagatgaagaaca

SEQ ID NO: 372708 - DNA, 25 bp, Mus musculus
tgagtgtgtctcaggtggtccacaa

SEQ ID NO: 372709 - DNA, 25 bp, Mus musculus
tgagtgtgtgtgtcagcggtctgag

SEQ ID NO: 372710 - DNA, 25 bp, Mus musculus
tgagtgttcagaaagcgctcctgtt

SEQ ID NO: 372711 - DNA, 25 bp, Mus musculus
tgagtgttggaatggtcagcctctc

SEQ ID NO: 372712 - DNA, 25 bp, Mus musculus
tgagtgttggcgggccatcccagca

SEQ ID NO: 372713 - DNA, 25 bp, Mus musculus
tgagtgttttctctcttttatttca

SEQ ID NO: 372714 - DNA, 25 bp, Mus musculus
tgagttacatgtatgatttctgtac

SEQ ID NO: 372715 - DNA, 25 bp, Mus musculus
tgagttacttagtggagagaacaga

SEQ ID NO: 372716 - DNA, 25 bp, Mus musculus
tgagttacttagtggtgagacgtgg

SEQ ID NO: 372717 - DNA, 25 bp, Mus musculus
tgagttagagagagagagagagaca

SEQ ID NO: 372718 - DNA, 25 bp, Mus musculus
tgagttagaggtcttgttgcgggtc

SEQ ID NO: 372719 - DNA, 25 bp, Mus musculus
tgagttagagttccagttactatgg

SEQ ID NO: 372720 - DNA, 25 bp, Mus musculus
tgagttattggtaacttcaattttt

SEQ ID NO: 372721 - DNA, 25 bp, Mus musculus
tgagttcaaggccttgctgtatcct

SEQ ID NO: 372722 - DNA, 25 bp, Mus musculus
tgagttcaaggtggtggtcgtgcag

SEQ ID NO: 372723 - DNA, 25 bp, Mus musculus
tgagttcaatgagcggtttgagtgg

SEQ ID NO: 372724 - DNA, 25 bp, Mus musculus
tgagttcacagaaacttcgtggcag

SEQ ID NO: 372725 - DNA, 25 bp, Mus musculus
tgagttcacagagcatgcaacccac

SEQ ID NO: 372726 - DNA, 25 bp, Mus musculus
tgagttcacagagttctcagtatgt

SEQ ID NO: 372727 - DNA, 25 bp, Mus musculus
tgagttcagcgacattaaggcccgc

SEQ ID NO: 372728 - DNA, 25 bp, Mus musculus
tgagttcatcgatggctaaagtaaa

SEQ ID NO: 372729 - DNA, 25 bp, Mus musculus
tgagttcatcgatgtctacttcatt

SEQ ID NO: 372730 - DNA, 25 bp, Mus musculus
tgagttcattgcaattcttggccac

SEQ ID NO: 372731 - DNA, 25 bp, Mus musculus
tgagttccactgggctcccatcctg

SEQ ID NO: 372732 - DNA, 25 bp, Mus musculus
tgagttccagagcccccttcactca

SEQ ID NO: 372733 - DNA, 25 bp, Mus musculus
tgagttcgagcccgccggagtcctg

SEQ ID NO: 372734 - DNA, 25 bp, Mus musculus
tgagttctaccgcagtggctgggca

SEQ ID NO: 372735 - DNA, 25 bp, Mus musculus
tgagttctccagagccaaggctgtt

SEQ ID NO: 372736 - DNA, 25 bp, Mus musculus
tgagttctcccataccctccacact

SEQ ID NO: 372737 - DNA, 25 bp, Mus musculus
tgagttcttgtgggaagcattcaac

SEQ ID NO: 372738 - DNA, 25 bp, Mus musculus
tgagttcttgtgggggatgcttggc

SEQ ID NO: 372739 - DNA, 25 bp, Mus musculus
tgagttcttgtgggtggccatgcag

SEQ ID NO: 372740 - DNA, 25 bp, Mus musculus
tgagttgcacggatgttctgagccc

SEQ ID NO: 372741 - DNA, 25 bp, Mus musculus
tgagttgccctgactctaccgcacc

SEQ ID NO: 372742 - DNA, 25 bp, Mus musculus
tgagttgctaaaactgccttggggt

SEQ ID NO: 372743 - DNA, 25 bp, Mus musculus
tgagttgctaaaagtgcctcctgag

SEQ ID NO: 372744 - DNA, 25 bp, Mus musculus
tgagttgctgctgattttcatttcc

SEQ ID NO: 372745 - DNA, 25 bp, Mus musculus
tgagttgctgctggtgccagggtgt

SEQ ID NO: 372746 - DNA, 25 bp, Mus musculus
tgagttggcaggaagaaaatgccgc

SEQ ID NO: 372747 - DNA, 25 bp, Mus musculus
tgagttggcagtcacaaactcgcag

SEQ ID NO: 372748 - DNA, 25 bp, Mus musculus
tgagttgtcaggtaaagatgagcct

SEQ ID NO: 372749 - DNA, 25 bp, Mus musculus
tgagtttaaggttaaatgagcagta

SEQ ID NO: 372750 - DNA, 25 bp, Mus musculus
tgagtttcacaagtggatagagaga

SEQ ID NO: 372751 - DNA, 25 bp, Mus musculus
tgagtttcaggagcggctgcaaagt

SEQ ID NO: 372752 - DNA, 25 bp, Mus musculus
tgagtttcccccacttacagactga

SEQ ID NO: 372753 - DNA, 25 bp, Mus musculus
tgagtttccgatgagacagaagact

SEQ ID NO: 372754 - DNA, 25 bp, Mus musculus
tgagtttctatgccgatcaaaagga

SEQ ID NO: 372755 - DNA, 25 bp, Mus musculus
tgagtttcttgtaatagggcccagt

SEQ ID NO: 372756 - DNA, 25 bp, Mus musculus
tgagtttctttctgcctgcacattt

SEQ ID NO: 372757 - DNA, 25 bp, Mus musculus
tgagtttgagatactaagcaaccag

SEQ ID NO: 372758 - DNA, 25 bp, Mus musculus
tgagtttgaggaggctcaacgcaca

SEQ ID NO: 372759 - DNA, 25 bp, Mus musculus
tgagtttgaggcgggatccacggca

SEQ ID NO: 372760 - DNA, 25 bp, Mus musculus
tgagtttgctcagaagtttacagag

SEQ ID NO: 372761 - DNA, 25 bp, Mus musculus
tgagtttggtctctggtggaattgg

SEQ ID NO: 372762 - DNA, 25 bp, Mus musculus
tgagttttatgagaggaacctgtct

SEQ ID NO: 372763 - DNA, 25 bp, Mus musculus
tgagttttcgcgagaactttcaaag

SEQ ID NO: 372764 - DNA, 25 bp, Mus musculus
tgagttttgaagcactaggttcacg

SEQ ID NO: 372765 - DNA, 25 bp, Mus musculus
tgagttttggccaagatccccagcc

SEQ ID NO: 372766 - DNA, 25 bp, Mus musculus
tgagtttttagatattatgagaaga

SEQ ID NO: 372767 - DNA, 25 bp, Mus musculus
tgagtttttggagttagaacaaatg

SEQ ID NO: 372768 - DNA, 25 bp, Mus musculus
tgataaaaaataaggctcatcctaa

SEQ ID NO: 372769 - DNA, 25 bp, Mus musculus
tgataaaaaggtgtcactctgcaaa

SEQ ID NO: 372770 - DNA, 25 bp, Mus musculus
tgataaaaagtctttttatgaacta

SEQ ID NO: 372771 - DNA, 25 bp, Mus musculus
tgataaaacatgctggaggcattcc

SEQ ID NO: 372772 - DNA, 25 bp, Mus musculus
tgataaaacatggcattctgcattt

SEQ ID NO: 372773 - DNA, 25 bp, Mus musculus
tgataaaaccacgactccagatgta

SEQ ID NO: 372774 - DNA, 25 bp, Mus musculus
tgataaaaccaggtttgcttatgat

SEQ ID NO: 372775 - DNA, 25 bp, Mus musculus
tgataaaactggggttcgcaacgtt

SEQ ID NO: 372776 - DNA, 25 bp, Mus musculus
tgataaaactgggtggtcatatgct

SEQ ID NO: 372777 - DNA, 25 bp, Mus musculus
tgataaaagcatcaggcaagaggca

SEQ ID NO: 372778 - DNA, 25 bp, Mus musculus
tgataaaagcatcagttgtgactgt

SEQ ID NO: 372779 - DNA, 25 bp, Mus musculus
tgataaaatcaagatgtctgttggt

SEQ ID NO: 372780 - DNA, 25 bp, Mus musculus
tgataaaattctggagctggaggag

SEQ ID NO: 372781 - DNA, 25 bp, Mus musculus
tgataaagagaaacttttagcggac

SEQ ID NO: 372782 - DNA, 25 bp, Mus musculus
tgataaagagatgagacctgctcga

SEQ ID NO: 372783 - DNA, 25 bp, Mus musculus
tgataaagaggaagaagaaagaaaa

SEQ ID NO: 372784 - DNA, 25 bp, Mus musculus
tgataaaggagattgaggacggctg

SEQ ID NO: 372785 - DNA, 25 bp, Mus musculus
tgataaaggaggccttggaaataca

SEQ ID NO: 372786 - DNA, 25 bp, Mus musculus
tgataaagggtgaggtgtgccaaag

SEQ ID NO: 372787 - DNA, 25 bp, Mus musculus
tgataaagggtgagttttatgtgat

SEQ ID NO: 372788 - DNA, 25 bp, Mus musculus
tgataaagttcacctcctggctatt

SEQ ID NO: 372789 - DNA, 25 bp, Mus musculus
tgataaagttcagctcctggctatt

SEQ ID NO: 372790 - DNA, 25 bp, Mus musculus
tgataaataagagggcaatgcgagc

SEQ ID NO: 372791 - DNA, 25 bp, Mus musculus
tgataaataggagctccaccccagg

SEQ ID NO: 372792 - DNA, 25 bp, Mus musculus
tgataaatgaggacatagcattgtt

SEQ ID NO: 372793 - DNA, 25 bp, Mus musculus
tgataacacaggccatggcgcaggc

SEQ ID NO: 372794 - DNA, 25 bp, Mus musculus
tgataacacaggtgccttcttcaca

SEQ ID NO: 372795 - DNA, 25 bp, Mus musculus
tgataacagagcaacccgatagcag

SEQ ID NO: 372796 - DNA, 25 bp, Mus musculus
tgataacagagcatacaagcaatga

SEQ ID NO: 372797 - DNA, 25 bp, Mus musculus
tgataacagagtcaatccccttctg

SEQ ID NO: 372798 - DNA, 25 bp, Mus musculus
tgataaccacggctctgaagcgtca

SEQ ID NO: 372799 - DNA, 25 bp, Mus musculus
tgataaccacgtctctgggtcctta

SEQ ID NO: 372800 - DNA, 25 bp, Mus musculus
tgataacgaacggtaccatggttgt

SEQ ID NO: 372801 - DNA, 25 bp, Mus musculus
tgataacggagttggtgaatgatac

SEQ ID NO: 372802 - DNA, 25 bp, Mus musculus
tgataagaagattatttccaagttg

SEQ ID NO: 372803 - DNA, 25 bp, Mus musculus
tgataagagcacagcttctccagcc

SEQ ID NO: 372804 - DNA, 25 bp, Mus musculus
tgataagagcacagtgctggctgcg

SEQ ID NO: 372805 - DNA, 25 bp, Mus musculus
tgataagagtgcagctcagagacat

SEQ ID NO: 372806 - DNA, 25 bp, Mus musculus
tgataagccatcaggtccatggaga

SEQ ID NO: 372807 - DNA, 25 bp, Mus musculus
tgataagctgaatgatatggaacct

SEQ ID NO: 372808 - DNA, 25 bp, Mus musculus
tgataagctgggtaaaactccacca

SEQ ID NO: 372809 - DNA, 25 bp, Mus musculus
tgataaggctcagagagtctgcagg

SEQ ID NO: 372810 - DNA, 25 bp, Mus musculus
tgataagtcagatgaatgagaacag

SEQ ID NO: 372811 - DNA, 25 bp, Mus musculus
tgataagtttgaggtattctgctat

SEQ ID NO: 372812 - DNA, 25 bp, Mus musculus
tgataataaggacaaccggatccag

SEQ ID NO: 372813 - DNA, 25 bp, Mus musculus
tgataataagtttctgagggtcagg

SEQ ID NO: 372814 - DNA, 25 bp, Mus musculus
tgataataccaggattgtctacaac

SEQ ID NO: 372815 - DNA, 25 bp, Mus musculus
tgataatagccagaacaaatataaa

SEQ ID NO: 372816 - DNA, 25 bp, Mus musculus
tgataatgaaggaattgctatcttt

SEQ ID NO: 372817 - DNA, 25 bp, Mus musculus
tgataatgagtattctagtcaagaa

SEQ ID NO: 372818 - DNA, 25 bp, Mus musculus
tgataatgtagatgaaactgaaggc

SEQ ID NO: 372819 - DNA, 25 bp, Mus musculus
tgataatgtagatgaggaagcaagg

SEQ ID NO: 372820 - DNA, 25 bp, Mus musculus
tgatacaaatggaaactataagtaa

SEQ ID NO: 372821 - DNA, 25 bp, Mus musculus
tgatacacaagacatttcgactttg

SEQ ID NO: 372822 - DNA, 25 bp, Mus musculus
tgatacacagagagcgatacacaca

SEQ ID NO: 372823 - DNA, 25 bp, Mus musculus
tgatacacagagatatagtgctggc

SEQ ID NO: 372824 - DNA, 25 bp, Mus musculus
tgatacagagcgcctagatgatttc

SEQ ID NO: 372825 - DNA, 25 bp, Mus musculus
tgatacagcaggtggggatgcgtca

SEQ ID NO: 372826 - DNA, 25 bp, Mus musculus
tgatacatatgagtcaaacgttcta

SEQ ID NO: 372827 - DNA, 25 bp, Mus musculus
tgatacatccaggtgcatggaggac

SEQ ID NO: 372828 - DNA, 25 bp, Mus musculus
tgatacatttaaaagctatgacttc

SEQ ID NO: 372829 - DNA, 25 bp, Mus musculus
tgatacatttaaaaggccatatcaa

SEQ ID NO: 372830 - DNA, 25 bp, Mus musculus
tgataccaacaaggcaaagggtggt

SEQ ID NO: 372831 - DNA, 25 bp, Mus musculus
tgataccatcctcatccctttttga

SEQ ID NO: 372832 - DNA, 25 bp, Mus musculus
tgataccctgggcaggattcctatc

SEQ ID NO: 372833 - DNA, 25 bp, Mus musculus
tgatacctgaccacggtgattggga

SEQ ID NO: 372834 - DNA, 25 bp, Mus musculus
tgatacctgaccacggtttggctcc

SEQ ID NO: 372835 - DNA, 25 bp, Mus musculus
tgatacgcacagatcttgatatgga

SEQ ID NO: 372836 - DNA, 25 bp, Mus musculus
tgatacgtttggaaagctggtctat

SEQ ID NO: 372837 - DNA, 25 bp, Mus musculus
tgatacgtttggaaatgttccttca

SEQ ID NO: 372838 - DNA, 25 bp, Mus musculus
tgatactaaaaggagacagtggaat

SEQ ID NO: 372839 - DNA, 25 bp, Mus musculus
tgatactaaaagtgaagcctgtctg

SEQ ID NO: 372840 - DNA, 25 bp, Mus musculus
tgatactccactcttggatatcacg

SEQ ID NO: 372841 - DNA, 25 bp, Mus musculus
tgatactccactcttggcaagtcgg

SEQ ID NO: 372842 - DNA, 25 bp, Mus musculus
tgatactgccacatgctgctggggc

SEQ ID NO: 372843 - DNA, 25 bp, Mus musculus
tgatagaaaggtttacgaaagatac

SEQ ID NO: 372844 - DNA, 25 bp, Mus musculus
tgatagaaagttgatcttcttaggt

SEQ ID NO: 372845 - DNA, 25 bp, Mus musculus
tgatagaagaagtgagctgaagagg

SEQ ID NO: 372846 - DNA, 25 bp, Mus musculus
tgatagaagagcttcggaaatgtgt

SEQ ID NO: 372847 - DNA, 25 bp, Mus musculus
tgatagaagagtggtagatgaccct

SEQ ID NO: 372848 - DNA, 25 bp, Mus musculus
tgatagaatgttgctggtgaagaat

SEQ ID NO: 372849 - DNA, 25 bp, Mus musculus
tgatagacacctgagatatcaagtt

SEQ ID NO: 372850 - DNA, 25 bp, Mus musculus
tgatagacagatcctacttctggac

SEQ ID NO: 372851 - DNA, 25 bp, Mus musculus
tgatagacagcccctgttgcatgac

SEQ ID NO: 372852 - DNA, 25 bp, Mus musculus
tgatagacagctgctgctccagctg

SEQ ID NO: 372853 - DNA, 25 bp, Mus musculus
tgatagactaggatattttaaagaa

SEQ ID NO: 372854 - DNA, 25 bp, Mus musculus
tgatagactaggttggtttgccatc

SEQ ID NO: 372855 - DNA, 25 bp, Mus musculus
tgatagagttgcaacatctcggatc

SEQ ID NO: 372856 - DNA, 25 bp, Mus musculus
tgatagagtttcagatacaccaagt

SEQ ID NO: 372857 - DNA, 25 bp, Mus musculus
tgatagagtttcagcacccacagag

SEQ ID NO: 372858 - DNA, 25 bp, Mus musculus
tgatagcaaaactccaccagagaag

SEQ ID NO: 372859 - DNA, 25 bp, Mus musculus
tgatagcatcaggcgcgagcttcat

SEQ ID NO: 372860 - DNA, 25 bp, Mus musculus
tgatagccaagagaggtcactatgg

SEQ ID NO: 372861 - DNA, 25 bp, Mus musculus
tgatagccaagagagttctgttggc

SEQ ID NO: 372862 - DNA, 25 bp, Mus musculus
tgatagccatattgccctctgtttt

SEQ ID NO: 372863 - DNA, 25 bp, Mus musculus
tgatagcctcgtggaactggaacac

SEQ ID NO: 372864 - DNA, 25 bp, Mus musculus
tgatagcctgggtttgtcactcttt

SEQ ID NO: 372865 - DNA, 25 bp, Mus musculus
tgatagcgatgaggaagatgatgat

SEQ ID NO: 372866 - DNA, 25 bp, Mus musculus
tgatagcggagaaaattggagagga

SEQ ID NO: 372867 - DNA, 25 bp, Mus musculus
tgatagctgaaaagaaagggccaaa

SEQ ID NO: 372868 - DNA, 25 bp, Mus musculus
tgatagctgaaaaggtgtctctggt

SEQ ID NO: 372869 - DNA, 25 bp, Mus musculus
tgatagctttgataaatttgaattc

SEQ ID NO: 372870 - DNA, 25 bp, Mus musculus
tgataggacagaacaccacccaaag

SEQ ID NO: 372871 - DNA, 25 bp, Mus musculus
tgataggacagtgttcttcacaaaa

SEQ ID NO: 372872 - DNA, 25 bp, Mus musculus
tgataggagacgattgcagggatga

SEQ ID NO: 372873 - DNA, 25 bp, Mus musculus
tgataggcaggagatgagccgctcc

SEQ ID NO: 372874 - DNA, 25 bp, Mus musculus
tgataggcttggtgaatcacagacc

SEQ ID NO: 372875 - DNA, 25 bp, Mus musculus
tgatagggagttctgaggctctaag

SEQ ID NO: 372876 - DNA, 25 bp, Mus musculus
tgatagtagtgtcctggaggccaca

SEQ ID NO: 372877 - DNA, 25 bp, Mus musculus
tgatagtagttacacctctaagtta

SEQ ID NO: 372878 - DNA, 25 bp, Mus musculus
tgatagtccagcagactgatacctc

SEQ ID NO: 372879 - DNA, 25 bp, Mus musculus
tgatagtggtaaggccatcgaagac

SEQ ID NO: 372880 - DNA, 25 bp, Mus musculus
tgatagtggtaagtgcggctggctc

SEQ ID NO: 372881 - DNA, 25 bp, Mus musculus
tgatagttcaaatgcgcttaaagga

SEQ ID NO: 372882 - DNA, 25 bp, Mus musculus
tgatataaaggttttaaatgcacag

SEQ ID NO: 372883 - DNA, 25 bp, Mus musculus
tgatataaatgtcaggactcaggac

SEQ ID NO: 372884 - DNA, 25 bp, Mus musculus
tgatatacaggtggaatgacattgg

SEQ ID NO: 372885 - DNA, 25 bp, Mus musculus
tgatatactcatctgccatggtgtg

SEQ ID NO: 372886 - DNA, 25 bp, Mus musculus
tgatatcaagtcgcgcattgccaag

SEQ ID NO: 372887 - DNA, 25 bp, Mus musculus
tgatatcacaaatgttaactcattc

SEQ ID NO: 372888 - DNA, 25 bp, Mus musculus
tgatatcatccgagttagaacaaat

SEQ ID NO: 372889 - DNA, 25 bp, Mus musculus
tgatatccagtatggaagggtggag

SEQ ID NO: 372890 - DNA, 25 bp, Mus musculus
tgatatcccagattttagaaaggaa

SEQ ID NO: 372891 - DNA, 25 bp, Mus musculus
tgatatcccaggtccaaatatcaca

SEQ ID NO: 372892 - DNA, 25 bp, Mus musculus
tgatatctttgaagaccttgctttt

SEQ ID NO: 372893 - DNA, 25 bp, Mus musculus
tgatatctttgaagatgctgtcttc

SEQ ID NO: 372894 - DNA, 25 bp, Mus musculus
tgatatctttgaaggacgtgtaatt

SEQ ID NO: 372895 - DNA, 25 bp, Mus musculus
tgatatctttgaagtactaagtata

SEQ ID NO: 372896 - DNA, 25 bp, Mus musculus
tgatatctttgtatatgaggtgact

SEQ ID NO: 372897 - DNA, 25 bp, Mus musculus
tgatatgaagcagattgattatacg

SEQ ID NO: 372898 - DNA, 25 bp, Mus musculus
tgatatgaggagtcagtacaggcta

SEQ ID NO: 372899 - DNA, 25 bp, Mus musculus
tgatatgcacagtggcttctatttt

SEQ ID NO: 372900 - DNA, 25 bp, Mus musculus
tgatatgcagctgaggcgtaagttg

SEQ ID NO: 372901 - DNA, 25 bp, Mus musculus
tgatatgcagctgagtccacgtgaa

SEQ ID NO: 372902 - DNA, 25 bp, Mus musculus
tgatatggacaggggatagcccacc

SEQ ID NO: 372903 - DNA, 25 bp, Mus musculus
tgatatggagaaccttcacacctgt

SEQ ID NO: 372904 - DNA, 25 bp, Mus musculus
tgatatggcacccgttattggaaat

SEQ ID NO: 372905 - DNA, 25 bp, Mus musculus
tgatatgtcgaccggaagaaagact

SEQ ID NO: 372906 - DNA, 25 bp, Mus musculus
tgatatgttattcagaggaccagag

SEQ ID NO: 372907 - DNA, 25 bp, Mus musculus
tgatattaagatgctaacattttta

SEQ ID NO: 372908 - DNA, 25 bp, Mus musculus
tgatattcaagcgtctgttgcggtt

SEQ ID NO: 372909 - DNA, 25 bp, Mus musculus
tgatattcaaggaacagcgtctgtt

SEQ ID NO: 372910 - DNA, 25 bp, Mus musculus
tgatattggtgatgtaaccattact

SEQ ID NO: 372911 - DNA, 25 bp, Mus musculus
tgatattgtcatatccaactgtgtt

SEQ ID NO: 372912 - DNA, 25 bp, Mus musculus
tgatatttgctccgctttttgcaat

SEQ ID NO: 372913 - DNA, 25 bp, Mus musculus
tgatcaaaaagtttcagttcgttgt

SEQ ID NO: 372914 - DNA, 25 bp, Mus musculus
tgatcaaagcagtccggcatgagga

SEQ ID NO: 372915 - DNA, 25 bp, Mus musculus
tgatcaaaggcattcctttggacca

SEQ ID NO: 372916 - DNA, 25 bp, Mus musculus
tgatcaaagggtgaagtcggtgata

SEQ ID NO: 372917 - DNA, 25 bp, Mus musculus
tgatcaaagtgccagtgaaccccag

SEQ ID NO: 372918 - DNA, 25 bp, Mus musculus
tgatcaaagtggaaatggatccacc

SEQ ID NO: 372919 - DNA, 25 bp, Mus musculus
tgatcaacaacaccaaggagtttat

SEQ ID NO: 372920 - DNA, 25 bp, Mus musculus
tgatcaacagacgtatgttgtcacc

SEQ ID NO: 372921 - DNA, 25 bp, Mus musculus
tgatcaacagccaaaccactgagca

SEQ ID NO: 372922 - DNA, 25 bp, Mus musculus
tgatcaacaggtctccattttgaca

SEQ ID NO: 372923 - DNA, 25 bp, Mus musculus
tgatcaacgaagcaatggcaccatt

SEQ ID NO: 372924 - DNA, 25 bp, Mus musculus
tgatcaacgacaaggtggcccagct

SEQ ID NO: 372925 - DNA, 25 bp, Mus musculus
tgatcaactctcatctgttctcagc

SEQ ID NO: 372926 - DNA, 25 bp, Mus musculus
tgatcaagagaatcgagcctagaat

SEQ ID NO: 372927 - DNA, 25 bp, Mus musculus
tgatcaagcgagactccctccaacc

SEQ ID NO: 372928 - DNA, 25 bp, Mus musculus
tgatcaagcgagatggccgccaaga

SEQ ID NO: 372929 - DNA, 25 bp, Mus musculus
tgatcaaggaaccttctgtggatga

SEQ ID NO: 372930 - DNA, 25 bp, Mus musculus
tgatcaagggcatccaccacggccc

SEQ ID NO: 372931 - DNA, 25 bp, Mus musculus
tgatcacaccacagggctatgagaa

SEQ ID NO: 372932 - DNA, 25 bp, Mus musculus
tgatcacaccacaggtcccaggaga

SEQ ID NO: 372933 - DNA, 25 bp, Mus musculus
tgatcacaccacagttgctaagggt

SEQ ID NO: 372934 - DNA, 25 bp, Mus musculus
tgatcacagaacttgacgtcagggc

SEQ ID NO: 372935 - DNA, 25 bp, Mus musculus
tgatcacagaacttgtgcaggtgtt

SEQ ID NO: 372936 - DNA, 25 bp, Mus musculus
tgatcaccctggagacgactctaga

SEQ ID NO: 372937 - DNA, 25 bp, Mus musculus
tgatcacctacgggccctatgccgt

SEQ ID NO: 372938 - DNA, 25 bp, Mus musculus
tgatcacgaagcacagctgtgacga

SEQ ID NO: 372939 - DNA, 25 bp, Mus musculus
tgatcacgtccaagaatttcaccca

SEQ ID NO: 372940 - DNA, 25 bp, Mus musculus
tgatcacgtccaaggtggctgtgcc

SEQ ID NO: 372941 - DNA, 25 bp, Mus musculus
tgatcactatgatgcctgttcctgc

SEQ ID NO: 372942 - DNA, 25 bp, Mus musculus
tgatcactgtgaatggttaccatac

SEQ ID NO: 372943 - DNA, 25 bp, Mus musculus
tgatcagaaaatgagctctgttaag

SEQ ID NO: 372944 - DNA, 25 bp, Mus musculus
tgatcagaaacctgaacctgtggac

SEQ ID NO: 372945 - DNA, 25 bp, Mus musculus
tgatcagaaacctgatattcagaca

SEQ ID NO: 372946 - DNA, 25 bp, Mus musculus
tgatcagacaggaaaggatgtggcc

SEQ ID NO: 372947 - DNA, 25 bp, Mus musculus
tgatcagcacatgggagtggtcaca

SEQ ID NO: 372948 - DNA, 25 bp, Mus musculus
tgatcagcacatgggctttcccagt

SEQ ID NO: 372949 - DNA, 25 bp, Mus musculus
tgatcagcaccatgtcaaatcctct

SEQ ID NO: 372950 - DNA, 25 bp, Mus musculus
tgatcagcagaggtgctgttaccag

SEQ ID NO: 372951 - DNA, 25 bp, Mus musculus
tgatcagcagagtgaaatggttaag

SEQ ID NO: 372952 - DNA, 25 bp, Mus musculus
tgatcagcagctcgtgcctcctact

SEQ ID NO: 372953 - DNA, 25 bp, Mus musculus
tgatcagcgacatcgatggagatgg

SEQ ID NO: 372954 - DNA, 25 bp, Mus musculus
tgatcaggtccagggcaatggcagc

SEQ ID NO: 372955 - DNA, 25 bp, Mus musculus
tgatcaggtgctaggttaaagatcg

SEQ ID NO: 372956 - DNA, 25 bp, Mus musculus
tgatcatcacaggagttggtgacac

SEQ ID NO: 372957 - DNA, 25 bp, Mus musculus
tgatcatcagccacttccacctgga

SEQ ID NO: 372958 - DNA, 25 bp, Mus musculus
tgatcatcaggccatctgccccatc

SEQ ID NO: 372959 - DNA, 25 bp, Mus musculus
tgatcatccagccctacatccagaa

SEQ ID NO: 372960 - DNA, 25 bp, Mus musculus
tgatcatccattcaggcgtccgcga

SEQ ID NO: 372961 - DNA, 25 bp, Mus musculus
tgatcatcccagcctatgggaaggt

SEQ ID NO: 372962 - DNA, 25 bp, Mus musculus
tgatcatcccggcgcctccccatct

SEQ ID NO: 372963 - DNA, 25 bp, Mus musculus
tgatcatcccgggagttccgactct

SEQ ID NO: 372964 - DNA, 25 bp, Mus musculus
tgatcatcccggtatccctggaact

SEQ ID NO: 372965 - DNA, 25 bp, Mus musculus
tgatcatctattagggcttatttca

SEQ ID NO: 372966 - DNA, 25 bp, Mus musculus
tgatcatctcattgctaagaatgtg

SEQ ID NO: 372967 - DNA, 25 bp, Mus musculus
tgatcatggacggggcatttggcac

SEQ ID NO: 372968 - DNA, 25 bp, Mus musculus
tgatcattgtccgtgcaaaactggt

SEQ ID NO: 372969 - DNA, 25 bp, Mus musculus
tgatcatttttctgacaagcaggtg

SEQ ID NO: 372970 - DNA, 25 bp, Mus musculus
tgatcatttttctggtgtgatcctg

SEQ ID NO: 372971 - DNA, 25 bp, Mus musculus
tgatccaaaaaggatacatgaggat

SEQ ID NO: 372972 - DNA, 25 bp, Mus musculus
tgatccacagagatgtgaagccatc

SEQ ID NO: 372973 - DNA, 25 bp, Mus musculus
tgatccacaggccctttggagacgg

SEQ ID NO: 372974 - DNA, 25 bp, Mus musculus
tgatccagaaaagctctccgtaaat

SEQ ID NO: 372975 - DNA, 25 bp, Mus musculus
tgatccagaaaagctgtcttcagac

SEQ ID NO: 372976 - DNA, 25 bp, Mus musculus
tgatccagaaagatcaagagcacct

SEQ ID NO: 372977 - DNA, 25 bp, Mus musculus
tgatccagaacctggagaatgtggt

SEQ ID NO: 372978 - DNA, 25 bp, Mus musculus
tgatccagaagcagaggacgttcgt

SEQ ID NO: 372979 - DNA, 25 bp, Mus musculus
tgatccagacggccacccgagacct

SEQ ID NO: 372980 - DNA, 25 bp, Mus musculus
tgatccagggcaagaaagtatccac

SEQ ID NO: 372981 - DNA, 25 bp, Mus musculus
tgatccagggcaaggtatgtcctct

SEQ ID NO: 372982 - DNA, 25 bp, Mus musculus
tgatccagtcaaggaggaggatgac

SEQ ID NO: 372983 - DNA, 25 bp, Mus musculus
tgatccagtcaaggatgactatgac

SEQ ID NO: 372984 - DNA, 25 bp, Mus musculus
tgatccagtgaggcctcaggtccag

SEQ ID NO: 372985 - DNA, 25 bp, Mus musculus
tgatccagttcaggatgagatgctg

SEQ ID NO: 372986 - DNA, 25 bp, Mus musculus
tgatcccaagggttggcccctaggt

SEQ ID NO: 372987 - DNA, 25 bp, Mus musculus
tgatcccactctgaggagaagaatt

SEQ ID NO: 372988 - DNA, 25 bp, Mus musculus
tgatcccactctgaggtccagagtt

SEQ ID NO: 372989 - DNA, 25 bp, Mus musculus
tgatcccagagctggtttggccctg

SEQ ID NO: 372990 - DNA, 25 bp, Mus musculus
tgatccccaagggtgtgctggctgt

SEQ ID NO: 372991 - DNA, 25 bp, Mus musculus
tgatccccaagtgcctggctgagcg

SEQ ID NO: 372992 - DNA, 25 bp, Mus musculus
tgatccccaatgtggaaaccatcct

SEQ ID NO: 372993 - DNA, 25 bp, Mus musculus
tgatccccacaggagaaatgctctt

SEQ ID NO: 372994 - DNA, 25 bp, Mus musculus
tgatccccacaggtgatggacagaa

SEQ ID NO: 372995 - DNA, 25 bp, Mus musculus
tgatccccagacagttacacgtctg

SEQ ID NO: 372996 - DNA, 25 bp, Mus musculus
tgatccccagctgtgctcaggatga

SEQ ID NO: 372997 - DNA, 25 bp, Mus musculus
tgatcccccagagaggccaggctgg

SEQ ID NO: 372998 - DNA, 25 bp, Mus musculus
tgatcccccagagagtcatggacca

SEQ ID NO: 372999 - DNA, 25 bp, Mus musculus
tgatcccgggataggcttctgtgtc

SEQ ID NO: 373000 - DNA, 25 bp, Mus musculus
tgatcccgtgaaggtgattcagaca

SEQ ID NO: 373001 - DNA, 25 bp, Mus musculus
tgatccctagagatgtcttcctgaa

SEQ ID NO: 373002 - DNA, 25 bp, Mus musculus
tgatccctaggtcagacgggaacac

SEQ ID NO: 373003 - DNA, 25 bp, Mus musculus
tgatccctctaaaagaagcgtgcaa

SEQ ID NO: 373004 - DNA, 25 bp, Mus musculus
tgatccctctaaaagcttcctgcag

SEQ ID NO: 373005 - DNA, 25 bp, Mus musculus
tgatccgagaggccttggaagctaa

SEQ ID NO: 373006 - DNA, 25 bp, Mus musculus
tgatccgccagtttacagacctgca

SEQ ID NO: 373007 - DNA, 25 bp, Mus musculus
tgatccgcccagtgggggcaggagg

SEQ ID NO: 373008 - DNA, 25 bp, Mus musculus
tgatccggaacggtctgaaggtcac

SEQ ID NO: 373009 - DNA, 25 bp, Mus musculus
tgatccggaacggtggttgtggagg

SEQ ID NO: 373010 - DNA, 25 bp, Mus musculus
tgatcctatggtgaatcccccggag

SEQ ID NO: 373011 - DNA, 25 bp, Mus musculus
tgatcctcatcggggtacttttgat

SEQ ID NO: 373012 - DNA, 25 bp, Mus musculus
tgatcctccgcaatgcacggctgtt

SEQ ID NO: 373013 - DNA, 25 bp, Mus musculus
tgatcctcgcctttggtaccacgta

SEQ ID NO: 373014 - DNA, 25 bp, Mus musculus
tgatcctctgaacctgccgaattcg

SEQ ID NO: 373015 - DNA, 25 bp, Mus musculus
tgatcctgagaatgaatgaacaaaa

SEQ ID NO: 373016 - DNA, 25 bp, Mus musculus
tgatcctgagaatggtctctctggg

SEQ ID NO: 373017 - DNA, 25 bp, Mus musculus
tgatcctgagacttgttcaagggga

SEQ ID NO: 373018 - DNA, 25 bp, Mus musculus
tgatcctggaggctgttcatcagca

SEQ ID NO: 373019 - DNA, 25 bp, Mus musculus
tgatcctggaggtggccttagacat

SEQ ID NO: 373020 - DNA, 25 bp, Mus musculus
tgatcctgggctgggacgaagtagc

SEQ ID NO: 373021 - DNA, 25 bp, Mus musculus
tgatccttcatggcagtgaagaagc

SEQ ID NO: 373022 - DNA, 25 bp, Mus musculus
tgatccttctgagagctgtccagct

SEQ ID NO: 373023 - DNA, 25 bp, Mus musculus
tgatccttctgagccaatagtaacc

SEQ ID NO: 373024 - DNA, 25 bp, Mus musculus
tgatcgaaaggtggcctcctcagat

SEQ ID NO: 373025 - DNA, 25 bp, Mus musculus
tgatcgaagagttagcaatagcgaa

SEQ ID NO: 373026 - DNA, 25 bp, Mus musculus
tgatcgacacaaatgaagaaaaaac

SEQ ID NO: 373027 - DNA, 25 bp, Mus musculus
tgatcgacacaataaaattgaagag

SEQ ID NO: 373028 - DNA, 25 bp, Mus musculus
tgatcgaggcatggccagtaatgtt

SEQ ID NO: 373029 - DNA, 25 bp, Mus musculus
tgatcgaggcatgggtgaacggcct

SEQ ID NO: 373030 - DNA, 25 bp, Mus musculus
tgatcgatgccagaaagaagagctg

SEQ ID NO: 373031 - DNA, 25 bp, Mus musculus
tgatcgatgccagattttgcctcag

SEQ ID NO: 373032 - DNA, 25 bp, Mus musculus
tgatcgatgccaggtttcacttttt

SEQ ID NO: 373033 - DNA, 25 bp, Mus musculus
tgatcgcctcaaggagtatgtctcc

SEQ ID NO: 373034 - DNA, 25 bp, Mus musculus
tgatcgcctgcatcgagggagtaga

SEQ ID NO: 373035 - DNA, 25 bp, Mus musculus
tgatcgctgggttcctgagactgac

SEQ ID NO: 373036 - DNA, 25 bp, Mus musculus
tgatcgcttcaatgcaccgggtgct

SEQ ID NO: 373037 - DNA, 25 bp, Mus musculus
tgatcgctttctgaatggtttggct

SEQ ID NO: 373038 - DNA, 25 bp, Mus musculus
tgatcggagtgccaagacacaagca

SEQ ID NO: 373039 - DNA, 25 bp, Mus musculus
tgatcggagtgccaattattctgtt

SEQ ID NO: 373040 - DNA, 25 bp, Mus musculus
tgatcggctccgagggagcagaagg

SEQ ID NO: 373041 - DNA, 25 bp, Mus musculus
tgatcggctccgaggtgggaaacta

SEQ ID NO: 373042 - DNA, 25 bp, Mus musculus
tgatcgggaacatggagcacatggc

SEQ ID NO: 373043 - DNA, 25 bp, Mus musculus
tgatcgtcacccacagcaatgagag

SEQ ID NO: 373044 - DNA, 25 bp, Mus musculus
tgatcgtgtacagggtgaagttgat

SEQ ID NO: 373045 - DNA, 25 bp, Mus musculus
tgatctacactgttgttggccgccc

SEQ ID NO: 373046 - DNA, 25 bp, Mus musculus
tgatctagaagaagaagctgaagtc

SEQ ID NO: 373047 - DNA, 25 bp, Mus musculus
tgatctagtttgtttggtgtacaga

SEQ ID NO: 373048 - DNA, 25 bp, Mus musculus
tgatctattttcaagaaagtgttgg

SEQ ID NO: 373049 - DNA, 25 bp, Mus musculus
tgatctattttcggatgtacatgct

SEQ ID NO: 373050 - DNA, 25 bp, Mus musculus
tgatctcaagttggagaatttgatg

SEQ ID NO: 373051 - DNA, 25 bp, Mus musculus
tgatctcactcaggctcccatgtgt

SEQ ID NO: 373052 - DNA, 25 bp, Mus musculus
tgatctccaactaggcggccgtcac

SEQ ID NO: 373053 - DNA, 25 bp, Mus musculus
tgatctccaaggactcaggcagctg

SEQ ID NO: 373054 - DNA, 25 bp, Mus musculus
tgatctccaatggactaaattcgga

SEQ ID NO: 373055 - DNA, 25 bp, Mus musculus
tgatctccatgatggtggccagtaa

SEQ ID NO: 373056 - DNA, 25 bp, Mus musculus
tgatctcctaggagtgcgcgatgat

SEQ ID NO: 373057 - DNA, 25 bp, Mus musculus
tgatctcctaggtttcaggaatggg

SEQ ID NO: 373058 - DNA, 25 bp, Mus musculus
tgatctctcaggtgccaacaggatc

SEQ ID NO: 373059 - DNA, 25 bp, Mus musculus
tgatctctcagtgtaccccgaaggt

SEQ ID NO: 373060 - DNA, 25 bp, Mus musculus
tgatctgaagcctggttccctcaac

SEQ ID NO: 373061 - DNA, 25 bp, Mus musculus
tgatctgaaggaaggcgaagtgcac

SEQ ID NO: 373062 - DNA, 25 bp, Mus musculus
tgatctgaccaaggtttggcctcac

SEQ ID NO: 373063 - DNA, 25 bp, Mus musculus
tgatctgagaggcctctcctgcagc

SEQ ID NO: 373064 - DNA, 25 bp, Mus musculus
tgatctgcagactcagccttatgga

SEQ ID NO: 373065 - DNA, 25 bp, Mus musculus
tgatctgcaggaccagtccatgatg

SEQ ID NO: 373066 - DNA, 25 bp, Mus musculus
tgatctgcagtcagcaactcttagg

SEQ ID NO: 373067 - DNA, 25 bp, Mus musculus
tgatctgcggcggtcagggaaactg

SEQ ID NO: 373068 - DNA, 25 bp, Mus musculus
tgatctggaagagactttggccagt

SEQ ID NO: 373069 - DNA, 25 bp, Mus musculus
tgatctggaagatgaagtctatgca

SEQ ID NO: 373070 - DNA, 25 bp, Mus musculus
tgatctggacgatgattctgacagc

SEQ ID NO: 373071 - DNA, 25 bp, Mus musculus
tgatctggagcagcagcctcagggc

SEQ ID NO: 373072 - DNA, 25 bp, Mus musculus
tgatctggagtgccccgagcctaat

SEQ ID NO: 373073 - DNA, 25 bp, Mus musculus
tgatctggagtgtgggccagaccca

SEQ ID NO: 373074 - DNA, 25 bp, Mus musculus
tgatctgtagcacccagttcttgca

SEQ ID NO: 373075 - DNA, 25 bp, Mus musculus
tgatctgtcacttgggagtttgccc

SEQ ID NO: 373076 - DNA, 25 bp, Mus musculus
tgatctgtgccatgccaggtggttc

SEQ ID NO: 373077 - DNA, 25 bp, Mus musculus
tgatcttaagatgtcagtagaaaca

SEQ ID NO: 373078 - DNA, 25 bp, Mus musculus
tgatcttaaggatcgagagcgatga

SEQ ID NO: 373079 - DNA, 25 bp, Mus musculus
tgatcttaataatcctattgcagtg

SEQ ID NO: 373080 - DNA, 25 bp, Mus musculus
tgatcttcagctacattttcagctt

SEQ ID NO: 373081 - DNA, 25 bp, Mus musculus
tgatcttcagggggtgattagtgtt

SEQ ID NO: 373082 - DNA, 25 bp, Mus musculus
tgatcttcctggacaaaccaattct

SEQ ID NO: 373083 - DNA, 25 bp, Mus musculus
tgatcttctaaagttgattgaatca

SEQ ID NO: 373084 - DNA, 25 bp, Mus musculus
tgatcttctgccatacccgcaaaac

SEQ ID NO: 373085 - DNA, 25 bp, Mus musculus
tgatcttgaacggggtgccacggct

SEQ ID NO: 373086 - DNA, 25 bp, Mus musculus
tgatcttgaactcacagaaggaagg

SEQ ID NO: 373087 - DNA, 25 bp, Mus musculus
tgatcttgagtctgcaactgtgtct

SEQ ID NO: 373088 - DNA, 25 bp, Mus musculus
tgatcttgataaaagtgaatttcct

SEQ ID NO: 373089 - DNA, 25 bp, Mus musculus
tgatcttgataggatctgcttaaat

SEQ ID NO: 373090 - DNA, 25 bp, Mus musculus
tgatcttgctattgaagtggacctt

SEQ ID NO: 373091 - DNA, 25 bp, Mus musculus
tgatcttggggagtgggaggtgctg

SEQ ID NO: 373092 - DNA, 25 bp, Mus musculus
tgatcttgtgagagggtctgcattt

SEQ ID NO: 373093 - DNA, 25 bp, Mus musculus
tgatctttaaatatatttactggct

SEQ ID NO: 373094 - DNA, 25 bp, Mus musculus
tgatctttaagaatggtgacaagta

SEQ ID NO: 373095 - DNA, 25 bp, Mus musculus
tgatctttagaagactgctggacac

SEQ ID NO: 373096 - DNA, 25 bp, Mus musculus
tgatctttccaaaagcaactgcttt

SEQ ID NO: 373097 - DNA, 25 bp, Mus musculus
tgatctttccaaaagctcctgggac

SEQ ID NO: 373098 - DNA, 25 bp, Mus musculus
tgatctttctcagattccttgtaat

SEQ ID NO: 373099 - DNA, 25 bp, Mus musculus
tgatgaaaaacagggaagctgcccg

SEQ ID NO: 373100 - DNA, 25 bp, Mus musculus
tgatgaaaaacagggaagctgctaa

SEQ ID NO: 373101 - DNA, 25 bp, Mus musculus
tgatgaaaaacgtgaagcttccctc

SEQ ID NO: 373102 - DNA, 25 bp, Mus musculus
tgatgaaaacaccaggcagtggtgg

SEQ ID NO: 373103 - DNA, 25 bp, Mus musculus
tgatgaaaacggaacaccagatgca

SEQ ID NO: 373104 - DNA, 25 bp, Mus musculus
tgatgaaaacgttgtatcagagtaa

SEQ ID NO: 373105 - DNA, 25 bp, Mus musculus
tgatgaaaactacatggaatttcta

SEQ ID NO: 373106 - DNA, 25 bp, Mus musculus
tgatgaaaagcttgttcggccagtc

SEQ ID NO: 373107 - DNA, 25 bp, Mus musculus
tgatgaaaaggaagtaccattggca

SEQ ID NO: 373108 - DNA, 25 bp, Mus musculus
tgatgaaacagtcaaaacaattcac

SEQ ID NO: 373109 - DNA, 25 bp, Mus musculus
tgatgaaacagtgaaaaccataagg

SEQ ID NO: 373110 - DNA, 25 bp, Mus musculus
tgatgaaagagaaaaaaatctggat

SEQ ID NO: 373111 - DNA, 25 bp, Mus musculus
tgatgaaagcagccatgtactcggt

SEQ ID NO: 373112 - DNA, 25 bp, Mus musculus
tgatgaaagcagtggtccatgccgt

SEQ ID NO: 373113 - DNA, 25 bp, Mus musculus
tgatgaaagggaggctacagacaca

SEQ ID NO: 373114 - DNA, 25 bp, Mus musculus
tgatgaaaggggagggcactgacac

SEQ ID NO: 373115 - DNA, 25 bp, Mus musculus
tgatgaaatagactctttcctacga

SEQ ID NO: 373116 - DNA, 25 bp, Mus musculus
tgatgaaatgctttgaaccctgaaa

SEQ ID NO: 373117 - DNA, 25 bp, Mus musculus
tgatgaaatggaaaaactctgatga

SEQ ID NO: 373118 - DNA, 25 bp, Mus musculus
tgatgaaatggtcttcttcccgtgt

SEQ ID NO: 373119 - DNA, 25 bp, Mus musculus
tgatgaaattacttctgaaaagcaa

SEQ ID NO: 373120 - DNA, 25 bp, Mus musculus
tgatgaaattatacgacctcctgtg

SEQ ID NO: 373121 - DNA, 25 bp, Mus musculus
tgatgaaattgagcaactgaagcag

SEQ ID NO: 373122 - DNA, 25 bp, Mus musculus
tgatgaacatggaagggttattaat

SEQ ID NO: 373123 - DNA, 25 bp, Mus musculus
tgatgaacatggtgaagattcctgt

SEQ ID NO: 373124 - DNA, 25 bp, Mus musculus
tgatgaactcagctctgatgtctcc

SEQ ID NO: 373125 - DNA, 25 bp, Mus musculus
tgatgaactgaatccaaatccagat

SEQ ID NO: 373126 - DNA, 25 bp, Mus musculus
tgatgaactgcctgacttgtgacac

SEQ ID NO: 373127 - DNA, 25 bp, Mus musculus
tgatgaagaccgggcatctggagat

SEQ ID NO: 373128 - DNA, 25 bp, Mus musculus
tgatgaagatcgctgagatccgaaa

SEQ ID NO: 373129 - DNA, 25 bp, Mus musculus
tgatgaagcatgcggatccccggat

SEQ ID NO: 373130 - DNA, 25 bp, Mus musculus
tgatgaagcatgcggtttctgatgt

SEQ ID NO: 373131 - DNA, 25 bp, Mus musculus
tgatgaagccagaagatgtagctaa

SEQ ID NO: 373132 - DNA, 25 bp, Mus musculus
tgatgaagccagatgctgatgctgt

SEQ ID NO: 373133 - DNA, 25 bp, Mus musculus
tgatgaagccagcactagcaacaag

SEQ ID NO: 373134 - DNA, 25 bp, Mus musculus
tgatgaatcccaaaggccctgccaa

SEQ ID NO: 373135 - DNA, 25 bp, Mus musculus
tgatgaatgacgaataggtgaaggg

SEQ ID NO: 373136 - DNA, 25 bp, Mus musculus
tgatgaatggcaagtgactgtctgc

SEQ ID NO: 373137 - DNA, 25 bp, Mus musculus
tgatgaatggcagtcactacagcta

SEQ ID NO: 373138 - DNA, 25 bp, Mus musculus
tgatgacaaacaagctgctaactca

SEQ ID NO: 373139 - DNA, 25 bp, Mus musculus
tgatgacaaacaagctttgaaaagt

SEQ ID NO: 373140 - DNA, 25 bp, Mus musculus
tgatgacaactacgaaagagcctgt

SEQ ID NO: 373141 - DNA, 25 bp, Mus musculus
tgatgacaattttgaagaaggcgag

SEQ ID NO: 373142 - DNA, 25 bp, Mus musculus
tgatgacacagattctgagctgggg

SEQ ID NO: 373143 - DNA, 25 bp, Mus musculus
tgatgacactggctgcggctggaag

SEQ ID NO: 373144 - DNA, 25 bp, Mus musculus
tgatgacagtatggaagggcctagt

SEQ ID NO: 373145 - DNA, 25 bp, Mus musculus
tgatgaccaaggaggagcccctgcc

SEQ ID NO: 373146 - DNA, 25 bp, Mus musculus
tgatgaccagagttacaagcacctt

SEQ ID NO: 373147 - DNA, 25 bp, Mus musculus
tgatgaccaggatctgacacacatg

SEQ ID NO: 373148 - DNA, 25 bp, Mus musculus
tgatgaccaggattacttacactcg

SEQ ID NO: 373149 - DNA, 25 bp, Mus musculus
tgatgacccagtcttatctcctctg

SEQ ID NO: 373150 - DNA, 25 bp, Mus musculus
tgatgacctggaagacgagctctat

SEQ ID NO: 373151 - DNA, 25 bp, Mus musculus
tgatgacctggaagataaactgaag

SEQ ID NO: 373152 - DNA, 25 bp, Mus musculus
tgatgacgagctaaccttcttttaa

SEQ ID NO: 373153 - DNA, 25 bp, Mus musculus
tgatgacgagctctcttctcttccc

SEQ ID NO: 373154 - DNA, 25 bp, Mus musculus
tgatgacgatggtctcccttctcag

SEQ ID NO: 373155 - DNA, 25 bp, Mus musculus
tgatgactaccatcatcgagaagaa

SEQ ID NO: 373156 - DNA, 25 bp, Mus musculus
tgatgactccgaaccaactgtgaga

SEQ ID NO: 373157 - DNA, 25 bp, Mus musculus
tgatgactcgaaggaacctaagtca

SEQ ID NO: 373158 - DNA, 25 bp, Mus musculus
tgatgacttagaagacgagctgtat

SEQ ID NO: 373159 - DNA, 25 bp, Mus musculus
tgatgacttagaagagaaagtggcc

SEQ ID NO: 373160 - DNA, 25 bp, Mus musculus
tgatgacttagaagataagtttctt

SEQ ID NO: 373161 - DNA, 25 bp, Mus musculus
tgatgacttagaagatcaactctac

SEQ ID NO: 373162 - DNA, 25 bp, Mus musculus
tgatgagaaaaaggtcctggagtgg

SEQ ID NO: 373163 - DNA, 25 bp, Mus musculus
tgatgagaaaggaaatttcttggtc

SEQ ID NO: 373164 - DNA, 25 bp, Mus musculus
tgatgagaaaggggaggagcgctac

SEQ ID NO: 373165 - DNA, 25 bp, Mus musculus
tgatgagacaaagggagctgaaggt

SEQ ID NO: 373166 - DNA, 25 bp, Mus musculus
tgatgagcaggaaaagaagccggaa

SEQ ID NO: 373167 - DNA, 25 bp, Mus musculus
tgatgagccagtcccgcatccttca

SEQ ID NO: 373168 - DNA, 25 bp, Mus musculus
tgatgagctcaacggtttagcctgg

SEQ ID NO: 373169 - DNA, 25 bp, Mus musculus
tgatgagctcaactctgaagtgtcc

SEQ ID NO: 373170 - DNA, 25 bp, Mus musculus
tgatgagctcaagggtttagcctgg

SEQ ID NO: 373171 - DNA, 25 bp, Mus musculus
tgatgagctcaagtctgaagtgtcc

SEQ ID NO: 373172 - DNA, 25 bp, Mus musculus
tgatgaggagatactggagtgtgga

SEQ ID NO: 373173 - DNA, 25 bp, Mus musculus
tgatgaggataaagaatgacagccc

SEQ ID NO: 373174 - DNA, 25 bp, Mus musculus
tgatgaggatgaagatgatgaggaa

SEQ ID NO: 373175 - DNA, 25 bp, Mus musculus
tgatgaggcgaaggaaagctcacaa

SEQ ID NO: 373176 - DNA, 25 bp, Mus musculus
tgatgagggtaagtatcagatggag

SEQ ID NO: 373177 - DNA, 25 bp, Mus musculus
tgatgagtcacaattttatattggc

SEQ ID NO: 373178 - DNA, 25 bp, Mus musculus
tgatgagtgagatcgcagccttccc

SEQ ID NO: 373179 - DNA, 25 bp, Mus musculus
tgatgagtgagatcgtttcctcctc

SEQ ID NO: 373180 - DNA, 25 bp, Mus musculus
tgatgagtggtacatatgacaatgg

SEQ ID NO: 373181 - DNA, 25 bp, Mus musculus
tgatgagtggtacgacatgacaatg

SEQ ID NO: 373182 - DNA, 25 bp, Mus musculus
tgatgagttcattgcaattcttggc

SEQ ID NO: 373183 - DNA, 25 bp, Mus musculus
tgatgagttctcccataccctccac

SEQ ID NO: 373184 - DNA, 25 bp, Mus musculus
tgatgataagaacaaattggaagaa

SEQ ID NO: 373185 - DNA, 25 bp, Mus musculus
tgatgatacttatgaccacggctct

SEQ ID NO: 373186 - DNA, 25 bp, Mus musculus
tgatgatagaatgttgctggtgaag

SEQ ID NO: 373187 - DNA, 25 bp, Mus musculus
tgatgatatctttgtatatgaggtg

SEQ ID NO: 373188 - DNA, 25 bp, Mus musculus
tgatgatcaggaatctagagaagca

SEQ ID NO: 373189 - DNA, 25 bp, Mus musculus
tgatgatcaggaccagtgtccagac

SEQ ID NO: 373190 - DNA, 25 bp, Mus musculus
tgatgatccagaagcaacatggctt

SEQ ID NO: 373191 - DNA, 25 bp, Mus musculus
tgatgatcgtggaccctgccatcag

SEQ ID NO: 373192 - DNA, 25 bp, Mus musculus
tgatgatcgtggcgggatccgcaga

SEQ ID NO: 373193 - DNA, 25 bp, Mus musculus
tgatgatcgtggtttggcctggaac

SEQ ID NO: 373194 - DNA, 25 bp, Mus musculus
tgatgatctattggatgatacatgg

SEQ ID NO: 373195 - DNA, 25 bp, Mus musculus
tgatgatctggaagagactttggcc

SEQ ID NO: 373196 - DNA, 25 bp, Mus musculus
tgatgatctggaagatgaagtctat

SEQ ID NO: 373197 - DNA, 25 bp, Mus musculus
tgatgatcttgagtctgcaactgtg

SEQ ID NO: 373198 - DNA, 25 bp, Mus musculus
tgatgatgagaagggcaggtcccct

SEQ ID NO: 373199 - DNA, 25 bp, Mus musculus
tgatgatgagcaggaaaagaagccg

SEQ ID NO: 373200 - DNA, 25 bp, Mus musculus
tgatgatgcagggccctggccacat

SEQ ID NO: 373201 - DNA, 25 bp, Mus musculus
tgatgatggagaggtggacatggaa

SEQ ID NO: 373202 - DNA, 25 bp, Mus musculus
tgatgatggcttagatgaaatcatc

SEQ ID NO: 373203 - DNA, 25 bp, Mus musculus
tgatgatgtgcctgatgacattatg

SEQ ID NO: 373204 - DNA, 25 bp, Mus musculus
tgatgatgtttttccctaggcagtc

SEQ ID NO: 373205 - DNA, 25 bp, Mus musculus
tgatgattaacctggtgctggattt

SEQ ID NO: 373206 - DNA, 25 bp, Mus musculus
tgatgattcacagtggtaagattgg

SEQ ID NO: 373207 - DNA, 25 bp, Mus musculus
tgatgatttcgatagcaatgcagtt

SEQ ID NO: 373208 - DNA, 25 bp, Mus musculus
tgatgattttaatagctcgatgacc

SEQ ID NO: 373209 - DNA, 25 bp, Mus musculus
tgatgattttaatagtgctagccat

SEQ ID NO: 373210 - DNA, 25 bp, Mus musculus
tgatgcaaaaaggtctgctgaagac

SEQ ID NO: 373211 - DNA, 25 bp, Mus musculus
tgatgcaaagttccaggtgttcctg

SEQ ID NO: 373212 - DNA, 25 bp, Mus musculus
tgatgcaagggttctggaatactta

SEQ ID NO: 373213 - DNA, 25 bp, Mus musculus
tgatgcaattcgggaggctttggag

SEQ ID NO: 373214 - DNA, 25 bp, Mus musculus
tgatgcaatttaaaattgtggtggg

SEQ ID NO: 373215 - DNA, 25 bp, Mus musculus
tgatgcacgggaaggaagtgggcag

SEQ ID NO: 373216 - DNA, 25 bp, Mus musculus
tgatgcactgaccctgcagttgggt

SEQ ID NO: 373217 - DNA, 25 bp, Mus musculus
tgatgcactgtcagaacaagcctgc

SEQ ID NO: 373218 - DNA, 25 bp, Mus musculus
tgatgcactgtcaggttccgagtcc

SEQ ID NO: 373219 - DNA, 25 bp, Mus musculus
tgatgcagacggagaagcagttctt

SEQ ID NO: 373220 - DNA, 25 bp, Mus musculus
tgatgcagacttccacagcacagcc

SEQ ID NO: 373221 - DNA, 25 bp, Mus musculus
tgatgcagacttccgggtctgacag

SEQ ID NO: 373222 - DNA, 25 bp, Mus musculus
tgatgcagagactgtgctgtatctg

SEQ ID NO: 373223 - DNA, 25 bp, Mus musculus
tgatgcagaggccaagaagatagca

SEQ ID NO: 373224 - DNA, 25 bp, Mus musculus
tgatgcagctatgaaggggctggca

SEQ ID NO: 373225 - DNA, 25 bp, Mus musculus
tgatgcagctccccaccacttactt

SEQ ID NO: 373226 - DNA, 25 bp, Mus musculus
tgatgcaggagactgacggttctgt

SEQ ID NO: 373227 - DNA, 25 bp, Mus musculus
tgatgcagtgcaggcaatacagagt

SEQ ID NO: 373228 - DNA, 25 bp, Mus musculus
tgatgcatcattgtcgctgcccagg

SEQ ID NO: 373229 - DNA, 25 bp, Mus musculus
tgatgcatccgatgtcgtcctggag

SEQ ID NO: 373230 - DNA, 25 bp, Mus musculus
tgatgcattcacagggtgatcttgt

SEQ ID NO: 373231 - DNA, 25 bp, Mus musculus
tgatgccaagtttgagcatgccacc

SEQ ID NO: 373232 - DNA, 25 bp, Mus musculus
tgatgccaagtttgagtctggagac

SEQ ID NO: 373233 - DNA, 25 bp, Mus musculus
tgatgccatgaagccattttcagtc

SEQ ID NO: 373234 - DNA, 25 bp, Mus musculus
tgatgccattccaggtaaatgggcc

SEQ ID NO: 373235 - DNA, 25 bp, Mus musculus
tgatgcccaaggcaacttaagggct

SEQ ID NO: 373236 - DNA, 25 bp, Mus musculus
tgatgcccaggacttagaagagttc

SEQ ID NO: 373237 - DNA, 25 bp, Mus musculus
tgatgcccagtcttaccatgagcgg

SEQ ID NO: 373238 - DNA, 25 bp, Mus musculus
tgatgccccaggaaacacaattaga

SEQ ID NO: 373239 - DNA, 25 bp, Mus musculus
tgatgccccaggtaacacaattaga

SEQ ID NO: 373240 - DNA, 25 bp, Mus musculus
tgatgcccccacttaatgcccaaag

SEQ ID NO: 373241 - DNA, 25 bp, Mus musculus
tgatgccctgcaccactttgccagc

SEQ ID NO: 373242 - DNA, 25 bp, Mus musculus
tgatgcctcacctgctccaggtttc

SEQ ID NO: 373243 - DNA, 25 bp, Mus musculus
tgatgcctcacctgggtgctacaga

SEQ ID NO: 373244 - DNA, 25 bp, Mus musculus
tgatgcctcaggttcaaccaggccc

SEQ ID NO: 373245 - DNA, 25 bp, Mus musculus
tgatgcctccgctggaaaccatggc

SEQ ID NO: 373246 - DNA, 25 bp, Mus musculus
tgatgcctgcataaggttataagta

SEQ ID NO: 373247 - DNA, 25 bp, Mus musculus
tgatgcctgcataagtgagcaactg

SEQ ID NO: 373248 - DNA, 25 bp, Mus musculus
tgatgcgcaagggctacgagggcct

SEQ ID NO: 373249 - DNA, 25 bp, Mus musculus
tgatgcgcaaggtatgaatgctgct

SEQ ID NO: 373250 - DNA, 25 bp, Mus musculus
tgatgcggagaatataggcaaagag

SEQ ID NO: 373251 - DNA, 25 bp, Mus musculus
tgatgcgtgccagggcgacagtgga

SEQ ID NO: 373252 - DNA, 25 bp, Mus musculus
tgatgctacaggtaaagtccttttc

SEQ ID NO: 373253 - DNA, 25 bp, Mus musculus
tgatgctagagaggaggtggctgaa

SEQ ID NO: 373254 - DNA, 25 bp, Mus musculus
tgatgctagagcctcagtctgaaaa

SEQ ID NO: 373255 - DNA, 25 bp, Mus musculus
tgatgctagctctggtacacctaca

SEQ ID NO: 373256 - DNA, 25 bp, Mus musculus
tgatgctcacagagaacagtacact

SEQ ID NO: 373257 - DNA, 25 bp, Mus musculus
tgatgctcacaggaagttcattcaa

SEQ ID NO: 373258 - DNA, 25 bp, Mus musculus
tgatgctcccaacaggttctgggcc

SEQ ID NO: 373259 - DNA, 25 bp, Mus musculus
tgatgctgaccagatcgtgagacat

SEQ ID NO: 373260 - DNA, 25 bp, Mus musculus
tgatgctgaccagcacgtaacttct

SEQ ID NO: 373261 - DNA, 25 bp, Mus musculus
tgatgctgaccaggatcttcccaac

SEQ ID NO: 373262 - DNA, 25 bp, Mus musculus
tgatgctgaccgagatccctgacga

SEQ ID NO: 373263 - DNA, 25 bp, Mus musculus
tgatgctgacggtcacagagctgct

SEQ ID NO: 373264 - DNA, 25 bp, Mus musculus
tgatgctgaggcctgacctggagct

SEQ ID NO: 373265 - DNA, 25 bp, Mus musculus
tgatgctgcagaatatgtgtacatg

SEQ ID NO: 373266 - DNA, 25 bp, Mus musculus
tgatgctgccaggagacgctctgtc

SEQ ID NO: 373267 - DNA, 25 bp, Mus musculus
tgatgctgcgaagctgatggtgcct

SEQ ID NO: 373268 - DNA, 25 bp, Mus musculus
tgatgctggccagccggtttaagca

SEQ ID NO: 373269 - DNA, 25 bp, Mus musculus
tgatgctgtagagagacaatgtcta

SEQ ID NO: 373270 - DNA, 25 bp, Mus musculus
tgatgctgtccactttgatcttcat

SEQ ID NO: 373271 - DNA, 25 bp, Mus musculus
tgatgctgtgcaaagtgcacaccgt

SEQ ID NO: 373272 - DNA, 25 bp, Mus musculus
tgatgctgtggacaaggtctctttc

SEQ ID NO: 373273 - DNA, 25 bp, Mus musculus
tgatgctgtggactgtgtttgaagg

SEQ ID NO: 373274 - DNA, 25 bp, Mus musculus
tgatgcttcagctgagtgtgacaga

SEQ ID NO: 373275 - DNA, 25 bp, Mus musculus
tgatgcttcagctgggtggcacagt

SEQ ID NO: 373276 - DNA, 25 bp, Mus musculus
tgatgcttgcggaatgcagcccgca

SEQ ID NO: 373277 - DNA, 25 bp, Mus musculus
tgatgcttgcgtgcaatgctcaccc

SEQ ID NO: 373278 - DNA, 25 bp, Mus musculus
tgatgcttttcctggagagcctgac

SEQ ID NO: 373279 - DNA, 25 bp, Mus musculus
tgatggaaagaaaattgcccaggaa

SEQ ID NO: 373280 - DNA, 25 bp, Mus musculus
tgatggaaagctgagcccaggaagt

SEQ ID NO: 373281 - DNA, 25 bp, Mus musculus
tgatggaaaggagttctggcaggta

SEQ ID NO: 373282 - DNA, 25 bp, Mus musculus
tgatggaaagggtccaattggttcc

SEQ ID NO: 373283 - DNA, 25 bp, Mus musculus
tgatggaacaagacttgatttcatt

SEQ ID NO: 373284 - DNA, 25 bp, Mus musculus
tgatggaacaagtgcatggaggact

SEQ ID NO: 373285 - DNA, 25 bp, Mus musculus
tgatggaattgaacttttgagcaga

SEQ ID NO: 373286 - DNA, 25 bp, Mus musculus
tgatggacaagaaaaagaataatct

SEQ ID NO: 373287 - DNA, 25 bp, Mus musculus
tgatggacaaggtggagtttgtcca

SEQ ID NO: 373288 - DNA, 25 bp, Mus musculus
tgatggacagccctgggatcgatgt

SEQ ID NO: 373289 - DNA, 25 bp, Mus musculus
tgatggacaggaaacagacagctga

SEQ ID NO: 373290 - DNA, 25 bp, Mus musculus
tgatggacaggtttttggtgcatta

SEQ ID NO: 373291 - DNA, 25 bp, Mus musculus
tgatggacatatcaattactgggat

SEQ ID NO: 373292 - DNA, 25 bp, Mus musculus
tgatggacatatcatcataccccac

SEQ ID NO: 373293 - DNA, 25 bp, Mus musculus
tgatggaccatgaagcaaagctgct

SEQ ID NO: 373294 - DNA, 25 bp, Mus musculus
tgatggagaacaggatgaagaagag

SEQ ID NO: 373295 - DNA, 25 bp, Mus musculus
tgatggagagaggtgccagcgtgga

SEQ ID NO: 373296 - DNA, 25 bp, Mus musculus
tgatggagaggtggacatggaaggc

SEQ ID NO: 373297 - DNA, 25 bp, Mus musculus
tgatggagagttatttgcttggggc

SEQ ID NO: 373298 - DNA, 25 bp, Mus musculus
tgatggagatgagaagaagccgggc

SEQ ID NO: 373299 - DNA, 25 bp, Mus musculus
tgatggagatgcgctccctccttta

SEQ ID NO: 373300 - DNA, 25 bp, Mus musculus
tgatggagatggggtcctaaaggaa

SEQ ID NO: 373301 - DNA, 25 bp, Mus musculus
tgatggagctctatggccgagaacc

SEQ ID NO: 373302 - DNA, 25 bp, Mus musculus
tgatggaggagtcttctatgagtgc

SEQ ID NO: 373303 - DNA, 25 bp, Mus musculus
tgatggagtcggctcttaaccggct

SEQ ID NO: 373304 - DNA, 25 bp, Mus musculus
tgatggagtctctggagcagcgtgc

SEQ ID NO: 373305 - DNA, 25 bp, Mus musculus
tgatggagtgaagtgcctcagagcg

SEQ ID NO: 373306 - DNA, 25 bp, Mus musculus
tgatggagttggacattggtgccca

SEQ ID NO: 373307 - DNA, 25 bp, Mus musculus
tgatggatatagacaacagaaagcc

SEQ ID NO: 373308 - DNA, 25 bp, Mus musculus
tgatggattgtcgcgatagagtaca

SEQ ID NO: 373309 - DNA, 25 bp, Mus musculus
tgatggattttaagggtctcacacc

SEQ ID NO: 373310 - DNA, 25 bp, Mus musculus
tgatggcaaaagtttcttctgggac

SEQ ID NO: 373311 - DNA, 25 bp, Mus musculus
tgatggcaagatcttctgtgtgcat

SEQ ID NO: 373312 - DNA, 25 bp, Mus musculus
tgatggcaagggtcatgtgggtaca

SEQ ID NO: 373313 - DNA, 25 bp, Mus musculus
tgatggcaaggtgctgtctgaaacc

SEQ ID NO: 373314 - DNA, 25 bp, Mus musculus
tgatggcaatgccaggtggcccaga

SEQ ID NO: 373315 - DNA, 25 bp, Mus musculus
tgatggcaatgccaggttgaacgac

SEQ ID NO: 373316 - DNA, 25 bp, Mus musculus
tgatggcacagaagatgctgacaaa

SEQ ID NO: 373317 - DNA, 25 bp, Mus musculus
tgatggcagagtgttcaacttctgt

SEQ ID NO: 373318 - DNA, 25 bp, Mus musculus
tgatggcatgtgtccaaatgatgag

SEQ ID NO: 373319 - DNA, 25 bp, Mus musculus
tgatggccaggcctagccaggtgta

SEQ ID NO: 373320 - DNA, 25 bp, Mus musculus
tgatggccatggtcaagaaaaaaaa

SEQ ID NO: 373321 - DNA, 25 bp, Mus musculus
tgatggccggggacctgaagacgag

SEQ ID NO: 373322 - DNA, 25 bp, Mus musculus
tgatggcgactgttgccctctatac

SEQ ID NO: 373323 - DNA, 25 bp, Mus musculus
tgatggctacagggtttatttggtc

SEQ ID NO: 373324 - DNA, 25 bp, Mus musculus
tgatggctattcggagaataatgtt

SEQ ID NO: 373325 - DNA, 25 bp, Mus musculus
tgatggctgatgaggtataccaaga

SEQ ID NO: 373326 - DNA, 25 bp, Mus musculus
tgatggcttagatgaaatcatcatg

SEQ ID NO: 373327 - DNA, 25 bp, Mus musculus
tgatggcttgcacgggtcaagtcat

SEQ ID NO: 373328 - DNA, 25 bp, Mus musculus
tgatggcttgcaggggtcaagtcat

SEQ ID NO: 373329 - DNA, 25 bp, Mus musculus
tgatgggaagaaacctgatcaggac

SEQ ID NO: 373330 - DNA, 25 bp, Mus musculus
tgatgggaagaaccagcaagagaca

SEQ ID NO: 373331 - DNA, 25 bp, Mus musculus
tgatgggaagcaggtacccacccgg

SEQ ID NO: 373332 - DNA, 25 bp, Mus musculus
tgatgggaaggacaaaccagagaag

SEQ ID NO: 373333 - DNA, 25 bp, Mus musculus
tgatgggaaggtatggatgtattgt

SEQ ID NO: 373334 - DNA, 25 bp, Mus musculus
tgatgggaaggtggcagtgaacctg

SEQ ID NO: 373335 - DNA, 25 bp, Mus musculus
tgatgggagagcaagccctcatgag

SEQ ID NO: 373336 - DNA, 25 bp, Mus musculus
tgatgggagaggctttgaagactgc

SEQ ID NO: 373337 - DNA, 25 bp, Mus musculus
tgatgggagcacagaggggaaggcc

SEQ ID NO: 373338 - DNA, 25 bp, Mus musculus
tgatgggagcacagtgtgcagcttg

SEQ ID NO: 373339 - DNA, 25 bp, Mus musculus
tgatgggcaaggctgggtgggtgaa

SEQ ID NO: 373340 - DNA, 25 bp, Mus musculus
tgatgggcaggcaccaggagagctc

SEQ ID NO: 373341 - DNA, 25 bp, Mus musculus
tgatgggcccacctcctggcatgcg

SEQ ID NO: 373342 - DNA, 25 bp, Mus musculus
tgatgggcggagatctgagtgcccg

SEQ ID NO: 373343 - DNA, 25 bp, Mus musculus
tgatgggctgcagggacctcccggg

SEQ ID NO: 373344 - DNA, 25 bp, Mus musculus
tgatggggcagaagaaactcttggt

SEQ ID NO: 373345 - DNA, 25 bp, Mus musculus
tgatggggtcccaggaggagtggga

SEQ ID NO: 373346 - DNA, 25 bp, Mus musculus
tgatggggtcccagggatccgtttc

SEQ ID NO: 373347 - DNA, 25 bp, Mus musculus
tgatgggtagtgatgtaagcggtaa

SEQ ID NO: 373348 - DNA, 25 bp, Mus musculus
tgatgggtcctggagtgaacccaac

SEQ ID NO: 373349 - DNA, 25 bp, Mus musculus
tgatggtaaaaatactggctcgaat

SEQ ID NO: 373350 - DNA, 25 bp, Mus musculus
tgatggtaagcttctctctaacagc

SEQ ID NO: 373351 - DNA, 25 bp, Mus musculus
tgatggtacctacccagcgtcccca

SEQ ID NO: 373352 - DNA, 25 bp, Mus musculus
tgatggtagacggggtattgaaggg

SEQ ID NO: 373353 - DNA, 25 bp, Mus musculus
tgatggtcaaggttgttcctacatg

SEQ ID NO: 373354 - DNA, 25 bp, Mus musculus
tgatggtcaggaagcctgctgcgtg

SEQ ID NO: 373355 - DNA, 25 bp, Mus musculus
tgatggtcaggtgtgacagacatca

SEQ ID NO: 373356 - DNA, 25 bp, Mus musculus
tgatggtccaaagggcaacccaggt

SEQ ID NO: 373357 - DNA, 25 bp, Mus musculus
tgatggtcccaaaggtgcagctggc

SEQ ID NO: 373358 - DNA, 25 bp, Mus musculus
tgatggtccctctggtcttgatggt

SEQ ID NO: 373359 - DNA, 25 bp, Mus musculus
tgatggtgaagatcccatacatcac

SEQ ID NO: 373360 - DNA, 25 bp, Mus musculus
tgatggtgacggggatcgaaacatg

SEQ ID NO: 373361 - DNA, 25 bp, Mus musculus
tgatggtgagaagggagaggctggt

SEQ ID NO: 373362 - DNA, 25 bp, Mus musculus
tgatggtgaggtctagtgacaggat

SEQ ID NO: 373363 - DNA, 25 bp, Mus musculus
tgatggtgcacgcctctgcctcccg

SEQ ID NO: 373364 - DNA, 25 bp, Mus musculus
tgatggtgctcagggtacagcatgt

SEQ ID NO: 373365 - DNA, 25 bp, Mus musculus
tgatggttcctcagaaaatgaagtc

SEQ ID NO: 373366 - DNA, 25 bp, Mus musculus
tgatggttcctcagagccgagcaat

SEQ ID NO: 373367 - DNA, 25 bp, Mus musculus
tgatggttgaaatagaattgatgga

SEQ ID NO: 373368 - DNA, 25 bp, Mus musculus
tgatggttgaaatagagggaccagt

SEQ ID NO: 373369 - DNA, 25 bp, Mus musculus
tgatgtaaagattttgctggaagaa

SEQ ID NO: 373370 - DNA, 25 bp, Mus musculus
tgatgtacaagaaagggaagatgaa

SEQ ID NO: 373371 - DNA, 25 bp, Mus musculus
tgatgtacaggtcatagatgagcag

SEQ ID NO: 373372 - DNA, 25 bp, Mus musculus
tgatgtaccagggagtggctggatg

SEQ ID NO: 373373 - DNA, 25 bp, Mus musculus
tgatgtacgcaccagttgaattttc

SEQ ID NO: 373374 - DNA, 25 bp, Mus musculus
tgatgtacgccagtgaattcatctt

SEQ ID NO: 373375 - DNA, 25 bp, Mus musculus
tgatgtacttcaggccacagacttc

SEQ ID NO: 373376 - DNA, 25 bp, Mus musculus
tgatgtatcagggtaagacatacaa

SEQ ID NO: 373377 - DNA, 25 bp, Mus musculus
tgatgtatgaggcttcctgcgggca

SEQ ID NO: 373378 - DNA, 25 bp, Mus musculus
tgatgtattggctggatcccaagtc

SEQ ID NO: 373379 - DNA, 25 bp, Mus musculus
tgatgtatttgtggggtaatcagga

SEQ ID NO: 373380 - DNA, 25 bp, Mus musculus
tgatgtcaacagccgcctggtttac

SEQ ID NO: 373381 - DNA, 25 bp, Mus musculus
tgatgtcaacagccggtgataactc

SEQ ID NO: 373382 - DNA, 25 bp, Mus musculus
tgatgtcaatcacaacttgaaagat

SEQ ID NO: 373383 - DNA, 25 bp, Mus musculus
tgatgtcacctcggctaaggatggg

SEQ ID NO: 373384 - DNA, 25 bp, Mus musculus
tgatgtcacgaagccagcgatctct

SEQ ID NO: 373385 - DNA, 25 bp, Mus musculus
tgatgtcacgccgcataactcatca

SEQ ID NO: 373386 - DNA, 25 bp, Mus musculus
tgatgtcacggtctattacaatggc

SEQ ID NO: 373387 - DNA, 25 bp, Mus musculus
tgatgtcagcgtcaatactatcaat

SEQ ID NO: 373388 - DNA, 25 bp, Mus musculus
tgatgtcatccaggaggtggagtat

SEQ ID NO: 373389 - DNA, 25 bp, Mus musculus
tgatgtcatgcaagcatttgacatg

SEQ ID NO: 373390 - DNA, 25 bp, Mus musculus
tgatgtcatgcaaggttcaaaggga

SEQ ID NO: 373391 - DNA, 25 bp, Mus musculus
tgatgtcatgcaagtttgtatgccg

SEQ ID NO: 373392 - DNA, 25 bp, Mus musculus
tgatgtcattctcccatgtgtgaag

SEQ ID NO: 373393 - DNA, 25 bp, Mus musculus
tgatgtccaagtacaaatatagaga

SEQ ID NO: 373394 - DNA, 25 bp, Mus musculus
tgatgtccatgaggcctgtcccagg

SEQ ID NO: 373395 - DNA, 25 bp, Mus musculus
tgatgtccgagaggtcattgctaga

SEQ ID NO: 373396 - DNA, 25 bp, Mus musculus
tgatgtccgggcactagagcagcca

SEQ ID NO: 373397 - DNA, 25 bp, Mus musculus
tgatgtcctatatgaactgagaaac

SEQ ID NO: 373398 - DNA, 25 bp, Mus musculus
tgatgtcctgggtcatggtagtatc

SEQ ID NO: 373399 - DNA, 25 bp, Mus musculus
tgatgtcctgtggaggaaattgtgt

SEQ ID NO: 373400 - DNA, 25 bp, Mus musculus
tgatgtcgcagggacactgggttcc

SEQ ID NO: 373401 - DNA, 25 bp, Mus musculus
tgatgtctatttggagtgtctaaaa

SEQ ID NO: 373402 - DNA, 25 bp, Mus musculus
tgatgtctcagctggacaaaccatc

SEQ ID NO: 373403 - DNA, 25 bp, Mus musculus
tgatgtctcagctgggtactctcaa

SEQ ID NO: 373404 - DNA, 25 bp, Mus musculus
tgatgtctgacgaggtgttccacga

SEQ ID NO: 373405 - DNA, 25 bp, Mus musculus
tgatgtctggaagccatgactgttc

SEQ ID NO: 373406 - DNA, 25 bp, Mus musculus
tgatgtctttgcaaggtattgtcgc

SEQ ID NO: 373407 - DNA, 25 bp, Mus musculus
tgatgtgaccctggacaaactgtag

SEQ ID NO: 373408 - DNA, 25 bp, Mus musculus
tgatgtgatgacaggaaattgttta

SEQ ID NO: 373409 - DNA, 25 bp, Mus musculus
tgatgtgcatgtgtgggcatattca

SEQ ID NO: 373410 - DNA, 25 bp, Mus musculus
tgatgtgccaagtaatgtatattta

SEQ ID NO: 373411 - DNA, 25 bp, Mus musculus
tgatgtgctctgtgcagccctggct

SEQ ID NO: 373412 - DNA, 25 bp, Mus musculus
tgatgtggaaaggaaaatagaaatt

SEQ ID NO: 373413 - DNA, 25 bp, Mus musculus
tgatgtggaagattttaattccttt

SEQ ID NO: 373414 - DNA, 25 bp, Mus musculus
tgatgtggcctgcccagagtgacct

SEQ ID NO: 373415 - DNA, 25 bp, Mus musculus
tgatgtgggagaccactgggacacc

SEQ ID NO: 373416 - DNA, 25 bp, Mus musculus
tgatgtgggaggtacgtgggagcaa

SEQ ID NO: 373417 - DNA, 25 bp, Mus musculus
tgatgtgggtccaggctctggacct

SEQ ID NO: 373418 - DNA, 25 bp, Mus musculus
tgatgtgtaagcttatcacagttca

SEQ ID NO: 373419 - DNA, 25 bp, Mus musculus
tgatgtgtttggactcacacacgag

SEQ ID NO: 373420 - DNA, 25 bp, Mus musculus
tgatgtgtttggggaggcagatgcg

SEQ ID NO: 373421 - DNA, 25 bp, Mus musculus
tgatgttatcaagaaaaagaataaa

SEQ ID NO: 373422 - DNA, 25 bp, Mus musculus
tgatgttatctcactatcctttgtg

SEQ ID NO: 373423 - DNA, 25 bp, Mus musculus
tgatgttcaaacacttcgacaagga

SEQ ID NO: 373424 - DNA, 25 bp, Mus musculus
tgatgttctttatagacagacgcct

SEQ ID NO: 373425 - DNA, 25 bp, Mus musculus
tgatgttctttatagtgaggctatg

SEQ ID NO: 373426 - DNA, 25 bp, Mus musculus
tgatgttgaaatggaatacactatg

SEQ ID NO: 373427 - DNA, 25 bp, Mus musculus
tgatgttggtgatctgaaaacatca

SEQ ID NO: 373428 - DNA, 25 bp, Mus musculus
tgatgttgtccctgacaggtttggc

SEQ ID NO: 373429 - DNA, 25 bp, Mus musculus
tgatgtttacaagtatgagaccagc

SEQ ID NO: 373430 - DNA, 25 bp, Mus musculus
tgatgtttcccagaatcatacgatg

SEQ ID NO: 373431 - DNA, 25 bp, Mus musculus
tgattaaagacttaggaagaagact

SEQ ID NO: 373432 - DNA, 25 bp, Mus musculus
tgattaaagacttaggtgggtcggt

SEQ ID NO: 373433 - DNA, 25 bp, Mus musculus
tgattaaagtgaggaataagactgt

SEQ ID NO: 373434 - DNA, 25 bp, Mus musculus
tgattaacctggtgctggatttcta

SEQ ID NO: 373435 - DNA, 25 bp, Mus musculus
tgattaataaccagctggttgatca

SEQ ID NO: 373436 - DNA, 25 bp, Mus musculus
tgattaatgacgctggtgaaataca

SEQ ID NO: 373437 - DNA, 25 bp, Mus musculus
tgattaatggcacagacgcagcctc

SEQ ID NO: 373438 - DNA, 25 bp, Mus musculus
tgattacaagaccataccactctcc

SEQ ID NO: 373439 - DNA, 25 bp, Mus musculus
tgattacaagaccatgtttatgtct

SEQ ID NO: 373440 - DNA, 25 bp, Mus musculus
tgattacaatgcaagaaatcctacc

SEQ ID NO: 373441 - DNA, 25 bp, Mus musculus
tgattacagagaattgtatttcttt

SEQ ID NO: 373442 - DNA, 25 bp, Mus musculus
tgattacagaggctttggtatagga

SEQ ID NO: 373443 - DNA, 25 bp, Mus musculus
tgattacagaggttgccatgaagtg

SEQ ID NO: 373444 - DNA, 25 bp, Mus musculus
tgattacccactcagaaaagcggcc

SEQ ID NO: 373445 - DNA, 25 bp, Mus musculus
tgattactctgagagagtcagtcct

SEQ ID NO: 373446 - DNA, 25 bp, Mus musculus
tgattactttgagcgtcgagcagaa

SEQ ID NO: 373447 - DNA, 25 bp, Mus musculus
tgattactttgagtttgctggggga

SEQ ID NO: 373448 - DNA, 25 bp, Mus musculus
tgattagagggggacatgtcaatct

SEQ ID NO: 373449 - DNA, 25 bp, Mus musculus
tgattatagaaaaggtcattttgag

SEQ ID NO: 373450 - DNA, 25 bp, Mus musculus
tgattatagcaatcagcagagtggt

SEQ ID NO: 373451 - DNA, 25 bp, Mus musculus
tgattatagtttcagagccatctga

SEQ ID NO: 373452 - DNA, 25 bp, Mus musculus
tgattatcaggactagcggacatgg

SEQ ID NO: 373453 - DNA, 25 bp, Mus musculus
tgattatcagtaccccaccccaggt

SEQ ID NO: 373454 - DNA, 25 bp, Mus musculus
tgattatgtctgtcagaatctccat

SEQ ID NO: 373455 - DNA, 25 bp, Mus musculus
tgattattggagccccagaacgagg

SEQ ID NO: 373456 - DNA, 25 bp, Mus musculus
tgattcaaaaggatggccaggcttt

SEQ ID NO: 373457 - DNA, 25 bp, Mus musculus
tgattcaacagatgtctttcaacaa

SEQ ID NO: 373458 - DNA, 25 bp, Mus musculus
tgattcaacaggcaatcgagattat

SEQ ID NO: 373459 - DNA, 25 bp, Mus musculus
tgattcaaggaggcttggcaaattg

SEQ ID NO: 373460 - DNA, 25 bp, Mus musculus
tgattcacatcgagaaagcctttga

SEQ ID NO: 373461 - DNA, 25 bp, Mus musculus
tgattcacatcgagctggagtacct

SEQ ID NO: 373462 - DNA, 25 bp, Mus musculus
tgattcactgaaaggtcgttgctcc

SEQ ID NO: 373463 - DNA, 25 bp, Mus musculus
tgattcactgagctcctgcaaaaaa

SEQ ID NO: 373464 - DNA, 25 bp, Mus musculus
tgattcagaagatgatttttggtga

SEQ ID NO: 373465 - DNA, 25 bp, Mus musculus
tgattcagacattgcagatggtgaa

SEQ ID NO: 373466 - DNA, 25 bp, Mus musculus
tgattcaggaatggagactttggag

SEQ ID NO: 373467 - DNA, 25 bp, Mus musculus
tgattcatcagacacctgctgtcca

SEQ ID NO: 373468 - DNA, 25 bp, Mus musculus
tgattcatctagaggttttacagac

SEQ ID NO: 373469 - DNA, 25 bp, Mus musculus
tgattcatctagagtacaaaacagg

SEQ ID NO: 373470 - DNA, 25 bp, Mus musculus
tgattcatgagccatcaaagagagg

SEQ ID NO: 373471 - DNA, 25 bp, Mus musculus
tgattccaagcctggaagggcgttt

SEQ ID NO: 373472 - DNA, 25 bp, Mus musculus
tgattccaaggagattgccctctat

SEQ ID NO: 373473 - DNA, 25 bp, Mus musculus
tgattccaaggagccagaaatcata

SEQ ID NO: 373474 - DNA, 25 bp, Mus musculus
tgattccacaggcaatccagatcat

SEQ ID NO: 373475 - DNA, 25 bp, Mus musculus
tgattccaccagcaggttcagcagc

SEQ ID NO: 373476 - DNA, 25 bp, Mus musculus
tgattccaccagtggacagagggga

SEQ ID NO: 373477 - DNA, 25 bp, Mus musculus
tgattccacgtgcgtgcttcttgcc

SEQ ID NO: 373478 - DNA, 25 bp, Mus musculus
tgattccactagggctattctcctg

SEQ ID NO: 373479 - DNA, 25 bp, Mus musculus
tgattccagcagtcaggctgggaca

SEQ ID NO: 373480 - DNA, 25 bp, Mus musculus
tgattccattctttgtggtcgctac

SEQ ID NO: 373481 - DNA, 25 bp, Mus musculus
tgattccattcttttgttggggatg

SEQ ID NO: 373482 - DNA, 25 bp, Mus musculus
tgattcccagctgtttggggcaact

SEQ ID NO: 373483 - DNA, 25 bp, Mus musculus
tgattcccctggatcattcggacaa

SEQ ID NO: 373484 - DNA, 25 bp, Mus musculus
tgattccgaagcacctttggggaac

SEQ ID NO: 373485 - DNA, 25 bp, Mus musculus
tgattcctcagggcatcgtgaagct

SEQ ID NO: 373486 - DNA, 25 bp, Mus musculus
tgattcctctgaggatgacaaggag

SEQ ID NO: 373487 - DNA, 25 bp, Mus musculus
tgattcgagaggttccgtgaggagg

SEQ ID NO: 373488 - DNA, 25 bp, Mus musculus
tgattcgagcacatgtaatagcgct

SEQ ID NO: 373489 - DNA, 25 bp, Mus musculus
tgattcgagcacatgtttaggtaat

SEQ ID NO: 373490 - DNA, 25 bp, Mus musculus
tgattcgagcgacttcggagcacaa

SEQ ID NO: 373491 - DNA, 25 bp, Mus musculus
tgattcgagcggggttccttgtgga

SEQ ID NO: 373492 - DNA, 25 bp, Mus musculus
tgattctaaactaggtcatgtggta

SEQ ID NO: 373493 - DNA, 25 bp, Mus musculus
tgattctactgaggtgtaaactctt

SEQ ID NO: 373494 - DNA, 25 bp, Mus musculus
tgattctcaagctgggaagtcatca

SEQ ID NO: 373495 - DNA, 25 bp, Mus musculus
tgattctccatggagcttggagctg

SEQ ID NO: 373496 - DNA, 25 bp, Mus musculus
tgattctccatggaggcaagatgaa

SEQ ID NO: 373497 - DNA, 25 bp, Mus musculus
tgattctcttgccattcattgacag

SEQ ID NO: 373498 - DNA, 25 bp, Mus musculus
tgattctcttggattgttcatcacc

SEQ ID NO: 373499 - DNA, 25 bp, Mus musculus
tgattctgaggtgtggcttgacgcc

SEQ ID NO: 373500 - DNA, 25 bp, Mus musculus
tgattctgctgagcatttgctagct

SEQ ID NO: 373501 - DNA, 25 bp, Mus musculus
tgattctgctggtgtgggacttgac

SEQ ID NO: 373502 - DNA, 25 bp, Mus musculus
tgattctgtggaactagtcttgcaa

SEQ ID NO: 373503 - DNA, 25 bp, Mus musculus
tgattcttgaatgcaccttatagcc

SEQ ID NO: 373504 - DNA, 25 bp, Mus musculus
tgattgaaagtaatcacccaattgt

SEQ ID NO: 373505 - DNA, 25 bp, Mus musculus
tgattgaaagtataattgcagaagg

SEQ ID NO: 373506 - DNA, 25 bp, Mus musculus
tgattgacaaggttttacttgtaat

SEQ ID NO: 373507 - DNA, 25 bp, Mus musculus
tgattgacaatgagacgctgccagt

SEQ ID NO: 373508 - DNA, 25 bp, Mus musculus
tgattgacacctcaggtggacccct

SEQ ID NO: 373509 - DNA, 25 bp, Mus musculus
tgattgacagagactctttcaagca

SEQ ID NO: 373510 - DNA, 25 bp, Mus musculus
tgattgacagagagccccttccaac

SEQ ID NO: 373511 - DNA, 25 bp, Mus musculus
tgattgagaagctgggaggctggaa

SEQ ID NO: 373512 - DNA, 25 bp, Mus musculus
tgattgagaaggtgggaggctggaa

SEQ ID NO: 373513 - DNA, 25 bp, Mus musculus
tgattgagggcctcgagaatggctc

SEQ ID NO: 373514 - DNA, 25 bp, Mus musculus
tgattgataatcctgctaccagccg

SEQ ID NO: 373515 - DNA, 25 bp, Mus musculus
tgattgcatctttatggaaagagta

SEQ ID NO: 373516 - DNA, 25 bp, Mus musculus
tgattgccagaggcatgaatcctac

SEQ ID NO: 373517 - DNA, 25 bp, Mus musculus
tgattgccttttcccagtgttgtgc

SEQ ID NO: 373518 - DNA, 25 bp, Mus musculus
tgattgcgcaggccttcagaagtat

SEQ ID NO: 373519 - DNA, 25 bp, Mus musculus
tgattgctaagatcccaccaaatat

SEQ ID NO: 373520 - DNA, 25 bp, Mus musculus
tgattgctaaggttgagggcaaagg

SEQ ID NO: 373521 - DNA, 25 bp, Mus musculus
tgattgctctaagaagctgatggtc

SEQ ID NO: 373522 - DNA, 25 bp, Mus musculus
tgattgctgcagtgtgaaaaactca

SEQ ID NO: 373523 - DNA, 25 bp, Mus musculus
tgattgctgctgcaggttaccaaca

SEQ ID NO: 373524 - DNA, 25 bp, Mus musculus
tgattgctgtggacagacgcctgca

SEQ ID NO: 373525 - DNA, 25 bp, Mus musculus
tgattggacagcctgccgggcctcc

SEQ ID NO: 373526 - DNA, 25 bp, Mus musculus
tgattggacaggcatcaagattctt

SEQ ID NO: 373527 - DNA, 25 bp, Mus musculus
tgattggataaggaggatttcaggg

SEQ ID NO: 373528 - DNA, 25 bp, Mus musculus
tgattggatcccaaaattcccagtt

SEQ ID NO: 373529 - DNA, 25 bp, Mus musculus
tgattggcaagcagtggtgacgtat

SEQ ID NO: 373530 - DNA, 25 bp, Mus musculus
tgattggcaggtctcacatgagttt

SEQ ID NO: 373531 - DNA, 25 bp, Mus musculus
tgattggccgagagatgaaaaatga

SEQ ID NO: 373532 - DNA, 25 bp, Mus musculus
tgattggccgagaggcaagaagaga

SEQ ID NO: 373533 - DNA, 25 bp, Mus musculus
tgattggctgtagtttccagagtct

SEQ ID NO: 373534 - DNA, 25 bp, Mus musculus
tgattgggaaggtttggcctggaac

SEQ ID NO: 373535 - DNA, 25 bp, Mus musculus
tgattgggctctatgaaccagactt

SEQ ID NO: 373536 - DNA, 25 bp, Mus musculus
tgattggggagggttttgaatcctg

SEQ ID NO: 373537 - DNA, 25 bp, Mus musculus
tgattggtgcaggagaatttggaga

SEQ ID NO: 373538 - DNA, 25 bp, Mus musculus
tgattggttatgtcacaaacataaa

SEQ ID NO: 373539 - DNA, 25 bp, Mus musculus
tgattggttatgtggcagcagaaga

SEQ ID NO: 373540 - DNA, 25 bp, Mus musculus
tgattgtaaagggtctcctgtgagc

SEQ ID NO: 373541 - DNA, 25 bp, Mus musculus
tgattgtaagcggacatcagaaaag

SEQ ID NO: 373542 - DNA, 25 bp, Mus musculus
tgattgtagagatcagctcgaacgg

SEQ ID NO: 373543 - DNA, 25 bp, Mus musculus
tgattgtagagttcaggatggcttt

SEQ ID NO: 373544 - DNA, 25 bp, Mus musculus
tgattgtagctgaggttcgttccac

SEQ ID NO: 373545 - DNA, 25 bp, Mus musculus
tgattgtatacaaaagcacaaaagg

SEQ ID NO: 373546 - DNA, 25 bp, Mus musculus
tgattgtatacaaaagtcaggtttt

SEQ ID NO: 373547 - DNA, 25 bp, Mus musculus
tgattgtcgagacgtgcgaccgcat

SEQ ID NO: 373548 - DNA, 25 bp, Mus musculus
tgattgtgaaaacattcgtatagct

SEQ ID NO: 373549 - DNA, 25 bp, Mus musculus
tgattgtgagcggaaaagtgtacct

SEQ ID NO: 373550 - DNA, 25 bp, Mus musculus
tgattgtggcaggacgaagaatgac

SEQ ID NO: 373551 - DNA, 25 bp, Mus musculus
tgattgtggcaggtatcacgagcat

SEQ ID NO: 373552 - DNA, 25 bp, Mus musculus
tgattgtgggcaggatatttgtgtt

SEQ ID NO: 373553 - DNA, 25 bp, Mus musculus
tgattgtggtgacactgcaaatgga

SEQ ID NO: 373554 - DNA, 25 bp, Mus musculus
tgattgttctattaggtcatgacgc

SEQ ID NO: 373555 - DNA, 25 bp, Mus musculus
tgattgttgaagatataattgacac

SEQ ID NO: 373556 - DNA, 25 bp, Mus musculus
tgattgtttttcctggtgtgactta

SEQ ID NO: 373557 - DNA, 25 bp, Mus musculus
tgatttaaagctcatccactggaac

SEQ ID NO: 373558 - DNA, 25 bp, Mus musculus
tgatttaaaggatgacgagaaggtc

SEQ ID NO: 373559 - DNA, 25 bp, Mus musculus
tgatttaaaggtcatccactggaac

SEQ ID NO: 373560 - DNA, 25 bp, Mus musculus
tgatttaaataataggtggttagcc

SEQ ID NO: 373561 - DNA, 25 bp, Mus musculus
tgatttaaggcttttgcctaccaaa

SEQ ID NO: 373562 - DNA, 25 bp, Mus musculus
tgatttaagggcagcagggaacctt

SEQ ID NO: 373563 - DNA, 25 bp, Mus musculus
tgatttacagaagataacaaagttg

SEQ ID NO: 373564 - DNA, 25 bp, Mus musculus
tgatttacagaagtgctaggcctgg

SEQ ID NO: 373565 - DNA, 25 bp, Mus musculus
tgatttacagaagtggacaagaagc

SEQ ID NO: 373566 - DNA, 25 bp, Mus musculus
tgatttacaggtggaaagctttcgt

SEQ ID NO: 373567 - DNA, 25 bp, Mus musculus
tgatttagacttggagatcccttcc

SEQ ID NO: 373568 - DNA, 25 bp, Mus musculus
tgatttaggaatgttcttgggagtc

SEQ ID NO: 373569 - DNA, 25 bp, Mus musculus
tgatttatgacaaagatcagttcat

SEQ ID NO: 373570 - DNA, 25 bp, Mus musculus
tgatttcaattaaggtattaagtca

SEQ ID NO: 373571 - DNA, 25 bp, Mus musculus
tgatttcagtgtcagacttaaatgg

SEQ ID NO: 373572 - DNA, 25 bp, Mus musculus
tgatttcatcaactatcatgcttcg

SEQ ID NO: 373573 - DNA, 25 bp, Mus musculus
tgatttccagagagaagacctgatg

SEQ ID NO: 373574 - DNA, 25 bp, Mus musculus
tgatttccagcctcatgtcatagtg

SEQ ID NO: 373575 - DNA, 25 bp, Mus musculus
tgatttccagtccctgcagggctca

SEQ ID NO: 373576 - DNA, 25 bp, Mus musculus
tgatttcctggattctcaggactcg

SEQ ID NO: 373577 - DNA, 25 bp, Mus musculus
tgatttcgaggggacccagccgtag

SEQ ID NO: 373578 - DNA, 25 bp, Mus musculus
tgatttcgatagcaatgcagttgct

SEQ ID NO: 373579 - DNA, 25 bp, Mus musculus
tgatttcttcaagcacaagtatcag

SEQ ID NO: 373580 - DNA, 25 bp, Mus musculus
tgatttcttcaaggccaagaagata

SEQ ID NO: 373581 - DNA, 25 bp, Mus musculus
tgatttcttcattgagactggacaa

SEQ ID NO: 373582 - DNA, 25 bp, Mus musculus
tgatttcttgacaggcatcctcgtg

SEQ ID NO: 373583 - DNA, 25 bp, Mus musculus
tgatttcttggaatagaaaccctaa

SEQ ID NO: 373584 - DNA, 25 bp, Mus musculus
tgatttcttgggtgaagaaaatcta

SEQ ID NO: 373585 - DNA, 25 bp, Mus musculus
tgatttgaaaatcgaatctctaggg

SEQ ID NO: 373586 - DNA, 25 bp, Mus musculus
tgatttgaaaatcgatcttctttca

SEQ ID NO: 373587 - DNA, 25 bp, Mus musculus
tgatttgaaaatcggttagtccttc

SEQ ID NO: 373588 - DNA, 25 bp, Mus musculus
tgatttgaaggagccaagcaataag

SEQ ID NO: 373589 - DNA, 25 bp, Mus musculus
tgatttgctgtcagaagctatcccc

SEQ ID NO: 373590 - DNA, 25 bp, Mus musculus
tgatttggagaggtacaactgatga

SEQ ID NO: 373591 - DNA, 25 bp, Mus musculus
tgatttggggttcccagcagtggca

SEQ ID NO: 373592 - DNA, 25 bp, Mus musculus
tgatttggttcagagtcttttacat

SEQ ID NO: 373593 - DNA, 25 bp, Mus musculus
tgatttggttcagagttgtcctggg

SEQ ID NO: 373594 - DNA, 25 bp, Mus musculus
tgatttgtagaactagtccttatcg

SEQ ID NO: 373595 - DNA, 25 bp, Mus musculus
tgatttgtagaactatgcattttgc

SEQ ID NO: 373596 - DNA, 25 bp, Mus musculus
tgatttgtcccatggccttctttct

SEQ ID NO: 373597 - DNA, 25 bp, Mus musculus
tgattttaatagctcgatgacctca

SEQ ID NO: 373598 - DNA, 25 bp, Mus musculus
tgattttaatagtgctagccatcgc

SEQ ID NO: 373599 - DNA, 25 bp, Mus musculus
tgattttaggttacagccaagctct

SEQ ID NO: 373600 - DNA, 25 bp, Mus musculus
tgattttatgccagagatttcagaa

SEQ ID NO: 373601 - DNA, 25 bp, Mus musculus
tgattttcaggaaaagtgcaagaaa

SEQ ID NO: 373602 - DNA, 25 bp, Mus musculus
tgattttcaggcagaaatttaatat

SEQ ID NO: 373603 - DNA, 25 bp, Mus musculus
tgattttcaggggctccaacaccaa

SEQ ID NO: 373604 - DNA, 25 bp, Mus musculus
tgattttcccgaatactcctcaagc

SEQ ID NO: 373605 - DNA, 25 bp, Mus musculus
tgattttcggcaaggatgagcccca

SEQ ID NO: 373606 - DNA, 25 bp, Mus musculus
tgattttcggcaagggcgtctactg

SEQ ID NO: 373607 - DNA, 25 bp, Mus musculus
tgattttgagaattcagagccaatg

SEQ ID NO: 373608 - DNA, 25 bp, Mus musculus
tgattttgagtttgaaaatgaaaaa

SEQ ID NO: 373609 - DNA, 25 bp, Mus musculus
tgatttttacatggacttgacatca

SEQ ID NO: 373610 - DNA, 25 bp, Mus musculus
tgatttttcagaaagtaaacgaagc

SEQ ID NO: 373611 - DNA, 25 bp, Mus musculus
tgatttttcaggcccaatgatgatc

SEQ ID NO: 373612 - DNA, 25 bp, Mus musculus
tgatttttcaggggatgtttcggaa

SEQ ID NO: 373613 - DNA, 25 bp, Mus musculus
tgatttttcggaagacagcgtggaa

SEQ ID NO: 373614 - DNA, 25 bp, Mus musculus
tgattttttgcaggcatcacagact

SEQ ID NO: 373615 - DNA, 25 bp, Mus musculus
tgatttttttggaatgggcaaagaa

SEQ ID NO: 373616 - DNA, 25 bp, Mus musculus
tgcaaaaacaaagctcctgggctcc

SEQ ID NO: 373617 - DNA, 25 bp, Mus musculus
tgcaaaaacagatgtggaaagagca

SEQ ID NO: 373618 - DNA, 25 bp, Mus musculus
tgcaaaaacagctcaatgacagtca

SEQ ID NO: 373619 - DNA, 25 bp, Mus musculus
tgcaaaaacagctctgtccaaagct

SEQ ID NO: 373620 - DNA, 25 bp, Mus musculus
tgcaaaaaggggatggaattcgaag

SEQ ID NO: 373621 - DNA, 25 bp, Mus musculus
tgcaaaacagatggagaatagggct

SEQ ID NO: 373622 - DNA, 25 bp, Mus musculus
tgcaaaacaggatatcctgtacctg

SEQ ID NO: 373623 - DNA, 25 bp, Mus musculus
tgcaaaacccaaagccctttgccat

SEQ ID NO: 373624 - DNA, 25 bp, Mus musculus
tgcaaaagagcaccagcacagctga

SEQ ID NO: 373625 - DNA, 25 bp, Mus musculus
tgcaaaagccacccgaatggctgtt

SEQ ID NO: 373626 - DNA, 25 bp, Mus musculus
tgcaaaagcgggcctcctgctgcca

SEQ ID NO: 373627 - DNA, 25 bp, Mus musculus
tgcaaaagcgggtggaggagagcag

SEQ ID NO: 373628 - DNA, 25 bp, Mus musculus
tgcaaaatagcggtcacacaactgg

SEQ ID NO: 373629 - DNA, 25 bp, Mus musculus
tgcaaaatatcagctggtggctggc

SEQ ID NO: 373630 - DNA, 25 bp, Mus musculus
tgcaaaatatcagtctagccgcaga

SEQ ID NO: 373631 - DNA, 25 bp, Mus musculus
tgcaaaatgaaaagatgaaaacttt

SEQ ID NO: 373632 - DNA, 25 bp, Mus musculus
tgcaaaatggcaggagctcgacgcc

SEQ ID NO: 373633 - DNA, 25 bp, Mus musculus
tgcaaaatgggagccaggagtcctt

SEQ ID NO: 373634 - DNA, 25 bp, Mus musculus
tgcaaaattcagaatgggctgtatg

SEQ ID NO: 373635 - DNA, 25 bp, Mus musculus
tgcaaacaagggcaccctggaggac

SEQ ID NO: 373636 - DNA, 25 bp, Mus musculus
tgcaaaccagcaagctcctgggcct

SEQ ID NO: 373637 - DNA, 25 bp, Mus musculus
tgcaaaccagcaagtgcgactgtat

SEQ ID NO: 373638 - DNA, 25 bp, Mus musculus
tgcaaaccatgatctcaagaccaga

SEQ ID NO: 373639 - DNA, 25 bp, Mus musculus
tgcaaaccatgcctcaatctaggtg

SEQ ID NO: 373640 - DNA, 25 bp, Mus musculus
tgcaaaccccagatatccagcttgt

SEQ ID NO: 373641 - DNA, 25 bp, Mus musculus
tgcaaacccttgtgaactgaagaat

SEQ ID NO: 373642 - DNA, 25 bp, Mus musculus
tgcaaacctctgaagagttacatgc

SEQ ID NO: 373643 - DNA, 25 bp, Mus musculus
tgcaaacctctgcggcggtatctga

SEQ ID NO: 373644 - DNA, 25 bp, Mus musculus
tgcaaactatactgagatcgcctta

SEQ ID NO: 373645 - DNA, 25 bp, Mus musculus
tgcaaactcaagatgctgatcatat

SEQ ID NO: 373646 - DNA, 25 bp, Mus musculus
tgcaaactttatgatcctggggcag

SEQ ID NO: 373647 - DNA, 25 bp, Mus musculus
tgcaaagaagtttacaattcctgga

SEQ ID NO: 373648 - DNA, 25 bp, Mus musculus
tgcaaagaatggggtaaccatagag

SEQ ID NO: 373649 - DNA, 25 bp, Mus musculus
tgcaaagacaggagggagaaagaga

SEQ ID NO: 373650 - DNA, 25 bp, Mus musculus
tgcaaagagtgagttggcttcagct

SEQ ID NO: 373651 - DNA, 25 bp, Mus musculus
tgcaaagcagaacaggggctaccct

SEQ ID NO: 373652 - DNA, 25 bp, Mus musculus
tgcaaagcagagacggtaacacggt

SEQ ID NO: 373653 - DNA, 25 bp, Mus musculus
tgcaaagcagcaaataaccacattt

SEQ ID NO: 373654 - DNA, 25 bp, Mus musculus
tgcaaagcagcaatcccatatgaca

SEQ ID NO: 373655 - DNA, 25 bp, Mus musculus
tgcaaagccacaagtgcctccaaaa

SEQ ID NO: 373656 - DNA, 25 bp, Mus musculus
tgcaaagcgtctggcagcagaagat

SEQ ID NO: 373657 - DNA, 25 bp, Mus musculus
tgcaaagctgaaggctccgagtacc

SEQ ID NO: 373658 - DNA, 25 bp, Mus musculus
tgcaaagcttctctggttctctgcc

SEQ ID NO: 373659 - DNA, 25 bp, Mus musculus
tgcaaagcttctgtggttctctgcc

SEQ ID NO: 373660 - DNA, 25 bp, Mus musculus
tgcaaaggaaacgatggatctgggg

SEQ ID NO: 373661 - DNA, 25 bp, Mus musculus
tgcaaaggaaacggtgcctcctcct

SEQ ID NO: 373662 - DNA, 25 bp, Mus musculus
tgcaaaggaagctcaatgacagtca

SEQ ID NO: 373663 - DNA, 25 bp, Mus musculus
tgcaaaggaggtgttttagctcacc

SEQ ID NO: 373664 - DNA, 25 bp, Mus musculus
tgcaaaggcctaacatttggaaggc

SEQ ID NO: 373665 - DNA, 25 bp, Mus musculus
tgcaaaggcctaacctccaaaagta

SEQ ID NO: 373666 - DNA, 25 bp, Mus musculus
tgcaaaggcctgaatcaggtctgct

SEQ ID NO: 373667 - DNA, 25 bp, Mus musculus
tgcaaagggagcttggcatggatcc

SEQ ID NO: 373668 - DNA, 25 bp, Mus musculus
tgcaaaggtaaccagagcgagcacc

SEQ ID NO: 373669 - DNA, 25 bp, Mus musculus
tgcaaagtaaaaacaaatataaagc

SEQ ID NO: 373670 - DNA, 25 bp, Mus musculus
tgcaaagtaatatctccatctctgt

SEQ ID NO: 373671 - DNA, 25 bp, Mus musculus
tgcaaagtggacagtcccaccgtca

SEQ ID NO: 373672 - DNA, 25 bp, Mus musculus
tgcaaagttggtatatccaaagcct

SEQ ID NO: 373673 - DNA, 25 bp, Mus musculus
tgcaaataacgtgaactgtggactt

SEQ ID NO: 373674 - DNA, 25 bp, Mus musculus
tgcaaataagtgaaaaggaagatga

SEQ ID NO: 373675 - DNA, 25 bp, Mus musculus
tgcaaataccggtcaactattcctc

SEQ ID NO: 373676 - DNA, 25 bp, Mus musculus
tgcaaatacttaacgtctcattctt

SEQ ID NO: 373677 - DNA, 25 bp, Mus musculus
tgcaaatcggggcggtgtgaatgac

SEQ ID NO: 373678 - DNA, 25 bp, Mus musculus
tgcaaatgaacaagctgagtatgag

SEQ ID NO: 373679 - DNA, 25 bp, Mus musculus
tgcaaatgaggatgcccctaaatcg

SEQ ID NO: 373680 - DNA, 25 bp, Mus musculus
tgcaaatgagttccagacaggattc

SEQ ID NO: 373681 - DNA, 25 bp, Mus musculus
tgcaaatgctgaaaaaggagtgaat

SEQ ID NO: 373682 - DNA, 25 bp, Mus musculus
tgcaaatgctgagtgaattatatga

SEQ ID NO: 373683 - DNA, 25 bp, Mus musculus
tgcaaatgctggaactgcagcagtt

SEQ ID NO: 373684 - DNA, 25 bp, Mus musculus
tgcaaatggcgaaagtcctaggtgg

SEQ ID NO: 373685 - DNA, 25 bp, Mus musculus
tgcaaatgggaacaactgtataaga

SEQ ID NO: 373686 - DNA, 25 bp, Mus musculus
tgcaaatgtcccaggccgctagtca

SEQ ID NO: 373687 - DNA, 25 bp, Mus musculus
tgcaaattagatgttctttgtttac

SEQ ID NO: 373688 - DNA, 25 bp, Mus musculus
tgcaaattagtttcgtggttttctc

SEQ ID NO: 373689 - DNA, 25 bp, Mus musculus
tgcaaatttacagagcagcatggcc

SEQ ID NO: 373690 - DNA, 25 bp, Mus musculus
tgcaaatttgatgcattcttcagtc

SEQ ID NO: 373691 - DNA, 25 bp, Mus musculus
tgcaacaaaggcttcaccacagcag

SEQ ID NO: 373692 - DNA, 25 bp, Mus musculus
tgcaacaaaggtactggtgaggttt

SEQ ID NO: 373693 - DNA, 25 bp, Mus musculus
tgcaacaacaagggaagtactccgc

SEQ ID NO: 373694 - DNA, 25 bp, Mus musculus
tgcaacaacaagggagctcactcag

SEQ ID NO: 373695 - DNA, 25 bp, Mus musculus
tgcaacaaccttgaccttattcaat

SEQ ID NO: 373696 - DNA, 25 bp, Mus musculus
tgcaacaacgggatcccggagaact

SEQ ID NO: 373697 - DNA, 25 bp, Mus musculus
tgcaacaagaaggtgacactggcca

SEQ ID NO: 373698 - DNA, 25 bp, Mus musculus
tgcaacaatgaatggcatgcatttt

SEQ ID NO: 373699 - DNA, 25 bp, Mus musculus
tgcaacaatggcgccccctgtaatg

SEQ ID NO: 373700 - DNA, 25 bp, Mus musculus
tgcaacacaagatttccacccagat

SEQ ID NO: 373701 - DNA, 25 bp, Mus musculus
tgcaacacaaggctgtgtctctcca

SEQ ID NO: 373702 - DNA, 25 bp, Mus musculus
tgcaacacctcgaaggaatggaaga

SEQ ID NO: 373703 - DNA, 25 bp, Mus musculus
tgcaacacctcgaaggtacacaact

SEQ ID NO: 373704 - DNA, 25 bp, Mus musculus
tgcaacacgccctgaaccgcttggg

SEQ ID NO: 373705 - DNA, 25 bp, Mus musculus
tgcaacaggctaggtgctggtgttg

SEQ ID NO: 373706 - DNA, 25 bp, Mus musculus
tgcaacaggctaggttgcaggaagc

SEQ ID NO: 373707 - DNA, 25 bp, Mus musculus
tgcaacaggcttaggtgccacattc

SEQ ID NO: 373708 - DNA, 25 bp, Mus musculus
tgcaacatacaggttaccaaagtga

SEQ ID NO: 373709 - DNA, 25 bp, Mus musculus
tgcaacatcccagccaaagcaaaat

SEQ ID NO: 373710 - DNA, 25 bp, Mus musculus
tgcaacatgacatagatcctataag

SEQ ID NO: 373711 - DNA, 25 bp, Mus musculus
tgcaacatgacatagggtacatgtg

SEQ ID NO: 373712 - DNA, 25 bp, Mus musculus
tgcaaccaaatcaagggccgatgat

SEQ ID NO: 373713 - DNA, 25 bp, Mus musculus
tgcaaccaagatgagtccttccacc

SEQ ID NO: 373714 - DNA, 25 bp, Mus musculus
tgcaaccaagatttaaacgagtgtg

SEQ ID NO: 373715 - DNA, 25 bp, Mus musculus
tgcaaccaaggcctttgtagatttc

SEQ ID NO: 373716 - DNA, 25 bp, Mus musculus
tgcaaccacagaaggttatagaagc

SEQ ID NO: 373717 - DNA, 25 bp, Mus musculus
tgcaaccacagggactggaaatggc

SEQ ID NO: 373718 - DNA, 25 bp, Mus musculus
tgcaaccatgagaccagcaccaact

SEQ ID NO: 373719 - DNA, 25 bp, Mus musculus
tgcaaccatgatcaagcacttcctg

SEQ ID NO: 373720 - DNA, 25 bp, Mus musculus
tgcaaccatggatgacaaggagtat

SEQ ID NO: 373721 - DNA, 25 bp, Mus musculus
tgcaacccagagaccttccccttgc

SEQ ID NO: 373722 - DNA, 25 bp, Mus musculus
tgcaacccatgagcatccaggtgat

SEQ ID NO: 373723 - DNA, 25 bp, Mus musculus
tgcaaccccagcccgcacccggaag

SEQ ID NO: 373724 - DNA, 25 bp, Mus musculus
tgcaacccccggagtttcaagccac

SEQ ID NO: 373725 - DNA, 25 bp, Mus musculus
tgcaacccgtggcagtcaagctctt

SEQ ID NO: 373726 - DNA, 25 bp, Mus musculus
tgcaaccctgcccacctgaggcaaa

SEQ ID NO: 373727 - DNA, 25 bp, Mus musculus
tgcaaccctgcccagctgaggcaaa

SEQ ID NO: 373728 - DNA, 25 bp, Mus musculus
tgcaaccctggaccctgtcctgctg

SEQ ID NO: 373729 - DNA, 25 bp, Mus musculus
tgcaaccctggagctgccgcagtgg

SEQ ID NO: 373730 - DNA, 25 bp, Mus musculus
tgcaaccgaagctgacattatctct

SEQ ID NO: 373731 - DNA, 25 bp, Mus musculus
tgcaaccgaggtcacatggtgggct

SEQ ID NO: 373732 - DNA, 25 bp, Mus musculus
tgcaacctcttggaaaggtatgctg

SEQ ID NO: 373733 - DNA, 25 bp, Mus musculus
tgcaacctgccgaataaggccagca

SEQ ID NO: 373734 - DNA, 25 bp, Mus musculus
tgcaacctgccgagaaacccttttg

SEQ ID NO: 373735 - DNA, 25 bp, Mus musculus
tgcaacgcacgacgcagtggaagaa

SEQ ID NO: 373736 - DNA, 25 bp, Mus musculus
tgcaacgccacttgaccaaatgtga

SEQ ID NO: 373737 - DNA, 25 bp, Mus musculus
tgcaacggacaggagacctgaacta

SEQ ID NO: 373738 - DNA, 25 bp, Mus musculus
tgcaacggcgcctcggctggacatt

SEQ ID NO: 373739 - DNA, 25 bp, Mus musculus
tgcaacggcgcctcggtggagtctt

SEQ ID NO: 373740 - DNA, 25 bp, Mus musculus
tgcaacgtaatgcctcagttccact

SEQ ID NO: 373741 - DNA, 25 bp, Mus musculus
tgcaactacagccttgatgaccacc

SEQ ID NO: 373742 - DNA, 25 bp, Mus musculus
tgcaactcaaggatggatgccctga

SEQ ID NO: 373743 - DNA, 25 bp, Mus musculus
tgcaactcaaggtctaaggtacaaa

SEQ ID NO: 373744 - DNA, 25 bp, Mus musculus
tgcaactccttatgaagtggcagtg

SEQ ID NO: 373745 - DNA, 25 bp, Mus musculus
tgcaactgacaagatttagccttca

SEQ ID NO: 373746 - DNA, 25 bp, Mus musculus
tgcaactgacaaggtattcatgcta

SEQ ID NO: 373747 - DNA, 25 bp, Mus musculus
tgcaacttaccagacttggtggttc

SEQ ID NO: 373748 - DNA, 25 bp, Mus musculus
tgcaacttaccaggtggatcccact

SEQ ID NO: 373749 - DNA, 25 bp, Mus musculus
tgcaacttcgtcgttccgccgccac

SEQ ID NO: 373750 - DNA, 25 bp, Mus musculus
tgcaacttctagccctgctgtcctc

SEQ ID NO: 373751 - DNA, 25 bp, Mus musculus
tgcaacttgagagctttggatatac

SEQ ID NO: 373752 - DNA, 25 bp, Mus musculus
tgcaactttaagatggagccagatc

SEQ ID NO: 373753 - DNA, 25 bp, Mus musculus
tgcaactttgcggagatgatgatgg

SEQ ID NO: 373754 - DNA, 25 bp, Mus musculus
tgcaactttgcgggtgagatggatt

SEQ ID NO: 373755 - DNA, 25 bp, Mus musculus
tgcaagaaaaggaaggaactcaagt

SEQ ID NO: 373756 - DNA, 25 bp, Mus musculus
tgcaagaaaaggactggacagacta

SEQ ID NO: 373757 - DNA, 25 bp, Mus musculus
tgcaagaaaaggctcatgtgttttc

SEQ ID NO: 373758 - DNA, 25 bp, Mus musculus
tgcaagaaaccttgtcactagatgc

SEQ ID NO: 373759 - DNA, 25 bp, Mus musculus
tgcaagaaatttgccgaggccttgg

SEQ ID NO: 373760 - DNA, 25 bp, Mus musculus
tgcaagaaatttggtgtccagggaa

SEQ ID NO: 373761 - DNA, 25 bp, Mus musculus
tgcaagaacacatacagtgtcttca

SEQ ID NO: 373762 - DNA, 25 bp, Mus musculus
tgcaagaacactgtcttcaagatcc

SEQ ID NO: 373763 - DNA, 25 bp, Mus musculus
tgcaagaatcaaacatttttaagac

SEQ ID NO: 373764 - DNA, 25 bp, Mus musculus
tgcaagaattgagagacatctcctg

SEQ ID NO: 373765 - DNA, 25 bp, Mus musculus
tgcaagaccaaggacgagtcttgca

SEQ ID NO: 373766 - DNA, 25 bp, Mus musculus
tgcaagactaggtttgccagatctg

SEQ ID NO: 373767 - DNA, 25 bp, Mus musculus
tgcaagagagaaagaatctggaggt

SEQ ID NO: 373768 - DNA, 25 bp, Mus musculus
tgcaagagcaaaatgtttcaaatgt

SEQ ID NO: 373769 - DNA, 25 bp, Mus musculus
tgcaagagcaataaaattgctactg

SEQ ID NO: 373770 - DNA, 25 bp, Mus musculus
tgcaagagcagtttgacaacttaaa

SEQ ID NO: 373771 - DNA, 25 bp, Mus musculus
tgcaagagctttctatccaaggaga

SEQ ID NO: 373772 - DNA, 25 bp, Mus musculus
tgcaagaggatgagatcgactgggg

SEQ ID NO: 373773 - DNA, 25 bp, Mus musculus
tgcaagaggcaagacctggggatct

SEQ ID NO: 373774 - DNA, 25 bp, Mus musculus
tgcaagaggcacaggctcgaagcac

SEQ ID NO: 373775 - DNA, 25 bp, Mus musculus
tgcaagagtgagggtgatctgcaat

SEQ ID NO: 373776 - DNA, 25 bp, Mus musculus
tgcaagatcaagacagctgcatctt

SEQ ID NO: 373777 - DNA, 25 bp, Mus musculus
tgcaagatgaggagcctcagagaca

SEQ ID NO: 373778 - DNA, 25 bp, Mus musculus
tgcaagatgaggcagagaaggttga

SEQ ID NO: 373779 - DNA, 25 bp, Mus musculus
tgcaagatgcaggccccttcccagt

SEQ ID NO: 373780 - DNA, 25 bp, Mus musculus
tgcaagatggaagaaaatctgggtt

SEQ ID NO: 373781 - DNA, 25 bp, Mus musculus
tgcaagatggaagggctctctaaat

SEQ ID NO: 373782 - DNA, 25 bp, Mus musculus
tgcaagcaaggggaagggaggagca

SEQ ID NO: 373783 - DNA, 25 bp, Mus musculus
tgcaagcagtcccggctgagtttga

SEQ ID NO: 373784 - DNA, 25 bp, Mus musculus
tgcaagcatccagagcaagaagagt

SEQ ID NO: 373785 - DNA, 25 bp, Mus musculus
tgcaagcatccagggcttatcagag

SEQ ID NO: 373786 - DNA, 25 bp, Mus musculus
tgcaagcatcttctggtaaatccat

SEQ ID NO: 373787 - DNA, 25 bp, Mus musculus
tgcaagcattcagctccctgccccc

SEQ ID NO: 373788 - DNA, 25 bp, Mus musculus
tgcaagccaagcagtctctggtccc

SEQ ID NO: 373789 - DNA, 25 bp, Mus musculus
tgcaagccaaggtgaaacttcagcc

SEQ ID NO: 373790 - DNA, 25 bp, Mus musculus
tgcaagccaaggttacctctggaac

SEQ ID NO: 373791 - DNA, 25 bp, Mus musculus
tgcaagccactgatgcttctctgcg

SEQ ID NO: 373792 - DNA, 25 bp, Mus musculus
tgcaagccagccccaggtatggctc

SEQ ID NO: 373793 - DNA, 25 bp, Mus musculus
tgcaagccaggccattccccagtat

SEQ ID NO: 373794 - DNA, 25 bp, Mus musculus
tgcaagccaggtggagcagccaatt

SEQ ID NO: 373795 - DNA, 25 bp, Mus musculus
tgcaagccaggttccttaaaagaaa

SEQ ID NO: 373796 - DNA, 25 bp, Mus musculus
tgcaagccccaagaggatgattatt

SEQ ID NO: 373797 - DNA, 25 bp, Mus musculus
tgcaagccctgagcttgtcccactg

SEQ ID NO: 373798 - DNA, 25 bp, Mus musculus
tgcaagccctggctgcttttagaaa

SEQ ID NO: 373799 - DNA, 25 bp, Mus musculus
tgcaagccgggaagcctatcctcta

SEQ ID NO: 373800 - DNA, 25 bp, Mus musculus
tgcaagccggtggcccagcctgcag

SEQ ID NO: 373801 - DNA, 25 bp, Mus musculus
tgcaagcctcaagacgaaagtaggt

SEQ ID NO: 373802 - DNA, 25 bp, Mus musculus
tgcaagcctgtatggatggattccg

SEQ ID NO: 373803 - DNA, 25 bp, Mus musculus
tgcaagccttcagaatctgggatac

SEQ ID NO: 373804 - DNA, 25 bp, Mus musculus
tgcaagccttcagacacctagatgt

SEQ ID NO: 373805 - DNA, 25 bp, Mus musculus
tgcaagctaggtaggaacaaccttg

SEQ ID NO: 373806 - DNA, 25 bp, Mus musculus
tgcaagctcagatgtatagactcac

SEQ ID NO: 373807 - DNA, 25 bp, Mus musculus
tgcaagctgcaggttgcttctataa

SEQ ID NO: 373808 - DNA, 25 bp, Mus musculus
tgcaaggaaatccggacatctatga

SEQ ID NO: 373809 - DNA, 25 bp, Mus musculus
tgcaaggaaggttggcagcgtggta

SEQ ID NO: 373810 - DNA, 25 bp, Mus musculus
tgcaaggaagtgggaggcagttctg

SEQ ID NO: 373811 - DNA, 25 bp, Mus musculus
tgcaaggaagtggtataatggccgg

SEQ ID NO: 373812 - DNA, 25 bp, Mus musculus
tgcaaggatgctacggaagagtcct

SEQ ID NO: 373813 - DNA, 25 bp, Mus musculus
tgcaaggatggagaatacattgatg

SEQ ID NO: 373814 - DNA, 25 bp, Mus musculus
tgcaaggattccagccccagtctct

SEQ ID NO: 373815 - DNA, 25 bp, Mus musculus
tgcaaggcaaatctcatataaaaca

SEQ ID NO: 373816 - DNA, 25 bp, Mus musculus
tgcaaggcaggtcttccatgtttgt

SEQ ID NO: 373817 - DNA, 25 bp, Mus musculus
tgcaaggcaggttggcgtgggtgga

SEQ ID NO: 373818 - DNA, 25 bp, Mus musculus
tgcaaggcatggcccagttcaattt

SEQ ID NO: 373819 - DNA, 25 bp, Mus musculus
tgcaaggccagtggatgcgcctatg

SEQ ID NO: 373820 - DNA, 25 bp, Mus musculus
tgcaaggcccatgtcttccctacac

SEQ ID NO: 373821 - DNA, 25 bp, Mus musculus
tgcaaggcctcgaaccgccgtccct

SEQ ID NO: 373822 - DNA, 25 bp, Mus musculus
tgcaaggcctcgtcattgtgacaga

SEQ ID NO: 373823 - DNA, 25 bp, Mus musculus
tgcaaggctgtgtatacagttttgc

SEQ ID NO: 373824 - DNA, 25 bp, Mus musculus
tgcaagggcaagggttcttggccca

SEQ ID NO: 373825 - DNA, 25 bp, Mus musculus
tgcaaggttcctgccgctaacgtcc

SEQ ID NO: 373826 - DNA, 25 bp, Mus musculus
tgcaagtaatcggagaggtattctt

SEQ ID NO: 373827 - DNA, 25 bp, Mus musculus
tgcaagtaatcggtggcaattatgg

SEQ ID NO: 373828 - DNA, 25 bp, Mus musculus
tgcaagtataggacaacctcaagtc

SEQ ID NO: 373829 - DNA, 25 bp, Mus musculus
tgcaagtcaatcaggcgacggtgtg

SEQ ID NO: 373830 - DNA, 25 bp, Mus musculus
tgcaagtcaggccgtctactgtgtg

SEQ ID NO: 373831 - DNA, 25 bp, Mus musculus
tgcaagtcatgtcattgtgcttctt

SEQ ID NO: 373832 - DNA, 25 bp, Mus musculus
tgcaagtctccaggtgctgctgggg

SEQ ID NO: 373833 - DNA, 25 bp, Mus musculus
tgcaagtggaccagcagcagcagca

SEQ ID NO: 373834 - DNA, 25 bp, Mus musculus
tgcaagtggaccaggactaccttat

SEQ ID NO: 373835 - DNA, 25 bp, Mus musculus
tgcaagtggaggtgaagtatttgac

SEQ ID NO: 373836 - DNA, 25 bp, Mus musculus
tgcaagtggcaggattctgaatcag

SEQ ID NO: 373837 - DNA, 25 bp, Mus musculus
tgcaagtgggagaatccacctcatt

SEQ ID NO: 373838 - DNA, 25 bp, Mus musculus
tgcaagtgggtctccaacaagtggt

SEQ ID NO: 373839 - DNA, 25 bp, Mus musculus
tgcaagttaaaaggaacttctgcag

SEQ ID NO: 373840 - DNA, 25 bp, Mus musculus
tgcaagttcctatgtcacctccaag

SEQ ID NO: 373841 - DNA, 25 bp, Mus musculus
tgcaatacctggcgccagagcttct

SEQ ID NO: 373842 - DNA, 25 bp, Mus musculus
tgcaatataaggcacaatggaaggt

SEQ ID NO: 373843 - DNA, 25 bp, Mus musculus
tgcaatatgactgaaacggcatgga

SEQ ID NO: 373844 - DNA, 25 bp, Mus musculus
tgcaatatgactgcccgaagccttt

SEQ ID NO: 373845 - DNA, 25 bp, Mus musculus
tgcaatattaaagtaccaaccaaaa

SEQ ID NO: 373846 - DNA, 25 bp, Mus musculus
tgcaatcaaagttgtcctggggaag

SEQ ID NO: 373847 - DNA, 25 bp, Mus musculus
tgcaatcacaggtggatacccttcg

SEQ ID NO: 373848 - DNA, 25 bp, Mus musculus
tgcaatcagagaaaggtttaacatc

SEQ ID NO: 373849 - DNA, 25 bp, Mus musculus
tgcaatcatcaggagcaaagagccc

SEQ ID NO: 373850 - DNA, 25 bp, Mus musculus
tgcaatccagcccttacagaggaac

SEQ ID NO: 373851 - DNA, 25 bp, Mus musculus
tgcaatccaggtcctggaatcctga

SEQ ID NO: 373852 - DNA, 25 bp, Mus musculus
tgcaatcgaggtcatgcttctggag

SEQ ID NO: 373853 - DNA, 25 bp, Mus musculus
tgcaatcttaacaattcaggccaaa

SEQ ID NO: 373854 - DNA, 25 bp, Mus musculus
tgcaatgaagctacgccaatcaaaa

SEQ ID NO: 373855 - DNA, 25 bp, Mus musculus
tgcaatgaagctacgtcgacgcata

SEQ ID NO: 373856 - DNA, 25 bp, Mus musculus
tgcaatgacggtgccccctacagcc

SEQ ID NO: 373857 - DNA, 25 bp, Mus musculus
tgcaatgagggctggagtggcaaaa

SEQ ID NO: 373858 - DNA, 25 bp, Mus musculus
tgcaatgattattgggtgtgcatta

SEQ ID NO: 373859 - DNA, 25 bp, Mus musculus
tgcaatgcaaatgggaacaactgta

SEQ ID NO: 373860 - DNA, 25 bp, Mus musculus
tgcaatgcaggacagtggtgactac

SEQ ID NO: 373861 - DNA, 25 bp, Mus musculus
tgcaatgcagtccgtggtggatgac

SEQ ID NO: 373862 - DNA, 25 bp, Mus musculus
tgcaatggcagaacacaagaattaa

SEQ ID NO: 373863 - DNA, 25 bp, Mus musculus
tgcaatggcagcctggactgcatcc

SEQ ID NO: 373864 - DNA, 25 bp, Mus musculus
tgcaatggcaggcctagccagcatg

SEQ ID NO: 373865 - DNA, 25 bp, Mus musculus
tgcaatggcaggtgctgacctgagc

SEQ ID NO: 373866 - DNA, 25 bp, Mus musculus
tgcaatggcaggttttactgcaatc

SEQ ID NO: 373867 - DNA, 25 bp, Mus musculus
tgcaatggcagtctgttccggtaca

SEQ ID NO: 373868 - DNA, 25 bp, Mus musculus
tgcaattacaaaggtggctttgaca

SEQ ID NO: 373869 - DNA, 25 bp, Mus musculus
tgcaattcagaatgtctctcatgtt

SEQ ID NO: 373870 - DNA, 25 bp, Mus musculus
tgcaattcagaatgttgttcagatg

SEQ ID NO: 373871 - DNA, 25 bp, Mus musculus
tgcaattccatggctgcagaagagg

SEQ ID NO: 373872 - DNA, 25 bp, Mus musculus
tgcaattccatggtactctttgatc

SEQ ID NO: 373873 - DNA, 25 bp, Mus musculus
tgcaattctccccaggaaaatacag

SEQ ID NO: 373874 - DNA, 25 bp, Mus musculus
tgcaattgccaaggcaggtgcagtg

SEQ ID NO: 373875 - DNA, 25 bp, Mus musculus
tgcaattggaaagacagtgatgtga

SEQ ID NO: 373876 - DNA, 25 bp, Mus musculus
tgcaattggaaaggtatctggccag

SEQ ID NO: 373877 - DNA, 25 bp, Mus musculus
tgcaattggactcaagcggatagcc

SEQ ID NO: 373878 - DNA, 25 bp, Mus musculus
tgcaatttaaaattgtggtgggttg

SEQ ID NO: 373879 - DNA, 25 bp, Mus musculus
tgcaatttcggagcttcaccctgat

SEQ ID NO: 373880 - DNA, 25 bp, Mus musculus
tgcaatttggaagggaggtcctggc

SEQ ID NO: 373881 - DNA, 25 bp, Mus musculus
tgcacaaaacgagatctggcagacc

SEQ ID NO: 373882 - DNA, 25 bp, Mus musculus
tgcacaaaacgagtgacgagtatct

SEQ ID NO: 373883 - DNA, 25 bp, Mus musculus
tgcacaaacagagcagctctggctc

SEQ ID NO: 373884 - DNA, 25 bp, Mus musculus
tgcacaaacaggcggaaattgtgaa

SEQ ID NO: 373885 - DNA, 25 bp, Mus musculus
tgcacaaacagtgccccaggtactg

SEQ ID NO: 373886 - DNA, 25 bp, Mus musculus
tgcacaaacgagctccttatgtctc

SEQ ID NO: 373887 - DNA, 25 bp, Mus musculus
tgcacaaacgaggggaatatattaa

SEQ ID NO: 373888 - DNA, 25 bp, Mus musculus
tgcacaaacgggagagcaaccttcc

SEQ ID NO: 373889 - DNA, 25 bp, Mus musculus
tgcacaaagaaagcaactgggacaa

SEQ ID NO: 373890 - DNA, 25 bp, Mus musculus
tgcacaaatcaaggcatgctgtgag

SEQ ID NO: 373891 - DNA, 25 bp, Mus musculus
tgcacaaatcaaggtgacaaaagaa

SEQ ID NO: 373892 - DNA, 25 bp, Mus musculus
tgcacaacagaatgcacgtagaaaa

SEQ ID NO: 373893 - DNA, 25 bp, Mus musculus
tgcacaagattttagtttgggatca

SEQ ID NO: 373894 - DNA, 25 bp, Mus musculus
tgcacaagcaagagtaaaaagaaga

SEQ ID NO: 373895 - DNA, 25 bp, Mus musculus
tgcacaagccagggcccatcactct

SEQ ID NO: 373896 - DNA, 25 bp, Mus musculus
tgcacaagctgacaggaagactctt

SEQ ID NO: 373897 - DNA, 25 bp, Mus musculus
tgcacaagctgacaggttgccatgc

SEQ ID NO: 373898 - DNA, 25 bp, Mus musculus
tgcacaaggcatgtgaagccagtga

SEQ ID NO: 373899 - DNA, 25 bp, Mus musculus
tgcacaaggtgggccgagacatctt

SEQ ID NO: 373900 - DNA, 25 bp, Mus musculus
tgcacaatcctgagaggaagatcca

SEQ ID NO: 373901 - DNA, 25 bp, Mus musculus
tgcacaatcctgaggtgaagaggaa

SEQ ID NO: 373902 - DNA, 25 bp, Mus musculus
tgcacaattgagggttgccccggct

SEQ ID NO: 373903 - DNA, 25 bp, Mus musculus
tgcacaattgctcactatttggata

SEQ ID NO: 373904 - DNA, 25 bp, Mus musculus
tgcacacaaaagcaaatcactgaag

SEQ ID NO: 373905 - DNA, 25 bp, Mus musculus
tgcacacacaaggccaggagcatca

SEQ ID NO: 373906 - DNA, 25 bp, Mus musculus
tgcacacacacacggattgagtcct

SEQ ID NO: 373907 - DNA, 25 bp, Mus musculus
tgcacacacacagggattgagtcct

SEQ ID NO: 373908 - DNA, 25 bp, Mus musculus
tgcacacagaagtccctgagctcag

SEQ ID NO: 373909 - DNA, 25 bp, Mus musculus
tgcacacagacacaagatggaatat

SEQ ID NO: 373910 - DNA, 25 bp, Mus musculus
tgcacacagtggatgaagaagagaa

SEQ ID NO: 373911 - DNA, 25 bp, Mus musculus
tgcacacagtggtaccgttttgcag

SEQ ID NO: 373912 - DNA, 25 bp, Mus musculus
tgcacacataacaccaatgactgca

SEQ ID NO: 373913 - DNA, 25 bp, Mus musculus
tgcacacatacacgcccgaatggct

SEQ ID NO: 373914 - DNA, 25 bp, Mus musculus
tgcacacatgaaacagtttgtagtg

SEQ ID NO: 373915 - DNA, 25 bp, Mus musculus
tgcacacatggatgaaaattcagga

SEQ ID NO: 373916 - DNA, 25 bp, Mus musculus
tgcacacctcatgagctggctgcct

SEQ ID NO: 373917 - DNA, 25 bp, Mus musculus
tgcacacggttggataaacctgact

SEQ ID NO: 373918 - DNA, 25 bp, Mus musculus
tgcacacttacgtccacgccacgct

SEQ ID NO: 373919 - DNA, 25 bp, Mus musculus
tgcacagaaaacccagccagtggtt

SEQ ID NO: 373920 - DNA, 25 bp, Mus musculus
tgcacagaaagactaccaccatacc

SEQ ID NO: 373921 - DNA, 25 bp, Mus musculus
tgcacagaaagccaggggctgggtt

SEQ ID NO: 373922 - DNA, 25 bp, Mus musculus
tgcacagaaagggagagtcctgcat

SEQ ID NO: 373923 - DNA, 25 bp, Mus musculus
tgcacagaatcccagtctcctcact

SEQ ID NO: 373924 - DNA, 25 bp, Mus musculus
tgcacagaatcccagtggggaaacg

SEQ ID NO: 373925 - DNA, 25 bp, Mus musculus
tgcacagacaggagcatgcaaaaca

SEQ ID NO: 373926 - DNA, 25 bp, Mus musculus
tgcacagacaggagcatgcattctt

SEQ ID NO: 373927 - DNA, 25 bp, Mus musculus
tgcacagaccaggtgattgtgcaga

SEQ ID NO: 373928 - DNA, 25 bp, Mus musculus
tgcacagaccagtacatgacaatgg

SEQ ID NO: 373929 - DNA, 25 bp, Mus musculus
tgcacagacgagctgttcaaggaga

SEQ ID NO: 373930 - DNA, 25 bp, Mus musculus
tgcacagagagaattttgttcaggc

SEQ ID NO: 373931 - DNA, 25 bp, Mus musculus
tgcacagatatctttccatctgtgt

SEQ ID NO: 373932 - DNA, 25 bp, Mus musculus
tgcacagatgagacgggcatagaac

SEQ ID NO: 373933 - DNA, 25 bp, Mus musculus
tgcacagatgagacgggtattgaac

SEQ ID NO: 373934 - DNA, 25 bp, Mus musculus
tgcacagatgtcaggagccctgtcc

SEQ ID NO: 373935 - DNA, 25 bp, Mus musculus
tgcacagatgtcagggttgtacctg

SEQ ID NO: 373936 - DNA, 25 bp, Mus musculus
tgcacagatgtcaggtttatgcgca

SEQ ID NO: 373937 - DNA, 25 bp, Mus musculus
tgcacagatgtcagtcatcttcctc

SEQ ID NO: 373938 - DNA, 25 bp, Mus musculus
tgcacagcactgccagggggaaggg

SEQ ID NO: 373939 - DNA, 25 bp, Mus musculus
tgcacagcagaggcagacaggcacc

SEQ ID NO: 373940 - DNA, 25 bp, Mus musculus
tgcacagcagaggtggaaaatggtt

SEQ ID NO: 373941 - DNA, 25 bp, Mus musculus
tgcacagcccaaagtctgacactac

SEQ ID NO: 373942 - DNA, 25 bp, Mus musculus
tgcacagcctagcgggtgcaaagaa

SEQ ID NO: 373943 - DNA, 25 bp, Mus musculus
tgcacagcgaccagcagccagttcc

SEQ ID NO: 373944 - DNA, 25 bp, Mus musculus
tgcacagcgggctgacggctgaggc

SEQ ID NO: 373945 - DNA, 25 bp, Mus musculus
tgcacagcgtacagatgaaaagggg

SEQ ID NO: 373946 - DNA, 25 bp, Mus musculus
tgcacagcgtacaggctcaggaaac

SEQ ID NO: 373947 - DNA, 25 bp, Mus musculus
tgcacagctaaagtgtatactcctg

SEQ ID NO: 373948 - DNA, 25 bp, Mus musculus
tgcacagctcctgtccaggagatgg

SEQ ID NO: 373949 - DNA, 25 bp, Mus musculus
tgcacagctggtatgcatggaccat

SEQ ID NO: 373950 - DNA, 25 bp, Mus musculus
tgcacaggagaagggagttggcagt

SEQ ID NO: 373951 - DNA, 25 bp, Mus musculus
tgcacaggagaaggtgaaggaggga

SEQ ID NO: 373952 - DNA, 25 bp, Mus musculus
tgcacaggagggtcacttccctccg

SEQ ID NO: 373953 - DNA, 25 bp, Mus musculus
tgcacaggggatgatgagacagaag

SEQ ID NO: 373954 - DNA, 25 bp, Mus musculus
tgcacagtggatgttcctccatttg

SEQ ID NO: 373955 - DNA, 25 bp, Mus musculus
tgcacagttatggtgtgggagatcc

SEQ ID NO: 373956 - DNA, 25 bp, Mus musculus
tgcacagttggttttgaagaaaggc

SEQ ID NO: 373957 - DNA, 25 bp, Mus musculus
tgcacataatggaagggccatgcca

SEQ ID NO: 373958 - DNA, 25 bp, Mus musculus
tgcacatatgaggtgcttgagcagg

SEQ ID NO: 373959 - DNA, 25 bp, Mus musculus
tgcacatatgagtgttttaaaatgc

SEQ ID NO: 373960 - DNA, 25 bp, Mus musculus
tgcacatcaagacctgtgttcctgt

SEQ ID NO: 373961 - DNA, 25 bp, Mus musculus
tgcacatcaaggtccctttgtgtgc

SEQ ID NO: 373962 - DNA, 25 bp, Mus musculus
tgcacatccgagatgatgggcgtcg

SEQ ID NO: 373963 - DNA, 25 bp, Mus musculus
tgcacatcctccggactctaatgag

SEQ ID NO: 373964 - DNA, 25 bp, Mus musculus
tgcacatctctgatgtggaagggga

SEQ ID NO: 373965 - DNA, 25 bp, Mus musculus
tgcacatgataggctatgatagaag

SEQ ID NO: 373966 - DNA, 25 bp, Mus musculus
tgcacatgccaggggatgccccata

SEQ ID NO: 373967 - DNA, 25 bp, Mus musculus
tgcacatggaaggcctgggagggta

SEQ ID NO: 373968 - DNA, 25 bp, Mus musculus
tgcacatggaccagttggaggtggg

SEQ ID NO: 373969 - DNA, 25 bp, Mus musculus
tgcacatggagaggaaactgtcagc

SEQ ID NO: 373970 - DNA, 25 bp, Mus musculus
tgcacatggattcttggcacttgat

SEQ ID NO: 373971 - DNA, 25 bp, Mus musculus
tgcacatgtcagatactttggcaaa

SEQ ID NO: 373972 - DNA, 25 bp, Mus musculus
tgcacatgtgtagggtgtgtgagga

SEQ ID NO: 373973 - DNA, 25 bp, Mus musculus
tgcacattcaccaggtgcactgcct

SEQ ID NO: 373974 - DNA, 25 bp, Mus musculus
tgcacattcagaaacgcatcccact

SEQ ID NO: 373975 - DNA, 25 bp, Mus musculus
tgcacattcaggagtgtgttccaga

SEQ ID NO: 373976 - DNA, 25 bp, Mus musculus
tgcacatttgaagacatgctccagc

SEQ ID NO: 373977 - DNA, 25 bp, Mus musculus
tgcaccaaacaggaccagagtttgg

SEQ ID NO: 373978 - DNA, 25 bp, Mus musculus
tgcaccaaacccagctgtgttccgc

SEQ ID NO: 373979 - DNA, 25 bp, Mus musculus
tgcaccaaacggttgcagacccctt

SEQ ID NO: 373980 - DNA, 25 bp, Mus musculus
tgcaccaaagaccgtggggcagtta

SEQ ID NO: 373981 - DNA, 25 bp, Mus musculus
tgcaccaaatgactcgaccgatcat

SEQ ID NO: 373982 - DNA, 25 bp, Mus musculus
tgcaccaacgccagaaggaagaggc

SEQ ID NO: 373983 - DNA, 25 bp, Mus musculus
tgcaccaagaagctgcagcaatacc

SEQ ID NO: 373984 - DNA, 25 bp, Mus musculus
tgcaccaatgtgagatctggcggga

SEQ ID NO: 373985 - DNA, 25 bp, Mus musculus
tgcaccaatgtgagcacacagcatg

SEQ ID NO: 373986 - DNA, 25 bp, Mus musculus
tgcaccacctgttccagaagttggc

SEQ ID NO: 373987 - DNA, 25 bp, Mus musculus
tgcaccacgagatgtgtgttaaagg

SEQ ID NO: 373988 - DNA, 25 bp, Mus musculus
tgcaccacgaggatcagaacttatc

SEQ ID NO: 373989 - DNA, 25 bp, Mus musculus
tgcaccactgctgcgcaaggtatac

SEQ ID NO: 373990 - DNA, 25 bp, Mus musculus
tgcaccagaatggcatccaggtgat

SEQ ID NO: 373991 - DNA, 25 bp, Mus musculus
tgcaccagacaagatgatagtagct

SEQ ID NO: 373992 - DNA, 25 bp, Mus musculus
tgcaccagagcaatgttcttctgct

SEQ ID NO: 373993 - DNA, 25 bp, Mus musculus
tgcaccagcaagctgagttcctacc

SEQ ID NO: 373994 - DNA, 25 bp, Mus musculus
tgcaccagcatttggtataggaggg

SEQ ID NO: 373995 - DNA, 25 bp, Mus musculus
tgcaccagcgtacagattgcatctg

SEQ ID NO: 373996 - DNA, 25 bp, Mus musculus
tgcaccaggcaccaggtcctgttta

SEQ ID NO: 373997 - DNA, 25 bp, Mus musculus
tgcaccagtctctcaccatgtccaa

SEQ ID NO: 373998 - DNA, 25 bp, Mus musculus
tgcaccatcacaccaccagtcccgc

SEQ ID NO: 373999 - DNA, 25 bp, Mus musculus
tgcaccatccagagagatgccaaag

SEQ ID NO: 374000 - DNA, 25 bp, Mus musculus
tgcaccatcgagggctgtcctggct

SEQ ID NO: 374001 - DNA, 25 bp, Mus musculus
tgcaccatcgccaagaacagcagct

SEQ ID NO: 374002 - DNA, 25 bp, Mus musculus
tgcaccatcgctcactatctggata

SEQ ID NO: 374003 - DNA, 25 bp, Mus musculus
tgcacccaactatactgtcactgcc

SEQ ID NO: 374004 - DNA, 25 bp, Mus musculus
tgcacccaagcccctccagttcttg

SEQ ID NO: 374005 - DNA, 25 bp, Mus musculus
tgcacccaagggcacagaccggctg

SEQ ID NO: 374006 - DNA, 25 bp, Mus musculus
tgcacccagaggcatcagaaaagtt

SEQ ID NO: 374007 - DNA, 25 bp, Mus musculus
tgcaccccagagcgaagaggagcat

SEQ ID NO: 374008 - DNA, 25 bp, Mus musculus
tgcaccccagagcgaatggcggagg

SEQ ID NO: 374009 - DNA, 25 bp, Mus musculus
tgcacccctacagccccagctaacc

SEQ ID NO: 374010 - DNA, 25 bp, Mus musculus
tgcacccctacaggatggtcagaac

SEQ ID NO: 374011 - DNA, 25 bp, Mus musculus
tgcacccctacaggtctgtctgacc

SEQ ID NO: 374012 - DNA, 25 bp, Mus musculus
tgcacccctacagtcagggtttcta

SEQ ID NO: 374013 - DNA, 25 bp, Mus musculus
tgcacccctacagtgttctcaacat

SEQ ID NO: 374014 - DNA, 25 bp, Mus musculus
tgcacccctactctttctgacctgt

SEQ ID NO: 374015 - DNA, 25 bp, Mus musculus
tgcacccgcaaagcctccaggtgag

SEQ ID NO: 374016 - DNA, 25 bp, Mus musculus
tgcaccctctgatactccagatcca

SEQ ID NO: 374017 - DNA, 25 bp, Mus musculus
tgcaccctctgattgctaaagaaga

SEQ ID NO: 374018 - DNA, 25 bp, Mus musculus
tgcacccttacaaaggtgaccgggc

SEQ ID NO: 374019 - DNA, 25 bp, Mus musculus
tgcaccgcggaggctctgcagaagc

SEQ ID NO: 374020 - DNA, 25 bp, Mus musculus
tgcaccggacgccgagatgctccag

SEQ ID NO: 374021 - DNA, 25 bp, Mus musculus
tgcaccggagtcatgggggtctgct

SEQ ID NO: 374022 - DNA, 25 bp, Mus musculus
tgcaccgtgacaagggtgaagatgg

SEQ ID NO: 374023 - DNA, 25 bp, Mus musculus
tgcaccgtgagcgcctatgacttgg

SEQ ID NO: 374024 - DNA, 25 bp, Mus musculus
tgcaccgtgtttgaggccttattca

SEQ ID NO: 374025 - DNA, 25 bp, Mus musculus
tgcacctaaagcatgcgaggtcctt

SEQ ID NO: 374026 - DNA, 25 bp, Mus musculus
tgcacctaaagcatgtttctctaga

SEQ ID NO: 374027 - DNA, 25 bp, Mus musculus
tgcacctaatgccacagagcaacaa

SEQ ID NO: 374028 - DNA, 25 bp, Mus musculus
tgcacctaccaaactggcattatgg

SEQ ID NO: 374029 - DNA, 25 bp, Mus musculus
tgcacctacggcccagaccaccggc

SEQ ID NO: 374030 - DNA, 25 bp, Mus musculus
tgcacctatagatggcattcgctca

SEQ ID NO: 374031 - DNA, 25 bp, Mus musculus
tgcacctatagtgtctataatataa

SEQ ID NO: 374032 - DNA, 25 bp, Mus musculus
tgcacctatatcctgaataaaaagt

SEQ ID NO: 374033 - DNA, 25 bp, Mus musculus
tgcacctcaagagggagagaaaatg

SEQ ID NO: 374034 - DNA, 25 bp, Mus musculus
tgcacctcaagaggtacctaagagt

SEQ ID NO: 374035 - DNA, 25 bp, Mus musculus
tgcacctcagctttgtgcgctctgt

SEQ ID NO: 374036 - DNA, 25 bp, Mus musculus
tgcacctcccaggaccccaagacac

SEQ ID NO: 374037 - DNA, 25 bp, Mus musculus
tgcacctcctgtgctttcgttgggg

SEQ ID NO: 374038 - DNA, 25 bp, Mus musculus
tgcacctgcggacggcatcgctgtc

SEQ ID NO: 374039 - DNA, 25 bp, Mus musculus
tgcacctgcggctctatcagaactt

SEQ ID NO: 374040 - DNA, 25 bp, Mus musculus
tgcacctgcgggtcagattatcgcc

SEQ ID NO: 374041 - DNA, 25 bp, Mus musculus
tgcacctggaagatgctggagacca

SEQ ID NO: 374042 - DNA, 25 bp, Mus musculus
tgcacctggaaggtatgacattatg

SEQ ID NO: 374043 - DNA, 25 bp, Mus musculus
tgcacctggagatctgcctgtcaat

SEQ ID NO: 374044 - DNA, 25 bp, Mus musculus
tgcacctggatgcaccctgctcttc

SEQ ID NO: 374045 - DNA, 25 bp, Mus musculus
tgcacctggatgcattttgttccca

SEQ ID NO: 374046 - DNA, 25 bp, Mus musculus
tgcacctgtccaggcgtttcttttg

SEQ ID NO: 374047 - DNA, 25 bp, Mus musculus
tgcaccttcagcagagcacacaaca

SEQ ID NO: 374048 - DNA, 25 bp, Mus musculus
tgcaccttcaggacgccgaggcagg

SEQ ID NO: 374049 - DNA, 25 bp, Mus musculus
tgcaccttcccacagcatcgccaaa

SEQ ID NO: 374050 - DNA, 25 bp, Mus musculus
tgcaccttcccacaggtctgcctct

SEQ ID NO: 374051 - DNA, 25 bp, Mus musculus
tgcaccttgggccagattgtgtcac

SEQ ID NO: 374052 - DNA, 25 bp, Mus musculus
tgcaccttgggccaggctgctgtag

SEQ ID NO: 374053 - DNA, 25 bp, Mus musculus
tgcacgaaatgaggacaagctactg

SEQ ID NO: 374054 - DNA, 25 bp, Mus musculus
tgcacgactccgctctcactcttga

SEQ ID NO: 374055 - DNA, 25 bp, Mus musculus
tgcacgatcctgacatgactgactt

SEQ ID NO: 374056 - DNA, 25 bp, Mus musculus
tgcacgatgaacttggtaagttctc

SEQ ID NO: 374057 - DNA, 25 bp, Mus musculus
tgcacgcaaggtggccgaaggcctg

SEQ ID NO: 374058 - DNA, 25 bp, Mus musculus
tgcacgcacaggaaatcccaatggc

SEQ ID NO: 374059 - DNA, 25 bp, Mus musculus
tgcacgcaggatggacctctctacg

SEQ ID NO: 374060 - DNA, 25 bp, Mus musculus
tgcacgcaggatgtgtatccatcga

SEQ ID NO: 374061 - DNA, 25 bp, Mus musculus
tgcacgccgccagagacggcaaaga

SEQ ID NO: 374062 - DNA, 25 bp, Mus musculus
tgcacgcctacagcttcctggtggc

SEQ ID NO: 374063 - DNA, 25 bp, Mus musculus
tgcacgcgcttgccgacccttcccg

SEQ ID NO: 374064 - DNA, 25 bp, Mus musculus
tgcacgcggaaagagaactagatca

SEQ ID NO: 374065 - DNA, 25 bp, Mus musculus
tgcacgcggtcagaactgtgccgga

SEQ ID NO: 374066 - DNA, 25 bp, Mus musculus
tgcacgctgatgaccctgactatat

SEQ ID NO: 374067 - DNA, 25 bp, Mus musculus
tgcacgctgatgaccgacccttggg

SEQ ID NO: 374068 - DNA, 25 bp, Mus musculus
tgcacggcaacagatttctttcttt

SEQ ID NO: 374069 - DNA, 25 bp, Mus musculus
tgcacggcaacaggcctgatgggat

SEQ ID NO: 374070 - DNA, 25 bp, Mus musculus
tgcacggcactgccactgattccag

SEQ ID NO: 374071 - DNA, 25 bp, Mus musculus
tgcacggcagattacaaaagaagac

SEQ ID NO: 374072 - DNA, 25 bp, Mus musculus
tgcacggcgggagggagcccagagg

SEQ ID NO: 374073 - DNA, 25 bp, Mus musculus
tgcacggctggccaggccaaggaag

SEQ ID NO: 374074 - DNA, 25 bp, Mus musculus
tgcacgggaaggaagtgggcagcat

SEQ ID NO: 374075 - DNA, 25 bp, Mus musculus
tgcacggtgaagatctggaacaacg

SEQ ID NO: 374076 - DNA, 25 bp, Mus musculus
tgcacgtcaggacaaagtggggcag

SEQ ID NO: 374077 - DNA, 25 bp, Mus musculus
tgcacgtgacagtgggctccctgct

SEQ ID NO: 374078 - DNA, 25 bp, Mus musculus
tgcacgtgcagcgcccacaggcccg

SEQ ID NO: 374079 - DNA, 25 bp, Mus musculus
tgcacgtgcagggtccccgacaaca

SEQ ID NO: 374080 - DNA, 25 bp, Mus musculus
tgcactacacagccattaggaacca

SEQ ID NO: 374081 - DNA, 25 bp, Mus musculus
tgcactacacaggacaccaaggact

SEQ ID NO: 374082 - DNA, 25 bp, Mus musculus
tgcactacgcgggtgacttcacctg

SEQ ID NO: 374083 - DNA, 25 bp, Mus musculus
tgcactagagtatcaagagagcctg

SEQ ID NO: 374084 - DNA, 25 bp, Mus musculus
tgcactagcaggtatggcggctctg

SEQ ID NO: 374085 - DNA, 25 bp, Mus musculus
tgcactagcagttgctcaaatgctc

SEQ ID NO: 374086 - DNA, 25 bp, Mus musculus
tgcactagcgggacttggtgagtat

SEQ ID NO: 374087 - DNA, 25 bp, Mus musculus
tgcactagcggtctcaaaagattca

SEQ ID NO: 374088 - DNA, 25 bp, Mus musculus
tgcactataaagtcgtaaaatatga

SEQ ID NO: 374089 - DNA, 25 bp, Mus musculus
tgcactatcggtctgtgcactgtgt

SEQ ID NO: 374090 - DNA, 25 bp, Mus musculus
tgcactatcggtttggaggtaccaa

SEQ ID NO: 374091 - DNA, 25 bp, Mus musculus
tgcactatgagtctacctgaaggac

SEQ ID NO: 374092 - DNA, 25 bp, Mus musculus
tgcactcaaaagtcagcgtgggaga

SEQ ID NO: 374093 - DNA, 25 bp, Mus musculus
tgcactcaactggctcgggagcctt

SEQ ID NO: 374094 - DNA, 25 bp, Mus musculus
tgcactcactgtgagcacagcggct

SEQ ID NO: 374095 - DNA, 25 bp, Mus musculus
tgcactcagacagatggtgcagagg

SEQ ID NO: 374096 - DNA, 25 bp, Mus musculus
tgcactcagggtggcacaagacttg

SEQ ID NO: 374097 - DNA, 25 bp, Mus musculus
tgcactcaggtcctcattcctaggc

SEQ ID NO: 374098 - DNA, 25 bp, Mus musculus
tgcactcgagacgggccattgctcc

SEQ ID NO: 374099 - DNA, 25 bp, Mus musculus
tgcactcgcagaacaccagcctcat

SEQ ID NO: 374100 - DNA, 25 bp, Mus musculus
tgcactctatgttttctcagtgccc

SEQ ID NO: 374101 - DNA, 25 bp, Mus musculus
tgcactctcagctccagctagaaga

SEQ ID NO: 374102 - DNA, 25 bp, Mus musculus
tgcactctcagctgagcagcaagaa

SEQ ID NO: 374103 - DNA, 25 bp, Mus musculus
tgcactctcagctgctttgctgctg

SEQ ID NO: 374104 - DNA, 25 bp, Mus musculus
tgcactgaaataaccagctttcact

SEQ ID NO: 374105 - DNA, 25 bp, Mus musculus
tgcactgagcgggaactgagccgtg

SEQ ID NO: 374106 - DNA, 25 bp, Mus musculus
tgcactgagtaggcagaaaacttct

SEQ ID NO: 374107 - DNA, 25 bp, Mus musculus
tgcactgatggccggggacctgaag

SEQ ID NO: 374108 - DNA, 25 bp, Mus musculus
tgcactgcaaagctggaatgaagta

SEQ ID NO: 374109 - DNA, 25 bp, Mus musculus
tgcactgcagaaggctctgaaggac

SEQ ID NO: 374110 - DNA, 25 bp, Mus musculus
tgcactgcagggttttggcgaccct

SEQ ID NO: 374111 - DNA, 25 bp, Mus musculus
tgcactgccagcacggggtctggac

SEQ ID NO: 374112 - DNA, 25 bp, Mus musculus
tgcactgccccaaggtgaagaactg

SEQ ID NO: 374113 - DNA, 25 bp, Mus musculus
tgcactgctccatgctggcagaaga

SEQ ID NO: 374114 - DNA, 25 bp, Mus musculus
tgcactggacttgctgaaacctggt

SEQ ID NO: 374115 - DNA, 25 bp, Mus musculus
tgcactggagatggcagtgctggag

SEQ ID NO: 374116 - DNA, 25 bp, Mus musculus
tgcactggaggttccaataccaaca

SEQ ID NO: 374117 - DNA, 25 bp, Mus musculus
tgcactggcagaagctcttggcatt

SEQ ID NO: 374118 - DNA, 25 bp, Mus musculus
tgcactgggaaatatggctttgtaa

SEQ ID NO: 374119 - DNA, 25 bp, Mus musculus
tgcactgggaaggcttgtcgcttac

SEQ ID NO: 374120 - DNA, 25 bp, Mus musculus
tgcactgtaacgagcgcttgtacag

SEQ ID NO: 374121 - DNA, 25 bp, Mus musculus
tgcactgtacagacagtggatttgg

SEQ ID NO: 374122 - DNA, 25 bp, Mus musculus
tgcactgtcagaacaagcctgccat

SEQ ID NO: 374123 - DNA, 25 bp, Mus musculus
tgcactgtcagagagtggggacagc

SEQ ID NO: 374124 - DNA, 25 bp, Mus musculus
tgcactgtcagcagcattccttgcc

SEQ ID NO: 374125 - DNA, 25 bp, Mus musculus
tgcactgtcaggttccgagtccgag

SEQ ID NO: 374126 - DNA, 25 bp, Mus musculus
tgcactgtgggccagatctgccacc

SEQ ID NO: 374127 - DNA, 25 bp, Mus musculus
tgcactgtgtgaccagcccatcaaa

SEQ ID NO: 374128 - DNA, 25 bp, Mus musculus
tgcactgtgtgtggagtgctgacag

SEQ ID NO: 374129 - DNA, 25 bp, Mus musculus
tgcactgtgtgtggcatattctcat

SEQ ID NO: 374130 - DNA, 25 bp, Mus musculus
tgcacttaacaggacaagctctgac

SEQ ID NO: 374131 - DNA, 25 bp, Mus musculus
tgcacttagcatgatgacttgctca

SEQ ID NO: 374132 - DNA, 25 bp, Mus musculus
tgcacttcaaccagtgtttgtcagc

SEQ ID NO: 374133 - DNA, 25 bp, Mus musculus
tgcacttcagacgaattatcaataa

SEQ ID NO: 374134 - DNA, 25 bp, Mus musculus
tgcacttccagatctctgacatcta

SEQ ID NO: 374135 - DNA, 25 bp, Mus musculus
tgcacttcggggaggacagggtaac

SEQ ID NO: 374136 - DNA, 25 bp, Mus musculus
tgcacttcggggaggtggccaagca

SEQ ID NO: 374137 - DNA, 25 bp, Mus musculus
tgcactttacaggtggctttgcagc

SEQ ID NO: 374138 - DNA, 25 bp, Mus musculus
tgcagaaaaagacggcctgtcagga

SEQ ID NO: 374139 - DNA, 25 bp, Mus musculus
tgcagaaaaagcttcaaactctcca

SEQ ID NO: 374140 - DNA, 25 bp, Mus musculus
tgcagaaaaaggagcaggtagggga

SEQ ID NO: 374141 - DNA, 25 bp, Mus musculus
tgcagaaaatatggtggtcactgat

SEQ ID NO: 374142 - DNA, 25 bp, Mus musculus
tgcagaaaatcaaactgcagcttgc

SEQ ID NO: 374143 - DNA, 25 bp, Mus musculus
tgcagaaaatggaagagacctgtgg

SEQ ID NO: 374144 - DNA, 25 bp, Mus musculus
tgcagaaacagacatggcaagtgtc

SEQ ID NO: 374145 - DNA, 25 bp, Mus musculus
tgcagaaacatcgagagatccgggg

SEQ ID NO: 374146 - DNA, 25 bp, Mus musculus
tgcagaaactcaaggctcctgacta

SEQ ID NO: 374147 - DNA, 25 bp, Mus musculus
tgcagaaagaaaagcccttatgtta

SEQ ID NO: 374148 - DNA, 25 bp, Mus musculus
tgcagaaagagctcagggactgcag

SEQ ID NO: 374149 - DNA, 25 bp, Mus musculus
tgcagaaagaggtacataatgctgg

SEQ ID NO: 374150 - DNA, 25 bp, Mus musculus
tgcagaaagaggtgaaaaaactgca

SEQ ID NO: 374151 - DNA, 25 bp, Mus musculus
tgcagaaagcaggattcctctacta

SEQ ID NO: 374152 - DNA, 25 bp, Mus musculus
tgcagaaagcaggccgtctactgtg

SEQ ID NO: 374153 - DNA, 25 bp, Mus musculus
tgcagaaagcagggctgactgtgaa

SEQ ID NO: 374154 - DNA, 25 bp, Mus musculus
tgcagaaagcaggtcatccgggtgg

SEQ ID NO: 374155 - DNA, 25 bp, Mus musculus
tgcagaaattgaagagagagaagcg

SEQ ID NO: 374156 - DNA, 25 bp, Mus musculus
tgcagaacacaagggcaagatcatc

SEQ ID NO: 374157 - DNA, 25 bp, Mus musculus
tgcagaacacagcggagatccagca

SEQ ID NO: 374158 - DNA, 25 bp, Mus musculus
tgcagaacacaggtgttgaatcata

SEQ ID NO: 374159 - DNA, 25 bp, Mus musculus
tgcagaacagaccagagatgggcag

SEQ ID NO: 374160 - DNA, 25 bp, Mus musculus
tgcagaacagagcctacttccagca

SEQ ID NO: 374161 - DNA, 25 bp, Mus musculus
tgcagaacattggagccatgtcaag

SEQ ID NO: 374162 - DNA, 25 bp, Mus musculus
tgcagaaccaggtggagaatctaaa

SEQ ID NO: 374163 - DNA, 25 bp, Mus musculus
tgcagaacctgaggcactgaaagaa

SEQ ID NO: 374164 - DNA, 25 bp, Mus musculus
tgcagaacggatcgagcgtttggaa

SEQ ID NO: 374165 - DNA, 25 bp, Mus musculus
tgcagaacttgcggtcttagagcct

SEQ ID NO: 374166 - DNA, 25 bp, Mus musculus
tgcagaagaaacacatggtgatgtg

SEQ ID NO: 374167 - DNA, 25 bp, Mus musculus
tgcagaagaaactcatggtgatgtg

SEQ ID NO: 374168 - DNA, 25 bp, Mus musculus
tgcagaagacagtgcatttgcaggg

SEQ ID NO: 374169 - DNA, 25 bp, Mus musculus
tgcagaagacagtgctcttactggc

SEQ ID NO: 374170 - DNA, 25 bp, Mus musculus
tgcagaagagaagaaaaattcaacg

SEQ ID NO: 374171 - DNA, 25 bp, Mus musculus
tgcagaagagttagcaaaacgtgga

SEQ ID NO: 374172 - DNA, 25 bp, Mus musculus
tgcagaagcaagatcccaaaaggat

SEQ ID NO: 374173 - DNA, 25 bp, Mus musculus
tgcagaagcaagtgttttgcctgtg

SEQ ID NO: 374174 - DNA, 25 bp, Mus musculus
tgcagaagcagaaagaagaagaagc

SEQ ID NO: 374175 - DNA, 25 bp, Mus musculus
tgcagaagcatcaagatgacttaca

SEQ ID NO: 374176 - DNA, 25 bp, Mus musculus
tgcagaagccatggctcggatggcg

SEQ ID NO: 374177 - DNA, 25 bp, Mus musculus
tgcagaagctggaagatgaagaaaa

SEQ ID NO: 374178 - DNA, 25 bp, Mus musculus
tgcagaaggaatccaacgatgcaga

SEQ ID NO: 374179 - DNA, 25 bp, Mus musculus
tgcagaaggactggcccagcctgag

SEQ ID NO: 374180 - DNA, 25 bp, Mus musculus
tgcagaaggagctcaggggctggag

SEQ ID NO: 374181 - DNA, 25 bp, Mus musculus
tgcagaaggcaatgaaggaaaccaa

SEQ ID NO: 374182 - DNA, 25 bp, Mus musculus
tgcagaaggcaatggaatgatctca

SEQ ID NO: 374183 - DNA, 25 bp, Mus musculus
tgcagaaggcccagctctgataaga

SEQ ID NO: 374184 - DNA, 25 bp, Mus musculus
tgcagaaggcccaggtcgtggactt

SEQ ID NO: 374185 - DNA, 25 bp, Mus musculus
tgcagaaggcccaggtggctttcat

SEQ ID NO: 374186 - DNA, 25 bp, Mus musculus
tgcagaatcacagatggaacaatgt

SEQ ID NO: 374187 - DNA, 25 bp, Mus musculus
tgcagaatcattcaggtctgtctat

SEQ ID NO: 374188 - DNA, 25 bp, Mus musculus
tgcagaatcattcagtcttccgtgt

SEQ ID NO: 374189 - DNA, 25 bp, Mus musculus
tgcagaatcggccagcgcccgagga

SEQ ID NO: 374190 - DNA, 25 bp, Mus musculus
tgcagaatctggaggctggtgaggc

SEQ ID NO: 374191 - DNA, 25 bp, Mus musculus
tgcagaatgcagagtacagttgtga

SEQ ID NO: 374192 - DNA, 25 bp, Mus musculus
tgcagaatgcagcagtttgcaaagc

SEQ ID NO: 374193 - DNA, 25 bp, Mus musculus
tgcagaatgcaggtggaccctcaga

SEQ ID NO: 374194 - DNA, 25 bp, Mus musculus
tgcagaatgcaggtgtaatgtcttt

SEQ ID NO: 374195 - DNA, 25 bp, Mus musculus
tgcagaatgtgataggtttgccaga

SEQ ID NO: 374196 - DNA, 25 bp, Mus musculus
tgcagaatgtttaccgagagaaagc

SEQ ID NO: 374197 - DNA, 25 bp, Mus musculus
tgcagaattctgaagaggacagctc

SEQ ID NO: 374198 - DNA, 25 bp, Mus musculus
tgcagacaaagatggggcaaatcta

SEQ ID NO: 374199 - DNA, 25 bp, Mus musculus
tgcagacaagccaagaatgtgctga

SEQ ID NO: 374200 - DNA, 25 bp, Mus musculus
tgcagacacagatgacgctcctgtc

SEQ ID NO: 374201 - DNA, 25 bp, Mus musculus
tgcagacacagggctctgctctgaa

SEQ ID NO: 374202 - DNA, 25 bp, Mus musculus
tgcagacacgagatcttgtacaacc

SEQ ID NO: 374203 - DNA, 25 bp, Mus musculus
tgcagacagaacggtcattgattac

SEQ ID NO: 374204 - DNA, 25 bp, Mus musculus
tgcagacagaacggttgattacaac

SEQ ID NO: 374205 - DNA, 25 bp, Mus musculus
tgcagacagagaacggggagttggc

SEQ ID NO: 374206 - DNA, 25 bp, Mus musculus
tgcagacagagaatggggagctgtc

SEQ ID NO: 374207 - DNA, 25 bp, Mus musculus
tgcagacatttatggtggttatgct

SEQ ID NO: 374208 - DNA, 25 bp, Mus musculus
tgcagaccacccaggctttaaagat

SEQ ID NO: 374209 - DNA, 25 bp, Mus musculus
tgcagaccagaggctgcctggagca

SEQ ID NO: 374210 - DNA, 25 bp, Mus musculus
tgcagaccatggggccgaggaggac

SEQ ID NO: 374211 - DNA, 25 bp, Mus musculus
tgcagaccccggaaagccagaacct

SEQ ID NO: 374212 - DNA, 25 bp, Mus musculus
tgcagacctcaccgacacactggat

SEQ ID NO: 374213 - DNA, 25 bp, Mus musculus
tgcagacctcaccttcctcacaggt

SEQ ID NO: 374214 - DNA, 25 bp, Mus musculus
tgcagacctctgacaaggatgagag

SEQ ID NO: 374215 - DNA, 25 bp, Mus musculus
tgcagacctctgagcgaacatccca

SEQ ID NO: 374216 - DNA, 25 bp, Mus musculus
tgcagacctgccaggacgctgagcc

SEQ ID NO: 374217 - DNA, 25 bp, Mus musculus
tgcagacctgccaggtgtcaccatg

SEQ ID NO: 374218 - DNA, 25 bp, Mus musculus
tgcagacctgggactggctgtgatg

SEQ ID NO: 374219 - DNA, 25 bp, Mus musculus
tgcagacggccatggaaccacaaac

SEQ ID NO: 374220 - DNA, 25 bp, Mus musculus
tgcagacggctccagattactacaa

SEQ ID NO: 374221 - DNA, 25 bp, Mus musculus
tgcagacgtagagggatttaaagac

SEQ ID NO: 374222 - DNA, 25 bp, Mus musculus
tgcagactaaaggcatgcagtatgg

SEQ ID NO: 374223 - DNA, 25 bp, Mus musculus
tgcagactaaaggtgttgacagctc

SEQ ID NO: 374224 - DNA, 25 bp, Mus musculus
tgcagactacagcggtcagcagagc

SEQ ID NO: 374225 - DNA, 25 bp, Mus musculus
tgcagactcatggctgggctctaca

SEQ ID NO: 374226 - DNA, 25 bp, Mus musculus
tgcagactcggtcaccactcaagat

SEQ ID NO: 374227 - DNA, 25 bp, Mus musculus
tgcagactctgatactaccacaaga

SEQ ID NO: 374228 - DNA, 25 bp, Mus musculus
tgcagactctgtccagccagctggc

SEQ ID NO: 374229 - DNA, 25 bp, Mus musculus
tgcagactgcggtgaggggagccga

SEQ ID NO: 374230 - DNA, 25 bp, Mus musculus
tgcagacttccacagcacagccccc

SEQ ID NO: 374231 - DNA, 25 bp, Mus musculus
tgcagacttcccagctctcttctcc

SEQ ID NO: 374232 - DNA, 25 bp, Mus musculus
tgcagacttcccagggctatacatc

SEQ ID NO: 374233 - DNA, 25 bp, Mus musculus
tgcagacttccgggtctgacagagc

SEQ ID NO: 374234 - DNA, 25 bp, Mus musculus
tgcagagaaactcatcaagcaatca

SEQ ID NO: 374235 - DNA, 25 bp, Mus musculus
tgcagagaaagaacatttcagaaca

SEQ ID NO: 374236 - DNA, 25 bp, Mus musculus
tgcagagaaagagggggcccgccta

SEQ ID NO: 374237 - DNA, 25 bp, Mus musculus
tgcagagaaatgtgatttgttcatc

SEQ ID NO: 374238 - DNA, 25 bp, Mus musculus
tgcagagacagatttgatcaaaaaa

SEQ ID NO: 374239 - DNA, 25 bp, Mus musculus
tgcagagacaggagctgctgctgga

SEQ ID NO: 374240 - DNA, 25 bp, Mus musculus
tgcagagacaggtactgagttcaaa

SEQ ID NO: 374241 - DNA, 25 bp, Mus musculus
tgcagagacattttgagcagcaccg

SEQ ID NO: 374242 - DNA, 25 bp, Mus musculus
tgcagagaccccgatcctcgtggga

SEQ ID NO: 374243 - DNA, 25 bp, Mus musculus
tgcagagaccccggaccaatctccg

SEQ ID NO: 374244 - DNA, 25 bp, Mus musculus
tgcagagaccccgggtccagcacca

SEQ ID NO: 374245 - DNA, 25 bp, Mus musculus
tgcagagaccgctacatcagaagat

SEQ ID NO: 374246 - DNA, 25 bp, Mus musculus
tgcagagactgtgagcaaagaaaat

SEQ ID NO: 374247 - DNA, 25 bp, Mus musculus
tgcagagactgtgctgtatctggtg

SEQ ID NO: 374248 - DNA, 25 bp, Mus musculus
tgcagagacttcttccctaggaaaa

SEQ ID NO: 374249 - DNA, 25 bp, Mus musculus
tgcagagagatgactggtctggttc

SEQ ID NO: 374250 - DNA, 25 bp, Mus musculus
tgcagagagatgagcatccagctca

SEQ ID NO: 374251 - DNA, 25 bp, Mus musculus
tgcagagagctctggcgcaacagcg

SEQ ID NO: 374252 - DNA, 25 bp, Mus musculus
tgcagagagtcaggaacgtggaagt

SEQ ID NO: 374253 - DNA, 25 bp, Mus musculus
tgcagagatcgggttctgcggggag

SEQ ID NO: 374254 - DNA, 25 bp, Mus musculus
tgcagagcagatctggtggccctcc

SEQ ID NO: 374255 - DNA, 25 bp, Mus musculus
tgcagagcaggtttgacatggctga

SEQ ID NO: 374256 - DNA, 25 bp, Mus musculus
tgcagagcatggtctagtctcctga

SEQ ID NO: 374257 - DNA, 25 bp, Mus musculus
tgcagagccacggtcaagatgctga

SEQ ID NO: 374258 - DNA, 25 bp, Mus musculus
tgcagagccagagccagctgacctc

SEQ ID NO: 374259 - DNA, 25 bp, Mus musculus
tgcagagccagagtctgcagacaat

SEQ ID NO: 374260 - DNA, 25 bp, Mus musculus
tgcagagccagtgagccctgcctag

SEQ ID NO: 374261 - DNA, 25 bp, Mus musculus
tgcagagcctggctggcacgttttg

SEQ ID NO: 374262 - DNA, 25 bp, Mus musculus
tgcagagcgagatcaagaaatccac

SEQ ID NO: 374263 - DNA, 25 bp, Mus musculus
tgcagagcgaggtaaagaaatccac

SEQ ID NO: 374264 - DNA, 25 bp, Mus musculus
tgcagagcgggaggagactcggaag

SEQ ID NO: 374265 - DNA, 25 bp, Mus musculus
tgcagagctgtaaggccgtggcaga

SEQ ID NO: 374266 - DNA, 25 bp, Mus musculus
tgcagagcttaagccaatccatggc

SEQ ID NO: 374267 - DNA, 25 bp, Mus musculus
tgcagagcttcgagcttccattaag

SEQ ID NO: 374268 - DNA, 25 bp, Mus musculus
tgcagaggaccaaggaagccgtgaa

SEQ ID NO: 374269 - DNA, 25 bp, Mus musculus
tgcagaggactgggccccacaggat

SEQ ID NO: 374270 - DNA, 25 bp, Mus musculus
tgcagaggactgtatgaacgaggct

SEQ ID NO: 374271 - DNA, 25 bp, Mus musculus
tgcagaggagaacgcggtgtgtgag

SEQ ID NO: 374272 - DNA, 25 bp, Mus musculus
tgcagaggagcctggccccttcatg

SEQ ID NO: 374273 - DNA, 25 bp, Mus musculus
tgcagaggaggagggtggacggacc

SEQ ID NO: 374274 - DNA, 25 bp, Mus musculus
tgcagaggaggtgttactagtacag

SEQ ID NO: 374275 - DNA, 25 bp, Mus musculus
tgcagaggataagtactctcagaag

SEQ ID NO: 374276 - DNA, 25 bp, Mus musculus
tgcagaggcacatataatggaacta

SEQ ID NO: 374277 - DNA, 25 bp, Mus musculus
tgcagaggcagatataatggaacta

SEQ ID NO: 374278 - DNA, 25 bp, Mus musculus
tgcagaggccagagctattaagaat

SEQ ID NO: 374279 - DNA, 25 bp, Mus musculus
tgcagaggctgacaggcggaacttg

SEQ ID NO: 374280 - DNA, 25 bp, Mus musculus
tgcagaggtccagacgtcgcctcat

SEQ ID NO: 374281 - DNA, 25 bp, Mus musculus
tgcagaggtgacagatcccacaacg

SEQ ID NO: 374282 - DNA, 25 bp, Mus musculus
tgcagagtaatgctccaagtatgtt

SEQ ID NO: 374283 - DNA, 25 bp, Mus musculus
tgcagagtcaaaacagcagtgacag

SEQ ID NO: 374284 - DNA, 25 bp, Mus musculus
tgcagagtcaaagatgttgatcctg

SEQ ID NO: 374285 - DNA, 25 bp, Mus musculus
tgcagagtctgtgcggtgaccacac

SEQ ID NO: 374286 - DNA, 25 bp, Mus musculus
tgcagagtgaaatgacactgctgtc

SEQ ID NO: 374287 - DNA, 25 bp, Mus musculus
tgcagagtgagcaccaggttttgtg

SEQ ID NO: 374288 - DNA, 25 bp, Mus musculus
tgcagagtgagcagccccacagtga

SEQ ID NO: 374289 - DNA, 25 bp, Mus musculus
tgcagagtgatgtcaagtacaaatc

SEQ ID NO: 374290 - DNA, 25 bp, Mus musculus
tgcagagtgcagtattgtggaatgt

SEQ ID NO: 374291 - DNA, 25 bp, Mus musculus
tgcagagtgctgatcagggcactga

SEQ ID NO: 374292 - DNA, 25 bp, Mus musculus
tgcagagtggcatggaaggtgaagg

SEQ ID NO: 374293 - DNA, 25 bp, Mus musculus
tgcagatacaggatcacttctgtat

SEQ ID NO: 374294 - DNA, 25 bp, Mus musculus
tgcagatcagacccagcatgtgcag

SEQ ID NO: 374295 - DNA, 25 bp, Mus musculus
tgcagatccgcccctccttctcctg

SEQ ID NO: 374296 - DNA, 25 bp, Mus musculus
tgcagatccggtcctctccgggctg

SEQ ID NO: 374297 - DNA, 25 bp, Mus musculus
tgcagatcctgacaagggcacgtgg

SEQ ID NO: 374298 - DNA, 25 bp, Mus musculus
tgcagatgacctcctcctggggagg

SEQ ID NO: 374299 - DNA, 25 bp, Mus musculus
tgcagatgatgggagaattctgtgg

SEQ ID NO: 374300 - DNA, 25 bp, Mus musculus
tgcagatgatgggtgcagtttgaga

SEQ ID NO: 374301 - DNA, 25 bp, Mus musculus
tgcagatgcacagatttgacataat

SEQ ID NO: 374302 - DNA, 25 bp, Mus musculus
tgcagatgccgacttggacattgct

SEQ ID NO: 374303 - DNA, 25 bp, Mus musculus
tgcagatgcgggaggggaaaatgga

SEQ ID NO: 374304 - DNA, 25 bp, Mus musculus
tgcagatggaaagatgacatcgttc

SEQ ID NO: 374305 - DNA, 25 bp, Mus musculus
tgcagatggcaaagcaacagaaaag

SEQ ID NO: 374306 - DNA, 25 bp, Mus musculus
tgcagatggcaaaggaagactccct

SEQ ID NO: 374307 - DNA, 25 bp, Mus musculus
tgcagatggctaggagtaaaaatgg

SEQ ID NO: 374308 - DNA, 25 bp, Mus musculus
tgcagatggctagggaatgtggagc

SEQ ID NO: 374309 - DNA, 25 bp, Mus musculus
tgcagatgtccctgtccattgccct

SEQ ID NO: 374310 - DNA, 25 bp, Mus musculus
tgcagattcaaagttcacagtcaga

SEQ ID NO: 374311 - DNA, 25 bp, Mus musculus
tgcagattcaaatgaccagcagtta

SEQ ID NO: 374312 - DNA, 25 bp, Mus musculus
tgcagatttccgaaggtacatttta

SEQ ID NO: 374313 - DNA, 25 bp, Mus musculus
tgcagatttgggacacagcaggcca

SEQ ID NO: 374314 - DNA, 25 bp, Mus musculus
tgcagcaaagagttccaacacccac

SEQ ID NO: 374315 - DNA, 25 bp, Mus musculus
tgcagcaaagccaccatgccaatca

SEQ ID NO: 374316 - DNA, 25 bp, Mus musculus
tgcagcaaaggaaggacagacgaat

SEQ ID NO: 374317 - DNA, 25 bp, Mus musculus
tgcagcaaaggccgatacaaagcag

SEQ ID NO: 374318 - DNA, 25 bp, Mus musculus
tgcagcaacaaggcgggaggaagca

SEQ ID NO: 374319 - DNA, 25 bp, Mus musculus
tgcagcaacaatagaattttcattt

SEQ ID NO: 374320 - DNA, 25 bp, Mus musculus
tgcagcaacaataggtgttgacttt

SEQ ID NO: 374321 - DNA, 25 bp, Mus musculus
tgcagcaaccaagctgtgattggac

SEQ ID NO: 374322 - DNA, 25 bp, Mus musculus
tgcagcaaccaaggagacagtgatg

SEQ ID NO: 374323 - DNA, 25 bp, Mus musculus
tgcagcaagagttccactgttgtgg

SEQ ID NO: 374324 - DNA, 25 bp, Mus musculus
tgcagcaataccctgcagcaagggg

SEQ ID NO: 374325 - DNA, 25 bp, Mus musculus
tgcagcacaacccttccaggcagac

SEQ ID NO: 374326 - DNA, 25 bp, Mus musculus
tgcagcacaatcgagagcagcaaaa

SEQ ID NO: 374327 - DNA, 25 bp, Mus musculus
tgcagcacaatcgagatcctgcctc

SEQ ID NO: 374328 - DNA, 25 bp, Mus musculus
tgcagcacagcagatttaggaccga

SEQ ID NO: 374329 - DNA, 25 bp, Mus musculus
tgcagcacagcagggacagggtggt

SEQ ID NO: 374330 - DNA, 25 bp, Mus musculus
tgcagcacagggggcagtgcccaaa

SEQ ID NO: 374331 - DNA, 25 bp, Mus musculus
tgcagcacaggttctgattcggttc

SEQ ID NO: 374332 - DNA, 25 bp, Mus musculus
tgcagcaccctgacacccagggctc

SEQ ID NO: 374333 - DNA, 25 bp, Mus musculus
tgcagcaccctgccagtggcccagc

SEQ ID NO: 374334 - DNA, 25 bp, Mus musculus
tgcagcacctgatagctcgggaggc

SEQ ID NO: 374335 - DNA, 25 bp, Mus musculus
tgcagcacgcaactgatttagatga

SEQ ID NO: 374336 - DNA, 25 bp, Mus musculus
tgcagcactacacagcagcgtaccc

SEQ ID NO: 374337 - DNA, 25 bp, Mus musculus
tgcagcactacacagcctccagccc

SEQ ID NO: 374338 - DNA, 25 bp, Mus musculus
tgcagcactgcaggagcctgtgacc

SEQ ID NO: 374339 - DNA, 25 bp, Mus musculus
tgcagcacttcagtgctgtcttcct

SEQ ID NO: 374340 - DNA, 25 bp, Mus musculus
tgcagcagaaagatagaagctagaa

SEQ ID NO: 374341 - DNA, 25 bp, Mus musculus
tgcagcagaacctggaagctatgct

SEQ ID NO: 374342 - DNA, 25 bp, Mus musculus
tgcagcagaagattctctgtggcaa

SEQ ID NO: 374343 - DNA, 25 bp, Mus musculus
tgcagcagcaggaggtgtatggtgc

SEQ ID NO: 374344 - DNA, 25 bp, Mus musculus
tgcagcagcagttgcaacaacctca

SEQ ID NO: 374345 - DNA, 25 bp, Mus musculus
tgcagcagcattagattgtcttcga

SEQ ID NO: 374346 - DNA, 25 bp, Mus musculus
tgcagcagccggaggggcacacaaa

SEQ ID NO: 374347 - DNA, 25 bp, Mus musculus
tgcagcagccggaggtgtgtttcat

SEQ ID NO: 374348 - DNA, 25 bp, Mus musculus
tgcagcagccggagtttgaagagga

SEQ ID NO: 374349 - DNA, 25 bp, Mus musculus
tgcagcagcttagagaagctgatgg

SEQ ID NO: 374350 - DNA, 25 bp, Mus musculus
tgcagcagcttagggatacaagttg

SEQ ID NO: 374351 - DNA, 25 bp, Mus musculus
tgcagcaggcagccagcccagtggg

SEQ ID NO: 374352 - DNA, 25 bp, Mus musculus
tgcagcaggctctattcccaacttt

SEQ ID NO: 374353 - DNA, 25 bp, Mus musculus
tgcagcaggctcttgcatcccctca

SEQ ID NO: 374354 - DNA, 25 bp, Mus musculus
tgcagcaggggccctccctgaccct

SEQ ID NO: 374355 - DNA, 25 bp, Mus musculus
tgcagcagtatgccttcctcaagcc

SEQ ID NO: 374356 - DNA, 25 bp, Mus musculus
tgcagcagtgtgaagggctcaggat

SEQ ID NO: 374357 - DNA, 25 bp, Mus musculus
tgcagcatataacaggaacggtcat

SEQ ID NO: 374358 - DNA, 25 bp, Mus musculus
tgcagcatataacaggaatttctct

SEQ ID NO: 374359 - DNA, 25 bp, Mus musculus
tgcagcatcacaggaggcacctcac

SEQ ID NO: 374360 - DNA, 25 bp, Mus musculus
tgcagcatctgaggaacaagcaatg

SEQ ID NO: 374361 - DNA, 25 bp, Mus musculus
tgcagcatctgaggaagactcttca

SEQ ID NO: 374362 - DNA, 25 bp, Mus musculus
tgcagcatgaaaggatcttctacct

SEQ ID NO: 374363 - DNA, 25 bp, Mus musculus
tgcagcattcaggtcaaggaagctg

SEQ ID NO: 374364 - DNA, 25 bp, Mus musculus
tgcagccaaagggtggataccctgg

SEQ ID NO: 374365 - DNA, 25 bp, Mus musculus
tgcagccaacgggattggtcgcctg

SEQ ID NO: 374366 - DNA, 25 bp, Mus musculus
tgcagccaagaagtccaggaagaag

SEQ ID NO: 374367 - DNA, 25 bp, Mus musculus
tgcagccaaggccacagaggatcaa

SEQ ID NO: 374368 - DNA, 25 bp, Mus musculus
tgcagccaagtccctgccgccttcg

SEQ ID NO: 374369 - DNA, 25 bp, Mus musculus
tgcagccaagtggaccattgacctg

SEQ ID NO: 374370 - DNA, 25 bp, Mus musculus
tgcagccaagtggaccccacagagc

SEQ ID NO: 374371 - DNA, 25 bp, Mus musculus
tgcagccaccagaggatgacagagg

SEQ ID NO: 374372 - DNA, 25 bp, Mus musculus
tgcagccacgatggacagtctgagg

SEQ ID NO: 374373 - DNA, 25 bp, Mus musculus
tgcagccactgggttgccaagaagt

SEQ ID NO: 374374 - DNA, 25 bp, Mus musculus
tgcagccagaacccgattcatcagt

SEQ ID NO: 374375 - DNA, 25 bp, Mus musculus
tgcagccagaagaatatccagttat

SEQ ID NO: 374376 - DNA, 25 bp, Mus musculus
tgcagccagcagcatgtgtttcagt

SEQ ID NO: 374377 - DNA, 25 bp, Mus musculus
tgcagccaggcgatgacgtggtctc

SEQ ID NO: 374378 - DNA, 25 bp, Mus musculus
tgcagcccagaagggtgtgcagatt

SEQ ID NO: 374379 - DNA, 25 bp, Mus musculus
tgcagcccagagaagagtttagcgg

SEQ ID NO: 374380 - DNA, 25 bp, Mus musculus
tgcagcccagggcgctgtgaggtta

SEQ ID NO: 374381 - DNA, 25 bp, Mus musculus
tgcagcccagtggtatgacctgatg

SEQ ID NO: 374382 - DNA, 25 bp, Mus musculus
tgcagcccatccgctgagttcctga

SEQ ID NO: 374383 - DNA, 25 bp, Mus musculus
tgcagccccagggcctgcttccgag

SEQ ID NO: 374384 - DNA, 25 bp, Mus musculus
tgcagcccctgtccaggtgattgag

SEQ ID NO: 374385 - DNA, 25 bp, Mus musculus
tgcagcccgagggatgagtttgtgg

SEQ ID NO: 374386 - DNA, 25 bp, Mus musculus
tgcagccgaggcagacgaggcatat

SEQ ID NO: 374387 - DNA, 25 bp, Mus musculus
tgcagccgagggaatgggcttggaa

SEQ ID NO: 374388 - DNA, 25 bp, Mus musculus
tgcagccgcccggccatctgcttca

SEQ ID NO: 374389 - DNA, 25 bp, Mus musculus
tgcagccgcccgggacaggccatct

SEQ ID NO: 374390 - DNA, 25 bp, Mus musculus
tgcagccgctaccccggaagaccag

SEQ ID NO: 374391 - DNA, 25 bp, Mus musculus
tgcagccgctacgaccccatccctg

SEQ ID NO: 374392 - DNA, 25 bp, Mus musculus
tgcagccgctggatccagccgcagc

SEQ ID NO: 374393 - DNA, 25 bp, Mus musculus
tgcagccgtgcagagaaaatttcct

SEQ ID NO: 374394 - DNA, 25 bp, Mus musculus
tgcagccgtgcagagatcctgtaca

SEQ ID NO: 374395 - DNA, 25 bp, Mus musculus
tgcagcctcagcaaagaagagtcga

SEQ ID NO: 374396 - DNA, 25 bp, Mus musculus
tgcagcctcagccaagttgaagttc

SEQ ID NO: 374397 - DNA, 25 bp, Mus musculus
tgcagcctcgggttcctccatctcc

SEQ ID NO: 374398 - DNA, 25 bp, Mus musculus
tgcagcctctgtccggatagcttct

SEQ ID NO: 374399 - DNA, 25 bp, Mus musculus
tgcagcctgtaagcccagcactatg

SEQ ID NO: 374400 - DNA, 25 bp, Mus musculus
tgcagcctgtaagcccagcatgtgc

SEQ ID NO: 374401 - DNA, 25 bp, Mus musculus
tgcagcctgtaagttcttgcagata

SEQ ID NO: 374402 - DNA, 25 bp, Mus musculus
tgcagcgacggatcgaagcctgttc

SEQ ID NO: 374403 - DNA, 25 bp, Mus musculus
tgcagcgactggctctggtccttca

SEQ ID NO: 374404 - DNA, 25 bp, Mus musculus
tgcagcgagaggtggaggtagaggt

SEQ ID NO: 374405 - DNA, 25 bp, Mus musculus
tgcagcgaggagggctaccagttcc

SEQ ID NO: 374406 - DNA, 25 bp, Mus musculus
tgcagcgatcaggtaatagtgcagc

SEQ ID NO: 374407 - DNA, 25 bp, Mus musculus
tgcagcgattcaagaatttgcatca

SEQ ID NO: 374408 - DNA, 25 bp, Mus musculus
tgcagcgattcaagagtgcactctt

SEQ ID NO: 374409 - DNA, 25 bp, Mus musculus
tgcagcgcctggagcatgcagccaa

SEQ ID NO: 374410 - DNA, 25 bp, Mus musculus
tgcagcgcgcagacgggtccagtga

SEQ ID NO: 374411 - DNA, 25 bp, Mus musculus
tgcagcgcgcagcccctggaggaag

SEQ ID NO: 374412 - DNA, 25 bp, Mus musculus
tgcagcgcggcgaaagaaagatcac

SEQ ID NO: 374413 - DNA, 25 bp, Mus musculus
tgcagcgctagatggaggtgaattg

SEQ ID NO: 374414 - DNA, 25 bp, Mus musculus
tgcagcgctatgcttggcgcaaacg

SEQ ID NO: 374415 - DNA, 25 bp, Mus musculus
tgcagcgctatgtgatgtacaaagc

SEQ ID NO: 374416 - DNA, 25 bp, Mus musculus
tgcagcgctcacgggaaccagtgac

SEQ ID NO: 374417 - DNA, 25 bp, Mus musculus
tgcagcgctccggaccctggctggg

SEQ ID NO: 374418 - DNA, 25 bp, Mus musculus
tgcagcgctccggtggaatgaacct

SEQ ID NO: 374419 - DNA, 25 bp, Mus musculus
tgcagcggaagggcgtgtggaatgt

SEQ ID NO: 374420 - DNA, 25 bp, Mus musculus
tgcagcggcatgaagatgagctaag

SEQ ID NO: 374421 - DNA, 25 bp, Mus musculus
tgcagcggcatggtgatgaatcttt

SEQ ID NO: 374422 - DNA, 25 bp, Mus musculus
tgcagcggcttcctctggggggtca

SEQ ID NO: 374423 - DNA, 25 bp, Mus musculus
tgcagcgggagggcagcagagcttt

SEQ ID NO: 374424 - DNA, 25 bp, Mus musculus
tgcagcgggccagctacgaatacat

SEQ ID NO: 374425 - DNA, 25 bp, Mus musculus
tgcagcgggccaggaatgagatcag

SEQ ID NO: 374426 - DNA, 25 bp, Mus musculus
tgcagcgggtttcgacttctcgccg

SEQ ID NO: 374427 - DNA, 25 bp, Mus musculus
tgcagcgttcgaggagcgacacaac

SEQ ID NO: 374428 - DNA, 25 bp, Mus musculus
tgcagcgttcgaggtcgtgagtcag

SEQ ID NO: 374429 - DNA, 25 bp, Mus musculus
tgcagctaaagatgaacatgaaaca

SEQ ID NO: 374430 - DNA, 25 bp, Mus musculus
tgcagctaacaggattggtatcatt

SEQ ID NO: 374431 - DNA, 25 bp, Mus musculus
tgcagctaaggcagaaaagatagca

SEQ ID NO: 374432 - DNA, 25 bp, Mus musculus
tgcagctacaggagtcatggctggc

SEQ ID NO: 374433 - DNA, 25 bp, Mus musculus
tgcagctacgccaggcacaaatatg

SEQ ID NO: 374434 - DNA, 25 bp, Mus musculus
tgcagctagaagggaagtctcagcg

SEQ ID NO: 374435 - DNA, 25 bp, Mus musculus
tgcagctatgtcaaagataagtgtt

SEQ ID NO: 374436 - DNA, 25 bp, Mus musculus
tgcagctcacctccgctgcctgcct

SEQ ID NO: 374437 - DNA, 25 bp, Mus musculus
tgcagctcagtcactcagctgcagc

SEQ ID NO: 374438 - DNA, 25 bp, Mus musculus
tgcagctccgagagcaggtctgggg

SEQ ID NO: 374439 - DNA, 25 bp, Mus musculus
tgcagctccgagaggtcctggccca

SEQ ID NO: 374440 - DNA, 25 bp, Mus musculus
tgcagctcctgaatgtacccctcta

SEQ ID NO: 374441 - DNA, 25 bp, Mus musculus
tgcagctctccagtgtggatgccac

SEQ ID NO: 374442 - DNA, 25 bp, Mus musculus
tgcagctctctcaggagttaaaaat

SEQ ID NO: 374443 - DNA, 25 bp, Mus musculus
tgcagctcttagagattcccaccct

SEQ ID NO: 374444 - DNA, 25 bp, Mus musculus
tgcagctgaggagcagctgccttct

SEQ ID NO: 374445 - DNA, 25 bp, Mus musculus
tgcagctgaggcgtaagttggattt

SEQ ID NO: 374446 - DNA, 25 bp, Mus musculus
tgcagctgagtccacgtgaagtcac

SEQ ID NO: 374447 - DNA, 25 bp, Mus musculus
tgcagctgcaaaggagggctgctgg

SEQ ID NO: 374448 - DNA, 25 bp, Mus musculus
tgcagctgcacgggcaggtggtagc

SEQ ID NO: 374449 - DNA, 25 bp, Mus musculus
tgcagctgccatgactcagtcggct

SEQ ID NO: 374450 - DNA, 25 bp, Mus musculus
tgcagctgccatgggaattcctcaa

SEQ ID NO: 374451 - DNA, 25 bp, Mus musculus
tgcagctgcgaggctctacacagag

SEQ ID NO: 374452 - DNA, 25 bp, Mus musculus
tgcagctgctgaaggaagcaatgtg

SEQ ID NO: 374453 - DNA, 25 bp, Mus musculus
tgcagctgctgattgggaacaagtc

SEQ ID NO: 374454 - DNA, 25 bp, Mus musculus
tgcagctgctgctgagtgagcgggt

SEQ ID NO: 374455 - DNA, 25 bp, Mus musculus
tgcagctggaggtgtggaacaccag

SEQ ID NO: 374456 - DNA, 25 bp, Mus musculus
tgcagctggatgaagatgggtttgt

SEQ ID NO: 374457 - DNA, 25 bp, Mus musculus
tgcagctggccgagaaaaacgggta

SEQ ID NO: 374458 - DNA, 25 bp, Mus musculus
tgcagctggccgaggaacacctgct

SEQ ID NO: 374459 - DNA, 25 bp, Mus musculus
tgcagctggtggagcactacaccac

SEQ ID NO: 374460 - DNA, 25 bp, Mus musculus
tgcagctggtggaggcatggctgga

SEQ ID NO: 374461 - DNA, 25 bp, Mus musculus
tgcagcttcaggaccacagccactt

SEQ ID NO: 374462 - DNA, 25 bp, Mus musculus
tgcagcttcaggatttctaccacga

SEQ ID NO: 374463 - DNA, 25 bp, Mus musculus
tgcagcttcatgagtttaaattcct

SEQ ID NO: 374464 - DNA, 25 bp, Mus musculus
tgcagcttcgagaagtacgatgaag

SEQ ID NO: 374465 - DNA, 25 bp, Mus musculus
tgcagctttgttgagaaggagcgcc

SEQ ID NO: 374466 - DNA, 25 bp, Mus musculus
tgcaggaaaacattgctgatagccc

SEQ ID NO: 374467 - DNA, 25 bp, Mus musculus
tgcaggaaaagagttcctggtctga

SEQ ID NO: 374468 - DNA, 25 bp, Mus musculus
tgcaggaaactggagtgtgggttcg

SEQ ID NO: 374469 - DNA, 25 bp, Mus musculus
tgcaggaaagacatggaaggcctcg

SEQ ID NO: 374470 - DNA, 25 bp, Mus musculus
tgcaggaaagatggccctgcatgca

SEQ ID NO: 374471 - DNA, 25 bp, Mus musculus
tgcaggaaccaatgagacaccatga

SEQ ID NO: 374472 - DNA, 25 bp, Mus musculus
tgcaggaaccaatggagccattccg

SEQ ID NO: 374473 - DNA, 25 bp, Mus musculus
tgcaggaaccaggttggtctggggt

SEQ ID NO: 374474 - DNA, 25 bp, Mus musculus
tgcaggaaccagttggaaggacctg

SEQ ID NO: 374475 - DNA, 25 bp, Mus musculus
tgcaggaagcacgggggtaccattc

SEQ ID NO: 374476 - DNA, 25 bp, Mus musculus
tgcaggaagcacgggtggctgcaag

SEQ ID NO: 374477 - DNA, 25 bp, Mus musculus
tgcaggaagcgctgctccgaaagac

SEQ ID NO: 374478 - DNA, 25 bp, Mus musculus
tgcaggaagctcagatgctgcagtt

SEQ ID NO: 374479 - DNA, 25 bp, Mus musculus
tgcaggaaggtgtggggcggagtcc

SEQ ID NO: 374480 - DNA, 25 bp, Mus musculus
tgcaggaatatttaaggctgcaagc

SEQ ID NO: 374481 - DNA, 25 bp, Mus musculus
tgcaggacagctgtggagctggcct

SEQ ID NO: 374482 - DNA, 25 bp, Mus musculus
tgcaggacaggaggattacaaccag

SEQ ID NO: 374483 - DNA, 25 bp, Mus musculus
tgcaggacagggaggtactgatact

SEQ ID NO: 374484 - DNA, 25 bp, Mus musculus
tgcaggacagggaggttccagaata

SEQ ID NO: 374485 - DNA, 25 bp, Mus musculus
tgcaggacaggtggcctctgatgat

SEQ ID NO: 374486 - DNA, 25 bp, Mus musculus
tgcaggacatgaagctacagtcgtt

SEQ ID NO: 374487 - DNA, 25 bp, Mus musculus
tgcaggaccacagaactacagctga

SEQ ID NO: 374488 - DNA, 25 bp, Mus musculus
tgcaggaccacagttatatatcttc

SEQ ID NO: 374489 - DNA, 25 bp, Mus musculus
tgcaggaccaggtgtcatttggaac

SEQ ID NO: 374490 - DNA, 25 bp, Mus musculus
tgcaggaccaggtgtctgatctgga

SEQ ID NO: 374491 - DNA, 25 bp, Mus musculus
tgcaggactacatgctcacagttac

SEQ ID NO: 374492 - DNA, 25 bp, Mus musculus
tgcaggactgaggaagccagctttg

SEQ ID NO: 374493 - DNA, 25 bp, Mus musculus
tgcaggactgaggtcctctttcagc

SEQ ID NO: 374494 - DNA, 25 bp, Mus musculus
tgcaggactgggctacacagagaaa

SEQ ID NO: 374495 - DNA, 25 bp, Mus musculus
tgcaggactgggctacgcagatcaa

SEQ ID NO: 374496 - DNA, 25 bp, Mus musculus
tgcaggagaaaagaataaatgaaga

SEQ ID NO: 374497 - DNA, 25 bp, Mus musculus
tgcaggagaagatcacaagagggaa

SEQ ID NO: 374498 - DNA, 25 bp, Mus musculus
tgcaggagaagatggtggatcgcac

SEQ ID NO: 374499 - DNA, 25 bp, Mus musculus
tgcaggagaaggaagaacaaaaaac

SEQ ID NO: 374500 - DNA, 25 bp, Mus musculus
tgcaggagacccacagtatcagaaa

SEQ ID NO: 374501 - DNA, 25 bp, Mus musculus
tgcaggagagctgggtcgcccaatg

SEQ ID NO: 374502 - DNA, 25 bp, Mus musculus
tgcaggagaggtttgggaaaagctt

SEQ ID NO: 374503 - DNA, 25 bp, Mus musculus
tgcaggagatcagggtctgatgttt

SEQ ID NO: 374504 - DNA, 25 bp, Mus musculus
tgcaggagcagcctgagagggactt

SEQ ID NO: 374505 - DNA, 25 bp, Mus musculus
tgcaggagcagctgacaggtctgat

SEQ ID NO: 374506 - DNA, 25 bp, Mus musculus
tgcaggagcaggccaacgagggcat

SEQ ID NO: 374507 - DNA, 25 bp, Mus musculus
tgcaggagctacggaggaggcaaaa

SEQ ID NO: 374508 - DNA, 25 bp, Mus musculus
tgcaggagctacggatagcgaggtt

SEQ ID NO: 374509 - DNA, 25 bp, Mus musculus
tgcaggaggaggagcatatgctggt

SEQ ID NO: 374510 - DNA, 25 bp, Mus musculus
tgcaggaggctcaggattcagactc

SEQ ID NO: 374511 - DNA, 25 bp, Mus musculus
tgcaggagtacaagagccagatgaa

SEQ ID NO: 374512 - DNA, 25 bp, Mus musculus
tgcaggagtacaaggccaagctaca

SEQ ID NO: 374513 - DNA, 25 bp, Mus musculus
tgcaggagtcccagatccagtatgt

SEQ ID NO: 374514 - DNA, 25 bp, Mus musculus
tgcaggatataaagaaaccagaccg

SEQ ID NO: 374515 - DNA, 25 bp, Mus musculus
tgcaggatataaagaccgtgatgac

SEQ ID NO: 374516 - DNA, 25 bp, Mus musculus
tgcaggatgagtgggatgcagtcat

SEQ ID NO: 374517 - DNA, 25 bp, Mus musculus
tgcaggatgagtggggttggccgaa

SEQ ID NO: 374518 - DNA, 25 bp, Mus musculus
tgcaggatgcaggtcaactgaagct

SEQ ID NO: 374519 - DNA, 25 bp, Mus musculus
tgcaggatgccagccccgccttcct

SEQ ID NO: 374520 - DNA, 25 bp, Mus musculus
tgcaggatgtgccagaacaagctgt

SEQ ID NO: 374521 - DNA, 25 bp, Mus musculus
tgcaggattgggaagaaaaagaaga

SEQ ID NO: 374522 - DNA, 25 bp, Mus musculus
tgcaggattgggaagggctcctgtg

SEQ ID NO: 374523 - DNA, 25 bp, Mus musculus
tgcaggcacaagcctccattgaggg

SEQ ID NO: 374524 - DNA, 25 bp, Mus musculus
tgcaggcactgcacgagtctgagat

SEQ ID NO: 374525 - DNA, 25 bp, Mus musculus
tgcaggcatccaagcatttgtggtc

SEQ ID NO: 374526 - DNA, 25 bp, Mus musculus
tgcaggcatccagggccttttgctc

SEQ ID NO: 374527 - DNA, 25 bp, Mus musculus
tgcaggcatgacaggagctggagaa

SEQ ID NO: 374528 - DNA, 25 bp, Mus musculus
tgcaggcatgaggtgttctggctga

SEQ ID NO: 374529 - DNA, 25 bp, Mus musculus
tgcaggcattgacccttcttggagc

SEQ ID NO: 374530 - DNA, 25 bp, Mus musculus
tgcaggcattgaccgctcatcctaa

SEQ ID NO: 374531 - DNA, 25 bp, Mus musculus
tgcaggcccaagcctccattgaggg

SEQ ID NO: 374532 - DNA, 25 bp, Mus musculus
tgcaggcccaaggtctccatggtgg

SEQ ID NO: 374533 - DNA, 25 bp, Mus musculus
tgcaggcccccacagccgtgtttga

SEQ ID NO: 374534 - DNA, 25 bp, Mus musculus
tgcaggcccccacagtttgtatcta

SEQ ID NO: 374535 - DNA, 25 bp, Mus musculus
tgcaggccctactgggggtgaacct

SEQ ID NO: 374536 - DNA, 25 bp, Mus musculus
tgcaggccgagatcaagatgctgtc

SEQ ID NO: 374537 - DNA, 25 bp, Mus musculus
tgcaggccgagcaggtccttgaagt

SEQ ID NO: 374538 - DNA, 25 bp, Mus musculus
tgcaggccgcattaggaggaagaga

SEQ ID NO: 374539 - DNA, 25 bp, Mus musculus
tgcaggccgcattgctgctcagagg

SEQ ID NO: 374540 - DNA, 25 bp, Mus musculus
tgcaggcctggagataaagttcctt

SEQ ID NO: 374541 - DNA, 25 bp, Mus musculus
tgcaggcctttgagttgtccaggga

SEQ ID NO: 374542 - DNA, 25 bp, Mus musculus
tgcaggcctttgctggagcatgttc

SEQ ID NO: 374543 - DNA, 25 bp, Mus musculus
tgcaggcctttgggaaggaatgttc

SEQ ID NO: 374544 - DNA, 25 bp, Mus musculus
tgcaggcgcgaggttctgcagaccc

SEQ ID NO: 374545 - DNA, 25 bp, Mus musculus
tgcaggcggcccaagatgtccatct

SEQ ID NO: 374546 - DNA, 25 bp, Mus musculus
tgcaggcggcttgaagatgagcagc

SEQ ID NO: 374547 - DNA, 25 bp, Mus musculus
tgcaggcgtgaggaaactgctgtca

SEQ ID NO: 374548 - DNA, 25 bp, Mus musculus
tgcaggctacatggggttgacctgt

SEQ ID NO: 374549 - DNA, 25 bp, Mus musculus
tgcaggctacgaatttaaagaggac

SEQ ID NO: 374550 - DNA, 25 bp, Mus musculus
tgcaggctcaagaaatagccagaca

SEQ ID NO: 374551 - DNA, 25 bp, Mus musculus
tgcaggctcacgctctcaccactga

SEQ ID NO: 374552 - DNA, 25 bp, Mus musculus
tgcaggctcagcaaatgacaagatt

SEQ ID NO: 374553 - DNA, 25 bp, Mus musculus
tgcaggctcaggactggaggaccga

SEQ ID NO: 374554 - DNA, 25 bp, Mus musculus
tgcaggctccagaatggagctgcga

SEQ ID NO: 374555 - DNA, 25 bp, Mus musculus
tgcaggctccaggtacacctggtga

SEQ ID NO: 374556 - DNA, 25 bp, Mus musculus
tgcaggctgtcagatttatgcagga

SEQ ID NO: 374557 - DNA, 25 bp, Mus musculus
tgcaggctgtcagctcgttcgtgtc

SEQ ID NO: 374558 - DNA, 25 bp, Mus musculus
tgcaggcttatgctttgatccagtg

SEQ ID NO: 374559 - DNA, 25 bp, Mus musculus
tgcagggaaaccataacgtcaaact

SEQ ID NO: 374560 - DNA, 25 bp, Mus musculus
tgcagggatgaaggacacagggact

SEQ ID NO: 374561 - DNA, 25 bp, Mus musculus
tgcagggatgaaggtctgtcagttt

SEQ ID NO: 374562 - DNA, 25 bp, Mus musculus
tgcagggcaagatccggactcttca

SEQ ID NO: 374563 - DNA, 25 bp, Mus musculus
tgcagggcacccgccaacatgagtc

SEQ ID NO: 374564 - DNA, 25 bp, Mus musculus
tgcagggcagcgaggttgtaagtgt

SEQ ID NO: 374565 - DNA, 25 bp, Mus musculus
tgcagggcagcgattgtaagtgtct

SEQ ID NO: 374566 - DNA, 25 bp, Mus musculus
tgcagggccagaaggagctcccagc

SEQ ID NO: 374567 - DNA, 25 bp, Mus musculus
tgcagggccagaaggtgatggtgca

SEQ ID NO: 374568 - DNA, 25 bp, Mus musculus
tgcagggcccaggaattgcattggg

SEQ ID NO: 374569 - DNA, 25 bp, Mus musculus
tgcagggctgctaaccccgagatgc

SEQ ID NO: 374570 - DNA, 25 bp, Mus musculus
tgcagggctgctctagaagtcaaga

SEQ ID NO: 374571 - DNA, 25 bp, Mus musculus
tgcagggctggaagccattcagttg

SEQ ID NO: 374572 - DNA, 25 bp, Mus musculus
tgcagggcttaccaggtgtccctgg

SEQ ID NO: 374573 - DNA, 25 bp, Mus musculus
tgcaggggaatatggctctggccca

SEQ ID NO: 374574 - DNA, 25 bp, Mus musculus
tgcaggggaggacatagtcgacagc

SEQ ID NO: 374575 - DNA, 25 bp, Mus musculus
tgcaggggaggcaggtatggatgta

SEQ ID NO: 374576 - DNA, 25 bp, Mus musculus
tgcaggggaggctttgctacagatg

SEQ ID NO: 374577 - DNA, 25 bp, Mus musculus
tgcaggggcaagctggacccccaaa

SEQ ID NO: 374578 - DNA, 25 bp, Mus musculus
tgcagggtcactacagtgacagaga

SEQ ID NO: 374579 - DNA, 25 bp, Mus musculus
tgcagggtgaaaggggaacatctca

SEQ ID NO: 374580 - DNA, 25 bp, Mus musculus
tgcagggtgaaagggtgggatgcta

SEQ ID NO: 374581 - DNA, 25 bp, Mus musculus
tgcagggtgtggtgtgtcctctggt

SEQ ID NO: 374582 - DNA, 25 bp, Mus musculus
tgcaggtccattgggcatcatgaag

SEQ ID NO: 374583 - DNA, 25 bp, Mus musculus
tgcaggtcttgtgagtaacatttca

SEQ ID NO: 374584 - DNA, 25 bp, Mus musculus
tgcaggtgacagacacatctggtca

SEQ ID NO: 374585 - DNA, 25 bp, Mus musculus
tgcaggtgacaggttgctttgaagg

SEQ ID NO: 374586 - DNA, 25 bp, Mus musculus
tgcaggtgactccaggagcagttcc

SEQ ID NO: 374587 - DNA, 25 bp, Mus musculus
tgcaggtgagccaggcaccttttgt

SEQ ID NO: 374588 - DNA, 25 bp, Mus musculus
tgcaggtgagtacggctccacagca

SEQ ID NO: 374589 - DNA, 25 bp, Mus musculus
tgcaggtgcaaagagctgaggacct

SEQ ID NO: 374590 - DNA, 25 bp, Mus musculus
tgcaggtgcttctggtaacccaggg

SEQ ID NO: 374591 - DNA, 25 bp, Mus musculus
tgcaggtggcagttttaggttctga

SEQ ID NO: 374592 - DNA, 25 bp, Mus musculus
tgcaggtggtcaggacaggtacagc

SEQ ID NO: 374593 - DNA, 25 bp, Mus musculus
tgcaggtggtcaggcctataccatt

SEQ ID NO: 374594 - DNA, 25 bp, Mus musculus
tgcaggtggtcagttgaccaagctg

SEQ ID NO: 374595 - DNA, 25 bp, Mus musculus
tgcaggtggtgagcgccgagcagaa

SEQ ID NO: 374596 - DNA, 25 bp, Mus musculus
tgcaggtgtgtatgctaatgggaat

SEQ ID NO: 374597 - DNA, 25 bp, Mus musculus
tgcagtaagaaggaattagaaagta

SEQ ID NO: 374598 - DNA, 25 bp, Mus musculus
tgcagtaagaaggaggataaaattc

SEQ ID NO: 374599 - DNA, 25 bp, Mus musculus
tgcagtaagcagcttaacaggagca

SEQ ID NO: 374600 - DNA, 25 bp, Mus musculus
tgcagtaattccgaaatcaacatgc

SEQ ID NO: 374601 - DNA, 25 bp, Mus musculus
tgcagtaattccgagtcctgaagaa

SEQ ID NO: 374602 - DNA, 25 bp, Mus musculus
tgcagtacaaagagtacttttgagg

SEQ ID NO: 374603 - DNA, 25 bp, Mus musculus
tgcagtaggggctgctgaataatga

SEQ ID NO: 374604 - DNA, 25 bp, Mus musculus
tgcagtatggaagttcccagaaatc

SEQ ID NO: 374605 - DNA, 25 bp, Mus musculus
tgcagtattagtgctacagcctgct

SEQ ID NO: 374606 - DNA, 25 bp, Mus musculus
tgcagtcaaaatcaagcactgcacc

SEQ ID NO: 374607 - DNA, 25 bp, Mus musculus
tgcagtcaaatggatctggcttctc

SEQ ID NO: 374608 - DNA, 25 bp, Mus musculus
tgcagtcaagaaagcctgtacccca

SEQ ID NO: 374609 - DNA, 25 bp, Mus musculus
tgcagtcaagaaaggacatctgatt

SEQ ID NO: 374610 - DNA, 25 bp, Mus musculus
tgcagtcaagaaagtcatcagcagg

SEQ ID NO: 374611 - DNA, 25 bp, Mus musculus
tgcagtcaagtgccgtgcagctggc

SEQ ID NO: 374612 - DNA, 25 bp, Mus musculus
tgcagtcacaggtggataccctccg

SEQ ID NO: 374613 - DNA, 25 bp, Mus musculus
tgcagtcaccgccaccccgggaccc

SEQ ID NO: 374614 - DNA, 25 bp, Mus musculus
tgcagtcaccgccggcccagtgctc

SEQ ID NO: 374615 - DNA, 25 bp, Mus musculus
tgcagtcaccgcctaatagggccca

SEQ ID NO: 374616 - DNA, 25 bp, Mus musculus
tgcagtcagctgacactgtagctca

SEQ ID NO: 374617 - DNA, 25 bp, Mus musculus
tgcagtccagagtggaccagattgt

SEQ ID NO: 374618 - DNA, 25 bp, Mus musculus
tgcagtccaggatagatatgattgt

SEQ ID NO: 374619 - DNA, 25 bp, Mus musculus
tgcagtccaggtcctgcgactggag

SEQ ID NO: 374620 - DNA, 25 bp, Mus musculus
tgcagtcccacttgttcggccagtc

SEQ ID NO: 374621 - DNA, 25 bp, Mus musculus
tgcagtcccaggaggatctcccaga

SEQ ID NO: 374622 - DNA, 25 bp, Mus musculus
tgcagtcccccctagccagcggaag

SEQ ID NO: 374623 - DNA, 25 bp, Mus musculus
tgcagtcccccctcaggacattcag

SEQ ID NO: 374624 - DNA, 25 bp, Mus musculus
tgcagtcccccctgaatgggtccct

SEQ ID NO: 374625 - DNA, 25 bp, Mus musculus
tgcagtcctcgaggagatcccagcc

SEQ ID NO: 374626 - DNA, 25 bp, Mus musculus
tgcagtcgcagcagaaactggaggt

SEQ ID NO: 374627 - DNA, 25 bp, Mus musculus
tgcagtcgcagcagctaacagagaa

SEQ ID NO: 374628 - DNA, 25 bp, Mus musculus
tgcagtcgtgaggtaccgaaagaag

SEQ ID NO: 374629 - DNA, 25 bp, Mus musculus
tgcagtctatgctggaaacagcttt

SEQ ID NO: 374630 - DNA, 25 bp, Mus musculus
tgcagtctatggactggaaacggag

SEQ ID NO: 374631 - DNA, 25 bp, Mus musculus
tgcagtctggcaaaggccaaggaag

SEQ ID NO: 374632 - DNA, 25 bp, Mus musculus
tgcagtcttcaaaagagtgttgaag

SEQ ID NO: 374633 - DNA, 25 bp, Mus musculus
tgcagtcttcaaaagtgaggaagaa

SEQ ID NO: 374634 - DNA, 25 bp, Mus musculus
tgcagtgaccaacattgatcgccct

SEQ ID NO: 374635 - DNA, 25 bp, Mus musculus
tgcagtgaccacaggacaggattat

SEQ ID NO: 374636 - DNA, 25 bp, Mus musculus
tgcagtgaccaccattcctgcgccc

SEQ ID NO: 374637 - DNA, 25 bp, Mus musculus
tgcagtgaccagaacatcaaactga

SEQ ID NO: 374638 - DNA, 25 bp, Mus musculus
tgcagtgaccagggtgccacaactc

SEQ ID NO: 374639 - DNA, 25 bp, Mus musculus
tgcagtgacgtggtgggaagaggtg

SEQ ID NO: 374640 - DNA, 25 bp, Mus musculus
tgcagtgactcagacatggaaacca

SEQ ID NO: 374641 - DNA, 25 bp, Mus musculus
tgcagtgactcagctattcgtcttc

SEQ ID NO: 374642 - DNA, 25 bp, Mus musculus
tgcagtgagcgaaagactttactgg

SEQ ID NO: 374643 - DNA, 25 bp, Mus musculus
tgcagtgcaggaaagacatggaagg

SEQ ID NO: 374644 - DNA, 25 bp, Mus musculus
tgcagtgcaggaaagatggccctgc

SEQ ID NO: 374645 - DNA, 25 bp, Mus musculus
tgcagtgcaggcaatacagagtgct

SEQ ID NO: 374646 - DNA, 25 bp, Mus musculus
tgcagtgccagccggactcctccac

SEQ ID NO: 374647 - DNA, 25 bp, Mus musculus
tgcagtgcggacctaaataacgagc

SEQ ID NO: 374648 - DNA, 25 bp, Mus musculus
tgcagtgcggaccttcactacttcg

SEQ ID NO: 374649 - DNA, 25 bp, Mus musculus
tgcagtggaaggcaaagagaaacag

SEQ ID NO: 374650 - DNA, 25 bp, Mus musculus
tgcagtggagctccgcgtgagtcgg

SEQ ID NO: 374651 - DNA, 25 bp, Mus musculus
tgcagtggagttgtttaagaatgtg

SEQ ID NO: 374652 - DNA, 25 bp, Mus musculus
tgcagtggatgagcaacatgttctg

SEQ ID NO: 374653 - DNA, 25 bp, Mus musculus
tgcagtggatgatgagtctgactat

SEQ ID NO: 374654 - DNA, 25 bp, Mus musculus
tgcagtggcccagctgctgtcaaca

SEQ ID NO: 374655 - DNA, 25 bp, Mus musculus
tgcagtggctggcatgctacaaatg

SEQ ID NO: 374656 - DNA, 25 bp, Mus musculus
tgcagtggtgatgctgtcatcaagg

SEQ ID NO: 374657 - DNA, 25 bp, Mus musculus
tgcagtgtaaacaattagatttaga

SEQ ID NO: 374658 - DNA, 25 bp, Mus musculus
tgcagtgtaaagattgcaaattcaa

SEQ ID NO: 374659 - DNA, 25 bp, Mus musculus
tgcagtgtagggtaaacacaagacg

SEQ ID NO: 374660 - DNA, 25 bp, Mus musculus
tgcagtgtcagtgctgccctaggag

SEQ ID NO: 374661 - DNA, 25 bp, Mus musculus
tgcagtgtcagttcctttctagatt

SEQ ID NO: 374662 - DNA, 25 bp, Mus musculus
tgcagtgtgattgggagaaaccact

SEQ ID NO: 374663 - DNA, 25 bp, Mus musculus
tgcagtgtggctagcaagctgcctc

SEQ ID NO: 374664 - DNA, 25 bp, Mus musculus
tgcagtgtggggaaatcccacctgg

SEQ ID NO: 374665 - DNA, 25 bp, Mus musculus
tgcagtgtgtgaagcaaggagaact

SEQ ID NO: 374666 - DNA, 25 bp, Mus musculus
tgcagtgtgtggcacctctgcagtg

SEQ ID NO: 374667 - DNA, 25 bp, Mus musculus
tgcagttaaagctccctcttgatgt

SEQ ID NO: 374668 - DNA, 25 bp, Mus musculus
tgcagttaaaggatggttcctatca

SEQ ID NO: 374669 - DNA, 25 bp, Mus musculus
tgcagttaagagaacagcacattag

SEQ ID NO: 374670 - DNA, 25 bp, Mus musculus
tgcagttaagaggatcgctgcagag

SEQ ID NO: 374671 - DNA, 25 bp, Mus musculus
tgcagttacgtaggtctggtcagct

SEQ ID NO: 374672 - DNA, 25 bp, Mus musculus
tgcagttatatggtggtgacgtatg

SEQ ID NO: 374673 - DNA, 25 bp, Mus musculus
tgcagttatgcagaacttgtcacaa

SEQ ID NO: 374674 - DNA, 25 bp, Mus musculus
tgcagttcaagcaaatggtattcat

SEQ ID NO: 374675 - DNA, 25 bp, Mus musculus
tgcagttcaggtttgctgtcttatt

SEQ ID NO: 374676 - DNA, 25 bp, Mus musculus
tgcagttccaggaggaggacttcat

SEQ ID NO: 374677 - DNA, 25 bp, Mus musculus
tgcagttccaggtccctgagggtct

SEQ ID NO: 374678 - DNA, 25 bp, Mus musculus
tgcagttctatatgctgtctcctaa

SEQ ID NO: 374679 - DNA, 25 bp, Mus musculus
tgcagttctatatgttcgcatggac

SEQ ID NO: 374680 - DNA, 25 bp, Mus musculus
tgcagttctcaggaggggtcatctc

SEQ ID NO: 374681 - DNA, 25 bp, Mus musculus
tgcagttctcgttgtgaaaatgtcc

SEQ ID NO: 374682 - DNA, 25 bp, Mus musculus
tgcagttcttaacaggcacgtgaca

SEQ ID NO: 374683 - DNA, 25 bp, Mus musculus
tgcagttgcagctctaagaacaggt

SEQ ID NO: 374684 - DNA, 25 bp, Mus musculus
tgcagttgcaggtttcttcgggtag

SEQ ID NO: 374685 - DNA, 25 bp, Mus musculus
tgcagttgtggtatcccaagggtta

SEQ ID NO: 374686 - DNA, 25 bp, Mus musculus
tgcagttgtgtgactatgcaagctg

SEQ ID NO: 374687 - DNA, 25 bp, Mus musculus
tgcagttgtgtgggtgaatgggatt

SEQ ID NO: 374688 - DNA, 25 bp, Mus musculus
tgcagtttaaaaacggcgtggagcc

SEQ ID NO: 374689 - DNA, 25 bp, Mus musculus
tgcagtttgccatgaagcggctgct

SEQ ID NO: 374690 - DNA, 25 bp, Mus musculus
tgcagtttgggatgaatgccagctc

SEQ ID NO: 374691 - DNA, 25 bp, Mus musculus
tgcagttttgaggcaagaaatctca

SEQ ID NO: 374692 - DNA, 25 bp, Mus musculus
tgcataaacaggctgagattgtgaa

SEQ ID NO: 374693 - DNA, 25 bp, Mus musculus
tgcataaacaggctgagatttgaga

SEQ ID NO: 374694 - DNA, 25 bp, Mus musculus
tgcataaattgaatctgtataaact

SEQ ID NO: 374695 - DNA, 25 bp, Mus musculus
tgcataacctgcaaacactgccccc

SEQ ID NO: 374696 - DNA, 25 bp, Mus musculus
tgcataaggccacatgttttatggc

SEQ ID NO: 374697 - DNA, 25 bp, Mus musculus
tgcataatccagccctctaataaag

SEQ ID NO: 374698 - DNA, 25 bp, Mus musculus
tgcataatcttggtggagaaactct

SEQ ID NO: 374699 - DNA, 25 bp, Mus musculus
tgcatacacaggaaagggctgtgag

SEQ ID NO: 374700 - DNA, 25 bp, Mus musculus
tgcataccaaatcagcagaaatgga

SEQ ID NO: 374701 - DNA, 25 bp, Mus musculus
tgcatactcacgtgaatgatggcac

SEQ ID NO: 374702 - DNA, 25 bp, Mus musculus
tgcatactggaaaaggtgtactttg

SEQ ID NO: 374703 - DNA, 25 bp, Mus musculus
tgcatagaccaggtgagacggaagg

SEQ ID NO: 374704 - DNA, 25 bp, Mus musculus
tgcatagatgacgccacacgcgggt

SEQ ID NO: 374705 - DNA, 25 bp, Mus musculus
tgcatagcagagctacccagctggg

SEQ ID NO: 374706 - DNA, 25 bp, Mus musculus
tgcatagctctgtggagcgaccctg

SEQ ID NO: 374707 - DNA, 25 bp, Mus musculus
tgcatagtttagggtgtctagccca

SEQ ID NO: 374708 - DNA, 25 bp, Mus musculus
tgcatataaactggcgagatgtccc

SEQ ID NO: 374709 - DNA, 25 bp, Mus musculus
tgcatatcagatctgatgttttgat

SEQ ID NO: 374710 - DNA, 25 bp, Mus musculus
tgcatatcccagatgctcatctttg

SEQ ID NO: 374711 - DNA, 25 bp, Mus musculus
tgcatatctaggggagtatgtgctc

SEQ ID NO: 374712 - DNA, 25 bp, Mus musculus
tgcatatctgagattcagtttgctg

SEQ ID NO: 374713 - DNA, 25 bp, Mus musculus
tgcatatctggccagaaatggcctc

SEQ ID NO: 374714 - DNA, 25 bp, Mus musculus
tgcatatggagggagcctggaggat

SEQ ID NO: 374715 - DNA, 25 bp, Mus musculus
tgcatatgtacaggcagaccgaagg

SEQ ID NO: 374716 - DNA, 25 bp, Mus musculus
tgcatatgtacagtcccagaagtat

SEQ ID NO: 374717 - DNA, 25 bp, Mus musculus
tgcatatgttcaatttgaggatgtt

SEQ ID NO: 374718 - DNA, 25 bp, Mus musculus
tgcatattcagggtgacggcctctc

SEQ ID NO: 374719 - DNA, 25 bp, Mus musculus
tgcatattttgtgagttcaaaattg

SEQ ID NO: 374720 - DNA, 25 bp, Mus musculus
tgcatcaaacaagttgatcaagagc

SEQ ID NO: 374721 - DNA, 25 bp, Mus musculus
tgcatcaaacagtatgaagaagaaa

SEQ ID NO: 374722 - DNA, 25 bp, Mus musculus
tgcatcaaccctgagacagctcttc

SEQ ID NO: 374723 - DNA, 25 bp, Mus musculus
tgcatcaaccctgagtgccaggacc

SEQ ID NO: 374724 - DNA, 25 bp, Mus musculus
tgcatcaaggtacttgtgtcagatg

SEQ ID NO: 374725 - DNA, 25 bp, Mus musculus
tgcatcacaccagatgctgccagcc

SEQ ID NO: 374726 - DNA, 25 bp, Mus musculus
tgcatcacaccagggagcaggatca

SEQ ID NO: 374727 - DNA, 25 bp, Mus musculus
tgcatcacacgatttgtgaaaacat

SEQ ID NO: 374728 - DNA, 25 bp, Mus musculus
tgcatcacacggctcattcacctaa

SEQ ID NO: 374729 - DNA, 25 bp, Mus musculus
tgcatcaccctgacaaaggagacaa

SEQ ID NO: 374730 - DNA, 25 bp, Mus musculus
tgcatcactaggaacagcatctgat

SEQ ID NO: 374731 - DNA, 25 bp, Mus musculus
tgcatcactgttgctcacctttcaa

SEQ ID NO: 374732 - DNA, 25 bp, Mus musculus
tgcatcagaaaaggtgactaataaa

SEQ ID NO: 374733 - DNA, 25 bp, Mus musculus
tgcatcagacagggcaacgtttcat

SEQ ID NO: 374734 - DNA, 25 bp, Mus musculus
tgcatcagcagtgatgatcttttct

SEQ ID NO: 374735 - DNA, 25 bp, Mus musculus
tgcatcaggtcctggatgaacgaga

SEQ ID NO: 374736 - DNA, 25 bp, Mus musculus
tgcatcagtggatcgatatcaacaa

SEQ ID NO: 374737 - DNA, 25 bp, Mus musculus
tgcatcatcaatccaaacatctgtg

SEQ ID NO: 374738 - DNA, 25 bp, Mus musculus
tgcatcattcaggtttttcctgatg

SEQ ID NO: 374739 - DNA, 25 bp, Mus musculus
tgcatcatttgaacaatgcccagcg

SEQ ID NO: 374740 - DNA, 25 bp, Mus musculus
tgcatcatttgactgaggaccattt

SEQ ID NO: 374741 - DNA, 25 bp, Mus musculus
tgcatccaagaaggatcctgtagca

SEQ ID NO: 374742 - DNA, 25 bp, Mus musculus
tgcatccaaggctgtcggcgagcca

SEQ ID NO: 374743 - DNA, 25 bp, Mus musculus
tgcatccacaccgccgtgacgtctt

SEQ ID NO: 374744 - DNA, 25 bp, Mus musculus
tgcatccacaccgcttgcttgggtc

SEQ ID NO: 374745 - DNA, 25 bp, Mus musculus
tgcatccacagagcttggctgaaga

SEQ ID NO: 374746 - DNA, 25 bp, Mus musculus
tgcatccagaacaatggagacacca

SEQ ID NO: 374747 - DNA, 25 bp, Mus musculus
tgcatccagaggtctggtagcagcc

SEQ ID NO: 374748 - DNA, 25 bp, Mus musculus
tgcatccagggatgcaggcagcctc

SEQ ID NO: 374749 - DNA, 25 bp, Mus musculus
tgcatccagggatgttaattttaca

SEQ ID NO: 374750 - DNA, 25 bp, Mus musculus
tgcatccatgcagtattcaagagac

SEQ ID NO: 374751 - DNA, 25 bp, Mus musculus
tgcatcccacagggtggtcatgatc

SEQ ID NO: 374752 - DNA, 25 bp, Mus musculus
tgcatcccagctggaagcaggagag

SEQ ID NO: 374753 - DNA, 25 bp, Mus musculus
tgcatcccagctgtcgctgactccc

SEQ ID NO: 374754 - DNA, 25 bp, Mus musculus
tgcatccccatcaagaaatctgacc

SEQ ID NO: 374755 - DNA, 25 bp, Mus musculus
tgcatcccttgaggagttaccaaat

SEQ ID NO: 374756 - DNA, 25 bp, Mus musculus
tgcatccgaccagacagatggatac

SEQ ID NO: 374757 - DNA, 25 bp, Mus musculus
tgcatccgaccagcttttttaaaca

SEQ ID NO: 374758 - DNA, 25 bp, Mus musculus
tgcatccgaccaggatggcttcccc

SEQ ID NO: 374759 - DNA, 25 bp, Mus musculus
tgcatccggggacagagtccttggc

SEQ ID NO: 374760 - DNA, 25 bp, Mus musculus
tgcatccgtaagggcaccagcgtct

SEQ ID NO: 374761 - DNA, 25 bp, Mus musculus
tgcatccgtatcaactcaacaagga

SEQ ID NO: 374762 - DNA, 25 bp, Mus musculus
tgcatccgtatcaagacatgttcag

SEQ ID NO: 374763 - DNA, 25 bp, Mus musculus
tgcatcctaaatcagctgctgaaat

SEQ ID NO: 374764 - DNA, 25 bp, Mus musculus
tgcatcctaaatcaggtcatggttt

SEQ ID NO: 374765 - DNA, 25 bp, Mus musculus
tgcatcctcaagaggaagcccgtgc

SEQ ID NO: 374766 - DNA, 25 bp, Mus musculus
tgcatcctgaagaagcacgcccact

SEQ ID NO: 374767 - DNA, 25 bp, Mus musculus
tgcatcctggcaggggacccagccg

SEQ ID NO: 374768 - DNA, 25 bp, Mus musculus
tgcatccttcaggtctccagatgag

SEQ ID NO: 374769 - DNA, 25 bp, Mus musculus
tgcatccttcgaatgctgactccct

SEQ ID NO: 374770 - DNA, 25 bp, Mus musculus
tgcatcgcctgcagggcatggaaca

SEQ ID NO: 374771 - DNA, 25 bp, Mus musculus
tgcatcgcggggtggcgggacggga

SEQ ID NO: 374772 - DNA, 25 bp, Mus musculus
tgcatcggaggtcaccttcgtctcc

SEQ ID NO: 374773 - DNA, 25 bp, Mus musculus
tgcatcgtcccagcggctgaccaag

SEQ ID NO: 374774 - DNA, 25 bp, Mus musculus
tgcatcgtgctccagtgtggcgctg

SEQ ID NO: 374775 - DNA, 25 bp, Mus musculus
tgcatctagtgcaggtgagtgcagg

SEQ ID NO: 374776 - DNA, 25 bp, Mus musculus
tgcatctagtttgactaccaaagga

SEQ ID NO: 374777 - DNA, 25 bp, Mus musculus
tgcatctatacaggtgacctcttgg

SEQ ID NO: 374778 - DNA, 25 bp, Mus musculus
tgcatctatgaggagaaccatggct

SEQ ID NO: 374779 - DNA, 25 bp, Mus musculus
tgcatctccaggtcccacctgctcg

SEQ ID NO: 374780 - DNA, 25 bp, Mus musculus
tgcatctgaagaggtggccatggcc

SEQ ID NO: 374781 - DNA, 25 bp, Mus musculus
tgcatctgagccttctaggaaagat

SEQ ID NO: 374782 - DNA, 25 bp, Mus musculus
tgcatctgagtgccgtactgttcga

SEQ ID NO: 374783 - DNA, 25 bp, Mus musculus
tgcatctgcctcattgtacaagtct

SEQ ID NO: 374784 - DNA, 25 bp, Mus musculus
tgcatctgcctgcaccgtactagct

SEQ ID NO: 374785 - DNA, 25 bp, Mus musculus
tgcatctgcctgctgggctcagtgg

SEQ ID NO: 374786 - DNA, 25 bp, Mus musculus
tgcatctggagaccaggttctctgc

SEQ ID NO: 374787 - DNA, 25 bp, Mus musculus
tgcatcttggctggtggctaccaag

SEQ ID NO: 374788 - DNA, 25 bp, Mus musculus
tgcatctttatggaaagagtatggc

SEQ ID NO: 374789 - DNA, 25 bp, Mus musculus
tgcatctttggaatgcacaagccca

SEQ ID NO: 374790 - DNA, 25 bp, Mus musculus
tgcatgaaaggccgcaccatgtatg

SEQ ID NO: 374791 - DNA, 25 bp, Mus musculus
tgcatgaaaggcctgacaagatcaa

SEQ ID NO: 374792 - DNA, 25 bp, Mus musculus
tgcatgaagacaaatcagagcgaga

SEQ ID NO: 374793 - DNA, 25 bp, Mus musculus
tgcatgaagacataccgacgcttgc

SEQ ID NO: 374794 - DNA, 25 bp, Mus musculus
tgcatgaagcggtgttcgaggaata

SEQ ID NO: 374795 - DNA, 25 bp, Mus musculus
tgcatgaagtcccagtggccagtga

SEQ ID NO: 374796 - DNA, 25 bp, Mus musculus
tgcatgaagttgcaagaagacaccc

SEQ ID NO: 374797 - DNA, 25 bp, Mus musculus
tgcatgaagttgccagaaggagaag

SEQ ID NO: 374798 - DNA, 25 bp, Mus musculus
tgcatgaatatacagagtaagtctc

SEQ ID NO: 374799 - DNA, 25 bp, Mus musculus
tgcatgacaaccagggtggtgcccc

SEQ ID NO: 374800 - DNA, 25 bp, Mus musculus
tgcatgacactaaacatggagtgga

SEQ ID NO: 374801 - DNA, 25 bp, Mus musculus
tgcatgaccagtgtagtccatggaa

SEQ ID NO: 374802 - DNA, 25 bp, Mus musculus
tgcatgacgtgttcgagaaccgtta

SEQ ID NO: 374803 - DNA, 25 bp, Mus musculus
tgcatgagcagaaagatcagtatgc

SEQ ID NO: 374804 - DNA, 25 bp, Mus musculus
tgcatgagcagaaaggacaaagccc

SEQ ID NO: 374805 - DNA, 25 bp, Mus musculus
tgcatgagcagtaccccctggcctt

SEQ ID NO: 374806 - DNA, 25 bp, Mus musculus
tgcatgagcagtcgatggctgtgta

SEQ ID NO: 374807 - DNA, 25 bp, Mus musculus
tgcatgagtggtgtgacggctgtga

SEQ ID NO: 374808 - DNA, 25 bp, Mus musculus
tgcatgatatagataccaagtggta

SEQ ID NO: 374809 - DNA, 25 bp, Mus musculus
tgcatgatataggacagaaattggg

SEQ ID NO: 374810 - DNA, 25 bp, Mus musculus
tgcatgatcttgctattgaagtgga

SEQ ID NO: 374811 - DNA, 25 bp, Mus musculus
tgcatgatgcggagaatataggcaa

SEQ ID NO: 374812 - DNA, 25 bp, Mus musculus
tgcatgcaaggcttgttccccctgt

SEQ ID NO: 374813 - DNA, 25 bp, Mus musculus
tgcatgcaaggtacagaagaaagat

SEQ ID NO: 374814 - DNA, 25 bp, Mus musculus
tgcatgcacatgtctcgaattatca

SEQ ID NO: 374815 - DNA, 25 bp, Mus musculus
tgcatgcagatggagatgcagcctt

SEQ ID NO: 374816 - DNA, 25 bp, Mus musculus
tgcatgcagatgggggcagagatgc

SEQ ID NO: 374817 - DNA, 25 bp, Mus musculus
tgcatgcagtcagacttctccaagg

SEQ ID NO: 374818 - DNA, 25 bp, Mus musculus
tgcatgcagtcagtgcagcccttcg

SEQ ID NO: 374819 - DNA, 25 bp, Mus musculus
tgcatgcatgcatgtggtcaacctg

SEQ ID NO: 374820 - DNA, 25 bp, Mus musculus
tgcatgcatgtccaggttctcacgc

SEQ ID NO: 374821 - DNA, 25 bp, Mus musculus
tgcatgccaggttcccactatgtag

SEQ ID NO: 374822 - DNA, 25 bp, Mus musculus
tgcatgccatgacccccgaggctgc

SEQ ID NO: 374823 - DNA, 25 bp, Mus musculus
tgcatgcctgggccctggcccagct

SEQ ID NO: 374824 - DNA, 25 bp, Mus musculus
tgcatgcggacaggcctgagtactt

SEQ ID NO: 374825 - DNA, 25 bp, Mus musculus
tgcatgcggacaggccttgttttca

SEQ ID NO: 374826 - DNA, 25 bp, Mus musculus
tgcatgcggaccaggccttgttttc

SEQ ID NO: 374827 - DNA, 25 bp, Mus musculus
tgcatgctaatagaagtagtcccca

SEQ ID NO: 374828 - DNA, 25 bp, Mus musculus
tgcatgctaataggccaggtggttg

SEQ ID NO: 374829 - DNA, 25 bp, Mus musculus
tgcatgctaatagggaagaccgggc

SEQ ID NO: 374830 - DNA, 25 bp, Mus musculus
tgcatgctagatgtgaaacattttt

SEQ ID NO: 374831 - DNA, 25 bp, Mus musculus
tgcatgctagcttggccgacaggaa

SEQ ID NO: 374832 - DNA, 25 bp, Mus musculus
tgcatgctaggagatgtacgactaa

SEQ ID NO: 374833 - DNA, 25 bp, Mus musculus
tgcatgctcatggtgggcagcaatg

SEQ ID NO: 374834 - DNA, 25 bp, Mus musculus
tgcatgctgatgccattctatttat

SEQ ID NO: 374835 - DNA, 25 bp, Mus musculus
tgcatgctgatgccttagacttgca

SEQ ID NO: 374836 - DNA, 25 bp, Mus musculus
tgcatgctggagaatcttctctgtc

SEQ ID NO: 374837 - DNA, 25 bp, Mus musculus
tgcatgctggaggtacgctggatcg

SEQ ID NO: 374838 - DNA, 25 bp, Mus musculus
tgcatgctggatctctcgtctgctc

SEQ ID NO: 374839 - DNA, 25 bp, Mus musculus
tgcatgctgggatagctcaggtttt

SEQ ID NO: 374840 - DNA, 25 bp, Mus musculus
tgcatgctgggtccttcaggaccca

SEQ ID NO: 374841 - DNA, 25 bp, Mus musculus
tgcatgctttagagtgatgatgact

SEQ ID NO: 374842 - DNA, 25 bp, Mus musculus
tgcatggaaacaggtttaatcttgt

SEQ ID NO: 374843 - DNA, 25 bp, Mus musculus
tgcatggaaacagtcaccaaggagc

SEQ ID NO: 374844 - DNA, 25 bp, Mus musculus
tgcatggaaaggaagttggcagtat

SEQ ID NO: 374845 - DNA, 25 bp, Mus musculus
tgcatggatatgaggtccagagatt

SEQ ID NO: 374846 - DNA, 25 bp, Mus musculus
tgcatggatggagtgacggatgacg

SEQ ID NO: 374847 - DNA, 25 bp, Mus musculus
tgcatgggcacagtgaccccagttt

SEQ ID NO: 374848 - DNA, 25 bp, Mus musculus
tgcatgggcagacacagccctggac

SEQ ID NO: 374849 - DNA, 25 bp, Mus musculus
tgcatggttaaccagagtcctggat

SEQ ID NO: 374850 - DNA, 25 bp, Mus musculus
tgcatgtacactaaggtaagaaatc

SEQ ID NO: 374851 - DNA, 25 bp, Mus musculus
tgcatgtagatatggcagacgaggc

SEQ ID NO: 374852 - DNA, 25 bp, Mus musculus
tgcatgtcaccctgatggtgcccct

SEQ ID NO: 374853 - DNA, 25 bp, Mus musculus
tgcatgtcaccctgccgtggatgct

SEQ ID NO: 374854 - DNA, 25 bp, Mus musculus
tgcatgtcaccctggactggtggcc

SEQ ID NO: 374855 - DNA, 25 bp, Mus musculus
tgcatgtcaccctgtgctgaaggct

SEQ ID NO: 374856 - DNA, 25 bp, Mus musculus
tgcatgtccaggttctcacgcggtt

SEQ ID NO: 374857 - DNA, 25 bp, Mus musculus
tgcatgtctacaagcatttgtcaag

SEQ ID NO: 374858 - DNA, 25 bp, Mus musculus
tgcatgtctcagagcttggatctgt

SEQ ID NO: 374859 - DNA, 25 bp, Mus musculus
tgcatgtgacagacctcactcacag

SEQ ID NO: 374860 - DNA, 25 bp, Mus musculus
tgcatgtgacagataattcacagaa

SEQ ID NO: 374861 - DNA, 25 bp, Mus musculus
tgcatgtgacctctctatcacggac

SEQ ID NO: 374862 - DNA, 25 bp, Mus musculus
tgcatgtgctccctctctatagcct

SEQ ID NO: 374863 - DNA, 25 bp, Mus musculus
tgcatgtggagaagtctggtgcctc

SEQ ID NO: 374864 - DNA, 25 bp, Mus musculus
tgcatgttcttggaaacctgatatc

SEQ ID NO: 374865 - DNA, 25 bp, Mus musculus
tgcatgttgagacacaaagatcgag

SEQ ID NO: 374866 - DNA, 25 bp, Mus musculus
tgcatgttgtcagggcctaagatca

SEQ ID NO: 374867 - DNA, 25 bp, Mus musculus
tgcatgttgtcaggggaagagatgg

SEQ ID NO: 374868 - DNA, 25 bp, Mus musculus
tgcatgtttcaggtggtttgttgaa

SEQ ID NO: 374869 - DNA, 25 bp, Mus musculus
tgcattaaatcagcaagccccgccc

SEQ ID NO: 374870 - DNA, 25 bp, Mus musculus
tgcattaattcaaaaaagatcattc

SEQ ID NO: 374871 - DNA, 25 bp, Mus musculus
tgcattacaagcccacagagcagtt

SEQ ID NO: 374872 - DNA, 25 bp, Mus musculus
tgcattacaagccttcccgctccat

SEQ ID NO: 374873 - DNA, 25 bp, Mus musculus
tgcattagaaaagaatctaaaggga

SEQ ID NO: 374874 - DNA, 25 bp, Mus musculus
tgcattagtgggtttgatgaccctg

SEQ ID NO: 374875 - DNA, 25 bp, Mus musculus
tgcattatcaacgagtactgtattg

SEQ ID NO: 374876 - DNA, 25 bp, Mus musculus
tgcattatctggtgaccatctcggt

SEQ ID NO: 374877 - DNA, 25 bp, Mus musculus
tgcattcacagacacggctaaggaa

SEQ ID NO: 374878 - DNA, 25 bp, Mus musculus
tgcattcacagggtacagatttatt

SEQ ID NO: 374879 - DNA, 25 bp, Mus musculus
tgcattcagaggtggggtaagtgcc

SEQ ID NO: 374880 - DNA, 25 bp, Mus musculus
tgcattcaggggtgattcagacaag

SEQ ID NO: 374881 - DNA, 25 bp, Mus musculus
tgcattcagtgaaggatttgaactt

SEQ ID NO: 374882 - DNA, 25 bp, Mus musculus
tgcattccagaaagtatgcagccct

SEQ ID NO: 374883 - DNA, 25 bp, Mus musculus
tgcattcgtgccgaggagttgtctt

SEQ ID NO: 374884 - DNA, 25 bp, Mus musculus
tgcattcgtggtgtttgtctttggt

SEQ ID NO: 374885 - DNA, 25 bp, Mus musculus
tgcattctacaggcggcagaaacag

SEQ ID NO: 374886 - DNA, 25 bp, Mus musculus
tgcattctcagcatggtgagacaca

SEQ ID NO: 374887 - DNA, 25 bp, Mus musculus
tgcattctctcaatcgtgtatgccc

SEQ ID NO: 374888 - DNA, 25 bp, Mus musculus
tgcattctctcaatggtgtatgccc

SEQ ID NO: 374889 - DNA, 25 bp, Mus musculus
tgcattctgggtttctggttagctt

SEQ ID NO: 374890 - DNA, 25 bp, Mus musculus
tgcattcttcaagagtttatccatg

SEQ ID NO: 374891 - DNA, 25 bp, Mus musculus
tgcattgagacgtccgagatacccg

SEQ ID NO: 374892 - DNA, 25 bp, Mus musculus
tgcattgcatgcagcgtgcagggtc

SEQ ID NO: 374893 - DNA, 25 bp, Mus musculus
tgcattgccaaggcgttcgtgcctc

SEQ ID NO: 374894 - DNA, 25 bp, Mus musculus
tgcattgccatggaccgctcctttg

SEQ ID NO: 374895 - DNA, 25 bp, Mus musculus
tgcattgctctccagtccctgccgc

SEQ ID NO: 374896 - DNA, 25 bp, Mus musculus
tgcattgctgaagatacgccaatgt

SEQ ID NO: 374897 - DNA, 25 bp, Mus musculus
tgcattgctgaaggaatttgagcag

SEQ ID NO: 374898 - DNA, 25 bp, Mus musculus
tgcattggacagattgtccttctga

SEQ ID NO: 374899 - DNA, 25 bp, Mus musculus
tgcattggaccagttttcagagctg

SEQ ID NO: 374900 - DNA, 25 bp, Mus musculus
tgcattggaggttaaaattatacaa

SEQ ID NO: 374901 - DNA, 25 bp, Mus musculus
tgcattggcggaggtgtggacctcg

SEQ ID NO: 374902 - DNA, 25 bp, Mus musculus
tgcatttactgagaaacatggtgaa

SEQ ID NO: 374903 - DNA, 25 bp, Mus musculus
tgcatttcaggttaatatccttcca

SEQ ID NO: 374904 - DNA, 25 bp, Mus musculus
tgcatttctacagaacctgctttca

SEQ ID NO: 374905 - DNA, 25 bp, Mus musculus
tgcatttctcaggaaacacgatggg

SEQ ID NO: 374906 - DNA, 25 bp, Mus musculus
tgcatttgagtgacaaagtctacag

SEQ ID NO: 374907 - DNA, 25 bp, Mus musculus
tgcatttgcaggtcgctatgcattt

SEQ ID NO: 374908 - DNA, 25 bp, Mus musculus
tgcatttggcataattccaagaaac

SEQ ID NO: 374909 - DNA, 25 bp, Mus musculus
tgcattttaaggaagatccttggaa

SEQ ID NO: 374910 - DNA, 25 bp, Mus musculus
tgcattttaaggagcataaacatct

SEQ ID NO: 374911 - DNA, 25 bp, Mus musculus
tgcattttaaggagtgcatgcggga

SEQ ID NO: 374912 - DNA, 25 bp, Mus musculus
tgcattttactccagatggcagact

SEQ ID NO: 374913 - DNA, 25 bp, Mus musculus
tgcattttactccagccctggctgt

SEQ ID NO: 374914 - DNA, 25 bp, Mus musculus
tgcattttcacgacatccatggggt

SEQ ID NO: 374915 - DNA, 25 bp, Mus musculus
tgcattttgaggctaagacccttcg

SEQ ID NO: 374916 - DNA, 25 bp, Mus musculus
tgcattttgaggctatcagtgacga

SEQ ID NO: 374917 - DNA, 25 bp, Mus musculus
tgccaaaacagatgaagaaccacct

SEQ ID NO: 374918 - DNA, 25 bp, Mus musculus
tgccaaaacgaaaacagatacaaag

SEQ ID NO: 374919 - DNA, 25 bp, Mus musculus
tgccaaaataatgacaccattctaa

SEQ ID NO: 374920 - DNA, 25 bp, Mus musculus
tgccaaaatcatgctgacacccagt

SEQ ID NO: 374921 - DNA, 25 bp, Mus musculus
tgccaaaattgaagagaatcaaaag

SEQ ID NO: 374922 - DNA, 25 bp, Mus musculus
tgccaaacaagtgcgctctgaaaac

SEQ ID NO: 374923 - DNA, 25 bp, Mus musculus
tgccaaacaagtgcggtaattaccc

SEQ ID NO: 374924 - DNA, 25 bp, Mus musculus
tgccaaacagagcatgctggagaag

SEQ ID NO: 374925 - DNA, 25 bp, Mus musculus
tgccaaacagctgcagagaaaagcc

SEQ ID NO: 374926 - DNA, 25 bp, Mus musculus
tgccaaacccaaactggatcctctg

SEQ ID NO: 374927 - DNA, 25 bp, Mus musculus
tgccaaagaagattcccagcgacac

SEQ ID NO: 374928 - DNA, 25 bp, Mus musculus
tgccaaagaagctcctatgctgttc

SEQ ID NO: 374929 - DNA, 25 bp, Mus musculus
tgccaaagactgcagagaacttcag

SEQ ID NO: 374930 - DNA, 25 bp, Mus musculus
tgccaaagagatgaaggagtcagcg

SEQ ID NO: 374931 - DNA, 25 bp, Mus musculus
tgccaaagaggagatatttggacca

SEQ ID NO: 374932 - DNA, 25 bp, Mus musculus
tgccaaagcagggctgcaggtggag

SEQ ID NO: 374933 - DNA, 25 bp, Mus musculus
tgccaaagccctgaatggcttcacc

SEQ ID NO: 374934 - DNA, 25 bp, Mus musculus
tgccaaagtgaagccgaagaagctg

SEQ ID NO: 374935 - DNA, 25 bp, Mus musculus
tgccaaatcaacatcaacgattgcc

SEQ ID NO: 374936 - DNA, 25 bp, Mus musculus
tgccaaatggcccagcaaggaccca

SEQ ID NO: 374937 - DNA, 25 bp, Mus musculus
tgccaaattaaatgccttgatggga

SEQ ID NO: 374938 - DNA, 25 bp, Mus musculus
tgccaaattagtgcatgaagttgcc

SEQ ID NO: 374939 - DNA, 25 bp, Mus musculus
tgccaaattggctccacttacctgt

SEQ ID NO: 374940 - DNA, 25 bp, Mus musculus
tgccaacaaggcagagatggagttg

SEQ ID NO: 374941 - DNA, 25 bp, Mus musculus
tgccaacatggccatcctggacatg

SEQ ID NO: 374942 - DNA, 25 bp, Mus musculus
tgccaaccagacgtaccaccagact

SEQ ID NO: 374943 - DNA, 25 bp, Mus musculus
tgccaaccaggactgggcaaagcca

SEQ ID NO: 374944 - DNA, 25 bp, Mus musculus
tgccaaccagttgtctaatgggttt

SEQ ID NO: 374945 - DNA, 25 bp, Mus musculus
tgccaacccagtgaactccaccatc

SEQ ID NO: 374946 - DNA, 25 bp, Mus musculus
tgccaaccccataggaggccgctac

SEQ ID NO: 374947 - DNA, 25 bp, Mus musculus
tgccaacctcgtgaggactctcatt

SEQ ID NO: 374948 - DNA, 25 bp, Mus musculus
tgccaacctcgtgagttacaggact

SEQ ID NO: 374949 - DNA, 25 bp, Mus musculus
tgccaacgtgagagtcattcagaat

SEQ ID NO: 374950 - DNA, 25 bp, Mus musculus
tgccaacgtgagggagcctgtatat

SEQ ID NO: 374951 - DNA, 25 bp, Mus musculus
tgccaactcctttggactggtgcag

SEQ ID NO: 374952 - DNA, 25 bp, Mus musculus
tgccaactctgaaaagaagaaaaag

SEQ ID NO: 374953 - DNA, 25 bp, Mus musculus
tgccaactgagaggactggctgccc

SEQ ID NO: 374954 - DNA, 25 bp, Mus musculus
tgccaactgcgggaaggagctaact

SEQ ID NO: 374955 - DNA, 25 bp, Mus musculus
tgccaactggcaggggacatgaagc

SEQ ID NO: 374956 - DNA, 25 bp, Mus musculus
tgccaactggcaggtatttgacata

SEQ ID NO: 374957 - DNA, 25 bp, Mus musculus
tgccaactggtgctctgttgccgtt

SEQ ID NO: 374958 - DNA, 25 bp, Mus musculus
tgccaagaacatactaaaagcaatg

SEQ ID NO: 374959 - DNA, 25 bp, Mus musculus
tgccaagaacggtatttgaatatca

SEQ ID NO: 374960 - DNA, 25 bp, Mus musculus
tgccaagaagggttgagattgagaa

SEQ ID NO: 374961 - DNA, 25 bp, Mus musculus
tgccaagacatactccagtgatttt

SEQ ID NO: 374962 - DNA, 25 bp, Mus musculus
tgccaagaccaggaacagcctcatg

SEQ ID NO: 374963 - DNA, 25 bp, Mus musculus
tgccaagaccagggacggtctgact

SEQ ID NO: 374964 - DNA, 25 bp, Mus musculus
tgccaagaccagtgaggtctggtat

SEQ ID NO: 374965 - DNA, 25 bp, Mus musculus
tgccaagaccggacagggtctcatg

SEQ ID NO: 374966 - DNA, 25 bp, Mus musculus
tgccaagaccggggatcccaacaag

SEQ ID NO: 374967 - DNA, 25 bp, Mus musculus
tgccaagacgaagaatggatacaca

SEQ ID NO: 374968 - DNA, 25 bp, Mus musculus
tgccaagataaataggtgaggctgc

SEQ ID NO: 374969 - DNA, 25 bp, Mus musculus
tgccaagataaatagttcaattatc

SEQ ID NO: 374970 - DNA, 25 bp, Mus musculus
tgccaagatcatgggtgtggctgga

SEQ ID NO: 374971 - DNA, 25 bp, Mus musculus
tgccaagatctggtggatcgcactc

SEQ ID NO: 374972 - DNA, 25 bp, Mus musculus
tgccaagatcttgatccagtttttt

SEQ ID NO: 374973 - DNA, 25 bp, Mus musculus
tgccaagatggctccagctccagct

SEQ ID NO: 374974 - DNA, 25 bp, Mus musculus
tgccaagatgggtgctcacagtact

SEQ ID NO: 374975 - DNA, 25 bp, Mus musculus
tgccaagcaaggaagcctgctgaca

SEQ ID NO: 374976 - DNA, 25 bp, Mus musculus
tgccaagcaataaaattcatataaa

SEQ ID NO: 374977 - DNA, 25 bp, Mus musculus
tgccaagcagatgaaggggctggca

SEQ ID NO: 374978 - DNA, 25 bp, Mus musculus
tgccaagcaggcagctgtgttaatg

SEQ ID NO: 374979 - DNA, 25 bp, Mus musculus
tgccaagcaggtaattaataatgct

SEQ ID NO: 374980 - DNA, 25 bp, Mus musculus
tgccaagcagtggaggctctttgcc

SEQ ID NO: 374981 - DNA, 25 bp, Mus musculus
tgccaagcatgatgtcaaagtcttt

SEQ ID NO: 374982 - DNA, 25 bp, Mus musculus
tgccaagcattgtggcagatgtgag

SEQ ID NO: 374983 - DNA, 25 bp, Mus musculus
tgccaagcatttccctccaggcttt

SEQ ID NO: 374984 - DNA, 25 bp, Mus musculus
tgccaagccatgaggcaagaaacta

SEQ ID NO: 374985 - DNA, 25 bp, Mus musculus
tgccaagccccctcttgaattttct

SEQ ID NO: 374986 - DNA, 25 bp, Mus musculus
tgccaagcccgaggtctcctctgat

SEQ ID NO: 374987 - DNA, 25 bp, Mus musculus
tgccaagcgaagagacagggcaggg

SEQ ID NO: 374988 - DNA, 25 bp, Mus musculus
tgccaagctcaatggctacacggat

SEQ ID NO: 374989 - DNA, 25 bp, Mus musculus
tgccaagctcatggccagggcattg

SEQ ID NO: 374990 - DNA, 25 bp, Mus musculus
tgccaagctcatgggccctgcaccc

SEQ ID NO: 374991 - DNA, 25 bp, Mus musculus
tgccaagctcatgggtacttccgcc

SEQ ID NO: 374992 - DNA, 25 bp, Mus musculus
tgccaagctggagaatggcaaagcg

SEQ ID NO: 374993 - DNA, 25 bp, Mus musculus
tgccaaggaggagaagtataaagag

SEQ ID NO: 374994 - DNA, 25 bp, Mus musculus
tgccaaggaggagtcagacacagac

SEQ ID NO: 374995 - DNA, 25 bp, Mus musculus
tgccaaggaggtgagacggaaggcc

SEQ ID NO: 374996 - DNA, 25 bp, Mus musculus
tgccaaggcaacggccacgtacccc

SEQ ID NO: 374997 - DNA, 25 bp, Mus musculus
tgccaaggcaggctgtcaggttgta

SEQ ID NO: 374998 - DNA, 25 bp, Mus musculus
tgccaaggcaggtgatttggagttc

SEQ ID NO: 374999 - DNA, 25 bp, Mus musculus
tgccaaggcctgtggcatcctgcct

SEQ ID NO: 375000 - DNA, 25 bp, Mus musculus
tgccaaggctgccgctctggcccac

SEQ ID NO: 375001 - DNA, 25 bp, Mus musculus
tgccaagtataaaggagaagacaat

SEQ ID NO: 375002 - DNA, 25 bp, Mus musculus
tgccaagtgccagaacaccaagctg

SEQ ID NO: 375003 - DNA, 25 bp, Mus musculus
tgccaagtttgagcatgccaccagc

SEQ ID NO: 375004 - DNA, 25 bp, Mus musculus
tgccaagtttgagtctggagacgtg

SEQ ID NO: 375005 - DNA, 25 bp, Mus musculus
tgccaataaagttctttgtgatgtc

SEQ ID NO: 375006 - DNA, 25 bp, Mus musculus
tgccaataaatcagagtcctcattt

SEQ ID NO: 375007 - DNA, 25 bp, Mus musculus
tgccaataagctacaggagcttcaa

SEQ ID NO: 375008 - DNA, 25 bp, Mus musculus
tgccaataaggctgtggaagaaatg

SEQ ID NO: 375009 - DNA, 25 bp, Mus musculus
tgccaataatccgtgccggcataga

SEQ ID NO: 375010 - DNA, 25 bp, Mus musculus
tgccaataatgcagaccagcagttg

SEQ ID NO: 375011 - DNA, 25 bp, Mus musculus
tgccaatattttcgagcattactgt

SEQ ID NO: 375012 - DNA, 25 bp, Mus musculus
tgccaatgaagaatctggtccaggc

SEQ ID NO: 375013 - DNA, 25 bp, Mus musculus
tgccaatgaagaccctggtcttttg

SEQ ID NO: 375014 - DNA, 25 bp, Mus musculus
tgccaatgccatgctggtgccagtg

SEQ ID NO: 375015 - DNA, 25 bp, Mus musculus
tgccaatgcgactgcttttttccgc

SEQ ID NO: 375016 - DNA, 25 bp, Mus musculus
tgccaatgcgcttaagaaaatcaga

SEQ ID NO: 375017 - DNA, 25 bp, Mus musculus
tgccaatgcgtgcatgtcctgcagc

SEQ ID NO: 375018 - DNA, 25 bp, Mus musculus
tgccaatggaggtcctgcaccagat

SEQ ID NO: 375019 - DNA, 25 bp, Mus musculus
tgccaatggagtggagattgtggac

SEQ ID NO: 375020 - DNA, 25 bp, Mus musculus
tgccaatggctacatttgtcctctc

SEQ ID NO: 375021 - DNA, 25 bp, Mus musculus
tgccaatgggattggtcgcctggtt

SEQ ID NO: 375022 - DNA, 25 bp, Mus musculus
tgccaattatacaactgctgacaag

SEQ ID NO: 375023 - DNA, 25 bp, Mus musculus
tgccaattcccttggatttcagttt

SEQ ID NO: 375024 - DNA, 25 bp, Mus musculus
tgccaattgaggtcatgatgaatga

SEQ ID NO: 375025 - DNA, 25 bp, Mus musculus
tgccaatttgggcaccctaagatga

SEQ ID NO: 375026 - DNA, 25 bp, Mus musculus
tgccaatttgggcactgcagcctgt

SEQ ID NO: 375027 - DNA, 25 bp, Mus musculus
tgccaattttgagcagttcctccag

SEQ ID NO: 375028 - DNA, 25 bp, Mus musculus
tgccaatttttgacaacagaacaaa

SEQ ID NO: 375029 - DNA, 25 bp, Mus musculus
tgccacaaaaggagccataattcca

SEQ ID NO: 375030 - DNA, 25 bp, Mus musculus
tgccacaaacaaaagtgtttacaat

SEQ ID NO: 375031 - DNA, 25 bp, Mus musculus
tgccacaaaggaacctacttggtga

SEQ ID NO: 375032 - DNA, 25 bp, Mus musculus
tgccacaaaggtagctacttggtga

SEQ ID NO: 375033 - DNA, 25 bp, Mus musculus
tgccacaaatgaaggagcccattga

SEQ ID NO: 375034 - DNA, 25 bp, Mus musculus
tgccacaacagaaagcctaaaacta

SEQ ID NO: 375035 - DNA, 25 bp, Mus musculus
tgccacaaggagagaactgcccagc

SEQ ID NO: 375036 - DNA, 25 bp, Mus musculus
tgccacacagaggacggctgaacgt

SEQ ID NO: 375037 - DNA, 25 bp, Mus musculus
tgccacacagatgctggagagcatg

SEQ ID NO: 375038 - DNA, 25 bp, Mus musculus
tgccacacagcacaggtgtaacgag

SEQ ID NO: 375039 - DNA, 25 bp, Mus musculus
tgccacaccatataccgaagcaaag

SEQ ID NO: 375040 - DNA, 25 bp, Mus musculus
tgccacaccatatataaactacact

SEQ ID NO: 375041 - DNA, 25 bp, Mus musculus
tgccacacgagaccctggctgggca

SEQ ID NO: 375042 - DNA, 25 bp, Mus musculus
tgccacactggggtagcctttgtga

SEQ ID NO: 375043 - DNA, 25 bp, Mus musculus
tgccacacttaggcatcctacatca

SEQ ID NO: 375044 - DNA, 25 bp, Mus musculus
tgccacacttcacaaggatggaata

SEQ ID NO: 375045 - DNA, 25 bp, Mus musculus
tgccacacttggaggtgaaatcgcc

SEQ ID NO: 375046 - DNA, 25 bp, Mus musculus
tgccacagacagggccactgccggt

SEQ ID NO: 375047 - DNA, 25 bp, Mus musculus
tgccacagcccttcagccagtactg

SEQ ID NO: 375048 - DNA, 25 bp, Mus musculus
tgccacagctcctccctggcccata

SEQ ID NO: 375049 - DNA, 25 bp, Mus musculus
tgccacagtgaaaaaagcaactata

SEQ ID NO: 375050 - DNA, 25 bp, Mus musculus
tgccacagtgaaggagcagattata

SEQ ID NO: 375051 - DNA, 25 bp, Mus musculus
tgccacagtttctcccatccccacc

SEQ ID NO: 375052 - DNA, 25 bp, Mus musculus
tgccacatagaaggctctcagcacc

SEQ ID NO: 375053 - DNA, 25 bp, Mus musculus
tgccacatcatgacaagaaaaagac

SEQ ID NO: 375054 - DNA, 25 bp, Mus musculus
tgccacatcattcaaatattggaga

SEQ ID NO: 375055 - DNA, 25 bp, Mus musculus
tgccacatcctgtgccaataacttc

SEQ ID NO: 375056 - DNA, 25 bp, Mus musculus
tgccacatgtacaaggactcacaca

SEQ ID NO: 375057 - DNA, 25 bp, Mus musculus
tgccaccaaaggtcgggtcattcca

SEQ ID NO: 375058 - DNA, 25 bp, Mus musculus
tgccaccaagacctgtacatggaaa

SEQ ID NO: 375059 - DNA, 25 bp, Mus musculus
tgccaccaagcagaaacagcacctc

SEQ ID NO: 375060 - DNA, 25 bp, Mus musculus
tgccaccaagcaggagattacctgg

SEQ ID NO: 375061 - DNA, 25 bp, Mus musculus
tgccaccaagtcctgtacatggaaa

SEQ ID NO: 375062 - DNA, 25 bp, Mus musculus
tgccaccacacccgagcagtatata

SEQ ID NO: 375063 - DNA, 25 bp, Mus musculus
tgccaccaccaggaacttcctgtag

SEQ ID NO: 375064 - DNA, 25 bp, Mus musculus
tgccaccactcaggagcccttgccc

SEQ ID NO: 375065 - DNA, 25 bp, Mus musculus
tgccaccagcagccaggccaaaaaa

SEQ ID NO: 375066 - DNA, 25 bp, Mus musculus
tgccaccatatcagccattgaagcc

SEQ ID NO: 375067 - DNA, 25 bp, Mus musculus
tgccaccatccgtgactgtcctgga

SEQ ID NO: 375068 - DNA, 25 bp, Mus musculus
tgccaccatgaaaggagaagcggac

SEQ ID NO: 375069 - DNA, 25 bp, Mus musculus
tgccaccatttggcttcattaaaaa

SEQ ID NO: 375070 - DNA, 25 bp, Mus musculus
tgccacccaggttctgattggaacg

SEQ ID NO: 375071 - DNA, 25 bp, Mus musculus
tgccacccatagtgggccaaagaga

SEQ ID NO: 375072 - DNA, 25 bp, Mus musculus
tgccacccatgctttctggatcatt

SEQ ID NO: 375073 - DNA, 25 bp, Mus musculus
tgccacccgacagggccgcagcctc

SEQ ID NO: 375074 - DNA, 25 bp, Mus musculus
tgccacccgacccagttaatctctc

SEQ ID NO: 375075 - DNA, 25 bp, Mus musculus
tgccaccctgtactgcattaacttc

SEQ ID NO: 375076 - DNA, 25 bp, Mus musculus
tgccaccctgtactgtgacaagggc

SEQ ID NO: 375077 - DNA, 25 bp, Mus musculus
tgccacctactggacccttttgtgg

SEQ ID NO: 375078 - DNA, 25 bp, Mus musculus
tgccacctaggtttgaagactccca

SEQ ID NO: 375079 - DNA, 25 bp, Mus musculus
tgccacctcacgaggttcctggaca

SEQ ID NO: 375080 - DNA, 25 bp, Mus musculus
tgccacctccaagtcagcctccaag

SEQ ID NO: 375081 - DNA, 25 bp, Mus musculus
tgccacctgccaagactgtggccgc

SEQ ID NO: 375082 - DNA, 25 bp, Mus musculus
tgccacctgcgagcccactcggctg

SEQ ID NO: 375083 - DNA, 25 bp, Mus musculus
tgccacgagagagctgcaagacctc

SEQ ID NO: 375084 - DNA, 25 bp, Mus musculus
tgccacgcaggcttacagttcctcc

SEQ ID NO: 375085 - DNA, 25 bp, Mus musculus
tgccacgccccctgattgaacctct

SEQ ID NO: 375086 - DNA, 25 bp, Mus musculus
tgccacgcggcacagcccatgcagc

SEQ ID NO: 375087 - DNA, 25 bp, Mus musculus
tgccacgctgagcaccatcaatcag

SEQ ID NO: 375088 - DNA, 25 bp, Mus musculus
tgccacggaggatctagataaaact

SEQ ID NO: 375089 - DNA, 25 bp, Mus musculus
tgccacggaggatgaggatgaggaa

SEQ ID NO: 375090 - DNA, 25 bp, Mus musculus
tgccacggaggatgtcccgcatggt

SEQ ID NO: 375091 - DNA, 25 bp, Mus musculus
tgccacggagtcggaccaggaggaa

SEQ ID NO: 375092 - DNA, 25 bp, Mus musculus
tgccacggagttctggaagaccgct

SEQ ID NO: 375093 - DNA, 25 bp, Mus musculus
tgccacggccatggggtctgtgaca

SEQ ID NO: 375094 - DNA, 25 bp, Mus musculus
tgccacggctgagttaagaatcatg

SEQ ID NO: 375095 - DNA, 25 bp, Mus musculus
tgccacgggaacggagtgtgcaatt

SEQ ID NO: 375096 - DNA, 25 bp, Mus musculus
tgccactacctacagcggcagaacc

SEQ ID NO: 375097 - DNA, 25 bp, Mus musculus
tgccactattgagcatgacctcctg

SEQ ID NO: 375098 - DNA, 25 bp, Mus musculus
tgccactcacgcgagttccagtgtg

SEQ ID NO: 375099 - DNA, 25 bp, Mus musculus
tgccactcagcttgatactcatgga

SEQ ID NO: 375100 - DNA, 25 bp, Mus musculus
tgccactgaggagctcctagttaaa

SEQ ID NO: 375101 - DNA, 25 bp, Mus musculus
tgccactgagtgaagcgtctgcctg

SEQ ID NO: 375102 - DNA, 25 bp, Mus musculus
tgccactgcgcgccggagcctggcg

SEQ ID NO: 375103 - DNA, 25 bp, Mus musculus
tgccactgcgcgcgcccggcatgcc

SEQ ID NO: 375104 - DNA, 25 bp, Mus musculus
tgccactgctttgcctgtaccccag

SEQ ID NO: 375105 - DNA, 25 bp, Mus musculus
tgccactgggacaggacctctggaa

SEQ ID NO: 375106 - DNA, 25 bp, Mus musculus
tgccactgggacagggatcatagac

SEQ ID NO: 375107 - DNA, 25 bp, Mus musculus
tgccactgtgagcttcaacctggct

SEQ ID NO: 375108 - DNA, 25 bp, Mus musculus
tgccacttcaggatacatcagagaa

SEQ ID NO: 375109 - DNA, 25 bp, Mus musculus
tgccacttcaggtaaaatatagttt

SEQ ID NO: 375110 - DNA, 25 bp, Mus musculus
tgccacttccaaggtagcgttggta

SEQ ID NO: 375111 - DNA, 25 bp, Mus musculus
tgccactttcagacctagatacttg

SEQ ID NO: 375112 - DNA, 25 bp, Mus musculus
tgccactttccagccttccccgagg

SEQ ID NO: 375113 - DNA, 25 bp, Mus musculus
tgccactttccaggtgacatatcag

SEQ ID NO: 375114 - DNA, 25 bp, Mus musculus
tgccacttttgaacgggacagcttt

SEQ ID NO: 375115 - DNA, 25 bp, Mus musculus
tgccagaaacacagatttaccttat

SEQ ID NO: 375116 - DNA, 25 bp, Mus musculus
tgccagaaacacagggggtgcagct

SEQ ID NO: 375117 - DNA, 25 bp, Mus musculus
tgccagaaacagcatgccagaattc

SEQ ID NO: 375118 - DNA, 25 bp, Mus musculus
tgccagaaagagaaatgctttgagc

SEQ ID NO: 375119 - DNA, 25 bp, Mus musculus
tgccagaaagtgacagcatcctcta

SEQ ID NO: 375120 - DNA, 25 bp, Mus musculus
tgccagaacagatagtcgtacaagc

SEQ ID NO: 375121 - DNA, 25 bp, Mus musculus
tgccagaagactagattgaggagga

SEQ ID NO: 375122 - DNA, 25 bp, Mus musculus
tgccagaagactagccgccgtgcca

SEQ ID NO: 375123 - DNA, 25 bp, Mus musculus
tgccagaagctgaacttcactggac

SEQ ID NO: 375124 - DNA, 25 bp, Mus musculus
tgccagaaggaggcggcgctctcgc

SEQ ID NO: 375125 - DNA, 25 bp, Mus musculus
tgccagaatagaaggccgttgacta

SEQ ID NO: 375126 - DNA, 25 bp, Mus musculus
tgccagaattactgcatctcccctc

SEQ ID NO: 375127 - DNA, 25 bp, Mus musculus
tgccagactgcaaaggtgaccagag

SEQ ID NO: 375128 - DNA, 25 bp, Mus musculus
tgccagacttaaagatttcacaggt

SEQ ID NO: 375129 - DNA, 25 bp, Mus musculus
tgccagacttaaagtggcccagacg

SEQ ID NO: 375130 - DNA, 25 bp, Mus musculus
tgccagagaaggaacatggcttcca

SEQ ID NO: 375131 - DNA, 25 bp, Mus musculus
tgccagagaggaccccggagctgca

SEQ ID NO: 375132 - DNA, 25 bp, Mus musculus
tgccagagcagaagtcagcatccag

SEQ ID NO: 375133 - DNA, 25 bp, Mus musculus
tgccagagcatggggctctctttgg

SEQ ID NO: 375134 - DNA, 25 bp, Mus musculus
tgccagagcgtttggaacacctttc

SEQ ID NO: 375135 - DNA, 25 bp, Mus musculus
tgccagaggccctgcccgcctggtc

SEQ ID NO: 375136 - DNA, 25 bp, Mus musculus
tgccagaggtgccaggtctgcaaag

SEQ ID NO: 375137 - DNA, 25 bp, Mus musculus
tgccagagtgcagcattattgattg

SEQ ID NO: 375138 - DNA, 25 bp, Mus musculus
tgccagagttcccagatgaagaaac

SEQ ID NO: 375139 - DNA, 25 bp, Mus musculus
tgccagataccaggttgctggtgac

SEQ ID NO: 375140 - DNA, 25 bp, Mus musculus
tgccagatacttcactcgctcgaag

SEQ ID NO: 375141 - DNA, 25 bp, Mus musculus
tgccagatgaagatgactgtcagat

SEQ ID NO: 375142 - DNA, 25 bp, Mus musculus
tgccagatgaggatcatggctgctg

SEQ ID NO: 375143 - DNA, 25 bp, Mus musculus
tgccagatgctaggcatgaggtgaa

SEQ ID NO: 375144 - DNA, 25 bp, Mus musculus
tgccagatgtcaagaaagcgtgtac

SEQ ID NO: 375145 - DNA, 25 bp, Mus musculus
tgccagatgtcaagatatctgtttc

SEQ ID NO: 375146 - DNA, 25 bp, Mus musculus
tgccagatgttttaatggctgttag

SEQ ID NO: 375147 - DNA, 25 bp, Mus musculus
tgccagattgtggctctgaacttcc

SEQ ID NO: 375148 - DNA, 25 bp, Mus musculus
tgccagcaaggtgtagctacttcac

SEQ ID NO: 375149 - DNA, 25 bp, Mus musculus
tgccagcaatgaggtaccatggttg

SEQ ID NO: 375150 - DNA, 25 bp, Mus musculus
tgccagcaatgaggtggctcacaac

SEQ ID NO: 375151 - DNA, 25 bp, Mus musculus
tgccagcacaagaaccaggcagata

SEQ ID NO: 375152 - DNA, 25 bp, Mus musculus
tgccagcacccaagcaaacactttt

SEQ ID NO: 375153 - DNA, 25 bp, Mus musculus
tgccagcacccaggccctgtccagc

SEQ ID NO: 375154 - DNA, 25 bp, Mus musculus
tgccagcacccgccgccgctcctct

SEQ ID NO: 375155 - DNA, 25 bp, Mus musculus
tgccagcactggcaggctgaagatg

SEQ ID NO: 375156 - DNA, 25 bp, Mus musculus
tgccagcagaagatgatgactattc

SEQ ID NO: 375157 - DNA, 25 bp, Mus musculus
tgccagcagaagattctactcaaca

SEQ ID NO: 375158 - DNA, 25 bp, Mus musculus
tgccagcagacagctcccaacccct

SEQ ID NO: 375159 - DNA, 25 bp, Mus musculus
tgccagcagcagatagtttcttaat

SEQ ID NO: 375160 - DNA, 25 bp, Mus musculus
tgccagcagtctgtatgaggattgt

SEQ ID NO: 375161 - DNA, 25 bp, Mus musculus
tgccagcatcagggagcctgtatat

SEQ ID NO: 375162 - DNA, 25 bp, Mus musculus
tgccagccaacggaggccggctggc

SEQ ID NO: 375163 - DNA, 25 bp, Mus musculus
tgccagccaggcttcccggatttgg

SEQ ID NO: 375164 - DNA, 25 bp, Mus musculus
tgccagccagggactaggccctggc

SEQ ID NO: 375165 - DNA, 25 bp, Mus musculus
tgccagccagtgtacgatcccaagt

SEQ ID NO: 375166 - DNA, 25 bp, Mus musculus
tgccagcccaaagaggatctaagcc

SEQ ID NO: 375167 - DNA, 25 bp, Mus musculus
tgccagcccaacctggctcggaaga

SEQ ID NO: 375168 - DNA, 25 bp, Mus musculus
tgccagcccactggaagccgaagct

SEQ ID NO: 375169 - DNA, 25 bp, Mus musculus
tgccagccccacgggtctcagaggt

SEQ ID NO: 375170 - DNA, 25 bp, Mus musculus
tgccagcccccaaccatcaaatcgg

SEQ ID NO: 375171 - DNA, 25 bp, Mus musculus
tgccagccgatggaaaggtcaattt

SEQ ID NO: 375172 - DNA, 25 bp, Mus musculus
tgccagccgccacaggaactggtgt

SEQ ID NO: 375173 - DNA, 25 bp, Mus musculus
tgccagccgccacaggtcctgttga

SEQ ID NO: 375174 - DNA, 25 bp, Mus musculus
tgccagccggactcctccaccctgc

SEQ ID NO: 375175 - DNA, 25 bp, Mus musculus
tgccagcgccgctttcccgaaagat

SEQ ID NO: 375176 - DNA, 25 bp, Mus musculus
tgccagctcaaagctgtgtgtcaac

SEQ ID NO: 375177 - DNA, 25 bp, Mus musculus
tgccagctccggaactctgtggaac

SEQ ID NO: 375178 - DNA, 25 bp, Mus musculus
tgccagctccgggcatgggatatca

SEQ ID NO: 375179 - DNA, 25 bp, Mus musculus
tgccagctgacagatggcgttgacg

SEQ ID NO: 375180 - DNA, 25 bp, Mus musculus
tgccagctgcaggccacaggcagga

SEQ ID NO: 375181 - DNA, 25 bp, Mus musculus
tgccagctgcaggtggtggctgagc

SEQ ID NO: 375182 - DNA, 25 bp, Mus musculus
tgccagctgccggactgccctccag

SEQ ID NO: 375183 - DNA, 25 bp, Mus musculus
tgccagctggacatcaacgattgcc

SEQ ID NO: 375184 - DNA, 25 bp, Mus musculus
tgccagctggacgccaatgagtgtg

SEQ ID NO: 375185 - DNA, 25 bp, Mus musculus
tgccagctggagacctccacacagc

SEQ ID NO: 375186 - DNA, 25 bp, Mus musculus
tgccagctggagagtaggtggcatt

SEQ ID NO: 375187 - DNA, 25 bp, Mus musculus
tgccagctggtggaggaggaagtga

SEQ ID NO: 375188 - DNA, 25 bp, Mus musculus
tgccagcttcctgcttcagtaactt

SEQ ID NO: 375189 - DNA, 25 bp, Mus musculus
tgccagcttggaggcgaatgaagtg

SEQ ID NO: 375190 - DNA, 25 bp, Mus musculus
tgccagctttcgacccggattctca

SEQ ID NO: 375191 - DNA, 25 bp, Mus musculus
tgccaggaaatgcaggttttcctta

SEQ ID NO: 375192 - DNA, 25 bp, Mus musculus
tgccaggaagtggtcatattcacga

SEQ ID NO: 375193 - DNA, 25 bp, Mus musculus
tgccaggaatgtaataacatgctgt

SEQ ID NO: 375194 - DNA, 25 bp, Mus musculus
tgccaggaccccacctggattccga

SEQ ID NO: 375195 - DNA, 25 bp, Mus musculus
tgccaggacggggagacccatataa

SEQ ID NO: 375196 - DNA, 25 bp, Mus musculus
tgccaggagcagaggctcatctacc

SEQ ID NO: 375197 - DNA, 25 bp, Mus musculus
tgccaggagcagagggggatgcccc

SEQ ID NO: 375198 - DNA, 25 bp, Mus musculus
tgccaggagtgaagaccttgcactt

SEQ ID NO: 375199 - DNA, 25 bp, Mus musculus
tgccagggagatgccattgggtacc

SEQ ID NO: 375200 - DNA, 25 bp, Mus musculus
tgccagggaggtgtgaatgaggcag

SEQ ID NO: 375201 - DNA, 25 bp, Mus musculus
tgccagggctctccgaacctagcta

SEQ ID NO: 375202 - DNA, 25 bp, Mus musculus
tgccagggctctccgagaccgaagc

SEQ ID NO: 375203 - DNA, 25 bp, Mus musculus
tgccagggctctccggcgcatctcc

SEQ ID NO: 375204 - DNA, 25 bp, Mus musculus
tgccaggggccccagcccctctggt

SEQ ID NO: 375205 - DNA, 25 bp, Mus musculus
tgccaggtggtgatctgcgaccagt

SEQ ID NO: 375206 - DNA, 25 bp, Mus musculus
tgccagtaaagcatatgggtgattt

SEQ ID NO: 375207 - DNA, 25 bp, Mus musculus
tgccagtaacaggcacatccaggac

SEQ ID NO: 375208 - DNA, 25 bp, Mus musculus
tgccagtaatacattcaaactacaa

SEQ ID NO: 375209 - DNA, 25 bp, Mus musculus
tgccagtactgtggtggcttcagta

SEQ ID NO: 375210 - DNA, 25 bp, Mus musculus
tgccagtagcaaggaggccaatgcc

SEQ ID NO: 375211 - DNA, 25 bp, Mus musculus
tgccagtagcaagttgcaggaggcc

SEQ ID NO: 375212 - DNA, 25 bp, Mus musculus
tgccagtagggggtacagtcctcag

SEQ ID NO: 375213 - DNA, 25 bp, Mus musculus
tgccagtctacaatcggtggagaca

SEQ ID NO: 375214 - DNA, 25 bp, Mus musculus
tgccagtgaagtgataagttgcaag

SEQ ID NO: 375215 - DNA, 25 bp, Mus musculus
tgccagtgacacccgtgccggcata

SEQ ID NO: 375216 - DNA, 25 bp, Mus musculus
tgccagtgactacaaatacaaagtt

SEQ ID NO: 375217 - DNA, 25 bp, Mus musculus
tgccagtgatatacatggagatgac

SEQ ID NO: 375218 - DNA, 25 bp, Mus musculus
tgccagtgcaagaatggccatttgt

SEQ ID NO: 375219 - DNA, 25 bp, Mus musculus
tgccagtgcaagatgaagcactgat

SEQ ID NO: 375220 - DNA, 25 bp, Mus musculus
tgccagtgcccccaccggatgcaga

SEQ ID NO: 375221 - DNA, 25 bp, Mus musculus
tgccagtgcccccaggcttcccccc

SEQ ID NO: 375222 - DNA, 25 bp, Mus musculus
tgccagtggaccctcatgacctact

SEQ ID NO: 375223 - DNA, 25 bp, Mus musculus
tgccagtggacgactctcaggcaca

SEQ ID NO: 375224 - DNA, 25 bp, Mus musculus
tgccagtgggatcccactaaatttc

SEQ ID NO: 375225 - DNA, 25 bp, Mus musculus
tgccagtgggatcgctgttgtggct

SEQ ID NO: 375226 - DNA, 25 bp, Mus musculus
tgccagtgtctcaggaatgtcaagt

SEQ ID NO: 375227 - DNA, 25 bp, Mus musculus
tgccagtgtctcaggcggcttggat

SEQ ID NO: 375228 - DNA, 25 bp, Mus musculus
tgccagtgtctcaggtgactcaagt

SEQ ID NO: 375229 - DNA, 25 bp, Mus musculus
tgccagtgtctcaggtgactccaat

SEQ ID NO: 375230 - DNA, 25 bp, Mus musculus
tgccagtgtgcgcagcctggaaggg

SEQ ID NO: 375231 - DNA, 25 bp, Mus musculus
tgccagtgtgcgcagcttgcttctc

SEQ ID NO: 375232 - DNA, 25 bp, Mus musculus
tgccagttaatgcttcaaactgttc

SEQ ID NO: 375233 - DNA, 25 bp, Mus musculus
tgccagttcttcagtgctgagccta

SEQ ID NO: 375234 - DNA, 25 bp, Mus musculus
tgccagttgcaagtattccccttcc

SEQ ID NO: 375235 - DNA, 25 bp, Mus musculus
tgccagttgcctctcagtttcagcc

SEQ ID NO: 375236 - DNA, 25 bp, Mus musculus
tgccagtttttccaccgctctccag

SEQ ID NO: 375237 - DNA, 25 bp, Mus musculus
tgccataaaggtgacaaatggatac

SEQ ID NO: 375238 - DNA, 25 bp, Mus musculus
tgccataacggtggggtttgcaata

SEQ ID NO: 375239 - DNA, 25 bp, Mus musculus
tgccataatgacaagtaccaggtgt

SEQ ID NO: 375240 - DNA, 25 bp, Mus musculus
tgccatactgaagctgacattatct

SEQ ID NO: 375241 - DNA, 25 bp, Mus musculus
tgccatagaaggttaatggagtgtt

SEQ ID NO: 375242 - DNA, 25 bp, Mus musculus
tgccatattgtttccatcctttatc

SEQ ID NO: 375243 - DNA, 25 bp, Mus musculus
tgccatatttagattataaaaaaga

SEQ ID NO: 375244 - DNA, 25 bp, Mus musculus
tgccatatttagcattcccgtcaat

SEQ ID NO: 375245 - DNA, 25 bp, Mus musculus
tgccatcaaggcccctaacagctcc

SEQ ID NO: 375246 - DNA, 25 bp, Mus musculus
tgccatcacacacacttccttccca

SEQ ID NO: 375247 - DNA, 25 bp, Mus musculus
tgccatcacacacagatctcagtaa

SEQ ID NO: 375248 - DNA, 25 bp, Mus musculus
tgccatcaccaagatgacacttggg

SEQ ID NO: 375249 - DNA, 25 bp, Mus musculus
tgccatcaccaaggaagatttggaa

SEQ ID NO: 375250 - DNA, 25 bp, Mus musculus
tgccatcaccaaggatcagttcatg

SEQ ID NO: 375251 - DNA, 25 bp, Mus musculus
tgccatcaccttggcatttagtaag

SEQ ID NO: 375252 - DNA, 25 bp, Mus musculus
tgccatcactggccgagctctgctt

SEQ ID NO: 375253 - DNA, 25 bp, Mus musculus
tgccatcagcccaggatgctatctc

SEQ ID NO: 375254 - DNA, 25 bp, Mus musculus
tgccatcagcccaggcgattaaatc

SEQ ID NO: 375255 - DNA, 25 bp, Mus musculus
tgccatcagtgaatcaaaggataaa

SEQ ID NO: 375256 - DNA, 25 bp, Mus musculus
tgccatcatggacatcgataagggt

SEQ ID NO: 375257 - DNA, 25 bp, Mus musculus
tgccatcattgcagctgtgatcact

SEQ ID NO: 375258 - DNA, 25 bp, Mus musculus
tgccatcattggaaagatctatacc

SEQ ID NO: 375259 - DNA, 25 bp, Mus musculus
tgccatcccatcacctggaacaacc

SEQ ID NO: 375260 - DNA, 25 bp, Mus musculus
tgccatccctggatgtcagtgctct

SEQ ID NO: 375261 - DNA, 25 bp, Mus musculus
tgccatcctcaggttcaggcagctg

SEQ ID NO: 375262 - DNA, 25 bp, Mus musculus
tgccatcctcggtttctacttattc

SEQ ID NO: 375263 - DNA, 25 bp, Mus musculus
tgccatccttgctcggcgtcctacc

SEQ ID NO: 375264 - DNA, 25 bp, Mus musculus
tgccatccttggtgaggctttccct

SEQ ID NO: 375265 - DNA, 25 bp, Mus musculus
tgccatccttgtcgctgcggatggg

SEQ ID NO: 375266 - DNA, 25 bp, Mus musculus
tgccatcgctgcattctgctctggc

SEQ ID NO: 375267 - DNA, 25 bp, Mus musculus
tgccatcggccaggtttggccgtcg

SEQ ID NO: 375268 - DNA, 25 bp, Mus musculus
tgccatcggccagtgggatctggtg

SEQ ID NO: 375269 - DNA, 25 bp, Mus musculus
tgccatcgtgaccatgctcaagctg

SEQ ID NO: 375270 - DNA, 25 bp, Mus musculus
tgccatctacaggctgtttgattat

SEQ ID NO: 375271 - DNA, 25 bp, Mus musculus
tgccatctacagtggctacagcttt

SEQ ID NO: 375272 - DNA, 25 bp, Mus musculus
tgccatctagcactaagagcggcgc

SEQ ID NO: 375273 - DNA, 25 bp, Mus musculus
tgccatctagtgctcttcctcctgg

SEQ ID NO: 375274 - DNA, 25 bp, Mus musculus
tgccatctgtgcaggtcctacggct

SEQ ID NO: 375275 - DNA, 25 bp, Mus musculus
tgccatcttccccaggttctccaag

SEQ ID NO: 375276 - DNA, 25 bp, Mus musculus
tgccatgaaacccaattccaaatct

SEQ ID NO: 375277 - DNA, 25 bp, Mus musculus
tgccatgaaatggccctgcggattg

SEQ ID NO: 375278 - DNA, 25 bp, Mus musculus
tgccatgaagccattttcagtcaag

SEQ ID NO: 375279 - DNA, 25 bp, Mus musculus
tgccatgaccccagtgaccgtctgg

SEQ ID NO: 375280 - DNA, 25 bp, Mus musculus
tgccatgactatctacggagaagtc

SEQ ID NO: 375281 - DNA, 25 bp, Mus musculus
tgccatgactttctacggagaagtc

SEQ ID NO: 375282 - DNA, 25 bp, Mus musculus
tgccatgagagttgactctgtgcag

SEQ ID NO: 375283 - DNA, 25 bp, Mus musculus
tgccatgagagttgggcacttgctg

SEQ ID NO: 375284 - DNA, 25 bp, Mus musculus
tgccatgagttcgagcccgccggag

SEQ ID NO: 375285 - DNA, 25 bp, Mus musculus
tgccatgcagtgagctgctggtgat

SEQ ID NO: 375286 - DNA, 25 bp, Mus musculus
tgccatgccaggaactccatggcgg

SEQ ID NO: 375287 - DNA, 25 bp, Mus musculus
tgccatgccaggaggaaaggggaag

SEQ ID NO: 375288 - DNA, 25 bp, Mus musculus
tgccatgcgcagtacaacccggagc

SEQ ID NO: 375289 - DNA, 25 bp, Mus musculus
tgccatgcttcctctaacagcagcg

SEQ ID NO: 375290 - DNA, 25 bp, Mus musculus
tgccatggaatccacagttgatgat

SEQ ID NO: 375291 - DNA, 25 bp, Mus musculus
tgccatggaatccctttcagaaatc

SEQ ID NO: 375292 - DNA, 25 bp, Mus musculus
tgccatggaatccgataaagataaa

SEQ ID NO: 375293 - DNA, 25 bp, Mus musculus
tgccatggacgtgactgcaccccaa

SEQ ID NO: 375294 - DNA, 25 bp, Mus musculus
tgccatggcagcaaacccctccccc

SEQ ID NO: 375295 - DNA, 25 bp, Mus musculus
tgccatggcagcaaagatccctccc

SEQ ID NO: 375296 - DNA, 25 bp, Mus musculus
tgccatggtagtgatggacagaatc

SEQ ID NO: 375297 - DNA, 25 bp, Mus musculus
tgccatgtacgagctggtggtgatt

SEQ ID NO: 375298 - DNA, 25 bp, Mus musculus
tgccatgtcagccagtataatgttt

SEQ ID NO: 375299 - DNA, 25 bp, Mus musculus
tgccatgtccaagcggggtgccacg

SEQ ID NO: 375300 - DNA, 25 bp, Mus musculus
tgccatgttggatgccgccttggac

SEQ ID NO: 375301 - DNA, 25 bp, Mus musculus
tgccattattgctttcgaggacgcg

SEQ ID NO: 375302 - DNA, 25 bp, Mus musculus
tgccattcaaacacacacaggagaa

SEQ ID NO: 375303 - DNA, 25 bp, Mus musculus
tgccattcaaattcatgagatattt

SEQ ID NO: 375304 - DNA, 25 bp, Mus musculus
tgccattcaagaaggagaaaatatt

SEQ ID NO: 375305 - DNA, 25 bp, Mus musculus
tgccattcaagtggcagccacagca

SEQ ID NO: 375306 - DNA, 25 bp, Mus musculus
tgccattccaggtaaatgggccagc

SEQ ID NO: 375307 - DNA, 25 bp, Mus musculus
tgccattctagatgtgaaggcacca

SEQ ID NO: 375308 - DNA, 25 bp, Mus musculus
tgccattctcaatggaaatatggaa

SEQ ID NO: 375309 - DNA, 25 bp, Mus musculus
tgccattctcaatgggaaaaagagc

SEQ ID NO: 375310 - DNA, 25 bp, Mus musculus
tgccattctcagcaggccgcagatc

SEQ ID NO: 375311 - DNA, 25 bp, Mus musculus
tgccattctcaggaaaactactcag

SEQ ID NO: 375312 - DNA, 25 bp, Mus musculus
tgccattgaagctgaagaagatgct

SEQ ID NO: 375313 - DNA, 25 bp, Mus musculus
tgccattgagaaaatgaaacagctt

SEQ ID NO: 375314 - DNA, 25 bp, Mus musculus
tgccattgagacgtaccaccagact

SEQ ID NO: 375315 - DNA, 25 bp, Mus musculus
tgccattgctgctgattactctgta

SEQ ID NO: 375316 - DNA, 25 bp, Mus musculus
tgccattgctttaaggacctgcagg

SEQ ID NO: 375317 - DNA, 25 bp, Mus musculus
tgccattgtcgagggggtggcaccg

SEQ ID NO: 375318 - DNA, 25 bp, Mus musculus
tgccattgtcgaggtgtcaagctct

SEQ ID NO: 375319 - DNA, 25 bp, Mus musculus
tgccattgttaagaccgagaattca

SEQ ID NO: 375320 - DNA, 25 bp, Mus musculus
tgccatttactttgggtcactgccc

SEQ ID NO: 375321 - DNA, 25 bp, Mus musculus
tgccatttcagcaggatagtcattg

SEQ ID NO: 375322 - DNA, 25 bp, Mus musculus
tgccatttcagcaggttcaggcgca

SEQ ID NO: 375323 - DNA, 25 bp, Mus musculus
tgccattttaaataggttgtaggaa

SEQ ID NO: 375324 - DNA, 25 bp, Mus musculus
tgccattttcaatgggaaagcgagc

SEQ ID NO: 375325 - DNA, 25 bp, Mus musculus
tgccattttcggctggacgtcgact

SEQ ID NO: 375326 - DNA, 25 bp, Mus musculus
tgccattttctaggaaacctcgtgt

SEQ ID NO: 375327 - DNA, 25 bp, Mus musculus
tgccatttttcaaggaagagaagtg

SEQ ID NO: 375328 - DNA, 25 bp, Mus musculus
tgcccaaaagaaaggctgaagggga

SEQ ID NO: 375329 - DNA, 25 bp, Mus musculus
tgcccaaacagcaagcgcctgtgag

SEQ ID NO: 375330 - DNA, 25 bp, Mus musculus
tgcccaaacgtgtgcccaattacct

SEQ ID NO: 375331 - DNA, 25 bp, Mus musculus
tgcccaaaggacagaataatcctca

SEQ ID NO: 375332 - DNA, 25 bp, Mus musculus
tgcccaaaggacagctggctgtata

SEQ ID NO: 375333 - DNA, 25 bp, Mus musculus
tgcccaaagggacactacatgaagg

SEQ ID NO: 375334 - DNA, 25 bp, Mus musculus
tgcccaacaaggcacctcccacgta

SEQ ID NO: 375335 - DNA, 25 bp, Mus musculus
tgcccaacacagagggtgaacagcc

SEQ ID NO: 375336 - DNA, 25 bp, Mus musculus
tgcccaacacagtggggctgtggtc

SEQ ID NO: 375337 - DNA, 25 bp, Mus musculus
tgcccaacaccagaactattgtccc

SEQ ID NO: 375338 - DNA, 25 bp, Mus musculus
tgcccaacatcatgaaagccaagaa

SEQ ID NO: 375339 - DNA, 25 bp, Mus musculus
tgcccaaccccaggcacagctgact

SEQ ID NO: 375340 - DNA, 25 bp, Mus musculus
tgcccaacctcagcaaagccagtgg

SEQ ID NO: 375341 - DNA, 25 bp, Mus musculus
tgcccaacctcagcacttttctgta

SEQ ID NO: 375342 - DNA, 25 bp, Mus musculus
tgcccaagaagcgtgggaccttcat

SEQ ID NO: 375343 - DNA, 25 bp, Mus musculus
tgcccaagaccagctcacggatgat

SEQ ID NO: 375344 - DNA, 25 bp, Mus musculus
tgcccaagagcgatctagggcggcc

SEQ ID NO: 375345 - DNA, 25 bp, Mus musculus
tgcccaagaggtcactgagcactgg

SEQ ID NO: 375346 - DNA, 25 bp, Mus musculus
tgcccaagataaggatggtagaggt

SEQ ID NO: 375347 - DNA, 25 bp, Mus musculus
tgcccaagataaggcactcctgcag

SEQ ID NO: 375348 - DNA, 25 bp, Mus musculus
tgcccaagatgagcagctgtggcgg

SEQ ID NO: 375349 - DNA, 25 bp, Mus musculus
tgcccaagctaaaggagctgaatct

SEQ ID NO: 375350 - DNA, 25 bp, Mus musculus
tgcccaagctgcaccaggaggcggt

SEQ ID NO: 375351 - DNA, 25 bp, Mus musculus
tgcccaaggagaatgaccccagact

SEQ ID NO: 375352 - DNA, 25 bp, Mus musculus
tgcccaaggagtgggggtgggctta

SEQ ID NO: 375353 - DNA, 25 bp, Mus musculus
tgcccaaggagttctggcaggtggc

SEQ ID NO: 375354 - DNA, 25 bp, Mus musculus
tgcccaaggccacagccaggagaaa

SEQ ID NO: 375355 - DNA, 25 bp, Mus musculus
tgcccaataaggcacctcccaccta

SEQ ID NO: 375356 - DNA, 25 bp, Mus musculus
tgcccaattctgggacactcactct

SEQ ID NO: 375357 - DNA, 25 bp, Mus musculus
tgcccaattgttatggctttgagtg

SEQ ID NO: 375358 - DNA, 25 bp, Mus musculus
tgcccacaaggttcttgttcattct

SEQ ID NO: 375359 - DNA, 25 bp, Mus musculus
tgcccacacagggtgtgtccccagg

SEQ ID NO: 375360 - DNA, 25 bp, Mus musculus
tgcccacacaggttctgcagtacag

SEQ ID NO: 375361 - DNA, 25 bp, Mus musculus
tgcccacacccacagggctgtcccc

SEQ ID NO: 375362 - DNA, 25 bp, Mus musculus
tgcccacacgctgattctctacctg

SEQ ID NO: 375363 - DNA, 25 bp, Mus musculus
tgcccacacgctgcaggtgctgtta

SEQ ID NO: 375364 - DNA, 25 bp, Mus musculus
tgcccacagacaggtggtggctggc

SEQ ID NO: 375365 - DNA, 25 bp, Mus musculus
tgcccacagcccaggctatatcagt

SEQ ID NO: 375366 - DNA, 25 bp, Mus musculus
tgcccacattccagggccctctgcc

SEQ ID NO: 375367 - DNA, 25 bp, Mus musculus
tgcccaccagagcgagtacattgca

SEQ ID NO: 375368 - DNA, 25 bp, Mus musculus
tgcccaccaggattctcagtccttc

SEQ ID NO: 375369 - DNA, 25 bp, Mus musculus
tgcccaccaggcttggaagggaggc

SEQ ID NO: 375370 - DNA, 25 bp, Mus musculus
tgcccaccagttgacagggctggag

SEQ ID NO: 375371 - DNA, 25 bp, Mus musculus
tgcccacctacaggatgtcaatcgg

SEQ ID NO: 375372 - DNA, 25 bp, Mus musculus
tgcccacctggctggtttggacaag

SEQ ID NO: 375373 - DNA, 25 bp, Mus musculus
tgcccacctggtacccaggatattg

SEQ ID NO: 375374 - DNA, 25 bp, Mus musculus
tgcccacctggtacttcctgtggcg

SEQ ID NO: 375375 - DNA, 25 bp, Mus musculus
tgcccacctggttcccagagctaga

SEQ ID NO: 375376 - DNA, 25 bp, Mus musculus
tgcccacgagacttttctttgagta

SEQ ID NO: 375377 - DNA, 25 bp, Mus musculus
tgcccacgagttcccacttggactt

SEQ ID NO: 375378 - DNA, 25 bp, Mus musculus
tgcccacgtcaccctggtcttcctc

SEQ ID NO: 375379 - DNA, 25 bp, Mus musculus
tgcccactctacagcttggccagca

SEQ ID NO: 375380 - DNA, 25 bp, Mus musculus
tgcccactctacaggttcacctggt

SEQ ID NO: 375381 - DNA, 25 bp, Mus musculus
tgcccactgcatcaacacaaacttg

SEQ ID NO: 375382 - DNA, 25 bp, Mus musculus
tgcccactgccggatcctaataact

SEQ ID NO: 375383 - DNA, 25 bp, Mus musculus
tgcccacttgggaggcagaggccat

SEQ ID NO: 375384 - DNA, 25 bp, Mus musculus
tgcccactttcagagcaccccccgg

SEQ ID NO: 375385 - DNA, 25 bp, Mus musculus
tgcccactttcagagccctccaact

SEQ ID NO: 375386 - DNA, 25 bp, Mus musculus
tgcccagaaagtgcttctctccttg

SEQ ID NO: 375387 - DNA, 25 bp, Mus musculus
tgcccagaaagtggtcacgcccggg

SEQ ID NO: 375388 - DNA, 25 bp, Mus musculus
tgcccagaaggagtcgaaagccaaa

SEQ ID NO: 375389 - DNA, 25 bp, Mus musculus
tgcccagaatttgaggtctttaagt

SEQ ID NO: 375390 - DNA, 25 bp, Mus musculus
tgcccagagatggactccagattcc

SEQ ID NO: 375391 - DNA, 25 bp, Mus musculus
tgcccagagctccgggctcaagtcc

SEQ ID NO: 375392 - DNA, 25 bp, Mus musculus
tgcccagaggagtaccctcacctga

SEQ ID NO: 375393 - DNA, 25 bp, Mus musculus
tgcccagagtaggaggtggtgccca

SEQ ID NO: 375394 - DNA, 25 bp, Mus musculus
tgcccagagtgaacctgtgagaaga

SEQ ID NO: 375395 - DNA, 25 bp, Mus musculus
tgcccagatcaaatcgtgtccagcc

SEQ ID NO: 375396 - DNA, 25 bp, Mus musculus
tgcccagatcaactattagacatgt

SEQ ID NO: 375397 - DNA, 25 bp, Mus musculus
tgcccagcaaaaatcccaggatcac

SEQ ID NO: 375398 - DNA, 25 bp, Mus musculus
tgcccagcaaaaatgggggcagcca

SEQ ID NO: 375399 - DNA, 25 bp, Mus musculus
tgcccagccaggagagaatctggga

SEQ ID NO: 375400 - DNA, 25 bp, Mus musculus
tgcccagccaggagctatcctctga

SEQ ID NO: 375401 - DNA, 25 bp, Mus musculus
tgcccagccggtaagaccagctgtg

SEQ ID NO: 375402 - DNA, 25 bp, Mus musculus
tgcccagcctacggttgtctaccgg

SEQ ID NO: 375403 - DNA, 25 bp, Mus musculus
tgcccagcctacgtggtgaagatgg

SEQ ID NO: 375404 - DNA, 25 bp, Mus musculus
tgcccagcctccaaaagccctgccc

SEQ ID NO: 375405 - DNA, 25 bp, Mus musculus
tgcccagcgcttcagcaccgcacag

SEQ ID NO: 375406 - DNA, 25 bp, Mus musculus
tgcccagcgcttcagggagcgacag

SEQ ID NO: 375407 - DNA, 25 bp, Mus musculus
tgcccagctcacgagacagggcagg

SEQ ID NO: 375408 - DNA, 25 bp, Mus musculus
tgcccaggaaaccaggaatgacacg

SEQ ID NO: 375409 - DNA, 25 bp, Mus musculus
tgcccaggaaagagcccaagatgat

SEQ ID NO: 375410 - DNA, 25 bp, Mus musculus
tgcccaggaaagtttctatgttgtc

SEQ ID NO: 375411 - DNA, 25 bp, Mus musculus
tgcccaggaaccagtaattccacga

SEQ ID NO: 375412 - DNA, 25 bp, Mus musculus
tgcccaggacagaggattccctgtc

SEQ ID NO: 375413 - DNA, 25 bp, Mus musculus
tgcccaggacagaggcttccccacc

SEQ ID NO: 375414 - DNA, 25 bp, Mus musculus
tgcccaggagaaactgggagctgaa

SEQ ID NO: 375415 - DNA, 25 bp, Mus musculus
tgcccaggagaaagctattacaagc

SEQ ID NO: 375416 - DNA, 25 bp, Mus musculus
tgcccaggagacacatcaagttgga

SEQ ID NO: 375417 - DNA, 25 bp, Mus musculus
tgcccaggagagattccttctgtca

SEQ ID NO: 375418 - DNA, 25 bp, Mus musculus
tgcccaggagagtttccttctgtca

SEQ ID NO: 375419 - DNA, 25 bp, Mus musculus
tgcccaggatgtggctggaccgctt

SEQ ID NO: 375420 - DNA, 25 bp, Mus musculus
tgcccaggcccaaatgtaccgtcta

SEQ ID NO: 375421 - DNA, 25 bp, Mus musculus
tgcccaggccgggaggcccagatgg

SEQ ID NO: 375422 - DNA, 25 bp, Mus musculus
tgcccaggcctccagttctcccagg

SEQ ID NO: 375423 - DNA, 25 bp, Mus musculus
tgcccaggcgtcgggattatcgtgg

SEQ ID NO: 375424 - DNA, 25 bp, Mus musculus
tgcccaggctgaaggcatcccacgt

SEQ ID NO: 375425 - DNA, 25 bp, Mus musculus
tgcccaggctgtgggtcctcccagg

SEQ ID NO: 375426 - DNA, 25 bp, Mus musculus
tgcccagggcgcaagtgtgagccac

SEQ ID NO: 375427 - DNA, 25 bp, Mus musculus
tgcccaggggcaggatggtgttgct

SEQ ID NO: 375428 - DNA, 25 bp, Mus musculus
tgcccagtgcctatgcttgtggtcc

SEQ ID NO: 375429 - DNA, 25 bp, Mus musculus
tgcccagtttgcaggagcattaaga

SEQ ID NO: 375430 - DNA, 25 bp, Mus musculus
tgcccagtttgccactgcgctggaa

SEQ ID NO: 375431 - DNA, 25 bp, Mus musculus
tgcccatatgcagaagttgctctgg

SEQ ID NO: 375432 - DNA, 25 bp, Mus musculus
tgcccatcagattatctgcaatgct

SEQ ID NO: 375433 - DNA, 25 bp, Mus musculus
tgcccatcagcaccagggacccagg

SEQ ID NO: 375434 - DNA, 25 bp, Mus musculus
tgcccatcagcaccctccagcacgg

SEQ ID NO: 375435 - DNA, 25 bp, Mus musculus
tgcccatcagcaccggccccccact

SEQ ID NO: 375436 - DNA, 25 bp, Mus musculus
tgcccatcatcagtttttccagagg

SEQ ID NO: 375437 - DNA, 25 bp, Mus musculus
tgcccatccggttccagtggtggct

SEQ ID NO: 375438 - DNA, 25 bp, Mus musculus
tgcccatccttaccctatccagcaa

SEQ ID NO: 375439 - DNA, 25 bp, Mus musculus
tgcccatcgatcagatgttgctttg

SEQ ID NO: 375440 - DNA, 25 bp, Mus musculus
tgcccatcgatcaggcccaatgatg

SEQ ID NO: 375441 - DNA, 25 bp, Mus musculus
tgcccatcgatcaggtcaactttgt

SEQ ID NO: 375442 - DNA, 25 bp, Mus musculus
tgcccatctcaaagaaaaaatggca

SEQ ID NO: 375443 - DNA, 25 bp, Mus musculus
tgcccatctcagagaggaaactgag

SEQ ID NO: 375444 - DNA, 25 bp, Mus musculus
tgcccatgaaaaacccgtctcgata

SEQ ID NO: 375445 - DNA, 25 bp, Mus musculus
tgcccatgaaaaatttggaaatcgg

SEQ ID NO: 375446 - DNA, 25 bp, Mus musculus
tgcccatgacaagctccaccgcaca

SEQ ID NO: 375447 - DNA, 25 bp, Mus musculus
tgcccatgatgggcctggtttggag

SEQ ID NO: 375448 - DNA, 25 bp, Mus musculus
tgcccatgccctgtgatcagaccac

SEQ ID NO: 375449 - DNA, 25 bp, Mus musculus
tgcccatggaggtcctgtccagagt

SEQ ID NO: 375450 - DNA, 25 bp, Mus musculus
tgcccatgtgatcatgattctggaa

SEQ ID NO: 375451 - DNA, 25 bp, Mus musculus
tgcccattccagctgtcgcagagat

SEQ ID NO: 375452 - DNA, 25 bp, Mus musculus
tgcccattctcagcatcatgctggg

SEQ ID NO: 375453 - DNA, 25 bp, Mus musculus
tgcccattgcctcagcaactatcag

SEQ ID NO: 375454 - DNA, 25 bp, Mus musculus
tgcccattgcctcagcctctccaac

SEQ ID NO: 375455 - DNA, 25 bp, Mus musculus
tgcccattgtcaggtgcgtgaagct

SEQ ID NO: 375456 - DNA, 25 bp, Mus musculus
tgccccaaaccagcgtgcctcatgg

SEQ ID NO: 375457 - DNA, 25 bp, Mus musculus
tgccccaaagacattctgcccaagc

SEQ ID NO: 375458 - DNA, 25 bp, Mus musculus
tgccccaaaggcattcgatgggtgt

SEQ ID NO: 375459 - DNA, 25 bp, Mus musculus
tgccccaaagttccccagctcgggc

SEQ ID NO: 375460 - DNA, 25 bp, Mus musculus
tgccccaagatgaggacgctcgcac

SEQ ID NO: 375461 - DNA, 25 bp, Mus musculus
tgccccaagcacaaggtgagactgt

SEQ ID NO: 375462 - DNA, 25 bp, Mus musculus
tgccccacaccccgtgacccgcagg

SEQ ID NO: 375463 - DNA, 25 bp, Mus musculus
tgccccacgaactgggtgactttgc

SEQ ID NO: 375464 - DNA, 25 bp, Mus musculus
tgccccacgaactgggtgcagccct

SEQ ID NO: 375465 - DNA, 25 bp, Mus musculus
tgccccactaagattgaagattatg

SEQ ID NO: 375466 - DNA, 25 bp, Mus musculus
tgccccacttcagaaggcccgaaag

SEQ ID NO: 375467 - DNA, 25 bp, Mus musculus
tgccccacttcagtgtgtagaaggc

SEQ ID NO: 375468 - DNA, 25 bp, Mus musculus
tgccccagccacagatgaacgagac

SEQ ID NO: 375469 - DNA, 25 bp, Mus musculus
tgccccaggagacctaggcagactg

SEQ ID NO: 375470 - DNA, 25 bp, Mus musculus
tgccccaggagaggactcttccccc

SEQ ID NO: 375471 - DNA, 25 bp, Mus musculus
tgccccaggagtttcctgaagtcgt

SEQ ID NO: 375472 - DNA, 25 bp, Mus musculus
tgccccaggccgtgaatgaccagtg

SEQ ID NO: 375473 - DNA, 25 bp, Mus musculus
tgccccaggccgtggactaaagacc

SEQ ID NO: 375474 - DNA, 25 bp, Mus musculus
tgccccaggcgggatccgggagaca

SEQ ID NO: 375475 - DNA, 25 bp, Mus musculus
tgccccagtgccagtggcatcaaat

SEQ ID NO: 375476 - DNA, 25 bp, Mus musculus
tgccccagtgccgtttgattttaca

SEQ ID NO: 375477 - DNA, 25 bp, Mus musculus
tgccccatccagaggccatggacgg

SEQ ID NO: 375478 - DNA, 25 bp, Mus musculus
tgcccccaaagatcatccagctcct

SEQ ID NO: 375479 - DNA, 25 bp, Mus musculus
tgcccccaaagctcctgtgccaggt

SEQ ID NO: 375480 - DNA, 25 bp, Mus musculus
tgcccccaactattgtgaccagatg

SEQ ID NO: 375481 - DNA, 25 bp, Mus musculus
tgcccccaagagatcccgtttcatg

SEQ ID NO: 375482 - DNA, 25 bp, Mus musculus
tgcccccaagaggacgagtcttgca

SEQ ID NO: 375483 - DNA, 25 bp, Mus musculus
tgcccccaaggacttaaaagaggag

SEQ ID NO: 375484 - DNA, 25 bp, Mus musculus
tgcccccaaggtggtgttcgtagag

SEQ ID NO: 375485 - DNA, 25 bp, Mus musculus
tgcccccacctactgagctggtctg

SEQ ID NO: 375486 - DNA, 25 bp, Mus musculus
tgcccccacctactggggacttctg

SEQ ID NO: 375487 - DNA, 25 bp, Mus musculus
tgcccccacttaatgcccaaaggat

SEQ ID NO: 375488 - DNA, 25 bp, Mus musculus
tgcccccagaagagttctcttcctt

SEQ ID NO: 375489 - DNA, 25 bp, Mus musculus
tgcccccagagagctctcatggtac

SEQ ID NO: 375490 - DNA, 25 bp, Mus musculus
tgcccccagagaggcagagcccctg

SEQ ID NO: 375491 - DNA, 25 bp, Mus musculus
tgcccccagaggctgaagatggaaa

SEQ ID NO: 375492 - DNA, 25 bp, Mus musculus
tgcccccagagggagaaggggagta

SEQ ID NO: 375493 - DNA, 25 bp, Mus musculus
tgcccccagcagtggataaaatatt

SEQ ID NO: 375494 - DNA, 25 bp, Mus musculus
tgcccccagcttcggcttgttttat

SEQ ID NO: 375495 - DNA, 25 bp, Mus musculus
tgcccccagcttcgggtcttttcac

SEQ ID NO: 375496 - DNA, 25 bp, Mus musculus
tgcccccagtgagcctccctctccc

SEQ ID NO: 375497 - DNA, 25 bp, Mus musculus
tgcccccattcttcctcggtgtgca

SEQ ID NO: 375498 - DNA, 25 bp, Mus musculus
tgccccccaattattaagaaattta

SEQ ID NO: 375499 - DNA, 25 bp, Mus musculus
tgccccccagaatggtgggacgctc

SEQ ID NO: 375500 - DNA, 25 bp, Mus musculus
tgccccccagccacgagcctcccaa

SEQ ID NO: 375501 - DNA, 25 bp, Mus musculus
tgccccccaggagagtgtgctgggc

SEQ ID NO: 375502 - DNA, 25 bp, Mus musculus
tgccccccaggtcaagtggctgggc

SEQ ID NO: 375503 - DNA, 25 bp, Mus musculus
tgccccccaggtcttgactcaggaa

SEQ ID NO: 375504 - DNA, 25 bp, Mus musculus
tgccccccgatctagtgttgacagc

SEQ ID NO: 375505 - DNA, 25 bp, Mus musculus
tgcccccgcaaggagatggagttct

SEQ ID NO: 375506 - DNA, 25 bp, Mus musculus
tgccccctccccctgaccagctgtc

SEQ ID NO: 375507 - DNA, 25 bp, Mus musculus
tgccccctggcctgagaagcctgta

SEQ ID NO: 375508 - DNA, 25 bp, Mus musculus
tgccccctggcctgattgcagcccg

SEQ ID NO: 375509 - DNA, 25 bp, Mus musculus
tgccccctttcacagagcatgatct

SEQ ID NO: 375510 - DNA, 25 bp, Mus musculus
tgccccctttcacaggctcctgagc

SEQ ID NO: 375511 - DNA, 25 bp, Mus musculus
tgccccctttcatacctgctactac

SEQ ID NO: 375512 - DNA, 25 bp, Mus musculus
tgccccgaggcggttctcctgattc

SEQ ID NO: 375513 - DNA, 25 bp, Mus musculus
tgccccgcaacagcaatccaaactt

SEQ ID NO: 375514 - DNA, 25 bp, Mus musculus
tgccccgccacccagatctggaaca

SEQ ID NO: 375515 - DNA, 25 bp, Mus musculus
tgccccgccacccagcggccacatc

SEQ ID NO: 375516 - DNA, 25 bp, Mus musculus
tgccccgccgcaggcccggacacag

SEQ ID NO: 375517 - DNA, 25 bp, Mus musculus
tgccccgccggccaatgggcccagt

SEQ ID NO: 375518 - DNA, 25 bp, Mus musculus
tgccccgctatgagcttgaggaggc

SEQ ID NO: 375519 - DNA, 25 bp, Mus musculus
tgccccggccagctgactgctgtcc

SEQ ID NO: 375520 - DNA, 25 bp, Mus musculus
tgccccgggacgtggtcaacgtggt

SEQ ID NO: 375521 - DNA, 25 bp, Mus musculus
tgccccgggagagacggagatttcc

SEQ ID NO: 375522 - DNA, 25 bp, Mus musculus
tgccccgtaacaggaattattttat

SEQ ID NO: 375523 - DNA, 25 bp, Mus musculus
tgccccgttccaaggactcctttat

SEQ ID NO: 375524 - DNA, 25 bp, Mus musculus
tgccccgttccaaggcaagtccttg

SEQ ID NO: 375525 - DNA, 25 bp, Mus musculus
tgcccctataaaaactccgatgatc

SEQ ID NO: 375526 - DNA, 25 bp, Mus musculus
tgcccctcaccgaggaggagaatgg

SEQ ID NO: 375527 - DNA, 25 bp, Mus musculus
tgcccctcagcagcagcaacagcag

SEQ ID NO: 375528 - DNA, 25 bp, Mus musculus
tgcccctcaggcggtgctatacaac

SEQ ID NO: 375529 - DNA, 25 bp, Mus musculus
tgcccctccctgaactcggctgcac

SEQ ID NO: 375530 - DNA, 25 bp, Mus musculus
tgcccctgataccaggggttccagt

SEQ ID NO: 375531 - DNA, 25 bp, Mus musculus
tgcccctgcaaagataccgaagcaa

SEQ ID NO: 375532 - DNA, 25 bp, Mus musculus
tgcccctgcaaaggttttccatctc

SEQ ID NO: 375533 - DNA, 25 bp, Mus musculus
tgcccctgccagggctgatggtgac

SEQ ID NO: 375534 - DNA, 25 bp, Mus musculus
tgcccctgcctaagccaaggaagta

SEQ ID NO: 375535 - DNA, 25 bp, Mus musculus
tgcccctgcctgagcaaggggacca

SEQ ID NO: 375536 - DNA, 25 bp, Mus musculus
tgcccctggaacctgatctaacaaa

SEQ ID NO: 375537 - DNA, 25 bp, Mus musculus
tgcccctggaggctgccacccgtct

SEQ ID NO: 375538 - DNA, 25 bp, Mus musculus
tgcccctggctgaggcagagcagct

SEQ ID NO: 375539 - DNA, 25 bp, Mus musculus
tgcccctgtcatctctcaccctcgc

SEQ ID NO: 375540 - DNA, 25 bp, Mus musculus
tgcccctgtgagctgcaaaaggaag

SEQ ID NO: 375541 - DNA, 25 bp, Mus musculus
tgcccctgttggaattcgacaccgg

SEQ ID NO: 375542 - DNA, 25 bp, Mus musculus
tgccccttccttcccagtggatctg

SEQ ID NO: 375543 - DNA, 25 bp, Mus musculus
tgccccttggatagactacgagtct

SEQ ID NO: 375544 - DNA, 25 bp, Mus musculus
tgccccttggatagagcatatttaa

SEQ ID NO: 375545 - DNA, 25 bp, Mus musculus
tgcccgaaagagtctaaagcctgac

SEQ ID NO: 375546 - DNA, 25 bp, Mus musculus
tgcccgaaagagtctaaagcgcctg

SEQ ID NO: 375547 - DNA, 25 bp, Mus musculus
tgcccgaaaggctgagaccgctgcc

SEQ ID NO: 375548 - DNA, 25 bp, Mus musculus
tgcccgaagctacaggactcttccc

SEQ ID NO: 375549 - DNA, 25 bp, Mus musculus
tgcccgaccctgaagggacctttga

SEQ ID NO: 375550 - DNA, 25 bp, Mus musculus
tgcccgaccctgaaggtggacttgt

SEQ ID NO: 375551 - DNA, 25 bp, Mus musculus
tgcccgacttgggcaggtaaaccac

SEQ ID NO: 375552 - DNA, 25 bp, Mus musculus
tgcccgagaggttctgggagaggtg

SEQ ID NO: 375553 - DNA, 25 bp, Mus musculus
tgcccgagcgtttctagagcatctg

SEQ ID NO: 375554 - DNA, 25 bp, Mus musculus
tgcccgcactggagcgtgctcttca

SEQ ID NO: 375555 - DNA, 25 bp, Mus musculus
tgcccgcaggagcgcagcaatctag

SEQ ID NO: 375556 - DNA, 25 bp, Mus musculus
tgcccgcccacaagtatgtcttggc

SEQ ID NO: 375557 - DNA, 25 bp, Mus musculus
tgcccgcccaggttgtcttgacacc

SEQ ID NO: 375558 - DNA, 25 bp, Mus musculus
tgcccgcggggactggtatccggtt

SEQ ID NO: 375559 - DNA, 25 bp, Mus musculus
tgcccggaaagccccggcagcccaa

SEQ ID NO: 375560 - DNA, 25 bp, Mus musculus
tgcccggacccgagatgagcaataa

SEQ ID NO: 375561 - DNA, 25 bp, Mus musculus
tgcccggagccgcgactgatttcct

SEQ ID NO: 375562 - DNA, 25 bp, Mus musculus
tgcccggagccgcgttggaggcctc

SEQ ID NO: 375563 - DNA, 25 bp, Mus musculus
tgcccggagcgagacactttcctga

SEQ ID NO: 375564 - DNA, 25 bp, Mus musculus
tgcccggagcgaggtagcaaacaag

SEQ ID NO: 375565 - DNA, 25 bp, Mus musculus
tgcccggcgccggttcagtcctcgc

SEQ ID NO: 375566 - DNA, 25 bp, Mus musculus
tgcccggcgcggcgggagccgctcc

SEQ ID NO: 375567 - DNA, 25 bp, Mus musculus
tgcccggctacatggcatcagtgga

SEQ ID NO: 375568 - DNA, 25 bp, Mus musculus
tgcccggctgcaggcgaatctggtt

SEQ ID NO: 375569 - DNA, 25 bp, Mus musculus
tgcccggcttagaactctccgctgg

SEQ ID NO: 375570 - DNA, 25 bp, Mus musculus
tgcccgggaagagttcagccggcgc

SEQ ID NO: 375571 - DNA, 25 bp, Mus musculus
tgcccgggacaaagggtgaagcagg

SEQ ID NO: 375572 - DNA, 25 bp, Mus musculus
tgcccgggcaagacatccacatctt

SEQ ID NO: 375573 - DNA, 25 bp, Mus musculus
tgcccggtcttccgctgaaggggat

SEQ ID NO: 375574 - DNA, 25 bp, Mus musculus
tgcccggtgtgtgcgtgtgcaagag

SEQ ID NO: 375575 - DNA, 25 bp, Mus musculus
tgcccgtatagattacatctcgctt

SEQ ID NO: 375576 - DNA, 25 bp, Mus musculus
tgcccgtataggcacgtcagcttta

SEQ ID NO: 375577 - DNA, 25 bp, Mus musculus
tgcccgtcaaaagattccaagaaac

SEQ ID NO: 375578 - DNA, 25 bp, Mus musculus
tgcccgtcgaaaagacaattgggaa

SEQ ID NO: 375579 - DNA, 25 bp, Mus musculus
tgcccgtgaagagtgtttcccgaga

SEQ ID NO: 375580 - DNA, 25 bp, Mus musculus
tgcccgtgatgactgataaacaagc

SEQ ID NO: 375581 - DNA, 25 bp, Mus musculus
tgcccgtggagcaagtgtttgccaa

SEQ ID NO: 375582 - DNA, 25 bp, Mus musculus
tgcccgtggaggaggtggacatcta

SEQ ID NO: 375583 - DNA, 25 bp, Mus musculus
tgcccgtggtgctggggcctgtgct

SEQ ID NO: 375584 - DNA, 25 bp, Mus musculus
tgcccgttttagcttggctgaagag

SEQ ID NO: 375585 - DNA, 25 bp, Mus musculus
tgccctaaagaagtattagatggac

SEQ ID NO: 375586 - DNA, 25 bp, Mus musculus
tgccctaagaggttatcaagaaatc

SEQ ID NO: 375587 - DNA, 25 bp, Mus musculus
tgccctagagatagtcaataacaga

SEQ ID NO: 375588 - DNA, 25 bp, Mus musculus
tgccctagagatcaagatattatct

SEQ ID NO: 375589 - DNA, 25 bp, Mus musculus
tgccctagcttgggggctttcaggt

SEQ ID NO: 375590 - DNA, 25 bp, Mus musculus
tgccctatgggaatattcagagcag

SEQ ID NO: 375591 - DNA, 25 bp, Mus musculus
tgccctattcctcagggtctctaag

SEQ ID NO: 375592 - DNA, 25 bp, Mus musculus
tgccctcaagaaagaagctgtttgg

SEQ ID NO: 375593 - DNA, 25 bp, Mus musculus
tgccctcaagaaaggtgtggtgacc

SEQ ID NO: 375594 - DNA, 25 bp, Mus musculus
tgccctcaaggtaatggatgactac

SEQ ID NO: 375595 - DNA, 25 bp, Mus musculus
tgccctcaaggtggtgaagaaagtg

SEQ ID NO: 375596 - DNA, 25 bp, Mus musculus
tgccctcacacagagaggtctgaag

SEQ ID NO: 375597 - DNA, 25 bp, Mus musculus
tgccctcacacaggtttccctctgt

SEQ ID NO: 375598 - DNA, 25 bp, Mus musculus
tgccctcaccagacaatccctgttg

SEQ ID NO: 375599 - DNA, 25 bp, Mus musculus
tgccctcaccagtcaatccctgttg

SEQ ID NO: 375600 - DNA, 25 bp, Mus musculus
tgccctcacgatcaacaaggcagga

SEQ ID NO: 375601 - DNA, 25 bp, Mus musculus
tgccctcacgcataaaaataagatc

SEQ ID NO: 375602 - DNA, 25 bp, Mus musculus
tgccctcactcggccgccgcgtgtc

SEQ ID NO: 375603 - DNA, 25 bp, Mus musculus
tgccctcagagcctgtggacatttc

SEQ ID NO: 375604 - DNA, 25 bp, Mus musculus
tgccctcagagggccgggttaaacg

SEQ ID NO: 375605 - DNA, 25 bp, Mus musculus
tgccctcagccccccagcacttgtg

SEQ ID NO: 375606 - DNA, 25 bp, Mus musculus
tgccctcaggttcattctgaatcta

SEQ ID NO: 375607 - DNA, 25 bp, Mus musculus
tgccctcatttgagaacaagactat

SEQ ID NO: 375608 - DNA, 25 bp, Mus musculus
tgccctccacagagttccccacacc

SEQ ID NO: 375609 - DNA, 25 bp, Mus musculus
tgccctccacagcccctacttccag

SEQ ID NO: 375610 - DNA, 25 bp, Mus musculus
tgccctccacaggagcaggcgagca

SEQ ID NO: 375611 - DNA, 25 bp, Mus musculus
tgccctccacttcctgttgtcggtg

SEQ ID NO: 375612 - DNA, 25 bp, Mus musculus
tgccctcccagccaccaaaggggag

SEQ ID NO: 375613 - DNA, 25 bp, Mus musculus
tgccctccggccaggcgattaaatc

SEQ ID NO: 375614 - DNA, 25 bp, Mus musculus
tgccctccgttgaaagcaccatacc

SEQ ID NO: 375615 - DNA, 25 bp, Mus musculus
tgccctcgacttagaatattagaag

SEQ ID NO: 375616 - DNA, 25 bp, Mus musculus
tgccctcgacttaggagcaggctgc

SEQ ID NO: 375617 - DNA, 25 bp, Mus musculus
tgccctctgagtccaaccaagttta

SEQ ID NO: 375618 - DNA, 25 bp, Mus musculus
tgccctctgtaaagtgatggctgca

SEQ ID NO: 375619 - DNA, 25 bp, Mus musculus
tgccctctgtcactgtcacgttcat

SEQ ID NO: 375620 - DNA, 25 bp, Mus musculus
tgccctcttcggggaagaaatagat

SEQ ID NO: 375621 - DNA, 25 bp, Mus musculus
tgccctcttctgcacatcgagtcac

SEQ ID NO: 375622 - DNA, 25 bp, Mus musculus
tgccctgaaagtcccgagtttatgt

SEQ ID NO: 375623 - DNA, 25 bp, Mus musculus
tgccctgaagctcctgtatgacagc

SEQ ID NO: 375624 - DNA, 25 bp, Mus musculus
tgccctgaaggctggataatcaggg

SEQ ID NO: 375625 - DNA, 25 bp, Mus musculus
tgccctgaaggtcagaaacccaagg

SEQ ID NO: 375626 - DNA, 25 bp, Mus musculus
tgccctgaccccggtgtgtgatagc

SEQ ID NO: 375627 - DNA, 25 bp, Mus musculus
tgccctgaggccctttatgctgctg

SEQ ID NO: 375628 - DNA, 25 bp, Mus musculus
tgccctgatgtaggacgaagaatga

SEQ ID NO: 375629 - DNA, 25 bp, Mus musculus
tgccctgcaagcctgtatggatgga

SEQ ID NO: 375630 - DNA, 25 bp, Mus musculus
tgccctgcaccactttgccagcact

SEQ ID NO: 375631 - DNA, 25 bp, Mus musculus
tgccctgcagccagacagtgacccc

SEQ ID NO: 375632 - DNA, 25 bp, Mus musculus
tgccctgcagggtttgtccgccctc

SEQ ID NO: 375633 - DNA, 25 bp, Mus musculus
tgccctgcaggtcaatgtgattgag

SEQ ID NO: 375634 - DNA, 25 bp, Mus musculus
tgccctgcagtaccacatcaacaaa

SEQ ID NO: 375635 - DNA, 25 bp, Mus musculus
tgccctgcatcaaggagcttgtgtc

SEQ ID NO: 375636 - DNA, 25 bp, Mus musculus
tgccctgcccattgtgtcctggggc

SEQ ID NO: 375637 - DNA, 25 bp, Mus musculus
tgccctgcctgtgggaagtgctttg

SEQ ID NO: 375638 - DNA, 25 bp, Mus musculus
tgccctgcctgtgggctcagtctcc

SEQ ID NO: 375639 - DNA, 25 bp, Mus musculus
tgccctgctggacattcaggagctt

SEQ ID NO: 375640 - DNA, 25 bp, Mus musculus
tgccctgctggacctgttcagcccc

SEQ ID NO: 375641 - DNA, 25 bp, Mus musculus
tgccctgctgggtggggagacagca

SEQ ID NO: 375642 - DNA, 25 bp, Mus musculus
tgccctggacgttgagtgtggaaaa

SEQ ID NO: 375643 - DNA, 25 bp, Mus musculus
tgccctggccaaggtcctggacaat

SEQ ID NO: 375644 - DNA, 25 bp, Mus musculus
tgccctggccgaggaagccgagata

SEQ ID NO: 375645 - DNA, 25 bp, Mus musculus
tgccctgggagacggggttgaccgg

SEQ ID NO: 375646 - DNA, 25 bp, Mus musculus
tgccctgggagcctctgacctccag

SEQ ID NO: 375647 - DNA, 25 bp, Mus musculus
tgccctggggagccttttgcccttc

SEQ ID NO: 375648 - DNA, 25 bp, Mus musculus
tgccctggtaaatgctactgagtga

SEQ ID NO: 375649 - DNA, 25 bp, Mus musculus
tgccctgtccccagccccctcccca

SEQ ID NO: 375650 - DNA, 25 bp, Mus musculus
tgccctgtgagtttcaggtgccatg

SEQ ID NO: 375651 - DNA, 25 bp, Mus musculus
tgccctgtggctatattgctgcctt

SEQ ID NO: 375652 - DNA, 25 bp, Mus musculus
tgccctgtggcttcattttccagtt

SEQ ID NO: 375653 - DNA, 25 bp, Mus musculus
tgccctgtgtgaaggagcttctgcg

SEQ ID NO: 375654 - DNA, 25 bp, Mus musculus
tgccctgttacctcgccgagctgga

SEQ ID NO: 375655 - DNA, 25 bp, Mus musculus
tgcccttaaacaggaaatctttgag

SEQ ID NO: 375656 - DNA, 25 bp, Mus musculus
tgcccttaaacagttgcaggaaatc

SEQ ID NO: 375657 - DNA, 25 bp, Mus musculus
tgcccttaaggccctggaattcccg

SEQ ID NO: 375658 - DNA, 25 bp, Mus musculus
tgcccttaaggtccctgccctccct

SEQ ID NO: 375659 - DNA, 25 bp, Mus musculus
tgcccttaatgaaaacattaaccag

SEQ ID NO: 375660 - DNA, 25 bp, Mus musculus
tgcccttagatttctacacgagaac

SEQ ID NO: 375661 - DNA, 25 bp, Mus musculus
tgcccttcaggaaagcctgtgggcc

SEQ ID NO: 375662 - DNA, 25 bp, Mus musculus
tgcccttccgagctatccgggtgac

SEQ ID NO: 375663 - DNA, 25 bp, Mus musculus
tgcccttccgaggaagtctgccggc

SEQ ID NO: 375664 - DNA, 25 bp, Mus musculus
tgcccttcctcacagaaaataaagc

SEQ ID NO: 375665 - DNA, 25 bp, Mus musculus
tgcccttcggcaaggtcggaacctg

SEQ ID NO: 375666 - DNA, 25 bp, Mus musculus
tgcccttcgggagacaaatgtgcgc

SEQ ID NO: 375667 - DNA, 25 bp, Mus musculus
tgcccttcgggagccatcaagagtt

SEQ ID NO: 375668 - DNA, 25 bp, Mus musculus
tgcccttcttcgacatggctgggct

SEQ ID NO: 375669 - DNA, 25 bp, Mus musculus
tgcccttcttcgtggatccaggttc

SEQ ID NO: 375670 - DNA, 25 bp, Mus musculus
tgcccttgaagggtaagtggagaaa

SEQ ID NO: 375671 - DNA, 25 bp, Mus musculus
tgcccttgactggtacagacttacg

SEQ ID NO: 375672 - DNA, 25 bp, Mus musculus
tgcccttgtccccagcaagtcttct

SEQ ID NO: 375673 - DNA, 25 bp, Mus musculus
tgccctttctctggaacttcgagtc

SEQ ID NO: 375674 - DNA, 25 bp, Mus musculus
tgccctttctctgggagctgaacat

SEQ ID NO: 375675 - DNA, 25 bp, Mus musculus
tgcccttttatagaccagtttgaat

SEQ ID NO: 375676 - DNA, 25 bp, Mus musculus
tgcccttttcccgtgtgttcaggga

SEQ ID NO: 375677 - DNA, 25 bp, Mus musculus
tgccctttttggctgcagagataca

SEQ ID NO: 375678 - DNA, 25 bp, Mus musculus
tgccctttttgtgccgtggtgagaa

SEQ ID NO: 375679 - DNA, 25 bp, Mus musculus
tgccgaaacccagatgaggaataac

SEQ ID NO: 375680 - DNA, 25 bp, Mus musculus
tgccgaacaccggttttgcctcaat

SEQ ID NO: 375681 - DNA, 25 bp, Mus musculus
tgccgaacaccgtgcacttaatgca

SEQ ID NO: 375682 - DNA, 25 bp, Mus musculus
tgccgaagcaaggtgagatctccag

SEQ ID NO: 375683 - DNA, 25 bp, Mus musculus
tgccgacacagccacagcatttcac

SEQ ID NO: 375684 - DNA, 25 bp, Mus musculus
tgccgacatctgtagcatatatccg

SEQ ID NO: 375685 - DNA, 25 bp, Mus musculus
tgccgactacgtggaggagcccaag

SEQ ID NO: 375686 - DNA, 25 bp, Mus musculus
tgccgactgtggggtgtgccttctt

SEQ ID NO: 375687 - DNA, 25 bp, Mus musculus
tgccgagaaagaggcagagaaaccc

SEQ ID NO: 375688 - DNA, 25 bp, Mus musculus
tgccgagatggcacgttttgtgccc

SEQ ID NO: 375689 - DNA, 25 bp, Mus musculus
tgccgagcaacaggtgtcgttgaca

SEQ ID NO: 375690 - DNA, 25 bp, Mus musculus
tgccgaggaggctagacaaatggct

SEQ ID NO: 375691 - DNA, 25 bp, Mus musculus
tgccgaggaggggcgtgctggtcac

SEQ ID NO: 375692 - DNA, 25 bp, Mus musculus
tgccgaggtcctcacctccttcact

SEQ ID NO: 375693 - DNA, 25 bp, Mus musculus
tgccgagtccgacggatcgctactc

SEQ ID NO: 375694 - DNA, 25 bp, Mus musculus
tgccgataagtacgccctggagcgt

SEQ ID NO: 375695 - DNA, 25 bp, Mus musculus
tgccgatcacagggagaacattctg

SEQ ID NO: 375696 - DNA, 25 bp, Mus musculus
tgccgatcagaaccagtttgacaca

SEQ ID NO: 375697 - DNA, 25 bp, Mus musculus
tgccgatcagctatatttctcttgg

SEQ ID NO: 375698 - DNA, 25 bp, Mus musculus
tgccgatgagtctgccaccatttga

SEQ ID NO: 375699 - DNA, 25 bp, Mus musculus
tgccgatgagtctgcctgccattgc

SEQ ID NO: 375700 - DNA, 25 bp, Mus musculus
tgccgatgccagatgagacatcgtt

SEQ ID NO: 375701 - DNA, 25 bp, Mus musculus
tgccgatgtaccaggaaacatccga

SEQ ID NO: 375702 - DNA, 25 bp, Mus musculus
tgccgcaacgatgggaagctcctgg

SEQ ID NO: 375703 - DNA, 25 bp, Mus musculus
tgccgcaccgctacagggcattagg

SEQ ID NO: 375704 - DNA, 25 bp, Mus musculus
tgccgcagacagagtgccctgggcg

SEQ ID NO: 375705 - DNA, 25 bp, Mus musculus
tgccgcaggacagcaccacgcccca

SEQ ID NO: 375706 - DNA, 25 bp, Mus musculus
tgccgcagggaagagcgggctaact

SEQ ID NO: 375707 - DNA, 25 bp, Mus musculus
tgccgcagggggtgctacagaagac

SEQ ID NO: 375708 - DNA, 25 bp, Mus musculus
tgccgcaggggtcatgttagcggct

SEQ ID NO: 375709 - DNA, 25 bp, Mus musculus
tgccgcatgcaggtggaccctcaga

SEQ ID NO: 375710 - DNA, 25 bp, Mus musculus
tgccgccacaaagaaaggaaacacg

SEQ ID NO: 375711 - DNA, 25 bp, Mus musculus
tgccgccacagccagaagttgaaat

SEQ ID NO: 375712 - DNA, 25 bp, Mus musculus
tgccgccacagcggccccgtgtctg

SEQ ID NO: 375713 - DNA, 25 bp, Mus musculus
tgccgccaccacctggaactggtga

SEQ ID NO: 375714 - DNA, 25 bp, Mus musculus
tgccgccataggtttatggagccgt

SEQ ID NO: 375715 - DNA, 25 bp, Mus musculus
tgccgcccaggactgctcctgcctt

SEQ ID NO: 375716 - DNA, 25 bp, Mus musculus
tgccgcccagtgttcctttgaagac

SEQ ID NO: 375717 - DNA, 25 bp, Mus musculus
tgccgcccagtgttgtcactggacc

SEQ ID NO: 375718 - DNA, 25 bp, Mus musculus
tgccgccccaacccgtgtcacaatg

SEQ ID NO: 375719 - DNA, 25 bp, Mus musculus
tgccgccccgccttgaacagagaaa

SEQ ID NO: 375720 - DNA, 25 bp, Mus musculus
tgccgcccctgctattacaagccag

SEQ ID NO: 375721 - DNA, 25 bp, Mus musculus
tgccgcccgagcagttgccccagaa

SEQ ID NO: 375722 - DNA, 25 bp, Mus musculus
tgccgccgccaagaaacaggctcgc

SEQ ID NO: 375723 - DNA, 25 bp, Mus musculus
tgccgccgccagtttcccacttgtc

SEQ ID NO: 375724 - DNA, 25 bp, Mus musculus
tgccgccgtaggaactgacccgagg

SEQ ID NO: 375725 - DNA, 25 bp, Mus musculus
tgccgccgtcatggccgactactgg

SEQ ID NO: 375726 - DNA, 25 bp, Mus musculus
tgccgccgtgcggggagcagcaatg

SEQ ID NO: 375727 - DNA, 25 bp, Mus musculus
tgccgccgtgcggggatagctgccc

SEQ ID NO: 375728 - DNA, 25 bp, Mus musculus
tgccgcctacaggattcctgtctag

SEQ ID NO: 375729 - DNA, 25 bp, Mus musculus
tgccgcctacagtgcagggagacta

SEQ ID NO: 375730 - DNA, 25 bp, Mus musculus
tgccgcctcagaggtttaaacgcat

SEQ ID NO: 375731 - DNA, 25 bp, Mus musculus
tgccgcctccagtgccgggagcccg

SEQ ID NO: 375732 - DNA, 25 bp, Mus musculus
tgccgcctcctcagtatcaggcacc

SEQ ID NO: 375733 - DNA, 25 bp, Mus musculus
tgccgcctcctccgagcctgaagct

SEQ ID NO: 375734 - DNA, 25 bp, Mus musculus
tgccgcctggaacagctggaagaga

SEQ ID NO: 375735 - DNA, 25 bp, Mus musculus
tgccgcctggtcttctgggccgagt

SEQ ID NO: 375736 - DNA, 25 bp, Mus musculus
tgccgcctggtcttgtgggccgagt

SEQ ID NO: 375737 - DNA, 25 bp, Mus musculus
tgccgcgacctgaacacatgtcgga

SEQ ID NO: 375738 - DNA, 25 bp, Mus musculus
tgccgcgacgagaaccccagacaga

SEQ ID NO: 375739 - DNA, 25 bp, Mus musculus
tgccgcgacgagccctgctggtgtg

SEQ ID NO: 375740 - DNA, 25 bp, Mus musculus
tgccgcgacgagctgaggagggcag

SEQ ID NO: 375741 - DNA, 25 bp, Mus musculus
tgccgcgcctggagagctccacgca

SEQ ID NO: 375742 - DNA, 25 bp, Mus musculus
tgccgcgggcgcagataaagaagct

SEQ ID NO: 375743 - DNA, 25 bp, Mus musculus
tgccgcgtggagcaggacctggcaa

SEQ ID NO: 375744 - DNA, 25 bp, Mus musculus
tgccgctaatttgtggaacctctga

SEQ ID NO: 375745 - DNA, 25 bp, Mus musculus
tgccgctaatttgtggccgtctgct

SEQ ID NO: 375746 - DNA, 25 bp, Mus musculus
tgccgctaatttgtgtttacagacc

SEQ ID NO: 375747 - DNA, 25 bp, Mus musculus
tgccgctccacagtggctccacgta

SEQ ID NO: 375748 - DNA, 25 bp, Mus musculus
tgccgctccagaagctcgaagcggt

SEQ ID NO: 375749 - DNA, 25 bp, Mus musculus
tgccgctccatcagggttccagtga

SEQ ID NO: 375750 - DNA, 25 bp, Mus musculus
tgccgctccatcagtggctccacgt

SEQ ID NO: 375751 - DNA, 25 bp, Mus musculus
tgccgctcttggtttccatcgtgtg

SEQ ID NO: 375752 - DNA, 25 bp, Mus musculus
tgccgctgaagagcgtattgaaggg

SEQ ID NO: 375753 - DNA, 25 bp, Mus musculus
tgccgctgagtggatacattccacc

SEQ ID NO: 375754 - DNA, 25 bp, Mus musculus
tgccgctgctgggtggctgcgttga

SEQ ID NO: 375755 - DNA, 25 bp, Mus musculus
tgccgctgcttgcaaggagaagttg

SEQ ID NO: 375756 - DNA, 25 bp, Mus musculus
tgccgctggcatggacagttctgcc

SEQ ID NO: 375757 - DNA, 25 bp, Mus musculus
tgccgctggccagtttcttcagcga

SEQ ID NO: 375758 - DNA, 25 bp, Mus musculus
tgccgcttccatcagacctgaggtc

SEQ ID NO: 375759 - DNA, 25 bp, Mus musculus
tgccgcttgcgtggctcggatggcg

SEQ ID NO: 375760 - DNA, 25 bp, Mus musculus
tgccggaacgagccatggaccctct

SEQ ID NO: 375761 - DNA, 25 bp, Mus musculus
tgccggaacgaggcttcatctaccc

SEQ ID NO: 375762 - DNA, 25 bp, Mus musculus
tgccggaagcagtagctaagatgcg

SEQ ID NO: 375763 - DNA, 25 bp, Mus musculus
tgccggaggagaggtacagacatga

SEQ ID NO: 375764 - DNA, 25 bp, Mus musculus
tgccggagggcctcgagctgaaggg

SEQ ID NO: 375765 - DNA, 25 bp, Mus musculus
tgccggagggcctcggtcacccagc

SEQ ID NO: 375766 - DNA, 25 bp, Mus musculus
tgccggagttgcaagaccatagtct

SEQ ID NO: 375767 - DNA, 25 bp, Mus musculus
tgccggcaccaacagcgccaggcag

SEQ ID NO: 375768 - DNA, 25 bp, Mus musculus
tgccggcaggcaccgaggtggtttg

SEQ ID NO: 375769 - DNA, 25 bp, Mus musculus
tgccggccagcagtactattactgg

SEQ ID NO: 375770 - DNA, 25 bp, Mus musculus
tgccggccgagattgctaagaagcc

SEQ ID NO: 375771 - DNA, 25 bp, Mus musculus
tgccggccgcgcgcgcgttattgga

SEQ ID NO: 375772 - DNA, 25 bp, Mus musculus
tgccggcctccaggtctgtgcactt

SEQ ID NO: 375773 - DNA, 25 bp, Mus musculus
tgccggcggggtctcctgtgagcag

SEQ ID NO: 375774 - DNA, 25 bp, Mus musculus
tgccggctcagagggaggaggacag

SEQ ID NO: 375775 - DNA, 25 bp, Mus musculus
tgccggctgaggagaaacaacaaat

SEQ ID NO: 375776 - DNA, 25 bp, Mus musculus
tgccggctgccgttccgagcccttc

SEQ ID NO: 375777 - DNA, 25 bp, Mus musculus
tgccggctgggctgctgattcacgg

SEQ ID NO: 375778 - DNA, 25 bp, Mus musculus
tgccggcttgatgcccccaagcctc

SEQ ID NO: 375779 - DNA, 25 bp, Mus musculus
tgccgggatcaaggcagagatgctt

SEQ ID NO: 375780 - DNA, 25 bp, Mus musculus
tgccgggattaaagagcaaaagaga

SEQ ID NO: 375781 - DNA, 25 bp, Mus musculus
tgccgggattaaagagtctattttc

SEQ ID NO: 375782 - DNA, 25 bp, Mus musculus
tgccgggcagccaggcaccacctac

SEQ ID NO: 375783 - DNA, 25 bp, Mus musculus
tgccgggcagcgagtcatcctccac

SEQ ID NO: 375784 - DNA, 25 bp, Mus musculus
tgccgggcgagctggaaaccatggc

SEQ ID NO: 375785 - DNA, 25 bp, Mus musculus
tgccgggcgaggcctctgagaacac

SEQ ID NO: 375786 - DNA, 25 bp, Mus musculus
tgccgggctgtgcctctcctttccc

SEQ ID NO: 375787 - DNA, 25 bp, Mus musculus
tgccggtgagtacgcctgctaagcc

SEQ ID NO: 375788 - DNA, 25 bp, Mus musculus
tgccggtgcccccggccctcaagga

SEQ ID NO: 375789 - DNA, 25 bp, Mus musculus
tgccggttagggactgcatgagaag

SEQ ID NO: 375790 - DNA, 25 bp, Mus musculus
tgccggttaggggcgaatggacccg

SEQ ID NO: 375791 - DNA, 25 bp, Mus musculus
tgccggttgagagggggcacaatat

SEQ ID NO: 375792 - DNA, 25 bp, Mus musculus
tgccgtaagaacttgaaaactcctc

SEQ ID NO: 375793 - DNA, 25 bp, Mus musculus
tgccgtaagaactttcttttgcatg

SEQ ID NO: 375794 - DNA, 25 bp, Mus musculus
tgccgtaagaatttcatcctatcta

SEQ ID NO: 375795 - DNA, 25 bp, Mus musculus
tgccgtaccagagccattcatcagg

SEQ ID NO: 375796 - DNA, 25 bp, Mus musculus
tgccgtaccagggacattcttctcc

SEQ ID NO: 375797 - DNA, 25 bp, Mus musculus
tgccgtacctccaggtgatcaagct

SEQ ID NO: 375798 - DNA, 25 bp, Mus musculus
tgccgtagcggggatgatgagcaat

SEQ ID NO: 375799 - DNA, 25 bp, Mus musculus
tgccgtatcaacattgatgagtgcc

SEQ ID NO: 375800 - DNA, 25 bp, Mus musculus
tgccgtcaaagtcgtgaccccaggc

SEQ ID NO: 375801 - DNA, 25 bp, Mus musculus
tgccgtcatgtcccggaacagcctg

SEQ ID NO: 375802 - DNA, 25 bp, Mus musculus
tgccgtcatttatagggttatacag

SEQ ID NO: 375803 - DNA, 25 bp, Mus musculus
tgccgtcctgcaccaacctgcgagc

SEQ ID NO: 375804 - DNA, 25 bp, Mus musculus
tgccgtccttgggaggttctggctg

SEQ ID NO: 375805 - DNA, 25 bp, Mus musculus
tgccgtcgctagagttttcaggaag

SEQ ID NO: 375806 - DNA, 25 bp, Mus musculus
tgccgtgaaagaaaccggctctgaa

SEQ ID NO: 375807 - DNA, 25 bp, Mus musculus
tgccgtgaaaggctcagcggctgca

SEQ ID NO: 375808 - DNA, 25 bp, Mus musculus
tgccgtgacgcatgatctttcttcc

SEQ ID NO: 375809 - DNA, 25 bp, Mus musculus
tgccgtgacggttgcaggccgagta

SEQ ID NO: 375810 - DNA, 25 bp, Mus musculus
tgccgtgcactgggttaaaaacgac

SEQ ID NO: 375811 - DNA, 25 bp, Mus musculus
tgccgtgcaggcagccagctccaat

SEQ ID NO: 375812 - DNA, 25 bp, Mus musculus
tgccgtggaggaccccagcagcatc

SEQ ID NO: 375813 - DNA, 25 bp, Mus musculus
tgccgtgtgacgcagtgggccatga

SEQ ID NO: 375814 - DNA, 25 bp, Mus musculus
tgccgtgtgagttctgtggggtgca

SEQ ID NO: 375815 - DNA, 25 bp, Mus musculus
tgccgtgtgtctgcccatcgtgtcc

SEQ ID NO: 375816 - DNA, 25 bp, Mus musculus
tgccgtgttagatgagaaccacagt

SEQ ID NO: 375817 - DNA, 25 bp, Mus musculus
tgccgtgttagtccctataaccggt

SEQ ID NO: 375818 - DNA, 25 bp, Mus musculus
tgccgttaaacctgaagaatcacta

SEQ ID NO: 375819 - DNA, 25 bp, Mus musculus
tgccgttaaatgtgggaacttcgca

SEQ ID NO: 375820 - DNA, 25 bp, Mus musculus
tgccgttcttagccgatctctgaga

SEQ ID NO: 375821 - DNA, 25 bp, Mus musculus
tgccgttcttagccggtaccagacg

SEQ ID NO: 375822 - DNA, 25 bp, Mus musculus
tgccgttcttagccggtccttcagt

SEQ ID NO: 375823 - DNA, 25 bp, Mus musculus
tgccgttgactgtgtactcgatttc

SEQ ID NO: 375824 - DNA, 25 bp, Mus musculus
tgccgttgcaagatcgatgatgaaa

SEQ ID NO: 375825 - DNA, 25 bp, Mus musculus
tgccgttttgagaagattgctgcat

SEQ ID NO: 375826 - DNA, 25 bp, Mus musculus
tgccgttttgaggctttggagaaga

SEQ ID NO: 375827 - DNA, 25 bp, Mus musculus
tgcctaacaagtggtggaccaagca

SEQ ID NO: 375828 - DNA, 25 bp, Mus musculus
tgcctaacaggtcgctgttattcct

SEQ ID NO: 375829 - DNA, 25 bp, Mus musculus
tgcctaactttcagttcaaaccgga

SEQ ID NO: 375830 - DNA, 25 bp, Mus musculus
tgcctaagaatggctcttaccgccc

SEQ ID NO: 375831 - DNA, 25 bp, Mus musculus
tgcctaagaatgggatgcctggaac

SEQ ID NO: 375832 - DNA, 25 bp, Mus musculus
tgcctaagccagatctcaaagccat

SEQ ID NO: 375833 - DNA, 25 bp, Mus musculus
tgcctaatgaccaagccttagggtc

SEQ ID NO: 375834 - DNA, 25 bp, Mus musculus
tgcctaatttggctgagtatgagtt

SEQ ID NO: 375835 - DNA, 25 bp, Mus musculus
tgcctacaaacctggtctgaagcag

SEQ ID NO: 375836 - DNA, 25 bp, Mus musculus
tgcctacaaacctgtcgacttaaaa

SEQ ID NO: 375837 - DNA, 25 bp, Mus musculus
tgcctacactctagatggagtggat

SEQ ID NO: 375838 - DNA, 25 bp, Mus musculus
tgcctacagtgacagaaatcagttc

SEQ ID NO: 375839 - DNA, 25 bp, Mus musculus
tgcctacagtgacagttacggacga

SEQ ID NO: 375840 - DNA, 25 bp, Mus musculus
tgcctacatctggtagtttacaaga

SEQ ID NO: 375841 - DNA, 25 bp, Mus musculus
tgcctacattaatgattccattggc

SEQ ID NO: 375842 - DNA, 25 bp, Mus musculus
tgcctacattaatgctaccgtcttg

SEQ ID NO: 375843 - DNA, 25 bp, Mus musculus
tgcctaccagatatgaaagatcatg

SEQ ID NO: 375844 - DNA, 25 bp, Mus musculus
tgcctaccaggtgcagagcccctct

SEQ ID NO: 375845 - DNA, 25 bp, Mus musculus
tgcctaccaggtgctgaggatcaaa

SEQ ID NO: 375846 - DNA, 25 bp, Mus musculus
tgcctaccaggtggcaaaggaaacc

SEQ ID NO: 375847 - DNA, 25 bp, Mus musculus
tgcctaccaggtgtccgtaaatgga

SEQ ID NO: 375848 - DNA, 25 bp, Mus musculus
tgcctaccccaaaaattatggaccc

SEQ ID NO: 375849 - DNA, 25 bp, Mus musculus
tgcctaccctgaggaagctggaagg

SEQ ID NO: 375850 - DNA, 25 bp, Mus musculus
tgcctaccgtgccagcccccatgca

SEQ ID NO: 375851 - DNA, 25 bp, Mus musculus
tgcctaccgtgcttgccattcccct

SEQ ID NO: 375852 - DNA, 25 bp, Mus musculus
tgcctaccttcaaggcctgcacgct

SEQ ID NO: 375853 - DNA, 25 bp, Mus musculus
tgcctacggacaggatcgagagctg

SEQ ID NO: 375854 - DNA, 25 bp, Mus musculus
tgcctactacaacctggactgcagt

SEQ ID NO: 375855 - DNA, 25 bp, Mus musculus
tgcctactacaacctggcgtgacgg

SEQ ID NO: 375856 - DNA, 25 bp, Mus musculus
tgcctactacaaccttgcggagtgt

SEQ ID NO: 375857 - DNA, 25 bp, Mus musculus
tgcctactacagagtgatgctgagg

SEQ ID NO: 375858 - DNA, 25 bp, Mus musculus
tgcctactacagagttggtgaatat

SEQ ID NO: 375859 - DNA, 25 bp, Mus musculus
tgcctactgggcaaggtggtttggg

SEQ ID NO: 375860 - DNA, 25 bp, Mus musculus
tgcctactggggaaggagaagctga

SEQ ID NO: 375861 - DNA, 25 bp, Mus musculus
tgcctagaagagtggttcttcgagt

SEQ ID NO: 375862 - DNA, 25 bp, Mus musculus
tgcctagaaggggcaatgtcatcat

SEQ ID NO: 375863 - DNA, 25 bp, Mus musculus
tgcctagcgccgagagatagtgctg

SEQ ID NO: 375864 - DNA, 25 bp, Mus musculus
tgcctagcgccgagagattggagaa

SEQ ID NO: 375865 - DNA, 25 bp, Mus musculus
tgcctagcttctgaagttgtaatga

SEQ ID NO: 375866 - DNA, 25 bp, Mus musculus
tgcctagctttgtatagtccagatg

SEQ ID NO: 375867 - DNA, 25 bp, Mus musculus
tgcctagtcgaagcccagagaagaa

SEQ ID NO: 375868 - DNA, 25 bp, Mus musculus
tgcctagtcgaagtgcccccctcct

SEQ ID NO: 375869 - DNA, 25 bp, Mus musculus
tgcctagtgagtttacaggctggtg

SEQ ID NO: 375870 - DNA, 25 bp, Mus musculus
tgcctatactagtgagcatcagatg

SEQ ID NO: 375871 - DNA, 25 bp, Mus musculus
tgcctatatgaggttggcgcatcct

SEQ ID NO: 375872 - DNA, 25 bp, Mus musculus
tgcctatcaggaaaggactcagctt

SEQ ID NO: 375873 - DNA, 25 bp, Mus musculus
tgcctatccagaccctcctcccaga

SEQ ID NO: 375874 - DNA, 25 bp, Mus musculus
tgcctatcctacagggaaatgcata

SEQ ID NO: 375875 - DNA, 25 bp, Mus musculus
tgcctatgatgtgagagaacaagag

SEQ ID NO: 375876 - DNA, 25 bp, Mus musculus
tgcctatgcaacccccagtccccag

SEQ ID NO: 375877 - DNA, 25 bp, Mus musculus
tgcctatgcaagactcatttcacct

SEQ ID NO: 375878 - DNA, 25 bp, Mus musculus
tgcctatggagggaggagtgatggg

SEQ ID NO: 375879 - DNA, 25 bp, Mus musculus
tgcctatggaggggtggacaaatcc

SEQ ID NO: 375880 - DNA, 25 bp, Mus musculus
tgcctatggatgccctcttggcttc

SEQ ID NO: 375881 - DNA, 25 bp, Mus musculus
tgcctatgggggaaggtgacgccat

SEQ ID NO: 375882 - DNA, 25 bp, Mus musculus
tgcctattcaagatctgcacgtttc

SEQ ID NO: 375883 - DNA, 25 bp, Mus musculus
tgcctattgtgaggaactaatgacc

SEQ ID NO: 375884 - DNA, 25 bp, Mus musculus
tgcctcaaagctcattggctaagca

SEQ ID NO: 375885 - DNA, 25 bp, Mus musculus
tgcctcacaagggactcatgcagtg

SEQ ID NO: 375886 - DNA, 25 bp, Mus musculus
tgcctcacaggtggataccttggct

SEQ ID NO: 375887 - DNA, 25 bp, Mus musculus
tgcctcacctgctccaggtttcctt

SEQ ID NO: 375888 - DNA, 25 bp, Mus musculus
tgcctcacctgggtgctacagaaga

SEQ ID NO: 375889 - DNA, 25 bp, Mus musculus
tgcctcaccttgctgtgccctcacg

SEQ ID NO: 375890 - DNA, 25 bp, Mus musculus
tgcctcagaaaagagctctgtcttc

SEQ ID NO: 375891 - DNA, 25 bp, Mus musculus
tgcctcagagaacatgagctgtggt

SEQ ID NO: 375892 - DNA, 25 bp, Mus musculus
tgcctcagagcacctacgcttggaa

SEQ ID NO: 375893 - DNA, 25 bp, Mus musculus
tgcctcagaggtggaagaagagaag

SEQ ID NO: 375894 - DNA, 25 bp, Mus musculus
tgcctcagcagccaatggaaacgat

SEQ ID NO: 375895 - DNA, 25 bp, Mus musculus
tgcctcagcagggctgccctttgga

SEQ ID NO: 375896 - DNA, 25 bp, Mus musculus
tgcctcagcatccgcctgatctctc

SEQ ID NO: 375897 - DNA, 25 bp, Mus musculus
tgcctcagtgaagaaactgacgctc

SEQ ID NO: 375898 - DNA, 25 bp, Mus musculus
tgcctcagtgcttctacctggcaga

SEQ ID NO: 375899 - DNA, 25 bp, Mus musculus
tgcctcagtggtgggttttttcagg

SEQ ID NO: 375900 - DNA, 25 bp, Mus musculus
tgcctcagtggtggtgagctcttca

SEQ ID NO: 375901 - DNA, 25 bp, Mus musculus
tgcctcagtgtcagggagtgttcct

SEQ ID NO: 375902 - DNA, 25 bp, Mus musculus
tgcctcagtgtcagtgattcgggta

SEQ ID NO: 375903 - DNA, 25 bp, Mus musculus
tgcctcagtgtggcctcccctggtt

SEQ ID NO: 375904 - DNA, 25 bp, Mus musculus
tgcctcagttgccgattgctgttct

SEQ ID NO: 375905 - DNA, 25 bp, Mus musculus
tgcctcagtttcagctcttggataa

SEQ ID NO: 375906 - DNA, 25 bp, Mus musculus
tgcctcagtttctgctcttggataa

SEQ ID NO: 375907 - DNA, 25 bp, Mus musculus
tgcctcatctgcatggactcttact

SEQ ID NO: 375908 - DNA, 25 bp, Mus musculus
tgcctcatcttcaaggccacaggac

SEQ ID NO: 375909 - DNA, 25 bp, Mus musculus
tgcctcatcttttgctggaatttat

SEQ ID NO: 375910 - DNA, 25 bp, Mus musculus
tgcctcatggcacaggagcttgaag

SEQ ID NO: 375911 - DNA, 25 bp, Mus musculus
tgcctccaagcccagcatgtgaggg

SEQ ID NO: 375912 - DNA, 25 bp, Mus musculus
tgcctccaagcccaggtaactgttc

SEQ ID NO: 375913 - DNA, 25 bp, Mus musculus
tgcctccaagggttcccgtgagaac

SEQ ID NO: 375914 - DNA, 25 bp, Mus musculus
tgcctccaagtccagagtcccggcc

SEQ ID NO: 375915 - DNA, 25 bp, Mus musculus
tgcctccactcaggtctgggaacgt

SEQ ID NO: 375916 - DNA, 25 bp, Mus musculus
tgcctccactccagctggtggctgg

SEQ ID NO: 375917 - DNA, 25 bp, Mus musculus
tgcctccagatgccttacagcacat

SEQ ID NO: 375918 - DNA, 25 bp, Mus musculus
tgcctccaggctgaagaaggacccc

SEQ ID NO: 375919 - DNA, 25 bp, Mus musculus
tgcctcccaaggttgttaaacatga

SEQ ID NO: 375920 - DNA, 25 bp, Mus musculus
tgcctcccagatacccagaaatgga

SEQ ID NO: 375921 - DNA, 25 bp, Mus musculus
tgcctccctcacagaccaagtctga

SEQ ID NO: 375922 - DNA, 25 bp, Mus musculus
tgcctccctccctggcagggggagg

SEQ ID NO: 375923 - DNA, 25 bp, Mus musculus
tgcctccctgagactctttgctgat

SEQ ID NO: 375924 - DNA, 25 bp, Mus musculus
tgcctccctgagcctccatgtactc

SEQ ID NO: 375925 - DNA, 25 bp, Mus musculus
tgcctccgcaaaaggttcgaacctt

SEQ ID NO: 375926 - DNA, 25 bp, Mus musculus
tgcctccgcaaaaggttggaagcaa

SEQ ID NO: 375927 - DNA, 25 bp, Mus musculus
tgcctccgcaccaacgttttgagga

SEQ ID NO: 375928 - DNA, 25 bp, Mus musculus
tgcctccgcttccgtgatgtgctaa

SEQ ID NO: 375929 - DNA, 25 bp, Mus musculus
tgcctccgggtaaagaggtgtatgc

SEQ ID NO: 375930 - DNA, 25 bp, Mus musculus
tgcctccgtgctgggggcagaatcc

SEQ ID NO: 375931 - DNA, 25 bp, Mus musculus
tgcctcctagatgccctttgaagcg

SEQ ID NO: 375932 - DNA, 25 bp, Mus musculus
tgcctcctcaagagctttcatcatt

SEQ ID NO: 375933 - DNA, 25 bp, Mus musculus
tgcctcctcaaggttggctcaaaaa

SEQ ID NO: 375934 - DNA, 25 bp, Mus musculus
tgcctcctcccccaggcttcagcac

SEQ ID NO: 375935 - DNA, 25 bp, Mus musculus
tgcctcctggcagcctggtgatcct

SEQ ID NO: 375936 - DNA, 25 bp, Mus musculus
tgcctccttaagggtcttgagacca

SEQ ID NO: 375937 - DNA, 25 bp, Mus musculus
tgcctccttcagatgacggattcca

SEQ ID NO: 375938 - DNA, 25 bp, Mus musculus
tgcctcctttcaggatgctgtgcgc

SEQ ID NO: 375939 - DNA, 25 bp, Mus musculus
tgcctcgaatacgaaaatggatcga

SEQ ID NO: 375940 - DNA, 25 bp, Mus musculus
tgcctcgatgccctggtcgtgtgcc

SEQ ID NO: 375941 - DNA, 25 bp, Mus musculus
tgcctcgcaaagagttataccctga

SEQ ID NO: 375942 - DNA, 25 bp, Mus musculus
tgcctcgccgtctggggcctcattt

SEQ ID NO: 375943 - DNA, 25 bp, Mus musculus
tgcctcggagcagagcgatcagcag

SEQ ID NO: 375944 - DNA, 25 bp, Mus musculus
tgcctcggagtttcagcctcaactg

SEQ ID NO: 375945 - DNA, 25 bp, Mus musculus
tgcctcggcccagcacagcccccca

SEQ ID NO: 375946 - DNA, 25 bp, Mus musculus
tgcctcggcgcggatgtggttagaa

SEQ ID NO: 375947 - DNA, 25 bp, Mus musculus
tgcctcggcggtgttcacctacaag

SEQ ID NO: 375948 - DNA, 25 bp, Mus musculus
tgcctcggtgctggcgccggagtac

SEQ ID NO: 375949 - DNA, 25 bp, Mus musculus
tgcctcggttcctgtaaagctggtg

SEQ ID NO: 375950 - DNA, 25 bp, Mus musculus
tgcctcgtacgggtattcccagggc

SEQ ID NO: 375951 - DNA, 25 bp, Mus musculus
tgcctcgtcatctgggagggcattg

SEQ ID NO: 375952 - DNA, 25 bp, Mus musculus
tgcctcgtcatgcacaccaagatga

SEQ ID NO: 375953 - DNA, 25 bp, Mus musculus
tgcctcgtgtctttggctaattctg

SEQ ID NO: 375954 - DNA, 25 bp, Mus musculus
tgcctcgtgtctttgtaaagtcggg

SEQ ID NO: 375955 - DNA, 25 bp, Mus musculus
tgcctctaaaaacccacaactcctt

SEQ ID NO: 375956 - DNA, 25 bp, Mus musculus
tgcctctaaaaagccacaactcctt

SEQ ID NO: 375957 - DNA, 25 bp, Mus musculus
tgcctctaagatctcaggatggacc

SEQ ID NO: 375958 - DNA, 25 bp, Mus musculus
tgcctctatggcggaacctaaggaa

SEQ ID NO: 375959 - DNA, 25 bp, Mus musculus
tgcctctatggcggatcctgtctct

SEQ ID NO: 375960 - DNA, 25 bp, Mus musculus
tgcctctcaaatgaacctctagtct

SEQ ID NO: 375961 - DNA, 25 bp, Mus musculus
tgcctctcacagaatacatccagcc

SEQ ID NO: 375962 - DNA, 25 bp, Mus musculus
tgcctctcctctatgctcctttcct

SEQ ID NO: 375963 - DNA, 25 bp, Mus musculus
tgcctctcctctatggctcagcact

SEQ ID NO: 375964 - DNA, 25 bp, Mus musculus
tgcctctcttggaattaaaggacat

SEQ ID NO: 375965 - DNA, 25 bp, Mus musculus
tgcctctgaaacccgctgtacgctg

SEQ ID NO: 375966 - DNA, 25 bp, Mus musculus
tgcctctgaaacccggtagtgcaac

SEQ ID NO: 375967 - DNA, 25 bp, Mus musculus
tgcctctgaagcaggcagcacccga

SEQ ID NO: 375968 - DNA, 25 bp, Mus musculus
tgcctctgagaaggtctgcgaatgg

SEQ ID NO: 375969 - DNA, 25 bp, Mus musculus
tgcctctgatgctggctggggacat

SEQ ID NO: 375970 - DNA, 25 bp, Mus musculus
tgcctctggacagcggaggctgctg

SEQ ID NO: 375971 - DNA, 25 bp, Mus musculus
tgcctctggcgggatggactcctgt

SEQ ID NO: 375972 - DNA, 25 bp, Mus musculus
tgcctctggcggggctgcagtatgg

SEQ ID NO: 375973 - DNA, 25 bp, Mus musculus
tgcctctgtgtctcactaatgctca

SEQ ID NO: 375974 - DNA, 25 bp, Mus musculus
tgcctctgtgtctcgtttaaaaagc

SEQ ID NO: 375975 - DNA, 25 bp, Mus musculus
tgcctctgttaccgtaaagccttgg

SEQ ID NO: 375976 - DNA, 25 bp, Mus musculus
tgcctcttaaagaaaaatcaagaac

SEQ ID NO: 375977 - DNA, 25 bp, Mus musculus
tgcctcttacgtgtgttctcagggg

SEQ ID NO: 375978 - DNA, 25 bp, Mus musculus
tgcctcttatgaaggtctacggctt

SEQ ID NO: 375979 - DNA, 25 bp, Mus musculus
tgcctcttccaaggaatttgaaatc

SEQ ID NO: 375980 - DNA, 25 bp, Mus musculus
tgcctcttccaaggagtgccggtgc

SEQ ID NO: 375981 - DNA, 25 bp, Mus musculus
tgcctcttcgaacggcacccaccag

SEQ ID NO: 375982 - DNA, 25 bp, Mus musculus
tgcctcttctagtctcaacagatca

SEQ ID NO: 375983 - DNA, 25 bp, Mus musculus
tgcctcttgaagaagtggatgacct

SEQ ID NO: 375984 - DNA, 25 bp, Mus musculus
tgcctcttgaagtcagtttcagagg

SEQ ID NO: 375985 - DNA, 25 bp, Mus musculus
tgcctcttgccatgctggccgaggc

SEQ ID NO: 375986 - DNA, 25 bp, Mus musculus
tgcctgaaaaagaggcggcgggcca

SEQ ID NO: 375987 - DNA, 25 bp, Mus musculus
tgcctgaaaaaggtactgttggatg

SEQ ID NO: 375988 - DNA, 25 bp, Mus musculus
tgcctgaaaggttgcaggaatcctt

SEQ ID NO: 375989 - DNA, 25 bp, Mus musculus
tgcctgaacaagatgcactcccatc

SEQ ID NO: 375990 - DNA, 25 bp, Mus musculus
tgcctgaacaagctcagccctgggg

SEQ ID NO: 375991 - DNA, 25 bp, Mus musculus
tgcctgaacaaggctcttcctcctg

SEQ ID NO: 375992 - DNA, 25 bp, Mus musculus
tgcctgaagagaagccttccagcac

SEQ ID NO: 375993 - DNA, 25 bp, Mus musculus
tgcctgaatcgcccaagagcctaca

SEQ ID NO: 375994 - DNA, 25 bp, Mus musculus
tgcctgacaaattgacatcagcaaa

SEQ ID NO: 375995 - DNA, 25 bp, Mus musculus
tgcctgacaattggcagcttcagtt

SEQ ID NO: 375996 - DNA, 25 bp, Mus musculus
tgcctgacaccgatggcagactttc

SEQ ID NO: 375997 - DNA, 25 bp, Mus musculus
tgcctgacagctggctgaagggaga

SEQ ID NO: 375998 - DNA, 25 bp, Mus musculus
tgcctgaccccgaagcttgatggtg

SEQ ID NO: 375999 - DNA, 25 bp, Mus musculus
tgcctgaccccgaagttgatgaaac

SEQ ID NO: 376000 - DNA, 25 bp, Mus musculus
tgcctgactcagaacaggtgagaac

SEQ ID NO: 376001 - DNA, 25 bp, Mus musculus
tgcctgactcagactggttgggcgc

SEQ ID NO: 376002 - DNA, 25 bp, Mus musculus
tgcctgactcaggcaggccagcttt

SEQ ID NO: 376003 - DNA, 25 bp, Mus musculus
tgcctgactcaggtaggcctgtcaa

SEQ ID NO: 376004 - DNA, 25 bp, Mus musculus
tgcctgactcgctcggaagctgtcc

SEQ ID NO: 376005 - DNA, 25 bp, Mus musculus
tgcctgacttcccaggagctgatgc

SEQ ID NO: 376006 - DNA, 25 bp, Mus musculus
tgcctgagaagctcaaacaggccga

SEQ ID NO: 376007 - DNA, 25 bp, Mus musculus
tgcctgagaggcgtccccattcctg

SEQ ID NO: 376008 - DNA, 25 bp, Mus musculus
tgcctgagagtgaaataaagaaaga

SEQ ID NO: 376009 - DNA, 25 bp, Mus musculus
tgcctgagcggaggactggctaccc

SEQ ID NO: 376010 - DNA, 25 bp, Mus musculus
tgcctgagcgggctagctgtggagg

SEQ ID NO: 376011 - DNA, 25 bp, Mus musculus
tgcctgaggaggattcagaatttcc

SEQ ID NO: 376012 - DNA, 25 bp, Mus musculus
tgcctgagtgccagtgcccgcccca

SEQ ID NO: 376013 - DNA, 25 bp, Mus musculus
tgcctgagtgcgcaagcaaaagaaa

SEQ ID NO: 376014 - DNA, 25 bp, Mus musculus
tgcctgagtgcgcgtggaacctagg

SEQ ID NO: 376015 - DNA, 25 bp, Mus musculus
tgcctgatctttaggaggagcaggc

SEQ ID NO: 376016 - DNA, 25 bp, Mus musculus
tgcctgatgcctccgctggaaacca

SEQ ID NO: 376017 - DNA, 25 bp, Mus musculus
tgcctgatgctgcctcacacaagaa

SEQ ID NO: 376018 - DNA, 25 bp, Mus musculus
tgcctgatgtatgaggcttcctgcg

SEQ ID NO: 376019 - DNA, 25 bp, Mus musculus
tgcctgcacgcaaggtggccgaagg

SEQ ID NO: 376020 - DNA, 25 bp, Mus musculus
tgcctgcactggcacacaggcattt

SEQ ID NO: 376021 - DNA, 25 bp, Mus musculus
tgcctgcagaatcggccagcgcccg

SEQ ID NO: 376022 - DNA, 25 bp, Mus musculus
tgcctgcagtggatacattgttgca

SEQ ID NO: 376023 - DNA, 25 bp, Mus musculus
tgcctgcagtgtgcaatggtgctcc

SEQ ID NO: 376024 - DNA, 25 bp, Mus musculus
tgcctgcagttccacaggctcaggg

SEQ ID NO: 376025 - DNA, 25 bp, Mus musculus
tgcctgcataaggttataagtacat

SEQ ID NO: 376026 - DNA, 25 bp, Mus musculus
tgcctgcataagtgagcaactgttc

SEQ ID NO: 376027 - DNA, 25 bp, Mus musculus
tgcctgcatctacctttgcagatca

SEQ ID NO: 376028 - DNA, 25 bp, Mus musculus
tgcctgcatctgtctcttaaccttc

SEQ ID NO: 376029 - DNA, 25 bp, Mus musculus
tgcctgccagctgagaagccattct

SEQ ID NO: 376030 - DNA, 25 bp, Mus musculus
tgcctgccaggattttaccggaaga

SEQ ID NO: 376031 - DNA, 25 bp, Mus musculus
tgcctgccaggtgagaagccattct

SEQ ID NO: 376032 - DNA, 25 bp, Mus musculus
tgcctgccatgagacgaaagtaggt

SEQ ID NO: 376033 - DNA, 25 bp, Mus musculus
tgcctgccatgaggaattcttctac

SEQ ID NO: 376034 - DNA, 25 bp, Mus musculus
tgcctgccattgctgctctgacagt

SEQ ID NO: 376035 - DNA, 25 bp, Mus musculus
tgcctgccattgctgctgacaagga

SEQ ID NO: 376036 - DNA, 25 bp, Mus musculus
tgcctgccattgctgctgattactc

SEQ ID NO: 376037 - DNA, 25 bp, Mus musculus
tgcctgccgagcaatgccaagtgag

SEQ ID NO: 376038 - DNA, 25 bp, Mus musculus
tgcctgcctcacaagggactcatgc

SEQ ID NO: 376039 - DNA, 25 bp, Mus musculus
tgcctgcctgcagccactacctcct

SEQ ID NO: 376040 - DNA, 25 bp, Mus musculus
tgcctgccttgaggacgggcagaac

SEQ ID NO: 376041 - DNA, 25 bp, Mus musculus
tgcctgccttgaggctggctactgt

SEQ ID NO: 376042 - DNA, 25 bp, Mus musculus
tgcctgcggccaggaggtggcttac

SEQ ID NO: 376043 - DNA, 25 bp, Mus musculus
tgcctgctacagaggttgcaagtgt

SEQ ID NO: 376044 - DNA, 25 bp, Mus musculus
tgcctgctataaagaaactacataa

SEQ ID NO: 376045 - DNA, 25 bp, Mus musculus
tgcctgctataaaggacttagaagt

SEQ ID NO: 376046 - DNA, 25 bp, Mus musculus
tgcctgctatgagaaactccccaac

SEQ ID NO: 376047 - DNA, 25 bp, Mus musculus
tgcctgctgagcaagcgttttggtg

SEQ ID NO: 376048 - DNA, 25 bp, Mus musculus
tgcctgctgcaaagcctgcctgggg

SEQ ID NO: 376049 - DNA, 25 bp, Mus musculus
tgcctgctgctcacacacacacaca

SEQ ID NO: 376050 - DNA, 25 bp, Mus musculus
tgcctgctggaagtctctaataaag

SEQ ID NO: 376051 - DNA, 25 bp, Mus musculus
tgcctgcttctcggttcagcatggg

SEQ ID NO: 376052 - DNA, 25 bp, Mus musculus
tgcctgcttctggagggtgatgccc

SEQ ID NO: 376053 - DNA, 25 bp, Mus musculus
tgcctggaacccatcagatcttccc

SEQ ID NO: 376054 - DNA, 25 bp, Mus musculus
tgcctggaaggttgagattgagaag

SEQ ID NO: 376055 - DNA, 25 bp, Mus musculus
tgcctggaatctgcgacccatacgt

SEQ ID NO: 376056 - DNA, 25 bp, Mus musculus
tgcctggacagaaatatcttgagcc

SEQ ID NO: 376057 - DNA, 25 bp, Mus musculus
tgcctggacagcattgccgccacca

SEQ ID NO: 376058 - DNA, 25 bp, Mus musculus
tgcctggacaggggctctttagagc

SEQ ID NO: 376059 - DNA, 25 bp, Mus musculus
tgcctggaccactggcagcattagc

SEQ ID NO: 376060 - DNA, 25 bp, Mus musculus
tgcctggaccgcagaggagagcccc

SEQ ID NO: 376061 - DNA, 25 bp, Mus musculus
tgcctggacctcctcccatctcttc

SEQ ID NO: 376062 - DNA, 25 bp, Mus musculus
tgcctggagaatagctcctgtatca

SEQ ID NO: 376063 - DNA, 25 bp, Mus musculus
tgcctggagttgcagctgttccatc

SEQ ID NO: 376064 - DNA, 25 bp, Mus musculus
tgcctggatcaggaagcatatattc

SEQ ID NO: 376065 - DNA, 25 bp, Mus musculus
tgcctggatctggagcctgatctct

SEQ ID NO: 376066 - DNA, 25 bp, Mus musculus
tgcctggatgagagggtttaccagc

SEQ ID NO: 376067 - DNA, 25 bp, Mus musculus
tgcctggcacaaggtgatagaggga

SEQ ID NO: 376068 - DNA, 25 bp, Mus musculus
tgcctggcacagaagccttcaggga

SEQ ID NO: 376069 - DNA, 25 bp, Mus musculus
tgcctggcacagtagccttcaggga

SEQ ID NO: 376070 - DNA, 25 bp, Mus musculus
tgcctggccccatgggtccttctgg

SEQ ID NO: 376071 - DNA, 25 bp, Mus musculus
tgcctggccccccgggcgatggcat

SEQ ID NO: 376072 - DNA, 25 bp, Mus musculus
tgcctggcccggaagatgcaagcca

SEQ ID NO: 376073 - DNA, 25 bp, Mus musculus
tgcctggcccggtcacagcaaactg

SEQ ID NO: 376074 - DNA, 25 bp, Mus musculus
tgcctggccctccgggtccttctgg

SEQ ID NO: 376075 - DNA, 25 bp, Mus musculus
tgcctggcgccccacagcttgagga

SEQ ID NO: 376076 - DNA, 25 bp, Mus musculus
tgcctggcggcttaaaaggcagtat

SEQ ID NO: 376077 - DNA, 25 bp, Mus musculus
tgcctggctaagagggaaggctcct

SEQ ID NO: 376078 - DNA, 25 bp, Mus musculus
tgcctggctcacctctgctattgta

SEQ ID NO: 376079 - DNA, 25 bp, Mus musculus
tgcctgggaggccatggaggaactg

SEQ ID NO: 376080 - DNA, 25 bp, Mus musculus
tgcctgggatgcgccgcagcacctc

SEQ ID NO: 376081 - DNA, 25 bp, Mus musculus
tgcctgggattttcctggtctggag

SEQ ID NO: 376082 - DNA, 25 bp, Mus musculus
tgcctgggcaaaggggggctcctgg

SEQ ID NO: 376083 - DNA, 25 bp, Mus musculus
tgcctgggcacacaggccagcggtg

SEQ ID NO: 376084 - DNA, 25 bp, Mus musculus
tgcctgggcacacagggttttgaag

SEQ ID NO: 376085 - DNA, 25 bp, Mus musculus
tgcctgggccacagggacttggatg

SEQ ID NO: 376086 - DNA, 25 bp, Mus musculus
tgcctgggcgcaggaagatttggaa

SEQ ID NO: 376087 - DNA, 25 bp, Mus musculus
tgcctggggaagactcaagggcaaa

SEQ ID NO: 376088 - DNA, 25 bp, Mus musculus
tgcctggggaaggtgactttccagt

SEQ ID NO: 376089 - DNA, 25 bp, Mus musculus
tgcctgggtagcccgtgtcccatca

SEQ ID NO: 376090 - DNA, 25 bp, Mus musculus
tgcctgggtagcccgttacatcttc

SEQ ID NO: 376091 - DNA, 25 bp, Mus musculus
tgcctggtactaatggatagatgcc

SEQ ID NO: 376092 - DNA, 25 bp, Mus musculus
tgcctggtactaatgtgccagtatt

SEQ ID NO: 376093 - DNA, 25 bp, Mus musculus
tgcctggtatatgctcccggcaact

SEQ ID NO: 376094 - DNA, 25 bp, Mus musculus
tgcctggtcagtgtcagctggtcac

SEQ ID NO: 376095 - DNA, 25 bp, Mus musculus
tgcctggtggaaagacagctggaac

SEQ ID NO: 376096 - DNA, 25 bp, Mus musculus
tgcctggtggaagctccatggttat

SEQ ID NO: 376097 - DNA, 25 bp, Mus musculus
tgcctggtggaaggggagcaaactg

SEQ ID NO: 376098 - DNA, 25 bp, Mus musculus
tgcctggtggaggcggacctatgtg

SEQ ID NO: 376099 - DNA, 25 bp, Mus musculus
tgcctgtaacggagactctggtggc

SEQ ID NO: 376100 - DNA, 25 bp, Mus musculus
tgcctgtatgtgttgaggaggagag

SEQ ID NO: 376101 - DNA, 25 bp, Mus musculus
tgcctgtattggccttctgtatact

SEQ ID NO: 376102 - DNA, 25 bp, Mus musculus
tgcctgtcagcaaagttatttcgct

SEQ ID NO: 376103 - DNA, 25 bp, Mus musculus
tgcctgtcaggaccgaataaacctg

SEQ ID NO: 376104 - DNA, 25 bp, Mus musculus
tgcctgtcaggcttcctgcgggcac

SEQ ID NO: 376105 - DNA, 25 bp, Mus musculus
tgcctgtcagtcccaggtcctgccc

SEQ ID NO: 376106 - DNA, 25 bp, Mus musculus
tgcctgtcagtgaagctggctattt

SEQ ID NO: 376107 - DNA, 25 bp, Mus musculus
tgcctgtcatgaggaactcagaaat

SEQ ID NO: 376108 - DNA, 25 bp, Mus musculus
tgcctgtcatgaggaactcagccac

SEQ ID NO: 376109 - DNA, 25 bp, Mus musculus
tgcctgtccagacatcttcttctcc

SEQ ID NO: 376110 - DNA, 25 bp, Mus musculus
tgcctgtccagggatttggacattt

SEQ ID NO: 376111 - DNA, 25 bp, Mus musculus
tgcctgtcctggttgttcctcaaag

SEQ ID NO: 376112 - DNA, 25 bp, Mus musculus
tgcctgtctcagagagcctgggcac

SEQ ID NO: 376113 - DNA, 25 bp, Mus musculus
tgcctgtctgagccgctacagaacc

SEQ ID NO: 376114 - DNA, 25 bp, Mus musculus
tgcctgtctgcactggtgaccatgt

SEQ ID NO: 376115 - DNA, 25 bp, Mus musculus
tgcctgtctggaaacaacctgatca

SEQ ID NO: 376116 - DNA, 25 bp, Mus musculus
tgcctgtgactcaggattctctacc

SEQ ID NO: 376117 - DNA, 25 bp, Mus musculus
tgcctgtgagaaggccctggggaag

SEQ ID NO: 376118 - DNA, 25 bp, Mus musculus
tgcctgtgaggtttctgtttacaga

SEQ ID NO: 376119 - DNA, 25 bp, Mus musculus
tgcctgtgccagggtgtgagggtaa

SEQ ID NO: 376120 - DNA, 25 bp, Mus musculus
tgcctgtgccagtgttctttccagg

SEQ ID NO: 376121 - DNA, 25 bp, Mus musculus
tgcctgtgccctcggaaccaccatc

SEQ ID NO: 376122 - DNA, 25 bp, Mus musculus
tgcctgtgccggcctttaatgtgat

SEQ ID NO: 376123 - DNA, 25 bp, Mus musculus
tgcctgtgctagacagtgtgctcaa

SEQ ID NO: 376124 - DNA, 25 bp, Mus musculus
tgcctgtgctcaggggagaaaggcc

SEQ ID NO: 376125 - DNA, 25 bp, Mus musculus
tgcctgtgctcaggtaatggaaaag

SEQ ID NO: 376126 - DNA, 25 bp, Mus musculus
tgcctgtggatcaagtgtttgcaaa

SEQ ID NO: 376127 - DNA, 25 bp, Mus musculus
tgcctgtggggaaaaccagttgggt

SEQ ID NO: 376128 - DNA, 25 bp, Mus musculus
tgcctgtggggaaagcatctgaact

SEQ ID NO: 376129 - DNA, 25 bp, Mus musculus
tgcctgtgggtcgggcacattgcct

SEQ ID NO: 376130 - DNA, 25 bp, Mus musculus
tgcctgtgggtcggggaagagttgg

SEQ ID NO: 376131 - DNA, 25 bp, Mus musculus
tgcctgtgtcagatcgaaccttgtt

SEQ ID NO: 376132 - DNA, 25 bp, Mus musculus
tgcctgtgtgtctcagcctcagctt

SEQ ID NO: 376133 - DNA, 25 bp, Mus musculus
tgcctgttacaggtctgcagcatag

SEQ ID NO: 376134 - DNA, 25 bp, Mus musculus
tgcctgttcctaacactaatgagcg

SEQ ID NO: 376135 - DNA, 25 bp, Mus musculus
tgcctgttgctgctgttatttccga

SEQ ID NO: 376136 - DNA, 25 bp, Mus musculus
tgccttaaaaaagaatccatgccca

SEQ ID NO: 376137 - DNA, 25 bp, Mus musculus
tgccttaaaaaaggatgctcatgtg

SEQ ID NO: 376138 - DNA, 25 bp, Mus musculus
tgccttaaaagaaaccatggaatgg

SEQ ID NO: 376139 - DNA, 25 bp, Mus musculus
tgccttaagaaagaatgggaaacag

SEQ ID NO: 376140 - DNA, 25 bp, Mus musculus
tgccttacagacgtggctctttggt

SEQ ID NO: 376141 - DNA, 25 bp, Mus musculus
tgccttacccatatctgtcaggata

SEQ ID NO: 376142 - DNA, 25 bp, Mus musculus
tgccttacctccagaacccgctcag

SEQ ID NO: 376143 - DNA, 25 bp, Mus musculus
tgccttagccaagagctgtcccgac

SEQ ID NO: 376144 - DNA, 25 bp, Mus musculus
tgccttagtccgagccgccatgggc

SEQ ID NO: 376145 - DNA, 25 bp, Mus musculus
tgccttagtgggctgggtgggtgaa

SEQ ID NO: 376146 - DNA, 25 bp, Mus musculus
tgccttattcaaggcctggtgtgtg

SEQ ID NO: 376147 - DNA, 25 bp, Mus musculus
tgccttattcaaggggtgtggaata

SEQ ID NO: 376148 - DNA, 25 bp, Mus musculus
tgccttcaaaatgcgtttcaagcac

SEQ ID NO: 376149 - DNA, 25 bp, Mus musculus
tgccttcaaacgtgtttggacttat

SEQ ID NO: 376150 - DNA, 25 bp, Mus musculus
tgccttcaaagacctactgaaagcc

SEQ ID NO: 376151 - DNA, 25 bp, Mus musculus
tgccttcaacggaggtactgtattg

SEQ ID NO: 376152 - DNA, 25 bp, Mus musculus
tgccttcaagaaagatgtccttggc

SEQ ID NO: 376153 - DNA, 25 bp, Mus musculus
tgccttcacggcggagtgttcctgt

SEQ ID NO: 376154 - DNA, 25 bp, Mus musculus
tgccttcagacagaaaacgaagtcc

SEQ ID NO: 376155 - DNA, 25 bp, Mus musculus
tgccttcaggctttgcagggaccct

SEQ ID NO: 376156 - DNA, 25 bp, Mus musculus
tgccttccaaggaaacctctgccgc

SEQ ID NO: 376157 - DNA, 25 bp, Mus musculus
tgccttccaaggttgagagctgttg

SEQ ID NO: 376158 - DNA, 25 bp, Mus musculus
tgccttccagtgtgtggacagccct

SEQ ID NO: 376159 - DNA, 25 bp, Mus musculus
tgccttccagtgtgtggtgtcccca

SEQ ID NO: 376160 - DNA, 25 bp, Mus musculus
tgccttcccaccttcaaaactggtg

SEQ ID NO: 376161 - DNA, 25 bp, Mus musculus
tgccttcccagaagaaaacatgaat

SEQ ID NO: 376162 - DNA, 25 bp, Mus musculus
tgccttcccccttggttgcctctct

SEQ ID NO: 376163 - DNA, 25 bp, Mus musculus
tgccttccgagatgagacggcagtg

SEQ ID NO: 376164 - DNA, 25 bp, Mus musculus
tgccttccgagggcagtactgctat

SEQ ID NO: 376165 - DNA, 25 bp, Mus musculus
tgccttcctatgtagcactcagcat

SEQ ID NO: 376166 - DNA, 25 bp, Mus musculus
tgccttcctcaagcagtataattcg

SEQ ID NO: 376167 - DNA, 25 bp, Mus musculus
tgccttcctcaatcacctctcccag

SEQ ID NO: 376168 - DNA, 25 bp, Mus musculus
tgccttcctcaatcacttatcacag

SEQ ID NO: 376169 - DNA, 25 bp, Mus musculus
tgccttcctggattcaccggcgccc

SEQ ID NO: 376170 - DNA, 25 bp, Mus musculus
tgccttcctgtcgatccccagcctc

SEQ ID NO: 376171 - DNA, 25 bp, Mus musculus
tgccttcctgtgtgccctgctttcc

SEQ ID NO: 376172 - DNA, 25 bp, Mus musculus
tgccttcctgtgtggaacaacgaag

SEQ ID NO: 376173 - DNA, 25 bp, Mus musculus
tgccttctcaggaagtaaaccaggt

SEQ ID NO: 376174 - DNA, 25 bp, Mus musculus
tgccttctcaggaagttctgatcca

SEQ ID NO: 376175 - DNA, 25 bp, Mus musculus
tgccttctctgggttccctggacgt

SEQ ID NO: 376176 - DNA, 25 bp, Mus musculus
tgccttctgaaagacccggccatgc

SEQ ID NO: 376177 - DNA, 25 bp, Mus musculus
tgccttctgagttaatatgacagat

SEQ ID NO: 376178 - DNA, 25 bp, Mus musculus
tgccttctgagttattgcggaagca

SEQ ID NO: 376179 - DNA, 25 bp, Mus musculus
tgccttctgagttgtagttagcgcc

SEQ ID NO: 376180 - DNA, 25 bp, Mus musculus
tgccttctgagttttcctcttgctc

SEQ ID NO: 376181 - DNA, 25 bp, Mus musculus
tgccttctgggcattgaagatcggc

SEQ ID NO: 376182 - DNA, 25 bp, Mus musculus
tgccttcttactgtgtcctactgaa

SEQ ID NO: 376183 - DNA, 25 bp, Mus musculus
tgccttcttggagaggtaaccccag

SEQ ID NO: 376184 - DNA, 25 bp, Mus musculus
tgccttgaaagatttacaagggccc

SEQ ID NO: 376185 - DNA, 25 bp, Mus musculus
tgccttgaaagcccccaaaatagag

SEQ ID NO: 376186 - DNA, 25 bp, Mus musculus
tgccttgaaggaggggtcatctcca

SEQ ID NO: 376187 - DNA, 25 bp, Mus musculus
tgccttgagagtctatcaccactac

SEQ ID NO: 376188 - DNA, 25 bp, Mus musculus
tgccttgatatgtcgaccggaagaa

SEQ ID NO: 376189 - DNA, 25 bp, Mus musculus
tgccttgatgacagggtcccttgca

SEQ ID NO: 376190 - DNA, 25 bp, Mus musculus
tgccttgattggccctcctttttct

SEQ ID NO: 376191 - DNA, 25 bp, Mus musculus
tgccttgccttactcagacactgac

SEQ ID NO: 376192 - DNA, 25 bp, Mus musculus
tgccttgcggcgccggacaggatgt

SEQ ID NO: 376193 - DNA, 25 bp, Mus musculus
tgccttgcttaccctagaagccgtt

SEQ ID NO: 376194 - DNA, 25 bp, Mus musculus
tgccttggtaaatgatgtggcacca

SEQ ID NO: 376195 - DNA, 25 bp, Mus musculus
tgccttgtcacaaaggaagttgttc

SEQ ID NO: 376196 - DNA, 25 bp, Mus musculus
tgccttgtcaggggtgacacccctg

SEQ ID NO: 376197 - DNA, 25 bp, Mus musculus
tgccttgtgcctacttgagcatcga

SEQ ID NO: 376198 - DNA, 25 bp, Mus musculus
tgccttgtggaggaactacttcatc

SEQ ID NO: 376199 - DNA, 25 bp, Mus musculus
tgccttgtgtgttgaggatgggagt

SEQ ID NO: 376200 - DNA, 25 bp, Mus musculus
tgccttgttcaacagaacaagtaag

SEQ ID NO: 376201 - DNA, 25 bp, Mus musculus
tgccttgttcaacaggtttatggtc

SEQ ID NO: 376202 - DNA, 25 bp, Mus musculus
tgccttgttcaacagttgttggtct

SEQ ID NO: 376203 - DNA, 25 bp, Mus musculus
tgcctttaacccaggtgactcatat

SEQ ID NO: 376204 - DNA, 25 bp, Mus musculus
tgcctttactccagacaaatcgcca

SEQ ID NO: 376205 - DNA, 25 bp, Mus musculus
tgcctttactccagtgcctatgact

SEQ ID NO: 376206 - DNA, 25 bp, Mus musculus
tgcctttccattggacacccccgcg

SEQ ID NO: 376207 - DNA, 25 bp, Mus musculus
tgcctttccccggaggaattcgtgg

SEQ ID NO: 376208 - DNA, 25 bp, Mus musculus
tgcctttccgatacgttctggaccc

SEQ ID NO: 376209 - DNA, 25 bp, Mus musculus
tgcctttctggagaaaaacaaaatg

SEQ ID NO: 376210 - DNA, 25 bp, Mus musculus
tgcctttgaaacagacataatgaga

SEQ ID NO: 376211 - DNA, 25 bp, Mus musculus
tgcctttgaacatgattctgttact

SEQ ID NO: 376212 - DNA, 25 bp, Mus musculus
tgcctttgaagccaggtgtttggcc

SEQ ID NO: 376213 - DNA, 25 bp, Mus musculus
tgcctttgacaacagctacagtagg

SEQ ID NO: 376214 - DNA, 25 bp, Mus musculus
tgcctttgacaacaggggaggcact

SEQ ID NO: 376215 - DNA, 25 bp, Mus musculus
tgcctttgacgtcctattaccagct

SEQ ID NO: 376216 - DNA, 25 bp, Mus musculus
tgcctttgagaagcatgtggatggc

SEQ ID NO: 376217 - DNA, 25 bp, Mus musculus
tgcctttgaggatgacatgcacagg

SEQ ID NO: 376218 - DNA, 25 bp, Mus musculus
tgcctttgaggtcaatcttggaaag

SEQ ID NO: 376219 - DNA, 25 bp, Mus musculus
tgcctttgcacctgagaacccatca

SEQ ID NO: 376220 - DNA, 25 bp, Mus musculus
tgcctttgcaggtgacagcagcatg

SEQ ID NO: 376221 - DNA, 25 bp, Mus musculus
tgcctttggggatgtcgtcaccgtc

SEQ ID NO: 376222 - DNA, 25 bp, Mus musculus
tgccttttacaatgctcatgacctg

SEQ ID NO: 376223 - DNA, 25 bp, Mus musculus
tgccttttgacagccacacctgcgc

SEQ ID NO: 376224 - DNA, 25 bp, Mus musculus
tgccttttgtaacagttggatgaaa

SEQ ID NO: 376225 - DNA, 25 bp, Mus musculus
tgccttttgtcagggattcgataaa

SEQ ID NO: 376226 - DNA, 25 bp, Mus musculus
tgcgaaaaagggatgactgagtggg

SEQ ID NO: 376227 - DNA, 25 bp, Mus musculus
tgcgaaagaagactttaagaaacaa

SEQ ID NO: 376228 - DNA, 25 bp, Mus musculus
tgcgaaagagaacctgctcctccgc

SEQ ID NO: 376229 - DNA, 25 bp, Mus musculus
tgcgaaagagattacaggacaggcc

SEQ ID NO: 376230 - DNA, 25 bp, Mus musculus
tgcgaaagctcagcccagtgtcgtg

SEQ ID NO: 376231 - DNA, 25 bp, Mus musculus
tgcgaacaagccgtggcaaggagat

SEQ ID NO: 376232 - DNA, 25 bp, Mus musculus
tgcgaacaagccgtggcattaaaaa

SEQ ID NO: 376233 - DNA, 25 bp, Mus musculus
tgcgaacctggtagcctataacatt

SEQ ID NO: 376234 - DNA, 25 bp, Mus musculus
tgcgaagatagagatctggccgccc

SEQ ID NO: 376235 - DNA, 25 bp, Mus musculus
tgcgaagcagatttatggtctgcat

SEQ ID NO: 376236 - DNA, 25 bp, Mus musculus
tgcgaagcagggtgtgcagattata

SEQ ID NO: 376237 - DNA, 25 bp, Mus musculus
tgcgaagctcccgccatgagaattt

SEQ ID NO: 376238 - DNA, 25 bp, Mus musculus
tgcgaaggaagtactattactggac

SEQ ID NO: 376239 - DNA, 25 bp, Mus musculus
tgcgaaggtcaagcacccctattga

SEQ ID NO: 376240 - DNA, 25 bp, Mus musculus
tgcgaaggtcaaggccacaggcctc

SEQ ID NO: 376241 - DNA, 25 bp, Mus musculus
tgcgaagtcttcgtgggacctcgca

SEQ ID NO: 376242 - DNA, 25 bp, Mus musculus
tgcgaatcggagccccagatcctgt

SEQ ID NO: 376243 - DNA, 25 bp, Mus musculus
tgcgaatggaaggagagtccagatt

SEQ ID NO: 376244 - DNA, 25 bp, Mus musculus
tgcgacaacagatggagaagtcttt

SEQ ID NO: 376245 - DNA, 25 bp, Mus musculus
tgcgacaaggaaacttatggaacga

SEQ ID NO: 376246 - DNA, 25 bp, Mus musculus
tgcgacaagggtgactattatatgg

SEQ ID NO: 376247 - DNA, 25 bp, Mus musculus
tgcgacaaggtccgcagatgcactt

SEQ ID NO: 376248 - DNA, 25 bp, Mus musculus
tgcgacagattggttctaggtctta

SEQ ID NO: 376249 - DNA, 25 bp, Mus musculus
tgcgaccaacagaaaacaagcacga

SEQ ID NO: 376250 - DNA, 25 bp, Mus musculus
tgcgaccaacagattcctgttgcgt

SEQ ID NO: 376251 - DNA, 25 bp, Mus musculus
tgcgaccaatgagggagagcccatg

SEQ ID NO: 376252 - DNA, 25 bp, Mus musculus
tgcgacccagccattcattgagaag

SEQ ID NO: 376253 - DNA, 25 bp, Mus musculus
tgcgacccaggtgcctggctgcagc

SEQ ID NO: 376254 - DNA, 25 bp, Mus musculus
tgcgaccctgcaagagttctttttg

SEQ ID NO: 376255 - DNA, 25 bp, Mus musculus
tgcgaccctgcaagatggagggggc

SEQ ID NO: 376256 - DNA, 25 bp, Mus musculus
tgcgaccgtgatggtaacaaatcac

SEQ ID NO: 376257 - DNA, 25 bp, Mus musculus
tgcgaccgtggctcctaatgtacag

SEQ ID NO: 376258 - DNA, 25 bp, Mus musculus
tgcgacggccagggtggaactactc

SEQ ID NO: 376259 - DNA, 25 bp, Mus musculus
tgcgacggccctaagggtggaacta

SEQ ID NO: 376260 - DNA, 25 bp, Mus musculus
tgcgacggccctaaggtttgaggat

SEQ ID NO: 376261 - DNA, 25 bp, Mus musculus
tgcgacggccctaagtgggagccgg

SEQ ID NO: 376262 - DNA, 25 bp, Mus musculus
tgcgactccgagcaccactcccata

SEQ ID NO: 376263 - DNA, 25 bp, Mus musculus
tgcgactctgagagcagaggggcag

SEQ ID NO: 376264 - DNA, 25 bp, Mus musculus
tgcgactgctccgagctcacaggaa

SEQ ID NO: 376265 - DNA, 25 bp, Mus musculus
tgcgacttggaccaattgctggaga

SEQ ID NO: 376266 - DNA, 25 bp, Mus musculus
tgcgacttggacctttgggcgacct

SEQ ID NO: 376267 - DNA, 25 bp, Mus musculus
tgcgacttggactcggctctctcct

SEQ ID NO: 376268 - DNA, 25 bp, Mus musculus
tgcgagactaaagaaacgtgttcct

SEQ ID NO: 376269 - DNA, 25 bp, Mus musculus
tgcgagactgaggaagattgacttc

SEQ ID NO: 376270 - DNA, 25 bp, Mus musculus
tgcgagagcagaaggaacttgacct

SEQ ID NO: 376271 - DNA, 25 bp, Mus musculus
tgcgagaggagcagcggcccctgaa

SEQ ID NO: 376272 - DNA, 25 bp, Mus musculus
tgcgagaggagggtgctgactactc

SEQ ID NO: 376273 - DNA, 25 bp, Mus musculus
tgcgagagtccacgagaaatggaag

SEQ ID NO: 376274 - DNA, 25 bp, Mus musculus
tgcgagagtccacgatatgttttct

SEQ ID NO: 376275 - DNA, 25 bp, Mus musculus
tgcgagagtccacggttttctctgt

SEQ ID NO: 376276 - DNA, 25 bp, Mus musculus
tgcgagcaagggtctctgatatggg

SEQ ID NO: 376277 - DNA, 25 bp, Mus musculus
tgcgagcaaggtccttccatagtga

SEQ ID NO: 376278 - DNA, 25 bp, Mus musculus
tgcgagcagatgagggcgctgtgtg

SEQ ID NO: 376279 - DNA, 25 bp, Mus musculus
tgcgagccaagatggacaacggaga

SEQ ID NO: 376280 - DNA, 25 bp, Mus musculus
tgcgagccacatttgccaaaaagca

SEQ ID NO: 376281 - DNA, 25 bp, Mus musculus
tgcgagccagcagctctgaactcca

SEQ ID NO: 376282 - DNA, 25 bp, Mus musculus
tgcgagcccccatgattcagtaacc

SEQ ID NO: 376283 - DNA, 25 bp, Mus musculus
tgcgagcccccatggctccataccc

SEQ ID NO: 376284 - DNA, 25 bp, Mus musculus
tgcgagcccgcatggattccaggtg

SEQ ID NO: 376285 - DNA, 25 bp, Mus musculus
tgcgagccgcagtggttttatgaag

SEQ ID NO: 376286 - DNA, 25 bp, Mus musculus
tgcgagcgagaagatgtttggcaca

SEQ ID NO: 376287 - DNA, 25 bp, Mus musculus
tgcgagcgagactatgagaagatgt

SEQ ID NO: 376288 - DNA, 25 bp, Mus musculus
tgcgagcgcagttacccagcatgcc

SEQ ID NO: 376289 - DNA, 25 bp, Mus musculus
tgcgagctacaagtattctgaggaa

SEQ ID NO: 376290 - DNA, 25 bp, Mus musculus
tgcgagctccagcaagaaaaattcc

SEQ ID NO: 376291 - DNA, 25 bp, Mus musculus
tgcgagctctgcttgctggttgttg

SEQ ID NO: 376292 - DNA, 25 bp, Mus musculus
tgcgagctgtgtggaaaaaatgtgg

SEQ ID NO: 376293 - DNA, 25 bp, Mus musculus
tgcgagctgtgtggtgacttaccaa

SEQ ID NO: 376294 - DNA, 25 bp, Mus musculus
tgcgaggagcagatatggcctccat

SEQ ID NO: 376295 - DNA, 25 bp, Mus musculus
tgcgaggccgcaatctgtcgcttta

SEQ ID NO: 376296 - DNA, 25 bp, Mus musculus
tgcgaggcgccacgacctgtgctac

SEQ ID NO: 376297 - DNA, 25 bp, Mus musculus
tgcgaggcgccacggtagcgcctgg

SEQ ID NO: 376298 - DNA, 25 bp, Mus musculus
tgcgagggaagctgtttactttgtg

SEQ ID NO: 376299 - DNA, 25 bp, Mus musculus
tgcgaggggaagattgcatctgggt

SEQ ID NO: 376300 - DNA, 25 bp, Mus musculus
tgcgaggggaaggtgaagtatttgt

SEQ ID NO: 376301 - DNA, 25 bp, Mus musculus
tgcgaggtgcctgggtccaagccgg

SEQ ID NO: 376302 - DNA, 25 bp, Mus musculus
tgcgaggtgcctgttaaagtccgcg

SEQ ID NO: 376303 - DNA, 25 bp, Mus musculus
tgcgagtaagtccagatctgatttg

SEQ ID NO: 376304 - DNA, 25 bp, Mus musculus
tgcgagtcatcaacctaatgcctga

SEQ ID NO: 376305 - DNA, 25 bp, Mus musculus
tgcgagtcccaggtttgaagagtgg

SEQ ID NO: 376306 - DNA, 25 bp, Mus musculus
tgcgagtcccagtgctgtaattaca

SEQ ID NO: 376307 - DNA, 25 bp, Mus musculus
tgcgagtcttcggggccctctgtcc

SEQ ID NO: 376308 - DNA, 25 bp, Mus musculus
tgcgataaaccattgttgaggacca

SEQ ID NO: 376309 - DNA, 25 bp, Mus musculus
tgcgatataaacctgaaggcatcag

SEQ ID NO: 376310 - DNA, 25 bp, Mus musculus
tgcgatatatacagatttgcaacag

SEQ ID NO: 376311 - DNA, 25 bp, Mus musculus
tgcgatatcttctttctcatctttg

SEQ ID NO: 376312 - DNA, 25 bp, Mus musculus
tgcgatccaaacgggaacaatataa

SEQ ID NO: 376313 - DNA, 25 bp, Mus musculus
tgcgatcctgtaagactttaaccca

SEQ ID NO: 376314 - DNA, 25 bp, Mus musculus
tgcgatcctgtaaggcactggtgaa

SEQ ID NO: 376315 - DNA, 25 bp, Mus musculus
tgcgatcggaagagaccaagcaaaa

SEQ ID NO: 376316 - DNA, 25 bp, Mus musculus
tgcgatctgggtggaaatggaattt

SEQ ID NO: 376317 - DNA, 25 bp, Mus musculus
tgcgatgaatggctgtatgcccagc

SEQ ID NO: 376318 - DNA, 25 bp, Mus musculus
tgcgatgaatgggtgtatgcccagc

SEQ ID NO: 376319 - DNA, 25 bp, Mus musculus
tgcgatggcggtacagagactcagc

SEQ ID NO: 376320 - DNA, 25 bp, Mus musculus
tgcgatgttatccaggccctggacc

SEQ ID NO: 376321 - DNA, 25 bp, Mus musculus
tgcgatgttatccaggctccctgtc

SEQ ID NO: 376322 - DNA, 25 bp, Mus musculus
tgcgattcaaccctcctgggatcag

SEQ ID NO: 376323 - DNA, 25 bp, Mus musculus
tgcgattcatctaaatggtgccatg

SEQ ID NO: 376324 - DNA, 25 bp, Mus musculus
tgcgattgaagagtcttttcacaga

SEQ ID NO: 376325 - DNA, 25 bp, Mus musculus
tgcgattgtgtcgaacaaatagtgg

SEQ ID NO: 376326 - DNA, 25 bp, Mus musculus
tgcgattgtgtcggacggtgggagt

SEQ ID NO: 376327 - DNA, 25 bp, Mus musculus
tgcgatttagctgctgtgtggatgt

SEQ ID NO: 376328 - DNA, 25 bp, Mus musculus
tgcgatttggaataattgatgtgac

SEQ ID NO: 376329 - DNA, 25 bp, Mus musculus
tgcgatttggaatattcgatgttac

SEQ ID NO: 376330 - DNA, 25 bp, Mus musculus
tgcgatttttgagaactgatagtgc

SEQ ID NO: 376331 - DNA, 25 bp, Mus musculus
tgcgcaaaatcacgcttaaaggatg

SEQ ID NO: 376332 - DNA, 25 bp, Mus musculus
tgcgcaaactgactgatgatgcttc

SEQ ID NO: 376333 - DNA, 25 bp, Mus musculus
tgcgcaaactggcgccccttgtctc

SEQ ID NO: 376334 - DNA, 25 bp, Mus musculus
tgcgcaaatgaagaagccggcatga

SEQ ID NO: 376335 - DNA, 25 bp, Mus musculus
tgcgcaaatgggagaagaaatgggt

SEQ ID NO: 376336 - DNA, 25 bp, Mus musculus
tgcgcaacgaaaaattcatttgcaa

SEQ ID NO: 376337 - DNA, 25 bp, Mus musculus
tgcgcaacgaatcctgactgttcct

SEQ ID NO: 376338 - DNA, 25 bp, Mus musculus
tgcgcaactggcaagcctctatgga

SEQ ID NO: 376339 - DNA, 25 bp, Mus musculus
tgcgcaactggcaagtttacaggct

SEQ ID NO: 376340 - DNA, 25 bp, Mus musculus
tgcgcaagatgcgccagcgcactgc

SEQ ID NO: 376341 - DNA, 25 bp, Mus musculus
tgcgcaaggagatgctgtggggcct

SEQ ID NO: 376342 - DNA, 25 bp, Mus musculus
tgcgcaaggagatggtggggctgcg

SEQ ID NO: 376343 - DNA, 25 bp, Mus musculus
tgcgcaaggagatgttgtctgtagg

SEQ ID NO: 376344 - DNA, 25 bp, Mus musculus
tgcgcaccttggtggaacactctgg

SEQ ID NO: 376345 - DNA, 25 bp, Mus musculus
tgcgcacgccggaccctgagccgta

SEQ ID NO: 376346 - DNA, 25 bp, Mus musculus
tgcgcactagggaaggtcccggatg

SEQ ID NO: 376347 - DNA, 25 bp, Mus musculus
tgcgcactcggaggccatgtcaggg

SEQ ID NO: 376348 - DNA, 25 bp, Mus musculus
tgcgcagacaggtgtcagctgactc

SEQ ID NO: 376349 - DNA, 25 bp, Mus musculus
tgcgcagactactttactggaaaga

SEQ ID NO: 376350 - DNA, 25 bp, Mus musculus
tgcgcagagaggtccaggatgcctt

SEQ ID NO: 376351 - DNA, 25 bp, Mus musculus
tgcgcagagaggtccaggatgctgt

SEQ ID NO: 376352 - DNA, 25 bp, Mus musculus
tgcgcagagatggttggcctgctat

SEQ ID NO: 376353 - DNA, 25 bp, Mus musculus
tgcgcagagcagattttctgcattt

SEQ ID NO: 376354 - DNA, 25 bp, Mus musculus
tgcgcagagcgcgggtgatgtgaac

SEQ ID NO: 376355 - DNA, 25 bp, Mus musculus
tgcgcagatgacagggcggaacttg

SEQ ID NO: 376356 - DNA, 25 bp, Mus musculus
tgcgcagcaggctgcctgctgtctc

SEQ ID NO: 376357 - DNA, 25 bp, Mus musculus
tgcgcagcgagcggagagtcatgga

SEQ ID NO: 376358 - DNA, 25 bp, Mus musculus
tgcgcagcgagcggggtgctgagtt

SEQ ID NO: 376359 - DNA, 25 bp, Mus musculus
tgcgcagctcggcatttcagtcgaa

SEQ ID NO: 376360 - DNA, 25 bp, Mus musculus
tgcgcagctgcagcctgacagagct

SEQ ID NO: 376361 - DNA, 25 bp, Mus musculus
tgcgcagctgcagctcctcctaggt

SEQ ID NO: 376362 - DNA, 25 bp, Mus musculus
tgcgcagctgcaggcaaaatgaagg

SEQ ID NO: 376363 - DNA, 25 bp, Mus musculus
tgcgcagctgcagggaggggaacta

SEQ ID NO: 376364 - DNA, 25 bp, Mus musculus
tgcgcaggcgcgcagtgaaagccgg

SEQ ID NO: 376365 - DNA, 25 bp, Mus musculus
tgcgcagtgctagctcttctgtcgg

SEQ ID NO: 376366 - DNA, 25 bp, Mus musculus
tgcgcatccctgagaacacaccagt

SEQ ID NO: 376367 - DNA, 25 bp, Mus musculus
tgcgcatccctgaggtcttccacac

SEQ ID NO: 376368 - DNA, 25 bp, Mus musculus
tgcgcatcctgcagccacattgcca

SEQ ID NO: 376369 - DNA, 25 bp, Mus musculus
tgcgcatgaagttcatgcaaagagg

SEQ ID NO: 376370 - DNA, 25 bp, Mus musculus
tgcgccacagactcttccaagcaat

SEQ ID NO: 376371 - DNA, 25 bp, Mus musculus
tgcgccacaggaaagcactgccacc

SEQ ID NO: 376372 - DNA, 25 bp, Mus musculus
tgcgccacctgagaaaagaaaagaa

SEQ ID NO: 376373 - DNA, 25 bp, Mus musculus
tgcgccacctgagaagagaagagaa

SEQ ID NO: 376374 - DNA, 25 bp, Mus musculus
tgcgccacctgagagatctcaggtt

SEQ ID NO: 376375 - DNA, 25 bp, Mus musculus
tgcgccacctgaggcctcccagcat

SEQ ID NO: 376376 - DNA, 25 bp, Mus musculus
tgcgccacgagaacgtcattgggct

SEQ ID NO: 376377 - DNA, 25 bp, Mus musculus
tgcgccacgagaactggacatttgg

SEQ ID NO: 376378 - DNA, 25 bp, Mus musculus
tgcgccagccaagaagaagatgaag

SEQ ID NO: 376379 - DNA, 25 bp, Mus musculus
tgcgccagccaaggtggggctgcag

SEQ ID NO: 376380 - DNA, 25 bp, Mus musculus
tgcgccatgacaagatcgtgattgt

SEQ ID NO: 376381 - DNA, 25 bp, Mus musculus
tgcgccattggtgagctgaaaaatg

SEQ ID NO: 376382 - DNA, 25 bp, Mus musculus
tgcgccccagcctccaccatgccaa

SEQ ID NO: 376383 - DNA, 25 bp, Mus musculus
tgcgccccagcgccctgtgtgtcaa

SEQ ID NO: 376384 - DNA, 25 bp, Mus musculus
tgcgcccccagccactggcccctac

SEQ ID NO: 376385 - DNA, 25 bp, Mus musculus
tgcgccccgggctccagcataccat

SEQ ID NO: 376386 - DNA, 25 bp, Mus musculus
tgcgccctcaggatgactgagtggg

SEQ ID NO: 376387 - DNA, 25 bp, Mus musculus
tgcgccctggacctgggctcccaga

SEQ ID NO: 376388 - DNA, 25 bp, Mus musculus
tgcgccctgggattcatcactcact

SEQ ID NO: 376389 - DNA, 25 bp, Mus musculus
tgcgccgccggtgtggccgtggctg

SEQ ID NO: 376390 - DNA, 25 bp, Mus musculus
tgcgccggagctatgtttcgaaacc

SEQ ID NO: 376391 - DNA, 25 bp, Mus musculus
tgcgccgggaccgacgccacagggc

SEQ ID NO: 376392 - DNA, 25 bp, Mus musculus
tgcgcctaggggaggatcatgcggc

SEQ ID NO: 376393 - DNA, 25 bp, Mus musculus
tgcgcctccgccggtgagctcctct

SEQ ID NO: 376394 - DNA, 25 bp, Mus musculus
tgcgcctgcaggtctctgcaagaac

SEQ ID NO: 376395 - DNA, 25 bp, Mus musculus
tgcgcctgcaggtggtggtggaaga

SEQ ID NO: 376396 - DNA, 25 bp, Mus musculus
tgcgcctgcaggttcacattgagat

SEQ ID NO: 376397 - DNA, 25 bp, Mus musculus
tgcgcctggagcaggaagggccagg

SEQ ID NO: 376398 - DNA, 25 bp, Mus musculus
tgcgcctggccaggatccattttct

SEQ ID NO: 376399 - DNA, 25 bp, Mus musculus
tgcgcctggccaggtctggcatatt

SEQ ID NO: 376400 - DNA, 25 bp, Mus musculus
tgcgcctgtgaagcgagcgcagcaa

SEQ ID NO: 376401 - DNA, 25 bp, Mus musculus
tgcgcctgtgaagcgcctcagtggg

SEQ ID NO: 376402 - DNA, 25 bp, Mus musculus
tgcgcctttggaagagatggagaga

SEQ ID NO: 376403 - DNA, 25 bp, Mus musculus
tgcgcgacaagccgaactgctttga

SEQ ID NO: 376404 - DNA, 25 bp, Mus musculus
tgcgcgacaggctgtttggtctcga

SEQ ID NO: 376405 - DNA, 25 bp, Mus musculus
tgcgcgacaggttctggatggtggt

SEQ ID NO: 376406 - DNA, 25 bp, Mus musculus
tgcgcgacaggttttggctcgtgat

SEQ ID NO: 376407 - DNA, 25 bp, Mus musculus
tgcgcgagaggaatgcgctcatgtt

SEQ ID NO: 376408 - DNA, 25 bp, Mus musculus
tgcgcgagagtatgtcttggctgtc

SEQ ID NO: 376409 - DNA, 25 bp, Mus musculus
tgcgcgcacaagaagatctctcgtc

SEQ ID NO: 376410 - DNA, 25 bp, Mus musculus
tgcgcgcacagatgggctgtatggg

SEQ ID NO: 376411 - DNA, 25 bp, Mus musculus
tgcgcgcacagatttgaagactgaa

SEQ ID NO: 376412 - DNA, 25 bp, Mus musculus
tgcgcgcacaggcctcctctgtcac

SEQ ID NO: 376413 - DNA, 25 bp, Mus musculus
tgcgcgcagctggggtcatgatata

SEQ ID NO: 376414 - DNA, 25 bp, Mus musculus
tgcgcgcccatcaagataagtgggc

SEQ ID NO: 376415 - DNA, 25 bp, Mus musculus
tgcgcgccgggccgcagtgcctggt

SEQ ID NO: 376416 - DNA, 25 bp, Mus musculus
tgcgcgccgggccgcccaacaagat

SEQ ID NO: 376417 - DNA, 25 bp, Mus musculus
tgcgcgcgacgtcagacacttagct

SEQ ID NO: 376418 - DNA, 25 bp, Mus musculus
tgcgcgcgacgtcaggtactcaatg

SEQ ID NO: 376419 - DNA, 25 bp, Mus musculus
tgcgcgcgcagacttacactttgaa

SEQ ID NO: 376420 - DNA, 25 bp, Mus musculus
tgcgcgcgcagagccaacagagaaa

SEQ ID NO: 376421 - DNA, 25 bp, Mus musculus
tgcgcgcgcagccaaagtgtatgtc

SEQ ID NO: 376422 - DNA, 25 bp, Mus musculus
tgcgcgcggcccaggggatccaaag

SEQ ID NO: 376423 - DNA, 25 bp, Mus musculus
tgcgcgcggcccaggtttggatctc

SEQ ID NO: 376424 - DNA, 25 bp, Mus musculus
tgcgcgctagaagatgttaaagaac

SEQ ID NO: 376425 - DNA, 25 bp, Mus musculus
tgcgcgctagaagctactcaggtgc

SEQ ID NO: 376426 - DNA, 25 bp, Mus musculus
tgcgcgctctcaggaggaggcaaaa

SEQ ID NO: 376427 - DNA, 25 bp, Mus musculus
tgcgcgctctcaggctagagttcac

SEQ ID NO: 376428 - DNA, 25 bp, Mus musculus
tgcgcggccgaggtacaatgtcacg

SEQ ID NO: 376429 - DNA, 25 bp, Mus musculus
tgcgcggcggcgggcaccatccaaa

SEQ ID NO: 376430 - DNA, 25 bp, Mus musculus
tgcgcggcggctggtttcctcaagg

SEQ ID NO: 376431 - DNA, 25 bp, Mus musculus
tgcgcgggagagtcctttcaagtgg

SEQ ID NO: 376432 - DNA, 25 bp, Mus musculus
tgcgcgggtggtgtaagaataaacg

SEQ ID NO: 376433 - DNA, 25 bp, Mus musculus
tgcgcggttggacgagtgaccaaaa

SEQ ID NO: 376434 - DNA, 25 bp, Mus musculus
tgcgcgtcacgccttggcccattgc

SEQ ID NO: 376435 - DNA, 25 bp, Mus musculus
tgcgcgtccagggtttcctctcctg

SEQ ID NO: 376436 - DNA, 25 bp, Mus musculus
tgcgcgtccaggttaaatgaatacc

SEQ ID NO: 376437 - DNA, 25 bp, Mus musculus
tgcgcgtcccagggacccagctgaa

SEQ ID NO: 376438 - DNA, 25 bp, Mus musculus
tgcgctaaactttgtgacttgcact

SEQ ID NO: 376439 - DNA, 25 bp, Mus musculus
tgcgctacaggggcgggacaaagga

SEQ ID NO: 376440 - DNA, 25 bp, Mus musculus
tgcgctactgcccactcaacatcag

SEQ ID NO: 376441 - DNA, 25 bp, Mus musculus
tgcgctactgcccattgaaaaatct

SEQ ID NO: 376442 - DNA, 25 bp, Mus musculus
tgcgctataaccgagactggtacaa

SEQ ID NO: 376443 - DNA, 25 bp, Mus musculus
tgcgctataaccgggctgggcctgg

SEQ ID NO: 376444 - DNA, 25 bp, Mus musculus
tgcgctatcatgagggtccatgcct

SEQ ID NO: 376445 - DNA, 25 bp, Mus musculus
tgcgctatgggtcaggtagtgggca

SEQ ID NO: 376446 - DNA, 25 bp, Mus musculus
tgcgctcaacaaggacccctcatgc

SEQ ID NO: 376447 - DNA, 25 bp, Mus musculus
tgcgctcagagcgtaaacgaccccg

SEQ ID NO: 376448 - DNA, 25 bp, Mus musculus
tgcgctccaggtgccacatcatctc

SEQ ID NO: 376449 - DNA, 25 bp, Mus musculus
tgcgctccgctagccaacatgagtc

SEQ ID NO: 376450 - DNA, 25 bp, Mus musculus
tgcgctccgggagtaaagacatttc

SEQ ID NO: 376451 - DNA, 25 bp, Mus musculus
tgcgctcgcacacggcctctgtgct

SEQ ID NO: 376452 - DNA, 25 bp, Mus musculus
tgcgctcgcacacggcctggaggtg

SEQ ID NO: 376453 - DNA, 25 bp, Mus musculus
tgcgctcgcacacgggggacgcccc

SEQ ID NO: 376454 - DNA, 25 bp, Mus musculus
tgcgctcggaactgtgtcgtgatta

SEQ ID NO: 376455 - DNA, 25 bp, Mus musculus
tgcgctcggtgagttgcaggatcca

SEQ ID NO: 376456 - DNA, 25 bp, Mus musculus
tgcgctctgcagctggtcacagctc

SEQ ID NO: 376457 - DNA, 25 bp, Mus musculus
tgcgctctgcagctgtatgttgtat

SEQ ID NO: 376458 - DNA, 25 bp, Mus musculus
tgcgctgaccgacaaaaagatcagg

SEQ ID NO: 376459 - DNA, 25 bp, Mus musculus
tgcgctgactgacatctactgccga

SEQ ID NO: 376460 - DNA, 25 bp, Mus musculus
tgcgctgccctggggctgtgtctgg

SEQ ID NO: 376461 - DNA, 25 bp, Mus musculus
tgcgctgccttgactgtggaaagag

SEQ ID NO: 376462 - DNA, 25 bp, Mus musculus
tgcgctgcgagagaggaagacgact

SEQ ID NO: 376463 - DNA, 25 bp, Mus musculus
tgcgctgcgctaattgtaaattcac

SEQ ID NO: 376464 - DNA, 25 bp, Mus musculus
tgcgctgcgtgacagctggtggcac

SEQ ID NO: 376465 - DNA, 25 bp, Mus musculus
tgcgctgcgtgcatccgtgcagccc

SEQ ID NO: 376466 - DNA, 25 bp, Mus musculus
tgcgctggaggtctaagccgactcg

SEQ ID NO: 376467 - DNA, 25 bp, Mus musculus
tgcgctggcaggtcccagggatttt

SEQ ID NO: 376468 - DNA, 25 bp, Mus musculus
tgcgctggcaggttgtagatacccc

SEQ ID NO: 376469 - DNA, 25 bp, Mus musculus
tgcgctgtatagaatgcggggttcg

SEQ ID NO: 376470 - DNA, 25 bp, Mus musculus
tgcgctgtggggatggaaatgcagg

SEQ ID NO: 376471 - DNA, 25 bp, Mus musculus
tgcgcttatttgaggagaatgagat

SEQ ID NO: 376472 - DNA, 25 bp, Mus musculus
tgcgcttatttgaggagtttgggct

SEQ ID NO: 376473 - DNA, 25 bp, Mus musculus
tgcgcttcattcaagtgcgcaaact

SEQ ID NO: 376474 - DNA, 25 bp, Mus musculus
tgcgcttcattcaatttgatcaaga

SEQ ID NO: 376475 - DNA, 25 bp, Mus musculus
tgcgcttccggtacggtggcaccgc

SEQ ID NO: 376476 - DNA, 25 bp, Mus musculus
tgcgcttcgcccgcagcctcgccca

SEQ ID NO: 376477 - DNA, 25 bp, Mus musculus
tgcggaaacaggcattgaagacaag

SEQ ID NO: 376478 - DNA, 25 bp, Mus musculus
tgcggaaagaaaacgagctgtttga

SEQ ID NO: 376479 - DNA, 25 bp, Mus musculus
tgcggaaatgggagaagaaatgggt

SEQ ID NO: 376480 - DNA, 25 bp, Mus musculus
tgcggaactaaagcaaatggttatg

SEQ ID NO: 376481 - DNA, 25 bp, Mus musculus
tgcggaagcagaggatctctcagca

SEQ ID NO: 376482 - DNA, 25 bp, Mus musculus
tgcggaagcagagggacctgtaccg

SEQ ID NO: 376483 - DNA, 25 bp, Mus musculus
tgcggacaatacaggctaggggtgt

SEQ ID NO: 376484 - DNA, 25 bp, Mus musculus
tgcggacacgtcttttgctctgcat

SEQ ID NO: 376485 - DNA, 25 bp, Mus musculus
tgcggacacgtgaatgtctgaagcc

SEQ ID NO: 376486 - DNA, 25 bp, Mus musculus
tgcggacacgtttcatcctatctaa

SEQ ID NO: 376487 - DNA, 25 bp, Mus musculus
tgcggacacttgtgaagcagcagga

SEQ ID NO: 376488 - DNA, 25 bp, Mus musculus
tgcggacacttgtggagcattctgg

SEQ ID NO: 376489 - DNA, 25 bp, Mus musculus
tgcggaccgagaacctctccataat

SEQ ID NO: 376490 - DNA, 25 bp, Mus musculus
tgcggaccgagaagaaccgatcgca

SEQ ID NO: 376491 - DNA, 25 bp, Mus musculus
tgcggacctcagcctttatcctcat

SEQ ID NO: 376492 - DNA, 25 bp, Mus musculus
tgcggacctcaggaaccctgatgac

SEQ ID NO: 376493 - DNA, 25 bp, Mus musculus
tgcggactcccggagaagcctcccc

SEQ ID NO: 376494 - DNA, 25 bp, Mus musculus
tgcggagacagggggctcaccctac

SEQ ID NO: 376495 - DNA, 25 bp, Mus musculus
tgcggagacaggttgcagaattcag

SEQ ID NO: 376496 - DNA, 25 bp, Mus musculus
tgcggagacaggtttcggccgagtc

SEQ ID NO: 376497 - DNA, 25 bp, Mus musculus
tgcggagacgtaagatcaacgagag

SEQ ID NO: 376498 - DNA, 25 bp, Mus musculus
tgcggagagactgggatgagcacag

SEQ ID NO: 376499 - DNA, 25 bp, Mus musculus
tgcggagatccccagagacagaact

SEQ ID NO: 376500 - DNA, 25 bp, Mus musculus
tgcggagattcggcgacctgacaaa

SEQ ID NO: 376501 - DNA, 25 bp, Mus musculus
tgcggagattcggcggtttatcaag

SEQ ID NO: 376502 - DNA, 25 bp, Mus musculus
tgcggagcagaatgatttccagagc

SEQ ID NO: 376503 - DNA, 25 bp, Mus musculus
tgcggagcattctgtgcccccaagg

SEQ ID NO: 376504 - DNA, 25 bp, Mus musculus
tgcggagcattgtgaccactgactg

SEQ ID NO: 376505 - DNA, 25 bp, Mus musculus
tgcggagcctaagtctgtaccaaaa

SEQ ID NO: 376506 - DNA, 25 bp, Mus musculus
tgcggagcgcggaggtgatgctagc

SEQ ID NO: 376507 - DNA, 25 bp, Mus musculus
tgcggagcggggttgaaagacacac

SEQ ID NO: 376508 - DNA, 25 bp, Mus musculus
tgcggagcgggtttatggtcggctg

SEQ ID NO: 376509 - DNA, 25 bp, Mus musculus
tgcggagctcgcgactcactgtgtg

SEQ ID NO: 376510 - DNA, 25 bp, Mus musculus
tgcggagctcggaattagctgaaca

SEQ ID NO: 376511 - DNA, 25 bp, Mus musculus
tgcggagggccaaaaaagtgtgcgc

SEQ ID NO: 376512 - DNA, 25 bp, Mus musculus
tgcggaggggtgggaggctgccggc

SEQ ID NO: 376513 - DNA, 25 bp, Mus musculus
tgcggagggtcctggaaacactcag

SEQ ID NO: 376514 - DNA, 25 bp, Mus musculus
tgcggagtacatgaagcacacaggg

SEQ ID NO: 376515 - DNA, 25 bp, Mus musculus
tgcggatatgtggccgatctgtccc

SEQ ID NO: 376516 - DNA, 25 bp, Mus musculus
tgcggatggagaatatattcctcct

SEQ ID NO: 376517 - DNA, 25 bp, Mus musculus
tgcggatggggaagccagctttgta

SEQ ID NO: 376518 - DNA, 25 bp, Mus musculus
tgcggattcggagcattcttgaagt

SEQ ID NO: 376519 - DNA, 25 bp, Mus musculus
tgcggattcggatggattccaaaga

SEQ ID NO: 376520 - DNA, 25 bp, Mus musculus
tgcggcaaagaggcattctggaatt

SEQ ID NO: 376521 - DNA, 25 bp, Mus musculus
tgcggcaccatggcaaccgaagaac

SEQ ID NO: 376522 - DNA, 25 bp, Mus musculus
tgcggcacccctgagtacttggctc

SEQ ID NO: 376523 - DNA, 25 bp, Mus musculus
tgcggcaccgcttgtcctgggctgg

SEQ ID NO: 376524 - DNA, 25 bp, Mus musculus
tgcggcaccggctggcccgcgggta

SEQ ID NO: 376525 - DNA, 25 bp, Mus musculus
tgcggcaccgtttcctctacaggta

SEQ ID NO: 376526 - DNA, 25 bp, Mus musculus
tgcggcagaatggacagttgctcag

SEQ ID NO: 376527 - DNA, 25 bp, Mus musculus
tgcggcagaatgggtgcagacctct

SEQ ID NO: 376528 - DNA, 25 bp, Mus musculus
tgcggcagatgccccacaggatcgc

SEQ ID NO: 376529 - DNA, 25 bp, Mus musculus
tgcggcagcaggccgggggacagta

SEQ ID NO: 376530 - DNA, 25 bp, Mus musculus
tgcggcagccgtggtcatagtcaga

SEQ ID NO: 376531 - DNA, 25 bp, Mus musculus
tgcggcagggatttgcttcaacctg

SEQ ID NO: 376532 - DNA, 25 bp, Mus musculus
tgcggcagggatttgtttcgcctgc

SEQ ID NO: 376533 - DNA, 25 bp, Mus musculus
tgcggcattaccttggttctgacca

SEQ ID NO: 376534 - DNA, 25 bp, Mus musculus
tgcggccaatagctctcagggcctg

SEQ ID NO: 376535 - DNA, 25 bp, Mus musculus
tgcggccacacggctggatagccgg

SEQ ID NO: 376536 - DNA, 25 bp, Mus musculus
tgcggccacacgtgacactggccaa

SEQ ID NO: 376537 - DNA, 25 bp, Mus musculus
tgcggccacacgttctgcggggagt

SEQ ID NO: 376538 - DNA, 25 bp, Mus musculus
tgcggccaggtgaggctccatcaag

SEQ ID NO: 376539 - DNA, 25 bp, Mus musculus
tgcggcccggctagttcattgaaag

SEQ ID NO: 376540 - DNA, 25 bp, Mus musculus
tgcggccgcaggcctgaagctcatg

SEQ ID NO: 376541 - DNA, 25 bp, Mus musculus
tgcggccgcccaagagtcctttgct

SEQ ID NO: 376542 - DNA, 25 bp, Mus musculus
tgcggccgcgtcatggccgtgcctg

SEQ ID NO: 376543 - DNA, 25 bp, Mus musculus
tgcggccggactcagatttgataat

SEQ ID NO: 376544 - DNA, 25 bp, Mus musculus
tgcggccggagggattcatcagtgg

SEQ ID NO: 376545 - DNA, 25 bp, Mus musculus
tgcggccggagggattcgaggacgc

SEQ ID NO: 376546 - DNA, 25 bp, Mus musculus
tgcggccggatgagattatgcggga

SEQ ID NO: 376547 - DNA, 25 bp, Mus musculus
tgcggccggatgccactacgaagga

SEQ ID NO: 376548 - DNA, 25 bp, Mus musculus
tgcggcctgacccggctccactcta

SEQ ID NO: 376549 - DNA, 25 bp, Mus musculus
tgcggcgccaagatccccagctcaa

SEQ ID NO: 376550 - DNA, 25 bp, Mus musculus
tgcggcgccggacaggatgtttgct

SEQ ID NO: 376551 - DNA, 25 bp, Mus musculus
tgcggcgcgactggaggataccagt

SEQ ID NO: 376552 - DNA, 25 bp, Mus musculus
tgcggcgcgactgggtggggctgct

SEQ ID NO: 376553 - DNA, 25 bp, Mus musculus
tgcggcgcgccgagggtgtgtggga

SEQ ID NO: 376554 - DNA, 25 bp, Mus musculus
tgcggcgcgccgagttgaactttct

SEQ ID NO: 376555 - DNA, 25 bp, Mus musculus
tgcggcgctagctaggcggccgtca

SEQ ID NO: 376556 - DNA, 25 bp, Mus musculus
tgcggcgctgtcagatcaagatcca

SEQ ID NO: 376557 - DNA, 25 bp, Mus musculus
tgcggcgggacagttgggcaaggcg

SEQ ID NO: 376558 - DNA, 25 bp, Mus musculus
tgcggcgggatcctataagttgcaa

SEQ ID NO: 376559 - DNA, 25 bp, Mus musculus
tgcggcgggatcctatgcatatttt

SEQ ID NO: 376560 - DNA, 25 bp, Mus musculus
tgcggcggtcaaggccctcagcctc

SEQ ID NO: 376561 - DNA, 25 bp, Mus musculus
tgcggcggtcaaggtcacggtctcg

SEQ ID NO: 376562 - DNA, 25 bp, Mus musculus
tgcggcggttgagacttctccattc

SEQ ID NO: 376563 - DNA, 25 bp, Mus musculus
tgcggctgcaaatgacacaacacgg

SEQ ID NO: 376564 - DNA, 25 bp, Mus musculus
tgcggctgcaaatggtaacgatcgg

SEQ ID NO: 376565 - DNA, 25 bp, Mus musculus
tgcggctgcagaagcgtctcctgta

SEQ ID NO: 376566 - DNA, 25 bp, Mus musculus
tgcggctgccagaaacttcagtgcc

SEQ ID NO: 376567 - DNA, 25 bp, Mus musculus
tgcggctgcccgggcagtgacggac

SEQ ID NO: 376568 - DNA, 25 bp, Mus musculus
tgcggctggaggttttcccgctcag

SEQ ID NO: 376569 - DNA, 25 bp, Mus musculus
tgcggctggagtgcccacgatggcc

SEQ ID NO: 376570 - DNA, 25 bp, Mus musculus
tgcggctggccacgtgtggttgaat

SEQ ID NO: 376571 - DNA, 25 bp, Mus musculus
tgcggctttctatagagctgggctc

SEQ ID NO: 376572 - DNA, 25 bp, Mus musculus
tgcggctttctataggtatggggac

SEQ ID NO: 376573 - DNA, 25 bp, Mus musculus
tgcggctttggaggggctgtgggtt

SEQ ID NO: 376574 - DNA, 25 bp, Mus musculus
tgcgggaaaccgctgaagctgacgt

SEQ ID NO: 376575 - DNA, 25 bp, Mus musculus
tgcgggaacaggagctcctcttgcg

SEQ ID NO: 376576 - DNA, 25 bp, Mus musculus
tgcgggaactgctggtgtgatcctt

SEQ ID NO: 376577 - DNA, 25 bp, Mus musculus
tgcgggaccaatgctcaggtctaga

SEQ ID NO: 376578 - DNA, 25 bp, Mus musculus
tgcgggaccagctgatccgagcaca

SEQ ID NO: 376579 - DNA, 25 bp, Mus musculus
tgcgggaccaggatgggctcaggcc

SEQ ID NO: 376580 - DNA, 25 bp, Mus musculus
tgcgggaccaggcctttaagaccat

SEQ ID NO: 376581 - DNA, 25 bp, Mus musculus
tgcgggacctgggtgtctcttccaa

SEQ ID NO: 376582 - DNA, 25 bp, Mus musculus
tgcgggactggctagaaaatactaa

SEQ ID NO: 376583 - DNA, 25 bp, Mus musculus
tgcgggagaaggtttttcgttggaa

SEQ ID NO: 376584 - DNA, 25 bp, Mus musculus
tgcgggagccaggagaacgggatgc

SEQ ID NO: 376585 - DNA, 25 bp, Mus musculus
tgcgggagccagttccaggcgaatc

SEQ ID NO: 376586 - DNA, 25 bp, Mus musculus
tgcgggagcgtcaggtcttgagaga

SEQ ID NO: 376587 - DNA, 25 bp, Mus musculus
tgcgggcacaggtggacgacccccc

SEQ ID NO: 376588 - DNA, 25 bp, Mus musculus
tgcgggcaccgagagtgttgagggc

SEQ ID NO: 376589 - DNA, 25 bp, Mus musculus
tgcgggcaccgggagctggtgattg

SEQ ID NO: 376590 - DNA, 25 bp, Mus musculus
tgcgggcagtctgggctgctggctc

SEQ ID NO: 376591 - DNA, 25 bp, Mus musculus
tgcgggccagaatcaccgccgcccc

SEQ ID NO: 376592 - DNA, 25 bp, Mus musculus
tgcgggcccagttgctgatagccca

SEQ ID NO: 376593 - DNA, 25 bp, Mus musculus
tgcgggcccggaaatgcacttagcg

SEQ ID NO: 376594 - DNA, 25 bp, Mus musculus
tgcgggcccgggactgtgcagcatg

SEQ ID NO: 376595 - DNA, 25 bp, Mus musculus
tgcgggccggcgaaatggcaaaatg

SEQ ID NO: 376596 - DNA, 25 bp, Mus musculus
tgcgggcgagatgtatacatctcaa

SEQ ID NO: 376597 - DNA, 25 bp, Mus musculus
tgcgggcgcaaggcctctctttctg

SEQ ID NO: 376598 - DNA, 25 bp, Mus musculus
tgcgggcgcggattgtgccttctga

SEQ ID NO: 376599 - DNA, 25 bp, Mus musculus
tgcgggcgctacagggcttttctcc

SEQ ID NO: 376600 - DNA, 25 bp, Mus musculus
tgcgggcgctacaggtggacaacat

SEQ ID NO: 376601 - DNA, 25 bp, Mus musculus
tgcgggcgtcggttgggtttctctg

SEQ ID NO: 376602 - DNA, 25 bp, Mus musculus
tgcgggctcgggaatgggaaacagc

SEQ ID NO: 376603 - DNA, 25 bp, Mus musculus
tgcgggctctccaggggaaaataag

SEQ ID NO: 376604 - DNA, 25 bp, Mus musculus
tgcgggctttgcttaaatccagtga

SEQ ID NO: 376605 - DNA, 25 bp, Mus musculus
tgcggggagtgaggggagctaccgt

SEQ ID NO: 376606 - DNA, 25 bp, Mus musculus
tgcggggcaaaatggagctcgacgc

SEQ ID NO: 376607 - DNA, 25 bp, Mus musculus
tgcgggggagttttacagagagcac

SEQ ID NO: 376608 - DNA, 25 bp, Mus musculus
tgcgggtagtttagtgaagctgtgg

SEQ ID NO: 376609 - DNA, 25 bp, Mus musculus
tgcgggtcccaagagacaggggtcc

SEQ ID NO: 376610 - DNA, 25 bp, Mus musculus
tgcgggtctcacgatctttggcatg

SEQ ID NO: 376611 - DNA, 25 bp, Mus musculus
tgcgggtctcacggaactctgattt

SEQ ID NO: 376612 - DNA, 25 bp, Mus musculus
tgcgggtgaatgatccccaatcagg

SEQ ID NO: 376613 - DNA, 25 bp, Mus musculus
tgcgggtgaatgggccaccacccaa

SEQ ID NO: 376614 - DNA, 25 bp, Mus musculus
tgcgggtgagatctgattttctggc

SEQ ID NO: 376615 - DNA, 25 bp, Mus musculus
tgcgggtgctgcccggcggtcccgc

SEQ ID NO: 376616 - DNA, 25 bp, Mus musculus
tgcgggtgctgtgcgcttctattcc

SEQ ID NO: 376617 - DNA, 25 bp, Mus musculus
tgcgggtgcttgtaggtggcgggac

SEQ ID NO: 376618 - DNA, 25 bp, Mus musculus
tgcgggtgtttggggcctacacgcc

SEQ ID NO: 376619 - DNA, 25 bp, Mus musculus
tgcgggttttgctggaccgcagcaa

SEQ ID NO: 376620 - DNA, 25 bp, Mus musculus
tgcggtactgaaggattctccagtg

SEQ ID NO: 376621 - DNA, 25 bp, Mus musculus
tgcggtagctcggtttcttctggga

SEQ ID NO: 376622 - DNA, 25 bp, Mus musculus
tgcggtatcggggggagtacaagga

SEQ ID NO: 376623 - DNA, 25 bp, Mus musculus
tgcggtccaggagattgtgccttct

SEQ ID NO: 376624 - DNA, 25 bp, Mus musculus
tgcggtccattcaggagatggagtt

SEQ ID NO: 376625 - DNA, 25 bp, Mus musculus
tgcggtccctcagattgctgaagct

SEQ ID NO: 376626 - DNA, 25 bp, Mus musculus
tgcggtgcagactggcccttcaaat

SEQ ID NO: 376627 - DNA, 25 bp, Mus musculus
tgcggtgctcacagcagagggtccc

SEQ ID NO: 376628 - DNA, 25 bp, Mus musculus
tgcggtggcctgcaggtagctcgcg

SEQ ID NO: 376629 - DNA, 25 bp, Mus musculus
tgcggttaagaggggcagactgaag

SEQ ID NO: 376630 - DNA, 25 bp, Mus musculus
tgcggttaagagggggtctcactgt

SEQ ID NO: 376631 - DNA, 25 bp, Mus musculus
tgcggttaagtgagcaaaccaacat

SEQ ID NO: 376632 - DNA, 25 bp, Mus musculus
tgcggttagtcgagaactgatagaa

SEQ ID NO: 376633 - DNA, 25 bp, Mus musculus
tgcggttctcccgaggaggcatgat

SEQ ID NO: 376634 - DNA, 25 bp, Mus musculus
tgcggttctcccgagggctgggata

SEQ ID NO: 376635 - DNA, 25 bp, Mus musculus
tgcggttggacaagggctgcaaaca

SEQ ID NO: 376636 - DNA, 25 bp, Mus musculus
tgcggttggctggcgtgccctacgt

SEQ ID NO: 376637 - DNA, 25 bp, Mus musculus
tgcggttgtcaggagatataacaga

SEQ ID NO: 376638 - DNA, 25 bp, Mus musculus
tgcggtttccagatgaagctctcaa

SEQ ID NO: 376639 - DNA, 25 bp, Mus musculus
tgcggtttgcactggtccaacccag

SEQ ID NO: 376640 - DNA, 25 bp, Mus musculus
tgcgtaagtggccctcaaagcggag

SEQ ID NO: 376641 - DNA, 25 bp, Mus musculus
tgcgtaatgacttccctgctgggac

SEQ ID NO: 376642 - DNA, 25 bp, Mus musculus
tgcgtacagggatcttgtcctttgc

SEQ ID NO: 376643 - DNA, 25 bp, Mus musculus
tgcgtacagggggtggtactggggt

SEQ ID NO: 376644 - DNA, 25 bp, Mus musculus
tgcgtacagtagcatccgggctaaa

SEQ ID NO: 376645 - DNA, 25 bp, Mus musculus
tgcgtaccagcatcgagaaggtgtc

SEQ ID NO: 376646 - DNA, 25 bp, Mus musculus
tgcgtaccaggtatggcatcagccc

SEQ ID NO: 376647 - DNA, 25 bp, Mus musculus
tgcgtacccattcaggctgcaacag

SEQ ID NO: 376648 - DNA, 25 bp, Mus musculus
tgcgtaccccagaccgattttgcac

SEQ ID NO: 376649 - DNA, 25 bp, Mus musculus
tgcgtagagaatgcgggtttccgct

SEQ ID NO: 376650 - DNA, 25 bp, Mus musculus
tgcgtaggaagggtggtgctgatcg

SEQ ID NO: 376651 - DNA, 25 bp, Mus musculus
tgcgtaggagcaatacaccaagtat

SEQ ID NO: 376652 - DNA, 25 bp, Mus musculus
tgcgtcactgaccggaggaacaagg

SEQ ID NO: 376653 - DNA, 25 bp, Mus musculus
tgcgtcagtggtcgcagacactttg

SEQ ID NO: 376654 - DNA, 25 bp, Mus musculus
tgcgtcatgggcccgattgacgaca

SEQ ID NO: 376655 - DNA, 25 bp, Mus musculus
tgcgtcattcagagaggaatgcgat

SEQ ID NO: 376656 - DNA, 25 bp, Mus musculus
tgcgtccaagctgtttcctctgcaa

SEQ ID NO: 376657 - DNA, 25 bp, Mus musculus
tgcgtccaaggcaaatttcaggtga

SEQ ID NO: 376658 - DNA, 25 bp, Mus musculus
tgcgtccaagtatctagcattcaca

SEQ ID NO: 376659 - DNA, 25 bp, Mus musculus
tgcgtcccgagggaaatggagcagt

SEQ ID NO: 376660 - DNA, 25 bp, Mus musculus
tgcgtccctctggggctgtggtcac

SEQ ID NO: 376661 - DNA, 25 bp, Mus musculus
tgcgtccgtgcccgttctgtacttc

SEQ ID NO: 376662 - DNA, 25 bp, Mus musculus
tgcgtcctgctgtctcaggtgctcc

SEQ ID NO: 376663 - DNA, 25 bp, Mus musculus
tgcgtcgagcagagtgtctacattg

SEQ ID NO: 376664 - DNA, 25 bp, Mus musculus
tgcgtctaaaggcttcgagtacctt

SEQ ID NO: 376665 - DNA, 25 bp, Mus musculus
tgcgtctcgagacaagaccataaag

SEQ ID NO: 376666 - DNA, 25 bp, Mus musculus
tgcgtctcgagacaagaccatcatc

SEQ ID NO: 376667 - DNA, 25 bp, Mus musculus
tgcgtctgccaggcagacggctctg

SEQ ID NO: 376668 - DNA, 25 bp, Mus musculus
tgcgtctgctgcatctctgagctgc

SEQ ID NO: 376669 - DNA, 25 bp, Mus musculus
tgcgtctgctgcggtttctttgctc

SEQ ID NO: 376670 - DNA, 25 bp, Mus musculus
tgcgtctgtttgctttgagcgctgc

SEQ ID NO: 376671 - DNA, 25 bp, Mus musculus
tgcgtcttcaggtaataaagctctt

SEQ ID NO: 376672 - DNA, 25 bp, Mus musculus
tgcgtcttctctggggtctatgttt

SEQ ID NO: 376673 - DNA, 25 bp, Mus musculus
tgcgtctttggagggtggaagagca

SEQ ID NO: 376674 - DNA, 25 bp, Mus musculus
tgcgtgatctgggtactgtggcaag

SEQ ID NO: 376675 - DNA, 25 bp, Mus musculus
tgcgtgcaattagagaaagataagg

SEQ ID NO: 376676 - DNA, 25 bp, Mus musculus
tgcgtgcaattaggcgtgcagccgg

SEQ ID NO: 376677 - DNA, 25 bp, Mus musculus
tgcgtgcacagcagaggcagacagg

SEQ ID NO: 376678 - DNA, 25 bp, Mus musculus
tgcgtgcagtgatcgtttcagctct

SEQ ID NO: 376679 - DNA, 25 bp, Mus musculus
tgcgtgccacagttcttgctgctga

SEQ ID NO: 376680 - DNA, 25 bp, Mus musculus
tgcgtgccagggcgacagtggaggc

SEQ ID NO: 376681 - DNA, 25 bp, Mus musculus
tgcgtgcccacgagacttttctttg

SEQ ID NO: 376682 - DNA, 25 bp, Mus musculus
tgcgtgcccacgagttcccacttgg

SEQ ID NO: 376683 - DNA, 25 bp, Mus musculus
tgcgtgcccagggcctagtgcttgt

SEQ ID NO: 376684 - DNA, 25 bp, Mus musculus
tgcgtgcccagggtcctgtgggcac

SEQ ID NO: 376685 - DNA, 25 bp, Mus musculus
tgcgtgcccaggttgtgtagcctga

SEQ ID NO: 376686 - DNA, 25 bp, Mus musculus
tgcgtgcctatcaatcccaggctcc

SEQ ID NO: 376687 - DNA, 25 bp, Mus musculus
tgcgtgcctatcaggaaaggactca

SEQ ID NO: 376688 - DNA, 25 bp, Mus musculus
tgcgtgctcatggaaacttcgggtg

SEQ ID NO: 376689 - DNA, 25 bp, Mus musculus
tgcgtgctcatggggtacgtgtgtg

SEQ ID NO: 376690 - DNA, 25 bp, Mus musculus
tgcgtggaagagtccccaagagctg

SEQ ID NO: 376691 - DNA, 25 bp, Mus musculus
tgcgtggaaggcagaaaccaggtgg

SEQ ID NO: 376692 - DNA, 25 bp, Mus musculus
tgcgtggacccagctgtcctggaag

SEQ ID NO: 376693 - DNA, 25 bp, Mus musculus
tgcgtggagctgagaaccagtcttc

SEQ ID NO: 376694 - DNA, 25 bp, Mus musculus
tgcgtggagctgagctcactccgtg

SEQ ID NO: 376695 - DNA, 25 bp, Mus musculus
tgcgtggagttacagctgccttgcc

SEQ ID NO: 376696 - DNA, 25 bp, Mus musculus
tgcgtggcggagatggcgcggccga

SEQ ID NO: 376697 - DNA, 25 bp, Mus musculus
tgcgtggcttccggagacagaaaag

SEQ ID NO: 376698 - DNA, 25 bp, Mus musculus
tgcgtggcttccggatcctttgtgt

SEQ ID NO: 376699 - DNA, 25 bp, Mus musculus
tgcgtgggagtcgagagactgacca

SEQ ID NO: 376700 - DNA, 25 bp, Mus musculus
tgcgtgggagtcgagttctaaaaca

SEQ ID NO: 376701 - DNA, 25 bp, Mus musculus
tgcgtggtcagcatgattcgattct

SEQ ID NO: 376702 - DNA, 25 bp, Mus musculus
tgcgtgtaacagatgctccatcctc

SEQ ID NO: 376703 - DNA, 25 bp, Mus musculus
tgcgtgtaacaggggctccttattg

SEQ ID NO: 376704 - DNA, 25 bp, Mus musculus
tgcgtgtcacccgcggttcctgaga

SEQ ID NO: 376705 - DNA, 25 bp, Mus musculus
tgcgtgtcagaaaatgagcttggtg

SEQ ID NO: 376706 - DNA, 25 bp, Mus musculus
tgcgtgtgagcgtggcacaagactt

SEQ ID NO: 376707 - DNA, 25 bp, Mus musculus
tgcgtgttgctggatgagtattgga

SEQ ID NO: 376708 - DNA, 25 bp, Mus musculus
tgcgtgttgctggctgccatgccta

SEQ ID NO: 376709 - DNA, 25 bp, Mus musculus
tgcgtgttgctggctggattgcctt

SEQ ID NO: 376710 - DNA, 25 bp, Mus musculus
tgcgtgttggtcgcctctctgcctt

SEQ ID NO: 376711 - DNA, 25 bp, Mus musculus
tgcgtgttggtcgcgggggttctac

SEQ ID NO: 376712 - DNA, 25 bp, Mus musculus
tgcgttaattgaacactgttaattt

SEQ ID NO: 376713 - DNA, 25 bp, Mus musculus
tgcgttagactcagaggagctgtga

SEQ ID NO: 376714 - DNA, 25 bp, Mus musculus
tgcgttagactcagagtcataaggt

SEQ ID NO: 376715 - DNA, 25 bp, Mus musculus
tgcgttagatctggctctgttgctg

SEQ ID NO: 376716 - DNA, 25 bp, Mus musculus
tgcgttatcagagtgaagccataga

SEQ ID NO: 376717 - DNA, 25 bp, Mus musculus
tgcgttatcgagcctactagttcaa

SEQ ID NO: 376718 - DNA, 25 bp, Mus musculus
tgcgttatcgaggaaagcatgtgga

SEQ ID NO: 376719 - DNA, 25 bp, Mus musculus
tgcgttatcgaggtaatatatataa

SEQ ID NO: 376720 - DNA, 25 bp, Mus musculus
tgcgttcacagagtgcaaattcacc

SEQ ID NO: 376721 - DNA, 25 bp, Mus musculus
tgcgttcactgaggcagttgcacct

SEQ ID NO: 376722 - DNA, 25 bp, Mus musculus
tgcgttcaggaggcagactccgggg

SEQ ID NO: 376723 - DNA, 25 bp, Mus musculus
tgcgttcccggctgtcactgagcac

SEQ ID NO: 376724 - DNA, 25 bp, Mus musculus
tgcgttcttcacaggtggcttctgc

SEQ ID NO: 376725 - DNA, 25 bp, Mus musculus
tgcgttgcaggtctccgggactcag

SEQ ID NO: 376726 - DNA, 25 bp, Mus musculus
tgcgttgggatcagattgataagta

SEQ ID NO: 376727 - DNA, 25 bp, Mus musculus
tgcgtttcagagggcccatagcctg

SEQ ID NO: 376728 - DNA, 25 bp, Mus musculus
tgcgtttctcccctgctcctctcca

SEQ ID NO: 376729 - DNA, 25 bp, Mus musculus
tgcgtttttcaaggatgtcactgat

SEQ ID NO: 376730 - DNA, 25 bp, Mus musculus
tgcgtttttcaagtatgaagtcaga

SEQ ID NO: 376731 - DNA, 25 bp, Mus musculus
tgctaaaagctctgggggtgaacat

SEQ ID NO: 376732 - DNA, 25 bp, Mus musculus
tgctaaaattacaagttgatcgtgt

SEQ ID NO: 376733 - DNA, 25 bp, Mus musculus
tgctaaacagcatccagggaaatga

SEQ ID NO: 376734 - DNA, 25 bp, Mus musculus
tgctaaaccattgctggcctcgaac

SEQ ID NO: 376735 - DNA, 25 bp, Mus musculus
tgctaaactgcaacacggctaagga

SEQ ID NO: 376736 - DNA, 25 bp, Mus musculus
tgctaaagcatgaccccgtggccct

SEQ ID NO: 376737 - DNA, 25 bp, Mus musculus
tgctaaaggaagacttcgctgatga

SEQ ID NO: 376738 - DNA, 25 bp, Mus musculus
tgctaaaggactggaaaggagacaa

SEQ ID NO: 376739 - DNA, 25 bp, Mus musculus
tgctaaagggagaaaagacatgctc

SEQ ID NO: 376740 - DNA, 25 bp, Mus musculus
tgctaaaggggaagaaaagacatgc

SEQ ID NO: 376741 - DNA, 25 bp, Mus musculus
tgctaaaggggaagtgaaatcttgt

SEQ ID NO: 376742 - DNA, 25 bp, Mus musculus
tgctaaatacaatgcctttaacttg

SEQ ID NO: 376743 - DNA, 25 bp, Mus musculus
tgctaaatatgttctagaagcccat

SEQ ID NO: 376744 - DNA, 25 bp, Mus musculus
tgctaacaacaacacctcgtccagt

SEQ ID NO: 376745 - DNA, 25 bp, Mus musculus
tgctaacaagagtgaaattccacaa

SEQ ID NO: 376746 - DNA, 25 bp, Mus musculus
tgctaacaatgagccgtggaagaag

SEQ ID NO: 376747 - DNA, 25 bp, Mus musculus
tgctaacacagttgctcctgaattc

SEQ ID NO: 376748 - DNA, 25 bp, Mus musculus
tgctaacaggaaaaattctccctgg

SEQ ID NO: 376749 - DNA, 25 bp, Mus musculus
tgctaacatcttcctggcttctgct

SEQ ID NO: 376750 - DNA, 25 bp, Mus musculus
tgctaactctaaactgcgaggccaa

SEQ ID NO: 376751 - DNA, 25 bp, Mus musculus
tgctaactctagcatatgaaacttc

SEQ ID NO: 376752 - DNA, 25 bp, Mus musculus
tgctaactgaaatggcaaagaagta

SEQ ID NO: 376753 - DNA, 25 bp, Mus musculus
tgctaactgagaccatgcagaggcc

SEQ ID NO: 376754 - DNA, 25 bp, Mus musculus
tgctaactttccactatttgctgcc

SEQ ID NO: 376755 - DNA, 25 bp, Mus musculus
tgctaagaaataagcagatccttgt

SEQ ID NO: 376756 - DNA, 25 bp, Mus musculus
tgctaagaaataaggatcgttcatc

SEQ ID NO: 376757 - DNA, 25 bp, Mus musculus
tgctaagaaggattcatggttggca

SEQ ID NO: 376758 - DNA, 25 bp, Mus musculus
tgctaagaagggtgctcacttcgtc

SEQ ID NO: 376759 - DNA, 25 bp, Mus musculus
tgctaagatggcagttgggttctga

SEQ ID NO: 376760 - DNA, 25 bp, Mus musculus
tgctaagcaactccgcctccctgcc

SEQ ID NO: 376761 - DNA, 25 bp, Mus musculus
tgctaagcaactccggagcctggtg

SEQ ID NO: 376762 - DNA, 25 bp, Mus musculus
tgctaagcccaaacttgcacgagcc

SEQ ID NO: 376763 - DNA, 25 bp, Mus musculus
tgctaaggaacaagactgggatcag

SEQ ID NO: 376764 - DNA, 25 bp, Mus musculus
tgctaaggatcctgaccccgaactt

SEQ ID NO: 376765 - DNA, 25 bp, Mus musculus
tgctaaggatgatctgatgatgagg

SEQ ID NO: 376766 - DNA, 25 bp, Mus musculus
tgctaagggaagatacacctatggc

SEQ ID NO: 376767 - DNA, 25 bp, Mus musculus
tgctaaggggcacctggccacattc

SEQ ID NO: 376768 - DNA, 25 bp, Mus musculus
tgctaagtacacaaatgatgacttc

SEQ ID NO: 376769 - DNA, 25 bp, Mus musculus
tgctaataagattgagtctgtttct

SEQ ID NO: 376770 - DNA, 25 bp, Mus musculus
tgctaataaggggttgatagtcctt

SEQ ID NO: 376771 - DNA, 25 bp, Mus musculus
tgctaatccgaataatttaaaaatg

SEQ ID NO: 376772 - DNA, 25 bp, Mus musculus
tgctaatctaggtcttgccgtggaa

SEQ ID NO: 376773 - DNA, 25 bp, Mus musculus
tgctaatgaagcaagtgtggaggca

SEQ ID NO: 376774 - DNA, 25 bp, Mus musculus
tgctaatgagactcagtccgctagt

SEQ ID NO: 376775 - DNA, 25 bp, Mus musculus
tgctaatgatcaaagcgctgcaggg

SEQ ID NO: 376776 - DNA, 25 bp, Mus musculus
tgctaatgatcaacggttccagttt

SEQ ID NO: 376777 - DNA, 25 bp, Mus musculus
tgctaatgcactgtctcaaaatcaa

SEQ ID NO: 376778 - DNA, 25 bp, Mus musculus
tgctaatgtcaacagaccgctccgg

SEQ ID NO: 376779 - DNA, 25 bp, Mus musculus
tgctaatgtcagcagaccgctccgg

SEQ ID NO: 376780 - DNA, 25 bp, Mus musculus
tgctaattcatacagattcatctga

SEQ ID NO: 376781 - DNA, 25 bp, Mus musculus
tgctaattcatacaggtcccatggc

SEQ ID NO: 376782 - DNA, 25 bp, Mus musculus
tgctacaaaagatttaaagatgacc

SEQ ID NO: 376783 - DNA, 25 bp, Mus musculus
tgctacaaaagcagcagcaacagaa

SEQ ID NO: 376784 - DNA, 25 bp, Mus musculus
tgctacaaagacatccttctacggt

SEQ ID NO: 376785 - DNA, 25 bp, Mus musculus
tgctacaaaggaaagaattgaatac

SEQ ID NO: 376786 - DNA, 25 bp, Mus musculus
tgctacaacaaaactacagacagtc

SEQ ID NO: 376787 - DNA, 25 bp, Mus musculus
tgctacaacgctaacagttcctttt

SEQ ID NO: 376788 - DNA, 25 bp, Mus musculus
tgctacaacttcaggaaaagctcct

SEQ ID NO: 376789 - DNA, 25 bp, Mus musculus
tgctacaagcacaactcctaatagt

SEQ ID NO: 376790 - DNA, 25 bp, Mus musculus
tgctacaaggaggatctcagtaaga

SEQ ID NO: 376791 - DNA, 25 bp, Mus musculus
tgctacacaaatggctacacggatg

SEQ ID NO: 376792 - DNA, 25 bp, Mus musculus
tgctacacagcctcttgccagccag

SEQ ID NO: 376793 - DNA, 25 bp, Mus musculus
tgctacaccccctcacgcctcacag

SEQ ID NO: 376794 - DNA, 25 bp, Mus musculus
tgctacacgaggtgcagtgggtggt

SEQ ID NO: 376795 - DNA, 25 bp, Mus musculus
tgctacacgagtgggtggtgcaaag

SEQ ID NO: 376796 - DNA, 25 bp, Mus musculus
tgctacagagagcagattctgccct

SEQ ID NO: 376797 - DNA, 25 bp, Mus musculus
tgctacagaggttgcaagtgttgat

SEQ ID NO: 376798 - DNA, 25 bp, Mus musculus
tgctacagagtggccaccctttgtg

SEQ ID NO: 376799 - DNA, 25 bp, Mus musculus
tgctacagcctcagatgaaatcatg

SEQ ID NO: 376800 - DNA, 25 bp, Mus musculus
tgctacagctgggctgggaggatcg

SEQ ID NO: 376801 - DNA, 25 bp, Mus musculus
tgctacagcttggggaagggaacat

SEQ ID NO: 376802 - DNA, 25 bp, Mus musculus
tgctacaggaggatctaagatgtcc

SEQ ID NO: 376803 - DNA, 25 bp, Mus musculus
tgctacatcggaggaaatgaggcca

SEQ ID NO: 376804 - DNA, 25 bp, Mus musculus
tgctacattaatgccaccctgcagg

SEQ ID NO: 376805 - DNA, 25 bp, Mus musculus
tgctacattggctggggctccaacg

SEQ ID NO: 376806 - DNA, 25 bp, Mus musculus
tgctacattggctggtgtcccttct

SEQ ID NO: 376807 - DNA, 25 bp, Mus musculus
tgctaccaacaagtatgaggtagac

SEQ ID NO: 376808 - DNA, 25 bp, Mus musculus
tgctaccacacaaggtttgacggat

SEQ ID NO: 376809 - DNA, 25 bp, Mus musculus
tgctaccacagccgctagtcagaca

SEQ ID NO: 376810 - DNA, 25 bp, Mus musculus
tgctaccacaggagccgaaagcgtg

SEQ ID NO: 376811 - DNA, 25 bp, Mus musculus
tgctaccactcaggctctcgccttg

SEQ ID NO: 376812 - DNA, 25 bp, Mus musculus
tgctaccataggagactacacggac

SEQ ID NO: 376813 - DNA, 25 bp, Mus musculus
tgctaccataggctccacttacctg

SEQ ID NO: 376814 - DNA, 25 bp, Mus musculus
tgctacccaagcagggtggccactg

SEQ ID NO: 376815 - DNA, 25 bp, Mus musculus
tgctaccccggcaaagctgttgctg

SEQ ID NO: 376816 - DNA, 25 bp, Mus musculus
tgctacccttctggttctttgtgtg

SEQ ID NO: 376817 - DNA, 25 bp, Mus musculus
tgctacctacggctctcttaagagc

SEQ ID NO: 376818 - DNA, 25 bp, Mus musculus
tgctacctacggggaacttgaaata

SEQ ID NO: 376819 - DNA, 25 bp, Mus musculus
tgctacctactagagccggagaaca

SEQ ID NO: 376820 - DNA, 25 bp, Mus musculus
tgctacctcagtctcacggatgatt

SEQ ID NO: 376821 - DNA, 25 bp, Mus musculus
tgctacctgcagggctgaccagctg

SEQ ID NO: 376822 - DNA, 25 bp, Mus musculus
tgctacctggaagaagccctgcaga

SEQ ID NO: 376823 - DNA, 25 bp, Mus musculus
tgctacctggaagagtgcctgctca

SEQ ID NO: 376824 - DNA, 25 bp, Mus musculus
tgctaccttaggatcgagcggtcca

SEQ ID NO: 376825 - DNA, 25 bp, Mus musculus
tgctaccttcaagatgctgtcccct

SEQ ID NO: 376826 - DNA, 25 bp, Mus musculus
tgctacgatagccatgagggcagaa

SEQ ID NO: 376827 - DNA, 25 bp, Mus musculus
tgctacgatagccattcccttcagg

SEQ ID NO: 376828 - DNA, 25 bp, Mus musculus
tgctacgataggtacctgtgtcgtg

SEQ ID NO: 376829 - DNA, 25 bp, Mus musculus
tgctacgcaggggaaatcctggccg

SEQ ID NO: 376830 - DNA, 25 bp, Mus musculus
tgctacggaggtgccttagctggat

SEQ ID NO: 376831 - DNA, 25 bp, Mus musculus
tgctacggcacagtgcttgctgaat

SEQ ID NO: 376832 - DNA, 25 bp, Mus musculus
tgctacggccgcactcggaacccac

SEQ ID NO: 376833 - DNA, 25 bp, Mus musculus
tgctacgtgagaacttgaagcaaga

SEQ ID NO: 376834 - DNA, 25 bp, Mus musculus
tgctacgtgagtttttcagattatc

SEQ ID NO: 376835 - DNA, 25 bp, Mus musculus
tgctactactgtgctgaggagacca

SEQ ID NO: 376836 - DNA, 25 bp, Mus musculus
tgctactcaggggcagttggtgacc

SEQ ID NO: 376837 - DNA, 25 bp, Mus musculus
tgctactccaggtttcttgaactcc

SEQ ID NO: 376838 - DNA, 25 bp, Mus musculus
tgctactccccagaagtctggagag

SEQ ID NO: 376839 - DNA, 25 bp, Mus musculus
tgctactcgcggttcccagagctag

SEQ ID NO: 376840 - DNA, 25 bp, Mus musculus
tgctactgaaccacaagaacccatg

SEQ ID NO: 376841 - DNA, 25 bp, Mus musculus
tgctactgatagttgccttatcttc

SEQ ID NO: 376842 - DNA, 25 bp, Mus musculus
tgctactgatagttgcggatgacgg

SEQ ID NO: 376843 - DNA, 25 bp, Mus musculus
tgctactgatctgtgctctaccgtg

SEQ ID NO: 376844 - DNA, 25 bp, Mus musculus
tgctactgatctgtggtgctgcaca

SEQ ID NO: 376845 - DNA, 25 bp, Mus musculus
tgctactgcaggggagccctatcat

SEQ ID NO: 376846 - DNA, 25 bp, Mus musculus
tgctactgcaggtaaatgagatcaa

SEQ ID NO: 376847 - DNA, 25 bp, Mus musculus
tgctactgctatggagcggaattcc

SEQ ID NO: 376848 - DNA, 25 bp, Mus musculus
tgctactgctatgggtttcagtccc

SEQ ID NO: 376849 - DNA, 25 bp, Mus musculus
tgctactggatacaggggtctgtga

SEQ ID NO: 376850 - DNA, 25 bp, Mus musculus
tgctactgtgcgcaatggatctgtc

SEQ ID NO: 376851 - DNA, 25 bp, Mus musculus
tgctacttctcctggacgtgcgacc

SEQ ID NO: 376852 - DNA, 25 bp, Mus musculus
tgctacttctcctggcaacgatatc

SEQ ID NO: 376853 - DNA, 25 bp, Mus musculus
tgctacttctctgtcagcacagggt

SEQ ID NO: 376854 - DNA, 25 bp, Mus musculus
tgctacttggccttgatgaggagtg

SEQ ID NO: 376855 - DNA, 25 bp, Mus musculus
tgctagaaacaaaggctagtctacc

SEQ ID NO: 376856 - DNA, 25 bp, Mus musculus
tgctagaacagaaactgcagttggt

SEQ ID NO: 376857 - DNA, 25 bp, Mus musculus
tgctagaattcgatttcagaaatat

SEQ ID NO: 376858 - DNA, 25 bp, Mus musculus
tgctagaattcggtgggctggtatg

SEQ ID NO: 376859 - DNA, 25 bp, Mus musculus
tgctagacaagtgctacgttgaaga

SEQ ID NO: 376860 - DNA, 25 bp, Mus musculus
tgctagacaggcttgtgttgcggag

SEQ ID NO: 376861 - DNA, 25 bp, Mus musculus
tgctagaccctggagggaagggtgg

SEQ ID NO: 376862 - DNA, 25 bp, Mus musculus
tgctagacgtggctgtgagtcctga

SEQ ID NO: 376863 - DNA, 25 bp, Mus musculus
tgctagagaaggagctggagcagag

SEQ ID NO: 376864 - DNA, 25 bp, Mus musculus
tgctagagacggtcgctcgcattcg

SEQ ID NO: 376865 - DNA, 25 bp, Mus musculus
tgctagagcgcatcccagcctttac

SEQ ID NO: 376866 - DNA, 25 bp, Mus musculus
tgctagagcgtgtgggcatcgttct

SEQ ID NO: 376867 - DNA, 25 bp, Mus musculus
tgctagataaggtcctggagacctt

SEQ ID NO: 376868 - DNA, 25 bp, Mus musculus
tgctagataaggtcctggaggagga

SEQ ID NO: 376869 - DNA, 25 bp, Mus musculus
tgctagcagagcaggatccaagtga

SEQ ID NO: 376870 - DNA, 25 bp, Mus musculus
tgctagcatcagggcccatttggag

SEQ ID NO: 376871 - DNA, 25 bp, Mus musculus
tgctagccaagatatcaacctgaat

SEQ ID NO: 376872 - DNA, 25 bp, Mus musculus
tgctagccaaggtgctggattaaaa

SEQ ID NO: 376873 - DNA, 25 bp, Mus musculus
tgctagcgaaccagtaatggtcagc

SEQ ID NO: 376874 - DNA, 25 bp, Mus musculus
tgctagctctggtacacctacacag

SEQ ID NO: 376875 - DNA, 25 bp, Mus musculus
tgctagctgaggaacatctgattgc

SEQ ID NO: 376876 - DNA, 25 bp, Mus musculus
tgctagctgggcaagatggtgtcac

SEQ ID NO: 376877 - DNA, 25 bp, Mus musculus
tgctaggaacaaagagaacctgcac

SEQ ID NO: 376878 - DNA, 25 bp, Mus musculus
tgctaggaacaaagagaccccgagg

SEQ ID NO: 376879 - DNA, 25 bp, Mus musculus
tgctaggaacaaaggtcaggtgccc

SEQ ID NO: 376880 - DNA, 25 bp, Mus musculus
tgctaggagacaaggtgagccctag

SEQ ID NO: 376881 - DNA, 25 bp, Mus musculus
tgctaggagcagagatcaagttctt

SEQ ID NO: 376882 - DNA, 25 bp, Mus musculus
tgctaggagcggtgtcctgtgccat

SEQ ID NO: 376883 - DNA, 25 bp, Mus musculus
tgctaggatttcagtttacccatca

SEQ ID NO: 376884 - DNA, 25 bp, Mus musculus
tgctaggcctccaggaggaccttgt

SEQ ID NO: 376885 - DNA, 25 bp, Mus musculus
tgctaggcctccaggaggagactcc

SEQ ID NO: 376886 - DNA, 25 bp, Mus musculus
tgctagggttaaaggagacattcca

SEQ ID NO: 376887 - DNA, 25 bp, Mus musculus
tgctaggtgttccctgctgctctca

SEQ ID NO: 376888 - DNA, 25 bp, Mus musculus
tgctagtactggaaggaaggtgcac

SEQ ID NO: 376889 - DNA, 25 bp, Mus musculus
tgctagtagtgacaggacactactg

SEQ ID NO: 376890 - DNA, 25 bp, Mus musculus
tgctagtcaccatcctgtcctactg

SEQ ID NO: 376891 - DNA, 25 bp, Mus musculus
tgctagtggacactagactacatcg

SEQ ID NO: 376892 - DNA, 25 bp, Mus musculus
tgctagtggagatgccgttcctatg

SEQ ID NO: 376893 - DNA, 25 bp, Mus musculus
tgctagtggagcaccaaggagtttc

SEQ ID NO: 376894 - DNA, 25 bp, Mus musculus
tgctagtggaggagtttcatttctg

SEQ ID NO: 376895 - DNA, 25 bp, Mus musculus
tgctagtggagggggttacaactaa

SEQ ID NO: 376896 - DNA, 25 bp, Mus musculus
tgctagtggagtgcactgaggccaa

SEQ ID NO: 376897 - DNA, 25 bp, Mus musculus
tgctagttggaaggctccgcccact

SEQ ID NO: 376898 - DNA, 25 bp, Mus musculus
tgctataaagaaactacataaagca

SEQ ID NO: 376899 - DNA, 25 bp, Mus musculus
tgctataaagcagtatcgtcatctg

SEQ ID NO: 376900 - DNA, 25 bp, Mus musculus
tgctataaaggacttagaagtctgc

SEQ ID NO: 376901 - DNA, 25 bp, Mus musculus
tgctatacctcacaggtgatccact

SEQ ID NO: 376902 - DNA, 25 bp, Mus musculus
tgctatacgaaggggctcctgggct

SEQ ID NO: 376903 - DNA, 25 bp, Mus musculus
tgctatagaaacgggttctgctgcc

SEQ ID NO: 376904 - DNA, 25 bp, Mus musculus
tgctatagaaggtaattacactctt

SEQ ID NO: 376905 - DNA, 25 bp, Mus musculus
tgctatagagctgtcatagcctgtc

SEQ ID NO: 376906 - DNA, 25 bp, Mus musculus
tgctatagagtcgacaagcagtgat

SEQ ID NO: 376907 - DNA, 25 bp, Mus musculus
tgctatagagtctggattttcctgg

SEQ ID NO: 376908 - DNA, 25 bp, Mus musculus
tgctataggaggatctcccagaagc

SEQ ID NO: 376909 - DNA, 25 bp, Mus musculus
tgctatcaaggtgcagagcccctct

SEQ ID NO: 376910 - DNA, 25 bp, Mus musculus
tgctatcatgcgtgagtgcatctcc

SEQ ID NO: 376911 - DNA, 25 bp, Mus musculus
tgctatccacgcagcctctgcctcg

SEQ ID NO: 376912 - DNA, 25 bp, Mus musculus
tgctatccacgcagctgccccttac

SEQ ID NO: 376913 - DNA, 25 bp, Mus musculus
tgctatccagatgtacgtgccctgg

SEQ ID NO: 376914 - DNA, 25 bp, Mus musculus
tgctatccctggctccctcatcagc

SEQ ID NO: 376915 - DNA, 25 bp, Mus musculus
tgctatcctaagtgatgtgccagca

SEQ ID NO: 376916 - DNA, 25 bp, Mus musculus
tgctatcgagatggtgacttgccgt

SEQ ID NO: 376917 - DNA, 25 bp, Mus musculus
tgctatcgaggtttttaagcctatg

SEQ ID NO: 376918 - DNA, 25 bp, Mus musculus
tgctatcgtggatggagacaggatt

SEQ ID NO: 376919 - DNA, 25 bp, Mus musculus
tgctatctacagtgggcagcaaaga

SEQ ID NO: 376920 - DNA, 25 bp, Mus musculus
tgctatctacagtgggccggcggcc

SEQ ID NO: 376921 - DNA, 25 bp, Mus musculus
tgctatctaccacaaatattatcac

SEQ ID NO: 376922 - DNA, 25 bp, Mus musculus
tgctatctaccacaacctgaagaac

SEQ ID NO: 376923 - DNA, 25 bp, Mus musculus
tgctatctggcaagagcggcctcgg

SEQ ID NO: 376924 - DNA, 25 bp, Mus musculus
tgctatctgttatgaaacaaatgtc

SEQ ID NO: 376925 - DNA, 25 bp, Mus musculus
tgctatgaacaccctccttgacggc

SEQ ID NO: 376926 - DNA, 25 bp, Mus musculus
tgctatgaacctgcagccagcagcc

SEQ ID NO: 376927 - DNA, 25 bp, Mus musculus
tgctatgaacgagcagttttggcaa

SEQ ID NO: 376928 - DNA, 25 bp, Mus musculus
tgctatgaagctacctacagccagc

SEQ ID NO: 376929 - DNA, 25 bp, Mus musculus
tgctatgaagctctggccatgggca

SEQ ID NO: 376930 - DNA, 25 bp, Mus musculus
tgctatgaaggtgaagcttccctca

SEQ ID NO: 376931 - DNA, 25 bp, Mus musculus
tgctatgactagagacctgcagggg

SEQ ID NO: 376932 - DNA, 25 bp, Mus musculus
tgctatgaggagggtattcctacat

SEQ ID NO: 376933 - DNA, 25 bp, Mus musculus
tgctatgatcaacgcctgtagggac

SEQ ID NO: 376934 - DNA, 25 bp, Mus musculus
tgctatgcaaaagttatgatggtta

SEQ ID NO: 376935 - DNA, 25 bp, Mus musculus
tgctatgcccagaacatcccaaccc

SEQ ID NO: 376936 - DNA, 25 bp, Mus musculus
tgctatgctaagtatgagagccaga

SEQ ID NO: 376937 - DNA, 25 bp, Mus musculus
tgctatgctatcgagatggtgactt

SEQ ID NO: 376938 - DNA, 25 bp, Mus musculus
tgctatgctatcgaggtttttaagc

SEQ ID NO: 376939 - DNA, 25 bp, Mus musculus
tgctatgctgataaggccttgctca

SEQ ID NO: 376940 - DNA, 25 bp, Mus musculus
tgctatggagtgcctttctttctgc

SEQ ID NO: 376941 - DNA, 25 bp, Mus musculus
tgctatggatggtgctttgcaagga

SEQ ID NO: 376942 - DNA, 25 bp, Mus musculus
tgctatggcaaccagtataatgttt

SEQ ID NO: 376943 - DNA, 25 bp, Mus musculus
tgctatggcaatgacaccagccagc

SEQ ID NO: 376944 - DNA, 25 bp, Mus musculus
tgctatggctctcattattttcaca

SEQ ID NO: 376945 - DNA, 25 bp, Mus musculus
tgctatggcttaagaccgaagggag

SEQ ID NO: 376946 - DNA, 25 bp, Mus musculus
tgctatggcttaagggaccgacgtc

SEQ ID NO: 376947 - DNA, 25 bp, Mus musculus
tgctatgggttcaggttctgccacc

SEQ ID NO: 376948 - DNA, 25 bp, Mus musculus
tgctatgtcagaaggcttatcaggt

SEQ ID NO: 376949 - DNA, 25 bp, Mus musculus
tgctatgtcaggaaaccatccaatg

SEQ ID NO: 376950 - DNA, 25 bp, Mus musculus
tgctatgtcgaccagtatgaggttt

SEQ ID NO: 376951 - DNA, 25 bp, Mus musculus
tgctatgtgaaggtgctcctggtca

SEQ ID NO: 376952 - DNA, 25 bp, Mus musculus
tgctattaaagctggtgagaaatgc

SEQ ID NO: 376953 - DNA, 25 bp, Mus musculus
tgctattaagatcgagttctctaag

SEQ ID NO: 376954 - DNA, 25 bp, Mus musculus
tgctattatcatagaccttcaggca

SEQ ID NO: 376955 - DNA, 25 bp, Mus musculus
tgctattatcatgatactaccacaa

SEQ ID NO: 376956 - DNA, 25 bp, Mus musculus
tgctattcaaaacagcgtggaagat

SEQ ID NO: 376957 - DNA, 25 bp, Mus musculus
tgctattccaaagatactggcattg

SEQ ID NO: 376958 - DNA, 25 bp, Mus musculus
tgctattctacaggaaaaatccgct

SEQ ID NO: 376959 - DNA, 25 bp, Mus musculus
tgctattctgcatctgagtgggaac

SEQ ID NO: 376960 - DNA, 25 bp, Mus musculus
tgctattgatggaaaagggttcctt

SEQ ID NO: 376961 - DNA, 25 bp, Mus musculus
tgctattgcagaggtggcttttgca

SEQ ID NO: 376962 - DNA, 25 bp, Mus musculus
tgctattgcaggtttcctggcagaa

SEQ ID NO: 376963 - DNA, 25 bp, Mus musculus
tgctattgctcaggccctggcacat

SEQ ID NO: 376964 - DNA, 25 bp, Mus musculus
tgctattggcttctcccatgatgac

SEQ ID NO: 376965 - DNA, 25 bp, Mus musculus
tgctatttgaccatctgttctgtgc

SEQ ID NO: 376966 - DNA, 25 bp, Mus musculus
tgctatttgcgtagccgcctgtgtg

SEQ ID NO: 376967 - DNA, 25 bp, Mus musculus
tgctcaaacaagtgtgatgctctgc

SEQ ID NO: 376968 - DNA, 25 bp, Mus musculus
tgctcaaacaggctctggaaaaact

SEQ ID NO: 376969 - DNA, 25 bp, Mus musculus
tgctcaaagccatggtttgactctg

SEQ ID NO: 376970 - DNA, 25 bp, Mus musculus
tgctcaaattcggggcttcctcgag

SEQ ID NO: 376971 - DNA, 25 bp, Mus musculus
tgctcaaattcggtgcagcccggaa

SEQ ID NO: 376972 - DNA, 25 bp, Mus musculus
tgctcaacagccatctccagtggct

SEQ ID NO: 376973 - DNA, 25 bp, Mus musculus
tgctcaacaggacttggatgttgtg

SEQ ID NO: 376974 - DNA, 25 bp, Mus musculus
tgctcaacaggctcacaccactcgt

SEQ ID NO: 376975 - DNA, 25 bp, Mus musculus
tgctcaaccagacgcacctctagta

SEQ ID NO: 376976 - DNA, 25 bp, Mus musculus
tgctcaaccagatccttgcatgaac

SEQ ID NO: 376977 - DNA, 25 bp, Mus musculus
tgctcaaccagggcatcgttctgcc

SEQ ID NO: 376978 - DNA, 25 bp, Mus musculus
tgctcaaccagtggacatatcaggc

SEQ ID NO: 376979 - DNA, 25 bp, Mus musculus
tgctcaacctgctggttggtgggga

SEQ ID NO: 376980 - DNA, 25 bp, Mus musculus
tgctcaactatgcttaactgcggat

SEQ ID NO: 376981 - DNA, 25 bp, Mus musculus
tgctcaactggctgttggaaagcct

SEQ ID NO: 376982 - DNA, 25 bp, Mus musculus
tgctcaagctgcaggaggaggcaaa

SEQ ID NO: 376983 - DNA, 25 bp, Mus musculus
tgctcaagtgtaagagtgtgtttga

SEQ ID NO: 376984 - DNA, 25 bp, Mus musculus
tgctcaagttcgattggatccgaga

SEQ ID NO: 376985 - DNA, 25 bp, Mus musculus
tgctcaagttcttctctgtgttcct

SEQ ID NO: 376986 - DNA, 25 bp, Mus musculus
tgctcaatgacgcctgggtcctaaa

SEQ ID NO: 376987 - DNA, 25 bp, Mus musculus
tgctcaattttaaggcagtgtgtga

SEQ ID NO: 376988 - DNA, 25 bp, Mus musculus
tgctcacaaaacaggagacatttga

SEQ ID NO: 376989 - DNA, 25 bp, Mus musculus
tgctcacaaggtgcagacctgaagg

SEQ ID NO: 376990 - DNA, 25 bp, Mus musculus
tgctcaccaagagctttgtaaatgg

SEQ ID NO: 376991 - DNA, 25 bp, Mus musculus
tgctcaccagtttgacttcggagga

SEQ ID NO: 376992 - DNA, 25 bp, Mus musculus
tgctcaccatggcagaacctgcaac

SEQ ID NO: 376993 - DNA, 25 bp, Mus musculus
tgctcaccattggagaccggtttgg

SEQ ID NO: 376994 - DNA, 25 bp, Mus musculus
tgctcacccacagagtgctgaccta

SEQ ID NO: 376995 - DNA, 25 bp, Mus musculus
tgctcacccagagcttgtcaatgtc

SEQ ID NO: 376996 - DNA, 25 bp, Mus musculus
tgctcacctgcggcttgggtgactc

SEQ ID NO: 376997 - DNA, 25 bp, Mus musculus
tgctcactgccaaggggacaatgac

SEQ ID NO: 376998 - DNA, 25 bp, Mus musculus
tgctcactgccaaggtgaaagcagc

SEQ ID NO: 376999 - DNA, 25 bp, Mus musculus
tgctcactggaagagccgcccgcac

SEQ ID NO: 377000 - DNA, 25 bp, Mus musculus
tgctcactggaagagcctcagaaac

SEQ ID NO: 377001 - DNA, 25 bp, Mus musculus
tgctcactggatcgccgcccttcac

SEQ ID NO: 377002 - DNA, 25 bp, Mus musculus
tgctcagaacgaaccaagaattgtc

SEQ ID NO: 377003 - DNA, 25 bp, Mus musculus
tgctcagaacggatcaataagccaa

SEQ ID NO: 377004 - DNA, 25 bp, Mus musculus
tgctcagaagaaacctgctcggtac

SEQ ID NO: 377005 - DNA, 25 bp, Mus musculus
tgctcagaagccaagctgctgcatt

SEQ ID NO: 377006 - DNA, 25 bp, Mus musculus
tgctcagaaggctcaggaggcatgt

SEQ ID NO: 377007 - DNA, 25 bp, Mus musculus
tgctcagaagtttgcagggacatgg

SEQ ID NO: 377008 - DNA, 25 bp, Mus musculus
tgctcagacaaagatgggctacacc

SEQ ID NO: 377009 - DNA, 25 bp, Mus musculus
tgctcagacagccgtgcttatggag

SEQ ID NO: 377010 - DNA, 25 bp, Mus musculus
tgctcagacttggatacccttctgc

SEQ ID NO: 377011 - DNA, 25 bp, Mus musculus
tgctcagagaccgcaatctcactgg

SEQ ID NO: 377012 - DNA, 25 bp, Mus musculus
tgctcagagaccgcaatgtgtatgt

SEQ ID NO: 377013 - DNA, 25 bp, Mus musculus
tgctcagagagtcggcgtccctaca

SEQ ID NO: 377014 - DNA, 25 bp, Mus musculus
tgctcagagagtcgggtctgagtgc

SEQ ID NO: 377015 - DNA, 25 bp, Mus musculus
tgctcagagtggcctctcaaaggca

SEQ ID NO: 377016 - DNA, 25 bp, Mus musculus
tgctcagatggtttagacacgtgtg

SEQ ID NO: 377017 - DNA, 25 bp, Mus musculus
tgctcagcaaggctgagcgccgcgt

SEQ ID NO: 377018 - DNA, 25 bp, Mus musculus
tgctcagcaagggccgcgtgttgga

SEQ ID NO: 377019 - DNA, 25 bp, Mus musculus
tgctcagcagaatcgggttgagatt

SEQ ID NO: 377020 - DNA, 25 bp, Mus musculus
tgctcagcagaatggcactacaaga

SEQ ID NO: 377021 - DNA, 25 bp, Mus musculus
tgctcagcagccactctctacaaac

SEQ ID NO: 377022 - DNA, 25 bp, Mus musculus
tgctcagcagggataactctctgcc

SEQ ID NO: 377023 - DNA, 25 bp, Mus musculus
tgctcagcaggtttgggaaaaattc

SEQ ID NO: 377024 - DNA, 25 bp, Mus musculus
tgctcagccagctgagggagtatga

SEQ ID NO: 377025 - DNA, 25 bp, Mus musculus
tgctcagccttgaggtcccactgga

SEQ ID NO: 377026 - DNA, 25 bp, Mus musculus
tgctcagcgcttagcccggaagacc

SEQ ID NO: 377027 - DNA, 25 bp, Mus musculus
tgctcagcgtggagcccttggatga

SEQ ID NO: 377028 - DNA, 25 bp, Mus musculus
tgctcagcgtggagctgcagccctt

SEQ ID NO: 377029 - DNA, 25 bp, Mus musculus
tgctcagctcaggtactagaagaca

SEQ ID NO: 377030 - DNA, 25 bp, Mus musculus
tgctcagctctgctctaaagcaaat

SEQ ID NO: 377031 - DNA, 25 bp, Mus musculus
tgctcagctgcgcatcctgcctctg

SEQ ID NO: 377032 - DNA, 25 bp, Mus musculus
tgctcagctgcgtcggcacccagga

SEQ ID NO: 377033 - DNA, 25 bp, Mus musculus
tgctcaggaaaggactttcctggaa

SEQ ID NO: 377034 - DNA, 25 bp, Mus musculus
tgctcaggaacagccccacagcagc

SEQ ID NO: 377035 - DNA, 25 bp, Mus musculus
tgctcaggaacagtatcatcaacat

SEQ ID NO: 377036 - DNA, 25 bp, Mus musculus
tgctcaggaatgcaacttctcggta

SEQ ID NO: 377037 - DNA, 25 bp, Mus musculus
tgctcaggagatcatgcctcccgca

SEQ ID NO: 377038 - DNA, 25 bp, Mus musculus
tgctcaggagcacagcgagctggac

SEQ ID NO: 377039 - DNA, 25 bp, Mus musculus
tgctcaggagctcaacgagctggac

SEQ ID NO: 377040 - DNA, 25 bp, Mus musculus
tgctcagggcagccaagcctgagca

SEQ ID NO: 377041 - DNA, 25 bp, Mus musculus
tgctcagggcagtggtcctcatagt

SEQ ID NO: 377042 - DNA, 25 bp, Mus musculus
tgctcaggtcagcctccatgtactc

SEQ ID NO: 377043 - DNA, 25 bp, Mus musculus
tgctcaggtcccacgccctggcaca

SEQ ID NO: 377044 - DNA, 25 bp, Mus musculus
tgctcaggtgctcaggtgtgtgtga

SEQ ID NO: 377045 - DNA, 25 bp, Mus musculus
tgctcataaatcagccttacgatgg

SEQ ID NO: 377046 - DNA, 25 bp, Mus musculus
tgctcatagatgtaggtgaaaaatc

SEQ ID NO: 377047 - DNA, 25 bp, Mus musculus
tgctcatccagatctgcaacgggct

SEQ ID NO: 377048 - DNA, 25 bp, Mus musculus
tgctcatccagctcagcacattgca

SEQ ID NO: 377049 - DNA, 25 bp, Mus musculus
tgctcatccaggaacaacttccacg

SEQ ID NO: 377050 - DNA, 25 bp, Mus musculus
tgctcatccaggtgggatatgagcc

SEQ ID NO: 377051 - DNA, 25 bp, Mus musculus
tgctcatccgaagtatcctggagaa

SEQ ID NO: 377052 - DNA, 25 bp, Mus musculus
tgctcatccgctcccatctccagga

SEQ ID NO: 377053 - DNA, 25 bp, Mus musculus
tgctcatccgggccgtggaagcatc

SEQ ID NO: 377054 - DNA, 25 bp, Mus musculus
tgctcatgcaggtccatgcctcccg

SEQ ID NO: 377055 - DNA, 25 bp, Mus musculus
tgctcatggtagcgaccacctgcag

SEQ ID NO: 377056 - DNA, 25 bp, Mus musculus
tgctcattagcttttttccaggaaa

SEQ ID NO: 377057 - DNA, 25 bp, Mus musculus
tgctcattaggtgtgtgatagcacg

SEQ ID NO: 377058 - DNA, 25 bp, Mus musculus
tgctcattataggggtgatcctgta

SEQ ID NO: 377059 - DNA, 25 bp, Mus musculus
tgctcattcgaagatgttttcggtg

SEQ ID NO: 377060 - DNA, 25 bp, Mus musculus
tgctcattgtgattatgtgggtacg

SEQ ID NO: 377061 - DNA, 25 bp, Mus musculus
tgctcattgtggtactgataggttc

SEQ ID NO: 377062 - DNA, 25 bp, Mus musculus
tgctcatttatgataattagcacca

SEQ ID NO: 377063 - DNA, 25 bp, Mus musculus
tgctccaaaattcaggtgattgaca

SEQ ID NO: 377064 - DNA, 25 bp, Mus musculus
tgctccaaagagctttggcaatcca

SEQ ID NO: 377065 - DNA, 25 bp, Mus musculus
tgctccaacggcttcctgctttttc

SEQ ID NO: 377066 - DNA, 25 bp, Mus musculus
tgctccaagcctcagctgctgttgc

SEQ ID NO: 377067 - DNA, 25 bp, Mus musculus
tgctccaagcctcaggattcctcta

SEQ ID NO: 377068 - DNA, 25 bp, Mus musculus
tgctccaaggctacagctcccccat

SEQ ID NO: 377069 - DNA, 25 bp, Mus musculus
tgctccaaggggagcctcctttccc

SEQ ID NO: 377070 - DNA, 25 bp, Mus musculus
tgctccaatgcgatgcaaatcctct

SEQ ID NO: 377071 - DNA, 25 bp, Mus musculus
tgctccaatgcgatgctttggctca

SEQ ID NO: 377072 - DNA, 25 bp, Mus musculus
tgctccacagcacatttggtcagaa

SEQ ID NO: 377073 - DNA, 25 bp, Mus musculus
tgctccacaggtgttctacactcag

SEQ ID NO: 377074 - DNA, 25 bp, Mus musculus
tgctccaccttcaagcttcagaaca

SEQ ID NO: 377075 - DNA, 25 bp, Mus musculus
tgctccaccttcaatttggaaggcc

SEQ ID NO: 377076 - DNA, 25 bp, Mus musculus
tgctccacgcggtagcactcagcat

SEQ ID NO: 377077 - DNA, 25 bp, Mus musculus
tgctccacttctatcagcaatcccg

SEQ ID NO: 377078 - DNA, 25 bp, Mus musculus
tgctccagaaccagaaccggagtgt

SEQ ID NO: 377079 - DNA, 25 bp, Mus musculus
tgctccagaaccagtgtctgacagt

SEQ ID NO: 377080 - DNA, 25 bp, Mus musculus
tgctccagacgtcttgagagcagac

SEQ ID NO: 377081 - DNA, 25 bp, Mus musculus
tgctccagagcatctaaagaaaaag

SEQ ID NO: 377082 - DNA, 25 bp, Mus musculus
tgctccagagctacttctccttcag

SEQ ID NO: 377083 - DNA, 25 bp, Mus musculus
tgctccagagctgctctgcgtacaa

SEQ ID NO: 377084 - DNA, 25 bp, Mus musculus
tgctccagagctggagaagcggggg

SEQ ID NO: 377085 - DNA, 25 bp, Mus musculus
tgctccagagctggcaggacctaca

SEQ ID NO: 377086 - DNA, 25 bp, Mus musculus
tgctccagatgaagatccaggagga

SEQ ID NO: 377087 - DNA, 25 bp, Mus musculus
tgctccagatgaagtcaggaggcaa

SEQ ID NO: 377088 - DNA, 25 bp, Mus musculus
tgctccagatggcagcacacgccaa

SEQ ID NO: 377089 - DNA, 25 bp, Mus musculus
tgctccagcctgggagggcctagga

SEQ ID NO: 377090 - DNA, 25 bp, Mus musculus
tgctccagcggctgtgacagcgagc

SEQ ID NO: 377091 - DNA, 25 bp, Mus musculus
tgctccaggccccagctttggtggc

SEQ ID NO: 377092 - DNA, 25 bp, Mus musculus
tgctccagtaacagttacagaaacc

SEQ ID NO: 377093 - DNA, 25 bp, Mus musculus
tgctccagtatgcagattaagaaac

SEQ ID NO: 377094 - DNA, 25 bp, Mus musculus
tgctccagtccgttgtggggactga

SEQ ID NO: 377095 - DNA, 25 bp, Mus musculus
tgctccagttgtgagatgtggtgat

SEQ ID NO: 377096 - DNA, 25 bp, Mus musculus
tgctccatacatcagccctcgtggt

SEQ ID NO: 377097 - DNA, 25 bp, Mus musculus
tgctccatacatcagttttgcaggt

SEQ ID NO: 377098 - DNA, 25 bp, Mus musculus
tgctccatcggcgggctcctggcct

SEQ ID NO: 377099 - DNA, 25 bp, Mus musculus
tgctccatcggcggggaagtttggt

SEQ ID NO: 377100 - DNA, 25 bp, Mus musculus
tgctccatcttccaggagaaccaca

SEQ ID NO: 377101 - DNA, 25 bp, Mus musculus
tgctccattgacacaattgttccag

SEQ ID NO: 377102 - DNA, 25 bp, Mus musculus
tgctccattgacgatggcacgaaca

SEQ ID NO: 377103 - DNA, 25 bp, Mus musculus
tgctcccaaagcattagcagagaca

SEQ ID NO: 377104 - DNA, 25 bp, Mus musculus
tgctcccaacaggttctgggcctct

SEQ ID NO: 377105 - DNA, 25 bp, Mus musculus
tgctcccaagcccttggacatccga

SEQ ID NO: 377106 - DNA, 25 bp, Mus musculus
tgctcccactgcaatttgaagagct

SEQ ID NO: 377107 - DNA, 25 bp, Mus musculus
tgctcccagatggtgtcataagccg

SEQ ID NO: 377108 - DNA, 25 bp, Mus musculus
tgctcccaggagaatttcacccacc

SEQ ID NO: 377109 - DNA, 25 bp, Mus musculus
tgctcccatgatgttcctgtacaac

SEQ ID NO: 377110 - DNA, 25 bp, Mus musculus
tgctcccatgcttatcattgcaagt

SEQ ID NO: 377111 - DNA, 25 bp, Mus musculus
tgctccccaaagaccctctatggga

SEQ ID NO: 377112 - DNA, 25 bp, Mus musculus
tgctccccagccctgaggtgcgcac

SEQ ID NO: 377113 - DNA, 25 bp, Mus musculus
tgctcccccaggccggtagtggtgg

SEQ ID NO: 377114 - DNA, 25 bp, Mus musculus
tgctcccgaaactgaccactgcggc

SEQ ID NO: 377115 - DNA, 25 bp, Mus musculus
tgctcccgctaagtcgtcagcgcag

SEQ ID NO: 377116 - DNA, 25 bp, Mus musculus
tgctcccgctagtgttgcagaggtt

SEQ ID NO: 377117 - DNA, 25 bp, Mus musculus
tgctcccgtattaggagacacagaa

SEQ ID NO: 377118 - DNA, 25 bp, Mus musculus
tgctcccgtccccaccgacaacggc

SEQ ID NO: 377119 - DNA, 25 bp, Mus musculus
tgctcccgtttgagcccggttcctg

SEQ ID NO: 377120 - DNA, 25 bp, Mus musculus
tgctccctaaagttgcagaattaag

SEQ ID NO: 377121 - DNA, 25 bp, Mus musculus
tgctccctcaaaccccggcttcttc

SEQ ID NO: 377122 - DNA, 25 bp, Mus musculus
tgctccctcagctgctcctggactt

SEQ ID NO: 377123 - DNA, 25 bp, Mus musculus
tgctccctccagactccatctgcgc

SEQ ID NO: 377124 - DNA, 25 bp, Mus musculus
tgctccctccagcgccaacgtcacc

SEQ ID NO: 377125 - DNA, 25 bp, Mus musculus
tgctccctcgcttagcgctctgtgg

SEQ ID NO: 377126 - DNA, 25 bp, Mus musculus
tgctccctgagtttgacgactctga

SEQ ID NO: 377127 - DNA, 25 bp, Mus musculus
tgctccctttgcgcacaggttacat

SEQ ID NO: 377128 - DNA, 25 bp, Mus musculus
tgctccgaaagcatgtggaattccg

SEQ ID NO: 377129 - DNA, 25 bp, Mus musculus
tgctccgaaatcaggcagaagagga

SEQ ID NO: 377130 - DNA, 25 bp, Mus musculus
tgctccgacaatatgcacctatttg

SEQ ID NO: 377131 - DNA, 25 bp, Mus musculus
tgctccgacaatgtagatttagaag

SEQ ID NO: 377132 - DNA, 25 bp, Mus musculus
tgctccgagagtgctcccagaggtt

SEQ ID NO: 377133 - DNA, 25 bp, Mus musculus
tgctccgaggcatgtcccccaggcc

SEQ ID NO: 377134 - DNA, 25 bp, Mus musculus
tgctccgagggaagctctacaaaga

SEQ ID NO: 377135 - DNA, 25 bp, Mus musculus
tgctccgcagccgaggctcgcgctg

SEQ ID NO: 377136 - DNA, 25 bp, Mus musculus
tgctccgcagctggctcctccaaga

SEQ ID NO: 377137 - DNA, 25 bp, Mus musculus
tgctccgcaggtatctgaatcccaa

SEQ ID NO: 377138 - DNA, 25 bp, Mus musculus
tgctccgcaggttgaactggagcac

SEQ ID NO: 377139 - DNA, 25 bp, Mus musculus
tgctccgccaccagggccagagctt

SEQ ID NO: 377140 - DNA, 25 bp, Mus musculus
tgctccgcgagccgcgaagccaaaa

SEQ ID NO: 377141 - DNA, 25 bp, Mus musculus
tgctccgcgagccgctggtgcacgg

SEQ ID NO: 377142 - DNA, 25 bp, Mus musculus
tgctccggagatcacagctgcacga

SEQ ID NO: 377143 - DNA, 25 bp, Mus musculus
tgctccggagatcattataggtaaa

SEQ ID NO: 377144 - DNA, 25 bp, Mus musculus
tgctccggggagaaaaatgtatacg

SEQ ID NO: 377145 - DNA, 25 bp, Mus musculus
tgctccgtatagaggaagcccagcc

SEQ ID NO: 377146 - DNA, 25 bp, Mus musculus
tgctccgtcctggatactccatgtt

SEQ ID NO: 377147 - DNA, 25 bp, Mus musculus
tgctccgtgcccgagtttcaggtgc

SEQ ID NO: 377148 - DNA, 25 bp, Mus musculus
tgctccgtggagggtacactagctc

SEQ ID NO: 377149 - DNA, 25 bp, Mus musculus
tgctccgtttggggcggcaaccttt

SEQ ID NO: 377150 - DNA, 25 bp, Mus musculus
tgctccgtttggggctacgccttct

SEQ ID NO: 377151 - DNA, 25 bp, Mus musculus
tgctcctaaactttccacatctaca

SEQ ID NO: 377152 - DNA, 25 bp, Mus musculus
tgctcctaaccgcgttggctctccc

SEQ ID NO: 377153 - DNA, 25 bp, Mus musculus
tgctcctatttgtgggattgttcat

SEQ ID NO: 377154 - DNA, 25 bp, Mus musculus
tgctcctcactccagccggatgtat

SEQ ID NO: 377155 - DNA, 25 bp, Mus musculus
tgctcctcagccatgagaaaacaag

SEQ ID NO: 377156 - DNA, 25 bp, Mus musculus
tgctcctcagccctaaagaaccacc

SEQ ID NO: 377157 - DNA, 25 bp, Mus musculus
tgctcctccacaggctctggtcagg

SEQ ID NO: 377158 - DNA, 25 bp, Mus musculus
tgctcctccgggaagaatgggagtg

SEQ ID NO: 377159 - DNA, 25 bp, Mus musculus
tgctcctccggtgccagtgaccttc

SEQ ID NO: 377160 - DNA, 25 bp, Mus musculus
tgctcctctagaggctgtggggtgg

SEQ ID NO: 377161 - DNA, 25 bp, Mus musculus
tgctcctctcttggtcaaactacaa

SEQ ID NO: 377162 - DNA, 25 bp, Mus musculus
tgctcctgatgaagaccctcttgtg

SEQ ID NO: 377163 - DNA, 25 bp, Mus musculus
tgctcctgatgaaggactatgtgct

SEQ ID NO: 377164 - DNA, 25 bp, Mus musculus
tgctcctgatgcgggagcacagtcg

SEQ ID NO: 377165 - DNA, 25 bp, Mus musculus
tgctcctgcaggtggaagcacttca

SEQ ID NO: 377166 - DNA, 25 bp, Mus musculus
tgctcctgccaatgggaagctcctg

SEQ ID NO: 377167 - DNA, 25 bp, Mus musculus
tgctcctgcctacaggttaggccgg

SEQ ID NO: 377168 - DNA, 25 bp, Mus musculus
tgctcctgcgggcggcatcgctgtc

SEQ ID NO: 377169 - DNA, 25 bp, Mus musculus
tgctcctggaggctttggaaatgta

SEQ ID NO: 377170 - DNA, 25 bp, Mus musculus
tgctcctggcatggtacttttctca

SEQ ID NO: 377171 - DNA, 25 bp, Mus musculus
tgctcctggggctgcgccggagcgc

SEQ ID NO: 377172 - DNA, 25 bp, Mus musculus
tgctcctgtgctagtttcgcatttg

SEQ ID NO: 377173 - DNA, 25 bp, Mus musculus
tgctcctgtgtagtgtgaaacagaa

SEQ ID NO: 377174 - DNA, 25 bp, Mus musculus
tgctcctgtgtatgctacaggaggg

SEQ ID NO: 377175 - DNA, 25 bp, Mus musculus
tgctccttccctgagcatagtaaca

SEQ ID NO: 377176 - DNA, 25 bp, Mus musculus
tgctccttctgtaggtgtgctgatg

SEQ ID NO: 377177 - DNA, 25 bp, Mus musculus
tgctccttgaatacctctgcaggtg

SEQ ID NO: 377178 - DNA, 25 bp, Mus musculus
tgctccttgcagatttctaacgagc

SEQ ID NO: 377179 - DNA, 25 bp, Mus musculus
tgctcgaaacagatcagccagcatt

SEQ ID NO: 377180 - DNA, 25 bp, Mus musculus
tgctcgaaacagtagtttagtatga

SEQ ID NO: 377181 - DNA, 25 bp, Mus musculus
tgctcgaaatgggaaccctaatggg

SEQ ID NO: 377182 - DNA, 25 bp, Mus musculus
tgctcgacaaagcatagtaacattc

SEQ ID NO: 377183 - DNA, 25 bp, Mus musculus
tgctcgaggagtgcatgggtacaga

SEQ ID NO: 377184 - DNA, 25 bp, Mus musculus
tgctcgcaagctgcaggctgcactg

SEQ ID NO: 377185 - DNA, 25 bp, Mus musculus
tgctcgcaagctgcgggtgcagcag

SEQ ID NO: 377186 - DNA, 25 bp, Mus musculus
tgctcgccccagaggtcacccggcc

SEQ ID NO: 377187 - DNA, 25 bp, Mus musculus
tgctcgccccagaggtgacccttac

SEQ ID NO: 377188 - DNA, 25 bp, Mus musculus
tgctcgccctgccgggagccctgca

SEQ ID NO: 377189 - DNA, 25 bp, Mus musculus
tgctcgccgagggcataacctgggt

SEQ ID NO: 377190 - DNA, 25 bp, Mus musculus
tgctcgccgcacctgcctcagtatg

SEQ ID NO: 377191 - DNA, 25 bp, Mus musculus
tgctcggaatgggaaccctaatggc

SEQ ID NO: 377192 - DNA, 25 bp, Mus musculus
tgctcggaatgggaaccctaatggg

SEQ ID NO: 377193 - DNA, 25 bp, Mus musculus
tgctcggcagcacatcatgcaacga

SEQ ID NO: 377194 - DNA, 25 bp, Mus musculus
tgctcggctcacggatgatgactct

SEQ ID NO: 377195 - DNA, 25 bp, Mus musculus
tgctcggcttcagagcactaaagcg

SEQ ID NO: 377196 - DNA, 25 bp, Mus musculus
tgctcggcttcagctggaaaggcat

SEQ ID NO: 377197 - DNA, 25 bp, Mus musculus
tgctcggcttcaggtgaagctgagg

SEQ ID NO: 377198 - DNA, 25 bp, Mus musculus
tgctcgggctgttgacagctagaat

SEQ ID NO: 377199 - DNA, 25 bp, Mus musculus
tgctcggggggaaggcccaaacaag

SEQ ID NO: 377200 - DNA, 25 bp, Mus musculus
tgctcggtctggtttatctccggca

SEQ ID NO: 377201 - DNA, 25 bp, Mus musculus
tgctcgtaccaggcacagaagaatg

SEQ ID NO: 377202 - DNA, 25 bp, Mus musculus
tgctcgtccgtggaggttgtcagag

SEQ ID NO: 377203 - DNA, 25 bp, Mus musculus
tgctcgtctccggcaatctctgagt

SEQ ID NO: 377204 - DNA, 25 bp, Mus musculus
tgctcgtctccggcaggaatttaat

SEQ ID NO: 377205 - DNA, 25 bp, Mus musculus
tgctcgtctgatgtcatggctccga

SEQ ID NO: 377206 - DNA, 25 bp, Mus musculus
tgctcgtctgatgttcacctcacct

SEQ ID NO: 377207 - DNA, 25 bp, Mus musculus
tgctcgtttccctggattatgccat

SEQ ID NO: 377208 - DNA, 25 bp, Mus musculus
tgctcgtttccctgggtatttctct

SEQ ID NO: 377209 - DNA, 25 bp, Mus musculus
tgctctaaagatgactgcttacggg

SEQ ID NO: 377210 - DNA, 25 bp, Mus musculus
tgctctaagatggtgcagtgaacca

SEQ ID NO: 377211 - DNA, 25 bp, Mus musculus
tgctctacaagaattttacagccct

SEQ ID NO: 377212 - DNA, 25 bp, Mus musculus
tgctctacagaaaataaatcataat

SEQ ID NO: 377213 - DNA, 25 bp, Mus musculus
tgctctacagagtgagcctaggagg

SEQ ID NO: 377214 - DNA, 25 bp, Mus musculus
tgctctaccagtccttcgtgaagga

SEQ ID NO: 377215 - DNA, 25 bp, Mus musculus
tgctctaccttgaaggcccacaatg

SEQ ID NO: 377216 - DNA, 25 bp, Mus musculus
tgctctacgagaaataccgacagta

SEQ ID NO: 377217 - DNA, 25 bp, Mus musculus
tgctctactcgtcctcttccacttc

SEQ ID NO: 377218 - DNA, 25 bp, Mus musculus
tgctctactggccagaaggccagca

SEQ ID NO: 377219 - DNA, 25 bp, Mus musculus
tgctctagccgagatgtggtgacca

SEQ ID NO: 377220 - DNA, 25 bp, Mus musculus
tgctctagccgaggccatgtggagc

SEQ ID NO: 377221 - DNA, 25 bp, Mus musculus
tgctctataaggatgttcgcaacct

SEQ ID NO: 377222 - DNA, 25 bp, Mus musculus
tgctctatcgaggctacatgaagga

SEQ ID NO: 377223 - DNA, 25 bp, Mus musculus
tgctctatggctcccttcttctcat

SEQ ID NO: 377224 - DNA, 25 bp, Mus musculus
tgctctcaaagccaaactgcagatg

SEQ ID NO: 377225 - DNA, 25 bp, Mus musculus
tgctctcaaaggtcttcctgcagca

SEQ ID NO: 377226 - DNA, 25 bp, Mus musculus
tgctctcaatgcaggtcaatggcca

SEQ ID NO: 377227 - DNA, 25 bp, Mus musculus
tgctctcacaggtccgctacagagc

SEQ ID NO: 377228 - DNA, 25 bp, Mus musculus
tgctctcacccaccgacctttgcac

SEQ ID NO: 377229 - DNA, 25 bp, Mus musculus
tgctctcacccgcccgagttcgtca

SEQ ID NO: 377230 - DNA, 25 bp, Mus musculus
tgctctcacccggtacttggtggag

SEQ ID NO: 377231 - DNA, 25 bp, Mus musculus
tgctctcaggagttcctggtctgag

SEQ ID NO: 377232 - DNA, 25 bp, Mus musculus
tgctctccaccgggaaaatctgaac

SEQ ID NO: 377233 - DNA, 25 bp, Mus musculus
tgctctccagcaggttacagtacct

SEQ ID NO: 377234 - DNA, 25 bp, Mus musculus
tgctctccagtccctgccgccttcg

SEQ ID NO: 377235 - DNA, 25 bp, Mus musculus
tgctctccctcaagacatctccgac

SEQ ID NO: 377236 - DNA, 25 bp, Mus musculus
tgctctccctcaagtgctgcattga

SEQ ID NO: 377237 - DNA, 25 bp, Mus musculus
tgctctccctctagagtgcagagga

SEQ ID NO: 377238 - DNA, 25 bp, Mus musculus
tgctctcctcagcccttcagggtgg

SEQ ID NO: 377239 - DNA, 25 bp, Mus musculus
tgctctcctgcaggaagtggacatt

SEQ ID NO: 377240 - DNA, 25 bp, Mus musculus
tgctctctaacacccttatttagaa

SEQ ID NO: 377241 - DNA, 25 bp, Mus musculus
tgctctctaagggccatgcagctcc

SEQ ID NO: 377242 - DNA, 25 bp, Mus musculus
tgctctctagaactgaactcattat

SEQ ID NO: 377243 - DNA, 25 bp, Mus musculus
tgctctctagcagccctacgttctt

SEQ ID NO: 377244 - DNA, 25 bp, Mus musculus
tgctctctatttcacgctgcccccg

SEQ ID NO: 377245 - DNA, 25 bp, Mus musculus
tgctctctatttggagagaaataca

SEQ ID NO: 377246 - DNA, 25 bp, Mus musculus
tgctctctcagcgcatctcctccct

SEQ ID NO: 377247 - DNA, 25 bp, Mus musculus
tgctctctcgaaaggttctgtacct

SEQ ID NO: 377248 - DNA, 25 bp, Mus musculus
tgctctctcggacacggagagccat

SEQ ID NO: 377249 - DNA, 25 bp, Mus musculus
tgctctctcttgacccaagccacga

SEQ ID NO: 377250 - DNA, 25 bp, Mus musculus
tgctctgaaaaatagtcacaaagca

SEQ ID NO: 377251 - DNA, 25 bp, Mus musculus
tgctctgaaagcttactgataaggt

SEQ ID NO: 377252 - DNA, 25 bp, Mus musculus
tgctctgaagattgtgcccacctat

SEQ ID NO: 377253 - DNA, 25 bp, Mus musculus
tgctctgaagggggtacttcgaagg

SEQ ID NO: 377254 - DNA, 25 bp, Mus musculus
tgctctgaaggtcagcaagtcaagt

SEQ ID NO: 377255 - DNA, 25 bp, Mus musculus
tgctctgaaggtttcttttgatcat

SEQ ID NO: 377256 - DNA, 25 bp, Mus musculus
tgctctgaccacagttttcctgact

SEQ ID NO: 377257 - DNA, 25 bp, Mus musculus
tgctctgacttggggaagaaagtga

SEQ ID NO: 377258 - DNA, 25 bp, Mus musculus
tgctctgagacctcgccatgccctt

SEQ ID NO: 377259 - DNA, 25 bp, Mus musculus
tgctctgataagtatggaacaactc

SEQ ID NO: 377260 - DNA, 25 bp, Mus musculus
tgctctgcaggcttcgagtaccttc

SEQ ID NO: 377261 - DNA, 25 bp, Mus musculus
tgctctgcagtgcctgagcaacact

SEQ ID NO: 377262 - DNA, 25 bp, Mus musculus
tgctctgcgccaaggacactgccac

SEQ ID NO: 377263 - DNA, 25 bp, Mus musculus
tgctctgctctgcctcggcaacagt

SEQ ID NO: 377264 - DNA, 25 bp, Mus musculus
tgctctggaccgggtagcaaatgcc

SEQ ID NO: 377265 - DNA, 25 bp, Mus musculus
tgctctggatgagagggagatgaga

SEQ ID NO: 377266 - DNA, 25 bp, Mus musculus
tgctctggctccagagaaatcttct

SEQ ID NO: 377267 - DNA, 25 bp, Mus musculus
tgctctgggatgctgcaggaccagg

SEQ ID NO: 377268 - DNA, 25 bp, Mus musculus
tgctctggtcttaggttcttgattg

SEQ ID NO: 377269 - DNA, 25 bp, Mus musculus
tgctctgtaagcagcctaggatgtc

SEQ ID NO: 377270 - DNA, 25 bp, Mus musculus
tgctctgtcatgggtcctctacagc

SEQ ID NO: 377271 - DNA, 25 bp, Mus musculus
tgctctgtccccaggcgtatgggca

SEQ ID NO: 377272 - DNA, 25 bp, Mus musculus
tgctctgtccccagggactgaaagg

SEQ ID NO: 377273 - DNA, 25 bp, Mus musculus
tgctctgtccccagtgcatgggtac

SEQ ID NO: 377274 - DNA, 25 bp, Mus musculus
tgctctgtctccacgaccctgcttt

SEQ ID NO: 377275 - DNA, 25 bp, Mus musculus
tgctctgtgatgaccaagatcttcc

SEQ ID NO: 377276 - DNA, 25 bp, Mus musculus
tgctctgtgtgcgtgtattctagtc

SEQ ID NO: 377277 - DNA, 25 bp, Mus musculus
tgctctgtgtgcgtgttaaaagagc

SEQ ID NO: 377278 - DNA, 25 bp, Mus musculus
tgctctgttgcatatgacatggaaa

SEQ ID NO: 377279 - DNA, 25 bp, Mus musculus
tgctctgttgcgctgacccctgccc

SEQ ID NO: 377280 - DNA, 25 bp, Mus musculus
tgctcttaaaacaagtgcctccaaa

SEQ ID NO: 377281 - DNA, 25 bp, Mus musculus
tgctcttaaaacaagtgttttgtca

SEQ ID NO: 377282 - DNA, 25 bp, Mus musculus
tgctcttaaactcggtgtgtatgaa

SEQ ID NO: 377283 - DNA, 25 bp, Mus musculus
tgctcttaccaatcttgaactttcc

SEQ ID NO: 377284 - DNA, 25 bp, Mus musculus
tgctcttcacctgcttcctggcagt

SEQ ID NO: 377285 - DNA, 25 bp, Mus musculus
tgctcttcagaatgtgaagagactc

SEQ ID NO: 377286 - DNA, 25 bp, Mus musculus
tgctcttccaggtgacagtcacaga

SEQ ID NO: 377287 - DNA, 25 bp, Mus musculus
tgctcttccagtgggaaacattctc

SEQ ID NO: 377288 - DNA, 25 bp, Mus musculus
tgctcttcccccacagtcccagacg

SEQ ID NO: 377289 - DNA, 25 bp, Mus musculus
tgctcttcctacagttggtcccgca

SEQ ID NO: 377290 - DNA, 25 bp, Mus musculus
tgctcttcctcgcgtttcatgcagg

SEQ ID NO: 377291 - DNA, 25 bp, Mus musculus
tgctcttcgggaatcatggcccaag

SEQ ID NO: 377292 - DNA, 25 bp, Mus musculus
tgctcttcgtctgctgggattcctg

SEQ ID NO: 377293 - DNA, 25 bp, Mus musculus
tgctcttcgtgttccgctactgccg

SEQ ID NO: 377294 - DNA, 25 bp, Mus musculus
tgctcttctccatagcagactagag

SEQ ID NO: 377295 - DNA, 25 bp, Mus musculus
tgctcttctccatatacctggtgat

SEQ ID NO: 377296 - DNA, 25 bp, Mus musculus
tgctcttctggaaagctaggtagaa

SEQ ID NO: 377297 - DNA, 25 bp, Mus musculus
tgctcttctggaaaggcctagactg

SEQ ID NO: 377298 - DNA, 25 bp, Mus musculus
tgctcttgagaccagcaggtttctg

SEQ ID NO: 377299 - DNA, 25 bp, Mus musculus
tgctcttgcagctgtctagcccatg

SEQ ID NO: 377300 - DNA, 25 bp, Mus musculus
tgctcttgccatgcttccaccactg

SEQ ID NO: 377301 - DNA, 25 bp, Mus musculus
tgctctttcctatggatttggccat

SEQ ID NO: 377302 - DNA, 25 bp, Mus musculus
tgctctttgaggacctttactcttt

SEQ ID NO: 377303 - DNA, 25 bp, Mus musculus
tgctctttggcagatcagtaatgga

SEQ ID NO: 377304 - DNA, 25 bp, Mus musculus
tgctctttgtcaggtaagaatgatt

SEQ ID NO: 377305 - DNA, 25 bp, Mus musculus
tgctgaaaacatgggtacaggaccc

SEQ ID NO: 377306 - DNA, 25 bp, Mus musculus
tgctgaaaacctcggctctctgctc

SEQ ID NO: 377307 - DNA, 25 bp, Mus musculus
tgctgaaaagaatgatggaaacttt

SEQ ID NO: 377308 - DNA, 25 bp, Mus musculus
tgctgaaaagttgccagtagttatc

SEQ ID NO: 377309 - DNA, 25 bp, Mus musculus
tgctgaaaccattaagttcgagaag

SEQ ID NO: 377310 - DNA, 25 bp, Mus musculus
tgctgaaaccgatcccagctctacc

SEQ ID NO: 377311 - DNA, 25 bp, Mus musculus
tgctgaaactgatgccatgcagaac

SEQ ID NO: 377312 - DNA, 25 bp, Mus musculus
tgctgaaactgtatgccatgttcct

SEQ ID NO: 377313 - DNA, 25 bp, Mus musculus
tgctgaaagtgaaacactagaccag

SEQ ID NO: 377314 - DNA, 25 bp, Mus musculus
tgctgaaagtgaaaccagaggagga

SEQ ID NO: 377315 - DNA, 25 bp, Mus musculus
tgctgaaatgcacctagtgtgtacc

SEQ ID NO: 377316 - DNA, 25 bp, Mus musculus
tgctgaaatggacgtatgttccatc

SEQ ID NO: 377317 - DNA, 25 bp, Mus musculus
tgctgaaatggtgacccgcagggcc

SEQ ID NO: 377318 - DNA, 25 bp, Mus musculus
tgctgaaattacggccgagatccag

SEQ ID NO: 377319 - DNA, 25 bp, Mus musculus
tgctgaaattggatgcaaaacatcc

SEQ ID NO: 377320 - DNA, 25 bp, Mus musculus
tgctgaacattacaagaagacgctg

SEQ ID NO: 377321 - DNA, 25 bp, Mus musculus
tgctgaacattacaaggtgggagag

SEQ ID NO: 377322 - DNA, 25 bp, Mus musculus
tgctgaacgagggttcagccgactc

SEQ ID NO: 377323 - DNA, 25 bp, Mus musculus
tgctgaacgctgagatcatctttct

SEQ ID NO: 377324 - DNA, 25 bp, Mus musculus
tgctgaagaaaagtactctcaaaaa

SEQ ID NO: 377325 - DNA, 25 bp, Mus musculus
tgctgaagaaagaattgatattttg

SEQ ID NO: 377326 - DNA, 25 bp, Mus musculus
tgctgaagaaattgaagcagctgga

SEQ ID NO: 377327 - DNA, 25 bp, Mus musculus
tgctgaagaacatgatgcaaggaga

SEQ ID NO: 377328 - DNA, 25 bp, Mus musculus
tgctgaagaacatggactggaaagt

SEQ ID NO: 377329 - DNA, 25 bp, Mus musculus
tgctgaagaagagagggactcaaag

SEQ ID NO: 377330 - DNA, 25 bp, Mus musculus
tgctgaagaagagcagtttccggag

SEQ ID NO: 377331 - DNA, 25 bp, Mus musculus
tgctgaagaagagcatcatggtcca

SEQ ID NO: 377332 - DNA, 25 bp, Mus musculus
tgctgaagagcacggatgttctttg

SEQ ID NO: 377333 - DNA, 25 bp, Mus musculus
tgctgaagatgatcaaaaagccgac

SEQ ID NO: 377334 - DNA, 25 bp, Mus musculus
tgctgaagatgtttccacagtgcct

SEQ ID NO: 377335 - DNA, 25 bp, Mus musculus
tgctgaagcagaactgtgtgtggga

SEQ ID NO: 377336 - DNA, 25 bp, Mus musculus
tgctgaagcagctcaccatgtccaa

SEQ ID NO: 377337 - DNA, 25 bp, Mus musculus
tgctgaagcaggacacaccaggaag

SEQ ID NO: 377338 - DNA, 25 bp, Mus musculus
tgctgaagccgagagaaatgtcttc

SEQ ID NO: 377339 - DNA, 25 bp, Mus musculus
tgctgaagccgggaggggcttttta

SEQ ID NO: 377340 - DNA, 25 bp, Mus musculus
tgctgaagccgtaagggttggagct

SEQ ID NO: 377341 - DNA, 25 bp, Mus musculus
tgctgaagctacagggttgaaaaat

SEQ ID NO: 377342 - DNA, 25 bp, Mus musculus
tgctgaagctggggggtcgtgtgaa

SEQ ID NO: 377343 - DNA, 25 bp, Mus musculus
tgctgaagttacagtcaccggaaga

SEQ ID NO: 377344 - DNA, 25 bp, Mus musculus
tgctgaagttagacacaccagaaga

SEQ ID NO: 377345 - DNA, 25 bp, Mus musculus
tgctgaataggtatctgatcaacgt

SEQ ID NO: 377346 - DNA, 25 bp, Mus musculus
tgctgaataggtgaattgagacctt

SEQ ID NO: 377347 - DNA, 25 bp, Mus musculus
tgctgaatcgaaaggctcaggtcac

SEQ ID NO: 377348 - DNA, 25 bp, Mus musculus
tgctgaatgagaaagaccttgtcct

SEQ ID NO: 377349 - DNA, 25 bp, Mus musculus
tgctgaatgatgctgggatccagat

SEQ ID NO: 377350 - DNA, 25 bp, Mus musculus
tgctgaattttagagaacgagttag

SEQ ID NO: 377351 - DNA, 25 bp, Mus musculus
tgctgaattttagagaatggctctg

SEQ ID NO: 377352 - DNA, 25 bp, Mus musculus
tgctgacaaagcaaatgaaaagaaa

SEQ ID NO: 377353 - DNA, 25 bp, Mus musculus
tgctgacaagccgatacacctcctt

SEQ ID NO: 377354 - DNA, 25 bp, Mus musculus
tgctgacaattgcttctacttctca

SEQ ID NO: 377355 - DNA, 25 bp, Mus musculus
tgctgacagaacaggtcctgctgca

SEQ ID NO: 377356 - DNA, 25 bp, Mus musculus
tgctgacagaattaacggcacagcc

SEQ ID NO: 377357 - DNA, 25 bp, Mus musculus
tgctgacatcacagatgagctccag

SEQ ID NO: 377358 - DNA, 25 bp, Mus musculus
tgctgacatggtcaaccagtacagc

SEQ ID NO: 377359 - DNA, 25 bp, Mus musculus
tgctgacattactggcatgcctgtg

SEQ ID NO: 377360 - DNA, 25 bp, Mus musculus
tgctgaccaagcccactccccaccg

SEQ ID NO: 377361 - DNA, 25 bp, Mus musculus
tgctgaccaaggagagagatggcat

SEQ ID NO: 377362 - DNA, 25 bp, Mus musculus
tgctgaccaaggcattggaattgtg

SEQ ID NO: 377363 - DNA, 25 bp, Mus musculus
tgctgaccagaatttttcagatttt

SEQ ID NO: 377364 - DNA, 25 bp, Mus musculus
tgctgaccagatcgtgagacatgac

SEQ ID NO: 377365 - DNA, 25 bp, Mus musculus
tgctgaccagctgtatatctgtgac

SEQ ID NO: 377366 - DNA, 25 bp, Mus musculus
tgctgaccaggatcttcccaacaac

SEQ ID NO: 377367 - DNA, 25 bp, Mus musculus
tgctgaccaggcagttctagatgag

SEQ ID NO: 377368 - DNA, 25 bp, Mus musculus
tgctgaccgttgaatcttttgagca

SEQ ID NO: 377369 - DNA, 25 bp, Mus musculus
tgctgacctcaaggtttccctggag

SEQ ID NO: 377370 - DNA, 25 bp, Mus musculus
tgctgacctgggcacacatgagagc

SEQ ID NO: 377371 - DNA, 25 bp, Mus musculus
tgctgacgagatctggccgccccgg

SEQ ID NO: 377372 - DNA, 25 bp, Mus musculus
tgctgacgcagatcattaagtgtca

SEQ ID NO: 377373 - DNA, 25 bp, Mus musculus
tgctgacgcaggatcctacccagag

SEQ ID NO: 377374 - DNA, 25 bp, Mus musculus
tgctgacggaccccggcaggaggac

SEQ ID NO: 377375 - DNA, 25 bp, Mus musculus
tgctgacggacccctgtttgtaagc

SEQ ID NO: 377376 - DNA, 25 bp, Mus musculus
tgctgactacatttcctcggcctgt

SEQ ID NO: 377377 - DNA, 25 bp, Mus musculus
tgctgactccaggaggaatgctgtg

SEQ ID NO: 377378 - DNA, 25 bp, Mus musculus
tgctgactccaggtctgttctcaga

SEQ ID NO: 377379 - DNA, 25 bp, Mus musculus
tgctgactcccagacattgggcctg

SEQ ID NO: 377380 - DNA, 25 bp, Mus musculus
tgctgactcccagaccatctcctac

SEQ ID NO: 377381 - DNA, 25 bp, Mus musculus
tgctgactcccaggatgccctgatg

SEQ ID NO: 377382 - DNA, 25 bp, Mus musculus
tgctgactcggctgaaagcaaaatc

SEQ ID NO: 377383 - DNA, 25 bp, Mus musculus
tgctgactcgggttatcttctctgt

SEQ ID NO: 377384 - DNA, 25 bp, Mus musculus
tgctgactgagctcggattgggaaa

SEQ ID NO: 377385 - DNA, 25 bp, Mus musculus
tgctgactggaaagcactctccagc

SEQ ID NO: 377386 - DNA, 25 bp, Mus musculus
tgctgactggttgcccattggacgt

SEQ ID NO: 377387 - DNA, 25 bp, Mus musculus
tgctgagaaacaggtggaagagctg

SEQ ID NO: 377388 - DNA, 25 bp, Mus musculus
tgctgagaagctgagttcctacccc

SEQ ID NO: 377389 - DNA, 25 bp, Mus musculus
tgctgagagagaggatgagaccggg

SEQ ID NO: 377390 - DNA, 25 bp, Mus musculus
tgctgagagcacggactagaagtga

SEQ ID NO: 377391 - DNA, 25 bp, Mus musculus
tgctgagagcgaaccccgactgcag

SEQ ID NO: 377392 - DNA, 25 bp, Mus musculus
tgctgagagtcgggccctgtctcca

SEQ ID NO: 377393 - DNA, 25 bp, Mus musculus
tgctgagagtcgggggcctggtgta

SEQ ID NO: 377394 - DNA, 25 bp, Mus musculus
tgctgagatcattaggaaacaggtc

SEQ ID NO: 377395 - DNA, 25 bp, Mus musculus
tgctgagatcattaggtctcagcca

SEQ ID NO: 377396 - DNA, 25 bp, Mus musculus
tgctgagatcttggaaatagcagac

SEQ ID NO: 377397 - DNA, 25 bp, Mus musculus
tgctgagattacagaatcgtatgga

SEQ ID NO: 377398 - DNA, 25 bp, Mus musculus
tgctgagattacagagaaaacagag

SEQ ID NO: 377399 - DNA, 25 bp, Mus musculus
tgctgagattacagaggcctcattc

SEQ ID NO: 377400 - DNA, 25 bp, Mus musculus
tgctgagattacagggacagtgatc

SEQ ID NO: 377401 - DNA, 25 bp, Mus musculus
tgctgagattacaggtgtggttgaa

SEQ ID NO: 377402 - DNA, 25 bp, Mus musculus
tgctgagattgaagaaaccgggctc

SEQ ID NO: 377403 - DNA, 25 bp, Mus musculus
tgctgagcaaagatgaagcggcagc

SEQ ID NO: 377404 - DNA, 25 bp, Mus musculus
tgctgagcaaaggagtgattctcga

SEQ ID NO: 377405 - DNA, 25 bp, Mus musculus
tgctgagcaagagatgcctgccttg

SEQ ID NO: 377406 - DNA, 25 bp, Mus musculus
tgctgagcaaggatgaagatggaaa

SEQ ID NO: 377407 - DNA, 25 bp, Mus musculus
tgctgagcagctgcagcagcccctg

SEQ ID NO: 377408 - DNA, 25 bp, Mus musculus
tgctgagcaggtagataataaaggt

SEQ ID NO: 377409 - DNA, 25 bp, Mus musculus
tgctgagcaggttcaattttatata

SEQ ID NO: 377410 - DNA, 25 bp, Mus musculus
tgctgagcagtaacttgaatcccac

SEQ ID NO: 377411 - DNA, 25 bp, Mus musculus
tgctgagcctggggaacaaaaactg

SEQ ID NO: 377412 - DNA, 25 bp, Mus musculus
tgctgagcctgggtcactgttctgg

SEQ ID NO: 377413 - DNA, 25 bp, Mus musculus
tgctgagcgagagagggaactggag

SEQ ID NO: 377414 - DNA, 25 bp, Mus musculus
tgctgagcgaggagtgactgcaaag

SEQ ID NO: 377415 - DNA, 25 bp, Mus musculus
tgctgagcgaggtgtgactgcaaag

SEQ ID NO: 377416 - DNA, 25 bp, Mus musculus
tgctgagcgcagtgggagatttgaa

SEQ ID NO: 377417 - DNA, 25 bp, Mus musculus
tgctgagcgctgagattggtgtcct

SEQ ID NO: 377418 - DNA, 25 bp, Mus musculus
tgctgagcgctgattcctgagtcag

SEQ ID NO: 377419 - DNA, 25 bp, Mus musculus
tgctgagcggactggcttttatgaa

SEQ ID NO: 377420 - DNA, 25 bp, Mus musculus
tgctgagctgacacttatgcctcct

SEQ ID NO: 377421 - DNA, 25 bp, Mus musculus
tgctgagctgctggaagagcatcgg

SEQ ID NO: 377422 - DNA, 25 bp, Mus musculus
tgctgaggaaacaggccgaggaaga

SEQ ID NO: 377423 - DNA, 25 bp, Mus musculus
tgctgaggaagagaagtttattgat

SEQ ID NO: 377424 - DNA, 25 bp, Mus musculus
tgctgaggagaatgcggaggccact

SEQ ID NO: 377425 - DNA, 25 bp, Mus musculus
tgctgagggtggttagaaagctgtc

SEQ ID NO: 377426 - DNA, 25 bp, Mus musculus
tgctgagtacaggatatgaatcaga

SEQ ID NO: 377427 - DNA, 25 bp, Mus musculus
tgctgagtacaggcgtgggtgactg

SEQ ID NO: 377428 - DNA, 25 bp, Mus musculus
tgctgagtccaggtgcagctgctgg

SEQ ID NO: 377429 - DNA, 25 bp, Mus musculus
tgctgagtccaggtgttttggttca

SEQ ID NO: 377430 - DNA, 25 bp, Mus musculus
tgctgagtgacatcgcatcggctct

SEQ ID NO: 377431 - DNA, 25 bp, Mus musculus
tgctgagtgacatcggcgccagagc

SEQ ID NO: 377432 - DNA, 25 bp, Mus musculus
tgctgagtgctgaagaggaagagca

SEQ ID NO: 377433 - DNA, 25 bp, Mus musculus
tgctgagtgtcctaggtcttgagag

SEQ ID NO: 377434 - DNA, 25 bp, Mus musculus
tgctgataacacaggccatggcgca

SEQ ID NO: 377435 - DNA, 25 bp, Mus musculus
tgctgataacacaggtgccttcttc

SEQ ID NO: 377436 - DNA, 25 bp, Mus musculus
tgctgataagatctcccttgatctg

SEQ ID NO: 377437 - DNA, 25 bp, Mus musculus
tgctgataagatgtctggtgagaag

SEQ ID NO: 377438 - DNA, 25 bp, Mus musculus
tgctgataaggccttgctcaacaga

SEQ ID NO: 377439 - DNA, 25 bp, Mus musculus
tgctgataccggtgacagtggtaaa

SEQ ID NO: 377440 - DNA, 25 bp, Mus musculus
tgctgatcaaactggattcagaaca

SEQ ID NO: 377441 - DNA, 25 bp, Mus musculus
tgctgatcaaccattgcagaccttt

SEQ ID NO: 377442 - DNA, 25 bp, Mus musculus
tgctgatcaagcaccacacagtcac

SEQ ID NO: 377443 - DNA, 25 bp, Mus musculus
tgctgatccagacggccacccgaga

SEQ ID NO: 377444 - DNA, 25 bp, Mus musculus
tgctgatccagtgaagtcgagttcc

SEQ ID NO: 377445 - DNA, 25 bp, Mus musculus
tgctgatcccaagggttggccccta

SEQ ID NO: 377446 - DNA, 25 bp, Mus musculus
tgctgatccccagctgtgctcagga

SEQ ID NO: 377447 - DNA, 25 bp, Mus musculus
tgctgatccctagagatgtcttcct

SEQ ID NO: 377448 - DNA, 25 bp, Mus musculus
tgctgatccctaggtcagacgggaa

SEQ ID NO: 377449 - DNA, 25 bp, Mus musculus
tgctgatcctatggtgaatcccccg

SEQ ID NO: 377450 - DNA, 25 bp, Mus musculus
tgctgatgaaggagagagaagtgca

SEQ ID NO: 377451 - DNA, 25 bp, Mus musculus
tgctgatgaagggtccgcaggtccg

SEQ ID NO: 377452 - DNA, 25 bp, Mus musculus
tgctgatgatcaggaccagtgtcca

SEQ ID NO: 377453 - DNA, 25 bp, Mus musculus
tgctgatgcagactttgtggtgctc

SEQ ID NO: 377454 - DNA, 25 bp, Mus musculus
tgctgatgcagctcccccaccagtc

SEQ ID NO: 377455 - DNA, 25 bp, Mus musculus
tgctgatgccattctatttatttcg

SEQ ID NO: 377456 - DNA, 25 bp, Mus musculus
tgctgatgctcggtgaaggaggtcg

SEQ ID NO: 377457 - DNA, 25 bp, Mus musculus
tgctgatggacagccctgggatcga

SEQ ID NO: 377458 - DNA, 25 bp, Mus musculus
tgctgatggacggctctcagacact

SEQ ID NO: 377459 - DNA, 25 bp, Mus musculus
tgctgatggagcatctgggtggtct

SEQ ID NO: 377460 - DNA, 25 bp, Mus musculus
tgctgatggagctatatacgccatg

SEQ ID NO: 377461 - DNA, 25 bp, Mus musculus
tgctgatggccatggtcaagaaaaa

SEQ ID NO: 377462 - DNA, 25 bp, Mus musculus
tgctgatgtaaagattttgctggaa

SEQ ID NO: 377463 - DNA, 25 bp, Mus musculus
tgctgatgtcccgccgaacgcagtg

SEQ ID NO: 377464 - DNA, 25 bp, Mus musculus
tgctgattcccctggatcattcgga

SEQ ID NO: 377465 - DNA, 25 bp, Mus musculus
tgctgattcgagaggttccgtgagg

SEQ ID NO: 377466 - DNA, 25 bp, Mus musculus
tgctgattttgccaagtcatctcac

SEQ ID NO: 377467 - DNA, 25 bp, Mus musculus
tgctgatttttcaggcccaatgatg

SEQ ID NO: 377468 - DNA, 25 bp, Mus musculus
tgctgatttttcaggggatgtttcg

SEQ ID NO: 377469 - DNA, 25 bp, Mus musculus
tgctgcaaaacccaaagccctttgc

SEQ ID NO: 377470 - DNA, 25 bp, Mus musculus
tgctgcaaaagcgggcctcctgctg

SEQ ID NO: 377471 - DNA, 25 bp, Mus musculus
tgctgcaaaagcgggtggaggagag

SEQ ID NO: 377472 - DNA, 25 bp, Mus musculus
tgctgcaacagcaaggtggccacga

SEQ ID NO: 377473 - DNA, 25 bp, Mus musculus
tgctgcaacagcgaggcagaggctc

SEQ ID NO: 377474 - DNA, 25 bp, Mus musculus
tgctgcaaccgaggtcacatggtgg

SEQ ID NO: 377475 - DNA, 25 bp, Mus musculus
tgctgcaagaccaaggacgagtctt

SEQ ID NO: 377476 - DNA, 25 bp, Mus musculus
tgctgcacaatgccttaggattctt

SEQ ID NO: 377477 - DNA, 25 bp, Mus musculus
tgctgcacagccctcctaagggtta

SEQ ID NO: 377478 - DNA, 25 bp, Mus musculus
tgctgcacaggaataaaggacataa

SEQ ID NO: 377479 - DNA, 25 bp, Mus musculus
tgctgcacaggagggtcacttccct

SEQ ID NO: 377480 - DNA, 25 bp, Mus musculus
tgctgcacagtgatcatcaaggagg

SEQ ID NO: 377481 - DNA, 25 bp, Mus musculus
tgctgcaccagattataagtgcctg

SEQ ID NO: 377482 - DNA, 25 bp, Mus musculus
tgctgcaccagattgatgtcctcga

SEQ ID NO: 377483 - DNA, 25 bp, Mus musculus
tgctgcactcgcagaacaccagcct

SEQ ID NO: 377484 - DNA, 25 bp, Mus musculus
tgctgcactgaaataaccagctttc

SEQ ID NO: 377485 - DNA, 25 bp, Mus musculus
tgctgcactgtacagacagtggatt

SEQ ID NO: 377486 - DNA, 25 bp, Mus musculus
tgctgcagaaaaagacggcctgtca

SEQ ID NO: 377487 - DNA, 25 bp, Mus musculus
tgctgcagaaaaaggagcaggtagg

SEQ ID NO: 377488 - DNA, 25 bp, Mus musculus
tgctgcagaaaatatggtggtcact

SEQ ID NO: 377489 - DNA, 25 bp, Mus musculus
tgctgcagaacgagtttgttgtatt

SEQ ID NO: 377490 - DNA, 25 bp, Mus musculus
tgctgcagaagccatggctcggatg

SEQ ID NO: 377491 - DNA, 25 bp, Mus musculus
tgctgcagaatatgtgtacatgtgt

SEQ ID NO: 377492 - DNA, 25 bp, Mus musculus
tgctgcagacagtcttcatcagctg

SEQ ID NO: 377493 - DNA, 25 bp, Mus musculus
tgctgcagactggtcttctcagtac

SEQ ID NO: 377494 - DNA, 25 bp, Mus musculus
tgctgcagagcttcacttggttcac

SEQ ID NO: 377495 - DNA, 25 bp, Mus musculus
tgctgcagataagtgattgacattt

SEQ ID NO: 377496 - DNA, 25 bp, Mus musculus
tgctgcagataagttactctcagct

SEQ ID NO: 377497 - DNA, 25 bp, Mus musculus
tgctgcagatgcgggaggggaaaat

SEQ ID NO: 377498 - DNA, 25 bp, Mus musculus
tgctgcagccgaggcagacgaggca

SEQ ID NO: 377499 - DNA, 25 bp, Mus musculus
tgctgcagccgagggaatgggcttg

SEQ ID NO: 377500 - DNA, 25 bp, Mus musculus
tgctgcagcgagaggtggaggtaga

SEQ ID NO: 377501 - DNA, 25 bp, Mus musculus
tgctgcagcttcgctcttgtggaca

SEQ ID NO: 377502 - DNA, 25 bp, Mus musculus
tgctgcaggcgcgaggttctgcaga

SEQ ID NO: 377503 - DNA, 25 bp, Mus musculus
tgctgcagtcagcaaaatatccaga

SEQ ID NO: 377504 - DNA, 25 bp, Mus musculus
tgctgcagtggttttaagctataac

SEQ ID NO: 377505 - DNA, 25 bp, Mus musculus
tgctgcagtgtggggaaatcccacc

SEQ ID NO: 377506 - DNA, 25 bp, Mus musculus
tgctgcagttttgaggcaagaaatc

SEQ ID NO: 377507 - DNA, 25 bp, Mus musculus
tgctgcatacccctgcccagatcaa

SEQ ID NO: 377508 - DNA, 25 bp, Mus musculus
tgctgcatcagaacctcttacatat

SEQ ID NO: 377509 - DNA, 25 bp, Mus musculus
tgctgcatcagcccagcactatggt

SEQ ID NO: 377510 - DNA, 25 bp, Mus musculus
tgctgcatcaggtaccaccagcttc

SEQ ID NO: 377511 - DNA, 25 bp, Mus musculus
tgctgcatgcagaacccttaccagt

SEQ ID NO: 377512 - DNA, 25 bp, Mus musculus
tgctgcatgcagctggtgcagaacc

SEQ ID NO: 377513 - DNA, 25 bp, Mus musculus
tgctgcatgtctacaagcatttgtc

SEQ ID NO: 377514 - DNA, 25 bp, Mus musculus
tgctgcattctggcgcctagtgaga

SEQ ID NO: 377515 - DNA, 25 bp, Mus musculus
tgctgccaattttgagcagttcctc

SEQ ID NO: 377516 - DNA, 25 bp, Mus musculus
tgctgccaatttttgacaacagaac

SEQ ID NO: 377517 - DNA, 25 bp, Mus musculus
tgctgccactgcccacccccgcgat

SEQ ID NO: 377518 - DNA, 25 bp, Mus musculus
tgctgccagagggaaattgtgggaa

SEQ ID NO: 377519 - DNA, 25 bp, Mus musculus
tgctgccagcacaagaaccaggcag

SEQ ID NO: 377520 - DNA, 25 bp, Mus musculus
tgctgccagcataagacagtgatga

SEQ ID NO: 377521 - DNA, 25 bp, Mus musculus
tgctgccagccaggcttcccggatt

SEQ ID NO: 377522 - DNA, 25 bp, Mus musculus
tgctgccagccagggactaggccct

SEQ ID NO: 377523 - DNA, 25 bp, Mus musculus
tgctgccagttgcctctcagtttca

SEQ ID NO: 377524 - DNA, 25 bp, Mus musculus
tgctgccatcaaattatttttaatg

SEQ ID NO: 377525 - DNA, 25 bp, Mus musculus
tgctgccatggtagtgatggacaga

SEQ ID NO: 377526 - DNA, 25 bp, Mus musculus
tgctgccattgagaaaatgaaacag

SEQ ID NO: 377527 - DNA, 25 bp, Mus musculus
tgctgccattgagacgtaccaccag

SEQ ID NO: 377528 - DNA, 25 bp, Mus musculus
tgctgcccacagagaggtgacagaa

SEQ ID NO: 377529 - DNA, 25 bp, Mus musculus
tgctgcccacaggaaataacagtat

SEQ ID NO: 377530 - DNA, 25 bp, Mus musculus
tgctgcccagatcttggtgaccaac

SEQ ID NO: 377531 - DNA, 25 bp, Mus musculus
tgctgcccagccggtaagaccagct

SEQ ID NO: 377532 - DNA, 25 bp, Mus musculus
tgctgccccaggagacctaggcaga

SEQ ID NO: 377533 - DNA, 25 bp, Mus musculus
tgctgccccaggagtttcctgaagt

SEQ ID NO: 377534 - DNA, 25 bp, Mus musculus
tgctgccccagggttcttttaggtt

SEQ ID NO: 377535 - DNA, 25 bp, Mus musculus
tgctgccccaggttgtgtggaggaa

SEQ ID NO: 377536 - DNA, 25 bp, Mus musculus
tgctgcccctcagcagcagcaacag

SEQ ID NO: 377537 - DNA, 25 bp, Mus musculus
tgctgcccctcctgggccctggcta

SEQ ID NO: 377538 - DNA, 25 bp, Mus musculus
tgctgcccgaaaggctgagaccgct

SEQ ID NO: 377539 - DNA, 25 bp, Mus musculus
tgctgcccgcggggactggtatccg

SEQ ID NO: 377540 - DNA, 25 bp, Mus musculus
tgctgccctagagatagtcaataac

SEQ ID NO: 377541 - DNA, 25 bp, Mus musculus
tgctgccctagagatcaagatatta

SEQ ID NO: 377542 - DNA, 25 bp, Mus musculus
tgctgccctattcctcagggtctct

SEQ ID NO: 377543 - DNA, 25 bp, Mus musculus
tgctgccctgcagtaccacatcaac

SEQ ID NO: 377544 - DNA, 25 bp, Mus musculus
tgctgccctggaatcttccgacagc

SEQ ID NO: 377545 - DNA, 25 bp, Mus musculus
tgctgccctggagcctcaaaccacc

SEQ ID NO: 377546 - DNA, 25 bp, Mus musculus
tgctgccctgtccccagccccctcc

SEQ ID NO: 377547 - DNA, 25 bp, Mus musculus
tgctgccgatctcagtctctggtcc

SEQ ID NO: 377548 - DNA, 25 bp, Mus musculus
tgctgccgtgtgagttctgtggggt

SEQ ID NO: 377549 - DNA, 25 bp, Mus musculus
tgctgccgttaggctactacatggg

SEQ ID NO: 377550 - DNA, 25 bp, Mus musculus
tgctgccgtttagctcgatgagaga

SEQ ID NO: 377551 - DNA, 25 bp, Mus musculus
tgctgccgtttggtggtgaagcagt

SEQ ID NO: 377552 - DNA, 25 bp, Mus musculus
tgctgcctcacaggtggataccttg

SEQ ID NO: 377553 - DNA, 25 bp, Mus musculus
tgctgcctcaggtacaactgatgag

SEQ ID NO: 377554 - DNA, 25 bp, Mus musculus
tgctgcctcaggtacctttgaccgg

SEQ ID NO: 377555 - DNA, 25 bp, Mus musculus
tgctgcctcagtttgacagcagtca

SEQ ID NO: 377556 - DNA, 25 bp, Mus musculus
tgctgcctgagccctaggaccatga

SEQ ID NO: 377557 - DNA, 25 bp, Mus musculus
tgctgcctgagggttaaaattctgt

SEQ ID NO: 377558 - DNA, 25 bp, Mus musculus
tgctgcctgaggtagtgactgtgct

SEQ ID NO: 377559 - DNA, 25 bp, Mus musculus
tgctgccttcacggcggagtgttcc

SEQ ID NO: 377560 - DNA, 25 bp, Mus musculus
tgctgccttcctcaagcagtataat

SEQ ID NO: 377561 - DNA, 25 bp, Mus musculus
tgctgccttttcctgggatcagcct

SEQ ID NO: 377562 - DNA, 25 bp, Mus musculus
tgctgcgacaaggcccttggactgg

SEQ ID NO: 377563 - DNA, 25 bp, Mus musculus
tgctgcgagaggccaaggtgacctg

SEQ ID NO: 377564 - DNA, 25 bp, Mus musculus
tgctgcgataaaccattgttgagga

SEQ ID NO: 377565 - DNA, 25 bp, Mus musculus
tgctgcgcaaggtttctctgtgtag

SEQ ID NO: 377566 - DNA, 25 bp, Mus musculus
tgctgcgcaaggtttctgacatgaa

SEQ ID NO: 377567 - DNA, 25 bp, Mus musculus
tgctgcgcacagagtcccaaaagaa

SEQ ID NO: 377568 - DNA, 25 bp, Mus musculus
tgctgcgcacagattccccaaaggc

SEQ ID NO: 377569 - DNA, 25 bp, Mus musculus
tgctgcgcagatgatgctgaataat

SEQ ID NO: 377570 - DNA, 25 bp, Mus musculus
tgctgcgcagatgcagaaccccgac

SEQ ID NO: 377571 - DNA, 25 bp, Mus musculus
tgctgcgcatgaagttcatgcaaag

SEQ ID NO: 377572 - DNA, 25 bp, Mus musculus
tgctgcgctcagagcgtaaacgacc

SEQ ID NO: 377573 - DNA, 25 bp, Mus musculus
tgctgcgcttcgcccgcagcctcgc

SEQ ID NO: 377574 - DNA, 25 bp, Mus musculus
tgctgcggaagaacgcagaggtgac

SEQ ID NO: 377575 - DNA, 25 bp, Mus musculus
tgctgcggagcattctgtgccccca

SEQ ID NO: 377576 - DNA, 25 bp, Mus musculus
tgctgcggagcattgtgaccactga

SEQ ID NO: 377577 - DNA, 25 bp, Mus musculus
tgctgcgtccctctggggctgtggt

SEQ ID NO: 377578 - DNA, 25 bp, Mus musculus
tgctgctaaagcttattgagcggtc

SEQ ID NO: 377579 - DNA, 25 bp, Mus musculus
tgctgctaaagggttatcacacatc

SEQ ID NO: 377580 - DNA, 25 bp, Mus musculus
tgctgctaatgtcagcagaccgctc

SEQ ID NO: 377581 - DNA, 25 bp, Mus musculus
tgctgctacgaaatccatacttgtt

SEQ ID NO: 377582 - DNA, 25 bp, Mus musculus
tgctgctacgaggaggaagatggtg

SEQ ID NO: 377583 - DNA, 25 bp, Mus musculus
tgctgctactactgtgctgaggaga

SEQ ID NO: 377584 - DNA, 25 bp, Mus musculus
tgctgctagacaggcttgtgttgcg

SEQ ID NO: 377585 - DNA, 25 bp, Mus musculus
tgctgctagacgtggctgtgagtcc

SEQ ID NO: 377586 - DNA, 25 bp, Mus musculus
tgctgctatcgtggatggagacagg

SEQ ID NO: 377587 - DNA, 25 bp, Mus musculus
tgctgctatgtgaaggtgctcctgg

SEQ ID NO: 377588 - DNA, 25 bp, Mus musculus
tgctgctcaaagaggtcctccgggt

SEQ ID NO: 377589 - DNA, 25 bp, Mus musculus
tgctgctcacacacacacacacaca

SEQ ID NO: 377590 - DNA, 25 bp, Mus musculus
tgctgctcactgacagggtttctct

SEQ ID NO: 377591 - DNA, 25 bp, Mus musculus
tgctgctcactgcattggataccct

SEQ ID NO: 377592 - DNA, 25 bp, Mus musculus
tgctgctcagaaggctcaggaggca

SEQ ID NO: 377593 - DNA, 25 bp, Mus musculus
tgctgctcagctctgctctaaagca

SEQ ID NO: 377594 - DNA, 25 bp, Mus musculus
tgctgctcaggtcagcctccatgta

SEQ ID NO: 377595 - DNA, 25 bp, Mus musculus
tgctgctcatggatgaagttgctgc

SEQ ID NO: 377596 - DNA, 25 bp, Mus musculus
tgctgctccagagctacttctcctt

SEQ ID NO: 377597 - DNA, 25 bp, Mus musculus
tgctgctccagagctgctctgcgta

SEQ ID NO: 377598 - DNA, 25 bp, Mus musculus
tgctgctccagagctggcaggacct

SEQ ID NO: 377599 - DNA, 25 bp, Mus musculus
tgctgctccaggaaattgccaaaca

SEQ ID NO: 377600 - DNA, 25 bp, Mus musculus
tgctgctccagggtggggcactgtg

SEQ ID NO: 377601 - DNA, 25 bp, Mus musculus
tgctgctcctagaagcgtgcaatca

SEQ ID NO: 377602 - DNA, 25 bp, Mus musculus
tgctgctcctgcaggtggaagcact

SEQ ID NO: 377603 - DNA, 25 bp, Mus musculus
tgctgctcctggaggctttggaaat

SEQ ID NO: 377604 - DNA, 25 bp, Mus musculus
tgctgctcctggtaacttcaatttt

SEQ ID NO: 377605 - DNA, 25 bp, Mus musculus
tgctgctctctatttcacgctgccc

SEQ ID NO: 377606 - DNA, 25 bp, Mus musculus
tgctgctctctatttggagagaaat

SEQ ID NO: 377607 - DNA, 25 bp, Mus musculus
tgctgctctgcgccaaggacactgc

SEQ ID NO: 377608 - DNA, 25 bp, Mus musculus
tgctgctctggcaaggccagacctc

SEQ ID NO: 377609 - DNA, 25 bp, Mus musculus
tgctgctctgggtaaccaaggctct

SEQ ID NO: 377610 - DNA, 25 bp, Mus musculus
tgctgctgaaagaaattagccgagc

SEQ ID NO: 377611 - DNA, 25 bp, Mus musculus
tgctgctgaagaacttttccagtcc

SEQ ID NO: 377612 - DNA, 25 bp, Mus musculus
tgctgctgaagaggcagaggagtcc

SEQ ID NO: 377613 - DNA, 25 bp, Mus musculus
tgctgctgaatttgaagtcctgaag

SEQ ID NO: 377614 - DNA, 25 bp, Mus musculus
tgctgctgacatgttctactgggca

SEQ ID NO: 377615 - DNA, 25 bp, Mus musculus
tgctgctgagagcggcccctttgtt

SEQ ID NO: 377616 - DNA, 25 bp, Mus musculus
tgctgctgagaggttcatgtactgg

SEQ ID NO: 377617 - DNA, 25 bp, Mus musculus
tgctgctgagcaaggatgaagatgg

SEQ ID NO: 377618 - DNA, 25 bp, Mus musculus
tgctgctgcaccagattataagtgc

SEQ ID NO: 377619 - DNA, 25 bp, Mus musculus
tgctgctgcaccagattgatgtcct

SEQ ID NO: 377620 - DNA, 25 bp, Mus musculus
tgctgctgcaggtactagaagacac

SEQ ID NO: 377621 - DNA, 25 bp, Mus musculus
tgctgctgcaggttaccaacatatc

SEQ ID NO: 377622 - DNA, 25 bp, Mus musculus
tgctgctgccagataaagatagaga

SEQ ID NO: 377623 - DNA, 25 bp, Mus musculus
tgctgctgccagcaggacggccagc

SEQ ID NO: 377624 - DNA, 25 bp, Mus musculus
tgctgctgctcggcgctggagaatc

SEQ ID NO: 377625 - DNA, 25 bp, Mus musculus
tgctgctgctgctggcctctccgga

SEQ ID NO: 377626 - DNA, 25 bp, Mus musculus
tgctgctgctgctggtcacgtgaag

SEQ ID NO: 377627 - DNA, 25 bp, Mus musculus
tgctgctgctggaacgggttccagc

SEQ ID NO: 377628 - DNA, 25 bp, Mus musculus
tgctgctgctggcctctccggagtc

SEQ ID NO: 377629 - DNA, 25 bp, Mus musculus
tgctgctgctggctgggctggttct

SEQ ID NO: 377630 - DNA, 25 bp, Mus musculus
tgctgctgctgggcgctgtctcagc

SEQ ID NO: 377631 - DNA, 25 bp, Mus musculus
tgctgctgctgggtgctggagagtc

SEQ ID NO: 377632 - DNA, 25 bp, Mus musculus
tgctgctgctggtcacgtgaagaaa

SEQ ID NO: 377633 - DNA, 25 bp, Mus musculus
tgctgctggaaaagccacacctgcg

SEQ ID NO: 377634 - DNA, 25 bp, Mus musculus
tgctgctggaaaaggtacctgagat

SEQ ID NO: 377635 - DNA, 25 bp, Mus musculus
tgctgctggattcgatgatatggaa

SEQ ID NO: 377636 - DNA, 25 bp, Mus musculus
tgctgctggccggtataactgcaac

SEQ ID NO: 377637 - DNA, 25 bp, Mus musculus
tgctgctggctgggctggttcttct

SEQ ID NO: 377638 - DNA, 25 bp, Mus musculus
tgctgctgggcgctgtctcagcctc

SEQ ID NO: 377639 - DNA, 25 bp, Mus musculus
tgctgctgggcttggttcctgcctc

SEQ ID NO: 377640 - DNA, 25 bp, Mus musculus
tgctgctgtatgcccttctctagga

SEQ ID NO: 377641 - DNA, 25 bp, Mus musculus
tgctgctgtcactggtgctcctggc

SEQ ID NO: 377642 - DNA, 25 bp, Mus musculus
tgctgctgtccttcctgcttagacg

SEQ ID NO: 377643 - DNA, 25 bp, Mus musculus
tgctgctgtggaagctgggattctt

SEQ ID NO: 377644 - DNA, 25 bp, Mus musculus
tgctgctgtggaagtgtggcttctt

SEQ ID NO: 377645 - DNA, 25 bp, Mus musculus
tgctgcttaatagatcacaactggc

SEQ ID NO: 377646 - DNA, 25 bp, Mus musculus
tgctgcttatggagaccacacagga

SEQ ID NO: 377647 - DNA, 25 bp, Mus musculus
tgctgcttcagtctcgttcgagaaa

SEQ ID NO: 377648 - DNA, 25 bp, Mus musculus
tgctgcttccgggtgttggaaggac

SEQ ID NO: 377649 - DNA, 25 bp, Mus musculus
tgctgcttctaggtgctggagagtc

SEQ ID NO: 377650 - DNA, 25 bp, Mus musculus
tgctgcttctcagtcaggatggcta

SEQ ID NO: 377651 - DNA, 25 bp, Mus musculus
tgctgcttctgccaagattacagta

SEQ ID NO: 377652 - DNA, 25 bp, Mus musculus
tgctgcttctgccttgtccccacag

SEQ ID NO: 377653 - DNA, 25 bp, Mus musculus
tgctgcttctggatttatttattat

SEQ ID NO: 377654 - DNA, 25 bp, Mus musculus
tgctgcttctggctggccggcctgg

SEQ ID NO: 377655 - DNA, 25 bp, Mus musculus
tgctgcttctgggtgccggtgaatc

SEQ ID NO: 377656 - DNA, 25 bp, Mus musculus
tgctgctttggctaccgctgcttca

SEQ ID NO: 377657 - DNA, 25 bp, Mus musculus
tgctggaaaacacagccatcaccat

SEQ ID NO: 377658 - DNA, 25 bp, Mus musculus
tgctggaaaacacaggtcgcctgac

SEQ ID NO: 377659 - DNA, 25 bp, Mus musculus
tgctggaaaagccacacctgcgccc

SEQ ID NO: 377660 - DNA, 25 bp, Mus musculus
tgctggaaaagcgagctgggagaac

SEQ ID NO: 377661 - DNA, 25 bp, Mus musculus
tgctggaaaagcgaggccttggaac

SEQ ID NO: 377662 - DNA, 25 bp, Mus musculus
tgctggaaaaggtacctgagattgt

SEQ ID NO: 377663 - DNA, 25 bp, Mus musculus
tgctggaaagagattgctctctcac

SEQ ID NO: 377664 - DNA, 25 bp, Mus musculus
tgctggaacagctggacatgcgccg

SEQ ID NO: 377665 - DNA, 25 bp, Mus musculus
tgctggaacagctgggctccctttc

SEQ ID NO: 377666 - DNA, 25 bp, Mus musculus
tgctggaactaaaggaaggccctca

SEQ ID NO: 377667 - DNA, 25 bp, Mus musculus
tgctggaatgcgcagattaagaaac

SEQ ID NO: 377668 - DNA, 25 bp, Mus musculus
tgctggaattaaagctctaagaaca

SEQ ID NO: 377669 - DNA, 25 bp, Mus musculus
tgctggaattaaaggaaactagaag

SEQ ID NO: 377670 - DNA, 25 bp, Mus musculus
tgctggaattacaggatgagcctgc

SEQ ID NO: 377671 - DNA, 25 bp, Mus musculus
tgctggacaagagcggttccggagc

SEQ ID NO: 377672 - DNA, 25 bp, Mus musculus
tgctggacaaggcccgagtccggaa

SEQ ID NO: 377673 - DNA, 25 bp, Mus musculus
tgctggacaatttaggctacagaac

SEQ ID NO: 377674 - DNA, 25 bp, Mus musculus
tgctggacaggagaggatgggagcc

SEQ ID NO: 377675 - DNA, 25 bp, Mus musculus
tgctggacaggccggggcccgccgc

SEQ ID NO: 377676 - DNA, 25 bp, Mus musculus
tgctggacccgctgcggctgctgta

SEQ ID NO: 377677 - DNA, 25 bp, Mus musculus
tgctggacccgtccattggagaatt

SEQ ID NO: 377678 - DNA, 25 bp, Mus musculus
tgctggacctgggggcagcccgggc

SEQ ID NO: 377679 - DNA, 25 bp, Mus musculus
tgctggacgaggtgccagtcattat

SEQ ID NO: 377680 - DNA, 25 bp, Mus musculus
tgctggactccacgtggaacttagg

SEQ ID NO: 377681 - DNA, 25 bp, Mus musculus
tgctggactttgcttcagaaaatgc

SEQ ID NO: 377682 - DNA, 25 bp, Mus musculus
tgctggactttggttcagaaaatgc

SEQ ID NO: 377683 - DNA, 25 bp, Mus musculus
tgctggagaaagagtacttcttagc

SEQ ID NO: 377684 - DNA, 25 bp, Mus musculus
tgctggagaatcttctctgtccact

SEQ ID NO: 377685 - DNA, 25 bp, Mus musculus
tgctggagagagggaaatctacaag

SEQ ID NO: 377686 - DNA, 25 bp, Mus musculus
tgctggagaggttatcaatgctgcc

SEQ ID NO: 377687 - DNA, 25 bp, Mus musculus
tgctggagcagaagatctatcccta

SEQ ID NO: 377688 - DNA, 25 bp, Mus musculus
tgctggagccagaagaacagacaag

SEQ ID NO: 377689 - DNA, 25 bp, Mus musculus
tgctggagccagaaggtttggattc

SEQ ID NO: 377690 - DNA, 25 bp, Mus musculus
tgctggagccagaggctgcattgtg

SEQ ID NO: 377691 - DNA, 25 bp, Mus musculus
tgctggagctgagatgacgttgcac

SEQ ID NO: 377692 - DNA, 25 bp, Mus musculus
tgctggaggcccaggatttggtgtc

SEQ ID NO: 377693 - DNA, 25 bp, Mus musculus
tgctggaggtacgctggatcgcgga

SEQ ID NO: 377694 - DNA, 25 bp, Mus musculus
tgctggaggtttgctgttatttcgc

SEQ ID NO: 377695 - DNA, 25 bp, Mus musculus
tgctggagtcagaacagggagcccc

SEQ ID NO: 377696 - DNA, 25 bp, Mus musculus
tgctggagtcagaggagtttgacaa

SEQ ID NO: 377697 - DNA, 25 bp, Mus musculus
tgctggagtccatcctgatggagtg

SEQ ID NO: 377698 - DNA, 25 bp, Mus musculus
tgctggagtccatgtttactgtctt

SEQ ID NO: 377699 - DNA, 25 bp, Mus musculus
tgctggagtgagagagcctgtgctg

SEQ ID NO: 377700 - DNA, 25 bp, Mus musculus
tgctggagtgagagaggaggagcgc

SEQ ID NO: 377701 - DNA, 25 bp, Mus musculus
tgctggagtgagagctgggaagtca

SEQ ID NO: 377702 - DNA, 25 bp, Mus musculus
tgctggagtgaggcctgccacccct

SEQ ID NO: 377703 - DNA, 25 bp, Mus musculus
tgctggagtttcaggaactaatgac

SEQ ID NO: 377704 - DNA, 25 bp, Mus musculus
tgctggatcagaaaaggaagtggaa

SEQ ID NO: 377705 - DNA, 25 bp, Mus musculus
tgctggatcagaccctgaatctgtg

SEQ ID NO: 377706 - DNA, 25 bp, Mus musculus
tgctggatcagactaagagcagcgt

SEQ ID NO: 377707 - DNA, 25 bp, Mus musculus
tgctggatcagaggtatcctgtctt

SEQ ID NO: 377708 - DNA, 25 bp, Mus musculus
tgctggatcatgcacctccagagat

SEQ ID NO: 377709 - DNA, 25 bp, Mus musculus
tgctggatccccacaatgatctgca

SEQ ID NO: 377710 - DNA, 25 bp, Mus musculus
tgctggatgatcctagcaaacagaa

SEQ ID NO: 377711 - DNA, 25 bp, Mus musculus
tgctggatgatgaagttctcatcat

SEQ ID NO: 377712 - DNA, 25 bp, Mus musculus
tgctggatgccatcgatgccctcat

SEQ ID NO: 377713 - DNA, 25 bp, Mus musculus
tgctggatggctctgccttattctc

SEQ ID NO: 377714 - DNA, 25 bp, Mus musculus
tgctggatgtgcagtattcccccac

SEQ ID NO: 377715 - DNA, 25 bp, Mus musculus
tgctggattcgatgatatggaaggc

SEQ ID NO: 377716 - DNA, 25 bp, Mus musculus
tgctggatttatgataaagctgctc

SEQ ID NO: 377717 - DNA, 25 bp, Mus musculus
tgctggcaaagagtgatggcgtgca

SEQ ID NO: 377718 - DNA, 25 bp, Mus musculus
tgctggcaaaggcgggttccagcac

SEQ ID NO: 377719 - DNA, 25 bp, Mus musculus
tgctggcaaaggtgggttccagcac

SEQ ID NO: 377720 - DNA, 25 bp, Mus musculus
tgctggcaagaacttgacctcatgg

SEQ ID NO: 377721 - DNA, 25 bp, Mus musculus
tgctggcaagagtattcaggagtgg

SEQ ID NO: 377722 - DNA, 25 bp, Mus musculus
tgctggcaaggtggcgacctgcaca

SEQ ID NO: 377723 - DNA, 25 bp, Mus musculus
tgctggcaatctcagagctaagtaa

SEQ ID NO: 377724 - DNA, 25 bp, Mus musculus
tgctggcaatctcagtttgtgactc

SEQ ID NO: 377725 - DNA, 25 bp, Mus musculus
tgctggcagagaagcaacatggctt

SEQ ID NO: 377726 - DNA, 25 bp, Mus musculus
tgctggcagagaagcaataccacat

SEQ ID NO: 377727 - DNA, 25 bp, Mus musculus
tgctggcagcaatgctggctttcaa

SEQ ID NO: 377728 - DNA, 25 bp, Mus musculus
tgctggcagcctccggacccctccc

SEQ ID NO: 377729 - DNA, 25 bp, Mus musculus
tgctggcagcgaacatgcgccggga

SEQ ID NO: 377730 - DNA, 25 bp, Mus musculus
tgctggcagtaactggcaagaagac

SEQ ID NO: 377731 - DNA, 25 bp, Mus musculus
tgctggcatcgtcaagaccactggg

SEQ ID NO: 377732 - DNA, 25 bp, Mus musculus
tgctggccaaaataccgactggaaa

SEQ ID NO: 377733 - DNA, 25 bp, Mus musculus
tgctggccaagttcagcaagaaggc

SEQ ID NO: 377734 - DNA, 25 bp, Mus musculus
tgctggccaatgacactctgaacat

SEQ ID NO: 377735 - DNA, 25 bp, Mus musculus
tgctggccacagagttcctggagtc

SEQ ID NO: 377736 - DNA, 25 bp, Mus musculus
tgctggccacaggcctgcccaaggc

SEQ ID NO: 377737 - DNA, 25 bp, Mus musculus
tgctggccagatagacaggaaaatc

SEQ ID NO: 377738 - DNA, 25 bp, Mus musculus
tgctggccagcagtgacgcgccgcc

SEQ ID NO: 377739 - DNA, 25 bp, Mus musculus
tgctggccagggtttaacgtttact

SEQ ID NO: 377740 - DNA, 25 bp, Mus musculus
tgctggccagtcaagatagccagcc

SEQ ID NO: 377741 - DNA, 25 bp, Mus musculus
tgctggccatcactgatgtgtcctt

SEQ ID NO: 377742 - DNA, 25 bp, Mus musculus
tgctggccatcactgcttcaccacg

SEQ ID NO: 377743 - DNA, 25 bp, Mus musculus
tgctggccatgagtactttgtgttc

SEQ ID NO: 377744 - DNA, 25 bp, Mus musculus
tgctggccctcagctccatgaagag

SEQ ID NO: 377745 - DNA, 25 bp, Mus musculus
tgctggccctggagcctggttacct

SEQ ID NO: 377746 - DNA, 25 bp, Mus musculus
tgctggccctgggtattgactttgc

SEQ ID NO: 377747 - DNA, 25 bp, Mus musculus
tgctggccgcacttggttacaagaa

SEQ ID NO: 377748 - DNA, 25 bp, Mus musculus
tgctggccgtggatattagcatttg

SEQ ID NO: 377749 - DNA, 25 bp, Mus musculus
tgctggcctcccaagaaaccagctc

SEQ ID NO: 377750 - DNA, 25 bp, Mus musculus
tgctggcctcccaagttcttgggga

SEQ ID NO: 377751 - DNA, 25 bp, Mus musculus
tgctggcctgacaggagtccccggc

SEQ ID NO: 377752 - DNA, 25 bp, Mus musculus
tgctggcctggcgttccacgcctac

SEQ ID NO: 377753 - DNA, 25 bp, Mus musculus
tgctggccttatgtccagccatttc

SEQ ID NO: 377754 - DNA, 25 bp, Mus musculus
tgctggcgaaagctgattccaaatt

SEQ ID NO: 377755 - DNA, 25 bp, Mus musculus
tgctggcgaaagctggtttaactca

SEQ ID NO: 377756 - DNA, 25 bp, Mus musculus
tgctggcgctaaaaggtcctgtttc

SEQ ID NO: 377757 - DNA, 25 bp, Mus musculus
tgctggcgctaaaagtgatgcgatt

SEQ ID NO: 377758 - DNA, 25 bp, Mus musculus
tgctggcgttggatggttacatcca

SEQ ID NO: 377759 - DNA, 25 bp, Mus musculus
tgctggctaagaggagaaaggcagc

SEQ ID NO: 377760 - DNA, 25 bp, Mus musculus
tgctggctacccaaggccgcacatg

SEQ ID NO: 377761 - DNA, 25 bp, Mus musculus
tgctggctcttaagatcttctgtgt

SEQ ID NO: 377762 - DNA, 25 bp, Mus musculus
tgctggctgagaaaatggctgttga

SEQ ID NO: 377763 - DNA, 25 bp, Mus musculus
tgctggctggaggttggggtttctt

SEQ ID NO: 377764 - DNA, 25 bp, Mus musculus
tgctggctggcggggtgccacggct

SEQ ID NO: 377765 - DNA, 25 bp, Mus musculus
tgctggctgtgtgcggtctgttcct

SEQ ID NO: 377766 - DNA, 25 bp, Mus musculus
tgctgggaaagaatctgcatgtgtg

SEQ ID NO: 377767 - DNA, 25 bp, Mus musculus
tgctgggaaaggaaggatttaatgc

SEQ ID NO: 377768 - DNA, 25 bp, Mus musculus
tgctgggaaagggaattttaatatt

SEQ ID NO: 377769 - DNA, 25 bp, Mus musculus
tgctgggaaagtccagatagtatcc

SEQ ID NO: 377770 - DNA, 25 bp, Mus musculus
tgctgggaagatgagccagatagcc

SEQ ID NO: 377771 - DNA, 25 bp, Mus musculus
tgctgggaaggatctggttctacac

SEQ ID NO: 377772 - DNA, 25 bp, Mus musculus
tgctgggaagggagagcacctggcc

SEQ ID NO: 377773 - DNA, 25 bp, Mus musculus
tgctgggaagtccgcccgtgctgtg

SEQ ID NO: 377774 - DNA, 25 bp, Mus musculus
tgctgggacaattgaacaattgcct

SEQ ID NO: 377775 - DNA, 25 bp, Mus musculus
tgctgggacaattgactggctgtgt

SEQ ID NO: 377776 - DNA, 25 bp, Mus musculus
tgctgggactaaagagatggatgtc

SEQ ID NO: 377777 - DNA, 25 bp, Mus musculus
tgctgggactaaaggggacagctgt

SEQ ID NO: 377778 - DNA, 25 bp, Mus musculus
tgctgggaggagagcgacatgtttg

SEQ ID NO: 377779 - DNA, 25 bp, Mus musculus
tgctgggaggaggtggcccagagtg

SEQ ID NO: 377780 - DNA, 25 bp, Mus musculus
tgctgggatccagaatttggggtgc

SEQ ID NO: 377781 - DNA, 25 bp, Mus musculus
tgctgggatggggaacatgacatcg

SEQ ID NO: 377782 - DNA, 25 bp, Mus musculus
tgctgggattaaagagacttccttg

SEQ ID NO: 377783 - DNA, 25 bp, Mus musculus
tgctgggattaaagatccagctgag

SEQ ID NO: 377784 - DNA, 25 bp, Mus musculus
tgctgggattaaagcagatataatt

SEQ ID NO: 377785 - DNA, 25 bp, Mus musculus
tgctgggattaaagcgtgagggtca

SEQ ID NO: 377786 - DNA, 25 bp, Mus musculus
tgctgggattaaaggggtccctcca

SEQ ID NO: 377787 - DNA, 25 bp, Mus musculus
tgctgggattaaaggtgtgggaaca

SEQ ID NO: 377788 - DNA, 25 bp, Mus musculus
tgctgggattaaaggttgtaagcat

SEQ ID NO: 377789 - DNA, 25 bp, Mus musculus
tgctgggattaaagtgctctgtgaa

SEQ ID NO: 377790 - DNA, 25 bp, Mus musculus
tgctgggattaatgatgctctccaa

SEQ ID NO: 377791 - DNA, 25 bp, Mus musculus
tgctgggattacagactcctccacc

SEQ ID NO: 377792 - DNA, 25 bp, Mus musculus
tgctgggattacaggttccacagca

SEQ ID NO: 377793 - DNA, 25 bp, Mus musculus
tgctgggattacaggttggcttcct

SEQ ID NO: 377794 - DNA, 25 bp, Mus musculus
tgctgggattacagtcttgaaatac

SEQ ID NO: 377795 - DNA, 25 bp, Mus musculus
tgctgggattagaggagttggaacc

SEQ ID NO: 377796 - DNA, 25 bp, Mus musculus
tgctgggattatgaggactccaagc

SEQ ID NO: 377797 - DNA, 25 bp, Mus musculus
tgctgggattccaggatggcagctc

SEQ ID NO: 377798 - DNA, 25 bp, Mus musculus
tgctgggattccaggtgacagagtg

SEQ ID NO: 377799 - DNA, 25 bp, Mus musculus
tgctgggattgcagttttcaaagat

SEQ ID NO: 377800 - DNA, 25 bp, Mus musculus
tgctgggcacgggagcctatgggaa

SEQ ID NO: 377801 - DNA, 25 bp, Mus musculus
tgctgggcacgggagtccgggtttg

SEQ ID NO: 377802 - DNA, 25 bp, Mus musculus
tgctgggcagctccagatgaaaatg

SEQ ID NO: 377803 - DNA, 25 bp, Mus musculus
tgctgggcaggtacctggacaatgt

SEQ ID NO: 377804 - DNA, 25 bp, Mus musculus
tgctgggcatctgtgtgatctcagt

SEQ ID NO: 377805 - DNA, 25 bp, Mus musculus
tgctgggcctggcaggggctgcgat

SEQ ID NO: 377806 - DNA, 25 bp, Mus musculus
tgctgggcctggcaggttcagtcct

SEQ ID NO: 377807 - DNA, 25 bp, Mus musculus
tgctgggctcagagggagtggggcc

SEQ ID NO: 377808 - DNA, 25 bp, Mus musculus
tgctgggcttggttcctgcctcaag

SEQ ID NO: 377809 - DNA, 25 bp, Mus musculus
tgctgggcttgtgtcttccaaaatt

SEQ ID NO: 377810 - DNA, 25 bp, Mus musculus
tgctggggaacatggaaagctgcct

SEQ ID NO: 377811 - DNA, 25 bp, Mus musculus
tgctggggaagcctgggtcacgtga

SEQ ID NO: 377812 - DNA, 25 bp, Mus musculus
tgctggggaagctggctgtgactcg

SEQ ID NO: 377813 - DNA, 25 bp, Mus musculus
tgctggggaagctgggatctcaagc

SEQ ID NO: 377814 - DNA, 25 bp, Mus musculus
tgctggggaaggaaggtgaccattg

SEQ ID NO: 377815 - DNA, 25 bp, Mus musculus
tgctggggaaggaagtgagcctggt

SEQ ID NO: 377816 - DNA, 25 bp, Mus musculus
tgctggggctacagatagggtctct

SEQ ID NO: 377817 - DNA, 25 bp, Mus musculus
tgctggggctacagatttatgacat

SEQ ID NO: 377818 - DNA, 25 bp, Mus musculus
tgctgggggctgggggggccaagat

SEQ ID NO: 377819 - DNA, 25 bp, Mus musculus
tgctgggggtcgcggggctcggatg

SEQ ID NO: 377820 - DNA, 25 bp, Mus musculus
tgctggggtacgcccgagctccagc

SEQ ID NO: 377821 - DNA, 25 bp, Mus musculus
tgctggggtccagctgtcaccctgc

SEQ ID NO: 377822 - DNA, 25 bp, Mus musculus
tgctggggtccagggaaaggctcga

SEQ ID NO: 377823 - DNA, 25 bp, Mus musculus
tgctgggtcagccgggatcaactgc

SEQ ID NO: 377824 - DNA, 25 bp, Mus musculus
tgctgggtcagccggttttttcatt

SEQ ID NO: 377825 - DNA, 25 bp, Mus musculus
tgctgggtcaggactaatgtaattg

SEQ ID NO: 377826 - DNA, 25 bp, Mus musculus
tgctgggtcagggataaaaagagca

SEQ ID NO: 377827 - DNA, 25 bp, Mus musculus
tgctgggtcaggtcaggaagcaggc

SEQ ID NO: 377828 - DNA, 25 bp, Mus musculus
tgctgggtcatacggtaacatttca

SEQ ID NO: 377829 - DNA, 25 bp, Mus musculus
tgctgggtggagagatcattcctcg

SEQ ID NO: 377830 - DNA, 25 bp, Mus musculus
tgctgggtttaaagaatacttgaac

SEQ ID NO: 377831 - DNA, 25 bp, Mus musculus
tgctggtaaaagctgatgaagagac

SEQ ID NO: 377832 - DNA, 25 bp, Mus musculus
tgctggtaaccaaagctgttctgtg

SEQ ID NO: 377833 - DNA, 25 bp, Mus musculus
tgctggtaagcattcactaatccag

SEQ ID NO: 377834 - DNA, 25 bp, Mus musculus
tgctggtaaggattcactaatccag

SEQ ID NO: 377835 - DNA, 25 bp, Mus musculus
tgctggtagatgctgacggctagac

SEQ ID NO: 377836 - DNA, 25 bp, Mus musculus
tgctggtagatggtgactagaggac

SEQ ID NO: 377837 - DNA, 25 bp, Mus musculus
tgctggtagatttgttgaatgacaa

SEQ ID NO: 377838 - DNA, 25 bp, Mus musculus
tgctggtagcctcggattccagagg

SEQ ID NO: 377839 - DNA, 25 bp, Mus musculus
tgctggtcaaagatgacctggatgg

SEQ ID NO: 377840 - DNA, 25 bp, Mus musculus
tgctggtcacgagctcttctgatct

SEQ ID NO: 377841 - DNA, 25 bp, Mus musculus
tgctggtcacgaggtaaccatcttg

SEQ ID NO: 377842 - DNA, 25 bp, Mus musculus
tgctggtcagagaattgaccttgct

SEQ ID NO: 377843 - DNA, 25 bp, Mus musculus
tgctggtcagctctgcaatctgagg

SEQ ID NO: 377844 - DNA, 25 bp, Mus musculus
tgctggtcaggcagagttcacggcc

SEQ ID NO: 377845 - DNA, 25 bp, Mus musculus
tgctggtcattaagggaaagatgga

SEQ ID NO: 377846 - DNA, 25 bp, Mus musculus
tgctggtccccctggtgctactggc

SEQ ID NO: 377847 - DNA, 25 bp, Mus musculus
tgctggtgaaggttcaattgtgaat

SEQ ID NO: 377848 - DNA, 25 bp, Mus musculus
tgctggtgaagttatgtaatccaaa

SEQ ID NO: 377849 - DNA, 25 bp, Mus musculus
tgctggtgagaggaagctttgtctc

SEQ ID NO: 377850 - DNA, 25 bp, Mus musculus
tgctggtgctcaggcattgcagctc

SEQ ID NO: 377851 - DNA, 25 bp, Mus musculus
tgctggtgctccggcattgcagctc

SEQ ID NO: 377852 - DNA, 25 bp, Mus musculus
tgctggtgctccgtggaccctaatg

SEQ ID NO: 377853 - DNA, 25 bp, Mus musculus
tgctggtgctgctggtgctcggggt

SEQ ID NO: 377854 - DNA, 25 bp, Mus musculus
tgctggtggaactggaaggcacaat

SEQ ID NO: 377855 - DNA, 25 bp, Mus musculus
tgctggtggaaggaggcaggattga

SEQ ID NO: 377856 - DNA, 25 bp, Mus musculus
tgctggtggagaaggtgtaaccagc

SEQ ID NO: 377857 - DNA, 25 bp, Mus musculus
tgctggtggagctggatcgggcggt

SEQ ID NO: 377858 - DNA, 25 bp, Mus musculus
tgctggtggagttctaccccacaat

SEQ ID NO: 377859 - DNA, 25 bp, Mus musculus
tgctggtggagttctatgccccgtg

SEQ ID NO: 377860 - DNA, 25 bp, Mus musculus
tgctggtggagttctatgccccttg

SEQ ID NO: 377861 - DNA, 25 bp, Mus musculus
tgctggtggccagagagctgaagcg

SEQ ID NO: 377862 - DNA, 25 bp, Mus musculus
tgctggtggctcagtttctacagtt

SEQ ID NO: 377863 - DNA, 25 bp, Mus musculus
tgctggtggctcagtttcttcggct

SEQ ID NO: 377864 - DNA, 25 bp, Mus musculus
tgctggtgggcaggtgtgctgatgt

SEQ ID NO: 377865 - DNA, 25 bp, Mus musculus
tgctggtgggcagtggagaaaaatg

SEQ ID NO: 377866 - DNA, 25 bp, Mus musculus
tgctggtggtgaactaaagcaccga

SEQ ID NO: 377867 - DNA, 25 bp, Mus musculus
tgctggtggtgaactgctgtatctt

SEQ ID NO: 377868 - DNA, 25 bp, Mus musculus
tgctggtggtgaagtatatcatgta

SEQ ID NO: 377869 - DNA, 25 bp, Mus musculus
tgctggtggtggcatcgtttgcatt

SEQ ID NO: 377870 - DNA, 25 bp, Mus musculus
tgctggtggtgttcagacagtaact

SEQ ID NO: 377871 - DNA, 25 bp, Mus musculus
tgctggtgtccgagatgcatgctgt

SEQ ID NO: 377872 - DNA, 25 bp, Mus musculus
tgctggtgtccgaggtcttcagatt

SEQ ID NO: 377873 - DNA, 25 bp, Mus musculus
tgctggtgtccgagtgtcctgcagg

SEQ ID NO: 377874 - DNA, 25 bp, Mus musculus
tgctggtgtcctaggccacagaagg

SEQ ID NO: 377875 - DNA, 25 bp, Mus musculus
tgctggtttatttacaccaagctgg

SEQ ID NO: 377876 - DNA, 25 bp, Mus musculus
tgctgtaaaactactgagaaggtcc

SEQ ID NO: 377877 - DNA, 25 bp, Mus musculus
tgctgtaaaactactgtcctcggcc

SEQ ID NO: 377878 - DNA, 25 bp, Mus musculus
tgctgtaaaactactgttttggtga

SEQ ID NO: 377879 - DNA, 25 bp, Mus musculus
tgctgtaaaagagaggaggctcaca

SEQ ID NO: 377880 - DNA, 25 bp, Mus musculus
tgctgtaaaggctggctactgtttg

SEQ ID NO: 377881 - DNA, 25 bp, Mus musculus
tgctgtaaatgaaggaatatgctca

SEQ ID NO: 377882 - DNA, 25 bp, Mus musculus
tgctgtacagagatggcccacacgg

SEQ ID NO: 377883 - DNA, 25 bp, Mus musculus
tgctgtacatgggatgctagccaac

SEQ ID NO: 377884 - DNA, 25 bp, Mus musculus
tgctgtaccagatcccacaacgtct

SEQ ID NO: 377885 - DNA, 25 bp, Mus musculus
tgctgtacgcgtcttgttggagatc

SEQ ID NO: 377886 - DNA, 25 bp, Mus musculus
tgctgtacgcgtgccggaattgcga

SEQ ID NO: 377887 - DNA, 25 bp, Mus musculus
tgctgtactggatgcaagacgctat

SEQ ID NO: 377888 - DNA, 25 bp, Mus musculus
tgctgtactgggtcaatgatgccgt

SEQ ID NO: 377889 - DNA, 25 bp, Mus musculus
tgctgtagagagacaatgtctatgt

SEQ ID NO: 377890 - DNA, 25 bp, Mus musculus
tgctgtagaggttgctgcatcccag

SEQ ID NO: 377891 - DNA, 25 bp, Mus musculus
tgctgtaggactttgagctgaggct

SEQ ID NO: 377892 - DNA, 25 bp, Mus musculus
tgctgtagtagtgactctcttttgg

SEQ ID NO: 377893 - DNA, 25 bp, Mus musculus
tgctgtataccctggtcagcctgct

SEQ ID NO: 377894 - DNA, 25 bp, Mus musculus
tgctgtataccggtcagctgctgga

SEQ ID NO: 377895 - DNA, 25 bp, Mus musculus
tgctgtatccacgagaggcacgcca

SEQ ID NO: 377896 - DNA, 25 bp, Mus musculus
tgctgtatctggtgctctaccttag

SEQ ID NO: 377897 - DNA, 25 bp, Mus musculus
tgctgtatctggtgctctaccttca

SEQ ID NO: 377898 - DNA, 25 bp, Mus musculus
tgctgtatgcccttctctaggaagg

SEQ ID NO: 377899 - DNA, 25 bp, Mus musculus
tgctgtatgggtggtctatcacacc

SEQ ID NO: 377900 - DNA, 25 bp, Mus musculus
tgctgtatggtgcccagcacggcct

SEQ ID NO: 377901 - DNA, 25 bp, Mus musculus
tgctgtatgtatacgacaccacggc

SEQ ID NO: 377902 - DNA, 25 bp, Mus musculus
tgctgtatgtatacgatccccccac

SEQ ID NO: 377903 - DNA, 25 bp, Mus musculus
tgctgtatgtatacgcaccaccacc

SEQ ID NO: 377904 - DNA, 25 bp, Mus musculus
tgctgtcaaactacagagtgaatgc

SEQ ID NO: 377905 - DNA, 25 bp, Mus musculus
tgctgtcaaggcccgcctggctgcc

SEQ ID NO: 377906 - DNA, 25 bp, Mus musculus
tgctgtcactggtgctcctggctct

SEQ ID NO: 377907 - DNA, 25 bp, Mus musculus
tgctgtcaggaagggactggaatac

SEQ ID NO: 377908 - DNA, 25 bp, Mus musculus
tgctgtcatcgaaggagctgtgcgg

SEQ ID NO: 377909 - DNA, 25 bp, Mus musculus
tgctgtcatggaggtttatcaccag

SEQ ID NO: 377910 - DNA, 25 bp, Mus musculus
tgctgtccaagttggggctcgctgt

SEQ ID NO: 377911 - DNA, 25 bp, Mus musculus
tgctgtccacaggtccacggtgtgg

SEQ ID NO: 377912 - DNA, 25 bp, Mus musculus
tgctgtccactttgatcttcatggt

SEQ ID NO: 377913 - DNA, 25 bp, Mus musculus
tgctgtccagaaccccgtctgtggc

SEQ ID NO: 377914 - DNA, 25 bp, Mus musculus
tgctgtccagagatgggtggctggt

SEQ ID NO: 377915 - DNA, 25 bp, Mus musculus
tgctgtccagggtgaagcctgctgg

SEQ ID NO: 377916 - DNA, 25 bp, Mus musculus
tgctgtcccacattggcaagacatt

SEQ ID NO: 377917 - DNA, 25 bp, Mus musculus
tgctgtcccaggtgctcctggtcac

SEQ ID NO: 377918 - DNA, 25 bp, Mus musculus
tgctgtcctagggacaaagtataga

SEQ ID NO: 377919 - DNA, 25 bp, Mus musculus
tgctgtcctaggggctcaaggaacc

SEQ ID NO: 377920 - DNA, 25 bp, Mus musculus
tgctgtcctatgcttcccatgatga

SEQ ID NO: 377921 - DNA, 25 bp, Mus musculus
tgctgtcctgaggattcggcccttt

SEQ ID NO: 377922 - DNA, 25 bp, Mus musculus
tgctgtccttacagggaatttaatg

SEQ ID NO: 377923 - DNA, 25 bp, Mus musculus
tgctgtccttcctgcttagacgcct

SEQ ID NO: 377924 - DNA, 25 bp, Mus musculus
tgctgtcgcagacggttcccagcag

SEQ ID NO: 377925 - DNA, 25 bp, Mus musculus
tgctgtcgtgcctcgaggcagcact

SEQ ID NO: 377926 - DNA, 25 bp, Mus musculus
tgctgtctatgtactgtgctactct

SEQ ID NO: 377927 - DNA, 25 bp, Mus musculus
tgctgtctcaggacactgctggccg

SEQ ID NO: 377928 - DNA, 25 bp, Mus musculus
tgctgtctcagggtgaaagagcaat

SEQ ID NO: 377929 - DNA, 25 bp, Mus musculus
tgctgtctccaggtgacattccaag

SEQ ID NO: 377930 - DNA, 25 bp, Mus musculus
tgctgtctgcaaggagaagatcgga

SEQ ID NO: 377931 - DNA, 25 bp, Mus musculus
tgctgtctgtgaacaaatctaccag

SEQ ID NO: 377932 - DNA, 25 bp, Mus musculus
tgctgtctgtgcagtactccaggag

SEQ ID NO: 377933 - DNA, 25 bp, Mus musculus
tgctgtgaaatcttctattccaagg

SEQ ID NO: 377934 - DNA, 25 bp, Mus musculus
tgctgtgaactagagcttctggaat

SEQ ID NO: 377935 - DNA, 25 bp, Mus musculus
tgctgtgaatctgtttcccatgctg

SEQ ID NO: 377936 - DNA, 25 bp, Mus musculus
tgctgtgacacttggtccctccagc

SEQ ID NO: 377937 - DNA, 25 bp, Mus musculus
tgctgtgacccaggagctgccttac

SEQ ID NO: 377938 - DNA, 25 bp, Mus musculus
tgctgtgactgagagcgagctgacc

SEQ ID NO: 377939 - DNA, 25 bp, Mus musculus
tgctgtgactgagagtgagaaagcg

SEQ ID NO: 377940 - DNA, 25 bp, Mus musculus
tgctgtgagcaagatcattgagcgc

SEQ ID NO: 377941 - DNA, 25 bp, Mus musculus
tgctgtgagcaaggctctacccctg

SEQ ID NO: 377942 - DNA, 25 bp, Mus musculus
tgctgtgagtgctccgtggcctctc

SEQ ID NO: 377943 - DNA, 25 bp, Mus musculus
tgctgtgatcacggtgacaaacttg

SEQ ID NO: 377944 - DNA, 25 bp, Mus musculus
tgctgtgatggagtcctcatggaaa

SEQ ID NO: 377945 - DNA, 25 bp, Mus musculus
tgctgtgcaaatggcaagctgtgca

SEQ ID NO: 377946 - DNA, 25 bp, Mus musculus
tgctgtgcaaatggtacaatcagct

SEQ ID NO: 377947 - DNA, 25 bp, Mus musculus
tgctgtgcagagcagatctggtggc

SEQ ID NO: 377948 - DNA, 25 bp, Mus musculus
tgctgtgcagctttttagaacttca

SEQ ID NO: 377949 - DNA, 25 bp, Mus musculus
tgctgtgcccctggctgggtttggt

SEQ ID NO: 377950 - DNA, 25 bp, Mus musculus
tgctgtgcccctgttcacctgctgt

SEQ ID NO: 377951 - DNA, 25 bp, Mus musculus
tgctgtgccgactacgtggaggagc

SEQ ID NO: 377952 - DNA, 25 bp, Mus musculus
tgctgtgccttgcacaacccggtct

SEQ ID NO: 377953 - DNA, 25 bp, Mus musculus
tgctgtgctgggtcacttttcatat

SEQ ID NO: 377954 - DNA, 25 bp, Mus musculus
tgctgtgcttgaggtgattgaagaa

SEQ ID NO: 377955 - DNA, 25 bp, Mus musculus
tgctgtggaagctgggattcttcaa

SEQ ID NO: 377956 - DNA, 25 bp, Mus musculus
tgctgtggaagtgtggcttcttccg

SEQ ID NO: 377957 - DNA, 25 bp, Mus musculus
tgctgtggacaagaaaggtgacact

SEQ ID NO: 377958 - DNA, 25 bp, Mus musculus
tgctgtggaccagtacctgatacta

SEQ ID NO: 377959 - DNA, 25 bp, Mus musculus
tgctgtggagatcggcctggccttc

SEQ ID NO: 377960 - DNA, 25 bp, Mus musculus
tgctgtggagattcatgacttgcag

SEQ ID NO: 377961 - DNA, 25 bp, Mus musculus
tgctgtggagctccttcaaaaaatg

SEQ ID NO: 377962 - DNA, 25 bp, Mus musculus
tgctgtggaggagaatggggagacc

SEQ ID NO: 377963 - DNA, 25 bp, Mus musculus
tgctgtggcagaattctcttttgtt

SEQ ID NO: 377964 - DNA, 25 bp, Mus musculus
tgctgtggcagatttgcaaacacga

SEQ ID NO: 377965 - DNA, 25 bp, Mus musculus
tgctgtggcattaagcactgaatgc

SEQ ID NO: 377966 - DNA, 25 bp, Mus musculus
tgctgtgggaaagtacattgagcat

SEQ ID NO: 377967 - DNA, 25 bp, Mus musculus
tgctgtgggaacttatttagaagtc

SEQ ID NO: 377968 - DNA, 25 bp, Mus musculus
tgctgtgggagctgtgatggatgat

SEQ ID NO: 377969 - DNA, 25 bp, Mus musculus
tgctgtgggcagggtgcctggctac

SEQ ID NO: 377970 - DNA, 25 bp, Mus musculus
tgctgtggtgacgctagagaactgg

SEQ ID NO: 377971 - DNA, 25 bp, Mus musculus
tgctgtgtgcaggagagatgggtgg

SEQ ID NO: 377972 - DNA, 25 bp, Mus musculus
tgctgtgtggatatctatgatagag

SEQ ID NO: 377973 - DNA, 25 bp, Mus musculus
tgctgtgtggatatgtttctgaaca

SEQ ID NO: 377974 - DNA, 25 bp, Mus musculus
tgctgtgtggatattgtgattcgtc

SEQ ID NO: 377975 - DNA, 25 bp, Mus musculus
tgctgtgtggctgagagtgctagct

SEQ ID NO: 377976 - DNA, 25 bp, Mus musculus
tgctgtgttactgaggcaacgtttc

SEQ ID NO: 377977 - DNA, 25 bp, Mus musculus
tgctgtgttactgagggactttgta

SEQ ID NO: 377978 - DNA, 25 bp, Mus musculus
tgctgtgttttattggatcgtggag

SEQ ID NO: 377979 - DNA, 25 bp, Mus musculus
tgctgttaaggaagaagagctggag

SEQ ID NO: 377980 - DNA, 25 bp, Mus musculus
tgctgttaatactgtggatttcttc

SEQ ID NO: 377981 - DNA, 25 bp, Mus musculus
tgctgttaatagtgtcccttttccc

SEQ ID NO: 377982 - DNA, 25 bp, Mus musculus
tgctgttacctcttatgccctgctg

SEQ ID NO: 377983 - DNA, 25 bp, Mus musculus
tgctgttacctcttctggctcatcg

SEQ ID NO: 377984 - DNA, 25 bp, Mus musculus
tgctgttactataaagctctgaagt

SEQ ID NO: 377985 - DNA, 25 bp, Mus musculus
tgctgttactattgacaccgattct

SEQ ID NO: 377986 - DNA, 25 bp, Mus musculus
tgctgttatcggaaataaagaaaga

SEQ ID NO: 377987 - DNA, 25 bp, Mus musculus
tgctgttattctggtatgggacgtt

SEQ ID NO: 377988 - DNA, 25 bp, Mus musculus
tgctgttcagccagggacagtggcc

SEQ ID NO: 377989 - DNA, 25 bp, Mus musculus
tgctgttcagggtgactcatattct

SEQ ID NO: 377990 - DNA, 25 bp, Mus musculus
tgctgttcagtcaaggacagtggcc

SEQ ID NO: 377991 - DNA, 25 bp, Mus musculus
tgctgttcccgatccgtacttcggt

SEQ ID NO: 377992 - DNA, 25 bp, Mus musculus
tgctgttcctgattatctattatct

SEQ ID NO: 377993 - DNA, 25 bp, Mus musculus
tgctgttctaaagaggacagatcac

SEQ ID NO: 377994 - DNA, 25 bp, Mus musculus
tgctgttctaaagagtaaccaggac

SEQ ID NO: 377995 - DNA, 25 bp, Mus musculus
tgctgttctaaagagtccaggtctc

SEQ ID NO: 377996 - DNA, 25 bp, Mus musculus
tgctgttctaaagagttggagaaca

SEQ ID NO: 377997 - DNA, 25 bp, Mus musculus
tgctgttctgaatgaagggacctga

SEQ ID NO: 377998 - DNA, 25 bp, Mus musculus
tgctgttctggctagccggatcagc

SEQ ID NO: 377999 - DNA, 25 bp, Mus musculus
tgctgttctttaaaggggactttgc

SEQ ID NO: 378000 - DNA, 25 bp, Mus musculus
tgctgttctttaaaggggagtttgt

SEQ ID NO: 378001 - DNA, 25 bp, Mus musculus
tgctgttctttatcctgggtgctgt

SEQ ID NO: 378002 - DNA, 25 bp, Mus musculus
tgctgttgaaaaaagcttatccatg

SEQ ID NO: 378003 - DNA, 25 bp, Mus musculus
tgctgttgctcggtgcgggcgagtc

SEQ ID NO: 378004 - DNA, 25 bp, Mus musculus
tgctgttggaaagtcgacagaggca

SEQ ID NO: 378005 - DNA, 25 bp, Mus musculus
tgctgttggaggaactgtactgagt

SEQ ID NO: 378006 - DNA, 25 bp, Mus musculus
tgctgttggggctaggtgtctccag

SEQ ID NO: 378007 - DNA, 25 bp, Mus musculus
tgctgttggggctagtgcttatcct

SEQ ID NO: 378008 - DNA, 25 bp, Mus musculus
tgctgttgtacttggccagccgtgt

SEQ ID NO: 378009 - DNA, 25 bp, Mus musculus
tgctgtttatggaccttgagatcac

SEQ ID NO: 378010 - DNA, 25 bp, Mus musculus
tgctgtttcccgcgggcaaggcacg

SEQ ID NO: 378011 - DNA, 25 bp, Mus musculus
tgctgtttcccgcgggtgtcctggc

SEQ ID NO: 378012 - DNA, 25 bp, Mus musculus
tgctgtttcctcctaggatgtcagg

SEQ ID NO: 378013 - DNA, 25 bp, Mus musculus
tgctgtttgagcgatttattgccaa

SEQ ID NO: 378014 - DNA, 25 bp, Mus musculus
tgctgtttgcaagaatgcatcttaa

SEQ ID NO: 378015 - DNA, 25 bp, Mus musculus
tgctgtttgcaaggtatccattatg

SEQ ID NO: 378016 - DNA, 25 bp, Mus musculus
tgctgttttgaagattaaaggttgc

SEQ ID NO: 378017 - DNA, 25 bp, Mus musculus
tgctgttttgatgattccaagagca

SEQ ID NO: 378018 - DNA, 25 bp, Mus musculus
tgcttaaaaaggcaatgatagtgag

SEQ ID NO: 378019 - DNA, 25 bp, Mus musculus
tgcttaaaatcaggaaattttgcca

SEQ ID NO: 378020 - DNA, 25 bp, Mus musculus
tgcttaaaatcaggcagggagaaga

SEQ ID NO: 378021 - DNA, 25 bp, Mus musculus
tgcttaaaatttggattcctgtctc

SEQ ID NO: 378022 - DNA, 25 bp, Mus musculus
tgcttaaacaaggtgattctgctgc

SEQ ID NO: 378023 - DNA, 25 bp, Mus musculus
tgcttaagagaaggtgttaggagtg

SEQ ID NO: 378024 - DNA, 25 bp, Mus musculus
tgcttaatagacttggtcccctgca

SEQ ID NO: 378025 - DNA, 25 bp, Mus musculus
tgcttaatagatcacaactggctat

SEQ ID NO: 378026 - DNA, 25 bp, Mus musculus
tgcttaatagattgtgcccacctat

SEQ ID NO: 378027 - DNA, 25 bp, Mus musculus
tgcttaataggtgtgtcctctggtc

SEQ ID NO: 378028 - DNA, 25 bp, Mus musculus
tgcttaatcaccaaggtcacgtgaa

SEQ ID NO: 378029 - DNA, 25 bp, Mus musculus
tgcttaatgaaaagtatttttctga

SEQ ID NO: 378030 - DNA, 25 bp, Mus musculus
tgcttaatgaaacccacagcactgg

SEQ ID NO: 378031 - DNA, 25 bp, Mus musculus
tgcttacaagattccgggctttaga

SEQ ID NO: 378032 - DNA, 25 bp, Mus musculus
tgcttacaaggccacagtgaacgcc

SEQ ID NO: 378033 - DNA, 25 bp, Mus musculus
tgcttacacatgtgcacattttact

SEQ ID NO: 378034 - DNA, 25 bp, Mus musculus
tgcttacccagtggggtacatgtac

SEQ ID NO: 378035 - DNA, 25 bp, Mus musculus
tgcttacccgccgcagctccggagt

SEQ ID NO: 378036 - DNA, 25 bp, Mus musculus
tgcttacccggtacctggcagcatg

SEQ ID NO: 378037 - DNA, 25 bp, Mus musculus
tgcttaccttaccactgagatacta

SEQ ID NO: 378038 - DNA, 25 bp, Mus musculus
tgcttacgctcagacagtccagggc

SEQ ID NO: 378039 - DNA, 25 bp, Mus musculus
tgcttactggactatccgatacacc

SEQ ID NO: 378040 - DNA, 25 bp, Mus musculus
tgcttactgtgagcgtgcaatgatg

SEQ ID NO: 378041 - DNA, 25 bp, Mus musculus
tgcttagaaagagcaactgtcctgt

SEQ ID NO: 378042 - DNA, 25 bp, Mus musculus
tgcttagagagttttgtcaagagtc

SEQ ID NO: 378043 - DNA, 25 bp, Mus musculus
tgcttagcaaggcacaacacgtacc

SEQ ID NO: 378044 - DNA, 25 bp, Mus musculus
tgcttagcataaaggcatttacact

SEQ ID NO: 378045 - DNA, 25 bp, Mus musculus
tgcttaggagagtgacagctagaat

SEQ ID NO: 378046 - DNA, 25 bp, Mus musculus
tgcttagtgtggatctgttaagatt

SEQ ID NO: 378047 - DNA, 25 bp, Mus musculus
tgcttataagactgaagagggaaca

SEQ ID NO: 378048 - DNA, 25 bp, Mus musculus
tgcttataagagagcttcatggagt

SEQ ID NO: 378049 - DNA, 25 bp, Mus musculus
tgcttataaggacccatagatgaac

SEQ ID NO: 378050 - DNA, 25 bp, Mus musculus
tgcttataagggtccgtcgtaacct

SEQ ID NO: 378051 - DNA, 25 bp, Mus musculus
tgcttataaggtgcacacaggacga

SEQ ID NO: 378052 - DNA, 25 bp, Mus musculus
tgcttatagtatgagagcatattcc

SEQ ID NO: 378053 - DNA, 25 bp, Mus musculus
tgcttatagtatgaggtacctgtcg

SEQ ID NO: 378054 - DNA, 25 bp, Mus musculus
tgcttatagtatgagtgatgtcctc

SEQ ID NO: 378055 - DNA, 25 bp, Mus musculus
tgcttatatggaaagtaaattcagt

SEQ ID NO: 378056 - DNA, 25 bp, Mus musculus
tgcttatcatcagcaacagcaacag

SEQ ID NO: 378057 - DNA, 25 bp, Mus musculus
tgcttatccaggttatcttctctgt

SEQ ID NO: 378058 - DNA, 25 bp, Mus musculus
tgcttatccatgaaggagcctacag

SEQ ID NO: 378059 - DNA, 25 bp, Mus musculus
tgcttatccatgaaggagtccgctc

SEQ ID NO: 378060 - DNA, 25 bp, Mus musculus
tgcttatctagggtggaagaaagcc

SEQ ID NO: 378061 - DNA, 25 bp, Mus musculus
tgcttatgacaaacatttttcagta

SEQ ID NO: 378062 - DNA, 25 bp, Mus musculus
tgcttatgacaggattgtggttgct

SEQ ID NO: 378063 - DNA, 25 bp, Mus musculus
tgcttatgacaggctgaagccatca

SEQ ID NO: 378064 - DNA, 25 bp, Mus musculus
tgcttatgaggaagaattctttcat

SEQ ID NO: 378065 - DNA, 25 bp, Mus musculus
tgcttatggagaccacacaggaggg

SEQ ID NO: 378066 - DNA, 25 bp, Mus musculus
tgcttatgggaggtccaaatatcac

SEQ ID NO: 378067 - DNA, 25 bp, Mus musculus
tgcttattatgctggataataagaa

SEQ ID NO: 378068 - DNA, 25 bp, Mus musculus
tgcttattcctgaagcagaaccacc

SEQ ID NO: 378069 - DNA, 25 bp, Mus musculus
tgcttattcctgaaggaggctgtga

SEQ ID NO: 378070 - DNA, 25 bp, Mus musculus
tgcttattgagttcagctatgaact

SEQ ID NO: 378071 - DNA, 25 bp, Mus musculus
tgcttcaaccagggccagtccctgt

SEQ ID NO: 378072 - DNA, 25 bp, Mus musculus
tgcttcaagaggcttggctttctga

SEQ ID NO: 378073 - DNA, 25 bp, Mus musculus
tgcttcaagcagcatgattgggctg

SEQ ID NO: 378074 - DNA, 25 bp, Mus musculus
tgcttcaagcagcgttccacgccta

SEQ ID NO: 378075 - DNA, 25 bp, Mus musculus
tgcttcaagcagtgtggcattgtcc

SEQ ID NO: 378076 - DNA, 25 bp, Mus musculus
tgcttcaccaccacctccaaagact

SEQ ID NO: 378077 - DNA, 25 bp, Mus musculus
tgcttcactagaaagaaaaatgact

SEQ ID NO: 378078 - DNA, 25 bp, Mus musculus
tgcttcagaagatggttacggctct

SEQ ID NO: 378079 - DNA, 25 bp, Mus musculus
tgcttcagaaggcacctcttccctt

SEQ ID NO: 378080 - DNA, 25 bp, Mus musculus
tgcttcagagaaggacagtgtcccc

SEQ ID NO: 378081 - DNA, 25 bp, Mus musculus
tgcttcagagaaggatgggggaacc

SEQ ID NO: 378082 - DNA, 25 bp, Mus musculus
tgcttcagagtctgaaagggtggct

SEQ ID NO: 378083 - DNA, 25 bp, Mus musculus
tgcttcagcaggagctgctaagtcg

SEQ ID NO: 378084 - DNA, 25 bp, Mus musculus
tgcttcagctgagtgtgacagataa

SEQ ID NO: 378085 - DNA, 25 bp, Mus musculus
tgcttcagctgggtggcacagtgat

SEQ ID NO: 378086 - DNA, 25 bp, Mus musculus
tgcttcagggagacacacctgcaaa

SEQ ID NO: 378087 - DNA, 25 bp, Mus musculus
tgcttcagtctcgttcgagaaatgg

SEQ ID NO: 378088 - DNA, 25 bp, Mus musculus
tgcttcatccaaggcgttagacaaa

SEQ ID NO: 378089 - DNA, 25 bp, Mus musculus
tgcttcatctgtggcctggagagag

SEQ ID NO: 378090 - DNA, 25 bp, Mus musculus
tgcttcatggactggtgtccaaaga

SEQ ID NO: 378091 - DNA, 25 bp, Mus musculus
tgcttcatgtctggatgtgtctagt

SEQ ID NO: 378092 - DNA, 25 bp, Mus musculus
tgcttccaaagcacaggctggctcg

SEQ ID NO: 378093 - DNA, 25 bp, Mus musculus
tgcttccaaagcagatcctggagta

SEQ ID NO: 378094 - DNA, 25 bp, Mus musculus
tgcttccaaagccaggtgtcagatg

SEQ ID NO: 378095 - DNA, 25 bp, Mus musculus
tgcttccacagccggagagtcaaac

SEQ ID NO: 378096 - DNA, 25 bp, Mus musculus
tgcttccacctgtcacagcaaactg

SEQ ID NO: 378097 - DNA, 25 bp, Mus musculus
tgcttccactctggtcagacatggt

SEQ ID NO: 378098 - DNA, 25 bp, Mus musculus
tgcttccagatggcctaccttcttg

SEQ ID NO: 378099 - DNA, 25 bp, Mus musculus
tgcttccagcagaataacaacaagc

SEQ ID NO: 378100 - DNA, 25 bp, Mus musculus
tgcttccaggcagtgctgaaaacca

SEQ ID NO: 378101 - DNA, 25 bp, Mus musculus
tgcttccaggttcaggtgttggcag

SEQ ID NO: 378102 - DNA, 25 bp, Mus musculus
tgcttccatccgagattgagcttga

SEQ ID NO: 378103 - DNA, 25 bp, Mus musculus
tgcttccatccgagcctgacctgat

SEQ ID NO: 378104 - DNA, 25 bp, Mus musculus
tgcttccatccgagtggcagcaagt

SEQ ID NO: 378105 - DNA, 25 bp, Mus musculus
tgcttcccagaggaagtcacagaca

SEQ ID NO: 378106 - DNA, 25 bp, Mus musculus
tgcttccccacccaggcctggatac

SEQ ID NO: 378107 - DNA, 25 bp, Mus musculus
tgcttccccagagaacacagcaggg

SEQ ID NO: 378108 - DNA, 25 bp, Mus musculus
tgcttccccatcaagatcccacgca

SEQ ID NO: 378109 - DNA, 25 bp, Mus musculus
tgcttcccggagacaactagctgtg

SEQ ID NO: 378110 - DNA, 25 bp, Mus musculus
tgcttccctgtgctggtccacaggc

SEQ ID NO: 378111 - DNA, 25 bp, Mus musculus
tgcttccctgtggtattattcaggg

SEQ ID NO: 378112 - DNA, 25 bp, Mus musculus
tgcttccgggtgttggaaggacaat

SEQ ID NO: 378113 - DNA, 25 bp, Mus musculus
tgcttccgttaaaggtcacacaact

SEQ ID NO: 378114 - DNA, 25 bp, Mus musculus
tgcttcctaggatggtggcccagat

SEQ ID NO: 378115 - DNA, 25 bp, Mus musculus
tgcttcctatcgacatcccaggcga

SEQ ID NO: 378116 - DNA, 25 bp, Mus musculus
tgcttcctatcggcctttcagacat

SEQ ID NO: 378117 - DNA, 25 bp, Mus musculus
tgcttcctcaagctggcagcagtga

SEQ ID NO: 378118 - DNA, 25 bp, Mus musculus
tgcttcctcagtgtggcttgaccta

SEQ ID NO: 378119 - DNA, 25 bp, Mus musculus
tgcttcctccaggatggattcatgg

SEQ ID NO: 378120 - DNA, 25 bp, Mus musculus
tgcttcctcgagaagccaacagagc

SEQ ID NO: 378121 - DNA, 25 bp, Mus musculus
tgcttcctcgatgagatcgtgggga

SEQ ID NO: 378122 - DNA, 25 bp, Mus musculus
tgcttcctgccccagaaaacatcgg

SEQ ID NO: 378123 - DNA, 25 bp, Mus musculus
tgcttcctggacaagaggggaagtc

SEQ ID NO: 378124 - DNA, 25 bp, Mus musculus
tgcttcctggacaaggtagagcctc

SEQ ID NO: 378125 - DNA, 25 bp, Mus musculus
tgcttccttcatccgctctgctttc

SEQ ID NO: 378126 - DNA, 25 bp, Mus musculus
tgcttcgaagaaagaagatggacga

SEQ ID NO: 378127 - DNA, 25 bp, Mus musculus
tgcttcgagaaaagatgagagtcac

SEQ ID NO: 378128 - DNA, 25 bp, Mus musculus
tgcttcgagaaaaggaaaatgagaa

SEQ ID NO: 378129 - DNA, 25 bp, Mus musculus
tgcttcggaaagtccttcaggctcc

SEQ ID NO: 378130 - DNA, 25 bp, Mus musculus
tgcttcggcaggttttgtcgctaac

SEQ ID NO: 378131 - DNA, 25 bp, Mus musculus
tgcttcggtctccagattcgcctct

SEQ ID NO: 378132 - DNA, 25 bp, Mus musculus
tgcttcgtcccatggtccttcagag

SEQ ID NO: 378133 - DNA, 25 bp, Mus musculus
tgcttctaagactctgaattcggtc

SEQ ID NO: 378134 - DNA, 25 bp, Mus musculus
tgcttctaatcaccaagccccgccc

SEQ ID NO: 378135 - DNA, 25 bp, Mus musculus
tgcttctatgaggttgactgtgggt

SEQ ID NO: 378136 - DNA, 25 bp, Mus musculus
tgcttctcaccaaggtctgagtacc

SEQ ID NO: 378137 - DNA, 25 bp, Mus musculus
tgcttctcagtcaggatggctaaag

SEQ ID NO: 378138 - DNA, 25 bp, Mus musculus
tgcttctccaccatcccttccagat

SEQ ID NO: 378139 - DNA, 25 bp, Mus musculus
tgcttctccgcaaaggcaccacctt

SEQ ID NO: 378140 - DNA, 25 bp, Mus musculus
tgcttctccgcaaagggtacacgca

SEQ ID NO: 378141 - DNA, 25 bp, Mus musculus
tgcttctcgactgagggtccaaacc

SEQ ID NO: 378142 - DNA, 25 bp, Mus musculus
tgcttctcgttggtgcctttgtgcc

SEQ ID NO: 378143 - DNA, 25 bp, Mus musculus
tgcttctctgggtctgtgaactcgt

SEQ ID NO: 378144 - DNA, 25 bp, Mus musculus
tgcttctctgtggaataaatttgtg

SEQ ID NO: 378145 - DNA, 25 bp, Mus musculus
tgcttctgaaacctcaggtggaacc

SEQ ID NO: 378146 - DNA, 25 bp, Mus musculus
tgcttctgcagaaggtttcaacact

SEQ ID NO: 378147 - DNA, 25 bp, Mus musculus
tgcttctgccaagattacagtagca

SEQ ID NO: 378148 - DNA, 25 bp, Mus musculus
tgcttctgcccaggtgagaggtgtt

SEQ ID NO: 378149 - DNA, 25 bp, Mus musculus
tgcttctgccccaggtgtaaagaag

SEQ ID NO: 378150 - DNA, 25 bp, Mus musculus
tgcttctgccttgtccccacagaga

SEQ ID NO: 378151 - DNA, 25 bp, Mus musculus
tgcttctgcgggtgcttctgtttcc

SEQ ID NO: 378152 - DNA, 25 bp, Mus musculus
tgcttctggagggtgatgcccacgt

SEQ ID NO: 378153 - DNA, 25 bp, Mus musculus
tgcttctgtgctaacctcaggagga

SEQ ID NO: 378154 - DNA, 25 bp, Mus musculus
tgcttctgttaggtgctggagagtc

SEQ ID NO: 378155 - DNA, 25 bp, Mus musculus
tgcttctgttggagataccttccta

SEQ ID NO: 378156 - DNA, 25 bp, Mus musculus
tgcttcttcacgtgacctgacagtg

SEQ ID NO: 378157 - DNA, 25 bp, Mus musculus
tgcttcttcagtacaggctatgttt

SEQ ID NO: 378158 - DNA, 25 bp, Mus musculus
tgcttcttgaaaggaactctgttga

SEQ ID NO: 378159 - DNA, 25 bp, Mus musculus
tgcttgaaaagacactgagtcctcg

SEQ ID NO: 378160 - DNA, 25 bp, Mus musculus
tgcttgaatctgctttttacctttg

SEQ ID NO: 378161 - DNA, 25 bp, Mus musculus
tgcttgacaacaagcctgaccacca

SEQ ID NO: 378162 - DNA, 25 bp, Mus musculus
tgcttgagaagatgaggtgaacacc

SEQ ID NO: 378163 - DNA, 25 bp, Mus musculus
tgcttgagcgcggcatccagccagc

SEQ ID NO: 378164 - DNA, 25 bp, Mus musculus
tgcttgaggtaatccattgtctgat

SEQ ID NO: 378165 - DNA, 25 bp, Mus musculus
tgcttgagtccaggttcacattgag

SEQ ID NO: 378166 - DNA, 25 bp, Mus musculus
tgcttgagtggacaggctgaatttg

SEQ ID NO: 378167 - DNA, 25 bp, Mus musculus
tgcttgagtttccgatgagacagaa

SEQ ID NO: 378168 - DNA, 25 bp, Mus musculus
tgcttgcaaacaggatgtctctcca

SEQ ID NO: 378169 - DNA, 25 bp, Mus musculus
tgcttgcaaaggtggtacccgggag

SEQ ID NO: 378170 - DNA, 25 bp, Mus musculus
tgcttgcaccagtctctcaccatgt

SEQ ID NO: 378171 - DNA, 25 bp, Mus musculus
tgcttgcatcgggattctgtaacag

SEQ ID NO: 378172 - DNA, 25 bp, Mus musculus
tgcttgcatcggggtcagtggataa

SEQ ID NO: 378173 - DNA, 25 bp, Mus musculus
tgcttgccacagagcccttgcttag

SEQ ID NO: 378174 - DNA, 25 bp, Mus musculus
tgcttgccacaggagacgtggctga

SEQ ID NO: 378175 - DNA, 25 bp, Mus musculus
tgcttgccagataaagtgcaggatg

SEQ ID NO: 378176 - DNA, 25 bp, Mus musculus
tgcttgccaggggctgacaagttac

SEQ ID NO: 378177 - DNA, 25 bp, Mus musculus
tgcttgccagggtgacagtggggga

SEQ ID NO: 378178 - DNA, 25 bp, Mus musculus
tgcttgccagtgggggaccgcttgt

SEQ ID NO: 378179 - DNA, 25 bp, Mus musculus
tgcttgccccgagtctccatctttg

SEQ ID NO: 378180 - DNA, 25 bp, Mus musculus
tgcttgcctccaggctgaagaagga

SEQ ID NO: 378181 - DNA, 25 bp, Mus musculus
tgcttgcctctgaagcaggcagcac

SEQ ID NO: 378182 - DNA, 25 bp, Mus musculus
tgcttgccttccagacctatccctg

SEQ ID NO: 378183 - DNA, 25 bp, Mus musculus
tgcttgcgaggcaggaaacagcctc

SEQ ID NO: 378184 - DNA, 25 bp, Mus musculus
tgcttgcgagggtgacacttcccaa

SEQ ID NO: 378185 - DNA, 25 bp, Mus musculus
tgcttgcgctccgcaagccccgccc

SEQ ID NO: 378186 - DNA, 25 bp, Mus musculus
tgcttgcggtcacctctgtcttcct

SEQ ID NO: 378187 - DNA, 25 bp, Mus musculus
tgcttgctaggggtcatgatatact

SEQ ID NO: 378188 - DNA, 25 bp, Mus musculus
tgcttgctcatcccagcctgctttt

SEQ ID NO: 378189 - DNA, 25 bp, Mus musculus
tgcttgctcattagcttttttccag

SEQ ID NO: 378190 - DNA, 25 bp, Mus musculus
tgcttgctcattaggtgtgtgatag

SEQ ID NO: 378191 - DNA, 25 bp, Mus musculus
tgcttgctctctcggacacggagag

SEQ ID NO: 378192 - DNA, 25 bp, Mus musculus
tgcttgctgaacccccacagaacct

SEQ ID NO: 378193 - DNA, 25 bp, Mus musculus
tgcttggaaggctgcccaccaagaa

SEQ ID NO: 378194 - DNA, 25 bp, Mus musculus
tgcttggagagactgggcagtttgg

SEQ ID NO: 378195 - DNA, 25 bp, Mus musculus
tgcttggagaggaggtcttcttctc

SEQ ID NO: 378196 - DNA, 25 bp, Mus musculus
tgcttggagtgttcctaactttgaa

SEQ ID NO: 378197 - DNA, 25 bp, Mus musculus
tgcttggataagattaatgtccttc

SEQ ID NO: 378198 - DNA, 25 bp, Mus musculus
tgcttggatgaactgtatgacatca

SEQ ID NO: 378199 - DNA, 25 bp, Mus musculus
tgcttggattacaggtgaccaggac

SEQ ID NO: 378200 - DNA, 25 bp, Mus musculus
tgcttggattacaggtggtgctctg

SEQ ID NO: 378201 - DNA, 25 bp, Mus musculus
tgcttggcatctgcaatgccgcgcc

SEQ ID NO: 378202 - DNA, 25 bp, Mus musculus
tgcttggcgcgaaaaggtggacaag

SEQ ID NO: 378203 - DNA, 25 bp, Mus musculus
tgcttggcgcgatatgctaatgaag

SEQ ID NO: 378204 - DNA, 25 bp, Mus musculus
tgcttggcgcggtgaaggcgataaa

SEQ ID NO: 378205 - DNA, 25 bp, Mus musculus
tgcttggcggcgcctgtgagagaga

SEQ ID NO: 378206 - DNA, 25 bp, Mus musculus
tgcttggctatggcatcttccactg

SEQ ID NO: 378207 - DNA, 25 bp, Mus musculus
tgcttgggggagccatgacagtagc

SEQ ID NO: 378208 - DNA, 25 bp, Mus musculus
tgcttggggtttgcccagatggggg

SEQ ID NO: 378209 - DNA, 25 bp, Mus musculus
tgcttgggtaagcagtggattctgt

SEQ ID NO: 378210 - DNA, 25 bp, Mus musculus
tgcttggtcctaaggccctttttgc

SEQ ID NO: 378211 - DNA, 25 bp, Mus musculus
tgcttggtcctcactgtgatgatcc

SEQ ID NO: 378212 - DNA, 25 bp, Mus musculus
tgcttgtaaggcatctcagaaggag

SEQ ID NO: 378213 - DNA, 25 bp, Mus musculus
tgcttgtaaggtgcaaaagaaggat

SEQ ID NO: 378214 - DNA, 25 bp, Mus musculus
tgcttgtataagctggaaaacaggc

SEQ ID NO: 378215 - DNA, 25 bp, Mus musculus
tgcttgtcaacaggaggagccatgg

SEQ ID NO: 378216 - DNA, 25 bp, Mus musculus
tgcttgtcaacagggtccaggtgca

SEQ ID NO: 378217 - DNA, 25 bp, Mus musculus
tgcttgtcaggaacaatccactttc

SEQ ID NO: 378218 - DNA, 25 bp, Mus musculus
tgcttgtcatctgagtcaacggttg

SEQ ID NO: 378219 - DNA, 25 bp, Mus musculus
tgcttgtcccctgctctgccgcaca

SEQ ID NO: 378220 - DNA, 25 bp, Mus musculus
tgcttgtctctgcagaccgctcggg

SEQ ID NO: 378221 - DNA, 25 bp, Mus musculus
tgcttgtgaatcagcaatgcaggga

SEQ ID NO: 378222 - DNA, 25 bp, Mus musculus
tgcttgtgagaagaaatggaaatga

SEQ ID NO: 378223 - DNA, 25 bp, Mus musculus
tgcttgtgagcatactctcctctta

SEQ ID NO: 378224 - DNA, 25 bp, Mus musculus
tgcttgtgaggatactctcctctta

SEQ ID NO: 378225 - DNA, 25 bp, Mus musculus
tgcttgtgtcgggaatgtgtttctg

SEQ ID NO: 378226 - DNA, 25 bp, Mus musculus
tgcttgtgtggacgctcgaattatc

SEQ ID NO: 378227 - DNA, 25 bp, Mus musculus
tgcttgttaaggctgctgaaaaatg

SEQ ID NO: 378228 - DNA, 25 bp, Mus musculus
tgcttgttcaggtgtcctatgccat

SEQ ID NO: 378229 - DNA, 25 bp, Mus musculus
tgctttaaaagcaaggatcatggag

SEQ ID NO: 378230 - DNA, 25 bp, Mus musculus
tgctttaaaaggaaaatacatagaa

SEQ ID NO: 378231 - DNA, 25 bp, Mus musculus
tgctttaaacatggtaccgggtgct

SEQ ID NO: 378232 - DNA, 25 bp, Mus musculus
tgctttaaacatgtacccctctatg

SEQ ID NO: 378233 - DNA, 25 bp, Mus musculus
tgctttaaacctaaacagaatatat

SEQ ID NO: 378234 - DNA, 25 bp, Mus musculus
tgctttaaacgacctgatctctgca

SEQ ID NO: 378235 - DNA, 25 bp, Mus musculus
tgctttaaacgtcgattgagtgata

SEQ ID NO: 378236 - DNA, 25 bp, Mus musculus
tgctttaattgacagattagcttta

SEQ ID NO: 378237 - DNA, 25 bp, Mus musculus
tgctttacagaatggggagcgctct

SEQ ID NO: 378238 - DNA, 25 bp, Mus musculus
tgctttacagaatgtctgcggatta

SEQ ID NO: 378239 - DNA, 25 bp, Mus musculus
tgctttacagatcgctgtggagaat

SEQ ID NO: 378240 - DNA, 25 bp, Mus musculus
tgctttacagctgacttggagctgg

SEQ ID NO: 378241 - DNA, 25 bp, Mus musculus
tgctttacatttaagacaaatgaag

SEQ ID NO: 378242 - DNA, 25 bp, Mus musculus
tgctttaccagaccatagaatccaa

SEQ ID NO: 378243 - DNA, 25 bp, Mus musculus
tgctttaccagagcaaggcttagat

SEQ ID NO: 378244 - DNA, 25 bp, Mus musculus
tgctttaccaggaacatttcagagg

SEQ ID NO: 378245 - DNA, 25 bp, Mus musculus
tgctttaccaggatatgactgcgcg

SEQ ID NO: 378246 - DNA, 25 bp, Mus musculus
tgctttaccgagcaggacccttcat

SEQ ID NO: 378247 - DNA, 25 bp, Mus musculus
tgctttaccgagcaggtcacggaag

SEQ ID NO: 378248 - DNA, 25 bp, Mus musculus
tgctttagagtgatgatgactgtgt

SEQ ID NO: 378249 - DNA, 25 bp, Mus musculus
tgctttagcattaaggaatcttggg

SEQ ID NO: 378250 - DNA, 25 bp, Mus musculus
tgctttatgaccctctggagatctt

SEQ ID NO: 378251 - DNA, 25 bp, Mus musculus
tgctttcaaagaacagcatgttttg

SEQ ID NO: 378252 - DNA, 25 bp, Mus musculus
tgctttcaagaaaggcgacagggtc

SEQ ID NO: 378253 - DNA, 25 bp, Mus musculus
tgctttcaccaaaggattctaacca

SEQ ID NO: 378254 - DNA, 25 bp, Mus musculus
tgctttcaccaaaggtcctggcatg

SEQ ID NO: 378255 - DNA, 25 bp, Mus musculus
tgctttcagaaattccctgcggtgg

SEQ ID NO: 378256 - DNA, 25 bp, Mus musculus
tgctttcagaagaatatgacagata

SEQ ID NO: 378257 - DNA, 25 bp, Mus musculus
tgctttcagaagacctggcggtgtt

SEQ ID NO: 378258 - DNA, 25 bp, Mus musculus
tgctttcagactaaggtggacttca

SEQ ID NO: 378259 - DNA, 25 bp, Mus musculus
tgctttcatcggctcggatgtggtg

SEQ ID NO: 378260 - DNA, 25 bp, Mus musculus
tgctttccacatgtctgccaggaac

SEQ ID NO: 378261 - DNA, 25 bp, Mus musculus
tgctttccagagacttcctgcttgg

SEQ ID NO: 378262 - DNA, 25 bp, Mus musculus
tgctttccagagcggaaacgggtcc

SEQ ID NO: 378263 - DNA, 25 bp, Mus musculus
tgctttccagaggcggccagcaggt

SEQ ID NO: 378264 - DNA, 25 bp, Mus musculus
tgctttccagcaagccccgcccaac

SEQ ID NO: 378265 - DNA, 25 bp, Mus musculus
tgctttccaggattcacagaaatcc

SEQ ID NO: 378266 - DNA, 25 bp, Mus musculus
tgctttccctaacatcgagaaggtg

SEQ ID NO: 378267 - DNA, 25 bp, Mus musculus
tgctttccgcaaggccctttatggg

SEQ ID NO: 378268 - DNA, 25 bp, Mus musculus
tgctttccggaagattcatcgcaga

SEQ ID NO: 378269 - DNA, 25 bp, Mus musculus
tgctttcctggaaaattgttgtgtc

SEQ ID NO: 378270 - DNA, 25 bp, Mus musculus
tgctttcgtgaaggatgttttattt

SEQ ID NO: 378271 - DNA, 25 bp, Mus musculus
tgctttctatccctgtgcacatgtt

SEQ ID NO: 378272 - DNA, 25 bp, Mus musculus
tgctttctcgttcagaatgtcatac

SEQ ID NO: 378273 - DNA, 25 bp, Mus musculus
tgctttctcttgagactcgttactg

SEQ ID NO: 378274 - DNA, 25 bp, Mus musculus
tgctttctcttgagggtaacaagaa

SEQ ID NO: 378275 - DNA, 25 bp, Mus musculus
tgctttcttcaagcaccagattgta

SEQ ID NO: 378276 - DNA, 25 bp, Mus musculus
tgctttgaaagtggtaacctcggcc

SEQ ID NO: 378277 - DNA, 25 bp, Mus musculus
tgctttgacacgagatgacataaca

SEQ ID NO: 378278 - DNA, 25 bp, Mus musculus
tgctttgatgtcccgcatggttcga

SEQ ID NO: 378279 - DNA, 25 bp, Mus musculus
tgctttgcacacagatggagtggcc

SEQ ID NO: 378280 - DNA, 25 bp, Mus musculus
tgctttgcgctcagggaaaggtgaa

SEQ ID NO: 378281 - DNA, 25 bp, Mus musculus
tgctttgcgctcagggcatccatgt

SEQ ID NO: 378282 - DNA, 25 bp, Mus musculus
tgctttgcttgaggtagtccattgt

SEQ ID NO: 378283 - DNA, 25 bp, Mus musculus
tgctttggactcagaggcttgctgc

SEQ ID NO: 378284 - DNA, 25 bp, Mus musculus
tgctttggagaagaaccatcagtca

SEQ ID NO: 378285 - DNA, 25 bp, Mus musculus
tgctttggagaaggagcttcagtga

SEQ ID NO: 378286 - DNA, 25 bp, Mus musculus
tgctttggaggttctggacggcatt

SEQ ID NO: 378287 - DNA, 25 bp, Mus musculus
tgctttggaggttctgggacagcaa

SEQ ID NO: 378288 - DNA, 25 bp, Mus musculus
tgctttggatggtatgccttacact

SEQ ID NO: 378289 - DNA, 25 bp, Mus musculus
tgctttgggcttcttgtgtccattg

SEQ ID NO: 378290 - DNA, 25 bp, Mus musculus
tgctttggtaagctgcgatatttaa

SEQ ID NO: 378291 - DNA, 25 bp, Mus musculus
tgctttggtgggcagtcctggcagc

SEQ ID NO: 378292 - DNA, 25 bp, Mus musculus
tgctttgtctaccagcctcttaaag

SEQ ID NO: 378293 - DNA, 25 bp, Mus musculus
tgctttgtctaccaggatcctcagg

SEQ ID NO: 378294 - DNA, 25 bp, Mus musculus
tgctttgttctgaggtgacgccatc

SEQ ID NO: 378295 - DNA, 25 bp, Mus musculus
tgcttttaaaggattaaaggagagc

SEQ ID NO: 378296 - DNA, 25 bp, Mus musculus
tgcttttaaggcagcccacccaaac

SEQ ID NO: 378297 - DNA, 25 bp, Mus musculus
tgcttttaagtaacggcacagccaa

SEQ ID NO: 378298 - DNA, 25 bp, Mus musculus
tgcttttacatttgtcataatcctt

SEQ ID NO: 378299 - DNA, 25 bp, Mus musculus
tgcttttagcccagatagtcgccac

SEQ ID NO: 378300 - DNA, 25 bp, Mus musculus
tgcttttataagacaggaaaagact

SEQ ID NO: 378301 - DNA, 25 bp, Mus musculus
tgcttttataagatgaagacaggaa

SEQ ID NO: 378302 - DNA, 25 bp, Mus musculus
tgcttttataagtctttgcagattc

SEQ ID NO: 378303 - DNA, 25 bp, Mus musculus
tgcttttcatcatgggaggtgaggc

SEQ ID NO: 378304 - DNA, 25 bp, Mus musculus
tgcttttcatcatggtcctccagga

SEQ ID NO: 378305 - DNA, 25 bp, Mus musculus
tgcttttcatctggagactgctcat

SEQ ID NO: 378306 - DNA, 25 bp, Mus musculus
tgcttttcatctggagagtctgcag

SEQ ID NO: 378307 - DNA, 25 bp, Mus musculus
tgcttttcctcagattgtctaaagc

SEQ ID NO: 378308 - DNA, 25 bp, Mus musculus
tgcttttcctggaagagtatctacg

SEQ ID NO: 378309 - DNA, 25 bp, Mus musculus
tgcttttcctggagagcctgacaag

SEQ ID NO: 378310 - DNA, 25 bp, Mus musculus
tgcttttgaggagttccactccagc

SEQ ID NO: 378311 - DNA, 25 bp, Mus musculus
tgcttttgccctctccgctccctgg

SEQ ID NO: 378312 - DNA, 25 bp, Mus musculus
tgcttttgcggagatgcggcattcc

SEQ ID NO: 378313 - DNA, 25 bp, Mus musculus
tgcttttgcggagtcactatttaga

SEQ ID NO: 378314 - DNA, 25 bp, Mus musculus
tgcttttgctgagagtgtgtgactc

SEQ ID NO: 378315 - DNA, 25 bp, Mus musculus
tgcttttgtggacaggttggtttaa

SEQ ID NO: 378316 - DNA, 25 bp, Mus musculus
tgcttttgtggacagtatttttgaa

SEQ ID NO: 378317 - DNA, 25 bp, Mus musculus
tgctttttaggaccttgttccttgt

SEQ ID NO: 378318 - DNA, 25 bp, Mus musculus
tgctttttagtggtgatcatgtgtg

SEQ ID NO: 378319 - DNA, 25 bp, Mus musculus
tgctttttctcaggtgccttcagtc

SEQ ID NO: 378320 - DNA, 25 bp, Mus musculus
tgctttttggattcagacgatgtca

SEQ ID NO: 378321 - DNA, 25 bp, Mus musculus
tggaaaaaagctctcttaagagcct

SEQ ID NO: 378322 - DNA, 25 bp, Mus musculus
tggaaaaaagggaacgaagagctct

SEQ ID NO: 378323 - DNA, 25 bp, Mus musculus
tggaaaaaagggtggccggcaagag

SEQ ID NO: 378324 - DNA, 25 bp, Mus musculus
tggaaaaaagttctaggcaagaaga

SEQ ID NO: 378325 - DNA, 25 bp, Mus musculus
tggaaaaacacagactgcgatggat

SEQ ID NO: 378326 - DNA, 25 bp, Mus musculus
tggaaaaacagaggccagagggcat

SEQ ID NO: 378327 - DNA, 25 bp, Mus musculus
tggaaaaacagggcttcaagcagca

SEQ ID NO: 378328 - DNA, 25 bp, Mus musculus
tggaaaaagctgaaggacagactgc

SEQ ID NO: 378329 - DNA, 25 bp, Mus musculus
tggaaaaaggggagagcatcactgg

SEQ ID NO: 378330 - DNA, 25 bp, Mus musculus
tggaaaaatatggaacaaaagttga

SEQ ID NO: 378331 - DNA, 25 bp, Mus musculus
tggaaaaattaaccacatgagatat

SEQ ID NO: 378332 - DNA, 25 bp, Mus musculus
tggaaaaattatatggtttgacgga

SEQ ID NO: 378333 - DNA, 25 bp, Mus musculus
tggaaaaatttggagacagaagctt

SEQ ID NO: 378334 - DNA, 25 bp, Mus musculus
tggaaaaatttggagctgacatcaa

SEQ ID NO: 378335 - DNA, 25 bp, Mus musculus
tggaaaacacagccatcaccatcgg

SEQ ID NO: 378336 - DNA, 25 bp, Mus musculus
tggaaaacacaggtcgcctgacgag

SEQ ID NO: 378337 - DNA, 25 bp, Mus musculus
tggaaaacacagtttggcttgtgct

SEQ ID NO: 378338 - DNA, 25 bp, Mus musculus
tggaaaacagatttattcttcattg

SEQ ID NO: 378339 - DNA, 25 bp, Mus musculus
tggaaaacagctttcctagcaagaa

SEQ ID NO: 378340 - DNA, 25 bp, Mus musculus
tggaaaacaggcccacagaacatga

SEQ ID NO: 378341 - DNA, 25 bp, Mus musculus
tggaaaacatgaggaaggacagacg

SEQ ID NO: 378342 - DNA, 25 bp, Mus musculus
tggaaaacatggggcttctcaccag

SEQ ID NO: 378343 - DNA, 25 bp, Mus musculus
tggaaaacattaagtcttgggtact

SEQ ID NO: 378344 - DNA, 25 bp, Mus musculus
tggaaaacattaataattaccgtgt

SEQ ID NO: 378345 - DNA, 25 bp, Mus musculus
tggaaaacctgaggagccaacagaa

SEQ ID NO: 378346 - DNA, 25 bp, Mus musculus
tggaaaacctgagggtgatttcaga

SEQ ID NO: 378347 - DNA, 25 bp, Mus musculus
tggaaaacgaagaaatgattctggg

SEQ ID NO: 378348 - DNA, 25 bp, Mus musculus
tggaaaactgatgagaaatgaattc

SEQ ID NO: 378349 - DNA, 25 bp, Mus musculus
tggaaaacttgtgaggttctctaat

SEQ ID NO: 378350 - DNA, 25 bp, Mus musculus
tggaaaagaaacctcttcggtgatc

SEQ ID NO: 378351 - DNA, 25 bp, Mus musculus
tggaaaagaaccgacgagctcacct

SEQ ID NO: 378352 - DNA, 25 bp, Mus musculus
tggaaaagaaccgtggctctccagg

SEQ ID NO: 378353 - DNA, 25 bp, Mus musculus
tggaaaagaactactgccgaaaccc

SEQ ID NO: 378354 - DNA, 25 bp, Mus musculus
tggaaaagacatggagatacagaat

SEQ ID NO: 378355 - DNA, 25 bp, Mus musculus
tggaaaagacatggaggaagcaagg

SEQ ID NO: 378356 - DNA, 25 bp, Mus musculus
tggaaaagataaaacagcgtttatt

SEQ ID NO: 378357 - DNA, 25 bp, Mus musculus
tggaaaagataaataaagacaactc

SEQ ID NO: 378358 - DNA, 25 bp, Mus musculus
tggaaaagatatgatgaggaattta

SEQ ID NO: 378359 - DNA, 25 bp, Mus musculus
tggaaaagatgaaggagcttcatat

SEQ ID NO: 378360 - DNA, 25 bp, Mus musculus
tggaaaagatgaaggggatggtaat

SEQ ID NO: 378361 - DNA, 25 bp, Mus musculus
tggaaaagcaactggatgaactgct

SEQ ID NO: 378362 - DNA, 25 bp, Mus musculus
tggaaaagcaagaagcacatggcat

SEQ ID NO: 378363 - DNA, 25 bp, Mus musculus
tggaaaagccgctggacgactctgt

SEQ ID NO: 378364 - DNA, 25 bp, Mus musculus
tggaaaagccgtcccgcacggtgac

SEQ ID NO: 378365 - DNA, 25 bp, Mus musculus
tggaaaagcgagctgggagaacagc

SEQ ID NO: 378366 - DNA, 25 bp, Mus musculus
tggaaaagcgaggaggcggctcagt

SEQ ID NO: 378367 - DNA, 25 bp, Mus musculus
tggaaaagcgaggccttggaacagc

SEQ ID NO: 378368 - DNA, 25 bp, Mus musculus
tggaaaagcgcagcctggaggccgg

SEQ ID NO: 378369 - DNA, 25 bp, Mus musculus
tggaaaagctggtggacaataacac

SEQ ID NO: 378370 - DNA, 25 bp, Mus musculus
tggaaaaggagaagctacttgcaaa

SEQ ID NO: 378371 - DNA, 25 bp, Mus musculus
tggaaaaggctaagagcctgaccag

SEQ ID NO: 378372 - DNA, 25 bp, Mus musculus
tggaaaagtcaggctattgaccttc

SEQ ID NO: 378373 - DNA, 25 bp, Mus musculus
tggaaaagtctaaagggccagtgtc

SEQ ID NO: 378374 - DNA, 25 bp, Mus musculus
tggaaaagtctaagggcagtttagc

SEQ ID NO: 378375 - DNA, 25 bp, Mus musculus
tggaaaatacagagcatacgatgcg

SEQ ID NO: 378376 - DNA, 25 bp, Mus musculus
tggaaaatacagatctgtgtcagca

SEQ ID NO: 378377 - DNA, 25 bp, Mus musculus
tggaaaatatcaggaagcagtgcat

SEQ ID NO: 378378 - DNA, 25 bp, Mus musculus
tggaaaatgaaagttgtaagcatca

SEQ ID NO: 378379 - DNA, 25 bp, Mus musculus
tggaaaatgaagatgctagaaaata

SEQ ID NO: 378380 - DNA, 25 bp, Mus musculus
tggaaaatgaaggttgcacgatttc

SEQ ID NO: 378381 - DNA, 25 bp, Mus musculus
tggaaacaaaagataaaatattttg

SEQ ID NO: 378382 - DNA, 25 bp, Mus musculus
tggaaacaactggtgccagcacatc

SEQ ID NO: 378383 - DNA, 25 bp, Mus musculus
tggaaacaagaatgcctacgagaat

SEQ ID NO: 378384 - DNA, 25 bp, Mus musculus
tggaaacaagcgcccaggcgcgttt

SEQ ID NO: 378385 - DNA, 25 bp, Mus musculus
tggaaacacaatcagatgtcgtttg

SEQ ID NO: 378386 - DNA, 25 bp, Mus musculus
tggaaacacaatcagccgcataact

SEQ ID NO: 378387 - DNA, 25 bp, Mus musculus
tggaaacacaatcagccgtcattca

SEQ ID NO: 378388 - DNA, 25 bp, Mus musculus
tggaaacacaatcagtcgaaggggg

SEQ ID NO: 378389 - DNA, 25 bp, Mus musculus
tggaaacacagccggatgttctttg

SEQ ID NO: 378390 - DNA, 25 bp, Mus musculus
tggaaacacccagagcctctcggcc

SEQ ID NO: 378391 - DNA, 25 bp, Mus musculus
tggaaaccagaagcgaatggaagac

SEQ ID NO: 378392 - DNA, 25 bp, Mus musculus
tggaaaccagcaggtgcagcaggtt

SEQ ID NO: 378393 - DNA, 25 bp, Mus musculus
tggaaaccaggaagtgagtgccttt

SEQ ID NO: 378394 - DNA, 25 bp, Mus musculus
tggaaaccaggacaagaagacagaa

SEQ ID NO: 378395 - DNA, 25 bp, Mus musculus
tggaaaccaggagaacagtacggac

SEQ ID NO: 378396 - DNA, 25 bp, Mus musculus
tggaaaccagggatcctggtaggga

SEQ ID NO: 378397 - DNA, 25 bp, Mus musculus
tggaaaccagtaagggcaaagatga

SEQ ID NO: 378398 - DNA, 25 bp, Mus musculus
tggaaaccagtattgcagcacccaa

SEQ ID NO: 378399 - DNA, 25 bp, Mus musculus
tggaaaccatggcagaacaaaaatc

SEQ ID NO: 378400 - DNA, 25 bp, Mus musculus
tggaaaccatggcagaattttctca

SEQ ID NO: 378401 - DNA, 25 bp, Mus musculus
tggaaaccatggcaggtacagagct

SEQ ID NO: 378402 - DNA, 25 bp, Mus musculus
tggaaacccagcgctaactgtcctt

SEQ ID NO: 378403 - DNA, 25 bp, Mus musculus
tggaaacctttccatattgtatttt

SEQ ID NO: 378404 - DNA, 25 bp, Mus musculus
tggaaacgactacatcgaccagctg

SEQ ID NO: 378405 - DNA, 25 bp, Mus musculus
tggaaacgacttgtaccaggggctg

SEQ ID NO: 378406 - DNA, 25 bp, Mus musculus
tggaaacggattttggcaagtcaag

SEQ ID NO: 378407 - DNA, 25 bp, Mus musculus
tggaaactaaggcattactcatcag

SEQ ID NO: 378408 - DNA, 25 bp, Mus musculus
tggaaactaaggctggccttgtggt

SEQ ID NO: 378409 - DNA, 25 bp, Mus musculus
tggaaactctccccccatcttcatc

SEQ ID NO: 378410 - DNA, 25 bp, Mus musculus
tggaaactctccgcccatcttcatc

SEQ ID NO: 378411 - DNA, 25 bp, Mus musculus
tggaaactgagcacattaatccagt

SEQ ID NO: 378412 - DNA, 25 bp, Mus musculus
tggaaactgagcaccaaacaacatg

SEQ ID NO: 378413 - DNA, 25 bp, Mus musculus
tggaaactgagcaccaagcttacaa

SEQ ID NO: 378414 - DNA, 25 bp, Mus musculus
tggaaactgagcagcagaataaaga

SEQ ID NO: 378415 - DNA, 25 bp, Mus musculus
tggaaactgagcattttgctctgta

SEQ ID NO: 378416 - DNA, 25 bp, Mus musculus
tggaaactggcggtgttttcagctg

SEQ ID NO: 378417 - DNA, 25 bp, Mus musculus
tggaaactggcgttgttgacaagat

SEQ ID NO: 378418 - DNA, 25 bp, Mus musculus
tggaaacttcaggagtcatggctgg

SEQ ID NO: 378419 - DNA, 25 bp, Mus musculus
tggaaacttcattgatgccaaagac

SEQ ID NO: 378420 - DNA, 25 bp, Mus musculus
tggaaacttctacaggtttccgtgg

SEQ ID NO: 378421 - DNA, 25 bp, Mus musculus
tggaaacttggagcaggcaccgctc

SEQ ID NO: 378422 - DNA, 25 bp, Mus musculus
tggaaactttgatctgctgttgtgt

SEQ ID NO: 378423 - DNA, 25 bp, Mus musculus
tggaaactttgatgaaacttttttg

SEQ ID NO: 378424 - DNA, 25 bp, Mus musculus
tggaaagaaaacagccccttcgagg

SEQ ID NO: 378425 - DNA, 25 bp, Mus musculus
tggaaagaaaacagctttgtttact

SEQ ID NO: 378426 - DNA, 25 bp, Mus musculus
tggaaagaaaacagtgacaacataa

SEQ ID NO: 378427 - DNA, 25 bp, Mus musculus
tggaaagaaacacgaagaaaggctt

SEQ ID NO: 378428 - DNA, 25 bp, Mus musculus
tggaaagaaagatgcaccaacaagg

SEQ ID NO: 378429 - DNA, 25 bp, Mus musculus
tggaaagaaatgatggttcaacttc

SEQ ID NO: 378430 - DNA, 25 bp, Mus musculus
tggaaagacagggggcagtgcccaa

SEQ ID NO: 378431 - DNA, 25 bp, Mus musculus
tggaaagacagtgtttgtaagcggt

SEQ ID NO: 378432 - DNA, 25 bp, Mus musculus
tggaaagagaaaggtattaagtcat

SEQ ID NO: 378433 - DNA, 25 bp, Mus musculus
tggaaagagagaaggggaacagcca

SEQ ID NO: 378434 - DNA, 25 bp, Mus musculus
tggaaagagcggaggccaacaccct

SEQ ID NO: 378435 - DNA, 25 bp, Mus musculus
tggaaagattgagttcaggaggggg

SEQ ID NO: 378436 - DNA, 25 bp, Mus musculus
tggaaagcaagatatattttgcaca

SEQ ID NO: 378437 - DNA, 25 bp, Mus musculus
tggaaagcaagcagaacacagaact

SEQ ID NO: 378438 - DNA, 25 bp, Mus musculus
tggaaagcaatcactctgtggaggg

SEQ ID NO: 378439 - DNA, 25 bp, Mus musculus
tggaaagcacagaactctttgttgc

SEQ ID NO: 378440 - DNA, 25 bp, Mus musculus
tggaaagccaggaataagatgtcac

SEQ ID NO: 378441 - DNA, 25 bp, Mus musculus
tggaaagccaggacgttaaaggatc

SEQ ID NO: 378442 - DNA, 25 bp, Mus musculus
tggaaagccgaaggtcctggttatg

SEQ ID NO: 378443 - DNA, 25 bp, Mus musculus
tggaaagcgcggatgacaacctcaa

SEQ ID NO: 378444 - DNA, 25 bp, Mus musculus
tggaaagcgcggatgggtaactcgt

SEQ ID NO: 378445 - DNA, 25 bp, Mus musculus
tggaaagctgcggcctcagcctggg

SEQ ID NO: 378446 - DNA, 25 bp, Mus musculus
tggaaagctgcgtctcgcggcaggt

SEQ ID NO: 378447 - DNA, 25 bp, Mus musculus
tggaaagctgctaacgaggctggct

SEQ ID NO: 378448 - DNA, 25 bp, Mus musculus
tggaaaggaacaggtatgtcactgg

SEQ ID NO: 378449 - DNA, 25 bp, Mus musculus
tggaaaggaagaggagccgctgctg

SEQ ID NO: 378450 - DNA, 25 bp, Mus musculus
tggaaaggaagcaagatttcctttc

SEQ ID NO: 378451 - DNA, 25 bp, Mus musculus
tggaaaggagcttagtgctttgggc

SEQ ID NO: 378452 - DNA, 25 bp, Mus musculus
tggaaaggagtatgtttgtcctggg

SEQ ID NO: 378453 - DNA, 25 bp, Mus musculus
tggaaaggagtattgcaagaagaac

SEQ ID NO: 378454 - DNA, 25 bp, Mus musculus
tggaaaggcaggtgtccacagccat

SEQ ID NO: 378455 - DNA, 25 bp, Mus musculus
tggaaaggcatgtataatgcctgcg

SEQ ID NO: 378456 - DNA, 25 bp, Mus musculus
tggaaaggtcgaggaccaaactctt

SEQ ID NO: 378457 - DNA, 25 bp, Mus musculus
tggaaagtcacagctttctcagggc

SEQ ID NO: 378458 - DNA, 25 bp, Mus musculus
tggaaagtgagttacatgaacatgc

SEQ ID NO: 378459 - DNA, 25 bp, Mus musculus
tggaaagtgggacaagatgcagcac

SEQ ID NO: 378460 - DNA, 25 bp, Mus musculus
tggaaagtgtggagagcctcaagtc

SEQ ID NO: 378461 - DNA, 25 bp, Mus musculus
tggaaagttaggaagaagagctgga

SEQ ID NO: 378462 - DNA, 25 bp, Mus musculus
tggaaagttggggttcacggctggt

SEQ ID NO: 378463 - DNA, 25 bp, Mus musculus
tggaaataacaaagatgctactaca

SEQ ID NO: 378464 - DNA, 25 bp, Mus musculus
tggaaataacaaaggctcaccatca

SEQ ID NO: 378465 - DNA, 25 bp, Mus musculus
tggaaataaggccgttgactacttt

SEQ ID NO: 378466 - DNA, 25 bp, Mus musculus
tggaaataatgctcttcatcttgcg

SEQ ID NO: 378467 - DNA, 25 bp, Mus musculus
tggaaataccatgatttctaggcaa

SEQ ID NO: 378468 - DNA, 25 bp, Mus musculus
tggaaatacccggccccagcctgca

SEQ ID NO: 378469 - DNA, 25 bp, Mus musculus
tggaaatattgcatactcctatgaa

SEQ ID NO: 378470 - DNA, 25 bp, Mus musculus
tggaaatcagcaagaagagaaccgg

SEQ ID NO: 378471 - DNA, 25 bp, Mus musculus
tggaaatcaggggtctgcaacaaca

SEQ ID NO: 378472 - DNA, 25 bp, Mus musculus
tggaaatcaggtgattcgtaagggc

SEQ ID NO: 378473 - DNA, 25 bp, Mus musculus
tggaaatccaggctgttcatcagca

SEQ ID NO: 378474 - DNA, 25 bp, Mus musculus
tggaaatccagggcagagatgacct

SEQ ID NO: 378475 - DNA, 25 bp, Mus musculus
tggaaatcctgtggtgggagcatgc

SEQ ID NO: 378476 - DNA, 25 bp, Mus musculus
tggaaatgagacgagaatgatgtca

SEQ ID NO: 378477 - DNA, 25 bp, Mus musculus
tggaaatgagacggaagctgccact

SEQ ID NO: 378478 - DNA, 25 bp, Mus musculus
tggaaatgagacgtgctggagatca

SEQ ID NO: 378479 - DNA, 25 bp, Mus musculus
tggaaatgaggaggctgctcagtgg

SEQ ID NO: 378480 - DNA, 25 bp, Mus musculus
tggaaatgaggcagctgcgatattt

SEQ ID NO: 378481 - DNA, 25 bp, Mus musculus
tggaaatgcagtccctgcagatagc

SEQ ID NO: 378482 - DNA, 25 bp, Mus musculus
tggaaatgcctcagcccagcgtaag

SEQ ID NO: 378483 - DNA, 25 bp, Mus musculus
tggaaatggatctgctgcgaaagcc

SEQ ID NO: 378484 - DNA, 25 bp, Mus musculus
tggaaatggggaacttctgtggcct

SEQ ID NO: 378485 - DNA, 25 bp, Mus musculus
tggaaatggggcactttctgcatct

SEQ ID NO: 378486 - DNA, 25 bp, Mus musculus
tggaaatggggggtcttcttgtgtt

SEQ ID NO: 378487 - DNA, 25 bp, Mus musculus
tggaaatgtagggtaagggtcgtca

SEQ ID NO: 378488 - DNA, 25 bp, Mus musculus
tggaaatgtaggtggttgtgagcca

SEQ ID NO: 378489 - DNA, 25 bp, Mus musculus
tggaacaaaattctcagatcggacc

SEQ ID NO: 378490 - DNA, 25 bp, Mus musculus
tggaacaaactcaagatgggaagtc

SEQ ID NO: 378491 - DNA, 25 bp, Mus musculus
tggaacaaactgaaggctcgatgag

SEQ ID NO: 378492 - DNA, 25 bp, Mus musculus
tggaacaacagaaaatcaatctttc

SEQ ID NO: 378493 - DNA, 25 bp, Mus musculus
tggaacaacaggtcctcagaatggt

SEQ ID NO: 378494 - DNA, 25 bp, Mus musculus
tggaacaacccgcaatactggagta

SEQ ID NO: 378495 - DNA, 25 bp, Mus musculus
tggaacaacgcgggggaccttatgg

SEQ ID NO: 378496 - DNA, 25 bp, Mus musculus
tggaacaagtcaggctccaaaaaca

SEQ ID NO: 378497 - DNA, 25 bp, Mus musculus
tggaacaagtgcgcatctgtagcca

SEQ ID NO: 378498 - DNA, 25 bp, Mus musculus
tggaacaagtttcttagacctctca

SEQ ID NO: 378499 - DNA, 25 bp, Mus musculus
tggaacaatcacagacagcttacct

SEQ ID NO: 378500 - DNA, 25 bp, Mus musculus
tggaacaatcacagaggccagaaga

SEQ ID NO: 378501 - DNA, 25 bp, Mus musculus
tggaacaatcacaggtgtagatgtc

SEQ ID NO: 378502 - DNA, 25 bp, Mus musculus
tggaacacaaaacgaaacctcgtgt

SEQ ID NO: 378503 - DNA, 25 bp, Mus musculus
tggaacactactgaccacgatgatg

SEQ ID NO: 378504 - DNA, 25 bp, Mus musculus
tggaacagaaacaggtgattttttc

SEQ ID NO: 378505 - DNA, 25 bp, Mus musculus
tggaacagaatcgaggtacaaccag

SEQ ID NO: 378506 - DNA, 25 bp, Mus musculus
tggaacagatccagcaattcttggc

SEQ ID NO: 378507 - DNA, 25 bp, Mus musculus
tggaacagctggacatgcgccggga

SEQ ID NO: 378508 - DNA, 25 bp, Mus musculus
tggaacagctgggctccctttcctg

SEQ ID NO: 378509 - DNA, 25 bp, Mus musculus
tggaacagctgtgtcactacttcga

SEQ ID NO: 378510 - DNA, 25 bp, Mus musculus
tggaacaggaactggtggattgtct

SEQ ID NO: 378511 - DNA, 25 bp, Mus musculus
tggaacaggaaggttcatatgggaa

SEQ ID NO: 378512 - DNA, 25 bp, Mus musculus
tggaacaggaatatgtggcatcagc

SEQ ID NO: 378513 - DNA, 25 bp, Mus musculus
tggaacaggaggagctgatccgagc

SEQ ID NO: 378514 - DNA, 25 bp, Mus musculus
tggaacataacctggagacagcctg

SEQ ID NO: 378515 - DNA, 25 bp, Mus musculus
tggaacatattggctccctgaccct

SEQ ID NO: 378516 - DNA, 25 bp, Mus musculus
tggaacatcagaggatctgagaaat

SEQ ID NO: 378517 - DNA, 25 bp, Mus musculus
tggaacatggaggaggattgtccgg

SEQ ID NO: 378518 - DNA, 25 bp, Mus musculus
tggaacatggagggccctgctcagt

SEQ ID NO: 378519 - DNA, 25 bp, Mus musculus
tggaacatggagggttcactgtggg

SEQ ID NO: 378520 - DNA, 25 bp, Mus musculus
tggaacattattgcttcacctctgc

SEQ ID NO: 378521 - DNA, 25 bp, Mus musculus
tggaacattcttctgccttggctgt

SEQ ID NO: 378522 - DNA, 25 bp, Mus musculus
tggaaccaaagatatttccatatga

SEQ ID NO: 378523 - DNA, 25 bp, Mus musculus
tggaaccaagagatgcaccttgcaa

SEQ ID NO: 378524 - DNA, 25 bp, Mus musculus
tggaaccaagagtttctagctctgg

SEQ ID NO: 378525 - DNA, 25 bp, Mus musculus
tggaaccaaggtgatgaatctttct

SEQ ID NO: 378526 - DNA, 25 bp, Mus musculus
tggaaccacagggagttaatgaggg

SEQ ID NO: 378527 - DNA, 25 bp, Mus musculus
tggaaccagaagctggaatcctttc

SEQ ID NO: 378528 - DNA, 25 bp, Mus musculus
tggaaccatcagcctgctgattttc

SEQ ID NO: 378529 - DNA, 25 bp, Mus musculus
tggaaccatcaggctgctgattttc

SEQ ID NO: 378530 - DNA, 25 bp, Mus musculus
tggaaccattacagccatccccagg

SEQ ID NO: 378531 - DNA, 25 bp, Mus musculus
tggaacccaaaagatcttcccctga

SEQ ID NO: 378532 - DNA, 25 bp, Mus musculus
tggaacccatcgcaggtgcagacca

SEQ ID NO: 378533 - DNA, 25 bp, Mus musculus
tggaaccccaggcagaaagtaaatc

SEQ ID NO: 378534 - DNA, 25 bp, Mus musculus
tggaacccccaatatgaacattttc

SEQ ID NO: 378535 - DNA, 25 bp, Mus musculus
tggaaccctctagcacctaaaggaa

SEQ ID NO: 378536 - DNA, 25 bp, Mus musculus
tggaaccctctgtgcagagaggtga

SEQ ID NO: 378537 - DNA, 25 bp, Mus musculus
tggaaccctggcaggtgcacaggct

SEQ ID NO: 378538 - DNA, 25 bp, Mus musculus
tggaaccctgttgggaactgttgac

SEQ ID NO: 378539 - DNA, 25 bp, Mus musculus
tggaaccgatcagtatatacacttc

SEQ ID NO: 378540 - DNA, 25 bp, Mus musculus
tggaaccgcccagggttcgctgatc

SEQ ID NO: 378541 - DNA, 25 bp, Mus musculus
tggaaccgcccaggtgctttttgaa

SEQ ID NO: 378542 - DNA, 25 bp, Mus musculus
tggaaccgggtgccatgtttcctga

SEQ ID NO: 378543 - DNA, 25 bp, Mus musculus
tggaacctaggatagagattgttgt

SEQ ID NO: 378544 - DNA, 25 bp, Mus musculus
tggaacctctcacagatgaatcagc

SEQ ID NO: 378545 - DNA, 25 bp, Mus musculus
tggaacctggagggaaaagcagttc

SEQ ID NO: 378546 - DNA, 25 bp, Mus musculus
tggaacctggcgcccaatgaaccag

SEQ ID NO: 378547 - DNA, 25 bp, Mus musculus
tggaacctggcgcggcactcctaga

SEQ ID NO: 378548 - DNA, 25 bp, Mus musculus
tggaacctgggcaggagctcgggga

SEQ ID NO: 378549 - DNA, 25 bp, Mus musculus
tggaaccttccagggctcactgatc

SEQ ID NO: 378550 - DNA, 25 bp, Mus musculus
tggaacgaggacaaggaaccttaca

SEQ ID NO: 378551 - DNA, 25 bp, Mus musculus
tggaacgaggacaagtgccaatgca

SEQ ID NO: 378552 - DNA, 25 bp, Mus musculus
tggaacgcagggatgccctgctggt

SEQ ID NO: 378553 - DNA, 25 bp, Mus musculus
tggaacgcatcaactgtccagcaga

SEQ ID NO: 378554 - DNA, 25 bp, Mus musculus
tggaacgcatgaaacggccttcctg

SEQ ID NO: 378555 - DNA, 25 bp, Mus musculus
tggaacgcttaagggaacaggaaga

SEQ ID NO: 378556 - DNA, 25 bp, Mus musculus
tggaacggcagacccagtttcctat

SEQ ID NO: 378557 - DNA, 25 bp, Mus musculus
tggaacggcagatcacagagcagca

SEQ ID NO: 378558 - DNA, 25 bp, Mus musculus
tggaacggcagatgataatgttcac

SEQ ID NO: 378559 - DNA, 25 bp, Mus musculus
tggaacggcagatgtggtacacgga

SEQ ID NO: 378560 - DNA, 25 bp, Mus musculus
tggaacggcagcgtgttgaggagac

SEQ ID NO: 378561 - DNA, 25 bp, Mus musculus
tggaacggcaggtagagatgacccc

SEQ ID NO: 378562 - DNA, 25 bp, Mus musculus
tggaacggctattcgctgcctgatg

SEQ ID NO: 378563 - DNA, 25 bp, Mus musculus
tggaacggctgctggtccaggtccc

SEQ ID NO: 378564 - DNA, 25 bp, Mus musculus
tggaacggctggtggtgaggtcgag

SEQ ID NO: 378565 - DNA, 25 bp, Mus musculus
tggaacgggcagtgtggtgagcact

SEQ ID NO: 378566 - DNA, 25 bp, Mus musculus
tggaacggtgaaggtgtggaatgtc

SEQ ID NO: 378567 - DNA, 25 bp, Mus musculus
tggaacgtatgatggaaatttctat

SEQ ID NO: 378568 - DNA, 25 bp, Mus musculus
tggaactaaaggaaggccctcatac

SEQ ID NO: 378569 - DNA, 25 bp, Mus musculus
tggaactaagggactttgaatatgt

SEQ ID NO: 378570 - DNA, 25 bp, Mus musculus
tggaactacaggtgaccccaaagga

SEQ ID NO: 378571 - DNA, 25 bp, Mus musculus
tggaactatcgcaggattgggtttc

SEQ ID NO: 378572 - DNA, 25 bp, Mus musculus
tggaactatcgcagggatcccaggc

SEQ ID NO: 378573 - DNA, 25 bp, Mus musculus
tggaactcaagttggtgggaactcg

SEQ ID NO: 378574 - DNA, 25 bp, Mus musculus
tggaactcaagtttggacgtcatga

SEQ ID NO: 378575 - DNA, 25 bp, Mus musculus
tggaactcagagtttgctattgcga

SEQ ID NO: 378576 - DNA, 25 bp, Mus musculus
tggaactcaggtagcactttgtatt

SEQ ID NO: 378577 - DNA, 25 bp, Mus musculus
tggaactctgacagtgtccattctg

SEQ ID NO: 378578 - DNA, 25 bp, Mus musculus
tggaactctgccaaaaatggatttg

SEQ ID NO: 378579 - DNA, 25 bp, Mus musculus
tggaactgaggatttctcagctgat

SEQ ID NO: 378580 - DNA, 25 bp, Mus musculus
tggaactgctgctcctccgttccct

SEQ ID NO: 378581 - DNA, 25 bp, Mus musculus
tggaactggacaaagaaacaacttc

SEQ ID NO: 378582 - DNA, 25 bp, Mus musculus
tggaactggacaaaggactgaggtc

SEQ ID NO: 378583 - DNA, 25 bp, Mus musculus
tggaactggacaaaggatgttggga

SEQ ID NO: 378584 - DNA, 25 bp, Mus musculus
tggaactggcagccagcgctcctgt

SEQ ID NO: 378585 - DNA, 25 bp, Mus musculus
tggaactggtcaaggcctggcagct

SEQ ID NO: 378586 - DNA, 25 bp, Mus musculus
tggaactgtctttatccgtctacct

SEQ ID NO: 378587 - DNA, 25 bp, Mus musculus
tggaactgtttggaggccaatgagg

SEQ ID NO: 378588 - DNA, 25 bp, Mus musculus
tggaacttcacgattcctgtgttga

SEQ ID NO: 378589 - DNA, 25 bp, Mus musculus
tggaacttcctcgtcccatctctcc

SEQ ID NO: 378590 - DNA, 25 bp, Mus musculus
tggaacttgtaaagtcccacgagtc

SEQ ID NO: 378591 - DNA, 25 bp, Mus musculus
tggaagaaaagttcctagtctccag

SEQ ID NO: 378592 - DNA, 25 bp, Mus musculus
tggaagaaaggcttggggcatatct

SEQ ID NO: 378593 - DNA, 25 bp, Mus musculus
tggaagaaaggtggtggtgtcaact

SEQ ID NO: 378594 - DNA, 25 bp, Mus musculus
tggaagaaatacaagaaaaattcct

SEQ ID NO: 378595 - DNA, 25 bp, Mus musculus
tggaagaaatggaggtgacagctac

SEQ ID NO: 378596 - DNA, 25 bp, Mus musculus
tggaagaactatatcagtctctgct

SEQ ID NO: 378597 - DNA, 25 bp, Mus musculus
tggaagaagaaaggatacaagaccc

SEQ ID NO: 378598 - DNA, 25 bp, Mus musculus
tggaagaagaaaggttcatcctcaa

SEQ ID NO: 378599 - DNA, 25 bp, Mus musculus
tggaagaagagaaccacaaactcca

SEQ ID NO: 378600 - DNA, 25 bp, Mus musculus
tggaagaagccaaggcatgttattt

SEQ ID NO: 378601 - DNA, 25 bp, Mus musculus
tggaagaagccacggatggtctcag

SEQ ID NO: 378602 - DNA, 25 bp, Mus musculus
tggaagaagcccaaggatgatgaaa

SEQ ID NO: 378603 - DNA, 25 bp, Mus musculus
tggaagaagggagcagcatccacgg

SEQ ID NO: 378604 - DNA, 25 bp, Mus musculus
tggaagaaggtgctccttcagcaag

SEQ ID NO: 378605 - DNA, 25 bp, Mus musculus
tggaagaatcacagggctggaccct

SEQ ID NO: 378606 - DNA, 25 bp, Mus musculus
tggaagaatggcatctagtgctttt

SEQ ID NO: 378607 - DNA, 25 bp, Mus musculus
tggaagaatttcagatgcccgtgtg

SEQ ID NO: 378608 - DNA, 25 bp, Mus musculus
tggaagaatttcagtgtctctgaag

SEQ ID NO: 378609 - DNA, 25 bp, Mus musculus
tggaagacaaggggctgcactggat

SEQ ID NO: 378610 - DNA, 25 bp, Mus musculus
tggaagacaagtgcctggagctggt

SEQ ID NO: 378611 - DNA, 25 bp, Mus musculus
tggaagacaagttgctgtctcacag

SEQ ID NO: 378612 - DNA, 25 bp, Mus musculus
tggaagacaccagcaccaatggaac

SEQ ID NO: 378613 - DNA, 25 bp, Mus musculus
tggaagacagagaatttcatcttca

SEQ ID NO: 378614 - DNA, 25 bp, Mus musculus
tggaagacagagttcctctgctaaa

SEQ ID NO: 378615 - DNA, 25 bp, Mus musculus
tggaagacatccagaaactgaagga

SEQ ID NO: 378616 - DNA, 25 bp, Mus musculus
tggaagacatccagccggatggcgc

SEQ ID NO: 378617 - DNA, 25 bp, Mus musculus
tggaagacctgatcctgtggaagag

SEQ ID NO: 378618 - DNA, 25 bp, Mus musculus
tggaagacctggataactggactgc

SEQ ID NO: 378619 - DNA, 25 bp, Mus musculus
tggaagacgtgaaattgcaagcttt

SEQ ID NO: 378620 - DNA, 25 bp, Mus musculus
tggaagacgtgaatatccgctccat

SEQ ID NO: 378621 - DNA, 25 bp, Mus musculus
tggaagactatctgtctgcaatcct

SEQ ID NO: 378622 - DNA, 25 bp, Mus musculus
tggaagactctcaggccggggagcg

SEQ ID NO: 378623 - DNA, 25 bp, Mus musculus
tggaagagacctccggaaatttgtg

SEQ ID NO: 378624 - DNA, 25 bp, Mus musculus
tggaagagcaggggaaggaagccag

SEQ ID NO: 378625 - DNA, 25 bp, Mus musculus
tggaagagcggagactactggattg

SEQ ID NO: 378626 - DNA, 25 bp, Mus musculus
tggaagagctggatgccttattgga

SEQ ID NO: 378627 - DNA, 25 bp, Mus musculus
tggaagaggaggaaactttggtttt

SEQ ID NO: 378628 - DNA, 25 bp, Mus musculus
tggaagaggaggaactatggtcctg

SEQ ID NO: 378629 - DNA, 25 bp, Mus musculus
tggaagaggaggaccatatggtgga

SEQ ID NO: 378630 - DNA, 25 bp, Mus musculus
tggaagaggccaaaggaaatttgtg

SEQ ID NO: 378631 - DNA, 25 bp, Mus musculus
tggaagagtatatcgcggacctgta

SEQ ID NO: 378632 - DNA, 25 bp, Mus musculus
tggaagagtattctttggtacaggt

SEQ ID NO: 378633 - DNA, 25 bp, Mus musculus
tggaagagttgcgagcgaatacagg

SEQ ID NO: 378634 - DNA, 25 bp, Mus musculus
tggaagagttgcgaggccaggtggt

SEQ ID NO: 378635 - DNA, 25 bp, Mus musculus
tggaagataacaagactcagattag

SEQ ID NO: 378636 - DNA, 25 bp, Mus musculus
tggaagatataaaggattctaaggt

SEQ ID NO: 378637 - DNA, 25 bp, Mus musculus
tggaagatctcgaaacggtaataag

SEQ ID NO: 378638 - DNA, 25 bp, Mus musculus
tggaagatctcgaaacttcagagga

SEQ ID NO: 378639 - DNA, 25 bp, Mus musculus
tggaagatcttctcagtcctagacc

SEQ ID NO: 378640 - DNA, 25 bp, Mus musculus
tggaagatcttgtggtcaagagcaa

SEQ ID NO: 378641 - DNA, 25 bp, Mus musculus
tggaagatggtgcagattccatgga

SEQ ID NO: 378642 - DNA, 25 bp, Mus musculus
tggaagatgtcggtcaataggcttg

SEQ ID NO: 378643 - DNA, 25 bp, Mus musculus
tggaagattcattattgaagaagtt

SEQ ID NO: 378644 - DNA, 25 bp, Mus musculus
tggaagattcgggcttcagttgtgt

SEQ ID NO: 378645 - DNA, 25 bp, Mus musculus
tggaagatttaaaaggtatgggtga

SEQ ID NO: 378646 - DNA, 25 bp, Mus musculus
tggaagcaacaaggctgagatggta

SEQ ID NO: 378647 - DNA, 25 bp, Mus musculus
tggaagcaagaggttgcagaattca

SEQ ID NO: 378648 - DNA, 25 bp, Mus musculus
tggaagcacagcgtggtcacctcca

SEQ ID NO: 378649 - DNA, 25 bp, Mus musculus
tggaagcacatccagaaggagcttg

SEQ ID NO: 378650 - DNA, 25 bp, Mus musculus
tggaagcaccagctggaggaagagc

SEQ ID NO: 378651 - DNA, 25 bp, Mus musculus
tggaagcaccttggtgaccagaatg

SEQ ID NO: 378652 - DNA, 25 bp, Mus musculus
tggaagcagagcgttggtcagacta

SEQ ID NO: 378653 - DNA, 25 bp, Mus musculus
tggaagcagagtcggagcagaagtg

SEQ ID NO: 378654 - DNA, 25 bp, Mus musculus
tggaagcagatgttttgggtccagg

SEQ ID NO: 378655 - DNA, 25 bp, Mus musculus
tggaagcagggaggctgcaaaggag

SEQ ID NO: 378656 - DNA, 25 bp, Mus musculus
tggaagccaactgggtggtgatgcc

SEQ ID NO: 378657 - DNA, 25 bp, Mus musculus
tggaagccaagaaagccctctctga

SEQ ID NO: 378658 - DNA, 25 bp, Mus musculus
tggaagccaagatttcctggccatg

SEQ ID NO: 378659 - DNA, 25 bp, Mus musculus
tggaagccaagggtgtaaattcccg

SEQ ID NO: 378660 - DNA, 25 bp, Mus musculus
tggaagccaaggtgaaagccgccct

SEQ ID NO: 378661 - DNA, 25 bp, Mus musculus
tggaagccagaaataggaccaaggt

SEQ ID NO: 378662 - DNA, 25 bp, Mus musculus
tggaagccagaaatggggctggtgt

SEQ ID NO: 378663 - DNA, 25 bp, Mus musculus
tggaagccagctttttgatcacgtc

SEQ ID NO: 378664 - DNA, 25 bp, Mus musculus
tggaagccaggaagcttcttgactt

SEQ ID NO: 378665 - DNA, 25 bp, Mus musculus
tggaagccaggagattagagtgggc

SEQ ID NO: 378666 - DNA, 25 bp, Mus musculus
tggaagccaggagtgggcctgaggc

SEQ ID NO: 378667 - DNA, 25 bp, Mus musculus
tggaagccaggcctgtagggacttc

SEQ ID NO: 378668 - DNA, 25 bp, Mus musculus
tggaagcccaccaggccatcatgat

SEQ ID NO: 378669 - DNA, 25 bp, Mus musculus
tggaagcccagaagaaactgtggat

SEQ ID NO: 378670 - DNA, 25 bp, Mus musculus
tggaagcccagctcacaggaaggag

SEQ ID NO: 378671 - DNA, 25 bp, Mus musculus
tggaagccctcgatgccaattctcg

SEQ ID NO: 378672 - DNA, 25 bp, Mus musculus
tggaagccctgaatgttctccctcc

SEQ ID NO: 378673 - DNA, 25 bp, Mus musculus
tggaagcccttaccagcccagcttt

SEQ ID NO: 378674 - DNA, 25 bp, Mus musculus
tggaagccgaggaacgccgccactc

SEQ ID NO: 378675 - DNA, 25 bp, Mus musculus
tggaagccgaggagctggaggagaa

SEQ ID NO: 378676 - DNA, 25 bp, Mus musculus
tggaagccgaggtctgcattacatt

SEQ ID NO: 378677 - DNA, 25 bp, Mus musculus
tggaagccgtgccccggcagcccaa

SEQ ID NO: 378678 - DNA, 25 bp, Mus musculus
tggaagcgaaggcaaacttaaacaa

SEQ ID NO: 378679 - DNA, 25 bp, Mus musculus
tggaagcgagacagggactctgatg

SEQ ID NO: 378680 - DNA, 25 bp, Mus musculus
tggaagcgcagaaccctgttctgca

SEQ ID NO: 378681 - DNA, 25 bp, Mus musculus
tggaagctaaaaatctggccgcccc

SEQ ID NO: 378682 - DNA, 25 bp, Mus musculus
tggaagctaaaagagcatgaaggaa

SEQ ID NO: 378683 - DNA, 25 bp, Mus musculus
tggaagctatttaacattgaggctt

SEQ ID NO: 378684 - DNA, 25 bp, Mus musculus
tggaagctgaaccaagtctgtgatg

SEQ ID NO: 378685 - DNA, 25 bp, Mus musculus
tggaagctgaggacctacctgtgca

SEQ ID NO: 378686 - DNA, 25 bp, Mus musculus
tggaagctgcagactttgtggtgct

SEQ ID NO: 378687 - DNA, 25 bp, Mus musculus
tggaagctgcaggagtggcatctcc

SEQ ID NO: 378688 - DNA, 25 bp, Mus musculus
tggaaggaactatgctgttggctgc

SEQ ID NO: 378689 - DNA, 25 bp, Mus musculus
tggaaggaagttctcctcggaccag

SEQ ID NO: 378690 - DNA, 25 bp, Mus musculus
tggaaggacaaggttgttgacctcc

SEQ ID NO: 378691 - DNA, 25 bp, Mus musculus
tggaaggagcagctgcccagagcat

SEQ ID NO: 378692 - DNA, 25 bp, Mus musculus
tggaaggaggccatgtcatgattga

SEQ ID NO: 378693 - DNA, 25 bp, Mus musculus
tggaaggagttagaaacaggtgaga

SEQ ID NO: 378694 - DNA, 25 bp, Mus musculus
tggaaggatgatgagctgaactttg

SEQ ID NO: 378695 - DNA, 25 bp, Mus musculus
tggaaggcaacaagatgaagaacaa

SEQ ID NO: 378696 - DNA, 25 bp, Mus musculus
tggaaggcaacaaggatgctacagc

SEQ ID NO: 378697 - DNA, 25 bp, Mus musculus
tggaaggcagaaaccaggtggcctt

SEQ ID NO: 378698 - DNA, 25 bp, Mus musculus
tggaaggcatctggcacacctctat

SEQ ID NO: 378699 - DNA, 25 bp, Mus musculus
tggaaggcatctgggagggacattg

SEQ ID NO: 378700 - DNA, 25 bp, Mus musculus
tggaaggcatgggtcccgagcattc

SEQ ID NO: 378701 - DNA, 25 bp, Mus musculus
tggaaggctctggagatggcaggtt

SEQ ID NO: 378702 - DNA, 25 bp, Mus musculus
tggaaggctgggttcctgaatgcca

SEQ ID NO: 378703 - DNA, 25 bp, Mus musculus
tggaaggcttcgttccttgcgcgct

SEQ ID NO: 378704 - DNA, 25 bp, Mus musculus
tggaagggcataggcagccacctag

SEQ ID NO: 378705 - DNA, 25 bp, Mus musculus
tggaagggcatcaggcggtatgaat

SEQ ID NO: 378706 - DNA, 25 bp, Mus musculus
tggaagggctcagccagagtaacag

SEQ ID NO: 378707 - DNA, 25 bp, Mus musculus
tggaaggggagtgggctcacccgag

SEQ ID NO: 378708 - DNA, 25 bp, Mus musculus
tggaaggtccagagaaggcaagctg

SEQ ID NO: 378709 - DNA, 25 bp, Mus musculus
tggaaggtccaggacctcagacaag

SEQ ID NO: 378710 - DNA, 25 bp, Mus musculus
tggaaggtcccggagcatgcaaaac

SEQ ID NO: 378711 - DNA, 25 bp, Mus musculus
tggaaggtcccggagcatgcattct

SEQ ID NO: 378712 - DNA, 25 bp, Mus musculus
tggaaggtcccggattgaaaagatg

SEQ ID NO: 378713 - DNA, 25 bp, Mus musculus
tggaagtaaagcttgttttcaggca

SEQ ID NO: 378714 - DNA, 25 bp, Mus musculus
tggaagtaaaggtcaccttggctgt

SEQ ID NO: 378715 - DNA, 25 bp, Mus musculus
tggaagtaacctaggtctgctgcag

SEQ ID NO: 378716 - DNA, 25 bp, Mus musculus
tggaagtacaaataatctgcaggac

SEQ ID NO: 378717 - DNA, 25 bp, Mus musculus
tggaagtagacacctacatacagac

SEQ ID NO: 378718 - DNA, 25 bp, Mus musculus
tggaagtatttgatcctgtgcccaa

SEQ ID NO: 378719 - DNA, 25 bp, Mus musculus
tggaagtatttgccagatcttctgg

SEQ ID NO: 378720 - DNA, 25 bp, Mus musculus
tggaagtcccaggctctgtgtgagt

SEQ ID NO: 378721 - DNA, 25 bp, Mus musculus
tggaagtccggcggtagccaccaag

SEQ ID NO: 378722 - DNA, 25 bp, Mus musculus
tggaagtccttaaggtgcagaccca

SEQ ID NO: 378723 - DNA, 25 bp, Mus musculus
tggaagtgaagaacccagattccaa

SEQ ID NO: 378724 - DNA, 25 bp, Mus musculus
tggaagtgaaggcctgaaccaaaat

SEQ ID NO: 378725 - DNA, 25 bp, Mus musculus
tggaagtgagagttcattgtttcca

SEQ ID NO: 378726 - DNA, 25 bp, Mus musculus
tggaagtgagggaagatggagatat

SEQ ID NO: 378727 - DNA, 25 bp, Mus musculus
tggaagtgcaggagaaagacgaaac

SEQ ID NO: 378728 - DNA, 25 bp, Mus musculus
tggaagtgctgaaggcagggaagcg

SEQ ID NO: 378729 - DNA, 25 bp, Mus musculus
tggaagtggaaatacgaaaaccagc

SEQ ID NO: 378730 - DNA, 25 bp, Mus musculus
tggaagtggaaataggaaaaccagc

SEQ ID NO: 378731 - DNA, 25 bp, Mus musculus
tggaagtggagagggaccttcttca

SEQ ID NO: 378732 - DNA, 25 bp, Mus musculus
tggaagtgggcaggcacccagcgga

SEQ ID NO: 378733 - DNA, 25 bp, Mus musculus
tggaagtgggcagggtgaagtgtgt

SEQ ID NO: 378734 - DNA, 25 bp, Mus musculus
tggaagtggtgggagccctatgctg

SEQ ID NO: 378735 - DNA, 25 bp, Mus musculus
tggaagtgtatccaggctttaagca

SEQ ID NO: 378736 - DNA, 25 bp, Mus musculus
tggaagtgtatccagggaccaccac

SEQ ID NO: 378737 - DNA, 25 bp, Mus musculus
tggaagtgtatccagggataatctt

SEQ ID NO: 378738 - DNA, 25 bp, Mus musculus
tggaagtgtccaggtgtaaccagcc

SEQ ID NO: 378739 - DNA, 25 bp, Mus musculus
tggaagttcaaggactcccttactt

SEQ ID NO: 378740 - DNA, 25 bp, Mus musculus
tggaagttgactgagcacgtgagtg

SEQ ID NO: 378741 - DNA, 25 bp, Mus musculus
tggaagttttttgggcattgttgtg

SEQ ID NO: 378742 - DNA, 25 bp, Mus musculus
tggaagttttttggttgcaaggaag

SEQ ID NO: 378743 - DNA, 25 bp, Mus musculus
tggaataaaaattgggatgaatggg

SEQ ID NO: 378744 - DNA, 25 bp, Mus musculus
tggaataaaggaaacaagctcccat

SEQ ID NO: 378745 - DNA, 25 bp, Mus musculus
tggaataaagtatcaggagtgcgac

SEQ ID NO: 378746 - DNA, 25 bp, Mus musculus
tggaataagagctcagtaagttcta

SEQ ID NO: 378747 - DNA, 25 bp, Mus musculus
tggaataatcacactgaagtgatcc

SEQ ID NO: 378748 - DNA, 25 bp, Mus musculus
tggaatacacagcagggcatcagcc

SEQ ID NO: 378749 - DNA, 25 bp, Mus musculus
tggaatacactgcatctatattgga

SEQ ID NO: 378750 - DNA, 25 bp, Mus musculus
tggaatacagtgccgtgatgtgaga

SEQ ID NO: 378751 - DNA, 25 bp, Mus musculus
tggaatacgcatgggatgccaatga

SEQ ID NO: 378752 - DNA, 25 bp, Mus musculus
tggaatacgtgaagttctccaagga

SEQ ID NO: 378753 - DNA, 25 bp, Mus musculus
tggaatatatacgggttctccttgc

SEQ ID NO: 378754 - DNA, 25 bp, Mus musculus
tggaatatcagaagtgacagacagg

SEQ ID NO: 378755 - DNA, 25 bp, Mus musculus
tggaatatgaagtatggatggaaga

SEQ ID NO: 378756 - DNA, 25 bp, Mus musculus
tggaatcacaggccaactactgtat

SEQ ID NO: 378757 - DNA, 25 bp, Mus musculus
tggaatcactccgacacctcctgcc

SEQ ID NO: 378758 - DNA, 25 bp, Mus musculus
tggaatcaggcggccccctttcagc

SEQ ID NO: 378759 - DNA, 25 bp, Mus musculus
tggaatcagggtgcgactggaccta

SEQ ID NO: 378760 - DNA, 25 bp, Mus musculus
tggaatccccaccaggacctgcaag

SEQ ID NO: 378761 - DNA, 25 bp, Mus musculus
tggaatccctgagatcaaaaccatc

SEQ ID NO: 378762 - DNA, 25 bp, Mus musculus
tggaatcctcacagccaacgaggtg

SEQ ID NO: 378763 - DNA, 25 bp, Mus musculus
tggaatcctcagctgtcgagaaacc

SEQ ID NO: 378764 - DNA, 25 bp, Mus musculus
tggaatcctcaggtatcagagaaga

SEQ ID NO: 378765 - DNA, 25 bp, Mus musculus
tggaatcctcaggttcctgccctcc

SEQ ID NO: 378766 - DNA, 25 bp, Mus musculus
tggaatcctggacagaaccagctcc

SEQ ID NO: 378767 - DNA, 25 bp, Mus musculus
tggaatcgcaggaaaccaacagaac

SEQ ID NO: 378768 - DNA, 25 bp, Mus musculus
tggaatcgcaggactgtgcctggaa

SEQ ID NO: 378769 - DNA, 25 bp, Mus musculus
tggaatcgcagttactgtgggaaag

SEQ ID NO: 378770 - DNA, 25 bp, Mus musculus
tggaatcggaaggcaggagagtatg

SEQ ID NO: 378771 - DNA, 25 bp, Mus musculus
tggaatctcaaaaaggttactgcag

SEQ ID NO: 378772 - DNA, 25 bp, Mus musculus
tggaatctcaaggatgtcacagtgg

SEQ ID NO: 378773 - DNA, 25 bp, Mus musculus
tggaatctcaggcaaaacccattta

SEQ ID NO: 378774 - DNA, 25 bp, Mus musculus
tggaatctccctgagcaagagtggg

SEQ ID NO: 378775 - DNA, 25 bp, Mus musculus
tggaatcttgacaagtggagagtac

SEQ ID NO: 378776 - DNA, 25 bp, Mus musculus
tggaatgaaaggcattttcccgact

SEQ ID NO: 378777 - DNA, 25 bp, Mus musculus
tggaatgaagaagcttctcttcagg

SEQ ID NO: 378778 - DNA, 25 bp, Mus musculus
tggaatgaagaaggaggtgaagatt

SEQ ID NO: 378779 - DNA, 25 bp, Mus musculus
tggaatgaagatctttctgagacca

SEQ ID NO: 378780 - DNA, 25 bp, Mus musculus
tggaatgaagggagaagcaggtcct

SEQ ID NO: 378781 - DNA, 25 bp, Mus musculus
tggaatgaagggtcctgtggctgtt

SEQ ID NO: 378782 - DNA, 25 bp, Mus musculus
tggaatgacagatcagctcgaacgg

SEQ ID NO: 378783 - DNA, 25 bp, Mus musculus
tggaatgaccgagagtgggaccgtg

SEQ ID NO: 378784 - DNA, 25 bp, Mus musculus
tggaatgattaatgacaccaattct

SEQ ID NO: 378785 - DNA, 25 bp, Mus musculus
tggaatgcagataacaattgaaatt

SEQ ID NO: 378786 - DNA, 25 bp, Mus musculus
tggaatgcagcttgaaggtcttcct

SEQ ID NO: 378787 - DNA, 25 bp, Mus musculus
tggaatgcgcagattaagaaacaaa

SEQ ID NO: 378788 - DNA, 25 bp, Mus musculus
tggaatggaaggccttgttacccac

SEQ ID NO: 378789 - DNA, 25 bp, Mus musculus
tggaatggcttccttcatgaagata

SEQ ID NO: 378790 - DNA, 25 bp, Mus musculus
tggaatgtcaagatgaagatgaatg

SEQ ID NO: 378791 - DNA, 25 bp, Mus musculus
tggaatgtcaagatgttaacgaatg

SEQ ID NO: 378792 - DNA, 25 bp, Mus musculus
tggaatgtgagatatgatgaatgga

SEQ ID NO: 378793 - DNA, 25 bp, Mus musculus
tggaatgttccagacgtgaagccct

SEQ ID NO: 378794 - DNA, 25 bp, Mus musculus
tggaattaaacaggcatgatgcaca

SEQ ID NO: 378795 - DNA, 25 bp, Mus musculus
tggaattaaagctctaagaacaggt

SEQ ID NO: 378796 - DNA, 25 bp, Mus musculus
tggaattaaaggaaactagaagtct

SEQ ID NO: 378797 - DNA, 25 bp, Mus musculus
tggaattaaggaagttacaatgatt

SEQ ID NO: 378798 - DNA, 25 bp, Mus musculus
tggaattacaggatgagcctgcccg

SEQ ID NO: 378799 - DNA, 25 bp, Mus musculus
tggaattacagggatcgcttacact

SEQ ID NO: 378800 - DNA, 25 bp, Mus musculus
tggaattaccgatggatctggtggc

SEQ ID NO: 378801 - DNA, 25 bp, Mus musculus
tggaattataagtactattaatcct

SEQ ID NO: 378802 - DNA, 25 bp, Mus musculus
tggaattatagccacaatcacaagt

SEQ ID NO: 378803 - DNA, 25 bp, Mus musculus
tggaattatgtctgaggaagatgga

SEQ ID NO: 378804 - DNA, 25 bp, Mus musculus
tggaattcaacaagaatttggatgt

SEQ ID NO: 378805 - DNA, 25 bp, Mus musculus
tggaattcaacaaggtgtcggtgct

SEQ ID NO: 378806 - DNA, 25 bp, Mus musculus
tggaattcatcttaggtcgggatgg

SEQ ID NO: 378807 - DNA, 25 bp, Mus musculus
tggaattccagattcgagtcaatag

SEQ ID NO: 378808 - DNA, 25 bp, Mus musculus
tggaattccaggcacgtgctctaac

SEQ ID NO: 378809 - DNA, 25 bp, Mus musculus
tggaattcctgggcatccagggcaa

SEQ ID NO: 378810 - DNA, 25 bp, Mus musculus
tggaattctcttcagtaccgggagg

SEQ ID NO: 378811 - DNA, 25 bp, Mus musculus
tggaattgaagatggatcacctact

SEQ ID NO: 378812 - DNA, 25 bp, Mus musculus
tggaattgatccgatttggaacctg

SEQ ID NO: 378813 - DNA, 25 bp, Mus musculus
tggaattgatccgtgtgccattgaa

SEQ ID NO: 378814 - DNA, 25 bp, Mus musculus
tggaattgcagtctgtgatgctccc

SEQ ID NO: 378815 - DNA, 25 bp, Mus musculus
tggaattggtggtgtgacaaacgga

SEQ ID NO: 378816 - DNA, 25 bp, Mus musculus
tggaattgtctcaaagaacttttga

SEQ ID NO: 378817 - DNA, 25 bp, Mus musculus
tggaattgtgcatggcagaagagga

SEQ ID NO: 378818 - DNA, 25 bp, Mus musculus
tggaattgtgcatgttccccctacc

SEQ ID NO: 378819 - DNA, 25 bp, Mus musculus
tggaatttatctatgatgaagctgc

SEQ ID NO: 378820 - DNA, 25 bp, Mus musculus
tggaatttatctatggtcgaatatt

SEQ ID NO: 378821 - DNA, 25 bp, Mus musculus
tggaatttatgggatgaacaagaag

SEQ ID NO: 378822 - DNA, 25 bp, Mus musculus
tggaatttatggtacaggaaaactc

SEQ ID NO: 378823 - DNA, 25 bp, Mus musculus
tggaattttgtaagaggacaatgcg

SEQ ID NO: 378824 - DNA, 25 bp, Mus musculus
tggaattttgtaagtacaaacaggc

SEQ ID NO: 378825 - DNA, 25 bp, Mus musculus
tggacaaaaaacttgagcccagcgg

SEQ ID NO: 378826 - DNA, 25 bp, Mus musculus
tggacaaagacggttatattaagaa

SEQ ID NO: 378827 - DNA, 25 bp, Mus musculus
tggacaaagatgagtggataagtgg

SEQ ID NO: 378828 - DNA, 25 bp, Mus musculus
tggacaaatccaggtggctcctccc

SEQ ID NO: 378829 - DNA, 25 bp, Mus musculus
tggacaaatcctcgtggctcctccc

SEQ ID NO: 378830 - DNA, 25 bp, Mus musculus
tggacaacataaggaagtcagacat

SEQ ID NO: 378831 - DNA, 25 bp, Mus musculus
tggacaacccagaagttctcctgat

SEQ ID NO: 378832 - DNA, 25 bp, Mus musculus
tggacaacctatgtcttttgtgcta

SEQ ID NO: 378833 - DNA, 25 bp, Mus musculus
tggacaacgagagctggggctttgt

SEQ ID NO: 378834 - DNA, 25 bp, Mus musculus
tggacaacgagagttctgcctgctg

SEQ ID NO: 378835 - DNA, 25 bp, Mus musculus
tggacaacgagcgagtggtgacgta

SEQ ID NO: 378836 - DNA, 25 bp, Mus musculus
tggacaacgagcgagttgggatggc

SEQ ID NO: 378837 - DNA, 25 bp, Mus musculus
tggacaactatgagtgaactccggg

SEQ ID NO: 378838 - DNA, 25 bp, Mus musculus
tggacaagaaaattgagcccagagt

SEQ ID NO: 378839 - DNA, 25 bp, Mus musculus
tggacaagaaaattgagcccagcgg

SEQ ID NO: 378840 - DNA, 25 bp, Mus musculus
tggacaagaaaattgtgcccaggga

SEQ ID NO: 378841 - DNA, 25 bp, Mus musculus
tggacaagagcggttccggagcctt

SEQ ID NO: 378842 - DNA, 25 bp, Mus musculus
tggacaagaggtgcaccatggagcc

SEQ ID NO: 378843 - DNA, 25 bp, Mus musculus
tggacaagatgtttaagacaagggg

SEQ ID NO: 378844 - DNA, 25 bp, Mus musculus
tggacaagcccataggaacctggct

SEQ ID NO: 378845 - DNA, 25 bp, Mus musculus
tggacaagcccataggttacaagga

SEQ ID NO: 378846 - DNA, 25 bp, Mus musculus
tggacaagcctgactgcctctttaa

SEQ ID NO: 378847 - DNA, 25 bp, Mus musculus
tggacaagctcctagatcttgatga

SEQ ID NO: 378848 - DNA, 25 bp, Mus musculus
tggacaagctccttccagtgacagc

SEQ ID NO: 378849 - DNA, 25 bp, Mus musculus
tggacaaggaagactttctctgtgt

SEQ ID NO: 378850 - DNA, 25 bp, Mus musculus
tggacaaggaaggttctgagcctgg

SEQ ID NO: 378851 - DNA, 25 bp, Mus musculus
tggacaaggaggacggtgtgccgat

SEQ ID NO: 378852 - DNA, 25 bp, Mus musculus
tggacaagtgagcagactcggagtg

SEQ ID NO: 378853 - DNA, 25 bp, Mus musculus
tggacaagtgagcagggacggcctc

SEQ ID NO: 378854 - DNA, 25 bp, Mus musculus
tggacaatcacttagcatgtgtgaa

SEQ ID NO: 378855 - DNA, 25 bp, Mus musculus
tggacaatcagcgcctgttggtctg

SEQ ID NO: 378856 - DNA, 25 bp, Mus musculus
tggacaatcagggtctatctacaca

SEQ ID NO: 378857 - DNA, 25 bp, Mus musculus
tggacaatcatggctgtcatggtat

SEQ ID NO: 378858 - DNA, 25 bp, Mus musculus
tggacaatgaaaacgtatccaacgg

SEQ ID NO: 378859 - DNA, 25 bp, Mus musculus
tggacaatgaagattacgaacatga

SEQ ID NO: 378860 - DNA, 25 bp, Mus musculus
tggacaatgtaaagaaccctgtgta

SEQ ID NO: 378861 - DNA, 25 bp, Mus musculus
tggacaattacggtgcccgagggcc

SEQ ID NO: 378862 - DNA, 25 bp, Mus musculus
tggacaatttaggctacagaacagg

SEQ ID NO: 378863 - DNA, 25 bp, Mus musculus
tggacacaaagttcagtactagaag

SEQ ID NO: 378864 - DNA, 25 bp, Mus musculus
tggacacacaatgggtgatccattc

SEQ ID NO: 378865 - DNA, 25 bp, Mus musculus
tggacacagtgcccgtgcgcagttc

SEQ ID NO: 378866 - DNA, 25 bp, Mus musculus
tggacacatcaccagggaattcgta

SEQ ID NO: 378867 - DNA, 25 bp, Mus musculus
tggacacatcaccaggtctcattat

SEQ ID NO: 378868 - DNA, 25 bp, Mus musculus
tggacaccaacacaggttccttcct

SEQ ID NO: 378869 - DNA, 25 bp, Mus musculus
tggacaccacagagctccttggtag

SEQ ID NO: 378870 - DNA, 25 bp, Mus musculus
tggacaccacaggaaagaatgtttc

SEQ ID NO: 378871 - DNA, 25 bp, Mus musculus
tggacaccacgcagaatggtggcat

SEQ ID NO: 378872 - DNA, 25 bp, Mus musculus
tggacaccacgcagcccccacatcg

SEQ ID NO: 378873 - DNA, 25 bp, Mus musculus
tggacacccatggctttgagcacac

SEQ ID NO: 378874 - DNA, 25 bp, Mus musculus
tggacaccggattcggtgtatcctg

SEQ ID NO: 378875 - DNA, 25 bp, Mus musculus
tggacacctatgaacttgcgatgta

SEQ ID NO: 378876 - DNA, 25 bp, Mus musculus
tggacacctatgttttcaaagatac

SEQ ID NO: 378877 - DNA, 25 bp, Mus musculus
tggacacgatggaagcagaaaccag

SEQ ID NO: 378878 - DNA, 25 bp, Mus musculus
tggacacgatggaagctcagctgcc

SEQ ID NO: 378879 - DNA, 25 bp, Mus musculus
tggacacgctatggcaatctttaaa

SEQ ID NO: 378880 - DNA, 25 bp, Mus musculus
tggacacggtggatggagcgagatg

SEQ ID NO: 378881 - DNA, 25 bp, Mus musculus
tggacactcaagaaaattacaacac

SEQ ID NO: 378882 - DNA, 25 bp, Mus musculus
tggacactcaagagagggactcctg

SEQ ID NO: 378883 - DNA, 25 bp, Mus musculus
tggacactcaaggcatttccccact

SEQ ID NO: 378884 - DNA, 25 bp, Mus musculus
tggacactgcaaaaacctggagcca

SEQ ID NO: 378885 - DNA, 25 bp, Mus musculus
tggacactggcagtttccaggcact

SEQ ID NO: 378886 - DNA, 25 bp, Mus musculus
tggacacttaaagctgcgcaaacca

SEQ ID NO: 378887 - DNA, 25 bp, Mus musculus
tggacacttaacaggtccccaggca

SEQ ID NO: 378888 - DNA, 25 bp, Mus musculus
tggacacttaccaggtctttgacag

SEQ ID NO: 378889 - DNA, 25 bp, Mus musculus
tggacacttgagaggctacagacac

SEQ ID NO: 378890 - DNA, 25 bp, Mus musculus
tggacagaaaccaagaccaaaaaca

SEQ ID NO: 378891 - DNA, 25 bp, Mus musculus
tggacagaaaccaagtgctaaactg

SEQ ID NO: 378892 - DNA, 25 bp, Mus musculus
tggacagaaagaatgtcactgctct

SEQ ID NO: 378893 - DNA, 25 bp, Mus musculus
tggacagaaggtctgtgtgtggtat

SEQ ID NO: 378894 - DNA, 25 bp, Mus musculus
tggacagacagtgggaagtctgttg

SEQ ID NO: 378895 - DNA, 25 bp, Mus musculus
tggacagaccctggacatcaacatg

SEQ ID NO: 378896 - DNA, 25 bp, Mus musculus
tggacagaccctgggacagcaggtg

SEQ ID NO: 378897 - DNA, 25 bp, Mus musculus
tggacagaccctgggctccaccctc

SEQ ID NO: 378898 - DNA, 25 bp, Mus musculus
tggacagaccctggtcactcatcag

SEQ ID NO: 378899 - DNA, 25 bp, Mus musculus
tggacagactgaaggacagggtggc

SEQ ID NO: 378900 - DNA, 25 bp, Mus musculus
tggacagagactggggctgcaggat

SEQ ID NO: 378901 - DNA, 25 bp, Mus musculus
tggacagagagttaattgacaagta

SEQ ID NO: 378902 - DNA, 25 bp, Mus musculus
tggacagagatccaaggacaccact

SEQ ID NO: 378903 - DNA, 25 bp, Mus musculus
tggacagagatccaaggttgaccac

SEQ ID NO: 378904 - DNA, 25 bp, Mus musculus
tggacagagcgaggtgtggacagtt

SEQ ID NO: 378905 - DNA, 25 bp, Mus musculus
tggacagatcaagaacctgctggga

SEQ ID NO: 378906 - DNA, 25 bp, Mus musculus
tggacagatcaagcgtctcagaata

SEQ ID NO: 378907 - DNA, 25 bp, Mus musculus
tggacagatgtccactcccgagact

SEQ ID NO: 378908 - DNA, 25 bp, Mus musculus
tggacagcaagggccatgtgaaact

SEQ ID NO: 378909 - DNA, 25 bp, Mus musculus
tggacagcaggtcatgttgggactc

SEQ ID NO: 378910 - DNA, 25 bp, Mus musculus
tggacagcagtcccagcgcttcccg

SEQ ID NO: 378911 - DNA, 25 bp, Mus musculus
tggacagccaggtgtggagggcttc

SEQ ID NO: 378912 - DNA, 25 bp, Mus musculus
tggacagccagtttgtaggtgtgga

SEQ ID NO: 378913 - DNA, 25 bp, Mus musculus
tggacagccatgctgagcttcttga

SEQ ID NO: 378914 - DNA, 25 bp, Mus musculus
tggacagcgagcagtgttgcctctc

SEQ ID NO: 378915 - DNA, 25 bp, Mus musculus
tggacagcgaggcatgctacaccaa

SEQ ID NO: 378916 - DNA, 25 bp, Mus musculus
tggacaggagaggatgggagccagg

SEQ ID NO: 378917 - DNA, 25 bp, Mus musculus
tggacaggatgtgtgaagatctgtg

SEQ ID NO: 378918 - DNA, 25 bp, Mus musculus
tggacaggccaaagcttcctgaaag

SEQ ID NO: 378919 - DNA, 25 bp, Mus musculus
tggacagggtaaagaaggaatggga

SEQ ID NO: 378920 - DNA, 25 bp, Mus musculus
tggacagtctgcagcatgtgtgaac

SEQ ID NO: 378921 - DNA, 25 bp, Mus musculus
tggacagtgaagatggagctggagg

SEQ ID NO: 378922 - DNA, 25 bp, Mus musculus
tggacagtgaaggtgacccttgtac

SEQ ID NO: 378923 - DNA, 25 bp, Mus musculus
tggacagtgagcctcgaggtctcct

SEQ ID NO: 378924 - DNA, 25 bp, Mus musculus
tggacagtgagctggtgacccctcc

SEQ ID NO: 378925 - DNA, 25 bp, Mus musculus
tggacagtgccagctgaggatggtt

SEQ ID NO: 378926 - DNA, 25 bp, Mus musculus
tggacagtgctctgagaacagtacg

SEQ ID NO: 378927 - DNA, 25 bp, Mus musculus
tggacagtggtgaggtgtatggctg

SEQ ID NO: 378928 - DNA, 25 bp, Mus musculus
tggacagtgttcaagggtctcttgt

SEQ ID NO: 378929 - DNA, 25 bp, Mus musculus
tggacatactgatagaccctgttga

SEQ ID NO: 378930 - DNA, 25 bp, Mus musculus
tggacatagaagggcttggctgagt

SEQ ID NO: 378931 - DNA, 25 bp, Mus musculus
tggacatagtttaggtattgctttc

SEQ ID NO: 378932 - DNA, 25 bp, Mus musculus
tggacatatcaattactgggattca

SEQ ID NO: 378933 - DNA, 25 bp, Mus musculus
tggacatatcatcataccccacatt

SEQ ID NO: 378934 - DNA, 25 bp, Mus musculus
tggacatcaagactgccaaggttac

SEQ ID NO: 378935 - DNA, 25 bp, Mus musculus
tggacatcacagcatggtttattga

SEQ ID NO: 378936 - DNA, 25 bp, Mus musculus
tggacatcacgggttatatatttgg

SEQ ID NO: 378937 - DNA, 25 bp, Mus musculus
tggacatcagagtaggtttgattgg

SEQ ID NO: 378938 - DNA, 25 bp, Mus musculus
tggacatcaggatgtgatggtggca

SEQ ID NO: 378939 - DNA, 25 bp, Mus musculus
tggacatcatccggcgcctgtctca

SEQ ID NO: 378940 - DNA, 25 bp, Mus musculus
tggacatcatttcagaagcatgtaa

SEQ ID NO: 378941 - DNA, 25 bp, Mus musculus
tggacatccgtggctccattgtcta

SEQ ID NO: 378942 - DNA, 25 bp, Mus musculus
tggacatcctgaactactttgagag

SEQ ID NO: 378943 - DNA, 25 bp, Mus musculus
tggacatcctgatcttaggacagct

SEQ ID NO: 378944 - DNA, 25 bp, Mus musculus
tggacatcctgcctccttccttgtg

SEQ ID NO: 378945 - DNA, 25 bp, Mus musculus
tggacatcgtggccagacttcatgg

SEQ ID NO: 378946 - DNA, 25 bp, Mus musculus
tggacatcgtggctcctgcttcctg

SEQ ID NO: 378947 - DNA, 25 bp, Mus musculus
tggacatctccaagatgcacatgat

SEQ ID NO: 378948 - DNA, 25 bp, Mus musculus
tggacatgaaagtggccgaggtcct

SEQ ID NO: 378949 - DNA, 25 bp, Mus musculus
tggacatgaaatggtgccacatccc

SEQ ID NO: 378950 - DNA, 25 bp, Mus musculus
tggacatgaagctgtttgtatggca

SEQ ID NO: 378951 - DNA, 25 bp, Mus musculus
tggacatgaaggtgcctcagccagg

SEQ ID NO: 378952 - DNA, 25 bp, Mus musculus
tggacatgatctccacatcttatcc

SEQ ID NO: 378953 - DNA, 25 bp, Mus musculus
tggacatgccagggctgtagcagtg

SEQ ID NO: 378954 - DNA, 25 bp, Mus musculus
tggacatgctgtgaatattctagag

SEQ ID NO: 378955 - DNA, 25 bp, Mus musculus
tggacatgctgtgatggacatacta

SEQ ID NO: 378956 - DNA, 25 bp, Mus musculus
tggacatggtggagcactacaccaa

SEQ ID NO: 378957 - DNA, 25 bp, Mus musculus
tggacatggtggagctggctggcta

SEQ ID NO: 378958 - DNA, 25 bp, Mus musculus
tggacatgttgaagagactttcaac

SEQ ID NO: 378959 - DNA, 25 bp, Mus musculus
tggacatgttgaaggtgttggctgc

SEQ ID NO: 378960 - DNA, 25 bp, Mus musculus
tggacattactggccagttcacaat

SEQ ID NO: 378961 - DNA, 25 bp, Mus musculus
tggacattcggatttccatttccta

SEQ ID NO: 378962 - DNA, 25 bp, Mus musculus
tggacattcggtcacagtctctgtg

SEQ ID NO: 378963 - DNA, 25 bp, Mus musculus
tggacattctggggaacggattgct

SEQ ID NO: 378964 - DNA, 25 bp, Mus musculus
tggacattgatgaaactgttattgg

SEQ ID NO: 378965 - DNA, 25 bp, Mus musculus
tggacattgccaagttaaaaggaga

SEQ ID NO: 378966 - DNA, 25 bp, Mus musculus
tggaccaaaaatgtggacatcttca

SEQ ID NO: 378967 - DNA, 25 bp, Mus musculus
tggaccaaacacgtgaagaagagtc

SEQ ID NO: 378968 - DNA, 25 bp, Mus musculus
tggaccaaagggtgctcagggagag

SEQ ID NO: 378969 - DNA, 25 bp, Mus musculus
tggaccaactttgctagatgtgtct

SEQ ID NO: 378970 - DNA, 25 bp, Mus musculus
tggaccaactttgctgtcatttctc

SEQ ID NO: 378971 - DNA, 25 bp, Mus musculus
tggaccaactttgcttcattacagg

SEQ ID NO: 378972 - DNA, 25 bp, Mus musculus
tggaccaagaggacggtgtgccgat

SEQ ID NO: 378973 - DNA, 25 bp, Mus musculus
tggaccaagatgcagacgacctgga

SEQ ID NO: 378974 - DNA, 25 bp, Mus musculus
tggaccaatgggtccaattggttct

SEQ ID NO: 378975 - DNA, 25 bp, Mus musculus
tggaccaatgggtcctcttgggata

SEQ ID NO: 378976 - DNA, 25 bp, Mus musculus
tggaccaatttgaaattgcagactg

SEQ ID NO: 378977 - DNA, 25 bp, Mus musculus
tggaccacaccagcattcggagggg

SEQ ID NO: 378978 - DNA, 25 bp, Mus musculus
tggaccacaccagttcctctaattc

SEQ ID NO: 378979 - DNA, 25 bp, Mus musculus
tggaccacagtcaccgagagtgagc

SEQ ID NO: 378980 - DNA, 25 bp, Mus musculus
tggaccacagtgctgccatagtgga

SEQ ID NO: 378981 - DNA, 25 bp, Mus musculus
tggaccacagtgggcctgtgcttta

SEQ ID NO: 378982 - DNA, 25 bp, Mus musculus
tggaccacattaggactctgttggt

SEQ ID NO: 378983 - DNA, 25 bp, Mus musculus
tggaccacattaggatctgaagtga

SEQ ID NO: 378984 - DNA, 25 bp, Mus musculus
tggaccacccttggtgaaggcagct

SEQ ID NO: 378985 - DNA, 25 bp, Mus musculus
tggaccacctggtccaagagggttt

SEQ ID NO: 378986 - DNA, 25 bp, Mus musculus
tggaccacgaatgtgccgcttcatc

SEQ ID NO: 378987 - DNA, 25 bp, Mus musculus
tggaccactcaaatgggcataggtg

SEQ ID NO: 378988 - DNA, 25 bp, Mus musculus
tggaccactccatggattgccggaa

SEQ ID NO: 378989 - DNA, 25 bp, Mus musculus
tggaccactggcagcattagcagtg

SEQ ID NO: 378990 - DNA, 25 bp, Mus musculus
tggaccagacaaagacatggaccct

SEQ ID NO: 378991 - DNA, 25 bp, Mus musculus
tggaccagacaaagccgaccctttc

SEQ ID NO: 378992 - DNA, 25 bp, Mus musculus
tggaccagatggcttcctgtttggc

SEQ ID NO: 378993 - DNA, 25 bp, Mus musculus
tggaccagcagagaaattcaaaggg

SEQ ID NO: 378994 - DNA, 25 bp, Mus musculus
tggaccagccctggggtacttgttg

SEQ ID NO: 378995 - DNA, 25 bp, Mus musculus
tggaccagctgcactatgtgacgga

SEQ ID NO: 378996 - DNA, 25 bp, Mus musculus
tggaccaggcagaagctgggaagtc

SEQ ID NO: 378997 - DNA, 25 bp, Mus musculus
tggaccagggacagactcactctgt

SEQ ID NO: 378998 - DNA, 25 bp, Mus musculus
tggaccagggcagtgccctgcagac

SEQ ID NO: 378999 - DNA, 25 bp, Mus musculus
tggaccagtttcagcgtgcgggagg

SEQ ID NO: 379000 - DNA, 25 bp, Mus musculus
tggaccatatcaagtctatgcatgg

SEQ ID NO: 379001 - DNA, 25 bp, Mus musculus
tggaccatatgaacttggcatggaa

SEQ ID NO: 379002 - DNA, 25 bp, Mus musculus
tggaccatcaaacagacctttggct

SEQ ID NO: 379003 - DNA, 25 bp, Mus musculus
tggaccatcggggtacctggaatgg

SEQ ID NO: 379004 - DNA, 25 bp, Mus musculus
tggaccatggcaggggagtcctcat

SEQ ID NO: 379005 - DNA, 25 bp, Mus musculus
tggaccatggccttatgttgactta

SEQ ID NO: 379006 - DNA, 25 bp, Mus musculus
tggaccatggtggagtttgggagca

SEQ ID NO: 379007 - DNA, 25 bp, Mus musculus
tggaccattggagggttcccagtgg

SEQ ID NO: 379008 - DNA, 25 bp, Mus musculus
tggaccattttagactacatccagc

SEQ ID NO: 379009 - DNA, 25 bp, Mus musculus
tggacccaaaggccctgcctgcctg

SEQ ID NO: 379010 - DNA, 25 bp, Mus musculus
tggacccaaatcaatactacaagat

SEQ ID NO: 379011 - DNA, 25 bp, Mus musculus
tggacccaagggaaagcgtggagag

SEQ ID NO: 379012 - DNA, 25 bp, Mus musculus
tggacccagaaggattgccacaagg

SEQ ID NO: 379013 - DNA, 25 bp, Mus musculus
tggacccagaaggtttgaggctctg

SEQ ID NO: 379014 - DNA, 25 bp, Mus musculus
tggacccagacaggtgcgtggtcca

SEQ ID NO: 379015 - DNA, 25 bp, Mus musculus
tggacccatcagctatgtggtggtg

SEQ ID NO: 379016 - DNA, 25 bp, Mus musculus
tggacccatctacagaggctgatcc

SEQ ID NO: 379017 - DNA, 25 bp, Mus musculus
tggaccccaaaggccatgaagaaga

SEQ ID NO: 379018 - DNA, 25 bp, Mus musculus
tggaccccaaatgattataagcaca

SEQ ID NO: 379019 - DNA, 25 bp, Mus musculus
tggaccccaccccgctggctgcctt

SEQ ID NO: 379020 - DNA, 25 bp, Mus musculus
tggaccccagacctgcagctaaagc

SEQ ID NO: 379021 - DNA, 25 bp, Mus musculus
tggaccccagatgcaccatgggctt

SEQ ID NO: 379022 - DNA, 25 bp, Mus musculus
tggaccccagggtccattcagaagc

SEQ ID NO: 379023 - DNA, 25 bp, Mus musculus
tggaccccatggcccctcaccgttc

SEQ ID NO: 379024 - DNA, 25 bp, Mus musculus
tggaccccctttcgccacagcccaa

SEQ ID NO: 379025 - DNA, 25 bp, Mus musculus
tggaccccgagagccccaaggacga

SEQ ID NO: 379026 - DNA, 25 bp, Mus musculus
tggaccccgagatccagttggactc

SEQ ID NO: 379027 - DNA, 25 bp, Mus musculus
tggaccccgaggcactgcctctgta

SEQ ID NO: 379028 - DNA, 25 bp, Mus musculus
tggaccccgtggatggtgtggtcct

SEQ ID NO: 379029 - DNA, 25 bp, Mus musculus
tggaccccgtggtctacgtgacact

SEQ ID NO: 379030 - DNA, 25 bp, Mus musculus
tggacccctatgaggagctcctagt

SEQ ID NO: 379031 - DNA, 25 bp, Mus musculus
tggacccctgaaggacatagcattg

SEQ ID NO: 379032 - DNA, 25 bp, Mus musculus
tggacccctgaaggttacagtctct

SEQ ID NO: 379033 - DNA, 25 bp, Mus musculus
tggacccgatagcctcggccctgcg

SEQ ID NO: 379034 - DNA, 25 bp, Mus musculus
tggacccgccgacagccaccatgcg

SEQ ID NO: 379035 - DNA, 25 bp, Mus musculus
tggacccggaaaagcatgccttgga

SEQ ID NO: 379036 - DNA, 25 bp, Mus musculus
tggaccctaaggagaaggagcgcca

SEQ ID NO: 379037 - DNA, 25 bp, Mus musculus
tggaccctaagtgcagctttgttgt

SEQ ID NO: 379038 - DNA, 25 bp, Mus musculus
tggaccctcagattgatgacattgt

SEQ ID NO: 379039 - DNA, 25 bp, Mus musculus
tggaccctgacccagccccaccatt

SEQ ID NO: 379040 - DNA, 25 bp, Mus musculus
tggaccctgagttccaccaggtgag

SEQ ID NO: 379041 - DNA, 25 bp, Mus musculus
tggaccctgctgaccctgtacacat

SEQ ID NO: 379042 - DNA, 25 bp, Mus musculus
tggaccctgtggaagggcggctggt

SEQ ID NO: 379043 - DNA, 25 bp, Mus musculus
tggacccttggcaggagctgtgaaa

SEQ ID NO: 379044 - DNA, 25 bp, Mus musculus
tggaccgaagcccaaagcccaccag

SEQ ID NO: 379045 - DNA, 25 bp, Mus musculus
tggaccgagagaaagtccctgagta

SEQ ID NO: 379046 - DNA, 25 bp, Mus musculus
tggaccgcaacaacgccatctatga

SEQ ID NO: 379047 - DNA, 25 bp, Mus musculus
tggaccgcaccaaagtggagcccct

SEQ ID NO: 379048 - DNA, 25 bp, Mus musculus
tggaccgcagaggagagcccccctt

SEQ ID NO: 379049 - DNA, 25 bp, Mus musculus
tggaccgccaggcactgggaaaaca

SEQ ID NO: 379050 - DNA, 25 bp, Mus musculus
tggaccggcacgtgtcggagctcca

SEQ ID NO: 379051 - DNA, 25 bp, Mus musculus
tggaccgtgggagaactactatcca

SEQ ID NO: 379052 - DNA, 25 bp, Mus musculus
tggacctaaagcctgagaatatctt

SEQ ID NO: 379053 - DNA, 25 bp, Mus musculus
tggacctacaacaccacctctgcag

SEQ ID NO: 379054 - DNA, 25 bp, Mus musculus
tggacctagaatggtgtgccaggac

SEQ ID NO: 379055 - DNA, 25 bp, Mus musculus
tggacctagaatggtttgcaatagc

SEQ ID NO: 379056 - DNA, 25 bp, Mus musculus
tggacctagaatgtgggcacaatgc

SEQ ID NO: 379057 - DNA, 25 bp, Mus musculus
tggacctagaggcctttatccagct

SEQ ID NO: 379058 - DNA, 25 bp, Mus musculus
tggacctagcagccttacagttcct

SEQ ID NO: 379059 - DNA, 25 bp, Mus musculus
tggacctagcaggcttacagttcct

SEQ ID NO: 379060 - DNA, 25 bp, Mus musculus
tggacctatcaccagtatcatagtt

SEQ ID NO: 379061 - DNA, 25 bp, Mus musculus
tggacctcaatggcaatgccctcgg

SEQ ID NO: 379062 - DNA, 25 bp, Mus musculus
tggacctcacagtggaagggttcca

SEQ ID NO: 379063 - DNA, 25 bp, Mus musculus
tggacctcacctccttatagctccc

SEQ ID NO: 379064 - DNA, 25 bp, Mus musculus
tggacctcagagatgaggagtttgc

SEQ ID NO: 379065 - DNA, 25 bp, Mus musculus
tggacctcaggcatcctgcatcctc

SEQ ID NO: 379066 - DNA, 25 bp, Mus musculus
tggacctcaggcatcctggatcctc

SEQ ID NO: 379067 - DNA, 25 bp, Mus musculus
tggacctccactccaggcagcagac

SEQ ID NO: 379068 - DNA, 25 bp, Mus musculus
tggacctccggggatataaaattcc

SEQ ID NO: 379069 - DNA, 25 bp, Mus musculus
tggacctccgggtcctgtgggtccc

SEQ ID NO: 379070 - DNA, 25 bp, Mus musculus
tggacctcctggtccaaatggtgaa

SEQ ID NO: 379071 - DNA, 25 bp, Mus musculus
tggacctcggagaacttccaggtcc

SEQ ID NO: 379072 - DNA, 25 bp, Mus musculus
tggacctcggagccacagagatcct

SEQ ID NO: 379073 - DNA, 25 bp, Mus musculus
tggacctcggagctgcccagacccc

SEQ ID NO: 379074 - DNA, 25 bp, Mus musculus
tggacctcggagggatgactcgaga

SEQ ID NO: 379075 - DNA, 25 bp, Mus musculus
tggacctgaagggcatgttcctgtc

SEQ ID NO: 379076 - DNA, 25 bp, Mus musculus
tggacctgacaggtgatctggagag

SEQ ID NO: 379077 - DNA, 25 bp, Mus musculus
tggacctgaggtggcatctttagcc

SEQ ID NO: 379078 - DNA, 25 bp, Mus musculus
tggacctgcagacccaagaatcttt

SEQ ID NO: 379079 - DNA, 25 bp, Mus musculus
tggacctgcagcacgtgggataagc

SEQ ID NO: 379080 - DNA, 25 bp, Mus musculus
tggacctgcctctgagtgctgcacc

SEQ ID NO: 379081 - DNA, 25 bp, Mus musculus
tggacctgcttgtgatatatgttgg

SEQ ID NO: 379082 - DNA, 25 bp, Mus musculus
tggacctggccaggagtgaattgga

SEQ ID NO: 379083 - DNA, 25 bp, Mus musculus
tggacctggccgaagcatgacccgc

SEQ ID NO: 379084 - DNA, 25 bp, Mus musculus
tggacctggctttgtctgttgctgt

SEQ ID NO: 379085 - DNA, 25 bp, Mus musculus
tggacctgggggcagcccgggccaa

SEQ ID NO: 379086 - DNA, 25 bp, Mus musculus
tggacctgggtcagaacatctttgc

SEQ ID NO: 379087 - DNA, 25 bp, Mus musculus
tggaccttaagatttcctattatga

SEQ ID NO: 379088 - DNA, 25 bp, Mus musculus
tggaccttcagaaggaagacaacat

SEQ ID NO: 379089 - DNA, 25 bp, Mus musculus
tggaccttcccaactctgctcctga

SEQ ID NO: 379090 - DNA, 25 bp, Mus musculus
tggaccttcccctgtctctgcactg

SEQ ID NO: 379091 - DNA, 25 bp, Mus musculus
tggaccttggaccaagaagttggtg

SEQ ID NO: 379092 - DNA, 25 bp, Mus musculus
tggacgaagaggatcttagtgaatt

SEQ ID NO: 379093 - DNA, 25 bp, Mus musculus
tggacgaagagtgaattcgggatag

SEQ ID NO: 379094 - DNA, 25 bp, Mus musculus
tggacgaagatgaaggtcaaactgg

SEQ ID NO: 379095 - DNA, 25 bp, Mus musculus
tggacgaagcagaggagttttttga

SEQ ID NO: 379096 - DNA, 25 bp, Mus musculus
tggacgaaggggatgcatgtggatg

SEQ ID NO: 379097 - DNA, 25 bp, Mus musculus
tggacgaaggggatgttgtggaagt

SEQ ID NO: 379098 - DNA, 25 bp, Mus musculus
tggacgacaagaactgctgagaaga

SEQ ID NO: 379099 - DNA, 25 bp, Mus musculus
tggacgacagctttagccaggccct

SEQ ID NO: 379100 - DNA, 25 bp, Mus musculus
tggacgaccggcgtgtgcagcctgg

SEQ ID NO: 379101 - DNA, 25 bp, Mus musculus
tggacgaccgtatctggactagaac

SEQ ID NO: 379102 - DNA, 25 bp, Mus musculus
tggacgactacttggggctcgtgag

SEQ ID NO: 379103 - DNA, 25 bp, Mus musculus
tggacgagacaaactgccagaaagt

SEQ ID NO: 379104 - DNA, 25 bp, Mus musculus
tggacgagacaaagtgctgctgttt

SEQ ID NO: 379105 - DNA, 25 bp, Mus musculus
tggacgagagggcagccctggtgct

SEQ ID NO: 379106 - DNA, 25 bp, Mus musculus
tggacgagagtttcggggccaggaa

SEQ ID NO: 379107 - DNA, 25 bp, Mus musculus
tggacgagtctgatagctgctgctt

SEQ ID NO: 379108 - DNA, 25 bp, Mus musculus
tggacgatccagcttacattgcagt

SEQ ID NO: 379109 - DNA, 25 bp, Mus musculus
tggacgcaagggcattgaaaacata

SEQ ID NO: 379110 - DNA, 25 bp, Mus musculus
tggacgcaagggtttgtgtttagtg

SEQ ID NO: 379111 - DNA, 25 bp, Mus musculus
tggacgcacagcctttgcttcctta

SEQ ID NO: 379112 - DNA, 25 bp, Mus musculus
tggacgcacaggcctcctgtgccac

SEQ ID NO: 379113 - DNA, 25 bp, Mus musculus
tggacgcaggagaagaaccaccacc

SEQ ID NO: 379114 - DNA, 25 bp, Mus musculus
tggacgcaggagaagcacatcatgc

SEQ ID NO: 379115 - DNA, 25 bp, Mus musculus
tggacgccatgccaggtatgcagga

SEQ ID NO: 379116 - DNA, 25 bp, Mus musculus
tggacgccatgccaggtgtgtttga

SEQ ID NO: 379117 - DNA, 25 bp, Mus musculus
tggacgccattcccccactttgttg

SEQ ID NO: 379118 - DNA, 25 bp, Mus musculus
tggacgcctcagctgcacactgccc

SEQ ID NO: 379119 - DNA, 25 bp, Mus musculus
tggacgcgaggtacaacgcctaccg

SEQ ID NO: 379120 - DNA, 25 bp, Mus musculus
tggacgcgagtttcggacccagtat

SEQ ID NO: 379121 - DNA, 25 bp, Mus musculus
tggacgcgcggaaaggaaacctcgt

SEQ ID NO: 379122 - DNA, 25 bp, Mus musculus
tggacgcgggagagaagatggaggg

SEQ ID NO: 379123 - DNA, 25 bp, Mus musculus
tggacgctcagccttcaaacagtag

SEQ ID NO: 379124 - DNA, 25 bp, Mus musculus
tggacgctcaggacccaccagagga

SEQ ID NO: 379125 - DNA, 25 bp, Mus musculus
tggacgctcaggggaggggcgacat

SEQ ID NO: 379126 - DNA, 25 bp, Mus musculus
tggacgctcggactgggctatatgc

SEQ ID NO: 379127 - DNA, 25 bp, Mus musculus
tggacgctctgctcatttgggagga

SEQ ID NO: 379128 - DNA, 25 bp, Mus musculus
tggacgctctggtcatccaacttgc

SEQ ID NO: 379129 - DNA, 25 bp, Mus musculus
tggacgcttgcctttgtctggaaag

SEQ ID NO: 379130 - DNA, 25 bp, Mus musculus
tggacgcttgtcaccagatttcgtg

SEQ ID NO: 379131 - DNA, 25 bp, Mus musculus
tggacggaagacacggagtatatat

SEQ ID NO: 379132 - DNA, 25 bp, Mus musculus
tggacggacagaatacaccatcacc

SEQ ID NO: 379133 - DNA, 25 bp, Mus musculus
tggacggacgggcgcctctgaagcg

SEQ ID NO: 379134 - DNA, 25 bp, Mus musculus
tggacggcaggtgaagtggaagatt

SEQ ID NO: 379135 - DNA, 25 bp, Mus musculus
tggacggccagggggtggcaccgaa

SEQ ID NO: 379136 - DNA, 25 bp, Mus musculus
tggacggcctgtatgccctgatgtc

SEQ ID NO: 379137 - DNA, 25 bp, Mus musculus
tggacggctgcacgagtcacaccgg

SEQ ID NO: 379138 - DNA, 25 bp, Mus musculus
tggacggcttgactaaaatacaaat

SEQ ID NO: 379139 - DNA, 25 bp, Mus musculus
tggacggcttgatgaggtctcccgc

SEQ ID NO: 379140 - DNA, 25 bp, Mus musculus
tggacggcttgatgagtaagaaagc

SEQ ID NO: 379141 - DNA, 25 bp, Mus musculus
tggacggcttggggatccagcaccc

SEQ ID NO: 379142 - DNA, 25 bp, Mus musculus
tggacgggacccagggtgaaatggt

SEQ ID NO: 379143 - DNA, 25 bp, Mus musculus
tggacgggacctcattcctctctgg

SEQ ID NO: 379144 - DNA, 25 bp, Mus musculus
tggacgggattaaggaatcttccga

SEQ ID NO: 379145 - DNA, 25 bp, Mus musculus
tggacggggaggtgctgacggagaa

SEQ ID NO: 379146 - DNA, 25 bp, Mus musculus
tggacggggcaagtgcatttggcac

SEQ ID NO: 379147 - DNA, 25 bp, Mus musculus
tggacgtaagaccaatcgcagcctg

SEQ ID NO: 379148 - DNA, 25 bp, Mus musculus
tggacgtaagaccagtgggagcagg

SEQ ID NO: 379149 - DNA, 25 bp, Mus musculus
tggacgtagcttcaggtgacctcac

SEQ ID NO: 379150 - DNA, 25 bp, Mus musculus
tggacgtgatgacagggtccaaggc

SEQ ID NO: 379151 - DNA, 25 bp, Mus musculus
tggacgtggaaggcattttgtgact

SEQ ID NO: 379152 - DNA, 25 bp, Mus musculus
tggacgtggaaggccttgatcctgc

SEQ ID NO: 379153 - DNA, 25 bp, Mus musculus
tggacgtggagcacctgggagatac

SEQ ID NO: 379154 - DNA, 25 bp, Mus musculus
tggacgtgttgttcggagatgggta

SEQ ID NO: 379155 - DNA, 25 bp, Mus musculus
tggacgttacaagtgggatgcctgg

SEQ ID NO: 379156 - DNA, 25 bp, Mus musculus
tggacgttcagagttactacctgga

SEQ ID NO: 379157 - DNA, 25 bp, Mus musculus
tggactaaacctctgaaactgtaag

SEQ ID NO: 379158 - DNA, 25 bp, Mus musculus
tggactaaggatcaccactacttta

SEQ ID NO: 379159 - DNA, 25 bp, Mus musculus
tggactaatctgaaggtgccctggg

SEQ ID NO: 379160 - DNA, 25 bp, Mus musculus
tggactacagagcagaaaaggaagg

SEQ ID NO: 379161 - DNA, 25 bp, Mus musculus
tggactacctcttaggtctctttga

SEQ ID NO: 379162 - DNA, 25 bp, Mus musculus
tggactagcgagccataaaagagag

SEQ ID NO: 379163 - DNA, 25 bp, Mus musculus
tggactagcggcctggtctcagcga

SEQ ID NO: 379164 - DNA, 25 bp, Mus musculus
tggactagcgtttcaggcctggtct

SEQ ID NO: 379165 - DNA, 25 bp, Mus musculus
tggactatataagatatccagaaag

SEQ ID NO: 379166 - DNA, 25 bp, Mus musculus
tggactatataaggtaaatgaattg

SEQ ID NO: 379167 - DNA, 25 bp, Mus musculus
tggactatgaaacagaaaaacaccg

SEQ ID NO: 379168 - DNA, 25 bp, Mus musculus
tggactatgccctcagctggggcca

SEQ ID NO: 379169 - DNA, 25 bp, Mus musculus
tggactatggctggcagagggagac

SEQ ID NO: 379170 - DNA, 25 bp, Mus musculus
tggactcaaagatgcagtgccagtt

SEQ ID NO: 379171 - DNA, 25 bp, Mus musculus
tggactcaagcggatagccaaggaa

SEQ ID NO: 379172 - DNA, 25 bp, Mus musculus
tggactcaagctctcttgagtcatg

SEQ ID NO: 379173 - DNA, 25 bp, Mus musculus
tggactcaatcagaggtgcttctta

SEQ ID NO: 379174 - DNA, 25 bp, Mus musculus
tggactcaatgcgatctggttctac

SEQ ID NO: 379175 - DNA, 25 bp, Mus musculus
tggactcatctaaggaattagctga

SEQ ID NO: 379176 - DNA, 25 bp, Mus musculus
tggactcatgagagcaaagaccatg

SEQ ID NO: 379177 - DNA, 25 bp, Mus musculus
tggactccaccacagatgaagaaga

SEQ ID NO: 379178 - DNA, 25 bp, Mus musculus
tggactccacgtggaacttaggcaa

SEQ ID NO: 379179 - DNA, 25 bp, Mus musculus
tggactccagggctgacagcttcga

SEQ ID NO: 379180 - DNA, 25 bp, Mus musculus
tggactcccacagccagcgtttccc

SEQ ID NO: 379181 - DNA, 25 bp, Mus musculus
tggactcccgggagatgcagcttca

SEQ ID NO: 379182 - DNA, 25 bp, Mus musculus
tggactcccgggaggctcaccatca

SEQ ID NO: 379183 - DNA, 25 bp, Mus musculus
tggactccggaggaacctggctcac

SEQ ID NO: 379184 - DNA, 25 bp, Mus musculus
tggactcctaggagggagcctccct

SEQ ID NO: 379185 - DNA, 25 bp, Mus musculus
tggactcgacagtgttagcaacaag

SEQ ID NO: 379186 - DNA, 25 bp, Mus musculus
tggactcgagctcagagctctggtg

SEQ ID NO: 379187 - DNA, 25 bp, Mus musculus
tggactcgagtgtgacagttgtgat

SEQ ID NO: 379188 - DNA, 25 bp, Mus musculus
tggactcgcagaaagaagctctaca

SEQ ID NO: 379189 - DNA, 25 bp, Mus musculus
tggactctaaactggtcagcctgct

SEQ ID NO: 379190 - DNA, 25 bp, Mus musculus
tggactctacaggagagtattgtct

SEQ ID NO: 379191 - DNA, 25 bp, Mus musculus
tggactctactgtgaggtctacatc

SEQ ID NO: 379192 - DNA, 25 bp, Mus musculus
tggactctcaggttgtgaggactga

SEQ ID NO: 379193 - DNA, 25 bp, Mus musculus
tggactctctcaaaccccttatccc

SEQ ID NO: 379194 - DNA, 25 bp, Mus musculus
tggactctctgaagagcactctggc

SEQ ID NO: 379195 - DNA, 25 bp, Mus musculus
tggactgaagatctctctgaaacaa

SEQ ID NO: 379196 - DNA, 25 bp, Mus musculus
tggactgaaggacgcagatagagct

SEQ ID NO: 379197 - DNA, 25 bp, Mus musculus
tggactgaaggtacgcagggaatac

SEQ ID NO: 379198 - DNA, 25 bp, Mus musculus
tggactgacgcagatgaagagctag

SEQ ID NO: 379199 - DNA, 25 bp, Mus musculus
tggactgatgggaaggaggccatgc

SEQ ID NO: 379200 - DNA, 25 bp, Mus musculus
tggactgcagactgccgaatacacc

SEQ ID NO: 379201 - DNA, 25 bp, Mus musculus
tggactgcagactggcatccgtctc

SEQ ID NO: 379202 - DNA, 25 bp, Mus musculus
tggactgcagaggccacttcttcag

SEQ ID NO: 379203 - DNA, 25 bp, Mus musculus
tggactgcagcctaaatggcaaaat

SEQ ID NO: 379204 - DNA, 25 bp, Mus musculus
tggactgcagcctcttttatgaaac

SEQ ID NO: 379205 - DNA, 25 bp, Mus musculus
tggactgccagggtcacgtggtact

SEQ ID NO: 379206 - DNA, 25 bp, Mus musculus
tggactgccagtacttggctccaga

SEQ ID NO: 379207 - DNA, 25 bp, Mus musculus
tggactgcctgaacagggacaacta

SEQ ID NO: 379208 - DNA, 25 bp, Mus musculus
tggactgcgccatctctgtctgccc

SEQ ID NO: 379209 - DNA, 25 bp, Mus musculus
tggactgctggcctggtagaggaga

SEQ ID NO: 379210 - DNA, 25 bp, Mus musculus
tggactgctgtaagtgtggacattc

SEQ ID NO: 379211 - DNA, 25 bp, Mus musculus
tggactgctgtcaatgggagccggt

SEQ ID NO: 379212 - DNA, 25 bp, Mus musculus
tggactggaaaacagtgaaggccca

SEQ ID NO: 379213 - DNA, 25 bp, Mus musculus
tggactggaaaggtggtctacttct

SEQ ID NO: 379214 - DNA, 25 bp, Mus musculus
tggactggaaaggttggtttcttca

SEQ ID NO: 379215 - DNA, 25 bp, Mus musculus
tggactggaaggaaatctacaagcg

SEQ ID NO: 379216 - DNA, 25 bp, Mus musculus
tggactggagtgagtcagcagtgta

SEQ ID NO: 379217 - DNA, 25 bp, Mus musculus
tggactggattctcggagagtcctt

SEQ ID NO: 379218 - DNA, 25 bp, Mus musculus
tggactggattctcggtgggagcca

SEQ ID NO: 379219 - DNA, 25 bp, Mus musculus
tggactggcaaatcaccccttttcc

SEQ ID NO: 379220 - DNA, 25 bp, Mus musculus
tggactggccgcaggaagctaagca

SEQ ID NO: 379221 - DNA, 25 bp, Mus musculus
tggactggccgcagggtacattcgc

SEQ ID NO: 379222 - DNA, 25 bp, Mus musculus
tggactgggaggtaggggtccatgg

SEQ ID NO: 379223 - DNA, 25 bp, Mus musculus
tggactggtttggtgttcatcatgg

SEQ ID NO: 379224 - DNA, 25 bp, Mus musculus
tggactgtaccgaggtctgatccca

SEQ ID NO: 379225 - DNA, 25 bp, Mus musculus
tggactgtatcaagcaatgtgaccc

SEQ ID NO: 379226 - DNA, 25 bp, Mus musculus
tggactgtcagactgctgggctgat

SEQ ID NO: 379227 - DNA, 25 bp, Mus musculus
tggactgtcaggattctctttcaaa

SEQ ID NO: 379228 - DNA, 25 bp, Mus musculus
tggactgtctggaaggtcgctgtgc

SEQ ID NO: 379229 - DNA, 25 bp, Mus musculus
tggactgtgatgggtgtacaataga

SEQ ID NO: 379230 - DNA, 25 bp, Mus musculus
tggactgtgcaaggaagatctggag

SEQ ID NO: 379231 - DNA, 25 bp, Mus musculus
tggactgtgtgtctggcgtgtgtgt

SEQ ID NO: 379232 - DNA, 25 bp, Mus musculus
tggactgttaggaacagcctcaggc

SEQ ID NO: 379233 - DNA, 25 bp, Mus musculus
tggacttaaaggtgcctggaagaat

SEQ ID NO: 379234 - DNA, 25 bp, Mus musculus
tggacttaagaacttttcctatttg

SEQ ID NO: 379235 - DNA, 25 bp, Mus musculus
tggacttaagaccatgctcgcattc

SEQ ID NO: 379236 - DNA, 25 bp, Mus musculus
tggacttacaggtactatgggttgt

SEQ ID NO: 379237 - DNA, 25 bp, Mus musculus
tggacttagagcatcactcttacag

SEQ ID NO: 379238 - DNA, 25 bp, Mus musculus
tggacttcagaaatgggacactaca

SEQ ID NO: 379239 - DNA, 25 bp, Mus musculus
tggacttcagaaattgtgaaggttc

SEQ ID NO: 379240 - DNA, 25 bp, Mus musculus
tggacttcagaaccagcagctgctg

SEQ ID NO: 379241 - DNA, 25 bp, Mus musculus
tggacttcgacaggggaatctggtc

SEQ ID NO: 379242 - DNA, 25 bp, Mus musculus
tggacttcgaggacgattacgtgca

SEQ ID NO: 379243 - DNA, 25 bp, Mus musculus
tggacttctatgtggtgctgggtag

SEQ ID NO: 379244 - DNA, 25 bp, Mus musculus
tggacttgcaagctctttacagttt

SEQ ID NO: 379245 - DNA, 25 bp, Mus musculus
tggacttgcaagtctctttacagaa

SEQ ID NO: 379246 - DNA, 25 bp, Mus musculus
tggacttgctgtaggttatgatgag

SEQ ID NO: 379247 - DNA, 25 bp, Mus musculus
tggactttcaagatgacgggacgac

SEQ ID NO: 379248 - DNA, 25 bp, Mus musculus
tggactttcaagcctatgtgtttcg

SEQ ID NO: 379249 - DNA, 25 bp, Mus musculus
tggactttctcagatcgtttaggaa

SEQ ID NO: 379250 - DNA, 25 bp, Mus musculus
tggactttctcaggagtctcatgaa

SEQ ID NO: 379251 - DNA, 25 bp, Mus musculus
tggactttgaagctgttaagaagaa

SEQ ID NO: 379252 - DNA, 25 bp, Mus musculus
tggactttgcaaggcagtactacga

SEQ ID NO: 379253 - DNA, 25 bp, Mus musculus
tggactttggaggacagaaaaatgg

SEQ ID NO: 379254 - DNA, 25 bp, Mus musculus
tggactttggagtctgaatatgcag

SEQ ID NO: 379255 - DNA, 25 bp, Mus musculus
tggactttttgatcgatgatgaaaa

SEQ ID NO: 379256 - DNA, 25 bp, Mus musculus
tggagaaaaacagtaccaaggagtt

SEQ ID NO: 379257 - DNA, 25 bp, Mus musculus
tggagaaaaacgaaaatcttcaagc

SEQ ID NO: 379258 - DNA, 25 bp, Mus musculus
tggagaaaaaggggaccatggcctt

SEQ ID NO: 379259 - DNA, 25 bp, Mus musculus
tggagaaaacctgaagactgagcag

SEQ ID NO: 379260 - DNA, 25 bp, Mus musculus
tggagaaaagagaatattttccaga

SEQ ID NO: 379261 - DNA, 25 bp, Mus musculus
tggagaaaagaggaatattagttag

SEQ ID NO: 379262 - DNA, 25 bp, Mus musculus
tggagaaaagggtgaacctggtcct

SEQ ID NO: 379263 - DNA, 25 bp, Mus musculus
tggagaaaatcttggaccttcctgg

SEQ ID NO: 379264 - DNA, 25 bp, Mus musculus
tggagaaaattagagccccttccaa

SEQ ID NO: 379265 - DNA, 25 bp, Mus musculus
tggagaaacagggtcatgatggtgg

SEQ ID NO: 379266 - DNA, 25 bp, Mus musculus
tggagaaacaggtcttgtccatgga

SEQ ID NO: 379267 - DNA, 25 bp, Mus musculus
tggagaaagagaacgcctcaaagag

SEQ ID NO: 379268 - DNA, 25 bp, Mus musculus
tggagaaagagaacggccctaccca

SEQ ID NO: 379269 - DNA, 25 bp, Mus musculus
tggagaaagaggctgccactcgctg

SEQ ID NO: 379270 - DNA, 25 bp, Mus musculus
tggagaaagaggtggaggtgattgg

SEQ ID NO: 379271 - DNA, 25 bp, Mus musculus
tggagaaagagtggaggtgattggg

SEQ ID NO: 379272 - DNA, 25 bp, Mus musculus
tggagaaatatgaggaacacatcaa

SEQ ID NO: 379273 - DNA, 25 bp, Mus musculus
tggagaaatatgagtggttccatgt

SEQ ID NO: 379274 - DNA, 25 bp, Mus musculus
tggagaaatcattcagtctgtgtat

SEQ ID NO: 379275 - DNA, 25 bp, Mus musculus
tggagaaatttggaggaattgatat

SEQ ID NO: 379276 - DNA, 25 bp, Mus musculus
tggagaacagcgaagccttggagct

SEQ ID NO: 379277 - DNA, 25 bp, Mus musculus
tggagaacaggatgaagaagagaag

SEQ ID NO: 379278 - DNA, 25 bp, Mus musculus
tggagaacaggtgagtgaaatcctc

SEQ ID NO: 379279 - DNA, 25 bp, Mus musculus
tggagaacaggtgcttttacaactc

SEQ ID NO: 379280 - DNA, 25 bp, Mus musculus
tggagaacatgattaatgacttcca

SEQ ID NO: 379281 - DNA, 25 bp, Mus musculus
tggagaacatggaggttgctatcgg

SEQ ID NO: 379282 - DNA, 25 bp, Mus musculus
tggagaacgagagtctccatcatcc

SEQ ID NO: 379283 - DNA, 25 bp, Mus musculus
tggagaacgagcctggaattgtgtc

SEQ ID NO: 379284 - DNA, 25 bp, Mus musculus
tggagaacggggaagtctaggaccc

SEQ ID NO: 379285 - DNA, 25 bp, Mus musculus
tggagaacggggtgaccgtggagac

SEQ ID NO: 379286 - DNA, 25 bp, Mus musculus
tggagaactccaaggtcctaggtga

SEQ ID NO: 379287 - DNA, 25 bp, Mus musculus
tggagaactccagggaggtcctgat

SEQ ID NO: 379288 - DNA, 25 bp, Mus musculus
tggagaactccaggtctttccagca

SEQ ID NO: 379289 - DNA, 25 bp, Mus musculus
tggagaactgccccaccattctcca

SEQ ID NO: 379290 - DNA, 25 bp, Mus musculus
tggagaacttcttaacatatgacat

SEQ ID NO: 379291 - DNA, 25 bp, Mus musculus
tggagaagaagaagtatgaacgagg

SEQ ID NO: 379292 - DNA, 25 bp, Mus musculus
tggagaagaagcacaagcttctggc

SEQ ID NO: 379293 - DNA, 25 bp, Mus musculus
tggagaagaagcaggaattcttagg

SEQ ID NO: 379294 - DNA, 25 bp, Mus musculus
tggagaagacaagtccatctaccgc

SEQ ID NO: 379295 - DNA, 25 bp, Mus musculus
tggagaagacctgtgccgtgtgacg

SEQ ID NO: 379296 - DNA, 25 bp, Mus musculus
tggagaagactacagatgggcagca

SEQ ID NO: 379297 - DNA, 25 bp, Mus musculus
tggagaagactacaggacctgcagg

SEQ ID NO: 379298 - DNA, 25 bp, Mus musculus
tggagaagactgcggttctacgggt

SEQ ID NO: 379299 - DNA, 25 bp, Mus musculus
tggagaagagaaaggtctgtatcca

SEQ ID NO: 379300 - DNA, 25 bp, Mus musculus
tggagaagagatgctggtccctttt

SEQ ID NO: 379301 - DNA, 25 bp, Mus musculus
tggagaagagcagtacactaggtac

SEQ ID NO: 379302 - DNA, 25 bp, Mus musculus
tggagaagaggatgcccctgtggaa

SEQ ID NO: 379303 - DNA, 25 bp, Mus musculus
tggagaagatggttccatatctgca

SEQ ID NO: 379304 - DNA, 25 bp, Mus musculus
tggagaaggaacggaggaagatgac

SEQ ID NO: 379305 - DNA, 25 bp, Mus musculus
tggagaaggccagacccccatcccg

SEQ ID NO: 379306 - DNA, 25 bp, Mus musculus
tggagaaggccagggtagacagcaa

SEQ ID NO: 379307 - DNA, 25 bp, Mus musculus
tggagaagtgcacgtaagttcatat

SEQ ID NO: 379308 - DNA, 25 bp, Mus musculus
tggagaataagcgtgaagtgcagcc

SEQ ID NO: 379309 - DNA, 25 bp, Mus musculus
tggagaataagtggtacagggtact

SEQ ID NO: 379310 - DNA, 25 bp, Mus musculus
tggagaatatccggagacaaaccct

SEQ ID NO: 379311 - DNA, 25 bp, Mus musculus
tggagaatccgaggccacaggcctc

SEQ ID NO: 379312 - DNA, 25 bp, Mus musculus
tggagaatctagaggtgaacgagat

SEQ ID NO: 379313 - DNA, 25 bp, Mus musculus
tggagaatgaagatgctgggttttc

SEQ ID NO: 379314 - DNA, 25 bp, Mus musculus
tggagaatggagttggctctgctct

SEQ ID NO: 379315 - DNA, 25 bp, Mus musculus
tggagaatgtcagattccagattac

SEQ ID NO: 379316 - DNA, 25 bp, Mus musculus
tggagaatgtgctagagatcaataa

SEQ ID NO: 379317 - DNA, 25 bp, Mus musculus
tggagaatgtgggctcatggcagat

SEQ ID NO: 379318 - DNA, 25 bp, Mus musculus
tggagaattacaagtgtgaagtagt

SEQ ID NO: 379319 - DNA, 25 bp, Mus musculus
tggagaattacagtactgtttatca

SEQ ID NO: 379320 - DNA, 25 bp, Mus musculus
tggagaatttctcaaagtgcaacag

SEQ ID NO: 379321 - DNA, 25 bp, Mus musculus
tggagaatttctgaaagtgcaacag

SEQ ID NO: 379322 - DNA, 25 bp, Mus musculus
tggagaattttctgggggtcccaca

SEQ ID NO: 379323 - DNA, 25 bp, Mus musculus
tggagacaaaattgcaatgcatgaa

SEQ ID NO: 379324 - DNA, 25 bp, Mus musculus
tggagacaaaattgtagaagaaccc

SEQ ID NO: 379325 - DNA, 25 bp, Mus musculus
tggagacaacggaaagacgatgctc

SEQ ID NO: 379326 - DNA, 25 bp, Mus musculus
tggagacaagctacgcatggagtac

SEQ ID NO: 379327 - DNA, 25 bp, Mus musculus
tggagacaaggaacatggaatacct

SEQ ID NO: 379328 - DNA, 25 bp, Mus musculus
tggagacaaggagtttttgggtaac

SEQ ID NO: 379329 - DNA, 25 bp, Mus musculus
tggagacaagtagtcttttacagaa

SEQ ID NO: 379330 - DNA, 25 bp, Mus musculus
tggagacaatggtctgtgggagccc

SEQ ID NO: 379331 - DNA, 25 bp, Mus musculus
tggagacacagacgctgttccggcg

SEQ ID NO: 379332 - DNA, 25 bp, Mus musculus
tggagacacagcatcttgcagcccc

SEQ ID NO: 379333 - DNA, 25 bp, Mus musculus
tggagacacagcctctgccaagcag

SEQ ID NO: 379334 - DNA, 25 bp, Mus musculus
tggagacaccttcaggtggaaggga

SEQ ID NO: 379335 - DNA, 25 bp, Mus musculus
tggagacactagacctgaactataa

SEQ ID NO: 379336 - DNA, 25 bp, Mus musculus
tggagacagaaaagaatgcagtcac

SEQ ID NO: 379337 - DNA, 25 bp, Mus musculus
tggagacagagcagacgatttacat

SEQ ID NO: 379338 - DNA, 25 bp, Mus musculus
tggagacagaggaggtggtcctggg

SEQ ID NO: 379339 - DNA, 25 bp, Mus musculus
tggagacagagtggtgattagaaat

SEQ ID NO: 379340 - DNA, 25 bp, Mus musculus
tggagacagcaggcacaccaagatg

SEQ ID NO: 379341 - DNA, 25 bp, Mus musculus
tggagacagcccacaggatgactca

SEQ ID NO: 379342 - DNA, 25 bp, Mus musculus
tggagacatcaagagttctaacgtg

SEQ ID NO: 379343 - DNA, 25 bp, Mus musculus
tggagacatgagcagctactccatc

SEQ ID NO: 379344 - DNA, 25 bp, Mus musculus
tggagacatgaggaactcagccacc

SEQ ID NO: 379345 - DNA, 25 bp, Mus musculus
tggagacatgagggctcatccgctc

SEQ ID NO: 379346 - DNA, 25 bp, Mus musculus
tggagacatgagtctaaggttgtgg

SEQ ID NO: 379347 - DNA, 25 bp, Mus musculus
tggagaccaacagacctgatagcaa

SEQ ID NO: 379348 - DNA, 25 bp, Mus musculus
tggagaccaacagcaagaactggca

SEQ ID NO: 379349 - DNA, 25 bp, Mus musculus
tggagaccacttgccatgcataatc

SEQ ID NO: 379350 - DNA, 25 bp, Mus musculus
tggagaccagcagcccagagtatgt

SEQ ID NO: 379351 - DNA, 25 bp, Mus musculus
tggagaccagcatgattgggctgat

SEQ ID NO: 379352 - DNA, 25 bp, Mus musculus
tggagaccaggttctctgccaacca

SEQ ID NO: 379353 - DNA, 25 bp, Mus musculus
tggagaccataggacaaggatgaga

SEQ ID NO: 379354 - DNA, 25 bp, Mus musculus
tggagacccaggagggtgtctccaa

SEQ ID NO: 379355 - DNA, 25 bp, Mus musculus
tggagacccaggtgataactcccta

SEQ ID NO: 379356 - DNA, 25 bp, Mus musculus
tggagacccattgtgccccaattcc

SEQ ID NO: 379357 - DNA, 25 bp, Mus musculus
tggagaccccagcaccacatctgcc

SEQ ID NO: 379358 - DNA, 25 bp, Mus musculus
tggagacccggatgggagccaggag

SEQ ID NO: 379359 - DNA, 25 bp, Mus musculus
tggagacccgggaccgggagctgct

SEQ ID NO: 379360 - DNA, 25 bp, Mus musculus
tggagaccctgagggagcgcttcag

SEQ ID NO: 379361 - DNA, 25 bp, Mus musculus
tggagaccggtggaggatctggaga

SEQ ID NO: 379362 - DNA, 25 bp, Mus musculus
tggagacctggaggatccccaggac

SEQ ID NO: 379363 - DNA, 25 bp, Mus musculus
tggagacctggccaaccgctgcaag

SEQ ID NO: 379364 - DNA, 25 bp, Mus musculus
tggagacctggtacggagcagagca

SEQ ID NO: 379365 - DNA, 25 bp, Mus musculus
tggagacgagagctggcattcctac

SEQ ID NO: 379366 - DNA, 25 bp, Mus musculus
tggagacgagggctcttgtgttaag

SEQ ID NO: 379367 - DNA, 25 bp, Mus musculus
tggagacgctcaaatcatgcactct

SEQ ID NO: 379368 - DNA, 25 bp, Mus musculus
tggagacgctcaacttgtcccaaaa

SEQ ID NO: 379369 - DNA, 25 bp, Mus musculus
tggagacggaaaagtgtcattggtc

SEQ ID NO: 379370 - DNA, 25 bp, Mus musculus
tggagacggattcctcctcaagtac

SEQ ID NO: 379371 - DNA, 25 bp, Mus musculus
tggagacggattcctggtgggtatt

SEQ ID NO: 379372 - DNA, 25 bp, Mus musculus
tggagactcaaactgaagtgagtag

SEQ ID NO: 379373 - DNA, 25 bp, Mus musculus
tggagactcagcaggtgatgaggaa

SEQ ID NO: 379374 - DNA, 25 bp, Mus musculus
tggagactccaagggctactacatg

SEQ ID NO: 379375 - DNA, 25 bp, Mus musculus
tggagagaaagacggtcgctgagtg

SEQ ID NO: 379376 - DNA, 25 bp, Mus musculus
tggagagaaagtttgctcttcaaaa

SEQ ID NO: 379377 - DNA, 25 bp, Mus musculus
tggagagaagcaaatttccattgat

SEQ ID NO: 379378 - DNA, 25 bp, Mus musculus
tggagagaagcaggagcttgaacca

SEQ ID NO: 379379 - DNA, 25 bp, Mus musculus
tggagagaagcaggaggatcatgcg

SEQ ID NO: 379380 - DNA, 25 bp, Mus musculus
tggagagaaggataaaggggagtgg

SEQ ID NO: 379381 - DNA, 25 bp, Mus musculus
tggagagaaggcctgcctgcctaca

SEQ ID NO: 379382 - DNA, 25 bp, Mus musculus
tggagagaagggctattggcttact

SEQ ID NO: 379383 - DNA, 25 bp, Mus musculus
tggagagaaggtcatttgagaccct

SEQ ID NO: 379384 - DNA, 25 bp, Mus musculus
tggagagaatcctgcgttttctgga

SEQ ID NO: 379385 - DNA, 25 bp, Mus musculus
tggagagacagaacaaggatttgaa

SEQ ID NO: 379386 - DNA, 25 bp, Mus musculus
tggagagactgctgactcgatacca

SEQ ID NO: 379387 - DNA, 25 bp, Mus musculus
tggagagagaggtgctcctggcaac

SEQ ID NO: 379388 - DNA, 25 bp, Mus musculus
tggagagagccaagagcgccttgct

SEQ ID NO: 379389 - DNA, 25 bp, Mus musculus
tggagagaggaaaaggcatttatat

SEQ ID NO: 379390 - DNA, 25 bp, Mus musculus
tggagagaggcaaactgctccacaa

SEQ ID NO: 379391 - DNA, 25 bp, Mus musculus
tggagagatacagaatgaatgaaga

SEQ ID NO: 379392 - DNA, 25 bp, Mus musculus
tggagagatacagagcactggtgaa

SEQ ID NO: 379393 - DNA, 25 bp, Mus musculus
tggagagatcttgtggcgccatgtt

SEQ ID NO: 379394 - DNA, 25 bp, Mus musculus
tggagagatgaaggatgatgaggaa

SEQ ID NO: 379395 - DNA, 25 bp, Mus musculus
tggagagatgagcaagttctatagt

SEQ ID NO: 379396 - DNA, 25 bp, Mus musculus
tggagagcaaagaaccccagctgaa

SEQ ID NO: 379397 - DNA, 25 bp, Mus musculus
tggagagcaaggacgaagaggatga

SEQ ID NO: 379398 - DNA, 25 bp, Mus musculus
tggagagcaaggtcgaagaggatga

SEQ ID NO: 379399 - DNA, 25 bp, Mus musculus
tggagagcaatatggtacctcacac

SEQ ID NO: 379400 - DNA, 25 bp, Mus musculus
tggagagcacaggattcagtaacct

SEQ ID NO: 379401 - DNA, 25 bp, Mus musculus
tggagagcagattgaaggtgctcca

SEQ ID NO: 379402 - DNA, 25 bp, Mus musculus
tggagagccagaagtacctgcactg

SEQ ID NO: 379403 - DNA, 25 bp, Mus musculus
tggagagcgagctgcagcgactccg

SEQ ID NO: 379404 - DNA, 25 bp, Mus musculus
tggagagctgtgtggctgagcagca

SEQ ID NO: 379405 - DNA, 25 bp, Mus musculus
tggagaggaaaaagagagaaaagga

SEQ ID NO: 379406 - DNA, 25 bp, Mus musculus
tggagaggaaacgatcctggggcag

SEQ ID NO: 379407 - DNA, 25 bp, Mus musculus
tggagaggaagaagcgacttgaaga

SEQ ID NO: 379408 - DNA, 25 bp, Mus musculus
tggagaggaaggcacagagaactga

SEQ ID NO: 379409 - DNA, 25 bp, Mus musculus
tggagaggaaggcgcgggctgggag

SEQ ID NO: 379410 - DNA, 25 bp, Mus musculus
tggagaggacagaagagtgtgtttg

SEQ ID NO: 379411 - DNA, 25 bp, Mus musculus
tggagaggagctctcctatgtggat

SEQ ID NO: 379412 - DNA, 25 bp, Mus musculus
tggagaggagggtctagagacatgt

SEQ ID NO: 379413 - DNA, 25 bp, Mus musculus
tggagaggaggtcttcttctccggg

SEQ ID NO: 379414 - DNA, 25 bp, Mus musculus
tggagaggatcgcccccaccccgca

SEQ ID NO: 379415 - DNA, 25 bp, Mus musculus
tggagaggatgaggaagccatggca

SEQ ID NO: 379416 - DNA, 25 bp, Mus musculus
tggagaggcagagatggacttcctg

SEQ ID NO: 379417 - DNA, 25 bp, Mus musculus
tggagagggaggggctctgcctcct

SEQ ID NO: 379418 - DNA, 25 bp, Mus musculus
tggagagggcagcggccgtctgggc

SEQ ID NO: 379419 - DNA, 25 bp, Mus musculus
tggagagggcagcggttccttcctc

SEQ ID NO: 379420 - DNA, 25 bp, Mus musculus
tggagagggcggaaggccaccaggc

SEQ ID NO: 379421 - DNA, 25 bp, Mus musculus
tggagaggtaatgcctgtggtcgtc

SEQ ID NO: 379422 - DNA, 25 bp, Mus musculus
tggagaggttccagatggagctgaa

SEQ ID NO: 379423 - DNA, 25 bp, Mus musculus
tggagaggttccagttaccagtaag

SEQ ID NO: 379424 - DNA, 25 bp, Mus musculus
tggagagtaaaaaagaatgcactgc

SEQ ID NO: 379425 - DNA, 25 bp, Mus musculus
tggagagtggatggcaggagaactg

SEQ ID NO: 379426 - DNA, 25 bp, Mus musculus
tggagataaacgaaattaggtccag

SEQ ID NO: 379427 - DNA, 25 bp, Mus musculus
tggagataaacgagtgtgcaactgc

SEQ ID NO: 379428 - DNA, 25 bp, Mus musculus
tggagataccaggcacaatcacttc

SEQ ID NO: 379429 - DNA, 25 bp, Mus musculus
tggagatacccagagccctgcaact

SEQ ID NO: 379430 - DNA, 25 bp, Mus musculus
tggagatagccaatgagatagatgg

SEQ ID NO: 379431 - DNA, 25 bp, Mus musculus
tggagatagtcgggcaatcctgtgt

SEQ ID NO: 379432 - DNA, 25 bp, Mus musculus
tggagatatgagacgaaagtaggtg

SEQ ID NO: 379433 - DNA, 25 bp, Mus musculus
tggagatatgaggtactccatccgc

SEQ ID NO: 379434 - DNA, 25 bp, Mus musculus
tggagatcaaaatggctcgcgctgt

SEQ ID NO: 379435 - DNA, 25 bp, Mus musculus
tggagatcagcagagaactactttc

SEQ ID NO: 379436 - DNA, 25 bp, Mus musculus
tggagatcaggaggcgccagctgac

SEQ ID NO: 379437 - DNA, 25 bp, Mus musculus
tggagatcaggattgacttgtggaa

SEQ ID NO: 379438 - DNA, 25 bp, Mus musculus
tggagatcaggttcaatgctccctt

SEQ ID NO: 379439 - DNA, 25 bp, Mus musculus
tggagatccagctgatggtagaaga

SEQ ID NO: 379440 - DNA, 25 bp, Mus musculus
tggagatccaggcttccgtggggcc

SEQ ID NO: 379441 - DNA, 25 bp, Mus musculus
tggagatccagtgtcctgagcaagt

SEQ ID NO: 379442 - DNA, 25 bp, Mus musculus
tggagatcgatgagctatgtgccac

SEQ ID NO: 379443 - DNA, 25 bp, Mus musculus
tggagatcgatgaggaagggaacct

SEQ ID NO: 379444 - DNA, 25 bp, Mus musculus
tggagatctaccagcaaaatcttgc

SEQ ID NO: 379445 - DNA, 25 bp, Mus musculus
tggagatctaccagggatgagtttg

SEQ ID NO: 379446 - DNA, 25 bp, Mus musculus
tggagatctcaaagggggaaaaacc

SEQ ID NO: 379447 - DNA, 25 bp, Mus musculus
tggagatctgagcacagccagcgtg

SEQ ID NO: 379448 - DNA, 25 bp, Mus musculus
tggagatctgagccatggatttccc

SEQ ID NO: 379449 - DNA, 25 bp, Mus musculus
tggagatgaaactgctgccacaggt

SEQ ID NO: 379450 - DNA, 25 bp, Mus musculus
tggagatgaagtgacttcaatcccc

SEQ ID NO: 379451 - DNA, 25 bp, Mus musculus
tggagatgaagtgatgactcgttgg

SEQ ID NO: 379452 - DNA, 25 bp, Mus musculus
tggagatgacatgtttcattggcaa

SEQ ID NO: 379453 - DNA, 25 bp, Mus musculus
tggagatgagaaataaagatttcag

SEQ ID NO: 379454 - DNA, 25 bp, Mus musculus
tggagatgagtcaagattactatga

SEQ ID NO: 379455 - DNA, 25 bp, Mus musculus
tggagatgagtcaagccgagatgac

SEQ ID NO: 379456 - DNA, 25 bp, Mus musculus
tggagatgagtcacagcccagcaca

SEQ ID NO: 379457 - DNA, 25 bp, Mus musculus
tggagatgcaaggagagtctcttcc

SEQ ID NO: 379458 - DNA, 25 bp, Mus musculus
tggagatgcagatggtgaaagtgat

SEQ ID NO: 379459 - DNA, 25 bp, Mus musculus
tggagatgccacagcccgtgttcct

SEQ ID NO: 379460 - DNA, 25 bp, Mus musculus
tggagatgccacagctcccaacccc

SEQ ID NO: 379461 - DNA, 25 bp, Mus musculus
tggagatgcttcagattctgaaggg

SEQ ID NO: 379462 - DNA, 25 bp, Mus musculus
tggagatgcttcaggactctctgat

SEQ ID NO: 379463 - DNA, 25 bp, Mus musculus
tggagatggaagtgtaaatggcatt

SEQ ID NO: 379464 - DNA, 25 bp, Mus musculus
tggagatggacctcctctggtaaag

SEQ ID NO: 379465 - DNA, 25 bp, Mus musculus
tggagatggacggaatgggcaccac

SEQ ID NO: 379466 - DNA, 25 bp, Mus musculus
tggagatggcagttccctccaggct

SEQ ID NO: 379467 - DNA, 25 bp, Mus musculus
tggagatgggatgcctggattctgc

SEQ ID NO: 379468 - DNA, 25 bp, Mus musculus
tggagatggtcaagcaagaagcgaa

SEQ ID NO: 379469 - DNA, 25 bp, Mus musculus
tggagatgtatcagattcagctact

SEQ ID NO: 379470 - DNA, 25 bp, Mus musculus
tggagatgtggctcaccatgcctac

SEQ ID NO: 379471 - DNA, 25 bp, Mus musculus
tggagatgtgggctgcgacccaata

SEQ ID NO: 379472 - DNA, 25 bp, Mus musculus
tggagatgtgtccagaccttttagc

SEQ ID NO: 379473 - DNA, 25 bp, Mus musculus
tggagattaaagtaattggcaactg

SEQ ID NO: 379474 - DNA, 25 bp, Mus musculus
tggagattcattgaattctgtcttt

SEQ ID NO: 379475 - DNA, 25 bp, Mus musculus
tggagattccagcaattcctggagt

SEQ ID NO: 379476 - DNA, 25 bp, Mus musculus
tggagattccaggaagcccctgagg

SEQ ID NO: 379477 - DNA, 25 bp, Mus musculus
tggagcaaaaaatgggctacacata

SEQ ID NO: 379478 - DNA, 25 bp, Mus musculus
tggagcaaaagtatgaattaggggc

SEQ ID NO: 379479 - DNA, 25 bp, Mus musculus
tggagcaaagaactgagattgcacc

SEQ ID NO: 379480 - DNA, 25 bp, Mus musculus
tggagcaaagattgcgccaggctga

SEQ ID NO: 379481 - DNA, 25 bp, Mus musculus
tggagcaaaggcaccatcggtttca

SEQ ID NO: 379482 - DNA, 25 bp, Mus musculus
tggagcaaagtgaaaaagatttggt

SEQ ID NO: 379483 - DNA, 25 bp, Mus musculus
tggagcaacaaggggaaagcgagag

SEQ ID NO: 379484 - DNA, 25 bp, Mus musculus
tggagcaacaagtccgtgcactgga

SEQ ID NO: 379485 - DNA, 25 bp, Mus musculus
tggagcaaggcatggaactcagtgg

SEQ ID NO: 379486 - DNA, 25 bp, Mus musculus
tggagcaaggtgaccatgctgcttg

SEQ ID NO: 379487 - DNA, 25 bp, Mus musculus
tggagcaaggtgacgatgctgcttg

SEQ ID NO: 379488 - DNA, 25 bp, Mus musculus
tggagcaaggtggccctgacaagtg

SEQ ID NO: 379489 - DNA, 25 bp, Mus musculus
tggagcaagtgatgacagactctgg

SEQ ID NO: 379490 - DNA, 25 bp, Mus musculus
tggagcacagtaaaggtctgtggag

SEQ ID NO: 379491 - DNA, 25 bp, Mus musculus
tggagcacatatcgacttggagagc

SEQ ID NO: 379492 - DNA, 25 bp, Mus musculus
tggagcactaatcaggaaaatggca

SEQ ID NO: 379493 - DNA, 25 bp, Mus musculus
tggagcactgaagaggaacctgctt

SEQ ID NO: 379494 - DNA, 25 bp, Mus musculus
tggagcagaagaataaagagataga

SEQ ID NO: 379495 - DNA, 25 bp, Mus musculus
tggagcagaagacaaaagaaattga

SEQ ID NO: 379496 - DNA, 25 bp, Mus musculus
tggagcagaagatctatccctatga

SEQ ID NO: 379497 - DNA, 25 bp, Mus musculus
tggagcagaaggataaacaaaggta

SEQ ID NO: 379498 - DNA, 25 bp, Mus musculus
tggagcagaaggttatgttcttgct

SEQ ID NO: 379499 - DNA, 25 bp, Mus musculus
tggagcagacgcgaaactggatggc

SEQ ID NO: 379500 - DNA, 25 bp, Mus musculus
tggagcagaggatttcagcgtcagg

SEQ ID NO: 379501 - DNA, 25 bp, Mus musculus
tggagcagatatcggcacaacgatg

SEQ ID NO: 379502 - DNA, 25 bp, Mus musculus
tggagcagatgtagttcatcctatc

SEQ ID NO: 379503 - DNA, 25 bp, Mus musculus
tggagcagcaccagaaataccggta

SEQ ID NO: 379504 - DNA, 25 bp, Mus musculus
tggagcagcagcagtaggcactggt

SEQ ID NO: 379505 - DNA, 25 bp, Mus musculus
tggagcagcagcctcagggctggct

SEQ ID NO: 379506 - DNA, 25 bp, Mus musculus
tggagcagcagcttggtctgggaac

SEQ ID NO: 379507 - DNA, 25 bp, Mus musculus
tggagcaggacatgctggcctcaaa

SEQ ID NO: 379508 - DNA, 25 bp, Mus musculus
tggagcaggacatgtttgcacaccc

SEQ ID NO: 379509 - DNA, 25 bp, Mus musculus
tggagcaggtgagggggtcggggtt

SEQ ID NO: 379510 - DNA, 25 bp, Mus musculus
tggagcagtgggagaaagatgatga

SEQ ID NO: 379511 - DNA, 25 bp, Mus musculus
tggagcagttggggaccagagttgg

SEQ ID NO: 379512 - DNA, 25 bp, Mus musculus
tggagcatcagctgctgacctgata

SEQ ID NO: 379513 - DNA, 25 bp, Mus musculus
tggagcatcagctgtggtcctctaa

SEQ ID NO: 379514 - DNA, 25 bp, Mus musculus
tggagcatcccgagatgacacgaat

SEQ ID NO: 379515 - DNA, 25 bp, Mus musculus
tggagcatcccgaggtgtttacaat

SEQ ID NO: 379516 - DNA, 25 bp, Mus musculus
tggagcatcctgccgtggtgaaggc

SEQ ID NO: 379517 - DNA, 25 bp, Mus musculus
tggagcatctcaagaacactcacca

SEQ ID NO: 379518 - DNA, 25 bp, Mus musculus
tggagcatgaagaaaggctacagca

SEQ ID NO: 379519 - DNA, 25 bp, Mus musculus
tggagcatgaagaagcctccaggac

SEQ ID NO: 379520 - DNA, 25 bp, Mus musculus
tggagcatgagagcgtagcaggagt

SEQ ID NO: 379521 - DNA, 25 bp, Mus musculus
tggagcatgaggagtggtggagagc

SEQ ID NO: 379522 - DNA, 25 bp, Mus musculus
tggagccaaacatttctcgggatta

SEQ ID NO: 379523 - DNA, 25 bp, Mus musculus
tggagccaaagaatgaataaaatgg

SEQ ID NO: 379524 - DNA, 25 bp, Mus musculus
tggagccaagagagctgaagcgctg

SEQ ID NO: 379525 - DNA, 25 bp, Mus musculus
tggagccaagatgataaatcatcat

SEQ ID NO: 379526 - DNA, 25 bp, Mus musculus
tggagccacaaactcctgcttcctg

SEQ ID NO: 379527 - DNA, 25 bp, Mus musculus
tggagccacaaattgcggttgccaa

SEQ ID NO: 379528 - DNA, 25 bp, Mus musculus
tggagccacaggatgaaataacagt

SEQ ID NO: 379529 - DNA, 25 bp, Mus musculus
tggagccacaggatgatggcagtga

SEQ ID NO: 379530 - DNA, 25 bp, Mus musculus
tggagccagaagaacagacaaggtg

SEQ ID NO: 379531 - DNA, 25 bp, Mus musculus
tggagccagaaggtttggattcctg

SEQ ID NO: 379532 - DNA, 25 bp, Mus musculus
tggagccagagaacctacaacaact

SEQ ID NO: 379533 - DNA, 25 bp, Mus musculus
tggagccagaggctgcattgtgatc

SEQ ID NO: 379534 - DNA, 25 bp, Mus musculus
tggagccagctatgtggccctagag

SEQ ID NO: 379535 - DNA, 25 bp, Mus musculus
tggagccagctcctgctgctgaaga

SEQ ID NO: 379536 - DNA, 25 bp, Mus musculus
tggagccaggagaaggctgctattt

SEQ ID NO: 379537 - DNA, 25 bp, Mus musculus
tggagccaggagagggctgctattt

SEQ ID NO: 379538 - DNA, 25 bp, Mus musculus
tggagccaggggtcttaccggtcgc

SEQ ID NO: 379539 - DNA, 25 bp, Mus musculus
tggagccatcccaagaccctcctca

SEQ ID NO: 379540 - DNA, 25 bp, Mus musculus
tggagcccaaaaagatggcacttcc

SEQ ID NO: 379541 - DNA, 25 bp, Mus musculus
tggagcccaagtttcagccatggct

SEQ ID NO: 379542 - DNA, 25 bp, Mus musculus
tggagcccacgaaccttcttttaaa

SEQ ID NO: 379543 - DNA, 25 bp, Mus musculus
tggagcccacgagcacccggaggat

SEQ ID NO: 379544 - DNA, 25 bp, Mus musculus
tggagcccacggtgacactgctgag

SEQ ID NO: 379545 - DNA, 25 bp, Mus musculus
tggagcccagaaatgtacggagttt

SEQ ID NO: 379546 - DNA, 25 bp, Mus musculus
tggagcccagaaattatttggtatg

SEQ ID NO: 379547 - DNA, 25 bp, Mus musculus
tggagcccatggaaaagacgaagag

SEQ ID NO: 379548 - DNA, 25 bp, Mus musculus
tggagccccacggatttcagttttt

SEQ ID NO: 379549 - DNA, 25 bp, Mus musculus
tggagcccccaccagcttcccttca

SEQ ID NO: 379550 - DNA, 25 bp, Mus musculus
tggagcccccaccaggcctcggtgt

SEQ ID NO: 379551 - DNA, 25 bp, Mus musculus
tggagccccgagcccttccagcagg

SEQ ID NO: 379552 - DNA, 25 bp, Mus musculus
tggagccccgagctcctctaatttc

SEQ ID NO: 379553 - DNA, 25 bp, Mus musculus
tggagcccctgaaagagatgacatc

SEQ ID NO: 379554 - DNA, 25 bp, Mus musculus
tggagccctgtgcagatttccctca

SEQ ID NO: 379555 - DNA, 25 bp, Mus musculus
tggagccctgtgcagccttgtgaca

SEQ ID NO: 379556 - DNA, 25 bp, Mus musculus
tggagcccttgacgcctccttggca

SEQ ID NO: 379557 - DNA, 25 bp, Mus musculus
tggagccgactgggctgtttccaac

SEQ ID NO: 379558 - DNA, 25 bp, Mus musculus
tggagccgactttgccagtatgtta

SEQ ID NO: 379559 - DNA, 25 bp, Mus musculus
tggagccgcccggaggtgcttgagg

SEQ ID NO: 379560 - DNA, 25 bp, Mus musculus
tggagccgcgtagactttaagaaac

SEQ ID NO: 379561 - DNA, 25 bp, Mus musculus
tggagccgtcgactctcaggtggac

SEQ ID NO: 379562 - DNA, 25 bp, Mus musculus
tggagcctggaatagagcaatcaag

SEQ ID NO: 379563 - DNA, 25 bp, Mus musculus
tggagcctgggaagagaagaaccaa

SEQ ID NO: 379564 - DNA, 25 bp, Mus musculus
tggagcctgggaagctccaggtgcg

SEQ ID NO: 379565 - DNA, 25 bp, Mus musculus
tggagccttcctgagatactgcagc

SEQ ID NO: 379566 - DNA, 25 bp, Mus musculus
tggagcgaatggagggtggagcttt

SEQ ID NO: 379567 - DNA, 25 bp, Mus musculus
tggagcgacaaggtaaaagaagaaa

SEQ ID NO: 379568 - DNA, 25 bp, Mus musculus
tggagcgacaccaggaacaccggac

SEQ ID NO: 379569 - DNA, 25 bp, Mus musculus
tggagcgagcggatttgataatggg

SEQ ID NO: 379570 - DNA, 25 bp, Mus musculus
tggagcgaggaaggcacctgatgca

SEQ ID NO: 379571 - DNA, 25 bp, Mus musculus
tggagcgaggaagggatcgcttaca

SEQ ID NO: 379572 - DNA, 25 bp, Mus musculus
tggagcgatcagaggaacaaggagc

SEQ ID NO: 379573 - DNA, 25 bp, Mus musculus
tggagcgatggttgtcggtgcctgc

SEQ ID NO: 379574 - DNA, 25 bp, Mus musculus
tggagcgatgtacctgacctctgtg

SEQ ID NO: 379575 - DNA, 25 bp, Mus musculus
tggagcgatgtggacagaagtacct

SEQ ID NO: 379576 - DNA, 25 bp, Mus musculus
tggagcgcagtgtgaaactggccca

SEQ ID NO: 379577 - DNA, 25 bp, Mus musculus
tggagcgctacaaagatgagcggga

SEQ ID NO: 379578 - DNA, 25 bp, Mus musculus
tggagcggaagagccccagcgggaa

SEQ ID NO: 379579 - DNA, 25 bp, Mus musculus
tggagcggagcctctctgcctttca

SEQ ID NO: 379580 - DNA, 25 bp, Mus musculus
tggagcggaggtctcattgggagaa

SEQ ID NO: 379581 - DNA, 25 bp, Mus musculus
tggagcggccgtaaggattcacctg

SEQ ID NO: 379582 - DNA, 25 bp, Mus musculus
tggagcggccgtaagtttgctaact

SEQ ID NO: 379583 - DNA, 25 bp, Mus musculus
tggagcggtgtgctcggccatcgac

SEQ ID NO: 379584 - DNA, 25 bp, Mus musculus
tggagcggtgtggtcattgggcttc

SEQ ID NO: 379585 - DNA, 25 bp, Mus musculus
tggagcgtatcccagaacaacctgc

SEQ ID NO: 379586 - DNA, 25 bp, Mus musculus
tggagcgtctggtgctacaagtgtg

SEQ ID NO: 379587 - DNA, 25 bp, Mus musculus
tggagcgtggagaccatcttcaaca

SEQ ID NO: 379588 - DNA, 25 bp, Mus musculus
tggagctaagaacggaaagaccaag

SEQ ID NO: 379589 - DNA, 25 bp, Mus musculus
tggagctacaggctggtaagaacag

SEQ ID NO: 379590 - DNA, 25 bp, Mus musculus
tggagctcaaccacttcggatatca

SEQ ID NO: 379591 - DNA, 25 bp, Mus musculus
tggagctcaaggagtgtctagccca

SEQ ID NO: 379592 - DNA, 25 bp, Mus musculus
tggagctcagcacaggggatgaaca

SEQ ID NO: 379593 - DNA, 25 bp, Mus musculus
tggagctcaggtgcccctgggagca

SEQ ID NO: 379594 - DNA, 25 bp, Mus musculus
tggagctcgaggtaaagaaaacgtg

SEQ ID NO: 379595 - DNA, 25 bp, Mus musculus
tggagctcggcaggcatttcaggga

SEQ ID NO: 379596 - DNA, 25 bp, Mus musculus
tggagctcgttcaagagggagcccg

SEQ ID NO: 379597 - DNA, 25 bp, Mus musculus
tggagctcgttcaagggggcgactt

SEQ ID NO: 379598 - DNA, 25 bp, Mus musculus
tggagctctatggccgagaaccaga

SEQ ID NO: 379599 - DNA, 25 bp, Mus musculus
tggagctctatggccgagaaccata

SEQ ID NO: 379600 - DNA, 25 bp, Mus musculus
tggagctctccgccggctgattatg

SEQ ID NO: 379601 - DNA, 25 bp, Mus musculus
tggagctcttcctgggcggcggcca

SEQ ID NO: 379602 - DNA, 25 bp, Mus musculus
tggagctgagaaccagtcttctggc

SEQ ID NO: 379603 - DNA, 25 bp, Mus musculus
tggagctgagagttcttccagatga

SEQ ID NO: 379604 - DNA, 25 bp, Mus musculus
tggagctgagatgacgttgcaccgt

SEQ ID NO: 379605 - DNA, 25 bp, Mus musculus
tggagctgagcacggagcctggtgg

SEQ ID NO: 379606 - DNA, 25 bp, Mus musculus
tggagctgagctcactccgtgtctt

SEQ ID NO: 379607 - DNA, 25 bp, Mus musculus
tggagctgagggagacgcactactt

SEQ ID NO: 379608 - DNA, 25 bp, Mus musculus
tggagctgatagaaacatctttctc

SEQ ID NO: 379609 - DNA, 25 bp, Mus musculus
tggagctgatggaacacccattctt

SEQ ID NO: 379610 - DNA, 25 bp, Mus musculus
tggagctgcagggatacaaactgca

SEQ ID NO: 379611 - DNA, 25 bp, Mus musculus
tggagctgcagggcctgttgctcaa

SEQ ID NO: 379612 - DNA, 25 bp, Mus musculus
tggagctgcaggggctctgagacag

SEQ ID NO: 379613 - DNA, 25 bp, Mus musculus
tggagctgcaggttcggggtgaagg

SEQ ID NO: 379614 - DNA, 25 bp, Mus musculus
tggagctgccagcatttgacattgt

SEQ ID NO: 379615 - DNA, 25 bp, Mus musculus
tggagctgctgagatcttagcctcc

SEQ ID NO: 379616 - DNA, 25 bp, Mus musculus
tggagctgctgagggagctgaatct

SEQ ID NO: 379617 - DNA, 25 bp, Mus musculus
tggagctgctgggaagatgctacca

SEQ ID NO: 379618 - DNA, 25 bp, Mus musculus
tggagctggaaggtcttgttgcagc

SEQ ID NO: 379619 - DNA, 25 bp, Mus musculus
tggagctggagggctaaaaccgact

SEQ ID NO: 379620 - DNA, 25 bp, Mus musculus
tggagctggccaggactgccgcttc

SEQ ID NO: 379621 - DNA, 25 bp, Mus musculus
tggagctgggaagccctggcacaaa

SEQ ID NO: 379622 - DNA, 25 bp, Mus musculus
tggagctgggacaggtggccctaag

SEQ ID NO: 379623 - DNA, 25 bp, Mus musculus
tggagctgggacgagcggatacggg

SEQ ID NO: 379624 - DNA, 25 bp, Mus musculus
tggagctgtacaaggtgctgagttc

SEQ ID NO: 379625 - DNA, 25 bp, Mus musculus
tggagctgtcaaggccctgtggaca

SEQ ID NO: 379626 - DNA, 25 bp, Mus musculus
tggagctgtgcatccttttatacag

SEQ ID NO: 379627 - DNA, 25 bp, Mus musculus
tggagctgtggttcgttctcccaga

SEQ ID NO: 379628 - DNA, 25 bp, Mus musculus
tggagctgttccagttacagattca

SEQ ID NO: 379629 - DNA, 25 bp, Mus musculus
tggagcttccgcaggcgccatggaa

SEQ ID NO: 379630 - DNA, 25 bp, Mus musculus
tggagcttgatgcagaatccaaatc

SEQ ID NO: 379631 - DNA, 25 bp, Mus musculus
tggagcttgatgcagctgtggcaga

SEQ ID NO: 379632 - DNA, 25 bp, Mus musculus
tggagcttgcaggaataacagaagc

SEQ ID NO: 379633 - DNA, 25 bp, Mus musculus
tggagctttgaatcgggaggaagca

SEQ ID NO: 379634 - DNA, 25 bp, Mus musculus
tggagctttgatgctgcattccgtg

SEQ ID NO: 379635 - DNA, 25 bp, Mus musculus
tggagcttttagaacgttttagagg

SEQ ID NO: 379636 - DNA, 25 bp, Mus musculus
tggagcttttgcggtttgtagtgca

SEQ ID NO: 379637 - DNA, 25 bp, Mus musculus
tggagcttttgcgttcagttcggtg

SEQ ID NO: 379638 - DNA, 25 bp, Mus musculus
tggaggaaaagaaagctgttcagag

SEQ ID NO: 379639 - DNA, 25 bp, Mus musculus
tggaggaaaagaaagtctgccaagg

SEQ ID NO: 379640 - DNA, 25 bp, Mus musculus
tggaggaaaatctgaatgaggtgta

SEQ ID NO: 379641 - DNA, 25 bp, Mus musculus
tggaggaaaccaggaatgggccttg

SEQ ID NO: 379642 - DNA, 25 bp, Mus musculus
tggaggaaaggttacagcaggcgga

SEQ ID NO: 379643 - DNA, 25 bp, Mus musculus
tggaggaaatcaatcgcaagcagga

SEQ ID NO: 379644 - DNA, 25 bp, Mus musculus
tggaggaacagagaagctcccgtcc

SEQ ID NO: 379645 - DNA, 25 bp, Mus musculus
tggaggaacagctgggccctgtctc

SEQ ID NO: 379646 - DNA, 25 bp, Mus musculus
tggaggaactcccaggctatgaaga

SEQ ID NO: 379647 - DNA, 25 bp, Mus musculus
tggaggaactgagaagacattttca

SEQ ID NO: 379648 - DNA, 25 bp, Mus musculus
tggaggaagacagggttccagtgat

SEQ ID NO: 379649 - DNA, 25 bp, Mus musculus
tggaggaagccaagaagaagctggc

SEQ ID NO: 379650 - DNA, 25 bp, Mus musculus
tggaggaaggaattctttgtgtggc

SEQ ID NO: 379651 - DNA, 25 bp, Mus musculus
tggaggacaaaggggagacaccatt

SEQ ID NO: 379652 - DNA, 25 bp, Mus musculus
tggaggacaaaggtcaagcaggtag

SEQ ID NO: 379653 - DNA, 25 bp, Mus musculus
tggaggacaagagcaacagtaccat

SEQ ID NO: 379654 - DNA, 25 bp, Mus musculus
tggaggacaagattaggaatcagtg

SEQ ID NO: 379655 - DNA, 25 bp, Mus musculus
tggaggacaagggcaggattctggg

SEQ ID NO: 379656 - DNA, 25 bp, Mus musculus
tggaggacaaggtgactgcaaaggg

SEQ ID NO: 379657 - DNA, 25 bp, Mus musculus
tggaggacaatgtctgttctgagta

SEQ ID NO: 379658 - DNA, 25 bp, Mus musculus
tggaggacaatgttttgatgagtgg

SEQ ID NO: 379659 - DNA, 25 bp, Mus musculus
tggaggacactggtgttagaaatga

SEQ ID NO: 379660 - DNA, 25 bp, Mus musculus
tggaggacagagggataagaaaaat

SEQ ID NO: 379661 - DNA, 25 bp, Mus musculus
tggaggacagatgccctgctggcag

SEQ ID NO: 379662 - DNA, 25 bp, Mus musculus
tggaggacaggaattgtttgttcct

SEQ ID NO: 379663 - DNA, 25 bp, Mus musculus
tggaggacctggaggaaattatgga

SEQ ID NO: 379664 - DNA, 25 bp, Mus musculus
tggaggacgcgatagttctgacaca

SEQ ID NO: 379665 - DNA, 25 bp, Mus musculus
tggaggacgtttgagcgaatctcat

SEQ ID NO: 379666 - DNA, 25 bp, Mus musculus
tggaggactatggcgtttactggcc

SEQ ID NO: 379667 - DNA, 25 bp, Mus musculus
tggaggactatggggtcacatatga

SEQ ID NO: 379668 - DNA, 25 bp, Mus musculus
tggaggacttcaggtatccgtggtc

SEQ ID NO: 379669 - DNA, 25 bp, Mus musculus
tggaggacttcagtgtgtctccagg

SEQ ID NO: 379670 - DNA, 25 bp, Mus musculus
tggaggagaagatggagcgagatgc

SEQ ID NO: 379671 - DNA, 25 bp, Mus musculus
tggaggagaatggggagacctgtct

SEQ ID NO: 379672 - DNA, 25 bp, Mus musculus
tggaggagaatttaaaagaagatgg

SEQ ID NO: 379673 - DNA, 25 bp, Mus musculus
tggaggagacttcaggctccaggat

SEQ ID NO: 379674 - DNA, 25 bp, Mus musculus
tggaggagagagaatgactctgtgg

SEQ ID NO: 379675 - DNA, 25 bp, Mus musculus
tggaggagagaggtacaatttcttc

SEQ ID NO: 379676 - DNA, 25 bp, Mus musculus
tggaggagagggctctgctctgaag

SEQ ID NO: 379677 - DNA, 25 bp, Mus musculus
tggaggagcagaattttctacagaa

SEQ ID NO: 379678 - DNA, 25 bp, Mus musculus
tggaggagcagtgccctcagccagc

SEQ ID NO: 379679 - DNA, 25 bp, Mus musculus
tggaggagctagagaactacatgga

SEQ ID NO: 379680 - DNA, 25 bp, Mus musculus
tggaggagctctgggaacctcctct

SEQ ID NO: 379681 - DNA, 25 bp, Mus musculus
tggaggagctctggggcccagcaac

SEQ ID NO: 379682 - DNA, 25 bp, Mus musculus
tggaggagctgaattttctgaagag

SEQ ID NO: 379683 - DNA, 25 bp, Mus musculus
tggaggagctgttttctgaagagat

SEQ ID NO: 379684 - DNA, 25 bp, Mus musculus
tggaggagcttgaggcgggcaggga

SEQ ID NO: 379685 - DNA, 25 bp, Mus musculus
tggaggaggaaaaggcatgaggatc

SEQ ID NO: 379686 - DNA, 25 bp, Mus musculus
tggaggaggacaaggagcgccatga

SEQ ID NO: 379687 - DNA, 25 bp, Mus musculus
tggaggaggagagtataaaggaggg

SEQ ID NO: 379688 - DNA, 25 bp, Mus musculus
tggaggaggagctgcagttctccct

SEQ ID NO: 379689 - DNA, 25 bp, Mus musculus
tggaggaggcagagggaagacttgc

SEQ ID NO: 379690 - DNA, 25 bp, Mus musculus
tggaggaggccgggccaaagtagag

SEQ ID NO: 379691 - DNA, 25 bp, Mus musculus
tggaggaggccgggtccagatagta

SEQ ID NO: 379692 - DNA, 25 bp, Mus musculus
tggaggaggccgggttcagattcag

SEQ ID NO: 379693 - DNA, 25 bp, Mus musculus
tggaggagggaagagtctgaggaag

SEQ ID NO: 379694 - DNA, 25 bp, Mus musculus
tggaggagtgggatcgagtgggatg

SEQ ID NO: 379695 - DNA, 25 bp, Mus musculus
tggaggagttcaaggacgacagcca

SEQ ID NO: 379696 - DNA, 25 bp, Mus musculus
tggaggagttgagttaaaagaagat

SEQ ID NO: 379697 - DNA, 25 bp, Mus musculus
tggaggatacgtcctctgccagagg

SEQ ID NO: 379698 - DNA, 25 bp, Mus musculus
tggaggatagaaccatcaggctgca

SEQ ID NO: 379699 - DNA, 25 bp, Mus musculus
tggaggatagaaccgtgcgattgca

SEQ ID NO: 379700 - DNA, 25 bp, Mus musculus
tggaggatagagcagctcagtcctc

SEQ ID NO: 379701 - DNA, 25 bp, Mus musculus
tggaggatcagttggcaaagctccg

SEQ ID NO: 379702 - DNA, 25 bp, Mus musculus
tggaggatcctccaggtggccacgg

SEQ ID NO: 379703 - DNA, 25 bp, Mus musculus
tggaggatcctccaggtggctttgc

SEQ ID NO: 379704 - DNA, 25 bp, Mus musculus
tggaggatctggaaagagaacttga

SEQ ID NO: 379705 - DNA, 25 bp, Mus musculus
tggaggatgaggaagctctgtgaag

SEQ ID NO: 379706 - DNA, 25 bp, Mus musculus
tggaggatgggctaggaaatcaagc

SEQ ID NO: 379707 - DNA, 25 bp, Mus musculus
tggaggatgtggagctggaccagat

SEQ ID NO: 379708 - DNA, 25 bp, Mus musculus
tggaggattccagtgtgacctgctg

SEQ ID NO: 379709 - DNA, 25 bp, Mus musculus
tggaggattccagtgtgtgtttcct

SEQ ID NO: 379710 - DNA, 25 bp, Mus musculus
tggaggatttgaggcctacctagga

SEQ ID NO: 379711 - DNA, 25 bp, Mus musculus
tggaggcaaatatctgaaagatttt

SEQ ID NO: 379712 - DNA, 25 bp, Mus musculus
tggaggcaagatgcctttgcggggc

SEQ ID NO: 379713 - DNA, 25 bp, Mus musculus
tggaggcaaggaagacatacatggg

SEQ ID NO: 379714 - DNA, 25 bp, Mus musculus
tggaggcaaggatggccaggctatg

SEQ ID NO: 379715 - DNA, 25 bp, Mus musculus
tggaggcaaggctatgctgtgggat

SEQ ID NO: 379716 - DNA, 25 bp, Mus musculus
tggaggcacagtggagttaccctgc

SEQ ID NO: 379717 - DNA, 25 bp, Mus musculus
tggaggcagaaagaattgcctatca

SEQ ID NO: 379718 - DNA, 25 bp, Mus musculus
tggaggcagaggaggtagaggaggc

SEQ ID NO: 379719 - DNA, 25 bp, Mus musculus
tggaggcagtgtgcaaatagtctac

SEQ ID NO: 379720 - DNA, 25 bp, Mus musculus
tggaggcagttgtctgctacagaga

SEQ ID NO: 379721 - DNA, 25 bp, Mus musculus
tggaggccaagcaggtgcaggccca

SEQ ID NO: 379722 - DNA, 25 bp, Mus musculus
tggaggccaagggagaagcaagcca

SEQ ID NO: 379723 - DNA, 25 bp, Mus musculus
tggaggccaaggggagtggagtaag

SEQ ID NO: 379724 - DNA, 25 bp, Mus musculus
tggaggccagcatattcaggaggcc

SEQ ID NO: 379725 - DNA, 25 bp, Mus musculus
tggaggccaggaaaacggcaactat

SEQ ID NO: 379726 - DNA, 25 bp, Mus musculus
tggaggccaggaatggtaccagcag

SEQ ID NO: 379727 - DNA, 25 bp, Mus musculus
tggaggccaggctgtaattcaaaat

SEQ ID NO: 379728 - DNA, 25 bp, Mus musculus
tggaggccaggtgacataccgcgta

SEQ ID NO: 379729 - DNA, 25 bp, Mus musculus
tggaggccagtgcctctctgggcag

SEQ ID NO: 379730 - DNA, 25 bp, Mus musculus
tggaggccatgaaaggaccccgaga

SEQ ID NO: 379731 - DNA, 25 bp, Mus musculus
tggaggcccaggatttggtgtcatt

SEQ ID NO: 379732 - DNA, 25 bp, Mus musculus
tggaggcccaggtgcgcaagttgga

SEQ ID NO: 379733 - DNA, 25 bp, Mus musculus
tggaggcccccaggattccccctct

SEQ ID NO: 379734 - DNA, 25 bp, Mus musculus
tggaggcccttcaagttttcctgga

SEQ ID NO: 379735 - DNA, 25 bp, Mus musculus
tggaggccggagaggagccgctgct

SEQ ID NO: 379736 - DNA, 25 bp, Mus musculus
tggaggcctcaaaggttaaggagct

SEQ ID NO: 379737 - DNA, 25 bp, Mus musculus
tggaggcctcatgatgcctggaatg

SEQ ID NO: 379738 - DNA, 25 bp, Mus musculus
tggaggcctcatgatggggcatcct

SEQ ID NO: 379739 - DNA, 25 bp, Mus musculus
tggaggcctctgagatcgaggatga

SEQ ID NO: 379740 - DNA, 25 bp, Mus musculus
tggaggcgagaaccatgtgtgctca

SEQ ID NO: 379741 - DNA, 25 bp, Mus musculus
tggaggcgagtatttcctaaatgac

SEQ ID NO: 379742 - DNA, 25 bp, Mus musculus
tggaggcgccactgcccacacttac

SEQ ID NO: 379743 - DNA, 25 bp, Mus musculus
tggaggcggccaagggagcagccgc

SEQ ID NO: 379744 - DNA, 25 bp, Mus musculus
tggaggctaggtcttggtttcctaa

SEQ ID NO: 379745 - DNA, 25 bp, Mus musculus
tggaggctataaggtacgaaaccag

SEQ ID NO: 379746 - DNA, 25 bp, Mus musculus
tggaggctataaggtccccagggag

SEQ ID NO: 379747 - DNA, 25 bp, Mus musculus
tggaggctcaagtgagggcattgcc

SEQ ID NO: 379748 - DNA, 25 bp, Mus musculus
tggaggctcaagtgtgagggagatg

SEQ ID NO: 379749 - DNA, 25 bp, Mus musculus
tggaggctctacaggttttggctca

SEQ ID NO: 379750 - DNA, 25 bp, Mus musculus
tggaggctggcagagcctcattaac

SEQ ID NO: 379751 - DNA, 25 bp, Mus musculus
tggaggctgtgagaggcttcctccc

SEQ ID NO: 379752 - DNA, 25 bp, Mus musculus
tggaggctgtgagagtgaagccgcc

SEQ ID NO: 379753 - DNA, 25 bp, Mus musculus
tggaggcttggagaatctccccgag

SEQ ID NO: 379754 - DNA, 25 bp, Mus musculus
tggaggcttggcaggatgacatgca

SEQ ID NO: 379755 - DNA, 25 bp, Mus musculus
tggaggcttggcagtttgcgtcctc

SEQ ID NO: 379756 - DNA, 25 bp, Mus musculus
tggaggctttttcagcttgcttccc

SEQ ID NO: 379757 - DNA, 25 bp, Mus musculus
tggaggctttttcaggaggcagtga

SEQ ID NO: 379758 - DNA, 25 bp, Mus musculus
tggagggaagagaaactgctcagga

SEQ ID NO: 379759 - DNA, 25 bp, Mus musculus
tggagggaaggaaggcacagctgat

SEQ ID NO: 379760 - DNA, 25 bp, Mus musculus
tggagggaatgtcagagatgggcgt

SEQ ID NO: 379761 - DNA, 25 bp, Mus musculus
tggagggaatgtcagttcactcacc

SEQ ID NO: 379762 - DNA, 25 bp, Mus musculus
tggagggacagcaactgctttgctc

SEQ ID NO: 379763 - DNA, 25 bp, Mus musculus
tggagggacagcctggatacaggtt

SEQ ID NO: 379764 - DNA, 25 bp, Mus musculus
tggagggacagtgacaggtttctgg

SEQ ID NO: 379765 - DNA, 25 bp, Mus musculus
tggagggactcaacgctgcagcccc

SEQ ID NO: 379766 - DNA, 25 bp, Mus musculus
tggagggactgtgagtgaccatgaa

SEQ ID NO: 379767 - DNA, 25 bp, Mus musculus
tggagggagacagaagcaggtggca

SEQ ID NO: 379768 - DNA, 25 bp, Mus musculus
tggagggagacagaaggaggtggtg

SEQ ID NO: 379769 - DNA, 25 bp, Mus musculus
tggagggagacagagcaggtggcag

SEQ ID NO: 379770 - DNA, 25 bp, Mus musculus
tggagggagagacgtgaaaaatgaa

SEQ ID NO: 379771 - DNA, 25 bp, Mus musculus
tggagggcaagatattagcatttgg

SEQ ID NO: 379772 - DNA, 25 bp, Mus musculus
tggagggcagaggctcagaggcaca

SEQ ID NO: 379773 - DNA, 25 bp, Mus musculus
tggagggcatatcctttttactggg

SEQ ID NO: 379774 - DNA, 25 bp, Mus musculus
tggagggctagatgggatgtgacca

SEQ ID NO: 379775 - DNA, 25 bp, Mus musculus
tggagggctaggcttcaacttgcgc

SEQ ID NO: 379776 - DNA, 25 bp, Mus musculus
tggagggcttgcggttccaaagggc

SEQ ID NO: 379777 - DNA, 25 bp, Mus musculus
tggaggggcgctggcaccttcaaac

SEQ ID NO: 379778 - DNA, 25 bp, Mus musculus
tggaggggcgctgggctacgatgga

SEQ ID NO: 379779 - DNA, 25 bp, Mus musculus
tggaggggcttcagacaccaatgac

SEQ ID NO: 379780 - DNA, 25 bp, Mus musculus
tggagggggtcagctagaagagtcc

SEQ ID NO: 379781 - DNA, 25 bp, Mus musculus
tggaggggtgagtgtggatctgcag

SEQ ID NO: 379782 - DNA, 25 bp, Mus musculus
tggagggtgaggctctgggtgctct

SEQ ID NO: 379783 - DNA, 25 bp, Mus musculus
tggagggtgccaaaaaggccaacaa

SEQ ID NO: 379784 - DNA, 25 bp, Mus musculus
tggaggtaatgttgggaggaaagaa

SEQ ID NO: 379785 - DNA, 25 bp, Mus musculus
tggaggtacaagagggaagaagaag

SEQ ID NO: 379786 - DNA, 25 bp, Mus musculus
tggaggtagagggtggagtttacca

SEQ ID NO: 379787 - DNA, 25 bp, Mus musculus
tggaggtcatggtgaaacatccacc

SEQ ID NO: 379788 - DNA, 25 bp, Mus musculus
tggaggtcatggtgaaacatgagct

SEQ ID NO: 379789 - DNA, 25 bp, Mus musculus
tggaggtcatttcaggggagcgttt

SEQ ID NO: 379790 - DNA, 25 bp, Mus musculus
tggaggtccgagcacaccctgaaag

SEQ ID NO: 379791 - DNA, 25 bp, Mus musculus
tggaggtccgaggcgagtgagctca

SEQ ID NO: 379792 - DNA, 25 bp, Mus musculus
tggaggtccgagggtgacttcacct

SEQ ID NO: 379793 - DNA, 25 bp, Mus musculus
tggaggtcgagcccgtgacaccata

SEQ ID NO: 379794 - DNA, 25 bp, Mus musculus
tggaggtctgccaggatatagctcc

SEQ ID NO: 379795 - DNA, 25 bp, Mus musculus
tggaggtcttcaaggaaccagcacc

SEQ ID NO: 379796 - DNA, 25 bp, Mus musculus
tggaggtgaaagaggtgacagctac

SEQ ID NO: 379797 - DNA, 25 bp, Mus musculus
tggaggtgaaggccaatacatatga

SEQ ID NO: 379798 - DNA, 25 bp, Mus musculus
tggaggtgattggaggcctgggagc

SEQ ID NO: 379799 - DNA, 25 bp, Mus musculus
tggaggtggcaatgttcagattcag

SEQ ID NO: 379800 - DNA, 25 bp, Mus musculus
tggaggtggcagagtataaaggagg

SEQ ID NO: 379801 - DNA, 25 bp, Mus musculus
tggaggtggcccaggtccctgtccg

SEQ ID NO: 379802 - DNA, 25 bp, Mus musculus
tggaggtggccgatgtgacagcatg

SEQ ID NO: 379803 - DNA, 25 bp, Mus musculus
tggaggtggccgctgaccagtgaag

SEQ ID NO: 379804 - DNA, 25 bp, Mus musculus
tggaggtggctgtgtctttcagccc

SEQ ID NO: 379805 - DNA, 25 bp, Mus musculus
tggaggtggggtgctgtgagtggct

SEQ ID NO: 379806 - DNA, 25 bp, Mus musculus
tggaggtgttcagctcctgcttcta

SEQ ID NO: 379807 - DNA, 25 bp, Mus musculus
tggaggtgttcagggaggcagatca

SEQ ID NO: 379808 - DNA, 25 bp, Mus musculus
tggaggttaaagcttctgccacaca

SEQ ID NO: 379809 - DNA, 25 bp, Mus musculus
tggaggttatacagacagagggtac

SEQ ID NO: 379810 - DNA, 25 bp, Mus musculus
tggaggttctggaacagctaatcca

SEQ ID NO: 379811 - DNA, 25 bp, Mus musculus
tggaggttctggacggcatttgcgg

SEQ ID NO: 379812 - DNA, 25 bp, Mus musculus
tggaggttctgggacagcaactgtt

SEQ ID NO: 379813 - DNA, 25 bp, Mus musculus
tggaggttgtcagggttacagccac

SEQ ID NO: 379814 - DNA, 25 bp, Mus musculus
tggaggttgttaaggacaaagcagg

SEQ ID NO: 379815 - DNA, 25 bp, Mus musculus
tggaggttgttaaggacctcataag

SEQ ID NO: 379816 - DNA, 25 bp, Mus musculus
tggaggtttgctgttatttcgctgc

SEQ ID NO: 379817 - DNA, 25 bp, Mus musculus
tggaggttttgttggtgtgcaacag

SEQ ID NO: 379818 - DNA, 25 bp, Mus musculus
tggagtaaattcagatgggtggcct

SEQ ID NO: 379819 - DNA, 25 bp, Mus musculus
tggagtaacagctagaaattgcaaa

SEQ ID NO: 379820 - DNA, 25 bp, Mus musculus
tggagtaactgagttggcagatatc

SEQ ID NO: 379821 - DNA, 25 bp, Mus musculus
tggagtaagaaagagcccagtaaga

SEQ ID NO: 379822 - DNA, 25 bp, Mus musculus
tggagtaagcagaggagacctgcca

SEQ ID NO: 379823 - DNA, 25 bp, Mus musculus
tggagtaatggccttattcaggatg

SEQ ID NO: 379824 - DNA, 25 bp, Mus musculus
tggagtacaggatcaataagccaag

SEQ ID NO: 379825 - DNA, 25 bp, Mus musculus
tggagtacagtaagggatgttctga

SEQ ID NO: 379826 - DNA, 25 bp, Mus musculus
tggagtacagtaagtactggctctg

SEQ ID NO: 379827 - DNA, 25 bp, Mus musculus
tggagtacagtaagttcatagacag

SEQ ID NO: 379828 - DNA, 25 bp, Mus musculus
tggagtactgagaggtagccagaaa

SEQ ID NO: 379829 - DNA, 25 bp, Mus musculus
tggagtagaaccaggggaaagcgca

SEQ ID NO: 379830 - DNA, 25 bp, Mus musculus
tggagtagacaggctcctcatagtc

SEQ ID NO: 379831 - DNA, 25 bp, Mus musculus
tggagtagagaaggtccatctctgt

SEQ ID NO: 379832 - DNA, 25 bp, Mus musculus
tggagtagatttagatgccagcacc

SEQ ID NO: 379833 - DNA, 25 bp, Mus musculus
tggagtataagacagatttcttctg

SEQ ID NO: 379834 - DNA, 25 bp, Mus musculus
tggagtataagacagtaagcgtcac

SEQ ID NO: 379835 - DNA, 25 bp, Mus musculus
tggagtatacaaaaaagcctgagct

SEQ ID NO: 379836 - DNA, 25 bp, Mus musculus
tggagtatcaggatgctgtgcgcac

SEQ ID NO: 379837 - DNA, 25 bp, Mus musculus
tggagtatccagagaaacatgactt

SEQ ID NO: 379838 - DNA, 25 bp, Mus musculus
tggagtatgccagacagctgaggcc

SEQ ID NO: 379839 - DNA, 25 bp, Mus musculus
tggagtatgccaggtactacatgag

SEQ ID NO: 379840 - DNA, 25 bp, Mus musculus
tggagtcaaagagtggcttcacccc

SEQ ID NO: 379841 - DNA, 25 bp, Mus musculus
tggagtcaagctggaaccacctgat

SEQ ID NO: 379842 - DNA, 25 bp, Mus musculus
tggagtcaagggagatcgtggtgag

SEQ ID NO: 379843 - DNA, 25 bp, Mus musculus
tggagtcaagttctccaaggagagg

SEQ ID NO: 379844 - DNA, 25 bp, Mus musculus
tggagtcacgggaagtcctgcatgt

SEQ ID NO: 379845 - DNA, 25 bp, Mus musculus
tggagtcagaacagggagcccccgg

SEQ ID NO: 379846 - DNA, 25 bp, Mus musculus
tggagtcagaccagggagcccccgg

SEQ ID NO: 379847 - DNA, 25 bp, Mus musculus
tggagtcagaggagtttgacaagaa

SEQ ID NO: 379848 - DNA, 25 bp, Mus musculus
tggagtcaggggaaatgagcatctc

SEQ ID NO: 379849 - DNA, 25 bp, Mus musculus
tggagtcaggggtcactaggattgt

SEQ ID NO: 379850 - DNA, 25 bp, Mus musculus
tggagtcatcaggggtttcctgaga

SEQ ID NO: 379851 - DNA, 25 bp, Mus musculus
tggagtcattagagtgttcagtgtc

SEQ ID NO: 379852 - DNA, 25 bp, Mus musculus
tggagtcattaggggccctgggacc

SEQ ID NO: 379853 - DNA, 25 bp, Mus musculus
tggagtcattcaagtttatctccgg

SEQ ID NO: 379854 - DNA, 25 bp, Mus musculus
tggagtccacgtacaagtatgaatt

SEQ ID NO: 379855 - DNA, 25 bp, Mus musculus
tggagtccagcaatccaaacttccc

SEQ ID NO: 379856 - DNA, 25 bp, Mus musculus
tggagtccataggctgtaccaactg

SEQ ID NO: 379857 - DNA, 25 bp, Mus musculus
tggagtccatcctgatggagtgcac

SEQ ID NO: 379858 - DNA, 25 bp, Mus musculus
tggagtccatgtgtaaagagctggc

SEQ ID NO: 379859 - DNA, 25 bp, Mus musculus
tggagtccatgtttactgtcttggg

SEQ ID NO: 379860 - DNA, 25 bp, Mus musculus
tggagtccattcgacaaagatgact

SEQ ID NO: 379861 - DNA, 25 bp, Mus musculus
tggagtccgtcacgctggcggtggt

SEQ ID NO: 379862 - DNA, 25 bp, Mus musculus
tggagtcctttcagggcttcttcgt

SEQ ID NO: 379863 - DNA, 25 bp, Mus musculus
tggagtctatgtcagacagggaaca

SEQ ID NO: 379864 - DNA, 25 bp, Mus musculus
tggagtctcctgagagaaattttcc

SEQ ID NO: 379865 - DNA, 25 bp, Mus musculus
tggagtctcctgaggttcaggacct

SEQ ID NO: 379866 - DNA, 25 bp, Mus musculus
tggagtctctggagcagcgtgccat

SEQ ID NO: 379867 - DNA, 25 bp, Mus musculus
tggagtctctggcgctgatcccact

SEQ ID NO: 379868 - DNA, 25 bp, Mus musculus
tggagtctctggcggccccactgaa

SEQ ID NO: 379869 - DNA, 25 bp, Mus musculus
tggagtctgtgaagagccacaatca

SEQ ID NO: 379870 - DNA, 25 bp, Mus musculus
tggagtctgtgaaggagaagtttga

SEQ ID NO: 379871 - DNA, 25 bp, Mus musculus
tggagtcttcccaggatgagtctga

SEQ ID NO: 379872 - DNA, 25 bp, Mus musculus
tggagtgaagtgcctcagagcgccg

SEQ ID NO: 379873 - DNA, 25 bp, Mus musculus
tggagtgacaggtcctttcccataa

SEQ ID NO: 379874 - DNA, 25 bp, Mus musculus
tggagtgacatagagtgtgctgctc

SEQ ID NO: 379875 - DNA, 25 bp, Mus musculus
tggagtgagagagcctgtgctgtgg

SEQ ID NO: 379876 - DNA, 25 bp, Mus musculus
tggagtgagagaggaggagcgcttt

SEQ ID NO: 379877 - DNA, 25 bp, Mus musculus
tggagtgagagctgggaagtcatca

SEQ ID NO: 379878 - DNA, 25 bp, Mus musculus
tggagtgaggaaaatggcacaccat

SEQ ID NO: 379879 - DNA, 25 bp, Mus musculus
tggagtgaggagaagaaacactgcc

SEQ ID NO: 379880 - DNA, 25 bp, Mus musculus
tggagtgaggtcaagggtcttctat

SEQ ID NO: 379881 - DNA, 25 bp, Mus musculus
tggagtgcagccaccaggacgcaga

SEQ ID NO: 379882 - DNA, 25 bp, Mus musculus
tggagtgcaggccctgcaggtcgga

SEQ ID NO: 379883 - DNA, 25 bp, Mus musculus
tggagtgcctcagtgaagaaactga

SEQ ID NO: 379884 - DNA, 25 bp, Mus musculus
tggagtgcctcagtgcttctacctg

SEQ ID NO: 379885 - DNA, 25 bp, Mus musculus
tggagtgcctcagtggtggtgagct

SEQ ID NO: 379886 - DNA, 25 bp, Mus musculus
tggagtgcggacacccggcctggcc

SEQ ID NO: 379887 - DNA, 25 bp, Mus musculus
tggagtggcaggagaagcgtagacc

SEQ ID NO: 379888 - DNA, 25 bp, Mus musculus
tggagtggcaggagccctggcctga

SEQ ID NO: 379889 - DNA, 25 bp, Mus musculus
tggagtggcaggaggcctatgtgaa

SEQ ID NO: 379890 - DNA, 25 bp, Mus musculus
tggagtgtactggatgtttgagaca

SEQ ID NO: 379891 - DNA, 25 bp, Mus musculus
tggagtgtccacagtacctgagaaa

SEQ ID NO: 379892 - DNA, 25 bp, Mus musculus
tggagtgtgagataacacgtatagg

SEQ ID NO: 379893 - DNA, 25 bp, Mus musculus
tggagtgtgggccagacccatgggc

SEQ ID NO: 379894 - DNA, 25 bp, Mus musculus
tggagtgttcggggttaactgctct

SEQ ID NO: 379895 - DNA, 25 bp, Mus musculus
tggagtgttgtgaggagtccatgaa

SEQ ID NO: 379896 - DNA, 25 bp, Mus musculus
tggagttaaaggtccttcacgtctt

SEQ ID NO: 379897 - DNA, 25 bp, Mus musculus
tggagttaagcacggaaataaccag

SEQ ID NO: 379898 - DNA, 25 bp, Mus musculus
tggagttaagtggctaaaagccaag

SEQ ID NO: 379899 - DNA, 25 bp, Mus musculus
tggagttacagaaggtttggaggta

SEQ ID NO: 379900 - DNA, 25 bp, Mus musculus
tggagttacagcttcgttacgacga

SEQ ID NO: 379901 - DNA, 25 bp, Mus musculus
tggagttacggtgaaactagattga

SEQ ID NO: 379902 - DNA, 25 bp, Mus musculus
tggagttagccagaatggagaatgg

SEQ ID NO: 379903 - DNA, 25 bp, Mus musculus
tggagttatttagacaagatcctga

SEQ ID NO: 379904 - DNA, 25 bp, Mus musculus
tggagttcagagacctcaacgaatc

SEQ ID NO: 379905 - DNA, 25 bp, Mus musculus
tggagttcagcagcacttggaacag

SEQ ID NO: 379906 - DNA, 25 bp, Mus musculus
tggagttcagtgatgacttggatgt

SEQ ID NO: 379907 - DNA, 25 bp, Mus musculus
tggagttccaagcagcatgggtcgg

SEQ ID NO: 379908 - DNA, 25 bp, Mus musculus
tggagttctagtttggattaacgcc

SEQ ID NO: 379909 - DNA, 25 bp, Mus musculus
tggagttctctgtaagtgcctggtg

SEQ ID NO: 379910 - DNA, 25 bp, Mus musculus
tggagttctggggacaatggtgaca

SEQ ID NO: 379911 - DNA, 25 bp, Mus musculus
tggagttgcagagaaccccaaaggt

SEQ ID NO: 379912 - DNA, 25 bp, Mus musculus
tggagttgcagagacctcagacagc

SEQ ID NO: 379913 - DNA, 25 bp, Mus musculus
tggagttgcagctgttccatcggga

SEQ ID NO: 379914 - DNA, 25 bp, Mus musculus
tggagttgcagtcctatcttcagag

SEQ ID NO: 379915 - DNA, 25 bp, Mus musculus
tggagttgctggaaaatctggatga

SEQ ID NO: 379916 - DNA, 25 bp, Mus musculus
tggagttgctggaacagattttctc

SEQ ID NO: 379917 - DNA, 25 bp, Mus musculus
tggagttggacattggtgcccaggg

SEQ ID NO: 379918 - DNA, 25 bp, Mus musculus
tggagttgtccaagattttaccgga

SEQ ID NO: 379919 - DNA, 25 bp, Mus musculus
tggagttgtccaaggaatgtggctt

SEQ ID NO: 379920 - DNA, 25 bp, Mus musculus
tggagttgtgatcttattaattgga

SEQ ID NO: 379921 - DNA, 25 bp, Mus musculus
tggagtttaaagatgtcattgtccc

SEQ ID NO: 379922 - DNA, 25 bp, Mus musculus
tggagtttaaagtgtcgtgttctga

SEQ ID NO: 379923 - DNA, 25 bp, Mus musculus
tggagtttcaggaactaatgaccat

SEQ ID NO: 379924 - DNA, 25 bp, Mus musculus
tggagtttctagcctcaaagcggag

SEQ ID NO: 379925 - DNA, 25 bp, Mus musculus
tggagtttctcagtgacatcactga

SEQ ID NO: 379926 - DNA, 25 bp, Mus musculus
tggagttttaggaaagatataccgc

SEQ ID NO: 379927 - DNA, 25 bp, Mus musculus
tggataaaaaggtagcaacaattgc

SEQ ID NO: 379928 - DNA, 25 bp, Mus musculus
tggataaagccgatcacgcgtccag

SEQ ID NO: 379929 - DNA, 25 bp, Mus musculus
tggataacaaaaaggccctaggcct

SEQ ID NO: 379930 - DNA, 25 bp, Mus musculus
tggataacaaaaaggtgatgaagga

SEQ ID NO: 379931 - DNA, 25 bp, Mus musculus
tggataacagtgcctccggagccag

SEQ ID NO: 379932 - DNA, 25 bp, Mus musculus
tggataacatgagcatcatcagctg

SEQ ID NO: 379933 - DNA, 25 bp, Mus musculus
tggataacccaggctgcatgagtgg

SEQ ID NO: 379934 - DNA, 25 bp, Mus musculus
tggataacttaaagagtatagaaat

SEQ ID NO: 379935 - DNA, 25 bp, Mus musculus
tggataagaaccagactgcagagaa

SEQ ID NO: 379936 - DNA, 25 bp, Mus musculus
tggataagaaccagagaaggaagaa

SEQ ID NO: 379937 - DNA, 25 bp, Mus musculus
tggataagaaccagtactgggttga

SEQ ID NO: 379938 - DNA, 25 bp, Mus musculus
tggataaggactgaatcttggtact

SEQ ID NO: 379939 - DNA, 25 bp, Mus musculus
tggataaggaggatttcagggtcca

SEQ ID NO: 379940 - DNA, 25 bp, Mus musculus
tggataatagaatgacagcagcaac

SEQ ID NO: 379941 - DNA, 25 bp, Mus musculus
tggataatatcttggctttccccct

SEQ ID NO: 379942 - DNA, 25 bp, Mus musculus
tggataatggcggggaagctcagtt

SEQ ID NO: 379943 - DNA, 25 bp, Mus musculus
tggataatgtagagggtcctgttat

SEQ ID NO: 379944 - DNA, 25 bp, Mus musculus
tggataattccaatgatgttgcaaa

SEQ ID NO: 379945 - DNA, 25 bp, Mus musculus
tggatacaacactggaagaaaatat

SEQ ID NO: 379946 - DNA, 25 bp, Mus musculus
tggatacaacactggtgtgtcagtc

SEQ ID NO: 379947 - DNA, 25 bp, Mus musculus
tggatacaggtggaaacgtcctcat

SEQ ID NO: 379948 - DNA, 25 bp, Mus musculus
tggatacccagacctgattgtggga

SEQ ID NO: 379949 - DNA, 25 bp, Mus musculus
tggatacccaggcctgattgtggga

SEQ ID NO: 379950 - DNA, 25 bp, Mus musculus
tggatacccagtttgcagatggcgt

SEQ ID NO: 379951 - DNA, 25 bp, Mus musculus
tggatactcaggaatgggcaaagga

SEQ ID NO: 379952 - DNA, 25 bp, Mus musculus
tggatactggaagaagccataattt

SEQ ID NO: 379953 - DNA, 25 bp, Mus musculus
tggatacttacaggagctgatcttt

SEQ ID NO: 379954 - DNA, 25 bp, Mus musculus
tggatactttaaagagaatgtggtc

SEQ ID NO: 379955 - DNA, 25 bp, Mus musculus
tggatactttaaagatgaaaacttt

SEQ ID NO: 379956 - DNA, 25 bp, Mus musculus
tggatagaaggaagcaggccagcag

SEQ ID NO: 379957 - DNA, 25 bp, Mus musculus
tggatagagattaaggagctatcga

SEQ ID NO: 379958 - DNA, 25 bp, Mus musculus
tggatagccaggtgccagaactggg

SEQ ID NO: 379959 - DNA, 25 bp, Mus musculus
tggatagcctgcttggcagtgacct

SEQ ID NO: 379960 - DNA, 25 bp, Mus musculus
tggatagcctggtaggacagtcctt

SEQ ID NO: 379961 - DNA, 25 bp, Mus musculus
tggatagtaaggtgaacatcattcc

SEQ ID NO: 379962 - DNA, 25 bp, Mus musculus
tggatagtagtgaattgaatccagg

SEQ ID NO: 379963 - DNA, 25 bp, Mus musculus
tggatagtgtggaaacctgctgccc

SEQ ID NO: 379964 - DNA, 25 bp, Mus musculus
tggatagtgtgggcctgccagctcc

SEQ ID NO: 379965 - DNA, 25 bp, Mus musculus
tggatatactcaaagggcagcacat

SEQ ID NO: 379966 - DNA, 25 bp, Mus musculus
tggatatactcaaaggtgttggggc

SEQ ID NO: 379967 - DNA, 25 bp, Mus musculus
tggatatacttcagaatctgaccac

SEQ ID NO: 379968 - DNA, 25 bp, Mus musculus
tggatatacttcagctccaacagag

SEQ ID NO: 379969 - DNA, 25 bp, Mus musculus
tggatatacttcaggaactaattct

SEQ ID NO: 379970 - DNA, 25 bp, Mus musculus
tggatatatccgaaatggctaccaa

SEQ ID NO: 379971 - DNA, 25 bp, Mus musculus
tggatatgagcaaacgtatgcagag

SEQ ID NO: 379972 - DNA, 25 bp, Mus musculus
tggatatgaggtccagagattcatt

SEQ ID NO: 379973 - DNA, 25 bp, Mus musculus
tggatatgatggtggctatggaggt

SEQ ID NO: 379974 - DNA, 25 bp, Mus musculus
tggatatgcaagctcttgaagacag

SEQ ID NO: 379975 - DNA, 25 bp, Mus musculus
tggatatgcaagttttgattatgaa

SEQ ID NO: 379976 - DNA, 25 bp, Mus musculus
tggatatgcaggtgcttcacctttt

SEQ ID NO: 379977 - DNA, 25 bp, Mus musculus
tggatattgtcaagaagcaagactt

SEQ ID NO: 379978 - DNA, 25 bp, Mus musculus
tggatattgtcaaggaactgaaaga

SEQ ID NO: 379979 - DNA, 25 bp, Mus musculus
tggatcaaaagcaggttgtccagag

SEQ ID NO: 379980 - DNA, 25 bp, Mus musculus
tggatcaaaggcctacagtttcaat

SEQ ID NO: 379981 - DNA, 25 bp, Mus musculus
tggatcaaggagaaaatacaactgt

SEQ ID NO: 379982 - DNA, 25 bp, Mus musculus
tggatcacacagtgagaccctgtct

SEQ ID NO: 379983 - DNA, 25 bp, Mus musculus
tggatcacactggatgcagcctacc

SEQ ID NO: 379984 - DNA, 25 bp, Mus musculus
tggatcacagctgcgaccgagggcc

SEQ ID NO: 379985 - DNA, 25 bp, Mus musculus
tggatcaccaggtgttgatgctcat

SEQ ID NO: 379986 - DNA, 25 bp, Mus musculus
tggatcacctctaagagacgtggag

SEQ ID NO: 379987 - DNA, 25 bp, Mus musculus
tggatcacgaaggtaacttcatgga

SEQ ID NO: 379988 - DNA, 25 bp, Mus musculus
tggatcacgaattgggccggtgtac

SEQ ID NO: 379989 - DNA, 25 bp, Mus musculus
tggatcagaccacaggttctcccct

SEQ ID NO: 379990 - DNA, 25 bp, Mus musculus
tggatcagaccacaggtttgtccag

SEQ ID NO: 379991 - DNA, 25 bp, Mus musculus
tggatcagattcaggcaacaatatc

SEQ ID NO: 379992 - DNA, 25 bp, Mus musculus
tggatcaggaagatcctggcccgcc

SEQ ID NO: 379993 - DNA, 25 bp, Mus musculus
tggatcaggtactggcccttgggat

SEQ ID NO: 379994 - DNA, 25 bp, Mus musculus
tggatcaggtgggaggttgtgccca

SEQ ID NO: 379995 - DNA, 25 bp, Mus musculus
tggatcataattgggtttcttcttt

SEQ ID NO: 379996 - DNA, 25 bp, Mus musculus
tggatcatcgacccccttttgcaat

SEQ ID NO: 379997 - DNA, 25 bp, Mus musculus
tggatccaccagcactgccccccaa

SEQ ID NO: 379998 - DNA, 25 bp, Mus musculus
tggatccagaccaaaaccaacaaaa

SEQ ID NO: 379999 - DNA, 25 bp, Mus musculus
tggatcccaaaattcccagttaagg

SEQ ID NO: 380000 - DNA, 25 bp, Mus musculus
tggatcccaagacagaccctgtgcg

SEQ ID NO: 380001 - DNA, 25 bp, Mus musculus
tggatcccactgatgccaagtatca

SEQ ID NO: 380002 - DNA, 25 bp, Mus musculus
tggatcccatctccgatggtggaac

SEQ ID NO: 380003 - DNA, 25 bp, Mus musculus
tggatccccacaatgatctgcatca

SEQ ID NO: 380004 - DNA, 25 bp, Mus musculus
tggatcccctgggagtgggaggagt

SEQ ID NO: 380005 - DNA, 25 bp, Mus musculus
tggatcccgggcgtccatgctggat

SEQ ID NO: 380006 - DNA, 25 bp, Mus musculus
tggatccctagataagaaagtctgg

SEQ ID NO: 380007 - DNA, 25 bp, Mus musculus
tggatccctagatatgaaagtctgg

SEQ ID NO: 380008 - DNA, 25 bp, Mus musculus
tggatccctctgtgcactgagcagc

SEQ ID NO: 380009 - DNA, 25 bp, Mus musculus
tggatccctctgttttgccattgct

SEQ ID NO: 380010 - DNA, 25 bp, Mus musculus
tggatccctgctgacaaggacacct

SEQ ID NO: 380011 - DNA, 25 bp, Mus musculus
tggatccgggaggaacatcacaagt

SEQ ID NO: 380012 - DNA, 25 bp, Mus musculus
tggatcctcccagccactggtgtga

SEQ ID NO: 380013 - DNA, 25 bp, Mus musculus
tggatcctcccagggttcactgatc

SEQ ID NO: 380014 - DNA, 25 bp, Mus musculus
tggatcctctcaatgaattcctgga

SEQ ID NO: 380015 - DNA, 25 bp, Mus musculus
tggatccttacatgcgctgtaagat

SEQ ID NO: 380016 - DNA, 25 bp, Mus musculus
tggatccttacatgctcctgaccac

SEQ ID NO: 380017 - DNA, 25 bp, Mus musculus
tggatccttgatcttagaatctttt

SEQ ID NO: 380018 - DNA, 25 bp, Mus musculus
tggatccttgctaatttgaaatatt

SEQ ID NO: 380019 - DNA, 25 bp, Mus musculus
tggatccttgggggcaggtcctaac

SEQ ID NO: 380020 - DNA, 25 bp, Mus musculus
tggatcgaaggcacggagggagttg

SEQ ID NO: 380021 - DNA, 25 bp, Mus musculus
tggatcgcggggtcccagctcctgc

SEQ ID NO: 380022 - DNA, 25 bp, Mus musculus
tggatcgctgtccagctcgtagtgc

SEQ ID NO: 380023 - DNA, 25 bp, Mus musculus
tggatcgctgtccaggagctggaga

SEQ ID NO: 380024 - DNA, 25 bp, Mus musculus
tggatcggccagtgagcccatcatc

SEQ ID NO: 380025 - DNA, 25 bp, Mus musculus
tggatcggccagtgccaaggcctgg

SEQ ID NO: 380026 - DNA, 25 bp, Mus musculus
tggatcggcggttcattacagcatc

SEQ ID NO: 380027 - DNA, 25 bp, Mus musculus
tggatcgtctgagtggagaacttca

SEQ ID NO: 380028 - DNA, 25 bp, Mus musculus
tggatctaacaaggagcgagatttt

SEQ ID NO: 380029 - DNA, 25 bp, Mus musculus
tggatctaacaaggttcatttaatt

SEQ ID NO: 380030 - DNA, 25 bp, Mus musculus
tggatctaccaaagtctcactttat

SEQ ID NO: 380031 - DNA, 25 bp, Mus musculus
tggatctactgagcgcagccttggg

SEQ ID NO: 380032 - DNA, 25 bp, Mus musculus
tggatctactggttctgcagtacag

SEQ ID NO: 380033 - DNA, 25 bp, Mus musculus
tggatctactgtgggcccagccacg

SEQ ID NO: 380034 - DNA, 25 bp, Mus musculus
tggatctattaaaagccccagaccc

SEQ ID NO: 380035 - DNA, 25 bp, Mus musculus
tggatctattaaaaggtcaccacca

SEQ ID NO: 380036 - DNA, 25 bp, Mus musculus
tggatctcactgtggtccagattat

SEQ ID NO: 380037 - DNA, 25 bp, Mus musculus
tggatctcataagagaggagccaaa

SEQ ID NO: 380038 - DNA, 25 bp, Mus musculus
tggatctcatggagagtaaaagttg

SEQ ID NO: 380039 - DNA, 25 bp, Mus musculus
tggatctccacttgggtgaaagaca

SEQ ID NO: 380040 - DNA, 25 bp, Mus musculus
tggatctctcagcaccatatcctct

SEQ ID NO: 380041 - DNA, 25 bp, Mus musculus
tggatctctgaaactgatgcagtga

SEQ ID NO: 380042 - DNA, 25 bp, Mus musculus
tggatctcttccaggaatgtctcga

SEQ ID NO: 380043 - DNA, 25 bp, Mus musculus
tggatctgaagatccttcttgatga

SEQ ID NO: 380044 - DNA, 25 bp, Mus musculus
tggatctgaaggcggcacgttttct

SEQ ID NO: 380045 - DNA, 25 bp, Mus musculus
tggatctgaataagtgcggacctat

SEQ ID NO: 380046 - DNA, 25 bp, Mus musculus
tggatctgagggaaatctgctccat

SEQ ID NO: 380047 - DNA, 25 bp, Mus musculus
tggatctgagtcaggatgcgtacac

SEQ ID NO: 380048 - DNA, 25 bp, Mus musculus
tggatctgcagccatgtcatatcca

SEQ ID NO: 380049 - DNA, 25 bp, Mus musculus
tggatctgcctgcgatctagggcgg

SEQ ID NO: 380050 - DNA, 25 bp, Mus musculus
tggatctgcctggtacaactgtaac

SEQ ID NO: 380051 - DNA, 25 bp, Mus musculus
tggatctggagcctgatctctcaac

SEQ ID NO: 380052 - DNA, 25 bp, Mus musculus
tggatctggataaagagttcaggaa

SEQ ID NO: 380053 - DNA, 25 bp, Mus musculus
tggatctggcccagaggccaagtga

SEQ ID NO: 380054 - DNA, 25 bp, Mus musculus
tggatcttacggagggctggatcgt

SEQ ID NO: 380055 - DNA, 25 bp, Mus musculus
tggatcttcccgctctgtgaccagc

SEQ ID NO: 380056 - DNA, 25 bp, Mus musculus
tggatcttcccggttctcggactcc

SEQ ID NO: 380057 - DNA, 25 bp, Mus musculus
tggatcttcttaaggagagcgattc

SEQ ID NO: 380058 - DNA, 25 bp, Mus musculus
tggatcttgcaactccatctcggaa

SEQ ID NO: 380059 - DNA, 25 bp, Mus musculus
tggatcttgcaactgaatctgcctg

SEQ ID NO: 380060 - DNA, 25 bp, Mus musculus
tggatctttaaagcgcagtgctaac

SEQ ID NO: 380061 - DNA, 25 bp, Mus musculus
tggatctttgggcttgtgatgcctg

SEQ ID NO: 380062 - DNA, 25 bp, Mus musculus
tggatctttgggtctgaacgggatg

SEQ ID NO: 380063 - DNA, 25 bp, Mus musculus
tggatgaaacagcatcaaaagacgt

SEQ ID NO: 380064 - DNA, 25 bp, Mus musculus
tggatgaaaggtcgagatttcaggt

SEQ ID NO: 380065 - DNA, 25 bp, Mus musculus
tggatgaacaacactttcatggtgg

SEQ ID NO: 380066 - DNA, 25 bp, Mus musculus
tggatgaacagaatgagatcatcga

SEQ ID NO: 380067 - DNA, 25 bp, Mus musculus
tggatgaactcctgaaagaaattca

SEQ ID NO: 380068 - DNA, 25 bp, Mus musculus
tggatgaactgtatgacatcatgta

SEQ ID NO: 380069 - DNA, 25 bp, Mus musculus
tggatgaagacaaggtgctggtctc

SEQ ID NO: 380070 - DNA, 25 bp, Mus musculus
tggatgaagatttagagagttccag

SEQ ID NO: 380071 - DNA, 25 bp, Mus musculus
tggatgaaggctagctacagtttct

SEQ ID NO: 380072 - DNA, 25 bp, Mus musculus
tggatgaaggcttgctacagtttct

SEQ ID NO: 380073 - DNA, 25 bp, Mus musculus
tggatgaattcaaggtggacattcg

SEQ ID NO: 380074 - DNA, 25 bp, Mus musculus
tggatgaattgaagccccacaggaa

SEQ ID NO: 380075 - DNA, 25 bp, Mus musculus
tggatgaatttcaggaatataccat

SEQ ID NO: 380076 - DNA, 25 bp, Mus musculus
tggatgaatttgacttcttagcact

SEQ ID NO: 380077 - DNA, 25 bp, Mus musculus
tggatgaatttgctggactcttggc

SEQ ID NO: 380078 - DNA, 25 bp, Mus musculus
tggatgacaagccaagcccgatcaa

SEQ ID NO: 380079 - DNA, 25 bp, Mus musculus
tggatgacaaggcatctgtgggctc

SEQ ID NO: 380080 - DNA, 25 bp, Mus musculus
tggatgacagacacccctgcactgg

SEQ ID NO: 380081 - DNA, 25 bp, Mus musculus
tggatgacagagcagagcctgctag

SEQ ID NO: 380082 - DNA, 25 bp, Mus musculus
tggatgacagcaacagttagagatg

SEQ ID NO: 380083 - DNA, 25 bp, Mus musculus
tggatgacagctctgaccaggctcg

SEQ ID NO: 380084 - DNA, 25 bp, Mus musculus
tggatgaccagagagtgatgtggag

SEQ ID NO: 380085 - DNA, 25 bp, Mus musculus
tggatgaccagagccccgggcctct

SEQ ID NO: 380086 - DNA, 25 bp, Mus musculus
tggatgaccagttggcaaagctccg

SEQ ID NO: 380087 - DNA, 25 bp, Mus musculus
tggatgaccggttctaatcagagat

SEQ ID NO: 380088 - DNA, 25 bp, Mus musculus
tggatgactctgctcactggagggt

SEQ ID NO: 380089 - DNA, 25 bp, Mus musculus
tggatgactgaagctggccccgttt

SEQ ID NO: 380090 - DNA, 25 bp, Mus musculus
tggatgactgggcagccacgccccg

SEQ ID NO: 380091 - DNA, 25 bp, Mus musculus
tggatgactgtgtggtgtcgattga

SEQ ID NO: 380092 - DNA, 25 bp, Mus musculus
tggatgactgtgtggttgcagaagc

SEQ ID NO: 380093 - DNA, 25 bp, Mus musculus
tggatgagagggtttaccagcccct

SEQ ID NO: 380094 - DNA, 25 bp, Mus musculus
tggatgagcaaggcgaacaactcga

SEQ ID NO: 380095 - DNA, 25 bp, Mus musculus
tggatgagcaaggcgaacaactgga

SEQ ID NO: 380096 - DNA, 25 bp, Mus musculus
tggatgagcgcaggctgtactacga

SEQ ID NO: 380097 - DNA, 25 bp, Mus musculus
tggatgaggagaactttgtgaaagc

SEQ ID NO: 380098 - DNA, 25 bp, Mus musculus
tggatgagtggatctccacttgggt

SEQ ID NO: 380099 - DNA, 25 bp, Mus musculus
tggatgatacagacgtcctacaacc

SEQ ID NO: 380100 - DNA, 25 bp, Mus musculus
tggatgatacctggaaaaatggtga

SEQ ID NO: 380101 - DNA, 25 bp, Mus musculus
tggatgatagtagtgtcctggaggc

SEQ ID NO: 380102 - DNA, 25 bp, Mus musculus
tggatgatagtagttacacctctaa

SEQ ID NO: 380103 - DNA, 25 bp, Mus musculus
tggatgatattggtgatgtaaccat

SEQ ID NO: 380104 - DNA, 25 bp, Mus musculus
tggatgatcaaaaccaggggctgtc

SEQ ID NO: 380105 - DNA, 25 bp, Mus musculus
tggatgatctatacctactcaggcc

SEQ ID NO: 380106 - DNA, 25 bp, Mus musculus
tggatgatctggacgatgattctga

SEQ ID NO: 380107 - DNA, 25 bp, Mus musculus
tggatgattaaggactttctgagcc

SEQ ID NO: 380108 - DNA, 25 bp, Mus musculus
tggatgcaaagcagaacaggggcta

SEQ ID NO: 380109 - DNA, 25 bp, Mus musculus
tggatgcaagctatgccccctcaaa

SEQ ID NO: 380110 - DNA, 25 bp, Mus musculus
tggatgcactcagggtgactacaac

SEQ ID NO: 380111 - DNA, 25 bp, Mus musculus
tggatgcactcaggttgaaggtgga

SEQ ID NO: 380112 - DNA, 25 bp, Mus musculus
tggatgcagaccttcaatttggttt

SEQ ID NO: 380113 - DNA, 25 bp, Mus musculus
tggatgcagctgccatcaaacttca

SEQ ID NO: 380114 - DNA, 25 bp, Mus musculus
tggatgcataaggaaagacaagaaa

SEQ ID NO: 380115 - DNA, 25 bp, Mus musculus
tggatgcattcaggggtgattcaga

SEQ ID NO: 380116 - DNA, 25 bp, Mus musculus
tggatgccacaaaaggagccataat

SEQ ID NO: 380117 - DNA, 25 bp, Mus musculus
tggatgccactggtaagaccacact

SEQ ID NO: 380118 - DNA, 25 bp, Mus musculus
tggatgccactggtactggcatagc

SEQ ID NO: 380119 - DNA, 25 bp, Mus musculus
tggatgccagatgaggatcatggct

SEQ ID NO: 380120 - DNA, 25 bp, Mus musculus
tggatgccaggcgcaagcggcggaa

SEQ ID NO: 380121 - DNA, 25 bp, Mus musculus
tggatgccatcgatgccctcatgaa

SEQ ID NO: 380122 - DNA, 25 bp, Mus musculus
tggatgccccaggaactggatgcct

SEQ ID NO: 380123 - DNA, 25 bp, Mus musculus
tggatgccccagttttataggcaat

SEQ ID NO: 380124 - DNA, 25 bp, Mus musculus
tggatgccctagtcctgcgcttctt

SEQ ID NO: 380125 - DNA, 25 bp, Mus musculus
tggatgccgtggaggaccccagcag

SEQ ID NO: 380126 - DNA, 25 bp, Mus musculus
tggatgcctcttacgtgtgttctca

SEQ ID NO: 380127 - DNA, 25 bp, Mus musculus
tggatgcctgggaggccatggagga

SEQ ID NO: 380128 - DNA, 25 bp, Mus musculus
tggatgcgtctaggtcttccaagtt

SEQ ID NO: 380129 - DNA, 25 bp, Mus musculus
tggatgctaatgcactgtctcaaaa

SEQ ID NO: 380130 - DNA, 25 bp, Mus musculus
tggatgctagaggtctgtgaggaac

SEQ ID NO: 380131 - DNA, 25 bp, Mus musculus
tggatgctatgagctgatacaagtg

SEQ ID NO: 380132 - DNA, 25 bp, Mus musculus
tggatgctatgtcaggatcgcagcg

SEQ ID NO: 380133 - DNA, 25 bp, Mus musculus
tggatgctcagacatggtgcctggt

SEQ ID NO: 380134 - DNA, 25 bp, Mus musculus
tggatgctcagagacaatgtctatg

SEQ ID NO: 380135 - DNA, 25 bp, Mus musculus
tggatgctctcaggagttcctggtc

SEQ ID NO: 380136 - DNA, 25 bp, Mus musculus
tggatgctgaaactgatgccatgca

SEQ ID NO: 380137 - DNA, 25 bp, Mus musculus
tggatgctgaaactgtatgccatgt

SEQ ID NO: 380138 - DNA, 25 bp, Mus musculus
tggatgctgaggacatcgtgaacac

SEQ ID NO: 380139 - DNA, 25 bp, Mus musculus
tggatgctgaggatattgtaggcac

SEQ ID NO: 380140 - DNA, 25 bp, Mus musculus
tggatgctgagggcactctgaggcc

SEQ ID NO: 380141 - DNA, 25 bp, Mus musculus
tggatgctgatccagtgaagtcgag

SEQ ID NO: 380142 - DNA, 25 bp, Mus musculus
tggatgctgatgagttcttgaccat

SEQ ID NO: 380143 - DNA, 25 bp, Mus musculus
tggatgctgatggcaatggcaccat

SEQ ID NO: 380144 - DNA, 25 bp, Mus musculus
tggatgctgatggcaatgggaccat

SEQ ID NO: 380145 - DNA, 25 bp, Mus musculus
tggatgctgccagctggacaggcct

SEQ ID NO: 380146 - DNA, 25 bp, Mus musculus
tggatgctggaggtcacatctgtca

SEQ ID NO: 380147 - DNA, 25 bp, Mus musculus
tggatgctggaggtgagccttcccg

SEQ ID NO: 380148 - DNA, 25 bp, Mus musculus
tggatgctgtggtggaatgcaattc

SEQ ID NO: 380149 - DNA, 25 bp, Mus musculus
tggatgctgtgtccaccacggcccc

SEQ ID NO: 380150 - DNA, 25 bp, Mus musculus
tggatgcttctcttcaggcctgggc

SEQ ID NO: 380151 - DNA, 25 bp, Mus musculus
tggatggaacctgttcgatttctcg

SEQ ID NO: 380152 - DNA, 25 bp, Mus musculus
tggatggaaggggtgaccactgact

SEQ ID NO: 380153 - DNA, 25 bp, Mus musculus
tggatggaccaagggccaagtgtgg

SEQ ID NO: 380154 - DNA, 25 bp, Mus musculus
tggatggagagaatgccacggtcct

SEQ ID NO: 380155 - DNA, 25 bp, Mus musculus
tggatggagagggccctggatgtca

SEQ ID NO: 380156 - DNA, 25 bp, Mus musculus
tggatggagaggttacagctgtggt

SEQ ID NO: 380157 - DNA, 25 bp, Mus musculus
tggatggagtgacggatgacgactc

SEQ ID NO: 380158 - DNA, 25 bp, Mus musculus
tggatggagtgtaactggcggcccc

SEQ ID NO: 380159 - DNA, 25 bp, Mus musculus
tggatggagtgtaagtggcggcccc

SEQ ID NO: 380160 - DNA, 25 bp, Mus musculus
tggatggcagccatagattgtaagc

SEQ ID NO: 380161 - DNA, 25 bp, Mus musculus
tggatggcagctgtccggcagagag

SEQ ID NO: 380162 - DNA, 25 bp, Mus musculus
tggatggcgagaaataccagagggg

SEQ ID NO: 380163 - DNA, 25 bp, Mus musculus
tggatggctacggaatgtcacttgc

SEQ ID NO: 380164 - DNA, 25 bp, Mus musculus
tggatggctacggccatcttttttt

SEQ ID NO: 380165 - DNA, 25 bp, Mus musculus
tggatggcttttatgatcattttaa

SEQ ID NO: 380166 - DNA, 25 bp, Mus musculus
tggatgggagacaatcccagctggc

SEQ ID NO: 380167 - DNA, 25 bp, Mus musculus
tggatgggagacctggaaccctaca

SEQ ID NO: 380168 - DNA, 25 bp, Mus musculus
tggatgggagacgatctggacgtgg

SEQ ID NO: 380169 - DNA, 25 bp, Mus musculus
tggatggggggtgtgccagccttcc

SEQ ID NO: 380170 - DNA, 25 bp, Mus musculus
tggatgggtgaacgagcgtcagtgc

SEQ ID NO: 380171 - DNA, 25 bp, Mus musculus
tggatggtgacctgctggcaggggc

SEQ ID NO: 380172 - DNA, 25 bp, Mus musculus
tggatggtgctctgggtttcctgtg

SEQ ID NO: 380173 - DNA, 25 bp, Mus musculus
tggatgtaaagacctctcgggaact

SEQ ID NO: 380174 - DNA, 25 bp, Mus musculus
tggatgtacaaataaaagtcttact

SEQ ID NO: 380175 - DNA, 25 bp, Mus musculus
tggatgtactggacaaacaaacaaa

SEQ ID NO: 380176 - DNA, 25 bp, Mus musculus
tggatgtagagaaggccatcgccca

SEQ ID NO: 380177 - DNA, 25 bp, Mus musculus
tggatgtcagctctctgctggaaaa

SEQ ID NO: 380178 - DNA, 25 bp, Mus musculus
tggatgtcagttctgtgaacagatg

SEQ ID NO: 380179 - DNA, 25 bp, Mus musculus
tggatgtccaccatggtaggtgagc

SEQ ID NO: 380180 - DNA, 25 bp, Mus musculus
tggatgtccagctggctaacctcac

SEQ ID NO: 380181 - DNA, 25 bp, Mus musculus
tggatgtctctgcaccatcggtttg

SEQ ID NO: 380182 - DNA, 25 bp, Mus musculus
tggatgtgatgctttagatgagcag

SEQ ID NO: 380183 - DNA, 25 bp, Mus musculus
tggatgtgcagtattcccccacagc

SEQ ID NO: 380184 - DNA, 25 bp, Mus musculus
tggatgttcaaattggggaatggcg

SEQ ID NO: 380185 - DNA, 25 bp, Mus musculus
tggatgttcaattggcttcgtgagg

SEQ ID NO: 380186 - DNA, 25 bp, Mus musculus
tggatgttgaggttctctgctgccc

SEQ ID NO: 380187 - DNA, 25 bp, Mus musculus
tggatgttggcccagaggcagcttc

SEQ ID NO: 380188 - DNA, 25 bp, Mus musculus
tggatgttggcccagtgtcaccaga

SEQ ID NO: 380189 - DNA, 25 bp, Mus musculus
tggatgtttccaagtttggtgtgat

SEQ ID NO: 380190 - DNA, 25 bp, Mus musculus
tggattaaaaaggatcagttcttaa

SEQ ID NO: 380191 - DNA, 25 bp, Mus musculus
tggattaaaaagggccaaatccttg

SEQ ID NO: 380192 - DNA, 25 bp, Mus musculus
tggattaaaaagtgcctgcacccgc

SEQ ID NO: 380193 - DNA, 25 bp, Mus musculus
tggattaaagctatcccctctgcca

SEQ ID NO: 380194 - DNA, 25 bp, Mus musculus
tggattaaagctttctccttatgtc

SEQ ID NO: 380195 - DNA, 25 bp, Mus musculus
tggattaagtagaagaactatacta

SEQ ID NO: 380196 - DNA, 25 bp, Mus musculus
tggattacaagactccactgcaaaa

SEQ ID NO: 380197 - DNA, 25 bp, Mus musculus
tggattacaggtgaccaggactgtc

SEQ ID NO: 380198 - DNA, 25 bp, Mus musculus
tggattacaggtggtgctctgggtc

SEQ ID NO: 380199 - DNA, 25 bp, Mus musculus
tggattaccatctagatgttggctg

SEQ ID NO: 380200 - DNA, 25 bp, Mus musculus
tggattagcaccaggaatgtcactg

SEQ ID NO: 380201 - DNA, 25 bp, Mus musculus
tggattatctgaagagcccagagcg

SEQ ID NO: 380202 - DNA, 25 bp, Mus musculus
tggattatctgaaggcctgggagct

SEQ ID NO: 380203 - DNA, 25 bp, Mus musculus
tggattatgggtgggtgcatccttg

SEQ ID NO: 380204 - DNA, 25 bp, Mus musculus
tggattatggtccacagtgaggacc

SEQ ID NO: 380205 - DNA, 25 bp, Mus musculus
tggattattgggcttgggtgactca

SEQ ID NO: 380206 - DNA, 25 bp, Mus musculus
tggattcaaggggaagaagccagct

SEQ ID NO: 380207 - DNA, 25 bp, Mus musculus
tggattcaatcgaagatgctggtgg

SEQ ID NO: 380208 - DNA, 25 bp, Mus musculus
tggattcacaggaattcactgtgaa

SEQ ID NO: 380209 - DNA, 25 bp, Mus musculus
tggattcagaagaataccacaaccg

SEQ ID NO: 380210 - DNA, 25 bp, Mus musculus
tggattcagagtccagaactttcct

SEQ ID NO: 380211 - DNA, 25 bp, Mus musculus
tggattcagcatttaagcaaaactg

SEQ ID NO: 380212 - DNA, 25 bp, Mus musculus
tggattcaggctcggtcttttccgg

SEQ ID NO: 380213 - DNA, 25 bp, Mus musculus
tggattcagtggcgccgacatcgcc

SEQ ID NO: 380214 - DNA, 25 bp, Mus musculus
tggattcagtgggcagagccagcag

SEQ ID NO: 380215 - DNA, 25 bp, Mus musculus
tggattcagtttctttagaatgtga

SEQ ID NO: 380216 - DNA, 25 bp, Mus musculus
tggattcataggggcttcttctgcc

SEQ ID NO: 380217 - DNA, 25 bp, Mus musculus
tggattcatgactcaggcccacaat

SEQ ID NO: 380218 - DNA, 25 bp, Mus musculus
tggattccaaaatgccattctagtt

SEQ ID NO: 380219 - DNA, 25 bp, Mus musculus
tggattcccaggtgaggacacttgt

SEQ ID NO: 380220 - DNA, 25 bp, Mus musculus
tggattccttacagtgtcctagatg

SEQ ID NO: 380221 - DNA, 25 bp, Mus musculus
tggattcgctccggtgtaatggata

SEQ ID NO: 380222 - DNA, 25 bp, Mus musculus
tggattctcggagagtccttcttgt

SEQ ID NO: 380223 - DNA, 25 bp, Mus musculus
tggattctcggtgggagccagcgca

SEQ ID NO: 380224 - DNA, 25 bp, Mus musculus
tggattctgattgtggaagcttacc

SEQ ID NO: 380225 - DNA, 25 bp, Mus musculus
tggattgacaggtcccaggtcgctg

SEQ ID NO: 380226 - DNA, 25 bp, Mus musculus
tggattgacaggtctgaacggcgtt

SEQ ID NO: 380227 - DNA, 25 bp, Mus musculus
tggattgccgggagccaccatgttc

SEQ ID NO: 380228 - DNA, 25 bp, Mus musculus
tggattgccgggagctgaccggaag

SEQ ID NO: 380229 - DNA, 25 bp, Mus musculus
tggattggccggctatggggcatgg

SEQ ID NO: 380230 - DNA, 25 bp, Mus musculus
tggattggcttccaggaggcaggca

SEQ ID NO: 380231 - DNA, 25 bp, Mus musculus
tggattgggtttatgcagaactctc

SEQ ID NO: 380232 - DNA, 25 bp, Mus musculus
tggattgggtttgaactcggagagt

SEQ ID NO: 380233 - DNA, 25 bp, Mus musculus
tggattgtagaacttcaatgcagga

SEQ ID NO: 380234 - DNA, 25 bp, Mus musculus
tggattgtgaagccaccagcatctg

SEQ ID NO: 380235 - DNA, 25 bp, Mus musculus
tggattgtgaagccagtattcccct

SEQ ID NO: 380236 - DNA, 25 bp, Mus musculus
tggattgtggaaggggaggagcgct

SEQ ID NO: 380237 - DNA, 25 bp, Mus musculus
tggattgtgtgagagattggtgtcc

SEQ ID NO: 380238 - DNA, 25 bp, Mus musculus
tggatttaaccagagctgtctgtct

SEQ ID NO: 380239 - DNA, 25 bp, Mus musculus
tggatttaaccaggtgccagattta

SEQ ID NO: 380240 - DNA, 25 bp, Mus musculus
tggatttaaccattcaaaatgtagg

SEQ ID NO: 380241 - DNA, 25 bp, Mus musculus
tggatttaagattgagatttttttg

SEQ ID NO: 380242 - DNA, 25 bp, Mus musculus
tggatttagaggaggatatgatggt

SEQ ID NO: 380243 - DNA, 25 bp, Mus musculus
tggatttatccaggtgtgaaattga

SEQ ID NO: 380244 - DNA, 25 bp, Mus musculus
tggatttatgataaagctgctcaaa

SEQ ID NO: 380245 - DNA, 25 bp, Mus musculus
tggatttcaaatctaaagcgggaag

SEQ ID NO: 380246 - DNA, 25 bp, Mus musculus
tggatttcacagggggttcaccgtc

SEQ ID NO: 380247 - DNA, 25 bp, Mus musculus
tggatttcagattgccagatcagta

SEQ ID NO: 380248 - DNA, 25 bp, Mus musculus
tggatttcagattggtggaccttcc

SEQ ID NO: 380249 - DNA, 25 bp, Mus musculus
tggatttccaggcagtagaggcccg

SEQ ID NO: 380250 - DNA, 25 bp, Mus musculus
tggatttccaggccgtggtattcca

SEQ ID NO: 380251 - DNA, 25 bp, Mus musculus
tggatttgaaagagctgaatgataa

SEQ ID NO: 380252 - DNA, 25 bp, Mus musculus
tggatttgacggagccacggccgca

SEQ ID NO: 380253 - DNA, 25 bp, Mus musculus
tggatttgatagacgtgaacgaagc

SEQ ID NO: 380254 - DNA, 25 bp, Mus musculus
tggatttgccaactgtttctatact

SEQ ID NO: 380255 - DNA, 25 bp, Mus musculus
tggatttgccaagaggagctctggc

SEQ ID NO: 380256 - DNA, 25 bp, Mus musculus
tggatttgccaatgcccagcagagg

SEQ ID NO: 380257 - DNA, 25 bp, Mus musculus
tggatttgctcaaaccagaacttgt

SEQ ID NO: 380258 - DNA, 25 bp, Mus musculus
tggatttgctgagaggttttctcaa

SEQ ID NO: 380259 - DNA, 25 bp, Mus musculus
tggatttgctgagagtgctcacagg

SEQ ID NO: 380260 - DNA, 25 bp, Mus musculus
tggatttggggaatacacatgccaa

SEQ ID NO: 380261 - DNA, 25 bp, Mus musculus
tggatttgggggtcctgttacagaa

SEQ ID NO: 380262 - DNA, 25 bp, Mus musculus
tggatttgtggagtctggccacaga

SEQ ID NO: 380263 - DNA, 25 bp, Mus musculus
tggatttgtgggggccagaacaatg

SEQ ID NO: 380264 - DNA, 25 bp, Mus musculus
tggattttaaaaggaaacagacagc

SEQ ID NO: 380265 - DNA, 25 bp, Mus musculus
tggattttaagggtctcacaccagc

SEQ ID NO: 380266 - DNA, 25 bp, Mus musculus
tggattttaaggtgagactgtggag

SEQ ID NO: 380267 - DNA, 25 bp, Mus musculus
tggattttcgcaactgcgcaaacca

SEQ ID NO: 380268 - DNA, 25 bp, Mus musculus
tggattttcggcctggccgagtggt

SEQ ID NO: 380269 - DNA, 25 bp, Mus musculus
tggcaaaaaggtggtggagaaaaat

SEQ ID NO: 380270 - DNA, 25 bp, Mus musculus
tggcaaaaccaggtgcagatccctg

SEQ ID NO: 380271 - DNA, 25 bp, Mus musculus
tggcaaaagatgccagtctaattga

SEQ ID NO: 380272 - DNA, 25 bp, Mus musculus
tggcaaaagatgtgtggtatctctt

SEQ ID NO: 380273 - DNA, 25 bp, Mus musculus
tggcaaacacctccctctcccagta

SEQ ID NO: 380274 - DNA, 25 bp, Mus musculus
tggcaaacagtcagtgtgaatttga

SEQ ID NO: 380275 - DNA, 25 bp, Mus musculus
tggcaaaccatgacatgtactatgc

SEQ ID NO: 380276 - DNA, 25 bp, Mus musculus
tggcaaaccctatgtttgatgaccc

SEQ ID NO: 380277 - DNA, 25 bp, Mus musculus
tggcaaactgttctgcggtggaggg

SEQ ID NO: 380278 - DNA, 25 bp, Mus musculus
tggcaaactgttctgtggtggttcc

SEQ ID NO: 380279 - DNA, 25 bp, Mus musculus
tggcaaacttgcagtatgatgatgg

SEQ ID NO: 380280 - DNA, 25 bp, Mus musculus
tggcaaagaaaatagctccggtacc

SEQ ID NO: 380281 - DNA, 25 bp, Mus musculus
tggcaaagcaagagattcgagtaag

SEQ ID NO: 380282 - DNA, 25 bp, Mus musculus
tggcaaaggatctagatgagaatga

SEQ ID NO: 380283 - DNA, 25 bp, Mus musculus
tggcaaaggcttttggggcaggggc

SEQ ID NO: 380284 - DNA, 25 bp, Mus musculus
tggcaaaggcttttggggctgactt

SEQ ID NO: 380285 - DNA, 25 bp, Mus musculus
tggcaaaggtgggttccagcactgc

SEQ ID NO: 380286 - DNA, 25 bp, Mus musculus
tggcaaagtaggagttggcatccat

SEQ ID NO: 380287 - DNA, 25 bp, Mus musculus
tggcaaagttagagaacgtggagat

SEQ ID NO: 380288 - DNA, 25 bp, Mus musculus
tggcaaatggagtattggcttccct

SEQ ID NO: 380289 - DNA, 25 bp, Mus musculus
tggcaaatgtgagaatgaaactttg

SEQ ID NO: 380290 - DNA, 25 bp, Mus musculus
tggcaaatgtgagttgtctgttgat

SEQ ID NO: 380291 - DNA, 25 bp, Mus musculus
tggcaaatttccagaaatcaacact

SEQ ID NO: 380292 - DNA, 25 bp, Mus musculus
tggcaaatttccagggctatgtgct

SEQ ID NO: 380293 - DNA, 25 bp, Mus musculus
tggcaaattttggtgctggggacat

SEQ ID NO: 380294 - DNA, 25 bp, Mus musculus
tggcaacaacgctctggtgcaagtg

SEQ ID NO: 380295 - DNA, 25 bp, Mus musculus
tggcaacagcaaggtgcacatgtat

SEQ ID NO: 380296 - DNA, 25 bp, Mus musculus
tggcaacagcaagtgctgacagtag

SEQ ID NO: 380297 - DNA, 25 bp, Mus musculus
tggcaacagggtctctgtgatgagc

SEQ ID NO: 380298 - DNA, 25 bp, Mus musculus
tggcaaccagaatggggaatgcatc

SEQ ID NO: 380299 - DNA, 25 bp, Mus musculus
tggcaaccagcatctgatgacatgt

SEQ ID NO: 380300 - DNA, 25 bp, Mus musculus
tggcaaccaggaagctgccctcagc

SEQ ID NO: 380301 - DNA, 25 bp, Mus musculus
tggcaaccaggctgacaggggctgg

SEQ ID NO: 380302 - DNA, 25 bp, Mus musculus
tggcaacccagaactgatagtgcat

SEQ ID NO: 380303 - DNA, 25 bp, Mus musculus
tggcaacccagattgacttgatgca

SEQ ID NO: 380304 - DNA, 25 bp, Mus musculus
tggcaacctcctctgacctctgggg

SEQ ID NO: 380305 - DNA, 25 bp, Mus musculus
tggcaacctttctagatgatttaag

SEQ ID NO: 380306 - DNA, 25 bp, Mus musculus
tggcaacgaaaggtctccgggcaca

SEQ ID NO: 380307 - DNA, 25 bp, Mus musculus
tggcaacgagcggaggaggtcccag

SEQ ID NO: 380308 - DNA, 25 bp, Mus musculus
tggcaacgattcaagctcttgcttc

SEQ ID NO: 380309 - DNA, 25 bp, Mus musculus
tggcaacgattcaaggaggagcccc

SEQ ID NO: 380310 - DNA, 25 bp, Mus musculus
tggcaacgtttccaggtatgagatg

SEQ ID NO: 380311 - DNA, 25 bp, Mus musculus
tggcaacgtttccagtgcaaacata

SEQ ID NO: 380312 - DNA, 25 bp, Mus musculus
tggcaactatgacgctgatttccaa

SEQ ID NO: 380313 - DNA, 25 bp, Mus musculus
tggcaactcttattgggctgtgcct

SEQ ID NO: 380314 - DNA, 25 bp, Mus musculus
tggcaactcttattgttggaaatct

SEQ ID NO: 380315 - DNA, 25 bp, Mus musculus
tggcaactgagaacaaagcaacaag

SEQ ID NO: 380316 - DNA, 25 bp, Mus musculus
tggcaactgagaacaaagcaacaat

SEQ ID NO: 380317 - DNA, 25 bp, Mus musculus
tggcaagaactccagtgtttcccga

SEQ ID NO: 380318 - DNA, 25 bp, Mus musculus
tggcaagacggcttccttgtgggtg

SEQ ID NO: 380319 - DNA, 25 bp, Mus musculus
tggcaagagagatctccagtcctga

SEQ ID NO: 380320 - DNA, 25 bp, Mus musculus
tggcaagagagtgctaacagccaaa

SEQ ID NO: 380321 - DNA, 25 bp, Mus musculus
tggcaagagccagcagcagcagcag

SEQ ID NO: 380322 - DNA, 25 bp, Mus musculus
tggcaagagcgcagatctcccctag

SEQ ID NO: 380323 - DNA, 25 bp, Mus musculus
tggcaagagcgcaggtccaacttca

SEQ ID NO: 380324 - DNA, 25 bp, Mus musculus
tggcaagattaaagctaaggaatat

SEQ ID NO: 380325 - DNA, 25 bp, Mus musculus
tggcaagattaaaggaaccaatgaa

SEQ ID NO: 380326 - DNA, 25 bp, Mus musculus
tggcaagatttggacgacagtgatc

SEQ ID NO: 380327 - DNA, 25 bp, Mus musculus
tggcaagcaagaacaaggatgagag

SEQ ID NO: 380328 - DNA, 25 bp, Mus musculus
tggcaagcacgatctgcccatggaa

SEQ ID NO: 380329 - DNA, 25 bp, Mus musculus
tggcaaggacagtctcatgcttgca

SEQ ID NO: 380330 - DNA, 25 bp, Mus musculus
tggcaaggagctttggaacctccga

SEQ ID NO: 380331 - DNA, 25 bp, Mus musculus
tggcaagggaggaccgggctcatca

SEQ ID NO: 380332 - DNA, 25 bp, Mus musculus
tggcaagggagggcgtggacgggtg

SEQ ID NO: 380333 - DNA, 25 bp, Mus musculus
tggcaagtgctcaggaagactcttc

SEQ ID NO: 380334 - DNA, 25 bp, Mus musculus
tggcaagtgctcaggaggccatgac

SEQ ID NO: 380335 - DNA, 25 bp, Mus musculus
tggcaagtgctccggccattccagc

SEQ ID NO: 380336 - DNA, 25 bp, Mus musculus
tggcaagtggctgagtatctccaga

SEQ ID NO: 380337 - DNA, 25 bp, Mus musculus
tggcaagtttgggcctgccttaagt

SEQ ID NO: 380338 - DNA, 25 bp, Mus musculus
tggcaataacagtgactggtcctat

SEQ ID NO: 380339 - DNA, 25 bp, Mus musculus
tggcaataaggagaggatggctgtg

SEQ ID NO: 380340 - DNA, 25 bp, Mus musculus
tggcaataatggaagtgggaagagt

SEQ ID NO: 380341 - DNA, 25 bp, Mus musculus
tggcaatcctggttctcgtggtgaa

SEQ ID NO: 380342 - DNA, 25 bp, Mus musculus
tggcaatctatgattcctgtgttga

SEQ ID NO: 380343 - DNA, 25 bp, Mus musculus
tggcaatctcagagctaagtaaaaa

SEQ ID NO: 380344 - DNA, 25 bp, Mus musculus
tggcaatctcagtttgtgactctgt

SEQ ID NO: 380345 - DNA, 25 bp, Mus musculus
tggcaatgacattggtccctatggt

SEQ ID NO: 380346 - DNA, 25 bp, Mus musculus
tggcaatgactggtgtccactccca

SEQ ID NO: 380347 - DNA, 25 bp, Mus musculus
tggcaatgactgtcattttagtgaa

SEQ ID NO: 380348 - DNA, 25 bp, Mus musculus
tggcaatgatggaagcaattttgga

SEQ ID NO: 380349 - DNA, 25 bp, Mus musculus
tggcaatgatggtggctatggcggt

SEQ ID NO: 380350 - DNA, 25 bp, Mus musculus
tggcaatgatggtggttatggagga

SEQ ID NO: 380351 - DNA, 25 bp, Mus musculus
tggcaatgcaaaacttgcagtaatg

SEQ ID NO: 380352 - DNA, 25 bp, Mus musculus
tggcaatgccaggtggcccagagtg

SEQ ID NO: 380353 - DNA, 25 bp, Mus musculus
tggcaatgccaggttgaacgacatg

SEQ ID NO: 380354 - DNA, 25 bp, Mus musculus
tggcaatggcagaaagaactcacgg

SEQ ID NO: 380355 - DNA, 25 bp, Mus musculus
tggcaatggcagtgagcaccactct

SEQ ID NO: 380356 - DNA, 25 bp, Mus musculus
tggcaatgtccaggaccgcattggt

SEQ ID NO: 380357 - DNA, 25 bp, Mus musculus
tggcaattcaggttcattttgctgg

SEQ ID NO: 380358 - DNA, 25 bp, Mus musculus
tggcaattcaggttcccaggtggtg

SEQ ID NO: 380359 - DNA, 25 bp, Mus musculus
tggcaattcaggttctcttgccaca

SEQ ID NO: 380360 - DNA, 25 bp, Mus musculus
tggcaatttcaaggcaactttccac

SEQ ID NO: 380361 - DNA, 25 bp, Mus musculus
tggcacaaacaaatgacatgttttt

SEQ ID NO: 380362 - DNA, 25 bp, Mus musculus
tggcacaacagtggggtgagtttaa

SEQ ID NO: 380363 - DNA, 25 bp, Mus musculus
tggcacaactctagagaagtttatt

SEQ ID NO: 380364 - DNA, 25 bp, Mus musculus
tggcacaagacgatacagcacgggc

SEQ ID NO: 380365 - DNA, 25 bp, Mus musculus
tggcacaagacggatcttgaaacag

SEQ ID NO: 380366 - DNA, 25 bp, Mus musculus
tggcacaatcaggcgacaggtgaac

SEQ ID NO: 380367 - DNA, 25 bp, Mus musculus
tggcacaatcaggttcttgagagga

SEQ ID NO: 380368 - DNA, 25 bp, Mus musculus
tggcacacaatctgccattatttgc

SEQ ID NO: 380369 - DNA, 25 bp, Mus musculus
tggcacacagaaaggggagtgtgtt

SEQ ID NO: 380370 - DNA, 25 bp, Mus musculus
tggcacagaagatgctgacaaatct

SEQ ID NO: 380371 - DNA, 25 bp, Mus musculus
tggcacagacatgatggtgggcatt

SEQ ID NO: 380372 - DNA, 25 bp, Mus musculus
tggcacagcaggacgcagagaccac

SEQ ID NO: 380373 - DNA, 25 bp, Mus musculus
tggcacagcagttccgcagaggacg

SEQ ID NO: 380374 - DNA, 25 bp, Mus musculus
tggcacagctccgggaggcctttga

SEQ ID NO: 380375 - DNA, 25 bp, Mus musculus
tggcacaggagagggaggcctggag

SEQ ID NO: 380376 - DNA, 25 bp, Mus musculus
tggcacaggaggcctggaggagctg

SEQ ID NO: 380377 - DNA, 25 bp, Mus musculus
tggcacatacgtgcagttctccgtg

SEQ ID NO: 380378 - DNA, 25 bp, Mus musculus
tggcacatgtttcagaaatgaagca

SEQ ID NO: 380379 - DNA, 25 bp, Mus musculus
tggcacatgtttcagccggatacca

SEQ ID NO: 380380 - DNA, 25 bp, Mus musculus
tggcacattcaaggacatcgaggaa

SEQ ID NO: 380381 - DNA, 25 bp, Mus musculus
tggcacattcaaggactgggctgac

SEQ ID NO: 380382 - DNA, 25 bp, Mus musculus
tggcacatttccagcgttcccaggc

SEQ ID NO: 380383 - DNA, 25 bp, Mus musculus
tggcacatttccagcgttcccatgc

SEQ ID NO: 380384 - DNA, 25 bp, Mus musculus
tggcaccacacgctacaggtacatc

SEQ ID NO: 380385 - DNA, 25 bp, Mus musculus
tggcaccagaggtattagaagataa

SEQ ID NO: 380386 - DNA, 25 bp, Mus musculus
tggcaccaggacttggagagctgtc

SEQ ID NO: 380387 - DNA, 25 bp, Mus musculus
tggcaccagtgggaggtctggactc

SEQ ID NO: 380388 - DNA, 25 bp, Mus musculus
tggcaccatcaccaaaaatgggtac

SEQ ID NO: 380389 - DNA, 25 bp, Mus musculus
tggcaccatcaccaagtcggatgct

SEQ ID NO: 380390 - DNA, 25 bp, Mus musculus
tggcacccaaatgcctggggaggat

SEQ ID NO: 380391 - DNA, 25 bp, Mus musculus
tggcacccaaatgttgataaaaatg

SEQ ID NO: 380392 - DNA, 25 bp, Mus musculus
tggcacccaagaatcagagcgagag

SEQ ID NO: 380393 - DNA, 25 bp, Mus musculus
tggcacccaagctttcagatgcagt

SEQ ID NO: 380394 - DNA, 25 bp, Mus musculus
tggcacccagaaggacctcttaaag

SEQ ID NO: 380395 - DNA, 25 bp, Mus musculus
tggcacccaggcacggagggagttg

SEQ ID NO: 380396 - DNA, 25 bp, Mus musculus
tggcacccaggcgcgaagggagctg

SEQ ID NO: 380397 - DNA, 25 bp, Mus musculus
tggcacccaggtacgcagggaatac

SEQ ID NO: 380398 - DNA, 25 bp, Mus musculus
tggcacccgagctaggggaagacac

SEQ ID NO: 380399 - DNA, 25 bp, Mus musculus
tggcacctgaggacaaagtctggag

SEQ ID NO: 380400 - DNA, 25 bp, Mus musculus
tggcacctggggtggaggcagggaa

SEQ ID NO: 380401 - DNA, 25 bp, Mus musculus
tggcaccttcagaggcagagagaga

SEQ ID NO: 380402 - DNA, 25 bp, Mus musculus
tggcaccttcagctacatcaggtag

SEQ ID NO: 380403 - DNA, 25 bp, Mus musculus
tggcaccttccggcagaaaggtgtt

SEQ ID NO: 380404 - DNA, 25 bp, Mus musculus
tggcacgaaatcctagtttcgtcct

SEQ ID NO: 380405 - DNA, 25 bp, Mus musculus
tggcacgaattgcagcatttgctga

SEQ ID NO: 380406 - DNA, 25 bp, Mus musculus
tggcacggaggcaagaaggagttaa

SEQ ID NO: 380407 - DNA, 25 bp, Mus musculus
tggcacggagtggactgctggatcc

SEQ ID NO: 380408 - DNA, 25 bp, Mus musculus
tggcacggcaggattcacagatgga

SEQ ID NO: 380409 - DNA, 25 bp, Mus musculus
tggcacgtctgcagctggtgagccg

SEQ ID NO: 380410 - DNA, 25 bp, Mus musculus
tggcactaacagaacctttagaagt

SEQ ID NO: 380411 - DNA, 25 bp, Mus musculus
tggcactaaggctggtgttcccggc

SEQ ID NO: 380412 - DNA, 25 bp, Mus musculus
tggcactacagatgctcatgacatc

SEQ ID NO: 380413 - DNA, 25 bp, Mus musculus
tggcactactggcctgcccaaggct

SEQ ID NO: 380414 - DNA, 25 bp, Mus musculus
tggcactcagggagcatggcactct

SEQ ID NO: 380415 - DNA, 25 bp, Mus musculus
tggcactgaaaagaggacagaacta

SEQ ID NO: 380416 - DNA, 25 bp, Mus musculus
tggcactgaaaagggttcccagccc

SEQ ID NO: 380417 - DNA, 25 bp, Mus musculus
tggcactgaggtgagggaaccagac

SEQ ID NO: 380418 - DNA, 25 bp, Mus musculus
tggcactgaggtttgggaaccagac

SEQ ID NO: 380419 - DNA, 25 bp, Mus musculus
tggcactgattggtgctgtcagatg

SEQ ID NO: 380420 - DNA, 25 bp, Mus musculus
tggcactgcagagcaaaaaaacact

SEQ ID NO: 380421 - DNA, 25 bp, Mus musculus
tggcactgcagctgctcctggcaca

SEQ ID NO: 380422 - DNA, 25 bp, Mus musculus
tggcactgcaggaagaagaggaaag

SEQ ID NO: 380423 - DNA, 25 bp, Mus musculus
tggcactgcagtggagaaagcatgc

SEQ ID NO: 380424 - DNA, 25 bp, Mus musculus
tggcactgcctagagacttcctgct

SEQ ID NO: 380425 - DNA, 25 bp, Mus musculus
tggcactgtcctcccagtggcacag

SEQ ID NO: 380426 - DNA, 25 bp, Mus musculus
tggcacttccattatcggaatgtgc

SEQ ID NO: 380427 - DNA, 25 bp, Mus musculus
tggcacttccggcagctccgtaacc

SEQ ID NO: 380428 - DNA, 25 bp, Mus musculus
tggcacttggtgagagccctgaaga

SEQ ID NO: 380429 - DNA, 25 bp, Mus musculus
tggcagaaagcaaaaaattgcaaat

SEQ ID NO: 380430 - DNA, 25 bp, Mus musculus
tggcagaaagcagtgagtacggctc

SEQ ID NO: 380431 - DNA, 25 bp, Mus musculus
tggcagaaagggctgaggccacgcc

SEQ ID NO: 380432 - DNA, 25 bp, Mus musculus
tggcagaagaggagaaagagaaaaa

SEQ ID NO: 380433 - DNA, 25 bp, Mus musculus
tggcagaagctcttggcatttgtga

SEQ ID NO: 380434 - DNA, 25 bp, Mus musculus
tggcagaaggcacagatggacagat

SEQ ID NO: 380435 - DNA, 25 bp, Mus musculus
tggcagaaggcacaggtgaaggaga

SEQ ID NO: 380436 - DNA, 25 bp, Mus musculus
tggcagaaggttctctctcttgcct

SEQ ID NO: 380437 - DNA, 25 bp, Mus musculus
tggcagaagtagagaaggatgtcca

SEQ ID NO: 380438 - DNA, 25 bp, Mus musculus
tggcagaatgagaatgtgattctgc

SEQ ID NO: 380439 - DNA, 25 bp, Mus musculus
tggcagacagagaggctccgcagga

SEQ ID NO: 380440 - DNA, 25 bp, Mus musculus
tggcagacccgagttgaaaaatctg

SEQ ID NO: 380441 - DNA, 25 bp, Mus musculus
tggcagacgtgttcaattttcacag

SEQ ID NO: 380442 - DNA, 25 bp, Mus musculus
tggcagacgtgttcacattctggtg

SEQ ID NO: 380443 - DNA, 25 bp, Mus musculus
tggcagacgtgttcagattccagca

SEQ ID NO: 380444 - DNA, 25 bp, Mus musculus
tggcagacttcttctcctcggacca

SEQ ID NO: 380445 - DNA, 25 bp, Mus musculus
tggcagagaacgaatcttggagaga

SEQ ID NO: 380446 - DNA, 25 bp, Mus musculus
tggcagagaactacttgtctaccca

SEQ ID NO: 380447 - DNA, 25 bp, Mus musculus
tggcagagaagcaacatggcttctg

SEQ ID NO: 380448 - DNA, 25 bp, Mus musculus
tggcagagaagcaataccacatcac

SEQ ID NO: 380449 - DNA, 25 bp, Mus musculus
tggcagagaagcttaagtgtgatac

SEQ ID NO: 380450 - DNA, 25 bp, Mus musculus
tggcagagaaggaggccgcatccac

SEQ ID NO: 380451 - DNA, 25 bp, Mus musculus
tggcagagaaggcagtattgcaaca

SEQ ID NO: 380452 - DNA, 25 bp, Mus musculus
tggcagagaagggcaaacattgtat

SEQ ID NO: 380453 - DNA, 25 bp, Mus musculus
tggcagagacggagggcatgctcaa

SEQ ID NO: 380454 - DNA, 25 bp, Mus musculus
tggcagagctaaagggtttggatcc

SEQ ID NO: 380455 - DNA, 25 bp, Mus musculus
tggcagaggaggctccgtgcccgca

SEQ ID NO: 380456 - DNA, 25 bp, Mus musculus
tggcagaggaggtccaactgagccc

SEQ ID NO: 380457 - DNA, 25 bp, Mus musculus
tggcagaggagtgacatcactgagg

SEQ ID NO: 380458 - DNA, 25 bp, Mus musculus
tggcagaggcctgcctcaaaatgca

SEQ ID NO: 380459 - DNA, 25 bp, Mus musculus
tggcagaggtgagtaaaaagaagaa

SEQ ID NO: 380460 - DNA, 25 bp, Mus musculus
tggcagaggtggataactgcacaag

SEQ ID NO: 380461 - DNA, 25 bp, Mus musculus
tggcagagtcccgttgccgagagat

SEQ ID NO: 380462 - DNA, 25 bp, Mus musculus
tggcagagtctaagtgttctgagct

SEQ ID NO: 380463 - DNA, 25 bp, Mus musculus
tggcagatgaggagaaaaagttacg

SEQ ID NO: 380464 - DNA, 25 bp, Mus musculus
tggcagatgccccaaatattcttac

SEQ ID NO: 380465 - DNA, 25 bp, Mus musculus
tggcagatgctcaggtatgggctta

SEQ ID NO: 380466 - DNA, 25 bp, Mus musculus
tggcagcaaacccctccccctccgc

SEQ ID NO: 380467 - DNA, 25 bp, Mus musculus
tggcagcaaagatccctccccgcgg

SEQ ID NO: 380468 - DNA, 25 bp, Mus musculus
tggcagcaatgctggctttcaatgt

SEQ ID NO: 380469 - DNA, 25 bp, Mus musculus
tggcagcaatggaagcccctaagat

SEQ ID NO: 380470 - DNA, 25 bp, Mus musculus
tggcagcacagatacctttatcaat

SEQ ID NO: 380471 - DNA, 25 bp, Mus musculus
tggcagcacagcttagaaccatacc

SEQ ID NO: 380472 - DNA, 25 bp, Mus musculus
tggcagcaccgggctaaagaagccc

SEQ ID NO: 380473 - DNA, 25 bp, Mus musculus
tggcagcagcccaaatgacccagtg

SEQ ID NO: 380474 - DNA, 25 bp, Mus musculus
tggcagcagcctttggcctctctgt

SEQ ID NO: 380475 - DNA, 25 bp, Mus musculus
tggcagcagcctttggtgcgcccgg

SEQ ID NO: 380476 - DNA, 25 bp, Mus musculus
tggcagcagcttctaggtgcgcccg

SEQ ID NO: 380477 - DNA, 25 bp, Mus musculus
tggcagccaaacatgatactggatg

SEQ ID NO: 380478 - DNA, 25 bp, Mus musculus
tggcagccaccagaggtgatccaac

SEQ ID NO: 380479 - DNA, 25 bp, Mus musculus
tggcagccagatgaggatgatgcca

SEQ ID NO: 380480 - DNA, 25 bp, Mus musculus
tggcagccatggtcacgtctctggg

SEQ ID NO: 380481 - DNA, 25 bp, Mus musculus
tggcagcccaaggattccagctttc

SEQ ID NO: 380482 - DNA, 25 bp, Mus musculus
tggcagcccaagtctttgcagattc

SEQ ID NO: 380483 - DNA, 25 bp, Mus musculus
tggcagccccttgagtatggcaaga

SEQ ID NO: 380484 - DNA, 25 bp, Mus musculus
tggcagcctgtcaacaatggctcaa

SEQ ID NO: 380485 - DNA, 25 bp, Mus musculus
tggcagcctgtcaagaatatcgcca

SEQ ID NO: 380486 - DNA, 25 bp, Mus musculus
tggcagcgaagatcacaaggtttac

SEQ ID NO: 380487 - DNA, 25 bp, Mus musculus
tggcagcgaaggcctccttgaacat

SEQ ID NO: 380488 - DNA, 25 bp, Mus musculus
tggcagcgataggaaggacctggat

SEQ ID NO: 380489 - DNA, 25 bp, Mus musculus
tggcagcgataggcttcattctcat

SEQ ID NO: 380490 - DNA, 25 bp, Mus musculus
tggcagcgatagggcttacccactc

SEQ ID NO: 380491 - DNA, 25 bp, Mus musculus
tggcagcgataggtcacttgcccag

SEQ ID NO: 380492 - DNA, 25 bp, Mus musculus
tggcagcgtgtcaacccaaagttta

SEQ ID NO: 380493 - DNA, 25 bp, Mus musculus
tggcagcgtgtttcccacgacagca

SEQ ID NO: 380494 - DNA, 25 bp, Mus musculus
tggcagctagagagaattccagaat

SEQ ID NO: 380495 - DNA, 25 bp, Mus musculus
tggcagctagagaggacccttatgg

SEQ ID NO: 380496 - DNA, 25 bp, Mus musculus
tggcagctatgggaaagagatacca

SEQ ID NO: 380497 - DNA, 25 bp, Mus musculus
tggcagctcaacaaggagctggtga

SEQ ID NO: 380498 - DNA, 25 bp, Mus musculus
tggcagctcctccggcactttgaca

SEQ ID NO: 380499 - DNA, 25 bp, Mus musculus
tggcagctcctccggtacaaggttc

SEQ ID NO: 380500 - DNA, 25 bp, Mus musculus
tggcagctgagaaacttggaaaaga

SEQ ID NO: 380501 - DNA, 25 bp, Mus musculus
tggcaggaacacacagtggggaggg

SEQ ID NO: 380502 - DNA, 25 bp, Mus musculus
tggcaggaagccagatatctcacag

SEQ ID NO: 380503 - DNA, 25 bp, Mus musculus
tggcaggaaggagactgcggcccac

SEQ ID NO: 380504 - DNA, 25 bp, Mus musculus
tggcaggaaggccatattgacacac

SEQ ID NO: 380505 - DNA, 25 bp, Mus musculus
tggcaggaaggccatcttgacacac

SEQ ID NO: 380506 - DNA, 25 bp, Mus musculus
tggcaggagaaggaggtggtggaga

SEQ ID NO: 380507 - DNA, 25 bp, Mus musculus
tggcaggagacaagaacttcatcac

SEQ ID NO: 380508 - DNA, 25 bp, Mus musculus
tggcaggagacctagaacttcatca

SEQ ID NO: 380509 - DNA, 25 bp, Mus musculus
tggcaggaggcagaaaggatgagcg

SEQ ID NO: 380510 - DNA, 25 bp, Mus musculus
tggcaggaggcaggtcattcattca

SEQ ID NO: 380511 - DNA, 25 bp, Mus musculus
tggcaggagggacagcgtccgatgc

SEQ ID NO: 380512 - DNA, 25 bp, Mus musculus
tggcaggatgggagcctcctgccta

SEQ ID NO: 380513 - DNA, 25 bp, Mus musculus
tggcaggatgggccaccgctgactg

SEQ ID NO: 380514 - DNA, 25 bp, Mus musculus
tggcaggattacaggactggatcct

SEQ ID NO: 380515 - DNA, 25 bp, Mus musculus
tggcaggattacaggcgaccccctc

SEQ ID NO: 380516 - DNA, 25 bp, Mus musculus
tggcaggcagtgtggattgtctgga

SEQ ID NO: 380517 - DNA, 25 bp, Mus musculus
tggcaggcctaggagatgcaagttg

SEQ ID NO: 380518 - DNA, 25 bp, Mus musculus
tggcaggcctaggaggggcgtccaa

SEQ ID NO: 380519 - DNA, 25 bp, Mus musculus
tggcaggctctgtcccaggtaaatc

SEQ ID NO: 380520 - DNA, 25 bp, Mus musculus
tggcaggctgcaggagctcttaggg

SEQ ID NO: 380521 - DNA, 25 bp, Mus musculus
tggcaggctgcaggtaactagttct

SEQ ID NO: 380522 - DNA, 25 bp, Mus musculus
tggcagggactggtccagcacctgc

SEQ ID NO: 380523 - DNA, 25 bp, Mus musculus
tggcagggccgaggcccgatttccc

SEQ ID NO: 380524 - DNA, 25 bp, Mus musculus
tggcagggctaacttcccgctcggc

SEQ ID NO: 380525 - DNA, 25 bp, Mus musculus
tggcagggctgagagatgggaaaga

SEQ ID NO: 380526 - DNA, 25 bp, Mus musculus
tggcaggtcccaagggtgcccctgg

SEQ ID NO: 380527 - DNA, 25 bp, Mus musculus
tggcaggtgtccctgccgtgtgtct

SEQ ID NO: 380528 - DNA, 25 bp, Mus musculus
tggcagtaactggcaagaagacagc

SEQ ID NO: 380529 - DNA, 25 bp, Mus musculus
tggcagtaccgagaggtcgactcat

SEQ ID NO: 380530 - DNA, 25 bp, Mus musculus
tggcagtacttcaagagcctgcaca

SEQ ID NO: 380531 - DNA, 25 bp, Mus musculus
tggcagtagctcagcttcttcagct

SEQ ID NO: 380532 - DNA, 25 bp, Mus musculus
tggcagtagctcaggaatgtcaagt

SEQ ID NO: 380533 - DNA, 25 bp, Mus musculus
tggcagtcacaggttggatgaaaaa

SEQ ID NO: 380534 - DNA, 25 bp, Mus musculus
tggcagtcagcaaacaaaaccgggg

SEQ ID NO: 380535 - DNA, 25 bp, Mus musculus
tggcagtcagcaaccaccctcccct

SEQ ID NO: 380536 - DNA, 25 bp, Mus musculus
tggcagtgaaacagctgggtgttaa

SEQ ID NO: 380537 - DNA, 25 bp, Mus musculus
tggcagtgaagcggatacgggccac

SEQ ID NO: 380538 - DNA, 25 bp, Mus musculus
tggcagtgagatccgccatcgcgat

SEQ ID NO: 380539 - DNA, 25 bp, Mus musculus
tggcagtgcaggggtacgcacgcgg

SEQ ID NO: 380540 - DNA, 25 bp, Mus musculus
tggcagtgctcataggaattcactg

SEQ ID NO: 380541 - DNA, 25 bp, Mus musculus
tggcagtggccagacaggtggagtc

SEQ ID NO: 380542 - DNA, 25 bp, Mus musculus
tggcagtggtggtgaccaaccactt

SEQ ID NO: 380543 - DNA, 25 bp, Mus musculus
tggcagtgtgcagatttgtgaataa

SEQ ID NO: 380544 - DNA, 25 bp, Mus musculus
tggcagttatatcaggggtcggcac

SEQ ID NO: 380545 - DNA, 25 bp, Mus musculus
tggcagttgcgggagtgggaggtgc

SEQ ID NO: 380546 - DNA, 25 bp, Mus musculus
tggcagttttgggggctcgccatac

SEQ ID NO: 380547 - DNA, 25 bp, Mus musculus
tggcagttttttgcatgttacatgg

SEQ ID NO: 380548 - DNA, 25 bp, Mus musculus
tggcatactacaggatctatgggca

SEQ ID NO: 380549 - DNA, 25 bp, Mus musculus
tggcatagttggagcgataggtctc

SEQ ID NO: 380550 - DNA, 25 bp, Mus musculus
tggcatatcagccatggacggagtc

SEQ ID NO: 380551 - DNA, 25 bp, Mus musculus
tggcatatgacatagcttgtgacga

SEQ ID NO: 380552 - DNA, 25 bp, Mus musculus
tggcatatgagcagatgaaacggct

SEQ ID NO: 380553 - DNA, 25 bp, Mus musculus
tggcatcaagaaaggctccgtgctg

SEQ ID NO: 380554 - DNA, 25 bp, Mus musculus
tggcatcaaggagacatcaacaagg

SEQ ID NO: 380555 - DNA, 25 bp, Mus musculus
tggcatcaaggagcaggacatcaac

SEQ ID NO: 380556 - DNA, 25 bp, Mus musculus
tggcatcaatcatggaaaggatttg

SEQ ID NO: 380557 - DNA, 25 bp, Mus musculus
tggcatcacgggagacaatgtccga

SEQ ID NO: 380558 - DNA, 25 bp, Mus musculus
tggcatcagagccaaggctaaactc

SEQ ID NO: 380559 - DNA, 25 bp, Mus musculus
tggcatcatacaagtttgtgtggcc

SEQ ID NO: 380560 - DNA, 25 bp, Mus musculus
tggcatcataggtggcatcatggca

SEQ ID NO: 380561 - DNA, 25 bp, Mus musculus
tggcatcatgggagcaggctgcact

SEQ ID NO: 380562 - DNA, 25 bp, Mus musculus
tggcatcatggtcaaaaatgctgct

SEQ ID NO: 380563 - DNA, 25 bp, Mus musculus
tggcatcatttgtaccatctgtacc

SEQ ID NO: 380564 - DNA, 25 bp, Mus musculus
tggcatccaaggtccagggagttgg

SEQ ID NO: 380565 - DNA, 25 bp, Mus musculus
tggcatccaggtgcgctacctgaaa

SEQ ID NO: 380566 - DNA, 25 bp, Mus musculus
tggcatcccgactgtgatctgtgag

SEQ ID NO: 380567 - DNA, 25 bp, Mus musculus
tggcatccttatcagacgaaagagc

SEQ ID NO: 380568 - DNA, 25 bp, Mus musculus
tggcatcgctggtgaggaaccacag

SEQ ID NO: 380569 - DNA, 25 bp, Mus musculus
tggcatcgctggtgggggcgctcct

SEQ ID NO: 380570 - DNA, 25 bp, Mus musculus
tggcatcgtcaagaccactgggagg

SEQ ID NO: 380571 - DNA, 25 bp, Mus musculus
tggcatcgtcacatgatcatggata

SEQ ID NO: 380572 - DNA, 25 bp, Mus musculus
tggcatctaattcagatcatgattc

SEQ ID NO: 380573 - DNA, 25 bp, Mus musculus
tggcatctacaaggctcacttgtat

SEQ ID NO: 380574 - DNA, 25 bp, Mus musculus
tggcatctacaagggcgccaaagca

SEQ ID NO: 380575 - DNA, 25 bp, Mus musculus
tggcatctcaagagttctatccagg

SEQ ID NO: 380576 - DNA, 25 bp, Mus musculus
tggcatctcaagcctccagaggtga

SEQ ID NO: 380577 - DNA, 25 bp, Mus musculus
tggcatctcaagcctccggtcagcg

SEQ ID NO: 380578 - DNA, 25 bp, Mus musculus
tggcatctcagatacgaacagaaca

SEQ ID NO: 380579 - DNA, 25 bp, Mus musculus
tggcatctgcaatgccgcgccagtt

SEQ ID NO: 380580 - DNA, 25 bp, Mus musculus
tggcatctggaaagacaggagctta

SEQ ID NO: 380581 - DNA, 25 bp, Mus musculus
tggcatctggaaaggtttccaaaat

SEQ ID NO: 380582 - DNA, 25 bp, Mus musculus
tggcatcttgaaggtaagtgacctg

SEQ ID NO: 380583 - DNA, 25 bp, Mus musculus
tggcatgaaaaggcccttgctgctg

SEQ ID NO: 380584 - DNA, 25 bp, Mus musculus
tggcatgaaaggaggaagcggctgg

SEQ ID NO: 380585 - DNA, 25 bp, Mus musculus
tggcatgaaaggcccagcttcggtc

SEQ ID NO: 380586 - DNA, 25 bp, Mus musculus
tggcatgaaaggttttgttttgttt

SEQ ID NO: 380587 - DNA, 25 bp, Mus musculus
tggcatgaccaagatgccaaagacc

SEQ ID NO: 380588 - DNA, 25 bp, Mus musculus
tggcatgaccaaggtacttcctgga

SEQ ID NO: 380589 - DNA, 25 bp, Mus musculus
tggcatgaccaagttcatgaagcct

SEQ ID NO: 380590 - DNA, 25 bp, Mus musculus
tggcatgatctttagaagactgctg

SEQ ID NO: 380591 - DNA, 25 bp, Mus musculus
tggcatgatgtgaggcactaagtga

SEQ ID NO: 380592 - DNA, 25 bp, Mus musculus
tggcatgcagctccatgactggaaa

SEQ ID NO: 380593 - DNA, 25 bp, Mus musculus
tggcatgcaggtgtaccagctggac

SEQ ID NO: 380594 - DNA, 25 bp, Mus musculus
tggcatgccaggtactgctggagag

SEQ ID NO: 380595 - DNA, 25 bp, Mus musculus
tggcatgccagtgaagagagagcta

SEQ ID NO: 380596 - DNA, 25 bp, Mus musculus
tggcatgcggcctcctcctccaggc

SEQ ID NO: 380597 - DNA, 25 bp, Mus musculus
tggcatggaagatgaaagagaagat

SEQ ID NO: 380598 - DNA, 25 bp, Mus musculus
tggcatggacgagatggcagttgag

SEQ ID NO: 380599 - DNA, 25 bp, Mus musculus
tggcatggagccagaccactcggcc

SEQ ID NO: 380600 - DNA, 25 bp, Mus musculus
tggcatggatgaagaactcgacagc

SEQ ID NO: 380601 - DNA, 25 bp, Mus musculus
tggcatggcacccaggcacggaggg

SEQ ID NO: 380602 - DNA, 25 bp, Mus musculus
tggcatggcacccaggcgcgaaggg

SEQ ID NO: 380603 - DNA, 25 bp, Mus musculus
tggcatggcacccaggtacgcaggg

SEQ ID NO: 380604 - DNA, 25 bp, Mus musculus
tggcatgggatggagagtctgtatt

SEQ ID NO: 380605 - DNA, 25 bp, Mus musculus
tggcatgggatgggggacagctgtt

SEQ ID NO: 380606 - DNA, 25 bp, Mus musculus
tggcatggtagaaagatctaaaggg

SEQ ID NO: 380607 - DNA, 25 bp, Mus musculus
tggcatggtagaaaggcctttgtag

SEQ ID NO: 380608 - DNA, 25 bp, Mus musculus
tggcatgtctaagccaatcaaagtt

SEQ ID NO: 380609 - DNA, 25 bp, Mus musculus
tggcatgtggctcctacccaggtcc

SEQ ID NO: 380610 - DNA, 25 bp, Mus musculus
tggcatgtggctcgacatgaacgaa

SEQ ID NO: 380611 - DNA, 25 bp, Mus musculus
tggcatgttcccaaatagctttctg

SEQ ID NO: 380612 - DNA, 25 bp, Mus musculus
tggcatgtttattagtggaatcttt

SEQ ID NO: 380613 - DNA, 25 bp, Mus musculus
tggcattaagcactgaatgcacagg

SEQ ID NO: 380614 - DNA, 25 bp, Mus musculus
tggcattatggactggcatgcacac

SEQ ID NO: 380615 - DNA, 25 bp, Mus musculus
tggcattgatgcgtgcagggcgaca

SEQ ID NO: 380616 - DNA, 25 bp, Mus musculus
tggcattgatggtgaccgaggtcca

SEQ ID NO: 380617 - DNA, 25 bp, Mus musculus
tggcattgcagatttatttcctggg

SEQ ID NO: 380618 - DNA, 25 bp, Mus musculus
tggcattgcaggccgaggagaatct

SEQ ID NO: 380619 - DNA, 25 bp, Mus musculus
tggcattgggattccaggcatagtc

SEQ ID NO: 380620 - DNA, 25 bp, Mus musculus
tggcattgtgaggggagctgttgtg

SEQ ID NO: 380621 - DNA, 25 bp, Mus musculus
tggcattgtgaggggtgttctgtag

SEQ ID NO: 380622 - DNA, 25 bp, Mus musculus
tggcatttctgatgggcagccccat

SEQ ID NO: 380623 - DNA, 25 bp, Mus musculus
tggcatttctgtggctaacttcgac

SEQ ID NO: 380624 - DNA, 25 bp, Mus musculus
tggccaaaataaaggattcacagaa

SEQ ID NO: 380625 - DNA, 25 bp, Mus musculus
tggccaaaatttatgagaagatctt

SEQ ID NO: 380626 - DNA, 25 bp, Mus musculus
tggccaaaatttcctctgtgaagct

SEQ ID NO: 380627 - DNA, 25 bp, Mus musculus
tggccaaacgaaagctgggctctcc

SEQ ID NO: 380628 - DNA, 25 bp, Mus musculus
tggccaaagaccctatcgtcaacgt

SEQ ID NO: 380629 - DNA, 25 bp, Mus musculus
tggccaaagacccttctggagaggt

SEQ ID NO: 380630 - DNA, 25 bp, Mus musculus
tggccaaagcctacagacacagagg

SEQ ID NO: 380631 - DNA, 25 bp, Mus musculus
tggccaaagttatctccctaggcga

SEQ ID NO: 380632 - DNA, 25 bp, Mus musculus
tggccaaatccttcgcgtctcagaa

SEQ ID NO: 380633 - DNA, 25 bp, Mus musculus
tggccaaatggcaccgctccaaaga

SEQ ID NO: 380634 - DNA, 25 bp, Mus musculus
tggccaacaagagtcctcgttgaaa

SEQ ID NO: 380635 - DNA, 25 bp, Mus musculus
tggccaacaagagtgatctgtcccc

SEQ ID NO: 380636 - DNA, 25 bp, Mus musculus
tggccaacaaggtcgtatacaacgt

SEQ ID NO: 380637 - DNA, 25 bp, Mus musculus
tggccaactccgacgtgtggagagg

SEQ ID NO: 380638 - DNA, 25 bp, Mus musculus
tggccaagaaactaggactaactga

SEQ ID NO: 380639 - DNA, 25 bp, Mus musculus
tggccaagaagacatccctgaagtc

SEQ ID NO: 380640 - DNA, 25 bp, Mus musculus
tggccaagaagatagatcctggatg

SEQ ID NO: 380641 - DNA, 25 bp, Mus musculus
tggccaagaaggggatgaggtgttg

SEQ ID NO: 380642 - DNA, 25 bp, Mus musculus
tggccaagaagtctacatgtgggtt

SEQ ID NO: 380643 - DNA, 25 bp, Mus musculus
tggccaagcagcagatgcatattga

SEQ ID NO: 380644 - DNA, 25 bp, Mus musculus
tggccaagcagggactggaatacgc

SEQ ID NO: 380645 - DNA, 25 bp, Mus musculus
tggccaagcaggggtttgatttcct

SEQ ID NO: 380646 - DNA, 25 bp, Mus musculus
tggccaagctgaacatccagagtct

SEQ ID NO: 380647 - DNA, 25 bp, Mus musculus
tggccaagcttaagcaaagtgagaa

SEQ ID NO: 380648 - DNA, 25 bp, Mus musculus
tggccaagcttaagctatgtactta

SEQ ID NO: 380649 - DNA, 25 bp, Mus musculus
tggccaagcttaaggccttggaaga

SEQ ID NO: 380650 - DNA, 25 bp, Mus musculus
tggccaaggacgaggaacctagtaa

SEQ ID NO: 380651 - DNA, 25 bp, Mus musculus
tggccaaggagggggctgagaaaat

SEQ ID NO: 380652 - DNA, 25 bp, Mus musculus
tggccaagtactgtgaggtgctgac

SEQ ID NO: 380653 - DNA, 25 bp, Mus musculus
tggccaagttcagcaagaaggccgg

SEQ ID NO: 380654 - DNA, 25 bp, Mus musculus
tggccaataaggatcgcctgaattc

SEQ ID NO: 380655 - DNA, 25 bp, Mus musculus
tggccaatggcatgccttggactct

SEQ ID NO: 380656 - DNA, 25 bp, Mus musculus
tggccaatggctgtcgatattcaac

SEQ ID NO: 380657 - DNA, 25 bp, Mus musculus
tggccacacaggatcagaacttatc

SEQ ID NO: 380658 - DNA, 25 bp, Mus musculus
tggccacaccaaggtgttcttcaag

SEQ ID NO: 380659 - DNA, 25 bp, Mus musculus
tggccacactcgctggagctggtgg

SEQ ID NO: 380660 - DNA, 25 bp, Mus musculus
tggccacagagacactggagctccc

SEQ ID NO: 380661 - DNA, 25 bp, Mus musculus
tggccacaggggcattgttgtgact

SEQ ID NO: 380662 - DNA, 25 bp, Mus musculus
tggccacattctgattcaaagaata

SEQ ID NO: 380663 - DNA, 25 bp, Mus musculus
tggccacattctgtaccaaggaaga

SEQ ID NO: 380664 - DNA, 25 bp, Mus musculus
tggccaccagaagattcagaatgtg

SEQ ID NO: 380665 - DNA, 25 bp, Mus musculus
tggccaccagccccactctgccccg

SEQ ID NO: 380666 - DNA, 25 bp, Mus musculus
tggccaccaggataaagcatgagtc

SEQ ID NO: 380667 - DNA, 25 bp, Mus musculus
tggccaccccgtgtcctatgcacca

SEQ ID NO: 380668 - DNA, 25 bp, Mus musculus
tggccacctactcccagatggccgg

SEQ ID NO: 380669 - DNA, 25 bp, Mus musculus
tggccacctccaagaatggtggcat

SEQ ID NO: 380670 - DNA, 25 bp, Mus musculus
tggccacctctgcgatgctcaaaac

SEQ ID NO: 380671 - DNA, 25 bp, Mus musculus
tggccacctcttctgtggttggaga

SEQ ID NO: 380672 - DNA, 25 bp, Mus musculus
tggccacctcttctgttggccgtgt

SEQ ID NO: 380673 - DNA, 25 bp, Mus musculus
tggccaccttttattctctcttgcc

SEQ ID NO: 380674 - DNA, 25 bp, Mus musculus
tggccacgctgccataatgaagaag

SEQ ID NO: 380675 - DNA, 25 bp, Mus musculus
tggccacgtcaagactctggaagct

SEQ ID NO: 380676 - DNA, 25 bp, Mus musculus
tggccacgtcaagatgtcacgtgac

SEQ ID NO: 380677 - DNA, 25 bp, Mus musculus
tggccacgttgccgacttcctggtg

SEQ ID NO: 380678 - DNA, 25 bp, Mus musculus
tggccacgttgccgagaacctgcca

SEQ ID NO: 380679 - DNA, 25 bp, Mus musculus
tggccacgttgccgattttgtcctg

SEQ ID NO: 380680 - DNA, 25 bp, Mus musculus
tggccactccctaccgaggatgctt

SEQ ID NO: 380681 - DNA, 25 bp, Mus musculus
tggccactgagctcaccctcgttct

SEQ ID NO: 380682 - DNA, 25 bp, Mus musculus
tggccactgaggacccctataatac

SEQ ID NO: 380683 - DNA, 25 bp, Mus musculus
tggccactgatagtgcctttgatgt

SEQ ID NO: 380684 - DNA, 25 bp, Mus musculus
tggccactgcttggcctgtccactg

SEQ ID NO: 380685 - DNA, 25 bp, Mus musculus
tggccactggtcaaggcaactattg

SEQ ID NO: 380686 - DNA, 25 bp, Mus musculus
tggccactgtcacggtctgtctgac

SEQ ID NO: 380687 - DNA, 25 bp, Mus musculus
tggccactgtggcctcctgagtgaa

SEQ ID NO: 380688 - DNA, 25 bp, Mus musculus
tggccactgtggtcaaagcacgaat

SEQ ID NO: 380689 - DNA, 25 bp, Mus musculus
tggccactgtggtctctgtgatgag

SEQ ID NO: 380690 - DNA, 25 bp, Mus musculus
tggccactgtgtttacttattttat

SEQ ID NO: 380691 - DNA, 25 bp, Mus musculus
tggccacttgcaggagttcgaggag

SEQ ID NO: 380692 - DNA, 25 bp, Mus musculus
tggccacttgcaggctgtggggtcg

SEQ ID NO: 380693 - DNA, 25 bp, Mus musculus
tggccagaaacagatctggagaatt

SEQ ID NO: 380694 - DNA, 25 bp, Mus musculus
tggccagaaggatgtcaatgggccc

SEQ ID NO: 380695 - DNA, 25 bp, Mus musculus
tggccagacagctgagaaggtagag

SEQ ID NO: 380696 - DNA, 25 bp, Mus musculus
tggccagactcagacacaacaacag

SEQ ID NO: 380697 - DNA, 25 bp, Mus musculus
tggccagagaaggtgcttgacatcc

SEQ ID NO: 380698 - DNA, 25 bp, Mus musculus
tggccagagaagtctttctgtcttg

SEQ ID NO: 380699 - DNA, 25 bp, Mus musculus
tggccagagatacccaggggccata

SEQ ID NO: 380700 - DNA, 25 bp, Mus musculus
tggccagagtcatggatttgataga

SEQ ID NO: 380701 - DNA, 25 bp, Mus musculus
tggccagatctaggcagtgcacagc

SEQ ID NO: 380702 - DNA, 25 bp, Mus musculus
tggccagatctagtgctcacatggt

SEQ ID NO: 380703 - DNA, 25 bp, Mus musculus
tggccagcaacacaacaacattttt

SEQ ID NO: 380704 - DNA, 25 bp, Mus musculus
tggccagcaagatgatgactctgct

SEQ ID NO: 380705 - DNA, 25 bp, Mus musculus
tggccagcacccggctacctgagga

SEQ ID NO: 380706 - DNA, 25 bp, Mus musculus
tggccagcacccgggctgtggctgt

SEQ ID NO: 380707 - DNA, 25 bp, Mus musculus
tggccagcacgcaatcagcggagtg

SEQ ID NO: 380708 - DNA, 25 bp, Mus musculus
tggccagcaggctccagcccactcc

SEQ ID NO: 380709 - DNA, 25 bp, Mus musculus
tggccagcaggtgcttgtgtgtaac

SEQ ID NO: 380710 - DNA, 25 bp, Mus musculus
tggccagccacctattgacccaagg

SEQ ID NO: 380711 - DNA, 25 bp, Mus musculus
tggccagccaggcctgcagcatcaa

SEQ ID NO: 380712 - DNA, 25 bp, Mus musculus
tggccagccctgctctcggagactg

SEQ ID NO: 380713 - DNA, 25 bp, Mus musculus
tggccagcctggcacggatgcttgc

SEQ ID NO: 380714 - DNA, 25 bp, Mus musculus
tggccagctgcagacgaagcttctt

SEQ ID NO: 380715 - DNA, 25 bp, Mus musculus
tggccagctgcagagcgaagtcacc

SEQ ID NO: 380716 - DNA, 25 bp, Mus musculus
tggccagctgcagctgctgataaag

SEQ ID NO: 380717 - DNA, 25 bp, Mus musculus
tggccagctttggaatctctgttgg

SEQ ID NO: 380718 - DNA, 25 bp, Mus musculus
tggccagctttggcactttctaggt

SEQ ID NO: 380719 - DNA, 25 bp, Mus musculus
tggccagctttggggggctggctgt

SEQ ID NO: 380720 - DNA, 25 bp, Mus musculus
tggccaggaacggagggcatggctg

SEQ ID NO: 380721 - DNA, 25 bp, Mus musculus
tggccaggaacggagttatggcatt

SEQ ID NO: 380722 - DNA, 25 bp, Mus musculus
tggccaggaaggggagccaggccgt

SEQ ID NO: 380723 - DNA, 25 bp, Mus musculus
tggccaggagtgagaagacataatt

SEQ ID NO: 380724 - DNA, 25 bp, Mus musculus
tggccaggatcgaaagccagcctgc

SEQ ID NO: 380725 - DNA, 25 bp, Mus musculus
tggccaggcctagccaggtgtagaa

SEQ ID NO: 380726 - DNA, 25 bp, Mus musculus
tggccaggcttgtagaaaatgatgt

SEQ ID NO: 380727 - DNA, 25 bp, Mus musculus
tggccagggctcaggagctccttcc

SEQ ID NO: 380728 - DNA, 25 bp, Mus musculus
tggccaggtattgagacaatgatgg

SEQ ID NO: 380729 - DNA, 25 bp, Mus musculus
tggccagtaactctgaatgtgaaag

SEQ ID NO: 380730 - DNA, 25 bp, Mus musculus
tggccagtaaggcccgaatggctgg

SEQ ID NO: 380731 - DNA, 25 bp, Mus musculus
tggccagtcaagatagccagccctg

SEQ ID NO: 380732 - DNA, 25 bp, Mus musculus
tggccagtctcagatgatacaactc

SEQ ID NO: 380733 - DNA, 25 bp, Mus musculus
tggccagtctcagattgttatagat

SEQ ID NO: 380734 - DNA, 25 bp, Mus musculus
tggccagtgatcttctagagtggat

SEQ ID NO: 380735 - DNA, 25 bp, Mus musculus
tggccagtgcacaagtgcacttaat

SEQ ID NO: 380736 - DNA, 25 bp, Mus musculus
tggccagttcagcttccaaaggcct

SEQ ID NO: 380737 - DNA, 25 bp, Mus musculus
tggccagttcaggatttccacttaa

SEQ ID NO: 380738 - DNA, 25 bp, Mus musculus
tggccatacaggtcctgtccagagt

SEQ ID NO: 380739 - DNA, 25 bp, Mus musculus
tggccatacatagggaaaggcagga

SEQ ID NO: 380740 - DNA, 25 bp, Mus musculus
tggccatcaagacctctcacagccc

SEQ ID NO: 380741 - DNA, 25 bp, Mus musculus
tggccatcactgatgtgtccttccg

SEQ ID NO: 380742 - DNA, 25 bp, Mus musculus
tggccatcactgcttcaccacgacc

SEQ ID NO: 380743 - DNA, 25 bp, Mus musculus
tggccatcagtcctctacgaatgtc

SEQ ID NO: 380744 - DNA, 25 bp, Mus musculus
tggccatcataggtacccaggatat

SEQ ID NO: 380745 - DNA, 25 bp, Mus musculus
tggccatccagaagcctccccagct

SEQ ID NO: 380746 - DNA, 25 bp, Mus musculus
tggccatccgagcagtggcaaagca

SEQ ID NO: 380747 - DNA, 25 bp, Mus musculus
tggccatcggacctgatttcaagtc

SEQ ID NO: 380748 - DNA, 25 bp, Mus musculus
tggccatcggacctgctatctgatg

SEQ ID NO: 380749 - DNA, 25 bp, Mus musculus
tggccatctcaggtgagttggagtg

SEQ ID NO: 380750 - DNA, 25 bp, Mus musculus
tggccatgaagcacgagaacgaggc

SEQ ID NO: 380751 - DNA, 25 bp, Mus musculus
tggccatgagatgagatggaccaaa

SEQ ID NO: 380752 - DNA, 25 bp, Mus musculus
tggccatgatttatgggctcattgt

SEQ ID NO: 380753 - DNA, 25 bp, Mus musculus
tggccatgatttatgtttgagattg

SEQ ID NO: 380754 - DNA, 25 bp, Mus musculus
tggccatggatgttggcaaggcccg

SEQ ID NO: 380755 - DNA, 25 bp, Mus musculus
tggccatggctgagactctgaagac

SEQ ID NO: 380756 - DNA, 25 bp, Mus musculus
tggccatgtacccagaggatcatta

SEQ ID NO: 380757 - DNA, 25 bp, Mus musculus
tggccatgtacccccatgcccggtt

SEQ ID NO: 380758 - DNA, 25 bp, Mus musculus
tggccatgtacccgcacgtgacaca

SEQ ID NO: 380759 - DNA, 25 bp, Mus musculus
tggccatgtgtttgagatcctgtca

SEQ ID NO: 380760 - DNA, 25 bp, Mus musculus
tggccatgttcctagagtacaacaa

SEQ ID NO: 380761 - DNA, 25 bp, Mus musculus
tggccatgttgcagaggttctcagg

SEQ ID NO: 380762 - DNA, 25 bp, Mus musculus
tggccattgaggtgaggcacagagt

SEQ ID NO: 380763 - DNA, 25 bp, Mus musculus
tggccattgccagagatccttgtgt

SEQ ID NO: 380764 - DNA, 25 bp, Mus musculus
tggcccaaagagggagcggaagcca

SEQ ID NO: 380765 - DNA, 25 bp, Mus musculus
tggcccaagaggcattatcgacctg

SEQ ID NO: 380766 - DNA, 25 bp, Mus musculus
tggcccacaagacccgccctagttg

SEQ ID NO: 380767 - DNA, 25 bp, Mus musculus
tggcccacaagcccccactgtgaat

SEQ ID NO: 380768 - DNA, 25 bp, Mus musculus
tggcccacaaggaatgtgggtgcca

SEQ ID NO: 380769 - DNA, 25 bp, Mus musculus
tggcccacaccccaggaagtcagag

SEQ ID NO: 380770 - DNA, 25 bp, Mus musculus
tggcccacactggcagccaccacca

SEQ ID NO: 380771 - DNA, 25 bp, Mus musculus
tggcccacagaattacggcagcggc

SEQ ID NO: 380772 - DNA, 25 bp, Mus musculus
tggcccacagactgacccttggtta

SEQ ID NO: 380773 - DNA, 25 bp, Mus musculus
tggcccacccctcaggtgttacatg

SEQ ID NO: 380774 - DNA, 25 bp, Mus musculus
tggcccacgcaggatcatgtgttca

SEQ ID NO: 380775 - DNA, 25 bp, Mus musculus
tggcccacgcctgtgtaggcttgtg

SEQ ID NO: 380776 - DNA, 25 bp, Mus musculus
tggcccacgcgcagcaacacctcca

SEQ ID NO: 380777 - DNA, 25 bp, Mus musculus
tggcccacgcgcagcgctgtgtagt

SEQ ID NO: 380778 - DNA, 25 bp, Mus musculus
tggcccacggacgaccatgacaccc

SEQ ID NO: 380779 - DNA, 25 bp, Mus musculus
tggcccagaaggagatccttaagct

SEQ ID NO: 380780 - DNA, 25 bp, Mus musculus
tggcccagaatcctgggccaccaat

SEQ ID NO: 380781 - DNA, 25 bp, Mus musculus
tggcccagacagtgactcaggtgca

SEQ ID NO: 380782 - DNA, 25 bp, Mus musculus
tggcccagattaaagtcaaataatt

SEQ ID NO: 380783 - DNA, 25 bp, Mus musculus
tggcccagattaagtctcctgaaag

SEQ ID NO: 380784 - DNA, 25 bp, Mus musculus
tggcccagcagctggagcaattcaa

SEQ ID NO: 380785 - DNA, 25 bp, Mus musculus
tggcccagcatttgggggagagcac

SEQ ID NO: 380786 - DNA, 25 bp, Mus musculus
tggcccagcgggtacaccaggaaaa

SEQ ID NO: 380787 - DNA, 25 bp, Mus musculus
tggcccagctctgggatgggttgaa

SEQ ID NO: 380788 - DNA, 25 bp, Mus musculus
tggcccagctctggggagaactctg

SEQ ID NO: 380789 - DNA, 25 bp, Mus musculus
tggcccaggaggtcctgtccttggg

SEQ ID NO: 380790 - DNA, 25 bp, Mus musculus
tggcccaggaggtgtctgagactga

SEQ ID NO: 380791 - DNA, 25 bp, Mus musculus
tggcccaggcctggcttcttcacaa

SEQ ID NO: 380792 - DNA, 25 bp, Mus musculus
tggcccataaatgctgttggctgct

SEQ ID NO: 380793 - DNA, 25 bp, Mus musculus
tggcccatgagctagggcacgttct

SEQ ID NO: 380794 - DNA, 25 bp, Mus musculus
tggccccaaaggtgtgaacattggc

SEQ ID NO: 380795 - DNA, 25 bp, Mus musculus
tggccccaaggtggccattgaagag

SEQ ID NO: 380796 - DNA, 25 bp, Mus musculus
tggccccagacaggttcagaactta

SEQ ID NO: 380797 - DNA, 25 bp, Mus musculus
tggccccagtgcagattaaggttga

SEQ ID NO: 380798 - DNA, 25 bp, Mus musculus
tggccccatgggtccttctggtcct

SEQ ID NO: 380799 - DNA, 25 bp, Mus musculus
tggccccatttacagggagaagctg

SEQ ID NO: 380800 - DNA, 25 bp, Mus musculus
tggcccccaaggccatgaagaagat

SEQ ID NO: 380801 - DNA, 25 bp, Mus musculus
tggcccccatggttcagcatgggct

SEQ ID NO: 380802 - DNA, 25 bp, Mus musculus
tggccccccgcggacttccaatagt

SEQ ID NO: 380803 - DNA, 25 bp, Mus musculus
tggccccccgggcgatggcatcaaa

SEQ ID NO: 380804 - DNA, 25 bp, Mus musculus
tggcccccgaggatgtcagtgctct

SEQ ID NO: 380805 - DNA, 25 bp, Mus musculus
tggccccctctccaggtgtctccag

SEQ ID NO: 380806 - DNA, 25 bp, Mus musculus
tggccccgagatgaagtgactgaga

SEQ ID NO: 380807 - DNA, 25 bp, Mus musculus
tggccccgaggtctcagatctgaca

SEQ ID NO: 380808 - DNA, 25 bp, Mus musculus
tggccccgagtgccagttgccagct

SEQ ID NO: 380809 - DNA, 25 bp, Mus musculus
tggccccgtgggagcccttggactc

SEQ ID NO: 380810 - DNA, 25 bp, Mus musculus
tggcccctacataaaatggttccta

SEQ ID NO: 380811 - DNA, 25 bp, Mus musculus
tggcccctgtcgatctttgggttcc

SEQ ID NO: 380812 - DNA, 25 bp, Mus musculus
tggcccctgtcggaactgctgcact

SEQ ID NO: 380813 - DNA, 25 bp, Mus musculus
tggcccctgttggcatcctcaaatc

SEQ ID NO: 380814 - DNA, 25 bp, Mus musculus
tggccccttgcaagtgcccctctca

SEQ ID NO: 380815 - DNA, 25 bp, Mus musculus
tggccccttgcaagttctgggccaa

SEQ ID NO: 380816 - DNA, 25 bp, Mus musculus
tggcccgaacaggtcttattttagt

SEQ ID NO: 380817 - DNA, 25 bp, Mus musculus
tggcccgccaggactgcagtaatgg

SEQ ID NO: 380818 - DNA, 25 bp, Mus musculus
tggcccgcccggattgatgaactcc

SEQ ID NO: 380819 - DNA, 25 bp, Mus musculus
tggcccgcccggtgcatttctaggt

SEQ ID NO: 380820 - DNA, 25 bp, Mus musculus
tggcccggagcacgcagcccgactc

SEQ ID NO: 380821 - DNA, 25 bp, Mus musculus
tggcccggattaaggggacctggct

SEQ ID NO: 380822 - DNA, 25 bp, Mus musculus
tggcccggcccactcagaggctgag

SEQ ID NO: 380823 - DNA, 25 bp, Mus musculus
tggcccggccctcctgaagcccttt

SEQ ID NO: 380824 - DNA, 25 bp, Mus musculus
tggcccggctgtacacttccggcct

SEQ ID NO: 380825 - DNA, 25 bp, Mus musculus
tggcccggcttctgcaggcacaagg

SEQ ID NO: 380826 - DNA, 25 bp, Mus musculus
tggcccggtgaggagctgtgggaac

SEQ ID NO: 380827 - DNA, 25 bp, Mus musculus
tggccctaaaggggttggtgctatc

SEQ ID NO: 380828 - DNA, 25 bp, Mus musculus
tggccctaacaaaggtgacactcga

SEQ ID NO: 380829 - DNA, 25 bp, Mus musculus
tggccctaagggcaactccggaggt

SEQ ID NO: 380830 - DNA, 25 bp, Mus musculus
tggccctagaggtccacctggccct

SEQ ID NO: 380831 - DNA, 25 bp, Mus musculus
tggccctcaatgcagtgactggatt

SEQ ID NO: 380832 - DNA, 25 bp, Mus musculus
tggccctcacaagtggccaatcaaa

SEQ ID NO: 380833 - DNA, 25 bp, Mus musculus
tggccctcacggtatatgctatgat

SEQ ID NO: 380834 - DNA, 25 bp, Mus musculus
tggccctcagctccatgaagagtct

SEQ ID NO: 380835 - DNA, 25 bp, Mus musculus
tggccctcagctccatgaagagttg

SEQ ID NO: 380836 - DNA, 25 bp, Mus musculus
tggccctcagggacctgcaggtgaa

SEQ ID NO: 380837 - DNA, 25 bp, Mus musculus
tggccctcagggtcccacaggagag

SEQ ID NO: 380838 - DNA, 25 bp, Mus musculus
tggccctccgggtccttctggagat

SEQ ID NO: 380839 - DNA, 25 bp, Mus musculus
tggccctcctggtgctgatggccag

SEQ ID NO: 380840 - DNA, 25 bp, Mus musculus
tggccctccttcacgtagaaaatcc

SEQ ID NO: 380841 - DNA, 25 bp, Mus musculus
tggccctctacaggagtgtgcaccg

SEQ ID NO: 380842 - DNA, 25 bp, Mus musculus
tggccctctgaatgtcaagccccgc

SEQ ID NO: 380843 - DNA, 25 bp, Mus musculus
tggccctctggtgtgccacagatca

SEQ ID NO: 380844 - DNA, 25 bp, Mus musculus
tggccctgacctcaggattggaaaa

SEQ ID NO: 380845 - DNA, 25 bp, Mus musculus
tggccctgagatgacaaatcctctg

SEQ ID NO: 380846 - DNA, 25 bp, Mus musculus
tggccctgagccccgagggtcctgc

SEQ ID NO: 380847 - DNA, 25 bp, Mus musculus
tggccctgagccccgtgtactggtt

SEQ ID NO: 380848 - DNA, 25 bp, Mus musculus
tggccctgcccagagcctgacccca

SEQ ID NO: 380849 - DNA, 25 bp, Mus musculus
tggccctgcccagatactcccccca

SEQ ID NO: 380850 - DNA, 25 bp, Mus musculus
tggccctggcagagaacacagcagg

SEQ ID NO: 380851 - DNA, 25 bp, Mus musculus
tggccctggcaggtctccctgcagg

SEQ ID NO: 380852 - DNA, 25 bp, Mus musculus
tggccctggggaagaagagtctgag

SEQ ID NO: 380853 - DNA, 25 bp, Mus musculus
tggccctggggctgggtccttggct

SEQ ID NO: 380854 - DNA, 25 bp, Mus musculus
tggccctggtcacaggtgcgggtag

SEQ ID NO: 380855 - DNA, 25 bp, Mus musculus
tggccctggtggatcagaacaagta

SEQ ID NO: 380856 - DNA, 25 bp, Mus musculus
tggccctgtcctgccatcatgaagg

SEQ ID NO: 380857 - DNA, 25 bp, Mus musculus
tggccctgttgcagccccaccatgg

SEQ ID NO: 380858 - DNA, 25 bp, Mus musculus
tggccctgttgcaggttctgccacc

SEQ ID NO: 380859 - DNA, 25 bp, Mus musculus
tggcccttagagtaatccatatgca

SEQ ID NO: 380860 - DNA, 25 bp, Mus musculus
tggcccttcaggagccacgtcagtg

SEQ ID NO: 380861 - DNA, 25 bp, Mus musculus
tggcccttcaggaggcagcagaagc

SEQ ID NO: 380862 - DNA, 25 bp, Mus musculus
tggcccttctagacacccaggacat

SEQ ID NO: 380863 - DNA, 25 bp, Mus musculus
tggcccttctcatcaaggtgattct

SEQ ID NO: 380864 - DNA, 25 bp, Mus musculus
tggccgacaaagttccacaggtgtg

SEQ ID NO: 380865 - DNA, 25 bp, Mus musculus
tggccgacagagtgcttgggatccc

SEQ ID NO: 380866 - DNA, 25 bp, Mus musculus
tggccgacagtacagaaccaacgaa

SEQ ID NO: 380867 - DNA, 25 bp, Mus musculus
tggccgacagtacagggttagctga

SEQ ID NO: 380868 - DNA, 25 bp, Mus musculus
tggccgagacctacgacttcctctt

SEQ ID NO: 380869 - DNA, 25 bp, Mus musculus
tggccgagagatgaaaaatgataga

SEQ ID NO: 380870 - DNA, 25 bp, Mus musculus
tggccgagaggcaagaagagaggcg

SEQ ID NO: 380871 - DNA, 25 bp, Mus musculus
tggccgagaggggagcccagaggag

SEQ ID NO: 380872 - DNA, 25 bp, Mus musculus
tggccgagccggacccctctgaccc

SEQ ID NO: 380873 - DNA, 25 bp, Mus musculus
tggccgagccggaccgattcagact

SEQ ID NO: 380874 - DNA, 25 bp, Mus musculus
tggccgagccggaccgccgcaaggt

SEQ ID NO: 380875 - DNA, 25 bp, Mus musculus
tggccgagctagcaacctttcccct

SEQ ID NO: 380876 - DNA, 25 bp, Mus musculus
tggccgagctagctgctgcctgttg

SEQ ID NO: 380877 - DNA, 25 bp, Mus musculus
tggccgaggaggtccagattatctc

SEQ ID NO: 380878 - DNA, 25 bp, Mus musculus
tggccgagtaccagagcccacagac

SEQ ID NO: 380879 - DNA, 25 bp, Mus musculus
tggccgagtaccaggacctgacgtt

SEQ ID NO: 380880 - DNA, 25 bp, Mus musculus
tggccgagtaccaggctaacccttt

SEQ ID NO: 380881 - DNA, 25 bp, Mus musculus
tggccgagtataagcaattaaccct

SEQ ID NO: 380882 - DNA, 25 bp, Mus musculus
tggccgagtgttgctgaacacaacc

SEQ ID NO: 380883 - DNA, 25 bp, Mus musculus
tggccgataaagattactctgtgac

SEQ ID NO: 380884 - DNA, 25 bp, Mus musculus
tggccgatgaggtaatcactgtgtt

SEQ ID NO: 380885 - DNA, 25 bp, Mus musculus
tggccgatgagtaatatgcagactg

SEQ ID NO: 380886 - DNA, 25 bp, Mus musculus
tggccgcacagaactgactgtccct

SEQ ID NO: 380887 - DNA, 25 bp, Mus musculus
tggccgcacagcctgctcttcctcc

SEQ ID NO: 380888 - DNA, 25 bp, Mus musculus
tggccgcacttggttacaagaacgt

SEQ ID NO: 380889 - DNA, 25 bp, Mus musculus
tggccgccacggatgggtgctacag

SEQ ID NO: 380890 - DNA, 25 bp, Mus musculus
tggccgccatcatgtctgccacaac

SEQ ID NO: 380891 - DNA, 25 bp, Mus musculus
tggccgcccaagacctccctgggcc

SEQ ID NO: 380892 - DNA, 25 bp, Mus musculus
tggccgcctagcaggaactgtctac

SEQ ID NO: 380893 - DNA, 25 bp, Mus musculus
tggccgcctagcagtttgttttgtt

SEQ ID NO: 380894 - DNA, 25 bp, Mus musculus
tggccgccttcctagccctcgtggt

SEQ ID NO: 380895 - DNA, 25 bp, Mus musculus
tggccgcgatggaagagacattgat

SEQ ID NO: 380896 - DNA, 25 bp, Mus musculus
tggccgcgcagccagcgttccatgt

SEQ ID NO: 380897 - DNA, 25 bp, Mus musculus
tggccgcgtccgggtgatctctggg

SEQ ID NO: 380898 - DNA, 25 bp, Mus musculus
tggccgctcagaaaagatgtctttg

SEQ ID NO: 380899 - DNA, 25 bp, Mus musculus
tggccgctcagtgtcttaaaacata

SEQ ID NO: 380900 - DNA, 25 bp, Mus musculus
tggccgctctggggatgtcaaccta

SEQ ID NO: 380901 - DNA, 25 bp, Mus musculus
tggccgctgtagaattggaaaagca

SEQ ID NO: 380902 - DNA, 25 bp, Mus musculus
tggccgcttcttcactgactatggt

SEQ ID NO: 380903 - DNA, 25 bp, Mus musculus
tggccgcttgcggaggtttggattc

SEQ ID NO: 380904 - DNA, 25 bp, Mus musculus
tggccgctttcaggtagcactttgt

SEQ ID NO: 380905 - DNA, 25 bp, Mus musculus
tggccggaaataagactgcagcttt

SEQ ID NO: 380906 - DNA, 25 bp, Mus musculus
tggccggagcagagtctggccacag

SEQ ID NO: 380907 - DNA, 25 bp, Mus musculus
tggccggccagactacagcaatgaa

SEQ ID NO: 380908 - DNA, 25 bp, Mus musculus
tggccggcccggattgatgacattg

SEQ ID NO: 380909 - DNA, 25 bp, Mus musculus
tggccggccggcgggtgcccagatc

SEQ ID NO: 380910 - DNA, 25 bp, Mus musculus
tggccggcgtgacagcatttgacat

SEQ ID NO: 380911 - DNA, 25 bp, Mus musculus
tggccgggaagaccaaatacacact

SEQ ID NO: 380912 - DNA, 25 bp, Mus musculus
tggccgggacaaggtaatgttctcc

SEQ ID NO: 380913 - DNA, 25 bp, Mus musculus
tggccgggatcaggtggatcaactg

SEQ ID NO: 380914 - DNA, 25 bp, Mus musculus
tggccgggcaagctgccaaaagcct

SEQ ID NO: 380915 - DNA, 25 bp, Mus musculus
tggccgggctaactggactcatgca

SEQ ID NO: 380916 - DNA, 25 bp, Mus musculus
tggccgggctggtccctctgtcacc

SEQ ID NO: 380917 - DNA, 25 bp, Mus musculus
tggccggggcgaggttctctccact

SEQ ID NO: 380918 - DNA, 25 bp, Mus musculus
tggccggtacaagcttcctgacagt

SEQ ID NO: 380919 - DNA, 25 bp, Mus musculus
tggccgtaaatggttcagactgggc

SEQ ID NO: 380920 - DNA, 25 bp, Mus musculus
tggccgtagagcatgcactcttggc

SEQ ID NO: 380921 - DNA, 25 bp, Mus musculus
tggccgtagaggtgctgggattaca

SEQ ID NO: 380922 - DNA, 25 bp, Mus musculus
tggccgtattgagagttgcattgta

SEQ ID NO: 380923 - DNA, 25 bp, Mus musculus
tggccgtattgaggaacaaaggact

SEQ ID NO: 380924 - DNA, 25 bp, Mus musculus
tggccgtccaagaacatgtacccta

SEQ ID NO: 380925 - DNA, 25 bp, Mus musculus
tggccgtcgtcaggtgggtccgagc

SEQ ID NO: 380926 - DNA, 25 bp, Mus musculus
tggccgtgaaggtggaggcagggaa

SEQ ID NO: 380927 - DNA, 25 bp, Mus musculus
tggccgtgcagcaagacccagaagc

SEQ ID NO: 380928 - DNA, 25 bp, Mus musculus
tggccgtggcagaggtagttctggt

SEQ ID NO: 380929 - DNA, 25 bp, Mus musculus
tggccgtgggaccgtggctaccgaa

SEQ ID NO: 380930 - DNA, 25 bp, Mus musculus
tggccgttgttggagccactggcaa

SEQ ID NO: 380931 - DNA, 25 bp, Mus musculus
tggccgtttttgtgatctgccagct

SEQ ID NO: 380932 - DNA, 25 bp, Mus musculus
tggcctacagggctggctgtggact

SEQ ID NO: 380933 - DNA, 25 bp, Mus musculus
tggcctaccagagcaatttttatat

SEQ ID NO: 380934 - DNA, 25 bp, Mus musculus
tggcctaccgtgtggataaacgttt

SEQ ID NO: 380935 - DNA, 25 bp, Mus musculus
tggcctaccgtgtggccttcagtgg

SEQ ID NO: 380936 - DNA, 25 bp, Mus musculus
tggcctactactcttaaaaaacagt

SEQ ID NO: 380937 - DNA, 25 bp, Mus musculus
tggcctactactgtcgtttatatgc

SEQ ID NO: 380938 - DNA, 25 bp, Mus musculus
tggcctagcctatgctgctggggcc

SEQ ID NO: 380939 - DNA, 25 bp, Mus musculus
tggcctataggaagtttggtgagcg

SEQ ID NO: 380940 - DNA, 25 bp, Mus musculus
tggcctatcagcgggcttatccgct

SEQ ID NO: 380941 - DNA, 25 bp, Mus musculus
tggcctatcagcgggtcatagaaga

SEQ ID NO: 380942 - DNA, 25 bp, Mus musculus
tggcctatctcgacgtcggatgcgc

SEQ ID NO: 380943 - DNA, 25 bp, Mus musculus
tggcctatgatgatcctcatgggtg

SEQ ID NO: 380944 - DNA, 25 bp, Mus musculus
tggcctatgatggatctgatgaacg

SEQ ID NO: 380945 - DNA, 25 bp, Mus musculus
tggcctatgcaggagggagcctcac

SEQ ID NO: 380946 - DNA, 25 bp, Mus musculus
tggcctatgcaggtgtgctgatgat

SEQ ID NO: 380947 - DNA, 25 bp, Mus musculus
tggcctatggataaggttaaaaatt

SEQ ID NO: 380948 - DNA, 25 bp, Mus musculus
tggcctatgtggcaggctgggtcct

SEQ ID NO: 380949 - DNA, 25 bp, Mus musculus
tggcctattacatgccaacaattct

SEQ ID NO: 380950 - DNA, 25 bp, Mus musculus
tggcctattacatggatacatgggc

SEQ ID NO: 380951 - DNA, 25 bp, Mus musculus
tggcctattttggatttcagtgaat

SEQ ID NO: 380952 - DNA, 25 bp, Mus musculus
tggcctattttggcaactccgaaga

SEQ ID NO: 380953 - DNA, 25 bp, Mus musculus
tggcctcaaaaatactgggcggttg

SEQ ID NO: 380954 - DNA, 25 bp, Mus musculus
tggcctcaaatgaagaatcaccgcc

SEQ ID NO: 380955 - DNA, 25 bp, Mus musculus
tggcctcaacagttcctgggtggag

SEQ ID NO: 380956 - DNA, 25 bp, Mus musculus
tggcctcacacaagtttaaaaggat

SEQ ID NO: 380957 - DNA, 25 bp, Mus musculus
tggcctcacagatccgtgaagaggt

SEQ ID NO: 380958 - DNA, 25 bp, Mus musculus
tggcctcagcaatgtgaagctgaac

SEQ ID NO: 380959 - DNA, 25 bp, Mus musculus
tggcctccaacacccgctgcctcaa

SEQ ID NO: 380960 - DNA, 25 bp, Mus musculus
tggcctccacagaggttgtgcccac

SEQ ID NO: 380961 - DNA, 25 bp, Mus musculus
tggcctccagaagccaccatggggc

SEQ ID NO: 380962 - DNA, 25 bp, Mus musculus
tggcctccatggaccctggacttcg

SEQ ID NO: 380963 - DNA, 25 bp, Mus musculus
tggcctccatgtggatataccgctg

SEQ ID NO: 380964 - DNA, 25 bp, Mus musculus
tggcctccatgtggcatttggcaca

SEQ ID NO: 380965 - DNA, 25 bp, Mus musculus
tggcctcccaagaaaccagctcttc

SEQ ID NO: 380966 - DNA, 25 bp, Mus musculus
tggcctcccaagttcttggggacac

SEQ ID NO: 380967 - DNA, 25 bp, Mus musculus
tggcctccctgggccccaaggaccc

SEQ ID NO: 380968 - DNA, 25 bp, Mus musculus
tggcctccgctcaggaacgagttca

SEQ ID NO: 380969 - DNA, 25 bp, Mus musculus
tggcctccgctcaggtaaacagaat

SEQ ID NO: 380970 - DNA, 25 bp, Mus musculus
tggcctccggataaagatagagaaa

SEQ ID NO: 380971 - DNA, 25 bp, Mus musculus
tggcctccgggtttgtattgagggc

SEQ ID NO: 380972 - DNA, 25 bp, Mus musculus
tggcctccgtcaacactgaggcctt

SEQ ID NO: 380973 - DNA, 25 bp, Mus musculus
tggcctcctcctaccccatcccagc

SEQ ID NO: 380974 - DNA, 25 bp, Mus musculus
tggcctcctggactgtgctgggggc

SEQ ID NO: 380975 - DNA, 25 bp, Mus musculus
tggcctcctgggtggtgcagactgt

SEQ ID NO: 380976 - DNA, 25 bp, Mus musculus
tggcctcgccaagagttcctccagc

SEQ ID NO: 380977 - DNA, 25 bp, Mus musculus
tggcctcgccaaggtatgtggaccg

SEQ ID NO: 380978 - DNA, 25 bp, Mus musculus
tggcctcgcccgactatctctcacc

SEQ ID NO: 380979 - DNA, 25 bp, Mus musculus
tggcctcgcgctataaccacttccg

SEQ ID NO: 380980 - DNA, 25 bp, Mus musculus
tggcctcgctaggatgcttcatttc

SEQ ID NO: 380981 - DNA, 25 bp, Mus musculus
tggcctcggtgattgaagtgagtga

SEQ ID NO: 380982 - DNA, 25 bp, Mus musculus
tggcctctaagtgccatcacctgtt

SEQ ID NO: 380983 - DNA, 25 bp, Mus musculus
tggcctctaagttgctgactgtcca

SEQ ID NO: 380984 - DNA, 25 bp, Mus musculus
tggcctctatctggggactgcctcc

SEQ ID NO: 380985 - DNA, 25 bp, Mus musculus
tggcctctatctgggttggacctcg

SEQ ID NO: 380986 - DNA, 25 bp, Mus musculus
tggcctctcagaaaacatccagtac

SEQ ID NO: 380987 - DNA, 25 bp, Mus musculus
tggcctctcaggtcaaaggctgaga

SEQ ID NO: 380988 - DNA, 25 bp, Mus musculus
tggcctctgataaaggcaactgttg

SEQ ID NO: 380989 - DNA, 25 bp, Mus musculus
tggcctctgcaggtggcgacctgca

SEQ ID NO: 380990 - DNA, 25 bp, Mus musculus
tggcctcttcacaattacgctcgat

SEQ ID NO: 380991 - DNA, 25 bp, Mus musculus
tggcctctttaaaagaacagatgca

SEQ ID NO: 380992 - DNA, 25 bp, Mus musculus
tggcctctttaaattgaaaatacag

SEQ ID NO: 380993 - DNA, 25 bp, Mus musculus
tggcctgaagacattgtctttcctg

SEQ ID NO: 380994 - DNA, 25 bp, Mus musculus
tggcctgaagcaaggtattggtttt

SEQ ID NO: 380995 - DNA, 25 bp, Mus musculus
tggcctgacaggagtccccggcatg

SEQ ID NO: 380996 - DNA, 25 bp, Mus musculus
tggcctgacccagaggtctttgacc

SEQ ID NO: 380997 - DNA, 25 bp, Mus musculus
tggcctgagaattcttttcgtcctg

SEQ ID NO: 380998 - DNA, 25 bp, Mus musculus
tggcctgcaagttataccacatcac

SEQ ID NO: 380999 - DNA, 25 bp, Mus musculus
tggcctgcaggtagctcgcggcgtc

SEQ ID NO: 381000 - DNA, 25 bp, Mus musculus
tggcctgctgaggactggctgcccc

SEQ ID NO: 381001 - DNA, 25 bp, Mus musculus
tggcctgcttgaaatggaatttatc

SEQ ID NO: 381002 - DNA, 25 bp, Mus musculus
tggcctgctttacagatcgctgtgg

SEQ ID NO: 381003 - DNA, 25 bp, Mus musculus
tggcctgctttacagctgacttgga

SEQ ID NO: 381004 - DNA, 25 bp, Mus musculus
tggcctggaaaggtacagttaaaga

SEQ ID NO: 381005 - DNA, 25 bp, Mus musculus
tggcctggagcttaccagcccttct

SEQ ID NO: 381006 - DNA, 25 bp, Mus musculus
tggcctggagtgttgaagatgaagc

SEQ ID NO: 381007 - DNA, 25 bp, Mus musculus
tggcctggcaggcccttttagctac

SEQ ID NO: 381008 - DNA, 25 bp, Mus musculus
tggcctggccaccagccccactctg

SEQ ID NO: 381009 - DNA, 25 bp, Mus musculus
tggcctggccaccaggataaagcat

SEQ ID NO: 381010 - DNA, 25 bp, Mus musculus
tggcctggcgcttaatgaaaaacta

SEQ ID NO: 381011 - DNA, 25 bp, Mus musculus
tggcctggtgtgggctaaattggtt

SEQ ID NO: 381012 - DNA, 25 bp, Mus musculus
tggcctgtaccattgcctatggcct

SEQ ID NO: 381013 - DNA, 25 bp, Mus musculus
tggcctgtctcagatgtcttcagta

SEQ ID NO: 381014 - DNA, 25 bp, Mus musculus
tggcctgtctgaggccctggccaga

SEQ ID NO: 381015 - DNA, 25 bp, Mus musculus
tggcctgtgagaaccacctcagtgg

SEQ ID NO: 381016 - DNA, 25 bp, Mus musculus
tggcctgtgagaacgacctcagtgg

SEQ ID NO: 381017 - DNA, 25 bp, Mus musculus
tggcctgtggagggttgtctaccgg

SEQ ID NO: 381018 - DNA, 25 bp, Mus musculus
tggcctgtgtggatgtgaacgagtg

SEQ ID NO: 381019 - DNA, 25 bp, Mus musculus
tggcctgtgtggttgtgaacgagtg

SEQ ID NO: 381020 - DNA, 25 bp, Mus musculus
tggcctgttgggtcacttccctccg

SEQ ID NO: 381021 - DNA, 25 bp, Mus musculus
tggccttaaagtctttaagaaatag

SEQ ID NO: 381022 - DNA, 25 bp, Mus musculus
tggccttaccatgtgccctgggggg

SEQ ID NO: 381023 - DNA, 25 bp, Mus musculus
tggccttagagtttctgcgccccct

SEQ ID NO: 381024 - DNA, 25 bp, Mus musculus
tggccttagtcctgatgctgtctat

SEQ ID NO: 381025 - DNA, 25 bp, Mus musculus
tggccttatgtccagccatttcaag

SEQ ID NO: 381026 - DNA, 25 bp, Mus musculus
tggccttcaagacagatcctcaaga

SEQ ID NO: 381027 - DNA, 25 bp, Mus musculus
tggccttcaagacagcgtgggtggg

SEQ ID NO: 381028 - DNA, 25 bp, Mus musculus
tggccttcaaggttgtagccctcgg

SEQ ID NO: 381029 - DNA, 25 bp, Mus musculus
tggccttcagagctccagatacctg

SEQ ID NO: 381030 - DNA, 25 bp, Mus musculus
tggccttccacgagttcgaggaagc

SEQ ID NO: 381031 - DNA, 25 bp, Mus musculus
tggccttccccttagctcagagctc

SEQ ID NO: 381032 - DNA, 25 bp, Mus musculus
tggccttccgggctccctggtcctg

SEQ ID NO: 381033 - DNA, 25 bp, Mus musculus
tggccttcgagtttgatcctgagtt

SEQ ID NO: 381034 - DNA, 25 bp, Mus musculus
tggccttctctctgaaggtgttcct

SEQ ID NO: 381035 - DNA, 25 bp, Mus musculus
tggccttcttgagctgaaaattgag

SEQ ID NO: 381036 - DNA, 25 bp, Mus musculus
tggccttcttgagggccttcttgaa

SEQ ID NO: 381037 - DNA, 25 bp, Mus musculus
tggccttgaaaagatgaatgagaac

SEQ ID NO: 381038 - DNA, 25 bp, Mus musculus
tggccttgaaaagattggccacctg

SEQ ID NO: 381039 - DNA, 25 bp, Mus musculus
tggccttgaaaaggtagacccacaa

SEQ ID NO: 381040 - DNA, 25 bp, Mus musculus
tggccttgaacaggacaggccgaag

SEQ ID NO: 381041 - DNA, 25 bp, Mus musculus
tggccttgacaatatcaacatgaca

SEQ ID NO: 381042 - DNA, 25 bp, Mus musculus
tggccttgatgtgagccatgagcct

SEQ ID NO: 381043 - DNA, 25 bp, Mus musculus
tggccttggaggaaactttgcttcc

SEQ ID NO: 381044 - DNA, 25 bp, Mus musculus
tggccttggaggtttgcctggagac

SEQ ID NO: 381045 - DNA, 25 bp, Mus musculus
tggccttggcaacagaccccaatat

SEQ ID NO: 381046 - DNA, 25 bp, Mus musculus
tggccttggcagcacaaacttgacc

SEQ ID NO: 381047 - DNA, 25 bp, Mus musculus
tggccttggcaggggccagtccctg

SEQ ID NO: 381048 - DNA, 25 bp, Mus musculus
tggccttggcaggtctctcttcagt

SEQ ID NO: 381049 - DNA, 25 bp, Mus musculus
tggccttgtaaacatcagctgcggg

SEQ ID NO: 381050 - DNA, 25 bp, Mus musculus
tggccttgtcgggtgtgatcatggt

SEQ ID NO: 381051 - DNA, 25 bp, Mus musculus
tggcctttaagcctggaaaggaaat

SEQ ID NO: 381052 - DNA, 25 bp, Mus musculus
tggcctttacagagatgagcatcag

SEQ ID NO: 381053 - DNA, 25 bp, Mus musculus
tggcctttaccagcctgccgacata

SEQ ID NO: 381054 - DNA, 25 bp, Mus musculus
tggcctttaccaggacagccacttc

SEQ ID NO: 381055 - DNA, 25 bp, Mus musculus
tggcctttaccagggtctcagcact

SEQ ID NO: 381056 - DNA, 25 bp, Mus musculus
tggcctttcaggtgatctgtctggc

SEQ ID NO: 381057 - DNA, 25 bp, Mus musculus
tggcctttgatgccgtcctgcttga

SEQ ID NO: 381058 - DNA, 25 bp, Mus musculus
tggcctttgttcaggaatatcgttc

SEQ ID NO: 381059 - DNA, 25 bp, Mus musculus
tggccttttatcaggttccttagct

SEQ ID NO: 381060 - DNA, 25 bp, Mus musculus
tggccttttcagaactcaagctctt

SEQ ID NO: 381061 - DNA, 25 bp, Mus musculus
tggccttttcagggctacagtgcat

SEQ ID NO: 381062 - DNA, 25 bp, Mus musculus
tggcctttttgcctccagcgtctcc

SEQ ID NO: 381063 - DNA, 25 bp, Mus musculus
tggcgaaaatcagatcaaagatgag

SEQ ID NO: 381064 - DNA, 25 bp, Mus musculus
tggcgaaagctgataacacatgatc

SEQ ID NO: 381065 - DNA, 25 bp, Mus musculus
tggcgaaagctgattccaaattaca

SEQ ID NO: 381066 - DNA, 25 bp, Mus musculus
tggcgaaagctggttccttgtggag

SEQ ID NO: 381067 - DNA, 25 bp, Mus musculus
tggcgaaagctggtttaactcacat

SEQ ID NO: 381068 - DNA, 25 bp, Mus musculus
tggcgaaccacagaaagcgtccatc

SEQ ID NO: 381069 - DNA, 25 bp, Mus musculus
tggcgaaccaggtgatcaggtgtaa

SEQ ID NO: 381070 - DNA, 25 bp, Mus musculus
tggcgaaggaggatgaggaacctgg

SEQ ID NO: 381071 - DNA, 25 bp, Mus musculus
tggcgaaggagggtggccggactgc

SEQ ID NO: 381072 - DNA, 25 bp, Mus musculus
tggcgaatcagaataatttaaaaat

SEQ ID NO: 381073 - DNA, 25 bp, Mus musculus
tggcgaatgggaaagggccaaataa

SEQ ID NO: 381074 - DNA, 25 bp, Mus musculus
tggcgacagaaaggaatcccaatgc

SEQ ID NO: 381075 - DNA, 25 bp, Mus musculus
tggcgacatgatatttgaaggaaac

SEQ ID NO: 381076 - DNA, 25 bp, Mus musculus
tggcgaccaggcttcagatgctagc

SEQ ID NO: 381077 - DNA, 25 bp, Mus musculus
tggcgaccagtacaaggccacagat

SEQ ID NO: 381078 - DNA, 25 bp, Mus musculus
tggcgaccgcagcaacccttctggg

SEQ ID NO: 381079 - DNA, 25 bp, Mus musculus
tggcgacctggtgactccataccaa

SEQ ID NO: 381080 - DNA, 25 bp, Mus musculus
tggcgaccttcagggaaaatgccaa

SEQ ID NO: 381081 - DNA, 25 bp, Mus musculus
tggcgactattcttctatgagtgct

SEQ ID NO: 381082 - DNA, 25 bp, Mus musculus
tggcgactgcagcctattccaagcc

SEQ ID NO: 381083 - DNA, 25 bp, Mus musculus
tggcgactgcaggtaacgggcaacc

SEQ ID NO: 381084 - DNA, 25 bp, Mus musculus
tggcgactggagaaggtcttcgctt

SEQ ID NO: 381085 - DNA, 25 bp, Mus musculus
tggcgactggagaagtatgtgggtg

SEQ ID NO: 381086 - DNA, 25 bp, Mus musculus
tggcgagaagaccaccatgcgggac

SEQ ID NO: 381087 - DNA, 25 bp, Mus musculus
tggcgagacaactaaattttccaat

SEQ ID NO: 381088 - DNA, 25 bp, Mus musculus
tggcgagaccggggcatggaacaag

SEQ ID NO: 381089 - DNA, 25 bp, Mus musculus
tggcgagactgagagccctgagccc

SEQ ID NO: 381090 - DNA, 25 bp, Mus musculus
tggcgagactgagaggctatcaggg

SEQ ID NO: 381091 - DNA, 25 bp, Mus musculus
tggcgagaggagggctctggtctgg

SEQ ID NO: 381092 - DNA, 25 bp, Mus musculus
tggcgagaggaggtctcgaagtcct

SEQ ID NO: 381093 - DNA, 25 bp, Mus musculus
tggcgagatcatcaaaccagaagat

SEQ ID NO: 381094 - DNA, 25 bp, Mus musculus
tggcgagccaaaatgggctccgggc

SEQ ID NO: 381095 - DNA, 25 bp, Mus musculus
tggcgagccaaaatgggttttatgg

SEQ ID NO: 381096 - DNA, 25 bp, Mus musculus
tggcgagcccctcggtcttcaaagc

SEQ ID NO: 381097 - DNA, 25 bp, Mus musculus
tggcgagcggatctacgaagtagtc

SEQ ID NO: 381098 - DNA, 25 bp, Mus musculus
tggcgaggacgagagctctatttca

SEQ ID NO: 381099 - DNA, 25 bp, Mus musculus
tggcgaggacgagagctctggtgca

SEQ ID NO: 381100 - DNA, 25 bp, Mus musculus
tggcgaggactagtgttacaggtgg

SEQ ID NO: 381101 - DNA, 25 bp, Mus musculus
tggcgaggagaaagcggtggagaaa

SEQ ID NO: 381102 - DNA, 25 bp, Mus musculus
tggcgaggagccatcaagcaaattt

SEQ ID NO: 381103 - DNA, 25 bp, Mus musculus
tggcgaggaggaggtgtagcccatg

SEQ ID NO: 381104 - DNA, 25 bp, Mus musculus
tggcgaggaggatctgatggacaag

SEQ ID NO: 381105 - DNA, 25 bp, Mus musculus
tggcgaggcatgtggctctggtttc

SEQ ID NO: 381106 - DNA, 25 bp, Mus musculus
tggcgaggctcaaagcccgatttgg

SEQ ID NO: 381107 - DNA, 25 bp, Mus musculus
tggcgagtagcaggaataaacacgt

SEQ ID NO: 381108 - DNA, 25 bp, Mus musculus
tggcgagtccttatgacacgtcccc

SEQ ID NO: 381109 - DNA, 25 bp, Mus musculus
tggcgagtctgtgaaggccccaaag

SEQ ID NO: 381110 - DNA, 25 bp, Mus musculus
tggcgagtggaaggtcctcatcatg

SEQ ID NO: 381111 - DNA, 25 bp, Mus musculus
tggcgagtggaagtcgtggaagaca

SEQ ID NO: 381112 - DNA, 25 bp, Mus musculus
tggcgattaaaggcctgaagctcat

SEQ ID NO: 381113 - DNA, 25 bp, Mus musculus
tggcgattagactctgccttcaggg

SEQ ID NO: 381114 - DNA, 25 bp, Mus musculus
tggcgattagaggtctgacatggct

SEQ ID NO: 381115 - DNA, 25 bp, Mus musculus
tggcgattggggtggtcctgccgac

SEQ ID NO: 381116 - DNA, 25 bp, Mus musculus
tggcgcagatgggatacagatttct

SEQ ID NO: 381117 - DNA, 25 bp, Mus musculus
tggcgcagatggtcaccctgctgat

SEQ ID NO: 381118 - DNA, 25 bp, Mus musculus
tggcgcaggagcgtggattggtgac

SEQ ID NO: 381119 - DNA, 25 bp, Mus musculus
tggcgcaggatgcaggagttcctca

SEQ ID NO: 381120 - DNA, 25 bp, Mus musculus
tggcgcagtcctaggactgcattta

SEQ ID NO: 381121 - DNA, 25 bp, Mus musculus
tggcgcagtcctagggcctggtggc

SEQ ID NO: 381122 - DNA, 25 bp, Mus musculus
tggcgcagtcctaggtgaagaagac

SEQ ID NO: 381123 - DNA, 25 bp, Mus musculus
tggcgcagtcttgagtaatccagaa

SEQ ID NO: 381124 - DNA, 25 bp, Mus musculus
tggcgcatcccagggttctgcctgt

SEQ ID NO: 381125 - DNA, 25 bp, Mus musculus
tggcgccaaaggggccaaggagaag

SEQ ID NO: 381126 - DNA, 25 bp, Mus musculus
tggcgccagccaggacggcttcacg

SEQ ID NO: 381127 - DNA, 25 bp, Mus musculus
tggcgcccagggcaaggacagccac

SEQ ID NO: 381128 - DNA, 25 bp, Mus musculus
tggcgcccagtgagtgaacccccac

SEQ ID NO: 381129 - DNA, 25 bp, Mus musculus
tggcgccccacagcttgaggaggca

SEQ ID NO: 381130 - DNA, 25 bp, Mus musculus
tggcgccccaccagaaaacgaggag

SEQ ID NO: 381131 - DNA, 25 bp, Mus musculus
tggcgcccgaccctaggtacccagg

SEQ ID NO: 381132 - DNA, 25 bp, Mus musculus
tggcgccgagcggggcgaggtggca

SEQ ID NO: 381133 - DNA, 25 bp, Mus musculus
tggcgccgagcgggtcctcaggact

SEQ ID NO: 381134 - DNA, 25 bp, Mus musculus
tggcgccgccccactgaagggcagt

SEQ ID NO: 381135 - DNA, 25 bp, Mus musculus
tggcgccgccgggttcaagcgctgt

SEQ ID NO: 381136 - DNA, 25 bp, Mus musculus
tggcgcctactcagggctaacatca

SEQ ID NO: 381137 - DNA, 25 bp, Mus musculus
tggcgcctagagaagcctccccagc

SEQ ID NO: 381138 - DNA, 25 bp, Mus musculus
tggcgcctatgatgggaagattaaa

SEQ ID NO: 381139 - DNA, 25 bp, Mus musculus
tggcgcctgaggtgctagaggacaa

SEQ ID NO: 381140 - DNA, 25 bp, Mus musculus
tggcgcctgtgaaaaagcttgtggc

SEQ ID NO: 381141 - DNA, 25 bp, Mus musculus
tggcgcgatgtctcacaccattttg

SEQ ID NO: 381142 - DNA, 25 bp, Mus musculus
tggcgcgatgtgcctgcgacagaca

SEQ ID NO: 381143 - DNA, 25 bp, Mus musculus
tggcgcgcctgcaggactttaagct

SEQ ID NO: 381144 - DNA, 25 bp, Mus musculus
tggcgcgcctgcaggcaagaaggag

SEQ ID NO: 381145 - DNA, 25 bp, Mus musculus
tggcgcgcggccaggtcttggtttc

SEQ ID NO: 381146 - DNA, 25 bp, Mus musculus
tggcgcgcgtccgaaatgctgagct

SEQ ID NO: 381147 - DNA, 25 bp, Mus musculus
tggcgcggcaaccaaccgtctggat

SEQ ID NO: 381148 - DNA, 25 bp, Mus musculus
tggcgcggccgaggctgcttccgcc

SEQ ID NO: 381149 - DNA, 25 bp, Mus musculus
tggcgctaaaaggtcctgtttcttc

SEQ ID NO: 381150 - DNA, 25 bp, Mus musculus
tggcgctaaaagtgatgcgattgac

SEQ ID NO: 381151 - DNA, 25 bp, Mus musculus
tggcgctcaccctgattgactcgtg

SEQ ID NO: 381152 - DNA, 25 bp, Mus musculus
tggcgctcaccctgcgactactgtg

SEQ ID NO: 381153 - DNA, 25 bp, Mus musculus
tggcgctccagactgtacccacagg

SEQ ID NO: 381154 - DNA, 25 bp, Mus musculus
tggcgctccagaggctggaggagcc

SEQ ID NO: 381155 - DNA, 25 bp, Mus musculus
tggcgctccagggacctctgagctg

SEQ ID NO: 381156 - DNA, 25 bp, Mus musculus
tggcgctccaggtgcccatcagctt

SEQ ID NO: 381157 - DNA, 25 bp, Mus musculus
tggcgctgagggtcgagaatacaag

SEQ ID NO: 381158 - DNA, 25 bp, Mus musculus
tggcgctgagggtcggtgccagcac

SEQ ID NO: 381159 - DNA, 25 bp, Mus musculus
tggcgctgccttgagagtcgcttca

SEQ ID NO: 381160 - DNA, 25 bp, Mus musculus
tggcgctggagagcctgaccagaca

SEQ ID NO: 381161 - DNA, 25 bp, Mus musculus
tggcgctgtacaagcttggcttctt

SEQ ID NO: 381162 - DNA, 25 bp, Mus musculus
tggcgctgtacaaggttcactctaa

SEQ ID NO: 381163 - DNA, 25 bp, Mus musculus
tggcgctgtccagggtcttcaaagc

SEQ ID NO: 381164 - DNA, 25 bp, Mus musculus
tggcgctttcttagatgttgccttc

SEQ ID NO: 381165 - DNA, 25 bp, Mus musculus
tggcgctttggagagcgtcaagatc

SEQ ID NO: 381166 - DNA, 25 bp, Mus musculus
tggcggaagaagagaagaaagatga

SEQ ID NO: 381167 - DNA, 25 bp, Mus musculus
tggcggacaggctgggccgtcggaa

SEQ ID NO: 381168 - DNA, 25 bp, Mus musculus
tggcggacagtttcctgtggccttc

SEQ ID NO: 381169 - DNA, 25 bp, Mus musculus
tggcggagagagtacccagtattac

SEQ ID NO: 381170 - DNA, 25 bp, Mus musculus
tggcggagaggtattagaagataat

SEQ ID NO: 381171 - DNA, 25 bp, Mus musculus
tggcggagaggtgttctctgaggac

SEQ ID NO: 381172 - DNA, 25 bp, Mus musculus
tggcggagcaggggaagagacacag

SEQ ID NO: 381173 - DNA, 25 bp, Mus musculus
tggcggagccgaatcctattctaag

SEQ ID NO: 381174 - DNA, 25 bp, Mus musculus
tggcggaggagataggcgtttctaa

SEQ ID NO: 381175 - DNA, 25 bp, Mus musculus
tggcggaggaggagttctccaacac

SEQ ID NO: 381176 - DNA, 25 bp, Mus musculus
tggcggaggaggcggacgagcaaaa

SEQ ID NO: 381177 - DNA, 25 bp, Mus musculus
tggcggaggattcacgtatgggacc

SEQ ID NO: 381178 - DNA, 25 bp, Mus musculus
tggcggaggggcaggttctggtatt

SEQ ID NO: 381179 - DNA, 25 bp, Mus musculus
tggcggagtcggaggccctaatgct

SEQ ID NO: 381180 - DNA, 25 bp, Mus musculus
tggcggagttcgagactaccaggta

SEQ ID NO: 381181 - DNA, 25 bp, Mus musculus
tggcggatcatgtgcagagcctggc

SEQ ID NO: 381182 - DNA, 25 bp, Mus musculus
tggcggcacagctggctggaccaga

SEQ ID NO: 381183 - DNA, 25 bp, Mus musculus
tggcggcagacgcagcttcggcttc

SEQ ID NO: 381184 - DNA, 25 bp, Mus musculus
tggcggccgaggtctgactgggccc

SEQ ID NO: 381185 - DNA, 25 bp, Mus musculus
tggcggccgccaaggacagtcacga

SEQ ID NO: 381186 - DNA, 25 bp, Mus musculus
tggcggccgggatctgggacgatgt

SEQ ID NO: 381187 - DNA, 25 bp, Mus musculus
tggcggcctttaggatgggaaagtt

SEQ ID NO: 381188 - DNA, 25 bp, Mus musculus
tggcggcctttaggctccccatata

SEQ ID NO: 381189 - DNA, 25 bp, Mus musculus
tggcggcgaagaggtcctgagttca

SEQ ID NO: 381190 - DNA, 25 bp, Mus musculus
tggcggcgaagtctcccctcaccag

SEQ ID NO: 381191 - DNA, 25 bp, Mus musculus
tggcggcgctggcgggtgatgaagc

SEQ ID NO: 381192 - DNA, 25 bp, Mus musculus
tggcggcgctggcgggtgttccgaa

SEQ ID NO: 381193 - DNA, 25 bp, Mus musculus
tggcggcggcggaccggcggcggcg

SEQ ID NO: 381194 - DNA, 25 bp, Mus musculus
tggcggcgtgagcccagatcatgca

SEQ ID NO: 381195 - DNA, 25 bp, Mus musculus
tggcggctctacagccagaatgtca

SEQ ID NO: 381196 - DNA, 25 bp, Mus musculus
tggcggctctaggctccagcagcca

SEQ ID NO: 381197 - DNA, 25 bp, Mus musculus
tggcggctgggaccctgtacacata

SEQ ID NO: 381198 - DNA, 25 bp, Mus musculus
tggcggcttaaaaggcagtatgatg

SEQ ID NO: 381199 - DNA, 25 bp, Mus musculus
tggcgggcaacagttcactgaggaa

SEQ ID NO: 381200 - DNA, 25 bp, Mus musculus
tggcgggcaatggtgaatgagaatg

SEQ ID NO: 381201 - DNA, 25 bp, Mus musculus
tggcgggccggactatgcaagctgc

SEQ ID NO: 381202 - DNA, 25 bp, Mus musculus
tggcgggccgggtttctgttgatgc

SEQ ID NO: 381203 - DNA, 25 bp, Mus musculus
tggcgggcgaaggggaactgatcac

SEQ ID NO: 381204 - DNA, 25 bp, Mus musculus
tggcgggcgctaggtccgtctccca

SEQ ID NO: 381205 - DNA, 25 bp, Mus musculus
tggcgggcgttaaagctctcgtggc

SEQ ID NO: 381206 - DNA, 25 bp, Mus musculus
tggcggggaggctggggaaggaagc

SEQ ID NO: 381207 - DNA, 25 bp, Mus musculus
tggcggggaggctggtgcaaacagc

SEQ ID NO: 381208 - DNA, 25 bp, Mus musculus
tggcggggttgggaatggctttgct

SEQ ID NO: 381209 - DNA, 25 bp, Mus musculus
tggcggggttggggggcttctgctt

SEQ ID NO: 381210 - DNA, 25 bp, Mus musculus
tggcggggttggggtcgatactgac

SEQ ID NO: 381211 - DNA, 25 bp, Mus musculus
tggcgggtcctgcgttcttggccca

SEQ ID NO: 381212 - DNA, 25 bp, Mus musculus
tggcggtaacagagtactgtttggc

SEQ ID NO: 381213 - DNA, 25 bp, Mus musculus
tggcggtaccagcccctctcccgag

SEQ ID NO: 381214 - DNA, 25 bp, Mus musculus
tggcggtgaggagaggtttcatagt

SEQ ID NO: 381215 - DNA, 25 bp, Mus musculus
tggcggtgctccaggacagcatcgc

SEQ ID NO: 381216 - DNA, 25 bp, Mus musculus
tggcggtggacatcatcctgggcag

SEQ ID NO: 381217 - DNA, 25 bp, Mus musculus
tggcggtggaggcgggggccctagc

SEQ ID NO: 381218 - DNA, 25 bp, Mus musculus
tggcggtggtagtggaagcaatttt

SEQ ID NO: 381219 - DNA, 25 bp, Mus musculus
tggcggtggtagtggtggctatggc

SEQ ID NO: 381220 - DNA, 25 bp, Mus musculus
tggcggtgtacggcgcaacctgcgg

SEQ ID NO: 381221 - DNA, 25 bp, Mus musculus
tggcggtgtcaagaaaaggaagtcg

SEQ ID NO: 381222 - DNA, 25 bp, Mus musculus
tggcggtgtcaagccacagagcaac

SEQ ID NO: 381223 - DNA, 25 bp, Mus musculus
tggcggtgtcaaggaaccacaaacc

SEQ ID NO: 381224 - DNA, 25 bp, Mus musculus
tggcgtaaagagactgatgtctgga

SEQ ID NO: 381225 - DNA, 25 bp, Mus musculus
tggcgtaaagaggttctccccaatc

SEQ ID NO: 381226 - DNA, 25 bp, Mus musculus
tggcgtcgccggggatagaagtgga

SEQ ID NO: 381227 - DNA, 25 bp, Mus musculus
tggcgtcggggtgacatggacagat

SEQ ID NO: 381228 - DNA, 25 bp, Mus musculus
tggcgtctactccagtaaatcctgt

SEQ ID NO: 381229 - DNA, 25 bp, Mus musculus
tggcgtctcccaggtgttcttgaag

SEQ ID NO: 381230 - DNA, 25 bp, Mus musculus
tggcgtcttatgggttggaggatga

SEQ ID NO: 381231 - DNA, 25 bp, Mus musculus
tggcgtgactggctggtgtgcagga

SEQ ID NO: 381232 - DNA, 25 bp, Mus musculus
tggcgtgcgacaaggaaacttatgg

SEQ ID NO: 381233 - DNA, 25 bp, Mus musculus
tggcgtgcgacaagggtgactatta

SEQ ID NO: 381234 - DNA, 25 bp, Mus musculus
tggcgtgcgacaaggtccgcagatg

SEQ ID NO: 381235 - DNA, 25 bp, Mus musculus
tggcgtggaagggggaggcacacgg

SEQ ID NO: 381236 - DNA, 25 bp, Mus musculus
tggcgtggcagtgtacagctgtaag

SEQ ID NO: 381237 - DNA, 25 bp, Mus musculus
tggcgtgttctgagatgacagtcat

SEQ ID NO: 381238 - DNA, 25 bp, Mus musculus
tggcgtgttctgaggatcctggaaa

SEQ ID NO: 381239 - DNA, 25 bp, Mus musculus
tggcgttaaactttctccagaccag

SEQ ID NO: 381240 - DNA, 25 bp, Mus musculus
tggcgttatgggtgtgataggtata

SEQ ID NO: 381241 - DNA, 25 bp, Mus musculus
tggcgttatgtttgagatggtatca

SEQ ID NO: 381242 - DNA, 25 bp, Mus musculus
tggcgttcatggaatatgaagacaa

SEQ ID NO: 381243 - DNA, 25 bp, Mus musculus
tggcgttggagatctcatcccgtac

SEQ ID NO: 381244 - DNA, 25 bp, Mus musculus
tggcgttggagggtgctgagtactc

SEQ ID NO: 381245 - DNA, 25 bp, Mus musculus
tggcgttggagtgtcccatcctgat

SEQ ID NO: 381246 - DNA, 25 bp, Mus musculus
tggcgttggatggttacatccaggc

SEQ ID NO: 381247 - DNA, 25 bp, Mus musculus
tggcgttttagtgaacaacgtgggc

SEQ ID NO: 381248 - DNA, 25 bp, Mus musculus
tggctaaaaaaagaaatcacaattc

SEQ ID NO: 381249 - DNA, 25 bp, Mus musculus
tggctaaaaaaagaaggtgacacag

SEQ ID NO: 381250 - DNA, 25 bp, Mus musculus
tggctaaaactgtgcagttgtacta

SEQ ID NO: 381251 - DNA, 25 bp, Mus musculus
tggctaaaagccaagcacggaaata

SEQ ID NO: 381252 - DNA, 25 bp, Mus musculus
tggctaaataaccagagtatgctgg

SEQ ID NO: 381253 - DNA, 25 bp, Mus musculus
tggctaacccaggaactggtgctcc

SEQ ID NO: 381254 - DNA, 25 bp, Mus musculus
tggctaacctcaaagcctctccgac

SEQ ID NO: 381255 - DNA, 25 bp, Mus musculus
tggctaactctgagggcacgtcaga

SEQ ID NO: 381256 - DNA, 25 bp, Mus musculus
tggctaactctgagttcctgaaatt

SEQ ID NO: 381257 - DNA, 25 bp, Mus musculus
tggctaagagctgcttttagaagga

SEQ ID NO: 381258 - DNA, 25 bp, Mus musculus
tggctaagaggagaaaggcagcctc

SEQ ID NO: 381259 - DNA, 25 bp, Mus musculus
tggctaagtggctctgtatttctgt

SEQ ID NO: 381260 - DNA, 25 bp, Mus musculus
tggctaagtggctgagccaaaccag

SEQ ID NO: 381261 - DNA, 25 bp, Mus musculus
tggctaagtgggccctgcattatcc

SEQ ID NO: 381262 - DNA, 25 bp, Mus musculus
tggctaatgatgcctatcctggccc

SEQ ID NO: 381263 - DNA, 25 bp, Mus musculus
tggctaatggctcagctttcaacat

SEQ ID NO: 381264 - DNA, 25 bp, Mus musculus
tggctaattagcatctgaagttgag

SEQ ID NO: 381265 - DNA, 25 bp, Mus musculus
tggctacaaaaggtgcaccaatggg

SEQ ID NO: 381266 - DNA, 25 bp, Mus musculus
tggctacaaaaggtgcttccactca

SEQ ID NO: 381267 - DNA, 25 bp, Mus musculus
tggctacaaggctgagggaaaatac

SEQ ID NO: 381268 - DNA, 25 bp, Mus musculus
tggctacaagggatgggcataattc

SEQ ID NO: 381269 - DNA, 25 bp, Mus musculus
tggctacactgggcgccctgtgctt

SEQ ID NO: 381270 - DNA, 25 bp, Mus musculus
tggctaccacaaccagctgctgaac

SEQ ID NO: 381271 - DNA, 25 bp, Mus musculus
tggctaccagggacctcctggccgc

SEQ ID NO: 381272 - DNA, 25 bp, Mus musculus
tggctaccatgggagccccgcaagg

SEQ ID NO: 381273 - DNA, 25 bp, Mus musculus
tggctacccaaggccgcacatgcct

SEQ ID NO: 381274 - DNA, 25 bp, Mus musculus
tggctacctttctgaaggacgggct

SEQ ID NO: 381275 - DNA, 25 bp, Mus musculus
tggctacgacccgggagcccataag

SEQ ID NO: 381276 - DNA, 25 bp, Mus musculus
tggctacgagataacagacaaaaga

SEQ ID NO: 381277 - DNA, 25 bp, Mus musculus
tggctacgggcacggctcggatggc

SEQ ID NO: 381278 - DNA, 25 bp, Mus musculus
tggctactatactctgtattctgtc

SEQ ID NO: 381279 - DNA, 25 bp, Mus musculus
tggctactctgagataaagccactc

SEQ ID NO: 381280 - DNA, 25 bp, Mus musculus
tggctactctgagtgttataggctc

SEQ ID NO: 381281 - DNA, 25 bp, Mus musculus
tggctactgccaggcaatgaacatc

SEQ ID NO: 381282 - DNA, 25 bp, Mus musculus
tggctactggggatgcacaaaaagt

SEQ ID NO: 381283 - DNA, 25 bp, Mus musculus
tggctactggttcaagatggctttc

SEQ ID NO: 381284 - DNA, 25 bp, Mus musculus
tggctagactacagggaaagccacc

SEQ ID NO: 381285 - DNA, 25 bp, Mus musculus
tggctagagaggctgccctgggagc

SEQ ID NO: 381286 - DNA, 25 bp, Mus musculus
tggctagagtcattgcaggcccggc

SEQ ID NO: 381287 - DNA, 25 bp, Mus musculus
tggctagcaggtattcatgctagcc

SEQ ID NO: 381288 - DNA, 25 bp, Mus musculus
tggctagcatgagaacaaatataaa

SEQ ID NO: 381289 - DNA, 25 bp, Mus musculus
tggctagcatgagcatcagttgggg

SEQ ID NO: 381290 - DNA, 25 bp, Mus musculus
tggctagctcgtgtgccgtgcaggt

SEQ ID NO: 381291 - DNA, 25 bp, Mus musculus
tggctagctgcacatccctacaaag

SEQ ID NO: 381292 - DNA, 25 bp, Mus musculus
tggctagtgcaaagatcagctacta

SEQ ID NO: 381293 - DNA, 25 bp, Mus musculus
tggctatatcaagtttcatgcaggc

SEQ ID NO: 381294 - DNA, 25 bp, Mus musculus
tggctatcaggatgactttctgctc

SEQ ID NO: 381295 - DNA, 25 bp, Mus musculus
tggctatcatactgctgataaagat

SEQ ID NO: 381296 - DNA, 25 bp, Mus musculus
tggctatccagatattgctgttgga

SEQ ID NO: 381297 - DNA, 25 bp, Mus musculus
tggctatcccagatggatgactggt

SEQ ID NO: 381298 - DNA, 25 bp, Mus musculus
tggctatgaagaatgcccatatcac

SEQ ID NO: 381299 - DNA, 25 bp, Mus musculus
tggctatgaagccacattgggattg

SEQ ID NO: 381300 - DNA, 25 bp, Mus musculus
tggctatgccagctcttctcctatg

SEQ ID NO: 381301 - DNA, 25 bp, Mus musculus
tggctatgccaggaacccatctctc

SEQ ID NO: 381302 - DNA, 25 bp, Mus musculus
tggctatgccttctaggtttgatat

SEQ ID NO: 381303 - DNA, 25 bp, Mus musculus
tggctatgctctcagaggttcctga

SEQ ID NO: 381304 - DNA, 25 bp, Mus musculus
tggctatgctctcaggctggcatca

SEQ ID NO: 381305 - DNA, 25 bp, Mus musculus
tggctatggagaggtgggaaagggg

SEQ ID NO: 381306 - DNA, 25 bp, Mus musculus
tggctatgggagatgataaaagctt

SEQ ID NO: 381307 - DNA, 25 bp, Mus musculus
tggctatgtgtatggcttggcaaat

SEQ ID NO: 381308 - DNA, 25 bp, Mus musculus
tggctatgtgtatggtgattccacc

SEQ ID NO: 381309 - DNA, 25 bp, Mus musculus
tggctatgttgagattcattttatg

SEQ ID NO: 381310 - DNA, 25 bp, Mus musculus
tggctatgttgagcttcgttacgac

SEQ ID NO: 381311 - DNA, 25 bp, Mus musculus
tggctatgttggaaatataaatgag

SEQ ID NO: 381312 - DNA, 25 bp, Mus musculus
tggctattaaccaggtcttcaagat

SEQ ID NO: 381313 - DNA, 25 bp, Mus musculus
tggctattagagccagatcatctgt

SEQ ID NO: 381314 - DNA, 25 bp, Mus musculus
tggctattagagtgtgctcaagagt

SEQ ID NO: 381315 - DNA, 25 bp, Mus musculus
tggctattcggagaataatgttttt

SEQ ID NO: 381316 - DNA, 25 bp, Mus musculus
tggctattgagcatgcaccattgtg

SEQ ID NO: 381317 - DNA, 25 bp, Mus musculus
tggctattgagctcttcctcatggt

SEQ ID NO: 381318 - DNA, 25 bp, Mus musculus
tggctatttcaggctttgatgggac

SEQ ID NO: 381319 - DNA, 25 bp, Mus musculus
tggctcaaaaaaaaaaagcctctaa

SEQ ID NO: 381320 - DNA, 25 bp, Mus musculus
tggctcaaactaagtggcctgcttg

SEQ ID NO: 381321 - DNA, 25 bp, Mus musculus
tggctcaaagtcaagaaaaaacaag

SEQ ID NO: 381322 - DNA, 25 bp, Mus musculus
tggctcaaagtcaagatctcaaaat

SEQ ID NO: 381323 - DNA, 25 bp, Mus musculus
tggctcaacagatccaaaaggtaat

SEQ ID NO: 381324 - DNA, 25 bp, Mus musculus
tggctcaagaggaaggctacgtgtt

SEQ ID NO: 381325 - DNA, 25 bp, Mus musculus
tggctcaagcaggaacctagcaaaa

SEQ ID NO: 381326 - DNA, 25 bp, Mus musculus
tggctcaagcagggccacaatgcca

SEQ ID NO: 381327 - DNA, 25 bp, Mus musculus
tggctcaagcaggtaacaaatcaca

SEQ ID NO: 381328 - DNA, 25 bp, Mus musculus
tggctcaaggaaccatctggtgacc

SEQ ID NO: 381329 - DNA, 25 bp, Mus musculus
tggctcaatacggttattactctgg

SEQ ID NO: 381330 - DNA, 25 bp, Mus musculus
tggctcaatgaacaggttgataaag

SEQ ID NO: 381331 - DNA, 25 bp, Mus musculus
tggctcaatgatccttccttcatac

SEQ ID NO: 381332 - DNA, 25 bp, Mus musculus
tggctcacagctgtgatgagtgcag

SEQ ID NO: 381333 - DNA, 25 bp, Mus musculus
tggctcacaggaatagatttcttat

SEQ ID NO: 381334 - DNA, 25 bp, Mus musculus
tggctcactggtcctgcgactggag

SEQ ID NO: 381335 - DNA, 25 bp, Mus musculus
tggctcacttgggtgctggtctcct

SEQ ID NO: 381336 - DNA, 25 bp, Mus musculus
tggctcagaggtgtctgccttattg

SEQ ID NO: 381337 - DNA, 25 bp, Mus musculus
tggctcaggagcaagattgccaagg

SEQ ID NO: 381338 - DNA, 25 bp, Mus musculus
tggctcaggagcaagtttcaggtta

SEQ ID NO: 381339 - DNA, 25 bp, Mus musculus
tggctcagtcaatggagagaacaag

SEQ ID NO: 381340 - DNA, 25 bp, Mus musculus
tggctcagtgggctccgtgaagact

SEQ ID NO: 381341 - DNA, 25 bp, Mus musculus
tggctcatcagccacggcaagctca

SEQ ID NO: 381342 - DNA, 25 bp, Mus musculus
tggctcatcagctggctctgtccac

SEQ ID NO: 381343 - DNA, 25 bp, Mus musculus
tggctcatcaggaggactgacaaac

SEQ ID NO: 381344 - DNA, 25 bp, Mus musculus
tggctcatcagttggcagttctgca

SEQ ID NO: 381345 - DNA, 25 bp, Mus musculus
tggctcatggggaagtctaaagcta

SEQ ID NO: 381346 - DNA, 25 bp, Mus musculus
tggctcatgggttctgcaatcttca

SEQ ID NO: 381347 - DNA, 25 bp, Mus musculus
tggctcattgaaggttcaaccattt

SEQ ID NO: 381348 - DNA, 25 bp, Mus musculus
tggctccaactggcgtccctacagc

SEQ ID NO: 381349 - DNA, 25 bp, Mus musculus
tggctccaactgggtctgagtgccc

SEQ ID NO: 381350 - DNA, 25 bp, Mus musculus
tggctccaccactgagtttgaagag

SEQ ID NO: 381351 - DNA, 25 bp, Mus musculus
tggctccacccaggctaccttcatg

SEQ ID NO: 381352 - DNA, 25 bp, Mus musculus
tggctccactgtcttatatcggatc

SEQ ID NO: 381353 - DNA, 25 bp, Mus musculus
tggctccagaaggatctgttccaaa

SEQ ID NO: 381354 - DNA, 25 bp, Mus musculus
tggctccagagctctctgtggttgc

SEQ ID NO: 381355 - DNA, 25 bp, Mus musculus
tggctccagcctgagagcttcggtg

SEQ ID NO: 381356 - DNA, 25 bp, Mus musculus
tggctccagctccaggtacttcgag

SEQ ID NO: 381357 - DNA, 25 bp, Mus musculus
tggctccatatatcaaatctggagg

SEQ ID NO: 381358 - DNA, 25 bp, Mus musculus
tggctccatcctggcctcccttttt

SEQ ID NO: 381359 - DNA, 25 bp, Mus musculus
tggctccatcctgttactgagctgc

SEQ ID NO: 381360 - DNA, 25 bp, Mus musculus
tggctccatgaagtacaaaggcata

SEQ ID NO: 381361 - DNA, 25 bp, Mus musculus
tggctccatgcagctgaggtctaca

SEQ ID NO: 381362 - DNA, 25 bp, Mus musculus
tggctccattcagagcataccagaa

SEQ ID NO: 381363 - DNA, 25 bp, Mus musculus
tggctccattcagttttcctttttc

SEQ ID NO: 381364 - DNA, 25 bp, Mus musculus
tggctcccaggtcgggaccctggtg

SEQ ID NO: 381365 - DNA, 25 bp, Mus musculus
tggctcccaggtcggtgttttatct

SEQ ID NO: 381366 - DNA, 25 bp, Mus musculus
tggctcccagtgtgctccaactgct

SEQ ID NO: 381367 - DNA, 25 bp, Mus musculus
tggctcccgggagcggggcagccac

SEQ ID NO: 381368 - DNA, 25 bp, Mus musculus
tggctcccgggagcggtcgagctag

SEQ ID NO: 381369 - DNA, 25 bp, Mus musculus
tggctccctgaggggtacctcggaa

SEQ ID NO: 381370 - DNA, 25 bp, Mus musculus
tggctccctgcacaggggtgacagt

SEQ ID NO: 381371 - DNA, 25 bp, Mus musculus
tggctccctgcatgtacccctcaat

SEQ ID NO: 381372 - DNA, 25 bp, Mus musculus
tggctcccttgggaagccggaggaa

SEQ ID NO: 381373 - DNA, 25 bp, Mus musculus
tggctcccttgggaatttagaagcc

SEQ ID NO: 381374 - DNA, 25 bp, Mus musculus
tggctcccttggggttctcacgcgg

SEQ ID NO: 381375 - DNA, 25 bp, Mus musculus
tggctccgcagcagaatgccaagag

SEQ ID NO: 381376 - DNA, 25 bp, Mus musculus
tggctccgccgagcacagtgtatga

SEQ ID NO: 381377 - DNA, 25 bp, Mus musculus
tggctccgccgaggaagaaaatact

SEQ ID NO: 381378 - DNA, 25 bp, Mus musculus
tggctccggaaagggctctatcacg

SEQ ID NO: 381379 - DNA, 25 bp, Mus musculus
tggctccggacagaccatggcaacg

SEQ ID NO: 381380 - DNA, 25 bp, Mus musculus
tggctccggacaggatgcatttgct

SEQ ID NO: 381381 - DNA, 25 bp, Mus musculus
tggctccggacagtttccttttaga

SEQ ID NO: 381382 - DNA, 25 bp, Mus musculus
tggctccggcagggaagcccagccc

SEQ ID NO: 381383 - DNA, 25 bp, Mus musculus
tggctccgggagaaggatcagtggt

SEQ ID NO: 381384 - DNA, 25 bp, Mus musculus
tggctcctatatcatagcaagagga

SEQ ID NO: 381385 - DNA, 25 bp, Mus musculus
tggctcctccagggtccggtactgg

SEQ ID NO: 381386 - DNA, 25 bp, Mus musculus
tggctcctccaggtgtttgtggtag

SEQ ID NO: 381387 - DNA, 25 bp, Mus musculus
tggctcctgcttccggtgttccgaa

SEQ ID NO: 381388 - DNA, 25 bp, Mus musculus
tggctccttaccaggagatcgagac

SEQ ID NO: 381389 - DNA, 25 bp, Mus musculus
tggctccttcacccgggaggaagct

SEQ ID NO: 381390 - DNA, 25 bp, Mus musculus
tggctcgaaaaaacatgcagagatc

SEQ ID NO: 381391 - DNA, 25 bp, Mus musculus
tggctcgcaggtttgcctgcaatga

SEQ ID NO: 381392 - DNA, 25 bp, Mus musculus
tggctcggcgtcgccggcagctgca

SEQ ID NO: 381393 - DNA, 25 bp, Mus musculus
tggctcgggctgcagatttattgcc

SEQ ID NO: 381394 - DNA, 25 bp, Mus musculus
tggctcggtacaggttgtaagttct

SEQ ID NO: 381395 - DNA, 25 bp, Mus musculus
tggctcggtgtgtcccttagaagat

SEQ ID NO: 381396 - DNA, 25 bp, Mus musculus
tggctcggtgtgtgctgcttttgat

SEQ ID NO: 381397 - DNA, 25 bp, Mus musculus
tggctcgtgaaagattcaactggca

SEQ ID NO: 381398 - DNA, 25 bp, Mus musculus
tggctcgtgaaagtgcattgttggt

SEQ ID NO: 381399 - DNA, 25 bp, Mus musculus
tggctctaaagaaggatgtggactg

SEQ ID NO: 381400 - DNA, 25 bp, Mus musculus
tggctctaaatgggatatccttctc

SEQ ID NO: 381401 - DNA, 25 bp, Mus musculus
tggctctagagaaggagctagaagc

SEQ ID NO: 381402 - DNA, 25 bp, Mus musculus
tggctctataaacaggcggcagcag

SEQ ID NO: 381403 - DNA, 25 bp, Mus musculus
tggctctataaacaggtcttagagc

SEQ ID NO: 381404 - DNA, 25 bp, Mus musculus
tggctctatcacaggccaaaacaac

SEQ ID NO: 381405 - DNA, 25 bp, Mus musculus
tggctctcactgaccctctcccctt

SEQ ID NO: 381406 - DNA, 25 bp, Mus musculus
tggctctcagccaccaccttgtcgc

SEQ ID NO: 381407 - DNA, 25 bp, Mus musculus
tggctctcagcttgcagacaaaagg

SEQ ID NO: 381408 - DNA, 25 bp, Mus musculus
tggctctcaggagcgcggccttctg

SEQ ID NO: 381409 - DNA, 25 bp, Mus musculus
tggctctcattattttcacaaagtt

SEQ ID NO: 381410 - DNA, 25 bp, Mus musculus
tggctctctgaggtggaggctctcc

SEQ ID NO: 381411 - DNA, 25 bp, Mus musculus
tggctctgaagaaggatgtggactg

SEQ ID NO: 381412 - DNA, 25 bp, Mus musculus
tggctctgaagattgccctctatga

SEQ ID NO: 381413 - DNA, 25 bp, Mus musculus
tggctctgagaacaggaagcccagc

SEQ ID NO: 381414 - DNA, 25 bp, Mus musculus
tggctctgagataggtgtcttccac

SEQ ID NO: 381415 - DNA, 25 bp, Mus musculus
tggctctgaggtaggtgtcttccac

SEQ ID NO: 381416 - DNA, 25 bp, Mus musculus
tggctctgcaggtagccagaaatgg

SEQ ID NO: 381417 - DNA, 25 bp, Mus musculus
tggctctggaccctcttctagcccc

SEQ ID NO: 381418 - DNA, 25 bp, Mus musculus
tggctctggcacagccggagagaag

SEQ ID NO: 381419 - DNA, 25 bp, Mus musculus
tggctctggcacaggtgctttgcca

SEQ ID NO: 381420 - DNA, 25 bp, Mus musculus
tggctctggtcgtggacgcagacga

SEQ ID NO: 381421 - DNA, 25 bp, Mus musculus
tggctctgtctagagctgaggacct

SEQ ID NO: 381422 - DNA, 25 bp, Mus musculus
tggctcttaagatcttctgtgtgca

SEQ ID NO: 381423 - DNA, 25 bp, Mus musculus
tggctcttaggtaagaagacaagat

SEQ ID NO: 381424 - DNA, 25 bp, Mus musculus
tggctcttcatccagcagatccgaa

SEQ ID NO: 381425 - DNA, 25 bp, Mus musculus
tggctcttcatccagcattccatga

SEQ ID NO: 381426 - DNA, 25 bp, Mus musculus
tggctcttccacaggtctgttggtg

SEQ ID NO: 381427 - DNA, 25 bp, Mus musculus
tggctcttctaaagacctcaaagga

SEQ ID NO: 381428 - DNA, 25 bp, Mus musculus
tggctcttttccaggtggttttcct

SEQ ID NO: 381429 - DNA, 25 bp, Mus musculus
tggctgaaagataagcccctggtcc

SEQ ID NO: 381430 - DNA, 25 bp, Mus musculus
tggctgaaaggacttctagatctgt

SEQ ID NO: 381431 - DNA, 25 bp, Mus musculus
tggctgaacagacttggctttcttg

SEQ ID NO: 381432 - DNA, 25 bp, Mus musculus
tggctgaacagagaacagagtttcc

SEQ ID NO: 381433 - DNA, 25 bp, Mus musculus
tggctgaacagtgagcttcactaga

SEQ ID NO: 381434 - DNA, 25 bp, Mus musculus
tggctgaacagtttccgctgccttg

SEQ ID NO: 381435 - DNA, 25 bp, Mus musculus
tggctgaagacacaggggctcctta

SEQ ID NO: 381436 - DNA, 25 bp, Mus musculus
tggctgaagaggtcccaggtaaatc

SEQ ID NO: 381437 - DNA, 25 bp, Mus musculus
tggctgaagcaggaatggacagacc

SEQ ID NO: 381438 - DNA, 25 bp, Mus musculus
tggctgaaggagaacttgagagaga

SEQ ID NO: 381439 - DNA, 25 bp, Mus musculus
tggctgaaggaggtctctctgctcc

SEQ ID NO: 381440 - DNA, 25 bp, Mus musculus
tggctgaagggagagttcgtgtcga

SEQ ID NO: 381441 - DNA, 25 bp, Mus musculus
tggctgaagtgaggggggtccagcg

SEQ ID NO: 381442 - DNA, 25 bp, Mus musculus
tggctgaagtgagtgggcccagcca

SEQ ID NO: 381443 - DNA, 25 bp, Mus musculus
tggctgaatagcctgagaaatgcca

SEQ ID NO: 381444 - DNA, 25 bp, Mus musculus
tggctgacaaagagcttccactttc

SEQ ID NO: 381445 - DNA, 25 bp, Mus musculus
tggctgacaaagggcactggttcaa

SEQ ID NO: 381446 - DNA, 25 bp, Mus musculus
tggctgacaagatgcaggtactacg

SEQ ID NO: 381447 - DNA, 25 bp, Mus musculus
tggctgacaagcctatcctctactc

SEQ ID NO: 381448 - DNA, 25 bp, Mus musculus
tggctgacaaggaagcggcctttga

SEQ ID NO: 381449 - DNA, 25 bp, Mus musculus
tggctgacaaggaaggcctgaaggg

SEQ ID NO: 381450 - DNA, 25 bp, Mus musculus
tggctgacaaggcacccacatcttt

SEQ ID NO: 381451 - DNA, 25 bp, Mus musculus
tggctgacacgcttccaggtccgag

SEQ ID NO: 381452 - DNA, 25 bp, Mus musculus
tggctgacacggtccgaggagacat

SEQ ID NO: 381453 - DNA, 25 bp, Mus musculus
tggctgacagatctcggcaaaagtg

SEQ ID NO: 381454 - DNA, 25 bp, Mus musculus
tggctgacagcttggatctgtctga

SEQ ID NO: 381455 - DNA, 25 bp, Mus musculus
tggctgacaggattgtccggagcag

SEQ ID NO: 381456 - DNA, 25 bp, Mus musculus
tggctgacagtcatgagagccgagt

SEQ ID NO: 381457 - DNA, 25 bp, Mus musculus
tggctgaccttcatgcaaggctggg

SEQ ID NO: 381458 - DNA, 25 bp, Mus musculus
tggctgactgcagatctgatttgta

SEQ ID NO: 381459 - DNA, 25 bp, Mus musculus
tggctgactgctgtacacttcctga

SEQ ID NO: 381460 - DNA, 25 bp, Mus musculus
tggctgagaaaatggctgttgatgg

SEQ ID NO: 381461 - DNA, 25 bp, Mus musculus
tggctgagaaccgggaccgcgtggc

SEQ ID NO: 381462 - DNA, 25 bp, Mus musculus
tggctgagacaggcacataagactt

SEQ ID NO: 381463 - DNA, 25 bp, Mus musculus
tggctgagagccgagccagacaggt

SEQ ID NO: 381464 - DNA, 25 bp, Mus musculus
tggctgagagtaaatgtggggacct

SEQ ID NO: 381465 - DNA, 25 bp, Mus musculus
tggctgagcagcaaaggtgaatgaa

SEQ ID NO: 381466 - DNA, 25 bp, Mus musculus
tggctgaggacctcctttcttattt

SEQ ID NO: 381467 - DNA, 25 bp, Mus musculus
tggctgaggacctcggatgggtccc

SEQ ID NO: 381468 - DNA, 25 bp, Mus musculus
tggctgaggagaagcaaaccaagag

SEQ ID NO: 381469 - DNA, 25 bp, Mus musculus
tggctgaggaggcagctgacctaga

SEQ ID NO: 381470 - DNA, 25 bp, Mus musculus
tggctgaggctcaggagaccaccat

SEQ ID NO: 381471 - DNA, 25 bp, Mus musculus
tggctgaggctcagtggagaccaga

SEQ ID NO: 381472 - DNA, 25 bp, Mus musculus
tggctgagtatagacaactgtcatc

SEQ ID NO: 381473 - DNA, 25 bp, Mus musculus
tggctgagtataggaaggggccaga

SEQ ID NO: 381474 - DNA, 25 bp, Mus musculus
tggctgagttccagagcccccttca

SEQ ID NO: 381475 - DNA, 25 bp, Mus musculus
tggctgatagggtgggagagggccg

SEQ ID NO: 381476 - DNA, 25 bp, Mus musculus
tggctgatcaaaggaaaggactcag

SEQ ID NO: 381477 - DNA, 25 bp, Mus musculus
tggctgatctgcatccccaaaagca

SEQ ID NO: 381478 - DNA, 25 bp, Mus musculus
tggctgatgaaatgggtctaggaaa

SEQ ID NO: 381479 - DNA, 25 bp, Mus musculus
tggctgatgaggtataccaagacaa

SEQ ID NO: 381480 - DNA, 25 bp, Mus musculus
tggctgatggcatgtgtccaaatga

SEQ ID NO: 381481 - DNA, 25 bp, Mus musculus
tggctgcaaaaaagcactggaatga

SEQ ID NO: 381482 - DNA, 25 bp, Mus musculus
tggctgcaaaaacttgagaattaca

SEQ ID NO: 381483 - DNA, 25 bp, Mus musculus
tggctgcaaaaaggtcctggtctct

SEQ ID NO: 381484 - DNA, 25 bp, Mus musculus
tggctgcaaacactcagagtgatta

SEQ ID NO: 381485 - DNA, 25 bp, Mus musculus
tggctgcaaaggccactttgccaag

SEQ ID NO: 381486 - DNA, 25 bp, Mus musculus
tggctgcaaagttgcagatatcaag

SEQ ID NO: 381487 - DNA, 25 bp, Mus musculus
tggctgcaagaaaatgccagaaaat

SEQ ID NO: 381488 - DNA, 25 bp, Mus musculus
tggctgcacagaaagactaccacca

SEQ ID NO: 381489 - DNA, 25 bp, Mus musculus
tggctgcacagaaagccaggggctg

SEQ ID NO: 381490 - DNA, 25 bp, Mus musculus
tggctgcacagaaagggagagtcct

SEQ ID NO: 381491 - DNA, 25 bp, Mus musculus
tggctgcacagtgtatgagaagcag

SEQ ID NO: 381492 - DNA, 25 bp, Mus musculus
tggctgcagagcgggaggagactcg

SEQ ID NO: 381493 - DNA, 25 bp, Mus musculus
tggctgcagaggtagaccctgactt

SEQ ID NO: 381494 - DNA, 25 bp, Mus musculus
tggctgcagaggtggaccctgatca

SEQ ID NO: 381495 - DNA, 25 bp, Mus musculus
tggctgcagatccgcccctccttct

SEQ ID NO: 381496 - DNA, 25 bp, Mus musculus
tggctgcagatccggtcctctccgg

SEQ ID NO: 381497 - DNA, 25 bp, Mus musculus
tggctgcagcgctagatggaggtga

SEQ ID NO: 381498 - DNA, 25 bp, Mus musculus
tggctgcagctggaggtgtggaaca

SEQ ID NO: 381499 - DNA, 25 bp, Mus musculus
tggctgcaggcggcccaagatgtcc

SEQ ID NO: 381500 - DNA, 25 bp, Mus musculus
tggctgcaggcggcttgaagatgag

SEQ ID NO: 381501 - DNA, 25 bp, Mus musculus
tggctgcagtggatgagcaacatgt

SEQ ID NO: 381502 - DNA, 25 bp, Mus musculus
tggctgcagtggatgatgagtctga

SEQ ID NO: 381503 - DNA, 25 bp, Mus musculus
tggctgcatagatgacgccacacgc

SEQ ID NO: 381504 - DNA, 25 bp, Mus musculus
tggctgcatccagaggtctggtagc

SEQ ID NO: 381505 - DNA, 25 bp, Mus musculus
tggctgcattgcatgcagcgtgcag

SEQ ID NO: 381506 - DNA, 25 bp, Mus musculus
tggctgccacgcagactgtatcgtg

SEQ ID NO: 381507 - DNA, 25 bp, Mus musculus
tggctgccagcgggcgaactttctg

SEQ ID NO: 381508 - DNA, 25 bp, Mus musculus
tggctgccagtagataaaagatctg

SEQ ID NO: 381509 - DNA, 25 bp, Mus musculus
tggctgccagtcttcaattagtggg

SEQ ID NO: 381510 - DNA, 25 bp, Mus musculus
tggctgccatagcaaaaaagcaaga

SEQ ID NO: 381511 - DNA, 25 bp, Mus musculus
tggctgccataggagtcagtgactt

SEQ ID NO: 381512 - DNA, 25 bp, Mus musculus
tggctgccattcaaacacacacagg

SEQ ID NO: 381513 - DNA, 25 bp, Mus musculus
tggctgccattcaaattcatgagat

SEQ ID NO: 381514 - DNA, 25 bp, Mus musculus
tggctgccattcaagaaggagaaaa

SEQ ID NO: 381515 - DNA, 25 bp, Mus musculus
tggctgcccaaggtgaacttgatct

SEQ ID NO: 381516 - DNA, 25 bp, Mus musculus
tggctgcccaaggttgttgctaagt

SEQ ID NO: 381517 - DNA, 25 bp, Mus musculus
tggctgccgtgacgcatgatctttc

SEQ ID NO: 381518 - DNA, 25 bp, Mus musculus
tggctgccgtgacggttgcaggccg

SEQ ID NO: 381519 - DNA, 25 bp, Mus musculus
tggctgcgtttgagcctgagccttt

SEQ ID NO: 381520 - DNA, 25 bp, Mus musculus
tggctgctaaccgggtctttggggc

SEQ ID NO: 381521 - DNA, 25 bp, Mus musculus
tggctgctcagctgcactgagctgt

SEQ ID NO: 381522 - DNA, 25 bp, Mus musculus
tggctgctcagtgtttcctttcaga

SEQ ID NO: 381523 - DNA, 25 bp, Mus musculus
tggctgctcccatgatgttcctgta

SEQ ID NO: 381524 - DNA, 25 bp, Mus musculus
tggctgctctgagacctcgccatgc

SEQ ID NO: 381525 - DNA, 25 bp, Mus musculus
tggctgctgactctgctctccctgt

SEQ ID NO: 381526 - DNA, 25 bp, Mus musculus
tggctgctgcaggtcctgtgggaat

SEQ ID NO: 381527 - DNA, 25 bp, Mus musculus
tggctgctgcagtgctggggatcaa

SEQ ID NO: 381528 - DNA, 25 bp, Mus musculus
tggctgctgggaagtccgcccgtgc

SEQ ID NO: 381529 - DNA, 25 bp, Mus musculus
tggctgcttataagagagcttcatg

SEQ ID NO: 381530 - DNA, 25 bp, Mus musculus
tggctgcttataaggtgcacacagg

SEQ ID NO: 381531 - DNA, 25 bp, Mus musculus
tggctgcttccaggcttttatttgt

SEQ ID NO: 381532 - DNA, 25 bp, Mus musculus
tggctgctttgcggactttgaatgt

SEQ ID NO: 381533 - DNA, 25 bp, Mus musculus
tggctgctttgcggtactggaattg

SEQ ID NO: 381534 - DNA, 25 bp, Mus musculus
tggctggaacggctattcgctgcct

SEQ ID NO: 381535 - DNA, 25 bp, Mus musculus
tggctggaagcagatgttttgggtc

SEQ ID NO: 381536 - DNA, 25 bp, Mus musculus
tggctggaataaaaattgggatgaa

SEQ ID NO: 381537 - DNA, 25 bp, Mus musculus
tggctggaccagatgcggtgagcac

SEQ ID NO: 381538 - DNA, 25 bp, Mus musculus
tggctggaccgaagcccaaagccca

SEQ ID NO: 381539 - DNA, 25 bp, Mus musculus
tggctggactgcagaggccacttct

SEQ ID NO: 381540 - DNA, 25 bp, Mus musculus
tggctggagagaaggataaagggga

SEQ ID NO: 381541 - DNA, 25 bp, Mus musculus
tggctggagagaaggcctgcctgcc

SEQ ID NO: 381542 - DNA, 25 bp, Mus musculus
tggctggagagaagggctattggct

SEQ ID NO: 381543 - DNA, 25 bp, Mus musculus
tggctggagagaaggtcatttgaga

SEQ ID NO: 381544 - DNA, 25 bp, Mus musculus
tggctggagagctgtgtggctgagc

SEQ ID NO: 381545 - DNA, 25 bp, Mus musculus
tggctggaggggagtggggccggcc

SEQ ID NO: 381546 - DNA, 25 bp, Mus musculus
tggctggaggggatgccaacaagga

SEQ ID NO: 381547 - DNA, 25 bp, Mus musculus
tggctggaggggtgatggtaatgcc

SEQ ID NO: 381548 - DNA, 25 bp, Mus musculus
tggctggatccggtggacacaccac

SEQ ID NO: 381549 - DNA, 25 bp, Mus musculus
tggctggatccgtaccccaagtacc

SEQ ID NO: 381550 - DNA, 25 bp, Mus musculus
tggctggatccgtattcttgttcct

SEQ ID NO: 381551 - DNA, 25 bp, Mus musculus
tggctggattcaaggggaagaagcc

SEQ ID NO: 381552 - DNA, 25 bp, Mus musculus
tggctggcaatgtccacagacaaac

SEQ ID NO: 381553 - DNA, 25 bp, Mus musculus
tggctggcacaggagagggaggcct

SEQ ID NO: 381554 - DNA, 25 bp, Mus musculus
tggctggcacaggaggcctggagga

SEQ ID NO: 381555 - DNA, 25 bp, Mus musculus
tggctggcagcactgaaaactgatg

SEQ ID NO: 381556 - DNA, 25 bp, Mus musculus
tggctggcaggaggcacagtggtgt

SEQ ID NO: 381557 - DNA, 25 bp, Mus musculus
tggctggcgaaggatgatgccctgg

SEQ ID NO: 381558 - DNA, 25 bp, Mus musculus
tggctggcgtatgaggagtgggaag

SEQ ID NO: 381559 - DNA, 25 bp, Mus musculus
tggctggcgtgaggccaaagcaaaa

SEQ ID NO: 381560 - DNA, 25 bp, Mus musculus
tggctggctcaaggaaccatctggt

SEQ ID NO: 381561 - DNA, 25 bp, Mus musculus
tggctgggaaccaccgtcacttcca

SEQ ID NO: 381562 - DNA, 25 bp, Mus musculus
tggctgggaccaggagctgacagat

SEQ ID NO: 381563 - DNA, 25 bp, Mus musculus
tggctgggcagattggccacctgct

SEQ ID NO: 381564 - DNA, 25 bp, Mus musculus
tggctgggccctgtttttgggaata

SEQ ID NO: 381565 - DNA, 25 bp, Mus musculus
tggctgggccttgggggcctgggct

SEQ ID NO: 381566 - DNA, 25 bp, Mus musculus
tggctgggttcccagtgatagaaaa

SEQ ID NO: 381567 - DNA, 25 bp, Mus musculus
tggctggtaccaattctatttattt

SEQ ID NO: 381568 - DNA, 25 bp, Mus musculus
tggctggtacccctgctgatgtacc

SEQ ID NO: 381569 - DNA, 25 bp, Mus musculus
tggctggtacccgtgctgatgtacc

SEQ ID NO: 381570 - DNA, 25 bp, Mus musculus
tggctggtccagctggtcttcacag

SEQ ID NO: 381571 - DNA, 25 bp, Mus musculus
tggctggtccaggtacatccctgag

SEQ ID NO: 381572 - DNA, 25 bp, Mus musculus
tggctggtccatcctctggaccgtg

SEQ ID NO: 381573 - DNA, 25 bp, Mus musculus
tggctggtgcctgactttaagcaag

SEQ ID NO: 381574 - DNA, 25 bp, Mus musculus
tggctggtggagtgttctccagttt

SEQ ID NO: 381575 - DNA, 25 bp, Mus musculus
tggctgtaagaaggtgattttaaaa

SEQ ID NO: 381576 - DNA, 25 bp, Mus musculus
tggctgtacagggatggctaccaga

SEQ ID NO: 381577 - DNA, 25 bp, Mus musculus
tggctgtaccaccttcccaggacca

SEQ ID NO: 381578 - DNA, 25 bp, Mus musculus
tggctgtagcagctgcaccacatat

SEQ ID NO: 381579 - DNA, 25 bp, Mus musculus
tggctgtagcagtgcaccacatatc

SEQ ID NO: 381580 - DNA, 25 bp, Mus musculus
tggctgtagccaaagagactgcttc

SEQ ID NO: 381581 - DNA, 25 bp, Mus musculus
tggctgtatccataggagttttaaa

SEQ ID NO: 381582 - DNA, 25 bp, Mus musculus
tggctgtatccataggatttacatg

SEQ ID NO: 381583 - DNA, 25 bp, Mus musculus
tggctgtatggcgatgagaatgaag

SEQ ID NO: 381584 - DNA, 25 bp, Mus musculus
tggctgtatggcggcccgtgggacg

SEQ ID NO: 381585 - DNA, 25 bp, Mus musculus
tggctgtatttgaaaaaactggcca

SEQ ID NO: 381586 - DNA, 25 bp, Mus musculus
tggctgtatttggaatgggctgctt

SEQ ID NO: 381587 - DNA, 25 bp, Mus musculus
tggctgtcacaaagatcatagccca

SEQ ID NO: 381588 - DNA, 25 bp, Mus musculus
tggctgtcaccaaggaccccaactg

SEQ ID NO: 381589 - DNA, 25 bp, Mus musculus
tggctgtcaccaaggcccacgtttt

SEQ ID NO: 381590 - DNA, 25 bp, Mus musculus
tggctgtcagctgctgactgtgcat

SEQ ID NO: 381591 - DNA, 25 bp, Mus musculus
tggctgtctgaccaagtaacttagc

SEQ ID NO: 381592 - DNA, 25 bp, Mus musculus
tggctgtctggtttaacttgcacag

SEQ ID NO: 381593 - DNA, 25 bp, Mus musculus
tggctgtgcaggtataatggccgga

SEQ ID NO: 381594 - DNA, 25 bp, Mus musculus
tggctgtgctgcagaaaaagcagac

SEQ ID NO: 381595 - DNA, 25 bp, Mus musculus
tggctgtgtgattgatcctgttaca

SEQ ID NO: 381596 - DNA, 25 bp, Mus musculus
tggctgtgtgcggtctgttcctgcg

SEQ ID NO: 381597 - DNA, 25 bp, Mus musculus
tggctgttagtaagaatcccagtaa

SEQ ID NO: 381598 - DNA, 25 bp, Mus musculus
tggctgttcagagactgggtgggtc

SEQ ID NO: 381599 - DNA, 25 bp, Mus musculus
tggctgttcgcgaagaatcgagatc

SEQ ID NO: 381600 - DNA, 25 bp, Mus musculus
tggctgttcgcgaagtgcgtcccca

SEQ ID NO: 381601 - DNA, 25 bp, Mus musculus
tggctgttggcagttctggcaggtg

SEQ ID NO: 381602 - DNA, 25 bp, Mus musculus
tggctgtttatcgcaggaggcagaa

SEQ ID NO: 381603 - DNA, 25 bp, Mus musculus
tggctgtttctgggtgtggccatcc

SEQ ID NO: 381604 - DNA, 25 bp, Mus musculus
tggctgtttgccgagattgctctct

SEQ ID NO: 381605 - DNA, 25 bp, Mus musculus
tggctgttttcacaggaactggtga

SEQ ID NO: 381606 - DNA, 25 bp, Mus musculus
tggcttaaaagagtctcccccacag

SEQ ID NO: 381607 - DNA, 25 bp, Mus musculus
tggcttaaaagccgaagaagcaggc

SEQ ID NO: 381608 - DNA, 25 bp, Mus musculus
tggcttaaaagctcgtgtggccagc

SEQ ID NO: 381609 - DNA, 25 bp, Mus musculus
tggcttaaacgccataacccagacc

SEQ ID NO: 381610 - DNA, 25 bp, Mus musculus
tggcttaacagaacaggagtgtgtg

SEQ ID NO: 381611 - DNA, 25 bp, Mus musculus
tggcttacagacaaagcctatttct

SEQ ID NO: 381612 - DNA, 25 bp, Mus musculus
tggcttacaggttcagaggttcagt

SEQ ID NO: 381613 - DNA, 25 bp, Mus musculus
tggcttacagtggaatgggcctgct

SEQ ID NO: 381614 - DNA, 25 bp, Mus musculus
tggcttacagtgggaagacatggga

SEQ ID NO: 381615 - DNA, 25 bp, Mus musculus
tggcttactgcaccgatcctagttc

SEQ ID NO: 381616 - DNA, 25 bp, Mus musculus
tggcttatatgtgcacatggcgact

SEQ ID NO: 381617 - DNA, 25 bp, Mus musculus
tggcttatatgtggagctgtgtgga

SEQ ID NO: 381618 - DNA, 25 bp, Mus musculus
tggcttatctgaggtggggaaagat

SEQ ID NO: 381619 - DNA, 25 bp, Mus musculus
tggcttatgaacagatcaagcgggc

SEQ ID NO: 381620 - DNA, 25 bp, Mus musculus
tggcttattttgaagtgatgagact

SEQ ID NO: 381621 - DNA, 25 bp, Mus musculus
tggcttcaaacaagttcaaaaggat

SEQ ID NO: 381622 - DNA, 25 bp, Mus musculus
tggcttcaagcagattaacctgtgg

SEQ ID NO: 381623 - DNA, 25 bp, Mus musculus
tggcttcaagttttggaaacatgat

SEQ ID NO: 381624 - DNA, 25 bp, Mus musculus
tggcttcaatatggaatctttctga

SEQ ID NO: 381625 - DNA, 25 bp, Mus musculus
tggcttcactgcgctggcattgacc

SEQ ID NO: 381626 - DNA, 25 bp, Mus musculus
tggcttcagatcagagttggtgtgg

SEQ ID NO: 381627 - DNA, 25 bp, Mus musculus
tggcttcataactcgaatgaaactt

SEQ ID NO: 381628 - DNA, 25 bp, Mus musculus
tggcttcattggaggtttaggatta

SEQ ID NO: 381629 - DNA, 25 bp, Mus musculus
tggcttccaacatactgcagggttg

SEQ ID NO: 381630 - DNA, 25 bp, Mus musculus
tggcttccacaggattttcaccttg

SEQ ID NO: 381631 - DNA, 25 bp, Mus musculus
tggcttccaccgttgtggccagaac

SEQ ID NO: 381632 - DNA, 25 bp, Mus musculus
tggcttccagggctggcgctgcaaa

SEQ ID NO: 381633 - DNA, 25 bp, Mus musculus
tggcttccatttctgcaaggagtcc

SEQ ID NO: 381634 - DNA, 25 bp, Mus musculus
tggcttcccaaaaatgtatccatcg

SEQ ID NO: 381635 - DNA, 25 bp, Mus musculus
tggcttcccagatgaatgcactgat

SEQ ID NO: 381636 - DNA, 25 bp, Mus musculus
tggcttcccctcagtgaatgtggct

SEQ ID NO: 381637 - DNA, 25 bp, Mus musculus
tggcttccctgagctgggaacactc

SEQ ID NO: 381638 - DNA, 25 bp, Mus musculus
tggcttccctgcaagatatggttgc

SEQ ID NO: 381639 - DNA, 25 bp, Mus musculus
tggcttccctgcaaggagtgttacg

SEQ ID NO: 381640 - DNA, 25 bp, Mus musculus
tggcttccgaggctccggcttcgtc

SEQ ID NO: 381641 - DNA, 25 bp, Mus musculus
tggcttccgagtccctcctgggggg

SEQ ID NO: 381642 - DNA, 25 bp, Mus musculus
tggcttccggaaggaactggtgagc

SEQ ID NO: 381643 - DNA, 25 bp, Mus musculus
tggcttccggaaggcctctggattc

SEQ ID NO: 381644 - DNA, 25 bp, Mus musculus
tggcttcctcagcactggagacaag

SEQ ID NO: 381645 - DNA, 25 bp, Mus musculus
tggcttcctgaagccccagtcttat

SEQ ID NO: 381646 - DNA, 25 bp, Mus musculus
tggcttcctgagaggctggcctcca

SEQ ID NO: 381647 - DNA, 25 bp, Mus musculus
tggcttcctgcctggcacggcgcag

SEQ ID NO: 381648 - DNA, 25 bp, Mus musculus
tggcttcctgcggcagagagtactt

SEQ ID NO: 381649 - DNA, 25 bp, Mus musculus
tggcttcctggatgtccagaaggat

SEQ ID NO: 381650 - DNA, 25 bp, Mus musculus
tggcttccttcatgaagataagcag

SEQ ID NO: 381651 - DNA, 25 bp, Mus musculus
tggcttcctttccgtagccagccca

SEQ ID NO: 381652 - DNA, 25 bp, Mus musculus
tggcttcgttcttagatgagcccag

SEQ ID NO: 381653 - DNA, 25 bp, Mus musculus
tggcttctaactcaggaaggcgaag

SEQ ID NO: 381654 - DNA, 25 bp, Mus musculus
tggcttctactcaaattctggaata

SEQ ID NO: 381655 - DNA, 25 bp, Mus musculus
tggcttctcaccgcttagaattaca

SEQ ID NO: 381656 - DNA, 25 bp, Mus musculus
tggcttctcaccgggcgagcctttc

SEQ ID NO: 381657 - DNA, 25 bp, Mus musculus
tggcttctcaccggtgcacgcctcc

SEQ ID NO: 381658 - DNA, 25 bp, Mus musculus
tggcttctcaccgttatcctaggcg

SEQ ID NO: 381659 - DNA, 25 bp, Mus musculus
tggcttctcagatgggagctcagaa

SEQ ID NO: 381660 - DNA, 25 bp, Mus musculus
tggcttctcagttccagagcctctg

SEQ ID NO: 381661 - DNA, 25 bp, Mus musculus
tggcttctcccaaattaaatgatga

SEQ ID NO: 381662 - DNA, 25 bp, Mus musculus
tggcttctctctcggtggagacaca

SEQ ID NO: 381663 - DNA, 25 bp, Mus musculus
tggcttctctcttccacttgtagtg

SEQ ID NO: 381664 - DNA, 25 bp, Mus musculus
tggcttctgagaaactggtcaaaat

SEQ ID NO: 381665 - DNA, 25 bp, Mus musculus
tggcttctgggcgaggaaaaagtaa

SEQ ID NO: 381666 - DNA, 25 bp, Mus musculus
tggcttctgtttgaggttcctgggt

SEQ ID NO: 381667 - DNA, 25 bp, Mus musculus
tggcttcttcagcactggagaccag

SEQ ID NO: 381668 - DNA, 25 bp, Mus musculus
tggcttcttcaggactctttcatgg

SEQ ID NO: 381669 - DNA, 25 bp, Mus musculus
tggcttctttctccttgtggacaaa

SEQ ID NO: 381670 - DNA, 25 bp, Mus musculus
tggcttgaagatgataattagcacc

SEQ ID NO: 381671 - DNA, 25 bp, Mus musculus
tggcttgaaggatgctcagattgca

SEQ ID NO: 381672 - DNA, 25 bp, Mus musculus
tggcttgactcccaaagcctacaag

SEQ ID NO: 381673 - DNA, 25 bp, Mus musculus
tggcttgactgctccttctggccgc

SEQ ID NO: 381674 - DNA, 25 bp, Mus musculus
tggcttgagtgggccttcccgctcc

SEQ ID NO: 381675 - DNA, 25 bp, Mus musculus
tggcttgcaaggctaccaaggccct

SEQ ID NO: 381676 - DNA, 25 bp, Mus musculus
tggcttgcagataaaaatatatacc

SEQ ID NO: 381677 - DNA, 25 bp, Mus musculus
tggcttgcagcggtcaagtcatgtg

SEQ ID NO: 381678 - DNA, 25 bp, Mus musculus
tggcttgcaggggtcaagtcatgtg

SEQ ID NO: 381679 - DNA, 25 bp, Mus musculus
tggcttgccaggtgaatattggctt

SEQ ID NO: 381680 - DNA, 25 bp, Mus musculus
tggcttgccccggggacagaccacc

SEQ ID NO: 381681 - DNA, 25 bp, Mus musculus
tggcttgccgggccctccaggtccc

SEQ ID NO: 381682 - DNA, 25 bp, Mus musculus
tggcttgctgaagctcaggtacctg

SEQ ID NO: 381683 - DNA, 25 bp, Mus musculus
tggcttgctgaagtggcttttcatg

SEQ ID NO: 381684 - DNA, 25 bp, Mus musculus
tggcttggaatgagactgcagatct

SEQ ID NO: 381685 - DNA, 25 bp, Mus musculus
tggcttggactgaaggtacgcaggg

SEQ ID NO: 381686 - DNA, 25 bp, Mus musculus
tggcttggatcgaaggcacggaggg

SEQ ID NO: 381687 - DNA, 25 bp, Mus musculus
tggcttgggaattgacaggcatcgc

SEQ ID NO: 381688 - DNA, 25 bp, Mus musculus
tggcttgtgctcaaacaggctctgg

SEQ ID NO: 381689 - DNA, 25 bp, Mus musculus
tggcttgtggtctatgttcagaacc

SEQ ID NO: 381690 - DNA, 25 bp, Mus musculus
tggcttgttctgggggtggtggagt

SEQ ID NO: 381691 - DNA, 25 bp, Mus musculus
tggcttgttggaggggactttccca

SEQ ID NO: 381692 - DNA, 25 bp, Mus musculus
tggctttaacaatctccattcggac

SEQ ID NO: 381693 - DNA, 25 bp, Mus musculus
tggctttaagacactggaacggtca

SEQ ID NO: 381694 - DNA, 25 bp, Mus musculus
tggctttaataaaccacgtttacgc

SEQ ID NO: 381695 - DNA, 25 bp, Mus musculus
tggctttaatatgggcggcaacgac

SEQ ID NO: 381696 - DNA, 25 bp, Mus musculus
tggctttacaggaaatctgacgttt

SEQ ID NO: 381697 - DNA, 25 bp, Mus musculus
tggctttagcaagagcatggtcaat

SEQ ID NO: 381698 - DNA, 25 bp, Mus musculus
tggctttagcaaggcccgcggccat

SEQ ID NO: 381699 - DNA, 25 bp, Mus musculus
tggctttatcaggcgttctgtcaaa

SEQ ID NO: 381700 - DNA, 25 bp, Mus musculus
tggctttatcaggggcgttcaattt

SEQ ID NO: 381701 - DNA, 25 bp, Mus musculus
tggctttcaagggaacaaagaatcg

SEQ ID NO: 381702 - DNA, 25 bp, Mus musculus
tggctttcaagttgtggagctcctg

SEQ ID NO: 381703 - DNA, 25 bp, Mus musculus
tggctttcagagacgagttacaatt

SEQ ID NO: 381704 - DNA, 25 bp, Mus musculus
tggctttcagggacttcctggacct

SEQ ID NO: 381705 - DNA, 25 bp, Mus musculus
tggctttcgcagagcagtcctcaga

SEQ ID NO: 381706 - DNA, 25 bp, Mus musculus
tggctttcgcagagctgctcttgga

SEQ ID NO: 381707 - DNA, 25 bp, Mus musculus
tggctttgaagaatcaggcccagga

SEQ ID NO: 381708 - DNA, 25 bp, Mus musculus
tggctttgccacacagtgaagatgc

SEQ ID NO: 381709 - DNA, 25 bp, Mus musculus
tggctttgctcagccttctggccgg

SEQ ID NO: 381710 - DNA, 25 bp, Mus musculus
tggctttgctggagtatattgaaaa

SEQ ID NO: 381711 - DNA, 25 bp, Mus musculus
tggctttgctgggttgctatgatat

SEQ ID NO: 381712 - DNA, 25 bp, Mus musculus
tggctttggaaattgccgcagatga

SEQ ID NO: 381713 - DNA, 25 bp, Mus musculus
tggctttggagctcctgatggtttg

SEQ ID NO: 381714 - DNA, 25 bp, Mus musculus
tggctttggaggtcggtgagctggt

SEQ ID NO: 381715 - DNA, 25 bp, Mus musculus
tggctttgtgtgggcttgcaaaatt

SEQ ID NO: 381716 - DNA, 25 bp, Mus musculus
tggcttttaatgatctagtgaagcc

SEQ ID NO: 381717 - DNA, 25 bp, Mus musculus
tggcttttacagacccataactggt

SEQ ID NO: 381718 - DNA, 25 bp, Mus musculus
tggcttttacagggagggtagacct

SEQ ID NO: 381719 - DNA, 25 bp, Mus musculus
tggcttttacagttgttctgatgtt

SEQ ID NO: 381720 - DNA, 25 bp, Mus musculus
tggcttttctgattcaccccaccat

SEQ ID NO: 381721 - DNA, 25 bp, Mus musculus
tggcttttctgattttcagaaagaa

SEQ ID NO: 381722 - DNA, 25 bp, Mus musculus
tggcttttgcagaggtttcctggca

SEQ ID NO: 381723 - DNA, 25 bp, Mus musculus
tggcttttgcaggtctgacagcgga

SEQ ID NO: 381724 - DNA, 25 bp, Mus musculus
tggcttttgctggagggagctggga

SEQ ID NO: 381725 - DNA, 25 bp, Mus musculus
tggctttttaaaggaaggcatccca

SEQ ID NO: 381726 - DNA, 25 bp, Mus musculus
tgggaaaaagaccaaagattcaagt

SEQ ID NO: 381727 - DNA, 25 bp, Mus musculus
tgggaaaacagaattataacaattg

SEQ ID NO: 381728 - DNA, 25 bp, Mus musculus
tgggaaaaccaaaggtccagaatag

SEQ ID NO: 381729 - DNA, 25 bp, Mus musculus
tgggaaaacggtatatgcaccatcc

SEQ ID NO: 381730 - DNA, 25 bp, Mus musculus
tgggaaaagaactaaatggcagcac

SEQ ID NO: 381731 - DNA, 25 bp, Mus musculus
tgggaaaagaactaatttcagcata

SEQ ID NO: 381732 - DNA, 25 bp, Mus musculus
tgggaaaagaactgttcagctccta

SEQ ID NO: 381733 - DNA, 25 bp, Mus musculus
tgggaaaagactgtaatgaaacctc

SEQ ID NO: 381734 - DNA, 25 bp, Mus musculus
tgggaaaaggacgctattacaagga

SEQ ID NO: 381735 - DNA, 25 bp, Mus musculus
tgggaaaatgaaacttggggaccat

SEQ ID NO: 381736 - DNA, 25 bp, Mus musculus
tgggaaaatggctcagggggagcac

SEQ ID NO: 381737 - DNA, 25 bp, Mus musculus
tgggaaacaagaaagacagagtcca

SEQ ID NO: 381738 - DNA, 25 bp, Mus musculus
tgggaaaccatgtggtgctctaaga

SEQ ID NO: 381739 - DNA, 25 bp, Mus musculus
tgggaaacccaagcttatggcaaac

SEQ ID NO: 381740 - DNA, 25 bp, Mus musculus
tgggaaacctgaatctgtatcgatt

SEQ ID NO: 381741 - DNA, 25 bp, Mus musculus
tgggaaaccttggtcttgccacctc

SEQ ID NO: 381742 - DNA, 25 bp, Mus musculus
tgggaaactatgatctcttcactgg

SEQ ID NO: 381743 - DNA, 25 bp, Mus musculus
tgggaaactgccgccacagtacatg

SEQ ID NO: 381744 - DNA, 25 bp, Mus musculus
tgggaaactgctctcctatgtggat

SEQ ID NO: 381745 - DNA, 25 bp, Mus musculus
tgggaaagaagatgaaagcagaagt

SEQ ID NO: 381746 - DNA, 25 bp, Mus musculus
tgggaaagaagggactcgtactggg

SEQ ID NO: 381747 - DNA, 25 bp, Mus musculus
tgggaaagaaggttaacctctgctt

SEQ ID NO: 381748 - DNA, 25 bp, Mus musculus
tgggaaagatttctgaaaattaatg

SEQ ID NO: 381749 - DNA, 25 bp, Mus musculus
tgggaaagatttctggggtgatgac

SEQ ID NO: 381750 - DNA, 25 bp, Mus musculus
tgggaaagcaccagcccacctaaac

SEQ ID NO: 381751 - DNA, 25 bp, Mus musculus
tgggaaagcaggggagaagtcaata

SEQ ID NO: 381752 - DNA, 25 bp, Mus musculus
tgggaaagctgatgaatgcaccctt

SEQ ID NO: 381753 - DNA, 25 bp, Mus musculus
tgggaaagctggccgaggagttgtc

SEQ ID NO: 381754 - DNA, 25 bp, Mus musculus
tgggaaataagagatccagcccact

SEQ ID NO: 381755 - DNA, 25 bp, Mus musculus
tgggaaatacccaagtaccagcaag

SEQ ID NO: 381756 - DNA, 25 bp, Mus musculus
tgggaaatacggtatcaccagcctc

SEQ ID NO: 381757 - DNA, 25 bp, Mus musculus
tgggaaatctgtcagggccagagaa

SEQ ID NO: 381758 - DNA, 25 bp, Mus musculus
tgggaaatctgtcagggggagatga

SEQ ID NO: 381759 - DNA, 25 bp, Mus musculus
tgggaaatgatgagaatggcttggt

SEQ ID NO: 381760 - DNA, 25 bp, Mus musculus
tgggaaatgatgtggttgagaaata

SEQ ID NO: 381761 - DNA, 25 bp, Mus musculus
tgggaaattattagggatgccagta

SEQ ID NO: 381762 - DNA, 25 bp, Mus musculus
tgggaacaaaggaggaggacatctt

SEQ ID NO: 381763 - DNA, 25 bp, Mus musculus
tgggaacaagagaggcaatgggtga

SEQ ID NO: 381764 - DNA, 25 bp, Mus musculus
tgggaacaagtaccattaattaagg

SEQ ID NO: 381765 - DNA, 25 bp, Mus musculus
tgggaacacacaaagattcagagct

SEQ ID NO: 381766 - DNA, 25 bp, Mus musculus
tgggaacacacaaaggttggttcct

SEQ ID NO: 381767 - DNA, 25 bp, Mus musculus
tgggaacagccttagctacatcaaa

SEQ ID NO: 381768 - DNA, 25 bp, Mus musculus
tgggaaccggcggcttcatggcggc

SEQ ID NO: 381769 - DNA, 25 bp, Mus musculus
tgggaacctaaatggggggatcgca

SEQ ID NO: 381770 - DNA, 25 bp, Mus musculus
tgggaacctaaatggtggagccact

SEQ ID NO: 381771 - DNA, 25 bp, Mus musculus
tgggaacctgtgaggtcatgcactt

SEQ ID NO: 381772 - DNA, 25 bp, Mus musculus
tgggaacgcagagcagtgggaagag

SEQ ID NO: 381773 - DNA, 25 bp, Mus musculus
tgggaacgtgatacgatgagcagct

SEQ ID NO: 381774 - DNA, 25 bp, Mus musculus
tgggaactccagcccttttacacag

SEQ ID NO: 381775 - DNA, 25 bp, Mus musculus
tgggaactgcaggtaaggaactgcc

SEQ ID NO: 381776 - DNA, 25 bp, Mus musculus
tgggaactgcagtttccctgcaggt

SEQ ID NO: 381777 - DNA, 25 bp, Mus musculus
tgggaacttcagacccagccacctc

SEQ ID NO: 381778 - DNA, 25 bp, Mus musculus
tgggaagaaaaaaagaccccagcgc

SEQ ID NO: 381779 - DNA, 25 bp, Mus musculus
tgggaagaaaattgcagcctggagc

SEQ ID NO: 381780 - DNA, 25 bp, Mus musculus
tgggaagaaagaaggatagatataa

SEQ ID NO: 381781 - DNA, 25 bp, Mus musculus
tgggaagaaagatgtgtacactctt

SEQ ID NO: 381782 - DNA, 25 bp, Mus musculus
tgggaagaacactgctgtgctggga

SEQ ID NO: 381783 - DNA, 25 bp, Mus musculus
tgggaagaagacggatctccatctt

SEQ ID NO: 381784 - DNA, 25 bp, Mus musculus
tgggaagaaggccaccgacgcattc

SEQ ID NO: 381785 - DNA, 25 bp, Mus musculus
tgggaagacctcactccagtcccgc

SEQ ID NO: 381786 - DNA, 25 bp, Mus musculus
tgggaagacctcactgacctctcac

SEQ ID NO: 381787 - DNA, 25 bp, Mus musculus
tgggaagacctcactgtttctctat

SEQ ID NO: 381788 - DNA, 25 bp, Mus musculus
tgggaagactccaattcattgcttc

SEQ ID NO: 381789 - DNA, 25 bp, Mus musculus
tgggaagaggacaggcttttccctg

SEQ ID NO: 381790 - DNA, 25 bp, Mus musculus
tgggaagagtgccatgacaatgcag

SEQ ID NO: 381791 - DNA, 25 bp, Mus musculus
tgggaagagtgtgtcctgagttgca

SEQ ID NO: 381792 - DNA, 25 bp, Mus musculus
tgggaagatggaccggcagatgttc

SEQ ID NO: 381793 - DNA, 25 bp, Mus musculus
tgggaagcaaaggctcaagtcattc

SEQ ID NO: 381794 - DNA, 25 bp, Mus musculus
tgggaagcaggtacccacccggaag

SEQ ID NO: 381795 - DNA, 25 bp, Mus musculus
tgggaagccagagagggtctgcgag

SEQ ID NO: 381796 - DNA, 25 bp, Mus musculus
tgggaagcgaatccgaaatgaagca

SEQ ID NO: 381797 - DNA, 25 bp, Mus musculus
tgggaagcgaatccgtgaaatggcc

SEQ ID NO: 381798 - DNA, 25 bp, Mus musculus
tgggaagcgacatgcgtactgagcg

SEQ ID NO: 381799 - DNA, 25 bp, Mus musculus
tgggaagcgacatggtaagaatgat

SEQ ID NO: 381800 - DNA, 25 bp, Mus musculus
tgggaagctgtcagcattctgccta

SEQ ID NO: 381801 - DNA, 25 bp, Mus musculus
tgggaagctgtcagttctgagaagt

SEQ ID NO: 381802 - DNA, 25 bp, Mus musculus
tgggaagctgtgctcagtagtccta

SEQ ID NO: 381803 - DNA, 25 bp, Mus musculus
tgggaaggacatgaatgtgttaata

SEQ ID NO: 381804 - DNA, 25 bp, Mus musculus
tgggaaggagctgtcagtagaagca

SEQ ID NO: 381805 - DNA, 25 bp, Mus musculus
tgggaaggatgaagattcctatcac

SEQ ID NO: 381806 - DNA, 25 bp, Mus musculus
tgggaaggatgggtaacaaaggagg

SEQ ID NO: 381807 - DNA, 25 bp, Mus musculus
tgggaaggatgtcctttcaacaggg

SEQ ID NO: 381808 - DNA, 25 bp, Mus musculus
tgggaaggattagatctgccacctc

SEQ ID NO: 381809 - DNA, 25 bp, Mus musculus
tgggaaggcactttccggatgatcc

SEQ ID NO: 381810 - DNA, 25 bp, Mus musculus
tgggaaggcagaaggtgatgtgggt

SEQ ID NO: 381811 - DNA, 25 bp, Mus musculus
tgggaaggtggaggtgtggtacatc

SEQ ID NO: 381812 - DNA, 25 bp, Mus musculus
tgggaagtcagtcagctttccctgc

SEQ ID NO: 381813 - DNA, 25 bp, Mus musculus
tgggaagtcagtcaggtcagctttg

SEQ ID NO: 381814 - DNA, 25 bp, Mus musculus
tgggaagtcgctgatgaggagactg

SEQ ID NO: 381815 - DNA, 25 bp, Mus musculus
tgggaagtgtcgccagagaaacaat

SEQ ID NO: 381816 - DNA, 25 bp, Mus musculus
tgggaagtgtcgcttccaacagtgt

SEQ ID NO: 381817 - DNA, 25 bp, Mus musculus
tgggaagttactccgagatgccgcg

SEQ ID NO: 381818 - DNA, 25 bp, Mus musculus
tgggaagttctttccttgcggaata

SEQ ID NO: 381819 - DNA, 25 bp, Mus musculus
tgggaagttctttcgttgcggaata

SEQ ID NO: 381820 - DNA, 25 bp, Mus musculus
tgggaagttggtacagagcatcata

SEQ ID NO: 381821 - DNA, 25 bp, Mus musculus
tgggaataattgtgaggatgaagtt

SEQ ID NO: 381822 - DNA, 25 bp, Mus musculus
tgggaatacaggagacagaaaagag

SEQ ID NO: 381823 - DNA, 25 bp, Mus musculus
tgggaatagaaggctatcctaccta

SEQ ID NO: 381824 - DNA, 25 bp, Mus musculus
tgggaatattgaagtacttggtttt

SEQ ID NO: 381825 - DNA, 25 bp, Mus musculus
tgggaatcagtgggtatcacaggct

SEQ ID NO: 381826 - DNA, 25 bp, Mus musculus
tgggaatcatacatgacgcctttga

SEQ ID NO: 381827 - DNA, 25 bp, Mus musculus
tgggaatcatgacagaacagccttg

SEQ ID NO: 381828 - DNA, 25 bp, Mus musculus
tgggaatcatgacaggcccattctt

SEQ ID NO: 381829 - DNA, 25 bp, Mus musculus
tgggaatccttgaaagccctctggg

SEQ ID NO: 381830 - DNA, 25 bp, Mus musculus
tgggaatctcaacacctcacgaagg

SEQ ID NO: 381831 - DNA, 25 bp, Mus musculus
tgggaatctgatccgctgtactctc

SEQ ID NO: 381832 - DNA, 25 bp, Mus musculus
tgggaattcatatgactgtgatgag

SEQ ID NO: 381833 - DNA, 25 bp, Mus musculus
tgggaattcatgtctgcccggacaa

SEQ ID NO: 381834 - DNA, 25 bp, Mus musculus
tgggaattgagaatatgaacgaggc

SEQ ID NO: 381835 - DNA, 25 bp, Mus musculus
tgggaattgcaaagatgtgtccagg

SEQ ID NO: 381836 - DNA, 25 bp, Mus musculus
tgggaattgcaaagtgtactgggac

SEQ ID NO: 381837 - DNA, 25 bp, Mus musculus
tgggaattggtcctggctctgtctg

SEQ ID NO: 381838 - DNA, 25 bp, Mus musculus
tgggaattgtacagatatcgatgag

SEQ ID NO: 381839 - DNA, 25 bp, Mus musculus
tgggaatttgctggggagaaggaac

SEQ ID NO: 381840 - DNA, 25 bp, Mus musculus
tgggaattttatgtaagaccagctg

SEQ ID NO: 381841 - DNA, 25 bp, Mus musculus
tgggacaaaacgcaccctacctgga

SEQ ID NO: 381842 - DNA, 25 bp, Mus musculus
tgggacaacagtttacctacgttgc

SEQ ID NO: 381843 - DNA, 25 bp, Mus musculus
tgggacaattcaggacccttttgtg

SEQ ID NO: 381844 - DNA, 25 bp, Mus musculus
tgggacaattgaacaattgcctata

SEQ ID NO: 381845 - DNA, 25 bp, Mus musculus
tgggacaattgactggctgtgtttt

SEQ ID NO: 381846 - DNA, 25 bp, Mus musculus
tgggacacaaacgaggtataagtat

SEQ ID NO: 381847 - DNA, 25 bp, Mus musculus
tgggacacaaggtgtcccaaatggc

SEQ ID NO: 381848 - DNA, 25 bp, Mus musculus
tgggacacacaggagagtactaaat

SEQ ID NO: 381849 - DNA, 25 bp, Mus musculus
tgggacacagagtcttcaagcagcg

SEQ ID NO: 381850 - DNA, 25 bp, Mus musculus
tgggacacctgcctgcagtacaagg

SEQ ID NO: 381851 - DNA, 25 bp, Mus musculus
tgggacagaacggttgatttagggg

SEQ ID NO: 381852 - DNA, 25 bp, Mus musculus
tgggacagaagggtgaccagggcga

SEQ ID NO: 381853 - DNA, 25 bp, Mus musculus
tgggacagagccagctgcgcaaacc

SEQ ID NO: 381854 - DNA, 25 bp, Mus musculus
tgggacagattggatctggccgccc

SEQ ID NO: 381855 - DNA, 25 bp, Mus musculus
tgggacagcagatccatgcccgcaa

SEQ ID NO: 381856 - DNA, 25 bp, Mus musculus
tgggacagcagggccgcctcagtga

SEQ ID NO: 381857 - DNA, 25 bp, Mus musculus
tgggacagccagaggaacagatgga

SEQ ID NO: 381858 - DNA, 25 bp, Mus musculus
tgggacagccagctgaagtgagtag

SEQ ID NO: 381859 - DNA, 25 bp, Mus musculus
tgggacagccaggtaacaatttcaa

SEQ ID NO: 381860 - DNA, 25 bp, Mus musculus
tgggacaggagacaattacaatgga

SEQ ID NO: 381861 - DNA, 25 bp, Mus musculus
tgggacaggagtgtctcttcttgca

SEQ ID NO: 381862 - DNA, 25 bp, Mus musculus
tgggacagtagggaagttgccaccc

SEQ ID NO: 381863 - DNA, 25 bp, Mus musculus
tgggacagtagggcagcaccagcga

SEQ ID NO: 381864 - DNA, 25 bp, Mus musculus
tgggacataagttctacggccccag

SEQ ID NO: 381865 - DNA, 25 bp, Mus musculus
tgggacatccgtgggctagcccatg

SEQ ID NO: 381866 - DNA, 25 bp, Mus musculus
tgggacatcgcccaggttctcggac

SEQ ID NO: 381867 - DNA, 25 bp, Mus musculus
tgggacatgaatttggacctcactg

SEQ ID NO: 381868 - DNA, 25 bp, Mus musculus
tgggacatgatgtgattaagacgct

SEQ ID NO: 381869 - DNA, 25 bp, Mus musculus
tgggacatgccaggtcctacatctc

SEQ ID NO: 381870 - DNA, 25 bp, Mus musculus
tgggacattcggacccagatgaccc

SEQ ID NO: 381871 - DNA, 25 bp, Mus musculus
tgggaccaactcagtacctgtggca

SEQ ID NO: 381872 - DNA, 25 bp, Mus musculus
tgggaccaagaacacggtacaacct

SEQ ID NO: 381873 - DNA, 25 bp, Mus musculus
tgggaccagagagggtccgggccat

SEQ ID NO: 381874 - DNA, 25 bp, Mus musculus
tgggaccatcacaagatctgatact

SEQ ID NO: 381875 - DNA, 25 bp, Mus musculus
tgggacccaaaccagggtgtggaca

SEQ ID NO: 381876 - DNA, 25 bp, Mus musculus
tgggacccacatggttactgggaag

SEQ ID NO: 381877 - DNA, 25 bp, Mus musculus
tgggacccagcatgctggcgacttc

SEQ ID NO: 381878 - DNA, 25 bp, Mus musculus
tgggacccaggacagacagctgcag

SEQ ID NO: 381879 - DNA, 25 bp, Mus musculus
tgggacccaggctgccctgccctcc

SEQ ID NO: 381880 - DNA, 25 bp, Mus musculus
tgggaccctccaaagaatcataacg

SEQ ID NO: 381881 - DNA, 25 bp, Mus musculus
tgggaccctccaaaggtcctgctta

SEQ ID NO: 381882 - DNA, 25 bp, Mus musculus
tgggaccctggtacctcatcaactt

SEQ ID NO: 381883 - DNA, 25 bp, Mus musculus
tgggacctaaaactttgcagattcc

SEQ ID NO: 381884 - DNA, 25 bp, Mus musculus
tgggacctacctgaactacctgggg

SEQ ID NO: 381885 - DNA, 25 bp, Mus musculus
tgggacctacgtatcacaaggctgc

SEQ ID NO: 381886 - DNA, 25 bp, Mus musculus
tgggacctcaacagggtgagccagg

SEQ ID NO: 381887 - DNA, 25 bp, Mus musculus
tgggacctcaacagtgggcagctga

SEQ ID NO: 381888 - DNA, 25 bp, Mus musculus
tgggacctcacctacccaaagctgg

SEQ ID NO: 381889 - DNA, 25 bp, Mus musculus
tgggacctcagagtaatataaagat

SEQ ID NO: 381890 - DNA, 25 bp, Mus musculus
tgggacctcaggctgactgctgtcc

SEQ ID NO: 381891 - DNA, 25 bp, Mus musculus
tgggacctcaggtctgttgtggggg

SEQ ID NO: 381892 - DNA, 25 bp, Mus musculus
tgggacctcatcattctctggcagg

SEQ ID NO: 381893 - DNA, 25 bp, Mus musculus
tgggacctcatctacgtgggccgga

SEQ ID NO: 381894 - DNA, 25 bp, Mus musculus
tgggacctccgggcctagctgggga

SEQ ID NO: 381895 - DNA, 25 bp, Mus musculus
tgggacctctgggagccagcagagg

SEQ ID NO: 381896 - DNA, 25 bp, Mus musculus
tgggacctctgggagcccacagaga

SEQ ID NO: 381897 - DNA, 25 bp, Mus musculus
tgggacctttctaggtgactacttt

SEQ ID NO: 381898 - DNA, 25 bp, Mus musculus
tgggacgaagaagacctgtattccc

SEQ ID NO: 381899 - DNA, 25 bp, Mus musculus
tgggacgaagaagacctgtattcct

SEQ ID NO: 381900 - DNA, 25 bp, Mus musculus
tgggacgcttggtaaagcgttcggc

SEQ ID NO: 381901 - DNA, 25 bp, Mus musculus
tgggacgtgaaggacttcaagaccg

SEQ ID NO: 381902 - DNA, 25 bp, Mus musculus
tgggacgtttcccagatctgtctcg

SEQ ID NO: 381903 - DNA, 25 bp, Mus musculus
tgggactaaagagatggatgtcctt

SEQ ID NO: 381904 - DNA, 25 bp, Mus musculus
tgggactaaaggggacagctgttgt

SEQ ID NO: 381905 - DNA, 25 bp, Mus musculus
tgggactacagggatccgtgaacca

SEQ ID NO: 381906 - DNA, 25 bp, Mus musculus
tgggactaccaggcctgtacggaga

SEQ ID NO: 381907 - DNA, 25 bp, Mus musculus
tgggactcagatggaccacacagcc

SEQ ID NO: 381908 - DNA, 25 bp, Mus musculus
tgggactctctgcgccctttgtggc

SEQ ID NO: 381909 - DNA, 25 bp, Mus musculus
tgggactctgaacaaatcctgctgc

SEQ ID NO: 381910 - DNA, 25 bp, Mus musculus
tgggactgaagactcggatgacgcc

SEQ ID NO: 381911 - DNA, 25 bp, Mus musculus
tgggactgaatatagtatgtgcagc

SEQ ID NO: 381912 - DNA, 25 bp, Mus musculus
tgggactgagggtggttgctgtata

SEQ ID NO: 381913 - DNA, 25 bp, Mus musculus
tgggactgcagaatgacagatttga

SEQ ID NO: 381914 - DNA, 25 bp, Mus musculus
tgggactggagggtgacagaagaca

SEQ ID NO: 381915 - DNA, 25 bp, Mus musculus
tgggacttaatttgagcataaggag

SEQ ID NO: 381916 - DNA, 25 bp, Mus musculus
tgggacttactacagctgggcatgg

SEQ ID NO: 381917 - DNA, 25 bp, Mus musculus
tgggacttactacaggtggctgcgg

SEQ ID NO: 381918 - DNA, 25 bp, Mus musculus
tgggagaaaactaagatgtcaactt

SEQ ID NO: 381919 - DNA, 25 bp, Mus musculus
tgggagaaagaaggcatgtcatgtt

SEQ ID NO: 381920 - DNA, 25 bp, Mus musculus
tgggagaaaggggcgctcctggcaa

SEQ ID NO: 381921 - DNA, 25 bp, Mus musculus
tgggagaaagtgagagcaccacttc

SEQ ID NO: 381922 - DNA, 25 bp, Mus musculus
tgggagaacagatacaaaggatggg

SEQ ID NO: 381923 - DNA, 25 bp, Mus musculus
tgggagaactcgcaccagggtccac

SEQ ID NO: 381924 - DNA, 25 bp, Mus musculus
tgggagaagagacaattgggaagaa

SEQ ID NO: 381925 - DNA, 25 bp, Mus musculus
tgggagaatcaggcatcgcctccat

SEQ ID NO: 381926 - DNA, 25 bp, Mus musculus
tgggagacagagatcctgaggacgc

SEQ ID NO: 381927 - DNA, 25 bp, Mus musculus
tgggagaccacaagccggtgttcct

SEQ ID NO: 381928 - DNA, 25 bp, Mus musculus
tgggagacccaagacgatactgtat

SEQ ID NO: 381929 - DNA, 25 bp, Mus musculus
tgggagacccaagctgtcctggaac

SEQ ID NO: 381930 - DNA, 25 bp, Mus musculus
tgggagaccgagctcagcagtcagc

SEQ ID NO: 381931 - DNA, 25 bp, Mus musculus
tgggagaccggggaaaatgcactga

SEQ ID NO: 381932 - DNA, 25 bp, Mus musculus
tgggagaccgggtgacactggacct

SEQ ID NO: 381933 - DNA, 25 bp, Mus musculus
tgggagaccttgagacagatgggag

SEQ ID NO: 381934 - DNA, 25 bp, Mus musculus
tgggagagaaaagaaaaaacaagaa

SEQ ID NO: 381935 - DNA, 25 bp, Mus musculus
tgggagagaaaagccttaccaatag

SEQ ID NO: 381936 - DNA, 25 bp, Mus musculus
tgggagagaggcaccatgacaaccc

SEQ ID NO: 381937 - DNA, 25 bp, Mus musculus
tgggagagagggttgaaaactagct

SEQ ID NO: 381938 - DNA, 25 bp, Mus musculus
tgggagagcagcgggaacttcattg

SEQ ID NO: 381939 - DNA, 25 bp, Mus musculus
tgggagagcaggaggtgtaaagaaa

SEQ ID NO: 381940 - DNA, 25 bp, Mus musculus
tgggagagcgtggtcactgacaata

SEQ ID NO: 381941 - DNA, 25 bp, Mus musculus
tgggagagctaaggatcaagcactt

SEQ ID NO: 381942 - DNA, 25 bp, Mus musculus
tgggagaggacgcgtgagcatgcca

SEQ ID NO: 381943 - DNA, 25 bp, Mus musculus
tgggagagggggaccaagtcattga

SEQ ID NO: 381944 - DNA, 25 bp, Mus musculus
tgggagatacagggcatggatgggc

SEQ ID NO: 381945 - DNA, 25 bp, Mus musculus
tgggagatgaagcgggagatcgttg

SEQ ID NO: 381946 - DNA, 25 bp, Mus musculus
tgggagatgagaaattatgcttcag

SEQ ID NO: 381947 - DNA, 25 bp, Mus musculus
tgggagcaaggaggctcatctgcgg

SEQ ID NO: 381948 - DNA, 25 bp, Mus musculus
tgggagcacagaggggaaggcccac

SEQ ID NO: 381949 - DNA, 25 bp, Mus musculus
tgggagcacagtgtgcagcttgcag

SEQ ID NO: 381950 - DNA, 25 bp, Mus musculus
tgggagcactggctcacccatgaca

SEQ ID NO: 381951 - DNA, 25 bp, Mus musculus
tgggagcagaggtggagcgaccctg

SEQ ID NO: 381952 - DNA, 25 bp, Mus musculus
tgggagcagcatgggatcccggaga

SEQ ID NO: 381953 - DNA, 25 bp, Mus musculus
tgggagcagctgttgctttcccctg

SEQ ID NO: 381954 - DNA, 25 bp, Mus musculus
tgggagcaggaattaccttgcattt

SEQ ID NO: 381955 - DNA, 25 bp, Mus musculus
tgggagccagccccagcagttgtct

SEQ ID NO: 381956 - DNA, 25 bp, Mus musculus
tgggagcccaggcctccagatctat

SEQ ID NO: 381957 - DNA, 25 bp, Mus musculus
tgggagcccgcgaagctctcggaga

SEQ ID NO: 381958 - DNA, 25 bp, Mus musculus
tgggagccgggagccccgatgaccg

SEQ ID NO: 381959 - DNA, 25 bp, Mus musculus
tgggagcgagttaagagaaaatgag

SEQ ID NO: 381960 - DNA, 25 bp, Mus musculus
tgggagcgggggtccaactgagccc

SEQ ID NO: 381961 - DNA, 25 bp, Mus musculus
tgggagctaagaataatagggccca

SEQ ID NO: 381962 - DNA, 25 bp, Mus musculus
tgggagctgacagagcttttcttca

SEQ ID NO: 381963 - DNA, 25 bp, Mus musculus
tgggagctgctgttgctttcccctg

SEQ ID NO: 381964 - DNA, 25 bp, Mus musculus
tgggaggaagctgtccatggctggg

SEQ ID NO: 381965 - DNA, 25 bp, Mus musculus
tgggaggagaaggtcctgttgagtc

SEQ ID NO: 381966 - DNA, 25 bp, Mus musculus
tgggaggagactgacaaaaccaaaa

SEQ ID NO: 381967 - DNA, 25 bp, Mus musculus
tgggaggagagaaggaagaattctg

SEQ ID NO: 381968 - DNA, 25 bp, Mus musculus
tgggaggagatattggtccttcatt

SEQ ID NO: 381969 - DNA, 25 bp, Mus musculus
tgggaggagcagatattcagtgaac

SEQ ID NO: 381970 - DNA, 25 bp, Mus musculus
tgggaggatggcagctcagctgttc

SEQ ID NO: 381971 - DNA, 25 bp, Mus musculus
tgggaggatggcagggccaggttgc

SEQ ID NO: 381972 - DNA, 25 bp, Mus musculus
tgggaggcaggctgccccagcagtt

SEQ ID NO: 381973 - DNA, 25 bp, Mus musculus
tgggaggccaggattgataagtatc

SEQ ID NO: 381974 - DNA, 25 bp, Mus musculus
tgggaggccaggctttttgatcacg

SEQ ID NO: 381975 - DNA, 25 bp, Mus musculus
tgggaggctatggtcgtggtggtgg

SEQ ID NO: 381976 - DNA, 25 bp, Mus musculus
tgggaggctcaagcactgctacagg

SEQ ID NO: 381977 - DNA, 25 bp, Mus musculus
tgggaggctcgatgaaaaacacaaa

SEQ ID NO: 381978 - DNA, 25 bp, Mus musculus
tgggaggctcgatggagaattttgg

SEQ ID NO: 381979 - DNA, 25 bp, Mus musculus
tgggagggagccagcctggaggccg

SEQ ID NO: 381980 - DNA, 25 bp, Mus musculus
tgggaggggcaaaggagcatggctt

SEQ ID NO: 381981 - DNA, 25 bp, Mus musculus
tgggaggtggagatgtcatcaggcc

SEQ ID NO: 381982 - DNA, 25 bp, Mus musculus
tgggaggttctgcagaccatgccgt

SEQ ID NO: 381983 - DNA, 25 bp, Mus musculus
tgggagtaaatatttctaccatttt

SEQ ID NO: 381984 - DNA, 25 bp, Mus musculus
tgggagtaaattagcatatgtatat

SEQ ID NO: 381985 - DNA, 25 bp, Mus musculus
tgggagtaagtcgaatctacaaaat

SEQ ID NO: 381986 - DNA, 25 bp, Mus musculus
tgggagtacagctgactcaagagac

SEQ ID NO: 381987 - DNA, 25 bp, Mus musculus
tgggagtacgaatttcagcgaggag

SEQ ID NO: 381988 - DNA, 25 bp, Mus musculus
tgggagtattacaagcatccgatat

SEQ ID NO: 381989 - DNA, 25 bp, Mus musculus
tgggagtcaccacggttcatggaaa

SEQ ID NO: 381990 - DNA, 25 bp, Mus musculus
tgggagtcaggacacctatatcaac

SEQ ID NO: 381991 - DNA, 25 bp, Mus musculus
tgggagtcgagagactgaccaacca

SEQ ID NO: 381992 - DNA, 25 bp, Mus musculus
tgggagtcgagttctaaaacaacaa

SEQ ID NO: 381993 - DNA, 25 bp, Mus musculus
tgggagtgaacggtctcaggagctc

SEQ ID NO: 381994 - DNA, 25 bp, Mus musculus
tgggagtgaggcccagcctgcagga

SEQ ID NO: 381995 - DNA, 25 bp, Mus musculus
tgggagtgaggtgacttctgtgact

SEQ ID NO: 381996 - DNA, 25 bp, Mus musculus
tgggagtgagtcaggaacaaagtat

SEQ ID NO: 381997 - DNA, 25 bp, Mus musculus
tgggagtgcagattgaaaaatgcag

SEQ ID NO: 381998 - DNA, 25 bp, Mus musculus
tgggagtgtctggcaccgtggactt

SEQ ID NO: 381999 - DNA, 25 bp, Mus musculus
tgggagtgtgttcatgtgaacgagt

SEQ ID NO: 382000 - DNA, 25 bp, Mus musculus
tgggagtgtgttgatgtgaacgagt

SEQ ID NO: 382001 - DNA, 25 bp, Mus musculus
tgggagttcgctatctgcaggtgtc

SEQ ID NO: 382002 - DNA, 25 bp, Mus musculus
tgggagttggtaaatgtttatggag

SEQ ID NO: 382003 - DNA, 25 bp, Mus musculus
tgggagtttgaggaattagaaagta

SEQ ID NO: 382004 - DNA, 25 bp, Mus musculus
tgggataaaaagaatgctgccaaga

SEQ ID NO: 382005 - DNA, 25 bp, Mus musculus
tgggataaaggattccagcagattt

SEQ ID NO: 382006 - DNA, 25 bp, Mus musculus
tgggataacaacgtctatttttatt

SEQ ID NO: 382007 - DNA, 25 bp, Mus musculus
tgggataacagttcccaaagtggct

SEQ ID NO: 382008 - DNA, 25 bp, Mus musculus
tgggatacaaagtcctctcagcagg

SEQ ID NO: 382009 - DNA, 25 bp, Mus musculus
tgggatacaagaacaatttttattc

SEQ ID NO: 382010 - DNA, 25 bp, Mus musculus
tgggatagaagggcttcttggtaat

SEQ ID NO: 382011 - DNA, 25 bp, Mus musculus
tgggatagagccagcacgcatttga

SEQ ID NO: 382012 - DNA, 25 bp, Mus musculus
tgggatagagccagtatccatggaa

SEQ ID NO: 382013 - DNA, 25 bp, Mus musculus
tgggatatccctaagattttgttcc

SEQ ID NO: 382014 - DNA, 25 bp, Mus musculus
tgggatatcgcggcccaatggaaga

SEQ ID NO: 382015 - DNA, 25 bp, Mus musculus
tgggatatcgcgggacaggaacggt

SEQ ID NO: 382016 - DNA, 25 bp, Mus musculus
tgggatatgaggtgcagcagaaaga

SEQ ID NO: 382017 - DNA, 25 bp, Mus musculus
tgggatatgtggggacatcagtgca

SEQ ID NO: 382018 - DNA, 25 bp, Mus musculus
tgggatattcacaagagcgttataa

SEQ ID NO: 382019 - DNA, 25 bp, Mus musculus
tgggatatttgcaagatgagatgaa

SEQ ID NO: 382020 - DNA, 25 bp, Mus musculus
tgggatcacaagtgtgtctcaaaag

SEQ ID NO: 382021 - DNA, 25 bp, Mus musculus
tgggatcattcacagatcattctag

SEQ ID NO: 382022 - DNA, 25 bp, Mus musculus
tgggatcattgtctgcgtggtggct

SEQ ID NO: 382023 - DNA, 25 bp, Mus musculus
tgggatccaacgacaatcagcgcct

SEQ ID NO: 382024 - DNA, 25 bp, Mus musculus
tgggatccaacgacattgatacact

SEQ ID NO: 382025 - DNA, 25 bp, Mus musculus
tgggatccaccaccacgggctcacc

SEQ ID NO: 382026 - DNA, 25 bp, Mus musculus
tgggatccagaatccaactgtgtta

SEQ ID NO: 382027 - DNA, 25 bp, Mus musculus
tgggatccagaatttggggtgctgt

SEQ ID NO: 382028 - DNA, 25 bp, Mus musculus
tgggatccagagggctgactctgtg

SEQ ID NO: 382029 - DNA, 25 bp, Mus musculus
tgggatcccccagggtgaagcactg

SEQ ID NO: 382030 - DNA, 25 bp, Mus musculus
tgggatcccccagggttgtgactta

SEQ ID NO: 382031 - DNA, 25 bp, Mus musculus
tgggatccctgctttgtggaaggac

SEQ ID NO: 382032 - DNA, 25 bp, Mus musculus
tgggatcctaaagtggccgtgcctg

SEQ ID NO: 382033 - DNA, 25 bp, Mus musculus
tgggatcctccaacaatcctccatg

SEQ ID NO: 382034 - DNA, 25 bp, Mus musculus
tgggatcctgggagaatttagagct

SEQ ID NO: 382035 - DNA, 25 bp, Mus musculus
tgggatctaagtaaaattggagaag

SEQ ID NO: 382036 - DNA, 25 bp, Mus musculus
tgggatctagacgaggacctattaa

SEQ ID NO: 382037 - DNA, 25 bp, Mus musculus
tgggatctaggacgctgcattggga

SEQ ID NO: 382038 - DNA, 25 bp, Mus musculus
tgggatctcacaacgggcaccacca

SEQ ID NO: 382039 - DNA, 25 bp, Mus musculus
tgggatctcagagggatttgaccca

SEQ ID NO: 382040 - DNA, 25 bp, Mus musculus
tgggatctggaacagacacagccct

SEQ ID NO: 382041 - DNA, 25 bp, Mus musculus
tgggatctgggacactgaatggagc

SEQ ID NO: 382042 - DNA, 25 bp, Mus musculus
tgggatctttgctttctcatgagaa

SEQ ID NO: 382043 - DNA, 25 bp, Mus musculus
tgggatgaaacggaacattttccct

SEQ ID NO: 382044 - DNA, 25 bp, Mus musculus
tgggatgaaacggttctgtgatgac

SEQ ID NO: 382045 - DNA, 25 bp, Mus musculus
tgggatgaagattgtggatgtcagt

SEQ ID NO: 382046 - DNA, 25 bp, Mus musculus
tgggatgaaggtgactgtcctggaa

SEQ ID NO: 382047 - DNA, 25 bp, Mus musculus
tgggatgacaagcaggtttgctgag

SEQ ID NO: 382048 - DNA, 25 bp, Mus musculus
tgggatgacgaggaagaggaacagg

SEQ ID NO: 382049 - DNA, 25 bp, Mus musculus
tgggatgcaactgatgtttcccaga

SEQ ID NO: 382050 - DNA, 25 bp, Mus musculus
tgggatgcaactgggaagagagcac

SEQ ID NO: 382051 - DNA, 25 bp, Mus musculus
tgggatgcacacagccaaccccaac

SEQ ID NO: 382052 - DNA, 25 bp, Mus musculus
tgggatgctactcaggggcagttgg

SEQ ID NO: 382053 - DNA, 25 bp, Mus musculus
tgggatggagctcctggtgaacaat

SEQ ID NO: 382054 - DNA, 25 bp, Mus musculus
tgggatgggaaaggtgactctggca

SEQ ID NO: 382055 - DNA, 25 bp, Mus musculus
tgggatgggaggtcccacgtgatct

SEQ ID NO: 382056 - DNA, 25 bp, Mus musculus
tgggatggtgaaggagacaaaattc

SEQ ID NO: 382057 - DNA, 25 bp, Mus musculus
tgggatgtgccgacggtggttcctg

SEQ ID NO: 382058 - DNA, 25 bp, Mus musculus
tgggatgtgccggaatgcaggctcc

SEQ ID NO: 382059 - DNA, 25 bp, Mus musculus
tgggatgtggagcggccaaccccaa

SEQ ID NO: 382060 - DNA, 25 bp, Mus musculus
tgggatgttcacaagagcgttataa

SEQ ID NO: 382061 - DNA, 25 bp, Mus musculus
tgggatgttggcctgatgccctcag

SEQ ID NO: 382062 - DNA, 25 bp, Mus musculus
tgggatgttgggtagcggaaagacc

SEQ ID NO: 382063 - DNA, 25 bp, Mus musculus
tgggatgttgggtgtttgaagctta

SEQ ID NO: 382064 - DNA, 25 bp, Mus musculus
tgggattaaaaagaatggaatcatc

SEQ ID NO: 382065 - DNA, 25 bp, Mus musculus
tgggattaaagagacttccttgagc

SEQ ID NO: 382066 - DNA, 25 bp, Mus musculus
tgggattaaagatccagctgagctc

SEQ ID NO: 382067 - DNA, 25 bp, Mus musculus
tgggattaaagatggcagactttct

SEQ ID NO: 382068 - DNA, 25 bp, Mus musculus
tgggattaaagattcatcagtggga

SEQ ID NO: 382069 - DNA, 25 bp, Mus musculus
tgggattaaagcagatataatttct

SEQ ID NO: 382070 - DNA, 25 bp, Mus musculus
tgggattaaagcgtgagggtcacac

SEQ ID NO: 382071 - DNA, 25 bp, Mus musculus
tgggattaaaggaaacaaatgtcct

SEQ ID NO: 382072 - DNA, 25 bp, Mus musculus
tgggattaaaggatgaaaatgagtg

SEQ ID NO: 382073 - DNA, 25 bp, Mus musculus
tgggattaaagggcatgaatctttc

SEQ ID NO: 382074 - DNA, 25 bp, Mus musculus
tgggattaaaggggtccctccaatc

SEQ ID NO: 382075 - DNA, 25 bp, Mus musculus
tgggattaaaggtatagtccagatg

SEQ ID NO: 382076 - DNA, 25 bp, Mus musculus
tgggattaaaggtgtgggaacaagc

SEQ ID NO: 382077 - DNA, 25 bp, Mus musculus
tgggattaaaggttgtaagcatcaa

SEQ ID NO: 382078 - DNA, 25 bp, Mus musculus
tgggattaaagtgctctgtgaagaa

SEQ ID NO: 382079 - DNA, 25 bp, Mus musculus
tgggattaatgatgctctccaagtt

SEQ ID NO: 382080 - DNA, 25 bp, Mus musculus
tgggattacagactcctccaccctg

SEQ ID NO: 382081 - DNA, 25 bp, Mus musculus
tgggattacaggggctgagatttat

SEQ ID NO: 382082 - DNA, 25 bp, Mus musculus
tgggattacaggttccacagcactg

SEQ ID NO: 382083 - DNA, 25 bp, Mus musculus
tgggattacaggttggcttcctgaa

SEQ ID NO: 382084 - DNA, 25 bp, Mus musculus
tgggattacagtcttgaaatacagc

SEQ ID NO: 382085 - DNA, 25 bp, Mus musculus
tgggattaccacaaatactggatgt

SEQ ID NO: 382086 - DNA, 25 bp, Mus musculus
tgggattagaggagttggaaccctg

SEQ ID NO: 382087 - DNA, 25 bp, Mus musculus
tgggattatcagaacaaaacgtgtg

SEQ ID NO: 382088 - DNA, 25 bp, Mus musculus
tgggattatgaggactccaagcccc

SEQ ID NO: 382089 - DNA, 25 bp, Mus musculus
tgggattattatgctttctcccaga

SEQ ID NO: 382090 - DNA, 25 bp, Mus musculus
tgggattcagaagataattggagaa

SEQ ID NO: 382091 - DNA, 25 bp, Mus musculus
tgggattcagtcattaggattggac

SEQ ID NO: 382092 - DNA, 25 bp, Mus musculus
tgggattcatcacagagccggctga

SEQ ID NO: 382093 - DNA, 25 bp, Mus musculus
tgggattccaggacgcccctgtgaa

SEQ ID NO: 382094 - DNA, 25 bp, Mus musculus
tgggattccaggagaaccacaatgt

SEQ ID NO: 382095 - DNA, 25 bp, Mus musculus
tgggattccaggatggcagctcctg

SEQ ID NO: 382096 - DNA, 25 bp, Mus musculus
tgggattccaggtgacagagtgcca

SEQ ID NO: 382097 - DNA, 25 bp, Mus musculus
tgggattctgtctcaaaccatgaat

SEQ ID NO: 382098 - DNA, 25 bp, Mus musculus
tgggattgcaggccctcaaggcccc

SEQ ID NO: 382099 - DNA, 25 bp, Mus musculus
tgggattgcagttttcaaagataca

SEQ ID NO: 382100 - DNA, 25 bp, Mus musculus
tgggattggaattgtacccattgtg

SEQ ID NO: 382101 - DNA, 25 bp, Mus musculus
tgggattgtaggtcacgctggagtt

SEQ ID NO: 382102 - DNA, 25 bp, Mus musculus
tgggatttaagtctgtgcgagggtg

SEQ ID NO: 382103 - DNA, 25 bp, Mus musculus
tgggatttagtctggcgtgtgcagc

SEQ ID NO: 382104 - DNA, 25 bp, Mus musculus
tgggatttcagacaggtggagtcac

SEQ ID NO: 382105 - DNA, 25 bp, Mus musculus
tgggatttcaggataacctctttct

SEQ ID NO: 382106 - DNA, 25 bp, Mus musculus
tgggatttcaggtctctggctttcc

SEQ ID NO: 382107 - DNA, 25 bp, Mus musculus
tgggatttgtcgccagagagacaag

SEQ ID NO: 382108 - DNA, 25 bp, Mus musculus
tgggcaaaccactggatatattggg

SEQ ID NO: 382109 - DNA, 25 bp, Mus musculus
tgggcaaaccactggggagtagagc

SEQ ID NO: 382110 - DNA, 25 bp, Mus musculus
tgggcaaagaggtgcgtgagcacat

SEQ ID NO: 382111 - DNA, 25 bp, Mus musculus
tgggcaaagagtcagacatttacat

SEQ ID NO: 382112 - DNA, 25 bp, Mus musculus
tgggcaaaggaagatttgatgaaaa

SEQ ID NO: 382113 - DNA, 25 bp, Mus musculus
tgggcaaaggggggctcctggcaaa

SEQ ID NO: 382114 - DNA, 25 bp, Mus musculus
tgggcaaatcaggaaaggatgtggc

SEQ ID NO: 382115 - DNA, 25 bp, Mus musculus
tgggcaacaagggaaatactggggc

SEQ ID NO: 382116 - DNA, 25 bp, Mus musculus
tgggcaacaaggtggaccccctttc

SEQ ID NO: 382117 - DNA, 25 bp, Mus musculus
tgggcaacctttggtagagaccttt

SEQ ID NO: 382118 - DNA, 25 bp, Mus musculus
tgggcaacgctgaatggtgccatga

SEQ ID NO: 382119 - DNA, 25 bp, Mus musculus
tgggcaacgctgtcagcgaaggcct

SEQ ID NO: 382120 - DNA, 25 bp, Mus musculus
tgggcaacttcctttcacgtgactg

SEQ ID NO: 382121 - DNA, 25 bp, Mus musculus
tgggcaagctggtggtaacggaaaa

SEQ ID NO: 382122 - DNA, 25 bp, Mus musculus
tgggcaaggagatccacgatttgtt

SEQ ID NO: 382123 - DNA, 25 bp, Mus musculus
tgggcaaggagatggaatccaagtg

SEQ ID NO: 382124 - DNA, 25 bp, Mus musculus
tgggcaagtcagaatcaacctaccg

SEQ ID NO: 382125 - DNA, 25 bp, Mus musculus
tgggcaagtcagacagtatctcact

SEQ ID NO: 382126 - DNA, 25 bp, Mus musculus
tgggcaagtcagcgattgtagtgag

SEQ ID NO: 382127 - DNA, 25 bp, Mus musculus
tgggcaagtccagcctgctcctgag

SEQ ID NO: 382128 - DNA, 25 bp, Mus musculus
tgggcaataaatatgcttcatcttc

SEQ ID NO: 382129 - DNA, 25 bp, Mus musculus
tgggcaatatcatgattgaccccgt

SEQ ID NO: 382130 - DNA, 25 bp, Mus musculus
tgggcaatggacttcaggcaatcca

SEQ ID NO: 382131 - DNA, 25 bp, Mus musculus
tgggcaatggcttcgcaggctgcat

SEQ ID NO: 382132 - DNA, 25 bp, Mus musculus
tgggcaatggctttgcgggctgcgt

SEQ ID NO: 382133 - DNA, 25 bp, Mus musculus
tgggcacaagcaaagaccggtgtgt

SEQ ID NO: 382134 - DNA, 25 bp, Mus musculus
tgggcacaagcaaaggaaagaggcc

SEQ ID NO: 382135 - DNA, 25 bp, Mus musculus
tgggcacaagcaaagtggtagtgtg

SEQ ID NO: 382136 - DNA, 25 bp, Mus musculus
tgggcacaaggcgacccaagctcca

SEQ ID NO: 382137 - DNA, 25 bp, Mus musculus
tgggcacaagggtgtggactgcgat

SEQ ID NO: 382138 - DNA, 25 bp, Mus musculus
tgggcacacaggccagcggtgtgag

SEQ ID NO: 382139 - DNA, 25 bp, Mus musculus
tgggcacacagggttttgaaggccc

SEQ ID NO: 382140 - DNA, 25 bp, Mus musculus
tgggcacagacatggagtcagtgac

SEQ ID NO: 382141 - DNA, 25 bp, Mus musculus
tgggcacagattggtgttggtacta

SEQ ID NO: 382142 - DNA, 25 bp, Mus musculus
tgggcacccaaggtgaaagcagaaa

SEQ ID NO: 382143 - DNA, 25 bp, Mus musculus
tgggcacctcgagaagcctgtacag

SEQ ID NO: 382144 - DNA, 25 bp, Mus musculus
tgggcacctcgattgcagcccggga

SEQ ID NO: 382145 - DNA, 25 bp, Mus musculus
tgggcacctgaatccaccttgacac

SEQ ID NO: 382146 - DNA, 25 bp, Mus musculus
tgggcacctgagagagaagacacag

SEQ ID NO: 382147 - DNA, 25 bp, Mus musculus
tgggcacctgctggggttgggactc

SEQ ID NO: 382148 - DNA, 25 bp, Mus musculus
tgggcacctggaagaccgatgctgt

SEQ ID NO: 382149 - DNA, 25 bp, Mus musculus
tgggcacctggaagctgtggtgtac

SEQ ID NO: 382150 - DNA, 25 bp, Mus musculus
tgggcacctggaaggcctccccagg

SEQ ID NO: 382151 - DNA, 25 bp, Mus musculus
tgggcacctggaagtcccctcctgg

SEQ ID NO: 382152 - DNA, 25 bp, Mus musculus
tgggcacctggaagtcttccccagg

SEQ ID NO: 382153 - DNA, 25 bp, Mus musculus
tgggcacgaggctggaaggctgcgt

SEQ ID NO: 382154 - DNA, 25 bp, Mus musculus
tgggcacgccggagctccctgtggc

SEQ ID NO: 382155 - DNA, 25 bp, Mus musculus
tgggcacgggagcctatgggaaggt

SEQ ID NO: 382156 - DNA, 25 bp, Mus musculus
tgggcacgggagtccgggtttgcac

SEQ ID NO: 382157 - DNA, 25 bp, Mus musculus
tgggcacgtaagagatgatgatgga

SEQ ID NO: 382158 - DNA, 25 bp, Mus musculus
tgggcactcagggcccaggacggct

SEQ ID NO: 382159 - DNA, 25 bp, Mus musculus
tgggcactcaggtgaagccaacacc

SEQ ID NO: 382160 - DNA, 25 bp, Mus musculus
tgggcactcatgcatgctagtccca

SEQ ID NO: 382161 - DNA, 25 bp, Mus musculus
tgggcactgacatggttcctgccat

SEQ ID NO: 382162 - DNA, 25 bp, Mus musculus
tgggcactgatgaggacagctcaga

SEQ ID NO: 382163 - DNA, 25 bp, Mus musculus
tgggcactgatgaggattctcagga

SEQ ID NO: 382164 - DNA, 25 bp, Mus musculus
tgggcactgctgtgcttatggcaaa

SEQ ID NO: 382165 - DNA, 25 bp, Mus musculus
tgggcacttttgaaatggccatgaa

SEQ ID NO: 382166 - DNA, 25 bp, Mus musculus
tgggcagaaaggtgatcgagggtcg

SEQ ID NO: 382167 - DNA, 25 bp, Mus musculus
tgggcagaagttgctcaagatgctg

SEQ ID NO: 382168 - DNA, 25 bp, Mus musculus
tgggcagaatcatagggagaggcgg

SEQ ID NO: 382169 - DNA, 25 bp, Mus musculus
tgggcagagccagagaatgttgctg

SEQ ID NO: 382170 - DNA, 25 bp, Mus musculus
tgggcagatcacagacactgcagaa

SEQ ID NO: 382171 - DNA, 25 bp, Mus musculus
tgggcagatgcacatgcagaacatc

SEQ ID NO: 382172 - DNA, 25 bp, Mus musculus
tgggcagcatcagcccccggcagca

SEQ ID NO: 382173 - DNA, 25 bp, Mus musculus
tgggcagccggcaggaccagtggct

SEQ ID NO: 382174 - DNA, 25 bp, Mus musculus
tgggcagcctgtggggacaggttgc

SEQ ID NO: 382175 - DNA, 25 bp, Mus musculus
tgggcagcctgtggttgcagctcct

SEQ ID NO: 382176 - DNA, 25 bp, Mus musculus
tgggcagcgccagtggctccgcggg

SEQ ID NO: 382177 - DNA, 25 bp, Mus musculus
tgggcagctacttggttccctgccg

SEQ ID NO: 382178 - DNA, 25 bp, Mus musculus
tgggcagctgagattcctgctgctt

SEQ ID NO: 382179 - DNA, 25 bp, Mus musculus
tgggcagctgaggtgtgactttgag

SEQ ID NO: 382180 - DNA, 25 bp, Mus musculus
tgggcaggagctgagctgtagccct

SEQ ID NO: 382181 - DNA, 25 bp, Mus musculus
tgggcaggtattcacctacaagcag

SEQ ID NO: 382182 - DNA, 25 bp, Mus musculus
tgggcagtacactgcctcaggcgat

SEQ ID NO: 382183 - DNA, 25 bp, Mus musculus
tgggcagtacattgccattacccag

SEQ ID NO: 382184 - DNA, 25 bp, Mus musculus
tgggcagtggagggccctgtctgta

SEQ ID NO: 382185 - DNA, 25 bp, Mus musculus
tgggcatcacagtcagtacaggcta

SEQ ID NO: 382186 - DNA, 25 bp, Mus musculus
tgggcatcaccacgatcagagtgat

SEQ ID NO: 382187 - DNA, 25 bp, Mus musculus
tgggcatcagagaggatgtaactta

SEQ ID NO: 382188 - DNA, 25 bp, Mus musculus
tgggcatcagagagggaagaaaatg

SEQ ID NO: 382189 - DNA, 25 bp, Mus musculus
tgggcatctcactgcaatgcctgtc

SEQ ID NO: 382190 - DNA, 25 bp, Mus musculus
tgggcatctcactggtggagctggc

SEQ ID NO: 382191 - DNA, 25 bp, Mus musculus
tgggcatctgaaggtctgccttgac

SEQ ID NO: 382192 - DNA, 25 bp, Mus musculus
tgggcatctgtgtgatctcagtgaa

SEQ ID NO: 382193 - DNA, 25 bp, Mus musculus
tgggcatgaagctgagtgaagatgg

SEQ ID NO: 382194 - DNA, 25 bp, Mus musculus
tgggcatgagcaagcacgtcgcgtt

SEQ ID NO: 382195 - DNA, 25 bp, Mus musculus
tgggcatgaggctgctggcgttccc

SEQ ID NO: 382196 - DNA, 25 bp, Mus musculus
tgggcatgatgcccccgcctcctcc

SEQ ID NO: 382197 - DNA, 25 bp, Mus musculus
tgggcatgtgcgggtctatgaatga

SEQ ID NO: 382198 - DNA, 25 bp, Mus musculus
tgggcatgtggccattatgtttgtc

SEQ ID NO: 382199 - DNA, 25 bp, Mus musculus
tgggcatgtggggtgatcctgtata

SEQ ID NO: 382200 - DNA, 25 bp, Mus musculus
tgggccaaaccaatatattgtggct

SEQ ID NO: 382201 - DNA, 25 bp, Mus musculus
tgggccaacacctgaatctcctgga

SEQ ID NO: 382202 - DNA, 25 bp, Mus musculus
tgggccaataagaagttgtgaagtt

SEQ ID NO: 382203 - DNA, 25 bp, Mus musculus
tgggccaattctggaccaccaaggc

SEQ ID NO: 382204 - DNA, 25 bp, Mus musculus
tgggccacaaattatgtgagtgact

SEQ ID NO: 382205 - DNA, 25 bp, Mus musculus
tgggccacaagccctagcatccctg

SEQ ID NO: 382206 - DNA, 25 bp, Mus musculus
tgggccacagctcggtcgtccagtc

SEQ ID NO: 382207 - DNA, 25 bp, Mus musculus
tgggccacagggacttggatgttgt

SEQ ID NO: 382208 - DNA, 25 bp, Mus musculus
tgggccacagggtcctactggagtg

SEQ ID NO: 382209 - DNA, 25 bp, Mus musculus
tgggccacttgcccatgttaccaga

SEQ ID NO: 382210 - DNA, 25 bp, Mus musculus
tgggccagaaggtccggctggtaat

SEQ ID NO: 382211 - DNA, 25 bp, Mus musculus
tgggccagaggcttcatgtggaaga

SEQ ID NO: 382212 - DNA, 25 bp, Mus musculus
tgggccagagggtccaggtggagtt

SEQ ID NO: 382213 - DNA, 25 bp, Mus musculus
tgggccagatgggccctcctggtcc

SEQ ID NO: 382214 - DNA, 25 bp, Mus musculus
tgggccagcagactggaagctcctg

SEQ ID NO: 382215 - DNA, 25 bp, Mus musculus
tgggccagcaggtggcccgaggcag

SEQ ID NO: 382216 - DNA, 25 bp, Mus musculus
tgggccagctgcagagaatgttgct

SEQ ID NO: 382217 - DNA, 25 bp, Mus musculus
tgggccaggacctgtgtgctcccac

SEQ ID NO: 382218 - DNA, 25 bp, Mus musculus
tgggccaggacgtggctccttccag

SEQ ID NO: 382219 - DNA, 25 bp, Mus musculus
tgggccagtatggagacacggacta

SEQ ID NO: 382220 - DNA, 25 bp, Mus musculus
tgggccagtatggagatcctcacca

SEQ ID NO: 382221 - DNA, 25 bp, Mus musculus
tgggccagtgatgagatgccatcca

SEQ ID NO: 382222 - DNA, 25 bp, Mus musculus
tgggccatattcaggcaaatgctga

SEQ ID NO: 382223 - DNA, 25 bp, Mus musculus
tgggccatgaagtgggctttgttat

SEQ ID NO: 382224 - DNA, 25 bp, Mus musculus
tgggccatggatggcggggatctga

SEQ ID NO: 382225 - DNA, 25 bp, Mus musculus
tgggccatggatggtgttgttacag

SEQ ID NO: 382226 - DNA, 25 bp, Mus musculus
tgggccatttcaagtccgaggtccc

SEQ ID NO: 382227 - DNA, 25 bp, Mus musculus
tgggcccaagaggcctcaaagagct

SEQ ID NO: 382228 - DNA, 25 bp, Mus musculus
tgggcccaagaggcctcgtggagcc

SEQ ID NO: 382229 - DNA, 25 bp, Mus musculus
tgggcccacagtgggggctgaagaa

SEQ ID NO: 382230 - DNA, 25 bp, Mus musculus
tgggcccacagtggttctcactgtg

SEQ ID NO: 382231 - DNA, 25 bp, Mus musculus
tgggcccacctcctggcatgcggcc

SEQ ID NO: 382232 - DNA, 25 bp, Mus musculus
tgggcccatctcaggagcaggcgag

SEQ ID NO: 382233 - DNA, 25 bp, Mus musculus
tgggccccaacagcgggccacagat

SEQ ID NO: 382234 - DNA, 25 bp, Mus musculus
tgggccccaacagcgggtctggagg

SEQ ID NO: 382235 - DNA, 25 bp, Mus musculus
tgggccccaagggcttctagactgg

SEQ ID NO: 382236 - DNA, 25 bp, Mus musculus
tgggccccacaagatccgtgtgaat

SEQ ID NO: 382237 - DNA, 25 bp, Mus musculus
tgggccccacaaggacctgctctcc

SEQ ID NO: 382238 - DNA, 25 bp, Mus musculus
tgggcccccaagccttggaaataca

SEQ ID NO: 382239 - DNA, 25 bp, Mus musculus
tgggcccggcagaatggctcccgca

SEQ ID NO: 382240 - DNA, 25 bp, Mus musculus
tgggccctctgggaccaagaggaat

SEQ ID NO: 382241 - DNA, 25 bp, Mus musculus
tgggccctgcaggactgttcccgac

SEQ ID NO: 382242 - DNA, 25 bp, Mus musculus
tgggccctggcaggacaacagtcca

SEQ ID NO: 382243 - DNA, 25 bp, Mus musculus
tgggccctttacccctgcttcctgc

SEQ ID NO: 382244 - DNA, 25 bp, Mus musculus
tgggccgaagaggagcttggctttg

SEQ ID NO: 382245 - DNA, 25 bp, Mus musculus
tgggccgactccgggacagacaatc

SEQ ID NO: 382246 - DNA, 25 bp, Mus musculus
tgggccgactccgtggaaacctctg

SEQ ID NO: 382247 - DNA, 25 bp, Mus musculus
tgggccgccagaattcagtagcttt

SEQ ID NO: 382248 - DNA, 25 bp, Mus musculus
tgggccgccttggcttcctttctga

SEQ ID NO: 382249 - DNA, 25 bp, Mus musculus
tgggccgcgcctactgactatcaat

SEQ ID NO: 382250 - DNA, 25 bp, Mus musculus
tgggccgcgcctactgttccaggac

SEQ ID NO: 382251 - DNA, 25 bp, Mus musculus
tgggccgctacgtgaatgagatcaa

SEQ ID NO: 382252 - DNA, 25 bp, Mus musculus
tgggccgctcagcttactattacca

SEQ ID NO: 382253 - DNA, 25 bp, Mus musculus
tgggccggacctacaacttctgaaa

SEQ ID NO: 382254 - DNA, 25 bp, Mus musculus
tgggccggacctacactgatgaaga

SEQ ID NO: 382255 - DNA, 25 bp, Mus musculus
tgggccgtttctgcttccctcaaga

SEQ ID NO: 382256 - DNA, 25 bp, Mus musculus
tgggcctaagttatgaggagtccaa

SEQ ID NO: 382257 - DNA, 25 bp, Mus musculus
tgggcctagactttctgagtaccat

SEQ ID NO: 382258 - DNA, 25 bp, Mus musculus
tgggcctagcagtggcatctttctt

SEQ ID NO: 382259 - DNA, 25 bp, Mus musculus
tgggcctcaagtccccaagacttcc

SEQ ID NO: 382260 - DNA, 25 bp, Mus musculus
tgggcctcaccagtgaagcggcccc

SEQ ID NO: 382261 - DNA, 25 bp, Mus musculus
tgggcctcgtggagttcaggacctt

SEQ ID NO: 382262 - DNA, 25 bp, Mus musculus
tgggcctgaatgatatgtttggacc

SEQ ID NO: 382263 - DNA, 25 bp, Mus musculus
tgggcctgaatggctccgtgctctg

SEQ ID NO: 382264 - DNA, 25 bp, Mus musculus
tgggcctgaatgtctcttacagata

SEQ ID NO: 382265 - DNA, 25 bp, Mus musculus
tgggcctgaggctcttcgcggcaaa

SEQ ID NO: 382266 - DNA, 25 bp, Mus musculus
tgggcctgcggtagaaaaagcagac

SEQ ID NO: 382267 - DNA, 25 bp, Mus musculus
tgggcctgctacaaggtgcagcaga

SEQ ID NO: 382268 - DNA, 25 bp, Mus musculus
tgggcctggcaggggctgcgatgga

SEQ ID NO: 382269 - DNA, 25 bp, Mus musculus
tgggcctggcaggttcagtcctcgc

SEQ ID NO: 382270 - DNA, 25 bp, Mus musculus
tgggcctggccaggagtgaattgga

SEQ ID NO: 382271 - DNA, 25 bp, Mus musculus
tgggccttaaatcagtgtcggtgac

SEQ ID NO: 382272 - DNA, 25 bp, Mus musculus
tgggccttccagccatgctgcaagc

SEQ ID NO: 382273 - DNA, 25 bp, Mus musculus
tgggccttgggggcctgggctggtg

SEQ ID NO: 382274 - DNA, 25 bp, Mus musculus
tgggccttgtacaggtatcacaagg

SEQ ID NO: 382275 - DNA, 25 bp, Mus musculus
tgggccttgtgttttttcagttcta

SEQ ID NO: 382276 - DNA, 25 bp, Mus musculus
tgggcctttatggcatctgaacgcc

SEQ ID NO: 382277 - DNA, 25 bp, Mus musculus
tgggcctttgttcaagcacacaacc

SEQ ID NO: 382278 - DNA, 25 bp, Mus musculus
tgggcgaaagaagagtggaggaacc

SEQ ID NO: 382279 - DNA, 25 bp, Mus musculus
tgggcgaagctcaaggccacttctt

SEQ ID NO: 382280 - DNA, 25 bp, Mus musculus
tgggcgagacacattgcgctggctc

SEQ ID NO: 382281 - DNA, 25 bp, Mus musculus
tgggcgagctgttgatgtgatggca

SEQ ID NO: 382282 - DNA, 25 bp, Mus musculus
tgggcgagtgcggtttcgtggtggc

SEQ ID NO: 382283 - DNA, 25 bp, Mus musculus
tgggcgagttaaagcacatggtgat

SEQ ID NO: 382284 - DNA, 25 bp, Mus musculus
tgggcgatggggcactggctccagc

SEQ ID NO: 382285 - DNA, 25 bp, Mus musculus
tgggcgcaccaaggccatggtggcg

SEQ ID NO: 382286 - DNA, 25 bp, Mus musculus
tgggcgcagacatgaaagcttgcgg

SEQ ID NO: 382287 - DNA, 25 bp, Mus musculus
tgggcgcccggcgcagcaagcacac

SEQ ID NO: 382288 - DNA, 25 bp, Mus musculus
tgggcgccggccacggcccggacac

SEQ ID NO: 382289 - DNA, 25 bp, Mus musculus
tgggcgcctccagaacagcatgttt

SEQ ID NO: 382290 - DNA, 25 bp, Mus musculus
tgggcgcctccaggaacacttctgt

SEQ ID NO: 382291 - DNA, 25 bp, Mus musculus
tgggcgcgcgccagttggacatttg

SEQ ID NO: 382292 - DNA, 25 bp, Mus musculus
tgggcgcgctcggagacattccaaa

SEQ ID NO: 382293 - DNA, 25 bp, Mus musculus
tgggcgcggtcaagaaaggctctgg

SEQ ID NO: 382294 - DNA, 25 bp, Mus musculus
tgggcgcggtcaaggatcatctgct

SEQ ID NO: 382295 - DNA, 25 bp, Mus musculus
tgggcgctcagcagttctccgacct

SEQ ID NO: 382296 - DNA, 25 bp, Mus musculus
tgggcgctgcagggtaattcagaga

SEQ ID NO: 382297 - DNA, 25 bp, Mus musculus
tgggcgctggaagagactctcatgg

SEQ ID NO: 382298 - DNA, 25 bp, Mus musculus
tgggcgctgtggagataaagaagct

SEQ ID NO: 382299 - DNA, 25 bp, Mus musculus
tgggcggagatctgagtgcccgtcc

SEQ ID NO: 382300 - DNA, 25 bp, Mus musculus
tgggcggccggaggtttgccaaaga

SEQ ID NO: 382301 - DNA, 25 bp, Mus musculus
tgggcggcggggaggacttgcacta

SEQ ID NO: 382302 - DNA, 25 bp, Mus musculus
tgggcgggaaccaggtgctacagaa

SEQ ID NO: 382303 - DNA, 25 bp, Mus musculus
tgggcgggagagatggatgcgagtt

SEQ ID NO: 382304 - DNA, 25 bp, Mus musculus
tgggcgggctgacgcttcccaacct

SEQ ID NO: 382305 - DNA, 25 bp, Mus musculus
tgggcgggctgctgagaagacgctt

SEQ ID NO: 382306 - DNA, 25 bp, Mus musculus
tgggcgggctggtatgcgtcttctg

SEQ ID NO: 382307 - DNA, 25 bp, Mus musculus
tgggcgggctggtgagaagacgctt

SEQ ID NO: 382308 - DNA, 25 bp, Mus musculus
tgggcgtctgggcaagacctgcagg

SEQ ID NO: 382309 - DNA, 25 bp, Mus musculus
tgggcgtgcggattgtcgcagcaat

SEQ ID NO: 382310 - DNA, 25 bp, Mus musculus
tgggcgtggaagctatggaggtttt

SEQ ID NO: 382311 - DNA, 25 bp, Mus musculus
tgggctaaagaatatgacagatacc

SEQ ID NO: 382312 - DNA, 25 bp, Mus musculus
tgggctaatgcagagatccactgcc

SEQ ID NO: 382313 - DNA, 25 bp, Mus musculus
tgggctaatgcagaggggagtttgc

SEQ ID NO: 382314 - DNA, 25 bp, Mus musculus
tgggctacaaagctgctgatgagac

SEQ ID NO: 382315 - DNA, 25 bp, Mus musculus
tgggctacaaggtgaagaagcatct

SEQ ID NO: 382316 - DNA, 25 bp, Mus musculus
tgggctacagagctcaccatgccta

SEQ ID NO: 382317 - DNA, 25 bp, Mus musculus
tgggctacagaggtgggcttactgt

SEQ ID NO: 382318 - DNA, 25 bp, Mus musculus
tgggctacagaggtgtccaacaggc

SEQ ID NO: 382319 - DNA, 25 bp, Mus musculus
tgggctaccagattttgttcggatc

SEQ ID NO: 382320 - DNA, 25 bp, Mus musculus
tgggctaccagtggttgtccccatc

SEQ ID NO: 382321 - DNA, 25 bp, Mus musculus
tgggctactaaggagggcgctctct

SEQ ID NO: 382322 - DNA, 25 bp, Mus musculus
tgggctacttcgcgtgggctgtctt

SEQ ID NO: 382323 - DNA, 25 bp, Mus musculus
tgggctagagcaagccccgcccaac

SEQ ID NO: 382324 - DNA, 25 bp, Mus musculus
tgggctaggaaggttctgtttgttt

SEQ ID NO: 382325 - DNA, 25 bp, Mus musculus
tgggctataagacccagttgtagct

SEQ ID NO: 382326 - DNA, 25 bp, Mus musculus
tgggctataaggatgtctcccgtgc

SEQ ID NO: 382327 - DNA, 25 bp, Mus musculus
tgggctataggtcggatatgaagag

SEQ ID NO: 382328 - DNA, 25 bp, Mus musculus
tgggctatgacagccagcccgcttt

SEQ ID NO: 382329 - DNA, 25 bp, Mus musculus
tgggctatgacccccctctctccct

SEQ ID NO: 382330 - DNA, 25 bp, Mus musculus
tgggctatggagctggtgctgtccg

SEQ ID NO: 382331 - DNA, 25 bp, Mus musculus
tgggctatggagtcccaacaggagg

SEQ ID NO: 382332 - DNA, 25 bp, Mus musculus
tgggctatttcttgttgccaaaaca

SEQ ID NO: 382333 - DNA, 25 bp, Mus musculus
tgggctcacacgaggtagctcgcgg

SEQ ID NO: 382334 - DNA, 25 bp, Mus musculus
tgggctcagagggagtggggccggc

SEQ ID NO: 382335 - DNA, 25 bp, Mus musculus
tgggctcagcaaaggcagctgagat

SEQ ID NO: 382336 - DNA, 25 bp, Mus musculus
tgggctcagctatggactgtctaac

SEQ ID NO: 382337 - DNA, 25 bp, Mus musculus
tgggctccaaatctgaggttatgcg

SEQ ID NO: 382338 - DNA, 25 bp, Mus musculus
tgggctccacaagcaaaaccttgag

SEQ ID NO: 382339 - DNA, 25 bp, Mus musculus
tgggctccagacagtccaatgccac

SEQ ID NO: 382340 - DNA, 25 bp, Mus musculus
tgggctccagacagtcctaacaggg

SEQ ID NO: 382341 - DNA, 25 bp, Mus musculus
tgggctccagatctactactctgaa

SEQ ID NO: 382342 - DNA, 25 bp, Mus musculus
tgggctccagcagcccaagcccagc

SEQ ID NO: 382343 - DNA, 25 bp, Mus musculus
tgggctccccaggagatggcctgac

SEQ ID NO: 382344 - DNA, 25 bp, Mus musculus
tgggctcctctgggatttgttttgg

SEQ ID NO: 382345 - DNA, 25 bp, Mus musculus
tgggctcctggtctctgggccaggg

SEQ ID NO: 382346 - DNA, 25 bp, Mus musculus
tgggctcgctacgaggtgtgggctc

SEQ ID NO: 382347 - DNA, 25 bp, Mus musculus
tgggctcggagttttcaggaagagc

SEQ ID NO: 382348 - DNA, 25 bp, Mus musculus
tgggctctacgggtgacaccaggtc

SEQ ID NO: 382349 - DNA, 25 bp, Mus musculus
tgggctctatgaaccagacttggga

SEQ ID NO: 382350 - DNA, 25 bp, Mus musculus
tgggctctcacttccagaggaactc

SEQ ID NO: 382351 - DNA, 25 bp, Mus musculus
tgggctctgaagggtacaccatgag

SEQ ID NO: 382352 - DNA, 25 bp, Mus musculus
tgggctctgaagggtggaataagca

SEQ ID NO: 382353 - DNA, 25 bp, Mus musculus
tgggctctgagaggcccctgcccgg

SEQ ID NO: 382354 - DNA, 25 bp, Mus musculus
tgggctctgcagattctcattgcca

SEQ ID NO: 382355 - DNA, 25 bp, Mus musculus
tgggctctgtagcaggtctagtgac

SEQ ID NO: 382356 - DNA, 25 bp, Mus musculus
tgggctctgtgggggcagctggcat

SEQ ID NO: 382357 - DNA, 25 bp, Mus musculus
tgggctctttgggtatgtgcagcac

SEQ ID NO: 382358 - DNA, 25 bp, Mus musculus
tgggctgaagagatttgaaagtgac

SEQ ID NO: 382359 - DNA, 25 bp, Mus musculus
tgggctgaagctaggcggccgtcac

SEQ ID NO: 382360 - DNA, 25 bp, Mus musculus
tgggctgaaggagacagaggaaggc

SEQ ID NO: 382361 - DNA, 25 bp, Mus musculus
tgggctgaaggggagcttctggagg

SEQ ID NO: 382362 - DNA, 25 bp, Mus musculus
tgggctgagaagcggaggctgctga

SEQ ID NO: 382363 - DNA, 25 bp, Mus musculus
tgggctgagaaggtgaggtggcctt

SEQ ID NO: 382364 - DNA, 25 bp, Mus musculus
tgggctgatgacccagtcttatctc

SEQ ID NO: 382365 - DNA, 25 bp, Mus musculus
tgggctgcaagcggattgggtttcc

SEQ ID NO: 382366 - DNA, 25 bp, Mus musculus
tgggctgcaagtgggtctccaacaa

SEQ ID NO: 382367 - DNA, 25 bp, Mus musculus
tgggctgcagaggattctcattgtc

SEQ ID NO: 382368 - DNA, 25 bp, Mus musculus
tgggctgcagagtgtcctttatttc

SEQ ID NO: 382369 - DNA, 25 bp, Mus musculus
tgggctgcagggacctcccgggtcg

SEQ ID NO: 382370 - DNA, 25 bp, Mus musculus
tgggctgcatgcattgtggctgggg

SEQ ID NO: 382371 - DNA, 25 bp, Mus musculus
tgggctgcatgcggaccaggccttg

SEQ ID NO: 382372 - DNA, 25 bp, Mus musculus
tgggctgccccaggatccacctgat

SEQ ID NO: 382373 - DNA, 25 bp, Mus musculus
tgggctgccgaatgaaaaggtgcag

SEQ ID NO: 382374 - DNA, 25 bp, Mus musculus
tgggctgccgactaggatgaaggac

SEQ ID NO: 382375 - DNA, 25 bp, Mus musculus
tgggctgccgactatcaagaatgac

SEQ ID NO: 382376 - DNA, 25 bp, Mus musculus
tgggctgccgactatggaaatccta

SEQ ID NO: 382377 - DNA, 25 bp, Mus musculus
tgggctgccgactggacccagctga

SEQ ID NO: 382378 - DNA, 25 bp, Mus musculus
tgggctgccgactggtcaatataga

SEQ ID NO: 382379 - DNA, 25 bp, Mus musculus
tgggctgccgactgtgtccatgttg

SEQ ID NO: 382380 - DNA, 25 bp, Mus musculus
tgggctgcctctaagatctcaggat

SEQ ID NO: 382381 - DNA, 25 bp, Mus musculus
tgggctgcgggagccaatgtcccta

SEQ ID NO: 382382 - DNA, 25 bp, Mus musculus
tgggctgcgggtttgttttctgccg

SEQ ID NO: 382383 - DNA, 25 bp, Mus musculus
tgggctgctgactcctctgcaggtg

SEQ ID NO: 382384 - DNA, 25 bp, Mus musculus
tgggctgctgactgtgtcaacaagg

SEQ ID NO: 382385 - DNA, 25 bp, Mus musculus
tgggctgctggcaactatcgaactc

SEQ ID NO: 382386 - DNA, 25 bp, Mus musculus
tgggctgcttgctctctaactgatg

SEQ ID NO: 382387 - DNA, 25 bp, Mus musculus
tgggctgcttggcttacttctttga

SEQ ID NO: 382388 - DNA, 25 bp, Mus musculus
tgggctgggatcattgtctgcgtgg

SEQ ID NO: 382389 - DNA, 25 bp, Mus musculus
tgggctgggctccagatctactact

SEQ ID NO: 382390 - DNA, 25 bp, Mus musculus
tgggctgtctgttgtttctctgctg

SEQ ID NO: 382391 - DNA, 25 bp, Mus musculus
tgggctgttttggtgtgcacatccc

SEQ ID NO: 382392 - DNA, 25 bp, Mus musculus
tgggcttaaaaggcatccaaggaat

SEQ ID NO: 382393 - DNA, 25 bp, Mus musculus
tgggcttaccaacagggagtacacc

SEQ ID NO: 382394 - DNA, 25 bp, Mus musculus
tgggcttaccaacagtctcaagaag

SEQ ID NO: 382395 - DNA, 25 bp, Mus musculus
tgggcttcactggtaaacaggtgat

SEQ ID NO: 382396 - DNA, 25 bp, Mus musculus
tgggcttcagcgagaactttcaaag

SEQ ID NO: 382397 - DNA, 25 bp, Mus musculus
tgggcttcaggtgctgtgggacggg

SEQ ID NO: 382398 - DNA, 25 bp, Mus musculus
tgggcttcccgatacgacatttcat

SEQ ID NO: 382399 - DNA, 25 bp, Mus musculus
tgggcttcccgattctgtttaggca

SEQ ID NO: 382400 - DNA, 25 bp, Mus musculus
tgggcttcccggagccgaggacctg

SEQ ID NO: 382401 - DNA, 25 bp, Mus musculus
tgggcttcctcaatattgatgaaag

SEQ ID NO: 382402 - DNA, 25 bp, Mus musculus
tgggcttcttctcgaccaacttgca

SEQ ID NO: 382403 - DNA, 25 bp, Mus musculus
tgggcttcttggtgtctgaccgaga

SEQ ID NO: 382404 - DNA, 25 bp, Mus musculus
tgggcttctttcagacaagcgtgag

SEQ ID NO: 382405 - DNA, 25 bp, Mus musculus
tgggcttgacgacaatggaggtaga

SEQ ID NO: 382406 - DNA, 25 bp, Mus musculus
tgggcttgacgtgtccaacctgtca

SEQ ID NO: 382407 - DNA, 25 bp, Mus musculus
tgggcttgcagattttcttctaacg

SEQ ID NO: 382408 - DNA, 25 bp, Mus musculus
tgggcttgcatgaggcaaaagagat

SEQ ID NO: 382409 - DNA, 25 bp, Mus musculus
tgggcttgcatgagggctcgctgcc

SEQ ID NO: 382410 - DNA, 25 bp, Mus musculus
tgggcttggaggcaagggcagtgag

SEQ ID NO: 382411 - DNA, 25 bp, Mus musculus
tgggcttggggaagtcccagatcta

SEQ ID NO: 382412 - DNA, 25 bp, Mus musculus
tgggcttgtattgaaaaagcttgtg

SEQ ID NO: 382413 - DNA, 25 bp, Mus musculus
tgggctttcacttaggaatgtgact

SEQ ID NO: 382414 - DNA, 25 bp, Mus musculus
tgggctttccaagttacctgattta

SEQ ID NO: 382415 - DNA, 25 bp, Mus musculus
tgggctttctcagggctctggcgca

SEQ ID NO: 382416 - DNA, 25 bp, Mus musculus
tgggcttttcaggtcacctagcatt

SEQ ID NO: 382417 - DNA, 25 bp, Mus musculus
tgggcttttgcaggcacaacccggt

SEQ ID NO: 382418 - DNA, 25 bp, Mus musculus
tggggaaaagggaaagcttggcgtg

SEQ ID NO: 382419 - DNA, 25 bp, Mus musculus
tggggaaacaactgggctcgggcca

SEQ ID NO: 382420 - DNA, 25 bp, Mus musculus
tggggaaaccaaggacacactgaag

SEQ ID NO: 382421 - DNA, 25 bp, Mus musculus
tggggaaaggtgaacgctgctggtt

SEQ ID NO: 382422 - DNA, 25 bp, Mus musculus
tggggaacagaagccggatggtgtc

SEQ ID NO: 382423 - DNA, 25 bp, Mus musculus
tggggaacaggcaggatgagataga

SEQ ID NO: 382424 - DNA, 25 bp, Mus musculus
tggggaacaggcaggtcacgaaaga

SEQ ID NO: 382425 - DNA, 25 bp, Mus musculus
tggggaacaggtctttcatagtact

SEQ ID NO: 382426 - DNA, 25 bp, Mus musculus
tggggaacatggaaagctgcctttt

SEQ ID NO: 382427 - DNA, 25 bp, Mus musculus
tggggaagaagagcccttctcccta

SEQ ID NO: 382428 - DNA, 25 bp, Mus musculus
tggggaagcagatggagttccagaa

SEQ ID NO: 382429 - DNA, 25 bp, Mus musculus
tggggaagcctgggtcacgtgaaga

SEQ ID NO: 382430 - DNA, 25 bp, Mus musculus
tggggaagcgagccctgaagacaag

SEQ ID NO: 382431 - DNA, 25 bp, Mus musculus
tggggaagcgcagcgagcaggacac

SEQ ID NO: 382432 - DNA, 25 bp, Mus musculus
tggggaagcgcaggacacagaaaat

SEQ ID NO: 382433 - DNA, 25 bp, Mus musculus
tggggaagcggtaggtgcacgcctc

SEQ ID NO: 382434 - DNA, 25 bp, Mus musculus
tggggaagctggctgtgactcgagg

SEQ ID NO: 382435 - DNA, 25 bp, Mus musculus
tggggaagctgggatctcaagcaca

SEQ ID NO: 382436 - DNA, 25 bp, Mus musculus
tggggaaggaaggtgaccattgttg

SEQ ID NO: 382437 - DNA, 25 bp, Mus musculus
tggggaaggaagtgagcctggtggt

SEQ ID NO: 382438 - DNA, 25 bp, Mus musculus
tggggaaggacgcatctcttcgccg

SEQ ID NO: 382439 - DNA, 25 bp, Mus musculus
tggggaatattcctacctccactcc

SEQ ID NO: 382440 - DNA, 25 bp, Mus musculus
tggggaatgggagaagagttagaat

SEQ ID NO: 382441 - DNA, 25 bp, Mus musculus
tggggaatgggagaagatgctgtgg

SEQ ID NO: 382442 - DNA, 25 bp, Mus musculus
tggggacaacgaaggtgaccccatc

SEQ ID NO: 382443 - DNA, 25 bp, Mus musculus
tggggacacggcatcctttgaagtg

SEQ ID NO: 382444 - DNA, 25 bp, Mus musculus
tggggacagagcagaatttgatact

SEQ ID NO: 382445 - DNA, 25 bp, Mus musculus
tggggacagagcaggggtgctcttc

SEQ ID NO: 382446 - DNA, 25 bp, Mus musculus
tggggacaggacctttgagcagcca

SEQ ID NO: 382447 - DNA, 25 bp, Mus musculus
tggggacaggttctggaaatacgct

SEQ ID NO: 382448 - DNA, 25 bp, Mus musculus
tggggaccaaacggtgatggaaaac

SEQ ID NO: 382449 - DNA, 25 bp, Mus musculus
tggggaccagctgggagagcgaggg

SEQ ID NO: 382450 - DNA, 25 bp, Mus musculus
tggggaccataaagtctaaggttgt

SEQ ID NO: 382451 - DNA, 25 bp, Mus musculus
tggggaccctagggctgtgcctggc

SEQ ID NO: 382452 - DNA, 25 bp, Mus musculus
tggggaccgagccctctgattgccc

SEQ ID NO: 382453 - DNA, 25 bp, Mus musculus
tggggacctgtaaagctcggatgcc

SEQ ID NO: 382454 - DNA, 25 bp, Mus musculus
tggggacctgtaaagttgcttttag

SEQ ID NO: 382455 - DNA, 25 bp, Mus musculus
tggggacgcgtccgactgaggctcc

SEQ ID NO: 382456 - DNA, 25 bp, Mus musculus
tggggacgcgtccggccccagcggt

SEQ ID NO: 382457 - DNA, 25 bp, Mus musculus
tggggacggcccttggtgtggacag

SEQ ID NO: 382458 - DNA, 25 bp, Mus musculus
tggggacgtgcagaattaccatgag

SEQ ID NO: 382459 - DNA, 25 bp, Mus musculus
tggggacgtgcagaccatcccatgg

SEQ ID NO: 382460 - DNA, 25 bp, Mus musculus
tggggactcttaaagatgagaattc

SEQ ID NO: 382461 - DNA, 25 bp, Mus musculus
tggggacttggcagctcatgctgtt

SEQ ID NO: 382462 - DNA, 25 bp, Mus musculus
tggggacttggcaggtccaacgtcg

SEQ ID NO: 382463 - DNA, 25 bp, Mus musculus
tggggacttggggacggctgttctc

SEQ ID NO: 382464 - DNA, 25 bp, Mus musculus
tggggactttgccaggacctgtgtc

SEQ ID NO: 382465 - DNA, 25 bp, Mus musculus
tggggagaaaacaccagctacatca

SEQ ID NO: 382466 - DNA, 25 bp, Mus musculus
tggggagaaacagccctgacggccg

SEQ ID NO: 382467 - DNA, 25 bp, Mus musculus
tggggagaacttgggctctgctctg

SEQ ID NO: 382468 - DNA, 25 bp, Mus musculus
tggggagaataagtgttttgcagct

SEQ ID NO: 382469 - DNA, 25 bp, Mus musculus
tggggagaccggtactttgatccgg

SEQ ID NO: 382470 - DNA, 25 bp, Mus musculus
tggggagagactgatgagacatcgt

SEQ ID NO: 382471 - DNA, 25 bp, Mus musculus
tggggagagaggaagaactacagag

SEQ ID NO: 382472 - DNA, 25 bp, Mus musculus
tggggagagtgaggctcaggccagc

SEQ ID NO: 382473 - DNA, 25 bp, Mus musculus
tggggagatgtgagggatctaccaa

SEQ ID NO: 382474 - DNA, 25 bp, Mus musculus
tggggagcccaggtccggtgagcaa

SEQ ID NO: 382475 - DNA, 25 bp, Mus musculus
tggggagccgggaggctacagacta

SEQ ID NO: 382476 - DNA, 25 bp, Mus musculus
tggggagccttttgcccttcttttg

SEQ ID NO: 382477 - DNA, 25 bp, Mus musculus
tggggagcgcggcagtggagctggc

SEQ ID NO: 382478 - DNA, 25 bp, Mus musculus
tggggagcggcggtggtgtgccaag

SEQ ID NO: 382479 - DNA, 25 bp, Mus musculus
tggggagcggcggtgtgatccattg

SEQ ID NO: 382480 - DNA, 25 bp, Mus musculus
tggggagctctcgaagtgccctgga

SEQ ID NO: 382481 - DNA, 25 bp, Mus musculus
tggggagctctcggtctcaactcat

SEQ ID NO: 382482 - DNA, 25 bp, Mus musculus
tggggagctggccccacagggcttg

SEQ ID NO: 382483 - DNA, 25 bp, Mus musculus
tggggagctggctaagctggtgctg

SEQ ID NO: 382484 - DNA, 25 bp, Mus musculus
tggggagctttgaggacctcatgga

SEQ ID NO: 382485 - DNA, 25 bp, Mus musculus
tggggaggagacagacaccatccaa

SEQ ID NO: 382486 - DNA, 25 bp, Mus musculus
tggggaggagctgggctttgactac

SEQ ID NO: 382487 - DNA, 25 bp, Mus musculus
tggggaggcagtaaattacagagaa

SEQ ID NO: 382488 - DNA, 25 bp, Mus musculus
tggggaggcagtgttcagggaggtt

SEQ ID NO: 382489 - DNA, 25 bp, Mus musculus
tggggaggccaaccgctatggatta

SEQ ID NO: 382490 - DNA, 25 bp, Mus musculus
tggggagggcgaggtgctcctaatg

SEQ ID NO: 382491 - DNA, 25 bp, Mus musculus
tggggagtaaagacctgttgtactg

SEQ ID NO: 382492 - DNA, 25 bp, Mus musculus
tggggagtaaagtggcagacctgtt

SEQ ID NO: 382493 - DNA, 25 bp, Mus musculus
tggggagtacagaggtgcaggtcct

SEQ ID NO: 382494 - DNA, 25 bp, Mus musculus
tggggagtactttggtcggtgtggt

SEQ ID NO: 382495 - DNA, 25 bp, Mus musculus
tggggagtctggtaaataagctgaa

SEQ ID NO: 382496 - DNA, 25 bp, Mus musculus
tggggagtttgagatcccactgaga

SEQ ID NO: 382497 - DNA, 25 bp, Mus musculus
tggggataaagtgtactggaattaa

SEQ ID NO: 382498 - DNA, 25 bp, Mus musculus
tggggataattggcctgtggaagca

SEQ ID NO: 382499 - DNA, 25 bp, Mus musculus
tggggataattgggtctggcaactt

SEQ ID NO: 382500 - DNA, 25 bp, Mus musculus
tggggatatggtgaacttgaccaga

SEQ ID NO: 382501 - DNA, 25 bp, Mus musculus
tggggatatggttgcctgtaatctc

SEQ ID NO: 382502 - DNA, 25 bp, Mus musculus
tggggatatgtaagacacctgtgga

SEQ ID NO: 382503 - DNA, 25 bp, Mus musculus
tggggatatgtaagtgctcttgtga

SEQ ID NO: 382504 - DNA, 25 bp, Mus musculus
tggggatcatgtcggtcacacagca

SEQ ID NO: 382505 - DNA, 25 bp, Mus musculus
tggggatccagccgagcccggtctt

SEQ ID NO: 382506 - DNA, 25 bp, Mus musculus
tggggatccagccggttactctcca

SEQ ID NO: 382507 - DNA, 25 bp, Mus musculus
tggggatccgagagactcgggaaac

SEQ ID NO: 382508 - DNA, 25 bp, Mus musculus
tggggatctcagactatggcgacaa

SEQ ID NO: 382509 - DNA, 25 bp, Mus musculus
tggggatgagaaagttgatgaagat

SEQ ID NO: 382510 - DNA, 25 bp, Mus musculus
tggggatgcaggttctccgccatga

SEQ ID NO: 382511 - DNA, 25 bp, Mus musculus
tggggatggcagattcctgtccatg

SEQ ID NO: 382512 - DNA, 25 bp, Mus musculus
tggggatgtgaagatcatcagaaac

SEQ ID NO: 382513 - DNA, 25 bp, Mus musculus
tggggattaaggcaggttgtcacaa

SEQ ID NO: 382514 - DNA, 25 bp, Mus musculus
tggggattatttagcacaggtgatg

SEQ ID NO: 382515 - DNA, 25 bp, Mus musculus
tggggattcttcagcacaggggatg

SEQ ID NO: 382516 - DNA, 25 bp, Mus musculus
tggggattgaacttcgtgggcatcg

SEQ ID NO: 382517 - DNA, 25 bp, Mus musculus
tggggatttacagggctgcagaatg

SEQ ID NO: 382518 - DNA, 25 bp, Mus musculus
tggggcaagaccaagatcaccgatg

SEQ ID NO: 382519 - DNA, 25 bp, Mus musculus
tggggcaagcctgaacctgtcacag

SEQ ID NO: 382520 - DNA, 25 bp, Mus musculus
tggggcagaacctggccaagatcct

SEQ ID NO: 382521 - DNA, 25 bp, Mus musculus
tggggcagaacgaggttgtgaacca

SEQ ID NO: 382522 - DNA, 25 bp, Mus musculus
tggggcagaagattgctttggcctt

SEQ ID NO: 382523 - DNA, 25 bp, Mus musculus
tggggcagaagcgcattaaagagga

SEQ ID NO: 382524 - DNA, 25 bp, Mus musculus
tggggcagagcagggatcagtggtg

SEQ ID NO: 382525 - DNA, 25 bp, Mus musculus
tggggcagatcctccttatcccact

SEQ ID NO: 382526 - DNA, 25 bp, Mus musculus
tggggcagatgcgaatgaagaggcc

SEQ ID NO: 382527 - DNA, 25 bp, Mus musculus
tggggcagccaggctggggatgaca

SEQ ID NO: 382528 - DNA, 25 bp, Mus musculus
tggggcagccagtcttcctgtccca

SEQ ID NO: 382529 - DNA, 25 bp, Mus musculus
tggggcagcttggagccggaagctg

SEQ ID NO: 382530 - DNA, 25 bp, Mus musculus
tggggcaggaagtgtcgagtggctg

SEQ ID NO: 382531 - DNA, 25 bp, Mus musculus
tggggcaggagccgaaatgtctcag

SEQ ID NO: 382532 - DNA, 25 bp, Mus musculus
tggggcaggagccgagtctccttat

SEQ ID NO: 382533 - DNA, 25 bp, Mus musculus
tggggcaggagccgatcccttttca

SEQ ID NO: 382534 - DNA, 25 bp, Mus musculus
tggggcagggcgggagagtattgtc

SEQ ID NO: 382535 - DNA, 25 bp, Mus musculus
tggggcagtttagaaatgcacttag

SEQ ID NO: 382536 - DNA, 25 bp, Mus musculus
tggggcatactgcagtgcttaaatg

SEQ ID NO: 382537 - DNA, 25 bp, Mus musculus
tggggcatgagtgtaatgttcaagc

SEQ ID NO: 382538 - DNA, 25 bp, Mus musculus
tggggcatgcaggcttcctgctttt

SEQ ID NO: 382539 - DNA, 25 bp, Mus musculus
tggggccaaggcgtgattaaggttg

SEQ ID NO: 382540 - DNA, 25 bp, Mus musculus
tggggccacagaggcagaggagtcc

SEQ ID NO: 382541 - DNA, 25 bp, Mus musculus
tggggccacaggtgccccccactcg

SEQ ID NO: 382542 - DNA, 25 bp, Mus musculus
tggggccagctcgcaagcaggctga

SEQ ID NO: 382543 - DNA, 25 bp, Mus musculus
tggggccagctcgcttgaagctcct

SEQ ID NO: 382544 - DNA, 25 bp, Mus musculus
tggggccatgatgagtacctatacc

SEQ ID NO: 382545 - DNA, 25 bp, Mus musculus
tggggccattggaggagtctgcggt

SEQ ID NO: 382546 - DNA, 25 bp, Mus musculus
tggggccccacggatgctggtggac

SEQ ID NO: 382547 - DNA, 25 bp, Mus musculus
tggggccccatcggaagctcagaac

SEQ ID NO: 382548 - DNA, 25 bp, Mus musculus
tggggccgaaggcctgggatgggaa

SEQ ID NO: 382549 - DNA, 25 bp, Mus musculus
tggggccgagcaaccatgaaggtga

SEQ ID NO: 382550 - DNA, 25 bp, Mus musculus
tggggccgcacggttggtacacgat

SEQ ID NO: 382551 - DNA, 25 bp, Mus musculus
tggggcctaactggtttgcatttcc

SEQ ID NO: 382552 - DNA, 25 bp, Mus musculus
tggggcctacagaagaggaggccac

SEQ ID NO: 382553 - DNA, 25 bp, Mus musculus
tggggcctccgagaggttggcctgc

SEQ ID NO: 382554 - DNA, 25 bp, Mus musculus
tggggcctggaggacatcatgttca

SEQ ID NO: 382555 - DNA, 25 bp, Mus musculus
tggggcctggtgcagctggtgctgc

SEQ ID NO: 382556 - DNA, 25 bp, Mus musculus
tggggccttggtgttgggagccctt

SEQ ID NO: 382557 - DNA, 25 bp, Mus musculus
tggggcctttagatgggaaagttga

SEQ ID NO: 382558 - DNA, 25 bp, Mus musculus
tggggcgatccggaacctggtggcc

SEQ ID NO: 382559 - DNA, 25 bp, Mus musculus
tggggcgatccgggaaggccatagc

SEQ ID NO: 382560 - DNA, 25 bp, Mus musculus
tggggcgcacagccctgtgaagcca

SEQ ID NO: 382561 - DNA, 25 bp, Mus musculus
tggggcgcagacatgtcttttctcc

SEQ ID NO: 382562 - DNA, 25 bp, Mus musculus
tggggcgcaggacccaagtttcttc

SEQ ID NO: 382563 - DNA, 25 bp, Mus musculus
tggggcgccagacaggattatggaa

SEQ ID NO: 382564 - DNA, 25 bp, Mus musculus
tggggcgccagggatcaacgttgta

SEQ ID NO: 382565 - DNA, 25 bp, Mus musculus
tggggctacagatagggtctctcca

SEQ ID NO: 382566 - DNA, 25 bp, Mus musculus
tggggctacagatttatgacattca

SEQ ID NO: 382567 - DNA, 25 bp, Mus musculus
tggggctacaggtggccttgcacgc

SEQ ID NO: 382568 - DNA, 25 bp, Mus musculus
tggggctactacggttgcaatgagg

SEQ ID NO: 382569 - DNA, 25 bp, Mus musculus
tggggctatgcagatggctatgaac

SEQ ID NO: 382570 - DNA, 25 bp, Mus musculus
tggggctccagagataaagctgctc

SEQ ID NO: 382571 - DNA, 25 bp, Mus musculus
tggggctccagagattatttgtctt

SEQ ID NO: 382572 - DNA, 25 bp, Mus musculus
tggggctcccttactcagttccctt

SEQ ID NO: 382573 - DNA, 25 bp, Mus musculus
tggggctcctctaaattggttccag

SEQ ID NO: 382574 - DNA, 25 bp, Mus musculus
tggggctcgcaggatccctgctgcc

SEQ ID NO: 382575 - DNA, 25 bp, Mus musculus
tggggctcggatggtaaaacaccat

SEQ ID NO: 382576 - DNA, 25 bp, Mus musculus
tggggctcggcatctatattggaaa

SEQ ID NO: 382577 - DNA, 25 bp, Mus musculus
tggggctctctggtggttcatccct

SEQ ID NO: 382578 - DNA, 25 bp, Mus musculus
tggggctgaaaagacactacaagaa

SEQ ID NO: 382579 - DNA, 25 bp, Mus musculus
tggggctgacggagggtgaggagtt

SEQ ID NO: 382580 - DNA, 25 bp, Mus musculus
tggggctgaggccgggaccggagct

SEQ ID NO: 382581 - DNA, 25 bp, Mus musculus
tggggctgatggcttccctaggatt

SEQ ID NO: 382582 - DNA, 25 bp, Mus musculus
tggggctgcagaccccacgtggctc

SEQ ID NO: 382583 - DNA, 25 bp, Mus musculus
tggggctgcccaaagagcatgccac

SEQ ID NO: 382584 - DNA, 25 bp, Mus musculus
tggggctgcccaaagagccccctca

SEQ ID NO: 382585 - DNA, 25 bp, Mus musculus
tggggctgcccaaagcctgagaccc

SEQ ID NO: 382586 - DNA, 25 bp, Mus musculus
tggggctgctgctctgtaaagaaga

SEQ ID NO: 382587 - DNA, 25 bp, Mus musculus
tggggctggacgttgagatcaccac

SEQ ID NO: 382588 - DNA, 25 bp, Mus musculus
tggggctgtgatggaatttcacgtt

SEQ ID NO: 382589 - DNA, 25 bp, Mus musculus
tggggctgtgatggtagcatcgcct

SEQ ID NO: 382590 - DNA, 25 bp, Mus musculus
tggggctgtggcagactaactccag

SEQ ID NO: 382591 - DNA, 25 bp, Mus musculus
tggggctgtgggattatctgaacga

SEQ ID NO: 382592 - DNA, 25 bp, Mus musculus
tggggcttaaagagggcttggggca

SEQ ID NO: 382593 - DNA, 25 bp, Mus musculus
tggggcttaactggttacaaaatgt

SEQ ID NO: 382594 - DNA, 25 bp, Mus musculus
tggggcttactcaggatgtcaatgg

SEQ ID NO: 382595 - DNA, 25 bp, Mus musculus
tggggcttatggtgtctgatctgga

SEQ ID NO: 382596 - DNA, 25 bp, Mus musculus
tggggcttctagccagagccatgca

SEQ ID NO: 382597 - DNA, 25 bp, Mus musculus
tggggctttaggagggttggtggtc

SEQ ID NO: 382598 - DNA, 25 bp, Mus musculus
tgggggaaatctaagataccaagtg

SEQ ID NO: 382599 - DNA, 25 bp, Mus musculus
tgggggaacaggttgagtgatggta

SEQ ID NO: 382600 - DNA, 25 bp, Mus musculus
tgggggaacagtttctctaatagca

SEQ ID NO: 382601 - DNA, 25 bp, Mus musculus
tgggggaacctggagctgcccatcg

SEQ ID NO: 382602 - DNA, 25 bp, Mus musculus
tgggggaacctgggagccacccaag

SEQ ID NO: 382603 - DNA, 25 bp, Mus musculus
tgggggacacatcagggggcgtcag

SEQ ID NO: 382604 - DNA, 25 bp, Mus musculus
tgggggacctcagaaggtctatatg

SEQ ID NO: 382605 - DNA, 25 bp, Mus musculus
tgggggacgctgcaagtgtggaggc

SEQ ID NO: 382606 - DNA, 25 bp, Mus musculus
tgggggacgctgggatttgaactgt

SEQ ID NO: 382607 - DNA, 25 bp, Mus musculus
tgggggactggcaggaccgtcacga

SEQ ID NO: 382608 - DNA, 25 bp, Mus musculus
tgggggagacgttcatgggcggtgg

SEQ ID NO: 382609 - DNA, 25 bp, Mus musculus
tgggggagactatggtggaacccag

SEQ ID NO: 382610 - DNA, 25 bp, Mus musculus
tgggggagactcgggggaactgatc

SEQ ID NO: 382611 - DNA, 25 bp, Mus musculus
tgggggagcacgagggttttttgca

SEQ ID NO: 382612 - DNA, 25 bp, Mus musculus
tgggggaggtcagatgtctctctta

SEQ ID NO: 382613 - DNA, 25 bp, Mus musculus
tgggggagtctcttgtacagaggag

SEQ ID NO: 382614 - DNA, 25 bp, Mus musculus
tgggggagtgcgggaacagaactca

SEQ ID NO: 382615 - DNA, 25 bp, Mus musculus
tgggggatctccaggggagttttgt

SEQ ID NO: 382616 - DNA, 25 bp, Mus musculus
tgggggcaccgaggtctccagcaga

SEQ ID NO: 382617 - DNA, 25 bp, Mus musculus
tgggggcaccgagtcaaataattta

SEQ ID NO: 382618 - DNA, 25 bp, Mus musculus
tgggggcagcagcaccatggccagc

SEQ ID NO: 382619 - DNA, 25 bp, Mus musculus
tgggggcagcagcttcctggccccg

SEQ ID NO: 382620 - DNA, 25 bp, Mus musculus
tgggggcagcaggatcccagtgtgc

SEQ ID NO: 382621 - DNA, 25 bp, Mus musculus
tgggggcagggagacgatactgtat

SEQ ID NO: 382622 - DNA, 25 bp, Mus musculus
tgggggccaagtgctcaccgagtct

SEQ ID NO: 382623 - DNA, 25 bp, Mus musculus
tgggggcccacaggtgcagttggtg

SEQ ID NO: 382624 - DNA, 25 bp, Mus musculus
tgggggcccacagttggtgaacaac

SEQ ID NO: 382625 - DNA, 25 bp, Mus musculus
tgggggcctgcatggcctgattgtg

SEQ ID NO: 382626 - DNA, 25 bp, Mus musculus
tgggggcctggctgggatgggtgct

SEQ ID NO: 382627 - DNA, 25 bp, Mus musculus
tgggggcctgggtccaagccggccc

SEQ ID NO: 382628 - DNA, 25 bp, Mus musculus
tgggggcgcgccctcaagaacagaa

SEQ ID NO: 382629 - DNA, 25 bp, Mus musculus
tgggggcgcgccctcacgtctgact

SEQ ID NO: 382630 - DNA, 25 bp, Mus musculus
tgggggctcgaagggcaggtaaacc

SEQ ID NO: 382631 - DNA, 25 bp, Mus musculus
tgggggctgctggacctaccggcat

SEQ ID NO: 382632 - DNA, 25 bp, Mus musculus
tgggggctgctggacggagcgggat

SEQ ID NO: 382633 - DNA, 25 bp, Mus musculus
tgggggctggctcagctcccaagtg

SEQ ID NO: 382634 - DNA, 25 bp, Mus musculus
tgggggctgggggggccaagatggg

SEQ ID NO: 382635 - DNA, 25 bp, Mus musculus
tgggggcttagacaggataaggaag

SEQ ID NO: 382636 - DNA, 25 bp, Mus musculus
tgggggcttgtgagggtgactacgg

SEQ ID NO: 382637 - DNA, 25 bp, Mus musculus
tggggggacctgcactcagcaggac

SEQ ID NO: 382638 - DNA, 25 bp, Mus musculus
tgggggggcccacagactgcagcaa

SEQ ID NO: 382639 - DNA, 25 bp, Mus musculus
tggggggtccctggtgtcgcggaag

SEQ ID NO: 382640 - DNA, 25 bp, Mus musculus
tgggggtaagggtggaatgtacgtc

SEQ ID NO: 382641 - DNA, 25 bp, Mus musculus
tgggggtagcaggtttggaccttat

SEQ ID NO: 382642 - DNA, 25 bp, Mus musculus
tgggggtatggagaggtgtcatcaa

SEQ ID NO: 382643 - DNA, 25 bp, Mus musculus
tgggggtcactggagtcgctgggga

SEQ ID NO: 382644 - DNA, 25 bp, Mus musculus
tgggggtcgcggggctcggatggcg

SEQ ID NO: 382645 - DNA, 25 bp, Mus musculus
tgggggtctgagagaatcgcacgtc

SEQ ID NO: 382646 - DNA, 25 bp, Mus musculus
tgggggtgggggagggcacatagaa

SEQ ID NO: 382647 - DNA, 25 bp, Mus musculus
tgggggttggtcactacactgcata

SEQ ID NO: 382648 - DNA, 25 bp, Mus musculus
tggggtaaagataaacaacaaagcc

SEQ ID NO: 382649 - DNA, 25 bp, Mus musculus
tggggtaaaggagtcaactgagagc

SEQ ID NO: 382650 - DNA, 25 bp, Mus musculus
tggggtacagattcccgtggggctg

SEQ ID NO: 382651 - DNA, 25 bp, Mus musculus
tggggtacagggtgaagtactggat

SEQ ID NO: 382652 - DNA, 25 bp, Mus musculus
tggggtacgcccgagctccagcaag

SEQ ID NO: 382653 - DNA, 25 bp, Mus musculus
tggggtactgccagggaatgaattt

SEQ ID NO: 382654 - DNA, 25 bp, Mus musculus
tggggtactgccagtgctgcgcaca

SEQ ID NO: 382655 - DNA, 25 bp, Mus musculus
tggggtactgctgcaggtcctggtg

SEQ ID NO: 382656 - DNA, 25 bp, Mus musculus
tggggtatcagaaggttggaggctg

SEQ ID NO: 382657 - DNA, 25 bp, Mus musculus
tggggtattataatattattggcgt

SEQ ID NO: 382658 - DNA, 25 bp, Mus musculus
tggggtatttcagggattctcctga

SEQ ID NO: 382659 - DNA, 25 bp, Mus musculus
tggggtcacctctaggtcattttac

SEQ ID NO: 382660 - DNA, 25 bp, Mus musculus
tggggtcaggcaaggcagtccctcg

SEQ ID NO: 382661 - DNA, 25 bp, Mus musculus
tggggtcatcccgtactcactggcc

SEQ ID NO: 382662 - DNA, 25 bp, Mus musculus
tggggtcattgaatacaaaggtgcc

SEQ ID NO: 382663 - DNA, 25 bp, Mus musculus
tggggtcatttgcaggtttaaggag

SEQ ID NO: 382664 - DNA, 25 bp, Mus musculus
tggggtccagctgtcaccctgctga

SEQ ID NO: 382665 - DNA, 25 bp, Mus musculus
tggggtccagggaaaggctcgagtg

SEQ ID NO: 382666 - DNA, 25 bp, Mus musculus
tggggtccaggtcgggatggtggct

SEQ ID NO: 382667 - DNA, 25 bp, Mus musculus
tggggtcccaggaggagtgggagca

SEQ ID NO: 382668 - DNA, 25 bp, Mus musculus
tggggtcccagggatccgtttcatt

SEQ ID NO: 382669 - DNA, 25 bp, Mus musculus
tggggtccccagaatcactatcagt

SEQ ID NO: 382670 - DNA, 25 bp, Mus musculus
tggggtccccagcaggaagggccca

SEQ ID NO: 382671 - DNA, 25 bp, Mus musculus
tggggtccccagccgatcgggtcag

SEQ ID NO: 382672 - DNA, 25 bp, Mus musculus
tggggtcccggacaagagtacatgg

SEQ ID NO: 382673 - DNA, 25 bp, Mus musculus
tggggtcccggatatttggaagata

SEQ ID NO: 382674 - DNA, 25 bp, Mus musculus
tggggtcccgggctactcttccgtg

SEQ ID NO: 382675 - DNA, 25 bp, Mus musculus
tggggtccgggagtgttacaggtgg

SEQ ID NO: 382676 - DNA, 25 bp, Mus musculus
tggggtcctggaaaggtgatgtaca

SEQ ID NO: 382677 - DNA, 25 bp, Mus musculus
tggggtcctgtttaaccatcagcag

SEQ ID NO: 382678 - DNA, 25 bp, Mus musculus
tggggtcctgtttaagagttcagat

SEQ ID NO: 382679 - DNA, 25 bp, Mus musculus
tggggtctacccagaagaaggacca

SEQ ID NO: 382680 - DNA, 25 bp, Mus musculus
tggggtcttttcctgccccacctcc

SEQ ID NO: 382681 - DNA, 25 bp, Mus musculus
tggggtgacgaggtggagtacatgt

SEQ ID NO: 382682 - DNA, 25 bp, Mus musculus
tggggtgagaagggcgttctctcca

SEQ ID NO: 382683 - DNA, 25 bp, Mus musculus
tggggtgcacctcagctttgtgcgc

SEQ ID NO: 382684 - DNA, 25 bp, Mus musculus
tggggtgcactcagggtggcacaag

SEQ ID NO: 382685 - DNA, 25 bp, Mus musculus
tggggtgcactcaggtcctcattcc

SEQ ID NO: 382686 - DNA, 25 bp, Mus musculus
tggggtgcagaatttctgaagtgaa

SEQ ID NO: 382687 - DNA, 25 bp, Mus musculus
tggggtgcgacttggaccaattgct

SEQ ID NO: 382688 - DNA, 25 bp, Mus musculus
tggggtgcgacttggactcggctct

SEQ ID NO: 382689 - DNA, 25 bp, Mus musculus
tggggtgctgatggggaaggaccgg

SEQ ID NO: 382690 - DNA, 25 bp, Mus musculus
tggggtgctgatgtttgagatgctg

SEQ ID NO: 382691 - DNA, 25 bp, Mus musculus
tggggtggaagccaggaagcttctt

SEQ ID NO: 382692 - DNA, 25 bp, Mus musculus
tggggtggaagccaggcctgtaggg

SEQ ID NO: 382693 - DNA, 25 bp, Mus musculus
tggggtggcgacagatgttgcatta

SEQ ID NO: 382694 - DNA, 25 bp, Mus musculus
tggggtggcgacaggtgtgactgga

SEQ ID NO: 382695 - DNA, 25 bp, Mus musculus
tggggttatatcaagttcaaaagga

SEQ ID NO: 382696 - DNA, 25 bp, Mus musculus
tggggttcagtacatcggcatcatg

SEQ ID NO: 382697 - DNA, 25 bp, Mus musculus
tggggttcagttctgatacccgatt

SEQ ID NO: 382698 - DNA, 25 bp, Mus musculus
tggggttcatgagaggccgaggcca

SEQ ID NO: 382699 - DNA, 25 bp, Mus musculus
tggggttccatgccggcaaagtgca

SEQ ID NO: 382700 - DNA, 25 bp, Mus musculus
tggggttgccagccatgctgcaagc

SEQ ID NO: 382701 - DNA, 25 bp, Mus musculus
tggggttgcccttgaacatttatga

SEQ ID NO: 382702 - DNA, 25 bp, Mus musculus
tggggttgcccttggtgaggcatgc

SEQ ID NO: 382703 - DNA, 25 bp, Mus musculus
tggggttgcctaggtgaggcatgca

SEQ ID NO: 382704 - DNA, 25 bp, Mus musculus
tggggttgggcgacagagagagatg

SEQ ID NO: 382705 - DNA, 25 bp, Mus musculus
tggggttttaaggtgtctggctgag

SEQ ID NO: 382706 - DNA, 25 bp, Mus musculus
tggggtttttcaggatgccacagtt

SEQ ID NO: 382707 - DNA, 25 bp, Mus musculus
tgggtaaactgaggctcctagaagg

SEQ ID NO: 382708 - DNA, 25 bp, Mus musculus
tgggtaacacagaagccaccatggg

SEQ ID NO: 382709 - DNA, 25 bp, Mus musculus
tgggtaactgtgtaggtgcaggcaa

SEQ ID NO: 382710 - DNA, 25 bp, Mus musculus
tgggtacaagggcaagctccagaaa

SEQ ID NO: 382711 - DNA, 25 bp, Mus musculus
tgggtacagaccaggacaaagagaa

SEQ ID NO: 382712 - DNA, 25 bp, Mus musculus
tgggtaccaggcacaggctaccctc

SEQ ID NO: 382713 - DNA, 25 bp, Mus musculus
tgggtacccagttgcacaacctggt

SEQ ID NO: 382714 - DNA, 25 bp, Mus musculus
tgggtaccccaaaagagaatcgcac

SEQ ID NO: 382715 - DNA, 25 bp, Mus musculus
tgggtaccttgatgccatcccgccc

SEQ ID NO: 382716 - DNA, 25 bp, Mus musculus
tgggtacgatatatcacacagaacc

SEQ ID NO: 382717 - DNA, 25 bp, Mus musculus
tgggtactcaaaaaggtctatccta

SEQ ID NO: 382718 - DNA, 25 bp, Mus musculus
tgggtacttaatgagttccgatctg

SEQ ID NO: 382719 - DNA, 25 bp, Mus musculus
tgggtagagagaaagggtacagatt

SEQ ID NO: 382720 - DNA, 25 bp, Mus musculus
tgggtagcagacagattgatgacat

SEQ ID NO: 382721 - DNA, 25 bp, Mus musculus
tgggtagcccgtgtcccatcactgg

SEQ ID NO: 382722 - DNA, 25 bp, Mus musculus
tgggtagcccgttacatcttcaaac

SEQ ID NO: 382723 - DNA, 25 bp, Mus musculus
tgggtaggtggagtattggcttccc

SEQ ID NO: 382724 - DNA, 25 bp, Mus musculus
tgggtagtgatgtaagcggtaacca

SEQ ID NO: 382725 - DNA, 25 bp, Mus musculus
tgggtatacaccaggcatccacatg

SEQ ID NO: 382726 - DNA, 25 bp, Mus musculus
tgggtatatagcttgaagtcaatgg

SEQ ID NO: 382727 - DNA, 25 bp, Mus musculus
tgggtatcagatgttcatctagaaa

SEQ ID NO: 382728 - DNA, 25 bp, Mus musculus
tgggtattggtaagttccctgctat

SEQ ID NO: 382729 - DNA, 25 bp, Mus musculus
tgggtattggtccagaacacagcct

SEQ ID NO: 382730 - DNA, 25 bp, Mus musculus
tgggtcaaagcactccactcatcag

SEQ ID NO: 382731 - DNA, 25 bp, Mus musculus
tgggtcaaagcattcctcaaccacc

SEQ ID NO: 382732 - DNA, 25 bp, Mus musculus
tgggtcacaagaagccgtctcagtg

SEQ ID NO: 382733 - DNA, 25 bp, Mus musculus
tgggtcacaaggtcaaagcaagtag

SEQ ID NO: 382734 - DNA, 25 bp, Mus musculus
tgggtcacataccaggggctgcgat

SEQ ID NO: 382735 - DNA, 25 bp, Mus musculus
tgggtcacccacaaggtggagaaat

SEQ ID NO: 382736 - DNA, 25 bp, Mus musculus
tgggtcagaagcatactgaggatag

SEQ ID NO: 382737 - DNA, 25 bp, Mus musculus
tgggtcagaagcatacttagacgtt

SEQ ID NO: 382738 - DNA, 25 bp, Mus musculus
tgggtcagacagcgtcatcatgaca

SEQ ID NO: 382739 - DNA, 25 bp, Mus musculus
tgggtcagacaggcaagggctcatt

SEQ ID NO: 382740 - DNA, 25 bp, Mus musculus
tgggtcagccgggatcaactgcact

SEQ ID NO: 382741 - DNA, 25 bp, Mus musculus
tgggtcagccggttttttcattagg

SEQ ID NO: 382742 - DNA, 25 bp, Mus musculus
tgggtcatacggtaacatttcactt

SEQ ID NO: 382743 - DNA, 25 bp, Mus musculus
tgggtcatgcagccctcaggaagag

SEQ ID NO: 382744 - DNA, 25 bp, Mus musculus
tgggtcccagtgaagagacatcatg

SEQ ID NO: 382745 - DNA, 25 bp, Mus musculus
tgggtcccagtgaaggtcgcaggca

SEQ ID NO: 382746 - DNA, 25 bp, Mus musculus
tgggtccctccagacttcctctgcc

SEQ ID NO: 382747 - DNA, 25 bp, Mus musculus
tgggtccctccaggtgggcacatgg

SEQ ID NO: 382748 - DNA, 25 bp, Mus musculus
tgggtcccttgcagccatgcagtgg

SEQ ID NO: 382749 - DNA, 25 bp, Mus musculus
tgggtcctcggggcgagcgaggttt

SEQ ID NO: 382750 - DNA, 25 bp, Mus musculus
tgggtcctggagtagcctctccagg

SEQ ID NO: 382751 - DNA, 25 bp, Mus musculus
tgggtcctggagtagtcccaggcac

SEQ ID NO: 382752 - DNA, 25 bp, Mus musculus
tgggtcctggatggagcctgcagat

SEQ ID NO: 382753 - DNA, 25 bp, Mus musculus
tgggtcctgggagccacgctggtac

SEQ ID NO: 382754 - DNA, 25 bp, Mus musculus
tgggtcgatatcaggtgtcctggag

SEQ ID NO: 382755 - DNA, 25 bp, Mus musculus
tgggtctcaaggagtcagagcaacc

SEQ ID NO: 382756 - DNA, 25 bp, Mus musculus
tgggtctcacgacaggtgatttccg

SEQ ID NO: 382757 - DNA, 25 bp, Mus musculus
tgggtctcagattatacagacacgc

SEQ ID NO: 382758 - DNA, 25 bp, Mus musculus
tgggtctcagcctcgaatgggtgaa

SEQ ID NO: 382759 - DNA, 25 bp, Mus musculus
tgggtctccaggctcagcccgtgcc

SEQ ID NO: 382760 - DNA, 25 bp, Mus musculus
tgggtctcccagtttgtcactcttt

SEQ ID NO: 382761 - DNA, 25 bp, Mus musculus
tgggtctctgcagtgctatggggca

SEQ ID NO: 382762 - DNA, 25 bp, Mus musculus
tgggtctgacaggcacagtagactg

SEQ ID NO: 382763 - DNA, 25 bp, Mus musculus
tgggtctgacagtgttgtcatgact

SEQ ID NO: 382764 - DNA, 25 bp, Mus musculus
tgggtctgctcaagagtgaagacaa

SEQ ID NO: 382765 - DNA, 25 bp, Mus musculus
tgggtctggaggtttgaggctctgt

SEQ ID NO: 382766 - DNA, 25 bp, Mus musculus
tgggtcttgggaagaaagacgatgc

SEQ ID NO: 382767 - DNA, 25 bp, Mus musculus
tgggtctttcgaatccttcgaaatg

SEQ ID NO: 382768 - DNA, 25 bp, Mus musculus
tgggtgaaaagccggctttctcctt

SEQ ID NO: 382769 - DNA, 25 bp, Mus musculus
tgggtgaaacacaggacttccatag

SEQ ID NO: 382770 - DNA, 25 bp, Mus musculus
tgggtgaagaagaagctgactgcgg

SEQ ID NO: 382771 - DNA, 25 bp, Mus musculus
tgggtgacagagtggaccagattgt

SEQ ID NO: 382772 - DNA, 25 bp, Mus musculus
tgggtgacctatcagggtacttttg

SEQ ID NO: 382773 - DNA, 25 bp, Mus musculus
tgggtgacctgggatggattcatgg

SEQ ID NO: 382774 - DNA, 25 bp, Mus musculus
tgggtgagaggctgcccctggagac

SEQ ID NO: 382775 - DNA, 25 bp, Mus musculus
tgggtgagcaggtgcgggaggtgct

SEQ ID NO: 382776 - DNA, 25 bp, Mus musculus
tgggtgaggaggttgtggcagcatt

SEQ ID NO: 382777 - DNA, 25 bp, Mus musculus
tgggtgataataaggacaaccggat

SEQ ID NO: 382778 - DNA, 25 bp, Mus musculus
tgggtgataataagtttctgagggt

SEQ ID NO: 382779 - DNA, 25 bp, Mus musculus
tgggtgataggtgaccatggaggag

SEQ ID NO: 382780 - DNA, 25 bp, Mus musculus
tgggtgatccaggtcattgtggcca

SEQ ID NO: 382781 - DNA, 25 bp, Mus musculus
tgggtgatgaaagggctgtgcctgg

SEQ ID NO: 382782 - DNA, 25 bp, Mus musculus
tgggtgatgactcagcttctaagga

SEQ ID NO: 382783 - DNA, 25 bp, Mus musculus
tgggtgatgactgcccagtgtttcc

SEQ ID NO: 382784 - DNA, 25 bp, Mus musculus
tgggtgatgactgttgctttcacta

SEQ ID NO: 382785 - DNA, 25 bp, Mus musculus
tgggtgatgctggggagatggtgcg

SEQ ID NO: 382786 - DNA, 25 bp, Mus musculus
tgggtgattctcttgccattcattg

SEQ ID NO: 382787 - DNA, 25 bp, Mus musculus
tgggtgattctcttggattgttcat

SEQ ID NO: 382788 - DNA, 25 bp, Mus musculus
tgggtgcaatgggtgaaagagctgg

SEQ ID NO: 382789 - DNA, 25 bp, Mus musculus
tgggtgcagggggaacagctgtgcc

SEQ ID NO: 382790 - DNA, 25 bp, Mus musculus
tgggtgcaggggtgtgccccagaga

SEQ ID NO: 382791 - DNA, 25 bp, Mus musculus
tgggtgccacgcaggcttacagttc

SEQ ID NO: 382792 - DNA, 25 bp, Mus musculus
tgggtgcccgagaggttctgggaga

SEQ ID NO: 382793 - DNA, 25 bp, Mus musculus
tgggtgcccgggatgaaagtgggat

SEQ ID NO: 382794 - DNA, 25 bp, Mus musculus
tgggtgctgcagtggttttaagcta

SEQ ID NO: 382795 - DNA, 25 bp, Mus musculus
tgggtggacaggtgagcaatgccag

SEQ ID NO: 382796 - DNA, 25 bp, Mus musculus
tgggtggagagcatgggggggaaag

SEQ ID NO: 382797 - DNA, 25 bp, Mus musculus
tgggtggaggcaaagacacttgtgc

SEQ ID NO: 382798 - DNA, 25 bp, Mus musculus
tgggtggagtgctctctgaaaactg

SEQ ID NO: 382799 - DNA, 25 bp, Mus musculus
tgggtggagtggtccattcgtttga

SEQ ID NO: 382800 - DNA, 25 bp, Mus musculus
tgggtggcagaggaggtccaactga

SEQ ID NO: 382801 - DNA, 25 bp, Mus musculus
tgggtggccatgggaaatggagcag

SEQ ID NO: 382802 - DNA, 25 bp, Mus musculus
tgggtggccatgtgcccagcccccg

SEQ ID NO: 382803 - DNA, 25 bp, Mus musculus
tgggtggggccacagaggcagagga

SEQ ID NO: 382804 - DNA, 25 bp, Mus musculus
tgggtggggccacaggtgcccccca

SEQ ID NO: 382805 - DNA, 25 bp, Mus musculus
tgggtggggttcagtacatcggcat

SEQ ID NO: 382806 - DNA, 25 bp, Mus musculus
tgggtggttgacatgtgcgagtagt

SEQ ID NO: 382807 - DNA, 25 bp, Mus musculus
tgggtggttttcttgaccctgcttt

SEQ ID NO: 382808 - DNA, 25 bp, Mus musculus
tgggtgtccagacgctgcggccagg

SEQ ID NO: 382809 - DNA, 25 bp, Mus musculus
tgggtgtgagattctctccagaggc

SEQ ID NO: 382810 - DNA, 25 bp, Mus musculus
tgggtgtgcctgaggagtccctgtg

SEQ ID NO: 382811 - DNA, 25 bp, Mus musculus
tgggtgtgcctgaggctgacctgtg

SEQ ID NO: 382812 - DNA, 25 bp, Mus musculus
tgggtgtggatggaggcattgcact

SEQ ID NO: 382813 - DNA, 25 bp, Mus musculus
tgggtgtggcaaggggaaactgttt

SEQ ID NO: 382814 - DNA, 25 bp, Mus musculus
tgggtgtggccagatcagactccaa

SEQ ID NO: 382815 - DNA, 25 bp, Mus musculus
tgggtgtggccagcgttttaccaac

SEQ ID NO: 382816 - DNA, 25 bp, Mus musculus
tgggtgtgtgaaatgcacttagcga

SEQ ID NO: 382817 - DNA, 25 bp, Mus musculus
tgggtgtgtggactgtgcagcatgg

SEQ ID NO: 382818 - DNA, 25 bp, Mus musculus
tgggtgttgaatacaaggttctcag

SEQ ID NO: 382819 - DNA, 25 bp, Mus musculus
tgggtgttgatgaagagctggagtg

SEQ ID NO: 382820 - DNA, 25 bp, Mus musculus
tgggtgttggcactgggatcagtaa

SEQ ID NO: 382821 - DNA, 25 bp, Mus musculus
tgggtgtttttcagatttcaccgag

SEQ ID NO: 382822 - DNA, 25 bp, Mus musculus
tgggttaaatattgatgagaaggct

SEQ ID NO: 382823 - DNA, 25 bp, Mus musculus
tgggttacaacatgggagaggcaga

SEQ ID NO: 382824 - DNA, 25 bp, Mus musculus
tgggttaccgagagcttttgctggg

SEQ ID NO: 382825 - DNA, 25 bp, Mus musculus
tgggttagagatgagacctgctcga

SEQ ID NO: 382826 - DNA, 25 bp, Mus musculus
tgggttcaagatcttggcaaccatg

SEQ ID NO: 382827 - DNA, 25 bp, Mus musculus
tgggttcacacaggagtgccaggag

SEQ ID NO: 382828 - DNA, 25 bp, Mus musculus
tgggttccagaccagccacgatgcc

SEQ ID NO: 382829 - DNA, 25 bp, Mus musculus
tgggttcccaagcagcagcaggctg

SEQ ID NO: 382830 - DNA, 25 bp, Mus musculus
tgggttcccagtgatagaaaacgag

SEQ ID NO: 382831 - DNA, 25 bp, Mus musculus
tgggttcctagctggaggaaatcca

SEQ ID NO: 382832 - DNA, 25 bp, Mus musculus
tgggttcctaggtccagctggagga

SEQ ID NO: 382833 - DNA, 25 bp, Mus musculus
tgggttcctccagctctacccgatc

SEQ ID NO: 382834 - DNA, 25 bp, Mus musculus
tgggttctcaaggcggggacgatcc

SEQ ID NO: 382835 - DNA, 25 bp, Mus musculus
tgggttctcgggcaatgatggcagt

SEQ ID NO: 382836 - DNA, 25 bp, Mus musculus
tgggttctgatgatgattcatgaaa

SEQ ID NO: 382837 - DNA, 25 bp, Mus musculus
tgggttctgcaggaggagtgatggg

SEQ ID NO: 382838 - DNA, 25 bp, Mus musculus
tgggttctgcatcccgttcacgcaa

SEQ ID NO: 382839 - DNA, 25 bp, Mus musculus
tgggttctggtgatggccataaaat

SEQ ID NO: 382840 - DNA, 25 bp, Mus musculus
tgggttgagtaaattcacagatact

SEQ ID NO: 382841 - DNA, 25 bp, Mus musculus
tgggttgcagcccagaggacttcct

SEQ ID NO: 382842 - DNA, 25 bp, Mus musculus
tgggttgcagttataataaagacct

SEQ ID NO: 382843 - DNA, 25 bp, Mus musculus
tgggttggggagtattactatgaat

SEQ ID NO: 382844 - DNA, 25 bp, Mus musculus
tgggttgtaggcttctccagtggca

SEQ ID NO: 382845 - DNA, 25 bp, Mus musculus
tgggtttaaagaatacttgaactat

SEQ ID NO: 382846 - DNA, 25 bp, Mus musculus
tgggtttaaagacagtatttgaaga

SEQ ID NO: 382847 - DNA, 25 bp, Mus musculus
tgggtttaacggagagggcggcgaa

SEQ ID NO: 382848 - DNA, 25 bp, Mus musculus
tgggtttaacggagatgagaaggcc

SEQ ID NO: 382849 - DNA, 25 bp, Mus musculus
tgggtttactgcagctctgcattga

SEQ ID NO: 382850 - DNA, 25 bp, Mus musculus
tgggtttactgcaggacattaagga

SEQ ID NO: 382851 - DNA, 25 bp, Mus musculus
tgggtttcaagcctggggaaaaaga

SEQ ID NO: 382852 - DNA, 25 bp, Mus musculus
tgggtttcaagtcttgtgatggatg

SEQ ID NO: 382853 - DNA, 25 bp, Mus musculus
tgggtttcagaacagagggcaatgc

SEQ ID NO: 382854 - DNA, 25 bp, Mus musculus
tgggtttcaggatccagccgcagcc

SEQ ID NO: 382855 - DNA, 25 bp, Mus musculus
tgggtttcgcagagcttcctctctc

SEQ ID NO: 382856 - DNA, 25 bp, Mus musculus
tgggtttgcagtcttctggcagctc

SEQ ID NO: 382857 - DNA, 25 bp, Mus musculus
tgggtttgccgattcccacccctgg

SEQ ID NO: 382858 - DNA, 25 bp, Mus musculus
tgggtttgccggattatcacaaaat

SEQ ID NO: 382859 - DNA, 25 bp, Mus musculus
tgggtttgcttctcccttccagata

SEQ ID NO: 382860 - DNA, 25 bp, Mus musculus
tgggttttaagtgcggagatccaag

SEQ ID NO: 382861 - DNA, 25 bp, Mus musculus
tgggttttttctggcgagcggcgtg

SEQ ID NO: 382862 - DNA, 25 bp, Mus musculus
tggtaaaatatcctgcccaaactcc

SEQ ID NO: 382863 - DNA, 25 bp, Mus musculus
tggtaaaatatcggatgcccgggta

SEQ ID NO: 382864 - DNA, 25 bp, Mus musculus
tggtaaaccgtcaaggtcacggtct

SEQ ID NO: 382865 - DNA, 25 bp, Mus musculus
tggtaaagacagcacagccccccag

SEQ ID NO: 382866 - DNA, 25 bp, Mus musculus
tggtaaagacagcctaaccatgcca

SEQ ID NO: 382867 - DNA, 25 bp, Mus musculus
tggtaaagggggagcacgagtgctt

SEQ ID NO: 382868 - DNA, 25 bp, Mus musculus
tggtaaagtcctgggaatcaacaag

SEQ ID NO: 382869 - DNA, 25 bp, Mus musculus
tggtaaagtggttcatcggaacctt

SEQ ID NO: 382870 - DNA, 25 bp, Mus musculus
tggtaaccaaagctgttctgtgtcc

SEQ ID NO: 382871 - DNA, 25 bp, Mus musculus
tggtaaccacacagcttgttcggtt

SEQ ID NO: 382872 - DNA, 25 bp, Mus musculus
tggtaaggagaaggatggcctcagg

SEQ ID NO: 382873 - DNA, 25 bp, Mus musculus
tggtaaggttcccaggatcaccgac

SEQ ID NO: 382874 - DNA, 25 bp, Mus musculus
tggtaagttcccagcttcttctgtg

SEQ ID NO: 382875 - DNA, 25 bp, Mus musculus
tggtaatcagggtaacacgcagtct

SEQ ID NO: 382876 - DNA, 25 bp, Mus musculus
tggtaatgatgaccattaattaagg

SEQ ID NO: 382877 - DNA, 25 bp, Mus musculus
tggtaatggagcccgagttcgtcaa

SEQ ID NO: 382878 - DNA, 25 bp, Mus musculus
tggtaatggaggtgcccctgtgctc

SEQ ID NO: 382879 - DNA, 25 bp, Mus musculus
tggtaatttacagtagttgcagtaa

SEQ ID NO: 382880 - DNA, 25 bp, Mus musculus
tggtacaaacagaggatcaatacca

SEQ ID NO: 382881 - DNA, 25 bp, Mus musculus
tggtacaaccacttccagctgcccc

SEQ ID NO: 382882 - DNA, 25 bp, Mus musculus
tggtacaacccaagtaatgaaaatc

SEQ ID NO: 382883 - DNA, 25 bp, Mus musculus
tggtacaagacgcatgttaatgaaa

SEQ ID NO: 382884 - DNA, 25 bp, Mus musculus
tggtacaccacacagacagaggagt

SEQ ID NO: 382885 - DNA, 25 bp, Mus musculus
tggtacacctacacaaatgtcccct

SEQ ID NO: 382886 - DNA, 25 bp, Mus musculus
tggtacactgcagtgctggtgttgg

SEQ ID NO: 382887 - DNA, 25 bp, Mus musculus
tggtacagaaaaagctcctgccacc

SEQ ID NO: 382888 - DNA, 25 bp, Mus musculus
tggtacagaatgggataaagatgac

SEQ ID NO: 382889 - DNA, 25 bp, Mus musculus
tggtacagaatgggatctttttaaa

SEQ ID NO: 382890 - DNA, 25 bp, Mus musculus
tggtacagaatgggctgaaccaata

SEQ ID NO: 382891 - DNA, 25 bp, Mus musculus
tggtacagaatggggggtcaacagg

SEQ ID NO: 382892 - DNA, 25 bp, Mus musculus
tggtacagaccatattaaccagctt

SEQ ID NO: 382893 - DNA, 25 bp, Mus musculus
tggtacagaccatattgatcagttg

SEQ ID NO: 382894 - DNA, 25 bp, Mus musculus
tggtacagaggtatctacacaagcc

SEQ ID NO: 382895 - DNA, 25 bp, Mus musculus
tggtacatcatcatggaaggcgtca

SEQ ID NO: 382896 - DNA, 25 bp, Mus musculus
tggtaccaacggaggtcctgggtgg

SEQ ID NO: 382897 - DNA, 25 bp, Mus musculus
tggtaccaactgtgtaaggagaagc

SEQ ID NO: 382898 - DNA, 25 bp, Mus musculus
tggtaccacagaatgagagccacgt

SEQ ID NO: 382899 - DNA, 25 bp, Mus musculus
tggtaccacagagcatttctgaaga

SEQ ID NO: 382900 - DNA, 25 bp, Mus musculus
tggtacccatgaaactgcatttcta

SEQ ID NO: 382901 - DNA, 25 bp, Mus musculus
tggtaccccgtcggcaatgatggca

SEQ ID NO: 382902 - DNA, 25 bp, Mus musculus
tggtacccgaggagaaactggaaac

SEQ ID NO: 382903 - DNA, 25 bp, Mus musculus
tggtacccgaggagaccaaacagtc

SEQ ID NO: 382904 - DNA, 25 bp, Mus musculus
tggtacccgaggagaccaaagaaga

SEQ ID NO: 382905 - DNA, 25 bp, Mus musculus
tggtacccgatagaggtccaggtct

SEQ ID NO: 382906 - DNA, 25 bp, Mus musculus
tggtacccttgtgaatacatcaaga

SEQ ID NO: 382907 - DNA, 25 bp, Mus musculus
tggtaccgaggagggacttcaaaac

SEQ ID NO: 382908 - DNA, 25 bp, Mus musculus
tggtaccgcaccaagtgtgaggaga

SEQ ID NO: 382909 - DNA, 25 bp, Mus musculus
tggtacctacccagcgtccccatgg

SEQ ID NO: 382910 - DNA, 25 bp, Mus musculus
tggtacctgaagatgaaatgtggca

SEQ ID NO: 382911 - DNA, 25 bp, Mus musculus
tggtacctgcagcccatacctggat

SEQ ID NO: 382912 - DNA, 25 bp, Mus musculus
tggtacctgcagtgcctgagacgta

SEQ ID NO: 382913 - DNA, 25 bp, Mus musculus
tggtacctgcggctgaaggtgaaga

SEQ ID NO: 382914 - DNA, 25 bp, Mus musculus
tggtacgaagcgccctttccgtcag

SEQ ID NO: 382915 - DNA, 25 bp, Mus musculus
tggtacgttcaggaggccccatcgg

SEQ ID NO: 382916 - DNA, 25 bp, Mus musculus
tggtacgttcaggggttgtgctggg

SEQ ID NO: 382917 - DNA, 25 bp, Mus musculus
tggtactaatggatagatgcctgca

SEQ ID NO: 382918 - DNA, 25 bp, Mus musculus
tggtactaatgtgccagtattagca

SEQ ID NO: 382919 - DNA, 25 bp, Mus musculus
tggtactcacagagcggtccaacct

SEQ ID NO: 382920 - DNA, 25 bp, Mus musculus
tggtactcacagcgcatgactacat

SEQ ID NO: 382921 - DNA, 25 bp, Mus musculus
tggtactcacagggcatgactacat

SEQ ID NO: 382922 - DNA, 25 bp, Mus musculus
tggtactcacagtgcggtccaacct

SEQ ID NO: 382923 - DNA, 25 bp, Mus musculus
tggtactgaatcttcagtgagcatg

SEQ ID NO: 382924 - DNA, 25 bp, Mus musculus
tggtactgctgcatgccctgaagcc

SEQ ID NO: 382925 - DNA, 25 bp, Mus musculus
tggtactggagcagagggtccccag

SEQ ID NO: 382926 - DNA, 25 bp, Mus musculus
tggtactgtaggtggatagtccaac

SEQ ID NO: 382927 - DNA, 25 bp, Mus musculus
tggtactgtccgcatgagacactgc

SEQ ID NO: 382928 - DNA, 25 bp, Mus musculus
tggtacttcggctgtcccagggctc

SEQ ID NO: 382929 - DNA, 25 bp, Mus musculus
tggtagaaagatctaaaggggtgat

SEQ ID NO: 382930 - DNA, 25 bp, Mus musculus
tggtagaaaggcctttgtagatttc

SEQ ID NO: 382931 - DNA, 25 bp, Mus musculus
tggtagaaccagacgatggaggctc

SEQ ID NO: 382932 - DNA, 25 bp, Mus musculus
tggtagaagcaacaggcatgacttg

SEQ ID NO: 382933 - DNA, 25 bp, Mus musculus
tggtagaccagtaacttccctctca

SEQ ID NO: 382934 - DNA, 25 bp, Mus musculus
tggtagacggggtattgaagggcgt

SEQ ID NO: 382935 - DNA, 25 bp, Mus musculus
tggtagactgataggactccagagg

SEQ ID NO: 382936 - DNA, 25 bp, Mus musculus
tggtagagaaagaaaccctggccct

SEQ ID NO: 382937 - DNA, 25 bp, Mus musculus
tggtagagaaggcagaagaatgcca

SEQ ID NO: 382938 - DNA, 25 bp, Mus musculus
tggtagagaagggaccacagtatgg

SEQ ID NO: 382939 - DNA, 25 bp, Mus musculus
tggtagagctgcgcttgtgcacttt

SEQ ID NO: 382940 - DNA, 25 bp, Mus musculus
tggtagagtgtgtgggaaagggccg

SEQ ID NO: 382941 - DNA, 25 bp, Mus musculus
tggtagattacgctcacaacaacta

SEQ ID NO: 382942 - DNA, 25 bp, Mus musculus
tggtagattgccagagctccacgca

SEQ ID NO: 382943 - DNA, 25 bp, Mus musculus
tggtagatttgttgaatgacaaaga

SEQ ID NO: 382944 - DNA, 25 bp, Mus musculus
tggtagcagatttcttagatttttg

SEQ ID NO: 382945 - DNA, 25 bp, Mus musculus
tggtagccaattctcccacacagat

SEQ ID NO: 382946 - DNA, 25 bp, Mus musculus
tggtagcccaggcaagcgcttccag

SEQ ID NO: 382947 - DNA, 25 bp, Mus musculus
tggtagcccaggccaccatggcaga

SEQ ID NO: 382948 - DNA, 25 bp, Mus musculus
tggtagccccagaacccatgtgagt

SEQ ID NO: 382949 - DNA, 25 bp, Mus musculus
tggtagccccagaggccttcggaca

SEQ ID NO: 382950 - DNA, 25 bp, Mus musculus
tggtagccccagataaggaatatct

SEQ ID NO: 382951 - DNA, 25 bp, Mus musculus
tggtagccggagcgatctttgggtt

SEQ ID NO: 382952 - DNA, 25 bp, Mus musculus
tggtagcctcggattccagaggggt

SEQ ID NO: 382953 - DNA, 25 bp, Mus musculus
tggtagcgaaagaaggtaaaattta

SEQ ID NO: 382954 - DNA, 25 bp, Mus musculus
tggtagcgtacattgcaaacattaa

SEQ ID NO: 382955 - DNA, 25 bp, Mus musculus
tggtaggaaagagaaaatccctgag

SEQ ID NO: 382956 - DNA, 25 bp, Mus musculus
tggtaggaaaggtccagcaagacta

SEQ ID NO: 382957 - DNA, 25 bp, Mus musculus
tggtaggcaggttgttcgtagtctt

SEQ ID NO: 382958 - DNA, 25 bp, Mus musculus
tggtaggtgcgccaaacagtggggc

SEQ ID NO: 382959 - DNA, 25 bp, Mus musculus
tggtagtaaaatggaaggtgtcttg

SEQ ID NO: 382960 - DNA, 25 bp, Mus musculus
tggtagtagatgtcccatattatga

SEQ ID NO: 382961 - DNA, 25 bp, Mus musculus
tggtagtgattgtaagaatgaagat

SEQ ID NO: 382962 - DNA, 25 bp, Mus musculus
tggtagtgattgtaatctacttttt

SEQ ID NO: 382963 - DNA, 25 bp, Mus musculus
tggtagtgtactgtgaccgtgatac

SEQ ID NO: 382964 - DNA, 25 bp, Mus musculus
tggtagttacagccaacggtaacga

SEQ ID NO: 382965 - DNA, 25 bp, Mus musculus
tggtagttacaggtcataaaaggat

SEQ ID NO: 382966 - DNA, 25 bp, Mus musculus
tggtataaagagggtgtattacctc

SEQ ID NO: 382967 - DNA, 25 bp, Mus musculus
tggtatacagatcagagaaaatatg

SEQ ID NO: 382968 - DNA, 25 bp, Mus musculus
tggtatacaggaggataccagatgt

SEQ ID NO: 382969 - DNA, 25 bp, Mus musculus
tggtatacaggagtacttatgtggt

SEQ ID NO: 382970 - DNA, 25 bp, Mus musculus
tggtatatcgaactcgcacttgcat

SEQ ID NO: 382971 - DNA, 25 bp, Mus musculus
tggtatatcgttgtgcagactacac

SEQ ID NO: 382972 - DNA, 25 bp, Mus musculus
tggtatcaactgtgtaaggagaagc

SEQ ID NO: 382973 - DNA, 25 bp, Mus musculus
tggtatcagaagaagattggagcat

SEQ ID NO: 382974 - DNA, 25 bp, Mus musculus
tggtatcagaagaagattggagcct

SEQ ID NO: 382975 - DNA, 25 bp, Mus musculus
tggtatcagaagaagggtttcaaaa

SEQ ID NO: 382976 - DNA, 25 bp, Mus musculus
tggtatcagaagaaggtcaaagaag

SEQ ID NO: 382977 - DNA, 25 bp, Mus musculus
tggtatcatgatgacacttgttgat

SEQ ID NO: 382978 - DNA, 25 bp, Mus musculus
tggtatcatgggtataggtccagtc

SEQ ID NO: 382979 - DNA, 25 bp, Mus musculus
tggtatcatggtggatacagtgccc

SEQ ID NO: 382980 - DNA, 25 bp, Mus musculus
tggtatccacatgggtctcctggaa

SEQ ID NO: 382981 - DNA, 25 bp, Mus musculus
tggtatccacgcctgaggtcctggt

SEQ ID NO: 382982 - DNA, 25 bp, Mus musculus
tggtatccttggggcactgcgtgac

SEQ ID NO: 382983 - DNA, 25 bp, Mus musculus
tggtatctgaagacgctcatgatcc

SEQ ID NO: 382984 - DNA, 25 bp, Mus musculus
tggtatctggttggcagatattccg

SEQ ID NO: 382985 - DNA, 25 bp, Mus musculus
tggtatcttcgaaccaagtatcagg

SEQ ID NO: 382986 - DNA, 25 bp, Mus musculus
tggtatgagagggagcttcgttacg

SEQ ID NO: 382987 - DNA, 25 bp, Mus musculus
tggtatgagagggaggtctgggaca

SEQ ID NO: 382988 - DNA, 25 bp, Mus musculus
tggtatgcagaggttaaggagctcc

SEQ ID NO: 382989 - DNA, 25 bp, Mus musculus
tggtatgcatgcggtctcccactgc

SEQ ID NO: 382990 - DNA, 25 bp, Mus musculus
tggtatgcatgcggtgtgagcatct

SEQ ID NO: 382991 - DNA, 25 bp, Mus musculus
tggtatgccaaacagcagttattca

SEQ ID NO: 382992 - DNA, 25 bp, Mus musculus
tggtatgttccaggattgaaccagc

SEQ ID NO: 382993 - DNA, 25 bp, Mus musculus
tggtatgttgccagatggatttgtt

SEQ ID NO: 382994 - DNA, 25 bp, Mus musculus
tggtattactgactgcagcaccaca

SEQ ID NO: 382995 - DNA, 25 bp, Mus musculus
tggtattccaggaatcatggcccaa

SEQ ID NO: 382996 - DNA, 25 bp, Mus musculus
tggtattcctcagacagtaaagact

SEQ ID NO: 382997 - DNA, 25 bp, Mus musculus
tggtattggcgtgagcggaggctgc

SEQ ID NO: 382998 - DNA, 25 bp, Mus musculus
tggtatttgagaggtagtgatttaa

SEQ ID NO: 382999 - DNA, 25 bp, Mus musculus
tggtattttgaagtccctggatgag

SEQ ID NO: 383000 - DNA, 25 bp, Mus musculus
tggtatttttaggctgttcatttag

SEQ ID NO: 383001 - DNA, 25 bp, Mus musculus
tggtcaacacaggtcttctgacgct

SEQ ID NO: 383002 - DNA, 25 bp, Mus musculus
tggtcaactgtgcaggctatgtggt

SEQ ID NO: 383003 - DNA, 25 bp, Mus musculus
tggtcaactgtgcaggtgacagtaa

SEQ ID NO: 383004 - DNA, 25 bp, Mus musculus
tggtcaagaacagcatgggtacaca

SEQ ID NO: 383005 - DNA, 25 bp, Mus musculus
tggtcaagaggaaattgatgaggcc

SEQ ID NO: 383006 - DNA, 25 bp, Mus musculus
tggtcaaggcggagccagatgttaa

SEQ ID NO: 383007 - DNA, 25 bp, Mus musculus
tggtcaatagggtacacctggtgag

SEQ ID NO: 383008 - DNA, 25 bp, Mus musculus
tggtcacaaggctccgacatgaagc

SEQ ID NO: 383009 - DNA, 25 bp, Mus musculus
tggtcacaagtgcgaatctgtccaa

SEQ ID NO: 383010 - DNA, 25 bp, Mus musculus
tggtcacacaaagaaacaggtatgt

SEQ ID NO: 383011 - DNA, 25 bp, Mus musculus
tggtcacacaaaggtatgtgatgat

SEQ ID NO: 383012 - DNA, 25 bp, Mus musculus
tggtcacacagggctcgcttgcctg

SEQ ID NO: 383013 - DNA, 25 bp, Mus musculus
tggtcacactcacgataaaagctgg

SEQ ID NO: 383014 - DNA, 25 bp, Mus musculus
tggtcacaggtgcccagcagaggag

SEQ ID NO: 383015 - DNA, 25 bp, Mus musculus
tggtcacatggtgacctggcctcag

SEQ ID NO: 383016 - DNA, 25 bp, Mus musculus
tggtcaccaacagtcagcgtgggag

SEQ ID NO: 383017 - DNA, 25 bp, Mus musculus
tggtcacccctggccctgaaggcag

SEQ ID NO: 383018 - DNA, 25 bp, Mus musculus
tggtcacctgagcaagttgttgggc

SEQ ID NO: 383019 - DNA, 25 bp, Mus musculus
tggtcacgagctcttctgatctcca

SEQ ID NO: 383020 - DNA, 25 bp, Mus musculus
tggtcacgaggtaaccatcttggag

SEQ ID NO: 383021 - DNA, 25 bp, Mus musculus
tggtcactcgtgcagcgactgcagg

SEQ ID NO: 383022 - DNA, 25 bp, Mus musculus
tggtcactcgtgcagctcagagagc

SEQ ID NO: 383023 - DNA, 25 bp, Mus musculus
tggtcactcgtgcagtgccaccgtg

SEQ ID NO: 383024 - DNA, 25 bp, Mus musculus
tggtcactctaaccggtcatttggc

SEQ ID NO: 383025 - DNA, 25 bp, Mus musculus
tggtcactgaacaggttgctccagg

SEQ ID NO: 383026 - DNA, 25 bp, Mus musculus
tggtcactgtgcagctcattctctt

SEQ ID NO: 383027 - DNA, 25 bp, Mus musculus
tggtcactgtgcagttccgctcgct

SEQ ID NO: 383028 - DNA, 25 bp, Mus musculus
tggtcacttgctgagatatggggag

SEQ ID NO: 383029 - DNA, 25 bp, Mus musculus
tggtcagaagagggggacctacaca

SEQ ID NO: 383030 - DNA, 25 bp, Mus musculus
tggtcagagaggtgctggtaactca

SEQ ID NO: 383031 - DNA, 25 bp, Mus musculus
tggtcagagcagcagattttccacc

SEQ ID NO: 383032 - DNA, 25 bp, Mus musculus
tggtcagagcctcagaattgctcag

SEQ ID NO: 383033 - DNA, 25 bp, Mus musculus
tggtcagagcctcagggggcctgtg

SEQ ID NO: 383034 - DNA, 25 bp, Mus musculus
tggtcagatgagggtacgggcgctt

SEQ ID NO: 383035 - DNA, 25 bp, Mus musculus
tggtcagcaatggggctggagagat

SEQ ID NO: 383036 - DNA, 25 bp, Mus musculus
tggtcagcaatgggttcagacctcg

SEQ ID NO: 383037 - DNA, 25 bp, Mus musculus
tggtcagcatgattcgattcttgaa

SEQ ID NO: 383038 - DNA, 25 bp, Mus musculus
tggtcagccaaatggtgttgtgtga

SEQ ID NO: 383039 - DNA, 25 bp, Mus musculus
tggtcagccaaatgtctttctgtaa

SEQ ID NO: 383040 - DNA, 25 bp, Mus musculus
tggtcagccaaattgaggatgccat

SEQ ID NO: 383041 - DNA, 25 bp, Mus musculus
tggtcagcgtctgggaaagaagagg

SEQ ID NO: 383042 - DNA, 25 bp, Mus musculus
tggtcagctttgaacgctgtgtgag

SEQ ID NO: 383043 - DNA, 25 bp, Mus musculus
tggtcaggaaaattggaacaatcca

SEQ ID NO: 383044 - DNA, 25 bp, Mus musculus
tggtcaggaaatgagtccacagatg

SEQ ID NO: 383045 - DNA, 25 bp, Mus musculus
tggtcagggcagggataatcttaag

SEQ ID NO: 383046 - DNA, 25 bp, Mus musculus
tggtcagggtgcacaggaaatactg

SEQ ID NO: 383047 - DNA, 25 bp, Mus musculus
tggtcaggtgagcagattgatgatg

SEQ ID NO: 383048 - DNA, 25 bp, Mus musculus
tggtcaggtgtgacagacatcacat

SEQ ID NO: 383049 - DNA, 25 bp, Mus musculus
tggtcagtctctgcaggttcagggg

SEQ ID NO: 383050 - DNA, 25 bp, Mus musculus
tggtcagtgtctccctccaagccac

SEQ ID NO: 383051 - DNA, 25 bp, Mus musculus
tggtcagtgttggtttcaacctctt

SEQ ID NO: 383052 - DNA, 25 bp, Mus musculus
tggtcataaaggttccagatgatga

SEQ ID NO: 383053 - DNA, 25 bp, Mus musculus
tggtcatcaacaggctctccttttt

SEQ ID NO: 383054 - DNA, 25 bp, Mus musculus
tggtcatcagagctgtactggcgat

SEQ ID NO: 383055 - DNA, 25 bp, Mus musculus
tggtcatcagtgtcctcctatcggt

SEQ ID NO: 383056 - DNA, 25 bp, Mus musculus
tggtcatcccagcagaagttttcaa

SEQ ID NO: 383057 - DNA, 25 bp, Mus musculus
tggtcatcccccacgctgacagccc

SEQ ID NO: 383058 - DNA, 25 bp, Mus musculus
tggtcatcgacaatgagcaccgggg

SEQ ID NO: 383059 - DNA, 25 bp, Mus musculus
tggtcatcgacaatggttcaggggt

SEQ ID NO: 383060 - DNA, 25 bp, Mus musculus
tggtcatcgaggtcttccagaaacg

SEQ ID NO: 383061 - DNA, 25 bp, Mus musculus
tggtcatgaagaagcagaattctaa

SEQ ID NO: 383062 - DNA, 25 bp, Mus musculus
tggtcatgaagacatgtttaaaaag

SEQ ID NO: 383063 - DNA, 25 bp, Mus musculus
tggtcatgaaggcatttgagcactt

SEQ ID NO: 383064 - DNA, 25 bp, Mus musculus
tggtcatgagaggagaaagagtcct

SEQ ID NO: 383065 - DNA, 25 bp, Mus musculus
tggtcatgagaggagggcaggtttt

SEQ ID NO: 383066 - DNA, 25 bp, Mus musculus
tggtcatggtgtgaggggtcccaca

SEQ ID NO: 383067 - DNA, 25 bp, Mus musculus
tggtcattaagggaaagatggagct

SEQ ID NO: 383068 - DNA, 25 bp, Mus musculus
tggtcattgtgcttcatgttcaaat

SEQ ID NO: 383069 - DNA, 25 bp, Mus musculus
tggtcattgtgcttcgtgcctttat

SEQ ID NO: 383070 - DNA, 25 bp, Mus musculus
tggtcattgtgcttgatgttcaaat

SEQ ID NO: 383071 - DNA, 25 bp, Mus musculus
tggtcattgtgcttggtgcctttat

SEQ ID NO: 383072 - DNA, 25 bp, Mus musculus
tggtccaaacagactgaaagtgtcc

SEQ ID NO: 383073 - DNA, 25 bp, Mus musculus
tggtccaaagggcaacccaggtcca

SEQ ID NO: 383074 - DNA, 25 bp, Mus musculus
tggtccaatttgtctagtgctggct

SEQ ID NO: 383075 - DNA, 25 bp, Mus musculus
tggtccacaagggggggctgttcaa

SEQ ID NO: 383076 - DNA, 25 bp, Mus musculus
tggtccacagagatccactgaggct

SEQ ID NO: 383077 - DNA, 25 bp, Mus musculus
tggtccacataaaaggaaattgtgg

SEQ ID NO: 383078 - DNA, 25 bp, Mus musculus
tggtccaccgtgtcagactcagtca

SEQ ID NO: 383079 - DNA, 25 bp, Mus musculus
tggtccacggtgggggacccctgtg

SEQ ID NO: 383080 - DNA, 25 bp, Mus musculus
tggtccacggtgggggattgctgct

SEQ ID NO: 383081 - DNA, 25 bp, Mus musculus
tggtccagaacagcctgcacttcgc

SEQ ID NO: 383082 - DNA, 25 bp, Mus musculus
tggtccagaacagctggaggtggct

SEQ ID NO: 383083 - DNA, 25 bp, Mus musculus
tggtccagaaccctctgattgccct

SEQ ID NO: 383084 - DNA, 25 bp, Mus musculus
tggtccagcagatgcgtcgagccct

SEQ ID NO: 383085 - DNA, 25 bp, Mus musculus
tggtccagtggaacagattgttgtg

SEQ ID NO: 383086 - DNA, 25 bp, Mus musculus
tggtccagtggaacgtgggatctca

SEQ ID NO: 383087 - DNA, 25 bp, Mus musculus
tggtccagtttcccttgtgggtatg

SEQ ID NO: 383088 - DNA, 25 bp, Mus musculus
tggtccataaacatggacttgaatt

SEQ ID NO: 383089 - DNA, 25 bp, Mus musculus
tggtccatggacaagatgcaatcac

SEQ ID NO: 383090 - DNA, 25 bp, Mus musculus
tggtccatggggtgcgccccgggat

SEQ ID NO: 383091 - DNA, 25 bp, Mus musculus
tggtcccaaaggtgcagctggccca

SEQ ID NO: 383092 - DNA, 25 bp, Mus musculus
tggtcccacccagacaggcttcagg

SEQ ID NO: 383093 - DNA, 25 bp, Mus musculus
tggtcccagcgcaagagcctgttat

SEQ ID NO: 383094 - DNA, 25 bp, Mus musculus
tggtcccagcgcaggagcctgttat

SEQ ID NO: 383095 - DNA, 25 bp, Mus musculus
tggtcccagctcaggaggaaaactc

SEQ ID NO: 383096 - DNA, 25 bp, Mus musculus
tggtccccaggcctggctgctgcca

SEQ ID NO: 383097 - DNA, 25 bp, Mus musculus
tggtcccccaataccgtgactgtcc

SEQ ID NO: 383098 - DNA, 25 bp, Mus musculus
tggtccccctggtgctactggcttc

SEQ ID NO: 383099 - DNA, 25 bp, Mus musculus
tggtcccctggagcaccaaggaaat

SEQ ID NO: 383100 - DNA, 25 bp, Mus musculus
tggtcccgggtgaacagagtatctg

SEQ ID NO: 383101 - DNA, 25 bp, Mus musculus
tggtccctacacgaatgaagtgtat

SEQ ID NO: 383102 - DNA, 25 bp, Mus musculus
tggtccctacagtcaagctgtgcaa

SEQ ID NO: 383103 - DNA, 25 bp, Mus musculus
tggtccctcctaagactgtatcact

SEQ ID NO: 383104 - DNA, 25 bp, Mus musculus
tggtccctctggtcttgatggtcct

SEQ ID NO: 383105 - DNA, 25 bp, Mus musculus
tggtccctgagttcgtcaatgcatc

SEQ ID NO: 383106 - DNA, 25 bp, Mus musculus
tggtccctgttctccaccctcccct

SEQ ID NO: 383107 - DNA, 25 bp, Mus musculus
tggtccctgttgacaatatctttaa

SEQ ID NO: 383108 - DNA, 25 bp, Mus musculus
tggtccctgttgacgaacctaaaac

SEQ ID NO: 383109 - DNA, 25 bp, Mus musculus
tggtccgagtcgctgatgagcggga

SEQ ID NO: 383110 - DNA, 25 bp, Mus musculus
tggtccgcgtcggtgctggcctgca

SEQ ID NO: 383111 - DNA, 25 bp, Mus musculus
tggtccgcttaaaggactggacaga

SEQ ID NO: 383112 - DNA, 25 bp, Mus musculus
tggtccggagccaggacaaagccaa

SEQ ID NO: 383113 - DNA, 25 bp, Mus musculus
tggtccggagccagggctcagattc

SEQ ID NO: 383114 - DNA, 25 bp, Mus musculus
tggtccggcggctggtcacctttgt

SEQ ID NO: 383115 - DNA, 25 bp, Mus musculus
tggtccgggagacaggcctctcttt

SEQ ID NO: 383116 - DNA, 25 bp, Mus musculus
tggtccgtcaagcccttgaccacat

SEQ ID NO: 383117 - DNA, 25 bp, Mus musculus
tggtcctaaaaaagagaacgcacca

SEQ ID NO: 383118 - DNA, 25 bp, Mus musculus
tggtcctaaggccctttttgctttc

SEQ ID NO: 383119 - DNA, 25 bp, Mus musculus
tggtcctacgatcccaggctccggc

SEQ ID NO: 383120 - DNA, 25 bp, Mus musculus
tggtcctacggctgtgtggtgaaga

SEQ ID NO: 383121 - DNA, 25 bp, Mus musculus
tggtcctagggttctccacatacga

SEQ ID NO: 383122 - DNA, 25 bp, Mus musculus
tggtcctcactgtgatgatccggga

SEQ ID NO: 383123 - DNA, 25 bp, Mus musculus
tggtcctcaggcattaacaagtgcc

SEQ ID NO: 383124 - DNA, 25 bp, Mus musculus
tggtcctgaagacagcccaggaccc

SEQ ID NO: 383125 - DNA, 25 bp, Mus musculus
tggtcctgagaaaggtataaatggg

SEQ ID NO: 383126 - DNA, 25 bp, Mus musculus
tggtcctgagctgtttggggcaact

SEQ ID NO: 383127 - DNA, 25 bp, Mus musculus
tggtcctgcctctgggcggaaaaac

SEQ ID NO: 383128 - DNA, 25 bp, Mus musculus
tggtcctgcctctgggttaacaatc

SEQ ID NO: 383129 - DNA, 25 bp, Mus musculus
tggtcctggcctggtgtgcatcggc

SEQ ID NO: 383130 - DNA, 25 bp, Mus musculus
tggtcctggggccatcagctccaga

SEQ ID NO: 383131 - DNA, 25 bp, Mus musculus
tggtcctgggggaatggataagtat

SEQ ID NO: 383132 - DNA, 25 bp, Mus musculus
tggtcctggggtacaatggtgcttt

SEQ ID NO: 383133 - DNA, 25 bp, Mus musculus
tggtcctgtcagcttcagccacctt

SEQ ID NO: 383134 - DNA, 25 bp, Mus musculus
tggtcctgtcagtggatgtgtcctc

SEQ ID NO: 383135 - DNA, 25 bp, Mus musculus
tggtcctgtgggtctccctggtcct

SEQ ID NO: 383136 - DNA, 25 bp, Mus musculus
tggtcctgtgggtgaaccaggtctc

SEQ ID NO: 383137 - DNA, 25 bp, Mus musculus
tggtcctgtgggtgagcaaggcctc

SEQ ID NO: 383138 - DNA, 25 bp, Mus musculus
tggtccttctagcaggcctgcctac

SEQ ID NO: 383139 - DNA, 25 bp, Mus musculus
tggtccttctggagcccctggtgaa

SEQ ID NO: 383140 - DNA, 25 bp, Mus musculus
tggtccttgaaccgggcaccatcca

SEQ ID NO: 383141 - DNA, 25 bp, Mus musculus
tggtcgaagctgggttgaaaactag

SEQ ID NO: 383142 - DNA, 25 bp, Mus musculus
tggtcgaattcgccgcatgtctcgc

SEQ ID NO: 383143 - DNA, 25 bp, Mus musculus
tggtcgcagaagtacagcacgtggg

SEQ ID NO: 383144 - DNA, 25 bp, Mus musculus
tggtcgcagacgaagaaatggaagc

SEQ ID NO: 383145 - DNA, 25 bp, Mus musculus
tggtcgccatcccagggaacaggaa

SEQ ID NO: 383146 - DNA, 25 bp, Mus musculus
tggtcggaggagtggtgtggaaggc

SEQ ID NO: 383147 - DNA, 25 bp, Mus musculus
tggtcgggagtcagaaagagcccag

SEQ ID NO: 383148 - DNA, 25 bp, Mus musculus
tggtcgtcgtcatgatggagaggag

SEQ ID NO: 383149 - DNA, 25 bp, Mus musculus
tggtcgttcagccaggttgcattga

SEQ ID NO: 383150 - DNA, 25 bp, Mus musculus
tggtctaaagaatcagaagtactcc

SEQ ID NO: 383151 - DNA, 25 bp, Mus musculus
tggtctacaaagaaatgttctgcga

SEQ ID NO: 383152 - DNA, 25 bp, Mus musculus
tggtctacaaagtggatcccactgc

SEQ ID NO: 383153 - DNA, 25 bp, Mus musculus
tggtctacaagacagtagccaacct

SEQ ID NO: 383154 - DNA, 25 bp, Mus musculus
tggtctacaagatcacagagcagca

SEQ ID NO: 383155 - DNA, 25 bp, Mus musculus
tggtctacagaatagacatgctaac

SEQ ID NO: 383156 - DNA, 25 bp, Mus musculus
tggtctacagagctctcagacactg

SEQ ID NO: 383157 - DNA, 25 bp, Mus musculus
tggtctacagatacaaatatagaga

SEQ ID NO: 383158 - DNA, 25 bp, Mus musculus
tggtctacatagggctccaacacca

SEQ ID NO: 383159 - DNA, 25 bp, Mus musculus
tggtctacatagtgtgagtcattct

SEQ ID NO: 383160 - DNA, 25 bp, Mus musculus
tggtctagcaagccgggtatcccag

SEQ ID NO: 383161 - DNA, 25 bp, Mus musculus
tggtctagcaagggcaatgacatca

SEQ ID NO: 383162 - DNA, 25 bp, Mus musculus
tggtctatcctggccgcctgggaac

SEQ ID NO: 383163 - DNA, 25 bp, Mus musculus
tggtctatcctggggacctaaaaca

SEQ ID NO: 383164 - DNA, 25 bp, Mus musculus
tggtctatcctggtgatccactgcg

SEQ ID NO: 383165 - DNA, 25 bp, Mus musculus
tggtctattcagatacagccctgca

SEQ ID NO: 383166 - DNA, 25 bp, Mus musculus
tggtctattcagctacagtgatcct

SEQ ID NO: 383167 - DNA, 25 bp, Mus musculus
tggtctcacgcggtcggatatgaag

SEQ ID NO: 383168 - DNA, 25 bp, Mus musculus
tggtctcactgggcatacttctccg

SEQ ID NO: 383169 - DNA, 25 bp, Mus musculus
tggtctcagaagtgccttcaagaca

SEQ ID NO: 383170 - DNA, 25 bp, Mus musculus
tggtctccctagtagatccactgtg

SEQ ID NO: 383171 - DNA, 25 bp, Mus musculus
tggtctccctggggcatcagccgtc

SEQ ID NO: 383172 - DNA, 25 bp, Mus musculus
tggtctccgaggagtatgtctccaa

SEQ ID NO: 383173 - DNA, 25 bp, Mus musculus
tggtctcctccggcttgttggaggt

SEQ ID NO: 383174 - DNA, 25 bp, Mus musculus
tggtctcgctctggcttcccatttc

SEQ ID NO: 383175 - DNA, 25 bp, Mus musculus
tggtctctgcgcggttgactcttca

SEQ ID NO: 383176 - DNA, 25 bp, Mus musculus
tggtctctgtggagaactactgcat

SEQ ID NO: 383177 - DNA, 25 bp, Mus musculus
tggtctctgtgggagcttgcatttc

SEQ ID NO: 383178 - DNA, 25 bp, Mus musculus
tggtctctgtgggtggtaaatctgt

SEQ ID NO: 383179 - DNA, 25 bp, Mus musculus
tggtctcttcccatacatggcctgc

SEQ ID NO: 383180 - DNA, 25 bp, Mus musculus
tggtctcttccttacacatgatgaa

SEQ ID NO: 383181 - DNA, 25 bp, Mus musculus
tggtctgaagctcagaactttgcca

SEQ ID NO: 383182 - DNA, 25 bp, Mus musculus
tggtctgaaggacagggtttctctg

SEQ ID NO: 383183 - DNA, 25 bp, Mus musculus
tggtctgagaggtcttcctggaaaa

SEQ ID NO: 383184 - DNA, 25 bp, Mus musculus
tggtctgagcaggactcggaaccca

SEQ ID NO: 383185 - DNA, 25 bp, Mus musculus
tggtctgagtgaagattatttgtct

SEQ ID NO: 383186 - DNA, 25 bp, Mus musculus
tggtctgcaaaggagaatcacactg

SEQ ID NO: 383187 - DNA, 25 bp, Mus musculus
tggtctgcggaaagtacacaaacaa

SEQ ID NO: 383188 - DNA, 25 bp, Mus musculus
tggtctgctggacgcctttagaaca

SEQ ID NO: 383189 - DNA, 25 bp, Mus musculus
tggtctgctgggaagcggaacagga

SEQ ID NO: 383190 - DNA, 25 bp, Mus musculus
tggtctggagcaagcccacaccgcc

SEQ ID NO: 383191 - DNA, 25 bp, Mus musculus
tggtctgggttaaatggtttgtctt

SEQ ID NO: 383192 - DNA, 25 bp, Mus musculus
tggtctgtggaatgtgacaaacgga

SEQ ID NO: 383193 - DNA, 25 bp, Mus musculus
tggtcttcacaggcgtggagaccat

SEQ ID NO: 383194 - DNA, 25 bp, Mus musculus
tggtcttcacagggacctgtgggat

SEQ ID NO: 383195 - DNA, 25 bp, Mus musculus
tggtcttcacctgcctctgcctcct

SEQ ID NO: 383196 - DNA, 25 bp, Mus musculus
tggtcttcagagtggaattgggctt

SEQ ID NO: 383197 - DNA, 25 bp, Mus musculus
tggtcttccagatgagaaaatgatg

SEQ ID NO: 383198 - DNA, 25 bp, Mus musculus
tggtcttccagatggggacttcaga

SEQ ID NO: 383199 - DNA, 25 bp, Mus musculus
tggtcttccaggggaatgcaggcaa

SEQ ID NO: 383200 - DNA, 25 bp, Mus musculus
tggtcttcctgacagggagccaggc

SEQ ID NO: 383201 - DNA, 25 bp, Mus musculus
tggtcttctatgcccaatatctctg

SEQ ID NO: 383202 - DNA, 25 bp, Mus musculus
tggtcttctatggccaatatctctg

SEQ ID NO: 383203 - DNA, 25 bp, Mus musculus
tggtcttgctgaggaacatggttgg

SEQ ID NO: 383204 - DNA, 25 bp, Mus musculus
tggtctttggagatatggaaggcca

SEQ ID NO: 383205 - DNA, 25 bp, Mus musculus
tggtgaaagaaaaagtggcccatcc

SEQ ID NO: 383206 - DNA, 25 bp, Mus musculus
tggtgaaatgaggaagaaaagcgag

SEQ ID NO: 383207 - DNA, 25 bp, Mus musculus
tggtgaaatttatgattccatatta

SEQ ID NO: 383208 - DNA, 25 bp, Mus musculus
tggtgaacaaaacagattgcctgca

SEQ ID NO: 383209 - DNA, 25 bp, Mus musculus
tggtgaacccattggtcagtgacat

SEQ ID NO: 383210 - DNA, 25 bp, Mus musculus
tggtgaaccgggtgaccctggtgaa

SEQ ID NO: 383211 - DNA, 25 bp, Mus musculus
tggtgaactggctgacagttgatga

SEQ ID NO: 383212 - DNA, 25 bp, Mus musculus
tggtgaactggctgactgccttgtg

SEQ ID NO: 383213 - DNA, 25 bp, Mus musculus
tggtgaactggctgactgctgatct

SEQ ID NO: 383214 - DNA, 25 bp, Mus musculus
tggtgaactggctgagacttgctaa

SEQ ID NO: 383215 - DNA, 25 bp, Mus musculus
tggtgaagaaggttcattatgatgg

SEQ ID NO: 383216 - DNA, 25 bp, Mus musculus
tggtgaagagcaggtatctcagacg

SEQ ID NO: 383217 - DNA, 25 bp, Mus musculus
tggtgaagagctcgtatatccagag

SEQ ID NO: 383218 - DNA, 25 bp, Mus musculus
tggtgaagagctggtatatccagag

SEQ ID NO: 383219 - DNA, 25 bp, Mus musculus
tggtgaagcacctcctggacctcct

SEQ ID NO: 383220 - DNA, 25 bp, Mus musculus
tggtgaaggaaaagtatgatacaga

SEQ ID NO: 383221 - DNA, 25 bp, Mus musculus
tggtgaaggaagatgaggctcgcat

SEQ ID NO: 383222 - DNA, 25 bp, Mus musculus
tggtgaaggacctcagtgcagaaga

SEQ ID NO: 383223 - DNA, 25 bp, Mus musculus
tggtgaaggcatgggtcttcggatc

SEQ ID NO: 383224 - DNA, 25 bp, Mus musculus
tggtgaagtaggaaacacactggag

SEQ ID NO: 383225 - DNA, 25 bp, Mus musculus
tggtgaatagcaaaggatgcagtca

SEQ ID NO: 383226 - DNA, 25 bp, Mus musculus
tggtgaatgcacagacgtggacgaa

SEQ ID NO: 383227 - DNA, 25 bp, Mus musculus
tggtgaatgctctggtgtccgccga

SEQ ID NO: 383228 - DNA, 25 bp, Mus musculus
tggtgaatgtcacagatgccatctc

SEQ ID NO: 383229 - DNA, 25 bp, Mus musculus
tggtgaattgggatgatgaggaatc

SEQ ID NO: 383230 - DNA, 25 bp, Mus musculus
tggtgacaagaagactagcagtgag

SEQ ID NO: 383231 - DNA, 25 bp, Mus musculus
tggtgacaagggagaccagggcctt

SEQ ID NO: 383232 - DNA, 25 bp, Mus musculus
tggtgacaagggcaacagcaggttc

SEQ ID NO: 383233 - DNA, 25 bp, Mus musculus
tggtgacaaggtgaattcccttggg

SEQ ID NO: 383234 - DNA, 25 bp, Mus musculus
tggtgacaatatctggcaaaaagga

SEQ ID NO: 383235 - DNA, 25 bp, Mus musculus
tggtgacacaagggacccgggaggc

SEQ ID NO: 383236 - DNA, 25 bp, Mus musculus
tggtgacacaaggtgtggcctttgc

SEQ ID NO: 383237 - DNA, 25 bp, Mus musculus
tggtgacacagaagatctggaactt

SEQ ID NO: 383238 - DNA, 25 bp, Mus musculus
tggtgacacagaaggaaggaattca

SEQ ID NO: 383239 - DNA, 25 bp, Mus musculus
tggtgacacctgtgtacaggaaaac

SEQ ID NO: 383240 - DNA, 25 bp, Mus musculus
tggtgacagacagtcttcacacatc

SEQ ID NO: 383241 - DNA, 25 bp, Mus musculus
tggtgacaggatggctgggcacaga

SEQ ID NO: 383242 - DNA, 25 bp, Mus musculus
tggtgacaggatgttggtgttggta

SEQ ID NO: 383243 - DNA, 25 bp, Mus musculus
tggtgacaggtattgagatgttcca

SEQ ID NO: 383244 - DNA, 25 bp, Mus musculus
tggtgaccaagactgcgcttcgcca

SEQ ID NO: 383245 - DNA, 25 bp, Mus musculus
tggtgacccgccaggacaatggatt

SEQ ID NO: 383246 - DNA, 25 bp, Mus musculus
tggtgacgacggtgaagctgggaag

SEQ ID NO: 383247 - DNA, 25 bp, Mus musculus
tggtgacggggatcgaaacatgatt

SEQ ID NO: 383248 - DNA, 25 bp, Mus musculus
tggtgactactggaataccagttgt

SEQ ID NO: 383249 - DNA, 25 bp, Mus musculus
tggtgactcacagctgaaggtggag

SEQ ID NO: 383250 - DNA, 25 bp, Mus musculus
tggtgactcacagggaacaacccct

SEQ ID NO: 383251 - DNA, 25 bp, Mus musculus
tggtgactctggggctgacaaaaag

SEQ ID NO: 383252 - DNA, 25 bp, Mus musculus
tggtgactgatggtggaatgtacgt

SEQ ID NO: 383253 - DNA, 25 bp, Mus musculus
tggtgactggatctgggagcatcaa

SEQ ID NO: 383254 - DNA, 25 bp, Mus musculus
tggtgagaacaagaaagcatctaaa

SEQ ID NO: 383255 - DNA, 25 bp, Mus musculus
tggtgagaagaacagcagtggtgaa

SEQ ID NO: 383256 - DNA, 25 bp, Mus musculus
tggtgagaagggagaggctggtcgc

SEQ ID NO: 383257 - DNA, 25 bp, Mus musculus
tggtgagacccaggttcaactggag

SEQ ID NO: 383258 - DNA, 25 bp, Mus musculus
tggtgagaggtaagcttgtctcctc

SEQ ID NO: 383259 - DNA, 25 bp, Mus musculus
tggtgagatggacaggcagcgggca

SEQ ID NO: 383260 - DNA, 25 bp, Mus musculus
tggtgagcaagttgagctctgagga

SEQ ID NO: 383261 - DNA, 25 bp, Mus musculus
tggtgagccatcttttctggggact

SEQ ID NO: 383262 - DNA, 25 bp, Mus musculus
tggtgagcctcccgagcaccatcaa

SEQ ID NO: 383263 - DNA, 25 bp, Mus musculus
tggtgaggctagaaagaaggatttc

SEQ ID NO: 383264 - DNA, 25 bp, Mus musculus
tggtgaggcttccagatggtcggca

SEQ ID NO: 383265 - DNA, 25 bp, Mus musculus
tggtgaggtacacaggcgcaggtct

SEQ ID NO: 383266 - DNA, 25 bp, Mus musculus
tggtgagtgaagagctctgcagttt

SEQ ID NO: 383267 - DNA, 25 bp, Mus musculus
tggtgagttcaggtactcagttcgt

SEQ ID NO: 383268 - DNA, 25 bp, Mus musculus
tggtgagttcaggtggttgtggagg

SEQ ID NO: 383269 - DNA, 25 bp, Mus musculus
tggtgataaaaaggtgtcactctgc

SEQ ID NO: 383270 - DNA, 25 bp, Mus musculus
tggtgataaaaagtctttttatgaa

SEQ ID NO: 383271 - DNA, 25 bp, Mus musculus
tggtgatatcccagattttagaaag

SEQ ID NO: 383272 - DNA, 25 bp, Mus musculus
tggtgatatcccaggtccaaatatc

SEQ ID NO: 383273 - DNA, 25 bp, Mus musculus
tggtgatcaaggtgttcctggagag

SEQ ID NO: 383274 - DNA, 25 bp, Mus musculus
tggtgatcaggatctgcacctggga

SEQ ID NO: 383275 - DNA, 25 bp, Mus musculus
tggtgatccctgcagacggctctgt

SEQ ID NO: 383276 - DNA, 25 bp, Mus musculus
tggtgatgaaagtggctcagctcaa

SEQ ID NO: 383277 - DNA, 25 bp, Mus musculus
tggtgatgagaggaagctttgtctc

SEQ ID NO: 383278 - DNA, 25 bp, Mus musculus
tggtgatggaaagctgagcccagga

SEQ ID NO: 383279 - DNA, 25 bp, Mus musculus
tggtgattaggacaaagccaaagtt

SEQ ID NO: 383280 - DNA, 25 bp, Mus musculus
tggtgattatagcaatcagcagagt

SEQ ID NO: 383281 - DNA, 25 bp, Mus musculus
tggtgcaaagttggtatatccaaag

SEQ ID NO: 383282 - DNA, 25 bp, Mus musculus
tggtgcaacgtttgtgcttgtcctt

SEQ ID NO: 383283 - DNA, 25 bp, Mus musculus
tggtgcaagagagtgtccaagcacg

SEQ ID NO: 383284 - DNA, 25 bp, Mus musculus
tggtgcacagaccaggtgattgtgc

SEQ ID NO: 383285 - DNA, 25 bp, Mus musculus
tggtgcacaggacacaaaaaagaag

SEQ ID NO: 383286 - DNA, 25 bp, Mus musculus
tggtgcacagtttccctcaggacac

SEQ ID NO: 383287 - DNA, 25 bp, Mus musculus
tggtgcacatgccaggggatgcccc

SEQ ID NO: 383288 - DNA, 25 bp, Mus musculus
tggtgcacctggtccacaaggtttc

SEQ ID NO: 383289 - DNA, 25 bp, Mus musculus
tggtgcacgcctctgcctcccgagt

SEQ ID NO: 383290 - DNA, 25 bp, Mus musculus
tggtgcactgcaaagctggaatgaa

SEQ ID NO: 383291 - DNA, 25 bp, Mus musculus
tggtgcagcgaggagggctaccagt

SEQ ID NO: 383292 - DNA, 25 bp, Mus musculus
tggtgcagcgatcaggtaatagtgc

SEQ ID NO: 383293 - DNA, 25 bp, Mus musculus
tggtgcagcgctccggtggaatgaa

SEQ ID NO: 383294 - DNA, 25 bp, Mus musculus
tggtgcagcggaagggcgtgtggaa

SEQ ID NO: 383295 - DNA, 25 bp, Mus musculus
tggtgcagggtgtggtgtgtcctct

SEQ ID NO: 383296 - DNA, 25 bp, Mus musculus
tggtgcagtacaaagagtacttttg

SEQ ID NO: 383297 - DNA, 25 bp, Mus musculus
tggtgcagtatgatctgaagagtgc

SEQ ID NO: 383298 - DNA, 25 bp, Mus musculus
tggtgcagtgctgttgaattttctc

SEQ ID NO: 383299 - DNA, 25 bp, Mus musculus
tggtgcagtggtggagcaaagccca

SEQ ID NO: 383300 - DNA, 25 bp, Mus musculus
tggtgcatgctagcttggccgacag

SEQ ID NO: 383301 - DNA, 25 bp, Mus musculus
tggtgccaagaagatgcacgacgag

SEQ ID NO: 383302 - DNA, 25 bp, Mus musculus
tggtgccaagggcgaagctggtccc

SEQ ID NO: 383303 - DNA, 25 bp, Mus musculus
tggtgccaatgccatgctggtgcca

SEQ ID NO: 383304 - DNA, 25 bp, Mus musculus
tggtgccaattgctggtgccagtgg

SEQ ID NO: 383305 - DNA, 25 bp, Mus musculus
tggtgccagaagctgaacttcactg

SEQ ID NO: 383306 - DNA, 25 bp, Mus musculus
tggtgccagcacccaagcaaacact

SEQ ID NO: 383307 - DNA, 25 bp, Mus musculus
tggtgccatctagtgctcttcctcc

SEQ ID NO: 383308 - DNA, 25 bp, Mus musculus
tggtgcccagagagaggcaggaagc

SEQ ID NO: 383309 - DNA, 25 bp, Mus musculus
tggtgcccagggtgctggtgttgaa

SEQ ID NO: 383310 - DNA, 25 bp, Mus musculus
tggtgccctcttctgcacatcgagt

SEQ ID NO: 383311 - DNA, 25 bp, Mus musculus
tggtgccggccgagattgctaagaa

SEQ ID NO: 383312 - DNA, 25 bp, Mus musculus
tggtgccgtgttctcgaaaaggtgc

SEQ ID NO: 383313 - DNA, 25 bp, Mus musculus
tggtgcctagatgctgaatgctccc

SEQ ID NO: 383314 - DNA, 25 bp, Mus musculus
tggtgcctgactttaagcaagaagt

SEQ ID NO: 383315 - DNA, 25 bp, Mus musculus
tggtgccttcagaattgttttactt

SEQ ID NO: 383316 - DNA, 25 bp, Mus musculus
tggtgcgaggaggtggagcctacta

SEQ ID NO: 383317 - DNA, 25 bp, Mus musculus
tggtgcggccagagagtcgatatgc

SEQ ID NO: 383318 - DNA, 25 bp, Mus musculus
tggtgcgggtagtttagtgaagctg

SEQ ID NO: 383319 - DNA, 25 bp, Mus musculus
tggtgctaagaggcttcctggatgt

SEQ ID NO: 383320 - DNA, 25 bp, Mus musculus
tggtgctaaggcaacatctgcaacc

SEQ ID NO: 383321 - DNA, 25 bp, Mus musculus
tggtgctaagggtgaagctggcccc

SEQ ID NO: 383322 - DNA, 25 bp, Mus musculus
tggtgctaaggtggtggagaaagca

SEQ ID NO: 383323 - DNA, 25 bp, Mus musculus
tggtgctaatacaacctgtgggtgg

SEQ ID NO: 383324 - DNA, 25 bp, Mus musculus
tggtgctaatcacagaactgttaca

SEQ ID NO: 383325 - DNA, 25 bp, Mus musculus
tggtgctaatgtctgtgcgtcctgg

SEQ ID NO: 383326 - DNA, 25 bp, Mus musculus
tggtgctagcaggttttatgaccca

SEQ ID NO: 383327 - DNA, 25 bp, Mus musculus
tggtgctatgaagctacctacagcc

SEQ ID NO: 383328 - DNA, 25 bp, Mus musculus
tggtgctatgaagctctggccatgg

SEQ ID NO: 383329 - DNA, 25 bp, Mus musculus
tggtgctcaggcaagatgggcatat

SEQ ID NO: 383330 - DNA, 25 bp, Mus musculus
tggtgctcaggcattgcagctcttt

SEQ ID NO: 383331 - DNA, 25 bp, Mus musculus
tggtgctcagggtacagcatgtttg

SEQ ID NO: 383332 - DNA, 25 bp, Mus musculus
tggtgctcagtggcagcatggagcc

SEQ ID NO: 383333 - DNA, 25 bp, Mus musculus
tggtgctccaaagagctttggcaat

SEQ ID NO: 383334 - DNA, 25 bp, Mus musculus
tggtgctcccaggagaatttcaccc

SEQ ID NO: 383335 - DNA, 25 bp, Mus musculus
tggtgctccgcagctggctcctcca

SEQ ID NO: 383336 - DNA, 25 bp, Mus musculus
tggtgctccgcaggtatctgaatcc

SEQ ID NO: 383337 - DNA, 25 bp, Mus musculus
tggtgctccgcaggttgaactggag

SEQ ID NO: 383338 - DNA, 25 bp, Mus musculus
tggtgctccggcattgcagctcttt

SEQ ID NO: 383339 - DNA, 25 bp, Mus musculus
tggtgctccgtggaccctaatgaca

SEQ ID NO: 383340 - DNA, 25 bp, Mus musculus
tggtgctcctgtgtagtgtgaaaca

SEQ ID NO: 383341 - DNA, 25 bp, Mus musculus
tggtgctcctgtgtatgctacagga

SEQ ID NO: 383342 - DNA, 25 bp, Mus musculus
tggtgctctgaagggggtacttcga

SEQ ID NO: 383343 - DNA, 25 bp, Mus musculus
tggtgctctgaaggtcagcaagtca

SEQ ID NO: 383344 - DNA, 25 bp, Mus musculus
tggtgctctggaccgggtagcaaat

SEQ ID NO: 383345 - DNA, 25 bp, Mus musculus
tggtgctctgggtttcctgtggcca

SEQ ID NO: 383346 - DNA, 25 bp, Mus musculus
tggtgctgatgcagactttgtggtg

SEQ ID NO: 383347 - DNA, 25 bp, Mus musculus
tggtgctgatgcagctcccccacca

SEQ ID NO: 383348 - DNA, 25 bp, Mus musculus
tggtgctgatgtcccgccgaacgca

SEQ ID NO: 383349 - DNA, 25 bp, Mus musculus
tggtgctgccccacacctctggcca

SEQ ID NO: 383350 - DNA, 25 bp, Mus musculus
tggtgctgcccccggccagccctga

SEQ ID NO: 383351 - DNA, 25 bp, Mus musculus
tggtgctgctgccagcaggacggcc

SEQ ID NO: 383352 - DNA, 25 bp, Mus musculus
tggtgctgctggtgctcggggtaac

SEQ ID NO: 383353 - DNA, 25 bp, Mus musculus
tggtgctggagagcaaaaaaacact

SEQ ID NO: 383354 - DNA, 25 bp, Mus musculus
tggtgctggaggtgtcctgtccatg

SEQ ID NO: 383355 - DNA, 25 bp, Mus musculus
tggtgctggagtggagaaagcatgc

SEQ ID NO: 383356 - DNA, 25 bp, Mus musculus
tggtgctggagttaaaggcagatgt

SEQ ID NO: 383357 - DNA, 25 bp, Mus musculus
tggtgctggggtcctttatggagag

SEQ ID NO: 383358 - DNA, 25 bp, Mus musculus
tggtgctgtggcagaattctctttt

SEQ ID NO: 383359 - DNA, 25 bp, Mus musculus
tggtgctgtggcagatttgcaaaca

SEQ ID NO: 383360 - DNA, 25 bp, Mus musculus
tggtgctgtgtggatctctcagaca

SEQ ID NO: 383361 - DNA, 25 bp, Mus musculus
tggtgcttacgaacacagatatgta

SEQ ID NO: 383362 - DNA, 25 bp, Mus musculus
tggtgcttcctcagtgtggcttgac

SEQ ID NO: 383363 - DNA, 25 bp, Mus musculus
tggtgcttcggtacctgggccagct

SEQ ID NO: 383364 - DNA, 25 bp, Mus musculus
tggtgcttggctatggcatcttcca

SEQ ID NO: 383365 - DNA, 25 bp, Mus musculus
tggtgcttgtgaatcagcaatgcag

SEQ ID NO: 383366 - DNA, 25 bp, Mus musculus
tggtggaaagataaggaattggaac

SEQ ID NO: 383367 - DNA, 25 bp, Mus musculus
tggtggaaatagacaacctgttggt

SEQ ID NO: 383368 - DNA, 25 bp, Mus musculus
tggtggaaatagctgcagtacctca

SEQ ID NO: 383369 - DNA, 25 bp, Mus musculus
tggtggaaatgaggcagctgcgata

SEQ ID NO: 383370 - DNA, 25 bp, Mus musculus
tggtggaactggaaggcacaatgga

SEQ ID NO: 383371 - DNA, 25 bp, Mus musculus
tggtggaagaggagacaagtttcct

SEQ ID NO: 383372 - DNA, 25 bp, Mus musculus
tggtggaagatgtgctcgtagctct

SEQ ID NO: 383373 - DNA, 25 bp, Mus musculus
tggtggaagccgaggaacgccgcca

SEQ ID NO: 383374 - DNA, 25 bp, Mus musculus
tggtggaagccgaggagctggagga

SEQ ID NO: 383375 - DNA, 25 bp, Mus musculus
tggtggaaggggagcaaactggact

SEQ ID NO: 383376 - DNA, 25 bp, Mus musculus
tggtggaagtgcaggagaaagacga

SEQ ID NO: 383377 - DNA, 25 bp, Mus musculus
tggtggaatcgcaggaaaccaacag

SEQ ID NO: 383378 - DNA, 25 bp, Mus musculus
tggtggaatcgcaggactgtgcctg

SEQ ID NO: 383379 - DNA, 25 bp, Mus musculus
tggtggaatgcatgcagatgtcaac

SEQ ID NO: 383380 - DNA, 25 bp, Mus musculus
tggtggaatttatgggatgaacaag

SEQ ID NO: 383381 - DNA, 25 bp, Mus musculus
tggtggacagggaatgtacggcatt

SEQ ID NO: 383382 - DNA, 25 bp, Mus musculus
tggtggacagtgcctatgaagtcat

SEQ ID NO: 383383 - DNA, 25 bp, Mus musculus
tggtggacatcgtggccagacttca

SEQ ID NO: 383384 - DNA, 25 bp, Mus musculus
tggtggacatcgtggctcctgcttc

SEQ ID NO: 383385 - DNA, 25 bp, Mus musculus
tggtggacctcaggcatcctgcatc

SEQ ID NO: 383386 - DNA, 25 bp, Mus musculus
tggtggacctcaggcatcctggatc

SEQ ID NO: 383387 - DNA, 25 bp, Mus musculus
tggtggacgacagctttagccaggc

SEQ ID NO: 383388 - DNA, 25 bp, Mus musculus
tggtggactccggaggaacctggct

SEQ ID NO: 383389 - DNA, 25 bp, Mus musculus
tggtggactgtcagactgctgggct

SEQ ID NO: 383390 - DNA, 25 bp, Mus musculus
tggtggactgtcaggattctctttc

SEQ ID NO: 383391 - DNA, 25 bp, Mus musculus
tggtggagaaggcttactgctccca

SEQ ID NO: 383392 - DNA, 25 bp, Mus musculus
tggtggagaaggtgtaaccagccat

SEQ ID NO: 383393 - DNA, 25 bp, Mus musculus
tggtggagacaacggaaagacgatg

SEQ ID NO: 383394 - DNA, 25 bp, Mus musculus
tggtggagacacagacgctgttccg

SEQ ID NO: 383395 - DNA, 25 bp, Mus musculus
tggtggagaccagcatgattgggct

SEQ ID NO: 383396 - DNA, 25 bp, Mus musculus
tggtggagagaggcaaactgctcca

SEQ ID NO: 383397 - DNA, 25 bp, Mus musculus
tggtggagagcgagctgcagcgact

SEQ ID NO: 383398 - DNA, 25 bp, Mus musculus
tggtggagatccagtgtcctgagca

SEQ ID NO: 383399 - DNA, 25 bp, Mus musculus
tggtggagatggacggaatgggcac

SEQ ID NO: 383400 - DNA, 25 bp, Mus musculus
tggtggagcaaggtggccctgtctc

SEQ ID NO: 383401 - DNA, 25 bp, Mus musculus
tggtggagcgacaaggtaaaagaag

SEQ ID NO: 383402 - DNA, 25 bp, Mus musculus
tggtggagctctccgccggctgatt

SEQ ID NO: 383403 - DNA, 25 bp, Mus musculus
tggtggagctgcagggatacaaact

SEQ ID NO: 383404 - DNA, 25 bp, Mus musculus
tggtggagctggatcgggcggtgct

SEQ ID NO: 383405 - DNA, 25 bp, Mus musculus
tggtggaggaacatggccaccacct

SEQ ID NO: 383406 - DNA, 25 bp, Mus musculus
tggtggaggacctggaggaaattat

SEQ ID NO: 383407 - DNA, 25 bp, Mus musculus
tggtggaggagaagatggagcgaga

SEQ ID NO: 383408 - DNA, 25 bp, Mus musculus
tggtggagtacgaatatattgtggc

SEQ ID NO: 383409 - DNA, 25 bp, Mus musculus
tggtggagtgcacctgtcaagcccg

SEQ ID NO: 383410 - DNA, 25 bp, Mus musculus
tggtggagttctaccccacaatcaa

SEQ ID NO: 383411 - DNA, 25 bp, Mus musculus
tggtggagttctatgccccgtggtg

SEQ ID NO: 383412 - DNA, 25 bp, Mus musculus
tggtggagttctatgccccttggtg

SEQ ID NO: 383413 - DNA, 25 bp, Mus musculus
tggtggagttggccaaacagtgggg

SEQ ID NO: 383414 - DNA, 25 bp, Mus musculus
tggtggatcagctggaaaacaggct

SEQ ID NO: 383415 - DNA, 25 bp, Mus musculus
tggtggatggtgacctgctggcagg

SEQ ID NO: 383416 - DNA, 25 bp, Mus musculus
tggtggattctgggaaggtgaagga

SEQ ID NO: 383417 - DNA, 25 bp, Mus musculus
tggtggatttaggagaggatgaaga

SEQ ID NO: 383418 - DNA, 25 bp, Mus musculus
tggtggcaagcttggcgcccgtgtt

SEQ ID NO: 383419 - DNA, 25 bp, Mus musculus
tggtggcacggatggcaatgtgcgt

SEQ ID NO: 383420 - DNA, 25 bp, Mus musculus
tggtggcagcagcccaaatgaccca

SEQ ID NO: 383421 - DNA, 25 bp, Mus musculus
tggtggcagctgagaaacttggaaa

SEQ ID NO: 383422 - DNA, 25 bp, Mus musculus
tggtggcaggtgactccagctccgt

SEQ ID NO: 383423 - DNA, 25 bp, Mus musculus
tggtggcaggtgggacctgaccaag

SEQ ID NO: 383424 - DNA, 25 bp, Mus musculus
tggtggcatcataggtggcatcatg

SEQ ID NO: 383425 - DNA, 25 bp, Mus musculus
tggtggcatctcagatacgaacaga

SEQ ID NO: 383426 - DNA, 25 bp, Mus musculus
tggtggcattccattgacaatttgc

SEQ ID NO: 383427 - DNA, 25 bp, Mus musculus
tggtggcattgggctggaaagggtg

SEQ ID NO: 383428 - DNA, 25 bp, Mus musculus
tggtggccaaggttccctaccgcct

SEQ ID NO: 383429 - DNA, 25 bp, Mus musculus
tggtggccacaggctcccataatgc

SEQ ID NO: 383430 - DNA, 25 bp, Mus musculus
tggtggccacaggttggttttatca

SEQ ID NO: 383431 - DNA, 25 bp, Mus musculus
tggtggccacctactcccagatggc

SEQ ID NO: 383432 - DNA, 25 bp, Mus musculus
tggtggccacctgggtgcagtgtgc

SEQ ID NO: 383433 - DNA, 25 bp, Mus musculus
tggtggccagagagctgaagcgctg

SEQ ID NO: 383434 - DNA, 25 bp, Mus musculus
tggtggccaggacagcaaccatctg

SEQ ID NO: 383435 - DNA, 25 bp, Mus musculus
tggtggccagggttttaatgtagtt

SEQ ID NO: 383436 - DNA, 25 bp, Mus musculus
tggtggccatggtctgggaaggccc

SEQ ID NO: 383437 - DNA, 25 bp, Mus musculus
tggtggcccaggaggtcctgtcctt

SEQ ID NO: 383438 - DNA, 25 bp, Mus musculus
tggtggcccgagctgtgggaacctt

SEQ ID NO: 383439 - DNA, 25 bp, Mus musculus
tggtggccctgtctctctggacttt

SEQ ID NO: 383440 - DNA, 25 bp, Mus musculus
tggtggccgacaaagttccacaggt

SEQ ID NO: 383441 - DNA, 25 bp, Mus musculus
tggtggccgagtgttgctgaacaca

SEQ ID NO: 383442 - DNA, 25 bp, Mus musculus
tggtggccgccgacaacactggtag

SEQ ID NO: 383443 - DNA, 25 bp, Mus musculus
tggtggccgccgatacatataccat

SEQ ID NO: 383444 - DNA, 25 bp, Mus musculus
tggtggccgtagagcatgcactctt

SEQ ID NO: 383445 - DNA, 25 bp, Mus musculus
tggtggccgtagaggtgctgggatt

SEQ ID NO: 383446 - DNA, 25 bp, Mus musculus
tggtggccgtgaaggtggaggcagg

SEQ ID NO: 383447 - DNA, 25 bp, Mus musculus
tggtggcctactactcttaaaaaac

SEQ ID NO: 383448 - DNA, 25 bp, Mus musculus
tggtggcctactactgtcgtttata

SEQ ID NO: 383449 - DNA, 25 bp, Mus musculus
tggtggcctcaagggttacagggaa

SEQ ID NO: 383450 - DNA, 25 bp, Mus musculus
tggtggcctcctggactgtgctggg

SEQ ID NO: 383451 - DNA, 25 bp, Mus musculus
tggtggcctcctgggtggtgcagac

SEQ ID NO: 383452 - DNA, 25 bp, Mus musculus
tggtggcctcgcgctataaccactt

SEQ ID NO: 383453 - DNA, 25 bp, Mus musculus
tggtggcctctaagtgccatcacct

SEQ ID NO: 383454 - DNA, 25 bp, Mus musculus
tggtggcctctaagttgctgactgt

SEQ ID NO: 383455 - DNA, 25 bp, Mus musculus
tggtggcctgtggtttatggtgtgc

SEQ ID NO: 383456 - DNA, 25 bp, Mus musculus
tggtggcgacagatgtgaaggcacc

SEQ ID NO: 383457 - DNA, 25 bp, Mus musculus
tggtggcgcagtcttgagtaatcca

SEQ ID NO: 383458 - DNA, 25 bp, Mus musculus
tggtggcgggagcctttttctggct

SEQ ID NO: 383459 - DNA, 25 bp, Mus musculus
tggtggcggggaaggcagatgaggg

SEQ ID NO: 383460 - DNA, 25 bp, Mus musculus
tggtggcgtggaagggggaggcaca

SEQ ID NO: 383461 - DNA, 25 bp, Mus musculus
tggtggctacctgaagctgatgccc

SEQ ID NO: 383462 - DNA, 25 bp, Mus musculus
tggtggctcaagttttcctgacttc

SEQ ID NO: 383463 - DNA, 25 bp, Mus musculus
tggtggctcacagctgtgatgagtg

SEQ ID NO: 383464 - DNA, 25 bp, Mus musculus
tggtggctcagtttctacagttaac

SEQ ID NO: 383465 - DNA, 25 bp, Mus musculus
tggtggctcagtttcttcggctgtc

SEQ ID NO: 383466 - DNA, 25 bp, Mus musculus
tggtggctcgattcctgtctctgag

SEQ ID NO: 383467 - DNA, 25 bp, Mus musculus
tggtggctctcagcttgcagacaaa

SEQ ID NO: 383468 - DNA, 25 bp, Mus musculus
tggtggctctcaggagcgcggcctt

SEQ ID NO: 383469 - DNA, 25 bp, Mus musculus
tggtggctgatgaaatgggtctagg

SEQ ID NO: 383470 - DNA, 25 bp, Mus musculus
tggtggctggagccctcagctgtgg

SEQ ID NO: 383471 - DNA, 25 bp, Mus musculus
tggtggctgtgcaggtataatggcc

SEQ ID NO: 383472 - DNA, 25 bp, Mus musculus
tggtggctttggtggcatatccaat

SEQ ID NO: 383473 - DNA, 25 bp, Mus musculus
tggtgggaatcagtgggtatcacag

SEQ ID NO: 383474 - DNA, 25 bp, Mus musculus
tggtgggacagggcaagaccgtgat

SEQ ID NO: 383475 - DNA, 25 bp, Mus musculus
tggtgggaccagtttaaaaggatgc

SEQ ID NO: 383476 - DNA, 25 bp, Mus musculus
tggtgggagagcgtggtcactgaca

SEQ ID NO: 383477 - DNA, 25 bp, Mus musculus
tggtgggagatgaagcgggagatcg

SEQ ID NO: 383478 - DNA, 25 bp, Mus musculus
tggtgggcacccaaggtgaaagcag

SEQ ID NO: 383479 - DNA, 25 bp, Mus musculus
tggtgggcaccccaggtgaaagcag

SEQ ID NO: 383480 - DNA, 25 bp, Mus musculus
tggtgggcagcttcatgttgtgtgt

SEQ ID NO: 383481 - DNA, 25 bp, Mus musculus
tggtgggcagggccttcgtatacct

SEQ ID NO: 383482 - DNA, 25 bp, Mus musculus
tggtgggcaggtgtgctgatgtcaa

SEQ ID NO: 383483 - DNA, 25 bp, Mus musculus
tggtgggcagtggagaaaaatggtc

SEQ ID NO: 383484 - DNA, 25 bp, Mus musculus
tggtgggctaccagattttgttcgg

SEQ ID NO: 383485 - DNA, 25 bp, Mus musculus
tggtgggctaccagtggttgtcccc

SEQ ID NO: 383486 - DNA, 25 bp, Mus musculus
tggtggggaagttgcttcaggcagc

SEQ ID NO: 383487 - DNA, 25 bp, Mus musculus
tggtggggctcgcaggatccctgct

SEQ ID NO: 383488 - DNA, 25 bp, Mus musculus
tggtgggggtagcaggtttggacct

SEQ ID NO: 383489 - DNA, 25 bp, Mus musculus
tggtggtacaagacgcatgttaatg

SEQ ID NO: 383490 - DNA, 25 bp, Mus musculus
tggtggtaggcaggttgttcgtagt

SEQ ID NO: 383491 - DNA, 25 bp, Mus musculus
tggtggtataaagagggtgtattac

SEQ ID NO: 383492 - DNA, 25 bp, Mus musculus
tggtggtatcatgatgacacttgtt

SEQ ID NO: 383493 - DNA, 25 bp, Mus musculus
tggtggtatcatggtggatacagtg

SEQ ID NO: 383494 - DNA, 25 bp, Mus musculus
tggtggtatccacgcctgaggtcct

SEQ ID NO: 383495 - DNA, 25 bp, Mus musculus
tggtggtatcttcgaaccaagtatc

SEQ ID NO: 383496 - DNA, 25 bp, Mus musculus
tggtggtcatcccagcagaagtttt

SEQ ID NO: 383497 - DNA, 25 bp, Mus musculus
tggtggtcctggggccatcagctcc

SEQ ID NO: 383498 - DNA, 25 bp, Mus musculus
tggtggtcctggggtacaatggtgc

SEQ ID NO: 383499 - DNA, 25 bp, Mus musculus
tggtggtccttgaaccgggcaccat

SEQ ID NO: 383500 - DNA, 25 bp, Mus musculus
tggtggtctcacgcggtcggatatg

SEQ ID NO: 383501 - DNA, 25 bp, Mus musculus
tggtggtctccgggttctgcaggag

SEQ ID NO: 383502 - DNA, 25 bp, Mus musculus
tggtggtcttccaggggaatgcagg

SEQ ID NO: 383503 - DNA, 25 bp, Mus musculus
tggtggtgaactaaagcaccgagtc

SEQ ID NO: 383504 - DNA, 25 bp, Mus musculus
tggtggtgaactgctgtatcttgga

SEQ ID NO: 383505 - DNA, 25 bp, Mus musculus
tggtggtgaagtatatcatgtataa

SEQ ID NO: 383506 - DNA, 25 bp, Mus musculus
tggtggtgaccggaactttctaagc

SEQ ID NO: 383507 - DNA, 25 bp, Mus musculus
tggtggtgatgaaagtggctcagct

SEQ ID NO: 383508 - DNA, 25 bp, Mus musculus
tggtggtgccaattgctggtgccag

SEQ ID NO: 383509 - DNA, 25 bp, Mus musculus
tggtggtggacagggaatgtacggc

SEQ ID NO: 383510 - DNA, 25 bp, Mus musculus
tggtggtggacagtgcctatgaagt

SEQ ID NO: 383511 - DNA, 25 bp, Mus musculus
tggtggtggaggaggggaatttgct

SEQ ID NO: 383512 - DNA, 25 bp, Mus musculus
tggtggtggagggggacgatttggt

SEQ ID NO: 383513 - DNA, 25 bp, Mus musculus
tggtggtggcattgggctggaaagg

SEQ ID NO: 383514 - DNA, 25 bp, Mus musculus
tggtggtggggaagttgcttcaggc

SEQ ID NO: 383515 - DNA, 25 bp, Mus musculus
tggtggtggttctgacagagcctca

SEQ ID NO: 383516 - DNA, 25 bp, Mus musculus
tggtggtgttatgcttgcttcacta

SEQ ID NO: 383517 - DNA, 25 bp, Mus musculus
tggtggtgttcagtgtggacgagga

SEQ ID NO: 383518 - DNA, 25 bp, Mus musculus
tggtggttctgacagagcctcaagg

SEQ ID NO: 383519 - DNA, 25 bp, Mus musculus
tggtggttctttaagctacaaaaaa

SEQ ID NO: 383520 - DNA, 25 bp, Mus musculus
tggtggtttaacaggtgtcactctg

SEQ ID NO: 383521 - DNA, 25 bp, Mus musculus
tggtggttttactgagttgcactca

SEQ ID NO: 383522 - DNA, 25 bp, Mus musculus
tggtgtaaagggagatcgaggccca

SEQ ID NO: 383523 - DNA, 25 bp, Mus musculus
tggtgtaaaggtagatcgaggccca

SEQ ID NO: 383524 - DNA, 25 bp, Mus musculus
tggtgtaatgctttgtcggatatga

SEQ ID NO: 383525 - DNA, 25 bp, Mus musculus
tggtgtacacacaggtggtgacagt

SEQ ID NO: 383526 - DNA, 25 bp, Mus musculus
tggtgtacagggatcagaacaagta

SEQ ID NO: 383527 - DNA, 25 bp, Mus musculus
tggtgtactggagaaaatgttttca

SEQ ID NO: 383528 - DNA, 25 bp, Mus musculus
tggtgtactggagagggtgtaacaa

SEQ ID NO: 383529 - DNA, 25 bp, Mus musculus
tggtgtagcacatttccttctggct

SEQ ID NO: 383530 - DNA, 25 bp, Mus musculus
tggtgtagcaggcagcaaagaagaa

SEQ ID NO: 383531 - DNA, 25 bp, Mus musculus
tggtgtaggatgtaggtgaattata

SEQ ID NO: 383532 - DNA, 25 bp, Mus musculus
tggtgtaggcagtctcatcaagcaa

SEQ ID NO: 383533 - DNA, 25 bp, Mus musculus
tggtgtataatgaatttcagaaatt

SEQ ID NO: 383534 - DNA, 25 bp, Mus musculus
tggtgtataatggcatttgagcact

SEQ ID NO: 383535 - DNA, 25 bp, Mus musculus
tggtgtcaaaggagaccaaggtgta

SEQ ID NO: 383536 - DNA, 25 bp, Mus musculus
tggtgtcaacattgtggagatgctg

SEQ ID NO: 383537 - DNA, 25 bp, Mus musculus
tggtgtcaagcctgagggatctgag

SEQ ID NO: 383538 - DNA, 25 bp, Mus musculus
tggtgtcaagctcccagactccacc

SEQ ID NO: 383539 - DNA, 25 bp, Mus musculus
tggtgtcacaggcggcacgttttct

SEQ ID NO: 383540 - DNA, 25 bp, Mus musculus
tggtgtcaccacaggccgacccgtg

SEQ ID NO: 383541 - DNA, 25 bp, Mus musculus
tggtgtcactgcaagagcggccccg

SEQ ID NO: 383542 - DNA, 25 bp, Mus musculus
tggtgtcagagaaggaagcagcggt

SEQ ID NO: 383543 - DNA, 25 bp, Mus musculus
tggtgtcagagaagtatccctggga

SEQ ID NO: 383544 - DNA, 25 bp, Mus musculus
tggtgtccagagagttgtgtggcca

SEQ ID NO: 383545 - DNA, 25 bp, Mus musculus
tggtgtcccgggatgccaagccttt

SEQ ID NO: 383546 - DNA, 25 bp, Mus musculus
tggtgtccgagatgcatgctgttct

SEQ ID NO: 383547 - DNA, 25 bp, Mus musculus
tggtgtccgaggtcttcagattaca

SEQ ID NO: 383548 - DNA, 25 bp, Mus musculus
tggtgtccgagtgtcctgcaggtct

SEQ ID NO: 383549 - DNA, 25 bp, Mus musculus
tggtgtcctaggccacagaaggacc

SEQ ID NO: 383550 - DNA, 25 bp, Mus musculus
tggtgtcctgctgaggcgagtaaca

SEQ ID NO: 383551 - DNA, 25 bp, Mus musculus
tggtgtcctggctggtatctgccga

SEQ ID NO: 383552 - DNA, 25 bp, Mus musculus
tggtgtcgctcgagttcctgaggat

SEQ ID NO: 383553 - DNA, 25 bp, Mus musculus
tggtgtcgctcgggtatcaagtctc

SEQ ID NO: 383554 - DNA, 25 bp, Mus musculus
tggtgtcggaggatataaaattccg

SEQ ID NO: 383555 - DNA, 25 bp, Mus musculus
tggtgtctctggtcccatgggtccc

SEQ ID NO: 383556 - DNA, 25 bp, Mus musculus
tggtgtctgggaaagagtgtgagga

SEQ ID NO: 383557 - DNA, 25 bp, Mus musculus
tggtgtctgtggggacctctgagct

SEQ ID NO: 383558 - DNA, 25 bp, Mus musculus
tggtgtgaagaaaagaaagtccagt

SEQ ID NO: 383559 - DNA, 25 bp, Mus musculus
tggtgtgaaggaatcttctgagagc

SEQ ID NO: 383560 - DNA, 25 bp, Mus musculus
tggtgtgaccttgggctggcatccc

SEQ ID NO: 383561 - DNA, 25 bp, Mus musculus
tggtgtgaccttgggtgctggcctc

SEQ ID NO: 383562 - DNA, 25 bp, Mus musculus
tggtgtgactgagttggccgcccca

SEQ ID NO: 383563 - DNA, 25 bp, Mus musculus
tggtgtgacttgagaacacaagaga

SEQ ID NO: 383564 - DNA, 25 bp, Mus musculus
tggtgtgacttgagaagctgaatca

SEQ ID NO: 383565 - DNA, 25 bp, Mus musculus
tggtgtgccaacgaggaatatcctc

SEQ ID NO: 383566 - DNA, 25 bp, Mus musculus
tggtgtgccaacgccagctttttta

SEQ ID NO: 383567 - DNA, 25 bp, Mus musculus
tggtgtgccaggagagtactaaatt

SEQ ID NO: 383568 - DNA, 25 bp, Mus musculus
tggtgtgccccctctagtcctccct

SEQ ID NO: 383569 - DNA, 25 bp, Mus musculus
tggtgtgcgaccagatctgctgctt

SEQ ID NO: 383570 - DNA, 25 bp, Mus musculus
tggtgtgcgaccaggtgtctgcctg

SEQ ID NO: 383571 - DNA, 25 bp, Mus musculus
tggtgtgctccaggctggacagtat

SEQ ID NO: 383572 - DNA, 25 bp, Mus musculus
tggtgtgcttggattacacagtgcg

SEQ ID NO: 383573 - DNA, 25 bp, Mus musculus
tggtgtgcttgtgctcgccgtggga

SEQ ID NO: 383574 - DNA, 25 bp, Mus musculus
tggtgtggacactcctggagccaga

SEQ ID NO: 383575 - DNA, 25 bp, Mus musculus
tggtgtggaggctcatctcagagaa

SEQ ID NO: 383576 - DNA, 25 bp, Mus musculus
tggtgtggaggggctcctctgtcca

SEQ ID NO: 383577 - DNA, 25 bp, Mus musculus
tggtgtggagtttgcagattccttt

SEQ ID NO: 383578 - DNA, 25 bp, Mus musculus
tggtgtggatggtgcctgcaggccc

SEQ ID NO: 383579 - DNA, 25 bp, Mus musculus
tggtgtggcagtagaaacagatact

SEQ ID NO: 383580 - DNA, 25 bp, Mus musculus
tggtgtggcattttttggaccatat

SEQ ID NO: 383581 - DNA, 25 bp, Mus musculus
tggtgtggggctcctctaaattggt

SEQ ID NO: 383582 - DNA, 25 bp, Mus musculus
tggtgtggtggccagtgggtgcatc

SEQ ID NO: 383583 - DNA, 25 bp, Mus musculus
tggtgtgtagaactgctccaggctt

SEQ ID NO: 383584 - DNA, 25 bp, Mus musculus
tggtgtgtctagggtgtgcttatat

SEQ ID NO: 383585 - DNA, 25 bp, Mus musculus
tggtgtgtgtgtgtaatagggatgg

SEQ ID NO: 383586 - DNA, 25 bp, Mus musculus
tggtgtgttagagtggattgaaatg

SEQ ID NO: 383587 - DNA, 25 bp, Mus musculus
tggtgtgttaggtatggctttccca

SEQ ID NO: 383588 - DNA, 25 bp, Mus musculus
tggtgtgttaggtgcggtggctact

SEQ ID NO: 383589 - DNA, 25 bp, Mus musculus
tggtgtgtttgaggagatttctaat

SEQ ID NO: 383590 - DNA, 25 bp, Mus musculus
tggtgttaaaaagacatgtttttca

SEQ ID NO: 383591 - DNA, 25 bp, Mus musculus
tggtgttaaaaagtttatgatcaca

SEQ ID NO: 383592 - DNA, 25 bp, Mus musculus
tggtgttaacatgattgttcgtttt

SEQ ID NO: 383593 - DNA, 25 bp, Mus musculus
tggtgttacaggccgccctgctcca

SEQ ID NO: 383594 - DNA, 25 bp, Mus musculus
tggtgttacaggttagtgtcactgg

SEQ ID NO: 383595 - DNA, 25 bp, Mus musculus
tggtgttagctatttatgaagccaa

SEQ ID NO: 383596 - DNA, 25 bp, Mus musculus
tggtgttagctatttatggttacac

SEQ ID NO: 383597 - DNA, 25 bp, Mus musculus
tggtgttatcaagctgaggattgaa

SEQ ID NO: 383598 - DNA, 25 bp, Mus musculus
tggtgttatgcttgcttcactaaag

SEQ ID NO: 383599 - DNA, 25 bp, Mus musculus
tggtgttcagtgtggacgaggagga

SEQ ID NO: 383600 - DNA, 25 bp, Mus musculus
tggtgttcctactggagttaaaggg

SEQ ID NO: 383601 - DNA, 25 bp, Mus musculus
tggtgttcgctccaggtgagaagtc

SEQ ID NO: 383602 - DNA, 25 bp, Mus musculus
tggtgttcgtggcaggggatgatga

SEQ ID NO: 383603 - DNA, 25 bp, Mus musculus
tggtgttcttatgactctgggctga

SEQ ID NO: 383604 - DNA, 25 bp, Mus musculus
tggtgttgattacaggtacagcgca

SEQ ID NO: 383605 - DNA, 25 bp, Mus musculus
tggtgttgctgaagatcaaccgaga

SEQ ID NO: 383606 - DNA, 25 bp, Mus musculus
tggtgttggagcccctgggaacaag

SEQ ID NO: 383607 - DNA, 25 bp, Mus musculus
tggtgttggagctctgtgatacatg

SEQ ID NO: 383608 - DNA, 25 bp, Mus musculus
tggtgttggaggaagtaaagctcta

SEQ ID NO: 383609 - DNA, 25 bp, Mus musculus
tggtgtttaaggccaagcatctggc

SEQ ID NO: 383610 - DNA, 25 bp, Mus musculus
tggtgtttgcaggagtgtaccctat

SEQ ID NO: 383611 - DNA, 25 bp, Mus musculus
tggtgttttcaggcctctgctcgat

SEQ ID NO: 383612 - DNA, 25 bp, Mus musculus
tggttaacagaatgagaacagacaa

SEQ ID NO: 383613 - DNA, 25 bp, Mus musculus
tggttaaccagagtcctggatgccc

SEQ ID NO: 383614 - DNA, 25 bp, Mus musculus
tggttaacctgattcctggtttgga

SEQ ID NO: 383615 - DNA, 25 bp, Mus musculus
tggttaacctggatggggaggtgat

SEQ ID NO: 383616 - DNA, 25 bp, Mus musculus
tggttaacctgggagtttctgcatc

SEQ ID NO: 383617 - DNA, 25 bp, Mus musculus
tggttaactgccagatggttcttcg

SEQ ID NO: 383618 - DNA, 25 bp, Mus musculus
tggttaataaaggaggctttggagg

SEQ ID NO: 383619 - DNA, 25 bp, Mus musculus
tggttaataatgatgctgtggttag

SEQ ID NO: 383620 - DNA, 25 bp, Mus musculus
tggttaataatgcagctgtgtctga

SEQ ID NO: 383621 - DNA, 25 bp, Mus musculus
tggttacacagggctgttcaggtgt

SEQ ID NO: 383622 - DNA, 25 bp, Mus musculus
tggttacactatacagtggtggaag

SEQ ID NO: 383623 - DNA, 25 bp, Mus musculus
tggttacctagaggtgggaggcttt

SEQ ID NO: 383624 - DNA, 25 bp, Mus musculus
tggttactcagggatgaacaagaag

SEQ ID NO: 383625 - DNA, 25 bp, Mus musculus
tggttactttatctgcacaaacagc

SEQ ID NO: 383626 - DNA, 25 bp, Mus musculus
tggttagaacaggtccgagtaggtg

SEQ ID NO: 383627 - DNA, 25 bp, Mus musculus
tggttagagatgaatccgccagttc

SEQ ID NO: 383628 - DNA, 25 bp, Mus musculus
tggttataactgacaggtataaaaa

SEQ ID NO: 383629 - DNA, 25 bp, Mus musculus
tggttatactaatggaattgctagt

SEQ ID NO: 383630 - DNA, 25 bp, Mus musculus
tggttatactgccttaacatgggca

SEQ ID NO: 383631 - DNA, 25 bp, Mus musculus
tggttatatttgcctaaagacgtca

SEQ ID NO: 383632 - DNA, 25 bp, Mus musculus
tggttatcacaagtgtgtgggataa

SEQ ID NO: 383633 - DNA, 25 bp, Mus musculus
tggttatctccgggtctcactgtta

SEQ ID NO: 383634 - DNA, 25 bp, Mus musculus
tggttatgccagaaacccttcactg

SEQ ID NO: 383635 - DNA, 25 bp, Mus musculus
tggttattgagaaggagaacactga

SEQ ID NO: 383636 - DNA, 25 bp, Mus musculus
tggttattggtggttttggctcgtg

SEQ ID NO: 383637 - DNA, 25 bp, Mus musculus
tggttcaagacaagataagccgaca

SEQ ID NO: 383638 - DNA, 25 bp, Mus musculus
tggttcaagtgggtgttccagtgat

SEQ ID NO: 383639 - DNA, 25 bp, Mus musculus
tggttcaagtgttcctgtccacaga

SEQ ID NO: 383640 - DNA, 25 bp, Mus musculus
tggttcacagagatcccagaaaccg

SEQ ID NO: 383641 - DNA, 25 bp, Mus musculus
tggttcaccacacagacagaggagc

SEQ ID NO: 383642 - DNA, 25 bp, Mus musculus
tggttcaccacacagacagaggagt

SEQ ID NO: 383643 - DNA, 25 bp, Mus musculus
tggttcagagtcttttacatgtacc

SEQ ID NO: 383644 - DNA, 25 bp, Mus musculus
tggttcagagttgtcctggggaagg

SEQ ID NO: 383645 - DNA, 25 bp, Mus musculus
tggttcagctcctacctccttcttc

SEQ ID NO: 383646 - DNA, 25 bp, Mus musculus
tggttcagggcctggacagccactt

SEQ ID NO: 383647 - DNA, 25 bp, Mus musculus
tggttcataccaggttgtaagcatc

SEQ ID NO: 383648 - DNA, 25 bp, Mus musculus
tggttcatccatacatccagaaccc

SEQ ID NO: 383649 - DNA, 25 bp, Mus musculus
tggttccaagagaagagcgcctccc

SEQ ID NO: 383650 - DNA, 25 bp, Mus musculus
tggttccaagagaagagtgcttccc

SEQ ID NO: 383651 - DNA, 25 bp, Mus musculus
tggttccaagagaagagtgcttcgc

SEQ ID NO: 383652 - DNA, 25 bp, Mus musculus
tggttccaagagcaggtcaccgaca

SEQ ID NO: 383653 - DNA, 25 bp, Mus musculus
tggttccagcagaagtacgatggaa

SEQ ID NO: 383654 - DNA, 25 bp, Mus musculus
tggttccaggcggggtacatggctt

SEQ ID NO: 383655 - DNA, 25 bp, Mus musculus
tggttccaggcggggttaaactcac

SEQ ID NO: 383656 - DNA, 25 bp, Mus musculus
tggttccataggtgcggctctgggg

SEQ ID NO: 383657 - DNA, 25 bp, Mus musculus
tggttccatcaagggaagaaggatg

SEQ ID NO: 383658 - DNA, 25 bp, Mus musculus
tggttccatgtggatgctgcctggg

SEQ ID NO: 383659 - DNA, 25 bp, Mus musculus
tggttccatgtggatggctgactct

SEQ ID NO: 383660 - DNA, 25 bp, Mus musculus
tggttcccaaggacttgtactggtt

SEQ ID NO: 383661 - DNA, 25 bp, Mus musculus
tggttcccaatgatctgattggctg

SEQ ID NO: 383662 - DNA, 25 bp, Mus musculus
tggttcccaatgatggcagcaagat

SEQ ID NO: 383663 - DNA, 25 bp, Mus musculus
tggttcccagaaagccccgcagccc

SEQ ID NO: 383664 - DNA, 25 bp, Mus musculus
tggttcccgacgctcctgcgttcta

SEQ ID NO: 383665 - DNA, 25 bp, Mus musculus
tggttcccgacggtgacaaacttga

SEQ ID NO: 383666 - DNA, 25 bp, Mus musculus
tggttcccgacggttttggctatgg

SEQ ID NO: 383667 - DNA, 25 bp, Mus musculus
tggttcctcagaaaatgaagtccca

SEQ ID NO: 383668 - DNA, 25 bp, Mus musculus
tggttcctcagaacctgggaggcag

SEQ ID NO: 383669 - DNA, 25 bp, Mus musculus
tggttcctcagagccgagcaatggt

SEQ ID NO: 383670 - DNA, 25 bp, Mus musculus
tggttcctctgtcagatgatgatca

SEQ ID NO: 383671 - DNA, 25 bp, Mus musculus
tggttcctggagggatcaatgtgac

SEQ ID NO: 383672 - DNA, 25 bp, Mus musculus
tggttccttgagatacgacatttca

SEQ ID NO: 383673 - DNA, 25 bp, Mus musculus
tggttcctttccttgggagcgagca

SEQ ID NO: 383674 - DNA, 25 bp, Mus musculus
tggttcgaaggccatgacagtagct

SEQ ID NO: 383675 - DNA, 25 bp, Mus musculus
tggttcgaaggggctcatcctgtta

SEQ ID NO: 383676 - DNA, 25 bp, Mus musculus
tggttcgcctgggtggcggctgaca

SEQ ID NO: 383677 - DNA, 25 bp, Mus musculus
tggttcgcgagaacagttcaagggc

SEQ ID NO: 383678 - DNA, 25 bp, Mus musculus
tggttctagaacagttcttaggaag

SEQ ID NO: 383679 - DNA, 25 bp, Mus musculus
tggttctatctatgaatttggaaat

SEQ ID NO: 383680 - DNA, 25 bp, Mus musculus
tggttctccagagggaaaaagccta

SEQ ID NO: 383681 - DNA, 25 bp, Mus musculus
tggttctcgagcaccctcagaatat

SEQ ID NO: 383682 - DNA, 25 bp, Mus musculus
tggttctcgaggctgctgatgagac

SEQ ID NO: 383683 - DNA, 25 bp, Mus musculus
tggttctgagaatctgcctgtggag

SEQ ID NO: 383684 - DNA, 25 bp, Mus musculus
tggttctgagttctcatctccctct

SEQ ID NO: 383685 - DNA, 25 bp, Mus musculus
tggttctgcagaggaacagctgtgc

SEQ ID NO: 383686 - DNA, 25 bp, Mus musculus
tggttctgcaggagcagagcccggg

SEQ ID NO: 383687 - DNA, 25 bp, Mus musculus
tggttctgcttcccaggctaaggag

SEQ ID NO: 383688 - DNA, 25 bp, Mus musculus
tggttctggaaatcctgagaatatc

SEQ ID NO: 383689 - DNA, 25 bp, Mus musculus
tggttctggaaatggctgaccaagg

SEQ ID NO: 383690 - DNA, 25 bp, Mus musculus
tggttctggaatgatctcaacttcc

SEQ ID NO: 383691 - DNA, 25 bp, Mus musculus
tggttctgggggcaaactggaagga

SEQ ID NO: 383692 - DNA, 25 bp, Mus musculus
tggttctggtgctgaaacccttcac

SEQ ID NO: 383693 - DNA, 25 bp, Mus musculus
tggttctgtccagagcctcaaggtc

SEQ ID NO: 383694 - DNA, 25 bp, Mus musculus
tggttctgtccaggatcattttaac

SEQ ID NO: 383695 - DNA, 25 bp, Mus musculus
tggttcttaagtcagagagcgagga

SEQ ID NO: 383696 - DNA, 25 bp, Mus musculus
tggttcttcaagatctggagaccct

SEQ ID NO: 383697 - DNA, 25 bp, Mus musculus
tggttcttcaaggccacgaaagacc

SEQ ID NO: 383698 - DNA, 25 bp, Mus musculus
tggttcttcagcaagacagaggagc

SEQ ID NO: 383699 - DNA, 25 bp, Mus musculus
tggttcttcaggcgtggctcccgca

SEQ ID NO: 383700 - DNA, 25 bp, Mus musculus
tggttcttcaggtacatggcttctt

SEQ ID NO: 383701 - DNA, 25 bp, Mus musculus
tggttcttcaggtcagaaggagaca

SEQ ID NO: 383702 - DNA, 25 bp, Mus musculus
tggttcttcctcaaccccctagaat

SEQ ID NO: 383703 - DNA, 25 bp, Mus musculus
tggttcttgtttgatactttatgca

SEQ ID NO: 383704 - DNA, 25 bp, Mus musculus
tggttctttaagctacaaaaaattg

SEQ ID NO: 383705 - DNA, 25 bp, Mus musculus
tggttctttccaaatggacctgagg

SEQ ID NO: 383706 - DNA, 25 bp, Mus musculus
tggttgaaatagaattgatggaatc

SEQ ID NO: 383707 - DNA, 25 bp, Mus musculus
tggttgaaatagagggaccagtctt

SEQ ID NO: 383708 - DNA, 25 bp, Mus musculus
tggttgaacttgttggatttgaact

SEQ ID NO: 383709 - DNA, 25 bp, Mus musculus
tggttgaagacacaggaggcagcca

SEQ ID NO: 383710 - DNA, 25 bp, Mus musculus
tggttgaagagggtgctgatacttt

SEQ ID NO: 383711 - DNA, 25 bp, Mus musculus
tggttgaagaggtgcacactttatg

SEQ ID NO: 383712 - DNA, 25 bp, Mus musculus
tggttgaatgatccagagtcctccc

SEQ ID NO: 383713 - DNA, 25 bp, Mus musculus
tggttgaatttctggtaatctatgc

SEQ ID NO: 383714 - DNA, 25 bp, Mus musculus
tggttgaatttctggtttgcggtgt

SEQ ID NO: 383715 - DNA, 25 bp, Mus musculus
tggttgacatcaaatacaagaggaa

SEQ ID NO: 383716 - DNA, 25 bp, Mus musculus
tggttgacatcaagactgaaggaca

SEQ ID NO: 383717 - DNA, 25 bp, Mus musculus
tggttgacatgtgcgagtagtgggt

SEQ ID NO: 383718 - DNA, 25 bp, Mus musculus
tggttgatccaaacatccagaaccc

SEQ ID NO: 383719 - DNA, 25 bp, Mus musculus
tggttgattgagaaggagggagagt

SEQ ID NO: 383720 - DNA, 25 bp, Mus musculus
tggttgcaggaagaccgagtagtga

SEQ ID NO: 383721 - DNA, 25 bp, Mus musculus
tggttgcaggagcacccccaccgct

SEQ ID NO: 383722 - DNA, 25 bp, Mus musculus
tggttgcaggagggtgaagggcctg

SEQ ID NO: 383723 - DNA, 25 bp, Mus musculus
tggttgccaagaaggggtagaggag

SEQ ID NO: 383724 - DNA, 25 bp, Mus musculus
tggttgccaaggctacataaactgt

SEQ ID NO: 383725 - DNA, 25 bp, Mus musculus
tggttgccaaggtccaaggacctta

SEQ ID NO: 383726 - DNA, 25 bp, Mus musculus
tggttgccaggctccacccgcggtc

SEQ ID NO: 383727 - DNA, 25 bp, Mus musculus
tggttgcccaggtgctgggcttgga

SEQ ID NO: 383728 - DNA, 25 bp, Mus musculus
tggttgccgccataggtttatggag

SEQ ID NO: 383729 - DNA, 25 bp, Mus musculus
tggttgccggacctacaacctgggc

SEQ ID NO: 383730 - DNA, 25 bp, Mus musculus
tggttgcggaaacaggcattgaaga

SEQ ID NO: 383731 - DNA, 25 bp, Mus musculus
tggttgctatggaacatcattcatg

SEQ ID NO: 383732 - DNA, 25 bp, Mus musculus
tggttgctatggtctgggagggtct

SEQ ID NO: 383733 - DNA, 25 bp, Mus musculus
tggttgctgaagaagagcatcatgg

SEQ ID NO: 383734 - DNA, 25 bp, Mus musculus
tggttgctgtggccctctgattgcc

SEQ ID NO: 383735 - DNA, 25 bp, Mus musculus
tggttgcttctggggtcacaggatg

SEQ ID NO: 383736 - DNA, 25 bp, Mus musculus
tggttggaacgaatgcctccaattc

SEQ ID NO: 383737 - DNA, 25 bp, Mus musculus
tggttggacttggtgtgagtcattc

SEQ ID NO: 383738 - DNA, 25 bp, Mus musculus
tggttggagaaatctctggtcgctt

SEQ ID NO: 383739 - DNA, 25 bp, Mus musculus
tggttggagcaggtactggccttat

SEQ ID NO: 383740 - DNA, 25 bp, Mus musculus
tggttggagcaggtggcaaagcaac

SEQ ID NO: 383741 - DNA, 25 bp, Mus musculus
tggttggagccagctatgtggccct

SEQ ID NO: 383742 - DNA, 25 bp, Mus musculus
tggttggagccagctcctgctgctg

SEQ ID NO: 383743 - DNA, 25 bp, Mus musculus
tggttggagctgcagggcctgttgc

SEQ ID NO: 383744 - DNA, 25 bp, Mus musculus
tggttggagctgcaggggctctgag

SEQ ID NO: 383745 - DNA, 25 bp, Mus musculus
tggttggatgggcacacgctgccac

SEQ ID NO: 383746 - DNA, 25 bp, Mus musculus
tggttggcaacctctgaagtcttga

SEQ ID NO: 383747 - DNA, 25 bp, Mus musculus
tggttggcaggtgaatttggaaggc

SEQ ID NO: 383748 - DNA, 25 bp, Mus musculus
tggttggccctcagggtcccacagg

SEQ ID NO: 383749 - DNA, 25 bp, Mus musculus
tggttggcggagagagtacccagta

SEQ ID NO: 383750 - DNA, 25 bp, Mus musculus
tggttggctaccagggacctcctgg

SEQ ID NO: 383751 - DNA, 25 bp, Mus musculus
tggttgggaaggaaaagggctatgc

SEQ ID NO: 383752 - DNA, 25 bp, Mus musculus
tggttgggataaactcgcatgtgtg

SEQ ID NO: 383753 - DNA, 25 bp, Mus musculus
tggttgtcagcgctgatagaagtgg

SEQ ID NO: 383754 - DNA, 25 bp, Mus musculus
tggttgtcttccaaaaggctcaaag

SEQ ID NO: 383755 - DNA, 25 bp, Mus musculus
tggttgtgattcagatacaaacagg

SEQ ID NO: 383756 - DNA, 25 bp, Mus musculus
tggttgtgattcagatcaactgcca

SEQ ID NO: 383757 - DNA, 25 bp, Mus musculus
tggttgtgctgggcctgcttccgag

SEQ ID NO: 383758 - DNA, 25 bp, Mus musculus
tggttgtggtcaaccacactgtcct

SEQ ID NO: 383759 - DNA, 25 bp, Mus musculus
tggttgtgtctcttactggggcctt

SEQ ID NO: 383760 - DNA, 25 bp, Mus musculus
tggttgttcaagttataggtaaaag

SEQ ID NO: 383761 - DNA, 25 bp, Mus musculus
tggttgttccggaggaatttgaagc

SEQ ID NO: 383762 - DNA, 25 bp, Mus musculus
tggttgttgaaggactcgggacacc

SEQ ID NO: 383763 - DNA, 25 bp, Mus musculus
tggttgtttttggtgccttcaagac

SEQ ID NO: 383764 - DNA, 25 bp, Mus musculus
tggtttaaaaaactacatatggtca

SEQ ID NO: 383765 - DNA, 25 bp, Mus musculus
tggtttaaaaactctgtgcaccgag

SEQ ID NO: 383766 - DNA, 25 bp, Mus musculus
tggtttaacaggtgtcactctgcaa

SEQ ID NO: 383767 - DNA, 25 bp, Mus musculus
tggtttaacttattagtacttgtga

SEQ ID NO: 383768 - DNA, 25 bp, Mus musculus
tggtttacacagtattactatgaat

SEQ ID NO: 383769 - DNA, 25 bp, Mus musculus
tggtttacagactgttttccaagct

SEQ ID NO: 383770 - DNA, 25 bp, Mus musculus
tggtttacaggtttactgctaggcc

SEQ ID NO: 383771 - DNA, 25 bp, Mus musculus
tggtttacagtccctggatgacgcg

SEQ ID NO: 383772 - DNA, 25 bp, Mus musculus
tggtttagattctcaaaccatgaat

SEQ ID NO: 383773 - DNA, 25 bp, Mus musculus
tggtttatatgcattcacatcattg

SEQ ID NO: 383774 - DNA, 25 bp, Mus musculus
tggtttatatgcttgtgggcttttt

SEQ ID NO: 383775 - DNA, 25 bp, Mus musculus
tggtttatcaagattactcgggaca

SEQ ID NO: 383776 - DNA, 25 bp, Mus musculus
tggtttatcaagggatccacaaatg

SEQ ID NO: 383777 - DNA, 25 bp, Mus musculus
tggtttatcagagatttgaagttca

SEQ ID NO: 383778 - DNA, 25 bp, Mus musculus
tggtttatcaggacccagcatgaac

SEQ ID NO: 383779 - DNA, 25 bp, Mus musculus
tggtttatcgggaccagaataagta

SEQ ID NO: 383780 - DNA, 25 bp, Mus musculus
tggtttatttacaccaagctggatg

SEQ ID NO: 383781 - DNA, 25 bp, Mus musculus
tggtttcaaggtgacagatcagtca

SEQ ID NO: 383782 - DNA, 25 bp, Mus musculus
tggtttcacaggtcaactttgtgag

SEQ ID NO: 383783 - DNA, 25 bp, Mus musculus
tggtttcagaaggtttgaagactcc

SEQ ID NO: 383784 - DNA, 25 bp, Mus musculus
tggtttcagaggaggcctttcccag

SEQ ID NO: 383785 - DNA, 25 bp, Mus musculus
tggtttcaggccttcccctgaaggc

SEQ ID NO: 383786 - DNA, 25 bp, Mus musculus
tggtttcagggcagcccctggaaga

SEQ ID NO: 383787 - DNA, 25 bp, Mus musculus
tggtttcatctcaaagcatacagct

SEQ ID NO: 383788 - DNA, 25 bp, Mus musculus
tggtttccactgagtccttagccag

SEQ ID NO: 383789 - DNA, 25 bp, Mus musculus
tggtttccactgcacctcctggcct

SEQ ID NO: 383790 - DNA, 25 bp, Mus musculus
tggtttccagcccgtcctttcatca

SEQ ID NO: 383791 - DNA, 25 bp, Mus musculus
tggtttcccattgaaggtttcagga

SEQ ID NO: 383792 - DNA, 25 bp, Mus musculus
tggtttcccattgagtacccagact

SEQ ID NO: 383793 - DNA, 25 bp, Mus musculus
tggtttcccgggtatgcatggacca

SEQ ID NO: 383794 - DNA, 25 bp, Mus musculus
tggtttccctggatcaggacatgca

SEQ ID NO: 383795 - DNA, 25 bp, Mus musculus
tggtttccgaggtctctgtgttggt

SEQ ID NO: 383796 - DNA, 25 bp, Mus musculus
tggtttcctccgcaccaccaccacc

SEQ ID NO: 383797 - DNA, 25 bp, Mus musculus
tggtttcgcctacaggcatatacca

SEQ ID NO: 383798 - DNA, 25 bp, Mus musculus
tggtttcggatccaggacctgctgt

SEQ ID NO: 383799 - DNA, 25 bp, Mus musculus
tggtttctccaccaggacatggatt

SEQ ID NO: 383800 - DNA, 25 bp, Mus musculus
tggtttctcctacaaattgctaata

SEQ ID NO: 383801 - DNA, 25 bp, Mus musculus
tggtttctcctgggctgcaagccca

SEQ ID NO: 383802 - DNA, 25 bp, Mus musculus
tggtttctctagatctcacactcct

SEQ ID NO: 383803 - DNA, 25 bp, Mus musculus
tggtttctctaggtattctcatggg

SEQ ID NO: 383804 - DNA, 25 bp, Mus musculus
tggtttctctaggtgtgagcatctt

SEQ ID NO: 383805 - DNA, 25 bp, Mus musculus
tggtttctcttgtccatctcagtcc

SEQ ID NO: 383806 - DNA, 25 bp, Mus musculus
tggtttctggtttgccagctccgga

SEQ ID NO: 383807 - DNA, 25 bp, Mus musculus
tggtttctggtttgtcaaagacata

SEQ ID NO: 383808 - DNA, 25 bp, Mus musculus
tggtttcttggtcagaagaagcgca

SEQ ID NO: 383809 - DNA, 25 bp, Mus musculus
tggtttgaaagtatccctggaagac

SEQ ID NO: 383810 - DNA, 25 bp, Mus musculus
tggtttgaagatcccaatacttctc

SEQ ID NO: 383811 - DNA, 25 bp, Mus musculus
tggtttgaaggtttggagtcgagat

SEQ ID NO: 383812 - DNA, 25 bp, Mus musculus
tggtttgcagcttcatggtttcaga

SEQ ID NO: 383813 - DNA, 25 bp, Mus musculus
tggtttgcagggatgcggtaaaaac

SEQ ID NO: 383814 - DNA, 25 bp, Mus musculus
tggtttgccctcaggttcattctga

SEQ ID NO: 383815 - DNA, 25 bp, Mus musculus
tggtttgcctcctgaataaaaagtc

SEQ ID NO: 383816 - DNA, 25 bp, Mus musculus
tggtttgcgaggctggagcaaaaca

SEQ ID NO: 383817 - DNA, 25 bp, Mus musculus
tggtttgcgtttgcagtatgaagtc

SEQ ID NO: 383818 - DNA, 25 bp, Mus musculus
tggtttgctcgccgcacctgcctca

SEQ ID NO: 383819 - DNA, 25 bp, Mus musculus
tggtttgctctgaagattgtgccca

SEQ ID NO: 383820 - DNA, 25 bp, Mus musculus
tggtttgctctgaaggtttcttttg

SEQ ID NO: 383821 - DNA, 25 bp, Mus musculus
tggtttggacaagatgtttaagaca

SEQ ID NO: 383822 - DNA, 25 bp, Mus musculus
tggtttgggaagggctgtcatgggg

SEQ ID NO: 383823 - DNA, 25 bp, Mus musculus
tggtttgtgagagaggctgtccgta

SEQ ID NO: 383824 - DNA, 25 bp, Mus musculus
tggtttgtgagagagttataaaaga

SEQ ID NO: 383825 - DNA, 25 bp, Mus musculus
tggtttgtgtggggttcactgatca

SEQ ID NO: 383826 - DNA, 25 bp, Mus musculus
tggtttgttttacagcatgtacatt

SEQ ID NO: 383827 - DNA, 25 bp, Mus musculus
tggtttgttttacagcctttcccat

SEQ ID NO: 383828 - DNA, 25 bp, Mus musculus
tggttttaaggctgtctgatcccac

SEQ ID NO: 383829 - DNA, 25 bp, Mus musculus
tggttttacggagtaagccatgaga

SEQ ID NO: 383830 - DNA, 25 bp, Mus musculus
tggttttactgagttgcactcactg

SEQ ID NO: 383831 - DNA, 25 bp, Mus musculus
tggttttcatccaggtggatcgcac

SEQ ID NO: 383832 - DNA, 25 bp, Mus musculus
tggttttcatgatcatccagtcctc

SEQ ID NO: 383833 - DNA, 25 bp, Mus musculus
tggttttcttgaccctgctttttgc

SEQ ID NO: 383834 - DNA, 25 bp, Mus musculus
tggttttgccctgcactcctgggca

SEQ ID NO: 383835 - DNA, 25 bp, Mus musculus
tggttttgccctgggctacggcgtg

SEQ ID NO: 383836 - DNA, 25 bp, Mus musculus
tggttttggaggctgataagctggc

SEQ ID NO: 383837 - DNA, 25 bp, Mus musculus
tggtttttgacagaccagccacacc

SEQ ID NO: 383838 - DNA, 25 bp, Mus musculus
tggtttttgacagcctcattaactt

SEQ ID NO: 383839 - DNA, 25 bp, Mus musculus
tgtaaaaagatggatcagtttgaca

SEQ ID NO: 383840 - DNA, 25 bp, Mus musculus
tgtaaaaattaatggtatcctaaag

SEQ ID NO: 383841 - DNA, 25 bp, Mus musculus
tgtaaaaattaatggttggctgcag

SEQ ID NO: 383842 - DNA, 25 bp, Mus musculus
tgtaaaacgagccctcagggattca

SEQ ID NO: 383843 - DNA, 25 bp, Mus musculus
tgtaaaactactgagaaggtccttt

SEQ ID NO: 383844 - DNA, 25 bp, Mus musculus
tgtaaaactactgtcctcggcccag

SEQ ID NO: 383845 - DNA, 25 bp, Mus musculus
tgtaaaactactgttttggtgaaaa

SEQ ID NO: 383846 - DNA, 25 bp, Mus musculus
tgtaaaatcagaggtccggaccgct

SEQ ID NO: 383847 - DNA, 25 bp, Mus musculus
tgtaaaatccccagatcccagcctc

SEQ ID NO: 383848 - DNA, 25 bp, Mus musculus
tgtaaaatccccagctattgcagat

SEQ ID NO: 383849 - DNA, 25 bp, Mus musculus
tgtaaaatccccaggtgtgactgca

SEQ ID NO: 383850 - DNA, 25 bp, Mus musculus
tgtaaaatctgggggttacaactaa

SEQ ID NO: 383851 - DNA, 25 bp, Mus musculus
tgtaaaatctgtgcactgaggccaa

SEQ ID NO: 383852 - DNA, 25 bp, Mus musculus
tgtaaacagagactcacttctgctg

SEQ ID NO: 383853 - DNA, 25 bp, Mus musculus
tgtaaacagataggtaccctactcg

SEQ ID NO: 383854 - DNA, 25 bp, Mus musculus
tgtaaaccaggtcactcctgtcccc

SEQ ID NO: 383855 - DNA, 25 bp, Mus musculus
tgtaaaccggaagaagttcagagtt

SEQ ID NO: 383856 - DNA, 25 bp, Mus musculus
tgtaaacctgaactatgacaatgaa

SEQ ID NO: 383857 - DNA, 25 bp, Mus musculus
tgtaaacctgttgccaagaactatg

SEQ ID NO: 383858 - DNA, 25 bp, Mus musculus
tgtaaagaagctggctgtgaacaca

SEQ ID NO: 383859 - DNA, 25 bp, Mus musculus
tgtaaagatcatgagacagaacttc

SEQ ID NO: 383860 - DNA, 25 bp, Mus musculus
tgtaaagcgatgattcccccgactc

SEQ ID NO: 383861 - DNA, 25 bp, Mus musculus
tgtaaaggtctcctggtcttatatc

SEQ ID NO: 383862 - DNA, 25 bp, Mus musculus
tgtaaagtatgtgggctggaaaaag

SEQ ID NO: 383863 - DNA, 25 bp, Mus musculus
tgtaaagtatgtggttctgctcatt

SEQ ID NO: 383864 - DNA, 25 bp, Mus musculus
tgtaaagtcccacacctacttcatt

SEQ ID NO: 383865 - DNA, 25 bp, Mus musculus
tgtaaagttgacagtcccacagtca

SEQ ID NO: 383866 - DNA, 25 bp, Mus musculus
tgtaaagtttcggaacaaggagccc

SEQ ID NO: 383867 - DNA, 25 bp, Mus musculus
tgtaaataggtttgagtacagtgat

SEQ ID NO: 383868 - DNA, 25 bp, Mus musculus
tgtaaatctaagatcaactatgggg

SEQ ID NO: 383869 - DNA, 25 bp, Mus musculus
tgtaaatgaaggaatatgctcagag

SEQ ID NO: 383870 - DNA, 25 bp, Mus musculus
tgtaaatgcagggtctcgtggttcc

SEQ ID NO: 383871 - DNA, 25 bp, Mus musculus
tgtaaatgcagtgattgatgatgca

SEQ ID NO: 383872 - DNA, 25 bp, Mus musculus
tgtaacaacaggaggcccagcctcg

SEQ ID NO: 383873 - DNA, 25 bp, Mus musculus
tgtaacaaggaggcttacagtgggt

SEQ ID NO: 383874 - DNA, 25 bp, Mus musculus
tgtaacaccaaaggcgacctggcga

SEQ ID NO: 383875 - DNA, 25 bp, Mus musculus
tgtaacagagggaaaacagttggag

SEQ ID NO: 383876 - DNA, 25 bp, Mus musculus
tgtaacagagggttcccatctcctg

SEQ ID NO: 383877 - DNA, 25 bp, Mus musculus
tgtaacagagggtttgaagatcaag

SEQ ID NO: 383878 - DNA, 25 bp, Mus musculus
tgtaacatcttctcacatcatggct

SEQ ID NO: 383879 - DNA, 25 bp, Mus musculus
tgtaaccaaagatgtcgcactggct

SEQ ID NO: 383880 - DNA, 25 bp, Mus musculus
tgtaaccatagatcgcaagccatga

SEQ ID NO: 383881 - DNA, 25 bp, Mus musculus
tgtaaccataggcccgaggacggtg

SEQ ID NO: 383882 - DNA, 25 bp, Mus musculus
tgtaaccatgaaaatcagaaaatgc

SEQ ID NO: 383883 - DNA, 25 bp, Mus musculus
tgtaacccagagatttattttatgt

SEQ ID NO: 383884 - DNA, 25 bp, Mus musculus
tgtaaccgtgggactcgatctgccc

SEQ ID NO: 383885 - DNA, 25 bp, Mus musculus
tgtaacgtaaggacaagatggcaac

SEQ ID NO: 383886 - DNA, 25 bp, Mus musculus
tgtaactacagaggcctccaggtgt

SEQ ID NO: 383887 - DNA, 25 bp, Mus musculus
tgtaactacagttgtgcccctgtct

SEQ ID NO: 383888 - DNA, 25 bp, Mus musculus
tgtaactcacaacggacgcctcctt

SEQ ID NO: 383889 - DNA, 25 bp, Mus musculus
tgtaactcacaacgggattgtcttg

SEQ ID NO: 383890 - DNA, 25 bp, Mus musculus
tgtaactcagaaagaagattataaa

SEQ ID NO: 383891 - DNA, 25 bp, Mus musculus
tgtaactccaggggcactatgaacg

SEQ ID NO: 383892 - DNA, 25 bp, Mus musculus
tgtaactcccgtgagcacttcattc

SEQ ID NO: 383893 - DNA, 25 bp, Mus musculus
tgtaactcccgtgaggttcttgtag

SEQ ID NO: 383894 - DNA, 25 bp, Mus musculus
tgtaactctggttttcttatccgca

SEQ ID NO: 383895 - DNA, 25 bp, Mus musculus
tgtaactgaggctttaacagaaaat

SEQ ID NO: 383896 - DNA, 25 bp, Mus musculus
tgtaactgcaaactcccacgtcctc

SEQ ID NO: 383897 - DNA, 25 bp, Mus musculus
tgtaactgcaaactgccacgtcctc

SEQ ID NO: 383898 - DNA, 25 bp, Mus musculus
tgtaactgttacgaaatctcataag

SEQ ID NO: 383899 - DNA, 25 bp, Mus musculus
tgtaactgttacgatccatcttttt

SEQ ID NO: 383900 - DNA, 25 bp, Mus musculus
tgtaactttctgcagcctccatctc

SEQ ID NO: 383901 - DNA, 25 bp, Mus musculus
tgtaagaaaagtgatgctgcatcaa

SEQ ID NO: 383902 - DNA, 25 bp, Mus musculus
tgtaagaaaatcatatgtgacaaat

SEQ ID NO: 383903 - DNA, 25 bp, Mus musculus
tgtaagaaggtcccaggtaaatcac

SEQ ID NO: 383904 - DNA, 25 bp, Mus musculus
tgtaagagcttgtgccattcctgcc

SEQ ID NO: 383905 - DNA, 25 bp, Mus musculus
tgtaagagcttgtgttattggattt

SEQ ID NO: 383906 - DNA, 25 bp, Mus musculus
tgtaagcactggggaaagcctttgc

SEQ ID NO: 383907 - DNA, 25 bp, Mus musculus
tgtaagcatggtcccctgtgtaggc

SEQ ID NO: 383908 - DNA, 25 bp, Mus musculus
tgtaagcccggccgaattcgaggac

SEQ ID NO: 383909 - DNA, 25 bp, Mus musculus
tgtaagcctcagaaggatgcgggct

SEQ ID NO: 383910 - DNA, 25 bp, Mus musculus
tgtaagccttgcatagtcccagaag

SEQ ID NO: 383911 - DNA, 25 bp, Mus musculus
tgtaagcggacatcagaaaagttcc

SEQ ID NO: 383912 - DNA, 25 bp, Mus musculus
tgtaagctgcagagaagctagaaac

SEQ ID NO: 383913 - DNA, 25 bp, Mus musculus
tgtaaggaaacacagatacctctga

SEQ ID NO: 383914 - DNA, 25 bp, Mus musculus
tgtaaggacaagggagttgtatttg

SEQ ID NO: 383915 - DNA, 25 bp, Mus musculus
tgtaaggacaaggtagactgggtac

SEQ ID NO: 383916 - DNA, 25 bp, Mus musculus
tgtaaggcccatcctttgtgagatc

SEQ ID NO: 383917 - DNA, 25 bp, Mus musculus
tgtaagtaccgagtgctgcttttga

SEQ ID NO: 383918 - DNA, 25 bp, Mus musculus
tgtaagtccctcttagagtttcaag

SEQ ID NO: 383919 - DNA, 25 bp, Mus musculus
tgtaagtgattctgcaaaaaatact

SEQ ID NO: 383920 - DNA, 25 bp, Mus musculus
tgtaagttaccatgcctgtctcctc

SEQ ID NO: 383921 - DNA, 25 bp, Mus musculus
tgtaagtttttcagaatttcttaat

SEQ ID NO: 383922 - DNA, 25 bp, Mus musculus
tgtaataaaaagaagctgaagtcat

SEQ ID NO: 383923 - DNA, 25 bp, Mus musculus
tgtaataaaaagatgccagcagagg

SEQ ID NO: 383924 - DNA, 25 bp, Mus musculus
tgtaataaagctgcgaagctggggt

SEQ ID NO: 383925 - DNA, 25 bp, Mus musculus
tgtaatagctgccactgaagctggg

SEQ ID NO: 383926 - DNA, 25 bp, Mus musculus
tgtaatagctgccactgacaaagca

SEQ ID NO: 383927 - DNA, 25 bp, Mus musculus
tgtaatagtgaagcagagccatgaa

SEQ ID NO: 383928 - DNA, 25 bp, Mus musculus
tgtaatcagcagctgttctcatatg

SEQ ID NO: 383929 - DNA, 25 bp, Mus musculus
tgtaatcattgacagattctttcta

SEQ ID NO: 383930 - DNA, 25 bp, Mus musculus
tgtaatcattgacagtcctgatgct

SEQ ID NO: 383931 - DNA, 25 bp, Mus musculus
tgtaatcattgagaatgaaaagaag

SEQ ID NO: 383932 - DNA, 25 bp, Mus musculus
tgtaatctcggattgtaagggccaa

SEQ ID NO: 383933 - DNA, 25 bp, Mus musculus
tgtaatcttgagaaaatgaaaatca

SEQ ID NO: 383934 - DNA, 25 bp, Mus musculus
tgtaatgaagaaaagtccatcataa

SEQ ID NO: 383935 - DNA, 25 bp, Mus musculus
tgtaatgaagacttgtgacacctgg

SEQ ID NO: 383936 - DNA, 25 bp, Mus musculus
tgtaatgaaggaaaatatctgcaga

SEQ ID NO: 383937 - DNA, 25 bp, Mus musculus
tgtaatgctttgtcggatatgaaga

SEQ ID NO: 383938 - DNA, 25 bp, Mus musculus
tgtaatggacgggcattttgttccc

SEQ ID NO: 383939 - DNA, 25 bp, Mus musculus
tgtaatggcagtttgagatggtatc

SEQ ID NO: 383940 - DNA, 25 bp, Mus musculus
tgtaatgtgagacctctgggtgagg

SEQ ID NO: 383941 - DNA, 25 bp, Mus musculus
tgtaatgtgagagattggtgtcctt

SEQ ID NO: 383942 - DNA, 25 bp, Mus musculus
tgtaattactttctggatgagcaga

SEQ ID NO: 383943 - DNA, 25 bp, Mus musculus
tgtaattcaggtgagcacctcctcc

SEQ ID NO: 383944 - DNA, 25 bp, Mus musculus
tgtaattccaactctggttgaccct

SEQ ID NO: 383945 - DNA, 25 bp, Mus musculus
tgtaattgtagctgatgaagagttt

SEQ ID NO: 383946 - DNA, 25 bp, Mus musculus
tgtaattgtaggtgccgcaccagtt

SEQ ID NO: 383947 - DNA, 25 bp, Mus musculus
tgtaatttaaccgcttggctgaaga

SEQ ID NO: 383948 - DNA, 25 bp, Mus musculus
tgtacaaaacgcccattttcctgaa

SEQ ID NO: 383949 - DNA, 25 bp, Mus musculus
tgtacaaaactgtgggaacctggat

SEQ ID NO: 383950 - DNA, 25 bp, Mus musculus
tgtacaaaagccctatagtcgctct

SEQ ID NO: 383951 - DNA, 25 bp, Mus musculus
tgtacaaaaggttgaagaaatggta

SEQ ID NO: 383952 - DNA, 25 bp, Mus musculus
tgtacaaaatatttggtgacttcac

SEQ ID NO: 383953 - DNA, 25 bp, Mus musculus
tgtacaaagaaatggcaaccagata

SEQ ID NO: 383954 - DNA, 25 bp, Mus musculus
tgtacaaagcaacaggtggaccgta

SEQ ID NO: 383955 - DNA, 25 bp, Mus musculus
tgtacaaataaaagtcttactccta

SEQ ID NO: 383956 - DNA, 25 bp, Mus musculus
tgtacaacagaatgaccagtgcctg

SEQ ID NO: 383957 - DNA, 25 bp, Mus musculus
tgtacaagattgggcagcccagaca

SEQ ID NO: 383958 - DNA, 25 bp, Mus musculus
tgtacaagattggtcaactcagatc

SEQ ID NO: 383959 - DNA, 25 bp, Mus musculus
tgtacaagctgaaccctcacctgtg

SEQ ID NO: 383960 - DNA, 25 bp, Mus musculus
tgtacaaggagggtgacaatagctt

SEQ ID NO: 383961 - DNA, 25 bp, Mus musculus
tgtacaagggccagatgctgcatat

SEQ ID NO: 383962 - DNA, 25 bp, Mus musculus
tgtacaataacaaagctgcagtgtt

SEQ ID NO: 383963 - DNA, 25 bp, Mus musculus
tgtacaatgaaaatcttgttcatat

SEQ ID NO: 383964 - DNA, 25 bp, Mus musculus
tgtacaatgagaaacatattcaaga

SEQ ID NO: 383965 - DNA, 25 bp, Mus musculus
tgtacacaagaagcagtcgttcccc

SEQ ID NO: 383966 - DNA, 25 bp, Mus musculus
tgtacacacaggtggtgacagtggc

SEQ ID NO: 383967 - DNA, 25 bp, Mus musculus
tgtacaccaggtcctgataagccct

SEQ ID NO: 383968 - DNA, 25 bp, Mus musculus
tgtacactaaggtaagaaatccagt

SEQ ID NO: 383969 - DNA, 25 bp, Mus musculus
tgtacactaggaagtcagaggcaaa

SEQ ID NO: 383970 - DNA, 25 bp, Mus musculus
tgtacactccaggagctgcagcccc

SEQ ID NO: 383971 - DNA, 25 bp, Mus musculus
tgtacactgacgaggatagtgccat

SEQ ID NO: 383972 - DNA, 25 bp, Mus musculus
tgtacactgacgtccagaaacgctg

SEQ ID NO: 383973 - DNA, 25 bp, Mus musculus
tgtacagaaagagtatgaaaagaca

SEQ ID NO: 383974 - DNA, 25 bp, Mus musculus
tgtacagaaagcaagatttgtcttc

SEQ ID NO: 383975 - DNA, 25 bp, Mus musculus
tgtacagaacagctaggactcagat

SEQ ID NO: 383976 - DNA, 25 bp, Mus musculus
tgtacagaacaggcaaagacaagaa

SEQ ID NO: 383977 - DNA, 25 bp, Mus musculus
tgtacagaagcagattaagcacatg

SEQ ID NO: 383978 - DNA, 25 bp, Mus musculus
tgtacagaagctgttgcaatacaag

SEQ ID NO: 383979 - DNA, 25 bp, Mus musculus
tgtacagaaggacctggtggctaac

SEQ ID NO: 383980 - DNA, 25 bp, Mus musculus
tgtacagaagtttgcccggctctcg

SEQ ID NO: 383981 - DNA, 25 bp, Mus musculus
tgtacagaattggacaaaatcccca

SEQ ID NO: 383982 - DNA, 25 bp, Mus musculus
tgtacagagacaggttgcttttaac

SEQ ID NO: 383983 - DNA, 25 bp, Mus musculus
tgtacagatgatggcgagtcattcg

SEQ ID NO: 383984 - DNA, 25 bp, Mus musculus
tgtacagcaggcaggcaaccttcag

SEQ ID NO: 383985 - DNA, 25 bp, Mus musculus
tgtacagggatggctaccagagacc

SEQ ID NO: 383986 - DNA, 25 bp, Mus musculus
tgtacaggtggggtttaggtcacaa

SEQ ID NO: 383987 - DNA, 25 bp, Mus musculus
tgtacagtacaggcaaatttccagg

SEQ ID NO: 383988 - DNA, 25 bp, Mus musculus
tgtacagtgacaggtatatctttgc

SEQ ID NO: 383989 - DNA, 25 bp, Mus musculus
tgtacagtgcaaaggtaatgctgat

SEQ ID NO: 383990 - DNA, 25 bp, Mus musculus
tgtacagtgcttctcagacacaaat

SEQ ID NO: 383991 - DNA, 25 bp, Mus musculus
tgtacagttccagaggcagcagtgg

SEQ ID NO: 383992 - DNA, 25 bp, Mus musculus
tgtacagttccagattcagcactta

SEQ ID NO: 383993 - DNA, 25 bp, Mus musculus
tgtacatgcagcagattcaagtcaa

SEQ ID NO: 383994 - DNA, 25 bp, Mus musculus
tgtacatggaggaatgtctataaca

SEQ ID NO: 383995 - DNA, 25 bp, Mus musculus
tgtacatgggatgctagccaacgac

SEQ ID NO: 383996 - DNA, 25 bp, Mus musculus
tgtaccaccggtaactaaatgacca

SEQ ID NO: 383997 - DNA, 25 bp, Mus musculus
tgtaccaccggtatccatgccagca

SEQ ID NO: 383998 - DNA, 25 bp, Mus musculus
tgtaccaccttcccaggaccagtca

SEQ ID NO: 383999 - DNA, 25 bp, Mus musculus
tgtaccactaaacgattggtgaccc

SEQ ID NO: 384000 - DNA, 25 bp, Mus musculus
tgtaccacttagatagttgaagtat

SEQ ID NO: 384001 - DNA, 25 bp, Mus musculus
tgtaccagaaataggagcagttgac

SEQ ID NO: 384002 - DNA, 25 bp, Mus musculus
tgtaccagagaactgaaaagctcca

SEQ ID NO: 384003 - DNA, 25 bp, Mus musculus
tgtaccagatcaaggtggttgaaga

SEQ ID NO: 384004 - DNA, 25 bp, Mus musculus
tgtaccaggagaaggtgaggtacac

SEQ ID NO: 384005 - DNA, 25 bp, Mus musculus
tgtaccatatcaagtttagagacgt

SEQ ID NO: 384006 - DNA, 25 bp, Mus musculus
tgtaccatcagctgactacccaggc

SEQ ID NO: 384007 - DNA, 25 bp, Mus musculus
tgtaccatcagctgagtgactgtgg

SEQ ID NO: 384008 - DNA, 25 bp, Mus musculus
tgtaccatccctgagatctggacct

SEQ ID NO: 384009 - DNA, 25 bp, Mus musculus
tgtaccatccgtgagatctggacct

SEQ ID NO: 384010 - DNA, 25 bp, Mus musculus
tgtaccattgcctatggcctgggcc

SEQ ID NO: 384011 - DNA, 25 bp, Mus musculus
tgtaccattgggcagcaagaagggc

SEQ ID NO: 384012 - DNA, 25 bp, Mus musculus
tgtacccaagagttgtcttggacac

SEQ ID NO: 384013 - DNA, 25 bp, Mus musculus
tgtacccaggcccaggtgttatctg

SEQ ID NO: 384014 - DNA, 25 bp, Mus musculus
tgtaccccaacaagaatcagcacac

SEQ ID NO: 384015 - DNA, 25 bp, Mus musculus
tgtaccccaacaagacccgtctaaa

SEQ ID NO: 384016 - DNA, 25 bp, Mus musculus
tgtaccccagctatcatgaacatag

SEQ ID NO: 384017 - DNA, 25 bp, Mus musculus
tgtaccccaggcattgggcatggag

SEQ ID NO: 384018 - DNA, 25 bp, Mus musculus
tgtaccccgaaagagctcctgggct

SEQ ID NO: 384019 - DNA, 25 bp, Mus musculus
tgtaccctatgataaaaactacagt

SEQ ID NO: 384020 - DNA, 25 bp, Mus musculus
tgtaccctatgcatctgcctctata

SEQ ID NO: 384021 - DNA, 25 bp, Mus musculus
tgtaccctccagctggaccctggag

SEQ ID NO: 384022 - DNA, 25 bp, Mus musculus
tgtacccttgccaaaagcggggagc

SEQ ID NO: 384023 - DNA, 25 bp, Mus musculus
tgtacccttgccaaggttcccagaa

SEQ ID NO: 384024 - DNA, 25 bp, Mus musculus
tgtacccttgtggaccagcagagaa

SEQ ID NO: 384025 - DNA, 25 bp, Mus musculus
tgtaccctttcatagattaccaagg

SEQ ID NO: 384026 - DNA, 25 bp, Mus musculus
tgtaccctttcatagctatgataag

SEQ ID NO: 384027 - DNA, 25 bp, Mus musculus
tgtaccgactttcacgatatgtgac

SEQ ID NO: 384028 - DNA, 25 bp, Mus musculus
tgtaccgggtcggagactgcaagtg

SEQ ID NO: 384029 - DNA, 25 bp, Mus musculus
tgtacctagaaggaagagaaaagag

SEQ ID NO: 384030 - DNA, 25 bp, Mus musculus
tgtacctataaccagacacgcagtg

SEQ ID NO: 384031 - DNA, 25 bp, Mus musculus
tgtacctataaccaggtgcagacac

SEQ ID NO: 384032 - DNA, 25 bp, Mus musculus
tgtacctatggagtaatggttcctg

SEQ ID NO: 384033 - DNA, 25 bp, Mus musculus
tgtacctatggatgtgctgggccag

SEQ ID NO: 384034 - DNA, 25 bp, Mus musculus
tgtacctatggcagggccaccaaag

SEQ ID NO: 384035 - DNA, 25 bp, Mus musculus
tgtacctccacgaggcgagcctgtc

SEQ ID NO: 384036 - DNA, 25 bp, Mus musculus
tgtacctcccacccttggactctcc

SEQ ID NO: 384037 - DNA, 25 bp, Mus musculus
tgtacctgattggactgcccgtggt

SEQ ID NO: 384038 - DNA, 25 bp, Mus musculus
tgtacctgcaactcaatcgtttact

SEQ ID NO: 384039 - DNA, 25 bp, Mus musculus
tgtacctgcaagaagaaagtcctct

SEQ ID NO: 384040 - DNA, 25 bp, Mus musculus
tgtacctgcagcctgcactggatgg

SEQ ID NO: 384041 - DNA, 25 bp, Mus musculus
tgtacctggtccaggataaatagga

SEQ ID NO: 384042 - DNA, 25 bp, Mus musculus
tgtaccttcaagggatttaaacgag

SEQ ID NO: 384043 - DNA, 25 bp, Mus musculus
tgtaccttcattacgtgcgaccctg

SEQ ID NO: 384044 - DNA, 25 bp, Mus musculus
tgtaccttcattgaactccaagatt

SEQ ID NO: 384045 - DNA, 25 bp, Mus musculus
tgtaccttggcaggagccaacagag

SEQ ID NO: 384046 - DNA, 25 bp, Mus musculus
tgtacgaagcagctccttaattgat

SEQ ID NO: 384047 - DNA, 25 bp, Mus musculus
tgtacgacgatgacgtggcgcagtg

SEQ ID NO: 384048 - DNA, 25 bp, Mus musculus
tgtacgatccaccaggtttgaggag

SEQ ID NO: 384049 - DNA, 25 bp, Mus musculus
tgtacgcaaaataataggaagaagg

SEQ ID NO: 384050 - DNA, 25 bp, Mus musculus
tgtacgcaaaatagttgaaaaacat

SEQ ID NO: 384051 - DNA, 25 bp, Mus musculus
tgtacgccaagaaatccaggaagta

SEQ ID NO: 384052 - DNA, 25 bp, Mus musculus
tgtacggcggagatgaagttggcgc

SEQ ID NO: 384053 - DNA, 25 bp, Mus musculus
tgtacggctgcgaggaagaagaaat

SEQ ID NO: 384054 - DNA, 25 bp, Mus musculus
tgtacggctgcgaggaattcatcag

SEQ ID NO: 384055 - DNA, 25 bp, Mus musculus
tgtacggtgttcagggactgctgac

SEQ ID NO: 384056 - DNA, 25 bp, Mus musculus
tgtacggtgttcaggtcactgcaag

SEQ ID NO: 384057 - DNA, 25 bp, Mus musculus
tgtacgtacacaggttttcctttgg

SEQ ID NO: 384058 - DNA, 25 bp, Mus musculus
tgtacgtgagcctggacagaccctc

SEQ ID NO: 384059 - DNA, 25 bp, Mus musculus
tgtacgtgttcaatgggcatgttca

SEQ ID NO: 384060 - DNA, 25 bp, Mus musculus
tgtactaaaaatagcccagaagaga

SEQ ID NO: 384061 - DNA, 25 bp, Mus musculus
tgtactacacagttcaacgggaagg

SEQ ID NO: 384062 - DNA, 25 bp, Mus musculus
tgtactacaccacagattatcagct

SEQ ID NO: 384063 - DNA, 25 bp, Mus musculus
tgtactagggaatattggcagctcc

SEQ ID NO: 384064 - DNA, 25 bp, Mus musculus
tgtactattggggagagagaaaaaa

SEQ ID NO: 384065 - DNA, 25 bp, Mus musculus
tgtactcaagactgcaggcgctaac

SEQ ID NO: 384066 - DNA, 25 bp, Mus musculus
tgtactcaaggagaatctgggagca

SEQ ID NO: 384067 - DNA, 25 bp, Mus musculus
tgtactcaagtcctggatcagtgag

SEQ ID NO: 384068 - DNA, 25 bp, Mus musculus
tgtactcagttaggatgaccattga

SEQ ID NO: 384069 - DNA, 25 bp, Mus musculus
tgtactcagttagtttcctatgatg

SEQ ID NO: 384070 - DNA, 25 bp, Mus musculus
tgtactccacgtgatccgaggaccc

SEQ ID NO: 384071 - DNA, 25 bp, Mus musculus
tgtactccctgagtggctatggagt

SEQ ID NO: 384072 - DNA, 25 bp, Mus musculus
tgtactcctggaccatgatgtgcct

SEQ ID NO: 384073 - DNA, 25 bp, Mus musculus
tgtactctcaaactagatttcctct

SEQ ID NO: 384074 - DNA, 25 bp, Mus musculus
tgtactctcgggaggtgttcctgct

SEQ ID NO: 384075 - DNA, 25 bp, Mus musculus
tgtactctgaaactagactctacag

SEQ ID NO: 384076 - DNA, 25 bp, Mus musculus
tgtactctgaaactctgccgagtgt

SEQ ID NO: 384077 - DNA, 25 bp, Mus musculus
tgtactgaaggatttctggtaggtc

SEQ ID NO: 384078 - DNA, 25 bp, Mus musculus
tgtactgaaggtctttgacgatggt

SEQ ID NO: 384079 - DNA, 25 bp, Mus musculus
tgtactgccaaggtcaaggctggtt

SEQ ID NO: 384080 - DNA, 25 bp, Mus musculus
tgtactgcgtggtgacatctcccat

SEQ ID NO: 384081 - DNA, 25 bp, Mus musculus
tgtactgctgactggttgcccattg

SEQ ID NO: 384082 - DNA, 25 bp, Mus musculus
tgtactggagaaaatgttttcagac

SEQ ID NO: 384083 - DNA, 25 bp, Mus musculus
tgtactggagacaggccgggtgacc

SEQ ID NO: 384084 - DNA, 25 bp, Mus musculus
tgtactggagagggtgtaacaaaat

SEQ ID NO: 384085 - DNA, 25 bp, Mus musculus
tgtactgtaagaggcttctcaggat

SEQ ID NO: 384086 - DNA, 25 bp, Mus musculus
tgtacttacatatataaataaataa

SEQ ID NO: 384087 - DNA, 25 bp, Mus musculus
tgtacttcaggccacagacttccct

SEQ ID NO: 384088 - DNA, 25 bp, Mus musculus
tgtacttcattgtacgatctttgcg

SEQ ID NO: 384089 - DNA, 25 bp, Mus musculus
tgtacttgactgaagtgtgcttttg

SEQ ID NO: 384090 - DNA, 25 bp, Mus musculus
tgtacttggagaggctccggctcac

SEQ ID NO: 384091 - DNA, 25 bp, Mus musculus
tgtactttgactcggtccctaccac

SEQ ID NO: 384092 - DNA, 25 bp, Mus musculus
tgtactttgactcgtgaagtcatca

SEQ ID NO: 384093 - DNA, 25 bp, Mus musculus
tgtactttgtgcaggtcccagccag

SEQ ID NO: 384094 - DNA, 25 bp, Mus musculus
tgtactttgtgcagtggctcgtggg

SEQ ID NO: 384095 - DNA, 25 bp, Mus musculus
tgtacttttcatcgtccaactttaa

SEQ ID NO: 384096 - DNA, 25 bp, Mus musculus
tgtagaaaaagggcttttcctagat

SEQ ID NO: 384097 - DNA, 25 bp, Mus musculus
tgtagaaaactgtggtgtcatggat

SEQ ID NO: 384098 - DNA, 25 bp, Mus musculus
tgtagaaaagatggcagcctttact

SEQ ID NO: 384099 - DNA, 25 bp, Mus musculus
tgtagaaaagattaatggggaatgg

SEQ ID NO: 384100 - DNA, 25 bp, Mus musculus
tgtagaaaaggggcatcgtctgcct

SEQ ID NO: 384101 - DNA, 25 bp, Mus musculus
tgtagaaacaaggtgctctgttgcc

SEQ ID NO: 384102 - DNA, 25 bp, Mus musculus
tgtagaaacgaaacgttgacaaaca

SEQ ID NO: 384103 - DNA, 25 bp, Mus musculus
tgtagaaataaagatgatcagtcag

SEQ ID NO: 384104 - DNA, 25 bp, Mus musculus
tgtagaacagattagtgggtattgg

SEQ ID NO: 384105 - DNA, 25 bp, Mus musculus
tgtagaacctgccctctgaccgtgc

SEQ ID NO: 384106 - DNA, 25 bp, Mus musculus
tgtagaactgctccaggctttcttc

SEQ ID NO: 384107 - DNA, 25 bp, Mus musculus
tgtagaagagcttagcctatcttca

SEQ ID NO: 384108 - DNA, 25 bp, Mus musculus
tgtagaagccatccgttctcgtgct

SEQ ID NO: 384109 - DNA, 25 bp, Mus musculus
tgtagaagctggtgggatgcaggca

SEQ ID NO: 384110 - DNA, 25 bp, Mus musculus
tgtagaaggcagaggtggcacggcg

SEQ ID NO: 384111 - DNA, 25 bp, Mus musculus
tgtagaagttgtcctagaatcgaat

SEQ ID NO: 384112 - DNA, 25 bp, Mus musculus
tgtagaattctcactggccggggcg

SEQ ID NO: 384113 - DNA, 25 bp, Mus musculus
tgtagacaccacgggtgctggtgac

SEQ ID NO: 384114 - DNA, 25 bp, Mus musculus
tgtagaccaaagcccatggcctagg

SEQ ID NO: 384115 - DNA, 25 bp, Mus musculus
tgtagaccaagtggtgtctaccatg

SEQ ID NO: 384116 - DNA, 25 bp, Mus musculus
tgtagacctggccttccctccgggt

SEQ ID NO: 384117 - DNA, 25 bp, Mus musculus
tgtagacgctcttttcagacccaag

SEQ ID NO: 384118 - DNA, 25 bp, Mus musculus
tgtagactccatagaactttccaaa

SEQ ID NO: 384119 - DNA, 25 bp, Mus musculus
tgtagactccataggaccttctgtc

SEQ ID NO: 384120 - DNA, 25 bp, Mus musculus
tgtagacttgaacagcattgaggat

SEQ ID NO: 384121 - DNA, 25 bp, Mus musculus
tgtagagaaagacatggagatgact

SEQ ID NO: 384122 - DNA, 25 bp, Mus musculus
tgtagagaaggccatcgcccactat

SEQ ID NO: 384123 - DNA, 25 bp, Mus musculus
tgtagagagccggaacaggtactta

SEQ ID NO: 384124 - DNA, 25 bp, Mus musculus
tgtagagagccggaaggataaagaa

SEQ ID NO: 384125 - DNA, 25 bp, Mus musculus
tgtagagatctcagtgcccttatgc

SEQ ID NO: 384126 - DNA, 25 bp, Mus musculus
tgtagagcaaggaaagaccgtagag

SEQ ID NO: 384127 - DNA, 25 bp, Mus musculus
tgtagagccaaacatccagaaccca

SEQ ID NO: 384128 - DNA, 25 bp, Mus musculus
tgtagagccacagaactgtcctggc

SEQ ID NO: 384129 - DNA, 25 bp, Mus musculus
tgtagagccacagagacagtgtttc

SEQ ID NO: 384130 - DNA, 25 bp, Mus musculus
tgtagagccacaggatctcaattca

SEQ ID NO: 384131 - DNA, 25 bp, Mus musculus
tgtagagccaggaagtgactgtgga

SEQ ID NO: 384132 - DNA, 25 bp, Mus musculus
tgtagagcccatcaggtggttgaag

SEQ ID NO: 384133 - DNA, 25 bp, Mus musculus
tgtagaggagctccaagtatgttag

SEQ ID NO: 384134 - DNA, 25 bp, Mus musculus
tgtagaggcagagccccactccaca

SEQ ID NO: 384135 - DNA, 25 bp, Mus musculus
tgtagagtgtaaattccccttttat

SEQ ID NO: 384136 - DNA, 25 bp, Mus musculus
tgtagatatggcagacgaggcatat

SEQ ID NO: 384137 - DNA, 25 bp, Mus musculus
tgtagatggagaatggtaccgcgcc

SEQ ID NO: 384138 - DNA, 25 bp, Mus musculus
tgtagatgtggaatggacagaccaa

SEQ ID NO: 384139 - DNA, 25 bp, Mus musculus
tgtagatgtggatgaaaagaatcag

SEQ ID NO: 384140 - DNA, 25 bp, Mus musculus
tgtagattctggtggctttgatgaa

SEQ ID NO: 384141 - DNA, 25 bp, Mus musculus
tgtagattctggtggtggacttctc

SEQ ID NO: 384142 - DNA, 25 bp, Mus musculus
tgtagcaacagaggaacatgtgtat

SEQ ID NO: 384143 - DNA, 25 bp, Mus musculus
tgtagcaccccaggtgttgactgtc

SEQ ID NO: 384144 - DNA, 25 bp, Mus musculus
tgtagcaccccagttcttgcaggtg

SEQ ID NO: 384145 - DNA, 25 bp, Mus musculus
tgtagcacctgagggatatgatgct

SEQ ID NO: 384146 - DNA, 25 bp, Mus musculus
tgtagcacctgagttctcactcaac

SEQ ID NO: 384147 - DNA, 25 bp, Mus musculus
tgtagcaggcagcaaagaagaatgg

SEQ ID NO: 384148 - DNA, 25 bp, Mus musculus
tgtagcagtgcaccacatatctacc

SEQ ID NO: 384149 - DNA, 25 bp, Mus musculus
tgtagcagttccagtcagctgcggg

SEQ ID NO: 384150 - DNA, 25 bp, Mus musculus
tgtagcatctgttgaattgtggaac

SEQ ID NO: 384151 - DNA, 25 bp, Mus musculus
tgtagcatctgttgacttgactgaa

SEQ ID NO: 384152 - DNA, 25 bp, Mus musculus
tgtagcatctgttgggccagagggc

SEQ ID NO: 384153 - DNA, 25 bp, Mus musculus
tgtagccaaagagactgcttctaaa

SEQ ID NO: 384154 - DNA, 25 bp, Mus musculus
tgtagccaagaccacatccttcaca

SEQ ID NO: 384155 - DNA, 25 bp, Mus musculus
tgtagccaaggtcagattacctgca

SEQ ID NO: 384156 - DNA, 25 bp, Mus musculus
tgtagccatcctcccgccacacctg

SEQ ID NO: 384157 - DNA, 25 bp, Mus musculus
tgtagcccaattccaagagatatgt

SEQ ID NO: 384158 - DNA, 25 bp, Mus musculus
tgtagcccagaaagtcctaggtggg

SEQ ID NO: 384159 - DNA, 25 bp, Mus musculus
tgtagccctagatcctttacaagcg

SEQ ID NO: 384160 - DNA, 25 bp, Mus musculus
tgtagccgaagcagatccacaactt

SEQ ID NO: 384161 - DNA, 25 bp, Mus musculus
tgtagccgaagcgatctgctaatgc

SEQ ID NO: 384162 - DNA, 25 bp, Mus musculus
tgtagcctacagatgaaaaacgact

SEQ ID NO: 384163 - DNA, 25 bp, Mus musculus
tgtagcctacaggtggcggaggacg

SEQ ID NO: 384164 - DNA, 25 bp, Mus musculus
tgtagcctcaggatgcctggtgtgc

SEQ ID NO: 384165 - DNA, 25 bp, Mus musculus
tgtagcctggaaggagctttggtta

SEQ ID NO: 384166 - DNA, 25 bp, Mus musculus
tgtagcctggaagggcatactttga

SEQ ID NO: 384167 - DNA, 25 bp, Mus musculus
tgtagcctttgagaggaacaaatgt

SEQ ID NO: 384168 - DNA, 25 bp, Mus musculus
tgtagcgatgaagaaagaggaacct

SEQ ID NO: 384169 - DNA, 25 bp, Mus musculus
tgtagcgctgcccgggatctccatc

SEQ ID NO: 384170 - DNA, 25 bp, Mus musculus
tgtagcggcagccaggacatagtca

SEQ ID NO: 384171 - DNA, 25 bp, Mus musculus
tgtagcggcagccagggaacatctc

SEQ ID NO: 384172 - DNA, 25 bp, Mus musculus
tgtagcggcagccaggtgcagggca

SEQ ID NO: 384173 - DNA, 25 bp, Mus musculus
tgtagcggcagccaggtgggatgct

SEQ ID NO: 384174 - DNA, 25 bp, Mus musculus
tgtagctcagaatgtgaagctcttg

SEQ ID NO: 384175 - DNA, 25 bp, Mus musculus
tgtagctcaggttcccctccagact

SEQ ID NO: 384176 - DNA, 25 bp, Mus musculus
tgtagctgaggagctcttccaggaa

SEQ ID NO: 384177 - DNA, 25 bp, Mus musculus
tgtagctgaggttcgttccaccagt

SEQ ID NO: 384178 - DNA, 25 bp, Mus musculus
tgtagctgctgctaactgtgtggtt

SEQ ID NO: 384179 - DNA, 25 bp, Mus musculus
tgtagctggaagagtatctgtggga

SEQ ID NO: 384180 - DNA, 25 bp, Mus musculus
tgtagctggaatgttacagaatttt

SEQ ID NO: 384181 - DNA, 25 bp, Mus musculus
tgtagctgttctagtaagcagaggg

SEQ ID NO: 384182 - DNA, 25 bp, Mus musculus
tgtaggaactgcaggacagtaatga

SEQ ID NO: 384183 - DNA, 25 bp, Mus musculus
tgtaggacaaaggtatggctttgtg

SEQ ID NO: 384184 - DNA, 25 bp, Mus musculus
tgtaggactttgagctgaggctgca

SEQ ID NO: 384185 - DNA, 25 bp, Mus musculus
tgtaggagaacagggcgtggtaccc

SEQ ID NO: 384186 - DNA, 25 bp, Mus musculus
tgtaggagaaggtccaacgggcgct

SEQ ID NO: 384187 - DNA, 25 bp, Mus musculus
tgtaggatacaggtgccctagctgt

SEQ ID NO: 384188 - DNA, 25 bp, Mus musculus
tgtaggatgtaggtgaattatactt

SEQ ID NO: 384189 - DNA, 25 bp, Mus musculus
tgtaggcagtctcatcaagcaatca

SEQ ID NO: 384190 - DNA, 25 bp, Mus musculus
tgtaggcatgccgggtggctttgct

SEQ ID NO: 384191 - DNA, 25 bp, Mus musculus
tgtaggccaggttgactcttcacca

SEQ ID NO: 384192 - DNA, 25 bp, Mus musculus
tgtaggcctcaactataagtcttgc

SEQ ID NO: 384193 - DNA, 25 bp, Mus musculus
tgtaggcggatcaaccccccttaag

SEQ ID NO: 384194 - DNA, 25 bp, Mus musculus
tgtaggcggatcaagatcagtataa

SEQ ID NO: 384195 - DNA, 25 bp, Mus musculus
tgtagggaatgaaaggtgatgaagt

SEQ ID NO: 384196 - DNA, 25 bp, Mus musculus
tgtagggctgcctctctggatgggt

SEQ ID NO: 384197 - DNA, 25 bp, Mus musculus
tgtagggctgttgccaaggcacctg

SEQ ID NO: 384198 - DNA, 25 bp, Mus musculus
tgtaggggtaaagatctaagctgga

SEQ ID NO: 384199 - DNA, 25 bp, Mus musculus
tgtaggtcagagtttttgtgccgca

SEQ ID NO: 384200 - DNA, 25 bp, Mus musculus
tgtaggtccgccggtttcaacctct

SEQ ID NO: 384201 - DNA, 25 bp, Mus musculus
tgtaggtgccctgcgggcttcgagg

SEQ ID NO: 384202 - DNA, 25 bp, Mus musculus
tgtaggtggaagtcttctatgagtg

SEQ ID NO: 384203 - DNA, 25 bp, Mus musculus
tgtagtactagtgaggccacaggca

SEQ ID NO: 384204 - DNA, 25 bp, Mus musculus
tgtagtactcattctgaatctagta

SEQ ID NO: 384205 - DNA, 25 bp, Mus musculus
tgtagtactcattcttcttttagct

SEQ ID NO: 384206 - DNA, 25 bp, Mus musculus
tgtagtatttaagaaaagtgagagg

SEQ ID NO: 384207 - DNA, 25 bp, Mus musculus
tgtagtcagtaagctgtggtgtacc

SEQ ID NO: 384208 - DNA, 25 bp, Mus musculus
tgtagtcccagcgagatggagttgc

SEQ ID NO: 384209 - DNA, 25 bp, Mus musculus
tgtagtcgcagaactgcactggcgt

SEQ ID NO: 384210 - DNA, 25 bp, Mus musculus
tgtagtctggggggtcagcagcctt

SEQ ID NO: 384211 - DNA, 25 bp, Mus musculus
tgtagtgaaaagctgcagcaatacc

SEQ ID NO: 384212 - DNA, 25 bp, Mus musculus
tgtagtgaagctatgccattgtgcg

SEQ ID NO: 384213 - DNA, 25 bp, Mus musculus
tgtagtgaagctccttggcgagcaa

SEQ ID NO: 384214 - DNA, 25 bp, Mus musculus
tgtagtgaggcagcagagtgaagtc

SEQ ID NO: 384215 - DNA, 25 bp, Mus musculus
tgtagtgatgctgcatgccatgaag

SEQ ID NO: 384216 - DNA, 25 bp, Mus musculus
tgtagtgcatgagtttccagatcca

SEQ ID NO: 384217 - DNA, 25 bp, Mus musculus
tgtagtggaagaagaatgactgtca

SEQ ID NO: 384218 - DNA, 25 bp, Mus musculus
tgtagtggaagagaaatcactgtca

SEQ ID NO: 384219 - DNA, 25 bp, Mus musculus
tgtagtggatcaggcactggcccag

SEQ ID NO: 384220 - DNA, 25 bp, Mus musculus
tgtagtggatccctgctgacaagga

SEQ ID NO: 384221 - DNA, 25 bp, Mus musculus
tgtagtggctctggcatgctgagcc

SEQ ID NO: 384222 - DNA, 25 bp, Mus musculus
tgtagtggtgctcaggcaagatggg

SEQ ID NO: 384223 - DNA, 25 bp, Mus musculus
tgtagtggtgctcagtggcagcatg

SEQ ID NO: 384224 - DNA, 25 bp, Mus musculus
tgtagtgttactcaggtaccagcgc

SEQ ID NO: 384225 - DNA, 25 bp, Mus musculus
tgtagttcagagtgtcaaaaccgct

SEQ ID NO: 384226 - DNA, 25 bp, Mus musculus
tgtagttctgtgcatctgggtggtc

SEQ ID NO: 384227 - DNA, 25 bp, Mus musculus
tgtagttgatctggtgtgttatcga

SEQ ID NO: 384228 - DNA, 25 bp, Mus musculus
tgtagttgattgggaatttggcagc

SEQ ID NO: 384229 - DNA, 25 bp, Mus musculus
tgtataaatgagtctgctattgata

SEQ ID NO: 384230 - DNA, 25 bp, Mus musculus
tgtataacaaggattctcaaagctg

SEQ ID NO: 384231 - DNA, 25 bp, Mus musculus
tgtataagactgtcatcaggaattt

SEQ ID NO: 384232 - DNA, 25 bp, Mus musculus
tgtataatcccaatgacagttctgc

SEQ ID NO: 384233 - DNA, 25 bp, Mus musculus
tgtataatgaaagcccagttcggaa

SEQ ID NO: 384234 - DNA, 25 bp, Mus musculus
tgtataatgagaaatgttgtcagag

SEQ ID NO: 384235 - DNA, 25 bp, Mus musculus
tgtatacaaaagcacaaaaggcaac

SEQ ID NO: 384236 - DNA, 25 bp, Mus musculus
tgtatacaaaagtcaggttttcagc

SEQ ID NO: 384237 - DNA, 25 bp, Mus musculus
tgtatacagaggagcattccggctg

SEQ ID NO: 384238 - DNA, 25 bp, Mus musculus
tgtatacagtggcccatcatggctg

SEQ ID NO: 384239 - DNA, 25 bp, Mus musculus
tgtataccaaggaggccaaattggg

SEQ ID NO: 384240 - DNA, 25 bp, Mus musculus
tgtataccaaggagtttctatgatt

SEQ ID NO: 384241 - DNA, 25 bp, Mus musculus
tgtataccagcacctgaggagaggt

SEQ ID NO: 384242 - DNA, 25 bp, Mus musculus
tgtataccaggaatttccacagtgc

SEQ ID NO: 384243 - DNA, 25 bp, Mus musculus
tgtatacgacgacccgtctcgatac

SEQ ID NO: 384244 - DNA, 25 bp, Mus musculus
tgtatacgacgactcgtccgtctcg

SEQ ID NO: 384245 - DNA, 25 bp, Mus musculus
tgtatacgacgatgttgagactgtg

SEQ ID NO: 384246 - DNA, 25 bp, Mus musculus
tgtatacttagacaaaagtcctcag

SEQ ID NO: 384247 - DNA, 25 bp, Mus musculus
tgtatagaagtgggaagatgcccga

SEQ ID NO: 384248 - DNA, 25 bp, Mus musculus
tgtatagagaaaacgtgaaaaaggt

SEQ ID NO: 384249 - DNA, 25 bp, Mus musculus
tgtatataacacttgacatctcaat

SEQ ID NO: 384250 - DNA, 25 bp, Mus musculus
tgtatataacacttgattctcattg

SEQ ID NO: 384251 - DNA, 25 bp, Mus musculus
tgtatatacaggaaaactcctcctt

SEQ ID NO: 384252 - DNA, 25 bp, Mus musculus
tgtatatattaggctatgtggtggt

SEQ ID NO: 384253 - DNA, 25 bp, Mus musculus
tgtatatcagacactgtcctgttgg

SEQ ID NO: 384254 - DNA, 25 bp, Mus musculus
tgtatatcatgcatccatttttgtt

SEQ ID NO: 384255 - DNA, 25 bp, Mus musculus
tgtatatccacagtcaagccctgct

SEQ ID NO: 384256 - DNA, 25 bp, Mus musculus
tgtatatctacaggtctgacaagac

SEQ ID NO: 384257 - DNA, 25 bp, Mus musculus
tgtatatctttaagcaacctcactt

SEQ ID NO: 384258 - DNA, 25 bp, Mus musculus
tgtatattcagggtcacagcttccc

SEQ ID NO: 384259 - DNA, 25 bp, Mus musculus
tgtatcaaaatttctatgaggagag

SEQ ID NO: 384260 - DNA, 25 bp, Mus musculus
tgtatcaaaccctacctgggggaat

SEQ ID NO: 384261 - DNA, 25 bp, Mus musculus
tgtatcaaacgctacctgggggaat

SEQ ID NO: 384262 - DNA, 25 bp, Mus musculus
tgtatcacagctgcctcatatacag

SEQ ID NO: 384263 - DNA, 25 bp, Mus musculus
tgtatcaccgtccagatccccaccc

SEQ ID NO: 384264 - DNA, 25 bp, Mus musculus
tgtatcaccgtccaggtctgggtgg

SEQ ID NO: 384265 - DNA, 25 bp, Mus musculus
tgtatcacttgatattaaactaacc

SEQ ID NO: 384266 - DNA, 25 bp, Mus musculus
tgtatcacttgggtgagaatgcctg

SEQ ID NO: 384267 - DNA, 25 bp, Mus musculus
tgtatcagaggacctcagaatacat

SEQ ID NO: 384268 - DNA, 25 bp, Mus musculus
tgtatcagatgcaggttgcgttaca

SEQ ID NO: 384269 - DNA, 25 bp, Mus musculus
tgtatcagcaactgacaggggagca

SEQ ID NO: 384270 - DNA, 25 bp, Mus musculus
tgtatcagctgcgaatccctcgtgg

SEQ ID NO: 384271 - DNA, 25 bp, Mus musculus
tgtatccaaaagaaatccagagaga

SEQ ID NO: 384272 - DNA, 25 bp, Mus musculus
tgtatccaaaagcaaatttcgcaga

SEQ ID NO: 384273 - DNA, 25 bp, Mus musculus
tgtatccaagggagcccaggaagtc

SEQ ID NO: 384274 - DNA, 25 bp, Mus musculus
tgtatccagaggaagttgtcctggt

SEQ ID NO: 384275 - DNA, 25 bp, Mus musculus
tgtatccagaggatgttgggcaggg

SEQ ID NO: 384276 - DNA, 25 bp, Mus musculus
tgtatccaggtcacccagatctctg

SEQ ID NO: 384277 - DNA, 25 bp, Mus musculus
tgtatccataggagttttaaagcca

SEQ ID NO: 384278 - DNA, 25 bp, Mus musculus
tgtatccataggatttacatggata

SEQ ID NO: 384279 - DNA, 25 bp, Mus musculus
tgtatccctgttgctgagctggtga

SEQ ID NO: 384280 - DNA, 25 bp, Mus musculus
tgtatccgcccaacaggcgctgtga

SEQ ID NO: 384281 - DNA, 25 bp, Mus musculus
tgtatccgcccaacatgccacctta

SEQ ID NO: 384282 - DNA, 25 bp, Mus musculus
tgtatcctcagttcatgttccatct

SEQ ID NO: 384283 - DNA, 25 bp, Mus musculus
tgtatcctgagagacaggcaatacc

SEQ ID NO: 384284 - DNA, 25 bp, Mus musculus
tgtatcgacagttctgtaagcatca

SEQ ID NO: 384285 - DNA, 25 bp, Mus musculus
tgtatcggaggacaccaaagtgaat

SEQ ID NO: 384286 - DNA, 25 bp, Mus musculus
tgtatctacgggcaggctcccggac

SEQ ID NO: 384287 - DNA, 25 bp, Mus musculus
tgtatctcaacagcaagctgcctag

SEQ ID NO: 384288 - DNA, 25 bp, Mus musculus
tgtatctcaccattgttataataaa

SEQ ID NO: 384289 - DNA, 25 bp, Mus musculus
tgtatctctctctgtggaggtgaag

SEQ ID NO: 384290 - DNA, 25 bp, Mus musculus
tgtatctctttcaggtagagcttga

SEQ ID NO: 384291 - DNA, 25 bp, Mus musculus
tgtatctctttcagtatcctgtgcg

SEQ ID NO: 384292 - DNA, 25 bp, Mus musculus
tgtatctggtgctctaccttagcag

SEQ ID NO: 384293 - DNA, 25 bp, Mus musculus
tgtatctggtgctctaccttcaggc

SEQ ID NO: 384294 - DNA, 25 bp, Mus musculus
tgtatctgtctgcaggtgttatttc

SEQ ID NO: 384295 - DNA, 25 bp, Mus musculus
tgtatcttcgggctcgctgcccacc

SEQ ID NO: 384296 - DNA, 25 bp, Mus musculus
tgtatgaaaaccgacctatgtcacc

SEQ ID NO: 384297 - DNA, 25 bp, Mus musculus
tgtatgaaaaccgacttccagatta

SEQ ID NO: 384298 - DNA, 25 bp, Mus musculus
tgtatgaaacctgggactttactgg

SEQ ID NO: 384299 - DNA, 25 bp, Mus musculus
tgtatgaaagcctgtcagccggatg

SEQ ID NO: 384300 - DNA, 25 bp, Mus musculus
tgtatgaaaggctgtcagccggatg

SEQ ID NO: 384301 - DNA, 25 bp, Mus musculus
tgtatgaaatcagccacaccttcaa

SEQ ID NO: 384302 - DNA, 25 bp, Mus musculus
tgtatgacatccagtcaccagattt

SEQ ID NO: 384303 - DNA, 25 bp, Mus musculus
tgtatgaccagaattatcccatcca

SEQ ID NO: 384304 - DNA, 25 bp, Mus musculus
tgtatgacgaggagacccgcatcct

SEQ ID NO: 384305 - DNA, 25 bp, Mus musculus
tgtatgacgttgctgatcactggag

SEQ ID NO: 384306 - DNA, 25 bp, Mus musculus
tgtatgagaagctgaagcagtcgca

SEQ ID NO: 384307 - DNA, 25 bp, Mus musculus
tgtatgagatggaagctgccactga

SEQ ID NO: 384308 - DNA, 25 bp, Mus musculus
tgtatgagctggatagagagatgaa

SEQ ID NO: 384309 - DNA, 25 bp, Mus musculus
tgtatgaggcagccatctccattct

SEQ ID NO: 384310 - DNA, 25 bp, Mus musculus
tgtatgaggcagggctcattttcac

SEQ ID NO: 384311 - DNA, 25 bp, Mus musculus
tgtatgagtggcctcgaactcagaa

SEQ ID NO: 384312 - DNA, 25 bp, Mus musculus
tgtatgatccacaggccctttggag

SEQ ID NO: 384313 - DNA, 25 bp, Mus musculus
tgtatgatgaggagacccgcatcct

SEQ ID NO: 384314 - DNA, 25 bp, Mus musculus
tgtatgcacacagtggatgaagaag

SEQ ID NO: 384315 - DNA, 25 bp, Mus musculus
tgtatgcacacagtggtaccgtttt

SEQ ID NO: 384316 - DNA, 25 bp, Mus musculus
tgtatgcactcctcccagcagttat

SEQ ID NO: 384317 - DNA, 25 bp, Mus musculus
tgtatgcactcctggatatccggcg

SEQ ID NO: 384318 - DNA, 25 bp, Mus musculus
tgtatgccaagagcaagaaagtatg

SEQ ID NO: 384319 - DNA, 25 bp, Mus musculus
tgtatgccaagaggaataaaaggaa

SEQ ID NO: 384320 - DNA, 25 bp, Mus musculus
tgtatgccacatgagtctttcaatg

SEQ ID NO: 384321 - DNA, 25 bp, Mus musculus
tgtatgccagcatgtctgattgcct

SEQ ID NO: 384322 - DNA, 25 bp, Mus musculus
tgtatgcgcaaggcttcattctcat

SEQ ID NO: 384323 - DNA, 25 bp, Mus musculus
tgtatgctacaaaggaaagaattga

SEQ ID NO: 384324 - DNA, 25 bp, Mus musculus
tgtatgctagttcactttaattgag

SEQ ID NO: 384325 - DNA, 25 bp, Mus musculus
tgtatggaaagatggcctctgcaca

SEQ ID NO: 384326 - DNA, 25 bp, Mus musculus
tgtatggaagagttactttggagta

SEQ ID NO: 384327 - DNA, 25 bp, Mus musculus
tgtatggaagatctctgcgatatga

SEQ ID NO: 384328 - DNA, 25 bp, Mus musculus
tgtatggcaaggatttaattaaaga

SEQ ID NO: 384329 - DNA, 25 bp, Mus musculus
tgtatggcaaggctggccttctaag

SEQ ID NO: 384330 - DNA, 25 bp, Mus musculus
tgtatggcacgaatgaggaagagtg

SEQ ID NO: 384331 - DNA, 25 bp, Mus musculus
tgtatggcgagatagaccatgcctt

SEQ ID NO: 384332 - DNA, 25 bp, Mus musculus
tgtatggcgagattttcagtttaga

SEQ ID NO: 384333 - DNA, 25 bp, Mus musculus
tgtatggctactatactctgtattc

SEQ ID NO: 384334 - DNA, 25 bp, Mus musculus
tgtatgggggcaggtggctttgtgg

SEQ ID NO: 384335 - DNA, 25 bp, Mus musculus
tgtatggtctcgagatgaagatatc

SEQ ID NO: 384336 - DNA, 25 bp, Mus musculus
tgtatggtctcgagcagcagtgaag

SEQ ID NO: 384337 - DNA, 25 bp, Mus musculus
tgtatggtgccgtgttctcgaaaag

SEQ ID NO: 384338 - DNA, 25 bp, Mus musculus
tgtatgtatacaggtttgttaactg

SEQ ID NO: 384339 - DNA, 25 bp, Mus musculus
tgtatgtatacgacaccacggcgac

SEQ ID NO: 384340 - DNA, 25 bp, Mus musculus
tgtatgtatacgatccccccacaac

SEQ ID NO: 384341 - DNA, 25 bp, Mus musculus
tgtatgtatacgcaccaccaccacc

SEQ ID NO: 384342 - DNA, 25 bp, Mus musculus
tgtatgtcttggtggtcactaactg

SEQ ID NO: 384343 - DNA, 25 bp, Mus musculus
tgtatgtgttgaggaggagagaaca

SEQ ID NO: 384344 - DNA, 25 bp, Mus musculus
tgtattaaagatccaaaaggtaatt

SEQ ID NO: 384345 - DNA, 25 bp, Mus musculus
tgtattaaagggtatgatgtgattg

SEQ ID NO: 384346 - DNA, 25 bp, Mus musculus
tgtattaagaggagtgtctccaatc

SEQ ID NO: 384347 - DNA, 25 bp, Mus musculus
tgtattaagagttccgaggtgataa

SEQ ID NO: 384348 - DNA, 25 bp, Mus musculus
tgtattaattagaggaggttcgcct

SEQ ID NO: 384349 - DNA, 25 bp, Mus musculus
tgtattacagagtgatggcgtgcag

SEQ ID NO: 384350 - DNA, 25 bp, Mus musculus
tgtattacagcagcaatattcacaa

SEQ ID NO: 384351 - DNA, 25 bp, Mus musculus
tgtattactggcccggctgtgaagt

SEQ ID NO: 384352 - DNA, 25 bp, Mus musculus
tgtattagaaaaggaaactgcattc

SEQ ID NO: 384353 - DNA, 25 bp, Mus musculus
tgtattagaaaagtctctccagagg

SEQ ID NO: 384354 - DNA, 25 bp, Mus musculus
tgtattagagggaattctgcctttg

SEQ ID NO: 384355 - DNA, 25 bp, Mus musculus
tgtattagaggttcataagccagaa

SEQ ID NO: 384356 - DNA, 25 bp, Mus musculus
tgtattagaggttggcaggaaggta

SEQ ID NO: 384357 - DNA, 25 bp, Mus musculus
tgtattatcgttatgagtattggag

SEQ ID NO: 384358 - DNA, 25 bp, Mus musculus
tgtattattttatggatattcatta

SEQ ID NO: 384359 - DNA, 25 bp, Mus musculus
tgtattatttttttggccatattcc

SEQ ID NO: 384360 - DNA, 25 bp, Mus musculus
tgtattcaaagaacttagtagtcag

SEQ ID NO: 384361 - DNA, 25 bp, Mus musculus
tgtattcaagatgctggagacttgg

SEQ ID NO: 384362 - DNA, 25 bp, Mus musculus
tgtattcaaggtctgcgacgagccc

SEQ ID NO: 384363 - DNA, 25 bp, Mus musculus
tgtattcacgtagggtgatatggga

SEQ ID NO: 384364 - DNA, 25 bp, Mus musculus
tgtattccagaatgcccatatcaca

SEQ ID NO: 384365 - DNA, 25 bp, Mus musculus
tgtattccagcatccagaattcaag

SEQ ID NO: 384366 - DNA, 25 bp, Mus musculus
tgtattccaggcgttacaatattta

SEQ ID NO: 384367 - DNA, 25 bp, Mus musculus
tgtattccatagggatccaagccta

SEQ ID NO: 384368 - DNA, 25 bp, Mus musculus
tgtattccatagggcatgccttcag

SEQ ID NO: 384369 - DNA, 25 bp, Mus musculus
tgtattcccaggacccacattgtgg

SEQ ID NO: 384370 - DNA, 25 bp, Mus musculus
tgtattctcagttcctgtagttgct

SEQ ID NO: 384371 - DNA, 25 bp, Mus musculus
tgtattctgatgatgttgctttccc

SEQ ID NO: 384372 - DNA, 25 bp, Mus musculus
tgtattctgcaaaaccttatgcaca

SEQ ID NO: 384373 - DNA, 25 bp, Mus musculus
tgtattctgcaaacttcaagcacaa

SEQ ID NO: 384374 - DNA, 25 bp, Mus musculus
tgtattgcagagctgtttgacagcg

SEQ ID NO: 384375 - DNA, 25 bp, Mus musculus
tgtattgcagcttctagagctgttt

SEQ ID NO: 384376 - DNA, 25 bp, Mus musculus
tgtattggataagaccaccgctctt

SEQ ID NO: 384377 - DNA, 25 bp, Mus musculus
tgtattggctggatcccaagtcttc

SEQ ID NO: 384378 - DNA, 25 bp, Mus musculus
tgtatttaagaatgcaccaaacaaa

SEQ ID NO: 384379 - DNA, 25 bp, Mus musculus
tgtatttaaggcccatctccgagtt

SEQ ID NO: 384380 - DNA, 25 bp, Mus musculus
tgtatttaaggttcttggacttgct

SEQ ID NO: 384381 - DNA, 25 bp, Mus musculus
tgtatttacagatttatgacattca

SEQ ID NO: 384382 - DNA, 25 bp, Mus musculus
tgtatttacaggatcttgctgcata

SEQ ID NO: 384383 - DNA, 25 bp, Mus musculus
tgtatttatccaaaggtgttttaca

SEQ ID NO: 384384 - DNA, 25 bp, Mus musculus
tgtatttgtggggtaatcaggaagc

SEQ ID NO: 384385 - DNA, 25 bp, Mus musculus
tgtattttaggtacattttatgatt

SEQ ID NO: 384386 - DNA, 25 bp, Mus musculus
tgtattttctcaggtgtgcatgtag

SEQ ID NO: 384387 - DNA, 25 bp, Mus musculus
tgtattttggggtgagcgtggacag

SEQ ID NO: 384388 - DNA, 25 bp, Mus musculus
tgtcaaaaaggtatggttccgaccg

SEQ ID NO: 384389 - DNA, 25 bp, Mus musculus
tgtcaaaacctgggcaagatccggg

SEQ ID NO: 384390 - DNA, 25 bp, Mus musculus
tgtcaaaactgcaagttgcacccag

SEQ ID NO: 384391 - DNA, 25 bp, Mus musculus
tgtcaaaacttggctcttgaccgca

SEQ ID NO: 384392 - DNA, 25 bp, Mus musculus
tgtcaaaccagggttctctaaatgc

SEQ ID NO: 384393 - DNA, 25 bp, Mus musculus
tgtcaaaccaggttaaggagctccg

SEQ ID NO: 384394 - DNA, 25 bp, Mus musculus
tgtcaaacccaaggtatggaagact

SEQ ID NO: 384395 - DNA, 25 bp, Mus musculus
tgtcaaacttcagagtgaatgccat

SEQ ID NO: 384396 - DNA, 25 bp, Mus musculus
tgtcaaagactgccttactaaagat

SEQ ID NO: 384397 - DNA, 25 bp, Mus musculus
tgtcaaagagctgggtctctccagt

SEQ ID NO: 384398 - DNA, 25 bp, Mus musculus
tgtcaaagaggtacagcagggtggc

SEQ ID NO: 384399 - DNA, 25 bp, Mus musculus
tgtcaaagatcaattatcatgtaga

SEQ ID NO: 384400 - DNA, 25 bp, Mus musculus
tgtcaaagatcatttatcatgtaga

SEQ ID NO: 384401 - DNA, 25 bp, Mus musculus
tgtcaaagcagacagaatttcagca

SEQ ID NO: 384402 - DNA, 25 bp, Mus musculus
tgtcaaagcagacaggttcagctcc

SEQ ID NO: 384403 - DNA, 25 bp, Mus musculus
tgtcaaagcccaagaaatagcagac

SEQ ID NO: 384404 - DNA, 25 bp, Mus musculus
tgtcaaagcccaaggacatgggaga

SEQ ID NO: 384405 - DNA, 25 bp, Mus musculus
tgtcaaaggatggctccggtgagga

SEQ ID NO: 384406 - DNA, 25 bp, Mus musculus
tgtcaaaggatggtggtgtgcgaat

SEQ ID NO: 384407 - DNA, 25 bp, Mus musculus
tgtcaaataaaaatccatggagctt

SEQ ID NO: 384408 - DNA, 25 bp, Mus musculus
tgtcaaatatggacctgggtcgctt

SEQ ID NO: 384409 - DNA, 25 bp, Mus musculus
tgtcaaatatggccaccaggccttg

SEQ ID NO: 384410 - DNA, 25 bp, Mus musculus
tgtcaaatcaagatgtcattaaagc

SEQ ID NO: 384411 - DNA, 25 bp, Mus musculus
tgtcaacaagctcattcagttcctg

SEQ ID NO: 384412 - DNA, 25 bp, Mus musculus
tgtcaacaaggtctaggaaaccttc

SEQ ID NO: 384413 - DNA, 25 bp, Mus musculus
tgtcaacagccgcctggtttaccat

SEQ ID NO: 384414 - DNA, 25 bp, Mus musculus
tgtcaacagccggtgataactccct

SEQ ID NO: 384415 - DNA, 25 bp, Mus musculus
tgtcaacagcgtgagcaccactctg

SEQ ID NO: 384416 - DNA, 25 bp, Mus musculus
tgtcaacattcaggagcagagccca

SEQ ID NO: 384417 - DNA, 25 bp, Mus musculus
tgtcaacattcagtacacactgcgc

SEQ ID NO: 384418 - DNA, 25 bp, Mus musculus
tgtcaaccaggaacctggctcaccg

SEQ ID NO: 384419 - DNA, 25 bp, Mus musculus
tgtcaaccctgaagatattgtgaac

SEQ ID NO: 384420 - DNA, 25 bp, Mus musculus
tgtcaaccgacccccaggctcaaca

SEQ ID NO: 384421 - DNA, 25 bp, Mus musculus
tgtcaacctgtcaggtgactcaagt

SEQ ID NO: 384422 - DNA, 25 bp, Mus musculus
tgtcaacctgtcaggtgactccaat

SEQ ID NO: 384423 - DNA, 25 bp, Mus musculus
tgtcaacgaggaaatgttgtccttc

SEQ ID NO: 384424 - DNA, 25 bp, Mus musculus
tgtcaacgaggtccccggacctcca

SEQ ID NO: 384425 - DNA, 25 bp, Mus musculus
tgtcaacggcttgtctgtgccacca

SEQ ID NO: 384426 - DNA, 25 bp, Mus musculus
tgtcaactctcccagggctttctga

SEQ ID NO: 384427 - DNA, 25 bp, Mus musculus
tgtcaactgacaggccataaaatca

SEQ ID NO: 384428 - DNA, 25 bp, Mus musculus
tgtcaagaacaaggcccagtctgtg

SEQ ID NO: 384429 - DNA, 25 bp, Mus musculus
tgtcaagaacagctggggaagtgaa

SEQ ID NO: 384430 - DNA, 25 bp, Mus musculus
tgtcaagaccaaacggcccccttga

SEQ ID NO: 384431 - DNA, 25 bp, Mus musculus
tgtcaagattgagattcccctcttc

SEQ ID NO: 384432 - DNA, 25 bp, Mus musculus
tgtcaagcacggggcgggggcagag

SEQ ID NO: 384433 - DNA, 25 bp, Mus musculus
tgtcaagcagatgagacaaggagcc

SEQ ID NO: 384434 - DNA, 25 bp, Mus musculus
tgtcaagccaaacatccagaaccca

SEQ ID NO: 384435 - DNA, 25 bp, Mus musculus
tgtcaagctcgaaccagcccctccg

SEQ ID NO: 384436 - DNA, 25 bp, Mus musculus
tgtcaagctgagactgttggtgaaa

SEQ ID NO: 384437 - DNA, 25 bp, Mus musculus
tgtcaaggcggcccagaccagtgac

SEQ ID NO: 384438 - DNA, 25 bp, Mus musculus
tgtcaaggttcaggtcttatatcca

SEQ ID NO: 384439 - DNA, 25 bp, Mus musculus
tgtcaagtacgagctttatggccac

SEQ ID NO: 384440 - DNA, 25 bp, Mus musculus
tgtcaagtcatttcctgtagaagac

SEQ ID NO: 384441 - DNA, 25 bp, Mus musculus
tgtcaagtcgatgagcagtttgcag

SEQ ID NO: 384442 - DNA, 25 bp, Mus musculus
tgtcaagtttcagcctcttagcaag

SEQ ID NO: 384443 - DNA, 25 bp, Mus musculus
tgtcaagtttcaggacacacaggac

SEQ ID NO: 384444 - DNA, 25 bp, Mus musculus
tgtcaataaggtaatgttagcagaa

SEQ ID NO: 384445 - DNA, 25 bp, Mus musculus
tgtcaatactacatttatgatctgc

SEQ ID NO: 384446 - DNA, 25 bp, Mus musculus
tgtcaatatgaagagtaaagatggg

SEQ ID NO: 384447 - DNA, 25 bp, Mus musculus
tgtcaatatgagaagaacaaacacc

SEQ ID NO: 384448 - DNA, 25 bp, Mus musculus
tgtcaatatgatataaatgaatgtg

SEQ ID NO: 384449 - DNA, 25 bp, Mus musculus
tgtcaatcaatggtgtcccagatga

SEQ ID NO: 384450 - DNA, 25 bp, Mus musculus
tgtcaatcacaacttgaaagatgcc

SEQ ID NO: 384451 - DNA, 25 bp, Mus musculus
tgtcaatcagcacaatgctccagtt

SEQ ID NO: 384452 - DNA, 25 bp, Mus musculus
tgtcaatcataaggatgagaacaag

SEQ ID NO: 384453 - DNA, 25 bp, Mus musculus
tgtcaatcataagggcgagatgtgt

SEQ ID NO: 384454 - DNA, 25 bp, Mus musculus
tgtcaatctgaaagagttcttgcct

SEQ ID NO: 384455 - DNA, 25 bp, Mus musculus
tgtcaatctgaaaggtacccagaac

SEQ ID NO: 384456 - DNA, 25 bp, Mus musculus
tgtcaatctggtacaccaggggttg

SEQ ID NO: 384457 - DNA, 25 bp, Mus musculus
tgtcaatgaggcagaattccacctg

SEQ ID NO: 384458 - DNA, 25 bp, Mus musculus
tgtcaatgcagcccagatggagctc

SEQ ID NO: 384459 - DNA, 25 bp, Mus musculus
tgtcaatgcagcttgttttagccca

SEQ ID NO: 384460 - DNA, 25 bp, Mus musculus
tgtcaatgcaggcgacctggcattc

SEQ ID NO: 384461 - DNA, 25 bp, Mus musculus
tgtcaatgcccccaaccccatccaa

SEQ ID NO: 384462 - DNA, 25 bp, Mus musculus
tgtcaattcacaccgaaactatgtt

SEQ ID NO: 384463 - DNA, 25 bp, Mus musculus
tgtcacaaaggaagttgttcaaggg

SEQ ID NO: 384464 - DNA, 25 bp, Mus musculus
tgtcacaacagctcgcaatgccctg

SEQ ID NO: 384465 - DNA, 25 bp, Mus musculus
tgtcacaagaaagaagagccaagtg

SEQ ID NO: 384466 - DNA, 25 bp, Mus musculus
tgtcacaagcagtcatgaaagtcca

SEQ ID NO: 384467 - DNA, 25 bp, Mus musculus
tgtcacaagcagtctgaccaaggac

SEQ ID NO: 384468 - DNA, 25 bp, Mus musculus
tgtcacaaggcagccatggaatttc

SEQ ID NO: 384469 - DNA, 25 bp, Mus musculus
tgtcacaaggcaggggcaagcggat

SEQ ID NO: 384470 - DNA, 25 bp, Mus musculus
tgtcacacagatccagctgagctca

SEQ ID NO: 384471 - DNA, 25 bp, Mus musculus
tgtcacacagatttttggagacagt

SEQ ID NO: 384472 - DNA, 25 bp, Mus musculus
tgtcacacagcactcatgaacacta

SEQ ID NO: 384473 - DNA, 25 bp, Mus musculus
tgtcacactgaagctcgcactggac

SEQ ID NO: 384474 - DNA, 25 bp, Mus musculus
tgtcacactgaaggccgttcctcag

SEQ ID NO: 384475 - DNA, 25 bp, Mus musculus
tgtcacagaagagaagagttgatac

SEQ ID NO: 384476 - DNA, 25 bp, Mus musculus
tgtcacagagcacttttaataaccc

SEQ ID NO: 384477 - DNA, 25 bp, Mus musculus
tgtcacagagcagaatgattggcag

SEQ ID NO: 384478 - DNA, 25 bp, Mus musculus
tgtcacagagcagttttaataaccc

SEQ ID NO: 384479 - DNA, 25 bp, Mus musculus
tgtcacagcacggtctctctgctcc

SEQ ID NO: 384480 - DNA, 25 bp, Mus musculus
tgtcacaggattcagctctgtttcc

SEQ ID NO: 384481 - DNA, 25 bp, Mus musculus
tgtcacaggattcaggccactaaac

SEQ ID NO: 384482 - DNA, 25 bp, Mus musculus
tgtcacaggggcaggtggcagtgca

SEQ ID NO: 384483 - DNA, 25 bp, Mus musculus
tgtcacaggggcgggacaggaaagc

SEQ ID NO: 384484 - DNA, 25 bp, Mus musculus
tgtcacagggggtgagaaccctgct

SEQ ID NO: 384485 - DNA, 25 bp, Mus musculus
tgtcacagggggtggaaagctttcg

SEQ ID NO: 384486 - DNA, 25 bp, Mus musculus
tgtcacagtaccgtcacctccaagt

SEQ ID NO: 384487 - DNA, 25 bp, Mus musculus
tgtcacagtgtggttgatgacatta

SEQ ID NO: 384488 - DNA, 25 bp, Mus musculus
tgtcacatgttcttggcattgggag

SEQ ID NO: 384489 - DNA, 25 bp, Mus musculus
tgtcaccaactcagctctctgctct

SEQ ID NO: 384490 - DNA, 25 bp, Mus musculus
tgtcaccaaggaccccaactggtac

SEQ ID NO: 384491 - DNA, 25 bp, Mus musculus
tgtcaccaaggcccacgtttttgca

SEQ ID NO: 384492 - DNA, 25 bp, Mus musculus
tgtcaccacacaggtatcagtgagc

SEQ ID NO: 384493 - DNA, 25 bp, Mus musculus
tgtcaccacacagtcttaggcaacc

SEQ ID NO: 384494 - DNA, 25 bp, Mus musculus
tgtcaccacaggccgacccgtggaa

SEQ ID NO: 384495 - DNA, 25 bp, Mus musculus
tgtcaccacccagaaggaatacaca

SEQ ID NO: 384496 - DNA, 25 bp, Mus musculus
tgtcaccacccaggcctcccaagac

SEQ ID NO: 384497 - DNA, 25 bp, Mus musculus
tgtcaccaggactcaaatattctcc

SEQ ID NO: 384498 - DNA, 25 bp, Mus musculus
tgtcacccaaggtccagtttgatgt

SEQ ID NO: 384499 - DNA, 25 bp, Mus musculus
tgtcacccagactaagaaacttcag

SEQ ID NO: 384500 - DNA, 25 bp, Mus musculus
tgtcacccatatggcccacacggat

SEQ ID NO: 384501 - DNA, 25 bp, Mus musculus
tgtcacccatggtccgacttttgag

SEQ ID NO: 384502 - DNA, 25 bp, Mus musculus
tgtcaccccggtccctccgagccat

SEQ ID NO: 384503 - DNA, 25 bp, Mus musculus
tgtcacccctgtatatcaacctgaa

SEQ ID NO: 384504 - DNA, 25 bp, Mus musculus
tgtcacccgcggttcctgagactga

SEQ ID NO: 384505 - DNA, 25 bp, Mus musculus
tgtcaccctcagaagacccccgtca

SEQ ID NO: 384506 - DNA, 25 bp, Mus musculus
tgtcaccctgtctggaaagaaatga

SEQ ID NO: 384507 - DNA, 25 bp, Mus musculus
tgtcaccgagaggcttcattaacaa

SEQ ID NO: 384508 - DNA, 25 bp, Mus musculus
tgtcacctatgatgaggactaccag

SEQ ID NO: 384509 - DNA, 25 bp, Mus musculus
tgtcacctatgatggacaagaagct

SEQ ID NO: 384510 - DNA, 25 bp, Mus musculus
tgtcacctcggaggtcccacccagg

SEQ ID NO: 384511 - DNA, 25 bp, Mus musculus
tgtcacctcggctaaggatggggat

SEQ ID NO: 384512 - DNA, 25 bp, Mus musculus
tgtcaccttcagctacccctgcaga

SEQ ID NO: 384513 - DNA, 25 bp, Mus musculus
tgtcaccttccgagaactccgtgca

SEQ ID NO: 384514 - DNA, 25 bp, Mus musculus
tgtcacgcagcatgcttccctagcg

SEQ ID NO: 384515 - DNA, 25 bp, Mus musculus
tgtcacgcagcatgggctccggctg

SEQ ID NO: 384516 - DNA, 25 bp, Mus musculus
tgtcacgctacggaatgaagctacc

SEQ ID NO: 384517 - DNA, 25 bp, Mus musculus
tgtcacgcttctataaacctgactc

SEQ ID NO: 384518 - DNA, 25 bp, Mus musculus
tgtcacgcttctattaaaccgggag

SEQ ID NO: 384519 - DNA, 25 bp, Mus musculus
tgtcacgggggctggcacaggtgat

SEQ ID NO: 384520 - DNA, 25 bp, Mus musculus
tgtcacgtccggaaggtgaatcggt

SEQ ID NO: 384521 - DNA, 25 bp, Mus musculus
tgtcactaacaaggataagaagcat

SEQ ID NO: 384522 - DNA, 25 bp, Mus musculus
tgtcactatgccacagcccaactgg

SEQ ID NO: 384523 - DNA, 25 bp, Mus musculus
tgtcactcacccccaattccaggag

SEQ ID NO: 384524 - DNA, 25 bp, Mus musculus
tgtcactcagaagaaacccagaggt

SEQ ID NO: 384525 - DNA, 25 bp, Mus musculus
tgtcactcaggtctgtggaggaagc

SEQ ID NO: 384526 - DNA, 25 bp, Mus musculus
tgtcactcaggtgcggacattctac

SEQ ID NO: 384527 - DNA, 25 bp, Mus musculus
tgtcactccagagaaattcccaaca

SEQ ID NO: 384528 - DNA, 25 bp, Mus musculus
tgtcactccagaggccacaaaagaa

SEQ ID NO: 384529 - DNA, 25 bp, Mus musculus
tgtcactcctgctggttgcatgtac

SEQ ID NO: 384530 - DNA, 25 bp, Mus musculus
tgtcactctgggagttagcgacgcc

SEQ ID NO: 384531 - DNA, 25 bp, Mus musculus
tgtcactgagaaacgtctcagagag

SEQ ID NO: 384532 - DNA, 25 bp, Mus musculus
tgtcactgagaaggtgtccttggtg

SEQ ID NO: 384533 - DNA, 25 bp, Mus musculus
tgtcactgagctcctgcttcctgac

SEQ ID NO: 384534 - DNA, 25 bp, Mus musculus
tgtcactgcaagagcggccccggtc

SEQ ID NO: 384535 - DNA, 25 bp, Mus musculus
tgtcactgcagcgacggctccgggt

SEQ ID NO: 384536 - DNA, 25 bp, Mus musculus
tgtcactgcagcgctgctgtggctg

SEQ ID NO: 384537 - DNA, 25 bp, Mus musculus
tgtcactggtttgtacagtgtctac

SEQ ID NO: 384538 - DNA, 25 bp, Mus musculus
tgtcacttgtgactgaggctccacg

SEQ ID NO: 384539 - DNA, 25 bp, Mus musculus
tgtcactttcggctggggaactgac

SEQ ID NO: 384540 - DNA, 25 bp, Mus musculus
tgtcactttgcagtgccctgctctg

SEQ ID NO: 384541 - DNA, 25 bp, Mus musculus
tgtcagaaaatgagcttggtgttgg

SEQ ID NO: 384542 - DNA, 25 bp, Mus musculus
tgtcagaacctggcaccaccgaggg

SEQ ID NO: 384543 - DNA, 25 bp, Mus musculus
tgtcagaactcaaataattttgcac

SEQ ID NO: 384544 - DNA, 25 bp, Mus musculus
tgtcagaactcagcatcttatggaa

SEQ ID NO: 384545 - DNA, 25 bp, Mus musculus
tgtcagaactcagtcaggctgttcc

SEQ ID NO: 384546 - DNA, 25 bp, Mus musculus
tgtcagaactgcagttggagctgca

SEQ ID NO: 384547 - DNA, 25 bp, Mus musculus
tgtcagaagaaagagtgcagcagct

SEQ ID NO: 384548 - DNA, 25 bp, Mus musculus
tgtcagaagcacggtactacaagaa

SEQ ID NO: 384549 - DNA, 25 bp, Mus musculus
tgtcagaagtctgagaactcagatg

SEQ ID NO: 384550 - DNA, 25 bp, Mus musculus
tgtcagaagtctgagatgattggga

SEQ ID NO: 384551 - DNA, 25 bp, Mus musculus
tgtcagaattggggaccctctgact

SEQ ID NO: 384552 - DNA, 25 bp, Mus musculus
tgtcagacaagaaagggatctgtgt

SEQ ID NO: 384553 - DNA, 25 bp, Mus musculus
tgtcagacgatgaaggtgaagatgc

SEQ ID NO: 384554 - DNA, 25 bp, Mus musculus
tgtcagacgatgaagtaaggaaagc

SEQ ID NO: 384555 - DNA, 25 bp, Mus musculus
tgtcagagaaggaagcagcggtggc

SEQ ID NO: 384556 - DNA, 25 bp, Mus musculus
tgtcagagaaggtctcccatgttct

SEQ ID NO: 384557 - DNA, 25 bp, Mus musculus
tgtcagagaagtatccctgggagga

SEQ ID NO: 384558 - DNA, 25 bp, Mus musculus
tgtcagagagaagaatgaaagtaac

SEQ ID NO: 384559 - DNA, 25 bp, Mus musculus
tgtcagagccagttgtcactcagcc

SEQ ID NO: 384560 - DNA, 25 bp, Mus musculus
tgtcagagctctcgtgacagccttg

SEQ ID NO: 384561 - DNA, 25 bp, Mus musculus
tgtcagaggaggatacgggaagcca

SEQ ID NO: 384562 - DNA, 25 bp, Mus musculus
tgtcagaggaggtggagcctactac

SEQ ID NO: 384563 - DNA, 25 bp, Mus musculus
tgtcagaggtaaacagaaagaattt

SEQ ID NO: 384564 - DNA, 25 bp, Mus musculus
tgtcagaggtttgagatggaagctc

SEQ ID NO: 384565 - DNA, 25 bp, Mus musculus
tgtcagagtatgtgtcttcaccctg

SEQ ID NO: 384566 - DNA, 25 bp, Mus musculus
tgtcagatattgttgttgttacaga

SEQ ID NO: 384567 - DNA, 25 bp, Mus musculus
tgtcagatcccagacttggagagag

SEQ ID NO: 384568 - DNA, 25 bp, Mus musculus
tgtcagatcccaggaagccatgaca

SEQ ID NO: 384569 - DNA, 25 bp, Mus musculus
tgtcagatcccagtatatttgtgtc

SEQ ID NO: 384570 - DNA, 25 bp, Mus musculus
tgtcagatggcagagagtgcagcag

SEQ ID NO: 384571 - DNA, 25 bp, Mus musculus
tgtcagcaaagttatttcgcttggc

SEQ ID NO: 384572 - DNA, 25 bp, Mus musculus
tgtcagcaagaaagatgttattctt

SEQ ID NO: 384573 - DNA, 25 bp, Mus musculus
tgtcagcaagaaagctgcaggaatg

SEQ ID NO: 384574 - DNA, 25 bp, Mus musculus
tgtcagcacagctgtctgggattcc

SEQ ID NO: 384575 - DNA, 25 bp, Mus musculus
tgtcagcaggacgtggtgacagagt

SEQ ID NO: 384576 - DNA, 25 bp, Mus musculus
tgtcagcaggggtggatctggcttc

SEQ ID NO: 384577 - DNA, 25 bp, Mus musculus
tgtcagcatgagagctggattgtca

SEQ ID NO: 384578 - DNA, 25 bp, Mus musculus
tgtcagcatgagaggaaccatttgt

SEQ ID NO: 384579 - DNA, 25 bp, Mus musculus
tgtcagccaagaagaccaccaagtt

SEQ ID NO: 384580 - DNA, 25 bp, Mus musculus
tgtcagccaagaaggccagcaccct

SEQ ID NO: 384581 - DNA, 25 bp, Mus musculus
tgtcagccagggcggagctacacgg

SEQ ID NO: 384582 - DNA, 25 bp, Mus musculus
tgtcagcccaggtgctgtgagtggc

SEQ ID NO: 384583 - DNA, 25 bp, Mus musculus
tgtcagcgactgggtgccattgtgg

SEQ ID NO: 384584 - DNA, 25 bp, Mus musculus
tgtcagcgcaaactgggcaaacgct

SEQ ID NO: 384585 - DNA, 25 bp, Mus musculus
tgtcagcgctgatagaagtggaatt

SEQ ID NO: 384586 - DNA, 25 bp, Mus musculus
tgtcagcgggaacagcagtggtgaa

SEQ ID NO: 384587 - DNA, 25 bp, Mus musculus
tgtcagctacgcaggaagggcccag

SEQ ID NO: 384588 - DNA, 25 bp, Mus musculus
tgtcagctacgccgatcgggtcagg

SEQ ID NO: 384589 - DNA, 25 bp, Mus musculus
tgtcagctgccaacggacaaggctg

SEQ ID NO: 384590 - DNA, 25 bp, Mus musculus
tgtcagctgccatcggacaaggctg

SEQ ID NO: 384591 - DNA, 25 bp, Mus musculus
tgtcagctgcccagcctggtgagga

SEQ ID NO: 384592 - DNA, 25 bp, Mus musculus
tgtcagctgtaccagataacatgtt

SEQ ID NO: 384593 - DNA, 25 bp, Mus musculus
tgtcagctgtatccttcaggagccc

SEQ ID NO: 384594 - DNA, 25 bp, Mus musculus
tgtcagcttcaaggtggacagcagc

SEQ ID NO: 384595 - DNA, 25 bp, Mus musculus
tgtcaggaagaggagctttggctgt

SEQ ID NO: 384596 - DNA, 25 bp, Mus musculus
tgtcaggaagaggctgtcaacagga

SEQ ID NO: 384597 - DNA, 25 bp, Mus musculus
tgtcaggaagagggagtcccagcag

SEQ ID NO: 384598 - DNA, 25 bp, Mus musculus
tgtcaggaagggactggaatacgct

SEQ ID NO: 384599 - DNA, 25 bp, Mus musculus
tgtcaggaattccttaactccattc

SEQ ID NO: 384600 - DNA, 25 bp, Mus musculus
tgtcaggagaagagtctgttcaaga

SEQ ID NO: 384601 - DNA, 25 bp, Mus musculus
tgtcaggagaagtggctggtgaggt

SEQ ID NO: 384602 - DNA, 25 bp, Mus musculus
tgtcaggagcagattgccagggcaa

SEQ ID NO: 384603 - DNA, 25 bp, Mus musculus
tgtcaggatatgacataatgaaatc

SEQ ID NO: 384604 - DNA, 25 bp, Mus musculus
tgtcaggcagaatgggcttatgtct

SEQ ID NO: 384605 - DNA, 25 bp, Mus musculus
tgtcaggcatgaactatgaagatga

SEQ ID NO: 384606 - DNA, 25 bp, Mus musculus
tgtcaggccggaggctcctgtagtt

SEQ ID NO: 384607 - DNA, 25 bp, Mus musculus
tgtcagggaggtataagtgctacat

SEQ ID NO: 384608 - DNA, 25 bp, Mus musculus
tgtcagggggcaaagccaggaggaa

SEQ ID NO: 384609 - DNA, 25 bp, Mus musculus
tgtcagggtaagagatggctgtgaa

SEQ ID NO: 384610 - DNA, 25 bp, Mus musculus
tgtcaggtgctgatttcaacgttga

SEQ ID NO: 384611 - DNA, 25 bp, Mus musculus
tgtcaggttgccaagcaacacgtgc

SEQ ID NO: 384612 - DNA, 25 bp, Mus musculus
tgtcaggttgccaaggccttaatcc

SEQ ID NO: 384613 - DNA, 25 bp, Mus musculus
tgtcaggttgtaggttatcttgacg

SEQ ID NO: 384614 - DNA, 25 bp, Mus musculus
tgtcagtaactgaaggtgtccactc

SEQ ID NO: 384615 - DNA, 25 bp, Mus musculus
tgtcagtatgtggtccagtgtgagc

SEQ ID NO: 384616 - DNA, 25 bp, Mus musculus
tgtcagtcaggggacgtggaacacc

SEQ ID NO: 384617 - DNA, 25 bp, Mus musculus
tgtcagtcctatggcagtaccagtg

SEQ ID NO: 384618 - DNA, 25 bp, Mus musculus
tgtcagtgaggttcctgctgctgtc

SEQ ID NO: 384619 - DNA, 25 bp, Mus musculus
tgtcagtgcgattcccaactttcag

SEQ ID NO: 384620 - DNA, 25 bp, Mus musculus
tgtcagtggagcagcttacagatgt

SEQ ID NO: 384621 - DNA, 25 bp, Mus musculus
tgtcagtgtgtcaaatctctcatgg

SEQ ID NO: 384622 - DNA, 25 bp, Mus musculus
tgtcagttctgtgaacagatgtgac

SEQ ID NO: 384623 - DNA, 25 bp, Mus musculus
tgtcagttgggaaattcctaaatgc

SEQ ID NO: 384624 - DNA, 25 bp, Mus musculus
tgtcataaaagaaatgtaccccaag

SEQ ID NO: 384625 - DNA, 25 bp, Mus musculus
tgtcataaaagatgggcgaaccaag

SEQ ID NO: 384626 - DNA, 25 bp, Mus musculus
tgtcatacagccaaggccaggtagc

SEQ ID NO: 384627 - DNA, 25 bp, Mus musculus
tgtcatagcaaccaccgctcttgat

SEQ ID NO: 384628 - DNA, 25 bp, Mus musculus
tgtcatagcactggaccacgggttt

SEQ ID NO: 384629 - DNA, 25 bp, Mus musculus
tgtcatagtgcatttctcatctaca

SEQ ID NO: 384630 - DNA, 25 bp, Mus musculus
tgtcatatgtagcagctgtggcaga

SEQ ID NO: 384631 - DNA, 25 bp, Mus musculus
tgtcatattttggtttttgggaata

SEQ ID NO: 384632 - DNA, 25 bp, Mus musculus
tgtcatcaaaggcctctccctggaa

SEQ ID NO: 384633 - DNA, 25 bp, Mus musculus
tgtcatcaaagggaatgatgaaagg

SEQ ID NO: 384634 - DNA, 25 bp, Mus musculus
tgtcatcaaagggtctgagtggcaa

SEQ ID NO: 384635 - DNA, 25 bp, Mus musculus
tgtcatcaaaggtccagatgttcct

SEQ ID NO: 384636 - DNA, 25 bp, Mus musculus
tgtcatcaacagggctgatatccct

SEQ ID NO: 384637 - DNA, 25 bp, Mus musculus
tgtcatcaaccaccatggcgaggag

SEQ ID NO: 384638 - DNA, 25 bp, Mus musculus
tgtcatcaaccagcatggcgaggag

SEQ ID NO: 384639 - DNA, 25 bp, Mus musculus
tgtcatcacaccggtgttttggcca

SEQ ID NO: 384640 - DNA, 25 bp, Mus musculus
tgtcatcacagacaccctctctcca

SEQ ID NO: 384641 - DNA, 25 bp, Mus musculus
tgtcatcacagattctttaagattt

SEQ ID NO: 384642 - DNA, 25 bp, Mus musculus
tgtcatcacagcttagcgctctgtg

SEQ ID NO: 384643 - DNA, 25 bp, Mus musculus
tgtcatcaccatgatctgtgccatt

SEQ ID NO: 384644 - DNA, 25 bp, Mus musculus
tgtcatcatgaatgtgaaagagttt

SEQ ID NO: 384645 - DNA, 25 bp, Mus musculus
tgtcatccacacctccatcccactc

SEQ ID NO: 384646 - DNA, 25 bp, Mus musculus
tgtcatccacagaatcctagacttt

SEQ ID NO: 384647 - DNA, 25 bp, Mus musculus
tgtcatccacagagacttgaagcct

SEQ ID NO: 384648 - DNA, 25 bp, Mus musculus
tgtcatccagaatgccttattgttg

SEQ ID NO: 384649 - DNA, 25 bp, Mus musculus
tgtcatccaggaccccatgcctgcg

SEQ ID NO: 384650 - DNA, 25 bp, Mus musculus
tgtcatccaggaggtggagtatgtg

SEQ ID NO: 384651 - DNA, 25 bp, Mus musculus
tgtcatccagggcttcctactatga

SEQ ID NO: 384652 - DNA, 25 bp, Mus musculus
tgtcatccaggtcttggataaatac

SEQ ID NO: 384653 - DNA, 25 bp, Mus musculus
tgtcatccagttactgctgaccttt

SEQ ID NO: 384654 - DNA, 25 bp, Mus musculus
tgtcatccccgtggccctgttgcat

SEQ ID NO: 384655 - DNA, 25 bp, Mus musculus
tgtcatccggaagctggcaaaaacg

SEQ ID NO: 384656 - DNA, 25 bp, Mus musculus
tgtcatcctcagacaacattgtgca

SEQ ID NO: 384657 - DNA, 25 bp, Mus musculus
tgtcatcctcagctgggagggcatt

SEQ ID NO: 384658 - DNA, 25 bp, Mus musculus
tgtcatcctcaggcacaccaagatg

SEQ ID NO: 384659 - DNA, 25 bp, Mus musculus
tgtcatcctcaggcagtgccctgaa

SEQ ID NO: 384660 - DNA, 25 bp, Mus musculus
tgtcatcctcgaagccaagctggat

SEQ ID NO: 384661 - DNA, 25 bp, Mus musculus
tgtcatcctcgtgcctggctgcttg

SEQ ID NO: 384662 - DNA, 25 bp, Mus musculus
tgtcatcctggacatggcccgtgtg

SEQ ID NO: 384663 - DNA, 25 bp, Mus musculus
tgtcatccttgtctcattgggagaa

SEQ ID NO: 384664 - DNA, 25 bp, Mus musculus
tgtcatcgaaggagctgtgcggtct

SEQ ID NO: 384665 - DNA, 25 bp, Mus musculus
tgtcatcgacagaggatgagggtga

SEQ ID NO: 384666 - DNA, 25 bp, Mus musculus
tgtcatcgccacctgcggccccgac

SEQ ID NO: 384667 - DNA, 25 bp, Mus musculus
tgtcatcggttcgatttggggatat

SEQ ID NO: 384668 - DNA, 25 bp, Mus musculus
tgtcatcggttcggcgtaatagctt

SEQ ID NO: 384669 - DNA, 25 bp, Mus musculus
tgtcatcgtcatacgtccctggagg

SEQ ID NO: 384670 - DNA, 25 bp, Mus musculus
tgtcatctacatagaccagcccacc

SEQ ID NO: 384671 - DNA, 25 bp, Mus musculus
tgtcatctacatagaccaggacgat

SEQ ID NO: 384672 - DNA, 25 bp, Mus musculus
tgtcatctcccagggactgcgcagc

SEQ ID NO: 384673 - DNA, 25 bp, Mus musculus
tgtcatctctgtatgtgactgtcct

SEQ ID NO: 384674 - DNA, 25 bp, Mus musculus
tgtcatgatcacaggacacctatat

SEQ ID NO: 384675 - DNA, 25 bp, Mus musculus
tgtcatgatcacaggtgacaatctt

SEQ ID NO: 384676 - DNA, 25 bp, Mus musculus
tgtcatgatggtgtttggccttggt

SEQ ID NO: 384677 - DNA, 25 bp, Mus musculus
tgtcatgcaagcatttgacatgctc

SEQ ID NO: 384678 - DNA, 25 bp, Mus musculus
tgtcatgcaaggttcaaagggatcc

SEQ ID NO: 384679 - DNA, 25 bp, Mus musculus
tgtcatgcaagtttgtatgccggaa

SEQ ID NO: 384680 - DNA, 25 bp, Mus musculus
tgtcatgctgtgtgcaggagagatg

SEQ ID NO: 384681 - DNA, 25 bp, Mus musculus
tgtcatggaaagttacttcaatgag

SEQ ID NO: 384682 - DNA, 25 bp, Mus musculus
tgtcatggaatcaggcggccccctt

SEQ ID NO: 384683 - DNA, 25 bp, Mus musculus
tgtcatggaatcagggtgcgactgg

SEQ ID NO: 384684 - DNA, 25 bp, Mus musculus
tgtcatggagagaatgcctcctata

SEQ ID NO: 384685 - DNA, 25 bp, Mus musculus
tgtcatggaggactgtcaccagacc

SEQ ID NO: 384686 - DNA, 25 bp, Mus musculus
tgtcatggaggtttatcaccagatc

SEQ ID NO: 384687 - DNA, 25 bp, Mus musculus
tgtcatggagtatacaaaaaagcct

SEQ ID NO: 384688 - DNA, 25 bp, Mus musculus
tgtcatgttcttcttcagaaacaaa

SEQ ID NO: 384689 - DNA, 25 bp, Mus musculus
tgtcatgttgtgtgcaggagagatg

SEQ ID NO: 384690 - DNA, 25 bp, Mus musculus
tgtcattaactacgtggaaaaggca

SEQ ID NO: 384691 - DNA, 25 bp, Mus musculus
tgtcattaagcccacaaggcccgac

SEQ ID NO: 384692 - DNA, 25 bp, Mus musculus
tgtcattaatccaggatccacaggg

SEQ ID NO: 384693 - DNA, 25 bp, Mus musculus
tgtcattcacgagcaccctgaaaca

SEQ ID NO: 384694 - DNA, 25 bp, Mus musculus
tgtcattcacggtgaaggcagcttc

SEQ ID NO: 384695 - DNA, 25 bp, Mus musculus
tgtcattcactgtataagcatgatc

SEQ ID NO: 384696 - DNA, 25 bp, Mus musculus
tgtcattcagaaggcctctctcttg

SEQ ID NO: 384697 - DNA, 25 bp, Mus musculus
tgtcattccagggatcttcattgcc

SEQ ID NO: 384698 - DNA, 25 bp, Mus musculus
tgtcattgagaagtgccccaagcca

SEQ ID NO: 384699 - DNA, 25 bp, Mus musculus
tgtcattgagaagtgcctgtgacat

SEQ ID NO: 384700 - DNA, 25 bp, Mus musculus
tgtcattgagtaggtggacccatgc

SEQ ID NO: 384701 - DNA, 25 bp, Mus musculus
tgtcattggagccaggcaggtgcag

SEQ ID NO: 384702 - DNA, 25 bp, Mus musculus
tgtcattggagccaggtacgtacag

SEQ ID NO: 384703 - DNA, 25 bp, Mus musculus
tgtcattgtggctgatcagactcca

SEQ ID NO: 384704 - DNA, 25 bp, Mus musculus
tgtcatttacacaatgtactttcct

SEQ ID NO: 384705 - DNA, 25 bp, Mus musculus
tgtcatttacacgggttatgcaaca

SEQ ID NO: 384706 - DNA, 25 bp, Mus musculus
tgtcattttcagaatggtcgatgta

SEQ ID NO: 384707 - DNA, 25 bp, Mus musculus
tgtcatttttagctccgcctgctcc

SEQ ID NO: 384708 - DNA, 25 bp, Mus musculus
tgtcatttttaggatttggtgtcat

SEQ ID NO: 384709 - DNA, 25 bp, Mus musculus
tgtccaaacataggaattccaggca

SEQ ID NO: 384710 - DNA, 25 bp, Mus musculus
tgtccaaacatgactttctgggaca

SEQ ID NO: 384711 - DNA, 25 bp, Mus musculus
tgtccaacagctcctggagcttttt

SEQ ID NO: 384712 - DNA, 25 bp, Mus musculus
tgtccaacagtaatttgtcagattt

SEQ ID NO: 384713 - DNA, 25 bp, Mus musculus
tgtccaaccagaaagagtccaaagc

SEQ ID NO: 384714 - DNA, 25 bp, Mus musculus
tgtccaacctggggtttaagaggcg

SEQ ID NO: 384715 - DNA, 25 bp, Mus musculus
tgtccaaggcccaggtggtgaccat

SEQ ID NO: 384716 - DNA, 25 bp, Mus musculus
tgtccaagttggggctcgctgtggg

SEQ ID NO: 384717 - DNA, 25 bp, Mus musculus
tgtccaatgtcccatcaccatctca

SEQ ID NO: 384718 - DNA, 25 bp, Mus musculus
tgtccaatgtgaaggctccagcctg

SEQ ID NO: 384719 - DNA, 25 bp, Mus musculus
tgtccacaaccagaaaagccagctc

SEQ ID NO: 384720 - DNA, 25 bp, Mus musculus
tgtccacaaccagccctcagcggca

SEQ ID NO: 384721 - DNA, 25 bp, Mus musculus
tgtccacaaccaggctcccaccacc

SEQ ID NO: 384722 - DNA, 25 bp, Mus musculus
tgtccacaagatatgtgagatagat

SEQ ID NO: 384723 - DNA, 25 bp, Mus musculus
tgtccacacaagctttgaaccactg

SEQ ID NO: 384724 - DNA, 25 bp, Mus musculus
tgtccacacaaggtttcacgacttc

SEQ ID NO: 384725 - DNA, 25 bp, Mus musculus
tgtccacacaggtttatgaagctga

SEQ ID NO: 384726 - DNA, 25 bp, Mus musculus
tgtccacacccagatgaagttgctg

SEQ ID NO: 384727 - DNA, 25 bp, Mus musculus
tgtccacaccggtgatcctaagaga

SEQ ID NO: 384728 - DNA, 25 bp, Mus musculus
tgtccacactacaggctccttcctg

SEQ ID NO: 384729 - DNA, 25 bp, Mus musculus
tgtccacactacaggtctgtaactg

SEQ ID NO: 384730 - DNA, 25 bp, Mus musculus
tgtccacagtcgagagctaagatgc

SEQ ID NO: 384731 - DNA, 25 bp, Mus musculus
tgtccacatgcccctgtgatgccag

SEQ ID NO: 384732 - DNA, 25 bp, Mus musculus
tgtccacatgcgtttgatatcgttg

SEQ ID NO: 384733 - DNA, 25 bp, Mus musculus
tgtccaccagggtttgacctgccac

SEQ ID NO: 384734 - DNA, 25 bp, Mus musculus
tgtccaccatggtaggtgagctcca

SEQ ID NO: 384735 - DNA, 25 bp, Mus musculus
tgtccacccgagtggcccatcctca

SEQ ID NO: 384736 - DNA, 25 bp, Mus musculus
tgtccacctcacagaatagcattcc

SEQ ID NO: 384737 - DNA, 25 bp, Mus musculus
tgtccacctcacagaggagcaggga

SEQ ID NO: 384738 - DNA, 25 bp, Mus musculus
tgtccacctcacagattcccggtcg

SEQ ID NO: 384739 - DNA, 25 bp, Mus musculus
tgtccacgcgccagggaatggacct

SEQ ID NO: 384740 - DNA, 25 bp, Mus musculus
tgtccacgcggttctatggtacaga

SEQ ID NO: 384741 - DNA, 25 bp, Mus musculus
tgtccacgcgtgcagtctgcatcag

SEQ ID NO: 384742 - DNA, 25 bp, Mus musculus
tgtccactgaggaaacctcaccgaa

SEQ ID NO: 384743 - DNA, 25 bp, Mus musculus
tgtccactgagggtgtgctgatttc

SEQ ID NO: 384744 - DNA, 25 bp, Mus musculus
tgtccactgtgccactcctgcctgg

SEQ ID NO: 384745 - DNA, 25 bp, Mus musculus
tgtccactgtgccagcaccagaccc

SEQ ID NO: 384746 - DNA, 25 bp, Mus musculus
tgtccagaaagcgaccataacctgt

SEQ ID NO: 384747 - DNA, 25 bp, Mus musculus
tgtccagaacagtgtccccgatgaa

SEQ ID NO: 384748 - DNA, 25 bp, Mus musculus
tgtccagaaggacaaggtggaaccc

SEQ ID NO: 384749 - DNA, 25 bp, Mus musculus
tgtccagactcggggccctgttctc

SEQ ID NO: 384750 - DNA, 25 bp, Mus musculus
tgtccagagaaggtgatcatctgtc

SEQ ID NO: 384751 - DNA, 25 bp, Mus musculus
tgtccagagagagaaccttcacacc

SEQ ID NO: 384752 - DNA, 25 bp, Mus musculus
tgtccagagagttgtgtggccatca

SEQ ID NO: 384753 - DNA, 25 bp, Mus musculus
tgtccagaggtgccgagtaacttgt

SEQ ID NO: 384754 - DNA, 25 bp, Mus musculus
tgtccagaggtgccgcaccatggcc

SEQ ID NO: 384755 - DNA, 25 bp, Mus musculus
tgtccagatcacagaatacagatat

SEQ ID NO: 384756 - DNA, 25 bp, Mus musculus
tgtccagatcacagcctctgcagaa

SEQ ID NO: 384757 - DNA, 25 bp, Mus musculus
tgtccagatcacggaccaggaggga

SEQ ID NO: 384758 - DNA, 25 bp, Mus musculus
tgtccagatcaggatgactctttag

SEQ ID NO: 384759 - DNA, 25 bp, Mus musculus
tgtccagatcagtaggtgcaaactc

SEQ ID NO: 384760 - DNA, 25 bp, Mus musculus
tgtccagatgtccagatctgctgga

SEQ ID NO: 384761 - DNA, 25 bp, Mus musculus
tgtccagatgtccaggtgtggtgca

SEQ ID NO: 384762 - DNA, 25 bp, Mus musculus
tgtccagcacagaatcgtccttgga

SEQ ID NO: 384763 - DNA, 25 bp, Mus musculus
tgtccagcacagccagccatatgga

SEQ ID NO: 384764 - DNA, 25 bp, Mus musculus
tgtccagcacagggacctgaggtgc

SEQ ID NO: 384765 - DNA, 25 bp, Mus musculus
tgtccagcaccaaagaaggcatggt

SEQ ID NO: 384766 - DNA, 25 bp, Mus musculus
tgtccagcaggccacgattgctgcc

SEQ ID NO: 384767 - DNA, 25 bp, Mus musculus
tgtccagcagtagggagtgccgcgt

SEQ ID NO: 384768 - DNA, 25 bp, Mus musculus
tgtccagcagtaggggaacaaagat

SEQ ID NO: 384769 - DNA, 25 bp, Mus musculus
tgtccagcgctgagcttcacctggt

SEQ ID NO: 384770 - DNA, 25 bp, Mus musculus
tgtccagcggctcgaggacttctcc

SEQ ID NO: 384771 - DNA, 25 bp, Mus musculus
tgtccaggagcagacacggatcatc

SEQ ID NO: 384772 - DNA, 25 bp, Mus musculus
tgtccaggagcaggggggactcccc

SEQ ID NO: 384773 - DNA, 25 bp, Mus musculus
tgtccaggcaagatcagctctgaat

SEQ ID NO: 384774 - DNA, 25 bp, Mus musculus
tgtccaggtcctttcctcttccctc

SEQ ID NO: 384775 - DNA, 25 bp, Mus musculus
tgtccaggtggctgagctcccgcca

SEQ ID NO: 384776 - DNA, 25 bp, Mus musculus
tgtccaggtggctgccccagtgcgg

SEQ ID NO: 384777 - DNA, 25 bp, Mus musculus
tgtccagtaagcagataaggatgaa

SEQ ID NO: 384778 - DNA, 25 bp, Mus musculus
tgtccatacggctggctcggatggc

SEQ ID NO: 384779 - DNA, 25 bp, Mus musculus
tgtccatcaaagccccagaagaccc

SEQ ID NO: 384780 - DNA, 25 bp, Mus musculus
tgtccatcaaagccctgtgcccacg

SEQ ID NO: 384781 - DNA, 25 bp, Mus musculus
tgtccatcaaagctgacttctctac

SEQ ID NO: 384782 - DNA, 25 bp, Mus musculus
tgtccatcaaagggtcgtcttctgc

SEQ ID NO: 384783 - DNA, 25 bp, Mus musculus
tgtccatgaccggaatccatgccca

SEQ ID NO: 384784 - DNA, 25 bp, Mus musculus
tgtccatgagaagaggaagcttctt

SEQ ID NO: 384785 - DNA, 25 bp, Mus musculus
tgtccatgagatggattctgacgtt

SEQ ID NO: 384786 - DNA, 25 bp, Mus musculus
tgtccatgaggcctgtcccaggctc

SEQ ID NO: 384787 - DNA, 25 bp, Mus musculus
tgtccatgaggttttggggcgagaa

SEQ ID NO: 384788 - DNA, 25 bp, Mus musculus
tgtccatgcagtatgctgcctggct

SEQ ID NO: 384789 - DNA, 25 bp, Mus musculus
tgtccatgcagtcccccagcctgca

SEQ ID NO: 384790 - DNA, 25 bp, Mus musculus
tgtccatgccataaggaaatcctac

SEQ ID NO: 384791 - DNA, 25 bp, Mus musculus
tgtccatggaagacagcagtgacag

SEQ ID NO: 384792 - DNA, 25 bp, Mus musculus
tgtccatggtaacaggcctgatgga

SEQ ID NO: 384793 - DNA, 25 bp, Mus musculus
tgtccatggtaacagtcaacaaatg

SEQ ID NO: 384794 - DNA, 25 bp, Mus musculus
tgtccatgtgccagggaaaccgtga

SEQ ID NO: 384795 - DNA, 25 bp, Mus musculus
tgtccattcatcaactggccttgac

SEQ ID NO: 384796 - DNA, 25 bp, Mus musculus
tgtccattcatcaggaagcaggtgt

SEQ ID NO: 384797 - DNA, 25 bp, Mus musculus
tgtccattctcagcgctgtgtagtt

SEQ ID NO: 384798 - DNA, 25 bp, Mus musculus
tgtccattgcaaaggctgggatcat

SEQ ID NO: 384799 - DNA, 25 bp, Mus musculus
tgtccatttcgacttctctacccag

SEQ ID NO: 384800 - DNA, 25 bp, Mus musculus
tgtcccaaacacaaggcgaaggaga

SEQ ID NO: 384801 - DNA, 25 bp, Mus musculus
tgtcccaacaggccatccgctgcac

SEQ ID NO: 384802 - DNA, 25 bp, Mus musculus
tgtcccaatccgggctgtggaaacc

SEQ ID NO: 384803 - DNA, 25 bp, Mus musculus
tgtcccacaaggcatgctagtccca

SEQ ID NO: 384804 - DNA, 25 bp, Mus musculus
tgtcccacattggcaagacattgct

SEQ ID NO: 384805 - DNA, 25 bp, Mus musculus
tgtcccacctcagcaccaggaccct

SEQ ID NO: 384806 - DNA, 25 bp, Mus musculus
tgtcccaccttgtgcgccccgcacg

SEQ ID NO: 384807 - DNA, 25 bp, Mus musculus
tgtcccagaacaatattgctgcctt

SEQ ID NO: 384808 - DNA, 25 bp, Mus musculus
tgtcccagtccccacgggcactatg

SEQ ID NO: 384809 - DNA, 25 bp, Mus musculus
tgtcccattctctggtgccctgcct

SEQ ID NO: 384810 - DNA, 25 bp, Mus musculus
tgtccccaaaacctgacgtccacgt

SEQ ID NO: 384811 - DNA, 25 bp, Mus musculus
tgtccccaagaggtacttttctcac

SEQ ID NO: 384812 - DNA, 25 bp, Mus musculus
tgtccccaagccacagcccaactgg

SEQ ID NO: 384813 - DNA, 25 bp, Mus musculus
tgtccccaagccagccccgcagccc

SEQ ID NO: 384814 - DNA, 25 bp, Mus musculus
tgtccccacaggggcaggtgctgag

SEQ ID NO: 384815 - DNA, 25 bp, Mus musculus
tgtccccaccgccatgcctgtctcc

SEQ ID NO: 384816 - DNA, 25 bp, Mus musculus
tgtccccacctccagggtgaagttg

SEQ ID NO: 384817 - DNA, 25 bp, Mus musculus
tgtccccaggaggcccccaaggtgg

SEQ ID NO: 384818 - DNA, 25 bp, Mus musculus
tgtccccatatgagcataaatcaaa

SEQ ID NO: 384819 - DNA, 25 bp, Mus musculus
tgtccccatatgatgggaaataagt

SEQ ID NO: 384820 - DNA, 25 bp, Mus musculus
tgtccccatgtacagactcatccca

SEQ ID NO: 384821 - DNA, 25 bp, Mus musculus
tgtccccatgtacagctcacaaact

SEQ ID NO: 384822 - DNA, 25 bp, Mus musculus
tgtcccccaaggaggtaagcctgga

SEQ ID NO: 384823 - DNA, 25 bp, Mus musculus
tgtcccccacgtgccccgagccctc

SEQ ID NO: 384824 - DNA, 25 bp, Mus musculus
tgtcccccagccgagtttgtctttg

SEQ ID NO: 384825 - DNA, 25 bp, Mus musculus
tgtcccccaggcgagtttgtctttg

SEQ ID NO: 384826 - DNA, 25 bp, Mus musculus
tgtcccccaggtttcacggggctgg

SEQ ID NO: 384827 - DNA, 25 bp, Mus musculus
tgtccccgaggctgcttatgatccc

SEQ ID NO: 384828 - DNA, 25 bp, Mus musculus
tgtccccgctgtacttgtccagctc

SEQ ID NO: 384829 - DNA, 25 bp, Mus musculus
tgtccccgggaggtttcatgggatc

SEQ ID NO: 384830 - DNA, 25 bp, Mus musculus
tgtcccctagaaggaagagtcactc

SEQ ID NO: 384831 - DNA, 25 bp, Mus musculus
tgtcccctcagttccccagtgaaga

SEQ ID NO: 384832 - DNA, 25 bp, Mus musculus
tgtcccctgcccggaattctgatca

SEQ ID NO: 384833 - DNA, 25 bp, Mus musculus
tgtcccctgggagtgcttacttttc

SEQ ID NO: 384834 - DNA, 25 bp, Mus musculus
tgtccccttcgcggccgtcagaatg

SEQ ID NO: 384835 - DNA, 25 bp, Mus musculus
tgtccccttcggatgaattgtctgg

SEQ ID NO: 384836 - DNA, 25 bp, Mus musculus
tgtcccgaaactccagtgacacgtg

SEQ ID NO: 384837 - DNA, 25 bp, Mus musculus
tgtcccgacgccttggtctgtgtgt

SEQ ID NO: 384838 - DNA, 25 bp, Mus musculus
tgtcccgattctgtggacaggccaa

SEQ ID NO: 384839 - DNA, 25 bp, Mus musculus
tgtcccggatggagtgtcgaggggg

SEQ ID NO: 384840 - DNA, 25 bp, Mus musculus
tgtcccggggcggcctcttgggaga

SEQ ID NO: 384841 - DNA, 25 bp, Mus musculus
tgtcccggggcggtgatgtggccgt

SEQ ID NO: 384842 - DNA, 25 bp, Mus musculus
tgtcccgtcatctcccccagatctc

SEQ ID NO: 384843 - DNA, 25 bp, Mus musculus
tgtcccgtggcccctctggtttcac

SEQ ID NO: 384844 - DNA, 25 bp, Mus musculus
tgtcccgtgggcccaagaactcagg

SEQ ID NO: 384845 - DNA, 25 bp, Mus musculus
tgtcccgtgtcatgggtctcagcct

SEQ ID NO: 384846 - DNA, 25 bp, Mus musculus
tgtccctaccctcgagtctgtagct

SEQ ID NO: 384847 - DNA, 25 bp, Mus musculus
tgtccctcaagttgcctgcaggagg

SEQ ID NO: 384848 - DNA, 25 bp, Mus musculus
tgtccctcaatgcaaaaaggccaga

SEQ ID NO: 384849 - DNA, 25 bp, Mus musculus
tgtccctcaatggcacgctcctgtc

SEQ ID NO: 384850 - DNA, 25 bp, Mus musculus
tgtccctcaatttcgaggactccac

SEQ ID NO: 384851 - DNA, 25 bp, Mus musculus
tgtccctcagctgcttccggttgta

SEQ ID NO: 384852 - DNA, 25 bp, Mus musculus
tgtccctcaggtggccccttctgcc

SEQ ID NO: 384853 - DNA, 25 bp, Mus musculus
tgtccctcagtcgagccccgttgag

SEQ ID NO: 384854 - DNA, 25 bp, Mus musculus
tgtccctccccagcaatctactctc

SEQ ID NO: 384855 - DNA, 25 bp, Mus musculus
tgtccctccccaggaacattgacca

SEQ ID NO: 384856 - DNA, 25 bp, Mus musculus
tgtccctcctgcaagcgttctgtca

SEQ ID NO: 384857 - DNA, 25 bp, Mus musculus
tgtccctctatgccaaaaggccaga

SEQ ID NO: 384858 - DNA, 25 bp, Mus musculus
tgtccctgaggagcagggcattttc

SEQ ID NO: 384859 - DNA, 25 bp, Mus musculus
tgtccctgctggagaatgagagaga

SEQ ID NO: 384860 - DNA, 25 bp, Mus musculus
tgtccctgctggaggagctgatgca

SEQ ID NO: 384861 - DNA, 25 bp, Mus musculus
tgtccctggagaaggatatgaatca

SEQ ID NO: 384862 - DNA, 25 bp, Mus musculus
tgtccctggagaaggcgtgggtgac

SEQ ID NO: 384863 - DNA, 25 bp, Mus musculus
tgtccctggagaagtcaaacaggtg

SEQ ID NO: 384864 - DNA, 25 bp, Mus musculus
tgtccctggtccaggtgaaatcgcc

SEQ ID NO: 384865 - DNA, 25 bp, Mus musculus
tgtccctgtaacaagcttaaatcca

SEQ ID NO: 384866 - DNA, 25 bp, Mus musculus
tgtccctgtctgaaggatctcacat

SEQ ID NO: 384867 - DNA, 25 bp, Mus musculus
tgtccctgtctgaaggcacttctgg

SEQ ID NO: 384868 - DNA, 25 bp, Mus musculus
tgtccctgtctgtggccaggagggc

SEQ ID NO: 384869 - DNA, 25 bp, Mus musculus
tgtccctgtgggaagcccccggcag

SEQ ID NO: 384870 - DNA, 25 bp, Mus musculus
tgtccctttaggagagaagatagag

SEQ ID NO: 384871 - DNA, 25 bp, Mus musculus
tgtccgaaatctgcttcttgcagga

SEQ ID NO: 384872 - DNA, 25 bp, Mus musculus
tgtccgacgctgacatggactgggc

SEQ ID NO: 384873 - DNA, 25 bp, Mus musculus
tgtccgagagaagacacagctggta

SEQ ID NO: 384874 - DNA, 25 bp, Mus musculus
tgtccgagagaagaccaccaaggcc

SEQ ID NO: 384875 - DNA, 25 bp, Mus musculus
tgtccgagagaaggtgggtgacatc

SEQ ID NO: 384876 - DNA, 25 bp, Mus musculus
tgtccgagaggtcattgctagaatc

SEQ ID NO: 384877 - DNA, 25 bp, Mus musculus
tgtccgagatctgctgcccaccaat

SEQ ID NO: 384878 - DNA, 25 bp, Mus musculus
tgtccgagccaggacgagggatctg

SEQ ID NO: 384879 - DNA, 25 bp, Mus musculus
tgtccgaggggcggatacagagact

SEQ ID NO: 384880 - DNA, 25 bp, Mus musculus
tgtccgcactgtgagaaggagggga

SEQ ID NO: 384881 - DNA, 25 bp, Mus musculus
tgtccgcagagacgagaacagagct

SEQ ID NO: 384882 - DNA, 25 bp, Mus musculus
tgtccgcagagacgagctgacatcc

SEQ ID NO: 384883 - DNA, 25 bp, Mus musculus
tgtccgcaggcggctcaaagacttg

SEQ ID NO: 384884 - DNA, 25 bp, Mus musculus
tgtccgcataggcttcagttgtgtt

SEQ ID NO: 384885 - DNA, 25 bp, Mus musculus
tgtccgccagggttcggcagactcc

SEQ ID NO: 384886 - DNA, 25 bp, Mus musculus
tgtccgcccgagatcatcagaaact

SEQ ID NO: 384887 - DNA, 25 bp, Mus musculus
tgtccgccgccgcaaccatcagcct

SEQ ID NO: 384888 - DNA, 25 bp, Mus musculus
tgtccgcctcacaggaacaaaaagt

SEQ ID NO: 384889 - DNA, 25 bp, Mus musculus
tgtccgctcagggatggtctgtagg

SEQ ID NO: 384890 - DNA, 25 bp, Mus musculus
tgtccgctcagggcttctgacccca

SEQ ID NO: 384891 - DNA, 25 bp, Mus musculus
tgtccggaaggtctgcgctgccaat

SEQ ID NO: 384892 - DNA, 25 bp, Mus musculus
tgtccggagtcccaagtctccaggt

SEQ ID NO: 384893 - DNA, 25 bp, Mus musculus
tgtccggctctggttggtcatgctg

SEQ ID NO: 384894 - DNA, 25 bp, Mus musculus
tgtccgggcagccaaggagatccag

SEQ ID NO: 384895 - DNA, 25 bp, Mus musculus
tgtccggggacgagatgatttttga

SEQ ID NO: 384896 - DNA, 25 bp, Mus musculus
tgtccgggggcctcgcctgctcctg

SEQ ID NO: 384897 - DNA, 25 bp, Mus musculus
tgtccgtaaacttgggtgctggaat

SEQ ID NO: 384898 - DNA, 25 bp, Mus musculus
tgtccgtaaagaagaacacaacaac

SEQ ID NO: 384899 - DNA, 25 bp, Mus musculus
tgtccgtcaagtttggaaatgatgt

SEQ ID NO: 384900 - DNA, 25 bp, Mus musculus
tgtccgtcagagaatgctgactttg

SEQ ID NO: 384901 - DNA, 25 bp, Mus musculus
tgtccgtcctgccgggagctcttac

SEQ ID NO: 384902 - DNA, 25 bp, Mus musculus
tgtccgtgccagacctcgcagtaac

SEQ ID NO: 384903 - DNA, 25 bp, Mus musculus
tgtccgtgccagtaaccctgacctc

SEQ ID NO: 384904 - DNA, 25 bp, Mus musculus
tgtcctaacgagaatgtcataccca

SEQ ID NO: 384905 - DNA, 25 bp, Mus musculus
tgtcctaagaaaccatcaagaagcg

SEQ ID NO: 384906 - DNA, 25 bp, Mus musculus
tgtcctaagaaacgcaggctccagc

SEQ ID NO: 384907 - DNA, 25 bp, Mus musculus
tgtcctacaagcctggacaaactac

SEQ ID NO: 384908 - DNA, 25 bp, Mus musculus
tgtcctacaaggccctcgttgccct

SEQ ID NO: 384909 - DNA, 25 bp, Mus musculus
tgtcctacaatgatgatgtgctgac

SEQ ID NO: 384910 - DNA, 25 bp, Mus musculus
tgtcctagcagattgtccttctgaa

SEQ ID NO: 384911 - DNA, 25 bp, Mus musculus
tgtcctataacaggataacataaat

SEQ ID NO: 384912 - DNA, 25 bp, Mus musculus
tgtcctatgcttcccatgatgaaaa

SEQ ID NO: 384913 - DNA, 25 bp, Mus musculus
tgtcctcaaatcggggaaaaactct

SEQ ID NO: 384914 - DNA, 25 bp, Mus musculus
tgtcctcaacaaggacctgatgcaa

SEQ ID NO: 384915 - DNA, 25 bp, Mus musculus
tgtcctcaactccaccccagcctgc

SEQ ID NO: 384916 - DNA, 25 bp, Mus musculus
tgtcctcaagtgagccccaggccat

SEQ ID NO: 384917 - DNA, 25 bp, Mus musculus
tgtcctcacatgaaggggcctctgc

SEQ ID NO: 384918 - DNA, 25 bp, Mus musculus
tgtcctcaccaagatcctccaattc

SEQ ID NO: 384919 - DNA, 25 bp, Mus musculus
tgtcctcaccaaggtttctctggac

SEQ ID NO: 384920 - DNA, 25 bp, Mus musculus
tgtcctcaccacttgagctcctggc

SEQ ID NO: 384921 - DNA, 25 bp, Mus musculus
tgtcctcaccacttggtgaacagtg

SEQ ID NO: 384922 - DNA, 25 bp, Mus musculus
tgtcctcagaggtgtgctcctgcaa

SEQ ID NO: 384923 - DNA, 25 bp, Mus musculus
tgtcctcagggagtgcctgcacttc

SEQ ID NO: 384924 - DNA, 25 bp, Mus musculus
tgtcctcagtcaggaggtctcccca

SEQ ID NO: 384925 - DNA, 25 bp, Mus musculus
tgtcctcagtcagtgctggggactg

SEQ ID NO: 384926 - DNA, 25 bp, Mus musculus
tgtcctcataccagaatctggtcaa

SEQ ID NO: 384927 - DNA, 25 bp, Mus musculus
tgtcctcatagcagaatctggtcaa

SEQ ID NO: 384928 - DNA, 25 bp, Mus musculus
tgtcctcccaaagggtatgtgtatt

SEQ ID NO: 384929 - DNA, 25 bp, Mus musculus
tgtcctccccgttctgatacccgat

SEQ ID NO: 384930 - DNA, 25 bp, Mus musculus
tgtcctcccgggtaaatagctgtgt

SEQ ID NO: 384931 - DNA, 25 bp, Mus musculus
tgtcctccctcactgcactaacctt

SEQ ID NO: 384932 - DNA, 25 bp, Mus musculus
tgtcctccctcactggtgagaatgt

SEQ ID NO: 384933 - DNA, 25 bp, Mus musculus
tgtcctcctgctgatgctttcattg

SEQ ID NO: 384934 - DNA, 25 bp, Mus musculus
tgtcctcgagagacccagccattcg

SEQ ID NO: 384935 - DNA, 25 bp, Mus musculus
tgtcctcgagttttactacagagac

SEQ ID NO: 384936 - DNA, 25 bp, Mus musculus
tgtcctcggaaaccatcgagcgttt

SEQ ID NO: 384937 - DNA, 25 bp, Mus musculus
tgtcctcgtaggaatcagagaagct

SEQ ID NO: 384938 - DNA, 25 bp, Mus musculus
tgtcctctcaaggctcaaactcaga

SEQ ID NO: 384939 - DNA, 25 bp, Mus musculus
tgtcctctcagtggccccagggccc

SEQ ID NO: 384940 - DNA, 25 bp, Mus musculus
tgtcctctgcctgctccggctcctg

SEQ ID NO: 384941 - DNA, 25 bp, Mus musculus
tgtcctcttctagttctttgtatgc

SEQ ID NO: 384942 - DNA, 25 bp, Mus musculus
tgtcctcttgcaaggagtcagcatt

SEQ ID NO: 384943 - DNA, 25 bp, Mus musculus
tgtcctctttcatacgcggaaccct

SEQ ID NO: 384944 - DNA, 25 bp, Mus musculus
tgtcctctttcatacggattttgat

SEQ ID NO: 384945 - DNA, 25 bp, Mus musculus
tgtcctctttcataggcggaaccct

SEQ ID NO: 384946 - DNA, 25 bp, Mus musculus
tgtcctctttcatagggattttgat

SEQ ID NO: 384947 - DNA, 25 bp, Mus musculus
tgtcctgaaagccagagacccgccc

SEQ ID NO: 384948 - DNA, 25 bp, Mus musculus
tgtcctgaaagtaggcttctttggc

SEQ ID NO: 384949 - DNA, 25 bp, Mus musculus
tgtcctgaaagtctcagaggagcag

SEQ ID NO: 384950 - DNA, 25 bp, Mus musculus
tgtcctgaacttggatcctttctct

SEQ ID NO: 384951 - DNA, 25 bp, Mus musculus
tgtcctgaatgtgagaagattacag

SEQ ID NO: 384952 - DNA, 25 bp, Mus musculus
tgtcctgactatatgatggggctgt

SEQ ID NO: 384953 - DNA, 25 bp, Mus musculus
tgtcctgatgaggtttatcagctta

SEQ ID NO: 384954 - DNA, 25 bp, Mus musculus
tgtcctgattccgggactgcaggct

SEQ ID NO: 384955 - DNA, 25 bp, Mus musculus
tgtcctgcacaaggttctgaaccag

SEQ ID NO: 384956 - DNA, 25 bp, Mus musculus
tgtcctgcagggtttcaaagataac

SEQ ID NO: 384957 - DNA, 25 bp, Mus musculus
tgtcctgcctgacctgcaggaagaa

SEQ ID NO: 384958 - DNA, 25 bp, Mus musculus
tgtcctgccttgagagcttacccct

SEQ ID NO: 384959 - DNA, 25 bp, Mus musculus
tgtcctgccttgaggatgacaagat

SEQ ID NO: 384960 - DNA, 25 bp, Mus musculus
tgtcctgccttgaggttcctagaca

SEQ ID NO: 384961 - DNA, 25 bp, Mus musculus
tgtcctgctaaggctagagcgcaga

SEQ ID NO: 384962 - DNA, 25 bp, Mus musculus
tgtcctgctaagtgttcttgagtgg

SEQ ID NO: 384963 - DNA, 25 bp, Mus musculus
tgtcctgctcaggtgactcagaaga

SEQ ID NO: 384964 - DNA, 25 bp, Mus musculus
tgtcctgctgaggcgagtaacaaga

SEQ ID NO: 384965 - DNA, 25 bp, Mus musculus
tgtcctgctgtaaaggctggctact

SEQ ID NO: 384966 - DNA, 25 bp, Mus musculus
tgtcctgcttagtcttgctgtttca

SEQ ID NO: 384967 - DNA, 25 bp, Mus musculus
tgtcctgcttttttcacttcccttt

SEQ ID NO: 384968 - DNA, 25 bp, Mus musculus
tgtcctggaaccaaggtgatgaatc

SEQ ID NO: 384969 - DNA, 25 bp, Mus musculus
tgtcctggaactgtgttacatcctg

SEQ ID NO: 384970 - DNA, 25 bp, Mus musculus
tgtcctggaaggtggtttgctctct

SEQ ID NO: 384971 - DNA, 25 bp, Mus musculus
tgtcctggagataggacgagtgacc

SEQ ID NO: 384972 - DNA, 25 bp, Mus musculus
tgtcctggagcagacaggattatgg

SEQ ID NO: 384973 - DNA, 25 bp, Mus musculus
tgtcctggaggagagggaagaatta

SEQ ID NO: 384974 - DNA, 25 bp, Mus musculus
tgtcctggaggccagcatattcagg

SEQ ID NO: 384975 - DNA, 25 bp, Mus musculus
tgtcctggcctcagacctcacagtg

SEQ ID NO: 384976 - DNA, 25 bp, Mus musculus
tgtcctgggcctaagttatgaggag

SEQ ID NO: 384977 - DNA, 25 bp, Mus musculus
tgtcctgggttcaggcatcagaaac

SEQ ID NO: 384978 - DNA, 25 bp, Mus musculus
tgtcctgggttcaggtgtttccagg

SEQ ID NO: 384979 - DNA, 25 bp, Mus musculus
tgtcctggtatgatcccaggctccg

SEQ ID NO: 384980 - DNA, 25 bp, Mus musculus
tgtcctgtaaggtggtctgtgatga

SEQ ID NO: 384981 - DNA, 25 bp, Mus musculus
tgtcctgtgaagacatcaacgaatg

SEQ ID NO: 384982 - DNA, 25 bp, Mus musculus
tgtcctgtgaagacatcaatgagtg

SEQ ID NO: 384983 - DNA, 25 bp, Mus musculus
tgtcctgtgaagaccaagacgagtg

SEQ ID NO: 384984 - DNA, 25 bp, Mus musculus
tgtcctgtgcagaagattgataagt

SEQ ID NO: 384985 - DNA, 25 bp, Mus musculus
tgtcctgtggagagcctccaacgtg

SEQ ID NO: 384986 - DNA, 25 bp, Mus musculus
tgtcctgtggaggaaattgtgtcag

SEQ ID NO: 384987 - DNA, 25 bp, Mus musculus
tgtcctgttgcagggccacaatacc

SEQ ID NO: 384988 - DNA, 25 bp, Mus musculus
tgtccttaaaaggttatggctttca

SEQ ID NO: 384989 - DNA, 25 bp, Mus musculus
tgtccttaagtgtgggaacttcgca

SEQ ID NO: 384990 - DNA, 25 bp, Mus musculus
tgtccttaatgaacctcccactgag

SEQ ID NO: 384991 - DNA, 25 bp, Mus musculus
tgtccttacagggaatttaatgaag

SEQ ID NO: 384992 - DNA, 25 bp, Mus musculus
tgtccttactgtcccgagaaggtgt

SEQ ID NO: 384993 - DNA, 25 bp, Mus musculus
tgtccttcactctagcccatccagt

SEQ ID NO: 384994 - DNA, 25 bp, Mus musculus
tgtccttcaggaaggtggtcagcgc

SEQ ID NO: 384995 - DNA, 25 bp, Mus musculus
tgtccttcctgccccttccatcaag

SEQ ID NO: 384996 - DNA, 25 bp, Mus musculus
tgtccttcctgtcagggattgtgcc

SEQ ID NO: 384997 - DNA, 25 bp, Mus musculus
tgtccttcgggacctgctagaagtg

SEQ ID NO: 384998 - DNA, 25 bp, Mus musculus
tgtccttcgggtactatgggttgtc

SEQ ID NO: 384999 - DNA, 25 bp, Mus musculus
tgtccttgaagagcccacctgaatg

SEQ ID NO: 385000 - DNA, 25 bp, Mus musculus
tgtccttgaggcccatctgaacagc

SEQ ID NO: 385001 - DNA, 25 bp, Mus musculus
tgtccttgtaacaagcttaaatcca

SEQ ID NO: 385002 - DNA, 25 bp, Mus musculus
tgtcctttcatgtaaatttacatat

SEQ ID NO: 385003 - DNA, 25 bp, Mus musculus
tgtcgaaccacactaaacaagattg

SEQ ID NO: 385004 - DNA, 25 bp, Mus musculus
tgtcgaacccctggaattgtggagg

SEQ ID NO: 385005 - DNA, 25 bp, Mus musculus
tgtcgaagacggggacattacactt

SEQ ID NO: 385006 - DNA, 25 bp, Mus musculus
tgtcgaaggagacgaagagatgaga

SEQ ID NO: 385007 - DNA, 25 bp, Mus musculus
tgtcgacccgacaaaacttacctgg

SEQ ID NO: 385008 - DNA, 25 bp, Mus musculus
tgtcgacccggaggaggaggaggaa

SEQ ID NO: 385009 - DNA, 25 bp, Mus musculus
tgtcgactggaaggataggtgcggt

SEQ ID NO: 385010 - DNA, 25 bp, Mus musculus
tgtcgactttggaggtctcccagtg

SEQ ID NO: 385011 - DNA, 25 bp, Mus musculus
tgtcgagactcagggtgaaatggtc

SEQ ID NO: 385012 - DNA, 25 bp, Mus musculus
tgtcgagtggcctcggatgtggaag

SEQ ID NO: 385013 - DNA, 25 bp, Mus musculus
tgtcgatgaggtccatgagagaagt

SEQ ID NO: 385014 - DNA, 25 bp, Mus musculus
tgtcgatgggggccgttgactactt

SEQ ID NO: 385015 - DNA, 25 bp, Mus musculus
tgtcgattattcagaagcagaacag

SEQ ID NO: 385016 - DNA, 25 bp, Mus musculus
tgtcgcaaagagctcaccgagctct

SEQ ID NO: 385017 - DNA, 25 bp, Mus musculus
tgtcgcaaagagggtttctctgtgt

SEQ ID NO: 385018 - DNA, 25 bp, Mus musculus
tgtcgcaaagagtgtggggagacct

SEQ ID NO: 385019 - DNA, 25 bp, Mus musculus
tgtcgcacgagagctgcctgtagct

SEQ ID NO: 385020 - DNA, 25 bp, Mus musculus
tgtcgcacgaggtggactcacatta

SEQ ID NO: 385021 - DNA, 25 bp, Mus musculus
tgtcgcagacggttcccagcagtgg

SEQ ID NO: 385022 - DNA, 25 bp, Mus musculus
tgtcgcaggcaaaggttcagaactt

SEQ ID NO: 385023 - DNA, 25 bp, Mus musculus
tgtcgcatccatgtcattgaccaca

SEQ ID NO: 385024 - DNA, 25 bp, Mus musculus
tgtcgccaaagcaaggacgtccacg

SEQ ID NO: 385025 - DNA, 25 bp, Mus musculus
tgtcgccaaagcccatgaaatgatt

SEQ ID NO: 385026 - DNA, 25 bp, Mus musculus
tgtcgccagcccgtcccaggtaaat

SEQ ID NO: 385027 - DNA, 25 bp, Mus musculus
tgtcgccattggatcatctgtccct

SEQ ID NO: 385028 - DNA, 25 bp, Mus musculus
tgtcgccgccacagagttctgtcct

SEQ ID NO: 385029 - DNA, 25 bp, Mus musculus
tgtcgcctgtagttgcagccccacc

SEQ ID NO: 385030 - DNA, 25 bp, Mus musculus
tgtcgctcctgggaccatttactcc

SEQ ID NO: 385031 - DNA, 25 bp, Mus musculus
tgtcgctgaaccgagcctgttcctg

SEQ ID NO: 385032 - DNA, 25 bp, Mus musculus
tgtcgctgcacagtgatgactcttc

SEQ ID NO: 385033 - DNA, 25 bp, Mus musculus
tgtcgctgctcggtgtcgcaacatc

SEQ ID NO: 385034 - DNA, 25 bp, Mus musculus
tgtcgctgtggctacgtgttctgta

SEQ ID NO: 385035 - DNA, 25 bp, Mus musculus
tgtcgcttgtagaaatgccaaagcc

SEQ ID NO: 385036 - DNA, 25 bp, Mus musculus
tgtcgcttgtaggaatgccaaagcc

SEQ ID NO: 385037 - DNA, 25 bp, Mus musculus
tgtcgcttttttatcaggtcgcatc

SEQ ID NO: 385038 - DNA, 25 bp, Mus musculus
tgtcggaagcaaggtctggtccatc

SEQ ID NO: 385039 - DNA, 25 bp, Mus musculus
tgtcggaggccagttctggtccgca

SEQ ID NO: 385040 - DNA, 25 bp, Mus musculus
tgtcggaggctccgtggaacactcg

SEQ ID NO: 385041 - DNA, 25 bp, Mus musculus
tgtcggagttgctgggagacattgg

SEQ ID NO: 385042 - DNA, 25 bp, Mus musculus
tgtcggataaccagtggcatccttt

SEQ ID NO: 385043 - DNA, 25 bp, Mus musculus
tgtcggatcagctgcctgctgtctc

SEQ ID NO: 385044 - DNA, 25 bp, Mus musculus
tgtcggcatggcagcccacccaaac

SEQ ID NO: 385045 - DNA, 25 bp, Mus musculus
tgtcggcggaacaggtaattgctgg

SEQ ID NO: 385046 - DNA, 25 bp, Mus musculus
tgtcggcgtaggaatgtgtttctga

SEQ ID NO: 385047 - DNA, 25 bp, Mus musculus
tgtcggctgagaggcaggctgcaag

SEQ ID NO: 385048 - DNA, 25 bp, Mus musculus
tgtcggctgagaggcaggctgtcaa

SEQ ID NO: 385049 - DNA, 25 bp, Mus musculus
tgtcggcttccttaagacagatggg

SEQ ID NO: 385050 - DNA, 25 bp, Mus musculus
tgtcgggaccgtgaagtggatggga

SEQ ID NO: 385051 - DNA, 25 bp, Mus musculus
tgtcgggagatgagaatcagctgtt

SEQ ID NO: 385052 - DNA, 25 bp, Mus musculus
tgtcgggagatgagcattcgcagcc

SEQ ID NO: 385053 - DNA, 25 bp, Mus musculus
tgtcgggagatggatccttaaattt

SEQ ID NO: 385054 - DNA, 25 bp, Mus musculus
tgtcgggcagaactgtgtctgtatg

SEQ ID NO: 385055 - DNA, 25 bp, Mus musculus
tgtcgggcagccagccattcatgca

SEQ ID NO: 385056 - DNA, 25 bp, Mus musculus
tgtcggggacagagtctcggccacc

SEQ ID NO: 385057 - DNA, 25 bp, Mus musculus
tgtcggtgagatgggtgcaaggatt

SEQ ID NO: 385058 - DNA, 25 bp, Mus musculus
tgtcggtgctatgagtgctctgggg

SEQ ID NO: 385059 - DNA, 25 bp, Mus musculus
tgtcggtgctatggcctgtgctgct

SEQ ID NO: 385060 - DNA, 25 bp, Mus musculus
tgtcgtacacaaatgaagagagact

SEQ ID NO: 385061 - DNA, 25 bp, Mus musculus
tgtcgtagagacactctgcacaaag

SEQ ID NO: 385062 - DNA, 25 bp, Mus musculus
tgtcgtatagagtctgaaggaaggc

SEQ ID NO: 385063 - DNA, 25 bp, Mus musculus
tgtcgtccagtatagggagaagctg

SEQ ID NO: 385064 - DNA, 25 bp, Mus musculus
tgtcgtcgccgagaagacctccttc

SEQ ID NO: 385065 - DNA, 25 bp, Mus musculus
tgtcgtcgtcagcttgacaaaagta

SEQ ID NO: 385066 - DNA, 25 bp, Mus musculus
tgtcgtctgcctctgtccagttgtc

SEQ ID NO: 385067 - DNA, 25 bp, Mus musculus
tgtcgtgacctctaaatgtggtcaa

SEQ ID NO: 385068 - DNA, 25 bp, Mus musculus
tgtcgtgagaagcatggtgaagaaa

SEQ ID NO: 385069 - DNA, 25 bp, Mus musculus
tgtcgtgagaaggtatagcagtgtt

SEQ ID NO: 385070 - DNA, 25 bp, Mus musculus
tgtcgtggaagggttttatggaaga

SEQ ID NO: 385071 - DNA, 25 bp, Mus musculus
tgtcgtggtcagaatttcaaaggcc

SEQ ID NO: 385072 - DNA, 25 bp, Mus musculus
tgtcgttcgaggtaaaaagagaaaa

SEQ ID NO: 385073 - DNA, 25 bp, Mus musculus
tgtcgttggaggcagacgatttaca

SEQ ID NO: 385074 - DNA, 25 bp, Mus musculus
tgtcgttggcttcctgcctggtgag

SEQ ID NO: 385075 - DNA, 25 bp, Mus musculus
tgtctaagactgcagatgcccccga

SEQ ID NO: 385076 - DNA, 25 bp, Mus musculus
tgtctaagattctccttccacgacc

SEQ ID NO: 385077 - DNA, 25 bp, Mus musculus
tgtctaatcattcttgtgaatctct

SEQ ID NO: 385078 - DNA, 25 bp, Mus musculus
tgtctaatcattctttctgagcaga

SEQ ID NO: 385079 - DNA, 25 bp, Mus musculus
tgtctacaaccgctcccaccaacag

SEQ ID NO: 385080 - DNA, 25 bp, Mus musculus
tgtctacaaccggtggcaggatcca

SEQ ID NO: 385081 - DNA, 25 bp, Mus musculus
tgtctaccaacgataaaacaataaa

SEQ ID NO: 385082 - DNA, 25 bp, Mus musculus
tgtctaccagcctcttaaaggtgac

SEQ ID NO: 385083 - DNA, 25 bp, Mus musculus
tgtctaccaggatcctcaggggcgg

SEQ ID NO: 385084 - DNA, 25 bp, Mus musculus
tgtctaccccaggtggcagccttgg

SEQ ID NO: 385085 - DNA, 25 bp, Mus musculus
tgtctacctgatgccgaatgatcac

SEQ ID NO: 385086 - DNA, 25 bp, Mus musculus
tgtctacctgatgcctggcctggtc

SEQ ID NO: 385087 - DNA, 25 bp, Mus musculus
tgtctacctgatgcgcctggagctg

SEQ ID NO: 385088 - DNA, 25 bp, Mus musculus
tgtctacctgtacagggctggtact

SEQ ID NO: 385089 - DNA, 25 bp, Mus musculus
tgtctacctgtacagttttgtggcg

SEQ ID NO: 385090 - DNA, 25 bp, Mus musculus
tgtctacgaacacggccaaagtgaa

SEQ ID NO: 385091 - DNA, 25 bp, Mus musculus
tgtctacgagaagatctcaagaaag

SEQ ID NO: 385092 - DNA, 25 bp, Mus musculus
tgtctacgagaccctgaagaatcgc

SEQ ID NO: 385093 - DNA, 25 bp, Mus musculus
tgtctacggtgccaggctgtactgc

SEQ ID NO: 385094 - DNA, 25 bp, Mus musculus
tgtctacgttaaggtcacctccaag

SEQ ID NO: 385095 - DNA, 25 bp, Mus musculus
tgtctacgttaagttccggcgggag

SEQ ID NO: 385096 - DNA, 25 bp, Mus musculus
tgtctactcaataagctgagagtgc

SEQ ID NO: 385097 - DNA, 25 bp, Mus musculus
tgtctactcacagagagaaaaaacc

SEQ ID NO: 385098 - DNA, 25 bp, Mus musculus
tgtctactcacagagccccgtggct

SEQ ID NO: 385099 - DNA, 25 bp, Mus musculus
tgtctactggtgcattgaagatcgg

SEQ ID NO: 385100 - DNA, 25 bp, Mus musculus
tgtctagaagctctaggaatgattc

SEQ ID NO: 385101 - DNA, 25 bp, Mus musculus
tgtctagaatacgcgtctgatggct

SEQ ID NO: 385102 - DNA, 25 bp, Mus musculus
tgtctagactggctgttcctgtgtt

SEQ ID NO: 385103 - DNA, 25 bp, Mus musculus
tgtctagttcaggccagctgctgct

SEQ ID NO: 385104 - DNA, 25 bp, Mus musculus
tgtctatacagaggctctccctacg

SEQ ID NO: 385105 - DNA, 25 bp, Mus musculus
tgtctatctgccagcagaatggcat

SEQ ID NO: 385106 - DNA, 25 bp, Mus musculus
tgtctatgagacattgaaaaatacc

SEQ ID NO: 385107 - DNA, 25 bp, Mus musculus
tgtctatgagtttctgatgtctggt

SEQ ID NO: 385108 - DNA, 25 bp, Mus musculus
tgtctatggaagaaggatattacaa

SEQ ID NO: 385109 - DNA, 25 bp, Mus musculus
tgtctatggaggaagaagacagcat

SEQ ID NO: 385110 - DNA, 25 bp, Mus musculus
tgtctatggcagtcctgacttcctg

SEQ ID NO: 385111 - DNA, 25 bp, Mus musculus
tgtctatttggagtgtctaaaacct

SEQ ID NO: 385112 - DNA, 25 bp, Mus musculus
tgtctcaaagcgcaaatttcccagc

SEQ ID NO: 385113 - DNA, 25 bp, Mus musculus
tgtctcaacaaaagggctctactac

SEQ ID NO: 385114 - DNA, 25 bp, Mus musculus
tgtctcaacagcctgacagagcagc

SEQ ID NO: 385115 - DNA, 25 bp, Mus musculus
tgtctcaaccctcgtctcttctgtc

SEQ ID NO: 385116 - DNA, 25 bp, Mus musculus
tgtctcaagaatatgttgttgatca

SEQ ID NO: 385117 - DNA, 25 bp, Mus musculus
tgtctcaagtaccggcagtccttta

SEQ ID NO: 385118 - DNA, 25 bp, Mus musculus
tgtctcacaatgccatcaggtttgg

SEQ ID NO: 385119 - DNA, 25 bp, Mus musculus
tgtctcacaatggagatcagaacca

SEQ ID NO: 385120 - DNA, 25 bp, Mus musculus
tgtctcacatccagggtaaagcccc

SEQ ID NO: 385121 - DNA, 25 bp, Mus musculus
tgtctcacatccaggtaaccgagaa

SEQ ID NO: 385122 - DNA, 25 bp, Mus musculus
tgtctcacccaggagatcttcagaa

SEQ ID NO: 385123 - DNA, 25 bp, Mus musculus
tgtctcacccaggagatggagttcc

SEQ ID NO: 385124 - DNA, 25 bp, Mus musculus
tgtctcacccaggatgagtttcatc

SEQ ID NO: 385125 - DNA, 25 bp, Mus musculus
tgtctcacccgggtgctggggacat

SEQ ID NO: 385126 - DNA, 25 bp, Mus musculus
tgtctcagagcttggatctgtctga

SEQ ID NO: 385127 - DNA, 25 bp, Mus musculus
tgtctcagatcttgtaggactccct

SEQ ID NO: 385128 - DNA, 25 bp, Mus musculus
tgtctcagcgcggattaccttatgc

SEQ ID NO: 385129 - DNA, 25 bp, Mus musculus
tgtctcagctggacaaaccatcttt

SEQ ID NO: 385130 - DNA, 25 bp, Mus musculus
tgtctcagctgggtactctcaagtt

SEQ ID NO: 385131 - DNA, 25 bp, Mus musculus
tgtctcaggaaaggtaaacctagcc

SEQ ID NO: 385132 - DNA, 25 bp, Mus musculus
tgtctcagtcgaaaggcaagaagcg

SEQ ID NO: 385133 - DNA, 25 bp, Mus musculus
tgtctcatccctgctcctgtctcca

SEQ ID NO: 385134 - DNA, 25 bp, Mus musculus
tgtctcattctctgcatcgggttca

SEQ ID NO: 385135 - DNA, 25 bp, Mus musculus
tgtctcattgtgtggaatcacaggc

SEQ ID NO: 385136 - DNA, 25 bp, Mus musculus
tgtctcatttggatggcaccacccc

SEQ ID NO: 385137 - DNA, 25 bp, Mus musculus
tgtctccaaaccggagtcctgttga

SEQ ID NO: 385138 - DNA, 25 bp, Mus musculus
tgtctccaagccaagaggacctgcg

SEQ ID NO: 385139 - DNA, 25 bp, Mus musculus
tgtctccacgaccctgctttttgca

SEQ ID NO: 385140 - DNA, 25 bp, Mus musculus
tgtctccagacatggagacaacagc

SEQ ID NO: 385141 - DNA, 25 bp, Mus musculus
tgtctccagtgcaagcagcccagcc

SEQ ID NO: 385142 - DNA, 25 bp, Mus musculus
tgtctcccaggctttgaagggccac

SEQ ID NO: 385143 - DNA, 25 bp, Mus musculus
tgtctcccgagtgccttagtcctgg

SEQ ID NO: 385144 - DNA, 25 bp, Mus musculus
tgtctccctacagagatgggagacc

SEQ ID NO: 385145 - DNA, 25 bp, Mus musculus
tgtctccctacagaggagaatttag

SEQ ID NO: 385146 - DNA, 25 bp, Mus musculus
tgtctccctacagaggtgtgtcaga

SEQ ID NO: 385147 - DNA, 25 bp, Mus musculus
tgtctccgcaggggaacagtacatt

SEQ ID NO: 385148 - DNA, 25 bp, Mus musculus
tgtctccggatctgatcgtctgccg

SEQ ID NO: 385149 - DNA, 25 bp, Mus musculus
tgtctcctcaaggcaccttgttgtg

SEQ ID NO: 385150 - DNA, 25 bp, Mus musculus
tgtctcctccaaaacctcaggctgg

SEQ ID NO: 385151 - DNA, 25 bp, Mus musculus
tgtctcctgcttggctcctgtagtt

SEQ ID NO: 385152 - DNA, 25 bp, Mus musculus
tgtctcgaaccagtggcaacactgg

SEQ ID NO: 385153 - DNA, 25 bp, Mus musculus
tgtctcgagagctgaagacaccagc

SEQ ID NO: 385154 - DNA, 25 bp, Mus musculus
tgtctcgcatgaaggagatcttgga

SEQ ID NO: 385155 - DNA, 25 bp, Mus musculus
tgtctcggataggagatgtttgaga

SEQ ID NO: 385156 - DNA, 25 bp, Mus musculus
tgtctcggtgctcttcaaatgtcgt

SEQ ID NO: 385157 - DNA, 25 bp, Mus musculus
tgtctcggtgtccttcccgtcgaat

SEQ ID NO: 385158 - DNA, 25 bp, Mus musculus
tgtctctattaaaagatgacttaca

SEQ ID NO: 385159 - DNA, 25 bp, Mus musculus
tgtctctattaaaagctcttttgga

SEQ ID NO: 385160 - DNA, 25 bp, Mus musculus
tgtctctcagatgaccactctagag

SEQ ID NO: 385161 - DNA, 25 bp, Mus musculus
tgtctctccggatggacctgatcga

SEQ ID NO: 385162 - DNA, 25 bp, Mus musculus
tgtctctccggcccccgcgcgccgg

SEQ ID NO: 385163 - DNA, 25 bp, Mus musculus
tgtctctcgaagattccccccagct

SEQ ID NO: 385164 - DNA, 25 bp, Mus musculus
tgtctctctttgtagggactacaag

SEQ ID NO: 385165 - DNA, 25 bp, Mus musculus
tgtctctgaagaatgcaccaccaaa

SEQ ID NO: 385166 - DNA, 25 bp, Mus musculus
tgtctctgacaaatcgccagtacct

SEQ ID NO: 385167 - DNA, 25 bp, Mus musculus
tgtctctgacaaattctctccagag

SEQ ID NO: 385168 - DNA, 25 bp, Mus musculus
tgtctctgcagaacaacactgaagt

SEQ ID NO: 385169 - DNA, 25 bp, Mus musculus
tgtctctgcagaccgctcgggaatg

SEQ ID NO: 385170 - DNA, 25 bp, Mus musculus
tgtctctgcagagagtcagtccttc

SEQ ID NO: 385171 - DNA, 25 bp, Mus musculus
tgtctctgcagagtctgcgagaaat

SEQ ID NO: 385172 - DNA, 25 bp, Mus musculus
tgtctctgcagccaaaacaacaccc

SEQ ID NO: 385173 - DNA, 25 bp, Mus musculus
tgtctctgcagccaaaacaacagcc

SEQ ID NO: 385174 - DNA, 25 bp, Mus musculus
tgtctctgcaggtaatgaaaaggga

SEQ ID NO: 385175 - DNA, 25 bp, Mus musculus
tgtctctgtccttgtcttatctcct

SEQ ID NO: 385176 - DNA, 25 bp, Mus musculus
tgtctctgtccttttgcctttatca

SEQ ID NO: 385177 - DNA, 25 bp, Mus musculus
tgtctcttgcacaagttgatgggca

SEQ ID NO: 385178 - DNA, 25 bp, Mus musculus
tgtctctttgacaggagaaggaatg

SEQ ID NO: 385179 - DNA, 25 bp, Mus musculus
tgtctgaaaacgatgatggagctgg

SEQ ID NO: 385180 - DNA, 25 bp, Mus musculus
tgtctgaaaaggctcccccaccgaa

SEQ ID NO: 385181 - DNA, 25 bp, Mus musculus
tgtctgaaaagggccggcaggagga

SEQ ID NO: 385182 - DNA, 25 bp, Mus musculus
tgtctgaaatactgatccagaacac

SEQ ID NO: 385183 - DNA, 25 bp, Mus musculus
tgtctgaaatgacacggagagccat

SEQ ID NO: 385184 - DNA, 25 bp, Mus musculus
tgtctgaaatgagcatctgtaacac

SEQ ID NO: 385185 - DNA, 25 bp, Mus musculus
tgtctgaagaggaggtgctgggccc

SEQ ID NO: 385186 - DNA, 25 bp, Mus musculus
tgtctgaagtgcaggaactctgcaa

SEQ ID NO: 385187 - DNA, 25 bp, Mus musculus
tgtctgaagtgcaggtatcagggtg

SEQ ID NO: 385188 - DNA, 25 bp, Mus musculus
tgtctgacaatgagctgtgtgtccg

SEQ ID NO: 385189 - DNA, 25 bp, Mus musculus
tgtctgacagccctgtgtggggctg

SEQ ID NO: 385190 - DNA, 25 bp, Mus musculus
tgtctgaccagcatgcccgctgcct

SEQ ID NO: 385191 - DNA, 25 bp, Mus musculus
tgtctgaccaggaaaagaaagatgt

SEQ ID NO: 385192 - DNA, 25 bp, Mus musculus
tgtctgacctgtcaaactgggctca

SEQ ID NO: 385193 - DNA, 25 bp, Mus musculus
tgtctgacgaggtgttccacgacat

SEQ ID NO: 385194 - DNA, 25 bp, Mus musculus
tgtctgacgcactgtatcactttcg

SEQ ID NO: 385195 - DNA, 25 bp, Mus musculus
tgtctgacggtgctgggaggatctg

SEQ ID NO: 385196 - DNA, 25 bp, Mus musculus
tgtctgacttcggtcagccatgtca

SEQ ID NO: 385197 - DNA, 25 bp, Mus musculus
tgtctgagaatgaagacactcagcc

SEQ ID NO: 385198 - DNA, 25 bp, Mus musculus
tgtctgagaatgaaggctctggaat

SEQ ID NO: 385199 - DNA, 25 bp, Mus musculus
tgtctgagagacaggacggggcgct

SEQ ID NO: 385200 - DNA, 25 bp, Mus musculus
tgtctgagagacaggccttctgtat

SEQ ID NO: 385201 - DNA, 25 bp, Mus musculus
tgtctgagaggaaccattctctgag

SEQ ID NO: 385202 - DNA, 25 bp, Mus musculus
tgtctgagaggaacccttctctgag

SEQ ID NO: 385203 - DNA, 25 bp, Mus musculus
tgtctgagaggaagttttatctgtg

SEQ ID NO: 385204 - DNA, 25 bp, Mus musculus
tgtctgagcaggagaatctggagaa

SEQ ID NO: 385205 - DNA, 25 bp, Mus musculus
tgtctgagcaggtgctcctgtgtgc

SEQ ID NO: 385206 - DNA, 25 bp, Mus musculus
tgtctgagccgctacagaacctgaa

SEQ ID NO: 385207 - DNA, 25 bp, Mus musculus
tgtctgaggcgcggcccagcactat

SEQ ID NO: 385208 - DNA, 25 bp, Mus musculus
tgtctgaggggaagagatgcaattc

SEQ ID NO: 385209 - DNA, 25 bp, Mus musculus
tgtctgagtaaggagagtccttctt

SEQ ID NO: 385210 - DNA, 25 bp, Mus musculus
tgtctgagtctgaagaagacaaagg

SEQ ID NO: 385211 - DNA, 25 bp, Mus musculus
tgtctgagtgtcaggatggtggtgc

SEQ ID NO: 385212 - DNA, 25 bp, Mus musculus
tgtctgagtgtcaggctgtgagtcc

SEQ ID NO: 385213 - DNA, 25 bp, Mus musculus
tgtctgataaataagagggcaatgc

SEQ ID NO: 385214 - DNA, 25 bp, Mus musculus
tgtctgatggaggtaaaagtaactc

SEQ ID NO: 385215 - DNA, 25 bp, Mus musculus
tgtctgattctgaggtgtggcttga

SEQ ID NO: 385216 - DNA, 25 bp, Mus musculus
tgtctgcaaaaagaaatacgaagaa

SEQ ID NO: 385217 - DNA, 25 bp, Mus musculus
tgtctgcaagagaccgggctcatca

SEQ ID NO: 385218 - DNA, 25 bp, Mus musculus
tgtctgcaagcatcctggtcaacat

SEQ ID NO: 385219 - DNA, 25 bp, Mus musculus
tgtctgcaaggaatggaccgggttc

SEQ ID NO: 385220 - DNA, 25 bp, Mus musculus
tgtctgcaaggagaagatcggatgg

SEQ ID NO: 385221 - DNA, 25 bp, Mus musculus
tgtctgcaaggatccagcaatgcct

SEQ ID NO: 385222 - DNA, 25 bp, Mus musculus
tgtctgcaaggatctctcctcacca

SEQ ID NO: 385223 - DNA, 25 bp, Mus musculus
tgtctgcaatcccaaaccttgtcac

SEQ ID NO: 385224 - DNA, 25 bp, Mus musculus
tgtctgcactatcggtctgtgcact

SEQ ID NO: 385225 - DNA, 25 bp, Mus musculus
tgtctgcactatcggtttggaggta

SEQ ID NO: 385226 - DNA, 25 bp, Mus musculus
tgtctgcactggtgaccatgtacag

SEQ ID NO: 385227 - DNA, 25 bp, Mus musculus
tgtctgcaggaagggtccccctgtg

SEQ ID NO: 385228 - DNA, 25 bp, Mus musculus
tgtctgcaggaaggtgtggggcgga

SEQ ID NO: 385229 - DNA, 25 bp, Mus musculus
tgtctgcagtaggggctgctgaata

SEQ ID NO: 385230 - DNA, 25 bp, Mus musculus
tgtctgccagaatggggaggtagag

SEQ ID NO: 385231 - DNA, 25 bp, Mus musculus
tgtctgccagactgtcattgaagac

SEQ ID NO: 385232 - DNA, 25 bp, Mus musculus
tgtctgccagccaggtgcccaggac

SEQ ID NO: 385233 - DNA, 25 bp, Mus musculus
tgtctgccagtgtgccccaggctat

SEQ ID NO: 385234 - DNA, 25 bp, Mus musculus
tgtctgccctggatgacttgaaagt

SEQ ID NO: 385235 - DNA, 25 bp, Mus musculus
tgtctgccgtgcgtctcttcctgca

SEQ ID NO: 385236 - DNA, 25 bp, Mus musculus
tgtctgccgtgtgtctgcccatcgt

SEQ ID NO: 385237 - DNA, 25 bp, Mus musculus
tgtctgcctcaaagctcattggcta

SEQ ID NO: 385238 - DNA, 25 bp, Mus musculus
tgtctgcctgtccagacatcttctt

SEQ ID NO: 385239 - DNA, 25 bp, Mus musculus
tgtctgcctgtccagggatttggac

SEQ ID NO: 385240 - DNA, 25 bp, Mus musculus
tgtctgcctttggaaaggagcaccg

SEQ ID NO: 385241 - DNA, 25 bp, Mus musculus
tgtctgcgatttagctgctgtgtgg

SEQ ID NO: 385242 - DNA, 25 bp, Mus musculus
tgtctgcgtctcgagacaagaccat

SEQ ID NO: 385243 - DNA, 25 bp, Mus musculus
tgtctgctattaagatcgagttctc

SEQ ID NO: 385244 - DNA, 25 bp, Mus musculus
tgtctgctccctggtggttctctgc

SEQ ID NO: 385245 - DNA, 25 bp, Mus musculus
tgtctgctcctggccttcccagagg

SEQ ID NO: 385246 - DNA, 25 bp, Mus musculus
tgtctgcttggagccctgcactatt

SEQ ID NO: 385247 - DNA, 25 bp, Mus musculus
tgtctgctttcaagaaaggcgacag

SEQ ID NO: 385248 - DNA, 25 bp, Mus musculus
tgtctggaaagagaaaacatcgctc

SEQ ID NO: 385249 - DNA, 25 bp, Mus musculus
tgtctggaaggtcgctgtgctatgg

SEQ ID NO: 385250 - DNA, 25 bp, Mus musculus
tgtctggaatcacaggccaactact

SEQ ID NO: 385251 - DNA, 25 bp, Mus musculus
tgtctggaatcccaggccaactact

SEQ ID NO: 385252 - DNA, 25 bp, Mus musculus
tgtctggacagagtttgatgagtgg

SEQ ID NO: 385253 - DNA, 25 bp, Mus musculus
tgtctggacggcctgtatgccctga

SEQ ID NO: 385254 - DNA, 25 bp, Mus musculus
tgtctggacttgggcggacgtatgt

SEQ ID NO: 385255 - DNA, 25 bp, Mus musculus
tgtctggacttggggggacgtatgt

SEQ ID NO: 385256 - DNA, 25 bp, Mus musculus
tgtctggagaagattgaagaaatgc

SEQ ID NO: 385257 - DNA, 25 bp, Mus musculus
tgtctggagaaggtggactatagtg

SEQ ID NO: 385258 - DNA, 25 bp, Mus musculus
tgtctggagacacagcatcttgcag

SEQ ID NO: 385259 - DNA, 25 bp, Mus musculus
tgtctggatgccagccactgctgtg

SEQ ID NO: 385260 - DNA, 25 bp, Mus musculus
tgtctggcacaagggtgactgtggc

SEQ ID NO: 385261 - DNA, 25 bp, Mus musculus
tgtctggcccacaagacccgcccta

SEQ ID NO: 385262 - DNA, 25 bp, Mus musculus
tgtctggcccacaagcccccactgt

SEQ ID NO: 385263 - DNA, 25 bp, Mus musculus
tgtctggcgagtctgtgaaggcccc

SEQ ID NO: 385264 - DNA, 25 bp, Mus musculus
tgtctgggaaagagtgtgaggagat

SEQ ID NO: 385265 - DNA, 25 bp, Mus musculus
tgtctgggaggagccacccgcggtc

SEQ ID NO: 385266 - DNA, 25 bp, Mus musculus
tgtctgggatctaagtaaaattgga

SEQ ID NO: 385267 - DNA, 25 bp, Mus musculus
tgtctggtagcagttggaacaagag

SEQ ID NO: 385268 - DNA, 25 bp, Mus musculus
tgtctgtagtgatgctgcatgccat

SEQ ID NO: 385269 - DNA, 25 bp, Mus musculus
tgtctgtatcacagctgcctcatat

SEQ ID NO: 385270 - DNA, 25 bp, Mus musculus
tgtctgtatccagcgagacggtcat

SEQ ID NO: 385271 - DNA, 25 bp, Mus musculus
tgtctgtatgagaacaaagccagtc

SEQ ID NO: 385272 - DNA, 25 bp, Mus musculus
tgtctgtatgagtggctgagagggt

SEQ ID NO: 385273 - DNA, 25 bp, Mus musculus
tgtctgtattgagaaacctgaaaaa

SEQ ID NO: 385274 - DNA, 25 bp, Mus musculus
tgtctgtctatgaaaatgacactgt

SEQ ID NO: 385275 - DNA, 25 bp, Mus musculus
tgtctgtctatggtatcatcagaga

SEQ ID NO: 385276 - DNA, 25 bp, Mus musculus
tgtctgtctctttgacaggagaagg

SEQ ID NO: 385277 - DNA, 25 bp, Mus musculus
tgtctgtctggctggaaatgtttct

SEQ ID NO: 385278 - DNA, 25 bp, Mus musculus
tgtctgtctgggagatgctatttcc

SEQ ID NO: 385279 - DNA, 25 bp, Mus musculus
tgtctgtgactggattggccgcaga

SEQ ID NO: 385280 - DNA, 25 bp, Mus musculus
tgtctgtgagcagtctcgaatggaa

SEQ ID NO: 385281 - DNA, 25 bp, Mus musculus
tgtctgtgaggagttcaaggatgtg

SEQ ID NO: 385282 - DNA, 25 bp, Mus musculus
tgtctgtggcggcacagtggttgaa

SEQ ID NO: 385283 - DNA, 25 bp, Mus musculus
tgtctgtggcggtcattgtcatgag

SEQ ID NO: 385284 - DNA, 25 bp, Mus musculus
tgtctgtggctcagctatcttccag

SEQ ID NO: 385285 - DNA, 25 bp, Mus musculus
tgtctgtggctgtcctccaggagga

SEQ ID NO: 385286 - DNA, 25 bp, Mus musculus
tgtctgtggtcctgaatccttcaca

SEQ ID NO: 385287 - DNA, 25 bp, Mus musculus
tgtctgtgtggaggtacattcgctc

SEQ ID NO: 385288 - DNA, 25 bp, Mus musculus
tgtctgttgcggtggcactgcttcg

SEQ ID NO: 385289 - DNA, 25 bp, Mus musculus
tgtctgttgtttctctgctgcccta

SEQ ID NO: 385290 - DNA, 25 bp, Mus musculus
tgtcttaaaggccgttgatgctcac

SEQ ID NO: 385291 - DNA, 25 bp, Mus musculus
tgtcttaaaggtatctcattcagtt

SEQ ID NO: 385292 - DNA, 25 bp, Mus musculus
tgtcttaatcagtggatggagacca

SEQ ID NO: 385293 - DNA, 25 bp, Mus musculus
tgtcttagatcagaaaagattcggc

SEQ ID NO: 385294 - DNA, 25 bp, Mus musculus
tgtcttagatcagaggcggcagacc

SEQ ID NO: 385295 - DNA, 25 bp, Mus musculus
tgtcttagctggcggtgtggcaccc

SEQ ID NO: 385296 - DNA, 25 bp, Mus musculus
tgtcttattcctcctatgaggcgtc

SEQ ID NO: 385297 - DNA, 25 bp, Mus musculus
tgtcttatttaaagctgagtgcaat

SEQ ID NO: 385298 - DNA, 25 bp, Mus musculus
tgtcttatttaagacttcattgaac

SEQ ID NO: 385299 - DNA, 25 bp, Mus musculus
tgtcttcaagaggaccctggcccag

SEQ ID NO: 385300 - DNA, 25 bp, Mus musculus
tgtcttcaagaggacgtccttcatt

SEQ ID NO: 385301 - DNA, 25 bp, Mus musculus
tgtcttcaaggtgccgccatgctgc

SEQ ID NO: 385302 - DNA, 25 bp, Mus musculus
tgtcttcaagtaaaggatctccctc

SEQ ID NO: 385303 - DNA, 25 bp, Mus musculus
tgtcttcacatcatgaagtgtgatc

SEQ ID NO: 385304 - DNA, 25 bp, Mus musculus
tgtcttcagagattttcacagctga

SEQ ID NO: 385305 - DNA, 25 bp, Mus musculus
tgtcttcattaggtgctgacctctc

SEQ ID NO: 385306 - DNA, 25 bp, Mus musculus
tgtcttcatttagggacaagaagac

SEQ ID NO: 385307 - DNA, 25 bp, Mus musculus
tgtcttccaaaaggctcaaagactt

SEQ ID NO: 385308 - DNA, 25 bp, Mus musculus
tgtcttccaagagaggaggctgtga

SEQ ID NO: 385309 - DNA, 25 bp, Mus musculus
tgtcttccaggccaagttccttcct

SEQ ID NO: 385310 - DNA, 25 bp, Mus musculus
tgtcttccccccaggattcttccta

SEQ ID NO: 385311 - DNA, 25 bp, Mus musculus
tgtcttccccccaggcttaagatac

SEQ ID NO: 385312 - DNA, 25 bp, Mus musculus
tgtcttcctagccacgagtctagca

SEQ ID NO: 385313 - DNA, 25 bp, Mus musculus
tgtcttcctatcagagagtgactca

SEQ ID NO: 385314 - DNA, 25 bp, Mus musculus
tgtcttcctatcagggctcagttct

SEQ ID NO: 385315 - DNA, 25 bp, Mus musculus
tgtcttctactgcggctggtgtcag

SEQ ID NO: 385316 - DNA, 25 bp, Mus musculus
tgtcttctactgcgggatggccatc

SEQ ID NO: 385317 - DNA, 25 bp, Mus musculus
tgtcttctactgcgggcatggtgaa

SEQ ID NO: 385318 - DNA, 25 bp, Mus musculus
tgtcttctcgcatgcacgcctacca

SEQ ID NO: 385319 - DNA, 25 bp, Mus musculus
tgtcttctgggtgctgggagccctg

SEQ ID NO: 385320 - DNA, 25 bp, Mus musculus
tgtcttctggttctctgtgttcctc

SEQ ID NO: 385321 - DNA, 25 bp, Mus musculus
tgtcttctgtgatggactgcagtaa

SEQ ID NO: 385322 - DNA, 25 bp, Mus musculus
tgtcttctgtgatggccaaagatct

SEQ ID NO: 385323 - DNA, 25 bp, Mus musculus
tgtcttctttgtcagtttgtccctg

SEQ ID NO: 385324 - DNA, 25 bp, Mus musculus
tgtcttgacaccaggaacctatggg

SEQ ID NO: 385325 - DNA, 25 bp, Mus musculus
tgtcttgacaccaggctgaccttct

SEQ ID NO: 385326 - DNA, 25 bp, Mus musculus
tgtcttgagctggaagccggttcct

SEQ ID NO: 385327 - DNA, 25 bp, Mus musculus
tgtcttgagctggcccatcatggct

SEQ ID NO: 385328 - DNA, 25 bp, Mus musculus
tgtcttgcaggtggaatgccatcca

SEQ ID NO: 385329 - DNA, 25 bp, Mus musculus
tgtcttggtcgatgggatgctttat

SEQ ID NO: 385330 - DNA, 25 bp, Mus musculus
tgtcttggtcggaggtggctattgc

SEQ ID NO: 385331 - DNA, 25 bp, Mus musculus
tgtcttgtaaccctgagataacaga

SEQ ID NO: 385332 - DNA, 25 bp, Mus musculus
tgtctttaagaattctgtctttatt

SEQ ID NO: 385333 - DNA, 25 bp, Mus musculus
tgtctttaaggtctctaatagatgc

SEQ ID NO: 385334 - DNA, 25 bp, Mus musculus
tgtctttaaggtggtgctgatcggc

SEQ ID NO: 385335 - DNA, 25 bp, Mus musculus
tgtctttaaggtgtttgtggccagc

SEQ ID NO: 385336 - DNA, 25 bp, Mus musculus
tgtctttacagtatgtaggccatgg

SEQ ID NO: 385337 - DNA, 25 bp, Mus musculus
tgtctttacagttgctagacctgat

SEQ ID NO: 385338 - DNA, 25 bp, Mus musculus
tgtctttatctgcatcccctgtgag

SEQ ID NO: 385339 - DNA, 25 bp, Mus musculus
tgtctttattagatgatgcagtccc

SEQ ID NO: 385340 - DNA, 25 bp, Mus musculus
tgtctttcagggtggtaggaatgta

SEQ ID NO: 385341 - DNA, 25 bp, Mus musculus
tgtctttccaacagagcttaccaaa

SEQ ID NO: 385342 - DNA, 25 bp, Mus musculus
tgtctttccagcttctcctggtctc

SEQ ID NO: 385343 - DNA, 25 bp, Mus musculus
tgtctttccagggagctcccgtcca

SEQ ID NO: 385344 - DNA, 25 bp, Mus musculus
tgtctttcctaaattctctgccctt

SEQ ID NO: 385345 - DNA, 25 bp, Mus musculus
tgtctttcgatttgcgatcttctgc

SEQ ID NO: 385346 - DNA, 25 bp, Mus musculus
tgtctttcgatttgctttgtccata

SEQ ID NO: 385347 - DNA, 25 bp, Mus musculus
tgtctttctctagcttttcctatga

SEQ ID NO: 385348 - DNA, 25 bp, Mus musculus
tgtctttgcaaggtattgtcgcctt

SEQ ID NO: 385349 - DNA, 25 bp, Mus musculus
tgtctttgcccggaacacacgccgg

SEQ ID NO: 385350 - DNA, 25 bp, Mus musculus
tgtctttgcgggcgtgctggtcacc

SEQ ID NO: 385351 - DNA, 25 bp, Mus musculus
tgtctttgcgggtgcctggctgagg

SEQ ID NO: 385352 - DNA, 25 bp, Mus musculus
tgtctttggagagctcaaagagaag

SEQ ID NO: 385353 - DNA, 25 bp, Mus musculus
tgtctttggagatctctgacatcta

SEQ ID NO: 385354 - DNA, 25 bp, Mus musculus
tgtctttgtaccaggatcttgaaac

SEQ ID NO: 385355 - DNA, 25 bp, Mus musculus
tgtctttgtaccagggggctggtgg

SEQ ID NO: 385356 - DNA, 25 bp, Mus musculus
tgtcttttactatagccccagcggg

SEQ ID NO: 385357 - DNA, 25 bp, Mus musculus
tgtcttttctatagatgcccaacat

SEQ ID NO: 385358 - DNA, 25 bp, Mus musculus
tgtcttttctgcccccagctatttt

SEQ ID NO: 385359 - DNA, 25 bp, Mus musculus
tgtcttttcttcggtgggtctcgga

SEQ ID NO: 385360 - DNA, 25 bp, Mus musculus
tgtcttttcttgccaatgaggcgag

SEQ ID NO: 385361 - DNA, 25 bp, Mus musculus
tgtcttttgcaatcaaagttctatt

SEQ ID NO: 385362 - DNA, 25 bp, Mus musculus
tgtcttttgcaattagaagatggag

SEQ ID NO: 385363 - DNA, 25 bp, Mus musculus
tgtcttttttgaaattggcaccgac

SEQ ID NO: 385364 - DNA, 25 bp, Mus musculus
tgtcttttttgctgagaaagtgatg

SEQ ID NO: 385365 - DNA, 25 bp, Mus musculus
tgtgaaaaaccaggtggaggatctt

SEQ ID NO: 385366 - DNA, 25 bp, Mus musculus
tgtgaaaaagctggaggcaagaaag

SEQ ID NO: 385367 - DNA, 25 bp, Mus musculus
tgtgaaaaagtattcaaacatagga

SEQ ID NO: 385368 - DNA, 25 bp, Mus musculus
tgtgaaaaatgagtttggcaaaggt

SEQ ID NO: 385369 - DNA, 25 bp, Mus musculus
tgtgaaaagagtgtcccagcagatg

SEQ ID NO: 385370 - DNA, 25 bp, Mus musculus
tgtgaaaaggagtgttaagcaaaag

SEQ ID NO: 385371 - DNA, 25 bp, Mus musculus
tgtgaaaatgcaaaggcaggaagga

SEQ ID NO: 385372 - DNA, 25 bp, Mus musculus
tgtgaaaatgcaaaggtttcatcac

SEQ ID NO: 385373 - DNA, 25 bp, Mus musculus
tgtgaaacagacaagcagatggggt

SEQ ID NO: 385374 - DNA, 25 bp, Mus musculus
tgtgaaacagggaagcagctggccc

SEQ ID NO: 385375 - DNA, 25 bp, Mus musculus
tgtgaaaccgagaccaactactaca

SEQ ID NO: 385376 - DNA, 25 bp, Mus musculus
tgtgaaaccggttgttctacacagc

SEQ ID NO: 385377 - DNA, 25 bp, Mus musculus
tgtgaaagactaggccaatcccttt

SEQ ID NO: 385378 - DNA, 25 bp, Mus musculus
tgtgaaagagaagcagtgaacttat

SEQ ID NO: 385379 - DNA, 25 bp, Mus musculus
tgtgaaagatcagtttggctttatt

SEQ ID NO: 385380 - DNA, 25 bp, Mus musculus
tgtgaaagggtcacggacctcttca

SEQ ID NO: 385381 - DNA, 25 bp, Mus musculus
tgtgaaagggtcacggttgcatctg

SEQ ID NO: 385382 - DNA, 25 bp, Mus musculus
tgtgaaagtacatttgcaagaatag

SEQ ID NO: 385383 - DNA, 25 bp, Mus musculus
tgtgaaagtggaacccagtgacaat

SEQ ID NO: 385384 - DNA, 25 bp, Mus musculus
tgtgaaagtgttacaggtttatgat

SEQ ID NO: 385385 - DNA, 25 bp, Mus musculus
tgtgaaataggtgagaagccagatc

SEQ ID NO: 385386 - DNA, 25 bp, Mus musculus
tgtgaaatagttttgggattttgcc

SEQ ID NO: 385387 - DNA, 25 bp, Mus musculus
tgtgaaatcaaggttacagaatgtc

SEQ ID NO: 385388 - DNA, 25 bp, Mus musculus
tgtgaaatgcacgatgaggaaactg

SEQ ID NO: 385389 - DNA, 25 bp, Mus musculus
tgtgaacaaagtgaattccaaggct

SEQ ID NO: 385390 - DNA, 25 bp, Mus musculus
tgtgaacaagatgacggtcagcgtc

SEQ ID NO: 385391 - DNA, 25 bp, Mus musculus
tgtgaacaagggttcccgagagaac

SEQ ID NO: 385392 - DNA, 25 bp, Mus musculus
tgtgaacacaagggtcatccaaacg

SEQ ID NO: 385393 - DNA, 25 bp, Mus musculus
tgtgaacaccccgggcttgcccagg

SEQ ID NO: 385394 - DNA, 25 bp, Mus musculus
tgtgaacactgagcctacacaggtg

SEQ ID NO: 385395 - DNA, 25 bp, Mus musculus
tgtgaacactgcgaaattgcccatt

SEQ ID NO: 385396 - DNA, 25 bp, Mus musculus
tgtgaacagaggcagaaactttgtc

SEQ ID NO: 385397 - DNA, 25 bp, Mus musculus
tgtgaacagttcaaattccatcaag

SEQ ID NO: 385398 - DNA, 25 bp, Mus musculus
tgtgaacagtttaaagcatgctagt

SEQ ID NO: 385399 - DNA, 25 bp, Mus musculus
tgtgaaccaaggaattcatcctaca

SEQ ID NO: 385400 - DNA, 25 bp, Mus musculus
tgtgaacccaagagacttctctacc

SEQ ID NO: 385401 - DNA, 25 bp, Mus musculus
tgtgaacccatcaggaaggatcatc

SEQ ID NO: 385402 - DNA, 25 bp, Mus musculus
tgtgaacccatcaggctgacatcaa

SEQ ID NO: 385403 - DNA, 25 bp, Mus musculus
tgtgaacctgaaaaatcatgtgggc

SEQ ID NO: 385404 - DNA, 25 bp, Mus musculus
tgtgaacctgacgtggccattcgtg

SEQ ID NO: 385405 - DNA, 25 bp, Mus musculus
tgtgaacgaagggaacaagtcatac

SEQ ID NO: 385406 - DNA, 25 bp, Mus musculus
tgtgaacgtgttagactcccatttc

SEQ ID NO: 385407 - DNA, 25 bp, Mus musculus
tgtgaactagagcttctggaatttc

SEQ ID NO: 385408 - DNA, 25 bp, Mus musculus
tgtgaactccagggaggttagaagg

SEQ ID NO: 385409 - DNA, 25 bp, Mus musculus
tgtgaactgttcagacgcctccttg

SEQ ID NO: 385410 - DNA, 25 bp, Mus musculus
tgtgaagaaccagggccagtgcggg

SEQ ID NO: 385411 - DNA, 25 bp, Mus musculus
tgtgaagaaccgacgcagacccttt

SEQ ID NO: 385412 - DNA, 25 bp, Mus musculus
tgtgaagaagggaagtgtgtttaat

SEQ ID NO: 385413 - DNA, 25 bp, Mus musculus
tgtgaagaagtggggtgccgccatg

SEQ ID NO: 385414 - DNA, 25 bp, Mus musculus
tgtgaagaatgtggcttcccagaca

SEQ ID NO: 385415 - DNA, 25 bp, Mus musculus
tgtgaagaattccatcaatggaaaa

SEQ ID NO: 385416 - DNA, 25 bp, Mus musculus
tgtgaagacgtgagcaagatggggc

SEQ ID NO: 385417 - DNA, 25 bp, Mus musculus
tgtgaagacgtggaggcatccaggc

SEQ ID NO: 385418 - DNA, 25 bp, Mus musculus
tgtgaagagcgtgggtgtggtggct

SEQ ID NO: 385419 - DNA, 25 bp, Mus musculus
tgtgaagagctgctggagcaggcac

SEQ ID NO: 385420 - DNA, 25 bp, Mus musculus
tgtgaagatctgctttcccaggcta

SEQ ID NO: 385421 - DNA, 25 bp, Mus musculus
tgtgaagatggagagcttccctatg

SEQ ID NO: 385422 - DNA, 25 bp, Mus musculus
tgtgaagcagaagtacctggactat

SEQ ID NO: 385423 - DNA, 25 bp, Mus musculus
tgtgaagccaccagcatctgctcga

SEQ ID NO: 385424 - DNA, 25 bp, Mus musculus
tgtgaagccacgcttgcctctccac

SEQ ID NO: 385425 - DNA, 25 bp, Mus musculus
tgtgaagccacgttgtgggacctaa

SEQ ID NO: 385426 - DNA, 25 bp, Mus musculus
tgtgaagccagacagccccaggatc

SEQ ID NO: 385427 - DNA, 25 bp, Mus musculus
tgtgaagccagacagggttgccata

SEQ ID NO: 385428 - DNA, 25 bp, Mus musculus
tgtgaagccagtattccccttccat

SEQ ID NO: 385429 - DNA, 25 bp, Mus musculus
tgtgaagcccggagggatccttttg

SEQ ID NO: 385430 - DNA, 25 bp, Mus musculus
tgtgaagcgaggtctaagccgactc

SEQ ID NO: 385431 - DNA, 25 bp, Mus musculus
tgtgaagcgagtttcagggacacgt

SEQ ID NO: 385432 - DNA, 25 bp, Mus musculus
tgtgaagctccgttttgttcagttg

SEQ ID NO: 385433 - DNA, 25 bp, Mus musculus
tgtgaaggaagccaaagagaaaaca

SEQ ID NO: 385434 - DNA, 25 bp, Mus musculus
tgtgaaggaaggactccaccgctaa

SEQ ID NO: 385435 - DNA, 25 bp, Mus musculus
tgtgaaggatgccagcccaaaccag

SEQ ID NO: 385436 - DNA, 25 bp, Mus musculus
tgtgaaggatgccagccctccaggg

SEQ ID NO: 385437 - DNA, 25 bp, Mus musculus
tgtgaaggatggcgaaacctgacca

SEQ ID NO: 385438 - DNA, 25 bp, Mus musculus
tgtgaagggtcagatttctcagctg

SEQ ID NO: 385439 - DNA, 25 bp, Mus musculus
tgtgaagtacctggttaactttgtg

SEQ ID NO: 385440 - DNA, 25 bp, Mus musculus
tgtgaagtcattcaattctggaaca

SEQ ID NO: 385441 - DNA, 25 bp, Mus musculus
tgtgaagtccaagctggaggcattc

SEQ ID NO: 385442 - DNA, 25 bp, Mus musculus
tgtgaagtctcttattggtgcagca

SEQ ID NO: 385443 - DNA, 25 bp, Mus musculus
tgtgaagtgctctggtcctccttgt

SEQ ID NO: 385444 - DNA, 25 bp, Mus musculus
tgtgaagtggaacactgactgtcac

SEQ ID NO: 385445 - DNA, 25 bp, Mus musculus
tgtgaagtgtttggattcacaacac

SEQ ID NO: 385446 - DNA, 25 bp, Mus musculus
tgtgaataaatgtctcattaagaac

SEQ ID NO: 385447 - DNA, 25 bp, Mus musculus
tgtgaatacatacacaaaggcatta

SEQ ID NO: 385448 - DNA, 25 bp, Mus musculus
tgtgaatatcagacatgtacatgga

SEQ ID NO: 385449 - DNA, 25 bp, Mus musculus
tgtgaatatcaggacaatgggctgg

SEQ ID NO: 385450 - DNA, 25 bp, Mus musculus
tgtgaatctaggtgtagaagccaca

SEQ ID NO: 385451 - DNA, 25 bp, Mus musculus
tgtgaatctgtttcccatgctgaga

SEQ ID NO: 385452 - DNA, 25 bp, Mus musculus
tgtgaatcttctggacatgttgacc

SEQ ID NO: 385453 - DNA, 25 bp, Mus musculus
tgtgaatgaaataatagctactctt

SEQ ID NO: 385454 - DNA, 25 bp, Mus musculus
tgtgaatggaggttggagacctagg

SEQ ID NO: 385455 - DNA, 25 bp, Mus musculus
tgtgaatgtctgtgtcagcagctcc

SEQ ID NO: 385456 - DNA, 25 bp, Mus musculus
tgtgaatgtgagagacctctcagta

SEQ ID NO: 385457 - DNA, 25 bp, Mus musculus
tgtgaatgtgaggcctcagtgagct

SEQ ID NO: 385458 - DNA, 25 bp, Mus musculus
tgtgaattagatgcaacgtgtaaca

SEQ ID NO: 385459 - DNA, 25 bp, Mus musculus
tgtgaattctgccagataaaacacg

SEQ ID NO: 385460 - DNA, 25 bp, Mus musculus
tgtgaattctgccagatactggatt

SEQ ID NO: 385461 - DNA, 25 bp, Mus musculus
tgtgaattgtagcaccatcccgatt

SEQ ID NO: 385462 - DNA, 25 bp, Mus musculus
tgtgaatttgggaggtcataagtgg

SEQ ID NO: 385463 - DNA, 25 bp, Mus musculus
tgtgaatttgggcacctccgcacct

SEQ ID NO: 385464 - DNA, 25 bp, Mus musculus
tgtgaattttgaggtggcccgggag

SEQ ID NO: 385465 - DNA, 25 bp, Mus musculus
tgtgaattttgagtctttccttctg

SEQ ID NO: 385466 - DNA, 25 bp, Mus musculus
tgtgacaaaggggaggaaatcttcc

SEQ ID NO: 385467 - DNA, 25 bp, Mus musculus
tgtgacaactgtgatgatccgggag

SEQ ID NO: 385468 - DNA, 25 bp, Mus musculus
tgtgacaagcagcctgacaaaagac

SEQ ID NO: 385469 - DNA, 25 bp, Mus musculus
tgtgacaagcaggctgagtaattta

SEQ ID NO: 385470 - DNA, 25 bp, Mus musculus
tgtgacaaggccaggtgtggaggca

SEQ ID NO: 385471 - DNA, 25 bp, Mus musculus
tgtgacaagttctcgcacacaagaa

SEQ ID NO: 385472 - DNA, 25 bp, Mus musculus
tgtgacaagttctcggcctatggct

SEQ ID NO: 385473 - DNA, 25 bp, Mus musculus
tgtgacactgtcagagtatttttct

SEQ ID NO: 385474 - DNA, 25 bp, Mus musculus
tgtgacacttggtccctccagctat

SEQ ID NO: 385475 - DNA, 25 bp, Mus musculus
tgtgacagaaaggcgatctctttcc

SEQ ID NO: 385476 - DNA, 25 bp, Mus musculus
tgtgacagaaagggaacgcatcatc

SEQ ID NO: 385477 - DNA, 25 bp, Mus musculus
tgtgacagacaagatttgaaagaag

SEQ ID NO: 385478 - DNA, 25 bp, Mus musculus
tgtgacagagtgggacttggtatgc

SEQ ID NO: 385479 - DNA, 25 bp, Mus musculus
tgtgacagggatgagtgggatgtac

SEQ ID NO: 385480 - DNA, 25 bp, Mus musculus
tgtgacagtatcgaggagaaagaaa

SEQ ID NO: 385481 - DNA, 25 bp, Mus musculus
tgtgacagtgatactagtcgacaat

SEQ ID NO: 385482 - DNA, 25 bp, Mus musculus
tgtgacagtgatactagtttaaaag

SEQ ID NO: 385483 - DNA, 25 bp, Mus musculus
tgtgacatactggggtgagcatgcc

SEQ ID NO: 385484 - DNA, 25 bp, Mus musculus
tgtgacatcacagctggtgaatgag

SEQ ID NO: 385485 - DNA, 25 bp, Mus musculus
tgtgacatccccctggttggtttta

SEQ ID NO: 385486 - DNA, 25 bp, Mus musculus
tgtgacatctacagctataacccag

SEQ ID NO: 385487 - DNA, 25 bp, Mus musculus
tgtgacattgagctgggctttgagg

SEQ ID NO: 385488 - DNA, 25 bp, Mus musculus
tgtgacattgtgctgggctttgagg

SEQ ID NO: 385489 - DNA, 25 bp, Mus musculus
tgtgaccacagaatcagacacaagt

SEQ ID NO: 385490 - DNA, 25 bp, Mus musculus
tgtgaccacagatcttaccttctct

SEQ ID NO: 385491 - DNA, 25 bp, Mus musculus
tgtgaccactcaagcccatcgtttc

SEQ ID NO: 385492 - DNA, 25 bp, Mus musculus
tgtgaccactcaaggcaccacaatg

SEQ ID NO: 385493 - DNA, 25 bp, Mus musculus
tgtgaccactcgtcctgaggttagc

SEQ ID NO: 385494 - DNA, 25 bp, Mus musculus
tgtgaccatactcccgagatgttag

SEQ ID NO: 385495 - DNA, 25 bp, Mus musculus
tgtgaccatcacagggtttgtggat

SEQ ID NO: 385496 - DNA, 25 bp, Mus musculus
tgtgaccatcacaggtctattctgg

SEQ ID NO: 385497 - DNA, 25 bp, Mus musculus
tgtgaccatcaggtactgcagggtt

SEQ ID NO: 385498 - DNA, 25 bp, Mus musculus
tgtgaccatggtttgggatcaaagc

SEQ ID NO: 385499 - DNA, 25 bp, Mus musculus
tgtgacccaccaacatgacctgggg

SEQ ID NO: 385500 - DNA, 25 bp, Mus musculus
tgtgacccaggagctgccttacaga

SEQ ID NO: 385501 - DNA, 25 bp, Mus musculus
tgtgaccgagatcaagatccacttc

SEQ ID NO: 385502 - DNA, 25 bp, Mus musculus
tgtgaccgaggttgaacatttcaag

SEQ ID NO: 385503 - DNA, 25 bp, Mus musculus
tgtgacctcaggggagctgctgcag

SEQ ID NO: 385504 - DNA, 25 bp, Mus musculus
tgtgacctcgcgagtttcctgacag

SEQ ID NO: 385505 - DNA, 25 bp, Mus musculus
tgtgacctgcttggttcaactggag

SEQ ID NO: 385506 - DNA, 25 bp, Mus musculus
tgtgacctgtataatggttacacag

SEQ ID NO: 385507 - DNA, 25 bp, Mus musculus
tgtgaccttagaatcagctgcccga

SEQ ID NO: 385508 - DNA, 25 bp, Mus musculus
tgtgaccttgggctggcatccccac

SEQ ID NO: 385509 - DNA, 25 bp, Mus musculus
tgtgaccttggggaaagatggagct

SEQ ID NO: 385510 - DNA, 25 bp, Mus musculus
tgtgaccttgggtgctggcctcgcg

SEQ ID NO: 385511 - DNA, 25 bp, Mus musculus
tgtgaccttggtctgccttgaccat

SEQ ID NO: 385512 - DNA, 25 bp, Mus musculus
tgtgaccttggttcttccatcagtg

SEQ ID NO: 385513 - DNA, 25 bp, Mus musculus
tgtgacgaaaggtctgtcacctaaa

SEQ ID NO: 385514 - DNA, 25 bp, Mus musculus
tgtgacgacaagatttgaaagaagc

SEQ ID NO: 385515 - DNA, 25 bp, Mus musculus
tgtgacgcgggatggtcactcggac

SEQ ID NO: 385516 - DNA, 25 bp, Mus musculus
tgtgacgcgggtctgcaccggtgag

SEQ ID NO: 385517 - DNA, 25 bp, Mus musculus
tgtgacgggaagcttatcaagtacg

SEQ ID NO: 385518 - DNA, 25 bp, Mus musculus
tgtgacgggaaggtgtgtgagtctc

SEQ ID NO: 385519 - DNA, 25 bp, Mus musculus
tgtgactacatgaagtgccctccgt

SEQ ID NO: 385520 - DNA, 25 bp, Mus musculus
tgtgactcaagctcgtgtggccagc

SEQ ID NO: 385521 - DNA, 25 bp, Mus musculus
tgtgactcaggattctctacctgag

SEQ ID NO: 385522 - DNA, 25 bp, Mus musculus
tgtgactccaaacatccagaaccca

SEQ ID NO: 385523 - DNA, 25 bp, Mus musculus
tgtgactgagagcgagctgaccaat

SEQ ID NO: 385524 - DNA, 25 bp, Mus musculus
tgtgactgagagtgagaaagcgctg

SEQ ID NO: 385525 - DNA, 25 bp, Mus musculus
tgtgactgagttggccgccccatcc

SEQ ID NO: 385526 - DNA, 25 bp, Mus musculus
tgtgactgtagcccggacatcacct

SEQ ID NO: 385527 - DNA, 25 bp, Mus musculus
tgtgacttagcccaggagttaaagt

SEQ ID NO: 385528 - DNA, 25 bp, Mus musculus
tgtgacttagctcaaagattagaac

SEQ ID NO: 385529 - DNA, 25 bp, Mus musculus
tgtgacttaggtaggtgagcctgtg

SEQ ID NO: 385530 - DNA, 25 bp, Mus musculus
tgtgacttccacatcctgactccgt

SEQ ID NO: 385531 - DNA, 25 bp, Mus musculus
tgtgacttgagaacacaagagagca

SEQ ID NO: 385532 - DNA, 25 bp, Mus musculus
tgtgacttgagaagctgaatcactt

SEQ ID NO: 385533 - DNA, 25 bp, Mus musculus
tgtgacttgctgctgcgatactatg

SEQ ID NO: 385534 - DNA, 25 bp, Mus musculus
tgtgacttgtcctacctgctgattt

SEQ ID NO: 385535 - DNA, 25 bp, Mus musculus
tgtgactttacaggaaaaccaccaa

SEQ ID NO: 385536 - DNA, 25 bp, Mus musculus
tgtgactttgcagtttcaccaaacc

SEQ ID NO: 385537 - DNA, 25 bp, Mus musculus
tgtgagaaccgagaaatggcaaaat

SEQ ID NO: 385538 - DNA, 25 bp, Mus musculus
tgtgagaacgacctcagtgggcagc

SEQ ID NO: 385539 - DNA, 25 bp, Mus musculus
tgtgagaacgtcctcagtgggcagc

SEQ ID NO: 385540 - DNA, 25 bp, Mus musculus
tgtgagaataagttcaaggtgctta

SEQ ID NO: 385541 - DNA, 25 bp, Mus musculus
tgtgagacagacattgacgagtgct

SEQ ID NO: 385542 - DNA, 25 bp, Mus musculus
tgtgagacagactcttcctgagtca

SEQ ID NO: 385543 - DNA, 25 bp, Mus musculus
tgtgagaccaacaaatagctgtatg

SEQ ID NO: 385544 - DNA, 25 bp, Mus musculus
tgtgagaccaacaaatgacaccgta

SEQ ID NO: 385545 - DNA, 25 bp, Mus musculus
tgtgagacgtgggactccagtgatt

SEQ ID NO: 385546 - DNA, 25 bp, Mus musculus
tgtgagagaaaccttataagtgtag

SEQ ID NO: 385547 - DNA, 25 bp, Mus musculus
tgtgagagaattaaggcaccaagga

SEQ ID NO: 385548 - DNA, 25 bp, Mus musculus
tgtgagagaggctgtccgtacctat

SEQ ID NO: 385549 - DNA, 25 bp, Mus musculus
tgtgagagagttataaaagatgaaa

SEQ ID NO: 385550 - DNA, 25 bp, Mus musculus
tgtgagaggaatcagaatcagactg

SEQ ID NO: 385551 - DNA, 25 bp, Mus musculus
tgtgagaggaatcagttcacagcgc

SEQ ID NO: 385552 - DNA, 25 bp, Mus musculus
tgtgagaggcagggcttgtcaatga

SEQ ID NO: 385553 - DNA, 25 bp, Mus musculus
tgtgagagtatgcagtccttcagct

SEQ ID NO: 385554 - DNA, 25 bp, Mus musculus
tgtgagagttgacggcgtccaacac

SEQ ID NO: 385555 - DNA, 25 bp, Mus musculus
tgtgagagttgagtcctacctgctc

SEQ ID NO: 385556 - DNA, 25 bp, Mus musculus
tgtgagatttttgtggacagcacat

SEQ ID NO: 385557 - DNA, 25 bp, Mus musculus
tgtgagcaaaaacctgtgctggctg

SEQ ID NO: 385558 - DNA, 25 bp, Mus musculus
tgtgagcaaagaggcaagagacaga

SEQ ID NO: 385559 - DNA, 25 bp, Mus musculus
tgtgagcaacttgtcttcactctgc

SEQ ID NO: 385560 - DNA, 25 bp, Mus musculus
tgtgagcaagaggaagcttttcttc

SEQ ID NO: 385561 - DNA, 25 bp, Mus musculus
tgtgagcaagatcattgagcgctgc

SEQ ID NO: 385562 - DNA, 25 bp, Mus musculus
tgtgagcaaggctctacccctggtc

SEQ ID NO: 385563 - DNA, 25 bp, Mus musculus
tgtgagcaagtgaacacggattcgg

SEQ ID NO: 385564 - DNA, 25 bp, Mus musculus
tgtgagcacaggacataataagaaa

SEQ ID NO: 385565 - DNA, 25 bp, Mus musculus
tgtgagcacatccgtctcaggtgaa

SEQ ID NO: 385566 - DNA, 25 bp, Mus musculus
tgtgagcatgaggttgtctattaca

SEQ ID NO: 385567 - DNA, 25 bp, Mus musculus
tgtgagcatgagttggatatacaac

SEQ ID NO: 385568 - DNA, 25 bp, Mus musculus
tgtgagccaccagagagctgtgcct

SEQ ID NO: 385569 - DNA, 25 bp, Mus musculus
tgtgagccacctaaggtgacaaaag

SEQ ID NO: 385570 - DNA, 25 bp, Mus musculus
tgtgagccaccttgtgtgtggaatg

SEQ ID NO: 385571 - DNA, 25 bp, Mus musculus
tgtgagccagagaagccatcctggc

SEQ ID NO: 385572 - DNA, 25 bp, Mus musculus
tgtgagccaggtacattctttgtga

SEQ ID NO: 385573 - DNA, 25 bp, Mus musculus
tgtgagcccacagcaacctcaagcc

SEQ ID NO: 385574 - DNA, 25 bp, Mus musculus
tgtgagcccacagccttctcatcat

SEQ ID NO: 385575 - DNA, 25 bp, Mus musculus
tgtgagccggtgatctctgggctag

SEQ ID NO: 385576 - DNA, 25 bp, Mus musculus
tgtgagcctgccgctcatgctgtat

SEQ ID NO: 385577 - DNA, 25 bp, Mus musculus
tgtgagcctgtttgtgggctgtcca

SEQ ID NO: 385578 - DNA, 25 bp, Mus musculus
tgtgagcgactgcatcgtcaacgtg

SEQ ID NO: 385579 - DNA, 25 bp, Mus musculus
tgtgagctagagaagatccagatct

SEQ ID NO: 385580 - DNA, 25 bp, Mus musculus
tgtgagctaggaaccggagtggccc

SEQ ID NO: 385581 - DNA, 25 bp, Mus musculus
tgtgagctgaagatcctagactttg

SEQ ID NO: 385582 - DNA, 25 bp, Mus musculus
tgtgagctggacgagaactacaata

SEQ ID NO: 385583 - DNA, 25 bp, Mus musculus
tgtgagctggaggcccctggcgaag

SEQ ID NO: 385584 - DNA, 25 bp, Mus musculus
tgtgagcttggcagactgtataaca

SEQ ID NO: 385585 - DNA, 25 bp, Mus musculus
tgtgaggacaagagtgtggaaaatg

SEQ ID NO: 385586 - DNA, 25 bp, Mus musculus
tgtgaggacagcatccctggcacca

SEQ ID NO: 385587 - DNA, 25 bp, Mus musculus
tgtgaggcacgtggacatcttcaat

SEQ ID NO: 385588 - DNA, 25 bp, Mus musculus
tgtgaggcttatcggaagaaatgga

SEQ ID NO: 385589 - DNA, 25 bp, Mus musculus
tgtgaggggtgcaagaactgcccca

SEQ ID NO: 385590 - DNA, 25 bp, Mus musculus
tgtgaggggtgcaagggcttcttcc

SEQ ID NO: 385591 - DNA, 25 bp, Mus musculus
tgtgagggtgggattattagattta

SEQ ID NO: 385592 - DNA, 25 bp, Mus musculus
tgtgaggtacaggtgtcggctctgt

SEQ ID NO: 385593 - DNA, 25 bp, Mus musculus
tgtgagtaggcaaggaccccatgac

SEQ ID NO: 385594 - DNA, 25 bp, Mus musculus
tgtgagtcaaaggtcacatgctgct

SEQ ID NO: 385595 - DNA, 25 bp, Mus musculus
tgtgagtcagaaccatctggtgacc

SEQ ID NO: 385596 - DNA, 25 bp, Mus musculus
tgtgagtctggacaggtcacgctgg

SEQ ID NO: 385597 - DNA, 25 bp, Mus musculus
tgtgagtgaagatagtttaggtcaa

SEQ ID NO: 385598 - DNA, 25 bp, Mus musculus
tgtgagtgaagatgatcgtaatact

SEQ ID NO: 385599 - DNA, 25 bp, Mus musculus
tgtgagtgagaaaggagacatggag

SEQ ID NO: 385600 - DNA, 25 bp, Mus musculus
tgtgagtgagaaaggggacagtcaa

SEQ ID NO: 385601 - DNA, 25 bp, Mus musculus
tgtgagtgatggaggacttctgtgt

SEQ ID NO: 385602 - DNA, 25 bp, Mus musculus
tgtgagtgctccgtggcctctcaaa

SEQ ID NO: 385603 - DNA, 25 bp, Mus musculus
tgtgagtggcgttatatgaatactc

SEQ ID NO: 385604 - DNA, 25 bp, Mus musculus
tgtgagtgtgagagcccgctgtgag

SEQ ID NO: 385605 - DNA, 25 bp, Mus musculus
tgtgagttagagttccagttactat

SEQ ID NO: 385606 - DNA, 25 bp, Mus musculus
tgtgagttcgactgtgatttaccgc

SEQ ID NO: 385607 - DNA, 25 bp, Mus musculus
tgtgagttgcacggatgttctgagc

SEQ ID NO: 385608 - DNA, 25 bp, Mus musculus
tgtgagttgtcaggtaaagatgagc

SEQ ID NO: 385609 - DNA, 25 bp, Mus musculus
tgtgataaaactggggttcgcaacg

SEQ ID NO: 385610 - DNA, 25 bp, Mus musculus
tgtgataaaactgggtggtcatatg

SEQ ID NO: 385611 - DNA, 25 bp, Mus musculus
tgtgataaagaccagaatatggtgg

SEQ ID NO: 385612 - DNA, 25 bp, Mus musculus
tgtgataaaggtgtccccaaggaat

SEQ ID NO: 385613 - DNA, 25 bp, Mus musculus
tgtgataaagttggagtcattcgat

SEQ ID NO: 385614 - DNA, 25 bp, Mus musculus
tgtgatacacaagacatttcgactt

SEQ ID NO: 385615 - DNA, 25 bp, Mus musculus
tgtgataccagaccctgaagaagaa

SEQ ID NO: 385616 - DNA, 25 bp, Mus musculus
tgtgatagggagttctgaggctcta

SEQ ID NO: 385617 - DNA, 25 bp, Mus musculus
tgtgatcaagcgagactccctccaa

SEQ ID NO: 385618 - DNA, 25 bp, Mus musculus
tgtgatcaagcgagatggccgccaa

SEQ ID NO: 385619 - DNA, 25 bp, Mus musculus
tgtgatcacggtgacaaacttgaag

SEQ ID NO: 385620 - DNA, 25 bp, Mus musculus
tgtgatcagcagctcgtgcctccta

SEQ ID NO: 385621 - DNA, 25 bp, Mus musculus
tgtgatcatcagccacttccacctg

SEQ ID NO: 385622 - DNA, 25 bp, Mus musculus
tgtgatcatcaggccatctgcccca

SEQ ID NO: 385623 - DNA, 25 bp, Mus musculus
tgtgatccacagagatgtgaagcca

SEQ ID NO: 385624 - DNA, 25 bp, Mus musculus
tgtgatccagtgaggcctcaggtcc

SEQ ID NO: 385625 - DNA, 25 bp, Mus musculus
tgtgatccgcccagtgggggcagga

SEQ ID NO: 385626 - DNA, 25 bp, Mus musculus
tgtgatcctccgcaatgcacggctg

SEQ ID NO: 385627 - DNA, 25 bp, Mus musculus
tgtgatcgctgggttcctgagactg

SEQ ID NO: 385628 - DNA, 25 bp, Mus musculus
tgtgatcgctttctgaatggtttgg

SEQ ID NO: 385629 - DNA, 25 bp, Mus musculus
tgtgatctactgctgagaagaggag

SEQ ID NO: 385630 - DNA, 25 bp, Mus musculus
tgtgatctactgtacagagctatcg

SEQ ID NO: 385631 - DNA, 25 bp, Mus musculus
tgtgatctagccagatcttctggag

SEQ ID NO: 385632 - DNA, 25 bp, Mus musculus
tgtgatctccaatggactaaattcg

SEQ ID NO: 385633 - DNA, 25 bp, Mus musculus
tgtgatctgcaggaccagtccatga

SEQ ID NO: 385634 - DNA, 25 bp, Mus musculus
tgtgatcttgataggatctgcttaa

SEQ ID NO: 385635 - DNA, 25 bp, Mus musculus
tgtgatcttggaggctggtccagga

SEQ ID NO: 385636 - DNA, 25 bp, Mus musculus
tgtgatgacaactacgaaagagcct

SEQ ID NO: 385637 - DNA, 25 bp, Mus musculus
tgtgatgacaggaaattgtttacta

SEQ ID NO: 385638 - DNA, 25 bp, Mus musculus
tgtgatgaccaaggaggagcccctg

SEQ ID NO: 385639 - DNA, 25 bp, Mus musculus
tgtgatgataagaacaaattggaag

SEQ ID NO: 385640 - DNA, 25 bp, Mus musculus
tgtgatgatccagaagcaacatggc

SEQ ID NO: 385641 - DNA, 25 bp, Mus musculus
tgtgatgcactgaccctgcagttgg

SEQ ID NO: 385642 - DNA, 25 bp, Mus musculus
tgtgatgcaggagactgacggttct

SEQ ID NO: 385643 - DNA, 25 bp, Mus musculus
tgtgatgctgtccactttgatcttc

SEQ ID NO: 385644 - DNA, 25 bp, Mus musculus
tgtgatgcttgcggaatgcagcccg

SEQ ID NO: 385645 - DNA, 25 bp, Mus musculus
tgtgatgcttgcgtgcaatgctcac

SEQ ID NO: 385646 - DNA, 25 bp, Mus musculus
tgtgatggaggatgtggtggaggac

SEQ ID NO: 385647 - DNA, 25 bp, Mus musculus
tgtgatggcttgcacgggtcaagtc

SEQ ID NO: 385648 - DNA, 25 bp, Mus musculus
tgtgatggcttgcaggggtcaagtc

SEQ ID NO: 385649 - DNA, 25 bp, Mus musculus
tgtgatggggccaaactgagccttt

SEQ ID NO: 385650 - DNA, 25 bp, Mus musculus
tgtgatggtaaaaatactggctcga

SEQ ID NO: 385651 - DNA, 25 bp, Mus musculus
tgtgatggtcaaggttgttcctaca

SEQ ID NO: 385652 - DNA, 25 bp, Mus musculus
tgtgatggtcaggaagcctgctgcg

SEQ ID NO: 385653 - DNA, 25 bp, Mus musculus
tgtgatgtacaagaaagggaagatg

SEQ ID NO: 385654 - DNA, 25 bp, Mus musculus
tgtgatgtatcagggtaagacatac

SEQ ID NO: 385655 - DNA, 25 bp, Mus musculus
tgtgatgtctatttggagtgtctaa

SEQ ID NO: 385656 - DNA, 25 bp, Mus musculus
tgtgattaaagccatcatgttaagg

SEQ ID NO: 385657 - DNA, 25 bp, Mus musculus
tgtgattaataaccagctggttgat

SEQ ID NO: 385658 - DNA, 25 bp, Mus musculus
tgtgattactggataagaaaacttc

SEQ ID NO: 385659 - DNA, 25 bp, Mus musculus
tgtgattatcaggactagcggacat

SEQ ID NO: 385660 - DNA, 25 bp, Mus musculus
tgtgattatgtctgtcagaatctcc

SEQ ID NO: 385661 - DNA, 25 bp, Mus musculus
tgtgattcagatacaaacaggatcc

SEQ ID NO: 385662 - DNA, 25 bp, Mus musculus
tgtgattcagatcaactgccaccct

SEQ ID NO: 385663 - DNA, 25 bp, Mus musculus
tgtgattctcaagctgggaagtcat

SEQ ID NO: 385664 - DNA, 25 bp, Mus musculus
tgtgattgacagagactctttcaag

SEQ ID NO: 385665 - DNA, 25 bp, Mus musculus
tgtgattgacagagagccccttcca

SEQ ID NO: 385666 - DNA, 25 bp, Mus musculus
tgtgattgctctaagaagctgatgg

SEQ ID NO: 385667 - DNA, 25 bp, Mus musculus
tgtgattggtgcaggagaatttgga

SEQ ID NO: 385668 - DNA, 25 bp, Mus musculus
tgtgattgtcgagacgtgcgaccgc

SEQ ID NO: 385669 - DNA, 25 bp, Mus musculus
tgtgattgtggtgacactgcaaatg

SEQ ID NO: 385670 - DNA, 25 bp, Mus musculus
tgtgatttacaggtggaaagctttc

SEQ ID NO: 385671 - DNA, 25 bp, Mus musculus
tgtgatttcctggattctcaggact

SEQ ID NO: 385672 - DNA, 25 bp, Mus musculus
tgtgattttatgccagagatttcag

SEQ ID NO: 385673 - DNA, 25 bp, Mus musculus
tgtgattttcaggaaaagtgcaaga

SEQ ID NO: 385674 - DNA, 25 bp, Mus musculus
tgtgcaaagaagtttacaattcctg

SEQ ID NO: 385675 - DNA, 25 bp, Mus musculus
tgtgcaaagaatggggtaaccatag

SEQ ID NO: 385676 - DNA, 25 bp, Mus musculus
tgtgcaaatgacccaggatgtacag

SEQ ID NO: 385677 - DNA, 25 bp, Mus musculus
tgtgcaaatggcaagctgtgcattg

SEQ ID NO: 385678 - DNA, 25 bp, Mus musculus
tgtgcaaatggtacaatcagctgcc

SEQ ID NO: 385679 - DNA, 25 bp, Mus musculus
tgtgcaaccacagggactggaaatg

SEQ ID NO: 385680 - DNA, 25 bp, Mus musculus
tgtgcaacctgcaccatgggcttgg

SEQ ID NO: 385681 - DNA, 25 bp, Mus musculus
tgtgcaacttctagccctgctgtcc

SEQ ID NO: 385682 - DNA, 25 bp, Mus musculus
tgtgcaagaaactggtcttttgtgt

SEQ ID NO: 385683 - DNA, 25 bp, Mus musculus
tgtgcaagccagccccaggtatggc

SEQ ID NO: 385684 - DNA, 25 bp, Mus musculus
tgtgcaaggcctcgaaccgccgtcc

SEQ ID NO: 385685 - DNA, 25 bp, Mus musculus
tgtgcaaggcctcgtcattgtgaca

SEQ ID NO: 385686 - DNA, 25 bp, Mus musculus
tgtgcaatggcaggtgctgacctga

SEQ ID NO: 385687 - DNA, 25 bp, Mus musculus
tgtgcacaaagatagttttgagata

SEQ ID NO: 385688 - DNA, 25 bp, Mus musculus
tgtgcacaaagcactgtgtgaagag

SEQ ID NO: 385689 - DNA, 25 bp, Mus musculus
tgtgcacaagccagggcccatcact

SEQ ID NO: 385690 - DNA, 25 bp, Mus musculus
tgtgcacaaggtgggccgagacatc

SEQ ID NO: 385691 - DNA, 25 bp, Mus musculus
tgtgcacaaggtggtccgagacatc

SEQ ID NO: 385692 - DNA, 25 bp, Mus musculus
tgtgcacacatgtctgagagcaagg

SEQ ID NO: 385693 - DNA, 25 bp, Mus musculus
tgtgcacatcctccggactctaatg

SEQ ID NO: 385694 - DNA, 25 bp, Mus musculus
tgtgcacatgctggtagctgagcat

SEQ ID NO: 385695 - DNA, 25 bp, Mus musculus
tgtgcacattcaggagtgtgttcca

SEQ ID NO: 385696 - DNA, 25 bp, Mus musculus
tgtgcaccacgagatgtgtgttaaa

SEQ ID NO: 385697 - DNA, 25 bp, Mus musculus
tgtgcaccacgaggatcagaactta

SEQ ID NO: 385698 - DNA, 25 bp, Mus musculus
tgtgcaccaggagcacctgagcctg

SEQ ID NO: 385699 - DNA, 25 bp, Mus musculus
tgtgcaccaggtacaagcagtcagt

SEQ ID NO: 385700 - DNA, 25 bp, Mus musculus
tgtgcaccaggttggcagagttggg

SEQ ID NO: 385701 - DNA, 25 bp, Mus musculus
tgtgcacggcactgccactgattcc

SEQ ID NO: 385702 - DNA, 25 bp, Mus musculus
tgtgcactcagccatagattgtaag

SEQ ID NO: 385703 - DNA, 25 bp, Mus musculus
tgtgcactctcagctgagcagcaag

SEQ ID NO: 385704 - DNA, 25 bp, Mus musculus
tgtgcactctcagctgctttgctgc

SEQ ID NO: 385705 - DNA, 25 bp, Mus musculus
tgtgcactggagatggcagtgctgg

SEQ ID NO: 385706 - DNA, 25 bp, Mus musculus
tgtgcactggaggttccaataccaa

SEQ ID NO: 385707 - DNA, 25 bp, Mus musculus
tgtgcagaaagagctcagggactgc

SEQ ID NO: 385708 - DNA, 25 bp, Mus musculus
tgtgcagaaattgaagagagagaag

SEQ ID NO: 385709 - DNA, 25 bp, Mus musculus
tgtgcagaagattgataagtatctg

SEQ ID NO: 385710 - DNA, 25 bp, Mus musculus
tgtgcagaaggagctcaggggctgg

SEQ ID NO: 385711 - DNA, 25 bp, Mus musculus
tgtgcagaatgtctcacagatcttt

SEQ ID NO: 385712 - DNA, 25 bp, Mus musculus
tgtgcagacagcccctgcaggaaca

SEQ ID NO: 385713 - DNA, 25 bp, Mus musculus
tgtgcagactctgtccagccagctg

SEQ ID NO: 385714 - DNA, 25 bp, Mus musculus
tgtgcagagcagatctggtggccct

SEQ ID NO: 385715 - DNA, 25 bp, Mus musculus
tgtgcagagtgctgatcagggcact

SEQ ID NO: 385716 - DNA, 25 bp, Mus musculus
tgtgcagcaacaaggcgggaggaag

SEQ ID NO: 385717 - DNA, 25 bp, Mus musculus
tgtgcagcacagggggcagtgccca

SEQ ID NO: 385718 - DNA, 25 bp, Mus musculus
tgtgcagcagcaggaggtgtatggt

SEQ ID NO: 385719 - DNA, 25 bp, Mus musculus
tgtgcagcagcagttgcaacaacct

SEQ ID NO: 385720 - DNA, 25 bp, Mus musculus
tgtgcagcaggctctattcccaact

SEQ ID NO: 385721 - DNA, 25 bp, Mus musculus
tgtgcagcaggctcttgcatcccct

SEQ ID NO: 385722 - DNA, 25 bp, Mus musculus
tgtgcagcatgagaatggctatgca

SEQ ID NO: 385723 - DNA, 25 bp, Mus musculus
tgtgcagcatgcttttcccagtcat

SEQ ID NO: 385724 - DNA, 25 bp, Mus musculus
tgtgcagccaagaagtccaggaaga

SEQ ID NO: 385725 - DNA, 25 bp, Mus musculus
tgtgcagcccagagaagagtttagc

SEQ ID NO: 385726 - DNA, 25 bp, Mus musculus
tgtgcagccgctaccccggaagacc

SEQ ID NO: 385727 - DNA, 25 bp, Mus musculus
tgtgcagccgctacgaccccatccc

SEQ ID NO: 385728 - DNA, 25 bp, Mus musculus
tgtgcagcctgtaagcccagcacta

SEQ ID NO: 385729 - DNA, 25 bp, Mus musculus
tgtgcagcctgtaagcccagcatgt

SEQ ID NO: 385730 - DNA, 25 bp, Mus musculus
tgtgcagcctgtaagttcttgcaga

SEQ ID NO: 385731 - DNA, 25 bp, Mus musculus
tgtgcagctagaagggaagtctcag

SEQ ID NO: 385732 - DNA, 25 bp, Mus musculus
tgtgcagctgcgaggctctacacag

SEQ ID NO: 385733 - DNA, 25 bp, Mus musculus
tgtgcagcttcaggaccacagccac

SEQ ID NO: 385734 - DNA, 25 bp, Mus musculus
tgtgcaggactgaggaagccagctt

SEQ ID NO: 385735 - DNA, 25 bp, Mus musculus
tgtgcaggactgaggtcctctttca

SEQ ID NO: 385736 - DNA, 25 bp, Mus musculus
tgtgcaggggcaagctggaccccca

SEQ ID NO: 385737 - DNA, 25 bp, Mus musculus
tgtgcagtcacaggtggataccctc

SEQ ID NO: 385738 - DNA, 25 bp, Mus musculus
tgtgcatagtttagggtgtctagcc

SEQ ID NO: 385739 - DNA, 25 bp, Mus musculus
tgtgcatatgtggcaaagtttataa

SEQ ID NO: 385740 - DNA, 25 bp, Mus musculus
tgtgcatccacaccgccgtgacgtc

SEQ ID NO: 385741 - DNA, 25 bp, Mus musculus
tgtgcatccacaccgcttgcttggg

SEQ ID NO: 385742 - DNA, 25 bp, Mus musculus
tgtgcatcggaggtcaccttcgtct

SEQ ID NO: 385743 - DNA, 25 bp, Mus musculus
tgtgcatctccaggtcccacctgct

SEQ ID NO: 385744 - DNA, 25 bp, Mus musculus
tgtgcatgaaaggcctgacaagatc

SEQ ID NO: 385745 - DNA, 25 bp, Mus musculus
tgtgcatgccatgacccccgaggct

SEQ ID NO: 385746 - DNA, 25 bp, Mus musculus
tgtgcatgctagatgtgaaacattt

SEQ ID NO: 385747 - DNA, 25 bp, Mus musculus
tgtgcatgctggatctctcgtctgc

SEQ ID NO: 385748 - DNA, 25 bp, Mus musculus
tgtgcatgctgggatagctcaggtt

SEQ ID NO: 385749 - DNA, 25 bp, Mus musculus
tgtgcatgtgacagacctcactcac

SEQ ID NO: 385750 - DNA, 25 bp, Mus musculus
tgtgcatgtgacagataattcacag

SEQ ID NO: 385751 - DNA, 25 bp, Mus musculus
tgtgcatgttcttggaaacctgata

SEQ ID NO: 385752 - DNA, 25 bp, Mus musculus
tgtgcattagaaaagaatctaaagg

SEQ ID NO: 385753 - DNA, 25 bp, Mus musculus
tgtgcattagtgggtttgatgaccc

SEQ ID NO: 385754 - DNA, 25 bp, Mus musculus
tgtgcattgccatggaccgctcctt

SEQ ID NO: 385755 - DNA, 25 bp, Mus musculus
tgtgcattggacagattgtccttct

SEQ ID NO: 385756 - DNA, 25 bp, Mus musculus
tgtgcattggactcgttactgggca

SEQ ID NO: 385757 - DNA, 25 bp, Mus musculus
tgtgccaaagataaatttgaaaatt

SEQ ID NO: 385758 - DNA, 25 bp, Mus musculus
tgtgccaacaaggcagagatggagt

SEQ ID NO: 385759 - DNA, 25 bp, Mus musculus
tgtgccaacatggccatcctggaca

SEQ ID NO: 385760 - DNA, 25 bp, Mus musculus
tgtgccaactgcgggaaggagctaa

SEQ ID NO: 385761 - DNA, 25 bp, Mus musculus
tgtgccacaaggagagaactgccca

SEQ ID NO: 385762 - DNA, 25 bp, Mus musculus
tgtgccacacagatgctggagagca

SEQ ID NO: 385763 - DNA, 25 bp, Mus musculus
tgtgccacacgagaccctggctggg

SEQ ID NO: 385764 - DNA, 25 bp, Mus musculus
tgtgccacaggcttacagtgggtct

SEQ ID NO: 385765 - DNA, 25 bp, Mus musculus
tgtgccacaggtgtcttatgtgtgg

SEQ ID NO: 385766 - DNA, 25 bp, Mus musculus
tgtgccaccaggatccaagcctatt

SEQ ID NO: 385767 - DNA, 25 bp, Mus musculus
tgtgccacccatgctttctggatca

SEQ ID NO: 385768 - DNA, 25 bp, Mus musculus
tgtgccacgccccctgattgaacct

SEQ ID NO: 385769 - DNA, 25 bp, Mus musculus
tgtgccacggatgaataaaaacgac

SEQ ID NO: 385770 - DNA, 25 bp, Mus musculus
tgtgccactaccccacagcggcaga

SEQ ID NO: 385771 - DNA, 25 bp, Mus musculus
tgtgccacttttgaacgggacagct

SEQ ID NO: 385772 - DNA, 25 bp, Mus musculus
tgtgccagaaagctgccccacgagc

SEQ ID NO: 385773 - DNA, 25 bp, Mus musculus
tgtgccagagaggaccccggagctg

SEQ ID NO: 385774 - DNA, 25 bp, Mus musculus
tgtgccagataccaggttgctggtg

SEQ ID NO: 385775 - DNA, 25 bp, Mus musculus
tgtgccagcagacagctcccaaccc

SEQ ID NO: 385776 - DNA, 25 bp, Mus musculus
tgtgccagctgccggactgccctcc

SEQ ID NO: 385777 - DNA, 25 bp, Mus musculus
tgtgccagtgacacccgtgccggca

SEQ ID NO: 385778 - DNA, 25 bp, Mus musculus
tgtgcccaagattgggtgtgatcgt

SEQ ID NO: 385779 - DNA, 25 bp, Mus musculus
tgtgcccacaagcctcccctcgcaa

SEQ ID NO: 385780 - DNA, 25 bp, Mus musculus
tgtgcccacaaggttcttgttcatt

SEQ ID NO: 385781 - DNA, 25 bp, Mus musculus
tgtgcccagaggagtaccctcacct

SEQ ID NO: 385782 - DNA, 25 bp, Mus musculus
tgtgcccagatcaaatcgtgtccag

SEQ ID NO: 385783 - DNA, 25 bp, Mus musculus
tgtgcccagatcaactattagacat

SEQ ID NO: 385784 - DNA, 25 bp, Mus musculus
tgtgcccagcctacggttgtctacc

SEQ ID NO: 385785 - DNA, 25 bp, Mus musculus
tgtgcccagcctacgtggtgaagat

SEQ ID NO: 385786 - DNA, 25 bp, Mus musculus
tgtgcccataggttacaaccatccg

SEQ ID NO: 385787 - DNA, 25 bp, Mus musculus
tgtgcccatgaaaaacccgtctcga

SEQ ID NO: 385788 - DNA, 25 bp, Mus musculus
tgtgcccatgaaaaatttggaaatc

SEQ ID NO: 385789 - DNA, 25 bp, Mus musculus
tgtgcccattccagctgtcgcagag

SEQ ID NO: 385790 - DNA, 25 bp, Mus musculus
tgtgcccccaagtctgtcttctcct

SEQ ID NO: 385791 - DNA, 25 bp, Mus musculus
tgtgcccccagagaggcagagcccc

SEQ ID NO: 385792 - DNA, 25 bp, Mus musculus
tgtgccccgcaacagcaatccaaac

SEQ ID NO: 385793 - DNA, 25 bp, Mus musculus
tgtgcccctgcctaagccaaggaag

SEQ ID NO: 385794 - DNA, 25 bp, Mus musculus
tgtgcccctggctgggtttggttac

SEQ ID NO: 385795 - DNA, 25 bp, Mus musculus
tgtgcccctgttcacctgctgttgc

SEQ ID NO: 385796 - DNA, 25 bp, Mus musculus
tgtgcccgtggtatcgatgttgaac

SEQ ID NO: 385797 - DNA, 25 bp, Mus musculus
tgtgccctcagccccccagcacttg

SEQ ID NO: 385798 - DNA, 25 bp, Mus musculus
tgtgccctcggaaccaccatctggg

SEQ ID NO: 385799 - DNA, 25 bp, Mus musculus
tgtgccctgaagctcctgtatgaca

SEQ ID NO: 385800 - DNA, 25 bp, Mus musculus
tgtgccctgaaggtcagaaacccaa

SEQ ID NO: 385801 - DNA, 25 bp, Mus musculus
tgtgccctgctgggtggggagacag

SEQ ID NO: 385802 - DNA, 25 bp, Mus musculus
tgtgcccttaatgaaaacattaacc

SEQ ID NO: 385803 - DNA, 25 bp, Mus musculus
tgtgccgactacgtggaggagccca

SEQ ID NO: 385804 - DNA, 25 bp, Mus musculus
tgtgccgaggaggggcgtgctggtc

SEQ ID NO: 385805 - DNA, 25 bp, Mus musculus
tgtgccgcaggtcgagatttcaggt

SEQ ID NO: 385806 - DNA, 25 bp, Mus musculus
tgtgccggcttgatgcccccaagcc

SEQ ID NO: 385807 - DNA, 25 bp, Mus musculus
tgtgccgtgtgacgcagtgggccat

SEQ ID NO: 385808 - DNA, 25 bp, Mus musculus
tgtgccgtgtggtgtggattcgcag

SEQ ID NO: 385809 - DNA, 25 bp, Mus musculus
tgtgccgttttgagaagattgctgc

SEQ ID NO: 385810 - DNA, 25 bp, Mus musculus
tgtgccgttttgaggctttggagaa

SEQ ID NO: 385811 - DNA, 25 bp, Mus musculus
tgtgcctaagccagatctcaaagcc

SEQ ID NO: 385812 - DNA, 25 bp, Mus musculus
tgtgcctaccgtgccagcccccatg

SEQ ID NO: 385813 - DNA, 25 bp, Mus musculus
tgtgcctaccgtgcttgccattccc

SEQ ID NO: 385814 - DNA, 25 bp, Mus musculus
tgtgcctagtcgaagcccagagaag

SEQ ID NO: 385815 - DNA, 25 bp, Mus musculus
tgtgcctagtcgaagtgcccccctc

SEQ ID NO: 385816 - DNA, 25 bp, Mus musculus
tgtgcctatccagaccctcctccca

SEQ ID NO: 385817 - DNA, 25 bp, Mus musculus
tgtgcctatgatgtgagagaacaag

SEQ ID NO: 385818 - DNA, 25 bp, Mus musculus
tgtgcctcagggtgacagaactggt

SEQ ID NO: 385819 - DNA, 25 bp, Mus musculus
tgtgcctcagggttgcagtaatgaa

SEQ ID NO: 385820 - DNA, 25 bp, Mus musculus
tgtgcctcaggttgccctctgtctg

SEQ ID NO: 385821 - DNA, 25 bp, Mus musculus
tgtgcctcctagatgccctttgaag

SEQ ID NO: 385822 - DNA, 25 bp, Mus musculus
tgtgcctctctgtgagcaaagaaaa

SEQ ID NO: 385823 - DNA, 25 bp, Mus musculus
tgtgcctcttccaaggaatttgaaa

SEQ ID NO: 385824 - DNA, 25 bp, Mus musculus
tgtgcctcttccaaggagtgccggt

SEQ ID NO: 385825 - DNA, 25 bp, Mus musculus
tgtgcctgagcggaggactggctac

SEQ ID NO: 385826 - DNA, 25 bp, Mus musculus
tgtgcctgagcgggctagctgtgga

SEQ ID NO: 385827 - DNA, 25 bp, Mus musculus
tgtgcctgaggagtccctgtgccag

SEQ ID NO: 385828 - DNA, 25 bp, Mus musculus
tgtgcctgaggctgacctgtgctcg

SEQ ID NO: 385829 - DNA, 25 bp, Mus musculus
tgtgcctgcagttccacaggctcag

SEQ ID NO: 385830 - DNA, 25 bp, Mus musculus
tgtgcctgctgcaaagcctgcctgg

SEQ ID NO: 385831 - DNA, 25 bp, Mus musculus
tgtgcctggaacccatcagatcttc

SEQ ID NO: 385832 - DNA, 25 bp, Mus musculus
tgtgcctggaggaccagctctctcc

SEQ ID NO: 385833 - DNA, 25 bp, Mus musculus
tgtgcctggtatatgctcccggcaa

SEQ ID NO: 385834 - DNA, 25 bp, Mus musculus
tgtgcctgtaatgaatggtatggtg

SEQ ID NO: 385835 - DNA, 25 bp, Mus musculus
tgtgcctgtcctggttgttcctcaa

SEQ ID NO: 385836 - DNA, 25 bp, Mus musculus
tgtgcctgtctcagagagcctgggc

SEQ ID NO: 385837 - DNA, 25 bp, Mus musculus
tgtgcctgtgccagggtgtgagggt

SEQ ID NO: 385838 - DNA, 25 bp, Mus musculus
tgtgcctgtgccagtgttctttcca

SEQ ID NO: 385839 - DNA, 25 bp, Mus musculus
tgtgccttcaggctcacccaggaat

SEQ ID NO: 385840 - DNA, 25 bp, Mus musculus
tgtgccttctgggcattgaagatcg

SEQ ID NO: 385841 - DNA, 25 bp, Mus musculus
tgtgcgaccaatgagggagagccca

SEQ ID NO: 385842 - DNA, 25 bp, Mus musculus
tgtgcgaccagatctgctgcttact

SEQ ID NO: 385843 - DNA, 25 bp, Mus musculus
tgtgcgaccaggtgtctgcctgtat

SEQ ID NO: 385844 - DNA, 25 bp, Mus musculus
tgtgcgaccgtgatggtaacaaatc

SEQ ID NO: 385845 - DNA, 25 bp, Mus musculus
tgtgcgagcaggtagtcaataccca

SEQ ID NO: 385846 - DNA, 25 bp, Mus musculus
tgtgcgaggtgcctgggtccaagcc

SEQ ID NO: 385847 - DNA, 25 bp, Mus musculus
tgtgcgaggtgcctgttaaagtccg

SEQ ID NO: 385848 - DNA, 25 bp, Mus musculus
tgtgcgcactcggaggccatgtcag

SEQ ID NO: 385849 - DNA, 25 bp, Mus musculus
tgtgcgccacctgagaaaagaaaag

SEQ ID NO: 385850 - DNA, 25 bp, Mus musculus
tgtgcgccacctgagaagagaagag

SEQ ID NO: 385851 - DNA, 25 bp, Mus musculus
tgtgcgccacctgagagatctcagg

SEQ ID NO: 385852 - DNA, 25 bp, Mus musculus
tgtgcgccacctgaggcctcccagc

SEQ ID NO: 385853 - DNA, 25 bp, Mus musculus
tgtgcgccctgggtccaactgagcc

SEQ ID NO: 385854 - DNA, 25 bp, Mus musculus
tgtgcgcctgccccgcgagaaaggg

SEQ ID NO: 385855 - DNA, 25 bp, Mus musculus
tgtgcgctggaggtctaagccgact

SEQ ID NO: 385856 - DNA, 25 bp, Mus musculus
tgtgcggcgagaaggactccatgaa

SEQ ID NO: 385857 - DNA, 25 bp, Mus musculus
tgtgcggcgagacacaccagaagag

SEQ ID NO: 385858 - DNA, 25 bp, Mus musculus
tgtgcggcgagatcccacgggttcc

SEQ ID NO: 385859 - DNA, 25 bp, Mus musculus
tgtgcggctcggtccgacgcacagc

SEQ ID NO: 385860 - DNA, 25 bp, Mus musculus
tgtgcgggaccagctgatccgagca

SEQ ID NO: 385861 - DNA, 25 bp, Mus musculus
tgtgcgggaccaggcctttaagacc

SEQ ID NO: 385862 - DNA, 25 bp, Mus musculus
tgtgcgggtgagatctgattttctg

SEQ ID NO: 385863 - DNA, 25 bp, Mus musculus
tgtgcggtatcggggggagtacaag

SEQ ID NO: 385864 - DNA, 25 bp, Mus musculus
tgtgcggtccctcagattgctgaag

SEQ ID NO: 385865 - DNA, 25 bp, Mus musculus
tgtgcgtcctgctgtctcaggtgct

SEQ ID NO: 385866 - DNA, 25 bp, Mus musculus
tgtgcgtggacccagctgtcctgga

SEQ ID NO: 385867 - DNA, 25 bp, Mus musculus
tgtgcgtgtaacagatgctccatcc

SEQ ID NO: 385868 - DNA, 25 bp, Mus musculus
tgtgcgtgtaacaggggctccttat

SEQ ID NO: 385869 - DNA, 25 bp, Mus musculus
tgtgcgtgttggtcgcctctctgcc

SEQ ID NO: 385870 - DNA, 25 bp, Mus musculus
tgtgcgtgttggtcgcgggggttct

SEQ ID NO: 385871 - DNA, 25 bp, Mus musculus
tgtgctaaagaaatgctctactata

SEQ ID NO: 385872 - DNA, 25 bp, Mus musculus
tgtgctaaagaaattgccaacaaac

SEQ ID NO: 385873 - DNA, 25 bp, Mus musculus
tgtgctacaaaaaactgagacgtat

SEQ ID NO: 385874 - DNA, 25 bp, Mus musculus
tgtgctacaagtccacacacgttcc

SEQ ID NO: 385875 - DNA, 25 bp, Mus musculus
tgtgctacagatgtcacagccattc

SEQ ID NO: 385876 - DNA, 25 bp, Mus musculus
tgtgctacagattacacctttgcga

SEQ ID NO: 385877 - DNA, 25 bp, Mus musculus
tgtgctaccttaggatcgagcggtc

SEQ ID NO: 385878 - DNA, 25 bp, Mus musculus
tgtgctagaacagaaactgcagttg

SEQ ID NO: 385879 - DNA, 25 bp, Mus musculus
tgtgctagacaagtgctacgttgaa

SEQ ID NO: 385880 - DNA, 25 bp, Mus musculus
tgtgctaggtctcctcctgcctgac

SEQ ID NO: 385881 - DNA, 25 bp, Mus musculus
tgtgctagtggacactagactacat

SEQ ID NO: 385882 - DNA, 25 bp, Mus musculus
tgtgctatagggattgtgccatctt

SEQ ID NO: 385883 - DNA, 25 bp, Mus musculus
tgtgctatgaaggtgaagcttccct

SEQ ID NO: 385884 - DNA, 25 bp, Mus musculus
tgtgctatgcccagaacatcccaac

SEQ ID NO: 385885 - DNA, 25 bp, Mus musculus
tgtgctatttgaccatctgttctgt

SEQ ID NO: 385886 - DNA, 25 bp, Mus musculus
tgtgctcaaacaggctctggaaaaa

SEQ ID NO: 385887 - DNA, 25 bp, Mus musculus
tgtgctcaagaccttcctggatgac

SEQ ID NO: 385888 - DNA, 25 bp, Mus musculus
tgtgctcaagttactgggcctggtg

SEQ ID NO: 385889 - DNA, 25 bp, Mus musculus
tgtgctcatccagatctgcaacggg

SEQ ID NO: 385890 - DNA, 25 bp, Mus musculus
tgtgctcatgcccgacatcgtgcac

SEQ ID NO: 385891 - DNA, 25 bp, Mus musculus
tgtgctcatgttcgagatgctcaca

SEQ ID NO: 385892 - DNA, 25 bp, Mus musculus
tgtgctcattataggggtgatcctg

SEQ ID NO: 385893 - DNA, 25 bp, Mus musculus
tgtgctccaacggcttcctgctttt

SEQ ID NO: 385894 - DNA, 25 bp, Mus musculus
tgtgctccacggggaggcacacggt

SEQ ID NO: 385895 - DNA, 25 bp, Mus musculus
tgtgctccaggctctcacagcagca

SEQ ID NO: 385896 - DNA, 25 bp, Mus musculus
tgtgctccaggctggacagtatggc

SEQ ID NO: 385897 - DNA, 25 bp, Mus musculus
tgtgctcccagatggtgtcataagc

SEQ ID NO: 385898 - DNA, 25 bp, Mus musculus
tgtgctccctaaagttgcagaatta

SEQ ID NO: 385899 - DNA, 25 bp, Mus musculus
tgtgctcctgcgggcggcatcgctg

SEQ ID NO: 385900 - DNA, 25 bp, Mus musculus
tgtgctcgacaaagcatagtaacat

SEQ ID NO: 385901 - DNA, 25 bp, Mus musculus
tgtgctcgtggcacggaggtgccaa

SEQ ID NO: 385902 - DNA, 25 bp, Mus musculus
tgtgctctcaggggactcctctcga

SEQ ID NO: 385903 - DNA, 25 bp, Mus musculus
tgtgctctctaagggccatgcagct

SEQ ID NO: 385904 - DNA, 25 bp, Mus musculus
tgtgctgaaatttcaaaaggacata

SEQ ID NO: 385905 - DNA, 25 bp, Mus musculus
tgtgctgaagagaactgcttcatgc

SEQ ID NO: 385906 - DNA, 25 bp, Mus musculus
tgtgctgactgagctcggattggga

SEQ ID NO: 385907 - DNA, 25 bp, Mus musculus
tgtgctgactgcctgtttctggacc

SEQ ID NO: 385908 - DNA, 25 bp, Mus musculus
tgtgctgagaagctgagttcctacc

SEQ ID NO: 385909 - DNA, 25 bp, Mus musculus
tgtgctgagagagaggatgagaccg

SEQ ID NO: 385910 - DNA, 25 bp, Mus musculus
tgtgctgagctgggtgaagatgatg

SEQ ID NO: 385911 - DNA, 25 bp, Mus musculus
tgtgctgcaaaagcgggcctcctgc

SEQ ID NO: 385912 - DNA, 25 bp, Mus musculus
tgtgctgcaaaagcgggtggaggag

SEQ ID NO: 385913 - DNA, 25 bp, Mus musculus
tgtgctgcaagaccaaggacgagtc

SEQ ID NO: 385914 - DNA, 25 bp, Mus musculus
tgtgctgcagaaaaagcagacggag

SEQ ID NO: 385915 - DNA, 25 bp, Mus musculus
tgtgctgcagactgaagtggccacc

SEQ ID NO: 385916 - DNA, 25 bp, Mus musculus
tgtgctgcaggctacatgtgagcga

SEQ ID NO: 385917 - DNA, 25 bp, Mus musculus
tgtgctgccagtccctccacagaca

SEQ ID NO: 385918 - DNA, 25 bp, Mus musculus
tgtgctgcccagatcttggtgacca

SEQ ID NO: 385919 - DNA, 25 bp, Mus musculus
tgtgctgcccgaaaggctgagaccg

SEQ ID NO: 385920 - DNA, 25 bp, Mus musculus
tgtgctgcgcaaggtttctctgtgt

SEQ ID NO: 385921 - DNA, 25 bp, Mus musculus
tgtgctgcgcaaggtttctgacatg

SEQ ID NO: 385922 - DNA, 25 bp, Mus musculus
tgtgctgctcaaagaggtcctccgg

SEQ ID NO: 385923 - DNA, 25 bp, Mus musculus
tgtgctgctgccttccctcctctag

SEQ ID NO: 385924 - DNA, 25 bp, Mus musculus
tgtgctgctgcgcggtgaccacaca

SEQ ID NO: 385925 - DNA, 25 bp, Mus musculus
tgtgctgcttccgggtgttggaagg

SEQ ID NO: 385926 - DNA, 25 bp, Mus musculus
tgtgctggagctgagatgacgttgc

SEQ ID NO: 385927 - DNA, 25 bp, Mus musculus
tgtgctggaggacttcatcaacaac

SEQ ID NO: 385928 - DNA, 25 bp, Mus musculus
tgtgctggaggtgtccaaagacaag

SEQ ID NO: 385929 - DNA, 25 bp, Mus musculus
tgtgctggccatgcctttttattct

SEQ ID NO: 385930 - DNA, 25 bp, Mus musculus
tgtgctggcgattcacttcagcaca

SEQ ID NO: 385931 - DNA, 25 bp, Mus musculus
tgtgctggtaaaagctgatgaagag

SEQ ID NO: 385932 - DNA, 25 bp, Mus musculus
tgtgctggtggatattcattagctt

SEQ ID NO: 385933 - DNA, 25 bp, Mus musculus
tgtgctgtacagagatggcccacac

SEQ ID NO: 385934 - DNA, 25 bp, Mus musculus
tgtgctgtgttggtccggaccgctg

SEQ ID NO: 385935 - DNA, 25 bp, Mus musculus
tgtgctgttggaggaactgtactga

SEQ ID NO: 385936 - DNA, 25 bp, Mus musculus
tgtgctgtttggaagtgaaatggaa

SEQ ID NO: 385937 - DNA, 25 bp, Mus musculus
tgtgcttagagctcctcctcccatc

SEQ ID NO: 385938 - DNA, 25 bp, Mus musculus
tgtgcttatccaggttatcttctct

SEQ ID NO: 385939 - DNA, 25 bp, Mus musculus
tgtgcttatgacaggattgtggttg

SEQ ID NO: 385940 - DNA, 25 bp, Mus musculus
tgtgcttatgacaggctgaagccat

SEQ ID NO: 385941 - DNA, 25 bp, Mus musculus
tgtgcttcagagtctgaaagggtgg

SEQ ID NO: 385942 - DNA, 25 bp, Mus musculus
tgtgcttcctccaggatggattcat

SEQ ID NO: 385943 - DNA, 25 bp, Mus musculus
tgtgcttctgagaagaggccgaatg

SEQ ID NO: 385944 - DNA, 25 bp, Mus musculus
tgtgcttctgatgatgagagtaacg

SEQ ID NO: 385945 - DNA, 25 bp, Mus musculus
tgtgcttgaatctgctttttacctt

SEQ ID NO: 385946 - DNA, 25 bp, Mus musculus
tgtgcttgaggtgattgaagaagaa

SEQ ID NO: 385947 - DNA, 25 bp, Mus musculus
tgtgcttgccagataaagtgcagga

SEQ ID NO: 385948 - DNA, 25 bp, Mus musculus
tgtgcttgccaggggctgacaagtt

SEQ ID NO: 385949 - DNA, 25 bp, Mus musculus
tgtgcttgctaggggtcatgatata

SEQ ID NO: 385950 - DNA, 25 bp, Mus musculus
tgtgcttggagagactgggcagttt

SEQ ID NO: 385951 - DNA, 25 bp, Mus musculus
tgtgcttgggggagccatgacagta

SEQ ID NO: 385952 - DNA, 25 bp, Mus musculus
tgtgcttgtcaggaacaatccactt

SEQ ID NO: 385953 - DNA, 25 bp, Mus musculus
tgtgctttcttcaagcaccagattg

SEQ ID NO: 385954 - DNA, 25 bp, Mus musculus
tgtgcttttcctggaagagtatcta

SEQ ID NO: 385955 - DNA, 25 bp, Mus musculus
tgtggaaaactgatgagaaatgaat

SEQ ID NO: 385956 - DNA, 25 bp, Mus musculus
tgtggaaaagaaacctcttcggtga

SEQ ID NO: 385957 - DNA, 25 bp, Mus musculus
tgtggaaaagaaccagcgggtccct

SEQ ID NO: 385958 - DNA, 25 bp, Mus musculus
tgtggaaaagatattctcatgtagg

SEQ ID NO: 385959 - DNA, 25 bp, Mus musculus
tgtggaaacagaccacaggatggct

SEQ ID NO: 385960 - DNA, 25 bp, Mus musculus
tgtggaaacagcactcatgaacact

SEQ ID NO: 385961 - DNA, 25 bp, Mus musculus
tgtggaaactggcggtgttttcagc

SEQ ID NO: 385962 - DNA, 25 bp, Mus musculus
tgtggaaactggcgttgttgacaag

SEQ ID NO: 385963 - DNA, 25 bp, Mus musculus
tgtggaaagaggagaaccatcaagc

SEQ ID NO: 385964 - DNA, 25 bp, Mus musculus
tgtggaaagaggtggcagtgggaga

SEQ ID NO: 385965 - DNA, 25 bp, Mus musculus
tgtggaaagattgagttcaggaggg

SEQ ID NO: 385966 - DNA, 25 bp, Mus musculus
tgtggaaagcaagatatattttgca

SEQ ID NO: 385967 - DNA, 25 bp, Mus musculus
tgtggaaatattgcatactcctatg

SEQ ID NO: 385968 - DNA, 25 bp, Mus musculus
tgtggaaatccaggctgttcatcag

SEQ ID NO: 385969 - DNA, 25 bp, Mus musculus
tgtggaaatccagggcagagatgac

SEQ ID NO: 385970 - DNA, 25 bp, Mus musculus
tgtggaaatccccagaggagctcta

SEQ ID NO: 385971 - DNA, 25 bp, Mus musculus
tgtggaaatgcagtccctgcagata

SEQ ID NO: 385972 - DNA, 25 bp, Mus musculus
tgtggaaatggggaacttctgtggc

SEQ ID NO: 385973 - DNA, 25 bp, Mus musculus
tgtggaaatggggcactttctgcat

SEQ ID NO: 385974 - DNA, 25 bp, Mus musculus
tgtggaaatggggggtcttcttgtg

SEQ ID NO: 385975 - DNA, 25 bp, Mus musculus
tgtggaacaagtgcgcatctgtagc

SEQ ID NO: 385976 - DNA, 25 bp, Mus musculus
tgtggaacacgaagccctgcagagg

SEQ ID NO: 385977 - DNA, 25 bp, Mus musculus
tgtggaacacgctgtcttcagacac

SEQ ID NO: 385978 - DNA, 25 bp, Mus musculus
tgtggaacagccgtgtaggtttcta

SEQ ID NO: 385979 - DNA, 25 bp, Mus musculus
tgtggaacaggtcccctgttccaga

SEQ ID NO: 385980 - DNA, 25 bp, Mus musculus
tgtggaacatcagaggatctgagaa

SEQ ID NO: 385981 - DNA, 25 bp, Mus musculus
tgtggaacatggagggccctgctca

SEQ ID NO: 385982 - DNA, 25 bp, Mus musculus
tgtggaaccgggtgccatgtttcct

SEQ ID NO: 385983 - DNA, 25 bp, Mus musculus
tgtggaacgcatcaactgtccagca

SEQ ID NO: 385984 - DNA, 25 bp, Mus musculus
tgtggaactgtctttatccgtctac

SEQ ID NO: 385985 - DNA, 25 bp, Mus musculus
tgtggaagactatctgtctgcaatc

SEQ ID NO: 385986 - DNA, 25 bp, Mus musculus
tgtggaagagagtccagaaaacctt

SEQ ID NO: 385987 - DNA, 25 bp, Mus musculus
tgtggaagagatgaaccggacaaaa

SEQ ID NO: 385988 - DNA, 25 bp, Mus musculus
tgtggaagaggaaccgggcaaatgg

SEQ ID NO: 385989 - DNA, 25 bp, Mus musculus
tgtggaagagtccctgattgtccct

SEQ ID NO: 385990 - DNA, 25 bp, Mus musculus
tgtggaagcaccagctggaggaaga

SEQ ID NO: 385991 - DNA, 25 bp, Mus musculus
tgtggaagcaccttggtgaccagaa

SEQ ID NO: 385992 - DNA, 25 bp, Mus musculus
tgtggaagccgtgccccggcagccc

SEQ ID NO: 385993 - DNA, 25 bp, Mus musculus
tgtggaagcgatggtgaatgagaat

SEQ ID NO: 385994 - DNA, 25 bp, Mus musculus
tgtggaagtcccaggctctgtgtga

SEQ ID NO: 385995 - DNA, 25 bp, Mus musculus
tgtggaagtcggtgatggcatgcag

SEQ ID NO: 385996 - DNA, 25 bp, Mus musculus
tgtggaataaagtatcaggagtgcg

SEQ ID NO: 385997 - DNA, 25 bp, Mus musculus
tgtggaatacgcatgggatgccaat

SEQ ID NO: 385998 - DNA, 25 bp, Mus musculus
tgtggaatgaagaagcttctcttca

SEQ ID NO: 385999 - DNA, 25 bp, Mus musculus
tgtggaatgaagaaggaggtgaaga

SEQ ID NO: 386000 - DNA, 25 bp, Mus musculus
tgtggaattatgtctgaggaagatg

SEQ ID NO: 386001 - DNA, 25 bp, Mus musculus
tgtggacaaagacggttatattaag

SEQ ID NO: 386002 - DNA, 25 bp, Mus musculus
tgtggacaagaaaggtgacactccc

SEQ ID NO: 386003 - DNA, 25 bp, Mus musculus
tgtggacaaggaagactttctctgt

SEQ ID NO: 386004 - DNA, 25 bp, Mus musculus
tgtggacaaggaaggttctgagcct

SEQ ID NO: 386005 - DNA, 25 bp, Mus musculus
tgtggacaaggtattctttgatctg

SEQ ID NO: 386006 - DNA, 25 bp, Mus musculus
tgtggacaaggtcattgtgctcagt

SEQ ID NO: 386007 - DNA, 25 bp, Mus musculus
tgtggacactcctggagccagaatg

SEQ ID NO: 386008 - DNA, 25 bp, Mus musculus
tgtggacatcaggatgtgatggtgg

SEQ ID NO: 386009 - DNA, 25 bp, Mus musculus
tgtggaccaagtttgttgcatattc

SEQ ID NO: 386010 - DNA, 25 bp, Mus musculus
tgtggaccagtacctgatactacct

SEQ ID NO: 386011 - DNA, 25 bp, Mus musculus
tgtggaccatcggggtacctggaat

SEQ ID NO: 386012 - DNA, 25 bp, Mus musculus
tgtggaccctaaggagaaggagcgc

SEQ ID NO: 386013 - DNA, 25 bp, Mus musculus
tgtggaccctaagtgcagctttgtt

SEQ ID NO: 386014 - DNA, 25 bp, Mus musculus
tgtggaccctgagttccaccaggtg

SEQ ID NO: 386015 - DNA, 25 bp, Mus musculus
tgtggaccgtgggagaactactatc

SEQ ID NO: 386016 - DNA, 25 bp, Mus musculus
tgtggacctagaatggtgtgccagg

SEQ ID NO: 386017 - DNA, 25 bp, Mus musculus
tgtggacctagaatggtttgcaata

SEQ ID NO: 386018 - DNA, 25 bp, Mus musculus
tgtggacctagaatgtgggcacaat

SEQ ID NO: 386019 - DNA, 25 bp, Mus musculus
tgtggacctagattcatcagccaga

SEQ ID NO: 386020 - DNA, 25 bp, Mus musculus
tgtggacctagggtttctctgtaga

SEQ ID NO: 386021 - DNA, 25 bp, Mus musculus
tgtggacgaagaaaatattcccgag

SEQ ID NO: 386022 - DNA, 25 bp, Mus musculus
tgtggacgaagcaatggcaagccgg

SEQ ID NO: 386023 - DNA, 25 bp, Mus musculus
tgtggacgagagagactcgggaaac

SEQ ID NO: 386024 - DNA, 25 bp, Mus musculus
tgtggacgctctgctcatttgggag

SEQ ID NO: 386025 - DNA, 25 bp, Mus musculus
tgtggacgctctggtcatccaactt

SEQ ID NO: 386026 - DNA, 25 bp, Mus musculus
tgtggacgtggaaggcattttgtga

SEQ ID NO: 386027 - DNA, 25 bp, Mus musculus
tgtggacgtggaaggccttgatcct

SEQ ID NO: 386028 - DNA, 25 bp, Mus musculus
tgtggactcaatgcgatctggttct

SEQ ID NO: 386029 - DNA, 25 bp, Mus musculus
tgtggactggagtgagtcagcagtg

SEQ ID NO: 386030 - DNA, 25 bp, Mus musculus
tgtggactgtgatgggtgtacaata

SEQ ID NO: 386031 - DNA, 25 bp, Mus musculus
tgtggacttagggctgaccagtttg

SEQ ID NO: 386032 - DNA, 25 bp, Mus musculus
tgtggacttaggtgacaagttccgg

SEQ ID NO: 386033 - DNA, 25 bp, Mus musculus
tgtggactttgaagctgttaagaag

SEQ ID NO: 386034 - DNA, 25 bp, Mus musculus
tgtggagaagggtcaactgctgcta

SEQ ID NO: 386035 - DNA, 25 bp, Mus musculus
tgtggagaagggtttcaaagctgaa

SEQ ID NO: 386036 - DNA, 25 bp, Mus musculus
tgtggagaaggtgaaatttatgaaa

SEQ ID NO: 386037 - DNA, 25 bp, Mus musculus
tgtggagaagtctggtgcctctagc

SEQ ID NO: 386038 - DNA, 25 bp, Mus musculus
tgtggagaatgcatttttcactctt

SEQ ID NO: 386039 - DNA, 25 bp, Mus musculus
tgtggagactcaaactgaagtgagt

SEQ ID NO: 386040 - DNA, 25 bp, Mus musculus
tgtggagactggcacccagctggaa

SEQ ID NO: 386041 - DNA, 25 bp, Mus musculus
tgtggagagaaagtttgctcttcaa

SEQ ID NO: 386042 - DNA, 25 bp, Mus musculus
tgtggagagagatggtatggtgtat

SEQ ID NO: 386043 - DNA, 25 bp, Mus musculus
tgtggagatagccaatgagatagat

SEQ ID NO: 386044 - DNA, 25 bp, Mus musculus
tgtggagatgacttggactgatgag

SEQ ID NO: 386045 - DNA, 25 bp, Mus musculus
tgtggagatgcaaggagagtctctt

SEQ ID NO: 386046 - DNA, 25 bp, Mus musculus
tgtggagatggagtatacaatggat

SEQ ID NO: 386047 - DNA, 25 bp, Mus musculus
tgtggagattccagcaattcctgga

SEQ ID NO: 386048 - DNA, 25 bp, Mus musculus
tgtggagattccaggaagcccctga

SEQ ID NO: 386049 - DNA, 25 bp, Mus musculus
tgtggagcaggctcctagaaggtga

SEQ ID NO: 386050 - DNA, 25 bp, Mus musculus
tgtggagcccacgagcacccggagg

SEQ ID NO: 386051 - DNA, 25 bp, Mus musculus
tgtggagcccacggtgacactgctg

SEQ ID NO: 386052 - DNA, 25 bp, Mus musculus
tgtggagcggccaaccccaacaaga

SEQ ID NO: 386053 - DNA, 25 bp, Mus musculus
tgtggagcgggtaatggatgactac

SEQ ID NO: 386054 - DNA, 25 bp, Mus musculus
tgtggagctggaaggtcttgttgca

SEQ ID NO: 386055 - DNA, 25 bp, Mus musculus
tgtggagctttgaatcgggaggaag

SEQ ID NO: 386056 - DNA, 25 bp, Mus musculus
tgtggaggaacagagaagctcccgt

SEQ ID NO: 386057 - DNA, 25 bp, Mus musculus
tgtggaggagaatggggagacctgt

SEQ ID NO: 386058 - DNA, 25 bp, Mus musculus
tgtggaggagggggatatgaaaggt

SEQ ID NO: 386059 - DNA, 25 bp, Mus musculus
tgtggaggatctggaaagagaactt

SEQ ID NO: 386060 - DNA, 25 bp, Mus musculus
tgtggaggctgggctgtacgggagc

SEQ ID NO: 386061 - DNA, 25 bp, Mus musculus
tgtggagggacagcaactgctttgc

SEQ ID NO: 386062 - DNA, 25 bp, Mus musculus
tgtggagggacagtgacaggtttct

SEQ ID NO: 386063 - DNA, 25 bp, Mus musculus
tgtggaggtagagggtggagtttac

SEQ ID NO: 386064 - DNA, 25 bp, Mus musculus
tgtggaggtccgagggtgacttcac

SEQ ID NO: 386065 - DNA, 25 bp, Mus musculus
tgtggaggttgcatcagatgaagaa

SEQ ID NO: 386066 - DNA, 25 bp, Mus musculus
tgtggaggttggtccctgcatccct

SEQ ID NO: 386067 - DNA, 25 bp, Mus musculus
tgtggagtgtggattttatggatac

SEQ ID NO: 386068 - DNA, 25 bp, Mus musculus
tgtggataagcctgagtggcgaccc

SEQ ID NO: 386069 - DNA, 25 bp, Mus musculus
tgtggataaggactgaatcttggta

SEQ ID NO: 386070 - DNA, 25 bp, Mus musculus
tgtggataagtgctgctaaagtggg

SEQ ID NO: 386071 - DNA, 25 bp, Mus musculus
tgtggataatgtagagggtcctgtt

SEQ ID NO: 386072 - DNA, 25 bp, Mus musculus
tgtggatagtgtggaaacctgctgc

SEQ ID NO: 386073 - DNA, 25 bp, Mus musculus
tgtggatagtgtgggcctgccagct

SEQ ID NO: 386074 - DNA, 25 bp, Mus musculus
tgtggatatatccgaaatggctacc

SEQ ID NO: 386075 - DNA, 25 bp, Mus musculus
tgtggatcaagtgtttgcaaaaaat

SEQ ID NO: 386076 - DNA, 25 bp, Mus musculus
tgtggatcacagctgcgaccgaggg

SEQ ID NO: 386077 - DNA, 25 bp, Mus musculus
tgtggatcaggaatcctttctgccc

SEQ ID NO: 386078 - DNA, 25 bp, Mus musculus
tgtggatccttgatcttagaatctt

SEQ ID NO: 386079 - DNA, 25 bp, Mus musculus
tgtggatccttgggggcaggtccta

SEQ ID NO: 386080 - DNA, 25 bp, Mus musculus
tgtggatgacagacacccctgcact

SEQ ID NO: 386081 - DNA, 25 bp, Mus musculus
tgtggatgacagagcagagcctgct

SEQ ID NO: 386082 - DNA, 25 bp, Mus musculus
tgtggatgaggtcactacttcagtg

SEQ ID NO: 386083 - DNA, 25 bp, Mus musculus
tgtggatgccctagtcctgcgcttc

SEQ ID NO: 386084 - DNA, 25 bp, Mus musculus
tgtggatggaggcattgcactcagc

SEQ ID NO: 386085 - DNA, 25 bp, Mus musculus
tgtggatggcgagaaataccagagg

SEQ ID NO: 386086 - DNA, 25 bp, Mus musculus
tgtggatgggtcagggaaagagttg

SEQ ID NO: 386087 - DNA, 25 bp, Mus musculus
tgtggatgggtgaacgagcgtcagt

SEQ ID NO: 386088 - DNA, 25 bp, Mus musculus
tgtggatgtgatgctttagatgagc

SEQ ID NO: 386089 - DNA, 25 bp, Mus musculus
tgtggattaaagctttctccttatg

SEQ ID NO: 386090 - DNA, 25 bp, Mus musculus
tgtggattcaatcgaagatgctggt

SEQ ID NO: 386091 - DNA, 25 bp, Mus musculus
tgtggattcagcatttaagcaaaac

SEQ ID NO: 386092 - DNA, 25 bp, Mus musculus
tgtggattttcggcctggccgagtg

SEQ ID NO: 386093 - DNA, 25 bp, Mus musculus
tgtggcaaaagactgctggagttaa

SEQ ID NO: 386094 - DNA, 25 bp, Mus musculus
tgtggcaaaagccctggaagagaga

SEQ ID NO: 386095 - DNA, 25 bp, Mus musculus
tgtggcaaagtaggagttggcatcc

SEQ ID NO: 386096 - DNA, 25 bp, Mus musculus
tgtggcaaagttagagaacgtggag

SEQ ID NO: 386097 - DNA, 25 bp, Mus musculus
tgtggcaaccagaatggggaatgca

SEQ ID NO: 386098 - DNA, 25 bp, Mus musculus
tgtggcaaccaggctgacaggggct

SEQ ID NO: 386099 - DNA, 25 bp, Mus musculus
tgtggcaatgactggtgtccactcc

SEQ ID NO: 386100 - DNA, 25 bp, Mus musculus
tgtggcaatgactgtcattttagtg

SEQ ID NO: 386101 - DNA, 25 bp, Mus musculus
tgtggcacaagacgatacagcacgg

SEQ ID NO: 386102 - DNA, 25 bp, Mus musculus
tgtggcacaagacggatcttgaaac

SEQ ID NO: 386103 - DNA, 25 bp, Mus musculus
tgtggcacaaggcaaagacatcagg

SEQ ID NO: 386104 - DNA, 25 bp, Mus musculus
tgtggcacacatcactcaactgcaa

SEQ ID NO: 386105 - DNA, 25 bp, Mus musculus
tgtggcaccacacgctacaggtaca

SEQ ID NO: 386106 - DNA, 25 bp, Mus musculus
tgtggcactaaggctggtgttcccg

SEQ ID NO: 386107 - DNA, 25 bp, Mus musculus
tgtggcacttccattatcggaatgt

SEQ ID NO: 386108 - DNA, 25 bp, Mus musculus
tgtggcagcaatggaagcccctaag

SEQ ID NO: 386109 - DNA, 25 bp, Mus musculus
tgtggcagcacagatacctttatca

SEQ ID NO: 386110 - DNA, 25 bp, Mus musculus
tgtggcagcgtgtcaacccaaagtt

SEQ ID NO: 386111 - DNA, 25 bp, Mus musculus
tgtggcagcgtgtttcccacgacag

SEQ ID NO: 386112 - DNA, 25 bp, Mus musculus
tgtggcagctatgggaaagagatac

SEQ ID NO: 386113 - DNA, 25 bp, Mus musculus
tgtggcagtagatgaagaacaacga

SEQ ID NO: 386114 - DNA, 25 bp, Mus musculus
tgtggcagtggtggtgaccaaccac

SEQ ID NO: 386115 - DNA, 25 bp, Mus musculus
tgtggcataaggtgatgttccctgt

SEQ ID NO: 386116 - DNA, 25 bp, Mus musculus
tgtggcatcagagccaaggctaaac

SEQ ID NO: 386117 - DNA, 25 bp, Mus musculus
tgtggcatgcagctccatgactgga

SEQ ID NO: 386118 - DNA, 25 bp, Mus musculus
tgtggcatgcaggtgtaccagctgg

SEQ ID NO: 386119 - DNA, 25 bp, Mus musculus
tgtggcatgccaggtactgctggag

SEQ ID NO: 386120 - DNA, 25 bp, Mus musculus
tgtggcatgccagtgaagagagagc

SEQ ID NO: 386121 - DNA, 25 bp, Mus musculus
tgtggcattaagcactgaatgcaca

SEQ ID NO: 386122 - DNA, 25 bp, Mus musculus
tgtggccaaagccaaacttgccaat

SEQ ID NO: 386123 - DNA, 25 bp, Mus musculus
tgtggccaaagggacagtacttatt

SEQ ID NO: 386124 - DNA, 25 bp, Mus musculus
tgtggccaagcagggactggaatac

SEQ ID NO: 386125 - DNA, 25 bp, Mus musculus
tgtggccaagcaggggtttgatttc

SEQ ID NO: 386126 - DNA, 25 bp, Mus musculus
tgtggccaatggcatgccttggact

SEQ ID NO: 386127 - DNA, 25 bp, Mus musculus
tgtggccaatggctgtcgatattca

SEQ ID NO: 386128 - DNA, 25 bp, Mus musculus
tgtggccacacaggatcagaactta

SEQ ID NO: 386129 - DNA, 25 bp, Mus musculus
tgtggccacgtgttctgccgatctt

SEQ ID NO: 386130 - DNA, 25 bp, Mus musculus
tgtggccaggatcgaaagccagcct

SEQ ID NO: 386131 - DNA, 25 bp, Mus musculus
tgtggccaggcttgtagaaaatgat

SEQ ID NO: 386132 - DNA, 25 bp, Mus musculus
tgtggcccaagataaagactgagtt

SEQ ID NO: 386133 - DNA, 25 bp, Mus musculus
tgtggcccaaggacactcctcctct

SEQ ID NO: 386134 - DNA, 25 bp, Mus musculus
tgtggcccaggttgctacaggcact

SEQ ID NO: 386135 - DNA, 25 bp, Mus musculus
tgtggcccagtcactggccggggcg

SEQ ID NO: 386136 - DNA, 25 bp, Mus musculus
tgtggcccttctcatcaaggtgatt

SEQ ID NO: 386137 - DNA, 25 bp, Mus musculus
tgtggccgataaagattactctgtg

SEQ ID NO: 386138 - DNA, 25 bp, Mus musculus
tgtggccgcacagaactgactgtcc

SEQ ID NO: 386139 - DNA, 25 bp, Mus musculus
tgtggccgctttcaggtagcacttt

SEQ ID NO: 386140 - DNA, 25 bp, Mus musculus
tgtggcctcgctaggatgcttcatt

SEQ ID NO: 386141 - DNA, 25 bp, Mus musculus
tgtggccttgcaaagctgttgctga

SEQ ID NO: 386142 - DNA, 25 bp, Mus musculus
tgtggccttttcagaactcaagctc

SEQ ID NO: 386143 - DNA, 25 bp, Mus musculus
tgtggccttttcagggctacagtgc

SEQ ID NO: 386144 - DNA, 25 bp, Mus musculus
tgtggcgaatcagaataatttaaaa

SEQ ID NO: 386145 - DNA, 25 bp, Mus musculus
tgtggcgaggagaaagcggtggaga

SEQ ID NO: 386146 - DNA, 25 bp, Mus musculus
tgtggcgccgagcggggcgaggtgg

SEQ ID NO: 386147 - DNA, 25 bp, Mus musculus
tgtggcgccgagcgggtcctcagga

SEQ ID NO: 386148 - DNA, 25 bp, Mus musculus
tgtggcgcggcaaccaaccgtctgg

SEQ ID NO: 386149 - DNA, 25 bp, Mus musculus
tgtggcgggcgctaggtccgtctcc

SEQ ID NO: 386150 - DNA, 25 bp, Mus musculus
tgtggcggggttgggaatggctttg

SEQ ID NO: 386151 - DNA, 25 bp, Mus musculus
tgtggcggggttggggggcttctgc

SEQ ID NO: 386152 - DNA, 25 bp, Mus musculus
tgtggcggggttggggtcgatactg

SEQ ID NO: 386153 - DNA, 25 bp, Mus musculus
tgtggcgtcggggtgacatggacag

SEQ ID NO: 386154 - DNA, 25 bp, Mus musculus
tgtggcgttaaactttctccagacc

SEQ ID NO: 386155 - DNA, 25 bp, Mus musculus
tgtggctaagactctagccttgttc

SEQ ID NO: 386156 - DNA, 25 bp, Mus musculus
tgtggctaagctaccgatttattga

SEQ ID NO: 386157 - DNA, 25 bp, Mus musculus
tgtggctaccctggtcatctgactt

SEQ ID NO: 386158 - DNA, 25 bp, Mus musculus
tgtggctactctgagataaagccac

SEQ ID NO: 386159 - DNA, 25 bp, Mus musculus
tgtggctactctgagtgttataggc

SEQ ID NO: 386160 - DNA, 25 bp, Mus musculus
tgtggctagagaggctgccctggga

SEQ ID NO: 386161 - DNA, 25 bp, Mus musculus
tgtggctatggagaggtgggaaagg

SEQ ID NO: 386162 - DNA, 25 bp, Mus musculus
tgtggctcagctatcttccagatca

SEQ ID NO: 386163 - DNA, 25 bp, Mus musculus
tgtggctccggcagggaagcccagc

SEQ ID NO: 386164 - DNA, 25 bp, Mus musculus
tgtggctgaagcaggaatggacaga

SEQ ID NO: 386165 - DNA, 25 bp, Mus musculus
tgtggctgaaggagaacttgagaga

SEQ ID NO: 386166 - DNA, 25 bp, Mus musculus
tgtggctgaaggaggtctctctgct

SEQ ID NO: 386167 - DNA, 25 bp, Mus musculus
tgtggctgagacaggcacataagac

SEQ ID NO: 386168 - DNA, 25 bp, Mus musculus
tgtggctgatcaaaggaaaggactc

SEQ ID NO: 386169 - DNA, 25 bp, Mus musculus
tgtggctgatcgcgtggctgaggag

SEQ ID NO: 386170 - DNA, 25 bp, Mus musculus
tgtggctgatctcttcattgggacc

SEQ ID NO: 386171 - DNA, 25 bp, Mus musculus
tgtggctgatgtatgtgtaagtgca

SEQ ID NO: 386172 - DNA, 25 bp, Mus musculus
tgtggctgcaaaggccactttgcca

SEQ ID NO: 386173 - DNA, 25 bp, Mus musculus
tgtggctgctcccgcaggctggcca

SEQ ID NO: 386174 - DNA, 25 bp, Mus musculus
tgtggctgctgactctgctctccct

SEQ ID NO: 386175 - DNA, 25 bp, Mus musculus
tgtggctgctgatgccatactccaa

SEQ ID NO: 386176 - DNA, 25 bp, Mus musculus
tgtggctgctgtctccccattcaga

SEQ ID NO: 386177 - DNA, 25 bp, Mus musculus
tgtggctggaggggagtggggccgg

SEQ ID NO: 386178 - DNA, 25 bp, Mus musculus
tgtggctgggaccaggagctgacag

SEQ ID NO: 386179 - DNA, 25 bp, Mus musculus
tgtggctggtacccctgctgatgta

SEQ ID NO: 386180 - DNA, 25 bp, Mus musculus
tgtggctggtacccgtgctgatgta

SEQ ID NO: 386181 - DNA, 25 bp, Mus musculus
tgtggctgtcacaaagatcatagcc

SEQ ID NO: 386182 - DNA, 25 bp, Mus musculus
tgtggctgttggcagttctggcagg

SEQ ID NO: 386183 - DNA, 25 bp, Mus musculus
tgtggcttagcagatcatcagtgct

SEQ ID NO: 386184 - DNA, 25 bp, Mus musculus
tgtggcttcaagttttggaaacatg

SEQ ID NO: 386185 - DNA, 25 bp, Mus musculus
tgtggcttcccagatgaatgcactg

SEQ ID NO: 386186 - DNA, 25 bp, Mus musculus
tgtggcttgccaggtgaatattggc

SEQ ID NO: 386187 - DNA, 25 bp, Mus musculus
tgtggctttaataaaccacgtttac

SEQ ID NO: 386188 - DNA, 25 bp, Mus musculus
tgtggctttaatatgggcggcaacg

SEQ ID NO: 386189 - DNA, 25 bp, Mus musculus
tgtggctttgaccatccacgaaaat

SEQ ID NO: 386190 - DNA, 25 bp, Mus musculus
tgtggctttgagtctgacaagatgt

SEQ ID NO: 386191 - DNA, 25 bp, Mus musculus
tgtggctttgctggagtatattgaa

SEQ ID NO: 386192 - DNA, 25 bp, Mus musculus
tgtggctttgctgggttgctatgat

SEQ ID NO: 386193 - DNA, 25 bp, Mus musculus
tgtgggaaaagaactaaatggcagc

SEQ ID NO: 386194 - DNA, 25 bp, Mus musculus
tgtgggaaaagaactaatttcagca

SEQ ID NO: 386195 - DNA, 25 bp, Mus musculus
tgtgggaaaagaactgttcagctcc

SEQ ID NO: 386196 - DNA, 25 bp, Mus musculus
tgtgggaaacccaagcttatggcaa

SEQ ID NO: 386197 - DNA, 25 bp, Mus musculus
tgtgggaaaccttggtcttgccacc

SEQ ID NO: 386198 - DNA, 25 bp, Mus musculus
tgtgggaaactatgatctcttcact

SEQ ID NO: 386199 - DNA, 25 bp, Mus musculus
tgtgggaaagaaggttaacctctgc

SEQ ID NO: 386200 - DNA, 25 bp, Mus musculus
tgtgggaaatacggtatcaccagcc

SEQ ID NO: 386201 - DNA, 25 bp, Mus musculus
tgtgggaacagctggaaggtaggcc

SEQ ID NO: 386202 - DNA, 25 bp, Mus musculus
tgtgggaacaggaacagaatggaag

SEQ ID NO: 386203 - DNA, 25 bp, Mus musculus
tgtgggaacaggtattgaagcccct

SEQ ID NO: 386204 - DNA, 25 bp, Mus musculus
tgtgggaacaggtgtcacagcacgg

SEQ ID NO: 386205 - DNA, 25 bp, Mus musculus
tgtgggaagaacactgctgtgctgg

SEQ ID NO: 386206 - DNA, 25 bp, Mus musculus
tgtgggaagacaaagccattggcct

SEQ ID NO: 386207 - DNA, 25 bp, Mus musculus
tgtgggacaaggttttgagcattaa

SEQ ID NO: 386208 - DNA, 25 bp, Mus musculus
tgtgggacatgaatttggacctcac

SEQ ID NO: 386209 - DNA, 25 bp, Mus musculus
tgtgggacccgaacaatttcgaaga

SEQ ID NO: 386210 - DNA, 25 bp, Mus musculus
tgtgggacctccgggcctagctggg

SEQ ID NO: 386211 - DNA, 25 bp, Mus musculus
tgtgggactgagggtggttgctgta

SEQ ID NO: 386212 - DNA, 25 bp, Mus musculus
tgtgggagaccactgggacaccaac

SEQ ID NO: 386213 - DNA, 25 bp, Mus musculus
tgtgggagacggccccgactctggc

SEQ ID NO: 386214 - DNA, 25 bp, Mus musculus
tgtgggagagaggcaccatgacaac

SEQ ID NO: 386215 - DNA, 25 bp, Mus musculus
tgtgggagattgtgaccttggagtg

SEQ ID NO: 386216 - DNA, 25 bp, Mus musculus
tgtgggagcaaggaggctcatctgc

SEQ ID NO: 386217 - DNA, 25 bp, Mus musculus
tgtgggagcagctgttgctttcccc

SEQ ID NO: 386218 - DNA, 25 bp, Mus musculus
tgtgggagctgctgttgctttcccc

SEQ ID NO: 386219 - DNA, 25 bp, Mus musculus
tgtgggatatcgcggcccaatggaa

SEQ ID NO: 386220 - DNA, 25 bp, Mus musculus
tgtgggatatcgcgggacaggaacg

SEQ ID NO: 386221 - DNA, 25 bp, Mus musculus
tgtgggcaacgctgaatggtgccat

SEQ ID NO: 386222 - DNA, 25 bp, Mus musculus
tgtgggcaacgctgtcagcgaaggc

SEQ ID NO: 386223 - DNA, 25 bp, Mus musculus
tgtgggcacctgaatccaccttgac

SEQ ID NO: 386224 - DNA, 25 bp, Mus musculus
tgtgggcacctgagagagaagacac

SEQ ID NO: 386225 - DNA, 25 bp, Mus musculus
tgtgggcacctgctggggttgggac

SEQ ID NO: 386226 - DNA, 25 bp, Mus musculus
tgtgggcagaaatccctagcctatc

SEQ ID NO: 386227 - DNA, 25 bp, Mus musculus
tgtgggccagatctgccacctccct

SEQ ID NO: 386228 - DNA, 25 bp, Mus musculus
tgtgggccagctacctgggtgctga

SEQ ID NO: 386229 - DNA, 25 bp, Mus musculus
tgtgggcccagaccattccccttgt

SEQ ID NO: 386230 - DNA, 25 bp, Mus musculus
tgtgggccgtttctgcttccctcaa

SEQ ID NO: 386231 - DNA, 25 bp, Mus musculus
tgtgggcgaggaatcttatggcaag

SEQ ID NO: 386232 - DNA, 25 bp, Mus musculus
tgtgggctgcttgctctctaactga

SEQ ID NO: 386233 - DNA, 25 bp, Mus musculus
tgtgggctgcttggcttacttcttt

SEQ ID NO: 386234 - DNA, 25 bp, Mus musculus
tgtgggcttcctcaatattgatgaa

SEQ ID NO: 386235 - DNA, 25 bp, Mus musculus
tgtggggaaaaccagttgggtctcc

SEQ ID NO: 386236 - DNA, 25 bp, Mus musculus
tgtggggaaagcatctgaactactg

SEQ ID NO: 386237 - DNA, 25 bp, Mus musculus
tgtggggaacagaagccggatggtg

SEQ ID NO: 386238 - DNA, 25 bp, Mus musculus
tgtggggaagaattcttgaagtcat

SEQ ID NO: 386239 - DNA, 25 bp, Mus musculus
tgtggggaagctcctgactatgata

SEQ ID NO: 386240 - DNA, 25 bp, Mus musculus
tgtggggacaaaacacagaagtctt

SEQ ID NO: 386241 - DNA, 25 bp, Mus musculus
tgtggggacaggttctggaaatacg

SEQ ID NO: 386242 - DNA, 25 bp, Mus musculus
tgtggggagaaacagccctgacggc

SEQ ID NO: 386243 - DNA, 25 bp, Mus musculus
tgtggggagaccggtactttgatcc

SEQ ID NO: 386244 - DNA, 25 bp, Mus musculus
tgtggggagagactgatgagacatc

SEQ ID NO: 386245 - DNA, 25 bp, Mus musculus
tgtggggattaaggcaggttgtcac

SEQ ID NO: 386246 - DNA, 25 bp, Mus musculus
tgtggggccaggtgtcctgtccatg

SEQ ID NO: 386247 - DNA, 25 bp, Mus musculus
tgtggggccgcacggttggtacacg

SEQ ID NO: 386248 - DNA, 25 bp, Mus musculus
tgtggggcgcacagccctgtgaagc

SEQ ID NO: 386249 - DNA, 25 bp, Mus musculus
tgtggggctccacagaattgtggct

SEQ ID NO: 386250 - DNA, 25 bp, Mus musculus
tgtggggctccctccatgtgctgtc

SEQ ID NO: 386251 - DNA, 25 bp, Mus musculus
tgtggggctcctctaaattggttcc

SEQ ID NO: 386252 - DNA, 25 bp, Mus musculus
tgtggggctgcagaccccacgtggc

SEQ ID NO: 386253 - DNA, 25 bp, Mus musculus
tgtggggctggcatggaaaataatg

SEQ ID NO: 386254 - DNA, 25 bp, Mus musculus
tgtggggctggtgtcaggcatggaa

SEQ ID NO: 386255 - DNA, 25 bp, Mus musculus
tgtgggggaacctggagctgcccat

SEQ ID NO: 386256 - DNA, 25 bp, Mus musculus
tgtgggggaacctgggagccaccca

SEQ ID NO: 386257 - DNA, 25 bp, Mus musculus
tgtgggggcctgcatggcctgattg

SEQ ID NO: 386258 - DNA, 25 bp, Mus musculus
tgtggggtcagggggactatgtatg

SEQ ID NO: 386259 - DNA, 25 bp, Mus musculus
tgtggggtccctggctcctggccct

SEQ ID NO: 386260 - DNA, 25 bp, Mus musculus
tgtggggtccgggagtgttacaggt

SEQ ID NO: 386261 - DNA, 25 bp, Mus musculus
tgtgggtaacacagaagccaccatg

SEQ ID NO: 386262 - DNA, 25 bp, Mus musculus
tgtgggtaccttgatgccatcccgc

SEQ ID NO: 386263 - DNA, 25 bp, Mus musculus
tgtgggtccaggctctggacctgat

SEQ ID NO: 386264 - DNA, 25 bp, Mus musculus
tgtgggtccctccagacttcctctg

SEQ ID NO: 386265 - DNA, 25 bp, Mus musculus
tgtgggtccctccaggtgggcacat

SEQ ID NO: 386266 - DNA, 25 bp, Mus musculus
tgtgggtcctcggggcgagcgaggt

SEQ ID NO: 386267 - DNA, 25 bp, Mus musculus
tgtgggtcgggcacattgcctcttt

SEQ ID NO: 386268 - DNA, 25 bp, Mus musculus
tgtgggtcggggaagagttgggctg

SEQ ID NO: 386269 - DNA, 25 bp, Mus musculus
tgtgggtctccaggctcagcccgtg

SEQ ID NO: 386270 - DNA, 25 bp, Mus musculus
tgtgggtgagcaggtgcgggaggtg

SEQ ID NO: 386271 - DNA, 25 bp, Mus musculus
tgtgggtgatccaggtcattgtggc

SEQ ID NO: 386272 - DNA, 25 bp, Mus musculus
tgtgggtgatgactcagcttctaag

SEQ ID NO: 386273 - DNA, 25 bp, Mus musculus
tgtgggtgatgactgttgctttcac

SEQ ID NO: 386274 - DNA, 25 bp, Mus musculus
tgtgggtggagtgctctctgaaaac

SEQ ID NO: 386275 - DNA, 25 bp, Mus musculus
tgtgggtggagtggtccattcgttt

SEQ ID NO: 386276 - DNA, 25 bp, Mus musculus
tgtgggttagcgctaactgtccttc

SEQ ID NO: 386277 - DNA, 25 bp, Mus musculus
tgtgggttatgttcagggcatgtcc

SEQ ID NO: 386278 - DNA, 25 bp, Mus musculus
tgtgggtttcaggatccagccgcag

SEQ ID NO: 386279 - DNA, 25 bp, Mus musculus
tgtggtaaagggggagcacgagtgc

SEQ ID NO: 386280 - DNA, 25 bp, Mus musculus
tgtggtaatcagggtaacacgcagt

SEQ ID NO: 386281 - DNA, 25 bp, Mus musculus
tgtggtacccttgtgaatacatcaa

SEQ ID NO: 386282 - DNA, 25 bp, Mus musculus
tgtggtaccggagtaaggaacgagg

SEQ ID NO: 386283 - DNA, 25 bp, Mus musculus
tgtggtacttcggctgtcccagggc

SEQ ID NO: 386284 - DNA, 25 bp, Mus musculus
tgtggtagagaaagaaaccctggcc

SEQ ID NO: 386285 - DNA, 25 bp, Mus musculus
tgtggtagagaaggcagaagaatgc

SEQ ID NO: 386286 - DNA, 25 bp, Mus musculus
tgtggtagcagacccaacagttccc

SEQ ID NO: 386287 - DNA, 25 bp, Mus musculus
tgtggtatgcagaggttaaggagct

SEQ ID NO: 386288 - DNA, 25 bp, Mus musculus
tgtggtcaaccacactgtcctgggc

SEQ ID NO: 386289 - DNA, 25 bp, Mus musculus
tgtggtcaaggacggacccggcttc

SEQ ID NO: 386290 - DNA, 25 bp, Mus musculus
tgtggtcaaggacttaatgggcatc

SEQ ID NO: 386291 - DNA, 25 bp, Mus musculus
tgtggtcaaggttcttgcagaatca

SEQ ID NO: 386292 - DNA, 25 bp, Mus musculus
tgtggtcagagcagcagattttcca

SEQ ID NO: 386293 - DNA, 25 bp, Mus musculus
tgtggtcagtctctgcaggttcagg

SEQ ID NO: 386294 - DNA, 25 bp, Mus musculus
tgtggtcatgaaggcatttgagcac

SEQ ID NO: 386295 - DNA, 25 bp, Mus musculus
tgtggtccgagggctgctggacctg

SEQ ID NO: 386296 - DNA, 25 bp, Mus musculus
tgtggtccgtcaagcccttgaccac

SEQ ID NO: 386297 - DNA, 25 bp, Mus musculus
tgtggtcctagggttctccacatac

SEQ ID NO: 386298 - DNA, 25 bp, Mus musculus
tgtggtcctgaatccttcacacctg

SEQ ID NO: 386299 - DNA, 25 bp, Mus musculus
tgtggtcctggcctggtgtgcatcg

SEQ ID NO: 386300 - DNA, 25 bp, Mus musculus
tgtggtcgagaaaagacaactgagg

SEQ ID NO: 386301 - DNA, 25 bp, Mus musculus
tgtggtcgagttgcagtaatgtgaa

SEQ ID NO: 386302 - DNA, 25 bp, Mus musculus
tgtggtctatgaaaccaatgtttta

SEQ ID NO: 386303 - DNA, 25 bp, Mus musculus
tgtggtctattcagatacagccctg

SEQ ID NO: 386304 - DNA, 25 bp, Mus musculus
tgtggtctattcagctacagtgatc

SEQ ID NO: 386305 - DNA, 25 bp, Mus musculus
tgtggtcttcacaggcgtggagacc

SEQ ID NO: 386306 - DNA, 25 bp, Mus musculus
tgtggtgacacctgtgtacaggaaa

SEQ ID NO: 386307 - DNA, 25 bp, Mus musculus
tgtggtgacaggcattgagatgttc

SEQ ID NO: 386308 - DNA, 25 bp, Mus musculus
tgtggtgacaggtattgagatgttc

SEQ ID NO: 386309 - DNA, 25 bp, Mus musculus
tgtggtgactgacctatccgcttct

SEQ ID NO: 386310 - DNA, 25 bp, Mus musculus
tgtggtgactgttggtcctgtggaa

SEQ ID NO: 386311 - DNA, 25 bp, Mus musculus
tgtggtgatcaggatctgcacctgg

SEQ ID NO: 386312 - DNA, 25 bp, Mus musculus
tgtggtgatggtacaccaggggttg

SEQ ID NO: 386313 - DNA, 25 bp, Mus musculus
tgtggtgcacaggacacaaaaaaga

SEQ ID NO: 386314 - DNA, 25 bp, Mus musculus
tgtggtgcacagtttccctcaggac

SEQ ID NO: 386315 - DNA, 25 bp, Mus musculus
tgtggtgcatgctagcttggccgac

SEQ ID NO: 386316 - DNA, 25 bp, Mus musculus
tgtggtgctaagaggcttcctggat

SEQ ID NO: 386317 - DNA, 25 bp, Mus musculus
tgtggtgctaaggcaacatctgcaa

SEQ ID NO: 386318 - DNA, 25 bp, Mus musculus
tgtggtgctaaggtggtggagaaag

SEQ ID NO: 386319 - DNA, 25 bp, Mus musculus
tgtggtggaagaggagacaagtttc

SEQ ID NO: 386320 - DNA, 25 bp, Mus musculus
tgtggtggagtacgaatatattgtg

SEQ ID NO: 386321 - DNA, 25 bp, Mus musculus
tgtggtggccagtgggtgcatcctt

SEQ ID NO: 386322 - DNA, 25 bp, Mus musculus
tgtggtggccatggtctgggaaggc

SEQ ID NO: 386323 - DNA, 25 bp, Mus musculus
tgtggtggctcgattcctgtctctg

SEQ ID NO: 386324 - DNA, 25 bp, Mus musculus
tgtggtggtataaagagggtgtatt

SEQ ID NO: 386325 - DNA, 25 bp, Mus musculus
tgtggtggtcatcccagcagaagtt

SEQ ID NO: 386326 - DNA, 25 bp, Mus musculus
tgtggtgttacaggccgccctgctc

SEQ ID NO: 386327 - DNA, 25 bp, Mus musculus
tgtggtgttacaggttagtgtcact

SEQ ID NO: 386328 - DNA, 25 bp, Mus musculus
tgtggttaataaaggaggctttgga

SEQ ID NO: 386329 - DNA, 25 bp, Mus musculus
tgtggttaataatgcagctgtgtct

SEQ ID NO: 386330 - DNA, 25 bp, Mus musculus
tgtggttcatcggctggactgtact

SEQ ID NO: 386331 - DNA, 25 bp, Mus musculus
tgtggttcccgacgctcctgcgttc

SEQ ID NO: 386332 - DNA, 25 bp, Mus musculus
tgtggttcccgacggtgacaaactt

SEQ ID NO: 386333 - DNA, 25 bp, Mus musculus
tgtggttcccgacggttttggctat

SEQ ID NO: 386334 - DNA, 25 bp, Mus musculus
tgtggttcctgatatgctctctgcc

SEQ ID NO: 386335 - DNA, 25 bp, Mus musculus
tgtggttctcgagcaccctcagaat

SEQ ID NO: 386336 - DNA, 25 bp, Mus musculus
tgtggttgacatcaaatacaagagg

SEQ ID NO: 386337 - DNA, 25 bp, Mus musculus
tgtggttgacatcaagactgaagga

SEQ ID NO: 386338 - DNA, 25 bp, Mus musculus
tgtggttgagctagaaaattatggt

SEQ ID NO: 386339 - DNA, 25 bp, Mus musculus
tgtggttgccggacctacaacctgg

SEQ ID NO: 386340 - DNA, 25 bp, Mus musculus
tgtggttggcaacctctgaagtctt

SEQ ID NO: 386341 - DNA, 25 bp, Mus musculus
tgtggtttaaaaaactacatatggt

SEQ ID NO: 386342 - DNA, 25 bp, Mus musculus
tgtggtttaaaaactctgtgcaccg

SEQ ID NO: 386343 - DNA, 25 bp, Mus musculus
tgtggtttacacagtattactatga

SEQ ID NO: 386344 - DNA, 25 bp, Mus musculus
tgtggtttatcaagattactcggga

SEQ ID NO: 386345 - DNA, 25 bp, Mus musculus
tgtggtttatcaagggatccacaaa

SEQ ID NO: 386346 - DNA, 25 bp, Mus musculus
tgtggtttctctaggtattctcatg

SEQ ID NO: 386347 - DNA, 25 bp, Mus musculus
tgtggtttgcagcttcatggtttca

SEQ ID NO: 386348 - DNA, 25 bp, Mus musculus
tgtggtttgcagggatgcggtaaaa

SEQ ID NO: 386349 - DNA, 25 bp, Mus musculus
tgtgtaaaaagagtattacaacaac

SEQ ID NO: 386350 - DNA, 25 bp, Mus musculus
tgtgtaaaaaggaagtgttaaacat

SEQ ID NO: 386351 - DNA, 25 bp, Mus musculus
tgtgtaaaaggccttaaccatggca

SEQ ID NO: 386352 - DNA, 25 bp, Mus musculus
tgtgtaaaatctgggggttacaact

SEQ ID NO: 386353 - DNA, 25 bp, Mus musculus
tgtgtaaaatctgtgcactgaggcc

SEQ ID NO: 386354 - DNA, 25 bp, Mus musculus
tgtgtaaagcgatgattcccccgac

SEQ ID NO: 386355 - DNA, 25 bp, Mus musculus
tgtgtaacaaggaggcttacagtgg

SEQ ID NO: 386356 - DNA, 25 bp, Mus musculus
tgtgtaacccagagatttattttat

SEQ ID NO: 386357 - DNA, 25 bp, Mus musculus
tgtgtaactcagaaagaagattata

SEQ ID NO: 386358 - DNA, 25 bp, Mus musculus
tgtgtaagcactggggaaagccttt

SEQ ID NO: 386359 - DNA, 25 bp, Mus musculus
tgtgtaagcagaatattcaagggca

SEQ ID NO: 386360 - DNA, 25 bp, Mus musculus
tgtgtaagcggccatgtattctcat

SEQ ID NO: 386361 - DNA, 25 bp, Mus musculus
tgtgtaagcggtatttggaggtaga

SEQ ID NO: 386362 - DNA, 25 bp, Mus musculus
tgtgtaatgaagaaaagtccatcat

SEQ ID NO: 386363 - DNA, 25 bp, Mus musculus
tgtgtaatgaagacttgtgacacct

SEQ ID NO: 386364 - DNA, 25 bp, Mus musculus
tgtgtacactccaggagctgcagcc

SEQ ID NO: 386365 - DNA, 25 bp, Mus musculus
tgtgtacagtgacaggtatatcttt

SEQ ID NO: 386366 - DNA, 25 bp, Mus musculus
tgtgtaccagatgacagaaggcagg

SEQ ID NO: 386367 - DNA, 25 bp, Mus musculus
tgtgtacccaggaataaaacccaat

SEQ ID NO: 386368 - DNA, 25 bp, Mus musculus
tgtgtacccaggttgtgactacact

SEQ ID NO: 386369 - DNA, 25 bp, Mus musculus
tgtgtacgtgagcctggacagaccc

SEQ ID NO: 386370 - DNA, 25 bp, Mus musculus
tgtgtactaaaaatagcccagaaga

SEQ ID NO: 386371 - DNA, 25 bp, Mus musculus
tgtgtacttgactgaagtgtgcttt

SEQ ID NO: 386372 - DNA, 25 bp, Mus musculus
tgtgtagaactgctccaggctttct

SEQ ID NO: 386373 - DNA, 25 bp, Mus musculus
tgtgtagaagccatccgttctcgtg

SEQ ID NO: 386374 - DNA, 25 bp, Mus musculus
tgtgtagcaggtttcaaagctgaat

SEQ ID NO: 386375 - DNA, 25 bp, Mus musculus
tgtgtagcctcaggatgcctggtgt

SEQ ID NO: 386376 - DNA, 25 bp, Mus musculus
tgtgtaggccaggttgactcttcac

SEQ ID NO: 386377 - DNA, 25 bp, Mus musculus
tgtgtaggggtaaagatctaagctg

SEQ ID NO: 386378 - DNA, 25 bp, Mus musculus
tgtgtagtcgcagaactgcactggc

SEQ ID NO: 386379 - DNA, 25 bp, Mus musculus
tgtgtataaagtacaacctgagaat

SEQ ID NO: 386380 - DNA, 25 bp, Mus musculus
tgtgtataagactgtcatcaggaat

SEQ ID NO: 386381 - DNA, 25 bp, Mus musculus
tgtgtatatctacaggtctgacaag

SEQ ID NO: 386382 - DNA, 25 bp, Mus musculus
tgtgtatatggacatctggattatg

SEQ ID NO: 386383 - DNA, 25 bp, Mus musculus
tgtgtatcagaggacctcagaatac

SEQ ID NO: 386384 - DNA, 25 bp, Mus musculus
tgtgtattaagaggagtgtctccaa

SEQ ID NO: 386385 - DNA, 25 bp, Mus musculus
tgtgtattaagagttccgaggtgat

SEQ ID NO: 386386 - DNA, 25 bp, Mus musculus
tgtgtattttggggtgagcgtggac

SEQ ID NO: 386387 - DNA, 25 bp, Mus musculus
tgtgtcaaaagcctatgtccccaca

SEQ ID NO: 386388 - DNA, 25 bp, Mus musculus
tgtgtcaaaagggaagatggaagac

SEQ ID NO: 386389 - DNA, 25 bp, Mus musculus
tgtgtcaacgaggaaatgttgtcct

SEQ ID NO: 386390 - DNA, 25 bp, Mus musculus
tgtgtcaacgaggtccccggacctc

SEQ ID NO: 386391 - DNA, 25 bp, Mus musculus
tgtgtcacacagatccagctgagct

SEQ ID NO: 386392 - DNA, 25 bp, Mus musculus
tgtgtcacacagatttttggagaca

SEQ ID NO: 386393 - DNA, 25 bp, Mus musculus
tgtgtcacacgtgtggggctgcctt

SEQ ID NO: 386394 - DNA, 25 bp, Mus musculus
tgtgtcacccaaggtccagtttgat

SEQ ID NO: 386395 - DNA, 25 bp, Mus musculus
tgtgtcacccattctaacggcaagt

SEQ ID NO: 386396 - DNA, 25 bp, Mus musculus
tgtgtcagaagcacggtactacaag

SEQ ID NO: 386397 - DNA, 25 bp, Mus musculus
tgtgtcagatcgaaccttgttcagc

SEQ ID NO: 386398 - DNA, 25 bp, Mus musculus
tgtgtcaggatatgacataatgaaa

SEQ ID NO: 386399 - DNA, 25 bp, Mus musculus
tgtgtcagggacaggagttcagagc

SEQ ID NO: 386400 - DNA, 25 bp, Mus musculus
tgtgtcagggctggacagtgctaca

SEQ ID NO: 386401 - DNA, 25 bp, Mus musculus
tgtgtcatctttccaaagaacattc

SEQ ID NO: 386402 - DNA, 25 bp, Mus musculus
tgtgtcattaactacgtggaaaagg

SEQ ID NO: 386403 - DNA, 25 bp, Mus musculus
tgtgtcattcagaaggcctctctct

SEQ ID NO: 386404 - DNA, 25 bp, Mus musculus
tgtgtcatttttagctccgcctgct

SEQ ID NO: 386405 - DNA, 25 bp, Mus musculus
tgtgtcatttttaggatttggtgtc

SEQ ID NO: 386406 - DNA, 25 bp, Mus musculus
tgtgtccaagctgtcagtagaagca

SEQ ID NO: 386407 - DNA, 25 bp, Mus musculus
tgtgtccagcagtagggagtgccgc

SEQ ID NO: 386408 - DNA, 25 bp, Mus musculus
tgtgtccagcagtaggggaacaaag

SEQ ID NO: 386409 - DNA, 25 bp, Mus musculus
tgtgtccatcctgtcctcagcctgc

SEQ ID NO: 386410 - DNA, 25 bp, Mus musculus
tgtgtccccagaaccaaggagagca

SEQ ID NO: 386411 - DNA, 25 bp, Mus musculus
tgtgtccctcatacaactagaccga

SEQ ID NO: 386412 - DNA, 25 bp, Mus musculus
tgtgtcctcagagtctcccattaga

SEQ ID NO: 386413 - DNA, 25 bp, Mus musculus
tgtgtcctcaggtggcagtttatgt

SEQ ID NO: 386414 - DNA, 25 bp, Mus musculus
tgtgtcctcgagagacccagccatt

SEQ ID NO: 386415 - DNA, 25 bp, Mus musculus
tgtgtcctcgagttttactacagag

SEQ ID NO: 386416 - DNA, 25 bp, Mus musculus
tgtgtcctgaggatctttccaacct

SEQ ID NO: 386417 - DNA, 25 bp, Mus musculus
tgtgtcctgagtatcccaggcgcgg

SEQ ID NO: 386418 - DNA, 25 bp, Mus musculus
tgtgtcctgctaaggctagagcgca

SEQ ID NO: 386419 - DNA, 25 bp, Mus musculus
tgtgtcctgctaagtgttcttgagt

SEQ ID NO: 386420 - DNA, 25 bp, Mus musculus
tgtgtcctgctcaggtgactcagaa

SEQ ID NO: 386421 - DNA, 25 bp, Mus musculus
tgtgtcctggagcagacaggattat

SEQ ID NO: 386422 - DNA, 25 bp, Mus musculus
tgtgtcctgtgaagacatcaacgaa

SEQ ID NO: 386423 - DNA, 25 bp, Mus musculus
tgtgtcctgtgaagacatcaatgag

SEQ ID NO: 386424 - DNA, 25 bp, Mus musculus
tgtgtcctgtgaagaccaagacgag

SEQ ID NO: 386425 - DNA, 25 bp, Mus musculus
tgtgtccttgaggcccatctgaaca

SEQ ID NO: 386426 - DNA, 25 bp, Mus musculus
tgtgtcgcacgagagctgcctgtag

SEQ ID NO: 386427 - DNA, 25 bp, Mus musculus
tgtgtcgcacgaggtggactcacat

SEQ ID NO: 386428 - DNA, 25 bp, Mus musculus
tgtgtcgctcctgggaccatttact

SEQ ID NO: 386429 - DNA, 25 bp, Mus musculus
tgtgtcgcttgtagaaatgccaaag

SEQ ID NO: 386430 - DNA, 25 bp, Mus musculus
tgtgtcgcttgtaggaatgccaaag

SEQ ID NO: 386431 - DNA, 25 bp, Mus musculus
tgtgtcggagaggctggtccaggag

SEQ ID NO: 386432 - DNA, 25 bp, Mus musculus
tgtgtcggagcctccgaagtagctg

SEQ ID NO: 386433 - DNA, 25 bp, Mus musculus
tgtgtctaaagggcttctctgccta

SEQ ID NO: 386434 - DNA, 25 bp, Mus musculus
tgtgtctaaaggtaaaacagactag

SEQ ID NO: 386435 - DNA, 25 bp, Mus musculus
tgtgtctaaggaaacagcaagacat

SEQ ID NO: 386436 - DNA, 25 bp, Mus musculus
tgtgtctaagtgtctgtgcttggag

SEQ ID NO: 386437 - DNA, 25 bp, Mus musculus
tgtgtctcaggtggtccacaaggct

SEQ ID NO: 386438 - DNA, 25 bp, Mus musculus
tgtgtctcggctttccagtctgttc

SEQ ID NO: 386439 - DNA, 25 bp, Mus musculus
tgtgtctcttactggggccttcact

SEQ ID NO: 386440 - DNA, 25 bp, Mus musculus
tgtgtctgaaaaggctcccccaccg

SEQ ID NO: 386441 - DNA, 25 bp, Mus musculus
tgtgtctgaccagcatgcccgctgc

SEQ ID NO: 386442 - DNA, 25 bp, Mus musculus
tgtgtctgacgcactgtatcacttt

SEQ ID NO: 386443 - DNA, 25 bp, Mus musculus
tgtgtctgaggtcaactgaagctgt

SEQ ID NO: 386444 - DNA, 25 bp, Mus musculus
tgtgtctgccagaatggggaggtag

SEQ ID NO: 386445 - DNA, 25 bp, Mus musculus
tgtgtctgccgtgcgtctcttcctg

SEQ ID NO: 386446 - DNA, 25 bp, Mus musculus
tgtgtctggaaagagaaaacatcgc

SEQ ID NO: 386447 - DNA, 25 bp, Mus musculus
tgtgtctggaggaggtaaatgaaaa

SEQ ID NO: 386448 - DNA, 25 bp, Mus musculus
tgtgtctgtctggctggaaatgttt

SEQ ID NO: 386449 - DNA, 25 bp, Mus musculus
tgtgtctgtctgggagatgctattt

SEQ ID NO: 386450 - DNA, 25 bp, Mus musculus
tgtgtcttcagcctcagctttatga

SEQ ID NO: 386451 - DNA, 25 bp, Mus musculus
tgtgtcttcagtaaatgaagcattt

SEQ ID NO: 386452 - DNA, 25 bp, Mus musculus
tgtgtcttcattaggtgctgacctc

SEQ ID NO: 386453 - DNA, 25 bp, Mus musculus
tgtgtgaaaaccttgtcactagatg

SEQ ID NO: 386454 - DNA, 25 bp, Mus musculus
tgtgtgaaagatcagtttggcttta

SEQ ID NO: 386455 - DNA, 25 bp, Mus musculus
tgtgtgaaggatggcgaaacctgac

SEQ ID NO: 386456 - DNA, 25 bp, Mus musculus
tgtgtgaagtacctggttaactttg

SEQ ID NO: 386457 - DNA, 25 bp, Mus musculus
tgtgtgacaccaacgacctgcagca

SEQ ID NO: 386458 - DNA, 25 bp, Mus musculus
tgtgtgacaccattcattgatgcag

SEQ ID NO: 386459 - DNA, 25 bp, Mus musculus
tgtgtgacagacaagatttgaaaga

SEQ ID NO: 386460 - DNA, 25 bp, Mus musculus
tgtgtgacctcaggggagctgctgc

SEQ ID NO: 386461 - DNA, 25 bp, Mus musculus
tgtgtgaccttggggaaagatggag

SEQ ID NO: 386462 - DNA, 25 bp, Mus musculus
tgtgtgaccttggttcttccatcag

SEQ ID NO: 386463 - DNA, 25 bp, Mus musculus
tgtgtgacgaaaggtctgtcaccta

SEQ ID NO: 386464 - DNA, 25 bp, Mus musculus
tgtgtgacttagcccaggagttaaa

SEQ ID NO: 386465 - DNA, 25 bp, Mus musculus
tgtgtgacttagctcaaagattaga

SEQ ID NO: 386466 - DNA, 25 bp, Mus musculus
tgtgtgacttaggtaggtgagcctg

SEQ ID NO: 386467 - DNA, 25 bp, Mus musculus
tgtgtgagagaaaccttataagtgt

SEQ ID NO: 386468 - DNA, 25 bp, Mus musculus
tgtgtgagagtgtggctatcttgct

SEQ ID NO: 386469 - DNA, 25 bp, Mus musculus
tgtgtgagagttgacggcgtccaac

SEQ ID NO: 386470 - DNA, 25 bp, Mus musculus
tgtgtgagagttgagtcctacctgc

SEQ ID NO: 386471 - DNA, 25 bp, Mus musculus
tgtgtgagcaaagaagatagaggag

SEQ ID NO: 386472 - DNA, 25 bp, Mus musculus
tgtgtgagcaacttggcatcagcat

SEQ ID NO: 386473 - DNA, 25 bp, Mus musculus
tgtgtgagccagagaagccatcctg

SEQ ID NO: 386474 - DNA, 25 bp, Mus musculus
tgtgtgagccaggtacattctttgt

SEQ ID NO: 386475 - DNA, 25 bp, Mus musculus
tgtgtgataaagttggagtcattcg

SEQ ID NO: 386476 - DNA, 25 bp, Mus musculus
tgtgtgatcaggagttcctctgtga

SEQ ID NO: 386477 - DNA, 25 bp, Mus musculus
tgtgtgatcatcagccacttccacc

SEQ ID NO: 386478 - DNA, 25 bp, Mus musculus
tgtgtgatcatcaggccatctgccc

SEQ ID NO: 386479 - DNA, 25 bp, Mus musculus
tgtgtgatgcgggtgcctggctacg

SEQ ID NO: 386480 - DNA, 25 bp, Mus musculus
tgtgtgatggtcaggaagcctgctg

SEQ ID NO: 386481 - DNA, 25 bp, Mus musculus
tgtgtgattactggataagaaaact

SEQ ID NO: 386482 - DNA, 25 bp, Mus musculus
tgtgtgcaaagctgtgccaccgcat

SEQ ID NO: 386483 - DNA, 25 bp, Mus musculus
tgtgtgcaaatgacccaggatgtac

SEQ ID NO: 386484 - DNA, 25 bp, Mus musculus
tgtgtgcactggagatggcagtgct

SEQ ID NO: 386485 - DNA, 25 bp, Mus musculus
tgtgtgcagaaagagctcagggact

SEQ ID NO: 386486 - DNA, 25 bp, Mus musculus
tgtgtgcagaaggagctcaggggct

SEQ ID NO: 386487 - DNA, 25 bp, Mus musculus
tgtgtgcagcggggagagttagatt

SEQ ID NO: 386488 - DNA, 25 bp, Mus musculus
tgtgtgcatagagtgttattgtaac

SEQ ID NO: 386489 - DNA, 25 bp, Mus musculus
tgtgtgcatagctaatgtctgcgac

SEQ ID NO: 386490 - DNA, 25 bp, Mus musculus
tgtgtgcatgaaaggcctgacaaga

SEQ ID NO: 386491 - DNA, 25 bp, Mus musculus
tgtgtgccaagatattgatgagtgc

SEQ ID NO: 386492 - DNA, 25 bp, Mus musculus
tgtgtgccaaggcgaaagcccatgg

SEQ ID NO: 386493 - DNA, 25 bp, Mus musculus
tgtgtgccaaggtttgacctgccac

SEQ ID NO: 386494 - DNA, 25 bp, Mus musculus
tgtgtgccaagtctatatttgaact

SEQ ID NO: 386495 - DNA, 25 bp, Mus musculus
tgtgtgccaagttccatatctgcat

SEQ ID NO: 386496 - DNA, 25 bp, Mus musculus
tgtgtgcccgtggtatcgatgttga

SEQ ID NO: 386497 - DNA, 25 bp, Mus musculus
tgtgtgcctgtaatgaatggtatgg

SEQ ID NO: 386498 - DNA, 25 bp, Mus musculus
tgtgtgcgtgtattctagtcaagaa

SEQ ID NO: 386499 - DNA, 25 bp, Mus musculus
tgtgtgcgtgttaaaagagccaaat

SEQ ID NO: 386500 - DNA, 25 bp, Mus musculus
tgtgtgctcgaaaattggagtttgc

SEQ ID NO: 386501 - DNA, 25 bp, Mus musculus
tgtgtgctgactgcctgtttctgga

SEQ ID NO: 386502 - DNA, 25 bp, Mus musculus
tgtgtgctgctcaaagaggtcctcc

SEQ ID NO: 386503 - DNA, 25 bp, Mus musculus
tgtgtgctgttggaggaactgtact

SEQ ID NO: 386504 - DNA, 25 bp, Mus musculus
tgtgtgcttgccagataaagtgcag

SEQ ID NO: 386505 - DNA, 25 bp, Mus musculus
tgtgtgcttggagagactgggcagt

SEQ ID NO: 386506 - DNA, 25 bp, Mus musculus
tgtgtggaagaacccctcagcagcc

SEQ ID NO: 386507 - DNA, 25 bp, Mus musculus
tgtgtggaagactatctgtctgcaa

SEQ ID NO: 386508 - DNA, 25 bp, Mus musculus
tgtgtggacatcaggatgtgatggt

SEQ ID NO: 386509 - DNA, 25 bp, Mus musculus
tgtgtggaccctgagttccaccagg

SEQ ID NO: 386510 - DNA, 25 bp, Mus musculus
tgtgtggacgagagagactcgggaa

SEQ ID NO: 386511 - DNA, 25 bp, Mus musculus
tgtgtggacgctcgaattatcaaga

SEQ ID NO: 386512 - DNA, 25 bp, Mus musculus
tgtgtggatatctatgatagagaat

SEQ ID NO: 386513 - DNA, 25 bp, Mus musculus
tgtgtggatatgtttctgaacaaag

SEQ ID NO: 386514 - DNA, 25 bp, Mus musculus
tgtgtggatattgtgattcgtcata

SEQ ID NO: 386515 - DNA, 25 bp, Mus musculus
tgtgtggcagcgtgtcaacccaaag

SEQ ID NO: 386516 - DNA, 25 bp, Mus musculus
tgtgtggcagcgtgtttcccacgac

SEQ ID NO: 386517 - DNA, 25 bp, Mus musculus
tgtgtggcaggggagccttctctgt

SEQ ID NO: 386518 - DNA, 25 bp, Mus musculus
tgtgtggccaaagccaaacttgcca

SEQ ID NO: 386519 - DNA, 25 bp, Mus musculus
tgtgtggccaaagggacagtactta

SEQ ID NO: 386520 - DNA, 25 bp, Mus musculus
tgtgtggcctggtggatgactacag

SEQ ID NO: 386521 - DNA, 25 bp, Mus musculus
tgtgtggcgtcggggtgacatggac

SEQ ID NO: 386522 - DNA, 25 bp, Mus musculus
tgtgtgggaacagctggaaggtagg

SEQ ID NO: 386523 - DNA, 25 bp, Mus musculus
tgtgtgggagacggccccgactctg

SEQ ID NO: 386524 - DNA, 25 bp, Mus musculus
tgtgtgggagagaggcaccatgaca

SEQ ID NO: 386525 - DNA, 25 bp, Mus musculus
tgtgtggttcatttttataagtttg

SEQ ID NO: 386526 - DNA, 25 bp, Mus musculus
tgtgtgtaagcactggggaaagcct

SEQ ID NO: 386527 - DNA, 25 bp, Mus musculus
tgtgtgtataaagtacaacctgaga

SEQ ID NO: 386528 - DNA, 25 bp, Mus musculus
tgtgtgtataagactgtcatcagga

SEQ ID NO: 386529 - DNA, 25 bp, Mus musculus
tgtgtgtcacacagatccagctgag

SEQ ID NO: 386530 - DNA, 25 bp, Mus musculus
tgtgtgtcacacagatttttggaga

SEQ ID NO: 386531 - DNA, 25 bp, Mus musculus
tgtgtgtcgcacgagagctgcctgt

SEQ ID NO: 386532 - DNA, 25 bp, Mus musculus
tgtgtgtcgcacgaggtggactcac

SEQ ID NO: 386533 - DNA, 25 bp, Mus musculus
tgtgtgtcggagaggctggtccagg

SEQ ID NO: 386534 - DNA, 25 bp, Mus musculus
tgtgtgtcggagcctccgaagtagc

SEQ ID NO: 386535 - DNA, 25 bp, Mus musculus
tgtgtgtcgtgctggtctgtgcgcg

SEQ ID NO: 386536 - DNA, 25 bp, Mus musculus
tgtgtgtctgcctcgtgcctcaatg

SEQ ID NO: 386537 - DNA, 25 bp, Mus musculus
tgtgtgtctggcgtgtgtgtgcaga

SEQ ID NO: 386538 - DNA, 25 bp, Mus musculus
tgtgtgtctggcttatggtagcatc

SEQ ID NO: 386539 - DNA, 25 bp, Mus musculus
tgtgtgtctgggagaagatgaccag

SEQ ID NO: 386540 - DNA, 25 bp, Mus musculus
tgtgtgtctgtctggctggaaatgt

SEQ ID NO: 386541 - DNA, 25 bp, Mus musculus
tgtgtgtctgtctgggagatgctat

SEQ ID NO: 386542 - DNA, 25 bp, Mus musculus
tgtgtgtcttcagcctcagctttat

SEQ ID NO: 386543 - DNA, 25 bp, Mus musculus
tgtgtgtgacgaaaggtctgtcacc

SEQ ID NO: 386544 - DNA, 25 bp, Mus musculus
tgtgtgtgaggaggttccccctgga

SEQ ID NO: 386545 - DNA, 25 bp, Mus musculus
tgtgtgtgcaacgatactgtatccg

SEQ ID NO: 386546 - DNA, 25 bp, Mus musculus
tgtgtgtgcagggaaatctgctcca

SEQ ID NO: 386547 - DNA, 25 bp, Mus musculus
tgtgtgtgccaagtctatatttgaa

SEQ ID NO: 386548 - DNA, 25 bp, Mus musculus
tgtgtgtgccaagttccatatctgc

SEQ ID NO: 386549 - DNA, 25 bp, Mus musculus
tgtgtgtgtggggagatggtggccc

SEQ ID NO: 386550 - DNA, 25 bp, Mus musculus
tgtgtgtgtgtggggagatggtggc

SEQ ID NO: 386551 - DNA, 25 bp, Mus musculus
tgtgtgtgtgtgtggggagatggtg

SEQ ID NO: 386552 - DNA, 25 bp, Mus musculus
tgtgtgttattggactctgggcttg

SEQ ID NO: 386553 - DNA, 25 bp, Mus musculus
tgtgtgttcatcacgctcctgccca

SEQ ID NO: 386554 - DNA, 25 bp, Mus musculus
tgtgtgttctctgtttgacacgttt

SEQ ID NO: 386555 - DNA, 25 bp, Mus musculus
tgtgtgttctgtagattcgagtaag

SEQ ID NO: 386556 - DNA, 25 bp, Mus musculus
tgtgtgtttggagaacccagattcc

SEQ ID NO: 386557 - DNA, 25 bp, Mus musculus
tgtgttaatgatgttgcttttctct

SEQ ID NO: 386558 - DNA, 25 bp, Mus musculus
tgtgttacaagctaatggcactgac

SEQ ID NO: 386559 - DNA, 25 bp, Mus musculus
tgtgttacaagggactgagtggggt

SEQ ID NO: 386560 - DNA, 25 bp, Mus musculus
tgtgttacagctgccctatccccac

SEQ ID NO: 386561 - DNA, 25 bp, Mus musculus
tgtgttactgaggcaacgtttcata

SEQ ID NO: 386562 - DNA, 25 bp, Mus musculus
tgtgttactgagggactttgtaaac

SEQ ID NO: 386563 - DNA, 25 bp, Mus musculus
tgtgttatcaaccgaacacagaaga

SEQ ID NO: 386564 - DNA, 25 bp, Mus musculus
tgtgttatgagtttgtgatgtctgg

SEQ ID NO: 386565 - DNA, 25 bp, Mus musculus
tgtgttatgcacaatcagagtcctc

SEQ ID NO: 386566 - DNA, 25 bp, Mus musculus
tgtgttattgagctgggaggcacca

SEQ ID NO: 386567 - DNA, 25 bp, Mus musculus
tgtgttattggactctgggcttgta

SEQ ID NO: 386568 - DNA, 25 bp, Mus musculus
tgtgttcaagaacaaggttggccat

SEQ ID NO: 386569 - DNA, 25 bp, Mus musculus
tgtgttcagcccgcatgccctacac

SEQ ID NO: 386570 - DNA, 25 bp, Mus musculus
tgtgttcatcaaactttcatggatc

SEQ ID NO: 386571 - DNA, 25 bp, Mus musculus
tgtgttcatcacgctcctgcccaat

SEQ ID NO: 386572 - DNA, 25 bp, Mus musculus
tgtgttcatcgtcgctgcaaaatac

SEQ ID NO: 386573 - DNA, 25 bp, Mus musculus
tgtgttccagaatggggaggtagag

SEQ ID NO: 386574 - DNA, 25 bp, Mus musculus
tgtgttccagggagatgctatttcc

SEQ ID NO: 386575 - DNA, 25 bp, Mus musculus
tgtgttcctgccagactgggtttgt

SEQ ID NO: 386576 - DNA, 25 bp, Mus musculus
tgtgttcctgggtcttgctgtctct

SEQ ID NO: 386577 - DNA, 25 bp, Mus musculus
tgtgttccttctgcttctaccaggc

SEQ ID NO: 386578 - DNA, 25 bp, Mus musculus
tgtgttcggcaggttcgcagaccag

SEQ ID NO: 386579 - DNA, 25 bp, Mus musculus
tgtgttctagactcaagaatgaata

SEQ ID NO: 386580 - DNA, 25 bp, Mus musculus
tgtgttctctgtttgacacgtttag

SEQ ID NO: 386581 - DNA, 25 bp, Mus musculus
tgtgttctgagctggcttgctgccc

SEQ ID NO: 386582 - DNA, 25 bp, Mus musculus
tgtgttctggcagggacgaaactta

SEQ ID NO: 386583 - DNA, 25 bp, Mus musculus
tgtgttctgtagattcgagtaagag

SEQ ID NO: 386584 - DNA, 25 bp, Mus musculus
tgtgttctttcagagtgcttctact

SEQ ID NO: 386585 - DNA, 25 bp, Mus musculus
tgtgttgaaggtgcaggaccagaca

SEQ ID NO: 386586 - DNA, 25 bp, Mus musculus
tgtgttgaggagcccaccgcaacga

SEQ ID NO: 386587 - DNA, 25 bp, Mus musculus
tgtgttgccagaaaaagatcttcca

SEQ ID NO: 386588 - DNA, 25 bp, Mus musculus
tgtgttgccgatgagtctgcaatcc

SEQ ID NO: 386589 - DNA, 25 bp, Mus musculus
tgtgttggagcaggcggacagagaa

SEQ ID NO: 386590 - DNA, 25 bp, Mus musculus
tgtgttggcaagagagatgaagatg

SEQ ID NO: 386591 - DNA, 25 bp, Mus musculus
tgtgttggcaagaggccacagcact

SEQ ID NO: 386592 - DNA, 25 bp, Mus musculus
tgtgttggcctttgagtagagtatc

SEQ ID NO: 386593 - DNA, 25 bp, Mus musculus
tgtgttggctcaggagggtgtgaag

SEQ ID NO: 386594 - DNA, 25 bp, Mus musculus
tgtgttgggctaaagaatatgacag

SEQ ID NO: 386595 - DNA, 25 bp, Mus musculus
tgtgttgtgaaagtggaacccagtg

SEQ ID NO: 386596 - DNA, 25 bp, Mus musculus
tgtgttgtgaaagtgttacaggttt

SEQ ID NO: 386597 - DNA, 25 bp, Mus musculus
tgtgtttaaggaatcaaaagtcagg

SEQ ID NO: 386598 - DNA, 25 bp, Mus musculus
tgtgtttactcactttcaaaactta

SEQ ID NO: 386599 - DNA, 25 bp, Mus musculus
tgtgtttactcactttgaaaaagag

SEQ ID NO: 386600 - DNA, 25 bp, Mus musculus
tgtgtttatggactacaaagaaggc

SEQ ID NO: 386601 - DNA, 25 bp, Mus musculus
tgtgtttattcaggtgcactgcatc

SEQ ID NO: 386602 - DNA, 25 bp, Mus musculus
tgtgtttccctacatccagaaccca

SEQ ID NO: 386603 - DNA, 25 bp, Mus musculus
tgtgtttgagaggaaacttcgagtc

SEQ ID NO: 386604 - DNA, 25 bp, Mus musculus
tgtgtttgaggaattattttatata

SEQ ID NO: 386605 - DNA, 25 bp, Mus musculus
tgtgtttgaggagatttctaatagc

SEQ ID NO: 386606 - DNA, 25 bp, Mus musculus
tgtgtttgaggaggtagggtctgac

SEQ ID NO: 386607 - DNA, 25 bp, Mus musculus
tgtgtttgaggaggtgtacaggaat

SEQ ID NO: 386608 - DNA, 25 bp, Mus musculus
tgtgtttgctagagggcaatgcgag

SEQ ID NO: 386609 - DNA, 25 bp, Mus musculus
tgtgtttggagaacccagattccaa

SEQ ID NO: 386610 - DNA, 25 bp, Mus musculus
tgtgtttgtagacccatccctgacg

SEQ ID NO: 386611 - DNA, 25 bp, Mus musculus
tgtgtttgtggtcctccactctttt

SEQ ID NO: 386612 - DNA, 25 bp, Mus musculus
tgtgtttgtggtctttgctgattct

SEQ ID NO: 386613 - DNA, 25 bp, Mus musculus
tgtgttttatccttacaatgacact

SEQ ID NO: 386614 - DNA, 25 bp, Mus musculus
tgtgttttattggatcgtggagttg

SEQ ID NO: 386615 - DNA, 25 bp, Mus musculus
tgtgttttcagatgtccctggtaga

SEQ ID NO: 386616 - DNA, 25 bp, Mus musculus
tgtgttttcagtggataatgaaaca

SEQ ID NO: 386617 - DNA, 25 bp, Mus musculus
tgtgttttgtgaagagtacccagta

SEQ ID NO: 386618 - DNA, 25 bp, Mus musculus
tgtgttttgtgaagcctggatggtg

SEQ ID NO: 386619 - DNA, 25 bp, Mus musculus
tgttaaaaagacatgtttttcagta

SEQ ID NO: 386620 - DNA, 25 bp, Mus musculus
tgttaaaaagtttatgatcacaggt

SEQ ID NO: 386621 - DNA, 25 bp, Mus musculus
tgttaaaaatattagcatcaaaaat

SEQ ID NO: 386622 - DNA, 25 bp, Mus musculus
tgttaaaagttcaaggagtctcatg

SEQ ID NO: 386623 - DNA, 25 bp, Mus musculus
tgttaaaatatcagaaatcatgagg

SEQ ID NO: 386624 - DNA, 25 bp, Mus musculus
tgttaaaatatcagaggctaaagaa

SEQ ID NO: 386625 - DNA, 25 bp, Mus musculus
tgttaaaatcaagatctctgctcct

SEQ ID NO: 386626 - DNA, 25 bp, Mus musculus
tgttaaaatcacagactcaccacct

SEQ ID NO: 386627 - DNA, 25 bp, Mus musculus
tgttaacaagcaagaaagaagacat

SEQ ID NO: 386628 - DNA, 25 bp, Mus musculus
tgttaacaagcaagatccgctgatc

SEQ ID NO: 386629 - DNA, 25 bp, Mus musculus
tgttaacaataaggacctccagtca

SEQ ID NO: 386630 - DNA, 25 bp, Mus musculus
tgttaacagcacagattctaccagt

SEQ ID NO: 386631 - DNA, 25 bp, Mus musculus
tgttaacaggccatggatgcccggg

SEQ ID NO: 386632 - DNA, 25 bp, Mus musculus
tgttaacatgaaggttcttccagca

SEQ ID NO: 386633 - DNA, 25 bp, Mus musculus
tgttaacatgagctttctgctcaac

SEQ ID NO: 386634 - DNA, 25 bp, Mus musculus
tgttaacatgaggtctatccaggaa

SEQ ID NO: 386635 - DNA, 25 bp, Mus musculus
tgttaacatgattgttcgttttgag

SEQ ID NO: 386636 - DNA, 25 bp, Mus musculus
tgttaagaaagaaacgctgcatcca

SEQ ID NO: 386637 - DNA, 25 bp, Mus musculus
tgttaagaaagattaaagatgaacc

SEQ ID NO: 386638 - DNA, 25 bp, Mus musculus
tgttaagaaaggacaaagatgttgc

SEQ ID NO: 386639 - DNA, 25 bp, Mus musculus
tgttaagacaatcagggcaagaaaa

SEQ ID NO: 386640 - DNA, 25 bp, Mus musculus
tgttaaggtctggctcagtttatga

SEQ ID NO: 386641 - DNA, 25 bp, Mus musculus
tgttaatacaaaagaagttatttta

SEQ ID NO: 386642 - DNA, 25 bp, Mus musculus
tgttaatccacaacagtgagaggac

SEQ ID NO: 386643 - DNA, 25 bp, Mus musculus
tgttaatgagaagggagccttctgg

SEQ ID NO: 386644 - DNA, 25 bp, Mus musculus
tgttaatgatgttgcttttctctta

SEQ ID NO: 386645 - DNA, 25 bp, Mus musculus
tgttaatggagcaaggtgtccatgt

SEQ ID NO: 386646 - DNA, 25 bp, Mus musculus
tgttaatgtccaagccatgtacata

SEQ ID NO: 386647 - DNA, 25 bp, Mus musculus
tgttaattaccaacgattgaaaaat

SEQ ID NO: 386648 - DNA, 25 bp, Mus musculus
tgttaattcaggctcctcatcctaa

SEQ ID NO: 386649 - DNA, 25 bp, Mus musculus
tgttaattcaggctgctcatcctaa

SEQ ID NO: 386650 - DNA, 25 bp, Mus musculus
tgttacaaactaaaggctatggtca

SEQ ID NO: 386651 - DNA, 25 bp, Mus musculus
tgttacaagagggaagcctgtcatg

SEQ ID NO: 386652 - DNA, 25 bp, Mus musculus
tgttacaagtgtgaggactgtggga

SEQ ID NO: 386653 - DNA, 25 bp, Mus musculus
tgttacacagcccagggaatattgg

SEQ ID NO: 386654 - DNA, 25 bp, Mus musculus
tgttacacaggttacaaccctggta

SEQ ID NO: 386655 - DNA, 25 bp, Mus musculus
tgttacactgacagacagatggggc

SEQ ID NO: 386656 - DNA, 25 bp, Mus musculus
tgttacagcaaggtggctcaggagt

SEQ ID NO: 386657 - DNA, 25 bp, Mus musculus
tgttacagtcagaagccggagcctg

SEQ ID NO: 386658 - DNA, 25 bp, Mus musculus
tgttaccaaagtgtgcaactgcgta

SEQ ID NO: 386659 - DNA, 25 bp, Mus musculus
tgttaccagtgtaagattaatgtgg

SEQ ID NO: 386660 - DNA, 25 bp, Mus musculus
tgttaccggaacagaaatcatcgtg

SEQ ID NO: 386661 - DNA, 25 bp, Mus musculus
tgttaccggaacggcacgacgcgac

SEQ ID NO: 386662 - DNA, 25 bp, Mus musculus
tgttacctccttggatttccataag

SEQ ID NO: 386663 - DNA, 25 bp, Mus musculus
tgttacctccttgggcatccccaaa

SEQ ID NO: 386664 - DNA, 25 bp, Mus musculus
tgttacctcgccgagctggaattcg

SEQ ID NO: 386665 - DNA, 25 bp, Mus musculus
tgttacctcttatgccctgctgtga

SEQ ID NO: 386666 - DNA, 25 bp, Mus musculus
tgttacctcttctggctcatcgcca

SEQ ID NO: 386667 - DNA, 25 bp, Mus musculus
tgttaccttgctgtatcgacatgga

SEQ ID NO: 386668 - DNA, 25 bp, Mus musculus
tgttaccttgttgtctctgcttcct

SEQ ID NO: 386669 - DNA, 25 bp, Mus musculus
tgttacgcttgtacttcatcctgct

SEQ ID NO: 386670 - DNA, 25 bp, Mus musculus
tgttacggaggacccgagtcagaac

SEQ ID NO: 386671 - DNA, 25 bp, Mus musculus
tgttactaacagcaagttcaatgtc

SEQ ID NO: 386672 - DNA, 25 bp, Mus musculus
tgttactaacattagaaatccacag

SEQ ID NO: 386673 - DNA, 25 bp, Mus musculus
tgttactatcaaagtattctgcaga

SEQ ID NO: 386674 - DNA, 25 bp, Mus musculus
tgttactatgtttacggcagtgctt

SEQ ID NO: 386675 - DNA, 25 bp, Mus musculus
tgttactatgtttagggcagtgctt

SEQ ID NO: 386676 - DNA, 25 bp, Mus musculus
tgttactcaggtaccagcgctgaag

SEQ ID NO: 386677 - DNA, 25 bp, Mus musculus
tgttactgaggaacttcctgatgtc

SEQ ID NO: 386678 - DNA, 25 bp, Mus musculus
tgttactgaggcaacgtttcatact

SEQ ID NO: 386679 - DNA, 25 bp, Mus musculus
tgttactgagggactttgtaaacag

SEQ ID NO: 386680 - DNA, 25 bp, Mus musculus
tgttactttgtaaagcaatccgaag

SEQ ID NO: 386681 - DNA, 25 bp, Mus musculus
tgttagaaacaaatgggatggaaga

SEQ ID NO: 386682 - DNA, 25 bp, Mus musculus
tgttagaaacaaatggtgaagaaga

SEQ ID NO: 386683 - DNA, 25 bp, Mus musculus
tgttagaagtccctccgctccaagg

SEQ ID NO: 386684 - DNA, 25 bp, Mus musculus
tgttagaatgtgagcggacggacaa

SEQ ID NO: 386685 - DNA, 25 bp, Mus musculus
tgttagacagaatggcaatcccaat

SEQ ID NO: 386686 - DNA, 25 bp, Mus musculus
tgttagacattggatgccgccttgg

SEQ ID NO: 386687 - DNA, 25 bp, Mus musculus
tgttagacattggctgcggttctgg

SEQ ID NO: 386688 - DNA, 25 bp, Mus musculus
tgttagacctgtcttgtaaccctga

SEQ ID NO: 386689 - DNA, 25 bp, Mus musculus
tgttagagaacagggaccgtgtggg

SEQ ID NO: 386690 - DNA, 25 bp, Mus musculus
tgttagagagaatggactgctgtcc

SEQ ID NO: 386691 - DNA, 25 bp, Mus musculus
tgttagaggagatttaccttcaaga

SEQ ID NO: 386692 - DNA, 25 bp, Mus musculus
tgttagatatcgaaggatgttttat

SEQ ID NO: 386693 - DNA, 25 bp, Mus musculus
tgttagatcaggctgctttctccca

SEQ ID NO: 386694 - DNA, 25 bp, Mus musculus
tgttagatcaggggggctttgcccc

SEQ ID NO: 386695 - DNA, 25 bp, Mus musculus
tgttagcgttaccctgggaatctga

SEQ ID NO: 386696 - DNA, 25 bp, Mus musculus
tgttagctatttatgaagccaaagc

SEQ ID NO: 386697 - DNA, 25 bp, Mus musculus
tgttagctatttatggttacacctt

SEQ ID NO: 386698 - DNA, 25 bp, Mus musculus
tgttagctgaggtgccgacaatggc

SEQ ID NO: 386699 - DNA, 25 bp, Mus musculus
tgttaggaaacagctatataaaaga

SEQ ID NO: 386700 - DNA, 25 bp, Mus musculus
tgttaggaaacagggtggactctcc

SEQ ID NO: 386701 - DNA, 25 bp, Mus musculus
tgttaggcaccgtgggcctaaccaa

SEQ ID NO: 386702 - DNA, 25 bp, Mus musculus
tgttagggaaataattgttgcttgt

SEQ ID NO: 386703 - DNA, 25 bp, Mus musculus
tgttagtaagaatcccagtaaacct

SEQ ID NO: 386704 - DNA, 25 bp, Mus musculus
tgttagtaagcacagtacagaagcg

SEQ ID NO: 386705 - DNA, 25 bp, Mus musculus
tgttagtctcagaggatagctctct

SEQ ID NO: 386706 - DNA, 25 bp, Mus musculus
tgttagtgaccagatggttcagaac

SEQ ID NO: 386707 - DNA, 25 bp, Mus musculus
tgttagtgaccagtaaaaggtactt

SEQ ID NO: 386708 - DNA, 25 bp, Mus musculus
tgttagtgacctgacgttgatgtca

SEQ ID NO: 386709 - DNA, 25 bp, Mus musculus
tgttagtgacctgactcctgggtgc

SEQ ID NO: 386710 - DNA, 25 bp, Mus musculus
tgttagtgagctgctggaagctctg

SEQ ID NO: 386711 - DNA, 25 bp, Mus musculus
tgttagtgtcaatccctgatactgt

SEQ ID NO: 386712 - DNA, 25 bp, Mus musculus
tgttatacctccggcttatacaact

SEQ ID NO: 386713 - DNA, 25 bp, Mus musculus
tgttatagccagagaatgtattctt

SEQ ID NO: 386714 - DNA, 25 bp, Mus musculus
tgttatagccagataactggggtga

SEQ ID NO: 386715 - DNA, 25 bp, Mus musculus
tgttatcaaccgaacacagaagaat

SEQ ID NO: 386716 - DNA, 25 bp, Mus musculus
tgttatcaagaaaaagaataaaccc

SEQ ID NO: 386717 - DNA, 25 bp, Mus musculus
tgttatcagaagccccaacttgaat

SEQ ID NO: 386718 - DNA, 25 bp, Mus musculus
tgttatcagaaggcccaacttgaat

SEQ ID NO: 386719 - DNA, 25 bp, Mus musculus
tgttatccagatggtttcaaggctg

SEQ ID NO: 386720 - DNA, 25 bp, Mus musculus
tgttatccaggccctggacctcagt

SEQ ID NO: 386721 - DNA, 25 bp, Mus musculus
tgttatccaggctccctgtccattg

SEQ ID NO: 386722 - DNA, 25 bp, Mus musculus
tgttatcgctgcaggaacgtttgga

SEQ ID NO: 386723 - DNA, 25 bp, Mus musculus
tgttatctcactatcctttgtgaga

SEQ ID NO: 386724 - DNA, 25 bp, Mus musculus
tgttatctccagaagtgacagacag

SEQ ID NO: 386725 - DNA, 25 bp, Mus musculus
tgttatctgaagaaagaatctgtgg

SEQ ID NO: 386726 - DNA, 25 bp, Mus musculus
tgttatctgaaggttttctctgtat

SEQ ID NO: 386727 - DNA, 25 bp, Mus musculus
tgttatgacaagcccgtctcgatac

SEQ ID NO: 386728 - DNA, 25 bp, Mus musculus
tgttatgcacaatcagagtcctcat

SEQ ID NO: 386729 - DNA, 25 bp, Mus musculus
tgttatgccagtcaggatttgcaca

SEQ ID NO: 386730 - DNA, 25 bp, Mus musculus
tgttatggagggagtgaagccagcc

SEQ ID NO: 386731 - DNA, 25 bp, Mus musculus
tgttatgtcagtatatgactgctgc

SEQ ID NO: 386732 - DNA, 25 bp, Mus musculus
tgttattcagaggaccagagttcaa

SEQ ID NO: 386733 - DNA, 25 bp, Mus musculus
tgttattcagctaccactacccctg

SEQ ID NO: 386734 - DNA, 25 bp, Mus musculus
tgttattcaggctttcaccactgag

SEQ ID NO: 386735 - DNA, 25 bp, Mus musculus
tgttattccagcccaggaggaagaa

SEQ ID NO: 386736 - DNA, 25 bp, Mus musculus
tgttattctggtatgggacgtttca

SEQ ID NO: 386737 - DNA, 25 bp, Mus musculus
tgttattgaaaggtgacattcccac

SEQ ID NO: 386738 - DNA, 25 bp, Mus musculus
tgttattgaaggacctctcttgcct

SEQ ID NO: 386739 - DNA, 25 bp, Mus musculus
tgttattgagctgggaggcaccatt

SEQ ID NO: 386740 - DNA, 25 bp, Mus musculus
tgttattgatgctgtaagaactaaa

SEQ ID NO: 386741 - DNA, 25 bp, Mus musculus
tgttattgctactgggggctacggg

SEQ ID NO: 386742 - DNA, 25 bp, Mus musculus
tgttattgtagacaggtactggcat

SEQ ID NO: 386743 - DNA, 25 bp, Mus musculus
tgttattgtcagcaagcttcaggag

SEQ ID NO: 386744 - DNA, 25 bp, Mus musculus
tgttcaaaaggaggccacctatgaa

SEQ ID NO: 386745 - DNA, 25 bp, Mus musculus
tgttcaaaaggagtatgaaggctta

SEQ ID NO: 386746 - DNA, 25 bp, Mus musculus
tgttcaaaaggagtttgttgaagga

SEQ ID NO: 386747 - DNA, 25 bp, Mus musculus
tgttcaaaatcgaacaccaaacagc

SEQ ID NO: 386748 - DNA, 25 bp, Mus musculus
tgttcaaacatgcccagttgcagaa

SEQ ID NO: 386749 - DNA, 25 bp, Mus musculus
tgttcaaagggctgaacgacaaagt

SEQ ID NO: 386750 - DNA, 25 bp, Mus musculus
tgttcaacagaacaagtaagaagtt

SEQ ID NO: 386751 - DNA, 25 bp, Mus musculus
tgttcaacagcactgttgccaaggg

SEQ ID NO: 386752 - DNA, 25 bp, Mus musculus
tgttcaacagggaccaaatgacgtc

SEQ ID NO: 386753 - DNA, 25 bp, Mus musculus
tgttcaacaggtttatggtcggctg

SEQ ID NO: 386754 - DNA, 25 bp, Mus musculus
tgttcaacagtgcacagtgtgttcg

SEQ ID NO: 386755 - DNA, 25 bp, Mus musculus
tgttcaacagttgttggtcttgacg

SEQ ID NO: 386756 - DNA, 25 bp, Mus musculus
tgttcaacatcgtagagggagattc

SEQ ID NO: 386757 - DNA, 25 bp, Mus musculus
tgttcaaccctgactctaaggggct

SEQ ID NO: 386758 - DNA, 25 bp, Mus musculus
tgttcaagaaatccttttatcttgc

SEQ ID NO: 386759 - DNA, 25 bp, Mus musculus
tgttcaagaaatctgatagacgcaa

SEQ ID NO: 386760 - DNA, 25 bp, Mus musculus
tgttcaagaaatttgatgaaaaaga

SEQ ID NO: 386761 - DNA, 25 bp, Mus musculus
tgttcaagaaccatgaacacataga

SEQ ID NO: 386762 - DNA, 25 bp, Mus musculus
tgttcaagaagcgaccttcctatga

SEQ ID NO: 386763 - DNA, 25 bp, Mus musculus
tgttcaagcaagaaggcacttgcta

SEQ ID NO: 386764 - DNA, 25 bp, Mus musculus
tgttcaaggagaagaagaaaaagtc

SEQ ID NO: 386765 - DNA, 25 bp, Mus musculus
tgttcaattcccggacggcctatgc

SEQ ID NO: 386766 - DNA, 25 bp, Mus musculus
tgttcacaagagcgttataacctgg

SEQ ID NO: 386767 - DNA, 25 bp, Mus musculus
tgttcacacctaagatggaacagct

SEQ ID NO: 386768 - DNA, 25 bp, Mus musculus
tgttcacacctaagattgagcagct

SEQ ID NO: 386769 - DNA, 25 bp, Mus musculus
tgttcacatcaacaggaacgtcatc

SEQ ID NO: 386770 - DNA, 25 bp, Mus musculus
tgttcacatcagcaggaacgtcatc

SEQ ID NO: 386771 - DNA, 25 bp, Mus musculus
tgttcacatcagcagtgcctgcaga

SEQ ID NO: 386772 - DNA, 25 bp, Mus musculus
tgttcaccagaaaccaggtggcctt

SEQ ID NO: 386773 - DNA, 25 bp, Mus musculus
tgttcaccagacagaacttctgtgg

SEQ ID NO: 386774 - DNA, 25 bp, Mus musculus
tgttcaccagacagggcacgttctc

SEQ ID NO: 386775 - DNA, 25 bp, Mus musculus
tgttcaccaggagctggaatttgga

SEQ ID NO: 386776 - DNA, 25 bp, Mus musculus
tgttcactatgaagattcacagaca

SEQ ID NO: 386777 - DNA, 25 bp, Mus musculus
tgttcactcagaggcagccatggaa

SEQ ID NO: 386778 - DNA, 25 bp, Mus musculus
tgttcactgatgaggcatcaatact

SEQ ID NO: 386779 - DNA, 25 bp, Mus musculus
tgttcacttcaggtattgacctcat

SEQ ID NO: 386780 - DNA, 25 bp, Mus musculus
tgttcacttcaggtgtggacctcgt

SEQ ID NO: 386781 - DNA, 25 bp, Mus musculus
tgttcactttggaggaatgggaggg

SEQ ID NO: 386782 - DNA, 25 bp, Mus musculus
tgttcagaaagcgctcctgttatct

SEQ ID NO: 386783 - DNA, 25 bp, Mus musculus
tgttcagaaaggagctcttaccaaa

SEQ ID NO: 386784 - DNA, 25 bp, Mus musculus
tgttcagaacgatcatccagcccct

SEQ ID NO: 386785 - DNA, 25 bp, Mus musculus
tgttcagagactgggtgggtctttc

SEQ ID NO: 386786 - DNA, 25 bp, Mus musculus
tgttcagagatggtggagactgaga

SEQ ID NO: 386787 - DNA, 25 bp, Mus musculus
tgttcagatactgaatgaatctgag

SEQ ID NO: 386788 - DNA, 25 bp, Mus musculus
tgttcaggagatggtaaccaagtca

SEQ ID NO: 386789 - DNA, 25 bp, Mus musculus
tgttcaggtgttaggggatgctggc

SEQ ID NO: 386790 - DNA, 25 bp, Mus musculus
tgttcagtagacagtataacaaact

SEQ ID NO: 386791 - DNA, 25 bp, Mus musculus
tgttcagtcaaggacagtggcctta

SEQ ID NO: 386792 - DNA, 25 bp, Mus musculus
tgttcagtcgggctctaagcaatga

SEQ ID NO: 386793 - DNA, 25 bp, Mus musculus
tgttcagtcggtttccgtgagagtg

SEQ ID NO: 386794 - DNA, 25 bp, Mus musculus
tgttcagtctcaccggctggggaga

SEQ ID NO: 386795 - DNA, 25 bp, Mus musculus
tgttcagtgaccacgctgtgttgac

SEQ ID NO: 386796 - DNA, 25 bp, Mus musculus
tgttcagtgaccacggggtaaaggc

SEQ ID NO: 386797 - DNA, 25 bp, Mus musculus
tgttcagttggatgaaaattccaag

SEQ ID NO: 386798 - DNA, 25 bp, Mus musculus
tgttcataaacttgttcaagccata

SEQ ID NO: 386799 - DNA, 25 bp, Mus musculus
tgttcatcaaactttcatggatcgc

SEQ ID NO: 386800 - DNA, 25 bp, Mus musculus
tgttcatcacgctcctgcccaatga

SEQ ID NO: 386801 - DNA, 25 bp, Mus musculus
tgttcatcagcacagaccggggagc

SEQ ID NO: 386802 - DNA, 25 bp, Mus musculus
tgttcatcgagccgagatgaaacca

SEQ ID NO: 386803 - DNA, 25 bp, Mus musculus
tgttcatcgataccgtgatgcaatt

SEQ ID NO: 386804 - DNA, 25 bp, Mus musculus
tgttcatcgtcgctgcaaaatacaa

SEQ ID NO: 386805 - DNA, 25 bp, Mus musculus
tgttcatgggagaagggcaggttta

SEQ ID NO: 386806 - DNA, 25 bp, Mus musculus
tgttcatgggagaggggtaactatc

SEQ ID NO: 386807 - DNA, 25 bp, Mus musculus
tgttcattttactgtgtggagagcc

SEQ ID NO: 386808 - DNA, 25 bp, Mus musculus
tgttccaaccccgatgctctgaacc

SEQ ID NO: 386809 - DNA, 25 bp, Mus musculus
tgttccaccaggctgggccggtaat

SEQ ID NO: 386810 - DNA, 25 bp, Mus musculus
tgttccaccagtatttgaggcagag

SEQ ID NO: 386811 - DNA, 25 bp, Mus musculus
tgttccacgccccatggtgtggaca

SEQ ID NO: 386812 - DNA, 25 bp, Mus musculus
tgttccactcgctctttgccattgg

SEQ ID NO: 386813 - DNA, 25 bp, Mus musculus
tgttccactcggatcaagtttgtgg

SEQ ID NO: 386814 - DNA, 25 bp, Mus musculus
tgttccactgtagtcacagtaatga

SEQ ID NO: 386815 - DNA, 25 bp, Mus musculus
tgttccagaggaggtactacaagcc

SEQ ID NO: 386816 - DNA, 25 bp, Mus musculus
tgttccagcaaccagaatttcagct

SEQ ID NO: 386817 - DNA, 25 bp, Mus musculus
tgttccagtactttgtgacaggtgt

SEQ ID NO: 386818 - DNA, 25 bp, Mus musculus
tgttccagttgcagattgaacttca

SEQ ID NO: 386819 - DNA, 25 bp, Mus musculus
tgttccagttgcagcaggtactctg

SEQ ID NO: 386820 - DNA, 25 bp, Mus musculus
tgttccagttgcaggtacaacataa

SEQ ID NO: 386821 - DNA, 25 bp, Mus musculus
tgttccatacacaggctcatcagca

SEQ ID NO: 386822 - DNA, 25 bp, Mus musculus
tgttccattgagatctgtgccgctg

SEQ ID NO: 386823 - DNA, 25 bp, Mus musculus
tgttcccacagatgaagtgtcctat

SEQ ID NO: 386824 - DNA, 25 bp, Mus musculus
tgttcccacagatggaacagattct

SEQ ID NO: 386825 - DNA, 25 bp, Mus musculus
tgttcccaggcaaattccatcaagc

SEQ ID NO: 386826 - DNA, 25 bp, Mus musculus
tgttcccattccttcaaaaagagtg

SEQ ID NO: 386827 - DNA, 25 bp, Mus musculus
tgttccgagaccagacccctgagca

SEQ ID NO: 386828 - DNA, 25 bp, Mus musculus
tgttccgattcctaggggtgttatt

SEQ ID NO: 386829 - DNA, 25 bp, Mus musculus
tgttccgcaaggaggtgctggctca

SEQ ID NO: 386830 - DNA, 25 bp, Mus musculus
tgttccgcccaagttggtcacaatg

SEQ ID NO: 386831 - DNA, 25 bp, Mus musculus
tgttccgcgacgccggtgccttcgc

SEQ ID NO: 386832 - DNA, 25 bp, Mus musculus
tgttccggaggaatttgaagcctat

SEQ ID NO: 386833 - DNA, 25 bp, Mus musculus
tgttccggtttgcaggagagaggga

SEQ ID NO: 386834 - DNA, 25 bp, Mus musculus
tgttccgtgagggaaaagaagacca

SEQ ID NO: 386835 - DNA, 25 bp, Mus musculus
tgttccgttggcagaagccatcccg

SEQ ID NO: 386836 - DNA, 25 bp, Mus musculus
tgttcctaaacccagctggtgccag

SEQ ID NO: 386837 - DNA, 25 bp, Mus musculus
tgttcctaacactaatgagcgagtg

SEQ ID NO: 386838 - DNA, 25 bp, Mus musculus
tgttcctacggtttcacaaggtatt

SEQ ID NO: 386839 - DNA, 25 bp, Mus musculus
tgttcctactggagttaaagggaat

SEQ ID NO: 386840 - DNA, 25 bp, Mus musculus
tgttcctacttccagaacatttaaa

SEQ ID NO: 386841 - DNA, 25 bp, Mus musculus
tgttcctagaacaggccttcgatat

SEQ ID NO: 386842 - DNA, 25 bp, Mus musculus
tgttcctaggcaaggtgctgatagt

SEQ ID NO: 386843 - DNA, 25 bp, Mus musculus
tgttcctcagcaacttgatttctta

SEQ ID NO: 386844 - DNA, 25 bp, Mus musculus
tgttcctccctttcggcttcgtgag

SEQ ID NO: 386845 - DNA, 25 bp, Mus musculus
tgttcctccttgtagcaatgctgtg

SEQ ID NO: 386846 - DNA, 25 bp, Mus musculus
tgttcctctgaaaaggaaaagaagc

SEQ ID NO: 386847 - DNA, 25 bp, Mus musculus
tgttcctctgtttctgtgaggacct

SEQ ID NO: 386848 - DNA, 25 bp, Mus musculus
tgttcctctgtttcttggaggatct

SEQ ID NO: 386849 - DNA, 25 bp, Mus musculus
tgttcctgcaaaaggctctgagttt

SEQ ID NO: 386850 - DNA, 25 bp, Mus musculus
tgttcctgccagactgggtttgtca

SEQ ID NO: 386851 - DNA, 25 bp, Mus musculus
tgttcctgctgcgctctgtgccaac

SEQ ID NO: 386852 - DNA, 25 bp, Mus musculus
tgttccttccgaaccctgtgtattc

SEQ ID NO: 386853 - DNA, 25 bp, Mus musculus
tgttccttcctatgggctggtggaa

SEQ ID NO: 386854 - DNA, 25 bp, Mus musculus
tgttccttcctggaggacgacttca

SEQ ID NO: 386855 - DNA, 25 bp, Mus musculus
tgttccttctccactacctcctcca

SEQ ID NO: 386856 - DNA, 25 bp, Mus musculus
tgttccttctgcttctaccaggccc

SEQ ID NO: 386857 - DNA, 25 bp, Mus musculus
tgttcgaaagcattgcattggtctc

SEQ ID NO: 386858 - DNA, 25 bp, Mus musculus
tgttcgacttcaggtctgtggccat

SEQ ID NO: 386859 - DNA, 25 bp, Mus musculus
tgttcgagaggcctccaacatgggc

SEQ ID NO: 386860 - DNA, 25 bp, Mus musculus
tgttcgccagcaacatctccagcac

SEQ ID NO: 386861 - DNA, 25 bp, Mus musculus
tgttcgcgaagaatcgagatccgag

SEQ ID NO: 386862 - DNA, 25 bp, Mus musculus
tgttcgcgaagtgcgtccccacgcg

SEQ ID NO: 386863 - DNA, 25 bp, Mus musculus
tgttcgcggggctcgtgctcgtggg

SEQ ID NO: 386864 - DNA, 25 bp, Mus musculus
tgttcgctccaggtgagaagtctgg

SEQ ID NO: 386865 - DNA, 25 bp, Mus musculus
tgttcgctgtgcgggtgtctccacg

SEQ ID NO: 386866 - DNA, 25 bp, Mus musculus
tgttcgctgtgcgggtgtgggcaca

SEQ ID NO: 386867 - DNA, 25 bp, Mus musculus
tgttcggatgctgaatccctacacg

SEQ ID NO: 386868 - DNA, 25 bp, Mus musculus
tgttcggcaggttcgcagaccagtg

SEQ ID NO: 386869 - DNA, 25 bp, Mus musculus
tgttcggtaaacctggagatgggta

SEQ ID NO: 386870 - DNA, 25 bp, Mus musculus
tgttcggtgcagagccaccatgcca

SEQ ID NO: 386871 - DNA, 25 bp, Mus musculus
tgttcgtcccagcgtcagcccaggc

SEQ ID NO: 386872 - DNA, 25 bp, Mus musculus
tgttcgtctttcagctacagcggaa

SEQ ID NO: 386873 - DNA, 25 bp, Mus musculus
tgttcgtctttcaggctgatgcccc

SEQ ID NO: 386874 - DNA, 25 bp, Mus musculus
tgttcgtgcggtcttttgatggatt

SEQ ID NO: 386875 - DNA, 25 bp, Mus musculus
tgttcgtgctgggtgatagcacact

SEQ ID NO: 386876 - DNA, 25 bp, Mus musculus
tgttcgtggaggtggagcctactac

SEQ ID NO: 386877 - DNA, 25 bp, Mus musculus
tgttcgtggcaggggatgatgagca

SEQ ID NO: 386878 - DNA, 25 bp, Mus musculus
tgttcgttcttagaatcctattcta

SEQ ID NO: 386879 - DNA, 25 bp, Mus musculus
tgttctaaagaggacagatcacagt

SEQ ID NO: 386880 - DNA, 25 bp, Mus musculus
tgttctaaagagtaaccaggactgc

SEQ ID NO: 386881 - DNA, 25 bp, Mus musculus
tgttctaaagagtccaggtctccat

SEQ ID NO: 386882 - DNA, 25 bp, Mus musculus
tgttctaaagagttggagaacagag

SEQ ID NO: 386883 - DNA, 25 bp, Mus musculus
tgttctaaagatgctgaaggcatca

SEQ ID NO: 386884 - DNA, 25 bp, Mus musculus
tgttctaaaggtgctttccagctat

SEQ ID NO: 386885 - DNA, 25 bp, Mus musculus
tgttctaacactgctgcgaccattg

SEQ ID NO: 386886 - DNA, 25 bp, Mus musculus
tgttctacaagctgactcatcatgt

SEQ ID NO: 386887 - DNA, 25 bp, Mus musculus
tgttctacagcccagggtctggtga

SEQ ID NO: 386888 - DNA, 25 bp, Mus musculus
tgttctacagcccaggtttggtcat

SEQ ID NO: 386889 - DNA, 25 bp, Mus musculus
tgttctacaggctgcggctgtgttg

SEQ ID NO: 386890 - DNA, 25 bp, Mus musculus
tgttctagaaaacaactcccagacc

SEQ ID NO: 386891 - DNA, 25 bp, Mus musculus
tgttctagaaaacaatattgatggg

SEQ ID NO: 386892 - DNA, 25 bp, Mus musculus
tgttctagaagttggtagtttacaa

SEQ ID NO: 386893 - DNA, 25 bp, Mus musculus
tgttctataaaagagcatgggtaca

SEQ ID NO: 386894 - DNA, 25 bp, Mus musculus
tgttctataaaagaggtatatatta

SEQ ID NO: 386895 - DNA, 25 bp, Mus musculus
tgttctatgatgattcggctccttt

SEQ ID NO: 386896 - DNA, 25 bp, Mus musculus
tgttctatgctccctggtgcagcat

SEQ ID NO: 386897 - DNA, 25 bp, Mus musculus
tgttctatgctccctttcccaggtg

SEQ ID NO: 386898 - DNA, 25 bp, Mus musculus
tgttctatgctgggacggccttctc

SEQ ID NO: 386899 - DNA, 25 bp, Mus musculus
tgttctattaggtcatgacgcatgg

SEQ ID NO: 386900 - DNA, 25 bp, Mus musculus
tgttctcatccaaagcctttatcca

SEQ ID NO: 386901 - DNA, 25 bp, Mus musculus
tgttctccaatgttgtatgtgctat

SEQ ID NO: 386902 - DNA, 25 bp, Mus musculus
tgttctcccggacgagggatctgat

SEQ ID NO: 386903 - DNA, 25 bp, Mus musculus
tgttctcctccgaggtccagtttgg

SEQ ID NO: 386904 - DNA, 25 bp, Mus musculus
tgttctcgttcaggttagccagtac

SEQ ID NO: 386905 - DNA, 25 bp, Mus musculus
tgttctctaaagggcctggggatat

SEQ ID NO: 386906 - DNA, 25 bp, Mus musculus
tgttctctaaagttacaaattataa

SEQ ID NO: 386907 - DNA, 25 bp, Mus musculus
tgttctctaacctggccctctgctg

SEQ ID NO: 386908 - DNA, 25 bp, Mus musculus
tgttctctaattttccaggtgccga

SEQ ID NO: 386909 - DNA, 25 bp, Mus musculus
tgttctctgtttgacacgtttaggg

SEQ ID NO: 386910 - DNA, 25 bp, Mus musculus
tgttctcttccatatgaggaaactg

SEQ ID NO: 386911 - DNA, 25 bp, Mus musculus
tgttctcttggagttctgacgggaa

SEQ ID NO: 386912 - DNA, 25 bp, Mus musculus
tgttctgagctggcttgctgcccat

SEQ ID NO: 386913 - DNA, 25 bp, Mus musculus
tgttctgagtctttcctggttttct

SEQ ID NO: 386914 - DNA, 25 bp, Mus musculus
tgttctgcagaccatcctgtcagca

SEQ ID NO: 386915 - DNA, 25 bp, Mus musculus
tgttctgcagacgaagacatgggga

SEQ ID NO: 386916 - DNA, 25 bp, Mus musculus
tgttctgcaggcttgcgagaaggtc

SEQ ID NO: 386917 - DNA, 25 bp, Mus musculus
tgttctgcatctcaccagcccccca

SEQ ID NO: 386918 - DNA, 25 bp, Mus musculus
tgttctggatacagacaggatcttt

SEQ ID NO: 386919 - DNA, 25 bp, Mus musculus
tgttctggatacagccaaggtctcc

SEQ ID NO: 386920 - DNA, 25 bp, Mus musculus
tgttctggcagggacgaaacttagc

SEQ ID NO: 386921 - DNA, 25 bp, Mus musculus
tgttctggcggatgaaatgtggcaa

SEQ ID NO: 386922 - DNA, 25 bp, Mus musculus
tgttctggcttccagggctggcgct

SEQ ID NO: 386923 - DNA, 25 bp, Mus musculus
tgttctgggggtggtggagttgttg

SEQ ID NO: 386924 - DNA, 25 bp, Mus musculus
tgttctgtagattcgagtaagagta

SEQ ID NO: 386925 - DNA, 25 bp, Mus musculus
tgttctgtatgcttcctgcgggcac

SEQ ID NO: 386926 - DNA, 25 bp, Mus musculus
tgttctgtgcaggtgcagacctgaa

SEQ ID NO: 386927 - DNA, 25 bp, Mus musculus
tgttctgtgtggaggtactacaagc

SEQ ID NO: 386928 - DNA, 25 bp, Mus musculus
tgttcttaaggatacagaggaagct

SEQ ID NO: 386929 - DNA, 25 bp, Mus musculus
tgttcttaagtggccaaatgtaaat

SEQ ID NO: 386930 - DNA, 25 bp, Mus musculus
tgttcttatgactctgctgggattc

SEQ ID NO: 386931 - DNA, 25 bp, Mus musculus
tgttcttatgactctgggctgatgc

SEQ ID NO: 386932 - DNA, 25 bp, Mus musculus
tgttcttatgactgcaccattcctg

SEQ ID NO: 386933 - DNA, 25 bp, Mus musculus
tgttcttatgcctgaaaaagacctt

SEQ ID NO: 386934 - DNA, 25 bp, Mus musculus
tgttcttcagaaacaacatgccaga

SEQ ID NO: 386935 - DNA, 25 bp, Mus musculus
tgttcttcagaaacagacatctaag

SEQ ID NO: 386936 - DNA, 25 bp, Mus musculus
tgttcttctccacggtactacttgt

SEQ ID NO: 386937 - DNA, 25 bp, Mus musculus
tgttcttctccacgttctaccacgc

SEQ ID NO: 386938 - DNA, 25 bp, Mus musculus
tgttcttctcggacctactaaattc

SEQ ID NO: 386939 - DNA, 25 bp, Mus musculus
tgttcttcttcagaaacaaacatat

SEQ ID NO: 386940 - DNA, 25 bp, Mus musculus
tgttcttgatatacatgataatcag

SEQ ID NO: 386941 - DNA, 25 bp, Mus musculus
tgttcttgatccataacaaactgaa

SEQ ID NO: 386942 - DNA, 25 bp, Mus musculus
tgttcttgcgacatttgtgacacat

SEQ ID NO: 386943 - DNA, 25 bp, Mus musculus
tgttcttggaggagggcaatgcgag

SEQ ID NO: 386944 - DNA, 25 bp, Mus musculus
tgttcttggattcgctggttggtgg

SEQ ID NO: 386945 - DNA, 25 bp, Mus musculus
tgttcttgtggctcaggggactcca

SEQ ID NO: 386946 - DNA, 25 bp, Mus musculus
tgttctttaaaaaagccgagctgga

SEQ ID NO: 386947 - DNA, 25 bp, Mus musculus
tgttctttaaaggggactttgccac

SEQ ID NO: 386948 - DNA, 25 bp, Mus musculus
tgttctttaaaggggagtttgtgtg

SEQ ID NO: 386949 - DNA, 25 bp, Mus musculus
tgttctttaagatcgctccagtgga

SEQ ID NO: 386950 - DNA, 25 bp, Mus musculus
tgttctttaaggatcctatgtagcc

SEQ ID NO: 386951 - DNA, 25 bp, Mus musculus
tgttctttatagacagacgcctgca

SEQ ID NO: 386952 - DNA, 25 bp, Mus musculus
tgttctttatagtgaggctatgggc

SEQ ID NO: 386953 - DNA, 25 bp, Mus musculus
tgttctttcagagtgcttctacttc

SEQ ID NO: 386954 - DNA, 25 bp, Mus musculus
tgttctttccggctgtgacttcttt

SEQ ID NO: 386955 - DNA, 25 bp, Mus musculus
tgttgaaaaaagcttatccatgact

SEQ ID NO: 386956 - DNA, 25 bp, Mus musculus
tgttgaaagtggagcaaaatgccat

SEQ ID NO: 386957 - DNA, 25 bp, Mus musculus
tgttgaaatggaatacactatggat

SEQ ID NO: 386958 - DNA, 25 bp, Mus musculus
tgttgaacaacagatgcagcgaagc

SEQ ID NO: 386959 - DNA, 25 bp, Mus musculus
tgttgaacagagaaattagccgagc

SEQ ID NO: 386960 - DNA, 25 bp, Mus musculus
tgttgaagaaatgttgttatccgat

SEQ ID NO: 386961 - DNA, 25 bp, Mus musculus
tgttgaagagacaaggcatagtgca

SEQ ID NO: 386962 - DNA, 25 bp, Mus musculus
tgttgaagctatggtaaaagtttca

SEQ ID NO: 386963 - DNA, 25 bp, Mus musculus
tgttgaataagttcgtgtgtaagaa

SEQ ID NO: 386964 - DNA, 25 bp, Mus musculus
tgttgaatacaaggttctcaggaca

SEQ ID NO: 386965 - DNA, 25 bp, Mus musculus
tgttgaatgaccctcttccattttg

SEQ ID NO: 386966 - DNA, 25 bp, Mus musculus
tgttgaattctatgccccttggtgt

SEQ ID NO: 386967 - DNA, 25 bp, Mus musculus
tgttgacaaaggcacagcgccctca

SEQ ID NO: 386968 - DNA, 25 bp, Mus musculus
tgttgacactcgaggatgtgaagca

SEQ ID NO: 386969 - DNA, 25 bp, Mus musculus
tgttgacactgaagttggtgagtct

SEQ ID NO: 386970 - DNA, 25 bp, Mus musculus
tgttgacaggcagaggcacggtaga

SEQ ID NO: 386971 - DNA, 25 bp, Mus musculus
tgttgaccctgcagaaaacttcttc

SEQ ID NO: 386972 - DNA, 25 bp, Mus musculus
tgttgaccgaaagcacagccatctt

SEQ ID NO: 386973 - DNA, 25 bp, Mus musculus
tgttgacctggaggagatggtggaa

SEQ ID NO: 386974 - DNA, 25 bp, Mus musculus
tgttgacctggaggagctgttgggc

SEQ ID NO: 386975 - DNA, 25 bp, Mus musculus
tgttgacggacttattgccaaggaa

SEQ ID NO: 386976 - DNA, 25 bp, Mus musculus
tgttgactttaggaatgtgaagctc

SEQ ID NO: 386977 - DNA, 25 bp, Mus musculus
tgttgactttagggtcttctcagtt

SEQ ID NO: 386978 - DNA, 25 bp, Mus musculus
tgttgagaagacgggatatcgctcg

SEQ ID NO: 386979 - DNA, 25 bp, Mus musculus
tgttgagcaggccacagaaggaccc

SEQ ID NO: 386980 - DNA, 25 bp, Mus musculus
tgttgagcgaagaacaaattacctg

SEQ ID NO: 386981 - DNA, 25 bp, Mus musculus
tgttgagcgaagacccttaccagga

SEQ ID NO: 386982 - DNA, 25 bp, Mus musculus
tgttgagctactcaggcctgcctac

SEQ ID NO: 386983 - DNA, 25 bp, Mus musculus
tgttgagctactcaggtcaaggctt

SEQ ID NO: 386984 - DNA, 25 bp, Mus musculus
tgttgagctgttcagaatgaattag

SEQ ID NO: 386985 - DNA, 25 bp, Mus musculus
tgttgagctgttcagacggtgcgca

SEQ ID NO: 386986 - DNA, 25 bp, Mus musculus
tgttgagctgttcagagacagatgg

SEQ ID NO: 386987 - DNA, 25 bp, Mus musculus
tgttgagggaggagctttcatggat

SEQ ID NO: 386988 - DNA, 25 bp, Mus musculus
tgttgagtcaaacgagtctcccatt

SEQ ID NO: 386989 - DNA, 25 bp, Mus musculus
tgttgagtcaaacgccacatctaca

SEQ ID NO: 386990 - DNA, 25 bp, Mus musculus
tgttgatacaaatggaaactataag

SEQ ID NO: 386991 - DNA, 25 bp, Mus musculus
tgttgatgaagagctggagtgattg

SEQ ID NO: 386992 - DNA, 25 bp, Mus musculus
tgttgatgcaaatgtgctagttggc

SEQ ID NO: 386993 - DNA, 25 bp, Mus musculus
tgttgatggctacagggtttatttg

SEQ ID NO: 386994 - DNA, 25 bp, Mus musculus
tgttgattacaggtacagcgcagca

SEQ ID NO: 386995 - DNA, 25 bp, Mus musculus
tgttgcaaatgctggaactgcagca

SEQ ID NO: 386996 - DNA, 25 bp, Mus musculus
tgttgcaaccctggaccctgtcctg

SEQ ID NO: 386997 - DNA, 25 bp, Mus musculus
tgttgcaacctcttggaaaggtatg

SEQ ID NO: 386998 - DNA, 25 bp, Mus musculus
tgttgcaactccttatgaagtggca

SEQ ID NO: 386999 - DNA, 25 bp, Mus musculus
tgttgcaagagggtgaagaagctga

SEQ ID NO: 387000 - DNA, 25 bp, Mus musculus
tgttgcaattacccacggtctgaaa

SEQ ID NO: 387001 - DNA, 25 bp, Mus musculus
tgttgcaattacgtttctactgcac

SEQ ID NO: 387002 - DNA, 25 bp, Mus musculus
tgttgcagaagacagtgcatttgca

SEQ ID NO: 387003 - DNA, 25 bp, Mus musculus
tgttgcagaagacagtgctcttact

SEQ ID NO: 387004 - DNA, 25 bp, Mus musculus
tgttgcagctatgtcaaagataagt

SEQ ID NO: 387005 - DNA, 25 bp, Mus musculus
tgttgcaggtgacagacacatctgg

SEQ ID NO: 387006 - DNA, 25 bp, Mus musculus
tgttgcaggtgacaggttgctttga

SEQ ID NO: 387007 - DNA, 25 bp, Mus musculus
tgttgcatatctgagattcagtttg

SEQ ID NO: 387008 - DNA, 25 bp, Mus musculus
tgttgcatcaggtactgtaataggt

SEQ ID NO: 387009 - DNA, 25 bp, Mus musculus
tgttgcatgaagacaaatcagagcg

SEQ ID NO: 387010 - DNA, 25 bp, Mus musculus
tgttgcatttgcaggtcgctatgca

SEQ ID NO: 387011 - DNA, 25 bp, Mus musculus
tgttgccaaattggctccacttacc

SEQ ID NO: 387012 - DNA, 25 bp, Mus musculus
tgttgccaatggaggtcctgcacca

SEQ ID NO: 387013 - DNA, 25 bp, Mus musculus
tgttgccaatggagtggagattgtg

SEQ ID NO: 387014 - DNA, 25 bp, Mus musculus
tgttgcccagctggcatttttcagg

SEQ ID NO: 387015 - DNA, 25 bp, Mus musculus
tgttgccccagtgccagtggcatca

SEQ ID NO: 387016 - DNA, 25 bp, Mus musculus
tgttgccccagtgccgtttgatttt

SEQ ID NO: 387017 - DNA, 25 bp, Mus musculus
tgttgccgatgagtctgcaatcctg

SEQ ID NO: 387018 - DNA, 25 bp, Mus musculus
tgttgccgatgagtctgccaccatt

SEQ ID NO: 387019 - DNA, 25 bp, Mus musculus
tgttgccgatgagtctgcctgccat

SEQ ID NO: 387020 - DNA, 25 bp, Mus musculus
tgttgccgtgacctttgcagatcaa

SEQ ID NO: 387021 - DNA, 25 bp, Mus musculus
tgttgcctcagatttcttgacctac

SEQ ID NO: 387022 - DNA, 25 bp, Mus musculus
tgttgcgagctctgcttgctggttg

SEQ ID NO: 387023 - DNA, 25 bp, Mus musculus
tgttgcgcgctctcaggctagagtt

SEQ ID NO: 387024 - DNA, 25 bp, Mus musculus
tgttgcggctgaagaacgggaaccg

SEQ ID NO: 387025 - DNA, 25 bp, Mus musculus
tgttgcggctgagtggagattctag

SEQ ID NO: 387026 - DNA, 25 bp, Mus musculus
tgttgctgaagatcaaccgagaaag

SEQ ID NO: 387027 - DNA, 25 bp, Mus musculus
tgttgctgaagcttcaaaagaaagc

SEQ ID NO: 387028 - DNA, 25 bp, Mus musculus
tgttgctgagattgccaaaatgctt

SEQ ID NO: 387029 - DNA, 25 bp, Mus musculus
tgttgctgaggggcggcctgagctg

SEQ ID NO: 387030 - DNA, 25 bp, Mus musculus
tgttgctgctccagggtggggcact

SEQ ID NO: 387031 - DNA, 25 bp, Mus musculus
tgttgctgctggggtctgcgagctt

SEQ ID NO: 387032 - DNA, 25 bp, Mus musculus
tgttgctgctgttatttccgagaga

SEQ ID NO: 387033 - DNA, 25 bp, Mus musculus
tgttgctggagacaaccggatccag

SEQ ID NO: 387034 - DNA, 25 bp, Mus musculus
tgttgctgtagaggttgctgcatcc

SEQ ID NO: 387035 - DNA, 25 bp, Mus musculus
tgttgcttagcctcctgtaccctgg

SEQ ID NO: 387036 - DNA, 25 bp, Mus musculus
tgttgcttaggattccctgcacagc

SEQ ID NO: 387037 - DNA, 25 bp, Mus musculus
tgttgcttcccagaggaagtcacag

SEQ ID NO: 387038 - DNA, 25 bp, Mus musculus
tgttgcttgatggtgaaattgaagc

SEQ ID NO: 387039 - DNA, 25 bp, Mus musculus
tgttggaaagacagggggcagtgcc

SEQ ID NO: 387040 - DNA, 25 bp, Mus musculus
tgttggaaagacagtgtttgtaagc

SEQ ID NO: 387041 - DNA, 25 bp, Mus musculus
tgttggaaagtcgacagaggcaaga

SEQ ID NO: 387042 - DNA, 25 bp, Mus musculus
tgttggaaccaaagatatttccata

SEQ ID NO: 387043 - DNA, 25 bp, Mus musculus
tgttggacaagccccacgcaatcat

SEQ ID NO: 387044 - DNA, 25 bp, Mus musculus
tgttggacagatgcaccaacaagga

SEQ ID NO: 387045 - DNA, 25 bp, Mus musculus
tgttggacagattgtaggtgaagtg

SEQ ID NO: 387046 - DNA, 25 bp, Mus musculus
tgttggactcatgagagcaaagacc

SEQ ID NO: 387047 - DNA, 25 bp, Mus musculus
tgttggagaaacactgaggacggga

SEQ ID NO: 387048 - DNA, 25 bp, Mus musculus
tgttggagaaactggcagagctgtg

SEQ ID NO: 387049 - DNA, 25 bp, Mus musculus
tgttggagaacggggtgaccgtgga

SEQ ID NO: 387050 - DNA, 25 bp, Mus musculus
tgttggagcaggcggacagagaagt

SEQ ID NO: 387051 - DNA, 25 bp, Mus musculus
tgttggagcgggcggcaggaaatgc

SEQ ID NO: 387052 - DNA, 25 bp, Mus musculus
tgttggagtaatggccttattcagg

SEQ ID NO: 387053 - DNA, 25 bp, Mus musculus
tgttggataaaggataaggtagcta

SEQ ID NO: 387054 - DNA, 25 bp, Mus musculus
tgttggatagtagtgaattgaatcc

SEQ ID NO: 387055 - DNA, 25 bp, Mus musculus
tgttggatgctgaggacatcgtgaa

SEQ ID NO: 387056 - DNA, 25 bp, Mus musculus
tgttggatgctgaggatattgtagg

SEQ ID NO: 387057 - DNA, 25 bp, Mus musculus
tgttggatgctgagggcactctgag

SEQ ID NO: 387058 - DNA, 25 bp, Mus musculus
tgttggattatgggtgggtgcatcc

SEQ ID NO: 387059 - DNA, 25 bp, Mus musculus
tgttggattatggtccacagtgagg

SEQ ID NO: 387060 - DNA, 25 bp, Mus musculus
tgttggcaaagctagatctttcaga

SEQ ID NO: 387061 - DNA, 25 bp, Mus musculus
tgttggcaaagctgacaaaccaagt

SEQ ID NO: 387062 - DNA, 25 bp, Mus musculus
tgttggcaaagcttcttcagctgac

SEQ ID NO: 387063 - DNA, 25 bp, Mus musculus
tgttggcaaaggtgactccaatgaa

SEQ ID NO: 387064 - DNA, 25 bp, Mus musculus
tgttggcaagagagatgaagatgct

SEQ ID NO: 387065 - DNA, 25 bp, Mus musculus
tgttggcaagaggccacagcactat

SEQ ID NO: 387066 - DNA, 25 bp, Mus musculus
tgttggcactgcaggaagaagagga

SEQ ID NO: 387067 - DNA, 25 bp, Mus musculus
tgttggcactgggatcagtaatggc

SEQ ID NO: 387068 - DNA, 25 bp, Mus musculus
tgttggcatcagaccacagcagttt

SEQ ID NO: 387069 - DNA, 25 bp, Mus musculus
tgttggcccagaggcagcttccaat

SEQ ID NO: 387070 - DNA, 25 bp, Mus musculus
tgttggcccagtgtcaccagactgt

SEQ ID NO: 387071 - DNA, 25 bp, Mus musculus
tgttggccgaggtggtcctgccgac

SEQ ID NO: 387072 - DNA, 25 bp, Mus musculus
tgttggcctataggaagtttggtga

SEQ ID NO: 387073 - DNA, 25 bp, Mus musculus
tgttggcctctcagaaaacatccag

SEQ ID NO: 387074 - DNA, 25 bp, Mus musculus
tgttggcctctcaggtcaaaggctg

SEQ ID NO: 387075 - DNA, 25 bp, Mus musculus
tgttggcctggtacaggaccctgga

SEQ ID NO: 387076 - DNA, 25 bp, Mus musculus
tgttggcctttgagtagagtatcac

SEQ ID NO: 387077 - DNA, 25 bp, Mus musculus
tgttggcggcgtgagcccagatcat

SEQ ID NO: 387078 - DNA, 25 bp, Mus musculus
tgttggctaatggagcccgctgtga

SEQ ID NO: 387079 - DNA, 25 bp, Mus musculus
tgttggctcaggagggtgtgaagac

SEQ ID NO: 387080 - DNA, 25 bp, Mus musculus
tgttggctgaatgtttgttaactga

SEQ ID NO: 387081 - DNA, 25 bp, Mus musculus
tgttggctgccagcgggcgaacttt

SEQ ID NO: 387082 - DNA, 25 bp, Mus musculus
tgttggcttgtggtctatgttcaga

SEQ ID NO: 387083 - DNA, 25 bp, Mus musculus
tgttgggaagatttctgggcttcaa

SEQ ID NO: 387084 - DNA, 25 bp, Mus musculus
tgttgggaagggtctctcattggac

SEQ ID NO: 387085 - DNA, 25 bp, Mus musculus
tgttgggaatgtccggcggtttcat

SEQ ID NO: 387086 - DNA, 25 bp, Mus musculus
tgttgggagtaaatatttctaccat

SEQ ID NO: 387087 - DNA, 25 bp, Mus musculus
tgttgggattccaggacgcccctgt

SEQ ID NO: 387088 - DNA, 25 bp, Mus musculus
tgttgggattgtaggtcacgctgga

SEQ ID NO: 387089 - DNA, 25 bp, Mus musculus
tgttgggcagatcctgctcatctct

SEQ ID NO: 387090 - DNA, 25 bp, Mus musculus
tgttgggcaggatgtttggatctgg

SEQ ID NO: 387091 - DNA, 25 bp, Mus musculus
tgttgggcatggaaccatctggagg

SEQ ID NO: 387092 - DNA, 25 bp, Mus musculus
tgttgggctaaagaatatgacagat

SEQ ID NO: 387093 - DNA, 25 bp, Mus musculus
tgttgggcttcagcgagaactttca

SEQ ID NO: 387094 - DNA, 25 bp, Mus musculus
tgttggggcgccagacaggattatg

SEQ ID NO: 387095 - DNA, 25 bp, Mus musculus
tgttggggcgccagggatcaacgtt

SEQ ID NO: 387096 - DNA, 25 bp, Mus musculus
tgttggggctaggtgtctccagtgc

SEQ ID NO: 387097 - DNA, 25 bp, Mus musculus
tgttggggctagtgcttatcctggt

SEQ ID NO: 387098 - DNA, 25 bp, Mus musculus
tgttgggggtctgagagaatcgcac

SEQ ID NO: 387099 - DNA, 25 bp, Mus musculus
tgttggggttgccagccatgctgca

SEQ ID NO: 387100 - DNA, 25 bp, Mus musculus
tgttgggtatcagatgttcatctag

SEQ ID NO: 387101 - DNA, 25 bp, Mus musculus
tgttgggttcagatacaggagccta

SEQ ID NO: 387102 - DNA, 25 bp, Mus musculus
tgttggtgccatggtggcttcagta

SEQ ID NO: 387103 - DNA, 25 bp, Mus musculus
tgttggtggcacggatggcaatgtg

SEQ ID NO: 387104 - DNA, 25 bp, Mus musculus
tgttggttatatttgcctaaagacg

SEQ ID NO: 387105 - DNA, 25 bp, Mus musculus
tgttggttattggtggttttggctc

SEQ ID NO: 387106 - DNA, 25 bp, Mus musculus
tgttggttgatccaaacatccagaa

SEQ ID NO: 387107 - DNA, 25 bp, Mus musculus
tgttggttggaacgaatgcctccaa

SEQ ID NO: 387108 - DNA, 25 bp, Mus musculus
tgttggttggagcatttgacattgt

SEQ ID NO: 387109 - DNA, 25 bp, Mus musculus
tgttggttggagtgctcaaggaggc

SEQ ID NO: 387110 - DNA, 25 bp, Mus musculus
tgttggtttccagcccgtcctttca

SEQ ID NO: 387111 - DNA, 25 bp, Mus musculus
tgttgtaaaatggtatggcctcaca

SEQ ID NO: 387112 - DNA, 25 bp, Mus musculus
tgttgtaaatgcagggtctcgtggt

SEQ ID NO: 387113 - DNA, 25 bp, Mus musculus
tgttgtaaatgcagtgattgatgat

SEQ ID NO: 387114 - DNA, 25 bp, Mus musculus
tgttgtaccccaggcattgggcatg

SEQ ID NO: 387115 - DNA, 25 bp, Mus musculus
tgttgtacctgattggactgcccgt

SEQ ID NO: 387116 - DNA, 25 bp, Mus musculus
tgttgtacttggccagccgtgtggg

SEQ ID NO: 387117 - DNA, 25 bp, Mus musculus
tgttgtcaaggtttgatctcatttt

SEQ ID NO: 387118 - DNA, 25 bp, Mus musculus
tgttgtcagggcctaagatcaccaa

SEQ ID NO: 387119 - DNA, 25 bp, Mus musculus
tgttgtcaggggaagagatggctgt

SEQ ID NO: 387120 - DNA, 25 bp, Mus musculus
tgttgtcagggtaagagatggctgt

SEQ ID NO: 387121 - DNA, 25 bp, Mus musculus
tgttgtcatggagagaatgcctcct

SEQ ID NO: 387122 - DNA, 25 bp, Mus musculus
tgttgtcatggaggactgtcaccag

SEQ ID NO: 387123 - DNA, 25 bp, Mus musculus
tgttgtccctgacaggtttggccat

SEQ ID NO: 387124 - DNA, 25 bp, Mus musculus
tgttgtcgcaggacagtaatgatga

SEQ ID NO: 387125 - DNA, 25 bp, Mus musculus
tgttgtcggcgtaggaatgtgtttc

SEQ ID NO: 387126 - DNA, 25 bp, Mus musculus
tgttgtctcaaagcgcaaatttccc

SEQ ID NO: 387127 - DNA, 25 bp, Mus musculus
tgttgtgaaagtggaacccagtgac

SEQ ID NO: 387128 - DNA, 25 bp, Mus musculus
tgttgtgaaagtgttacaggtttat

SEQ ID NO: 387129 - DNA, 25 bp, Mus musculus
tgttgtgaagaacttcaagttggag

SEQ ID NO: 387130 - DNA, 25 bp, Mus musculus
tgttgtgaagctcttcaatgatgct

SEQ ID NO: 387131 - DNA, 25 bp, Mus musculus
tgttgtgaataggatggagacaaca

SEQ ID NO: 387132 - DNA, 25 bp, Mus musculus
tgttgtgcaaatgaagaaaagcaac

SEQ ID NO: 387133 - DNA, 25 bp, Mus musculus
tgttgtgcagagactgccttgtgtg

SEQ ID NO: 387134 - DNA, 25 bp, Mus musculus
tgttgtgcagaggcggccatgcttc

SEQ ID NO: 387135 - DNA, 25 bp, Mus musculus
tgttgtgcagcacagggggcagtgc

SEQ ID NO: 387136 - DNA, 25 bp, Mus musculus
tgttgtgccacaggcttacagtggg

SEQ ID NO: 387137 - DNA, 25 bp, Mus musculus
tgttgtgccacaggtgtcttatgtg

SEQ ID NO: 387138 - DNA, 25 bp, Mus musculus
tgttgtggaggttgcatcagatgaa

SEQ ID NO: 387139 - DNA, 25 bp, Mus musculus
tgttgtggaggttggtccctgcatc

SEQ ID NO: 387140 - DNA, 25 bp, Mus musculus
tgttgtggatccttgatcttagaat

SEQ ID NO: 387141 - DNA, 25 bp, Mus musculus
tgttgtggatccttgggggcaggtc

SEQ ID NO: 387142 - DNA, 25 bp, Mus musculus
tgttgtggattaaagctttctcctt

SEQ ID NO: 387143 - DNA, 25 bp, Mus musculus
tgttgtgtagatgaacgagaccgtg

SEQ ID NO: 387144 - DNA, 25 bp, Mus musculus
tgttgtgtattttggggtgagcgtg

SEQ ID NO: 387145 - DNA, 25 bp, Mus musculus
tgttgtgtccggtataagtgctaca

SEQ ID NO: 387146 - DNA, 25 bp, Mus musculus
tgttgtgtctcggctttccagtctg

SEQ ID NO: 387147 - DNA, 25 bp, Mus musculus
tgttgttaaagctcccaagctgttt

SEQ ID NO: 387148 - DNA, 25 bp, Mus musculus
tgttgttactgaggaacttcctgat

SEQ ID NO: 387149 - DNA, 25 bp, Mus musculus
tgttgttagatcaggctgctttctc

SEQ ID NO: 387150 - DNA, 25 bp, Mus musculus
tgttgttagatcaggggggctttgc

SEQ ID NO: 387151 - DNA, 25 bp, Mus musculus
tgttgttatctgaagaaagaatctg

SEQ ID NO: 387152 - DNA, 25 bp, Mus musculus
tgttgttatctgaaggttttctctg

SEQ ID NO: 387153 - DNA, 25 bp, Mus musculus
tgttgttcaagatgaggagactgac

SEQ ID NO: 387154 - DNA, 25 bp, Mus musculus
tgttgttcaagcatttatatctact

SEQ ID NO: 387155 - DNA, 25 bp, Mus musculus
tgttgttcaagctgcctcaggcgat

SEQ ID NO: 387156 - DNA, 25 bp, Mus musculus
tgttgttcaaggaatatagagcttt

SEQ ID NO: 387157 - DNA, 25 bp, Mus musculus
tgttgttcagagattgacggcgggg

SEQ ID NO: 387158 - DNA, 25 bp, Mus musculus
tgttgttcagagccaccagtggtaa

SEQ ID NO: 387159 - DNA, 25 bp, Mus musculus
tgttgttcaggtttatcatggcttc

SEQ ID NO: 387160 - DNA, 25 bp, Mus musculus
tgttgttctgaggactctcattggg

SEQ ID NO: 387161 - DNA, 25 bp, Mus musculus
tgttgttctggattccacccagaac

SEQ ID NO: 387162 - DNA, 25 bp, Mus musculus
tgttgttgagccaccttctcctgag

SEQ ID NO: 387163 - DNA, 25 bp, Mus musculus
tgttgttgaggcagcatattatact

SEQ ID NO: 387164 - DNA, 25 bp, Mus musculus
tgttgttgctgctggggtctgcgag

SEQ ID NO: 387165 - DNA, 25 bp, Mus musculus
tgttgttgctggagacaaccggatc

SEQ ID NO: 387166 - DNA, 25 bp, Mus musculus
tgttgtttcacatttctggaaagca

SEQ ID NO: 387167 - DNA, 25 bp, Mus musculus
tgttgtttcacatttggtgagtggg

SEQ ID NO: 387168 - DNA, 25 bp, Mus musculus
tgttgtttttcatctagataaaaat

SEQ ID NO: 387169 - DNA, 25 bp, Mus musculus
tgtttaaactgcagaggtatacaag

SEQ ID NO: 387170 - DNA, 25 bp, Mus musculus
tgtttaaattggggtccaagtacag

SEQ ID NO: 387171 - DNA, 25 bp, Mus musculus
tgtttaacacaaaggcaaggcagca

SEQ ID NO: 387172 - DNA, 25 bp, Mus musculus
tgtttaacagtattgcagaaacgtg

SEQ ID NO: 387173 - DNA, 25 bp, Mus musculus
tgtttaacattgggcctaacaggcc

SEQ ID NO: 387174 - DNA, 25 bp, Mus musculus
tgtttaacattggggtggccttgca

SEQ ID NO: 387175 - DNA, 25 bp, Mus musculus
tgtttaaggagatgaaaccctgttg

SEQ ID NO: 387176 - DNA, 25 bp, Mus musculus
tgtttaagttccgatacttcgctgg

SEQ ID NO: 387177 - DNA, 25 bp, Mus musculus
tgtttaatgaagactttgtatcatc

SEQ ID NO: 387178 - DNA, 25 bp, Mus musculus
tgtttaatgaagtgtcacgagcaag

SEQ ID NO: 387179 - DNA, 25 bp, Mus musculus
tgtttaatgaggaaagactaataga

SEQ ID NO: 387180 - DNA, 25 bp, Mus musculus
tgtttaatgaggaaggcttgttgtc

SEQ ID NO: 387181 - DNA, 25 bp, Mus musculus
tgtttaatgcaagagagatgctgag

SEQ ID NO: 387182 - DNA, 25 bp, Mus musculus
tgtttaattcagattccaaggaaat

SEQ ID NO: 387183 - DNA, 25 bp, Mus musculus
tgtttaattccatatttgatggtag

SEQ ID NO: 387184 - DNA, 25 bp, Mus musculus
tgtttacaagccaacaactatttgg

SEQ ID NO: 387185 - DNA, 25 bp, Mus musculus
tgtttacagaaaagggactgatttg

SEQ ID NO: 387186 - DNA, 25 bp, Mus musculus
tgtttacatcagtggttggagacta

SEQ ID NO: 387187 - DNA, 25 bp, Mus musculus
tgtttaccacgcatgcagctggtcc

SEQ ID NO: 387188 - DNA, 25 bp, Mus musculus
tgtttaccctcttcggtgtttatgg

SEQ ID NO: 387189 - DNA, 25 bp, Mus musculus
tgtttacctaggtgcctatgatcgc

SEQ ID NO: 387190 - DNA, 25 bp, Mus musculus
tgtttacgtaaagggcctgacaaga

SEQ ID NO: 387191 - DNA, 25 bp, Mus musculus
tgtttactcactttcaaaacttaag

SEQ ID NO: 387192 - DNA, 25 bp, Mus musculus
tgtttactcactttgaaaaagagaa

SEQ ID NO: 387193 - DNA, 25 bp, Mus musculus
tgtttactcccaatatgaagactct

SEQ ID NO: 387194 - DNA, 25 bp, Mus musculus
tgtttagaagtaacagcctccaccg

SEQ ID NO: 387195 - DNA, 25 bp, Mus musculus
tgtttagattattagatatgctctc

SEQ ID NO: 387196 - DNA, 25 bp, Mus musculus
tgtttagctacaggaagcagtttga

SEQ ID NO: 387197 - DNA, 25 bp, Mus musculus
tgtttagctacaggagcatctggac

SEQ ID NO: 387198 - DNA, 25 bp, Mus musculus
tgtttatcagaagtttccagagtgt

SEQ ID NO: 387199 - DNA, 25 bp, Mus musculus
tgtttatcgaggaggcagcgggccg

SEQ ID NO: 387200 - DNA, 25 bp, Mus musculus
tgtttatctagactaaaacaaaggc

SEQ ID NO: 387201 - DNA, 25 bp, Mus musculus
tgtttatctaggtgcctatgaccgc

SEQ ID NO: 387202 - DNA, 25 bp, Mus musculus
tgtttatctgaaggatcctacccag

SEQ ID NO: 387203 - DNA, 25 bp, Mus musculus
tgtttatgggtacaggacatacagg

SEQ ID NO: 387204 - DNA, 25 bp, Mus musculus
tgtttattagtggaatctttgggga

SEQ ID NO: 387205 - DNA, 25 bp, Mus musculus
tgtttattcaggtgcactgcatcag

SEQ ID NO: 387206 - DNA, 25 bp, Mus musculus
tgtttcaaaagctctcttctccctt

SEQ ID NO: 387207 - DNA, 25 bp, Mus musculus
tgtttcaaaaggcattgcgctccct

SEQ ID NO: 387208 - DNA, 25 bp, Mus musculus
tgtttcacagatagaagctttggag

SEQ ID NO: 387209 - DNA, 25 bp, Mus musculus
tgtttcacagggtcaggtacctgga

SEQ ID NO: 387210 - DNA, 25 bp, Mus musculus
tgtttcacagttcttccagaaagga

SEQ ID NO: 387211 - DNA, 25 bp, Mus musculus
tgtttcacatttctggaaagcagtg

SEQ ID NO: 387212 - DNA, 25 bp, Mus musculus
tgtttcacatttggtgagtggggca

SEQ ID NO: 387213 - DNA, 25 bp, Mus musculus
tgtttcacccgcaaatgtcagcaat

SEQ ID NO: 387214 - DNA, 25 bp, Mus musculus
tgtttcacccgcaattcccactacc

SEQ ID NO: 387215 - DNA, 25 bp, Mus musculus
tgtttcatttcctgcttcaacagac

SEQ ID NO: 387216 - DNA, 25 bp, Mus musculus
tgtttcatttcctgtcctaataaaa

SEQ ID NO: 387217 - DNA, 25 bp, Mus musculus
tgtttcatttgggagaaccatggct

SEQ ID NO: 387218 - DNA, 25 bp, Mus musculus
tgtttccaacccaagctcttttgtg

SEQ ID NO: 387219 - DNA, 25 bp, Mus musculus
tgtttccaagctctgtccgggcctt

SEQ ID NO: 387220 - DNA, 25 bp, Mus musculus
tgtttccaaggatctgttaagattc

SEQ ID NO: 387221 - DNA, 25 bp, Mus musculus
tgtttccaagtgttcatggatgtgc

SEQ ID NO: 387222 - DNA, 25 bp, Mus musculus
tgtttccaagtttggtgtgattttc

SEQ ID NO: 387223 - DNA, 25 bp, Mus musculus
tgtttccaggacagatggcgctgcc

SEQ ID NO: 387224 - DNA, 25 bp, Mus musculus
tgtttccagtgccagtttcctagat

SEQ ID NO: 387225 - DNA, 25 bp, Mus musculus
tgtttccatagtctgagtgacagcc

SEQ ID NO: 387226 - DNA, 25 bp, Mus musculus
tgtttcccaaactatgtcggacggc

SEQ ID NO: 387227 - DNA, 25 bp, Mus musculus
tgtttcccagaatcatacgatgact

SEQ ID NO: 387228 - DNA, 25 bp, Mus musculus
tgtttcccagaccaggtcgacctcg

SEQ ID NO: 387229 - DNA, 25 bp, Mus musculus
tgtttcccagggtcccaaaggccgc

SEQ ID NO: 387230 - DNA, 25 bp, Mus musculus
tgtttccccagatcctgtcttccat

SEQ ID NO: 387231 - DNA, 25 bp, Mus musculus
tgtttcccccaacttacagactgaa

SEQ ID NO: 387232 - DNA, 25 bp, Mus musculus
tgtttcccgcgggcaaggcacgagt

SEQ ID NO: 387233 - DNA, 25 bp, Mus musculus
tgtttcccgcgggtgtcctggctgt

SEQ ID NO: 387234 - DNA, 25 bp, Mus musculus
tgtttccgaaatgagctggaatttt

SEQ ID NO: 387235 - DNA, 25 bp, Mus musculus
tgtttccgagaagagtagcagctct

SEQ ID NO: 387236 - DNA, 25 bp, Mus musculus
tgtttccgagggtcagataacacta

SEQ ID NO: 387237 - DNA, 25 bp, Mus musculus
tgtttcctagaagggaggtggtgtg

SEQ ID NO: 387238 - DNA, 25 bp, Mus musculus
tgtttcctccctgagaatgaggtgt

SEQ ID NO: 387239 - DNA, 25 bp, Mus musculus
tgtttcctgaactcggaaggtgaac

SEQ ID NO: 387240 - DNA, 25 bp, Mus musculus
tgtttcctgatgcttttgggtcgca

SEQ ID NO: 387241 - DNA, 25 bp, Mus musculus
tgtttcctgtgaaccgatttaaagg

SEQ ID NO: 387242 - DNA, 25 bp, Mus musculus
tgtttcggaggccgatggcaccacc

SEQ ID NO: 387243 - DNA, 25 bp, Mus musculus
tgtttcggtgacagggcggctacta

SEQ ID NO: 387244 - DNA, 25 bp, Mus musculus
tgtttcgtcatgagatcaaggacac

SEQ ID NO: 387245 - DNA, 25 bp, Mus musculus
tgtttctaaagagaaaccatgaagt

SEQ ID NO: 387246 - DNA, 25 bp, Mus musculus
tgtttctactctggtgaccatagct

SEQ ID NO: 387247 - DNA, 25 bp, Mus musculus
tgtttctagaggcctcaaacagcgc

SEQ ID NO: 387248 - DNA, 25 bp, Mus musculus
tgtttctattgaaaccatagacaga

SEQ ID NO: 387249 - DNA, 25 bp, Mus musculus
tgtttctattgaaggtgttgttgct

SEQ ID NO: 387250 - DNA, 25 bp, Mus musculus
tgtttctcactcaaggtggcgtgat

SEQ ID NO: 387251 - DNA, 25 bp, Mus musculus
tgtttctcagctcagaggctgagaa

SEQ ID NO: 387252 - DNA, 25 bp, Mus musculus
tgtttctcgctggaaggctctacag

SEQ ID NO: 387253 - DNA, 25 bp, Mus musculus
tgtttctctgcgccaggtatcagag

SEQ ID NO: 387254 - DNA, 25 bp, Mus musculus
tgtttctctgcgcctggtatcagag

SEQ ID NO: 387255 - DNA, 25 bp, Mus musculus
tgtttctgcaagatgaacgagaccg

SEQ ID NO: 387256 - DNA, 25 bp, Mus musculus
tgtttctgcctccaggagaaggtcc

SEQ ID NO: 387257 - DNA, 25 bp, Mus musculus
tgtttctgcttttgtctgctgccca

SEQ ID NO: 387258 - DNA, 25 bp, Mus musculus
tgtttctggtgaagattatgggaca

SEQ ID NO: 387259 - DNA, 25 bp, Mus musculus
tgtttctgtccgaggtcgctcatcc

SEQ ID NO: 387260 - DNA, 25 bp, Mus musculus
tgtttctgtgtgagtgcatgcggga

SEQ ID NO: 387261 - DNA, 25 bp, Mus musculus
tgtttcttaccatctatggagttga

SEQ ID NO: 387262 - DNA, 25 bp, Mus musculus
tgtttgaaaacagctcgaggctggg

SEQ ID NO: 387263 - DNA, 25 bp, Mus musculus
tgtttgaaatggctcggttttactc

SEQ ID NO: 387264 - DNA, 25 bp, Mus musculus
tgtttgaatggtaaatgatctgaaa

SEQ ID NO: 387265 - DNA, 25 bp, Mus musculus
tgtttgacatggcaacagaagttgg

SEQ ID NO: 387266 - DNA, 25 bp, Mus musculus
tgtttgacccaagacaaggtctcac

SEQ ID NO: 387267 - DNA, 25 bp, Mus musculus
tgtttgaccttgttaccggagggga

SEQ ID NO: 387268 - DNA, 25 bp, Mus musculus
tgtttgacttaccatgctcgcattc

SEQ ID NO: 387269 - DNA, 25 bp, Mus musculus
tgtttgagaagctgggtatcagtac

SEQ ID NO: 387270 - DNA, 25 bp, Mus musculus
tgtttgagaggaaacttcgagtcaa

SEQ ID NO: 387271 - DNA, 25 bp, Mus musculus
tgtttgagcagcagcaaaaagatgg

SEQ ID NO: 387272 - DNA, 25 bp, Mus musculus
tgtttgagcgatttattgccaagcc

SEQ ID NO: 387273 - DNA, 25 bp, Mus musculus
tgtttgaggaggtagggtctgacca

SEQ ID NO: 387274 - DNA, 25 bp, Mus musculus
tgtttgaggaggtgtacaggaatga

SEQ ID NO: 387275 - DNA, 25 bp, Mus musculus
tgtttgaggcgatggattgtaagcg

SEQ ID NO: 387276 - DNA, 25 bp, Mus musculus
tgtttgatgatacttatgaccacgg

SEQ ID NO: 387277 - DNA, 25 bp, Mus musculus
tgtttgattccagccataatcgcat

SEQ ID NO: 387278 - DNA, 25 bp, Mus musculus
tgtttgcaagaatgcatcttaacag

SEQ ID NO: 387279 - DNA, 25 bp, Mus musculus
tgtttgcaaggtatccattatgatg

SEQ ID NO: 387280 - DNA, 25 bp, Mus musculus
tgtttgcatgctaggagatgtacga

SEQ ID NO: 387281 - DNA, 25 bp, Mus musculus
tgtttgccaagatctggtggatcgc

SEQ ID NO: 387282 - DNA, 25 bp, Mus musculus
tgtttgccaagatcttgatccagtt

SEQ ID NO: 387283 - DNA, 25 bp, Mus musculus
tgtttgccaagggaaagaaggcaat

SEQ ID NO: 387284 - DNA, 25 bp, Mus musculus
tgtttgccaaggggaacttccccag

SEQ ID NO: 387285 - DNA, 25 bp, Mus musculus
tgtttgccacaacagaaagcctaaa

SEQ ID NO: 387286 - DNA, 25 bp, Mus musculus
tgtttgccagaaatgtgcaaactgc

SEQ ID NO: 387287 - DNA, 25 bp, Mus musculus
tgtttgccagaatggaggataggaa

SEQ ID NO: 387288 - DNA, 25 bp, Mus musculus
tgtttgccagacacgcgaaaagaag

SEQ ID NO: 387289 - DNA, 25 bp, Mus musculus
tgtttgcccagatgggttttgatgg

SEQ ID NO: 387290 - DNA, 25 bp, Mus musculus
tgtttgcccagctctctgtgctatc

SEQ ID NO: 387291 - DNA, 25 bp, Mus musculus
tgtttgccgggtgtaatggataggt

SEQ ID NO: 387292 - DNA, 25 bp, Mus musculus
tgtttgcctgggaaatgctcataaa

SEQ ID NO: 387293 - DNA, 25 bp, Mus musculus
tgtttgctagagggcaatgcgagca

SEQ ID NO: 387294 - DNA, 25 bp, Mus musculus
tgtttgctattgggcacaaatatgc

SEQ ID NO: 387295 - DNA, 25 bp, Mus musculus
tgtttgctcagggtgcagtgagcct

SEQ ID NO: 387296 - DNA, 25 bp, Mus musculus
tgtttgctgaagaccaaggactggt

SEQ ID NO: 387297 - DNA, 25 bp, Mus musculus
tgtttgctgaagcagaactgtgtgt

SEQ ID NO: 387298 - DNA, 25 bp, Mus musculus
tgtttgctgaagcagctcaccatgt

SEQ ID NO: 387299 - DNA, 25 bp, Mus musculus
tgtttgctgaagcaggacacaccag

SEQ ID NO: 387300 - DNA, 25 bp, Mus musculus
tgtttggaaaggatcgtgaactggg

SEQ ID NO: 387301 - DNA, 25 bp, Mus musculus
tgtttggaaaggcgaccgtgctgtg

SEQ ID NO: 387302 - DNA, 25 bp, Mus musculus
tgtttggaaaggctggcaagtttga

SEQ ID NO: 387303 - DNA, 25 bp, Mus musculus
tgtttggacggtgtgccggactcct

SEQ ID NO: 387304 - DNA, 25 bp, Mus musculus
tgtttggagaaatcttcaagacctg

SEQ ID NO: 387305 - DNA, 25 bp, Mus musculus
tgtttggagctcgaggtaaagaaaa

SEQ ID NO: 387306 - DNA, 25 bp, Mus musculus
tgtttggcaggatgctcgggacaca

SEQ ID NO: 387307 - DNA, 25 bp, Mus musculus
tgtttggcagtctccaaaaccccaa

SEQ ID NO: 387308 - DNA, 25 bp, Mus musculus
tgtttggccccaaaggtgtgaacat

SEQ ID NO: 387309 - DNA, 25 bp, Mus musculus
tgtttggtcaggtggtacgtgggct

SEQ ID NO: 387310 - DNA, 25 bp, Mus musculus
tgtttggttcttcgggcctgtgtga

SEQ ID NO: 387311 - DNA, 25 bp, Mus musculus
tgtttgtaaaagtaaaggagtgaga

SEQ ID NO: 387312 - DNA, 25 bp, Mus musculus
tgtttgtaaaattccttctgatgta

SEQ ID NO: 387313 - DNA, 25 bp, Mus musculus
tgtttgtacaaagggcaatcctgca

SEQ ID NO: 387314 - DNA, 25 bp, Mus musculus
tgtttgtaccaggcaacttgccact

SEQ ID NO: 387315 - DNA, 25 bp, Mus musculus
tgtttgtaccaggttcccaagagtt

SEQ ID NO: 387316 - DNA, 25 bp, Mus musculus
tgtttgtcctcaaatcgtcctgctt

SEQ ID NO: 387317 - DNA, 25 bp, Mus musculus
tgtttgtccttaagtgtgggaactt

SEQ ID NO: 387318 - DNA, 25 bp, Mus musculus
tgtttgtgaatggctgcttattgga

SEQ ID NO: 387319 - DNA, 25 bp, Mus musculus
tgtttgtgacctcgtactagaagac

SEQ ID NO: 387320 - DNA, 25 bp, Mus musculus
tgtttgtgcagggatcgcttacact

SEQ ID NO: 387321 - DNA, 25 bp, Mus musculus
tgtttgtgcagttgctttattctcc

SEQ ID NO: 387322 - DNA, 25 bp, Mus musculus
tgtttgtgtgtggacaggccaaaat

SEQ ID NO: 387323 - DNA, 25 bp, Mus musculus
tgtttgttagtgagctgctggaagc

SEQ ID NO: 387324 - DNA, 25 bp, Mus musculus
tgtttgttgaattctatgccccttg

SEQ ID NO: 387325 - DNA, 25 bp, Mus musculus
tgtttgttgttaaagctcccaagct

SEQ ID NO: 387326 - DNA, 25 bp, Mus musculus
tgttttaaaaggtgtccagtgtgaa

SEQ ID NO: 387327 - DNA, 25 bp, Mus musculus
tgttttaaatggggctctctaagta

SEQ ID NO: 387328 - DNA, 25 bp, Mus musculus
tgttttacaaaaggtcacaaccatg

SEQ ID NO: 387329 - DNA, 25 bp, Mus musculus
tgttttacagatggctcattgcgtg

SEQ ID NO: 387330 - DNA, 25 bp, Mus musculus
tgttttacagcatgtacattgccgt

SEQ ID NO: 387331 - DNA, 25 bp, Mus musculus
tgttttacagcctttcccatggtcc

SEQ ID NO: 387332 - DNA, 25 bp, Mus musculus
tgttttacaggtgtgtgtggtttca

SEQ ID NO: 387333 - DNA, 25 bp, Mus musculus
tgttttacatattgcaagacgacaa

SEQ ID NO: 387334 - DNA, 25 bp, Mus musculus
tgttttagaaccaaccgatgttaca

SEQ ID NO: 387335 - DNA, 25 bp, Mus musculus
tgttttagaactaagaaataaagat

SEQ ID NO: 387336 - DNA, 25 bp, Mus musculus
tgttttagaactaagtagcaaccca

SEQ ID NO: 387337 - DNA, 25 bp, Mus musculus
tgttttataaacagacatttccact

SEQ ID NO: 387338 - DNA, 25 bp, Mus musculus
tgttttatcctggtctctaataaag

SEQ ID NO: 387339 - DNA, 25 bp, Mus musculus
tgttttatccttacaatgacactgt

SEQ ID NO: 387340 - DNA, 25 bp, Mus musculus
tgttttatgagatgtccagctcgcc

SEQ ID NO: 387341 - DNA, 25 bp, Mus musculus
tgttttatggctggcctggtctgtt

SEQ ID NO: 387342 - DNA, 25 bp, Mus musculus
tgttttattggatcgtggagttgat

SEQ ID NO: 387343 - DNA, 25 bp, Mus musculus
tgttttcaaaaaagaatatgatgct

SEQ ID NO: 387344 - DNA, 25 bp, Mus musculus
tgttttcacaggaactggtgactac

SEQ ID NO: 387345 - DNA, 25 bp, Mus musculus
tgttttcagacagctggttcgatgc

SEQ ID NO: 387346 - DNA, 25 bp, Mus musculus
tgttttcagagttggaaacaacttc

SEQ ID NO: 387347 - DNA, 25 bp, Mus musculus
tgttttccagcaagtggaacacatt

SEQ ID NO: 387348 - DNA, 25 bp, Mus musculus
tgttttccagccaaatagaggagct

SEQ ID NO: 387349 - DNA, 25 bp, Mus musculus
tgttttccaggaggtggtgtggtct

SEQ ID NO: 387350 - DNA, 25 bp, Mus musculus
tgttttccccttctgttgtactttg

SEQ ID NO: 387351 - DNA, 25 bp, Mus musculus
tgttttcgaaggcagtataattcgt

SEQ ID NO: 387352 - DNA, 25 bp, Mus musculus
tgttttcgaaggcatgcttgtagtg

SEQ ID NO: 387353 - DNA, 25 bp, Mus musculus
tgttttctcacagcatggtctgaga

SEQ ID NO: 387354 - DNA, 25 bp, Mus musculus
tgttttctccaggaaggaactcaag

SEQ ID NO: 387355 - DNA, 25 bp, Mus musculus
tgttttctctgacagctgtcatcag

SEQ ID NO: 387356 - DNA, 25 bp, Mus musculus
tgttttctggagtgacactagcaga

SEQ ID NO: 387357 - DNA, 25 bp, Mus musculus
tgttttctgtcaagacaccatgatt

SEQ ID NO: 387358 - DNA, 25 bp, Mus musculus
tgttttctgttgagcggctgcaaag

SEQ ID NO: 387359 - DNA, 25 bp, Mus musculus
tgttttgaaacatgtccacctcgta

SEQ ID NO: 387360 - DNA, 25 bp, Mus musculus
tgttttgaagattaaaggttgcaca

SEQ ID NO: 387361 - DNA, 25 bp, Mus musculus
tgttttgatacagtcaccaaggagc

SEQ ID NO: 387362 - DNA, 25 bp, Mus musculus
tgttttgatgattccaagagcagag

SEQ ID NO: 387363 - DNA, 25 bp, Mus musculus
tgttttgcagttcaggtttgctgtc

SEQ ID NO: 387364 - DNA, 25 bp, Mus musculus
tgttttgcataggtgcctctccttt

SEQ ID NO: 387365 - DNA, 25 bp, Mus musculus
tgttttgcctgtagagacagctgca

SEQ ID NO: 387366 - DNA, 25 bp, Mus musculus
tgttttgctttgtttacagacctgc

SEQ ID NO: 387367 - DNA, 25 bp, Mus musculus
tgttttggaagaagacgtcaaactc

SEQ ID NO: 387368 - DNA, 25 bp, Mus musculus
tgttttggaagaagtcagttaagga

SEQ ID NO: 387369 - DNA, 25 bp, Mus musculus
tgttttggaatgagagacatgtcta

SEQ ID NO: 387370 - DNA, 25 bp, Mus musculus
tgttttggttggtatgctgtacatc

SEQ ID NO: 387371 - DNA, 25 bp, Mus musculus
tgttttgtgaagagtacccagtatt

SEQ ID NO: 387372 - DNA, 25 bp, Mus musculus
tgttttgtgaagcctggatggtgga

SEQ ID NO: 387373 - DNA, 25 bp, Mus musculus
tgttttgtgaaggacaaggctacac

SEQ ID NO: 387374 - DNA, 25 bp, Mus musculus
tgttttgttgctttcccagcactat

SEQ ID NO: 387375 - DNA, 25 bp, Mus musculus
tgtttttaaactaggtcgatccttc

SEQ ID NO: 387376 - DNA, 25 bp, Mus musculus
tgtttttacaagagctaagtgattg

SEQ ID NO: 387377 - DNA, 25 bp, Mus musculus
tgtttttacttcgcggagtgctctc

SEQ ID NO: 387378 - DNA, 25 bp, Mus musculus
tgtttttcagatttcaccgagatga

SEQ ID NO: 387379 - DNA, 25 bp, Mus musculus
tgtttttcatacagataaaaattat

SEQ ID NO: 387380 - DNA, 25 bp, Mus musculus
tgtttttcatctagataaaaattat

SEQ ID NO: 387381 - DNA, 25 bp, Mus musculus
tgtttttccaaggagtgtggggccg

SEQ ID NO: 387382 - DNA, 25 bp, Mus musculus
tgtttttcctcagagcccagatgcc

SEQ ID NO: 387383 - DNA, 25 bp, Mus musculus
tgtttttcctggtgtgacttatgag

SEQ ID NO: 387384 - DNA, 25 bp, Mus musculus
tgtttttctggatcttgtttcctct

SEQ ID NO: 387385 - DNA, 25 bp, Mus musculus
tgtttttctgtgaaggcgttaagat

SEQ ID NO: 387386 - DNA, 25 bp, Mus musculus
tgtttttgaagagctacagacagtc

SEQ ID NO: 387387 - DNA, 25 bp, Mus musculus
tgtttttgcagaatgtgtgctgtgt

SEQ ID NO: 387388 - DNA, 25 bp, Mus musculus
tgtttttgctgatgggaacttttgg

SEQ ID NO: 387389 - DNA, 25 bp, Mus musculus
tgtttttgctgatttctaagttatt

SEQ ID NO: 387390 - DNA, 25 bp, Mus musculus
tgtttttgtgctgttgcttcctgga

SEQ ID NO: 387391 - DNA, 25 bp, Mus musculus
tgtttttgttgtacggacattgctg

SEQ ID NO: 387392 - DNA, 25 bp, Mus musculus
tgttttttcaggatgacttgattat

SEQ ID NO: 387393 - DNA, 25 bp, Mus musculus
ttaaaaaactggtatccagctcata

SEQ ID NO: 387394 - DNA, 25 bp, Mus musculus
ttaaaaacagtacagattgctaaga

SEQ ID NO: 387395 - DNA, 25 bp, Mus musculus
ttaaaaacctgcaactggattacaa

SEQ ID NO: 387396 - DNA, 25 bp, Mus musculus
ttaaaaaccttaggttgttctgcat

SEQ ID NO: 387397 - DNA, 25 bp, Mus musculus
ttaaaaagacttggtgattgggata

SEQ ID NO: 387398 - DNA, 25 bp, Mus musculus
ttaaaaagagcaacagtgtgaagaa

SEQ ID NO: 387399 - DNA, 25 bp, Mus musculus
ttaaaaagtgcttctctctgaatcc

SEQ ID NO: 387400 - DNA, 25 bp, Mus musculus
ttaaaaatattagcatcaaaaatct

SEQ ID NO: 387401 - DNA, 25 bp, Mus musculus
ttaaaaatattgagactggaagtga

SEQ ID NO: 387402 - DNA, 25 bp, Mus musculus
ttaaaaatattgggtatgaaagtgc

SEQ ID NO: 387403 - DNA, 25 bp, Mus musculus
ttaaaaatcgcctcaccattgagct

SEQ ID NO: 387404 - DNA, 25 bp, Mus musculus
ttaaaaatgcaccaacaattctctt

SEQ ID NO: 387405 - DNA, 25 bp, Mus musculus
ttaaaaattgagacctctgacagct

SEQ ID NO: 387406 - DNA, 25 bp, Mus musculus
ttaaaaattgagagagagaagatta

SEQ ID NO: 387407 - DNA, 25 bp, Mus musculus
ttaaaacaaagatgtctcatttccg

SEQ ID NO: 387408 - DNA, 25 bp, Mus musculus
ttaaaacaaaggggaagcgtgcggc

SEQ ID NO: 387409 - DNA, 25 bp, Mus musculus
ttaaaacaagtgcctccaaaaccat

SEQ ID NO: 387410 - DNA, 25 bp, Mus musculus
ttaaaacaagtgttttgtcaagtta

SEQ ID NO: 387411 - DNA, 25 bp, Mus musculus
ttaaaacacaggagctccttctggc

SEQ ID NO: 387412 - DNA, 25 bp, Mus musculus
ttaaaacacgccttggccggaatgt

SEQ ID NO: 387413 - DNA, 25 bp, Mus musculus
ttaaaacacgccttggggttctctg

SEQ ID NO: 387414 - DNA, 25 bp, Mus musculus
ttaaaacaggatcacgagtttgatt

SEQ ID NO: 387415 - DNA, 25 bp, Mus musculus
ttaaaacaggatcaggagtttgatt

SEQ ID NO: 387416 - DNA, 25 bp, Mus musculus
ttaaaacaggcctcaaggctttgat

SEQ ID NO: 387417 - DNA, 25 bp, Mus musculus
ttaaaaccagatcagaaaccagtaa

SEQ ID NO: 387418 - DNA, 25 bp, Mus musculus
ttaaaactctgcgaggcagaggctc

SEQ ID NO: 387419 - DNA, 25 bp, Mus musculus
ttaaaactttgctgcgagacaaaac

SEQ ID NO: 387420 - DNA, 25 bp, Mus musculus
ttaaaactttgtagttggtgatgat

SEQ ID NO: 387421 - DNA, 25 bp, Mus musculus
ttaaaagaagatccagtcctgcagg

SEQ ID NO: 387422 - DNA, 25 bp, Mus musculus
ttaaaagaatggaggtccgctgggg

SEQ ID NO: 387423 - DNA, 25 bp, Mus musculus
ttaaaagagatttctattctctaca

SEQ ID NO: 387424 - DNA, 25 bp, Mus musculus
ttaaaagagatttctgctgaatgtg

SEQ ID NO: 387425 - DNA, 25 bp, Mus musculus
ttaaaagctaaacaagagcatgaag

SEQ ID NO: 387426 - DNA, 25 bp, Mus musculus
ttaaaaggaactggtctctcatgga

SEQ ID NO: 387427 - DNA, 25 bp, Mus musculus
ttaaaaggttatttgaacacacagg

SEQ ID NO: 387428 - DNA, 25 bp, Mus musculus
ttaaaaggttatttggtacaaaatg

SEQ ID NO: 387429 - DNA, 25 bp, Mus musculus
ttaaaagtaaatggaagtacgactg

SEQ ID NO: 387430 - DNA, 25 bp, Mus musculus
ttaaaagttcaaggagtctcatgaa

SEQ ID NO: 387431 - DNA, 25 bp, Mus musculus
ttaaaataatccaaggaagaattct

SEQ ID NO: 387432 - DNA, 25 bp, Mus musculus
ttaaaataatcctgtcaaggtattc

SEQ ID NO: 387433 - DNA, 25 bp, Mus musculus
ttaaaataccagtgtaagcggtaac

SEQ ID NO: 387434 - DNA, 25 bp, Mus musculus
ttaaaatacctgagcatctgtaaca

SEQ ID NO: 387435 - DNA, 25 bp, Mus musculus
ttaaaatatcagaaatcatgaggtc

SEQ ID NO: 387436 - DNA, 25 bp, Mus musculus
ttaaaatatcagaggctaaagaagg

SEQ ID NO: 387437 - DNA, 25 bp, Mus musculus
ttaaaatcaagatctctgctcctca

SEQ ID NO: 387438 - DNA, 25 bp, Mus musculus
ttaaaatcacagactcaccacctcc

SEQ ID NO: 387439 - DNA, 25 bp, Mus musculus
ttaaaatcaggaaattttgccaaag

SEQ ID NO: 387440 - DNA, 25 bp, Mus musculus
ttaaaatcaggcagggagaagaaac

SEQ ID NO: 387441 - DNA, 25 bp, Mus musculus
ttaaaatccaagaggcggtggtggt

SEQ ID NO: 387442 - DNA, 25 bp, Mus musculus
ttaaaattcagcctttagaaaggaa

SEQ ID NO: 387443 - DNA, 25 bp, Mus musculus
ttaaaattcaggctgtagctgtttg

SEQ ID NO: 387444 - DNA, 25 bp, Mus musculus
ttaaaattctcaagccagtaaaaaa

SEQ ID NO: 387445 - DNA, 25 bp, Mus musculus
ttaaaattctcaagtcacgaacccc

SEQ ID NO: 387446 - DNA, 25 bp, Mus musculus
ttaaaattgcctgtacacagagttc

SEQ ID NO: 387447 - DNA, 25 bp, Mus musculus
ttaaaatttcttgtgaaaatgaaca

SEQ ID NO: 387448 - DNA, 25 bp, Mus musculus
ttaaaatttggattcctgtctctga

SEQ ID NO: 387449 - DNA, 25 bp, Mus musculus
ttaaacaaaagaaagatataagcat

SEQ ID NO: 387450 - DNA, 25 bp, Mus musculus
ttaaacaaagatcctgtgtaccggg

SEQ ID NO: 387451 - DNA, 25 bp, Mus musculus
ttaaacaaagatgagtacattgaga

SEQ ID NO: 387452 - DNA, 25 bp, Mus musculus
ttaaacaacctagagcttcaggatc

SEQ ID NO: 387453 - DNA, 25 bp, Mus musculus
ttaaacaagcgcagatattaaacta

SEQ ID NO: 387454 - DNA, 25 bp, Mus musculus
ttaaacaccagggtctcctagccct

SEQ ID NO: 387455 - DNA, 25 bp, Mus musculus
ttaaacaggagttgacacatggttt

SEQ ID NO: 387456 - DNA, 25 bp, Mus musculus
ttaaacaggtcaaggagagtgtcac

SEQ ID NO: 387457 - DNA, 25 bp, Mus musculus
ttaaacataaaagaaattgcatgtg

SEQ ID NO: 387458 - DNA, 25 bp, Mus musculus
ttaaacataaaggtgactgattttg

SEQ ID NO: 387459 - DNA, 25 bp, Mus musculus
ttaaacatatggaataaatttcaag

SEQ ID NO: 387460 - DNA, 25 bp, Mus musculus
ttaaacatatggaatgcaaattgaa

SEQ ID NO: 387461 - DNA, 25 bp, Mus musculus
ttaaacatgcccactgtcacgcacg

SEQ ID NO: 387462 - DNA, 25 bp, Mus musculus
ttaaaccacattttgctatgagctt

SEQ ID NO: 387463 - DNA, 25 bp, Mus musculus
ttaaaccacattttggtgtgatgga

SEQ ID NO: 387464 - DNA, 25 bp, Mus musculus
ttaaacctgagcattttaatctgaa

SEQ ID NO: 387465 - DNA, 25 bp, Mus musculus
ttaaactgcacagagatcccaagtg

SEQ ID NO: 387466 - DNA, 25 bp, Mus musculus
ttaaactgggagtgtgtgccgacaa

SEQ ID NO: 387467 - DNA, 25 bp, Mus musculus
ttaaacttacatcaaaattatatta

SEQ ID NO: 387468 - DNA, 25 bp, Mus musculus
ttaaacttacatgtttgaggattgc

SEQ ID NO: 387469 - DNA, 25 bp, Mus musculus
ttaaagaaatcaaagagaaaatgga

SEQ ID NO: 387470 - DNA, 25 bp, Mus musculus
ttaaagaaatcaaagatatagatgt

SEQ ID NO: 387471 - DNA, 25 bp, Mus musculus
ttaaagaacttgtgtagcttgtaga

SEQ ID NO: 387472 - DNA, 25 bp, Mus musculus
ttaaagaaggaagatgcaggttttg

SEQ ID NO: 387473 - DNA, 25 bp, Mus musculus
ttaaagaaggaaggatccaggccag

SEQ ID NO: 387474 - DNA, 25 bp, Mus musculus
ttaaagaatgtggagccactgtatg

SEQ ID NO: 387475 - DNA, 25 bp, Mus musculus
ttaaagaccacaaagaaacatggtg

SEQ ID NO: 387476 - DNA, 25 bp, Mus musculus
ttaaagacgatgaacgtgtcgtggg

SEQ ID NO: 387477 - DNA, 25 bp, Mus musculus
ttaaagacttaggaagaagactacg

SEQ ID NO: 387478 - DNA, 25 bp, Mus musculus
ttaaagacttaggtgggtcggtgat

SEQ ID NO: 387479 - DNA, 25 bp, Mus musculus
ttaaagagacaggacctgatagatg

SEQ ID NO: 387480 - DNA, 25 bp, Mus musculus
ttaaagagcatgaaagccaaagcat

SEQ ID NO: 387481 - DNA, 25 bp, Mus musculus
ttaaagagcatggacggagattaca

SEQ ID NO: 387482 - DNA, 25 bp, Mus musculus
ttaaagagccaatggaccttgccac

SEQ ID NO: 387483 - DNA, 25 bp, Mus musculus
ttaaagagccaatgggtctcataac

SEQ ID NO: 387484 - DNA, 25 bp, Mus musculus
ttaaagagttggcaggaatagtggg

SEQ ID NO: 387485 - DNA, 25 bp, Mus musculus
ttaaagatgaacatctcagcggttc

SEQ ID NO: 387486 - DNA, 25 bp, Mus musculus
ttaaagatgacctaggaaacacact

SEQ ID NO: 387487 - DNA, 25 bp, Mus musculus
ttaaagattttttcagtattggaaa

SEQ ID NO: 387488 - DNA, 25 bp, Mus musculus
ttaaagcaaaaagtcaaagctttta

SEQ ID NO: 387489 - DNA, 25 bp, Mus musculus
ttaaagcaaggtgaatgtttgaatt

SEQ ID NO: 387490 - DNA, 25 bp, Mus musculus
ttaaagcacctcctgattccactgt

SEQ ID NO: 387491 - DNA, 25 bp, Mus musculus
ttaaagcatgcgcagatgacagggt

SEQ ID NO: 387492 - DNA, 25 bp, Mus musculus
ttaaagcatgggcagtagctcgtct

SEQ ID NO: 387493 - DNA, 25 bp, Mus musculus
ttaaagcccagattcagtttgctga

SEQ ID NO: 387494 - DNA, 25 bp, Mus musculus
ttaaagctcagagccggccacccca

SEQ ID NO: 387495 - DNA, 25 bp, Mus musculus
ttaaagctcagtaccgcacaaccaa

SEQ ID NO: 387496 - DNA, 25 bp, Mus musculus
ttaaagctggcgagcttctgcagtt

SEQ ID NO: 387497 - DNA, 25 bp, Mus musculus
ttaaagctggcggtccccaaccatc

SEQ ID NO: 387498 - DNA, 25 bp, Mus musculus
ttaaagcttttagagtcgctgactc

SEQ ID NO: 387499 - DNA, 25 bp, Mus musculus
ttaaaggacagacaggctttccagg

SEQ ID NO: 387500 - DNA, 25 bp, Mus musculus
ttaaaggacttaagggaacgaatgg

SEQ ID NO: 387501 - DNA, 25 bp, Mus musculus
ttaaaggattctgctcttgctgtcc

SEQ ID NO: 387502 - DNA, 25 bp, Mus musculus
ttaaaggcacaggaagcggaacagg

SEQ ID NO: 387503 - DNA, 25 bp, Mus musculus
ttaaagggcatcagcgagggctgcc

SEQ ID NO: 387504 - DNA, 25 bp, Mus musculus
ttaaagggcatcaggaggctgcaca

SEQ ID NO: 387505 - DNA, 25 bp, Mus musculus
ttaaagtgaagacgctgactgggaa

SEQ ID NO: 387506 - DNA, 25 bp, Mus musculus
ttaaagtgaagtccaccacagaaag

SEQ ID NO: 387507 - DNA, 25 bp, Mus musculus
ttaaagtgaggaataagactgtcaa

SEQ ID NO: 387508 - DNA, 25 bp, Mus musculus
ttaaagtttaaccagctcaggaaga

SEQ ID NO: 387509 - DNA, 25 bp, Mus musculus
ttaaagtttcagcaacccagcatgt

SEQ ID NO: 387510 - DNA, 25 bp, Mus musculus
ttaaagtttgaggtgggatgtgtgt

SEQ ID NO: 387511 - DNA, 25 bp, Mus musculus
ttaaataaaggtatggcctcacatg

SEQ ID NO: 387512 - DNA, 25 bp, Mus musculus
ttaaataataggtggttagccagcg

SEQ ID NO: 387513 - DNA, 25 bp, Mus musculus
ttaaatacctggatcctgagcatgc

SEQ ID NO: 387514 - DNA, 25 bp, Mus musculus
ttaaatataaaatggaagctttaaa

SEQ ID NO: 387515 - DNA, 25 bp, Mus musculus
ttaaatataaaatgggtcaaataga

SEQ ID NO: 387516 - DNA, 25 bp, Mus musculus
ttaaatatcacgaacacactaaata

SEQ ID NO: 387517 - DNA, 25 bp, Mus musculus
ttaaatattttgaggttccatctgt

SEQ ID NO: 387518 - DNA, 25 bp, Mus musculus
ttaaatcatcaccagaataagcctg

SEQ ID NO: 387519 - DNA, 25 bp, Mus musculus
ttaaatccagtacaggtgaatatac

SEQ ID NO: 387520 - DNA, 25 bp, Mus musculus
ttaaatctgaagtgcagcgtaagta

SEQ ID NO: 387521 - DNA, 25 bp, Mus musculus
ttaaatgaagagatggttacgcccc

SEQ ID NO: 387522 - DNA, 25 bp, Mus musculus
ttaaatgaagaggtgtttatggaga

SEQ ID NO: 387523 - DNA, 25 bp, Mus musculus
ttaaatgacaacaattgacatatat

SEQ ID NO: 387524 - DNA, 25 bp, Mus musculus
ttaaatgcagacttaattcaggtag

SEQ ID NO: 387525 - DNA, 25 bp, Mus musculus
ttaaatgcaggtctcagccagtctc

SEQ ID NO: 387526 - DNA, 25 bp, Mus musculus
ttaaatgccaaacacactggctctg

SEQ ID NO: 387527 - DNA, 25 bp, Mus musculus
ttaaatgccaatccttcccagtttc

SEQ ID NO: 387528 - DNA, 25 bp, Mus musculus
ttaaatgggccagatacaatttgtt

SEQ ID NO: 387529 - DNA, 25 bp, Mus musculus
ttaaatgtacagtctaaatccagtg

SEQ ID NO: 387530 - DNA, 25 bp, Mus musculus
ttaaatgtggaagaggaaccgggca

SEQ ID NO: 387531 - DNA, 25 bp, Mus musculus
ttaaattcacatgagctgtttcaga

SEQ ID NO: 387532 - DNA, 25 bp, Mus musculus
ttaaattgctcaagagacattttaa

SEQ ID NO: 387533 - DNA, 25 bp, Mus musculus
ttaaattgctcaagagtcctaaacc

SEQ ID NO: 387534 - DNA, 25 bp, Mus musculus
ttaaattggggtccaagtacagcac

SEQ ID NO: 387535 - DNA, 25 bp, Mus musculus
ttaaatttcagattttatcatgtgg

SEQ ID NO: 387536 - DNA, 25 bp, Mus musculus
ttaaatttgataatgcaaacccgtg

SEQ ID NO: 387537 - DNA, 25 bp, Mus musculus
ttaacaaaatatagtgtcatcatgc

SEQ ID NO: 387538 - DNA, 25 bp, Mus musculus
ttaacaaagtagcagacagtgttac

SEQ ID NO: 387539 - DNA, 25 bp, Mus musculus
ttaacaagaaatacgatgaggatga

SEQ ID NO: 387540 - DNA, 25 bp, Mus musculus
ttaacaagaaatacggtgaagctct

SEQ ID NO: 387541 - DNA, 25 bp, Mus musculus
ttaacaagaagattgacctgaagtt

SEQ ID NO: 387542 - DNA, 25 bp, Mus musculus
ttaacaagaagatttacaagattgg

SEQ ID NO: 387543 - DNA, 25 bp, Mus musculus
ttaacaagcaagaaagaagacatct

SEQ ID NO: 387544 - DNA, 25 bp, Mus musculus
ttaacaagcaagatccgctgatctt

SEQ ID NO: 387545 - DNA, 25 bp, Mus musculus
ttaacaagcacaatgggtgtgtttt

SEQ ID NO: 387546 - DNA, 25 bp, Mus musculus
ttaacaataaggacctccagtcaga

SEQ ID NO: 387547 - DNA, 25 bp, Mus musculus
ttaacaatagacatgaagcgccacc

SEQ ID NO: 387548 - DNA, 25 bp, Mus musculus
ttaacacaaaggcaaggcagcaaat

SEQ ID NO: 387549 - DNA, 25 bp, Mus musculus
ttaacacaagaaggctacatggatg

SEQ ID NO: 387550 - DNA, 25 bp, Mus musculus
ttaacacacaagattcttccagatg

SEQ ID NO: 387551 - DNA, 25 bp, Mus musculus
ttaacacacaagcctccatgcattg

SEQ ID NO: 387552 - DNA, 25 bp, Mus musculus
ttaacaccattgaaggtcctcaact

SEQ ID NO: 387553 - DNA, 25 bp, Mus musculus
ttaacacctgcagatgcaagttgtt

SEQ ID NO: 387554 - DNA, 25 bp, Mus musculus
ttaacacgaccaggtctcccagtgg

SEQ ID NO: 387555 - DNA, 25 bp, Mus musculus
ttaacactggcagaggtacggagtt

SEQ ID NO: 387556 - DNA, 25 bp, Mus musculus
ttaacagaaaaggagtgtgtgaggg

SEQ ID NO: 387557 - DNA, 25 bp, Mus musculus
ttaacagaaacttcagaaaagtaga

SEQ ID NO: 387558 - DNA, 25 bp, Mus musculus
ttaacagaatgagaacagacaaggt

SEQ ID NO: 387559 - DNA, 25 bp, Mus musculus
ttaacagataagccctccctgaccc

SEQ ID NO: 387560 - DNA, 25 bp, Mus musculus
ttaacagataggttctgcctcatgg

SEQ ID NO: 387561 - DNA, 25 bp, Mus musculus
ttaacagatgacaggtctgaggagg

SEQ ID NO: 387562 - DNA, 25 bp, Mus musculus
ttaacagcacagattctaccagtgg

SEQ ID NO: 387563 - DNA, 25 bp, Mus musculus
ttaacagcaggctctctggagtcca

SEQ ID NO: 387564 - DNA, 25 bp, Mus musculus
ttaacagcgttggcctggaacagcc

SEQ ID NO: 387565 - DNA, 25 bp, Mus musculus
ttaacaggccatggatgcccgggta

SEQ ID NO: 387566 - DNA, 25 bp, Mus musculus
ttaacagtgatgctgatgagtgcct

SEQ ID NO: 387567 - DNA, 25 bp, Mus musculus
ttaacagtgatgctggacaccgcct

SEQ ID NO: 387568 - DNA, 25 bp, Mus musculus
ttaacatgaaggaccttctgtcatt

SEQ ID NO: 387569 - DNA, 25 bp, Mus musculus
ttaacatgaaggttcttccagcacc

SEQ ID NO: 387570 - DNA, 25 bp, Mus musculus
ttaacatgagctttctgctcaacag

SEQ ID NO: 387571 - DNA, 25 bp, Mus musculus
ttaacatgaggtctatccaggaaaa

SEQ ID NO: 387572 - DNA, 25 bp, Mus musculus
ttaacatggagatgagtgtgaatgt

SEQ ID NO: 387573 - DNA, 25 bp, Mus musculus
ttaacatggaggaccctctgtcatt

SEQ ID NO: 387574 - DNA, 25 bp, Mus musculus
ttaacattgggcctaacaggcctac

SEQ ID NO: 387575 - DNA, 25 bp, Mus musculus
ttaacattggggtggccttgcacgc

SEQ ID NO: 387576 - DNA, 25 bp, Mus musculus
ttaacatttacagctcccctctcca

SEQ ID NO: 387577 - DNA, 25 bp, Mus musculus
ttaaccaaagaggatatagatctga

SEQ ID NO: 387578 - DNA, 25 bp, Mus musculus
ttaaccaacaacctccagagtcttc

SEQ ID NO: 387579 - DNA, 25 bp, Mus musculus
ttaaccacagatttattctgtgatg

SEQ ID NO: 387580 - DNA, 25 bp, Mus musculus
ttaaccacagatttcacctgggcca

SEQ ID NO: 387581 - DNA, 25 bp, Mus musculus
ttaaccagaaaggtgatctgtaaat

SEQ ID NO: 387582 - DNA, 25 bp, Mus musculus
ttaaccattcaaaatgtaggccgct

SEQ ID NO: 387583 - DNA, 25 bp, Mus musculus
ttaacccacagacaaggaatatgtg

SEQ ID NO: 387584 - DNA, 25 bp, Mus musculus
ttaacccccctaagggcagcagcaa

SEQ ID NO: 387585 - DNA, 25 bp, Mus musculus
ttaaccctgcaactgatgagatgcg

SEQ ID NO: 387586 - DNA, 25 bp, Mus musculus
ttaacccttggagtaaaaatggctt

SEQ ID NO: 387587 - DNA, 25 bp, Mus musculus
ttaaccgtgagataccagagagctg

SEQ ID NO: 387588 - DNA, 25 bp, Mus musculus
ttaacctagagcgggtgactgagat

SEQ ID NO: 387589 - DNA, 25 bp, Mus musculus
ttaacctgagaaatgccaaccaaaa

SEQ ID NO: 387590 - DNA, 25 bp, Mus musculus
ttaacctgggggcagccgaggaagt

SEQ ID NO: 387591 - DNA, 25 bp, Mus musculus
ttaacctttggtgctttacatggtg

SEQ ID NO: 387592 - DNA, 25 bp, Mus musculus
ttaacgccaaggtaaacgatgatgt

SEQ ID NO: 387593 - DNA, 25 bp, Mus musculus
ttaacgctcgatgcggccaaagaga

SEQ ID NO: 387594 - DNA, 25 bp, Mus musculus
ttaacgctcgatgcgggtggtagga

SEQ ID NO: 387595 - DNA, 25 bp, Mus musculus
ttaacgctcgatgcgttcacaatct

SEQ ID NO: 387596 - DNA, 25 bp, Mus musculus
ttaacggagagggcggcgaagagga

SEQ ID NO: 387597 - DNA, 25 bp, Mus musculus
ttaacggagatgagaaggccactaa

SEQ ID NO: 387598 - DNA, 25 bp, Mus musculus
ttaacggtgtgcagttcatggaccg

SEQ ID NO: 387599 - DNA, 25 bp, Mus musculus
ttaacgtcggctgcccgctttgagc

SEQ ID NO: 387600 - DNA, 25 bp, Mus musculus
ttaactaatggcagttggatcctcc

SEQ ID NO: 387601 - DNA, 25 bp, Mus musculus
ttaactaccaagcatctatatttgc

SEQ ID NO: 387602 - DNA, 25 bp, Mus musculus
ttaactctgaagaaggctccttccc

SEQ ID NO: 387603 - DNA, 25 bp, Mus musculus
ttaactgacacgagtgcgcaaactt

SEQ ID NO: 387604 - DNA, 25 bp, Mus musculus
ttaactgacacgcaacagatagtaa

SEQ ID NO: 387605 - DNA, 25 bp, Mus musculus
ttaactgacacggtaagtcttcttt

SEQ ID NO: 387606 - DNA, 25 bp, Mus musculus
ttaactgactagatcttgatatgga

SEQ ID NO: 387607 - DNA, 25 bp, Mus musculus
ttaactgagcatgagcttttatggg

SEQ ID NO: 387608 - DNA, 25 bp, Mus musculus
ttaactgagcatgaggtctcagaca

SEQ ID NO: 387609 - DNA, 25 bp, Mus musculus
ttaactgcattttaggagtgcatgc

SEQ ID NO: 387610 - DNA, 25 bp, Mus musculus
ttaactgccagatggttcttcgtgg

SEQ ID NO: 387611 - DNA, 25 bp, Mus musculus
ttaactggaaagaatgtcttgattg

SEQ ID NO: 387612 - DNA, 25 bp, Mus musculus
ttaactggaaaggatataattgaca

SEQ ID NO: 387613 - DNA, 25 bp, Mus musculus
ttaactggagttggtcgaattatgt

SEQ ID NO: 387614 - DNA, 25 bp, Mus musculus
ttaactggtatgatcctcatgggtg

SEQ ID NO: 387615 - DNA, 25 bp, Mus musculus
ttaactgtgagtggacatcatcgaa

SEQ ID NO: 387616 - DNA, 25 bp, Mus musculus
ttaacttaaaagatactgagagaag

SEQ ID NO: 387617 - DNA, 25 bp, Mus musculus
ttaacttaaaagatgattcataata

SEQ ID NO: 387618 - DNA, 25 bp, Mus musculus
ttaacttaacagcaggctctctgga

SEQ ID NO: 387619 - DNA, 25 bp, Mus musculus
ttaacttaatgtttgaaatgccctt

SEQ ID NO: 387620 - DNA, 25 bp, Mus musculus
ttaacttacaacaacctgaaggagc

SEQ ID NO: 387621 - DNA, 25 bp, Mus musculus
ttaacttagaggaggcacagacccc

SEQ ID NO: 387622 - DNA, 25 bp, Mus musculus
ttaacttcagcaaggaccataattt

SEQ ID NO: 387623 - DNA, 25 bp, Mus musculus
ttaacttcaggaaattcactgaggg

SEQ ID NO: 387624 - DNA, 25 bp, Mus musculus
ttaacttgaaggtagaagacttttt

SEQ ID NO: 387625 - DNA, 25 bp, Mus musculus
ttaactttagcccagaaactaggcc

SEQ ID NO: 387626 - DNA, 25 bp, Mus musculus
ttaactttaggtgctgctttcctgc

SEQ ID NO: 387627 - DNA, 25 bp, Mus musculus
ttaactttcatagatcctgaagggt

SEQ ID NO: 387628 - DNA, 25 bp, Mus musculus
ttaagaaaagcagccactggagagg

SEQ ID NO: 387629 - DNA, 25 bp, Mus musculus
ttaagaaacaaacggctcttgctga

SEQ ID NO: 387630 - DNA, 25 bp, Mus musculus
ttaagaaacggagccagctgtggat

SEQ ID NO: 387631 - DNA, 25 bp, Mus musculus
ttaagaaagctggacctgggctgaa

SEQ ID NO: 387632 - DNA, 25 bp, Mus musculus
ttaagaaatatgaagacactccagc

SEQ ID NO: 387633 - DNA, 25 bp, Mus musculus
ttaagaaatgctgcggcaccattat

SEQ ID NO: 387634 - DNA, 25 bp, Mus musculus
ttaagaacaaggacaacatccacgc

SEQ ID NO: 387635 - DNA, 25 bp, Mus musculus
ttaagaacaagtactgaaagtgctg

SEQ ID NO: 387636 - DNA, 25 bp, Mus musculus
ttaagaacacgcaagacagcagtcc

SEQ ID NO: 387637 - DNA, 25 bp, Mus musculus
ttaagaacacgcaagggtgagatct

SEQ ID NO: 387638 - DNA, 25 bp, Mus musculus
ttaagaacagacatcatgatcggga

SEQ ID NO: 387639 - DNA, 25 bp, Mus musculus
ttaagaagaaagcagcacacacagg

SEQ ID NO: 387640 - DNA, 25 bp, Mus musculus
ttaagaagaaaggactgacagacga

SEQ ID NO: 387641 - DNA, 25 bp, Mus musculus
ttaagaagatttaccactcggccct

SEQ ID NO: 387642 - DNA, 25 bp, Mus musculus
ttaagaaggcaaatgctatgctgga

SEQ ID NO: 387643 - DNA, 25 bp, Mus musculus
ttaagaatgaggtggcgagtgggat

SEQ ID NO: 387644 - DNA, 25 bp, Mus musculus
ttaagaattccttgaatccgacgtg

SEQ ID NO: 387645 - DNA, 25 bp, Mus musculus
ttaagaattccttgatccaaacgca

SEQ ID NO: 387646 - DNA, 25 bp, Mus musculus
ttaagacaaaattagagaggaggaa

SEQ ID NO: 387647 - DNA, 25 bp, Mus musculus
ttaagacaaaattagtccatttcag

SEQ ID NO: 387648 - DNA, 25 bp, Mus musculus
ttaagacaatcagggcaagaaaatt

SEQ ID NO: 387649 - DNA, 25 bp, Mus musculus
ttaagacataggtggcaggatccaa

SEQ ID NO: 387650 - DNA, 25 bp, Mus musculus
ttaagacattagaagatctcaggaa

SEQ ID NO: 387651 - DNA, 25 bp, Mus musculus
ttaagaccagagtagcttatctaca

SEQ ID NO: 387652 - DNA, 25 bp, Mus musculus
ttaagaccattcaaatccctgagca

SEQ ID NO: 387653 - DNA, 25 bp, Mus musculus
ttaagacgaagatggccaagctgcg

SEQ ID NO: 387654 - DNA, 25 bp, Mus musculus
ttaagacgaagggcaaggaggcccc

SEQ ID NO: 387655 - DNA, 25 bp, Mus musculus
ttaagacgtcagataatcaaattaa

SEQ ID NO: 387656 - DNA, 25 bp, Mus musculus
ttaagactggcctgctgcaaaaatg

SEQ ID NO: 387657 - DNA, 25 bp, Mus musculus
ttaagagaaaaaagaatggaatggc

SEQ ID NO: 387658 - DNA, 25 bp, Mus musculus
ttaagagaaaaaagatttgatgttg

SEQ ID NO: 387659 - DNA, 25 bp, Mus musculus
ttaagagaaggtgttaggagtggat

SEQ ID NO: 387660 - DNA, 25 bp, Mus musculus
ttaagaggaaaaagcgaccagctac

SEQ ID NO: 387661 - DNA, 25 bp, Mus musculus
ttaagaggaggtccttgttcaccaa

SEQ ID NO: 387662 - DNA, 25 bp, Mus musculus
ttaagataggaggctccctgctatg

SEQ ID NO: 387663 - DNA, 25 bp, Mus musculus
ttaagattgtctggagatggctgca

SEQ ID NO: 387664 - DNA, 25 bp, Mus musculus
ttaagatttggaagatggagaactc

SEQ ID NO: 387665 - DNA, 25 bp, Mus musculus
ttaagatttggaagggtggatgtca

SEQ ID NO: 387666 - DNA, 25 bp, Mus musculus
ttaagatttggaagtcaagaagttt

SEQ ID NO: 387667 - DNA, 25 bp, Mus musculus
ttaagcaagtgcaagcaatagctgt

SEQ ID NO: 387668 - DNA, 25 bp, Mus musculus
ttaagcaagtgcaaggcaaaggcag

SEQ ID NO: 387669 - DNA, 25 bp, Mus musculus
ttaagcaagtgcaaggtttctgaaa

SEQ ID NO: 387670 - DNA, 25 bp, Mus musculus
ttaagcaatgtcaggcgtccgacct

SEQ ID NO: 387671 - DNA, 25 bp, Mus musculus
ttaagcaattgcaggactctgatgg

SEQ ID NO: 387672 - DNA, 25 bp, Mus musculus
ttaagcacagaaggtgggactgggc

SEQ ID NO: 387673 - DNA, 25 bp, Mus musculus
ttaagcagagcaagatctggtgctt

SEQ ID NO: 387674 - DNA, 25 bp, Mus musculus
ttaagcatttcaagacccactccct

SEQ ID NO: 387675 - DNA, 25 bp, Mus musculus
ttaagcatttcaaggagaaataccc

SEQ ID NO: 387676 - DNA, 25 bp, Mus musculus
ttaagcatttcaagggtctcatata

SEQ ID NO: 387677 - DNA, 25 bp, Mus musculus
ttaagccacgaggaaagcgtcatca

SEQ ID NO: 387678 - DNA, 25 bp, Mus musculus
ttaagccagaggcaatgggctctgg

SEQ ID NO: 387679 - DNA, 25 bp, Mus musculus
ttaagccagggtcagactcagtcac

SEQ ID NO: 387680 - DNA, 25 bp, Mus musculus
ttaagccagggtttgcagagcagtc

SEQ ID NO: 387681 - DNA, 25 bp, Mus musculus
ttaagcccaggtgttcatgaagcct

SEQ ID NO: 387682 - DNA, 25 bp, Mus musculus
ttaagccccaggagccctcccaggc

SEQ ID NO: 387683 - DNA, 25 bp, Mus musculus
ttaagccgtacagtaagcactaccc

SEQ ID NO: 387684 - DNA, 25 bp, Mus musculus
ttaagctcaggaggcctcctgatga

SEQ ID NO: 387685 - DNA, 25 bp, Mus musculus
ttaagctcttacaggcaccaacaga

SEQ ID NO: 387686 - DNA, 25 bp, Mus musculus
ttaaggaacaggctttcatgctgct

SEQ ID NO: 387687 - DNA, 25 bp, Mus musculus
ttaaggaactctttgggcctgcctt

SEQ ID NO: 387688 - DNA, 25 bp, Mus musculus
ttaaggaactgaaggagtctttgtc

SEQ ID NO: 387689 - DNA, 25 bp, Mus musculus
ttaaggacaaagcagaaaatggatc

SEQ ID NO: 387690 - DNA, 25 bp, Mus musculus
ttaaggacaaagcagacgttgattc

SEQ ID NO: 387691 - DNA, 25 bp, Mus musculus
ttaaggagagagctttccctcctcc

SEQ ID NO: 387692 - DNA, 25 bp, Mus musculus
ttaaggagagaggagcaagtgtcgt

SEQ ID NO: 387693 - DNA, 25 bp, Mus musculus
ttaaggagagctaacatttagagga

SEQ ID NO: 387694 - DNA, 25 bp, Mus musculus
ttaaggagagctcacattcaggggt

SEQ ID NO: 387695 - DNA, 25 bp, Mus musculus
ttaaggatatcgatggccgccctgt

SEQ ID NO: 387696 - DNA, 25 bp, Mus musculus
ttaaggatccggatggagcttttaa

SEQ ID NO: 387697 - DNA, 25 bp, Mus musculus
ttaaggatccggatgggtatagtgc

SEQ ID NO: 387698 - DNA, 25 bp, Mus musculus
ttaaggatggaaagaaagatctgat

SEQ ID NO: 387699 - DNA, 25 bp, Mus musculus
ttaaggatggaaagagcttaacaaa

SEQ ID NO: 387700 - DNA, 25 bp, Mus musculus
ttaaggatgtggtccttctggcttc

SEQ ID NO: 387701 - DNA, 25 bp, Mus musculus
ttaaggatttcctgattccacgagg

SEQ ID NO: 387702 - DNA, 25 bp, Mus musculus
ttaaggccaaaaatgtcagcagcta

SEQ ID NO: 387703 - DNA, 25 bp, Mus musculus
ttaagggacagcaaggagtccgtgg

SEQ ID NO: 387704 - DNA, 25 bp, Mus musculus
ttaagggcgagatgagcaaccctgg

SEQ ID NO: 387705 - DNA, 25 bp, Mus musculus
ttaaggggagagctcctgctttctg

SEQ ID NO: 387706 - DNA, 25 bp, Mus musculus
ttaaggggagaggaagctttgtctc

SEQ ID NO: 387707 - DNA, 25 bp, Mus musculus
ttaaggtctggctcagtttatgaac

SEQ ID NO: 387708 - DNA, 25 bp, Mus musculus
ttaagtacagaagatctaaagcggg

SEQ ID NO: 387709 - DNA, 25 bp, Mus musculus
ttaagtacatggcgcagcagcagtt

SEQ ID NO: 387710 - DNA, 25 bp, Mus musculus
ttaagtagaagaactatactatgca

SEQ ID NO: 387711 - DNA, 25 bp, Mus musculus
ttaagtatttgatgctggagaagcg

SEQ ID NO: 387712 - DNA, 25 bp, Mus musculus
ttaagtatttggctcagtgtttaga

SEQ ID NO: 387713 - DNA, 25 bp, Mus musculus
ttaagtccagatctgatgaacacaa

SEQ ID NO: 387714 - DNA, 25 bp, Mus musculus
ttaagtcgttgacaggaaagagtag

SEQ ID NO: 387715 - DNA, 25 bp, Mus musculus
ttaagtgaggacaggcttttgattg

SEQ ID NO: 387716 - DNA, 25 bp, Mus musculus
ttaagttcaggtcagaggaacgccc

SEQ ID NO: 387717 - DNA, 25 bp, Mus musculus
ttaagttccagtggtaactcataaa

SEQ ID NO: 387718 - DNA, 25 bp, Mus musculus
ttaagtttatgaattcctcagagag

SEQ ID NO: 387719 - DNA, 25 bp, Mus musculus
ttaagtttatggctgcagttccggc

SEQ ID NO: 387720 - DNA, 25 bp, Mus musculus
ttaagtttatgtgctctatgcccag

SEQ ID NO: 387721 - DNA, 25 bp, Mus musculus
ttaataaaaagacctcacagtggat

SEQ ID NO: 387722 - DNA, 25 bp, Mus musculus
ttaataaagaagatatgcacctatt

SEQ ID NO: 387723 - DNA, 25 bp, Mus musculus
ttaataacagaagaaattaaagaga

SEQ ID NO: 387724 - DNA, 25 bp, Mus musculus
ttaataacgtaacgcccggccacac

SEQ ID NO: 387725 - DNA, 25 bp, Mus musculus
ttaataactggcatcctcgtgtaca

SEQ ID NO: 387726 - DNA, 25 bp, Mus musculus
ttaatacaaaagaagttattttagc

SEQ ID NO: 387727 - DNA, 25 bp, Mus musculus
ttaatacagatactgggagtccttt

SEQ ID NO: 387728 - DNA, 25 bp, Mus musculus
ttaatacagatacttgtggcaatat

SEQ ID NO: 387729 - DNA, 25 bp, Mus musculus
ttaatactgcttaagtatttttctg

SEQ ID NO: 387730 - DNA, 25 bp, Mus musculus
ttaatagcagagggctaccgtgtga

SEQ ID NO: 387731 - DNA, 25 bp, Mus musculus
ttaatagctctcaggtcaactcctg

SEQ ID NO: 387732 - DNA, 25 bp, Mus musculus
ttaatagtgaggtagaggaggcttc

SEQ ID NO: 387733 - DNA, 25 bp, Mus musculus
ttaatataaacaacttccattcgaa

SEQ ID NO: 387734 - DNA, 25 bp, Mus musculus
ttaatatatgatcctgaaaaagccg

SEQ ID NO: 387735 - DNA, 25 bp, Mus musculus
ttaatatcaaggtactgtctgatga

SEQ ID NO: 387736 - DNA, 25 bp, Mus musculus
ttaatatcagaagtttcagtctgga

SEQ ID NO: 387737 - DNA, 25 bp, Mus musculus
ttaatattaaagagtccttcactcg

SEQ ID NO: 387738 - DNA, 25 bp, Mus musculus
ttaatcaacagattcaaggcctctt

SEQ ID NO: 387739 - DNA, 25 bp, Mus musculus
ttaatcacaaaaatataattggcct

SEQ ID NO: 387740 - DNA, 25 bp, Mus musculus
ttaatcaccaaggtcacgtgaaact

SEQ ID NO: 387741 - DNA, 25 bp, Mus musculus
ttaatcaccccatcggtgtagcccg

SEQ ID NO: 387742 - DNA, 25 bp, Mus musculus
ttaatcagttcaagtctgttatctc

SEQ ID NO: 387743 - DNA, 25 bp, Mus musculus
ttaatcatgctcggatcaagcaaat

SEQ ID NO: 387744 - DNA, 25 bp, Mus musculus
ttaatcatgctcggctatctgcacc

SEQ ID NO: 387745 - DNA, 25 bp, Mus musculus
ttaatcatgtcacagcgtctgttga

SEQ ID NO: 387746 - DNA, 25 bp, Mus musculus
ttaatcatgtcacagggcagcaagt

SEQ ID NO: 387747 - DNA, 25 bp, Mus musculus
ttaatccacaacagtgagaggactt

SEQ ID NO: 387748 - DNA, 25 bp, Mus musculus
ttaatccaggaagcatttgtcaagg

SEQ ID NO: 387749 - DNA, 25 bp, Mus musculus
ttaatcccacaggctctgttgtcat

SEQ ID NO: 387750 - DNA, 25 bp, Mus musculus
ttaatcccttctcctgagctacata

SEQ ID NO: 387751 - DNA, 25 bp, Mus musculus
ttaatcctgaacaggatgctgccag

SEQ ID NO: 387752 - DNA, 25 bp, Mus musculus
ttaatctgaaggggagaaaactggt

SEQ ID NO: 387753 - DNA, 25 bp, Mus musculus
ttaatctgagaggccagtcaccact

SEQ ID NO: 387754 - DNA, 25 bp, Mus musculus
ttaatcttcatcaagtcacagtaat

SEQ ID NO: 387755 - DNA, 25 bp, Mus musculus
ttaatcttccttcctactagacgtg

SEQ ID NO: 387756 - DNA, 25 bp, Mus musculus
ttaatgaaaagtatttttctgacct

SEQ ID NO: 387757 - DNA, 25 bp, Mus musculus
ttaatgaaacccacagcactggtca

SEQ ID NO: 387758 - DNA, 25 bp, Mus musculus
ttaatgaactaaagcttgacaaaaa

SEQ ID NO: 387759 - DNA, 25 bp, Mus musculus
ttaatgaaggaatggtcacgatcta

SEQ ID NO: 387760 - DNA, 25 bp, Mus musculus
ttaatgacaaattaaaagagatgtt

SEQ ID NO: 387761 - DNA, 25 bp, Mus musculus
ttaatgacgctgaggttttatataa

SEQ ID NO: 387762 - DNA, 25 bp, Mus musculus
ttaatgacgctggtgaaatacagga

SEQ ID NO: 387763 - DNA, 25 bp, Mus musculus
ttaatgactggttaggaaacctgcc

SEQ ID NO: 387764 - DNA, 25 bp, Mus musculus
ttaatgagaagggagccttctgggg

SEQ ID NO: 387765 - DNA, 25 bp, Mus musculus
ttaatgagatcctcacattagcttt

SEQ ID NO: 387766 - DNA, 25 bp, Mus musculus
ttaatgagcgactggtctgtgagtt

SEQ ID NO: 387767 - DNA, 25 bp, Mus musculus
ttaatgagctacccatgacatcagc

SEQ ID NO: 387768 - DNA, 25 bp, Mus musculus
ttaatgaggaaagactaatagacaa

SEQ ID NO: 387769 - DNA, 25 bp, Mus musculus
ttaatgaggaaggcttgttgtcatc

SEQ ID NO: 387770 - DNA, 25 bp, Mus musculus
ttaatgaggggtattcagagtgggc

SEQ ID NO: 387771 - DNA, 25 bp, Mus musculus
ttaatgagtaagtggcttgcagcgt

SEQ ID NO: 387772 - DNA, 25 bp, Mus musculus
ttaatgatccagattatatcagaat

SEQ ID NO: 387773 - DNA, 25 bp, Mus musculus
ttaatgatccggaccttcgagaagt

SEQ ID NO: 387774 - DNA, 25 bp, Mus musculus
ttaatgatgaagatgcagatagact

SEQ ID NO: 387775 - DNA, 25 bp, Mus musculus
ttaatgcaagagagatgctgaggat

SEQ ID NO: 387776 - DNA, 25 bp, Mus musculus
ttaatgcactagcaggtatggcggc

SEQ ID NO: 387777 - DNA, 25 bp, Mus musculus
ttaatgcactagcagttgctcaaat

SEQ ID NO: 387778 - DNA, 25 bp, Mus musculus
ttaatgcagctaaagatgaacatga

SEQ ID NO: 387779 - DNA, 25 bp, Mus musculus
ttaatgcagttctcgttgtgaaaat

SEQ ID NO: 387780 - DNA, 25 bp, Mus musculus
ttaatgcatcatttgaacaatgccc

SEQ ID NO: 387781 - DNA, 25 bp, Mus musculus
ttaatgcatcatttgactgaggacc

SEQ ID NO: 387782 - DNA, 25 bp, Mus musculus
ttaatgccatttagttcgctacacc

SEQ ID NO: 387783 - DNA, 25 bp, Mus musculus
ttaatgcggttacgaagaagaggaa

SEQ ID NO: 387784 - DNA, 25 bp, Mus musculus
ttaatgctgaggccgggataactgg

SEQ ID NO: 387785 - DNA, 25 bp, Mus musculus
ttaatgctgtaggcaccagacctgt

SEQ ID NO: 387786 - DNA, 25 bp, Mus musculus
ttaatggaacagatggcagtgaaaa

SEQ ID NO: 387787 - DNA, 25 bp, Mus musculus
ttaatggagcaaggtgtccatgttg

SEQ ID NO: 387788 - DNA, 25 bp, Mus musculus
ttaatggaggccaggaaaacggcaa

SEQ ID NO: 387789 - DNA, 25 bp, Mus musculus
ttaatggatgcaggggtcccaattt

SEQ ID NO: 387790 - DNA, 25 bp, Mus musculus
ttaatggatgcaggtgtagcagtgg

SEQ ID NO: 387791 - DNA, 25 bp, Mus musculus
ttaatggcacaagaacaagtaagaa

SEQ ID NO: 387792 - DNA, 25 bp, Mus musculus
ttaatggcacagacgcagcctcctt

SEQ ID NO: 387793 - DNA, 25 bp, Mus musculus
ttaatggcggagaggtattagaaga

SEQ ID NO: 387794 - DNA, 25 bp, Mus musculus
ttaatggcggagaggtgttctctga

SEQ ID NO: 387795 - DNA, 25 bp, Mus musculus
ttaatggggcccaaattcattggtg

SEQ ID NO: 387796 - DNA, 25 bp, Mus musculus
ttaatgggtctggttctccacatga

SEQ ID NO: 387797 - DNA, 25 bp, Mus musculus
ttaatggttgctctctgaaaactga

SEQ ID NO: 387798 - DNA, 25 bp, Mus musculus
ttaatgtaccagctcaaacaggccg

SEQ ID NO: 387799 - DNA, 25 bp, Mus musculus
ttaatgtaccagtgtatctctatgg

SEQ ID NO: 387800 - DNA, 25 bp, Mus musculus
ttaatgtagaaaagattaatgggga

SEQ ID NO: 387801 - DNA, 25 bp, Mus musculus
ttaatgtagaaagattaatggggaa

SEQ ID NO: 387802 - DNA, 25 bp, Mus musculus
ttaatgtagaacagattagtgggta

SEQ ID NO: 387803 - DNA, 25 bp, Mus musculus
ttaatgtatcggaggacaccaaagt

SEQ ID NO: 387804 - DNA, 25 bp, Mus musculus
ttaatgtcagccataacaaactgaa

SEQ ID NO: 387805 - DNA, 25 bp, Mus musculus
ttaatgtccaagccatgtacatagt

SEQ ID NO: 387806 - DNA, 25 bp, Mus musculus
ttaatgtggcagatatcattaatgg

SEQ ID NO: 387807 - DNA, 25 bp, Mus musculus
ttaatgttagagagaatggactgct

SEQ ID NO: 387808 - DNA, 25 bp, Mus musculus
ttaatgttggaggacctggataagg

SEQ ID NO: 387809 - DNA, 25 bp, Mus musculus
ttaatgttggaggatttagacaaga

SEQ ID NO: 387810 - DNA, 25 bp, Mus musculus
ttaatgtttgtgtgtctaaacagca

SEQ ID NO: 387811 - DNA, 25 bp, Mus musculus
ttaatgttttaagttcctgaatgcc

SEQ ID NO: 387812 - DNA, 25 bp, Mus musculus
ttaattaaaattcagcctttagaaa

SEQ ID NO: 387813 - DNA, 25 bp, Mus musculus
ttaattaaaattcaggctgtagctg

SEQ ID NO: 387814 - DNA, 25 bp, Mus musculus
ttaattaccaacgattgaaaaatgc

SEQ ID NO: 387815 - DNA, 25 bp, Mus musculus
ttaattacgccacttatggatgtag

SEQ ID NO: 387816 - DNA, 25 bp, Mus musculus
ttaattagaggaggttcgccttcgc

SEQ ID NO: 387817 - DNA, 25 bp, Mus musculus
ttaattcaggctcctcatcctaaat

SEQ ID NO: 387818 - DNA, 25 bp, Mus musculus
ttaattcaggctgctcatcctaaat

SEQ ID NO: 387819 - DNA, 25 bp, Mus musculus
ttaattccatatttgatggtagagt

SEQ ID NO: 387820 - DNA, 25 bp, Mus musculus
ttaattcctgaggtaaaggggaatg

SEQ ID NO: 387821 - DNA, 25 bp, Mus musculus
ttaattcctgaggttcttaatatgt

SEQ ID NO: 387822 - DNA, 25 bp, Mus musculus
ttaattctagaaggttttctgtcca

SEQ ID NO: 387823 - DNA, 25 bp, Mus musculus
ttaattctccattgaaatgttgtcc

SEQ ID NO: 387824 - DNA, 25 bp, Mus musculus
ttaattgacagattagctttatttg

SEQ ID NO: 387825 - DNA, 25 bp, Mus musculus
ttaattgagaaggcatacaaatgct

SEQ ID NO: 387826 - DNA, 25 bp, Mus musculus
ttaattgctacctcaggctctgacc

SEQ ID NO: 387827 - DNA, 25 bp, Mus musculus
ttaattgctggccttcgttttcaca

SEQ ID NO: 387828 - DNA, 25 bp, Mus musculus
ttaattggggaagcgagccctgaag

SEQ ID NO: 387829 - DNA, 25 bp, Mus musculus
ttaattggggaagcggtaggtgcac

SEQ ID NO: 387830 - DNA, 25 bp, Mus musculus
ttaatttcagcaagaggaatatcct

SEQ ID NO: 387831 - DNA, 25 bp, Mus musculus
ttaatttccagcaagcttgagtcta

SEQ ID NO: 387832 - DNA, 25 bp, Mus musculus
ttaatttccagcaagtaccaggaat

SEQ ID NO: 387833 - DNA, 25 bp, Mus musculus
ttaatttccgagtggacaagattac

SEQ ID NO: 387834 - DNA, 25 bp, Mus musculus
ttaatttgaagggtgattcagaagt

SEQ ID NO: 387835 - DNA, 25 bp, Mus musculus
ttaattttagctgaaccaataacgt

SEQ ID NO: 387836 - DNA, 25 bp, Mus musculus
ttacaaaatgagacctgggcggccc

SEQ ID NO: 387837 - DNA, 25 bp, Mus musculus
ttacaaacagtggccagtttcactg

SEQ ID NO: 387838 - DNA, 25 bp, Mus musculus
ttacaaactaaaggctatggtcatg

SEQ ID NO: 387839 - DNA, 25 bp, Mus musculus
ttacaaactgagtagcactcagcat

SEQ ID NO: 387840 - DNA, 25 bp, Mus musculus
ttacaaagatgacagcaaaaatgta

SEQ ID NO: 387841 - DNA, 25 bp, Mus musculus
ttacaaagatgacagcaaacataaa

SEQ ID NO: 387842 - DNA, 25 bp, Mus musculus
ttacaaagtagctcaaccgaagaac

SEQ ID NO: 387843 - DNA, 25 bp, Mus musculus
ttacaaatacgatacactaaagatt

SEQ ID NO: 387844 - DNA, 25 bp, Mus musculus
ttacaaatacggtacccatgtgaaa

SEQ ID NO: 387845 - DNA, 25 bp, Mus musculus
ttacaaatatgtggggatgatcctt

SEQ ID NO: 387846 - DNA, 25 bp, Mus musculus
ttacaaatatgtggggtacgatctt

SEQ ID NO: 387847 - DNA, 25 bp, Mus musculus
ttacaaatcaggagtatacaagcat

SEQ ID NO: 387848 - DNA, 25 bp, Mus musculus
ttacaaatgaacagctctggagtgc

SEQ ID NO: 387849 - DNA, 25 bp, Mus musculus
ttacaaatgaacaggcctattcctg

SEQ ID NO: 387850 - DNA, 25 bp, Mus musculus
ttacaaatgaacaggtgtgcggacc

SEQ ID NO: 387851 - DNA, 25 bp, Mus musculus
ttacaacaaaaggccaactactcaa

SEQ ID NO: 387852 - DNA, 25 bp, Mus musculus
ttacaacaacctgaaggagctccac

SEQ ID NO: 387853 - DNA, 25 bp, Mus musculus
ttacaacatgggagaggcagagttt

SEQ ID NO: 387854 - DNA, 25 bp, Mus musculus
ttacaaccagagggcatgaagagat

SEQ ID NO: 387855 - DNA, 25 bp, Mus musculus
ttacaaccagagttttcctccctcg

SEQ ID NO: 387856 - DNA, 25 bp, Mus musculus
ttacaacctcgaggaatcatgcacc

SEQ ID NO: 387857 - DNA, 25 bp, Mus musculus
ttacaactaccagaacaatgaaaag

SEQ ID NO: 387858 - DNA, 25 bp, Mus musculus
ttacaactaccagattatccagctg

SEQ ID NO: 387859 - DNA, 25 bp, Mus musculus
ttacaactaccaggcaggacccgac

SEQ ID NO: 387860 - DNA, 25 bp, Mus musculus
ttacaactaggccagatttacctta

SEQ ID NO: 387861 - DNA, 25 bp, Mus musculus
ttacaactaggccagctgctcagcc

SEQ ID NO: 387862 - DNA, 25 bp, Mus musculus
ttacaagaagacttgcctaacgata

SEQ ID NO: 387863 - DNA, 25 bp, Mus musculus
ttacaagaagagtaccagcctcact

SEQ ID NO: 387864 - DNA, 25 bp, Mus musculus
ttacaagaagatgaccgcggagggc

SEQ ID NO: 387865 - DNA, 25 bp, Mus musculus
ttacaagaaggatgagaacaagttg

SEQ ID NO: 387866 - DNA, 25 bp, Mus musculus
ttacaagaccataccactctcctcc

SEQ ID NO: 387867 - DNA, 25 bp, Mus musculus
ttacaagaccatgtttatgtctggg

SEQ ID NO: 387868 - DNA, 25 bp, Mus musculus
ttacaagataaagctcacttcaatt

SEQ ID NO: 387869 - DNA, 25 bp, Mus musculus
ttacaagatagcgggacacggctct

SEQ ID NO: 387870 - DNA, 25 bp, Mus musculus
ttacaagcatgagggacaaagcccc

SEQ ID NO: 387871 - DNA, 25 bp, Mus musculus
ttacaagcgggatctctaccagaag

SEQ ID NO: 387872 - DNA, 25 bp, Mus musculus
ttacaaggaagggcaaatgacttgg

SEQ ID NO: 387873 - DNA, 25 bp, Mus musculus
ttacaaggacagcaaggtggtgtgg

SEQ ID NO: 387874 - DNA, 25 bp, Mus musculus
ttacaaggacatatggagattacca

SEQ ID NO: 387875 - DNA, 25 bp, Mus musculus
ttacaagggattccagtactagtac

SEQ ID NO: 387876 - DNA, 25 bp, Mus musculus
ttacaagtggatgaacagccagtcc

SEQ ID NO: 387877 - DNA, 25 bp, Mus musculus
ttacaagtgtaaagtagtcgccggg

SEQ ID NO: 387878 - DNA, 25 bp, Mus musculus
ttacaagtgtgaggactgtgggaaa

SEQ ID NO: 387879 - DNA, 25 bp, Mus musculus
ttacaataaccagtctgtgaaccta

SEQ ID NO: 387880 - DNA, 25 bp, Mus musculus
ttacaataagattacatctcgctta

SEQ ID NO: 387881 - DNA, 25 bp, Mus musculus
ttacaatccggaaccagctattgca

SEQ ID NO: 387882 - DNA, 25 bp, Mus musculus
ttacaatccggtggcgtccccttga

SEQ ID NO: 387883 - DNA, 25 bp, Mus musculus
ttacaatcttaaaggggcaagcgga

SEQ ID NO: 387884 - DNA, 25 bp, Mus musculus
ttacaatgcaagaaatcctaccttg

SEQ ID NO: 387885 - DNA, 25 bp, Mus musculus
ttacaatgcagagactgatgaagta

SEQ ID NO: 387886 - DNA, 25 bp, Mus musculus
ttacaatgcagagagtgacctcagt

SEQ ID NO: 387887 - DNA, 25 bp, Mus musculus
ttacaatgggagatgatggcccttc

SEQ ID NO: 387888 - DNA, 25 bp, Mus musculus
ttacaatgggaggtgctggatagtt

SEQ ID NO: 387889 - DNA, 25 bp, Mus musculus
ttacaatgggagtgaacacggattc

SEQ ID NO: 387890 - DNA, 25 bp, Mus musculus
ttacaattcctgtacactcacgcct

SEQ ID NO: 387891 - DNA, 25 bp, Mus musculus
ttacaattgagaccaggccatgctc

SEQ ID NO: 387892 - DNA, 25 bp, Mus musculus
ttacacaaacagatctttgagggga

SEQ ID NO: 387893 - DNA, 25 bp, Mus musculus
ttacacaaacagtcaaagcagtcct

SEQ ID NO: 387894 - DNA, 25 bp, Mus musculus
ttacacaaagcagagcaaaaagggg

SEQ ID NO: 387895 - DNA, 25 bp, Mus musculus
ttacacaaagcagggctttgggaat

SEQ ID NO: 387896 - DNA, 25 bp, Mus musculus
ttacacaataatggagtgatagaag

SEQ ID NO: 387897 - DNA, 25 bp, Mus musculus
ttacacacaggctgagggtatcgcc

SEQ ID NO: 387898 - DNA, 25 bp, Mus musculus
ttacacactccctgtcctgttagcc

SEQ ID NO: 387899 - DNA, 25 bp, Mus musculus
ttacacactgcagcaatgcacggct

SEQ ID NO: 387900 - DNA, 25 bp, Mus musculus
ttacacagctgaaggagagactaga

SEQ ID NO: 387901 - DNA, 25 bp, Mus musculus
ttacacagggctgttcaggtgtctc

SEQ ID NO: 387902 - DNA, 25 bp, Mus musculus
ttacacatacagagttcgttatcta

SEQ ID NO: 387903 - DNA, 25 bp, Mus musculus
ttacacatctgaccccagtacatgg

SEQ ID NO: 387904 - DNA, 25 bp, Mus musculus
ttacacatgctattgatctgatgga

SEQ ID NO: 387905 - DNA, 25 bp, Mus musculus
ttacacatgctattgatgcttgctt

SEQ ID NO: 387906 - DNA, 25 bp, Mus musculus
ttacacatgtgcacattttactgtt

SEQ ID NO: 387907 - DNA, 25 bp, Mus musculus
ttacacattgcggatagagacatcg

SEQ ID NO: 387908 - DNA, 25 bp, Mus musculus
ttacacatttttgttgtgaagttat

SEQ ID NO: 387909 - DNA, 25 bp, Mus musculus
ttacaccaagattctgggctaatat

SEQ ID NO: 387910 - DNA, 25 bp, Mus musculus
ttacaccaagcaagaatgtgaaact

SEQ ID NO: 387911 - DNA, 25 bp, Mus musculus
ttacaccaagcaagatcgacatcag

SEQ ID NO: 387912 - DNA, 25 bp, Mus musculus
ttacaccaagtttctgggctaatat

SEQ ID NO: 387913 - DNA, 25 bp, Mus musculus
ttacaccagtggaaggcaaaggctg

SEQ ID NO: 387914 - DNA, 25 bp, Mus musculus
ttacaccatttaagttgctttctga

SEQ ID NO: 387915 - DNA, 25 bp, Mus musculus
ttacacccacgaaatggcaaatccc

SEQ ID NO: 387916 - DNA, 25 bp, Mus musculus
ttacacccagcaatcccaggatcca

SEQ ID NO: 387917 - DNA, 25 bp, Mus musculus
ttacacccgtcaaatatgaataccc

SEQ ID NO: 387918 - DNA, 25 bp, Mus musculus
ttacacgaccagtgcagcccctgga

SEQ ID NO: 387919 - DNA, 25 bp, Mus musculus
ttacacgacccaaggaggcaagtgt

SEQ ID NO: 387920 - DNA, 25 bp, Mus musculus
ttacacgacccaagtggcagcaatg

SEQ ID NO: 387921 - DNA, 25 bp, Mus musculus
ttacactatacagtggtggaagata

SEQ ID NO: 387922 - DNA, 25 bp, Mus musculus
ttacactcttccagacccatgaaaa

SEQ ID NO: 387923 - DNA, 25 bp, Mus musculus
ttacactgacagacagatggggctg

SEQ ID NO: 387924 - DNA, 25 bp, Mus musculus
ttacacttcaacggtctgagcgcaa

SEQ ID NO: 387925 - DNA, 25 bp, Mus musculus
ttacacttcaagatgtttgatgtgg

SEQ ID NO: 387926 - DNA, 25 bp, Mus musculus
ttacagaaaaagaggctcctcaact

SEQ ID NO: 387927 - DNA, 25 bp, Mus musculus
ttacagaaaagggactgatttgctt

SEQ ID NO: 387928 - DNA, 25 bp, Mus musculus
ttacagaaaagggtgtgtttgacgt

SEQ ID NO: 387929 - DNA, 25 bp, Mus musculus
ttacagaaatcgagctgaggaaacg

SEQ ID NO: 387930 - DNA, 25 bp, Mus musculus
ttacagaatgaggccggggacgacc

SEQ ID NO: 387931 - DNA, 25 bp, Mus musculus
ttacagaatggggagcgctctctga

SEQ ID NO: 387932 - DNA, 25 bp, Mus musculus
ttacagaatgtctgcggattatatc

SEQ ID NO: 387933 - DNA, 25 bp, Mus musculus
ttacagaattgcatactgggaccca

SEQ ID NO: 387934 - DNA, 25 bp, Mus musculus
ttacagaattggagttcatagagga

SEQ ID NO: 387935 - DNA, 25 bp, Mus musculus
ttacagaccagtgtgtgccatcccg

SEQ ID NO: 387936 - DNA, 25 bp, Mus musculus
ttacagacgggctgactcctcacta

SEQ ID NO: 387937 - DNA, 25 bp, Mus musculus
ttacagacgggctttgctgttggtg

SEQ ID NO: 387938 - DNA, 25 bp, Mus musculus
ttacagagcagcagaaaattgtcca

SEQ ID NO: 387939 - DNA, 25 bp, Mus musculus
ttacagagcatgaaatgcattgata

SEQ ID NO: 387940 - DNA, 25 bp, Mus musculus
ttacagagctatctaaactctgttc

SEQ ID NO: 387941 - DNA, 25 bp, Mus musculus
ttacagaggaaatccaacagcttcc

SEQ ID NO: 387942 - DNA, 25 bp, Mus musculus
ttacagagtgcaagggtagctaaga

SEQ ID NO: 387943 - DNA, 25 bp, Mus musculus
ttacagagtgcaaggtaaatcttta

SEQ ID NO: 387944 - DNA, 25 bp, Mus musculus
ttacagataaagaggactcacggag

SEQ ID NO: 387945 - DNA, 25 bp, Mus musculus
ttacagataaagaggtgctaggacc

SEQ ID NO: 387946 - DNA, 25 bp, Mus musculus
ttacagataaagagtgtgactggct

SEQ ID NO: 387947 - DNA, 25 bp, Mus musculus
ttacagataaggaactgctgaagaa

SEQ ID NO: 387948 - DNA, 25 bp, Mus musculus
ttacagataaggtgttctcattgtt

SEQ ID NO: 387949 - DNA, 25 bp, Mus musculus
ttacagatccagggagcatggcact

SEQ ID NO: 387950 - DNA, 25 bp, Mus musculus
ttacagatgaccgtgataaaggtga

SEQ ID NO: 387951 - DNA, 25 bp, Mus musculus
ttacagcaaaataggaaacctcgtg

SEQ ID NO: 387952 - DNA, 25 bp, Mus musculus
ttacagcaaaataggacggaaagtt

SEQ ID NO: 387953 - DNA, 25 bp, Mus musculus
ttacagcaaggtgaataaatctgat

SEQ ID NO: 387954 - DNA, 25 bp, Mus musculus
ttacagcaaggtggctcaggagtta

SEQ ID NO: 387955 - DNA, 25 bp, Mus musculus
ttacagcacacaggcagaggtgtta

SEQ ID NO: 387956 - DNA, 25 bp, Mus musculus
ttacagcagcccagtgtcacgagca

SEQ ID NO: 387957 - DNA, 25 bp, Mus musculus
ttacagcagtcactgctggggttcg

SEQ ID NO: 387958 - DNA, 25 bp, Mus musculus
ttacagccacagccacaacctgcgc

SEQ ID NO: 387959 - DNA, 25 bp, Mus musculus
ttacagccagctggctttttctaaa

SEQ ID NO: 387960 - DNA, 25 bp, Mus musculus
ttacagccaggcatgctgagccggc

SEQ ID NO: 387961 - DNA, 25 bp, Mus musculus
ttacagcccaagcagccacctagat

SEQ ID NO: 387962 - DNA, 25 bp, Mus musculus
ttacagctaaagagaatggactcgc

SEQ ID NO: 387963 - DNA, 25 bp, Mus musculus
ttacagctagttcatcactatttca

SEQ ID NO: 387964 - DNA, 25 bp, Mus musculus
ttacagctattgcgtctgcaccagg

SEQ ID NO: 387965 - DNA, 25 bp, Mus musculus
ttacagctcacagaaggacatggct

SEQ ID NO: 387966 - DNA, 25 bp, Mus musculus
ttacagctctttaggtctgaacggc

SEQ ID NO: 387967 - DNA, 25 bp, Mus musculus
ttacagcttcagaagggtcatgttt

SEQ ID NO: 387968 - DNA, 25 bp, Mus musculus
ttacagcttcagcagctctatgccg

SEQ ID NO: 387969 - DNA, 25 bp, Mus musculus
ttacaggaagggtctgcttggtgag

SEQ ID NO: 387970 - DNA, 25 bp, Mus musculus
ttacaggaaggtgtcagacaaagaa

SEQ ID NO: 387971 - DNA, 25 bp, Mus musculus
ttacaggacatgagctactatagaa

SEQ ID NO: 387972 - DNA, 25 bp, Mus musculus
ttacaggacccagagcaagtccaca

SEQ ID NO: 387973 - DNA, 25 bp, Mus musculus
ttacaggagccaggccacagaggat

SEQ ID NO: 387974 - DNA, 25 bp, Mus musculus
ttacaggagctcgagaacttcaagt

SEQ ID NO: 387975 - DNA, 25 bp, Mus musculus
ttacaggaggttgtgccagccattg

SEQ ID NO: 387976 - DNA, 25 bp, Mus musculus
ttacaggatacaaggcaaaaacagc

SEQ ID NO: 387977 - DNA, 25 bp, Mus musculus
ttacaggatagagactaatgctcat

SEQ ID NO: 387978 - DNA, 25 bp, Mus musculus
ttacaggcgagatgatttttgatcc

SEQ ID NO: 387979 - DNA, 25 bp, Mus musculus
ttacagggcaagcttgatgcttgcc

SEQ ID NO: 387980 - DNA, 25 bp, Mus musculus
ttacaggtaaacagggattcgataa

SEQ ID NO: 387981 - DNA, 25 bp, Mus musculus
ttacaggtaatgaagaaggatattt

SEQ ID NO: 387982 - DNA, 25 bp, Mus musculus
ttacagtaacagaggtgataagatt

SEQ ID NO: 387983 - DNA, 25 bp, Mus musculus
ttacagtaacagagttgacagttcc

SEQ ID NO: 387984 - DNA, 25 bp, Mus musculus
ttacagtaagaggtaaagttcaagt

SEQ ID NO: 387985 - DNA, 25 bp, Mus musculus
ttacagtaaggggctccacgggcct

SEQ ID NO: 387986 - DNA, 25 bp, Mus musculus
ttacagtactatggggatgtctgtg

SEQ ID NO: 387987 - DNA, 25 bp, Mus musculus
ttacagtatgtattggatatgatgg

SEQ ID NO: 387988 - DNA, 25 bp, Mus musculus
ttacagtcagaagccggagcctggc

SEQ ID NO: 387989 - DNA, 25 bp, Mus musculus
ttacagtcctagaaaaccaaactgc

SEQ ID NO: 387990 - DNA, 25 bp, Mus musculus
ttacagttaaggaagctgtgctgaa

SEQ ID NO: 387991 - DNA, 25 bp, Mus musculus
ttacagttaagtagtcttttcacag

SEQ ID NO: 387992 - DNA, 25 bp, Mus musculus
ttacagtttcagagtttctaagctg

SEQ ID NO: 387993 - DNA, 25 bp, Mus musculus
ttacagtttgccccggctgaggata

SEQ ID NO: 387994 - DNA, 25 bp, Mus musculus
ttacagtttttggaggcaactgtgc

SEQ ID NO: 387995 - DNA, 25 bp, Mus musculus
ttacataaaagaggaactcattata

SEQ ID NO: 387996 - DNA, 25 bp, Mus musculus
ttacataacccttcggtgacccacc

SEQ ID NO: 387997 - DNA, 25 bp, Mus musculus
ttacatacagccagagaagtgacag

SEQ ID NO: 387998 - DNA, 25 bp, Mus musculus
ttacatacagccaggaaacaaagct

SEQ ID NO: 387999 - DNA, 25 bp, Mus musculus
ttacatacagccaggaaggaatctg

SEQ ID NO: 388000 - DNA, 25 bp, Mus musculus
ttacatactcaagctaccactaccc

SEQ ID NO: 388001 - DNA, 25 bp, Mus musculus
ttacatacttctacactccagaaga

SEQ ID NO: 388002 - DNA, 25 bp, Mus musculus
ttacataggcaaggatagttcatgc

SEQ ID NO: 388003 - DNA, 25 bp, Mus musculus
ttacatataataagaacctatgggc

SEQ ID NO: 388004 - DNA, 25 bp, Mus musculus
ttacatatgcagacatcaagcccta

SEQ ID NO: 388005 - DNA, 25 bp, Mus musculus
ttacatatgcaggaatctccacaca

SEQ ID NO: 388006 - DNA, 25 bp, Mus musculus
ttacatattgcaagacgacaaggaa

SEQ ID NO: 388007 - DNA, 25 bp, Mus musculus
ttacatcaagaagtccaaggttgtg

SEQ ID NO: 388008 - DNA, 25 bp, Mus musculus
ttacatcaccagaagacaagactgg

SEQ ID NO: 388009 - DNA, 25 bp, Mus musculus
ttacatcacgaatccagttcactct

SEQ ID NO: 388010 - DNA, 25 bp, Mus musculus
ttacatccctctggatcggttaagc

SEQ ID NO: 388011 - DNA, 25 bp, Mus musculus
ttacatccctctggtgaattccaag

SEQ ID NO: 388012 - DNA, 25 bp, Mus musculus
ttacatcgacagacatctgcaacta

SEQ ID NO: 388013 - DNA, 25 bp, Mus musculus
ttacatgcaggtcataaatgaagga

SEQ ID NO: 388014 - DNA, 25 bp, Mus musculus
ttacatggaaagatcagtactgagt

SEQ ID NO: 388015 - DNA, 25 bp, Mus musculus
ttacatggaaagggatcagtaatgg

SEQ ID NO: 388016 - DNA, 25 bp, Mus musculus
ttacatggaaggaggcatggagaag

SEQ ID NO: 388017 - DNA, 25 bp, Mus musculus
ttacatggaagggcgtggagctggt

SEQ ID NO: 388018 - DNA, 25 bp, Mus musculus
ttacatgtttttacaagagctaagt

SEQ ID NO: 388019 - DNA, 25 bp, Mus musculus
ttacattacacaagaaaaaagtgaa

SEQ ID NO: 388020 - DNA, 25 bp, Mus musculus
ttacattcaatgctcagtgctgcct

SEQ ID NO: 388021 - DNA, 25 bp, Mus musculus
ttacattcagctctggtgattgttc

SEQ ID NO: 388022 - DNA, 25 bp, Mus musculus
ttacattccaaaggtgtgcaggatt

SEQ ID NO: 388023 - DNA, 25 bp, Mus musculus
ttacattccacactcccgtatgaaa

SEQ ID NO: 388024 - DNA, 25 bp, Mus musculus
ttacattgcaatggatgagtttcat

SEQ ID NO: 388025 - DNA, 25 bp, Mus musculus
ttacattggcatagctccttattac

SEQ ID NO: 388026 - DNA, 25 bp, Mus musculus
ttacatttaagacaaatgaagagaa

SEQ ID NO: 388027 - DNA, 25 bp, Mus musculus
ttaccaaaaggatatccaggtacct

SEQ ID NO: 388028 - DNA, 25 bp, Mus musculus
ttaccaaaaggtacctgtgtgccct

SEQ ID NO: 388029 - DNA, 25 bp, Mus musculus
ttaccaaagcagagttctcgtcatt

SEQ ID NO: 388030 - DNA, 25 bp, Mus musculus
ttaccaaagcaggcttcttccctta

SEQ ID NO: 388031 - DNA, 25 bp, Mus musculus
ttaccaaattgttcccataacaact

SEQ ID NO: 388032 - DNA, 25 bp, Mus musculus
ttaccaacagggagtacacctttag

SEQ ID NO: 388033 - DNA, 25 bp, Mus musculus
ttaccaacagtctcaagaaggatcc

SEQ ID NO: 388034 - DNA, 25 bp, Mus musculus
ttaccaactgcttgtggactaaaga

SEQ ID NO: 388035 - DNA, 25 bp, Mus musculus
ttaccaagagtaaggacgagtcttg

SEQ ID NO: 388036 - DNA, 25 bp, Mus musculus
ttaccaaggagctggagaaggtgta

SEQ ID NO: 388037 - DNA, 25 bp, Mus musculus
ttaccaatagttcagacatcctaca

SEQ ID NO: 388038 - DNA, 25 bp, Mus musculus
ttaccaatcccagtgactctggacg

SEQ ID NO: 388039 - DNA, 25 bp, Mus musculus
ttaccaatgaagacagttgattcag

SEQ ID NO: 388040 - DNA, 25 bp, Mus musculus
ttaccaatttttgtagtgccaggac

SEQ ID NO: 388041 - DNA, 25 bp, Mus musculus
ttaccacaaccacagactggaacca

SEQ ID NO: 388042 - DNA, 25 bp, Mus musculus
ttaccacaaggagccagaactacag

SEQ ID NO: 388043 - DNA, 25 bp, Mus musculus
ttaccacagtcactggacccaaagt

SEQ ID NO: 388044 - DNA, 25 bp, Mus musculus
ttaccacccaagattcagtttgctg

SEQ ID NO: 388045 - DNA, 25 bp, Mus musculus
ttaccacctccaagaagccaaatct

SEQ ID NO: 388046 - DNA, 25 bp, Mus musculus
ttaccacctcccaagattccacttt

SEQ ID NO: 388047 - DNA, 25 bp, Mus musculus
ttaccacctgtggtggactggtgat

SEQ ID NO: 388048 - DNA, 25 bp, Mus musculus
ttaccacgcatgcagctggtccagg

SEQ ID NO: 388049 - DNA, 25 bp, Mus musculus
ttaccagaagcagtgcgatgacttt

SEQ ID NO: 388050 - DNA, 25 bp, Mus musculus
ttaccagacactaatctgaccccag

SEQ ID NO: 388051 - DNA, 25 bp, Mus musculus
ttaccagacactgcacaagggcacc

SEQ ID NO: 388052 - DNA, 25 bp, Mus musculus
ttaccagatgcaaagttctgctttc

SEQ ID NO: 388053 - DNA, 25 bp, Mus musculus
ttaccagcctcagattcagcgttta

SEQ ID NO: 388054 - DNA, 25 bp, Mus musculus
ttaccagctagaaacgagatgtccc

SEQ ID NO: 388055 - DNA, 25 bp, Mus musculus
ttaccagctagaaacttctcctctg

SEQ ID NO: 388056 - DNA, 25 bp, Mus musculus
ttaccagctttagaaggcatggatg

SEQ ID NO: 388057 - DNA, 25 bp, Mus musculus
ttaccaggaagcatctgtctgagca

SEQ ID NO: 388058 - DNA, 25 bp, Mus musculus
ttaccaggaggacagatcttctatc

SEQ ID NO: 388059 - DNA, 25 bp, Mus musculus
ttaccaggcataactcctggctctt

SEQ ID NO: 388060 - DNA, 25 bp, Mus musculus
ttaccagggtcggacaaatgacaaa

SEQ ID NO: 388061 - DNA, 25 bp, Mus musculus
ttaccagtgaggctgtgtctactct

SEQ ID NO: 388062 - DNA, 25 bp, Mus musculus
ttaccagtgtaagattaatgtggct

SEQ ID NO: 388063 - DNA, 25 bp, Mus musculus
ttaccatagaagtacctcaaatcgt

SEQ ID NO: 388064 - DNA, 25 bp, Mus musculus
ttaccatagaagttgctcctttggt

SEQ ID NO: 388065 - DNA, 25 bp, Mus musculus
ttaccatatcccaagtgtctgataa

SEQ ID NO: 388066 - DNA, 25 bp, Mus musculus
ttaccatcataacagcactaccacc

SEQ ID NO: 388067 - DNA, 25 bp, Mus musculus
ttaccatcataggccagttcacaat

SEQ ID NO: 388068 - DNA, 25 bp, Mus musculus
ttaccatcatcacagacaccacggc

SEQ ID NO: 388069 - DNA, 25 bp, Mus musculus
ttaccatcatcacagattctcgagc

SEQ ID NO: 388070 - DNA, 25 bp, Mus musculus
ttaccatgaggatccagcaatgcct

SEQ ID NO: 388071 - DNA, 25 bp, Mus musculus
ttaccatgtgctgcacaatcctgga

SEQ ID NO: 388072 - DNA, 25 bp, Mus musculus
ttaccattaataaggaccaaaatgt

SEQ ID NO: 388073 - DNA, 25 bp, Mus musculus
ttaccattgatcatgctactaatcg

SEQ ID NO: 388074 - DNA, 25 bp, Mus musculus
ttacccaaagcccacctggaagcag

SEQ ID NO: 388075 - DNA, 25 bp, Mus musculus
ttacccaaaggaagcctcaaggcac

SEQ ID NO: 388076 - DNA, 25 bp, Mus musculus
ttacccaaaggtggctctgcgggtc

SEQ ID NO: 388077 - DNA, 25 bp, Mus musculus
ttacccaaagtcagagaagtcctgc

SEQ ID NO: 388078 - DNA, 25 bp, Mus musculus
ttacccaacttcaggtaccaatggg

SEQ ID NO: 388079 - DNA, 25 bp, Mus musculus
ttacccactcagaaaagcggcctta

SEQ ID NO: 388080 - DNA, 25 bp, Mus musculus
ttacccagaaaagaaggtctctggt

SEQ ID NO: 388081 - DNA, 25 bp, Mus musculus
ttacccagtggggtacatgtacccc

SEQ ID NO: 388082 - DNA, 25 bp, Mus musculus
ttacccattttctctatgagtattg

SEQ ID NO: 388083 - DNA, 25 bp, Mus musculus
ttaccccatggaggttatttttgaa

SEQ ID NO: 388084 - DNA, 25 bp, Mus musculus
ttacccccaagtgctgcaggaggct

SEQ ID NO: 388085 - DNA, 25 bp, Mus musculus
ttaccccgcggacaggtttggccgt

SEQ ID NO: 388086 - DNA, 25 bp, Mus musculus
ttaccccggagcgagcccatccgtc

SEQ ID NO: 388087 - DNA, 25 bp, Mus musculus
ttacccctacaggaaggcccaggac

SEQ ID NO: 388088 - DNA, 25 bp, Mus musculus
ttacccgcccccaggccttctgggt

SEQ ID NO: 388089 - DNA, 25 bp, Mus musculus
ttacccggagaactggtgcctcgtc

SEQ ID NO: 388090 - DNA, 25 bp, Mus musculus
ttacccggggaaacaatggagaagt

SEQ ID NO: 388091 - DNA, 25 bp, Mus musculus
ttaccctagccagcataattaaatc

SEQ ID NO: 388092 - DNA, 25 bp, Mus musculus
ttaccctagccagggttgatttctt

SEQ ID NO: 388093 - DNA, 25 bp, Mus musculus
ttaccctccgaagctctggatgggt

SEQ ID NO: 388094 - DNA, 25 bp, Mus musculus
ttaccctcttcggtgtttatggaga

SEQ ID NO: 388095 - DNA, 25 bp, Mus musculus
ttaccctgatggaaactcccagtat

SEQ ID NO: 388096 - DNA, 25 bp, Mus musculus
ttaccctgatggtcataatgattac

SEQ ID NO: 388097 - DNA, 25 bp, Mus musculus
ttaccctgcttcagcaacttgattt

SEQ ID NO: 388098 - DNA, 25 bp, Mus musculus
ttaccctggcaagaggtccgtcttc

SEQ ID NO: 388099 - DNA, 25 bp, Mus musculus
ttaccctgttgaggtttttcatctt

SEQ ID NO: 388100 - DNA, 25 bp, Mus musculus
ttaccgagcaggacccttcatgttc

SEQ ID NO: 388101 - DNA, 25 bp, Mus musculus
ttaccgagcaggtcacggaagagta

SEQ ID NO: 388102 - DNA, 25 bp, Mus musculus
ttaccgatggatctggtggccctcc

SEQ ID NO: 388103 - DNA, 25 bp, Mus musculus
ttaccgcacggataattgtgtggag

SEQ ID NO: 388104 - DNA, 25 bp, Mus musculus
ttaccgctcccctgagaacacaagg

SEQ ID NO: 388105 - DNA, 25 bp, Mus musculus
ttaccgctcccctggttctggttaa

SEQ ID NO: 388106 - DNA, 25 bp, Mus musculus
ttaccgctctagccgcagccagagc

SEQ ID NO: 388107 - DNA, 25 bp, Mus musculus
ttaccggaacagaaatcatcgtgag

SEQ ID NO: 388108 - DNA, 25 bp, Mus musculus
ttaccggaacggcacgacgcgactt

SEQ ID NO: 388109 - DNA, 25 bp, Mus musculus
ttaccggcactgggcactgaaagaa

SEQ ID NO: 388110 - DNA, 25 bp, Mus musculus
ttaccgtaatggacggatctttgcc

SEQ ID NO: 388111 - DNA, 25 bp, Mus musculus
ttacctaaatgactgataatggtct

SEQ ID NO: 388112 - DNA, 25 bp, Mus musculus
ttacctaaatggacaggatccttgt

SEQ ID NO: 388113 - DNA, 25 bp, Mus musculus
ttacctaatgaaaagatctccaaga

SEQ ID NO: 388114 - DNA, 25 bp, Mus musculus
ttacctacaactgctgcttgtaccg

SEQ ID NO: 388115 - DNA, 25 bp, Mus musculus
ttacctacacttcagatttccaaaa

SEQ ID NO: 388116 - DNA, 25 bp, Mus musculus
ttacctaccaggacctgatctctgc

SEQ ID NO: 388117 - DNA, 25 bp, Mus musculus
ttacctagaggtgggaggctttgtg

SEQ ID NO: 388118 - DNA, 25 bp, Mus musculus
ttacctatgaccatctgtgtaagaa

SEQ ID NO: 388119 - DNA, 25 bp, Mus musculus
ttacctatgaccgaatataccatgc

SEQ ID NO: 388120 - DNA, 25 bp, Mus musculus
ttacctcaacagagaataggtgagg

SEQ ID NO: 388121 - DNA, 25 bp, Mus musculus
ttacctcaacagggattctgaaggg

SEQ ID NO: 388122 - DNA, 25 bp, Mus musculus
ttacctcaatgagatccagagtttt

SEQ ID NO: 388123 - DNA, 25 bp, Mus musculus
ttacctcactcacgctgcccaacat

SEQ ID NO: 388124 - DNA, 25 bp, Mus musculus
ttacctcactcaggctgccatccag

SEQ ID NO: 388125 - DNA, 25 bp, Mus musculus
ttacctccagaacccgctcagttgt

SEQ ID NO: 388126 - DNA, 25 bp, Mus musculus
ttacctccaggctcggttgtcctac

SEQ ID NO: 388127 - DNA, 25 bp, Mus musculus
ttacctccagtgtgacaaatacaag

SEQ ID NO: 388128 - DNA, 25 bp, Mus musculus
ttacctccttggatttccataagac

SEQ ID NO: 388129 - DNA, 25 bp, Mus musculus
ttacctccttgggcatccccaaagc

SEQ ID NO: 388130 - DNA, 25 bp, Mus musculus
ttacctctgggacaaggacaaagaa

SEQ ID NO: 388131 - DNA, 25 bp, Mus musculus
ttacctcttcaggctctgtgttccg

SEQ ID NO: 388132 - DNA, 25 bp, Mus musculus
ttacctgaaggatgggccttacatc

SEQ ID NO: 388133 - DNA, 25 bp, Mus musculus
ttacctgaaggttgggccttacatc

SEQ ID NO: 388134 - DNA, 25 bp, Mus musculus
ttacctgcaaagtaacagcctccac

SEQ ID NO: 388135 - DNA, 25 bp, Mus musculus
ttacctgcacaagctgactcatcat

SEQ ID NO: 388136 - DNA, 25 bp, Mus musculus
ttacctgcctggaaagccaacaggt

SEQ ID NO: 388137 - DNA, 25 bp, Mus musculus
ttacctgcctgggtctgggatctgg

SEQ ID NO: 388138 - DNA, 25 bp, Mus musculus
ttacctgcgacccagccattcattg

SEQ ID NO: 388139 - DNA, 25 bp, Mus musculus
ttacctgcgacccaggtgcctggct

SEQ ID NO: 388140 - DNA, 25 bp, Mus musculus
ttacctgctcagcagaatcgggttg

SEQ ID NO: 388141 - DNA, 25 bp, Mus musculus
ttacctgctggcaggtcgcttctcc

SEQ ID NO: 388142 - DNA, 25 bp, Mus musculus
ttacctggaaagagctgttattaga

SEQ ID NO: 388143 - DNA, 25 bp, Mus musculus
ttacctggaaaggtggtggtggcag

SEQ ID NO: 388144 - DNA, 25 bp, Mus musculus
ttacctggaccaaagggtgctcagg

SEQ ID NO: 388145 - DNA, 25 bp, Mus musculus
ttacctggagaagacctgtgccgtg

SEQ ID NO: 388146 - DNA, 25 bp, Mus musculus
ttacctggagaagtgtgtctggggc

SEQ ID NO: 388147 - DNA, 25 bp, Mus musculus
ttacctggagagagttcaccttttc

SEQ ID NO: 388148 - DNA, 25 bp, Mus musculus
ttacctgtgatgtctcacaccattt

SEQ ID NO: 388149 - DNA, 25 bp, Mus musculus
ttacctgtggctaagactctagcct

SEQ ID NO: 388150 - DNA, 25 bp, Mus musculus
ttacctgtggctaagctaccgattt

SEQ ID NO: 388151 - DNA, 25 bp, Mus musculus
ttaccttaccactgagatactagat

SEQ ID NO: 388152 - DNA, 25 bp, Mus musculus
ttaccttaccagttttacaggaatc

SEQ ID NO: 388153 - DNA, 25 bp, Mus musculus
ttaccttcaaacctggtgcgttcat

SEQ ID NO: 388154 - DNA, 25 bp, Mus musculus
ttaccttcagaattggataaccacg

SEQ ID NO: 388155 - DNA, 25 bp, Mus musculus
ttaccttccaggaatcctgctgcat

SEQ ID NO: 388156 - DNA, 25 bp, Mus musculus
ttaccttctggattcttggcgcccg

SEQ ID NO: 388157 - DNA, 25 bp, Mus musculus
ttaccttgcaaagaatccaaaacct

SEQ ID NO: 388158 - DNA, 25 bp, Mus musculus
ttaccttgcaaaggagtggccgtcc

SEQ ID NO: 388159 - DNA, 25 bp, Mus musculus
ttaccttggtgagaccatagcccag

SEQ ID NO: 388160 - DNA, 25 bp, Mus musculus
ttaccttgttgtctctgcttcctga

SEQ ID NO: 388161 - DNA, 25 bp, Mus musculus
ttacctttcagcctcccagtaaagg

SEQ ID NO: 388162 - DNA, 25 bp, Mus musculus
ttacctttgcagaaagaagaatcct

SEQ ID NO: 388163 - DNA, 25 bp, Mus musculus
ttacctttgctttgtattacgtgca

SEQ ID NO: 388164 - DNA, 25 bp, Mus musculus
ttacgaactcggctaccaagagcaa

SEQ ID NO: 388165 - DNA, 25 bp, Mus musculus
ttacgacaaatgtgtgccaaagaat

SEQ ID NO: 388166 - DNA, 25 bp, Mus musculus
ttacgacaagaacatcatcaagaaa

SEQ ID NO: 388167 - DNA, 25 bp, Mus musculus
ttacgacaagacaccaagtggactg

SEQ ID NO: 388168 - DNA, 25 bp, Mus musculus
ttacgacactgtacttcgcagatat

SEQ ID NO: 388169 - DNA, 25 bp, Mus musculus
ttacgactacagaagtgacctctag

SEQ ID NO: 388170 - DNA, 25 bp, Mus musculus
ttacgactacagaagtgacctctgg

SEQ ID NO: 388171 - DNA, 25 bp, Mus musculus
ttacgagcagagggagccaaattca

SEQ ID NO: 388172 - DNA, 25 bp, Mus musculus
ttacgatatcacaaatgttaactca

SEQ ID NO: 388173 - DNA, 25 bp, Mus musculus
ttacgatgaagactgccaaagtggc

SEQ ID NO: 388174 - DNA, 25 bp, Mus musculus
ttacgatgaaggctgtcatggtatc

SEQ ID NO: 388175 - DNA, 25 bp, Mus musculus
ttacgccacttatggatgtaggtca

SEQ ID NO: 388176 - DNA, 25 bp, Mus musculus
ttacgccccgcaagactttcctttg

SEQ ID NO: 388177 - DNA, 25 bp, Mus musculus
ttacgcctttgagatggctgtctca

SEQ ID NO: 388178 - DNA, 25 bp, Mus musculus
ttacgctcagacagtccagggccca

SEQ ID NO: 388179 - DNA, 25 bp, Mus musculus
ttacgctctcctactccgtggtgtt

SEQ ID NO: 388180 - DNA, 25 bp, Mus musculus
ttacgcttcctgaagggatgggctc

SEQ ID NO: 388181 - DNA, 25 bp, Mus musculus
ttacggaagcttggtaatgcaggtg

SEQ ID NO: 388182 - DNA, 25 bp, Mus musculus
ttacggactaggccagcaggtggcc

SEQ ID NO: 388183 - DNA, 25 bp, Mus musculus
ttacggactagggccctgcacacag

SEQ ID NO: 388184 - DNA, 25 bp, Mus musculus
ttacggactaggtggccatcaagaa

SEQ ID NO: 388185 - DNA, 25 bp, Mus musculus
ttacggagagattttatacaagctg

SEQ ID NO: 388186 - DNA, 25 bp, Mus musculus
ttacggagagattttatgagaggct

SEQ ID NO: 388187 - DNA, 25 bp, Mus musculus
ttacggagccagccatgagaagttg

SEQ ID NO: 388188 - DNA, 25 bp, Mus musculus
ttacggagccagttttataggtaga

SEQ ID NO: 388189 - DNA, 25 bp, Mus musculus
ttacggagggcactaaatcgtcctg

SEQ ID NO: 388190 - DNA, 25 bp, Mus musculus
ttacggagggcagtaaatcgtcctg

SEQ ID NO: 388191 - DNA, 25 bp, Mus musculus
ttacggatagggagttcttccccag

SEQ ID NO: 388192 - DNA, 25 bp, Mus musculus
ttacggcaaagtctcatacatccca

SEQ ID NO: 388193 - DNA, 25 bp, Mus musculus
ttacggcactacggatgatctgaga

SEQ ID NO: 388194 - DNA, 25 bp, Mus musculus
ttacggcactacgggttccaatatt

SEQ ID NO: 388195 - DNA, 25 bp, Mus musculus
ttacggcttgtcacattcccacgag

SEQ ID NO: 388196 - DNA, 25 bp, Mus musculus
ttacgggcagatcagctgtcctgga

SEQ ID NO: 388197 - DNA, 25 bp, Mus musculus
ttacgggcagatcagtccgcactgg

SEQ ID NO: 388198 - DNA, 25 bp, Mus musculus
ttacggggcttgggagcatttagct

SEQ ID NO: 388199 - DNA, 25 bp, Mus musculus
ttacgggggaggctgctctgagatg

SEQ ID NO: 388200 - DNA, 25 bp, Mus musculus
ttacgtaaagggcctgacaagatca

SEQ ID NO: 388201 - DNA, 25 bp, Mus musculus
ttacgtcatgccagatgtctctccg

SEQ ID NO: 388202 - DNA, 25 bp, Mus musculus
ttacgtcatgtactatgagatgtcc

SEQ ID NO: 388203 - DNA, 25 bp, Mus musculus
ttacgtcattgggaggaaaactccc

SEQ ID NO: 388204 - DNA, 25 bp, Mus musculus
ttacgtcattgggtgggtgttcgtg

SEQ ID NO: 388205 - DNA, 25 bp, Mus musculus
ttacgtcctgaacacgacccgagca

SEQ ID NO: 388206 - DNA, 25 bp, Mus musculus
ttacgtgaagagagggcacatctgc

SEQ ID NO: 388207 - DNA, 25 bp, Mus musculus
ttacgtggagaggtcaacagtctgg

SEQ ID NO: 388208 - DNA, 25 bp, Mus musculus
ttacgttactggttgcttctataac

SEQ ID NO: 388209 - DNA, 25 bp, Mus musculus
ttactaaaactccagttccttctga

SEQ ID NO: 388210 - DNA, 25 bp, Mus musculus
ttactaaagttgttcaaggcctggc

SEQ ID NO: 388211 - DNA, 25 bp, Mus musculus
ttactaacagcaagttcaatgtcgg

SEQ ID NO: 388212 - DNA, 25 bp, Mus musculus
ttactaacattagaaatccacaggt

SEQ ID NO: 388213 - DNA, 25 bp, Mus musculus
ttactaagaaagagaccagtgctgt

SEQ ID NO: 388214 - DNA, 25 bp, Mus musculus
ttactaaggccaagcttctggggtt

SEQ ID NO: 388215 - DNA, 25 bp, Mus musculus
ttactaagtggaggttccatgttgg

SEQ ID NO: 388216 - DNA, 25 bp, Mus musculus
ttactaatcaaaatacgcctactat

SEQ ID NO: 388217 - DNA, 25 bp, Mus musculus
ttactaatcaaagtggacccaacag

SEQ ID NO: 388218 - DNA, 25 bp, Mus musculus
ttactaatcaggattgtcttgcctg

SEQ ID NO: 388219 - DNA, 25 bp, Mus musculus
ttactaattactgaaaaagaagtta

SEQ ID NO: 388220 - DNA, 25 bp, Mus musculus
ttactaattactggattctgctcta

SEQ ID NO: 388221 - DNA, 25 bp, Mus musculus
ttactacaagggccagtatatccta

SEQ ID NO: 388222 - DNA, 25 bp, Mus musculus
ttactacattatatatgcaagttct

SEQ ID NO: 388223 - DNA, 25 bp, Mus musculus
ttactacattatatctacatcaaat

SEQ ID NO: 388224 - DNA, 25 bp, Mus musculus
ttactaccaagccccaggagatggg

SEQ ID NO: 388225 - DNA, 25 bp, Mus musculus
ttactacgaaggaggaaactcccag

SEQ ID NO: 388226 - DNA, 25 bp, Mus musculus
ttactacgtcatgcagtgcccttcc

SEQ ID NO: 388227 - DNA, 25 bp, Mus musculus
ttactacgtcatggtcatctgctat

SEQ ID NO: 388228 - DNA, 25 bp, Mus musculus
ttactactacatgatcatctccaga

SEQ ID NO: 388229 - DNA, 25 bp, Mus musculus
ttactactatggagacatttcgact

SEQ ID NO: 388230 - DNA, 25 bp, Mus musculus
ttactactatggaggacagtggttc

SEQ ID NO: 388231 - DNA, 25 bp, Mus musculus
ttactagcacaaggtgactacgaga

SEQ ID NO: 388232 - DNA, 25 bp, Mus musculus
ttactaggaaaaaaagtggtcatgc

SEQ ID NO: 388233 - DNA, 25 bp, Mus musculus
ttactatcaaagtattctgcagatg

SEQ ID NO: 388234 - DNA, 25 bp, Mus musculus
ttactatccatggagggctgagccg

SEQ ID NO: 388235 - DNA, 25 bp, Mus musculus
ttactatcccgagaaagcctacatc

SEQ ID NO: 388236 - DNA, 25 bp, Mus musculus
ttactatcccgaggcccgagtccgg

SEQ ID NO: 388237 - DNA, 25 bp, Mus musculus
ttactatcctaaaggggtctttgtg

SEQ ID NO: 388238 - DNA, 25 bp, Mus musculus
ttactatcctaaagggtgacaaagg

SEQ ID NO: 388239 - DNA, 25 bp, Mus musculus
ttactatctgacaggatggcttgcc

SEQ ID NO: 388240 - DNA, 25 bp, Mus musculus
ttactatctgggtgacaatagcttt

SEQ ID NO: 388241 - DNA, 25 bp, Mus musculus
ttactatgaaaagggatggatcttt

SEQ ID NO: 388242 - DNA, 25 bp, Mus musculus
ttactatgaaaaggtgacgtgcaca

SEQ ID NO: 388243 - DNA, 25 bp, Mus musculus
ttactatgaagtttctctgcccagc

SEQ ID NO: 388244 - DNA, 25 bp, Mus musculus
ttactatgaatacctctctgacgcc

SEQ ID NO: 388245 - DNA, 25 bp, Mus musculus
ttactatgctgagcagattaagaaa

SEQ ID NO: 388246 - DNA, 25 bp, Mus musculus
ttactatgctgagggccaaggatgt

SEQ ID NO: 388247 - DNA, 25 bp, Mus musculus
ttactatgtttacggcagtgcttga

SEQ ID NO: 388248 - DNA, 25 bp, Mus musculus
ttactatgtttagggcagtgcttga

SEQ ID NO: 388249 - DNA, 25 bp, Mus musculus
ttactatttccatgatggccagtgc

SEQ ID NO: 388250 - DNA, 25 bp, Mus musculus
ttactcaaacccgcaacttgaattg

SEQ ID NO: 388251 - DNA, 25 bp, Mus musculus
ttactcacaaagaagcacagaccct

SEQ ID NO: 388252 - DNA, 25 bp, Mus musculus
ttactcacaaagaaggatggaaggt

SEQ ID NO: 388253 - DNA, 25 bp, Mus musculus
ttactcacttgaagcccatctctga

SEQ ID NO: 388254 - DNA, 25 bp, Mus musculus
ttactcagaaaacattccgtgcagt

SEQ ID NO: 388255 - DNA, 25 bp, Mus musculus
ttactcatgaaaacttgctagaaat

SEQ ID NO: 388256 - DNA, 25 bp, Mus musculus
ttactcattcattcgatattacaca

SEQ ID NO: 388257 - DNA, 25 bp, Mus musculus
ttactccaagttcggggaatgcagc

SEQ ID NO: 388258 - DNA, 25 bp, Mus musculus
ttactccaagttcggtcccctgtgt

SEQ ID NO: 388259 - DNA, 25 bp, Mus musculus
ttactcccaagactctgaggtccat

SEQ ID NO: 388260 - DNA, 25 bp, Mus musculus
ttactcccaagatggctgtctcaaa

SEQ ID NO: 388261 - DNA, 25 bp, Mus musculus
ttactcccaagcccctggaccttcg

SEQ ID NO: 388262 - DNA, 25 bp, Mus musculus
ttactcccaatatgaagactcttca

SEQ ID NO: 388263 - DNA, 25 bp, Mus musculus
ttactccgtggcgaatctcattagg

SEQ ID NO: 388264 - DNA, 25 bp, Mus musculus
ttactcctcagcagagttacgtcaa

SEQ ID NO: 388265 - DNA, 25 bp, Mus musculus
ttactcctcagcaggtatttgtcaa

SEQ ID NO: 388266 - DNA, 25 bp, Mus musculus
ttactcgcagggcaacaaagaatca

SEQ ID NO: 388267 - DNA, 25 bp, Mus musculus
ttactcgcagtgagatgagtcagaa

SEQ ID NO: 388268 - DNA, 25 bp, Mus musculus
ttactcgccaggcaagcgcttccag

SEQ ID NO: 388269 - DNA, 25 bp, Mus musculus
ttactctaaggccttcctcctgcag

SEQ ID NO: 388270 - DNA, 25 bp, Mus musculus
ttactctcacaatgctctgtcagaa

SEQ ID NO: 388271 - DNA, 25 bp, Mus musculus
ttactctcacaatgtgtcctactga

SEQ ID NO: 388272 - DNA, 25 bp, Mus musculus
ttactctcccagcatgctggactat

SEQ ID NO: 388273 - DNA, 25 bp, Mus musculus
ttactctcttagcagtgaagcagat

SEQ ID NO: 388274 - DNA, 25 bp, Mus musculus
ttactctgagagagtcagtccttcc

SEQ ID NO: 388275 - DNA, 25 bp, Mus musculus
ttactctgggcacgctaataatttt

SEQ ID NO: 388276 - DNA, 25 bp, Mus musculus
ttactgaaactgcaggtcacggaag

SEQ ID NO: 388277 - DNA, 25 bp, Mus musculus
ttactgaaactgcagtggactgagt

SEQ ID NO: 388278 - DNA, 25 bp, Mus musculus
ttactgaactgatggctgcccaagt

SEQ ID NO: 388279 - DNA, 25 bp, Mus musculus
ttactgaagcagaaggagctaggtg

SEQ ID NO: 388280 - DNA, 25 bp, Mus musculus
ttactgaatctgtcagacgtgttga

SEQ ID NO: 388281 - DNA, 25 bp, Mus musculus
ttactgacagcttttgcctaccaaa

SEQ ID NO: 388282 - DNA, 25 bp, Mus musculus
ttactgacagcttttttattaagct

SEQ ID NO: 388283 - DNA, 25 bp, Mus musculus
ttactgacagtgtacactcttttct

SEQ ID NO: 388284 - DNA, 25 bp, Mus musculus
ttactgacagttgaacaccagtgta

SEQ ID NO: 388285 - DNA, 25 bp, Mus musculus
ttactgactgcagcaccacagccgc

SEQ ID NO: 388286 - DNA, 25 bp, Mus musculus
ttactgagaaggaaggtctgtctgc

SEQ ID NO: 388287 - DNA, 25 bp, Mus musculus
ttactgcaacagctttttctaaaag

SEQ ID NO: 388288 - DNA, 25 bp, Mus musculus
ttactgcaccgatcctagttccgtg

SEQ ID NO: 388289 - DNA, 25 bp, Mus musculus
ttactgcagcagcttcaaactgttc

SEQ ID NO: 388290 - DNA, 25 bp, Mus musculus
ttactgcagcaggagtgtgataatt

SEQ ID NO: 388291 - DNA, 25 bp, Mus musculus
ttactgcaggtaccgaatgtctaca

SEQ ID NO: 388292 - DNA, 25 bp, Mus musculus
ttactgccaagatatagatgagtgc

SEQ ID NO: 388293 - DNA, 25 bp, Mus musculus
ttactgcccagacaagtgctgttgc

SEQ ID NO: 388294 - DNA, 25 bp, Mus musculus
ttactgcccagaccgtgccagtgcc

SEQ ID NO: 388295 - DNA, 25 bp, Mus musculus
ttactgcccttggctctggtcaggg

SEQ ID NO: 388296 - DNA, 25 bp, Mus musculus
ttactgctaccgccatcttagaact

SEQ ID NO: 388297 - DNA, 25 bp, Mus musculus
ttactgctaccgctgtggcaatgtg

SEQ ID NO: 388298 - DNA, 25 bp, Mus musculus
ttactgctgacctcaggatgtcagg

SEQ ID NO: 388299 - DNA, 25 bp, Mus musculus
ttactgctgctgaaagaaattagcc

SEQ ID NO: 388300 - DNA, 25 bp, Mus musculus
ttactgctgctgaatttgaagtcct

SEQ ID NO: 388301 - DNA, 25 bp, Mus musculus
ttactgctttgactgtactccctcc

SEQ ID NO: 388302 - DNA, 25 bp, Mus musculus
ttactggaagattatcctgtccttg

SEQ ID NO: 388303 - DNA, 25 bp, Mus musculus
ttactggactatccgatacacctcc

SEQ ID NO: 388304 - DNA, 25 bp, Mus musculus
ttactggcattgcagatttatttcc

SEQ ID NO: 388305 - DNA, 25 bp, Mus musculus
ttactggcattgcaggccgaggaga

SEQ ID NO: 388306 - DNA, 25 bp, Mus musculus
ttactggcattggaccatctgctgc

SEQ ID NO: 388307 - DNA, 25 bp, Mus musculus
ttactggcattggatctcaggaaaa

SEQ ID NO: 388308 - DNA, 25 bp, Mus musculus
ttactggcccggctgtgaagttgag

SEQ ID NO: 388309 - DNA, 25 bp, Mus musculus
ttactggcctcaaaaatactgggcg

SEQ ID NO: 388310 - DNA, 25 bp, Mus musculus
ttactggctgtctgaccaagtaact

SEQ ID NO: 388311 - DNA, 25 bp, Mus musculus
ttactggctgtctggtttaacttgc

SEQ ID NO: 388312 - DNA, 25 bp, Mus musculus
ttactggtacctgcggctgaaggtg

SEQ ID NO: 388313 - DNA, 25 bp, Mus musculus
ttactgtagcaaagacggtttacag

SEQ ID NO: 388314 - DNA, 25 bp, Mus musculus
ttactgtagcaaggacaaatctgtt

SEQ ID NO: 388315 - DNA, 25 bp, Mus musculus
ttactgtcaagcagatgagacaagg

SEQ ID NO: 388316 - DNA, 25 bp, Mus musculus
ttactgtcccgagaaggtgtagggt

SEQ ID NO: 388317 - DNA, 25 bp, Mus musculus
ttactgtcgagagaagggtttctca

SEQ ID NO: 388318 - DNA, 25 bp, Mus musculus
ttactgtgaacagtatgtctggatt

SEQ ID NO: 388319 - DNA, 25 bp, Mus musculus
ttactgtgagcgtgcaatgatgcgc

SEQ ID NO: 388320 - DNA, 25 bp, Mus musculus
ttactgtgcaagaattactacggta

SEQ ID NO: 388321 - DNA, 25 bp, Mus musculus
ttactgtggaagtgtggattcttta

SEQ ID NO: 388322 - DNA, 25 bp, Mus musculus
ttactgtggaagtgtggcttcttca

SEQ ID NO: 388323 - DNA, 25 bp, Mus musculus
ttactgtggttcctgatatgctctc

SEQ ID NO: 388324 - DNA, 25 bp, Mus musculus
ttactgttaacaggacattcgacat

SEQ ID NO: 388325 - DNA, 25 bp, Mus musculus
ttactgttcttgatatacatgataa

SEQ ID NO: 388326 - DNA, 25 bp, Mus musculus
ttactgttcttgatccataacaaac

SEQ ID NO: 388327 - DNA, 25 bp, Mus musculus
ttacttaaaaagagtgtgtaagctt

SEQ ID NO: 388328 - DNA, 25 bp, Mus musculus
ttacttaaaggaagtggaacaacta

SEQ ID NO: 388329 - DNA, 25 bp, Mus musculus
ttacttaaatcgggagagtgtgctg

SEQ ID NO: 388330 - DNA, 25 bp, Mus musculus
ttacttaacagcgttggcctggaac

SEQ ID NO: 388331 - DNA, 25 bp, Mus musculus
ttacttagtggagagaacagatact

SEQ ID NO: 388332 - DNA, 25 bp, Mus musculus
ttacttagtggtgagacgtggaatc

SEQ ID NO: 388333 - DNA, 25 bp, Mus musculus
ttacttatccctgtcctctacagcc

SEQ ID NO: 388334 - DNA, 25 bp, Mus musculus
ttacttcagccctgcattttgcaga

SEQ ID NO: 388335 - DNA, 25 bp, Mus musculus
ttacttcataaatatccttttatct

SEQ ID NO: 388336 - DNA, 25 bp, Mus musculus
ttacttccctgcaattttgaaccca

SEQ ID NO: 388337 - DNA, 25 bp, Mus musculus
ttacttcgcacaggtgcaggtgtcc

SEQ ID NO: 388338 - DNA, 25 bp, Mus musculus
ttacttctacagtgatggagaaaga

SEQ ID NO: 388339 - DNA, 25 bp, Mus musculus
ttacttctgatggcctcgaactcag

SEQ ID NO: 388340 - DNA, 25 bp, Mus musculus
ttacttctgcccgggctgagcgccc

SEQ ID NO: 388341 - DNA, 25 bp, Mus musculus
ttacttctgcccggtgctggccaca

SEQ ID NO: 388342 - DNA, 25 bp, Mus musculus
ttacttctgtgtactgccttctgaa

SEQ ID NO: 388343 - DNA, 25 bp, Mus musculus
ttacttctgtgtagtagtttacaaa

SEQ ID NO: 388344 - DNA, 25 bp, Mus musculus
ttacttctttcaggtactcatgtga

SEQ ID NO: 388345 - DNA, 25 bp, Mus musculus
ttacttgcacagggaacaagaatgt

SEQ ID NO: 388346 - DNA, 25 bp, Mus musculus
ttacttgtaaagatttgagaaacct

SEQ ID NO: 388347 - DNA, 25 bp, Mus musculus
ttacttgtgaaactataagcagcaa

SEQ ID NO: 388348 - DNA, 25 bp, Mus musculus
ttacttgtgccagtctaatgcacta

SEQ ID NO: 388349 - DNA, 25 bp, Mus musculus
ttactttacaagattaatgccgctg

SEQ ID NO: 388350 - DNA, 25 bp, Mus musculus
ttactttacaagccccaagcattct

SEQ ID NO: 388351 - DNA, 25 bp, Mus musculus
ttactttacaagcttcaacaaatcc

SEQ ID NO: 388352 - DNA, 25 bp, Mus musculus
ttactttacagtctattaaaggttg

SEQ ID NO: 388353 - DNA, 25 bp, Mus musculus
ttactttacagtctgttatcaagaa

SEQ ID NO: 388354 - DNA, 25 bp, Mus musculus
ttactttatctgcacaaacagcgcc

SEQ ID NO: 388355 - DNA, 25 bp, Mus musculus
ttactttcaacatcaaagtggctag

SEQ ID NO: 388356 - DNA, 25 bp, Mus musculus
ttactttcaatggagagccgtgcag

SEQ ID NO: 388357 - DNA, 25 bp, Mus musculus
ttactttctggatgagcagaagcta

SEQ ID NO: 388358 - DNA, 25 bp, Mus musculus
ttactttgagaatctcctgtccaag

SEQ ID NO: 388359 - DNA, 25 bp, Mus musculus
ttactttgagcgtcgagcagaacag

SEQ ID NO: 388360 - DNA, 25 bp, Mus musculus
ttactttgagtttgctgggggaagc

SEQ ID NO: 388361 - DNA, 25 bp, Mus musculus
ttactttgataagaatggcaatccc

SEQ ID NO: 388362 - DNA, 25 bp, Mus musculus
ttactttgataaggatggcattgta

SEQ ID NO: 388363 - DNA, 25 bp, Mus musculus
ttactttgtaaagcaatccgaaggt

SEQ ID NO: 388364 - DNA, 25 bp, Mus musculus
ttactttgttctcgagcaggttagc

SEQ ID NO: 388365 - DNA, 25 bp, Mus musculus
ttacttttgagaatgctctggcttc

SEQ ID NO: 388366 - DNA, 25 bp, Mus musculus
ttagaaaaagtaagtgcttccttgg

SEQ ID NO: 388367 - DNA, 25 bp, Mus musculus
ttagaaaagaccactaaccatgagt

SEQ ID NO: 388368 - DNA, 25 bp, Mus musculus
ttagaaaagaccactgggttatcct

SEQ ID NO: 388369 - DNA, 25 bp, Mus musculus
ttagaaaagtaccaggtgttttcag

SEQ ID NO: 388370 - DNA, 25 bp, Mus musculus
ttagaaaatattggattggaagcct

SEQ ID NO: 388371 - DNA, 25 bp, Mus musculus
ttagaaaatgctaaggtttatggga

SEQ ID NO: 388372 - DNA, 25 bp, Mus musculus
ttagaaacaaatgggatggaagact

SEQ ID NO: 388373 - DNA, 25 bp, Mus musculus
ttagaaacaaatggtgaagaagatg

SEQ ID NO: 388374 - DNA, 25 bp, Mus musculus
ttagaaagaagcatgtctgctgtga

SEQ ID NO: 388375 - DNA, 25 bp, Mus musculus
ttagaaagagcaactgtcctgtcct

SEQ ID NO: 388376 - DNA, 25 bp, Mus musculus
ttagaacaagatttaccggacagca

SEQ ID NO: 388377 - DNA, 25 bp, Mus musculus
ttagaacacataaaggcaagaaaac

SEQ ID NO: 388378 - DNA, 25 bp, Mus musculus
ttagaaccagaagagccaccaacca

SEQ ID NO: 388379 - DNA, 25 bp, Mus musculus
ttagaaccagaagatgccatctcat

SEQ ID NO: 388380 - DNA, 25 bp, Mus musculus
ttagaaccagaaggagcaccgtact

SEQ ID NO: 388381 - DNA, 25 bp, Mus musculus
ttagaaccagcagatgacaccgtac

SEQ ID NO: 388382 - DNA, 25 bp, Mus musculus
ttagaaccccggtggcgacagacaa

SEQ ID NO: 388383 - DNA, 25 bp, Mus musculus
ttagaactaagaaataaagatttta

SEQ ID NO: 388384 - DNA, 25 bp, Mus musculus
ttagaactaagtagcaacccagctc

SEQ ID NO: 388385 - DNA, 25 bp, Mus musculus
ttagaactcaggcaggaagaggaac

SEQ ID NO: 388386 - DNA, 25 bp, Mus musculus
ttagaactgtggagtatcacggtga

SEQ ID NO: 388387 - DNA, 25 bp, Mus musculus
ttagaagaaagttggggctgtgcgg

SEQ ID NO: 388388 - DNA, 25 bp, Mus musculus
ttagaagaagtgctctggatgttct

SEQ ID NO: 388389 - DNA, 25 bp, Mus musculus
ttagaagaatcagcagccgctcttc

SEQ ID NO: 388390 - DNA, 25 bp, Mus musculus
ttagaagacactagggtggctaccg

SEQ ID NO: 388391 - DNA, 25 bp, Mus musculus
ttagaagataggttaagagcaggat

SEQ ID NO: 388392 - DNA, 25 bp, Mus musculus
ttagaagatggagatcagccagatg

SEQ ID NO: 388393 - DNA, 25 bp, Mus musculus
ttagaagatggagatggctcttgga

SEQ ID NO: 388394 - DNA, 25 bp, Mus musculus
ttagaagcagaatggaatgacctat

SEQ ID NO: 388395 - DNA, 25 bp, Mus musculus
ttagaagcatggtcttagaaatgag

SEQ ID NO: 388396 - DNA, 25 bp, Mus musculus
ttagaagctctcatctgaaaataat

SEQ ID NO: 388397 - DNA, 25 bp, Mus musculus
ttagaagctctgaatgacaaaaagc

SEQ ID NO: 388398 - DNA, 25 bp, Mus musculus
ttagaaggacagaaaaaaagcagag

SEQ ID NO: 388399 - DNA, 25 bp, Mus musculus
ttagaaggacagctcctgaattcgg

SEQ ID NO: 388400 - DNA, 25 bp, Mus musculus
ttagaaggaggattgcttcctgagg

SEQ ID NO: 388401 - DNA, 25 bp, Mus musculus
ttagaaggaggccattaggaaacct

SEQ ID NO: 388402 - DNA, 25 bp, Mus musculus
ttagaaggaggggctaaggagaagg

SEQ ID NO: 388403 - DNA, 25 bp, Mus musculus
ttagaagtcatccttggcatggatg

SEQ ID NO: 388404 - DNA, 25 bp, Mus musculus
ttagaatatgaagctttggttccag

SEQ ID NO: 388405 - DNA, 25 bp, Mus musculus
ttagaatggcagggacggtcaagac

SEQ ID NO: 388406 - DNA, 25 bp, Mus musculus
ttagaatgtgagcggacggacaatt

SEQ ID NO: 388407 - DNA, 25 bp, Mus musculus
ttagacaagtgtgagaaaaaacaag

SEQ ID NO: 388408 - DNA, 25 bp, Mus musculus
ttagacacagtgaagtcccctcctg

SEQ ID NO: 388409 - DNA, 25 bp, Mus musculus
ttagacatagtagcaacccagctca

SEQ ID NO: 388410 - DNA, 25 bp, Mus musculus
ttagacattggatgccgccttggac

SEQ ID NO: 388411 - DNA, 25 bp, Mus musculus
ttagacattggctgcggttctgggc

SEQ ID NO: 388412 - DNA, 25 bp, Mus musculus
ttagaccatggcacccgatggcctc

SEQ ID NO: 388413 - DNA, 25 bp, Mus musculus
ttagaccatgtggtgaccatcatca

SEQ ID NO: 388414 - DNA, 25 bp, Mus musculus
ttagacccagccagggttgtcgccc

SEQ ID NO: 388415 - DNA, 25 bp, Mus musculus
ttagacccccgagaaaccagctctt

SEQ ID NO: 388416 - DNA, 25 bp, Mus musculus
ttagaccctgcacggctgtggactt

SEQ ID NO: 388417 - DNA, 25 bp, Mus musculus
ttagacctcaagaattaaaacagga

SEQ ID NO: 388418 - DNA, 25 bp, Mus musculus
ttagacctcaagggagaaggtgata

SEQ ID NO: 388419 - DNA, 25 bp, Mus musculus
ttagacctggaatcagatgaagagc

SEQ ID NO: 388420 - DNA, 25 bp, Mus musculus
ttagacctgtcttgtaaccctgaga

SEQ ID NO: 388421 - DNA, 25 bp, Mus musculus
ttagacgaggaggtggagttgttac

SEQ ID NO: 388422 - DNA, 25 bp, Mus musculus
ttagactacatgtccttctgcgcgt

SEQ ID NO: 388423 - DNA, 25 bp, Mus musculus
ttagactcagaggagctgtgattgg

SEQ ID NO: 388424 - DNA, 25 bp, Mus musculus
ttagactcagagtcataaggtcacc

SEQ ID NO: 388425 - DNA, 25 bp, Mus musculus
ttagactccatgtgctcggcgctct

SEQ ID NO: 388426 - DNA, 25 bp, Mus musculus
ttagacttgaaagcacagtggttga

SEQ ID NO: 388427 - DNA, 25 bp, Mus musculus
ttagacttggccagggagccacagc

SEQ ID NO: 388428 - DNA, 25 bp, Mus musculus
ttagagaaacatggtggcgacagac

SEQ ID NO: 388429 - DNA, 25 bp, Mus musculus
ttagagaacagggaccgtgtgggct

SEQ ID NO: 388430 - DNA, 25 bp, Mus musculus
ttagagacaaaggttctaatcagag

SEQ ID NO: 388431 - DNA, 25 bp, Mus musculus
ttagagaccctgaattaccggtatt

SEQ ID NO: 388432 - DNA, 25 bp, Mus musculus
ttagagagaagaaagaatatcttgt

SEQ ID NO: 388433 - DNA, 25 bp, Mus musculus
ttagagagaagaaatctccacagca

SEQ ID NO: 388434 - DNA, 25 bp, Mus musculus
ttagagagaagcaactggtctccga

SEQ ID NO: 388435 - DNA, 25 bp, Mus musculus
ttagagagaggcaggagtacgtgct

SEQ ID NO: 388436 - DNA, 25 bp, Mus musculus
ttagagaggctgtgtcccattgtat

SEQ ID NO: 388437 - DNA, 25 bp, Mus musculus
ttagagagggctcaggtggtggaga

SEQ ID NO: 388438 - DNA, 25 bp, Mus musculus
ttagagagttcaaggggctgagatt

SEQ ID NO: 388439 - DNA, 25 bp, Mus musculus
ttagagataaggttcatcatttgga

SEQ ID NO: 388440 - DNA, 25 bp, Mus musculus
ttagagatccctctgagaccacctt

SEQ ID NO: 388441 - DNA, 25 bp, Mus musculus
ttagagatgaatccgccagttcctt

SEQ ID NO: 388442 - DNA, 25 bp, Mus musculus
ttagagatgaggctggaggggtagc

SEQ ID NO: 388443 - DNA, 25 bp, Mus musculus
ttagagatggtgaagaatttaagaa

SEQ ID NO: 388444 - DNA, 25 bp, Mus musculus
ttagagcagaaagccaatgctcttc

SEQ ID NO: 388445 - DNA, 25 bp, Mus musculus
ttagagcagcaggtatggacaacag

SEQ ID NO: 388446 - DNA, 25 bp, Mus musculus
ttagagccaggttcaatatacaaat

SEQ ID NO: 388447 - DNA, 25 bp, Mus musculus
ttagagcctatgcatctgactgtag

SEQ ID NO: 388448 - DNA, 25 bp, Mus musculus
ttagagcctatggatctgactgtag

SEQ ID NO: 388449 - DNA, 25 bp, Mus musculus
ttagagcctgaacagagagctgaaa

SEQ ID NO: 388450 - DNA, 25 bp, Mus musculus
ttagagcctgctggcaatcatctgg

SEQ ID NO: 388451 - DNA, 25 bp, Mus musculus
ttagagctggtgtgtctccaggcta

SEQ ID NO: 388452 - DNA, 25 bp, Mus musculus
ttagaggactagcccactgtgccga

SEQ ID NO: 388453 - DNA, 25 bp, Mus musculus
ttagaggactgtcagaaaacccagc

SEQ ID NO: 388454 - DNA, 25 bp, Mus musculus
ttagaggagagccaagttgaagttc

SEQ ID NO: 388455 - DNA, 25 bp, Mus musculus
ttagaggcctcactagggcagggcc

SEQ ID NO: 388456 - DNA, 25 bp, Mus musculus
ttagagggcaggacaataagactgc

SEQ ID NO: 388457 - DNA, 25 bp, Mus musculus
ttagaggtcacaacttctcacacat

SEQ ID NO: 388458 - DNA, 25 bp, Mus musculus
ttagagtaccagcgcgggatgcgga

SEQ ID NO: 388459 - DNA, 25 bp, Mus musculus
ttagagttttggtcccagcaacaga

SEQ ID NO: 388460 - DNA, 25 bp, Mus musculus
ttagataagaaggtcggagctgaaa

SEQ ID NO: 388461 - DNA, 25 bp, Mus musculus
ttagataatccacttaaacatttaa

SEQ ID NO: 388462 - DNA, 25 bp, Mus musculus
ttagatatcgaaggatgttttattt

SEQ ID NO: 388463 - DNA, 25 bp, Mus musculus
ttagatcaatatgagtggtactgca

SEQ ID NO: 388464 - DNA, 25 bp, Mus musculus
ttagatccaaaacacacagtgtatg

SEQ ID NO: 388465 - DNA, 25 bp, Mus musculus
ttagatccttccaagactcagatta

SEQ ID NO: 388466 - DNA, 25 bp, Mus musculus
ttagatctagtgagcagcacctcca

SEQ ID NO: 388467 - DNA, 25 bp, Mus musculus
ttagatctagtttttagagaaatca

SEQ ID NO: 388468 - DNA, 25 bp, Mus musculus
ttagatctcacgagacatatctgaa

SEQ ID NO: 388469 - DNA, 25 bp, Mus musculus
ttagatctcacgagggagaaactgc

SEQ ID NO: 388470 - DNA, 25 bp, Mus musculus
ttagatctggctctgttgctgtaga

SEQ ID NO: 388471 - DNA, 25 bp, Mus musculus
ttagatcttgggaacctggtggcca

SEQ ID NO: 388472 - DNA, 25 bp, Mus musculus
ttagatgaacttgggaatgtacctg

SEQ ID NO: 388473 - DNA, 25 bp, Mus musculus
ttagatgaacttgggttttatgatt

SEQ ID NO: 388474 - DNA, 25 bp, Mus musculus
ttagatgaagaattcatcctacaaa

SEQ ID NO: 388475 - DNA, 25 bp, Mus musculus
ttagatgatcagagtggtaagaaaa

SEQ ID NO: 388476 - DNA, 25 bp, Mus musculus
ttagatgatgtgaacgagattattg

SEQ ID NO: 388477 - DNA, 25 bp, Mus musculus
ttagatgatgttggtgatctgaaaa

SEQ ID NO: 388478 - DNA, 25 bp, Mus musculus
ttagatgcctgagggcaggatggcc

SEQ ID NO: 388479 - DNA, 25 bp, Mus musculus
ttagatggaaaggtgtcgcaacatc

SEQ ID NO: 388480 - DNA, 25 bp, Mus musculus
ttagattattagatatgctctccaa

SEQ ID NO: 388481 - DNA, 25 bp, Mus musculus
ttagattcttagaagggctggaaaa

SEQ ID NO: 388482 - DNA, 25 bp, Mus musculus
ttagatttattgttgattcttccaa

SEQ ID NO: 388483 - DNA, 25 bp, Mus musculus
ttagcaaaaaagggtctcgtagcat

SEQ ID NO: 388484 - DNA, 25 bp, Mus musculus
ttagcaaaaaaggtgttcctcagca

SEQ ID NO: 388485 - DNA, 25 bp, Mus musculus
ttagcaaaaccaaggctgagccgag

SEQ ID NO: 388486 - DNA, 25 bp, Mus musculus
ttagcaaaaccaaggctgaggcgag

SEQ ID NO: 388487 - DNA, 25 bp, Mus musculus
ttagcaaaagtgcttggctgtctgg

SEQ ID NO: 388488 - DNA, 25 bp, Mus musculus
ttagcaaagcaacaggtttcagata

SEQ ID NO: 388489 - DNA, 25 bp, Mus musculus
ttagcaacacctctactgccgccca

SEQ ID NO: 388490 - DNA, 25 bp, Mus musculus
ttagcaaccgctatggaattgccat

SEQ ID NO: 388491 - DNA, 25 bp, Mus musculus
ttagcaactggagcactaaagcgaa

SEQ ID NO: 388492 - DNA, 25 bp, Mus musculus
ttagcaagcagtccatctcagtcca

SEQ ID NO: 388493 - DNA, 25 bp, Mus musculus
ttagcaagcataaacagattccggg

SEQ ID NO: 388494 - DNA, 25 bp, Mus musculus
ttagcaataggagaagatggagggg

SEQ ID NO: 388495 - DNA, 25 bp, Mus musculus
ttagcaccaggaatgtcactgtctg

SEQ ID NO: 388496 - DNA, 25 bp, Mus musculus
ttagcaccgtggtgagtaatagttc

SEQ ID NO: 388497 - DNA, 25 bp, Mus musculus
ttagcacgaatgtgtgagaaaacct

SEQ ID NO: 388498 - DNA, 25 bp, Mus musculus
ttagcacttggtgtggagaagacag

SEQ ID NO: 388499 - DNA, 25 bp, Mus musculus
ttagcagaacaggtgtttggatttg

SEQ ID NO: 388500 - DNA, 25 bp, Mus musculus
ttagcagaagctcacgctcgcctga

SEQ ID NO: 388501 - DNA, 25 bp, Mus musculus
ttagcagaccaaaagcccttgccag

SEQ ID NO: 388502 - DNA, 25 bp, Mus musculus
ttagcaggaggcccaagcctttcca

SEQ ID NO: 388503 - DNA, 25 bp, Mus musculus
ttagcaggaggcccaatgattagca

SEQ ID NO: 388504 - DNA, 25 bp, Mus musculus
ttagcagtcaaactcagcaacagca

SEQ ID NO: 388505 - DNA, 25 bp, Mus musculus
ttagcagtcaatatatggactaatg

SEQ ID NO: 388506 - DNA, 25 bp, Mus musculus
ttagcataaaggcatttacactctt

SEQ ID NO: 388507 - DNA, 25 bp, Mus musculus
ttagcatacagaatatgaacatcga

SEQ ID NO: 388508 - DNA, 25 bp, Mus musculus
ttagcatacaggtccaacccagtgg

SEQ ID NO: 388509 - DNA, 25 bp, Mus musculus
ttagcatactcagcgagagaagcgg

SEQ ID NO: 388510 - DNA, 25 bp, Mus musculus
ttagcatccagtgggtgtataacat

SEQ ID NO: 388511 - DNA, 25 bp, Mus musculus
ttagcatccgccacgccgtctgggt

SEQ ID NO: 388512 - DNA, 25 bp, Mus musculus
ttagcatcggcaggacagcagcgct

SEQ ID NO: 388513 - DNA, 25 bp, Mus musculus
ttagcatctgacattgagattcttt

SEQ ID NO: 388514 - DNA, 25 bp, Mus musculus
ttagcatggcagatgaaccggacaa

SEQ ID NO: 388515 - DNA, 25 bp, Mus musculus
ttagcattaaggaatcttgggaagc

SEQ ID NO: 388516 - DNA, 25 bp, Mus musculus
ttagccaccaaagcgatgttaaaga

SEQ ID NO: 388517 - DNA, 25 bp, Mus musculus
ttagccaccaggacacagaatgttc

SEQ ID NO: 388518 - DNA, 25 bp, Mus musculus
ttagcccagcaaggaacaccagtgt

SEQ ID NO: 388519 - DNA, 25 bp, Mus musculus
ttagcccatatgcaactgccccctg

SEQ ID NO: 388520 - DNA, 25 bp, Mus musculus
ttagccccaggtgctgcagtcgcag

SEQ ID NO: 388521 - DNA, 25 bp, Mus musculus
ttagccccgtggacccagcagctgt

SEQ ID NO: 388522 - DNA, 25 bp, Mus musculus
ttagccccgtgggtgctcgtgtgca

SEQ ID NO: 388523 - DNA, 25 bp, Mus musculus
ttagcccgaggggaccctgttgact

SEQ ID NO: 388524 - DNA, 25 bp, Mus musculus
ttagcccgcgaggaacagtctgaga

SEQ ID NO: 388525 - DNA, 25 bp, Mus musculus
ttagcccggtgcacgatgcccccga

SEQ ID NO: 388526 - DNA, 25 bp, Mus musculus
ttagccgaaggcagcttggagaaga

SEQ ID NO: 388527 - DNA, 25 bp, Mus musculus
ttagccgaaggcagtctttcagaaa

SEQ ID NO: 388528 - DNA, 25 bp, Mus musculus
ttagccgagcgtaagatcccctgct

SEQ ID NO: 388529 - DNA, 25 bp, Mus musculus
ttagccgagcgtaaggctgatggat

SEQ ID NO: 388530 - DNA, 25 bp, Mus musculus
ttagccgaggctgtgtgtgtgaagt

SEQ ID NO: 388531 - DNA, 25 bp, Mus musculus
ttagccggaggatactcagctctgg

SEQ ID NO: 388532 - DNA, 25 bp, Mus musculus
ttagccggtgacgccgccgaagatg

SEQ ID NO: 388533 - DNA, 25 bp, Mus musculus
ttagcctacccctgaccatcccctc

SEQ ID NO: 388534 - DNA, 25 bp, Mus musculus
ttagcctttgaggtgtgcctgcagt

SEQ ID NO: 388535 - DNA, 25 bp, Mus musculus
ttagcgagcagggcgtaagaacaag

SEQ ID NO: 388536 - DNA, 25 bp, Mus musculus
ttagcgatttccgggacctcatgtc

SEQ ID NO: 388537 - DNA, 25 bp, Mus musculus
ttagcgccatcagcgaggctgctgc

SEQ ID NO: 388538 - DNA, 25 bp, Mus musculus
ttagcggataacaggctgaccacag

SEQ ID NO: 388539 - DNA, 25 bp, Mus musculus
ttagcggcggactggtgcagtcaga

SEQ ID NO: 388540 - DNA, 25 bp, Mus musculus
ttagcggcgggagtctatcctgaac

SEQ ID NO: 388541 - DNA, 25 bp, Mus musculus
ttagcggcgggtactataccaactg

SEQ ID NO: 388542 - DNA, 25 bp, Mus musculus
ttagcggtgagtgatcgtgagacat

SEQ ID NO: 388543 - DNA, 25 bp, Mus musculus
ttagcgttaccctgggaatctgaga

SEQ ID NO: 388544 - DNA, 25 bp, Mus musculus
ttagctacaggaagcagtttgagcc

SEQ ID NO: 388545 - DNA, 25 bp, Mus musculus
ttagctacaggagcatctggacccg

SEQ ID NO: 388546 - DNA, 25 bp, Mus musculus
ttagctaccaagaccgagatgccgc

SEQ ID NO: 388547 - DNA, 25 bp, Mus musculus
ttagctacctgcctaaccagcccct

SEQ ID NO: 388548 - DNA, 25 bp, Mus musculus
ttagctatagtcatttacaaaatgg

SEQ ID NO: 388549 - DNA, 25 bp, Mus musculus
ttagctatttatgaagccaaagctg

SEQ ID NO: 388550 - DNA, 25 bp, Mus musculus
ttagctatttatggttacaccttct

SEQ ID NO: 388551 - DNA, 25 bp, Mus musculus
ttagctctgccccaggcctcctcaa

SEQ ID NO: 388552 - DNA, 25 bp, Mus musculus
ttagctgaccgtgctattcactggc

SEQ ID NO: 388553 - DNA, 25 bp, Mus musculus
ttagctgaccgtggtgagttgaggg

SEQ ID NO: 388554 - DNA, 25 bp, Mus musculus
ttagctgccgctccacagtggctcc

SEQ ID NO: 388555 - DNA, 25 bp, Mus musculus
ttagctggcaaagattttctttgag

SEQ ID NO: 388556 - DNA, 25 bp, Mus musculus
ttagctggcggtgtggcacccactt

SEQ ID NO: 388557 - DNA, 25 bp, Mus musculus
ttagctgggacctacctgaactacc

SEQ ID NO: 388558 - DNA, 25 bp, Mus musculus
ttagctgggacctacgtatcacaag

SEQ ID NO: 388559 - DNA, 25 bp, Mus musculus
ttagctgtgcaagctgacttcggag

SEQ ID NO: 388560 - DNA, 25 bp, Mus musculus
ttagcttcctgagagtgcccgaggc

SEQ ID NO: 388561 - DNA, 25 bp, Mus musculus
ttagcttttatggcgcgagcttcat

SEQ ID NO: 388562 - DNA, 25 bp, Mus musculus
ttaggaaaacaataaatgcacctga

SEQ ID NO: 388563 - DNA, 25 bp, Mus musculus
ttaggaaaacagtccttcacgtctt

SEQ ID NO: 388564 - DNA, 25 bp, Mus musculus
ttaggaaaaccaatggctcaccctg

SEQ ID NO: 388565 - DNA, 25 bp, Mus musculus
ttaggaaacagctatataaaagaac

SEQ ID NO: 388566 - DNA, 25 bp, Mus musculus
ttaggaaacagggtggactctccca

SEQ ID NO: 388567 - DNA, 25 bp, Mus musculus
ttaggaaccaaggtagcttctccat

SEQ ID NO: 388568 - DNA, 25 bp, Mus musculus
ttaggaacccagattttgttcctgg

SEQ ID NO: 388569 - DNA, 25 bp, Mus musculus
ttaggaagggaagttcttccatcag

SEQ ID NO: 388570 - DNA, 25 bp, Mus musculus
ttaggaagttccgattaatggaacg

SEQ ID NO: 388571 - DNA, 25 bp, Mus musculus
ttaggaatcagtggcaacagtacca

SEQ ID NO: 388572 - DNA, 25 bp, Mus musculus
ttaggacacattctggtgctggaga

SEQ ID NO: 388573 - DNA, 25 bp, Mus musculus
ttaggacagagatcggtaccgttgc

SEQ ID NO: 388574 - DNA, 25 bp, Mus musculus
ttaggacaggaggggaagaaaatgg

SEQ ID NO: 388575 - DNA, 25 bp, Mus musculus
ttaggaccacgagtattgttacagt

SEQ ID NO: 388576 - DNA, 25 bp, Mus musculus
ttaggaccagctcgcaggattaagg

SEQ ID NO: 388577 - DNA, 25 bp, Mus musculus
ttaggacctcggggagaaagaggga

SEQ ID NO: 388578 - DNA, 25 bp, Mus musculus
ttaggacctgggatggattgtaagc

SEQ ID NO: 388579 - DNA, 25 bp, Mus musculus
ttaggactcagctccatgtctatcc

SEQ ID NO: 388580 - DNA, 25 bp, Mus musculus
ttaggactcaggtctggctgtgcat

SEQ ID NO: 388581 - DNA, 25 bp, Mus musculus
ttaggagaagacataatgtcaagtg

SEQ ID NO: 388582 - DNA, 25 bp, Mus musculus
ttaggagaaggttgtggagttcttt

SEQ ID NO: 388583 - DNA, 25 bp, Mus musculus
ttaggagagcagctgctgaaagacc

SEQ ID NO: 388584 - DNA, 25 bp, Mus musculus
ttaggagccagaagctgactgctgc

SEQ ID NO: 388585 - DNA, 25 bp, Mus musculus
ttaggagccagaaggaggctggcaa

SEQ ID NO: 388586 - DNA, 25 bp, Mus musculus
ttaggagccagaggaagtcacagac

SEQ ID NO: 388587 - DNA, 25 bp, Mus musculus
ttaggaggaatgccctgctggaggc

SEQ ID NO: 388588 - DNA, 25 bp, Mus musculus
ttaggaggaatggcctactgaacca

SEQ ID NO: 388589 - DNA, 25 bp, Mus musculus
ttaggaggagagcaattatgaagcc

SEQ ID NO: 388590 - DNA, 25 bp, Mus musculus
ttaggaggtatcttgatgtggttat

SEQ ID NO: 388591 - DNA, 25 bp, Mus musculus
ttaggaggtcctaacaagacagaac

SEQ ID NO: 388592 - DNA, 25 bp, Mus musculus
ttaggagtaaagcagtcagtggaag

SEQ ID NO: 388593 - DNA, 25 bp, Mus musculus
ttaggagtaaagctgcttctaaaca

SEQ ID NO: 388594 - DNA, 25 bp, Mus musculus
ttaggagtccggtgagttggagtga

SEQ ID NO: 388595 - DNA, 25 bp, Mus musculus
ttaggagtgtgaaaaaagtcattga

SEQ ID NO: 388596 - DNA, 25 bp, Mus musculus
ttaggagttcacagcatgaaggact

SEQ ID NO: 388597 - DNA, 25 bp, Mus musculus
ttaggagttcacagcgcactgtttg

SEQ ID NO: 388598 - DNA, 25 bp, Mus musculus
ttaggagttgaatgcccaaaggata

SEQ ID NO: 388599 - DNA, 25 bp, Mus musculus
ttaggatcagcatagaagctgcgtt

SEQ ID NO: 388600 - DNA, 25 bp, Mus musculus
ttaggatcagcataggatcaagtag

SEQ ID NO: 388601 - DNA, 25 bp, Mus musculus
ttaggattatagatcctggcagcca

SEQ ID NO: 388602 - DNA, 25 bp, Mus musculus
ttaggattgcagcacctaccctcag

SEQ ID NO: 388603 - DNA, 25 bp, Mus musculus
ttaggcaagggaaggacatttggat

SEQ ID NO: 388604 - DNA, 25 bp, Mus musculus
ttaggcacaaggatactgagaactc

SEQ ID NO: 388605 - DNA, 25 bp, Mus musculus
ttaggcccaaagctctacagactca

SEQ ID NO: 388606 - DNA, 25 bp, Mus musculus
ttaggcccaaaggtacagagatgtt

SEQ ID NO: 388607 - DNA, 25 bp, Mus musculus
ttaggcccaaaggtgttctacactc

SEQ ID NO: 388608 - DNA, 25 bp, Mus musculus
ttaggccgcggaggtcacaggctct

SEQ ID NO: 388609 - DNA, 25 bp, Mus musculus
ttaggccttctatagcccgtgtgat

SEQ ID NO: 388610 - DNA, 25 bp, Mus musculus
ttaggccttctataggcctctgctc

SEQ ID NO: 388611 - DNA, 25 bp, Mus musculus
ttaggccttctatagtgagattata

SEQ ID NO: 388612 - DNA, 25 bp, Mus musculus
ttaggcggacaggagatgaccggtt

SEQ ID NO: 388613 - DNA, 25 bp, Mus musculus
ttaggctcccgagttctacacagct

SEQ ID NO: 388614 - DNA, 25 bp, Mus musculus
ttaggctggccgcaggctggcaaca

SEQ ID NO: 388615 - DNA, 25 bp, Mus musculus
ttaggcttgcttgttggtgattgta

SEQ ID NO: 388616 - DNA, 25 bp, Mus musculus
ttagggaaataattgttgcttgtgc

SEQ ID NO: 388617 - DNA, 25 bp, Mus musculus
ttagggaacagacactctccccgac

SEQ ID NO: 388618 - DNA, 25 bp, Mus musculus
ttagggaagaaagtgtctggactct

SEQ ID NO: 388619 - DNA, 25 bp, Mus musculus
ttagggaagaagaagcccagggtgc

SEQ ID NO: 388620 - DNA, 25 bp, Mus musculus
ttagggatggagcctcccaagctga

SEQ ID NO: 388621 - DNA, 25 bp, Mus musculus
ttagggcaagattctcagccaccgg

SEQ ID NO: 388622 - DNA, 25 bp, Mus musculus
ttagggcagaatatgcagacagaca

SEQ ID NO: 388623 - DNA, 25 bp, Mus musculus
ttagggccggacaggattgtggaat

SEQ ID NO: 388624 - DNA, 25 bp, Mus musculus
ttagggccggacagtgtctcgttcg

SEQ ID NO: 388625 - DNA, 25 bp, Mus musculus
ttaggggatggtgatgaacgagacc

SEQ ID NO: 388626 - DNA, 25 bp, Mus musculus
ttagggggggatctgatggatacgg

SEQ ID NO: 388627 - DNA, 25 bp, Mus musculus
ttagggtccacatggtgatatcatg

SEQ ID NO: 388628 - DNA, 25 bp, Mus musculus
ttagggtgtcttctaatgttctgat

SEQ ID NO: 388629 - DNA, 25 bp, Mus musculus
ttagggttcaggaggggtgagtcag

SEQ ID NO: 388630 - DNA, 25 bp, Mus musculus
ttaggtaaatgagatcatgattctg

SEQ ID NO: 388631 - DNA, 25 bp, Mus musculus
ttaggtaggctcagagtgcgatgcg

SEQ ID NO: 388632 - DNA, 25 bp, Mus musculus
ttaggtaggctcagagttcgaggaa

SEQ ID NO: 388633 - DNA, 25 bp, Mus musculus
ttaggtcgctgatctgccaggatcc

SEQ ID NO: 388634 - DNA, 25 bp, Mus musculus
ttaggtcgctgcacacagggccaga

SEQ ID NO: 388635 - DNA, 25 bp, Mus musculus
ttaggtctggatcccacgcaatgat

SEQ ID NO: 388636 - DNA, 25 bp, Mus musculus
ttaggtgtaagcccatctgctggca

SEQ ID NO: 388637 - DNA, 25 bp, Mus musculus
ttaggtgtggccttgcaaagctgtt

SEQ ID NO: 388638 - DNA, 25 bp, Mus musculus
ttaggttctcaggctattgatacag

SEQ ID NO: 388639 - DNA, 25 bp, Mus musculus
ttaggttgtcagcgggtgactttgc

SEQ ID NO: 388640 - DNA, 25 bp, Mus musculus
ttaggtttaatatttcagcagtgtg

SEQ ID NO: 388641 - DNA, 25 bp, Mus musculus
ttaggtttgcagatgatacgtatac

SEQ ID NO: 388642 - DNA, 25 bp, Mus musculus
ttaggtttgcatgggacacagcagg

SEQ ID NO: 388643 - DNA, 25 bp, Mus musculus
ttagtaaaacttacctcactgtgga

SEQ ID NO: 388644 - DNA, 25 bp, Mus musculus
ttagtaaatgaaggctggagccagt

SEQ ID NO: 388645 - DNA, 25 bp, Mus musculus
ttagtaagagtttgatacgaacaga

SEQ ID NO: 388646 - DNA, 25 bp, Mus musculus
ttagtaagcatgtgtcatggctccg

SEQ ID NO: 388647 - DNA, 25 bp, Mus musculus
ttagtagacaagggagcatatgcag

SEQ ID NO: 388648 - DNA, 25 bp, Mus musculus
ttagtagcagaggtaactcagcaac

SEQ ID NO: 388649 - DNA, 25 bp, Mus musculus
ttagtagcttccaggtggtggtcct

SEQ ID NO: 388650 - DNA, 25 bp, Mus musculus
ttagtaggaagggcatttgtgtact

SEQ ID NO: 388651 - DNA, 25 bp, Mus musculus
ttagtatcaaaacttctctattctc

SEQ ID NO: 388652 - DNA, 25 bp, Mus musculus
ttagtattaaagataatcaaataca

SEQ ID NO: 388653 - DNA, 25 bp, Mus musculus
ttagtattccaggaaaagatggcat

SEQ ID NO: 388654 - DNA, 25 bp, Mus musculus
ttagtattgcatatagtcctgatgg

SEQ ID NO: 388655 - DNA, 25 bp, Mus musculus
ttagtcaccagtgccagcggattga

SEQ ID NO: 388656 - DNA, 25 bp, Mus musculus
ttagtcccagaacagatcgggaagc

SEQ ID NO: 388657 - DNA, 25 bp, Mus musculus
ttagtcccagtggaagcaccagcct

SEQ ID NO: 388658 - DNA, 25 bp, Mus musculus
ttagtccgagccgccatgggctgcc

SEQ ID NO: 388659 - DNA, 25 bp, Mus musculus
ttagtccgcagacccccaggaaaca

SEQ ID NO: 388660 - DNA, 25 bp, Mus musculus
ttagtcctcagaggccagttgttgc

SEQ ID NO: 388661 - DNA, 25 bp, Mus musculus
ttagtcctggcaggactttcctgga

SEQ ID NO: 388662 - DNA, 25 bp, Mus musculus
ttagtcctgggaaaggtgtggtatc

SEQ ID NO: 388663 - DNA, 25 bp, Mus musculus
ttagtccttgccctgccgaagattt

SEQ ID NO: 388664 - DNA, 25 bp, Mus musculus
ttagtctagaaaacataggagacag

SEQ ID NO: 388665 - DNA, 25 bp, Mus musculus
ttagtctagaaaacgctaatctttc

SEQ ID NO: 388666 - DNA, 25 bp, Mus musculus
ttagtctcagaggatagctctctac

SEQ ID NO: 388667 - DNA, 25 bp, Mus musculus
ttagtgaccagatggttcagaactt

SEQ ID NO: 388668 - DNA, 25 bp, Mus musculus
ttagtgaccagtaaaaggtactttt

SEQ ID NO: 388669 - DNA, 25 bp, Mus musculus
ttagtgacctgacgttgatgtcagt

SEQ ID NO: 388670 - DNA, 25 bp, Mus musculus
ttagtgacctgactcctgggtgcca

SEQ ID NO: 388671 - DNA, 25 bp, Mus musculus
ttagtgataggctctctcctaaacc

SEQ ID NO: 388672 - DNA, 25 bp, Mus musculus
ttagtgatagggttcactgtgggag

SEQ ID NO: 388673 - DNA, 25 bp, Mus musculus
ttagtgcaggaaacttcgcggctca

SEQ ID NO: 388674 - DNA, 25 bp, Mus musculus
ttagtggaagaaagcacattgtagt

SEQ ID NO: 388675 - DNA, 25 bp, Mus musculus
ttagtggaccctcagattgatgaca

SEQ ID NO: 388676 - DNA, 25 bp, Mus musculus
ttagtggccagggttgaagacaatg

SEQ ID NO: 388677 - DNA, 25 bp, Mus musculus
ttagtggccaggtcctgctctctct

SEQ ID NO: 388678 - DNA, 25 bp, Mus musculus
ttagtgtcaatccctgatactgtag

SEQ ID NO: 388679 - DNA, 25 bp, Mus musculus
ttagttaaaagctgtatcgacatgg

SEQ ID NO: 388680 - DNA, 25 bp, Mus musculus
ttagttaaaggtctctgtgttggtt

SEQ ID NO: 388681 - DNA, 25 bp, Mus musculus
ttagttaagctgagtgtcctggttg

SEQ ID NO: 388682 - DNA, 25 bp, Mus musculus
ttagttcccaacggggttaagcctg

SEQ ID NO: 388683 - DNA, 25 bp, Mus musculus
ttagttggacagagctggcaaggga

SEQ ID NO: 388684 - DNA, 25 bp, Mus musculus
ttagttgttcaagagaaaccattta

SEQ ID NO: 388685 - DNA, 25 bp, Mus musculus
ttagttgttcaagatgggagaatga

SEQ ID NO: 388686 - DNA, 25 bp, Mus musculus
ttagttttaaggccgaagtcaattc

SEQ ID NO: 388687 - DNA, 25 bp, Mus musculus
ttagttttaagtatggcgcccagaa

SEQ ID NO: 388688 - DNA, 25 bp, Mus musculus
ttataaaaaggcacagaagaatgag

SEQ ID NO: 388689 - DNA, 25 bp, Mus musculus
ttataaaaatctgctgtatcttgga

SEQ ID NO: 388690 - DNA, 25 bp, Mus musculus
ttataaaaatggtgtccttggactt

SEQ ID NO: 388691 - DNA, 25 bp, Mus musculus
ttataaaaatggtgtcctttggccg

SEQ ID NO: 388692 - DNA, 25 bp, Mus musculus
ttataaaagacggcatccagctcag

SEQ ID NO: 388693 - DNA, 25 bp, Mus musculus
ttataaacagacatttccactgggc

SEQ ID NO: 388694 - DNA, 25 bp, Mus musculus
ttataaacattcaagctctgcctca

SEQ ID NO: 388695 - DNA, 25 bp, Mus musculus
ttataaacttaatgaggacatggct

SEQ ID NO: 388696 - DNA, 25 bp, Mus musculus
ttataacaaactggatgcagagaat

SEQ ID NO: 388697 - DNA, 25 bp, Mus musculus
ttataactacaaggatcctgctggc

SEQ ID NO: 388698 - DNA, 25 bp, Mus musculus
ttataactaccagatgccaccgcag

SEQ ID NO: 388699 - DNA, 25 bp, Mus musculus
ttataactaccaggcttatacaact

SEQ ID NO: 388700 - DNA, 25 bp, Mus musculus
ttataacttgcagattctgcttcga

SEQ ID NO: 388701 - DNA, 25 bp, Mus musculus
ttataagaacgagctgcaccgccat

SEQ ID NO: 388702 - DNA, 25 bp, Mus musculus
ttataagaagccagatgtgaactgg

SEQ ID NO: 388703 - DNA, 25 bp, Mus musculus
ttataagacaaaaaagaagaggagc

SEQ ID NO: 388704 - DNA, 25 bp, Mus musculus
ttataagagagatgctaacattttt

SEQ ID NO: 388705 - DNA, 25 bp, Mus musculus
ttataagagaggtagaaatgggtcc

SEQ ID NO: 388706 - DNA, 25 bp, Mus musculus
ttataagcaaatgggggaagcccta

SEQ ID NO: 388707 - DNA, 25 bp, Mus musculus
ttataagcaaattctacggtgagac

SEQ ID NO: 388708 - DNA, 25 bp, Mus musculus
ttataatatgaatgtctcaggtgaa

SEQ ID NO: 388709 - DNA, 25 bp, Mus musculus
ttataatcaggctggccagctaagc

SEQ ID NO: 388710 - DNA, 25 bp, Mus musculus
ttataatgaaaaggtaatgtatgtg

SEQ ID NO: 388711 - DNA, 25 bp, Mus musculus
ttataatgattccgatggagggacg

SEQ ID NO: 388712 - DNA, 25 bp, Mus musculus
ttataatgccaacagcactatagtt

SEQ ID NO: 388713 - DNA, 25 bp, Mus musculus
ttataatgtaatctgggtgttgacg

SEQ ID NO: 388714 - DNA, 25 bp, Mus musculus
ttataatgtgtctgacttcttccga

SEQ ID NO: 388715 - DNA, 25 bp, Mus musculus
ttataattactgagacaacactggt

SEQ ID NO: 388716 - DNA, 25 bp, Mus musculus
ttataatttataagagagatggttg

SEQ ID NO: 388717 - DNA, 25 bp, Mus musculus
ttataatttcaaggttgattctttc

SEQ ID NO: 388718 - DNA, 25 bp, Mus musculus
ttatacaaatgtcggagtcttctaa

SEQ ID NO: 388719 - DNA, 25 bp, Mus musculus
ttatacaagaccaggggttcaagga

SEQ ID NO: 388720 - DNA, 25 bp, Mus musculus
ttatacacaatgagactcaccataa

SEQ ID NO: 388721 - DNA, 25 bp, Mus musculus
ttatacagcagcagggcacgtcaga

SEQ ID NO: 388722 - DNA, 25 bp, Mus musculus
ttataccctagccggaaagccagtg

SEQ ID NO: 388723 - DNA, 25 bp, Mus musculus
ttataccctagccgtgtacaagtct

SEQ ID NO: 388724 - DNA, 25 bp, Mus musculus
ttataccctctcctaccaccactgg

SEQ ID NO: 388725 - DNA, 25 bp, Mus musculus
ttatacctcaagctggcacagtgat

SEQ ID NO: 388726 - DNA, 25 bp, Mus musculus
ttatacctccggcttatacaactgt

SEQ ID NO: 388727 - DNA, 25 bp, Mus musculus
ttatacctggggttttgtatgaaca

SEQ ID NO: 388728 - DNA, 25 bp, Mus musculus
ttatactggaagaagaaacagtcaa

SEQ ID NO: 388729 - DNA, 25 bp, Mus musculus
ttatactggaagtagaaacagtcaa

SEQ ID NO: 388730 - DNA, 25 bp, Mus musculus
ttatactgtgacaggagggctggcg

SEQ ID NO: 388731 - DNA, 25 bp, Mus musculus
ttatacttgctagctgccgactaca

SEQ ID NO: 388732 - DNA, 25 bp, Mus musculus
ttatactttaagaggctggattgtc

SEQ ID NO: 388733 - DNA, 25 bp, Mus musculus
ttatagaaaaggtcattttgagtgc

SEQ ID NO: 388734 - DNA, 25 bp, Mus musculus
ttatagaacacatagtgtggatcca

SEQ ID NO: 388735 - DNA, 25 bp, Mus musculus
ttatagaacacatagttaaccttgg

SEQ ID NO: 388736 - DNA, 25 bp, Mus musculus
ttatagactggcctcatctgttccg

SEQ ID NO: 388737 - DNA, 25 bp, Mus musculus
ttatagatgcttatgtggatatgct

SEQ ID NO: 388738 - DNA, 25 bp, Mus musculus
ttatagattctgattcttcgtggtg

SEQ ID NO: 388739 - DNA, 25 bp, Mus musculus
ttatagattctttcttgaacacttc

SEQ ID NO: 388740 - DNA, 25 bp, Mus musculus
ttatagcagtgatcccgcttcgatg

SEQ ID NO: 388741 - DNA, 25 bp, Mus musculus
ttatagccagagaatgtattcttca

SEQ ID NO: 388742 - DNA, 25 bp, Mus musculus
ttatagccagataactggggtgagt

SEQ ID NO: 388743 - DNA, 25 bp, Mus musculus
ttatagccaggatttcccagcctgg

SEQ ID NO: 388744 - DNA, 25 bp, Mus musculus
ttatagccaggtctccagcagaagg

SEQ ID NO: 388745 - DNA, 25 bp, Mus musculus
ttataggacaggacggggtccctcc

SEQ ID NO: 388746 - DNA, 25 bp, Mus musculus
ttataggagctttactgaagactgt

SEQ ID NO: 388747 - DNA, 25 bp, Mus musculus
ttatagtatgagagcatattccgcg

SEQ ID NO: 388748 - DNA, 25 bp, Mus musculus
ttatagtatgaggtacctgtcgtag

SEQ ID NO: 388749 - DNA, 25 bp, Mus musculus
ttatagtatgagtgatgtcctcgca

SEQ ID NO: 388750 - DNA, 25 bp, Mus musculus
ttatagtctgattcctttctccttg

SEQ ID NO: 388751 - DNA, 25 bp, Mus musculus
ttatataagaagcccctccaggccg

SEQ ID NO: 388752 - DNA, 25 bp, Mus musculus
ttatataccaaaggttcaaaagagg

SEQ ID NO: 388753 - DNA, 25 bp, Mus musculus
ttatatatagcaaaaatgtgaatcc

SEQ ID NO: 388754 - DNA, 25 bp, Mus musculus
ttatatatagcaactttaaaggatt

SEQ ID NO: 388755 - DNA, 25 bp, Mus musculus
ttatatatatggacatacatgttta

SEQ ID NO: 388756 - DNA, 25 bp, Mus musculus
ttatatatatggatttgttgctgtt

SEQ ID NO: 388757 - DNA, 25 bp, Mus musculus
ttatatatgaggtaccagctctact

SEQ ID NO: 388758 - DNA, 25 bp, Mus musculus
ttatatatgcgaaaggcctgtccga

SEQ ID NO: 388759 - DNA, 25 bp, Mus musculus
ttatatatgcgaaagggaacttccc

SEQ ID NO: 388760 - DNA, 25 bp, Mus musculus
ttatatcaagttcaaaaggatgctg

SEQ ID NO: 388761 - DNA, 25 bp, Mus musculus
ttatatcatttagaggacattcact

SEQ ID NO: 388762 - DNA, 25 bp, Mus musculus
ttatatccacgataattttattccc

SEQ ID NO: 388763 - DNA, 25 bp, Mus musculus
ttatatccttctagtgttgggcaac

SEQ ID NO: 388764 - DNA, 25 bp, Mus musculus
ttatatccttttagtgttgggcaac

SEQ ID NO: 388765 - DNA, 25 bp, Mus musculus
ttatatgaaagttacgagaagcagg

SEQ ID NO: 388766 - DNA, 25 bp, Mus musculus
ttatatgaactatgatggattcaat

SEQ ID NO: 388767 - DNA, 25 bp, Mus musculus
ttatatgacagagtccgctcctgcc

SEQ ID NO: 388768 - DNA, 25 bp, Mus musculus
ttatatgacaggtcatggagggaat

SEQ ID NO: 388769 - DNA, 25 bp, Mus musculus
ttatatgagtccaccaatggctcaa

SEQ ID NO: 388770 - DNA, 25 bp, Mus musculus
ttatatggaaagtaaattcagttcc

SEQ ID NO: 388771 - DNA, 25 bp, Mus musculus
ttatatggagcaaaaaatgggctac

SEQ ID NO: 388772 - DNA, 25 bp, Mus musculus
ttatatggagcaaaagtatgaatta

SEQ ID NO: 388773 - DNA, 25 bp, Mus musculus
ttatattaaaaggtgtccagtgtga

SEQ ID NO: 388774 - DNA, 25 bp, Mus musculus
ttatattaacccttggagtaaaaat

SEQ ID NO: 388775 - DNA, 25 bp, Mus musculus
ttatattcaaccagctgtgaccata

SEQ ID NO: 388776 - DNA, 25 bp, Mus musculus
ttatattgttacatgggtttatcca

SEQ ID NO: 388777 - DNA, 25 bp, Mus musculus
ttatattgttacatgtgtatctcca

SEQ ID NO: 388778 - DNA, 25 bp, Mus musculus
ttatatttctagaagatcattgcaa

SEQ ID NO: 388779 - DNA, 25 bp, Mus musculus
ttatcaaaacggaaggacctgcaat

SEQ ID NO: 388780 - DNA, 25 bp, Mus musculus
ttatcaaaagacttccaactgaata

SEQ ID NO: 388781 - DNA, 25 bp, Mus musculus
ttatcaaagaggatgtctcggaact

SEQ ID NO: 388782 - DNA, 25 bp, Mus musculus
ttatcaaccgaacacagaagaatcc

SEQ ID NO: 388783 - DNA, 25 bp, Mus musculus
ttatcaacctgaccctctatgggat

SEQ ID NO: 388784 - DNA, 25 bp, Mus musculus
ttatcaacctggaggacggtgagat

SEQ ID NO: 388785 - DNA, 25 bp, Mus musculus
ttatcaacgagtactgtattggcaa

SEQ ID NO: 388786 - DNA, 25 bp, Mus musculus
ttatcaagaagaaggacttttcccc

SEQ ID NO: 388787 - DNA, 25 bp, Mus musculus
ttatcaaggaacaagctagtggggt

SEQ ID NO: 388788 - DNA, 25 bp, Mus musculus
ttatcaagttctcagatgaatatct

SEQ ID NO: 388789 - DNA, 25 bp, Mus musculus
ttatcaatgacaacttcatcgactg

SEQ ID NO: 388790 - DNA, 25 bp, Mus musculus
ttatcacaagtgtgtgggataagag

SEQ ID NO: 388791 - DNA, 25 bp, Mus musculus
ttatcacaatgaggttgacattgtg

SEQ ID NO: 388792 - DNA, 25 bp, Mus musculus
ttatcaccaccacataagattgtct

SEQ ID NO: 388793 - DNA, 25 bp, Mus musculus
ttatcaccagggagctaagaagatt

SEQ ID NO: 388794 - DNA, 25 bp, Mus musculus
ttatcacccaaggttcagacaatga

SEQ ID NO: 388795 - DNA, 25 bp, Mus musculus
ttatcaccttccagaactctgcagc

SEQ ID NO: 388796 - DNA, 25 bp, Mus musculus
ttatcaccttccagactcagaactt

SEQ ID NO: 388797 - DNA, 25 bp, Mus musculus
ttatcaccttccaggctcaaactac

SEQ ID NO: 388798 - DNA, 25 bp, Mus musculus
ttatcacgaagaaaaacgtgaacat

SEQ ID NO: 388799 - DNA, 25 bp, Mus musculus
ttatcacggtacccttatttgacca

SEQ ID NO: 388800 - DNA, 25 bp, Mus musculus
ttatcactagaggtcgatcgcgatc

SEQ ID NO: 388801 - DNA, 25 bp, Mus musculus
ttatcactcagataacccttcctca

SEQ ID NO: 388802 - DNA, 25 bp, Mus musculus
ttatcactcaggcccaggcctggga

SEQ ID NO: 388803 - DNA, 25 bp, Mus musculus
ttatcactgcgagatgagctttgat

SEQ ID NO: 388804 - DNA, 25 bp, Mus musculus
ttatcactgcgagctgcttgacatg

SEQ ID NO: 388805 - DNA, 25 bp, Mus musculus
ttatcactgtgggccccctcccttc

SEQ ID NO: 388806 - DNA, 25 bp, Mus musculus
ttatcactttcaaaggcatctagtc

SEQ ID NO: 388807 - DNA, 25 bp, Mus musculus
ttatcagaaagctgtcggtgaccct

SEQ ID NO: 388808 - DNA, 25 bp, Mus musculus
ttatcagaagccccaacttgaataa

SEQ ID NO: 388809 - DNA, 25 bp, Mus musculus
ttatcagaaggcccaacttgaataa

SEQ ID NO: 388810 - DNA, 25 bp, Mus musculus
ttatcagaagtttccagagtgtgga

SEQ ID NO: 388811 - DNA, 25 bp, Mus musculus
ttatcagcccggcagccacatgttc

SEQ ID NO: 388812 - DNA, 25 bp, Mus musculus
ttatcagggatgtaggagatgagcc

SEQ ID NO: 388813 - DNA, 25 bp, Mus musculus
ttatcagtcaggattctgaatcagg

SEQ ID NO: 388814 - DNA, 25 bp, Mus musculus
ttatcagtcagggttacagagtcat

SEQ ID NO: 388815 - DNA, 25 bp, Mus musculus
ttatcagtctcagcatcctcatgtg

SEQ ID NO: 388816 - DNA, 25 bp, Mus musculus
ttatcatatgataatattaagaatg

SEQ ID NO: 388817 - DNA, 25 bp, Mus musculus
ttatcatatgatagtctgatatgcc

SEQ ID NO: 388818 - DNA, 25 bp, Mus musculus
ttatcatcaaaactggaagtttggt

SEQ ID NO: 388819 - DNA, 25 bp, Mus musculus
ttatcatccaggccattccccagta

SEQ ID NO: 388820 - DNA, 25 bp, Mus musculus
ttatcatccttagcaagagatgtcg

SEQ ID NO: 388821 - DNA, 25 bp, Mus musculus
ttatcattattcagggattgcttac

SEQ ID NO: 388822 - DNA, 25 bp, Mus musculus
ttatcattattcagttgtttgttgc

SEQ ID NO: 388823 - DNA, 25 bp, Mus musculus
ttatcattttttcgtcacagatcac

SEQ ID NO: 388824 - DNA, 25 bp, Mus musculus
ttatccaaaatcaggaacccactgg

SEQ ID NO: 388825 - DNA, 25 bp, Mus musculus
ttatccaaaggtgttttacatgagc

SEQ ID NO: 388826 - DNA, 25 bp, Mus musculus
ttatccaagtaatgagaggaagacg

SEQ ID NO: 388827 - DNA, 25 bp, Mus musculus
ttatccactcaattttaaagaaatc

SEQ ID NO: 388828 - DNA, 25 bp, Mus musculus
ttatccactttcttgggtctttggg

SEQ ID NO: 388829 - DNA, 25 bp, Mus musculus
ttatccagagacagcccaaaacttc

SEQ ID NO: 388830 - DNA, 25 bp, Mus musculus
ttatccagaggagacagcactctga

SEQ ID NO: 388831 - DNA, 25 bp, Mus musculus
ttatccagagtggagctgtaataga

SEQ ID NO: 388832 - DNA, 25 bp, Mus musculus
ttatccagagttgtttcttgagata

SEQ ID NO: 388833 - DNA, 25 bp, Mus musculus
ttatccaggacagttgtccacgtac

SEQ ID NO: 388834 - DNA, 25 bp, Mus musculus
ttatccagtcgcccctcccagagac

SEQ ID NO: 388835 - DNA, 25 bp, Mus musculus
ttatccagtcgccttctccttgcag

SEQ ID NO: 388836 - DNA, 25 bp, Mus musculus
ttatccataaacacggcttttttca

SEQ ID NO: 388837 - DNA, 25 bp, Mus musculus
ttatccatgaaggagcctacagaaa

SEQ ID NO: 388838 - DNA, 25 bp, Mus musculus
ttatccatgaaggagtccgctcaga

SEQ ID NO: 388839 - DNA, 25 bp, Mus musculus
ttatccattgcataaccccaaatct

SEQ ID NO: 388840 - DNA, 25 bp, Mus musculus
ttatcccaaagcctgaaaccaaaat

SEQ ID NO: 388841 - DNA, 25 bp, Mus musculus
ttatcccaaagcctgatgaggatga

SEQ ID NO: 388842 - DNA, 25 bp, Mus musculus
ttatcccaatgtggaagaagctcag

SEQ ID NO: 388843 - DNA, 25 bp, Mus musculus
ttatcccactctgcccgacctctga

SEQ ID NO: 388844 - DNA, 25 bp, Mus musculus
ttatccccaacagcgggaacttcat

SEQ ID NO: 388845 - DNA, 25 bp, Mus musculus
ttatccccaacaggtggtgaagcag

SEQ ID NO: 388846 - DNA, 25 bp, Mus musculus
ttatccccatggaaagggctgtgag

SEQ ID NO: 388847 - DNA, 25 bp, Mus musculus
ttatccccatggagaaaatccccca

SEQ ID NO: 388848 - DNA, 25 bp, Mus musculus
ttatccccatgttagaattgcccct

SEQ ID NO: 388849 - DNA, 25 bp, Mus musculus
ttatccccttatcagagcctgcccc

SEQ ID NO: 388850 - DNA, 25 bp, Mus musculus
ttatccgactacgggtggactatag

SEQ ID NO: 388851 - DNA, 25 bp, Mus musculus
ttatcctctctggcctctctcttgt

SEQ ID NO: 388852 - DNA, 25 bp, Mus musculus
ttatcctctttgacactctcgtggg

SEQ ID NO: 388853 - DNA, 25 bp, Mus musculus
ttatcctctttgacacttttctcaa

SEQ ID NO: 388854 - DNA, 25 bp, Mus musculus
ttatcctgagcaaaggctacaacaa

SEQ ID NO: 388855 - DNA, 25 bp, Mus musculus
ttatcctgcaagggagcccggtggt

SEQ ID NO: 388856 - DNA, 25 bp, Mus musculus
ttatcctggactgagctcctggcta

SEQ ID NO: 388857 - DNA, 25 bp, Mus musculus
ttatcctgtggtgtgagtgttgagt

SEQ ID NO: 388858 - DNA, 25 bp, Mus musculus
ttatccttaagatgactgcttacgg

SEQ ID NO: 388859 - DNA, 25 bp, Mus musculus
ttatcgaggaggcagcgggccgtga

SEQ ID NO: 388860 - DNA, 25 bp, Mus musculus
ttatcgctgcaggaacgtttggatg

SEQ ID NO: 388861 - DNA, 25 bp, Mus musculus
ttatcggaactgagccatctcttgg

SEQ ID NO: 388862 - DNA, 25 bp, Mus musculus
ttatcgttatgttgattcacaatga

SEQ ID NO: 388863 - DNA, 25 bp, Mus musculus
ttatctaaggaaggaaaaccataag

SEQ ID NO: 388864 - DNA, 25 bp, Mus musculus
ttatctacatttcagacatcccgct

SEQ ID NO: 388865 - DNA, 25 bp, Mus musculus
ttatctacatttcagatcctcctac

SEQ ID NO: 388866 - DNA, 25 bp, Mus musculus
ttatctacgagaccctcctctggct

SEQ ID NO: 388867 - DNA, 25 bp, Mus musculus
ttatctactacaaggtttgaagagt

SEQ ID NO: 388868 - DNA, 25 bp, Mus musculus
ttatctagtgccaggaaaatactaa

SEQ ID NO: 388869 - DNA, 25 bp, Mus musculus
ttatctataccagataaaaactaca

SEQ ID NO: 388870 - DNA, 25 bp, Mus musculus
ttatctcactatcctttgtgagatc

SEQ ID NO: 388871 - DNA, 25 bp, Mus musculus
ttatctccacaaaggtgtattccct

SEQ ID NO: 388872 - DNA, 25 bp, Mus musculus
ttatctccagaagtgacagacagga

SEQ ID NO: 388873 - DNA, 25 bp, Mus musculus
ttatctccagtaccattgcaagtac

SEQ ID NO: 388874 - DNA, 25 bp, Mus musculus
ttatctccatctcttcccactggaa

SEQ ID NO: 388875 - DNA, 25 bp, Mus musculus
ttatctccgggtctcactgttagag

SEQ ID NO: 388876 - DNA, 25 bp, Mus musculus
ttatctcctctcctgaaaatgactc

SEQ ID NO: 388877 - DNA, 25 bp, Mus musculus
ttatctctgttggggcttcacacct

SEQ ID NO: 388878 - DNA, 25 bp, Mus musculus
ttatctgaaaggcttacctctaaaa

SEQ ID NO: 388879 - DNA, 25 bp, Mus musculus
ttatctgaaagtggtcccaaaccaa

SEQ ID NO: 388880 - DNA, 25 bp, Mus musculus
ttatctgaagaaagaatctgtggag

SEQ ID NO: 388881 - DNA, 25 bp, Mus musculus
ttatctgaagagcccagagcgtttc

SEQ ID NO: 388882 - DNA, 25 bp, Mus musculus
ttatctgaaggatcctacccagaga

SEQ ID NO: 388883 - DNA, 25 bp, Mus musculus
ttatctgaaggcctgggagctgccc

SEQ ID NO: 388884 - DNA, 25 bp, Mus musculus
ttatctgaaggttttctctgtatag

SEQ ID NO: 388885 - DNA, 25 bp, Mus musculus
ttatctgcagaatgtgtatgcacct

SEQ ID NO: 388886 - DNA, 25 bp, Mus musculus
ttatctggaaaatgccactccgtgt

SEQ ID NO: 388887 - DNA, 25 bp, Mus musculus
ttatctgtagtgcaaagtactacaa

SEQ ID NO: 388888 - DNA, 25 bp, Mus musculus
ttatcttaagaggaggtccttgttc

SEQ ID NO: 388889 - DNA, 25 bp, Mus musculus
ttatcttcaagcagagaaagaacga

SEQ ID NO: 388890 - DNA, 25 bp, Mus musculus
ttatcttcaagcagcctgaaaggca

SEQ ID NO: 388891 - DNA, 25 bp, Mus musculus
ttatcttcctgagatgctgtcccct

SEQ ID NO: 388892 - DNA, 25 bp, Mus musculus
ttatctttataggctgaaggcggca

SEQ ID NO: 388893 - DNA, 25 bp, Mus musculus
ttatgaaaaataagattggccaggt

SEQ ID NO: 388894 - DNA, 25 bp, Mus musculus
ttatgaaaaataaggtagagcaact

SEQ ID NO: 388895 - DNA, 25 bp, Mus musculus
ttatgaaaactggtgaagggccgga

SEQ ID NO: 388896 - DNA, 25 bp, Mus musculus
ttatgaaagcagggcttacatacct

SEQ ID NO: 388897 - DNA, 25 bp, Mus musculus
ttatgaaatggcctcaaaccccctg

SEQ ID NO: 388898 - DNA, 25 bp, Mus musculus
ttatgaacagatcaagcgggccatc

SEQ ID NO: 388899 - DNA, 25 bp, Mus musculus
ttatgaacagattgatgacattgta

SEQ ID NO: 388900 - DNA, 25 bp, Mus musculus
ttatgaacatggtgaagtatttgtt

SEQ ID NO: 388901 - DNA, 25 bp, Mus musculus
ttatgaaccggcagtttcgaaactg

SEQ ID NO: 388902 - DNA, 25 bp, Mus musculus
ttatgaagatcccacataccatttt

SEQ ID NO: 388903 - DNA, 25 bp, Mus musculus
ttatgaagccagacaagttggcatt

SEQ ID NO: 388904 - DNA, 25 bp, Mus musculus
ttatgaagccaggtccctcaaagtt

SEQ ID NO: 388905 - DNA, 25 bp, Mus musculus
ttatgaatatacagcgtttgacttt

SEQ ID NO: 388906 - DNA, 25 bp, Mus musculus
ttatgaatccagaggttggaatgaa

SEQ ID NO: 388907 - DNA, 25 bp, Mus musculus
ttatgaatgttccccattgtaacat

SEQ ID NO: 388908 - DNA, 25 bp, Mus musculus
ttatgaatgttccccgtaacaaatc

SEQ ID NO: 388909 - DNA, 25 bp, Mus musculus
ttatgaatgttccccgtcagaaacg

SEQ ID NO: 388910 - DNA, 25 bp, Mus musculus
ttatgacaaacatttttcagtatgg

SEQ ID NO: 388911 - DNA, 25 bp, Mus musculus
ttatgacaaagatcagttcatgtgt

SEQ ID NO: 388912 - DNA, 25 bp, Mus musculus
ttatgacaagcccgtctcgatactg

SEQ ID NO: 388913 - DNA, 25 bp, Mus musculus
ttatgacactatttttgaagactat

SEQ ID NO: 388914 - DNA, 25 bp, Mus musculus
ttatgacaggtctaaaaggcttggt

SEQ ID NO: 388915 - DNA, 25 bp, Mus musculus
ttatgacaggtctatgctgaggggt

SEQ ID NO: 388916 - DNA, 25 bp, Mus musculus
ttatgacatccggatgctgaccttc

SEQ ID NO: 388917 - DNA, 25 bp, Mus musculus
ttatgacatccgggtcaaggctggt

SEQ ID NO: 388918 - DNA, 25 bp, Mus musculus
ttatgacatgatgatgcagtccctc

SEQ ID NO: 388919 - DNA, 25 bp, Mus musculus
ttatgaccaccactaccatcacgga

SEQ ID NO: 388920 - DNA, 25 bp, Mus musculus
ttatgaccctgcctccacaggagtg

SEQ ID NO: 388921 - DNA, 25 bp, Mus musculus
ttatgaccctgctttttaaattggc

SEQ ID NO: 388922 - DNA, 25 bp, Mus musculus
ttatgacctgatggccaacttagca

SEQ ID NO: 388923 - DNA, 25 bp, Mus musculus
ttatgacctggcagaacagcttttt

SEQ ID NO: 388924 - DNA, 25 bp, Mus musculus
ttatgactaacagggagtacacctt

SEQ ID NO: 388925 - DNA, 25 bp, Mus musculus
ttatgagactggagagacgagagaa

SEQ ID NO: 388926 - DNA, 25 bp, Mus musculus
ttatgagactggatctctttccttt

SEQ ID NO: 388927 - DNA, 25 bp, Mus musculus
ttatgagcagcatcagtatgagact

SEQ ID NO: 388928 - DNA, 25 bp, Mus musculus
ttatgagcaggatcagtatgagact

SEQ ID NO: 388929 - DNA, 25 bp, Mus musculus
ttatgagcagggcgatgaagaagcc

SEQ ID NO: 388930 - DNA, 25 bp, Mus musculus
ttatgagcatcccgactttaagctc

SEQ ID NO: 388931 - DNA, 25 bp, Mus musculus
ttatgagtatgcaggtcctgatgaa

SEQ ID NO: 388932 - DNA, 25 bp, Mus musculus
ttatgataaggactatgtcagataa

SEQ ID NO: 388933 - DNA, 25 bp, Mus musculus
ttatgataagtacatggagaggttc

SEQ ID NO: 388934 - DNA, 25 bp, Mus musculus
ttatgatatcacaaatgttaactca

SEQ ID NO: 388935 - DNA, 25 bp, Mus musculus
ttatgatattaagatgctaacattt

SEQ ID NO: 388936 - DNA, 25 bp, Mus musculus
ttatgatcaggaaccagctcctgat

SEQ ID NO: 388937 - DNA, 25 bp, Mus musculus
ttatgatcaggcggcttggattttg

SEQ ID NO: 388938 - DNA, 25 bp, Mus musculus
ttatgatgaggccaagcacgtgagg

SEQ ID NO: 388939 - DNA, 25 bp, Mus musculus
ttatgatgagtcacaattttatatt

SEQ ID NO: 388940 - DNA, 25 bp, Mus musculus
ttatgatgagtgtaaaagaagatac

SEQ ID NO: 388941 - DNA, 25 bp, Mus musculus
ttatgatgagtgtttatcaccagat

SEQ ID NO: 388942 - DNA, 25 bp, Mus musculus
ttatgatgagtttgtgacttaagct

SEQ ID NO: 388943 - DNA, 25 bp, Mus musculus
ttatgatgcatccgatgtcgtcctg

SEQ ID NO: 388944 - DNA, 25 bp, Mus musculus
ttatgatgcatcggatgtcgtcctg

SEQ ID NO: 388945 - DNA, 25 bp, Mus musculus
ttatgattgtaaagggtctcctgtg

SEQ ID NO: 388946 - DNA, 25 bp, Mus musculus
ttatgcaaatgaggatgcccctaaa

SEQ ID NO: 388947 - DNA, 25 bp, Mus musculus
ttatgcaaatgagttccagacagga

SEQ ID NO: 388948 - DNA, 25 bp, Mus musculus
ttatgcacaatcagagtcctcattt

SEQ ID NO: 388949 - DNA, 25 bp, Mus musculus
ttatgcacctacggcccagaccacc

SEQ ID NO: 388950 - DNA, 25 bp, Mus musculus
ttatgcagaaaaagcttcaaactct

SEQ ID NO: 388951 - DNA, 25 bp, Mus musculus
ttatgcagacacgagatcttgtaca

SEQ ID NO: 388952 - DNA, 25 bp, Mus musculus
ttatgcagagatgcacacaagccac

SEQ ID NO: 388953 - DNA, 25 bp, Mus musculus
ttatgcagagcttctgaacaaggtc

SEQ ID NO: 388954 - DNA, 25 bp, Mus musculus
ttatgcagaggatgattctgacagc

SEQ ID NO: 388955 - DNA, 25 bp, Mus musculus
ttatgcagttgtggtatcccaaggg

SEQ ID NO: 388956 - DNA, 25 bp, Mus musculus
ttatgcagttgtgtgactatgcaag

SEQ ID NO: 388957 - DNA, 25 bp, Mus musculus
ttatgcagttgtgtgggtgaatggg

SEQ ID NO: 388958 - DNA, 25 bp, Mus musculus
ttatgcatcaacgctgtaagatgaa

SEQ ID NO: 388959 - DNA, 25 bp, Mus musculus
ttatgcatggaaaggaagttggcag

SEQ ID NO: 388960 - DNA, 25 bp, Mus musculus
ttatgcattgagacgtccgagatac

SEQ ID NO: 388961 - DNA, 25 bp, Mus musculus
ttatgccaaagagatgaaggagtca

SEQ ID NO: 388962 - DNA, 25 bp, Mus musculus
ttatgccaaaggctttaacagaaaa

SEQ ID NO: 388963 - DNA, 25 bp, Mus musculus
ttatgcccctgtcatctctcaccct

SEQ ID NO: 388964 - DNA, 25 bp, Mus musculus
ttatgccctgcaggtcaatgtgatt

SEQ ID NO: 388965 - DNA, 25 bp, Mus musculus
ttatgccgtcatgtcccggaacagc

SEQ ID NO: 388966 - DNA, 25 bp, Mus musculus
ttatgcgaaattcaacatggccaat

SEQ ID NO: 388967 - DNA, 25 bp, Mus musculus
ttatgcgtctgccaggcagacggct

SEQ ID NO: 388968 - DNA, 25 bp, Mus musculus
ttatgcgtcttcaggtaataaagct

SEQ ID NO: 388969 - DNA, 25 bp, Mus musculus
ttatgctagaaaaggttgcacgatt

SEQ ID NO: 388970 - DNA, 25 bp, Mus musculus
ttatgctccagagtgagagacttgc

SEQ ID NO: 388971 - DNA, 25 bp, Mus musculus
ttatgctccagagtttcagttcctg

SEQ ID NO: 388972 - DNA, 25 bp, Mus musculus
ttatgctccagccactctgctgatg

SEQ ID NO: 388973 - DNA, 25 bp, Mus musculus
ttatgctgactgacccttcctacct

SEQ ID NO: 388974 - DNA, 25 bp, Mus musculus
ttatgctgactggtgtcgtttcagc

SEQ ID NO: 388975 - DNA, 25 bp, Mus musculus
ttatgctgggaaagaatctgcatgt

SEQ ID NO: 388976 - DNA, 25 bp, Mus musculus
ttatgctgggaaagggaattttaat

SEQ ID NO: 388977 - DNA, 25 bp, Mus musculus
ttatgctttaggtgaaggcgataaa

SEQ ID NO: 388978 - DNA, 25 bp, Mus musculus
ttatggaaagcacagaactctttgt

SEQ ID NO: 388979 - DNA, 25 bp, Mus musculus
ttatggaagagagtttcatgggatc

SEQ ID NO: 388980 - DNA, 25 bp, Mus musculus
ttatggacgaagaggatcttagtga

SEQ ID NO: 388981 - DNA, 25 bp, Mus musculus
ttatggacgaagagtgaattcggga

SEQ ID NO: 388982 - DNA, 25 bp, Mus musculus
ttatggactggcatgcacacaatcg

SEQ ID NO: 388983 - DNA, 25 bp, Mus musculus
ttatggacttaaaggtgcctggaag

SEQ ID NO: 388984 - DNA, 25 bp, Mus musculus
ttatggagcagagaatgacggacaa

SEQ ID NO: 388985 - DNA, 25 bp, Mus musculus
ttatggagcttttagaacgttttag

SEQ ID NO: 388986 - DNA, 25 bp, Mus musculus
ttatggaggaaggtcgtggacttcc

SEQ ID NO: 388987 - DNA, 25 bp, Mus musculus
ttatggattcccaggtgaggacact

SEQ ID NO: 388988 - DNA, 25 bp, Mus musculus
ttatggccaatgaggtcactcgtta

SEQ ID NO: 388989 - DNA, 25 bp, Mus musculus
ttatggccaatggtcagttggtgaa

SEQ ID NO: 388990 - DNA, 25 bp, Mus musculus
ttatggccatcaagacctctcacag

SEQ ID NO: 388991 - DNA, 25 bp, Mus musculus
ttatggcgaggagccatcaagcaaa

SEQ ID NO: 388992 - DNA, 25 bp, Mus musculus
ttatggcgaggaggaggtgtagccc

SEQ ID NO: 388993 - DNA, 25 bp, Mus musculus
ttatggcgttggagatctcatcccg

SEQ ID NO: 388994 - DNA, 25 bp, Mus musculus
ttatggcgttggagtgtcccatcct

SEQ ID NO: 388995 - DNA, 25 bp, Mus musculus
ttatggctgacaagatgcaggtact

SEQ ID NO: 388996 - DNA, 25 bp, Mus musculus
ttatgggaagaattgcggcgagcaa

SEQ ID NO: 388997 - DNA, 25 bp, Mus musculus
ttatgggacctaatgacagcccata

SEQ ID NO: 388998 - DNA, 25 bp, Mus musculus
ttatgggacctcaggtctgttgtgg

SEQ ID NO: 388999 - DNA, 25 bp, Mus musculus
ttatgggacctctcaatgaaagtga

SEQ ID NO: 389000 - DNA, 25 bp, Mus musculus
ttatgggagaccggggaaaatgcac

SEQ ID NO: 389001 - DNA, 25 bp, Mus musculus
ttatgggatatcttcagaaaaaatg

SEQ ID NO: 389002 - DNA, 25 bp, Mus musculus
ttatgggatgaaacggaacattttc

SEQ ID NO: 389003 - DNA, 25 bp, Mus musculus
ttatgggatgaaacggttctgtgat

SEQ ID NO: 389004 - DNA, 25 bp, Mus musculus
ttatgggtacaggacatacaggaag

SEQ ID NO: 389005 - DNA, 25 bp, Mus musculus
ttatgggttggggagtattactatg

SEQ ID NO: 389006 - DNA, 25 bp, Mus musculus
ttatggtagcaagatctaaaggggt

SEQ ID NO: 389007 - DNA, 25 bp, Mus musculus
ttatggtccaacgacctgagcccaa

SEQ ID NO: 389008 - DNA, 25 bp, Mus musculus
ttatgtacttcattgtacgatcttt

SEQ ID NO: 389009 - DNA, 25 bp, Mus musculus
ttatgtcaatgcccccaaccccatc

SEQ ID NO: 389010 - DNA, 25 bp, Mus musculus
ttatgtcaggagttcaccttttcca

SEQ ID NO: 389011 - DNA, 25 bp, Mus musculus
ttatgtccccacaggggcaggtgct

SEQ ID NO: 389012 - DNA, 25 bp, Mus musculus
ttatgtctgagggtttggaaatagt

SEQ ID NO: 389013 - DNA, 25 bp, Mus musculus
ttatgtctgaggtatctcatttaag

SEQ ID NO: 389014 - DNA, 25 bp, Mus musculus
ttatgtgaaataggtgagaagccag

SEQ ID NO: 389015 - DNA, 25 bp, Mus musculus
ttatgtgaaatagttttgggatttt

SEQ ID NO: 389016 - DNA, 25 bp, Mus musculus
ttatgtgatggctgcaccccatcag

SEQ ID NO: 389017 - DNA, 25 bp, Mus musculus
ttatgtgatgtactacgagatgtcc

SEQ ID NO: 389018 - DNA, 25 bp, Mus musculus
ttatgtgcatatgtggcaaagttta

SEQ ID NO: 389019 - DNA, 25 bp, Mus musculus
ttatgtttttgtgctgttgcttcct

SEQ ID NO: 389020 - DNA, 25 bp, Mus musculus
ttattaaaaacaatctggaacttcc

SEQ ID NO: 389021 - DNA, 25 bp, Mus musculus
ttattaaaagtaaatggaagtacga

SEQ ID NO: 389022 - DNA, 25 bp, Mus musculus
ttattaaacggatggctcccagcat

SEQ ID NO: 389023 - DNA, 25 bp, Mus musculus
ttattaaagtggttggctatgatat

SEQ ID NO: 389024 - DNA, 25 bp, Mus musculus
ttattaaagtttaaccagctcagga

SEQ ID NO: 389025 - DNA, 25 bp, Mus musculus
ttattaatatggaaatgaaagtgcc

SEQ ID NO: 389026 - DNA, 25 bp, Mus musculus
ttattacaaggaatcgcctgcttat

SEQ ID NO: 389027 - DNA, 25 bp, Mus musculus
ttattacaggtaatgaagaaggata

SEQ ID NO: 389028 - DNA, 25 bp, Mus musculus
ttattaccaagatgaacccccaaag

SEQ ID NO: 389029 - DNA, 25 bp, Mus musculus
ttattaccaagcataccacaaaaag

SEQ ID NO: 389030 - DNA, 25 bp, Mus musculus
ttattaccaaggtgctatatctgaa

SEQ ID NO: 389031 - DNA, 25 bp, Mus musculus
ttattaccacagcgtttatgtttga

SEQ ID NO: 389032 - DNA, 25 bp, Mus musculus
ttattaccacaggaactgcatgagt

SEQ ID NO: 389033 - DNA, 25 bp, Mus musculus
ttattactaccaagccccaggagat

SEQ ID NO: 389034 - DNA, 25 bp, Mus musculus
ttattacttgcacagggaacaagaa

SEQ ID NO: 389035 - DNA, 25 bp, Mus musculus
ttattagaaggacagaaaaaaagca

SEQ ID NO: 389036 - DNA, 25 bp, Mus musculus
ttattagaaggacagctcctgaatt

SEQ ID NO: 389037 - DNA, 25 bp, Mus musculus
ttattagcccatatgcaactgcccc

SEQ ID NO: 389038 - DNA, 25 bp, Mus musculus
ttattagcctttgaggtgtgcctgc

SEQ ID NO: 389039 - DNA, 25 bp, Mus musculus
ttattatcaacctgaccctctatgg

SEQ ID NO: 389040 - DNA, 25 bp, Mus musculus
ttattatcaacctggaggacggtga

SEQ ID NO: 389041 - DNA, 25 bp, Mus musculus
ttattatggtagcaagatctaaagg

SEQ ID NO: 389042 - DNA, 25 bp, Mus musculus
ttattattcaagattaaaccagaag

SEQ ID NO: 389043 - DNA, 25 bp, Mus musculus
ttattattcggcatacccatgtacc

SEQ ID NO: 389044 - DNA, 25 bp, Mus musculus
ttattatttaggcttggctggtgtt

SEQ ID NO: 389045 - DNA, 25 bp, Mus musculus
ttattatttaggtcattttgagtgc

SEQ ID NO: 389046 - DNA, 25 bp, Mus musculus
ttattcaaagactcctggaagtaga

SEQ ID NO: 389047 - DNA, 25 bp, Mus musculus
ttattcaaagttgtccgtgtaattg

SEQ ID NO: 389048 - DNA, 25 bp, Mus musculus
ttattcaaggcctggtgtgtgcctt

SEQ ID NO: 389049 - DNA, 25 bp, Mus musculus
ttattcaaggggtgtggaatattat

SEQ ID NO: 389050 - DNA, 25 bp, Mus musculus
ttattcacgacagtgttgaaggctc

SEQ ID NO: 389051 - DNA, 25 bp, Mus musculus
ttattcagaagtaccgggctttcat

SEQ ID NO: 389052 - DNA, 25 bp, Mus musculus
ttattcatcccagaaggaagaattc

SEQ ID NO: 389053 - DNA, 25 bp, Mus musculus
ttattccaaacacagccagccaatg

SEQ ID NO: 389054 - DNA, 25 bp, Mus musculus
ttattccaaacacagcccacctgca

SEQ ID NO: 389055 - DNA, 25 bp, Mus musculus
ttattccaaacacagccccagccag

SEQ ID NO: 389056 - DNA, 25 bp, Mus musculus
ttattccagaggcatttggatttaa

SEQ ID NO: 389057 - DNA, 25 bp, Mus musculus
ttattccaggatggctaatcgcgat

SEQ ID NO: 389058 - DNA, 25 bp, Mus musculus
ttattccatagtagtgggcagcagt

SEQ ID NO: 389059 - DNA, 25 bp, Mus musculus
ttattccctttaaggcatcaatact

SEQ ID NO: 389060 - DNA, 25 bp, Mus musculus
ttattcctacgccagagatgcgatg

SEQ ID NO: 389061 - DNA, 25 bp, Mus musculus
ttattcctacggatctcatagaaaa

SEQ ID NO: 389062 - DNA, 25 bp, Mus musculus
ttattcctcctatgaggcgtctgga

SEQ ID NO: 389063 - DNA, 25 bp, Mus musculus
ttattcctgaagcagaaccaccaat

SEQ ID NO: 389064 - DNA, 25 bp, Mus musculus
ttattcctgaaggaggctgtgaaag

SEQ ID NO: 389065 - DNA, 25 bp, Mus musculus
ttattcgcagtggctgtgacgtgaa

SEQ ID NO: 389066 - DNA, 25 bp, Mus musculus
ttattctatggctagaaaatgccca

SEQ ID NO: 389067 - DNA, 25 bp, Mus musculus
ttattctgagcggtatcaagttata

SEQ ID NO: 389068 - DNA, 25 bp, Mus musculus
ttattctgcagaagataccgggaca

SEQ ID NO: 389069 - DNA, 25 bp, Mus musculus
ttattctgcagaagggggactatgt

SEQ ID NO: 389070 - DNA, 25 bp, Mus musculus
ttattcttatccaggtaccattact

SEQ ID NO: 389071 - DNA, 25 bp, Mus musculus
ttattcttttggcctaagatcacca

SEQ ID NO: 389072 - DNA, 25 bp, Mus musculus
ttattgaaacatccatttcagtcct

SEQ ID NO: 389073 - DNA, 25 bp, Mus musculus
ttattgaaagaaaagcgggtgccct

SEQ ID NO: 389074 - DNA, 25 bp, Mus musculus
ttattgaaaggatgaagaaacacgg

SEQ ID NO: 389075 - DNA, 25 bp, Mus musculus
ttattgaaaggtgacattcccactg

SEQ ID NO: 389076 - DNA, 25 bp, Mus musculus
ttattgaagacacaggattatgtac

SEQ ID NO: 389077 - DNA, 25 bp, Mus musculus
ttattgacagtaagggtgatgcccg

SEQ ID NO: 389078 - DNA, 25 bp, Mus musculus
ttattgagaaggagaacactgaagg

SEQ ID NO: 389079 - DNA, 25 bp, Mus musculus
ttattgagttcagctatgaactctc

SEQ ID NO: 389080 - DNA, 25 bp, Mus musculus
ttattgagttcattcaggctggtgg

SEQ ID NO: 389081 - DNA, 25 bp, Mus musculus
ttattgatgaaaagatttatttatt

SEQ ID NO: 389082 - DNA, 25 bp, Mus musculus
ttattgatgaaatagactctttcct

SEQ ID NO: 389083 - DNA, 25 bp, Mus musculus
ttattgccaaagatactgatcaatg

SEQ ID NO: 389084 - DNA, 25 bp, Mus musculus
ttattgccaaagctagttatgaaca

SEQ ID NO: 389085 - DNA, 25 bp, Mus musculus
ttattgccaaagctgcgtctttgcc

SEQ ID NO: 389086 - DNA, 25 bp, Mus musculus
ttattgctaagatggcagttgggtt

SEQ ID NO: 389087 - DNA, 25 bp, Mus musculus
ttattgctactgggggctacgggcg

SEQ ID NO: 389088 - DNA, 25 bp, Mus musculus
ttattgctcggggtgacaaagactt

SEQ ID NO: 389089 - DNA, 25 bp, Mus musculus
ttattggacaagtgcaactgtagcc

SEQ ID NO: 389090 - DNA, 25 bp, Mus musculus
ttattggcaggattgaaagctactc

SEQ ID NO: 389091 - DNA, 25 bp, Mus musculus
ttattggcagggcagaggagaccag

SEQ ID NO: 389092 - DNA, 25 bp, Mus musculus
ttattgggacagacacaggaattgt

SEQ ID NO: 389093 - DNA, 25 bp, Mus musculus
ttattgtagacaggtactggcatag

SEQ ID NO: 389094 - DNA, 25 bp, Mus musculus
ttattgtcagcaagcttcaggagct

SEQ ID NO: 389095 - DNA, 25 bp, Mus musculus
ttattgtgctgctgatgaagagact

SEQ ID NO: 389096 - DNA, 25 bp, Mus musculus
ttattgttaaaggaaattcgatagc

SEQ ID NO: 389097 - DNA, 25 bp, Mus musculus
ttattgttcctgacaaccctccata

SEQ ID NO: 389098 - DNA, 25 bp, Mus musculus
ttattgttcctggtttctctttgta

SEQ ID NO: 389099 - DNA, 25 bp, Mus musculus
ttatttaaagctgagtgcaatatcc

SEQ ID NO: 389100 - DNA, 25 bp, Mus musculus
ttatttattggcacagacacaggaa

SEQ ID NO: 389101 - DNA, 25 bp, Mus musculus
ttatttcaaaatggagctgaagttc

SEQ ID NO: 389102 - DNA, 25 bp, Mus musculus
ttatttcaactttggccaccagttc

SEQ ID NO: 389103 - DNA, 25 bp, Mus musculus
ttatttcaactttggcctaccttct

SEQ ID NO: 389104 - DNA, 25 bp, Mus musculus
ttatttcaagtgtcaccagactgtt

SEQ ID NO: 389105 - DNA, 25 bp, Mus musculus
ttatttcagggaaaacaggcagcac

SEQ ID NO: 389106 - DNA, 25 bp, Mus musculus
ttatttccaaccacggctcactcca

SEQ ID NO: 389107 - DNA, 25 bp, Mus musculus
ttatttccaactatgaaaagaaagt

SEQ ID NO: 389108 - DNA, 25 bp, Mus musculus
ttatttccacgatggggtccgagtg

SEQ ID NO: 389109 - DNA, 25 bp, Mus musculus
ttatttcggcaggaattagctctgc

SEQ ID NO: 389110 - DNA, 25 bp, Mus musculus
ttatttcggcaggcaatacggaata

SEQ ID NO: 389111 - DNA, 25 bp, Mus musculus
ttatttctacatggtctcttcatgg

SEQ ID NO: 389112 - DNA, 25 bp, Mus musculus
ttatttctccagagcgtgcccctgg

SEQ ID NO: 389113 - DNA, 25 bp, Mus musculus
ttatttctccaggcttcacagagat

SEQ ID NO: 389114 - DNA, 25 bp, Mus musculus
ttatttctggaagctttgcaaaaag

SEQ ID NO: 389115 - DNA, 25 bp, Mus musculus
ttatttggagaagaccaacctggtc

SEQ ID NO: 389116 - DNA, 25 bp, Mus musculus
ttatttggagaaggatcttcaagct

SEQ ID NO: 389117 - DNA, 25 bp, Mus musculus
ttatttgtctgtctcttctcacagg

SEQ ID NO: 389118 - DNA, 25 bp, Mus musculus
ttattttacagtgaaaatgtgctat

SEQ ID NO: 389119 - DNA, 25 bp, Mus musculus
ttattttatggatattcattagctt

SEQ ID NO: 389120 - DNA, 25 bp, Mus musculus
ttattttcaataatggacgctgtag

SEQ ID NO: 389121 - DNA, 25 bp, Mus musculus
ttattttcagagaagcagaagataa

SEQ ID NO: 389122 - DNA, 25 bp, Mus musculus
ttattttgaagtgatgagactatcc

SEQ ID NO: 389123 - DNA, 25 bp, Mus musculus
ttattttggggaaggatattcagtg

SEQ ID NO: 389124 - DNA, 25 bp, Mus musculus
ttatttttaagaggcaagaaacaaa

SEQ ID NO: 389125 - DNA, 25 bp, Mus musculus
ttatttttcccccctcaagatcggc

SEQ ID NO: 389126 - DNA, 25 bp, Mus musculus
ttatttttttggccatattcccaaa

SEQ ID NO: 389127 - DNA, 25 bp, Mus musculus
ttcaaaaaaactggaagccaagtac

SEQ ID NO: 389128 - DNA, 25 bp, Mus musculus
ttcaaaaaaactggaagtcagcagg

SEQ ID NO: 389129 - DNA, 25 bp, Mus musculus
ttcaaaaaaccagtgcctccgaagc

SEQ ID NO: 389130 - DNA, 25 bp, Mus musculus
ttcaaaaaagaatatgatgctgtgg

SEQ ID NO: 389131 - DNA, 25 bp, Mus musculus
ttcaaaaaagatggtttttgatcat

SEQ ID NO: 389132 - DNA, 25 bp, Mus musculus
ttcaaaaaatcagggcttgcggctt

SEQ ID NO: 389133 - DNA, 25 bp, Mus musculus
ttcaaaaacaacagaatcaagacac

SEQ ID NO: 389134 - DNA, 25 bp, Mus musculus
ttcaaaaacaacaggctcctcaact

SEQ ID NO: 389135 - DNA, 25 bp, Mus musculus
ttcaaaaacaggatctgagtcttca

SEQ ID NO: 389136 - DNA, 25 bp, Mus musculus
ttcaaaaacaggtcagcccttctta

SEQ ID NO: 389137 - DNA, 25 bp, Mus musculus
ttcaaaaaccaagaatggattgtcg

SEQ ID NO: 389138 - DNA, 25 bp, Mus musculus
ttcaaaaactggagacctcaggaaa

SEQ ID NO: 389139 - DNA, 25 bp, Mus musculus
ttcaaaaagataaaggagcgaatcc

SEQ ID NO: 389140 - DNA, 25 bp, Mus musculus
ttcaaaaataattggtttggattca

SEQ ID NO: 389141 - DNA, 25 bp, Mus musculus
ttcaaaaatagctcggtcgaggagt

SEQ ID NO: 389142 - DNA, 25 bp, Mus musculus
ttcaaaaatgggaacttgacgagag

SEQ ID NO: 389143 - DNA, 25 bp, Mus musculus
ttcaaaaatgggatagatgtgcatg

SEQ ID NO: 389144 - DNA, 25 bp, Mus musculus
ttcaaaaattaagtgtctctgccac

SEQ ID NO: 389145 - DNA, 25 bp, Mus musculus
ttcaaaaattaagttagctgacaag

SEQ ID NO: 389146 - DNA, 25 bp, Mus musculus
ttcaaaacacacgaattgtcacaat

SEQ ID NO: 389147 - DNA, 25 bp, Mus musculus
ttcaaaaccaagattaattgcctga

SEQ ID NO: 389148 - DNA, 25 bp, Mus musculus
ttcaaaaggaggccacctatgaaaa

SEQ ID NO: 389149 - DNA, 25 bp, Mus musculus
ttcaaaaggaggtttccccagaagt

SEQ ID NO: 389150 - DNA, 25 bp, Mus musculus
ttcaaaaggagtatgaaggcttaga

SEQ ID NO: 389151 - DNA, 25 bp, Mus musculus
ttcaaaaggagtttgttgaaggatc

SEQ ID NO: 389152 - DNA, 25 bp, Mus musculus
ttcaaaagtatggcttagacttgtg

SEQ ID NO: 389153 - DNA, 25 bp, Mus musculus
ttcaaaagtcacaagggaacagcag

SEQ ID NO: 389154 - DNA, 25 bp, Mus musculus
ttcaaaatgcgactggaagaactaa

SEQ ID NO: 389155 - DNA, 25 bp, Mus musculus
ttcaaaatgcgactggtggcaatta

SEQ ID NO: 389156 - DNA, 25 bp, Mus musculus
ttcaaaatgcgtttcaagcaccaac

SEQ ID NO: 389157 - DNA, 25 bp, Mus musculus
ttcaaacaagttcaaaaggatgctg

SEQ ID NO: 389158 - DNA, 25 bp, Mus musculus
ttcaaacacaagttggaaatctaca

SEQ ID NO: 389159 - DNA, 25 bp, Mus musculus
ttcaaacagcggatcactgcagacc

SEQ ID NO: 389160 - DNA, 25 bp, Mus musculus
ttcaaacatccaggtggctctggtc

SEQ ID NO: 389161 - DNA, 25 bp, Mus musculus
ttcaaaccagtaggtgcaaactcag

SEQ ID NO: 389162 - DNA, 25 bp, Mus musculus
ttcaaacccagctctgcatgcccat

SEQ ID NO: 389163 - DNA, 25 bp, Mus musculus
ttcaaacccagggcaagacagacta

SEQ ID NO: 389164 - DNA, 25 bp, Mus musculus
ttcaaaccgcctgaggcacagaccc

SEQ ID NO: 389165 - DNA, 25 bp, Mus musculus
ttcaaaccgcctgagtcaaatcaga

SEQ ID NO: 389166 - DNA, 25 bp, Mus musculus
ttcaaacctggtgcgttcattcctg

SEQ ID NO: 389167 - DNA, 25 bp, Mus musculus
ttcaaacgtggggttctatggccta

SEQ ID NO: 389168 - DNA, 25 bp, Mus musculus
ttcaaactaacagaaattgatgatg

SEQ ID NO: 389169 - DNA, 25 bp, Mus musculus
ttcaaactaacaggtcaaggaaaac

SEQ ID NO: 389170 - DNA, 25 bp, Mus musculus
ttcaaactgaaactattaggcagga

SEQ ID NO: 389171 - DNA, 25 bp, Mus musculus
ttcaaactgcctggaattacatgaa

SEQ ID NO: 389172 - DNA, 25 bp, Mus musculus
ttcaaactgcctgggtagtccatga

SEQ ID NO: 389173 - DNA, 25 bp, Mus musculus
ttcaaactggaggagttcaggaggg

SEQ ID NO: 389174 - DNA, 25 bp, Mus musculus
ttcaaagaatgattctgttggctca

SEQ ID NO: 389175 - DNA, 25 bp, Mus musculus
ttcaaagacaagaccggacaataca

SEQ ID NO: 389176 - DNA, 25 bp, Mus musculus
ttcaaagacaagacgtggacacgca

SEQ ID NO: 389177 - DNA, 25 bp, Mus musculus
ttcaaagacaagctcaaacatgtct

SEQ ID NO: 389178 - DNA, 25 bp, Mus musculus
ttcaaagacaaggtgagggtggtga

SEQ ID NO: 389179 - DNA, 25 bp, Mus musculus
ttcaaagagcagcctctattaagat

SEQ ID NO: 389180 - DNA, 25 bp, Mus musculus
ttcaaagatacgaaggaagaagttc

SEQ ID NO: 389181 - DNA, 25 bp, Mus musculus
ttcaaagatacgaagtgatgtcctg

SEQ ID NO: 389182 - DNA, 25 bp, Mus musculus
ttcaaagatctgtgaagttcattca

SEQ ID NO: 389183 - DNA, 25 bp, Mus musculus
ttcaaagattcaaggaagcctgggg

SEQ ID NO: 389184 - DNA, 25 bp, Mus musculus
ttcaaagattggaaggagacttcaa

SEQ ID NO: 389185 - DNA, 25 bp, Mus musculus
ttcaaagattggaaggtattcccat

SEQ ID NO: 389186 - DNA, 25 bp, Mus musculus
ttcaaagattggaagtggttctgtg

SEQ ID NO: 389187 - DNA, 25 bp, Mus musculus
ttcaaagattggaagttcctgtgga

SEQ ID NO: 389188 - DNA, 25 bp, Mus musculus
ttcaaagcagaagcctcctgccaaa

SEQ ID NO: 389189 - DNA, 25 bp, Mus musculus
ttcaaagcagttgaaaactgaaccg

SEQ ID NO: 389190 - DNA, 25 bp, Mus musculus
ttcaaagcatgattggagagagaga

SEQ ID NO: 389191 - DNA, 25 bp, Mus musculus
ttcaaagcatgtcttttgctgatca

SEQ ID NO: 389192 - DNA, 25 bp, Mus musculus
ttcaaagccaaggcaaagctgatgg

SEQ ID NO: 389193 - DNA, 25 bp, Mus musculus
ttcaaagccaaggctgcctacctga

SEQ ID NO: 389194 - DNA, 25 bp, Mus musculus
ttcaaagcccgggtatcatccggat

SEQ ID NO: 389195 - DNA, 25 bp, Mus musculus
ttcaaagccctgaaggcactaagtg

SEQ ID NO: 389196 - DNA, 25 bp, Mus musculus
ttcaaagcgtggttgatctggtggc

SEQ ID NO: 389197 - DNA, 25 bp, Mus musculus
ttcaaaggaagaagatgtagaatgt

SEQ ID NO: 389198 - DNA, 25 bp, Mus musculus
ttcaaaggaagaagttacagattca

SEQ ID NO: 389199 - DNA, 25 bp, Mus musculus
ttcaaaggagcggatttccatttcc

SEQ ID NO: 389200 - DNA, 25 bp, Mus musculus
ttcaaaggagtgtcactactccatc

SEQ ID NO: 389201 - DNA, 25 bp, Mus musculus
ttcaaaggcaaaattcttccaagaa

SEQ ID NO: 389202 - DNA, 25 bp, Mus musculus
ttcaaaggcaaagcttccctggttg

SEQ ID NO: 389203 - DNA, 25 bp, Mus musculus
ttcaaaggctaaaggtctgtacaca

SEQ ID NO: 389204 - DNA, 25 bp, Mus musculus
ttcaaagtaccaggaaaggacacag

SEQ ID NO: 389205 - DNA, 25 bp, Mus musculus
ttcaaagtagaaggttacatccagg

SEQ ID NO: 389206 - DNA, 25 bp, Mus musculus
ttcaaagttcccctggcctggggaa

SEQ ID NO: 389207 - DNA, 25 bp, Mus musculus
ttcaaataaaaaggtgcttgagcag

SEQ ID NO: 389208 - DNA, 25 bp, Mus musculus
ttcaaataagaatgaagagcatggc

SEQ ID NO: 389209 - DNA, 25 bp, Mus musculus
ttcaaatacattcaggaagccgaaa

SEQ ID NO: 389210 - DNA, 25 bp, Mus musculus
ttcaaatactgaactgtccctgatg

SEQ ID NO: 389211 - DNA, 25 bp, Mus musculus
ttcaaatcccaagttccgtgaggag

SEQ ID NO: 389212 - DNA, 25 bp, Mus musculus
ttcaaatctggaatgttccggagaa

SEQ ID NO: 389213 - DNA, 25 bp, Mus musculus
ttcaaatgaactaactacttgatga

SEQ ID NO: 389214 - DNA, 25 bp, Mus musculus
ttcaaatgaactgggaaactagaac

SEQ ID NO: 389215 - DNA, 25 bp, Mus musculus
ttcaaatgttgtggcagaataccag

SEQ ID NO: 389216 - DNA, 25 bp, Mus musculus
ttcaaatgttgtgtcctctgttgtg

SEQ ID NO: 389217 - DNA, 25 bp, Mus musculus
ttcaaattaaaaatgatgtcttcat

SEQ ID NO: 389218 - DNA, 25 bp, Mus musculus
ttcaaatttcatggctacctctgtc

SEQ ID NO: 389219 - DNA, 25 bp, Mus musculus
ttcaaattttgctacaaaaggcatt

SEQ ID NO: 389220 - DNA, 25 bp, Mus musculus
ttcaaattttggcacgcagctacaa

SEQ ID NO: 389221 - DNA, 25 bp, Mus musculus
ttcaacaaaactcagggaccaagag

SEQ ID NO: 389222 - DNA, 25 bp, Mus musculus
ttcaacaaacgaactccaatgtgga

SEQ ID NO: 389223 - DNA, 25 bp, Mus musculus
ttcaacaaacggtgtttgcctgcat

SEQ ID NO: 389224 - DNA, 25 bp, Mus musculus
ttcaacaaacgttgacttgctggtg

SEQ ID NO: 389225 - DNA, 25 bp, Mus musculus
ttcaacaaaggtgatctgcaattcg

SEQ ID NO: 389226 - DNA, 25 bp, Mus musculus
ttcaacaacaggcatgttacatgga

SEQ ID NO: 389227 - DNA, 25 bp, Mus musculus
ttcaacaagaaaaatatgttccaag

SEQ ID NO: 389228 - DNA, 25 bp, Mus musculus
ttcaacaagaatcagcttcagagga

SEQ ID NO: 389229 - DNA, 25 bp, Mus musculus
ttcaacaagaatcaggttgtggagt

SEQ ID NO: 389230 - DNA, 25 bp, Mus musculus
ttcaacaatcatggctgcttgtgcc

SEQ ID NO: 389231 - DNA, 25 bp, Mus musculus
ttcaacaatggcaagattgagctcc

SEQ ID NO: 389232 - DNA, 25 bp, Mus musculus
ttcaacaatggcaatcatgaggcag

SEQ ID NO: 389233 - DNA, 25 bp, Mus musculus
ttcaacacatcacttgtcttcccca

SEQ ID NO: 389234 - DNA, 25 bp, Mus musculus
ttcaacagacaagtcaagagcaatc

SEQ ID NO: 389235 - DNA, 25 bp, Mus musculus
ttcaacagacaggtggaggaagagc

SEQ ID NO: 389236 - DNA, 25 bp, Mus musculus
ttcaacagagctgccttccgtctct

SEQ ID NO: 389237 - DNA, 25 bp, Mus musculus
ttcaacagctgaggaaggtgtcttg

SEQ ID NO: 389238 - DNA, 25 bp, Mus musculus
ttcaacaggaaggtgactgtggact

SEQ ID NO: 389239 - DNA, 25 bp, Mus musculus
ttcaacatcatcttggtggagaggc

SEQ ID NO: 389240 - DNA, 25 bp, Mus musculus
ttcaacatcgtagagggagattcat

SEQ ID NO: 389241 - DNA, 25 bp, Mus musculus
ttcaacatgagcctcctgatgctgc

SEQ ID NO: 389242 - DNA, 25 bp, Mus musculus
ttcaacattgaggatcataaagaca

SEQ ID NO: 389243 - DNA, 25 bp, Mus musculus
ttcaaccaacaggagctctttggaa

SEQ ID NO: 389244 - DNA, 25 bp, Mus musculus
ttcaaccacaatgacggattccacc

SEQ ID NO: 389245 - DNA, 25 bp, Mus musculus
ttcaaccagcgaattcagcttgctg

SEQ ID NO: 389246 - DNA, 25 bp, Mus musculus
ttcaaccatcaggggctggtgtcat

SEQ ID NO: 389247 - DNA, 25 bp, Mus musculus
ttcaaccatcaggtctaggtggctg

SEQ ID NO: 389248 - DNA, 25 bp, Mus musculus
ttcaaccccacagtaaactacattt

SEQ ID NO: 389249 - DNA, 25 bp, Mus musculus
ttcaaccccgggaggaagctatgct

SEQ ID NO: 389250 - DNA, 25 bp, Mus musculus
ttcaaccctcaggaatccaaacgct

SEQ ID NO: 389251 - DNA, 25 bp, Mus musculus
ttcaaccctgactctaaggggctct

SEQ ID NO: 389252 - DNA, 25 bp, Mus musculus
ttcaaccgagttgagtccattcgcc

SEQ ID NO: 389253 - DNA, 25 bp, Mus musculus
ttcaaccgggagaggtctgctctga

SEQ ID NO: 389254 - DNA, 25 bp, Mus musculus
ttcaaccgggagcaggaggacagga

SEQ ID NO: 389255 - DNA, 25 bp, Mus musculus
ttcaaccgggagcattctcagagct

SEQ ID NO: 389256 - DNA, 25 bp, Mus musculus
ttcaacctctaaaagcccgatttgg

SEQ ID NO: 389257 - DNA, 25 bp, Mus musculus
ttcaacctctatgtgacggacgccg

SEQ ID NO: 389258 - DNA, 25 bp, Mus musculus
ttcaacctgcccaaggagctggagg

SEQ ID NO: 389259 - DNA, 25 bp, Mus musculus
ttcaacgcgccacacctggccgccg

SEQ ID NO: 389260 - DNA, 25 bp, Mus musculus
ttcaacggaggtactgtattggcaa

SEQ ID NO: 389261 - DNA, 25 bp, Mus musculus
ttcaacgggggattcatcagttggt

SEQ ID NO: 389262 - DNA, 25 bp, Mus musculus
ttcaactacagccttacctgcctcc

SEQ ID NO: 389263 - DNA, 25 bp, Mus musculus
ttcaactccaggcctctagactgtg

SEQ ID NO: 389264 - DNA, 25 bp, Mus musculus
ttcaactccaggtatctccacaggc

SEQ ID NO: 389265 - DNA, 25 bp, Mus musculus
ttcaactccatcaaggagctgaatg

SEQ ID NO: 389266 - DNA, 25 bp, Mus musculus
ttcaactccccagagcaccccttgg

SEQ ID NO: 389267 - DNA, 25 bp, Mus musculus
ttcaactccccaggaagctacaggg

SEQ ID NO: 389268 - DNA, 25 bp, Mus musculus
ttcaactctgtagtgaatgtgggct

SEQ ID NO: 389269 - DNA, 25 bp, Mus musculus
ttcaactgcgagatgaaatggaagg

SEQ ID NO: 389270 - DNA, 25 bp, Mus musculus
ttcaactgctcacagagtcagtccg

SEQ ID NO: 389271 - DNA, 25 bp, Mus musculus
ttcaacttcagagctgtgcctgaga

SEQ ID NO: 389272 - DNA, 25 bp, Mus musculus
ttcaacttcaggagcctttggagac

SEQ ID NO: 389273 - DNA, 25 bp, Mus musculus
ttcaacttccgcctggactagcacc

SEQ ID NO: 389274 - DNA, 25 bp, Mus musculus
ttcaacttctggtctcacccaaaat

SEQ ID NO: 389275 - DNA, 25 bp, Mus musculus
ttcaactttggccaccagttctacc

SEQ ID NO: 389276 - DNA, 25 bp, Mus musculus
ttcaactttggcctaccttcttgcc

SEQ ID NO: 389277 - DNA, 25 bp, Mus musculus
ttcaagaaaagagaaaattggagat

SEQ ID NO: 389278 - DNA, 25 bp, Mus musculus
ttcaagaaaaggaaaatgtccctgt

SEQ ID NO: 389279 - DNA, 25 bp, Mus musculus
ttcaagaaagatgtccttggctccc

SEQ ID NO: 389280 - DNA, 25 bp, Mus musculus
ttcaagaaaggtttcagactgaaat

SEQ ID NO: 389281 - DNA, 25 bp, Mus musculus
ttcaagaaatattatgctgaagtag

SEQ ID NO: 389282 - DNA, 25 bp, Mus musculus
ttcaagaaatccagcgtgcgagaag

SEQ ID NO: 389283 - DNA, 25 bp, Mus musculus
ttcaagaaatccggcaacttgaatt

SEQ ID NO: 389284 - DNA, 25 bp, Mus musculus
ttcaagaaatccgggcagtttagga

SEQ ID NO: 389285 - DNA, 25 bp, Mus musculus
ttcaagaaatgtatctttccgacct

SEQ ID NO: 389286 - DNA, 25 bp, Mus musculus
ttcaagaacaagtatgaggatgaaa

SEQ ID NO: 389287 - DNA, 25 bp, Mus musculus
ttcaagaacattgcgacgctccagg

SEQ ID NO: 389288 - DNA, 25 bp, Mus musculus
ttcaagaagacaccctgatatctgc

SEQ ID NO: 389289 - DNA, 25 bp, Mus musculus
ttcaagaagatagcgaaacagagat

SEQ ID NO: 389290 - DNA, 25 bp, Mus musculus
ttcaagaagatcaaggaacgcatcc

SEQ ID NO: 389291 - DNA, 25 bp, Mus musculus
ttcaagaagcgaccttcctatgaaa

SEQ ID NO: 389292 - DNA, 25 bp, Mus musculus
ttcaagaaggagaacagagaaagca

SEQ ID NO: 389293 - DNA, 25 bp, Mus musculus
ttcaagaaggagtatggctgtaaga

SEQ ID NO: 389294 - DNA, 25 bp, Mus musculus
ttcaagaagtcctgagtttatccat

SEQ ID NO: 389295 - DNA, 25 bp, Mus musculus
ttcaagaagtcctggtctttgcctg

SEQ ID NO: 389296 - DNA, 25 bp, Mus musculus
ttcaagaagtcctgtggaagtgttt

SEQ ID NO: 389297 - DNA, 25 bp, Mus musculus
ttcaagaatgacattgtcaactggc

SEQ ID NO: 389298 - DNA, 25 bp, Mus musculus
ttcaagacaagataagccgacaacc

SEQ ID NO: 389299 - DNA, 25 bp, Mus musculus
ttcaagacaagcaagagtccggcca

SEQ ID NO: 389300 - DNA, 25 bp, Mus musculus
ttcaagacagatcctcaagaatgcc

SEQ ID NO: 389301 - DNA, 25 bp, Mus musculus
ttcaagacagcgtgggtgggctcgc

SEQ ID NO: 389302 - DNA, 25 bp, Mus musculus
ttcaagacagtgaggggaaacaggc

SEQ ID NO: 389303 - DNA, 25 bp, Mus musculus
ttcaagacgatctggctgaaagtgg

SEQ ID NO: 389304 - DNA, 25 bp, Mus musculus
ttcaagagaaaagaaccaagaaaga

SEQ ID NO: 389305 - DNA, 25 bp, Mus musculus
ttcaagagaaagccttgtttgcagt

SEQ ID NO: 389306 - DNA, 25 bp, Mus musculus
ttcaagagaaaggttcaattttata

SEQ ID NO: 389307 - DNA, 25 bp, Mus musculus
ttcaagaggaaattgatgagctcct

SEQ ID NO: 389308 - DNA, 25 bp, Mus musculus
ttcaagaggaccctggcccagtcgt

SEQ ID NO: 389309 - DNA, 25 bp, Mus musculus
ttcaagaggacgtccttcatttctt

SEQ ID NO: 389310 - DNA, 25 bp, Mus musculus
ttcaagagggcgaggcagaggtaga

SEQ ID NO: 389311 - DNA, 25 bp, Mus musculus
ttcaagagtatggggaaaaagaggg

SEQ ID NO: 389312 - DNA, 25 bp, Mus musculus
ttcaagagtattcggggaaacctca

SEQ ID NO: 389313 - DNA, 25 bp, Mus musculus
ttcaagagtctggacaacatgtgca

SEQ ID NO: 389314 - DNA, 25 bp, Mus musculus
ttcaagagtgaccagccgtgggaat

SEQ ID NO: 389315 - DNA, 25 bp, Mus musculus
ttcaagataagagatatgccagaat

SEQ ID NO: 389316 - DNA, 25 bp, Mus musculus
ttcaagatcaagcttctcttgcagg

SEQ ID NO: 389317 - DNA, 25 bp, Mus musculus
ttcaagatgagagcgatgacagaga

SEQ ID NO: 389318 - DNA, 25 bp, Mus musculus
ttcaagatgaggcgagtggcagtgt

SEQ ID NO: 389319 - DNA, 25 bp, Mus musculus
ttcaagcaaccatttaagaagacca

SEQ ID NO: 389320 - DNA, 25 bp, Mus musculus
ttcaagcaagaaggcacttgctatc

SEQ ID NO: 389321 - DNA, 25 bp, Mus musculus
ttcaagcaagactgtacatttgcag

SEQ ID NO: 389322 - DNA, 25 bp, Mus musculus
ttcaagcaagtaaaccggcctcaga

SEQ ID NO: 389323 - DNA, 25 bp, Mus musculus
ttcaagcagaacagccttccagaaa

SEQ ID NO: 389324 - DNA, 25 bp, Mus musculus
ttcaagcagaacagggcggcagatc

SEQ ID NO: 389325 - DNA, 25 bp, Mus musculus
ttcaagcagaacaggtttgccagat

SEQ ID NO: 389326 - DNA, 25 bp, Mus musculus
ttcaagcagagggttcgcaaagaac

SEQ ID NO: 389327 - DNA, 25 bp, Mus musculus
ttcaagcagattaacctgtggaaga

SEQ ID NO: 389328 - DNA, 25 bp, Mus musculus
ttcaagcatggatgagttggcagag

SEQ ID NO: 389329 - DNA, 25 bp, Mus musculus
ttcaagccaaaaggtgaaacctcag

SEQ ID NO: 389330 - DNA, 25 bp, Mus musculus
ttcaagccattgctgcatgcctgtg

SEQ ID NO: 389331 - DNA, 25 bp, Mus musculus
ttcaagccattgcttttgggactcg

SEQ ID NO: 389332 - DNA, 25 bp, Mus musculus
ttcaagcccagctactaaaggagat

SEQ ID NO: 389333 - DNA, 25 bp, Mus musculus
ttcaagcccagctatgggacccctg

SEQ ID NO: 389334 - DNA, 25 bp, Mus musculus
ttcaagcccagtcttgcctccagca

SEQ ID NO: 389335 - DNA, 25 bp, Mus musculus
ttcaagcccccaaaggttgctttca

SEQ ID NO: 389336 - DNA, 25 bp, Mus musculus
ttcaagccctggtaacccatagtcc

SEQ ID NO: 389337 - DNA, 25 bp, Mus musculus
ttcaagccctggtgtctcttgctca

SEQ ID NO: 389338 - DNA, 25 bp, Mus musculus
ttcaagcgtgttagatatcgatgag

SEQ ID NO: 389339 - DNA, 25 bp, Mus musculus
ttcaagctatgatgaccagacctgc

SEQ ID NO: 389340 - DNA, 25 bp, Mus musculus
ttcaagctcttatgtgagacgtgga

SEQ ID NO: 389341 - DNA, 25 bp, Mus musculus
ttcaagctggatcttctatcgggca

SEQ ID NO: 389342 - DNA, 25 bp, Mus musculus
ttcaagctgggtgcgcatggtgaga

SEQ ID NO: 389343 - DNA, 25 bp, Mus musculus
ttcaaggaaaacaggacccatcctc

SEQ ID NO: 389344 - DNA, 25 bp, Mus musculus
ttcaaggaaaacagtctataaagca

SEQ ID NO: 389345 - DNA, 25 bp, Mus musculus
ttcaaggaaggaatcttttgtgttt

SEQ ID NO: 389346 - DNA, 25 bp, Mus musculus
ttcaaggaatgtatgtgcatgaaag

SEQ ID NO: 389347 - DNA, 25 bp, Mus musculus
ttcaaggagaagaagaaaaagtcag

SEQ ID NO: 389348 - DNA, 25 bp, Mus musculus
ttcaaggagaagaagcaatgtctga

SEQ ID NO: 389349 - DNA, 25 bp, Mus musculus
ttcaaggagaagagaacagaaagcc

SEQ ID NO: 389350 - DNA, 25 bp, Mus musculus
ttcaaggagaggtctggtccatcga

SEQ ID NO: 389351 - DNA, 25 bp, Mus musculus
ttcaaggagaggttgctatggtgac

SEQ ID NO: 389352 - DNA, 25 bp, Mus musculus
ttcaaggagctgcaacaacattttt

SEQ ID NO: 389353 - DNA, 25 bp, Mus musculus
ttcaaggccaagatccgggacttgc

SEQ ID NO: 389354 - DNA, 25 bp, Mus musculus
ttcaaggccaagggtctactatacc

SEQ ID NO: 389355 - DNA, 25 bp, Mus musculus
ttcaaggccagcagattgtgatatc

SEQ ID NO: 389356 - DNA, 25 bp, Mus musculus
ttcaaggccagcaggtctcataaca

SEQ ID NO: 389357 - DNA, 25 bp, Mus musculus
ttcaaggccaggttgatggaaacca

SEQ ID NO: 389358 - DNA, 25 bp, Mus musculus
ttcaaggccataaagactcactccg

SEQ ID NO: 389359 - DNA, 25 bp, Mus musculus
ttcaaggccataaaggcttctgggg

SEQ ID NO: 389360 - DNA, 25 bp, Mus musculus
ttcaaggcctgacaacatcgctgtc

SEQ ID NO: 389361 - DNA, 25 bp, Mus musculus
ttcaaggcgacaatgttctcaaaca

SEQ ID NO: 389362 - DNA, 25 bp, Mus musculus
ttcaagggcaagatcctatttatct

SEQ ID NO: 389363 - DNA, 25 bp, Mus musculus
ttcaagggcagtgggtgctggtctt

SEQ ID NO: 389364 - DNA, 25 bp, Mus musculus
ttcaagggcatggtgggcagcaaag

SEQ ID NO: 389365 - DNA, 25 bp, Mus musculus
ttcaagggcggaggtgagtgcagga

SEQ ID NO: 389366 - DNA, 25 bp, Mus musculus
ttcaagggctcttgctgttccgggg

SEQ ID NO: 389367 - DNA, 25 bp, Mus musculus
ttcaagggctcttgggcagcgctca

SEQ ID NO: 389368 - DNA, 25 bp, Mus musculus
ttcaaggtcaacaggcgcaacctgg

SEQ ID NO: 389369 - DNA, 25 bp, Mus musculus
ttcaaggtcgaacacatgggtcgga

SEQ ID NO: 389370 - DNA, 25 bp, Mus musculus
ttcaagtaatacaagctatggtgaa

SEQ ID NO: 389371 - DNA, 25 bp, Mus musculus
ttcaagtacagagatgaactcaagc

SEQ ID NO: 389372 - DNA, 25 bp, Mus musculus
ttcaagtacaggtatgaactcaagc

SEQ ID NO: 389373 - DNA, 25 bp, Mus musculus
ttcaagtcctgagatgagccgccag

SEQ ID NO: 389374 - DNA, 25 bp, Mus musculus
ttcaagtcctgctctacagagggaa

SEQ ID NO: 389375 - DNA, 25 bp, Mus musculus
ttcaagtcctggtgtggaggctgag

SEQ ID NO: 389376 - DNA, 25 bp, Mus musculus
ttcaagtccttggaaattagaagga

SEQ ID NO: 389377 - DNA, 25 bp, Mus musculus
ttcaagtccttggaccatggtatct

SEQ ID NO: 389378 - DNA, 25 bp, Mus musculus
ttcaagtgaaagaggtcaaccggat

SEQ ID NO: 389379 - DNA, 25 bp, Mus musculus
ttcaagtgatagttctcagtatgtg

SEQ ID NO: 389380 - DNA, 25 bp, Mus musculus
ttcaagtgcaaggtcatcttccatg

SEQ ID NO: 389381 - DNA, 25 bp, Mus musculus
ttcaagtgttggactggaacttcct

SEQ ID NO: 389382 - DNA, 25 bp, Mus musculus
ttcaagtgttggcagcagtggtggt

SEQ ID NO: 389383 - DNA, 25 bp, Mus musculus
ttcaagttagttgatctgcctgcct

SEQ ID NO: 389384 - DNA, 25 bp, Mus musculus
ttcaagtttgagctgggaagatgcc

SEQ ID NO: 389385 - DNA, 25 bp, Mus musculus
ttcaagtttgcaaagaagaaacagc

SEQ ID NO: 389386 - DNA, 25 bp, Mus musculus
ttcaagtttgcaaaggaaatatatc

SEQ ID NO: 389387 - DNA, 25 bp, Mus musculus
ttcaagtttttataatgtaaagctg

SEQ ID NO: 389388 - DNA, 25 bp, Mus musculus
ttcaataaagcagttttccacatcg

SEQ ID NO: 389389 - DNA, 25 bp, Mus musculus
ttcaataaatggatggaaacccttg

SEQ ID NO: 389390 - DNA, 25 bp, Mus musculus
ttcaataagcagctgacagagggta

SEQ ID NO: 389391 - DNA, 25 bp, Mus musculus
ttcaataatgatttccagggtagcc

SEQ ID NO: 389392 - DNA, 25 bp, Mus musculus
ttcaataatggactcccttttattt

SEQ ID NO: 389393 - DNA, 25 bp, Mus musculus
ttcaataatgtggtgaaaacaactg

SEQ ID NO: 389394 - DNA, 25 bp, Mus musculus
ttcaatacagtagtctggacagagg

SEQ ID NO: 389395 - DNA, 25 bp, Mus musculus
ttcaatagaggatatccatgcattt

SEQ ID NO: 389396 - DNA, 25 bp, Mus musculus
ttcaatatcttgggagccgaagagg

SEQ ID NO: 389397 - DNA, 25 bp, Mus musculus
ttcaatatcttggtacagggagccg

SEQ ID NO: 389398 - DNA, 25 bp, Mus musculus
ttcaatcaagtttttgcagcctgtc

SEQ ID NO: 389399 - DNA, 25 bp, Mus musculus
ttcaatcacgcagtcatgtttactg

SEQ ID NO: 389400 - DNA, 25 bp, Mus musculus
ttcaatcacgcagtggatcgtagac

SEQ ID NO: 389401 - DNA, 25 bp, Mus musculus
ttcaatcccagttacatttcaaccg

SEQ ID NO: 389402 - DNA, 25 bp, Mus musculus
ttcaatcccagttatcttgacgaat

SEQ ID NO: 389403 - DNA, 25 bp, Mus musculus
ttcaatccccaagaccctgaagaag

SEQ ID NO: 389404 - DNA, 25 bp, Mus musculus
ttcaatccccaaggttcattctgtg

SEQ ID NO: 389405 - DNA, 25 bp, Mus musculus
ttcaatcctctagactttgagagtt

SEQ ID NO: 389406 - DNA, 25 bp, Mus musculus
ttcaatcctctagttttgacctgcc

SEQ ID NO: 389407 - DNA, 25 bp, Mus musculus
ttcaatcgcagaggagaactgcggc

SEQ ID NO: 389408 - DNA, 25 bp, Mus musculus
ttcaatcggacagggatgagaccgg

SEQ ID NO: 389409 - DNA, 25 bp, Mus musculus
ttcaatctccaacaacaaagaagcc

SEQ ID NO: 389410 - DNA, 25 bp, Mus musculus
ttcaatcttcctagtgacggctctg

SEQ ID NO: 389411 - DNA, 25 bp, Mus musculus
ttcaatcttcctagtgagccccggg

SEQ ID NO: 389412 - DNA, 25 bp, Mus musculus
ttcaatcttctcagggacaggggca

SEQ ID NO: 389413 - DNA, 25 bp, Mus musculus
ttcaatctttttaaggtacagcaag

SEQ ID NO: 389414 - DNA, 25 bp, Mus musculus
ttcaatgaagagcggctgattgaca

SEQ ID NO: 389415 - DNA, 25 bp, Mus musculus
ttcaatgaagagggcatctcctccc

SEQ ID NO: 389416 - DNA, 25 bp, Mus musculus
ttcaatgacttcagagaatacctgt

SEQ ID NO: 389417 - DNA, 25 bp, Mus musculus
ttcaatgacttcagctgctgacctc

SEQ ID NO: 389418 - DNA, 25 bp, Mus musculus
ttcaatgagaagtgaacatgtatga

SEQ ID NO: 389419 - DNA, 25 bp, Mus musculus
ttcaatgagcagggttggtttttgc

SEQ ID NO: 389420 - DNA, 25 bp, Mus musculus
ttcaatgagcaggtttcagcggacg

SEQ ID NO: 389421 - DNA, 25 bp, Mus musculus
ttcaatgagcggtttgagtgggatc

SEQ ID NO: 389422 - DNA, 25 bp, Mus musculus
ttcaatgcctgcctgcaaatttcag

SEQ ID NO: 389423 - DNA, 25 bp, Mus musculus
ttcaatggagagccgtgcagcgtgg

SEQ ID NO: 389424 - DNA, 25 bp, Mus musculus
ttcaatggccagaagcaccaagaat

SEQ ID NO: 389425 - DNA, 25 bp, Mus musculus
ttcaatggccaggtcaggagtttac

SEQ ID NO: 389426 - DNA, 25 bp, Mus musculus
ttcaatgtggctcactttagtgcca

SEQ ID NO: 389427 - DNA, 25 bp, Mus musculus
ttcaatgttcaccagaaaccaggtg

SEQ ID NO: 389428 - DNA, 25 bp, Mus musculus
ttcaatgttggatagagatatgtcc

SEQ ID NO: 389429 - DNA, 25 bp, Mus musculus
ttcaatgttgggcagatcctgctca

SEQ ID NO: 389430 - DNA, 25 bp, Mus musculus
ttcaatgtttcaggacagtcggccc

SEQ ID NO: 389431 - DNA, 25 bp, Mus musculus
ttcaattaaggtattaagtcatgat

SEQ ID NO: 389432 - DNA, 25 bp, Mus musculus
ttcaattaccagggtgaaagaattg

SEQ ID NO: 389433 - DNA, 25 bp, Mus musculus
ttcaattccaatgcaaacaagaatg

SEQ ID NO: 389434 - DNA, 25 bp, Mus musculus
ttcaattcccggacggcctatgcaa

SEQ ID NO: 389435 - DNA, 25 bp, Mus musculus
ttcaattctgatgtactaaaaatca

SEQ ID NO: 389436 - DNA, 25 bp, Mus musculus
ttcaattttgaaatgtgctgctctg

SEQ ID NO: 389437 - DNA, 25 bp, Mus musculus
ttcacaaaacaaaccaaggctacta

SEQ ID NO: 389438 - DNA, 25 bp, Mus musculus
ttcacaaaagggaaggatctgtcct

SEQ ID NO: 389439 - DNA, 25 bp, Mus musculus
ttcacaaagttcagagtgcagagag

SEQ ID NO: 389440 - DNA, 25 bp, Mus musculus
ttcacaaatttatcctgtagtatgt

SEQ ID NO: 389441 - DNA, 25 bp, Mus musculus
ttcacaacaaaccgagaaaggaacc

SEQ ID NO: 389442 - DNA, 25 bp, Mus musculus
ttcacaacaacaagcatcaccctac

SEQ ID NO: 389443 - DNA, 25 bp, Mus musculus
ttcacaacaacaaggagcactttag

SEQ ID NO: 389444 - DNA, 25 bp, Mus musculus
ttcacaacagcgaggtgtaccacga

SEQ ID NO: 389445 - DNA, 25 bp, Mus musculus
ttcacaaccattcctggtctgacgg

SEQ ID NO: 389446 - DNA, 25 bp, Mus musculus
ttcacaacgttaaaggatatcactt

SEQ ID NO: 389447 - DNA, 25 bp, Mus musculus
ttcacaagtcaaaggtttaacagaa

SEQ ID NO: 389448 - DNA, 25 bp, Mus musculus
ttcacaagttgagatgaagcccgag

SEQ ID NO: 389449 - DNA, 25 bp, Mus musculus
ttcacaatggccaaagatgagagct

SEQ ID NO: 389450 - DNA, 25 bp, Mus musculus
ttcacaatggccagaaagaagactc

SEQ ID NO: 389451 - DNA, 25 bp, Mus musculus
ttcacaatgtgatacctgactgtca

SEQ ID NO: 389452 - DNA, 25 bp, Mus musculus
ttcacaatgttgagctctctggcaa

SEQ ID NO: 389453 - DNA, 25 bp, Mus musculus
ttcacacacagtaaggaaatgatat

SEQ ID NO: 389454 - DNA, 25 bp, Mus musculus
ttcacacacagtaaggctttaccgc

SEQ ID NO: 389455 - DNA, 25 bp, Mus musculus
ttcacacacatttaccttcagtgaa

SEQ ID NO: 389456 - DNA, 25 bp, Mus musculus
ttcacacagaagtgctgtcgactgt

SEQ ID NO: 389457 - DNA, 25 bp, Mus musculus
ttcacacagcagaaagtgtcaccgt

SEQ ID NO: 389458 - DNA, 25 bp, Mus musculus
ttcacaccaggagagcactgtgaag

SEQ ID NO: 389459 - DNA, 25 bp, Mus musculus
ttcacaccagtcttcgctgatagag

SEQ ID NO: 389460 - DNA, 25 bp, Mus musculus
ttcacacctaagatggaacagctag

SEQ ID NO: 389461 - DNA, 25 bp, Mus musculus
ttcacacctaagattgagcagctag

SEQ ID NO: 389462 - DNA, 25 bp, Mus musculus
ttcacacggcaagtactgaaccttc

SEQ ID NO: 389463 - DNA, 25 bp, Mus musculus
ttcacacgggaagagtcaccgaagg

SEQ ID NO: 389464 - DNA, 25 bp, Mus musculus
ttcacacgggatgaaattgttgata

SEQ ID NO: 389465 - DNA, 25 bp, Mus musculus
ttcacactaatcttgtaaccaccaa

SEQ ID NO: 389466 - DNA, 25 bp, Mus musculus
ttcacactgagaccagacttctttc

SEQ ID NO: 389467 - DNA, 25 bp, Mus musculus
ttcacactgagagcagacttctttc

SEQ ID NO: 389468 - DNA, 25 bp, Mus musculus
ttcacactgctttggtgcggcaagt

SEQ ID NO: 389469 - DNA, 25 bp, Mus musculus
ttcacagaacaagcagacttccagc

SEQ ID NO: 389470 - DNA, 25 bp, Mus musculus
ttcacagaagaacactcaaggctgc

SEQ ID NO: 389471 - DNA, 25 bp, Mus musculus
ttcacagaaggagacattctggaga

SEQ ID NO: 389472 - DNA, 25 bp, Mus musculus
ttcacagaagggttgactacagtca

SEQ ID NO: 389473 - DNA, 25 bp, Mus musculus
ttcacagacttctacctggtgatgc

SEQ ID NO: 389474 - DNA, 25 bp, Mus musculus
ttcacagatcaagagattggtgagc

SEQ ID NO: 389475 - DNA, 25 bp, Mus musculus
ttcacagatcaagaggcctgggatt

SEQ ID NO: 389476 - DNA, 25 bp, Mus musculus
ttcacagatgtgcagcttgaaggag

SEQ ID NO: 389477 - DNA, 25 bp, Mus musculus
ttcacagcagatgtaaagaacatgt

SEQ ID NO: 389478 - DNA, 25 bp, Mus musculus
ttcacagcagcacatccctacaaag

SEQ ID NO: 389479 - DNA, 25 bp, Mus musculus
ttcacagcaggtgcccagggaagct

SEQ ID NO: 389480 - DNA, 25 bp, Mus musculus
ttcacagcaggtttaaaaaatacat

SEQ ID NO: 389481 - DNA, 25 bp, Mus musculus
ttcacagcatcaaggtggcccggca

SEQ ID NO: 389482 - DNA, 25 bp, Mus musculus
ttcacagccccacttcacagccatg

SEQ ID NO: 389483 - DNA, 25 bp, Mus musculus
ttcacagccccagttcacagccatg

SEQ ID NO: 389484 - DNA, 25 bp, Mus musculus
ttcacagcctcatcattacagatgg

SEQ ID NO: 389485 - DNA, 25 bp, Mus musculus
ttcacagcctgtgaccatctttgga

SEQ ID NO: 389486 - DNA, 25 bp, Mus musculus
ttcacagctctaggcttttcagatg

SEQ ID NO: 389487 - DNA, 25 bp, Mus musculus
ttcacagctgccgggcccttcgaca

SEQ ID NO: 389488 - DNA, 25 bp, Mus musculus
ttcacaggaaactggccaggtgctc

SEQ ID NO: 389489 - DNA, 25 bp, Mus musculus
ttcacaggaaactggttggctggga

SEQ ID NO: 389490 - DNA, 25 bp, Mus musculus
ttcacaggagaacagataagccaaa

SEQ ID NO: 389491 - DNA, 25 bp, Mus musculus
ttcacaggagagatagacccagtga

SEQ ID NO: 389492 - DNA, 25 bp, Mus musculus
ttcacaggcaaacaggggcaattat

SEQ ID NO: 389493 - DNA, 25 bp, Mus musculus
ttcacaggcaaacagggtacctttc

SEQ ID NO: 389494 - DNA, 25 bp, Mus musculus
ttcacaggcagccggggcgagaagg

SEQ ID NO: 389495 - DNA, 25 bp, Mus musculus
ttcacagggggttcaccgtctcccg

SEQ ID NO: 389496 - DNA, 25 bp, Mus musculus
ttcacagggtggcatacacagagat

SEQ ID NO: 389497 - DNA, 25 bp, Mus musculus
ttcacagggtggcatctacccagct

SEQ ID NO: 389498 - DNA, 25 bp, Mus musculus
ttcacagtgcctggacaggtcctgg

SEQ ID NO: 389499 - DNA, 25 bp, Mus musculus
ttcacagtgcctggtgtcgaggagg

SEQ ID NO: 389500 - DNA, 25 bp, Mus musculus
ttcacatacactgatcatagaactc

SEQ ID NO: 389501 - DNA, 25 bp, Mus musculus
ttcacatacaggagcgacagttttg

SEQ ID NO: 389502 - DNA, 25 bp, Mus musculus
ttcacatcagcaggaacgtcatcca

SEQ ID NO: 389503 - DNA, 25 bp, Mus musculus
ttcacatcagcagtgcctgcagaag

SEQ ID NO: 389504 - DNA, 25 bp, Mus musculus
ttcacatcatgaagtgtgatctggg

SEQ ID NO: 389505 - DNA, 25 bp, Mus musculus
ttcacatcgagaaagcctttgagtc

SEQ ID NO: 389506 - DNA, 25 bp, Mus musculus
ttcacatcgagctggagtacctcac

SEQ ID NO: 389507 - DNA, 25 bp, Mus musculus
ttcacatgagctgtttcagaaagac

SEQ ID NO: 389508 - DNA, 25 bp, Mus musculus
ttcacattcaggcacaccaagatga

SEQ ID NO: 389509 - DNA, 25 bp, Mus musculus
ttcacattgtcagatctcagggcag

SEQ ID NO: 389510 - DNA, 25 bp, Mus musculus
ttcacattgtcagatgtccattcag

SEQ ID NO: 389511 - DNA, 25 bp, Mus musculus
ttcacatttcaagttcatggcatct

SEQ ID NO: 389512 - DNA, 25 bp, Mus musculus
ttcaccaaaaagggaactacaagaa

SEQ ID NO: 389513 - DNA, 25 bp, Mus musculus
ttcaccaaaggattctaaccacatt

SEQ ID NO: 389514 - DNA, 25 bp, Mus musculus
ttcaccaaaggtcctggcatgggat

SEQ ID NO: 389515 - DNA, 25 bp, Mus musculus
ttcaccaagacacacccgcagtggt

SEQ ID NO: 389516 - DNA, 25 bp, Mus musculus
ttcaccaagacacaggggaagtccc

SEQ ID NO: 389517 - DNA, 25 bp, Mus musculus
ttcaccaagatatcgactgatatct

SEQ ID NO: 389518 - DNA, 25 bp, Mus musculus
ttcaccaagatctcggtggatatgt

SEQ ID NO: 389519 - DNA, 25 bp, Mus musculus
ttcaccaagccacagcaatgtgggg

SEQ ID NO: 389520 - DNA, 25 bp, Mus musculus
ttcaccaagccacaggatggtgaca

SEQ ID NO: 389521 - DNA, 25 bp, Mus musculus
ttcaccaagtccatgaagccatgta

SEQ ID NO: 389522 - DNA, 25 bp, Mus musculus
ttcaccaagtccatgagtttaagat

SEQ ID NO: 389523 - DNA, 25 bp, Mus musculus
ttcaccaagtccatgattctgtaac

SEQ ID NO: 389524 - DNA, 25 bp, Mus musculus
ttcaccaagtccatgcaacagggag

SEQ ID NO: 389525 - DNA, 25 bp, Mus musculus
ttcaccacacagacagaggagctga

SEQ ID NO: 389526 - DNA, 25 bp, Mus musculus
ttcaccacacagacagaggagttga

SEQ ID NO: 389527 - DNA, 25 bp, Mus musculus
ttcaccacacctcagcagggacctc

SEQ ID NO: 389528 - DNA, 25 bp, Mus musculus
ttcaccaccacctccaaagactggc

SEQ ID NO: 389529 - DNA, 25 bp, Mus musculus
ttcaccaccatcatttttgatgact

SEQ ID NO: 389530 - DNA, 25 bp, Mus musculus
ttcaccaccccttgggggctcgctc

SEQ ID NO: 389531 - DNA, 25 bp, Mus musculus
ttcaccactaacgactctgacacca

SEQ ID NO: 389532 - DNA, 25 bp, Mus musculus
ttcaccactaacgggactcagaaga

SEQ ID NO: 389533 - DNA, 25 bp, Mus musculus
ttcaccactgaccggggggtgtgtc

SEQ ID NO: 389534 - DNA, 25 bp, Mus musculus
ttcaccacttttgatcttgattctg

SEQ ID NO: 389535 - DNA, 25 bp, Mus musculus
ttcaccagacagaacttctgtggga

SEQ ID NO: 389536 - DNA, 25 bp, Mus musculus
ttcaccagacagggcacgttctcag

SEQ ID NO: 389537 - DNA, 25 bp, Mus musculus
ttcaccagcccgaggacaagaaaag

SEQ ID NO: 389538 - DNA, 25 bp, Mus musculus
ttcaccaggagctggaatttggagt

SEQ ID NO: 389539 - DNA, 25 bp, Mus musculus
ttcaccaggcaggcagtacaggcca

SEQ ID NO: 389540 - DNA, 25 bp, Mus musculus
ttcaccaggcaggtaagcttcaagc

SEQ ID NO: 389541 - DNA, 25 bp, Mus musculus
ttcaccaggtggagagcatatccga

SEQ ID NO: 389542 - DNA, 25 bp, Mus musculus
ttcaccaggtggagataagtcattg

SEQ ID NO: 389543 - DNA, 25 bp, Mus musculus
ttcaccagtgcacggtgatattttt

SEQ ID NO: 389544 - DNA, 25 bp, Mus musculus
ttcaccagtttgggctcaagagtgt

SEQ ID NO: 389545 - DNA, 25 bp, Mus musculus
ttcaccatgagagggtgtggaccgt

SEQ ID NO: 389546 - DNA, 25 bp, Mus musculus
ttcaccattggggctgtgcatttgg

SEQ ID NO: 389547 - DNA, 25 bp, Mus musculus
ttcaccattgggttcacaggctgtg

SEQ ID NO: 389548 - DNA, 25 bp, Mus musculus
ttcacccaggaatatattccaatgc

SEQ ID NO: 389549 - DNA, 25 bp, Mus musculus
ttcacccaggaatattggcagtgct

SEQ ID NO: 389550 - DNA, 25 bp, Mus musculus
ttcacccatggaagacaaagtctgg

SEQ ID NO: 389551 - DNA, 25 bp, Mus musculus
ttcacccatggaagcaccccccatt

SEQ ID NO: 389552 - DNA, 25 bp, Mus musculus
ttcaccccacagctgaacaatgtgg

SEQ ID NO: 389553 - DNA, 25 bp, Mus musculus
ttcaccccacaggtgcgactggacc

SEQ ID NO: 389554 - DNA, 25 bp, Mus musculus
ttcaccccaggagaaagaaagcagc

SEQ ID NO: 389555 - DNA, 25 bp, Mus musculus
ttcaccccaggcttacagttcctcc

SEQ ID NO: 389556 - DNA, 25 bp, Mus musculus
ttcaccccaggtgaacacctttatg

SEQ ID NO: 389557 - DNA, 25 bp, Mus musculus
ttcaccccaggtttgtatggagaga

SEQ ID NO: 389558 - DNA, 25 bp, Mus musculus
ttcacccctctccatatcgctgtat

SEQ ID NO: 389559 - DNA, 25 bp, Mus musculus
ttcacccgagtcccctgagggatct

SEQ ID NO: 389560 - DNA, 25 bp, Mus musculus
ttcacccgcaaatgtcagcaattga

SEQ ID NO: 389561 - DNA, 25 bp, Mus musculus
ttcacccgcaattcccactacctga

SEQ ID NO: 389562 - DNA, 25 bp, Mus musculus
ttcacccggaaggccctcaatgaca

SEQ ID NO: 389563 - DNA, 25 bp, Mus musculus
ttcacccggaggtttcagaaagtgg

SEQ ID NO: 389564 - DNA, 25 bp, Mus musculus
ttcaccctcagaggagctggactac

SEQ ID NO: 389565 - DNA, 25 bp, Mus musculus
ttcaccctgtgcacctctcctcttg

SEQ ID NO: 389566 - DNA, 25 bp, Mus musculus
ttcacccttacccagatgaggctct

SEQ ID NO: 389567 - DNA, 25 bp, Mus musculus
ttcacccttacccagcccagagccc

SEQ ID NO: 389568 - DNA, 25 bp, Mus musculus
ttcaccgatcagaaacctgatatct

SEQ ID NO: 389569 - DNA, 25 bp, Mus musculus
ttcaccgatcaggacaacatccacg

SEQ ID NO: 389570 - DNA, 25 bp, Mus musculus
ttcaccgcacagacaccaagtggac

SEQ ID NO: 389571 - DNA, 25 bp, Mus musculus
ttcaccgcacggaatgacatcactc

SEQ ID NO: 389572 - DNA, 25 bp, Mus musculus
ttcaccgccgctttgacctcgaaaa

SEQ ID NO: 389573 - DNA, 25 bp, Mus musculus
ttcaccgctctccctacagccttgc

SEQ ID NO: 389574 - DNA, 25 bp, Mus musculus
ttcaccggctctgtggggctgctgc

SEQ ID NO: 389575 - DNA, 25 bp, Mus musculus
ttcaccgtatggctccatggtgtat

SEQ ID NO: 389576 - DNA, 25 bp, Mus musculus
ttcacctacaagtggccatggatcg

SEQ ID NO: 389577 - DNA, 25 bp, Mus musculus
ttcacctacaagtgggcccgtgatt

SEQ ID NO: 389578 - DNA, 25 bp, Mus musculus
ttcacctaccaggaccctgtcctgc

SEQ ID NO: 389579 - DNA, 25 bp, Mus musculus
ttcacctacgattaccacaccctgc

SEQ ID NO: 389580 - DNA, 25 bp, Mus musculus
ttcacctacggcaagagatgtcgat

SEQ ID NO: 389581 - DNA, 25 bp, Mus musculus
ttcacctcagccaacactgataggg

SEQ ID NO: 389582 - DNA, 25 bp, Mus musculus
ttcacctcagccaagtaccaaaggc

SEQ ID NO: 389583 - DNA, 25 bp, Mus musculus
ttcacctccagagccagctccagct

SEQ ID NO: 389584 - DNA, 25 bp, Mus musculus
ttcacctccattgggcacatgaccg

SEQ ID NO: 389585 - DNA, 25 bp, Mus musculus
ttcacctcccagatcttctccctgg

SEQ ID NO: 389586 - DNA, 25 bp, Mus musculus
ttcacctcgccaggctgcctaaacc

SEQ ID NO: 389587 - DNA, 25 bp, Mus musculus
ttcacctcgccagggtgcactcgtg

SEQ ID NO: 389588 - DNA, 25 bp, Mus musculus
ttcacctctcgtcagatgtcgtcac

SEQ ID NO: 389589 - DNA, 25 bp, Mus musculus
ttcacctctcgtcaggactgcaaga

SEQ ID NO: 389590 - DNA, 25 bp, Mus musculus
ttcacctgataaaaagtatgtctac

SEQ ID NO: 389591 - DNA, 25 bp, Mus musculus
ttcacctgatagcatgtggcatgaa

SEQ ID NO: 389592 - DNA, 25 bp, Mus musculus
ttcacctgctgcagaatcaagctat

SEQ ID NO: 389593 - DNA, 25 bp, Mus musculus
ttcacctggcaagcttcacatggag

SEQ ID NO: 389594 - DNA, 25 bp, Mus musculus
ttcaccttgcaaagcctttcccaac

SEQ ID NO: 389595 - DNA, 25 bp, Mus musculus
ttcacctttctgtccttggggatgg

SEQ ID NO: 389596 - DNA, 25 bp, Mus musculus
ttcacctttggtgtcctgtgcatgt

SEQ ID NO: 389597 - DNA, 25 bp, Mus musculus
ttcacgaaagaacttatttgtccaa

SEQ ID NO: 389598 - DNA, 25 bp, Mus musculus
ttcacgaagagataggtgatttcag

SEQ ID NO: 389599 - DNA, 25 bp, Mus musculus
ttcacgacagtgttgaaggctccgg

SEQ ID NO: 389600 - DNA, 25 bp, Mus musculus
ttcacgaccaagaagcttcgttaca

SEQ ID NO: 389601 - DNA, 25 bp, Mus musculus
ttcacgataggcaaggggaagtcag

SEQ ID NO: 389602 - DNA, 25 bp, Mus musculus
ttcacgatgttaaagctgtctgctc

SEQ ID NO: 389603 - DNA, 25 bp, Mus musculus
ttcacgcagccttcaggctcagttc

SEQ ID NO: 389604 - DNA, 25 bp, Mus musculus
ttcacgcctctgggaaacctaaatg

SEQ ID NO: 389605 - DNA, 25 bp, Mus musculus
ttcacgcgccgcggccttagaagaa

SEQ ID NO: 389606 - DNA, 25 bp, Mus musculus
ttcacgcgccgcggctccatgttct

SEQ ID NO: 389607 - DNA, 25 bp, Mus musculus
ttcacgctggatgttgaatgcggag

SEQ ID NO: 389608 - DNA, 25 bp, Mus musculus
ttcacgctggggtttctctgtatag

SEQ ID NO: 389609 - DNA, 25 bp, Mus musculus
ttcacggaactcgatggagcaaacc

SEQ ID NO: 389610 - DNA, 25 bp, Mus musculus
ttcacggcctccagtgacctgacag

SEQ ID NO: 389611 - DNA, 25 bp, Mus musculus
ttcacggcctccagtgactgccggg

SEQ ID NO: 389612 - DNA, 25 bp, Mus musculus
ttcacggtcaccaggccattccaag

SEQ ID NO: 389613 - DNA, 25 bp, Mus musculus
ttcacggtccaagtgtgggacttga

SEQ ID NO: 389614 - DNA, 25 bp, Mus musculus
ttcacgtctctggacaagccctcag

SEQ ID NO: 389615 - DNA, 25 bp, Mus musculus
ttcacgtggttggaaattgatggaa

SEQ ID NO: 389616 - DNA, 25 bp, Mus musculus
ttcacgtggttggaatgtggtgttt

SEQ ID NO: 389617 - DNA, 25 bp, Mus musculus
ttcacgtgttcatttgtgattcatg

SEQ ID NO: 389618 - DNA, 25 bp, Mus musculus
ttcacgttgggttcgccaagcagcc

SEQ ID NO: 389619 - DNA, 25 bp, Mus musculus
ttcacgtttctcaggttattactct

SEQ ID NO: 389620 - DNA, 25 bp, Mus musculus
ttcactaaacaagacctcctaagcc

SEQ ID NO: 389621 - DNA, 25 bp, Mus musculus
ttcactaccctcccaaactggcctc

SEQ ID NO: 389622 - DNA, 25 bp, Mus musculus
ttcactagccagtgagcgcatgagc

SEQ ID NO: 389623 - DNA, 25 bp, Mus musculus
ttcactagccagtgcctaaggaaga

SEQ ID NO: 389624 - DNA, 25 bp, Mus musculus
ttcactagctgggtacctcttgtgt

SEQ ID NO: 389625 - DNA, 25 bp, Mus musculus
ttcactatgaagattcacagacaca

SEQ ID NO: 389626 - DNA, 25 bp, Mus musculus
ttcactattctgaggttggtgtcat

SEQ ID NO: 389627 - DNA, 25 bp, Mus musculus
ttcactcaagagttcacaagccaga

SEQ ID NO: 389628 - DNA, 25 bp, Mus musculus
ttcactcaaggagctctgtgaatct

SEQ ID NO: 389629 - DNA, 25 bp, Mus musculus
ttcactcagaggcagccatggaacg

SEQ ID NO: 389630 - DNA, 25 bp, Mus musculus
ttcactccactccagggtctagaga

SEQ ID NO: 389631 - DNA, 25 bp, Mus musculus
ttcactccctgaaaaatcgagttga

SEQ ID NO: 389632 - DNA, 25 bp, Mus musculus
ttcactccctgcagtctcgaatgga

SEQ ID NO: 389633 - DNA, 25 bp, Mus musculus
ttcactcctggagcaggcagcaccc

SEQ ID NO: 389634 - DNA, 25 bp, Mus musculus
ttcactcctggagtagaaaaagaca

SEQ ID NO: 389635 - DNA, 25 bp, Mus musculus
ttcactcggttcccttctctgggtc

SEQ ID NO: 389636 - DNA, 25 bp, Mus musculus
ttcactctagagtcttttattcaaa

SEQ ID NO: 389637 - DNA, 25 bp, Mus musculus
ttcactctctcatgaggagccccag

SEQ ID NO: 389638 - DNA, 25 bp, Mus musculus
ttcactcttccttggtactctcaag

SEQ ID NO: 389639 - DNA, 25 bp, Mus musculus
ttcactgaaaggtcgttgctccaga

SEQ ID NO: 389640 - DNA, 25 bp, Mus musculus
ttcactgaacagacagctccgaaga

SEQ ID NO: 389641 - DNA, 25 bp, Mus musculus
ttcactgaagaagtggactctcgaa

SEQ ID NO: 389642 - DNA, 25 bp, Mus musculus
ttcactgacacatgccctgagccct

SEQ ID NO: 389643 - DNA, 25 bp, Mus musculus
ttcactgactagtctccagaggctc

SEQ ID NO: 389644 - DNA, 25 bp, Mus musculus
ttcactgactattttaacagcgtat

SEQ ID NO: 389645 - DNA, 25 bp, Mus musculus
ttcactgatgaggcatcaatacttg

SEQ ID NO: 389646 - DNA, 25 bp, Mus musculus
ttcactgcaacaaggtgtcagctga

SEQ ID NO: 389647 - DNA, 25 bp, Mus musculus
ttcactgcagctgctattggagcga

SEQ ID NO: 389648 - DNA, 25 bp, Mus musculus
ttcactgcaggtcccaaattggtta

SEQ ID NO: 389649 - DNA, 25 bp, Mus musculus
ttcactgcaggtccgagagaagcca

SEQ ID NO: 389650 - DNA, 25 bp, Mus musculus
ttcactgcaggttcacctggagaaa

SEQ ID NO: 389651 - DNA, 25 bp, Mus musculus
ttcactgcagtgcccaggtccgaga

SEQ ID NO: 389652 - DNA, 25 bp, Mus musculus
ttcactggaaagacatgcagctgtt

SEQ ID NO: 389653 - DNA, 25 bp, Mus musculus
ttcactggacatgggtgaagaaggg

SEQ ID NO: 389654 - DNA, 25 bp, Mus musculus
ttcactggcagtgagatccgccatc

SEQ ID NO: 389655 - DNA, 25 bp, Mus musculus
ttcactgggaaaaggtaaatgttgg

SEQ ID NO: 389656 - DNA, 25 bp, Mus musculus
ttcactgggaaaaggtggcagtggg

SEQ ID NO: 389657 - DNA, 25 bp, Mus musculus
ttcactgggaaaagtgagccccagg

SEQ ID NO: 389658 - DNA, 25 bp, Mus musculus
ttcactgggctataggtcggatatg

SEQ ID NO: 389659 - DNA, 25 bp, Mus musculus
ttcactggtcaagattcatgaaaaa

SEQ ID NO: 389660 - DNA, 25 bp, Mus musculus
ttcactgtaaaccaggtcactcctg

SEQ ID NO: 389661 - DNA, 25 bp, Mus musculus
ttcactgtaaaggtgcgagaagatg

SEQ ID NO: 389662 - DNA, 25 bp, Mus musculus
ttcactgtcaagtcaagactgttgg

SEQ ID NO: 389663 - DNA, 25 bp, Mus musculus
ttcactgtcattagaccatttccag

SEQ ID NO: 389664 - DNA, 25 bp, Mus musculus
ttcactgtccagcttgccagtgcaa

SEQ ID NO: 389665 - DNA, 25 bp, Mus musculus
ttcactgtggaagtggtcccaaccg

SEQ ID NO: 389666 - DNA, 25 bp, Mus musculus
ttcactgttcagcccacagtgagaa

SEQ ID NO: 389667 - DNA, 25 bp, Mus musculus
ttcactgttcaggcatccgaaggtg

SEQ ID NO: 389668 - DNA, 25 bp, Mus musculus
ttcacttaaggtccttcagaccaga

SEQ ID NO: 389669 - DNA, 25 bp, Mus musculus
ttcacttagacagacttacaacagc

SEQ ID NO: 389670 - DNA, 25 bp, Mus musculus
ttcacttcaaaggagtgtcactact

SEQ ID NO: 389671 - DNA, 25 bp, Mus musculus
ttcacttcaggtattgacctcatgg

SEQ ID NO: 389672 - DNA, 25 bp, Mus musculus
ttcacttcaggtgtggacctcgttt

SEQ ID NO: 389673 - DNA, 25 bp, Mus musculus
ttcacttccaacgtgaaactcatcc

SEQ ID NO: 389674 - DNA, 25 bp, Mus musculus
ttcacttctgttcaggaaactggag

SEQ ID NO: 389675 - DNA, 25 bp, Mus musculus
ttcacttgcaggtgttgtttgtggc

SEQ ID NO: 389676 - DNA, 25 bp, Mus musculus
ttcacttgcagtcgagcaaaagacg

SEQ ID NO: 389677 - DNA, 25 bp, Mus musculus
ttcacttgccaaaggaaagcgagct

SEQ ID NO: 389678 - DNA, 25 bp, Mus musculus
ttcacttgccaaaggcagtttgatg

SEQ ID NO: 389679 - DNA, 25 bp, Mus musculus
ttcacttggtgcatcgggagcaatc

SEQ ID NO: 389680 - DNA, 25 bp, Mus musculus
ttcacttgtgacagagccctgcttc

SEQ ID NO: 389681 - DNA, 25 bp, Mus musculus
ttcacttgttgccagaaagcagcag

SEQ ID NO: 389682 - DNA, 25 bp, Mus musculus
ttcacttgttgccaggtgaacagct

SEQ ID NO: 389683 - DNA, 25 bp, Mus musculus
ttcactttaaaacggctaggacttc

SEQ ID NO: 389684 - DNA, 25 bp, Mus musculus
ttcactttcacgaggagaacatttg

SEQ ID NO: 389685 - DNA, 25 bp, Mus musculus
ttcactttggaagagctcattgccc

SEQ ID NO: 389686 - DNA, 25 bp, Mus musculus
ttcactttggaggaatgggagggca

SEQ ID NO: 389687 - DNA, 25 bp, Mus musculus
ttcactttgtgctggaaggcgcttt

SEQ ID NO: 389688 - DNA, 25 bp, Mus musculus
ttcactttgtgctgggaaagagtat

SEQ ID NO: 389689 - DNA, 25 bp, Mus musculus
ttcacttttcagtatatatggtctg

SEQ ID NO: 389690 - DNA, 25 bp, Mus musculus
ttcacttttggttccacaccctctg

SEQ ID NO: 389691 - DNA, 25 bp, Mus musculus
ttcagaaaacagcatcaaggatgaa

SEQ ID NO: 389692 - DNA, 25 bp, Mus musculus
ttcagaaaacaggtaaaggctatta

SEQ ID NO: 389693 - DNA, 25 bp, Mus musculus
ttcagaaaagttggactacatctga

SEQ ID NO: 389694 - DNA, 25 bp, Mus musculus
ttcagaaaatagccaggactatcaa

SEQ ID NO: 389695 - DNA, 25 bp, Mus musculus
ttcagaaaataggtattgaggctct

SEQ ID NO: 389696 - DNA, 25 bp, Mus musculus
ttcagaaacagacctcgatgcagtc

SEQ ID NO: 389697 - DNA, 25 bp, Mus musculus
ttcagaaacaggtctggatgcttaa

SEQ ID NO: 389698 - DNA, 25 bp, Mus musculus
ttcagaaacaggtctggcaggatca

SEQ ID NO: 389699 - DNA, 25 bp, Mus musculus
ttcagaaacaggtggtgatgaagca

SEQ ID NO: 389700 - DNA, 25 bp, Mus musculus
ttcagaaacagtggaagcatcagtt

SEQ ID NO: 389701 - DNA, 25 bp, Mus musculus
ttcagaaacatctcctttcagcctg

SEQ ID NO: 389702 - DNA, 25 bp, Mus musculus
ttcagaaaccatggtcgcttatacc

SEQ ID NO: 389703 - DNA, 25 bp, Mus musculus
ttcagaaaccatgtctcgaagatat

SEQ ID NO: 389704 - DNA, 25 bp, Mus musculus
ttcagaaactgtacggacatggcta

SEQ ID NO: 389705 - DNA, 25 bp, Mus musculus
ttcagaaagagagtcctgttgaaga

SEQ ID NO: 389706 - DNA, 25 bp, Mus musculus
ttcagaaaggaagagatcaaagatg

SEQ ID NO: 389707 - DNA, 25 bp, Mus musculus
ttcagaaaggagttcgtgaagtgac

SEQ ID NO: 389708 - DNA, 25 bp, Mus musculus
ttcagaacagagggcaatgcgagca

SEQ ID NO: 389709 - DNA, 25 bp, Mus musculus
ttcagaaccagcctgggcccgaagg

SEQ ID NO: 389710 - DNA, 25 bp, Mus musculus
ttcagaaccagctttgaatggcaga

SEQ ID NO: 389711 - DNA, 25 bp, Mus musculus
ttcagaaccaggtgaccaacgccag

SEQ ID NO: 389712 - DNA, 25 bp, Mus musculus
ttcagaaccgcgtgttgatcgtgtc

SEQ ID NO: 389713 - DNA, 25 bp, Mus musculus
ttcagaacctttgaggtctcagagc

SEQ ID NO: 389714 - DNA, 25 bp, Mus musculus
ttcagaacctttgagttcctcatga

SEQ ID NO: 389715 - DNA, 25 bp, Mus musculus
ttcagaacgcaccggtagctggagt

SEQ ID NO: 389716 - DNA, 25 bp, Mus musculus
ttcagaagaaatacgatgacagcga

SEQ ID NO: 389717 - DNA, 25 bp, Mus musculus
ttcagaagaaatacggcttcttggt

SEQ ID NO: 389718 - DNA, 25 bp, Mus musculus
ttcagaagaggatgactgagtggga

SEQ ID NO: 389719 - DNA, 25 bp, Mus musculus
ttcagaagataccatctatgtcttt

SEQ ID NO: 389720 - DNA, 25 bp, Mus musculus
ttcagaagatgcaaccctgagacct

SEQ ID NO: 389721 - DNA, 25 bp, Mus musculus
ttcagaagattcagatggggctgag

SEQ ID NO: 389722 - DNA, 25 bp, Mus musculus
ttcagaagctcaagacatgaagcgc

SEQ ID NO: 389723 - DNA, 25 bp, Mus musculus
ttcagaaggaatgcggcctccttcc

SEQ ID NO: 389724 - DNA, 25 bp, Mus musculus
ttcagaagttaaggaaacatattca

SEQ ID NO: 389725 - DNA, 25 bp, Mus musculus
ttcagaagttgcagcggcaatatgg

SEQ ID NO: 389726 - DNA, 25 bp, Mus musculus
ttcagaagttgcaggaattattgaa

SEQ ID NO: 389727 - DNA, 25 bp, Mus musculus
ttcagaatatagagtcatggatgct

SEQ ID NO: 389728 - DNA, 25 bp, Mus musculus
ttcagaatatcaccggattcatggt

SEQ ID NO: 389729 - DNA, 25 bp, Mus musculus
ttcagaatgaagtatgagaatgaac

SEQ ID NO: 389730 - DNA, 25 bp, Mus musculus
ttcagacacaatggcctgtgagtat

SEQ ID NO: 389731 - DNA, 25 bp, Mus musculus
ttcagacaccaggaagcccctgagg

SEQ ID NO: 389732 - DNA, 25 bp, Mus musculus
ttcagacatagtcacagcccagcac

SEQ ID NO: 389733 - DNA, 25 bp, Mus musculus
ttcagaccaatacccacaggtccgc

SEQ ID NO: 389734 - DNA, 25 bp, Mus musculus
ttcagaccaggcagcgagtactaac

SEQ ID NO: 389735 - DNA, 25 bp, Mus musculus
ttcagacccgattagtggagtacct

SEQ ID NO: 389736 - DNA, 25 bp, Mus musculus
ttcagacctctcctgagatgggggt

SEQ ID NO: 389737 - DNA, 25 bp, Mus musculus
ttcagacgcaagaccattctttaaa

SEQ ID NO: 389738 - DNA, 25 bp, Mus musculus
ttcagactaaggtggacttcacctc

SEQ ID NO: 389739 - DNA, 25 bp, Mus musculus
ttcagactcaagtacgaaaacgagc

SEQ ID NO: 389740 - DNA, 25 bp, Mus musculus
ttcagacttgctggtacaagtatga

SEQ ID NO: 389741 - DNA, 25 bp, Mus musculus
ttcagagaaagcaggttcatgtttt

SEQ ID NO: 389742 - DNA, 25 bp, Mus musculus
ttcagagaaggacagtgtccccatg

SEQ ID NO: 389743 - DNA, 25 bp, Mus musculus
ttcagagaaggatgggggaaccagg

SEQ ID NO: 389744 - DNA, 25 bp, Mus musculus
ttcagagacagaggtctcaagggag

SEQ ID NO: 389745 - DNA, 25 bp, Mus musculus
ttcagagactcaggattgaaaagat

SEQ ID NO: 389746 - DNA, 25 bp, Mus musculus
ttcagagagaggtaccgacccttga

SEQ ID NO: 389747 - DNA, 25 bp, Mus musculus
ttcagagagagtctttctgcaggta

SEQ ID NO: 389748 - DNA, 25 bp, Mus musculus
ttcagagagttaggctgccaacagc

SEQ ID NO: 389749 - DNA, 25 bp, Mus musculus
ttcagagatcggcaggatgactgac

SEQ ID NO: 389750 - DNA, 25 bp, Mus musculus
ttcagagatggtggagactgagaac

SEQ ID NO: 389751 - DNA, 25 bp, Mus musculus
ttcagagattttgactttgtcttcg

SEQ ID NO: 389752 - DNA, 25 bp, Mus musculus
ttcagagcaaagatttctgctggac

SEQ ID NO: 389753 - DNA, 25 bp, Mus musculus
ttcagagcaaaggggggctctacta

SEQ ID NO: 389754 - DNA, 25 bp, Mus musculus
ttcagagcaggagcctttgaccagc

SEQ ID NO: 389755 - DNA, 25 bp, Mus musculus
ttcagagccagatagacctcttggc

SEQ ID NO: 389756 - DNA, 25 bp, Mus musculus
ttcagagccaggttgtaaaagttaa

SEQ ID NO: 389757 - DNA, 25 bp, Mus musculus
ttcagagcgagggagcccgaaccaa

SEQ ID NO: 389758 - DNA, 25 bp, Mus musculus
ttcagagctagaggatgtggagaaa

SEQ ID NO: 389759 - DNA, 25 bp, Mus musculus
ttcagagctctttgatgacttgggt

SEQ ID NO: 389760 - DNA, 25 bp, Mus musculus
ttcagagctgaagccagcaagcctg

SEQ ID NO: 389761 - DNA, 25 bp, Mus musculus
ttcagagctgaaggctattctagac

SEQ ID NO: 389762 - DNA, 25 bp, Mus musculus
ttcagagctggaaccctgccacatg

SEQ ID NO: 389763 - DNA, 25 bp, Mus musculus
ttcagagctggagagttgaagcaga

SEQ ID NO: 389764 - DNA, 25 bp, Mus musculus
ttcagagctggcttccatggagatg

SEQ ID NO: 389765 - DNA, 25 bp, Mus musculus
ttcagaggctgggcaaagtccttca

SEQ ID NO: 389766 - DNA, 25 bp, Mus musculus
ttcagagtgagatcatcatccaagt

SEQ ID NO: 389767 - DNA, 25 bp, Mus musculus
ttcagagttaacaaacatgatcagg

SEQ ID NO: 389768 - DNA, 25 bp, Mus musculus
ttcagagttaacaggtggctggatc

SEQ ID NO: 389769 - DNA, 25 bp, Mus musculus
ttcagagttggaaacaacttcctgc

SEQ ID NO: 389770 - DNA, 25 bp, Mus musculus
ttcagagtttgaactctcttgctct

SEQ ID NO: 389771 - DNA, 25 bp, Mus musculus
ttcagagtttgaatctgtcggggct

SEQ ID NO: 389772 - DNA, 25 bp, Mus musculus
ttcagataaatcagatgttttcggt

SEQ ID NO: 389773 - DNA, 25 bp, Mus musculus
ttcagataaatcagcttctctccac

SEQ ID NO: 389774 - DNA, 25 bp, Mus musculus
ttcagataattggaggatagacagt

SEQ ID NO: 389775 - DNA, 25 bp, Mus musculus
ttcagataattgggccattgacagc

SEQ ID NO: 389776 - DNA, 25 bp, Mus musculus
ttcagatacataccaaggagggtga

SEQ ID NO: 389777 - DNA, 25 bp, Mus musculus
ttcagataccacggccagagatcct

SEQ ID NO: 389778 - DNA, 25 bp, Mus musculus
ttcagatactgaatgaatctgagct

SEQ ID NO: 389779 - DNA, 25 bp, Mus musculus
ttcagatactgttacagccctgccc

SEQ ID NO: 389780 - DNA, 25 bp, Mus musculus
ttcagatcagagttggtgtggacct

SEQ ID NO: 389781 - DNA, 25 bp, Mus musculus
ttcagatgagggaaagcactgccac

SEQ ID NO: 389782 - DNA, 25 bp, Mus musculus
ttcagatgcacatatggatgcatct

SEQ ID NO: 389783 - DNA, 25 bp, Mus musculus
ttcagatgcacatcctcttctagaa

SEQ ID NO: 389784 - DNA, 25 bp, Mus musculus
ttcagatgtaccctcctgaaaagaa

SEQ ID NO: 389785 - DNA, 25 bp, Mus musculus
ttcagattctgagagtctgctagtc

SEQ ID NO: 389786 - DNA, 25 bp, Mus musculus
ttcagattctgagtctgatatcctt

SEQ ID NO: 389787 - DNA, 25 bp, Mus musculus
ttcagattctgagtggggacctcat

SEQ ID NO: 389788 - DNA, 25 bp, Mus musculus
ttcagattggttctgtaagcggacc

SEQ ID NO: 389789 - DNA, 25 bp, Mus musculus
ttcagatttcacagagacagccatt

SEQ ID NO: 389790 - DNA, 25 bp, Mus musculus
ttcagcaaaggcacacaccgaggct

SEQ ID NO: 389791 - DNA, 25 bp, Mus musculus
ttcagcaacagcatccgccaccacg

SEQ ID NO: 389792 - DNA, 25 bp, Mus musculus
ttcagcaagatcaaggcattatgtt

SEQ ID NO: 389793 - DNA, 25 bp, Mus musculus
ttcagcaagatgaagacatcccggc

SEQ ID NO: 389794 - DNA, 25 bp, Mus musculus
ttcagcaagatgagtcgaaaggaca

SEQ ID NO: 389795 - DNA, 25 bp, Mus musculus
ttcagcacaacaatgcagatagact

SEQ ID NO: 389796 - DNA, 25 bp, Mus musculus
ttcagcacaacatgggaaaacccag

SEQ ID NO: 389797 - DNA, 25 bp, Mus musculus
ttcagcaccagatccctgctgtctg

SEQ ID NO: 389798 - DNA, 25 bp, Mus musculus
ttcagcaccaggagggagctatgga

SEQ ID NO: 389799 - DNA, 25 bp, Mus musculus
ttcagcacctttcagggaagccagc

SEQ ID NO: 389800 - DNA, 25 bp, Mus musculus
ttcagcactcggtaattcagagatc

SEQ ID NO: 389801 - DNA, 25 bp, Mus musculus
ttcagcactgaggttcaagaatttg

SEQ ID NO: 389802 - DNA, 25 bp, Mus musculus
ttcagcagacacagattcaaaataa

SEQ ID NO: 389803 - DNA, 25 bp, Mus musculus
ttcagcagactgagtcgtggtcctg

SEQ ID NO: 389804 - DNA, 25 bp, Mus musculus
ttcagcagagactaaaggagatcca

SEQ ID NO: 389805 - DNA, 25 bp, Mus musculus
ttcagcagagcaggaagatccttcc

SEQ ID NO: 389806 - DNA, 25 bp, Mus musculus
ttcagcagaggagacagcagtggtc

SEQ ID NO: 389807 - DNA, 25 bp, Mus musculus
ttcagcagcaggtccaggggcagcc

SEQ ID NO: 389808 - DNA, 25 bp, Mus musculus
ttcagcagcgtcatggagatgctca

SEQ ID NO: 389809 - DNA, 25 bp, Mus musculus
ttcagcagcttccagatttgtctca

SEQ ID NO: 389810 - DNA, 25 bp, Mus musculus
ttcagcaggaagcgtcccaggttcc

SEQ ID NO: 389811 - DNA, 25 bp, Mus musculus
ttcagcaggaagtaaaatctctttg

SEQ ID NO: 389812 - DNA, 25 bp, Mus musculus
ttcagcaggataaaggcataatcaa

SEQ ID NO: 389813 - DNA, 25 bp, Mus musculus
ttcagcagtcagcatcaggggcgca

SEQ ID NO: 389814 - DNA, 25 bp, Mus musculus
ttcagcatagtctccattcagaacc

SEQ ID NO: 389815 - DNA, 25 bp, Mus musculus
ttcagcatcaggggttcggcatgct

SEQ ID NO: 389816 - DNA, 25 bp, Mus musculus
ttcagccaaagaaccccaaatctca

SEQ ID NO: 389817 - DNA, 25 bp, Mus musculus
ttcagccaaagcctattggtgtagg

SEQ ID NO: 389818 - DNA, 25 bp, Mus musculus
ttcagccaaaggagccagtcacact

SEQ ID NO: 389819 - DNA, 25 bp, Mus musculus
ttcagccaaaggattgggacatgat

SEQ ID NO: 389820 - DNA, 25 bp, Mus musculus
ttcagccacactcagggcaggagga

SEQ ID NO: 389821 - DNA, 25 bp, Mus musculus
ttcagccacactcagggcgcttatt

SEQ ID NO: 389822 - DNA, 25 bp, Mus musculus
ttcagccagagatcaccagaagctg

SEQ ID NO: 389823 - DNA, 25 bp, Mus musculus
ttcagccagagggggcttttacagc

SEQ ID NO: 389824 - DNA, 25 bp, Mus musculus
ttcagccagatgaactttcaagttg

SEQ ID NO: 389825 - DNA, 25 bp, Mus musculus
ttcagccaggagggagcggacatgg

SEQ ID NO: 389826 - DNA, 25 bp, Mus musculus
ttcagccagtgctccacctggtggc

SEQ ID NO: 389827 - DNA, 25 bp, Mus musculus
ttcagccatccaaggatgaggccat

SEQ ID NO: 389828 - DNA, 25 bp, Mus musculus
ttcagccccagctctcgggacagtc

SEQ ID NO: 389829 - DNA, 25 bp, Mus musculus
ttcagcccccatttgaataagactg

SEQ ID NO: 389830 - DNA, 25 bp, Mus musculus
ttcagcccctctgcacctaccctgt

SEQ ID NO: 389831 - DNA, 25 bp, Mus musculus
ttcagccctcagtggaccctgatca

SEQ ID NO: 389832 - DNA, 25 bp, Mus musculus
ttcagccctgagagggagattcgta

SEQ ID NO: 389833 - DNA, 25 bp, Mus musculus
ttcagccctgcacaggctagccctg

SEQ ID NO: 389834 - DNA, 25 bp, Mus musculus
ttcagccctgcgcagatggtggacc

SEQ ID NO: 389835 - DNA, 25 bp, Mus musculus
ttcagccctgctgctggctgtcatc

SEQ ID NO: 389836 - DNA, 25 bp, Mus musculus
ttcagccctgctgctgtggtgaaag

SEQ ID NO: 389837 - DNA, 25 bp, Mus musculus
ttcagccgagaaacatcccaaaccg

SEQ ID NO: 389838 - DNA, 25 bp, Mus musculus
ttcagccgagaagaactttgatcag

SEQ ID NO: 389839 - DNA, 25 bp, Mus musculus
ttcagccgcatcgctctgaagaaag

SEQ ID NO: 389840 - DNA, 25 bp, Mus musculus
ttcagccgcgtccagaccatttttg

SEQ ID NO: 389841 - DNA, 25 bp, Mus musculus
ttcagcctaccaggtacaaccacgt

SEQ ID NO: 389842 - DNA, 25 bp, Mus musculus
ttcagcctcagaaccgcaaatttat

SEQ ID NO: 389843 - DNA, 25 bp, Mus musculus
ttcagcctcagcccagcgtaagcgg

SEQ ID NO: 389844 - DNA, 25 bp, Mus musculus
ttcagcctcaggttatgaaaatgac

SEQ ID NO: 389845 - DNA, 25 bp, Mus musculus
ttcagcctcagtggtgacccaagca

SEQ ID NO: 389846 - DNA, 25 bp, Mus musculus
ttcagcctgggctcagccatcgcct

SEQ ID NO: 389847 - DNA, 25 bp, Mus musculus
ttcagcgaggaagatgaggacgatg

SEQ ID NO: 389848 - DNA, 25 bp, Mus musculus
ttcagcgagggaagcttcttgactt

SEQ ID NO: 389849 - DNA, 25 bp, Mus musculus
ttcagcgccgccgctggagagatgt

SEQ ID NO: 389850 - DNA, 25 bp, Mus musculus
ttcagcgcctctggagttagtgagc

SEQ ID NO: 389851 - DNA, 25 bp, Mus musculus
ttcagcgcctctggtgacagagtgc

SEQ ID NO: 389852 - DNA, 25 bp, Mus musculus
ttcagcgcctctgtcttgttttcag

SEQ ID NO: 389853 - DNA, 25 bp, Mus musculus
ttcagcggcggacagggagaatccc

SEQ ID NO: 389854 - DNA, 25 bp, Mus musculus
ttcagcggctcaggatggcctcagg

SEQ ID NO: 389855 - DNA, 25 bp, Mus musculus
ttcagcggctcaggccctgcccatt

SEQ ID NO: 389856 - DNA, 25 bp, Mus musculus
ttcagcgggtcaggtatatgcacca

SEQ ID NO: 389857 - DNA, 25 bp, Mus musculus
ttcagcgggtcaggtatggatgagc

SEQ ID NO: 389858 - DNA, 25 bp, Mus musculus
ttcagcggttacaggatgagctgag

SEQ ID NO: 389859 - DNA, 25 bp, Mus musculus
ttcagcggttacagggtcttactta

SEQ ID NO: 389860 - DNA, 25 bp, Mus musculus
ttcagcgtcagtctgaaggtgcttc

SEQ ID NO: 389861 - DNA, 25 bp, Mus musculus
ttcagcgtcagtctgcctttgcctg

SEQ ID NO: 389862 - DNA, 25 bp, Mus musculus
ttcagcgtgtctcatactacaagga

SEQ ID NO: 389863 - DNA, 25 bp, Mus musculus
ttcagctaaggaaaggtacaaaaat

SEQ ID NO: 389864 - DNA, 25 bp, Mus musculus
ttcagctacattttcagctttgtga

SEQ ID NO: 389865 - DNA, 25 bp, Mus musculus
ttcagctacgaaccaaaaaccacaa

SEQ ID NO: 389866 - DNA, 25 bp, Mus musculus
ttcagctatggaccgtcacgacggc

SEQ ID NO: 389867 - DNA, 25 bp, Mus musculus
ttcagctcaaggctgtcaagtcctc

SEQ ID NO: 389868 - DNA, 25 bp, Mus musculus
ttcagctccagccagggatagagaa

SEQ ID NO: 389869 - DNA, 25 bp, Mus musculus
ttcagctcccaggttgaagaaatgg

SEQ ID NO: 389870 - DNA, 25 bp, Mus musculus
ttcagctcctacctccttcttcaga

SEQ ID NO: 389871 - DNA, 25 bp, Mus musculus
ttcagctcctgcagccggatgtatg

SEQ ID NO: 389872 - DNA, 25 bp, Mus musculus
ttcagctcgcccaacttcatcaagc

SEQ ID NO: 389873 - DNA, 25 bp, Mus musculus
ttcagctctgagaggatgtgcccga

SEQ ID NO: 389874 - DNA, 25 bp, Mus musculus
ttcagctctgcggaggtgctgctgg

SEQ ID NO: 389875 - DNA, 25 bp, Mus musculus
ttcagctctggtgattgttcagtcc

SEQ ID NO: 389876 - DNA, 25 bp, Mus musculus
ttcagctgaaaaacattggattgca

SEQ ID NO: 389877 - DNA, 25 bp, Mus musculus
ttcagctgaagtcaggaaagtcagc

SEQ ID NO: 389878 - DNA, 25 bp, Mus musculus
ttcagctgcagagtgctgatcccag

SEQ ID NO: 389879 - DNA, 25 bp, Mus musculus
ttcagctgctgaggttatttaaact

SEQ ID NO: 389880 - DNA, 25 bp, Mus musculus
ttcagctgctgggactccgaggtga

SEQ ID NO: 389881 - DNA, 25 bp, Mus musculus
ttcagctggcaacacccaaggccct

SEQ ID NO: 389882 - DNA, 25 bp, Mus musculus
ttcagctggcaagaccggggttcga

SEQ ID NO: 389883 - DNA, 25 bp, Mus musculus
ttcagctgtaatggtgcgtctaatg

SEQ ID NO: 389884 - DNA, 25 bp, Mus musculus
ttcagcttatcaggtgcccagatag

SEQ ID NO: 389885 - DNA, 25 bp, Mus musculus
ttcagcttcaaatcagtaccacact

SEQ ID NO: 389886 - DNA, 25 bp, Mus musculus
ttcagcttcaaggtttggattcagg

SEQ ID NO: 389887 - DNA, 25 bp, Mus musculus
ttcagcttggggaatctggagcaat

SEQ ID NO: 389888 - DNA, 25 bp, Mus musculus
ttcagcttggggaatcttgctcttt

SEQ ID NO: 389889 - DNA, 25 bp, Mus musculus
ttcagcttggtgctgttaaagggaa

SEQ ID NO: 389890 - DNA, 25 bp, Mus musculus
ttcagctttggggtggtaatactgg

SEQ ID NO: 389891 - DNA, 25 bp, Mus musculus
ttcaggaaacttcaggacccctgtg

SEQ ID NO: 389892 - DNA, 25 bp, Mus musculus
ttcaggaaagagcaaataagttggt

SEQ ID NO: 389893 - DNA, 25 bp, Mus musculus
ttcaggaaagcctgtgggccgaagc

SEQ ID NO: 389894 - DNA, 25 bp, Mus musculus
ttcaggaaattcactgagggccagg

SEQ ID NO: 389895 - DNA, 25 bp, Mus musculus
ttcaggaaccatatcctaggcaatg

SEQ ID NO: 389896 - DNA, 25 bp, Mus musculus
ttcaggaaccatatgactgcttacg

SEQ ID NO: 389897 - DNA, 25 bp, Mus musculus
ttcaggaaccatattctgttttatt

SEQ ID NO: 389898 - DNA, 25 bp, Mus musculus
ttcaggaacttcagtttgaaaatga

SEQ ID NO: 389899 - DNA, 25 bp, Mus musculus
ttcaggaaggggaaggtgatctgag

SEQ ID NO: 389900 - DNA, 25 bp, Mus musculus
ttcaggaagtgaagggggaggtgac

SEQ ID NO: 389901 - DNA, 25 bp, Mus musculus
ttcaggaagtgaagtgttgaagaaa

SEQ ID NO: 389902 - DNA, 25 bp, Mus musculus
ttcaggaatggagactttggagact

SEQ ID NO: 389903 - DNA, 25 bp, Mus musculus
ttcaggacaaggttttcaaaataaa

SEQ ID NO: 389904 - DNA, 25 bp, Mus musculus
ttcaggaccaagtatgagtcagagc

SEQ ID NO: 389905 - DNA, 25 bp, Mus musculus
ttcaggaccccaaggtcatgatgct

SEQ ID NO: 389906 - DNA, 25 bp, Mus musculus
ttcaggaccgcttggctctacagag

SEQ ID NO: 389907 - DNA, 25 bp, Mus musculus
ttcaggacgtgacagaaaagatcaa

SEQ ID NO: 389908 - DNA, 25 bp, Mus musculus
ttcaggacgtgacagggaggcccgg

SEQ ID NO: 389909 - DNA, 25 bp, Mus musculus
ttcaggacttgctgatgtggatgcc

SEQ ID NO: 389910 - DNA, 25 bp, Mus musculus
ttcaggagaaggatagagatggttg

SEQ ID NO: 389911 - DNA, 25 bp, Mus musculus
ttcaggagatggtaaccaagtcaaa

SEQ ID NO: 389912 - DNA, 25 bp, Mus musculus
ttcaggagcagaaggtatatgtggt

SEQ ID NO: 389913 - DNA, 25 bp, Mus musculus
ttcaggagcggaggtacactgtagc

SEQ ID NO: 389914 - DNA, 25 bp, Mus musculus
ttcaggagcggcagtctcagagaga

SEQ ID NO: 389915 - DNA, 25 bp, Mus musculus
ttcaggagctgctactcaggtgcaa

SEQ ID NO: 389916 - DNA, 25 bp, Mus musculus
ttcaggaggaggacttactgtgttc

SEQ ID NO: 389917 - DNA, 25 bp, Mus musculus
ttcaggaggaggtggcaaaccctgc

SEQ ID NO: 389918 - DNA, 25 bp, Mus musculus
ttcaggagggggaacagacatcctt

SEQ ID NO: 389919 - DNA, 25 bp, Mus musculus
ttcaggagtacagacagcacccttg

SEQ ID NO: 389920 - DNA, 25 bp, Mus musculus
ttcaggataggggaatggtctagca

SEQ ID NO: 389921 - DNA, 25 bp, Mus musculus
ttcaggatgaagaactacaaagcaa

SEQ ID NO: 389922 - DNA, 25 bp, Mus musculus
ttcaggatgaagaggagaagacacc

SEQ ID NO: 389923 - DNA, 25 bp, Mus musculus
ttcaggatgagctgcaaaggctgcg

SEQ ID NO: 389924 - DNA, 25 bp, Mus musculus
ttcaggatgtcgagatgcagatctc

SEQ ID NO: 389925 - DNA, 25 bp, Mus musculus
ttcaggatgtcgaggtacggtcaga

SEQ ID NO: 389926 - DNA, 25 bp, Mus musculus
ttcaggcaaaagcgagcggagctcc

SEQ ID NO: 389927 - DNA, 25 bp, Mus musculus
ttcaggcaacatgaaattgatggga

SEQ ID NO: 389928 - DNA, 25 bp, Mus musculus
ttcaggcagagctggaaaaggtgca

SEQ ID NO: 389929 - DNA, 25 bp, Mus musculus
ttcaggcagctccaggtataatggc

SEQ ID NO: 389930 - DNA, 25 bp, Mus musculus
ttcaggccaacaaggtacgcacgcg

SEQ ID NO: 389931 - DNA, 25 bp, Mus musculus
ttcaggccagggaccgagaacacgc

SEQ ID NO: 389932 - DNA, 25 bp, Mus musculus
ttcaggcctttcagagacgaagaga

SEQ ID NO: 389933 - DNA, 25 bp, Mus musculus
ttcaggcgcatcaggtgaagaagag

SEQ ID NO: 389934 - DNA, 25 bp, Mus musculus
ttcaggcgcggggtgatggcaggag

SEQ ID NO: 389935 - DNA, 25 bp, Mus musculus
ttcaggcgctagggtctgggaacgt

SEQ ID NO: 389936 - DNA, 25 bp, Mus musculus
ttcaggcgctatgggtcatctgttc

SEQ ID NO: 389937 - DNA, 25 bp, Mus musculus
ttcaggctcggtcttttccgggctg

SEQ ID NO: 389938 - DNA, 25 bp, Mus musculus
ttcaggctggaaaggagctggagga

SEQ ID NO: 389939 - DNA, 25 bp, Mus musculus
ttcaggcttaaagggtatgtccctg

SEQ ID NO: 389940 - DNA, 25 bp, Mus musculus
ttcaggcttcaggtgcaggtcctgc

SEQ ID NO: 389941 - DNA, 25 bp, Mus musculus
ttcaggcttccagttcacgtggaga

SEQ ID NO: 389942 - DNA, 25 bp, Mus musculus
ttcagggaaacacagaaatatgccg

SEQ ID NO: 389943 - DNA, 25 bp, Mus musculus
ttcagggaacacagagcagctgcag

SEQ ID NO: 389944 - DNA, 25 bp, Mus musculus
ttcagggaacacagagttcttcttg

SEQ ID NO: 389945 - DNA, 25 bp, Mus musculus
ttcagggaacacttgggggagaagc

SEQ ID NO: 389946 - DNA, 25 bp, Mus musculus
ttcagggaaccaggatgagattctg

SEQ ID NO: 389947 - DNA, 25 bp, Mus musculus
ttcagggaagaatcggtttctggtg

SEQ ID NO: 389948 - DNA, 25 bp, Mus musculus
ttcagggaaggacctctccgagcct

SEQ ID NO: 389949 - DNA, 25 bp, Mus musculus
ttcagggaagttttgctccagacta

SEQ ID NO: 389950 - DNA, 25 bp, Mus musculus
ttcagggagaccctggtctccctgg

SEQ ID NO: 389951 - DNA, 25 bp, Mus musculus
ttcagggattacagtgctgtgctcc

SEQ ID NO: 389952 - DNA, 25 bp, Mus musculus
ttcagggcagctctcagggcctgtg

SEQ ID NO: 389953 - DNA, 25 bp, Mus musculus
ttcagggccacactggtgctgtgac

SEQ ID NO: 389954 - DNA, 25 bp, Mus musculus
ttcagggcctggacagccacttcca

SEQ ID NO: 389955 - DNA, 25 bp, Mus musculus
ttcagggggtaaatgtgattagtgt

SEQ ID NO: 389956 - DNA, 25 bp, Mus musculus
ttcaggggtcaggaggcgggagcct

SEQ ID NO: 389957 - DNA, 25 bp, Mus musculus
ttcagggtgatgctctcccagtgtc

SEQ ID NO: 389958 - DNA, 25 bp, Mus musculus
ttcaggtacaagattgagaaatggc

SEQ ID NO: 389959 - DNA, 25 bp, Mus musculus
ttcaggtccctcactaaaagcacct

SEQ ID NO: 389960 - DNA, 25 bp, Mus musculus
ttcaggtcctaaaaggtgcaactac

SEQ ID NO: 389961 - DNA, 25 bp, Mus musculus
ttcaggtctcggccagaaggtttgg

SEQ ID NO: 389962 - DNA, 25 bp, Mus musculus
ttcaggtgaggcctttaccctccgg

SEQ ID NO: 389963 - DNA, 25 bp, Mus musculus
ttcaggtggacacctccctttcctc

SEQ ID NO: 389964 - DNA, 25 bp, Mus musculus
ttcaggtgtactcctccctttcctc

SEQ ID NO: 389965 - DNA, 25 bp, Mus musculus
ttcaggtgtactcctctcttttcat

SEQ ID NO: 389966 - DNA, 25 bp, Mus musculus
ttcaggtgttaggggatgctggcaa

SEQ ID NO: 389967 - DNA, 25 bp, Mus musculus
ttcaggttaggattcccaggaaaac

SEQ ID NO: 389968 - DNA, 25 bp, Mus musculus
ttcaggttctgagaaaacctatcct

SEQ ID NO: 389969 - DNA, 25 bp, Mus musculus
ttcagtaatgcaacgtttcagtcta

SEQ ID NO: 389970 - DNA, 25 bp, Mus musculus
ttcagtaatgcaacgtttcagtctg

SEQ ID NO: 389971 - DNA, 25 bp, Mus musculus
ttcagtacaatcctgatttgtactg

SEQ ID NO: 389972 - DNA, 25 bp, Mus musculus
ttcagtacaggaaggctgtgaaggc

SEQ ID NO: 389973 - DNA, 25 bp, Mus musculus
ttcagtacagggcttcttcgtgtct

SEQ ID NO: 389974 - DNA, 25 bp, Mus musculus
ttcagtaggagtgtgacttggaagg

SEQ ID NO: 389975 - DNA, 25 bp, Mus musculus
ttcagtatcctgatcacatttgaca

SEQ ID NO: 389976 - DNA, 25 bp, Mus musculus
ttcagtatgacgttcgcctggctct

SEQ ID NO: 389977 - DNA, 25 bp, Mus musculus
ttcagtattcctgtcttgacttcct

SEQ ID NO: 389978 - DNA, 25 bp, Mus musculus
ttcagtcagagatatatttctgagt

SEQ ID NO: 389979 - DNA, 25 bp, Mus musculus
ttcagtccaagatatgagaaccaca

SEQ ID NO: 389980 - DNA, 25 bp, Mus musculus
ttcagtccaagattgcccaatgatc

SEQ ID NO: 389981 - DNA, 25 bp, Mus musculus
ttcagtccaagcacgccgcagcagc

SEQ ID NO: 389982 - DNA, 25 bp, Mus musculus
ttcagtccaagcacggggacagctt

SEQ ID NO: 389983 - DNA, 25 bp, Mus musculus
ttcagtcctacaggtttgttaagaa

SEQ ID NO: 389984 - DNA, 25 bp, Mus musculus
ttcagtcctggccgccaagttgaag

SEQ ID NO: 389985 - DNA, 25 bp, Mus musculus
ttcagtcctggtgaactgtccatcc

SEQ ID NO: 389986 - DNA, 25 bp, Mus musculus
ttcagtcctggtggtccccagcagg

SEQ ID NO: 389987 - DNA, 25 bp, Mus musculus
ttcagtcctttctggtgtccgccga

SEQ ID NO: 389988 - DNA, 25 bp, Mus musculus
ttcagtctaagtgtacacaggagaa

SEQ ID NO: 389989 - DNA, 25 bp, Mus musculus
ttcagtctcaccggctggggagaga

SEQ ID NO: 389990 - DNA, 25 bp, Mus musculus
ttcagtctctcagtgcctgtgctga

SEQ ID NO: 389991 - DNA, 25 bp, Mus musculus
ttcagtctgagattggccaggtgaa

SEQ ID NO: 389992 - DNA, 25 bp, Mus musculus
ttcagtcttggctgttccttcttgg

SEQ ID NO: 389993 - DNA, 25 bp, Mus musculus
ttcagtgaagagcgagatgttgaac

SEQ ID NO: 389994 - DNA, 25 bp, Mus musculus
ttcagtgaagaggaggtcccccaga

SEQ ID NO: 389995 - DNA, 25 bp, Mus musculus
ttcagtgaaggatttgaactttttg

SEQ ID NO: 389996 - DNA, 25 bp, Mus musculus
ttcagtgaaggtaatggaaaaggtg

SEQ ID NO: 389997 - DNA, 25 bp, Mus musculus
ttcagtgacaactccacagagtcat

SEQ ID NO: 389998 - DNA, 25 bp, Mus musculus
ttcagtgacagattgctgttcttct

SEQ ID NO: 389999 - DNA, 25 bp, Mus musculus
ttcagtgaccacgctgtgttgacat

SEQ ID NO: 390000 - DNA, 25 bp, Mus musculus
ttcagtgaccacggggtaaaggccg

SEQ ID NO: 390001 - DNA, 25 bp, Mus musculus
ttcagtgaggaggcttacatcccgc

SEQ ID NO: 390002 - DNA, 25 bp, Mus musculus
ttcagtgaggatggattcctgaaag

SEQ ID NO: 390003 - DNA, 25 bp, Mus musculus
ttcagtgcaaggatggaaggaccct

SEQ ID NO: 390004 - DNA, 25 bp, Mus musculus
ttcagtgcaaggttatcctgctcgg

SEQ ID NO: 390005 - DNA, 25 bp, Mus musculus
ttcagtgcccacccgagtcattcga

SEQ ID NO: 390006 - DNA, 25 bp, Mus musculus
ttcagtgcctgccacgtgagaagcc

SEQ ID NO: 390007 - DNA, 25 bp, Mus musculus
ttcagtgcctgccaggtgagaagcc

SEQ ID NO: 390008 - DNA, 25 bp, Mus musculus
ttcagtgctcagaagtttgcaggga

SEQ ID NO: 390009 - DNA, 25 bp, Mus musculus
ttcagtgctcagcaggtttgggaaa

SEQ ID NO: 390010 - DNA, 25 bp, Mus musculus
ttcagtgcttttaatcagcttaaga

SEQ ID NO: 390011 - DNA, 25 bp, Mus musculus
ttcagtggaaggtaaacagaatctg

SEQ ID NO: 390012 - DNA, 25 bp, Mus musculus
ttcagtggaccaaattttcaggatg

SEQ ID NO: 390013 - DNA, 25 bp, Mus musculus
ttcagtggaccagccttcgtggtga

SEQ ID NO: 390014 - DNA, 25 bp, Mus musculus
ttcagtggcctacagggctggctgt

SEQ ID NO: 390015 - DNA, 25 bp, Mus musculus
ttcagtggctcggatgttcagcaca

SEQ ID NO: 390016 - DNA, 25 bp, Mus musculus
ttcagtggggctccacctgttcccc

SEQ ID NO: 390017 - DNA, 25 bp, Mus musculus
ttcagtgggggagtttgtgacattc

SEQ ID NO: 390018 - DNA, 25 bp, Mus musculus
ttcagtgggggatttccaatttcga

SEQ ID NO: 390019 - DNA, 25 bp, Mus musculus
ttcagtgtaggatctcttcactggt

SEQ ID NO: 390020 - DNA, 25 bp, Mus musculus
ttcagtgtcagacttaaatggagtg

SEQ ID NO: 390021 - DNA, 25 bp, Mus musculus
ttcagtgtcatcaaggtctttccgg

SEQ ID NO: 390022 - DNA, 25 bp, Mus musculus
ttcagttaatggaatcttctgagag

SEQ ID NO: 390023 - DNA, 25 bp, Mus musculus
ttcagttacaagcaacaacaacaaa

SEQ ID NO: 390024 - DNA, 25 bp, Mus musculus
ttcagttacaaggcaatgtatgtga

SEQ ID NO: 390025 - DNA, 25 bp, Mus musculus
ttcagttagctgagacacttgtgag

SEQ ID NO: 390026 - DNA, 25 bp, Mus musculus
ttcagttagctgagtcggctgcacg

SEQ ID NO: 390027 - DNA, 25 bp, Mus musculus
ttcagttcaaagatctaaatgcaaa

SEQ ID NO: 390028 - DNA, 25 bp, Mus musculus
ttcagttcagttagcccccaaccat

SEQ ID NO: 390029 - DNA, 25 bp, Mus musculus
ttcagttcagttttgctaactgtgg

SEQ ID NO: 390030 - DNA, 25 bp, Mus musculus
ttcagttcttctcaggggaggagta

SEQ ID NO: 390031 - DNA, 25 bp, Mus musculus
ttcagttcttctcagggttggaaat

SEQ ID NO: 390032 - DNA, 25 bp, Mus musculus
ttcagttcttctcaggtatattgaa

SEQ ID NO: 390033 - DNA, 25 bp, Mus musculus
ttcagttgacacgagccgtctaccc

SEQ ID NO: 390034 - DNA, 25 bp, Mus musculus
ttcagttgacacggaacagtccaat

SEQ ID NO: 390035 - DNA, 25 bp, Mus musculus
ttcagttgcctcaagacatttgagg

SEQ ID NO: 390036 - DNA, 25 bp, Mus musculus
ttcagttgcctcaaggtcctctgtc

SEQ ID NO: 390037 - DNA, 25 bp, Mus musculus
ttcagttggagcaggccctgcagga

SEQ ID NO: 390038 - DNA, 25 bp, Mus musculus
ttcagttggatgaaaattccaagtt

SEQ ID NO: 390039 - DNA, 25 bp, Mus musculus
ttcagttggccaaggtgtttcccag

SEQ ID NO: 390040 - DNA, 25 bp, Mus musculus
ttcagtttccacagaatggactcgc

SEQ ID NO: 390041 - DNA, 25 bp, Mus musculus
ttcagtttctcgcagagtgttcctg

SEQ ID NO: 390042 - DNA, 25 bp, Mus musculus
ttcagtttctcgcagatatattacc

SEQ ID NO: 390043 - DNA, 25 bp, Mus musculus
ttcagtttgataccggatggtggat

SEQ ID NO: 390044 - DNA, 25 bp, Mus musculus
ttcagttttagatcaagaatgaccc

SEQ ID NO: 390045 - DNA, 25 bp, Mus musculus
ttcataaacaagatgaaattataga

SEQ ID NO: 390046 - DNA, 25 bp, Mus musculus
ttcataaacaaggtcgctggtcatc

SEQ ID NO: 390047 - DNA, 25 bp, Mus musculus
ttcataaacttgttcaagccatatt

SEQ ID NO: 390048 - DNA, 25 bp, Mus musculus
ttcataaatgatgtatgtcgcactg

SEQ ID NO: 390049 - DNA, 25 bp, Mus musculus
ttcataacaaggatatagtgcacag

SEQ ID NO: 390050 - DNA, 25 bp, Mus musculus
ttcataacatagactgaaacagtcc

SEQ ID NO: 390051 - DNA, 25 bp, Mus musculus
ttcataactcgaatgaaactttgct

SEQ ID NO: 390052 - DNA, 25 bp, Mus musculus
ttcataacttccagagaatctcagt

SEQ ID NO: 390053 - DNA, 25 bp, Mus musculus
ttcataacttccagatccaggcctt

SEQ ID NO: 390054 - DNA, 25 bp, Mus musculus
ttcataagaagtgtttccacgatga

SEQ ID NO: 390055 - DNA, 25 bp, Mus musculus
ttcataatcaaggcgtatgggcaag

SEQ ID NO: 390056 - DNA, 25 bp, Mus musculus
ttcataccagctgcttttatggtgg

SEQ ID NO: 390057 - DNA, 25 bp, Mus musculus
ttcataccaggttgtaagcatcaat

SEQ ID NO: 390058 - DNA, 25 bp, Mus musculus
ttcatacctcgagaattatagtgaa

SEQ ID NO: 390059 - DNA, 25 bp, Mus musculus
ttcatacgatcacagataactatgc

SEQ ID NO: 390060 - DNA, 25 bp, Mus musculus
ttcatacgatcacagggatctcgat

SEQ ID NO: 390061 - DNA, 25 bp, Mus musculus
ttcatactgcatgacatcaacagtg

SEQ ID NO: 390062 - DNA, 25 bp, Mus musculus
ttcatagaagatcaagatgtagaac

SEQ ID NO: 390063 - DNA, 25 bp, Mus musculus
ttcatagaaggtacttcaagagtaa

SEQ ID NO: 390064 - DNA, 25 bp, Mus musculus
ttcatagaaggttctcattgtgtaa

SEQ ID NO: 390065 - DNA, 25 bp, Mus musculus
ttcatagctccagtgacccaccgtt

SEQ ID NO: 390066 - DNA, 25 bp, Mus musculus
ttcatagcttacatacccttcgcag

SEQ ID NO: 390067 - DNA, 25 bp, Mus musculus
ttcataggagaagtatgagctggtg

SEQ ID NO: 390068 - DNA, 25 bp, Mus musculus
ttcatagggcggtcagctcactaag

SEQ ID NO: 390069 - DNA, 25 bp, Mus musculus
ttcatagtagttctcttcccatact

SEQ ID NO: 390070 - DNA, 25 bp, Mus musculus
ttcatatcagatgttttccagcaag

SEQ ID NO: 390071 - DNA, 25 bp, Mus musculus
ttcatatcagcacggacgattccgg

SEQ ID NO: 390072 - DNA, 25 bp, Mus musculus
ttcatatcagcacgggtcacccaga

SEQ ID NO: 390073 - DNA, 25 bp, Mus musculus
ttcatatcagtggaacacatttcca

SEQ ID NO: 390074 - DNA, 25 bp, Mus musculus
ttcatatccttcaggatggaacaga

SEQ ID NO: 390075 - DNA, 25 bp, Mus musculus
ttcatatctaccgtcgacttaaaac

SEQ ID NO: 390076 - DNA, 25 bp, Mus musculus
ttcatattggacaagaagttgttca

SEQ ID NO: 390077 - DNA, 25 bp, Mus musculus
ttcatattggacaagtagaggggac

SEQ ID NO: 390078 - DNA, 25 bp, Mus musculus
ttcatatttggccacagccttcgtg

SEQ ID NO: 390079 - DNA, 25 bp, Mus musculus
ttcatcaaagagtgtggcctgctca

SEQ ID NO: 390080 - DNA, 25 bp, Mus musculus
ttcatcaacagagctggcatgtttg

SEQ ID NO: 390081 - DNA, 25 bp, Mus musculus
ttcatcaactatcatgcttcggatg

SEQ ID NO: 390082 - DNA, 25 bp, Mus musculus
ttcatcaagcctggtacttgctaca

SEQ ID NO: 390083 - DNA, 25 bp, Mus musculus
ttcatcacagagccggctgatcttt

SEQ ID NO: 390084 - DNA, 25 bp, Mus musculus
ttcatcacagcacaggaggaagcaa

SEQ ID NO: 390085 - DNA, 25 bp, Mus musculus
ttcatcaccaactttccaagattac

SEQ ID NO: 390086 - DNA, 25 bp, Mus musculus
ttcatcaccaggagctcggacggcg

SEQ ID NO: 390087 - DNA, 25 bp, Mus musculus
ttcatcaccaggagctctcctccca

SEQ ID NO: 390088 - DNA, 25 bp, Mus musculus
ttcatcaccaggagtatgcttgaga

SEQ ID NO: 390089 - DNA, 25 bp, Mus musculus
ttcatcactcagtgcatgaggaagc

SEQ ID NO: 390090 - DNA, 25 bp, Mus musculus
ttcatcagaacaggagtaagcatgg

SEQ ID NO: 390091 - DNA, 25 bp, Mus musculus
ttcatcagaggagattgaagggcgg

SEQ ID NO: 390092 - DNA, 25 bp, Mus musculus
ttcatcagcaagagcttatttcctc

SEQ ID NO: 390093 - DNA, 25 bp, Mus musculus
ttcatcagcacagaccggggagctc

SEQ ID NO: 390094 - DNA, 25 bp, Mus musculus
ttcatcagccaggagccagtcctgt

SEQ ID NO: 390095 - DNA, 25 bp, Mus musculus
ttcatcatcaaggtctttcgcttcc

SEQ ID NO: 390096 - DNA, 25 bp, Mus musculus
ttcatcatcacggtcttctggccac

SEQ ID NO: 390097 - DNA, 25 bp, Mus musculus
ttcatcatcccaggagtgttactag

SEQ ID NO: 390098 - DNA, 25 bp, Mus musculus
ttcatcatcccagtcttcatcagct

SEQ ID NO: 390099 - DNA, 25 bp, Mus musculus
ttcatcatgaacctgctcctggccg

SEQ ID NO: 390100 - DNA, 25 bp, Mus musculus
ttcatcatgggaggtgaggctctgg

SEQ ID NO: 390101 - DNA, 25 bp, Mus musculus
ttcatcatggtcctccaggaggact

SEQ ID NO: 390102 - DNA, 25 bp, Mus musculus
ttcatccaaagatgactggtttaca

SEQ ID NO: 390103 - DNA, 25 bp, Mus musculus
ttcatccaaggcgttagacaaaccc

SEQ ID NO: 390104 - DNA, 25 bp, Mus musculus
ttcatccagcagacgtcccccgcca

SEQ ID NO: 390105 - DNA, 25 bp, Mus musculus
ttcatccagtgagaaaattgtacaa

SEQ ID NO: 390106 - DNA, 25 bp, Mus musculus
ttcatccagtgaggaatcttccgag

SEQ ID NO: 390107 - DNA, 25 bp, Mus musculus
ttcatccatcaggcgtggtttctgt

SEQ ID NO: 390108 - DNA, 25 bp, Mus musculus
ttcatccatggaccggcacgatggc

SEQ ID NO: 390109 - DNA, 25 bp, Mus musculus
ttcatcccagaaggaagaattctgt

SEQ ID NO: 390110 - DNA, 25 bp, Mus musculus
ttcatcccaggaaaggtgattgatg

SEQ ID NO: 390111 - DNA, 25 bp, Mus musculus
ttcatcccaggagatcttcccacgg

SEQ ID NO: 390112 - DNA, 25 bp, Mus musculus
ttcatccccaaggggacaaatgtaa

SEQ ID NO: 390113 - DNA, 25 bp, Mus musculus
ttcatccccacagataattctgaaa

SEQ ID NO: 390114 - DNA, 25 bp, Mus musculus
ttcatccccacagggtcagttttgt

SEQ ID NO: 390115 - DNA, 25 bp, Mus musculus
ttcatccccacagtacccatgatgc

SEQ ID NO: 390116 - DNA, 25 bp, Mus musculus
ttcatccccagagagaaccttcttc

SEQ ID NO: 390117 - DNA, 25 bp, Mus musculus
ttcatccccagagagatgaggaaag

SEQ ID NO: 390118 - DNA, 25 bp, Mus musculus
ttcatccccagagagcatttctggc

SEQ ID NO: 390119 - DNA, 25 bp, Mus musculus
ttcatccctgaactgcacacgccaa

SEQ ID NO: 390120 - DNA, 25 bp, Mus musculus
ttcatccgaaaggcacagtgttcct

SEQ ID NO: 390121 - DNA, 25 bp, Mus musculus
ttcatccgaaagggactcctctagc

SEQ ID NO: 390122 - DNA, 25 bp, Mus musculus
ttcatccgtatccaggattccctgg

SEQ ID NO: 390123 - DNA, 25 bp, Mus musculus
ttcatcctagcggtttgcctgagaa

SEQ ID NO: 390124 - DNA, 25 bp, Mus musculus
ttcatcctgaagacgcatttagtaa

SEQ ID NO: 390125 - DNA, 25 bp, Mus musculus
ttcatccttgttaggtgccgcattg

SEQ ID NO: 390126 - DNA, 25 bp, Mus musculus
ttcatccttttccagacagtccagg

SEQ ID NO: 390127 - DNA, 25 bp, Mus musculus
ttcatcgacaaagacaacactgctt

SEQ ID NO: 390128 - DNA, 25 bp, Mus musculus
ttcatcgacaaggtgcgcttcctgg

SEQ ID NO: 390129 - DNA, 25 bp, Mus musculus
ttcatcgagccgagatgaaaccaga

SEQ ID NO: 390130 - DNA, 25 bp, Mus musculus
ttcatcgataccgtgatgcaattgc

SEQ ID NO: 390131 - DNA, 25 bp, Mus musculus
ttcatcgccaatgctgacttggagc

SEQ ID NO: 390132 - DNA, 25 bp, Mus musculus
ttcatcgtcagcaagctgtgggcca

SEQ ID NO: 390133 - DNA, 25 bp, Mus musculus
ttcatcgtcgcagaaagtaagcccc

SEQ ID NO: 390134 - DNA, 25 bp, Mus musculus
ttcatcgtcgcagacagctgagtag

SEQ ID NO: 390135 - DNA, 25 bp, Mus musculus
ttcatcgtcgctgcaaaatacaaca

SEQ ID NO: 390136 - DNA, 25 bp, Mus musculus
ttcatcgtgaagagcctccccaggt

SEQ ID NO: 390137 - DNA, 25 bp, Mus musculus
ttcatctactcttggttcttcattg

SEQ ID NO: 390138 - DNA, 25 bp, Mus musculus
ttcatctagaggttttacagacagc

SEQ ID NO: 390139 - DNA, 25 bp, Mus musculus
ttcatctagagtacaaaacaggaga

SEQ ID NO: 390140 - DNA, 25 bp, Mus musculus
ttcatctcaaagcatacagctgcaa

SEQ ID NO: 390141 - DNA, 25 bp, Mus musculus
ttcatctcaaggatccttgacactg

SEQ ID NO: 390142 - DNA, 25 bp, Mus musculus
ttcatctcagatgtggtgaacgact

SEQ ID NO: 390143 - DNA, 25 bp, Mus musculus
ttcatctccaaggttggtgacacat

SEQ ID NO: 390144 - DNA, 25 bp, Mus musculus
ttcatctctcaggctctctaactga

SEQ ID NO: 390145 - DNA, 25 bp, Mus musculus
ttcatctctgagaacagaggcgtga

SEQ ID NO: 390146 - DNA, 25 bp, Mus musculus
ttcatctctggcgttattgctgtct

SEQ ID NO: 390147 - DNA, 25 bp, Mus musculus
ttcatctctggtcttgacgaagtga

SEQ ID NO: 390148 - DNA, 25 bp, Mus musculus
ttcatctgcaaagaaatcctacgaa

SEQ ID NO: 390149 - DNA, 25 bp, Mus musculus
ttcatctgccgactccctgtcctgt

SEQ ID NO: 390150 - DNA, 25 bp, Mus musculus
ttcatctgccggaagccgactctgt

SEQ ID NO: 390151 - DNA, 25 bp, Mus musculus
ttcatctgctgggaccagagtgagg

SEQ ID NO: 390152 - DNA, 25 bp, Mus musculus
ttcatctgggaatctacagtgattt

SEQ ID NO: 390153 - DNA, 25 bp, Mus musculus
ttcatctgggtatctacagtgattt

SEQ ID NO: 390154 - DNA, 25 bp, Mus musculus
ttcatctgtggcctggagagagaca

SEQ ID NO: 390155 - DNA, 25 bp, Mus musculus
ttcatctgtgtgggaacgtgttccg

SEQ ID NO: 390156 - DNA, 25 bp, Mus musculus
ttcatctgtttcaaatcccagaaac

SEQ ID NO: 390157 - DNA, 25 bp, Mus musculus
ttcatctgtttcaagaagatctgcc

SEQ ID NO: 390158 - DNA, 25 bp, Mus musculus
ttcatcttaggtcgggatggtggct

SEQ ID NO: 390159 - DNA, 25 bp, Mus musculus
ttcatcttatcaggagcacggcatc

SEQ ID NO: 390160 - DNA, 25 bp, Mus musculus
ttcatcttcaggggtcagcaggaag

SEQ ID NO: 390161 - DNA, 25 bp, Mus musculus
ttcatcttccaattctcctctggct

SEQ ID NO: 390162 - DNA, 25 bp, Mus musculus
ttcatcttccagagaggaggctcac

SEQ ID NO: 390163 - DNA, 25 bp, Mus musculus
ttcatctttatcagcaatgctggtg

SEQ ID NO: 390164 - DNA, 25 bp, Mus musculus
ttcatctttcagatggtgatataca

SEQ ID NO: 390165 - DNA, 25 bp, Mus musculus
ttcatcttttggatcactggtgtta

SEQ ID NO: 390166 - DNA, 25 bp, Mus musculus
ttcatgaaagatcgattatattttg

SEQ ID NO: 390167 - DNA, 25 bp, Mus musculus
ttcatgaaagctccttgtgaaccac

SEQ ID NO: 390168 - DNA, 25 bp, Mus musculus
ttcatgaaaggaagaacaattgtgg

SEQ ID NO: 390169 - DNA, 25 bp, Mus musculus
ttcatgaaaggaatacagatgttat

SEQ ID NO: 390170 - DNA, 25 bp, Mus musculus
ttcatgaaagttccgacgagatatc

SEQ ID NO: 390171 - DNA, 25 bp, Mus musculus
ttcatgaagaacatatgacatccaa

SEQ ID NO: 390172 - DNA, 25 bp, Mus musculus
ttcatgaagaaggctggataccagg

SEQ ID NO: 390173 - DNA, 25 bp, Mus musculus
ttcatgaataagcagttccgggctt

SEQ ID NO: 390174 - DNA, 25 bp, Mus musculus
ttcatgacaagtgggccaatccgag

SEQ ID NO: 390175 - DNA, 25 bp, Mus musculus
ttcatgacaccaggacttcctccat

SEQ ID NO: 390176 - DNA, 25 bp, Mus musculus
ttcatgacagaggacatttgacaca

SEQ ID NO: 390177 - DNA, 25 bp, Mus musculus
ttcatgacagatttctcaggaatat

SEQ ID NO: 390178 - DNA, 25 bp, Mus musculus
ttcatgacagtgtggctcagactcc

SEQ ID NO: 390179 - DNA, 25 bp, Mus musculus
ttcatgacgccaggatcccattttc

SEQ ID NO: 390180 - DNA, 25 bp, Mus musculus
ttcatgacggagcgaaatacttaag

SEQ ID NO: 390181 - DNA, 25 bp, Mus musculus
ttcatgagctacttcccacccctgc

SEQ ID NO: 390182 - DNA, 25 bp, Mus musculus
ttcatgagtccagacttcttgtgaa

SEQ ID NO: 390183 - DNA, 25 bp, Mus musculus
ttcatgagtccaggctagatatgga

SEQ ID NO: 390184 - DNA, 25 bp, Mus musculus
ttcatgagttaaggcgtcgaggtgg

SEQ ID NO: 390185 - DNA, 25 bp, Mus musculus
ttcatgataagaaccaacttcttgt

SEQ ID NO: 390186 - DNA, 25 bp, Mus musculus
ttcatgataagggaagaagacatga

SEQ ID NO: 390187 - DNA, 25 bp, Mus musculus
ttcatgataagtgcacaaagaagac

SEQ ID NO: 390188 - DNA, 25 bp, Mus musculus
ttcatgatgaccaggattacttaca

SEQ ID NO: 390189 - DNA, 25 bp, Mus musculus
ttcatgatgtgaccctggacaaact

SEQ ID NO: 390190 - DNA, 25 bp, Mus musculus
ttcatgattatagtgcagcagctgc

SEQ ID NO: 390191 - DNA, 25 bp, Mus musculus
ttcatgatttccagagagaagacct

SEQ ID NO: 390192 - DNA, 25 bp, Mus musculus
ttcatgatttccagcctcatgtcat

SEQ ID NO: 390193 - DNA, 25 bp, Mus musculus
ttcatgcagcactatgccttcctca

SEQ ID NO: 390194 - DNA, 25 bp, Mus musculus
ttcatgcagcagtatgccttcctca

SEQ ID NO: 390195 - DNA, 25 bp, Mus musculus
ttcatgcatttggaggaactgccat

SEQ ID NO: 390196 - DNA, 25 bp, Mus musculus
ttcatgccaaaggcctctggctgta

SEQ ID NO: 390197 - DNA, 25 bp, Mus musculus
ttcatgccaaaggtcagttcaccgg

SEQ ID NO: 390198 - DNA, 25 bp, Mus musculus
ttcatgccaccctctgcctcccaag

SEQ ID NO: 390199 - DNA, 25 bp, Mus musculus
ttcatgccaggactactgttgaaga

SEQ ID NO: 390200 - DNA, 25 bp, Mus musculus
ttcatgccatgccaggaactccatg

SEQ ID NO: 390201 - DNA, 25 bp, Mus musculus
ttcatgccatgccaggaggaaaggg

SEQ ID NO: 390202 - DNA, 25 bp, Mus musculus
ttcatgccatttcagtgcccgatgg

SEQ ID NO: 390203 - DNA, 25 bp, Mus musculus
ttcatgcccacctggtaacatcttg

SEQ ID NO: 390204 - DNA, 25 bp, Mus musculus
ttcatgcccagggtgttccatgagc

SEQ ID NO: 390205 - DNA, 25 bp, Mus musculus
ttcatgcccatccggttccagtggt

SEQ ID NO: 390206 - DNA, 25 bp, Mus musculus
ttcatgcgctgtggggatggaaatg

SEQ ID NO: 390207 - DNA, 25 bp, Mus musculus
ttcatgctaggcaatggtcactcgg

SEQ ID NO: 390208 - DNA, 25 bp, Mus musculus
ttcatgctggacccgctgcggctgc

SEQ ID NO: 390209 - DNA, 25 bp, Mus musculus
ttcatgctggacccgtccattggag

SEQ ID NO: 390210 - DNA, 25 bp, Mus musculus
ttcatgctggatgacctcaatgcca

SEQ ID NO: 390211 - DNA, 25 bp, Mus musculus
ttcatgctggatgatactatcgtgg

SEQ ID NO: 390212 - DNA, 25 bp, Mus musculus
ttcatggaagagggtagcacattac

SEQ ID NO: 390213 - DNA, 25 bp, Mus musculus
ttcatggaagaggtccagaaagtct

SEQ ID NO: 390214 - DNA, 25 bp, Mus musculus
ttcatggactagcgagccataaaag

SEQ ID NO: 390215 - DNA, 25 bp, Mus musculus
ttcatggactggtgtccaaagacaa

SEQ ID NO: 390216 - DNA, 25 bp, Mus musculus
ttcatggagagacgtgacactcact

SEQ ID NO: 390217 - DNA, 25 bp, Mus musculus
ttcatggagagggaggggcggaaga

SEQ ID NO: 390218 - DNA, 25 bp, Mus musculus
ttcatggagcaggtgcaccgtggca

SEQ ID NO: 390219 - DNA, 25 bp, Mus musculus
ttcatggataaaggtgctggagagt

SEQ ID NO: 390220 - DNA, 25 bp, Mus musculus
ttcatggatgaattgaagccccaca

SEQ ID NO: 390221 - DNA, 25 bp, Mus musculus
ttcatggatgaatttgctggactct

SEQ ID NO: 390222 - DNA, 25 bp, Mus musculus
ttcatggattcactagggaaggaaa

SEQ ID NO: 390223 - DNA, 25 bp, Mus musculus
ttcatggctgtgtgattgatcctgt

SEQ ID NO: 390224 - DNA, 25 bp, Mus musculus
ttcatgggagaagggcaggtttatc

SEQ ID NO: 390225 - DNA, 25 bp, Mus musculus
ttcatgggagaggggtaactatcca

SEQ ID NO: 390226 - DNA, 25 bp, Mus musculus
ttcatgggcgtgcggattgtcgcag

SEQ ID NO: 390227 - DNA, 25 bp, Mus musculus
ttcatggtactgctgtattttcatc

SEQ ID NO: 390228 - DNA, 25 bp, Mus musculus
ttcatggtagaagtctttatagata

SEQ ID NO: 390229 - DNA, 25 bp, Mus musculus
ttcatggtgaaggacacatcttacc

SEQ ID NO: 390230 - DNA, 25 bp, Mus musculus
ttcatggtggccaaggttccctacc

SEQ ID NO: 390231 - DNA, 25 bp, Mus musculus
ttcatgtacccaagagttgtcttgg

SEQ ID NO: 390232 - DNA, 25 bp, Mus musculus
ttcatgtagccgcctcaaacatgtc

SEQ ID NO: 390233 - DNA, 25 bp, Mus musculus
ttcatgtagtgaggacagtagaatt

SEQ ID NO: 390234 - DNA, 25 bp, Mus musculus
ttcatgtagtgaggcagcagagtga

SEQ ID NO: 390235 - DNA, 25 bp, Mus musculus
ttcatgtatgagctggatagagaga

SEQ ID NO: 390236 - DNA, 25 bp, Mus musculus
ttcatgtcaacaaagtccaaggttg

SEQ ID NO: 390237 - DNA, 25 bp, Mus musculus
ttcatgtccaaagggctcccagagg

SEQ ID NO: 390238 - DNA, 25 bp, Mus musculus
ttcatgtccggaaggtctgcgctgc

SEQ ID NO: 390239 - DNA, 25 bp, Mus musculus
ttcatgtctggatgtgtctagtccg

SEQ ID NO: 390240 - DNA, 25 bp, Mus musculus
ttcatgtgcacaaagatagttttga

SEQ ID NO: 390241 - DNA, 25 bp, Mus musculus
ttcatgtgcacaaagcactgtgtga

SEQ ID NO: 390242 - DNA, 25 bp, Mus musculus
ttcatgtgccaggctggcgacttca

SEQ ID NO: 390243 - DNA, 25 bp, Mus musculus
ttcatgtgccgtgtggtgtggattc

SEQ ID NO: 390244 - DNA, 25 bp, Mus musculus
ttcatgtggaaggtgtgaatctggc

SEQ ID NO: 390245 - DNA, 25 bp, Mus musculus
ttcatgtggtaccggagtaaggaac

SEQ ID NO: 390246 - DNA, 25 bp, Mus musculus
ttcatgtgtagcaggtttcaaagct

SEQ ID NO: 390247 - DNA, 25 bp, Mus musculus
ttcatgttcgtgattgtgctgtcct

SEQ ID NO: 390248 - DNA, 25 bp, Mus musculus
ttcatgtttccagttggcctctatt

SEQ ID NO: 390249 - DNA, 25 bp, Mus musculus
ttcatgtttgagggccatgacacca

SEQ ID NO: 390250 - DNA, 25 bp, Mus musculus
ttcattaaaagctccaggtctggtt

SEQ ID NO: 390251 - DNA, 25 bp, Mus musculus
ttcattaaacccaacaaacctgtga

SEQ ID NO: 390252 - DNA, 25 bp, Mus musculus
ttcattaagcagaggtgacagctgc

SEQ ID NO: 390253 - DNA, 25 bp, Mus musculus
ttcattaatgagcgccttaaagctg

SEQ ID NO: 390254 - DNA, 25 bp, Mus musculus
ttcattaatgagggccttaaagctg

SEQ ID NO: 390255 - DNA, 25 bp, Mus musculus
ttcattacaaccagagggcatgaag

SEQ ID NO: 390256 - DNA, 25 bp, Mus musculus
ttcattacaaccagagttttcctcc

SEQ ID NO: 390257 - DNA, 25 bp, Mus musculus
ttcattaccaaattgttcccataac

SEQ ID NO: 390258 - DNA, 25 bp, Mus musculus
ttcattacctggagaagtgtgtctg

SEQ ID NO: 390259 - DNA, 25 bp, Mus musculus
ttcattacgtaatgaagtacttaag

SEQ ID NO: 390260 - DNA, 25 bp, Mus musculus
ttcattataagaacaacaaaaccat

SEQ ID NO: 390261 - DNA, 25 bp, Mus musculus
ttcattataagcatgatcgggaggg

SEQ ID NO: 390262 - DNA, 25 bp, Mus musculus
ttcattattctatggctagaaaatg

SEQ ID NO: 390263 - DNA, 25 bp, Mus musculus
ttcattattgtgctgctgatgaaga

SEQ ID NO: 390264 - DNA, 25 bp, Mus musculus
ttcattcaataaatggatggaaacc

SEQ ID NO: 390265 - DNA, 25 bp, Mus musculus
ttcattcagcactcggtaattcaga

SEQ ID NO: 390266 - DNA, 25 bp, Mus musculus
ttcattcattcccactatgggcctc

SEQ ID NO: 390267 - DNA, 25 bp, Mus musculus
ttcattccatagtgagttcttagac

SEQ ID NO: 390268 - DNA, 25 bp, Mus musculus
ttcattccattgtgagttcttagac

SEQ ID NO: 390269 - DNA, 25 bp, Mus musculus
ttcattccccagactaggctgtcct

SEQ ID NO: 390270 - DNA, 25 bp, Mus musculus
ttcattcctaggtggtctcctagcc

SEQ ID NO: 390271 - DNA, 25 bp, Mus musculus
ttcattcctctcagccaaaaagact

SEQ ID NO: 390272 - DNA, 25 bp, Mus musculus
ttcattcgaattgggcggcggccag

SEQ ID NO: 390273 - DNA, 25 bp, Mus musculus
ttcattcgttcacggctgctcagac

SEQ ID NO: 390274 - DNA, 25 bp, Mus musculus
ttcattctaataaggagtggagtca

SEQ ID NO: 390275 - DNA, 25 bp, Mus musculus
ttcattctcatcgccgagctgaatg

SEQ ID NO: 390276 - DNA, 25 bp, Mus musculus
ttcattgaattttagaatgattgaa

SEQ ID NO: 390277 - DNA, 25 bp, Mus musculus
ttcattgaattttagctggattcat

SEQ ID NO: 390278 - DNA, 25 bp, Mus musculus
ttcattgaccaggagctgtccaggt

SEQ ID NO: 390279 - DNA, 25 bp, Mus musculus
ttcattgagtgcaggaatttgacgg

SEQ ID NO: 390280 - DNA, 25 bp, Mus musculus
ttcattgagtgcaggcttggctgtt

SEQ ID NO: 390281 - DNA, 25 bp, Mus musculus
ttcattgatctggttatccaggccg

SEQ ID NO: 390282 - DNA, 25 bp, Mus musculus
ttcattgatgggcagacacgcaccc

SEQ ID NO: 390283 - DNA, 25 bp, Mus musculus
ttcattgccagcaaccgtgtcttca

SEQ ID NO: 390284 - DNA, 25 bp, Mus musculus
ttcattgctaacaggatgcccatcc

SEQ ID NO: 390285 - DNA, 25 bp, Mus musculus
ttcattgctaacaggggatcatgag

SEQ ID NO: 390286 - DNA, 25 bp, Mus musculus
ttcattgctcagacggccagagcag

SEQ ID NO: 390287 - DNA, 25 bp, Mus musculus
ttcattgctcagcatgagaatgata

SEQ ID NO: 390288 - DNA, 25 bp, Mus musculus
ttcattgctggctttgcggtgggct

SEQ ID NO: 390289 - DNA, 25 bp, Mus musculus
ttcattggaggtttaggattagcat

SEQ ID NO: 390290 - DNA, 25 bp, Mus musculus
ttcattggattccgccattgatctt

SEQ ID NO: 390291 - DNA, 25 bp, Mus musculus
ttcattgtaatcgattggtatcatt

SEQ ID NO: 390292 - DNA, 25 bp, Mus musculus
ttcattgtcaggttcctggaaagca

SEQ ID NO: 390293 - DNA, 25 bp, Mus musculus
ttcattgtggaggtcaacgtcctgc

SEQ ID NO: 390294 - DNA, 25 bp, Mus musculus
ttcattgtgtaaagcctcctgtacc

SEQ ID NO: 390295 - DNA, 25 bp, Mus musculus
ttcatttaaaatggatgtgaaatga

SEQ ID NO: 390296 - DNA, 25 bp, Mus musculus
ttcatttactaagactctccttccc

SEQ ID NO: 390297 - DNA, 25 bp, Mus musculus
ttcatttactaagggctacagagcc

SEQ ID NO: 390298 - DNA, 25 bp, Mus musculus
ttcatttactgatgggagtcacagc

SEQ ID NO: 390299 - DNA, 25 bp, Mus musculus
ttcatttactttgtggcctttttgg

SEQ ID NO: 390300 - DNA, 25 bp, Mus musculus
ttcatttcaagatgtgcccttccca

SEQ ID NO: 390301 - DNA, 25 bp, Mus musculus
ttcatttcaggccatcagctccaga

SEQ ID NO: 390302 - DNA, 25 bp, Mus musculus
ttcatttcaggctcctgtggctgtc

SEQ ID NO: 390303 - DNA, 25 bp, Mus musculus
ttcatttcagttgcctctctgcatt

SEQ ID NO: 390304 - DNA, 25 bp, Mus musculus
ttcatttcctgcttcaacagactcc

SEQ ID NO: 390305 - DNA, 25 bp, Mus musculus
ttcatttcctgtcctaataaaaggt

SEQ ID NO: 390306 - DNA, 25 bp, Mus musculus
ttcatttcggctcagactcgcatgt

SEQ ID NO: 390307 - DNA, 25 bp, Mus musculus
ttcatttcggctcagggaagtgact

SEQ ID NO: 390308 - DNA, 25 bp, Mus musculus
ttcatttctcatctcccagcaggcc

SEQ ID NO: 390309 - DNA, 25 bp, Mus musculus
ttcatttgagggggtcaggacaaag

SEQ ID NO: 390310 - DNA, 25 bp, Mus musculus
ttcatttgtatgtataggctgttat

SEQ ID NO: 390311 - DNA, 25 bp, Mus musculus
ttcatttgtgaagcctccaggcatc

SEQ ID NO: 390312 - DNA, 25 bp, Mus musculus
ttcatttgtgaagctggaagccgaa

SEQ ID NO: 390313 - DNA, 25 bp, Mus musculus
ttcatttgtgtaattttgtgccatc

SEQ ID NO: 390314 - DNA, 25 bp, Mus musculus
ttcattttcaaaagaaacagcaaca

SEQ ID NO: 390315 - DNA, 25 bp, Mus musculus
ttcattttgaaacacgagaagccct

SEQ ID NO: 390316 - DNA, 25 bp, Mus musculus
ttccaaaacactgtaacatggcaca

SEQ ID NO: 390317 - DNA, 25 bp, Mus musculus
ttccaaaaggagactttctgcactg

SEQ ID NO: 390318 - DNA, 25 bp, Mus musculus
ttccaaaatgataaactttataatc

SEQ ID NO: 390319 - DNA, 25 bp, Mus musculus
ttccaaaatgccattctagttcgct

SEQ ID NO: 390320 - DNA, 25 bp, Mus musculus
ttccaaaatggccatgtcagggatg

SEQ ID NO: 390321 - DNA, 25 bp, Mus musculus
ttccaaacacagccagccaatgcca

SEQ ID NO: 390322 - DNA, 25 bp, Mus musculus
ttccaaacacagcccacctgcatct

SEQ ID NO: 390323 - DNA, 25 bp, Mus musculus
ttccaaacacagccccagccagcca

SEQ ID NO: 390324 - DNA, 25 bp, Mus musculus
ttccaaacctagagagagaaataca

SEQ ID NO: 390325 - DNA, 25 bp, Mus musculus
ttccaaacgctataggtatgtgtat

SEQ ID NO: 390326 - DNA, 25 bp, Mus musculus
ttccaaagatactggcattgcccga

SEQ ID NO: 390327 - DNA, 25 bp, Mus musculus
ttccaaagcagatcctggagtaagc

SEQ ID NO: 390328 - DNA, 25 bp, Mus musculus
ttccaaagtaccaatacacgagacc

SEQ ID NO: 390329 - DNA, 25 bp, Mus musculus
ttccaaagtgggatccggcactggg

SEQ ID NO: 390330 - DNA, 25 bp, Mus musculus
ttccaaatgtgacgagaagaacggg

SEQ ID NO: 390331 - DNA, 25 bp, Mus musculus
ttccaacaacatcaaagaaaaattc

SEQ ID NO: 390332 - DNA, 25 bp, Mus musculus
ttccaacaacatcatgaacaacgtg

SEQ ID NO: 390333 - DNA, 25 bp, Mus musculus
ttccaacaacctagctcccgatggt

SEQ ID NO: 390334 - DNA, 25 bp, Mus musculus
ttccaacaagacgatccacgcagag

SEQ ID NO: 390335 - DNA, 25 bp, Mus musculus
ttccaacaagaggaaaaagctatgt

SEQ ID NO: 390336 - DNA, 25 bp, Mus musculus
ttccaacagccgcgcacactggagc

SEQ ID NO: 390337 - DNA, 25 bp, Mus musculus
ttccaacagtccaaaccatagacag

SEQ ID NO: 390338 - DNA, 25 bp, Mus musculus
ttccaacatcaaagccattggtgtc

SEQ ID NO: 390339 - DNA, 25 bp, Mus musculus
ttccaacatctgagcagctcaaaga

SEQ ID NO: 390340 - DNA, 25 bp, Mus musculus
ttccaaccacaagcgactcgtcctc

SEQ ID NO: 390341 - DNA, 25 bp, Mus musculus
ttccaaccacaagcgagcctagaag

SEQ ID NO: 390342 - DNA, 25 bp, Mus musculus
ttccaaccacaagcgagttcacatg

SEQ ID NO: 390343 - DNA, 25 bp, Mus musculus
ttccaaccacggctcactccagcag

SEQ ID NO: 390344 - DNA, 25 bp, Mus musculus
ttccaaccagacctgccccaggatc

SEQ ID NO: 390345 - DNA, 25 bp, Mus musculus
ttccaaccagctggctgaagccatc

SEQ ID NO: 390346 - DNA, 25 bp, Mus musculus
ttccaacccaagctcttttgtgact

SEQ ID NO: 390347 - DNA, 25 bp, Mus musculus
ttccaaccccgatgctctgaaccca

SEQ ID NO: 390348 - DNA, 25 bp, Mus musculus
ttccaacctacaagggcaagatgaa

SEQ ID NO: 390349 - DNA, 25 bp, Mus musculus
ttccaactcaggctgcttctgatgc

SEQ ID NO: 390350 - DNA, 25 bp, Mus musculus
ttccaactggggcacttccccactc

SEQ ID NO: 390351 - DNA, 25 bp, Mus musculus
ttccaactgtctaaattgatcaggg

SEQ ID NO: 390352 - DNA, 25 bp, Mus musculus
ttccaagaaaggtgcttacagacac

SEQ ID NO: 390353 - DNA, 25 bp, Mus musculus
ttccaagaacactgatgaaatcatg

SEQ ID NO: 390354 - DNA, 25 bp, Mus musculus
ttccaagagaagagcgcctccctgc

SEQ ID NO: 390355 - DNA, 25 bp, Mus musculus
ttccaagagaagagtgcttccctgc

SEQ ID NO: 390356 - DNA, 25 bp, Mus musculus
ttccaagagaagagtgcttcgctgc

SEQ ID NO: 390357 - DNA, 25 bp, Mus musculus
ttccaagagaggaggctgtgaaaga

SEQ ID NO: 390358 - DNA, 25 bp, Mus musculus
ttccaagagcaggtcaccgacaatg

SEQ ID NO: 390359 - DNA, 25 bp, Mus musculus
ttccaagaggcaacaactgtatgtg

SEQ ID NO: 390360 - DNA, 25 bp, Mus musculus
ttccaagatgtaccttgaaaccatg

SEQ ID NO: 390361 - DNA, 25 bp, Mus musculus
ttccaagcaatgtggtacacggatg

SEQ ID NO: 390362 - DNA, 25 bp, Mus musculus
ttccaagcaattttcaacatggatt

SEQ ID NO: 390363 - DNA, 25 bp, Mus musculus
ttccaagcagcatgggtcggagccc

SEQ ID NO: 390364 - DNA, 25 bp, Mus musculus
ttccaagcagggaccaggataatgc

SEQ ID NO: 390365 - DNA, 25 bp, Mus musculus
ttccaagcagttactgctgaccttt

SEQ ID NO: 390366 - DNA, 25 bp, Mus musculus
ttccaagcctgaggactgggacaag

SEQ ID NO: 390367 - DNA, 25 bp, Mus musculus
ttccaagcctgaggactgggatgaa

SEQ ID NO: 390368 - DNA, 25 bp, Mus musculus
ttccaagctgttgagcaagcaccag

SEQ ID NO: 390369 - DNA, 25 bp, Mus musculus
ttccaaggagattgccctctatgag

SEQ ID NO: 390370 - DNA, 25 bp, Mus musculus
ttccaaggagccagaaatcatagtc

SEQ ID NO: 390371 - DNA, 25 bp, Mus musculus
ttccaaggatgagtgggtggaagag

SEQ ID NO: 390372 - DNA, 25 bp, Mus musculus
ttccaaggttaccagagctgaaatt

SEQ ID NO: 390373 - DNA, 25 bp, Mus musculus
ttccaaggttaccagtatgcaaccg

SEQ ID NO: 390374 - DNA, 25 bp, Mus musculus
ttccaaggttaccagtgtttgaaag

SEQ ID NO: 390375 - DNA, 25 bp, Mus musculus
ttccaagtacattcacttcttccct

SEQ ID NO: 390376 - DNA, 25 bp, Mus musculus
ttccaagtctgagtgtggataagtc

SEQ ID NO: 390377 - DNA, 25 bp, Mus musculus
ttccaagtttggaagataccaacat

SEQ ID NO: 390378 - DNA, 25 bp, Mus musculus
ttccaatacaagcacaggggagtat

SEQ ID NO: 390379 - DNA, 25 bp, Mus musculus
ttccaatatggctttatcctcttgt

SEQ ID NO: 390380 - DNA, 25 bp, Mus musculus
ttccaatcattagcaatcgtggaac

SEQ ID NO: 390381 - DNA, 25 bp, Mus musculus
ttccaatcattagggagctgtccag

SEQ ID NO: 390382 - DNA, 25 bp, Mus musculus
ttccaatccagagacctcttttctg

SEQ ID NO: 390383 - DNA, 25 bp, Mus musculus
ttccaatccagcctgaggtctccaa

SEQ ID NO: 390384 - DNA, 25 bp, Mus musculus
ttccaatcccttgctgatctgaata

SEQ ID NO: 390385 - DNA, 25 bp, Mus musculus
ttccaatctatcagggcgtctaaga

SEQ ID NO: 390386 - DNA, 25 bp, Mus musculus
ttccaatctatcagggtgaaggcgg

SEQ ID NO: 390387 - DNA, 25 bp, Mus musculus
ttccaatgcagcctgtggcatctct

SEQ ID NO: 390388 - DNA, 25 bp, Mus musculus
ttccaatgctaatgccagtgactca

SEQ ID NO: 390389 - DNA, 25 bp, Mus musculus
ttccaatgtggaaaagaagaccaga

SEQ ID NO: 390390 - DNA, 25 bp, Mus musculus
ttccaattcctccaggtcatcgtca

SEQ ID NO: 390391 - DNA, 25 bp, Mus musculus
ttccacaaagagcgcctggccatcg

SEQ ID NO: 390392 - DNA, 25 bp, Mus musculus
ttccacaaagtcaaggctctacccc

SEQ ID NO: 390393 - DNA, 25 bp, Mus musculus
ttccacaacatctgggacaagctgg

SEQ ID NO: 390394 - DNA, 25 bp, Mus musculus
ttccacaagtacaacatcttgattg

SEQ ID NO: 390395 - DNA, 25 bp, Mus musculus
ttccacaatacgcgccccctgtaat

SEQ ID NO: 390396 - DNA, 25 bp, Mus musculus
ttccacaatcggtattaccagagca

SEQ ID NO: 390397 - DNA, 25 bp, Mus musculus
ttccacaatggtatcgggctagcca

SEQ ID NO: 390398 - DNA, 25 bp, Mus musculus
ttccacacacgccaccccaccttca

SEQ ID NO: 390399 - DNA, 25 bp, Mus musculus
ttccacacacggaggaggttggccc

SEQ ID NO: 390400 - DNA, 25 bp, Mus musculus
ttccacacagttgaaaagggcaggc

SEQ ID NO: 390401 - DNA, 25 bp, Mus musculus
ttccacacatatgacgttcagaaac

SEQ ID NO: 390402 - DNA, 25 bp, Mus musculus
ttccacacccaggttctgattggaa

SEQ ID NO: 390403 - DNA, 25 bp, Mus musculus
ttccacaccgacactgcaaatggat

SEQ ID NO: 390404 - DNA, 25 bp, Mus musculus
ttccacacctctctctcaggagtga

SEQ ID NO: 390405 - DNA, 25 bp, Mus musculus
ttccacactgaggtgcactggcacg

SEQ ID NO: 390406 - DNA, 25 bp, Mus musculus
ttccacagagcctttgatatggttc

SEQ ID NO: 390407 - DNA, 25 bp, Mus musculus
ttccacagagctctggagaccctcc

SEQ ID NO: 390408 - DNA, 25 bp, Mus musculus
ttccacagaggttctatggtacaga

SEQ ID NO: 390409 - DNA, 25 bp, Mus musculus
ttccacagcacggagctcgaagacg

SEQ ID NO: 390410 - DNA, 25 bp, Mus musculus
ttccacagccagatttgaccaagct

SEQ ID NO: 390411 - DNA, 25 bp, Mus musculus
ttccacagcccagaaaagaaaaagt

SEQ ID NO: 390412 - DNA, 25 bp, Mus musculus
ttccacagccggagagtcaaacaca

SEQ ID NO: 390413 - DNA, 25 bp, Mus musculus
ttccacagcctgtgctcattgccca

SEQ ID NO: 390414 - DNA, 25 bp, Mus musculus
ttccacaggagtggtcccgtaggcc

SEQ ID NO: 390415 - DNA, 25 bp, Mus musculus
ttccacaggcctgagtttcctgagc

SEQ ID NO: 390416 - DNA, 25 bp, Mus musculus
ttccacagtgatgctctagctagaa

SEQ ID NO: 390417 - DNA, 25 bp, Mus musculus
ttccacagtgttgctctagctagaa

SEQ ID NO: 390418 - DNA, 25 bp, Mus musculus
ttccacatagtgctggggatcgaac

SEQ ID NO: 390419 - DNA, 25 bp, Mus musculus
ttccacatagttcagcaatcagcaa

SEQ ID NO: 390420 - DNA, 25 bp, Mus musculus
ttccacattccccagcctctgcaga

SEQ ID NO: 390421 - DNA, 25 bp, Mus musculus
ttccacatttggagcccttacagag

SEQ ID NO: 390422 - DNA, 25 bp, Mus musculus
ttccaccaaggaggaatttcaacaa

SEQ ID NO: 390423 - DNA, 25 bp, Mus musculus
ttccaccaaggcctcctatctttct

SEQ ID NO: 390424 - DNA, 25 bp, Mus musculus
ttccaccaaggtatggtgtggaagc

SEQ ID NO: 390425 - DNA, 25 bp, Mus musculus
ttccaccaccaggtattccaataac

SEQ ID NO: 390426 - DNA, 25 bp, Mus musculus
ttccaccacctggatcgagaactcg

SEQ ID NO: 390427 - DNA, 25 bp, Mus musculus
ttccaccagcaggttcagcagctcc

SEQ ID NO: 390428 - DNA, 25 bp, Mus musculus
ttccaccaggcagcatctgaggacc

SEQ ID NO: 390429 - DNA, 25 bp, Mus musculus
ttccaccccaaacagtgtcaccccg

SEQ ID NO: 390430 - DNA, 25 bp, Mus musculus
ttccaccccacaggtatatacggtg

SEQ ID NO: 390431 - DNA, 25 bp, Mus musculus
ttccaccccagactctgcagaggac

SEQ ID NO: 390432 - DNA, 25 bp, Mus musculus
ttccaccccggccccagctggagcc

SEQ ID NO: 390433 - DNA, 25 bp, Mus musculus
ttccaccgaaggtttctctgtagcc

SEQ ID NO: 390434 - DNA, 25 bp, Mus musculus
ttccaccgacctgatcaagggatca

SEQ ID NO: 390435 - DNA, 25 bp, Mus musculus
ttccaccgcagtgtgaagaaaaagg

SEQ ID NO: 390436 - DNA, 25 bp, Mus musculus
ttccaccgcgccctgtctcactgct

SEQ ID NO: 390437 - DNA, 25 bp, Mus musculus
ttccaccgttgtggccagaaccccg

SEQ ID NO: 390438 - DNA, 25 bp, Mus musculus
ttccacctagggactgccgcttcgc

SEQ ID NO: 390439 - DNA, 25 bp, Mus musculus
ttccacctccacagcacaagagcaa

SEQ ID NO: 390440 - DNA, 25 bp, Mus musculus
ttccacctccttaaaaatataactg

SEQ ID NO: 390441 - DNA, 25 bp, Mus musculus
ttccacctgtcagacccgccaggag

SEQ ID NO: 390442 - DNA, 25 bp, Mus musculus
ttccacctgtgggtccttgctgcca

SEQ ID NO: 390443 - DNA, 25 bp, Mus musculus
ttccaccttcagcaacaacacttga

SEQ ID NO: 390444 - DNA, 25 bp, Mus musculus
ttccacgacagctccctcttgatgt

SEQ ID NO: 390445 - DNA, 25 bp, Mus musculus
ttccacgatggggtccgagtggcag

SEQ ID NO: 390446 - DNA, 25 bp, Mus musculus
ttccacgccacttgtcggcagctct

SEQ ID NO: 390447 - DNA, 25 bp, Mus musculus
ttccacgccccatggtgtggacatt

SEQ ID NO: 390448 - DNA, 25 bp, Mus musculus
ttccacgcctgattctggcaggtga

SEQ ID NO: 390449 - DNA, 25 bp, Mus musculus
ttccacgcttcaaggcgcaacctgg

SEQ ID NO: 390450 - DNA, 25 bp, Mus musculus
ttccacggaagagtaaagacatttc

SEQ ID NO: 390451 - DNA, 25 bp, Mus musculus
ttccacggaggttaatctataattt

SEQ ID NO: 390452 - DNA, 25 bp, Mus musculus
ttccacgtgcgtgcttcttgccacc

SEQ ID NO: 390453 - DNA, 25 bp, Mus musculus
ttccactaaagattcagagtcacca

SEQ ID NO: 390454 - DNA, 25 bp, Mus musculus
ttccactagggctattctcctgagc

SEQ ID NO: 390455 - DNA, 25 bp, Mus musculus
ttccactatagtgagttctctggtg

SEQ ID NO: 390456 - DNA, 25 bp, Mus musculus
ttccactatgatatcctcttgtttg

SEQ ID NO: 390457 - DNA, 25 bp, Mus musculus
ttccactcatcctccttgtgagcag

SEQ ID NO: 390458 - DNA, 25 bp, Mus musculus
ttccactccgacaagatgaaagaaa

SEQ ID NO: 390459 - DNA, 25 bp, Mus musculus
ttccactcctagctccaccccccgg

SEQ ID NO: 390460 - DNA, 25 bp, Mus musculus
ttccactccttccaggatcccctgc

SEQ ID NO: 390461 - DNA, 25 bp, Mus musculus
ttccactcgcacaccgagagaacaa

SEQ ID NO: 390462 - DNA, 25 bp, Mus musculus
ttccactctgaacttaacatctctg

SEQ ID NO: 390463 - DNA, 25 bp, Mus musculus
ttccactctggtcagacatggttgc

SEQ ID NO: 390464 - DNA, 25 bp, Mus musculus
ttccactcttgaagatgccgagatg

SEQ ID NO: 390465 - DNA, 25 bp, Mus musculus
ttccactcttgaaggatgcccacca

SEQ ID NO: 390466 - DNA, 25 bp, Mus musculus
ttccactgctctggctcgacttcgg

SEQ ID NO: 390467 - DNA, 25 bp, Mus musculus
ttccactgtagtcacagtaatgaaa

SEQ ID NO: 390468 - DNA, 25 bp, Mus musculus
ttccactgttccatgtctccaggaa

SEQ ID NO: 390469 - DNA, 25 bp, Mus musculus
ttccacttgactgggacgtggaaca

SEQ ID NO: 390470 - DNA, 25 bp, Mus musculus
ttccactttcaggaccatggtatct

SEQ ID NO: 390471 - DNA, 25 bp, Mus musculus
ttccagaaaaatgaaactgtgaagt

SEQ ID NO: 390472 - DNA, 25 bp, Mus musculus
ttccagaaagatggaaccgccctgt

SEQ ID NO: 390473 - DNA, 25 bp, Mus musculus
ttccagaaagcagaatgctggcaga

SEQ ID NO: 390474 - DNA, 25 bp, Mus musculus
ttccagaaagccaaagcggaggaag

SEQ ID NO: 390475 - DNA, 25 bp, Mus musculus
ttccagaaagccaagaacagagagt

SEQ ID NO: 390476 - DNA, 25 bp, Mus musculus
ttccagaaagtatgcagccctgctg

SEQ ID NO: 390477 - DNA, 25 bp, Mus musculus
ttccagaaagtatgcagccctttga

SEQ ID NO: 390478 - DNA, 25 bp, Mus musculus
ttccagaaagtgatcacagaatacc

SEQ ID NO: 390479 - DNA, 25 bp, Mus musculus
ttccagaaagtgtctatcgcagcga

SEQ ID NO: 390480 - DNA, 25 bp, Mus musculus
ttccagaaattccaggatgtctgtg

SEQ ID NO: 390481 - DNA, 25 bp, Mus musculus
ttccagaaattccaggattgctgtg

SEQ ID NO: 390482 - DNA, 25 bp, Mus musculus
ttccagaacaagattcttttcgtcc

SEQ ID NO: 390483 - DNA, 25 bp, Mus musculus
ttccagaacaagtttccatagaacc

SEQ ID NO: 390484 - DNA, 25 bp, Mus musculus
ttccagaacagggaaaggcaggagc

SEQ ID NO: 390485 - DNA, 25 bp, Mus musculus
ttccagaacttgccatcaatgcctt

SEQ ID NO: 390486 - DNA, 25 bp, Mus musculus
ttccagaagaagaaataaagtggag

SEQ ID NO: 390487 - DNA, 25 bp, Mus musculus
ttccagaagcaggtgtccccagaac

SEQ ID NO: 390488 - DNA, 25 bp, Mus musculus
ttccagaagccatgggactcgtggg

SEQ ID NO: 390489 - DNA, 25 bp, Mus musculus
ttccagaccaaagaagagagggaac

SEQ ID NO: 390490 - DNA, 25 bp, Mus musculus
ttccagaccacagggatcacccatc

SEQ ID NO: 390491 - DNA, 25 bp, Mus musculus
ttccagaccacaggtccctgtggaa

SEQ ID NO: 390492 - DNA, 25 bp, Mus musculus
ttccagaccagggacggaaactttc

SEQ ID NO: 390493 - DNA, 25 bp, Mus musculus
ttccagaccggtggcagacatggaa

SEQ ID NO: 390494 - DNA, 25 bp, Mus musculus
ttccagagaatcttataggatttaa

SEQ ID NO: 390495 - DNA, 25 bp, Mus musculus
ttccagagatgaagaccacatagcc

SEQ ID NO: 390496 - DNA, 25 bp, Mus musculus
ttccagagatgagatcacatagcat

SEQ ID NO: 390497 - DNA, 25 bp, Mus musculus
ttccagagcaatggcacggaatgct

SEQ ID NO: 390498 - DNA, 25 bp, Mus musculus
ttccagagcacccaggcttccactg

SEQ ID NO: 390499 - DNA, 25 bp, Mus musculus
ttccagagcatcacgaaatagatat

SEQ ID NO: 390500 - DNA, 25 bp, Mus musculus
ttccagagcatcacgccagtagaaa

SEQ ID NO: 390501 - DNA, 25 bp, Mus musculus
ttccagaggaagtagacaatcctcc

SEQ ID NO: 390502 - DNA, 25 bp, Mus musculus
ttccagaggagaggtggtgaaggca

SEQ ID NO: 390503 - DNA, 25 bp, Mus musculus
ttccagaggaggtactacaagcctg

SEQ ID NO: 390504 - DNA, 25 bp, Mus musculus
ttccagaggcggccagcaggtggcc

SEQ ID NO: 390505 - DNA, 25 bp, Mus musculus
ttccagataactgcctttgtacctc

SEQ ID NO: 390506 - DNA, 25 bp, Mus musculus
ttccagatacattgacatcagcaaa

SEQ ID NO: 390507 - DNA, 25 bp, Mus musculus
ttccagatacgtcttccaagttgct

SEQ ID NO: 390508 - DNA, 25 bp, Mus musculus
ttccagattcttggataaggaattg

SEQ ID NO: 390509 - DNA, 25 bp, Mus musculus
ttccagattggtgccattcagtcat

SEQ ID NO: 390510 - DNA, 25 bp, Mus musculus
ttccagatttgcaagacagttcggc

SEQ ID NO: 390511 - DNA, 25 bp, Mus musculus
ttccagatttgcaagggagttgatt

SEQ ID NO: 390512 - DNA, 25 bp, Mus musculus
ttccagcaaagaattgggatatgac

SEQ ID NO: 390513 - DNA, 25 bp, Mus musculus
ttccagcaaaggtttagaccctctg

SEQ ID NO: 390514 - DNA, 25 bp, Mus musculus
ttccagcaaccagaatttcagcttc

SEQ ID NO: 390515 - DNA, 25 bp, Mus musculus
ttccagcaaccagcacccggcagtg

SEQ ID NO: 390516 - DNA, 25 bp, Mus musculus
ttccagcaacttgaggctcctgagc

SEQ ID NO: 390517 - DNA, 25 bp, Mus musculus
ttccagcaagcttgagtctactgaa

SEQ ID NO: 390518 - DNA, 25 bp, Mus musculus
ttccagcaagtaccaggaatgtgaa

SEQ ID NO: 390519 - DNA, 25 bp, Mus musculus
ttccagcaagtggaacacatttcca

SEQ ID NO: 390520 - DNA, 25 bp, Mus musculus
ttccagcaagttctggatgatttaa

SEQ ID NO: 390521 - DNA, 25 bp, Mus musculus
ttccagcacagtcggagccagggag

SEQ ID NO: 390522 - DNA, 25 bp, Mus musculus
ttccagcacctacgtttgttgaagg

SEQ ID NO: 390523 - DNA, 25 bp, Mus musculus
ttccagcacgtgaggacaagttttt

SEQ ID NO: 390524 - DNA, 25 bp, Mus musculus
ttccagcagaagtacgatggaatca

SEQ ID NO: 390525 - DNA, 25 bp, Mus musculus
ttccagcagaccgacttgtctcagg

SEQ ID NO: 390526 - DNA, 25 bp, Mus musculus
ttccagcagtcaggctgggacaacg

SEQ ID NO: 390527 - DNA, 25 bp, Mus musculus
ttccagcagtctaaggtgtctgaac

SEQ ID NO: 390528 - DNA, 25 bp, Mus musculus
ttccagcatcgatttgactttattg

SEQ ID NO: 390529 - DNA, 25 bp, Mus musculus
ttccagccagaccagcggagtcgga

SEQ ID NO: 390530 - DNA, 25 bp, Mus musculus
ttccagccagcccaggtgcatacac

SEQ ID NO: 390531 - DNA, 25 bp, Mus musculus
ttccagccagcccaggttttacttg

SEQ ID NO: 390532 - DNA, 25 bp, Mus musculus
ttccagcccaggtgctggggcccgc

SEQ ID NO: 390533 - DNA, 25 bp, Mus musculus
ttccagccctgagatgctcacgtag

SEQ ID NO: 390534 - DNA, 25 bp, Mus musculus
ttccagccgtcctcaaagcctatga

SEQ ID NO: 390535 - DNA, 25 bp, Mus musculus
ttccagccttcaccgtatggtgtgg

SEQ ID NO: 390536 - DNA, 25 bp, Mus musculus
ttccagcgatcgcaggattgaaatt

SEQ ID NO: 390537 - DNA, 25 bp, Mus musculus
ttccagctaagcaggtctgaagaaa

SEQ ID NO: 390538 - DNA, 25 bp, Mus musculus
ttccagctcgagcaggacttccaat

SEQ ID NO: 390539 - DNA, 25 bp, Mus musculus
ttccagctcgagcaggttaggagaa

SEQ ID NO: 390540 - DNA, 25 bp, Mus musculus
ttccagctggagggagagcgtgagc

SEQ ID NO: 390541 - DNA, 25 bp, Mus musculus
ttccagcttgtgaggttcttgtttc

SEQ ID NO: 390542 - DNA, 25 bp, Mus musculus
ttccagctttgagatggctatgaac

SEQ ID NO: 390543 - DNA, 25 bp, Mus musculus
ttccaggaaacagaaagctggtcca

SEQ ID NO: 390544 - DNA, 25 bp, Mus musculus
ttccaggaaacaggaaggagtcttc

SEQ ID NO: 390545 - DNA, 25 bp, Mus musculus
ttccaggaaacatggaaataagcag

SEQ ID NO: 390546 - DNA, 25 bp, Mus musculus
ttccaggaagaggcggtgacagagg

SEQ ID NO: 390547 - DNA, 25 bp, Mus musculus
ttccaggaagggactatattgatca

SEQ ID NO: 390548 - DNA, 25 bp, Mus musculus
ttccaggacagatggcgctgccagt

SEQ ID NO: 390549 - DNA, 25 bp, Mus musculus
ttccaggaccacgatgtccctggta

SEQ ID NO: 390550 - DNA, 25 bp, Mus musculus
ttccaggagaatgccaggaggtcat

SEQ ID NO: 390551 - DNA, 25 bp, Mus musculus
ttccaggaggaagaagactcagaaa

SEQ ID NO: 390552 - DNA, 25 bp, Mus musculus
ttccaggaggacagcgagacggtca

SEQ ID NO: 390553 - DNA, 25 bp, Mus musculus
ttccaggcaactaggaggctggatt

SEQ ID NO: 390554 - DNA, 25 bp, Mus musculus
ttccaggcaactagggtttcaactc

SEQ ID NO: 390555 - DNA, 25 bp, Mus musculus
ttccaggcagatacaacagcacaac

SEQ ID NO: 390556 - DNA, 25 bp, Mus musculus
ttccaggcagtgctgaaaaccaagc

SEQ ID NO: 390557 - DNA, 25 bp, Mus musculus
ttccaggcattgtggactctagaaa

SEQ ID NO: 390558 - DNA, 25 bp, Mus musculus
ttccaggcattgtggattatcagac

SEQ ID NO: 390559 - DNA, 25 bp, Mus musculus
ttccaggcggggtacatggcttctt

SEQ ID NO: 390560 - DNA, 25 bp, Mus musculus
ttccaggcggggttaaactcacttt

SEQ ID NO: 390561 - DNA, 25 bp, Mus musculus
ttccaggctacaggagatcgctctg

SEQ ID NO: 390562 - DNA, 25 bp, Mus musculus
ttccagggacctgagggtacagtcc

SEQ ID NO: 390563 - DNA, 25 bp, Mus musculus
ttccagggagattccagacttctgc

SEQ ID NO: 390564 - DNA, 25 bp, Mus musculus
ttccagggagggtcccacctcctgg

SEQ ID NO: 390565 - DNA, 25 bp, Mus musculus
ttccagggattcatgctgtattttc

SEQ ID NO: 390566 - DNA, 25 bp, Mus musculus
ttccaggggatccaggaccagatgt

SEQ ID NO: 390567 - DNA, 25 bp, Mus musculus
ttccaggtatggtatgaaaccaaag

SEQ ID NO: 390568 - DNA, 25 bp, Mus musculus
ttccaggtcagtgcttcgcaagatg

SEQ ID NO: 390569 - DNA, 25 bp, Mus musculus
ttccaggtctgagagcccaacatgc

SEQ ID NO: 390570 - DNA, 25 bp, Mus musculus
ttccaggtgcagagggcagctgaga

SEQ ID NO: 390571 - DNA, 25 bp, Mus musculus
ttccaggtgcagctggtgatcaagg

SEQ ID NO: 390572 - DNA, 25 bp, Mus musculus
ttccaggtggacattgaggcactgc

SEQ ID NO: 390573 - DNA, 25 bp, Mus musculus
ttccaggttcaggtgttggcagccg

SEQ ID NO: 390574 - DNA, 25 bp, Mus musculus
ttccagtacaggaaattaaaatgca

SEQ ID NO: 390575 - DNA, 25 bp, Mus musculus
ttccagtacaggtcagaggaacgcc

SEQ ID NO: 390576 - DNA, 25 bp, Mus musculus
ttccagtacattacgatgagactga

SEQ ID NO: 390577 - DNA, 25 bp, Mus musculus
ttccagtacattacggctgagcggg

SEQ ID NO: 390578 - DNA, 25 bp, Mus musculus
ttccagtaccaagacaaagcctatt

SEQ ID NO: 390579 - DNA, 25 bp, Mus musculus
ttccagtactttgtgacaggtgtgt

SEQ ID NO: 390580 - DNA, 25 bp, Mus musculus
ttccagtagtactacatgccaaatc

SEQ ID NO: 390581 - DNA, 25 bp, Mus musculus
ttccagtagtactagatgccaaatc

SEQ ID NO: 390582 - DNA, 25 bp, Mus musculus
ttccagtatcggtaactgtgaatgc

SEQ ID NO: 390583 - DNA, 25 bp, Mus musculus
ttccagtatcggtaagtgttattgt

SEQ ID NO: 390584 - DNA, 25 bp, Mus musculus
ttccagtatcggtactaatgtctgc

SEQ ID NO: 390585 - DNA, 25 bp, Mus musculus
ttccagtatcggtactcctccaaag

SEQ ID NO: 390586 - DNA, 25 bp, Mus musculus
ttccagtcctttgagattgagcgtc

SEQ ID NO: 390587 - DNA, 25 bp, Mus musculus
ttccagtcttggcagagttttgcct

SEQ ID NO: 390588 - DNA, 25 bp, Mus musculus
ttccagtgaattcttggacctgagt

SEQ ID NO: 390589 - DNA, 25 bp, Mus musculus
ttccagtgagcttgcttcccagagc

SEQ ID NO: 390590 - DNA, 25 bp, Mus musculus
ttccagtgaggagaaggacctcacc

SEQ ID NO: 390591 - DNA, 25 bp, Mus musculus
ttccagtgcaccagcagaacagttt

SEQ ID NO: 390592 - DNA, 25 bp, Mus musculus
ttccagtgcaggcctaaccctgtcc

SEQ ID NO: 390593 - DNA, 25 bp, Mus musculus
ttccagtgcagggaaaagctgtgtt

SEQ ID NO: 390594 - DNA, 25 bp, Mus musculus
ttccagtgccagtttcctagattgg

SEQ ID NO: 390595 - DNA, 25 bp, Mus musculus
ttccagtgtcctggcagcccaaacg

SEQ ID NO: 390596 - DNA, 25 bp, Mus musculus
ttccagttaaaaaatcttgcccagt

SEQ ID NO: 390597 - DNA, 25 bp, Mus musculus
ttccagttaaacctgctgatcttaa

SEQ ID NO: 390598 - DNA, 25 bp, Mus musculus
ttccagttactctacatcccctcct

SEQ ID NO: 390599 - DNA, 25 bp, Mus musculus
ttccagttactctacttcatctact

SEQ ID NO: 390600 - DNA, 25 bp, Mus musculus
ttccagttcagcagcctgcagcagg

SEQ ID NO: 390601 - DNA, 25 bp, Mus musculus
ttccagttcagcagggcacctacgc

SEQ ID NO: 390602 - DNA, 25 bp, Mus musculus
ttccagttcggagaggctctgtctg

SEQ ID NO: 390603 - DNA, 25 bp, Mus musculus
ttccagttcggagaggtggttctgg

SEQ ID NO: 390604 - DNA, 25 bp, Mus musculus
ttccagttgcagattgaacttcatg

SEQ ID NO: 390605 - DNA, 25 bp, Mus musculus
ttccagttgcagcaggtactctgaa

SEQ ID NO: 390606 - DNA, 25 bp, Mus musculus
ttccagttgcaggtacaacataaga

SEQ ID NO: 390607 - DNA, 25 bp, Mus musculus
ttccagtttaacaagacagtggagc

SEQ ID NO: 390608 - DNA, 25 bp, Mus musculus
ttccagtttgctaagaactttgttg

SEQ ID NO: 390609 - DNA, 25 bp, Mus musculus
ttccagtttggagagtgtgacttgc

SEQ ID NO: 390610 - DNA, 25 bp, Mus musculus
ttccagtttggagggtttctctgtg

SEQ ID NO: 390611 - DNA, 25 bp, Mus musculus
ttccataaagggcaagaaaaagtca

SEQ ID NO: 390612 - DNA, 25 bp, Mus musculus
ttccataaaggggcagtaaatggct

SEQ ID NO: 390613 - DNA, 25 bp, Mus musculus
ttccataagaacgggagaggctcca

SEQ ID NO: 390614 - DNA, 25 bp, Mus musculus
ttccataagtttggatgatttacct

SEQ ID NO: 390615 - DNA, 25 bp, Mus musculus
ttccataatgcagggcacaccaaga

SEQ ID NO: 390616 - DNA, 25 bp, Mus musculus
ttccataattgtgtggattctttaa

SEQ ID NO: 390617 - DNA, 25 bp, Mus musculus
ttccatacacaggctcatcagcagg

SEQ ID NO: 390618 - DNA, 25 bp, Mus musculus
ttccatagacctcatcttcagtccc

SEQ ID NO: 390619 - DNA, 25 bp, Mus musculus
ttccatagacctcatggcctctaca

SEQ ID NO: 390620 - DNA, 25 bp, Mus musculus
ttccatagacctcattgggcaagag

SEQ ID NO: 390621 - DNA, 25 bp, Mus musculus
ttccatagtcacaggacgtccagca

SEQ ID NO: 390622 - DNA, 25 bp, Mus musculus
ttccatagtctgagtgacagcccat

SEQ ID NO: 390623 - DNA, 25 bp, Mus musculus
ttccatatcagctggaaggacgggc

SEQ ID NO: 390624 - DNA, 25 bp, Mus musculus
ttccatatcctcagattcagaaaaa

SEQ ID NO: 390625 - DNA, 25 bp, Mus musculus
ttccatatcctcagcctctccagct

SEQ ID NO: 390626 - DNA, 25 bp, Mus musculus
ttccatatgaatatcaagatggatg

SEQ ID NO: 390627 - DNA, 25 bp, Mus musculus
ttccatatgaccaaaggctactata

SEQ ID NO: 390628 - DNA, 25 bp, Mus musculus
ttccatattattataaatgaggagt

SEQ ID NO: 390629 - DNA, 25 bp, Mus musculus
ttccatcaagatcagagacaccagt

SEQ ID NO: 390630 - DNA, 25 bp, Mus musculus
ttccatcaagggaagaaggatgcag

SEQ ID NO: 390631 - DNA, 25 bp, Mus musculus
ttccatcaccagcatccatgtctta

SEQ ID NO: 390632 - DNA, 25 bp, Mus musculus
ttccatcaccaggtgcgtgatgaca

SEQ ID NO: 390633 - DNA, 25 bp, Mus musculus
ttccatcacccagggcaccccactc

SEQ ID NO: 390634 - DNA, 25 bp, Mus musculus
ttccatcactcagctggagcaattc

SEQ ID NO: 390635 - DNA, 25 bp, Mus musculus
ttccatcactcagggcgttcccttg

SEQ ID NO: 390636 - DNA, 25 bp, Mus musculus
ttccatcatagccaagttcctgtac

SEQ ID NO: 390637 - DNA, 25 bp, Mus musculus
ttccatcatgaggaaatttgccccg

SEQ ID NO: 390638 - DNA, 25 bp, Mus musculus
ttccatcccaaagaaccatggatcg

SEQ ID NO: 390639 - DNA, 25 bp, Mus musculus
ttccatccgagattgagcttgaagc

SEQ ID NO: 390640 - DNA, 25 bp, Mus musculus
ttccatccgagcctgacctgatgga

SEQ ID NO: 390641 - DNA, 25 bp, Mus musculus
ttccatccgagtggcagcaagttgg

SEQ ID NO: 390642 - DNA, 25 bp, Mus musculus
ttccatccggatagacaagcgtgag

SEQ ID NO: 390643 - DNA, 25 bp, Mus musculus
ttccatcctatatagtctacatggg

SEQ ID NO: 390644 - DNA, 25 bp, Mus musculus
ttccatcctgagcggctctctgtgg

SEQ ID NO: 390645 - DNA, 25 bp, Mus musculus
ttccatcctttgcatgtgtctaagg

SEQ ID NO: 390646 - DNA, 25 bp, Mus musculus
ttccatcggcttggtttggttccag

SEQ ID NO: 390647 - DNA, 25 bp, Mus musculus
ttccatcgtgatcggcaagaagcca

SEQ ID NO: 390648 - DNA, 25 bp, Mus musculus
ttccatcgtgatcggtgagaaggac

SEQ ID NO: 390649 - DNA, 25 bp, Mus musculus
ttccatctacaggcctgtccactgg

SEQ ID NO: 390650 - DNA, 25 bp, Mus musculus
ttccatctgctcccagaattacctc

SEQ ID NO: 390651 - DNA, 25 bp, Mus musculus
ttccatcttcaagccttctgtggat

SEQ ID NO: 390652 - DNA, 25 bp, Mus musculus
ttccatgaaagagacaggtgttgac

SEQ ID NO: 390653 - DNA, 25 bp, Mus musculus
ttccatgaaatgagtttctctaata

SEQ ID NO: 390654 - DNA, 25 bp, Mus musculus
ttccatgaaggcattgtcgccagca

SEQ ID NO: 390655 - DNA, 25 bp, Mus musculus
ttccatgaaggcctgcgggccctcg

SEQ ID NO: 390656 - DNA, 25 bp, Mus musculus
ttccatgaaggcgagcctgtcagcg

SEQ ID NO: 390657 - DNA, 25 bp, Mus musculus
ttccatgacctcgaaaacgggctgt

SEQ ID NO: 390658 - DNA, 25 bp, Mus musculus
ttccatgccggcaaagtgcaaacag

SEQ ID NO: 390659 - DNA, 25 bp, Mus musculus
ttccatgccgggttgcttcctagaa

SEQ ID NO: 390660 - DNA, 25 bp, Mus musculus
ttccatggcaccaggattttaattc

SEQ ID NO: 390661 - DNA, 25 bp, Mus musculus
ttccatggctcagcaagcttccctg

SEQ ID NO: 390662 - DNA, 25 bp, Mus musculus
ttccatgtcatcatatgatttttgg

SEQ ID NO: 390663 - DNA, 25 bp, Mus musculus
ttccatgtcatcattatcacttatg

SEQ ID NO: 390664 - DNA, 25 bp, Mus musculus
ttccatgtccagcaccaaagaaggc

SEQ ID NO: 390665 - DNA, 25 bp, Mus musculus
ttccatgtccaggttttcccatcat

SEQ ID NO: 390666 - DNA, 25 bp, Mus musculus
ttccatgtctttaagaattctgtct

SEQ ID NO: 390667 - DNA, 25 bp, Mus musculus
ttccatgtctttaaggtgtttgtgg

SEQ ID NO: 390668 - DNA, 25 bp, Mus musculus
ttccatgtggatgctgcctggggtg

SEQ ID NO: 390669 - DNA, 25 bp, Mus musculus
ttccatgtggatggctgactctgtg

SEQ ID NO: 390670 - DNA, 25 bp, Mus musculus
ttccattacaagaccgaccagggca

SEQ ID NO: 390671 - DNA, 25 bp, Mus musculus
ttccattctacacagctcacatgag

SEQ ID NO: 390672 - DNA, 25 bp, Mus musculus
ttccattcttagaaaacgcctcctt

SEQ ID NO: 390673 - DNA, 25 bp, Mus musculus
ttccattctttgtggtcgctacact

SEQ ID NO: 390674 - DNA, 25 bp, Mus musculus
ttccattcttttgttggggatggaa

SEQ ID NO: 390675 - DNA, 25 bp, Mus musculus
ttccattgaaagaggcttcatcact

SEQ ID NO: 390676 - DNA, 25 bp, Mus musculus
ttccattgactaggccagggtcaca

SEQ ID NO: 390677 - DNA, 25 bp, Mus musculus
ttccattgagttcctccgcaacaaa

SEQ ID NO: 390678 - DNA, 25 bp, Mus musculus
ttccattgctggggggaaaggctca

SEQ ID NO: 390679 - DNA, 25 bp, Mus musculus
ttccatttaacgttctgatgaacaa

SEQ ID NO: 390680 - DNA, 25 bp, Mus musculus
ttccatttaattgtaaatgaagagt

SEQ ID NO: 390681 - DNA, 25 bp, Mus musculus
ttccatttcaaggtctcaaaagatt

SEQ ID NO: 390682 - DNA, 25 bp, Mus musculus
ttccatttcactccgcagatgaccc

SEQ ID NO: 390683 - DNA, 25 bp, Mus musculus
ttccatttccactctgcttccctgt

SEQ ID NO: 390684 - DNA, 25 bp, Mus musculus
ttccatttcccagggcacaccaata

SEQ ID NO: 390685 - DNA, 25 bp, Mus musculus
ttccatttctgaaagattagaacac

SEQ ID NO: 390686 - DNA, 25 bp, Mus musculus
ttccatttctgaaaggccagtgaat

SEQ ID NO: 390687 - DNA, 25 bp, Mus musculus
ttcccaaaaatgtatccatcgagat

SEQ ID NO: 390688 - DNA, 25 bp, Mus musculus
ttcccaaaacagaataaatggagag

SEQ ID NO: 390689 - DNA, 25 bp, Mus musculus
ttcccaaaacagtatctttcagaat

SEQ ID NO: 390690 - DNA, 25 bp, Mus musculus
ttcccaaacaggtgcagttaaaaac

SEQ ID NO: 390691 - DNA, 25 bp, Mus musculus
ttcccaaaccaaaagttgatgtagg

SEQ ID NO: 390692 - DNA, 25 bp, Mus musculus
ttcccaaactatgtcggacggccaa

SEQ ID NO: 390693 - DNA, 25 bp, Mus musculus
ttcccaaagagatgcacgggaataa

SEQ ID NO: 390694 - DNA, 25 bp, Mus musculus
ttcccaaatggatgacaagtgggaa

SEQ ID NO: 390695 - DNA, 25 bp, Mus musculus
ttcccaaatggattttctctatatg

SEQ ID NO: 390696 - DNA, 25 bp, Mus musculus
ttcccaacaagacgatgatgatgac

SEQ ID NO: 390697 - DNA, 25 bp, Mus musculus
ttcccaacagagcaagtgacaaatg

SEQ ID NO: 390698 - DNA, 25 bp, Mus musculus
ttcccaacagagcaatctctggcaa

SEQ ID NO: 390699 - DNA, 25 bp, Mus musculus
ttcccaacctcagacgacaatttcc

SEQ ID NO: 390700 - DNA, 25 bp, Mus musculus
ttcccaacggggttaagcctgatca

SEQ ID NO: 390701 - DNA, 25 bp, Mus musculus
ttcccaagagaaggatgggtagaac

SEQ ID NO: 390702 - DNA, 25 bp, Mus musculus
ttcccaagcagcagcaggctgtggc

SEQ ID NO: 390703 - DNA, 25 bp, Mus musculus
ttcccaagcttcctgatgctccatt

SEQ ID NO: 390704 - DNA, 25 bp, Mus musculus
ttcccaaggaccattctggatgcag

SEQ ID NO: 390705 - DNA, 25 bp, Mus musculus
ttcccaaggacttgtactggtttcc

SEQ ID NO: 390706 - DNA, 25 bp, Mus musculus
ttcccaagtcggatgtggaaatgga

SEQ ID NO: 390707 - DNA, 25 bp, Mus musculus
ttcccaagtcggttaacagtgatgt

SEQ ID NO: 390708 - DNA, 25 bp, Mus musculus
ttcccaataaaagataattggttaa

SEQ ID NO: 390709 - DNA, 25 bp, Mus musculus
ttcccaataaaaggctcccgtccac

SEQ ID NO: 390710 - DNA, 25 bp, Mus musculus
ttcccaatcctcaaccagttctgta

SEQ ID NO: 390711 - DNA, 25 bp, Mus musculus
ttcccaatcctcgagccctgacata

SEQ ID NO: 390712 - DNA, 25 bp, Mus musculus
ttcccaatgatctgattggctgtgt

SEQ ID NO: 390713 - DNA, 25 bp, Mus musculus
ttcccaatgatggcagcaagatcag

SEQ ID NO: 390714 - DNA, 25 bp, Mus musculus
ttcccaatggtgatgatggtgaatg

SEQ ID NO: 390715 - DNA, 25 bp, Mus musculus
ttcccaattcaggaagcacagacca

SEQ ID NO: 390716 - DNA, 25 bp, Mus musculus
ttcccacagaacacggaatgacaag

SEQ ID NO: 390717 - DNA, 25 bp, Mus musculus
ttcccacagaacacgtgaaagcaga

SEQ ID NO: 390718 - DNA, 25 bp, Mus musculus
ttcccacagaggttgaaatgggcat

SEQ ID NO: 390719 - DNA, 25 bp, Mus musculus
ttcccacagatgaagtgtcctatac

SEQ ID NO: 390720 - DNA, 25 bp, Mus musculus
ttcccacagatggaacagattctgg

SEQ ID NO: 390721 - DNA, 25 bp, Mus musculus
ttcccacagcatccgaacttttgtg

SEQ ID NO: 390722 - DNA, 25 bp, Mus musculus
ttcccaccaacaaggcctgtttcga

SEQ ID NO: 390723 - DNA, 25 bp, Mus musculus
ttcccaccaagcccacaaggcccga

SEQ ID NO: 390724 - DNA, 25 bp, Mus musculus
ttcccacccaggaatccaaacgctt

SEQ ID NO: 390725 - DNA, 25 bp, Mus musculus
ttcccacccagtgatgactacgatg

SEQ ID NO: 390726 - DNA, 25 bp, Mus musculus
ttcccaccttcaaaactggtgaaca

SEQ ID NO: 390727 - DNA, 25 bp, Mus musculus
ttcccacgctccaggagaggcggga

SEQ ID NO: 390728 - DNA, 25 bp, Mus musculus
ttcccacggctgctgacctcctgca

SEQ ID NO: 390729 - DNA, 25 bp, Mus musculus
ttcccactcatgttactgggcctgg

SEQ ID NO: 390730 - DNA, 25 bp, Mus musculus
ttcccactctcctgaacttccaggt

SEQ ID NO: 390731 - DNA, 25 bp, Mus musculus
ttcccactctcctggtcctgagtca

SEQ ID NO: 390732 - DNA, 25 bp, Mus musculus
ttcccactgaggccaatgtgctttg

SEQ ID NO: 390733 - DNA, 25 bp, Mus musculus
ttcccagaaagccccgcagccctac

SEQ ID NO: 390734 - DNA, 25 bp, Mus musculus
ttcccagaacaagactgagaatcag

SEQ ID NO: 390735 - DNA, 25 bp, Mus musculus
ttcccagaacaagattactactcaa

SEQ ID NO: 390736 - DNA, 25 bp, Mus musculus
ttcccagaagaaaacatgaattata

SEQ ID NO: 390737 - DNA, 25 bp, Mus musculus
ttcccagaagaatctgatgccaacg

SEQ ID NO: 390738 - DNA, 25 bp, Mus musculus
ttcccagagaaaggatgcaagctgt

SEQ ID NO: 390739 - DNA, 25 bp, Mus musculus
ttcccagagaagggggaactgatta

SEQ ID NO: 390740 - DNA, 25 bp, Mus musculus
ttcccagagggcattcaaagggatg

SEQ ID NO: 390741 - DNA, 25 bp, Mus musculus
ttcccagatgctggcttggagatga

SEQ ID NO: 390742 - DNA, 25 bp, Mus musculus
ttcccagatggcgaatactgggtcg

SEQ ID NO: 390743 - DNA, 25 bp, Mus musculus
ttcccagcacgccgctttttagaac

SEQ ID NO: 390744 - DNA, 25 bp, Mus musculus
ttcccagcagagcaagctgacgatc

SEQ ID NO: 390745 - DNA, 25 bp, Mus musculus
ttcccagcagtgcaagctgacgatc

SEQ ID NO: 390746 - DNA, 25 bp, Mus musculus
ttcccagcctaggcgaaacctgacc

SEQ ID NO: 390747 - DNA, 25 bp, Mus musculus
ttcccagctcacttcttccccgtcc

SEQ ID NO: 390748 - DNA, 25 bp, Mus musculus
ttcccaggacgatagccagccctgg

SEQ ID NO: 390749 - DNA, 25 bp, Mus musculus
ttcccaggacggctactggcaggag

SEQ ID NO: 390750 - DNA, 25 bp, Mus musculus
ttcccaggattcaagggagccccgg

SEQ ID NO: 390751 - DNA, 25 bp, Mus musculus
ttcccagggaggtcagcacctcggc

SEQ ID NO: 390752 - DNA, 25 bp, Mus musculus
ttcccagggcagcagagaatcagct

SEQ ID NO: 390753 - DNA, 25 bp, Mus musculus
ttcccagggcagcccagcaagacgc

SEQ ID NO: 390754 - DNA, 25 bp, Mus musculus
ttcccagggccaacaggtgaccgag

SEQ ID NO: 390755 - DNA, 25 bp, Mus musculus
ttcccaggtgcagcctctaggtcgc

SEQ ID NO: 390756 - DNA, 25 bp, Mus musculus
ttcccagtcagacactgcatatgcg

SEQ ID NO: 390757 - DNA, 25 bp, Mus musculus
ttcccagtcagagctctgaacatgt

SEQ ID NO: 390758 - DNA, 25 bp, Mus musculus
ttcccagtggggctcaagagtgtca

SEQ ID NO: 390759 - DNA, 25 bp, Mus musculus
ttcccagtggggtacatgtacccct

SEQ ID NO: 390760 - DNA, 25 bp, Mus musculus
ttcccataagtctgcgagtaaactt

SEQ ID NO: 390761 - DNA, 25 bp, Mus musculus
ttcccatcaacctgctgtcctgggc

SEQ ID NO: 390762 - DNA, 25 bp, Mus musculus
ttcccatcagcccaggccacagcag

SEQ ID NO: 390763 - DNA, 25 bp, Mus musculus
ttcccatccagctggtgaagacaca

SEQ ID NO: 390764 - DNA, 25 bp, Mus musculus
ttcccatccgacagcccgccggagt

SEQ ID NO: 390765 - DNA, 25 bp, Mus musculus
ttcccatcctcacaaaagcacttgc

SEQ ID NO: 390766 - DNA, 25 bp, Mus musculus
ttcccatgcgagctgatggctttgt

SEQ ID NO: 390767 - DNA, 25 bp, Mus musculus
ttcccatgcgagctggtccctgagt

SEQ ID NO: 390768 - DNA, 25 bp, Mus musculus
ttcccatgttgttgctggttgttgg

SEQ ID NO: 390769 - DNA, 25 bp, Mus musculus
ttcccattccttcaaaaagagtgac

SEQ ID NO: 390770 - DNA, 25 bp, Mus musculus
ttcccattcttcaggtgttgggaaa

SEQ ID NO: 390771 - DNA, 25 bp, Mus musculus
ttcccattgaaggtttcaggacatt

SEQ ID NO: 390772 - DNA, 25 bp, Mus musculus
ttcccattgagtacccagactcatg

SEQ ID NO: 390773 - DNA, 25 bp, Mus musculus
ttcccatttgattgagaaatgtgat

SEQ ID NO: 390774 - DNA, 25 bp, Mus musculus
ttccccaaagtaatggactcatgga

SEQ ID NO: 390775 - DNA, 25 bp, Mus musculus
ttccccaactccaagggctgggtct

SEQ ID NO: 390776 - DNA, 25 bp, Mus musculus
ttccccaactccaaggttacagagt

SEQ ID NO: 390777 - DNA, 25 bp, Mus musculus
ttccccaagttcaggaagaagcaca

SEQ ID NO: 390778 - DNA, 25 bp, Mus musculus
ttccccaagttcaggagctctgcac

SEQ ID NO: 390779 - DNA, 25 bp, Mus musculus
ttccccaatggtccatttactcgac

SEQ ID NO: 390780 - DNA, 25 bp, Mus musculus
ttccccacccaggcctggataccac

SEQ ID NO: 390781 - DNA, 25 bp, Mus musculus
ttccccacctgggaaaagatgccgt

SEQ ID NO: 390782 - DNA, 25 bp, Mus musculus
ttccccagacacagaaagccatcac

SEQ ID NO: 390783 - DNA, 25 bp, Mus musculus
ttccccagagataagctgacgctgg

SEQ ID NO: 390784 - DNA, 25 bp, Mus musculus
ttccccagcacagcaatcttccctg

SEQ ID NO: 390785 - DNA, 25 bp, Mus musculus
ttccccagctacaggtacattactg

SEQ ID NO: 390786 - DNA, 25 bp, Mus musculus
ttccccatacctaaggtggagattc

SEQ ID NO: 390787 - DNA, 25 bp, Mus musculus
ttccccatcaagatcccacgcaatg

SEQ ID NO: 390788 - DNA, 25 bp, Mus musculus
ttccccatctggcatgcccacgtgc

SEQ ID NO: 390789 - DNA, 25 bp, Mus musculus
ttccccatgagaggtagctaagtgg

SEQ ID NO: 390790 - DNA, 25 bp, Mus musculus
ttccccatgccaaagtctttgaaac

SEQ ID NO: 390791 - DNA, 25 bp, Mus musculus
ttccccattgccgagctcggcttca

SEQ ID NO: 390792 - DNA, 25 bp, Mus musculus
ttcccccaacttacagactgaagtg

SEQ ID NO: 390793 - DNA, 25 bp, Mus musculus
ttcccccaccatgaatttgtggccc

SEQ ID NO: 390794 - DNA, 25 bp, Mus musculus
ttcccccactggagagaccactgct

SEQ ID NO: 390795 - DNA, 25 bp, Mus musculus
ttcccccagcagactggagggtggt

SEQ ID NO: 390796 - DNA, 25 bp, Mus musculus
ttcccccattggagaggaacctgct

SEQ ID NO: 390797 - DNA, 25 bp, Mus musculus
ttcccccattggagccaaggctgtt

SEQ ID NO: 390798 - DNA, 25 bp, Mus musculus
ttccccccaggattcttcctactaa

SEQ ID NO: 390799 - DNA, 25 bp, Mus musculus
ttccccccaggcttaagatactcac

SEQ ID NO: 390800 - DNA, 25 bp, Mus musculus
ttcccccccagctacccgtacagtg

SEQ ID NO: 390801 - DNA, 25 bp, Mus musculus
ttccccccggcagatgagacaccaa

SEQ ID NO: 390802 - DNA, 25 bp, Mus musculus
ttccccccggcaggtaattctgact

SEQ ID NO: 390803 - DNA, 25 bp, Mus musculus
ttccccccgggtctgtctgccaaaa

SEQ ID NO: 390804 - DNA, 25 bp, Mus musculus
ttcccccgcccaggacagtcggccc

SEQ ID NO: 390805 - DNA, 25 bp, Mus musculus
ttccccctagaagtggccctgccgc

SEQ ID NO: 390806 - DNA, 25 bp, Mus musculus
ttccccctgaggaggctgcggggcc

SEQ ID NO: 390807 - DNA, 25 bp, Mus musculus
ttccccctggagtcctttcactgca

SEQ ID NO: 390808 - DNA, 25 bp, Mus musculus
ttccccctggtcaggagtgctgcaa

SEQ ID NO: 390809 - DNA, 25 bp, Mus musculus
ttccccctggtcaggcactcggaca

SEQ ID NO: 390810 - DNA, 25 bp, Mus musculus
ttcccccttggttgcctctctgcat

SEQ ID NO: 390811 - DNA, 25 bp, Mus musculus
ttccccgaactttagaccatgccgt

SEQ ID NO: 390812 - DNA, 25 bp, Mus musculus
ttccccgaagccgggctgatgtgat

SEQ ID NO: 390813 - DNA, 25 bp, Mus musculus
ttccccgcagaagacctccttccct

SEQ ID NO: 390814 - DNA, 25 bp, Mus musculus
ttccccgctggaagtttgtgtgagt

SEQ ID NO: 390815 - DNA, 25 bp, Mus musculus
ttccccggaagacgaagagccggaa

SEQ ID NO: 390816 - DNA, 25 bp, Mus musculus
ttccccggaagcactctgacaccat

SEQ ID NO: 390817 - DNA, 25 bp, Mus musculus
ttccccggataacgagcgaccgcct

SEQ ID NO: 390818 - DNA, 25 bp, Mus musculus
ttccccggataacgtggaccatgtg

SEQ ID NO: 390819 - DNA, 25 bp, Mus musculus
ttccccgggatggagatgaggtgcc

SEQ ID NO: 390820 - DNA, 25 bp, Mus musculus
ttccccggtgcgcggaaagatcaac

SEQ ID NO: 390821 - DNA, 25 bp, Mus musculus
ttccccgtgaaggacagtcatggca

SEQ ID NO: 390822 - DNA, 25 bp, Mus musculus
ttccccgtgcccagtcgagaagccc

SEQ ID NO: 390823 - DNA, 25 bp, Mus musculus
ttcccctaagtacaggtcaccatca

SEQ ID NO: 390824 - DNA, 25 bp, Mus musculus
ttcccctagcacagcagagtcaatt

SEQ ID NO: 390825 - DNA, 25 bp, Mus musculus
ttcccctcaagtctgagtttgtgat

SEQ ID NO: 390826 - DNA, 25 bp, Mus musculus
ttcccctcagagttgtctgctggtt

SEQ ID NO: 390827 - DNA, 25 bp, Mus musculus
ttcccctcagcaaatccagtttgct

SEQ ID NO: 390828 - DNA, 25 bp, Mus musculus
ttcccctcaggagtggagtcaacat

SEQ ID NO: 390829 - DNA, 25 bp, Mus musculus
ttcccctcaggggtgatccattcat

SEQ ID NO: 390830 - DNA, 25 bp, Mus musculus
ttcccctcagtgaatgtggctctct

SEQ ID NO: 390831 - DNA, 25 bp, Mus musculus
ttcccctcctgaagctgattggcgt

SEQ ID NO: 390832 - DNA, 25 bp, Mus musculus
ttcccctgaagcattgaaaaaggca

SEQ ID NO: 390833 - DNA, 25 bp, Mus musculus
ttcccctgaagccaatcatctgggg

SEQ ID NO: 390834 - DNA, 25 bp, Mus musculus
ttcccctgagatctaaacctactga

SEQ ID NO: 390835 - DNA, 25 bp, Mus musculus
ttcccctgcaaaaatctggaagaga

SEQ ID NO: 390836 - DNA, 25 bp, Mus musculus
ttcccctgcaatactgccgaaaccc

SEQ ID NO: 390837 - DNA, 25 bp, Mus musculus
ttcccctgcctccccactaccctcc

SEQ ID NO: 390838 - DNA, 25 bp, Mus musculus
ttcccctgtgaccctagtctctctt

SEQ ID NO: 390839 - DNA, 25 bp, Mus musculus
ttccccttagctcagagctctggtg

SEQ ID NO: 390840 - DNA, 25 bp, Mus musculus
ttccccttcagctcttggggtgaag

SEQ ID NO: 390841 - DNA, 25 bp, Mus musculus
ttccccttcaggagtcgctttcctt

SEQ ID NO: 390842 - DNA, 25 bp, Mus musculus
ttccccttcaggcctgcctttttcc

SEQ ID NO: 390843 - DNA, 25 bp, Mus musculus
ttccccttgtgctttgatgaccacg

SEQ ID NO: 390844 - DNA, 25 bp, Mus musculus
ttccccttgtgctttggtctccttc

SEQ ID NO: 390845 - DNA, 25 bp, Mus musculus
ttcccctttggagtcccatggtctg

SEQ ID NO: 390846 - DNA, 25 bp, Mus musculus
ttcccgaagccgcagccagagccac

SEQ ID NO: 390847 - DNA, 25 bp, Mus musculus
ttcccgaagtatcatgtaccggagc

SEQ ID NO: 390848 - DNA, 25 bp, Mus musculus
ttcccgagaaggccgagcctgctag

SEQ ID NO: 390849 - DNA, 25 bp, Mus musculus
ttcccgagacaagagattcagatgc

SEQ ID NO: 390850 - DNA, 25 bp, Mus musculus
ttcccgagacaagagtttccttcta

SEQ ID NO: 390851 - DNA, 25 bp, Mus musculus
ttcccgagccaggatcttgtgctga

SEQ ID NO: 390852 - DNA, 25 bp, Mus musculus
ttcccgaggtcgatacttcccaaga

SEQ ID NO: 390853 - DNA, 25 bp, Mus musculus
ttcccgagtcaaaagagctttggca

SEQ ID NO: 390854 - DNA, 25 bp, Mus musculus
ttcccgagtccagattgaacacata

SEQ ID NO: 390855 - DNA, 25 bp, Mus musculus
ttcccgagtccaggccgacgtggaa

SEQ ID NO: 390856 - DNA, 25 bp, Mus musculus
ttcccgatccaggtctctgagtgtg

SEQ ID NO: 390857 - DNA, 25 bp, Mus musculus
ttcccgattgcagcgtgcccttgaa

SEQ ID NO: 390858 - DNA, 25 bp, Mus musculus
ttcccgatttgcccatgaagctgtt

SEQ ID NO: 390859 - DNA, 25 bp, Mus musculus
ttcccgcaacaggtgacccaatgac

SEQ ID NO: 390860 - DNA, 25 bp, Mus musculus
ttcccgccctggatgccttttacaa

SEQ ID NO: 390861 - DNA, 25 bp, Mus musculus
ttcccgccgcggaggagaatggcgc

SEQ ID NO: 390862 - DNA, 25 bp, Mus musculus
ttcccgcctggtctctctgggatcc

SEQ ID NO: 390863 - DNA, 25 bp, Mus musculus
ttcccgcttggcaggccggcagagg

SEQ ID NO: 390864 - DNA, 25 bp, Mus musculus
ttcccggagacaactagctgtgtta

SEQ ID NO: 390865 - DNA, 25 bp, Mus musculus
ttcccggcccatcgggtgagcccgg

SEQ ID NO: 390866 - DNA, 25 bp, Mus musculus
ttcccggctcacctggttccggaag

SEQ ID NO: 390867 - DNA, 25 bp, Mus musculus
ttcccggctgtcactgagcactggc

SEQ ID NO: 390868 - DNA, 25 bp, Mus musculus
ttcccgggagcgagagctttgtaaa

SEQ ID NO: 390869 - DNA, 25 bp, Mus musculus
ttcccgtcctacgtgggctcgccat

SEQ ID NO: 390870 - DNA, 25 bp, Mus musculus
ttccctacagaactcttgagccctt

SEQ ID NO: 390871 - DNA, 25 bp, Mus musculus
ttccctacagcctgcccactgaacc

SEQ ID NO: 390872 - DNA, 25 bp, Mus musculus
ttccctaccctctgggtctggagac

SEQ ID NO: 390873 - DNA, 25 bp, Mus musculus
ttccctaccttcaacaggactggga

SEQ ID NO: 390874 - DNA, 25 bp, Mus musculus
ttccctagagatggctttcctgact

SEQ ID NO: 390875 - DNA, 25 bp, Mus musculus
ttccctatctacttggaccagaagt

SEQ ID NO: 390876 - DNA, 25 bp, Mus musculus
ttccctatgttacagaacccaagag

SEQ ID NO: 390877 - DNA, 25 bp, Mus musculus
ttccctattgcagagatggagactc

SEQ ID NO: 390878 - DNA, 25 bp, Mus musculus
ttccctattgcagagggcaagttta

SEQ ID NO: 390879 - DNA, 25 bp, Mus musculus
ttccctcacctcaggattctgggta

SEQ ID NO: 390880 - DNA, 25 bp, Mus musculus
ttccctcacctcagggaagagggat

SEQ ID NO: 390881 - DNA, 25 bp, Mus musculus
ttccctcacctgaagaaaaaagcag

SEQ ID NO: 390882 - DNA, 25 bp, Mus musculus
ttccctcacctgaagggatgtctga

SEQ ID NO: 390883 - DNA, 25 bp, Mus musculus
ttccctcagactcggggtcgcatcc

SEQ ID NO: 390884 - DNA, 25 bp, Mus musculus
ttccctcagactcggtacctcggaa

SEQ ID NO: 390885 - DNA, 25 bp, Mus musculus
ttccctcagactcggtcccccagag

SEQ ID NO: 390886 - DNA, 25 bp, Mus musculus
ttccctcaggcgaaaatatttcttg

SEQ ID NO: 390887 - DNA, 25 bp, Mus musculus
ttccctcaggcgacccaactctact

SEQ ID NO: 390888 - DNA, 25 bp, Mus musculus
ttccctcatcaatggtgaacaaccc

SEQ ID NO: 390889 - DNA, 25 bp, Mus musculus
ttccctccactggttggaagaggct

SEQ ID NO: 390890 - DNA, 25 bp, Mus musculus
ttccctcccgcccaagcctaataga

SEQ ID NO: 390891 - DNA, 25 bp, Mus musculus
ttccctcctggccttcccagaggcc

SEQ ID NO: 390892 - DNA, 25 bp, Mus musculus
ttccctcggaggcacgcgcctacct

SEQ ID NO: 390893 - DNA, 25 bp, Mus musculus
ttccctcggagtacaacacagaaga

SEQ ID NO: 390894 - DNA, 25 bp, Mus musculus
ttccctctagatttgatcaaaaaac

SEQ ID NO: 390895 - DNA, 25 bp, Mus musculus
ttccctctagtggaaacaagttgag

SEQ ID NO: 390896 - DNA, 25 bp, Mus musculus
ttccctctagttgtgagcggccatt

SEQ ID NO: 390897 - DNA, 25 bp, Mus musculus
ttccctctcagggtgcgggtagcgg

SEQ ID NO: 390898 - DNA, 25 bp, Mus musculus
ttccctctcctgaaagcgctgagaa

SEQ ID NO: 390899 - DNA, 25 bp, Mus musculus
ttccctctctttgccaaggtgaacg

SEQ ID NO: 390900 - DNA, 25 bp, Mus musculus
ttccctcttgcagctcaaatgtccc

SEQ ID NO: 390901 - DNA, 25 bp, Mus musculus
ttccctcttggctgatggtgaggcc

SEQ ID NO: 390902 - DNA, 25 bp, Mus musculus
ttccctgaaacccaaatatgccaag

SEQ ID NO: 390903 - DNA, 25 bp, Mus musculus
ttccctgaagtcaagggcaggcact

SEQ ID NO: 390904 - DNA, 25 bp, Mus musculus
ttccctgaagtcaaggtcggttagg

SEQ ID NO: 390905 - DNA, 25 bp, Mus musculus
ttccctgacagcaggggcttcagtg

SEQ ID NO: 390906 - DNA, 25 bp, Mus musculus
ttccctgacagcagttcccacagct

SEQ ID NO: 390907 - DNA, 25 bp, Mus musculus
ttccctgatatcaagtcgcgcattg

SEQ ID NO: 390908 - DNA, 25 bp, Mus musculus
ttccctgatcacaaagcagacccag

SEQ ID NO: 390909 - DNA, 25 bp, Mus musculus
ttccctgatgcgagagaacaagaga

SEQ ID NO: 390910 - DNA, 25 bp, Mus musculus
ttccctgcaagatatggttgcagga

SEQ ID NO: 390911 - DNA, 25 bp, Mus musculus
ttccctgcaaggagtgttacggctt

SEQ ID NO: 390912 - DNA, 25 bp, Mus musculus
ttccctgcacggctggccaggccaa

SEQ ID NO: 390913 - DNA, 25 bp, Mus musculus
ttccctgccagaggttgagacagat

SEQ ID NO: 390914 - DNA, 25 bp, Mus musculus
ttccctgcccgaagggacagtttgg

SEQ ID NO: 390915 - DNA, 25 bp, Mus musculus
ttccctgctacagcaacttctcctg

SEQ ID NO: 390916 - DNA, 25 bp, Mus musculus
ttccctgctccacaggtgttctaca

SEQ ID NO: 390917 - DNA, 25 bp, Mus musculus
ttccctgctgtcaacggggtctcat

SEQ ID NO: 390918 - DNA, 25 bp, Mus musculus
ttccctgctgttcctgattatctat

SEQ ID NO: 390919 - DNA, 25 bp, Mus musculus
ttccctgcttcagcaagcttccctg

SEQ ID NO: 390920 - DNA, 25 bp, Mus musculus
ttccctgcttccagcccctatgtta

SEQ ID NO: 390921 - DNA, 25 bp, Mus musculus
ttccctgctttttggagaggacgac

SEQ ID NO: 390922 - DNA, 25 bp, Mus musculus
ttccctggacaagctgtggccagcg

SEQ ID NO: 390923 - DNA, 25 bp, Mus musculus
ttccctggatgagcaagaaggagtt

SEQ ID NO: 390924 - DNA, 25 bp, Mus musculus
ttccctggcacagaaacatcatcca

SEQ ID NO: 390925 - DNA, 25 bp, Mus musculus
ttccctggcacagcaagcttccctg

SEQ ID NO: 390926 - DNA, 25 bp, Mus musculus
ttccctggcaccgggcactgactgt

SEQ ID NO: 390927 - DNA, 25 bp, Mus musculus
ttccctggcactgcaagtttcccca

SEQ ID NO: 390928 - DNA, 25 bp, Mus musculus
ttccctggccctcacaagtggccaa

SEQ ID NO: 390929 - DNA, 25 bp, Mus musculus
ttccctggcctccctgggccccaag

SEQ ID NO: 390930 - DNA, 25 bp, Mus musculus
ttccctggctaagcaagcttccctg

SEQ ID NO: 390931 - DNA, 25 bp, Mus musculus
ttccctgggtttaaagacagtattt

SEQ ID NO: 390932 - DNA, 25 bp, Mus musculus
ttccctggtacagcaaccttccatg

SEQ ID NO: 390933 - DNA, 25 bp, Mus musculus
ttccctggtacagcaagcttccctg

SEQ ID NO: 390934 - DNA, 25 bp, Mus musculus
ttccctggtacagcaagctttcctg

SEQ ID NO: 390935 - DNA, 25 bp, Mus musculus
ttccctgtcagaatgatcatgcgtc

SEQ ID NO: 390936 - DNA, 25 bp, Mus musculus
ttccctgtcctaggtagcagaggca

SEQ ID NO: 390937 - DNA, 25 bp, Mus musculus
ttccctgtcctgaggccatgcttgt

SEQ ID NO: 390938 - DNA, 25 bp, Mus musculus
ttccctgtctctcagaactgagggg

SEQ ID NO: 390939 - DNA, 25 bp, Mus musculus
ttccctgtctctttggtcaagacag

SEQ ID NO: 390940 - DNA, 25 bp, Mus musculus
ttccctgtctgtacctacagccggg

SEQ ID NO: 390941 - DNA, 25 bp, Mus musculus
ttccctgtttcagcaaccttccatg

SEQ ID NO: 390942 - DNA, 25 bp, Mus musculus
ttccctgtttcagcaaccttccctg

SEQ ID NO: 390943 - DNA, 25 bp, Mus musculus
ttccctgtttcagcaagcttccctg

SEQ ID NO: 390944 - DNA, 25 bp, Mus musculus
ttccctgtttcagcaagtttcccca

SEQ ID NO: 390945 - DNA, 25 bp, Mus musculus
ttccctgtttcagcaatcttccctg

SEQ ID NO: 390946 - DNA, 25 bp, Mus musculus
ttccctgtttcagcttccctgtttc

SEQ ID NO: 390947 - DNA, 25 bp, Mus musculus
ttccctgtttcaggattatttttct

SEQ ID NO: 390948 - DNA, 25 bp, Mus musculus
ttcccttacatgaagtcgatggcaa

SEQ ID NO: 390949 - DNA, 25 bp, Mus musculus
ttcccttcaaggcatgagagaattc

SEQ ID NO: 390950 - DNA, 25 bp, Mus musculus
ttcccttcatttctcatctcccagc

SEQ ID NO: 390951 - DNA, 25 bp, Mus musculus
ttcccttcccgagggcgctgtgagg

SEQ ID NO: 390952 - DNA, 25 bp, Mus musculus
ttcccttccggcacaattgccaaaa

SEQ ID NO: 390953 - DNA, 25 bp, Mus musculus
ttcccttctggccttcccagaggcc

SEQ ID NO: 390954 - DNA, 25 bp, Mus musculus
ttcccttgagacaccagagaagaaa

SEQ ID NO: 390955 - DNA, 25 bp, Mus musculus
ttcccttgatggcaagtatgtctat

SEQ ID NO: 390956 - DNA, 25 bp, Mus musculus
ttccctttaaggcatcaatacttgt

SEQ ID NO: 390957 - DNA, 25 bp, Mus musculus
ttccctttctcaggtccaggtggag

SEQ ID NO: 390958 - DNA, 25 bp, Mus musculus
ttcccttttacttggcaagtccttg

SEQ ID NO: 390959 - DNA, 25 bp, Mus musculus
ttcccttttgcatggtaagaccagc

SEQ ID NO: 390960 - DNA, 25 bp, Mus musculus
ttccgaaatgagctggaattttgga

SEQ ID NO: 390961 - DNA, 25 bp, Mus musculus
ttccgaagactgtcgctcctgtgcg

SEQ ID NO: 390962 - DNA, 25 bp, Mus musculus
ttccgaagatggaggagctggagtc

SEQ ID NO: 390963 - DNA, 25 bp, Mus musculus
ttccgaagcgcctccctcttgatgt

SEQ ID NO: 390964 - DNA, 25 bp, Mus musculus
ttccgaagcgcggtcaacatggctg

SEQ ID NO: 390965 - DNA, 25 bp, Mus musculus
ttccgaaggagcaggttgatatgtc

SEQ ID NO: 390966 - DNA, 25 bp, Mus musculus
ttccgacaagagcctgaaacctgct

SEQ ID NO: 390967 - DNA, 25 bp, Mus musculus
ttccgacaagaggactactgccttt

SEQ ID NO: 390968 - DNA, 25 bp, Mus musculus
ttccgacaatgatagaccaaactgc

SEQ ID NO: 390969 - DNA, 25 bp, Mus musculus
ttccgacaatgatagattcaaacac

SEQ ID NO: 390970 - DNA, 25 bp, Mus musculus
ttccgacatggaggatgacttgaaa

SEQ ID NO: 390971 - DNA, 25 bp, Mus musculus
ttccgacattccaacacttcaaact

SEQ ID NO: 390972 - DNA, 25 bp, Mus musculus
ttccgacattccaacgtgtccgatc

SEQ ID NO: 390973 - DNA, 25 bp, Mus musculus
ttccgaccattagccaagtccaggt

SEQ ID NO: 390974 - DNA, 25 bp, Mus musculus
ttccgacccctacttcagcaccctg

SEQ ID NO: 390975 - DNA, 25 bp, Mus musculus
ttccgacgcgcctttccctctggag

SEQ ID NO: 390976 - DNA, 25 bp, Mus musculus
ttccgacgcgcctttcctctctgga

SEQ ID NO: 390977 - DNA, 25 bp, Mus musculus
ttccgacgcgcctttctccacccca

SEQ ID NO: 390978 - DNA, 25 bp, Mus musculus
ttccgagaagccagctggagattca

SEQ ID NO: 390979 - DNA, 25 bp, Mus musculus
ttccgagaccagacccctgagcagc

SEQ ID NO: 390980 - DNA, 25 bp, Mus musculus
ttccgagcagaagcaagccatacag

SEQ ID NO: 390981 - DNA, 25 bp, Mus musculus
ttccgagcaggggaagagttgctga

SEQ ID NO: 390982 - DNA, 25 bp, Mus musculus
ttccgagcgggggaacctgatttga

SEQ ID NO: 390983 - DNA, 25 bp, Mus musculus
ttccgagcgtacctgtgcccacatc

SEQ ID NO: 390984 - DNA, 25 bp, Mus musculus
ttccgaggccttcagaatctgagga

SEQ ID NO: 390985 - DNA, 25 bp, Mus musculus
ttccgaggccttcaggtggttgagc

SEQ ID NO: 390986 - DNA, 25 bp, Mus musculus
ttccgaggctcagtactatggcatg

SEQ ID NO: 390987 - DNA, 25 bp, Mus musculus
ttccgagtcagctacttcctgtgct

SEQ ID NO: 390988 - DNA, 25 bp, Mus musculus
ttccgagtcatcaagacttcataag

SEQ ID NO: 390989 - DNA, 25 bp, Mus musculus
ttccgagtcatcaaggtaaaccgag

SEQ ID NO: 390990 - DNA, 25 bp, Mus musculus
ttccgagtccctcctggggggtcac

SEQ ID NO: 390991 - DNA, 25 bp, Mus musculus
ttccgagttcaaggtcgcttctccg

SEQ ID NO: 390992 - DNA, 25 bp, Mus musculus
ttccgatccttaccagtgaggctgc

SEQ ID NO: 390993 - DNA, 25 bp, Mus musculus
ttccgatggcagaaacttgattgaa

SEQ ID NO: 390994 - DNA, 25 bp, Mus musculus
ttccgatgtgacctctgccatgcca

SEQ ID NO: 390995 - DNA, 25 bp, Mus musculus
ttccgattcctaggggtgttattgg

SEQ ID NO: 390996 - DNA, 25 bp, Mus musculus
ttccgatttgggacgaggacctatt

SEQ ID NO: 390997 - DNA, 25 bp, Mus musculus
ttccgcaaacaaaaaatgcagagag

SEQ ID NO: 390998 - DNA, 25 bp, Mus musculus
ttccgcaaggaggtgctggctcagc

SEQ ID NO: 390999 - DNA, 25 bp, Mus musculus
ttccgcaagggcaaggtgctggctc

SEQ ID NO: 391000 - DNA, 25 bp, Mus musculus
ttccgcagtacccaggacactgtgg

SEQ ID NO: 391001 - DNA, 25 bp, Mus musculus
ttccgccaaatggactggaacttcc

SEQ ID NO: 391002 - DNA, 25 bp, Mus musculus
ttccgccaggtctcagttgtggccg

SEQ ID NO: 391003 - DNA, 25 bp, Mus musculus
ttccgcccaagttggtcacaatggc

SEQ ID NO: 391004 - DNA, 25 bp, Mus musculus
ttccgccgaccccgggatggcacac

SEQ ID NO: 391005 - DNA, 25 bp, Mus musculus
ttccgccgaccccgtgggctgttca

SEQ ID NO: 391006 - DNA, 25 bp, Mus musculus
ttccgcctggggtgactgtcccagc

SEQ ID NO: 391007 - DNA, 25 bp, Mus musculus
ttccgccttcgccagttctcaggcc

SEQ ID NO: 391008 - DNA, 25 bp, Mus musculus
ttccgcgaatcggtgttgagaaact

SEQ ID NO: 391009 - DNA, 25 bp, Mus musculus
ttccgcgacagagactaggcctgac

SEQ ID NO: 391010 - DNA, 25 bp, Mus musculus
ttccgcgacaggcaggagactgaac

SEQ ID NO: 391011 - DNA, 25 bp, Mus musculus
ttccgcgacaggggtccctccaatc

SEQ ID NO: 391012 - DNA, 25 bp, Mus musculus
ttccgcgacaggtcagggtatttct

SEQ ID NO: 391013 - DNA, 25 bp, Mus musculus
ttccgcgacgccggtgccttcgccg

SEQ ID NO: 391014 - DNA, 25 bp, Mus musculus
ttccgcgcctcgcagggctcaacat

SEQ ID NO: 391015 - DNA, 25 bp, Mus musculus
ttccgcggatcacgagtgaccgtct

SEQ ID NO: 391016 - DNA, 25 bp, Mus musculus
ttccgcgggacggatttgatctact

SEQ ID NO: 391017 - DNA, 25 bp, Mus musculus
ttccgcgggacggggagaaagagag

SEQ ID NO: 391018 - DNA, 25 bp, Mus musculus
ttccgcgtcgagatttggtgactga

SEQ ID NO: 391019 - DNA, 25 bp, Mus musculus
ttccggaaatggcactgtttttagg

SEQ ID NO: 391020 - DNA, 25 bp, Mus musculus
ttccggaaatgtgagcgggagaatg

SEQ ID NO: 391021 - DNA, 25 bp, Mus musculus
ttccggaaggtgctgctggaggccc

SEQ ID NO: 391022 - DNA, 25 bp, Mus musculus
ttccggaagttccagggatccttgt

SEQ ID NO: 391023 - DNA, 25 bp, Mus musculus
ttccggaagttccaggtctggaggc

SEQ ID NO: 391024 - DNA, 25 bp, Mus musculus
ttccggaatgcaggtttcaaatgat

SEQ ID NO: 391025 - DNA, 25 bp, Mus musculus
ttccggaatttggaactcagggcgg

SEQ ID NO: 391026 - DNA, 25 bp, Mus musculus
ttccggaatttgggctctggacctg

SEQ ID NO: 391027 - DNA, 25 bp, Mus musculus
ttccggacagccagcccaggctatc

SEQ ID NO: 391028 - DNA, 25 bp, Mus musculus
ttccggacagccaggcctctgggga

SEQ ID NO: 391029 - DNA, 25 bp, Mus musculus
ttccggaccatcacccttcagagtc

SEQ ID NO: 391030 - DNA, 25 bp, Mus musculus
ttccggacctatgagtgtgatccag

SEQ ID NO: 391031 - DNA, 25 bp, Mus musculus
ttccggacggctcagaaaaggggga

SEQ ID NO: 391032 - DNA, 25 bp, Mus musculus
ttccggagctggactgaacttttga

SEQ ID NO: 391033 - DNA, 25 bp, Mus musculus
ttccggcagaggtatcgcatcctga

SEQ ID NO: 391034 - DNA, 25 bp, Mus musculus
ttccggccgccaaggttcgcttatc

SEQ ID NO: 391035 - DNA, 25 bp, Mus musculus
ttccggcgagggctgtaaaaaatgg

SEQ ID NO: 391036 - DNA, 25 bp, Mus musculus
ttccggctcttcaagtacggggtac

SEQ ID NO: 391037 - DNA, 25 bp, Mus musculus
ttccggctgacgggctcctccccga

SEQ ID NO: 391038 - DNA, 25 bp, Mus musculus
ttccggctggccacccccatcagtc

SEQ ID NO: 391039 - DNA, 25 bp, Mus musculus
ttccgggaaagggctctcttgtgct

SEQ ID NO: 391040 - DNA, 25 bp, Mus musculus
ttccgggagatccccactccttcct

SEQ ID NO: 391041 - DNA, 25 bp, Mus musculus
ttccgggagcaggaggagccaagca

SEQ ID NO: 391042 - DNA, 25 bp, Mus musculus
ttccgggagcaggaggagccaggag

SEQ ID NO: 391043 - DNA, 25 bp, Mus musculus
ttccgggatgcctgatcgtaccgag

SEQ ID NO: 391044 - DNA, 25 bp, Mus musculus
ttccgggcagggatttcagccatgg

SEQ ID NO: 391045 - DNA, 25 bp, Mus musculus
ttccgggctccctggtcctgagggt

SEQ ID NO: 391046 - DNA, 25 bp, Mus musculus
ttccgggctcggaggtccctgaccc

SEQ ID NO: 391047 - DNA, 25 bp, Mus musculus
ttccggggtctggacagcattcttc

SEQ ID NO: 391048 - DNA, 25 bp, Mus musculus
ttccggggtctggtggtacttgact

SEQ ID NO: 391049 - DNA, 25 bp, Mus musculus
ttccgggtccaggcactttctaggt

SEQ ID NO: 391050 - DNA, 25 bp, Mus musculus
ttccggtcagatgttcacacggaag

SEQ ID NO: 391051 - DNA, 25 bp, Mus musculus
ttccggtcattaggttcaaccagat

SEQ ID NO: 391052 - DNA, 25 bp, Mus musculus
ttccggttcggattctgtgtcttta

SEQ ID NO: 391053 - DNA, 25 bp, Mus musculus
ttccggttctcatcaagatcaatga

SEQ ID NO: 391054 - DNA, 25 bp, Mus musculus
ttccggttctcatgctcctgtggct

SEQ ID NO: 391055 - DNA, 25 bp, Mus musculus
ttccggtttgcaggagagagggagc

SEQ ID NO: 391056 - DNA, 25 bp, Mus musculus
ttccgtatctatttctgccaaatcc

SEQ ID NO: 391057 - DNA, 25 bp, Mus musculus
ttccgtatctttttctgccaaatcc

SEQ ID NO: 391058 - DNA, 25 bp, Mus musculus
ttccgtcataacgggcctgtgtgat

SEQ ID NO: 391059 - DNA, 25 bp, Mus musculus
ttccgtccagaagaaaacacacgtg

SEQ ID NO: 391060 - DNA, 25 bp, Mus musculus
ttccgtccagaagcccacagtcacc

SEQ ID NO: 391061 - DNA, 25 bp, Mus musculus
ttccgtccagaagggtgaacctaag

SEQ ID NO: 391062 - DNA, 25 bp, Mus musculus
ttccgtcctacaaacctcatccagc

SEQ ID NO: 391063 - DNA, 25 bp, Mus musculus
ttccgtcgaatgaaaacaagatgag

SEQ ID NO: 391064 - DNA, 25 bp, Mus musculus
ttccgtcgaatgaaactatccagca

SEQ ID NO: 391065 - DNA, 25 bp, Mus musculus
ttccgtctatagccaagcagaagca

SEQ ID NO: 391066 - DNA, 25 bp, Mus musculus
ttccgtctataggcggaacatgttc

SEQ ID NO: 391067 - DNA, 25 bp, Mus musculus
ttccgtgagaagtttatgcagcacc

SEQ ID NO: 391068 - DNA, 25 bp, Mus musculus
ttccgtgagggaaaagaagaccaga

SEQ ID NO: 391069 - DNA, 25 bp, Mus musculus
ttccgtgcaggcgcctaaaagaaag

SEQ ID NO: 391070 - DNA, 25 bp, Mus musculus
ttccgtgcctttgaagatgagcagc

SEQ ID NO: 391071 - DNA, 25 bp, Mus musculus
ttccgttaaaggtcacacaactggc

SEQ ID NO: 391072 - DNA, 25 bp, Mus musculus
ttccgttcaaaggtctcaacatggt

SEQ ID NO: 391073 - DNA, 25 bp, Mus musculus
ttccgttggcagaagccatcccgat

SEQ ID NO: 391074 - DNA, 25 bp, Mus musculus
ttcctaaaaaaagactgggctatat

SEQ ID NO: 391075 - DNA, 25 bp, Mus musculus
ttcctaaaaaaagtgccgtgatgcc

SEQ ID NO: 391076 - DNA, 25 bp, Mus musculus
ttcctaaaagcagccaacaagaagc

SEQ ID NO: 391077 - DNA, 25 bp, Mus musculus
ttcctaaaaggtaaagcaccgtgga

SEQ ID NO: 391078 - DNA, 25 bp, Mus musculus
ttcctaaacccagctggtgccagct

SEQ ID NO: 391079 - DNA, 25 bp, Mus musculus
ttcctaaatgtgttgcaacagacca

SEQ ID NO: 391080 - DNA, 25 bp, Mus musculus
ttcctaaattctctgcccttctgcc

SEQ ID NO: 391081 - DNA, 25 bp, Mus musculus
ttcctaacttttagtcacagaaaag

SEQ ID NO: 391082 - DNA, 25 bp, Mus musculus
ttcctaagaagacccagcactactt

SEQ ID NO: 391083 - DNA, 25 bp, Mus musculus
ttcctaagaaggccacagacccagc

SEQ ID NO: 391084 - DNA, 25 bp, Mus musculus
ttcctaaggaatgggtattggcttg

SEQ ID NO: 391085 - DNA, 25 bp, Mus musculus
ttcctaatccgggagctttctccag

SEQ ID NO: 391086 - DNA, 25 bp, Mus musculus
ttcctacaaaaggtgtggcgtggca

SEQ ID NO: 391087 - DNA, 25 bp, Mus musculus
ttcctacaagttggtcagtgaaatg

SEQ ID NO: 391088 - DNA, 25 bp, Mus musculus
ttcctacacaaaaagctgttcagca

SEQ ID NO: 391089 - DNA, 25 bp, Mus musculus
ttcctacagagagaacctggaggat

SEQ ID NO: 391090 - DNA, 25 bp, Mus musculus
ttcctacaggacaagaatgccctgg

SEQ ID NO: 391091 - DNA, 25 bp, Mus musculus
ttcctacaggacaagctaagcattg

SEQ ID NO: 391092 - DNA, 25 bp, Mus musculus
ttcctacattgtcttgctgagtatc

SEQ ID NO: 391093 - DNA, 25 bp, Mus musculus
ttcctaccacagggtctgtaccaaa

SEQ ID NO: 391094 - DNA, 25 bp, Mus musculus
ttcctacccatgttcctgaatgtgt

SEQ ID NO: 391095 - DNA, 25 bp, Mus musculus
ttcctacctccagactttggttctg

SEQ ID NO: 391096 - DNA, 25 bp, Mus musculus
ttcctacctccagaggttggcgatt

SEQ ID NO: 391097 - DNA, 25 bp, Mus musculus
ttcctacctccagatttaggtcgct

SEQ ID NO: 391098 - DNA, 25 bp, Mus musculus
ttcctacctccaggcacttagcgct

SEQ ID NO: 391099 - DNA, 25 bp, Mus musculus
ttcctacctccagtacctcactgtg

SEQ ID NO: 391100 - DNA, 25 bp, Mus musculus
ttcctactactgctcccagggctgt

SEQ ID NO: 391101 - DNA, 25 bp, Mus musculus
ttcctactagggagagactctacag

SEQ ID NO: 391102 - DNA, 25 bp, Mus musculus
ttcctacttccagaacatttaaaag

SEQ ID NO: 391103 - DNA, 25 bp, Mus musculus
ttcctagaacaggccttcgatatga

SEQ ID NO: 391104 - DNA, 25 bp, Mus musculus
ttcctagaagggaggtggtgtggtc

SEQ ID NO: 391105 - DNA, 25 bp, Mus musculus
ttcctagacacacagcccatcctca

SEQ ID NO: 391106 - DNA, 25 bp, Mus musculus
ttcctagacagacaaagtttctctg

SEQ ID NO: 391107 - DNA, 25 bp, Mus musculus
ttcctagacagtgttcctaggatcc

SEQ ID NO: 391108 - DNA, 25 bp, Mus musculus
ttcctagcagaggaaaagaagcttc

SEQ ID NO: 391109 - DNA, 25 bp, Mus musculus
ttcctagcaggagtgatgatgtgcc

SEQ ID NO: 391110 - DNA, 25 bp, Mus musculus
ttcctagctgactatgctcactctt

SEQ ID NO: 391111 - DNA, 25 bp, Mus musculus
ttcctagctgggctatggagttact

SEQ ID NO: 391112 - DNA, 25 bp, Mus musculus
ttcctaggaagaggatgtacatgct

SEQ ID NO: 391113 - DNA, 25 bp, Mus musculus
ttcctaggaagccagtgacgccaag

SEQ ID NO: 391114 - DNA, 25 bp, Mus musculus
ttcctaggacagggcttcgcctcta

SEQ ID NO: 391115 - DNA, 25 bp, Mus musculus
ttcctaggagctgggcttgcaggca

SEQ ID NO: 391116 - DNA, 25 bp, Mus musculus
ttcctaggatggtggcccagatgat

SEQ ID NO: 391117 - DNA, 25 bp, Mus musculus
ttcctaggcaaggtgctgatagtct

SEQ ID NO: 391118 - DNA, 25 bp, Mus musculus
ttcctagggacaagtcactgttctg

SEQ ID NO: 391119 - DNA, 25 bp, Mus musculus
ttcctaggtgccagattgacgtgtt

SEQ ID NO: 391120 - DNA, 25 bp, Mus musculus
ttcctaggtgccaggttggctgatg

SEQ ID NO: 391121 - DNA, 25 bp, Mus musculus
ttcctaggtggtctcctagcccttt

SEQ ID NO: 391122 - DNA, 25 bp, Mus musculus
ttcctagtccaattcaggttattga

SEQ ID NO: 391123 - DNA, 25 bp, Mus musculus
ttcctataatgttgtgatgacgacc

SEQ ID NO: 391124 - DNA, 25 bp, Mus musculus
ttcctataggcaaaggttctgcctc

SEQ ID NO: 391125 - DNA, 25 bp, Mus musculus
ttcctatcagagagtgactcagaca

SEQ ID NO: 391126 - DNA, 25 bp, Mus musculus
ttcctatcagcttgcgtgtgaactt

SEQ ID NO: 391127 - DNA, 25 bp, Mus musculus
ttcctatcagggctcagttctgaca

SEQ ID NO: 391128 - DNA, 25 bp, Mus musculus
ttcctatcctggtgctactaaaatt

SEQ ID NO: 391129 - DNA, 25 bp, Mus musculus
ttcctatgaagcccacattcagtgt

SEQ ID NO: 391130 - DNA, 25 bp, Mus musculus
ttcctatgaaggaagagcagcatgc

SEQ ID NO: 391131 - DNA, 25 bp, Mus musculus
ttcctatgagactatggcaggggca

SEQ ID NO: 391132 - DNA, 25 bp, Mus musculus
ttcctatgatcgtcatcttcttcct

SEQ ID NO: 391133 - DNA, 25 bp, Mus musculus
ttcctatggaccagggatttaaaat

SEQ ID NO: 391134 - DNA, 25 bp, Mus musculus
ttcctcaaacaagaaaaagagaaaa

SEQ ID NO: 391135 - DNA, 25 bp, Mus musculus
ttcctcaaacaagaagaatcctgtt

SEQ ID NO: 391136 - DNA, 25 bp, Mus musculus
ttcctcaaacaaggcaccaaggaga

SEQ ID NO: 391137 - DNA, 25 bp, Mus musculus
ttcctcaaagaaggtcagctggccg

SEQ ID NO: 391138 - DNA, 25 bp, Mus musculus
ttcctcaacagtgtctacattgggc

SEQ ID NO: 391139 - DNA, 25 bp, Mus musculus
ttcctcaacgagcaggatgaggtgt

SEQ ID NO: 391140 - DNA, 25 bp, Mus musculus
ttcctcaatcacctctcccagtaca

SEQ ID NO: 391141 - DNA, 25 bp, Mus musculus
ttcctcaatcacttatcacagttca

SEQ ID NO: 391142 - DNA, 25 bp, Mus musculus
ttcctcaatgtgttgcaacagacca

SEQ ID NO: 391143 - DNA, 25 bp, Mus musculus
ttcctcacactcagagccttccaag

SEQ ID NO: 391144 - DNA, 25 bp, Mus musculus
ttcctcacagaaaataaagcagttg

SEQ ID NO: 391145 - DNA, 25 bp, Mus musculus
ttcctcacaggaaagcaaagattca

SEQ ID NO: 391146 - DNA, 25 bp, Mus musculus
ttcctcactccagatgtgtttgggc

SEQ ID NO: 391147 - DNA, 25 bp, Mus musculus
ttcctcactgacctggcctctgggg

SEQ ID NO: 391148 - DNA, 25 bp, Mus musculus
ttcctcagaagcaaatggagaccat

SEQ ID NO: 391149 - DNA, 25 bp, Mus musculus
ttcctcagaagttgtggagtttgac

SEQ ID NO: 391150 - DNA, 25 bp, Mus musculus
ttcctcagaattatctgggaatgtg

SEQ ID NO: 391151 - DNA, 25 bp, Mus musculus
ttcctcagacaggcttccatacaca

SEQ ID NO: 391152 - DNA, 25 bp, Mus musculus
ttcctcagacagtgaaaacaaagaa

SEQ ID NO: 391153 - DNA, 25 bp, Mus musculus
ttcctcagacgctgactcatcccag

SEQ ID NO: 391154 - DNA, 25 bp, Mus musculus
ttcctcagcatggctggaccgcttc

SEQ ID NO: 391155 - DNA, 25 bp, Mus musculus
ttcctcagccccagtttgacggatg

SEQ ID NO: 391156 - DNA, 25 bp, Mus musculus
ttcctcagtaatgaccaattctcca

SEQ ID NO: 391157 - DNA, 25 bp, Mus musculus
ttcctcataaattccacatgagata

SEQ ID NO: 391158 - DNA, 25 bp, Mus musculus
ttcctcataaggtcacgttcatgaa

SEQ ID NO: 391159 - DNA, 25 bp, Mus musculus
ttcctcatcagtgccaactgtaaag

SEQ ID NO: 391160 - DNA, 25 bp, Mus musculus
ttcctcatcagtggccaccaatgaa

SEQ ID NO: 391161 - DNA, 25 bp, Mus musculus
ttcctcatccccaaggccgcagatc

SEQ ID NO: 391162 - DNA, 25 bp, Mus musculus
ttcctcatccccaaggggtcaatcc

SEQ ID NO: 391163 - DNA, 25 bp, Mus musculus
ttcctcatctatgagggctacgagg

SEQ ID NO: 391164 - DNA, 25 bp, Mus musculus
ttcctcatgaggaaacggctgctct

SEQ ID NO: 391165 - DNA, 25 bp, Mus musculus
ttcctcatggctgtgacattgaggg

SEQ ID NO: 391166 - DNA, 25 bp, Mus musculus
ttcctcatttacgagcacgagtgct

SEQ ID NO: 391167 - DNA, 25 bp, Mus musculus
ttcctccaaaatactgttcagccat

SEQ ID NO: 391168 - DNA, 25 bp, Mus musculus
ttcctccaaagatccattactaatg

SEQ ID NO: 391169 - DNA, 25 bp, Mus musculus
ttcctccaaaggagctctcaagtgg

SEQ ID NO: 391170 - DNA, 25 bp, Mus musculus
ttcctccaaagtgtgacttatgagg

SEQ ID NO: 391171 - DNA, 25 bp, Mus musculus
ttcctccaacaaatgcagaaccccg

SEQ ID NO: 391172 - DNA, 25 bp, Mus musculus
ttcctccaagagaaggtggacctgg

SEQ ID NO: 391173 - DNA, 25 bp, Mus musculus
ttcctccacaaaggtcagaagaggg

SEQ ID NO: 391174 - DNA, 25 bp, Mus musculus
ttcctccacaagagcctgagttttc

SEQ ID NO: 391175 - DNA, 25 bp, Mus musculus
ttcctccaccaggtagctgagacct

SEQ ID NO: 391176 - DNA, 25 bp, Mus musculus
ttcctccactccagatcatgtcatc

SEQ ID NO: 391177 - DNA, 25 bp, Mus musculus
ttcctccagctctacccgatcaagt

SEQ ID NO: 391178 - DNA, 25 bp, Mus musculus
ttcctccaggatcctcatccgagag

SEQ ID NO: 391179 - DNA, 25 bp, Mus musculus
ttcctccaggatggattcatgggtg

SEQ ID NO: 391180 - DNA, 25 bp, Mus musculus
ttcctcccaagattcccgtggggct

SEQ ID NO: 391181 - DNA, 25 bp, Mus musculus
ttcctcccagatgatgggcgtcggg

SEQ ID NO: 391182 - DNA, 25 bp, Mus musculus
ttcctcccctgctacaaaaaattgc

SEQ ID NO: 391183 - DNA, 25 bp, Mus musculus
ttcctcccctggctagagcatggaa

SEQ ID NO: 391184 - DNA, 25 bp, Mus musculus
ttcctccctcccatgcagccacctg

SEQ ID NO: 391185 - DNA, 25 bp, Mus musculus
ttcctccctgagaatgaggtgtata

SEQ ID NO: 391186 - DNA, 25 bp, Mus musculus
ttcctccctttcggcttcgtgagct

SEQ ID NO: 391187 - DNA, 25 bp, Mus musculus
ttcctcctaaagaacagagcctggg

SEQ ID NO: 391188 - DNA, 25 bp, Mus musculus
ttcctcctaaagccgagcgccagcg

SEQ ID NO: 391189 - DNA, 25 bp, Mus musculus
ttcctcctaaggcgcctgtgtctgg

SEQ ID NO: 391190 - DNA, 25 bp, Mus musculus
ttcctcctacaacacggtagaggac

SEQ ID NO: 391191 - DNA, 25 bp, Mus musculus
ttcctcctacattgagcagacacgg

SEQ ID NO: 391192 - DNA, 25 bp, Mus musculus
ttcctcctgccagacttggcagcct

SEQ ID NO: 391193 - DNA, 25 bp, Mus musculus
ttcctcctgccaggccaaaagcacc

SEQ ID NO: 391194 - DNA, 25 bp, Mus musculus
ttcctcctgccaggttttttccttg

SEQ ID NO: 391195 - DNA, 25 bp, Mus musculus
ttcctcctttggtggccgtgcctgc

SEQ ID NO: 391196 - DNA, 25 bp, Mus musculus
ttcctcgaacacctatgtgcccttc

SEQ ID NO: 391197 - DNA, 25 bp, Mus musculus
ttcctcgaacacctgagccagcccg

SEQ ID NO: 391198 - DNA, 25 bp, Mus musculus
ttcctcgaaggtcctggccacaccc

SEQ ID NO: 391199 - DNA, 25 bp, Mus musculus
ttcctcgcctgtgaactcatcagca

SEQ ID NO: 391200 - DNA, 25 bp, Mus musculus
ttcctcgcttttgagcttggcaaat

SEQ ID NO: 391201 - DNA, 25 bp, Mus musculus
ttcctcgcttttgagtgacagccct

SEQ ID NO: 391202 - DNA, 25 bp, Mus musculus
ttcctcggagtttgatccatttttt

SEQ ID NO: 391203 - DNA, 25 bp, Mus musculus
ttcctcggcaatcagtttggagatt

SEQ ID NO: 391204 - DNA, 25 bp, Mus musculus
ttcctcggccagaagccaccccagt

SEQ ID NO: 391205 - DNA, 25 bp, Mus musculus
ttcctcggccagaagctgaacctta

SEQ ID NO: 391206 - DNA, 25 bp, Mus musculus
ttcctcggccagaagttgcaagttg

SEQ ID NO: 391207 - DNA, 25 bp, Mus musculus
ttcctcgggctccactctcgctcac

SEQ ID NO: 391208 - DNA, 25 bp, Mus musculus
ttcctcgtccttgagagatgccaaa

SEQ ID NO: 391209 - DNA, 25 bp, Mus musculus
ttcctctaaacaagacgggccgcat

SEQ ID NO: 391210 - DNA, 25 bp, Mus musculus
ttcctctaaagaccggaaagcactg

SEQ ID NO: 391211 - DNA, 25 bp, Mus musculus
ttcctctacagacagaccctgctct

SEQ ID NO: 391212 - DNA, 25 bp, Mus musculus
ttcctctacaggggacctggctgac

SEQ ID NO: 391213 - DNA, 25 bp, Mus musculus
ttcctctacgctgagcggcagcctg

SEQ ID NO: 391214 - DNA, 25 bp, Mus musculus
ttcctctagaacagatgcaaaatcg

SEQ ID NO: 391215 - DNA, 25 bp, Mus musculus
ttcctctagaacaggagagcctgac

SEQ ID NO: 391216 - DNA, 25 bp, Mus musculus
ttcctctagacacctttctctccct

SEQ ID NO: 391217 - DNA, 25 bp, Mus musculus
ttcctctcagccaaaaagacttgga

SEQ ID NO: 391218 - DNA, 25 bp, Mus musculus
ttcctctccaagcttttcatcctac

SEQ ID NO: 391219 - DNA, 25 bp, Mus musculus
ttcctctccacccatctgctggcaa

SEQ ID NO: 391220 - DNA, 25 bp, Mus musculus
ttcctctctgacttcctctttgcca

SEQ ID NO: 391221 - DNA, 25 bp, Mus musculus
ttcctctctgtgcagcacgatggcc

SEQ ID NO: 391222 - DNA, 25 bp, Mus musculus
ttcctctgaactcagactactcgct

SEQ ID NO: 391223 - DNA, 25 bp, Mus musculus
ttcctctgacagtctcatctttgga

SEQ ID NO: 391224 - DNA, 25 bp, Mus musculus
ttcctctgaggatgacaaggagtat

SEQ ID NO: 391225 - DNA, 25 bp, Mus musculus
ttcctctgctacaaggctttcttct

SEQ ID NO: 391226 - DNA, 25 bp, Mus musculus
ttcctctgctacaagtgactacttc

SEQ ID NO: 391227 - DNA, 25 bp, Mus musculus
ttcctctggaaagccccggcagccc

SEQ ID NO: 391228 - DNA, 25 bp, Mus musculus
ttcctctggaagggagagacgacat

SEQ ID NO: 391229 - DNA, 25 bp, Mus musculus
ttcctctgggaaaagggtcaatgct

SEQ ID NO: 391230 - DNA, 25 bp, Mus musculus
ttcctctgtaccagttgctgtgatt

SEQ ID NO: 391231 - DNA, 25 bp, Mus musculus
ttcctctgtcagatgatgatcattt

SEQ ID NO: 391232 - DNA, 25 bp, Mus musculus
ttcctctgtttctgtgaggaccttg

SEQ ID NO: 391233 - DNA, 25 bp, Mus musculus
ttcctctgtttcttggaggatctgg

SEQ ID NO: 391234 - DNA, 25 bp, Mus musculus
ttcctcttacttaaggaactcagag

SEQ ID NO: 391235 - DNA, 25 bp, Mus musculus
ttcctcttatgacagctggaacgct

SEQ ID NO: 391236 - DNA, 25 bp, Mus musculus
ttcctcttatgacaggtggctgtct

SEQ ID NO: 391237 - DNA, 25 bp, Mus musculus
ttcctcttcagctgctctgtccggg

SEQ ID NO: 391238 - DNA, 25 bp, Mus musculus
ttcctcttccactggggtgtgtctg

SEQ ID NO: 391239 - DNA, 25 bp, Mus musculus
ttcctcttcgccgccattgctcctg

SEQ ID NO: 391240 - DNA, 25 bp, Mus musculus
ttcctctttaaaggattggtgacca

SEQ ID NO: 391241 - DNA, 25 bp, Mus musculus
ttcctctttagaacctgggtgtggt

SEQ ID NO: 391242 - DNA, 25 bp, Mus musculus
ttcctgaaacagagaagcccgtgct

SEQ ID NO: 391243 - DNA, 25 bp, Mus musculus
ttcctgaaagatgatggcgtgagca

SEQ ID NO: 391244 - DNA, 25 bp, Mus musculus
ttcctgaaagctttggatagatcag

SEQ ID NO: 391245 - DNA, 25 bp, Mus musculus
ttcctgaaagttaaatcggagatct

SEQ ID NO: 391246 - DNA, 25 bp, Mus musculus
ttcctgaacacagtaaggtagatta

SEQ ID NO: 391247 - DNA, 25 bp, Mus musculus
ttcctgaagaaaggaactgtcgtcc

SEQ ID NO: 391248 - DNA, 25 bp, Mus musculus
ttcctgaagaaagtggtatcccgcc

SEQ ID NO: 391249 - DNA, 25 bp, Mus musculus
ttcctgaagaacggtatcactgagg

SEQ ID NO: 391250 - DNA, 25 bp, Mus musculus
ttcctgaagatcaaagacgccttag

SEQ ID NO: 391251 - DNA, 25 bp, Mus musculus
ttcctgaagccccagtcttattaat

SEQ ID NO: 391252 - DNA, 25 bp, Mus musculus
ttcctgaaggaggtactgtctgagc

SEQ ID NO: 391253 - DNA, 25 bp, Mus musculus
ttcctgaaggagtgtggcatgttca

SEQ ID NO: 391254 - DNA, 25 bp, Mus musculus
ttcctgaaggttgctagacctgatg

SEQ ID NO: 391255 - DNA, 25 bp, Mus musculus
ttcctgaatacacaggccccagtgc

SEQ ID NO: 391256 - DNA, 25 bp, Mus musculus
ttcctgaatgacaagctccccgagg

SEQ ID NO: 391257 - DNA, 25 bp, Mus musculus
ttcctgaatgacaaggtggaggagc

SEQ ID NO: 391258 - DNA, 25 bp, Mus musculus
ttcctgacagggagccaggcttggc

SEQ ID NO: 391259 - DNA, 25 bp, Mus musculus
ttcctgacaggtagccaggcttggc

SEQ ID NO: 391260 - DNA, 25 bp, Mus musculus
ttcctgaccaagagtggcaacagca

SEQ ID NO: 391261 - DNA, 25 bp, Mus musculus
ttcctgactggctggtttttcaacg

SEQ ID NO: 391262 - DNA, 25 bp, Mus musculus
ttcctgagaggctggcctccacatt

SEQ ID NO: 391263 - DNA, 25 bp, Mus musculus
ttcctgagagtgcccgaggcgcccg

SEQ ID NO: 391264 - DNA, 25 bp, Mus musculus
ttcctgaggaacagcgcatcgccat

SEQ ID NO: 391265 - DNA, 25 bp, Mus musculus
ttcctgaggctgtaagcaatggctt

SEQ ID NO: 391266 - DNA, 25 bp, Mus musculus
ttcctgagtgagctcattgcccacc

SEQ ID NO: 391267 - DNA, 25 bp, Mus musculus
ttcctgagtgccatggattggcgtc

SEQ ID NO: 391268 - DNA, 25 bp, Mus musculus
ttcctgagtggtatccttggcatgg

SEQ ID NO: 391269 - DNA, 25 bp, Mus musculus
ttcctgatcagggctccagtggtcc

SEQ ID NO: 391270 - DNA, 25 bp, Mus musculus
ttcctgatcaggtaatgtatgtgga

SEQ ID NO: 391271 - DNA, 25 bp, Mus musculus
ttcctgatctccgcatctcttcgcc

SEQ ID NO: 391272 - DNA, 25 bp, Mus musculus
ttcctgatgaaatgctttgaaccct

SEQ ID NO: 391273 - DNA, 25 bp, Mus musculus
ttcctgatgaaatggaaaaactctg

SEQ ID NO: 391274 - DNA, 25 bp, Mus musculus
ttcctgatgaaatggtcttcttccc

SEQ ID NO: 391275 - DNA, 25 bp, Mus musculus
ttcctgatgaagttatagtgcctcg

SEQ ID NO: 391276 - DNA, 25 bp, Mus musculus
ttcctgatgaatgtcattggtctca

SEQ ID NO: 391277 - DNA, 25 bp, Mus musculus
ttcctgatgctgacggtcacagagc

SEQ ID NO: 391278 - DNA, 25 bp, Mus musculus
ttcctgatgggcaaggctgggtggg

SEQ ID NO: 391279 - DNA, 25 bp, Mus musculus
ttcctgcaaaaggctctgagtttct

SEQ ID NO: 391280 - DNA, 25 bp, Mus musculus
ttcctgcaagaactgagcctggaca

SEQ ID NO: 391281 - DNA, 25 bp, Mus musculus
ttcctgcaagcagccttcagatgaa

SEQ ID NO: 391282 - DNA, 25 bp, Mus musculus
ttcctgcaagcatttgacattgtgc

SEQ ID NO: 391283 - DNA, 25 bp, Mus musculus
ttcctgcaagggtggccatgggtga

SEQ ID NO: 391284 - DNA, 25 bp, Mus musculus
ttcctgcacagcgggctgacggctg

SEQ ID NO: 391285 - DNA, 25 bp, Mus musculus
ttcctgcacctaccaaactggcatt

SEQ ID NO: 391286 - DNA, 25 bp, Mus musculus
ttcctgcactttgaggaggaagaga

SEQ ID NO: 391287 - DNA, 25 bp, Mus musculus
ttcctgcaggaccaggtgtcatttg

SEQ ID NO: 391288 - DNA, 25 bp, Mus musculus
ttcctgcaggaccaggtgtctgatc

SEQ ID NO: 391289 - DNA, 25 bp, Mus musculus
ttcctgcaggaggcagcgggccgtg

SEQ ID NO: 391290 - DNA, 25 bp, Mus musculus
ttcctgcatcttccttcctaggcat

SEQ ID NO: 391291 - DNA, 25 bp, Mus musculus
ttcctgcatgctgggtccttcagga

SEQ ID NO: 391292 - DNA, 25 bp, Mus musculus
ttcctgccacctggagatggtgttt

SEQ ID NO: 391293 - DNA, 25 bp, Mus musculus
ttcctgccagactgggtttgtcatg

SEQ ID NO: 391294 - DNA, 25 bp, Mus musculus
ttcctgccagggtgactctgatggc

SEQ ID NO: 391295 - DNA, 25 bp, Mus musculus
ttcctgccagggtgactctggtggc

SEQ ID NO: 391296 - DNA, 25 bp, Mus musculus
ttcctgcccacctggtacttcctgt

SEQ ID NO: 391297 - DNA, 25 bp, Mus musculus
ttcctgcccacctggttcccagagc

SEQ ID NO: 391298 - DNA, 25 bp, Mus musculus
ttcctgcccagtgggcagctgatca

SEQ ID NO: 391299 - DNA, 25 bp, Mus musculus
ttcctgccccagaaaacatcggacc

SEQ ID NO: 391300 - DNA, 25 bp, Mus musculus
ttcctgcccccagaacctggaccct

SEQ ID NO: 391301 - DNA, 25 bp, Mus musculus
ttcctgccccgtgaggagactgctc

SEQ ID NO: 391302 - DNA, 25 bp, Mus musculus
ttcctgccctcgctagttctgacgg

SEQ ID NO: 391303 - DNA, 25 bp, Mus musculus
ttcctgcctaacaggtcgctgttat

SEQ ID NO: 391304 - DNA, 25 bp, Mus musculus
ttcctgcctagctttgtatagtcca

SEQ ID NO: 391305 - DNA, 25 bp, Mus musculus
ttcctgcctcccaaggttgttaaac

SEQ ID NO: 391306 - DNA, 25 bp, Mus musculus
ttcctgcctcggttcctgtaaagct

SEQ ID NO: 391307 - DNA, 25 bp, Mus musculus
ttcctgcctgacctggagctgcagt

SEQ ID NO: 391308 - DNA, 25 bp, Mus musculus
ttcctgcctggcacggcgcaggagt

SEQ ID NO: 391309 - DNA, 25 bp, Mus musculus
ttcctgcctggtcagtgtcagctgg

SEQ ID NO: 391310 - DNA, 25 bp, Mus musculus
ttcctgccttgattggccctccttt

SEQ ID NO: 391311 - DNA, 25 bp, Mus musculus
ttcctgcgaggctgctccactactc

SEQ ID NO: 391312 - DNA, 25 bp, Mus musculus
ttcctgctaccataggagactacac

SEQ ID NO: 391313 - DNA, 25 bp, Mus musculus
ttcctgctaccataggctccactta

SEQ ID NO: 391314 - DNA, 25 bp, Mus musculus
ttcctgctcaagttcgattggatcc

SEQ ID NO: 391315 - DNA, 25 bp, Mus musculus
ttcctgctcaagttcttctctgtgt

SEQ ID NO: 391316 - DNA, 25 bp, Mus musculus
ttcctgctcaggagactgcttctaa

SEQ ID NO: 391317 - DNA, 25 bp, Mus musculus
ttcctgctcccaagcccttggacat

SEQ ID NO: 391318 - DNA, 25 bp, Mus musculus
ttcctgctctgaaagcttactgata

SEQ ID NO: 391319 - DNA, 25 bp, Mus musculus
ttcctgctgaacgagggttcagccg

SEQ ID NO: 391320 - DNA, 25 bp, Mus musculus
ttcctgctgacaagccgatacacct

SEQ ID NO: 391321 - DNA, 25 bp, Mus musculus
ttcctgctgcagaacgagtttgttg

SEQ ID NO: 391322 - DNA, 25 bp, Mus musculus
ttcctgctgcaggctctggtccaag

SEQ ID NO: 391323 - DNA, 25 bp, Mus musculus
ttcctgctgcgctctgtgccaacgc

SEQ ID NO: 391324 - DNA, 25 bp, Mus musculus
ttcctgctgctaaagcttattgagc

SEQ ID NO: 391325 - DNA, 25 bp, Mus musculus
ttcctgctgctaaagggttatcaca

SEQ ID NO: 391326 - DNA, 25 bp, Mus musculus
ttcctgctgctgaagaacttttcca

SEQ ID NO: 391327 - DNA, 25 bp, Mus musculus
ttcctgctggccggcattgaatgtc

SEQ ID NO: 391328 - DNA, 25 bp, Mus musculus
ttcctgctggtgtcagtgtctgaaa

SEQ ID NO: 391329 - DNA, 25 bp, Mus musculus
ttcctgcttcctgccacagcaccca

SEQ ID NO: 391330 - DNA, 25 bp, Mus musculus
ttcctggaaaattgttgtgtctgtg

SEQ ID NO: 391331 - DNA, 25 bp, Mus musculus
ttcctggaaacgactacatcgacca

SEQ ID NO: 391332 - DNA, 25 bp, Mus musculus
ttcctggaaacgacttgtaccaggg

SEQ ID NO: 391333 - DNA, 25 bp, Mus musculus
ttcctggaaatccactgcagctcat

SEQ ID NO: 391334 - DNA, 25 bp, Mus musculus
ttcctggaaatgcacggggagatgt

SEQ ID NO: 391335 - DNA, 25 bp, Mus musculus
ttcctggaacagactaaggctggac

SEQ ID NO: 391336 - DNA, 25 bp, Mus musculus
ttcctggaacaggtgacatgtatga

SEQ ID NO: 391337 - DNA, 25 bp, Mus musculus
ttcctggacaagaggggaagtccct

SEQ ID NO: 391338 - DNA, 25 bp, Mus musculus
ttcctggacaaggtagagcctcagg

SEQ ID NO: 391339 - DNA, 25 bp, Mus musculus
ttcctggacctcctggtccaaatgg

SEQ ID NO: 391340 - DNA, 25 bp, Mus musculus
ttcctggacgccattcccccacttt

SEQ ID NO: 391341 - DNA, 25 bp, Mus musculus
ttcctggacttcgggtcagtgaatg

SEQ ID NO: 391342 - DNA, 25 bp, Mus musculus
ttcctggacttcggtatatccaaag

SEQ ID NO: 391343 - DNA, 25 bp, Mus musculus
ttcctggagacaagtagtcttttac

SEQ ID NO: 391344 - DNA, 25 bp, Mus musculus
ttcctggagagaaagacggtcgctg

SEQ ID NO: 391345 - DNA, 25 bp, Mus musculus
ttcctggagaggagggtctagagac

SEQ ID NO: 391346 - DNA, 25 bp, Mus musculus
ttcctggagccaggggtcttaccgg

SEQ ID NO: 391347 - DNA, 25 bp, Mus musculus
ttcctggatgccaggcgcaagcggc

SEQ ID NO: 391348 - DNA, 25 bp, Mus musculus
ttcctggatgcgttaagatctccat

SEQ ID NO: 391349 - DNA, 25 bp, Mus musculus
ttcctggcacagaaacatcatccaa

SEQ ID NO: 391350 - DNA, 25 bp, Mus musculus
ttcctggcacagcaagcttccctgg

SEQ ID NO: 391351 - DNA, 25 bp, Mus musculus
ttcctggcactgcagagcaaaaaaa

SEQ ID NO: 391352 - DNA, 25 bp, Mus musculus
ttcctggcactgcagtggagaaagc

SEQ ID NO: 391353 - DNA, 25 bp, Mus musculus
ttcctggcagcactgtccatccaag

SEQ ID NO: 391354 - DNA, 25 bp, Mus musculus
ttcctggcagcagacttttcacaga

SEQ ID NO: 391355 - DNA, 25 bp, Mus musculus
ttcctggcagcctcgggatggatgg

SEQ ID NO: 391356 - DNA, 25 bp, Mus musculus
ttcctggcccagcgggtacaccagg

SEQ ID NO: 391357 - DNA, 25 bp, Mus musculus
ttcctggcccccaaggccatgaaga

SEQ ID NO: 391358 - DNA, 25 bp, Mus musculus
ttcctggccgctcagaaaagatgtc

SEQ ID NO: 391359 - DNA, 25 bp, Mus musculus
ttcctggccgctcagtgtcttaaaa

SEQ ID NO: 391360 - DNA, 25 bp, Mus musculus
ttcctggcgagcggatctacgaagt

SEQ ID NO: 391361 - DNA, 25 bp, Mus musculus
ttcctggctctatccaggcttacaa

SEQ ID NO: 391362 - DNA, 25 bp, Mus musculus
ttcctggctctctacctggccaatg

SEQ ID NO: 391363 - DNA, 25 bp, Mus musculus
ttcctggctgaggtactttctgaac

SEQ ID NO: 391364 - DNA, 25 bp, Mus musculus
ttcctggcttgcacaccggggccct

SEQ ID NO: 391365 - DNA, 25 bp, Mus musculus
ttcctggcttgcagtgtgcctgcag

SEQ ID NO: 391366 - DNA, 25 bp, Mus musculus
ttcctgggacctggtcactcctgtc

SEQ ID NO: 391367 - DNA, 25 bp, Mus musculus
ttcctgggactcagatggaccacac

SEQ ID NO: 391368 - DNA, 25 bp, Mus musculus
ttcctgggagaaacactcatcattg

SEQ ID NO: 391369 - DNA, 25 bp, Mus musculus
ttcctgggatctgaacttcactgga

SEQ ID NO: 391370 - DNA, 25 bp, Mus musculus
ttcctgggatctgctgtgtcccagg

SEQ ID NO: 391371 - DNA, 25 bp, Mus musculus
ttcctgggatgttgggtagcggaaa

SEQ ID NO: 391372 - DNA, 25 bp, Mus musculus
ttcctgggcacagaccgcgggacag

SEQ ID NO: 391373 - DNA, 25 bp, Mus musculus
ttcctgggcacctgactcagcgtga

SEQ ID NO: 391374 - DNA, 25 bp, Mus musculus
ttcctgggcagactcagccatggtc

SEQ ID NO: 391375 - DNA, 25 bp, Mus musculus
ttcctggggatgggagtgagtgctg

SEQ ID NO: 391376 - DNA, 25 bp, Mus musculus
ttcctgggtacaggcaaccaagaac

SEQ ID NO: 391377 - DNA, 25 bp, Mus musculus
ttcctgggtacaggtcggccagtga

SEQ ID NO: 391378 - DNA, 25 bp, Mus musculus
ttcctgggtctttcgaatccttcga

SEQ ID NO: 391379 - DNA, 25 bp, Mus musculus
ttcctgggtgatgttttcagctttg

SEQ ID NO: 391380 - DNA, 25 bp, Mus musculus
ttcctgggtgtggtcaacagctgag

SEQ ID NO: 391381 - DNA, 25 bp, Mus musculus
ttcctgggttgcagcccagaggact

SEQ ID NO: 391382 - DNA, 25 bp, Mus musculus
ttcctgggttgcagttataataaag

SEQ ID NO: 391383 - DNA, 25 bp, Mus musculus
ttcctggtacagaccatattaacca

SEQ ID NO: 391384 - DNA, 25 bp, Mus musculus
ttcctggtacagaccatattgatca

SEQ ID NO: 391385 - DNA, 25 bp, Mus musculus
ttcctggtagtagatgtcccatatt

SEQ ID NO: 391386 - DNA, 25 bp, Mus musculus
ttcctggtataactatggtatcgct

SEQ ID NO: 391387 - DNA, 25 bp, Mus musculus
ttcctggtcacaaggctccgacatg

SEQ ID NO: 391388 - DNA, 25 bp, Mus musculus
ttcctggtcacaagtgcgaatctgt

SEQ ID NO: 391389 - DNA, 25 bp, Mus musculus
ttcctggtgctacctttttttgatc

SEQ ID NO: 391390 - DNA, 25 bp, Mus musculus
ttcctggtgctagcacaggttagtg

SEQ ID NO: 391391 - DNA, 25 bp, Mus musculus
ttcctggtgctagctggtgaagaca

SEQ ID NO: 391392 - DNA, 25 bp, Mus musculus
ttcctggtgctaggagtggcctgca

SEQ ID NO: 391393 - DNA, 25 bp, Mus musculus
ttcctggtgctggagagcaaaaaaa

SEQ ID NO: 391394 - DNA, 25 bp, Mus musculus
ttcctggtgctggagtggagaaagc

SEQ ID NO: 391395 - DNA, 25 bp, Mus musculus
ttcctggtgtaaagggagatcgagg

SEQ ID NO: 391396 - DNA, 25 bp, Mus musculus
ttcctggtgtcaaaggagaccaagg

SEQ ID NO: 391397 - DNA, 25 bp, Mus musculus
ttcctgtaaggacttaaatatttta

SEQ ID NO: 391398 - DNA, 25 bp, Mus musculus
ttcctgtaaggagacgttcatttga

SEQ ID NO: 391399 - DNA, 25 bp, Mus musculus
ttcctgtagccaagaccacatcctt

SEQ ID NO: 391400 - DNA, 25 bp, Mus musculus
ttcctgtagccaaggtcagattacc

SEQ ID NO: 391401 - DNA, 25 bp, Mus musculus
ttcctgtatcagggtgcgcaggctt

SEQ ID NO: 391402 - DNA, 25 bp, Mus musculus
ttcctgtatttaagaatgcaccaaa

SEQ ID NO: 391403 - DNA, 25 bp, Mus musculus
ttcctgtatttaaggcccatctccg

SEQ ID NO: 391404 - DNA, 25 bp, Mus musculus
ttcctgtatttaaggttcttggact

SEQ ID NO: 391405 - DNA, 25 bp, Mus musculus
ttcctgtcagccggggcctccccca

SEQ ID NO: 391406 - DNA, 25 bp, Mus musculus
ttcctgtcagccggtaacctccgtg

SEQ ID NO: 391407 - DNA, 25 bp, Mus musculus
ttcctgtcagggattgtgccatctt

SEQ ID NO: 391408 - DNA, 25 bp, Mus musculus
ttcctgtcagtgctctggatgttct

SEQ ID NO: 391409 - DNA, 25 bp, Mus musculus
ttcctgtccaccctgttggcagaag

SEQ ID NO: 391410 - DNA, 25 bp, Mus musculus
ttcctgtccagagagaacattataa

SEQ ID NO: 391411 - DNA, 25 bp, Mus musculus
ttcctgtccaggagagaacacaagc

SEQ ID NO: 391412 - DNA, 25 bp, Mus musculus
ttcctgtccgtacagagactcagcc

SEQ ID NO: 391413 - DNA, 25 bp, Mus musculus
ttcctgtgaaccgatttaaaggaat

SEQ ID NO: 391414 - DNA, 25 bp, Mus musculus
ttcctgtgcaatgaccggggtcgct

SEQ ID NO: 391415 - DNA, 25 bp, Mus musculus
ttcctgtggagtgtggattttatgg

SEQ ID NO: 391416 - DNA, 25 bp, Mus musculus
ttcctgtgtcccgtgtcacaatggg

SEQ ID NO: 391417 - DNA, 25 bp, Mus musculus
ttcctgtgtgccctgctttccccag

SEQ ID NO: 391418 - DNA, 25 bp, Mus musculus
ttcctgtgtggaacaacgaagccta

SEQ ID NO: 391419 - DNA, 25 bp, Mus musculus
ttcctgttcagggagaggcggtgag

SEQ ID NO: 391420 - DNA, 25 bp, Mus musculus
ttcctgttcaggtccgcgaatacct

SEQ ID NO: 391421 - DNA, 25 bp, Mus musculus
ttcctgttcggaacctggacttgag

SEQ ID NO: 391422 - DNA, 25 bp, Mus musculus
ttcctgttctgcatctcaccagccc

SEQ ID NO: 391423 - DNA, 25 bp, Mus musculus
ttcctgttggcaaccgtgtcttcac

SEQ ID NO: 391424 - DNA, 25 bp, Mus musculus
ttcctgttgggcatctcctatgtcg

SEQ ID NO: 391425 - DNA, 25 bp, Mus musculus
ttcctgtttgcagtatgatctggac

SEQ ID NO: 391426 - DNA, 25 bp, Mus musculus
ttcctgttttatggctggcctggtc

SEQ ID NO: 391427 - DNA, 25 bp, Mus musculus
ttccttaaacaagatccatgcatac

SEQ ID NO: 391428 - DNA, 25 bp, Mus musculus
ttccttaaagggattggagctggag

SEQ ID NO: 391429 - DNA, 25 bp, Mus musculus
ttccttaaaggggcgacctggcatt

SEQ ID NO: 391430 - DNA, 25 bp, Mus musculus
ttccttaacctgggatcgcttacac

SEQ ID NO: 391431 - DNA, 25 bp, Mus musculus
ttccttaactcatgcagatgtcaac

SEQ ID NO: 391432 - DNA, 25 bp, Mus musculus
ttccttaactgcaacaagtttttct

SEQ ID NO: 391433 - DNA, 25 bp, Mus musculus
ttccttaatccaggaagcatttgtc

SEQ ID NO: 391434 - DNA, 25 bp, Mus musculus
ttccttacaggtaaacagggattcg

SEQ ID NO: 391435 - DNA, 25 bp, Mus musculus
ttccttacagtgtcctagatgatga

SEQ ID NO: 391436 - DNA, 25 bp, Mus musculus
ttccttagagcagaacatctggccc

SEQ ID NO: 391437 - DNA, 25 bp, Mus musculus
ttccttagcaaccttccatggctca

SEQ ID NO: 391438 - DNA, 25 bp, Mus musculus
ttccttatagtctgattcctttctc

SEQ ID NO: 391439 - DNA, 25 bp, Mus musculus
ttccttatcagaggtcgactcatgg

SEQ ID NO: 391440 - DNA, 25 bp, Mus musculus
ttccttatcaggaactcaataaaca

SEQ ID NO: 391441 - DNA, 25 bp, Mus musculus
ttccttatcagtcaggattctgaat

SEQ ID NO: 391442 - DNA, 25 bp, Mus musculus
ttccttatcagtgtagcccagtgaa

SEQ ID NO: 391443 - DNA, 25 bp, Mus musculus
ttccttatctaacagtgtcattcag

SEQ ID NO: 391444 - DNA, 25 bp, Mus musculus
ttccttatctacgagaccctcctct

SEQ ID NO: 391445 - DNA, 25 bp, Mus musculus
ttccttatctatttttcatcatcgg

SEQ ID NO: 391446 - DNA, 25 bp, Mus musculus
ttccttatttctgtgacagctatat

SEQ ID NO: 391447 - DNA, 25 bp, Mus musculus
ttccttcaagagcatgctgggactt

SEQ ID NO: 391448 - DNA, 25 bp, Mus musculus
ttccttcaagggacttcctcgccca

SEQ ID NO: 391449 - DNA, 25 bp, Mus musculus
ttccttcacaacagcgaggtgtacc

SEQ ID NO: 391450 - DNA, 25 bp, Mus musculus
ttccttcagctacgaaccaaaaacc

SEQ ID NO: 391451 - DNA, 25 bp, Mus musculus
ttccttcagtgaggaggcttacatc

SEQ ID NO: 391452 - DNA, 25 bp, Mus musculus
ttccttcatagaagatcaagatgta

SEQ ID NO: 391453 - DNA, 25 bp, Mus musculus
ttccttcatagaaggtacttcaaga

SEQ ID NO: 391454 - DNA, 25 bp, Mus musculus
ttccttcatagaaggttctcattgt

SEQ ID NO: 391455 - DNA, 25 bp, Mus musculus
ttccttcatccgctctgctttccgg

SEQ ID NO: 391456 - DNA, 25 bp, Mus musculus
ttccttcatgacagaggacatttga

SEQ ID NO: 391457 - DNA, 25 bp, Mus musculus
ttccttcatgacagatttctcagga

SEQ ID NO: 391458 - DNA, 25 bp, Mus musculus
ttccttccaactcaggctgcttctg

SEQ ID NO: 391459 - DNA, 25 bp, Mus musculus
ttccttccagtgagcttgcttccca

SEQ ID NO: 391460 - DNA, 25 bp, Mus musculus
ttccttcccagtggggctcaagagt

SEQ ID NO: 391461 - DNA, 25 bp, Mus musculus
ttccttcccagtggggtacatgtac

SEQ ID NO: 391462 - DNA, 25 bp, Mus musculus
ttccttcctatgggctggtggaata

SEQ ID NO: 391463 - DNA, 25 bp, Mus musculus
ttccttcctggaggacgacttcatc

SEQ ID NO: 391464 - DNA, 25 bp, Mus musculus
ttccttctaagattggtgtcccttt

SEQ ID NO: 391465 - DNA, 25 bp, Mus musculus
ttccttctccactacctcctccacc

SEQ ID NO: 391466 - DNA, 25 bp, Mus musculus
ttccttctgcggagaacgttttaga

SEQ ID NO: 391467 - DNA, 25 bp, Mus musculus
ttccttctgcttctaccaggccctg

SEQ ID NO: 391468 - DNA, 25 bp, Mus musculus
ttccttctggttctggctgatctct

SEQ ID NO: 391469 - DNA, 25 bp, Mus musculus
ttccttctgtggagcggatgtgggt

SEQ ID NO: 391470 - DNA, 25 bp, Mus musculus
ttccttcttcttcaggcaacagact

SEQ ID NO: 391471 - DNA, 25 bp, Mus musculus
ttccttcttcttcaggttgccagtc

SEQ ID NO: 391472 - DNA, 25 bp, Mus musculus
ttccttgaagaggagcagacagatc

SEQ ID NO: 391473 - DNA, 25 bp, Mus musculus
ttccttgaagaggttgcccacggac

SEQ ID NO: 391474 - DNA, 25 bp, Mus musculus
ttccttgcagatatactgctgttct

SEQ ID NO: 391475 - DNA, 25 bp, Mus musculus
ttccttgcaggtccattcacacagc

SEQ ID NO: 391476 - DNA, 25 bp, Mus musculus
ttccttggaggactcaaggaaatcg

SEQ ID NO: 391477 - DNA, 25 bp, Mus musculus
ttccttggaggttcattctgtggtg

SEQ ID NO: 391478 - DNA, 25 bp, Mus musculus
ttccttggctcatcagcagttattc

SEQ ID NO: 391479 - DNA, 25 bp, Mus musculus
ttccttgtcaaacccaacagttccc

SEQ ID NO: 391480 - DNA, 25 bp, Mus musculus
ttccttgtcaacaatcaagatgacg

SEQ ID NO: 391481 - DNA, 25 bp, Mus musculus
ttccttgtccagattatgaagtatg

SEQ ID NO: 391482 - DNA, 25 bp, Mus musculus
ttccttgtccagtggttttaggtga

SEQ ID NO: 391483 - DNA, 25 bp, Mus musculus
ttccttgtggaggtcttccaagttg

SEQ ID NO: 391484 - DNA, 25 bp, Mus musculus
ttccttgttcatagggcggcggggc

SEQ ID NO: 391485 - DNA, 25 bp, Mus musculus
ttccttgttcatccgaacaaaaaag

SEQ ID NO: 391486 - DNA, 25 bp, Mus musculus
ttcctttaaaagatcagcatggaga

SEQ ID NO: 391487 - DNA, 25 bp, Mus musculus
ttcctttacagcaaggtgaataaat

SEQ ID NO: 391488 - DNA, 25 bp, Mus musculus
ttcctttatagaggacaaggaatat

SEQ ID NO: 391489 - DNA, 25 bp, Mus musculus
ttcctttcacagaaggagacattct

SEQ ID NO: 391490 - DNA, 25 bp, Mus musculus
ttcctttcaccgccgctttgacctc

SEQ ID NO: 391491 - DNA, 25 bp, Mus musculus
ttcctttcaggatggcctcaggcaa

SEQ ID NO: 391492 - DNA, 25 bp, Mus musculus
ttcctttcaggcaagtacattgcct

SEQ ID NO: 391493 - DNA, 25 bp, Mus musculus
ttcctttcaggcctcagggctggct

SEQ ID NO: 391494 - DNA, 25 bp, Mus musculus
ttcctttccgtagccagcccaggct

SEQ ID NO: 391495 - DNA, 25 bp, Mus musculus
ttcctttcctaagaaccaagacaac

SEQ ID NO: 391496 - DNA, 25 bp, Mus musculus
ttcctttcttaccctcagctggata

SEQ ID NO: 391497 - DNA, 25 bp, Mus musculus
ttcctttgactgtggcagccacagc

SEQ ID NO: 391498 - DNA, 25 bp, Mus musculus
ttcctttgaggaaatggatccacct

SEQ ID NO: 391499 - DNA, 25 bp, Mus musculus
ttcctttgaggagagtactaaattt

SEQ ID NO: 391500 - DNA, 25 bp, Mus musculus
ttcctttgaggaggattctggaggc

SEQ ID NO: 391501 - DNA, 25 bp, Mus musculus
ttcctttgagtccatcagcagtgtt

SEQ ID NO: 391502 - DNA, 25 bp, Mus musculus
ttcctttgcaaagtgcattgaggtc

SEQ ID NO: 391503 - DNA, 25 bp, Mus musculus
ttcctttgcacaggtgacgccatct

SEQ ID NO: 391504 - DNA, 25 bp, Mus musculus
ttcctttgcttggccacagacaagc

SEQ ID NO: 391505 - DNA, 25 bp, Mus musculus
ttcctttggaaaagttgctgtggtt

SEQ ID NO: 391506 - DNA, 25 bp, Mus musculus
ttcctttggcttccctcatcagcga

SEQ ID NO: 391507 - DNA, 25 bp, Mus musculus
ttcctttggtagactctggctggag

SEQ ID NO: 391508 - DNA, 25 bp, Mus musculus
ttcctttgttcctggggcctgtgtt

SEQ ID NO: 391509 - DNA, 25 bp, Mus musculus
ttccttttaaaactatcacttgtgg

SEQ ID NO: 391510 - DNA, 25 bp, Mus musculus
ttccttttctgaaggtgtagaagcc

SEQ ID NO: 391511 - DNA, 25 bp, Mus musculus
ttcctttttcctaactcttggcaag

SEQ ID NO: 391512 - DNA, 25 bp, Mus musculus
ttccttttttgaaggagcacatgga

SEQ ID NO: 391513 - DNA, 25 bp, Mus musculus
ttccttttttgaaggattcactagc

SEQ ID NO: 391514 - DNA, 25 bp, Mus musculus
ttcgaaaaacaaggacactgctggc

SEQ ID NO: 391515 - DNA, 25 bp, Mus musculus
ttcgaaaagagagtgtatctgtcag

SEQ ID NO: 391516 - DNA, 25 bp, Mus musculus
ttcgaaacgagaaaggtgagatctc

SEQ ID NO: 391517 - DNA, 25 bp, Mus musculus
ttcgaaactggagggctctctggga

SEQ ID NO: 391518 - DNA, 25 bp, Mus musculus
ttcgaaactggaggtgacccctgta

SEQ ID NO: 391519 - DNA, 25 bp, Mus musculus
ttcgaaactggagttacctcgctga

SEQ ID NO: 391520 - DNA, 25 bp, Mus musculus
ttcgaaagaaagatcttcctcagaa

SEQ ID NO: 391521 - DNA, 25 bp, Mus musculus
ttcgaaagaaagctgattcaagcat

SEQ ID NO: 391522 - DNA, 25 bp, Mus musculus
ttcgaaagcacagaatactattaca

SEQ ID NO: 391523 - DNA, 25 bp, Mus musculus
ttcgaaagcacaggttttgcactga

SEQ ID NO: 391524 - DNA, 25 bp, Mus musculus
ttcgaaagcacgaggatggatgcga

SEQ ID NO: 391525 - DNA, 25 bp, Mus musculus
ttcgaaagcattgcattggtctctg

SEQ ID NO: 391526 - DNA, 25 bp, Mus musculus
ttcgaaagtgaagatatggagtctg

SEQ ID NO: 391527 - DNA, 25 bp, Mus musculus
ttcgaaattacaggaagctctcgta

SEQ ID NO: 391528 - DNA, 25 bp, Mus musculus
ttcgaaatttacaatctttaagaaa

SEQ ID NO: 391529 - DNA, 25 bp, Mus musculus
ttcgaactacttaaagaaagatcac

SEQ ID NO: 391530 - DNA, 25 bp, Mus musculus
ttcgaactcttcaacaatgccatga

SEQ ID NO: 391531 - DNA, 25 bp, Mus musculus
ttcgaactcttcaagaatgccatga

SEQ ID NO: 391532 - DNA, 25 bp, Mus musculus
ttcgaagaaagaagatggacgacat

SEQ ID NO: 391533 - DNA, 25 bp, Mus musculus
ttcgaagccaaggcccaggccttgt

SEQ ID NO: 391534 - DNA, 25 bp, Mus musculus
ttcgaagctaacggggaataaaagc

SEQ ID NO: 391535 - DNA, 25 bp, Mus musculus
ttcgaagtttccagactcaaactgt

SEQ ID NO: 391536 - DNA, 25 bp, Mus musculus
ttcgaagtttccagcctcctctggt

SEQ ID NO: 391537 - DNA, 25 bp, Mus musculus
ttcgaataaggactgcatcaaattt

SEQ ID NO: 391538 - DNA, 25 bp, Mus musculus
ttcgaataagtaataaaagagcagt

SEQ ID NO: 391539 - DNA, 25 bp, Mus musculus
ttcgaataccggcatgtcatgttgc

SEQ ID NO: 391540 - DNA, 25 bp, Mus musculus
ttcgaatcaagccaaatctgaagtg

SEQ ID NO: 391541 - DNA, 25 bp, Mus musculus
ttcgaatcaagccaatccataggaa

SEQ ID NO: 391542 - DNA, 25 bp, Mus musculus
ttcgaatgcctggtgcagccggatg

SEQ ID NO: 391543 - DNA, 25 bp, Mus musculus
ttcgaattgggcggcggccagcgcg

SEQ ID NO: 391544 - DNA, 25 bp, Mus musculus
ttcgacacgccggagtctgagggtg

SEQ ID NO: 391545 - DNA, 25 bp, Mus musculus
ttcgacaggggaatctggtcggctg

SEQ ID NO: 391546 - DNA, 25 bp, Mus musculus
ttcgacaggggaatggtttggaaca

SEQ ID NO: 391547 - DNA, 25 bp, Mus musculus
ttcgacagtattccggaacctgtgc

SEQ ID NO: 391548 - DNA, 25 bp, Mus musculus
ttcgacagtgcgaaaattttgccaa

SEQ ID NO: 391549 - DNA, 25 bp, Mus musculus
ttcgacagttcacagggaaccccaa

SEQ ID NO: 391550 - DNA, 25 bp, Mus musculus
ttcgacatagaaaggccaccttagg

SEQ ID NO: 391551 - DNA, 25 bp, Mus musculus
ttcgacatagaaagggagccaccca

SEQ ID NO: 391552 - DNA, 25 bp, Mus musculus
ttcgaccagtggggagtggagctgg

SEQ ID NO: 391553 - DNA, 25 bp, Mus musculus
ttcgaccagtggggctggggaagca

SEQ ID NO: 391554 - DNA, 25 bp, Mus musculus
ttcgacctcacaaggtgactggaca

SEQ ID NO: 391555 - DNA, 25 bp, Mus musculus
ttcgacctcacaagtgcacgatctg

SEQ ID NO: 391556 - DNA, 25 bp, Mus musculus
ttcgacctgcagctttcctgcctgt

SEQ ID NO: 391557 - DNA, 25 bp, Mus musculus
ttcgacctgcagggattgctgatgg

SEQ ID NO: 391558 - DNA, 25 bp, Mus musculus
ttcgacgaactccaggatgtgtttg

SEQ ID NO: 391559 - DNA, 25 bp, Mus musculus
ttcgactccagctatgacagggact

SEQ ID NO: 391560 - DNA, 25 bp, Mus musculus
ttcgactccagctatgctcctactt

SEQ ID NO: 391561 - DNA, 25 bp, Mus musculus
ttcgactctgttggttcactttaat

SEQ ID NO: 391562 - DNA, 25 bp, Mus musculus
ttcgactggaacatggtgcagcccg

SEQ ID NO: 391563 - DNA, 25 bp, Mus musculus
ttcgacttcaggtctgtggccatga

SEQ ID NO: 391564 - DNA, 25 bp, Mus musculus
ttcgactttacttctgtggagtcaa

SEQ ID NO: 391565 - DNA, 25 bp, Mus musculus
ttcgagaaaagatgagagtcacgga

SEQ ID NO: 391566 - DNA, 25 bp, Mus musculus
ttcgagaaaaggaaaatgagaagtg

SEQ ID NO: 391567 - DNA, 25 bp, Mus musculus
ttcgagaaagaagcctcaggtacag

SEQ ID NO: 391568 - DNA, 25 bp, Mus musculus
ttcgagaaatgagtcctctctggga

SEQ ID NO: 391569 - DNA, 25 bp, Mus musculus
ttcgagaagaacgaggccatccagg

SEQ ID NO: 391570 - DNA, 25 bp, Mus musculus
ttcgagaagaacgaggcggcccatg

SEQ ID NO: 391571 - DNA, 25 bp, Mus musculus
ttcgagaagtcaaccatccaaaact

SEQ ID NO: 391572 - DNA, 25 bp, Mus musculus
ttcgagaatgacatgggatacaaac

SEQ ID NO: 391573 - DNA, 25 bp, Mus musculus
ttcgagaatgagatgagctgcccga

SEQ ID NO: 391574 - DNA, 25 bp, Mus musculus
ttcgagatgatgcagaacatgttgg

SEQ ID NO: 391575 - DNA, 25 bp, Mus musculus
ttcgagcacatgcccttaggcccag

SEQ ID NO: 391576 - DNA, 25 bp, Mus musculus
ttcgagcacatgggagtgttgtgaa

SEQ ID NO: 391577 - DNA, 25 bp, Mus musculus
ttcgagcacatgtaatagcgctcat

SEQ ID NO: 391578 - DNA, 25 bp, Mus musculus
ttcgagcacatgtttaggtaatagc

SEQ ID NO: 391579 - DNA, 25 bp, Mus musculus
ttcgagcacttccggtggacactgc

SEQ ID NO: 391580 - DNA, 25 bp, Mus musculus
ttcgagcacttccgtgtctgtctct

SEQ ID NO: 391581 - DNA, 25 bp, Mus musculus
ttcgagccagcataggtgcaacaag

SEQ ID NO: 391582 - DNA, 25 bp, Mus musculus
ttcgagcccgggcaggtaaatttaa

SEQ ID NO: 391583 - DNA, 25 bp, Mus musculus
ttcgagcggactcagacggtcagcg

SEQ ID NO: 391584 - DNA, 25 bp, Mus musculus
ttcgagctattttggattactataa

SEQ ID NO: 391585 - DNA, 25 bp, Mus musculus
ttcgagctgaagggaagtgaccaag

SEQ ID NO: 391586 - DNA, 25 bp, Mus musculus
ttcgagctgaagggctctcctgctg

SEQ ID NO: 391587 - DNA, 25 bp, Mus musculus
ttcgagctggggttattcccaattg

SEQ ID NO: 391588 - DNA, 25 bp, Mus musculus
ttcgagcttctgcaaggttctgtcc

SEQ ID NO: 391589 - DNA, 25 bp, Mus musculus
ttcgaggacccgcgagatgctgagg

SEQ ID NO: 391590 - DNA, 25 bp, Mus musculus
ttcgaggacgattacgtgcactcta

SEQ ID NO: 391591 - DNA, 25 bp, Mus musculus
ttcgaggagactcctgaggcttttg

SEQ ID NO: 391592 - DNA, 25 bp, Mus musculus
ttcgaggcaataaattggagagagg

SEQ ID NO: 391593 - DNA, 25 bp, Mus musculus
ttcgaggccagccggctacacagag

SEQ ID NO: 391594 - DNA, 25 bp, Mus musculus
ttcgaggctaatgaggaagcattag

SEQ ID NO: 391595 - DNA, 25 bp, Mus musculus
ttcgaggctaatgaggtttctggct

SEQ ID NO: 391596 - DNA, 25 bp, Mus musculus
ttcgagggcacaggcggacctatgt

SEQ ID NO: 391597 - DNA, 25 bp, Mus musculus
ttcgagggcagagagtctcgctctc

SEQ ID NO: 391598 - DNA, 25 bp, Mus musculus
ttcgagggcagagttaatgttcgtg

SEQ ID NO: 391599 - DNA, 25 bp, Mus musculus
ttcgagtcacaggcctgagggccag

SEQ ID NO: 391600 - DNA, 25 bp, Mus musculus
ttcgagtcacagggggtgacatggc

SEQ ID NO: 391601 - DNA, 25 bp, Mus musculus
ttcgataatttcaatgtccttggct

SEQ ID NO: 391602 - DNA, 25 bp, Mus musculus
ttcgataccgacatccatgctgtcc

SEQ ID NO: 391603 - DNA, 25 bp, Mus musculus
ttcgatcagtgagctcctgctgttc

SEQ ID NO: 391604 - DNA, 25 bp, Mus musculus
ttcgatccaagtgagttacaagact

SEQ ID NO: 391605 - DNA, 25 bp, Mus musculus
ttcgatccaggctccccggctgtca

SEQ ID NO: 391606 - DNA, 25 bp, Mus musculus
ttcgatccaggtgctaccaagtaca

SEQ ID NO: 391607 - DNA, 25 bp, Mus musculus
ttcgatccgcccaagagctcaaagc

SEQ ID NO: 391608 - DNA, 25 bp, Mus musculus
ttcgatgacgattgtggtgggttgt

SEQ ID NO: 391609 - DNA, 25 bp, Mus musculus
ttcgatgagcgcattttaaagccca

SEQ ID NO: 391610 - DNA, 25 bp, Mus musculus
ttcgatggcatgtggctcctaccca

SEQ ID NO: 391611 - DNA, 25 bp, Mus musculus
ttcgatgtcgccagcgcccctccag

SEQ ID NO: 391612 - DNA, 25 bp, Mus musculus
ttcgatgttcaggagcaggatattg

SEQ ID NO: 391613 - DNA, 25 bp, Mus musculus
ttcgatgttcagggcaaccgtcctg

SEQ ID NO: 391614 - DNA, 25 bp, Mus musculus
ttcgattcaaccacaatgacggatt

SEQ ID NO: 391615 - DNA, 25 bp, Mus musculus
ttcgatttgcgatcttctgcctatt

SEQ ID NO: 391616 - DNA, 25 bp, Mus musculus
ttcgatttgctttgtccatacgttc

SEQ ID NO: 391617 - DNA, 25 bp, Mus musculus
ttcgcaaacgtccagcgtttggagc

SEQ ID NO: 391618 - DNA, 25 bp, Mus musculus
ttcgcaaacgtccaggagcaggcct

SEQ ID NO: 391619 - DNA, 25 bp, Mus musculus
ttcgcaaagactctcacccaggtga

SEQ ID NO: 391620 - DNA, 25 bp, Mus musculus
ttcgcaactatcagcccttgtttct

SEQ ID NO: 391621 - DNA, 25 bp, Mus musculus
ttcgcaactatcaggctcggaactt

SEQ ID NO: 391622 - DNA, 25 bp, Mus musculus
ttcgcaagaaatgggaaccccaaca

SEQ ID NO: 391623 - DNA, 25 bp, Mus musculus
ttcgcaagcccaagtatgatcaggg

SEQ ID NO: 391624 - DNA, 25 bp, Mus musculus
ttcgcacagtggggtcggttacgga

SEQ ID NO: 391625 - DNA, 25 bp, Mus musculus
ttcgcacagtgtgtgttttgtgcct

SEQ ID NO: 391626 - DNA, 25 bp, Mus musculus
ttcgcaccacccctgccactgccgc

SEQ ID NO: 391627 - DNA, 25 bp, Mus musculus
ttcgcagcctggacctggggattcc

SEQ ID NO: 391628 - DNA, 25 bp, Mus musculus
ttcgcagcctgttcagaattggggc

SEQ ID NO: 391629 - DNA, 25 bp, Mus musculus
ttcgcaggagggcgaagagaaagac

SEQ ID NO: 391630 - DNA, 25 bp, Mus musculus
ttcgcaggggacaagatcacctttg

SEQ ID NO: 391631 - DNA, 25 bp, Mus musculus
ttcgcataccggatggaaatgcagg

SEQ ID NO: 391632 - DNA, 25 bp, Mus musculus
ttcgcataggagagcgggctgagcg

SEQ ID NO: 391633 - DNA, 25 bp, Mus musculus
ttcgcattgcctgctccccacactc

SEQ ID NO: 391634 - DNA, 25 bp, Mus musculus
ttcgccaagatttggattcaagtca

SEQ ID NO: 391635 - DNA, 25 bp, Mus musculus
ttcgccaagtacagacttctggagg

SEQ ID NO: 391636 - DNA, 25 bp, Mus musculus
ttcgccaatggccaaatcaaagaaa

SEQ ID NO: 391637 - DNA, 25 bp, Mus musculus
ttcgccacagaaatggcctccacct

SEQ ID NO: 391638 - DNA, 25 bp, Mus musculus
ttcgccacccaagttggagtcattc

SEQ ID NO: 391639 - DNA, 25 bp, Mus musculus
ttcgccagcaacatctccagcacct

SEQ ID NO: 391640 - DNA, 25 bp, Mus musculus
ttcgccataggtaacattgccaaga

SEQ ID NO: 391641 - DNA, 25 bp, Mus musculus
ttcgccataggtagcattgccaaga

SEQ ID NO: 391642 - DNA, 25 bp, Mus musculus
ttcgccatctacgaggttcccaaag

SEQ ID NO: 391643 - DNA, 25 bp, Mus musculus
ttcgccatgtactattttacctatg

SEQ ID NO: 391644 - DNA, 25 bp, Mus musculus
ttcgcccaagaaggtggagtttgtc

SEQ ID NO: 391645 - DNA, 25 bp, Mus musculus
ttcgcccacgactgcactgggccct

SEQ ID NO: 391646 - DNA, 25 bp, Mus musculus
ttcgcccaggataaagcgattgtcc

SEQ ID NO: 391647 - DNA, 25 bp, Mus musculus
ttcgccccctggtgtggacattgca

SEQ ID NO: 391648 - DNA, 25 bp, Mus musculus
ttcgccgagcactagcgctggggac

SEQ ID NO: 391649 - DNA, 25 bp, Mus musculus
ttcgccgagccgagatactactcgt

SEQ ID NO: 391650 - DNA, 25 bp, Mus musculus
ttcgccgccatggagtcctccacct

SEQ ID NO: 391651 - DNA, 25 bp, Mus musculus
ttcgccgcgtctggtgacttctgtg

SEQ ID NO: 391652 - DNA, 25 bp, Mus musculus
ttcgcctacaggcatataccagcgt

SEQ ID NO: 391653 - DNA, 25 bp, Mus musculus
ttcgcctattgtggcaagtggtttg

SEQ ID NO: 391654 - DNA, 25 bp, Mus musculus
ttcgcctcagaggtcgagcccagtg

SEQ ID NO: 391655 - DNA, 25 bp, Mus musculus
ttcgcctcagaggtggcatgcagat

SEQ ID NO: 391656 - DNA, 25 bp, Mus musculus
ttcgcctctacctaacaccccaatt

SEQ ID NO: 391657 - DNA, 25 bp, Mus musculus
ttcgcctctacctctttctagtaac

SEQ ID NO: 391658 - DNA, 25 bp, Mus musculus
ttcgcctctgacggggcatatctgc

SEQ ID NO: 391659 - DNA, 25 bp, Mus musculus
ttcgcctgaggattggatggtgaga

SEQ ID NO: 391660 - DNA, 25 bp, Mus musculus
ttcgcctgtggaggcgcagcccggt

SEQ ID NO: 391661 - DNA, 25 bp, Mus musculus
ttcgcctgtggtgaagaagttgcaa

SEQ ID NO: 391662 - DNA, 25 bp, Mus musculus
ttcgccttcaccagggatgactctg

SEQ ID NO: 391663 - DNA, 25 bp, Mus musculus
ttcgcgacatgaatggaatgaccta

SEQ ID NO: 391664 - DNA, 25 bp, Mus musculus
ttcgcgacatgatctacttctccaa

SEQ ID NO: 391665 - DNA, 25 bp, Mus musculus
ttcgcgagaacagttcaagggcaga

SEQ ID NO: 391666 - DNA, 25 bp, Mus musculus
ttcgcgatccgcagaagacctaacc

SEQ ID NO: 391667 - DNA, 25 bp, Mus musculus
ttcgcgatccgcagagcagcttaag

SEQ ID NO: 391668 - DNA, 25 bp, Mus musculus
ttcgcgattatcagaatccctctgc

SEQ ID NO: 391669 - DNA, 25 bp, Mus musculus
ttcgcgattatcagagtccagtaga

SEQ ID NO: 391670 - DNA, 25 bp, Mus musculus
ttcgcgcactctgtgggtcatttct

SEQ ID NO: 391671 - DNA, 25 bp, Mus musculus
ttcgcgccgacgaaatggctaccaa

SEQ ID NO: 391672 - DNA, 25 bp, Mus musculus
ttcgcgcctagtattttgttaaatt

SEQ ID NO: 391673 - DNA, 25 bp, Mus musculus
ttcgcgcctggagtctcactgttag

SEQ ID NO: 391674 - DNA, 25 bp, Mus musculus
ttcgcgcgcagtggtaactcataaa

SEQ ID NO: 391675 - DNA, 25 bp, Mus musculus
ttcgcgctgtccttctcctccgcct

SEQ ID NO: 391676 - DNA, 25 bp, Mus musculus
ttcgcggaagatatatgttgggtaa

SEQ ID NO: 391677 - DNA, 25 bp, Mus musculus
ttcgcggcgctggagcctggaatgc

SEQ ID NO: 391678 - DNA, 25 bp, Mus musculus
ttcgcggcgggataaataaggaaaa

SEQ ID NO: 391679 - DNA, 25 bp, Mus musculus
ttcgcggcgggcaaatgaccatgga

SEQ ID NO: 391680 - DNA, 25 bp, Mus musculus
ttcgcggcggggtggcggtgggatc

SEQ ID NO: 391681 - DNA, 25 bp, Mus musculus
ttcgcgggcttcaggtagaagccac

SEQ ID NO: 391682 - DNA, 25 bp, Mus musculus
ttcgcgggcttcaggtgaggatccc

SEQ ID NO: 391683 - DNA, 25 bp, Mus musculus
ttcgcgggcttcagtgctggaggag

SEQ ID NO: 391684 - DNA, 25 bp, Mus musculus
ttcgcgtcacggtcttgttgcagca

SEQ ID NO: 391685 - DNA, 25 bp, Mus musculus
ttcgctacacaggacatcatgccta

SEQ ID NO: 391686 - DNA, 25 bp, Mus musculus
ttcgctacacaggagatcatgccta

SEQ ID NO: 391687 - DNA, 25 bp, Mus musculus
ttcgctacttttaagatttttgaag

SEQ ID NO: 391688 - DNA, 25 bp, Mus musculus
ttcgctccaggtgagaagtctggga

SEQ ID NO: 391689 - DNA, 25 bp, Mus musculus
ttcgctgaagagcatccgtgcagcc

SEQ ID NO: 391690 - DNA, 25 bp, Mus musculus
ttcgctgctattctccactccagag

SEQ ID NO: 391691 - DNA, 25 bp, Mus musculus
ttcgctgctgaggtcgtacaccctg

SEQ ID NO: 391692 - DNA, 25 bp, Mus musculus
ttcgctggccctcctggtgctgatg

SEQ ID NO: 391693 - DNA, 25 bp, Mus musculus
ttcgctgtgcgggtgtctccacgac

SEQ ID NO: 391694 - DNA, 25 bp, Mus musculus
ttcgctgtgcgggtgtgggcacatc

SEQ ID NO: 391695 - DNA, 25 bp, Mus musculus
ttcgcttgcaggcctacagggtgga

SEQ ID NO: 391696 - DNA, 25 bp, Mus musculus
ttcgcttgtggggaatgtttttgag

SEQ ID NO: 391697 - DNA, 25 bp, Mus musculus
ttcggaaaacaaaggcatccttact

SEQ ID NO: 391698 - DNA, 25 bp, Mus musculus
ttcggaaagttggggccctggagtc

SEQ ID NO: 391699 - DNA, 25 bp, Mus musculus
ttcggaagaggagggagaatcccgt

SEQ ID NO: 391700 - DNA, 25 bp, Mus musculus
ttcggaaggagctgactggccaatc

SEQ ID NO: 391701 - DNA, 25 bp, Mus musculus
ttcggaatctaggagcccaccttgg

SEQ ID NO: 391702 - DNA, 25 bp, Mus musculus
ttcggaatgagaaaaaggagaagaa

SEQ ID NO: 391703 - DNA, 25 bp, Mus musculus
ttcggacatctgtggttcggcagac

SEQ ID NO: 391704 - DNA, 25 bp, Mus musculus
ttcggaccactcggagatgtggtca

SEQ ID NO: 391705 - DNA, 25 bp, Mus musculus
ttcggaccactcggcctctgcagag

SEQ ID NO: 391706 - DNA, 25 bp, Mus musculus
ttcggacccacatggtggacctgct

SEQ ID NO: 391707 - DNA, 25 bp, Mus musculus
ttcggacccagtcgacctgataaaa

SEQ ID NO: 391708 - DNA, 25 bp, Mus musculus
ttcggactaggggctctgagacaga

SEQ ID NO: 391709 - DNA, 25 bp, Mus musculus
ttcggactcaggaggatatttccac

SEQ ID NO: 391710 - DNA, 25 bp, Mus musculus
ttcggagaagatgtggacccctggc

SEQ ID NO: 391711 - DNA, 25 bp, Mus musculus
ttcggagaaggcctcctgccagaag

SEQ ID NO: 391712 - DNA, 25 bp, Mus musculus
ttcggaggagccagttcttgcctta

SEQ ID NO: 391713 - DNA, 25 bp, Mus musculus
ttcggaggccagcggggctggcgct

SEQ ID NO: 391714 - DNA, 25 bp, Mus musculus
ttcggaggccagcgggggctggctt

SEQ ID NO: 391715 - DNA, 25 bp, Mus musculus
ttcggataagacagatatgaaccga

SEQ ID NO: 391716 - DNA, 25 bp, Mus musculus
ttcggatccaggacctgctgtcctt

SEQ ID NO: 391717 - DNA, 25 bp, Mus musculus
ttcggattcaggcttgtgtgtgagg

SEQ ID NO: 391718 - DNA, 25 bp, Mus musculus
ttcggattcaggtaatcgccacgtg

SEQ ID NO: 391719 - DNA, 25 bp, Mus musculus
ttcggatttggagatataaccaaga

SEQ ID NO: 391720 - DNA, 25 bp, Mus musculus
ttcggcaaaaatgagtctcatagtt

SEQ ID NO: 391721 - DNA, 25 bp, Mus musculus
ttcggcaaagagacttctggtgcgt

SEQ ID NO: 391722 - DNA, 25 bp, Mus musculus
ttcggcaaagatgacagaaggcagg

SEQ ID NO: 391723 - DNA, 25 bp, Mus musculus
ttcggcaaaggtgacatttgcaacc

SEQ ID NO: 391724 - DNA, 25 bp, Mus musculus
ttcggcaagcaaggcttatacccct

SEQ ID NO: 391725 - DNA, 25 bp, Mus musculus
ttcggcagctagagacagtccgaga

SEQ ID NO: 391726 - DNA, 25 bp, Mus musculus
ttcggcccaaagagatgaagttggc

SEQ ID NO: 391727 - DNA, 25 bp, Mus musculus
ttcggccggacgctagcagaatctt

SEQ ID NO: 391728 - DNA, 25 bp, Mus musculus
ttcggccggacgggaagcttagata

SEQ ID NO: 391729 - DNA, 25 bp, Mus musculus
ttcggccggctccattcagaacaac

SEQ ID NO: 391730 - DNA, 25 bp, Mus musculus
ttcggccttgtggtaccaatgggga

SEQ ID NO: 391731 - DNA, 25 bp, Mus musculus
ttcggcgccgatcaggttaaagatc

SEQ ID NO: 391732 - DNA, 25 bp, Mus musculus
ttcggcgctgctcggagcctggtgg

SEQ ID NO: 391733 - DNA, 25 bp, Mus musculus
ttcggcgggtctcagaaagaagaaa

SEQ ID NO: 391734 - DNA, 25 bp, Mus musculus
ttcggcgggtctcaggacaagccaa

SEQ ID NO: 391735 - DNA, 25 bp, Mus musculus
ttcggctaagaaccaaaaatcacaa

SEQ ID NO: 391736 - DNA, 25 bp, Mus musculus
ttcggctacaggagatccagtcact

SEQ ID NO: 391737 - DNA, 25 bp, Mus musculus
ttcggctacatggtcctctctctgg

SEQ ID NO: 391738 - DNA, 25 bp, Mus musculus
ttcggctactacacgtgggctgtct

SEQ ID NO: 391739 - DNA, 25 bp, Mus musculus
ttcggctcagactcgcatgtgtgga

SEQ ID NO: 391740 - DNA, 25 bp, Mus musculus
ttcggctcagggaagtgactttcac

SEQ ID NO: 391741 - DNA, 25 bp, Mus musculus
ttcggctccagaccaaagattcaag

SEQ ID NO: 391742 - DNA, 25 bp, Mus musculus
ttcggctccaggccaactggaatag

SEQ ID NO: 391743 - DNA, 25 bp, Mus musculus
ttcggctcccacagagctgatttat

SEQ ID NO: 391744 - DNA, 25 bp, Mus musculus
ttcggctcggcccagggctcccagt

SEQ ID NO: 391745 - DNA, 25 bp, Mus musculus
ttcggctctgcggggcgcctctgaa

SEQ ID NO: 391746 - DNA, 25 bp, Mus musculus
ttcggctgaacaaaccttatatcta

SEQ ID NO: 391747 - DNA, 25 bp, Mus musculus
ttcggctgaacaagttggtgacaca

SEQ ID NO: 391748 - DNA, 25 bp, Mus musculus
ttcggctgcagacttgacatcgtct

SEQ ID NO: 391749 - DNA, 25 bp, Mus musculus
ttcggctgccgactgcgaatcgcca

SEQ ID NO: 391750 - DNA, 25 bp, Mus musculus
ttcggcttgagagagagagccagct

SEQ ID NO: 391751 - DNA, 25 bp, Mus musculus
ttcgggaatctgggtggtactgggg

SEQ ID NO: 391752 - DNA, 25 bp, Mus musculus
ttcgggacagataagcagcgtgctt

SEQ ID NO: 391753 - DNA, 25 bp, Mus musculus
ttcgggaccaggtctcctgttctcc

SEQ ID NO: 391754 - DNA, 25 bp, Mus musculus
ttcgggactacaggcgagcggcgtg

SEQ ID NO: 391755 - DNA, 25 bp, Mus musculus
ttcgggactacagggtcaacgtggt

SEQ ID NO: 391756 - DNA, 25 bp, Mus musculus
ttcgggagactagcgtggcgactcc

SEQ ID NO: 391757 - DNA, 25 bp, Mus musculus
ttcgggagactaggtcacgagcctg

SEQ ID NO: 391758 - DNA, 25 bp, Mus musculus
ttcgggagaggaacagtatccagat

SEQ ID NO: 391759 - DNA, 25 bp, Mus musculus
ttcgggagaggaggtttgggatgct

SEQ ID NO: 391760 - DNA, 25 bp, Mus musculus
ttcgggagaggcattcagtggctct

SEQ ID NO: 391761 - DNA, 25 bp, Mus musculus
ttcgggcactgagcaccagttttgt

SEQ ID NO: 391762 - DNA, 25 bp, Mus musculus
ttcgggcagaagctgcgagacgctt

SEQ ID NO: 391763 - DNA, 25 bp, Mus musculus
ttcgggcagctccccctctacctgg

SEQ ID NO: 391764 - DNA, 25 bp, Mus musculus
ttcgggcatctgtgggcatgtattt

SEQ ID NO: 391765 - DNA, 25 bp, Mus musculus
ttcgggcatgagccaaagcctgcgc

SEQ ID NO: 391766 - DNA, 25 bp, Mus musculus
ttcgggcccagctctccagtctaac

SEQ ID NO: 391767 - DNA, 25 bp, Mus musculus
ttcgggcctaccaggataaggaagc

SEQ ID NO: 391768 - DNA, 25 bp, Mus musculus
ttcgggctctggaggtacccactga

SEQ ID NO: 391769 - DNA, 25 bp, Mus musculus
ttcgggctctgtaggttgtgaacca

SEQ ID NO: 391770 - DNA, 25 bp, Mus musculus
ttcggggctgacagatcaacttatg

SEQ ID NO: 391771 - DNA, 25 bp, Mus musculus
ttcgggggccagccgccgccatgat

SEQ ID NO: 391772 - DNA, 25 bp, Mus musculus
ttcgggtagccggagtatgccgcct

SEQ ID NO: 391773 - DNA, 25 bp, Mus musculus
ttcgggtcagccggatgtggagaaa

SEQ ID NO: 391774 - DNA, 25 bp, Mus musculus
ttcgggtcataccaggtaatatcct

SEQ ID NO: 391775 - DNA, 25 bp, Mus musculus
ttcgggtccccggctacagcaagtg

SEQ ID NO: 391776 - DNA, 25 bp, Mus musculus
ttcggtaaacctggagatgggtatc

SEQ ID NO: 391777 - DNA, 25 bp, Mus musculus
ttcggtattcctcaccttatggcta

SEQ ID NO: 391778 - DNA, 25 bp, Mus musculus
ttcggtattcctcagcttatggcta

SEQ ID NO: 391779 - DNA, 25 bp, Mus musculus
ttcggtccaagaggtcctccaggac

SEQ ID NO: 391780 - DNA, 25 bp, Mus musculus
ttcggtctccagattcgcctctaat

SEQ ID NO: 391781 - DNA, 25 bp, Mus musculus
ttcggtgacagggcggctactaaga

SEQ ID NO: 391782 - DNA, 25 bp, Mus musculus
ttcggtgacatgaccaatgaggaat

SEQ ID NO: 391783 - DNA, 25 bp, Mus musculus
ttcggtgagagctcaaggcttctag

SEQ ID NO: 391784 - DNA, 25 bp, Mus musculus
ttcggtgcagagccaccatgccaat

SEQ ID NO: 391785 - DNA, 25 bp, Mus musculus
ttcggtgtcaggaggacatgtctag

SEQ ID NO: 391786 - DNA, 25 bp, Mus musculus
ttcggtgtcaggggacactcttaag

SEQ ID NO: 391787 - DNA, 25 bp, Mus musculus
ttcggtgtgctcatgcccgacatcg

SEQ ID NO: 391788 - DNA, 25 bp, Mus musculus
ttcggtgtgctcatgttcgagatgc

SEQ ID NO: 391789 - DNA, 25 bp, Mus musculus
ttcggtgttcctcagcaacttgatt

SEQ ID NO: 391790 - DNA, 25 bp, Mus musculus
ttcggtgttggtctggtcagctacc

SEQ ID NO: 391791 - DNA, 25 bp, Mus musculus
ttcgtactagaggctgctgtccgtg

SEQ ID NO: 391792 - DNA, 25 bp, Mus musculus
ttcgtactagctcacttcatgacat

SEQ ID NO: 391793 - DNA, 25 bp, Mus musculus
ttcgtactagctcctggacttctag

SEQ ID NO: 391794 - DNA, 25 bp, Mus musculus
ttcgtactggagaagttatttccga

SEQ ID NO: 391795 - DNA, 25 bp, Mus musculus
ttcgtacttctacagttacccagct

SEQ ID NO: 391796 - DNA, 25 bp, Mus musculus
ttcgtagaagtggtgattgaaggtg

SEQ ID NO: 391797 - DNA, 25 bp, Mus musculus
ttcgtatacaaggaattttctcgat

SEQ ID NO: 391798 - DNA, 25 bp, Mus musculus
ttcgtatacaagttccctctaggaa

SEQ ID NO: 391799 - DNA, 25 bp, Mus musculus
ttcgtatcctagagaggtgctcggt

SEQ ID NO: 391800 - DNA, 25 bp, Mus musculus
ttcgtcagcaggaagcgcatccagt

SEQ ID NO: 391801 - DNA, 25 bp, Mus musculus
ttcgtcagcaggaagtatggaagct

SEQ ID NO: 391802 - DNA, 25 bp, Mus musculus
ttcgtcagtgtggtgatttacaaaa

SEQ ID NO: 391803 - DNA, 25 bp, Mus musculus
ttcgtcatgagatcaaggacacctt

SEQ ID NO: 391804 - DNA, 25 bp, Mus musculus
ttcgtcccaacgaaaattgaacaga

SEQ ID NO: 391805 - DNA, 25 bp, Mus musculus
ttcgtcccagcgtcagcccaggcca

SEQ ID NO: 391806 - DNA, 25 bp, Mus musculus
ttcgtcccatggtccttcagaggac

SEQ ID NO: 391807 - DNA, 25 bp, Mus musculus
ttcgtcccctcaggatcgccacgac

SEQ ID NO: 391808 - DNA, 25 bp, Mus musculus
ttcgtcctgtgagagagattccccc

SEQ ID NO: 391809 - DNA, 25 bp, Mus musculus
ttcgtcctgtgagatctatgtaaga

SEQ ID NO: 391810 - DNA, 25 bp, Mus musculus
ttcgtcgtcgtccgctccagaaatc

SEQ ID NO: 391811 - DNA, 25 bp, Mus musculus
ttcgtctaccaagctgttccacgca

SEQ ID NO: 391812 - DNA, 25 bp, Mus musculus
ttcgtctaccaaggagaggaacgtc

SEQ ID NO: 391813 - DNA, 25 bp, Mus musculus
ttcgtctccgggctggtttgataac

SEQ ID NO: 391814 - DNA, 25 bp, Mus musculus
ttcgtctctcaggtgccgcaccagt

SEQ ID NO: 391815 - DNA, 25 bp, Mus musculus
ttcgtctgaagacaaacctgagaca

SEQ ID NO: 391816 - DNA, 25 bp, Mus musculus
ttcgtctgaagatgggtcagagatg

SEQ ID NO: 391817 - DNA, 25 bp, Mus musculus
ttcgtctgaggaagaatgtttcttg

SEQ ID NO: 391818 - DNA, 25 bp, Mus musculus
ttcgtcttcatcgcgcccttgctga

SEQ ID NO: 391819 - DNA, 25 bp, Mus musculus
ttcgtcttcatcgtggacctgctgc

SEQ ID NO: 391820 - DNA, 25 bp, Mus musculus
ttcgtcttctggctggctggaggcg

SEQ ID NO: 391821 - DNA, 25 bp, Mus musculus
ttcgtctttcagctacagcggaaca

SEQ ID NO: 391822 - DNA, 25 bp, Mus musculus
ttcgtctttcaggctgatgccccaa

SEQ ID NO: 391823 - DNA, 25 bp, Mus musculus
ttcgtgaaatcttcagctgctgacc

SEQ ID NO: 391824 - DNA, 25 bp, Mus musculus
ttcgtgacacctaaggtgaaggcga

SEQ ID NO: 391825 - DNA, 25 bp, Mus musculus
ttcgtgagcgctctctgctctctgc

SEQ ID NO: 391826 - DNA, 25 bp, Mus musculus
ttcgtgagcggcaattcaaatgagt

SEQ ID NO: 391827 - DNA, 25 bp, Mus musculus
ttcgtgagtggaagaatcctcggct

SEQ ID NO: 391828 - DNA, 25 bp, Mus musculus
ttcgtgagtggaaggcgagaactcc

SEQ ID NO: 391829 - DNA, 25 bp, Mus musculus
ttcgtgagtggaaggggattttaca

SEQ ID NO: 391830 - DNA, 25 bp, Mus musculus
ttcgtgatttccagtccctgcaggg

SEQ ID NO: 391831 - DNA, 25 bp, Mus musculus
ttcgtgcacagcaaaactctttgga

SEQ ID NO: 391832 - DNA, 25 bp, Mus musculus
ttcgtgcacatttttgcagcctgtc

SEQ ID NO: 391833 - DNA, 25 bp, Mus musculus
ttcgtgcaccgtaacgtacctgaac

SEQ ID NO: 391834 - DNA, 25 bp, Mus musculus
ttcgtgcccaaggttgtccagagct

SEQ ID NO: 391835 - DNA, 25 bp, Mus musculus
ttcgtggaagaggtaaagagagatc

SEQ ID NO: 391836 - DNA, 25 bp, Mus musculus
ttcgtggaaggcaagaagaaatacc

SEQ ID NO: 391837 - DNA, 25 bp, Mus musculus
ttcgtggaaggggaagacagcgcca

SEQ ID NO: 391838 - DNA, 25 bp, Mus musculus
ttcgtggaggtcctggacctttaat

SEQ ID NO: 391839 - DNA, 25 bp, Mus musculus
ttcgtggcagatctgattgccttca

SEQ ID NO: 391840 - DNA, 25 bp, Mus musculus
ttcgtggcaggggatgatgagcaat

SEQ ID NO: 391841 - DNA, 25 bp, Mus musculus
ttcgtggcaggttgttcctacatgt

SEQ ID NO: 391842 - DNA, 25 bp, Mus musculus
ttcgtggctggcggactatttcagc

SEQ ID NO: 391843 - DNA, 25 bp, Mus musculus
ttcgtggctggtttgactcagaagg

SEQ ID NO: 391844 - DNA, 25 bp, Mus musculus
ttcgtgggaagatagacccagtgac

SEQ ID NO: 391845 - DNA, 25 bp, Mus musculus
ttcgtgggcgcccggcgcagcaagc

SEQ ID NO: 391846 - DNA, 25 bp, Mus musculus
ttcgtgtcctgcttagtcttgctgt

SEQ ID NO: 391847 - DNA, 25 bp, Mus musculus
ttcgtgtcctgcttttttcacttcc

SEQ ID NO: 391848 - DNA, 25 bp, Mus musculus
ttcgtgtctttgcgggcgtgctggt

SEQ ID NO: 391849 - DNA, 25 bp, Mus musculus
ttcgtgtctttgcgggtgcctggct

SEQ ID NO: 391850 - DNA, 25 bp, Mus musculus
ttcgtgttcactttagaacacccgg

SEQ ID NO: 391851 - DNA, 25 bp, Mus musculus
ttcgtgtttcaaaagctctcttctc

SEQ ID NO: 391852 - DNA, 25 bp, Mus musculus
ttcgtgtttcaaaaggcattgcgct

SEQ ID NO: 391853 - DNA, 25 bp, Mus musculus
ttcgtgtttcaggtattctgcgttg

SEQ ID NO: 391854 - DNA, 25 bp, Mus musculus
ttcgttaagagaggagaactttgac

SEQ ID NO: 391855 - DNA, 25 bp, Mus musculus
ttcgttcaaggggcagaatcctttc

SEQ ID NO: 391856 - DNA, 25 bp, Mus musculus
ttcgttcacggctgctcagactgca

SEQ ID NO: 391857 - DNA, 25 bp, Mus musculus
ttcgttctctagcgaaatccctctc

SEQ ID NO: 391858 - DNA, 25 bp, Mus musculus
ttcgttctctagcgtgatttttctt

SEQ ID NO: 391859 - DNA, 25 bp, Mus musculus
ttcgttctgtgatgccagcagaggg

SEQ ID NO: 391860 - DNA, 25 bp, Mus musculus
ttcgttcttagaatcctattctaag

SEQ ID NO: 391861 - DNA, 25 bp, Mus musculus
ttcgttcttagatgagcccaggtcg

SEQ ID NO: 391862 - DNA, 25 bp, Mus musculus
ttcgttgccaggagatggcctgact

SEQ ID NO: 391863 - DNA, 25 bp, Mus musculus
ttcgttgggggcactcagaaagaag

SEQ ID NO: 391864 - DNA, 25 bp, Mus musculus
ttcgtttgtcagattttccactcac

SEQ ID NO: 391865 - DNA, 25 bp, Mus musculus
ttcgtttgtgagtttgatgcagcct

SEQ ID NO: 391866 - DNA, 25 bp, Mus musculus
ttcgtttgtgagtttgtctttggag

SEQ ID NO: 391867 - DNA, 25 bp, Mus musculus
ttcgttttcacaggggccgatcaac

SEQ ID NO: 391868 - DNA, 25 bp, Mus musculus
ttcgttttcctgggagactccagaa

SEQ ID NO: 391869 - DNA, 25 bp, Mus musculus
ttcgttttctctagatccatttggg

SEQ ID NO: 391870 - DNA, 25 bp, Mus musculus
ttcgttttgacttatatgatgttga

SEQ ID NO: 391871 - DNA, 25 bp, Mus musculus
ttctaaaacaagaggagattaggtt

SEQ ID NO: 391872 - DNA, 25 bp, Mus musculus
ttctaaaaggaatattattggcgtg

SEQ ID NO: 391873 - DNA, 25 bp, Mus musculus
ttctaaacaatcagcccaggagtta

SEQ ID NO: 391874 - DNA, 25 bp, Mus musculus
ttctaaacagaaaggtgtcaactct

SEQ ID NO: 391875 - DNA, 25 bp, Mus musculus
ttctaaacagaattctgatttttta

SEQ ID NO: 391876 - DNA, 25 bp, Mus musculus
ttctaaacagatggatttactgcag

SEQ ID NO: 391877 - DNA, 25 bp, Mus musculus
ttctaaacaggatttggtgagcttt

SEQ ID NO: 391878 - DNA, 25 bp, Mus musculus
ttctaaacagggaacagcagtgcac

SEQ ID NO: 391879 - DNA, 25 bp, Mus musculus
ttctaaacgtttcactgcgcaaacc

SEQ ID NO: 391880 - DNA, 25 bp, Mus musculus
ttctaaactacatgagcgatgtcga

SEQ ID NO: 391881 - DNA, 25 bp, Mus musculus
ttctaaactaggtcatgtggtaatg

SEQ ID NO: 391882 - DNA, 25 bp, Mus musculus
ttctaaagaaaggtattgaggctct

SEQ ID NO: 391883 - DNA, 25 bp, Mus musculus
ttctaaagagaaaccatgaagtgac

SEQ ID NO: 391884 - DNA, 25 bp, Mus musculus
ttctaaagaggacagatcacagtga

SEQ ID NO: 391885 - DNA, 25 bp, Mus musculus
ttctaaagagtaaccaggactgcca

SEQ ID NO: 391886 - DNA, 25 bp, Mus musculus
ttctaaagagtccaggtctccatgt

SEQ ID NO: 391887 - DNA, 25 bp, Mus musculus
ttctaaagagttggagaacagaggc

SEQ ID NO: 391888 - DNA, 25 bp, Mus musculus
ttctaaagatgctgaaggcatcaca

SEQ ID NO: 391889 - DNA, 25 bp, Mus musculus
ttctaaagcagatactaaaatggat

SEQ ID NO: 391890 - DNA, 25 bp, Mus musculus
ttctaaagcaggtactaaaatggat

SEQ ID NO: 391891 - DNA, 25 bp, Mus musculus
ttctaaagtgaacaggccatggcgc

SEQ ID NO: 391892 - DNA, 25 bp, Mus musculus
ttctaaagtgaacaggtgccttctt

SEQ ID NO: 391893 - DNA, 25 bp, Mus musculus
ttctaaagttcaagagctgtttgac

SEQ ID NO: 391894 - DNA, 25 bp, Mus musculus
ttctaaatgaacttcagtaacttgt

SEQ ID NO: 391895 - DNA, 25 bp, Mus musculus
ttctaaatgataagaatggcacacg

SEQ ID NO: 391896 - DNA, 25 bp, Mus musculus
ttctaaatgataaggaacatgacat

SEQ ID NO: 391897 - DNA, 25 bp, Mus musculus
ttctaaattaaagactgagtgtgga

SEQ ID NO: 391898 - DNA, 25 bp, Mus musculus
ttctaacactgctgcgaccattgcc

SEQ ID NO: 391899 - DNA, 25 bp, Mus musculus
ttctaacagcagcaggaaaatggga

SEQ ID NO: 391900 - DNA, 25 bp, Mus musculus
ttctaacagctcaagatggtgagga

SEQ ID NO: 391901 - DNA, 25 bp, Mus musculus
ttctaacatattaaaggaggtcctg

SEQ ID NO: 391902 - DNA, 25 bp, Mus musculus
ttctaaccactcacaatcagcggag

SEQ ID NO: 391903 - DNA, 25 bp, Mus musculus
ttctaaccagaggcaccaggatcat

SEQ ID NO: 391904 - DNA, 25 bp, Mus musculus
ttctaacctggagaatgccctggac

SEQ ID NO: 391905 - DNA, 25 bp, Mus musculus
ttctaactcaggaaggcgaagtgca

SEQ ID NO: 391906 - DNA, 25 bp, Mus musculus
ttctaactgggttatgggtgctaca

SEQ ID NO: 391907 - DNA, 25 bp, Mus musculus
ttctaactggtagtgtgaggaaact

SEQ ID NO: 391908 - DNA, 25 bp, Mus musculus
ttctaagactcaggtaacagttcag

SEQ ID NO: 391909 - DNA, 25 bp, Mus musculus
ttctaagagcaagatatgaaatcgt

SEQ ID NO: 391910 - DNA, 25 bp, Mus musculus
ttctaagattggtgtcccttttccc

SEQ ID NO: 391911 - DNA, 25 bp, Mus musculus
ttctaagcagaagcaccgagtggat

SEQ ID NO: 391912 - DNA, 25 bp, Mus musculus
ttctaagcaggctgaggtctctagc

SEQ ID NO: 391913 - DNA, 25 bp, Mus musculus
ttctaaggattcaggctaaaaccga

SEQ ID NO: 391914 - DNA, 25 bp, Mus musculus
ttctaagtcgcaggtagaatggatg

SEQ ID NO: 391915 - DNA, 25 bp, Mus musculus
ttctaagtgaaggacagagggtacc

SEQ ID NO: 391916 - DNA, 25 bp, Mus musculus
ttctaagttggatcagtgatgatga

SEQ ID NO: 391917 - DNA, 25 bp, Mus musculus
ttctaagtttgcagcttggatgctc

SEQ ID NO: 391918 - DNA, 25 bp, Mus musculus
ttctaataaggagtggagtcaacat

SEQ ID NO: 391919 - DNA, 25 bp, Mus musculus
ttctaatcaccaagccccgcccaac

SEQ ID NO: 391920 - DNA, 25 bp, Mus musculus
ttctaatcccaagcacggtagatgg

SEQ ID NO: 391921 - DNA, 25 bp, Mus musculus
ttctaatcctaaatctccacagttg

SEQ ID NO: 391922 - DNA, 25 bp, Mus musculus
ttctaatgggggtcctgctccagaa

SEQ ID NO: 391923 - DNA, 25 bp, Mus musculus
ttctacaaaagattgatgtatcctc

SEQ ID NO: 391924 - DNA, 25 bp, Mus musculus
ttctacaaaaggtacacaataaaag

SEQ ID NO: 391925 - DNA, 25 bp, Mus musculus
ttctacaaagctgggcatggaaggg

SEQ ID NO: 391926 - DNA, 25 bp, Mus musculus
ttctacaaaggaagtaaccaggagc

SEQ ID NO: 391927 - DNA, 25 bp, Mus musculus
ttctacaacaagaaggtagaggcag

SEQ ID NO: 391928 - DNA, 25 bp, Mus musculus
ttctacaacaggccattctttgccc

SEQ ID NO: 391929 - DNA, 25 bp, Mus musculus
ttctacaacagggcatccgtccctg

SEQ ID NO: 391930 - DNA, 25 bp, Mus musculus
ttctacaaccaagaaggtttgatga

SEQ ID NO: 391931 - DNA, 25 bp, Mus musculus
ttctacaaccaaggagaatagcaaa

SEQ ID NO: 391932 - DNA, 25 bp, Mus musculus
ttctacaagaatgaggaaggcactt

SEQ ID NO: 391933 - DNA, 25 bp, Mus musculus
ttctacaagaatgcggaaggcactt

SEQ ID NO: 391934 - DNA, 25 bp, Mus musculus
ttctacaagcaagacccaagagtta

SEQ ID NO: 391935 - DNA, 25 bp, Mus musculus
ttctacaagcaaggagttacaccct

SEQ ID NO: 391936 - DNA, 25 bp, Mus musculus
ttctacaagccaggagccatgcgag

SEQ ID NO: 391937 - DNA, 25 bp, Mus musculus
ttctacacagctcacatgagccccc

SEQ ID NO: 391938 - DNA, 25 bp, Mus musculus
ttctacacccatgagcacttgctgg

SEQ ID NO: 391939 - DNA, 25 bp, Mus musculus
ttctacagaagagggtgattaaagt

SEQ ID NO: 391940 - DNA, 25 bp, Mus musculus
ttctacagcaagttcgatccttcat

SEQ ID NO: 391941 - DNA, 25 bp, Mus musculus
ttctacagcatagccctcagggatt

SEQ ID NO: 391942 - DNA, 25 bp, Mus musculus
ttctacagcatagggaagcagctgc

SEQ ID NO: 391943 - DNA, 25 bp, Mus musculus
ttctacagccatgggcttctgcttc

SEQ ID NO: 391944 - DNA, 25 bp, Mus musculus
ttctacagcccagggtctggtgaga

SEQ ID NO: 391945 - DNA, 25 bp, Mus musculus
ttctacagcccaggtttggtcatct

SEQ ID NO: 391946 - DNA, 25 bp, Mus musculus
ttctacaggccaactgccaatttgt

SEQ ID NO: 391947 - DNA, 25 bp, Mus musculus
ttctacaggctccagtctttcaccc

SEQ ID NO: 391948 - DNA, 25 bp, Mus musculus
ttctacatcctggtgtttgtggtag

SEQ ID NO: 391949 - DNA, 25 bp, Mus musculus
ttctacatctttggtattgttgggt

SEQ ID NO: 391950 - DNA, 25 bp, Mus musculus
ttctacattaggcaaatcaacaatg

SEQ ID NO: 391951 - DNA, 25 bp, Mus musculus
ttctaccagaattatatatgttggg

SEQ ID NO: 391952 - DNA, 25 bp, Mus musculus
ttctaccagaggctgtgtacagcgc

SEQ ID NO: 391953 - DNA, 25 bp, Mus musculus
ttctaccagcaaggttggcccctag

SEQ ID NO: 391954 - DNA, 25 bp, Mus musculus
ttctaccaggcggaagatggacagc

SEQ ID NO: 391955 - DNA, 25 bp, Mus musculus
ttctacccagaggaagaatttgagc

SEQ ID NO: 391956 - DNA, 25 bp, Mus musculus
ttctacccagcatagccccttcaca

SEQ ID NO: 391957 - DNA, 25 bp, Mus musculus
ttctacccatttctcccaagtgctg

SEQ ID NO: 391958 - DNA, 25 bp, Mus musculus
ttctaccccagacaagaataaggtg

SEQ ID NO: 391959 - DNA, 25 bp, Mus musculus
ttctaccccagttcccaaagtggct

SEQ ID NO: 391960 - DNA, 25 bp, Mus musculus
ttctacccgacagacatacttcctg

SEQ ID NO: 391961 - DNA, 25 bp, Mus musculus
ttctacccgacagggtgtgaacaaa

SEQ ID NO: 391962 - DNA, 25 bp, Mus musculus
ttctaccctgtccaagcccacagga

SEQ ID NO: 391963 - DNA, 25 bp, Mus musculus
ttctaccgcaacgtggtctccattg

SEQ ID NO: 391964 - DNA, 25 bp, Mus musculus
ttctaccgcagtggctgggcactga

SEQ ID NO: 391965 - DNA, 25 bp, Mus musculus
ttctaccgctcctggaggatgaaaa

SEQ ID NO: 391966 - DNA, 25 bp, Mus musculus
ttctaccgctgaaaaagcagttgat

SEQ ID NO: 391967 - DNA, 25 bp, Mus musculus
ttctaccgctttgatgcagcaatta

SEQ ID NO: 391968 - DNA, 25 bp, Mus musculus
ttctaccggtttcagacaccctatt

SEQ ID NO: 391969 - DNA, 25 bp, Mus musculus
ttctacctacaagagaactctgaag

SEQ ID NO: 391970 - DNA, 25 bp, Mus musculus
ttctacctacaagaggagagtcaaa

SEQ ID NO: 391971 - DNA, 25 bp, Mus musculus
ttctacctacaagaggtagaaagtc

SEQ ID NO: 391972 - DNA, 25 bp, Mus musculus
ttctacctgaacagggacccagaag

SEQ ID NO: 391973 - DNA, 25 bp, Mus musculus
ttctacctgaaggatctgaaaacat

SEQ ID NO: 391974 - DNA, 25 bp, Mus musculus
ttctacgagagctttaattttgcca

SEQ ID NO: 391975 - DNA, 25 bp, Mus musculus
ttctacgagagctttggtctctttg

SEQ ID NO: 391976 - DNA, 25 bp, Mus musculus
ttctacgatgagtgtaaacgaagat

SEQ ID NO: 391977 - DNA, 25 bp, Mus musculus
ttctacgccaagcatcatcagctgg

SEQ ID NO: 391978 - DNA, 25 bp, Mus musculus
ttctacgtggcagatggcagcctgc

SEQ ID NO: 391979 - DNA, 25 bp, Mus musculus
ttctactactgggactcgtactggg

SEQ ID NO: 391980 - DNA, 25 bp, Mus musculus
ttctactagagttatctgggaatgt

SEQ ID NO: 391981 - DNA, 25 bp, Mus musculus
ttctactcaaattctggaatatcct

SEQ ID NO: 391982 - DNA, 25 bp, Mus musculus
ttctactcagcttcagaggatgaat

SEQ ID NO: 391983 - DNA, 25 bp, Mus musculus
ttctactcaggaactgctgaagaag

SEQ ID NO: 391984 - DNA, 25 bp, Mus musculus
ttctactcctcgctgagcacctccc

SEQ ID NO: 391985 - DNA, 25 bp, Mus musculus
ttctactctggtgaccatagctgat

SEQ ID NO: 391986 - DNA, 25 bp, Mus musculus
ttctactctgtctgaagaagagctg

SEQ ID NO: 391987 - DNA, 25 bp, Mus musculus
ttctactgaaggcttccaaaggaat

SEQ ID NO: 391988 - DNA, 25 bp, Mus musculus
ttctactgacatgtaccataatgtc

SEQ ID NO: 391989 - DNA, 25 bp, Mus musculus
ttctactgaggtgtaaactcttcca

SEQ ID NO: 391990 - DNA, 25 bp, Mus musculus
ttctactgcggctggtgtcagtcga

SEQ ID NO: 391991 - DNA, 25 bp, Mus musculus
ttctactgcgggatggccatcgtcc

SEQ ID NO: 391992 - DNA, 25 bp, Mus musculus
ttctactgcgggcatggtgaagcct

SEQ ID NO: 391993 - DNA, 25 bp, Mus musculus
ttctacttacgaaggaagtggttcc

SEQ ID NO: 391994 - DNA, 25 bp, Mus musculus
ttctacttcctcgaggcctacaatt

SEQ ID NO: 391995 - DNA, 25 bp, Mus musculus
ttctacttgtcagattgctgcccgg

SEQ ID NO: 391996 - DNA, 25 bp, Mus musculus
ttctactttaatggtgagtacgcag

SEQ ID NO: 391997 - DNA, 25 bp, Mus musculus
ttctactttctgctttcatctccgt

SEQ ID NO: 391998 - DNA, 25 bp, Mus musculus
ttctacttttctggaggcattggag

SEQ ID NO: 391999 - DNA, 25 bp, Mus musculus
ttctagaaaacaactcccagaccta

SEQ ID NO: 392000 - DNA, 25 bp, Mus musculus
ttctagaaaacaatattgatgggca

SEQ ID NO: 392001 - DNA, 25 bp, Mus musculus
ttctagaacagttcttaggaagcaa

SEQ ID NO: 392002 - DNA, 25 bp, Mus musculus
ttctagaagaggcaatattgataat

SEQ ID NO: 392003 - DNA, 25 bp, Mus musculus
ttctagaagtggtacaaatggacct

SEQ ID NO: 392004 - DNA, 25 bp, Mus musculus
ttctagaagtggtagaaatggacct

SEQ ID NO: 392005 - DNA, 25 bp, Mus musculus
ttctagaagttggtagtttacaaat

SEQ ID NO: 392006 - DNA, 25 bp, Mus musculus
ttctagacaaggcaggttcaccgga

SEQ ID NO: 392007 - DNA, 25 bp, Mus musculus
ttctagacacagggcccatcatggc

SEQ ID NO: 392008 - DNA, 25 bp, Mus musculus
ttctagacccaggagttttgctctg

SEQ ID NO: 392009 - DNA, 25 bp, Mus musculus
ttctagacttcggatccagcaatgc

SEQ ID NO: 392010 - DNA, 25 bp, Mus musculus
ttctagactttgaggaggaagaagt

SEQ ID NO: 392011 - DNA, 25 bp, Mus musculus
ttctagagaccattgacaaagccaa

SEQ ID NO: 392012 - DNA, 25 bp, Mus musculus
ttctagatcagccaccatgcggcgt

SEQ ID NO: 392013 - DNA, 25 bp, Mus musculus
ttctagatcctgaagatgttgctgt

SEQ ID NO: 392014 - DNA, 25 bp, Mus musculus
ttctagatcctgaatgttgctgtgc

SEQ ID NO: 392015 - DNA, 25 bp, Mus musculus
ttctagatgagatatgtgaatcctc

SEQ ID NO: 392016 - DNA, 25 bp, Mus musculus
ttctagatgatatggagagcaccac

SEQ ID NO: 392017 - DNA, 25 bp, Mus musculus
ttctagatgatatggcccactatga

SEQ ID NO: 392018 - DNA, 25 bp, Mus musculus
ttctagatttaaagtgttcctagga

SEQ ID NO: 392019 - DNA, 25 bp, Mus musculus
ttctagcaccaagaaattcattcct

SEQ ID NO: 392020 - DNA, 25 bp, Mus musculus
ttctagcacttgtgcttccaatagt

SEQ ID NO: 392021 - DNA, 25 bp, Mus musculus
ttctagcagcagaaagagccgtctc

SEQ ID NO: 392022 - DNA, 25 bp, Mus musculus
ttctagcagtgcaaggtgtccgcaa

SEQ ID NO: 392023 - DNA, 25 bp, Mus musculus
ttctagcatcaaagatcttcaggat

SEQ ID NO: 392024 - DNA, 25 bp, Mus musculus
ttctagcatcaaaggccagaaacat

SEQ ID NO: 392025 - DNA, 25 bp, Mus musculus
ttctagccagctgcagacggagctg

SEQ ID NO: 392026 - DNA, 25 bp, Mus musculus
ttctagcctaccagggatggctctg

SEQ ID NO: 392027 - DNA, 25 bp, Mus musculus
ttctagctgtcgggacacagattgg

SEQ ID NO: 392028 - DNA, 25 bp, Mus musculus
ttctaggacctcgagtataactgca

SEQ ID NO: 392029 - DNA, 25 bp, Mus musculus
ttctaggatgcgatacaaatctcaa

SEQ ID NO: 392030 - DNA, 25 bp, Mus musculus
ttctaggatgcgatgccctgtggaa

SEQ ID NO: 392031 - DNA, 25 bp, Mus musculus
ttctaggatttgttgtggcttttta

SEQ ID NO: 392032 - DNA, 25 bp, Mus musculus
ttctaggggcccaggtggacaacat

SEQ ID NO: 392033 - DNA, 25 bp, Mus musculus
ttctagtaaaagtgtcctagatgat

SEQ ID NO: 392034 - DNA, 25 bp, Mus musculus
ttctagtagcttgtcttctcacagg

SEQ ID NO: 392035 - DNA, 25 bp, Mus musculus
ttctagtgactggggaattgatgtc

SEQ ID NO: 392036 - DNA, 25 bp, Mus musculus
ttctagttaagaggtttggacattt

SEQ ID NO: 392037 - DNA, 25 bp, Mus musculus
ttctagttgttggaggaactgctga

SEQ ID NO: 392038 - DNA, 25 bp, Mus musculus
ttctataaaagagcatgggtacaca

SEQ ID NO: 392039 - DNA, 25 bp, Mus musculus
ttctataaaagaggtatatattatg

SEQ ID NO: 392040 - DNA, 25 bp, Mus musculus
ttctataacggctgggcacgtggag

SEQ ID NO: 392041 - DNA, 25 bp, Mus musculus
ttctataagaactgctccgctcggc

SEQ ID NO: 392042 - DNA, 25 bp, Mus musculus
ttctataagaactggcacaagtcta

SEQ ID NO: 392043 - DNA, 25 bp, Mus musculus
ttctataagtgtgagatcgagtgct

SEQ ID NO: 392044 - DNA, 25 bp, Mus musculus
ttctatacacaggtgattttcgata

SEQ ID NO: 392045 - DNA, 25 bp, Mus musculus
ttctataccaagaagtgtcgagagc

SEQ ID NO: 392046 - DNA, 25 bp, Mus musculus
ttctataccattgacactggccaaa

SEQ ID NO: 392047 - DNA, 25 bp, Mus musculus
ttctataggagctgagacccttcct

SEQ ID NO: 392048 - DNA, 25 bp, Mus musculus
ttctatagttcaggcatctactatg

SEQ ID NO: 392049 - DNA, 25 bp, Mus musculus
ttctatatcccttgcattccatatt

SEQ ID NO: 392050 - DNA, 25 bp, Mus musculus
ttctatatgacagactccattagca

SEQ ID NO: 392051 - DNA, 25 bp, Mus musculus
ttctatatgacagggcttctggtgt

SEQ ID NO: 392052 - DNA, 25 bp, Mus musculus
ttctatcacagagctgtttggattt

SEQ ID NO: 392053 - DNA, 25 bp, Mus musculus
ttctatccagggatgaactccatcc

SEQ ID NO: 392054 - DNA, 25 bp, Mus musculus
ttctatccagggcccattgtggaag

SEQ ID NO: 392055 - DNA, 25 bp, Mus musculus
ttctatcccagaaaggatgaggcca

SEQ ID NO: 392056 - DNA, 25 bp, Mus musculus
ttctatccccaaacaggagacttaa

SEQ ID NO: 392057 - DNA, 25 bp, Mus musculus
ttctatccgccccagaccctgttag

SEQ ID NO: 392058 - DNA, 25 bp, Mus musculus
ttctatcggcatggtttgctaggta

SEQ ID NO: 392059 - DNA, 25 bp, Mus musculus
ttctatctatgaatttggaaatact

SEQ ID NO: 392060 - DNA, 25 bp, Mus musculus
ttctatctcaaagcaagccccgccc

SEQ ID NO: 392061 - DNA, 25 bp, Mus musculus
ttctatctcgcagaggagttagcga

SEQ ID NO: 392062 - DNA, 25 bp, Mus musculus
ttctatctttggtatagttggaatt

SEQ ID NO: 392063 - DNA, 25 bp, Mus musculus
ttctatctttttgagttgtgtaaaa

SEQ ID NO: 392064 - DNA, 25 bp, Mus musculus
ttctatgagaaagtccctccaggag

SEQ ID NO: 392065 - DNA, 25 bp, Mus musculus
ttctatgatgattcggctcctttga

SEQ ID NO: 392066 - DNA, 25 bp, Mus musculus
ttctatgatggagaatccgggctgg

SEQ ID NO: 392067 - DNA, 25 bp, Mus musculus
ttctatgcaggcacggtgctgttgt

SEQ ID NO: 392068 - DNA, 25 bp, Mus musculus
ttctatgccagacttggaggtaaca

SEQ ID NO: 392069 - DNA, 25 bp, Mus musculus
ttctatgccatgaagcagaagggac

SEQ ID NO: 392070 - DNA, 25 bp, Mus musculus
ttctatgctaataacatgtacctga

SEQ ID NO: 392071 - DNA, 25 bp, Mus musculus
ttctatgctaggtattctctgaaaa

SEQ ID NO: 392072 - DNA, 25 bp, Mus musculus
ttctatgctccctggtgcagcatgt

SEQ ID NO: 392073 - DNA, 25 bp, Mus musculus
ttctatgctccctttcccaggtggt

SEQ ID NO: 392074 - DNA, 25 bp, Mus musculus
ttctatgctgggacggccttctctg

SEQ ID NO: 392075 - DNA, 25 bp, Mus musculus
ttctatgcttcagatggagtggatg

SEQ ID NO: 392076 - DNA, 25 bp, Mus musculus
ttctatgcttcagcccctggtcata

SEQ ID NO: 392077 - DNA, 25 bp, Mus musculus
ttctatggagagaaacaacccgagg

SEQ ID NO: 392078 - DNA, 25 bp, Mus musculus
ttctatgtcatggtggggttttttg

SEQ ID NO: 392079 - DNA, 25 bp, Mus musculus
ttctatgtgagcaactgggacaaat

SEQ ID NO: 392080 - DNA, 25 bp, Mus musculus
ttctatgtgaggaaaaacgggatct

SEQ ID NO: 392081 - DNA, 25 bp, Mus musculus
ttctatgtggaaaggaaaatagaaa

SEQ ID NO: 392082 - DNA, 25 bp, Mus musculus
ttctattaacacagatgctgctcag

SEQ ID NO: 392083 - DNA, 25 bp, Mus musculus
ttctattaacacagcacggtgcaac

SEQ ID NO: 392084 - DNA, 25 bp, Mus musculus
ttctattaacacaggatcacactat

SEQ ID NO: 392085 - DNA, 25 bp, Mus musculus
ttctattaacagcttcgaccttgcc

SEQ ID NO: 392086 - DNA, 25 bp, Mus musculus
ttctattgaaaccatagacagaagt

SEQ ID NO: 392087 - DNA, 25 bp, Mus musculus
ttctattgaaggtgttgttgctgat

SEQ ID NO: 392088 - DNA, 25 bp, Mus musculus
ttctattgataaggctgcctttgat

SEQ ID NO: 392089 - DNA, 25 bp, Mus musculus
ttctattgataaggtaacaagccga

SEQ ID NO: 392090 - DNA, 25 bp, Mus musculus
ttctatttcctagagctgtttgaca

SEQ ID NO: 392091 - DNA, 25 bp, Mus musculus
ttctatttctgggttctgccagaat

SEQ ID NO: 392092 - DNA, 25 bp, Mus musculus
ttctattttgagagactgcctttag

SEQ ID NO: 392093 - DNA, 25 bp, Mus musculus
ttctattttgaggttgagcacatca

SEQ ID NO: 392094 - DNA, 25 bp, Mus musculus
ttctcaaaaccagggatactgggaa

SEQ ID NO: 392095 - DNA, 25 bp, Mus musculus
ttctcaaaattcaattgctgatagc

SEQ ID NO: 392096 - DNA, 25 bp, Mus musculus
ttctcaaaattcaatttctgttgcc

SEQ ID NO: 392097 - DNA, 25 bp, Mus musculus
ttctcaaagcagcaggagcagaccc

SEQ ID NO: 392098 - DNA, 25 bp, Mus musculus
ttctcaaagcccaggagaagcgccc

SEQ ID NO: 392099 - DNA, 25 bp, Mus musculus
ttctcaaattaaatccaagttaatc

SEQ ID NO: 392100 - DNA, 25 bp, Mus musculus
ttctcaacaacctgagattcatatt

SEQ ID NO: 392101 - DNA, 25 bp, Mus musculus
ttctcaacagccatctgcaatggct

SEQ ID NO: 392102 - DNA, 25 bp, Mus musculus
ttctcaacctagcagaagcgctcct

SEQ ID NO: 392103 - DNA, 25 bp, Mus musculus
ttctcaacctgccagatgcagagaa

SEQ ID NO: 392104 - DNA, 25 bp, Mus musculus
ttctcaacctgccaggatatgctct

SEQ ID NO: 392105 - DNA, 25 bp, Mus musculus
ttctcaactcagtttgacccattga

SEQ ID NO: 392106 - DNA, 25 bp, Mus musculus
ttctcaactctttcgatatgtcttg

SEQ ID NO: 392107 - DNA, 25 bp, Mus musculus
ttctcaactctttcgtctcctttta

SEQ ID NO: 392108 - DNA, 25 bp, Mus musculus
ttctcaactggctatggctcctggg

SEQ ID NO: 392109 - DNA, 25 bp, Mus musculus
ttctcaagaattaggtaagtggaga

SEQ ID NO: 392110 - DNA, 25 bp, Mus musculus
ttctcaagaggtctgaatttcctgt

SEQ ID NO: 392111 - DNA, 25 bp, Mus musculus
ttctcaagcagatttcggaggcact

SEQ ID NO: 392112 - DNA, 25 bp, Mus musculus
ttctcaagcagggtactggtctctt

SEQ ID NO: 392113 - DNA, 25 bp, Mus musculus
ttctcaagcaggtggcccacgcgct

SEQ ID NO: 392114 - DNA, 25 bp, Mus musculus
ttctcaagcatgacttaacctgtgt

SEQ ID NO: 392115 - DNA, 25 bp, Mus musculus
ttctcaaggcaggttgtaaaagtta

SEQ ID NO: 392116 - DNA, 25 bp, Mus musculus
ttctcaaggcggggacgatccggag

SEQ ID NO: 392117 - DNA, 25 bp, Mus musculus
ttctcaatgcctcagcttcggtagc

SEQ ID NO: 392118 - DNA, 25 bp, Mus musculus
ttctcaatggaaatatggaaacctc

SEQ ID NO: 392119 - DNA, 25 bp, Mus musculus
ttctcaatgggaaaaagagcttgtc

SEQ ID NO: 392120 - DNA, 25 bp, Mus musculus
ttctcaatttcaagtcagaagacat

SEQ ID NO: 392121 - DNA, 25 bp, Mus musculus
ttctcacaatggaggaagaacgagc

SEQ ID NO: 392122 - DNA, 25 bp, Mus musculus
ttctcacagagatgaggcttgagcc

SEQ ID NO: 392123 - DNA, 25 bp, Mus musculus
ttctcacagagtgttctccatggcc

SEQ ID NO: 392124 - DNA, 25 bp, Mus musculus
ttctcacaggacatgaaggcaccac

SEQ ID NO: 392125 - DNA, 25 bp, Mus musculus
ttctcacaggtcatgaaggcaccac

SEQ ID NO: 392126 - DNA, 25 bp, Mus musculus
ttctcacataaaggctgaaggtgaa

SEQ ID NO: 392127 - DNA, 25 bp, Mus musculus
ttctcaccaccaaggaaaagttgta

SEQ ID NO: 392128 - DNA, 25 bp, Mus musculus
ttctcacccccagcccagccaagcg

SEQ ID NO: 392129 - DNA, 25 bp, Mus musculus
ttctcacccccagctccaaccctct

SEQ ID NO: 392130 - DNA, 25 bp, Mus musculus
ttctcacccggaaaatgactccctc

SEQ ID NO: 392131 - DNA, 25 bp, Mus musculus
ttctcaccgacatcactcagcactc

SEQ ID NO: 392132 - DNA, 25 bp, Mus musculus
ttctcaccgctcgaggtggccaggc

SEQ ID NO: 392133 - DNA, 25 bp, Mus musculus
ttctcacgaaaagatcctgagcaag

SEQ ID NO: 392134 - DNA, 25 bp, Mus musculus
ttctcacgcaagaccctgactgcac

SEQ ID NO: 392135 - DNA, 25 bp, Mus musculus
ttctcactcaaggtggcgtgattga

SEQ ID NO: 392136 - DNA, 25 bp, Mus musculus
ttctcacttctaggtcgtttcagct

SEQ ID NO: 392137 - DNA, 25 bp, Mus musculus
ttctcagacaaatgtcagtgagatc

SEQ ID NO: 392138 - DNA, 25 bp, Mus musculus
ttctcagacacaaaccaaatgaaca

SEQ ID NO: 392139 - DNA, 25 bp, Mus musculus
ttctcagaggggcaggagctccggg

SEQ ID NO: 392140 - DNA, 25 bp, Mus musculus
ttctcagatctcctgagccacagcc

SEQ ID NO: 392141 - DNA, 25 bp, Mus musculus
ttctcagcaggccgcagatcatgcc

SEQ ID NO: 392142 - DNA, 25 bp, Mus musculus
ttctcagcatccctggctgagagct

SEQ ID NO: 392143 - DNA, 25 bp, Mus musculus
ttctcagcatttgccctggttccca

SEQ ID NO: 392144 - DNA, 25 bp, Mus musculus
ttctcaggaagtaaaccaggttctg

SEQ ID NO: 392145 - DNA, 25 bp, Mus musculus
ttctcaggaagtgcttctgtttcct

SEQ ID NO: 392146 - DNA, 25 bp, Mus musculus
ttctcaggaagttctgatccagaca

SEQ ID NO: 392147 - DNA, 25 bp, Mus musculus
ttctcaggacagcatcccagccttt

SEQ ID NO: 392148 - DNA, 25 bp, Mus musculus
ttctcaggagaaccagacttgggat

SEQ ID NO: 392149 - DNA, 25 bp, Mus musculus
ttctcaggatcaccaggtgctcgag

SEQ ID NO: 392150 - DNA, 25 bp, Mus musculus
ttctcagggaaaagcacagagctga

SEQ ID NO: 392151 - DNA, 25 bp, Mus musculus
ttctcagggaaaaggaacaccatgg

SEQ ID NO: 392152 - DNA, 25 bp, Mus musculus
ttctcaggttgttcctcaatgtctg

SEQ ID NO: 392153 - DNA, 25 bp, Mus musculus
ttctcagtcaggagagaattcagag

SEQ ID NO: 392154 - DNA, 25 bp, Mus musculus
ttctcagtcagggtgacaagggaga

SEQ ID NO: 392155 - DNA, 25 bp, Mus musculus
ttctcagtcaggtaccaagcgcctt

SEQ ID NO: 392156 - DNA, 25 bp, Mus musculus
ttctcagtcaggtcgcagacatttt

SEQ ID NO: 392157 - DNA, 25 bp, Mus musculus
ttctcagtgaagagtcacatactca

SEQ ID NO: 392158 - DNA, 25 bp, Mus musculus
ttctcagtgctgatgcagatgcgct

SEQ ID NO: 392159 - DNA, 25 bp, Mus musculus
ttctcagtgctgatgcgcttcgacg

SEQ ID NO: 392160 - DNA, 25 bp, Mus musculus
ttctcagtgtaacccagtgtggtga

SEQ ID NO: 392161 - DNA, 25 bp, Mus musculus
ttctcagttaaaaaacaaggtgaga

SEQ ID NO: 392162 - DNA, 25 bp, Mus musculus
ttctcagttcagcgtcgccaacagg

SEQ ID NO: 392163 - DNA, 25 bp, Mus musculus
ttctcagttttcgcatcaaggtgta

SEQ ID NO: 392164 - DNA, 25 bp, Mus musculus
ttctcataaaaatggatgagacatc

SEQ ID NO: 392165 - DNA, 25 bp, Mus musculus
ttctcataaaattcccatggctctt

SEQ ID NO: 392166 - DNA, 25 bp, Mus musculus
ttctcatactgcaggcagagaggtg

SEQ ID NO: 392167 - DNA, 25 bp, Mus musculus
ttctcatactgcagtctggacagag

SEQ ID NO: 392168 - DNA, 25 bp, Mus musculus
ttctcatcaaggataacagcaagct

SEQ ID NO: 392169 - DNA, 25 bp, Mus musculus
ttctcatcaatgccaaccgtcctgg

SEQ ID NO: 392170 - DNA, 25 bp, Mus musculus
ttctcatcaatgccagtcccatccc

SEQ ID NO: 392171 - DNA, 25 bp, Mus musculus
ttctcatccaaagcctttatccatc

SEQ ID NO: 392172 - DNA, 25 bp, Mus musculus
ttctcatccgctgagacccatgcgg

SEQ ID NO: 392173 - DNA, 25 bp, Mus musculus
ttctcatccgctgagatgctggtgg

SEQ ID NO: 392174 - DNA, 25 bp, Mus musculus
ttctcatcttgagaacccagcagtg

SEQ ID NO: 392175 - DNA, 25 bp, Mus musculus
ttctcatgaagccattgatcttatc

SEQ ID NO: 392176 - DNA, 25 bp, Mus musculus
ttctcatgatgacaggtttctactg

SEQ ID NO: 392177 - DNA, 25 bp, Mus musculus
ttctcatgttgccagagaggcagat

SEQ ID NO: 392178 - DNA, 25 bp, Mus musculus
ttctcattaaggtaaatgaccgtcg

SEQ ID NO: 392179 - DNA, 25 bp, Mus musculus
ttctcattgacccaggtgctctcac

SEQ ID NO: 392180 - DNA, 25 bp, Mus musculus
ttctccaaagagaaggaaaagtgat

SEQ ID NO: 392181 - DNA, 25 bp, Mus musculus
ttctccaaagagaaggcaggtacac

SEQ ID NO: 392182 - DNA, 25 bp, Mus musculus
ttctccaaagccaagcccgatacca

SEQ ID NO: 392183 - DNA, 25 bp, Mus musculus
ttctccaaaggtctgtcaaatatgg

SEQ ID NO: 392184 - DNA, 25 bp, Mus musculus
ttctccaaattatgtgccaccaaaa

SEQ ID NO: 392185 - DNA, 25 bp, Mus musculus
ttctccaagcatgagttatttgctg

SEQ ID NO: 392186 - DNA, 25 bp, Mus musculus
ttctccaaggtggcctagactgctc

SEQ ID NO: 392187 - DNA, 25 bp, Mus musculus
ttctccaaggtggctggacccgact

SEQ ID NO: 392188 - DNA, 25 bp, Mus musculus
ttctccaagtatgaaggaggagtag

SEQ ID NO: 392189 - DNA, 25 bp, Mus musculus
ttctccaataattctatactttctg

SEQ ID NO: 392190 - DNA, 25 bp, Mus musculus
ttctccaataattcttatttgtaga

SEQ ID NO: 392191 - DNA, 25 bp, Mus musculus
ttctccacagtcactggagagtcag

SEQ ID NO: 392192 - DNA, 25 bp, Mus musculus
ttctccacagtcgctggagagtcag

SEQ ID NO: 392193 - DNA, 25 bp, Mus musculus
ttctccacattcgagatggtggagt

SEQ ID NO: 392194 - DNA, 25 bp, Mus musculus
ttctccacattcgagatgttcctcc

SEQ ID NO: 392195 - DNA, 25 bp, Mus musculus
ttctccaccaagtcaaagtaaacaa

SEQ ID NO: 392196 - DNA, 25 bp, Mus musculus
ttctccaccaggacatggatttgat

SEQ ID NO: 392197 - DNA, 25 bp, Mus musculus
ttctccaccatcccttccagatatg

SEQ ID NO: 392198 - DNA, 25 bp, Mus musculus
ttctccacccgcgggggccctagct

SEQ ID NO: 392199 - DNA, 25 bp, Mus musculus
ttctccacccggacagagtccttgg

SEQ ID NO: 392200 - DNA, 25 bp, Mus musculus
ttctccacgcctctcgtcagaagaa

SEQ ID NO: 392201 - DNA, 25 bp, Mus musculus
ttctccactcttgaaagaaaaatga

SEQ ID NO: 392202 - DNA, 25 bp, Mus musculus
ttctccactggcctctcggacctca

SEQ ID NO: 392203 - DNA, 25 bp, Mus musculus
ttctccactggtgaagaagcaggcc

SEQ ID NO: 392204 - DNA, 25 bp, Mus musculus
ttctccacttcaggtactaaacaga

SEQ ID NO: 392205 - DNA, 25 bp, Mus musculus
ttctccagaacagctatggatttgc

SEQ ID NO: 392206 - DNA, 25 bp, Mus musculus
ttctccagaacagctgttcctaagg

SEQ ID NO: 392207 - DNA, 25 bp, Mus musculus
ttctccagaaggtcgcttataccaa

SEQ ID NO: 392208 - DNA, 25 bp, Mus musculus
ttctccagacctggctgcccagacc

SEQ ID NO: 392209 - DNA, 25 bp, Mus musculus
ttctccagagaggtgcccttctcca

SEQ ID NO: 392210 - DNA, 25 bp, Mus musculus
ttctccagagcaccgcctcctggct

SEQ ID NO: 392211 - DNA, 25 bp, Mus musculus
ttctccagagccaaggctgttgtgg

SEQ ID NO: 392212 - DNA, 25 bp, Mus musculus
ttctccagaggcaagttcaaggttt

SEQ ID NO: 392213 - DNA, 25 bp, Mus musculus
ttctccagagggaaaaagcctacag

SEQ ID NO: 392214 - DNA, 25 bp, Mus musculus
ttctccagatgacttcttgggtcgt

SEQ ID NO: 392215 - DNA, 25 bp, Mus musculus
ttctccagcaaggcatgatcaccat

SEQ ID NO: 392216 - DNA, 25 bp, Mus musculus
ttctccagcaagttacagtccctgt

SEQ ID NO: 392217 - DNA, 25 bp, Mus musculus
ttctccagcagcaagagccagaggg

SEQ ID NO: 392218 - DNA, 25 bp, Mus musculus
ttctccagcaggacccaacctcctg

SEQ ID NO: 392219 - DNA, 25 bp, Mus musculus
ttctccagccaatgctgactaccag

SEQ ID NO: 392220 - DNA, 25 bp, Mus musculus
ttctccagcgggcagaggcggatct

SEQ ID NO: 392221 - DNA, 25 bp, Mus musculus
ttctccagcgggcaggtcatgttag

SEQ ID NO: 392222 - DNA, 25 bp, Mus musculus
ttctccagctcaaagctgctgagag

SEQ ID NO: 392223 - DNA, 25 bp, Mus musculus
ttctccaggtacaagacgaactgga

SEQ ID NO: 392224 - DNA, 25 bp, Mus musculus
ttctccagtctccaggtgattggat

SEQ ID NO: 392225 - DNA, 25 bp, Mus musculus
ttctccagttccaggaagtcgttct

SEQ ID NO: 392226 - DNA, 25 bp, Mus musculus
ttctccagttccagtaagtgcaata

SEQ ID NO: 392227 - DNA, 25 bp, Mus musculus
ttctccatcaaaccccggcagccca

SEQ ID NO: 392228 - DNA, 25 bp, Mus musculus
ttctccatcctaccagttcgcagac

SEQ ID NO: 392229 - DNA, 25 bp, Mus musculus
ttctccatcctaccatatctgtctc

SEQ ID NO: 392230 - DNA, 25 bp, Mus musculus
ttctccatggagcttggagctgcct

SEQ ID NO: 392231 - DNA, 25 bp, Mus musculus
ttctccatggaggcaagatgaatat

SEQ ID NO: 392232 - DNA, 25 bp, Mus musculus
ttctccattccatttctgggcttca

SEQ ID NO: 392233 - DNA, 25 bp, Mus musculus
ttctcccaaattaaatgatgaacaa

SEQ ID NO: 392234 - DNA, 25 bp, Mus musculus
ttctcccacagtgcgtgctattatg

SEQ ID NO: 392235 - DNA, 25 bp, Mus musculus
ttctcccaccagatacccataatat

SEQ ID NO: 392236 - DNA, 25 bp, Mus musculus
ttctcccaccaggctcaatattgtg

SEQ ID NO: 392237 - DNA, 25 bp, Mus musculus
ttctcccacctacgggtggcggctg

SEQ ID NO: 392238 - DNA, 25 bp, Mus musculus
ttctcccagagcctggcacccccag

SEQ ID NO: 392239 - DNA, 25 bp, Mus musculus
ttctcccagaggaactctgtgcctg

SEQ ID NO: 392240 - DNA, 25 bp, Mus musculus
ttctcccagaggaggacgatgtcat

SEQ ID NO: 392241 - DNA, 25 bp, Mus musculus
ttctcccagaggagttggatattct

SEQ ID NO: 392242 - DNA, 25 bp, Mus musculus
ttctcccagaggcaaaatctcatca

SEQ ID NO: 392243 - DNA, 25 bp, Mus musculus
ttctcccagagtggcttcatcactg

SEQ ID NO: 392244 - DNA, 25 bp, Mus musculus
ttctcccaggaagcctcaaggagaa

SEQ ID NO: 392245 - DNA, 25 bp, Mus musculus
ttctcccaggaagcgtgcccaacta

SEQ ID NO: 392246 - DNA, 25 bp, Mus musculus
ttctcccaggaagtgcaaagaggag

SEQ ID NO: 392247 - DNA, 25 bp, Mus musculus
ttctcccatcaggaggaggagatag

SEQ ID NO: 392248 - DNA, 25 bp, Mus musculus
ttctcccatgattaatgaattagta

SEQ ID NO: 392249 - DNA, 25 bp, Mus musculus
ttctcccctgacagacccggagtta

SEQ ID NO: 392250 - DNA, 25 bp, Mus musculus
ttctcccctggtttctgtatgcaaa

SEQ ID NO: 392251 - DNA, 25 bp, Mus musculus
ttctcccgaggaggcatgataagct

SEQ ID NO: 392252 - DNA, 25 bp, Mus musculus
ttctcccgagggctgggataagcgc

SEQ ID NO: 392253 - DNA, 25 bp, Mus musculus
ttctccctcaccttgttttctgctc

SEQ ID NO: 392254 - DNA, 25 bp, Mus musculus
ttctccctccaaatttgggcagaca

SEQ ID NO: 392255 - DNA, 25 bp, Mus musculus
ttctccctccggaaagaacaagtta

SEQ ID NO: 392256 - DNA, 25 bp, Mus musculus
ttctccctggaaggtggaacctagg

SEQ ID NO: 392257 - DNA, 25 bp, Mus musculus
ttctccctggtcgtaatggagatag

SEQ ID NO: 392258 - DNA, 25 bp, Mus musculus
ttctccgagattctggacctgtgtt

SEQ ID NO: 392259 - DNA, 25 bp, Mus musculus
ttctccgcaaaggcaccaccttcca

SEQ ID NO: 392260 - DNA, 25 bp, Mus musculus
ttctccgcaaagggtacacgcagct

SEQ ID NO: 392261 - DNA, 25 bp, Mus musculus
ttctccgcaccagaggaacttctgc

SEQ ID NO: 392262 - DNA, 25 bp, Mus musculus
ttctccgccagtcaacaggagaagt

SEQ ID NO: 392263 - DNA, 25 bp, Mus musculus
ttctccgccgagccggaccgggctg

SEQ ID NO: 392264 - DNA, 25 bp, Mus musculus
ttctccgccgagcgcctcggtcctg

SEQ ID NO: 392265 - DNA, 25 bp, Mus musculus
ttctccgcggaggaccctaggaaaa

SEQ ID NO: 392266 - DNA, 25 bp, Mus musculus
ttctccgcggaggtattacttggac

SEQ ID NO: 392267 - DNA, 25 bp, Mus musculus
ttctccggaactcagatttcaacta

SEQ ID NO: 392268 - DNA, 25 bp, Mus musculus
ttctccggctggcccaccttgggac

SEQ ID NO: 392269 - DNA, 25 bp, Mus musculus
ttctccgggctgaggagccaacatg

SEQ ID NO: 392270 - DNA, 25 bp, Mus musculus
ttctcctacaaattgctaataatca

SEQ ID NO: 392271 - DNA, 25 bp, Mus musculus
ttctcctacttcaagggccaacggc

SEQ ID NO: 392272 - DNA, 25 bp, Mus musculus
ttctcctatggctgtcttcagacac

SEQ ID NO: 392273 - DNA, 25 bp, Mus musculus
ttctcctatgggtatggccgaatag

SEQ ID NO: 392274 - DNA, 25 bp, Mus musculus
ttctcctccgaggtccagtttggcc

SEQ ID NO: 392275 - DNA, 25 bp, Mus musculus
ttctcctccttaaagcctgcggagc

SEQ ID NO: 392276 - DNA, 25 bp, Mus musculus
ttctcctgaaatgcctaacatacat

SEQ ID NO: 392277 - DNA, 25 bp, Mus musculus
ttctcctgatatctaatagcattcc

SEQ ID NO: 392278 - DNA, 25 bp, Mus musculus
ttctcctgatggaggtgcttgtcct

SEQ ID NO: 392279 - DNA, 25 bp, Mus musculus
ttctcctgcagcgagcttcaagcgt

SEQ ID NO: 392280 - DNA, 25 bp, Mus musculus
ttctcctgcagcgatatcgatgagt

SEQ ID NO: 392281 - DNA, 25 bp, Mus musculus
ttctcctgccctgtgcaagtgccct

SEQ ID NO: 392282 - DNA, 25 bp, Mus musculus
ttctcctggaggttccaactatggg

SEQ ID NO: 392283 - DNA, 25 bp, Mus musculus
ttctcctggcccagcaaccttccct

SEQ ID NO: 392284 - DNA, 25 bp, Mus musculus
ttctcctggcccagcaatcttccct

SEQ ID NO: 392285 - DNA, 25 bp, Mus musculus
ttctcctgggagggtcatctatggg

SEQ ID NO: 392286 - DNA, 25 bp, Mus musculus
ttctcctgtcaggccagatttggac

SEQ ID NO: 392287 - DNA, 25 bp, Mus musculus
ttctccttccgttcagcggacgccg

SEQ ID NO: 392288 - DNA, 25 bp, Mus musculus
ttctccttctgggataaaaagaagc

SEQ ID NO: 392289 - DNA, 25 bp, Mus musculus
ttctcgacatagatatcccaatgtc

SEQ ID NO: 392290 - DNA, 25 bp, Mus musculus
ttctcgacataggtgcactgcatca

SEQ ID NO: 392291 - DNA, 25 bp, Mus musculus
ttctcgacctttgaatgatagagac

SEQ ID NO: 392292 - DNA, 25 bp, Mus musculus
ttctcgactgagggtccaaaccttg

SEQ ID NO: 392293 - DNA, 25 bp, Mus musculus
ttctcgagcaccctcagaatatggc

SEQ ID NO: 392294 - DNA, 25 bp, Mus musculus
ttctcgagggaaagtgtccacagac

SEQ ID NO: 392295 - DNA, 25 bp, Mus musculus
ttctcgcgccagaggaaggtgggag

SEQ ID NO: 392296 - DNA, 25 bp, Mus musculus
ttctcgcgccagagtttgtgatcct

SEQ ID NO: 392297 - DNA, 25 bp, Mus musculus
ttctcgctattcagattcttctgga

SEQ ID NO: 392298 - DNA, 25 bp, Mus musculus
ttctcgctgggaaatctacaaaatg

SEQ ID NO: 392299 - DNA, 25 bp, Mus musculus
ttctcggaggaagcaccactgccga

SEQ ID NO: 392300 - DNA, 25 bp, Mus musculus
ttctcgggaggatccgagcgtgcgc

SEQ ID NO: 392301 - DNA, 25 bp, Mus musculus
ttctcgggaggtggctgtctgccca

SEQ ID NO: 392302 - DNA, 25 bp, Mus musculus
ttctcgggcaaggacttagcattca

SEQ ID NO: 392303 - DNA, 25 bp, Mus musculus
ttctcgggtcgcaggaactggtgct

SEQ ID NO: 392304 - DNA, 25 bp, Mus musculus
ttctcggtgagcacgatgaaacgga

SEQ ID NO: 392305 - DNA, 25 bp, Mus musculus
ttctcgtgaactggttaccaggcct

SEQ ID NO: 392306 - DNA, 25 bp, Mus musculus
ttctcgtgggctgtgccggcattgg

SEQ ID NO: 392307 - DNA, 25 bp, Mus musculus
ttctcgtgtaaggatcttctgccta

SEQ ID NO: 392308 - DNA, 25 bp, Mus musculus
ttctcgttcagaatgtcatacccag

SEQ ID NO: 392309 - DNA, 25 bp, Mus musculus
ttctcgttcaggttagccagtacac

SEQ ID NO: 392310 - DNA, 25 bp, Mus musculus
ttctcgttggtgcctttgtgcctct

SEQ ID NO: 392311 - DNA, 25 bp, Mus musculus
ttctctaaagggcctggggatatgg

SEQ ID NO: 392312 - DNA, 25 bp, Mus musculus
ttctctaaagttacaaattataata

SEQ ID NO: 392313 - DNA, 25 bp, Mus musculus
ttctctaacctggccctctgctgtt

SEQ ID NO: 392314 - DNA, 25 bp, Mus musculus
ttctctaataaagcaaggagtaaat

SEQ ID NO: 392315 - DNA, 25 bp, Mus musculus
ttctctaataaaggatatggtggtg

SEQ ID NO: 392316 - DNA, 25 bp, Mus musculus
ttctctacaaaaagattgaagacct

SEQ ID NO: 392317 - DNA, 25 bp, Mus musculus
ttctctacacaggaaatccaccttc

SEQ ID NO: 392318 - DNA, 25 bp, Mus musculus
ttctctacacaggctgacaagaaaa

SEQ ID NO: 392319 - DNA, 25 bp, Mus musculus
ttctctaccaggtctgtcacctaaa

SEQ ID NO: 392320 - DNA, 25 bp, Mus musculus
ttctctagatagggtgagcgtggac

SEQ ID NO: 392321 - DNA, 25 bp, Mus musculus
ttctctagatttcaccaacgtattg

SEQ ID NO: 392322 - DNA, 25 bp, Mus musculus
ttctctagcacaggttggtctgggg

SEQ ID NO: 392323 - DNA, 25 bp, Mus musculus
ttctctagcgaaatccctctctact

SEQ ID NO: 392324 - DNA, 25 bp, Mus musculus
ttctctagcgtgatttttcttccag

SEQ ID NO: 392325 - DNA, 25 bp, Mus musculus
ttctctagcttttcctatgatgaca

SEQ ID NO: 392326 - DNA, 25 bp, Mus musculus
ttctctataaaaagaaaaatattac

SEQ ID NO: 392327 - DNA, 25 bp, Mus musculus
ttctctatctgccaaagtaaacaat

SEQ ID NO: 392328 - DNA, 25 bp, Mus musculus
ttctctcaccggcagaggctgaagg

SEQ ID NO: 392329 - DNA, 25 bp, Mus musculus
ttctctcactgtcaggaagttggtg

SEQ ID NO: 392330 - DNA, 25 bp, Mus musculus
ttctctcagcagattccaaaggctg

SEQ ID NO: 392331 - DNA, 25 bp, Mus musculus
ttctctcagcaggccttgagcctcc

SEQ ID NO: 392332 - DNA, 25 bp, Mus musculus
ttctctcatagggaactttcaagtt

SEQ ID NO: 392333 - DNA, 25 bp, Mus musculus
ttctctcattgctcgagtttgtgac

SEQ ID NO: 392334 - DNA, 25 bp, Mus musculus
ttctctccagcagaactaaagaacg

SEQ ID NO: 392335 - DNA, 25 bp, Mus musculus
ttctctccagctctgggccccagaa

SEQ ID NO: 392336 - DNA, 25 bp, Mus musculus
ttctctccaggctctacttctgttc

SEQ ID NO: 392337 - DNA, 25 bp, Mus musculus
ttctctccaggctctgggaccctga

SEQ ID NO: 392338 - DNA, 25 bp, Mus musculus
ttctctccagtggtggatgtgaaga

SEQ ID NO: 392339 - DNA, 25 bp, Mus musculus
ttctctccctcgcagttcttgaaca

SEQ ID NO: 392340 - DNA, 25 bp, Mus musculus
ttctctccttggtcacgcccgggtc

SEQ ID NO: 392341 - DNA, 25 bp, Mus musculus
ttctctcgccggcagctcttcctcc

SEQ ID NO: 392342 - DNA, 25 bp, Mus musculus
ttctctcgccggcagggttgggatc

SEQ ID NO: 392343 - DNA, 25 bp, Mus musculus
ttctctcggctccgctagttctgac

SEQ ID NO: 392344 - DNA, 25 bp, Mus musculus
ttctctcggctccgctgccctgggc

SEQ ID NO: 392345 - DNA, 25 bp, Mus musculus
ttctctcgtcaagtgagccccaggc

SEQ ID NO: 392346 - DNA, 25 bp, Mus musculus
ttctctctccagcgcctgtattatg

SEQ ID NO: 392347 - DNA, 25 bp, Mus musculus
ttctctctccagggagtgttcctgt

SEQ ID NO: 392348 - DNA, 25 bp, Mus musculus
ttctctctccagtacccccacttcc

SEQ ID NO: 392349 - DNA, 25 bp, Mus musculus
ttctctctctctttgatgggggaac

SEQ ID NO: 392350 - DNA, 25 bp, Mus musculus
ttctctctgcaggtcaggaatctac

SEQ ID NO: 392351 - DNA, 25 bp, Mus musculus
ttctctctgcaggttaatatccgac

SEQ ID NO: 392352 - DNA, 25 bp, Mus musculus
ttctctctggcagggatggaagact

SEQ ID NO: 392353 - DNA, 25 bp, Mus musculus
ttctctctgtctggtatctatcctg

SEQ ID NO: 392354 - DNA, 25 bp, Mus musculus
ttctctgaaccaggttatgaaaatg

SEQ ID NO: 392355 - DNA, 25 bp, Mus musculus
ttctctgacaggaatgaatttcata

SEQ ID NO: 392356 - DNA, 25 bp, Mus musculus
ttctctgaccctgaatcgtccttgg

SEQ ID NO: 392357 - DNA, 25 bp, Mus musculus
ttctctgagactcgtctgccagaag

SEQ ID NO: 392358 - DNA, 25 bp, Mus musculus
ttctctgagagaaggtggagcagcc

SEQ ID NO: 392359 - DNA, 25 bp, Mus musculus
ttctctgaggaagagacactccagc

SEQ ID NO: 392360 - DNA, 25 bp, Mus musculus
ttctctgaggaagaggacttttggg

SEQ ID NO: 392361 - DNA, 25 bp, Mus musculus
ttctctgaggggagcttttcccagt

SEQ ID NO: 392362 - DNA, 25 bp, Mus musculus
ttctctgcaagatcaagacagctgc

SEQ ID NO: 392363 - DNA, 25 bp, Mus musculus
ttctctgcagaccggcccaacgtgc

SEQ ID NO: 392364 - DNA, 25 bp, Mus musculus
ttctctgcagtcaatcgcaggccac

SEQ ID NO: 392365 - DNA, 25 bp, Mus musculus
ttctctgcgcagatgttgatgagtg

SEQ ID NO: 392366 - DNA, 25 bp, Mus musculus
ttctctgcgccacgtatcagagcat

SEQ ID NO: 392367 - DNA, 25 bp, Mus musculus
ttctctgcgccaggtatcagagcat

SEQ ID NO: 392368 - DNA, 25 bp, Mus musculus
ttctctgctacctgaattttgtgcc

SEQ ID NO: 392369 - DNA, 25 bp, Mus musculus
ttctctggaagattaggtcagagac

SEQ ID NO: 392370 - DNA, 25 bp, Mus musculus
ttctctggaagtcctagtcactcga

SEQ ID NO: 392371 - DNA, 25 bp, Mus musculus
ttctctggccacaggaaatcgagag

SEQ ID NO: 392372 - DNA, 25 bp, Mus musculus
ttctctggccacgggaaatcgagag

SEQ ID NO: 392373 - DNA, 25 bp, Mus musculus
ttctctggcttcctcccgaggccga

SEQ ID NO: 392374 - DNA, 25 bp, Mus musculus
ttctctggggtctggccaaagatct

SEQ ID NO: 392375 - DNA, 25 bp, Mus musculus
ttctctggggtctggtcagaaagac

SEQ ID NO: 392376 - DNA, 25 bp, Mus musculus
ttctctgtaaaagggtgtctttaag

SEQ ID NO: 392377 - DNA, 25 bp, Mus musculus
ttctctgtaagttctccctgttcac

SEQ ID NO: 392378 - DNA, 25 bp, Mus musculus
ttctctgtcgggtaagcagctgctc

SEQ ID NO: 392379 - DNA, 25 bp, Mus musculus
ttctctgtctagggctgacggttgc

SEQ ID NO: 392380 - DNA, 25 bp, Mus musculus
ttctctgtctccaggacacccaaca

SEQ ID NO: 392381 - DNA, 25 bp, Mus musculus
ttctctgtctcggggaaaggttgga

SEQ ID NO: 392382 - DNA, 25 bp, Mus musculus
ttctctgtctcggggtgacaatagc

SEQ ID NO: 392383 - DNA, 25 bp, Mus musculus
ttctctgttcagcccttcccacaaa

SEQ ID NO: 392384 - DNA, 25 bp, Mus musculus
ttctctgttcaggatatgcagtacc

SEQ ID NO: 392385 - DNA, 25 bp, Mus musculus
ttctctgtttgagtgatgagccggc

SEQ ID NO: 392386 - DNA, 25 bp, Mus musculus
ttctcttaaggttgtgtggaggaaa

SEQ ID NO: 392387 - DNA, 25 bp, Mus musculus
ttctcttagccccaggtgctgcagt

SEQ ID NO: 392388 - DNA, 25 bp, Mus musculus
ttctcttcacaaccattcctggtct

SEQ ID NO: 392389 - DNA, 25 bp, Mus musculus
ttctcttcagtaccgggaggtggct

SEQ ID NO: 392390 - DNA, 25 bp, Mus musculus
ttctcttccagctaccactatgccg

SEQ ID NO: 392391 - DNA, 25 bp, Mus musculus
ttctcttccatatgaggaaactgag

SEQ ID NO: 392392 - DNA, 25 bp, Mus musculus
ttctcttctcagggtctcagaatgg

SEQ ID NO: 392393 - DNA, 25 bp, Mus musculus
ttctcttgagactcgttactgggca

SEQ ID NO: 392394 - DNA, 25 bp, Mus musculus
ttctcttgagggtaacaagaagaag

SEQ ID NO: 392395 - DNA, 25 bp, Mus musculus
ttctcttggaggctgcaaaagacat

SEQ ID NO: 392396 - DNA, 25 bp, Mus musculus
ttctcttggagttctgacgggaaca

SEQ ID NO: 392397 - DNA, 25 bp, Mus musculus
ttctcttgtgatgaggagactgacc

SEQ ID NO: 392398 - DNA, 25 bp, Mus musculus
ttctcttgtgctgccacaggtgaca

SEQ ID NO: 392399 - DNA, 25 bp, Mus musculus
ttctcttgttaggttcacctggaga

SEQ ID NO: 392400 - DNA, 25 bp, Mus musculus
ttctctttagtcccgatcatccagg

SEQ ID NO: 392401 - DNA, 25 bp, Mus musculus
ttctctttgctgcgattatttgatt

SEQ ID NO: 392402 - DNA, 25 bp, Mus musculus
ttctctttgctgcggcttcatagag

SEQ ID NO: 392403 - DNA, 25 bp, Mus musculus
ttctcttttggactgggttttgcca

SEQ ID NO: 392404 - DNA, 25 bp, Mus musculus
ttctctttttctcgaaagaaggatt

SEQ ID NO: 392405 - DNA, 25 bp, Mus musculus
ttctgaaaataaaggtgcctcgtct

SEQ ID NO: 392406 - DNA, 25 bp, Mus musculus
ttctgaaacaccaggaacgggagcg

SEQ ID NO: 392407 - DNA, 25 bp, Mus musculus
ttctgaaacaccaggagttggagag

SEQ ID NO: 392408 - DNA, 25 bp, Mus musculus
ttctgaaacagcctcaaggagaagc

SEQ ID NO: 392409 - DNA, 25 bp, Mus musculus
ttctgaaacaggaaatccggctcat

SEQ ID NO: 392410 - DNA, 25 bp, Mus musculus
ttctgaaacataatcacagaactgt

SEQ ID NO: 392411 - DNA, 25 bp, Mus musculus
ttctgaaacccacagcatggtgaga

SEQ ID NO: 392412 - DNA, 25 bp, Mus musculus
ttctgaaacttacttacagctacga

SEQ ID NO: 392413 - DNA, 25 bp, Mus musculus
ttctgaaatacgattcagatggtta

SEQ ID NO: 392414 - DNA, 25 bp, Mus musculus
ttctgaacagcagctcccgttactt

SEQ ID NO: 392415 - DNA, 25 bp, Mus musculus
ttctgaacagcaggtcccaggattt

SEQ ID NO: 392416 - DNA, 25 bp, Mus musculus
ttctgaacctagtctctgtccagat

SEQ ID NO: 392417 - DNA, 25 bp, Mus musculus
ttctgaagagacttgcctttcatcc

SEQ ID NO: 392418 - DNA, 25 bp, Mus musculus
ttctgaagagatacaaggggacttc

SEQ ID NO: 392419 - DNA, 25 bp, Mus musculus
ttctgaagaggcttatccatgactg

SEQ ID NO: 392420 - DNA, 25 bp, Mus musculus
ttctgaaggagacccagcatgtgca

SEQ ID NO: 392421 - DNA, 25 bp, Mus musculus
ttctgaaggagccggcatgaccaag

SEQ ID NO: 392422 - DNA, 25 bp, Mus musculus
ttctgaaggcactggcactacaaga

SEQ ID NO: 392423 - DNA, 25 bp, Mus musculus
ttctgaagtagcttgccacaagctt

SEQ ID NO: 392424 - DNA, 25 bp, Mus musculus
ttctgaatcacggagtcaaagtgga

SEQ ID NO: 392425 - DNA, 25 bp, Mus musculus
ttctgaatcacgtgtcgagtgtccc

SEQ ID NO: 392426 - DNA, 25 bp, Mus musculus
ttctgaatctcccaggaaacctcat

SEQ ID NO: 392427 - DNA, 25 bp, Mus musculus
ttctgaatctcccaggtagtcaata

SEQ ID NO: 392428 - DNA, 25 bp, Mus musculus
ttctgaattgaggattaagcttgca

SEQ ID NO: 392429 - DNA, 25 bp, Mus musculus
ttctgacagatatagactcttcaag

SEQ ID NO: 392430 - DNA, 25 bp, Mus musculus
ttctgacatggaggaaatgctgtca

SEQ ID NO: 392431 - DNA, 25 bp, Mus musculus
ttctgaccaaagaatacattccacc

SEQ ID NO: 392432 - DNA, 25 bp, Mus musculus
ttctgaccaacagaacatacaacat

SEQ ID NO: 392433 - DNA, 25 bp, Mus musculus
ttctgaccaccacggcatcacggct

SEQ ID NO: 392434 - DNA, 25 bp, Mus musculus
ttctgaccgccctgctgctcatgat

SEQ ID NO: 392435 - DNA, 25 bp, Mus musculus
ttctgacgctgagctccaacagtgt

SEQ ID NO: 392436 - DNA, 25 bp, Mus musculus
ttctgactgcgacatttacattgtt

SEQ ID NO: 392437 - DNA, 25 bp, Mus musculus
ttctgactgcggttgaaatgggcat

SEQ ID NO: 392438 - DNA, 25 bp, Mus musculus
ttctgactgctgcagcagagagcca

SEQ ID NO: 392439 - DNA, 25 bp, Mus musculus
ttctgagaaagacaactgaggataa

SEQ ID NO: 392440 - DNA, 25 bp, Mus musculus
ttctgagaaagattgtctaaagcca

SEQ ID NO: 392441 - DNA, 25 bp, Mus musculus
ttctgagaacaggaatggccttgat

SEQ ID NO: 392442 - DNA, 25 bp, Mus musculus
ttctgagaaggggctcctgtttgtt

SEQ ID NO: 392443 - DNA, 25 bp, Mus musculus
ttctgagaaggttccctgtagccca

SEQ ID NO: 392444 - DNA, 25 bp, Mus musculus
ttctgagaccaccctcccttggaac

SEQ ID NO: 392445 - DNA, 25 bp, Mus musculus
ttctgagagaaactgcaagaaaaat

SEQ ID NO: 392446 - DNA, 25 bp, Mus musculus
ttctgagagaacatgaacaaaaagt

SEQ ID NO: 392447 - DNA, 25 bp, Mus musculus
ttctgagatagcaagcagattgggg

SEQ ID NO: 392448 - DNA, 25 bp, Mus musculus
ttctgagccaggtatcatacagact

SEQ ID NO: 392449 - DNA, 25 bp, Mus musculus
ttctgagcctcactggtgggtgtgc

SEQ ID NO: 392450 - DNA, 25 bp, Mus musculus
ttctgagccttgcgtgccctcccag

SEQ ID NO: 392451 - DNA, 25 bp, Mus musculus
ttctgagctgagaggcaaacccgtg

SEQ ID NO: 392452 - DNA, 25 bp, Mus musculus
ttctgagctggcttgctgcccattc

SEQ ID NO: 392453 - DNA, 25 bp, Mus musculus
ttctgaggaagcactggattgccaa

SEQ ID NO: 392454 - DNA, 25 bp, Mus musculus
ttctgaggaaggtattcggcaccaa

SEQ ID NO: 392455 - DNA, 25 bp, Mus musculus
ttctgaggagggtgtaaaagaagag

SEQ ID NO: 392456 - DNA, 25 bp, Mus musculus
ttctgaggccatgagttccgactct

SEQ ID NO: 392457 - DNA, 25 bp, Mus musculus
ttctgaggtgagctttgacgccgcc

SEQ ID NO: 392458 - DNA, 25 bp, Mus musculus
ttctgagtaaaggtgaacatcagtg

SEQ ID NO: 392459 - DNA, 25 bp, Mus musculus
ttctgagtaaaggtgaacgacgact

SEQ ID NO: 392460 - DNA, 25 bp, Mus musculus
ttctgagtcaagagcttggattctg

SEQ ID NO: 392461 - DNA, 25 bp, Mus musculus
ttctgagtcacgtgctgtaattaca

SEQ ID NO: 392462 - DNA, 25 bp, Mus musculus
ttctgagtctttcctggttttctat

SEQ ID NO: 392463 - DNA, 25 bp, Mus musculus
ttctgagtggagagggcgaggcccc

SEQ ID NO: 392464 - DNA, 25 bp, Mus musculus
ttctgagttttcgcgagaactttca

SEQ ID NO: 392465 - DNA, 25 bp, Mus musculus
ttctgataatagtgttatccaagat

SEQ ID NO: 392466 - DNA, 25 bp, Mus musculus
ttctgatagaagaagtgagctgaag

SEQ ID NO: 392467 - DNA, 25 bp, Mus musculus
ttctgatagaggtgccctgggacaa

SEQ ID NO: 392468 - DNA, 25 bp, Mus musculus
ttctgataggcttggtgaatcacag

SEQ ID NO: 392469 - DNA, 25 bp, Mus musculus
ttctgatatgaggacccatcctctg

SEQ ID NO: 392470 - DNA, 25 bp, Mus musculus
ttctgatcaacaggtctccattttg

SEQ ID NO: 392471 - DNA, 25 bp, Mus musculus
ttctgatcagcagagtgaaatggtt

SEQ ID NO: 392472 - DNA, 25 bp, Mus musculus
ttctgatcaggtgttgtttgtggca

SEQ ID NO: 392473 - DNA, 25 bp, Mus musculus
ttctgatcctagtgtcaaaggtccc

SEQ ID NO: 392474 - DNA, 25 bp, Mus musculus
ttctgatctccatgatggtggccag

SEQ ID NO: 392475 - DNA, 25 bp, Mus musculus
ttctgatcttgaacggggtgccacg

SEQ ID NO: 392476 - DNA, 25 bp, Mus musculus
ttctgatgaactcagctctgatgtc

SEQ ID NO: 392477 - DNA, 25 bp, Mus musculus
ttctgatgacactggctgcggctgg

SEQ ID NO: 392478 - DNA, 25 bp, Mus musculus
ttctgatgagctgggaagtcatcaa

SEQ ID NO: 392479 - DNA, 25 bp, Mus musculus
ttctgatgatgattcatgaaaaact

SEQ ID NO: 392480 - DNA, 25 bp, Mus musculus
ttctgatgatgttgctttcccctgt

SEQ ID NO: 392481 - DNA, 25 bp, Mus musculus
ttctgatgctgccaggagacgctct

SEQ ID NO: 392482 - DNA, 25 bp, Mus musculus
ttctgatggaggaatcaaaaatgaa

SEQ ID NO: 392483 - DNA, 25 bp, Mus musculus
ttctgattatagggtcctgctgatg

SEQ ID NO: 392484 - DNA, 25 bp, Mus musculus
ttctgattgaagcctgctgcaaaaa

SEQ ID NO: 392485 - DNA, 25 bp, Mus musculus
ttctgattgggactggaaaaggagg

SEQ ID NO: 392486 - DNA, 25 bp, Mus musculus
ttctgattggggtactggaaaaggt

SEQ ID NO: 392487 - DNA, 25 bp, Mus musculus
ttctgatttcgaggggacccagccg

SEQ ID NO: 392488 - DNA, 25 bp, Mus musculus
ttctgcaaaaacagatgtggaaaga

SEQ ID NO: 392489 - DNA, 25 bp, Mus musculus
ttctgcaaaaaggggatggaattcg

SEQ ID NO: 392490 - DNA, 25 bp, Mus musculus
ttctgcaaaagaaatacaaagagta

SEQ ID NO: 392491 - DNA, 25 bp, Mus musculus
ttctgcaaaagagctgcagggatgg

SEQ ID NO: 392492 - DNA, 25 bp, Mus musculus
ttctgcaaagagccgtctagacaag

SEQ ID NO: 392493 - DNA, 25 bp, Mus musculus
ttctgcaaagggagcttggcatgga

SEQ ID NO: 392494 - DNA, 25 bp, Mus musculus
ttctgcaagaaggagatctggaaca

SEQ ID NO: 392495 - DNA, 25 bp, Mus musculus
ttctgcaagagcaataaaattgcta

SEQ ID NO: 392496 - DNA, 25 bp, Mus musculus
ttctgcaaggcaaatctcatataaa

SEQ ID NO: 392497 - DNA, 25 bp, Mus musculus
ttctgcaagtgggtgggaccatcat

SEQ ID NO: 392498 - DNA, 25 bp, Mus musculus
ttctgcacagaaaacccagccagtg

SEQ ID NO: 392499 - DNA, 25 bp, Mus musculus
ttctgcacagacttggagcagttcg

SEQ ID NO: 392500 - DNA, 25 bp, Mus musculus
ttctgcaccagcaggaagtgatgtc

SEQ ID NO: 392501 - DNA, 25 bp, Mus musculus
ttctgcaccaggcatagcaggaagt

SEQ ID NO: 392502 - DNA, 25 bp, Mus musculus
ttctgcacggcgggtaacttcatgg

SEQ ID NO: 392503 - DNA, 25 bp, Mus musculus
ttctgcacgtgcagcgcccacaggc

SEQ ID NO: 392504 - DNA, 25 bp, Mus musculus
ttctgcacgtgcagggtccccgaca

SEQ ID NO: 392505 - DNA, 25 bp, Mus musculus
ttctgcactagagtatcaagagagc

SEQ ID NO: 392506 - DNA, 25 bp, Mus musculus
ttctgcactaggctccgcaggaggc

SEQ ID NO: 392507 - DNA, 25 bp, Mus musculus
ttctgcactctcagctccagctaga

SEQ ID NO: 392508 - DNA, 25 bp, Mus musculus
ttctgcagaagataccgggacacag

SEQ ID NO: 392509 - DNA, 25 bp, Mus musculus
ttctgcagaagggggactatgtatg

SEQ ID NO: 392510 - DNA, 25 bp, Mus musculus
ttctgcagaaggtttcaacactaaa

SEQ ID NO: 392511 - DNA, 25 bp, Mus musculus
ttctgcagaccatcctgtcagcacc

SEQ ID NO: 392512 - DNA, 25 bp, Mus musculus
ttctgcagacgaagacatggggatg

SEQ ID NO: 392513 - DNA, 25 bp, Mus musculus
ttctgcagaggaacagctgtgccaa

SEQ ID NO: 392514 - DNA, 25 bp, Mus musculus
ttctgcagatacaggatcacttctg

SEQ ID NO: 392515 - DNA, 25 bp, Mus musculus
ttctgcagcagatcgtgaaccttat

SEQ ID NO: 392516 - DNA, 25 bp, Mus musculus
ttctgcagctggcactggggctgct

SEQ ID NO: 392517 - DNA, 25 bp, Mus musculus
ttctgcaggctcagcaaatgacaag

SEQ ID NO: 392518 - DNA, 25 bp, Mus musculus
ttctgcagggcccaggaattgcatt

SEQ ID NO: 392519 - DNA, 25 bp, Mus musculus
ttctgcaggtcacgtacagtgcttt

SEQ ID NO: 392520 - DNA, 25 bp, Mus musculus
ttctgcatcaccctgacaaaggaga

SEQ ID NO: 392521 - DNA, 25 bp, Mus musculus
ttctgcatcccgttcacgcaaagaa

SEQ ID NO: 392522 - DNA, 25 bp, Mus musculus
ttctgcatctatgaggagaaccatg

SEQ ID NO: 392523 - DNA, 25 bp, Mus musculus
ttctgcatctgaacaccgaccttag

SEQ ID NO: 392524 - DNA, 25 bp, Mus musculus
ttctgcatctgagtgggaactggta

SEQ ID NO: 392525 - DNA, 25 bp, Mus musculus
ttctgcatgaacttctgcacagcag

SEQ ID NO: 392526 - DNA, 25 bp, Mus musculus
ttctgcatgaatttcagttcgttgt

SEQ ID NO: 392527 - DNA, 25 bp, Mus musculus
ttctgcatgaggcttggatctagca

SEQ ID NO: 392528 - DNA, 25 bp, Mus musculus
ttctgcatgctcatggtgggcagca

SEQ ID NO: 392529 - DNA, 25 bp, Mus musculus
ttctgcatggctgatccttccttgt

SEQ ID NO: 392530 - DNA, 25 bp, Mus musculus
ttctgcattcctctgtgtaccgagg

SEQ ID NO: 392531 - DNA, 25 bp, Mus musculus
ttctgcattcgctgtgacagcgagc

SEQ ID NO: 392532 - DNA, 25 bp, Mus musculus
ttctgcattcgtgccgaggagttgt

SEQ ID NO: 392533 - DNA, 25 bp, Mus musculus
ttctgcattcgtggtgtttgtcttt

SEQ ID NO: 392534 - DNA, 25 bp, Mus musculus
ttctgcatttactgagaaacatggt

SEQ ID NO: 392535 - DNA, 25 bp, Mus musculus
ttctgcattttaaggaagatccttg

SEQ ID NO: 392536 - DNA, 25 bp, Mus musculus
ttctgcattttaaggagcataaaca

SEQ ID NO: 392537 - DNA, 25 bp, Mus musculus
ttctgccaaagttgctcaccaaggt

SEQ ID NO: 392538 - DNA, 25 bp, Mus musculus
ttctgccaaggacctccctgcaccc

SEQ ID NO: 392539 - DNA, 25 bp, Mus musculus
ttctgccaaggcgcagcacctccct

SEQ ID NO: 392540 - DNA, 25 bp, Mus musculus
ttctgccacctactggacccttttg

SEQ ID NO: 392541 - DNA, 25 bp, Mus musculus
ttctgccacctccaagtcagcctcc

SEQ ID NO: 392542 - DNA, 25 bp, Mus musculus
ttctgccaggaatgtaataacatgc

SEQ ID NO: 392543 - DNA, 25 bp, Mus musculus
ttctgccagtgtgattttgacattg

SEQ ID NO: 392544 - DNA, 25 bp, Mus musculus
ttctgccatctagcactaagagcgg

SEQ ID NO: 392545 - DNA, 25 bp, Mus musculus
ttctgcccagccaccccgctggggt

SEQ ID NO: 392546 - DNA, 25 bp, Mus musculus
ttctgccccaggtgtaaagaagagc

SEQ ID NO: 392547 - DNA, 25 bp, Mus musculus
ttctgccgccagcattgacctcttt

SEQ ID NO: 392548 - DNA, 25 bp, Mus musculus
ttctgcctacatctggtagtttaca

SEQ ID NO: 392549 - DNA, 25 bp, Mus musculus
ttctgcctagcatcaacgatatagc

SEQ ID NO: 392550 - DNA, 25 bp, Mus musculus
ttctgcctaggtatgtctatatagc

SEQ ID NO: 392551 - DNA, 25 bp, Mus musculus
ttctgcctaggtcctcaactttgac

SEQ ID NO: 392552 - DNA, 25 bp, Mus musculus
ttctgcctcaggacctcttcctgat

SEQ ID NO: 392553 - DNA, 25 bp, Mus musculus
ttctgcctccaggagaaggtccttt

SEQ ID NO: 392554 - DNA, 25 bp, Mus musculus
ttctgcctgacaaattgacatcagc

SEQ ID NO: 392555 - DNA, 25 bp, Mus musculus
ttctgcctgacaattggcagcttca

SEQ ID NO: 392556 - DNA, 25 bp, Mus musculus
ttctgcctgaggaggattcagaatt

SEQ ID NO: 392557 - DNA, 25 bp, Mus musculus
ttctgcctgggatgcgccgcagcac

SEQ ID NO: 392558 - DNA, 25 bp, Mus musculus
ttctgcctgggattttcctggtctg

SEQ ID NO: 392559 - DNA, 25 bp, Mus musculus
ttctgcctgtattggccttctgtat

SEQ ID NO: 392560 - DNA, 25 bp, Mus musculus
ttctgcctttgaaacagacataatg

SEQ ID NO: 392561 - DNA, 25 bp, Mus musculus
ttctgcctttgaacatgattctgtt

SEQ ID NO: 392562 - DNA, 25 bp, Mus musculus
ttctgcctttgggctgtaccttggc

SEQ ID NO: 392563 - DNA, 25 bp, Mus musculus
ttctgcgaaactgaagaagatgctg

SEQ ID NO: 392564 - DNA, 25 bp, Mus musculus
ttctgcgattcccaaggccttcccc

SEQ ID NO: 392565 - DNA, 25 bp, Mus musculus
ttctgcgcagagaggtccaggatgc

SEQ ID NO: 392566 - DNA, 25 bp, Mus musculus
ttctgcggaatggggtgagtgagga

SEQ ID NO: 392567 - DNA, 25 bp, Mus musculus
ttctgcgggctttgcttaaatccag

SEQ ID NO: 392568 - DNA, 25 bp, Mus musculus
ttctgcgggtgcttctgtttccggt

SEQ ID NO: 392569 - DNA, 25 bp, Mus musculus
ttctgctaaaccattgctggcctcg

SEQ ID NO: 392570 - DNA, 25 bp, Mus musculus
ttctgctacaagcttcctgacagtg

SEQ ID NO: 392571 - DNA, 25 bp, Mus musculus
ttctgctacagcggctgtacagcat

SEQ ID NO: 392572 - DNA, 25 bp, Mus musculus
ttctgctacaggagtcagcagcccc

SEQ ID NO: 392573 - DNA, 25 bp, Mus musculus
ttctgctatagaaggtaattacact

SEQ ID NO: 392574 - DNA, 25 bp, Mus musculus
ttctgctcacagcctccctcttaac

SEQ ID NO: 392575 - DNA, 25 bp, Mus musculus
ttctgctccagcaaggtgcagagct

SEQ ID NO: 392576 - DNA, 25 bp, Mus musculus
ttctgctcggcagcacatcatgcaa

SEQ ID NO: 392577 - DNA, 25 bp, Mus musculus
ttctgctctgaaggaaagagatgtc

SEQ ID NO: 392578 - DNA, 25 bp, Mus musculus
ttctgctctgcatggtgacatggac

SEQ ID NO: 392579 - DNA, 25 bp, Mus musculus
ttctgctctggcccgtgggattgac

SEQ ID NO: 392580 - DNA, 25 bp, Mus musculus
ttctgctgagcaaagatgaagcggc

SEQ ID NO: 392581 - DNA, 25 bp, Mus musculus
ttctgctgataccggtgacagtggt

SEQ ID NO: 392582 - DNA, 25 bp, Mus musculus
ttctgctgatggacggctctcagac

SEQ ID NO: 392583 - DNA, 25 bp, Mus musculus
ttctgctgtacgcgtcttgttggag

SEQ ID NO: 392584 - DNA, 25 bp, Mus musculus
ttctgctgtacgcgtgccggaattg

SEQ ID NO: 392585 - DNA, 25 bp, Mus musculus
ttctgctgtatgggtggtctatcac

SEQ ID NO: 392586 - DNA, 25 bp, Mus musculus
ttctgctgtatggtgcccagcacgg

SEQ ID NO: 392587 - DNA, 25 bp, Mus musculus
ttctgctgtatttcccacaggtttt

SEQ ID NO: 392588 - DNA, 25 bp, Mus musculus
ttctgctgtatttctcacagatctt

SEQ ID NO: 392589 - DNA, 25 bp, Mus musculus
ttctgctgtggaacgacatcgccat

SEQ ID NO: 392590 - DNA, 25 bp, Mus musculus
ttctgcttagcctgctgaggcattg

SEQ ID NO: 392591 - DNA, 25 bp, Mus musculus
ttctgcttagtgcctgcacgtctgt

SEQ ID NO: 392592 - DNA, 25 bp, Mus musculus
ttctgcttatggcgtgcgcagggac

SEQ ID NO: 392593 - DNA, 25 bp, Mus musculus
ttctgcttatgtgcttctgggtcct

SEQ ID NO: 392594 - DNA, 25 bp, Mus musculus
ttctgcttcaagcagcatgattggg

SEQ ID NO: 392595 - DNA, 25 bp, Mus musculus
ttctgcttcaagcagcgttccacgc

SEQ ID NO: 392596 - DNA, 25 bp, Mus musculus
ttctgcttcaagcagtgtggcattg

SEQ ID NO: 392597 - DNA, 25 bp, Mus musculus
ttctgcttccacctgtcacagcaaa

SEQ ID NO: 392598 - DNA, 25 bp, Mus musculus
ttctgcttcccaggctaaggagaag

SEQ ID NO: 392599 - DNA, 25 bp, Mus musculus
ttctgcttgatgtcctagaagaccc

SEQ ID NO: 392600 - DNA, 25 bp, Mus musculus
ttctgctttcaggttctcagaagca

SEQ ID NO: 392601 - DNA, 25 bp, Mus musculus
ttctgctttcaggttctgcagcatt

SEQ ID NO: 392602 - DNA, 25 bp, Mus musculus
ttctgctttcaggttgggagaaaca

SEQ ID NO: 392603 - DNA, 25 bp, Mus musculus
ttctgcttttgtctgctgcccatca

SEQ ID NO: 392604 - DNA, 25 bp, Mus musculus
ttctggaaaacagatttattcttca

SEQ ID NO: 392605 - DNA, 25 bp, Mus musculus
ttctggaaagaatatccagttatgg

SEQ ID NO: 392606 - DNA, 25 bp, Mus musculus
ttctggaaagagatggctgtctcaa

SEQ ID NO: 392607 - DNA, 25 bp, Mus musculus
ttctggaaagctaggtagaagccca

SEQ ID NO: 392608 - DNA, 25 bp, Mus musculus
ttctggaaaggcctagactggttcc

SEQ ID NO: 392609 - DNA, 25 bp, Mus musculus
ttctggaaagtgagttacatgaaca

SEQ ID NO: 392610 - DNA, 25 bp, Mus musculus
ttctggaaatcctgagaatatcttg

SEQ ID NO: 392611 - DNA, 25 bp, Mus musculus
ttctggaaatggctgaccaaggtcg

SEQ ID NO: 392612 - DNA, 25 bp, Mus musculus
ttctggaactctgacagtgtccatt

SEQ ID NO: 392613 - DNA, 25 bp, Mus musculus
ttctggaactctgccaaaaatggat

SEQ ID NO: 392614 - DNA, 25 bp, Mus musculus
ttctggaacttcacgattcctgtgt

SEQ ID NO: 392615 - DNA, 25 bp, Mus musculus
ttctggaagattcgggcttcagttg

SEQ ID NO: 392616 - DNA, 25 bp, Mus musculus
ttctggaagccaactgggtggtgat

SEQ ID NO: 392617 - DNA, 25 bp, Mus musculus
ttctggaagccaagaaagccctctc

SEQ ID NO: 392618 - DNA, 25 bp, Mus musculus
ttctggaatacactgcatctatatt

SEQ ID NO: 392619 - DNA, 25 bp, Mus musculus
ttctggaatatcctggaccatgctg

SEQ ID NO: 392620 - DNA, 25 bp, Mus musculus
ttctggaatgacagatcagctcgaa

SEQ ID NO: 392621 - DNA, 25 bp, Mus musculus
ttctggaatgatctcaacttcctgt

SEQ ID NO: 392622 - DNA, 25 bp, Mus musculus
ttctggaatgtggaacagccccaac

SEQ ID NO: 392623 - DNA, 25 bp, Mus musculus
ttctggaatgtggtagcgagatggg

SEQ ID NO: 392624 - DNA, 25 bp, Mus musculus
ttctggaattacagggatcgcttac

SEQ ID NO: 392625 - DNA, 25 bp, Mus musculus
ttctggacaaggtcagtcctcccgg

SEQ ID NO: 392626 - DNA, 25 bp, Mus musculus
ttctggacactcaagaaaattacaa

SEQ ID NO: 392627 - DNA, 25 bp, Mus musculus
ttctggacactcaagagagggactc

SEQ ID NO: 392628 - DNA, 25 bp, Mus musculus
ttctggacactcaaggcatttcccc

SEQ ID NO: 392629 - DNA, 25 bp, Mus musculus
ttctggaccctgcatggtttattga

SEQ ID NO: 392630 - DNA, 25 bp, Mus musculus
ttctggacctggctgcaggtcctgg

SEQ ID NO: 392631 - DNA, 25 bp, Mus musculus
ttctggactctcaggttgtgaggac

SEQ ID NO: 392632 - DNA, 25 bp, Mus musculus
ttctggactttcaagatgacgggac

SEQ ID NO: 392633 - DNA, 25 bp, Mus musculus
ttctggactttcaagcctatgtgtt

SEQ ID NO: 392634 - DNA, 25 bp, Mus musculus
ttctggagaagctccagcacccgag

SEQ ID NO: 392635 - DNA, 25 bp, Mus musculus
ttctggagacccggatgggagccag

SEQ ID NO: 392636 - DNA, 25 bp, Mus musculus
ttctggagagaagtgtgctggtgtc

SEQ ID NO: 392637 - DNA, 25 bp, Mus musculus
ttctggagagggcatcatggctctt

SEQ ID NO: 392638 - DNA, 25 bp, Mus musculus
ttctggagcaacaaggggaaagcga

SEQ ID NO: 392639 - DNA, 25 bp, Mus musculus
ttctggagcaacaagtccgtgcact

SEQ ID NO: 392640 - DNA, 25 bp, Mus musculus
ttctggagcagtgccaataacttcg

SEQ ID NO: 392641 - DNA, 25 bp, Mus musculus
ttctggaggcaaggatggccaggct

SEQ ID NO: 392642 - DNA, 25 bp, Mus musculus
ttctggaggcaaggctatgctgtgg

SEQ ID NO: 392643 - DNA, 25 bp, Mus musculus
ttctggataagagtgcctcgggccc

SEQ ID NO: 392644 - DNA, 25 bp, Mus musculus
ttctggataagcccacctggaagca

SEQ ID NO: 392645 - DNA, 25 bp, Mus musculus
ttctggataaggtgcttctgtgtgg

SEQ ID NO: 392646 - DNA, 25 bp, Mus musculus
ttctggatacagacaggatctttct

SEQ ID NO: 392647 - DNA, 25 bp, Mus musculus
ttctggatacagccaaggtctccaa

SEQ ID NO: 392648 - DNA, 25 bp, Mus musculus
ttctggatacaggtggaaacgtcct

SEQ ID NO: 392649 - DNA, 25 bp, Mus musculus
ttctggatatgcaagctcttgaaga

SEQ ID NO: 392650 - DNA, 25 bp, Mus musculus
ttctggatatgcaagttttgattat

SEQ ID NO: 392651 - DNA, 25 bp, Mus musculus
ttctggatgaagctgtagcaatgga

SEQ ID NO: 392652 - DNA, 25 bp, Mus musculus
ttctggatgactctgctcactggag

SEQ ID NO: 392653 - DNA, 25 bp, Mus musculus
ttctggatgagaattggcaaggttg

SEQ ID NO: 392654 - DNA, 25 bp, Mus musculus
ttctggatgctatgtcaggatcgca

SEQ ID NO: 392655 - DNA, 25 bp, Mus musculus
ttctggcaaaagatgcttgcattgg

SEQ ID NO: 392656 - DNA, 25 bp, Mus musculus
ttctggcagagaacgaatcttggag

SEQ ID NO: 392657 - DNA, 25 bp, Mus musculus
ttctggcagagacttggcagtgtaa

SEQ ID NO: 392658 - DNA, 25 bp, Mus musculus
ttctggcagaggcattgaagacaag

SEQ ID NO: 392659 - DNA, 25 bp, Mus musculus
ttctggcagccatggtcacgtctct

SEQ ID NO: 392660 - DNA, 25 bp, Mus musculus
ttctggcagttttttgcatgttaca

SEQ ID NO: 392661 - DNA, 25 bp, Mus musculus
ttctggcattgatggtttgtcttct

SEQ ID NO: 392662 - DNA, 25 bp, Mus musculus
ttctggcattggatctactgctgag

SEQ ID NO: 392663 - DNA, 25 bp, Mus musculus
ttctggcccataaatgctgttggct

SEQ ID NO: 392664 - DNA, 25 bp, Mus musculus
ttctggccctagaggtccacctggc

SEQ ID NO: 392665 - DNA, 25 bp, Mus musculus
ttctggcctatgatgatcctcatgg

SEQ ID NO: 392666 - DNA, 25 bp, Mus musculus
ttctggcctatgatggatctgatga

SEQ ID NO: 392667 - DNA, 25 bp, Mus musculus
ttctggcctcagatgccctgctgtg

SEQ ID NO: 392668 - DNA, 25 bp, Mus musculus
ttctggcctccgatggtgacattat

SEQ ID NO: 392669 - DNA, 25 bp, Mus musculus
ttctggcgaatgggaaagggccaaa

SEQ ID NO: 392670 - DNA, 25 bp, Mus musculus
ttctggctcacagagaaggacttga

SEQ ID NO: 392671 - DNA, 25 bp, Mus musculus
ttctggctcagatgcgattcatgct

SEQ ID NO: 392672 - DNA, 25 bp, Mus musculus
ttctggctccagaaggatctgttcc

SEQ ID NO: 392673 - DNA, 25 bp, Mus musculus
ttctggctctctgaggtggaggctc

SEQ ID NO: 392674 - DNA, 25 bp, Mus musculus
ttctggctggcagcactgaaaactg

SEQ ID NO: 392675 - DNA, 25 bp, Mus musculus
ttctggctggcaggaggcacagtgg

SEQ ID NO: 392676 - DNA, 25 bp, Mus musculus
ttctggctgtttctgggtgtggcca

SEQ ID NO: 392677 - DNA, 25 bp, Mus musculus
ttctggcttccagggctggcgctgc

SEQ ID NO: 392678 - DNA, 25 bp, Mus musculus
ttctggcttctggctccaggccggg

SEQ ID NO: 392679 - DNA, 25 bp, Mus musculus
ttctgggaagcttccagctttatct

SEQ ID NO: 392680 - DNA, 25 bp, Mus musculus
ttctgggaagtgcgaaatcaaagtt

SEQ ID NO: 392681 - DNA, 25 bp, Mus musculus
ttctgggagaagatgctcagaccag

SEQ ID NO: 392682 - DNA, 25 bp, Mus musculus
ttctgggattaaaggaaacaaatgt

SEQ ID NO: 392683 - DNA, 25 bp, Mus musculus
ttctgggcaacaagggaaatactgg

SEQ ID NO: 392684 - DNA, 25 bp, Mus musculus
ttctgggcaacaaggtggaccccct

SEQ ID NO: 392685 - DNA, 25 bp, Mus musculus
ttctgggcaaggagcacttcaatta

SEQ ID NO: 392686 - DNA, 25 bp, Mus musculus
ttctgggccaggagtctccaaaacc

SEQ ID NO: 392687 - DNA, 25 bp, Mus musculus
ttctgggccatttcaagtccgaggt

SEQ ID NO: 392688 - DNA, 25 bp, Mus musculus
ttctgggcgaggaaaaagtaaaggt

SEQ ID NO: 392689 - DNA, 25 bp, Mus musculus
ttctgggcgaggagagaacacattt

SEQ ID NO: 392690 - DNA, 25 bp, Mus musculus
ttctgggctaagacctccagtcaga

SEQ ID NO: 392691 - DNA, 25 bp, Mus musculus
ttctgggctctgcagattctcattg

SEQ ID NO: 392692 - DNA, 25 bp, Mus musculus
ttctggggaaggtgcagctggatct

SEQ ID NO: 392693 - DNA, 25 bp, Mus musculus
ttctggggaggcagtaaattacaga

SEQ ID NO: 392694 - DNA, 25 bp, Mus musculus
ttctggggaggcagtgttcagggag

SEQ ID NO: 392695 - DNA, 25 bp, Mus musculus
ttctggggcagatcctccttatccc

SEQ ID NO: 392696 - DNA, 25 bp, Mus musculus
ttctggggttgcctaggtgaggcat

SEQ ID NO: 392697 - DNA, 25 bp, Mus musculus
ttctgggtcaaagcactccactcat

SEQ ID NO: 392698 - DNA, 25 bp, Mus musculus
ttctgggtcaaagcattcctcaacc

SEQ ID NO: 392699 - DNA, 25 bp, Mus musculus
ttctgggtcagggggattgatgtga

SEQ ID NO: 392700 - DNA, 25 bp, Mus musculus
ttctgggtcctggatggagcctgca

SEQ ID NO: 392701 - DNA, 25 bp, Mus musculus
ttctgggtcctgggagccacgctgg

SEQ ID NO: 392702 - DNA, 25 bp, Mus musculus
ttctgggtgaaggagagtttgggtc

SEQ ID NO: 392703 - DNA, 25 bp, Mus musculus
ttctgggttgagtaaattcacagat

SEQ ID NO: 392704 - DNA, 25 bp, Mus musculus
ttctggtaatccccggcagcccaac

SEQ ID NO: 392705 - DNA, 25 bp, Mus musculus
ttctggtaccacagaatgagagcca

SEQ ID NO: 392706 - DNA, 25 bp, Mus musculus
ttctggtaccacagagcatttctga

SEQ ID NO: 392707 - DNA, 25 bp, Mus musculus
ttctggtacctgcagcccatacctg

SEQ ID NO: 392708 - DNA, 25 bp, Mus musculus
ttctggtacctgcagtgcctgagac

SEQ ID NO: 392709 - DNA, 25 bp, Mus musculus
ttctggtcagtgttcacaccgcggg

SEQ ID NO: 392710 - DNA, 25 bp, Mus musculus
ttctggtgaagattatgggacagtc

SEQ ID NO: 392711 - DNA, 25 bp, Mus musculus
ttctggtgaggctagaaagaaggat

SEQ ID NO: 392712 - DNA, 25 bp, Mus musculus
ttctggtgagtatgcagctgataaa

SEQ ID NO: 392713 - DNA, 25 bp, Mus musculus
ttctggtgatggccataaaatcagg

SEQ ID NO: 392714 - DNA, 25 bp, Mus musculus
ttctggtgccagcaactggccatgc

SEQ ID NO: 392715 - DNA, 25 bp, Mus musculus
ttctggtgccagctctaggaatgat

SEQ ID NO: 392716 - DNA, 25 bp, Mus musculus
ttctggtgccagggtttctctgtgt

SEQ ID NO: 392717 - DNA, 25 bp, Mus musculus
ttctggtgctgaaacccttcactga

SEQ ID NO: 392718 - DNA, 25 bp, Mus musculus
ttctggtgtgcttggattacacagt

SEQ ID NO: 392719 - DNA, 25 bp, Mus musculus
ttctggtgtgcttgtgctcgccgtg

SEQ ID NO: 392720 - DNA, 25 bp, Mus musculus
ttctggtgttcggtagagctggtga

SEQ ID NO: 392721 - DNA, 25 bp, Mus musculus
ttctggtgttcggtgaagatggttc

SEQ ID NO: 392722 - DNA, 25 bp, Mus musculus
ttctggttctggctgatctcttcgt

SEQ ID NO: 392723 - DNA, 25 bp, Mus musculus
ttctggttgcccaggtgctgggctt

SEQ ID NO: 392724 - DNA, 25 bp, Mus musculus
ttctggtttcaaggtgacagatcag

SEQ ID NO: 392725 - DNA, 25 bp, Mus musculus
ttctggtttgccagctccggaaaag

SEQ ID NO: 392726 - DNA, 25 bp, Mus musculus
ttctggtttgtcaaagacatagatg

SEQ ID NO: 392727 - DNA, 25 bp, Mus musculus
ttctgtaacattgccattatcctca

SEQ ID NO: 392728 - DNA, 25 bp, Mus musculus
ttctgtaacgtatgatggatcgaat

SEQ ID NO: 392729 - DNA, 25 bp, Mus musculus
ttctgtaacgtatgatggattcaat

SEQ ID NO: 392730 - DNA, 25 bp, Mus musculus
ttctgtaagcatggtcccctgtgta

SEQ ID NO: 392731 - DNA, 25 bp, Mus musculus
ttctgtacagaacagctaggactca

SEQ ID NO: 392732 - DNA, 25 bp, Mus musculus
ttctgtacagaacaggcaaagacaa

SEQ ID NO: 392733 - DNA, 25 bp, Mus musculus
ttctgtaccgatgcactcccgctgc

SEQ ID NO: 392734 - DNA, 25 bp, Mus musculus
ttctgtactctcgggaggtgttcct

SEQ ID NO: 392735 - DNA, 25 bp, Mus musculus
ttctgtagaaaggaacatgtctcag

SEQ ID NO: 392736 - DNA, 25 bp, Mus musculus
ttctgtagacgctcttttcagaccc

SEQ ID NO: 392737 - DNA, 25 bp, Mus musculus
ttctgtagagatttggcccagtact

SEQ ID NO: 392738 - DNA, 25 bp, Mus musculus
ttctgtagccctagatcctttacaa

SEQ ID NO: 392739 - DNA, 25 bp, Mus musculus
ttctgtattatcgttatgagtattg

SEQ ID NO: 392740 - DNA, 25 bp, Mus musculus
ttctgtcaaaacttggctcttgacc

SEQ ID NO: 392741 - DNA, 25 bp, Mus musculus
ttctgtcaagccaaacatccagaac

SEQ ID NO: 392742 - DNA, 25 bp, Mus musculus
ttctgtcaagcctggaatgaagtat

SEQ ID NO: 392743 - DNA, 25 bp, Mus musculus
ttctgtcagaagccacattgaattt

SEQ ID NO: 392744 - DNA, 25 bp, Mus musculus
ttctgtcatagcaaccaccgctctt

SEQ ID NO: 392745 - DNA, 25 bp, Mus musculus
ttctgtcatagcactggaccacggg

SEQ ID NO: 392746 - DNA, 25 bp, Mus musculus
ttctgtcattcacgagcaccctgaa

SEQ ID NO: 392747 - DNA, 25 bp, Mus musculus
ttctgtcattcacggtgaaggcagc

SEQ ID NO: 392748 - DNA, 25 bp, Mus musculus
ttctgtccagagcctcaaggtccct

SEQ ID NO: 392749 - DNA, 25 bp, Mus musculus
ttctgtccaggatcattttaacctc

SEQ ID NO: 392750 - DNA, 25 bp, Mus musculus
ttctgtccctcccctttctcccttg

SEQ ID NO: 392751 - DNA, 25 bp, Mus musculus
ttctgtccgaggtcgctcatccgat

SEQ ID NO: 392752 - DNA, 25 bp, Mus musculus
ttctgtccgctcagggatggtctgt

SEQ ID NO: 392753 - DNA, 25 bp, Mus musculus
ttctgtccgctcagggcttctgacc

SEQ ID NO: 392754 - DNA, 25 bp, Mus musculus
ttctgtcggacggggctgaaaagct

SEQ ID NO: 392755 - DNA, 25 bp, Mus musculus
ttctgtcggacttagaagaattgaa

SEQ ID NO: 392756 - DNA, 25 bp, Mus musculus
ttctgtcgggagatgagaatcagct

SEQ ID NO: 392757 - DNA, 25 bp, Mus musculus
ttctgtcgggagatgagcattcgca

SEQ ID NO: 392758 - DNA, 25 bp, Mus musculus
ttctgtcgggagatggatccttaaa

SEQ ID NO: 392759 - DNA, 25 bp, Mus musculus
ttctgtctcccctgaggcctttgct

SEQ ID NO: 392760 - DNA, 25 bp, Mus musculus
ttctgtctgagatcgtcagtggcat

SEQ ID NO: 392761 - DNA, 25 bp, Mus musculus
ttctgtctggagaagattgaagaaa

SEQ ID NO: 392762 - DNA, 25 bp, Mus musculus
ttctgtctggagaaggtggactata

SEQ ID NO: 392763 - DNA, 25 bp, Mus musculus
ttctgtctgtggcggcacagtggtt

SEQ ID NO: 392764 - DNA, 25 bp, Mus musculus
ttctgtctgtggcggtcattgtcat

SEQ ID NO: 392765 - DNA, 25 bp, Mus musculus
ttctgtcttaatcagtggatggaga

SEQ ID NO: 392766 - DNA, 25 bp, Mus musculus
ttctgtgaagaaaagacatgctcac

SEQ ID NO: 392767 - DNA, 25 bp, Mus musculus
ttctgtgaagatgggaaataagttc

SEQ ID NO: 392768 - DNA, 25 bp, Mus musculus
ttctgtgaaggcgttaagatcatct

SEQ ID NO: 392769 - DNA, 25 bp, Mus musculus
ttctgtgaagtcaccttaattttcc

SEQ ID NO: 392770 - DNA, 25 bp, Mus musculus
ttctgtgacaagggagcagaaagaa

SEQ ID NO: 392771 - DNA, 25 bp, Mus musculus
ttctgtgacaaggtcatagtccgcc

SEQ ID NO: 392772 - DNA, 25 bp, Mus musculus
ttctgtgaccttagaatcagctgcc

SEQ ID NO: 392773 - DNA, 25 bp, Mus musculus
ttctgtgagtcagaaccatctggtg

SEQ ID NO: 392774 - DNA, 25 bp, Mus musculus
ttctgtgatggactgcagtaatgga

SEQ ID NO: 392775 - DNA, 25 bp, Mus musculus
ttctgtgatggccaaagatctcatc

SEQ ID NO: 392776 - DNA, 25 bp, Mus musculus
ttctgtgattatcaggactagcgga

SEQ ID NO: 392777 - DNA, 25 bp, Mus musculus
ttctgtgattatgtctgtcagaatc

SEQ ID NO: 392778 - DNA, 25 bp, Mus musculus
ttctgtgcacacatgtctgagagca

SEQ ID NO: 392779 - DNA, 25 bp, Mus musculus
ttctgtgcaggtgcagacctgaagg

SEQ ID NO: 392780 - DNA, 25 bp, Mus musculus
ttctgtgccaacatggccatcctgg

SEQ ID NO: 392781 - DNA, 25 bp, Mus musculus
ttctgtgccacgccccctgattgaa

SEQ ID NO: 392782 - DNA, 25 bp, Mus musculus
ttctgtgccaggctgtttgattatc

SEQ ID NO: 392783 - DNA, 25 bp, Mus musculus
ttctgtgctatgaaggtgaagcttc

SEQ ID NO: 392784 - DNA, 25 bp, Mus musculus
ttctgtgctgtttggaagtgaaatg

SEQ ID NO: 392785 - DNA, 25 bp, Mus musculus
ttctgtggacgaagaaaatattccc

SEQ ID NO: 392786 - DNA, 25 bp, Mus musculus
ttctgtggagcggatgtgggtggct

SEQ ID NO: 392787 - DNA, 25 bp, Mus musculus
ttctgtggccatttctggcagctct

SEQ ID NO: 392788 - DNA, 25 bp, Mus musculus
ttctgtggggaagaattcttgaagt

SEQ ID NO: 392789 - DNA, 25 bp, Mus musculus
ttctgtgggttagcgctaactgtcc

SEQ ID NO: 392790 - DNA, 25 bp, Mus musculus
ttctgtgtacctcagctggattcat

SEQ ID NO: 392791 - DNA, 25 bp, Mus musculus
ttctgtgtcaagcccaacaagcttc

SEQ ID NO: 392792 - DNA, 25 bp, Mus musculus
ttctgtgtctggaggaggtaaatga

SEQ ID NO: 392793 - DNA, 25 bp, Mus musculus
ttctgtgtggaggtactacaagcct

SEQ ID NO: 392794 - DNA, 25 bp, Mus musculus
ttctgtgttgatgagaggctgtaag

SEQ ID NO: 392795 - DNA, 25 bp, Mus musculus
ttctgtgttgcggttccctcatcgg

SEQ ID NO: 392796 - DNA, 25 bp, Mus musculus
ttctgttagacagaatggcaatccc

SEQ ID NO: 392797 - DNA, 25 bp, Mus musculus
ttctgttcaggaaactggagacccc

SEQ ID NO: 392798 - DNA, 25 bp, Mus musculus
ttctgttcaggaggaagcagaaatc

SEQ ID NO: 392799 - DNA, 25 bp, Mus musculus
ttctgttcaggatatagatctgatt

SEQ ID NO: 392800 - DNA, 25 bp, Mus musculus
ttctgttcccatgagaacccctgag

SEQ ID NO: 392801 - DNA, 25 bp, Mus musculus
ttctgttcccatggaatcattggtc

SEQ ID NO: 392802 - DNA, 25 bp, Mus musculus
ttctgttccttccgaaccctgtgta

SEQ ID NO: 392803 - DNA, 25 bp, Mus musculus
ttctgttctctgatttggggatatt

SEQ ID NO: 392804 - DNA, 25 bp, Mus musculus
ttctgttctctggcgtaatagcttg

SEQ ID NO: 392805 - DNA, 25 bp, Mus musculus
ttctgttctctggtgaagaaatctt

SEQ ID NO: 392806 - DNA, 25 bp, Mus musculus
ttctgttctggcggatgaaatgtgg

SEQ ID NO: 392807 - DNA, 25 bp, Mus musculus
ttctgttgcaagcctacttctccct

SEQ ID NO: 392808 - DNA, 25 bp, Mus musculus
ttctgttgcaaggtgatctctgcac

SEQ ID NO: 392809 - DNA, 25 bp, Mus musculus
ttctgttggagataccttcctatcc

SEQ ID NO: 392810 - DNA, 25 bp, Mus musculus
ttctgtttccgggtgccatgcagaa

SEQ ID NO: 392811 - DNA, 25 bp, Mus musculus
ttctgtttcgatctatgtaagagca

SEQ ID NO: 392812 - DNA, 25 bp, Mus musculus
ttctgtttcggacttgccatcaacc

SEQ ID NO: 392813 - DNA, 25 bp, Mus musculus
ttctgtttctcgctggaaggctcta

SEQ ID NO: 392814 - DNA, 25 bp, Mus musculus
ttctgtttgaaatggctcggtttta

SEQ ID NO: 392815 - DNA, 25 bp, Mus musculus
ttctgtttgaggttcctgggtggag

SEQ ID NO: 392816 - DNA, 25 bp, Mus musculus
ttctgtttgctcagggtgcagtgag

SEQ ID NO: 392817 - DNA, 25 bp, Mus musculus
ttctgttttgtgaaggacaaggcta

SEQ ID NO: 392818 - DNA, 25 bp, Mus musculus
ttcttaaaaagtgcttctctctgaa

SEQ ID NO: 392819 - DNA, 25 bp, Mus musculus
ttcttaacaaggcacctaattacaa

SEQ ID NO: 392820 - DNA, 25 bp, Mus musculus
ttcttaacaaggtgcagatcactgg

SEQ ID NO: 392821 - DNA, 25 bp, Mus musculus
ttcttaacaggcacgtgacacaagc

SEQ ID NO: 392822 - DNA, 25 bp, Mus musculus
ttcttaaccctgcaactgatgagat

SEQ ID NO: 392823 - DNA, 25 bp, Mus musculus
ttcttaactatatgagcgatgtcga

SEQ ID NO: 392824 - DNA, 25 bp, Mus musculus
ttcttaagaagaaagcagcacacac

SEQ ID NO: 392825 - DNA, 25 bp, Mus musculus
ttcttaagaagaaaggactgacaga

SEQ ID NO: 392826 - DNA, 25 bp, Mus musculus
ttcttaagagaatacggacgggcca

SEQ ID NO: 392827 - DNA, 25 bp, Mus musculus
ttcttaagagcatggataagaatgg

SEQ ID NO: 392828 - DNA, 25 bp, Mus musculus
ttcttaatataacttgcaccgatta

SEQ ID NO: 392829 - DNA, 25 bp, Mus musculus
ttcttaatcaggtatgtgtacatcc

SEQ ID NO: 392830 - DNA, 25 bp, Mus musculus
ttcttaatcaggtcttctcgtccca

SEQ ID NO: 392831 - DNA, 25 bp, Mus musculus
ttcttaatcttccttcctactagac

SEQ ID NO: 392832 - DNA, 25 bp, Mus musculus
ttcttaattctggcagttaaaccag

SEQ ID NO: 392833 - DNA, 25 bp, Mus musculus
ttcttacagaagtaccctcctccac

SEQ ID NO: 392834 - DNA, 25 bp, Mus musculus
ttcttacagaagttactggacagtg

SEQ ID NO: 392835 - DNA, 25 bp, Mus musculus
ttcttaccaagaagtttgttcgcac

SEQ ID NO: 392836 - DNA, 25 bp, Mus musculus
ttcttaccagaacttgatcaccaga

SEQ ID NO: 392837 - DNA, 25 bp, Mus musculus
ttcttaccagagttctggccagggt

SEQ ID NO: 392838 - DNA, 25 bp, Mus musculus
ttcttaccagatgacaaatcatcac

SEQ ID NO: 392839 - DNA, 25 bp, Mus musculus
ttcttacctctggaaggcatcagtt

SEQ ID NO: 392840 - DNA, 25 bp, Mus musculus
ttcttacctctgtcccaattcacag

SEQ ID NO: 392841 - DNA, 25 bp, Mus musculus
ttcttacctgcaaagtaacagcctc

SEQ ID NO: 392842 - DNA, 25 bp, Mus musculus
ttcttactacaggaatgagtgccac

SEQ ID NO: 392843 - DNA, 25 bp, Mus musculus
ttcttactgacagcttttttattaa

SEQ ID NO: 392844 - DNA, 25 bp, Mus musculus
ttcttactgacagtgtacactcttt

SEQ ID NO: 392845 - DNA, 25 bp, Mus musculus
ttcttactggaagattatcctgtcc

SEQ ID NO: 392846 - DNA, 25 bp, Mus musculus
ttcttagaaaacgcctccttggcat

SEQ ID NO: 392847 - DNA, 25 bp, Mus musculus
ttcttagaagggctggaaaaaggaa

SEQ ID NO: 392848 - DNA, 25 bp, Mus musculus
ttcttagacctcaagaattaaaaca

SEQ ID NO: 392849 - DNA, 25 bp, Mus musculus
ttcttagacctcaagggagaaggtg

SEQ ID NO: 392850 - DNA, 25 bp, Mus musculus
ttcttagagagcttcctgccagcac

SEQ ID NO: 392851 - DNA, 25 bp, Mus musculus
ttcttagagataaggttcatcattt

SEQ ID NO: 392852 - DNA, 25 bp, Mus musculus
ttcttagcaagggtctgtcaccgct

SEQ ID NO: 392853 - DNA, 25 bp, Mus musculus
ttcttagccgatctctgagaagaga

SEQ ID NO: 392854 - DNA, 25 bp, Mus musculus
ttcttagccggtaccagacgttaag

SEQ ID NO: 392855 - DNA, 25 bp, Mus musculus
ttcttagccggtccttcagtagcct

SEQ ID NO: 392856 - DNA, 25 bp, Mus musculus
ttcttagcggcggactggtgcagtc

SEQ ID NO: 392857 - DNA, 25 bp, Mus musculus
ttcttagcggcgggagtctatcctg

SEQ ID NO: 392858 - DNA, 25 bp, Mus musculus
ttcttagcggcgggtactataccaa

SEQ ID NO: 392859 - DNA, 25 bp, Mus musculus
ttcttagctgagatagaagctttgg

SEQ ID NO: 392860 - DNA, 25 bp, Mus musculus
ttcttaggtaaggtggtcagcgcgc

SEQ ID NO: 392861 - DNA, 25 bp, Mus musculus
ttcttagtcaagggtctcatgtact

SEQ ID NO: 392862 - DNA, 25 bp, Mus musculus
ttcttagtcaaggttggcttcctga

SEQ ID NO: 392863 - DNA, 25 bp, Mus musculus
ttcttataaatgtttatgtctggga

SEQ ID NO: 392864 - DNA, 25 bp, Mus musculus
ttcttatatgggagagtcagtcgtt

SEQ ID NO: 392865 - DNA, 25 bp, Mus musculus
ttcttatcagggtcaaagaaggcaa

SEQ ID NO: 392866 - DNA, 25 bp, Mus musculus
ttcttatccaggtaccattactatg

SEQ ID NO: 392867 - DNA, 25 bp, Mus musculus
ttcttatctccatctcttcccactg

SEQ ID NO: 392868 - DNA, 25 bp, Mus musculus
ttcttatctgagttgaactctttag

SEQ ID NO: 392869 - DNA, 25 bp, Mus musculus
ttcttatctgtgttgaactctttag

SEQ ID NO: 392870 - DNA, 25 bp, Mus musculus
ttcttatgactctgctgggattcct

SEQ ID NO: 392871 - DNA, 25 bp, Mus musculus
ttcttatgactgcaccattcctgcc

SEQ ID NO: 392872 - DNA, 25 bp, Mus musculus
ttcttattcgcagtggctgtgacgt

SEQ ID NO: 392873 - DNA, 25 bp, Mus musculus
ttcttattgaaacatccatttcagt

SEQ ID NO: 392874 - DNA, 25 bp, Mus musculus
ttcttattgaatatccagaagatgt

SEQ ID NO: 392875 - DNA, 25 bp, Mus musculus
ttcttattggacaagtgcaactgta

SEQ ID NO: 392876 - DNA, 25 bp, Mus musculus
ttcttattgtcgctctattctctcc

SEQ ID NO: 392877 - DNA, 25 bp, Mus musculus
ttcttattgtcggttggtgatgaga

SEQ ID NO: 392878 - DNA, 25 bp, Mus musculus
ttcttcaaacgtggggttctatggc

SEQ ID NO: 392879 - DNA, 25 bp, Mus musculus
ttcttcaaagaatgattctgttggc

SEQ ID NO: 392880 - DNA, 25 bp, Mus musculus
ttcttcaaaggatcccagagagctt

SEQ ID NO: 392881 - DNA, 25 bp, Mus musculus
ttcttcaacgagcgggctgagcggc

SEQ ID NO: 392882 - DNA, 25 bp, Mus musculus
ttcttcaagaacattgcgacgctcc

SEQ ID NO: 392883 - DNA, 25 bp, Mus musculus
ttcttcaagaatgacattgtcaact

SEQ ID NO: 392884 - DNA, 25 bp, Mus musculus
ttcttcaagatgagagcgatgacag

SEQ ID NO: 392885 - DNA, 25 bp, Mus musculus
ttcttcaagatgaggcgagtggcag

SEQ ID NO: 392886 - DNA, 25 bp, Mus musculus
ttcttcaatatcttgggagccgaag

SEQ ID NO: 392887 - DNA, 25 bp, Mus musculus
ttcttcaatatcttggtacagggag

SEQ ID NO: 392888 - DNA, 25 bp, Mus musculus
ttcttcacactgctttggtgcggca

SEQ ID NO: 392889 - DNA, 25 bp, Mus musculus
ttcttcacaggaagtcctcgggtag

SEQ ID NO: 392890 - DNA, 25 bp, Mus musculus
ttcttcacaggtggcttctgcttat

SEQ ID NO: 392891 - DNA, 25 bp, Mus musculus
ttcttcaccagcccagagaactcag

SEQ ID NO: 392892 - DNA, 25 bp, Mus musculus
ttcttcaccattggggctgtgcatt

SEQ ID NO: 392893 - DNA, 25 bp, Mus musculus
ttcttcaccattgggttcacaggct

SEQ ID NO: 392894 - DNA, 25 bp, Mus musculus
ttcttcaccgcacagacaccaagtg

SEQ ID NO: 392895 - DNA, 25 bp, Mus musculus
ttcttcacctgggtgctacagaaga

SEQ ID NO: 392896 - DNA, 25 bp, Mus musculus
ttcttcacctttggtgtcctgtgca

SEQ ID NO: 392897 - DNA, 25 bp, Mus musculus
ttcttcacgctggatgttgaatgcg

SEQ ID NO: 392898 - DNA, 25 bp, Mus musculus
ttcttcacgctggggtttctctgta

SEQ ID NO: 392899 - DNA, 25 bp, Mus musculus
ttcttcacggcatggatgatgatgg

SEQ ID NO: 392900 - DNA, 25 bp, Mus musculus
ttcttcactgacacatgccctgagc

SEQ ID NO: 392901 - DNA, 25 bp, Mus musculus
ttcttcactgactagtctccagagg

SEQ ID NO: 392902 - DNA, 25 bp, Mus musculus
ttcttcactgactattttaacagcg

SEQ ID NO: 392903 - DNA, 25 bp, Mus musculus
ttcttcactgcaggtcccaaattgg

SEQ ID NO: 392904 - DNA, 25 bp, Mus musculus
ttcttcactgcaggttcacctggag

SEQ ID NO: 392905 - DNA, 25 bp, Mus musculus
ttcttcactgtaaaggtgcgagaag

SEQ ID NO: 392906 - DNA, 25 bp, Mus musculus
ttcttcactttcacgaggagaacat

SEQ ID NO: 392907 - DNA, 25 bp, Mus musculus
ttcttcagaaggtcgtgaaaataca

SEQ ID NO: 392908 - DNA, 25 bp, Mus musculus
ttcttcagacggtttctctagagga

SEQ ID NO: 392909 - DNA, 25 bp, Mus musculus
ttcttcagagagatgacataacact

SEQ ID NO: 392910 - DNA, 25 bp, Mus musculus
ttcttcagagggtttcatatgtccc

SEQ ID NO: 392911 - DNA, 25 bp, Mus musculus
ttcttcagagggtttcatctgccca

SEQ ID NO: 392912 - DNA, 25 bp, Mus musculus
ttcttcagcaagacagaggagctga

SEQ ID NO: 392913 - DNA, 25 bp, Mus musculus
ttcttcagcagatgatgcccgccag

SEQ ID NO: 392914 - DNA, 25 bp, Mus musculus
ttcttcagctggcaacacccaaggc

SEQ ID NO: 392915 - DNA, 25 bp, Mus musculus
ttcttcagctggcaagaccggggtt

SEQ ID NO: 392916 - DNA, 25 bp, Mus musculus
ttcttcaggaaagagcaaataagtt

SEQ ID NO: 392917 - DNA, 25 bp, Mus musculus
ttcttcataaaactctgaaggcatg

SEQ ID NO: 392918 - DNA, 25 bp, Mus musculus
ttcttcatatttggccacagccttc

SEQ ID NO: 392919 - DNA, 25 bp, Mus musculus
ttcttcatgcccacctggtaacatc

SEQ ID NO: 392920 - DNA, 25 bp, Mus musculus
ttcttcattgagactggacaatctg

SEQ ID NO: 392921 - DNA, 25 bp, Mus musculus
ttcttcattgccagcaaccgtgtct

SEQ ID NO: 392922 - DNA, 25 bp, Mus musculus
ttcttcattgtaatcgattggtatc

SEQ ID NO: 392923 - DNA, 25 bp, Mus musculus
ttcttcattgtcaggttcctggaaa

SEQ ID NO: 392924 - DNA, 25 bp, Mus musculus
ttcttcatttcaggccatcagctcc

SEQ ID NO: 392925 - DNA, 25 bp, Mus musculus
ttcttccaaggcagaagagtgggct

SEQ ID NO: 392926 - DNA, 25 bp, Mus musculus
ttcttccacagtgcctccggagcca

SEQ ID NO: 392927 - DNA, 25 bp, Mus musculus
ttcttccaccaaggaggaatttcaa

SEQ ID NO: 392928 - DNA, 25 bp, Mus musculus
ttcttccagccctgagatgctcacg

SEQ ID NO: 392929 - DNA, 25 bp, Mus musculus
ttcttccagtgcaggcctaaccctg

SEQ ID NO: 392930 - DNA, 25 bp, Mus musculus
ttcttccagtgcagggaaaagctgt

SEQ ID NO: 392931 - DNA, 25 bp, Mus musculus
ttcttccataaagggcaagaaaaag

SEQ ID NO: 392932 - DNA, 25 bp, Mus musculus
ttcttccataaaggggcagtaaatg

SEQ ID NO: 392933 - DNA, 25 bp, Mus musculus
ttcttcccacaatattctggataac

SEQ ID NO: 392934 - DNA, 25 bp, Mus musculus
ttcttcccacactcaccgagctctt

SEQ ID NO: 392935 - DNA, 25 bp, Mus musculus
ttcttcccagccggttccagcctcc

SEQ ID NO: 392936 - DNA, 25 bp, Mus musculus
ttcttcccaggagaaatatgaacca

SEQ ID NO: 392937 - DNA, 25 bp, Mus musculus
ttcttcccaggtgaagtggaagatt

SEQ ID NO: 392938 - DNA, 25 bp, Mus musculus
ttcttcccatcagcccaggccacag

SEQ ID NO: 392939 - DNA, 25 bp, Mus musculus
ttcttccctaagacctaggacctag

SEQ ID NO: 392940 - DNA, 25 bp, Mus musculus
ttcttccctaaggtgaaaggactga

SEQ ID NO: 392941 - DNA, 25 bp, Mus musculus
ttcttccctatctacttggaccaga

SEQ ID NO: 392942 - DNA, 25 bp, Mus musculus
ttcttcccttagaccgtcacgacgg

SEQ ID NO: 392943 - DNA, 25 bp, Mus musculus
ttcttccgagtcagctacttcctgt

SEQ ID NO: 392944 - DNA, 25 bp, Mus musculus
ttcttcctcaaccccctagaatcca

SEQ ID NO: 392945 - DNA, 25 bp, Mus musculus
ttcttcctcatcggacccccagcct

SEQ ID NO: 392946 - DNA, 25 bp, Mus musculus
ttcttcctcctttggtggccgtgcc

SEQ ID NO: 392947 - DNA, 25 bp, Mus musculus
ttcttcctgcccagtgggcagctga

SEQ ID NO: 392948 - DNA, 25 bp, Mus musculus
ttcttcctggctctatccaggctta

SEQ ID NO: 392949 - DNA, 25 bp, Mus musculus
ttcttcctggctctctacctggcca

SEQ ID NO: 392950 - DNA, 25 bp, Mus musculus
ttcttccttagcaaccttccatggc

SEQ ID NO: 392951 - DNA, 25 bp, Mus musculus
ttcttccttcaggtccttcatttct

SEQ ID NO: 392952 - DNA, 25 bp, Mus musculus
ttcttcgaagccaaggcccaggcct

SEQ ID NO: 392953 - DNA, 25 bp, Mus musculus
ttcttcgccccctggtgtggacatt

SEQ ID NO: 392954 - DNA, 25 bp, Mus musculus
ttcttcgcggaagatatatgttggg

SEQ ID NO: 392955 - DNA, 25 bp, Mus musculus
ttcttcgtgacgataagtgggcaga

SEQ ID NO: 392956 - DNA, 25 bp, Mus musculus
ttcttcgtgacgttattagaagccc

SEQ ID NO: 392957 - DNA, 25 bp, Mus musculus
ttcttcgtgtttcaggtattctgcg

SEQ ID NO: 392958 - DNA, 25 bp, Mus musculus
ttcttcgttgggggcactcagaaag

SEQ ID NO: 392959 - DNA, 25 bp, Mus musculus
ttcttctaagggaatacagtgagta

SEQ ID NO: 392960 - DNA, 25 bp, Mus musculus
ttcttctatccagggatgaactcca

SEQ ID NO: 392961 - DNA, 25 bp, Mus musculus
ttcttctatccagggcccattgtgg

SEQ ID NO: 392962 - DNA, 25 bp, Mus musculus
ttcttctatttctgggttctgccag

SEQ ID NO: 392963 - DNA, 25 bp, Mus musculus
ttcttctcaagcagatttcggaggc

SEQ ID NO: 392964 - DNA, 25 bp, Mus musculus
ttcttctcaagcagggtactggtct

SEQ ID NO: 392965 - DNA, 25 bp, Mus musculus
ttcttctcaagcaggtggcccacgc

SEQ ID NO: 392966 - DNA, 25 bp, Mus musculus
ttcttctcaatgtaaatttaacaca

SEQ ID NO: 392967 - DNA, 25 bp, Mus musculus
ttcttctcagaaaagaggccagctc

SEQ ID NO: 392968 - DNA, 25 bp, Mus musculus
ttcttctcagataaggatgaatgtt

SEQ ID NO: 392969 - DNA, 25 bp, Mus musculus
ttcttctcaggggaggagtacgggg

SEQ ID NO: 392970 - DNA, 25 bp, Mus musculus
ttcttctcagggttggaaatcgtgc

SEQ ID NO: 392971 - DNA, 25 bp, Mus musculus
ttcttctcaggtatattgaaatatt

SEQ ID NO: 392972 - DNA, 25 bp, Mus musculus
ttcttctccacggtactacttgtcc

SEQ ID NO: 392973 - DNA, 25 bp, Mus musculus
ttcttctccacgttctaccacgcct

SEQ ID NO: 392974 - DNA, 25 bp, Mus musculus
ttcttctgagaacaggaatggcctt

SEQ ID NO: 392975 - DNA, 25 bp, Mus musculus
ttcttctgatagaggtgccctggga

SEQ ID NO: 392976 - DNA, 25 bp, Mus musculus
ttcttctgatgagctgggaagtcat

SEQ ID NO: 392977 - DNA, 25 bp, Mus musculus
ttcttctgcaagcactgcagagagc

SEQ ID NO: 392978 - DNA, 25 bp, Mus musculus
ttcttctggcaccagcccatcaaaa

SEQ ID NO: 392979 - DNA, 25 bp, Mus musculus
ttcttctgtctcccctgaggccttt

SEQ ID NO: 392980 - DNA, 25 bp, Mus musculus
ttcttcttatagcaggttcttgtct

SEQ ID NO: 392981 - DNA, 25 bp, Mus musculus
ttcttcttatcagggtcaaagaagg

SEQ ID NO: 392982 - DNA, 25 bp, Mus musculus
ttcttcttcagaaacaaacatatca

SEQ ID NO: 392983 - DNA, 25 bp, Mus musculus
ttcttcttcaggcaacagactttat

SEQ ID NO: 392984 - DNA, 25 bp, Mus musculus
ttcttcttcaggttgccagtcacag

SEQ ID NO: 392985 - DNA, 25 bp, Mus musculus
ttcttcttgaaatctacccagaatg

SEQ ID NO: 392986 - DNA, 25 bp, Mus musculus
ttcttctttcctgactgatggcgct

SEQ ID NO: 392987 - DNA, 25 bp, Mus musculus
ttcttctttttagggacaggggcag

SEQ ID NO: 392988 - DNA, 25 bp, Mus musculus
ttcttctttttaggtcccgcctggc

SEQ ID NO: 392989 - DNA, 25 bp, Mus musculus
ttcttctttttaggtgaggagttct

SEQ ID NO: 392990 - DNA, 25 bp, Mus musculus
ttcttgaaatctacccagaatggaa

SEQ ID NO: 392991 - DNA, 25 bp, Mus musculus
ttcttgaaccaccaggcctcagctg

SEQ ID NO: 392992 - DNA, 25 bp, Mus musculus
ttcttgaacttgaggacccaagttt

SEQ ID NO: 392993 - DNA, 25 bp, Mus musculus
ttcttgaataggtattgataaatgg

SEQ ID NO: 392994 - DNA, 25 bp, Mus musculus
ttcttgaatgcaccttatagccatc

SEQ ID NO: 392995 - DNA, 25 bp, Mus musculus
ttcttgacaggcatcctcgtgtaca

SEQ ID NO: 392996 - DNA, 25 bp, Mus musculus
ttcttgacagggtcctgcaggcagg

SEQ ID NO: 392997 - DNA, 25 bp, Mus musculus
ttcttgaccggatccgctccctgcc

SEQ ID NO: 392998 - DNA, 25 bp, Mus musculus
ttcttgaccgggcttctcagagtgg

SEQ ID NO: 392999 - DNA, 25 bp, Mus musculus
ttcttgacggacttaaaaggacaac

SEQ ID NO: 393000 - DNA, 25 bp, Mus musculus
ttcttgactgggctgctggacctgg

SEQ ID NO: 393001 - DNA, 25 bp, Mus musculus
ttcttgacttacaaatcaggagtat

SEQ ID NO: 393002 - DNA, 25 bp, Mus musculus
ttcttgagaggccacagacctcccc

SEQ ID NO: 393003 - DNA, 25 bp, Mus musculus
ttcttgagtgagccctgaatctgtg

SEQ ID NO: 393004 - DNA, 25 bp, Mus musculus
ttcttgagtgagggtatcctgtctt

SEQ ID NO: 393005 - DNA, 25 bp, Mus musculus
ttcttgagtttgacagtgtcattca

SEQ ID NO: 393006 - DNA, 25 bp, Mus musculus
ttcttgatgagacctctttgacaat

SEQ ID NO: 393007 - DNA, 25 bp, Mus musculus
ttcttgcaaaaagacacacctgcaa

SEQ ID NO: 393008 - DNA, 25 bp, Mus musculus
ttcttgcaaaaagaggtctccaagg

SEQ ID NO: 393009 - DNA, 25 bp, Mus musculus
ttcttgcaaagatcactggagattg

SEQ ID NO: 393010 - DNA, 25 bp, Mus musculus
ttcttgcaagaattgagagacatct

SEQ ID NO: 393011 - DNA, 25 bp, Mus musculus
ttcttgcagcaggtctgctttgcct

SEQ ID NO: 393012 - DNA, 25 bp, Mus musculus
ttcttgcatggggatgatgactctt

SEQ ID NO: 393013 - DNA, 25 bp, Mus musculus
ttcttgccggccccgcccccgcctg

SEQ ID NO: 393014 - DNA, 25 bp, Mus musculus
ttcttgccgggatctgacccagacc

SEQ ID NO: 393015 - DNA, 25 bp, Mus musculus
ttcttgcctgcaggaagcaccatgg

SEQ ID NO: 393016 - DNA, 25 bp, Mus musculus
ttcttgcctgcagttccgtttcccc

SEQ ID NO: 393017 - DNA, 25 bp, Mus musculus
ttcttgctaacaacaacacctcgtc

SEQ ID NO: 393018 - DNA, 25 bp, Mus musculus
ttcttgctaactgtccagttaaata

SEQ ID NO: 393019 - DNA, 25 bp, Mus musculus
ttcttgctgactacatttcctcggc

SEQ ID NO: 393020 - DNA, 25 bp, Mus musculus
ttcttgctggacgaggtgccagtca

SEQ ID NO: 393021 - DNA, 25 bp, Mus musculus
ttcttggaaccctaagctgggctct

SEQ ID NO: 393022 - DNA, 25 bp, Mus musculus
ttcttggaatttatggtacaggaaa

SEQ ID NO: 393023 - DNA, 25 bp, Mus musculus
ttcttggagaggtaaccccaggtga

SEQ ID NO: 393024 - DNA, 25 bp, Mus musculus
ttcttggaggagggcaatgcgagca

SEQ ID NO: 393025 - DNA, 25 bp, Mus musculus
ttcttggagtcaggggaaatgagca

SEQ ID NO: 393026 - DNA, 25 bp, Mus musculus
ttcttggagtcaggggtcactagga

SEQ ID NO: 393027 - DNA, 25 bp, Mus musculus
ttcttggataatagaatgacagcag

SEQ ID NO: 393028 - DNA, 25 bp, Mus musculus
ttcttggatcggatgaagaagataa

SEQ ID NO: 393029 - DNA, 25 bp, Mus musculus
ttcttggattcgctggttggtgggg

SEQ ID NO: 393030 - DNA, 25 bp, Mus musculus
ttcttggcattataaaccgtgtcag

SEQ ID NO: 393031 - DNA, 25 bp, Mus musculus
ttcttggcattatgtgccctccgtt

SEQ ID NO: 393032 - DNA, 25 bp, Mus musculus
ttcttggcgttatgggtgtgatagg

SEQ ID NO: 393033 - DNA, 25 bp, Mus musculus
ttcttggcgttatgtttgagatggt

SEQ ID NO: 393034 - DNA, 25 bp, Mus musculus
ttcttgggagaggaagaagaaagga

SEQ ID NO: 393035 - DNA, 25 bp, Mus musculus
ttcttgggaggaagtccacattgct

SEQ ID NO: 393036 - DNA, 25 bp, Mus musculus
ttcttggtactgcatagtgggacac

SEQ ID NO: 393037 - DNA, 25 bp, Mus musculus
ttcttggtactggtgaacaccatgt

SEQ ID NO: 393038 - DNA, 25 bp, Mus musculus
ttcttggtcagaagaagcgcacgtt

SEQ ID NO: 393039 - DNA, 25 bp, Mus musculus
ttcttgtaattcaggtgagcacctc

SEQ ID NO: 393040 - DNA, 25 bp, Mus musculus
ttcttgtatacttagacaaaagtcc

SEQ ID NO: 393041 - DNA, 25 bp, Mus musculus
ttcttgtcaataaggtaatgttagc

SEQ ID NO: 393042 - DNA, 25 bp, Mus musculus
ttcttgtcataaaaatatgacagat

SEQ ID NO: 393043 - DNA, 25 bp, Mus musculus
ttcttgtctgaagcgaaggtgtccg

SEQ ID NO: 393044 - DNA, 25 bp, Mus musculus
ttcttgtgcaaactgggatggatct

SEQ ID NO: 393045 - DNA, 25 bp, Mus musculus
ttcttgtggccctattgtgtgccca

SEQ ID NO: 393046 - DNA, 25 bp, Mus musculus
ttcttgttgatgcaaatgtgctagt

SEQ ID NO: 393047 - DNA, 25 bp, Mus musculus
ttcttgttgttcaggtttatcatgg

SEQ ID NO: 393048 - DNA, 25 bp, Mus musculus
ttcttgtttcaggaaatggctgcag

SEQ ID NO: 393049 - DNA, 25 bp, Mus musculus
ttcttgtttcaggacttcctccatc

SEQ ID NO: 393050 - DNA, 25 bp, Mus musculus
ttcttgtttctgactctaaaacaac

SEQ ID NO: 393051 - DNA, 25 bp, Mus musculus
ttcttgtttctggatccttgacact

SEQ ID NO: 393052 - DNA, 25 bp, Mus musculus
ttcttgtttgatactttatgcatgg

SEQ ID NO: 393053 - DNA, 25 bp, Mus musculus
ttctttaaaaaagccgagctggaat

SEQ ID NO: 393054 - DNA, 25 bp, Mus musculus
ttctttaaaaggtgaggcatgaaat

SEQ ID NO: 393055 - DNA, 25 bp, Mus musculus
ttctttaaaggggactttgccacaa

SEQ ID NO: 393056 - DNA, 25 bp, Mus musculus
ttctttaaaggggagtttgtgtgga

SEQ ID NO: 393057 - DNA, 25 bp, Mus musculus
ttctttaaatgacaacaattgacat

SEQ ID NO: 393058 - DNA, 25 bp, Mus musculus
ttctttaacaaggtaaataagctga

SEQ ID NO: 393059 - DNA, 25 bp, Mus musculus
ttctttaagaaaagcagccactgga

SEQ ID NO: 393060 - DNA, 25 bp, Mus musculus
ttctttaagaagacagagcacactc

SEQ ID NO: 393061 - DNA, 25 bp, Mus musculus
ttctttaagagaagaatgtggccat

SEQ ID NO: 393062 - DNA, 25 bp, Mus musculus
ttctttacaaggattttcaccttgt

SEQ ID NO: 393063 - DNA, 25 bp, Mus musculus
ttctttaccaggtatgactacgagg

SEQ ID NO: 393064 - DNA, 25 bp, Mus musculus
ttctttacccacgtttttgcagctt

SEQ ID NO: 393065 - DNA, 25 bp, Mus musculus
ttctttacctgacaaagccaaggtg

SEQ ID NO: 393066 - DNA, 25 bp, Mus musculus
ttctttactatgcggagcaactgaa

SEQ ID NO: 393067 - DNA, 25 bp, Mus musculus
ttctttactgaatataagtaccata

SEQ ID NO: 393068 - DNA, 25 bp, Mus musculus
ttctttagagttttggtcccagcaa

SEQ ID NO: 393069 - DNA, 25 bp, Mus musculus
ttctttagattgtcccagttgtgac

SEQ ID NO: 393070 - DNA, 25 bp, Mus musculus
ttctttagcaagagcagtatataaa

SEQ ID NO: 393071 - DNA, 25 bp, Mus musculus
ttctttatgggaagaattgcggcga

SEQ ID NO: 393072 - DNA, 25 bp, Mus musculus
ttctttatttgagtgcagcagctgc

SEQ ID NO: 393073 - DNA, 25 bp, Mus musculus
ttctttcagagtgcttctacttctc

SEQ ID NO: 393074 - DNA, 25 bp, Mus musculus
ttctttcagcttggtgctgttaaag

SEQ ID NO: 393075 - DNA, 25 bp, Mus musculus
ttctttcaggtattcatgtgatgga

SEQ ID NO: 393076 - DNA, 25 bp, Mus musculus
ttctttcatagatgaagcccgaggc

SEQ ID NO: 393077 - DNA, 25 bp, Mus musculus
ttctttccaaatggacctgaggtgc

SEQ ID NO: 393078 - DNA, 25 bp, Mus musculus
ttctttccaacaaagcctacacagg

SEQ ID NO: 393079 - DNA, 25 bp, Mus musculus
ttctttccaacaacctgcatcataa

SEQ ID NO: 393080 - DNA, 25 bp, Mus musculus
ttctttccaagtccttctttgacca

SEQ ID NO: 393081 - DNA, 25 bp, Mus musculus
ttctttcccgagggagcacgggtct

SEQ ID NO: 393082 - DNA, 25 bp, Mus musculus
ttctttcccgaggtgttcacctaca

SEQ ID NO: 393083 - DNA, 25 bp, Mus musculus
ttctttccggctgtgacttcttttg

SEQ ID NO: 393084 - DNA, 25 bp, Mus musculus
ttctttcctgactgatggcgcttct

SEQ ID NO: 393085 - DNA, 25 bp, Mus musculus
ttctttcctggagtaggtgacatgt

SEQ ID NO: 393086 - DNA, 25 bp, Mus musculus
ttctttcgcttgcaggcctacaggg

SEQ ID NO: 393087 - DNA, 25 bp, Mus musculus
ttctttcggctaagaaccaaaaatc

SEQ ID NO: 393088 - DNA, 25 bp, Mus musculus
ttctttctctcagccaaagccttct

SEQ ID NO: 393089 - DNA, 25 bp, Mus musculus
ttctttctgaggtgtcagatgcccg

SEQ ID NO: 393090 - DNA, 25 bp, Mus musculus
ttctttctgccctgtttcaccttta

SEQ ID NO: 393091 - DNA, 25 bp, Mus musculus
ttctttctgcccttgcagaactggg

SEQ ID NO: 393092 - DNA, 25 bp, Mus musculus
ttctttctgcctgcacatttcataa

SEQ ID NO: 393093 - DNA, 25 bp, Mus musculus
ttctttctgtgttgatgagaggctg

SEQ ID NO: 393094 - DNA, 25 bp, Mus musculus
ttctttctgtgttgcggttccctca

SEQ ID NO: 393095 - DNA, 25 bp, Mus musculus
ttctttctttgaaggtgacgggccg

SEQ ID NO: 393096 - DNA, 25 bp, Mus musculus
ttctttctttgcagcacacagcaca

SEQ ID NO: 393097 - DNA, 25 bp, Mus musculus
ttctttcttttgggagcctcaatgg

SEQ ID NO: 393098 - DNA, 25 bp, Mus musculus
ttctttcttttgggagtgagtgtgt

SEQ ID NO: 393099 - DNA, 25 bp, Mus musculus
ttctttgaacctttggtcagaaagc

SEQ ID NO: 393100 - DNA, 25 bp, Mus musculus
ttctttgaagatgttccctcagcca

SEQ ID NO: 393101 - DNA, 25 bp, Mus musculus
ttctttgacatcagtgatgagagta

SEQ ID NO: 393102 - DNA, 25 bp, Mus musculus
ttctttgacatctgtgatgagagta

SEQ ID NO: 393103 - DNA, 25 bp, Mus musculus
ttctttgatccagatgccaaggggc

SEQ ID NO: 393104 - DNA, 25 bp, Mus musculus
ttctttgatgagaagtcccgtgttg

SEQ ID NO: 393105 - DNA, 25 bp, Mus musculus
ttctttgatgagtgcttcctttgca

SEQ ID NO: 393106 - DNA, 25 bp, Mus musculus
ttctttgcacaagacccacaccatc

SEQ ID NO: 393107 - DNA, 25 bp, Mus musculus
ttctttgcacaagggtttctctgta

SEQ ID NO: 393108 - DNA, 25 bp, Mus musculus
ttctttgcagcacacagcacacctg

SEQ ID NO: 393109 - DNA, 25 bp, Mus musculus
ttctttgccagcaagagaatccggg

SEQ ID NO: 393110 - DNA, 25 bp, Mus musculus
ttctttggagcagtggccgtgcctg

SEQ ID NO: 393111 - DNA, 25 bp, Mus musculus
ttctttggagtcaagttctccaagg

SEQ ID NO: 393112 - DNA, 25 bp, Mus musculus
ttctttgggaatgccctctacgccc

SEQ ID NO: 393113 - DNA, 25 bp, Mus musculus
ttctttgggcagctgctcgccctgc

SEQ ID NO: 393114 - DNA, 25 bp, Mus musculus
ttctttggggatgcccctgcctccc

SEQ ID NO: 393115 - DNA, 25 bp, Mus musculus
ttctttgtacacaatgccaaagaag

SEQ ID NO: 393116 - DNA, 25 bp, Mus musculus
ttctttgtacacagcccacttttag

SEQ ID NO: 393117 - DNA, 25 bp, Mus musculus
ttctttgtagccggggacgatccgg

SEQ ID NO: 393118 - DNA, 25 bp, Mus musculus
ttctttgtcagtttgtccctgctgg

SEQ ID NO: 393119 - DNA, 25 bp, Mus musculus
ttctttgttcaggagtttaatctga

SEQ ID NO: 393120 - DNA, 25 bp, Mus musculus
ttcttttacaataagagaccagcac

SEQ ID NO: 393121 - DNA, 25 bp, Mus musculus
ttcttttataaaagatctgcagtgg

SEQ ID NO: 393122 - DNA, 25 bp, Mus musculus
ttcttttcacaatgctcatgatctc

SEQ ID NO: 393123 - DNA, 25 bp, Mus musculus
ttcttttcctgggtgaaagacaagg

SEQ ID NO: 393124 - DNA, 25 bp, Mus musculus
ttcttttgccaggctgagctggatc

SEQ ID NO: 393125 - DNA, 25 bp, Mus musculus
ttcttttgggatccgagcaccagcc

SEQ ID NO: 393126 - DNA, 25 bp, Mus musculus
ttcttttggtctgtgagcatccctc

SEQ ID NO: 393127 - DNA, 25 bp, Mus musculus
ttcttttggtttttggtgaatgaat

SEQ ID NO: 393128 - DNA, 25 bp, Mus musculus
ttcttttgtcaaggactgtgaattg

SEQ ID NO: 393129 - DNA, 25 bp, Mus musculus
ttcttttgtcaaggatggtgaggaa

SEQ ID NO: 393130 - DNA, 25 bp, Mus musculus
ttctttttaatttctctttcctctc

SEQ ID NO: 393131 - DNA, 25 bp, Mus musculus
ttctttttagggacaggggcagacc

SEQ ID NO: 393132 - DNA, 25 bp, Mus musculus
ttctttttaggtcccgcctggcaga

SEQ ID NO: 393133 - DNA, 25 bp, Mus musculus
ttctttttaggtgaggagttctacg

SEQ ID NO: 393134 - DNA, 25 bp, Mus musculus
ttctttttttcctactcactgtgtg

SEQ ID NO: 393135 - DNA, 25 bp, Mus musculus
ttgaaaaacaagtggagagattttg

SEQ ID NO: 393136 - DNA, 25 bp, Mus musculus
ttgaaaaacttaagtaaatttgatc

SEQ ID NO: 393137 - DNA, 25 bp, Mus musculus
ttgaaaaagcgctctccagtgtcaa

SEQ ID NO: 393138 - DNA, 25 bp, Mus musculus
ttgaaaaagctgtcaagagcagagt

SEQ ID NO: 393139 - DNA, 25 bp, Mus musculus
ttgaaaaatgtgaaggggctctttc

SEQ ID NO: 393140 - DNA, 25 bp, Mus musculus
ttgaaaaatgtgaaggttggtacag

SEQ ID NO: 393141 - DNA, 25 bp, Mus musculus
ttgaaaacaaaacagaccagaacca

SEQ ID NO: 393142 - DNA, 25 bp, Mus musculus
ttgaaaacaaaacgaaccagctgcg

SEQ ID NO: 393143 - DNA, 25 bp, Mus musculus
ttgaaaacagctcgaggctgggagt

SEQ ID NO: 393144 - DNA, 25 bp, Mus musculus
ttgaaaacattatgaactgctgagt

SEQ ID NO: 393145 - DNA, 25 bp, Mus musculus
ttgaaaaccagatacaatggagagg

SEQ ID NO: 393146 - DNA, 25 bp, Mus musculus
ttgaaaaccaggaaaataggtgagc

SEQ ID NO: 393147 - DNA, 25 bp, Mus musculus
ttgaaaacccctcttatcctactag

SEQ ID NO: 393148 - DNA, 25 bp, Mus musculus
ttgaaaactatgctgaacttggtgt

SEQ ID NO: 393149 - DNA, 25 bp, Mus musculus
ttgaaaactatgtgcttgacagaag

SEQ ID NO: 393150 - DNA, 25 bp, Mus musculus
ttgaaaagaaatacaaagatgactc

SEQ ID NO: 393151 - DNA, 25 bp, Mus musculus
ttgaaaagaaattcaaagatgactc

SEQ ID NO: 393152 - DNA, 25 bp, Mus musculus
ttgaaaagaacgaaagtcagcgtgg

SEQ ID NO: 393153 - DNA, 25 bp, Mus musculus
ttgaaaaggaaggtacaagaggaca

SEQ ID NO: 393154 - DNA, 25 bp, Mus musculus
ttgaaaaggaaggtgtcttctcgtc

SEQ ID NO: 393155 - DNA, 25 bp, Mus musculus
ttgaaaaggcagaagatgcatattg

SEQ ID NO: 393156 - DNA, 25 bp, Mus musculus
ttgaaaaggcagaagcagaaatgct

SEQ ID NO: 393157 - DNA, 25 bp, Mus musculus
ttgaaaagtttgataacttacagtc

SEQ ID NO: 393158 - DNA, 25 bp, Mus musculus
ttgaaaataattgatgctgtgaagg

SEQ ID NO: 393159 - DNA, 25 bp, Mus musculus
ttgaaaatcgaatctctagggctgc

SEQ ID NO: 393160 - DNA, 25 bp, Mus musculus
ttgaaaatcgatcttctttcagaat

SEQ ID NO: 393161 - DNA, 25 bp, Mus musculus
ttgaaaatcggttagtccttcattg

SEQ ID NO: 393162 - DNA, 25 bp, Mus musculus
ttgaaaatcttagattttgtccaga

SEQ ID NO: 393163 - DNA, 25 bp, Mus musculus
ttgaaaatcttagcaaagagatgtc

SEQ ID NO: 393164 - DNA, 25 bp, Mus musculus
ttgaaaatgcttcgagaacagaaag

SEQ ID NO: 393165 - DNA, 25 bp, Mus musculus
ttgaaaatttaaagtaggaggagcc

SEQ ID NO: 393166 - DNA, 25 bp, Mus musculus
ttgaaaatttggaggcagcaccggc

SEQ ID NO: 393167 - DNA, 25 bp, Mus musculus
ttgaaacaagggggagaagcgagct

SEQ ID NO: 393168 - DNA, 25 bp, Mus musculus
ttgaaacaaggggttataatgagaa

SEQ ID NO: 393169 - DNA, 25 bp, Mus musculus
ttgaaacactatggatcgcagctcc

SEQ ID NO: 393170 - DNA, 25 bp, Mus musculus
ttgaaacaggctgttgtgcagacta

SEQ ID NO: 393171 - DNA, 25 bp, Mus musculus
ttgaaactaagcagaacaagccatc

SEQ ID NO: 393172 - DNA, 25 bp, Mus musculus
ttgaaactaagcaggaagcagaaca

SEQ ID NO: 393173 - DNA, 25 bp, Mus musculus
ttgaaactgaagaaactcggaaaat

SEQ ID NO: 393174 - DNA, 25 bp, Mus musculus
ttgaaactgaagaagctattgcctg

SEQ ID NO: 393175 - DNA, 25 bp, Mus musculus
ttgaaactgaagaagctcataatta

SEQ ID NO: 393176 - DNA, 25 bp, Mus musculus
ttgaaacttacaggccttacttctc

SEQ ID NO: 393177 - DNA, 25 bp, Mus musculus
ttgaaacttacaggtgcttttgggt

SEQ ID NO: 393178 - DNA, 25 bp, Mus musculus
ttgaaactttagtgccatggcagaa

SEQ ID NO: 393179 - DNA, 25 bp, Mus musculus
ttgaaagaaaagcgggtgccctcca

SEQ ID NO: 393180 - DNA, 25 bp, Mus musculus
ttgaaagaagcagttccgaggcctg

SEQ ID NO: 393181 - DNA, 25 bp, Mus musculus
ttgaaagagaggtcttacttgttcc

SEQ ID NO: 393182 - DNA, 25 bp, Mus musculus
ttgaaagagtcacatcagtttcacc

SEQ ID NO: 393183 - DNA, 25 bp, Mus musculus
ttgaaagcagccgctaacgtcctga

SEQ ID NO: 393184 - DNA, 25 bp, Mus musculus
ttgaaagccatgcattggaatttga

SEQ ID NO: 393185 - DNA, 25 bp, Mus musculus
ttgaaaggaattccagatggtcaaa

SEQ ID NO: 393186 - DNA, 25 bp, Mus musculus
ttgaaagggcccatgatctccatct

SEQ ID NO: 393187 - DNA, 25 bp, Mus musculus
ttgaaaggtcacagaggacacaaag

SEQ ID NO: 393188 - DNA, 25 bp, Mus musculus
ttgaaagtaagcgtttcaagggtac

SEQ ID NO: 393189 - DNA, 25 bp, Mus musculus
ttgaaagtccgctacgtgaaaaatg

SEQ ID NO: 393190 - DNA, 25 bp, Mus musculus
ttgaaagtgcaggaaaggaagttcc

SEQ ID NO: 393191 - DNA, 25 bp, Mus musculus
ttgaaatacaagctggcatttttca

SEQ ID NO: 393192 - DNA, 25 bp, Mus musculus
ttgaaatacaaggagcaactgtgcc

SEQ ID NO: 393193 - DNA, 25 bp, Mus musculus
ttgaaatcacagagaacacccagat

SEQ ID NO: 393194 - DNA, 25 bp, Mus musculus
ttgaaatctgatggttaccacaagc

SEQ ID NO: 393195 - DNA, 25 bp, Mus musculus
ttgaaatgtcagactcattgaaaga

SEQ ID NO: 393196 - DNA, 25 bp, Mus musculus
ttgaaatgtcaggatgccccaggtg

SEQ ID NO: 393197 - DNA, 25 bp, Mus musculus
ttgaacaaagaccggcaactatcca

SEQ ID NO: 393198 - DNA, 25 bp, Mus musculus
ttgaacaacatgggacgaaacttag

SEQ ID NO: 393199 - DNA, 25 bp, Mus musculus
ttgaacaagataaggggatggtaat

SEQ ID NO: 393200 - DNA, 25 bp, Mus musculus
ttgaacaatgattttgtggtggatg

SEQ ID NO: 393201 - DNA, 25 bp, Mus musculus
ttgaacaatgttatgatggttaatg

SEQ ID NO: 393202 - DNA, 25 bp, Mus musculus
ttgaacactgatatagaaaatcttg

SEQ ID NO: 393203 - DNA, 25 bp, Mus musculus
ttgaacagcataaggcttgctcttc

SEQ ID NO: 393204 - DNA, 25 bp, Mus musculus
ttgaacatccaaaagtttgcagtcc

SEQ ID NO: 393205 - DNA, 25 bp, Mus musculus
ttgaacatccaaagacacacaggac

SEQ ID NO: 393206 - DNA, 25 bp, Mus musculus
ttgaacatggatgtggacgccacta

SEQ ID NO: 393207 - DNA, 25 bp, Mus musculus
ttgaaccaagcacttgtttctagtt

SEQ ID NO: 393208 - DNA, 25 bp, Mus musculus
ttgaaccagaagactttgaaagcat

SEQ ID NO: 393209 - DNA, 25 bp, Mus musculus
ttgaaccagaagggctgtcaggggg

SEQ ID NO: 393210 - DNA, 25 bp, Mus musculus
ttgaaccagcagggtggcccacgcg

SEQ ID NO: 393211 - DNA, 25 bp, Mus musculus
ttgaaccggtcaacaatgcatattc

SEQ ID NO: 393212 - DNA, 25 bp, Mus musculus
ttgaacctcaacaccaagatgatac

SEQ ID NO: 393213 - DNA, 25 bp, Mus musculus
ttgaacctgaaaacattattatgtt

SEQ ID NO: 393214 - DNA, 25 bp, Mus musculus
ttgaacctgcaggtactaacaccac

SEQ ID NO: 393215 - DNA, 25 bp, Mus musculus
ttgaacctgcaggtcttttcatgtg

SEQ ID NO: 393216 - DNA, 25 bp, Mus musculus
ttgaacctttggtcagaaagcatgg

SEQ ID NO: 393217 - DNA, 25 bp, Mus musculus
ttgaacgaggaggctgtgtctgctt

SEQ ID NO: 393218 - DNA, 25 bp, Mus musculus
ttgaacgatttctgatcgtctgccg

SEQ ID NO: 393219 - DNA, 25 bp, Mus musculus
ttgaactaaaggagtcaaggagtat

SEQ ID NO: 393220 - DNA, 25 bp, Mus musculus
ttgaactaatcaaggacactgacat

SEQ ID NO: 393221 - DNA, 25 bp, Mus musculus
ttgaactcacagaaagcctcatata

SEQ ID NO: 393222 - DNA, 25 bp, Mus musculus
ttgaactcaggccatattcccaaag

SEQ ID NO: 393223 - DNA, 25 bp, Mus musculus
ttgaactcatcaagatgtttgacaa

SEQ ID NO: 393224 - DNA, 25 bp, Mus musculus
ttgaactcatcaagtgctcggcgct

SEQ ID NO: 393225 - DNA, 25 bp, Mus musculus
ttgaactcctgagatatgaatctga

SEQ ID NO: 393226 - DNA, 25 bp, Mus musculus
ttgaactctccagagtgctacaata

SEQ ID NO: 393227 - DNA, 25 bp, Mus musculus
ttgaactctggaaggaaaaaaatct

SEQ ID NO: 393228 - DNA, 25 bp, Mus musculus
ttgaactctggaaggctgtcaagaa

SEQ ID NO: 393229 - DNA, 25 bp, Mus musculus
ttgaactgataagacgccttgaagc

SEQ ID NO: 393230 - DNA, 25 bp, Mus musculus
ttgaactgataatggcaaagaagta

SEQ ID NO: 393231 - DNA, 25 bp, Mus musculus
ttgaactgatgaccaaacgggctgt

SEQ ID NO: 393232 - DNA, 25 bp, Mus musculus
ttgaactgatgaccgcccagctctc

SEQ ID NO: 393233 - DNA, 25 bp, Mus musculus
ttgaactgttcaagaatgccatgag

SEQ ID NO: 393234 - DNA, 25 bp, Mus musculus
ttgaacttattcagagatttcctct

SEQ ID NO: 393235 - DNA, 25 bp, Mus musculus
ttgaacttcaagctcttttggaaga

SEQ ID NO: 393236 - DNA, 25 bp, Mus musculus
ttgaacttgaagctggttcatgtct

SEQ ID NO: 393237 - DNA, 25 bp, Mus musculus
ttgaacttgaggacccaagtttctt

SEQ ID NO: 393238 - DNA, 25 bp, Mus musculus
ttgaacttgttggatttgaactttt

SEQ ID NO: 393239 - DNA, 25 bp, Mus musculus
ttgaagaaaaggaaatgttattccc

SEQ ID NO: 393240 - DNA, 25 bp, Mus musculus
ttgaagaaaaggaagatgaggagct

SEQ ID NO: 393241 - DNA, 25 bp, Mus musculus
ttgaagaaagagcgagatggacaga

SEQ ID NO: 393242 - DNA, 25 bp, Mus musculus
ttgaagaaagagcgatacttggtaa

SEQ ID NO: 393243 - DNA, 25 bp, Mus musculus
ttgaagaaatgttgttatccgatgc

SEQ ID NO: 393244 - DNA, 25 bp, Mus musculus
ttgaagaacagagcatttagctcct

SEQ ID NO: 393245 - DNA, 25 bp, Mus musculus
ttgaagaacagggagtgcttggtgc

SEQ ID NO: 393246 - DNA, 25 bp, Mus musculus
ttgaagaacatcgagaagccaggtc

SEQ ID NO: 393247 - DNA, 25 bp, Mus musculus
ttgaagaacctaaggcccgtgtctt

SEQ ID NO: 393248 - DNA, 25 bp, Mus musculus
ttgaagaactaaatgaatgccatga

SEQ ID NO: 393249 - DNA, 25 bp, Mus musculus
ttgaagaactaaatgcgaaatcacc

SEQ ID NO: 393250 - DNA, 25 bp, Mus musculus
ttgaagaagtaaccctcctcccctg

SEQ ID NO: 393251 - DNA, 25 bp, Mus musculus
ttgaagaatcaagaaactgatctca

SEQ ID NO: 393252 - DNA, 25 bp, Mus musculus
ttgaagaatctgaaggtccagcctg

SEQ ID NO: 393253 - DNA, 25 bp, Mus musculus
ttgaagaattcagtgaacagagtat

SEQ ID NO: 393254 - DNA, 25 bp, Mus musculus
ttgaagaatttcaagactgcgagtg

SEQ ID NO: 393255 - DNA, 25 bp, Mus musculus
ttgaagacacaggattatgtactga

SEQ ID NO: 393256 - DNA, 25 bp, Mus musculus
ttgaagacatgaggactttcagtca

SEQ ID NO: 393257 - DNA, 25 bp, Mus musculus
ttgaagaccatcttgcagtgcgccc

SEQ ID NO: 393258 - DNA, 25 bp, Mus musculus
ttgaagaccatgaagggctgccaac

SEQ ID NO: 393259 - DNA, 25 bp, Mus musculus
ttgaagactctggtaggaacaacct

SEQ ID NO: 393260 - DNA, 25 bp, Mus musculus
ttgaagactctgtgcctggaatcaa

SEQ ID NO: 393261 - DNA, 25 bp, Mus musculus
ttgaagactgtggaaacaccaggca

SEQ ID NO: 393262 - DNA, 25 bp, Mus musculus
ttgaagactgtggtcttgccgtcac

SEQ ID NO: 393263 - DNA, 25 bp, Mus musculus
ttgaagagaagagccttgttgatac

SEQ ID NO: 393264 - DNA, 25 bp, Mus musculus
ttgaagagacaaggcatagtgcagt

SEQ ID NO: 393265 - DNA, 25 bp, Mus musculus
ttgaagagcagatggcccagtgagc

SEQ ID NO: 393266 - DNA, 25 bp, Mus musculus
ttgaagagcaggttgcttccataag

SEQ ID NO: 393267 - DNA, 25 bp, Mus musculus
ttgaagaggaacatgcagaggcacg

SEQ ID NO: 393268 - DNA, 25 bp, Mus musculus
ttgaagaggaacatgggatgtgaag

SEQ ID NO: 393269 - DNA, 25 bp, Mus musculus
ttgaagatcctgggggcagtgtatg

SEQ ID NO: 393270 - DNA, 25 bp, Mus musculus
ttgaagatcttgaagccatgatcaa

SEQ ID NO: 393271 - DNA, 25 bp, Mus musculus
ttgaagatcttgaaggataccagaa

SEQ ID NO: 393272 - DNA, 25 bp, Mus musculus
ttgaagatgacacagaccattcttt

SEQ ID NO: 393273 - DNA, 25 bp, Mus musculus
ttgaagatgaggatttcttatctgc

SEQ ID NO: 393274 - DNA, 25 bp, Mus musculus
ttgaagatgattttggaagttgctt

SEQ ID NO: 393275 - DNA, 25 bp, Mus musculus
ttgaagcactgagccctccagagct

SEQ ID NO: 393276 - DNA, 25 bp, Mus musculus
ttgaagcactgagccctccccactt

SEQ ID NO: 393277 - DNA, 25 bp, Mus musculus
ttgaagcatggcaatgaaatctaca

SEQ ID NO: 393278 - DNA, 25 bp, Mus musculus
ttgaagcatggccagaagacatgtt

SEQ ID NO: 393279 - DNA, 25 bp, Mus musculus
ttgaagcatttaatgcctcctgcct

SEQ ID NO: 393280 - DNA, 25 bp, Mus musculus
ttgaagccaggtgtttggccttggt

SEQ ID NO: 393281 - DNA, 25 bp, Mus musculus
ttgaagccttcaaggcgccccccac

SEQ ID NO: 393282 - DNA, 25 bp, Mus musculus
ttgaagccttcaaggtgaagtacat

SEQ ID NO: 393283 - DNA, 25 bp, Mus musculus
ttgaagccttgataggaccttcgag

SEQ ID NO: 393284 - DNA, 25 bp, Mus musculus
ttgaagccttgataggagctgttta

SEQ ID NO: 393285 - DNA, 25 bp, Mus musculus
ttgaagctaccaaacgcaagcacca

SEQ ID NO: 393286 - DNA, 25 bp, Mus musculus
ttgaagctatggtaaaagtttcatt

SEQ ID NO: 393287 - DNA, 25 bp, Mus musculus
ttgaagctccaggaggcactgaaga

SEQ ID NO: 393288 - DNA, 25 bp, Mus musculus
ttgaagctccaggaggttatttcca

SEQ ID NO: 393289 - DNA, 25 bp, Mus musculus
ttgaaggaagaggggatatgtggta

SEQ ID NO: 393290 - DNA, 25 bp, Mus musculus
ttgaaggaagataaagccatcccga

SEQ ID NO: 393291 - DNA, 25 bp, Mus musculus
ttgaaggaagatacatgttgtcagg

SEQ ID NO: 393292 - DNA, 25 bp, Mus musculus
ttgaaggaatgggagaatgaagggg

SEQ ID NO: 393293 - DNA, 25 bp, Mus musculus
ttgaaggaatgggagacgtacgcag

SEQ ID NO: 393294 - DNA, 25 bp, Mus musculus
ttgaaggacagccaaatagaataat

SEQ ID NO: 393295 - DNA, 25 bp, Mus musculus
ttgaaggacgggcagtaccaggcgg

SEQ ID NO: 393296 - DNA, 25 bp, Mus musculus
ttgaaggacgggctctccctacgga

SEQ ID NO: 393297 - DNA, 25 bp, Mus musculus
ttgaaggacgggggatggtggacag

SEQ ID NO: 393298 - DNA, 25 bp, Mus musculus
ttgaaggagaacgggaggctgccgg

SEQ ID NO: 393299 - DNA, 25 bp, Mus musculus
ttgaaggagatggattctgatgcaa

SEQ ID NO: 393300 - DNA, 25 bp, Mus musculus
ttgaaggaggcagtgttttgtcaag

SEQ ID NO: 393301 - DNA, 25 bp, Mus musculus
ttgaaggatactccagatgccaacg

SEQ ID NO: 393302 - DNA, 25 bp, Mus musculus
ttgaaggatcaaggcagagatgctt

SEQ ID NO: 393303 - DNA, 25 bp, Mus musculus
ttgaaggcaacagaatgaagggacc

SEQ ID NO: 393304 - DNA, 25 bp, Mus musculus
ttgaaggcaacagtgaagggacctg

SEQ ID NO: 393305 - DNA, 25 bp, Mus musculus
ttgaaggcaacatcgctgtgggcaa

SEQ ID NO: 393306 - DNA, 25 bp, Mus musculus
ttgaaggcaacatcggatggcactt

SEQ ID NO: 393307 - DNA, 25 bp, Mus musculus
ttgaaggcttgggaggaactgagtg

SEQ ID NO: 393308 - DNA, 25 bp, Mus musculus
ttgaaggcttgggagggtgacactt

SEQ ID NO: 393309 - DNA, 25 bp, Mus musculus
ttgaaggggctgaagtatatccatg

SEQ ID NO: 393310 - DNA, 25 bp, Mus musculus
ttgaaggtacaggagttaaagacca

SEQ ID NO: 393311 - DNA, 25 bp, Mus musculus
ttgaagtaaaaggcaaccagataaa

SEQ ID NO: 393312 - DNA, 25 bp, Mus musculus
ttgaagtagaggcaccagactcccc

SEQ ID NO: 393313 - DNA, 25 bp, Mus musculus
ttgaagtcagaaaccccaggtttcc

SEQ ID NO: 393314 - DNA, 25 bp, Mus musculus
ttgaagtcctccggaccatgctgcc

SEQ ID NO: 393315 - DNA, 25 bp, Mus musculus
ttgaagtcctccggtctgaaactct

SEQ ID NO: 393316 - DNA, 25 bp, Mus musculus
ttgaagtctggctgtacatcattga

SEQ ID NO: 393317 - DNA, 25 bp, Mus musculus
ttgaagtgaaagctgctcctgacat

SEQ ID NO: 393318 - DNA, 25 bp, Mus musculus
ttgaagtgaaaggagatttctaata

SEQ ID NO: 393319 - DNA, 25 bp, Mus musculus
ttgaagtgaatccaggtggcacaag

SEQ ID NO: 393320 - DNA, 25 bp, Mus musculus
ttgaagtgtatccctgggaagatgc

SEQ ID NO: 393321 - DNA, 25 bp, Mus musculus
ttgaagtgttgcttgctgtgcctca

SEQ ID NO: 393322 - DNA, 25 bp, Mus musculus
ttgaagtgttgcttgttttgctggt

SEQ ID NO: 393323 - DNA, 25 bp, Mus musculus
ttgaagttaaaaagtggaatgcagt

SEQ ID NO: 393324 - DNA, 25 bp, Mus musculus
ttgaatataacatcagatattcagt

SEQ ID NO: 393325 - DNA, 25 bp, Mus musculus
ttgaatatactgttgaatcaaggga

SEQ ID NO: 393326 - DNA, 25 bp, Mus musculus
ttgaatatagacctgaaaaccatct

SEQ ID NO: 393327 - DNA, 25 bp, Mus musculus
ttgaatatccagggttctctgacct

SEQ ID NO: 393328 - DNA, 25 bp, Mus musculus
ttgaatatgagatgtgcataatgcg

SEQ ID NO: 393329 - DNA, 25 bp, Mus musculus
ttgaatatgaggtgtcagctgtgcc

SEQ ID NO: 393330 - DNA, 25 bp, Mus musculus
ttgaatatgtggtgctgctgttttt

SEQ ID NO: 393331 - DNA, 25 bp, Mus musculus
ttgaatattgtcaagatcgtaccga

SEQ ID NO: 393332 - DNA, 25 bp, Mus musculus
ttgaatcaacagagtatgtcaatag

SEQ ID NO: 393333 - DNA, 25 bp, Mus musculus
ttgaatcaggagcttacagatgtcc

SEQ ID NO: 393334 - DNA, 25 bp, Mus musculus
ttgaatccagaagacattgatcagc

SEQ ID NO: 393335 - DNA, 25 bp, Mus musculus
ttgaatctattgcagagttacccct

SEQ ID NO: 393336 - DNA, 25 bp, Mus musculus
ttgaatctattgcagcagtgtcaga

SEQ ID NO: 393337 - DNA, 25 bp, Mus musculus
ttgaatctcaggactccagaggacc

SEQ ID NO: 393338 - DNA, 25 bp, Mus musculus
ttgaatgaccctcttccattttggt

SEQ ID NO: 393339 - DNA, 25 bp, Mus musculus
ttgaatgagccaaggaccagagtga

SEQ ID NO: 393340 - DNA, 25 bp, Mus musculus
ttgaatgatgcagagtcctccccgt

SEQ ID NO: 393341 - DNA, 25 bp, Mus musculus
ttgaatgattacaacatttcagaag

SEQ ID NO: 393342 - DNA, 25 bp, Mus musculus
ttgaatgcttataagggtccgtcgt

SEQ ID NO: 393343 - DNA, 25 bp, Mus musculus
ttgaatggcaaggtgctggatggtt

SEQ ID NO: 393344 - DNA, 25 bp, Mus musculus
ttgaatgtccaggaccccctggccc

SEQ ID NO: 393345 - DNA, 25 bp, Mus musculus
ttgaattcttctatacagaaactgc

SEQ ID NO: 393346 - DNA, 25 bp, Mus musculus
ttgaattgtaatgtggagctgcccg

SEQ ID NO: 393347 - DNA, 25 bp, Mus musculus
ttgaatttcattaagacctggtccc

SEQ ID NO: 393348 - DNA, 25 bp, Mus musculus
ttgaatttcattaagatcgggaagc

SEQ ID NO: 393349 - DNA, 25 bp, Mus musculus
ttgaatttctggtaatctatgccag

SEQ ID NO: 393350 - DNA, 25 bp, Mus musculus
ttgaatttctggtttgcggtgtagg

SEQ ID NO: 393351 - DNA, 25 bp, Mus musculus
ttgaattttagaatgattgaagata

SEQ ID NO: 393352 - DNA, 25 bp, Mus musculus
ttgaattttagctggattcatcgct

SEQ ID NO: 393353 - DNA, 25 bp, Mus musculus
ttgacaaaaacagcttatagagcac

SEQ ID NO: 393354 - DNA, 25 bp, Mus musculus
ttgacaaagagcctgactctgattc

SEQ ID NO: 393355 - DNA, 25 bp, Mus musculus
ttgacaaagccagctaccgagtcta

SEQ ID NO: 393356 - DNA, 25 bp, Mus musculus
ttgacaaaggcacagcgccctcagg

SEQ ID NO: 393357 - DNA, 25 bp, Mus musculus
ttgacaaagttggcatcctgacttt

SEQ ID NO: 393358 - DNA, 25 bp, Mus musculus
ttgacaacaagcctgaccaccactt

SEQ ID NO: 393359 - DNA, 25 bp, Mus musculus
ttgacaacagctacagtaggggagg

SEQ ID NO: 393360 - DNA, 25 bp, Mus musculus
ttgacaacaggggaggcacttatga

SEQ ID NO: 393361 - DNA, 25 bp, Mus musculus
ttgacaaccaatatcagtctctgct

SEQ ID NO: 393362 - DNA, 25 bp, Mus musculus
ttgacaaccagacacgcataactaa

SEQ ID NO: 393363 - DNA, 25 bp, Mus musculus
ttgacaaccttgcaggccctgtggt

SEQ ID NO: 393364 - DNA, 25 bp, Mus musculus
ttgacaagagctgaagtgggagaaa

SEQ ID NO: 393365 - DNA, 25 bp, Mus musculus
ttgacaagccccagcttatcaagta

SEQ ID NO: 393366 - DNA, 25 bp, Mus musculus
ttgacaagctaaggatttggagttt

SEQ ID NO: 393367 - DNA, 25 bp, Mus musculus
ttgacaataaaacgggtaaaatgat

SEQ ID NO: 393368 - DNA, 25 bp, Mus musculus
ttgacaatagctctggtgcaagtgt

SEQ ID NO: 393369 - DNA, 25 bp, Mus musculus
ttgacaattatgagggttcagctcc

SEQ ID NO: 393370 - DNA, 25 bp, Mus musculus
ttgacaattcagcctggagatgccc

SEQ ID NO: 393371 - DNA, 25 bp, Mus musculus
ttgacacactgcagcgtgctctgct

SEQ ID NO: 393372 - DNA, 25 bp, Mus musculus
ttgacacactggagggagactgtga

SEQ ID NO: 393373 - DNA, 25 bp, Mus musculus
ttgacacatacggacctcaaacctg

SEQ ID NO: 393374 - DNA, 25 bp, Mus musculus
ttgacacattggcggctttcttgat

SEQ ID NO: 393375 - DNA, 25 bp, Mus musculus
ttgacaccagctgcaaggtgtgagg

SEQ ID NO: 393376 - DNA, 25 bp, Mus musculus
ttgacaccaggaacctatgggctaa

SEQ ID NO: 393377 - DNA, 25 bp, Mus musculus
ttgacaccaggctgaccttcttcct

SEQ ID NO: 393378 - DNA, 25 bp, Mus musculus
ttgacaccagggtggacccagtgcc

SEQ ID NO: 393379 - DNA, 25 bp, Mus musculus
ttgacacctcaggtggaccccttga

SEQ ID NO: 393380 - DNA, 25 bp, Mus musculus
ttgacactactgatttcagctctga

SEQ ID NO: 393381 - DNA, 25 bp, Mus musculus
ttgacactcgaggatgtgaagcagg

SEQ ID NO: 393382 - DNA, 25 bp, Mus musculus
ttgacactgaagttggtgagtctag

SEQ ID NO: 393383 - DNA, 25 bp, Mus musculus
ttgacactgctgacagtgccacggc

SEQ ID NO: 393384 - DNA, 25 bp, Mus musculus
ttgacactgctgatgccgagtgctg

SEQ ID NO: 393385 - DNA, 25 bp, Mus musculus
ttgacacttaagggctacttgatta

SEQ ID NO: 393386 - DNA, 25 bp, Mus musculus
ttgacacttgggaggccatggagga

SEQ ID NO: 393387 - DNA, 25 bp, Mus musculus
ttgacagaaagcagatttcaacaag

SEQ ID NO: 393388 - DNA, 25 bp, Mus musculus
ttgacagacagaatgtactttcctt

SEQ ID NO: 393389 - DNA, 25 bp, Mus musculus
ttgacagagaaagatgccaagctgg

SEQ ID NO: 393390 - DNA, 25 bp, Mus musculus
ttgacagagactctttcaagcattt

SEQ ID NO: 393391 - DNA, 25 bp, Mus musculus
ttgacagagagccccttccaactta

SEQ ID NO: 393392 - DNA, 25 bp, Mus musculus
ttgacagatttaagagtttgtttct

SEQ ID NO: 393393 - DNA, 25 bp, Mus musculus
ttgacagatttaagcttccttccac

SEQ ID NO: 393394 - DNA, 25 bp, Mus musculus
ttgacagcaaaggcacccggattct

SEQ ID NO: 393395 - DNA, 25 bp, Mus musculus
ttgacaggcacgagctgcaggtcct

SEQ ID NO: 393396 - DNA, 25 bp, Mus musculus
ttgacaggcagaggcacggtagatg

SEQ ID NO: 393397 - DNA, 25 bp, Mus musculus
ttgacagtaagggtgatgcccggta

SEQ ID NO: 393398 - DNA, 25 bp, Mus musculus
ttgacagtgccaacctggagaaggc

SEQ ID NO: 393399 - DNA, 25 bp, Mus musculus
ttgacagtggaaaggttgagttatt

SEQ ID NO: 393400 - DNA, 25 bp, Mus musculus
ttgacagtgtcaagttctgtggatc

SEQ ID NO: 393401 - DNA, 25 bp, Mus musculus
ttgacagttgcttataggctcttga

SEQ ID NO: 393402 - DNA, 25 bp, Mus musculus
ttgacataagtgaacctagtaacaa

SEQ ID NO: 393403 - DNA, 25 bp, Mus musculus
ttgacatagcctgcaggggtccacc

SEQ ID NO: 393404 - DNA, 25 bp, Mus musculus
ttgacatagcctgctgggtccacca

SEQ ID NO: 393405 - DNA, 25 bp, Mus musculus
ttgacataggctcgttcaggcctgt

SEQ ID NO: 393406 - DNA, 25 bp, Mus musculus
ttgacatagggaacgtctagctcgt

SEQ ID NO: 393407 - DNA, 25 bp, Mus musculus
ttgacatcaaatacaagaggaattt

SEQ ID NO: 393408 - DNA, 25 bp, Mus musculus
ttgacatcaagactgaaggacaaga

SEQ ID NO: 393409 - DNA, 25 bp, Mus musculus
ttgacatcagctctgagtggtggga

SEQ ID NO: 393410 - DNA, 25 bp, Mus musculus
ttgacatcagctctgggcgtcagtg

SEQ ID NO: 393411 - DNA, 25 bp, Mus musculus
ttgacatccgacttcgccctcagct

SEQ ID NO: 393412 - DNA, 25 bp, Mus musculus
ttgacatgagtaacatacaagagat

SEQ ID NO: 393413 - DNA, 25 bp, Mus musculus
ttgacatggcaacagaagttggttt

SEQ ID NO: 393414 - DNA, 25 bp, Mus musculus
ttgaccaacattcagggtctactga

SEQ ID NO: 393415 - DNA, 25 bp, Mus musculus
ttgaccaagacccgggcctggttct

SEQ ID NO: 393416 - DNA, 25 bp, Mus musculus
ttgaccaatcagttcatgcagaaga

SEQ ID NO: 393417 - DNA, 25 bp, Mus musculus
ttgaccaatttagtattcgcctggg

SEQ ID NO: 393418 - DNA, 25 bp, Mus musculus
ttgaccacaggaataactcaacctg

SEQ ID NO: 393419 - DNA, 25 bp, Mus musculus
ttgaccactacgcaggaggattaca

SEQ ID NO: 393420 - DNA, 25 bp, Mus musculus
ttgaccactacgcagttaccgtgac

SEQ ID NO: 393421 - DNA, 25 bp, Mus musculus
ttgaccactcagctgctgcgctgcc

SEQ ID NO: 393422 - DNA, 25 bp, Mus musculus
ttgaccactgcagtctctctctcca

SEQ ID NO: 393423 - DNA, 25 bp, Mus musculus
ttgaccagaagcagctggtgaatga

SEQ ID NO: 393424 - DNA, 25 bp, Mus musculus
ttgaccagaagcagggaaaaggctc

SEQ ID NO: 393425 - DNA, 25 bp, Mus musculus
ttgaccagactgccgctctccacct

SEQ ID NO: 393426 - DNA, 25 bp, Mus musculus
ttgaccagactggcgctctccacct

SEQ ID NO: 393427 - DNA, 25 bp, Mus musculus
ttgaccagatagagctggagctggc

SEQ ID NO: 393428 - DNA, 25 bp, Mus musculus
ttgaccagcaccacctgcccctaga

SEQ ID NO: 393429 - DNA, 25 bp, Mus musculus
ttgaccatcagacaagctgcaaccc

SEQ ID NO: 393430 - DNA, 25 bp, Mus musculus
ttgaccatcaggactcttcccccca

SEQ ID NO: 393431 - DNA, 25 bp, Mus musculus
ttgaccatgaccaggaataactcaa

SEQ ID NO: 393432 - DNA, 25 bp, Mus musculus
ttgaccatgaccaggcgctggctca

SEQ ID NO: 393433 - DNA, 25 bp, Mus musculus
ttgaccatgcggatccttccatttt

SEQ ID NO: 393434 - DNA, 25 bp, Mus musculus
ttgacccaaagatcttggcatatac

SEQ ID NO: 393435 - DNA, 25 bp, Mus musculus
ttgacccaagacaaggtctcactat

SEQ ID NO: 393436 - DNA, 25 bp, Mus musculus
ttgacccagaattaggtatcgaagt

SEQ ID NO: 393437 - DNA, 25 bp, Mus musculus
ttgaccccaggccctgcaggtcgga

SEQ ID NO: 393438 - DNA, 25 bp, Mus musculus
ttgaccctgagacgatccagaacca

SEQ ID NO: 393439 - DNA, 25 bp, Mus musculus
ttgacccttcctgaaggagcagaga

SEQ ID NO: 393440 - DNA, 25 bp, Mus musculus
ttgaccctttgcctggctccaagat

SEQ ID NO: 393441 - DNA, 25 bp, Mus musculus
ttgaccgaaagcacagccatcttga

SEQ ID NO: 393442 - DNA, 25 bp, Mus musculus
ttgaccgagaaggagaagagttaga

SEQ ID NO: 393443 - DNA, 25 bp, Mus musculus
ttgaccgcacaggtactgagacaga

SEQ ID NO: 393444 - DNA, 25 bp, Mus musculus
ttgacctaacaaatgtcgagtggct

SEQ ID NO: 393445 - DNA, 25 bp, Mus musculus
ttgacctaccggttcttcagcgaac

SEQ ID NO: 393446 - DNA, 25 bp, Mus musculus
ttgacctcaaggtcctaaatgctca

SEQ ID NO: 393447 - DNA, 25 bp, Mus musculus
ttgacctcagatcttggtaatgttc

SEQ ID NO: 393448 - DNA, 25 bp, Mus musculus
ttgacctcatggtgttcgtgaccaa

SEQ ID NO: 393449 - DNA, 25 bp, Mus musculus
ttgacctcttcatgcgcatggactt

SEQ ID NO: 393450 - DNA, 25 bp, Mus musculus
ttgacctgaaaaggaaacctgcaga

SEQ ID NO: 393451 - DNA, 25 bp, Mus musculus
ttgacctgactggcaccctcaggaa

SEQ ID NO: 393452 - DNA, 25 bp, Mus musculus
ttgacctgactggtcacagtaatga

SEQ ID NO: 393453 - DNA, 25 bp, Mus musculus
ttgacctgactggtcttaagttttg

SEQ ID NO: 393454 - DNA, 25 bp, Mus musculus
ttgacctggaggagatggtggaatt

SEQ ID NO: 393455 - DNA, 25 bp, Mus musculus
ttgacctggaggagctgttgggccg

SEQ ID NO: 393456 - DNA, 25 bp, Mus musculus
ttgacctgtcccacaggcggaatgt

SEQ ID NO: 393457 - DNA, 25 bp, Mus musculus
ttgacctgtcctgaggttgctacag

SEQ ID NO: 393458 - DNA, 25 bp, Mus musculus
ttgaccttggacttcctggacacca

SEQ ID NO: 393459 - DNA, 25 bp, Mus musculus
ttgaccttgggtgccttccaacctt

SEQ ID NO: 393460 - DNA, 25 bp, Mus musculus
ttgacgaaaacgacagaagatacca

SEQ ID NO: 393461 - DNA, 25 bp, Mus musculus
ttgacgaaaacgagctgttgcgcag

SEQ ID NO: 393462 - DNA, 25 bp, Mus musculus
ttgacgaggcgtgagcacctccgca

SEQ ID NO: 393463 - DNA, 25 bp, Mus musculus
ttgacgagtttgttgtcacaatgct

SEQ ID NO: 393464 - DNA, 25 bp, Mus musculus
ttgacggaagaatcgggcagctcag

SEQ ID NO: 393465 - DNA, 25 bp, Mus musculus
ttgacggacttattgccaaggaaat

SEQ ID NO: 393466 - DNA, 25 bp, Mus musculus
ttgacggcaggagagcctgtgtcct

SEQ ID NO: 393467 - DNA, 25 bp, Mus musculus
ttgacggcaggagagggctgtagca

SEQ ID NO: 393468 - DNA, 25 bp, Mus musculus
ttgacggcagtactggcaccttctc

SEQ ID NO: 393469 - DNA, 25 bp, Mus musculus
ttgacggcagtactggtcctaaccg

SEQ ID NO: 393470 - DNA, 25 bp, Mus musculus
ttgacgtcgtgaagttaagcaaaac

SEQ ID NO: 393471 - DNA, 25 bp, Mus musculus
ttgacgtctaagattcctgctctgg

SEQ ID NO: 393472 - DNA, 25 bp, Mus musculus
ttgacgtgattgtgaataccctttt

SEQ ID NO: 393473 - DNA, 25 bp, Mus musculus
ttgactacaacagcgtccatgccat

SEQ ID NO: 393474 - DNA, 25 bp, Mus musculus
ttgactacagaacacaagacttcaa

SEQ ID NO: 393475 - DNA, 25 bp, Mus musculus
ttgactacagatttcatatataaat

SEQ ID NO: 393476 - DNA, 25 bp, Mus musculus
ttgactacagcacggtggatgacaa

SEQ ID NO: 393477 - DNA, 25 bp, Mus musculus
ttgactacaggaaactataagtaac

SEQ ID NO: 393478 - DNA, 25 bp, Mus musculus
ttgactacctgaggctggcccagcc

SEQ ID NO: 393479 - DNA, 25 bp, Mus musculus
ttgactacctgagggtgaacaacat

SEQ ID NO: 393480 - DNA, 25 bp, Mus musculus
ttgactacgtgaagcaacatccttt

SEQ ID NO: 393481 - DNA, 25 bp, Mus musculus
ttgactatcagcatggggctgcttt

SEQ ID NO: 393482 - DNA, 25 bp, Mus musculus
ttgactatcaggacctccaggacct

SEQ ID NO: 393483 - DNA, 25 bp, Mus musculus
ttgactattgacctagccccatccc

SEQ ID NO: 393484 - DNA, 25 bp, Mus musculus
ttgactcactgattcatctgaaaac

SEQ ID NO: 393485 - DNA, 25 bp, Mus musculus
ttgactccagctattcacggaacca

SEQ ID NO: 393486 - DNA, 25 bp, Mus musculus
ttgactcccaaagcctacaaggatg

SEQ ID NO: 393487 - DNA, 25 bp, Mus musculus
ttgactctcctcagaagactggtcc

SEQ ID NO: 393488 - DNA, 25 bp, Mus musculus
ttgactctcctcaggtcatgtttac

SEQ ID NO: 393489 - DNA, 25 bp, Mus musculus
ttgactctcggtgtcctccaccagt

SEQ ID NO: 393490 - DNA, 25 bp, Mus musculus
ttgactctgagatggtagagatggc

SEQ ID NO: 393491 - DNA, 25 bp, Mus musculus
ttgactctgaggtgctgtaggagcc

SEQ ID NO: 393492 - DNA, 25 bp, Mus musculus
ttgactctggttcaggctggcctgc

SEQ ID NO: 393493 - DNA, 25 bp, Mus musculus
ttgactcttacctgcctgtgccgtg

SEQ ID NO: 393494 - DNA, 25 bp, Mus musculus
ttgactgacagaagttaccaaatgg

SEQ ID NO: 393495 - DNA, 25 bp, Mus musculus
ttgactgagccaagtggtggcggga

SEQ ID NO: 393496 - DNA, 25 bp, Mus musculus
ttgactgcaggtccctggaaacaag

SEQ ID NO: 393497 - DNA, 25 bp, Mus musculus
ttgactgctttctatccctgtgcac

SEQ ID NO: 393498 - DNA, 25 bp, Mus musculus
ttgactggaatggtatttccaaact

SEQ ID NO: 393499 - DNA, 25 bp, Mus musculus
ttgactgggagaggatttgaattaa

SEQ ID NO: 393500 - DNA, 25 bp, Mus musculus
ttgactgggtggaggctaatctcga

SEQ ID NO: 393501 - DNA, 25 bp, Mus musculus
ttgactggtcaagaggaaattgatg

SEQ ID NO: 393502 - DNA, 25 bp, Mus musculus
ttgactgtcaggaacatgacattga

SEQ ID NO: 393503 - DNA, 25 bp, Mus musculus
ttgactgtgaagtgtgccttacatc

SEQ ID NO: 393504 - DNA, 25 bp, Mus musculus
ttgactgtgaatgggtgaatttgga

SEQ ID NO: 393505 - DNA, 25 bp, Mus musculus
ttgactgtgaatgggttctaacgtt

SEQ ID NO: 393506 - DNA, 25 bp, Mus musculus
ttgactgtgtttatggactacaaag

SEQ ID NO: 393507 - DNA, 25 bp, Mus musculus
ttgacttaaaggaactagaggctgc

SEQ ID NO: 393508 - DNA, 25 bp, Mus musculus
ttgacttacaaatcaggagtataca

SEQ ID NO: 393509 - DNA, 25 bp, Mus musculus
ttgacttcaacaccctcttcaagtc

SEQ ID NO: 393510 - DNA, 25 bp, Mus musculus
ttgacttcatggtggcttgcatgca

SEQ ID NO: 393511 - DNA, 25 bp, Mus musculus
ttgacttctcaaggagcgatgagca

SEQ ID NO: 393512 - DNA, 25 bp, Mus musculus
ttgacttctcaaggcgaccctttga

SEQ ID NO: 393513 - DNA, 25 bp, Mus musculus
ttgacttctctaaggcttgccctct

SEQ ID NO: 393514 - DNA, 25 bp, Mus musculus
ttgacttctgtagagtccaattggt

SEQ ID NO: 393515 - DNA, 25 bp, Mus musculus
ttgacttctgtaggcataaactggg

SEQ ID NO: 393516 - DNA, 25 bp, Mus musculus
ttgacttctttggtcttctagggga

SEQ ID NO: 393517 - DNA, 25 bp, Mus musculus
ttgacttgctgaacattgttccctg

SEQ ID NO: 393518 - DNA, 25 bp, Mus musculus
ttgacttggcggccatcgagtaaaa

SEQ ID NO: 393519 - DNA, 25 bp, Mus musculus
ttgactttaactttgagaagaacca

SEQ ID NO: 393520 - DNA, 25 bp, Mus musculus
ttgactttaggaatgtgaagctctt

SEQ ID NO: 393521 - DNA, 25 bp, Mus musculus
ttgactttagggtcttctcagttac

SEQ ID NO: 393522 - DNA, 25 bp, Mus musculus
ttgactttcacacaatcagggcatg

SEQ ID NO: 393523 - DNA, 25 bp, Mus musculus
ttgactttgaaggttgtcttgacac

SEQ ID NO: 393524 - DNA, 25 bp, Mus musculus
ttgagaaacatgctggtggctggga

SEQ ID NO: 393525 - DNA, 25 bp, Mus musculus
ttgagaaacatgctggtggtgtcac

SEQ ID NO: 393526 - DNA, 25 bp, Mus musculus
ttgagaaattgcaggtctcacccaa

SEQ ID NO: 393527 - DNA, 25 bp, Mus musculus
ttgagaacaacaggaacctgaggag

SEQ ID NO: 393528 - DNA, 25 bp, Mus musculus
ttgagaacaacaggactccgggaga

SEQ ID NO: 393529 - DNA, 25 bp, Mus musculus
ttgagaacaccaaattccggggtgc

SEQ ID NO: 393530 - DNA, 25 bp, Mus musculus
ttgagaaccccagggtccattcaca

SEQ ID NO: 393531 - DNA, 25 bp, Mus musculus
ttgagaacctgtctccttaaagaat

SEQ ID NO: 393532 - DNA, 25 bp, Mus musculus
ttgagaacggatgggatatttccac

SEQ ID NO: 393533 - DNA, 25 bp, Mus musculus
ttgagaactgggcgtggaaaagata

SEQ ID NO: 393534 - DNA, 25 bp, Mus musculus
ttgagaacttcaggtctgctgtaac

SEQ ID NO: 393535 - DNA, 25 bp, Mus musculus
ttgagaacttcaggtttgctgtctt

SEQ ID NO: 393536 - DNA, 25 bp, Mus musculus
ttgagaagaccaagactgtatccct

SEQ ID NO: 393537 - DNA, 25 bp, Mus musculus
ttgagaagaccaaggctttgatcca

SEQ ID NO: 393538 - DNA, 25 bp, Mus musculus
ttgagaagacgggatatcgctcgag

SEQ ID NO: 393539 - DNA, 25 bp, Mus musculus
ttgagaagactgtgaacaggtatga

SEQ ID NO: 393540 - DNA, 25 bp, Mus musculus
ttgagaagctgggcttcaacaaatc

SEQ ID NO: 393541 - DNA, 25 bp, Mus musculus
ttgagaagctgggtatcagtaccat

SEQ ID NO: 393542 - DNA, 25 bp, Mus musculus
ttgagaaggtgggaggctggaatat

SEQ ID NO: 393543 - DNA, 25 bp, Mus musculus
ttgagaataccattgagtcagacgt

SEQ ID NO: 393544 - DNA, 25 bp, Mus musculus
ttgagaatagctaagagctttgacc

SEQ ID NO: 393545 - DNA, 25 bp, Mus musculus
ttgagacaccgagagtgtgggttcg

SEQ ID NO: 393546 - DNA, 25 bp, Mus musculus
ttgagacaggaccagcaatggcaag

SEQ ID NO: 393547 - DNA, 25 bp, Mus musculus
ttgagaccagcaggtttctggacgg

SEQ ID NO: 393548 - DNA, 25 bp, Mus musculus
ttgagaccctacatgtacccctcaa

SEQ ID NO: 393549 - DNA, 25 bp, Mus musculus
ttgagacctataatggtcagcaaga

SEQ ID NO: 393550 - DNA, 25 bp, Mus musculus
ttgagactctctgtgcaaagaccca

SEQ ID NO: 393551 - DNA, 25 bp, Mus musculus
ttgagactgctcctggtgcatggag

SEQ ID NO: 393552 - DNA, 25 bp, Mus musculus
ttgagactgggcagttggtcatcat

SEQ ID NO: 393553 - DNA, 25 bp, Mus musculus
ttgagactgtgggatagtgtgctgg

SEQ ID NO: 393554 - DNA, 25 bp, Mus musculus
ttgagactgtggtgtgtctgcagga

SEQ ID NO: 393555 - DNA, 25 bp, Mus musculus
ttgagactttctttggggtaggctc

SEQ ID NO: 393556 - DNA, 25 bp, Mus musculus
ttgagagaagtgatattgtggtcca

SEQ ID NO: 393557 - DNA, 25 bp, Mus musculus
ttgagagaattggaaaatgactccc

SEQ ID NO: 393558 - DNA, 25 bp, Mus musculus
ttgagagagagaaggagagggaaag

SEQ ID NO: 393559 - DNA, 25 bp, Mus musculus
ttgagagagcgagagttactacctg

SEQ ID NO: 393560 - DNA, 25 bp, Mus musculus
ttgagagagcgaggttgcacatagg

SEQ ID NO: 393561 - DNA, 25 bp, Mus musculus
ttgagagagctgcaagcaggggtag

SEQ ID NO: 393562 - DNA, 25 bp, Mus musculus
ttgagagcaggtttaaacgcatctc

SEQ ID NO: 393563 - DNA, 25 bp, Mus musculus
ttgagagcctcctgacatgatgtag

SEQ ID NO: 393564 - DNA, 25 bp, Mus musculus
ttgagagcctcctggagctggtgga

SEQ ID NO: 393565 - DNA, 25 bp, Mus musculus
ttgagaggaatccaacctcagtgca

SEQ ID NO: 393566 - DNA, 25 bp, Mus musculus
ttgagaggggcaggtggcagctcag

SEQ ID NO: 393567 - DNA, 25 bp, Mus musculus
ttgagagtctatcaccactacttta

SEQ ID NO: 393568 - DNA, 25 bp, Mus musculus
ttgagagtctcaaggctacatgtga

SEQ ID NO: 393569 - DNA, 25 bp, Mus musculus
ttgagataaaagccagagttactta

SEQ ID NO: 393570 - DNA, 25 bp, Mus musculus
ttgagatatttaaagctgcaggcac

SEQ ID NO: 393571 - DNA, 25 bp, Mus musculus
ttgagatcaacccctagtggtgacc

SEQ ID NO: 393572 - DNA, 25 bp, Mus musculus
ttgagatcagctaattaagaaccta

SEQ ID NO: 393573 - DNA, 25 bp, Mus musculus
ttgagatcatggagatgctccaagc

SEQ ID NO: 393574 - DNA, 25 bp, Mus musculus
ttgagatccggaggatccaaggact

SEQ ID NO: 393575 - DNA, 25 bp, Mus musculus
ttgagatcttcgatttcaacagctt

SEQ ID NO: 393576 - DNA, 25 bp, Mus musculus
ttgagatgaatagcccagccaagcg

SEQ ID NO: 393577 - DNA, 25 bp, Mus musculus
ttgagatggagtctctagccaagag

SEQ ID NO: 393578 - DNA, 25 bp, Mus musculus
ttgagatgggaaggaaaaagtgtga

SEQ ID NO: 393579 - DNA, 25 bp, Mus musculus
ttgagatgggaagggaaaatgaaca

SEQ ID NO: 393580 - DNA, 25 bp, Mus musculus
ttgagattaagaaatgtgaccttca

SEQ ID NO: 393581 - DNA, 25 bp, Mus musculus
ttgagattaaggaagcctgctgcgt

SEQ ID NO: 393582 - DNA, 25 bp, Mus musculus
ttgagattacgccaggtggtgccac

SEQ ID NO: 393583 - DNA, 25 bp, Mus musculus
ttgagattactggagtgctgacaga

SEQ ID NO: 393584 - DNA, 25 bp, Mus musculus
ttgagattggcgtttcagtgaacaa

SEQ ID NO: 393585 - DNA, 25 bp, Mus musculus
ttgagcaaaggagaagcgctaccaa

SEQ ID NO: 393586 - DNA, 25 bp, Mus musculus
ttgagcaccccacgatggtacctca

SEQ ID NO: 393587 - DNA, 25 bp, Mus musculus
ttgagcaccccacggacagacagct

SEQ ID NO: 393588 - DNA, 25 bp, Mus musculus
ttgagcactccttctggagatcctt

SEQ ID NO: 393589 - DNA, 25 bp, Mus musculus
ttgagcagaagtcagaaattacact

SEQ ID NO: 393590 - DNA, 25 bp, Mus musculus
ttgagcagaagtggttcccagtggg

SEQ ID NO: 393591 - DNA, 25 bp, Mus musculus
ttgagcagcagcaaaaagatggaac

SEQ ID NO: 393592 - DNA, 25 bp, Mus musculus
ttgagcaggaattccgggtcagctg

SEQ ID NO: 393593 - DNA, 25 bp, Mus musculus
ttgagcaggagaagagtatcgatga

SEQ ID NO: 393594 - DNA, 25 bp, Mus musculus
ttgagcagggagatggcggtaaatg

SEQ ID NO: 393595 - DNA, 25 bp, Mus musculus
ttgagcagttggtaagtggagaaag

SEQ ID NO: 393596 - DNA, 25 bp, Mus musculus
ttgagcataggtcctgatcactggc

SEQ ID NO: 393597 - DNA, 25 bp, Mus musculus
ttgagcatccttgcagctggccagc

SEQ ID NO: 393598 - DNA, 25 bp, Mus musculus
ttgagccataatgaagagtctttgg

SEQ ID NO: 393599 - DNA, 25 bp, Mus musculus
ttgagcccgagaggagccacagacc

SEQ ID NO: 393600 - DNA, 25 bp, Mus musculus
ttgagcccgagaggcccatctgaac

SEQ ID NO: 393601 - DNA, 25 bp, Mus musculus
ttgagcccgagagtttccaaggagt

SEQ ID NO: 393602 - DNA, 25 bp, Mus musculus
ttgagccctttcttgcatttagtaa

SEQ ID NO: 393603 - DNA, 25 bp, Mus musculus
ttgagccgacccaggtctgtgcaga

SEQ ID NO: 393604 - DNA, 25 bp, Mus musculus
ttgagccgcagaagtatgaggcttg

SEQ ID NO: 393605 - DNA, 25 bp, Mus musculus
ttgagccggggaaaggtgctctccc

SEQ ID NO: 393606 - DNA, 25 bp, Mus musculus
ttgagccggggaaaggtgtctaagg

SEQ ID NO: 393607 - DNA, 25 bp, Mus musculus
ttgagcctcaggactcagagaggct

SEQ ID NO: 393608 - DNA, 25 bp, Mus musculus
ttgagcctcgaagtctttacctggg

SEQ ID NO: 393609 - DNA, 25 bp, Mus musculus
ttgagcgaagaacaaattacctgct

SEQ ID NO: 393610 - DNA, 25 bp, Mus musculus
ttgagcgaagacccttaccaggacc

SEQ ID NO: 393611 - DNA, 25 bp, Mus musculus
ttgagcgagttcaagggcagagaac

SEQ ID NO: 393612 - DNA, 25 bp, Mus musculus
ttgagcgcaaggtaatagaacttcc

SEQ ID NO: 393613 - DNA, 25 bp, Mus musculus
ttgagcggcggctggtaagaacagt

SEQ ID NO: 393614 - DNA, 25 bp, Mus musculus
ttgagcggtgaagcggagccctgca

SEQ ID NO: 393615 - DNA, 25 bp, Mus musculus
ttgagcggtgaagcgggtcgccctc

SEQ ID NO: 393616 - DNA, 25 bp, Mus musculus
ttgagcgtggcggacctcatccgca

SEQ ID NO: 393617 - DNA, 25 bp, Mus musculus
ttgagctactcaggcctgcctactt

SEQ ID NO: 393618 - DNA, 25 bp, Mus musculus
ttgagctactcaggtcaaggctttg

SEQ ID NO: 393619 - DNA, 25 bp, Mus musculus
ttgagctcaagaaaccacagtgcaa

SEQ ID NO: 393620 - DNA, 25 bp, Mus musculus
ttgagctcacatgaaaccaaagatg

SEQ ID NO: 393621 - DNA, 25 bp, Mus musculus
ttgagctcccaaggtggatgaagac

SEQ ID NO: 393622 - DNA, 25 bp, Mus musculus
ttgagctgcagaatgctggccttgc

SEQ ID NO: 393623 - DNA, 25 bp, Mus musculus
ttgagctgcagaatggtaatacaca

SEQ ID NO: 393624 - DNA, 25 bp, Mus musculus
ttgagctgccgactagaagttattt

SEQ ID NO: 393625 - DNA, 25 bp, Mus musculus
ttgagctgccgactatactgaagca

SEQ ID NO: 393626 - DNA, 25 bp, Mus musculus
ttgagctgccgactcctgatagagg

SEQ ID NO: 393627 - DNA, 25 bp, Mus musculus
ttgagctgccgacttaaccgtgtgg

SEQ ID NO: 393628 - DNA, 25 bp, Mus musculus
ttgagctgccttttgacatcccaga

SEQ ID NO: 393629 - DNA, 25 bp, Mus musculus
ttgagctgctccaggagcctgaagc

SEQ ID NO: 393630 - DNA, 25 bp, Mus musculus
ttgagctggctgggtttgactctgc

SEQ ID NO: 393631 - DNA, 25 bp, Mus musculus
ttgagctggctggtgctggcatgaa

SEQ ID NO: 393632 - DNA, 25 bp, Mus musculus
ttgagctgttcagaatgaattagcc

SEQ ID NO: 393633 - DNA, 25 bp, Mus musculus
ttgagctgttcagacggtgcgcagt

SEQ ID NO: 393634 - DNA, 25 bp, Mus musculus
ttgagctgttcagagacagatgggg

SEQ ID NO: 393635 - DNA, 25 bp, Mus musculus
ttgagcttaatgctttaatgactga

SEQ ID NO: 393636 - DNA, 25 bp, Mus musculus
ttgagcttaatgtttgttaacgcgc

SEQ ID NO: 393637 - DNA, 25 bp, Mus musculus
ttgagcttactggccgcagcaagaa

SEQ ID NO: 393638 - DNA, 25 bp, Mus musculus
ttgagcttactggcctttcaggcag

SEQ ID NO: 393639 - DNA, 25 bp, Mus musculus
ttgaggaaagcgaatctccccgagg

SEQ ID NO: 393640 - DNA, 25 bp, Mus musculus
ttgaggaaagggaacgggagatgga

SEQ ID NO: 393641 - DNA, 25 bp, Mus musculus
ttgaggaagagcaatgtggactttg

SEQ ID NO: 393642 - DNA, 25 bp, Mus musculus
ttgaggaagagccggaatcggtggg

SEQ ID NO: 393643 - DNA, 25 bp, Mus musculus
ttgaggaagcttcagcgacagcagt

SEQ ID NO: 393644 - DNA, 25 bp, Mus musculus
ttgaggaataggtacctggcagcat

SEQ ID NO: 393645 - DNA, 25 bp, Mus musculus
ttgaggaatgctcgccaaaacaact

SEQ ID NO: 393646 - DNA, 25 bp, Mus musculus
ttgaggaatgctctctttggggtgt

SEQ ID NO: 393647 - DNA, 25 bp, Mus musculus
ttgaggaatgggaaaagtacgagat

SEQ ID NO: 393648 - DNA, 25 bp, Mus musculus
ttgaggacagcttgtcccaggtaaa

SEQ ID NO: 393649 - DNA, 25 bp, Mus musculus
ttgaggaccccaaagtggttgatcg

SEQ ID NO: 393650 - DNA, 25 bp, Mus musculus
ttgaggacccggagctagaagcgat

SEQ ID NO: 393651 - DNA, 25 bp, Mus musculus
ttgaggactgatgggatggctctga

SEQ ID NO: 393652 - DNA, 25 bp, Mus musculus
ttgaggactttgaggacaatggtga

SEQ ID NO: 393653 - DNA, 25 bp, Mus musculus
ttgaggagagaagagaactatgagc

SEQ ID NO: 393654 - DNA, 25 bp, Mus musculus
ttgaggagagtgaggaagaagacga

SEQ ID NO: 393655 - DNA, 25 bp, Mus musculus
ttgaggagcagttcctgaatgccac

SEQ ID NO: 393656 - DNA, 25 bp, Mus musculus
ttgaggaggaagagttaacactcac

SEQ ID NO: 393657 - DNA, 25 bp, Mus musculus
ttgaggatagccaggtcaaagccca

SEQ ID NO: 393658 - DNA, 25 bp, Mus musculus
ttgaggatctggaagctcaagtgac

SEQ ID NO: 393659 - DNA, 25 bp, Mus musculus
ttgaggatgaaggacggtggcgcct

SEQ ID NO: 393660 - DNA, 25 bp, Mus musculus
ttgaggatgccagagcacagggcac

SEQ ID NO: 393661 - DNA, 25 bp, Mus musculus
ttgaggatgccaggagctccggccc

SEQ ID NO: 393662 - DNA, 25 bp, Mus musculus
ttgaggcaaagaacctagccagcta

SEQ ID NO: 393663 - DNA, 25 bp, Mus musculus
ttgaggcagaagtgctgtgtggtct

SEQ ID NO: 393664 - DNA, 25 bp, Mus musculus
ttgaggcagaagttgacccaccttc

SEQ ID NO: 393665 - DNA, 25 bp, Mus musculus
ttgaggcagaatgctatcaaaagcc

SEQ ID NO: 393666 - DNA, 25 bp, Mus musculus
ttgaggcaggtgcaagctggccatt

SEQ ID NO: 393667 - DNA, 25 bp, Mus musculus
ttgaggccaagcacgataaatacat

SEQ ID NO: 393668 - DNA, 25 bp, Mus musculus
ttgaggccaagcacgtggacgagaa

SEQ ID NO: 393669 - DNA, 25 bp, Mus musculus
ttgaggccccccagccaggatgatg

SEQ ID NO: 393670 - DNA, 25 bp, Mus musculus
ttgaggccctcaagtctcacatcat

SEQ ID NO: 393671 - DNA, 25 bp, Mus musculus
ttgaggccgtgaagagtgagccggt

SEQ ID NO: 393672 - DNA, 25 bp, Mus musculus
ttgaggcctggcaggtcctgaaaca

SEQ ID NO: 393673 - DNA, 25 bp, Mus musculus
ttgaggcctggcaggtgcccttctc

SEQ ID NO: 393674 - DNA, 25 bp, Mus musculus
ttgaggcctgggtgtgcattatgtg

SEQ ID NO: 393675 - DNA, 25 bp, Mus musculus
ttgaggctgaaaaagcaatacgagg

SEQ ID NO: 393676 - DNA, 25 bp, Mus musculus
ttgaggctgacagacaagattgtaa

SEQ ID NO: 393677 - DNA, 25 bp, Mus musculus
ttgaggctgatgaagccatcaaagg

SEQ ID NO: 393678 - DNA, 25 bp, Mus musculus
ttgaggctgggaggagtgggaggtg

SEQ ID NO: 393679 - DNA, 25 bp, Mus musculus
ttgaggctttcaagctaactgatga

SEQ ID NO: 393680 - DNA, 25 bp, Mus musculus
ttgagggaaggtccccaccctgcat

SEQ ID NO: 393681 - DNA, 25 bp, Mus musculus
ttgagggaggagctttcatggatcg

SEQ ID NO: 393682 - DNA, 25 bp, Mus musculus
ttgagggatgctgactgtgcaccat

SEQ ID NO: 393683 - DNA, 25 bp, Mus musculus
ttgagggcaagaaggctgcgaaaag

SEQ ID NO: 393684 - DNA, 25 bp, Mus musculus
ttgagggcagcctggacactgcaac

SEQ ID NO: 393685 - DNA, 25 bp, Mus musculus
ttgagggcctcgagaatggctctga

SEQ ID NO: 393686 - DNA, 25 bp, Mus musculus
ttgaggggagcactggactccttca

SEQ ID NO: 393687 - DNA, 25 bp, Mus musculus
ttgaggggagcactggccctgctcc

SEQ ID NO: 393688 - DNA, 25 bp, Mus musculus
ttgaggggctgtcctgctaaggaag

SEQ ID NO: 393689 - DNA, 25 bp, Mus musculus
ttgagggtgagtttgaaaccaggaa

SEQ ID NO: 393690 - DNA, 25 bp, Mus musculus
ttgaggtccaagctcggacctcagg

SEQ ID NO: 393691 - DNA, 25 bp, Mus musculus
ttgaggtctcactgctaataaagac

SEQ ID NO: 393692 - DNA, 25 bp, Mus musculus
ttgaggtctcactggttggcgcatc

SEQ ID NO: 393693 - DNA, 25 bp, Mus musculus
ttgaggtcttgacagaggatctccc

SEQ ID NO: 393694 - DNA, 25 bp, Mus musculus
ttgaggttcaaaaggatccagaagc

SEQ ID NO: 393695 - DNA, 25 bp, Mus musculus
ttgaggttcaaaaggcacagtgacc

SEQ ID NO: 393696 - DNA, 25 bp, Mus musculus
ttgaggttgagcaacattttgatgg

SEQ ID NO: 393697 - DNA, 25 bp, Mus musculus
ttgaggttgagggaatagccagagc

SEQ ID NO: 393698 - DNA, 25 bp, Mus musculus
ttgaggttgaggtgtcctcaacaat

SEQ ID NO: 393699 - DNA, 25 bp, Mus musculus
ttgagtaatgtcatggaattgggga

SEQ ID NO: 393700 - DNA, 25 bp, Mus musculus
ttgagtacaccacggacaaggagcc

SEQ ID NO: 393701 - DNA, 25 bp, Mus musculus
ttgagtacaggtctgtaccacaaca

SEQ ID NO: 393702 - DNA, 25 bp, Mus musculus
ttgagtacaggtgatttgaactgtg

SEQ ID NO: 393703 - DNA, 25 bp, Mus musculus
ttgagtacatggccccagagattct

SEQ ID NO: 393704 - DNA, 25 bp, Mus musculus
ttgagtagcagtgagcgtcctggga

SEQ ID NO: 393705 - DNA, 25 bp, Mus musculus
ttgagtatatgggaagtactggaga

SEQ ID NO: 393706 - DNA, 25 bp, Mus musculus
ttgagtatatggggcagagcccggg

SEQ ID NO: 393707 - DNA, 25 bp, Mus musculus
ttgagtatccggacaattccatcaa

SEQ ID NO: 393708 - DNA, 25 bp, Mus musculus
ttgagtattgggaatattacagcca

SEQ ID NO: 393709 - DNA, 25 bp, Mus musculus
ttgagtcaaacgagtctcccattag

SEQ ID NO: 393710 - DNA, 25 bp, Mus musculus
ttgagtcaaacgccacatctacatc

SEQ ID NO: 393711 - DNA, 25 bp, Mus musculus
ttgagtcaagagaatcggctatcca

SEQ ID NO: 393712 - DNA, 25 bp, Mus musculus
ttgagtcaagagatcaggacttccc

SEQ ID NO: 393713 - DNA, 25 bp, Mus musculus
ttgagtcaagagatgaagccacccc

SEQ ID NO: 393714 - DNA, 25 bp, Mus musculus
ttgagtccagaaagtcaacgcctca

SEQ ID NO: 393715 - DNA, 25 bp, Mus musculus
ttgagtccaggttcacattgagatc

SEQ ID NO: 393716 - DNA, 25 bp, Mus musculus
ttgagtcctcaaactcactctgcag

SEQ ID NO: 393717 - DNA, 25 bp, Mus musculus
ttgagtcctcaaagacaatgtgtct

SEQ ID NO: 393718 - DNA, 25 bp, Mus musculus
ttgagtcgatgtgcctgagacgtaa

SEQ ID NO: 393719 - DNA, 25 bp, Mus musculus
ttgagtcgcctcagaaaatgtatct

SEQ ID NO: 393720 - DNA, 25 bp, Mus musculus
ttgagtcgttgaagagagttgtggt

SEQ ID NO: 393721 - DNA, 25 bp, Mus musculus
ttgagtcgttgaaggtactagcaag

SEQ ID NO: 393722 - DNA, 25 bp, Mus musculus
ttgagtctacaggtttgtacagcgc

SEQ ID NO: 393723 - DNA, 25 bp, Mus musculus
ttgagtctgccaaaattatggaccc

SEQ ID NO: 393724 - DNA, 25 bp, Mus musculus
ttgagtgacgggtttagctttttct

SEQ ID NO: 393725 - DNA, 25 bp, Mus musculus
ttgagtgcaagaggcaagtgcaggt

SEQ ID NO: 393726 - DNA, 25 bp, Mus musculus
ttgagtgcaaggcaccccggctgga

SEQ ID NO: 393727 - DNA, 25 bp, Mus musculus
ttgagtgcaggaatttgacgggcac

SEQ ID NO: 393728 - DNA, 25 bp, Mus musculus
ttgagtgcaggcttggctgttgttc

SEQ ID NO: 393729 - DNA, 25 bp, Mus musculus
ttgagtggaacgcaaccttcctgct

SEQ ID NO: 393730 - DNA, 25 bp, Mus musculus
ttgagtggaatgcgctcttcgtggt

SEQ ID NO: 393731 - DNA, 25 bp, Mus musculus
ttgagtggacaggctgaatttgaca

SEQ ID NO: 393732 - DNA, 25 bp, Mus musculus
ttgagtgggaagatgatcttcccaa

SEQ ID NO: 393733 - DNA, 25 bp, Mus musculus
ttgagtggtccatgtctctttctcc

SEQ ID NO: 393734 - DNA, 25 bp, Mus musculus
ttgagtgtgcgcgggtcactcaccc

SEQ ID NO: 393735 - DNA, 25 bp, Mus musculus
ttgagtgttttctctcttttatttc

SEQ ID NO: 393736 - DNA, 25 bp, Mus musculus
ttgagttacttagtggagagaacag

SEQ ID NO: 393737 - DNA, 25 bp, Mus musculus
ttgagttacttagtggtgagacgtg

SEQ ID NO: 393738 - DNA, 25 bp, Mus musculus
ttgagttattggtaacttcaatttt

SEQ ID NO: 393739 - DNA, 25 bp, Mus musculus
ttgagttctccagagccaaggctgt

SEQ ID NO: 393740 - DNA, 25 bp, Mus musculus
ttgagttcttgtgggaagcattcaa

SEQ ID NO: 393741 - DNA, 25 bp, Mus musculus
ttgagttcttgtgggggatgcttgg

SEQ ID NO: 393742 - DNA, 25 bp, Mus musculus
ttgagttcttgtgggtggccatgca

SEQ ID NO: 393743 - DNA, 25 bp, Mus musculus
ttgagttgctgctgattttcatttc

SEQ ID NO: 393744 - DNA, 25 bp, Mus musculus
ttgagttgctgctggtgccagggtg

SEQ ID NO: 393745 - DNA, 25 bp, Mus musculus
ttgagtttccgatgagacagaagac

SEQ ID NO: 393746 - DNA, 25 bp, Mus musculus
ttgagtttgctcagaagtttacaga

SEQ ID NO: 393747 - DNA, 25 bp, Mus musculus
ttgagttttgaagcactaggttcac

SEQ ID NO: 393748 - DNA, 25 bp, Mus musculus
ttgataaaacatgctggaggcattc

SEQ ID NO: 393749 - DNA, 25 bp, Mus musculus
ttgataaaacatggcattctgcatt

SEQ ID NO: 393750 - DNA, 25 bp, Mus musculus
ttgataaaaccacgactccagatgt

SEQ ID NO: 393751 - DNA, 25 bp, Mus musculus
ttgataaaagtgaatttcctactga

SEQ ID NO: 393752 - DNA, 25 bp, Mus musculus
ttgataaaatcaagatgtctgttgg

SEQ ID NO: 393753 - DNA, 25 bp, Mus musculus
ttgataagagcacagcttctccagc

SEQ ID NO: 393754 - DNA, 25 bp, Mus musculus
ttgataagagcacagtgctggctgc

SEQ ID NO: 393755 - DNA, 25 bp, Mus musculus
ttgataaggctcagagagtctgcag

SEQ ID NO: 393756 - DNA, 25 bp, Mus musculus
ttgataataccaggattgtctacaa

SEQ ID NO: 393757 - DNA, 25 bp, Mus musculus
ttgataatccgctggctcgggcctg

SEQ ID NO: 393758 - DNA, 25 bp, Mus musculus
ttgatacaaatggaaactataagta

SEQ ID NO: 393759 - DNA, 25 bp, Mus musculus
ttgatacacagagagcgatacacac

SEQ ID NO: 393760 - DNA, 25 bp, Mus musculus
ttgatacacagagatatagtgctgg

SEQ ID NO: 393761 - DNA, 25 bp, Mus musculus
ttgataccctgggcaggattcctat

SEQ ID NO: 393762 - DNA, 25 bp, Mus musculus
ttgatacgtttggaaagctggtcta

SEQ ID NO: 393763 - DNA, 25 bp, Mus musculus
ttgatacgtttggaaatgttccttc

SEQ ID NO: 393764 - DNA, 25 bp, Mus musculus
ttgatactaaaaggagacagtggaa

SEQ ID NO: 393765 - DNA, 25 bp, Mus musculus
ttgatactaaaagtgaagcctgtct

SEQ ID NO: 393766 - DNA, 25 bp, Mus musculus
ttgatagacagatcctacttctgga

SEQ ID NO: 393767 - DNA, 25 bp, Mus musculus
ttgatagagtttcagatacaccaag

SEQ ID NO: 393768 - DNA, 25 bp, Mus musculus
ttgatagagtttcagcacccacaga

SEQ ID NO: 393769 - DNA, 25 bp, Mus musculus
ttgatagcggagaaaattggagagg

SEQ ID NO: 393770 - DNA, 25 bp, Mus musculus
ttgataggacagaacaccacccaaa

SEQ ID NO: 393771 - DNA, 25 bp, Mus musculus
ttgataggacagtgttcttcacaaa

SEQ ID NO: 393772 - DNA, 25 bp, Mus musculus
ttgatataaaggttttaaatgcaca

SEQ ID NO: 393773 - DNA, 25 bp, Mus musculus
ttgatatcatccgagttagaacaaa

SEQ ID NO: 393774 - DNA, 25 bp, Mus musculus
ttgatatctttgaagaccttgcttt

SEQ ID NO: 393775 - DNA, 25 bp, Mus musculus
ttgatatctttgaagatgctgtctt

SEQ ID NO: 393776 - DNA, 25 bp, Mus musculus
ttgatatctttgaaggacgtgtaat

SEQ ID NO: 393777 - DNA, 25 bp, Mus musculus
ttgatatctttgaagtactaagtat

SEQ ID NO: 393778 - DNA, 25 bp, Mus musculus
ttgatatgaagcagattgattatac

SEQ ID NO: 393779 - DNA, 25 bp, Mus musculus
ttgatatggcacccgttattggaaa

SEQ ID NO: 393780 - DNA, 25 bp, Mus musculus
ttgatatgtcgaccggaagaaagac

SEQ ID NO: 393781 - DNA, 25 bp, Mus musculus
ttgatattcggagctggagccctgt

SEQ ID NO: 393782 - DNA, 25 bp, Mus musculus
ttgatattcggctgaattcatcaga

SEQ ID NO: 393783 - DNA, 25 bp, Mus musculus
ttgatcaaagtgccagtgaacccca

SEQ ID NO: 393784 - DNA, 25 bp, Mus musculus
ttgatcaaagtggaaatggatccac

SEQ ID NO: 393785 - DNA, 25 bp, Mus musculus
ttgatcaacagacgtatgttgtcac

SEQ ID NO: 393786 - DNA, 25 bp, Mus musculus
ttgatcaacagccaaaccactgagc

SEQ ID NO: 393787 - DNA, 25 bp, Mus musculus
ttgatcacaaggtcacacttggtcc

SEQ ID NO: 393788 - DNA, 25 bp, Mus musculus
ttgatcacagtattttcacaaagtt

SEQ ID NO: 393789 - DNA, 25 bp, Mus musculus
ttgatcacagttttcattgaaaaat

SEQ ID NO: 393790 - DNA, 25 bp, Mus musculus
ttgatcatcccagcctatgggaagg

SEQ ID NO: 393791 - DNA, 25 bp, Mus musculus
ttgatcatctattagggcttatttc

SEQ ID NO: 393792 - DNA, 25 bp, Mus musculus
ttgatcatttttctgacaagcaggt

SEQ ID NO: 393793 - DNA, 25 bp, Mus musculus
ttgatcatttttctggtgtgatcct

SEQ ID NO: 393794 - DNA, 25 bp, Mus musculus
ttgatccagaaaagctctccgtaaa

SEQ ID NO: 393795 - DNA, 25 bp, Mus musculus
ttgatccagaaaagctgtcttcaga

SEQ ID NO: 393796 - DNA, 25 bp, Mus musculus
ttgatccagaacctggagaatgtgg

SEQ ID NO: 393797 - DNA, 25 bp, Mus musculus
ttgatccagttcaggatgagatgct

SEQ ID NO: 393798 - DNA, 25 bp, Mus musculus
ttgatcccgtgaaggtgattcagac

SEQ ID NO: 393799 - DNA, 25 bp, Mus musculus
ttgatcctggaggtggccttagaca

SEQ ID NO: 393800 - DNA, 25 bp, Mus musculus
ttgatcgcttcaatgcaccgggtgc

SEQ ID NO: 393801 - DNA, 25 bp, Mus musculus
ttgatctattttcaagaaagtgttg

SEQ ID NO: 393802 - DNA, 25 bp, Mus musculus
ttgatctattttcggatgtacatgc

SEQ ID NO: 393803 - DNA, 25 bp, Mus musculus
ttgatctcagatctgcagactctca

SEQ ID NO: 393804 - DNA, 25 bp, Mus musculus
ttgatctcaggtgattactgacgca

SEQ ID NO: 393805 - DNA, 25 bp, Mus musculus
ttgatctgaaggaaggcgaagtgca

SEQ ID NO: 393806 - DNA, 25 bp, Mus musculus
ttgatctgaccaaggtttggcctca

SEQ ID NO: 393807 - DNA, 25 bp, Mus musculus
ttgatcttaagatgtcagtagaaac

SEQ ID NO: 393808 - DNA, 25 bp, Mus musculus
ttgatcttaaggatcgagagcgatg

SEQ ID NO: 393809 - DNA, 25 bp, Mus musculus
ttgatcttaataatcctattgcagt

SEQ ID NO: 393810 - DNA, 25 bp, Mus musculus
ttgatcttgtgagagggtctgcatt

SEQ ID NO: 393811 - DNA, 25 bp, Mus musculus
ttgatctttctcagattccttgtaa

SEQ ID NO: 393812 - DNA, 25 bp, Mus musculus
ttgatgaaagagaaaaaaatctgga

SEQ ID NO: 393813 - DNA, 25 bp, Mus musculus
ttgatgaaatagactctttcctacg

SEQ ID NO: 393814 - DNA, 25 bp, Mus musculus
ttgatgaaattacttctgaaaagca

SEQ ID NO: 393815 - DNA, 25 bp, Mus musculus
ttgatgaaattatacgacctcctgt

SEQ ID NO: 393816 - DNA, 25 bp, Mus musculus
ttgatgaaattgagcaactgaagca

SEQ ID NO: 393817 - DNA, 25 bp, Mus musculus
ttgatgaagccagaagatgtagcta

SEQ ID NO: 393818 - DNA, 25 bp, Mus musculus
ttgatgaagccagatgctgatgctg

SEQ ID NO: 393819 - DNA, 25 bp, Mus musculus
ttgatgaagccagcactagcaacaa

SEQ ID NO: 393820 - DNA, 25 bp, Mus musculus
ttgatgaagcgtcaggaactgtgtg

SEQ ID NO: 393821 - DNA, 25 bp, Mus musculus
ttgatgaccagagttacaagcacct

SEQ ID NO: 393822 - DNA, 25 bp, Mus musculus
ttgatgacctggaagacgagctcta

SEQ ID NO: 393823 - DNA, 25 bp, Mus musculus
ttgatgacctggaagataaactgaa

SEQ ID NO: 393824 - DNA, 25 bp, Mus musculus
ttgatgactaccatcatcgagaaga

SEQ ID NO: 393825 - DNA, 25 bp, Mus musculus
ttgatgacttagaagacgagctgta

SEQ ID NO: 393826 - DNA, 25 bp, Mus musculus
ttgatgacttagaagagaaagtggc

SEQ ID NO: 393827 - DNA, 25 bp, Mus musculus
ttgatgacttagaagataagtttct

SEQ ID NO: 393828 - DNA, 25 bp, Mus musculus
ttgatgacttagaagatcaactcta

SEQ ID NO: 393829 - DNA, 25 bp, Mus musculus
ttgatgagaaaggaaatttcttggt

SEQ ID NO: 393830 - DNA, 25 bp, Mus musculus
ttgatgagggtaagtatcagatgga

SEQ ID NO: 393831 - DNA, 25 bp, Mus musculus
ttgatgagtgaagaggcgacgacgg

SEQ ID NO: 393832 - DNA, 25 bp, Mus musculus
ttgatgagtgacctgctgccgtctc

SEQ ID NO: 393833 - DNA, 25 bp, Mus musculus
ttgatgagtgcttcctttgcagctc

SEQ ID NO: 393834 - DNA, 25 bp, Mus musculus
ttgatgagtggtacatatgacaatg

SEQ ID NO: 393835 - DNA, 25 bp, Mus musculus
ttgatgagtggtacgacatgacaat

SEQ ID NO: 393836 - DNA, 25 bp, Mus musculus
ttgatgagttcattgcaattcttgg

SEQ ID NO: 393837 - DNA, 25 bp, Mus musculus
ttgatgatacttatgaccacggctc

SEQ ID NO: 393838 - DNA, 25 bp, Mus musculus
ttgatgatctattggatgatacatg

SEQ ID NO: 393839 - DNA, 25 bp, Mus musculus
ttgatgatctggaagagactttggc

SEQ ID NO: 393840 - DNA, 25 bp, Mus musculus
ttgatgatctggaagatgaagtcta

SEQ ID NO: 393841 - DNA, 25 bp, Mus musculus
ttgatgatcttgagtctgcaactgt

SEQ ID NO: 393842 - DNA, 25 bp, Mus musculus
ttgatgatgtgcctgatgacattat

SEQ ID NO: 393843 - DNA, 25 bp, Mus musculus
ttgatgcaaggactcgtggggaaaa

SEQ ID NO: 393844 - DNA, 25 bp, Mus musculus
ttgatgcaaggctttcctttgataa

SEQ ID NO: 393845 - DNA, 25 bp, Mus musculus
ttgatgcaagggagctggaggaaca

SEQ ID NO: 393846 - DNA, 25 bp, Mus musculus
ttgatgcagacttccacagcacagc

SEQ ID NO: 393847 - DNA, 25 bp, Mus musculus
ttgatgcagacttccgggtctgaca

SEQ ID NO: 393848 - DNA, 25 bp, Mus musculus
ttgatgcagctatgaaggggctggc

SEQ ID NO: 393849 - DNA, 25 bp, Mus musculus
ttgatgcatcattgtcgctgcccag

SEQ ID NO: 393850 - DNA, 25 bp, Mus musculus
ttgatgcccaaggcaacttaagggc

SEQ ID NO: 393851 - DNA, 25 bp, Mus musculus
ttgatgcgtgcagggcgacagtgga

SEQ ID NO: 393852 - DNA, 25 bp, Mus musculus
ttgatgcgtgccagggcgacagtgg

SEQ ID NO: 393853 - DNA, 25 bp, Mus musculus
ttgatgctagagaggaggtggctga

SEQ ID NO: 393854 - DNA, 25 bp, Mus musculus
ttgatgctagagcctcagtctgaaa

SEQ ID NO: 393855 - DNA, 25 bp, Mus musculus
ttgatgctgaccagatcgtgagaca

SEQ ID NO: 393856 - DNA, 25 bp, Mus musculus
ttgatgctgaccaggatcttcccaa

SEQ ID NO: 393857 - DNA, 25 bp, Mus musculus
ttgatgctgtgcaaagtgcacaccg

SEQ ID NO: 393858 - DNA, 25 bp, Mus musculus
ttgatgctgtggacaaggtctcttt

SEQ ID NO: 393859 - DNA, 25 bp, Mus musculus
ttgatgctgtggactgtgtttgaag

SEQ ID NO: 393860 - DNA, 25 bp, Mus musculus
ttgatgcttttcctggagagcctga

SEQ ID NO: 393861 - DNA, 25 bp, Mus musculus
ttgatggaaaagggttcctttgatt

SEQ ID NO: 393862 - DNA, 25 bp, Mus musculus
ttgatggaaagaaaattgcccagga

SEQ ID NO: 393863 - DNA, 25 bp, Mus musculus
ttgatggaaaggagttctggcaggt

SEQ ID NO: 393864 - DNA, 25 bp, Mus musculus
ttgatggaaagggtccaattggttc

SEQ ID NO: 393865 - DNA, 25 bp, Mus musculus
ttgatggagtctctggagcagcgtg

SEQ ID NO: 393866 - DNA, 25 bp, Mus musculus
ttgatggagtgaagtgcctcagagc

SEQ ID NO: 393867 - DNA, 25 bp, Mus musculus
ttgatggatatagacaacagaaagc

SEQ ID NO: 393868 - DNA, 25 bp, Mus musculus
ttgatggcaagatcttctgtgtgca

SEQ ID NO: 393869 - DNA, 25 bp, Mus musculus
ttgatggcaagggtcatgtgggtac

SEQ ID NO: 393870 - DNA, 25 bp, Mus musculus
ttgatggcaaggtgctgtctgaaac

SEQ ID NO: 393871 - DNA, 25 bp, Mus musculus
ttgatggcaagtatgtctatatagc

SEQ ID NO: 393872 - DNA, 25 bp, Mus musculus
ttgatggctacagggtttatttggt

SEQ ID NO: 393873 - DNA, 25 bp, Mus musculus
ttgatgggaagaaccagcaagagac

SEQ ID NO: 393874 - DNA, 25 bp, Mus musculus
ttgatggtgacggggatcgaaacat

SEQ ID NO: 393875 - DNA, 25 bp, Mus musculus
ttgatggtgagaagggagaggctgg

SEQ ID NO: 393876 - DNA, 25 bp, Mus musculus
ttgatgtacttcaggccacagactt

SEQ ID NO: 393877 - DNA, 25 bp, Mus musculus
ttgatgtcacgaagccagcgatctc

SEQ ID NO: 393878 - DNA, 25 bp, Mus musculus
ttgatgtcacgccgcataactcatc

SEQ ID NO: 393879 - DNA, 25 bp, Mus musculus
ttgatgtcacggtctattacaatgg

SEQ ID NO: 393880 - DNA, 25 bp, Mus musculus
ttgatgtcatccaggaggtggagta

SEQ ID NO: 393881 - DNA, 25 bp, Mus musculus
ttgatgtccgagaggtcattgctag

SEQ ID NO: 393882 - DNA, 25 bp, Mus musculus
ttgatgtcctgggtcatggtagtat

SEQ ID NO: 393883 - DNA, 25 bp, Mus musculus
ttgatgtctgacgaggtgttccacg

SEQ ID NO: 393884 - DNA, 25 bp, Mus musculus
ttgatgtctggaagccatgactgtt

SEQ ID NO: 393885 - DNA, 25 bp, Mus musculus
ttgatgtgcatgtgtgggcatattc

SEQ ID NO: 393886 - DNA, 25 bp, Mus musculus
ttgatgtgccaagtaatgtatattt

SEQ ID NO: 393887 - DNA, 25 bp, Mus musculus
ttgatgtggcctgcccagagtgacc

SEQ ID NO: 393888 - DNA, 25 bp, Mus musculus
ttgatgttatcaagaaaaagaataa

SEQ ID NO: 393889 - DNA, 25 bp, Mus musculus
ttgatgttctttatagacagacgcc

SEQ ID NO: 393890 - DNA, 25 bp, Mus musculus
ttgatgttctttatagtgaggctat

SEQ ID NO: 393891 - DNA, 25 bp, Mus musculus
ttgattacaggtacagcgcagcaga

SEQ ID NO: 393892 - DNA, 25 bp, Mus musculus
ttgattcaaaaggatggccaggctt

SEQ ID NO: 393893 - DNA, 25 bp, Mus musculus
ttgattcaacagatgtctttcaaca

SEQ ID NO: 393894 - DNA, 25 bp, Mus musculus
ttgattcaacaggcaatcgagatta

SEQ ID NO: 393895 - DNA, 25 bp, Mus musculus
ttgattcactgaaaggtcgttgctc

SEQ ID NO: 393896 - DNA, 25 bp, Mus musculus
ttgattcactgagctcctgcaaaaa

SEQ ID NO: 393897 - DNA, 25 bp, Mus musculus
ttgattccaaggagattgccctcta

SEQ ID NO: 393898 - DNA, 25 bp, Mus musculus
ttgattccaaggagccagaaatcat

SEQ ID NO: 393899 - DNA, 25 bp, Mus musculus
ttgattccagccataatcgcatgaa

SEQ ID NO: 393900 - DNA, 25 bp, Mus musculus
ttgattccagctactcccgaaacca

SEQ ID NO: 393901 - DNA, 25 bp, Mus musculus
ttgattcgagcacatgtaatagcgc

SEQ ID NO: 393902 - DNA, 25 bp, Mus musculus
ttgattcgagcacatgtttaggtaa

SEQ ID NO: 393903 - DNA, 25 bp, Mus musculus
ttgattctaaactaggtcatgtggt

SEQ ID NO: 393904 - DNA, 25 bp, Mus musculus
ttgattctactgaggtgtaaactct

SEQ ID NO: 393905 - DNA, 25 bp, Mus musculus
ttgattgaggactctcaaagaagga

SEQ ID NO: 393906 - DNA, 25 bp, Mus musculus
ttgattgaggggtctcactctaacc

SEQ ID NO: 393907 - DNA, 25 bp, Mus musculus
ttgattgccagaggcatgaatccta

SEQ ID NO: 393908 - DNA, 25 bp, Mus musculus
ttgattgctaagatcccaccaaata

SEQ ID NO: 393909 - DNA, 25 bp, Mus musculus
ttgattgctaaggttgagggcaaag

SEQ ID NO: 393910 - DNA, 25 bp, Mus musculus
ttgattgctgcagtgtgaaaaactc

SEQ ID NO: 393911 - DNA, 25 bp, Mus musculus
ttgattgtagagatcagctcgaacg

SEQ ID NO: 393912 - DNA, 25 bp, Mus musculus
ttgattgtagagttcaggatggctt

SEQ ID NO: 393913 - DNA, 25 bp, Mus musculus
ttgattgttgaagatataattgaca

SEQ ID NO: 393914 - DNA, 25 bp, Mus musculus
ttgatttagacttggagatcccttc

SEQ ID NO: 393915 - DNA, 25 bp, Mus musculus
ttgatttcttcaagcacaagtatca

SEQ ID NO: 393916 - DNA, 25 bp, Mus musculus
ttgatttcttcaaggccaagaagat

SEQ ID NO: 393917 - DNA, 25 bp, Mus musculus
ttgatttcttgacaggcatcctcgt

SEQ ID NO: 393918 - DNA, 25 bp, Mus musculus
ttgatttgaaggagccaagcaataa

SEQ ID NO: 393919 - DNA, 25 bp, Mus musculus
ttgatttgagggatggagagtcagg

SEQ ID NO: 393920 - DNA, 25 bp, Mus musculus
ttgatttggggttcccagcagtggc

SEQ ID NO: 393921 - DNA, 25 bp, Mus musculus
ttgatttgtcccatggccttctttc

SEQ ID NO: 393922 - DNA, 25 bp, Mus musculus
ttgattttcaggcagaaatttaata

SEQ ID NO: 393923 - DNA, 25 bp, Mus musculus
ttgattttcaggggctccaacacca

SEQ ID NO: 393924 - DNA, 25 bp, Mus musculus
ttgattttcggcaaggatgagcccc

SEQ ID NO: 393925 - DNA, 25 bp, Mus musculus
ttgattttcggcaagggcgtctact

SEQ ID NO: 393926 - DNA, 25 bp, Mus musculus
ttgatttttacatggacttgacatc

SEQ ID NO: 393927 - DNA, 25 bp, Mus musculus
ttgatttttcggaagacagcgtgga

SEQ ID NO: 393928 - DNA, 25 bp, Mus musculus
ttgcaaaaagacacacctgcaaaga

SEQ ID NO: 393929 - DNA, 25 bp, Mus musculus
ttgcaaaaagaggtctccaaggtca

SEQ ID NO: 393930 - DNA, 25 bp, Mus musculus
ttgcaaaatgaaaagatgaaaactt

SEQ ID NO: 393931 - DNA, 25 bp, Mus musculus
ttgcaaacaggatgtctctccattc

SEQ ID NO: 393932 - DNA, 25 bp, Mus musculus
ttgcaaacccttgtgaactgaagaa

SEQ ID NO: 393933 - DNA, 25 bp, Mus musculus
ttgcaaagacgtgtgcaagaactat

SEQ ID NO: 393934 - DNA, 25 bp, Mus musculus
ttgcaaagagtgagttggcttcagc

SEQ ID NO: 393935 - DNA, 25 bp, Mus musculus
ttgcaaagcagcaaataaccacatt

SEQ ID NO: 393936 - DNA, 25 bp, Mus musculus
ttgcaaagcagcaatcccatatgac

SEQ ID NO: 393937 - DNA, 25 bp, Mus musculus
ttgcaaagcgtctggcagcagaaga

SEQ ID NO: 393938 - DNA, 25 bp, Mus musculus
ttgcaaagcttcagtggttctctgc

SEQ ID NO: 393939 - DNA, 25 bp, Mus musculus
ttgcaaagcttctgtggttctctgc

SEQ ID NO: 393940 - DNA, 25 bp, Mus musculus
ttgcaaaggcctaacatttggaagg

SEQ ID NO: 393941 - DNA, 25 bp, Mus musculus
ttgcaaaggcctaacctccaaaagt

SEQ ID NO: 393942 - DNA, 25 bp, Mus musculus
ttgcaaagtaaaaacaaatataaag

SEQ ID NO: 393943 - DNA, 25 bp, Mus musculus
ttgcaaagtgcaatacgaggattct

SEQ ID NO: 393944 - DNA, 25 bp, Mus musculus
ttgcaaagtgccacagttgaggcta

SEQ ID NO: 393945 - DNA, 25 bp, Mus musculus
ttgcaaataccggtcaactattcct

SEQ ID NO: 393946 - DNA, 25 bp, Mus musculus
ttgcaaatgctgaaaaaggagtgaa

SEQ ID NO: 393947 - DNA, 25 bp, Mus musculus
ttgcaaatgctgagtgaattatatg

SEQ ID NO: 393948 - DNA, 25 bp, Mus musculus
ttgcaaatgctggaactgcagcagt

SEQ ID NO: 393949 - DNA, 25 bp, Mus musculus
ttgcaaatgtcccaggccgctagtc

SEQ ID NO: 393950 - DNA, 25 bp, Mus musculus
ttgcaaattagtttcgtggttttct

SEQ ID NO: 393951 - DNA, 25 bp, Mus musculus
ttgcaaatttgatgcattcttcagt

SEQ ID NO: 393952 - DNA, 25 bp, Mus musculus
ttgcaacaagaaggtgacactggcc

SEQ ID NO: 393953 - DNA, 25 bp, Mus musculus
ttgcaacacgccctgaaccgcttgg

SEQ ID NO: 393954 - DNA, 25 bp, Mus musculus
ttgcaacccccggagtttcaagcca

SEQ ID NO: 393955 - DNA, 25 bp, Mus musculus
ttgcaaccctggaccctgtcctgct

SEQ ID NO: 393956 - DNA, 25 bp, Mus musculus
ttgcaacctcttggaaaggtatgct

SEQ ID NO: 393957 - DNA, 25 bp, Mus musculus
ttgcaactccttatgaagtggcagt

SEQ ID NO: 393958 - DNA, 25 bp, Mus musculus
ttgcaactttgcggagatgatgatg

SEQ ID NO: 393959 - DNA, 25 bp, Mus musculus
ttgcaactttgcgggtgagatggat

SEQ ID NO: 393960 - DNA, 25 bp, Mus musculus
ttgcaagaagaacatccagagtctg

SEQ ID NO: 393961 - DNA, 25 bp, Mus musculus
ttgcaagaaggggaccagctgctga

SEQ ID NO: 393962 - DNA, 25 bp, Mus musculus
ttgcaagaattgagagacatctcct

SEQ ID NO: 393963 - DNA, 25 bp, Mus musculus
ttgcaagagcaaaatgtttcaaatg

SEQ ID NO: 393964 - DNA, 25 bp, Mus musculus
ttgcaagaggcacaggctcgaagca

SEQ ID NO: 393965 - DNA, 25 bp, Mus musculus
ttgcaagatgaggagcctcagagac

SEQ ID NO: 393966 - DNA, 25 bp, Mus musculus
ttgcaagatgaggcagagaaggttg

SEQ ID NO: 393967 - DNA, 25 bp, Mus musculus
ttgcaagatgcaggccccttcccag

SEQ ID NO: 393968 - DNA, 25 bp, Mus musculus
ttgcaagcaaggggaagggaggagc

SEQ ID NO: 393969 - DNA, 25 bp, Mus musculus
ttgcaagcctcaagacgaaagtagg

SEQ ID NO: 393970 - DNA, 25 bp, Mus musculus
ttgcaaggaagtgggaggcagttct

SEQ ID NO: 393971 - DNA, 25 bp, Mus musculus
ttgcaaggaagtggtataatggccg

SEQ ID NO: 393972 - DNA, 25 bp, Mus musculus
ttgcaagggcaagggttcttggccc

SEQ ID NO: 393973 - DNA, 25 bp, Mus musculus
ttgcaagtcaggccgtctactgtgt

SEQ ID NO: 393974 - DNA, 25 bp, Mus musculus
ttgcaagtcatgtcattgtgcttct

SEQ ID NO: 393975 - DNA, 25 bp, Mus musculus
ttgcaatattaaagtaccaaccaaa

SEQ ID NO: 393976 - DNA, 25 bp, Mus musculus
ttgcaattacccacggtctgaaaaa

SEQ ID NO: 393977 - DNA, 25 bp, Mus musculus
ttgcaattacgtttctactgcactt

SEQ ID NO: 393978 - DNA, 25 bp, Mus musculus
ttgcaattccatggctgcagaagag

SEQ ID NO: 393979 - DNA, 25 bp, Mus musculus
ttgcaattccatggtactctttgat

SEQ ID NO: 393980 - DNA, 25 bp, Mus musculus
ttgcaattggaaagacagtgatgtg

SEQ ID NO: 393981 - DNA, 25 bp, Mus musculus
ttgcaattggaaaggtatctggcca

SEQ ID NO: 393982 - DNA, 25 bp, Mus musculus
ttgcaatttggaagggaggtcctgg

SEQ ID NO: 393983 - DNA, 25 bp, Mus musculus
ttgcacaaacaggagagcaaccttc

SEQ ID NO: 393984 - DNA, 25 bp, Mus musculus
ttgcacaaacgggagagcaaccttc

SEQ ID NO: 393985 - DNA, 25 bp, Mus musculus
ttgcacaaagaaagcaactgggaca

SEQ ID NO: 393986 - DNA, 25 bp, Mus musculus
ttgcacaaatcaaggcatgctgtga

SEQ ID NO: 393987 - DNA, 25 bp, Mus musculus
ttgcacaaatcaaggtgacaaaaga

SEQ ID NO: 393988 - DNA, 25 bp, Mus musculus
ttgcacaaggcatgtgaagccagtg

SEQ ID NO: 393989 - DNA, 25 bp, Mus musculus
ttgcacacagacacaagatggaata

SEQ ID NO: 393990 - DNA, 25 bp, Mus musculus
ttgcacacagaggaaagaaaataca

SEQ ID NO: 393991 - DNA, 25 bp, Mus musculus
ttgcacacagatggagtggccggac

SEQ ID NO: 393992 - DNA, 25 bp, Mus musculus
ttgcacacagttttggtttctcccc

SEQ ID NO: 393993 - DNA, 25 bp, Mus musculus
ttgcacagcactgccagggggaagg

SEQ ID NO: 393994 - DNA, 25 bp, Mus musculus
ttgcacaggggatgatgagacagaa

SEQ ID NO: 393995 - DNA, 25 bp, Mus musculus
ttgcacatgataggctatgatagaa

SEQ ID NO: 393996 - DNA, 25 bp, Mus musculus
ttgcacatggagaggaaactgtcag

SEQ ID NO: 393997 - DNA, 25 bp, Mus musculus
ttgcacattcagaaacgcatcccac

SEQ ID NO: 393998 - DNA, 25 bp, Mus musculus
ttgcacatttgaagacatgctccag

SEQ ID NO: 393999 - DNA, 25 bp, Mus musculus
ttgcaccaacgccagaaggaagagg

SEQ ID NO: 394000 - DNA, 25 bp, Mus musculus
ttgcaccactgctgcgcaaggtata

SEQ ID NO: 394001 - DNA, 25 bp, Mus musculus
ttgcaccagacaagatgatagtagc

SEQ ID NO: 394002 - DNA, 25 bp, Mus musculus
ttgcaccagtctctcaccatgtcca

SEQ ID NO: 394003 - DNA, 25 bp, Mus musculus
ttgcaccatccagagagatgccaaa

SEQ ID NO: 394004 - DNA, 25 bp, Mus musculus
ttgcacccctactctttctgacctg

SEQ ID NO: 394005 - DNA, 25 bp, Mus musculus
ttgcacctaaagcatgcgaggtcct

SEQ ID NO: 394006 - DNA, 25 bp, Mus musculus
ttgcacctaaagcatgtttctctag

SEQ ID NO: 394007 - DNA, 25 bp, Mus musculus
ttgcacctatagatggcattcgctc

SEQ ID NO: 394008 - DNA, 25 bp, Mus musculus
ttgcacctatagtgtctataatata

SEQ ID NO: 394009 - DNA, 25 bp, Mus musculus
ttgcacctgcggacggcatcgctgt

SEQ ID NO: 394010 - DNA, 25 bp, Mus musculus
ttgcacctgcggctctatcagaact

SEQ ID NO: 394011 - DNA, 25 bp, Mus musculus
ttgcacctgcgggtcagattatcgc

SEQ ID NO: 394012 - DNA, 25 bp, Mus musculus
ttgcacctgtccaggcgtttctttt

SEQ ID NO: 394013 - DNA, 25 bp, Mus musculus
ttgcacgaaatgaggacaagctact

SEQ ID NO: 394014 - DNA, 25 bp, Mus musculus
ttgcacgcacaggaaatcccaatgg

SEQ ID NO: 394015 - DNA, 25 bp, Mus musculus
ttgcacggcagattacaaaagaaga

SEQ ID NO: 394016 - DNA, 25 bp, Mus musculus
ttgcactcagcccccactgtagacc

SEQ ID NO: 394017 - DNA, 25 bp, Mus musculus
ttgcactcagcgtacatgttgtgac

SEQ ID NO: 394018 - DNA, 25 bp, Mus musculus
ttgcactgagcgggaactgagccgt

SEQ ID NO: 394019 - DNA, 25 bp, Mus musculus
ttgcactgtgtgaccagcccatcaa

SEQ ID NO: 394020 - DNA, 25 bp, Mus musculus
ttgcacttccagatctctgacatct

SEQ ID NO: 394021 - DNA, 25 bp, Mus musculus
ttgcagaaacagacatggcaagtgt

SEQ ID NO: 394022 - DNA, 25 bp, Mus musculus
ttgcagaaagcaggccgtctactgt

SEQ ID NO: 394023 - DNA, 25 bp, Mus musculus
ttgcagaaagcagggctgactgtga

SEQ ID NO: 394024 - DNA, 25 bp, Mus musculus
ttgcagaagacagtgcatttgcagg

SEQ ID NO: 394025 - DNA, 25 bp, Mus musculus
ttgcagaagacagtgctcttactgg

SEQ ID NO: 394026 - DNA, 25 bp, Mus musculus
ttgcagaagcaagatcccaaaagga

SEQ ID NO: 394027 - DNA, 25 bp, Mus musculus
ttgcagaagcaagtgttttgcctgt

SEQ ID NO: 394028 - DNA, 25 bp, Mus musculus
ttgcagaaggcaatgaaggaaacca

SEQ ID NO: 394029 - DNA, 25 bp, Mus musculus
ttgcagaaggcaatggaatgatctc

SEQ ID NO: 394030 - DNA, 25 bp, Mus musculus
ttgcagacctgggactggctgtgat

SEQ ID NO: 394031 - DNA, 25 bp, Mus musculus
ttgcagacggccatggaaccacaaa

SEQ ID NO: 394032 - DNA, 25 bp, Mus musculus
ttgcagactgcggtgaggggagccg

SEQ ID NO: 394033 - DNA, 25 bp, Mus musculus
ttgcagacttcccagctctcttctc

SEQ ID NO: 394034 - DNA, 25 bp, Mus musculus
ttgcagacttcccagggctatacat

SEQ ID NO: 394035 - DNA, 25 bp, Mus musculus
ttgcagagacattttgagcagcacc

SEQ ID NO: 394036 - DNA, 25 bp, Mus musculus
ttgcagagatcgggttctgcgggga

SEQ ID NO: 394037 - DNA, 25 bp, Mus musculus
ttgcagagcatggtctagtctcctg

SEQ ID NO: 394038 - DNA, 25 bp, Mus musculus
ttgcagatcagacccagcatgtgca

SEQ ID NO: 394039 - DNA, 25 bp, Mus musculus
ttgcagatctgataaaaagagcaag

SEQ ID NO: 394040 - DNA, 25 bp, Mus musculus
ttgcagatgatgggagaattctgtg

SEQ ID NO: 394041 - DNA, 25 bp, Mus musculus
ttgcagatgatgggtgcagtttgag

SEQ ID NO: 394042 - DNA, 25 bp, Mus musculus
ttgcagatgccgacttggacattgc

SEQ ID NO: 394043 - DNA, 25 bp, Mus musculus
ttgcagatggaaagatgacatcgtt

SEQ ID NO: 394044 - DNA, 25 bp, Mus musculus
ttgcagattcaaagttcacagtcag

SEQ ID NO: 394045 - DNA, 25 bp, Mus musculus
ttgcagattcaaatgaccagcagtt

SEQ ID NO: 394046 - DNA, 25 bp, Mus musculus
ttgcagcaacaatagaattttcatt

SEQ ID NO: 394047 - DNA, 25 bp, Mus musculus
ttgcagcaacaataggtgttgactt

SEQ ID NO: 394048 - DNA, 25 bp, Mus musculus
ttgcagcagcattagattgtcttcg

SEQ ID NO: 394049 - DNA, 25 bp, Mus musculus
ttgcagcagccggaggggcacacaa

SEQ ID NO: 394050 - DNA, 25 bp, Mus musculus
ttgcagcagccggaggtgtgtttca

SEQ ID NO: 394051 - DNA, 25 bp, Mus musculus
ttgcagcagccggagtttgaagagg

SEQ ID NO: 394052 - DNA, 25 bp, Mus musculus
ttgcagcaggtctgctttgccttga

SEQ ID NO: 394053 - DNA, 25 bp, Mus musculus
ttgcagcatgagttcaaagaagctt

SEQ ID NO: 394054 - DNA, 25 bp, Mus musculus
ttgcagcatggctgaccaactgact

SEQ ID NO: 394055 - DNA, 25 bp, Mus musculus
ttgcagccaaggccacagaggatca

SEQ ID NO: 394056 - DNA, 25 bp, Mus musculus
ttgcagccaagtccctgccgccttc

SEQ ID NO: 394057 - DNA, 25 bp, Mus musculus
ttgcagccaagtggaccattgacct

SEQ ID NO: 394058 - DNA, 25 bp, Mus musculus
ttgcagccaagtggaccccacagag

SEQ ID NO: 394059 - DNA, 25 bp, Mus musculus
ttgcagccaccagaggatgacagag

SEQ ID NO: 394060 - DNA, 25 bp, Mus musculus
ttgcagccactgggttgccaagaag

SEQ ID NO: 394061 - DNA, 25 bp, Mus musculus
ttgcagcgattcaagaatttgcatc

SEQ ID NO: 394062 - DNA, 25 bp, Mus musculus
ttgcagcgattcaagagtgcactct

SEQ ID NO: 394063 - DNA, 25 bp, Mus musculus
ttgcagcgctcacgggaaccagtga

SEQ ID NO: 394064 - DNA, 25 bp, Mus musculus
ttgcagctacgccaggcacaaatat

SEQ ID NO: 394065 - DNA, 25 bp, Mus musculus
ttgcagctatgtcaaagataagtgt

SEQ ID NO: 394066 - DNA, 25 bp, Mus musculus
ttgcagctggtggaggcatggctgg

SEQ ID NO: 394067 - DNA, 25 bp, Mus musculus
ttgcagctgtctagcccatgccatt

SEQ ID NO: 394068 - DNA, 25 bp, Mus musculus
ttgcagcttcatgagtttaaattcc

SEQ ID NO: 394069 - DNA, 25 bp, Mus musculus
ttgcaggaaaagagttcctggtctg

SEQ ID NO: 394070 - DNA, 25 bp, Mus musculus
ttgcaggaaactggagtgtgggttc

SEQ ID NO: 394071 - DNA, 25 bp, Mus musculus
ttgcaggaagcacgggggtaccatt

SEQ ID NO: 394072 - DNA, 25 bp, Mus musculus
ttgcaggaagcacgggtggctgcaa

SEQ ID NO: 394073 - DNA, 25 bp, Mus musculus
ttgcaggaccacagaactacagctg

SEQ ID NO: 394074 - DNA, 25 bp, Mus musculus
ttgcaggaccacagttatatatctt

SEQ ID NO: 394075 - DNA, 25 bp, Mus musculus
ttgcaggatgagtgggatgcagtca

SEQ ID NO: 394076 - DNA, 25 bp, Mus musculus
ttgcaggatgagtggggttggccga

SEQ ID NO: 394077 - DNA, 25 bp, Mus musculus
ttgcaggcctggagataaagttcct

SEQ ID NO: 394078 - DNA, 25 bp, Mus musculus
ttgcaggctcacgctctcaccactg

SEQ ID NO: 394079 - DNA, 25 bp, Mus musculus
ttgcaggctcaggactggaggaccg

SEQ ID NO: 394080 - DNA, 25 bp, Mus musculus
ttgcagggcttaccaggtgtccctg

SEQ ID NO: 394081 - DNA, 25 bp, Mus musculus
ttgcaggtgacagacacatctggtc

SEQ ID NO: 394082 - DNA, 25 bp, Mus musculus
ttgcaggtgacaggttgctttgaag

SEQ ID NO: 394083 - DNA, 25 bp, Mus musculus
ttgcaggtggtcaggacaggtacag

SEQ ID NO: 394084 - DNA, 25 bp, Mus musculus
ttgcaggtggtcaggcctataccat

SEQ ID NO: 394085 - DNA, 25 bp, Mus musculus
ttgcaggtggtcagttgaccaagct

SEQ ID NO: 394086 - DNA, 25 bp, Mus musculus
ttgcagtaagcagcttaacaggagc

SEQ ID NO: 394087 - DNA, 25 bp, Mus musculus
ttgcagtcaagtgccgtgcagctgg

SEQ ID NO: 394088 - DNA, 25 bp, Mus musculus
ttgcagtctatgctggaaacagctt

SEQ ID NO: 394089 - DNA, 25 bp, Mus musculus
ttgcagtctatggactggaaacgga

SEQ ID NO: 394090 - DNA, 25 bp, Mus musculus
ttgcagtcttctggcagctcagagg

SEQ ID NO: 394091 - DNA, 25 bp, Mus musculus
ttgcagtggtgatgctgtcatcaag

SEQ ID NO: 394092 - DNA, 25 bp, Mus musculus
ttgcagttacgtaggtctggtcagc

SEQ ID NO: 394093 - DNA, 25 bp, Mus musculus
ttgcagttcaggtttgctgtcttat

SEQ ID NO: 394094 - DNA, 25 bp, Mus musculus
ttgcagttctcaggaggggtcatct

SEQ ID NO: 394095 - DNA, 25 bp, Mus musculus
ttgcagtttgggatgaatgccagct

SEQ ID NO: 394096 - DNA, 25 bp, Mus musculus
ttgcataatccagccctctaataaa

SEQ ID NO: 394097 - DNA, 25 bp, Mus musculus
ttgcatatcagatctgatgttttga

SEQ ID NO: 394098 - DNA, 25 bp, Mus musculus
ttgcatatctgagattcagtttgct

SEQ ID NO: 394099 - DNA, 25 bp, Mus musculus
ttgcatatgtacaggcagaccgaag

SEQ ID NO: 394100 - DNA, 25 bp, Mus musculus
ttgcatatgtacagtcccagaagta

SEQ ID NO: 394101 - DNA, 25 bp, Mus musculus
ttgcatatgttcaatttgaggatgt

SEQ ID NO: 394102 - DNA, 25 bp, Mus musculus
ttgcatattttgtgagttcaaaatt

SEQ ID NO: 394103 - DNA, 25 bp, Mus musculus
ttgcatcacaccagatgctgccagc

SEQ ID NO: 394104 - DNA, 25 bp, Mus musculus
ttgcatcacaccagggagcaggatc

SEQ ID NO: 394105 - DNA, 25 bp, Mus musculus
ttgcatcactgttgctcacctttca

SEQ ID NO: 394106 - DNA, 25 bp, Mus musculus
ttgcatcagacagggcaacgtttca

SEQ ID NO: 394107 - DNA, 25 bp, Mus musculus
ttgcatcagtggatcgatatcaaca

SEQ ID NO: 394108 - DNA, 25 bp, Mus musculus
ttgcatccagggatgcaggcagcct

SEQ ID NO: 394109 - DNA, 25 bp, Mus musculus
ttgcatccagggatgttaattttac

SEQ ID NO: 394110 - DNA, 25 bp, Mus musculus
ttgcatccagtgatgtggccgtgga

SEQ ID NO: 394111 - DNA, 25 bp, Mus musculus
ttgcatcgggattctgtaacagcaa

SEQ ID NO: 394112 - DNA, 25 bp, Mus musculus
ttgcatcggggtcagtggataaatc

SEQ ID NO: 394113 - DNA, 25 bp, Mus musculus
ttgcatctagtttgactaccaaagg

SEQ ID NO: 394114 - DNA, 25 bp, Mus musculus
ttgcatcttggctggtggctaccaa

SEQ ID NO: 394115 - DNA, 25 bp, Mus musculus
ttgcatctttatggaaagagtatgg

SEQ ID NO: 394116 - DNA, 25 bp, Mus musculus
ttgcatgaagacaaatcagagcgag

SEQ ID NO: 394117 - DNA, 25 bp, Mus musculus
ttgcatgaagttgcaagaagacacc

SEQ ID NO: 394118 - DNA, 25 bp, Mus musculus
ttgcatgaagttgccagaaggagaa

SEQ ID NO: 394119 - DNA, 25 bp, Mus musculus
ttgcatgagtggtgtgacggctgtg

SEQ ID NO: 394120 - DNA, 25 bp, Mus musculus
ttgcatgatcttgctattgaagtgg

SEQ ID NO: 394121 - DNA, 25 bp, Mus musculus
ttgcatgcaaggcttgttccccctg

SEQ ID NO: 394122 - DNA, 25 bp, Mus musculus
ttgcatgcaaggtacagaagaaaga

SEQ ID NO: 394123 - DNA, 25 bp, Mus musculus
ttgcatgcacatgtctcgaattatc

SEQ ID NO: 394124 - DNA, 25 bp, Mus musculus
ttgcatgcctgggccctggcccagc

SEQ ID NO: 394125 - DNA, 25 bp, Mus musculus
ttgcatgctaatagaagtagtcccc

SEQ ID NO: 394126 - DNA, 25 bp, Mus musculus
ttgcatgctaataggccaggtggtt

SEQ ID NO: 394127 - DNA, 25 bp, Mus musculus
ttgcatgctaatagggaagaccggg

SEQ ID NO: 394128 - DNA, 25 bp, Mus musculus
ttgcatgctaggagatgtacgacta

SEQ ID NO: 394129 - DNA, 25 bp, Mus musculus
ttgcatgctttagagtgatgatgac

SEQ ID NO: 394130 - DNA, 25 bp, Mus musculus
ttgcatggaaacaggtttaatcttg

SEQ ID NO: 394131 - DNA, 25 bp, Mus musculus
ttgcatggaaacagtcaccaaggag

SEQ ID NO: 394132 - DNA, 25 bp, Mus musculus
ttgcatggatatgaggtccagagat

SEQ ID NO: 394133 - DNA, 25 bp, Mus musculus
ttgcatgtttcaggtggtttgttga

SEQ ID NO: 394134 - DNA, 25 bp, Mus musculus
ttgcattcacagacacggctaagga

SEQ ID NO: 394135 - DNA, 25 bp, Mus musculus
ttgcattcacagggtacagatttat

SEQ ID NO: 394136 - DNA, 25 bp, Mus musculus
ttgcattccgcttgcttcccagagc

SEQ ID NO: 394137 - DNA, 25 bp, Mus musculus
ttgcattctacaggcggcagaaaca

SEQ ID NO: 394138 - DNA, 25 bp, Mus musculus
ttgcattctcagcatggtgagacac

SEQ ID NO: 394139 - DNA, 25 bp, Mus musculus
ttgcatttaggaggactgacaaacg

SEQ ID NO: 394140 - DNA, 25 bp, Mus musculus
ttgcatttgcaggtcgctatgcatt

SEQ ID NO: 394141 - DNA, 25 bp, Mus musculus
ttgcattttgaggctaagacccttc

SEQ ID NO: 394142 - DNA, 25 bp, Mus musculus
ttgcattttgaggctatcagtgacg

SEQ ID NO: 394143 - DNA, 25 bp, Mus musculus
ttgccaaagaagattcccagcgaca

SEQ ID NO: 394144 - DNA, 25 bp, Mus musculus
ttgccaaagaagctcctatgctgtt

SEQ ID NO: 394145 - DNA, 25 bp, Mus musculus
ttgccaaagaggagatatttggacc

SEQ ID NO: 394146 - DNA, 25 bp, Mus musculus
ttgccaaagcagggctgcaggtgga

SEQ ID NO: 394147 - DNA, 25 bp, Mus musculus
ttgccaaattggctccacttacctg

SEQ ID NO: 394148 - DNA, 25 bp, Mus musculus
ttgccaaccagacgtaccaccagac

SEQ ID NO: 394149 - DNA, 25 bp, Mus musculus
ttgccaacccagtgaactccaccat

SEQ ID NO: 394150 - DNA, 25 bp, Mus musculus
ttgccaactggtgctctgttgccgt

SEQ ID NO: 394151 - DNA, 25 bp, Mus musculus
ttgccaagaacatactaaaagcaat

SEQ ID NO: 394152 - DNA, 25 bp, Mus musculus
ttgccaagaacggtatttgaatatc

SEQ ID NO: 394153 - DNA, 25 bp, Mus musculus
ttgccaagacatactccagtgattt

SEQ ID NO: 394154 - DNA, 25 bp, Mus musculus
ttgccaagaccggacagggtctcat

SEQ ID NO: 394155 - DNA, 25 bp, Mus musculus
ttgccaagaccggggatcccaacaa

SEQ ID NO: 394156 - DNA, 25 bp, Mus musculus
ttgccaagagagtacacggtcatta

SEQ ID NO: 394157 - DNA, 25 bp, Mus musculus
ttgccaagaggaaaatagcttcatg

SEQ ID NO: 394158 - DNA, 25 bp, Mus musculus
ttgccaagatctggtggatcgcact

SEQ ID NO: 394159 - DNA, 25 bp, Mus musculus
ttgccaagatcttgatccagttttt

SEQ ID NO: 394160 - DNA, 25 bp, Mus musculus
ttgccaagcaaggaagcctgctgac

SEQ ID NO: 394161 - DNA, 25 bp, Mus musculus
ttgccaagcagatgaaggggctggc

SEQ ID NO: 394162 - DNA, 25 bp, Mus musculus
ttgccaagcaggtaattaataatgc

SEQ ID NO: 394163 - DNA, 25 bp, Mus musculus
ttgccaagccccctcttgaattttc

SEQ ID NO: 394164 - DNA, 25 bp, Mus musculus
ttgccaagctcaatggctacacgga

SEQ ID NO: 394165 - DNA, 25 bp, Mus musculus
ttgccaaggcaggtgatttggagtt

SEQ ID NO: 394166 - DNA, 25 bp, Mus musculus
ttgccaaggggaacttccccagagc

SEQ ID NO: 394167 - DNA, 25 bp, Mus musculus
ttgccaaggtccacccgactccatc

SEQ ID NO: 394168 - DNA, 25 bp, Mus musculus
ttgccaagtataaaggagaagacaa

SEQ ID NO: 394169 - DNA, 25 bp, Mus musculus
ttgccaataaagttctttgtgatgt

SEQ ID NO: 394170 - DNA, 25 bp, Mus musculus
ttgccaataaatcagagtcctcatt

SEQ ID NO: 394171 - DNA, 25 bp, Mus musculus
ttgccaataatccgtgccggcatag

SEQ ID NO: 394172 - DNA, 25 bp, Mus musculus
ttgccaataatgcagaccagcagtt

SEQ ID NO: 394173 - DNA, 25 bp, Mus musculus
ttgccaatggaggtcctgcaccaga

SEQ ID NO: 394174 - DNA, 25 bp, Mus musculus
ttgccaatggagtggagattgtgga

SEQ ID NO: 394175 - DNA, 25 bp, Mus musculus
ttgccacaacagaaagcctaaaact

SEQ ID NO: 394176 - DNA, 25 bp, Mus musculus
ttgccacacagtgaagatgccatca

SEQ ID NO: 394177 - DNA, 25 bp, Mus musculus
ttgccacaccatataccgaagcaaa

SEQ ID NO: 394178 - DNA, 25 bp, Mus musculus
ttgccacaccatatataaactacac

SEQ ID NO: 394179 - DNA, 25 bp, Mus musculus
ttgccacactgtgaccctaaaacct

SEQ ID NO: 394180 - DNA, 25 bp, Mus musculus
ttgccacacttggaggtgaaatcgc

SEQ ID NO: 394181 - DNA, 25 bp, Mus musculus
ttgccacctcacgaggttcctggac

SEQ ID NO: 394182 - DNA, 25 bp, Mus musculus
ttgccacggagttctggaagaccgc

SEQ ID NO: 394183 - DNA, 25 bp, Mus musculus
ttgccactgctttgcctgtacccca

SEQ ID NO: 394184 - DNA, 25 bp, Mus musculus
ttgccactgtgagcttcaacctggc

SEQ ID NO: 394185 - DNA, 25 bp, Mus musculus
ttgccacttcaggatacatcagaga

SEQ ID NO: 394186 - DNA, 25 bp, Mus musculus
ttgccacttcaggtaaaatatagtt

SEQ ID NO: 394187 - DNA, 25 bp, Mus musculus
ttgccagaaagagaaatgctttgag

SEQ ID NO: 394188 - DNA, 25 bp, Mus musculus
ttgccagaaggaacctgaatgaacc

SEQ ID NO: 394189 - DNA, 25 bp, Mus musculus
ttgccagaatggaccatctgcgacc

SEQ ID NO: 394190 - DNA, 25 bp, Mus musculus
ttgccagaattactgcatctcccct

SEQ ID NO: 394191 - DNA, 25 bp, Mus musculus
ttgccagagaaggaacatggcttcc

SEQ ID NO: 394192 - DNA, 25 bp, Mus musculus
ttgccagcaagagaatccgggctgg

SEQ ID NO: 394193 - DNA, 25 bp, Mus musculus
ttgccagccaacggaggccggctgg

SEQ ID NO: 394194 - DNA, 25 bp, Mus musculus
ttgccagcccaaagaggatctaagc

SEQ ID NO: 394195 - DNA, 25 bp, Mus musculus
ttgccagctccggaactctgtggaa

SEQ ID NO: 394196 - DNA, 25 bp, Mus musculus
ttgccagctccgggcatgggatatc

SEQ ID NO: 394197 - DNA, 25 bp, Mus musculus
ttgccagctggacatcaacgattgc

SEQ ID NO: 394198 - DNA, 25 bp, Mus musculus
ttgccagctggacgccaatgagtgt

SEQ ID NO: 394199 - DNA, 25 bp, Mus musculus
ttgccagcttcctgcttcagtaact

SEQ ID NO: 394200 - DNA, 25 bp, Mus musculus
ttgccaggctccacccgcggtcagc

SEQ ID NO: 394201 - DNA, 25 bp, Mus musculus
ttgccagggagatgccattgggtac

SEQ ID NO: 394202 - DNA, 25 bp, Mus musculus
ttgccagtgactacaaatacaaagt

SEQ ID NO: 394203 - DNA, 25 bp, Mus musculus
ttgccagtgatatacatggagatga

SEQ ID NO: 394204 - DNA, 25 bp, Mus musculus
ttgccagtgtctcaggcggcttgga

SEQ ID NO: 394205 - DNA, 25 bp, Mus musculus
ttgccagttgcaagtattccccttc

SEQ ID NO: 394206 - DNA, 25 bp, Mus musculus
ttgccataaaggtgacaaatggata

SEQ ID NO: 394207 - DNA, 25 bp, Mus musculus
ttgccatcaccaagatgacacttgg

SEQ ID NO: 394208 - DNA, 25 bp, Mus musculus
ttgccatcaccaaggaagatttgga

SEQ ID NO: 394209 - DNA, 25 bp, Mus musculus
ttgccatcaccaaggatcagttcat

SEQ ID NO: 394210 - DNA, 25 bp, Mus musculus
ttgccatcaggtattggcttgcttg

SEQ ID NO: 394211 - DNA, 25 bp, Mus musculus
ttgccatcattgcagctgtgatcac

SEQ ID NO: 394212 - DNA, 25 bp, Mus musculus
ttgccatcattggaaagatctatac

SEQ ID NO: 394213 - DNA, 25 bp, Mus musculus
ttgccatcctcggtttctacttatt

SEQ ID NO: 394214 - DNA, 25 bp, Mus musculus
ttgccatggaatccacagttgatga

SEQ ID NO: 394215 - DNA, 25 bp, Mus musculus
ttgccatggaatccctttcagaaat

SEQ ID NO: 394216 - DNA, 25 bp, Mus musculus
ttgccatggaatccgataaagataa

SEQ ID NO: 394217 - DNA, 25 bp, Mus musculus
ttgcccaacacagagggtgaacagc

SEQ ID NO: 394218 - DNA, 25 bp, Mus musculus
ttgcccaacacagtggggctgtggt

SEQ ID NO: 394219 - DNA, 25 bp, Mus musculus
ttgcccaaggagaatgaccccagac

SEQ ID NO: 394220 - DNA, 25 bp, Mus musculus
ttgcccaaggagttctggcaggtgg

SEQ ID NO: 394221 - DNA, 25 bp, Mus musculus
ttgcccaattctgggacactcactc

SEQ ID NO: 394222 - DNA, 25 bp, Mus musculus
ttgcccacctggctggtttggacaa

SEQ ID NO: 394223 - DNA, 25 bp, Mus musculus
ttgcccacctggtacccaggatatt

SEQ ID NO: 394224 - DNA, 25 bp, Mus musculus
ttgcccagagatggactccagattc

SEQ ID NO: 394225 - DNA, 25 bp, Mus musculus
ttgcccagatcctgtgggccgaagc

SEQ ID NO: 394226 - DNA, 25 bp, Mus musculus
ttgcccatcagcaccagggacccag

SEQ ID NO: 394227 - DNA, 25 bp, Mus musculus
ttgcccatcagcaccctccagcacg

SEQ ID NO: 394228 - DNA, 25 bp, Mus musculus
ttgcccatcagcaccggccccccac

SEQ ID NO: 394229 - DNA, 25 bp, Mus musculus
ttgcccatccttaccctatccagca

SEQ ID NO: 394230 - DNA, 25 bp, Mus musculus
ttgcccatctcaaagaaaaaatggc

SEQ ID NO: 394231 - DNA, 25 bp, Mus musculus
ttgcccatctcagagaggaaactga

SEQ ID NO: 394232 - DNA, 25 bp, Mus musculus
ttgcccattgatttaggtcgctccc

SEQ ID NO: 394233 - DNA, 25 bp, Mus musculus
ttgcccattgtcaggtgcgtgaagc

SEQ ID NO: 394234 - DNA, 25 bp, Mus musculus
ttgccccagtgccagtggcatcaaa

SEQ ID NO: 394235 - DNA, 25 bp, Mus musculus
ttgccccagtgccgtttgattttac

SEQ ID NO: 394236 - DNA, 25 bp, Mus musculus
ttgcccccaaagatcatccagctcc

SEQ ID NO: 394237 - DNA, 25 bp, Mus musculus
ttgcccccaaagctcctgtgccagg

SEQ ID NO: 394238 - DNA, 25 bp, Mus musculus
ttgcccccattcttcctcggtgtgc

SEQ ID NO: 394239 - DNA, 25 bp, Mus musculus
ttgccccccgatctagtgttgacag

SEQ ID NO: 394240 - DNA, 25 bp, Mus musculus
ttgccccctttcatacctgctacta

SEQ ID NO: 394241 - DNA, 25 bp, Mus musculus
ttgccccgagtctccatctttgtcc

SEQ ID NO: 394242 - DNA, 25 bp, Mus musculus
ttgcccctataaaaactccgatgat

SEQ ID NO: 394243 - DNA, 25 bp, Mus musculus
ttgcccctgcaaagataccgaagca

SEQ ID NO: 394244 - DNA, 25 bp, Mus musculus
ttgcccctgcaaaggttttccatct

SEQ ID NO: 394245 - DNA, 25 bp, Mus musculus
ttgcccgcaattgggcagatgcaca

SEQ ID NO: 394246 - DNA, 25 bp, Mus musculus
ttgcccgctggacagttgctgtgcg

SEQ ID NO: 394247 - DNA, 25 bp, Mus musculus
ttgcccggctacatggcatcagtgg

SEQ ID NO: 394248 - DNA, 25 bp, Mus musculus
ttgccctcacgatcaacaaggcagg

SEQ ID NO: 394249 - DNA, 25 bp, Mus musculus
ttgccctcacgcataaaaataagat

SEQ ID NO: 394250 - DNA, 25 bp, Mus musculus
ttgccctcagagcctgtggacattt

SEQ ID NO: 394251 - DNA, 25 bp, Mus musculus
ttgccctcagagggccgggttaaac

SEQ ID NO: 394252 - DNA, 25 bp, Mus musculus
ttgccctcaggcaccgaataaacct

SEQ ID NO: 394253 - DNA, 25 bp, Mus musculus
ttgccctcaggttcattctgaatct

SEQ ID NO: 394254 - DNA, 25 bp, Mus musculus
ttgccctcatttgagaacaagacta

SEQ ID NO: 394255 - DNA, 25 bp, Mus musculus
ttgccctctgagtccaaccaagttt

SEQ ID NO: 394256 - DNA, 25 bp, Mus musculus
ttgccctcttcggggaagaaataga

SEQ ID NO: 394257 - DNA, 25 bp, Mus musculus
ttgccctgagaattcatataaacct

SEQ ID NO: 394258 - DNA, 25 bp, Mus musculus
ttgccctgagagagaattctgtgat

SEQ ID NO: 394259 - DNA, 25 bp, Mus musculus
ttgccctgaggccctttatgctgct

SEQ ID NO: 394260 - DNA, 25 bp, Mus musculus
ttgccctgatgtaggacgaagaatg

SEQ ID NO: 394261 - DNA, 25 bp, Mus musculus
ttgccctgcatcaaggagcttgtgt

SEQ ID NO: 394262 - DNA, 25 bp, Mus musculus
ttgcccttaaggccctggaattccc

SEQ ID NO: 394263 - DNA, 25 bp, Mus musculus
ttgcccttaaggtccctgccctccc

SEQ ID NO: 394264 - DNA, 25 bp, Mus musculus
ttgcccttgactggtacagacttac

SEQ ID NO: 394265 - DNA, 25 bp, Mus musculus
ttgcccttgtccccagcaagtcttc

SEQ ID NO: 394266 - DNA, 25 bp, Mus musculus
ttgccgatcacagggagaacattct

SEQ ID NO: 394267 - DNA, 25 bp, Mus musculus
ttgccgatcagaaccagtttgacac

SEQ ID NO: 394268 - DNA, 25 bp, Mus musculus
ttgccgatcagctatatttctcttg

SEQ ID NO: 394269 - DNA, 25 bp, Mus musculus
ttgccgatgagtctgcaatcctgaa

SEQ ID NO: 394270 - DNA, 25 bp, Mus musculus
ttgccgatgagtctgccaccatttg

SEQ ID NO: 394271 - DNA, 25 bp, Mus musculus
ttgccgatgagtctgcctgccattg

SEQ ID NO: 394272 - DNA, 25 bp, Mus musculus
ttgccgatgccagatgagacatcgt

SEQ ID NO: 394273 - DNA, 25 bp, Mus musculus
ttgccgcaggaacaccccaattcct

SEQ ID NO: 394274 - DNA, 25 bp, Mus musculus
ttgccgcagggggtgctacagaaga

SEQ ID NO: 394275 - DNA, 25 bp, Mus musculus
ttgccgcaggggtcatgttagcggc

SEQ ID NO: 394276 - DNA, 25 bp, Mus musculus
ttgccgcaggggtgatgtttataag

SEQ ID NO: 394277 - DNA, 25 bp, Mus musculus
ttgccgccataggtttatggagccg

SEQ ID NO: 394278 - DNA, 25 bp, Mus musculus
ttgccgcccaggactgctcctgcct

SEQ ID NO: 394279 - DNA, 25 bp, Mus musculus
ttgccgccgtaggaactgacccgag

SEQ ID NO: 394280 - DNA, 25 bp, Mus musculus
ttgccgcctcctccgagcctgaagc

SEQ ID NO: 394281 - DNA, 25 bp, Mus musculus
ttgccgctggcatggacagttctgc

SEQ ID NO: 394282 - DNA, 25 bp, Mus musculus
ttgccggaacgagccatggaccctc

SEQ ID NO: 394283 - DNA, 25 bp, Mus musculus
ttgccggaacgaggcttcatctacc

SEQ ID NO: 394284 - DNA, 25 bp, Mus musculus
ttgccggccagcagtactattactg

SEQ ID NO: 394285 - DNA, 25 bp, Mus musculus
ttgccgggagccaccatgttcaacc

SEQ ID NO: 394286 - DNA, 25 bp, Mus musculus
ttgccgggagctgaccggaagaact

SEQ ID NO: 394287 - DNA, 25 bp, Mus musculus
ttgccgggcgagctggaaaccatgg

SEQ ID NO: 394288 - DNA, 25 bp, Mus musculus
ttgccgggcgaggcctctgagaaca

SEQ ID NO: 394289 - DNA, 25 bp, Mus musculus
ttgccgtacctccaggtgatcaagc

SEQ ID NO: 394290 - DNA, 25 bp, Mus musculus
ttgccgtatggtgacagctggccag

SEQ ID NO: 394291 - DNA, 25 bp, Mus musculus
ttgccgtccggtggagagtacagtg

SEQ ID NO: 394292 - DNA, 25 bp, Mus musculus
ttgccgtgaaagaaaccggctctga

SEQ ID NO: 394293 - DNA, 25 bp, Mus musculus
ttgccgtgaaaggctcagcggctgc

SEQ ID NO: 394294 - DNA, 25 bp, Mus musculus
ttgccgtgcaggcagccagctccaa

SEQ ID NO: 394295 - DNA, 25 bp, Mus musculus
ttgccgttaaacctgaagaatcact

SEQ ID NO: 394296 - DNA, 25 bp, Mus musculus
ttgccgttaaatgtgggaacttcgc

SEQ ID NO: 394297 - DNA, 25 bp, Mus musculus
ttgccgttgcaagatcgatgatgaa

SEQ ID NO: 394298 - DNA, 25 bp, Mus musculus
ttgcctaatttggctgagtatgagt

SEQ ID NO: 394299 - DNA, 25 bp, Mus musculus
ttgcctacaaacctggtctgaagca

SEQ ID NO: 394300 - DNA, 25 bp, Mus musculus
ttgcctacaaacctgtcgacttaaa

SEQ ID NO: 394301 - DNA, 25 bp, Mus musculus
ttgcctacagattgtctgtgattgg

SEQ ID NO: 394302 - DNA, 25 bp, Mus musculus
ttgcctacatgtagctgagacctat

SEQ ID NO: 394303 - DNA, 25 bp, Mus musculus
ttgcctactacagagtgatgctgag

SEQ ID NO: 394304 - DNA, 25 bp, Mus musculus
ttgcctactacagagttggtgaata

SEQ ID NO: 394305 - DNA, 25 bp, Mus musculus
ttgcctagcttctgaagttgtaatg

SEQ ID NO: 394306 - DNA, 25 bp, Mus musculus
ttgcctatatgaggttggcgcatcc

SEQ ID NO: 394307 - DNA, 25 bp, Mus musculus
ttgcctcaagacatttgagggacac

SEQ ID NO: 394308 - DNA, 25 bp, Mus musculus
ttgcctcaaggtcctctgtctctcc

SEQ ID NO: 394309 - DNA, 25 bp, Mus musculus
ttgcctccagatgccttacagcaca

SEQ ID NO: 394310 - DNA, 25 bp, Mus musculus
ttgcctccaggctgaagaaggaccc

SEQ ID NO: 394311 - DNA, 25 bp, Mus musculus
ttgcctccggaggtgtatgcagttg

SEQ ID NO: 394312 - DNA, 25 bp, Mus musculus
ttgcctcggagtttcagcctcaact

SEQ ID NO: 394313 - DNA, 25 bp, Mus musculus
ttgcctcggcgcggatgtggttaga

SEQ ID NO: 394314 - DNA, 25 bp, Mus musculus
ttgcctctgaagcaggcagcacccg

SEQ ID NO: 394315 - DNA, 25 bp, Mus musculus
ttgcctctggacagcggaggctgct

SEQ ID NO: 394316 - DNA, 25 bp, Mus musculus
ttgcctcttatgaaggtctacggct

SEQ ID NO: 394317 - DNA, 25 bp, Mus musculus
ttgcctcttctagtctcaacagatc

SEQ ID NO: 394318 - DNA, 25 bp, Mus musculus
ttgcctgaacaagatgcactcccat

SEQ ID NO: 394319 - DNA, 25 bp, Mus musculus
ttgcctgaacaagctcagccctggg

SEQ ID NO: 394320 - DNA, 25 bp, Mus musculus
ttgcctgaacaaggctcttcctcct

SEQ ID NO: 394321 - DNA, 25 bp, Mus musculus
ttgcctgaatcgcccaagagcctac

SEQ ID NO: 394322 - DNA, 25 bp, Mus musculus
ttgcctgactcgctcggaagctgtc

SEQ ID NO: 394323 - DNA, 25 bp, Mus musculus
ttgcctgagagtgaaataaagaaag

SEQ ID NO: 394324 - DNA, 25 bp, Mus musculus
ttgcctgcactggcacacaggcatt

SEQ ID NO: 394325 - DNA, 25 bp, Mus musculus
ttgcctgcaggaagcaccatggccc

SEQ ID NO: 394326 - DNA, 25 bp, Mus musculus
ttgcctgcagttccgtttcccccag

SEQ ID NO: 394327 - DNA, 25 bp, Mus musculus
ttgcctgcggccaggaggtggctta

SEQ ID NO: 394328 - DNA, 25 bp, Mus musculus
ttgcctgctacagaggttgcaagtg

SEQ ID NO: 394329 - DNA, 25 bp, Mus musculus
ttgcctgctggaagtctctaataaa

SEQ ID NO: 394330 - DNA, 25 bp, Mus musculus
ttgcctggaaggttgagattgagaa

SEQ ID NO: 394331 - DNA, 25 bp, Mus musculus
ttgcctggacctcctcccatctctt

SEQ ID NO: 394332 - DNA, 25 bp, Mus musculus
ttgcctggtggaaagacagctggaa

SEQ ID NO: 394333 - DNA, 25 bp, Mus musculus
ttgcctggtggaagctccatggtta

SEQ ID NO: 394334 - DNA, 25 bp, Mus musculus
ttgcctgtagagacagctgcatctt

SEQ ID NO: 394335 - DNA, 25 bp, Mus musculus
ttgcctgtcagtcccaggtcctgcc

SEQ ID NO: 394336 - DNA, 25 bp, Mus musculus
ttgcctgtgagaaggccctggggaa

SEQ ID NO: 394337 - DNA, 25 bp, Mus musculus
ttgcctgtgaggtttctgtttacag

SEQ ID NO: 394338 - DNA, 25 bp, Mus musculus
ttgcctgtgccctcggaaccaccat

SEQ ID NO: 394339 - DNA, 25 bp, Mus musculus
ttgccttagccaagagctgtcccga

SEQ ID NO: 394340 - DNA, 25 bp, Mus musculus
ttgccttcaaagacctactgaaagc

SEQ ID NO: 394341 - DNA, 25 bp, Mus musculus
ttgccttcaaggacctactgaaagc

SEQ ID NO: 394342 - DNA, 25 bp, Mus musculus
ttgccttccgagatgagacggcagt

SEQ ID NO: 394343 - DNA, 25 bp, Mus musculus
ttgccttccgagggcagtactgcta

SEQ ID NO: 394344 - DNA, 25 bp, Mus musculus
ttgccttctgaaagacccggccatg

SEQ ID NO: 394345 - DNA, 25 bp, Mus musculus
ttgccttggtaaatgatgtggcacc

SEQ ID NO: 394346 - DNA, 25 bp, Mus musculus
ttgccttgtggaggaactacttcat

SEQ ID NO: 394347 - DNA, 25 bp, Mus musculus
ttgccttgtgtgttgaggatgggag

SEQ ID NO: 394348 - DNA, 25 bp, Mus musculus
ttgcctttccccggaggaattcgtg

SEQ ID NO: 394349 - DNA, 25 bp, Mus musculus
ttgcctttgcacctgagaacccatc

SEQ ID NO: 394350 - DNA, 25 bp, Mus musculus
ttgcctttgcaggtgacagcagcat

SEQ ID NO: 394351 - DNA, 25 bp, Mus musculus
ttgccttttcccagtgttgtgcaga

SEQ ID NO: 394352 - DNA, 25 bp, Mus musculus
ttgccttttgtcagggattcgataa

SEQ ID NO: 394353 - DNA, 25 bp, Mus musculus
ttgcgacaacagatggagaagtctt

SEQ ID NO: 394354 - DNA, 25 bp, Mus musculus
ttgcgacttggacctttgggcgacc

SEQ ID NO: 394355 - DNA, 25 bp, Mus musculus
ttgcgagagcaatctgatgattctg

SEQ ID NO: 394356 - DNA, 25 bp, Mus musculus
ttgcgagcccccatgattcagtaac

SEQ ID NO: 394357 - DNA, 25 bp, Mus musculus
ttgcgagcccccatggctccatacc

SEQ ID NO: 394358 - DNA, 25 bp, Mus musculus
ttgcgagctctgcttgctggttgtt

SEQ ID NO: 394359 - DNA, 25 bp, Mus musculus
ttgcgagctgtgtggaaaaaatgtg

SEQ ID NO: 394360 - DNA, 25 bp, Mus musculus
ttgcgagctgtgtggtgacttacca

SEQ ID NO: 394361 - DNA, 25 bp, Mus musculus
ttgcgagtcatcaacctaatgcctg

SEQ ID NO: 394362 - DNA, 25 bp, Mus musculus
ttgcgatataaacctgaaggcatca

SEQ ID NO: 394363 - DNA, 25 bp, Mus musculus
ttgcgatccaaacgggaacaatata

SEQ ID NO: 394364 - DNA, 25 bp, Mus musculus
ttgcgatcctgtaagactttaaccc

SEQ ID NO: 394365 - DNA, 25 bp, Mus musculus
ttgcgatcctgtaaggcactggtga

SEQ ID NO: 394366 - DNA, 25 bp, Mus musculus
ttgcgatggcggtacagagactcag

SEQ ID NO: 394367 - DNA, 25 bp, Mus musculus
ttgcgatttggaataattgatgtga

SEQ ID NO: 394368 - DNA, 25 bp, Mus musculus
ttgcgatttggaatattcgatgtta

SEQ ID NO: 394369 - DNA, 25 bp, Mus musculus
ttgcgcaacgaaaaattcatttgca

SEQ ID NO: 394370 - DNA, 25 bp, Mus musculus
ttgcgcaacgaatcctgactgttcc

SEQ ID NO: 394371 - DNA, 25 bp, Mus musculus
ttgcgcagaggttacatcggcgtgg

SEQ ID NO: 394372 - DNA, 25 bp, Mus musculus
ttgcgcatcctgcagccacattgcc

SEQ ID NO: 394373 - DNA, 25 bp, Mus musculus
ttgcgccacagactcttccaagcaa

SEQ ID NO: 394374 - DNA, 25 bp, Mus musculus
ttgcgccccagcctccaccatgcca

SEQ ID NO: 394375 - DNA, 25 bp, Mus musculus
ttgcgccgccggtgtggccgtggct

SEQ ID NO: 394376 - DNA, 25 bp, Mus musculus
ttgcgcgcacagatttgaagactga

SEQ ID NO: 394377 - DNA, 25 bp, Mus musculus
ttgcgcgcacaggcctcctctgtca

SEQ ID NO: 394378 - DNA, 25 bp, Mus musculus
ttgcgcgcagctggggtcatgatat

SEQ ID NO: 394379 - DNA, 25 bp, Mus musculus
ttgcgcgctctcaggctagagttca

SEQ ID NO: 394380 - DNA, 25 bp, Mus musculus
ttgcgctacaggggcgggacaaagg

SEQ ID NO: 394381 - DNA, 25 bp, Mus musculus
ttgcgctcagggaaaggtgaacatg

SEQ ID NO: 394382 - DNA, 25 bp, Mus musculus
ttgcgctcagggcatccatgtgaat

SEQ ID NO: 394383 - DNA, 25 bp, Mus musculus
ttgcgctccgcaagccccgcccaac

SEQ ID NO: 394384 - DNA, 25 bp, Mus musculus
ttgcgctgccttgactgtggaaaga

SEQ ID NO: 394385 - DNA, 25 bp, Mus musculus
ttgcgctgtatagaatgcggggttc

SEQ ID NO: 394386 - DNA, 25 bp, Mus musculus
ttgcggaaacaggcattgaagacaa

SEQ ID NO: 394387 - DNA, 25 bp, Mus musculus
ttgcggagggtcctggaaacactca

SEQ ID NO: 394388 - DNA, 25 bp, Mus musculus
ttgcggatggggaagccagctttgt

SEQ ID NO: 394389 - DNA, 25 bp, Mus musculus
ttgcggcagatgccccacaggatcg

SEQ ID NO: 394390 - DNA, 25 bp, Mus musculus
ttgcggccacacggctggatagccg

SEQ ID NO: 394391 - DNA, 25 bp, Mus musculus
ttgcggcgccaagatccccagctca

SEQ ID NO: 394392 - DNA, 25 bp, Mus musculus
ttgcggcgccggacaggatgtttgc

SEQ ID NO: 394393 - DNA, 25 bp, Mus musculus
ttgcggcgctgtcagatcaagatcc

SEQ ID NO: 394394 - DNA, 25 bp, Mus musculus
ttgcggctgaagaacgggaaccggt

SEQ ID NO: 394395 - DNA, 25 bp, Mus musculus
ttgcggctgagtggagattctagac

SEQ ID NO: 394396 - DNA, 25 bp, Mus musculus
ttgcggctgcaaatgacacaacacg

SEQ ID NO: 394397 - DNA, 25 bp, Mus musculus
ttgcggctgcaaatggtaacgatcg

SEQ ID NO: 394398 - DNA, 25 bp, Mus musculus
ttgcgggtctcacgatctttggcat

SEQ ID NO: 394399 - DNA, 25 bp, Mus musculus
ttgcgggtctcacggaactctgatt

SEQ ID NO: 394400 - DNA, 25 bp, Mus musculus
ttgcggtcacctctgtcttcctact

SEQ ID NO: 394401 - DNA, 25 bp, Mus musculus
ttgcgtacagggatcttgtcctttg

SEQ ID NO: 394402 - DNA, 25 bp, Mus musculus
ttgcgtacagggggtggtactgggg

SEQ ID NO: 394403 - DNA, 25 bp, Mus musculus
ttgcgtcaagagcctcagcttaagg

SEQ ID NO: 394404 - DNA, 25 bp, Mus musculus
ttgcgtcttctctggggtctatgtt

SEQ ID NO: 394405 - DNA, 25 bp, Mus musculus
ttgcgtgcacagcagaggcagacag

SEQ ID NO: 394406 - DNA, 25 bp, Mus musculus
ttgcgtggagttacagctgccttgc

SEQ ID NO: 394407 - DNA, 25 bp, Mus musculus
ttgcgtgttgctggatgagtattgg

SEQ ID NO: 394408 - DNA, 25 bp, Mus musculus
ttgcgtgttgctggctgccatgcct

SEQ ID NO: 394409 - DNA, 25 bp, Mus musculus
ttgcgtgttgctggctggattgcct

SEQ ID NO: 394410 - DNA, 25 bp, Mus musculus
ttgcgttagatctggctctgttgct

SEQ ID NO: 394411 - DNA, 25 bp, Mus musculus
ttgcgttcgggaagatgctggtggt

SEQ ID NO: 394412 - DNA, 25 bp, Mus musculus
ttgcgttctcaggatccaaagggaa

SEQ ID NO: 394413 - DNA, 25 bp, Mus musculus
ttgcgttctcgagcttcatggggta

SEQ ID NO: 394414 - DNA, 25 bp, Mus musculus
ttgcgtttcagagggcccatagcct

SEQ ID NO: 394415 - DNA, 25 bp, Mus musculus
ttgcgtttctcccctgctcctctcc

SEQ ID NO: 394416 - DNA, 25 bp, Mus musculus
ttgcgtttttcaaggatgtcactga

SEQ ID NO: 394417 - DNA, 25 bp, Mus musculus
ttgcgtttttcaagtatgaagtcag

SEQ ID NO: 394418 - DNA, 25 bp, Mus musculus
ttgctaaaattacaagttgatcgtg

SEQ ID NO: 394419 - DNA, 25 bp, Mus musculus
ttgctaaacagcatccagggaaatg

SEQ ID NO: 394420 - DNA, 25 bp, Mus musculus
ttgctaaaggaagacttcgctgatg

SEQ ID NO: 394421 - DNA, 25 bp, Mus musculus
ttgctaacaacaacacctcgtccag

SEQ ID NO: 394422 - DNA, 25 bp, Mus musculus
ttgctaacaggatgcccatcccaga

SEQ ID NO: 394423 - DNA, 25 bp, Mus musculus
ttgctaacaggggatcatgagggac

SEQ ID NO: 394424 - DNA, 25 bp, Mus musculus
ttgctaactgaaatggcaaagaagt

SEQ ID NO: 394425 - DNA, 25 bp, Mus musculus
ttgctaactgccttgcagtgagaga

SEQ ID NO: 394426 - DNA, 25 bp, Mus musculus
ttgctaagaacaccagaaccgtgta

SEQ ID NO: 394427 - DNA, 25 bp, Mus musculus
ttgctaagatggcagttgggttctg

SEQ ID NO: 394428 - DNA, 25 bp, Mus musculus
ttgctaagcccaaacttgcacgagc

SEQ ID NO: 394429 - DNA, 25 bp, Mus musculus
ttgctaaggaacaagactgggatca

SEQ ID NO: 394430 - DNA, 25 bp, Mus musculus
ttgctaaggggcacctggccacatt

SEQ ID NO: 394431 - DNA, 25 bp, Mus musculus
ttgctaatccgaataatttaaaaat

SEQ ID NO: 394432 - DNA, 25 bp, Mus musculus
ttgctaatgaagcaagtgtggaggc

SEQ ID NO: 394433 - DNA, 25 bp, Mus musculus
ttgctacaaaagatttaaagatgac

SEQ ID NO: 394434 - DNA, 25 bp, Mus musculus
ttgctacaaaagcagcagcaacaga

SEQ ID NO: 394435 - DNA, 25 bp, Mus musculus
ttgctacaacgctaacagttccttt

SEQ ID NO: 394436 - DNA, 25 bp, Mus musculus
ttgctacaacttcaggaaaagctcc

SEQ ID NO: 394437 - DNA, 25 bp, Mus musculus
ttgctacaagtgtggtgagaaagga

SEQ ID NO: 394438 - DNA, 25 bp, Mus musculus
ttgctacaagtgtggtgggctagtc

SEQ ID NO: 394439 - DNA, 25 bp, Mus musculus
ttgctacacaaatggctacacggat

SEQ ID NO: 394440 - DNA, 25 bp, Mus musculus
ttgctacagctgggctgggaggatc

SEQ ID NO: 394441 - DNA, 25 bp, Mus musculus
ttgctacaggaggatctaagatgtc

SEQ ID NO: 394442 - DNA, 25 bp, Mus musculus
ttgctacccttctggttctttgtgt

SEQ ID NO: 394443 - DNA, 25 bp, Mus musculus
ttgctacctcagtctcacggatgat

SEQ ID NO: 394444 - DNA, 25 bp, Mus musculus
ttgctacctgcagggctgaccagct

SEQ ID NO: 394445 - DNA, 25 bp, Mus musculus
ttgctactgcaggggagccctatca

SEQ ID NO: 394446 - DNA, 25 bp, Mus musculus
ttgctactgggggctacgggcgaac

SEQ ID NO: 394447 - DNA, 25 bp, Mus musculus
ttgctagcagcaatcatctggggaa

SEQ ID NO: 394448 - DNA, 25 bp, Mus musculus
ttgctaggagacaaggtgagcccta

SEQ ID NO: 394449 - DNA, 25 bp, Mus musculus
ttgctaggtgttccctgctgctctc

SEQ ID NO: 394450 - DNA, 25 bp, Mus musculus
ttgctagtcaccatcctgtcctact

SEQ ID NO: 394451 - DNA, 25 bp, Mus musculus
ttgctataaagcagtatcgtcatct

SEQ ID NO: 394452 - DNA, 25 bp, Mus musculus
ttgctatagaaacgggttctgctgc

SEQ ID NO: 394453 - DNA, 25 bp, Mus musculus
ttgctatcatgcgtgagtgcatctc

SEQ ID NO: 394454 - DNA, 25 bp, Mus musculus
ttgctatctggcaagagcggcctcg

SEQ ID NO: 394455 - DNA, 25 bp, Mus musculus
ttgctatgaacacccctggctacat

SEQ ID NO: 394456 - DNA, 25 bp, Mus musculus
ttgctatgaacctgcagccagcagc

SEQ ID NO: 394457 - DNA, 25 bp, Mus musculus
ttgctatgaacgagcagttttggca

SEQ ID NO: 394458 - DNA, 25 bp, Mus musculus
ttgctatgaagttgaatctgcgtgg

SEQ ID NO: 394459 - DNA, 25 bp, Mus musculus
ttgctatgctaagtatgagagccag

SEQ ID NO: 394460 - DNA, 25 bp, Mus musculus
ttgctatggcttaagaccgaaggga

SEQ ID NO: 394461 - DNA, 25 bp, Mus musculus
ttgctatggcttaagggaccgacgt

SEQ ID NO: 394462 - DNA, 25 bp, Mus musculus
ttgctattgggcacaaatatgccag

SEQ ID NO: 394463 - DNA, 25 bp, Mus musculus
ttgctatttgcgtagccgcctgtgt

SEQ ID NO: 394464 - DNA, 25 bp, Mus musculus
ttgctcaaccagatccttgcatgaa

SEQ ID NO: 394465 - DNA, 25 bp, Mus musculus
ttgctcaaccagggcatcgttctgc

SEQ ID NO: 394466 - DNA, 25 bp, Mus musculus
ttgctcaagaccccggcagcccaac

SEQ ID NO: 394467 - DNA, 25 bp, Mus musculus
ttgctcaaggctgccttagacttgc

SEQ ID NO: 394468 - DNA, 25 bp, Mus musculus
ttgctcaattttaaggcagtgtgtg

SEQ ID NO: 394469 - DNA, 25 bp, Mus musculus
ttgctcacctgcggcttgggtgact

SEQ ID NO: 394470 - DNA, 25 bp, Mus musculus
ttgctcagaagaaacctgctcggta

SEQ ID NO: 394471 - DNA, 25 bp, Mus musculus
ttgctcagacttggatacccttctg

SEQ ID NO: 394472 - DNA, 25 bp, Mus musculus
ttgctcagcagaatggcactacaag

SEQ ID NO: 394473 - DNA, 25 bp, Mus musculus
ttgctcagcgcttagcccggaagac

SEQ ID NO: 394474 - DNA, 25 bp, Mus musculus
ttgctcaggagcacagcgagctgga

SEQ ID NO: 394475 - DNA, 25 bp, Mus musculus
ttgctcaggtcccacgccctggcac

SEQ ID NO: 394476 - DNA, 25 bp, Mus musculus
ttgctcataaatcagccttacgatg

SEQ ID NO: 394477 - DNA, 25 bp, Mus musculus
ttgctcattagcttttttccaggaa

SEQ ID NO: 394478 - DNA, 25 bp, Mus musculus
ttgctcattaggtgtgtgatagcac

SEQ ID NO: 394479 - DNA, 25 bp, Mus musculus
ttgctccaagggccccgccgtcacc

SEQ ID NO: 394480 - DNA, 25 bp, Mus musculus
ttgctccccagccctgaggtgcgca

SEQ ID NO: 394481 - DNA, 25 bp, Mus musculus
ttgctccctccagactccatctgcg

SEQ ID NO: 394482 - DNA, 25 bp, Mus musculus
ttgctccctccagcgccaacgtcac

SEQ ID NO: 394483 - DNA, 25 bp, Mus musculus
ttgctccctcgcttagcgctctgtg

SEQ ID NO: 394484 - DNA, 25 bp, Mus musculus
ttgctccgagagtgctcccagaggt

SEQ ID NO: 394485 - DNA, 25 bp, Mus musculus
ttgctccgtcctggatactccatgt

SEQ ID NO: 394486 - DNA, 25 bp, Mus musculus
ttgctccttctgtaggtgtgctgat

SEQ ID NO: 394487 - DNA, 25 bp, Mus musculus
ttgctcgaaatgggaaccctaatgg

SEQ ID NO: 394488 - DNA, 25 bp, Mus musculus
ttgctcgaggagtgcatgggtacag

SEQ ID NO: 394489 - DNA, 25 bp, Mus musculus
ttgctcgccgcacctgcctcagtat

SEQ ID NO: 394490 - DNA, 25 bp, Mus musculus
ttgctcggaatgggaaccctaatgg

SEQ ID NO: 394491 - DNA, 25 bp, Mus musculus
ttgctctaaagatgactgcttacgg

SEQ ID NO: 394492 - DNA, 25 bp, Mus musculus
ttgctctacagagtgagcctaggag

SEQ ID NO: 394493 - DNA, 25 bp, Mus musculus
ttgctctcacccgcccgagttcgtc

SEQ ID NO: 394494 - DNA, 25 bp, Mus musculus
ttgctctcacccggtacttggtgga

SEQ ID NO: 394495 - DNA, 25 bp, Mus musculus
ttgctctccagtccctgccgccttc

SEQ ID NO: 394496 - DNA, 25 bp, Mus musculus
ttgctctcctcagcccttcagggtg

SEQ ID NO: 394497 - DNA, 25 bp, Mus musculus
ttgctctctagaactgaactcatta

SEQ ID NO: 394498 - DNA, 25 bp, Mus musculus
ttgctctctcggacacggagagcca

SEQ ID NO: 394499 - DNA, 25 bp, Mus musculus
ttgctctgaagattgtgcccaccta

SEQ ID NO: 394500 - DNA, 25 bp, Mus musculus
ttgctctgaaggtttcttttgatca

SEQ ID NO: 394501 - DNA, 25 bp, Mus musculus
ttgctctgacttggggaagaaagtg

SEQ ID NO: 394502 - DNA, 25 bp, Mus musculus
ttgctctgataagtatggaacaact

SEQ ID NO: 394503 - DNA, 25 bp, Mus musculus
ttgctctgtccccaggcgtatgggc

SEQ ID NO: 394504 - DNA, 25 bp, Mus musculus
ttgctctgtccccagggactgaaag

SEQ ID NO: 394505 - DNA, 25 bp, Mus musculus
ttgctctgtccccagtgcatgggta

SEQ ID NO: 394506 - DNA, 25 bp, Mus musculus
ttgctcttaaactcggtgtgtatga

SEQ ID NO: 394507 - DNA, 25 bp, Mus musculus
ttgctcttcctacagttggtcccgc

SEQ ID NO: 394508 - DNA, 25 bp, Mus musculus
ttgctcttctccatagcagactaga

SEQ ID NO: 394509 - DNA, 25 bp, Mus musculus
ttgctcttctccatatacctggtga

SEQ ID NO: 394510 - DNA, 25 bp, Mus musculus
ttgctcttggcactaaacaagattg

SEQ ID NO: 394511 - DNA, 25 bp, Mus musculus
ttgctcttggggagatgcgaaaaaa

SEQ ID NO: 394512 - DNA, 25 bp, Mus musculus
ttgctctttgtcaggtaagaatgat

SEQ ID NO: 394513 - DNA, 25 bp, Mus musculus
ttgctgaaagtgaaacactagacca

SEQ ID NO: 394514 - DNA, 25 bp, Mus musculus
ttgctgaaagtgaaaccagaggagg

SEQ ID NO: 394515 - DNA, 25 bp, Mus musculus
ttgctgaaatgcacctagtgtgtac

SEQ ID NO: 394516 - DNA, 25 bp, Mus musculus
ttgctgaaatggtgacccgcagggc

SEQ ID NO: 394517 - DNA, 25 bp, Mus musculus
ttgctgaacccccacagaacctgat

SEQ ID NO: 394518 - DNA, 25 bp, Mus musculus
ttgctgaagaagagcatcatggtcc

SEQ ID NO: 394519 - DNA, 25 bp, Mus musculus
ttgctgaagcagaactgtgtgtggg

SEQ ID NO: 394520 - DNA, 25 bp, Mus musculus
ttgctgaagcagctcaccatgtcca

SEQ ID NO: 394521 - DNA, 25 bp, Mus musculus
ttgctgaagcaggacacaccaggaa

SEQ ID NO: 394522 - DNA, 25 bp, Mus musculus
ttgctgacaagcccttcaaattggc

SEQ ID NO: 394523 - DNA, 25 bp, Mus musculus
ttgctgacagaattaacggcacagc

SEQ ID NO: 394524 - DNA, 25 bp, Mus musculus
ttgctgaccaaggagagagatggca

SEQ ID NO: 394525 - DNA, 25 bp, Mus musculus
ttgctgaccaaggcattggaattgt

SEQ ID NO: 394526 - DNA, 25 bp, Mus musculus
ttgctgaccagaatttttcagattt

SEQ ID NO: 394527 - DNA, 25 bp, Mus musculus
ttgctgaccagctgtatatctgtga

SEQ ID NO: 394528 - DNA, 25 bp, Mus musculus
ttgctgacctcaaggtttccctgga

SEQ ID NO: 394529 - DNA, 25 bp, Mus musculus
ttgctgacgagatctggccgccccg

SEQ ID NO: 394530 - DNA, 25 bp, Mus musculus
ttgctgactacatttcctcggcctg

SEQ ID NO: 394531 - DNA, 25 bp, Mus musculus
ttgctgagaggttttctcaagaatt

SEQ ID NO: 394532 - DNA, 25 bp, Mus musculus
ttgctgagagtgctcacaggctggt

SEQ ID NO: 394533 - DNA, 25 bp, Mus musculus
ttgctgagagtgtgtgactccctcc

SEQ ID NO: 394534 - DNA, 25 bp, Mus musculus
ttgctgagcaagagatgcctgcctt

SEQ ID NO: 394535 - DNA, 25 bp, Mus musculus
ttgctgaggaagagaagtttattga

SEQ ID NO: 394536 - DNA, 25 bp, Mus musculus
ttgctgaggcctcttaagcaatgcc

SEQ ID NO: 394537 - DNA, 25 bp, Mus musculus
ttgctgataagatctcccttgatct

SEQ ID NO: 394538 - DNA, 25 bp, Mus musculus
ttgctgataagatgtctggtgagaa

SEQ ID NO: 394539 - DNA, 25 bp, Mus musculus
ttgctgatcccaagggttggcccct

SEQ ID NO: 394540 - DNA, 25 bp, Mus musculus
ttgctgatccccagctgtgctcagg

SEQ ID NO: 394541 - DNA, 25 bp, Mus musculus
ttgctgatgctcggtgaaggaggtc

SEQ ID NO: 394542 - DNA, 25 bp, Mus musculus
ttgctgatgtaaagattttgctgga

SEQ ID NO: 394543 - DNA, 25 bp, Mus musculus
ttgctgattcccctggatcattcgg

SEQ ID NO: 394544 - DNA, 25 bp, Mus musculus
ttgctgcaaccgaggtcacatggtg

SEQ ID NO: 394545 - DNA, 25 bp, Mus musculus
ttgctgcacaggagggtcacttccc

SEQ ID NO: 394546 - DNA, 25 bp, Mus musculus
ttgctgcagaaaatatggtggtcac

SEQ ID NO: 394547 - DNA, 25 bp, Mus musculus
ttgctgcagacagtcttcatcagct

SEQ ID NO: 394548 - DNA, 25 bp, Mus musculus
ttgctgcatacccctgcccagatca

SEQ ID NO: 394549 - DNA, 25 bp, Mus musculus
ttgctgccagcataagacagtgatg

SEQ ID NO: 394550 - DNA, 25 bp, Mus musculus
ttgctgccatcaaattatttttaat

SEQ ID NO: 394551 - DNA, 25 bp, Mus musculus
ttgctgccctagagatagtcaataa

SEQ ID NO: 394552 - DNA, 25 bp, Mus musculus
ttgctgccctagagatcaagatatt

SEQ ID NO: 394553 - DNA, 25 bp, Mus musculus
ttgctgccctgcagtaccacatcaa

SEQ ID NO: 394554 - DNA, 25 bp, Mus musculus
ttgctgccctgtccccagccccctc

SEQ ID NO: 394555 - DNA, 25 bp, Mus musculus
ttgctgcctcacaggtggatacctt

SEQ ID NO: 394556 - DNA, 25 bp, Mus musculus
ttgctgcctgagggttaaaattctg

SEQ ID NO: 394557 - DNA, 25 bp, Mus musculus
ttgctgcgcagatgatgctgaataa

SEQ ID NO: 394558 - DNA, 25 bp, Mus musculus
ttgctgcgcagatgcagaaccccga

SEQ ID NO: 394559 - DNA, 25 bp, Mus musculus
ttgctgcgctcagagcgtaaacgac

SEQ ID NO: 394560 - DNA, 25 bp, Mus musculus
ttgctgctcactgacagggtttctc

SEQ ID NO: 394561 - DNA, 25 bp, Mus musculus
ttgctgctcactgcattggataccc

SEQ ID NO: 394562 - DNA, 25 bp, Mus musculus
ttgctgctcatggatgaagttgctg

SEQ ID NO: 394563 - DNA, 25 bp, Mus musculus
ttgctgctccagggtggggcactgt

SEQ ID NO: 394564 - DNA, 25 bp, Mus musculus
ttgctgctcctagaagcgtgcaatc

SEQ ID NO: 394565 - DNA, 25 bp, Mus musculus
ttgctgctcctggtaacttcaattt

SEQ ID NO: 394566 - DNA, 25 bp, Mus musculus
ttgctgctctgcgccaaggacactg

SEQ ID NO: 394567 - DNA, 25 bp, Mus musculus
ttgctgctgcaggttaccaacatat

SEQ ID NO: 394568 - DNA, 25 bp, Mus musculus
ttgctgctggattcgatgatatgga

SEQ ID NO: 394569 - DNA, 25 bp, Mus musculus
ttgctgctggggtctgcgagcttta

SEQ ID NO: 394570 - DNA, 25 bp, Mus musculus
ttgctgctgtatgcccttctctagg

SEQ ID NO: 394571 - DNA, 25 bp, Mus musculus
ttgctgctgtccttcctgcttagac

SEQ ID NO: 394572 - DNA, 25 bp, Mus musculus
ttgctgcttctgccttgtccccaca

SEQ ID NO: 394573 - DNA, 25 bp, Mus musculus
ttgctggacgaggtgccagtcatta

SEQ ID NO: 394574 - DNA, 25 bp, Mus musculus
ttgctggagtcagaacagggagccc

SEQ ID NO: 394575 - DNA, 25 bp, Mus musculus
ttgctggagtcagaggagtttgaca

SEQ ID NO: 394576 - DNA, 25 bp, Mus musculus
ttgctggcaagagtattcaggagtg

SEQ ID NO: 394577 - DNA, 25 bp, Mus musculus
ttgctggcaaggtggcgacctgcac

SEQ ID NO: 394578 - DNA, 25 bp, Mus musculus
ttgctggccagcagtgacgcgccgc

SEQ ID NO: 394579 - DNA, 25 bp, Mus musculus
ttgctgggaggagagcgacatgttt

SEQ ID NO: 394580 - DNA, 25 bp, Mus musculus
ttgctggggggaaaggctcaagcca

SEQ ID NO: 394581 - DNA, 25 bp, Mus musculus
ttgctgggtcatacggtaacatttc

SEQ ID NO: 394582 - DNA, 25 bp, Mus musculus
ttgctggtgaaggttcaattgtgaa

SEQ ID NO: 394583 - DNA, 25 bp, Mus musculus
ttgctggtgaagttatgtaatccaa

SEQ ID NO: 394584 - DNA, 25 bp, Mus musculus
ttgctggtgctccggcattgcagct

SEQ ID NO: 394585 - DNA, 25 bp, Mus musculus
ttgctggtgctccgtggaccctaat

SEQ ID NO: 394586 - DNA, 25 bp, Mus musculus
ttgctggtggaaggaggcaggattg

SEQ ID NO: 394587 - DNA, 25 bp, Mus musculus
ttgctggtggtggcatcgtttgcat

SEQ ID NO: 394588 - DNA, 25 bp, Mus musculus
ttgctggtggtgttcagacagtaac

SEQ ID NO: 394589 - DNA, 25 bp, Mus musculus
ttgctgtaaaagagaggaggctcac

SEQ ID NO: 394590 - DNA, 25 bp, Mus musculus
ttgctgtaccagatcccacaacgtc

SEQ ID NO: 394591 - DNA, 25 bp, Mus musculus
ttgctgtagaggttgctgcatccca

SEQ ID NO: 394592 - DNA, 25 bp, Mus musculus
ttgctgtcaaactacagagtgaatg

SEQ ID NO: 394593 - DNA, 25 bp, Mus musculus
ttgctgtccagaaccccgtctgtgg

SEQ ID NO: 394594 - DNA, 25 bp, Mus musculus
ttgctgtccagggtgaagcctgctg

SEQ ID NO: 394595 - DNA, 25 bp, Mus musculus
ttgctgtcgtgcctcgaggcagcac

SEQ ID NO: 394596 - DNA, 25 bp, Mus musculus
ttgctgtctcaggacactgctggcc

SEQ ID NO: 394597 - DNA, 25 bp, Mus musculus
ttgctgtctcagggtgaaagagcaa

SEQ ID NO: 394598 - DNA, 25 bp, Mus musculus
ttgctgtgacacttggtccctccag

SEQ ID NO: 394599 - DNA, 25 bp, Mus musculus
ttgctgtgatcacggtgacaaactt

SEQ ID NO: 394600 - DNA, 25 bp, Mus musculus
ttgctgtgatggagtcctcatggaa

SEQ ID NO: 394601 - DNA, 25 bp, Mus musculus
ttgctgtggagatcggcctggcctt

SEQ ID NO: 394602 - DNA, 25 bp, Mus musculus
ttgctgtggagctccttcaaaaaat

SEQ ID NO: 394603 - DNA, 25 bp, Mus musculus
ttgctgtggcactcagaaagaagac

SEQ ID NO: 394604 - DNA, 25 bp, Mus musculus
ttgctgtgggaaagtacattgagca

SEQ ID NO: 394605 - DNA, 25 bp, Mus musculus
ttgctgtgggagctgtgatggatga

SEQ ID NO: 394606 - DNA, 25 bp, Mus musculus
ttgctgtgtggctgagagtgctagc

SEQ ID NO: 394607 - DNA, 25 bp, Mus musculus
ttgctgttaatactgtggatttctt

SEQ ID NO: 394608 - DNA, 25 bp, Mus musculus
ttgctgttaatagtgtcccttttcc

SEQ ID NO: 394609 - DNA, 25 bp, Mus musculus
ttgctgttactataaagctctgaag

SEQ ID NO: 394610 - DNA, 25 bp, Mus musculus
ttgctgttactattgacaccgattc

SEQ ID NO: 394611 - DNA, 25 bp, Mus musculus
ttgctgttatcggaaataaagaaag

SEQ ID NO: 394612 - DNA, 25 bp, Mus musculus
ttgctgttctgtgattcttactggg

SEQ ID NO: 394613 - DNA, 25 bp, Mus musculus
ttgctgttctttatcctgggtgctg

SEQ ID NO: 394614 - DNA, 25 bp, Mus musculus
ttgctgtttatggaccttgagatca

SEQ ID NO: 394615 - DNA, 25 bp, Mus musculus
ttgcttaaaacatgctaattccact

SEQ ID NO: 394616 - DNA, 25 bp, Mus musculus
ttgcttaatagacttggtcccctgc

SEQ ID NO: 394617 - DNA, 25 bp, Mus musculus
ttgcttaatagattgtgcccaccta

SEQ ID NO: 394618 - DNA, 25 bp, Mus musculus
ttgcttaataggtgtgtcctctggt

SEQ ID NO: 394619 - DNA, 25 bp, Mus musculus
ttgcttacaagattccgggctttag

SEQ ID NO: 394620 - DNA, 25 bp, Mus musculus
ttgcttacaaggccacagtgaacgc

SEQ ID NO: 394621 - DNA, 25 bp, Mus musculus
ttgcttaccttaccactgagatact

SEQ ID NO: 394622 - DNA, 25 bp, Mus musculus
ttgcttagaggctcttgaaatggac

SEQ ID NO: 394623 - DNA, 25 bp, Mus musculus
ttgcttagcaaggcacaacacgtac

SEQ ID NO: 394624 - DNA, 25 bp, Mus musculus
ttgcttcaaccagggccagtccctg

SEQ ID NO: 394625 - DNA, 25 bp, Mus musculus
ttgcttcatccaaggcgttagacaa

SEQ ID NO: 394626 - DNA, 25 bp, Mus musculus
ttgcttccactctggtcagacatgg

SEQ ID NO: 394627 - DNA, 25 bp, Mus musculus
ttgcttccagatggcctaccttctt

SEQ ID NO: 394628 - DNA, 25 bp, Mus musculus
ttgcttcccagaggaagtcacagac

SEQ ID NO: 394629 - DNA, 25 bp, Mus musculus
ttgcttcgagaaaagatgagagtca

SEQ ID NO: 394630 - DNA, 25 bp, Mus musculus
ttgcttcgagaaaaggaaaatgaga

SEQ ID NO: 394631 - DNA, 25 bp, Mus musculus
ttgcttctaatcaccaagccccgcc

SEQ ID NO: 394632 - DNA, 25 bp, Mus musculus
ttgcttctcaccaaggtctgagtac

SEQ ID NO: 394633 - DNA, 25 bp, Mus musculus
ttgcttctccaccatcccttccaga

SEQ ID NO: 394634 - DNA, 25 bp, Mus musculus
ttgcttctctgtggaataaatttgt

SEQ ID NO: 394635 - DNA, 25 bp, Mus musculus
ttgcttctgaaacctcaggtggaac

SEQ ID NO: 394636 - DNA, 25 bp, Mus musculus
ttgcttctgacaatcgaatcccgcc

SEQ ID NO: 394637 - DNA, 25 bp, Mus musculus
ttgcttctgacaatggaatcccgcc

SEQ ID NO: 394638 - DNA, 25 bp, Mus musculus
ttgcttctgaggtggtcctggactt

SEQ ID NO: 394639 - DNA, 25 bp, Mus musculus
ttgcttctggggtcacaggatgctg

SEQ ID NO: 394640 - DNA, 25 bp, Mus musculus
ttgcttctgttaggtgctggagagt

SEQ ID NO: 394641 - DNA, 25 bp, Mus musculus
ttgcttgaatgggcctgtgttttat

SEQ ID NO: 394642 - DNA, 25 bp, Mus musculus
ttgcttgaggtaatccattgtctga

SEQ ID NO: 394643 - DNA, 25 bp, Mus musculus
ttgcttgatggtgaaattgaagcca

SEQ ID NO: 394644 - DNA, 25 bp, Mus musculus
ttgcttgcaaacaggatgtctctcc

SEQ ID NO: 394645 - DNA, 25 bp, Mus musculus
ttgcttgccttccagacctatccct

SEQ ID NO: 394646 - DNA, 25 bp, Mus musculus
ttgcttgctcattagcttttttcca

SEQ ID NO: 394647 - DNA, 25 bp, Mus musculus
ttgcttgctcattaggtgtgtgata

SEQ ID NO: 394648 - DNA, 25 bp, Mus musculus
ttgcttgctctctcggacacggaga

SEQ ID NO: 394649 - DNA, 25 bp, Mus musculus
ttgcttggtgggttcaggggtgatc

SEQ ID NO: 394650 - DNA, 25 bp, Mus musculus
ttgcttgtaaggtgcaaaagaagga

SEQ ID NO: 394651 - DNA, 25 bp, Mus musculus
ttgcttgtcggaatctgatgcttct

SEQ ID NO: 394652 - DNA, 25 bp, Mus musculus
ttgctttaaggacctgcaggaagaa

SEQ ID NO: 394653 - DNA, 25 bp, Mus musculus
ttgctttacagaatggggagcgctc

SEQ ID NO: 394654 - DNA, 25 bp, Mus musculus
ttgctttacagaatgtctgcggatt

SEQ ID NO: 394655 - DNA, 25 bp, Mus musculus
ttgctttcaaagaacagcatgtttt

SEQ ID NO: 394656 - DNA, 25 bp, Mus musculus
ttgctttcaccaaaggattctaacc

SEQ ID NO: 394657 - DNA, 25 bp, Mus musculus
ttgctttcaccaaaggtcctggcat

SEQ ID NO: 394658 - DNA, 25 bp, Mus musculus
ttgctttcagaagaatatgacagat

SEQ ID NO: 394659 - DNA, 25 bp, Mus musculus
ttgctttccacatgtctgccaggaa

SEQ ID NO: 394660 - DNA, 25 bp, Mus musculus
ttgctttccagaatgggcaaaggac

SEQ ID NO: 394661 - DNA, 25 bp, Mus musculus
ttgctttccagagacttcctgcttg

SEQ ID NO: 394662 - DNA, 25 bp, Mus musculus
ttgctttccagagcggaaacgggtc

SEQ ID NO: 394663 - DNA, 25 bp, Mus musculus
ttgctttccatgggtcccacattga

SEQ ID NO: 394664 - DNA, 25 bp, Mus musculus
ttgctttcgtgaaggatgttttatt

SEQ ID NO: 394665 - DNA, 25 bp, Mus musculus
ttgctttctgtgaggccaggttcca

SEQ ID NO: 394666 - DNA, 25 bp, Mus musculus
ttgctttctgtttctaatcctggtg

SEQ ID NO: 394667 - DNA, 25 bp, Mus musculus
ttgctttgaaagtggtaacctcggc

SEQ ID NO: 394668 - DNA, 25 bp, Mus musculus
ttgctttgacacgagatgacataac

SEQ ID NO: 394669 - DNA, 25 bp, Mus musculus
ttgctttgatgaaaaaacaaaaacc

SEQ ID NO: 394670 - DNA, 25 bp, Mus musculus
ttgctttgcttgaggtagtccattg

SEQ ID NO: 394671 - DNA, 25 bp, Mus musculus
ttgctttggatggtatgccttacac

SEQ ID NO: 394672 - DNA, 25 bp, Mus musculus
ttgctttggtgggcagtcctggcag

SEQ ID NO: 394673 - DNA, 25 bp, Mus musculus
ttgcttttaaaggattaaaggagag

SEQ ID NO: 394674 - DNA, 25 bp, Mus musculus
ttgcttttacatttgtcataatcct

SEQ ID NO: 394675 - DNA, 25 bp, Mus musculus
ttgcttttgcggagatgcggcattc

SEQ ID NO: 394676 - DNA, 25 bp, Mus musculus
ttgcttttgcggagtcactatttag

SEQ ID NO: 394677 - DNA, 25 bp, Mus musculus
ttggaaaaaagctctcttaagagcc

SEQ ID NO: 394678 - DNA, 25 bp, Mus musculus
ttggaaaaaagttctaggcaagaag

SEQ ID NO: 394679 - DNA, 25 bp, Mus musculus
ttggaaaaacacagactgcgatgga

SEQ ID NO: 394680 - DNA, 25 bp, Mus musculus
ttggaaaaacagaggccagagggca

SEQ ID NO: 394681 - DNA, 25 bp, Mus musculus
ttggaaaaacagggcttcaagcagc

SEQ ID NO: 394682 - DNA, 25 bp, Mus musculus
ttggaaaacatgaggaaggacagac

SEQ ID NO: 394683 - DNA, 25 bp, Mus musculus
ttggaaaacattaagtcttgggtac

SEQ ID NO: 394684 - DNA, 25 bp, Mus musculus
ttggaaaacattaataattaccgtg

SEQ ID NO: 394685 - DNA, 25 bp, Mus musculus
ttggaaaagaaccgacgagctcacc

SEQ ID NO: 394686 - DNA, 25 bp, Mus musculus
ttggaaaagaaccgtggctctccag

SEQ ID NO: 394687 - DNA, 25 bp, Mus musculus
ttggaaaagataaataaagacaact

SEQ ID NO: 394688 - DNA, 25 bp, Mus musculus
ttggaaaagatatgatgaggaattt

SEQ ID NO: 394689 - DNA, 25 bp, Mus musculus
ttggaaaagcgcagcctggaggccg

SEQ ID NO: 394690 - DNA, 25 bp, Mus musculus
ttggaaaaggagaagctacttgcaa

SEQ ID NO: 394691 - DNA, 25 bp, Mus musculus
ttggaaaatgaaagttgtaagcatc

SEQ ID NO: 394692 - DNA, 25 bp, Mus musculus
ttggaaacaactggtgccagcacat

SEQ ID NO: 394693 - DNA, 25 bp, Mus musculus
ttggaaacaagaatgcctacgagaa

SEQ ID NO: 394694 - DNA, 25 bp, Mus musculus
ttggaaacaggttcagacaatgaat

SEQ ID NO: 394695 - DNA, 25 bp, Mus musculus
ttggaaacttcaggagtcatggctg

SEQ ID NO: 394696 - DNA, 25 bp, Mus musculus
ttggaaacttcattgatgccaaaga

SEQ ID NO: 394697 - DNA, 25 bp, Mus musculus
ttggaaagaaacacgaagaaaggct

SEQ ID NO: 394698 - DNA, 25 bp, Mus musculus
ttggaaagaaagatgcaccaacaag

SEQ ID NO: 394699 - DNA, 25 bp, Mus musculus
ttggaaagacagggggcagtgccca

SEQ ID NO: 394700 - DNA, 25 bp, Mus musculus
ttggaaagacagtgtttgtaagcgg

SEQ ID NO: 394701 - DNA, 25 bp, Mus musculus
ttggaaagagaaaggtattaagtca

SEQ ID NO: 394702 - DNA, 25 bp, Mus musculus
ttggaaagagcggaggccaacaccc

SEQ ID NO: 394703 - DNA, 25 bp, Mus musculus
ttggaaagctgcggcctcagcctgg

SEQ ID NO: 394704 - DNA, 25 bp, Mus musculus
ttggaaagctgcgtctcgcggcagg

SEQ ID NO: 394705 - DNA, 25 bp, Mus musculus
ttggaaaggtttttcttgatattta

SEQ ID NO: 394706 - DNA, 25 bp, Mus musculus
ttggaaagtcgacagaggcaagacc

SEQ ID NO: 394707 - DNA, 25 bp, Mus musculus
ttggaaatcagcaagaagagaaccg

SEQ ID NO: 394708 - DNA, 25 bp, Mus musculus
ttggaaatcaggggtctgcaacaac

SEQ ID NO: 394709 - DNA, 25 bp, Mus musculus
ttggaaatcaggtgattcgtaaggg

SEQ ID NO: 394710 - DNA, 25 bp, Mus musculus
ttggaaatgagacgagaatgatgtc

SEQ ID NO: 394711 - DNA, 25 bp, Mus musculus
ttggaaatgagacggaagctgccac

SEQ ID NO: 394712 - DNA, 25 bp, Mus musculus
ttggaaatgagacgtgctggagatc

SEQ ID NO: 394713 - DNA, 25 bp, Mus musculus
ttggaaatgcctcagcccagcgtaa

SEQ ID NO: 394714 - DNA, 25 bp, Mus musculus
ttggaaatggatctgctgcgaaagc

SEQ ID NO: 394715 - DNA, 25 bp, Mus musculus
ttggaaattgccgcagatgaccctc

SEQ ID NO: 394716 - DNA, 25 bp, Mus musculus
ttggaacaaaattctcagatcggac

SEQ ID NO: 394717 - DNA, 25 bp, Mus musculus
ttggaacaagtcaggctccaaaaac

SEQ ID NO: 394718 - DNA, 25 bp, Mus musculus
ttggaacagaaacaggtgatttttt

SEQ ID NO: 394719 - DNA, 25 bp, Mus musculus
ttggaacagatccagcaattcttgg

SEQ ID NO: 394720 - DNA, 25 bp, Mus musculus
ttggaacaggaactggtggattgtc

SEQ ID NO: 394721 - DNA, 25 bp, Mus musculus
ttggaacataacctggagacagcct

SEQ ID NO: 394722 - DNA, 25 bp, Mus musculus
ttggaacatagacaacatagaaaag

SEQ ID NO: 394723 - DNA, 25 bp, Mus musculus
ttggaacatggagggttcactgtgg

SEQ ID NO: 394724 - DNA, 25 bp, Mus musculus
ttggaacattattgcttcacctctg

SEQ ID NO: 394725 - DNA, 25 bp, Mus musculus
ttggaaccaaagatatttccatatg

SEQ ID NO: 394726 - DNA, 25 bp, Mus musculus
ttggaaccaagagatgcaccttgca

SEQ ID NO: 394727 - DNA, 25 bp, Mus musculus
ttggaaccaagagtttctagctctg

SEQ ID NO: 394728 - DNA, 25 bp, Mus musculus
ttggaaccctaagctgggctctccc

SEQ ID NO: 394729 - DNA, 25 bp, Mus musculus
ttggaaccctgttgggaactgttga

SEQ ID NO: 394730 - DNA, 25 bp, Mus musculus
ttggaactagagttggtgacacaca

SEQ ID NO: 394731 - DNA, 25 bp, Mus musculus
ttggaactaggtgcaagaatatttg

SEQ ID NO: 394732 - DNA, 25 bp, Mus musculus
ttggaactgaggatttctcagctga

SEQ ID NO: 394733 - DNA, 25 bp, Mus musculus
ttggaactggtcaaggcctggcagc

SEQ ID NO: 394734 - DNA, 25 bp, Mus musculus
ttggaacttcctcgtcccatctctc

SEQ ID NO: 394735 - DNA, 25 bp, Mus musculus
ttggaagaaaggtggtggtgtcaac

SEQ ID NO: 394736 - DNA, 25 bp, Mus musculus
ttggaagaaatacaagaaaaattcc

SEQ ID NO: 394737 - DNA, 25 bp, Mus musculus
ttggaagaagacgtcaaactccgtg

SEQ ID NO: 394738 - DNA, 25 bp, Mus musculus
ttggaagaagagaaccacaaactcc

SEQ ID NO: 394739 - DNA, 25 bp, Mus musculus
ttggaagaagccaaggcatgttatt

SEQ ID NO: 394740 - DNA, 25 bp, Mus musculus
ttggaagaagtcagttaaggaggat

SEQ ID NO: 394741 - DNA, 25 bp, Mus musculus
ttggaagaatcacagggctggaccc

SEQ ID NO: 394742 - DNA, 25 bp, Mus musculus
ttggaagaatggcatctagtgcttt

SEQ ID NO: 394743 - DNA, 25 bp, Mus musculus
ttggaagaatttcagatgcccgtgt

SEQ ID NO: 394744 - DNA, 25 bp, Mus musculus
ttggaagaatttcagtgtctctgaa

SEQ ID NO: 394745 - DNA, 25 bp, Mus musculus
ttggaagagcaggggaaggaagcca

SEQ ID NO: 394746 - DNA, 25 bp, Mus musculus
ttggaagaggccctgggcttctcca

SEQ ID NO: 394747 - DNA, 25 bp, Mus musculus
ttggaagataacaagactcagatta

SEQ ID NO: 394748 - DNA, 25 bp, Mus musculus
ttggaagatgtcggtcaataggctt

SEQ ID NO: 394749 - DNA, 25 bp, Mus musculus
ttggaagcaacaaggctgagatggt

SEQ ID NO: 394750 - DNA, 25 bp, Mus musculus
ttggaagcatagaaggcctactcac

SEQ ID NO: 394751 - DNA, 25 bp, Mus musculus
ttggaagccaagatttcctggccat

SEQ ID NO: 394752 - DNA, 25 bp, Mus musculus
ttggaagccaagggtgtaaattccc

SEQ ID NO: 394753 - DNA, 25 bp, Mus musculus
ttggaagccaggagattagagtggg

SEQ ID NO: 394754 - DNA, 25 bp, Mus musculus
ttggaagccaggagtgggcctgagg

SEQ ID NO: 394755 - DNA, 25 bp, Mus musculus
ttggaagcgagacagggactctgat

SEQ ID NO: 394756 - DNA, 25 bp, Mus musculus
ttggaaggaagttctcctcggacca

SEQ ID NO: 394757 - DNA, 25 bp, Mus musculus
ttggaaggacaaggttgttgacctc

SEQ ID NO: 394758 - DNA, 25 bp, Mus musculus
ttggaaggaggccatgtcatgattg

SEQ ID NO: 394759 - DNA, 25 bp, Mus musculus
ttggaagggcatcaggcggtatgaa

SEQ ID NO: 394760 - DNA, 25 bp, Mus musculus
ttggaagtgagggaagatggagata

SEQ ID NO: 394761 - DNA, 25 bp, Mus musculus
ttggaagttttttgggcattgttgt

SEQ ID NO: 394762 - DNA, 25 bp, Mus musculus
ttggaagttttttggttgcaaggaa

SEQ ID NO: 394763 - DNA, 25 bp, Mus musculus
ttggaataaaggaaacaagctccca

SEQ ID NO: 394764 - DNA, 25 bp, Mus musculus
ttggaatacagtgccgtgatgtgag

SEQ ID NO: 394765 - DNA, 25 bp, Mus musculus
ttggaatcagggctacggctaccag

SEQ ID NO: 394766 - DNA, 25 bp, Mus musculus
ttggaatcaggtggacagcagcaaa

SEQ ID NO: 394767 - DNA, 25 bp, Mus musculus
ttggaatcctggacagaaccagctc

SEQ ID NO: 394768 - DNA, 25 bp, Mus musculus
ttggaatcgcagttactgtgggaaa

SEQ ID NO: 394769 - DNA, 25 bp, Mus musculus
ttggaatctcaaggatgtcacagtg

SEQ ID NO: 394770 - DNA, 25 bp, Mus musculus
ttggaatctccctgagcaagagtgg

SEQ ID NO: 394771 - DNA, 25 bp, Mus musculus
ttggaatgaagggtcctgtggctgt

SEQ ID NO: 394772 - DNA, 25 bp, Mus musculus
ttggaatgaccgagagtgggaccgt

SEQ ID NO: 394773 - DNA, 25 bp, Mus musculus
ttggaatgagactgcagatcttgga

SEQ ID NO: 394774 - DNA, 25 bp, Mus musculus
ttggaatgattaatgacaccaattc

SEQ ID NO: 394775 - DNA, 25 bp, Mus musculus
ttggaattgaagatggatcacctac

SEQ ID NO: 394776 - DNA, 25 bp, Mus musculus
ttggaattgatccgatttggaacct

SEQ ID NO: 394777 - DNA, 25 bp, Mus musculus
ttggaattgatccgtgtgccattga

SEQ ID NO: 394778 - DNA, 25 bp, Mus musculus
ttggaattggtggtgtgacaaacgg

SEQ ID NO: 394779 - DNA, 25 bp, Mus musculus
ttggaatttatggtacaggaaaact

SEQ ID NO: 394780 - DNA, 25 bp, Mus musculus
ttggacaacataaggaagtcagaca

SEQ ID NO: 394781 - DNA, 25 bp, Mus musculus
ttggacaacgagagctggggctttg

SEQ ID NO: 394782 - DNA, 25 bp, Mus musculus
ttggacaacgagagttctgcctgct

SEQ ID NO: 394783 - DNA, 25 bp, Mus musculus
ttggacaagaggtgcaccatggagc

SEQ ID NO: 394784 - DNA, 25 bp, Mus musculus
ttggacaagatgtttaagacaaggg

SEQ ID NO: 394785 - DNA, 25 bp, Mus musculus
ttggacaatgtaaagaaccctgtgt

SEQ ID NO: 394786 - DNA, 25 bp, Mus musculus
ttggacacgctatggcaatctttaa

SEQ ID NO: 394787 - DNA, 25 bp, Mus musculus
ttggacagatcaagaacctgctggg

SEQ ID NO: 394788 - DNA, 25 bp, Mus musculus
ttggacagatcaagcgtctcagaat

SEQ ID NO: 394789 - DNA, 25 bp, Mus musculus
ttggacagcaagggccatgtgaaac

SEQ ID NO: 394790 - DNA, 25 bp, Mus musculus
ttggacagtctgcagcatgtgtgaa

SEQ ID NO: 394791 - DNA, 25 bp, Mus musculus
ttggacagtgagcctcgaggtctcc

SEQ ID NO: 394792 - DNA, 25 bp, Mus musculus
ttggacagtgagctggtgacccctc

SEQ ID NO: 394793 - DNA, 25 bp, Mus musculus
ttggacatgatctccacatcttatc

SEQ ID NO: 394794 - DNA, 25 bp, Mus musculus
ttggacatgccagggctgtagcagt

SEQ ID NO: 394795 - DNA, 25 bp, Mus musculus
ttggacatgctgtgaatattctaga

SEQ ID NO: 394796 - DNA, 25 bp, Mus musculus
ttggacatgctgtgatggacatact

SEQ ID NO: 394797 - DNA, 25 bp, Mus musculus
ttggacatggactgaagcccttaga

SEQ ID NO: 394798 - DNA, 25 bp, Mus musculus
ttggacatggcccttagatgttgca

SEQ ID NO: 394799 - DNA, 25 bp, Mus musculus
ttggaccacaccagcattcggaggg

SEQ ID NO: 394800 - DNA, 25 bp, Mus musculus
ttggaccacaccagttcctctaatt

SEQ ID NO: 394801 - DNA, 25 bp, Mus musculus
ttggaccacctggtccaagagggtt

SEQ ID NO: 394802 - DNA, 25 bp, Mus musculus
ttggaccacgctatggttttggaga

SEQ ID NO: 394803 - DNA, 25 bp, Mus musculus
ttggaccactcaaatgggcataggt

SEQ ID NO: 394804 - DNA, 25 bp, Mus musculus
ttggaccagcagagaaattcaaagg

SEQ ID NO: 394805 - DNA, 25 bp, Mus musculus
ttggacccaggagccgggtgtgggc

SEQ ID NO: 394806 - DNA, 25 bp, Mus musculus
ttggacccatcagctatgtggtggt

SEQ ID NO: 394807 - DNA, 25 bp, Mus musculus
ttggaccccaaatgattataagcac

SEQ ID NO: 394808 - DNA, 25 bp, Mus musculus
ttggaccccaccccgctggctgcct

SEQ ID NO: 394809 - DNA, 25 bp, Mus musculus
ttggaccccagggtccattcagaag

SEQ ID NO: 394810 - DNA, 25 bp, Mus musculus
ttggaccgactgcttactgatgtca

SEQ ID NO: 394811 - DNA, 25 bp, Mus musculus
ttggaccgactggttactgatgtca

SEQ ID NO: 394812 - DNA, 25 bp, Mus musculus
ttggaccggcacgtgtcggagctcc

SEQ ID NO: 394813 - DNA, 25 bp, Mus musculus
ttggacctcagagatgaggagtttg

SEQ ID NO: 394814 - DNA, 25 bp, Mus musculus
ttggacctgaggtggcatctttagc

SEQ ID NO: 394815 - DNA, 25 bp, Mus musculus
ttggaccttaagatttcctattatg

SEQ ID NO: 394816 - DNA, 25 bp, Mus musculus
ttggaccttcagaaggaagacaaca

SEQ ID NO: 394817 - DNA, 25 bp, Mus musculus
ttggacggacagaatacaccatcac

SEQ ID NO: 394818 - DNA, 25 bp, Mus musculus
ttggacggccagggggtggcaccga

SEQ ID NO: 394819 - DNA, 25 bp, Mus musculus
ttggacggcttgactaaaatacaaa

SEQ ID NO: 394820 - DNA, 25 bp, Mus musculus
ttggacggcttgatgaggtctcccg

SEQ ID NO: 394821 - DNA, 25 bp, Mus musculus
ttggacggcttgatgagtaagaaag

SEQ ID NO: 394822 - DNA, 25 bp, Mus musculus
ttggacggcttggggatccagcacc

SEQ ID NO: 394823 - DNA, 25 bp, Mus musculus
ttggactatataagatatccagaaa

SEQ ID NO: 394824 - DNA, 25 bp, Mus musculus
ttggactatataaggtaaatgaatt

SEQ ID NO: 394825 - DNA, 25 bp, Mus musculus
ttggactcagaggcttgctgcattt

SEQ ID NO: 394826 - DNA, 25 bp, Mus musculus
ttggactcatgagagcaaagaccat

SEQ ID NO: 394827 - DNA, 25 bp, Mus musculus
ttggactcgagctcagagctctggt

SEQ ID NO: 394828 - DNA, 25 bp, Mus musculus
ttggactcgagtgtgacagttgtga

SEQ ID NO: 394829 - DNA, 25 bp, Mus musculus
ttggactgaaggtacgcagggaata

SEQ ID NO: 394830 - DNA, 25 bp, Mus musculus
ttggactgcagactgccgaatacac

SEQ ID NO: 394831 - DNA, 25 bp, Mus musculus
ttggactgcagactggcatccgtct

SEQ ID NO: 394832 - DNA, 25 bp, Mus musculus
ttggactgcagcctaaatggcaaaa

SEQ ID NO: 394833 - DNA, 25 bp, Mus musculus
ttggactgccagggtcacgtggtac

SEQ ID NO: 394834 - DNA, 25 bp, Mus musculus
ttggactgccagtacttggctccag

SEQ ID NO: 394835 - DNA, 25 bp, Mus musculus
ttggactggaaaggtggtctacttc

SEQ ID NO: 394836 - DNA, 25 bp, Mus musculus
ttggactggaaaggttggtttcttc

SEQ ID NO: 394837 - DNA, 25 bp, Mus musculus
ttggactggtttggtgttcatcatg

SEQ ID NO: 394838 - DNA, 25 bp, Mus musculus
ttggactgtaccgaggtctgatccc

SEQ ID NO: 394839 - DNA, 25 bp, Mus musculus
ttggactgtatcaagcaatgtgacc

SEQ ID NO: 394840 - DNA, 25 bp, Mus musculus
ttggacttcagccctagtctgaaga

SEQ ID NO: 394841 - DNA, 25 bp, Mus musculus
ttggacttgagcagcgaccactgaa

SEQ ID NO: 394842 - DNA, 25 bp, Mus musculus
ttggacttgcaagctctttacagtt

SEQ ID NO: 394843 - DNA, 25 bp, Mus musculus
ttggacttgcaagtctctttacaga

SEQ ID NO: 394844 - DNA, 25 bp, Mus musculus
ttggactttgcaaggcagtactacg

SEQ ID NO: 394845 - DNA, 25 bp, Mus musculus
ttggagaaaatcttggaccttcctg

SEQ ID NO: 394846 - DNA, 25 bp, Mus musculus
ttggagaaacactgaggacgggatg

SEQ ID NO: 394847 - DNA, 25 bp, Mus musculus
ttggagaaactggcagagctgtgtg

SEQ ID NO: 394848 - DNA, 25 bp, Mus musculus
ttggagaacggggtgaccgtggaga

SEQ ID NO: 394849 - DNA, 25 bp, Mus musculus
ttggagaagagcagtacactaggta

SEQ ID NO: 394850 - DNA, 25 bp, Mus musculus
ttggagaaggaacggaggaagatga

SEQ ID NO: 394851 - DNA, 25 bp, Mus musculus
ttggagaagggtcttatggaagtgt

SEQ ID NO: 394852 - DNA, 25 bp, Mus musculus
ttggagaatggttataagtacatgg

SEQ ID NO: 394853 - DNA, 25 bp, Mus musculus
ttggagaatgtcagattccagatta

SEQ ID NO: 394854 - DNA, 25 bp, Mus musculus
ttggagaattacagtactgtttatc

SEQ ID NO: 394855 - DNA, 25 bp, Mus musculus
ttggagacatgagcagctactccat

SEQ ID NO: 394856 - DNA, 25 bp, Mus musculus
ttggagacatgaggaactcagccac

SEQ ID NO: 394857 - DNA, 25 bp, Mus musculus
ttggagacatgagggctcatccgct

SEQ ID NO: 394858 - DNA, 25 bp, Mus musculus
ttggagacatgagtctaaggttgtg

SEQ ID NO: 394859 - DNA, 25 bp, Mus musculus
ttggagaccataggacaaggatgag

SEQ ID NO: 394860 - DNA, 25 bp, Mus musculus
ttggagaccctgagggagcgcttca

SEQ ID NO: 394861 - DNA, 25 bp, Mus musculus
ttggagactccaagggctactacat

SEQ ID NO: 394862 - DNA, 25 bp, Mus musculus
ttggagagacagaacaaggatttga

SEQ ID NO: 394863 - DNA, 25 bp, Mus musculus
ttggagaggaaaaagagagaaaagg

SEQ ID NO: 394864 - DNA, 25 bp, Mus musculus
ttggagaggaggtcttcttctccgg

SEQ ID NO: 394865 - DNA, 25 bp, Mus musculus
ttggagaggatgaggaagccatggc

SEQ ID NO: 394866 - DNA, 25 bp, Mus musculus
ttggagagtggacagaaaacatcag

SEQ ID NO: 394867 - DNA, 25 bp, Mus musculus
ttggagagtggatggcaggagaact

SEQ ID NO: 394868 - DNA, 25 bp, Mus musculus
ttggagataaacgaaattaggtcca

SEQ ID NO: 394869 - DNA, 25 bp, Mus musculus
ttggagataaacgagtgtgcaactg

SEQ ID NO: 394870 - DNA, 25 bp, Mus musculus
ttggagatagtcgggcaatcctgtg

SEQ ID NO: 394871 - DNA, 25 bp, Mus musculus
ttggagatatgagacgaaagtaggt

SEQ ID NO: 394872 - DNA, 25 bp, Mus musculus
ttggagatatgaggtactccatccg

SEQ ID NO: 394873 - DNA, 25 bp, Mus musculus
ttggagatctgagcacagccagcgt

SEQ ID NO: 394874 - DNA, 25 bp, Mus musculus
ttggagatctgagccatggatttcc

SEQ ID NO: 394875 - DNA, 25 bp, Mus musculus
ttggagatgaagtgacttcaatccc

SEQ ID NO: 394876 - DNA, 25 bp, Mus musculus
ttggagatgaagtgatgactcgttg

SEQ ID NO: 394877 - DNA, 25 bp, Mus musculus
ttggagatgacatgtttcattggca

SEQ ID NO: 394878 - DNA, 25 bp, Mus musculus
ttggagatgcttcagattctgaagg

SEQ ID NO: 394879 - DNA, 25 bp, Mus musculus
ttggagatgcttcaggactctctga

SEQ ID NO: 394880 - DNA, 25 bp, Mus musculus
ttggagatgtgggctgcgacccaat

SEQ ID NO: 394881 - DNA, 25 bp, Mus musculus
ttggagatgtgtccagaccttttag

SEQ ID NO: 394882 - DNA, 25 bp, Mus musculus
ttggagattcattgaattctgtctt

SEQ ID NO: 394883 - DNA, 25 bp, Mus musculus
ttggagattggggcctgtgttttat

SEQ ID NO: 394884 - DNA, 25 bp, Mus musculus
ttggagcaagatgagatggaccaaa

SEQ ID NO: 394885 - DNA, 25 bp, Mus musculus
ttggagcactgaagaggaacctgct

SEQ ID NO: 394886 - DNA, 25 bp, Mus musculus
ttggagcagacgcgaaactggatgg

SEQ ID NO: 394887 - DNA, 25 bp, Mus musculus
ttggagcaggcggacagagaagttc

SEQ ID NO: 394888 - DNA, 25 bp, Mus musculus
ttggagcatgaagaaaggctacagc

SEQ ID NO: 394889 - DNA, 25 bp, Mus musculus
ttggagcatgaagaagcctccagga

SEQ ID NO: 394890 - DNA, 25 bp, Mus musculus
ttggagccagcgacccatacgtgaa

SEQ ID NO: 394891 - DNA, 25 bp, Mus musculus
ttggagccagctatgtggccctaga

SEQ ID NO: 394892 - DNA, 25 bp, Mus musculus
ttggagccagctcctgctgctgaag

SEQ ID NO: 394893 - DNA, 25 bp, Mus musculus
ttggagccaggcaggtgcagtctat

SEQ ID NO: 394894 - DNA, 25 bp, Mus musculus
ttggagccaggtacgtacagacgct

SEQ ID NO: 394895 - DNA, 25 bp, Mus musculus
ttggagccgactgggctgtttccaa

SEQ ID NO: 394896 - DNA, 25 bp, Mus musculus
ttggagccgggagttgatacaaaat

SEQ ID NO: 394897 - DNA, 25 bp, Mus musculus
ttggagccgtcgactctcaggtgga

SEQ ID NO: 394898 - DNA, 25 bp, Mus musculus
ttggagctcaaccacttcggatatc

SEQ ID NO: 394899 - DNA, 25 bp, Mus musculus
ttggagctcaaggagtgtctagccc

SEQ ID NO: 394900 - DNA, 25 bp, Mus musculus
ttggagctcaggtgcccctgggagc

SEQ ID NO: 394901 - DNA, 25 bp, Mus musculus
ttggagctcgaggtaaagaaaacgt

SEQ ID NO: 394902 - DNA, 25 bp, Mus musculus
ttggagctgcagggcctgttgctca

SEQ ID NO: 394903 - DNA, 25 bp, Mus musculus
ttggagctgcaggggctctgagaca

SEQ ID NO: 394904 - DNA, 25 bp, Mus musculus
ttggagctgggaagccctggcacaa

SEQ ID NO: 394905 - DNA, 25 bp, Mus musculus
ttggagctgtcaaggccctgtggac

SEQ ID NO: 394906 - DNA, 25 bp, Mus musculus
ttggaggaagtccgccagttcctta

SEQ ID NO: 394907 - DNA, 25 bp, Mus musculus
ttggaggaataaacattgctgaggc

SEQ ID NO: 394908 - DNA, 25 bp, Mus musculus
ttggaggacagagggataagaaaaa

SEQ ID NO: 394909 - DNA, 25 bp, Mus musculus
ttggaggacagatgccctgctggca

SEQ ID NO: 394910 - DNA, 25 bp, Mus musculus
ttggaggactatggcgtttactggc

SEQ ID NO: 394911 - DNA, 25 bp, Mus musculus
ttggaggactatggggtcacatatg

SEQ ID NO: 394912 - DNA, 25 bp, Mus musculus
ttggaggagaatttaaaagaagatg

SEQ ID NO: 394913 - DNA, 25 bp, Mus musculus
ttggaggagagagaatgactctgtg

SEQ ID NO: 394914 - DNA, 25 bp, Mus musculus
ttggaggagagaggtacaatttctt

SEQ ID NO: 394915 - DNA, 25 bp, Mus musculus
ttggaggagtgggatcgagtgggat

SEQ ID NO: 394916 - DNA, 25 bp, Mus musculus
ttggaggatagaaccatcaggctgc

SEQ ID NO: 394917 - DNA, 25 bp, Mus musculus
ttggaggatagaaccgtgcgattgc

SEQ ID NO: 394918 - DNA, 25 bp, Mus musculus
ttggaggatcctccaggtggctttg

SEQ ID NO: 394919 - DNA, 25 bp, Mus musculus
ttggaggatttgaggcctacctagg

SEQ ID NO: 394920 - DNA, 25 bp, Mus musculus
ttggaggcagacgatttacatggat

SEQ ID NO: 394921 - DNA, 25 bp, Mus musculus
ttggaggccaggaatggtaccagca

SEQ ID NO: 394922 - DNA, 25 bp, Mus musculus
ttggaggccagtgcctctctgggca

SEQ ID NO: 394923 - DNA, 25 bp, Mus musculus
ttggaggctaggtcttggtttccta

SEQ ID NO: 394924 - DNA, 25 bp, Mus musculus
ttggaggctataaggtacgaaacca

SEQ ID NO: 394925 - DNA, 25 bp, Mus musculus
ttggaggctataaggtccccaggga

SEQ ID NO: 394926 - DNA, 25 bp, Mus musculus
ttggaggctgcaaaagacatttgaa

SEQ ID NO: 394927 - DNA, 25 bp, Mus musculus
ttggaggcttggagaatctccccga

SEQ ID NO: 394928 - DNA, 25 bp, Mus musculus
ttggagggagttatggggggatgct

SEQ ID NO: 394929 - DNA, 25 bp, Mus musculus
ttggagggcttgcggttccaaaggg

SEQ ID NO: 394930 - DNA, 25 bp, Mus musculus
ttggagggggtcagctagaagagtc

SEQ ID NO: 394931 - DNA, 25 bp, Mus musculus
ttggaggtctgccaggatatagctc

SEQ ID NO: 394932 - DNA, 25 bp, Mus musculus
ttggaggttatacagacagagggta

SEQ ID NO: 394933 - DNA, 25 bp, Mus musculus
ttggaggttctggaacagctaatcc

SEQ ID NO: 394934 - DNA, 25 bp, Mus musculus
ttggaggttctggacggcatttgcg

SEQ ID NO: 394935 - DNA, 25 bp, Mus musculus
ttggaggttctgggacagcaactgt

SEQ ID NO: 394936 - DNA, 25 bp, Mus musculus
ttggaggttgttaaggacaaagcag

SEQ ID NO: 394937 - DNA, 25 bp, Mus musculus
ttggaggttgttaaggacctcataa

SEQ ID NO: 394938 - DNA, 25 bp, Mus musculus
ttggagtaaattcagatgggtggcc

SEQ ID NO: 394939 - DNA, 25 bp, Mus musculus
ttggagtaacagctagaaattgcaa

SEQ ID NO: 394940 - DNA, 25 bp, Mus musculus
ttggagtaatggccttattcaggat

SEQ ID NO: 394941 - DNA, 25 bp, Mus musculus
ttggagtagatcaatccccttctgc

SEQ ID NO: 394942 - DNA, 25 bp, Mus musculus
ttggagtagatttagatgccagcac

SEQ ID NO: 394943 - DNA, 25 bp, Mus musculus
ttggagtcaagttctccaaggagag

SEQ ID NO: 394944 - DNA, 25 bp, Mus musculus
ttggagtcaggggaaatgagcatct

SEQ ID NO: 394945 - DNA, 25 bp, Mus musculus
ttggagtcaggggtcactaggattg

SEQ ID NO: 394946 - DNA, 25 bp, Mus musculus
ttggagtctcctgagagaaattttc

SEQ ID NO: 394947 - DNA, 25 bp, Mus musculus
ttggagtctcctgaggttcaggacc

SEQ ID NO: 394948 - DNA, 25 bp, Mus musculus
ttggagtgacaggtcctttcccata

SEQ ID NO: 394949 - DNA, 25 bp, Mus musculus
ttggagtgttcggggttaactgctc

SEQ ID NO: 394950 - DNA, 25 bp, Mus musculus
ttggagttaaaggtccttcacgtct

SEQ ID NO: 394951 - DNA, 25 bp, Mus musculus
ttggagttctctgtaagtgcctggt

SEQ ID NO: 394952 - DNA, 25 bp, Mus musculus
ttggataaaggataaggtagctaaa

SEQ ID NO: 394953 - DNA, 25 bp, Mus musculus
ttggataaggaggatttcagggtcc

SEQ ID NO: 394954 - DNA, 25 bp, Mus musculus
ttggataatagaatgacagcagcaa

SEQ ID NO: 394955 - DNA, 25 bp, Mus musculus
ttggatactcaggaatgggcaaagg

SEQ ID NO: 394956 - DNA, 25 bp, Mus musculus
ttggatactggaagaagccataatt

SEQ ID NO: 394957 - DNA, 25 bp, Mus musculus
ttggatagtagtgaattgaatccag

SEQ ID NO: 394958 - DNA, 25 bp, Mus musculus
ttggatatggggtgcttcgagtgct

SEQ ID NO: 394959 - DNA, 25 bp, Mus musculus
ttggatattgtcaagaagcaagact

SEQ ID NO: 394960 - DNA, 25 bp, Mus musculus
ttggatattgtcaaggaactgaaag

SEQ ID NO: 394961 - DNA, 25 bp, Mus musculus
ttggatcaaaagcaggttgtccaga

SEQ ID NO: 394962 - DNA, 25 bp, Mus musculus
ttggatcacacagtgagaccctgtc

SEQ ID NO: 394963 - DNA, 25 bp, Mus musculus
ttggatcccaaaattcccagttaag

SEQ ID NO: 394964 - DNA, 25 bp, Mus musculus
ttggatccctctgtgcactgagcag

SEQ ID NO: 394965 - DNA, 25 bp, Mus musculus
ttggatccctctgttttgccattgc

SEQ ID NO: 394966 - DNA, 25 bp, Mus musculus
ttggatcgaaggcacggagggagtt

SEQ ID NO: 394967 - DNA, 25 bp, Mus musculus
ttggatctactgagcgcagccttgg

SEQ ID NO: 394968 - DNA, 25 bp, Mus musculus
ttggatctactggttctgcagtaca

SEQ ID NO: 394969 - DNA, 25 bp, Mus musculus
ttggatctactgtgggcccagccac

SEQ ID NO: 394970 - DNA, 25 bp, Mus musculus
ttggatctcataagagaggagccaa

SEQ ID NO: 394971 - DNA, 25 bp, Mus musculus
ttggatcttcccgctctgtgaccag

SEQ ID NO: 394972 - DNA, 25 bp, Mus musculus
ttggatcttcccggttctcggactc

SEQ ID NO: 394973 - DNA, 25 bp, Mus musculus
ttggatgaactgtatgacatcatgt

SEQ ID NO: 394974 - DNA, 25 bp, Mus musculus
ttggatgaccagagagtgatgtgga

SEQ ID NO: 394975 - DNA, 25 bp, Mus musculus
ttggatgaccagagccccgggcctc

SEQ ID NO: 394976 - DNA, 25 bp, Mus musculus
ttggatgatacagacgtcctacaac

SEQ ID NO: 394977 - DNA, 25 bp, Mus musculus
ttggatgcaagctatgccccctcaa

SEQ ID NO: 394978 - DNA, 25 bp, Mus musculus
ttggatgcacagcagtatgagttca

SEQ ID NO: 394979 - DNA, 25 bp, Mus musculus
ttggatgcacaggagtatgagttca

SEQ ID NO: 394980 - DNA, 25 bp, Mus musculus
ttggatgcctgggaggccatggagg

SEQ ID NO: 394981 - DNA, 25 bp, Mus musculus
ttggatgctgaggacatcgtgaaca

SEQ ID NO: 394982 - DNA, 25 bp, Mus musculus
ttggatgctgaggatattgtaggca

SEQ ID NO: 394983 - DNA, 25 bp, Mus musculus
ttggatgctgagggcactctgaggc

SEQ ID NO: 394984 - DNA, 25 bp, Mus musculus
ttggatggagaggttggtacaggcc

SEQ ID NO: 394985 - DNA, 25 bp, Mus musculus
ttggatggagccaaaaacaatacag

SEQ ID NO: 394986 - DNA, 25 bp, Mus musculus
ttggatggagcgtcagtgagtgaaa

SEQ ID NO: 394987 - DNA, 25 bp, Mus musculus
ttggatggcagctgtccggcagaga

SEQ ID NO: 394988 - DNA, 25 bp, Mus musculus
ttggatgtaaagacctctcgggaac

SEQ ID NO: 394989 - DNA, 25 bp, Mus musculus
ttggatgttgaggttctctgctgcc

SEQ ID NO: 394990 - DNA, 25 bp, Mus musculus
ttggattacaggtgaccaggactgt

SEQ ID NO: 394991 - DNA, 25 bp, Mus musculus
ttggattacaggtggtgctctgggt

SEQ ID NO: 394992 - DNA, 25 bp, Mus musculus
ttggattatgggtgggtgcatcctt

SEQ ID NO: 394993 - DNA, 25 bp, Mus musculus
ttggattatggtccacagtgaggac

SEQ ID NO: 394994 - DNA, 25 bp, Mus musculus
ttggattcagtttctttagaatgtg

SEQ ID NO: 394995 - DNA, 25 bp, Mus musculus
ttggattcataggggcttcttctgc

SEQ ID NO: 394996 - DNA, 25 bp, Mus musculus
ttggattccgccattgatcttatca

SEQ ID NO: 394997 - DNA, 25 bp, Mus musculus
ttggattcgctccggtgtaatggat

SEQ ID NO: 394998 - DNA, 25 bp, Mus musculus
ttggattgacaggtcccaggtcgct

SEQ ID NO: 394999 - DNA, 25 bp, Mus musculus
ttggattgacaggtctgaacggcgt

SEQ ID NO: 395000 - DNA, 25 bp, Mus musculus
ttggatttgccaactgtttctatac

SEQ ID NO: 395001 - DNA, 25 bp, Mus musculus
ttggatttgccaagaggagctctgg

SEQ ID NO: 395002 - DNA, 25 bp, Mus musculus
ttggatttgccaatgcccagcagag

SEQ ID NO: 395003 - DNA, 25 bp, Mus musculus
ttggatttgtggagtctggccacag

SEQ ID NO: 395004 - DNA, 25 bp, Mus musculus
ttggatttgtgggggccagaacaat

SEQ ID NO: 395005 - DNA, 25 bp, Mus musculus
ttggcaaaaccaggtgcagatccct

SEQ ID NO: 395006 - DNA, 25 bp, Mus musculus
ttggcaaatggagtattggcttccc

SEQ ID NO: 395007 - DNA, 25 bp, Mus musculus
ttggcaacaacgctctggtgcaagt

SEQ ID NO: 395008 - DNA, 25 bp, Mus musculus
ttggcaacagaccccaatatcctga

SEQ ID NO: 395009 - DNA, 25 bp, Mus musculus
ttggcaacagacctgcctggagttg

SEQ ID NO: 395010 - DNA, 25 bp, Mus musculus
ttggcaacagcaaggtgcacatgta

SEQ ID NO: 395011 - DNA, 25 bp, Mus musculus
ttggcaacagcaagtgctgacagta

SEQ ID NO: 395012 - DNA, 25 bp, Mus musculus
ttggcaacagggtctctgtgatgag

SEQ ID NO: 395013 - DNA, 25 bp, Mus musculus
ttggcaacagttggaacgctatctt

SEQ ID NO: 395014 - DNA, 25 bp, Mus musculus
ttggcaacgaaaggtctccgggcac

SEQ ID NO: 395015 - DNA, 25 bp, Mus musculus
ttggcaagagcgcagatctccccta

SEQ ID NO: 395016 - DNA, 25 bp, Mus musculus
ttggcaagagcgcaggtccaacttc

SEQ ID NO: 395017 - DNA, 25 bp, Mus musculus
ttggcaagcagtggtgacgtatgcc

SEQ ID NO: 395018 - DNA, 25 bp, Mus musculus
ttggcaagtgctccggccattccag

SEQ ID NO: 395019 - DNA, 25 bp, Mus musculus
ttggcaagtttgggcctgccttaag

SEQ ID NO: 395020 - DNA, 25 bp, Mus musculus
ttggcaataatggaagtgggaagag

SEQ ID NO: 395021 - DNA, 25 bp, Mus musculus
ttggcaatctatgattcctgtgttg

SEQ ID NO: 395022 - DNA, 25 bp, Mus musculus
ttggcaatgatggaagcaattttgg

SEQ ID NO: 395023 - DNA, 25 bp, Mus musculus
ttggcaatgatggtggctatggcgg

SEQ ID NO: 395024 - DNA, 25 bp, Mus musculus
ttggcaatgatggtggttatggagg

SEQ ID NO: 395025 - DNA, 25 bp, Mus musculus
ttggcaatgcaaaacttgcagtaat

SEQ ID NO: 395026 - DNA, 25 bp, Mus musculus
ttggcacagcagttccgcagaggac

SEQ ID NO: 395027 - DNA, 25 bp, Mus musculus
ttggcacatacgtgcagttctccgt

SEQ ID NO: 395028 - DNA, 25 bp, Mus musculus
ttggcacccaaatgcctggggagga

SEQ ID NO: 395029 - DNA, 25 bp, Mus musculus
ttggcacccaaatgttgataaaaat

SEQ ID NO: 395030 - DNA, 25 bp, Mus musculus
ttggcacctgaggacaaagtctgga

SEQ ID NO: 395031 - DNA, 25 bp, Mus musculus
ttggcacctggggtggaggcaggga

SEQ ID NO: 395032 - DNA, 25 bp, Mus musculus
ttggcactgcaggaagaagaggaaa

SEQ ID NO: 395033 - DNA, 25 bp, Mus musculus
ttggcacttggtgagagccctgaag

SEQ ID NO: 395034 - DNA, 25 bp, Mus musculus
ttggcagaaagcaaaaaattgcaaa

SEQ ID NO: 395035 - DNA, 25 bp, Mus musculus
ttggcagaagaggagaaagagaaaa

SEQ ID NO: 395036 - DNA, 25 bp, Mus musculus
ttggcagaagctctgcagatccaca

SEQ ID NO: 395037 - DNA, 25 bp, Mus musculus
ttggcagaaggtagcacggcttctc

SEQ ID NO: 395038 - DNA, 25 bp, Mus musculus
ttggcagacccgagttgaaaaatct

SEQ ID NO: 395039 - DNA, 25 bp, Mus musculus
ttggcagacttcttctcctcggacc

SEQ ID NO: 395040 - DNA, 25 bp, Mus musculus
ttggcagagaagcttaagtgtgata

SEQ ID NO: 395041 - DNA, 25 bp, Mus musculus
ttggcagagaaggcagtattgcaac

SEQ ID NO: 395042 - DNA, 25 bp, Mus musculus
ttggcagaggaggctccgtgcccgc

SEQ ID NO: 395043 - DNA, 25 bp, Mus musculus
ttggcagaggagtgacatcactgag

SEQ ID NO: 395044 - DNA, 25 bp, Mus musculus
ttggcagaggtgagtaaaaagaaga

SEQ ID NO: 395045 - DNA, 25 bp, Mus musculus
ttggcagaggtggataactgcacaa

SEQ ID NO: 395046 - DNA, 25 bp, Mus musculus
ttggcagatgaggagaaaaagttac

SEQ ID NO: 395047 - DNA, 25 bp, Mus musculus
ttggcagcccaaggattccagcttt

SEQ ID NO: 395048 - DNA, 25 bp, Mus musculus
ttggcagcccaagtctttgcagatt

SEQ ID NO: 395049 - DNA, 25 bp, Mus musculus
ttggcaggattacaggactggatcc

SEQ ID NO: 395050 - DNA, 25 bp, Mus musculus
ttggcaggctgcaggagctcttagg

SEQ ID NO: 395051 - DNA, 25 bp, Mus musculus
ttggcaggctgcaggtaactagttc

SEQ ID NO: 395052 - DNA, 25 bp, Mus musculus
ttggcagtcacaggttggatgaaaa

SEQ ID NO: 395053 - DNA, 25 bp, Mus musculus
ttggcagtgcaggggtacgcacgcg

SEQ ID NO: 395054 - DNA, 25 bp, Mus musculus
ttggcagtggccagacaggtggagt

SEQ ID NO: 395055 - DNA, 25 bp, Mus musculus
ttggcagttttgggggctcgccata

SEQ ID NO: 395056 - DNA, 25 bp, Mus musculus
ttggcatcaaggagacatcaacaag

SEQ ID NO: 395057 - DNA, 25 bp, Mus musculus
ttggcatcaaggagcaggacatcaa

SEQ ID NO: 395058 - DNA, 25 bp, Mus musculus
ttggcatcaatcatggaaaggattt

SEQ ID NO: 395059 - DNA, 25 bp, Mus musculus
ttggcatcagaccacagcagtttag

SEQ ID NO: 395060 - DNA, 25 bp, Mus musculus
ttggcatccaaggtccagggagttg

SEQ ID NO: 395061 - DNA, 25 bp, Mus musculus
ttggcatctacaaggctcacttgta

SEQ ID NO: 395062 - DNA, 25 bp, Mus musculus
ttggcatctacaagggcgccaaagc

SEQ ID NO: 395063 - DNA, 25 bp, Mus musculus
ttggcatctgcaatgccgcgccagt

SEQ ID NO: 395064 - DNA, 25 bp, Mus musculus
ttggcatgaaaggaggaagcggctg

SEQ ID NO: 395065 - DNA, 25 bp, Mus musculus
ttggcatgaaaggcccagcttcggt

SEQ ID NO: 395066 - DNA, 25 bp, Mus musculus
ttggcatgaaaggttttgttttgtt

SEQ ID NO: 395067 - DNA, 25 bp, Mus musculus
ttggcatgaccaagttcatgaagcc

SEQ ID NO: 395068 - DNA, 25 bp, Mus musculus
ttggcatgctggtttcaccatcgct

SEQ ID NO: 395069 - DNA, 25 bp, Mus musculus
ttggcattataaaccgtgtcagcat

SEQ ID NO: 395070 - DNA, 25 bp, Mus musculus
ttggcattatgtgccctccgtttta

SEQ ID NO: 395071 - DNA, 25 bp, Mus musculus
ttggccaaagttatctccctaggcg

SEQ ID NO: 395072 - DNA, 25 bp, Mus musculus
ttggccaaatggcaccgctccaaag

SEQ ID NO: 395073 - DNA, 25 bp, Mus musculus
ttggccaacaagagtcctcgttgaa

SEQ ID NO: 395074 - DNA, 25 bp, Mus musculus
ttggccaacaagagtgatctgtccc

SEQ ID NO: 395075 - DNA, 25 bp, Mus musculus
ttggccaacaaggtcgtatacaacg

SEQ ID NO: 395076 - DNA, 25 bp, Mus musculus
ttggccaagcagcagatgcatattg

SEQ ID NO: 395077 - DNA, 25 bp, Mus musculus
ttggccacaccaaggtgttcttcaa

SEQ ID NO: 395078 - DNA, 25 bp, Mus musculus
ttggccaccacacagagtcattctc

SEQ ID NO: 395079 - DNA, 25 bp, Mus musculus
ttggccaccactcctaatagtacag

SEQ ID NO: 395080 - DNA, 25 bp, Mus musculus
ttggccaccagagatcgagactcat

SEQ ID NO: 395081 - DNA, 25 bp, Mus musculus
ttggccaccattgcaagtactccac

SEQ ID NO: 395082 - DNA, 25 bp, Mus musculus
ttggccaccattgcctcaactgtgc

SEQ ID NO: 395083 - DNA, 25 bp, Mus musculus
ttggccacggatccgggaggagatc

SEQ ID NO: 395084 - DNA, 25 bp, Mus musculus
ttggccacgggctccggccattgga

SEQ ID NO: 395085 - DNA, 25 bp, Mus musculus
ttggccacgtcaagactctggaagc

SEQ ID NO: 395086 - DNA, 25 bp, Mus musculus
ttggccacgtcaagatgtcacgtga

SEQ ID NO: 395087 - DNA, 25 bp, Mus musculus
ttggccactgatagtgcctttgatg

SEQ ID NO: 395088 - DNA, 25 bp, Mus musculus
ttggccagacagctgagaaggtaga

SEQ ID NO: 395089 - DNA, 25 bp, Mus musculus
ttggccagcctggcacggatgcttg

SEQ ID NO: 395090 - DNA, 25 bp, Mus musculus
ttggccaggaaggggagccaggccg

SEQ ID NO: 395091 - DNA, 25 bp, Mus musculus
ttggccatgagatgagatggaccaa

SEQ ID NO: 395092 - DNA, 25 bp, Mus musculus
ttggccatgtgttcaagcgctgtct

SEQ ID NO: 395093 - DNA, 25 bp, Mus musculus
ttggcccacactggcagccaccacc

SEQ ID NO: 395094 - DNA, 25 bp, Mus musculus
ttggcccacgcctgtgtaggcttgt

SEQ ID NO: 395095 - DNA, 25 bp, Mus musculus
ttggccccaaaggtgtgaacattgg

SEQ ID NO: 395096 - DNA, 25 bp, Mus musculus
ttggccccagaagtcggtgaccttt

SEQ ID NO: 395097 - DNA, 25 bp, Mus musculus
ttggccccagggcctgagccatgga

SEQ ID NO: 395098 - DNA, 25 bp, Mus musculus
ttggcccggcccactcagaggctga

SEQ ID NO: 395099 - DNA, 25 bp, Mus musculus
ttggccctcagggtcccacaggaga

SEQ ID NO: 395100 - DNA, 25 bp, Mus musculus
ttggccctccttcacgtagaaaatc

SEQ ID NO: 395101 - DNA, 25 bp, Mus musculus
ttggccctgagatgacaaatcctct

SEQ ID NO: 395102 - DNA, 25 bp, Mus musculus
ttggccctggtggatcagaacaagt

SEQ ID NO: 395103 - DNA, 25 bp, Mus musculus
ttggccctgttgcagccccaccatg

SEQ ID NO: 395104 - DNA, 25 bp, Mus musculus
ttggccctgttgcaggttctgccac

SEQ ID NO: 395105 - DNA, 25 bp, Mus musculus
ttggcccttcaggagccacgtcagt

SEQ ID NO: 395106 - DNA, 25 bp, Mus musculus
ttggcccttcaggaggcagcagaag

SEQ ID NO: 395107 - DNA, 25 bp, Mus musculus
ttggccgagagatgaaaaatgatag

SEQ ID NO: 395108 - DNA, 25 bp, Mus musculus
ttggccgagaggcaagaagagaggc

SEQ ID NO: 395109 - DNA, 25 bp, Mus musculus
ttggccgcaggttctctccactatg

SEQ ID NO: 395110 - DNA, 25 bp, Mus musculus
ttggccgcctagcaggaactgtcta

SEQ ID NO: 395111 - DNA, 25 bp, Mus musculus
ttggccgcctagcagtttgttttgt

SEQ ID NO: 395112 - DNA, 25 bp, Mus musculus
ttggccgggctggtccctctgtcac

SEQ ID NO: 395113 - DNA, 25 bp, Mus musculus
ttggccggtacaagcttcctgacag

SEQ ID NO: 395114 - DNA, 25 bp, Mus musculus
ttggccgtaggtttagtctccactg

SEQ ID NO: 395115 - DNA, 25 bp, Mus musculus
ttggcctataggaagtttggtgagc

SEQ ID NO: 395116 - DNA, 25 bp, Mus musculus
ttggcctatgcaggagggagcctca

SEQ ID NO: 395117 - DNA, 25 bp, Mus musculus
ttggcctatgcaggtgtgctgatga

SEQ ID NO: 395118 - DNA, 25 bp, Mus musculus
ttggcctattttggatttcagtgaa

SEQ ID NO: 395119 - DNA, 25 bp, Mus musculus
ttggcctattttggcaactccgaag

SEQ ID NO: 395120 - DNA, 25 bp, Mus musculus
ttggcctccacagaggttgtgccca

SEQ ID NO: 395121 - DNA, 25 bp, Mus musculus
ttggcctccgtcaacactgaggcct

SEQ ID NO: 395122 - DNA, 25 bp, Mus musculus
ttggcctctcagaaaacatccagta

SEQ ID NO: 395123 - DNA, 25 bp, Mus musculus
ttggcctctcaggtcaaaggctgag

SEQ ID NO: 395124 - DNA, 25 bp, Mus musculus
ttggcctctttaaaagaacagatgc

SEQ ID NO: 395125 - DNA, 25 bp, Mus musculus
ttggcctctttaaattgaaaataca

SEQ ID NO: 395126 - DNA, 25 bp, Mus musculus
ttggcctgctgaggactggctgccc

SEQ ID NO: 395127 - DNA, 25 bp, Mus musculus
ttggcctggcaggcccttttagcta

SEQ ID NO: 395128 - DNA, 25 bp, Mus musculus
ttggcctgtggtcaaaatccagttt

SEQ ID NO: 395129 - DNA, 25 bp, Mus musculus
ttggcctgttgggtcacttccctcc

SEQ ID NO: 395130 - DNA, 25 bp, Mus musculus
ttggccttagtcctgatgctgtcta

SEQ ID NO: 395131 - DNA, 25 bp, Mus musculus
ttggccttcaaatctgcagaagaag

SEQ ID NO: 395132 - DNA, 25 bp, Mus musculus
ttggccttcagaatacccggaggcc

SEQ ID NO: 395133 - DNA, 25 bp, Mus musculus
ttggccttcagagctccagatacct

SEQ ID NO: 395134 - DNA, 25 bp, Mus musculus
ttggccttgacaatatcaacatgac

SEQ ID NO: 395135 - DNA, 25 bp, Mus musculus
ttggcctttacagagatgagcatca

SEQ ID NO: 395136 - DNA, 25 bp, Mus musculus
ttggcctttgagtagagtatcactt

SEQ ID NO: 395137 - DNA, 25 bp, Mus musculus
ttggccttttatcaggttccttagc

SEQ ID NO: 395138 - DNA, 25 bp, Mus musculus
ttggcgaaaatcagatcaaagatga

SEQ ID NO: 395139 - DNA, 25 bp, Mus musculus
ttggcgaccttcagggaaaatgcca

SEQ ID NO: 395140 - DNA, 25 bp, Mus musculus
ttggcgaggactagtgttacaggtg

SEQ ID NO: 395141 - DNA, 25 bp, Mus musculus
ttggcgattaaaggcctgaagctca

SEQ ID NO: 395142 - DNA, 25 bp, Mus musculus
ttggcgattagactctgccttcagg

SEQ ID NO: 395143 - DNA, 25 bp, Mus musculus
ttggcgattagaggtctgacatggc

SEQ ID NO: 395144 - DNA, 25 bp, Mus musculus
ttggcgccaaaggggccaaggagaa

SEQ ID NO: 395145 - DNA, 25 bp, Mus musculus
ttggcgcctactcagggctaacatc

SEQ ID NO: 395146 - DNA, 25 bp, Mus musculus
ttggcgcctgaggtgctagaggaca

SEQ ID NO: 395147 - DNA, 25 bp, Mus musculus
ttggcgcgatgtctcacaccatttt

SEQ ID NO: 395148 - DNA, 25 bp, Mus musculus
ttggcgcgatgtgcctgcgacagac

SEQ ID NO: 395149 - DNA, 25 bp, Mus musculus
ttggcgctttcttagatgttgcctt

SEQ ID NO: 395150 - DNA, 25 bp, Mus musculus
ttggcggagagagtacccagtatta

SEQ ID NO: 395151 - DNA, 25 bp, Mus musculus
ttggcggaggagataggcgtttcta

SEQ ID NO: 395152 - DNA, 25 bp, Mus musculus
ttggcggcgaagaggtcctgagttc

SEQ ID NO: 395153 - DNA, 25 bp, Mus musculus
ttggcggcgaagtctcccctcacca

SEQ ID NO: 395154 - DNA, 25 bp, Mus musculus
ttggcggcgtgagcccagatcatgc

SEQ ID NO: 395155 - DNA, 25 bp, Mus musculus
ttggcggtaccagcccctctcccga

SEQ ID NO: 395156 - DNA, 25 bp, Mus musculus
ttggcggtggtagtggaagcaattt

SEQ ID NO: 395157 - DNA, 25 bp, Mus musculus
ttggcggtggtagtggtggctatgg

SEQ ID NO: 395158 - DNA, 25 bp, Mus musculus
ttggcgtgagcggaggctgctgaac

SEQ ID NO: 395159 - DNA, 25 bp, Mus musculus
ttggcgttatgggtgtgataggtat

SEQ ID NO: 395160 - DNA, 25 bp, Mus musculus
ttggcgttatgtttgagatggtatc

SEQ ID NO: 395161 - DNA, 25 bp, Mus musculus
ttggcgttcaacaggtggtgtccgg

SEQ ID NO: 395162 - DNA, 25 bp, Mus musculus
ttggcgttttagtgaacaacgtggg

SEQ ID NO: 395163 - DNA, 25 bp, Mus musculus
ttggctaactctgagggcacgtcag

SEQ ID NO: 395164 - DNA, 25 bp, Mus musculus
ttggctaactctgagttcctgaaat

SEQ ID NO: 395165 - DNA, 25 bp, Mus musculus
ttggctaatggagcccgctgtgagg

SEQ ID NO: 395166 - DNA, 25 bp, Mus musculus
ttggctaccagggacctcctggccg

SEQ ID NO: 395167 - DNA, 25 bp, Mus musculus
ttggctactgccaggcaatgaacat

SEQ ID NO: 395168 - DNA, 25 bp, Mus musculus
ttggctagcaggtattcatgctagc

SEQ ID NO: 395169 - DNA, 25 bp, Mus musculus
ttggctagctgcacatccctacaaa

SEQ ID NO: 395170 - DNA, 25 bp, Mus musculus
ttggctataaaaaatgccaggcaga

SEQ ID NO: 395171 - DNA, 25 bp, Mus musculus
ttggctatatcaagtttcatgcagg

SEQ ID NO: 395172 - DNA, 25 bp, Mus musculus
ttggctatcaggatgactttctgct

SEQ ID NO: 395173 - DNA, 25 bp, Mus musculus
ttggctatgaagaatgcccatatca

SEQ ID NO: 395174 - DNA, 25 bp, Mus musculus
ttggctatgaagccacattgggatt

SEQ ID NO: 395175 - DNA, 25 bp, Mus musculus
ttggctatgccagctcttctcctat

SEQ ID NO: 395176 - DNA, 25 bp, Mus musculus
ttggctatgccaggaacccatctct

SEQ ID NO: 395177 - DNA, 25 bp, Mus musculus
ttggctatgtgtatggcttggcaaa

SEQ ID NO: 395178 - DNA, 25 bp, Mus musculus
ttggctatgtgtatggtgattccac

SEQ ID NO: 395179 - DNA, 25 bp, Mus musculus
ttggctattagagccagatcatctg

SEQ ID NO: 395180 - DNA, 25 bp, Mus musculus
ttggctattagagtgtgctcaagag

SEQ ID NO: 395181 - DNA, 25 bp, Mus musculus
ttggctatttcaggctttgatggga

SEQ ID NO: 395182 - DNA, 25 bp, Mus musculus
ttggctcaatacggttattactctg

SEQ ID NO: 395183 - DNA, 25 bp, Mus musculus
ttggctcagtcaatggagagaacaa

SEQ ID NO: 395184 - DNA, 25 bp, Mus musculus
ttggctcatcaggaggactgacaaa

SEQ ID NO: 395185 - DNA, 25 bp, Mus musculus
ttggctcatcagttggcagttctgc

SEQ ID NO: 395186 - DNA, 25 bp, Mus musculus
ttggctccagagctctctgtggttg

SEQ ID NO: 395187 - DNA, 25 bp, Mus musculus
ttggctccatgaagtacaaaggcat

SEQ ID NO: 395188 - DNA, 25 bp, Mus musculus
ttggctccgcagcagaatgccaaga

SEQ ID NO: 395189 - DNA, 25 bp, Mus musculus
ttggctcctccagggtccggtactg

SEQ ID NO: 395190 - DNA, 25 bp, Mus musculus
ttggctcctccaggtgtttgtggta

SEQ ID NO: 395191 - DNA, 25 bp, Mus musculus
ttggctctaaatgggatatccttct

SEQ ID NO: 395192 - DNA, 25 bp, Mus musculus
ttggctctatcacaggccaaaacaa

SEQ ID NO: 395193 - DNA, 25 bp, Mus musculus
ttggctctgaagattgccctctatg

SEQ ID NO: 395194 - DNA, 25 bp, Mus musculus
ttggctcttaggtaagaagacaaga

SEQ ID NO: 395195 - DNA, 25 bp, Mus musculus
ttggctcttctaaagacctcaaagg

SEQ ID NO: 395196 - DNA, 25 bp, Mus musculus
ttggctgaaaggacttctagatctg

SEQ ID NO: 395197 - DNA, 25 bp, Mus musculus
ttggctgaatgtttgttaactgaaa

SEQ ID NO: 395198 - DNA, 25 bp, Mus musculus
ttggctgacaggattgtccggagca

SEQ ID NO: 395199 - DNA, 25 bp, Mus musculus
ttggctgacagtcatgagagccgag

SEQ ID NO: 395200 - DNA, 25 bp, Mus musculus
ttggctgaccagcatattttcaatg

SEQ ID NO: 395201 - DNA, 25 bp, Mus musculus
ttggctgaccaggatattttcaatg

SEQ ID NO: 395202 - DNA, 25 bp, Mus musculus
ttggctgcacagtgtatgagaagca

SEQ ID NO: 395203 - DNA, 25 bp, Mus musculus
ttggctgcagaggtagaccctgact

SEQ ID NO: 395204 - DNA, 25 bp, Mus musculus
ttggctgcagaggtggaccctgatc

SEQ ID NO: 395205 - DNA, 25 bp, Mus musculus
ttggctgccagcgggcgaactttct

SEQ ID NO: 395206 - DNA, 25 bp, Mus musculus
ttggctgccagtagataaaagatct

SEQ ID NO: 395207 - DNA, 25 bp, Mus musculus
ttggctgccagtcttcaattagtgg

SEQ ID NO: 395208 - DNA, 25 bp, Mus musculus
ttggctgccatagcaaaaaagcaag

SEQ ID NO: 395209 - DNA, 25 bp, Mus musculus
ttggctgccataggagtcagtgact

SEQ ID NO: 395210 - DNA, 25 bp, Mus musculus
ttggctgcccaaggtgaacttgatc

SEQ ID NO: 395211 - DNA, 25 bp, Mus musculus
ttggctgcccaaggttgttgctaag

SEQ ID NO: 395212 - DNA, 25 bp, Mus musculus
ttggctgctcagctgcactgagctg

SEQ ID NO: 395213 - DNA, 25 bp, Mus musculus
ttggctgctcagtgtttcctttcag

SEQ ID NO: 395214 - DNA, 25 bp, Mus musculus
ttggctgctcccatgatgttcctgt

SEQ ID NO: 395215 - DNA, 25 bp, Mus musculus
ttggctgctttgcggactttgaatg

SEQ ID NO: 395216 - DNA, 25 bp, Mus musculus
ttggctgctttgcggtactggaatt

SEQ ID NO: 395217 - DNA, 25 bp, Mus musculus
ttggctggaccagatgcggtgagca

SEQ ID NO: 395218 - DNA, 25 bp, Mus musculus
ttggctggagagctgtgtggctgag

SEQ ID NO: 395219 - DNA, 25 bp, Mus musculus
ttggctggagggaaggtggctgggg

SEQ ID NO: 395220 - DNA, 25 bp, Mus musculus
ttggctggcgtatgaggagtgggaa

SEQ ID NO: 395221 - DNA, 25 bp, Mus musculus
ttggctggcgtgaggccaaagcaaa

SEQ ID NO: 395222 - DNA, 25 bp, Mus musculus
ttggctgggcagattggccacctgc

SEQ ID NO: 395223 - DNA, 25 bp, Mus musculus
ttggctggtccagctggtcttcaca

SEQ ID NO: 395224 - DNA, 25 bp, Mus musculus
ttggctggtccaggtacatccctga

SEQ ID NO: 395225 - DNA, 25 bp, Mus musculus
ttggctggtggagtgttctccagtt

SEQ ID NO: 395226 - DNA, 25 bp, Mus musculus
ttggctgtaagaaggtgattttaaa

SEQ ID NO: 395227 - DNA, 25 bp, Mus musculus
ttggctgtagtttccagagtctgac

SEQ ID NO: 395228 - DNA, 25 bp, Mus musculus
ttggctgttcagagactgggtgggt

SEQ ID NO: 395229 - DNA, 25 bp, Mus musculus
ttggcttcaagcagattaacctgtg

SEQ ID NO: 395230 - DNA, 25 bp, Mus musculus
ttggcttcattggaggtttaggatt

SEQ ID NO: 395231 - DNA, 25 bp, Mus musculus
ttggcttccaacatactgcagggtt

SEQ ID NO: 395232 - DNA, 25 bp, Mus musculus
ttggcttcccaaaaatgtatccatc

SEQ ID NO: 395233 - DNA, 25 bp, Mus musculus
ttggcttccgcttgccctatgctag

SEQ ID NO: 395234 - DNA, 25 bp, Mus musculus
ttggcttccggttgccctatgctag

SEQ ID NO: 395235 - DNA, 25 bp, Mus musculus
ttggcttcctcagcactggagacaa

SEQ ID NO: 395236 - DNA, 25 bp, Mus musculus
ttggcttcttcagcactggagacca

SEQ ID NO: 395237 - DNA, 25 bp, Mus musculus
ttggcttcttcaggactctttcatg

SEQ ID NO: 395238 - DNA, 25 bp, Mus musculus
ttggcttgaaggatgctcagattgc

SEQ ID NO: 395239 - DNA, 25 bp, Mus musculus
ttggcttgactgctccttctggccg

SEQ ID NO: 395240 - DNA, 25 bp, Mus musculus
ttggcttgcaaggctaccaaggccc

SEQ ID NO: 395241 - DNA, 25 bp, Mus musculus
ttggcttgcagataaaaatatatac

SEQ ID NO: 395242 - DNA, 25 bp, Mus musculus
ttggcttgccccggggacagaccac

SEQ ID NO: 395243 - DNA, 25 bp, Mus musculus
ttggcttgggaattgacaggcatcg

SEQ ID NO: 395244 - DNA, 25 bp, Mus musculus
ttggcttgtggtctatgttcagaac

SEQ ID NO: 395245 - DNA, 25 bp, Mus musculus
ttggcttgttggaggggactttccc

SEQ ID NO: 395246 - DNA, 25 bp, Mus musculus
ttggctttaacaatctccattcgga

SEQ ID NO: 395247 - DNA, 25 bp, Mus musculus
ttggctttaagacactggaacggtc

SEQ ID NO: 395248 - DNA, 25 bp, Mus musculus
ttggctttatcaggcgttctgtcaa

SEQ ID NO: 395249 - DNA, 25 bp, Mus musculus
ttggctttatcaggggcgttcaatt

SEQ ID NO: 395250 - DNA, 25 bp, Mus musculus
ttggctttcagagacgagttacaat

SEQ ID NO: 395251 - DNA, 25 bp, Mus musculus
ttggctttcgcagagcagtcctcag

SEQ ID NO: 395252 - DNA, 25 bp, Mus musculus
ttggctttcgcagagctgctcttgg

SEQ ID NO: 395253 - DNA, 25 bp, Mus musculus
ttggctttggagctcctgatggttt

SEQ ID NO: 395254 - DNA, 25 bp, Mus musculus
ttggctttggaggtcggtgagctgg

SEQ ID NO: 395255 - DNA, 25 bp, Mus musculus
ttggcttttaatgatctagtgaagc

SEQ ID NO: 395256 - DNA, 25 bp, Mus musculus
ttggctttttaaaggaaggcatccc

SEQ ID NO: 395257 - DNA, 25 bp, Mus musculus
ttgggaaaagactgtaatgaaacct

SEQ ID NO: 395258 - DNA, 25 bp, Mus musculus
ttgggaaaaggactagcggacatgg

SEQ ID NO: 395259 - DNA, 25 bp, Mus musculus
ttgggaaaaggtgatgcctgcttta

SEQ ID NO: 395260 - DNA, 25 bp, Mus musculus
ttgggaaaatgaaacttggggacca

SEQ ID NO: 395261 - DNA, 25 bp, Mus musculus
ttgggaaacaagaaagacagagtcc

SEQ ID NO: 395262 - DNA, 25 bp, Mus musculus
ttgggaaagctggccgaggagttgt

SEQ ID NO: 395263 - DNA, 25 bp, Mus musculus
ttgggaacagccttagctacatcaa

SEQ ID NO: 395264 - DNA, 25 bp, Mus musculus
ttgggaacttcagacccagccacct

SEQ ID NO: 395265 - DNA, 25 bp, Mus musculus
ttgggaagagacaaagacatcttat

SEQ ID NO: 395266 - DNA, 25 bp, Mus musculus
ttgggaagagtgccatgacaatgca

SEQ ID NO: 395267 - DNA, 25 bp, Mus musculus
ttgggaagagtgtgtcctgagttgc

SEQ ID NO: 395268 - DNA, 25 bp, Mus musculus
ttgggaagatgctgctctttggcgt

SEQ ID NO: 395269 - DNA, 25 bp, Mus musculus
ttgggaagatgctggagacctaggc

SEQ ID NO: 395270 - DNA, 25 bp, Mus musculus
ttgggaagatggctccttctcctac

SEQ ID NO: 395271 - DNA, 25 bp, Mus musculus
ttgggaaggattagatctgccacct

SEQ ID NO: 395272 - DNA, 25 bp, Mus musculus
ttgggaaggtggccttagtagaagt

SEQ ID NO: 395273 - DNA, 25 bp, Mus musculus
ttgggaagttactccgagatgccgc

SEQ ID NO: 395274 - DNA, 25 bp, Mus musculus
ttgggaataattgtgaggatgaagt

SEQ ID NO: 395275 - DNA, 25 bp, Mus musculus
ttgggaatacaggagacagaaaaga

SEQ ID NO: 395276 - DNA, 25 bp, Mus musculus
ttgggaatagaaggctatcctacct

SEQ ID NO: 395277 - DNA, 25 bp, Mus musculus
ttgggaataggccctttggagacgg

SEQ ID NO: 395278 - DNA, 25 bp, Mus musculus
ttgggaattgacaggcatcgcctcc

SEQ ID NO: 395279 - DNA, 25 bp, Mus musculus
ttgggaatttgctggggagaaggaa

SEQ ID NO: 395280 - DNA, 25 bp, Mus musculus
ttgggacaaaacgcaccctacctgg

SEQ ID NO: 395281 - DNA, 25 bp, Mus musculus
ttgggacagcagatccatgcccgca

SEQ ID NO: 395282 - DNA, 25 bp, Mus musculus
ttgggacagcagggccgcctcagtg

SEQ ID NO: 395283 - DNA, 25 bp, Mus musculus
ttgggactaccaggcctgtacggag

SEQ ID NO: 395284 - DNA, 25 bp, Mus musculus
ttgggagaagtatgcttccactgac

SEQ ID NO: 395285 - DNA, 25 bp, Mus musculus
ttgggagaagtttcttctagtatgc

SEQ ID NO: 395286 - DNA, 25 bp, Mus musculus
ttgggagacagagatcctgaggacg

SEQ ID NO: 395287 - DNA, 25 bp, Mus musculus
ttgggagaccgagctcagcagtcag

SEQ ID NO: 395288 - DNA, 25 bp, Mus musculus
ttgggagatacagggcatggatggg

SEQ ID NO: 395289 - DNA, 25 bp, Mus musculus
ttgggagccagccccagcagttgtc

SEQ ID NO: 395290 - DNA, 25 bp, Mus musculus
ttgggagcgggggtccaactgagcc

SEQ ID NO: 395291 - DNA, 25 bp, Mus musculus
ttgggagctccagtggcagtggggg

SEQ ID NO: 395292 - DNA, 25 bp, Mus musculus
ttgggaggagactgacaaaaccaaa

SEQ ID NO: 395293 - DNA, 25 bp, Mus musculus
ttgggaggagagaaggaagaattct

SEQ ID NO: 395294 - DNA, 25 bp, Mus musculus
ttgggaggaggcttgaagatgcagt

SEQ ID NO: 395295 - DNA, 25 bp, Mus musculus
ttgggaggctatggtcgtggtggtg

SEQ ID NO: 395296 - DNA, 25 bp, Mus musculus
ttgggaggctcgatgaaaaacacaa

SEQ ID NO: 395297 - DNA, 25 bp, Mus musculus
ttgggaggctcgatggagaattttg

SEQ ID NO: 395298 - DNA, 25 bp, Mus musculus
ttgggagggggggcctgctgtaggc

SEQ ID NO: 395299 - DNA, 25 bp, Mus musculus
ttgggagtaaatatttctaccattt

SEQ ID NO: 395300 - DNA, 25 bp, Mus musculus
ttgggagtaaattagcatatgtata

SEQ ID NO: 395301 - DNA, 25 bp, Mus musculus
ttgggagtcaccacggttcatggaa

SEQ ID NO: 395302 - DNA, 25 bp, Mus musculus
ttgggagtcaggacacctatatcaa

SEQ ID NO: 395303 - DNA, 25 bp, Mus musculus
ttgggataacaacgtctatttttat

SEQ ID NO: 395304 - DNA, 25 bp, Mus musculus
ttgggataacagttcccaaagtggc

SEQ ID NO: 395305 - DNA, 25 bp, Mus musculus
ttgggatatgtggggacatcagtgc

SEQ ID NO: 395306 - DNA, 25 bp, Mus musculus
ttgggatcagattgataagtatctg

SEQ ID NO: 395307 - DNA, 25 bp, Mus musculus
ttgggatctgggacactgaatggag

SEQ ID NO: 395308 - DNA, 25 bp, Mus musculus
ttgggatctttgctttctcatgaga

SEQ ID NO: 395309 - DNA, 25 bp, Mus musculus
ttgggatgaagattgtggatgtcag

SEQ ID NO: 395310 - DNA, 25 bp, Mus musculus
ttgggatgaaggtgactgtcctgga

SEQ ID NO: 395311 - DNA, 25 bp, Mus musculus
ttgggatggtgaaggagacaaaatt

SEQ ID NO: 395312 - DNA, 25 bp, Mus musculus
ttgggattattatgctttctcccag

SEQ ID NO: 395313 - DNA, 25 bp, Mus musculus
ttgggattccaggacgcccctgtga

SEQ ID NO: 395314 - DNA, 25 bp, Mus musculus
ttgggattgtaggtcacgctggagt

SEQ ID NO: 395315 - DNA, 25 bp, Mus musculus
ttgggatttcagacaggtggagtca

SEQ ID NO: 395316 - DNA, 25 bp, Mus musculus
ttgggatttcaggtctctggctttc

SEQ ID NO: 395317 - DNA, 25 bp, Mus musculus
ttgggattttagttctcaaataatt

SEQ ID NO: 395318 - DNA, 25 bp, Mus musculus
ttgggattttatcgcatcatattta

SEQ ID NO: 395319 - DNA, 25 bp, Mus musculus
ttgggcacaggaaagccatcaccaa

SEQ ID NO: 395320 - DNA, 25 bp, Mus musculus
ttgggcacctcgagaagcctgtaca

SEQ ID NO: 395321 - DNA, 25 bp, Mus musculus
ttgggcacctcgattgcagcccggg

SEQ ID NO: 395322 - DNA, 25 bp, Mus musculus
ttgggcacctggaagctgtggtgta

SEQ ID NO: 395323 - DNA, 25 bp, Mus musculus
ttgggcacctggaaggcctccccag

SEQ ID NO: 395324 - DNA, 25 bp, Mus musculus
ttgggcacgtaagagatgatgatgg

SEQ ID NO: 395325 - DNA, 25 bp, Mus musculus
ttgggcactgacatggttcctgcca

SEQ ID NO: 395326 - DNA, 25 bp, Mus musculus
ttgggcactgatgaggacagctcag

SEQ ID NO: 395327 - DNA, 25 bp, Mus musculus
ttgggcactgatgaggattctcagg

SEQ ID NO: 395328 - DNA, 25 bp, Mus musculus
ttgggcagcgccagtggctccgcgg

SEQ ID NO: 395329 - DNA, 25 bp, Mus musculus
ttgggcagctacttggttccctgcc

SEQ ID NO: 395330 - DNA, 25 bp, Mus musculus
ttgggcatctgaaggtctgccttga

SEQ ID NO: 395331 - DNA, 25 bp, Mus musculus
ttgggcatgaggctgctggcgttcc

SEQ ID NO: 395332 - DNA, 25 bp, Mus musculus
ttgggccaaaccaatatattgtggc

SEQ ID NO: 395333 - DNA, 25 bp, Mus musculus
ttgggccaacacctgaatctcctgg

SEQ ID NO: 395334 - DNA, 25 bp, Mus musculus
ttgggccagagagctgggtttgatc

SEQ ID NO: 395335 - DNA, 25 bp, Mus musculus
ttgggccagctgcagagaatgttgc

SEQ ID NO: 395336 - DNA, 25 bp, Mus musculus
ttgggccccacaagatccgtgtgaa

SEQ ID NO: 395337 - DNA, 25 bp, Mus musculus
ttgggcccggcagaatggctcccgc

SEQ ID NO: 395338 - DNA, 25 bp, Mus musculus
ttgggccgccttggcttcctttctg

SEQ ID NO: 395339 - DNA, 25 bp, Mus musculus
ttgggcctgaatgatatgtttggac

SEQ ID NO: 395340 - DNA, 25 bp, Mus musculus
ttgggcctgaatggctccgtgctct

SEQ ID NO: 395341 - DNA, 25 bp, Mus musculus
ttgggcctgaatgtctcttacagat

SEQ ID NO: 395342 - DNA, 25 bp, Mus musculus
ttgggcctttatggcatctgaacgc

SEQ ID NO: 395343 - DNA, 25 bp, Mus musculus
ttgggcctttgttcaagcacacaac

SEQ ID NO: 395344 - DNA, 25 bp, Mus musculus
ttgggcgcctccagaacagcatgtt

SEQ ID NO: 395345 - DNA, 25 bp, Mus musculus
ttgggcgcctccaggaacacttctg

SEQ ID NO: 395346 - DNA, 25 bp, Mus musculus
ttgggctaaagaatatgacagatac

SEQ ID NO: 395347 - DNA, 25 bp, Mus musculus
ttgggctaggaaggttctgtttgtt

SEQ ID NO: 395348 - DNA, 25 bp, Mus musculus
ttgggctatggagctggtgctgtcc

SEQ ID NO: 395349 - DNA, 25 bp, Mus musculus
ttgggctatggagtcccaacaggag

SEQ ID NO: 395350 - DNA, 25 bp, Mus musculus
ttgggctatttcttgttgccaaaac

SEQ ID NO: 395351 - DNA, 25 bp, Mus musculus
ttgggctcagctatggactgtctaa

SEQ ID NO: 395352 - DNA, 25 bp, Mus musculus
ttgggctctatgaaccagacttggg

SEQ ID NO: 395353 - DNA, 25 bp, Mus musculus
ttgggctgccgaatgaaaaggtgca

SEQ ID NO: 395354 - DNA, 25 bp, Mus musculus
ttgggctgccgactaggatgaagga

SEQ ID NO: 395355 - DNA, 25 bp, Mus musculus
ttgggctgccgactatcaagaatga

SEQ ID NO: 395356 - DNA, 25 bp, Mus musculus
ttgggctgccgactatggaaatcct

SEQ ID NO: 395357 - DNA, 25 bp, Mus musculus
ttgggctgccgactggacccagctg

SEQ ID NO: 395358 - DNA, 25 bp, Mus musculus
ttgggctgccgactggtcaatatag

SEQ ID NO: 395359 - DNA, 25 bp, Mus musculus
ttgggctgccgactgtgtccatgtt

SEQ ID NO: 395360 - DNA, 25 bp, Mus musculus
ttgggctgctgactcctctgcaggt

SEQ ID NO: 395361 - DNA, 25 bp, Mus musculus
ttgggctgctgactgtgtcaacaag

SEQ ID NO: 395362 - DNA, 25 bp, Mus musculus
ttgggctgctggcaactatcgaact

SEQ ID NO: 395363 - DNA, 25 bp, Mus musculus
ttgggcttcagcgagaactttcaaa

SEQ ID NO: 395364 - DNA, 25 bp, Mus musculus
ttgggcttcttgtgtccattgtcca

SEQ ID NO: 395365 - DNA, 25 bp, Mus musculus
ttgggcttgacgacaatggaggtag

SEQ ID NO: 395366 - DNA, 25 bp, Mus musculus
ttgggcttgacgtgtccaacctgtc

SEQ ID NO: 395367 - DNA, 25 bp, Mus musculus
ttgggcttgtattgaaaaagcttgt

SEQ ID NO: 395368 - DNA, 25 bp, Mus musculus
ttgggcttttcaggtcacctagcat

SEQ ID NO: 395369 - DNA, 25 bp, Mus musculus
ttggggaagcagatggagttccaga

SEQ ID NO: 395370 - DNA, 25 bp, Mus musculus
ttggggaagcgagccctgaagacaa

SEQ ID NO: 395371 - DNA, 25 bp, Mus musculus
ttggggaagcggtaggtgcacgcct

SEQ ID NO: 395372 - DNA, 25 bp, Mus musculus
ttggggacacggcatcctttgaagt

SEQ ID NO: 395373 - DNA, 25 bp, Mus musculus
ttggggacaggacctttgagcagcc

SEQ ID NO: 395374 - DNA, 25 bp, Mus musculus
ttggggaccctagggctgtgcctgg

SEQ ID NO: 395375 - DNA, 25 bp, Mus musculus
ttggggagagaggaagaactacaga

SEQ ID NO: 395376 - DNA, 25 bp, Mus musculus
ttggggagagtgaggctcaggccag

SEQ ID NO: 395377 - DNA, 25 bp, Mus musculus
ttggggagtctggtaaataagctga

SEQ ID NO: 395378 - DNA, 25 bp, Mus musculus
ttggggataaagtgtactggaatta

SEQ ID NO: 395379 - DNA, 25 bp, Mus musculus
ttggggatatggtgaacttgaccag

SEQ ID NO: 395380 - DNA, 25 bp, Mus musculus
ttggggatatggttgcctgtaatct

SEQ ID NO: 395381 - DNA, 25 bp, Mus musculus
ttggggatatgtaagacacctgtgg

SEQ ID NO: 395382 - DNA, 25 bp, Mus musculus
ttggggatatgtaagtgctcttgtg

SEQ ID NO: 395383 - DNA, 25 bp, Mus musculus
ttggggatgcccctgcctccctgga

SEQ ID NO: 395384 - DNA, 25 bp, Mus musculus
ttggggattatttagcacaggtgat

SEQ ID NO: 395385 - DNA, 25 bp, Mus musculus
ttggggatttacagggctgcagaat

SEQ ID NO: 395386 - DNA, 25 bp, Mus musculus
ttggggcaagatcgacatgctacag

SEQ ID NO: 395387 - DNA, 25 bp, Mus musculus
ttggggcaaggtggatacgacgctg

SEQ ID NO: 395388 - DNA, 25 bp, Mus musculus
ttggggcagagcagggatcagtggt

SEQ ID NO: 395389 - DNA, 25 bp, Mus musculus
ttggggcaggaagtgtcgagtggct

SEQ ID NO: 395390 - DNA, 25 bp, Mus musculus
ttggggccccacggatgctggtgga

SEQ ID NO: 395391 - DNA, 25 bp, Mus musculus
ttggggcgcagacatgtcttttctc

SEQ ID NO: 395392 - DNA, 25 bp, Mus musculus
ttggggcgcaggacccaagtttctt

SEQ ID NO: 395393 - DNA, 25 bp, Mus musculus
ttggggcgccagacaggattatgga

SEQ ID NO: 395394 - DNA, 25 bp, Mus musculus
ttggggcgccagggatcaacgttgt

SEQ ID NO: 395395 - DNA, 25 bp, Mus musculus
ttggggctaggtgtctccagtgcca

SEQ ID NO: 395396 - DNA, 25 bp, Mus musculus
ttggggctagtgcttatcctggtcg

SEQ ID NO: 395397 - DNA, 25 bp, Mus musculus
ttggggctccagagataaagctgct

SEQ ID NO: 395398 - DNA, 25 bp, Mus musculus
ttggggctccagagattatttgtct

SEQ ID NO: 395399 - DNA, 25 bp, Mus musculus
ttggggctcggatggtaaaacacca

SEQ ID NO: 395400 - DNA, 25 bp, Mus musculus
ttggggctcggcatctatattggaa

SEQ ID NO: 395401 - DNA, 25 bp, Mus musculus
ttggggctgaaaagacactacaaga

SEQ ID NO: 395402 - DNA, 25 bp, Mus musculus
ttgggggaccagtagttgcagtaag

SEQ ID NO: 395403 - DNA, 25 bp, Mus musculus
ttgggggagacgttcatgggcggtg

SEQ ID NO: 395404 - DNA, 25 bp, Mus musculus
ttgggggagactatggtggaaccca

SEQ ID NO: 395405 - DNA, 25 bp, Mus musculus
ttgggggaggtcagatgtctctctt

SEQ ID NO: 395406 - DNA, 25 bp, Mus musculus
ttgggggcagggagacgatactgta

SEQ ID NO: 395407 - DNA, 25 bp, Mus musculus
ttgggggctcgaagggcaggtaaac

SEQ ID NO: 395408 - DNA, 25 bp, Mus musculus
ttgggggtctgagagaatcgcacgt

SEQ ID NO: 395409 - DNA, 25 bp, Mus musculus
ttggggtattataatattattggcg

SEQ ID NO: 395410 - DNA, 25 bp, Mus musculus
ttggggtccaggtcgggatggtggc

SEQ ID NO: 395411 - DNA, 25 bp, Mus musculus
ttggggttcagttctgatacccgat

SEQ ID NO: 395412 - DNA, 25 bp, Mus musculus
ttggggttcatgagaggccgaggcc

SEQ ID NO: 395413 - DNA, 25 bp, Mus musculus
ttggggttgccagccatgctgcaag

SEQ ID NO: 395414 - DNA, 25 bp, Mus musculus
ttgggtacccagttgcacaacctgg

SEQ ID NO: 395415 - DNA, 25 bp, Mus musculus
ttgggtacttaatgagttccgatct

SEQ ID NO: 395416 - DNA, 25 bp, Mus musculus
ttgggtatatagcttgaagtcaatg

SEQ ID NO: 395417 - DNA, 25 bp, Mus musculus
ttgggtatcagatgttcatctagaa

SEQ ID NO: 395418 - DNA, 25 bp, Mus musculus
ttgggtcaaggtcgagtatgcctac

SEQ ID NO: 395419 - DNA, 25 bp, Mus musculus
ttgggtctcaaggagtcagagcaac

SEQ ID NO: 395420 - DNA, 25 bp, Mus musculus
ttgggtctcggcaaccaaactgaag

SEQ ID NO: 395421 - DNA, 25 bp, Mus musculus
ttgggtcttgggaagaaagacgatg

SEQ ID NO: 395422 - DNA, 25 bp, Mus musculus
ttgggtgcaatgggtgaaagagctg

SEQ ID NO: 395423 - DNA, 25 bp, Mus musculus
ttgggtgtttttcagatttcaccga

SEQ ID NO: 395424 - DNA, 25 bp, Mus musculus
ttgggttaccgagagcttttgctgg

SEQ ID NO: 395425 - DNA, 25 bp, Mus musculus
ttgggttcaagatcttggcaaccat

SEQ ID NO: 395426 - DNA, 25 bp, Mus musculus
ttgggttcagatacaggagcctaaa

SEQ ID NO: 395427 - DNA, 25 bp, Mus musculus
ttgggttgtaggcttctccagtggc

SEQ ID NO: 395428 - DNA, 25 bp, Mus musculus
ttgggtttcgcagagcttcctctct

SEQ ID NO: 395429 - DNA, 25 bp, Mus musculus
ttgggtttgcttctcccttccagat

SEQ ID NO: 395430 - DNA, 25 bp, Mus musculus
ttgggttttaagtgcggagatccaa

SEQ ID NO: 395431 - DNA, 25 bp, Mus musculus
ttgggttttttctggcgagcggcgt

SEQ ID NO: 395432 - DNA, 25 bp, Mus musculus
ttggtaaaagccatggccatgcaaa

SEQ ID NO: 395433 - DNA, 25 bp, Mus musculus
ttggtaaaatatcctgcccaaactc

SEQ ID NO: 395434 - DNA, 25 bp, Mus musculus
ttggtaaaatatcggatgcccgggt

SEQ ID NO: 395435 - DNA, 25 bp, Mus musculus
ttggtaaatgatgtggcaccattca

SEQ ID NO: 395436 - DNA, 25 bp, Mus musculus
ttggtaatagaggatctgagaaatg

SEQ ID NO: 395437 - DNA, 25 bp, Mus musculus
ttggtaatggagcccgagttcgtca

SEQ ID NO: 395438 - DNA, 25 bp, Mus musculus
ttggtaatggaggtgcccctgtgct

SEQ ID NO: 395439 - DNA, 25 bp, Mus musculus
ttggtaatttacagtagttgcagta

SEQ ID NO: 395440 - DNA, 25 bp, Mus musculus
ttggtactgaatcttcagtgagcat

SEQ ID NO: 395441 - DNA, 25 bp, Mus musculus
ttggtactgctgcatgccctgaagc

SEQ ID NO: 395442 - DNA, 25 bp, Mus musculus
ttggtagactctggctggaggcgtg

SEQ ID NO: 395443 - DNA, 25 bp, Mus musculus
ttggtagagggacagtgtcttggta

SEQ ID NO: 395444 - DNA, 25 bp, Mus musculus
ttggtagcagatttcttagattttt

SEQ ID NO: 395445 - DNA, 25 bp, Mus musculus
ttggtagcgtacattgcaaacatta

SEQ ID NO: 395446 - DNA, 25 bp, Mus musculus
ttggtaggtgcgccaaacagtgggg

SEQ ID NO: 395447 - DNA, 25 bp, Mus musculus
ttggtagtaaaatggaaggtgtctt

SEQ ID NO: 395448 - DNA, 25 bp, Mus musculus
ttggtatacaggaggataccagatg

SEQ ID NO: 395449 - DNA, 25 bp, Mus musculus
ttggtatacaggagtacttatgtgg

SEQ ID NO: 395450 - DNA, 25 bp, Mus musculus
ttggtattcctcagacagtaaagac

SEQ ID NO: 395451 - DNA, 25 bp, Mus musculus
ttggtattttgaagtccctggatga

SEQ ID NO: 395452 - DNA, 25 bp, Mus musculus
ttggtatttttaggctgttcattta

SEQ ID NO: 395453 - DNA, 25 bp, Mus musculus
ttggtcaagtgcatcgaggagttgt

SEQ ID NO: 395454 - DNA, 25 bp, Mus musculus
ttggtcacacagggctcgcttgcct

SEQ ID NO: 395455 - DNA, 25 bp, Mus musculus
ttggtcacctgagcaagttgttggg

SEQ ID NO: 395456 - DNA, 25 bp, Mus musculus
ttggtcacttgctgagatatgggga

SEQ ID NO: 395457 - DNA, 25 bp, Mus musculus
ttggtcagagaggtgctggtaactc

SEQ ID NO: 395458 - DNA, 25 bp, Mus musculus
ttggtcatgaagaagcagaattcta

SEQ ID NO: 395459 - DNA, 25 bp, Mus musculus
ttggtcatgaagacatgtttaaaaa

SEQ ID NO: 395460 - DNA, 25 bp, Mus musculus
ttggtccagtttcccttgtgggtat

SEQ ID NO: 395461 - DNA, 25 bp, Mus musculus
ttggtcccagctgtgcagtgcctac

SEQ ID NO: 395462 - DNA, 25 bp, Mus musculus
ttggtccctacagtcaagctgtgca

SEQ ID NO: 395463 - DNA, 25 bp, Mus musculus
ttggtccggagaaacattcatgctg

SEQ ID NO: 395464 - DNA, 25 bp, Mus musculus
ttggtcctaaaaaagagaacgcacc

SEQ ID NO: 395465 - DNA, 25 bp, Mus musculus
ttggtcctaaggccctttttgcttt

SEQ ID NO: 395466 - DNA, 25 bp, Mus musculus
ttggtcctcactgtgatgatccggg

SEQ ID NO: 395467 - DNA, 25 bp, Mus musculus
ttggtcctcatctctccaggcgtct

SEQ ID NO: 395468 - DNA, 25 bp, Mus musculus
ttggtccttctggagcccctggtga

SEQ ID NO: 395469 - DNA, 25 bp, Mus musculus
ttggtccttgaggatttcaaacaaa

SEQ ID NO: 395470 - DNA, 25 bp, Mus musculus
ttggtccttgttccaccctccaagc

SEQ ID NO: 395471 - DNA, 25 bp, Mus musculus
ttggtctcatctgccatggtgacct

SEQ ID NO: 395472 - DNA, 25 bp, Mus musculus
ttggtctcatctgtctgcaatcctg

SEQ ID NO: 395473 - DNA, 25 bp, Mus musculus
ttggtctccgaggagtatgtctcca

SEQ ID NO: 395474 - DNA, 25 bp, Mus musculus
ttggtctctggtggaattgggctta

SEQ ID NO: 395475 - DNA, 25 bp, Mus musculus
ttggtctctgtgggagcttgcattt

SEQ ID NO: 395476 - DNA, 25 bp, Mus musculus
ttggtctctgtgggtggtaaatctg

SEQ ID NO: 395477 - DNA, 25 bp, Mus musculus
ttggtctgaaggacagggtttctct

SEQ ID NO: 395478 - DNA, 25 bp, Mus musculus
ttggtctgagcaggactcggaaccc

SEQ ID NO: 395479 - DNA, 25 bp, Mus musculus
ttggtctgctggacgcctttagaac

SEQ ID NO: 395480 - DNA, 25 bp, Mus musculus
ttggtctgctgggaagcggaacagg

SEQ ID NO: 395481 - DNA, 25 bp, Mus musculus
ttggtgaaaagtgaagatgccatca

SEQ ID NO: 395482 - DNA, 25 bp, Mus musculus
ttggtgaaatttatgattccatatt

SEQ ID NO: 395483 - DNA, 25 bp, Mus musculus
ttggtgaaggaaaagtatgatacag

SEQ ID NO: 395484 - DNA, 25 bp, Mus musculus
ttggtgaataagtacaacaaagcca

SEQ ID NO: 395485 - DNA, 25 bp, Mus musculus
ttggtgacaaggtgaattcccttgg

SEQ ID NO: 395486 - DNA, 25 bp, Mus musculus
ttggtgacagacagtcttcacacat

SEQ ID NO: 395487 - DNA, 25 bp, Mus musculus
ttggtgacaggcttccccacctccc

SEQ ID NO: 395488 - DNA, 25 bp, Mus musculus
ttggtgacccgccaggacaatggat

SEQ ID NO: 395489 - DNA, 25 bp, Mus musculus
ttggtgagacccaggttcaactgga

SEQ ID NO: 395490 - DNA, 25 bp, Mus musculus
ttggtgataaaaaggtgtcactctg

SEQ ID NO: 395491 - DNA, 25 bp, Mus musculus
ttggtgataaaaagtctttttatga

SEQ ID NO: 395492 - DNA, 25 bp, Mus musculus
ttggtgatgagaggaagctttgtct

SEQ ID NO: 395493 - DNA, 25 bp, Mus musculus
ttggtgcaacgtttgtgcttgtcct

SEQ ID NO: 395494 - DNA, 25 bp, Mus musculus
ttggtgcagggtttgtggtagtgat

SEQ ID NO: 395495 - DNA, 25 bp, Mus musculus
ttggtgcagtacaaagagtactttt

SEQ ID NO: 395496 - DNA, 25 bp, Mus musculus
ttggtgccaagaagatgcacgacga

SEQ ID NO: 395497 - DNA, 25 bp, Mus musculus
ttggtgcggccagagagtcgatatg

SEQ ID NO: 395498 - DNA, 25 bp, Mus musculus
ttggtgctgatgcagactttgtggt

SEQ ID NO: 395499 - DNA, 25 bp, Mus musculus
ttggtgctgatgcagctcccccacc

SEQ ID NO: 395500 - DNA, 25 bp, Mus musculus
ttggtgctgtggcagaattctcttt

SEQ ID NO: 395501 - DNA, 25 bp, Mus musculus
ttggtgctgtggcagatttgcaaac

SEQ ID NO: 395502 - DNA, 25 bp, Mus musculus
ttggtggaaatgaggcagctgcgat

SEQ ID NO: 395503 - DNA, 25 bp, Mus musculus
ttggtggaagatgtgctcgtagctc

SEQ ID NO: 395504 - DNA, 25 bp, Mus musculus
ttggtggaatgcatgcagatgtcaa

SEQ ID NO: 395505 - DNA, 25 bp, Mus musculus
ttggtggacgacagctttagccagg

SEQ ID NO: 395506 - DNA, 25 bp, Mus musculus
ttggtggaggaaccagagtctatgg

SEQ ID NO: 395507 - DNA, 25 bp, Mus musculus
ttggtggatggatgagtttcatcct

SEQ ID NO: 395508 - DNA, 25 bp, Mus musculus
ttggtggcaagcttggcgcccgtgt

SEQ ID NO: 395509 - DNA, 25 bp, Mus musculus
ttggtggcacggatggcaatgtgcg

SEQ ID NO: 395510 - DNA, 25 bp, Mus musculus
ttggtggcatcataggtggcatcat

SEQ ID NO: 395511 - DNA, 25 bp, Mus musculus
ttggtggccgtgaaggtggaggcag

SEQ ID NO: 395512 - DNA, 25 bp, Mus musculus
ttggtggctacctgaagctgatgcc

SEQ ID NO: 395513 - DNA, 25 bp, Mus musculus
ttggtggctggagccctcagctgtg

SEQ ID NO: 395514 - DNA, 25 bp, Mus musculus
ttggtggtggaggaggggaatttgc

SEQ ID NO: 395515 - DNA, 25 bp, Mus musculus
ttggtggtggagggggacgatttgg

SEQ ID NO: 395516 - DNA, 25 bp, Mus musculus
ttggtgtacacacaggtggtgacag

SEQ ID NO: 395517 - DNA, 25 bp, Mus musculus
ttggtgtcacaggcggcacgttttc

SEQ ID NO: 395518 - DNA, 25 bp, Mus musculus
ttggtgtcagagaaggaagcagcgg

SEQ ID NO: 395519 - DNA, 25 bp, Mus musculus
ttggtgtcagagaagtatccctggg

SEQ ID NO: 395520 - DNA, 25 bp, Mus musculus
ttggtgtctggatgatgcatcccag

SEQ ID NO: 395521 - DNA, 25 bp, Mus musculus
ttggtgtctgtggggacctctgagc

SEQ ID NO: 395522 - DNA, 25 bp, Mus musculus
ttggtgtgaccttgggctggcatcc

SEQ ID NO: 395523 - DNA, 25 bp, Mus musculus
ttggtgtgaccttgggtgctggcct

SEQ ID NO: 395524 - DNA, 25 bp, Mus musculus
ttggtgtgctccaggctggacagta

SEQ ID NO: 395525 - DNA, 25 bp, Mus musculus
ttggtgtggaggctcatctcagaga

SEQ ID NO: 395526 - DNA, 25 bp, Mus musculus
ttggtgtggaggggctcctctgtcc

SEQ ID NO: 395527 - DNA, 25 bp, Mus musculus
ttggtgtggatggtgcctgcaggcc

SEQ ID NO: 395528 - DNA, 25 bp, Mus musculus
ttggtgtgtgtgtgtaatagggatg

SEQ ID NO: 395529 - DNA, 25 bp, Mus musculus
ttggtgttaaaaagacatgtttttc

SEQ ID NO: 395530 - DNA, 25 bp, Mus musculus
ttggtgttaaaaagtttatgatcac

SEQ ID NO: 395531 - DNA, 25 bp, Mus musculus
ttggtgttcccttgccaagaaacaa

SEQ ID NO: 395532 - DNA, 25 bp, Mus musculus
ttggttactcagggatgaacaagaa

SEQ ID NO: 395533 - DNA, 25 bp, Mus musculus
ttggttactttatctgcacaaacag

SEQ ID NO: 395534 - DNA, 25 bp, Mus musculus
ttggttagaacaggtccgagtaggt

SEQ ID NO: 395535 - DNA, 25 bp, Mus musculus
ttggttataactgacaggtataaaa

SEQ ID NO: 395536 - DNA, 25 bp, Mus musculus
ttggttatatttgcctaaagacgtc

SEQ ID NO: 395537 - DNA, 25 bp, Mus musculus
ttggttatctccgggtctcactgtt

SEQ ID NO: 395538 - DNA, 25 bp, Mus musculus
ttggttatgccagaaacccttcact

SEQ ID NO: 395539 - DNA, 25 bp, Mus musculus
ttggttatgtcacaaacataaacca

SEQ ID NO: 395540 - DNA, 25 bp, Mus musculus
ttggttatgtggcagcagaagaagc

SEQ ID NO: 395541 - DNA, 25 bp, Mus musculus
ttggttattgagaaggagaacactg

SEQ ID NO: 395542 - DNA, 25 bp, Mus musculus
ttggttattggtggttttggctcgt

SEQ ID NO: 395543 - DNA, 25 bp, Mus musculus
ttggttcaaggagtcctttgggagc

SEQ ID NO: 395544 - DNA, 25 bp, Mus musculus
ttggttcagagtcttttacatgtac

SEQ ID NO: 395545 - DNA, 25 bp, Mus musculus
ttggttcagagttgtcctggggaag

SEQ ID NO: 395546 - DNA, 25 bp, Mus musculus
ttggttcagggcctggacagccact

SEQ ID NO: 395547 - DNA, 25 bp, Mus musculus
ttggttccagatgggtgtgttttac

SEQ ID NO: 395548 - DNA, 25 bp, Mus musculus
ttggttccagggtgactgactgagt

SEQ ID NO: 395549 - DNA, 25 bp, Mus musculus
ttggttcccagaaagccccgcagcc

SEQ ID NO: 395550 - DNA, 25 bp, Mus musculus
ttggttcccgctgacacgtaggcaa

SEQ ID NO: 395551 - DNA, 25 bp, Mus musculus
ttggttcccgctgacctcccgccat

SEQ ID NO: 395552 - DNA, 25 bp, Mus musculus
ttggttcccgctgagacgtaggcaa

SEQ ID NO: 395553 - DNA, 25 bp, Mus musculus
ttggttcccgctgagctcccgccat

SEQ ID NO: 395554 - DNA, 25 bp, Mus musculus
ttggttccttgagatacgacatttc

SEQ ID NO: 395555 - DNA, 25 bp, Mus musculus
ttggttctatctatgaatttggaaa

SEQ ID NO: 395556 - DNA, 25 bp, Mus musculus
ttggttctgcagaggaacagctgtg

SEQ ID NO: 395557 - DNA, 25 bp, Mus musculus
ttggttcttgtttgatactttatgc

SEQ ID NO: 395558 - DNA, 25 bp, Mus musculus
ttggttgatccaaacatccagaacc

SEQ ID NO: 395559 - DNA, 25 bp, Mus musculus
ttggttgcagatttgcaatacatat

SEQ ID NO: 395560 - DNA, 25 bp, Mus musculus
ttggttgcaggaagaccgagtagtg

SEQ ID NO: 395561 - DNA, 25 bp, Mus musculus
ttggttgcaggtttgcaatacattt

SEQ ID NO: 395562 - DNA, 25 bp, Mus musculus
ttggttggaacgaatgcctccaatt

SEQ ID NO: 395563 - DNA, 25 bp, Mus musculus
ttggttggagcaggtactggcctta

SEQ ID NO: 395564 - DNA, 25 bp, Mus musculus
ttggttggagcaggtggcaaagcaa

SEQ ID NO: 395565 - DNA, 25 bp, Mus musculus
ttggttggagcatttgacattgtgc

SEQ ID NO: 395566 - DNA, 25 bp, Mus musculus
ttggttggagtgctcaaggaggcct

SEQ ID NO: 395567 - DNA, 25 bp, Mus musculus
ttggttgggataaactcgcatgtgt

SEQ ID NO: 395568 - DNA, 25 bp, Mus musculus
ttggttgttcaagttataggtaaaa

SEQ ID NO: 395569 - DNA, 25 bp, Mus musculus
ttggttgttgaaggactcgggacac

SEQ ID NO: 395570 - DNA, 25 bp, Mus musculus
ttggttgtttttggtgccttcaaga

SEQ ID NO: 395571 - DNA, 25 bp, Mus musculus
ttggtttaagtgctgtgaagagctt

SEQ ID NO: 395572 - DNA, 25 bp, Mus musculus
ttggtttacagtccctggatgacgc

SEQ ID NO: 395573 - DNA, 25 bp, Mus musculus
ttggtttccagcccgtcctttcatc

SEQ ID NO: 395574 - DNA, 25 bp, Mus musculus
ttggtttcctccgcaccaccaccac

SEQ ID NO: 395575 - DNA, 25 bp, Mus musculus
ttggtttctcctgggctgcaagccc

SEQ ID NO: 395576 - DNA, 25 bp, Mus musculus
ttggtttgcgaggctggagcaaaac

SEQ ID NO: 395577 - DNA, 25 bp, Mus musculus
ttggttttaaggctgtctgatccca

SEQ ID NO: 395578 - DNA, 25 bp, Mus musculus
ttggttttcatccaggtggatcgca

SEQ ID NO: 395579 - DNA, 25 bp, Mus musculus
ttggtttttggtgaatgaatataaa

SEQ ID NO: 395580 - DNA, 25 bp, Mus musculus
ttgtaaaaaggtatatcatgtataa

SEQ ID NO: 395581 - DNA, 25 bp, Mus musculus
ttgtaaaacgagccctcagggattc

SEQ ID NO: 395582 - DNA, 25 bp, Mus musculus
ttgtaaaatcagaggtccggaccgc

SEQ ID NO: 395583 - DNA, 25 bp, Mus musculus
ttgtaaaatggtatggcctcacaag

SEQ ID NO: 395584 - DNA, 25 bp, Mus musculus
ttgtaaaccggaagaagttcagagt

SEQ ID NO: 395585 - DNA, 25 bp, Mus musculus
ttgtaaagtttcggaacaaggagcc

SEQ ID NO: 395586 - DNA, 25 bp, Mus musculus
ttgtaaatgcagggtctcgtggttc

SEQ ID NO: 395587 - DNA, 25 bp, Mus musculus
ttgtaaatgcagtgattgatgatgc

SEQ ID NO: 395588 - DNA, 25 bp, Mus musculus
ttgtaacaaggctgtgtctgcttca

SEQ ID NO: 395589 - DNA, 25 bp, Mus musculus
ttgtaacaaggtacactttttgtca

SEQ ID NO: 395590 - DNA, 25 bp, Mus musculus
ttgtaaccatgaaaatcagaaaatg

SEQ ID NO: 395591 - DNA, 25 bp, Mus musculus
ttgtaacgtaaggacaagatggcaa

SEQ ID NO: 395592 - DNA, 25 bp, Mus musculus
ttgtaactctggttttcttatccgc

SEQ ID NO: 395593 - DNA, 25 bp, Mus musculus
ttgtaagaaaagtgatgctgcatca

SEQ ID NO: 395594 - DNA, 25 bp, Mus musculus
ttgtaagccttgcatagtcccagaa

SEQ ID NO: 395595 - DNA, 25 bp, Mus musculus
ttgtaagcggacatcagaaaagttc

SEQ ID NO: 395596 - DNA, 25 bp, Mus musculus
ttgtaagtaccgagtgctgcttttg

SEQ ID NO: 395597 - DNA, 25 bp, Mus musculus
ttgtaataaagctgcgaagctgggg

SEQ ID NO: 395598 - DNA, 25 bp, Mus musculus
ttgtaatagctgccactgaagctgg

SEQ ID NO: 395599 - DNA, 25 bp, Mus musculus
ttgtaatagctgccactgacaaagc

SEQ ID NO: 395600 - DNA, 25 bp, Mus musculus
ttgtaatagtgaagcagagccatga

SEQ ID NO: 395601 - DNA, 25 bp, Mus musculus
ttgtaatcagcttggcttacccttc

SEQ ID NO: 395602 - DNA, 25 bp, Mus musculus
ttgtaatctcggattgtaagggcca

SEQ ID NO: 395603 - DNA, 25 bp, Mus musculus
ttgtaatcttgagaaaatgaaaatc

SEQ ID NO: 395604 - DNA, 25 bp, Mus musculus
ttgtaattcaggtgagcacctcctc

SEQ ID NO: 395605 - DNA, 25 bp, Mus musculus
ttgtaattccaactctggttgaccc

SEQ ID NO: 395606 - DNA, 25 bp, Mus musculus
ttgtaatttaaccgcttggctgaag

SEQ ID NO: 395607 - DNA, 25 bp, Mus musculus
ttgtacaaaactgtgggaacctgga

SEQ ID NO: 395608 - DNA, 25 bp, Mus musculus
ttgtacaaaagccctatagtcgctc

SEQ ID NO: 395609 - DNA, 25 bp, Mus musculus
ttgtacaaaaggttgaagaaatggt

SEQ ID NO: 395610 - DNA, 25 bp, Mus musculus
ttgtacaaagggcaatcctgcacgt

SEQ ID NO: 395611 - DNA, 25 bp, Mus musculus
ttgtacaaggagggtgacaatagct

SEQ ID NO: 395612 - DNA, 25 bp, Mus musculus
ttgtacacaagaagcagtcgttccc

SEQ ID NO: 395613 - DNA, 25 bp, Mus musculus
ttgtacagaagctgttgcaatacaa

SEQ ID NO: 395614 - DNA, 25 bp, Mus musculus
ttgtacagaaggacctggtggctaa

SEQ ID NO: 395615 - DNA, 25 bp, Mus musculus
ttgtacagaggcctatggatttgtc

SEQ ID NO: 395616 - DNA, 25 bp, Mus musculus
ttgtacagagggatgaaatgcagag

SEQ ID NO: 395617 - DNA, 25 bp, Mus musculus
ttgtacagcaggcaggcaaccttca

SEQ ID NO: 395618 - DNA, 25 bp, Mus musculus
ttgtacatgcagcagattcaagtca

SEQ ID NO: 395619 - DNA, 25 bp, Mus musculus
ttgtaccaccggtaactaaatgacc

SEQ ID NO: 395620 - DNA, 25 bp, Mus musculus
ttgtaccaccggtatccatgccagc

SEQ ID NO: 395621 - DNA, 25 bp, Mus musculus
ttgtaccagagaactgaaaagctcc

SEQ ID NO: 395622 - DNA, 25 bp, Mus musculus
ttgtaccaggagaaggtgaggtaca

SEQ ID NO: 395623 - DNA, 25 bp, Mus musculus
ttgtaccattgggcagcaagaaggg

SEQ ID NO: 395624 - DNA, 25 bp, Mus musculus
ttgtaccccaacaagaatcagcaca

SEQ ID NO: 395625 - DNA, 25 bp, Mus musculus
ttgtaccccaacaagacccgtctaa

SEQ ID NO: 395626 - DNA, 25 bp, Mus musculus
ttgtaccccaggcattgggcatgga

SEQ ID NO: 395627 - DNA, 25 bp, Mus musculus
ttgtaccctatgataaaaactacag

SEQ ID NO: 395628 - DNA, 25 bp, Mus musculus
ttgtaccctatgcatctgcctctat

SEQ ID NO: 395629 - DNA, 25 bp, Mus musculus
ttgtacctgattggactgcccgtgg

SEQ ID NO: 395630 - DNA, 25 bp, Mus musculus
ttgtactcagccagaagcacccccg

SEQ ID NO: 395631 - DNA, 25 bp, Mus musculus
ttgtactcagttaggatgaccattg

SEQ ID NO: 395632 - DNA, 25 bp, Mus musculus
ttgtactcagttagtttcctatgat

SEQ ID NO: 395633 - DNA, 25 bp, Mus musculus
ttgtactggagacaggccgggtgac

SEQ ID NO: 395634 - DNA, 25 bp, Mus musculus
ttgtacttggccagccgtgtgggtg

SEQ ID NO: 395635 - DNA, 25 bp, Mus musculus
ttgtactttgactcggtccctacca

SEQ ID NO: 395636 - DNA, 25 bp, Mus musculus
ttgtactttgactcgtgaagtcatc

SEQ ID NO: 395637 - DNA, 25 bp, Mus musculus
ttgtagaaaactgtggtgtcatgga

SEQ ID NO: 395638 - DNA, 25 bp, Mus musculus
ttgtagaaaagatggcagcctttac

SEQ ID NO: 395639 - DNA, 25 bp, Mus musculus
ttgtagaaaaggggcatcgtctgcc

SEQ ID NO: 395640 - DNA, 25 bp, Mus musculus
ttgtagaactagtccttatcggaca

SEQ ID NO: 395641 - DNA, 25 bp, Mus musculus
ttgtagaactatgcattttgcagag

SEQ ID NO: 395642 - DNA, 25 bp, Mus musculus
ttgtagaagctggtgggatgcaggc

SEQ ID NO: 395643 - DNA, 25 bp, Mus musculus
ttgtagacaggtactggcatagcac

SEQ ID NO: 395644 - DNA, 25 bp, Mus musculus
ttgtagaccaaagcccatggcctag

SEQ ID NO: 395645 - DNA, 25 bp, Mus musculus
ttgtagaccaagtggtgtctaccat

SEQ ID NO: 395646 - DNA, 25 bp, Mus musculus
ttgtagactccatagaactttccaa

SEQ ID NO: 395647 - DNA, 25 bp, Mus musculus
ttgtagactccataggaccttctgt

SEQ ID NO: 395648 - DNA, 25 bp, Mus musculus
ttgtagaggagctccaagtatgtta

SEQ ID NO: 395649 - DNA, 25 bp, Mus musculus
ttgtagatgtggaatggacagacca

SEQ ID NO: 395650 - DNA, 25 bp, Mus musculus
ttgtagatgtggatgaaaagaatca

SEQ ID NO: 395651 - DNA, 25 bp, Mus musculus
ttgtagcaaggtatggtgcggatgg

SEQ ID NO: 395652 - DNA, 25 bp, Mus musculus
ttgtagcacctgagggatatgatgc

SEQ ID NO: 395653 - DNA, 25 bp, Mus musculus
ttgtagcacctgagttctcactcaa

SEQ ID NO: 395654 - DNA, 25 bp, Mus musculus
ttgtagcatctgttgaattgtggaa

SEQ ID NO: 395655 - DNA, 25 bp, Mus musculus
ttgtagcatctgttgacttgactga

SEQ ID NO: 395656 - DNA, 25 bp, Mus musculus
ttgtagcatctgttgggccagaggg

SEQ ID NO: 395657 - DNA, 25 bp, Mus musculus
ttgtagccatcctcccgccacacct

SEQ ID NO: 395658 - DNA, 25 bp, Mus musculus
ttgtagcccagaaagtcctaggtgg

SEQ ID NO: 395659 - DNA, 25 bp, Mus musculus
ttgtagccgaagcagatccacaact

SEQ ID NO: 395660 - DNA, 25 bp, Mus musculus
ttgtagccgaagcgatctgctaatg

SEQ ID NO: 395661 - DNA, 25 bp, Mus musculus
ttgtagctgaggttcgttccaccag

SEQ ID NO: 395662 - DNA, 25 bp, Mus musculus
ttgtagctgggattgacttctaaac

SEQ ID NO: 395663 - DNA, 25 bp, Mus musculus
ttgtagctgttctagtaagcagagg

SEQ ID NO: 395664 - DNA, 25 bp, Mus musculus
ttgtaggacaaaggtatggctttgt

SEQ ID NO: 395665 - DNA, 25 bp, Mus musculus
ttgtaggagaacagggcgtggtacc

SEQ ID NO: 395666 - DNA, 25 bp, Mus musculus
ttgtaggagcagtttctccacctgg

SEQ ID NO: 395667 - DNA, 25 bp, Mus musculus
ttgtaggcatgccgggtggctttgc

SEQ ID NO: 395668 - DNA, 25 bp, Mus musculus
ttgtaggtcagagtttttgtgccgc

SEQ ID NO: 395669 - DNA, 25 bp, Mus musculus
ttgtagtatttaagaaaagtgagag

SEQ ID NO: 395670 - DNA, 25 bp, Mus musculus
ttgtagtcagtaagctgtggtgtac

SEQ ID NO: 395671 - DNA, 25 bp, Mus musculus
ttgtagtggctctggcatgctgagc

SEQ ID NO: 395672 - DNA, 25 bp, Mus musculus
ttgtagttgatctggtgtgttatcg

SEQ ID NO: 395673 - DNA, 25 bp, Mus musculus
ttgtatacaaaagcacaaaaggcaa

SEQ ID NO: 395674 - DNA, 25 bp, Mus musculus
ttgtatacaaaagtcaggttttcag

SEQ ID NO: 395675 - DNA, 25 bp, Mus musculus
ttgtatacagaggagcattccggct

SEQ ID NO: 395676 - DNA, 25 bp, Mus musculus
ttgtatacttagacaaaagtcctca

SEQ ID NO: 395677 - DNA, 25 bp, Mus musculus
ttgtatcaaaatttctatgaggaga

SEQ ID NO: 395678 - DNA, 25 bp, Mus musculus
ttgtatcagcaactgacaggggagc

SEQ ID NO: 395679 - DNA, 25 bp, Mus musculus
ttgtatcgacagttctgtaagcatc

SEQ ID NO: 395680 - DNA, 25 bp, Mus musculus
ttgtatcttcgggctcgctgcccac

SEQ ID NO: 395681 - DNA, 25 bp, Mus musculus
ttgtatgctagttcactttaattga

SEQ ID NO: 395682 - DNA, 25 bp, Mus musculus
ttgtatggaagagttactttggagt

SEQ ID NO: 395683 - DNA, 25 bp, Mus musculus
ttgtatggaagatctctgcgatatg

SEQ ID NO: 395684 - DNA, 25 bp, Mus musculus
ttgtatgtataggctgttatgttta

SEQ ID NO: 395685 - DNA, 25 bp, Mus musculus
ttgtattaaagatccaaaaggtaat

SEQ ID NO: 395686 - DNA, 25 bp, Mus musculus
ttgtattaaagggtatgatgtgatt

SEQ ID NO: 395687 - DNA, 25 bp, Mus musculus
ttgtattaagatgggcgtatgtctt

SEQ ID NO: 395688 - DNA, 25 bp, Mus musculus
ttgtattagagggaattctgccttt

SEQ ID NO: 395689 - DNA, 25 bp, Mus musculus
ttgtattagaggttcataagccaga

SEQ ID NO: 395690 - DNA, 25 bp, Mus musculus
ttgtattagaggttggcaggaaggt

SEQ ID NO: 395691 - DNA, 25 bp, Mus musculus
ttgtattgcagagctgtttgacagc

SEQ ID NO: 395692 - DNA, 25 bp, Mus musculus
ttgtattgcagcttctagagctgtt

SEQ ID NO: 395693 - DNA, 25 bp, Mus musculus
ttgtatttacagatttatgacattc

SEQ ID NO: 395694 - DNA, 25 bp, Mus musculus
ttgtatttacaggatcttgctgcat

SEQ ID NO: 395695 - DNA, 25 bp, Mus musculus
ttgtattttaggtacattttatgat

SEQ ID NO: 395696 - DNA, 25 bp, Mus musculus
ttgtcaaacccaaggtatggaagac

SEQ ID NO: 395697 - DNA, 25 bp, Mus musculus
ttgtcaaagactgccttactaaaga

SEQ ID NO: 395698 - DNA, 25 bp, Mus musculus
ttgtcaaagagctgggtctctccag

SEQ ID NO: 395699 - DNA, 25 bp, Mus musculus
ttgtcaaagaggtacagcagggtgg

SEQ ID NO: 395700 - DNA, 25 bp, Mus musculus
ttgtcaaaggatggctccggtgagg

SEQ ID NO: 395701 - DNA, 25 bp, Mus musculus
ttgtcaaaggatggtggtgtgcgaa

SEQ ID NO: 395702 - DNA, 25 bp, Mus musculus
ttgtcaaataaaaatccatggagct

SEQ ID NO: 395703 - DNA, 25 bp, Mus musculus
ttgtcaacaagctcattcagttcct

SEQ ID NO: 395704 - DNA, 25 bp, Mus musculus
ttgtcaacaggaggagccatgggag

SEQ ID NO: 395705 - DNA, 25 bp, Mus musculus
ttgtcaacagggtccaggtgcacgt

SEQ ID NO: 395706 - DNA, 25 bp, Mus musculus
ttgtcaacattcaggagcagagccc

SEQ ID NO: 395707 - DNA, 25 bp, Mus musculus
ttgtcaacattcagtacacactgcg

SEQ ID NO: 395708 - DNA, 25 bp, Mus musculus
ttgtcaagaacagctggggaagtga

SEQ ID NO: 395709 - DNA, 25 bp, Mus musculus
ttgtcaagctcgaaccagcccctcc

SEQ ID NO: 395710 - DNA, 25 bp, Mus musculus
ttgtcaagggatacctccttcccat

SEQ ID NO: 395711 - DNA, 25 bp, Mus musculus
ttgtcaagtacgagctttatggcca

SEQ ID NO: 395712 - DNA, 25 bp, Mus musculus
ttgtcaagtggtgtgggcatattca

SEQ ID NO: 395713 - DNA, 25 bp, Mus musculus
ttgtcaataaggtaatgttagcaga

SEQ ID NO: 395714 - DNA, 25 bp, Mus musculus
ttgtcaatcagcacaatgctccagt

SEQ ID NO: 395715 - DNA, 25 bp, Mus musculus
ttgtcaatctggtacaccaggggtt

SEQ ID NO: 395716 - DNA, 25 bp, Mus musculus
ttgtcaatgaggcagaattccacct

SEQ ID NO: 395717 - DNA, 25 bp, Mus musculus
ttgtcacaaaggaagttgttcaagg

SEQ ID NO: 395718 - DNA, 25 bp, Mus musculus
ttgtcacaagcagtcatgaaagtcc

SEQ ID NO: 395719 - DNA, 25 bp, Mus musculus
ttgtcacaagcagtctgaccaagga

SEQ ID NO: 395720 - DNA, 25 bp, Mus musculus
ttgtcacaggggcgggacaggaaag

SEQ ID NO: 395721 - DNA, 25 bp, Mus musculus
ttgtcacagggggtgagaaccctgc

SEQ ID NO: 395722 - DNA, 25 bp, Mus musculus
ttgtcacagggggtggaaagctttc

SEQ ID NO: 395723 - DNA, 25 bp, Mus musculus
ttgtcacctgaggcccttctcccca

SEQ ID NO: 395724 - DNA, 25 bp, Mus musculus
ttgtcacctggagcattccagaaaa

SEQ ID NO: 395725 - DNA, 25 bp, Mus musculus
ttgtcacgcagcatgcttccctagc

SEQ ID NO: 395726 - DNA, 25 bp, Mus musculus
ttgtcacgcagcatgggctccggct

SEQ ID NO: 395727 - DNA, 25 bp, Mus musculus
ttgtcactatgccacagcccaactg

SEQ ID NO: 395728 - DNA, 25 bp, Mus musculus
ttgtcactgagaaacgtctcagaga

SEQ ID NO: 395729 - DNA, 25 bp, Mus musculus
ttgtcactgagctcctgcttcctga

SEQ ID NO: 395730 - DNA, 25 bp, Mus musculus
ttgtcactggggtgcggctaccagt

SEQ ID NO: 395731 - DNA, 25 bp, Mus musculus
ttgtcactgggttttacctgctgcc

SEQ ID NO: 395732 - DNA, 25 bp, Mus musculus
ttgtcagaacctggcaccaccgagg

SEQ ID NO: 395733 - DNA, 25 bp, Mus musculus
ttgtcagagagaagaatgaaagtaa

SEQ ID NO: 395734 - DNA, 25 bp, Mus musculus
ttgtcagcaagcttcaggagctcta

SEQ ID NO: 395735 - DNA, 25 bp, Mus musculus
ttgtcagcaggttgatgcaagttgg

SEQ ID NO: 395736 - DNA, 25 bp, Mus musculus
ttgtcagcgactgggtgccattgtg

SEQ ID NO: 395737 - DNA, 25 bp, Mus musculus
ttgtcagcgctgatagaagtggaat

SEQ ID NO: 395738 - DNA, 25 bp, Mus musculus
ttgtcagcgggtgactttgcagttc

SEQ ID NO: 395739 - DNA, 25 bp, Mus musculus
ttgtcaggagatataacagactttc

SEQ ID NO: 395740 - DNA, 25 bp, Mus musculus
ttgtcaggggtgacacccctggatg

SEQ ID NO: 395741 - DNA, 25 bp, Mus musculus
ttgtcagggtaagagatggctgtga

SEQ ID NO: 395742 - DNA, 25 bp, Mus musculus
ttgtcaggttgtaggttatcttgac

SEQ ID NO: 395743 - DNA, 25 bp, Mus musculus
ttgtcagtcttatggggcccagaca

SEQ ID NO: 395744 - DNA, 25 bp, Mus musculus
ttgtcagttgggaaattcctaaatg

SEQ ID NO: 395745 - DNA, 25 bp, Mus musculus
ttgtcataaaaatatgacagatacc

SEQ ID NO: 395746 - DNA, 25 bp, Mus musculus
ttgtcataaaagaaatgtaccccaa

SEQ ID NO: 395747 - DNA, 25 bp, Mus musculus
ttgtcataaaagatgggcgaaccaa

SEQ ID NO: 395748 - DNA, 25 bp, Mus musculus
ttgtcatcaaaggcctctccctgga

SEQ ID NO: 395749 - DNA, 25 bp, Mus musculus
ttgtcatcaaaggtccagatgttcc

SEQ ID NO: 395750 - DNA, 25 bp, Mus musculus
ttgtcatcaacagggctgatatccc

SEQ ID NO: 395751 - DNA, 25 bp, Mus musculus
ttgtcatcacagcttagcgctctgt

SEQ ID NO: 395752 - DNA, 25 bp, Mus musculus
ttgtcatccacacctccatcccact

SEQ ID NO: 395753 - DNA, 25 bp, Mus musculus
ttgtcatccaggtcttggataaata

SEQ ID NO: 395754 - DNA, 25 bp, Mus musculus
ttgtcatccccgtggccctgttgca

SEQ ID NO: 395755 - DNA, 25 bp, Mus musculus
ttgtcatcgacagaggatgagggtg

SEQ ID NO: 395756 - DNA, 25 bp, Mus musculus
ttgtcatcggttcgatttggggata

SEQ ID NO: 395757 - DNA, 25 bp, Mus musculus
ttgtcatcggttcggcgtaatagct

SEQ ID NO: 395758 - DNA, 25 bp, Mus musculus
ttgtcatctcccagggactgcgcag

SEQ ID NO: 395759 - DNA, 25 bp, Mus musculus
ttgtcatctgagtcaacggttgcaa

SEQ ID NO: 395760 - DNA, 25 bp, Mus musculus
ttgtcatggagagaatgcctcctat

SEQ ID NO: 395761 - DNA, 25 bp, Mus musculus
ttgtcatggaggactgtcaccagac

SEQ ID NO: 395762 - DNA, 25 bp, Mus musculus
ttgtcattccagggatcttcattgc

SEQ ID NO: 395763 - DNA, 25 bp, Mus musculus
ttgtcattgagcaagaagagaggcg

SEQ ID NO: 395764 - DNA, 25 bp, Mus musculus
ttgtcattgagtaggtggacccatg

SEQ ID NO: 395765 - DNA, 25 bp, Mus musculus
ttgtccaaacataggaattccaggc

SEQ ID NO: 395766 - DNA, 25 bp, Mus musculus
ttgtccaaacatgactttctgggac

SEQ ID NO: 395767 - DNA, 25 bp, Mus musculus
ttgtccaacagctcctggagctttt

SEQ ID NO: 395768 - DNA, 25 bp, Mus musculus
ttgtccaacagtaatttgtcagatt

SEQ ID NO: 395769 - DNA, 25 bp, Mus musculus
ttgtccaaggcccaggtggtgacca

SEQ ID NO: 395770 - DNA, 25 bp, Mus musculus
ttgtccacacccagatgaagttgct

SEQ ID NO: 395771 - DNA, 25 bp, Mus musculus
ttgtccagagagagaaccttcacac

SEQ ID NO: 395772 - DNA, 25 bp, Mus musculus
ttgtccagatcaggatgactcttta

SEQ ID NO: 395773 - DNA, 25 bp, Mus musculus
ttgtccagatcagtaggtgcaaact

SEQ ID NO: 395774 - DNA, 25 bp, Mus musculus
ttgtccagcggctcgaggacttctc

SEQ ID NO: 395775 - DNA, 25 bp, Mus musculus
ttgtccatcaaagccccagaagacc

SEQ ID NO: 395776 - DNA, 25 bp, Mus musculus
ttgtccatcaaagctgacttctcta

SEQ ID NO: 395777 - DNA, 25 bp, Mus musculus
ttgtccatgcagtatgctgcctggc

SEQ ID NO: 395778 - DNA, 25 bp, Mus musculus
ttgtccatgcagtcccccagcctgc

SEQ ID NO: 395779 - DNA, 25 bp, Mus musculus
ttgtccattctcagcgctgtgtagt

SEQ ID NO: 395780 - DNA, 25 bp, Mus musculus
ttgtcccagaacaatattgctgcct

SEQ ID NO: 395781 - DNA, 25 bp, Mus musculus
ttgtcccatggccttctttctagag

SEQ ID NO: 395782 - DNA, 25 bp, Mus musculus
ttgtccccaagccacagcccaactg

SEQ ID NO: 395783 - DNA, 25 bp, Mus musculus
ttgtccccaggaggcccccaaggtg

SEQ ID NO: 395784 - DNA, 25 bp, Mus musculus
ttgtcccccacgtgccccgagccct

SEQ ID NO: 395785 - DNA, 25 bp, Mus musculus
ttgtccccgggaggtttcatgggat

SEQ ID NO: 395786 - DNA, 25 bp, Mus musculus
ttgtcccctgggagtgcttactttt

SEQ ID NO: 395787 - DNA, 25 bp, Mus musculus
ttgtccccttcgcggccgtcagaat

SEQ ID NO: 395788 - DNA, 25 bp, Mus musculus
ttgtccccttcggatgaattgtctg

SEQ ID NO: 395789 - DNA, 25 bp, Mus musculus
ttgtcccgattctgtggacaggcca

SEQ ID NO: 395790 - DNA, 25 bp, Mus musculus
ttgtcccgtggcccctctggtttca

SEQ ID NO: 395791 - DNA, 25 bp, Mus musculus
ttgtcccgtgggcccaagaactcag

SEQ ID NO: 395792 - DNA, 25 bp, Mus musculus
ttgtccctaccctcgagtctgtagc

SEQ ID NO: 395793 - DNA, 25 bp, Mus musculus
ttgtccctccccagcaatctactct

SEQ ID NO: 395794 - DNA, 25 bp, Mus musculus
ttgtccctccccaggaacattgacc

SEQ ID NO: 395795 - DNA, 25 bp, Mus musculus
ttgtccctgaggagcagggcatttt

SEQ ID NO: 395796 - DNA, 25 bp, Mus musculus
ttgtccgaaatctgcttcttgcagg

SEQ ID NO: 395797 - DNA, 25 bp, Mus musculus
ttgtccgatgccatgaacacataga

SEQ ID NO: 395798 - DNA, 25 bp, Mus musculus
ttgtccgcagaaatctgtctttcag

SEQ ID NO: 395799 - DNA, 25 bp, Mus musculus
ttgtccgcaggaacctgaatgaacc

SEQ ID NO: 395800 - DNA, 25 bp, Mus musculus
ttgtccgcataggcttcagttgtgt

SEQ ID NO: 395801 - DNA, 25 bp, Mus musculus
ttgtccgccagggttcggcagactc

SEQ ID NO: 395802 - DNA, 25 bp, Mus musculus
ttgtccgcccgagatcatcagaaac

SEQ ID NO: 395803 - DNA, 25 bp, Mus musculus
ttgtccgccgccgcaaccatcagcc

SEQ ID NO: 395804 - DNA, 25 bp, Mus musculus
ttgtccgtatgttatatctcaacca

SEQ ID NO: 395805 - DNA, 25 bp, Mus musculus
ttgtcctaagattagcctcacagtt

SEQ ID NO: 395806 - DNA, 25 bp, Mus musculus
ttgtcctacaagcctggacaaacta

SEQ ID NO: 395807 - DNA, 25 bp, Mus musculus
ttgtcctacaaggccctcgttgccc

SEQ ID NO: 395808 - DNA, 25 bp, Mus musculus
ttgtcctataacaggataacataaa

SEQ ID NO: 395809 - DNA, 25 bp, Mus musculus
ttgtcctcaaatcgtcctgcttctc

SEQ ID NO: 395810 - DNA, 25 bp, Mus musculus
ttgtcctcagggagtgcctgcactt

SEQ ID NO: 395811 - DNA, 25 bp, Mus musculus
ttgtcctcagtcaggaggtctcccc

SEQ ID NO: 395812 - DNA, 25 bp, Mus musculus
ttgtcctcagtcagtgctggggact

SEQ ID NO: 395813 - DNA, 25 bp, Mus musculus
ttgtcctgattccgggactgcaggc

SEQ ID NO: 395814 - DNA, 25 bp, Mus musculus
ttgtcctgccttgagagcttacccc

SEQ ID NO: 395815 - DNA, 25 bp, Mus musculus
ttgtcctgccttgaggatgacaaga

SEQ ID NO: 395816 - DNA, 25 bp, Mus musculus
ttgtcctgccttgaggttcctagac

SEQ ID NO: 395817 - DNA, 25 bp, Mus musculus
ttgtcctggagataggacgagtgac

SEQ ID NO: 395818 - DNA, 25 bp, Mus musculus
ttgtcctggcctcagacctcacagt

SEQ ID NO: 395819 - DNA, 25 bp, Mus musculus
ttgtcctggtatgatcccaggctcc

SEQ ID NO: 395820 - DNA, 25 bp, Mus musculus
ttgtcctgtaaggtggtctgtgatg

SEQ ID NO: 395821 - DNA, 25 bp, Mus musculus
ttgtcctgttgcagggccacaatac

SEQ ID NO: 395822 - DNA, 25 bp, Mus musculus
ttgtccttaaaaggttatggctttc

SEQ ID NO: 395823 - DNA, 25 bp, Mus musculus
ttgtccttaagtgtgggaacttcgc

SEQ ID NO: 395824 - DNA, 25 bp, Mus musculus
ttgtcctttcatgtaaatttacata

SEQ ID NO: 395825 - DNA, 25 bp, Mus musculus
ttgtcgaaccacactaaacaagatt

SEQ ID NO: 395826 - DNA, 25 bp, Mus musculus
ttgtcgaagacggggacattacact

SEQ ID NO: 395827 - DNA, 25 bp, Mus musculus
ttgtcgactggaaggataggtgcgg

SEQ ID NO: 395828 - DNA, 25 bp, Mus musculus
ttgtcgagactcagggtgaaatggt

SEQ ID NO: 395829 - DNA, 25 bp, Mus musculus
ttgtcgatgaggtccatgagagaag

SEQ ID NO: 395830 - DNA, 25 bp, Mus musculus
ttgtcgattattcagaagcagaaca

SEQ ID NO: 395831 - DNA, 25 bp, Mus musculus
ttgtcgcaaagagctcaccgagctc

SEQ ID NO: 395832 - DNA, 25 bp, Mus musculus
ttgtcgcaaagagggtttctctgtg

SEQ ID NO: 395833 - DNA, 25 bp, Mus musculus
ttgtcgcaaagagtgtggggagacc

SEQ ID NO: 395834 - DNA, 25 bp, Mus musculus
ttgtcgccagcccgtcccaggtaaa

SEQ ID NO: 395835 - DNA, 25 bp, Mus musculus
ttgtcggaggccagttctggtccgc

SEQ ID NO: 395836 - DNA, 25 bp, Mus musculus
ttgtcggcgtaggaatgtgtttctg

SEQ ID NO: 395837 - DNA, 25 bp, Mus musculus
ttgtcgggcagaactgtgtctgtat

SEQ ID NO: 395838 - DNA, 25 bp, Mus musculus
ttgtcgggcagccagccattcatgc

SEQ ID NO: 395839 - DNA, 25 bp, Mus musculus
ttgtcggggacagagtctcggccac

SEQ ID NO: 395840 - DNA, 25 bp, Mus musculus
ttgtcgtcgtcagcttgacaaaagt

SEQ ID NO: 395841 - DNA, 25 bp, Mus musculus
ttgtcgtgacctctaaatgtggtca

SEQ ID NO: 395842 - DNA, 25 bp, Mus musculus
ttgtcgtggtcagaatttcaaaggc

SEQ ID NO: 395843 - DNA, 25 bp, Mus musculus
ttgtcgttcgaggtaaaaagagaaa

SEQ ID NO: 395844 - DNA, 25 bp, Mus musculus
ttgtcgttcggtgctcgtagctcta

SEQ ID NO: 395845 - DNA, 25 bp, Mus musculus
ttgtcgttggcttcctgcctggtga

SEQ ID NO: 395846 - DNA, 25 bp, Mus musculus
ttgtctaccaacgataaaacaataa

SEQ ID NO: 395847 - DNA, 25 bp, Mus musculus
ttgtctaccagcctcttaaaggtga

SEQ ID NO: 395848 - DNA, 25 bp, Mus musculus
ttgtctaccaggatcctcaggggcg

SEQ ID NO: 395849 - DNA, 25 bp, Mus musculus
ttgtctactcacagagagaaaaaac

SEQ ID NO: 395850 - DNA, 25 bp, Mus musculus
ttgtctactcacagagccccgtggc

SEQ ID NO: 395851 - DNA, 25 bp, Mus musculus
ttgtctactggtgcattgaagatcg

SEQ ID NO: 395852 - DNA, 25 bp, Mus musculus
ttgtctagactggctgttcctgtgt

SEQ ID NO: 395853 - DNA, 25 bp, Mus musculus
ttgtctagttcaggccagctgctgc

SEQ ID NO: 395854 - DNA, 25 bp, Mus musculus
ttgtctatgagtttctgatgtctgg

SEQ ID NO: 395855 - DNA, 25 bp, Mus musculus
ttgtctcaaagaacttttgagcaga

SEQ ID NO: 395856 - DNA, 25 bp, Mus musculus
ttgtctcaaagcgcaaatttcccag

SEQ ID NO: 395857 - DNA, 25 bp, Mus musculus
ttgtctcaacagcctgacagagcag

SEQ ID NO: 395858 - DNA, 25 bp, Mus musculus
ttgtctcatccctgctcctgtctcc

SEQ ID NO: 395859 - DNA, 25 bp, Mus musculus
ttgtctcattgtgtggaatcacagg

SEQ ID NO: 395860 - DNA, 25 bp, Mus musculus
ttgtctccggatctgatcgtctgcc

SEQ ID NO: 395861 - DNA, 25 bp, Mus musculus
ttgtctcctcaaggcaccttgttgt

SEQ ID NO: 395862 - DNA, 25 bp, Mus musculus
ttgtctctgcagaccgctcgggaat

SEQ ID NO: 395863 - DNA, 25 bp, Mus musculus
ttgtctgaagcgaaggtgtccgagc

SEQ ID NO: 395864 - DNA, 25 bp, Mus musculus
ttgtctgacttcggtcagccatgtc

SEQ ID NO: 395865 - DNA, 25 bp, Mus musculus
ttgtctgagaggaaccattctctga

SEQ ID NO: 395866 - DNA, 25 bp, Mus musculus
ttgtctgagaggaacccttctctga

SEQ ID NO: 395867 - DNA, 25 bp, Mus musculus
ttgtctgagaggaagttttatctgt

SEQ ID NO: 395868 - DNA, 25 bp, Mus musculus
ttgtctgagcaggagaatctggaga

SEQ ID NO: 395869 - DNA, 25 bp, Mus musculus
ttgtctgcaaggaatggaccgggtt

SEQ ID NO: 395870 - DNA, 25 bp, Mus musculus
ttgtctgcaaggatctctcctcacc

SEQ ID NO: 395871 - DNA, 25 bp, Mus musculus
ttgtctgccagactgtcattgaaga

SEQ ID NO: 395872 - DNA, 25 bp, Mus musculus
ttgtctgcgatttagctgctgtgtg

SEQ ID NO: 395873 - DNA, 25 bp, Mus musculus
ttgtctgctccctggtggttctctg

SEQ ID NO: 395874 - DNA, 25 bp, Mus musculus
ttgtctgtagtgatgctgcatgcca

SEQ ID NO: 395875 - DNA, 25 bp, Mus musculus
ttgtctgtggctcagctatcttcca

SEQ ID NO: 395876 - DNA, 25 bp, Mus musculus
ttgtcttagctggcggtgtggcacc

SEQ ID NO: 395877 - DNA, 25 bp, Mus musculus
ttgtcttcagagattttcacagctg

SEQ ID NO: 395878 - DNA, 25 bp, Mus musculus
ttgtcttccaaaaggctcaaagact

SEQ ID NO: 395879 - DNA, 25 bp, Mus musculus
ttgtcttcctagccacgagtctagc

SEQ ID NO: 395880 - DNA, 25 bp, Mus musculus
ttgtcttctgggtgctgggagccct

SEQ ID NO: 395881 - DNA, 25 bp, Mus musculus
ttgtcttctggttctctgtgttcct

SEQ ID NO: 395882 - DNA, 25 bp, Mus musculus
ttgtcttgacaccaggaacctatgg

SEQ ID NO: 395883 - DNA, 25 bp, Mus musculus
ttgtcttgacaccaggctgaccttc

SEQ ID NO: 395884 - DNA, 25 bp, Mus musculus
ttgtcttgagctggaagccggttcc

SEQ ID NO: 395885 - DNA, 25 bp, Mus musculus
ttgtcttgagctggcccatcatggc

SEQ ID NO: 395886 - DNA, 25 bp, Mus musculus
ttgtctttaaggtctctaatagatg

SEQ ID NO: 395887 - DNA, 25 bp, Mus musculus
ttgtctttaaggtggtgctgatcgg

SEQ ID NO: 395888 - DNA, 25 bp, Mus musculus
ttgtctttccagcttctcctggtct

SEQ ID NO: 395889 - DNA, 25 bp, Mus musculus
ttgtctttccagggagctcccgtcc

SEQ ID NO: 395890 - DNA, 25 bp, Mus musculus
ttgtcttttgcaatcaaagttctat

SEQ ID NO: 395891 - DNA, 25 bp, Mus musculus
ttgtcttttgcaattagaagatgga

SEQ ID NO: 395892 - DNA, 25 bp, Mus musculus
ttgtgaaaacattcgtatagctaat

SEQ ID NO: 395893 - DNA, 25 bp, Mus musculus
ttgtgaaaaggagtgttaagcaaaa

SEQ ID NO: 395894 - DNA, 25 bp, Mus musculus
ttgtgaaactataagcagcaaagat

SEQ ID NO: 395895 - DNA, 25 bp, Mus musculus
ttgtgaaagtggaacccagtgacaa

SEQ ID NO: 395896 - DNA, 25 bp, Mus musculus
ttgtgaaagtgttacaggtttatga

SEQ ID NO: 395897 - DNA, 25 bp, Mus musculus
ttgtgaaatgcacgatgaggaaact

SEQ ID NO: 395898 - DNA, 25 bp, Mus musculus
ttgtgaacaagggttcccgagagaa

SEQ ID NO: 395899 - DNA, 25 bp, Mus musculus
ttgtgaaccaaggaattcatcctac

SEQ ID NO: 395900 - DNA, 25 bp, Mus musculus
ttgtgaactgttcagacgcctcctt

SEQ ID NO: 395901 - DNA, 25 bp, Mus musculus
ttgtgaagaagggaagtgtgtttaa

SEQ ID NO: 395902 - DNA, 25 bp, Mus musculus
ttgtgaagaattccatcaatggaaa

SEQ ID NO: 395903 - DNA, 25 bp, Mus musculus
ttgtgaagagcgtgggtgtggtggc

SEQ ID NO: 395904 - DNA, 25 bp, Mus musculus
ttgtgaagcagaagtacctggacta

SEQ ID NO: 395905 - DNA, 25 bp, Mus musculus
ttgtgaagccaccagcatctgctcg

SEQ ID NO: 395906 - DNA, 25 bp, Mus musculus
ttgtgaagccagtattccccttcca

SEQ ID NO: 395907 - DNA, 25 bp, Mus musculus
ttgtgaagctccgttttgttcagtt

SEQ ID NO: 395908 - DNA, 25 bp, Mus musculus
ttgtgaaggaaggactccaccgcta

SEQ ID NO: 395909 - DNA, 25 bp, Mus musculus
ttgtgaaggaatctgattgccttca

SEQ ID NO: 395910 - DNA, 25 bp, Mus musculus
ttgtgaagtctcttattggtgcagc

SEQ ID NO: 395911 - DNA, 25 bp, Mus musculus
ttgtgaataaatgtctcattaagaa

SEQ ID NO: 395912 - DNA, 25 bp, Mus musculus
ttgtgaataggatggagacaacaga

SEQ ID NO: 395913 - DNA, 25 bp, Mus musculus
ttgtgaatggaggttggagacctag

SEQ ID NO: 395914 - DNA, 25 bp, Mus musculus
ttgtgaatggctgcttattggatct

SEQ ID NO: 395915 - DNA, 25 bp, Mus musculus
ttgtgaatgtgagagacctctcagt

SEQ ID NO: 395916 - DNA, 25 bp, Mus musculus
ttgtgaatgtgaggcctcagtgagc

SEQ ID NO: 395917 - DNA, 25 bp, Mus musculus
ttgtgacaaagcccaatggcgcgct

SEQ ID NO: 395918 - DNA, 25 bp, Mus musculus
ttgtgacaagcagcctgacaaaaga

SEQ ID NO: 395919 - DNA, 25 bp, Mus musculus
ttgtgacaagcaggctgagtaattt

SEQ ID NO: 395920 - DNA, 25 bp, Mus musculus
ttgtgacaccagcacacatagactg

SEQ ID NO: 395921 - DNA, 25 bp, Mus musculus
ttgtgacaccagcagacatagactg

SEQ ID NO: 395922 - DNA, 25 bp, Mus musculus
ttgtgacactgtcagagtatttttc

SEQ ID NO: 395923 - DNA, 25 bp, Mus musculus
ttgtgacagagtgggacttggtatg

SEQ ID NO: 395924 - DNA, 25 bp, Mus musculus
ttgtgacagggatgagtgggatgta

SEQ ID NO: 395925 - DNA, 25 bp, Mus musculus
ttgtgacctcgcgagtttcctgaca

SEQ ID NO: 395926 - DNA, 25 bp, Mus musculus
ttgtgacctcgtactagaagacaca

SEQ ID NO: 395927 - DNA, 25 bp, Mus musculus
ttgtgacgcgggatggtcactcgga

SEQ ID NO: 395928 - DNA, 25 bp, Mus musculus
ttgtgagaaccgagaaatggcaaaa

SEQ ID NO: 395929 - DNA, 25 bp, Mus musculus
ttgtgagaagaaatggaaatgatca

SEQ ID NO: 395930 - DNA, 25 bp, Mus musculus
ttgtgagaataagttcaaggtgctt

SEQ ID NO: 395931 - DNA, 25 bp, Mus musculus
ttgtgagaccaacaaatagctgtat

SEQ ID NO: 395932 - DNA, 25 bp, Mus musculus
ttgtgagaccaacaaatgacaccgt

SEQ ID NO: 395933 - DNA, 25 bp, Mus musculus
ttgtgagactcgccccacccatccc

SEQ ID NO: 395934 - DNA, 25 bp, Mus musculus
ttgtgagagaggctgtccgtaccta

SEQ ID NO: 395935 - DNA, 25 bp, Mus musculus
ttgtgagagagttataaaagatgaa

SEQ ID NO: 395936 - DNA, 25 bp, Mus musculus
ttgtgagatttttgtggacagcaca

SEQ ID NO: 395937 - DNA, 25 bp, Mus musculus
ttgtgagcagaacatgttactaaga

SEQ ID NO: 395938 - DNA, 25 bp, Mus musculus
ttgtgagcaggtgtccacaaagtgc

SEQ ID NO: 395939 - DNA, 25 bp, Mus musculus
ttgtgagcatgaggttgtctattac

SEQ ID NO: 395940 - DNA, 25 bp, Mus musculus
ttgtgagcatgagttggatatacaa

SEQ ID NO: 395941 - DNA, 25 bp, Mus musculus
ttgtgagcctgccgctcatgctgta

SEQ ID NO: 395942 - DNA, 25 bp, Mus musculus
ttgtgagcctgtttgtgggctgtcc

SEQ ID NO: 395943 - DNA, 25 bp, Mus musculus
ttgtgaggcgaacattgaggcttgg

SEQ ID NO: 395944 - DNA, 25 bp, Mus musculus
ttgtgaggcttatcggaagaaatgg

SEQ ID NO: 395945 - DNA, 25 bp, Mus musculus
ttgtgaggggagctgttgtggaaaa

SEQ ID NO: 395946 - DNA, 25 bp, Mus musculus
ttgtgaggggtgttctgtagtggcc

SEQ ID NO: 395947 - DNA, 25 bp, Mus musculus
ttgtgagtaccctgggaaaagagga

SEQ ID NO: 395948 - DNA, 25 bp, Mus musculus
ttgtgagtgaagatagtttaggtca

SEQ ID NO: 395949 - DNA, 25 bp, Mus musculus
ttgtgagtgaagatgatcgtaatac

SEQ ID NO: 395950 - DNA, 25 bp, Mus musculus
ttgtgagtgtgagagcccgctgtga

SEQ ID NO: 395951 - DNA, 25 bp, Mus musculus
ttgtgagttcgactgtgatttaccg

SEQ ID NO: 395952 - DNA, 25 bp, Mus musculus
ttgtgagtttgatgcagcctaccac

SEQ ID NO: 395953 - DNA, 25 bp, Mus musculus
ttgtgagtttgtctttggaggcctg

SEQ ID NO: 395954 - DNA, 25 bp, Mus musculus
ttgtgatacacaagacatttcgact

SEQ ID NO: 395955 - DNA, 25 bp, Mus musculus
ttgtgatagggagttctgaggctct

SEQ ID NO: 395956 - DNA, 25 bp, Mus musculus
ttgtgatatcgtgtcccgagatggg

SEQ ID NO: 395957 - DNA, 25 bp, Mus musculus
ttgtgatatgatgagaaaaccaagg

SEQ ID NO: 395958 - DNA, 25 bp, Mus musculus
ttgtgatctagccagatcttctgga

SEQ ID NO: 395959 - DNA, 25 bp, Mus musculus
ttgtgatcttattaattggaggctc

SEQ ID NO: 395960 - DNA, 25 bp, Mus musculus
ttgtgatcttggaggctggtccagg

SEQ ID NO: 395961 - DNA, 25 bp, Mus musculus
ttgtgatgatccagaagcaacatgg

SEQ ID NO: 395962 - DNA, 25 bp, Mus musculus
ttgtgatgcaggagactgacggttc

SEQ ID NO: 395963 - DNA, 25 bp, Mus musculus
ttgtgatggtcaaggttgttcctac

SEQ ID NO: 395964 - DNA, 25 bp, Mus musculus
ttgtgattaataaccagctggttga

SEQ ID NO: 395965 - DNA, 25 bp, Mus musculus
ttgtgattcagatacaaacaggatc

SEQ ID NO: 395966 - DNA, 25 bp, Mus musculus
ttgtgattcagatcaactgccaccc

SEQ ID NO: 395967 - DNA, 25 bp, Mus musculus
ttgtgcaaatgaagaaaagcaacta

SEQ ID NO: 395968 - DNA, 25 bp, Mus musculus
ttgtgcacaaggtggtccgagacat

SEQ ID NO: 395969 - DNA, 25 bp, Mus musculus
ttgtgcagagactgccttgtgtgga

SEQ ID NO: 395970 - DNA, 25 bp, Mus musculus
ttgtgcagagattaagcacatgatg

SEQ ID NO: 395971 - DNA, 25 bp, Mus musculus
ttgtgcagaggcggccatgcttctc

SEQ ID NO: 395972 - DNA, 25 bp, Mus musculus
ttgtgcagcacagggggcagtgccc

SEQ ID NO: 395973 - DNA, 25 bp, Mus musculus
ttgtgcaggactgaggaagccagct

SEQ ID NO: 395974 - DNA, 25 bp, Mus musculus
ttgtgcaggactgaggtcctctttc

SEQ ID NO: 395975 - DNA, 25 bp, Mus musculus
ttgtgcatctccaggtcccacctgc

SEQ ID NO: 395976 - DNA, 25 bp, Mus musculus
ttgtgcatgctagatgtgaaacatt

SEQ ID NO: 395977 - DNA, 25 bp, Mus musculus
ttgtgcatgctggatctctcgtctg

SEQ ID NO: 395978 - DNA, 25 bp, Mus musculus
ttgtgcattggactcgttactgggc

SEQ ID NO: 395979 - DNA, 25 bp, Mus musculus
ttgtgccaaagataaatttgaaaat

SEQ ID NO: 395980 - DNA, 25 bp, Mus musculus
ttgtgccacacgagaccctggctgg

SEQ ID NO: 395981 - DNA, 25 bp, Mus musculus
ttgtgccacaggcttacagtgggtc

SEQ ID NO: 395982 - DNA, 25 bp, Mus musculus
ttgtgccacaggtgtcttatgtgtg

SEQ ID NO: 395983 - DNA, 25 bp, Mus musculus
ttgtgccgcaggtcgagatttcagg

SEQ ID NO: 395984 - DNA, 25 bp, Mus musculus
ttgtgcctaagccagatctcaaagc

SEQ ID NO: 395985 - DNA, 25 bp, Mus musculus
ttgtgcctgtctcagagagcctggg

SEQ ID NO: 395986 - DNA, 25 bp, Mus musculus
ttgtgctaaagaaatgctctactat

SEQ ID NO: 395987 - DNA, 25 bp, Mus musculus
ttgtgctaaagaaattgccaacaaa

SEQ ID NO: 395988 - DNA, 25 bp, Mus musculus
ttgtgctatagggattgtgccatct

SEQ ID NO: 395989 - DNA, 25 bp, Mus musculus
ttgtgctcaaacaggctctggaaaa

SEQ ID NO: 395990 - DNA, 25 bp, Mus musculus
ttgtgctcaagaccttcctggatga

SEQ ID NO: 395991 - DNA, 25 bp, Mus musculus
ttgtgctcatccagatctgcaacgg

SEQ ID NO: 395992 - DNA, 25 bp, Mus musculus
ttgtgctccacggggaggcacacgg

SEQ ID NO: 395993 - DNA, 25 bp, Mus musculus
ttgtgctcccagatggtgtcataag

SEQ ID NO: 395994 - DNA, 25 bp, Mus musculus
ttgtgctctctaagggccatgcagc

SEQ ID NO: 395995 - DNA, 25 bp, Mus musculus
ttgtgctgactgagctcggattggg

SEQ ID NO: 395996 - DNA, 25 bp, Mus musculus
ttgtgctggaggtgtccaaagacaa

SEQ ID NO: 395997 - DNA, 25 bp, Mus musculus
ttgtgctggtaaaagctgatgaaga

SEQ ID NO: 395998 - DNA, 25 bp, Mus musculus
ttgtgcttaggacgggttcccgatt

SEQ ID NO: 395999 - DNA, 25 bp, Mus musculus
ttgtgcttgaatctgctttttacct

SEQ ID NO: 396000 - DNA, 25 bp, Mus musculus
ttgtgcttgctaggggtcatgatat

SEQ ID NO: 396001 - DNA, 25 bp, Mus musculus
ttgtggaaaagaaacctcttcggtg

SEQ ID NO: 396002 - DNA, 25 bp, Mus musculus
ttgtggaaaagaaccagcgggtccc

SEQ ID NO: 396003 - DNA, 25 bp, Mus musculus
ttgtggaaaagatattctcatgtag

SEQ ID NO: 396004 - DNA, 25 bp, Mus musculus
ttgtggaaacagcactcatgaacac

SEQ ID NO: 396005 - DNA, 25 bp, Mus musculus
ttgtggaaactggcggtgttttcag

SEQ ID NO: 396006 - DNA, 25 bp, Mus musculus
ttgtggaaactggcgttgttgacaa

SEQ ID NO: 396007 - DNA, 25 bp, Mus musculus
ttgtggaaagattgagttcaggagg

SEQ ID NO: 396008 - DNA, 25 bp, Mus musculus
ttgtggaacaagtgcgcatctgtag

SEQ ID NO: 396009 - DNA, 25 bp, Mus musculus
ttgtggaacacgaagccctgcagag

SEQ ID NO: 396010 - DNA, 25 bp, Mus musculus
ttgtggaacacgctgtcttcagaca

SEQ ID NO: 396011 - DNA, 25 bp, Mus musculus
ttgtggaaccgggtgccatgtttcc

SEQ ID NO: 396012 - DNA, 25 bp, Mus musculus
ttgtggaactgtaccttcactcaaa

SEQ ID NO: 396013 - DNA, 25 bp, Mus musculus
ttgtggaagagagtccagaaaacct

SEQ ID NO: 396014 - DNA, 25 bp, Mus musculus
ttgtggaagcgatggtgaatgagaa

SEQ ID NO: 396015 - DNA, 25 bp, Mus musculus
ttgtggaaggatacgccaatgtcaa

SEQ ID NO: 396016 - DNA, 25 bp, Mus musculus
ttgtggacaggttggtttaatgaag

SEQ ID NO: 396017 - DNA, 25 bp, Mus musculus
ttgtggacagtatttttgaacaatg

SEQ ID NO: 396018 - DNA, 25 bp, Mus musculus
ttgtggagactcaaactgaagtgag

SEQ ID NO: 396019 - DNA, 25 bp, Mus musculus
ttgtggagcgggtaatggatgacta

SEQ ID NO: 396020 - DNA, 25 bp, Mus musculus
ttgtggagctggaaggtcttgttgc

SEQ ID NO: 396021 - DNA, 25 bp, Mus musculus
ttgtggaggagggggatatgaaagg

SEQ ID NO: 396022 - DNA, 25 bp, Mus musculus
ttgtggaggttgcatcagatgaaga

SEQ ID NO: 396023 - DNA, 25 bp, Mus musculus
ttgtggaggttggtccctgcatccc

SEQ ID NO: 396024 - DNA, 25 bp, Mus musculus
ttgtggataagcctgagtggcgacc

SEQ ID NO: 396025 - DNA, 25 bp, Mus musculus
ttgtggataaggactgaatcttggt

SEQ ID NO: 396026 - DNA, 25 bp, Mus musculus
ttgtggataagtgctgctaaagtgg

SEQ ID NO: 396027 - DNA, 25 bp, Mus musculus
ttgtggataatgtagagggtcctgt

SEQ ID NO: 396028 - DNA, 25 bp, Mus musculus
ttgtggatagtgtggaaacctgctg

SEQ ID NO: 396029 - DNA, 25 bp, Mus musculus
ttgtggatagtgtgggcctgccagc

SEQ ID NO: 396030 - DNA, 25 bp, Mus musculus
ttgtggatatatccgaaatggctac

SEQ ID NO: 396031 - DNA, 25 bp, Mus musculus
ttgtggatcacagctgcgaccgagg

SEQ ID NO: 396032 - DNA, 25 bp, Mus musculus
ttgtggatccttgatcttagaatct

SEQ ID NO: 396033 - DNA, 25 bp, Mus musculus
ttgtggatccttgggggcaggtcct

SEQ ID NO: 396034 - DNA, 25 bp, Mus musculus
ttgtggatgtgatgctttagatgag

SEQ ID NO: 396035 - DNA, 25 bp, Mus musculus
ttgtggattaaagctttctccttat

SEQ ID NO: 396036 - DNA, 25 bp, Mus musculus
ttgtggattcagcatttaagcaaaa

SEQ ID NO: 396037 - DNA, 25 bp, Mus musculus
ttgtggcagctatgggaaagagata

SEQ ID NO: 396038 - DNA, 25 bp, Mus musculus
ttgtggccacacaggatcagaactt

SEQ ID NO: 396039 - DNA, 25 bp, Mus musculus
ttgtggcccaggatgacaacgagtg

SEQ ID NO: 396040 - DNA, 25 bp, Mus musculus
ttgtggcccaggttgacaacgagtg

SEQ ID NO: 396041 - DNA, 25 bp, Mus musculus
ttgtggcccttctcatcaaggtgat

SEQ ID NO: 396042 - DNA, 25 bp, Mus musculus
ttgtggccgataaagattactctgt

SEQ ID NO: 396043 - DNA, 25 bp, Mus musculus
ttgtggcgaatcagaataatttaaa

SEQ ID NO: 396044 - DNA, 25 bp, Mus musculus
ttgtggcgttaaactttctccagac

SEQ ID NO: 396045 - DNA, 25 bp, Mus musculus
ttgtggctgctcccgcaggctggcc

SEQ ID NO: 396046 - DNA, 25 bp, Mus musculus
ttgtggctttgaccatccacgaaaa

SEQ ID NO: 396047 - DNA, 25 bp, Mus musculus
ttgtggctttgagtctgacaagatg

SEQ ID NO: 396048 - DNA, 25 bp, Mus musculus
ttgtgggaagctcccctattttcca

SEQ ID NO: 396049 - DNA, 25 bp, Mus musculus
ttgtgggaagggcatttgtgtactt

SEQ ID NO: 396050 - DNA, 25 bp, Mus musculus
ttgtgggagcagctgttgctttccc

SEQ ID NO: 396051 - DNA, 25 bp, Mus musculus
ttgtgggagctgctgttgctttccc

SEQ ID NO: 396052 - DNA, 25 bp, Mus musculus
ttgtgggcagaagctgacgtttttc

SEQ ID NO: 396053 - DNA, 25 bp, Mus musculus
ttgtgggcaggatatttgtgtttgc

SEQ ID NO: 396054 - DNA, 25 bp, Mus musculus
ttgtgggcttcctcaatattgatga

SEQ ID NO: 396055 - DNA, 25 bp, Mus musculus
ttgtggggacaaaacacagaagtct

SEQ ID NO: 396056 - DNA, 25 bp, Mus musculus
ttgtggggacaggttctggaaatac

SEQ ID NO: 396057 - DNA, 25 bp, Mus musculus
ttgtggggtcagggggactatgtat

SEQ ID NO: 396058 - DNA, 25 bp, Mus musculus
ttgtgggtcctcggggcgagcgagg

SEQ ID NO: 396059 - DNA, 25 bp, Mus musculus
ttgtggtaatcagggtaacacgcag

SEQ ID NO: 396060 - DNA, 25 bp, Mus musculus
ttgtggtagagaaagaaaccctggc

SEQ ID NO: 396061 - DNA, 25 bp, Mus musculus
ttgtggtcaaccacactgtcctggg

SEQ ID NO: 396062 - DNA, 25 bp, Mus musculus
ttgtggtcaaggacggacccggctt

SEQ ID NO: 396063 - DNA, 25 bp, Mus musculus
ttgtggtcagagcagcagattttcc

SEQ ID NO: 396064 - DNA, 25 bp, Mus musculus
ttgtggtgactgacctatccgcttc

SEQ ID NO: 396065 - DNA, 25 bp, Mus musculus
ttgtggtgctagacctgaactataa

SEQ ID NO: 396066 - DNA, 25 bp, Mus musculus
ttgtggtgctgcatctacataacaa

SEQ ID NO: 396067 - DNA, 25 bp, Mus musculus
ttgtggtggctcgattcctgtctct

SEQ ID NO: 396068 - DNA, 25 bp, Mus musculus
ttgtggtgttacaggccgccctgct

SEQ ID NO: 396069 - DNA, 25 bp, Mus musculus
ttgtggtgttacaggttagtgtcac

SEQ ID NO: 396070 - DNA, 25 bp, Mus musculus
ttgtggttaataaaggaggctttgg

SEQ ID NO: 396071 - DNA, 25 bp, Mus musculus
ttgtggttaataatgcagctgtgtc

SEQ ID NO: 396072 - DNA, 25 bp, Mus musculus
ttgtggttcccgacgctcctgcgtt

SEQ ID NO: 396073 - DNA, 25 bp, Mus musculus
ttgtggttcccgacggtgacaaact

SEQ ID NO: 396074 - DNA, 25 bp, Mus musculus
ttgtggttcccgacggttttggcta

SEQ ID NO: 396075 - DNA, 25 bp, Mus musculus
ttgtggttggcaacctctgaagtct

SEQ ID NO: 396076 - DNA, 25 bp, Mus musculus
ttgtggtttatcaagattactcggg

SEQ ID NO: 396077 - DNA, 25 bp, Mus musculus
ttgtggtttatcaagggatccacaa

SEQ ID NO: 396078 - DNA, 25 bp, Mus musculus
ttgtgtaaagcctcctgtaccctgg

SEQ ID NO: 396079 - DNA, 25 bp, Mus musculus
ttgtgtaagcagaatattcaagggc

SEQ ID NO: 396080 - DNA, 25 bp, Mus musculus
ttgtgtacgtgagcctggacagacc

SEQ ID NO: 396081 - DNA, 25 bp, Mus musculus
ttgtgtaggccaggttgactcttca

SEQ ID NO: 396082 - DNA, 25 bp, Mus musculus
ttgtgtatatgctgtagaaaaccct

SEQ ID NO: 396083 - DNA, 25 bp, Mus musculus
ttgtgtattggcattggaggtgacc

SEQ ID NO: 396084 - DNA, 25 bp, Mus musculus
ttgtgtattttggggtgagcgtgga

SEQ ID NO: 396085 - DNA, 25 bp, Mus musculus
ttgtgtcaaaagcctatgtccccac

SEQ ID NO: 396086 - DNA, 25 bp, Mus musculus
ttgtgtcaaaagggaagatggaaga

SEQ ID NO: 396087 - DNA, 25 bp, Mus musculus
ttgtgtcaagggaaaagatgccgtt

SEQ ID NO: 396088 - DNA, 25 bp, Mus musculus
ttgtgtcagggacaggagttcagag

SEQ ID NO: 396089 - DNA, 25 bp, Mus musculus
ttgtgtcagggctggacagtgctac

SEQ ID NO: 396090 - DNA, 25 bp, Mus musculus
ttgtgtcgcttgtaggaatgccaaa

SEQ ID NO: 396091 - DNA, 25 bp, Mus musculus
ttgtgtctcggctttccagtctgtt

SEQ ID NO: 396092 - DNA, 25 bp, Mus musculus
ttgtgtctcttactggggccttcac

SEQ ID NO: 396093 - DNA, 25 bp, Mus musculus
ttgtgtctgaggtcaactgaagctg

SEQ ID NO: 396094 - DNA, 25 bp, Mus musculus
ttgtgtgatggtcaggaagcctgct

SEQ ID NO: 396095 - DNA, 25 bp, Mus musculus
ttgtgtgctcgaaaattggagtttg

SEQ ID NO: 396096 - DNA, 25 bp, Mus musculus
ttgtgtgctgctcaaagaggtcctc

SEQ ID NO: 396097 - DNA, 25 bp, Mus musculus
ttgtgtggacgctcgaattatcaag

SEQ ID NO: 396098 - DNA, 25 bp, Mus musculus
ttgtgtggccaaagccaaacttgcc

SEQ ID NO: 396099 - DNA, 25 bp, Mus musculus
ttgtgtggccaaagggacagtactt

SEQ ID NO: 396100 - DNA, 25 bp, Mus musculus
ttgtgtggttcatttttataagttt

SEQ ID NO: 396101 - DNA, 25 bp, Mus musculus
ttgtgtgtctggcttatggtagcat

SEQ ID NO: 396102 - DNA, 25 bp, Mus musculus
ttgtgtgtctgggagaagatgacca

SEQ ID NO: 396103 - DNA, 25 bp, Mus musculus
ttgtgtgttgaggatgggagtcaca

SEQ ID NO: 396104 - DNA, 25 bp, Mus musculus
ttgtgttaaggcctcacaccttgaa

SEQ ID NO: 396105 - DNA, 25 bp, Mus musculus
ttgtgttacagctgccctatcccca

SEQ ID NO: 396106 - DNA, 25 bp, Mus musculus
ttgtgttatcaaccgaacacagaag

SEQ ID NO: 396107 - DNA, 25 bp, Mus musculus
ttgtgttatcagaacccccaacttg

SEQ ID NO: 396108 - DNA, 25 bp, Mus musculus
ttgtgttatcagaagccccaacttg

SEQ ID NO: 396109 - DNA, 25 bp, Mus musculus
ttgtgttccagaatggggaggtaga

SEQ ID NO: 396110 - DNA, 25 bp, Mus musculus
ttgtgttccagggagatgctatttc

SEQ ID NO: 396111 - DNA, 25 bp, Mus musculus
ttgtgttcctgggtcttgctgtctc

SEQ ID NO: 396112 - DNA, 25 bp, Mus musculus
ttgtgttgaaggtgcaggaccagac

SEQ ID NO: 396113 - DNA, 25 bp, Mus musculus
ttgtgttggcaagagagatgaagat

SEQ ID NO: 396114 - DNA, 25 bp, Mus musculus
ttgtgttggcaagaggccacagcac

SEQ ID NO: 396115 - DNA, 25 bp, Mus musculus
ttgtgtttaaggaatcaaaagtcag

SEQ ID NO: 396116 - DNA, 25 bp, Mus musculus
ttgtgtttgagaggaaacttcgagt

SEQ ID NO: 396117 - DNA, 25 bp, Mus musculus
ttgtgtttgtagacccatccctgac

SEQ ID NO: 396118 - DNA, 25 bp, Mus musculus
ttgtgttttcagatgtccctggtag

SEQ ID NO: 396119 - DNA, 25 bp, Mus musculus
ttgttaacaagcaagaaagaagaca

SEQ ID NO: 396120 - DNA, 25 bp, Mus musculus
ttgttaacaagcaagatccgctgat

SEQ ID NO: 396121 - DNA, 25 bp, Mus musculus
ttgttaacaataaggacctccagtc

SEQ ID NO: 396122 - DNA, 25 bp, Mus musculus
ttgttaacatgagctttctgctcaa

SEQ ID NO: 396123 - DNA, 25 bp, Mus musculus
ttgttaacatgaggtctatccagga

SEQ ID NO: 396124 - DNA, 25 bp, Mus musculus
ttgttaaggtctggctcagtttatg

SEQ ID NO: 396125 - DNA, 25 bp, Mus musculus
ttgttaatacaaaagaagttatttt

SEQ ID NO: 396126 - DNA, 25 bp, Mus musculus
ttgttacaagagggaagcctgtcat

SEQ ID NO: 396127 - DNA, 25 bp, Mus musculus
ttgttacacaggttacaaccctggt

SEQ ID NO: 396128 - DNA, 25 bp, Mus musculus
ttgttacatgggtttatccatggct

SEQ ID NO: 396129 - DNA, 25 bp, Mus musculus
ttgttacatgtgtatctccagagtc

SEQ ID NO: 396130 - DNA, 25 bp, Mus musculus
ttgttaccaaagtgtgcaactgcgt

SEQ ID NO: 396131 - DNA, 25 bp, Mus musculus
ttgttacctccttggatttccataa

SEQ ID NO: 396132 - DNA, 25 bp, Mus musculus
ttgttacctccttgggcatccccaa

SEQ ID NO: 396133 - DNA, 25 bp, Mus musculus
ttgttaccttgctgtatcgacatgg

SEQ ID NO: 396134 - DNA, 25 bp, Mus musculus
ttgttaccttgttgtctctgcttcc

SEQ ID NO: 396135 - DNA, 25 bp, Mus musculus
ttgttactaacagcaagttcaatgt

SEQ ID NO: 396136 - DNA, 25 bp, Mus musculus
ttgttactaggattgaaattccaag

SEQ ID NO: 396137 - DNA, 25 bp, Mus musculus
ttgttactgaggaacttcctgatgt

SEQ ID NO: 396138 - DNA, 25 bp, Mus musculus
ttgttagaagtccctccgctccaag

SEQ ID NO: 396139 - DNA, 25 bp, Mus musculus
ttgttagatcaggctgctttctccc

SEQ ID NO: 396140 - DNA, 25 bp, Mus musculus
ttgttagatcaggggggctttgccc

SEQ ID NO: 396141 - DNA, 25 bp, Mus musculus
ttgttagggaaataattgttgcttg

SEQ ID NO: 396142 - DNA, 25 bp, Mus musculus
ttgttagtaagcacagtacagaagc

SEQ ID NO: 396143 - DNA, 25 bp, Mus musculus
ttgttagtgaccagatggttcagaa

SEQ ID NO: 396144 - DNA, 25 bp, Mus musculus
ttgttagtgaccagtaaaaggtact

SEQ ID NO: 396145 - DNA, 25 bp, Mus musculus
ttgttagtgagctgctggaagctct

SEQ ID NO: 396146 - DNA, 25 bp, Mus musculus
ttgttatagccagagaatgtattct

SEQ ID NO: 396147 - DNA, 25 bp, Mus musculus
ttgttatagccagataactggggtg

SEQ ID NO: 396148 - DNA, 25 bp, Mus musculus
ttgttatcagttgaatctggaggca

SEQ ID NO: 396149 - DNA, 25 bp, Mus musculus
ttgttatccagatggtttcaaggct

SEQ ID NO: 396150 - DNA, 25 bp, Mus musculus
ttgttatctgaagaaagaatctgtg

SEQ ID NO: 396151 - DNA, 25 bp, Mus musculus
ttgttatctgaaggttttctctgta

SEQ ID NO: 396152 - DNA, 25 bp, Mus musculus
ttgttatgccagtcaggatttgcac

SEQ ID NO: 396153 - DNA, 25 bp, Mus musculus
ttgttattgatgctgtaagaactaa

SEQ ID NO: 396154 - DNA, 25 bp, Mus musculus
ttgttcaaaaggaggccacctatga

SEQ ID NO: 396155 - DNA, 25 bp, Mus musculus
ttgttcaaaaggagtatgaaggctt

SEQ ID NO: 396156 - DNA, 25 bp, Mus musculus
ttgttcaaaaggagtttgttgaagg

SEQ ID NO: 396157 - DNA, 25 bp, Mus musculus
ttgttcaaaggaaatgccaccatgc

SEQ ID NO: 396158 - DNA, 25 bp, Mus musculus
ttgttcaaagggaagtggctgactc

SEQ ID NO: 396159 - DNA, 25 bp, Mus musculus
ttgttcaacagaacaagtaagaagt

SEQ ID NO: 396160 - DNA, 25 bp, Mus musculus
ttgttcaacaggtttatggtcggct

SEQ ID NO: 396161 - DNA, 25 bp, Mus musculus
ttgttcaacagttgttggtcttgac

SEQ ID NO: 396162 - DNA, 25 bp, Mus musculus
ttgttcaccagacagaacttctgtg

SEQ ID NO: 396163 - DNA, 25 bp, Mus musculus
ttgttcaccagacagggcacgttct

SEQ ID NO: 396164 - DNA, 25 bp, Mus musculus
ttgttcactttggaggaatgggagg

SEQ ID NO: 396165 - DNA, 25 bp, Mus musculus
ttgttcagaacgatcatccagcccc

SEQ ID NO: 396166 - DNA, 25 bp, Mus musculus
ttgttcagagattgacggcggggct

SEQ ID NO: 396167 - DNA, 25 bp, Mus musculus
ttgttcagagccaccagtggtaaaa

SEQ ID NO: 396168 - DNA, 25 bp, Mus musculus
ttgttcagatactgaatgaatctga

SEQ ID NO: 396169 - DNA, 25 bp, Mus musculus
ttgttcagtcgggctctaagcaatg

SEQ ID NO: 396170 - DNA, 25 bp, Mus musculus
ttgttcagtcggtttccgtgagagt

SEQ ID NO: 396171 - DNA, 25 bp, Mus musculus
ttgttcataaacttgttcaagccat

SEQ ID NO: 396172 - DNA, 25 bp, Mus musculus
ttgttcatggggcagtaaatggctt

SEQ ID NO: 396173 - DNA, 25 bp, Mus musculus
ttgttccactgtagtcacagtaatg

SEQ ID NO: 396174 - DNA, 25 bp, Mus musculus
ttgttcccaggcaaattccatcaag

SEQ ID NO: 396175 - DNA, 25 bp, Mus musculus
ttgttcccattccttcaaaaagagt

SEQ ID NO: 396176 - DNA, 25 bp, Mus musculus
ttgttccggaggaatttgaagccta

SEQ ID NO: 396177 - DNA, 25 bp, Mus musculus
ttgttccgtgagggaaaagaagacc

SEQ ID NO: 396178 - DNA, 25 bp, Mus musculus
ttgttcctgctgcgctctgtgccaa

SEQ ID NO: 396179 - DNA, 25 bp, Mus musculus
ttgttcgaataaatgctgctcatgg

SEQ ID NO: 396180 - DNA, 25 bp, Mus musculus
ttgttcggatgctgaatccctacac

SEQ ID NO: 396181 - DNA, 25 bp, Mus musculus
ttgttcgtgctgggtgatagcacac

SEQ ID NO: 396182 - DNA, 25 bp, Mus musculus
ttgttcgtggaggtggagcctacta

SEQ ID NO: 396183 - DNA, 25 bp, Mus musculus
ttgttctacaagctgactcatcatg

SEQ ID NO: 396184 - DNA, 25 bp, Mus musculus
ttgttctattaggtcatgacgcatg

SEQ ID NO: 396185 - DNA, 25 bp, Mus musculus
ttgttctccaatgttgtatgtgcta

SEQ ID NO: 396186 - DNA, 25 bp, Mus musculus
ttgttctcgttcaggttagccagta

SEQ ID NO: 396187 - DNA, 25 bp, Mus musculus
ttgttctctaaagggcctggggata

SEQ ID NO: 396188 - DNA, 25 bp, Mus musculus
ttgttctctaaagttacaaattata

SEQ ID NO: 396189 - DNA, 25 bp, Mus musculus
ttgttctcttccatatgaggaaact

SEQ ID NO: 396190 - DNA, 25 bp, Mus musculus
ttgttctgaggtgacgccatctggg

SEQ ID NO: 396191 - DNA, 25 bp, Mus musculus
ttgttctgggggtggtggagttgtt

SEQ ID NO: 396192 - DNA, 25 bp, Mus musculus
ttgttctgtgtggaggtactacaag

SEQ ID NO: 396193 - DNA, 25 bp, Mus musculus
ttgttcttaaggatacagaggaagc

SEQ ID NO: 396194 - DNA, 25 bp, Mus musculus
ttgttcttaagtggccaaatgtaaa

SEQ ID NO: 396195 - DNA, 25 bp, Mus musculus
ttgttctttaagatcgctccagtgg

SEQ ID NO: 396196 - DNA, 25 bp, Mus musculus
ttgttctttaaggatcctatgtagc

SEQ ID NO: 396197 - DNA, 25 bp, Mus musculus
ttgttgaacaacagatgcagcgaag

SEQ ID NO: 396198 - DNA, 25 bp, Mus musculus
ttgttgaattctatgccccttggtg

SEQ ID NO: 396199 - DNA, 25 bp, Mus musculus
ttgttgagtcaaacgagtctcccat

SEQ ID NO: 396200 - DNA, 25 bp, Mus musculus
ttgttgagtcaaacgccacatctac

SEQ ID NO: 396201 - DNA, 25 bp, Mus musculus
ttgttgatgcaaatgtgctagttgg

SEQ ID NO: 396202 - DNA, 25 bp, Mus musculus
ttgttgcaaatgctggaactgcagc

SEQ ID NO: 396203 - DNA, 25 bp, Mus musculus
ttgttgcaaccctggaccctgtcct

SEQ ID NO: 396204 - DNA, 25 bp, Mus musculus
ttgttgcatcaggtactgtaatagg

SEQ ID NO: 396205 - DNA, 25 bp, Mus musculus
ttgttgccagaaagcagcagctggc

SEQ ID NO: 396206 - DNA, 25 bp, Mus musculus
ttgttgccaggtgaacagctgcttt

SEQ ID NO: 396207 - DNA, 25 bp, Mus musculus
ttgttgcccagctggcatttttcag

SEQ ID NO: 396208 - DNA, 25 bp, Mus musculus
ttgttgcctcagatttcttgaccta

SEQ ID NO: 396209 - DNA, 25 bp, Mus musculus
ttgttgctaagacattcgacatgaa

SEQ ID NO: 396210 - DNA, 25 bp, Mus musculus
ttgttgctgctggggtctgcgagct

SEQ ID NO: 396211 - DNA, 25 bp, Mus musculus
ttgttgctggagacaaccggatcca

SEQ ID NO: 396212 - DNA, 25 bp, Mus musculus
ttgttgctgtagaggttgctgcatc

SEQ ID NO: 396213 - DNA, 25 bp, Mus musculus
ttgttgcttagcctcctgtaccctg

SEQ ID NO: 396214 - DNA, 25 bp, Mus musculus
ttgttgcttaggattccctgcacag

SEQ ID NO: 396215 - DNA, 25 bp, Mus musculus
ttgttgctttcccagcactatggtg

SEQ ID NO: 396216 - DNA, 25 bp, Mus musculus
ttgttggacagatgcaccaacaagg

SEQ ID NO: 396217 - DNA, 25 bp, Mus musculus
ttgttggaggagcgaacctagctca

SEQ ID NO: 396218 - DNA, 25 bp, Mus musculus
ttgttggaggagggaacctagctca

SEQ ID NO: 396219 - DNA, 25 bp, Mus musculus
ttgttggagtaatggccttattcag

SEQ ID NO: 396220 - DNA, 25 bp, Mus musculus
ttgttggataaaagcttatacccat

SEQ ID NO: 396221 - DNA, 25 bp, Mus musculus
ttgttggatagtagtgaattgaatc

SEQ ID NO: 396222 - DNA, 25 bp, Mus musculus
ttgttggcaaagctagatctttcag

SEQ ID NO: 396223 - DNA, 25 bp, Mus musculus
ttgttggcaaagctgacaaaccaag

SEQ ID NO: 396224 - DNA, 25 bp, Mus musculus
ttgttggcaaagcttcttcagctga

SEQ ID NO: 396225 - DNA, 25 bp, Mus musculus
ttgttggcaaaggtgactccaatga

SEQ ID NO: 396226 - DNA, 25 bp, Mus musculus
ttgttggcagagaactgatagaagt

SEQ ID NO: 396227 - DNA, 25 bp, Mus musculus
ttgttggcaggtattcaatacacaa

SEQ ID NO: 396228 - DNA, 25 bp, Mus musculus
ttgttggcatcagaccacagcagtt

SEQ ID NO: 396229 - DNA, 25 bp, Mus musculus
ttgttggggcgccagacaggattat

SEQ ID NO: 396230 - DNA, 25 bp, Mus musculus
ttgttggggcgccagggatcaacgt

SEQ ID NO: 396231 - DNA, 25 bp, Mus musculus
ttgttgggtatcagatgttcatcta

SEQ ID NO: 396232 - DNA, 25 bp, Mus musculus
ttgttgggttcagatacaggagcct

SEQ ID NO: 396233 - DNA, 25 bp, Mus musculus
ttgttggtttccagcccgtcctttc

SEQ ID NO: 396234 - DNA, 25 bp, Mus musculus
ttgttgtaccccaggcattgggcat

SEQ ID NO: 396235 - DNA, 25 bp, Mus musculus
ttgttgtcaaggtttgatctcattt

SEQ ID NO: 396236 - DNA, 25 bp, Mus musculus
ttgttgttaaagctcccaagctgtt

SEQ ID NO: 396237 - DNA, 25 bp, Mus musculus
ttgttgttcaagatgaggagactga

SEQ ID NO: 396238 - DNA, 25 bp, Mus musculus
ttgttgttcaagcatttatatctac

SEQ ID NO: 396239 - DNA, 25 bp, Mus musculus
ttgttgttcaagctgcctcaggcga

SEQ ID NO: 396240 - DNA, 25 bp, Mus musculus
ttgttgttcaaggaatatagagctt

SEQ ID NO: 396241 - DNA, 25 bp, Mus musculus
ttgttgttcagagattgacggcggg

SEQ ID NO: 396242 - DNA, 25 bp, Mus musculus
ttgttgttcagagccaccagtggta

SEQ ID NO: 396243 - DNA, 25 bp, Mus musculus
ttgttgttcaggtttatcatggctt

SEQ ID NO: 396244 - DNA, 25 bp, Mus musculus
ttgttgttgagccaccttctcctga

SEQ ID NO: 396245 - DNA, 25 bp, Mus musculus
ttgttgttgaggcagcatattatac

SEQ ID NO: 396246 - DNA, 25 bp, Mus musculus
ttgtttaaactacagaactttgtgg

SEQ ID NO: 396247 - DNA, 25 bp, Mus musculus
ttgtttaaactgcagaggtatacaa

SEQ ID NO: 396248 - DNA, 25 bp, Mus musculus
ttgtttaacggtagcgcctggcatg

SEQ ID NO: 396249 - DNA, 25 bp, Mus musculus
ttgtttacagaaaagggactgattt

SEQ ID NO: 396250 - DNA, 25 bp, Mus musculus
ttgtttacctaggtgcctatgatcg

SEQ ID NO: 396251 - DNA, 25 bp, Mus musculus
ttgtttatagaaatacaatattctc

SEQ ID NO: 396252 - DNA, 25 bp, Mus musculus
ttgtttatagagatttgaagttgga

SEQ ID NO: 396253 - DNA, 25 bp, Mus musculus
ttgtttatcagaagtttccagagtg

SEQ ID NO: 396254 - DNA, 25 bp, Mus musculus
ttgtttatctagactaaaacaaagg

SEQ ID NO: 396255 - DNA, 25 bp, Mus musculus
ttgtttatctaggtgcctatgaccg

SEQ ID NO: 396256 - DNA, 25 bp, Mus musculus
ttgtttcacatttctggaaagcagt

SEQ ID NO: 396257 - DNA, 25 bp, Mus musculus
ttgtttcacatttggtgagtggggc

SEQ ID NO: 396258 - DNA, 25 bp, Mus musculus
ttgtttcacccgcaaatgtcagcaa

SEQ ID NO: 396259 - DNA, 25 bp, Mus musculus
ttgtttcacccgcaattcccactac

SEQ ID NO: 396260 - DNA, 25 bp, Mus musculus
ttgtttccccagatcctgtcttcca

SEQ ID NO: 396261 - DNA, 25 bp, Mus musculus
ttgtttcccccaacttacagactga

SEQ ID NO: 396262 - DNA, 25 bp, Mus musculus
ttgtttcggtgacagggcggctact

SEQ ID NO: 396263 - DNA, 25 bp, Mus musculus
ttgtttctgtccgaggtcgctcatc

SEQ ID NO: 396264 - DNA, 25 bp, Mus musculus
ttgtttgaatggtaaatgatctgaa

SEQ ID NO: 396265 - DNA, 25 bp, Mus musculus
ttgtttgacttaccatgctcgcatt

SEQ ID NO: 396266 - DNA, 25 bp, Mus musculus
ttgtttgccagaatggaggatagga

SEQ ID NO: 396267 - DNA, 25 bp, Mus musculus
ttgtttgctcgctcgggcaaagtct

SEQ ID NO: 396268 - DNA, 25 bp, Mus musculus
ttgtttgctgaagaccaaggactgg

SEQ ID NO: 396269 - DNA, 25 bp, Mus musculus
ttgtttggtgctcctaaaaggagaa

SEQ ID NO: 396270 - DNA, 25 bp, Mus musculus
ttgtttggtgttaggcaggaacagg

SEQ ID NO: 396271 - DNA, 25 bp, Mus musculus
ttgtttggttcttcgggcctgtgtg

SEQ ID NO: 396272 - DNA, 25 bp, Mus musculus
ttgtttgtacaaagggcaatcctgc

SEQ ID NO: 396273 - DNA, 25 bp, Mus musculus
ttgtttgtaccaggcaacttgccac

SEQ ID NO: 396274 - DNA, 25 bp, Mus musculus
ttgtttgtaccaggttcccaagagt

SEQ ID NO: 396275 - DNA, 25 bp, Mus musculus
ttgtttgtgcagggatcgcttacac

SEQ ID NO: 396276 - DNA, 25 bp, Mus musculus
ttgtttgtgcagttgctttattctc

SEQ ID NO: 396277 - DNA, 25 bp, Mus musculus
ttgttttaaaaggtgtccagtgtga

SEQ ID NO: 396278 - DNA, 25 bp, Mus musculus
ttgttttaaatggggctctctaagt

SEQ ID NO: 396279 - DNA, 25 bp, Mus musculus
ttgttttacagatggctcattgcgt

SEQ ID NO: 396280 - DNA, 25 bp, Mus musculus
ttgttttacagcatgtacattgccg

SEQ ID NO: 396281 - DNA, 25 bp, Mus musculus
ttgttttacagcctttcccatggtc

SEQ ID NO: 396282 - DNA, 25 bp, Mus musculus
ttgttttacaggtgtgtgtggtttc

SEQ ID NO: 396283 - DNA, 25 bp, Mus musculus
ttgttttataaacagacatttccac

SEQ ID NO: 396284 - DNA, 25 bp, Mus musculus
ttgttttccagccaaatagaggagc

SEQ ID NO: 396285 - DNA, 25 bp, Mus musculus
ttgttttctgtcaagacaccatgat

SEQ ID NO: 396286 - DNA, 25 bp, Mus musculus
ttgttttggaagaagacgtcaaact

SEQ ID NO: 396287 - DNA, 25 bp, Mus musculus
ttgttttggaagaagtcagttaagg

SEQ ID NO: 396288 - DNA, 25 bp, Mus musculus
ttgttttggttggtatgctgtacat

SEQ ID NO: 396289 - DNA, 25 bp, Mus musculus
ttgtttttcatacagataaaaatta

SEQ ID NO: 396290 - DNA, 25 bp, Mus musculus
ttgtttttcatctagataaaaatta

SEQ ID NO: 396291 - DNA, 25 bp, Mus musculus
ttgtttttcctggtgtgacttatga

SEQ ID NO: 396292 - DNA, 25 bp, Mus musculus
ttgtttttctggatcttgtttcctc

SEQ ID NO: 396293 - DNA, 25 bp, Mus musculus
ttgtttttgctgatgggaacttttg

SEQ ID NO: 396294 - DNA, 25 bp, Mus musculus
ttgtttttgctgatttctaagttat

SEQ ID NO: 396295 - DNA, 25 bp, Mus musculus
tttaaaaaactggtatccagctcat

SEQ ID NO: 396296 - DNA, 25 bp, Mus musculus
tttaaaaaagccgagctggaattcg

SEQ ID NO: 396297 - DNA, 25 bp, Mus musculus
tttaaaaaagtcgagcctgttgacg

SEQ ID NO: 396298 - DNA, 25 bp, Mus musculus
tttaaaaagggagatgagtacgatg

SEQ ID NO: 396299 - DNA, 25 bp, Mus musculus
tttaaaacaggcctcaaggctttga

SEQ ID NO: 396300 - DNA, 25 bp, Mus musculus
tttaaaacggctaggacttctctca

SEQ ID NO: 396301 - DNA, 25 bp, Mus musculus
tttaaaactttgctgcgagacaaaa

SEQ ID NO: 396302 - DNA, 25 bp, Mus musculus
tttaaaactttgtagttggtgatga

SEQ ID NO: 396303 - DNA, 25 bp, Mus musculus
tttaaaagaagatccagtcctgcag

SEQ ID NO: 396304 - DNA, 25 bp, Mus musculus
tttaaaaggaactggtctctcatgg

SEQ ID NO: 396305 - DNA, 25 bp, Mus musculus
tttaaaataatccaaggaagaattc

SEQ ID NO: 396306 - DNA, 25 bp, Mus musculus
tttaaaataatcctgtcaaggtatt

SEQ ID NO: 396307 - DNA, 25 bp, Mus musculus
tttaaaataccagtgtaagcggtaa

SEQ ID NO: 396308 - DNA, 25 bp, Mus musculus
tttaaaatttcttgtgaaaatgaac

SEQ ID NO: 396309 - DNA, 25 bp, Mus musculus
tttaaacaaagatcctgtgtaccgg

SEQ ID NO: 396310 - DNA, 25 bp, Mus musculus
tttaaacaaagatgagtacattgag

SEQ ID NO: 396311 - DNA, 25 bp, Mus musculus
tttaaacaagcgcagatattaaact

SEQ ID NO: 396312 - DNA, 25 bp, Mus musculus
tttaaacaccagggtctcctagccc

SEQ ID NO: 396313 - DNA, 25 bp, Mus musculus
tttaaacctgagcattttaatctga

SEQ ID NO: 396314 - DNA, 25 bp, Mus musculus
tttaaactagcagggggaggagcag

SEQ ID NO: 396315 - DNA, 25 bp, Mus musculus
tttaaactaggtcgatccttcggga

SEQ ID NO: 396316 - DNA, 25 bp, Mus musculus
tttaaactgcagaggtatacaagtc

SEQ ID NO: 396317 - DNA, 25 bp, Mus musculus
tttaaagaacttgtgtagcttgtag

SEQ ID NO: 396318 - DNA, 25 bp, Mus musculus
tttaaagaccagcagtcttgccaga

SEQ ID NO: 396319 - DNA, 25 bp, Mus musculus
tttaaagaccaggagtcttgccaga

SEQ ID NO: 396320 - DNA, 25 bp, Mus musculus
tttaaagagacaggacctgatagat

SEQ ID NO: 396321 - DNA, 25 bp, Mus musculus
tttaaagatgaacatctcagcggtt

SEQ ID NO: 396322 - DNA, 25 bp, Mus musculus
tttaaagcaaggtgaatgtttgaat

SEQ ID NO: 396323 - DNA, 25 bp, Mus musculus
tttaaagcatgcgcagatgacaggg

SEQ ID NO: 396324 - DNA, 25 bp, Mus musculus
tttaaagcatgggcagtagctcgtc

SEQ ID NO: 396325 - DNA, 25 bp, Mus musculus
tttaaagctgccatccatccagaca

SEQ ID NO: 396326 - DNA, 25 bp, Mus musculus
tttaaaggacttaagggaacgaatg

SEQ ID NO: 396327 - DNA, 25 bp, Mus musculus
tttaaaggcacaggaagcggaacag

SEQ ID NO: 396328 - DNA, 25 bp, Mus musculus
tttaaagggcatcagcgagggctgc

SEQ ID NO: 396329 - DNA, 25 bp, Mus musculus
tttaaagggcatcaggaggctgcac

SEQ ID NO: 396330 - DNA, 25 bp, Mus musculus
tttaaagtttgaggtgggatgtgtg

SEQ ID NO: 396331 - DNA, 25 bp, Mus musculus
tttaaataataggtggttagccagc

SEQ ID NO: 396332 - DNA, 25 bp, Mus musculus
tttaaatataaaatggaagctttaa

SEQ ID NO: 396333 - DNA, 25 bp, Mus musculus
tttaaatataaaatgggtcaaatag

SEQ ID NO: 396334 - DNA, 25 bp, Mus musculus
tttaaatatcacgaacacactaaat

SEQ ID NO: 396335 - DNA, 25 bp, Mus musculus
tttaaatattttgaggttccatctg

SEQ ID NO: 396336 - DNA, 25 bp, Mus musculus
tttaaatgaagagatggttacgccc

SEQ ID NO: 396337 - DNA, 25 bp, Mus musculus
tttaaatgaagaggtgtttatggag

SEQ ID NO: 396338 - DNA, 25 bp, Mus musculus
tttaaatgacaacaattgacatata

SEQ ID NO: 396339 - DNA, 25 bp, Mus musculus
tttaaatgcagacttaattcaggta

SEQ ID NO: 396340 - DNA, 25 bp, Mus musculus
tttaaatgcaggtctcagccagtct

SEQ ID NO: 396341 - DNA, 25 bp, Mus musculus
tttaaatgtacagtctaaatccagt

SEQ ID NO: 396342 - DNA, 25 bp, Mus musculus
tttaaattggggtccaagtacagca

SEQ ID NO: 396343 - DNA, 25 bp, Mus musculus
tttaaatttcagattttatcatgtg

SEQ ID NO: 396344 - DNA, 25 bp, Mus musculus
tttaaatttgataatgcaaacccgt

SEQ ID NO: 396345 - DNA, 25 bp, Mus musculus
tttaacaatagacatgaagcgccac

SEQ ID NO: 396346 - DNA, 25 bp, Mus musculus
tttaacacaaaggcaaggcagcaaa

SEQ ID NO: 396347 - DNA, 25 bp, Mus musculus
tttaacacacaagattcttccagat

SEQ ID NO: 396348 - DNA, 25 bp, Mus musculus
tttaacacacaagcctccatgcatt

SEQ ID NO: 396349 - DNA, 25 bp, Mus musculus
tttaacacaggtgtgatcctgctgt

SEQ ID NO: 396350 - DNA, 25 bp, Mus musculus
tttaacagatgacaggtctgaggag

SEQ ID NO: 396351 - DNA, 25 bp, Mus musculus
tttaacattgggcctaacaggccta

SEQ ID NO: 396352 - DNA, 25 bp, Mus musculus
tttaacattggggtggccttgcacg

SEQ ID NO: 396353 - DNA, 25 bp, Mus musculus
tttaaccaacaacctccagagtctt

SEQ ID NO: 396354 - DNA, 25 bp, Mus musculus
tttaaccacagatttattctgtgat

SEQ ID NO: 396355 - DNA, 25 bp, Mus musculus
tttaaccacagatttcacctgggcc

SEQ ID NO: 396356 - DNA, 25 bp, Mus musculus
tttaaccagaaaggtgatctgtaaa

SEQ ID NO: 396357 - DNA, 25 bp, Mus musculus
tttaaccattcaaaatgtaggccgc

SEQ ID NO: 396358 - DNA, 25 bp, Mus musculus
tttaacccaggtgactcatattctc

SEQ ID NO: 396359 - DNA, 25 bp, Mus musculus
tttaacccccctaagggcagcagca

SEQ ID NO: 396360 - DNA, 25 bp, Mus musculus
tttaaccgtgagataccagagagct

SEQ ID NO: 396361 - DNA, 25 bp, Mus musculus
tttaacctgagaaatgccaaccaaa

SEQ ID NO: 396362 - DNA, 25 bp, Mus musculus
tttaacctttggtgctttacatggt

SEQ ID NO: 396363 - DNA, 25 bp, Mus musculus
tttaacgccaaggtaaacgatgatg

SEQ ID NO: 396364 - DNA, 25 bp, Mus musculus
tttaacggagagggcggcgaagagg

SEQ ID NO: 396365 - DNA, 25 bp, Mus musculus
tttaacggagatgagaaggccacta

SEQ ID NO: 396366 - DNA, 25 bp, Mus musculus
tttaactaccaagcatctatatttg

SEQ ID NO: 396367 - DNA, 25 bp, Mus musculus
tttaactgactagatcttgatatgg

SEQ ID NO: 396368 - DNA, 25 bp, Mus musculus
tttaactgcattttaggagtgcatg

SEQ ID NO: 396369 - DNA, 25 bp, Mus musculus
tttaactggaaagaatgtcttgatt

SEQ ID NO: 396370 - DNA, 25 bp, Mus musculus
tttaactggaaaggatataattgac

SEQ ID NO: 396371 - DNA, 25 bp, Mus musculus
tttaacttaatgtttgaaatgccct

SEQ ID NO: 396372 - DNA, 25 bp, Mus musculus
tttaacttagaggaggcacagaccc

SEQ ID NO: 396373 - DNA, 25 bp, Mus musculus
tttaacttcagcaaggaccataatt

SEQ ID NO: 396374 - DNA, 25 bp, Mus musculus
tttaactttgagaagaaccaaagat

SEQ ID NO: 396375 - DNA, 25 bp, Mus musculus
tttaagaaaagcagccactggagag

SEQ ID NO: 396376 - DNA, 25 bp, Mus musculus
tttaagaaacggagccagctgtgga

SEQ ID NO: 396377 - DNA, 25 bp, Mus musculus
tttaagaaagctggacctgggctga

SEQ ID NO: 396378 - DNA, 25 bp, Mus musculus
tttaagaacaaggacaacatccacg

SEQ ID NO: 396379 - DNA, 25 bp, Mus musculus
tttaagaacaagtactgaaagtgct

SEQ ID NO: 396380 - DNA, 25 bp, Mus musculus
tttaagaacagacatcatgatcggg

SEQ ID NO: 396381 - DNA, 25 bp, Mus musculus
tttaagaagatttaccactcggccc

SEQ ID NO: 396382 - DNA, 25 bp, Mus musculus
tttaagaagggctctgctaaggccg

SEQ ID NO: 396383 - DNA, 25 bp, Mus musculus
tttaagagagattcctttctccttg

SEQ ID NO: 396384 - DNA, 25 bp, Mus musculus
tttaagagaggatttaacagtgcgt

SEQ ID NO: 396385 - DNA, 25 bp, Mus musculus
tttaagagaggtggctttgcagctg

SEQ ID NO: 396386 - DNA, 25 bp, Mus musculus
tttaagataggaggctccctgctat

SEQ ID NO: 396387 - DNA, 25 bp, Mus musculus
tttaagcaattgcaggactctgatg

SEQ ID NO: 396388 - DNA, 25 bp, Mus musculus
tttaagcagagatgacgtcagtgac

SEQ ID NO: 396389 - DNA, 25 bp, Mus musculus
tttaagcatttcaagacccactccc

SEQ ID NO: 396390 - DNA, 25 bp, Mus musculus
tttaagcatttcaaggagaaatacc

SEQ ID NO: 396391 - DNA, 25 bp, Mus musculus
tttaagcatttcaagggtctcatat

SEQ ID NO: 396392 - DNA, 25 bp, Mus musculus
tttaagccacgaggaaagcgtcatc

SEQ ID NO: 396393 - DNA, 25 bp, Mus musculus
tttaagccagaacgctttaccgtgt

SEQ ID NO: 396394 - DNA, 25 bp, Mus musculus
tttaagccagagttgtaagcttgat

SEQ ID NO: 396395 - DNA, 25 bp, Mus musculus
tttaagccagggtcagactcagtca

SEQ ID NO: 396396 - DNA, 25 bp, Mus musculus
tttaagccagggtttgcagagcagt

SEQ ID NO: 396397 - DNA, 25 bp, Mus musculus
tttaagctcaggaggcctcctgatg

SEQ ID NO: 396398 - DNA, 25 bp, Mus musculus
tttaaggagagagctttccctcctc

SEQ ID NO: 396399 - DNA, 25 bp, Mus musculus
tttaaggagagaggagcaagtgtcg

SEQ ID NO: 396400 - DNA, 25 bp, Mus musculus
tttaaggatttcctgattccacgag

SEQ ID NO: 396401 - DNA, 25 bp, Mus musculus
tttaaggggagagctcctgctttct

SEQ ID NO: 396402 - DNA, 25 bp, Mus musculus
tttaaggggagaggaagctttgtct

SEQ ID NO: 396403 - DNA, 25 bp, Mus musculus
tttaagttccgatacttcgctggct

SEQ ID NO: 396404 - DNA, 25 bp, Mus musculus
tttaataaaggcctgtgatactcct

SEQ ID NO: 396405 - DNA, 25 bp, Mus musculus
tttaataactggcatcctcgtgtac

SEQ ID NO: 396406 - DNA, 25 bp, Mus musculus
tttaatacagatactgggagtcctt

SEQ ID NO: 396407 - DNA, 25 bp, Mus musculus
tttaatacagatacttgtggcaata

SEQ ID NO: 396408 - DNA, 25 bp, Mus musculus
tttaatagtgaggtagaggaggctt

SEQ ID NO: 396409 - DNA, 25 bp, Mus musculus
tttaatatcagaagtttcagtctgg

SEQ ID NO: 396410 - DNA, 25 bp, Mus musculus
tttaatatttcagcagtgtgataat

SEQ ID NO: 396411 - DNA, 25 bp, Mus musculus
tttaatcaagtacggcgagctcctc

SEQ ID NO: 396412 - DNA, 25 bp, Mus musculus
tttaatcaagtgctaccggactggg

SEQ ID NO: 396413 - DNA, 25 bp, Mus musculus
tttaatcagttcaagtctgttatct

SEQ ID NO: 396414 - DNA, 25 bp, Mus musculus
tttaatctgaaggggagaaaactgg

SEQ ID NO: 396415 - DNA, 25 bp, Mus musculus
tttaatctgagaggccagtcaccac

SEQ ID NO: 396416 - DNA, 25 bp, Mus musculus
tttaatcttcatcaagtcacagtaa

SEQ ID NO: 396417 - DNA, 25 bp, Mus musculus
tttaatgaagactttgtatcatctc

SEQ ID NO: 396418 - DNA, 25 bp, Mus musculus
tttaatgaagtgtcacgagcaagag

SEQ ID NO: 396419 - DNA, 25 bp, Mus musculus
tttaatgacgctgaggttttatata

SEQ ID NO: 396420 - DNA, 25 bp, Mus musculus
tttaatgagcgactggtctgtgagt

SEQ ID NO: 396421 - DNA, 25 bp, Mus musculus
tttaatgagctacccatgacatcag

SEQ ID NO: 396422 - DNA, 25 bp, Mus musculus
tttaatgaggaaagactaatagaca

SEQ ID NO: 396423 - DNA, 25 bp, Mus musculus
tttaatgaggaaggcttgttgtcat

SEQ ID NO: 396424 - DNA, 25 bp, Mus musculus
tttaatgatccagattatatcagaa

SEQ ID NO: 396425 - DNA, 25 bp, Mus musculus
tttaatgatccggaccttcgagaag

SEQ ID NO: 396426 - DNA, 25 bp, Mus musculus
tttaatgatgaagatgcagatagac

SEQ ID NO: 396427 - DNA, 25 bp, Mus musculus
tttaatgatgaggtccttctgtagc

SEQ ID NO: 396428 - DNA, 25 bp, Mus musculus
tttaatgcaagagagatgctgagga

SEQ ID NO: 396429 - DNA, 25 bp, Mus musculus
tttaatgctgaggccgggataactg

SEQ ID NO: 396430 - DNA, 25 bp, Mus musculus
tttaatggaacagatggcagtgaaa

SEQ ID NO: 396431 - DNA, 25 bp, Mus musculus
tttaatggcacaagaacaagtaaga

SEQ ID NO: 396432 - DNA, 25 bp, Mus musculus
tttaatggggcccaaattcattggt

SEQ ID NO: 396433 - DNA, 25 bp, Mus musculus
tttaatggttgctctctgaaaactg

SEQ ID NO: 396434 - DNA, 25 bp, Mus musculus
tttaatgtagaaaagattaatgggg

SEQ ID NO: 396435 - DNA, 25 bp, Mus musculus
tttaatgtagaaagattaatgggga

SEQ ID NO: 396436 - DNA, 25 bp, Mus musculus
tttaatgtagaacagattagtgggt

SEQ ID NO: 396437 - DNA, 25 bp, Mus musculus
tttaatgtatcggaggacaccaaag

SEQ ID NO: 396438 - DNA, 25 bp, Mus musculus
tttaatgttggaggacctggataag

SEQ ID NO: 396439 - DNA, 25 bp, Mus musculus
tttaatgttggaggatttagacaag

SEQ ID NO: 396440 - DNA, 25 bp, Mus musculus
tttaatgttttaagttcctgaatgc

SEQ ID NO: 396441 - DNA, 25 bp, Mus musculus
tttaattatgatggagaagaaacat

SEQ ID NO: 396442 - DNA, 25 bp, Mus musculus
tttaattatggtatgcagccactta

SEQ ID NO: 396443 - DNA, 25 bp, Mus musculus
tttaattcagattccaaggaaatag

SEQ ID NO: 396444 - DNA, 25 bp, Mus musculus
tttaattcagttgaaaagggcaggc

SEQ ID NO: 396445 - DNA, 25 bp, Mus musculus
tttaattccatatttgatggtagag

SEQ ID NO: 396446 - DNA, 25 bp, Mus musculus
tttaattgacagattagctttattt

SEQ ID NO: 396447 - DNA, 25 bp, Mus musculus
tttaattgctacctcaggctctgac

SEQ ID NO: 396448 - DNA, 25 bp, Mus musculus
tttaatttcagcaagaggaatatcc

SEQ ID NO: 396449 - DNA, 25 bp, Mus musculus
tttaatttccgagtggacaagatta

SEQ ID NO: 396450 - DNA, 25 bp, Mus musculus
tttaatttctctttcctctctctgg

SEQ ID NO: 396451 - DNA, 25 bp, Mus musculus
tttaattttagctgaaccaataacg

SEQ ID NO: 396452 - DNA, 25 bp, Mus musculus
tttacaaaaggtcacaaccatgtcg

SEQ ID NO: 396453 - DNA, 25 bp, Mus musculus
tttacaaaatgagacctgggcggcc

SEQ ID NO: 396454 - DNA, 25 bp, Mus musculus
tttacaaatggtattctctgaaaag

SEQ ID NO: 396455 - DNA, 25 bp, Mus musculus
tttacaaatgttatccaagcattag

SEQ ID NO: 396456 - DNA, 25 bp, Mus musculus
tttacaacaaaaggccaactactca

SEQ ID NO: 396457 - DNA, 25 bp, Mus musculus
tttacaagcccttgtcccagcagac

SEQ ID NO: 396458 - DNA, 25 bp, Mus musculus
tttacaaggaagggcaaatgacttg

SEQ ID NO: 396459 - DNA, 25 bp, Mus musculus
tttacaaggacatatggagattacc

SEQ ID NO: 396460 - DNA, 25 bp, Mus musculus
tttacaataaccagtctgtgaacct

SEQ ID NO: 396461 - DNA, 25 bp, Mus musculus
tttacaataagagaccagcaccatg

SEQ ID NO: 396462 - DNA, 25 bp, Mus musculus
tttacaataagattacatctcgctt

SEQ ID NO: 396463 - DNA, 25 bp, Mus musculus
tttacaatgcagagactgatgaagt

SEQ ID NO: 396464 - DNA, 25 bp, Mus musculus
tttacaatgcagagagtgacctcag

SEQ ID NO: 396465 - DNA, 25 bp, Mus musculus
tttacaattcctgtacactcacgcc

SEQ ID NO: 396466 - DNA, 25 bp, Mus musculus
tttacacaaagcagagcaaaaaggg

SEQ ID NO: 396467 - DNA, 25 bp, Mus musculus
tttacacaaagcagggctttgggaa

SEQ ID NO: 396468 - DNA, 25 bp, Mus musculus
tttacacactccctgtcctgttagc

SEQ ID NO: 396469 - DNA, 25 bp, Mus musculus
tttacacactgcagcaatgcacggc

SEQ ID NO: 396470 - DNA, 25 bp, Mus musculus
tttacaccaagcaagaatgtgaaac

SEQ ID NO: 396471 - DNA, 25 bp, Mus musculus
tttacaccaagcaagatcgacatca

SEQ ID NO: 396472 - DNA, 25 bp, Mus musculus
tttacaccatttaagttgctttctg

SEQ ID NO: 396473 - DNA, 25 bp, Mus musculus
tttacacccagcaatcccaggatcc

SEQ ID NO: 396474 - DNA, 25 bp, Mus musculus
tttacacgaccagtgcagcccctgg

SEQ ID NO: 396475 - DNA, 25 bp, Mus musculus
tttacacgacccaaggaggcaagtg

SEQ ID NO: 396476 - DNA, 25 bp, Mus musculus
tttacacgacccaagtggcagcaat

SEQ ID NO: 396477 - DNA, 25 bp, Mus musculus
tttacactcttccagacccatgaaa

SEQ ID NO: 396478 - DNA, 25 bp, Mus musculus
tttacagaaaagggactgatttgct

SEQ ID NO: 396479 - DNA, 25 bp, Mus musculus
tttacagaagataacaaagttgtta

SEQ ID NO: 396480 - DNA, 25 bp, Mus musculus
tttacagaagtgctaggcctggtgg

SEQ ID NO: 396481 - DNA, 25 bp, Mus musculus
tttacagaagtggacaagaagccta

SEQ ID NO: 396482 - DNA, 25 bp, Mus musculus
tttacagaatggggagcgctctctg

SEQ ID NO: 396483 - DNA, 25 bp, Mus musculus
tttacagaatgtctgcggattatat

SEQ ID NO: 396484 - DNA, 25 bp, Mus musculus
tttacagaattgcatactgggaccc

SEQ ID NO: 396485 - DNA, 25 bp, Mus musculus
tttacagaattggagttcatagagg

SEQ ID NO: 396486 - DNA, 25 bp, Mus musculus
tttacagaccagtgtgtgccatccc

SEQ ID NO: 396487 - DNA, 25 bp, Mus musculus
tttacagagaggaccatctgcgacc

SEQ ID NO: 396488 - DNA, 25 bp, Mus musculus
tttacagcaaatgcaacaaatgacg

SEQ ID NO: 396489 - DNA, 25 bp, Mus musculus
tttacagcaagccttttctgattat

SEQ ID NO: 396490 - DNA, 25 bp, Mus musculus
tttacagcaaggtgaataaatctga

SEQ ID NO: 396491 - DNA, 25 bp, Mus musculus
tttacagcagatacagttggtgcct

SEQ ID NO: 396492 - DNA, 25 bp, Mus musculus
tttacagccacagccacaacctgcg

SEQ ID NO: 396493 - DNA, 25 bp, Mus musculus
tttacagccagctggctttttctaa

SEQ ID NO: 396494 - DNA, 25 bp, Mus musculus
tttacagctagttcatcactatttc

SEQ ID NO: 396495 - DNA, 25 bp, Mus musculus
tttacagcttcagaagggtcatgtt

SEQ ID NO: 396496 - DNA, 25 bp, Mus musculus
tttacagcttcagcagctctatgcc

SEQ ID NO: 396497 - DNA, 25 bp, Mus musculus
tttacaggcgagatgatttttgatc

SEQ ID NO: 396498 - DNA, 25 bp, Mus musculus
tttacagggcaagcttgatgcttgc

SEQ ID NO: 396499 - DNA, 25 bp, Mus musculus
tttacagtctattaaaggttgcaca

SEQ ID NO: 396500 - DNA, 25 bp, Mus musculus
tttacagtctgttatcaagaaatcc

SEQ ID NO: 396501 - DNA, 25 bp, Mus musculus
tttacatactcaagctaccactacc

SEQ ID NO: 396502 - DNA, 25 bp, Mus musculus
tttacatatgcagacatcaagccct

SEQ ID NO: 396503 - DNA, 25 bp, Mus musculus
tttacatatgcaggaatctccacac

SEQ ID NO: 396504 - DNA, 25 bp, Mus musculus
tttacatattgcaagacgacaagga

SEQ ID NO: 396505 - DNA, 25 bp, Mus musculus
tttacatcagtggttggagactagg

SEQ ID NO: 396506 - DNA, 25 bp, Mus musculus
tttacatggaaagatcagtactgag

SEQ ID NO: 396507 - DNA, 25 bp, Mus musculus
tttacatggaaagggatcagtaatg

SEQ ID NO: 396508 - DNA, 25 bp, Mus musculus
tttacattacacaagaaaaaagtga

SEQ ID NO: 396509 - DNA, 25 bp, Mus musculus
tttacattccacactcccgtatgaa

SEQ ID NO: 396510 - DNA, 25 bp, Mus musculus
tttacattgcaatggatgagtttca

SEQ ID NO: 396511 - DNA, 25 bp, Mus musculus
tttacattggcatagctccttatta

SEQ ID NO: 396512 - DNA, 25 bp, Mus musculus
tttacatttaagacaaatgaagaga

SEQ ID NO: 396513 - DNA, 25 bp, Mus musculus
tttaccaaggagctggagaaggtgt

SEQ ID NO: 396514 - DNA, 25 bp, Mus musculus
tttaccacgcatgcagctggtccag

SEQ ID NO: 396515 - DNA, 25 bp, Mus musculus
tttaccagcggcactcagtcccaga

SEQ ID NO: 396516 - DNA, 25 bp, Mus musculus
tttaccagggtcggacaaatgacaa

SEQ ID NO: 396517 - DNA, 25 bp, Mus musculus
tttacccaaaggaagcctcaaggca

SEQ ID NO: 396518 - DNA, 25 bp, Mus musculus
tttacccctacaggaaggcccagga

SEQ ID NO: 396519 - DNA, 25 bp, Mus musculus
tttacccgcccccaggccttctggg

SEQ ID NO: 396520 - DNA, 25 bp, Mus musculus
tttaccctcttcggtgtttatggag

SEQ ID NO: 396521 - DNA, 25 bp, Mus musculus
tttaccgagcaggacccttcatgtt

SEQ ID NO: 396522 - DNA, 25 bp, Mus musculus
tttaccgagcaggtcacggaagagt

SEQ ID NO: 396523 - DNA, 25 bp, Mus musculus
tttaccgctcccctgagaacacaag

SEQ ID NO: 396524 - DNA, 25 bp, Mus musculus
tttaccgctcccctggttctggtta

SEQ ID NO: 396525 - DNA, 25 bp, Mus musculus
tttaccggcactgggcactgaaaga

SEQ ID NO: 396526 - DNA, 25 bp, Mus musculus
tttacctacaactgctgcttgtacc

SEQ ID NO: 396527 - DNA, 25 bp, Mus musculus
tttacctaccaggacctgatctctg

SEQ ID NO: 396528 - DNA, 25 bp, Mus musculus
tttacctcaacagagaataggtgag

SEQ ID NO: 396529 - DNA, 25 bp, Mus musculus
tttacctcaacagggattctgaagg

SEQ ID NO: 396530 - DNA, 25 bp, Mus musculus
tttacctcactcacgctgcccaaca

SEQ ID NO: 396531 - DNA, 25 bp, Mus musculus
tttacctcactcaggctgccatcca

SEQ ID NO: 396532 - DNA, 25 bp, Mus musculus
tttacctccgcacatccgtgaagag

SEQ ID NO: 396533 - DNA, 25 bp, Mus musculus
tttacctctgggacaaggacaaaga

SEQ ID NO: 396534 - DNA, 25 bp, Mus musculus
tttacctcttcaggctctgtgttcc

SEQ ID NO: 396535 - DNA, 25 bp, Mus musculus
tttaccttccaggaatcctgctgca

SEQ ID NO: 396536 - DNA, 25 bp, Mus musculus
tttaccttgcaaagaatccaaaacc

SEQ ID NO: 396537 - DNA, 25 bp, Mus musculus
tttaccttgcaaaggagtggccgtc

SEQ ID NO: 396538 - DNA, 25 bp, Mus musculus
tttaccttggtgagaccatagccca

SEQ ID NO: 396539 - DNA, 25 bp, Mus musculus
tttacctttgcagaaagaagaatcc

SEQ ID NO: 396540 - DNA, 25 bp, Mus musculus
tttacgaactcggctaccaagagca

SEQ ID NO: 396541 - DNA, 25 bp, Mus musculus
tttacgacaaatgtgtgccaaagaa

SEQ ID NO: 396542 - DNA, 25 bp, Mus musculus
tttacgagcagagggagccaaattc

SEQ ID NO: 396543 - DNA, 25 bp, Mus musculus
tttacgatatcacaaatgttaactc

SEQ ID NO: 396544 - DNA, 25 bp, Mus musculus
tttacgccccgcaagactttccttt

SEQ ID NO: 396545 - DNA, 25 bp, Mus musculus
tttacgcttcctgaagggatgggct

SEQ ID NO: 396546 - DNA, 25 bp, Mus musculus
tttacggagccagccatgagaagtt

SEQ ID NO: 396547 - DNA, 25 bp, Mus musculus
tttacggagccagttttataggtag

SEQ ID NO: 396548 - DNA, 25 bp, Mus musculus
tttacggatagggagttcttcccca

SEQ ID NO: 396549 - DNA, 25 bp, Mus musculus
tttacgggggaggctgctctgagat

SEQ ID NO: 396550 - DNA, 25 bp, Mus musculus
tttacgtaaagggcctgacaagatc

SEQ ID NO: 396551 - DNA, 25 bp, Mus musculus
tttacgttactggttgcttctataa

SEQ ID NO: 396552 - DNA, 25 bp, Mus musculus
tttactaaagttgttcaaggcctgg

SEQ ID NO: 396553 - DNA, 25 bp, Mus musculus
tttactaagaaagagaccagtgctg

SEQ ID NO: 396554 - DNA, 25 bp, Mus musculus
tttactaatcaggattgtcttgcct

SEQ ID NO: 396555 - DNA, 25 bp, Mus musculus
tttactatagccccagcgggaagaa

SEQ ID NO: 396556 - DNA, 25 bp, Mus musculus
tttactatgctgagcagattaagaa

SEQ ID NO: 396557 - DNA, 25 bp, Mus musculus
tttactatgctgagggccaaggatg

SEQ ID NO: 396558 - DNA, 25 bp, Mus musculus
tttactatttccatgatggccagtg

SEQ ID NO: 396559 - DNA, 25 bp, Mus musculus
tttactcaaacccgcaacttgaatt

SEQ ID NO: 396560 - DNA, 25 bp, Mus musculus
tttactccaagttcggggaatgcag

SEQ ID NO: 396561 - DNA, 25 bp, Mus musculus
tttactccaagttcggtcccctgtg

SEQ ID NO: 396562 - DNA, 25 bp, Mus musculus
tttactccagacaaatcgccatcaa

SEQ ID NO: 396563 - DNA, 25 bp, Mus musculus
tttactccagatggcagactttctg

SEQ ID NO: 396564 - DNA, 25 bp, Mus musculus
tttactccagccctggctgtcctag

SEQ ID NO: 396565 - DNA, 25 bp, Mus musculus
tttactccagccctggctgtcctgg

SEQ ID NO: 396566 - DNA, 25 bp, Mus musculus
tttactccagtgcctatgactcccc

SEQ ID NO: 396567 - DNA, 25 bp, Mus musculus
tttactcccaatatgaagactcttc

SEQ ID NO: 396568 - DNA, 25 bp, Mus musculus
tttactcgccaggcaagcgcttcca

SEQ ID NO: 396569 - DNA, 25 bp, Mus musculus
tttactctcacaatgctctgtcaga

SEQ ID NO: 396570 - DNA, 25 bp, Mus musculus
tttactctcacaatgtgtcctactg

SEQ ID NO: 396571 - DNA, 25 bp, Mus musculus
tttactgaatataagtaccatatta

SEQ ID NO: 396572 - DNA, 25 bp, Mus musculus
tttactgacagcttttgcctaccaa

SEQ ID NO: 396573 - DNA, 25 bp, Mus musculus
tttactgagtcttaagtatgttcaa

SEQ ID NO: 396574 - DNA, 25 bp, Mus musculus
tttactgagtcttatgtatgttcaa

SEQ ID NO: 396575 - DNA, 25 bp, Mus musculus
tttactgatgaattcctggcgcagc

SEQ ID NO: 396576 - DNA, 25 bp, Mus musculus
tttactgatgggcatccaacacctc

SEQ ID NO: 396577 - DNA, 25 bp, Mus musculus
tttactgcagctctgcattgagtgc

SEQ ID NO: 396578 - DNA, 25 bp, Mus musculus
tttactgcaggacattaaggacgcc

SEQ ID NO: 396579 - DNA, 25 bp, Mus musculus
tttactgcaggtaccgaatgtctac

SEQ ID NO: 396580 - DNA, 25 bp, Mus musculus
tttactgccatgacattctacggag

SEQ ID NO: 396581 - DNA, 25 bp, Mus musculus
tttactgccatgactttctacggag

SEQ ID NO: 396582 - DNA, 25 bp, Mus musculus
tttactgcccagacaagtgctgttg

SEQ ID NO: 396583 - DNA, 25 bp, Mus musculus
tttactgcccagaccgtgccagtgc

SEQ ID NO: 396584 - DNA, 25 bp, Mus musculus
tttactgcccttggctctggtcagg

SEQ ID NO: 396585 - DNA, 25 bp, Mus musculus
tttactgctgctgaaagaaattagc

SEQ ID NO: 396586 - DNA, 25 bp, Mus musculus
tttactgctgctgaatttgaagtcc

SEQ ID NO: 396587 - DNA, 25 bp, Mus musculus
tttactggctgtctgaccaagtaac

SEQ ID NO: 396588 - DNA, 25 bp, Mus musculus
tttactggctgtctggtttaacttg

SEQ ID NO: 396589 - DNA, 25 bp, Mus musculus
tttactgtcaagcagatgagacaag

SEQ ID NO: 396590 - DNA, 25 bp, Mus musculus
tttactgtgaacagtatgtctggat

SEQ ID NO: 396591 - DNA, 25 bp, Mus musculus
tttactgtggaagtgtggattcttt

SEQ ID NO: 396592 - DNA, 25 bp, Mus musculus
tttactgtggaagtgtggcttcttc

SEQ ID NO: 396593 - DNA, 25 bp, Mus musculus
tttactgtggttcctgatatgctct

SEQ ID NO: 396594 - DNA, 25 bp, Mus musculus
tttactgttaacaggacattcgaca

SEQ ID NO: 396595 - DNA, 25 bp, Mus musculus
tttacttaaatcgggagagtgtgct

SEQ ID NO: 396596 - DNA, 25 bp, Mus musculus
tttacttatccctgtcctctacagc

SEQ ID NO: 396597 - DNA, 25 bp, Mus musculus
tttacttcgcacaggtgcaggtgtc

SEQ ID NO: 396598 - DNA, 25 bp, Mus musculus
tttactttacaagattaatgccgct

SEQ ID NO: 396599 - DNA, 25 bp, Mus musculus
tttactttacaagccccaagcattc

SEQ ID NO: 396600 - DNA, 25 bp, Mus musculus
tttactttacaagcttcaacaaatc

SEQ ID NO: 396601 - DNA, 25 bp, Mus musculus
tttactttacagtctattaaaggtt

SEQ ID NO: 396602 - DNA, 25 bp, Mus musculus
tttactttacagtctgttatcaaga

SEQ ID NO: 396603 - DNA, 25 bp, Mus musculus
tttactttcaacatcaaagtggcta

SEQ ID NO: 396604 - DNA, 25 bp, Mus musculus
tttactttgagaatctcctgtccaa

SEQ ID NO: 396605 - DNA, 25 bp, Mus musculus
tttactttgggtcactgcccagccc

SEQ ID NO: 396606 - DNA, 25 bp, Mus musculus
tttacttttggtatatcatgtataa

SEQ ID NO: 396607 - DNA, 25 bp, Mus musculus
tttagaaagaagcatgtctgctgtg

SEQ ID NO: 396608 - DNA, 25 bp, Mus musculus
tttagaaccagaagagccaccaacc

SEQ ID NO: 396609 - DNA, 25 bp, Mus musculus
tttagaaccagaagatgccatctca

SEQ ID NO: 396610 - DNA, 25 bp, Mus musculus
tttagaaccagaaggagcaccgtac

SEQ ID NO: 396611 - DNA, 25 bp, Mus musculus
tttagaaccccggtggcgacagaca

SEQ ID NO: 396612 - DNA, 25 bp, Mus musculus
tttagaactaagaaataaagatttt

SEQ ID NO: 396613 - DNA, 25 bp, Mus musculus
tttagaactaagtagcaacccagct

SEQ ID NO: 396614 - DNA, 25 bp, Mus musculus
tttagaagaagtgctctggatgttc

SEQ ID NO: 396615 - DNA, 25 bp, Mus musculus
tttagaagataggttaagagcagga

SEQ ID NO: 396616 - DNA, 25 bp, Mus musculus
tttagaagatcttttacaggatggt

SEQ ID NO: 396617 - DNA, 25 bp, Mus musculus
tttagaagatgatggtgaggatgac

SEQ ID NO: 396618 - DNA, 25 bp, Mus musculus
tttagaagcatggtcttagaaatga

SEQ ID NO: 396619 - DNA, 25 bp, Mus musculus
tttagacatagtagcaacccagctc

SEQ ID NO: 396620 - DNA, 25 bp, Mus musculus
tttagacccccgagaaaccagctct

SEQ ID NO: 396621 - DNA, 25 bp, Mus musculus
tttagaccctgcacggctgtggact

SEQ ID NO: 396622 - DNA, 25 bp, Mus musculus
tttagactacatgtccttctgcgcg

SEQ ID NO: 396623 - DNA, 25 bp, Mus musculus
tttagagatccctctgagaccacct

SEQ ID NO: 396624 - DNA, 25 bp, Mus musculus
tttagagatgaggctggaggggtag

SEQ ID NO: 396625 - DNA, 25 bp, Mus musculus
tttagagatggtgaagaatttaaga

SEQ ID NO: 396626 - DNA, 25 bp, Mus musculus
tttagagcaggtttaaacgcatctc

SEQ ID NO: 396627 - DNA, 25 bp, Mus musculus
tttagagccaggttcaatatacaaa

SEQ ID NO: 396628 - DNA, 25 bp, Mus musculus
tttagagcctatcgatctgactgta

SEQ ID NO: 396629 - DNA, 25 bp, Mus musculus
tttagagcctatggatctgactgta

SEQ ID NO: 396630 - DNA, 25 bp, Mus musculus
tttagagcctgctggcaatcatctg

SEQ ID NO: 396631 - DNA, 25 bp, Mus musculus
tttagagttttggtcccagcaacag

SEQ ID NO: 396632 - DNA, 25 bp, Mus musculus
tttagataagagttgtagtgcaagt

SEQ ID NO: 396633 - DNA, 25 bp, Mus musculus
tttagataagtatgaattacttcta

SEQ ID NO: 396634 - DNA, 25 bp, Mus musculus
tttagataatccacttaaacattta

SEQ ID NO: 396635 - DNA, 25 bp, Mus musculus
tttagatatgcttggcctgtggaga

SEQ ID NO: 396636 - DNA, 25 bp, Mus musculus
tttagatcagctgaagcttgctttt

SEQ ID NO: 396637 - DNA, 25 bp, Mus musculus
tttagatccaaaacacacagtgtat

SEQ ID NO: 396638 - DNA, 25 bp, Mus musculus
tttagatctcacgagacatatctga

SEQ ID NO: 396639 - DNA, 25 bp, Mus musculus
tttagatctcacgagggagaaactg

SEQ ID NO: 396640 - DNA, 25 bp, Mus musculus
tttagatctgaacaatgcccagcgc

SEQ ID NO: 396641 - DNA, 25 bp, Mus musculus
tttagatctgcctcactagtagcca

SEQ ID NO: 396642 - DNA, 25 bp, Mus musculus
tttagatcttgggaacctggtggcc

SEQ ID NO: 396643 - DNA, 25 bp, Mus musculus
tttagatgatcagagtggtaagaaa

SEQ ID NO: 396644 - DNA, 25 bp, Mus musculus
tttagattattagatatgctctcca

SEQ ID NO: 396645 - DNA, 25 bp, Mus musculus
tttagcaaaggtgtggtggcttaag

SEQ ID NO: 396646 - DNA, 25 bp, Mus musculus
tttagcaactccagctatcacccag

SEQ ID NO: 396647 - DNA, 25 bp, Mus musculus
tttagcaactggagcactaaagcga

SEQ ID NO: 396648 - DNA, 25 bp, Mus musculus
tttagcaagcagtccatctcagtcc

SEQ ID NO: 396649 - DNA, 25 bp, Mus musculus
tttagcaccagttcctctttccaca

SEQ ID NO: 396650 - DNA, 25 bp, Mus musculus
tttagcattaaggaatcttgggaag

SEQ ID NO: 396651 - DNA, 25 bp, Mus musculus
tttagccaccaggacacagaatgtt

SEQ ID NO: 396652 - DNA, 25 bp, Mus musculus
tttagcccagatagtcgccacatcc

SEQ ID NO: 396653 - DNA, 25 bp, Mus musculus
tttagcccagcaaggaacaccagtg

SEQ ID NO: 396654 - DNA, 25 bp, Mus musculus
tttagccccagtggatctaaaggaa

SEQ ID NO: 396655 - DNA, 25 bp, Mus musculus
tttagcccgaggggaccctgttgac

SEQ ID NO: 396656 - DNA, 25 bp, Mus musculus
tttagctacaggaagcagtttgagc

SEQ ID NO: 396657 - DNA, 25 bp, Mus musculus
tttagctacaggagcatctggaccc

SEQ ID NO: 396658 - DNA, 25 bp, Mus musculus
tttagctaccaagaccgagatgccg

SEQ ID NO: 396659 - DNA, 25 bp, Mus musculus
tttaggaaaacaataaatgcacctg

SEQ ID NO: 396660 - DNA, 25 bp, Mus musculus
tttaggaaaacagtccttcacgtct

SEQ ID NO: 396661 - DNA, 25 bp, Mus musculus
tttaggaatcagtggcaacagtacc

SEQ ID NO: 396662 - DNA, 25 bp, Mus musculus
tttaggacaggaggggaagaaaatg

SEQ ID NO: 396663 - DNA, 25 bp, Mus musculus
tttaggactcagctccatgtctatc

SEQ ID NO: 396664 - DNA, 25 bp, Mus musculus
tttaggactcaggtctggctgtgca

SEQ ID NO: 396665 - DNA, 25 bp, Mus musculus
tttaggagaagacataatgtcaagt

SEQ ID NO: 396666 - DNA, 25 bp, Mus musculus
tttaggagaaggttgtggagttctt

SEQ ID NO: 396667 - DNA, 25 bp, Mus musculus
tttaggaggtatcttgatgtggtta

SEQ ID NO: 396668 - DNA, 25 bp, Mus musculus
tttaggagtccggtgagttggagtg

SEQ ID NO: 396669 - DNA, 25 bp, Mus musculus
tttaggattatagatcctggcagcc

SEQ ID NO: 396670 - DNA, 25 bp, Mus musculus
tttaggcaagggaaggacatttgga

SEQ ID NO: 396671 - DNA, 25 bp, Mus musculus
tttaggcacaaggatactgagaact

SEQ ID NO: 396672 - DNA, 25 bp, Mus musculus
tttagggaagaaagtgtctggactc

SEQ ID NO: 396673 - DNA, 25 bp, Mus musculus
tttagggtccacatggtgatatcat

SEQ ID NO: 396674 - DNA, 25 bp, Mus musculus
tttagggtgtcttctaatgttctga

SEQ ID NO: 396675 - DNA, 25 bp, Mus musculus
tttaggtaaatgagatcatgattct

SEQ ID NO: 396676 - DNA, 25 bp, Mus musculus
tttaggtcgctgatctgccaggatc

SEQ ID NO: 396677 - DNA, 25 bp, Mus musculus
tttaggtcgctgcacacagggccag

SEQ ID NO: 396678 - DNA, 25 bp, Mus musculus
tttaggtctggatcccacgcaatga

SEQ ID NO: 396679 - DNA, 25 bp, Mus musculus
tttaggtgtaagcccatctgctggc

SEQ ID NO: 396680 - DNA, 25 bp, Mus musculus
tttagtaagagtttgatacgaacag

SEQ ID NO: 396681 - DNA, 25 bp, Mus musculus
tttagtagcagaggtaactcagcaa

SEQ ID NO: 396682 - DNA, 25 bp, Mus musculus
tttagtaggaagggcatttgtgtac

SEQ ID NO: 396683 - DNA, 25 bp, Mus musculus
tttagtatcaaaacttctctattct

SEQ ID NO: 396684 - DNA, 25 bp, Mus musculus
tttagtcccgatcatccaggtttga

SEQ ID NO: 396685 - DNA, 25 bp, Mus musculus
tttagtcctcagaggccagttgttg

SEQ ID NO: 396686 - DNA, 25 bp, Mus musculus
tttagtccttgccctgccgaagatt

SEQ ID NO: 396687 - DNA, 25 bp, Mus musculus
tttagtgataggctctctcctaaac

SEQ ID NO: 396688 - DNA, 25 bp, Mus musculus
tttagtgatagggttcactgtggga

SEQ ID NO: 396689 - DNA, 25 bp, Mus musculus
tttagtgtagcacttactagtggcc

SEQ ID NO: 396690 - DNA, 25 bp, Mus musculus
tttagtgtagcttgaactttccacc

SEQ ID NO: 396691 - DNA, 25 bp, Mus musculus
tttagtgtagttccctcctttagca

SEQ ID NO: 396692 - DNA, 25 bp, Mus musculus
tttagttaaaagctgtatcgacatg

SEQ ID NO: 396693 - DNA, 25 bp, Mus musculus
tttagttaaaggtctctgtgttggt

SEQ ID NO: 396694 - DNA, 25 bp, Mus musculus
tttataaaaatctgctgtatcttgg

SEQ ID NO: 396695 - DNA, 25 bp, Mus musculus
tttataaaaatggtgtccttggact

SEQ ID NO: 396696 - DNA, 25 bp, Mus musculus
tttataaaaatggtgtcctttggcc

SEQ ID NO: 396697 - DNA, 25 bp, Mus musculus
tttataaaagatctgcagtgggtcc

SEQ ID NO: 396698 - DNA, 25 bp, Mus musculus
tttataaacagacatttccactggg

SEQ ID NO: 396699 - DNA, 25 bp, Mus musculus
tttataacaaactggatgcagagaa

SEQ ID NO: 396700 - DNA, 25 bp, Mus musculus
tttataactaccagatgccaccgca

SEQ ID NO: 396701 - DNA, 25 bp, Mus musculus
tttataactaccaggcttatacaac

SEQ ID NO: 396702 - DNA, 25 bp, Mus musculus
tttataagaacgagctgcaccgcca

SEQ ID NO: 396703 - DNA, 25 bp, Mus musculus
tttataagacaaaaaagaagaggag

SEQ ID NO: 396704 - DNA, 25 bp, Mus musculus
tttataagcaaatgggggaagccct

SEQ ID NO: 396705 - DNA, 25 bp, Mus musculus
tttataatatgaatgtctcaggtga

SEQ ID NO: 396706 - DNA, 25 bp, Mus musculus
tttataatgattccgatggagggac

SEQ ID NO: 396707 - DNA, 25 bp, Mus musculus
tttataatgtgtctgacttcttccg

SEQ ID NO: 396708 - DNA, 25 bp, Mus musculus
tttataatttataagagagatggtt

SEQ ID NO: 396709 - DNA, 25 bp, Mus musculus
tttatacacaatgagactcaccata

SEQ ID NO: 396710 - DNA, 25 bp, Mus musculus
tttatacagcagcagggcacgtcag

SEQ ID NO: 396711 - DNA, 25 bp, Mus musculus
tttatacctggggttttgtatgaac

SEQ ID NO: 396712 - DNA, 25 bp, Mus musculus
tttatactgtgacaggagggctggc

SEQ ID NO: 396713 - DNA, 25 bp, Mus musculus
tttatagattctgattcttcgtggt

SEQ ID NO: 396714 - DNA, 25 bp, Mus musculus
tttatagattctttcttgaacactt

SEQ ID NO: 396715 - DNA, 25 bp, Mus musculus
tttatatatgaggtaccagctctac

SEQ ID NO: 396716 - DNA, 25 bp, Mus musculus
tttatatccacgataattttattcc

SEQ ID NO: 396717 - DNA, 25 bp, Mus musculus
tttatatccttctagtgttgggcaa

SEQ ID NO: 396718 - DNA, 25 bp, Mus musculus
tttatatccttttagtgttgggcaa

SEQ ID NO: 396719 - DNA, 25 bp, Mus musculus
tttatatgacagagtccgctcctgc

SEQ ID NO: 396720 - DNA, 25 bp, Mus musculus
tttatatgacaggtcatggagggaa

SEQ ID NO: 396721 - DNA, 25 bp, Mus musculus
tttatatgagtccaccaatggctca

SEQ ID NO: 396722 - DNA, 25 bp, Mus musculus
tttatattcaaccagctgtgaccat

SEQ ID NO: 396723 - DNA, 25 bp, Mus musculus
tttatcaaaagacttccaactgaat

SEQ ID NO: 396724 - DNA, 25 bp, Mus musculus
tttatcaaagtgatctcagcgccct

SEQ ID NO: 396725 - DNA, 25 bp, Mus musculus
tttatcaatgacaacttcatcgact

SEQ ID NO: 396726 - DNA, 25 bp, Mus musculus
tttatcaccaccacataagattgtc

SEQ ID NO: 396727 - DNA, 25 bp, Mus musculus
tttatcacccaaggttcagacaatg

SEQ ID NO: 396728 - DNA, 25 bp, Mus musculus
tttatcaccttccagaactctgcag

SEQ ID NO: 396729 - DNA, 25 bp, Mus musculus
tttatcaccttccagactcagaact

SEQ ID NO: 396730 - DNA, 25 bp, Mus musculus
tttatcaccttccaggctcaaacta

SEQ ID NO: 396731 - DNA, 25 bp, Mus musculus
tttatcacggtacccttatttgacc

SEQ ID NO: 396732 - DNA, 25 bp, Mus musculus
tttatcactagaggtcgatcgcgat

SEQ ID NO: 396733 - DNA, 25 bp, Mus musculus
tttatcagaaagctgtcggtgaccc

SEQ ID NO: 396734 - DNA, 25 bp, Mus musculus
tttatcagaagtttccagagtgtgg

SEQ ID NO: 396735 - DNA, 25 bp, Mus musculus
tttatcattttttcgtcacagatca

SEQ ID NO: 396736 - DNA, 25 bp, Mus musculus
tttatccaaaggtgttttacatgag

SEQ ID NO: 396737 - DNA, 25 bp, Mus musculus
tttatccaagtaatgagaggaagac

SEQ ID NO: 396738 - DNA, 25 bp, Mus musculus
tttatccagtcgcccctcccagaga

SEQ ID NO: 396739 - DNA, 25 bp, Mus musculus
tttatccagtcgccttctccttgca

SEQ ID NO: 396740 - DNA, 25 bp, Mus musculus
tttatcccagaaatgtgaatcctca

SEQ ID NO: 396741 - DNA, 25 bp, Mus musculus
tttatcccaggtgtgccattttgaa

SEQ ID NO: 396742 - DNA, 25 bp, Mus musculus
tttatccccatggaaagggctgtga

SEQ ID NO: 396743 - DNA, 25 bp, Mus musculus
tttatcctctctggcctctctcttg

SEQ ID NO: 396744 - DNA, 25 bp, Mus musculus
tttatcctgtggtgtgagtgttgag

SEQ ID NO: 396745 - DNA, 25 bp, Mus musculus
tttatcgaggaggcagcgggccgtg

SEQ ID NO: 396746 - DNA, 25 bp, Mus musculus
tttatcggaactgagccatctcttg

SEQ ID NO: 396747 - DNA, 25 bp, Mus musculus
tttatcgttatgttgattcacaatg

SEQ ID NO: 396748 - DNA, 25 bp, Mus musculus
tttatctataccagataaaaactac

SEQ ID NO: 396749 - DNA, 25 bp, Mus musculus
tttatctatgatgaagctgctctta

SEQ ID NO: 396750 - DNA, 25 bp, Mus musculus
tttatctatggtcgaatatttccct

SEQ ID NO: 396751 - DNA, 25 bp, Mus musculus
tttatctcaggcttcctgctttttc

SEQ ID NO: 396752 - DNA, 25 bp, Mus musculus
tttatctcaggtgacataaatctta

SEQ ID NO: 396753 - DNA, 25 bp, Mus musculus
tttatctccacaaaggtgtattccc

SEQ ID NO: 396754 - DNA, 25 bp, Mus musculus
tttatctcctctcctgaaaatgact

SEQ ID NO: 396755 - DNA, 25 bp, Mus musculus
tttatctctgttggggcttcacacc

SEQ ID NO: 396756 - DNA, 25 bp, Mus musculus
tttatctgaaaggcttacctctaaa

SEQ ID NO: 396757 - DNA, 25 bp, Mus musculus
tttatctgaaagtggtcccaaacca

SEQ ID NO: 396758 - DNA, 25 bp, Mus musculus
tttatctgaaggatcctacccagag

SEQ ID NO: 396759 - DNA, 25 bp, Mus musculus
tttatctgaggtgagaagtctggga

SEQ ID NO: 396760 - DNA, 25 bp, Mus musculus
tttatctgtaacagcgtggaagatg

SEQ ID NO: 396761 - DNA, 25 bp, Mus musculus
tttatctgtagtgcaaagtactaca

SEQ ID NO: 396762 - DNA, 25 bp, Mus musculus
tttatcttcaagcagagaaagaacg

SEQ ID NO: 396763 - DNA, 25 bp, Mus musculus
tttatcttcaagcagcctgaaaggc

SEQ ID NO: 396764 - DNA, 25 bp, Mus musculus
tttatgaaaaataagattggccagg

SEQ ID NO: 396765 - DNA, 25 bp, Mus musculus
tttatgaaaaataaggtagagcaac

SEQ ID NO: 396766 - DNA, 25 bp, Mus musculus
tttatgaaagcagggcttacatacc

SEQ ID NO: 396767 - DNA, 25 bp, Mus musculus
tttatgaaccggcagtttcgaaact

SEQ ID NO: 396768 - DNA, 25 bp, Mus musculus
tttatgacaaagatcagttcatgtg

SEQ ID NO: 396769 - DNA, 25 bp, Mus musculus
tttatgactaacagggagtacacct

SEQ ID NO: 396770 - DNA, 25 bp, Mus musculus
tttatgagcagggcgatgaagaagc

SEQ ID NO: 396771 - DNA, 25 bp, Mus musculus
tttatgagtatgcaggtcctgatga

SEQ ID NO: 396772 - DNA, 25 bp, Mus musculus
tttatgatatcacaaatgttaactc

SEQ ID NO: 396773 - DNA, 25 bp, Mus musculus
tttatgatgagtgtaaaagaagata

SEQ ID NO: 396774 - DNA, 25 bp, Mus musculus
tttatgatgagtgtttatcaccaga

SEQ ID NO: 396775 - DNA, 25 bp, Mus musculus
tttatgatgagtttgtgacttaagc

SEQ ID NO: 396776 - DNA, 25 bp, Mus musculus
tttatgcacctacggcccagaccac

SEQ ID NO: 396777 - DNA, 25 bp, Mus musculus
tttatgcatcaacgctgtaagatga

SEQ ID NO: 396778 - DNA, 25 bp, Mus musculus
tttatgccaaaggctttaacagaaa

SEQ ID NO: 396779 - DNA, 25 bp, Mus musculus
tttatgcctgagcgcttcttagatc

SEQ ID NO: 396780 - DNA, 25 bp, Mus musculus
tttatgcctgatccaacaggaagcc

SEQ ID NO: 396781 - DNA, 25 bp, Mus musculus
tttatgcgaaattcaacatggccaa

SEQ ID NO: 396782 - DNA, 25 bp, Mus musculus
tttatgctgactgacccttcctacc

SEQ ID NO: 396783 - DNA, 25 bp, Mus musculus
tttatgctgactggtgtcgtttcag

SEQ ID NO: 396784 - DNA, 25 bp, Mus musculus
tttatgctgcgtccctgacccttgg

SEQ ID NO: 396785 - DNA, 25 bp, Mus musculus
tttatgctttaggtgaaggcgataa

SEQ ID NO: 396786 - DNA, 25 bp, Mus musculus
tttatggacgaagaggatcttagtg

SEQ ID NO: 396787 - DNA, 25 bp, Mus musculus
tttatggacgaagagtgaattcggg

SEQ ID NO: 396788 - DNA, 25 bp, Mus musculus
tttatggagggttcctggtacaggt

SEQ ID NO: 396789 - DNA, 25 bp, Mus musculus
tttatggattcccaggtgaggacac

SEQ ID NO: 396790 - DNA, 25 bp, Mus musculus
tttatgggaagaattgcggcgagca

SEQ ID NO: 396791 - DNA, 25 bp, Mus musculus
tttatgggtacaggacatacaggaa

SEQ ID NO: 396792 - DNA, 25 bp, Mus musculus
tttatggtccaacgacctgagccca

SEQ ID NO: 396793 - DNA, 25 bp, Mus musculus
tttatgtcagtcagccccagcaagg

SEQ ID NO: 396794 - DNA, 25 bp, Mus musculus
tttatgtctgagggtttggaaatag

SEQ ID NO: 396795 - DNA, 25 bp, Mus musculus
tttatgtctgaggtatctcatttaa

SEQ ID NO: 396796 - DNA, 25 bp, Mus musculus
tttattacaaggaatcgcctgctta

SEQ ID NO: 396797 - DNA, 25 bp, Mus musculus
tttattaccaagatgaacccccaaa

SEQ ID NO: 396798 - DNA, 25 bp, Mus musculus
tttattaccaagcataccacaaaaa

SEQ ID NO: 396799 - DNA, 25 bp, Mus musculus
tttattaccaaggtgctatatctga

SEQ ID NO: 396800 - DNA, 25 bp, Mus musculus
tttattatggtagcaagatctaaag

SEQ ID NO: 396801 - DNA, 25 bp, Mus musculus
tttattattcggcatacccatgtac

SEQ ID NO: 396802 - DNA, 25 bp, Mus musculus
tttattatttaggcttggctggtgt

SEQ ID NO: 396803 - DNA, 25 bp, Mus musculus
tttattatttaggtcattttgagtg

SEQ ID NO: 396804 - DNA, 25 bp, Mus musculus
tttattcagaagtaccgggctttca

SEQ ID NO: 396805 - DNA, 25 bp, Mus musculus
tttattcaggccacgcaacgggaag

SEQ ID NO: 396806 - DNA, 25 bp, Mus musculus
tttattcagggatgtgaaatgatct

SEQ ID NO: 396807 - DNA, 25 bp, Mus musculus
tttattcatcccagaaggaagaatt

SEQ ID NO: 396808 - DNA, 25 bp, Mus musculus
tttattccagctacctggagaactc

SEQ ID NO: 396809 - DNA, 25 bp, Mus musculus
tttattccctttaaggcatcaatac

SEQ ID NO: 396810 - DNA, 25 bp, Mus musculus
tttattcctacgccagagatgcgat

SEQ ID NO: 396811 - DNA, 25 bp, Mus musculus
tttattcctacggatctcatagaaa

SEQ ID NO: 396812 - DNA, 25 bp, Mus musculus
tttattctgagcggtatcaagttat

SEQ ID NO: 396813 - DNA, 25 bp, Mus musculus
tttattgacagtaagggtgatgccc

SEQ ID NO: 396814 - DNA, 25 bp, Mus musculus
tttattgatgaaaagatttatttat

SEQ ID NO: 396815 - DNA, 25 bp, Mus musculus
tttattgggacagacacaggaattg

SEQ ID NO: 396816 - DNA, 25 bp, Mus musculus
tttattgttgattcttccaagaagg

SEQ ID NO: 396817 - DNA, 25 bp, Mus musculus
tttatttcaagtgtcaccagactgt

SEQ ID NO: 396818 - DNA, 25 bp, Mus musculus
tttatttcagggaaaacaggcagca

SEQ ID NO: 396819 - DNA, 25 bp, Mus musculus
tttatttccacgatggggtccgagt

SEQ ID NO: 396820 - DNA, 25 bp, Mus musculus
tttatttctggaagctttgcaaaaa

SEQ ID NO: 396821 - DNA, 25 bp, Mus musculus
tttatttggagaagaccaacctggt

SEQ ID NO: 396822 - DNA, 25 bp, Mus musculus
tttatttggagaaggatcttcaagc

SEQ ID NO: 396823 - DNA, 25 bp, Mus musculus
tttatttgtctgtctcttctcacag

SEQ ID NO: 396824 - DNA, 25 bp, Mus musculus
tttcaaaaaagaatatgatgctgtg

SEQ ID NO: 396825 - DNA, 25 bp, Mus musculus
tttcaaaaaatcagggcttgcggct

SEQ ID NO: 396826 - DNA, 25 bp, Mus musculus
tttcaaaaacaggatctgagtcttc

SEQ ID NO: 396827 - DNA, 25 bp, Mus musculus
tttcaaaaacaggtcagcccttctt

SEQ ID NO: 396828 - DNA, 25 bp, Mus musculus
tttcaaaaaccaagaatggattgtc

SEQ ID NO: 396829 - DNA, 25 bp, Mus musculus
tttcaaaaactggagacctcaggaa

SEQ ID NO: 396830 - DNA, 25 bp, Mus musculus
tttcaaaaataattggtttggattc

SEQ ID NO: 396831 - DNA, 25 bp, Mus musculus
tttcaaaaatgggaacttgacgaga

SEQ ID NO: 396832 - DNA, 25 bp, Mus musculus
tttcaaaaatgggatagatgtgcat

SEQ ID NO: 396833 - DNA, 25 bp, Mus musculus
tttcaaaatggagctgaagttcctc

SEQ ID NO: 396834 - DNA, 25 bp, Mus musculus
tttcaaactggaggagttcaggagg

SEQ ID NO: 396835 - DNA, 25 bp, Mus musculus
tttcaaagattcaaggaagcctggg

SEQ ID NO: 396836 - DNA, 25 bp, Mus musculus
tttcaaagcagttgaaaactgaacc

SEQ ID NO: 396837 - DNA, 25 bp, Mus musculus
tttcaaaggaagaagatgtagaatg

SEQ ID NO: 396838 - DNA, 25 bp, Mus musculus
tttcaaaggaagaagttacagattc

SEQ ID NO: 396839 - DNA, 25 bp, Mus musculus
tttcaaaggagcggatttccatttc

SEQ ID NO: 396840 - DNA, 25 bp, Mus musculus
tttcaaagtgaaacctccacatgga

SEQ ID NO: 396841 - DNA, 25 bp, Mus musculus
tttcaaataagaatgaagagcatgg

SEQ ID NO: 396842 - DNA, 25 bp, Mus musculus
tttcaacaaacgaactccaatgtgg

SEQ ID NO: 396843 - DNA, 25 bp, Mus musculus
tttcaacaacaggcatgttacatgg

SEQ ID NO: 396844 - DNA, 25 bp, Mus musculus
tttcaacagacaggtggaggaagag

SEQ ID NO: 396845 - DNA, 25 bp, Mus musculus
tttcaacagctgaggaaggtgtctt

SEQ ID NO: 396846 - DNA, 25 bp, Mus musculus
tttcaaccccgggaggaagctatgc

SEQ ID NO: 396847 - DNA, 25 bp, Mus musculus
tttcaaccctcaggaatccaaacgc

SEQ ID NO: 396848 - DNA, 25 bp, Mus musculus
tttcaacgattgtactgcatctacg

SEQ ID NO: 396849 - DNA, 25 bp, Mus musculus
tttcaacttcagagctgtgcctgag

SEQ ID NO: 396850 - DNA, 25 bp, Mus musculus
tttcaacttcaggagcctttggaga

SEQ ID NO: 396851 - DNA, 25 bp, Mus musculus
tttcaacttccgcctggactagcac

SEQ ID NO: 396852 - DNA, 25 bp, Mus musculus
tttcaactttggccaccagttctac

SEQ ID NO: 396853 - DNA, 25 bp, Mus musculus
tttcaactttggcctaccttcttgc

SEQ ID NO: 396854 - DNA, 25 bp, Mus musculus
tttcaagaaaagagaaaattggaga

SEQ ID NO: 396855 - DNA, 25 bp, Mus musculus
tttcaagaaaaggaaaatgtccctg

SEQ ID NO: 396856 - DNA, 25 bp, Mus musculus
tttcaagaaatattatgctgaagta

SEQ ID NO: 396857 - DNA, 25 bp, Mus musculus
tttcaagaaatgtatctttccgacc

SEQ ID NO: 396858 - DNA, 25 bp, Mus musculus
tttcaagatcaagcttctcttgcag

SEQ ID NO: 396859 - DNA, 25 bp, Mus musculus
tttcaagcccagctactaaaggaga

SEQ ID NO: 396860 - DNA, 25 bp, Mus musculus
tttcaagccctggtaacccatagtc

SEQ ID NO: 396861 - DNA, 25 bp, Mus musculus
tttcaagccctggtgtctcttgctc

SEQ ID NO: 396862 - DNA, 25 bp, Mus musculus
tttcaagctcctgctgaaccactca

SEQ ID NO: 396863 - DNA, 25 bp, Mus musculus
tttcaaggagaggtctggtccatcg

SEQ ID NO: 396864 - DNA, 25 bp, Mus musculus
tttcaaggagaggttgctatggtga

SEQ ID NO: 396865 - DNA, 25 bp, Mus musculus
tttcaagtaatacaagctatggtga

SEQ ID NO: 396866 - DNA, 25 bp, Mus musculus
tttcaataatggactcccttttatt

SEQ ID NO: 396867 - DNA, 25 bp, Mus musculus
tttcaatcccagttacatttcaacc

SEQ ID NO: 396868 - DNA, 25 bp, Mus musculus
tttcaatcccagttatcttgacgaa

SEQ ID NO: 396869 - DNA, 25 bp, Mus musculus
tttcaatcctctagactttgagagt

SEQ ID NO: 396870 - DNA, 25 bp, Mus musculus
tttcaatcctctagttttgacctgc

SEQ ID NO: 396871 - DNA, 25 bp, Mus musculus
tttcaatggagagccgtgcagcgtg

SEQ ID NO: 396872 - DNA, 25 bp, Mus musculus
tttcaatgttggatagagatatgtc

SEQ ID NO: 396873 - DNA, 25 bp, Mus musculus
tttcaattaaggtattaagtcatga

SEQ ID NO: 396874 - DNA, 25 bp, Mus musculus
tttcaattccaatgcaaacaagaat

SEQ ID NO: 396875 - DNA, 25 bp, Mus musculus
tttcaattctgatgtactaaaaatc

SEQ ID NO: 396876 - DNA, 25 bp, Mus musculus
tttcacaaaacaaaccaaggctact

SEQ ID NO: 396877 - DNA, 25 bp, Mus musculus
tttcacaaagctcggattgggaaaa

SEQ ID NO: 396878 - DNA, 25 bp, Mus musculus
tttcacaaagttcagagtgcagaga

SEQ ID NO: 396879 - DNA, 25 bp, Mus musculus
tttcacaaatttatcctgtagtatg

SEQ ID NO: 396880 - DNA, 25 bp, Mus musculus
tttcacaagaggctccataggaatc

SEQ ID NO: 396881 - DNA, 25 bp, Mus musculus
tttcacaagtcaaaggtttaacaga

SEQ ID NO: 396882 - DNA, 25 bp, Mus musculus
tttcacaatgttgagctctctggca

SEQ ID NO: 396883 - DNA, 25 bp, Mus musculus
tttcacacggcaagtactgaacctt

SEQ ID NO: 396884 - DNA, 25 bp, Mus musculus
tttcacagaaggagacattctggag

SEQ ID NO: 396885 - DNA, 25 bp, Mus musculus
tttcacagcatcaaggtggcccggc

SEQ ID NO: 396886 - DNA, 25 bp, Mus musculus
tttcacagccccagttcacagccat

SEQ ID NO: 396887 - DNA, 25 bp, Mus musculus
tttcacagcctgtgaccatctttgg

SEQ ID NO: 396888 - DNA, 25 bp, Mus musculus
tttcacagctctaggcttttcagat

SEQ ID NO: 396889 - DNA, 25 bp, Mus musculus
tttcacagggggttcaccgtctccc

SEQ ID NO: 396890 - DNA, 25 bp, Mus musculus
tttcacagtctttcaggcatgctgg

SEQ ID NO: 396891 - DNA, 25 bp, Mus musculus
tttcacatacactgatcatagaact

SEQ ID NO: 396892 - DNA, 25 bp, Mus musculus
tttcacatttcaagttcatggcatc

SEQ ID NO: 396893 - DNA, 25 bp, Mus musculus
tttcacatttctggaaagcagtgcc

SEQ ID NO: 396894 - DNA, 25 bp, Mus musculus
tttcacatttggtgagtggggcagc

SEQ ID NO: 396895 - DNA, 25 bp, Mus musculus
tttcaccaaaaagggaactacaaga

SEQ ID NO: 396896 - DNA, 25 bp, Mus musculus
tttcaccaaaggattctaaccacat

SEQ ID NO: 396897 - DNA, 25 bp, Mus musculus
tttcaccaaaggtcctggcatggga

SEQ ID NO: 396898 - DNA, 25 bp, Mus musculus
tttcaccaagacacacccgcagtgg

SEQ ID NO: 396899 - DNA, 25 bp, Mus musculus
tttcaccaagacacaggggaagtcc

SEQ ID NO: 396900 - DNA, 25 bp, Mus musculus
tttcaccaccatcatttttgatgac

SEQ ID NO: 396901 - DNA, 25 bp, Mus musculus
tttcaccagggaagacagtgaccct

SEQ ID NO: 396902 - DNA, 25 bp, Mus musculus
tttcacccatggaagacaaagtctg

SEQ ID NO: 396903 - DNA, 25 bp, Mus musculus
tttcacccatggaagcaccccccat

SEQ ID NO: 396904 - DNA, 25 bp, Mus musculus
tttcaccccaggcttacagttcctc

SEQ ID NO: 396905 - DNA, 25 bp, Mus musculus
tttcacccgcaaatgtcagcaattg

SEQ ID NO: 396906 - DNA, 25 bp, Mus musculus
tttcacccgcaattcccactacctg

SEQ ID NO: 396907 - DNA, 25 bp, Mus musculus
tttcaccgccgctttgacctcgaaa

SEQ ID NO: 396908 - DNA, 25 bp, Mus musculus
tttcacctatctgggggcacctgat

SEQ ID NO: 396909 - DNA, 25 bp, Mus musculus
tttcacctcccagatcttctccctg

SEQ ID NO: 396910 - DNA, 25 bp, Mus musculus
tttcacctgatagcatgtggcatga

SEQ ID NO: 396911 - DNA, 25 bp, Mus musculus
tttcaccttgcaaagcctttcccaa

SEQ ID NO: 396912 - DNA, 25 bp, Mus musculus
tttcacgtctctggacaagccctca

SEQ ID NO: 396913 - DNA, 25 bp, Mus musculus
tttcacgtggagcctgacagcagcc

SEQ ID NO: 396914 - DNA, 25 bp, Mus musculus
tttcacgtgggcgggccaggctgtg

SEQ ID NO: 396915 - DNA, 25 bp, Mus musculus
tttcactcttccttggtactctcaa

SEQ ID NO: 396916 - DNA, 25 bp, Mus musculus
tttcactgaggttaatctataattt

SEQ ID NO: 396917 - DNA, 25 bp, Mus musculus
tttcacttaaggtccttcagaccag

SEQ ID NO: 396918 - DNA, 25 bp, Mus musculus
tttcacttgccaaaggaaagcgagc

SEQ ID NO: 396919 - DNA, 25 bp, Mus musculus
tttcacttgccaaaggcagtttgat

SEQ ID NO: 396920 - DNA, 25 bp, Mus musculus
tttcagaaaatagccaggactatca

SEQ ID NO: 396921 - DNA, 25 bp, Mus musculus
tttcagaaaataggtattgaggctc

SEQ ID NO: 396922 - DNA, 25 bp, Mus musculus
tttcagaaagtaaacgaagcaaaaa

SEQ ID NO: 396923 - DNA, 25 bp, Mus musculus
tttcagaacagagggcaatgcgagc

SEQ ID NO: 396924 - DNA, 25 bp, Mus musculus
tttcagaaccagcctgggcccgaag

SEQ ID NO: 396925 - DNA, 25 bp, Mus musculus
tttcagaaccagctttgaatggcag

SEQ ID NO: 396926 - DNA, 25 bp, Mus musculus
tttcagaacgcaccggtagctggag

SEQ ID NO: 396927 - DNA, 25 bp, Mus musculus
tttcagaagattcagatggggctga

SEQ ID NO: 396928 - DNA, 25 bp, Mus musculus
tttcagaagctcaagacatgaagcg

SEQ ID NO: 396929 - DNA, 25 bp, Mus musculus
tttcagaagttgcagcggcaatatg

SEQ ID NO: 396930 - DNA, 25 bp, Mus musculus
tttcagaagttgcaggaattattga

SEQ ID NO: 396931 - DNA, 25 bp, Mus musculus
tttcagaatatagagtcatggatgc

SEQ ID NO: 396932 - DNA, 25 bp, Mus musculus
tttcagacagctggttcgatgccca

SEQ ID NO: 396933 - DNA, 25 bp, Mus musculus
tttcagacaggattggtagcttatg

SEQ ID NO: 396934 - DNA, 25 bp, Mus musculus
tttcagacatagtcacagcccagca

SEQ ID NO: 396935 - DNA, 25 bp, Mus musculus
tttcagaccaatacccacaggtccg

SEQ ID NO: 396936 - DNA, 25 bp, Mus musculus
tttcagaccaggcagcgagtactaa

SEQ ID NO: 396937 - DNA, 25 bp, Mus musculus
tttcagactaaggtggacttcacct

SEQ ID NO: 396938 - DNA, 25 bp, Mus musculus
tttcagagacagaggtctcaaggga

SEQ ID NO: 396939 - DNA, 25 bp, Mus musculus
tttcagagctagaggatgtggagaa

SEQ ID NO: 396940 - DNA, 25 bp, Mus musculus
tttcagagctctttgatgacttggg

SEQ ID NO: 396941 - DNA, 25 bp, Mus musculus
tttcagagctggaaccctgccacat

SEQ ID NO: 396942 - DNA, 25 bp, Mus musculus
tttcagagctggagagttgaagcag

SEQ ID NO: 396943 - DNA, 25 bp, Mus musculus
tttcagagttaacaaacatgatcag

SEQ ID NO: 396944 - DNA, 25 bp, Mus musculus
tttcagagttaacaggtggctggat

SEQ ID NO: 396945 - DNA, 25 bp, Mus musculus
tttcagagttggaaacaacttcctg

SEQ ID NO: 396946 - DNA, 25 bp, Mus musculus
tttcagataattggaggatagacag

SEQ ID NO: 396947 - DNA, 25 bp, Mus musculus
tttcagataattgggccattgacag

SEQ ID NO: 396948 - DNA, 25 bp, Mus musculus
tttcagatacataccaaggagggtg

SEQ ID NO: 396949 - DNA, 25 bp, Mus musculus
tttcagatactgttacagccctgcc

SEQ ID NO: 396950 - DNA, 25 bp, Mus musculus
tttcagatgagggaaagcactgcca

SEQ ID NO: 396951 - DNA, 25 bp, Mus musculus
tttcagattgccagatcagtatatc

SEQ ID NO: 396952 - DNA, 25 bp, Mus musculus
tttcagattggtggaccttcctctt

SEQ ID NO: 396953 - DNA, 25 bp, Mus musculus
tttcagcacaacaatgcagatagac

SEQ ID NO: 396954 - DNA, 25 bp, Mus musculus
tttcagcacaacatgggaaaaccca

SEQ ID NO: 396955 - DNA, 25 bp, Mus musculus
tttcagcagacacagattcaaaata

SEQ ID NO: 396956 - DNA, 25 bp, Mus musculus
tttcagcagagactaaaggagatcc

SEQ ID NO: 396957 - DNA, 25 bp, Mus musculus
tttcagcagtcagcatcaggggcgc

SEQ ID NO: 396958 - DNA, 25 bp, Mus musculus
tttcagcatagtctccattcagaac

SEQ ID NO: 396959 - DNA, 25 bp, Mus musculus
tttcagcatcaggggttcggcatgc

SEQ ID NO: 396960 - DNA, 25 bp, Mus musculus
tttcagccagaccatagtcctgctc

SEQ ID NO: 396961 - DNA, 25 bp, Mus musculus
tttcagccagagatcaccagaagct

SEQ ID NO: 396962 - DNA, 25 bp, Mus musculus
tttcagccagagggggcttttacag

SEQ ID NO: 396963 - DNA, 25 bp, Mus musculus
tttcagccagattctggctggcgga

SEQ ID NO: 396964 - DNA, 25 bp, Mus musculus
tttcagccagtgctccacctggtgg

SEQ ID NO: 396965 - DNA, 25 bp, Mus musculus
tttcagccccagctctcgggacagt

SEQ ID NO: 396966 - DNA, 25 bp, Mus musculus
tttcagccctcagtggaccctgatc

SEQ ID NO: 396967 - DNA, 25 bp, Mus musculus
tttcagccgcatcgctctgaagaaa

SEQ ID NO: 396968 - DNA, 25 bp, Mus musculus
tttcagcgcctctggagttagtgag

SEQ ID NO: 396969 - DNA, 25 bp, Mus musculus
tttcagcgcctctggtgacagagtg

SEQ ID NO: 396970 - DNA, 25 bp, Mus musculus
tttcagcgcctctgtcttgttttca

SEQ ID NO: 396971 - DNA, 25 bp, Mus musculus
tttcagcggctcaggatggcctcag

SEQ ID NO: 396972 - DNA, 25 bp, Mus musculus
tttcagcggctcaggccctgcccat

SEQ ID NO: 396973 - DNA, 25 bp, Mus musculus
tttcagctatggaccgtcacgacgg

SEQ ID NO: 396974 - DNA, 25 bp, Mus musculus
tttcagctgaagtcaggaaagtcag

SEQ ID NO: 396975 - DNA, 25 bp, Mus musculus
tttcagctgctgggactccgaggtg

SEQ ID NO: 396976 - DNA, 25 bp, Mus musculus
tttcagctgtaatggtgcgtctaat

SEQ ID NO: 396977 - DNA, 25 bp, Mus musculus
tttcagcttggtgctgttaaaggga

SEQ ID NO: 396978 - DNA, 25 bp, Mus musculus
tttcaggcaaaagcgagcggagctc

SEQ ID NO: 396979 - DNA, 25 bp, Mus musculus
tttcaggccagggaccgagaacacg

SEQ ID NO: 396980 - DNA, 25 bp, Mus musculus
tttcaggcgcatcaggtgaagaaga

SEQ ID NO: 396981 - DNA, 25 bp, Mus musculus
tttcagggaaaacaggcagcacagg

SEQ ID NO: 396982 - DNA, 25 bp, Mus musculus
tttcagggagactgctgggctgatc

SEQ ID NO: 396983 - DNA, 25 bp, Mus musculus
tttcaggtattcatgtgatggaagg

SEQ ID NO: 396984 - DNA, 25 bp, Mus musculus
tttcagtaggagtgtgacttggaag

SEQ ID NO: 396985 - DNA, 25 bp, Mus musculus
tttcagtcagatatactttattaag

SEQ ID NO: 396986 - DNA, 25 bp, Mus musculus
tttcagtcaggaagtcctacctata

SEQ ID NO: 396987 - DNA, 25 bp, Mus musculus
tttcagtcctttctggtgtccgccg

SEQ ID NO: 396988 - DNA, 25 bp, Mus musculus
tttcagtctaagtgtacacaggaga

SEQ ID NO: 396989 - DNA, 25 bp, Mus musculus
tttcagtgacaactccacagagtca

SEQ ID NO: 396990 - DNA, 25 bp, Mus musculus
tttcagtgtcagacttaaatggagt

SEQ ID NO: 396991 - DNA, 25 bp, Mus musculus
tttcagttacaagcaacaacaacaa

SEQ ID NO: 396992 - DNA, 25 bp, Mus musculus
tttcagttacaaggcaatgtatgtg

SEQ ID NO: 396993 - DNA, 25 bp, Mus musculus
tttcagttcagttagcccccaacca

SEQ ID NO: 396994 - DNA, 25 bp, Mus musculus
tttcagttcagttttgctaactgtg

SEQ ID NO: 396995 - DNA, 25 bp, Mus musculus
tttcagttgacacgagccgtctacc

SEQ ID NO: 396996 - DNA, 25 bp, Mus musculus
tttcagttgacacggaacagtccaa

SEQ ID NO: 396997 - DNA, 25 bp, Mus musculus
tttcataaatgatgtatgtcgcact

SEQ ID NO: 396998 - DNA, 25 bp, Mus musculus
tttcataacatagactgaaacagtc

SEQ ID NO: 396999 - DNA, 25 bp, Mus musculus
tttcatacagacgcttgatcctgcc

SEQ ID NO: 397000 - DNA, 25 bp, Mus musculus
tttcatacagataaaaattattctc

SEQ ID NO: 397001 - DNA, 25 bp, Mus musculus
tttcatacagcacgcatttgatgga

SEQ ID NO: 397002 - DNA, 25 bp, Mus musculus
tttcatacaggattcaatgttggat

SEQ ID NO: 397003 - DNA, 25 bp, Mus musculus
tttcataccagctgcttttatggtg

SEQ ID NO: 397004 - DNA, 25 bp, Mus musculus
tttcatagctccagtgacccaccgt

SEQ ID NO: 397005 - DNA, 25 bp, Mus musculus
tttcatattggacaagaagttgttc

SEQ ID NO: 397006 - DNA, 25 bp, Mus musculus
tttcatattggacaagtagagggga

SEQ ID NO: 397007 - DNA, 25 bp, Mus musculus
tttcatcaactatcatgcttcggat

SEQ ID NO: 397008 - DNA, 25 bp, Mus musculus
tttcatcaagcctggtacttgctac

SEQ ID NO: 397009 - DNA, 25 bp, Mus musculus
tttcatcaagctcctggttgaagcc

SEQ ID NO: 397010 - DNA, 25 bp, Mus musculus
tttcatcaaggctatggcaatatag

SEQ ID NO: 397011 - DNA, 25 bp, Mus musculus
tttcatcaccaggagctcggacggc

SEQ ID NO: 397012 - DNA, 25 bp, Mus musculus
tttcatcaccaggagctctcctccc

SEQ ID NO: 397013 - DNA, 25 bp, Mus musculus
tttcatcaccaggagtatgcttgag

SEQ ID NO: 397014 - DNA, 25 bp, Mus musculus
tttcatcactcagtgcatgaggaag

SEQ ID NO: 397015 - DNA, 25 bp, Mus musculus
tttcatcagccaggagccagtcctg

SEQ ID NO: 397016 - DNA, 25 bp, Mus musculus
tttcatcatgggaggtgaggctctg

SEQ ID NO: 397017 - DNA, 25 bp, Mus musculus
tttcatcatggtcctccaggaggac

SEQ ID NO: 397018 - DNA, 25 bp, Mus musculus
tttcatccagggtcacaaacctaca

SEQ ID NO: 397019 - DNA, 25 bp, Mus musculus
tttcatcgacaaagacaacactgct

SEQ ID NO: 397020 - DNA, 25 bp, Mus musculus
tttcatctcaaagcatacagctgca

SEQ ID NO: 397021 - DNA, 25 bp, Mus musculus
tttcatctcagatgtggtgaacgac

SEQ ID NO: 397022 - DNA, 25 bp, Mus musculus
tttcatctctcaggctctctaactg

SEQ ID NO: 397023 - DNA, 25 bp, Mus musculus
tttcatctctgagaacagaggcgtg

SEQ ID NO: 397024 - DNA, 25 bp, Mus musculus
tttcatctggagactgctcatctgg

SEQ ID NO: 397025 - DNA, 25 bp, Mus musculus
tttcatctggagagtctgcaggaga

SEQ ID NO: 397026 - DNA, 25 bp, Mus musculus
tttcatcttccaattctcctctggc

SEQ ID NO: 397027 - DNA, 25 bp, Mus musculus
tttcatcttttggatcactggtgtt

SEQ ID NO: 397028 - DNA, 25 bp, Mus musculus
tttcatgacaccaggacttcctcca

SEQ ID NO: 397029 - DNA, 25 bp, Mus musculus
tttcatgatcatccagtcctcgctg

SEQ ID NO: 397030 - DNA, 25 bp, Mus musculus
tttcatgattatagtgcagcagctg

SEQ ID NO: 397031 - DNA, 25 bp, Mus musculus
tttcatgcatttggaggaactgcca

SEQ ID NO: 397032 - DNA, 25 bp, Mus musculus
tttcatgccaaaggcctctggctgt

SEQ ID NO: 397033 - DNA, 25 bp, Mus musculus
tttcatgccaaaggtcagttcaccg

SEQ ID NO: 397034 - DNA, 25 bp, Mus musculus
tttcatgccaccctctgcctcccaa

SEQ ID NO: 397035 - DNA, 25 bp, Mus musculus
tttcatgctaggcaatggtcactcg

SEQ ID NO: 397036 - DNA, 25 bp, Mus musculus
tttcatgctggatgacctcaatgcc

SEQ ID NO: 397037 - DNA, 25 bp, Mus musculus
tttcatggaagtgtgtgatgactgc

SEQ ID NO: 397038 - DNA, 25 bp, Mus musculus
tttcatggagagacgtgacactcac

SEQ ID NO: 397039 - DNA, 25 bp, Mus musculus
tttcatggagagggaggggcggaag

SEQ ID NO: 397040 - DNA, 25 bp, Mus musculus
tttcatggataaaggtgctggagag

SEQ ID NO: 397041 - DNA, 25 bp, Mus musculus
tttcatggattcactagggaaggaa

SEQ ID NO: 397042 - DNA, 25 bp, Mus musculus
tttcatggtagaagtctttatagat

SEQ ID NO: 397043 - DNA, 25 bp, Mus musculus
tttcatgtagtgaggacagtagaat

SEQ ID NO: 397044 - DNA, 25 bp, Mus musculus
tttcatgtagtgaggcagcagagtg

SEQ ID NO: 397045 - DNA, 25 bp, Mus musculus
tttcatgtccggaaggtctgcgctg

SEQ ID NO: 397046 - DNA, 25 bp, Mus musculus
tttcattaaaagctccaggtctggt

SEQ ID NO: 397047 - DNA, 25 bp, Mus musculus
tttcattaagacctggtcccagggc

SEQ ID NO: 397048 - DNA, 25 bp, Mus musculus
tttcattaagatcgggaagctgcat

SEQ ID NO: 397049 - DNA, 25 bp, Mus musculus
tttcattacaaccagagggcatgaa

SEQ ID NO: 397050 - DNA, 25 bp, Mus musculus
tttcattacaaccagagttttcctc

SEQ ID NO: 397051 - DNA, 25 bp, Mus musculus
tttcattataagaacaacaaaacca

SEQ ID NO: 397052 - DNA, 25 bp, Mus musculus
tttcattataagcatgatcgggagg

SEQ ID NO: 397053 - DNA, 25 bp, Mus musculus
tttcattgaggagtttgacaattat

SEQ ID NO: 397054 - DNA, 25 bp, Mus musculus
tttcatttaaaatggatgtgaaatg

SEQ ID NO: 397055 - DNA, 25 bp, Mus musculus
tttcatttactaagactctccttcc

SEQ ID NO: 397056 - DNA, 25 bp, Mus musculus
tttcatttactaagggctacagagc

SEQ ID NO: 397057 - DNA, 25 bp, Mus musculus
tttcatttactgatgggagtcacag

SEQ ID NO: 397058 - DNA, 25 bp, Mus musculus
tttcatttactttgtggcctttttg

SEQ ID NO: 397059 - DNA, 25 bp, Mus musculus
tttcatttcaagatgtgcccttccc

SEQ ID NO: 397060 - DNA, 25 bp, Mus musculus
tttcatttcctgcttcaacagactc

SEQ ID NO: 397061 - DNA, 25 bp, Mus musculus
tttcatttcctgtcctaataaaagg

SEQ ID NO: 397062 - DNA, 25 bp, Mus musculus
tttcatttgggagaaccatggctcc

SEQ ID NO: 397063 - DNA, 25 bp, Mus musculus
tttcatttgtgaagcctccaggcat

SEQ ID NO: 397064 - DNA, 25 bp, Mus musculus
tttcatttgtgaagctggaagccga

SEQ ID NO: 397065 - DNA, 25 bp, Mus musculus
tttccaaaagagaacggacactctt

SEQ ID NO: 397066 - DNA, 25 bp, Mus musculus
tttccaaaagcaactgctttgctct

SEQ ID NO: 397067 - DNA, 25 bp, Mus musculus
tttccaaaagcctgaaacatttgag

SEQ ID NO: 397068 - DNA, 25 bp, Mus musculus
tttccaaaagctcctggctagagga

SEQ ID NO: 397069 - DNA, 25 bp, Mus musculus
tttccaaaagctcctgggacctgag

SEQ ID NO: 397070 - DNA, 25 bp, Mus musculus
tttccaaacctagagagagaaatac

SEQ ID NO: 397071 - DNA, 25 bp, Mus musculus
tttccaaatgtgacgagaagaacgg

SEQ ID NO: 397072 - DNA, 25 bp, Mus musculus
tttccaacaaagcctacacaggtgc

SEQ ID NO: 397073 - DNA, 25 bp, Mus musculus
tttccaacaacatcaaagaaaaatt

SEQ ID NO: 397074 - DNA, 25 bp, Mus musculus
tttccaacaacatcatgaacaacgt

SEQ ID NO: 397075 - DNA, 25 bp, Mus musculus
tttccaacaacctgcatcataaggg

SEQ ID NO: 397076 - DNA, 25 bp, Mus musculus
tttccaacagagcttaccaaatgcc

SEQ ID NO: 397077 - DNA, 25 bp, Mus musculus
tttccaacagagggagacgatggac

SEQ ID NO: 397078 - DNA, 25 bp, Mus musculus
tttccaacagccgcgcacactggag

SEQ ID NO: 397079 - DNA, 25 bp, Mus musculus
tttccaacatcaaagccattggtgt

SEQ ID NO: 397080 - DNA, 25 bp, Mus musculus
tttccaaccacggctcactccagca

SEQ ID NO: 397081 - DNA, 25 bp, Mus musculus
tttccaaccagctggctgaagccat

SEQ ID NO: 397082 - DNA, 25 bp, Mus musculus
tttccaacccaagctcttttgtgac

SEQ ID NO: 397083 - DNA, 25 bp, Mus musculus
tttccaagaacactgatgaaatcat

SEQ ID NO: 397084 - DNA, 25 bp, Mus musculus
tttccaagcaatgtggtacacggat

SEQ ID NO: 397085 - DNA, 25 bp, Mus musculus
tttccaagcagggaccaggataatg

SEQ ID NO: 397086 - DNA, 25 bp, Mus musculus
tttccaagcagttactgctgacctt

SEQ ID NO: 397087 - DNA, 25 bp, Mus musculus
tttccaagctgttgagcaagcacca

SEQ ID NO: 397088 - DNA, 25 bp, Mus musculus
tttccaatatggctttatcctcttg

SEQ ID NO: 397089 - DNA, 25 bp, Mus musculus
tttccaatcattagcaatcgtggaa

SEQ ID NO: 397090 - DNA, 25 bp, Mus musculus
tttccaatcattagggagctgtcca

SEQ ID NO: 397091 - DNA, 25 bp, Mus musculus
tttccacaatacgcgccccctgtaa

SEQ ID NO: 397092 - DNA, 25 bp, Mus musculus
tttccacacagttgaaaagggcagg

SEQ ID NO: 397093 - DNA, 25 bp, Mus musculus
tttccacaccgacactgcaaatgga

SEQ ID NO: 397094 - DNA, 25 bp, Mus musculus
tttccacacctctctctcaggagtg

SEQ ID NO: 397095 - DNA, 25 bp, Mus musculus
tttccacagagcctttgatatggtt

SEQ ID NO: 397096 - DNA, 25 bp, Mus musculus
tttccacagagctctggagaccctc

SEQ ID NO: 397097 - DNA, 25 bp, Mus musculus
tttccacagcacggagctcgaagac

SEQ ID NO: 397098 - DNA, 25 bp, Mus musculus
tttccacagcctgtgctcattgccc

SEQ ID NO: 397099 - DNA, 25 bp, Mus musculus
tttccacaggcctgagtttcctgag

SEQ ID NO: 397100 - DNA, 25 bp, Mus musculus
tttccacatagtgctggggatcgaa

SEQ ID NO: 397101 - DNA, 25 bp, Mus musculus
tttccacatagttcagcaatcagca

SEQ ID NO: 397102 - DNA, 25 bp, Mus musculus
tttccaccacctggatcgagaactc

SEQ ID NO: 397103 - DNA, 25 bp, Mus musculus
tttccaccgaaggtttctctgtagc

SEQ ID NO: 397104 - DNA, 25 bp, Mus musculus
tttccacctgtcagacccgccagga

SEQ ID NO: 397105 - DNA, 25 bp, Mus musculus
tttccacctgtgggtccttgctgcc

SEQ ID NO: 397106 - DNA, 25 bp, Mus musculus
tttccacgatggggtccgagtggca

SEQ ID NO: 397107 - DNA, 25 bp, Mus musculus
tttccacgcttcaaggcgcaacctg

SEQ ID NO: 397108 - DNA, 25 bp, Mus musculus
tttccacggaagagtaaagacattt

SEQ ID NO: 397109 - DNA, 25 bp, Mus musculus
tttccacggaggttaatctataatt

SEQ ID NO: 397110 - DNA, 25 bp, Mus musculus
tttccactatagtgagttctctggt

SEQ ID NO: 397111 - DNA, 25 bp, Mus musculus
tttccactcatcctccttgtgagca

SEQ ID NO: 397112 - DNA, 25 bp, Mus musculus
tttccactgctctggctcgacttcg

SEQ ID NO: 397113 - DNA, 25 bp, Mus musculus
tttccactgttccatgtctccagga

SEQ ID NO: 397114 - DNA, 25 bp, Mus musculus
tttccactttcaggaccatggtatc

SEQ ID NO: 397115 - DNA, 25 bp, Mus musculus
tttccagaagaccagtttcccaact

SEQ ID NO: 397116 - DNA, 25 bp, Mus musculus
tttccagaagcaggtgtccccagaa

SEQ ID NO: 397117 - DNA, 25 bp, Mus musculus
tttccagaggcggccagcaggtggc

SEQ ID NO: 397118 - DNA, 25 bp, Mus musculus
tttccagattggtgccattcagtca

SEQ ID NO: 397119 - DNA, 25 bp, Mus musculus
tttccagcaaagaattgggatatga

SEQ ID NO: 397120 - DNA, 25 bp, Mus musculus
tttccagcaaaggtttagaccctct

SEQ ID NO: 397121 - DNA, 25 bp, Mus musculus
tttccagcaagcttgagtctactga

SEQ ID NO: 397122 - DNA, 25 bp, Mus musculus
tttccagcaagtaccaggaatgtga

SEQ ID NO: 397123 - DNA, 25 bp, Mus musculus
tttccagcaagtggaacacatttcc

SEQ ID NO: 397124 - DNA, 25 bp, Mus musculus
tttccagcaagttctggatgattta

SEQ ID NO: 397125 - DNA, 25 bp, Mus musculus
tttccagcagggtgacatggagtcc

SEQ ID NO: 397126 - DNA, 25 bp, Mus musculus
tttccagccgtggtcaagttcacca

SEQ ID NO: 397127 - DNA, 25 bp, Mus musculus
tttccagctggagggagagcgtgag

SEQ ID NO: 397128 - DNA, 25 bp, Mus musculus
tttccagcttgtgaggttcttgttt

SEQ ID NO: 397129 - DNA, 25 bp, Mus musculus
tttccagctttgagatggctatgaa

SEQ ID NO: 397130 - DNA, 25 bp, Mus musculus
tttccaggaaacatggaaataagca

SEQ ID NO: 397131 - DNA, 25 bp, Mus musculus
tttccaggacagatggcgctgccag

SEQ ID NO: 397132 - DNA, 25 bp, Mus musculus
tttccaggcaggctcatggcagata

SEQ ID NO: 397133 - DNA, 25 bp, Mus musculus
tttccaggctacaggagatcgctct

SEQ ID NO: 397134 - DNA, 25 bp, Mus musculus
tttccaggtatggtatgaaaccaaa

SEQ ID NO: 397135 - DNA, 25 bp, Mus musculus
tttccaggtgcagagggcagctgag

SEQ ID NO: 397136 - DNA, 25 bp, Mus musculus
tttccagtatcggtaactgtgaatg

SEQ ID NO: 397137 - DNA, 25 bp, Mus musculus
tttccagtatcggtaagtgttattg

SEQ ID NO: 397138 - DNA, 25 bp, Mus musculus
tttccagtatcggtactaatgtctg

SEQ ID NO: 397139 - DNA, 25 bp, Mus musculus
tttccagtatcggtactcctccaaa

SEQ ID NO: 397140 - DNA, 25 bp, Mus musculus
tttccagtgcaccagcagaacagtt

SEQ ID NO: 397141 - DNA, 25 bp, Mus musculus
tttccagtgccagtttcctagattg

SEQ ID NO: 397142 - DNA, 25 bp, Mus musculus
tttccagttaaacctgctgatctta

SEQ ID NO: 397143 - DNA, 25 bp, Mus musculus
tttccatagtcacaggacgtccagc

SEQ ID NO: 397144 - DNA, 25 bp, Mus musculus
tttccatagtctgagtgacagccca

SEQ ID NO: 397145 - DNA, 25 bp, Mus musculus
tttccatatcctcagattcagaaaa

SEQ ID NO: 397146 - DNA, 25 bp, Mus musculus
tttccatatcctcagcctctccagc

SEQ ID NO: 397147 - DNA, 25 bp, Mus musculus
tttccatatgaatatcaagatggat

SEQ ID NO: 397148 - DNA, 25 bp, Mus musculus
tttccatcaagatcagagacaccag

SEQ ID NO: 397149 - DNA, 25 bp, Mus musculus
tttccatccggatagacaagcgtga

SEQ ID NO: 397150 - DNA, 25 bp, Mus musculus
tttccatggcaccaggattttaatt

SEQ ID NO: 397151 - DNA, 25 bp, Mus musculus
tttccattgagttcctccgcaacaa

SEQ ID NO: 397152 - DNA, 25 bp, Mus musculus
tttccatttcaaggtctcaaaagat

SEQ ID NO: 397153 - DNA, 25 bp, Mus musculus
tttccatttctgaaagattagaaca

SEQ ID NO: 397154 - DNA, 25 bp, Mus musculus
tttcccaaactatgtcggacggcca

SEQ ID NO: 397155 - DNA, 25 bp, Mus musculus
tttcccacagaacacggaatgacaa

SEQ ID NO: 397156 - DNA, 25 bp, Mus musculus
tttcccacagaacacgtgaaagcag

SEQ ID NO: 397157 - DNA, 25 bp, Mus musculus
tttcccacagacctggatttggatt

SEQ ID NO: 397158 - DNA, 25 bp, Mus musculus
tttcccaccaagcccacaaggcccg

SEQ ID NO: 397159 - DNA, 25 bp, Mus musculus
tttcccactgaggccaatgtgcttt

SEQ ID NO: 397160 - DNA, 25 bp, Mus musculus
tttcccagagaagggggaactgatt

SEQ ID NO: 397161 - DNA, 25 bp, Mus musculus
tttcccagctcacttcttccccgtc

SEQ ID NO: 397162 - DNA, 25 bp, Mus musculus
tttcccaggacgatagccagccctg

SEQ ID NO: 397163 - DNA, 25 bp, Mus musculus
tttcccaggacggctactggcagga

SEQ ID NO: 397164 - DNA, 25 bp, Mus musculus
tttcccatcaacctgctgtcctggg

SEQ ID NO: 397165 - DNA, 25 bp, Mus musculus
tttcccatccagctggtgaagacac

SEQ ID NO: 397166 - DNA, 25 bp, Mus musculus
tttcccatgggtcactgcccagccc

SEQ ID NO: 397167 - DNA, 25 bp, Mus musculus
tttcccattgaaggtttcaggacat

SEQ ID NO: 397168 - DNA, 25 bp, Mus musculus
tttcccattgagtacccagactcat

SEQ ID NO: 397169 - DNA, 25 bp, Mus musculus
tttccccaaggcaagtcttggaagg

SEQ ID NO: 397170 - DNA, 25 bp, Mus musculus
tttccccaaggctagcttccgatcc

SEQ ID NO: 397171 - DNA, 25 bp, Mus musculus
tttccccaagtgcgccgcagagctc

SEQ ID NO: 397172 - DNA, 25 bp, Mus musculus
tttccccagcacagcaatcttccct

SEQ ID NO: 397173 - DNA, 25 bp, Mus musculus
tttccccagctacaggtacattact

SEQ ID NO: 397174 - DNA, 25 bp, Mus musculus
tttcccccaacttacagactgaagt

SEQ ID NO: 397175 - DNA, 25 bp, Mus musculus
tttcccccctcaagatcggcttcct

SEQ ID NO: 397176 - DNA, 25 bp, Mus musculus
tttcccccgcccaggacagtcggcc

SEQ ID NO: 397177 - DNA, 25 bp, Mus musculus
tttcccctcagcaaatccagtttgc

SEQ ID NO: 397178 - DNA, 25 bp, Mus musculus
tttcccctgaagcattgaaaaaggc

SEQ ID NO: 397179 - DNA, 25 bp, Mus musculus
tttcccctgaagccaatcatctggg

SEQ ID NO: 397180 - DNA, 25 bp, Mus musculus
tttcccctgcaaaaatctggaagag

SEQ ID NO: 397181 - DNA, 25 bp, Mus musculus
tttcccctgcaatactgccgaaacc

SEQ ID NO: 397182 - DNA, 25 bp, Mus musculus
tttccccttggtgcaccatggagcc

SEQ ID NO: 397183 - DNA, 25 bp, Mus musculus
tttcccctttggagtcccatggtct

SEQ ID NO: 397184 - DNA, 25 bp, Mus musculus
tttcccgagccaggatcttgtgctg

SEQ ID NO: 397185 - DNA, 25 bp, Mus musculus
tttcccgaggtcgatacttcccaag

SEQ ID NO: 397186 - DNA, 25 bp, Mus musculus
tttcccgagtccagattgaacacat

SEQ ID NO: 397187 - DNA, 25 bp, Mus musculus
tttcccgagtccaggccgacgtgga

SEQ ID NO: 397188 - DNA, 25 bp, Mus musculus
tttcccgcgggcaaggcacgagtgg

SEQ ID NO: 397189 - DNA, 25 bp, Mus musculus
tttcccgcgggtgtcctggctgtat

SEQ ID NO: 397190 - DNA, 25 bp, Mus musculus
tttccctaccttcaacaggactggg

SEQ ID NO: 397191 - DNA, 25 bp, Mus musculus
tttccctcagaatgggtcagcccgt

SEQ ID NO: 397192 - DNA, 25 bp, Mus musculus
tttccctcagagccagcccaggctt

SEQ ID NO: 397193 - DNA, 25 bp, Mus musculus
tttccctcaggcgacccaactctac

SEQ ID NO: 397194 - DNA, 25 bp, Mus musculus
tttccctctagtggaaacaagttga

SEQ ID NO: 397195 - DNA, 25 bp, Mus musculus
tttccctctagttgtgagcggccat

SEQ ID NO: 397196 - DNA, 25 bp, Mus musculus
tttccctcttggctgatggtgaggc

SEQ ID NO: 397197 - DNA, 25 bp, Mus musculus
tttccctgtctctcagaactgaggg

SEQ ID NO: 397198 - DNA, 25 bp, Mus musculus
tttccctgtctctttggtcaagaca

SEQ ID NO: 397199 - DNA, 25 bp, Mus musculus
tttcccttcccgagggcgctgtgag

SEQ ID NO: 397200 - DNA, 25 bp, Mus musculus
tttcccttttgcatggtaagaccag

SEQ ID NO: 397201 - DNA, 25 bp, Mus musculus
tttccgaaatgagctggaattttgg

SEQ ID NO: 397202 - DNA, 25 bp, Mus musculus
tttccgagcagaagcaagccataca

SEQ ID NO: 397203 - DNA, 25 bp, Mus musculus
tttccgagcgtacctgtgcccacat

SEQ ID NO: 397204 - DNA, 25 bp, Mus musculus
tttccgaggctcagtactatggcat

SEQ ID NO: 397205 - DNA, 25 bp, Mus musculus
tttccgatacgttctggacccttct

SEQ ID NO: 397206 - DNA, 25 bp, Mus musculus
tttccgcaaggccctttatgggact

SEQ ID NO: 397207 - DNA, 25 bp, Mus musculus
tttccgcgacagagactaggcctga

SEQ ID NO: 397208 - DNA, 25 bp, Mus musculus
tttccgcgacaggcaggagactgaa

SEQ ID NO: 397209 - DNA, 25 bp, Mus musculus
tttccgcgacaggggtccctccaat

SEQ ID NO: 397210 - DNA, 25 bp, Mus musculus
tttccgcgacaggtcagggtatttc

SEQ ID NO: 397211 - DNA, 25 bp, Mus musculus
tttccggaaatggcactgtttttag

SEQ ID NO: 397212 - DNA, 25 bp, Mus musculus
tttccggaaatgtgagcgggagaat

SEQ ID NO: 397213 - DNA, 25 bp, Mus musculus
tttccggaatgcaggtttcaaatga

SEQ ID NO: 397214 - DNA, 25 bp, Mus musculus
tttccggcgagggctgtaaaaaatg

SEQ ID NO: 397215 - DNA, 25 bp, Mus musculus
tttccggctgctcctgatgctgtgc

SEQ ID NO: 397216 - DNA, 25 bp, Mus musculus
tttccggttctcatcaagatcaatg

SEQ ID NO: 397217 - DNA, 25 bp, Mus musculus
tttccggttctcatgctcctgtggc

SEQ ID NO: 397218 - DNA, 25 bp, Mus musculus
tttccgtccagaagaaaacacacgt

SEQ ID NO: 397219 - DNA, 25 bp, Mus musculus
tttccgtccagaagcccacagtcac

SEQ ID NO: 397220 - DNA, 25 bp, Mus musculus
tttccgtccagaagggtgaacctaa

SEQ ID NO: 397221 - DNA, 25 bp, Mus musculus
tttccgtcctacaaacctcatccag

SEQ ID NO: 397222 - DNA, 25 bp, Mus musculus
tttccgtgcctttgaagatgagcag

SEQ ID NO: 397223 - DNA, 25 bp, Mus musculus
tttcctaaaggagatataatcagtg

SEQ ID NO: 397224 - DNA, 25 bp, Mus musculus
tttcctaaattctctgcccttctgc

SEQ ID NO: 397225 - DNA, 25 bp, Mus musculus
tttcctaacgctgctgcattttttc

SEQ ID NO: 397226 - DNA, 25 bp, Mus musculus
tttcctaacttttagtcacagaaaa

SEQ ID NO: 397227 - DNA, 25 bp, Mus musculus
tttcctacaagttggtcagtgaaat

SEQ ID NO: 397228 - DNA, 25 bp, Mus musculus
tttcctacagagagaacctggagga

SEQ ID NO: 397229 - DNA, 25 bp, Mus musculus
tttcctacagggaaatcagtcagcc

SEQ ID NO: 397230 - DNA, 25 bp, Mus musculus
tttcctacaggtggggctttaatcc

SEQ ID NO: 397231 - DNA, 25 bp, Mus musculus
tttcctacattgtcttgctgagtat

SEQ ID NO: 397232 - DNA, 25 bp, Mus musculus
tttcctactggctggacccatgaga

SEQ ID NO: 397233 - DNA, 25 bp, Mus musculus
tttcctagaagggaggtggtgtggt

SEQ ID NO: 397234 - DNA, 25 bp, Mus musculus
tttcctagctgggctatggagttac

SEQ ID NO: 397235 - DNA, 25 bp, Mus musculus
tttcctaggacagggcttcgcctct

SEQ ID NO: 397236 - DNA, 25 bp, Mus musculus
tttcctataatgttgtgatgacgac

SEQ ID NO: 397237 - DNA, 25 bp, Mus musculus
tttcctatcctggtgctactaaaat

SEQ ID NO: 397238 - DNA, 25 bp, Mus musculus
tttcctcagccccagtttgacggat

SEQ ID NO: 397239 - DNA, 25 bp, Mus musculus
tttcctcatggctgtgacattgagg

SEQ ID NO: 397240 - DNA, 25 bp, Mus musculus
tttcctccaaagatccattactaat

SEQ ID NO: 397241 - DNA, 25 bp, Mus musculus
tttcctccaaaggagctctcaagtg

SEQ ID NO: 397242 - DNA, 25 bp, Mus musculus
tttcctccaacaaatgcagaacccc

SEQ ID NO: 397243 - DNA, 25 bp, Mus musculus
tttcctcccaagattcccgtggggc

SEQ ID NO: 397244 - DNA, 25 bp, Mus musculus
tttcctccctatctgagctcttccc

SEQ ID NO: 397245 - DNA, 25 bp, Mus musculus
tttcctccctgagaatgaggtgtat

SEQ ID NO: 397246 - DNA, 25 bp, Mus musculus
tttcctcctaaagaacagagcctgg

SEQ ID NO: 397247 - DNA, 25 bp, Mus musculus
tttcctcctaaagccgagcgccagc

SEQ ID NO: 397248 - DNA, 25 bp, Mus musculus
tttcctcctacaacacggtagagga

SEQ ID NO: 397249 - DNA, 25 bp, Mus musculus
tttcctcctacattgagcagacacg

SEQ ID NO: 397250 - DNA, 25 bp, Mus musculus
tttcctcctgccagacttggcagcc

SEQ ID NO: 397251 - DNA, 25 bp, Mus musculus
tttcctcctgccaggttttttcctt

SEQ ID NO: 397252 - DNA, 25 bp, Mus musculus
tttcctctacagacagaccctgctc

SEQ ID NO: 397253 - DNA, 25 bp, Mus musculus
tttcctctacaggggacctggctga

SEQ ID NO: 397254 - DNA, 25 bp, Mus musculus
tttcctctagacacctttctctccc

SEQ ID NO: 397255 - DNA, 25 bp, Mus musculus
tttcctctccaagcttttcatccta

SEQ ID NO: 397256 - DNA, 25 bp, Mus musculus
tttcctctccacccatctgctggca

SEQ ID NO: 397257 - DNA, 25 bp, Mus musculus
tttcctctctgacttcctctttgcc

SEQ ID NO: 397258 - DNA, 25 bp, Mus musculus
tttcctgaaagctttggatagatca

SEQ ID NO: 397259 - DNA, 25 bp, Mus musculus
tttcctgaaagttaaatcggagatc

SEQ ID NO: 397260 - DNA, 25 bp, Mus musculus
tttcctgaagataggacgggagaaa

SEQ ID NO: 397261 - DNA, 25 bp, Mus musculus
tttcctgaaggaggtactgtctgag

SEQ ID NO: 397262 - DNA, 25 bp, Mus musculus
tttcctgaggctgtaagcaatggct

SEQ ID NO: 397263 - DNA, 25 bp, Mus musculus
tttcctgatcagggctccagtggtc

SEQ ID NO: 397264 - DNA, 25 bp, Mus musculus
tttcctgatcaggtaatgtatgtgg

SEQ ID NO: 397265 - DNA, 25 bp, Mus musculus
tttcctgcaagcatttgacattgtg

SEQ ID NO: 397266 - DNA, 25 bp, Mus musculus
tttcctgcagctatccttcggggcc

SEQ ID NO: 397267 - DNA, 25 bp, Mus musculus
tttcctgcagtatcaggagtgcgac

SEQ ID NO: 397268 - DNA, 25 bp, Mus musculus
tttcctgcctcccaaggttgttaaa

SEQ ID NO: 397269 - DNA, 25 bp, Mus musculus
tttcctgcctgacctggagctgcag

SEQ ID NO: 397270 - DNA, 25 bp, Mus musculus
tttcctgctcccaagcccttggaca

SEQ ID NO: 397271 - DNA, 25 bp, Mus musculus
tttcctgctgacaagccgatacacc

SEQ ID NO: 397272 - DNA, 25 bp, Mus musculus
tttcctggaaaattgttgtgtctgt

SEQ ID NO: 397273 - DNA, 25 bp, Mus musculus
tttcctggaacaggtgacatgtatg

SEQ ID NO: 397274 - DNA, 25 bp, Mus musculus
tttcctggagacaagtagtctttta

SEQ ID NO: 397275 - DNA, 25 bp, Mus musculus
tttcctggcacagaaacatcatcca

SEQ ID NO: 397276 - DNA, 25 bp, Mus musculus
tttcctggcacagcaagcttccctg

SEQ ID NO: 397277 - DNA, 25 bp, Mus musculus
tttcctggcagcactgtccatccaa

SEQ ID NO: 397278 - DNA, 25 bp, Mus musculus
tttcctggcagcctcgggatggatg

SEQ ID NO: 397279 - DNA, 25 bp, Mus musculus
tttcctggcgagcggatctacgaag

SEQ ID NO: 397280 - DNA, 25 bp, Mus musculus
tttcctggctgaggtactttctgaa

SEQ ID NO: 397281 - DNA, 25 bp, Mus musculus
tttcctgggagaaacactcatcatt

SEQ ID NO: 397282 - DNA, 25 bp, Mus musculus
tttcctgggcacagaccgcgggaca

SEQ ID NO: 397283 - DNA, 25 bp, Mus musculus
tttcctgggcagactcagccatggt

SEQ ID NO: 397284 - DNA, 25 bp, Mus musculus
tttcctggggatgggagtgagtgct

SEQ ID NO: 397285 - DNA, 25 bp, Mus musculus
tttcctggtgtaaagggagatcgag

SEQ ID NO: 397286 - DNA, 25 bp, Mus musculus
tttcctgtgaaccgatttaaaggaa

SEQ ID NO: 397287 - DNA, 25 bp, Mus musculus
tttcctgtgtcccgtgtcacaatgg

SEQ ID NO: 397288 - DNA, 25 bp, Mus musculus
tttcctgttcagggagaggcggtga

SEQ ID NO: 397289 - DNA, 25 bp, Mus musculus
tttcctgttcaggtccgcgaatacc

SEQ ID NO: 397290 - DNA, 25 bp, Mus musculus
tttcctgttcggaacctggacttga

SEQ ID NO: 397291 - DNA, 25 bp, Mus musculus
tttcctgttctgcatctcaccagcc

SEQ ID NO: 397292 - DNA, 25 bp, Mus musculus
tttccttaacctgggatcgcttaca

SEQ ID NO: 397293 - DNA, 25 bp, Mus musculus
tttccttatttctgtgacagctata

SEQ ID NO: 397294 - DNA, 25 bp, Mus musculus
tttccttcggacgctgaacccaaag

SEQ ID NO: 397295 - DNA, 25 bp, Mus musculus
tttccttctgtggagcggatgtggg

SEQ ID NO: 397296 - DNA, 25 bp, Mus musculus
tttccttgcagatatactgctgttc

SEQ ID NO: 397297 - DNA, 25 bp, Mus musculus
tttccttgcaggtccattcacacag

SEQ ID NO: 397298 - DNA, 25 bp, Mus musculus
tttccttgtcaaacccaacagttcc

SEQ ID NO: 397299 - DNA, 25 bp, Mus musculus
tttccttgtcaacaatcaagatgac

SEQ ID NO: 397300 - DNA, 25 bp, Mus musculus
tttccttgtggaggtcttccaagtt

SEQ ID NO: 397301 - DNA, 25 bp, Mus musculus
tttcctttatagaggacaaggaata

SEQ ID NO: 397302 - DNA, 25 bp, Mus musculus
tttcctttcaggatggcctcaggca

SEQ ID NO: 397303 - DNA, 25 bp, Mus musculus
tttcctttcaggcaagtacattgcc

SEQ ID NO: 397304 - DNA, 25 bp, Mus musculus
tttcctttcaggcctcagggctggc

SEQ ID NO: 397305 - DNA, 25 bp, Mus musculus
tttcctttgactgtggcagccacag

SEQ ID NO: 397306 - DNA, 25 bp, Mus musculus
tttcctttgaggaaatggatccacc

SEQ ID NO: 397307 - DNA, 25 bp, Mus musculus
tttcctttgagtccatcagcagtgt

SEQ ID NO: 397308 - DNA, 25 bp, Mus musculus
tttcctttggaaaagttgctgtggt

SEQ ID NO: 397309 - DNA, 25 bp, Mus musculus
tttcctttgggtattcccatctgtc

SEQ ID NO: 397310 - DNA, 25 bp, Mus musculus
tttccttttctgaaggtgtagaagc

SEQ ID NO: 397311 - DNA, 25 bp, Mus musculus
tttcgaaagaaagatcttcctcaga

SEQ ID NO: 397312 - DNA, 25 bp, Mus musculus
tttcgaaagaaagctgattcaagca

SEQ ID NO: 397313 - DNA, 25 bp, Mus musculus
tttcgaactacttaaagaaagatca

SEQ ID NO: 397314 - DNA, 25 bp, Mus musculus
tttcgacacgccggagtctgagggt

SEQ ID NO: 397315 - DNA, 25 bp, Mus musculus
tttcgacagtgcgaaaattttgcca

SEQ ID NO: 397316 - DNA, 25 bp, Mus musculus
tttcgaccaggaaaaaatcctgcta

SEQ ID NO: 397317 - DNA, 25 bp, Mus musculus
tttcgaccagttaccttactctggt

SEQ ID NO: 397318 - DNA, 25 bp, Mus musculus
tttcgacccgaggactatctccagt

SEQ ID NO: 397319 - DNA, 25 bp, Mus musculus
tttcgacctcacaaggtgactggac

SEQ ID NO: 397320 - DNA, 25 bp, Mus musculus
tttcgacctcacaagtgcacgatct

SEQ ID NO: 397321 - DNA, 25 bp, Mus musculus
tttcgacctgcagctttcctgcctg

SEQ ID NO: 397322 - DNA, 25 bp, Mus musculus
tttcgacctgcagggattgctgatg

SEQ ID NO: 397323 - DNA, 25 bp, Mus musculus
tttcgagctattttggattactata

SEQ ID NO: 397324 - DNA, 25 bp, Mus musculus
tttcgagctgaagggaagtgaccaa

SEQ ID NO: 397325 - DNA, 25 bp, Mus musculus
tttcgagctgaagggctctcctgct

SEQ ID NO: 397326 - DNA, 25 bp, Mus musculus
tttcgagctggggttattcccaatt

SEQ ID NO: 397327 - DNA, 25 bp, Mus musculus
tttcgaggggagggagacgatggac

SEQ ID NO: 397328 - DNA, 25 bp, Mus musculus
tttcgataatttcaatgtccttggc

SEQ ID NO: 397329 - DNA, 25 bp, Mus musculus
tttcgatgacgattgtggtgggttg

SEQ ID NO: 397330 - DNA, 25 bp, Mus musculus
tttcgatgagatggcggatccagac

SEQ ID NO: 397331 - DNA, 25 bp, Mus musculus
tttcgatgaggctgaattgcatcat

SEQ ID NO: 397332 - DNA, 25 bp, Mus musculus
tttcgatttgcgatcttctgcctat

SEQ ID NO: 397333 - DNA, 25 bp, Mus musculus
tttcgatttgctttgtccatacgtt

SEQ ID NO: 397334 - DNA, 25 bp, Mus musculus
tttcgcaagaaatgggaaccccaac

SEQ ID NO: 397335 - DNA, 25 bp, Mus musculus
tttcgcagagcttcctctctctggc

SEQ ID NO: 397336 - DNA, 25 bp, Mus musculus
tttcgcccaagaaggtggagtttgt

SEQ ID NO: 397337 - DNA, 25 bp, Mus musculus
tttcgccgccatggagtcctccacc

SEQ ID NO: 397338 - DNA, 25 bp, Mus musculus
tttcgcctacaggcatataccagcg

SEQ ID NO: 397339 - DNA, 25 bp, Mus musculus
tttcgctgaagagcatccgtgcagc

SEQ ID NO: 397340 - DNA, 25 bp, Mus musculus
tttcgcttgcaggcctacagggtgg

SEQ ID NO: 397341 - DNA, 25 bp, Mus musculus
tttcgcttgtggggaatgtttttga

SEQ ID NO: 397342 - DNA, 25 bp, Mus musculus
tttcggaagaggagggagaatcccg

SEQ ID NO: 397343 - DNA, 25 bp, Mus musculus
tttcggaaggagctgactggccaat

SEQ ID NO: 397344 - DNA, 25 bp, Mus musculus
tttcggaggccgatggcaccaccgg

SEQ ID NO: 397345 - DNA, 25 bp, Mus musculus
tttcggatccaggacctgctgtcct

SEQ ID NO: 397346 - DNA, 25 bp, Mus musculus
tttcggatttggagatataaccaag

SEQ ID NO: 397347 - DNA, 25 bp, Mus musculus
tttcggcaaggatgagccccaagaa

SEQ ID NO: 397348 - DNA, 25 bp, Mus musculus
tttcggcaagggcgtctactgggct

SEQ ID NO: 397349 - DNA, 25 bp, Mus musculus
tttcggccggacgctagcagaatct

SEQ ID NO: 397350 - DNA, 25 bp, Mus musculus
tttcggccggacgggaagcttagat

SEQ ID NO: 397351 - DNA, 25 bp, Mus musculus
tttcggcgtggttgagaacaaaaag

SEQ ID NO: 397352 - DNA, 25 bp, Mus musculus
tttcggctaagaaccaaaaatcaca

SEQ ID NO: 397353 - DNA, 25 bp, Mus musculus
tttcggctcagactcgcatgtgtgg

SEQ ID NO: 397354 - DNA, 25 bp, Mus musculus
tttcggctcagggaagtgactttca

SEQ ID NO: 397355 - DNA, 25 bp, Mus musculus
tttcggctctgcggggcgcctctga

SEQ ID NO: 397356 - DNA, 25 bp, Mus musculus
tttcgggcagctccccctctacctg

SEQ ID NO: 397357 - DNA, 25 bp, Mus musculus
tttcgggcatgagccaaagcctgcg

SEQ ID NO: 397358 - DNA, 25 bp, Mus musculus
tttcgggtccccggctacagcaagt

SEQ ID NO: 397359 - DNA, 25 bp, Mus musculus
tttcggtccaagaggtcctccagga

SEQ ID NO: 397360 - DNA, 25 bp, Mus musculus
tttcggtgacagggcggctactaag

SEQ ID NO: 397361 - DNA, 25 bp, Mus musculus
tttcgtatacaaggaattttctcga

SEQ ID NO: 397362 - DNA, 25 bp, Mus musculus
tttcgtatacaagttccctctagga

SEQ ID NO: 397363 - DNA, 25 bp, Mus musculus
tttcgtcaagatcaaggtcaccaag

SEQ ID NO: 397364 - DNA, 25 bp, Mus musculus
tttcgtcaaggtcaccaaggctggg

SEQ ID NO: 397365 - DNA, 25 bp, Mus musculus
tttcgtcagtgtggtgatttacaaa

SEQ ID NO: 397366 - DNA, 25 bp, Mus musculus
tttcgtcatgagatcaaggacacct

SEQ ID NO: 397367 - DNA, 25 bp, Mus musculus
tttcgtcttctggctggctggaggc

SEQ ID NO: 397368 - DNA, 25 bp, Mus musculus
tttcgtgaaggatgttttatttccg

SEQ ID NO: 397369 - DNA, 25 bp, Mus musculus
tttcgtgagtggaagaatcctcggc

SEQ ID NO: 397370 - DNA, 25 bp, Mus musculus
tttcgtgagtggaaggcgagaactc

SEQ ID NO: 397371 - DNA, 25 bp, Mus musculus
tttcgtgagtggaaggggattttac

SEQ ID NO: 397372 - DNA, 25 bp, Mus musculus
tttcgtgcacagcaaaactctttgg

SEQ ID NO: 397373 - DNA, 25 bp, Mus musculus
tttcgtgcacatttttgcagcctgt

SEQ ID NO: 397374 - DNA, 25 bp, Mus musculus
tttcgttctgtgatgccagcagagg

SEQ ID NO: 397375 - DNA, 25 bp, Mus musculus
tttcgttttctctagatccatttgg

SEQ ID NO: 397376 - DNA, 25 bp, Mus musculus
tttctaaacaggatttggtgagctt

SEQ ID NO: 397377 - DNA, 25 bp, Mus musculus
tttctaaacagggaacagcagtgca

SEQ ID NO: 397378 - DNA, 25 bp, Mus musculus
tttctaaactacatgagcgatgtcg

SEQ ID NO: 397379 - DNA, 25 bp, Mus musculus
tttctaaagagaaaccatgaagtga

SEQ ID NO: 397380 - DNA, 25 bp, Mus musculus
tttctaaatgaacttcagtaacttg

SEQ ID NO: 397381 - DNA, 25 bp, Mus musculus
tttctaaattaaagactgagtgtgg

SEQ ID NO: 397382 - DNA, 25 bp, Mus musculus
tttctaacagagaagaatatcaaga

SEQ ID NO: 397383 - DNA, 25 bp, Mus musculus
tttctaacagctcaagatggtgagg

SEQ ID NO: 397384 - DNA, 25 bp, Mus musculus
tttctaacaggtctggattttactg

SEQ ID NO: 397385 - DNA, 25 bp, Mus musculus
tttctaacctggagaatgccctgga

SEQ ID NO: 397386 - DNA, 25 bp, Mus musculus
tttctaactgggttatgggtgctac

SEQ ID NO: 397387 - DNA, 25 bp, Mus musculus
tttctaactggtagtgtgaggaaac

SEQ ID NO: 397388 - DNA, 25 bp, Mus musculus
tttctaagcaggctgaggtctctag

SEQ ID NO: 397389 - DNA, 25 bp, Mus musculus
tttctaaggattcaggctaaaaccg

SEQ ID NO: 397390 - DNA, 25 bp, Mus musculus
tttctaagtcgcaggtagaatggat

SEQ ID NO: 397391 - DNA, 25 bp, Mus musculus
tttctaatagcagcgtccccatgga

SEQ ID NO: 397392 - DNA, 25 bp, Mus musculus
tttctaatgggggtcctgctccaga

SEQ ID NO: 397393 - DNA, 25 bp, Mus musculus
tttctacaaaagattgatgtatcct

SEQ ID NO: 397394 - DNA, 25 bp, Mus musculus
tttctacaaaaggtacacaataaaa

SEQ ID NO: 397395 - DNA, 25 bp, Mus musculus
tttctacaacaggccattctttgcc

SEQ ID NO: 397396 - DNA, 25 bp, Mus musculus
tttctacaacagggcatccgtccct

SEQ ID NO: 397397 - DNA, 25 bp, Mus musculus
tttctacaagactatggcgacaagc

SEQ ID NO: 397398 - DNA, 25 bp, Mus musculus
tttctacaaggtcatggaggccttc

SEQ ID NO: 397399 - DNA, 25 bp, Mus musculus
tttctacaaggtcattcccaaaagc

SEQ ID NO: 397400 - DNA, 25 bp, Mus musculus
tttctacaagtctcgcctgctgctg

SEQ ID NO: 397401 - DNA, 25 bp, Mus musculus
tttctacaggccaactgccaatttg

SEQ ID NO: 397402 - DNA, 25 bp, Mus musculus
tttctacatggtctcttcatgggga

SEQ ID NO: 397403 - DNA, 25 bp, Mus musculus
tttctaccagcaaggttggccccta

SEQ ID NO: 397404 - DNA, 25 bp, Mus musculus
tttctacccagaggaagaatttgag

SEQ ID NO: 397405 - DNA, 25 bp, Mus musculus
tttctactcaggaactgctgaagaa

SEQ ID NO: 397406 - DNA, 25 bp, Mus musculus
tttctactctggtgaccatagctga

SEQ ID NO: 397407 - DNA, 25 bp, Mus musculus
tttctactctgtctgaagaagagct

SEQ ID NO: 397408 - DNA, 25 bp, Mus musculus
tttctactgaaggcttccaaaggaa

SEQ ID NO: 397409 - DNA, 25 bp, Mus musculus
tttctactttctgctttcatctccg

SEQ ID NO: 397410 - DNA, 25 bp, Mus musculus
tttctagaagatcattgcaacgatg

SEQ ID NO: 397411 - DNA, 25 bp, Mus musculus
tttctagacttcggatccagcaatg

SEQ ID NO: 397412 - DNA, 25 bp, Mus musculus
tttctagatgatatggagagcacca

SEQ ID NO: 397413 - DNA, 25 bp, Mus musculus
tttctagatgatatggcccactatg

SEQ ID NO: 397414 - DNA, 25 bp, Mus musculus
tttctagcacttgtgcttccaatag

SEQ ID NO: 397415 - DNA, 25 bp, Mus musculus
tttctagcatcaaagatcttcagga

SEQ ID NO: 397416 - DNA, 25 bp, Mus musculus
tttctagcatcaaaggccagaaaca

SEQ ID NO: 397417 - DNA, 25 bp, Mus musculus
tttctagtgactggggaattgatgt

SEQ ID NO: 397418 - DNA, 25 bp, Mus musculus
tttctatatcccttgcattccatat

SEQ ID NO: 397419 - DNA, 25 bp, Mus musculus
tttctatccccaaacaggagactta

SEQ ID NO: 397420 - DNA, 25 bp, Mus musculus
tttctatcggcatggtttgctaggt

SEQ ID NO: 397421 - DNA, 25 bp, Mus musculus
tttctatgccgatcaaaaggaaaac

SEQ ID NO: 397422 - DNA, 25 bp, Mus musculus
tttctatgtggaaaggaaaatagaa

SEQ ID NO: 397423 - DNA, 25 bp, Mus musculus
tttctattgaaaccatagacagaag

SEQ ID NO: 397424 - DNA, 25 bp, Mus musculus
tttctattgaaatctcacaggcctt

SEQ ID NO: 397425 - DNA, 25 bp, Mus musculus
tttctattgaaggtgttgttgctga

SEQ ID NO: 397426 - DNA, 25 bp, Mus musculus
tttctattgaatacaggctagtccc

SEQ ID NO: 397427 - DNA, 25 bp, Mus musculus
tttctcaaagcccaggagaagcgcc

SEQ ID NO: 397428 - DNA, 25 bp, Mus musculus
tttctcaaattaaatccaagttaat

SEQ ID NO: 397429 - DNA, 25 bp, Mus musculus
tttctcaatttcaagtcagaagaca

SEQ ID NO: 397430 - DNA, 25 bp, Mus musculus
tttctcacagcatggtctgagacgg

SEQ ID NO: 397431 - DNA, 25 bp, Mus musculus
tttctcacccccagcccagccaagc

SEQ ID NO: 397432 - DNA, 25 bp, Mus musculus
tttctcacccccagctccaaccctc

SEQ ID NO: 397433 - DNA, 25 bp, Mus musculus
tttctcacgaaaagatcctgagcaa

SEQ ID NO: 397434 - DNA, 25 bp, Mus musculus
tttctcacggaaacctaggcaggtg

SEQ ID NO: 397435 - DNA, 25 bp, Mus musculus
tttctcacgggcacatctcatcatc

SEQ ID NO: 397436 - DNA, 25 bp, Mus musculus
tttctcactcaaggtggcgtgattg

SEQ ID NO: 397437 - DNA, 25 bp, Mus musculus
tttctcagacaaatgtcagtgagat

SEQ ID NO: 397438 - DNA, 25 bp, Mus musculus
tttctcaggacagcatcccagcctt

SEQ ID NO: 397439 - DNA, 25 bp, Mus musculus
tttctcaggagaaccagacttggga

SEQ ID NO: 397440 - DNA, 25 bp, Mus musculus
tttctcagtcagggtgacaagggag

SEQ ID NO: 397441 - DNA, 25 bp, Mus musculus
tttctcagtgctgatgcagatgcgc

SEQ ID NO: 397442 - DNA, 25 bp, Mus musculus
tttctcagtgctgatgcgcttcgac

SEQ ID NO: 397443 - DNA, 25 bp, Mus musculus
tttctcataggtggaattgggctta

SEQ ID NO: 397444 - DNA, 25 bp, Mus musculus
tttctcatgaagccattgatcttat

SEQ ID NO: 397445 - DNA, 25 bp, Mus musculus
tttctcattaaggtaaatgaccgtc

SEQ ID NO: 397446 - DNA, 25 bp, Mus musculus
tttctccaagatggcctagactgct

SEQ ID NO: 397447 - DNA, 25 bp, Mus musculus
tttctccaaggtggcctagactgct

SEQ ID NO: 397448 - DNA, 25 bp, Mus musculus
tttctccaccaggacatggatttga

SEQ ID NO: 397449 - DNA, 25 bp, Mus musculus
tttctccagaaggtcgcttatacca

SEQ ID NO: 397450 - DNA, 25 bp, Mus musculus
tttctccagacctggctgcccagac

SEQ ID NO: 397451 - DNA, 25 bp, Mus musculus
tttctccagagcaccgcctcctggc

SEQ ID NO: 397452 - DNA, 25 bp, Mus musculus
tttctccagatgacttcttgggtcg

SEQ ID NO: 397453 - DNA, 25 bp, Mus musculus
tttctccagttccaggaagtcgttc

SEQ ID NO: 397454 - DNA, 25 bp, Mus musculus
tttctccagttccagtaagtgcaat

SEQ ID NO: 397455 - DNA, 25 bp, Mus musculus
tttctccatcaaaccccggcagccc

SEQ ID NO: 397456 - DNA, 25 bp, Mus musculus
tttctcccaccagatacccataata

SEQ ID NO: 397457 - DNA, 25 bp, Mus musculus
tttctcccaccaggctcaatattgt

SEQ ID NO: 397458 - DNA, 25 bp, Mus musculus
tttctcccagagcctggcaccccca

SEQ ID NO: 397459 - DNA, 25 bp, Mus musculus
tttctcccagaggcaaaatctcatc

SEQ ID NO: 397460 - DNA, 25 bp, Mus musculus
tttctcccaggtgctcaccattgct

SEQ ID NO: 397461 - DNA, 25 bp, Mus musculus
tttctccctcaccttgttttctgct

SEQ ID NO: 397462 - DNA, 25 bp, Mus musculus
tttctccctggaaggtggaacctag

SEQ ID NO: 397463 - DNA, 25 bp, Mus musculus
tttctcctacaaattgctaataatc

SEQ ID NO: 397464 - DNA, 25 bp, Mus musculus
tttctcctatggctgtcttcagaca

SEQ ID NO: 397465 - DNA, 25 bp, Mus musculus
tttctcctatgggtatggccgaata

SEQ ID NO: 397466 - DNA, 25 bp, Mus musculus
tttctcctgatatctaatagcattc

SEQ ID NO: 397467 - DNA, 25 bp, Mus musculus
tttctcctggaggttccaactatgg

SEQ ID NO: 397468 - DNA, 25 bp, Mus musculus
tttctcctgggctgcaagcccagcg

SEQ ID NO: 397469 - DNA, 25 bp, Mus musculus
tttctcgacctttgaatgatagaga

SEQ ID NO: 397470 - DNA, 25 bp, Mus musculus
tttctcgcagagtgttcctgacttc

SEQ ID NO: 397471 - DNA, 25 bp, Mus musculus
tttctcgcagatatattaccaaaga

SEQ ID NO: 397472 - DNA, 25 bp, Mus musculus
tttctcgctggaaggctctacagag

SEQ ID NO: 397473 - DNA, 25 bp, Mus musculus
tttctcggaggaagcaccactgccg

SEQ ID NO: 397474 - DNA, 25 bp, Mus musculus
tttctcgttcagaatgtcataccca

SEQ ID NO: 397475 - DNA, 25 bp, Mus musculus
tttctctacacaggaaatccacctt

SEQ ID NO: 397476 - DNA, 25 bp, Mus musculus
tttctctacacaggctgacaagaaa

SEQ ID NO: 397477 - DNA, 25 bp, Mus musculus
tttctctaccaggtctgtcacctaa

SEQ ID NO: 397478 - DNA, 25 bp, Mus musculus
tttctctagatagggtgagcgtgga

SEQ ID NO: 397479 - DNA, 25 bp, Mus musculus
tttctctagatttcaccaacgtatt

SEQ ID NO: 397480 - DNA, 25 bp, Mus musculus
tttctctagcttttcctatgatgac

SEQ ID NO: 397481 - DNA, 25 bp, Mus musculus
tttctctcagcagattccaaaggct

SEQ ID NO: 397482 - DNA, 25 bp, Mus musculus
tttctctcagcaggccttgagcctc

SEQ ID NO: 397483 - DNA, 25 bp, Mus musculus
tttctctcagccaaagccttctact

SEQ ID NO: 397484 - DNA, 25 bp, Mus musculus
tttctctctccagcgcctgtattat

SEQ ID NO: 397485 - DNA, 25 bp, Mus musculus
tttctctctccagggagtgttcctg

SEQ ID NO: 397486 - DNA, 25 bp, Mus musculus
tttctctctggcagggatggaagac

SEQ ID NO: 397487 - DNA, 25 bp, Mus musculus
tttctctgaccctgaatcgtccttg

SEQ ID NO: 397488 - DNA, 25 bp, Mus musculus
tttctctgcagtcaatcgcaggcca

SEQ ID NO: 397489 - DNA, 25 bp, Mus musculus
tttctctgcgcagatgttgatgagt

SEQ ID NO: 397490 - DNA, 25 bp, Mus musculus
tttctctgcgccaggtatcagagca

SEQ ID NO: 397491 - DNA, 25 bp, Mus musculus
tttctctgcgcctggtatcagagca

SEQ ID NO: 397492 - DNA, 25 bp, Mus musculus
tttctctgctacctgaattttgtgc

SEQ ID NO: 397493 - DNA, 25 bp, Mus musculus
tttctctggccacaggaaatcgaga

SEQ ID NO: 397494 - DNA, 25 bp, Mus musculus
tttctctggccacgggaaatcgaga

SEQ ID NO: 397495 - DNA, 25 bp, Mus musculus
tttctctggccctgtatccctggag

SEQ ID NO: 397496 - DNA, 25 bp, Mus musculus
tttctctgtctcggggaaaggttgg

SEQ ID NO: 397497 - DNA, 25 bp, Mus musculus
tttctctgtctcggggtgacaatag

SEQ ID NO: 397498 - DNA, 25 bp, Mus musculus
tttctcttgagactcgttactgggc

SEQ ID NO: 397499 - DNA, 25 bp, Mus musculus
tttctcttgagggtaacaagaagaa

SEQ ID NO: 397500 - DNA, 25 bp, Mus musculus
tttctcttgtgatgaggagactgac

SEQ ID NO: 397501 - DNA, 25 bp, Mus musculus
tttctcttgtgctgccacaggtgac

SEQ ID NO: 397502 - DNA, 25 bp, Mus musculus
tttctgaaacagcctcaaggagaag

SEQ ID NO: 397503 - DNA, 25 bp, Mus musculus
tttctgaaaggccagtgaatgtcct

SEQ ID NO: 397504 - DNA, 25 bp, Mus musculus
tttctgaacctagtctctgtccaga

SEQ ID NO: 397505 - DNA, 25 bp, Mus musculus
tttctgaagagacttgcctttcatc

SEQ ID NO: 397506 - DNA, 25 bp, Mus musculus
tttctgaagagatacaaggggactt

SEQ ID NO: 397507 - DNA, 25 bp, Mus musculus
tttctgaagaggcttatccatgact

SEQ ID NO: 397508 - DNA, 25 bp, Mus musculus
tttctgaaggcactggcactacaag

SEQ ID NO: 397509 - DNA, 25 bp, Mus musculus
tttctgaaggggcttgtcaatgagg

SEQ ID NO: 397510 - DNA, 25 bp, Mus musculus
tttctgaatcacggagtcaaagtgg

SEQ ID NO: 397511 - DNA, 25 bp, Mus musculus
tttctgaatcacgtgtcgagtgtcc

SEQ ID NO: 397512 - DNA, 25 bp, Mus musculus
tttctgaattgaggattaagcttgc

SEQ ID NO: 397513 - DNA, 25 bp, Mus musculus
tttctgacaggtaaccaatggagtt

SEQ ID NO: 397514 - DNA, 25 bp, Mus musculus
tttctgacatggaggaaatgctgtc

SEQ ID NO: 397515 - DNA, 25 bp, Mus musculus
tttctgaccaacagaacatacaaca

SEQ ID NO: 397516 - DNA, 25 bp, Mus musculus
tttctgagagaaactgcaagaaaaa

SEQ ID NO: 397517 - DNA, 25 bp, Mus musculus
tttctgagagaacatgaacaaaaag

SEQ ID NO: 397518 - DNA, 25 bp, Mus musculus
tttctgagctgagaggcaaacccgt

SEQ ID NO: 397519 - DNA, 25 bp, Mus musculus
tttctgaggagggtgtaaaagaaga

SEQ ID NO: 397520 - DNA, 25 bp, Mus musculus
tttctgaggccatgagttccgactc

SEQ ID NO: 397521 - DNA, 25 bp, Mus musculus
tttctgagggagacttcctgagcga

SEQ ID NO: 397522 - DNA, 25 bp, Mus musculus
tttctgataggcttggtgaatcaca

SEQ ID NO: 397523 - DNA, 25 bp, Mus musculus
tttctgatcaggtgttgtttgtggc

SEQ ID NO: 397524 - DNA, 25 bp, Mus musculus
tttctgatctccatgatggtggcca

SEQ ID NO: 397525 - DNA, 25 bp, Mus musculus
tttctgatgacactggctgcggctg

SEQ ID NO: 397526 - DNA, 25 bp, Mus musculus
tttctgattatagggtcctgctgat

SEQ ID NO: 397527 - DNA, 25 bp, Mus musculus
tttctgatttcgaggggacccagcc

SEQ ID NO: 397528 - DNA, 25 bp, Mus musculus
tttctgcaaagagccgtctagacaa

SEQ ID NO: 397529 - DNA, 25 bp, Mus musculus
tttctgcaagatgaacgagaccgtg

SEQ ID NO: 397530 - DNA, 25 bp, Mus musculus
tttctgcagacttgtactggtttcc

SEQ ID NO: 397531 - DNA, 25 bp, Mus musculus
tttctgcaggctcagcaaatgacaa

SEQ ID NO: 397532 - DNA, 25 bp, Mus musculus
tttctgcatctgaacaccgacctta

SEQ ID NO: 397533 - DNA, 25 bp, Mus musculus
tttctgcatgaggcttggatctagc

SEQ ID NO: 397534 - DNA, 25 bp, Mus musculus
tttctgccaaagttgctcaccaagg

SEQ ID NO: 397535 - DNA, 25 bp, Mus musculus
tttctgccagattcaagaacctggc

SEQ ID NO: 397536 - DNA, 25 bp, Mus musculus
tttctgccagcgggtccggagtggt

SEQ ID NO: 397537 - DNA, 25 bp, Mus musculus
tttctgccagggacatgaaatggcc

SEQ ID NO: 397538 - DNA, 25 bp, Mus musculus
tttctgcctccaggagaaggtcctt

SEQ ID NO: 397539 - DNA, 25 bp, Mus musculus
tttctgcctgaggaggattcagaat

SEQ ID NO: 397540 - DNA, 25 bp, Mus musculus
tttctgctccagcaaggtgcagagc

SEQ ID NO: 397541 - DNA, 25 bp, Mus musculus
tttctgctctgaaggaaagagatgt

SEQ ID NO: 397542 - DNA, 25 bp, Mus musculus
tttctgctctgcatggtgacatgga

SEQ ID NO: 397543 - DNA, 25 bp, Mus musculus
tttctgctctggcccgtgggattga

SEQ ID NO: 397544 - DNA, 25 bp, Mus musculus
tttctgctgtatttcccacaggttt

SEQ ID NO: 397545 - DNA, 25 bp, Mus musculus
tttctgctgtatttctcacagatct

SEQ ID NO: 397546 - DNA, 25 bp, Mus musculus
tttctgcttgatgtcctagaagacc

SEQ ID NO: 397547 - DNA, 25 bp, Mus musculus
tttctgctttcaggttctcagaagc

SEQ ID NO: 397548 - DNA, 25 bp, Mus musculus
tttctgctttcaggttctgcagcat

SEQ ID NO: 397549 - DNA, 25 bp, Mus musculus
tttctgctttcaggttgggagaaac

SEQ ID NO: 397550 - DNA, 25 bp, Mus musculus
tttctgcttttgtctgctgcccatc

SEQ ID NO: 397551 - DNA, 25 bp, Mus musculus
tttctggaaagaatatccagttatg

SEQ ID NO: 397552 - DNA, 25 bp, Mus musculus
tttctggaaagtgagttacatgaac

SEQ ID NO: 397553 - DNA, 25 bp, Mus musculus
tttctggaagctttgcaaaaaggta

SEQ ID NO: 397554 - DNA, 25 bp, Mus musculus
tttctggaatgacagatcagctcga

SEQ ID NO: 397555 - DNA, 25 bp, Mus musculus
tttctggaattacagggatcgctta

SEQ ID NO: 397556 - DNA, 25 bp, Mus musculus
tttctggacaaggtcagtcctcccg

SEQ ID NO: 397557 - DNA, 25 bp, Mus musculus
tttctggacctggctgcaggtcctg

SEQ ID NO: 397558 - DNA, 25 bp, Mus musculus
tttctggataagagtgcctcgggcc

SEQ ID NO: 397559 - DNA, 25 bp, Mus musculus
tttctggataagcccacctggaagc

SEQ ID NO: 397560 - DNA, 25 bp, Mus musculus
tttctggataaggtgcttctgtgtg

SEQ ID NO: 397561 - DNA, 25 bp, Mus musculus
tttctggatgactctgctcactgga

SEQ ID NO: 397562 - DNA, 25 bp, Mus musculus
tttctggatgagaattggcaaggtt

SEQ ID NO: 397563 - DNA, 25 bp, Mus musculus
tttctggcaaaagatgcttgcattg

SEQ ID NO: 397564 - DNA, 25 bp, Mus musculus
tttctggcagagaacgaatcttgga

SEQ ID NO: 397565 - DNA, 25 bp, Mus musculus
tttctggcattgatggtttgtcttc

SEQ ID NO: 397566 - DNA, 25 bp, Mus musculus
tttctggcattggatctactgctga

SEQ ID NO: 397567 - DNA, 25 bp, Mus musculus
tttctggcgaatgggaaagggccaa

SEQ ID NO: 397568 - DNA, 25 bp, Mus musculus
tttctgggcaaggagcacttcaatt

SEQ ID NO: 397569 - DNA, 25 bp, Mus musculus
tttctgggctaagacctccagtcag

SEQ ID NO: 397570 - DNA, 25 bp, Mus musculus
tttctggggttgcctaggtgaggca

SEQ ID NO: 397571 - DNA, 25 bp, Mus musculus
tttctggtaatccccggcagcccaa

SEQ ID NO: 397572 - DNA, 25 bp, Mus musculus
tttctggtaccacagaatgagagcc

SEQ ID NO: 397573 - DNA, 25 bp, Mus musculus
tttctggtaccacagagcatttctg

SEQ ID NO: 397574 - DNA, 25 bp, Mus musculus
tttctggtgaagattatgggacagt

SEQ ID NO: 397575 - DNA, 25 bp, Mus musculus
tttctggtttgccagctccggaaaa

SEQ ID NO: 397576 - DNA, 25 bp, Mus musculus
tttctggtttgtcaaagacatagat

SEQ ID NO: 397577 - DNA, 25 bp, Mus musculus
tttctgtaccgatgcactcccgctg

SEQ ID NO: 397578 - DNA, 25 bp, Mus musculus
tttctgtcaagccaaacatccagaa

SEQ ID NO: 397579 - DNA, 25 bp, Mus musculus
tttctgtcaagcctggaatgaagta

SEQ ID NO: 397580 - DNA, 25 bp, Mus musculus
tttctgtcagaagccacattgaatt

SEQ ID NO: 397581 - DNA, 25 bp, Mus musculus
tttctgtcatagcaaccaccgctct

SEQ ID NO: 397582 - DNA, 25 bp, Mus musculus
tttctgtcatagcactggaccacgg

SEQ ID NO: 397583 - DNA, 25 bp, Mus musculus
tttctgtcattcacgagcaccctga

SEQ ID NO: 397584 - DNA, 25 bp, Mus musculus
tttctgtcattcacggtgaaggcag

SEQ ID NO: 397585 - DNA, 25 bp, Mus musculus
tttctgtccacttcagtccagctgc

SEQ ID NO: 397586 - DNA, 25 bp, Mus musculus
tttctgtccgaggtcgctcatccga

SEQ ID NO: 397587 - DNA, 25 bp, Mus musculus
tttctgtccgctcagggatggtctg

SEQ ID NO: 397588 - DNA, 25 bp, Mus musculus
tttctgtccgctcagggcttctgac

SEQ ID NO: 397589 - DNA, 25 bp, Mus musculus
tttctgtgaagaaaagacatgctca

SEQ ID NO: 397590 - DNA, 25 bp, Mus musculus
tttctgtgaagatgggaaataagtt

SEQ ID NO: 397591 - DNA, 25 bp, Mus musculus
tttctgtgaaggcgttaagatcatc

SEQ ID NO: 397592 - DNA, 25 bp, Mus musculus
tttctgtgagtcagaaccatctggt

SEQ ID NO: 397593 - DNA, 25 bp, Mus musculus
tttctgtggggaagaattcttgaag

SEQ ID NO: 397594 - DNA, 25 bp, Mus musculus
tttctgtgttgatgagaggctgtaa

SEQ ID NO: 397595 - DNA, 25 bp, Mus musculus
tttctgtgttgcggttccctcatcg

SEQ ID NO: 397596 - DNA, 25 bp, Mus musculus
tttctgttctctgatttggggatat

SEQ ID NO: 397597 - DNA, 25 bp, Mus musculus
tttctgttctctggcgtaatagctt

SEQ ID NO: 397598 - DNA, 25 bp, Mus musculus
tttctgttctctggtgaagaaatct

SEQ ID NO: 397599 - DNA, 25 bp, Mus musculus
tttctgtttgttttcttctgcttct

SEQ ID NO: 397600 - DNA, 25 bp, Mus musculus
tttcttaactatatgagcgatgtcg

SEQ ID NO: 397601 - DNA, 25 bp, Mus musculus
tttcttaatcaggtatgtgtacatc

SEQ ID NO: 397602 - DNA, 25 bp, Mus musculus
tttcttaatcaggtcttctcgtccc

SEQ ID NO: 397603 - DNA, 25 bp, Mus musculus
tttcttaccatctatggagttgaac

SEQ ID NO: 397604 - DNA, 25 bp, Mus musculus
tttcttacctctggaaggcatcagt

SEQ ID NO: 397605 - DNA, 25 bp, Mus musculus
tttcttacctctgtcccaattcaca

SEQ ID NO: 397606 - DNA, 25 bp, Mus musculus
tttcttagagataaggttcatcatt

SEQ ID NO: 397607 - DNA, 25 bp, Mus musculus
tttcttagcggcggactggtgcagt

SEQ ID NO: 397608 - DNA, 25 bp, Mus musculus
tttcttagcggcgggagtctatcct

SEQ ID NO: 397609 - DNA, 25 bp, Mus musculus
tttcttagcggcgggtactatacca

SEQ ID NO: 397610 - DNA, 25 bp, Mus musculus
tttcttagctgagatagaagctttg

SEQ ID NO: 397611 - DNA, 25 bp, Mus musculus
tttcttatatgggagagtcagtcgt

SEQ ID NO: 397612 - DNA, 25 bp, Mus musculus
tttcttattcgcagtggctgtgacg

SEQ ID NO: 397613 - DNA, 25 bp, Mus musculus
tttcttattgaatatccagaagatg

SEQ ID NO: 397614 - DNA, 25 bp, Mus musculus
tttcttcaaacgtggggttctatgg

SEQ ID NO: 397615 - DNA, 25 bp, Mus musculus
tttcttcaagatgagagcgatgaca

SEQ ID NO: 397616 - DNA, 25 bp, Mus musculus
tttcttcaagatgaggcgagtggca

SEQ ID NO: 397617 - DNA, 25 bp, Mus musculus
tttcttcaagcacaagtatcagata

SEQ ID NO: 397618 - DNA, 25 bp, Mus musculus
tttcttcaagcaccagattgtacaa

SEQ ID NO: 397619 - DNA, 25 bp, Mus musculus
tttcttcaaggacgtagagtcagac

SEQ ID NO: 397620 - DNA, 25 bp, Mus musculus
tttcttcaaggccaagaagatagca

SEQ ID NO: 397621 - DNA, 25 bp, Mus musculus
tttcttcagacggtttctctagagg

SEQ ID NO: 397622 - DNA, 25 bp, Mus musculus
tttcttcagcagatgatgcccgcca

SEQ ID NO: 397623 - DNA, 25 bp, Mus musculus
tttcttcattgagactggacaatct

SEQ ID NO: 397624 - DNA, 25 bp, Mus musculus
tttcttcattgtcaggttcctggaa

SEQ ID NO: 397625 - DNA, 25 bp, Mus musculus
tttcttccaaggcagaagagtgggc

SEQ ID NO: 397626 - DNA, 25 bp, Mus musculus
tttcttccacagtgcctccggagcc

SEQ ID NO: 397627 - DNA, 25 bp, Mus musculus
tttcttccagggcttggctgagtag

SEQ ID NO: 397628 - DNA, 25 bp, Mus musculus
tttcttccataaagggcaagaaaaa

SEQ ID NO: 397629 - DNA, 25 bp, Mus musculus
tttcttccataaaggggcagtaaat

SEQ ID NO: 397630 - DNA, 25 bp, Mus musculus
tttcttcccagccggttccagcctc

SEQ ID NO: 397631 - DNA, 25 bp, Mus musculus
tttcttcccaggagaaatatgaacc

SEQ ID NO: 397632 - DNA, 25 bp, Mus musculus
tttcttcccaggtgaagtggaagat

SEQ ID NO: 397633 - DNA, 25 bp, Mus musculus
tttcttctgatgagctgggaagtca

SEQ ID NO: 397634 - DNA, 25 bp, Mus musculus
tttcttcttatcagggtcaaagaag

SEQ ID NO: 397635 - DNA, 25 bp, Mus musculus
tttcttgaataggtattgataaatg

SEQ ID NO: 397636 - DNA, 25 bp, Mus musculus
tttcttgacaggcatcctcgtgtac

SEQ ID NO: 397637 - DNA, 25 bp, Mus musculus
tttcttgaccggatccgctccctgc

SEQ ID NO: 397638 - DNA, 25 bp, Mus musculus
tttcttgaccgggcttctcagagtg

SEQ ID NO: 397639 - DNA, 25 bp, Mus musculus
tttcttgagtttgacagtgtcattc

SEQ ID NO: 397640 - DNA, 25 bp, Mus musculus
tttcttgcaaagatcactggagatt

SEQ ID NO: 397641 - DNA, 25 bp, Mus musculus
tttcttggatcggatgaagaagata

SEQ ID NO: 397642 - DNA, 25 bp, Mus musculus
tttcttggcattataaaccgtgtca

SEQ ID NO: 397643 - DNA, 25 bp, Mus musculus
tttcttggcattatgtgccctccgt

SEQ ID NO: 397644 - DNA, 25 bp, Mus musculus
tttcttgggagaggaagaagaaagg

SEQ ID NO: 397645 - DNA, 25 bp, Mus musculus
tttcttgggaggaagtccacattgc

SEQ ID NO: 397646 - DNA, 25 bp, Mus musculus
tttcttggtcagaagaagcgcacgt

SEQ ID NO: 397647 - DNA, 25 bp, Mus musculus
tttcttgtctgaagcgaaggtgtcc

SEQ ID NO: 397648 - DNA, 25 bp, Mus musculus
tttcttgtgcaaactgggatggatc

SEQ ID NO: 397649 - DNA, 25 bp, Mus musculus
tttcttgttgttcaggtttatcatg

SEQ ID NO: 397650 - DNA, 25 bp, Mus musculus
tttctttaaaaggtgaggcatgaaa

SEQ ID NO: 397651 - DNA, 25 bp, Mus musculus
tttctttaaatgacaacaattgaca

SEQ ID NO: 397652 - DNA, 25 bp, Mus musculus
tttctttaacaaggtaaataagctg

SEQ ID NO: 397653 - DNA, 25 bp, Mus musculus
tttctttacctgacaaagccaaggt

SEQ ID NO: 397654 - DNA, 25 bp, Mus musculus
tttctttactgaatataagtaccat

SEQ ID NO: 397655 - DNA, 25 bp, Mus musculus
tttctttagattgtcccagttgtga

SEQ ID NO: 397656 - DNA, 25 bp, Mus musculus
tttctttagcaagagcagtatataa

SEQ ID NO: 397657 - DNA, 25 bp, Mus musculus
tttctttcagccttttatgtcaccg

SEQ ID NO: 397658 - DNA, 25 bp, Mus musculus
tttctttcatagatgaagcccgagg

SEQ ID NO: 397659 - DNA, 25 bp, Mus musculus
tttctttccaacaaagcctacacag

SEQ ID NO: 397660 - DNA, 25 bp, Mus musculus
tttctttccaacaacctgcatcata

SEQ ID NO: 397661 - DNA, 25 bp, Mus musculus
tttctttccaagtccttctttgacc

SEQ ID NO: 397662 - DNA, 25 bp, Mus musculus
tttctttctgccctgtttcaccttt

SEQ ID NO: 397663 - DNA, 25 bp, Mus musculus
tttctttctgcctgcacatttcata

SEQ ID NO: 397664 - DNA, 25 bp, Mus musculus
tttctttgatgagtgcttcctttgc

SEQ ID NO: 397665 - DNA, 25 bp, Mus musculus
tttctttgcagcacacagcacacct

SEQ ID NO: 397666 - DNA, 25 bp, Mus musculus
tttctttggagcagtggccgtgcct

SEQ ID NO: 397667 - DNA, 25 bp, Mus musculus
tttctttgggcagctgctcgccctg

SEQ ID NO: 397668 - DNA, 25 bp, Mus musculus
tttctttgttcaggagtttaatctg

SEQ ID NO: 397669 - DNA, 25 bp, Mus musculus
tttcttttacaataagagaccagca

SEQ ID NO: 397670 - DNA, 25 bp, Mus musculus
tttcttttcctgggtgaaagacaag

SEQ ID NO: 397671 - DNA, 25 bp, Mus musculus
tttcttttggaggtgcagtgtatgc

SEQ ID NO: 397672 - DNA, 25 bp, Mus musculus
tttcttttgggagcctcaatggtgg

SEQ ID NO: 397673 - DNA, 25 bp, Mus musculus
tttcttttgggagtgagtgtgtact

SEQ ID NO: 397674 - DNA, 25 bp, Mus musculus
tttgaaaaagaatatatttgaaata

SEQ ID NO: 397675 - DNA, 25 bp, Mus musculus
tttgaaaaagcgctctccagtgtca

SEQ ID NO: 397676 - DNA, 25 bp, Mus musculus
tttgaaaaagctgtcaagagcagag

SEQ ID NO: 397677 - DNA, 25 bp, Mus musculus
tttgaaaaaggtgactcatttttct

SEQ ID NO: 397678 - DNA, 25 bp, Mus musculus
tttgaaaaagtcctaatcctggagg

SEQ ID NO: 397679 - DNA, 25 bp, Mus musculus
tttgaaaacagctcgaggctgggag

SEQ ID NO: 397680 - DNA, 25 bp, Mus musculus
tttgaaaaccaggaaaataggtgag

SEQ ID NO: 397681 - DNA, 25 bp, Mus musculus
tttgaaaaggaaggtacaagaggac

SEQ ID NO: 397682 - DNA, 25 bp, Mus musculus
tttgaaaaggaaggtgtcttctcgt

SEQ ID NO: 397683 - DNA, 25 bp, Mus musculus
tttgaaaatcgaatctctagggctg

SEQ ID NO: 397684 - DNA, 25 bp, Mus musculus
tttgaaaatcgatcttctttcagaa

SEQ ID NO: 397685 - DNA, 25 bp, Mus musculus
tttgaaaatcggttagtccttcatt

SEQ ID NO: 397686 - DNA, 25 bp, Mus musculus
tttgaaaatgatgccagaatttcag

SEQ ID NO: 397687 - DNA, 25 bp, Mus musculus
tttgaaaatttggaggcagcaccgg

SEQ ID NO: 397688 - DNA, 25 bp, Mus musculus
tttgaaacaggtgttctggctgatg

SEQ ID NO: 397689 - DNA, 25 bp, Mus musculus
tttgaaactaagcagaacaagccat

SEQ ID NO: 397690 - DNA, 25 bp, Mus musculus
tttgaaactaagcaggaagcagaac

SEQ ID NO: 397691 - DNA, 25 bp, Mus musculus
tttgaaactgaagaaactcggaaaa

SEQ ID NO: 397692 - DNA, 25 bp, Mus musculus
tttgaaagaagcagttccgaggcct

SEQ ID NO: 397693 - DNA, 25 bp, Mus musculus
tttgaaagagccccggcagcccaac

SEQ ID NO: 397694 - DNA, 25 bp, Mus musculus
tttgaaagagctgaatgataagaaa

SEQ ID NO: 397695 - DNA, 25 bp, Mus musculus
tttgaaaggaattccagatggtcaa

SEQ ID NO: 397696 - DNA, 25 bp, Mus musculus
tttgaaagggcccatgatctccatc

SEQ ID NO: 397697 - DNA, 25 bp, Mus musculus
tttgaaagtaagcgtttcaagggta

SEQ ID NO: 397698 - DNA, 25 bp, Mus musculus
tttgaaagtggtaacctcggccggg

SEQ ID NO: 397699 - DNA, 25 bp, Mus musculus
tttgaaatacaagctggcatttttc

SEQ ID NO: 397700 - DNA, 25 bp, Mus musculus
tttgaaatacaaggagcaactgtgc

SEQ ID NO: 397701 - DNA, 25 bp, Mus musculus
tttgaaatcattgctatgtccacca

SEQ ID NO: 397702 - DNA, 25 bp, Mus musculus
tttgaaatctgatggttaccacaag

SEQ ID NO: 397703 - DNA, 25 bp, Mus musculus
tttgaaatgtcagactcattgaaag

SEQ ID NO: 397704 - DNA, 25 bp, Mus musculus
tttgaaatgtcaggatgccccaggt

SEQ ID NO: 397705 - DNA, 25 bp, Mus musculus
tttgaacaaggaagctcggattctg

SEQ ID NO: 397706 - DNA, 25 bp, Mus musculus
tttgaacactgatatagaaaatctt

SEQ ID NO: 397707 - DNA, 25 bp, Mus musculus
tttgaacatccaaaagtttgcagtc

SEQ ID NO: 397708 - DNA, 25 bp, Mus musculus
tttgaacatccaaagacacacagga

SEQ ID NO: 397709 - DNA, 25 bp, Mus musculus
tttgaaccagaagactttgaaagca

SEQ ID NO: 397710 - DNA, 25 bp, Mus musculus
tttgaaccagaagggctgtcagggg

SEQ ID NO: 397711 - DNA, 25 bp, Mus musculus
tttgaacctttggtcagaaagcatg

SEQ ID NO: 397712 - DNA, 25 bp, Mus musculus
tttgaacgaggaggctgtgtctgct

SEQ ID NO: 397713 - DNA, 25 bp, Mus musculus
tttgaacgatttctgatcgtctgcc

SEQ ID NO: 397714 - DNA, 25 bp, Mus musculus
tttgaactaatcaaggacactgaca

SEQ ID NO: 397715 - DNA, 25 bp, Mus musculus
tttgaactcatcaagtgctcggcgc

SEQ ID NO: 397716 - DNA, 25 bp, Mus musculus
tttgaactgataagacgccttgaag

SEQ ID NO: 397717 - DNA, 25 bp, Mus musculus
tttgaactgataatggcaaagaagt

SEQ ID NO: 397718 - DNA, 25 bp, Mus musculus
tttgaactgttcaagaatgccatga

SEQ ID NO: 397719 - DNA, 25 bp, Mus musculus
tttgaacttcaagctcttttggaag

SEQ ID NO: 397720 - DNA, 25 bp, Mus musculus
tttgaacttgatcgtactcgacctg

SEQ ID NO: 397721 - DNA, 25 bp, Mus musculus
tttgaacttggatgtccagaggcgg

SEQ ID NO: 397722 - DNA, 25 bp, Mus musculus
tttgaagaagatgaagaggtgggtg

SEQ ID NO: 397723 - DNA, 25 bp, Mus musculus
tttgaagaagcagaaaagtataaag

SEQ ID NO: 397724 - DNA, 25 bp, Mus musculus
tttgaagaatcaagaaactgatctc

SEQ ID NO: 397725 - DNA, 25 bp, Mus musculus
tttgaagaattcagtgaacagagta

SEQ ID NO: 397726 - DNA, 25 bp, Mus musculus
tttgaagaccatcttgcagtgcgcc

SEQ ID NO: 397727 - DNA, 25 bp, Mus musculus
tttgaagactgtggaaacaccaggc

SEQ ID NO: 397728 - DNA, 25 bp, Mus musculus
tttgaagactgtggtcttgccgtca

SEQ ID NO: 397729 - DNA, 25 bp, Mus musculus
tttgaagagcagatggcccagtgag

SEQ ID NO: 397730 - DNA, 25 bp, Mus musculus
tttgaagagcaggttgcttccataa

SEQ ID NO: 397731 - DNA, 25 bp, Mus musculus
tttgaagaggaacatgcagaggcac

SEQ ID NO: 397732 - DNA, 25 bp, Mus musculus
tttgaagaggaacatgggatgtgaa

SEQ ID NO: 397733 - DNA, 25 bp, Mus musculus
tttgaagatgaggatttcttatctg

SEQ ID NO: 397734 - DNA, 25 bp, Mus musculus
tttgaagatgttccctcagccaatg

SEQ ID NO: 397735 - DNA, 25 bp, Mus musculus
tttgaagccaggtgtttggccttgg

SEQ ID NO: 397736 - DNA, 25 bp, Mus musculus
tttgaaggaactctcaaggggaagc

SEQ ID NO: 397737 - DNA, 25 bp, Mus musculus
tttgaaggaagaggggatatgtggt

SEQ ID NO: 397738 - DNA, 25 bp, Mus musculus
tttgaaggaggcagtgttttgtcaa

SEQ ID NO: 397739 - DNA, 25 bp, Mus musculus
tttgaaggatcaaggcagagatgct

SEQ ID NO: 397740 - DNA, 25 bp, Mus musculus
tttgaaggtgaattcttcaaagaac

SEQ ID NO: 397741 - DNA, 25 bp, Mus musculus
tttgaaggtgtattcttcaaagaac

SEQ ID NO: 397742 - DNA, 25 bp, Mus musculus
tttgaagtaaaaggcaaccagataa

SEQ ID NO: 397743 - DNA, 25 bp, Mus musculus
tttgaagtcctccggaccatgctgc

SEQ ID NO: 397744 - DNA, 25 bp, Mus musculus
tttgaagtcctccggtctgaaactc

SEQ ID NO: 397745 - DNA, 25 bp, Mus musculus
tttgaagttaaaaagtggaatgcag

SEQ ID NO: 397746 - DNA, 25 bp, Mus musculus
tttgaataataggaatatccgaagc

SEQ ID NO: 397747 - DNA, 25 bp, Mus musculus
tttgaataatatttccctcatggat

SEQ ID NO: 397748 - DNA, 25 bp, Mus musculus
tttgaatataacatcagatattcag

SEQ ID NO: 397749 - DNA, 25 bp, Mus musculus
tttgaatatccagggttctctgacc

SEQ ID NO: 397750 - DNA, 25 bp, Mus musculus
tttgaatgagccaaggaccagagtg

SEQ ID NO: 397751 - DNA, 25 bp, Mus musculus
tttgaatggcaaggtgctggatggt

SEQ ID NO: 397752 - DNA, 25 bp, Mus musculus
tttgaatgtccaggaccccctggcc

SEQ ID NO: 397753 - DNA, 25 bp, Mus musculus
tttgaattgtaatgtggagctgccc

SEQ ID NO: 397754 - DNA, 25 bp, Mus musculus
tttgacaaaaaatcagctgcccgag

SEQ ID NO: 397755 - DNA, 25 bp, Mus musculus
tttgacaaaaacagcttatagagca

SEQ ID NO: 397756 - DNA, 25 bp, Mus musculus
tttgacaaagagcctgactctgatt

SEQ ID NO: 397757 - DNA, 25 bp, Mus musculus
tttgacaaagccagctaccgagtct

SEQ ID NO: 397758 - DNA, 25 bp, Mus musculus
tttgacaaaggaaaaagaggcctca

SEQ ID NO: 397759 - DNA, 25 bp, Mus musculus
tttgacaaagttggcatcctgactt

SEQ ID NO: 397760 - DNA, 25 bp, Mus musculus
tttgacaacagctacagtaggggag

SEQ ID NO: 397761 - DNA, 25 bp, Mus musculus
tttgacaacaggggaggcacttatg

SEQ ID NO: 397762 - DNA, 25 bp, Mus musculus
tttgacaagccccagcttatcaagt

SEQ ID NO: 397763 - DNA, 25 bp, Mus musculus
tttgacaagctaaggatttggagtt

SEQ ID NO: 397764 - DNA, 25 bp, Mus musculus
tttgacaattatgagggttcagctc

SEQ ID NO: 397765 - DNA, 25 bp, Mus musculus
tttgacacattggcggctttcttga

SEQ ID NO: 397766 - DNA, 25 bp, Mus musculus
tttgacactactgatttcagctctg

SEQ ID NO: 397767 - DNA, 25 bp, Mus musculus
tttgacacttaagggctacttgatt

SEQ ID NO: 397768 - DNA, 25 bp, Mus musculus
tttgacagacagaatgtactttcct

SEQ ID NO: 397769 - DNA, 25 bp, Mus musculus
tttgacagcaaaggcacccggattc

SEQ ID NO: 397770 - DNA, 25 bp, Mus musculus
tttgacaggcacgagctgcaggtcc

SEQ ID NO: 397771 - DNA, 25 bp, Mus musculus
tttgacagtgccaacctggagaagg

SEQ ID NO: 397772 - DNA, 25 bp, Mus musculus
tttgacatcactgatgagagtagtg

SEQ ID NO: 397773 - DNA, 25 bp, Mus musculus
tttgacatcagtgatgagagtagtg

SEQ ID NO: 397774 - DNA, 25 bp, Mus musculus
tttgacatggcaacagaagttggtt

SEQ ID NO: 397775 - DNA, 25 bp, Mus musculus
tttgaccaagacccgggcctggttc

SEQ ID NO: 397776 - DNA, 25 bp, Mus musculus
tttgaccaatcagttcatgcagaag

SEQ ID NO: 397777 - DNA, 25 bp, Mus musculus
tttgaccactgcagtctctctctcc

SEQ ID NO: 397778 - DNA, 25 bp, Mus musculus
tttgaccaggatgacctcacggtaa

SEQ ID NO: 397779 - DNA, 25 bp, Mus musculus
tttgaccatgcggatccttccattt

SEQ ID NO: 397780 - DNA, 25 bp, Mus musculus
tttgacccaagacaaggtctcacta

SEQ ID NO: 397781 - DNA, 25 bp, Mus musculus
tttgaccgagaaggagaagagttag

SEQ ID NO: 397782 - DNA, 25 bp, Mus musculus
tttgaccgcacaggtactgagacag

SEQ ID NO: 397783 - DNA, 25 bp, Mus musculus
tttgacctcaaggtcctaaatgctc

SEQ ID NO: 397784 - DNA, 25 bp, Mus musculus
tttgacctcatggtgttcgtgacca

SEQ ID NO: 397785 - DNA, 25 bp, Mus musculus
tttgacctcttcatgcgcatggact

SEQ ID NO: 397786 - DNA, 25 bp, Mus musculus
tttgaccttggacttcctggacacc

SEQ ID NO: 397787 - DNA, 25 bp, Mus musculus
tttgaccttgggtgccttccaacct

SEQ ID NO: 397788 - DNA, 25 bp, Mus musculus
tttgacgaaaacgacagaagatacc

SEQ ID NO: 397789 - DNA, 25 bp, Mus musculus
tttgacgaaaacgagctgttgcgca

SEQ ID NO: 397790 - DNA, 25 bp, Mus musculus
tttgactacaacagcgtccatgcca

SEQ ID NO: 397791 - DNA, 25 bp, Mus musculus
tttgactacagcacggtggatgaca

SEQ ID NO: 397792 - DNA, 25 bp, Mus musculus
tttgactacctgaggctggcccagc

SEQ ID NO: 397793 - DNA, 25 bp, Mus musculus
tttgactacctgagggtgaacaaca

SEQ ID NO: 397794 - DNA, 25 bp, Mus musculus
tttgactatcagcatggggctgctt

SEQ ID NO: 397795 - DNA, 25 bp, Mus musculus
tttgactatcaggacctccaggacc

SEQ ID NO: 397796 - DNA, 25 bp, Mus musculus
tttgactccagctattcacggaacc

SEQ ID NO: 397797 - DNA, 25 bp, Mus musculus
tttgactctcctcagaagactggtc

SEQ ID NO: 397798 - DNA, 25 bp, Mus musculus
tttgactctcctcaggtcatgttta

SEQ ID NO: 397799 - DNA, 25 bp, Mus musculus
tttgactctgagatggtagagatgg

SEQ ID NO: 397800 - DNA, 25 bp, Mus musculus
tttgactctgaggtgctgtaggagc

SEQ ID NO: 397801 - DNA, 25 bp, Mus musculus
tttgactgacagaagttaccaaatg

SEQ ID NO: 397802 - DNA, 25 bp, Mus musculus
tttgactggaatggtatttccaaac

SEQ ID NO: 397803 - DNA, 25 bp, Mus musculus
tttgactgggtggaggctaatctcg

SEQ ID NO: 397804 - DNA, 25 bp, Mus musculus
tttgactgtcaggaacatgacattg

SEQ ID NO: 397805 - DNA, 25 bp, Mus musculus
tttgacttcaacaccctcttcaagt

SEQ ID NO: 397806 - DNA, 25 bp, Mus musculus
tttgacttctcaaggagcgatgagc

SEQ ID NO: 397807 - DNA, 25 bp, Mus musculus
tttgacttctcaaggcgaccctttg

SEQ ID NO: 397808 - DNA, 25 bp, Mus musculus
tttgacttctctaaggcttgccctc

SEQ ID NO: 397809 - DNA, 25 bp, Mus musculus
tttgacttctgtagagtccaattgg

SEQ ID NO: 397810 - DNA, 25 bp, Mus musculus
tttgacttctgtaggcataaactgg

SEQ ID NO: 397811 - DNA, 25 bp, Mus musculus
tttgacttctttggtcttctagggg

SEQ ID NO: 397812 - DNA, 25 bp, Mus musculus
tttgacttgctgaacattgttccct

SEQ ID NO: 397813 - DNA, 25 bp, Mus musculus
tttgagaaaggtttgcagctagaac

SEQ ID NO: 397814 - DNA, 25 bp, Mus musculus
tttgagaacaacaggaacctgagga

SEQ ID NO: 397815 - DNA, 25 bp, Mus musculus
tttgagaacaacaggactccgggag

SEQ ID NO: 397816 - DNA, 25 bp, Mus musculus
tttgagaacggatgggatatttcca

SEQ ID NO: 397817 - DNA, 25 bp, Mus musculus
tttgagaagaccaagactgtatccc

SEQ ID NO: 397818 - DNA, 25 bp, Mus musculus
tttgagaagaccaaggctttgatcc

SEQ ID NO: 397819 - DNA, 25 bp, Mus musculus
tttgagaagctgggcttcaacaaat

SEQ ID NO: 397820 - DNA, 25 bp, Mus musculus
tttgagaagctgggtatcagtacca

SEQ ID NO: 397821 - DNA, 25 bp, Mus musculus
tttgagaataccattgagtcagacg

SEQ ID NO: 397822 - DNA, 25 bp, Mus musculus
tttgagaatctcctgtccaagaaca

SEQ ID NO: 397823 - DNA, 25 bp, Mus musculus
tttgagaatgctctggcttctcctt

SEQ ID NO: 397824 - DNA, 25 bp, Mus musculus
tttgagacagttccgacgagatatc

SEQ ID NO: 397825 - DNA, 25 bp, Mus musculus
tttgagacctataatggtcagcaag

SEQ ID NO: 397826 - DNA, 25 bp, Mus musculus
tttgagactctctgtgcaaagaccc

SEQ ID NO: 397827 - DNA, 25 bp, Mus musculus
tttgagagagagaaggagagggaaa

SEQ ID NO: 397828 - DNA, 25 bp, Mus musculus
tttgagagcctcctgacatgatgta

SEQ ID NO: 397829 - DNA, 25 bp, Mus musculus
tttgagagcctcctggagctggtgg

SEQ ID NO: 397830 - DNA, 25 bp, Mus musculus
tttgagaggaaacttcgagtcaaat

SEQ ID NO: 397831 - DNA, 25 bp, Mus musculus
tttgagaggggcaggtggcagctca

SEQ ID NO: 397832 - DNA, 25 bp, Mus musculus
tttgagagtagtataagaaagaccc

SEQ ID NO: 397833 - DNA, 25 bp, Mus musculus
tttgagagtattattggcatttaca

SEQ ID NO: 397834 - DNA, 25 bp, Mus musculus
tttgagagtctcaaggctacatgtg

SEQ ID NO: 397835 - DNA, 25 bp, Mus musculus
tttgagatcagctaattaagaacct

SEQ ID NO: 397836 - DNA, 25 bp, Mus musculus
tttgagatcatggagatgctccaag

SEQ ID NO: 397837 - DNA, 25 bp, Mus musculus
tttgagatcttcgatttcaacagct

SEQ ID NO: 397838 - DNA, 25 bp, Mus musculus
tttgagatgggaaggaaaaagtgtg

SEQ ID NO: 397839 - DNA, 25 bp, Mus musculus
tttgagatgggaagggaaaatgaac

SEQ ID NO: 397840 - DNA, 25 bp, Mus musculus
tttgagatgggtaaccttttggtga

SEQ ID NO: 397841 - DNA, 25 bp, Mus musculus
tttgagatggtctgctttacgggaa

SEQ ID NO: 397842 - DNA, 25 bp, Mus musculus
tttgagattaagaaatgtgaccttc

SEQ ID NO: 397843 - DNA, 25 bp, Mus musculus
tttgagattaaggaagcctgctgcg

SEQ ID NO: 397844 - DNA, 25 bp, Mus musculus
tttgagattgtaaaagctggcaggc

SEQ ID NO: 397845 - DNA, 25 bp, Mus musculus
tttgagcaaaggagaagcgctacca

SEQ ID NO: 397846 - DNA, 25 bp, Mus musculus
tttgagcagaagtggttcccagtgg

SEQ ID NO: 397847 - DNA, 25 bp, Mus musculus
tttgagcagcagcaaaaagatggaa

SEQ ID NO: 397848 - DNA, 25 bp, Mus musculus
tttgagcataggtcctgatcactgg

SEQ ID NO: 397849 - DNA, 25 bp, Mus musculus
tttgagccgaggattaacacctgca

SEQ ID NO: 397850 - DNA, 25 bp, Mus musculus
tttgagccgcagaagtatgaggctt

SEQ ID NO: 397851 - DNA, 25 bp, Mus musculus
tttgagcgtggcggacctcatccgc

SEQ ID NO: 397852 - DNA, 25 bp, Mus musculus
tttgagctgctccaggagcctgaag

SEQ ID NO: 397853 - DNA, 25 bp, Mus musculus
tttgagctggctgggtttgactctg

SEQ ID NO: 397854 - DNA, 25 bp, Mus musculus
tttgagctggctggtgctggcatga

SEQ ID NO: 397855 - DNA, 25 bp, Mus musculus
tttgaggaaagcgaatctccccgag

SEQ ID NO: 397856 - DNA, 25 bp, Mus musculus
tttgaggaaagggaacgggagatgg

SEQ ID NO: 397857 - DNA, 25 bp, Mus musculus
tttgaggaagattgcaagcccaagg

SEQ ID NO: 397858 - DNA, 25 bp, Mus musculus
tttgaggaagcgagtctccagttaa

SEQ ID NO: 397859 - DNA, 25 bp, Mus musculus
tttgaggaatgctcgccaaaacaac

SEQ ID NO: 397860 - DNA, 25 bp, Mus musculus
tttgaggaatgctctctttggggtg

SEQ ID NO: 397861 - DNA, 25 bp, Mus musculus
tttgaggacagcttgtcccaggtaa

SEQ ID NO: 397862 - DNA, 25 bp, Mus musculus
tttgaggactgatgggatggctctg

SEQ ID NO: 397863 - DNA, 25 bp, Mus musculus
tttgaggactttgaggacaatggtg

SEQ ID NO: 397864 - DNA, 25 bp, Mus musculus
tttgaggagagaagagaactatgag

SEQ ID NO: 397865 - DNA, 25 bp, Mus musculus
tttgaggagcagttcctgaatgcca

SEQ ID NO: 397866 - DNA, 25 bp, Mus musculus
tttgaggatagccaggtcaaagccc

SEQ ID NO: 397867 - DNA, 25 bp, Mus musculus
tttgaggatgaaggacggtggcgcc

SEQ ID NO: 397868 - DNA, 25 bp, Mus musculus
tttgaggctttcaagctaactgatg

SEQ ID NO: 397869 - DNA, 25 bp, Mus musculus
tttgaggtccaagctcggacctcag

SEQ ID NO: 397870 - DNA, 25 bp, Mus musculus
tttgagtacaccacggacaaggagc

SEQ ID NO: 397871 - DNA, 25 bp, Mus musculus
tttgagtacaggtctgtaccacaac

SEQ ID NO: 397872 - DNA, 25 bp, Mus musculus
tttgagtacaggtgatttgaactgt

SEQ ID NO: 397873 - DNA, 25 bp, Mus musculus
tttgagtagcagtgagcgtcctggg

SEQ ID NO: 397874 - DNA, 25 bp, Mus musculus
tttgagtatccggacaattccatca

SEQ ID NO: 397875 - DNA, 25 bp, Mus musculus
tttgagtccagaaagtcaacgcctc

SEQ ID NO: 397876 - DNA, 25 bp, Mus musculus
tttgagtcctcaaactcactctgca

SEQ ID NO: 397877 - DNA, 25 bp, Mus musculus
tttgagtcctcaaagacaatgtgtc

SEQ ID NO: 397878 - DNA, 25 bp, Mus musculus
tttgagtcgcctcagaaaatgtatc

SEQ ID NO: 397879 - DNA, 25 bp, Mus musculus
tttgagtctacaggtttgtacagcg

SEQ ID NO: 397880 - DNA, 25 bp, Mus musculus
tttgagtgacaaagtctacaggaat

SEQ ID NO: 397881 - DNA, 25 bp, Mus musculus
tttgagtgacgggtttagctttttc

SEQ ID NO: 397882 - DNA, 25 bp, Mus musculus
tttgagtggaacgcaaccttcctgc

SEQ ID NO: 397883 - DNA, 25 bp, Mus musculus
tttgagtggaatgcgctcttcgtgg

SEQ ID NO: 397884 - DNA, 25 bp, Mus musculus
tttgagtgggaagatgatcttccca

SEQ ID NO: 397885 - DNA, 25 bp, Mus musculus
tttgagtgttttctctcttttattt

SEQ ID NO: 397886 - DNA, 25 bp, Mus musculus
tttgagttcttgtgggaagcattca

SEQ ID NO: 397887 - DNA, 25 bp, Mus musculus
tttgagttcttgtgggggatgcttg

SEQ ID NO: 397888 - DNA, 25 bp, Mus musculus
tttgagttcttgtgggtggccatgc

SEQ ID NO: 397889 - DNA, 25 bp, Mus musculus
tttgagtttgctcagaagtttacag

SEQ ID NO: 397890 - DNA, 25 bp, Mus musculus
tttgataaaaccacgactccagatg

SEQ ID NO: 397891 - DNA, 25 bp, Mus musculus
tttgataaagttcacctcctggcta

SEQ ID NO: 397892 - DNA, 25 bp, Mus musculus
tttgataaagttcagctcctggcta

SEQ ID NO: 397893 - DNA, 25 bp, Mus musculus
tttgataaggctcagagagtctgca

SEQ ID NO: 397894 - DNA, 25 bp, Mus musculus
tttgatacacagagagcgatacaca

SEQ ID NO: 397895 - DNA, 25 bp, Mus musculus
tttgatacacagagatatagtgctg

SEQ ID NO: 397896 - DNA, 25 bp, Mus musculus
tttgatacagtcaccaaggagctgg

SEQ ID NO: 397897 - DNA, 25 bp, Mus musculus
tttgatagacgtgaacgaagctttt

SEQ ID NO: 397898 - DNA, 25 bp, Mus musculus
tttgataggacagaacaccacccaa

SEQ ID NO: 397899 - DNA, 25 bp, Mus musculus
tttgataggacagtgttcttcacaa

SEQ ID NO: 397900 - DNA, 25 bp, Mus musculus
tttgatataaaggttttaaatgcac

SEQ ID NO: 397901 - DNA, 25 bp, Mus musculus
tttgatatggcacccgttattggaa

SEQ ID NO: 397902 - DNA, 25 bp, Mus musculus
tttgatattcggagctggagccctg

SEQ ID NO: 397903 - DNA, 25 bp, Mus musculus
tttgatattcggctgaattcatcag

SEQ ID NO: 397904 - DNA, 25 bp, Mus musculus
tttgatcaacagacgtatgttgtca

SEQ ID NO: 397905 - DNA, 25 bp, Mus musculus
tttgatcaacagccaaaccactgag

SEQ ID NO: 397906 - DNA, 25 bp, Mus musculus
tttgatcacaaggtcacacttggtc

SEQ ID NO: 397907 - DNA, 25 bp, Mus musculus
tttgatcacagtattttcacaaagt

SEQ ID NO: 397908 - DNA, 25 bp, Mus musculus
tttgatccagatgccaaggggctga

SEQ ID NO: 397909 - DNA, 25 bp, Mus musculus
tttgatcccgtgaaggtgattcaga

SEQ ID NO: 397910 - DNA, 25 bp, Mus musculus
tttgatctattttcaagaaagtgtt

SEQ ID NO: 397911 - DNA, 25 bp, Mus musculus
tttgatctattttcggatgtacatg

SEQ ID NO: 397912 - DNA, 25 bp, Mus musculus
tttgatctgaaggaaggcgaagtgc

SEQ ID NO: 397913 - DNA, 25 bp, Mus musculus
tttgatctgaccaaggtttggcctc

SEQ ID NO: 397914 - DNA, 25 bp, Mus musculus
tttgatgaagccagaagatgtagct

SEQ ID NO: 397915 - DNA, 25 bp, Mus musculus
tttgatgaagccagatgctgatgct

SEQ ID NO: 397916 - DNA, 25 bp, Mus musculus
tttgatgaagccagcactagcaaca

SEQ ID NO: 397917 - DNA, 25 bp, Mus musculus
tttgatgactaccatcatcgagaag

SEQ ID NO: 397918 - DNA, 25 bp, Mus musculus
tttgatgagaaaggaaatttcttgg

SEQ ID NO: 397919 - DNA, 25 bp, Mus musculus
tttgatgagggtaagtatcagatgg

SEQ ID NO: 397920 - DNA, 25 bp, Mus musculus
tttgatgaggtacagtatcagatgg

SEQ ID NO: 397921 - DNA, 25 bp, Mus musculus
tttgatgagtgcttcctttgcagct

SEQ ID NO: 397922 - DNA, 25 bp, Mus musculus
tttgatgatacttatgaccacggct

SEQ ID NO: 397923 - DNA, 25 bp, Mus musculus
tttgatgatctattggatgatacat

SEQ ID NO: 397924 - DNA, 25 bp, Mus musculus
tttgatgcactagctgaaaaacatg

SEQ ID NO: 397925 - DNA, 25 bp, Mus musculus
tttgatgcagctatgaaggggctgg

SEQ ID NO: 397926 - DNA, 25 bp, Mus musculus
tttgatgcccaaggcaacttaaggg

SEQ ID NO: 397927 - DNA, 25 bp, Mus musculus
tttgatgctagagaggaggtggctg

SEQ ID NO: 397928 - DNA, 25 bp, Mus musculus
tttgatgctagagcctcagtctgaa

SEQ ID NO: 397929 - DNA, 25 bp, Mus musculus
tttgatgctgtgcaaagtgcacacc

SEQ ID NO: 397930 - DNA, 25 bp, Mus musculus
tttgatgctgtggacaaggtctctt

SEQ ID NO: 397931 - DNA, 25 bp, Mus musculus
tttgatgctgtggactgtgtttgaa

SEQ ID NO: 397932 - DNA, 25 bp, Mus musculus
tttgatggaaagaaaattgcccagg

SEQ ID NO: 397933 - DNA, 25 bp, Mus musculus
tttgatggaaaggagttctggcagg

SEQ ID NO: 397934 - DNA, 25 bp, Mus musculus
tttgatggagcctgaaacatttgag

SEQ ID NO: 397935 - DNA, 25 bp, Mus musculus
tttgatggagtgaagtgcctcagag

SEQ ID NO: 397936 - DNA, 25 bp, Mus musculus
tttgatggcaagggtcatgtgggta

SEQ ID NO: 397937 - DNA, 25 bp, Mus musculus
tttgatggcaaggtgctgtctgaaa

SEQ ID NO: 397938 - DNA, 25 bp, Mus musculus
tttgatggtgacggggatcgaaaca

SEQ ID NO: 397939 - DNA, 25 bp, Mus musculus
tttgatgtccgagaggtcattgcta

SEQ ID NO: 397940 - DNA, 25 bp, Mus musculus
tttgatgtcctgggtcatggtagta

SEQ ID NO: 397941 - DNA, 25 bp, Mus musculus
tttgatgtctggaagccatgactgt

SEQ ID NO: 397942 - DNA, 25 bp, Mus musculus
tttgatgtgcatgtgtgggcatatt

SEQ ID NO: 397943 - DNA, 25 bp, Mus musculus
tttgatgtggcctgcccagagtgac

SEQ ID NO: 397944 - DNA, 25 bp, Mus musculus
tttgattcaaaaggatggccaggct

SEQ ID NO: 397945 - DNA, 25 bp, Mus musculus
tttgattcaacagatgtctttcaac

SEQ ID NO: 397946 - DNA, 25 bp, Mus musculus
tttgattcaacaggcaatcgagatt

SEQ ID NO: 397947 - DNA, 25 bp, Mus musculus
tttgattcactgaaaggtcgttgct

SEQ ID NO: 397948 - DNA, 25 bp, Mus musculus
tttgattccagccataatcgcatga

SEQ ID NO: 397949 - DNA, 25 bp, Mus musculus
tttgattccagctactcccgaaacc

SEQ ID NO: 397950 - DNA, 25 bp, Mus musculus
tttgattgctaagatcccaccaaat

SEQ ID NO: 397951 - DNA, 25 bp, Mus musculus
tttgattgctaaggttgagggcaaa

SEQ ID NO: 397952 - DNA, 25 bp, Mus musculus
tttgatttagacttggagatccctt

SEQ ID NO: 397953 - DNA, 25 bp, Mus musculus
tttgatttcctgtcccctgaactga

SEQ ID NO: 397954 - DNA, 25 bp, Mus musculus
tttgatttcttcaagcacaagtatc

SEQ ID NO: 397955 - DNA, 25 bp, Mus musculus
tttgatttcttcaaggccaagaaga

SEQ ID NO: 397956 - DNA, 25 bp, Mus musculus
tttgattttcaggcagaaatttaat

SEQ ID NO: 397957 - DNA, 25 bp, Mus musculus
tttgattttcaggggctccaacacc

SEQ ID NO: 397958 - DNA, 25 bp, Mus musculus
tttgatttttacatggacttgacat

SEQ ID NO: 397959 - DNA, 25 bp, Mus musculus
tttgcaaagacgtgtgcaagaacta

SEQ ID NO: 397960 - DNA, 25 bp, Mus musculus
tttgcaaagacgtgtgtgtctgctg

SEQ ID NO: 397961 - DNA, 25 bp, Mus musculus
tttgcaaagagtgagttggcttcag

SEQ ID NO: 397962 - DNA, 25 bp, Mus musculus
tttgcaaagcagcaaataaccacat

SEQ ID NO: 397963 - DNA, 25 bp, Mus musculus
tttgcaaagcagcaatcccatatga

SEQ ID NO: 397964 - DNA, 25 bp, Mus musculus
tttgcaaagcgtctggcagcagaag

SEQ ID NO: 397965 - DNA, 25 bp, Mus musculus
tttgcaaagtaaaaacaaatataaa

SEQ ID NO: 397966 - DNA, 25 bp, Mus musculus
tttgcaaataccggtcaactattcc

SEQ ID NO: 397967 - DNA, 25 bp, Mus musculus
tttgcaagagcaaaatgtttcaaat

SEQ ID NO: 397968 - DNA, 25 bp, Mus musculus
tttgcaaggaagtgggaggcagttc

SEQ ID NO: 397969 - DNA, 25 bp, Mus musculus
tttgcaaggaagtggtataatggcc

SEQ ID NO: 397970 - DNA, 25 bp, Mus musculus
tttgcaagtcaggccgtctactgtg

SEQ ID NO: 397971 - DNA, 25 bp, Mus musculus
tttgcaagtcatgtcattgtgcttc

SEQ ID NO: 397972 - DNA, 25 bp, Mus musculus
tttgcaagtggattgtcttgcctgt

SEQ ID NO: 397973 - DNA, 25 bp, Mus musculus
tttgcaatcgatggcagctcaacgg

SEQ ID NO: 397974 - DNA, 25 bp, Mus musculus
tttgcaatttggaagggaggtcctg

SEQ ID NO: 397975 - DNA, 25 bp, Mus musculus
tttgcacaaagttcgagaaggaatc

SEQ ID NO: 397976 - DNA, 25 bp, Mus musculus
tttgcacaaatcaaggcatgctgtg

SEQ ID NO: 397977 - DNA, 25 bp, Mus musculus
tttgcacaaatcaaggtgacaaaag

SEQ ID NO: 397978 - DNA, 25 bp, Mus musculus
tttgcacaagacccacaccatcttc

SEQ ID NO: 397979 - DNA, 25 bp, Mus musculus
tttgcacaagggtttctctgtagcc

SEQ ID NO: 397980 - DNA, 25 bp, Mus musculus
tttgcacacagacacaagatggaat

SEQ ID NO: 397981 - DNA, 25 bp, Mus musculus
tttgcacacagatggagtggccgga

SEQ ID NO: 397982 - DNA, 25 bp, Mus musculus
tttgcacagcactgccagggggaag

SEQ ID NO: 397983 - DNA, 25 bp, Mus musculus
tttgcacattcagaaacgcatccca

SEQ ID NO: 397984 - DNA, 25 bp, Mus musculus
tttgcaccactgctgcgcaaggtat

SEQ ID NO: 397985 - DNA, 25 bp, Mus musculus
tttgcacccctactctttctgacct

SEQ ID NO: 397986 - DNA, 25 bp, Mus musculus
tttgcacctgcggacggcatcgctg

SEQ ID NO: 397987 - DNA, 25 bp, Mus musculus
tttgcacctgcggctctatcagaac

SEQ ID NO: 397988 - DNA, 25 bp, Mus musculus
tttgcacctgcgggtcagattatcg

SEQ ID NO: 397989 - DNA, 25 bp, Mus musculus
tttgcacgcacaggaaatcccaatg

SEQ ID NO: 397990 - DNA, 25 bp, Mus musculus
tttgcactcagcccccactgtagac

SEQ ID NO: 397991 - DNA, 25 bp, Mus musculus
tttgcactcagcgtacatgttgtga

SEQ ID NO: 397992 - DNA, 25 bp, Mus musculus
tttgcactgagcgggaactgagccg

SEQ ID NO: 397993 - DNA, 25 bp, Mus musculus
tttgcactgtgtgaccagcccatca

SEQ ID NO: 397994 - DNA, 25 bp, Mus musculus
tttgcagaagcaagatcccaaaagg

SEQ ID NO: 397995 - DNA, 25 bp, Mus musculus
tttgcagaagcaagtgttttgcctg

SEQ ID NO: 397996 - DNA, 25 bp, Mus musculus
tttgcagactgcggtgaggggagcc

SEQ ID NO: 397997 - DNA, 25 bp, Mus musculus
tttgcagagttctctgtcattgagg

SEQ ID NO: 397998 - DNA, 25 bp, Mus musculus
tttgcagatggaaagatgacatcgt

SEQ ID NO: 397999 - DNA, 25 bp, Mus musculus
tttgcagatggagggaagactcccg

SEQ ID NO: 398000 - DNA, 25 bp, Mus musculus
tttgcagatggtagaaggacaagaa

SEQ ID NO: 398001 - DNA, 25 bp, Mus musculus
tttgcagattcaaagttcacagtca

SEQ ID NO: 398002 - DNA, 25 bp, Mus musculus
tttgcagattcaaatgaccagcagt

SEQ ID NO: 398003 - DNA, 25 bp, Mus musculus
tttgcagccaaggccacagaggatc

SEQ ID NO: 398004 - DNA, 25 bp, Mus musculus
tttgcagccaagtccctgccgcctt

SEQ ID NO: 398005 - DNA, 25 bp, Mus musculus
tttgcaggaaactggagtgtgggtt

SEQ ID NO: 398006 - DNA, 25 bp, Mus musculus
tttgcaggaagcacgggggtaccat

SEQ ID NO: 398007 - DNA, 25 bp, Mus musculus
tttgcaggaagcacgggtggctgca

SEQ ID NO: 398008 - DNA, 25 bp, Mus musculus
tttgcaggaccacagaactacagct

SEQ ID NO: 398009 - DNA, 25 bp, Mus musculus
tttgcaggaccacagttatatatct

SEQ ID NO: 398010 - DNA, 25 bp, Mus musculus
tttgcaggctcaggactggaggacc

SEQ ID NO: 398011 - DNA, 25 bp, Mus musculus
tttgcaggtggtcaggacaggtaca

SEQ ID NO: 398012 - DNA, 25 bp, Mus musculus
tttgcaggtggtcaggcctatacca

SEQ ID NO: 398013 - DNA, 25 bp, Mus musculus
tttgcaggtggtcagttgaccaagc

SEQ ID NO: 398014 - DNA, 25 bp, Mus musculus
tttgcagtctatgctggaaacagct

SEQ ID NO: 398015 - DNA, 25 bp, Mus musculus
tttgcagtctatggactggaaacgg

SEQ ID NO: 398016 - DNA, 25 bp, Mus musculus
tttgcagtcttctggcagctcagag

SEQ ID NO: 398017 - DNA, 25 bp, Mus musculus
tttgcagttcaggtttgctgtctta

SEQ ID NO: 398018 - DNA, 25 bp, Mus musculus
tttgcataaagactgaccatcatca

SEQ ID NO: 398019 - DNA, 25 bp, Mus musculus
tttgcataggtgcctctcctttccc

SEQ ID NO: 398020 - DNA, 25 bp, Mus musculus
tttgcatatcagatctgatgttttg

SEQ ID NO: 398021 - DNA, 25 bp, Mus musculus
tttgcatatgttcaatttgaggatg

SEQ ID NO: 398022 - DNA, 25 bp, Mus musculus
tttgcatattttgtgagttcaaaat

SEQ ID NO: 398023 - DNA, 25 bp, Mus musculus
tttgcatcagacagggcaacgtttc

SEQ ID NO: 398024 - DNA, 25 bp, Mus musculus
tttgcatgaagttgcaagaagacac

SEQ ID NO: 398025 - DNA, 25 bp, Mus musculus
tttgcatgcaaggcttgttccccct

SEQ ID NO: 398026 - DNA, 25 bp, Mus musculus
tttgcatgcaaggtacagaagaaag

SEQ ID NO: 398027 - DNA, 25 bp, Mus musculus
tttgcatgctaggagatgtacgact

SEQ ID NO: 398028 - DNA, 25 bp, Mus musculus
tttgcattcacagacacggctaagg

SEQ ID NO: 398029 - DNA, 25 bp, Mus musculus
tttgcattcacagggtacagattta

SEQ ID NO: 398030 - DNA, 25 bp, Mus musculus
tttgcattccgcttgcttcccagag

SEQ ID NO: 398031 - DNA, 25 bp, Mus musculus
tttgcattctcagcatggtgagaca

SEQ ID NO: 398032 - DNA, 25 bp, Mus musculus
tttgcatttaggaggactgacaaac

SEQ ID NO: 398033 - DNA, 25 bp, Mus musculus
tttgccaaagcagggctgcaggtgg

SEQ ID NO: 398034 - DNA, 25 bp, Mus musculus
tttgccaaaggtgttttacatgagc

SEQ ID NO: 398035 - DNA, 25 bp, Mus musculus
tttgccaagacatactccagtgatt

SEQ ID NO: 398036 - DNA, 25 bp, Mus musculus
tttgccaagaccggacagggtctca

SEQ ID NO: 398037 - DNA, 25 bp, Mus musculus
tttgccaagaccggggatcccaaca

SEQ ID NO: 398038 - DNA, 25 bp, Mus musculus
tttgccaagatctggtggatcgcac

SEQ ID NO: 398039 - DNA, 25 bp, Mus musculus
tttgccaagatcttgatccagtttt

SEQ ID NO: 398040 - DNA, 25 bp, Mus musculus
tttgccaagcagatgaaggggctgg

SEQ ID NO: 398041 - DNA, 25 bp, Mus musculus
tttgccaagcaggtaattaataatg

SEQ ID NO: 398042 - DNA, 25 bp, Mus musculus
tttgccaagccccctcttgaatttt

SEQ ID NO: 398043 - DNA, 25 bp, Mus musculus
tttgccaaggggaacttccccagag

SEQ ID NO: 398044 - DNA, 25 bp, Mus musculus
tttgccaataatccgtgccggcata

SEQ ID NO: 398045 - DNA, 25 bp, Mus musculus
tttgccaataatgcagaccagcagt

SEQ ID NO: 398046 - DNA, 25 bp, Mus musculus
tttgccacaacagaaagcctaaaac

SEQ ID NO: 398047 - DNA, 25 bp, Mus musculus
tttgccacacagtgaagatgccatc

SEQ ID NO: 398048 - DNA, 25 bp, Mus musculus
tttgccactgctttgcctgtacccc

SEQ ID NO: 398049 - DNA, 25 bp, Mus musculus
tttgccagaaggaacctgaatgaac

SEQ ID NO: 398050 - DNA, 25 bp, Mus musculus
tttgccagcaagagaatccgggctg

SEQ ID NO: 398051 - DNA, 25 bp, Mus musculus
tttgccagctccggaactctgtgga

SEQ ID NO: 398052 - DNA, 25 bp, Mus musculus
tttgccagctccgggcatgggatat

SEQ ID NO: 398053 - DNA, 25 bp, Mus musculus
tttgccagggagatgccattgggta

SEQ ID NO: 398054 - DNA, 25 bp, Mus musculus
tttgccagttgcaagtattcccctt

SEQ ID NO: 398055 - DNA, 25 bp, Mus musculus
tttgccatcaccaagatgacacttg

SEQ ID NO: 398056 - DNA, 25 bp, Mus musculus
tttgccatcaccaaggaagatttgg

SEQ ID NO: 398057 - DNA, 25 bp, Mus musculus
tttgccatcaccaaggatcagttca

SEQ ID NO: 398058 - DNA, 25 bp, Mus musculus
tttgccatcaggtattggcttgctt

SEQ ID NO: 398059 - DNA, 25 bp, Mus musculus
tttgccatcctcggtttctacttat

SEQ ID NO: 398060 - DNA, 25 bp, Mus musculus
tttgccatggaatccacagttgatg

SEQ ID NO: 398061 - DNA, 25 bp, Mus musculus
tttgccatggaatccctttcagaaa

SEQ ID NO: 398062 - DNA, 25 bp, Mus musculus
tttgccatggaatccgataaagata

SEQ ID NO: 398063 - DNA, 25 bp, Mus musculus
tttgcccaattctgggacactcact

SEQ ID NO: 398064 - DNA, 25 bp, Mus musculus
tttgcccacctggctggtttggaca

SEQ ID NO: 398065 - DNA, 25 bp, Mus musculus
tttgcccacctggtacccaggatat

SEQ ID NO: 398066 - DNA, 25 bp, Mus musculus
tttgcccattgatttaggtcgctcc

SEQ ID NO: 398067 - DNA, 25 bp, Mus musculus
tttgcccccaaagatcatccagctc

SEQ ID NO: 398068 - DNA, 25 bp, Mus musculus
tttgcccccaaagctcctgtgccag

SEQ ID NO: 398069 - DNA, 25 bp, Mus musculus
tttgccctcaggcaccgaataaacc

SEQ ID NO: 398070 - DNA, 25 bp, Mus musculus
tttgccctcaggttcattctgaatc

SEQ ID NO: 398071 - DNA, 25 bp, Mus musculus
tttgcccttaaggccctggaattcc

SEQ ID NO: 398072 - DNA, 25 bp, Mus musculus
tttgcccttaaggtccctgccctcc

SEQ ID NO: 398073 - DNA, 25 bp, Mus musculus
tttgccgatcacagggagaacattc

SEQ ID NO: 398074 - DNA, 25 bp, Mus musculus
tttgccgatcagaaccagtttgaca

SEQ ID NO: 398075 - DNA, 25 bp, Mus musculus
tttgccgatcagctatatttctctt

SEQ ID NO: 398076 - DNA, 25 bp, Mus musculus
tttgccgcagccagccctctgcccg

SEQ ID NO: 398077 - DNA, 25 bp, Mus musculus
tttgccgcaggcccggcacagtcag

SEQ ID NO: 398078 - DNA, 25 bp, Mus musculus
tttgccgcagggggtgctacagaag

SEQ ID NO: 398079 - DNA, 25 bp, Mus musculus
tttgccgcaggggtcatgttagcgg

SEQ ID NO: 398080 - DNA, 25 bp, Mus musculus
tttgccgttaaacctgaagaatcac

SEQ ID NO: 398081 - DNA, 25 bp, Mus musculus
tttgccgttaaatgtgggaacttcg

SEQ ID NO: 398082 - DNA, 25 bp, Mus musculus
tttgccgttgcaagatcgatgatga

SEQ ID NO: 398083 - DNA, 25 bp, Mus musculus
tttgcctaatttggctgagtatgag

SEQ ID NO: 398084 - DNA, 25 bp, Mus musculus
tttgcctacaaacctggtctgaagc

SEQ ID NO: 398085 - DNA, 25 bp, Mus musculus
tttgcctacaaacctgtcgacttaa

SEQ ID NO: 398086 - DNA, 25 bp, Mus musculus
tttgcctagcttctgaagttgtaat

SEQ ID NO: 398087 - DNA, 25 bp, Mus musculus
tttgcctatatgaggttggcgcatc

SEQ ID NO: 398088 - DNA, 25 bp, Mus musculus
tttgcctcaggtgacactggagctg

SEQ ID NO: 398089 - DNA, 25 bp, Mus musculus
tttgcctcggcgcggatgtggttag

SEQ ID NO: 398090 - DNA, 25 bp, Mus musculus
tttgcctgaatcgcccaagagccta

SEQ ID NO: 398091 - DNA, 25 bp, Mus musculus
tttgcctgcactggcacacaggcat

SEQ ID NO: 398092 - DNA, 25 bp, Mus musculus
tttgcctgtagagacagctgcatct

SEQ ID NO: 398093 - DNA, 25 bp, Mus musculus
tttgcctgtcagtcccaggtcctgc

SEQ ID NO: 398094 - DNA, 25 bp, Mus musculus
tttgcctgtgaggtttctgtttaca

SEQ ID NO: 398095 - DNA, 25 bp, Mus musculus
tttgccttccgagatgagacggcag

SEQ ID NO: 398096 - DNA, 25 bp, Mus musculus
tttgccttccgagggcagtactgct

SEQ ID NO: 398097 - DNA, 25 bp, Mus musculus
tttgcctttgcaggtgacagcagca

SEQ ID NO: 398098 - DNA, 25 bp, Mus musculus
tttgcgacttggacctttgggcgac

SEQ ID NO: 398099 - DNA, 25 bp, Mus musculus
tttgcgcaacgaaaaattcatttgc

SEQ ID NO: 398100 - DNA, 25 bp, Mus musculus
tttgcgcaacgaatcctgactgttc

SEQ ID NO: 398101 - DNA, 25 bp, Mus musculus
tttgcgcagaggttacatcggcgtg

SEQ ID NO: 398102 - DNA, 25 bp, Mus musculus
tttgcgcatcctgcagccacattgc

SEQ ID NO: 398103 - DNA, 25 bp, Mus musculus
tttgcgctcagggaaaggtgaacat

SEQ ID NO: 398104 - DNA, 25 bp, Mus musculus
tttgcgctcagggcatccatgtgaa

SEQ ID NO: 398105 - DNA, 25 bp, Mus musculus
tttgcgctgtatagaatgcggggtt

SEQ ID NO: 398106 - DNA, 25 bp, Mus musculus
tttgcgtacagggatcttgtccttt

SEQ ID NO: 398107 - DNA, 25 bp, Mus musculus
tttgcgtacagggggtggtactggg

SEQ ID NO: 398108 - DNA, 25 bp, Mus musculus
tttgcgtggagttacagctgccttg

SEQ ID NO: 398109 - DNA, 25 bp, Mus musculus
tttgcgtgttgctggatgagtattg

SEQ ID NO: 398110 - DNA, 25 bp, Mus musculus
tttgcgtgttgctggctgccatgcc

SEQ ID NO: 398111 - DNA, 25 bp, Mus musculus
tttgcgtgttgctggctggattgcc

SEQ ID NO: 398112 - DNA, 25 bp, Mus musculus
tttgcgttctcaggatccaaaggga

SEQ ID NO: 398113 - DNA, 25 bp, Mus musculus
tttgcgttctcgagcttcatggggt

SEQ ID NO: 398114 - DNA, 25 bp, Mus musculus
tttgcgtttttcaaggatgtcactg

SEQ ID NO: 398115 - DNA, 25 bp, Mus musculus
tttgcgtttttcaagtatgaagtca

SEQ ID NO: 398116 - DNA, 25 bp, Mus musculus
tttgctaaaggaagacttcgctgat

SEQ ID NO: 398117 - DNA, 25 bp, Mus musculus
tttgctacaacgctaacagttcctt

SEQ ID NO: 398118 - DNA, 25 bp, Mus musculus
tttgctacacaaatggctacacgga

SEQ ID NO: 398119 - DNA, 25 bp, Mus musculus
tttgctagaggtagaagagccacag

SEQ ID NO: 398120 - DNA, 25 bp, Mus musculus
tttgctataaagcagtatcgtcatc

SEQ ID NO: 398121 - DNA, 25 bp, Mus musculus
tttgctatgaacctgcagccagcag

SEQ ID NO: 398122 - DNA, 25 bp, Mus musculus
tttgctatgaacgagcagttttggc

SEQ ID NO: 398123 - DNA, 25 bp, Mus musculus
tttgctattggccaggctggccttg

SEQ ID NO: 398124 - DNA, 25 bp, Mus musculus
tttgctattgggcacaaatatgcca

SEQ ID NO: 398125 - DNA, 25 bp, Mus musculus
tttgctattggggggctctgcaacc

SEQ ID NO: 398126 - DNA, 25 bp, Mus musculus
tttgctattgtctaaatctcaggtt

SEQ ID NO: 398127 - DNA, 25 bp, Mus musculus
tttgctcacctgcggcttgggtgac

SEQ ID NO: 398128 - DNA, 25 bp, Mus musculus
tttgctcagggtgcagtgagcctgc

SEQ ID NO: 398129 - DNA, 25 bp, Mus musculus
tttgctcgaaatgggaaccctaatg

SEQ ID NO: 398130 - DNA, 25 bp, Mus musculus
tttgctcgaagttgtccagtctggc

SEQ ID NO: 398131 - DNA, 25 bp, Mus musculus
tttgctcgaggagtgcatgggtaca

SEQ ID NO: 398132 - DNA, 25 bp, Mus musculus
tttgctcgccgcacctgcctcagta

SEQ ID NO: 398133 - DNA, 25 bp, Mus musculus
tttgctcggaatgggaaccctaatg

SEQ ID NO: 398134 - DNA, 25 bp, Mus musculus
tttgctctcacccgcccgagttcgt

SEQ ID NO: 398135 - DNA, 25 bp, Mus musculus
tttgctctcacccggtacttggtgg

SEQ ID NO: 398136 - DNA, 25 bp, Mus musculus
tttgctctgaagattgtgcccacct

SEQ ID NO: 398137 - DNA, 25 bp, Mus musculus
tttgctctgaaggtttcttttgatc

SEQ ID NO: 398138 - DNA, 25 bp, Mus musculus
tttgctcttggcactaaacaagatt

SEQ ID NO: 398139 - DNA, 25 bp, Mus musculus
tttgctcttggggagatgcgaaaaa

SEQ ID NO: 398140 - DNA, 25 bp, Mus musculus
tttgctgaaagtgaaacactagacc

SEQ ID NO: 398141 - DNA, 25 bp, Mus musculus
tttgctgaaagtgaaaccagaggag

SEQ ID NO: 398142 - DNA, 25 bp, Mus musculus
tttgctgaaatgcacctagtgtgta

SEQ ID NO: 398143 - DNA, 25 bp, Mus musculus
tttgctgaaatggtgacccgcaggg

SEQ ID NO: 398144 - DNA, 25 bp, Mus musculus
tttgctgaagaccaaggactggtgg

SEQ ID NO: 398145 - DNA, 25 bp, Mus musculus
tttgctgaagcagaactgtgtgtgg

SEQ ID NO: 398146 - DNA, 25 bp, Mus musculus
tttgctgaagcagctcaccatgtcc

SEQ ID NO: 398147 - DNA, 25 bp, Mus musculus
tttgctgaagcaggacacaccagga

SEQ ID NO: 398148 - DNA, 25 bp, Mus musculus
tttgctgaccagaatttttcagatt

SEQ ID NO: 398149 - DNA, 25 bp, Mus musculus
tttgctgaccagctgtatatctgtg

SEQ ID NO: 398150 - DNA, 25 bp, Mus musculus
tttgctgagaggttttctcaagaat

SEQ ID NO: 398151 - DNA, 25 bp, Mus musculus
tttgctgagagtgctcacaggctgg

SEQ ID NO: 398152 - DNA, 25 bp, Mus musculus
tttgctgagagtgtgtgactccctc

SEQ ID NO: 398153 - DNA, 25 bp, Mus musculus
tttgctgcacaggagggtcacttcc

SEQ ID NO: 398154 - DNA, 25 bp, Mus musculus
tttgctgcagacagtcttcatcagc

SEQ ID NO: 398155 - DNA, 25 bp, Mus musculus
tttgctgcatacccctgcccagatc

SEQ ID NO: 398156 - DNA, 25 bp, Mus musculus
tttgctgccatcaaattatttttaa

SEQ ID NO: 398157 - DNA, 25 bp, Mus musculus
tttgctgccctgcagtaccacatca

SEQ ID NO: 398158 - DNA, 25 bp, Mus musculus
tttgctgcctcacaggtggatacct

SEQ ID NO: 398159 - DNA, 25 bp, Mus musculus
tttgctgctcactgacagggtttct

SEQ ID NO: 398160 - DNA, 25 bp, Mus musculus
tttgctgctcactgcattggatacc

SEQ ID NO: 398161 - DNA, 25 bp, Mus musculus
tttgctgctggattcgatgatatgg

SEQ ID NO: 398162 - DNA, 25 bp, Mus musculus
tttgctggccagcagtgacgcgccg

SEQ ID NO: 398163 - DNA, 25 bp, Mus musculus
tttgctggtgaaggttcaattgtga

SEQ ID NO: 398164 - DNA, 25 bp, Mus musculus
tttgctggtgaagttatgtaatcca

SEQ ID NO: 398165 - DNA, 25 bp, Mus musculus
tttgctggtgctccggcattgcagc

SEQ ID NO: 398166 - DNA, 25 bp, Mus musculus
tttgctggtgctccgtggaccctaa

SEQ ID NO: 398167 - DNA, 25 bp, Mus musculus
tttgctggtggtggcatcgtttgca

SEQ ID NO: 398168 - DNA, 25 bp, Mus musculus
tttgctggtggtgttcagacagtaa

SEQ ID NO: 398169 - DNA, 25 bp, Mus musculus
tttgctgtaaaagagaggaggctca

SEQ ID NO: 398170 - DNA, 25 bp, Mus musculus
tttgctgtaccagatcccacaacgt

SEQ ID NO: 398171 - DNA, 25 bp, Mus musculus
tttgctgtggagatcggcctggcct

SEQ ID NO: 398172 - DNA, 25 bp, Mus musculus
tttgctgtggagctccttcaaaaaa

SEQ ID NO: 398173 - DNA, 25 bp, Mus musculus
tttgctgtgggaaagtacattgagc

SEQ ID NO: 398174 - DNA, 25 bp, Mus musculus
tttgctgttctgtgattcttactgg

SEQ ID NO: 398175 - DNA, 25 bp, Mus musculus
tttgcttaggtcttgtctgtattcc

SEQ ID NO: 398176 - DNA, 25 bp, Mus musculus
tttgcttccagatggcctaccttct

SEQ ID NO: 398177 - DNA, 25 bp, Mus musculus
tttgcttctccaccatcccttccag

SEQ ID NO: 398178 - DNA, 25 bp, Mus musculus
tttgcttctgaggtggtcctggact

SEQ ID NO: 398179 - DNA, 25 bp, Mus musculus
tttgcttgaatgggcctgtgtttta

SEQ ID NO: 398180 - DNA, 25 bp, Mus musculus
tttgcttgaggtaatccattgtctg

SEQ ID NO: 398181 - DNA, 25 bp, Mus musculus
tttgcttgaggtagtccattgtctg

SEQ ID NO: 398182 - DNA, 25 bp, Mus musculus
tttgcttgcaaacaggatgtctctc

SEQ ID NO: 398183 - DNA, 25 bp, Mus musculus
tttgcttggtgggttcaggggtgat

SEQ ID NO: 398184 - DNA, 25 bp, Mus musculus
tttgcttgtaaggtgcaaaagaagg

SEQ ID NO: 398185 - DNA, 25 bp, Mus musculus
tttgctttcagaagaatatgacaga

SEQ ID NO: 398186 - DNA, 25 bp, Mus musculus
tttgctttccacatgtctgccagga

SEQ ID NO: 398187 - DNA, 25 bp, Mus musculus
tttgctttccagaatgggcaaagga

SEQ ID NO: 398188 - DNA, 25 bp, Mus musculus
tttgctttccatgggtcccacattg

SEQ ID NO: 398189 - DNA, 25 bp, Mus musculus
tttgctttgatgaaaaaacaaaaac

SEQ ID NO: 398190 - DNA, 25 bp, Mus musculus
tttgctttgcttgaggtagtccatt

SEQ ID NO: 398191 - DNA, 25 bp, Mus musculus
tttgctttggatggtatgccttaca

SEQ ID NO: 398192 - DNA, 25 bp, Mus musculus
tttgctttgtattacgtgcactcta

SEQ ID NO: 398193 - DNA, 25 bp, Mus musculus
tttggaaaaaagctctcttaagagc

SEQ ID NO: 398194 - DNA, 25 bp, Mus musculus
tttggaaaaaagttctaggcaagaa

SEQ ID NO: 398195 - DNA, 25 bp, Mus musculus
tttggaaaaacagaggccagagggc

SEQ ID NO: 398196 - DNA, 25 bp, Mus musculus
tttggaaaaacagggcttcaagcag

SEQ ID NO: 398197 - DNA, 25 bp, Mus musculus
tttggaaacgccattatttgcattt

SEQ ID NO: 398198 - DNA, 25 bp, Mus musculus
tttggaaacggattctgctctaata

SEQ ID NO: 398199 - DNA, 25 bp, Mus musculus
tttggaaactctccccccatcttca

SEQ ID NO: 398200 - DNA, 25 bp, Mus musculus
tttggaaactctccgcccatcttca

SEQ ID NO: 398201 - DNA, 25 bp, Mus musculus
tttggaaacttcaggagtcatggct

SEQ ID NO: 398202 - DNA, 25 bp, Mus musculus
tttggaaagaaagatgcaccaacaa

SEQ ID NO: 398203 - DNA, 25 bp, Mus musculus
tttggaaagggacatcatcgaaggg

SEQ ID NO: 398204 - DNA, 25 bp, Mus musculus
tttggaaaggtttttcttgatattt

SEQ ID NO: 398205 - DNA, 25 bp, Mus musculus
tttggaaatgagacgagaatgatgt

SEQ ID NO: 398206 - DNA, 25 bp, Mus musculus
tttggaaatgagacggaagctgcca

SEQ ID NO: 398207 - DNA, 25 bp, Mus musculus
tttggaaatgagacgtgctggagat

SEQ ID NO: 398208 - DNA, 25 bp, Mus musculus
tttggaaattgccgcagatgaccct

SEQ ID NO: 398209 - DNA, 25 bp, Mus musculus
tttggaacaagtcaggctccaaaaa

SEQ ID NO: 398210 - DNA, 25 bp, Mus musculus
tttggaacagattcaagtcaatctg

SEQ ID NO: 398211 - DNA, 25 bp, Mus musculus
tttggaacatagacaacatagaaaa

SEQ ID NO: 398212 - DNA, 25 bp, Mus musculus
tttggaaccaagagatgcaccttgc

SEQ ID NO: 398213 - DNA, 25 bp, Mus musculus
tttggaaccaagagtttctagctct

SEQ ID NO: 398214 - DNA, 25 bp, Mus musculus
tttggaactagagttggtgacacac

SEQ ID NO: 398215 - DNA, 25 bp, Mus musculus
tttggaactaggtgcaagaatattt

SEQ ID NO: 398216 - DNA, 25 bp, Mus musculus
tttggaacttcctcgtcccatctct

SEQ ID NO: 398217 - DNA, 25 bp, Mus musculus
tttggaagaaatacaagaaaaattc

SEQ ID NO: 398218 - DNA, 25 bp, Mus musculus
tttggaagaagacgtcaaactccgt

SEQ ID NO: 398219 - DNA, 25 bp, Mus musculus
tttggaagaagagaaccacaaactc

SEQ ID NO: 398220 - DNA, 25 bp, Mus musculus
tttggaagaagtcagttaaggagga

SEQ ID NO: 398221 - DNA, 25 bp, Mus musculus
tttggaagaatttcagatgcccgtg

SEQ ID NO: 398222 - DNA, 25 bp, Mus musculus
tttggaagaatttcagtgtctctga

SEQ ID NO: 398223 - DNA, 25 bp, Mus musculus
tttggaagagacctcaattattgtt

SEQ ID NO: 398224 - DNA, 25 bp, Mus musculus
tttggaagatgtcggtcaataggct

SEQ ID NO: 398225 - DNA, 25 bp, Mus musculus
tttggaagcaacaaggctgagatgg

SEQ ID NO: 398226 - DNA, 25 bp, Mus musculus
tttggaagccaggagattagagtgg

SEQ ID NO: 398227 - DNA, 25 bp, Mus musculus
tttggaagccaggagtgggcctgag

SEQ ID NO: 398228 - DNA, 25 bp, Mus musculus
tttggaagctacgcttacacaacct

SEQ ID NO: 398229 - DNA, 25 bp, Mus musculus
tttggaaggaagttctcctcggacc

SEQ ID NO: 398230 - DNA, 25 bp, Mus musculus
tttggaaggaggccatgtcatgatt

SEQ ID NO: 398231 - DNA, 25 bp, Mus musculus
tttggaagttttttgggcattgttg

SEQ ID NO: 398232 - DNA, 25 bp, Mus musculus
tttggaagttttttggttgcaagga

SEQ ID NO: 398233 - DNA, 25 bp, Mus musculus
tttggaatctcaaggatgtcacagt

SEQ ID NO: 398234 - DNA, 25 bp, Mus musculus
tttggaatgaagggtcctgtggctg

SEQ ID NO: 398235 - DNA, 25 bp, Mus musculus
tttggaattgatccgatttggaacc

SEQ ID NO: 398236 - DNA, 25 bp, Mus musculus
tttggaattgatccgtgtgccattg

SEQ ID NO: 398237 - DNA, 25 bp, Mus musculus
tttggacaagatgtttaagacaagg

SEQ ID NO: 398238 - DNA, 25 bp, Mus musculus
tttggacagatcaagaacctgctgg

SEQ ID NO: 398239 - DNA, 25 bp, Mus musculus
tttggacagatcaagcgtctcagaa

SEQ ID NO: 398240 - DNA, 25 bp, Mus musculus
tttggacagtcttgcaatgtttcta

SEQ ID NO: 398241 - DNA, 25 bp, Mus musculus
tttggacagtgagctggtgacccct

SEQ ID NO: 398242 - DNA, 25 bp, Mus musculus
tttggacagtgttgcaatgtttcta

SEQ ID NO: 398243 - DNA, 25 bp, Mus musculus
tttggacatgccagggctgtagcag

SEQ ID NO: 398244 - DNA, 25 bp, Mus musculus
tttggacatgctgtgaatattctag

SEQ ID NO: 398245 - DNA, 25 bp, Mus musculus
tttggacatgctgtgatggacatac

SEQ ID NO: 398246 - DNA, 25 bp, Mus musculus
tttggacatggactgaagcccttag

SEQ ID NO: 398247 - DNA, 25 bp, Mus musculus
tttggacatggcccttagatgttgc

SEQ ID NO: 398248 - DNA, 25 bp, Mus musculus
tttggaccaaagacccagccattcg

SEQ ID NO: 398249 - DNA, 25 bp, Mus musculus
tttggaccaactgttctcagtttgg

SEQ ID NO: 398250 - DNA, 25 bp, Mus musculus
tttggaccacctggtccaagagggt

SEQ ID NO: 398251 - DNA, 25 bp, Mus musculus
tttggacccatcagctatgtggtgg

SEQ ID NO: 398252 - DNA, 25 bp, Mus musculus
tttggaccgactcgttactgatgtc

SEQ ID NO: 398253 - DNA, 25 bp, Mus musculus
tttggaccgactggttactgatgtc

SEQ ID NO: 398254 - DNA, 25 bp, Mus musculus
tttggaccggcacgtgtcggagctc

SEQ ID NO: 398255 - DNA, 25 bp, Mus musculus
tttggacctccctccaactcttctg

SEQ ID NO: 398256 - DNA, 25 bp, Mus musculus
tttggacggccagggggtggcaccg

SEQ ID NO: 398257 - DNA, 25 bp, Mus musculus
tttggactatataagatatccagaa

SEQ ID NO: 398258 - DNA, 25 bp, Mus musculus
tttggactatataaggtaaatgaat

SEQ ID NO: 398259 - DNA, 25 bp, Mus musculus
tttggactcagaggcttgctgcatt

SEQ ID NO: 398260 - DNA, 25 bp, Mus musculus
tttggactggtttggtgttcatcat

SEQ ID NO: 398261 - DNA, 25 bp, Mus musculus
tttggagaaaaatgtggaattggtt

SEQ ID NO: 398262 - DNA, 25 bp, Mus musculus
tttggagaaatatgtggaattggtt

SEQ ID NO: 398263 - DNA, 25 bp, Mus musculus
tttggagaagaaccatcagtcatct

SEQ ID NO: 398264 - DNA, 25 bp, Mus musculus
tttggagaagaccaacctggtcttg

SEQ ID NO: 398265 - DNA, 25 bp, Mus musculus
tttggagaaggagcttcagtgactc

SEQ ID NO: 398266 - DNA, 25 bp, Mus musculus
tttggagaaggatcttcaagctact

SEQ ID NO: 398267 - DNA, 25 bp, Mus musculus
tttggagaaggtacattattttgtt

SEQ ID NO: 398268 - DNA, 25 bp, Mus musculus
tttggagaatgcagttccttttagt

SEQ ID NO: 398269 - DNA, 25 bp, Mus musculus
tttggagaattacagtactgtttat

SEQ ID NO: 398270 - DNA, 25 bp, Mus musculus
tttggagaattgcagtactgtttat

SEQ ID NO: 398271 - DNA, 25 bp, Mus musculus
tttggagaccataggacaaggatga

SEQ ID NO: 398272 - DNA, 25 bp, Mus musculus
tttggagaggatgaggaagccatgg

SEQ ID NO: 398273 - DNA, 25 bp, Mus musculus
tttggagagtggatggcaggagaac

SEQ ID NO: 398274 - DNA, 25 bp, Mus musculus
tttggagatatgagacgaaagtagg

SEQ ID NO: 398275 - DNA, 25 bp, Mus musculus
tttggagatatgaggtactccatcc

SEQ ID NO: 398276 - DNA, 25 bp, Mus musculus
tttggagatctgagcacagccagcg

SEQ ID NO: 398277 - DNA, 25 bp, Mus musculus
tttggagatctgagccatggatttc

SEQ ID NO: 398278 - DNA, 25 bp, Mus musculus
tttggagatgaagtgacttcaatcc

SEQ ID NO: 398279 - DNA, 25 bp, Mus musculus
tttggagatgaagtgatgactcgtt

SEQ ID NO: 398280 - DNA, 25 bp, Mus musculus
tttggagattcattgaattctgtct

SEQ ID NO: 398281 - DNA, 25 bp, Mus musculus
tttggagattggggcctgtgtttta

SEQ ID NO: 398282 - DNA, 25 bp, Mus musculus
tttggagcagacgcgaaactggatg

SEQ ID NO: 398283 - DNA, 25 bp, Mus musculus
tttggagcagtggccgtgcctgcag

SEQ ID NO: 398284 - DNA, 25 bp, Mus musculus
tttggagccagacacttgtctccta

SEQ ID NO: 398285 - DNA, 25 bp, Mus musculus
tttggagccagcgacccatacgtga

SEQ ID NO: 398286 - DNA, 25 bp, Mus musculus
tttggagccgactgggctgtttcca

SEQ ID NO: 398287 - DNA, 25 bp, Mus musculus
tttggagctcgaggtaaagaaaacg

SEQ ID NO: 398288 - DNA, 25 bp, Mus musculus
tttggaggagtatagaacattgcat

SEQ ID NO: 398289 - DNA, 25 bp, Mus musculus
tttggaggagtgggatcgagtggga

SEQ ID NO: 398290 - DNA, 25 bp, Mus musculus
tttggaggatcctccaggtggcttt

SEQ ID NO: 398291 - DNA, 25 bp, Mus musculus
tttggagggagttatggggggatgc

SEQ ID NO: 398292 - DNA, 25 bp, Mus musculus
tttggagggggtcagctagaagagt

SEQ ID NO: 398293 - DNA, 25 bp, Mus musculus
tttggaggttctggaacagctaatc

SEQ ID NO: 398294 - DNA, 25 bp, Mus musculus
tttggaggttctggacggcatttgc

SEQ ID NO: 398295 - DNA, 25 bp, Mus musculus
tttggaggttctgggacagcaactg

SEQ ID NO: 398296 - DNA, 25 bp, Mus musculus
tttggagtaacagctagaaattgca

SEQ ID NO: 398297 - DNA, 25 bp, Mus musculus
tttggagtagatcaatccccttctg

SEQ ID NO: 398298 - DNA, 25 bp, Mus musculus
tttggagtcaagttctccaaggaga

SEQ ID NO: 398299 - DNA, 25 bp, Mus musculus
tttggatactcaggaatgggcaaag

SEQ ID NO: 398300 - DNA, 25 bp, Mus musculus
tttggatatggggtgcttcgagtgc

SEQ ID NO: 398301 - DNA, 25 bp, Mus musculus
tttggatgaccagagagtgatgtgg

SEQ ID NO: 398302 - DNA, 25 bp, Mus musculus
tttggatgaccagagccccgggcct

SEQ ID NO: 398303 - DNA, 25 bp, Mus musculus
tttggatgatacagacgtcctacaa

SEQ ID NO: 398304 - DNA, 25 bp, Mus musculus
tttggattcagacgatgtcatgatg

SEQ ID NO: 398305 - DNA, 25 bp, Mus musculus
tttggattcataggggcttcttctg

SEQ ID NO: 398306 - DNA, 25 bp, Mus musculus
tttggatttgtggagtctggccaca

SEQ ID NO: 398307 - DNA, 25 bp, Mus musculus
tttggatttgtgggggccagaacaa

SEQ ID NO: 398308 - DNA, 25 bp, Mus musculus
tttggcaaatggagtattggcttcc

SEQ ID NO: 398309 - DNA, 25 bp, Mus musculus
tttggcaacaacgctctggtgcaag

SEQ ID NO: 398310 - DNA, 25 bp, Mus musculus
tttggcaacgaaaggtctccgggca

SEQ ID NO: 398311 - DNA, 25 bp, Mus musculus
tttggcaagtttgggcctgccttaa

SEQ ID NO: 398312 - DNA, 25 bp, Mus musculus
tttggcaatctatgattcctgtgtt

SEQ ID NO: 398313 - DNA, 25 bp, Mus musculus
tttggcaatgatggaagcaattttg

SEQ ID NO: 398314 - DNA, 25 bp, Mus musculus
tttggcaatgatggtggctatggcg

SEQ ID NO: 398315 - DNA, 25 bp, Mus musculus
tttggcaatgatggtggttatggag

SEQ ID NO: 398316 - DNA, 25 bp, Mus musculus
tttggcacatacgtgcagttctccg

SEQ ID NO: 398317 - DNA, 25 bp, Mus musculus
tttggcacccaaatgcctggggagg

SEQ ID NO: 398318 - DNA, 25 bp, Mus musculus
tttggcacccaaatgttgataaaaa

SEQ ID NO: 398319 - DNA, 25 bp, Mus musculus
tttggcagagagcactccccatatg

SEQ ID NO: 398320 - DNA, 25 bp, Mus musculus
tttggcagcggatctccatctttcc

SEQ ID NO: 398321 - DNA, 25 bp, Mus musculus
tttggcagtggccagacaggtggag

SEQ ID NO: 398322 - DNA, 25 bp, Mus musculus
tttggcatcaaggagacatcaacaa

SEQ ID NO: 398323 - DNA, 25 bp, Mus musculus
tttggcatctacaaggctcacttgt

SEQ ID NO: 398324 - DNA, 25 bp, Mus musculus
tttggcatctacaagggcgccaaag

SEQ ID NO: 398325 - DNA, 25 bp, Mus musculus
tttggcatgaaaggaggaagcggct

SEQ ID NO: 398326 - DNA, 25 bp, Mus musculus
tttggcatgaaaggcccagcttcgg

SEQ ID NO: 398327 - DNA, 25 bp, Mus musculus
tttggcatgaaaggttttgttttgt

SEQ ID NO: 398328 - DNA, 25 bp, Mus musculus
tttggcatgctggtttcaccatcgc

SEQ ID NO: 398329 - DNA, 25 bp, Mus musculus
tttggccaaagttatctccctaggc

SEQ ID NO: 398330 - DNA, 25 bp, Mus musculus
tttggccaaatggcaccgctccaaa

SEQ ID NO: 398331 - DNA, 25 bp, Mus musculus
tttggccaagatccccagcctcagc

SEQ ID NO: 398332 - DNA, 25 bp, Mus musculus
tttggccacaccaaggtgttcttca

SEQ ID NO: 398333 - DNA, 25 bp, Mus musculus
tttggccacggatccgggaggagat

SEQ ID NO: 398334 - DNA, 25 bp, Mus musculus
tttggccacgggctccggccattgg

SEQ ID NO: 398335 - DNA, 25 bp, Mus musculus
tttggccccaaaggtgtgaacattg

SEQ ID NO: 398336 - DNA, 25 bp, Mus musculus
tttggccccagaagtcggtgacctt

SEQ ID NO: 398337 - DNA, 25 bp, Mus musculus
tttggccccagggcctgagccatgg

SEQ ID NO: 398338 - DNA, 25 bp, Mus musculus
tttggccctccttcacgtagaaaat

SEQ ID NO: 398339 - DNA, 25 bp, Mus musculus
tttggccctgagatgacaaatcctc

SEQ ID NO: 398340 - DNA, 25 bp, Mus musculus
tttggccgcaggttctctccactat

SEQ ID NO: 398341 - DNA, 25 bp, Mus musculus
tttggccgtaggtttagtctccact

SEQ ID NO: 398342 - DNA, 25 bp, Mus musculus
tttggcctatgcaggagggagcctc

SEQ ID NO: 398343 - DNA, 25 bp, Mus musculus
tttggcctatgcaggtgtgctgatg

SEQ ID NO: 398344 - DNA, 25 bp, Mus musculus
tttggccttgacaatatcaacatga

SEQ ID NO: 398345 - DNA, 25 bp, Mus musculus
tttggcgaggactagtgttacaggt

SEQ ID NO: 398346 - DNA, 25 bp, Mus musculus
tttggcgcgatgtctcacaccattt

SEQ ID NO: 398347 - DNA, 25 bp, Mus musculus
tttggcgcgatgtgcctgcgacaga

SEQ ID NO: 398348 - DNA, 25 bp, Mus musculus
tttggcggcgaagaggtcctgagtt

SEQ ID NO: 398349 - DNA, 25 bp, Mus musculus
tttggcggcgaagtctcccctcacc

SEQ ID NO: 398350 - DNA, 25 bp, Mus musculus
tttggcggtaccagcccctctcccg

SEQ ID NO: 398351 - DNA, 25 bp, Mus musculus
tttggctatatcaagtttcatgcag

SEQ ID NO: 398352 - DNA, 25 bp, Mus musculus
tttggctatgaagaatgcccatatc

SEQ ID NO: 398353 - DNA, 25 bp, Mus musculus
tttggctatgaagccacattgggat

SEQ ID NO: 398354 - DNA, 25 bp, Mus musculus
tttggctcatcaggaggactgacaa

SEQ ID NO: 398355 - DNA, 25 bp, Mus musculus
tttggctcatcagttggcagttctg

SEQ ID NO: 398356 - DNA, 25 bp, Mus musculus
tttggctccatgaagtacaaaggca

SEQ ID NO: 398357 - DNA, 25 bp, Mus musculus
tttggctccgcagcagaatgccaag

SEQ ID NO: 398358 - DNA, 25 bp, Mus musculus
tttggctcttttacagacctcaaag

SEQ ID NO: 398359 - DNA, 25 bp, Mus musculus
tttggctgaaaggacttctagatct

SEQ ID NO: 398360 - DNA, 25 bp, Mus musculus
tttggctgacaggattgtccggagc

SEQ ID NO: 398361 - DNA, 25 bp, Mus musculus
tttggctgacagtcatgagagccga

SEQ ID NO: 398362 - DNA, 25 bp, Mus musculus
tttggctgccatagcaaaaaagcaa

SEQ ID NO: 398363 - DNA, 25 bp, Mus musculus
tttggctgccataggagtcagtgac

SEQ ID NO: 398364 - DNA, 25 bp, Mus musculus
tttggctgggcagattggccacctg

SEQ ID NO: 398365 - DNA, 25 bp, Mus musculus
tttggctgtaagaaggtgattttaa

SEQ ID NO: 398366 - DNA, 25 bp, Mus musculus
tttggcttcaatactgggcggttgc

SEQ ID NO: 398367 - DNA, 25 bp, Mus musculus
tttggcttcatactttatcttgtgt

SEQ ID NO: 398368 - DNA, 25 bp, Mus musculus
tttggcttccaacatactgcagggt

SEQ ID NO: 398369 - DNA, 25 bp, Mus musculus
tttggcttcctcagcactggagaca

SEQ ID NO: 398370 - DNA, 25 bp, Mus musculus
tttggcttgactgctccttctggcc

SEQ ID NO: 398371 - DNA, 25 bp, Mus musculus
tttggcttgcaaggctaccaaggcc

SEQ ID NO: 398372 - DNA, 25 bp, Mus musculus
tttggctttaagacactggaacggt

SEQ ID NO: 398373 - DNA, 25 bp, Mus musculus
tttggctttatcaggcgttctgtca

SEQ ID NO: 398374 - DNA, 25 bp, Mus musculus
tttggctttatcaggggcgttcaat

SEQ ID NO: 398375 - DNA, 25 bp, Mus musculus
tttggctttcgcagagcagtcctca

SEQ ID NO: 398376 - DNA, 25 bp, Mus musculus
tttggctttcgcagagctgctcttg

SEQ ID NO: 398377 - DNA, 25 bp, Mus musculus
tttggcttttaatgatctagtgaag

SEQ ID NO: 398378 - DNA, 25 bp, Mus musculus
tttgggaaaaggactagcggacatg

SEQ ID NO: 398379 - DNA, 25 bp, Mus musculus
tttgggaaaaggtgatgcctgcttt

SEQ ID NO: 398380 - DNA, 25 bp, Mus musculus
tttgggaaagctggccgaggagttg

SEQ ID NO: 398381 - DNA, 25 bp, Mus musculus
tttgggaaagcttcaccacgaccac

SEQ ID NO: 398382 - DNA, 25 bp, Mus musculus
tttgggaaggattagatctgccacc

SEQ ID NO: 398383 - DNA, 25 bp, Mus musculus
tttgggaagttactccgagatgccg

SEQ ID NO: 398384 - DNA, 25 bp, Mus musculus
tttgggaccggttcggaccatatcc

SEQ ID NO: 398385 - DNA, 25 bp, Mus musculus
tttgggagacagagatcctgaggac

SEQ ID NO: 398386 - DNA, 25 bp, Mus musculus
tttgggagaccgagctcagcagtca

SEQ ID NO: 398387 - DNA, 25 bp, Mus musculus
tttgggagcgggggtccaactgagc

SEQ ID NO: 398388 - DNA, 25 bp, Mus musculus
tttgggaggagagaaggaagaattc

SEQ ID NO: 398389 - DNA, 25 bp, Mus musculus
tttgggagtcaggacacctatatca

SEQ ID NO: 398390 - DNA, 25 bp, Mus musculus
tttgggagttatgcatatcccaaaa

SEQ ID NO: 398391 - DNA, 25 bp, Mus musculus
tttgggatatgtggggacatcagtg

SEQ ID NO: 398392 - DNA, 25 bp, Mus musculus
tttgggatgaagattgtggatgtca

SEQ ID NO: 398393 - DNA, 25 bp, Mus musculus
tttgggatgaaggtgactgtcctgg

SEQ ID NO: 398394 - DNA, 25 bp, Mus musculus
tttgggattttagttctcaaataat

SEQ ID NO: 398395 - DNA, 25 bp, Mus musculus
tttgggattttatcgcatcatattt

SEQ ID NO: 398396 - DNA, 25 bp, Mus musculus
tttgggcacaggaaagccatcacca

SEQ ID NO: 398397 - DNA, 25 bp, Mus musculus
tttgggcacgatgtataccaggtgg

SEQ ID NO: 398398 - DNA, 25 bp, Mus musculus
tttgggcacggactgtcagggcagg

SEQ ID NO: 398399 - DNA, 25 bp, Mus musculus
tttgggcatctgaaggtctgccttg

SEQ ID NO: 398400 - DNA, 25 bp, Mus musculus
tttgggccaaaccaatatattgtgg

SEQ ID NO: 398401 - DNA, 25 bp, Mus musculus
tttgggcctgaatgatatgtttgga

SEQ ID NO: 398402 - DNA, 25 bp, Mus musculus
tttgggcctgaatggctccgtgctc

SEQ ID NO: 398403 - DNA, 25 bp, Mus musculus
tttgggcctgaatgtctcttacaga

SEQ ID NO: 398404 - DNA, 25 bp, Mus musculus
tttgggcctttatggcatctgaacg

SEQ ID NO: 398405 - DNA, 25 bp, Mus musculus
tttgggctgctggcaactatcgaac

SEQ ID NO: 398406 - DNA, 25 bp, Mus musculus
tttgggcttcttgtgtccattgtcc

SEQ ID NO: 398407 - DNA, 25 bp, Mus musculus
tttggggagtctggtaaataagctg

SEQ ID NO: 398408 - DNA, 25 bp, Mus musculus
tttggggatgcccctgcctccctgg

SEQ ID NO: 398409 - DNA, 25 bp, Mus musculus
tttgggggaccagtagttgcagtaa

SEQ ID NO: 398410 - DNA, 25 bp, Mus musculus
tttgggggagacgttcatgggcggt

SEQ ID NO: 398411 - DNA, 25 bp, Mus musculus
tttgggggagactatggtggaaccc

SEQ ID NO: 398412 - DNA, 25 bp, Mus musculus
tttgggggctcgaagggcaggtaaa

SEQ ID NO: 398413 - DNA, 25 bp, Mus musculus
tttggggtattataatattattggc

SEQ ID NO: 398414 - DNA, 25 bp, Mus musculus
tttgggtctcggcaaccaaactgaa

SEQ ID NO: 398415 - DNA, 25 bp, Mus musculus
tttgggtcttctaattgtcaacagt

SEQ ID NO: 398416 - DNA, 25 bp, Mus musculus
tttgggtgcaatgggtgaaagagct

SEQ ID NO: 398417 - DNA, 25 bp, Mus musculus
tttgggttaccgagagcttttgctg

SEQ ID NO: 398418 - DNA, 25 bp, Mus musculus
tttgggtttgcttctcccttccaga

SEQ ID NO: 398419 - DNA, 25 bp, Mus musculus
tttgggttttttctggcgagcggcg

SEQ ID NO: 398420 - DNA, 25 bp, Mus musculus
tttggtaaaagccatggccatgcaa

SEQ ID NO: 398421 - DNA, 25 bp, Mus musculus
tttggtaaaatatcctgcccaaact

SEQ ID NO: 398422 - DNA, 25 bp, Mus musculus
tttggtaaaatatcggatgcccggg

SEQ ID NO: 398423 - DNA, 25 bp, Mus musculus
tttggtaatagaggatctgagaaat

SEQ ID NO: 398424 - DNA, 25 bp, Mus musculus
tttggtagactctggctggaggcgt

SEQ ID NO: 398425 - DNA, 25 bp, Mus musculus
tttggtagagggacagtgtcttggt

SEQ ID NO: 398426 - DNA, 25 bp, Mus musculus
tttggtattcctcagacagtaaaga

SEQ ID NO: 398427 - DNA, 25 bp, Mus musculus
tttggtcacctgagcaagttgttgg

SEQ ID NO: 398428 - DNA, 25 bp, Mus musculus
tttggtcacttgctgagatatgggg

SEQ ID NO: 398429 - DNA, 25 bp, Mus musculus
tttggtcagagaggtgctggtaact

SEQ ID NO: 398430 - DNA, 25 bp, Mus musculus
tttggtcatgaagaagcagaattct

SEQ ID NO: 398431 - DNA, 25 bp, Mus musculus
tttggtcatgaagacatgtttaaaa

SEQ ID NO: 398432 - DNA, 25 bp, Mus musculus
tttggtctctggtggaattgggctt

SEQ ID NO: 398433 - DNA, 25 bp, Mus musculus
tttggtctgaaggacagggtttctc

SEQ ID NO: 398434 - DNA, 25 bp, Mus musculus
tttggtctgtgagcatccctcacga

SEQ ID NO: 398435 - DNA, 25 bp, Mus musculus
tttggtgaaaagtgaagatgccatc

SEQ ID NO: 398436 - DNA, 25 bp, Mus musculus
tttggtgacaggcttccccacctcc

SEQ ID NO: 398437 - DNA, 25 bp, Mus musculus
tttggtgcaacgtttgtgcttgtcc

SEQ ID NO: 398438 - DNA, 25 bp, Mus musculus
tttggtgccacaagccccgcccaac

SEQ ID NO: 398439 - DNA, 25 bp, Mus musculus
tttggtggaatgcatgcagatgtca

SEQ ID NO: 398440 - DNA, 25 bp, Mus musculus
tttggtggcaagcttggcgcccgtg

SEQ ID NO: 398441 - DNA, 25 bp, Mus musculus
tttggtggtggaggaggggaatttg

SEQ ID NO: 398442 - DNA, 25 bp, Mus musculus
tttggtgtcacaggcggcacgtttt

SEQ ID NO: 398443 - DNA, 25 bp, Mus musculus
tttggtgtgctccaggctggacagt

SEQ ID NO: 398444 - DNA, 25 bp, Mus musculus
tttggtgtgtgtgtgtaatagggat

SEQ ID NO: 398445 - DNA, 25 bp, Mus musculus
tttggtgttcccttgccaagaaaca

SEQ ID NO: 398446 - DNA, 25 bp, Mus musculus
tttggttactcagggatgaacaaga

SEQ ID NO: 398447 - DNA, 25 bp, Mus musculus
tttggttagaacaggtccgagtagg

SEQ ID NO: 398448 - DNA, 25 bp, Mus musculus
tttggttataactgacaggtataaa

SEQ ID NO: 398449 - DNA, 25 bp, Mus musculus
tttggttcagagtcttttacatgta

SEQ ID NO: 398450 - DNA, 25 bp, Mus musculus
tttggttcagagttgtcctggggaa

SEQ ID NO: 398451 - DNA, 25 bp, Mus musculus
tttggttcctcaagccccgcccaac

SEQ ID NO: 398452 - DNA, 25 bp, Mus musculus
tttggttccttgagatacgacattt

SEQ ID NO: 398453 - DNA, 25 bp, Mus musculus
tttggttcttcgggcctgtgtgata

SEQ ID NO: 398454 - DNA, 25 bp, Mus musculus
tttggttcttgtttgatactttatg

SEQ ID NO: 398455 - DNA, 25 bp, Mus musculus
tttggttggagcaggtactggcctt

SEQ ID NO: 398456 - DNA, 25 bp, Mus musculus
tttggttggagcaggtggcaaagca

SEQ ID NO: 398457 - DNA, 25 bp, Mus musculus
tttggtttgcgaggctggagcaaaa

SEQ ID NO: 398458 - DNA, 25 bp, Mus musculus
tttggttttcatccaggtggatcgc

SEQ ID NO: 398459 - DNA, 25 bp, Mus musculus
tttggtttttggtgaatgaatataa

SEQ ID NO: 398460 - DNA, 25 bp, Mus musculus
tttgtaaagtttcggaacaaggagc

SEQ ID NO: 398461 - DNA, 25 bp, Mus musculus
tttgtaacagttggatgaaaaatct

SEQ ID NO: 398462 - DNA, 25 bp, Mus musculus
tttgtaaccatgaaaatcagaaaat

SEQ ID NO: 398463 - DNA, 25 bp, Mus musculus
tttgtaatagctgccactgaagctg

SEQ ID NO: 398464 - DNA, 25 bp, Mus musculus
tttgtaatagctgccactgacaaag

SEQ ID NO: 398465 - DNA, 25 bp, Mus musculus
tttgtaatagtgaagcagagccatg

SEQ ID NO: 398466 - DNA, 25 bp, Mus musculus
tttgtaatcagcttggcttaccctt

SEQ ID NO: 398467 - DNA, 25 bp, Mus musculus
tttgtaatctcggattgtaagggcc

SEQ ID NO: 398468 - DNA, 25 bp, Mus musculus
tttgtaatcttgagaaaatgaaaat

SEQ ID NO: 398469 - DNA, 25 bp, Mus musculus
tttgtaatttaaccgcttggctgaa

SEQ ID NO: 398470 - DNA, 25 bp, Mus musculus
tttgtacaaaagccctatagtcgct

SEQ ID NO: 398471 - DNA, 25 bp, Mus musculus
tttgtacaaaaggttgaagaaatgg

SEQ ID NO: 398472 - DNA, 25 bp, Mus musculus
tttgtacaaagggcaatcctgcacg

SEQ ID NO: 398473 - DNA, 25 bp, Mus musculus
tttgtacaaggagggtgacaatagc

SEQ ID NO: 398474 - DNA, 25 bp, Mus musculus
tttgtacacaatgccaaagaagctt

SEQ ID NO: 398475 - DNA, 25 bp, Mus musculus
tttgtacacagcccacttttaggtt

SEQ ID NO: 398476 - DNA, 25 bp, Mus musculus
tttgtaccaggatcttgaaacagga

SEQ ID NO: 398477 - DNA, 25 bp, Mus musculus
tttgtaccaggcaacttgccactcc

SEQ ID NO: 398478 - DNA, 25 bp, Mus musculus
tttgtaccagggggctggtggcatg

SEQ ID NO: 398479 - DNA, 25 bp, Mus musculus
tttgtaccaggttcccaagagttcc

SEQ ID NO: 398480 - DNA, 25 bp, Mus musculus
tttgtaccattgggcagcaagaagg

SEQ ID NO: 398481 - DNA, 25 bp, Mus musculus
tttgtaccccaacaagaatcagcac

SEQ ID NO: 398482 - DNA, 25 bp, Mus musculus
tttgtaccccaacaagacccgtcta

SEQ ID NO: 398483 - DNA, 25 bp, Mus musculus
tttgtaccctatgataaaaactaca

SEQ ID NO: 398484 - DNA, 25 bp, Mus musculus
tttgtaccctatgcatctgcctcta

SEQ ID NO: 398485 - DNA, 25 bp, Mus musculus
tttgtagaaaaggggcatcgtctgc

SEQ ID NO: 398486 - DNA, 25 bp, Mus musculus
tttgtagaactagtccttatcggac

SEQ ID NO: 398487 - DNA, 25 bp, Mus musculus
tttgtagaactatgcattttgcaga

SEQ ID NO: 398488 - DNA, 25 bp, Mus musculus
tttgtagaccaaagcccatggccta

SEQ ID NO: 398489 - DNA, 25 bp, Mus musculus
tttgtagaccaagtggtgtctacca

SEQ ID NO: 398490 - DNA, 25 bp, Mus musculus
tttgtagaggagctccaagtatgtt

SEQ ID NO: 398491 - DNA, 25 bp, Mus musculus
tttgtagcacctgagggatatgatg

SEQ ID NO: 398492 - DNA, 25 bp, Mus musculus
tttgtagcacctgagttctcactca

SEQ ID NO: 398493 - DNA, 25 bp, Mus musculus
tttgtagccatcctcccgccacacc

SEQ ID NO: 398494 - DNA, 25 bp, Mus musculus
tttgtagccgaagcagatccacaac

SEQ ID NO: 398495 - DNA, 25 bp, Mus musculus
tttgtagccggggacgatccggagc

SEQ ID NO: 398496 - DNA, 25 bp, Mus musculus
tttgtagctgggattgacttctaaa

SEQ ID NO: 398497 - DNA, 25 bp, Mus musculus
tttgtagtatttaagaaaagtgaga

SEQ ID NO: 398498 - DNA, 25 bp, Mus musculus
tttgtagtcagtaagctgtggtgta

SEQ ID NO: 398499 - DNA, 25 bp, Mus musculus
tttgtataagagagttctggagtct

SEQ ID NO: 398500 - DNA, 25 bp, Mus musculus
tttgtataaggtactgggaagaata

SEQ ID NO: 398501 - DNA, 25 bp, Mus musculus
tttgtatcgacagttctgtaagcat

SEQ ID NO: 398502 - DNA, 25 bp, Mus musculus
tttgtatcttcgggctcgctgccca

SEQ ID NO: 398503 - DNA, 25 bp, Mus musculus
tttgtatgtataggctgttatgttt

SEQ ID NO: 398504 - DNA, 25 bp, Mus musculus
tttgtattgcagagctgtttgacag

SEQ ID NO: 398505 - DNA, 25 bp, Mus musculus
tttgtattgcagcttctagagctgt

SEQ ID NO: 398506 - DNA, 25 bp, Mus musculus
tttgtcaaagactgccttactaaag

SEQ ID NO: 398507 - DNA, 25 bp, Mus musculus
tttgtcaaagaggtacagcagggtg

SEQ ID NO: 398508 - DNA, 25 bp, Mus musculus
tttgtcaaagatcaattatcatgta

SEQ ID NO: 398509 - DNA, 25 bp, Mus musculus
tttgtcaaagatcatttatcatgta

SEQ ID NO: 398510 - DNA, 25 bp, Mus musculus
tttgtcaaataaaaatccatggagc

SEQ ID NO: 398511 - DNA, 25 bp, Mus musculus
tttgtcaacattcaggagcagagcc

SEQ ID NO: 398512 - DNA, 25 bp, Mus musculus
tttgtcaacattcagtacacactgc

SEQ ID NO: 398513 - DNA, 25 bp, Mus musculus
tttgtcaagggatacctccttccca

SEQ ID NO: 398514 - DNA, 25 bp, Mus musculus
tttgtcaatctggtacaccaggggt

SEQ ID NO: 398515 - DNA, 25 bp, Mus musculus
tttgtcactatgccacagcccaact

SEQ ID NO: 398516 - DNA, 25 bp, Mus musculus
tttgtcactgagaaacgtctcagag

SEQ ID NO: 398517 - DNA, 25 bp, Mus musculus
tttgtcactgagctcctgcttcctg

SEQ ID NO: 398518 - DNA, 25 bp, Mus musculus
tttgtcatcaaaggcctctccctgg

SEQ ID NO: 398519 - DNA, 25 bp, Mus musculus
tttgtcatcaaaggtccagatgttc

SEQ ID NO: 398520 - DNA, 25 bp, Mus musculus
tttgtcatccaggtcttggataaat

SEQ ID NO: 398521 - DNA, 25 bp, Mus musculus
tttgtcatccccgtggccctgttgc

SEQ ID NO: 398522 - DNA, 25 bp, Mus musculus
tttgtccaacagctcctggagcttt

SEQ ID NO: 398523 - DNA, 25 bp, Mus musculus
tttgtccaacagtaatttgtcagat

SEQ ID NO: 398524 - DNA, 25 bp, Mus musculus
tttgtccagagagagaaccttcaca

SEQ ID NO: 398525 - DNA, 25 bp, Mus musculus
tttgtccagcggctcgaggacttct

SEQ ID NO: 398526 - DNA, 25 bp, Mus musculus
tttgtccattctcagcgctgtgtag

SEQ ID NO: 398527 - DNA, 25 bp, Mus musculus
tttgtcccatggccttctttctaga

SEQ ID NO: 398528 - DNA, 25 bp, Mus musculus
tttgtccccgggaggtttcatggga

SEQ ID NO: 398529 - DNA, 25 bp, Mus musculus
tttgtcccgtggcccctctggtttc

SEQ ID NO: 398530 - DNA, 25 bp, Mus musculus
tttgtcccgtgggcccaagaactca

SEQ ID NO: 398531 - DNA, 25 bp, Mus musculus
tttgtccgcagaaatctgtctttca

SEQ ID NO: 398532 - DNA, 25 bp, Mus musculus
tttgtccgcaggaacctgaatgaac

SEQ ID NO: 398533 - DNA, 25 bp, Mus musculus
tttgtccgccagggttcggcagact

SEQ ID NO: 398534 - DNA, 25 bp, Mus musculus
tttgtccgtatgttatatctcaacc

SEQ ID NO: 398535 - DNA, 25 bp, Mus musculus
tttgtcctaagattagcctcacagt

SEQ ID NO: 398536 - DNA, 25 bp, Mus musculus
tttgtcctcaaatcgtcctgcttct

SEQ ID NO: 398537 - DNA, 25 bp, Mus musculus
tttgtcctcagtcaggaggtctccc

SEQ ID NO: 398538 - DNA, 25 bp, Mus musculus
tttgtcctcagtcagtgctggggac

SEQ ID NO: 398539 - DNA, 25 bp, Mus musculus
tttgtcctgggaacagaaattcttt

SEQ ID NO: 398540 - DNA, 25 bp, Mus musculus
tttgtcctggtatgatcccaggctc

SEQ ID NO: 398541 - DNA, 25 bp, Mus musculus
tttgtccttaagtgtgggaacttcg

SEQ ID NO: 398542 - DNA, 25 bp, Mus musculus
tttgtcgaagacggggacattacac

SEQ ID NO: 398543 - DNA, 25 bp, Mus musculus
tttgtcgactggaaggataggtgcg

SEQ ID NO: 398544 - DNA, 25 bp, Mus musculus
tttgtcgagactcagggtgaaatgg

SEQ ID NO: 398545 - DNA, 25 bp, Mus musculus
tttgtcgccagcccgtcccaggtaa

SEQ ID NO: 398546 - DNA, 25 bp, Mus musculus
tttgtcggaggccagttctggtccg

SEQ ID NO: 398547 - DNA, 25 bp, Mus musculus
tttgtcggggacagagtctcggcca

SEQ ID NO: 398548 - DNA, 25 bp, Mus musculus
tttgtcgttcggtgctcgtagctct

SEQ ID NO: 398549 - DNA, 25 bp, Mus musculus
tttgtctacaggcttcctgaagaat

SEQ ID NO: 398550 - DNA, 25 bp, Mus musculus
tttgtctaccagcctcttaaaggtg

SEQ ID NO: 398551 - DNA, 25 bp, Mus musculus
tttgtctaccaggatcctcaggggc

SEQ ID NO: 398552 - DNA, 25 bp, Mus musculus
tttgtctagactggctgttcctgtg

SEQ ID NO: 398553 - DNA, 25 bp, Mus musculus
tttgtctgcaaggaatggaccgggt

SEQ ID NO: 398554 - DNA, 25 bp, Mus musculus
tttgtctgcaaggatctctcctcac

SEQ ID NO: 398555 - DNA, 25 bp, Mus musculus
tttgtctgccagactgtcattgaag

SEQ ID NO: 398556 - DNA, 25 bp, Mus musculus
tttgtctgctccctggtggttctct

SEQ ID NO: 398557 - DNA, 25 bp, Mus musculus
tttgtctttaaggtctctaatagat

SEQ ID NO: 398558 - DNA, 25 bp, Mus musculus
tttgtctttaaggtggtgctgatcg

SEQ ID NO: 398559 - DNA, 25 bp, Mus musculus
tttgtcttttgcaatcaaagttcta

SEQ ID NO: 398560 - DNA, 25 bp, Mus musculus
tttgtcttttgcaattagaagatgg

SEQ ID NO: 398561 - DNA, 25 bp, Mus musculus
tttgtgaaaggcactgaagatccac

SEQ ID NO: 398562 - DNA, 25 bp, Mus musculus
tttgtgaacaagggttcccgagaga

SEQ ID NO: 398563 - DNA, 25 bp, Mus musculus
tttgtgaaccaaggaattcatccta

SEQ ID NO: 398564 - DNA, 25 bp, Mus musculus
tttgtgaagcagaagtacctggact

SEQ ID NO: 398565 - DNA, 25 bp, Mus musculus
tttgtgaagctccgttttgttcagt

SEQ ID NO: 398566 - DNA, 25 bp, Mus musculus
tttgtgaaggaaggactccaccgct

SEQ ID NO: 398567 - DNA, 25 bp, Mus musculus
tttgtgaataaatgtctcattaaga

SEQ ID NO: 398568 - DNA, 25 bp, Mus musculus
tttgtgaatggctgcttattggatc

SEQ ID NO: 398569 - DNA, 25 bp, Mus musculus
tttgtgacaaagcccaatggcgcgc

SEQ ID NO: 398570 - DNA, 25 bp, Mus musculus
tttgtgacctcgtactagaagacac

SEQ ID NO: 398571 - DNA, 25 bp, Mus musculus
tttgtgacgcgggatggtcactcgg

SEQ ID NO: 398572 - DNA, 25 bp, Mus musculus
tttgtgagactcgccccacccatcc

SEQ ID NO: 398573 - DNA, 25 bp, Mus musculus
tttgtgagagaggctgtccgtacct

SEQ ID NO: 398574 - DNA, 25 bp, Mus musculus
tttgtgagagagttataaaagatga

SEQ ID NO: 398575 - DNA, 25 bp, Mus musculus
tttgtgagcagaacatgttactaag

SEQ ID NO: 398576 - DNA, 25 bp, Mus musculus
tttgtgagcaggtgtccacaaagtg

SEQ ID NO: 398577 - DNA, 25 bp, Mus musculus
tttgtgagcctgccgctcatgctgt

SEQ ID NO: 398578 - DNA, 25 bp, Mus musculus
tttgtgagcctgtttgtgggctgtc

SEQ ID NO: 398579 - DNA, 25 bp, Mus musculus
tttgtgaggcgaacattgaggcttg

SEQ ID NO: 398580 - DNA, 25 bp, Mus musculus
tttgtgagtgaagatagtttaggtc

SEQ ID NO: 398581 - DNA, 25 bp, Mus musculus
tttgtgagtgaagatgatcgtaata

SEQ ID NO: 398582 - DNA, 25 bp, Mus musculus
tttgtgagtgtgagagcccgctgtg

SEQ ID NO: 398583 - DNA, 25 bp, Mus musculus
tttgtgagtttgatgcagcctacca

SEQ ID NO: 398584 - DNA, 25 bp, Mus musculus
tttgtgagtttgtctttggaggcct

SEQ ID NO: 398585 - DNA, 25 bp, Mus musculus
tttgtgatacacaagacatttcgac

SEQ ID NO: 398586 - DNA, 25 bp, Mus musculus
tttgtgatatgatgagaaaaccaag

SEQ ID NO: 398587 - DNA, 25 bp, Mus musculus
tttgtgatgcaggagactgacggtt

SEQ ID NO: 398588 - DNA, 25 bp, Mus musculus
tttgtgcacaaggtggtccgagaca

SEQ ID NO: 398589 - DNA, 25 bp, Mus musculus
tttgtgcagagattaagcacatgat

SEQ ID NO: 398590 - DNA, 25 bp, Mus musculus
tttgtgcatgctagatgtgaaacat

SEQ ID NO: 398591 - DNA, 25 bp, Mus musculus
tttgtgccgcaggtcgagatttcag

SEQ ID NO: 398592 - DNA, 25 bp, Mus musculus
tttgtgcgagacggcccccttgaga

SEQ ID NO: 398593 - DNA, 25 bp, Mus musculus
tttgtgctcatccagatctgcaacg

SEQ ID NO: 398594 - DNA, 25 bp, Mus musculus
tttgtgctccacggggaggcacacg

SEQ ID NO: 398595 - DNA, 25 bp, Mus musculus
tttgtgctcgattacgctcgatttg

SEQ ID NO: 398596 - DNA, 25 bp, Mus musculus
tttgtgctctctaagggccatgcag

SEQ ID NO: 398597 - DNA, 25 bp, Mus musculus
tttgtgctgactgagctcggattgg

SEQ ID NO: 398598 - DNA, 25 bp, Mus musculus
tttgtggaaagattgagttcaggag

SEQ ID NO: 398599 - DNA, 25 bp, Mus musculus
tttgtggaacaagtgcgcatctgta

SEQ ID NO: 398600 - DNA, 25 bp, Mus musculus
tttgtggaacacgaagccctgcaga

SEQ ID NO: 398601 - DNA, 25 bp, Mus musculus
tttgtggaacacgctgtcttcagac

SEQ ID NO: 398602 - DNA, 25 bp, Mus musculus
tttgtggaagagagtccagaaaacc

SEQ ID NO: 398603 - DNA, 25 bp, Mus musculus
tttgtggaagcgatggtgaatgaga

SEQ ID NO: 398604 - DNA, 25 bp, Mus musculus
tttgtggacaggttggtttaatgaa

SEQ ID NO: 398605 - DNA, 25 bp, Mus musculus
tttgtggacagtatttttgaacaat

SEQ ID NO: 398606 - DNA, 25 bp, Mus musculus
tttgtggcagtcttcccaggccaag

SEQ ID NO: 398607 - DNA, 25 bp, Mus musculus
tttgtggcagtctttcagccaactc

SEQ ID NO: 398608 - DNA, 25 bp, Mus musculus
tttgtggccacacaggatcagaact

SEQ ID NO: 398609 - DNA, 25 bp, Mus musculus
tttgtggcccagcatgacaacgagt

SEQ ID NO: 398610 - DNA, 25 bp, Mus musculus
tttgtggcccaggatgacaacgagt

SEQ ID NO: 398611 - DNA, 25 bp, Mus musculus
tttgtggcggacgtgacttgtagct

SEQ ID NO: 398612 - DNA, 25 bp, Mus musculus
tttgtggggtcagggggactatgta

SEQ ID NO: 398613 - DNA, 25 bp, Mus musculus
tttgtggttaataatgcagctgtgt

SEQ ID NO: 398614 - DNA, 25 bp, Mus musculus
tttgtgtgctcgaaaattggagttt

SEQ ID NO: 398615 - DNA, 25 bp, Mus musculus
tttgtgtggttcatttttataagtt

SEQ ID NO: 398616 - DNA, 25 bp, Mus musculus
tttgtgttaaggcctcacaccttga

SEQ ID NO: 398617 - DNA, 25 bp, Mus musculus
tttgtgttacagctgccctatcccc

SEQ ID NO: 398618 - DNA, 25 bp, Mus musculus
tttgtgttgaaggtgcaggaccaga

SEQ ID NO: 398619 - DNA, 25 bp, Mus musculus
tttgtgtttaaggaatcaaaagtca

SEQ ID NO: 398620 - DNA, 25 bp, Mus musculus
tttgttaaaggctgatgaaccaatt

SEQ ID NO: 398621 - DNA, 25 bp, Mus musculus
tttgttaacatgagctttctgctca

SEQ ID NO: 398622 - DNA, 25 bp, Mus musculus
tttgttaacatgaggtctatccagg

SEQ ID NO: 398623 - DNA, 25 bp, Mus musculus
tttgttaaggtctggctcagtttat

SEQ ID NO: 398624 - DNA, 25 bp, Mus musculus
tttgttacagactagcttcctttta

SEQ ID NO: 398625 - DNA, 25 bp, Mus musculus
tttgttaccttgctgtatcgacatg

SEQ ID NO: 398626 - DNA, 25 bp, Mus musculus
tttgttaccttgttgtctctgcttc

SEQ ID NO: 398627 - DNA, 25 bp, Mus musculus
tttgttactaggattgaaattccaa

SEQ ID NO: 398628 - DNA, 25 bp, Mus musculus
tttgttagtgagctgctggaagctc

SEQ ID NO: 398629 - DNA, 25 bp, Mus musculus
tttgttatgccagtcaggatttgca

SEQ ID NO: 398630 - DNA, 25 bp, Mus musculus
tttgttattgatgctgtaagaacta

SEQ ID NO: 398631 - DNA, 25 bp, Mus musculus
tttgttcagaacgatcatccagccc

SEQ ID NO: 398632 - DNA, 25 bp, Mus musculus
tttgttcagtcgggctctaagcaat

SEQ ID NO: 398633 - DNA, 25 bp, Mus musculus
tttgttcagtcggtttccgtgagag

SEQ ID NO: 398634 - DNA, 25 bp, Mus musculus
tttgttcccaggcaaattccatcaa

SEQ ID NO: 398635 - DNA, 25 bp, Mus musculus
tttgttcccattccttcaaaaagag

SEQ ID NO: 398636 - DNA, 25 bp, Mus musculus
tttgttccgtgagggaaaagaagac

SEQ ID NO: 398637 - DNA, 25 bp, Mus musculus
tttgttcctggggcctgtgttttat

SEQ ID NO: 398638 - DNA, 25 bp, Mus musculus
tttgttcgaataaatgctgctcatg

SEQ ID NO: 398639 - DNA, 25 bp, Mus musculus
tttgttcgtggaggtggagcctact

SEQ ID NO: 398640 - DNA, 25 bp, Mus musculus
tttgttctacaagctgactcatcat

SEQ ID NO: 398641 - DNA, 25 bp, Mus musculus
tttgttctccaatgttgtatgtgct

SEQ ID NO: 398642 - DNA, 25 bp, Mus musculus
tttgttctcgagcaggttagccagt

SEQ ID NO: 398643 - DNA, 25 bp, Mus musculus
tttgttctcgttcaggttagccagt

SEQ ID NO: 398644 - DNA, 25 bp, Mus musculus
tttgttctcttccatatgaggaaac

SEQ ID NO: 398645 - DNA, 25 bp, Mus musculus
tttgttctgaggtgacgccatctgg

SEQ ID NO: 398646 - DNA, 25 bp, Mus musculus
tttgttcttaaggatacagaggaag

SEQ ID NO: 398647 - DNA, 25 bp, Mus musculus
tttgttcttaagtggccaaatgtaa

SEQ ID NO: 398648 - DNA, 25 bp, Mus musculus
tttgttctttaagatcgctccagtg

SEQ ID NO: 398649 - DNA, 25 bp, Mus musculus
tttgttctttaaggatcctatgtag

SEQ ID NO: 398650 - DNA, 25 bp, Mus musculus
tttgttgaattctatgccccttggt

SEQ ID NO: 398651 - DNA, 25 bp, Mus musculus
tttgttgcctcagatttcttgacct

SEQ ID NO: 398652 - DNA, 25 bp, Mus musculus
tttgttgcttagcctcctgtaccct

SEQ ID NO: 398653 - DNA, 25 bp, Mus musculus
tttgttgcttaggattccctgcaca

SEQ ID NO: 398654 - DNA, 25 bp, Mus musculus
tttgttgctttcccagcactatggt

SEQ ID NO: 398655 - DNA, 25 bp, Mus musculus
tttgttggacagatgcaccaacaag

SEQ ID NO: 398656 - DNA, 25 bp, Mus musculus
tttgttggaggtccagatggccata

SEQ ID NO: 398657 - DNA, 25 bp, Mus musculus
tttgttggagtaatggccttattca

SEQ ID NO: 398658 - DNA, 25 bp, Mus musculus
tttgttggcaaagctagatctttca

SEQ ID NO: 398659 - DNA, 25 bp, Mus musculus
tttgttggcaaagctgacaaaccaa

SEQ ID NO: 398660 - DNA, 25 bp, Mus musculus
tttgttggcaaagcttcttcagctg

SEQ ID NO: 398661 - DNA, 25 bp, Mus musculus
tttgttggcaaaggtgactccaatg

SEQ ID NO: 398662 - DNA, 25 bp, Mus musculus
tttgttgggtatcagatgttcatct

SEQ ID NO: 398663 - DNA, 25 bp, Mus musculus
tttgttggtttccagcccgtccttt

SEQ ID NO: 398664 - DNA, 25 bp, Mus musculus
tttgttgttaaagctcccaagctgt

SEQ ID NO: 398665 - DNA, 25 bp, Mus musculus
tttgttgttcagagattgacggcgg

SEQ ID NO: 398666 - DNA, 25 bp, Mus musculus
tttgttgttcagagccaccagtggt

SEQ ID NO: 398667 - DNA, 25 bp, Mus musculus
tttgtttacctaggtgcctatgatc

SEQ ID NO: 398668 - DNA, 25 bp, Mus musculus
tttgtttatctagactaaaacaaag

SEQ ID NO: 398669 - DNA, 25 bp, Mus musculus
tttgtttatctaggtgcctatgacc
